United States Patent 7,314,750 (ADDRESSABLE OLIGONUCLEOTIDE ARRAY OF THE RAT GENOME) - sequence listing, part 4

SEQ ID NO: 113235 - DNA, 25 bp, Rattus norvegicus
agagatgtttctacctgagcctcaa

SEQ ID NO: 113236 - DNA, 25 bp, Rattus norvegicus
agagatgtttcttcctgagcctcaa

SEQ ID NO: 113237 - DNA, 25 bp, Rattus norvegicus
agagatgtttgtctgcagcctcaaa

SEQ ID NO: 113238 - DNA, 25 bp, Rattus norvegicus
agagatgtttgtgtgcagcctcaaa

SEQ ID NO: 113239 - DNA, 25 bp, Rattus norvegicus
agagattaaaggcaacaggccagct

SEQ ID NO: 113240 - DNA, 25 bp, Rattus norvegicus
agagattaaagggaacaggccagct

SEQ ID NO: 113241 - DNA, 25 bp, Rattus norvegicus
agagattcaccaccttgcattgctg

SEQ ID NO: 113242 - DNA, 25 bp, Rattus norvegicus
agagattcaccagcttgcattgctg

SEQ ID NO: 113243 - DNA, 25 bp, Rattus norvegicus
agagattcagtcattcctggttccc

SEQ ID NO: 113244 - DNA, 25 bp, Rattus norvegicus
agagattcagtctttcctggttccc

SEQ ID NO: 113245 - DNA, 25 bp, Rattus norvegicus
agagattccattactgcagcacttg

SEQ ID NO: 113246 - DNA, 25 bp, Rattus norvegicus
agagattccatttctgcagcacttg

SEQ ID NO: 113247 - DNA, 25 bp, Rattus norvegicus
agagattccgcacatcatgtcggga

SEQ ID NO: 113248 - DNA, 25 bp, Rattus norvegicus
agagattccgcagatcatgtcggga

SEQ ID NO: 113249 - DNA, 25 bp, Rattus norvegicus
agagattctcctcagtcacgtcaga

SEQ ID NO: 113250 - DNA, 25 bp, Rattus norvegicus
agagattctcctgagtcacgtcaga

SEQ ID NO: 113251 - DNA, 25 bp, Rattus norvegicus
agagattctcttaccatttctcacc

SEQ ID NO: 113252 - DNA, 25 bp, Rattus norvegicus
agagattctctttccatttctcacc

SEQ ID NO: 113253 - DNA, 25 bp, Rattus norvegicus
agagattgacctactggacatccga

SEQ ID NO: 113254 - DNA, 25 bp, Rattus norvegicus
agagattgaccttctggacatccga

SEQ ID NO: 113255 - DNA, 25 bp, Rattus norvegicus
agagattgacgcacaccttgtggct

SEQ ID NO: 113256 - DNA, 25 bp, Rattus norvegicus
agagattgacgctcaccttgtggct

SEQ ID NO: 113257 - DNA, 25 bp, Rattus norvegicus
agagattgagacagtgaggaaccac

SEQ ID NO: 113258 - DNA, 25 bp, Rattus norvegicus
agagattgagactgtgaggaaccac

SEQ ID NO: 113259 - DNA, 25 bp, Rattus norvegicus
agagattgaggcaccttgcgcgctc

SEQ ID NO: 113260 - DNA, 25 bp, Rattus norvegicus
agagattgaggcatccggtttcaga

SEQ ID NO: 113261 - DNA, 25 bp, Rattus norvegicus
agagattgaggctccttgcgcgctc

SEQ ID NO: 113262 - DNA, 25 bp, Rattus norvegicus
agagattgaggcttccggtttcaga

SEQ ID NO: 113263 - DNA, 25 bp, Rattus norvegicus
agagattgcagcctgaacgtcgcac

SEQ ID NO: 113264 - DNA, 25 bp, Rattus norvegicus
agagattgcagcgtgaacgtcgcac

SEQ ID NO: 113265 - DNA, 25 bp, Rattus norvegicus
agagattgcgaaaggccggagtccc

SEQ ID NO: 113266 - DNA, 25 bp, Rattus norvegicus
agagattgcgaatggccggagtccc

SEQ ID NO: 113267 - DNA, 25 bp, Rattus norvegicus
agagattgcttgattcagccagaaa

SEQ ID NO: 113268 - DNA, 25 bp, Rattus norvegicus
agagattgcttgtttcagccagaaa

SEQ ID NO: 113269 - DNA, 25 bp, Rattus norvegicus
agagatttaagtccagctcctcctc

SEQ ID NO: 113270 - DNA, 25 bp, Rattus norvegicus
agagatttaagtgcagctcctcctc

SEQ ID NO: 113271 - DNA, 25 bp, Rattus norvegicus
agagatttagacaatgccacccctg

SEQ ID NO: 113272 - DNA, 25 bp, Rattus norvegicus
agagatttagactatgccacccctg

SEQ ID NO: 113273 - DNA, 25 bp, Rattus norvegicus
agagatttagctccgttttagagat

SEQ ID NO: 113274 - DNA, 25 bp, Rattus norvegicus
agagatttagctgcgttttagagat

SEQ ID NO: 113275 - DNA, 25 bp, Rattus norvegicus
agagatttagttccttgtcatacaa

SEQ ID NO: 113276 - DNA, 25 bp, Rattus norvegicus
agagatttagttgcttgtcatacaa

SEQ ID NO: 113277 - DNA, 25 bp, Rattus norvegicus
agagatttatccctggtccccagca

SEQ ID NO: 113278 - DNA, 25 bp, Rattus norvegicus
agagatttatccgtggtccccagca

SEQ ID NO: 113279 - DNA, 25 bp, Rattus norvegicus
agagatttcagaaggccctcaacgg

SEQ ID NO: 113280 - DNA, 25 bp, Rattus norvegicus
agagatttcagatggccctcaacgg

SEQ ID NO: 113281 - DNA, 25 bp, Rattus norvegicus
agagatttccacagttcatcctcct

SEQ ID NO: 113282 - DNA, 25 bp, Rattus norvegicus
agagatttccactgttcatcctcct

SEQ ID NO: 113283 - DNA, 25 bp, Rattus norvegicus
agagatttccagcagcgtcgacagt

SEQ ID NO: 113284 - DNA, 25 bp, Rattus norvegicus
agagatttccaggagcgtcgacagt

SEQ ID NO: 113285 - DNA, 25 bp, Rattus norvegicus
agagatttcgaaccagcctctcagc

SEQ ID NO: 113286 - DNA, 25 bp, Rattus norvegicus
agagatttcgaagcagcctctcagc

SEQ ID NO: 113287 - DNA, 25 bp, Rattus norvegicus
agagatttcgtcattccttctgtga

SEQ ID NO: 113288 - DNA, 25 bp, Rattus norvegicus
agagatttcgtctttccttctgtga

SEQ ID NO: 113289 - DNA, 25 bp, Rattus norvegicus
agagatttgaccacctctgctcttg

SEQ ID NO: 113290 - DNA, 25 bp, Rattus norvegicus
agagatttgacctcctctgctcttg

SEQ ID NO: 113291 - DNA, 25 bp, Rattus norvegicus
agagatttgtacacaggcaagtgcc

SEQ ID NO: 113292 - DNA, 25 bp, Rattus norvegicus
agagatttgtactcaggcaagtgcc

SEQ ID NO: 113293 - DNA, 25 bp, Rattus norvegicus
agagattttaatccaatgccttgta

SEQ ID NO: 113294 - DNA, 25 bp, Rattus norvegicus
agagattttaatgcaatgccttgta

SEQ ID NO: 113295 - DNA, 25 bp, Rattus norvegicus
agagattttgtcctaccgatggtgt

SEQ ID NO: 113296 - DNA, 25 bp, Rattus norvegicus
agagattttgtcgtaccgatggtgt

SEQ ID NO: 113297 - DNA, 25 bp, Rattus norvegicus
agagatttttatccggtactccaca

SEQ ID NO: 113298 - DNA, 25 bp, Rattus norvegicus
agagatttttatgcggtactccaca

SEQ ID NO: 113299 - DNA, 25 bp, Rattus norvegicus
agagatttttgtctgaccacccgta

SEQ ID NO: 113300 - DNA, 25 bp, Rattus norvegicus
agagatttttgtgtgaccacccgta

SEQ ID NO: 113301 - DNA, 25 bp, Rattus norvegicus
agagcaaaaactccgcccttacgta

SEQ ID NO: 113302 - DNA, 25 bp, Rattus norvegicus
agagcaaaaactgcgcccttacgta

SEQ ID NO: 113303 - DNA, 25 bp, Rattus norvegicus
agagcaaaattcctctcgacttccc

SEQ ID NO: 113304 - DNA, 25 bp, Rattus norvegicus
agagcaaaattcgtctcgacttccc

SEQ ID NO: 113305 - DNA, 25 bp, Rattus norvegicus
agagcaaacacccacaggcttgagg

SEQ ID NO: 113306 - DNA, 25 bp, Rattus norvegicus
agagcaaacaccgacaggcttgagg

SEQ ID NO: 113307 - DNA, 25 bp, Rattus norvegicus
agagcaaacagcatttcacggcctt

SEQ ID NO: 113308 - DNA, 25 bp, Rattus norvegicus
agagcaaacagcttttcacggcctt

SEQ ID NO: 113309 - DNA, 25 bp, Rattus norvegicus
agagcaaactcacgccaggtaacag

SEQ ID NO: 113310 - DNA, 25 bp, Rattus norvegicus
agagcaaactcaggccaggtaacag

SEQ ID NO: 113311 - DNA, 25 bp, Rattus norvegicus
agagcaaacttcactctggcactgg

SEQ ID NO: 113312 - DNA, 25 bp, Rattus norvegicus
agagcaaacttctctctggcactgg

SEQ ID NO: 113313 - DNA, 25 bp, Rattus norvegicus
agagcaaagaatacccatctccctg

SEQ ID NO: 113314 - DNA, 25 bp, Rattus norvegicus
agagcaaagaattcccatctccctg

SEQ ID NO: 113315 - DNA, 25 bp, Rattus norvegicus
agagcaaagcagcagcaccggcgtt

SEQ ID NO: 113316 - DNA, 25 bp, Rattus norvegicus
agagcaaagcaggagcaccggcgtt

SEQ ID NO: 113317 - DNA, 25 bp, Rattus norvegicus
agagcaaagctgacatacagagcaa

SEQ ID NO: 113318 - DNA, 25 bp, Rattus norvegicus
agagcaaagctgctccccaaatcct

SEQ ID NO: 113319 - DNA, 25 bp, Rattus norvegicus
agagcaaagctggtccccaaatcct

SEQ ID NO: 113320 - DNA, 25 bp, Rattus norvegicus
agagcaaagctgtcatacagagcaa

SEQ ID NO: 113321 - DNA, 25 bp, Rattus norvegicus
agagcaaattcgcagcattcttccc

SEQ ID NO: 113322 - DNA, 25 bp, Rattus norvegicus
agagcaaattcggagcattcttccc

SEQ ID NO: 113323 - DNA, 25 bp, Rattus norvegicus
agagcaacagcacggtcttcaccgt

SEQ ID NO: 113324 - DNA, 25 bp, Rattus norvegicus
agagcaacagcagggtcttcaccgt

SEQ ID NO: 113325 - DNA, 25 bp, Rattus norvegicus
agagcaacagccaacttctgcaggg

SEQ ID NO: 113326 - DNA, 25 bp, Rattus norvegicus
agagcaacagcctacttctgcaggg

SEQ ID NO: 113327 - DNA, 25 bp, Rattus norvegicus
agagcaaccctaccttgaacgagta

SEQ ID NO: 113328 - DNA, 25 bp, Rattus norvegicus
agagcaaccctagcttgaacgagta

SEQ ID NO: 113329 - DNA, 25 bp, Rattus norvegicus
agagcaaccctcaaaacacagaatg

SEQ ID NO: 113330 - DNA, 25 bp, Rattus norvegicus
agagcaaccctcatgaacggtgcac

SEQ ID NO: 113331 - DNA, 25 bp, Rattus norvegicus
agagcaaccctctaaacacagaatg

SEQ ID NO: 113332 - DNA, 25 bp, Rattus norvegicus
agagcaaccctcttgaacggtgcac

SEQ ID NO: 113333 - DNA, 25 bp, Rattus norvegicus
agagcaacgggcattggcttcttga

SEQ ID NO: 113334 - DNA, 25 bp, Rattus norvegicus
agagcaacgggctttggcttcttga

SEQ ID NO: 113335 - DNA, 25 bp, Rattus norvegicus
agagcaactcataccacgctattta

SEQ ID NO: 113336 - DNA, 25 bp, Rattus norvegicus
agagcaactcattccacgctattta

SEQ ID NO: 113337 - DNA, 25 bp, Rattus norvegicus
agagcaactgctatattcgcaccgc

SEQ ID NO: 113338 - DNA, 25 bp, Rattus norvegicus
agagcaactgctttattcgcaccgc

SEQ ID NO: 113339 - DNA, 25 bp, Rattus norvegicus
agagcaacttcgcacgttggcggta

SEQ ID NO: 113340 - DNA, 25 bp, Rattus norvegicus
agagcaacttcggacgttggcggta

SEQ ID NO: 113341 - DNA, 25 bp, Rattus norvegicus
agagcaagaattcttgccccgctac

SEQ ID NO: 113342 - DNA, 25 bp, Rattus norvegicus
agagcaagaattgttgccccgctac

SEQ ID NO: 113343 - DNA, 25 bp, Rattus norvegicus
agagcaagcaagagccaaccggcat

SEQ ID NO: 113344 - DNA, 25 bp, Rattus norvegicus
agagcaagcaagtgccaaccggcat

SEQ ID NO: 113345 - DNA, 25 bp, Rattus norvegicus
agagcaagcattacagcgcctacaa

SEQ ID NO: 113346 - DNA, 25 bp, Rattus norvegicus
agagcaagcatttcagcgcctacaa

SEQ ID NO: 113347 - DNA, 25 bp, Rattus norvegicus
agagcaagcggccaagattcccact

SEQ ID NO: 113348 - DNA, 25 bp, Rattus norvegicus
agagcaagcggcgaagattcccact

SEQ ID NO: 113349 - DNA, 25 bp, Rattus norvegicus
agagcaagctctacccagtctattt

SEQ ID NO: 113350 - DNA, 25 bp, Rattus norvegicus
agagcaagctcttcccagtctattt

SEQ ID NO: 113351 - DNA, 25 bp, Rattus norvegicus
agagcaagctgcatcgtgagctagt

SEQ ID NO: 113352 - DNA, 25 bp, Rattus norvegicus
agagcaagctgcttcgtgagctagt

SEQ ID NO: 113353 - DNA, 25 bp, Rattus norvegicus
agagcaaggctgactctggtgagca

SEQ ID NO: 113354 - DNA, 25 bp, Rattus norvegicus
agagcaaggctgtctctggtgagca

SEQ ID NO: 113355 - DNA, 25 bp, Rattus norvegicus
agagcaaggtccagctgagcagcac

SEQ ID NO: 113356 - DNA, 25 bp, Rattus norvegicus
agagcaaggtcctgctgagcagcac

SEQ ID NO: 113357 - DNA, 25 bp, Rattus norvegicus
agagcaagtctgaccaagtctcctt

SEQ ID NO: 113358 - DNA, 25 bp, Rattus norvegicus
agagcaagtctgagtcgcatgtccc

SEQ ID NO: 113359 - DNA, 25 bp, Rattus norvegicus
agagcaagtctgtccaagtctcctt

SEQ ID NO: 113360 - DNA, 25 bp, Rattus norvegicus
agagcaagtctgtgtcgcatgtccc

SEQ ID NO: 113361 - DNA, 25 bp, Rattus norvegicus
agagcaagtgttacaccctctgatg

SEQ ID NO: 113362 - DNA, 25 bp, Rattus norvegicus
agagcaagtgtttcaccctctgatg

SEQ ID NO: 113363 - DNA, 25 bp, Rattus norvegicus
agagcaagttctccttcagctttcc

SEQ ID NO: 113364 - DNA, 25 bp, Rattus norvegicus
agagcaagttctgcttcagctttcc

SEQ ID NO: 113365 - DNA, 25 bp, Rattus norvegicus
agagcacaacctagccaattacatg

SEQ ID NO: 113366 - DNA, 25 bp, Rattus norvegicus
agagcacaaccttgccaattacatg

SEQ ID NO: 113367 - DNA, 25 bp, Rattus norvegicus
agagcacaacgtaaagggtcgtaca

SEQ ID NO: 113368 - DNA, 25 bp, Rattus norvegicus
agagcacaacgtctgtctcctggga

SEQ ID NO: 113369 - DNA, 25 bp, Rattus norvegicus
agagcacaacgtgtgtctcctggga

SEQ ID NO: 113370 - DNA, 25 bp, Rattus norvegicus
agagcacaacgttaagggtcgtaca

SEQ ID NO: 113371 - DNA, 25 bp, Rattus norvegicus
agagcacaagatcgagcgccctttc

SEQ ID NO: 113372 - DNA, 25 bp, Rattus norvegicus
agagcacaagatggagcgccctttc

SEQ ID NO: 113373 - DNA, 25 bp, Rattus norvegicus
agagcacaagctacctgaaccacag

SEQ ID NO: 113374 - DNA, 25 bp, Rattus norvegicus
agagcacaagcttcctgaaccacag

SEQ ID NO: 113375 - DNA, 25 bp, Rattus norvegicus
agagcacaaggacttctcgccagag

SEQ ID NO: 113376 - DNA, 25 bp, Rattus norvegicus
agagcacaaggagttctcgccagag

SEQ ID NO: 113377 - DNA, 25 bp, Rattus norvegicus
agagcacacatcacggcacatagga

SEQ ID NO: 113378 - DNA, 25 bp, Rattus norvegicus
agagcacacatctcggcacatagga

SEQ ID NO: 113379 - DNA, 25 bp, Rattus norvegicus
agagcacacccaaggcttcaagcat

SEQ ID NO: 113380 - DNA, 25 bp, Rattus norvegicus
agagcacacccatggcttcaagcat

SEQ ID NO: 113381 - DNA, 25 bp, Rattus norvegicus
agagcacacggaccacctaatctgc

SEQ ID NO: 113382 - DNA, 25 bp, Rattus norvegicus
agagcacacggagcacctaatctgc

SEQ ID NO: 113383 - DNA, 25 bp, Rattus norvegicus
agagcacactagataattccttttg

SEQ ID NO: 113384 - DNA, 25 bp, Rattus norvegicus
agagcacactagttaattccttttg

SEQ ID NO: 113385 - DNA, 25 bp, Rattus norvegicus
agagcacactgaatctggctggcgc

SEQ ID NO: 113386 - DNA, 25 bp, Rattus norvegicus
agagcacactgacagataccccaag

SEQ ID NO: 113387 - DNA, 25 bp, Rattus norvegicus
agagcacactgagagataccccaag

SEQ ID NO: 113388 - DNA, 25 bp, Rattus norvegicus
agagcacactgattctggctggcgc

SEQ ID NO: 113389 - DNA, 25 bp, Rattus norvegicus
agagcacacttgagaaccacacatg

SEQ ID NO: 113390 - DNA, 25 bp, Rattus norvegicus
agagcacacttgtgaaccacacatg

SEQ ID NO: 113391 - DNA, 25 bp, Rattus norvegicus
agagcacagcacagtgtctgcctgc

SEQ ID NO: 113392 - DNA, 25 bp, Rattus norvegicus
agagcacagcactgtgtctgcctgc

SEQ ID NO: 113393 - DNA, 25 bp, Rattus norvegicus
agagcacagcagatggttgtccatt

SEQ ID NO: 113394 - DNA, 25 bp, Rattus norvegicus
agagcacagcagttggttgtccatt

SEQ ID NO: 113395 - DNA, 25 bp, Rattus norvegicus
agagcacagcctctcaaggccaaag

SEQ ID NO: 113396 - DNA, 25 bp, Rattus norvegicus
agagcacagcctgtcaaggccaaag

SEQ ID NO: 113397 - DNA, 25 bp, Rattus norvegicus
agagcacagcgcagcacataaagct

SEQ ID NO: 113398 - DNA, 25 bp, Rattus norvegicus
agagcacagcgctgcacataaagct

SEQ ID NO: 113399 - DNA, 25 bp, Rattus norvegicus
agagcacagctaagaccttaggcct

SEQ ID NO: 113400 - DNA, 25 bp, Rattus norvegicus
agagcacagctatgaccttaggcct

SEQ ID NO: 113401 - DNA, 25 bp, Rattus norvegicus
agagcacaggccagtactttgacca

SEQ ID NO: 113402 - DNA, 25 bp, Rattus norvegicus
agagcacaggcctgtactttgacca

SEQ ID NO: 113403 - DNA, 25 bp, Rattus norvegicus
agagcacaggctctgggaacgttcc

SEQ ID NO: 113404 - DNA, 25 bp, Rattus norvegicus
agagcacaggctgtgggaacgttcc

SEQ ID NO: 113405 - DNA, 25 bp, Rattus norvegicus
agagcacatacacaggacgacttgt

SEQ ID NO: 113406 - DNA, 25 bp, Rattus norvegicus
agagcacatacagaggacgacttgt

SEQ ID NO: 113407 - DNA, 25 bp, Rattus norvegicus
agagcacatccacgccatcggcaag

SEQ ID NO: 113408 - DNA, 25 bp, Rattus norvegicus
agagcacatccaggccatcggcaag

SEQ ID NO: 113409 - DNA, 25 bp, Rattus norvegicus
agagcacatggaaagcagccccaga

SEQ ID NO: 113410 - DNA, 25 bp, Rattus norvegicus
agagcacatggatagcagccccaga

SEQ ID NO: 113411 - DNA, 25 bp, Rattus norvegicus
agagcacatttcactaggctggata

SEQ ID NO: 113412 - DNA, 25 bp, Rattus norvegicus
agagcacatttctctaggctggata

SEQ ID NO: 113413 - DNA, 25 bp, Rattus norvegicus
agagcaccagaaacgactcctcctg

SEQ ID NO: 113414 - DNA, 25 bp, Rattus norvegicus
agagcaccagaatcgactcctcctg

SEQ ID NO: 113415 - DNA, 25 bp, Rattus norvegicus
agagcaccaggaccgaattcgcctt

SEQ ID NO: 113416 - DNA, 25 bp, Rattus norvegicus
agagcaccaggagcgaattcgcctt

SEQ ID NO: 113417 - DNA, 25 bp, Rattus norvegicus
agagcaccatctaccataaactggc

SEQ ID NO: 113418 - DNA, 25 bp, Rattus norvegicus
agagcaccatcttccataaactggc

SEQ ID NO: 113419 - DNA, 25 bp, Rattus norvegicus
agagcaccatgaagcctttctgtct

SEQ ID NO: 113420 - DNA, 25 bp, Rattus norvegicus
agagcaccatgatgcctttctgtct

SEQ ID NO: 113421 - DNA, 25 bp, Rattus norvegicus
agagcacccaccagatgttgaagac

SEQ ID NO: 113422 - DNA, 25 bp, Rattus norvegicus
agagcacccaccagtcggcgtatag

SEQ ID NO: 113423 - DNA, 25 bp, Rattus norvegicus
agagcacccacctgatgttgaagac

SEQ ID NO: 113424 - DNA, 25 bp, Rattus norvegicus
agagcacccacctgtcggcgtatag

SEQ ID NO: 113425 - DNA, 25 bp, Rattus norvegicus
agagcacccactccaagattcacag

SEQ ID NO: 113426 - DNA, 25 bp, Rattus norvegicus
agagcacccactgcaagattcacag

SEQ ID NO: 113427 - DNA, 25 bp, Rattus norvegicus
agagcacccaggaatacttggccct

SEQ ID NO: 113428 - DNA, 25 bp, Rattus norvegicus
agagcacccaggtatacttggccct

SEQ ID NO: 113429 - DNA, 25 bp, Rattus norvegicus
agagcaccccatcgcaggagcagag

SEQ ID NO: 113430 - DNA, 25 bp, Rattus norvegicus
agagcaccccatggcaggagcagag

SEQ ID NO: 113431 - DNA, 25 bp, Rattus norvegicus
agagcaccctagacttggccagaaa

SEQ ID NO: 113432 - DNA, 25 bp, Rattus norvegicus
agagcaccctagtcttggccagaaa

SEQ ID NO: 113433 - DNA, 25 bp, Rattus norvegicus
agagcaccctcgaagaggcaacggt

SEQ ID NO: 113434 - DNA, 25 bp, Rattus norvegicus
agagcaccctcgtagaggcaacggt

SEQ ID NO: 113435 - DNA, 25 bp, Rattus norvegicus
agagcaccctgaatcacaaggcagc

SEQ ID NO: 113436 - DNA, 25 bp, Rattus norvegicus
agagcaccctgattcacaaggcagc

SEQ ID NO: 113437 - DNA, 25 bp, Rattus norvegicus
agagcaccgtaaccatttctttcca

SEQ ID NO: 113438 - DNA, 25 bp, Rattus norvegicus
agagcaccgtaagcatttctttcca

SEQ ID NO: 113439 - DNA, 25 bp, Rattus norvegicus
agagcaccgtgcaggagtgcagtca

SEQ ID NO: 113440 - DNA, 25 bp, Rattus norvegicus
agagcaccgtgctggagtgcagtca

SEQ ID NO: 113441 - DNA, 25 bp, Rattus norvegicus
agagcacctgacaaagagccacacc

SEQ ID NO: 113442 - DNA, 25 bp, Rattus norvegicus
agagcacctgactaagagccacacc

SEQ ID NO: 113443 - DNA, 25 bp, Rattus norvegicus
agagcacctgatcccactggagaaa

SEQ ID NO: 113444 - DNA, 25 bp, Rattus norvegicus
agagcacctgatgccactggagaaa

SEQ ID NO: 113445 - DNA, 25 bp, Rattus norvegicus
agagcacctggactaccattttgca

SEQ ID NO: 113446 - DNA, 25 bp, Rattus norvegicus
agagcacctggagtaccattttgca

SEQ ID NO: 113447 - DNA, 25 bp, Rattus norvegicus
agagcacctttcagagtgtgccttt

SEQ ID NO: 113448 - DNA, 25 bp, Rattus norvegicus
agagcacctttctgagtgtgccttt

SEQ ID NO: 113449 - DNA, 25 bp, Rattus norvegicus
agagcacgcgctcttcagttcggtt

SEQ ID NO: 113450 - DNA, 25 bp, Rattus norvegicus
agagcacgcgctgttcagttcggtt

SEQ ID NO: 113451 - DNA, 25 bp, Rattus norvegicus
agagcacggccccttggatatgagt

SEQ ID NO: 113452 - DNA, 25 bp, Rattus norvegicus
agagcacggcccgttggatatgagt

SEQ ID NO: 113453 - DNA, 25 bp, Rattus norvegicus
agagcacgggttcatactgcctaat

SEQ ID NO: 113454 - DNA, 25 bp, Rattus norvegicus
agagcacgggttgatactgcctaat

SEQ ID NO: 113455 - DNA, 25 bp, Rattus norvegicus
agagcacgtcagaataccgccttga

SEQ ID NO: 113456 - DNA, 25 bp, Rattus norvegicus
agagcacgtcagtataccgccttga

SEQ ID NO: 113457 - DNA, 25 bp, Rattus norvegicus
agagcactacaacccaaactgtcaa

SEQ ID NO: 113458 - DNA, 25 bp, Rattus norvegicus
agagcactacaagccaaactgtcaa

SEQ ID NO: 113459 - DNA, 25 bp, Rattus norvegicus
agagcactacccacaatcactagtg

SEQ ID NO: 113460 - DNA, 25 bp, Rattus norvegicus
agagcactaccctcaatcactagtg

SEQ ID NO: 113461 - DNA, 25 bp, Rattus norvegicus
agagcactcaggagcttggcagcaa

SEQ ID NO: 113462 - DNA, 25 bp, Rattus norvegicus
agagcactcaggtgcttggcagcaa

SEQ ID NO: 113463 - DNA, 25 bp, Rattus norvegicus
agagcactcataatgcctctgactt

SEQ ID NO: 113464 - DNA, 25 bp, Rattus norvegicus
agagcactcatacctcgctcttcta

SEQ ID NO: 113465 - DNA, 25 bp, Rattus norvegicus
agagcactcatagctcgctcttcta

SEQ ID NO: 113466 - DNA, 25 bp, Rattus norvegicus
agagcactcatattgcctctgactt

SEQ ID NO: 113467 - DNA, 25 bp, Rattus norvegicus
agagcactctagcactgtaaggttt

SEQ ID NO: 113468 - DNA, 25 bp, Rattus norvegicus
agagcactctaggactgtaaggttt

SEQ ID NO: 113469 - DNA, 25 bp, Rattus norvegicus
agagcactctctacagcagatcctt

SEQ ID NO: 113470 - DNA, 25 bp, Rattus norvegicus
agagcactctcttcagcagatcctt

SEQ ID NO: 113471 - DNA, 25 bp, Rattus norvegicus
agagcactgattaccctccaagaaa

SEQ ID NO: 113472 - DNA, 25 bp, Rattus norvegicus
agagcactgatttccctccaagaaa

SEQ ID NO: 113473 - DNA, 25 bp, Rattus norvegicus
agagcactgcaacctttgtcttatc

SEQ ID NO: 113474 - DNA, 25 bp, Rattus norvegicus
agagcactgcaagctttgtcttatc

SEQ ID NO: 113475 - DNA, 25 bp, Rattus norvegicus
agagcactgcttactgacctggtca

SEQ ID NO: 113476 - DNA, 25 bp, Rattus norvegicus
agagcactgctttctgacctggtca

SEQ ID NO: 113477 - DNA, 25 bp, Rattus norvegicus
agagcactgggtcatctcctgagat

SEQ ID NO: 113478 - DNA, 25 bp, Rattus norvegicus
agagcactgggtgatctcctgagat

SEQ ID NO: 113479 - DNA, 25 bp, Rattus norvegicus
agagcactggttcctggtttctgtg

SEQ ID NO: 113480 - DNA, 25 bp, Rattus norvegicus
agagcactggttgctggtttctgtg

SEQ ID NO: 113481 - DNA, 25 bp, Rattus norvegicus
agagcactgtcaccaaaatgcccta

SEQ ID NO: 113482 - DNA, 25 bp, Rattus norvegicus
agagcactgtcagcaaaatgcccta

SEQ ID NO: 113483 - DNA, 25 bp, Rattus norvegicus
agagcactgtttagactggtccttg

SEQ ID NO: 113484 - DNA, 25 bp, Rattus norvegicus
agagcactgtttagattggccatag

SEQ ID NO: 113485 - DNA, 25 bp, Rattus norvegicus
agagcactgttttgactggtccttg

SEQ ID NO: 113486 - DNA, 25 bp, Rattus norvegicus
agagcactgttttgattggccatag

SEQ ID NO: 113487 - DNA, 25 bp, Rattus norvegicus
agagcacttaatatcaacctcaagg

SEQ ID NO: 113488 - DNA, 25 bp, Rattus norvegicus
agagcacttaatttcaacctcaagg

SEQ ID NO: 113489 - DNA, 25 bp, Rattus norvegicus
agagcacttagaccttaccatgaaa

SEQ ID NO: 113490 - DNA, 25 bp, Rattus norvegicus
agagcacttagagcttaccatgaaa

SEQ ID NO: 113491 - DNA, 25 bp, Rattus norvegicus
agagcacttagcagccaggaggcat

SEQ ID NO: 113492 - DNA, 25 bp, Rattus norvegicus
agagcacttagctgccaggaggcat

SEQ ID NO: 113493 - DNA, 25 bp, Rattus norvegicus
agagcacttcagcatccactgctgc

SEQ ID NO: 113494 - DNA, 25 bp, Rattus norvegicus
agagcacttcaggatccactgctgc

SEQ ID NO: 113495 - DNA, 25 bp, Rattus norvegicus
agagcacttccgcttggagcatcga

SEQ ID NO: 113496 - DNA, 25 bp, Rattus norvegicus
agagcacttccggttggagcatcga

SEQ ID NO: 113497 - DNA, 25 bp, Rattus norvegicus
agagcacttctcacagccacaaatg

SEQ ID NO: 113498 - DNA, 25 bp, Rattus norvegicus
agagcacttctcatggtggagcagc

SEQ ID NO: 113499 - DNA, 25 bp, Rattus norvegicus
agagcacttctctcagccacaaatg

SEQ ID NO: 113500 - DNA, 25 bp, Rattus norvegicus
agagcacttctcttggtggagcagc

SEQ ID NO: 113501 - DNA, 25 bp, Rattus norvegicus
agagcacttctgatcttgctgtcca

SEQ ID NO: 113502 - DNA, 25 bp, Rattus norvegicus
agagcacttctgttcttgctgtcca

SEQ ID NO: 113503 - DNA, 25 bp, Rattus norvegicus
agagcacttgggattagcatccaat

SEQ ID NO: 113504 - DNA, 25 bp, Rattus norvegicus
agagcacttgggtttagcatccaat

SEQ ID NO: 113505 - DNA, 25 bp, Rattus norvegicus
agagcacttgtactcttgcttgggt

SEQ ID NO: 113506 - DNA, 25 bp, Rattus norvegicus
agagcacttgtagtcttgcttgggt

SEQ ID NO: 113507 - DNA, 25 bp, Rattus norvegicus
agagcacttgtcaagatgcacatgt

SEQ ID NO: 113508 - DNA, 25 bp, Rattus norvegicus
agagcacttgtctagatgcacatgt

SEQ ID NO: 113509 - DNA, 25 bp, Rattus norvegicus
agagcactttaaccatctctgcttg

SEQ ID NO: 113510 - DNA, 25 bp, Rattus norvegicus
agagcactttaagcatctctgcttg

SEQ ID NO: 113511 - DNA, 25 bp, Rattus norvegicus
agagcactttgaccctctgcagctc

SEQ ID NO: 113512 - DNA, 25 bp, Rattus norvegicus
agagcactttgagcctctgcagctc

SEQ ID NO: 113513 - DNA, 25 bp, Rattus norvegicus
agagcagaacctcagtccccaggta

SEQ ID NO: 113514 - DNA, 25 bp, Rattus norvegicus
agagcagaacctgagtccccaggta

SEQ ID NO: 113515 - DNA, 25 bp, Rattus norvegicus
agagcagaacgaacggcaaccgggt

SEQ ID NO: 113516 - DNA, 25 bp, Rattus norvegicus
agagcagaacgatcggcaaccgggt

SEQ ID NO: 113517 - DNA, 25 bp, Rattus norvegicus
agagcagaaggcctgtgtctccatc

SEQ ID NO: 113518 - DNA, 25 bp, Rattus norvegicus
agagcagaaggcgtgtgtctccatc

SEQ ID NO: 113519 - DNA, 25 bp, Rattus norvegicus
agagcagaaggtagtctccagtttt

SEQ ID NO: 113520 - DNA, 25 bp, Rattus norvegicus
agagcagaaggttgtctccagtttt

SEQ ID NO: 113521 - DNA, 25 bp, Rattus norvegicus
agagcagaagtgacagccaagaagt

SEQ ID NO: 113522 - DNA, 25 bp, Rattus norvegicus
agagcagaagtgtcagccaagaagt

SEQ ID NO: 113523 - DNA, 25 bp, Rattus norvegicus
agagcagaatcacctttttcctcct

SEQ ID NO: 113524 - DNA, 25 bp, Rattus norvegicus
agagcagaatcagctttttcctcct

SEQ ID NO: 113525 - DNA, 25 bp, Rattus norvegicus
agagcagacctacactacccatgag

SEQ ID NO: 113526 - DNA, 25 bp, Rattus norvegicus
agagcagacctagactacccatgag

SEQ ID NO: 113527 - DNA, 25 bp, Rattus norvegicus
agagcagactccagagccgcccagt

SEQ ID NO: 113528 - DNA, 25 bp, Rattus norvegicus
agagcagactcctgagccgcccagt

SEQ ID NO: 113529 - DNA, 25 bp, Rattus norvegicus
agagcagagaacagctgacagccac

SEQ ID NO: 113530 - DNA, 25 bp, Rattus norvegicus
agagcagagaactgctgacagccac

SEQ ID NO: 113531 - DNA, 25 bp, Rattus norvegicus
agagcagagatcagcctgtggctac

SEQ ID NO: 113532 - DNA, 25 bp, Rattus norvegicus
agagcagagatctgcctgtggctac

SEQ ID NO: 113533 - DNA, 25 bp, Rattus norvegicus
agagcagagcgaccgcaccgcctta

SEQ ID NO: 113534 - DNA, 25 bp, Rattus norvegicus
agagcagagcgagcgcaccgcctta

SEQ ID NO: 113535 - DNA, 25 bp, Rattus norvegicus
agagcagagctgacaagccgtgaat

SEQ ID NO: 113536 - DNA, 25 bp, Rattus norvegicus
agagcagagctgtcaagccgtgaat

SEQ ID NO: 113537 - DNA, 25 bp, Rattus norvegicus
agagcagaggacatcatccttcctg

SEQ ID NO: 113538 - DNA, 25 bp, Rattus norvegicus
agagcagaggacatcttccttccat

SEQ ID NO: 113539 - DNA, 25 bp, Rattus norvegicus
agagcagaggacttcatccttcctg

SEQ ID NO: 113540 - DNA, 25 bp, Rattus norvegicus
agagcagaggacttcttccttccat

SEQ ID NO: 113541 - DNA, 25 bp, Rattus norvegicus
agagcagaggcaaccagtgaaccga

SEQ ID NO: 113542 - DNA, 25 bp, Rattus norvegicus
agagcagaggcatccagtgaaccga

SEQ ID NO: 113543 - DNA, 25 bp, Rattus norvegicus
agagcagaggcgctgccaccaccgc

SEQ ID NO: 113544 - DNA, 25 bp, Rattus norvegicus
agagcagaggcggtgccaccaccgc

SEQ ID NO: 113545 - DNA, 25 bp, Rattus norvegicus
agagcagagggcatctctgccagtt

SEQ ID NO: 113546 - DNA, 25 bp, Rattus norvegicus
agagcagagggcttctctgccagtt

SEQ ID NO: 113547 - DNA, 25 bp, Rattus norvegicus
agagcagaggttctgtcagtgcccc

SEQ ID NO: 113548 - DNA, 25 bp, Rattus norvegicus
agagcagaggttgtgtcagtgcccc

SEQ ID NO: 113549 - DNA, 25 bp, Rattus norvegicus
agagcagagtccagcccctattgat

SEQ ID NO: 113550 - DNA, 25 bp, Rattus norvegicus
agagcagagtcctgcccctattgat

SEQ ID NO: 113551 - DNA, 25 bp, Rattus norvegicus
agagcagagtttccggaagtcacgt

SEQ ID NO: 113552 - DNA, 25 bp, Rattus norvegicus
agagcagagtttgcggaagtcacgt

SEQ ID NO: 113553 - DNA, 25 bp, Rattus norvegicus
agagcagatcaaatggtccctcctt

SEQ ID NO: 113554 - DNA, 25 bp, Rattus norvegicus
agagcagatcaattggtccctcctt

SEQ ID NO: 113555 - DNA, 25 bp, Rattus norvegicus
agagcagatgttctcatgtcttaac

SEQ ID NO: 113556 - DNA, 25 bp, Rattus norvegicus
agagcagatgttgtcatgtcttaac

SEQ ID NO: 113557 - DNA, 25 bp, Rattus norvegicus
agagcagcaagcatacgcgccacat

SEQ ID NO: 113558 - DNA, 25 bp, Rattus norvegicus
agagcagcaagcttacgcgccacat

SEQ ID NO: 113559 - DNA, 25 bp, Rattus norvegicus
agagcagcacagaggcacccgagaa

SEQ ID NO: 113560 - DNA, 25 bp, Rattus norvegicus
agagcagcacagtggcacccgagaa

SEQ ID NO: 113561 - DNA, 25 bp, Rattus norvegicus
agagcagcacatcctttcctatctg

SEQ ID NO: 113562 - DNA, 25 bp, Rattus norvegicus
agagcagcacatgctttcctatctg

SEQ ID NO: 113563 - DNA, 25 bp, Rattus norvegicus
agagcagcacctccagtgagacatg

SEQ ID NO: 113564 - DNA, 25 bp, Rattus norvegicus
agagcagcacctgcagtgagacatg

SEQ ID NO: 113565 - DNA, 25 bp, Rattus norvegicus
agagcagcacgactgtacgttcgac

SEQ ID NO: 113566 - DNA, 25 bp, Rattus norvegicus
agagcagcacgagtgtacgttcgac

SEQ ID NO: 113567 - DNA, 25 bp, Rattus norvegicus
agagcagcacttcccagaggtgatg

SEQ ID NO: 113568 - DNA, 25 bp, Rattus norvegicus
agagcagcacttgccagaggtgatg

SEQ ID NO: 113569 - DNA, 25 bp, Rattus norvegicus
agagcagcagagacacctccttcag

SEQ ID NO: 113570 - DNA, 25 bp, Rattus norvegicus
agagcagcagagtcacctccttcag

SEQ ID NO: 113571 - DNA, 25 bp, Rattus norvegicus
agagcagcagctcagccccttgttt

SEQ ID NO: 113572 - DNA, 25 bp, Rattus norvegicus
agagcagcagctcctgcttattgga

SEQ ID NO: 113573 - DNA, 25 bp, Rattus norvegicus
agagcagcagctctgcttccagtgc

SEQ ID NO: 113574 - DNA, 25 bp, Rattus norvegicus
agagcagcagctgagccccttgttt

SEQ ID NO: 113575 - DNA, 25 bp, Rattus norvegicus
agagcagcagctgctgcttattgga

SEQ ID NO: 113576 - DNA, 25 bp, Rattus norvegicus
agagcagcagctgtgcttccagtgc

SEQ ID NO: 113577 - DNA, 25 bp, Rattus norvegicus
agagcagcagtactcttgccctctt

SEQ ID NO: 113578 - DNA, 25 bp, Rattus norvegicus
agagcagcagtagtcttgccctctt

SEQ ID NO: 113579 - DNA, 25 bp, Rattus norvegicus
agagcagcagtcaccgagttcaagt

SEQ ID NO: 113580 - DNA, 25 bp, Rattus norvegicus
agagcagcagtctccgagttcaagt

SEQ ID NO: 113581 - DNA, 25 bp, Rattus norvegicus
agagcagcagttacgtgccagtcgg

SEQ ID NO: 113582 - DNA, 25 bp, Rattus norvegicus
agagcagcagtttcgtgccagtcgg

SEQ ID NO: 113583 - DNA, 25 bp, Rattus norvegicus
agagcagcatttactgtcccctaat

SEQ ID NO: 113584 - DNA, 25 bp, Rattus norvegicus
agagcagcattttctgtcccctaat

SEQ ID NO: 113585 - DNA, 25 bp, Rattus norvegicus
agagcagccactcaaagggcttgta

SEQ ID NO: 113586 - DNA, 25 bp, Rattus norvegicus
agagcagccactgaaagggcttgta

SEQ ID NO: 113587 - DNA, 25 bp, Rattus norvegicus
agagcagcccagcaagaagcctagt

SEQ ID NO: 113588 - DNA, 25 bp, Rattus norvegicus
agagcagcccaggaagaagcctagt

SEQ ID NO: 113589 - DNA, 25 bp, Rattus norvegicus
agagcagcccgtcacctcggaggtc

SEQ ID NO: 113590 - DNA, 25 bp, Rattus norvegicus
agagcagcccgtgacctcggaggtc

SEQ ID NO: 113591 - DNA, 25 bp, Rattus norvegicus
agagcagccctacgcgtcctggagt

SEQ ID NO: 113592 - DNA, 25 bp, Rattus norvegicus
agagcagccctactagcacatgccg

SEQ ID NO: 113593 - DNA, 25 bp, Rattus norvegicus
agagcagccctaggcgtcctggagt

SEQ ID NO: 113594 - DNA, 25 bp, Rattus norvegicus
agagcagccctagtagcacatgccg

SEQ ID NO: 113595 - DNA, 25 bp, Rattus norvegicus
agagcagcccttcaggaggagctta

SEQ ID NO: 113596 - DNA, 25 bp, Rattus norvegicus
agagcagcccttgaggaggagctta

SEQ ID NO: 113597 - DNA, 25 bp, Rattus norvegicus
agagcagccgataccagttccgcaa

SEQ ID NO: 113598 - DNA, 25 bp, Rattus norvegicus
agagcagccgattccagttccgcaa

SEQ ID NO: 113599 - DNA, 25 bp, Rattus norvegicus
agagcagccgggagctccacactgg

SEQ ID NO: 113600 - DNA, 25 bp, Rattus norvegicus
agagcagccgggtgctccacactgg

SEQ ID NO: 113601 - DNA, 25 bp, Rattus norvegicus
agagcagcctctatacttcagggaa

SEQ ID NO: 113602 - DNA, 25 bp, Rattus norvegicus
agagcagcctctcaaaaggcgccga

SEQ ID NO: 113603 - DNA, 25 bp, Rattus norvegicus
agagcagcctctgaaaaggcgccga

SEQ ID NO: 113604 - DNA, 25 bp, Rattus norvegicus
agagcagcctctttacttcagggaa

SEQ ID NO: 113605 - DNA, 25 bp, Rattus norvegicus
agagcagcctgtctgatgccaacca

SEQ ID NO: 113606 - DNA, 25 bp, Rattus norvegicus
agagcagcctgtgtgatgccaacca

SEQ ID NO: 113607 - DNA, 25 bp, Rattus norvegicus
agagcagcgagtatcaaggactcca

SEQ ID NO: 113608 - DNA, 25 bp, Rattus norvegicus
agagcagcgagtttcaaggactcca

SEQ ID NO: 113609 - DNA, 25 bp, Rattus norvegicus
agagcagcgcccatgtgaagatcgt

SEQ ID NO: 113610 - DNA, 25 bp, Rattus norvegicus
agagcagcgcccttgtgaagatcgt

SEQ ID NO: 113611 - DNA, 25 bp, Rattus norvegicus
agagcagcgcgaagcacagcagcat

SEQ ID NO: 113612 - DNA, 25 bp, Rattus norvegicus
agagcagcgcgatgcacagcagcat

SEQ ID NO: 113613 - DNA, 25 bp, Rattus norvegicus
agagcagcggccagttggccgccac

SEQ ID NO: 113614 - DNA, 25 bp, Rattus norvegicus
agagcagcggcctgttggccgccac

SEQ ID NO: 113615 - DNA, 25 bp, Rattus norvegicus
agagcagcgtcccttcggtctggtt

SEQ ID NO: 113616 - DNA, 25 bp, Rattus norvegicus
agagcagcgtccgttcggtctggtt

SEQ ID NO: 113617 - DNA, 25 bp, Rattus norvegicus
agagcagctcatcgaggccgtcaac

SEQ ID NO: 113618 - DNA, 25 bp, Rattus norvegicus
agagcagctcatggaggccgtcaac

SEQ ID NO: 113619 - DNA, 25 bp, Rattus norvegicus
agagcagctcctccgagagtatttg

SEQ ID NO: 113620 - DNA, 25 bp, Rattus norvegicus
agagcagctcctgcgagagtatttg

SEQ ID NO: 113621 - DNA, 25 bp, Rattus norvegicus
agagcagctctgcacgttccaagga

SEQ ID NO: 113622 - DNA, 25 bp, Rattus norvegicus
agagcagctctgcatgttttcatgc

SEQ ID NO: 113623 - DNA, 25 bp, Rattus norvegicus
agagcagctctggacgttccaagga

SEQ ID NO: 113624 - DNA, 25 bp, Rattus norvegicus
agagcagctctggatgttttcatgc

SEQ ID NO: 113625 - DNA, 25 bp, Rattus norvegicus
agagcagctcttctgagcccagagt

SEQ ID NO: 113626 - DNA, 25 bp, Rattus norvegicus
agagcagctcttgtgagcccagagt

SEQ ID NO: 113627 - DNA, 25 bp, Rattus norvegicus
agagcagctggcacgtgactttcgc

SEQ ID NO: 113628 - DNA, 25 bp, Rattus norvegicus
agagcagctggctcgtgactttcgc

SEQ ID NO: 113629 - DNA, 25 bp, Rattus norvegicus
agagcagctgggacgccttcatcaa

SEQ ID NO: 113630 - DNA, 25 bp, Rattus norvegicus
agagcagctgggtcgccttcatcaa

SEQ ID NO: 113631 - DNA, 25 bp, Rattus norvegicus
agagcagctgttaccatgcttggat

SEQ ID NO: 113632 - DNA, 25 bp, Rattus norvegicus
agagcagctgtttccatgcttggat

SEQ ID NO: 113633 - DNA, 25 bp, Rattus norvegicus
agagcagcttagctcactgcagtct

SEQ ID NO: 113634 - DNA, 25 bp, Rattus norvegicus
agagcagcttaggtcactgcagtct

SEQ ID NO: 113635 - DNA, 25 bp, Rattus norvegicus
agagcagcttcacctggagcaggcc

SEQ ID NO: 113636 - DNA, 25 bp, Rattus norvegicus
agagcagcttcagctggagcaggcc

SEQ ID NO: 113637 - DNA, 25 bp, Rattus norvegicus
agagcagcttccctgtgctcaggac

SEQ ID NO: 113638 - DNA, 25 bp, Rattus norvegicus
agagcagcttccgtgtgctcaggac

SEQ ID NO: 113639 - DNA, 25 bp, Rattus norvegicus
agagcagcttctcgttctactgtgc

SEQ ID NO: 113640 - DNA, 25 bp, Rattus norvegicus
agagcagcttctggttctactgtgc

SEQ ID NO: 113641 - DNA, 25 bp, Rattus norvegicus
agagcagctttgatgacagtacccc

SEQ ID NO: 113642 - DNA, 25 bp, Rattus norvegicus
agagcagctttgttgacagtacccc

SEQ ID NO: 113643 - DNA, 25 bp, Rattus norvegicus
agagcaggaagtcctctaactctcc

SEQ ID NO: 113644 - DNA, 25 bp, Rattus norvegicus
agagcaggaagtgctctaactctcc

SEQ ID NO: 113645 - DNA, 25 bp, Rattus norvegicus
agagcaggacacattcattcagcat

SEQ ID NO: 113646 - DNA, 25 bp, Rattus norvegicus
agagcaggacactttcattcagcat

SEQ ID NO: 113647 - DNA, 25 bp, Rattus norvegicus
agagcaggaccacttctccttcact

SEQ ID NO: 113648 - DNA, 25 bp, Rattus norvegicus
agagcaggaccagttctccttcact

SEQ ID NO: 113649 - DNA, 25 bp, Rattus norvegicus
agagcaggacccctcagatgaggct

SEQ ID NO: 113650 - DNA, 25 bp, Rattus norvegicus
agagcaggacccgtcagatgaggct

SEQ ID NO: 113651 - DNA, 25 bp, Rattus norvegicus
agagcaggacttcctatgccagcat

SEQ ID NO: 113652 - DNA, 25 bp, Rattus norvegicus
agagcaggacttgctatgccagcat

SEQ ID NO: 113653 - DNA, 25 bp, Rattus norvegicus
agagcaggattcaaacaggctgaca

SEQ ID NO: 113654 - DNA, 25 bp, Rattus norvegicus
agagcaggattctaacaggctgaca

SEQ ID NO: 113655 - DNA, 25 bp, Rattus norvegicus
agagcaggcagtctctcccattgtg

SEQ ID NO: 113656 - DNA, 25 bp, Rattus norvegicus
agagcaggcagtgtctcccattgtg

SEQ ID NO: 113657 - DNA, 25 bp, Rattus norvegicus
agagcaggccagaggacgcaccttc

SEQ ID NO: 113658 - DNA, 25 bp, Rattus norvegicus
agagcaggccagtggacgcaccttc

SEQ ID NO: 113659 - DNA, 25 bp, Rattus norvegicus
agagcaggccttaatttcctgacta

SEQ ID NO: 113660 - DNA, 25 bp, Rattus norvegicus
agagcaggcctttatttcctgacta

SEQ ID NO: 113661 - DNA, 25 bp, Rattus norvegicus
agagcaggcgctcgccatcatggct

SEQ ID NO: 113662 - DNA, 25 bp, Rattus norvegicus
agagcaggcgctggccatcatggct

SEQ ID NO: 113663 - DNA, 25 bp, Rattus norvegicus
agagcaggctgcatccccaaaggaa

SEQ ID NO: 113664 - DNA, 25 bp, Rattus norvegicus
agagcaggctgcttccccaaaggaa

SEQ ID NO: 113665 - DNA, 25 bp, Rattus norvegicus
agagcagggcttctgttttttacaa

SEQ ID NO: 113666 - DNA, 25 bp, Rattus norvegicus
agagcagggcttgtgttttttacaa

SEQ ID NO: 113667 - DNA, 25 bp, Rattus norvegicus
agagcagggtctctcattcagccct

SEQ ID NO: 113668 - DNA, 25 bp, Rattus norvegicus
agagcagggtctgtcattcagccct

SEQ ID NO: 113669 - DNA, 25 bp, Rattus norvegicus
agagcagggttcacaggctgaccac

SEQ ID NO: 113670 - DNA, 25 bp, Rattus norvegicus
agagcagggttctcaggctgaccac

SEQ ID NO: 113671 - DNA, 25 bp, Rattus norvegicus
agagcaggtacaagcttcctgtctg

SEQ ID NO: 113672 - DNA, 25 bp, Rattus norvegicus
agagcaggtacatgcttcctgtctg

SEQ ID NO: 113673 - DNA, 25 bp, Rattus norvegicus
agagcaggtattaaacagtcacagc

SEQ ID NO: 113674 - DNA, 25 bp, Rattus norvegicus
agagcaggtatttaacagtcacagc

SEQ ID NO: 113675 - DNA, 25 bp, Rattus norvegicus
agagcaggtctcacaggagtgctga

SEQ ID NO: 113676 - DNA, 25 bp, Rattus norvegicus
agagcaggtctctcaggagtgctga

SEQ ID NO: 113677 - DNA, 25 bp, Rattus norvegicus
agagcaggtcttaatgagccattac

SEQ ID NO: 113678 - DNA, 25 bp, Rattus norvegicus
agagcaggtctttatgagccattac

SEQ ID NO: 113679 - DNA, 25 bp, Rattus norvegicus
agagcaggtggcagtcccattggac

SEQ ID NO: 113680 - DNA, 25 bp, Rattus norvegicus
agagcaggtggctgtcccattggac

SEQ ID NO: 113681 - DNA, 25 bp, Rattus norvegicus
agagcaggttcgatttctcagtcag

SEQ ID NO: 113682 - DNA, 25 bp, Rattus norvegicus
agagcaggttcgttttctcagtcag

SEQ ID NO: 113683 - DNA, 25 bp, Rattus norvegicus
agagcagtaaacctggccagtggct

SEQ ID NO: 113684 - DNA, 25 bp, Rattus norvegicus
agagcagtaaacgtggccagtggct

SEQ ID NO: 113685 - DNA, 25 bp, Rattus norvegicus
agagcagtactgacacctttactca

SEQ ID NO: 113686 - DNA, 25 bp, Rattus norvegicus
agagcagtactgtcacctttactca

SEQ ID NO: 113687 - DNA, 25 bp, Rattus norvegicus
agagcagtagccctggctcttgaca

SEQ ID NO: 113688 - DNA, 25 bp, Rattus norvegicus
agagcagtagccgtggctcttgaca

SEQ ID NO: 113689 - DNA, 25 bp, Rattus norvegicus
agagcagtcaccacatgctggcctt

SEQ ID NO: 113690 - DNA, 25 bp, Rattus norvegicus
agagcagtcacctcatgctggcctt

SEQ ID NO: 113691 - DNA, 25 bp, Rattus norvegicus
agagcagtcagtctcaccctatcaa

SEQ ID NO: 113692 - DNA, 25 bp, Rattus norvegicus
agagcagtcagtgtcaccctatcaa

SEQ ID NO: 113693 - DNA, 25 bp, Rattus norvegicus
agagcagtcatgacagccgcacatt

SEQ ID NO: 113694 - DNA, 25 bp, Rattus norvegicus
agagcagtcatgacctgaaacttag

SEQ ID NO: 113695 - DNA, 25 bp, Rattus norvegicus
agagcagtcatgtcagccgcacatt

SEQ ID NO: 113696 - DNA, 25 bp, Rattus norvegicus
agagcagtcatgtcctgaaacttag

SEQ ID NO: 113697 - DNA, 25 bp, Rattus norvegicus
agagcagtccctatgcgggaacgat

SEQ ID NO: 113698 - DNA, 25 bp, Rattus norvegicus
agagcagtccctttgcgggaacgat

SEQ ID NO: 113699 - DNA, 25 bp, Rattus norvegicus
agagcagtcctcatagtattagttt

SEQ ID NO: 113700 - DNA, 25 bp, Rattus norvegicus
agagcagtcctcttagtattagttt

SEQ ID NO: 113701 - DNA, 25 bp, Rattus norvegicus
agagcagtcgtgacctcgttttcat

SEQ ID NO: 113702 - DNA, 25 bp, Rattus norvegicus
agagcagtcgtgtcctcgttttcat

SEQ ID NO: 113703 - DNA, 25 bp, Rattus norvegicus
agagcagtctgcacttttaaccatc

SEQ ID NO: 113704 - DNA, 25 bp, Rattus norvegicus
agagcagtctgcctggctgccgcct

SEQ ID NO: 113705 - DNA, 25 bp, Rattus norvegicus
agagcagtctgcgtggctgccgcct

SEQ ID NO: 113706 - DNA, 25 bp, Rattus norvegicus
agagcagtctgctcttttaaccatc

SEQ ID NO: 113707 - DNA, 25 bp, Rattus norvegicus
agagcagtgacaagcccctggatga

SEQ ID NO: 113708 - DNA, 25 bp, Rattus norvegicus
agagcagtgacacgtgcctgcctgc

SEQ ID NO: 113709 - DNA, 25 bp, Rattus norvegicus
agagcagtgacaggtgcctgcctgc

SEQ ID NO: 113710 - DNA, 25 bp, Rattus norvegicus
agagcagtgacatgcccctggatga

SEQ ID NO: 113711 - DNA, 25 bp, Rattus norvegicus
agagcagtgagtatcaatgcccaca

SEQ ID NO: 113712 - DNA, 25 bp, Rattus norvegicus
agagcagtgagtttcaatgcccaca

SEQ ID NO: 113713 - DNA, 25 bp, Rattus norvegicus
agagcagtgcacacatcgcttcaga

SEQ ID NO: 113714 - DNA, 25 bp, Rattus norvegicus
agagcagtgcactcatcgcttcaga

SEQ ID NO: 113715 - DNA, 25 bp, Rattus norvegicus
agagcagtgccgagtgaccctggct

SEQ ID NO: 113716 - DNA, 25 bp, Rattus norvegicus
agagcagtgccgtgtgaccctggct

SEQ ID NO: 113717 - DNA, 25 bp, Rattus norvegicus
agagcagtgcttatcaaacatggtg

SEQ ID NO: 113718 - DNA, 25 bp, Rattus norvegicus
agagcagtgcttttcaaacatggtg

SEQ ID NO: 113719 - DNA, 25 bp, Rattus norvegicus
agagcagtgggcaagcctcactccc

SEQ ID NO: 113720 - DNA, 25 bp, Rattus norvegicus
agagcagtgggctagcctcactccc

SEQ ID NO: 113721 - DNA, 25 bp, Rattus norvegicus
agagcagtgtccctctattgtccgc

SEQ ID NO: 113722 - DNA, 25 bp, Rattus norvegicus
agagcagtgtccgtctattgtccgc

SEQ ID NO: 113723 - DNA, 25 bp, Rattus norvegicus
agagcagttcacagccatgttccga

SEQ ID NO: 113724 - DNA, 25 bp, Rattus norvegicus
agagcagttcactgccatgttccga

SEQ ID NO: 113725 - DNA, 25 bp, Rattus norvegicus
agagcagttccaatgtcacagagac

SEQ ID NO: 113726 - DNA, 25 bp, Rattus norvegicus
agagcagttccattgtcacagagac

SEQ ID NO: 113727 - DNA, 25 bp, Rattus norvegicus
agagcagttcctaaacagatgacat

SEQ ID NO: 113728 - DNA, 25 bp, Rattus norvegicus
agagcagttccttaacagatgacat

SEQ ID NO: 113729 - DNA, 25 bp, Rattus norvegicus
agagcagttgctcgagcgtatccca

SEQ ID NO: 113730 - DNA, 25 bp, Rattus norvegicus
agagcagttgctggagcgtatccca

SEQ ID NO: 113731 - DNA, 25 bp, Rattus norvegicus
agagcagtttacatcagtgaagcac

SEQ ID NO: 113732 - DNA, 25 bp, Rattus norvegicus
agagcagtttacttcagtgaagcac

SEQ ID NO: 113733 - DNA, 25 bp, Rattus norvegicus
agagcagttttgaccttgcctgggt

SEQ ID NO: 113734 - DNA, 25 bp, Rattus norvegicus
agagcagttttgtccttgcctgggt

SEQ ID NO: 113735 - DNA, 25 bp, Rattus norvegicus
agagcatacattaacttcagttatt

SEQ ID NO: 113736 - DNA, 25 bp, Rattus norvegicus
agagcatacatttacttcagttatt

SEQ ID NO: 113737 - DNA, 25 bp, Rattus norvegicus
agagcatacccacttctctactcag

SEQ ID NO: 113738 - DNA, 25 bp, Rattus norvegicus
agagcatacccagttctctactcag

SEQ ID NO: 113739 - DNA, 25 bp, Rattus norvegicus
agagcatagagcctcacctttgatc

SEQ ID NO: 113740 - DNA, 25 bp, Rattus norvegicus
agagcatagagcgtcacctttgatc

SEQ ID NO: 113741 - DNA, 25 bp, Rattus norvegicus
agagcataggcacttctggagttct

SEQ ID NO: 113742 - DNA, 25 bp, Rattus norvegicus
agagcataggcagttctggagttct

SEQ ID NO: 113743 - DNA, 25 bp, Rattus norvegicus
agagcatcacggagcgtccatgaag

SEQ ID NO: 113744 - DNA, 25 bp, Rattus norvegicus
agagcatcacggtgcgtccatgaag

SEQ ID NO: 113745 - DNA, 25 bp, Rattus norvegicus
agagcatcactccttatgttcctac

SEQ ID NO: 113746 - DNA, 25 bp, Rattus norvegicus
agagcatcactcgttatgttcctac

SEQ ID NO: 113747 - DNA, 25 bp, Rattus norvegicus
agagcatcagatcgcttccctccag

SEQ ID NO: 113748 - DNA, 25 bp, Rattus norvegicus
agagcatcagatggcttccctccag

SEQ ID NO: 113749 - DNA, 25 bp, Rattus norvegicus
agagcatcagtcattctcgcgggcc

SEQ ID NO: 113750 - DNA, 25 bp, Rattus norvegicus
agagcatcagtctttctcgcgggcc

SEQ ID NO: 113751 - DNA, 25 bp, Rattus norvegicus
agagcatcagtgacatcctcacgac

SEQ ID NO: 113752 - DNA, 25 bp, Rattus norvegicus
agagcatcagtgtcatcctcacgac

SEQ ID NO: 113753 - DNA, 25 bp, Rattus norvegicus
agagcatcataaccctggatggtgg

SEQ ID NO: 113754 - DNA, 25 bp, Rattus norvegicus
agagcatcataagcctggatggtgg

SEQ ID NO: 113755 - DNA, 25 bp, Rattus norvegicus
agagcatccaggacaatgccctgca

SEQ ID NO: 113756 - DNA, 25 bp, Rattus norvegicus
agagcatccaggtcaatgccctgca

SEQ ID NO: 113757 - DNA, 25 bp, Rattus norvegicus
agagcatcccgcatgagaggagcca

SEQ ID NO: 113758 - DNA, 25 bp, Rattus norvegicus
agagcatcccgcttgagaggagcca

SEQ ID NO: 113759 - DNA, 25 bp, Rattus norvegicus
agagcatcctggcaagtgcctgttt

SEQ ID NO: 113760 - DNA, 25 bp, Rattus norvegicus
agagcatcctgggaagtgcctgttt

SEQ ID NO: 113761 - DNA, 25 bp, Rattus norvegicus
agagcatccttcacggtagcctctg

SEQ ID NO: 113762 - DNA, 25 bp, Rattus norvegicus
agagcatccttcaggtgtgagacac

SEQ ID NO: 113763 - DNA, 25 bp, Rattus norvegicus
agagcatccttccatgtgaactgtg

SEQ ID NO: 113764 - DNA, 25 bp, Rattus norvegicus
agagcatccttcgatgtgaactgtg

SEQ ID NO: 113765 - DNA, 25 bp, Rattus norvegicus
agagcatccttctcggtagcctctg

SEQ ID NO: 113766 - DNA, 25 bp, Rattus norvegicus
agagcatccttctggtgtgagacac

SEQ ID NO: 113767 - DNA, 25 bp, Rattus norvegicus
agagcatccttgctctctgtaaccc

SEQ ID NO: 113768 - DNA, 25 bp, Rattus norvegicus
agagcatccttggtctctgtaaccc

SEQ ID NO: 113769 - DNA, 25 bp, Rattus norvegicus
agagcatcggtgatcttctctcgag

SEQ ID NO: 113770 - DNA, 25 bp, Rattus norvegicus
agagcatcggtgttcttctctcgag

SEQ ID NO: 113771 - DNA, 25 bp, Rattus norvegicus
agagcatcgtcacgcagcactcagt

SEQ ID NO: 113772 - DNA, 25 bp, Rattus norvegicus
agagcatcgtcaggcagcactcagt

SEQ ID NO: 113773 - DNA, 25 bp, Rattus norvegicus
agagcatctatgctgagcgcttccc

SEQ ID NO: 113774 - DNA, 25 bp, Rattus norvegicus
agagcatctatggtgagcgcttccc

SEQ ID NO: 113775 - DNA, 25 bp, Rattus norvegicus
agagcatctccactgggttgtttcc

SEQ ID NO: 113776 - DNA, 25 bp, Rattus norvegicus
agagcatctccagtgggttgtttcc

SEQ ID NO: 113777 - DNA, 25 bp, Rattus norvegicus
agagcatctcgcagcctgggaaggc

SEQ ID NO: 113778 - DNA, 25 bp, Rattus norvegicus
agagcatctcgctgcctgggaaggc

SEQ ID NO: 113779 - DNA, 25 bp, Rattus norvegicus
agagcatctctcagcaaaggagttt

SEQ ID NO: 113780 - DNA, 25 bp, Rattus norvegicus
agagcatctctccaaatccaggtat

SEQ ID NO: 113781 - DNA, 25 bp, Rattus norvegicus
agagcatctctcgaaatccaggtat

SEQ ID NO: 113782 - DNA, 25 bp, Rattus norvegicus
agagcatctctctgcaaaggagttt

SEQ ID NO: 113783 - DNA, 25 bp, Rattus norvegicus
agagcatctctgcaccccgtttcaa

SEQ ID NO: 113784 - DNA, 25 bp, Rattus norvegicus
agagcatctctggaccccgtttcaa

SEQ ID NO: 113785 - DNA, 25 bp, Rattus norvegicus
agagcatctgcgcaaagacacaggt

SEQ ID NO: 113786 - DNA, 25 bp, Rattus norvegicus
agagcatctgcggaaagacacaggt

SEQ ID NO: 113787 - DNA, 25 bp, Rattus norvegicus
agagcatcttccattgatatcaaaa

SEQ ID NO: 113788 - DNA, 25 bp, Rattus norvegicus
agagcatcttcctttgatatcaaaa

SEQ ID NO: 113789 - DNA, 25 bp, Rattus norvegicus
agagcatcttgcaattcttaccaaa

SEQ ID NO: 113790 - DNA, 25 bp, Rattus norvegicus
agagcatcttgctattcttaccaaa

SEQ ID NO: 113791 - DNA, 25 bp, Rattus norvegicus
agagcatcttggatgcctttgtgtc

SEQ ID NO: 113792 - DNA, 25 bp, Rattus norvegicus
agagcatcttggttgcctttgtgtc

SEQ ID NO: 113793 - DNA, 25 bp, Rattus norvegicus
agagcatcttttcttccagattcac

SEQ ID NO: 113794 - DNA, 25 bp, Rattus norvegicus
agagcatcttttgttccagattcac

SEQ ID NO: 113795 - DNA, 25 bp, Rattus norvegicus
agagcatgaccaatcgtcagcacac

SEQ ID NO: 113796 - DNA, 25 bp, Rattus norvegicus
agagcatgaccattcgtcagcacac

SEQ ID NO: 113797 - DNA, 25 bp, Rattus norvegicus
agagcatgagcacacagatccctat

SEQ ID NO: 113798 - DNA, 25 bp, Rattus norvegicus
agagcatgagcagacagatccctat

SEQ ID NO: 113799 - DNA, 25 bp, Rattus norvegicus
agagcatgattaactgtcagggctt

SEQ ID NO: 113800 - DNA, 25 bp, Rattus norvegicus
agagcatgattatctgtcagggctt

SEQ ID NO: 113801 - DNA, 25 bp, Rattus norvegicus
agagcatgcccgcagacttgaagat

SEQ ID NO: 113802 - DNA, 25 bp, Rattus norvegicus
agagcatgcccggagacttgaagat

SEQ ID NO: 113803 - DNA, 25 bp, Rattus norvegicus
agagcatgcctcatcagatgttgaa

SEQ ID NO: 113804 - DNA, 25 bp, Rattus norvegicus
agagcatgcctcttcagatgttgaa

SEQ ID NO: 113805 - DNA, 25 bp, Rattus norvegicus
agagcatgccttaaagacttagatc

SEQ ID NO: 113806 - DNA, 25 bp, Rattus norvegicus
agagcatgcctttaagacttagatc

SEQ ID NO: 113807 - DNA, 25 bp, Rattus norvegicus
agagcatgctaaaccatctcgcgca

SEQ ID NO: 113808 - DNA, 25 bp, Rattus norvegicus
agagcatgctaatccatctcgcgca

SEQ ID NO: 113809 - DNA, 25 bp, Rattus norvegicus
agagcatgctccattaagaacccgc

SEQ ID NO: 113810 - DNA, 25 bp, Rattus norvegicus
agagcatgctcctttaagaacccgc

SEQ ID NO: 113811 - DNA, 25 bp, Rattus norvegicus
agagcatgggtaatggccgttccct

SEQ ID NO: 113812 - DNA, 25 bp, Rattus norvegicus
agagcatgggtattggccgttccct

SEQ ID NO: 113813 - DNA, 25 bp, Rattus norvegicus
agagcatgtatacagcccctgttac

SEQ ID NO: 113814 - DNA, 25 bp, Rattus norvegicus
agagcatgtatagagcccctgttac

SEQ ID NO: 113815 - DNA, 25 bp, Rattus norvegicus
agagcatgtgcacatctcattgtca

SEQ ID NO: 113816 - DNA, 25 bp, Rattus norvegicus
agagcatgtgcagatctcattgtca

SEQ ID NO: 113817 - DNA, 25 bp, Rattus norvegicus
agagcatgtggcctgatgtctgccc

SEQ ID NO: 113818 - DNA, 25 bp, Rattus norvegicus
agagcatgtggcgtgatgtctgccc

SEQ ID NO: 113819 - DNA, 25 bp, Rattus norvegicus
agagcatgtttccaaccgttgtctt

SEQ ID NO: 113820 - DNA, 25 bp, Rattus norvegicus
agagcatgtttcgaaccgttgtctt

SEQ ID NO: 113821 - DNA, 25 bp, Rattus norvegicus
agagcattaactatcatcattgtga

SEQ ID NO: 113822 - DNA, 25 bp, Rattus norvegicus
agagcattaactttcatcattgtga

SEQ ID NO: 113823 - DNA, 25 bp, Rattus norvegicus
agagcattaatcagtgcccgcacag

SEQ ID NO: 113824 - DNA, 25 bp, Rattus norvegicus
agagcattaatctgtgcccgcacag

SEQ ID NO: 113825 - DNA, 25 bp, Rattus norvegicus
agagcattcatcaactgtgggtgga

SEQ ID NO: 113826 - DNA, 25 bp, Rattus norvegicus
agagcattcatctactgtgggtgga

SEQ ID NO: 113827 - DNA, 25 bp, Rattus norvegicus
agagcattcgtaacttttgagacag

SEQ ID NO: 113828 - DNA, 25 bp, Rattus norvegicus
agagcattcgtatcttttgagacag

SEQ ID NO: 113829 - DNA, 25 bp, Rattus norvegicus
agagcattctctcgtgttggcataa

SEQ ID NO: 113830 - DNA, 25 bp, Rattus norvegicus
agagcattctctggtgttggcataa

SEQ ID NO: 113831 - DNA, 25 bp, Rattus norvegicus
agagcattgcgcctcctgatttcac

SEQ ID NO: 113832 - DNA, 25 bp, Rattus norvegicus
agagcattgcgcgtcctgatttcac

SEQ ID NO: 113833 - DNA, 25 bp, Rattus norvegicus
agagcattggagactttttcccctt

SEQ ID NO: 113834 - DNA, 25 bp, Rattus norvegicus
agagcattggagtctttttcccctt

SEQ ID NO: 113835 - DNA, 25 bp, Rattus norvegicus
agagcattgttcatgcagtgacccc

SEQ ID NO: 113836 - DNA, 25 bp, Rattus norvegicus
agagcattgttcttgcagtgacccc

SEQ ID NO: 113837 - DNA, 25 bp, Rattus norvegicus
agagcatttcagaaccttttggaga

SEQ ID NO: 113838 - DNA, 25 bp, Rattus norvegicus
agagcatttcagtaccttttggaga

SEQ ID NO: 113839 - DNA, 25 bp, Rattus norvegicus
agagcatttcatcgtggcccaggaa

SEQ ID NO: 113840 - DNA, 25 bp, Rattus norvegicus
agagcatttcatggtggcccaggaa

SEQ ID NO: 113841 - DNA, 25 bp, Rattus norvegicus
agagcatttcccagtcaggtagcca

SEQ ID NO: 113842 - DNA, 25 bp, Rattus norvegicus
agagcatttccctgtcaggtagcca

SEQ ID NO: 113843 - DNA, 25 bp, Rattus norvegicus
agagcatttctcctttcaggcacac

SEQ ID NO: 113844 - DNA, 25 bp, Rattus norvegicus
agagcatttctcgtttcaggcacac

SEQ ID NO: 113845 - DNA, 25 bp, Rattus norvegicus
agagcatttctgactgtagaccatt

SEQ ID NO: 113846 - DNA, 25 bp, Rattus norvegicus
agagcatttctgtctgtagaccatt

SEQ ID NO: 113847 - DNA, 25 bp, Rattus norvegicus
agagcatttgtaccccttgcagtgg

SEQ ID NO: 113848 - DNA, 25 bp, Rattus norvegicus
agagcatttgtagcccttgcagtgg

SEQ ID NO: 113849 - DNA, 25 bp, Rattus norvegicus
agagccaaagcaacctttgcagcag

SEQ ID NO: 113850 - DNA, 25 bp, Rattus norvegicus
agagccaaagcatcctttgcagcag

SEQ ID NO: 113851 - DNA, 25 bp, Rattus norvegicus
agagccaacactcgtgatacagggt

SEQ ID NO: 113852 - DNA, 25 bp, Rattus norvegicus
agagccaacactggtgatacagggt

SEQ ID NO: 113853 - DNA, 25 bp, Rattus norvegicus
agagccaacatccacatacaaactt

SEQ ID NO: 113854 - DNA, 25 bp, Rattus norvegicus
agagccaacatcgacatacaaactt

SEQ ID NO: 113855 - DNA, 25 bp, Rattus norvegicus
agagccaaccacagccgtagaacca

SEQ ID NO: 113856 - DNA, 25 bp, Rattus norvegicus
agagccaaccactgccgtagaacca

SEQ ID NO: 113857 - DNA, 25 bp, Rattus norvegicus
agagccaagactcaaggccctgagt

SEQ ID NO: 113858 - DNA, 25 bp, Rattus norvegicus
agagccaagactgaaggccctgagt

SEQ ID NO: 113859 - DNA, 25 bp, Rattus norvegicus
agagccaagctgactgttctgccta

SEQ ID NO: 113860 - DNA, 25 bp, Rattus norvegicus
agagccaagctgatgcacagcagaa

SEQ ID NO: 113861 - DNA, 25 bp, Rattus norvegicus
agagccaagctgtctgttctgccta

SEQ ID NO: 113862 - DNA, 25 bp, Rattus norvegicus
agagccaagctgttgcacagcagaa

SEQ ID NO: 113863 - DNA, 25 bp, Rattus norvegicus
agagccaaggttagcttcacctcag

SEQ ID NO: 113864 - DNA, 25 bp, Rattus norvegicus
agagccaaggtttgcttcacctcag

SEQ ID NO: 113865 - DNA, 25 bp, Rattus norvegicus
agagccaatcagatacctttcgcag

SEQ ID NO: 113866 - DNA, 25 bp, Rattus norvegicus
agagccaatcagttacctttcgcag

SEQ ID NO: 113867 - DNA, 25 bp, Rattus norvegicus
agagccacaagtctagaccccattt

SEQ ID NO: 113868 - DNA, 25 bp, Rattus norvegicus
agagccacaagtgtagaccccattt

SEQ ID NO: 113869 - DNA, 25 bp, Rattus norvegicus
agagccacaattcatgctacccgca

SEQ ID NO: 113870 - DNA, 25 bp, Rattus norvegicus
agagccacaattgatgctacccgca

SEQ ID NO: 113871 - DNA, 25 bp, Rattus norvegicus
agagccacaccgctttatctcttgt

SEQ ID NO: 113872 - DNA, 25 bp, Rattus norvegicus
agagccacaccggtttatctcttgt

SEQ ID NO: 113873 - DNA, 25 bp, Rattus norvegicus
agagccacactaacccagaagcata

SEQ ID NO: 113874 - DNA, 25 bp, Rattus norvegicus
agagccacactatcccagaagcata

SEQ ID NO: 113875 - DNA, 25 bp, Rattus norvegicus
agagccacagagaaggcggtgctct

SEQ ID NO: 113876 - DNA, 25 bp, Rattus norvegicus
agagccacagagtaggcggtgctct

SEQ ID NO: 113877 - DNA, 25 bp, Rattus norvegicus
agagccacagcacatcccctggaaa

SEQ ID NO: 113878 - DNA, 25 bp, Rattus norvegicus
agagccacagcagatcccctggaaa

SEQ ID NO: 113879 - DNA, 25 bp, Rattus norvegicus
agagccacagccctcgagccaccgg

SEQ ID NO: 113880 - DNA, 25 bp, Rattus norvegicus
agagccacagccgtcgagccaccgg

SEQ ID NO: 113881 - DNA, 25 bp, Rattus norvegicus
agagccacatcgactgggcacggca

SEQ ID NO: 113882 - DNA, 25 bp, Rattus norvegicus
agagccacatcgtctgggcacggca

SEQ ID NO: 113883 - DNA, 25 bp, Rattus norvegicus
agagccacatggagtcatcagcagt

SEQ ID NO: 113884 - DNA, 25 bp, Rattus norvegicus
agagccacatggtgtcatcagcagt

SEQ ID NO: 113885 - DNA, 25 bp, Rattus norvegicus
agagccacatttactaacctacaga

SEQ ID NO: 113886 - DNA, 25 bp, Rattus norvegicus
agagccacattttctaacctacaga

SEQ ID NO: 113887 - DNA, 25 bp, Rattus norvegicus
agagccaccagcaaagagacagtgt

SEQ ID NO: 113888 - DNA, 25 bp, Rattus norvegicus
agagccaccagctaagagacagtgt

SEQ ID NO: 113889 - DNA, 25 bp, Rattus norvegicus
agagccaccatgatgggttgcccag

SEQ ID NO: 113890 - DNA, 25 bp, Rattus norvegicus
agagccaccatgttgggttgcccag

SEQ ID NO: 113891 - DNA, 25 bp, Rattus norvegicus
agagccaccggcaagagctttgagg

SEQ ID NO: 113892 - DNA, 25 bp, Rattus norvegicus
agagccaccggctagagctttgagg

SEQ ID NO: 113893 - DNA, 25 bp, Rattus norvegicus
agagccacctctatactgtagcaaa

SEQ ID NO: 113894 - DNA, 25 bp, Rattus norvegicus
agagccacctctttactgtagcaaa

SEQ ID NO: 113895 - DNA, 25 bp, Rattus norvegicus
agagccacgagtatcacagccatga

SEQ ID NO: 113896 - DNA, 25 bp, Rattus norvegicus
agagccacgagtttcacagccatga

SEQ ID NO: 113897 - DNA, 25 bp, Rattus norvegicus
agagccacgcgcagtcctgcagggt

SEQ ID NO: 113898 - DNA, 25 bp, Rattus norvegicus
agagccacgcgctgtcctgcagggt

SEQ ID NO: 113899 - DNA, 25 bp, Rattus norvegicus
agagccacgcgtacggttatgtaaa

SEQ ID NO: 113900 - DNA, 25 bp, Rattus norvegicus
agagccacgcgttcggttatgtaaa

SEQ ID NO: 113901 - DNA, 25 bp, Rattus norvegicus
agagccacgctgaagtcacttactg

SEQ ID NO: 113902 - DNA, 25 bp, Rattus norvegicus
agagccacgctgtagtcacttactg

SEQ ID NO: 113903 - DNA, 25 bp, Rattus norvegicus
agagccacgtgcatccagaagtcat

SEQ ID NO: 113904 - DNA, 25 bp, Rattus norvegicus
agagccacgtgcttccagaagtcat

SEQ ID NO: 113905 - DNA, 25 bp, Rattus norvegicus
agagccactatgatgtcattcccag

SEQ ID NO: 113906 - DNA, 25 bp, Rattus norvegicus
agagccactatgttgtcattcccag

SEQ ID NO: 113907 - DNA, 25 bp, Rattus norvegicus
agagccactgtgctagcagggacat

SEQ ID NO: 113908 - DNA, 25 bp, Rattus norvegicus
agagccactgtggtagcagggacat

SEQ ID NO: 113909 - DNA, 25 bp, Rattus norvegicus
agagccactttactatttaccatcc

SEQ ID NO: 113910 - DNA, 25 bp, Rattus norvegicus
agagccactttagtatttaccatcc

SEQ ID NO: 113911 - DNA, 25 bp, Rattus norvegicus
agagccactttgagcagggttcttc

SEQ ID NO: 113912 - DNA, 25 bp, Rattus norvegicus
agagccactttgcatggcatgcagc

SEQ ID NO: 113913 - DNA, 25 bp, Rattus norvegicus
agagccactttggatggcatgcagc

SEQ ID NO: 113914 - DNA, 25 bp, Rattus norvegicus
agagccactttgtgcagggttcttc

SEQ ID NO: 113915 - DNA, 25 bp, Rattus norvegicus
agagccagaatcagccccagaaaat

SEQ ID NO: 113916 - DNA, 25 bp, Rattus norvegicus
agagccagaatctgccccagaaaat

SEQ ID NO: 113917 - DNA, 25 bp, Rattus norvegicus
agagccagacaaaggcagctccccg

SEQ ID NO: 113918 - DNA, 25 bp, Rattus norvegicus
agagccagacaatggcagctccccg

SEQ ID NO: 113919 - DNA, 25 bp, Rattus norvegicus
agagccagacctacctagggtgtct

SEQ ID NO: 113920 - DNA, 25 bp, Rattus norvegicus
agagccagaccttcctagggtgtct

SEQ ID NO: 113921 - DNA, 25 bp, Rattus norvegicus
agagccagatttagcctgtcagcgg

SEQ ID NO: 113922 - DNA, 25 bp, Rattus norvegicus
agagccagattttgcctgtcagcgg

SEQ ID NO: 113923 - DNA, 25 bp, Rattus norvegicus
agagccagcagcagatgcggaccaa

SEQ ID NO: 113924 - DNA, 25 bp, Rattus norvegicus
agagccagcagctgatgcggaccaa

SEQ ID NO: 113925 - DNA, 25 bp, Rattus norvegicus
agagccagcagtccaaatgccttgt

SEQ ID NO: 113926 - DNA, 25 bp, Rattus norvegicus
agagccagcagtgcaaatgccttgt

SEQ ID NO: 113927 - DNA, 25 bp, Rattus norvegicus
agagccagcatcagccttcaagatg

SEQ ID NO: 113928 - DNA, 25 bp, Rattus norvegicus
agagccagcatctgccttcaagatg

SEQ ID NO: 113929 - DNA, 25 bp, Rattus norvegicus
agagccagccccaactgttcaggag

SEQ ID NO: 113930 - DNA, 25 bp, Rattus norvegicus
agagccagcccctactgttcaggag

SEQ ID NO: 113931 - DNA, 25 bp, Rattus norvegicus
agagccagcctgcaatctgggcacc

SEQ ID NO: 113932 - DNA, 25 bp, Rattus norvegicus
agagccagcctggaatctgggcacc

SEQ ID NO: 113933 - DNA, 25 bp, Rattus norvegicus
agagccagcgttccaaaacttcatg

SEQ ID NO: 113934 - DNA, 25 bp, Rattus norvegicus
agagccagcgttgcaaaacttcatg

SEQ ID NO: 113935 - DNA, 25 bp, Rattus norvegicus
agagccagctatattctacacaaag

SEQ ID NO: 113936 - DNA, 25 bp, Rattus norvegicus
agagccagctattttctacacaaag

SEQ ID NO: 113937 - DNA, 25 bp, Rattus norvegicus
agagccagctccacagtgcagtctg

SEQ ID NO: 113938 - DNA, 25 bp, Rattus norvegicus
agagccagctcctcagtgcagtctg

SEQ ID NO: 113939 - DNA, 25 bp, Rattus norvegicus
agagccagctctactcactgtttat

SEQ ID NO: 113940 - DNA, 25 bp, Rattus norvegicus
agagccagctcttctcactgtttat

SEQ ID NO: 113941 - DNA, 25 bp, Rattus norvegicus
agagccagctgccatgcatttcgga

SEQ ID NO: 113942 - DNA, 25 bp, Rattus norvegicus
agagccagctgcgatgcatttcgga

SEQ ID NO: 113943 - DNA, 25 bp, Rattus norvegicus
agagccaggaccatggaccctcaga

SEQ ID NO: 113944 - DNA, 25 bp, Rattus norvegicus
agagccaggaccttggaccctcaga

SEQ ID NO: 113945 - DNA, 25 bp, Rattus norvegicus
agagccaggataccactgtgcccct

SEQ ID NO: 113946 - DNA, 25 bp, Rattus norvegicus
agagccaggatagcactgtgcccct

SEQ ID NO: 113947 - DNA, 25 bp, Rattus norvegicus
agagccaggatgacagcagccccat

SEQ ID NO: 113948 - DNA, 25 bp, Rattus norvegicus
agagccaggatgtcagcagccccat

SEQ ID NO: 113949 - DNA, 25 bp, Rattus norvegicus
agagccaggcatcccttaggaacat

SEQ ID NO: 113950 - DNA, 25 bp, Rattus norvegicus
agagccaggcatgccttaggaacat

SEQ ID NO: 113951 - DNA, 25 bp, Rattus norvegicus
agagccagggccacagtgaccatga

SEQ ID NO: 113952 - DNA, 25 bp, Rattus norvegicus
agagccagggccacgatctaggaca

SEQ ID NO: 113953 - DNA, 25 bp, Rattus norvegicus
agagccagggcctcagtgaccatga

SEQ ID NO: 113954 - DNA, 25 bp, Rattus norvegicus
agagccagggcctcgatctaggaca

SEQ ID NO: 113955 - DNA, 25 bp, Rattus norvegicus
agagccagtaaacaacagggtccct

SEQ ID NO: 113956 - DNA, 25 bp, Rattus norvegicus
agagccagtaaagaacagggtccct

SEQ ID NO: 113957 - DNA, 25 bp, Rattus norvegicus
agagccagtcaaagcctgcccaggc

SEQ ID NO: 113958 - DNA, 25 bp, Rattus norvegicus
agagccagtcaatgcctgcccaggc

SEQ ID NO: 113959 - DNA, 25 bp, Rattus norvegicus
agagccagtgagctcatcgtgtctg

SEQ ID NO: 113960 - DNA, 25 bp, Rattus norvegicus
agagccagtgaggtcatcgtgtctg

SEQ ID NO: 113961 - DNA, 25 bp, Rattus norvegicus
agagccagtgctcactcagcgtgga

SEQ ID NO: 113962 - DNA, 25 bp, Rattus norvegicus
agagccagtgctgactcagcgtgga

SEQ ID NO: 113963 - DNA, 25 bp, Rattus norvegicus
agagccatcaaaagcagtgctggga

SEQ ID NO: 113964 - DNA, 25 bp, Rattus norvegicus
agagccatcaaatgcagtgctggga

SEQ ID NO: 113965 - DNA, 25 bp, Rattus norvegicus
agagccatcatcataggattcctaa

SEQ ID NO: 113966 - DNA, 25 bp, Rattus norvegicus
agagccatcatccataagttacaag

SEQ ID NO: 113967 - DNA, 25 bp, Rattus norvegicus
agagccatcatcgataagttacaag

SEQ ID NO: 113968 - DNA, 25 bp, Rattus norvegicus
agagccatcatcttaggattcctaa

SEQ ID NO: 113969 - DNA, 25 bp, Rattus norvegicus
agagccatcattcctgtcagtatag

SEQ ID NO: 113970 - DNA, 25 bp, Rattus norvegicus
agagccatcattgctgtcagtatag

SEQ ID NO: 113971 - DNA, 25 bp, Rattus norvegicus
agagccatccctataaagccaacag

SEQ ID NO: 113972 - DNA, 25 bp, Rattus norvegicus
agagccatccctttaaagccaacag

SEQ ID NO: 113973 - DNA, 25 bp, Rattus norvegicus
agagccatcctaaccagagctgaca

SEQ ID NO: 113974 - DNA, 25 bp, Rattus norvegicus
agagccatcctatccagagctgaca

SEQ ID NO: 113975 - DNA, 25 bp, Rattus norvegicus
agagccatccttacttgtccagtgt

SEQ ID NO: 113976 - DNA, 25 bp, Rattus norvegicus
agagccatccttatgtattagtgag

SEQ ID NO: 113977 - DNA, 25 bp, Rattus norvegicus
agagccatcctttcttgtccagtgt

SEQ ID NO: 113978 - DNA, 25 bp, Rattus norvegicus
agagccatccttttgtattagtgag

SEQ ID NO: 113979 - DNA, 25 bp, Rattus norvegicus
agagccatctagctactgacactgc

SEQ ID NO: 113980 - DNA, 25 bp, Rattus norvegicus
agagccatctaggtactgacactgc

SEQ ID NO: 113981 - DNA, 25 bp, Rattus norvegicus
agagccatctcaagatgtatcccac

SEQ ID NO: 113982 - DNA, 25 bp, Rattus norvegicus
agagccatctcatgatgtatcccac

SEQ ID NO: 113983 - DNA, 25 bp, Rattus norvegicus
agagccatggttatatacccacgta

SEQ ID NO: 113984 - DNA, 25 bp, Rattus norvegicus
agagccatggttttatacccacgta

SEQ ID NO: 113985 - DNA, 25 bp, Rattus norvegicus
agagccatgtaacctgtctcgctgc

SEQ ID NO: 113986 - DNA, 25 bp, Rattus norvegicus
agagccatgtaagctgtctcgctgc

SEQ ID NO: 113987 - DNA, 25 bp, Rattus norvegicus
agagccatgtgcattacggcgtgtt

SEQ ID NO: 113988 - DNA, 25 bp, Rattus norvegicus
agagccatgtgctttacggcgtgtt

SEQ ID NO: 113989 - DNA, 25 bp, Rattus norvegicus
agagccatgtgtctttagcagcaag

SEQ ID NO: 113990 - DNA, 25 bp, Rattus norvegicus
agagccatgtgtgtttagcagcaag

SEQ ID NO: 113991 - DNA, 25 bp, Rattus norvegicus
agagccatgttcaaccaatgtccgt

SEQ ID NO: 113992 - DNA, 25 bp, Rattus norvegicus
agagccatgttctaccaatgtccgt

SEQ ID NO: 113993 - DNA, 25 bp, Rattus norvegicus
agagccattacaaccggcggacttt

SEQ ID NO: 113994 - DNA, 25 bp, Rattus norvegicus
agagccattacatccggcggacttt

SEQ ID NO: 113995 - DNA, 25 bp, Rattus norvegicus
agagccattgggacccttgtttatt

SEQ ID NO: 113996 - DNA, 25 bp, Rattus norvegicus
agagccattgggtcccttgtttatt

SEQ ID NO: 113997 - DNA, 25 bp, Rattus norvegicus
agagccattgtcctgcttagctttt

SEQ ID NO: 113998 - DNA, 25 bp, Rattus norvegicus
agagccattgtcgtgcttagctttt

SEQ ID NO: 113999 - DNA, 25 bp, Rattus norvegicus
agagccattttactcttcataatta

SEQ ID NO: 114000 - DNA, 25 bp, Rattus norvegicus
agagccattttagtcttcataatta

SEQ ID NO: 114001 - DNA, 25 bp, Rattus norvegicus
agagccattttcaaggtccctcaaa

SEQ ID NO: 114002 - DNA, 25 bp, Rattus norvegicus
agagccattttctaggtccctcaaa

SEQ ID NO: 114003 - DNA, 25 bp, Rattus norvegicus
agagcccaagcccaggacttaagaa

SEQ ID NO: 114004 - DNA, 25 bp, Rattus norvegicus
agagcccaagccgaggacttaagaa

SEQ ID NO: 114005 - DNA, 25 bp, Rattus norvegicus
agagcccaagtcaactggcagcata

SEQ ID NO: 114006 - DNA, 25 bp, Rattus norvegicus
agagcccaagtctactggcagcata

SEQ ID NO: 114007 - DNA, 25 bp, Rattus norvegicus
agagcccacaggaggaagatggcat

SEQ ID NO: 114008 - DNA, 25 bp, Rattus norvegicus
agagcccacaggtggaagatggcat

SEQ ID NO: 114009 - DNA, 25 bp, Rattus norvegicus
agagcccacattaagtcttctgatt

SEQ ID NO: 114010 - DNA, 25 bp, Rattus norvegicus
agagcccacattaggtggcgcagga

SEQ ID NO: 114011 - DNA, 25 bp, Rattus norvegicus
agagcccacatttagtcttctgatt

SEQ ID NO: 114012 - DNA, 25 bp, Rattus norvegicus
agagcccacatttggtggcgcagga

SEQ ID NO: 114013 - DNA, 25 bp, Rattus norvegicus
agagcccacgctagaggacatccga

SEQ ID NO: 114014 - DNA, 25 bp, Rattus norvegicus
agagcccacgcttgaggacatccga

SEQ ID NO: 114015 - DNA, 25 bp, Rattus norvegicus
agagcccactgtcactcagtcatta

SEQ ID NO: 114016 - DNA, 25 bp, Rattus norvegicus
agagcccactgtgactcagtcatta

SEQ ID NO: 114017 - DNA, 25 bp, Rattus norvegicus
agagcccagactacctggatatcac

SEQ ID NO: 114018 - DNA, 25 bp, Rattus norvegicus
agagcccagacttcctggatatcac

SEQ ID NO: 114019 - DNA, 25 bp, Rattus norvegicus
agagcccagcctcggatacttgaga

SEQ ID NO: 114020 - DNA, 25 bp, Rattus norvegicus
agagcccagcctgggatacttgaga

SEQ ID NO: 114021 - DNA, 25 bp, Rattus norvegicus
agagcccagggaactgacttccata

SEQ ID NO: 114022 - DNA, 25 bp, Rattus norvegicus
agagcccagggatctgacttccata

SEQ ID NO: 114023 - DNA, 25 bp, Rattus norvegicus
agagcccagggcagttgtctgtttc

SEQ ID NO: 114024 - DNA, 25 bp, Rattus norvegicus
agagcccagggctgttgtctgtttc

SEQ ID NO: 114025 - DNA, 25 bp, Rattus norvegicus
agagcccaggttctaggtctgtatc

SEQ ID NO: 114026 - DNA, 25 bp, Rattus norvegicus
agagcccaggttgtaggtctgtatc

SEQ ID NO: 114027 - DNA, 25 bp, Rattus norvegicus
agagcccagtttctgcacagtggag

SEQ ID NO: 114028 - DNA, 25 bp, Rattus norvegicus
agagcccagtttgtgcacagtggag

SEQ ID NO: 114029 - DNA, 25 bp, Rattus norvegicus
agagcccatcccaagaaactagaag

SEQ ID NO: 114030 - DNA, 25 bp, Rattus norvegicus
agagcccatccctagaaactagaag

SEQ ID NO: 114031 - DNA, 25 bp, Rattus norvegicus
agagcccatctcagagcaggagagc

SEQ ID NO: 114032 - DNA, 25 bp, Rattus norvegicus
agagcccatctctgagcaggagagc

SEQ ID NO: 114033 - DNA, 25 bp, Rattus norvegicus
agagcccatgctctattgctccata

SEQ ID NO: 114034 - DNA, 25 bp, Rattus norvegicus
agagcccatgctgtattgctccata

SEQ ID NO: 114035 - DNA, 25 bp, Rattus norvegicus
agagcccatgtgctcctttgtgtga

SEQ ID NO: 114036 - DNA, 25 bp, Rattus norvegicus
agagcccatgtggtcctttgtgtga

SEQ ID NO: 114037 - DNA, 25 bp, Rattus norvegicus
agagcccattacattagccttagct

SEQ ID NO: 114038 - DNA, 25 bp, Rattus norvegicus
agagcccattactttagccttagct

SEQ ID NO: 114039 - DNA, 25 bp, Rattus norvegicus
agagcccattttcatgtgctgcagg

SEQ ID NO: 114040 - DNA, 25 bp, Rattus norvegicus
agagcccattttcctcaacttcaga

SEQ ID NO: 114041 - DNA, 25 bp, Rattus norvegicus
agagcccattttgatgtgctgcagg

SEQ ID NO: 114042 - DNA, 25 bp, Rattus norvegicus
agagcccattttgctcaacttcaga

SEQ ID NO: 114043 - DNA, 25 bp, Rattus norvegicus
agagccccaaggactcttctgagta

SEQ ID NO: 114044 - DNA, 25 bp, Rattus norvegicus
agagccccaaggtctcttctgagta

SEQ ID NO: 114045 - DNA, 25 bp, Rattus norvegicus
agagccccagagagagcactgcaat

SEQ ID NO: 114046 - DNA, 25 bp, Rattus norvegicus
agagccccagagtgagcactgcaat

SEQ ID NO: 114047 - DNA, 25 bp, Rattus norvegicus
agagccccaggacaggcaacctcga

SEQ ID NO: 114048 - DNA, 25 bp, Rattus norvegicus
agagccccaggactgtgcatgaaca

SEQ ID NO: 114049 - DNA, 25 bp, Rattus norvegicus
agagccccaggagaggcaacctcga

SEQ ID NO: 114050 - DNA, 25 bp, Rattus norvegicus
agagccccaggagtgtgcatgaaca

SEQ ID NO: 114051 - DNA, 25 bp, Rattus norvegicus
agagccccatagcaggtatttccga

SEQ ID NO: 114052 - DNA, 25 bp, Rattus norvegicus
agagccccataggaggtatttccga

SEQ ID NO: 114053 - DNA, 25 bp, Rattus norvegicus
agagccccatctaaccgagtgaaag

SEQ ID NO: 114054 - DNA, 25 bp, Rattus norvegicus
agagccccatctctgtcagggaagg

SEQ ID NO: 114055 - DNA, 25 bp, Rattus norvegicus
agagccccatctgtgtcagggaagg

SEQ ID NO: 114056 - DNA, 25 bp, Rattus norvegicus
agagccccatcttaccgagtgaaag

SEQ ID NO: 114057 - DNA, 25 bp, Rattus norvegicus
agagcccccacgcaaaatgcaaaaa

SEQ ID NO: 114058 - DNA, 25 bp, Rattus norvegicus
agagcccccacggaaaatgcaaaaa

SEQ ID NO: 114059 - DNA, 25 bp, Rattus norvegicus
agagccccgcagaggttcttgtttt

SEQ ID NO: 114060 - DNA, 25 bp, Rattus norvegicus
agagccccgcagtggttcttgtttt

SEQ ID NO: 114061 - DNA, 25 bp, Rattus norvegicus
agagccccgcgcagagaaggagatc

SEQ ID NO: 114062 - DNA, 25 bp, Rattus norvegicus
agagccccgcgctgagaaggagatc

SEQ ID NO: 114063 - DNA, 25 bp, Rattus norvegicus
agagcccctcacagttcatccagag

SEQ ID NO: 114064 - DNA, 25 bp, Rattus norvegicus
agagcccctcactgttcatccagag

SEQ ID NO: 114065 - DNA, 25 bp, Rattus norvegicus
agagcccctcgaatcctaaggataa

SEQ ID NO: 114066 - DNA, 25 bp, Rattus norvegicus
agagcccctcgattcctaaggataa

SEQ ID NO: 114067 - DNA, 25 bp, Rattus norvegicus
agagcccctgccaaacatagctgac

SEQ ID NO: 114068 - DNA, 25 bp, Rattus norvegicus
agagcccctgcctaacatagctgac

SEQ ID NO: 114069 - DNA, 25 bp, Rattus norvegicus
agagcccctggcagagctacttgac

SEQ ID NO: 114070 - DNA, 25 bp, Rattus norvegicus
agagcccctggctgagctacttgac

SEQ ID NO: 114071 - DNA, 25 bp, Rattus norvegicus
agagccccttcaagtgtgatcctga

SEQ ID NO: 114072 - DNA, 25 bp, Rattus norvegicus
agagccccttcatgtgtgatcctga

SEQ ID NO: 114073 - DNA, 25 bp, Rattus norvegicus
agagccccttccctgcaggaagtga

SEQ ID NO: 114074 - DNA, 25 bp, Rattus norvegicus
agagccccttccgtgcaggaagtga

SEQ ID NO: 114075 - DNA, 25 bp, Rattus norvegicus
agagccccttgcagaagacaccgta

SEQ ID NO: 114076 - DNA, 25 bp, Rattus norvegicus
agagccccttgctgaagacaccgta

SEQ ID NO: 114077 - DNA, 25 bp, Rattus norvegicus
agagcccgaagaattctgagaaatg

SEQ ID NO: 114078 - DNA, 25 bp, Rattus norvegicus
agagcccgaagatttctgagaaatg

SEQ ID NO: 114079 - DNA, 25 bp, Rattus norvegicus
agagcccgacacctttgtgaacaag

SEQ ID NO: 114080 - DNA, 25 bp, Rattus norvegicus
agagcccgacacgtttgtgaacaag

SEQ ID NO: 114081 - DNA, 25 bp, Rattus norvegicus
agagcccgagccatgaagatcccat

SEQ ID NO: 114082 - DNA, 25 bp, Rattus norvegicus
agagcccgagccttgaagatcccat

SEQ ID NO: 114083 - DNA, 25 bp, Rattus norvegicus
agagcccgagtcctctggttacctg

SEQ ID NO: 114084 - DNA, 25 bp, Rattus norvegicus
agagcccgagtcgtctggttacctg

SEQ ID NO: 114085 - DNA, 25 bp, Rattus norvegicus
agagcccgatctaggattctgttcc

SEQ ID NO: 114086 - DNA, 25 bp, Rattus norvegicus
agagcccgatcttggattctgttcc

SEQ ID NO: 114087 - DNA, 25 bp, Rattus norvegicus
agagcccgcaataacacacgtcagt

SEQ ID NO: 114088 - DNA, 25 bp, Rattus norvegicus
agagcccgcaattacacacgtcagt

SEQ ID NO: 114089 - DNA, 25 bp, Rattus norvegicus
agagcccgcagaagaagctgaccct

SEQ ID NO: 114090 - DNA, 25 bp, Rattus norvegicus
agagcccgcagatgaagctgaccct

SEQ ID NO: 114091 - DNA, 25 bp, Rattus norvegicus
agagcccgcagtcagatagccgcgt

SEQ ID NO: 114092 - DNA, 25 bp, Rattus norvegicus
agagcccgcagtgagatagccgcgt

SEQ ID NO: 114093 - DNA, 25 bp, Rattus norvegicus
agagcccgcctactggagactgaag

SEQ ID NO: 114094 - DNA, 25 bp, Rattus norvegicus
agagcccgcctagtggagactgaag

SEQ ID NO: 114095 - DNA, 25 bp, Rattus norvegicus
agagcccgctgcaagagccttcggt

SEQ ID NO: 114096 - DNA, 25 bp, Rattus norvegicus
agagcccgctgctagagccttcggt

SEQ ID NO: 114097 - DNA, 25 bp, Rattus norvegicus
agagcccgggtcattttggtccctg

SEQ ID NO: 114098 - DNA, 25 bp, Rattus norvegicus
agagcccgggtctttttggtccctg

SEQ ID NO: 114099 - DNA, 25 bp, Rattus norvegicus
agagcccggtccattgtatcaggca

SEQ ID NO: 114100 - DNA, 25 bp, Rattus norvegicus
agagcccggtcctttgtatcaggca

SEQ ID NO: 114101 - DNA, 25 bp, Rattus norvegicus
agagcccggtgcagctaactttcgt

SEQ ID NO: 114102 - DNA, 25 bp, Rattus norvegicus
agagcccggtgctgctaactttcgt

SEQ ID NO: 114103 - DNA, 25 bp, Rattus norvegicus
agagcccgtctgaatgggcagcacc

SEQ ID NO: 114104 - DNA, 25 bp, Rattus norvegicus
agagcccgtctgtatgggcagcacc

SEQ ID NO: 114105 - DNA, 25 bp, Rattus norvegicus
agagcccgtcttcggcagaaatgat

SEQ ID NO: 114106 - DNA, 25 bp, Rattus norvegicus
agagcccgtcttgggcagaaatgat

SEQ ID NO: 114107 - DNA, 25 bp, Rattus norvegicus
agagcccgtggaacaagctggcagt

SEQ ID NO: 114108 - DNA, 25 bp, Rattus norvegicus
agagcccgtggatcaagctggcagt

SEQ ID NO: 114109 - DNA, 25 bp, Rattus norvegicus
agagcccgttaacaaagtcaccaat

SEQ ID NO: 114110 - DNA, 25 bp, Rattus norvegicus
agagcccgttaagaaagtcaccaat

SEQ ID NO: 114111 - DNA, 25 bp, Rattus norvegicus
agagccctagatcagaagattgcca

SEQ ID NO: 114112 - DNA, 25 bp, Rattus norvegicus
agagccctagatgagaagattgcca

SEQ ID NO: 114113 - DNA, 25 bp, Rattus norvegicus
agagccctagcaatgatacccacac

SEQ ID NO: 114114 - DNA, 25 bp, Rattus norvegicus
agagccctagcattgatacccacac

SEQ ID NO: 114115 - DNA, 25 bp, Rattus norvegicus
agagccctagtcctcgctagagttg

SEQ ID NO: 114116 - DNA, 25 bp, Rattus norvegicus
agagccctagtcgtcgctagagttg

SEQ ID NO: 114117 - DNA, 25 bp, Rattus norvegicus
agagccctcaagaacatgcaaagac

SEQ ID NO: 114118 - DNA, 25 bp, Rattus norvegicus
agagccctcaagtacatgcaaagac

SEQ ID NO: 114119 - DNA, 25 bp, Rattus norvegicus
agagccctcatcacagttcttaatt

SEQ ID NO: 114120 - DNA, 25 bp, Rattus norvegicus
agagccctcatctcagttcttaatt

SEQ ID NO: 114121 - DNA, 25 bp, Rattus norvegicus
agagccctcctgaaacatctagaag

SEQ ID NO: 114122 - DNA, 25 bp, Rattus norvegicus
agagccctcctgtaacatctagaag

SEQ ID NO: 114123 - DNA, 25 bp, Rattus norvegicus
agagccctcgtcattaaagtcgtcg

SEQ ID NO: 114124 - DNA, 25 bp, Rattus norvegicus
agagccctcgtctttaaagtcgtcg

SEQ ID NO: 114125 - DNA, 25 bp, Rattus norvegicus
agagccctctcaccctttagaagaa

SEQ ID NO: 114126 - DNA, 25 bp, Rattus norvegicus
agagccctctcagcctttagaagaa

SEQ ID NO: 114127 - DNA, 25 bp, Rattus norvegicus
agagccctgaatatctcaaccttgg

SEQ ID NO: 114128 - DNA, 25 bp, Rattus norvegicus
agagccctgaatttctcaaccttgg

SEQ ID NO: 114129 - DNA, 25 bp, Rattus norvegicus
agagccctgatcctagagaaccgaa

SEQ ID NO: 114130 - DNA, 25 bp, Rattus norvegicus
agagccctgatcgtagagaaccgaa

SEQ ID NO: 114131 - DNA, 25 bp, Rattus norvegicus
agagccctgatgcatgtctcctaag

SEQ ID NO: 114132 - DNA, 25 bp, Rattus norvegicus
agagccctgatggatgtctcctaag

SEQ ID NO: 114133 - DNA, 25 bp, Rattus norvegicus
agagccctgattacctttgctggga

SEQ ID NO: 114134 - DNA, 25 bp, Rattus norvegicus
agagccctgatttcctttgctggga

SEQ ID NO: 114135 - DNA, 25 bp, Rattus norvegicus
agagccctgcagaggttgagactgt

SEQ ID NO: 114136 - DNA, 25 bp, Rattus norvegicus
agagccctgcagtggttgagactgt

SEQ ID NO: 114137 - DNA, 25 bp, Rattus norvegicus
agagccctgcccaatgagctagaaa

SEQ ID NO: 114138 - DNA, 25 bp, Rattus norvegicus
agagccctgccctatgagctagaaa

SEQ ID NO: 114139 - DNA, 25 bp, Rattus norvegicus
agagccctgctaagaacttgtgttt

SEQ ID NO: 114140 - DNA, 25 bp, Rattus norvegicus
agagccctgctatgaacttgtgttt

SEQ ID NO: 114141 - DNA, 25 bp, Rattus norvegicus
agagccctggatctcctggtgaaaa

SEQ ID NO: 114142 - DNA, 25 bp, Rattus norvegicus
agagccctggatgtcctggtgaaaa

SEQ ID NO: 114143 - DNA, 25 bp, Rattus norvegicus
agagccctgggcctgtgtttctatg

SEQ ID NO: 114144 - DNA, 25 bp, Rattus norvegicus
agagccctgggcgtgtgtttctatg

SEQ ID NO: 114145 - DNA, 25 bp, Rattus norvegicus
agagccctggtacctgacagtgtaa

SEQ ID NO: 114146 - DNA, 25 bp, Rattus norvegicus
agagccctggtagctgacagtgtaa

SEQ ID NO: 114147 - DNA, 25 bp, Rattus norvegicus
agagccctgtggacaacaaggaggt

SEQ ID NO: 114148 - DNA, 25 bp, Rattus norvegicus
agagccctgtggtcaacaaggaggt

SEQ ID NO: 114149 - DNA, 25 bp, Rattus norvegicus
agagcccttatcatcaaccccagaa

SEQ ID NO: 114150 - DNA, 25 bp, Rattus norvegicus
agagcccttatcttcaaccccagaa

SEQ ID NO: 114151 - DNA, 25 bp, Rattus norvegicus
agagcccttcacacagtgggatact

SEQ ID NO: 114152 - DNA, 25 bp, Rattus norvegicus
agagcccttcactcagtgggatact

SEQ ID NO: 114153 - DNA, 25 bp, Rattus norvegicus
agagcccttgaacagctcgtgctca

SEQ ID NO: 114154 - DNA, 25 bp, Rattus norvegicus
agagcccttgaagagctcgtgctca

SEQ ID NO: 114155 - DNA, 25 bp, Rattus norvegicus
agagcccttgctcctcagtaaactt

SEQ ID NO: 114156 - DNA, 25 bp, Rattus norvegicus
agagcccttgctgctcagtaaactt

SEQ ID NO: 114157 - DNA, 25 bp, Rattus norvegicus
agagcccttggaagagtgcttgtcc

SEQ ID NO: 114158 - DNA, 25 bp, Rattus norvegicus
agagcccttggatgagtgcttgtcc

SEQ ID NO: 114159 - DNA, 25 bp, Rattus norvegicus
agagcccttggcaacactacatata

SEQ ID NO: 114160 - DNA, 25 bp, Rattus norvegicus
agagcccttggcaggtgctttattc

SEQ ID NO: 114161 - DNA, 25 bp, Rattus norvegicus
agagcccttggctacactacatata

SEQ ID NO: 114162 - DNA, 25 bp, Rattus norvegicus
agagcccttggctggtgctttattc

SEQ ID NO: 114163 - DNA, 25 bp, Rattus norvegicus
agagcccttgtccactgctgctgtg

SEQ ID NO: 114164 - DNA, 25 bp, Rattus norvegicus
agagcccttgtcgactgctgctgtg

SEQ ID NO: 114165 - DNA, 25 bp, Rattus norvegicus
agagccgagaccagccagccgcggt

SEQ ID NO: 114166 - DNA, 25 bp, Rattus norvegicus
agagccgagacctgccagccgcggt

SEQ ID NO: 114167 - DNA, 25 bp, Rattus norvegicus
agagccgagcaccaccggatggcca

SEQ ID NO: 114168 - DNA, 25 bp, Rattus norvegicus
agagccgagcacgaccggatggcca

SEQ ID NO: 114169 - DNA, 25 bp, Rattus norvegicus
agagccgagccccagagaatcagta

SEQ ID NO: 114170 - DNA, 25 bp, Rattus norvegicus
agagccgagcccgagagaatcagta

SEQ ID NO: 114171 - DNA, 25 bp, Rattus norvegicus
agagccgagcgaccagcttgtctaa

SEQ ID NO: 114172 - DNA, 25 bp, Rattus norvegicus
agagccgagcgagcagcttgtctaa

SEQ ID NO: 114173 - DNA, 25 bp, Rattus norvegicus
agagccgagcgcaaccgacagcagc

SEQ ID NO: 114174 - DNA, 25 bp, Rattus norvegicus
agagccgagcgctaccgacagcagc

SEQ ID NO: 114175 - DNA, 25 bp, Rattus norvegicus
agagccgagctcatcctaggaacat

SEQ ID NO: 114176 - DNA, 25 bp, Rattus norvegicus
agagccgagctcttcctaggaacat

SEQ ID NO: 114177 - DNA, 25 bp, Rattus norvegicus
agagccgagcttaacccaacactta

SEQ ID NO: 114178 - DNA, 25 bp, Rattus norvegicus
agagccgagctttacccaacactta

SEQ ID NO: 114179 - DNA, 25 bp, Rattus norvegicus
agagccgattgtcccaacgaggact

SEQ ID NO: 114180 - DNA, 25 bp, Rattus norvegicus
agagccgattgtgccaacgaggact

SEQ ID NO: 114181 - DNA, 25 bp, Rattus norvegicus
agagccgcacgcaccgagtttcggg

SEQ ID NO: 114182 - DNA, 25 bp, Rattus norvegicus
agagccgcacgctccgagtttcggg

SEQ ID NO: 114183 - DNA, 25 bp, Rattus norvegicus
agagccgcagctacaacgactgggt

SEQ ID NO: 114184 - DNA, 25 bp, Rattus norvegicus
agagccgcagcttcaacgactgggt

SEQ ID NO: 114185 - DNA, 25 bp, Rattus norvegicus
agagccgcgccaaggtgagatcctg

SEQ ID NO: 114186 - DNA, 25 bp, Rattus norvegicus
agagccgcgccatggtgagatcctg

SEQ ID NO: 114187 - DNA, 25 bp, Rattus norvegicus
agagccgctcctcgatggcacggat

SEQ ID NO: 114188 - DNA, 25 bp, Rattus norvegicus
agagccgctcctggatggcacggat

SEQ ID NO: 114189 - DNA, 25 bp, Rattus norvegicus
agagccgctctgctgccaggcaagc

SEQ ID NO: 114190 - DNA, 25 bp, Rattus norvegicus
agagccgctctggtgccaggcaagc

SEQ ID NO: 114191 - DNA, 25 bp, Rattus norvegicus
agagccgctgaaatctcgtagcaga

SEQ ID NO: 114192 - DNA, 25 bp, Rattus norvegicus
agagccgctgaattctcgtagcaga

SEQ ID NO: 114193 - DNA, 25 bp, Rattus norvegicus
agagccgctgctctgtatgtgacag

SEQ ID NO: 114194 - DNA, 25 bp, Rattus norvegicus
agagccgctgctgtgtatgtgacag

SEQ ID NO: 114195 - DNA, 25 bp, Rattus norvegicus
agagccggaactcgaacactcacca

SEQ ID NO: 114196 - DNA, 25 bp, Rattus norvegicus
agagccggaactggaacactcacca

SEQ ID NO: 114197 - DNA, 25 bp, Rattus norvegicus
agagccggactcatactcgctgttg

SEQ ID NO: 114198 - DNA, 25 bp, Rattus norvegicus
agagccggactcttactcgctgttg

SEQ ID NO: 114199 - DNA, 25 bp, Rattus norvegicus
agagccggaggcctcccttcctgtt

SEQ ID NO: 114200 - DNA, 25 bp, Rattus norvegicus
agagccggaggcgtcccttcctgtt

SEQ ID NO: 114201 - DNA, 25 bp, Rattus norvegicus
agagccggccacaattctaaagcag

SEQ ID NO: 114202 - DNA, 25 bp, Rattus norvegicus
agagccggccactattctaaagcag

SEQ ID NO: 114203 - DNA, 25 bp, Rattus norvegicus
agagccggctggcaaagctccgact

SEQ ID NO: 114204 - DNA, 25 bp, Rattus norvegicus
agagccggctgggaaagctccgact

SEQ ID NO: 114205 - DNA, 25 bp, Rattus norvegicus
agagccgggactacattttggcctt

SEQ ID NO: 114206 - DNA, 25 bp, Rattus norvegicus
agagccgggacttcattttggcctt

SEQ ID NO: 114207 - DNA, 25 bp, Rattus norvegicus
agagccgggctcatctgggaaggac

SEQ ID NO: 114208 - DNA, 25 bp, Rattus norvegicus
agagccgggctcttctgggaaggac

SEQ ID NO: 114209 - DNA, 25 bp, Rattus norvegicus
agagccggtcatactgtgtgtctcc

SEQ ID NO: 114210 - DNA, 25 bp, Rattus norvegicus
agagccggtcattctgtgtgtctcc

SEQ ID NO: 114211 - DNA, 25 bp, Rattus norvegicus
agagccggtgctagctgtgtgtttc

SEQ ID NO: 114212 - DNA, 25 bp, Rattus norvegicus
agagccggtgctcacattatcatca

SEQ ID NO: 114213 - DNA, 25 bp, Rattus norvegicus
agagccggtgctgacattatcatca

SEQ ID NO: 114214 - DNA, 25 bp, Rattus norvegicus
agagccggtgcttgctgtgtgtttc

SEQ ID NO: 114215 - DNA, 25 bp, Rattus norvegicus
agagccgtagctagaagccgtccaa

SEQ ID NO: 114216 - DNA, 25 bp, Rattus norvegicus
agagccgtagcttgaagccgtccaa

SEQ ID NO: 114217 - DNA, 25 bp, Rattus norvegicus
agagccgtctgactcagcctgctaa

SEQ ID NO: 114218 - DNA, 25 bp, Rattus norvegicus
agagccgtctgagtcagcctgctaa

SEQ ID NO: 114219 - DNA, 25 bp, Rattus norvegicus
agagccgtggacaagatcccgtcag

SEQ ID NO: 114220 - DNA, 25 bp, Rattus norvegicus
agagccgtggactagatcccgtcag

SEQ ID NO: 114221 - DNA, 25 bp, Rattus norvegicus
agagccgtgtgaacccatcgacagc

SEQ ID NO: 114222 - DNA, 25 bp, Rattus norvegicus
agagccgtgtgatcccatcgacagc

SEQ ID NO: 114223 - DNA, 25 bp, Rattus norvegicus
agagccgttcacacactgaagacag

SEQ ID NO: 114224 - DNA, 25 bp, Rattus norvegicus
agagccgttcactcactgaagacag

SEQ ID NO: 114225 - DNA, 25 bp, Rattus norvegicus
agagccgtttttccgctttcaataa

SEQ ID NO: 114226 - DNA, 25 bp, Rattus norvegicus
agagccgtttttgcgctttcaataa

SEQ ID NO: 114227 - DNA, 25 bp, Rattus norvegicus
agagcctaaataatccccacagatt

SEQ ID NO: 114228 - DNA, 25 bp, Rattus norvegicus
agagcctaaatattccccacagatt

SEQ ID NO: 114229 - DNA, 25 bp, Rattus norvegicus
agagcctaccacagcttctacaaaa

SEQ ID NO: 114230 - DNA, 25 bp, Rattus norvegicus
agagcctaccactgcttctacaaaa

SEQ ID NO: 114231 - DNA, 25 bp, Rattus norvegicus
agagcctacctacagccatgttgtc

SEQ ID NO: 114232 - DNA, 25 bp, Rattus norvegicus
agagcctacctagagccatgttgtc

SEQ ID NO: 114233 - DNA, 25 bp, Rattus norvegicus
agagcctactgaagaatgctttagc

SEQ ID NO: 114234 - DNA, 25 bp, Rattus norvegicus
agagcctactgatgaatgctttagc

SEQ ID NO: 114235 - DNA, 25 bp, Rattus norvegicus
agagcctagagtcctggagcagtcc

SEQ ID NO: 114236 - DNA, 25 bp, Rattus norvegicus
agagcctagagtgctggagcagtcc

SEQ ID NO: 114237 - DNA, 25 bp, Rattus norvegicus
agagcctaggtccttgtgcatgctg

SEQ ID NO: 114238 - DNA, 25 bp, Rattus norvegicus
agagcctaggtcgttgtgcatgctg

SEQ ID NO: 114239 - DNA, 25 bp, Rattus norvegicus
agagcctatgctcgaccttctgaag

SEQ ID NO: 114240 - DNA, 25 bp, Rattus norvegicus
agagcctatgctggaccttctgaag

SEQ ID NO: 114241 - DNA, 25 bp, Rattus norvegicus
agagcctatttaatccctgtacact

SEQ ID NO: 114242 - DNA, 25 bp, Rattus norvegicus
agagcctatttattccctgtacact

SEQ ID NO: 114243 - DNA, 25 bp, Rattus norvegicus
agagcctcaaaactacagccaacag

SEQ ID NO: 114244 - DNA, 25 bp, Rattus norvegicus
agagcctcaaaagtacagccaacag

SEQ ID NO: 114245 - DNA, 25 bp, Rattus norvegicus
agagcctcaaacacataggcacaag

SEQ ID NO: 114246 - DNA, 25 bp, Rattus norvegicus
agagcctcaaactcataggcacaag

SEQ ID NO: 114247 - DNA, 25 bp, Rattus norvegicus
agagcctcaacaatctggatgtcgt

SEQ ID NO: 114248 - DNA, 25 bp, Rattus norvegicus
agagcctcaacattctggatgtcgt

SEQ ID NO: 114249 - DNA, 25 bp, Rattus norvegicus
agagcctcaaggagagcccacagag

SEQ ID NO: 114250 - DNA, 25 bp, Rattus norvegicus
agagcctcaaggctgcctattcctt

SEQ ID NO: 114251 - DNA, 25 bp, Rattus norvegicus
agagcctcaagggtgcctattcctt

SEQ ID NO: 114252 - DNA, 25 bp, Rattus norvegicus
agagcctcaaggtgagcccacagag

SEQ ID NO: 114253 - DNA, 25 bp, Rattus norvegicus
agagcctcacggcaacagcagaaca

SEQ ID NO: 114254 - DNA, 25 bp, Rattus norvegicus
agagcctcacgggaacagcagaaca

SEQ ID NO: 114255 - DNA, 25 bp, Rattus norvegicus
agagcctcagccacagtgaatatca

SEQ ID NO: 114256 - DNA, 25 bp, Rattus norvegicus
agagcctcagcctcagtgaatatca

SEQ ID NO: 114257 - DNA, 25 bp, Rattus norvegicus
agagcctcagtgctaatggccggcc

SEQ ID NO: 114258 - DNA, 25 bp, Rattus norvegicus
agagcctcagtggtaatggccggcc

SEQ ID NO: 114259 - DNA, 25 bp, Rattus norvegicus
agagcctcatcgacatggccaagta

SEQ ID NO: 114260 - DNA, 25 bp, Rattus norvegicus
agagcctcatcgtcatggccaagta

SEQ ID NO: 114261 - DNA, 25 bp, Rattus norvegicus
agagcctccactatgcagtagcaaa

SEQ ID NO: 114262 - DNA, 25 bp, Rattus norvegicus
agagcctccactttgcagtagcaaa

SEQ ID NO: 114263 - DNA, 25 bp, Rattus norvegicus
agagcctcccgcaggagacagtttg

SEQ ID NO: 114264 - DNA, 25 bp, Rattus norvegicus
agagcctcccgctggagacagtttg

SEQ ID NO: 114265 - DNA, 25 bp, Rattus norvegicus
agagcctcccggatgaactctactt

SEQ ID NO: 114266 - DNA, 25 bp, Rattus norvegicus
agagcctcccggttgaactctactt

SEQ ID NO: 114267 - DNA, 25 bp, Rattus norvegicus
agagcctcctctacatggctgtaag

SEQ ID NO: 114268 - DNA, 25 bp, Rattus norvegicus
agagcctcctcttcatggctgtaag

SEQ ID NO: 114269 - DNA, 25 bp, Rattus norvegicus
agagcctcctgaagcgggcatccag

SEQ ID NO: 114270 - DNA, 25 bp, Rattus norvegicus
agagcctcctgatgcgggcatccag

SEQ ID NO: 114271 - DNA, 25 bp, Rattus norvegicus
agagcctccttacctatgctatggg

SEQ ID NO: 114272 - DNA, 25 bp, Rattus norvegicus
agagcctccttagctatgctatggg

SEQ ID NO: 114273 - DNA, 25 bp, Rattus norvegicus
agagcctccttgctgtatcaatgag

SEQ ID NO: 114274 - DNA, 25 bp, Rattus norvegicus
agagcctccttggtgtatcaatgag

SEQ ID NO: 114275 - DNA, 25 bp, Rattus norvegicus
agagcctcctttagtactaattact

SEQ ID NO: 114276 - DNA, 25 bp, Rattus norvegicus
agagcctccttttgtactaattact

SEQ ID NO: 114277 - DNA, 25 bp, Rattus norvegicus
agagcctcgagaacagatgccatct

SEQ ID NO: 114278 - DNA, 25 bp, Rattus norvegicus
agagcctcgagatcagatgccatct

SEQ ID NO: 114279 - DNA, 25 bp, Rattus norvegicus
agagcctcgattatcctggtcaggg

SEQ ID NO: 114280 - DNA, 25 bp, Rattus norvegicus
agagcctcgattttcctggtcaggg

SEQ ID NO: 114281 - DNA, 25 bp, Rattus norvegicus
agagcctcgggcacaggtcataaca

SEQ ID NO: 114282 - DNA, 25 bp, Rattus norvegicus
agagcctcgggctcaggtcataaca

SEQ ID NO: 114283 - DNA, 25 bp, Rattus norvegicus
agagcctcgtccagcgcgggcggaa

SEQ ID NO: 114284 - DNA, 25 bp, Rattus norvegicus
agagcctcgtcctgcgcgggcggaa

SEQ ID NO: 114285 - DNA, 25 bp, Rattus norvegicus
agagcctcgtgtactggcatggcag

SEQ ID NO: 114286 - DNA, 25 bp, Rattus norvegicus
agagcctcgtgtctgctaggtaagc

SEQ ID NO: 114287 - DNA, 25 bp, Rattus norvegicus
agagcctcgtgtgtgctaggtaagc

SEQ ID NO: 114288 - DNA, 25 bp, Rattus norvegicus
agagcctcgtgttctggcatggcag

SEQ ID NO: 114289 - DNA, 25 bp, Rattus norvegicus
agagcctctctcagaaagtcatgca

SEQ ID NO: 114290 - DNA, 25 bp, Rattus norvegicus
agagcctctctctgaaagtcatgca

SEQ ID NO: 114291 - DNA, 25 bp, Rattus norvegicus
agagcctctctgaagggctaccagt

SEQ ID NO: 114292 - DNA, 25 bp, Rattus norvegicus
agagcctctctgtagggctaccagt

SEQ ID NO: 114293 - DNA, 25 bp, Rattus norvegicus
agagcctctgagatactctccagca

SEQ ID NO: 114294 - DNA, 25 bp, Rattus norvegicus
agagcctctgagttactctccagca

SEQ ID NO: 114295 - DNA, 25 bp, Rattus norvegicus
agagcctctgcaagtaatcgttcaa

SEQ ID NO: 114296 - DNA, 25 bp, Rattus norvegicus
agagcctctgcatgtaatcgttcaa

SEQ ID NO: 114297 - DNA, 25 bp, Rattus norvegicus
agagcctctgccaaggagccggaaa

SEQ ID NO: 114298 - DNA, 25 bp, Rattus norvegicus
agagcctctgcctaggagccggaaa

SEQ ID NO: 114299 - DNA, 25 bp, Rattus norvegicus
agagcctcttcacctaggtacaaaa

SEQ ID NO: 114300 - DNA, 25 bp, Rattus norvegicus
agagcctcttcagctaggtacaaaa

SEQ ID NO: 114301 - DNA, 25 bp, Rattus norvegicus
agagcctgaaccattgggtgaccgg

SEQ ID NO: 114302 - DNA, 25 bp, Rattus norvegicus
agagcctgaacctttgggtgaccgg

SEQ ID NO: 114303 - DNA, 25 bp, Rattus norvegicus
agagcctgaatgcttgtttcacaaa

SEQ ID NO: 114304 - DNA, 25 bp, Rattus norvegicus
agagcctgaatggttgtttcacaaa

SEQ ID NO: 114305 - DNA, 25 bp, Rattus norvegicus
agagcctgactcactagcatctgaa

SEQ ID NO: 114306 - DNA, 25 bp, Rattus norvegicus
agagcctgactctctagcatctgaa

SEQ ID NO: 114307 - DNA, 25 bp, Rattus norvegicus
agagcctgagccagggaacctcgaa

SEQ ID NO: 114308 - DNA, 25 bp, Rattus norvegicus
agagcctgagcctgggaacctcgaa

SEQ ID NO: 114309 - DNA, 25 bp, Rattus norvegicus
agagcctgagtgaattccacctgag

SEQ ID NO: 114310 - DNA, 25 bp, Rattus norvegicus
agagcctgagtgtattccacctgag

SEQ ID NO: 114311 - DNA, 25 bp, Rattus norvegicus
agagcctgatgcactgctcgggaga

SEQ ID NO: 114312 - DNA, 25 bp, Rattus norvegicus
agagcctgatgctctgctcgggaga

SEQ ID NO: 114313 - DNA, 25 bp, Rattus norvegicus
agagcctgatggaaccctgttgagt

SEQ ID NO: 114314 - DNA, 25 bp, Rattus norvegicus
agagcctgatggtaccctgttgagt

SEQ ID NO: 114315 - DNA, 25 bp, Rattus norvegicus
agagcctgcaagacgtcatttgaat

SEQ ID NO: 114316 - DNA, 25 bp, Rattus norvegicus
agagcctgcaagtcgtcatttgaat

SEQ ID NO: 114317 - DNA, 25 bp, Rattus norvegicus
agagcctgcactctcgcagatcagt

SEQ ID NO: 114318 - DNA, 25 bp, Rattus norvegicus
agagcctgcactgtcgcagatcagt

SEQ ID NO: 114319 - DNA, 25 bp, Rattus norvegicus
agagcctgcagaatgttccggagtc

SEQ ID NO: 114320 - DNA, 25 bp, Rattus norvegicus
agagcctgcagattgttccggagtc

SEQ ID NO: 114321 - DNA, 25 bp, Rattus norvegicus
agagcctgccagatttatctcgttt

SEQ ID NO: 114322 - DNA, 25 bp, Rattus norvegicus
agagcctgccagttttatctcgttt

SEQ ID NO: 114323 - DNA, 25 bp, Rattus norvegicus
agagcctgccctccggaagagacaa

SEQ ID NO: 114324 - DNA, 25 bp, Rattus norvegicus
agagcctgccctgcggaagagacaa

SEQ ID NO: 114325 - DNA, 25 bp, Rattus norvegicus
agagcctgctgaccagactgcctgg

SEQ ID NO: 114326 - DNA, 25 bp, Rattus norvegicus
agagcctgctgagcagactgcctgg

SEQ ID NO: 114327 - DNA, 25 bp, Rattus norvegicus
agagcctgctgccacacaaggctgc

SEQ ID NO: 114328 - DNA, 25 bp, Rattus norvegicus
agagcctgctgcgacacaaggctgc

SEQ ID NO: 114329 - DNA, 25 bp, Rattus norvegicus
agagcctgcttgagactgtctatat

SEQ ID NO: 114330 - DNA, 25 bp, Rattus norvegicus
agagcctgcttgtgactgtctatat

SEQ ID NO: 114331 - DNA, 25 bp, Rattus norvegicus
agagcctggagcattcctggatcaa

SEQ ID NO: 114332 - DNA, 25 bp, Rattus norvegicus
agagcctggagctttcctggatcaa

SEQ ID NO: 114333 - DNA, 25 bp, Rattus norvegicus
agagcctggaggaccaaccgcagta

SEQ ID NO: 114334 - DNA, 25 bp, Rattus norvegicus
agagcctggaggtccaaccgcagta

SEQ ID NO: 114335 - DNA, 25 bp, Rattus norvegicus
agagcctggccgctttgttgtcgtt

SEQ ID NO: 114336 - DNA, 25 bp, Rattus norvegicus
agagcctggccggtttgttgtcgtt

SEQ ID NO: 114337 - DNA, 25 bp, Rattus norvegicus
agagcctggctgagctgctatcgtt

SEQ ID NO: 114338 - DNA, 25 bp, Rattus norvegicus
agagcctggctgtgctgctatcgtt

SEQ ID NO: 114339 - DNA, 25 bp, Rattus norvegicus
agagcctgggaacgtgcattttgca

SEQ ID NO: 114340 - DNA, 25 bp, Rattus norvegicus
agagcctgggaaggtgcattttgca

SEQ ID NO: 114341 - DNA, 25 bp, Rattus norvegicus
agagcctgggacacgtagatcctca

SEQ ID NO: 114342 - DNA, 25 bp, Rattus norvegicus
agagcctgggactcgtagatcctca

SEQ ID NO: 114343 - DNA, 25 bp, Rattus norvegicus
agagcctgggatacttcagctccct

SEQ ID NO: 114344 - DNA, 25 bp, Rattus norvegicus
agagcctgggattcttcagctccct

SEQ ID NO: 114345 - DNA, 25 bp, Rattus norvegicus
agagcctgggctacataaaactttg

SEQ ID NO: 114346 - DNA, 25 bp, Rattus norvegicus
agagcctgggcttcataaaactttg

SEQ ID NO: 114347 - DNA, 25 bp, Rattus norvegicus
agagcctggtctcgacacttcttcc

SEQ ID NO: 114348 - DNA, 25 bp, Rattus norvegicus
agagcctggtctggacacttcttcc

SEQ ID NO: 114349 - DNA, 25 bp, Rattus norvegicus
agagcctggtgaccaagggcaccct

SEQ ID NO: 114350 - DNA, 25 bp, Rattus norvegicus
agagcctggtgagcaagggcaccct

SEQ ID NO: 114351 - DNA, 25 bp, Rattus norvegicus
agagcctgtctcaaagcgacaagaa

SEQ ID NO: 114352 - DNA, 25 bp, Rattus norvegicus
agagcctgtctcagggaattgcccc

SEQ ID NO: 114353 - DNA, 25 bp, Rattus norvegicus
agagcctgtctctaagcgacaagaa

SEQ ID NO: 114354 - DNA, 25 bp, Rattus norvegicus
agagcctgtctctgggaattgcccc

SEQ ID NO: 114355 - DNA, 25 bp, Rattus norvegicus
agagcctgtctgattgttagaccaa

SEQ ID NO: 114356 - DNA, 25 bp, Rattus norvegicus
agagcctgtctgtttgttagaccaa

SEQ ID NO: 114357 - DNA, 25 bp, Rattus norvegicus
agagcctgtcttcgttccggaagaa

SEQ ID NO: 114358 - DNA, 25 bp, Rattus norvegicus
agagcctgtcttggttccggaagaa

SEQ ID NO: 114359 - DNA, 25 bp, Rattus norvegicus
agagcctgtgagctggctttgacac

SEQ ID NO: 114360 - DNA, 25 bp, Rattus norvegicus
agagcctgtgaggtggctttgacac

SEQ ID NO: 114361 - DNA, 25 bp, Rattus norvegicus
agagcctgtgcaaccgtgttctggc

SEQ ID NO: 114362 - DNA, 25 bp, Rattus norvegicus
agagcctgtgcatccgtgttctggc

SEQ ID NO: 114363 - DNA, 25 bp, Rattus norvegicus
agagcctgtgccatgcttcagcaga

SEQ ID NO: 114364 - DNA, 25 bp, Rattus norvegicus
agagcctgtgccttgcttcagcaga

SEQ ID NO: 114365 - DNA, 25 bp, Rattus norvegicus
agagcctgtgcgattggatccttga

SEQ ID NO: 114366 - DNA, 25 bp, Rattus norvegicus
agagcctgtgcgtttggatccttga

SEQ ID NO: 114367 - DNA, 25 bp, Rattus norvegicus
agagcctgtgctcaagcactctgca

SEQ ID NO: 114368 - DNA, 25 bp, Rattus norvegicus
agagcctgtgctgaagcactctgca

SEQ ID NO: 114369 - DNA, 25 bp, Rattus norvegicus
agagcctgtggcactctggacagtg

SEQ ID NO: 114370 - DNA, 25 bp, Rattus norvegicus
agagcctgtggcattgctgtcatgt

SEQ ID NO: 114371 - DNA, 25 bp, Rattus norvegicus
agagcctgtggctctctggacagtg

SEQ ID NO: 114372 - DNA, 25 bp, Rattus norvegicus
agagcctgtggctttgctgtcatgt

SEQ ID NO: 114373 - DNA, 25 bp, Rattus norvegicus
agagcctgttcaacgggatttccac

SEQ ID NO: 114374 - DNA, 25 bp, Rattus norvegicus
agagcctgttcatcgggatttccac

SEQ ID NO: 114375 - DNA, 25 bp, Rattus norvegicus
agagccttacgaagttactacgtga

SEQ ID NO: 114376 - DNA, 25 bp, Rattus norvegicus
agagccttacgatgttactacgtga

SEQ ID NO: 114377 - DNA, 25 bp, Rattus norvegicus
agagccttagagacaatactcgtaa

SEQ ID NO: 114378 - DNA, 25 bp, Rattus norvegicus
agagccttagagtcaatactcgtaa

SEQ ID NO: 114379 - DNA, 25 bp, Rattus norvegicus
agagccttcaaacccatatcctcag

SEQ ID NO: 114380 - DNA, 25 bp, Rattus norvegicus
agagccttcaaagccatatcctcag

SEQ ID NO: 114381 - DNA, 25 bp, Rattus norvegicus
agagccttcagcattttctgtgcat

SEQ ID NO: 114382 - DNA, 25 bp, Rattus norvegicus
agagccttcagctttttctgtgcat

SEQ ID NO: 114383 - DNA, 25 bp, Rattus norvegicus
agagccttcattagcctttcagatg

SEQ ID NO: 114384 - DNA, 25 bp, Rattus norvegicus
agagccttcatttgcctttcagatg

SEQ ID NO: 114385 - DNA, 25 bp, Rattus norvegicus
agagccttccagatttacatagacc

SEQ ID NO: 114386 - DNA, 25 bp, Rattus norvegicus
agagccttccagttttacatagacc

SEQ ID NO: 114387 - DNA, 25 bp, Rattus norvegicus
agagccttccctagcaggactgtag

SEQ ID NO: 114388 - DNA, 25 bp, Rattus norvegicus
agagccttcccttgcaggactgtag

SEQ ID NO: 114389 - DNA, 25 bp, Rattus norvegicus
agagccttcctgacgactaacctag

SEQ ID NO: 114390 - DNA, 25 bp, Rattus norvegicus
agagccttcctgtcgactaacctag

SEQ ID NO: 114391 - DNA, 25 bp, Rattus norvegicus
agagccttccttaggttcaggcact

SEQ ID NO: 114392 - DNA, 25 bp, Rattus norvegicus
agagccttcctttggttcaggcact

SEQ ID NO: 114393 - DNA, 25 bp, Rattus norvegicus
agagccttcggtcagacgcttcgtg

SEQ ID NO: 114394 - DNA, 25 bp, Rattus norvegicus
agagccttcggtgagacgcttcgtg

SEQ ID NO: 114395 - DNA, 25 bp, Rattus norvegicus
agagccttctaacaaacctgtcctc

SEQ ID NO: 114396 - DNA, 25 bp, Rattus norvegicus
agagccttctaagaaacctgtcctc

SEQ ID NO: 114397 - DNA, 25 bp, Rattus norvegicus
agagccttctgcagtgttcacaggt

SEQ ID NO: 114398 - DNA, 25 bp, Rattus norvegicus
agagccttctgccttttattcctgc

SEQ ID NO: 114399 - DNA, 25 bp, Rattus norvegicus
agagccttctgcgttttattcctgc

SEQ ID NO: 114400 - DNA, 25 bp, Rattus norvegicus
agagccttctgctgtgttcacaggt

SEQ ID NO: 114401 - DNA, 25 bp, Rattus norvegicus
agagccttgaggatctttccctgac

SEQ ID NO: 114402 - DNA, 25 bp, Rattus norvegicus
agagccttgaggttctttccctgac

SEQ ID NO: 114403 - DNA, 25 bp, Rattus norvegicus
agagccttgcaaccattctcaggat

SEQ ID NO: 114404 - DNA, 25 bp, Rattus norvegicus
agagccttgcaacccacagactttg

SEQ ID NO: 114405 - DNA, 25 bp, Rattus norvegicus
agagccttgcaagcattctcaggat

SEQ ID NO: 114406 - DNA, 25 bp, Rattus norvegicus
agagccttgcaagccacagactttg

SEQ ID NO: 114407 - DNA, 25 bp, Rattus norvegicus
agagccttgctaatgttctttccgg

SEQ ID NO: 114408 - DNA, 25 bp, Rattus norvegicus
agagccttgctattgttctttccgg

SEQ ID NO: 114409 - DNA, 25 bp, Rattus norvegicus
agagccttgctgaaaccggtgcact

SEQ ID NO: 114410 - DNA, 25 bp, Rattus norvegicus
agagccttgctgtaaccggtgcact

SEQ ID NO: 114411 - DNA, 25 bp, Rattus norvegicus
agagccttgcttctgttctgtaagc

SEQ ID NO: 114412 - DNA, 25 bp, Rattus norvegicus
agagccttgcttgtgttctgtaagc

SEQ ID NO: 114413 - DNA, 25 bp, Rattus norvegicus
agagccttggacaaacttaccccat

SEQ ID NO: 114414 - DNA, 25 bp, Rattus norvegicus
agagccttggactaacttaccccat

SEQ ID NO: 114415 - DNA, 25 bp, Rattus norvegicus
agagccttggagagtctgctagtca

SEQ ID NO: 114416 - DNA, 25 bp, Rattus norvegicus
agagccttggagtgtctgctagtca

SEQ ID NO: 114417 - DNA, 25 bp, Rattus norvegicus
agagccttggccatgaactactgtg

SEQ ID NO: 114418 - DNA, 25 bp, Rattus norvegicus
agagccttggccttgaactactgtg

SEQ ID NO: 114419 - DNA, 25 bp, Rattus norvegicus
agagccttgggacctgggactccat

SEQ ID NO: 114420 - DNA, 25 bp, Rattus norvegicus
agagccttgggagctgggactccat

SEQ ID NO: 114421 - DNA, 25 bp, Rattus norvegicus
agagccttggtgaacgacattgtat

SEQ ID NO: 114422 - DNA, 25 bp, Rattus norvegicus
agagccttggtgtacgacattgtat

SEQ ID NO: 114423 - DNA, 25 bp, Rattus norvegicus
agagccttggttaatcctgtatcgt

SEQ ID NO: 114424 - DNA, 25 bp, Rattus norvegicus
agagccttggtttatcctgtatcgt

SEQ ID NO: 114425 - DNA, 25 bp, Rattus norvegicus
agagccttgtggagtctggtcagca

SEQ ID NO: 114426 - DNA, 25 bp, Rattus norvegicus
agagccttgtggtgtctggtcagca

SEQ ID NO: 114427 - DNA, 25 bp, Rattus norvegicus
agagcctttcctatgtctcatatct

SEQ ID NO: 114428 - DNA, 25 bp, Rattus norvegicus
agagcctttcctttgtctcatatct

SEQ ID NO: 114429 - DNA, 25 bp, Rattus norvegicus
agagcctttggactcattcattcat

SEQ ID NO: 114430 - DNA, 25 bp, Rattus norvegicus
agagcctttggagtcattcattcat

SEQ ID NO: 114431 - DNA, 25 bp, Rattus norvegicus
agagcgaagcacagccgttagtgta

SEQ ID NO: 114432 - DNA, 25 bp, Rattus norvegicus
agagcgaagcactgccgttagtgta

SEQ ID NO: 114433 - DNA, 25 bp, Rattus norvegicus
agagcgaaggctctgtgctccgaac

SEQ ID NO: 114434 - DNA, 25 bp, Rattus norvegicus
agagcgaaggctgtgtgctccgaac

SEQ ID NO: 114435 - DNA, 25 bp, Rattus norvegicus
agagcgaatctcatctggagttcag

SEQ ID NO: 114436 - DNA, 25 bp, Rattus norvegicus
agagcgaatctcttctggagttcag

SEQ ID NO: 114437 - DNA, 25 bp, Rattus norvegicus
agagcgacagctactccgggttcag

SEQ ID NO: 114438 - DNA, 25 bp, Rattus norvegicus
agagcgacagcttctccgggttcag

SEQ ID NO: 114439 - DNA, 25 bp, Rattus norvegicus
agagcgacgagcaggactccaagat

SEQ ID NO: 114440 - DNA, 25 bp, Rattus norvegicus
agagcgacgagctggactccaagat

SEQ ID NO: 114441 - DNA, 25 bp, Rattus norvegicus
agagcgacgattccatttttcacag

SEQ ID NO: 114442 - DNA, 25 bp, Rattus norvegicus
agagcgacgattgcatttttcacag

SEQ ID NO: 114443 - DNA, 25 bp, Rattus norvegicus
agagcgactgtcacaggaatgcccc

SEQ ID NO: 114444 - DNA, 25 bp, Rattus norvegicus
agagcgactgtccttctatgagact

SEQ ID NO: 114445 - DNA, 25 bp, Rattus norvegicus
agagcgactgtcgttctatgagact

SEQ ID NO: 114446 - DNA, 25 bp, Rattus norvegicus
agagcgactgtctcaggaatgcccc

SEQ ID NO: 114447 - DNA, 25 bp, Rattus norvegicus
agagcgactgtgcatgtgccgccat

SEQ ID NO: 114448 - DNA, 25 bp, Rattus norvegicus
agagcgactgtggatgtgccgccat

SEQ ID NO: 114449 - DNA, 25 bp, Rattus norvegicus
agagcgactgttatttcatcccaat

SEQ ID NO: 114450 - DNA, 25 bp, Rattus norvegicus
agagcgactgttttttcatcccaat

SEQ ID NO: 114451 - DNA, 25 bp, Rattus norvegicus
agagcgacttggcacaggacagttt

SEQ ID NO: 114452 - DNA, 25 bp, Rattus norvegicus
agagcgacttgggacaggacagttt

SEQ ID NO: 114453 - DNA, 25 bp, Rattus norvegicus
agagcgagccacacaagggactgga

SEQ ID NO: 114454 - DNA, 25 bp, Rattus norvegicus
agagcgagccactcaagggactgga

SEQ ID NO: 114455 - DNA, 25 bp, Rattus norvegicus
agagcgagcgagatctttagagaga

SEQ ID NO: 114456 - DNA, 25 bp, Rattus norvegicus
agagcgagcgagttctttagagaga

SEQ ID NO: 114457 - DNA, 25 bp, Rattus norvegicus
agagcgagcgcgagtttctcattgt

SEQ ID NO: 114458 - DNA, 25 bp, Rattus norvegicus
agagcgagcgcgtgtttctcattgt

SEQ ID NO: 114459 - DNA, 25 bp, Rattus norvegicus
agagcgaggaggatttcctacggca

SEQ ID NO: 114460 - DNA, 25 bp, Rattus norvegicus
agagcgaggaggttttcctacggca

SEQ ID NO: 114461 - DNA, 25 bp, Rattus norvegicus
agagcgagtcacagcggtcctagct

SEQ ID NO: 114462 - DNA, 25 bp, Rattus norvegicus
agagcgagtcactgcggtcctagct

SEQ ID NO: 114463 - DNA, 25 bp, Rattus norvegicus
agagcgatacccagggagatcccta

SEQ ID NO: 114464 - DNA, 25 bp, Rattus norvegicus
agagcgataccctgggagatcccta

SEQ ID NO: 114465 - DNA, 25 bp, Rattus norvegicus
agagcgatcaagacacctggcctca

SEQ ID NO: 114466 - DNA, 25 bp, Rattus norvegicus
agagcgatcaagtcacctggcctca

SEQ ID NO: 114467 - DNA, 25 bp, Rattus norvegicus
agagcgatgagccagatgctttcaa

SEQ ID NO: 114468 - DNA, 25 bp, Rattus norvegicus
agagcgatgagcgagatgctttcaa

SEQ ID NO: 114469 - DNA, 25 bp, Rattus norvegicus
agagcgattccaaacaaattgctac

SEQ ID NO: 114470 - DNA, 25 bp, Rattus norvegicus
agagcgattccatacaaattgctac

SEQ ID NO: 114471 - DNA, 25 bp, Rattus norvegicus
agagcgcaccagacagcggcttgca

SEQ ID NO: 114472 - DNA, 25 bp, Rattus norvegicus
agagcgcaccagtcagcggcttgca

SEQ ID NO: 114473 - DNA, 25 bp, Rattus norvegicus
agagcgcaccgacgagtctgcttag

SEQ ID NO: 114474 - DNA, 25 bp, Rattus norvegicus
agagcgcaccgaggagtctgcttag

SEQ ID NO: 114475 - DNA, 25 bp, Rattus norvegicus
agagcgcagcggagagcctgtcctt

SEQ ID NO: 114476 - DNA, 25 bp, Rattus norvegicus
agagcgcagcggtgagcctgtcctt

SEQ ID NO: 114477 - DNA, 25 bp, Rattus norvegicus
agagcgcaggcaccatgggttcact

SEQ ID NO: 114478 - DNA, 25 bp, Rattus norvegicus
agagcgcaggcagcatgggttcact

SEQ ID NO: 114479 - DNA, 25 bp, Rattus norvegicus
agagcgccacagatgggtgatatca

SEQ ID NO: 114480 - DNA, 25 bp, Rattus norvegicus
agagcgccacagttgggtgatatca

SEQ ID NO: 114481 - DNA, 25 bp, Rattus norvegicus
agagcgcccataaagagcccacgtg

SEQ ID NO: 114482 - DNA, 25 bp, Rattus norvegicus
agagcgcccatatagagcccacgtg

SEQ ID NO: 114483 - DNA, 25 bp, Rattus norvegicus
agagcgccctgtactgtgcattggt

SEQ ID NO: 114484 - DNA, 25 bp, Rattus norvegicus
agagcgccctgttctgtgcattggt

SEQ ID NO: 114485 - DNA, 25 bp, Rattus norvegicus
agagcgccgactagctgcccagttg

SEQ ID NO: 114486 - DNA, 25 bp, Rattus norvegicus
agagcgccgacttgctgcccagttg

SEQ ID NO: 114487 - DNA, 25 bp, Rattus norvegicus
agagcgccgggcagagttctaccac

SEQ ID NO: 114488 - DNA, 25 bp, Rattus norvegicus
agagcgccgggctgagttctaccac

SEQ ID NO: 114489 - DNA, 25 bp, Rattus norvegicus
agagcgccgtttcaatgctgccaag

SEQ ID NO: 114490 - DNA, 25 bp, Rattus norvegicus
agagcgccgtttgaatgctgccaag

SEQ ID NO: 114491 - DNA, 25 bp, Rattus norvegicus
agagcgcctccgcaaggtattgcag

SEQ ID NO: 114492 - DNA, 25 bp, Rattus norvegicus
agagcgcctccggaaggtattgcag

SEQ ID NO: 114493 - DNA, 25 bp, Rattus norvegicus
agagcgcctgcgaggtgtccacgca

SEQ ID NO: 114494 - DNA, 25 bp, Rattus norvegicus
agagcgcctgcgtggtgtccacgca

SEQ ID NO: 114495 - DNA, 25 bp, Rattus norvegicus
agagcgccttcgcaaatgagaccaa

SEQ ID NO: 114496 - DNA, 25 bp, Rattus norvegicus
agagcgccttcggaaatgagaccaa

SEQ ID NO: 114497 - DNA, 25 bp, Rattus norvegicus
agagcgcctttacctgtagatgagt

SEQ ID NO: 114498 - DNA, 25 bp, Rattus norvegicus
agagcgcctttagctgtagatgagt

SEQ ID NO: 114499 - DNA, 25 bp, Rattus norvegicus
agagcgcgttcgagaccaagtctgc

SEQ ID NO: 114500 - DNA, 25 bp, Rattus norvegicus
agagcgcgttcgtgaccaagtctgc

SEQ ID NO: 114501 - DNA, 25 bp, Rattus norvegicus
agagcgctagtacgagccccgacag

SEQ ID NO: 114502 - DNA, 25 bp, Rattus norvegicus
agagcgctagtaggagccccgacag

SEQ ID NO: 114503 - DNA, 25 bp, Rattus norvegicus
agagcgctcggaagctgcctcgcag

SEQ ID NO: 114504 - DNA, 25 bp, Rattus norvegicus
agagcgctcggatgctgcctcgcag

SEQ ID NO: 114505 - DNA, 25 bp, Rattus norvegicus
agagcgctgaacacgagcctgtgtc

SEQ ID NO: 114506 - DNA, 25 bp, Rattus norvegicus
agagcgctgaactcgagcctgtgtc

SEQ ID NO: 114507 - DNA, 25 bp, Rattus norvegicus
agagcgctgaccaagagttcattgt

SEQ ID NO: 114508 - DNA, 25 bp, Rattus norvegicus
agagcgctgacctagagttcattgt

SEQ ID NO: 114509 - DNA, 25 bp, Rattus norvegicus
agagcgctgatgcttttccagagga

SEQ ID NO: 114510 - DNA, 25 bp, Rattus norvegicus
agagcgctgatggttttccagagga

SEQ ID NO: 114511 - DNA, 25 bp, Rattus norvegicus
agagcgctgggtatttaattgcaaa

SEQ ID NO: 114512 - DNA, 25 bp, Rattus norvegicus
agagcgctgggtttttaattgcaaa

SEQ ID NO: 114513 - DNA, 25 bp, Rattus norvegicus
agagcgcttcatagtcagtgagacc

SEQ ID NO: 114514 - DNA, 25 bp, Rattus norvegicus
agagcgcttcattgtcagtgagacc

SEQ ID NO: 114515 - DNA, 25 bp, Rattus norvegicus
agagcgctttagagcatcctcatct

SEQ ID NO: 114516 - DNA, 25 bp, Rattus norvegicus
agagcgctttagtgcatcctcatct

SEQ ID NO: 114517 - DNA, 25 bp, Rattus norvegicus
agagcgctttccattccatgtattg

SEQ ID NO: 114518 - DNA, 25 bp, Rattus norvegicus
agagcgctttcctttccatgtattg

SEQ ID NO: 114519 - DNA, 25 bp, Rattus norvegicus
agagcgcttttcctaagttgctacc

SEQ ID NO: 114520 - DNA, 25 bp, Rattus norvegicus
agagcgcttttcgtaagttgctacc

SEQ ID NO: 114521 - DNA, 25 bp, Rattus norvegicus
agagcggaagatctacttggcgatt

SEQ ID NO: 114522 - DNA, 25 bp, Rattus norvegicus
agagcggaagatgtacttggcgatt

SEQ ID NO: 114523 - DNA, 25 bp, Rattus norvegicus
agagcggaagctacttgtggcctac

SEQ ID NO: 114524 - DNA, 25 bp, Rattus norvegicus
agagcggaagcttcttgtggcctac

SEQ ID NO: 114525 - DNA, 25 bp, Rattus norvegicus
agagcggaatatctgcagcaaggcc

SEQ ID NO: 114526 - DNA, 25 bp, Rattus norvegicus
agagcggaatatgtgcagcaaggcc

SEQ ID NO: 114527 - DNA, 25 bp, Rattus norvegicus
agagcggaccaccttaagcggacct

SEQ ID NO: 114528 - DNA, 25 bp, Rattus norvegicus
agagcggaccacgttaagcggacct

SEQ ID NO: 114529 - DNA, 25 bp, Rattus norvegicus
agagcggagtgtcgatctgccaccc

SEQ ID NO: 114530 - DNA, 25 bp, Rattus norvegicus
agagcggagtgtggatctgccaccc

SEQ ID NO: 114531 - DNA, 25 bp, Rattus norvegicus
agagcggatgagacacagtcctctc

SEQ ID NO: 114532 - DNA, 25 bp, Rattus norvegicus
agagcggatgagtcacagtcctctc

SEQ ID NO: 114533 - DNA, 25 bp, Rattus norvegicus
agagcggcacgtccaagtacggcga

SEQ ID NO: 114534 - DNA, 25 bp, Rattus norvegicus
agagcggcacgtgcaagtacggcga

SEQ ID NO: 114535 - DNA, 25 bp, Rattus norvegicus
agagcggcagcacttcacagcaaaa

SEQ ID NO: 114536 - DNA, 25 bp, Rattus norvegicus
agagcggcagcagttcacagcaaaa

SEQ ID NO: 114537 - DNA, 25 bp, Rattus norvegicus
agagcggcagccatgtttcagtgtg

SEQ ID NO: 114538 - DNA, 25 bp, Rattus norvegicus
agagcggcagccttgtttcagtgtg

SEQ ID NO: 114539 - DNA, 25 bp, Rattus norvegicus
agagcggcatgaacctttgcagaaa

SEQ ID NO: 114540 - DNA, 25 bp, Rattus norvegicus
agagcggcatgatcctttgcagaaa

SEQ ID NO: 114541 - DNA, 25 bp, Rattus norvegicus
agagcggcccttatgatacacgtta

SEQ ID NO: 114542 - DNA, 25 bp, Rattus norvegicus
agagcggcccttttgatacacgtta

SEQ ID NO: 114543 - DNA, 25 bp, Rattus norvegicus
agagcggcctcacctgaacctctgg

SEQ ID NO: 114544 - DNA, 25 bp, Rattus norvegicus
agagcggcctcactgtagatgcaat

SEQ ID NO: 114545 - DNA, 25 bp, Rattus norvegicus
agagcggcctcagctgaacctctgg

SEQ ID NO: 114546 - DNA, 25 bp, Rattus norvegicus
agagcggcctcagtgtagatgcaat

SEQ ID NO: 114547 - DNA, 25 bp, Rattus norvegicus
agagcggcgtggactcttacctgtg

SEQ ID NO: 114548 - DNA, 25 bp, Rattus norvegicus
agagcggcgtggtctcttacctgtg

SEQ ID NO: 114549 - DNA, 25 bp, Rattus norvegicus
agagcggctcggctacctcattgcg

SEQ ID NO: 114550 - DNA, 25 bp, Rattus norvegicus
agagcggctcgggtacctcattgcg

SEQ ID NO: 114551 - DNA, 25 bp, Rattus norvegicus
agagcggctctgagctgagcagcca

SEQ ID NO: 114552 - DNA, 25 bp, Rattus norvegicus
agagcggctctgtgctgagcagcca

SEQ ID NO: 114553 - DNA, 25 bp, Rattus norvegicus
agagcggctttcatgtttgtttgat

SEQ ID NO: 114554 - DNA, 25 bp, Rattus norvegicus
agagcggctttcttgtttgtttgat

SEQ ID NO: 114555 - DNA, 25 bp, Rattus norvegicus
agagcgggactaactgaagaaaata

SEQ ID NO: 114556 - DNA, 25 bp, Rattus norvegicus
agagcgggactatctgaagaaaata

SEQ ID NO: 114557 - DNA, 25 bp, Rattus norvegicus
agagcgggaggcctactaccaccaa

SEQ ID NO: 114558 - DNA, 25 bp, Rattus norvegicus
agagcgggaggcgtactaccaccaa

SEQ ID NO: 114559 - DNA, 25 bp, Rattus norvegicus
agagcgggatcgacttcgggaaaca

SEQ ID NO: 114560 - DNA, 25 bp, Rattus norvegicus
agagcgggatcgtcttcgggaaaca

SEQ ID NO: 114561 - DNA, 25 bp, Rattus norvegicus
agagcgggcagcagttctttggaac

SEQ ID NO: 114562 - DNA, 25 bp, Rattus norvegicus
agagcgggcagctgttctttggaac

SEQ ID NO: 114563 - DNA, 25 bp, Rattus norvegicus
agagcgggcctgctttcaacagcat

SEQ ID NO: 114564 - DNA, 25 bp, Rattus norvegicus
agagcgggcctggtttcaacagcat

SEQ ID NO: 114565 - DNA, 25 bp, Rattus norvegicus
agagcggtaggtatccgcattgcca

SEQ ID NO: 114566 - DNA, 25 bp, Rattus norvegicus
agagcggtaggtttccgcattgcca

SEQ ID NO: 114567 - DNA, 25 bp, Rattus norvegicus
agagcggtcaatctctccctagcta

SEQ ID NO: 114568 - DNA, 25 bp, Rattus norvegicus
agagcggtcaatgtctccctagcta

SEQ ID NO: 114569 - DNA, 25 bp, Rattus norvegicus
agagcggtccaccaacaccacgttg

SEQ ID NO: 114570 - DNA, 25 bp, Rattus norvegicus
agagcggtccacgaacaccacgttg

SEQ ID NO: 114571 - DNA, 25 bp, Rattus norvegicus
agagcggtctccaagagcgtgttta

SEQ ID NO: 114572 - DNA, 25 bp, Rattus norvegicus
agagcggtctcctagagcgtgttta

SEQ ID NO: 114573 - DNA, 25 bp, Rattus norvegicus
agagcggttagcactccgtagtaga

SEQ ID NO: 114574 - DNA, 25 bp, Rattus norvegicus
agagcggttagctctccgtagtaga

SEQ ID NO: 114575 - DNA, 25 bp, Rattus norvegicus
agagcggttccacagatgtggccac

SEQ ID NO: 114576 - DNA, 25 bp, Rattus norvegicus
agagcggttccagagatgtggccac

SEQ ID NO: 114577 - DNA, 25 bp, Rattus norvegicus
agagcggtttcaaatcgattggtcc

SEQ ID NO: 114578 - DNA, 25 bp, Rattus norvegicus
agagcggtttcatatcgattggtcc

SEQ ID NO: 114579 - DNA, 25 bp, Rattus norvegicus
agagcgtcctgtaaagccacccaaa

SEQ ID NO: 114580 - DNA, 25 bp, Rattus norvegicus
agagcgtcctgttaagccacccaaa

SEQ ID NO: 114581 - DNA, 25 bp, Rattus norvegicus
agagcgtctgtcaccaggaaggcca

SEQ ID NO: 114582 - DNA, 25 bp, Rattus norvegicus
agagcgtctgtctccaggaaggcca

SEQ ID NO: 114583 - DNA, 25 bp, Rattus norvegicus
agagcgtcttctagggtctgggaaa

SEQ ID NO: 114584 - DNA, 25 bp, Rattus norvegicus
agagcgtcttcttgggtctgggaaa

SEQ ID NO: 114585 - DNA, 25 bp, Rattus norvegicus
agagcgtgaatgagctcaccctata

SEQ ID NO: 114586 - DNA, 25 bp, Rattus norvegicus
agagcgtgaatgtgctcaccctata

SEQ ID NO: 114587 - DNA, 25 bp, Rattus norvegicus
agagcgtgcagcagtggccattcag

SEQ ID NO: 114588 - DNA, 25 bp, Rattus norvegicus
agagcgtgcagctgtggccattcag

SEQ ID NO: 114589 - DNA, 25 bp, Rattus norvegicus
agagcgtggaccaggagtatgccct

SEQ ID NO: 114590 - DNA, 25 bp, Rattus norvegicus
agagcgtggacctggagtatgccct

SEQ ID NO: 114591 - DNA, 25 bp, Rattus norvegicus
agagcgtggtccagctcctcgctga

SEQ ID NO: 114592 - DNA, 25 bp, Rattus norvegicus
agagcgtggtcctgctcctcgctga

SEQ ID NO: 114593 - DNA, 25 bp, Rattus norvegicus
agagcgttacaaccctgtgttcaat

SEQ ID NO: 114594 - DNA, 25 bp, Rattus norvegicus
agagcgttacaagcctgtgttcaat

SEQ ID NO: 114595 - DNA, 25 bp, Rattus norvegicus
agagcgttcctgatagatgtggtca

SEQ ID NO: 114596 - DNA, 25 bp, Rattus norvegicus
agagcgttcctgttagatgtggtca

SEQ ID NO: 114597 - DNA, 25 bp, Rattus norvegicus
agagcgttcgggactctgagcacag

SEQ ID NO: 114598 - DNA, 25 bp, Rattus norvegicus
agagcgttcgggtctctgagcacag

SEQ ID NO: 114599 - DNA, 25 bp, Rattus norvegicus
agagcgttctctcacatgcttactt

SEQ ID NO: 114600 - DNA, 25 bp, Rattus norvegicus
agagcgttctctgacatgcttactt

SEQ ID NO: 114601 - DNA, 25 bp, Rattus norvegicus
agagcgttctttccaccttgagact

SEQ ID NO: 114602 - DNA, 25 bp, Rattus norvegicus
agagcgttctttgcaccttgagact

SEQ ID NO: 114603 - DNA, 25 bp, Rattus norvegicus
agagcgtttcctatttaagcatggg

SEQ ID NO: 114604 - DNA, 25 bp, Rattus norvegicus
agagcgtttcctttttaagcatggg

SEQ ID NO: 114605 - DNA, 25 bp, Rattus norvegicus
agagcgtttgccaagtccaggaact

SEQ ID NO: 114606 - DNA, 25 bp, Rattus norvegicus
agagcgtttgcctagtccaggaact

SEQ ID NO: 114607 - DNA, 25 bp, Rattus norvegicus
agagcgtttgtgaccgtcgggacca

SEQ ID NO: 114608 - DNA, 25 bp, Rattus norvegicus
agagcgtttgtgtccgtcgggacca

SEQ ID NO: 114609 - DNA, 25 bp, Rattus norvegicus
agagctaaattacttcctccctttg

SEQ ID NO: 114610 - DNA, 25 bp, Rattus norvegicus
agagctaaattagttcctccctttg

SEQ ID NO: 114611 - DNA, 25 bp, Rattus norvegicus
agagctaactttctctccatttcca

SEQ ID NO: 114612 - DNA, 25 bp, Rattus norvegicus
agagctaactttgtctccatttcca

SEQ ID NO: 114613 - DNA, 25 bp, Rattus norvegicus
agagctaagacactcaggcttgcaa

SEQ ID NO: 114614 - DNA, 25 bp, Rattus norvegicus
agagctaagacagtcaggcttgcaa

SEQ ID NO: 114615 - DNA, 25 bp, Rattus norvegicus
agagctaagattactgcttccttgc

SEQ ID NO: 114616 - DNA, 25 bp, Rattus norvegicus
agagctaagatttctgcttccttgc

SEQ ID NO: 114617 - DNA, 25 bp, Rattus norvegicus
agagctaagccaaggacacttcctg

SEQ ID NO: 114618 - DNA, 25 bp, Rattus norvegicus
agagctaagccatggacacttcctg

SEQ ID NO: 114619 - DNA, 25 bp, Rattus norvegicus
agagctaagctgcacctctggagct

SEQ ID NO: 114620 - DNA, 25 bp, Rattus norvegicus
agagctaagctggacctctggagct

SEQ ID NO: 114621 - DNA, 25 bp, Rattus norvegicus
agagctaatttccacttggaccctg

SEQ ID NO: 114622 - DNA, 25 bp, Rattus norvegicus
agagctaatttcgacttggaccctg

SEQ ID NO: 114623 - DNA, 25 bp, Rattus norvegicus
agagctacacatcctactggcatgg

SEQ ID NO: 114624 - DNA, 25 bp, Rattus norvegicus
agagctacacatgctactggcatgg

SEQ ID NO: 114625 - DNA, 25 bp, Rattus norvegicus
agagctacagcaatcctcagtgttt

SEQ ID NO: 114626 - DNA, 25 bp, Rattus norvegicus
agagctacagcattcctcagtgttt

SEQ ID NO: 114627 - DNA, 25 bp, Rattus norvegicus
agagctacagttcgcactaccacgg

SEQ ID NO: 114628 - DNA, 25 bp, Rattus norvegicus
agagctacagttggcactaccacgg

SEQ ID NO: 114629 - DNA, 25 bp, Rattus norvegicus
agagctacccagatgccgtgaagat

SEQ ID NO: 114630 - DNA, 25 bp, Rattus norvegicus
agagctacccagttgccgtgaagat

SEQ ID NO: 114631 - DNA, 25 bp, Rattus norvegicus
agagctaccctgaggtctggttggt

SEQ ID NO: 114632 - DNA, 25 bp, Rattus norvegicus
agagctaccctgtggtctggttggt

SEQ ID NO: 114633 - DNA, 25 bp, Rattus norvegicus
agagctacctgcctaggtctggagt

SEQ ID NO: 114634 - DNA, 25 bp, Rattus norvegicus
agagctacctgcgtaggtctggagt

SEQ ID NO: 114635 - DNA, 25 bp, Rattus norvegicus
agagctacgactaacaccgcgggtg

SEQ ID NO: 114636 - DNA, 25 bp, Rattus norvegicus
agagctacgacttacaccgcgggtg

SEQ ID NO: 114637 - DNA, 25 bp, Rattus norvegicus
agagctacgttcagtgtcttctctg

SEQ ID NO: 114638 - DNA, 25 bp, Rattus norvegicus
agagctacgttctgtgtcttctctg

SEQ ID NO: 114639 - DNA, 25 bp, Rattus norvegicus
agagctactcagagccggctgggaa

SEQ ID NO: 114640 - DNA, 25 bp, Rattus norvegicus
agagctactcagtgccggctgggaa

SEQ ID NO: 114641 - DNA, 25 bp, Rattus norvegicus
agagctactcggagtacgtgtacaa

SEQ ID NO: 114642 - DNA, 25 bp, Rattus norvegicus
agagctactcggtgtacgtgtacaa

SEQ ID NO: 114643 - DNA, 25 bp, Rattus norvegicus
agagctactgtaacattttcaatca

SEQ ID NO: 114644 - DNA, 25 bp, Rattus norvegicus
agagctactgtatcattttcaatca

SEQ ID NO: 114645 - DNA, 25 bp, Rattus norvegicus
agagctactttgaaaccactgcaga

SEQ ID NO: 114646 - DNA, 25 bp, Rattus norvegicus
agagctactttgtaaccactgcaga

SEQ ID NO: 114647 - DNA, 25 bp, Rattus norvegicus
agagctagagctactgaactgttta

SEQ ID NO: 114648 - DNA, 25 bp, Rattus norvegicus
agagctagagcttctgaactgttta

SEQ ID NO: 114649 - DNA, 25 bp, Rattus norvegicus
agagctagcatgatgatttgggaac

SEQ ID NO: 114650 - DNA, 25 bp, Rattus norvegicus
agagctagcatgttgatttgggaac

SEQ ID NO: 114651 - DNA, 25 bp, Rattus norvegicus
agagctagcccgaaaaaagcgagag

SEQ ID NO: 114652 - DNA, 25 bp, Rattus norvegicus
agagctagcccgtaaaaagcgagag

SEQ ID NO: 114653 - DNA, 25 bp, Rattus norvegicus
agagctagccctacctgaggtctct

SEQ ID NO: 114654 - DNA, 25 bp, Rattus norvegicus
agagctagcccttcctgaggtctct

SEQ ID NO: 114655 - DNA, 25 bp, Rattus norvegicus
agagctagccgaagatggcctcctg

SEQ ID NO: 114656 - DNA, 25 bp, Rattus norvegicus
agagctagccgatgatggcctcctg

SEQ ID NO: 114657 - DNA, 25 bp, Rattus norvegicus
agagctagccttctgcttttgattc

SEQ ID NO: 114658 - DNA, 25 bp, Rattus norvegicus
agagctagccttgtgcttttgattc

SEQ ID NO: 114659 - DNA, 25 bp, Rattus norvegicus
agagctaggaagaccgcagcctgtg

SEQ ID NO: 114660 - DNA, 25 bp, Rattus norvegicus
agagctaggaagtccgcagcctgtg

SEQ ID NO: 114661 - DNA, 25 bp, Rattus norvegicus
agagctaggcctctatactactgat

SEQ ID NO: 114662 - DNA, 25 bp, Rattus norvegicus
agagctaggcctgtatactactgat

SEQ ID NO: 114663 - DNA, 25 bp, Rattus norvegicus
agagctaggctcatcaggtgatcag

SEQ ID NO: 114664 - DNA, 25 bp, Rattus norvegicus
agagctaggctcttcaggtgatcag

SEQ ID NO: 114665 - DNA, 25 bp, Rattus norvegicus
agagctagtccaatgagaagtcaca

SEQ ID NO: 114666 - DNA, 25 bp, Rattus norvegicus
agagctagtccattgagaagtcaca

SEQ ID NO: 114667 - DNA, 25 bp, Rattus norvegicus
agagctagtgtaactgacttttgaa

SEQ ID NO: 114668 - DNA, 25 bp, Rattus norvegicus
agagctagtgtatctgacttttgaa

SEQ ID NO: 114669 - DNA, 25 bp, Rattus norvegicus
agagctagtgttaactgttgggcag

SEQ ID NO: 114670 - DNA, 25 bp, Rattus norvegicus
agagctagtgttccatacttcttag

SEQ ID NO: 114671 - DNA, 25 bp, Rattus norvegicus
agagctagtgttgcatacttcttag

SEQ ID NO: 114672 - DNA, 25 bp, Rattus norvegicus
agagctagtgtttactgttgggcag

SEQ ID NO: 114673 - DNA, 25 bp, Rattus norvegicus
agagctagttgacgacagccagagc

SEQ ID NO: 114674 - DNA, 25 bp, Rattus norvegicus
agagctagttgaggacagccagagc

SEQ ID NO: 114675 - DNA, 25 bp, Rattus norvegicus
agagctatagagctggttctgattg

SEQ ID NO: 114676 - DNA, 25 bp, Rattus norvegicus
agagctatagaggtggttctgattg

SEQ ID NO: 114677 - DNA, 25 bp, Rattus norvegicus
agagctatgaccaacctgagacaat

SEQ ID NO: 114678 - DNA, 25 bp, Rattus norvegicus
agagctatgacctacctgagacaat

SEQ ID NO: 114679 - DNA, 25 bp, Rattus norvegicus
agagctatgcaacttgtccttatat

SEQ ID NO: 114680 - DNA, 25 bp, Rattus norvegicus
agagctatgcaagttgtccttatat

SEQ ID NO: 114681 - DNA, 25 bp, Rattus norvegicus
agagctatgcccacgtgtattcctg

SEQ ID NO: 114682 - DNA, 25 bp, Rattus norvegicus
agagctatgccctcgtgtattcctg

SEQ ID NO: 114683 - DNA, 25 bp, Rattus norvegicus
agagctatggctcgtttttgataga

SEQ ID NO: 114684 - DNA, 25 bp, Rattus norvegicus
agagctatggctggtttttgataga

SEQ ID NO: 114685 - DNA, 25 bp, Rattus norvegicus
agagctatgggcagctggacctctt

SEQ ID NO: 114686 - DNA, 25 bp, Rattus norvegicus
agagctatgggctgctggacctctt

SEQ ID NO: 114687 - DNA, 25 bp, Rattus norvegicus
agagctatgtccctcttcttaggac

SEQ ID NO: 114688 - DNA, 25 bp, Rattus norvegicus
agagctatgtccgtcttcttaggac

SEQ ID NO: 114689 - DNA, 25 bp, Rattus norvegicus
agagctattctgaccagtacttgat

SEQ ID NO: 114690 - DNA, 25 bp, Rattus norvegicus
agagctattctgtccagtacttgat

SEQ ID NO: 114691 - DNA, 25 bp, Rattus norvegicus
agagctattgccaacttttcaccat

SEQ ID NO: 114692 - DNA, 25 bp, Rattus norvegicus
agagctattgcctacttttcaccat

SEQ ID NO: 114693 - DNA, 25 bp, Rattus norvegicus
agagctattggcagcatctgaccat

SEQ ID NO: 114694 - DNA, 25 bp, Rattus norvegicus
agagctattggctgcatctgaccat

SEQ ID NO: 114695 - DNA, 25 bp, Rattus norvegicus
agagctcaatgactggcctgacttg

SEQ ID NO: 114696 - DNA, 25 bp, Rattus norvegicus
agagctcaatgagtggcctgacttg

SEQ ID NO: 114697 - DNA, 25 bp, Rattus norvegicus
agagctcacaccatattgggcatca

SEQ ID NO: 114698 - DNA, 25 bp, Rattus norvegicus
agagctcacaccttattgggcatca

SEQ ID NO: 114699 - DNA, 25 bp, Rattus norvegicus
agagctcacagacccagcgtctgga

SEQ ID NO: 114700 - DNA, 25 bp, Rattus norvegicus
agagctcacagagccagcgtctgga

SEQ ID NO: 114701 - DNA, 25 bp, Rattus norvegicus
agagctcacaggacctgcacttgag

SEQ ID NO: 114702 - DNA, 25 bp, Rattus norvegicus
agagctcacaggtcctgcacttgag

SEQ ID NO: 114703 - DNA, 25 bp, Rattus norvegicus
agagctcaccaaatagcccaagctg

SEQ ID NO: 114704 - DNA, 25 bp, Rattus norvegicus
agagctcaccaattagcccaagctg

SEQ ID NO: 114705 - DNA, 25 bp, Rattus norvegicus
agagctcacccaactcgaggataac

SEQ ID NO: 114706 - DNA, 25 bp, Rattus norvegicus
agagctcacccatctcgaggataac

SEQ ID NO: 114707 - DNA, 25 bp, Rattus norvegicus
agagctcactgactttcctgtgctg

SEQ ID NO: 114708 - DNA, 25 bp, Rattus norvegicus
agagctcactgagtttcctgtgctg

SEQ ID NO: 114709 - DNA, 25 bp, Rattus norvegicus
agagctcagctgattgtatatgtgt

SEQ ID NO: 114710 - DNA, 25 bp, Rattus norvegicus
agagctcagctgcacatgtttttgt

SEQ ID NO: 114711 - DNA, 25 bp, Rattus norvegicus
agagctcagctggacatgtttttgt

SEQ ID NO: 114712 - DNA, 25 bp, Rattus norvegicus
agagctcagctgtttgtatatgtgt

SEQ ID NO: 114713 - DNA, 25 bp, Rattus norvegicus
agagctcaggttcggcttcatttca

SEQ ID NO: 114714 - DNA, 25 bp, Rattus norvegicus
agagctcaggttgggcttcatttca

SEQ ID NO: 114715 - DNA, 25 bp, Rattus norvegicus
agagctcagtaacgaggccacccaa

SEQ ID NO: 114716 - DNA, 25 bp, Rattus norvegicus
agagctcagtaaggaggccacccaa

SEQ ID NO: 114717 - DNA, 25 bp, Rattus norvegicus
agagctcatagcacggcatttattt

SEQ ID NO: 114718 - DNA, 25 bp, Rattus norvegicus
agagctcatagctcggcatttattt

SEQ ID NO: 114719 - DNA, 25 bp, Rattus norvegicus
agagctcattaccatgtgaccagcg

SEQ ID NO: 114720 - DNA, 25 bp, Rattus norvegicus
agagctcattacgatgtgaccagcg

SEQ ID NO: 114721 - DNA, 25 bp, Rattus norvegicus
agagctccacctcctgaactttgtg

SEQ ID NO: 114722 - DNA, 25 bp, Rattus norvegicus
agagctccacctgctgaactttgtg

SEQ ID NO: 114723 - DNA, 25 bp, Rattus norvegicus
agagctccactcctgaagacgttca

SEQ ID NO: 114724 - DNA, 25 bp, Rattus norvegicus
agagctccactcgtgaagacgttca

SEQ ID NO: 114725 - DNA, 25 bp, Rattus norvegicus
agagctccagccacaggtccagtgg

SEQ ID NO: 114726 - DNA, 25 bp, Rattus norvegicus
agagctccagcctcaggtccagtgg

SEQ ID NO: 114727 - DNA, 25 bp, Rattus norvegicus
agagctccaggaagcaggccaccag

SEQ ID NO: 114728 - DNA, 25 bp, Rattus norvegicus
agagctccaggatgcaggccaccag

SEQ ID NO: 114729 - DNA, 25 bp, Rattus norvegicus
agagctccaggcatggccccaagta

SEQ ID NO: 114730 - DNA, 25 bp, Rattus norvegicus
agagctccaggcttggccccaagta

SEQ ID NO: 114731 - DNA, 25 bp, Rattus norvegicus
agagctccagtgcttatatcctgac

SEQ ID NO: 114732 - DNA, 25 bp, Rattus norvegicus
agagctccagtggttatatcctgac

SEQ ID NO: 114733 - DNA, 25 bp, Rattus norvegicus
agagctccatatattcttacgtccc

SEQ ID NO: 114734 - DNA, 25 bp, Rattus norvegicus
agagctccatatcctcgtgagcttt

SEQ ID NO: 114735 - DNA, 25 bp, Rattus norvegicus
agagctccatatgctcgtgagcttt

SEQ ID NO: 114736 - DNA, 25 bp, Rattus norvegicus
agagctccatattttcttacgtccc

SEQ ID NO: 114737 - DNA, 25 bp, Rattus norvegicus
agagctccatcgactgtcttgcttt

SEQ ID NO: 114738 - DNA, 25 bp, Rattus norvegicus
agagctccatcgtctgtcttgcttt

SEQ ID NO: 114739 - DNA, 25 bp, Rattus norvegicus
agagctccatctcctggatttccag

SEQ ID NO: 114740 - DNA, 25 bp, Rattus norvegicus
agagctccatctgctggatttccag

SEQ ID NO: 114741 - DNA, 25 bp, Rattus norvegicus
agagctcccaacactgagtctggta

SEQ ID NO: 114742 - DNA, 25 bp, Rattus norvegicus
agagctcccaactctgagtctggta

SEQ ID NO: 114743 - DNA, 25 bp, Rattus norvegicus
agagctcccacaccgcatgagatgc

SEQ ID NO: 114744 - DNA, 25 bp, Rattus norvegicus
agagctcccacacgaaaggctttta

SEQ ID NO: 114745 - DNA, 25 bp, Rattus norvegicus
agagctcccacagcgcatgagatgc

SEQ ID NO: 114746 - DNA, 25 bp, Rattus norvegicus
agagctcccacaggaaaggctttta

SEQ ID NO: 114747 - DNA, 25 bp, Rattus norvegicus
agagctcccagaaccatcagtgaga

SEQ ID NO: 114748 - DNA, 25 bp, Rattus norvegicus
agagctcccagatccatcagtgaga

SEQ ID NO: 114749 - DNA, 25 bp, Rattus norvegicus
agagctccctaacgcagtgaattgt

SEQ ID NO: 114750 - DNA, 25 bp, Rattus norvegicus
agagctccctaaggcagtgaattgt

SEQ ID NO: 114751 - DNA, 25 bp, Rattus norvegicus
agagctcccttgagcattcttgaag

SEQ ID NO: 114752 - DNA, 25 bp, Rattus norvegicus
agagctcccttgtgcattcttgaag

SEQ ID NO: 114753 - DNA, 25 bp, Rattus norvegicus
agagctccctttagggctaccaaga

SEQ ID NO: 114754 - DNA, 25 bp, Rattus norvegicus
agagctcccttttgggctaccaaga

SEQ ID NO: 114755 - DNA, 25 bp, Rattus norvegicus
agagctccgtcaagtgctggccacg

SEQ ID NO: 114756 - DNA, 25 bp, Rattus norvegicus
agagctccgtcatgtgctggccacg

SEQ ID NO: 114757 - DNA, 25 bp, Rattus norvegicus
agagctcctagtctgaaaagcctgg

SEQ ID NO: 114758 - DNA, 25 bp, Rattus norvegicus
agagctcctagtcttttttgcgttg

SEQ ID NO: 114759 - DNA, 25 bp, Rattus norvegicus
agagctcctagtgtgaaaagcctgg

SEQ ID NO: 114760 - DNA, 25 bp, Rattus norvegicus
agagctcctagtgttttttgcgttg

SEQ ID NO: 114761 - DNA, 25 bp, Rattus norvegicus
agagctcctcacagagtgggacctg

SEQ ID NO: 114762 - DNA, 25 bp, Rattus norvegicus
agagctcctcacctgtacaacagga

SEQ ID NO: 114763 - DNA, 25 bp, Rattus norvegicus
agagctcctcacgtgtacaacagga

SEQ ID NO: 114764 - DNA, 25 bp, Rattus norvegicus
agagctcctcactgagtgggacctg

SEQ ID NO: 114765 - DNA, 25 bp, Rattus norvegicus
agagctcctccaccagaagctgaag

SEQ ID NO: 114766 - DNA, 25 bp, Rattus norvegicus
agagctcctccagcagaagctgaag

SEQ ID NO: 114767 - DNA, 25 bp, Rattus norvegicus
agagctcctcctccgagagtgagga

SEQ ID NO: 114768 - DNA, 25 bp, Rattus norvegicus
agagctcctcctgcgagagtgagga

SEQ ID NO: 114769 - DNA, 25 bp, Rattus norvegicus
agagctcctctaaccaagcaacatt

SEQ ID NO: 114770 - DNA, 25 bp, Rattus norvegicus
agagctcctctatccaagcaacatt

SEQ ID NO: 114771 - DNA, 25 bp, Rattus norvegicus
agagctcctctgactttgaaatccc

SEQ ID NO: 114772 - DNA, 25 bp, Rattus norvegicus
agagctcctctgtctttgaaatccc

SEQ ID NO: 114773 - DNA, 25 bp, Rattus norvegicus
agagctcctcttagttttcaatctg

SEQ ID NO: 114774 - DNA, 25 bp, Rattus norvegicus
agagctcctctttgttttcaatctg

SEQ ID NO: 114775 - DNA, 25 bp, Rattus norvegicus
agagctcctgagaccttcagttcct

SEQ ID NO: 114776 - DNA, 25 bp, Rattus norvegicus
agagctcctgagtccttcagttcct

SEQ ID NO: 114777 - DNA, 25 bp, Rattus norvegicus
agagctcctggcatcagcggaaaca

SEQ ID NO: 114778 - DNA, 25 bp, Rattus norvegicus
agagctcctggcttcagcggaaaca

SEQ ID NO: 114779 - DNA, 25 bp, Rattus norvegicus
agagctcctgtgagtcacttggcat

SEQ ID NO: 114780 - DNA, 25 bp, Rattus norvegicus
agagctcctgtgtgtcacttggcat

SEQ ID NO: 114781 - DNA, 25 bp, Rattus norvegicus
agagctccttctagacatgtcgtgt

SEQ ID NO: 114782 - DNA, 25 bp, Rattus norvegicus
agagctccttcttgacatgtcgtgt

SEQ ID NO: 114783 - DNA, 25 bp, Rattus norvegicus
agagctccttgaccactaatgtttt

SEQ ID NO: 114784 - DNA, 25 bp, Rattus norvegicus
agagctccttgagcactaatgtttt

SEQ ID NO: 114785 - DNA, 25 bp, Rattus norvegicus
agagctcgacttcccggttttgctg

SEQ ID NO: 114786 - DNA, 25 bp, Rattus norvegicus
agagctcgacttgccggttttgctg

SEQ ID NO: 114787 - DNA, 25 bp, Rattus norvegicus
agagctcgagagacaccggtccatt

SEQ ID NO: 114788 - DNA, 25 bp, Rattus norvegicus
agagctcgagagtcaccggtccatt

SEQ ID NO: 114789 - DNA, 25 bp, Rattus norvegicus
agagctcggacaccttccagggaag

SEQ ID NO: 114790 - DNA, 25 bp, Rattus norvegicus
agagctcggacagcttccagggaag

SEQ ID NO: 114791 - DNA, 25 bp, Rattus norvegicus
agagctcggccgacatggcgctgca

SEQ ID NO: 114792 - DNA, 25 bp, Rattus norvegicus
agagctcggccgtcatggcgctgca

SEQ ID NO: 114793 - DNA, 25 bp, Rattus norvegicus
agagctcggcggacatggcccttca

SEQ ID NO: 114794 - DNA, 25 bp, Rattus norvegicus
agagctcggcggtcatggcccttca

SEQ ID NO: 114795 - DNA, 25 bp, Rattus norvegicus
agagctcgggcactcgcaggtccca

SEQ ID NO: 114796 - DNA, 25 bp, Rattus norvegicus
agagctcgggcagtcgcaggtccca

SEQ ID NO: 114797 - DNA, 25 bp, Rattus norvegicus
agagctcggttaatgggtttctcct

SEQ ID NO: 114798 - DNA, 25 bp, Rattus norvegicus
agagctcggttattgggtttctcct

SEQ ID NO: 114799 - DNA, 25 bp, Rattus norvegicus
agagctcgtatacaccggtttctgg

SEQ ID NO: 114800 - DNA, 25 bp, Rattus norvegicus
agagctcgtatagaccggtttctgg

SEQ ID NO: 114801 - DNA, 25 bp, Rattus norvegicus
agagctcgtgttaactgtgcactgt

SEQ ID NO: 114802 - DNA, 25 bp, Rattus norvegicus
agagctcgtgtttactgtgcactgt

SEQ ID NO: 114803 - DNA, 25 bp, Rattus norvegicus
agagctcgttgccatcggctcgcca

SEQ ID NO: 114804 - DNA, 25 bp, Rattus norvegicus
agagctcgttgcgatcggctcgcca

SEQ ID NO: 114805 - DNA, 25 bp, Rattus norvegicus
agagctctaacacggcaggatggcc

SEQ ID NO: 114806 - DNA, 25 bp, Rattus norvegicus
agagctctaacagggcaggatggcc

SEQ ID NO: 114807 - DNA, 25 bp, Rattus norvegicus
agagctctaagaaactactgcctgt

SEQ ID NO: 114808 - DNA, 25 bp, Rattus norvegicus
agagctctaagatactactgcctgt

SEQ ID NO: 114809 - DNA, 25 bp, Rattus norvegicus
agagctctaggtacctttcaacagg

SEQ ID NO: 114810 - DNA, 25 bp, Rattus norvegicus
agagctctaggtactgttcagactc

SEQ ID NO: 114811 - DNA, 25 bp, Rattus norvegicus
agagctctaggttcctttcaacagg

SEQ ID NO: 114812 - DNA, 25 bp, Rattus norvegicus
agagctctaggttctgttcagactc

SEQ ID NO: 114813 - DNA, 25 bp, Rattus norvegicus
agagctctagtgactgcttgtccac

SEQ ID NO: 114814 - DNA, 25 bp, Rattus norvegicus
agagctctagtgtctgcttgtccac

SEQ ID NO: 114815 - DNA, 25 bp, Rattus norvegicus
agagctctagttcttgtaggcagcg

SEQ ID NO: 114816 - DNA, 25 bp, Rattus norvegicus
agagctctagttgttgtaggcagcg

SEQ ID NO: 114817 - DNA, 25 bp, Rattus norvegicus
agagctctccagcagtcctctcgtg

SEQ ID NO: 114818 - DNA, 25 bp, Rattus norvegicus
agagctctccaggagtcctctcgtg

SEQ ID NO: 114819 - DNA, 25 bp, Rattus norvegicus
agagctctccctcatataactgatg

SEQ ID NO: 114820 - DNA, 25 bp, Rattus norvegicus
agagctctccctgatataactgatg

SEQ ID NO: 114821 - DNA, 25 bp, Rattus norvegicus
agagctctccgtctgggtcagtaca

SEQ ID NO: 114822 - DNA, 25 bp, Rattus norvegicus
agagctctccgtgtgggtcagtaca

SEQ ID NO: 114823 - DNA, 25 bp, Rattus norvegicus
agagctctctctcgatcagctttac

SEQ ID NO: 114824 - DNA, 25 bp, Rattus norvegicus
agagctctctctggatcagctttac

SEQ ID NO: 114825 - DNA, 25 bp, Rattus norvegicus
agagctctctgaagctacccaagtc

SEQ ID NO: 114826 - DNA, 25 bp, Rattus norvegicus
agagctctctgatgctacccaagtc

SEQ ID NO: 114827 - DNA, 25 bp, Rattus norvegicus
agagctctctggctggaagtcctga

SEQ ID NO: 114828 - DNA, 25 bp, Rattus norvegicus
agagctctctgggtggaagtcctga

SEQ ID NO: 114829 - DNA, 25 bp, Rattus norvegicus
agagctctgacaatttcctaacata

SEQ ID NO: 114830 - DNA, 25 bp, Rattus norvegicus
agagctctgacattttcctaacata

SEQ ID NO: 114831 - DNA, 25 bp, Rattus norvegicus
agagctctgacccagtgtcacaaag

SEQ ID NO: 114832 - DNA, 25 bp, Rattus norvegicus
agagctctgaccgagtgtcacaaag

SEQ ID NO: 114833 - DNA, 25 bp, Rattus norvegicus
agagctctgacgaactgcagtgcac

SEQ ID NO: 114834 - DNA, 25 bp, Rattus norvegicus
agagctctgacgtactgcagtgcac

SEQ ID NO: 114835 - DNA, 25 bp, Rattus norvegicus
agagctctgagacgcacacttgggt

SEQ ID NO: 114836 - DNA, 25 bp, Rattus norvegicus
agagctctgagaggcacacttgggt

SEQ ID NO: 114837 - DNA, 25 bp, Rattus norvegicus
agagctctgattaaagaggcccctg

SEQ ID NO: 114838 - DNA, 25 bp, Rattus norvegicus
agagctctgatttaagaggcccctg

SEQ ID NO: 114839 - DNA, 25 bp, Rattus norvegicus
agagctctgcaactcgaaaaaccca

SEQ ID NO: 114840 - DNA, 25 bp, Rattus norvegicus
agagctctgcaagtcgaaaaaccca

SEQ ID NO: 114841 - DNA, 25 bp, Rattus norvegicus
agagctctgcacactcaaaggctaa

SEQ ID NO: 114842 - DNA, 25 bp, Rattus norvegicus
agagctctgcactctcaaaggctaa

SEQ ID NO: 114843 - DNA, 25 bp, Rattus norvegicus
agagctctgccgagggcacgtctgt

SEQ ID NO: 114844 - DNA, 25 bp, Rattus norvegicus
agagctctgccgtgggcacgtctgt

SEQ ID NO: 114845 - DNA, 25 bp, Rattus norvegicus
agagctctgctgaggccacagacaa

SEQ ID NO: 114846 - DNA, 25 bp, Rattus norvegicus
agagctctgctgtggccacagacaa

SEQ ID NO: 114847 - DNA, 25 bp, Rattus norvegicus
agagctctggagcaagtcctaggca

SEQ ID NO: 114848 - DNA, 25 bp, Rattus norvegicus
agagctctggaggaagtcctaggca

SEQ ID NO: 114849 - DNA, 25 bp, Rattus norvegicus
agagctctggcgagtgctacgtaga

SEQ ID NO: 114850 - DNA, 25 bp, Rattus norvegicus
agagctctggcgtgtgctacgtaga

SEQ ID NO: 114851 - DNA, 25 bp, Rattus norvegicus
agagctctgggtctggttccaagac

SEQ ID NO: 114852 - DNA, 25 bp, Rattus norvegicus
agagctctgggtgtggttccaagac

SEQ ID NO: 114853 - DNA, 25 bp, Rattus norvegicus
agagctctggtgaggattgctcaga

SEQ ID NO: 114854 - DNA, 25 bp, Rattus norvegicus
agagctctggtgtggattgctcaga

SEQ ID NO: 114855 - DNA, 25 bp, Rattus norvegicus
agagctctgtaaagcctggttgggc

SEQ ID NO: 114856 - DNA, 25 bp, Rattus norvegicus
agagctctgtaatgcctggttgggc

SEQ ID NO: 114857 - DNA, 25 bp, Rattus norvegicus
agagctctgttgatcagccccaaac

SEQ ID NO: 114858 - DNA, 25 bp, Rattus norvegicus
agagctctgttgttcagccccaaac

SEQ ID NO: 114859 - DNA, 25 bp, Rattus norvegicus
agagctcttgacactgtcttcctgg

SEQ ID NO: 114860 - DNA, 25 bp, Rattus norvegicus
agagctcttgactctgtcttcctgg

SEQ ID NO: 114861 - DNA, 25 bp, Rattus norvegicus
agagctcttgccaggctggtatgaa

SEQ ID NO: 114862 - DNA, 25 bp, Rattus norvegicus
agagctcttgcccacagaccagaag

SEQ ID NO: 114863 - DNA, 25 bp, Rattus norvegicus
agagctcttgccgacagaccagaag

SEQ ID NO: 114864 - DNA, 25 bp, Rattus norvegicus
agagctcttgcctggctggtatgaa

SEQ ID NO: 114865 - DNA, 25 bp, Rattus norvegicus
agagctctttgaatgacccacgtct

SEQ ID NO: 114866 - DNA, 25 bp, Rattus norvegicus
agagctctttgattgacccacgtct

SEQ ID NO: 114867 - DNA, 25 bp, Rattus norvegicus
agagctctttgtaaaccgcagtcac

SEQ ID NO: 114868 - DNA, 25 bp, Rattus norvegicus
agagctctttgttaaccgcagtcac

SEQ ID NO: 114869 - DNA, 25 bp, Rattus norvegicus
agagctctttttactgtcagggtta

SEQ ID NO: 114870 - DNA, 25 bp, Rattus norvegicus
agagctcttttttctgtcagggtta

SEQ ID NO: 114871 - DNA, 25 bp, Rattus norvegicus
agagctgaaagcacaatgactccag

SEQ ID NO: 114872 - DNA, 25 bp, Rattus norvegicus
agagctgaaagccatcacccaatga

SEQ ID NO: 114873 - DNA, 25 bp, Rattus norvegicus
agagctgaaagcgatcacccaatga

SEQ ID NO: 114874 - DNA, 25 bp, Rattus norvegicus
agagctgaaagctcaatgactccag

SEQ ID NO: 114875 - DNA, 25 bp, Rattus norvegicus
agagctgaaccaaacgctcacacag

SEQ ID NO: 114876 - DNA, 25 bp, Rattus norvegicus
agagctgaaccatacgctcacacag

SEQ ID NO: 114877 - DNA, 25 bp, Rattus norvegicus
agagctgaacccagaactatttttt

SEQ ID NO: 114878 - DNA, 25 bp, Rattus norvegicus
agagctgaaccctgaactatttttt

SEQ ID NO: 114879 - DNA, 25 bp, Rattus norvegicus
agagctgaactgcatgagtcttcta

SEQ ID NO: 114880 - DNA, 25 bp, Rattus norvegicus
agagctgaactggatgagtcttcta

SEQ ID NO: 114881 - DNA, 25 bp, Rattus norvegicus
agagctgaagagctccctgcagcct

SEQ ID NO: 114882 - DNA, 25 bp, Rattus norvegicus
agagctgaagaggtccctgcagcct

SEQ ID NO: 114883 - DNA, 25 bp, Rattus norvegicus
agagctgaagcaattgccaggccct

SEQ ID NO: 114884 - DNA, 25 bp, Rattus norvegicus
agagctgaagcatttgccaggccct

SEQ ID NO: 114885 - DNA, 25 bp, Rattus norvegicus
agagctgaaggcacttctccagagc

SEQ ID NO: 114886 - DNA, 25 bp, Rattus norvegicus
agagctgaaggctcttctccagagc

SEQ ID NO: 114887 - DNA, 25 bp, Rattus norvegicus
agagctgaagtgatgctccttcccc

SEQ ID NO: 114888 - DNA, 25 bp, Rattus norvegicus
agagctgaagtgttgctccttcccc

SEQ ID NO: 114889 - DNA, 25 bp, Rattus norvegicus
agagctgaattgattgcccaaccct

SEQ ID NO: 114890 - DNA, 25 bp, Rattus norvegicus
agagctgaattgtttgcccaaccct

SEQ ID NO: 114891 - DNA, 25 bp, Rattus norvegicus
agagctgacagcatcgggtccactg

SEQ ID NO: 114892 - DNA, 25 bp, Rattus norvegicus
agagctgacagccacggttctgaga

SEQ ID NO: 114893 - DNA, 25 bp, Rattus norvegicus
agagctgacagcctcgattcttcag

SEQ ID NO: 114894 - DNA, 25 bp, Rattus norvegicus
agagctgacagcgacggttctgaga

SEQ ID NO: 114895 - DNA, 25 bp, Rattus norvegicus
agagctgacagcgtcgattcttcag

SEQ ID NO: 114896 - DNA, 25 bp, Rattus norvegicus
agagctgacagcttcgggtccactg

SEQ ID NO: 114897 - DNA, 25 bp, Rattus norvegicus
agagctgacaggaaatcatctcaca

SEQ ID NO: 114898 - DNA, 25 bp, Rattus norvegicus
agagctgacaggtaatcatctcaca

SEQ ID NO: 114899 - DNA, 25 bp, Rattus norvegicus
agagctgacatccatgtgccacgac

SEQ ID NO: 114900 - DNA, 25 bp, Rattus norvegicus
agagctgacatcgatgtgccacgac

SEQ ID NO: 114901 - DNA, 25 bp, Rattus norvegicus
agagctgacatgatgtcctctctta

SEQ ID NO: 114902 - DNA, 25 bp, Rattus norvegicus
agagctgacatgttgtcctctctta

SEQ ID NO: 114903 - DNA, 25 bp, Rattus norvegicus
agagctgaccagattgccaacaagt

SEQ ID NO: 114904 - DNA, 25 bp, Rattus norvegicus
agagctgaccagcacatgaccagca

SEQ ID NO: 114905 - DNA, 25 bp, Rattus norvegicus
agagctgaccaggacatgaccagca

SEQ ID NO: 114906 - DNA, 25 bp, Rattus norvegicus
agagctgaccagtttgccaacaagt

SEQ ID NO: 114907 - DNA, 25 bp, Rattus norvegicus
agagctgaccctatgtcacagctct

SEQ ID NO: 114908 - DNA, 25 bp, Rattus norvegicus
agagctgaccctttgtcacagctct

SEQ ID NO: 114909 - DNA, 25 bp, Rattus norvegicus
agagctgacgtcattctgccttgga

SEQ ID NO: 114910 - DNA, 25 bp, Rattus norvegicus
agagctgacgtctttctgccttgga

SEQ ID NO: 114911 - DNA, 25 bp, Rattus norvegicus
agagctgagagcaactgccttgtcc

SEQ ID NO: 114912 - DNA, 25 bp, Rattus norvegicus
agagctgagagctactgccttgtcc

SEQ ID NO: 114913 - DNA, 25 bp, Rattus norvegicus
agagctgaggctatatcgccaggcg

SEQ ID NO: 114914 - DNA, 25 bp, Rattus norvegicus
agagctgaggctttatcgccaggcg

SEQ ID NO: 114915 - DNA, 25 bp, Rattus norvegicus
agagctgagtgactggccccattga

SEQ ID NO: 114916 - DNA, 25 bp, Rattus norvegicus
agagctgagtgagtggccccattga

SEQ ID NO: 114917 - DNA, 25 bp, Rattus norvegicus
agagctgatactcccgagctccagc

SEQ ID NO: 114918 - DNA, 25 bp, Rattus norvegicus
agagctgatactgccgagctccagc

SEQ ID NO: 114919 - DNA, 25 bp, Rattus norvegicus
agagctgatcgcaggtgcgttttaa

SEQ ID NO: 114920 - DNA, 25 bp, Rattus norvegicus
agagctgatcgctggtgcgttttaa

SEQ ID NO: 114921 - DNA, 25 bp, Rattus norvegicus
agagctgatctcactgaggcgagag

SEQ ID NO: 114922 - DNA, 25 bp, Rattus norvegicus
agagctgatctctctgaggcgagag

SEQ ID NO: 114923 - DNA, 25 bp, Rattus norvegicus
agagctgatctgaggtatcattggt

SEQ ID NO: 114924 - DNA, 25 bp, Rattus norvegicus
agagctgatctgtggtatcattggt

SEQ ID NO: 114925 - DNA, 25 bp, Rattus norvegicus
agagctgatgaactcccggcagaca

SEQ ID NO: 114926 - DNA, 25 bp, Rattus norvegicus
agagctgatgaagtcccggcagaca

SEQ ID NO: 114927 - DNA, 25 bp, Rattus norvegicus
agagctgatgctccgtctttgctca

SEQ ID NO: 114928 - DNA, 25 bp, Rattus norvegicus
agagctgatgctgcgtctttgctca

SEQ ID NO: 114929 - DNA, 25 bp, Rattus norvegicus
agagctgatggcacctgtaggatga

SEQ ID NO: 114930 - DNA, 25 bp, Rattus norvegicus
agagctgatggctcctgtaggatga

SEQ ID NO: 114931 - DNA, 25 bp, Rattus norvegicus
agagctgattggaataaggtgtgta

SEQ ID NO: 114932 - DNA, 25 bp, Rattus norvegicus
agagctgattggtataaggtgtgta

SEQ ID NO: 114933 - DNA, 25 bp, Rattus norvegicus
agagctgatttcattcacgagtcat

SEQ ID NO: 114934 - DNA, 25 bp, Rattus norvegicus
agagctgatttctttcacgagtcat

SEQ ID NO: 114935 - DNA, 25 bp, Rattus norvegicus
agagctgcaagccactgttggccct

SEQ ID NO: 114936 - DNA, 25 bp, Rattus norvegicus
agagctgcaagcgactgttggccct

SEQ ID NO: 114937 - DNA, 25 bp, Rattus norvegicus
agagctgcaataacctgagaaggac

SEQ ID NO: 114938 - DNA, 25 bp, Rattus norvegicus
agagctgcaatatcctgagaaggac

SEQ ID NO: 114939 - DNA, 25 bp, Rattus norvegicus
agagctgcacatcttgtacgtttga

SEQ ID NO: 114940 - DNA, 25 bp, Rattus norvegicus
agagctgcacatgttgtacgtttga

SEQ ID NO: 114941 - DNA, 25 bp, Rattus norvegicus
agagctgcacctactgagacttaag

SEQ ID NO: 114942 - DNA, 25 bp, Rattus norvegicus
agagctgcaccttctgagacttaag

SEQ ID NO: 114943 - DNA, 25 bp, Rattus norvegicus
agagctgcacgacatgttcatggat

SEQ ID NO: 114944 - DNA, 25 bp, Rattus norvegicus
agagctgcacgagatgttcatggat

SEQ ID NO: 114945 - DNA, 25 bp, Rattus norvegicus
agagctgcagaacctgattgaagct

SEQ ID NO: 114946 - DNA, 25 bp, Rattus norvegicus
agagctgcagaagctgattgaagct

SEQ ID NO: 114947 - DNA, 25 bp, Rattus norvegicus
agagctgcagagctttttgccccag

SEQ ID NO: 114948 - DNA, 25 bp, Rattus norvegicus
agagctgcagaggtttttgccccag

SEQ ID NO: 114949 - DNA, 25 bp, Rattus norvegicus
agagctgcagatatccagaccgttc

SEQ ID NO: 114950 - DNA, 25 bp, Rattus norvegicus
agagctgcagatcgaattgtttaaa

SEQ ID NO: 114951 - DNA, 25 bp, Rattus norvegicus
agagctgcagatggaattgtttaaa

SEQ ID NO: 114952 - DNA, 25 bp, Rattus norvegicus
agagctgcagatttccagaccgttc

SEQ ID NO: 114953 - DNA, 25 bp, Rattus norvegicus
agagctgcagccaccaagttaagta

SEQ ID NO: 114954 - DNA, 25 bp, Rattus norvegicus
agagctgcagccaccccggaacaag

SEQ ID NO: 114955 - DNA, 25 bp, Rattus norvegicus
agagctgcagcctccaagttaagta

SEQ ID NO: 114956 - DNA, 25 bp, Rattus norvegicus
agagctgcagcctccccggaacaag

SEQ ID NO: 114957 - DNA, 25 bp, Rattus norvegicus
agagctgcaggtaagcctgtggact

SEQ ID NO: 114958 - DNA, 25 bp, Rattus norvegicus
agagctgcaggttagcctgtggact

SEQ ID NO: 114959 - DNA, 25 bp, Rattus norvegicus
agagctgcagttcattcgccaggct

SEQ ID NO: 114960 - DNA, 25 bp, Rattus norvegicus
agagctgcagttgattcgccaggct

SEQ ID NO: 114961 - DNA, 25 bp, Rattus norvegicus
agagctgcatcccaggtccctgaac

SEQ ID NO: 114962 - DNA, 25 bp, Rattus norvegicus
agagctgcatccgaggtccctgaac

SEQ ID NO: 114963 - DNA, 25 bp, Rattus norvegicus
agagctgcatggaacaccgccggta

SEQ ID NO: 114964 - DNA, 25 bp, Rattus norvegicus
agagctgcatggtacaccgccggta

SEQ ID NO: 114965 - DNA, 25 bp, Rattus norvegicus
agagctgccagtctcatcaaccagg

SEQ ID NO: 114966 - DNA, 25 bp, Rattus norvegicus
agagctgccagtgtcatcaaccagg

SEQ ID NO: 114967 - DNA, 25 bp, Rattus norvegicus
agagctgcccagagattaacttttg

SEQ ID NO: 114968 - DNA, 25 bp, Rattus norvegicus
agagctgcccagtgattaacttttg

SEQ ID NO: 114969 - DNA, 25 bp, Rattus norvegicus
agagctgccccgagtggagccacac

SEQ ID NO: 114970 - DNA, 25 bp, Rattus norvegicus
agagctgccccgtgtggagccacac

SEQ ID NO: 114971 - DNA, 25 bp, Rattus norvegicus
agagctgcccgacactgttgatctc

SEQ ID NO: 114972 - DNA, 25 bp, Rattus norvegicus
agagctgcccgagactgttgatctc

SEQ ID NO: 114973 - DNA, 25 bp, Rattus norvegicus
agagctgccgttaccattctttgaa

SEQ ID NO: 114974 - DNA, 25 bp, Rattus norvegicus
agagctgccgtttccattctttgaa

SEQ ID NO: 114975 - DNA, 25 bp, Rattus norvegicus
agagctgcctccagatttcatcttt

SEQ ID NO: 114976 - DNA, 25 bp, Rattus norvegicus
agagctgcctcctgatttcatcttt

SEQ ID NO: 114977 - DNA, 25 bp, Rattus norvegicus
agagctgcctgtcggatgcctgacc

SEQ ID NO: 114978 - DNA, 25 bp, Rattus norvegicus
agagctgcctgtgggatgcctgacc

SEQ ID NO: 114979 - DNA, 25 bp, Rattus norvegicus
agagctgccttcaaacaattgtcaa

SEQ ID NO: 114980 - DNA, 25 bp, Rattus norvegicus
agagctgccttctaacaattgtcaa

SEQ ID NO: 114981 - DNA, 25 bp, Rattus norvegicus
agagctgcctttctggatccagttc

SEQ ID NO: 114982 - DNA, 25 bp, Rattus norvegicus
agagctgcctttgtggatccagttc

SEQ ID NO: 114983 - DNA, 25 bp, Rattus norvegicus
agagctgcgaacagctacgcgctac

SEQ ID NO: 114984 - DNA, 25 bp, Rattus norvegicus
agagctgcgaactgctacgcgctac

SEQ ID NO: 114985 - DNA, 25 bp, Rattus norvegicus
agagctgcgaggaagcactggacat

SEQ ID NO: 114986 - DNA, 25 bp, Rattus norvegicus
agagctgcgaggtagcactggacat

SEQ ID NO: 114987 - DNA, 25 bp, Rattus norvegicus
agagctgcgctcaggtggtgctgca

SEQ ID NO: 114988 - DNA, 25 bp, Rattus norvegicus
agagctgcgctctggtggtgctgca

SEQ ID NO: 114989 - DNA, 25 bp, Rattus norvegicus
agagctgcgtgcctaagcactgctt

SEQ ID NO: 114990 - DNA, 25 bp, Rattus norvegicus
agagctgcgtgcgtaagcactgctt

SEQ ID NO: 114991 - DNA, 25 bp, Rattus norvegicus
agagctgctacacggcccgggatac

SEQ ID NO: 114992 - DNA, 25 bp, Rattus norvegicus
agagctgctacagggcccgggatac

SEQ ID NO: 114993 - DNA, 25 bp, Rattus norvegicus
agagctgctcatagtgaatccagaa

SEQ ID NO: 114994 - DNA, 25 bp, Rattus norvegicus
agagctgctcatcacgttgggcctt

SEQ ID NO: 114995 - DNA, 25 bp, Rattus norvegicus
agagctgctcatgacgttgggcctt

SEQ ID NO: 114996 - DNA, 25 bp, Rattus norvegicus
agagctgctcattgtgaatccagaa

SEQ ID NO: 114997 - DNA, 25 bp, Rattus norvegicus
agagctgctcgtagacccgtgggaa

SEQ ID NO: 114998 - DNA, 25 bp, Rattus norvegicus
agagctgctcgttgacccgtgggaa

SEQ ID NO: 114999 - DNA, 25 bp, Rattus norvegicus
agagctgctcttccaatcttttttg

SEQ ID NO: 115000 - DNA, 25 bp, Rattus norvegicus
agagctgctcttgcaatcttttttg

SEQ ID NO: 115001 - DNA, 25 bp, Rattus norvegicus
agagctgctgaccagccatggagtc

SEQ ID NO: 115002 - DNA, 25 bp, Rattus norvegicus
agagctgctgacgagccatggagtc

SEQ ID NO: 115003 - DNA, 25 bp, Rattus norvegicus
agagctgctgctatggcagggctta

SEQ ID NO: 115004 - DNA, 25 bp, Rattus norvegicus
agagctgctgctcagtcggttaaag

SEQ ID NO: 115005 - DNA, 25 bp, Rattus norvegicus
agagctgctgctcgaacatgatgcc

SEQ ID NO: 115006 - DNA, 25 bp, Rattus norvegicus
agagctgctgctgagtcggttaaag

SEQ ID NO: 115007 - DNA, 25 bp, Rattus norvegicus
agagctgctgctggaacatgatgcc

SEQ ID NO: 115008 - DNA, 25 bp, Rattus norvegicus
agagctgctgctttggcagggctta

SEQ ID NO: 115009 - DNA, 25 bp, Rattus norvegicus
agagctgctggactggaccttgtca

SEQ ID NO: 115010 - DNA, 25 bp, Rattus norvegicus
agagctgctggagtggaccttgtca

SEQ ID NO: 115011 - DNA, 25 bp, Rattus norvegicus
agagctgctggtagaagccctggac

SEQ ID NO: 115012 - DNA, 25 bp, Rattus norvegicus
agagctgctggtcatccagaaagac

SEQ ID NO: 115013 - DNA, 25 bp, Rattus norvegicus
agagctgctggtgatccagaaagac

SEQ ID NO: 115014 - DNA, 25 bp, Rattus norvegicus
agagctgctggttgaagccctggac

SEQ ID NO: 115015 - DNA, 25 bp, Rattus norvegicus
agagctgctgtgattctcccattct

SEQ ID NO: 115016 - DNA, 25 bp, Rattus norvegicus
agagctgctgtgtttctcccattct

SEQ ID NO: 115017 - DNA, 25 bp, Rattus norvegicus
agagctgcttggactccggagagca

SEQ ID NO: 115018 - DNA, 25 bp, Rattus norvegicus
agagctgcttggtctccggagagca

SEQ ID NO: 115019 - DNA, 25 bp, Rattus norvegicus
agagctggaatgaaccccttcccag

SEQ ID NO: 115020 - DNA, 25 bp, Rattus norvegicus
agagctggaatgagtgccttccttc

SEQ ID NO: 115021 - DNA, 25 bp, Rattus norvegicus
agagctggaatgtaccccttcccag

SEQ ID NO: 115022 - DNA, 25 bp, Rattus norvegicus
agagctggaatgtgtgccttccttc

SEQ ID NO: 115023 - DNA, 25 bp, Rattus norvegicus
agagctggactacagttcccgtggt

SEQ ID NO: 115024 - DNA, 25 bp, Rattus norvegicus
agagctggactagagttcccgtggt

SEQ ID NO: 115025 - DNA, 25 bp, Rattus norvegicus
agagctggattcaggtataggcatg

SEQ ID NO: 115026 - DNA, 25 bp, Rattus norvegicus
agagctggattctggtataggcatg

SEQ ID NO: 115027 - DNA, 25 bp, Rattus norvegicus
agagctggcacaaactcgggcagaa

SEQ ID NO: 115028 - DNA, 25 bp, Rattus norvegicus
agagctggcacatactcgggcagaa

SEQ ID NO: 115029 - DNA, 25 bp, Rattus norvegicus
agagctggcccaagattctagatga

SEQ ID NO: 115030 - DNA, 25 bp, Rattus norvegicus
agagctggcccacatgtggctgctt

SEQ ID NO: 115031 - DNA, 25 bp, Rattus norvegicus
agagctggcccagatgtggctgctt

SEQ ID NO: 115032 - DNA, 25 bp, Rattus norvegicus
agagctggcccatgattctagatga

SEQ ID NO: 115033 - DNA, 25 bp, Rattus norvegicus
agagctggcctaacataatttgcat

SEQ ID NO: 115034 - DNA, 25 bp, Rattus norvegicus
agagctggcctatcataatttgcat

SEQ ID NO: 115035 - DNA, 25 bp, Rattus norvegicus
agagctggcgacatctgactgggaa

SEQ ID NO: 115036 - DNA, 25 bp, Rattus norvegicus
agagctggcgacttctgactgggaa

SEQ ID NO: 115037 - DNA, 25 bp, Rattus norvegicus
agagctggcgtgagttcatctgctt

SEQ ID NO: 115038 - DNA, 25 bp, Rattus norvegicus
agagctggcgtgtgttcatctgctt

SEQ ID NO: 115039 - DNA, 25 bp, Rattus norvegicus
agagctggctgaagtgtccggttca

SEQ ID NO: 115040 - DNA, 25 bp, Rattus norvegicus
agagctggctgatgtgtccggttca

SEQ ID NO: 115041 - DNA, 25 bp, Rattus norvegicus
agagctggctgtaaccacatcactc

SEQ ID NO: 115042 - DNA, 25 bp, Rattus norvegicus
agagctggctgttaccacatcactc

SEQ ID NO: 115043 - DNA, 25 bp, Rattus norvegicus
agagctggcttaccagtttcgagca

SEQ ID NO: 115044 - DNA, 25 bp, Rattus norvegicus
agagctggcttagcagtttcgagca

SEQ ID NO: 115045 - DNA, 25 bp, Rattus norvegicus
agagctgggatgacagacccgtgtc

SEQ ID NO: 115046 - DNA, 25 bp, Rattus norvegicus
agagctgggatgtcagacccgtgtc

SEQ ID NO: 115047 - DNA, 25 bp, Rattus norvegicus
agagctgggcacagtcctttgacaa

SEQ ID NO: 115048 - DNA, 25 bp, Rattus norvegicus
agagctgggcactgtcctttgacaa

SEQ ID NO: 115049 - DNA, 25 bp, Rattus norvegicus
agagctgggccaaaccttctatgtg

SEQ ID NO: 115050 - DNA, 25 bp, Rattus norvegicus
agagctgggccaaatctctgggaac

SEQ ID NO: 115051 - DNA, 25 bp, Rattus norvegicus
agagctgggccataccttctatgtg

SEQ ID NO: 115052 - DNA, 25 bp, Rattus norvegicus
agagctgggccatatctctgggaac

SEQ ID NO: 115053 - DNA, 25 bp, Rattus norvegicus
agagctgggcgcagtaatcgaccag

SEQ ID NO: 115054 - DNA, 25 bp, Rattus norvegicus
agagctgggcgctgtaatcgaccag

SEQ ID NO: 115055 - DNA, 25 bp, Rattus norvegicus
agagctgggctgagctactctggca

SEQ ID NO: 115056 - DNA, 25 bp, Rattus norvegicus
agagctgggctgcacctctgagcta

SEQ ID NO: 115057 - DNA, 25 bp, Rattus norvegicus
agagctgggctggacctctgagcta

SEQ ID NO: 115058 - DNA, 25 bp, Rattus norvegicus
agagctgggctgtgctactctggca

SEQ ID NO: 115059 - DNA, 25 bp, Rattus norvegicus
agagctgggtctcactacatagtcc

SEQ ID NO: 115060 - DNA, 25 bp, Rattus norvegicus
agagctgggtctcccttggagcaca

SEQ ID NO: 115061 - DNA, 25 bp, Rattus norvegicus
agagctgggtctgactacatagtcc

SEQ ID NO: 115062 - DNA, 25 bp, Rattus norvegicus
agagctgggtctgccttggagcaca

SEQ ID NO: 115063 - DNA, 25 bp, Rattus norvegicus
agagctggtacaacgcagacatatt

SEQ ID NO: 115064 - DNA, 25 bp, Rattus norvegicus
agagctggtacatcgcagacatatt

SEQ ID NO: 115065 - DNA, 25 bp, Rattus norvegicus
agagctggtagcagaccttcgtgaa

SEQ ID NO: 115066 - DNA, 25 bp, Rattus norvegicus
agagctggtagctgaccttcgtgaa

SEQ ID NO: 115067 - DNA, 25 bp, Rattus norvegicus
agagctggtcaactcgctggctttt

SEQ ID NO: 115068 - DNA, 25 bp, Rattus norvegicus
agagctggtcaagtcgctggctttt

SEQ ID NO: 115069 - DNA, 25 bp, Rattus norvegicus
agagctggtcttccgtcctagggat

SEQ ID NO: 115070 - DNA, 25 bp, Rattus norvegicus
agagctggtcttgcgtcctagggat

SEQ ID NO: 115071 - DNA, 25 bp, Rattus norvegicus
agagctggtgatcacctccgtgaaa

SEQ ID NO: 115072 - DNA, 25 bp, Rattus norvegicus
agagctggtgatgacctccgtgaaa

SEQ ID NO: 115073 - DNA, 25 bp, Rattus norvegicus
agagctggtgtgattctgcctcgag

SEQ ID NO: 115074 - DNA, 25 bp, Rattus norvegicus
agagctggtgtgtttctgcctcgag

SEQ ID NO: 115075 - DNA, 25 bp, Rattus norvegicus
agagctggttgtactaaatcggaag

SEQ ID NO: 115076 - DNA, 25 bp, Rattus norvegicus
agagctggttgttctaaatcggaag

SEQ ID NO: 115077 - DNA, 25 bp, Rattus norvegicus
agagctgtaaagaactgaggtgaac

SEQ ID NO: 115078 - DNA, 25 bp, Rattus norvegicus
agagctgtaaagtactgaggtgaac

SEQ ID NO: 115079 - DNA, 25 bp, Rattus norvegicus
agagctgtaaatccccatcatcctg

SEQ ID NO: 115080 - DNA, 25 bp, Rattus norvegicus
agagctgtaaatgcccatcatcctg

SEQ ID NO: 115081 - DNA, 25 bp, Rattus norvegicus
agagctgtaaccctaaaaccctctg

SEQ ID NO: 115082 - DNA, 25 bp, Rattus norvegicus
agagctgtaaccgtaaaaccctctg

SEQ ID NO: 115083 - DNA, 25 bp, Rattus norvegicus
agagctgtacacaaggcctgccagt

SEQ ID NO: 115084 - DNA, 25 bp, Rattus norvegicus
agagctgtacactaggcctgccagt

SEQ ID NO: 115085 - DNA, 25 bp, Rattus norvegicus
agagctgtagcacagttctcgccta

SEQ ID NO: 115086 - DNA, 25 bp, Rattus norvegicus
agagctgtagcagagttctcgccta

SEQ ID NO: 115087 - DNA, 25 bp, Rattus norvegicus
agagctgtaggaaccgaagcacccc

SEQ ID NO: 115088 - DNA, 25 bp, Rattus norvegicus
agagctgtaggatccgaagcacccc

SEQ ID NO: 115089 - DNA, 25 bp, Rattus norvegicus
agagctgtagtgacttggttacctg

SEQ ID NO: 115090 - DNA, 25 bp, Rattus norvegicus
agagctgtagtgtcttggttacctg

SEQ ID NO: 115091 - DNA, 25 bp, Rattus norvegicus
agagctgtatctcgatgctgtcggc

SEQ ID NO: 115092 - DNA, 25 bp, Rattus norvegicus
agagctgtatctggatgctgtcggc

SEQ ID NO: 115093 - DNA, 25 bp, Rattus norvegicus
agagctgtcaatctcatgaccccag

SEQ ID NO: 115094 - DNA, 25 bp, Rattus norvegicus
agagctgtcaatgtcatgaccccag

SEQ ID NO: 115095 - DNA, 25 bp, Rattus norvegicus
agagctgtcattactagtatttaca

SEQ ID NO: 115096 - DNA, 25 bp, Rattus norvegicus
agagctgtcatttctagtatttaca

SEQ ID NO: 115097 - DNA, 25 bp, Rattus norvegicus
agagctgtcggccacactcagtgca

SEQ ID NO: 115098 - DNA, 25 bp, Rattus norvegicus
agagctgtcggcgacactcagtgca

SEQ ID NO: 115099 - DNA, 25 bp, Rattus norvegicus
agagctgtctctcttaacgtccgat

SEQ ID NO: 115100 - DNA, 25 bp, Rattus norvegicus
agagctgtctctgttaacgtccgat

SEQ ID NO: 115101 - DNA, 25 bp, Rattus norvegicus
agagctgtcttcactagtcttgcta

SEQ ID NO: 115102 - DNA, 25 bp, Rattus norvegicus
agagctgtcttctctagtcttgcta

SEQ ID NO: 115103 - DNA, 25 bp, Rattus norvegicus
agagctgtgagtactgtgtgagtcc

SEQ ID NO: 115104 - DNA, 25 bp, Rattus norvegicus
agagctgtgagttctgtgtgagtcc

SEQ ID NO: 115105 - DNA, 25 bp, Rattus norvegicus
agagctgtgcaaagtttccctcgga

SEQ ID NO: 115106 - DNA, 25 bp, Rattus norvegicus
agagctgtgcaatgtttccctcgga

SEQ ID NO: 115107 - DNA, 25 bp, Rattus norvegicus
agagctgtgcccctgatctttggtg

SEQ ID NO: 115108 - DNA, 25 bp, Rattus norvegicus
agagctgtgcccgtgatctttggtg

SEQ ID NO: 115109 - DNA, 25 bp, Rattus norvegicus
agagctgtgcgaagcgatccttgaa

SEQ ID NO: 115110 - DNA, 25 bp, Rattus norvegicus
agagctgtgcgatgcgatccttgaa

SEQ ID NO: 115111 - DNA, 25 bp, Rattus norvegicus
agagctgtggaaaggtcttctcccc

SEQ ID NO: 115112 - DNA, 25 bp, Rattus norvegicus
agagctgtggaatggtcttctcccc

SEQ ID NO: 115113 - DNA, 25 bp, Rattus norvegicus
agagctgtggagcagccccgtcttc

SEQ ID NO: 115114 - DNA, 25 bp, Rattus norvegicus
agagctgtggaggagccccgtcttc

SEQ ID NO: 115115 - DNA, 25 bp, Rattus norvegicus
agagctgtggcaagtcattttctcc

SEQ ID NO: 115116 - DNA, 25 bp, Rattus norvegicus
agagctgtggcatgtcattttctcc

SEQ ID NO: 115117 - DNA, 25 bp, Rattus norvegicus
agagctgtggccatttgtgcaggct

SEQ ID NO: 115118 - DNA, 25 bp, Rattus norvegicus
agagctgtggccttttgtgcaggct

SEQ ID NO: 115119 - DNA, 25 bp, Rattus norvegicus
agagctgtgtgtatgctgagcaaca

SEQ ID NO: 115120 - DNA, 25 bp, Rattus norvegicus
agagctgtgtgtttgctgagcaaca

SEQ ID NO: 115121 - DNA, 25 bp, Rattus norvegicus
agagctgtgtttctaatgagctgca

SEQ ID NO: 115122 - DNA, 25 bp, Rattus norvegicus
agagctgtgtttgtaatgagctgca

SEQ ID NO: 115123 - DNA, 25 bp, Rattus norvegicus
agagctgttaccattttgttaccca

SEQ ID NO: 115124 - DNA, 25 bp, Rattus norvegicus
agagctgttacctttttgttaccca

SEQ ID NO: 115125 - DNA, 25 bp, Rattus norvegicus
agagctgttcccctgatgccctcat

SEQ ID NO: 115126 - DNA, 25 bp, Rattus norvegicus
agagctgttcccctgttgggtgaaa

SEQ ID NO: 115127 - DNA, 25 bp, Rattus norvegicus
agagctgttcccgtgatgccctcat

SEQ ID NO: 115128 - DNA, 25 bp, Rattus norvegicus
agagctgttcccgtgttgggtgaaa

SEQ ID NO: 115129 - DNA, 25 bp, Rattus norvegicus
agagctgttcctctttatgccggtc

SEQ ID NO: 115130 - DNA, 25 bp, Rattus norvegicus
agagctgttcctgtttatgccggtc

SEQ ID NO: 115131 - DNA, 25 bp, Rattus norvegicus
agagctgttcttatactatatcccc

SEQ ID NO: 115132 - DNA, 25 bp, Rattus norvegicus
agagctgttcttttactatatcccc

SEQ ID NO: 115133 - DNA, 25 bp, Rattus norvegicus
agagctgttgacattttgtggtata

SEQ ID NO: 115134 - DNA, 25 bp, Rattus norvegicus
agagctgttgactttttgtggtata

SEQ ID NO: 115135 - DNA, 25 bp, Rattus norvegicus
agagctgttgggagattttgacatc

SEQ ID NO: 115136 - DNA, 25 bp, Rattus norvegicus
agagctgttgggtgattttgacatc

SEQ ID NO: 115137 - DNA, 25 bp, Rattus norvegicus
agagctgttgtcaccgagggctgac

SEQ ID NO: 115138 - DNA, 25 bp, Rattus norvegicus
agagctgttgtctccgagggctgac

SEQ ID NO: 115139 - DNA, 25 bp, Rattus norvegicus
agagctgtttaccaaccacaagcac

SEQ ID NO: 115140 - DNA, 25 bp, Rattus norvegicus
agagctgtttacgaaccacaagcac

SEQ ID NO: 115141 - DNA, 25 bp, Rattus norvegicus
agagctgtttggcacagttcctatc

SEQ ID NO: 115142 - DNA, 25 bp, Rattus norvegicus
agagctgtttgggacagttcctatc

SEQ ID NO: 115143 - DNA, 25 bp, Rattus norvegicus
agagcttacagccttttcgagttag

SEQ ID NO: 115144 - DNA, 25 bp, Rattus norvegicus
agagcttacagcgttttcgagttag

SEQ ID NO: 115145 - DNA, 25 bp, Rattus norvegicus
agagcttaccctctgcaagtgtaag

SEQ ID NO: 115146 - DNA, 25 bp, Rattus norvegicus
agagcttaccctgtgcaagtgtaag

SEQ ID NO: 115147 - DNA, 25 bp, Rattus norvegicus
agagcttacctgctggacatcgagg

SEQ ID NO: 115148 - DNA, 25 bp, Rattus norvegicus
agagcttacctggtggacatcgagg

SEQ ID NO: 115149 - DNA, 25 bp, Rattus norvegicus
agagcttactacatatttgtgcaaa

SEQ ID NO: 115150 - DNA, 25 bp, Rattus norvegicus
agagcttactacttatttgtgcaaa

SEQ ID NO: 115151 - DNA, 25 bp, Rattus norvegicus
agagcttactggacttcagtccatg

SEQ ID NO: 115152 - DNA, 25 bp, Rattus norvegicus
agagcttactggagcgcacatctgc

SEQ ID NO: 115153 - DNA, 25 bp, Rattus norvegicus
agagcttactggtcttcagtccatg

SEQ ID NO: 115154 - DNA, 25 bp, Rattus norvegicus
agagcttactggtgcgcacatctgc

SEQ ID NO: 115155 - DNA, 25 bp, Rattus norvegicus
agagcttagaagacgcccaggtcag

SEQ ID NO: 115156 - DNA, 25 bp, Rattus norvegicus
agagcttagaagtcgcccaggtcag

SEQ ID NO: 115157 - DNA, 25 bp, Rattus norvegicus
agagcttagggcagctactgtctca

SEQ ID NO: 115158 - DNA, 25 bp, Rattus norvegicus
agagcttagggctgctactgtctca

SEQ ID NO: 115159 - DNA, 25 bp, Rattus norvegicus
agagcttagtgtccaggagacgtct

SEQ ID NO: 115160 - DNA, 25 bp, Rattus norvegicus
agagcttagtgtgcaggagacgtct

SEQ ID NO: 115161 - DNA, 25 bp, Rattus norvegicus
agagcttattgcattctccagaaga

SEQ ID NO: 115162 - DNA, 25 bp, Rattus norvegicus
agagcttattgctttctccagaaga

SEQ ID NO: 115163 - DNA, 25 bp, Rattus norvegicus
agagcttattggcttaccttatata

SEQ ID NO: 115164 - DNA, 25 bp, Rattus norvegicus
agagcttattgggttaccttatata

SEQ ID NO: 115165 - DNA, 25 bp, Rattus norvegicus
agagcttcaaacacatgggcacatg

SEQ ID NO: 115166 - DNA, 25 bp, Rattus norvegicus
agagcttcaaactcatgggcacatg

SEQ ID NO: 115167 - DNA, 25 bp, Rattus norvegicus
agagcttcagaaatacaccacccat

SEQ ID NO: 115168 - DNA, 25 bp, Rattus norvegicus
agagcttcagaattacaccacccat

SEQ ID NO: 115169 - DNA, 25 bp, Rattus norvegicus
agagcttcagagacagccatctccc

SEQ ID NO: 115170 - DNA, 25 bp, Rattus norvegicus
agagcttcagagtcagccatctccc

SEQ ID NO: 115171 - DNA, 25 bp, Rattus norvegicus
agagcttcatttctgtcaatcccct

SEQ ID NO: 115172 - DNA, 25 bp, Rattus norvegicus
agagcttcatttgtgtcaatcccct

SEQ ID NO: 115173 - DNA, 25 bp, Rattus norvegicus
agagcttccagaaccgcagacgctg

SEQ ID NO: 115174 - DNA, 25 bp, Rattus norvegicus
agagcttccagatccgcagacgctg

SEQ ID NO: 115175 - DNA, 25 bp, Rattus norvegicus
agagcttccattcccaaatcttcag

SEQ ID NO: 115176 - DNA, 25 bp, Rattus norvegicus
agagcttccattgccaaatcttcag

SEQ ID NO: 115177 - DNA, 25 bp, Rattus norvegicus
agagcttcccttaacttctgtagtc

SEQ ID NO: 115178 - DNA, 25 bp, Rattus norvegicus
agagcttccctttacttctgtagtc

SEQ ID NO: 115179 - DNA, 25 bp, Rattus norvegicus
agagcttccgccatcacgctgagca

SEQ ID NO: 115180 - DNA, 25 bp, Rattus norvegicus
agagcttccgccttcacgctgagca

SEQ ID NO: 115181 - DNA, 25 bp, Rattus norvegicus
agagcttcctagcagaccgtgcagg

SEQ ID NO: 115182 - DNA, 25 bp, Rattus norvegicus
agagcttcctaggagaccgtgcagg

SEQ ID NO: 115183 - DNA, 25 bp, Rattus norvegicus
agagcttcctatctggtttctatga

SEQ ID NO: 115184 - DNA, 25 bp, Rattus norvegicus
agagcttcctatgtggtttctatga

SEQ ID NO: 115185 - DNA, 25 bp, Rattus norvegicus
agagcttcgctcatggtaggctagc

SEQ ID NO: 115186 - DNA, 25 bp, Rattus norvegicus
agagcttcgctcttggtaggctagc

SEQ ID NO: 115187 - DNA, 25 bp, Rattus norvegicus
agagcttcggcacatggcagccagc

SEQ ID NO: 115188 - DNA, 25 bp, Rattus norvegicus
agagcttcggcagatggcagccagc

SEQ ID NO: 115189 - DNA, 25 bp, Rattus norvegicus
agagcttcgtgcatgcagatggagc

SEQ ID NO: 115190 - DNA, 25 bp, Rattus norvegicus
agagcttcgtgcttgcagatggagc

SEQ ID NO: 115191 - DNA, 25 bp, Rattus norvegicus
agagcttctacgatgtgctttggtg

SEQ ID NO: 115192 - DNA, 25 bp, Rattus norvegicus
agagcttctacgttgtgctttggtg

SEQ ID NO: 115193 - DNA, 25 bp, Rattus norvegicus
agagcttctcataaacctggtgaaa

SEQ ID NO: 115194 - DNA, 25 bp, Rattus norvegicus
agagcttctcattaacctggtgaaa

SEQ ID NO: 115195 - DNA, 25 bp, Rattus norvegicus
agagcttctcctcagcatactaggg

SEQ ID NO: 115196 - DNA, 25 bp, Rattus norvegicus
agagcttctcctgagcatactaggg

SEQ ID NO: 115197 - DNA, 25 bp, Rattus norvegicus
agagcttctctcatagccgctggct

SEQ ID NO: 115198 - DNA, 25 bp, Rattus norvegicus
agagcttctctcttagccgctggct

SEQ ID NO: 115199 - DNA, 25 bp, Rattus norvegicus
agagcttctctgagtccacgggtgc

SEQ ID NO: 115200 - DNA, 25 bp, Rattus norvegicus
agagcttctctgtgtccacgggtgc

SEQ ID NO: 115201 - DNA, 25 bp, Rattus norvegicus
agagcttctgctctactactttttg

SEQ ID NO: 115202 - DNA, 25 bp, Rattus norvegicus
agagcttctgctgtactactttttg

SEQ ID NO: 115203 - DNA, 25 bp, Rattus norvegicus
agagcttctggaatggagatgctga

SEQ ID NO: 115204 - DNA, 25 bp, Rattus norvegicus
agagcttctggacccacaaggtgga

SEQ ID NO: 115205 - DNA, 25 bp, Rattus norvegicus
agagcttctggagccacaaggtgga

SEQ ID NO: 115206 - DNA, 25 bp, Rattus norvegicus
agagcttctggattggagatgctga

SEQ ID NO: 115207 - DNA, 25 bp, Rattus norvegicus
agagcttctggtcatatccttcata

SEQ ID NO: 115208 - DNA, 25 bp, Rattus norvegicus
agagcttctggtgatatccttcata

SEQ ID NO: 115209 - DNA, 25 bp, Rattus norvegicus
agagcttctgtgacttgtccaaggc

SEQ ID NO: 115210 - DNA, 25 bp, Rattus norvegicus
agagcttctgtgtcttgtccaaggc

SEQ ID NO: 115211 - DNA, 25 bp, Rattus norvegicus
agagcttcttacagagtttgtacac

SEQ ID NO: 115212 - DNA, 25 bp, Rattus norvegicus
agagcttcttactgagtttgtacac

SEQ ID NO: 115213 - DNA, 25 bp, Rattus norvegicus
agagcttcttcaccagccgcatggc

SEQ ID NO: 115214 - DNA, 25 bp, Rattus norvegicus
agagcttcttcagcagccgcatggc

SEQ ID NO: 115215 - DNA, 25 bp, Rattus norvegicus
agagcttcttccacctgtcagttaa

SEQ ID NO: 115216 - DNA, 25 bp, Rattus norvegicus
agagcttcttcctcctgtcagttaa

SEQ ID NO: 115217 - DNA, 25 bp, Rattus norvegicus
agagcttgactacggtccacctttg

SEQ ID NO: 115218 - DNA, 25 bp, Rattus norvegicus
agagcttgactagggtccacctttg

SEQ ID NO: 115219 - DNA, 25 bp, Rattus norvegicus
agagcttgagacctgggacatttaa

SEQ ID NO: 115220 - DNA, 25 bp, Rattus norvegicus
agagcttgagacgtgggacatttaa

SEQ ID NO: 115221 - DNA, 25 bp, Rattus norvegicus
agagcttgaggtaccacacacgatc

SEQ ID NO: 115222 - DNA, 25 bp, Rattus norvegicus
agagcttgaggttccacacacgatc

SEQ ID NO: 115223 - DNA, 25 bp, Rattus norvegicus
agagcttgcactcaggcaaccttga

SEQ ID NO: 115224 - DNA, 25 bp, Rattus norvegicus
agagcttgcactgaggcaaccttga

SEQ ID NO: 115225 - DNA, 25 bp, Rattus norvegicus
agagcttgcagaaagttcgcggctg

SEQ ID NO: 115226 - DNA, 25 bp, Rattus norvegicus
agagcttgcagatagttcgcggctg

SEQ ID NO: 115227 - DNA, 25 bp, Rattus norvegicus
agagcttgcagtctctacgcagcga

SEQ ID NO: 115228 - DNA, 25 bp, Rattus norvegicus
agagcttgcagtgtctacgcagcga

SEQ ID NO: 115229 - DNA, 25 bp, Rattus norvegicus
agagcttgcttaatgtctgccatgc

SEQ ID NO: 115230 - DNA, 25 bp, Rattus norvegicus
agagcttgcttattgtctgccatgc

SEQ ID NO: 115231 - DNA, 25 bp, Rattus norvegicus
agagcttgctttagagtggtctcct

SEQ ID NO: 115232 - DNA, 25 bp, Rattus norvegicus
agagcttgcttttgagtggtctcct

SEQ ID NO: 115233 - DNA, 25 bp, Rattus norvegicus
agagcttgtcctcctgcagaaggtt

SEQ ID NO: 115234 - DNA, 25 bp, Rattus norvegicus
agagcttgtcctgctgcagaaggtt

SEQ ID NO: 115235 - DNA, 25 bp, Rattus norvegicus
agagcttgtctcctggttgtagtca

SEQ ID NO: 115236 - DNA, 25 bp, Rattus norvegicus
agagcttgtctcgtggttgtagtca

SEQ ID NO: 115237 - DNA, 25 bp, Rattus norvegicus
agagcttgtgacctctgacctgagt

SEQ ID NO: 115238 - DNA, 25 bp, Rattus norvegicus
agagcttgtgacgtctgacctgagt

SEQ ID NO: 115239 - DNA, 25 bp, Rattus norvegicus
agagcttgtgccctcgagagattct

SEQ ID NO: 115240 - DNA, 25 bp, Rattus norvegicus
agagcttgtgccgtcgagagattct

SEQ ID NO: 115241 - DNA, 25 bp, Rattus norvegicus
agagctttacctacttcaactccat

SEQ ID NO: 115242 - DNA, 25 bp, Rattus norvegicus
agagctttaccttcttcaactccat

SEQ ID NO: 115243 - DNA, 25 bp, Rattus norvegicus
agagctttactcaatgagtccacac

SEQ ID NO: 115244 - DNA, 25 bp, Rattus norvegicus
agagctttactctatgagtccacac

SEQ ID NO: 115245 - DNA, 25 bp, Rattus norvegicus
agagctttcataccattggaactag

SEQ ID NO: 115246 - DNA, 25 bp, Rattus norvegicus
agagctttcatagcattggaactag

SEQ ID NO: 115247 - DNA, 25 bp, Rattus norvegicus
agagctttccgcacatggagcctaa

SEQ ID NO: 115248 - DNA, 25 bp, Rattus norvegicus
agagctttccgctcatggagcctaa

SEQ ID NO: 115249 - DNA, 25 bp, Rattus norvegicus
agagctttccttattaatgcctaag

SEQ ID NO: 115250 - DNA, 25 bp, Rattus norvegicus
agagctttcctttttaatgcctaag

SEQ ID NO: 115251 - DNA, 25 bp, Rattus norvegicus
agagctttcgttacttctacagaag

SEQ ID NO: 115252 - DNA, 25 bp, Rattus norvegicus
agagctttcgtttcttctacagaag

SEQ ID NO: 115253 - DNA, 25 bp, Rattus norvegicus
agagctttctcacaaaactccgccg

SEQ ID NO: 115254 - DNA, 25 bp, Rattus norvegicus
agagctttctcagaaaactccgccg

SEQ ID NO: 115255 - DNA, 25 bp, Rattus norvegicus
agagctttctctctatgggatttga

SEQ ID NO: 115256 - DNA, 25 bp, Rattus norvegicus
agagctttctctgtatgggatttga

SEQ ID NO: 115257 - DNA, 25 bp, Rattus norvegicus
agagctttctgacatccagcagggt

SEQ ID NO: 115258 - DNA, 25 bp, Rattus norvegicus
agagctttctgagatccagcagggt

SEQ ID NO: 115259 - DNA, 25 bp, Rattus norvegicus
agagctttctggcagtctttataca

SEQ ID NO: 115260 - DNA, 25 bp, Rattus norvegicus
agagctttctgggagtctttataca

SEQ ID NO: 115261 - DNA, 25 bp, Rattus norvegicus
agagctttgcttagattctgtttcc

SEQ ID NO: 115262 - DNA, 25 bp, Rattus norvegicus
agagctttgctttgattctgtttcc

SEQ ID NO: 115263 - DNA, 25 bp, Rattus norvegicus
agagctttgggcagaggctgtctct

SEQ ID NO: 115264 - DNA, 25 bp, Rattus norvegicus
agagctttgggctgaggctgtctct

SEQ ID NO: 115265 - DNA, 25 bp, Rattus norvegicus
agagctttgtcacttgccacttgat

SEQ ID NO: 115266 - DNA, 25 bp, Rattus norvegicus
agagctttgtcagttgccacttgat

SEQ ID NO: 115267 - DNA, 25 bp, Rattus norvegicus
agagctttgtctctgctacacaact

SEQ ID NO: 115268 - DNA, 25 bp, Rattus norvegicus
agagctttgtctgtgctacacaact

SEQ ID NO: 115269 - DNA, 25 bp, Rattus norvegicus
agagctttgtgaacgtcttcataga

SEQ ID NO: 115270 - DNA, 25 bp, Rattus norvegicus
agagctttgtgatcgtcttcataga

SEQ ID NO: 115271 - DNA, 25 bp, Rattus norvegicus
agagctttgttccttcgttgtcgtc

SEQ ID NO: 115272 - DNA, 25 bp, Rattus norvegicus
agagctttgttcgttcgttgtcgtc

SEQ ID NO: 115273 - DNA, 25 bp, Rattus norvegicus
agagcttttcctaggtttgggcctg

SEQ ID NO: 115274 - DNA, 25 bp, Rattus norvegicus
agagcttttccttggtttgggcctg

SEQ ID NO: 115275 - DNA, 25 bp, Rattus norvegicus
agagcttttctccatgtttatgcaa

SEQ ID NO: 115276 - DNA, 25 bp, Rattus norvegicus
agagcttttctcgatgtttatgcaa

SEQ ID NO: 115277 - DNA, 25 bp, Rattus norvegicus
agagcttttctgcatggccactaga

SEQ ID NO: 115278 - DNA, 25 bp, Rattus norvegicus
agagcttttctggatggccactaga

SEQ ID NO: 115279 - DNA, 25 bp, Rattus norvegicus
agagcttttgagcaccaccgtgtgg

SEQ ID NO: 115280 - DNA, 25 bp, Rattus norvegicus
agagcttttgaggaccaccgtgtgg

SEQ ID NO: 115281 - DNA, 25 bp, Rattus norvegicus
agagcttttgtactaaggtcccaca

SEQ ID NO: 115282 - DNA, 25 bp, Rattus norvegicus
agagcttttgtagtaaggtcccaca

SEQ ID NO: 115283 - DNA, 25 bp, Rattus norvegicus
agagctttttctctccaaggtgtct

SEQ ID NO: 115284 - DNA, 25 bp, Rattus norvegicus
agagctttttctgtccaaggtgtct

SEQ ID NO: 115285 - DNA, 25 bp, Rattus norvegicus
agaggaaaccccactgttcacattc

SEQ ID NO: 115286 - DNA, 25 bp, Rattus norvegicus
agaggaaacccctctgttcacattc

SEQ ID NO: 115287 - DNA, 25 bp, Rattus norvegicus
agaggaaacctcatctcaaaaacaa

SEQ ID NO: 115288 - DNA, 25 bp, Rattus norvegicus
agaggaaacctcttctcaaaaacaa

SEQ ID NO: 115289 - DNA, 25 bp, Rattus norvegicus
agaggaaaccttctcttccaggact

SEQ ID NO: 115290 - DNA, 25 bp, Rattus norvegicus
agaggaaaccttgtcttccaggact

SEQ ID NO: 115291 - DNA, 25 bp, Rattus norvegicus
agaggaaagcacacagcctgcgtgg

SEQ ID NO: 115292 - DNA, 25 bp, Rattus norvegicus
agaggaaagcactcagcctgcgtgg

SEQ ID NO: 115293 - DNA, 25 bp, Rattus norvegicus
agaggaaagccaacggtttcggatg

SEQ ID NO: 115294 - DNA, 25 bp, Rattus norvegicus
agaggaaagccatcggtttcggatg

SEQ ID NO: 115295 - DNA, 25 bp, Rattus norvegicus
agaggaaatagcaagtgtccttccc

SEQ ID NO: 115296 - DNA, 25 bp, Rattus norvegicus
agaggaaatagctagtgtccttccc

SEQ ID NO: 115297 - DNA, 25 bp, Rattus norvegicus
agaggaacacatatcgcttgcgcac

SEQ ID NO: 115298 - DNA, 25 bp, Rattus norvegicus
agaggaacacatttcgcttgcgcac

SEQ ID NO: 115299 - DNA, 25 bp, Rattus norvegicus
agaggaacaggcctctgagccacac

SEQ ID NO: 115300 - DNA, 25 bp, Rattus norvegicus
agaggaacaggcgtctgagccacac

SEQ ID NO: 115301 - DNA, 25 bp, Rattus norvegicus
agaggaaccactctgccatggtctt

SEQ ID NO: 115302 - DNA, 25 bp, Rattus norvegicus
agaggaaccactgtgccatggtctt

SEQ ID NO: 115303 - DNA, 25 bp, Rattus norvegicus
agaggaacccaacagcaccactcgg

SEQ ID NO: 115304 - DNA, 25 bp, Rattus norvegicus
agaggaacccaagagcaccactcgg

SEQ ID NO: 115305 - DNA, 25 bp, Rattus norvegicus
agaggaacccatctactgccttaga

SEQ ID NO: 115306 - DNA, 25 bp, Rattus norvegicus
agaggaacccatgtactgccttaga

SEQ ID NO: 115307 - DNA, 25 bp, Rattus norvegicus
agaggaaccctgcttggcgcccagt

SEQ ID NO: 115308 - DNA, 25 bp, Rattus norvegicus
agaggaaccctggttggcgcccagt

SEQ ID NO: 115309 - DNA, 25 bp, Rattus norvegicus
agaggaaccgcaatgtaaccagaac

SEQ ID NO: 115310 - DNA, 25 bp, Rattus norvegicus
agaggaaccgcattgtaaccagaac

SEQ ID NO: 115311 - DNA, 25 bp, Rattus norvegicus
agaggaaccggcaagctgcagctgc

SEQ ID NO: 115312 - DNA, 25 bp, Rattus norvegicus
agaggaaccggctagctgcagctgc

SEQ ID NO: 115313 - DNA, 25 bp, Rattus norvegicus
agaggaaccgttagccgccgaagtg

SEQ ID NO: 115314 - DNA, 25 bp, Rattus norvegicus
agaggaaccgtttgccgccgaagtg

SEQ ID NO: 115315 - DNA, 25 bp, Rattus norvegicus
agaggaacctccacctttgcaattt

SEQ ID NO: 115316 - DNA, 25 bp, Rattus norvegicus
agaggaacctcctcctttgcaattt

SEQ ID NO: 115317 - DNA, 25 bp, Rattus norvegicus
agaggaactggaatcccgctggcaa

SEQ ID NO: 115318 - DNA, 25 bp, Rattus norvegicus
agaggaactggattcccgctggcaa

SEQ ID NO: 115319 - DNA, 25 bp, Rattus norvegicus
agaggaactgtaaatctgttgccca

SEQ ID NO: 115320 - DNA, 25 bp, Rattus norvegicus
agaggaactgtatatctgttgccca

SEQ ID NO: 115321 - DNA, 25 bp, Rattus norvegicus
agaggaacttcgacgagagctgcct

SEQ ID NO: 115322 - DNA, 25 bp, Rattus norvegicus
agaggaacttcgtcgagagctgcct

SEQ ID NO: 115323 - DNA, 25 bp, Rattus norvegicus
agaggaacttctcagatgctgcact

SEQ ID NO: 115324 - DNA, 25 bp, Rattus norvegicus
agaggaacttctgagatgctgcact

SEQ ID NO: 115325 - DNA, 25 bp, Rattus norvegicus
agaggaagaagcctcccaatccgga

SEQ ID NO: 115326 - DNA, 25 bp, Rattus norvegicus
agaggaagaagcgtcccaatccgga

SEQ ID NO: 115327 - DNA, 25 bp, Rattus norvegicus
agaggaagacagactctctccagac

SEQ ID NO: 115328 - DNA, 25 bp, Rattus norvegicus
agaggaagacagtctctctccagac

SEQ ID NO: 115329 - DNA, 25 bp, Rattus norvegicus
agaggaagaccaactgccccttcag

SEQ ID NO: 115330 - DNA, 25 bp, Rattus norvegicus
agaggaagaccatctgccccttcag

SEQ ID NO: 115331 - DNA, 25 bp, Rattus norvegicus
agaggaagactgaccttagcagtgg

SEQ ID NO: 115332 - DNA, 25 bp, Rattus norvegicus
agaggaagactgtccttagcagtgg

SEQ ID NO: 115333 - DNA, 25 bp, Rattus norvegicus
agaggaagacttagccatccctcag

SEQ ID NO: 115334 - DNA, 25 bp, Rattus norvegicus
agaggaagactttgccatccctcag

SEQ ID NO: 115335 - DNA, 25 bp, Rattus norvegicus
agaggaagcagtatctcacgtgcct

SEQ ID NO: 115336 - DNA, 25 bp, Rattus norvegicus
agaggaagcagtttctcacgtgcct

SEQ ID NO: 115337 - DNA, 25 bp, Rattus norvegicus
agaggaagccaaagacccaggtcaa

SEQ ID NO: 115338 - DNA, 25 bp, Rattus norvegicus
agaggaagccaatgacccaggtcaa

SEQ ID NO: 115339 - DNA, 25 bp, Rattus norvegicus
agaggaagccccagatccatctgtg

SEQ ID NO: 115340 - DNA, 25 bp, Rattus norvegicus
agaggaagcccctgatccatctgtg

SEQ ID NO: 115341 - DNA, 25 bp, Rattus norvegicus
agaggaagccctcgtaggaactgaa

SEQ ID NO: 115342 - DNA, 25 bp, Rattus norvegicus
agaggaagccctggtaggaactgaa

SEQ ID NO: 115343 - DNA, 25 bp, Rattus norvegicus
agaggaagctctcccggtagtacgc

SEQ ID NO: 115344 - DNA, 25 bp, Rattus norvegicus
agaggaagctctgccggtagtacgc

SEQ ID NO: 115345 - DNA, 25 bp, Rattus norvegicus
agaggaagctgacccctgcaaatcc

SEQ ID NO: 115346 - DNA, 25 bp, Rattus norvegicus
agaggaagctgagccctgcaaatcc

SEQ ID NO: 115347 - DNA, 25 bp, Rattus norvegicus
agaggaagctgcacacagggcacca

SEQ ID NO: 115348 - DNA, 25 bp, Rattus norvegicus
agaggaagctgcagtctctgtgtct

SEQ ID NO: 115349 - DNA, 25 bp, Rattus norvegicus
agaggaagctgctcacagggcacca

SEQ ID NO: 115350 - DNA, 25 bp, Rattus norvegicus
agaggaagctgctgtctctgtgtct

SEQ ID NO: 115351 - DNA, 25 bp, Rattus norvegicus
agaggaagcttcagctcggctcgct

SEQ ID NO: 115352 - DNA, 25 bp, Rattus norvegicus
agaggaagcttctgctcggctcgct

SEQ ID NO: 115353 - DNA, 25 bp, Rattus norvegicus
agaggaagctttcagctcagcgcca

SEQ ID NO: 115354 - DNA, 25 bp, Rattus norvegicus
agaggaagctttgagctcagcgcca

SEQ ID NO: 115355 - DNA, 25 bp, Rattus norvegicus
agaggaaggctgacctgtctaccct

SEQ ID NO: 115356 - DNA, 25 bp, Rattus norvegicus
agaggaaggctgtcctgtctaccct

SEQ ID NO: 115357 - DNA, 25 bp, Rattus norvegicus
agaggaagtagtcccactcactgtc

SEQ ID NO: 115358 - DNA, 25 bp, Rattus norvegicus
agaggaagtagtgccactcactgtc

SEQ ID NO: 115359 - DNA, 25 bp, Rattus norvegicus
agaggaagtctcctgcctgtcttaa

SEQ ID NO: 115360 - DNA, 25 bp, Rattus norvegicus
agaggaagtctcgtgcctgtcttaa

SEQ ID NO: 115361 - DNA, 25 bp, Rattus norvegicus
agaggaagtctgacgtcaccgagct

SEQ ID NO: 115362 - DNA, 25 bp, Rattus norvegicus
agaggaagtctgtcgtcaccgagct

SEQ ID NO: 115363 - DNA, 25 bp, Rattus norvegicus
agaggaataagcatgctcacctgca

SEQ ID NO: 115364 - DNA, 25 bp, Rattus norvegicus
agaggaataagcttgctcacctgca

SEQ ID NO: 115365 - DNA, 25 bp, Rattus norvegicus
agaggaataccacagccacaggcac

SEQ ID NO: 115366 - DNA, 25 bp, Rattus norvegicus
agaggaataccagagccacaggcac

SEQ ID NO: 115367 - DNA, 25 bp, Rattus norvegicus
agaggaatatttctcagaccctggg

SEQ ID NO: 115368 - DNA, 25 bp, Rattus norvegicus
agaggaatatttgtcagaccctggg

SEQ ID NO: 115369 - DNA, 25 bp, Rattus norvegicus
agaggaatcaaacccagcccgactc

SEQ ID NO: 115370 - DNA, 25 bp, Rattus norvegicus
agaggaatcaaagccagcccgactc

SEQ ID NO: 115371 - DNA, 25 bp, Rattus norvegicus
agaggaatccgcactgcatggcatc

SEQ ID NO: 115372 - DNA, 25 bp, Rattus norvegicus
agaggaatccgctctgcatggcatc

SEQ ID NO: 115373 - DNA, 25 bp, Rattus norvegicus
agaggaatcgctaccccgacatgag

SEQ ID NO: 115374 - DNA, 25 bp, Rattus norvegicus
agaggaatcgcttccccgacatgag

SEQ ID NO: 115375 - DNA, 25 bp, Rattus norvegicus
agaggaatgcttatctctagcaaca

SEQ ID NO: 115376 - DNA, 25 bp, Rattus norvegicus
agaggaatgcttttctctagcaaca

SEQ ID NO: 115377 - DNA, 25 bp, Rattus norvegicus
agaggaatggtcagctcctccagtc

SEQ ID NO: 115378 - DNA, 25 bp, Rattus norvegicus
agaggaatggtctgctcctccagtc

SEQ ID NO: 115379 - DNA, 25 bp, Rattus norvegicus
agaggaattctgactttgcccatcc

SEQ ID NO: 115380 - DNA, 25 bp, Rattus norvegicus
agaggaattctgtctttgcccatcc

SEQ ID NO: 115381 - DNA, 25 bp, Rattus norvegicus
agaggaattcttactgcttttccca

SEQ ID NO: 115382 - DNA, 25 bp, Rattus norvegicus
agaggaattctttctgcttttccca

SEQ ID NO: 115383 - DNA, 25 bp, Rattus norvegicus
agaggaattgcccatggacagtgac

SEQ ID NO: 115384 - DNA, 25 bp, Rattus norvegicus
agaggaattgccgatggacagtgac

SEQ ID NO: 115385 - DNA, 25 bp, Rattus norvegicus
agaggacaagctactcctgaggcac

SEQ ID NO: 115386 - DNA, 25 bp, Rattus norvegicus
agaggacaagcttctcctgaggcac

SEQ ID NO: 115387 - DNA, 25 bp, Rattus norvegicus
agaggacaagttacacgaccagtgc

SEQ ID NO: 115388 - DNA, 25 bp, Rattus norvegicus
agaggacaagtttcacgaccagtgc

SEQ ID NO: 115389 - DNA, 25 bp, Rattus norvegicus
agaggacacactctctgggcctggc

SEQ ID NO: 115390 - DNA, 25 bp, Rattus norvegicus
agaggacacactgtctgggcctggc

SEQ ID NO: 115391 - DNA, 25 bp, Rattus norvegicus
agaggacacagacctgcttcagccc

SEQ ID NO: 115392 - DNA, 25 bp, Rattus norvegicus
agaggacacagagctgcttcagccc

SEQ ID NO: 115393 - DNA, 25 bp, Rattus norvegicus
agaggacacagtctgacctgtcaca

SEQ ID NO: 115394 - DNA, 25 bp, Rattus norvegicus
agaggacacagtgtgacctgtcaca

SEQ ID NO: 115395 - DNA, 25 bp, Rattus norvegicus
agaggacacctccaggttcagtttc

SEQ ID NO: 115396 - DNA, 25 bp, Rattus norvegicus
agaggacacctcgaggttcagtttc

SEQ ID NO: 115397 - DNA, 25 bp, Rattus norvegicus
agaggacactccagcaaggcatctg

SEQ ID NO: 115398 - DNA, 25 bp, Rattus norvegicus
agaggacactcctgcaaggcatctg

SEQ ID NO: 115399 - DNA, 25 bp, Rattus norvegicus
agaggacactgacgcgtctgctctc

SEQ ID NO: 115400 - DNA, 25 bp, Rattus norvegicus
agaggacactgaggcgtctgctctc

SEQ ID NO: 115401 - DNA, 25 bp, Rattus norvegicus
agaggacactggaatccctgctggc

SEQ ID NO: 115402 - DNA, 25 bp, Rattus norvegicus
agaggacactggtatccctgctggc

SEQ ID NO: 115403 - DNA, 25 bp, Rattus norvegicus
agaggacacttcaaccacatcttaa

SEQ ID NO: 115404 - DNA, 25 bp, Rattus norvegicus
agaggacacttctaccacatcttaa

SEQ ID NO: 115405 - DNA, 25 bp, Rattus norvegicus
agaggacactttacaccttcgagca

SEQ ID NO: 115406 - DNA, 25 bp, Rattus norvegicus
agaggacacttttcaccttcgagca

SEQ ID NO: 115407 - DNA, 25 bp, Rattus norvegicus
agaggacagcctacttcggtgggaa

SEQ ID NO: 115408 - DNA, 25 bp, Rattus norvegicus
agaggacagccttcttcggtgggaa

SEQ ID NO: 115409 - DNA, 25 bp, Rattus norvegicus
agaggacaggcaaccatcttgccgt

SEQ ID NO: 115410 - DNA, 25 bp, Rattus norvegicus
agaggacaggcatccatcttgccgt

SEQ ID NO: 115411 - DNA, 25 bp, Rattus norvegicus
agaggacaggcccacgtttgactac

SEQ ID NO: 115412 - DNA, 25 bp, Rattus norvegicus
agaggacaggccgacgtttgactac

SEQ ID NO: 115413 - DNA, 25 bp, Rattus norvegicus
agaggacagtacagtccggtctgcg

SEQ ID NO: 115414 - DNA, 25 bp, Rattus norvegicus
agaggacagtactgtccggtctgcg

SEQ ID NO: 115415 - DNA, 25 bp, Rattus norvegicus
agaggacagtccatgcagccttggt

SEQ ID NO: 115416 - DNA, 25 bp, Rattus norvegicus
agaggacagtccttgcagccttggt

SEQ ID NO: 115417 - DNA, 25 bp, Rattus norvegicus
agaggacagtgtaagtttagaggta

SEQ ID NO: 115418 - DNA, 25 bp, Rattus norvegicus
agaggacagtgttagtttagaggta

SEQ ID NO: 115419 - DNA, 25 bp, Rattus norvegicus
agaggacagttcacactcacgtgtt

SEQ ID NO: 115420 - DNA, 25 bp, Rattus norvegicus
agaggacagttctcactcacgtgtt

SEQ ID NO: 115421 - DNA, 25 bp, Rattus norvegicus
agaggacatcagactgctggtggca

SEQ ID NO: 115422 - DNA, 25 bp, Rattus norvegicus
agaggacatcagtctgctggtggca

SEQ ID NO: 115423 - DNA, 25 bp, Rattus norvegicus
agaggacatcgacacaaccccagtt

SEQ ID NO: 115424 - DNA, 25 bp, Rattus norvegicus
agaggacatcgagacaaccccagtt

SEQ ID NO: 115425 - DNA, 25 bp, Rattus norvegicus
agaggacatgtaccgcaagacttgt

SEQ ID NO: 115426 - DNA, 25 bp, Rattus norvegicus
agaggacatgtagcgcaagacttgt

SEQ ID NO: 115427 - DNA, 25 bp, Rattus norvegicus
agaggacattttcacagccactgtc

SEQ ID NO: 115428 - DNA, 25 bp, Rattus norvegicus
agaggacattttgacagccactgtc

SEQ ID NO: 115429 - DNA, 25 bp, Rattus norvegicus
agaggaccacatcggagcctgtaac

SEQ ID NO: 115430 - DNA, 25 bp, Rattus norvegicus
agaggaccacatgggagcctgtaac

SEQ ID NO: 115431 - DNA, 25 bp, Rattus norvegicus
agaggaccagagatggcctgccatc

SEQ ID NO: 115432 - DNA, 25 bp, Rattus norvegicus
agaggaccagagttggcctgccatc

SEQ ID NO: 115433 - DNA, 25 bp, Rattus norvegicus
agaggaccagctctggctagcacca

SEQ ID NO: 115434 - DNA, 25 bp, Rattus norvegicus
agaggaccagctgtggctagcacca

SEQ ID NO: 115435 - DNA, 25 bp, Rattus norvegicus
agaggaccaggaccttctctcagaa

SEQ ID NO: 115436 - DNA, 25 bp, Rattus norvegicus
agaggaccaggagcttctctcagaa

SEQ ID NO: 115437 - DNA, 25 bp, Rattus norvegicus
agaggaccaggcactgctcagtggc

SEQ ID NO: 115438 - DNA, 25 bp, Rattus norvegicus
agaggaccaggcatgaggagatact

SEQ ID NO: 115439 - DNA, 25 bp, Rattus norvegicus
agaggaccaggctctgctcagtggc

SEQ ID NO: 115440 - DNA, 25 bp, Rattus norvegicus
agaggaccaggcttgaggagatact

SEQ ID NO: 115441 - DNA, 25 bp, Rattus norvegicus
agaggaccatcaaacccgtgagcag

SEQ ID NO: 115442 - DNA, 25 bp, Rattus norvegicus
agaggaccatcatacccgtgagcag

SEQ ID NO: 115443 - DNA, 25 bp, Rattus norvegicus
agaggaccatgcaagagctcctgaa

SEQ ID NO: 115444 - DNA, 25 bp, Rattus norvegicus
agaggaccatgctagagctcctgaa

SEQ ID NO: 115445 - DNA, 25 bp, Rattus norvegicus
agaggaccatggcaccagaggcaaa

SEQ ID NO: 115446 - DNA, 25 bp, Rattus norvegicus
agaggaccatgggaccagaggcaaa

SEQ ID NO: 115447 - DNA, 25 bp, Rattus norvegicus
agaggaccattgacatccgccggga

SEQ ID NO: 115448 - DNA, 25 bp, Rattus norvegicus
agaggaccattgtcatccgccggga

SEQ ID NO: 115449 - DNA, 25 bp, Rattus norvegicus
agaggacccaagactgtctcccaat

SEQ ID NO: 115450 - DNA, 25 bp, Rattus norvegicus
agaggacccaagtctgtctcccaat

SEQ ID NO: 115451 - DNA, 25 bp, Rattus norvegicus
agaggacccacaataattccccagc

SEQ ID NO: 115452 - DNA, 25 bp, Rattus norvegicus
agaggacccacattaattccccagc

SEQ ID NO: 115453 - DNA, 25 bp, Rattus norvegicus
agaggacccaggagtcgcctaacat

SEQ ID NO: 115454 - DNA, 25 bp, Rattus norvegicus
agaggacccaggctactgctgagat

SEQ ID NO: 115455 - DNA, 25 bp, Rattus norvegicus
agaggacccaggcttgacttcctgc

SEQ ID NO: 115456 - DNA, 25 bp, Rattus norvegicus
agaggacccagggtactgctgagat

SEQ ID NO: 115457 - DNA, 25 bp, Rattus norvegicus
agaggacccagggttgacttcctgc

SEQ ID NO: 115458 - DNA, 25 bp, Rattus norvegicus
agaggacccaggtgtcgcctaacat

SEQ ID NO: 115459 - DNA, 25 bp, Rattus norvegicus
agaggacccagtctggagaccacca

SEQ ID NO: 115460 - DNA, 25 bp, Rattus norvegicus
agaggacccagtgtggagaccacca

SEQ ID NO: 115461 - DNA, 25 bp, Rattus norvegicus
agaggacccatcagttccgaaggca

SEQ ID NO: 115462 - DNA, 25 bp, Rattus norvegicus
agaggacccatctgttccgaaggca

SEQ ID NO: 115463 - DNA, 25 bp, Rattus norvegicus
agaggaccccaaacgcattagcagc

SEQ ID NO: 115464 - DNA, 25 bp, Rattus norvegicus
agaggaccccaatcgcattagcagc

SEQ ID NO: 115465 - DNA, 25 bp, Rattus norvegicus
agaggaccccagaggcagcagctac

SEQ ID NO: 115466 - DNA, 25 bp, Rattus norvegicus
agaggaccccagtggcagcagctac

SEQ ID NO: 115467 - DNA, 25 bp, Rattus norvegicus
agaggacccgggaagtctgcccagt

SEQ ID NO: 115468 - DNA, 25 bp, Rattus norvegicus
agaggacccgggtagtctgcccagt

SEQ ID NO: 115469 - DNA, 25 bp, Rattus norvegicus
agaggaccctctatagcggatgtgc

SEQ ID NO: 115470 - DNA, 25 bp, Rattus norvegicus
agaggaccctctttagcggatgtgc

SEQ ID NO: 115471 - DNA, 25 bp, Rattus norvegicus
agaggaccgcctacgtgccgaggaa

SEQ ID NO: 115472 - DNA, 25 bp, Rattus norvegicus
agaggaccgccttcgtgccgaggaa

SEQ ID NO: 115473 - DNA, 25 bp, Rattus norvegicus
agaggaccgcttcctgcgcacagag

SEQ ID NO: 115474 - DNA, 25 bp, Rattus norvegicus
agaggaccgcttctataacaaccac

SEQ ID NO: 115475 - DNA, 25 bp, Rattus norvegicus
agaggaccgcttgctgcgcacagag

SEQ ID NO: 115476 - DNA, 25 bp, Rattus norvegicus
agaggaccgcttgtataacaaccac

SEQ ID NO: 115477 - DNA, 25 bp, Rattus norvegicus
agaggacctaaacatcactgtcaaa

SEQ ID NO: 115478 - DNA, 25 bp, Rattus norvegicus
agaggacctaaagatcactgtcaaa

SEQ ID NO: 115479 - DNA, 25 bp, Rattus norvegicus
agaggacctctaaagcaacagccaa

SEQ ID NO: 115480 - DNA, 25 bp, Rattus norvegicus
agaggacctctatagcaacagccaa

SEQ ID NO: 115481 - DNA, 25 bp, Rattus norvegicus
agaggacctgcaagtgcctgaagca

SEQ ID NO: 115482 - DNA, 25 bp, Rattus norvegicus
agaggacctgcatgtgcctgaagca

SEQ ID NO: 115483 - DNA, 25 bp, Rattus norvegicus
agaggacctggcacattgaattaaa

SEQ ID NO: 115484 - DNA, 25 bp, Rattus norvegicus
agaggacctggctcattgaattaaa

SEQ ID NO: 115485 - DNA, 25 bp, Rattus norvegicus
agaggaccttgcagttttccgtttg

SEQ ID NO: 115486 - DNA, 25 bp, Rattus norvegicus
agaggaccttgctgttttccgtttg

SEQ ID NO: 115487 - DNA, 25 bp, Rattus norvegicus
agaggacgaacacctcactccaagt

SEQ ID NO: 115488 - DNA, 25 bp, Rattus norvegicus
agaggacgaacagctcactccaagt

SEQ ID NO: 115489 - DNA, 25 bp, Rattus norvegicus
agaggacgacgcagactacttctgt

SEQ ID NO: 115490 - DNA, 25 bp, Rattus norvegicus
agaggacgacgctgactacttctgt

SEQ ID NO: 115491 - DNA, 25 bp, Rattus norvegicus
agaggacgatcccagccgcacgctg

SEQ ID NO: 115492 - DNA, 25 bp, Rattus norvegicus
agaggacgatccgagccgcacgctg

SEQ ID NO: 115493 - DNA, 25 bp, Rattus norvegicus
agaggacgcaccaggactttgctgc

SEQ ID NO: 115494 - DNA, 25 bp, Rattus norvegicus
agaggacgcacctggactttgctgc

SEQ ID NO: 115495 - DNA, 25 bp, Rattus norvegicus
agaggacgccatccgaaatgctgca

SEQ ID NO: 115496 - DNA, 25 bp, Rattus norvegicus
agaggacgccatgcgaaatgctgca

SEQ ID NO: 115497 - DNA, 25 bp, Rattus norvegicus
agaggacgcctgcactcagagtcag

SEQ ID NO: 115498 - DNA, 25 bp, Rattus norvegicus
agaggacgcctggactcagagtcag

SEQ ID NO: 115499 - DNA, 25 bp, Rattus norvegicus
agaggacgctatccctccagggaaa

SEQ ID NO: 115500 - DNA, 25 bp, Rattus norvegicus
agaggacgctatgcctccagggaaa

SEQ ID NO: 115501 - DNA, 25 bp, Rattus norvegicus
agaggacggatcaggcccggtcgag

SEQ ID NO: 115502 - DNA, 25 bp, Rattus norvegicus
agaggacggatctggcccggtcgag

SEQ ID NO: 115503 - DNA, 25 bp, Rattus norvegicus
agaggacggcctccagctactgaag

SEQ ID NO: 115504 - DNA, 25 bp, Rattus norvegicus
agaggacggcctgcagctactgaag

SEQ ID NO: 115505 - DNA, 25 bp, Rattus norvegicus
agaggacgtcctattagccacagca

SEQ ID NO: 115506 - DNA, 25 bp, Rattus norvegicus
agaggacgtccttttagccacagca

SEQ ID NO: 115507 - DNA, 25 bp, Rattus norvegicus
agaggacgtgagcacagttcccagc

SEQ ID NO: 115508 - DNA, 25 bp, Rattus norvegicus
agaggacgtgagcagctcccacata

SEQ ID NO: 115509 - DNA, 25 bp, Rattus norvegicus
agaggacgtgaggacagttcccagc

SEQ ID NO: 115510 - DNA, 25 bp, Rattus norvegicus
agaggacgtgaggagctcccacata

SEQ ID NO: 115511 - DNA, 25 bp, Rattus norvegicus
agaggactcaccagccttttggaga

SEQ ID NO: 115512 - DNA, 25 bp, Rattus norvegicus
agaggactcacctgccttttggaga

SEQ ID NO: 115513 - DNA, 25 bp, Rattus norvegicus
agaggactcagacgctaccctcttg

SEQ ID NO: 115514 - DNA, 25 bp, Rattus norvegicus
agaggactcagaggctaccctcttg

SEQ ID NO: 115515 - DNA, 25 bp, Rattus norvegicus
agaggactcaggatctagccaggct

SEQ ID NO: 115516 - DNA, 25 bp, Rattus norvegicus
agaggactcaggttctagccaggct

SEQ ID NO: 115517 - DNA, 25 bp, Rattus norvegicus
agaggactcagtacccgacatatac

SEQ ID NO: 115518 - DNA, 25 bp, Rattus norvegicus
agaggactcagttcccgacatatac

SEQ ID NO: 115519 - DNA, 25 bp, Rattus norvegicus
agaggactcattcaagcctcttctc

SEQ ID NO: 115520 - DNA, 25 bp, Rattus norvegicus
agaggactcattgaagcctcttctc

SEQ ID NO: 115521 - DNA, 25 bp, Rattus norvegicus
agaggactccagcaacagcagaagt

SEQ ID NO: 115522 - DNA, 25 bp, Rattus norvegicus
agaggactccaggaacagcagaagt

SEQ ID NO: 115523 - DNA, 25 bp, Rattus norvegicus
agaggactcgaaaactccacagaag

SEQ ID NO: 115524 - DNA, 25 bp, Rattus norvegicus
agaggactcgaaagcgcccctggga

SEQ ID NO: 115525 - DNA, 25 bp, Rattus norvegicus
agaggactcgaacccgctggcttac

SEQ ID NO: 115526 - DNA, 25 bp, Rattus norvegicus
agaggactcgaagccgctggcttac

SEQ ID NO: 115527 - DNA, 25 bp, Rattus norvegicus
agaggactcgaatactccacagaag

SEQ ID NO: 115528 - DNA, 25 bp, Rattus norvegicus
agaggactcgaatgcgcccctggga

SEQ ID NO: 115529 - DNA, 25 bp, Rattus norvegicus
agaggactcgatcctctcttttgtc

SEQ ID NO: 115530 - DNA, 25 bp, Rattus norvegicus
agaggactcgatgctctcttttgtc

SEQ ID NO: 115531 - DNA, 25 bp, Rattus norvegicus
agaggactcggcagagggaccccaa

SEQ ID NO: 115532 - DNA, 25 bp, Rattus norvegicus
agaggactcggctgagggaccccaa

SEQ ID NO: 115533 - DNA, 25 bp, Rattus norvegicus
agaggactcgggagcatccatagat

SEQ ID NO: 115534 - DNA, 25 bp, Rattus norvegicus
agaggactcgggtgcatccatagat

SEQ ID NO: 115535 - DNA, 25 bp, Rattus norvegicus
agaggactctggatggcccctagcg

SEQ ID NO: 115536 - DNA, 25 bp, Rattus norvegicus
agaggactctggctgacttgctgat

SEQ ID NO: 115537 - DNA, 25 bp, Rattus norvegicus
agaggactctgggtgacttgctgat

SEQ ID NO: 115538 - DNA, 25 bp, Rattus norvegicus
agaggactctggttggcccctagcg

SEQ ID NO: 115539 - DNA, 25 bp, Rattus norvegicus
agaggactgccacgtctgcgtacag

SEQ ID NO: 115540 - DNA, 25 bp, Rattus norvegicus
agaggactgccaggtctgcgtacag

SEQ ID NO: 115541 - DNA, 25 bp, Rattus norvegicus
agaggactggaccatctctcgcaca

SEQ ID NO: 115542 - DNA, 25 bp, Rattus norvegicus
agaggactggacgatctctcgcaca

SEQ ID NO: 115543 - DNA, 25 bp, Rattus norvegicus
agaggactgggcagactgtcagcat

SEQ ID NO: 115544 - DNA, 25 bp, Rattus norvegicus
agaggactgggctgactgtcagcat

SEQ ID NO: 115545 - DNA, 25 bp, Rattus norvegicus
agaggactgggtcacagctccttgt

SEQ ID NO: 115546 - DNA, 25 bp, Rattus norvegicus
agaggactgggtgacagctccttgt

SEQ ID NO: 115547 - DNA, 25 bp, Rattus norvegicus
agaggacttccaaatcatctgcttc

SEQ ID NO: 115548 - DNA, 25 bp, Rattus norvegicus
agaggacttccatatcatctgcttc

SEQ ID NO: 115549 - DNA, 25 bp, Rattus norvegicus
agaggacttgccagcgctgctcgac

SEQ ID NO: 115550 - DNA, 25 bp, Rattus norvegicus
agaggacttgcctgcgctgctcgac

SEQ ID NO: 115551 - DNA, 25 bp, Rattus norvegicus
agaggacttgtgcaggaccctacct

SEQ ID NO: 115552 - DNA, 25 bp, Rattus norvegicus
agaggacttgtggaggaccctacct

SEQ ID NO: 115553 - DNA, 25 bp, Rattus norvegicus
agaggactttgcacgggctcagaag

SEQ ID NO: 115554 - DNA, 25 bp, Rattus norvegicus
agaggactttgctcgggctcagaag

SEQ ID NO: 115555 - DNA, 25 bp, Rattus norvegicus
agaggactttttccttgctgacttt

SEQ ID NO: 115556 - DNA, 25 bp, Rattus norvegicus
agaggactttttgcttgctgacttt

SEQ ID NO: 115557 - DNA, 25 bp, Rattus norvegicus
agaggagaacacagcagcttaaggt

SEQ ID NO: 115558 - DNA, 25 bp, Rattus norvegicus
agaggagaacactgcagcttaaggt

SEQ ID NO: 115559 - DNA, 25 bp, Rattus norvegicus
agaggagaatcgaataccccaacct

SEQ ID NO: 115560 - DNA, 25 bp, Rattus norvegicus
agaggagaatcgtataccccaacct

SEQ ID NO: 115561 - DNA, 25 bp, Rattus norvegicus
agaggagacaacatccgggcatcac

SEQ ID NO: 115562 - DNA, 25 bp, Rattus norvegicus
agaggagacaacttccgggcatcac

SEQ ID NO: 115563 - DNA, 25 bp, Rattus norvegicus
agaggagaccccaggctgacttagc

SEQ ID NO: 115564 - DNA, 25 bp, Rattus norvegicus
agaggagacccctggctgacttagc

SEQ ID NO: 115565 - DNA, 25 bp, Rattus norvegicus
agaggagactctccctccgagggtc

SEQ ID NO: 115566 - DNA, 25 bp, Rattus norvegicus
agaggagactctgcctccgagggtc

SEQ ID NO: 115567 - DNA, 25 bp, Rattus norvegicus
agaggagacttccacagctggctga

SEQ ID NO: 115568 - DNA, 25 bp, Rattus norvegicus
agaggagacttcgacagctggctga

SEQ ID NO: 115569 - DNA, 25 bp, Rattus norvegicus
agaggagagacaactgttggtccag

SEQ ID NO: 115570 - DNA, 25 bp, Rattus norvegicus
agaggagagacatctgttggtccag

SEQ ID NO: 115571 - DNA, 25 bp, Rattus norvegicus
agaggagagagcctgccacctatga

SEQ ID NO: 115572 - DNA, 25 bp, Rattus norvegicus
agaggagagagcgtgccacctatga

SEQ ID NO: 115573 - DNA, 25 bp, Rattus norvegicus
agaggagagcaaagctggtccccaa

SEQ ID NO: 115574 - DNA, 25 bp, Rattus norvegicus
agaggagagcaatgctggtccccaa

SEQ ID NO: 115575 - DNA, 25 bp, Rattus norvegicus
agaggagagcagacgcttcccatgt

SEQ ID NO: 115576 - DNA, 25 bp, Rattus norvegicus
agaggagagcagtcgcttcccatgt

SEQ ID NO: 115577 - DNA, 25 bp, Rattus norvegicus
agaggagagtggacagtttccttcc

SEQ ID NO: 115578 - DNA, 25 bp, Rattus norvegicus
agaggagagtggtcagtttccttcc

SEQ ID NO: 115579 - DNA, 25 bp, Rattus norvegicus
agaggagatcacctcgactccatgt

SEQ ID NO: 115580 - DNA, 25 bp, Rattus norvegicus
agaggagatcacgtcgactccatgt

SEQ ID NO: 115581 - DNA, 25 bp, Rattus norvegicus
agaggagatccaacgcctgttccag

SEQ ID NO: 115582 - DNA, 25 bp, Rattus norvegicus
agaggagatccatcgcctgttccag

SEQ ID NO: 115583 - DNA, 25 bp, Rattus norvegicus
agaggagatggcactttggccccgc

SEQ ID NO: 115584 - DNA, 25 bp, Rattus norvegicus
agaggagatggctctttggccccgc

SEQ ID NO: 115585 - DNA, 25 bp, Rattus norvegicus
agaggagcaacccagaggacacact

SEQ ID NO: 115586 - DNA, 25 bp, Rattus norvegicus
agaggagcaaccgagaggacacact

SEQ ID NO: 115587 - DNA, 25 bp, Rattus norvegicus
agaggagcaactacgccagggacag

SEQ ID NO: 115588 - DNA, 25 bp, Rattus norvegicus
agaggagcaacttcgccagggacag

SEQ ID NO: 115589 - DNA, 25 bp, Rattus norvegicus
agaggagcataaagcctaccctggc

SEQ ID NO: 115590 - DNA, 25 bp, Rattus norvegicus
agaggagcataatgcctaccctggc

SEQ ID NO: 115591 - DNA, 25 bp, Rattus norvegicus
agaggagcatctcattggcaggcct

SEQ ID NO: 115592 - DNA, 25 bp, Rattus norvegicus
agaggagcatctgattggcaggcct

SEQ ID NO: 115593 - DNA, 25 bp, Rattus norvegicus
agaggagccaagatctgtttccagt

SEQ ID NO: 115594 - DNA, 25 bp, Rattus norvegicus
agaggagccaagttctgtttccagt

SEQ ID NO: 115595 - DNA, 25 bp, Rattus norvegicus
agaggagccaccatctagtaagagt

SEQ ID NO: 115596 - DNA, 25 bp, Rattus norvegicus
agaggagccaccttctagtaagagt

SEQ ID NO: 115597 - DNA, 25 bp, Rattus norvegicus
agaggagccactagactatgccagt

SEQ ID NO: 115598 - DNA, 25 bp, Rattus norvegicus
agaggagccacttgactatgccagt

SEQ ID NO: 115599 - DNA, 25 bp, Rattus norvegicus
agaggagccatgctcagcatcgcat

SEQ ID NO: 115600 - DNA, 25 bp, Rattus norvegicus
agaggagccatggtcagcatcgcat

SEQ ID NO: 115601 - DNA, 25 bp, Rattus norvegicus
agaggagcccagagggacagccacc

SEQ ID NO: 115602 - DNA, 25 bp, Rattus norvegicus
agaggagcccagatgtgagccagat

SEQ ID NO: 115603 - DNA, 25 bp, Rattus norvegicus
agaggagcccagtgggacagccacc

SEQ ID NO: 115604 - DNA, 25 bp, Rattus norvegicus
agaggagcccagttgtgagccagat

SEQ ID NO: 115605 - DNA, 25 bp, Rattus norvegicus
agaggagccccacagctgaagcagc

SEQ ID NO: 115606 - DNA, 25 bp, Rattus norvegicus
agaggagccccagagctgaagcagc

SEQ ID NO: 115607 - DNA, 25 bp, Rattus norvegicus
agaggagccgagagctcccaaggaa

SEQ ID NO: 115608 - DNA, 25 bp, Rattus norvegicus
agaggagccgagtgctcccaaggaa

SEQ ID NO: 115609 - DNA, 25 bp, Rattus norvegicus
agaggagccgctaaccatcttcagc

SEQ ID NO: 115610 - DNA, 25 bp, Rattus norvegicus
agaggagccgcttaccatcttcagc

SEQ ID NO: 115611 - DNA, 25 bp, Rattus norvegicus
agaggagcctgacgtccgagccttt

SEQ ID NO: 115612 - DNA, 25 bp, Rattus norvegicus
agaggagcctgaggtccgagccttt

SEQ ID NO: 115613 - DNA, 25 bp, Rattus norvegicus
agaggagcctttctgatctgccatc

SEQ ID NO: 115614 - DNA, 25 bp, Rattus norvegicus
agaggagcctttgtgatctgccatc

SEQ ID NO: 115615 - DNA, 25 bp, Rattus norvegicus
agaggagcgcctagggctctggagc

SEQ ID NO: 115616 - DNA, 25 bp, Rattus norvegicus
agaggagcgccttgggctctggagc

SEQ ID NO: 115617 - DNA, 25 bp, Rattus norvegicus
agaggagcgtggagcggcagcggcg

SEQ ID NO: 115618 - DNA, 25 bp, Rattus norvegicus
agaggagcgtggtgcggcagcggcg

SEQ ID NO: 115619 - DNA, 25 bp, Rattus norvegicus
agaggagctcagatgggcacctacc

SEQ ID NO: 115620 - DNA, 25 bp, Rattus norvegicus
agaggagctcagttgggcacctacc

SEQ ID NO: 115621 - DNA, 25 bp, Rattus norvegicus
agaggagctctcattgctactcttg

SEQ ID NO: 115622 - DNA, 25 bp, Rattus norvegicus
agaggagctctctttgctactcttg

SEQ ID NO: 115623 - DNA, 25 bp, Rattus norvegicus
agaggagctgcccacaagtctctca

SEQ ID NO: 115624 - DNA, 25 bp, Rattus norvegicus
agaggagctgccgacaagtctctca

SEQ ID NO: 115625 - DNA, 25 bp, Rattus norvegicus
agaggagctggtcaagttgtcatca

SEQ ID NO: 115626 - DNA, 25 bp, Rattus norvegicus
agaggagctggtcacacttcgttga

SEQ ID NO: 115627 - DNA, 25 bp, Rattus norvegicus
agaggagctggtgaagttgtcatca

SEQ ID NO: 115628 - DNA, 25 bp, Rattus norvegicus
agaggagctggtgacacttcgttga

SEQ ID NO: 115629 - DNA, 25 bp, Rattus norvegicus
agaggaggacttccggatgcctcac

SEQ ID NO: 115630 - DNA, 25 bp, Rattus norvegicus
agaggaggacttgcggatgcctcac

SEQ ID NO: 115631 - DNA, 25 bp, Rattus norvegicus
agaggaggattcagcccaagccaac

SEQ ID NO: 115632 - DNA, 25 bp, Rattus norvegicus
agaggaggattctgcccaagccaac

SEQ ID NO: 115633 - DNA, 25 bp, Rattus norvegicus
agaggaggcacactccattgtcgtg

SEQ ID NO: 115634 - DNA, 25 bp, Rattus norvegicus
agaggaggcacagtccattgtcgtg

SEQ ID NO: 115635 - DNA, 25 bp, Rattus norvegicus
agaggaggcactaggaagccaatca

SEQ ID NO: 115636 - DNA, 25 bp, Rattus norvegicus
agaggaggcactagtcacgttaaag

SEQ ID NO: 115637 - DNA, 25 bp, Rattus norvegicus
agaggaggcacttggaagccaatca

SEQ ID NO: 115638 - DNA, 25 bp, Rattus norvegicus
agaggaggcacttgtcacgttaaag

SEQ ID NO: 115639 - DNA, 25 bp, Rattus norvegicus
agaggaggcctcaccgggtgacact

SEQ ID NO: 115640 - DNA, 25 bp, Rattus norvegicus
agaggaggcctcagctaggtcgctc

SEQ ID NO: 115641 - DNA, 25 bp, Rattus norvegicus
agaggaggcctctccgggtgacact

SEQ ID NO: 115642 - DNA, 25 bp, Rattus norvegicus
agaggaggcctctgctaggtcgctc

SEQ ID NO: 115643 - DNA, 25 bp, Rattus norvegicus
agaggaggcgacatcacgacggacc

SEQ ID NO: 115644 - DNA, 25 bp, Rattus norvegicus
agaggaggcgacttcacgacggacc

SEQ ID NO: 115645 - DNA, 25 bp, Rattus norvegicus
agaggaggcgcccaatcagctttcc

SEQ ID NO: 115646 - DNA, 25 bp, Rattus norvegicus
agaggaggcgccgaatcagctttcc

SEQ ID NO: 115647 - DNA, 25 bp, Rattus norvegicus
agaggaggctcacccacattttaca

SEQ ID NO: 115648 - DNA, 25 bp, Rattus norvegicus
agaggaggctcagccacattttaca

SEQ ID NO: 115649 - DNA, 25 bp, Rattus norvegicus
agaggaggctctatgctgcaccact

SEQ ID NO: 115650 - DNA, 25 bp, Rattus norvegicus
agaggaggctctttgctgcaccact

SEQ ID NO: 115651 - DNA, 25 bp, Rattus norvegicus
agaggaggctgtaacccacttcgtt

SEQ ID NO: 115652 - DNA, 25 bp, Rattus norvegicus
agaggaggctgttacccacttcgtt

SEQ ID NO: 115653 - DNA, 25 bp, Rattus norvegicus
agaggagggcatattcccgctggac

SEQ ID NO: 115654 - DNA, 25 bp, Rattus norvegicus
agaggagggcattttcccgctggac

SEQ ID NO: 115655 - DNA, 25 bp, Rattus norvegicus
agaggagggccaagcagctaaccca

SEQ ID NO: 115656 - DNA, 25 bp, Rattus norvegicus
agaggagggccatgcagctaaccca

SEQ ID NO: 115657 - DNA, 25 bp, Rattus norvegicus
agaggaggtatcagttcctcccatc

SEQ ID NO: 115658 - DNA, 25 bp, Rattus norvegicus
agaggaggtatctgttcctcccatc

SEQ ID NO: 115659 - DNA, 25 bp, Rattus norvegicus
agaggaggtcatacggagtgctaca

SEQ ID NO: 115660 - DNA, 25 bp, Rattus norvegicus
agaggaggtcattcggagtgctaca

SEQ ID NO: 115661 - DNA, 25 bp, Rattus norvegicus
agaggaggtctcaccagaagctctc

SEQ ID NO: 115662 - DNA, 25 bp, Rattus norvegicus
agaggaggtctctccagaagctctc

SEQ ID NO: 115663 - DNA, 25 bp, Rattus norvegicus
agaggaggtctgactaccacaccta

SEQ ID NO: 115664 - DNA, 25 bp, Rattus norvegicus
agaggaggtctgtctaccacaccta

SEQ ID NO: 115665 - DNA, 25 bp, Rattus norvegicus
agaggaggttccaatgttcggccta

SEQ ID NO: 115666 - DNA, 25 bp, Rattus norvegicus
agaggaggttcctatgttcggccta

SEQ ID NO: 115667 - DNA, 25 bp, Rattus norvegicus
agaggagtaactagtctcgctgaaa

SEQ ID NO: 115668 - DNA, 25 bp, Rattus norvegicus
agaggagtaacttgtctcgctgaaa

SEQ ID NO: 115669 - DNA, 25 bp, Rattus norvegicus
agaggagtatgccaggacccactgc

SEQ ID NO: 115670 - DNA, 25 bp, Rattus norvegicus
agaggagtatgcgaggacccactgc

SEQ ID NO: 115671 - DNA, 25 bp, Rattus norvegicus
agaggagtcatgcacccggttctat

SEQ ID NO: 115672 - DNA, 25 bp, Rattus norvegicus
agaggagtcatggacccggttctat

SEQ ID NO: 115673 - DNA, 25 bp, Rattus norvegicus
agaggagtccacctgcttgtgcttc

SEQ ID NO: 115674 - DNA, 25 bp, Rattus norvegicus
agaggagtccacgtgcttgtgcttc

SEQ ID NO: 115675 - DNA, 25 bp, Rattus norvegicus
agaggagtccataaacaatctgtta

SEQ ID NO: 115676 - DNA, 25 bp, Rattus norvegicus
agaggagtccattaacaatctgtta

SEQ ID NO: 115677 - DNA, 25 bp, Rattus norvegicus
agaggagtccgacttttcagagagc

SEQ ID NO: 115678 - DNA, 25 bp, Rattus norvegicus
agaggagtccgagttttcagagagc

SEQ ID NO: 115679 - DNA, 25 bp, Rattus norvegicus
agaggagtcggtacagccacatata

SEQ ID NO: 115680 - DNA, 25 bp, Rattus norvegicus
agaggagtcggttcagccacatata

SEQ ID NO: 115681 - DNA, 25 bp, Rattus norvegicus
agaggagtctaccacttttgttttg

SEQ ID NO: 115682 - DNA, 25 bp, Rattus norvegicus
agaggagtctacgacttttgttttg

SEQ ID NO: 115683 - DNA, 25 bp, Rattus norvegicus
agaggagtctccactttcctatcaa

SEQ ID NO: 115684 - DNA, 25 bp, Rattus norvegicus
agaggagtctcctctttcctatcaa

SEQ ID NO: 115685 - DNA, 25 bp, Rattus norvegicus
agaggagtctctcacttctgtcttc

SEQ ID NO: 115686 - DNA, 25 bp, Rattus norvegicus
agaggagtctctgacttctgtcttc

SEQ ID NO: 115687 - DNA, 25 bp, Rattus norvegicus
agaggagtctggacttacggctgca

SEQ ID NO: 115688 - DNA, 25 bp, Rattus norvegicus
agaggagtctggtcttacggctgca

SEQ ID NO: 115689 - DNA, 25 bp, Rattus norvegicus
agaggagtgagcacccctctctgct

SEQ ID NO: 115690 - DNA, 25 bp, Rattus norvegicus
agaggagtgagctcccctctctgct

SEQ ID NO: 115691 - DNA, 25 bp, Rattus norvegicus
agaggagtgccaccctgtgcgtctc

SEQ ID NO: 115692 - DNA, 25 bp, Rattus norvegicus
agaggagtgccagcctgtgcgtctc

SEQ ID NO: 115693 - DNA, 25 bp, Rattus norvegicus
agaggagtgcggaggccactctctc

SEQ ID NO: 115694 - DNA, 25 bp, Rattus norvegicus
agaggagtgcggtggccactctctc

SEQ ID NO: 115695 - DNA, 25 bp, Rattus norvegicus
agaggagtgtccagaagcacagaat

SEQ ID NO: 115696 - DNA, 25 bp, Rattus norvegicus
agaggagtgtcctgaagcacagaat

SEQ ID NO: 115697 - DNA, 25 bp, Rattus norvegicus
agaggagttctcctctgagtttcca

SEQ ID NO: 115698 - DNA, 25 bp, Rattus norvegicus
agaggagttctcgtctgagtttcca

SEQ ID NO: 115699 - DNA, 25 bp, Rattus norvegicus
agaggagtttgcactggccaagcac

SEQ ID NO: 115700 - DNA, 25 bp, Rattus norvegicus
agaggagtttgctctggccaagcac

SEQ ID NO: 115701 - DNA, 25 bp, Rattus norvegicus
agaggataaagtcagccatgtgagc

SEQ ID NO: 115702 - DNA, 25 bp, Rattus norvegicus
agaggataaagtgagccatgtgagc

SEQ ID NO: 115703 - DNA, 25 bp, Rattus norvegicus
agaggatagctcatgccgactacca

SEQ ID NO: 115704 - DNA, 25 bp, Rattus norvegicus
agaggatagctcttgccgactacca

SEQ ID NO: 115705 - DNA, 25 bp, Rattus norvegicus
agaggatagctgaccaccctctcct

SEQ ID NO: 115706 - DNA, 25 bp, Rattus norvegicus
agaggatagctgtccaccctctcct

SEQ ID NO: 115707 - DNA, 25 bp, Rattus norvegicus
agaggatatagactggatgccgtca

SEQ ID NO: 115708 - DNA, 25 bp, Rattus norvegicus
agaggatatagagtggatgccgtca

SEQ ID NO: 115709 - DNA, 25 bp, Rattus norvegicus
agaggatatgatcccagcttatttt

SEQ ID NO: 115710 - DNA, 25 bp, Rattus norvegicus
agaggatatgatgccagcttatttt

SEQ ID NO: 115711 - DNA, 25 bp, Rattus norvegicus
agaggatcaagtctccagctggctg

SEQ ID NO: 115712 - DNA, 25 bp, Rattus norvegicus
agaggatcaagtgtccagctggctg

SEQ ID NO: 115713 - DNA, 25 bp, Rattus norvegicus
agaggatcaatcaactgagcggcaa

SEQ ID NO: 115714 - DNA, 25 bp, Rattus norvegicus
agaggatcaatctactgagcggcaa

SEQ ID NO: 115715 - DNA, 25 bp, Rattus norvegicus
agaggatcacctccatttcgttcaa

SEQ ID NO: 115716 - DNA, 25 bp, Rattus norvegicus
agaggatcacctgcatttcgttcaa

SEQ ID NO: 115717 - DNA, 25 bp, Rattus norvegicus
agaggatcagtgcacccctgccaag

SEQ ID NO: 115718 - DNA, 25 bp, Rattus norvegicus
agaggatcagtggacccctgccaag

SEQ ID NO: 115719 - DNA, 25 bp, Rattus norvegicus
agaggatcatgacttcacggccact

SEQ ID NO: 115720 - DNA, 25 bp, Rattus norvegicus
agaggatcatgagttcacggccact

SEQ ID NO: 115721 - DNA, 25 bp, Rattus norvegicus
agaggatcattgctgtaccgtccct

SEQ ID NO: 115722 - DNA, 25 bp, Rattus norvegicus
agaggatcattggtgtaccgtccct

SEQ ID NO: 115723 - DNA, 25 bp, Rattus norvegicus
agaggatcccatacaaactccagaa

SEQ ID NO: 115724 - DNA, 25 bp, Rattus norvegicus
agaggatcccattcaaactccagaa

SEQ ID NO: 115725 - DNA, 25 bp, Rattus norvegicus
agaggatccgaacccagtgcccagc

SEQ ID NO: 115726 - DNA, 25 bp, Rattus norvegicus
agaggatccgaagccagtgcccagc

SEQ ID NO: 115727 - DNA, 25 bp, Rattus norvegicus
agaggatccgatagtcccggagctg

SEQ ID NO: 115728 - DNA, 25 bp, Rattus norvegicus
agaggatccgattgtcccggagctg

SEQ ID NO: 115729 - DNA, 25 bp, Rattus norvegicus
agaggatccggcaagcagactccct

SEQ ID NO: 115730 - DNA, 25 bp, Rattus norvegicus
agaggatccggctagcagactccct

SEQ ID NO: 115731 - DNA, 25 bp, Rattus norvegicus
agaggatcctagcaccatcttaagc

SEQ ID NO: 115732 - DNA, 25 bp, Rattus norvegicus
agaggatcctagcagacaccacttt

SEQ ID NO: 115733 - DNA, 25 bp, Rattus norvegicus
agaggatcctaggaccatcttaagc

SEQ ID NO: 115734 - DNA, 25 bp, Rattus norvegicus
agaggatcctaggagacaccacttt

SEQ ID NO: 115735 - DNA, 25 bp, Rattus norvegicus
agaggatcctggaactaaagtgctt

SEQ ID NO: 115736 - DNA, 25 bp, Rattus norvegicus
agaggatcctggacatgaagtgcga

SEQ ID NO: 115737 - DNA, 25 bp, Rattus norvegicus
agaggatcctggtactaaagtgctt

SEQ ID NO: 115738 - DNA, 25 bp, Rattus norvegicus
agaggatcctggtcatgaagtgcga

SEQ ID NO: 115739 - DNA, 25 bp, Rattus norvegicus
agaggatccttcagaaagcgcccac

SEQ ID NO: 115740 - DNA, 25 bp, Rattus norvegicus
agaggatccttctgaaagcgcccac

SEQ ID NO: 115741 - DNA, 25 bp, Rattus norvegicus
agaggatcgaccaatttcacgccat

SEQ ID NO: 115742 - DNA, 25 bp, Rattus norvegicus
agaggatcgacctatttcacgccat

SEQ ID NO: 115743 - DNA, 25 bp, Rattus norvegicus
agaggatcgcgcaaactctcgatcg

SEQ ID NO: 115744 - DNA, 25 bp, Rattus norvegicus
agaggatcgcgctaactctcgatcg

SEQ ID NO: 115745 - DNA, 25 bp, Rattus norvegicus
agaggatctcccagaagctgtgctc

SEQ ID NO: 115746 - DNA, 25 bp, Rattus norvegicus
agaggatctccctgaagctgtgctc

SEQ ID NO: 115747 - DNA, 25 bp, Rattus norvegicus
agaggatctcgaagccatcttctgt

SEQ ID NO: 115748 - DNA, 25 bp, Rattus norvegicus
agaggatctcgatgccatcttctgt

SEQ ID NO: 115749 - DNA, 25 bp, Rattus norvegicus
agaggatctgagattcattccccgc

SEQ ID NO: 115750 - DNA, 25 bp, Rattus norvegicus
agaggatctgagtttcattccccgc

SEQ ID NO: 115751 - DNA, 25 bp, Rattus norvegicus
agaggatctgccaggaaccacctgg

SEQ ID NO: 115752 - DNA, 25 bp, Rattus norvegicus
agaggatctgcctggaaccacctgg

SEQ ID NO: 115753 - DNA, 25 bp, Rattus norvegicus
agaggatcttctcactacctcagtc

SEQ ID NO: 115754 - DNA, 25 bp, Rattus norvegicus
agaggatcttctgactacctcagtc

SEQ ID NO: 115755 - DNA, 25 bp, Rattus norvegicus
agaggatcttgaatccttccctggg

SEQ ID NO: 115756 - DNA, 25 bp, Rattus norvegicus
agaggatcttgattccttccctggg

SEQ ID NO: 115757 - DNA, 25 bp, Rattus norvegicus
agaggatgacacaacccaagcacct

SEQ ID NO: 115758 - DNA, 25 bp, Rattus norvegicus
agaggatgacactacccaagcacct

SEQ ID NO: 115759 - DNA, 25 bp, Rattus norvegicus
agaggatgatggcaccggctctcca

SEQ ID NO: 115760 - DNA, 25 bp, Rattus norvegicus
agaggatgatgggaccggctctcca

SEQ ID NO: 115761 - DNA, 25 bp, Rattus norvegicus
agaggatgctccatgtgtccttcag

SEQ ID NO: 115762 - DNA, 25 bp, Rattus norvegicus
agaggatgctccttgtgtccttcag

SEQ ID NO: 115763 - DNA, 25 bp, Rattus norvegicus
agaggatgctctcactgccataggc

SEQ ID NO: 115764 - DNA, 25 bp, Rattus norvegicus
agaggatgctctgactgccataggc

SEQ ID NO: 115765 - DNA, 25 bp, Rattus norvegicus
agaggatgctgcattagctgctgcg

SEQ ID NO: 115766 - DNA, 25 bp, Rattus norvegicus
agaggatgctgctttagctgctgcg

SEQ ID NO: 115767 - DNA, 25 bp, Rattus norvegicus
agaggatgctgtcccacgaattagc

SEQ ID NO: 115768 - DNA, 25 bp, Rattus norvegicus
agaggatgctgtgccacgaattagc

SEQ ID NO: 115769 - DNA, 25 bp, Rattus norvegicus
agaggatggactcctggctccttga

SEQ ID NO: 115770 - DNA, 25 bp, Rattus norvegicus
agaggatggactgctggctccttga

SEQ ID NO: 115771 - DNA, 25 bp, Rattus norvegicus
agaggatggagtcgcatgccctccc

SEQ ID NO: 115772 - DNA, 25 bp, Rattus norvegicus
agaggatggagtggcatgccctccc

SEQ ID NO: 115773 - DNA, 25 bp, Rattus norvegicus
agaggatggctcagttccctagcaa

SEQ ID NO: 115774 - DNA, 25 bp, Rattus norvegicus
agaggatggctctgttccctagcaa

SEQ ID NO: 115775 - DNA, 25 bp, Rattus norvegicus
agaggatggctgaaggtcttccctg

SEQ ID NO: 115776 - DNA, 25 bp, Rattus norvegicus
agaggatggctgtaggtcttccctg

SEQ ID NO: 115777 - DNA, 25 bp, Rattus norvegicus
agaggatgggtaattttaccatcat

SEQ ID NO: 115778 - DNA, 25 bp, Rattus norvegicus
agaggatgggtatttttaccatcat

SEQ ID NO: 115779 - DNA, 25 bp, Rattus norvegicus
agaggatgtagtccacagctaggta

SEQ ID NO: 115780 - DNA, 25 bp, Rattus norvegicus
agaggatgtagtgcacagctaggta

SEQ ID NO: 115781 - DNA, 25 bp, Rattus norvegicus
agaggatgtcccatgtgttacaatc

SEQ ID NO: 115782 - DNA, 25 bp, Rattus norvegicus
agaggatgtcccttgtgttacaatc

SEQ ID NO: 115783 - DNA, 25 bp, Rattus norvegicus
agaggatgtcttcagttgcttttcc

SEQ ID NO: 115784 - DNA, 25 bp, Rattus norvegicus
agaggatgtcttgagttgcttttcc

SEQ ID NO: 115785 - DNA, 25 bp, Rattus norvegicus
agaggatgtgctactggccatgatc

SEQ ID NO: 115786 - DNA, 25 bp, Rattus norvegicus
agaggatgtgcttctggccatgatc

SEQ ID NO: 115787 - DNA, 25 bp, Rattus norvegicus
agaggatgtgggatccatcacctat

SEQ ID NO: 115788 - DNA, 25 bp, Rattus norvegicus
agaggatgtgggttccatcacctat

SEQ ID NO: 115789 - DNA, 25 bp, Rattus norvegicus
agaggatgtgtgatcctcactccta

SEQ ID NO: 115790 - DNA, 25 bp, Rattus norvegicus
agaggatgtgtgttcctcactccta

SEQ ID NO: 115791 - DNA, 25 bp, Rattus norvegicus
agaggattacacagcagccatgttt

SEQ ID NO: 115792 - DNA, 25 bp, Rattus norvegicus
agaggattacactgcagccatgttt

SEQ ID NO: 115793 - DNA, 25 bp, Rattus norvegicus
agaggattatgactcctagcgccct

SEQ ID NO: 115794 - DNA, 25 bp, Rattus norvegicus
agaggattatgagtcctagcgccct

SEQ ID NO: 115795 - DNA, 25 bp, Rattus norvegicus
agaggattccccagtgtcaggtagg

SEQ ID NO: 115796 - DNA, 25 bp, Rattus norvegicus
agaggattcccctgtgtcaggtagg

SEQ ID NO: 115797 - DNA, 25 bp, Rattus norvegicus
agaggattccctagggtgttgacct

SEQ ID NO: 115798 - DNA, 25 bp, Rattus norvegicus
agaggattcccttgggtgttgacct

SEQ ID NO: 115799 - DNA, 25 bp, Rattus norvegicus
agaggattccttcttcccaactaat

SEQ ID NO: 115800 - DNA, 25 bp, Rattus norvegicus
agaggattccttgttcccaactaat

SEQ ID NO: 115801 - DNA, 25 bp, Rattus norvegicus
agaggattctagcttgcccggacag

SEQ ID NO: 115802 - DNA, 25 bp, Rattus norvegicus
agaggattctaggttgcccggacag

SEQ ID NO: 115803 - DNA, 25 bp, Rattus norvegicus
agaggattctcccagctgtgctttc

SEQ ID NO: 115804 - DNA, 25 bp, Rattus norvegicus
agaggattctccgagctgtgctttc

SEQ ID NO: 115805 - DNA, 25 bp, Rattus norvegicus
agaggattctggattctgatcctga

SEQ ID NO: 115806 - DNA, 25 bp, Rattus norvegicus
agaggattctggtttctgatcctga

SEQ ID NO: 115807 - DNA, 25 bp, Rattus norvegicus
agaggattgagcagacctctgacct

SEQ ID NO: 115808 - DNA, 25 bp, Rattus norvegicus
agaggattgagctgacctctgacct

SEQ ID NO: 115809 - DNA, 25 bp, Rattus norvegicus
agaggattgcatcacacggctcatt

SEQ ID NO: 115810 - DNA, 25 bp, Rattus norvegicus
agaggattgcatgacacggctcatt

SEQ ID NO: 115811 - DNA, 25 bp, Rattus norvegicus
agaggattggacctctggtgtcctc

SEQ ID NO: 115812 - DNA, 25 bp, Rattus norvegicus
agaggattggacgtctggtgtcctc

SEQ ID NO: 115813 - DNA, 25 bp, Rattus norvegicus
agaggattggcacgcccctcagcat

SEQ ID NO: 115814 - DNA, 25 bp, Rattus norvegicus
agaggattggcaggcccctcagcat

SEQ ID NO: 115815 - DNA, 25 bp, Rattus norvegicus
agaggattgttacgtatccttacca

SEQ ID NO: 115816 - DNA, 25 bp, Rattus norvegicus
agaggattgttaggtatccttacca

SEQ ID NO: 115817 - DNA, 25 bp, Rattus norvegicus
agaggattttacatcacagcagaat

SEQ ID NO: 115818 - DNA, 25 bp, Rattus norvegicus
agaggattttacttcacagcagaat

SEQ ID NO: 115819 - DNA, 25 bp, Rattus norvegicus
agaggcaaagggagacaccagcccc

SEQ ID NO: 115820 - DNA, 25 bp, Rattus norvegicus
agaggcaaagggtgacaccagcccc

SEQ ID NO: 115821 - DNA, 25 bp, Rattus norvegicus
agaggcaaaggtatcctcctctggg

SEQ ID NO: 115822 - DNA, 25 bp, Rattus norvegicus
agaggcaaaggtttcctcctctggg

SEQ ID NO: 115823 - DNA, 25 bp, Rattus norvegicus
agaggcaacatccaacgtgctaggg

SEQ ID NO: 115824 - DNA, 25 bp, Rattus norvegicus
agaggcaacatcgaacgtgctaggg

SEQ ID NO: 115825 - DNA, 25 bp, Rattus norvegicus
agaggcaaccgccttgggttctctt

SEQ ID NO: 115826 - DNA, 25 bp, Rattus norvegicus
agaggcaaccgcgttgggttctctt

SEQ ID NO: 115827 - DNA, 25 bp, Rattus norvegicus
agaggcaacctgaactcactctgag

SEQ ID NO: 115828 - DNA, 25 bp, Rattus norvegicus
agaggcaacctgtactcactctgag

SEQ ID NO: 115829 - DNA, 25 bp, Rattus norvegicus
agaggcaactatccttaaaaaggca

SEQ ID NO: 115830 - DNA, 25 bp, Rattus norvegicus
agaggcaactatgcttaaaaaggca

SEQ ID NO: 115831 - DNA, 25 bp, Rattus norvegicus
agaggcaagctcaggccgttcatca

SEQ ID NO: 115832 - DNA, 25 bp, Rattus norvegicus
agaggcaagctctggccgttcatca

SEQ ID NO: 115833 - DNA, 25 bp, Rattus norvegicus
agaggcaaggtcagtgtctctgtcc

SEQ ID NO: 115834 - DNA, 25 bp, Rattus norvegicus
agaggcaaggtctgtgtctctgtcc

SEQ ID NO: 115835 - DNA, 25 bp, Rattus norvegicus
agaggcaagttccttttccagtctg

SEQ ID NO: 115836 - DNA, 25 bp, Rattus norvegicus
agaggcaagttcgttttccagtctg

SEQ ID NO: 115837 - DNA, 25 bp, Rattus norvegicus
agaggcaatgtcagcaccccagaag

SEQ ID NO: 115838 - DNA, 25 bp, Rattus norvegicus
agaggcaatgtctgcaccccagaag

SEQ ID NO: 115839 - DNA, 25 bp, Rattus norvegicus
agaggcacaaccatgcacacaggcg

SEQ ID NO: 115840 - DNA, 25 bp, Rattus norvegicus
agaggcacaaccttgcacacaggcg

SEQ ID NO: 115841 - DNA, 25 bp, Rattus norvegicus
agaggcacacataccatgtcctgtg

SEQ ID NO: 115842 - DNA, 25 bp, Rattus norvegicus
agaggcacacattccatgtcctgtg

SEQ ID NO: 115843 - DNA, 25 bp, Rattus norvegicus
agaggcacacggcattcccaaaggt

SEQ ID NO: 115844 - DNA, 25 bp, Rattus norvegicus
agaggcacacgggattcccaaaggt

SEQ ID NO: 115845 - DNA, 25 bp, Rattus norvegicus
agaggcaccccgacgcacgagagag

SEQ ID NO: 115846 - DNA, 25 bp, Rattus norvegicus
agaggcaccccgtcgcacgagagag

SEQ ID NO: 115847 - DNA, 25 bp, Rattus norvegicus
agaggcaccgttctggcttccagga

SEQ ID NO: 115848 - DNA, 25 bp, Rattus norvegicus
agaggcaccgttgtggcttccagga

SEQ ID NO: 115849 - DNA, 25 bp, Rattus norvegicus
agaggcacctccaggcttctgtgga

SEQ ID NO: 115850 - DNA, 25 bp, Rattus norvegicus
agaggcacctcccagatgtggacat

SEQ ID NO: 115851 - DNA, 25 bp, Rattus norvegicus
agaggcacctccgagatgtggacat

SEQ ID NO: 115852 - DNA, 25 bp, Rattus norvegicus
agaggcacctcctggcttctgtgga

SEQ ID NO: 115853 - DNA, 25 bp, Rattus norvegicus
agaggcacggctactggtataccaa

SEQ ID NO: 115854 - DNA, 25 bp, Rattus norvegicus
agaggcacggcttctggtataccaa

SEQ ID NO: 115855 - DNA, 25 bp, Rattus norvegicus
agaggcacgtggcagacttcaccca

SEQ ID NO: 115856 - DNA, 25 bp, Rattus norvegicus
agaggcacgtgggagacttcaccca

SEQ ID NO: 115857 - DNA, 25 bp, Rattus norvegicus
agaggcactatgctggtgccacttg

SEQ ID NO: 115858 - DNA, 25 bp, Rattus norvegicus
agaggcactatggtggtgccacttg

SEQ ID NO: 115859 - DNA, 25 bp, Rattus norvegicus
agaggcactcagagccgtgagcttt

SEQ ID NO: 115860 - DNA, 25 bp, Rattus norvegicus
agaggcactcagagttcttgtctgc

SEQ ID NO: 115861 - DNA, 25 bp, Rattus norvegicus
agaggcactcagtgccgtgagcttt

SEQ ID NO: 115862 - DNA, 25 bp, Rattus norvegicus
agaggcactcagtgttcttgtctgc

SEQ ID NO: 115863 - DNA, 25 bp, Rattus norvegicus
agaggcactgctaatctacttatcc

SEQ ID NO: 115864 - DNA, 25 bp, Rattus norvegicus
agaggcactgctcgattcttctgtc

SEQ ID NO: 115865 - DNA, 25 bp, Rattus norvegicus
agaggcactgctggattcttctgtc

SEQ ID NO: 115866 - DNA, 25 bp, Rattus norvegicus
agaggcactgcttatctacttatcc

SEQ ID NO: 115867 - DNA, 25 bp, Rattus norvegicus
agaggcactgtgctgtctgcagtcc

SEQ ID NO: 115868 - DNA, 25 bp, Rattus norvegicus
agaggcactgtggtgtctgcagtcc

SEQ ID NO: 115869 - DNA, 25 bp, Rattus norvegicus
agaggcagaatgatgctgtgctcca

SEQ ID NO: 115870 - DNA, 25 bp, Rattus norvegicus
agaggcagaatgttgctgtgctcca

SEQ ID NO: 115871 - DNA, 25 bp, Rattus norvegicus
agaggcagacacatggtctccaaca

SEQ ID NO: 115872 - DNA, 25 bp, Rattus norvegicus
agaggcagacacttggtctccaaca

SEQ ID NO: 115873 - DNA, 25 bp, Rattus norvegicus
agaggcagaggaccgtgatcttcac

SEQ ID NO: 115874 - DNA, 25 bp, Rattus norvegicus
agaggcagaggagcgtgatcttcac

SEQ ID NO: 115875 - DNA, 25 bp, Rattus norvegicus
agaggcagaggcacagatgctccta

SEQ ID NO: 115876 - DNA, 25 bp, Rattus norvegicus
agaggcagaggcctgcgttccacac

SEQ ID NO: 115877 - DNA, 25 bp, Rattus norvegicus
agaggcagaggcgtgcgttccacac

SEQ ID NO: 115878 - DNA, 25 bp, Rattus norvegicus
agaggcagaggctcagatgctccta

SEQ ID NO: 115879 - DNA, 25 bp, Rattus norvegicus
agaggcagagtaccattactttaaa

SEQ ID NO: 115880 - DNA, 25 bp, Rattus norvegicus
agaggcagagtagcattactttaaa

SEQ ID NO: 115881 - DNA, 25 bp, Rattus norvegicus
agaggcagatccagtcccttgggct

SEQ ID NO: 115882 - DNA, 25 bp, Rattus norvegicus
agaggcagatcctgtcccttgggct

SEQ ID NO: 115883 - DNA, 25 bp, Rattus norvegicus
agaggcagattcacacagccactga

SEQ ID NO: 115884 - DNA, 25 bp, Rattus norvegicus
agaggcagattctcacagccactga

SEQ ID NO: 115885 - DNA, 25 bp, Rattus norvegicus
agaggcagcagaactgtctccacat

SEQ ID NO: 115886 - DNA, 25 bp, Rattus norvegicus
agaggcagcagatctgtctccacat

SEQ ID NO: 115887 - DNA, 25 bp, Rattus norvegicus
agaggcagccagaattctcgcccag

SEQ ID NO: 115888 - DNA, 25 bp, Rattus norvegicus
agaggcagccagacacctactgaag

SEQ ID NO: 115889 - DNA, 25 bp, Rattus norvegicus
agaggcagccagctaggtccctgac

SEQ ID NO: 115890 - DNA, 25 bp, Rattus norvegicus
agaggcagccaggtaggtccctgac

SEQ ID NO: 115891 - DNA, 25 bp, Rattus norvegicus
agaggcagccagtattctcgcccag

SEQ ID NO: 115892 - DNA, 25 bp, Rattus norvegicus
agaggcagccagtcacctactgaag

SEQ ID NO: 115893 - DNA, 25 bp, Rattus norvegicus
agaggcagccctccccactgagatg

SEQ ID NO: 115894 - DNA, 25 bp, Rattus norvegicus
agaggcagccctgcccactgagatg

SEQ ID NO: 115895 - DNA, 25 bp, Rattus norvegicus
agaggcagcctacgtctatagcact

SEQ ID NO: 115896 - DNA, 25 bp, Rattus norvegicus
agaggcagcctaggtctatagcact

SEQ ID NO: 115897 - DNA, 25 bp, Rattus norvegicus
agaggcagcgacagcaggagccctc

SEQ ID NO: 115898 - DNA, 25 bp, Rattus norvegicus
agaggcagcgactgcaggagccctc

SEQ ID NO: 115899 - DNA, 25 bp, Rattus norvegicus
agaggcagctcaagttggctccgtg

SEQ ID NO: 115900 - DNA, 25 bp, Rattus norvegicus
agaggcagctcatgttggctccgtg

SEQ ID NO: 115901 - DNA, 25 bp, Rattus norvegicus
agaggcagctcccaaatcttttacc

SEQ ID NO: 115902 - DNA, 25 bp, Rattus norvegicus
agaggcagctccgaaatcttttacc

SEQ ID NO: 115903 - DNA, 25 bp, Rattus norvegicus
agaggcagctttcacgaaccaggaa

SEQ ID NO: 115904 - DNA, 25 bp, Rattus norvegicus
agaggcagctttcgctcagaccagg

SEQ ID NO: 115905 - DNA, 25 bp, Rattus norvegicus
agaggcagctttgacgaaccaggaa

SEQ ID NO: 115906 - DNA, 25 bp, Rattus norvegicus
agaggcagctttggctcagaccagg

SEQ ID NO: 115907 - DNA, 25 bp, Rattus norvegicus
agaggcaggctgacatctcccttaa

SEQ ID NO: 115908 - DNA, 25 bp, Rattus norvegicus
agaggcaggctgtcatctcccttaa

SEQ ID NO: 115909 - DNA, 25 bp, Rattus norvegicus
agaggcagggcccactattcctgac

SEQ ID NO: 115910 - DNA, 25 bp, Rattus norvegicus
agaggcagggccgactattcctgac

SEQ ID NO: 115911 - DNA, 25 bp, Rattus norvegicus
agaggcagtcttcttttgcttttca

SEQ ID NO: 115912 - DNA, 25 bp, Rattus norvegicus
agaggcagtcttgttttgcttttca

SEQ ID NO: 115913 - DNA, 25 bp, Rattus norvegicus
agaggcagtgggaccttgacctgca

SEQ ID NO: 115914 - DNA, 25 bp, Rattus norvegicus
agaggcagtgggtccttgacctgca

SEQ ID NO: 115915 - DNA, 25 bp, Rattus norvegicus
agaggcagtgtcataagtcctgtca

SEQ ID NO: 115916 - DNA, 25 bp, Rattus norvegicus
agaggcagtgtcttaagtcctgtca

SEQ ID NO: 115917 - DNA, 25 bp, Rattus norvegicus
agaggcagttacaaggcttcctaag

SEQ ID NO: 115918 - DNA, 25 bp, Rattus norvegicus
agaggcagttactaggcttcctaag

SEQ ID NO: 115919 - DNA, 25 bp, Rattus norvegicus
agaggcatacatccttatgtccggc

SEQ ID NO: 115920 - DNA, 25 bp, Rattus norvegicus
agaggcatacatgcttatgtccggc

SEQ ID NO: 115921 - DNA, 25 bp, Rattus norvegicus
agaggcatagctaccccaagagtta

SEQ ID NO: 115922 - DNA, 25 bp, Rattus norvegicus
agaggcatagcttccccaagagtta

SEQ ID NO: 115923 - DNA, 25 bp, Rattus norvegicus
agaggcatcatgactcctggagctg

SEQ ID NO: 115924 - DNA, 25 bp, Rattus norvegicus
agaggcatcatgcacacttagtgtt

SEQ ID NO: 115925 - DNA, 25 bp, Rattus norvegicus
agaggcatcatggacacttagtgtt

SEQ ID NO: 115926 - DNA, 25 bp, Rattus norvegicus
agaggcatcatgtctcctggagctg

SEQ ID NO: 115927 - DNA, 25 bp, Rattus norvegicus
agaggcatcggacttcagcgccagc

SEQ ID NO: 115928 - DNA, 25 bp, Rattus norvegicus
agaggcatcggagttcagcgccagc

SEQ ID NO: 115929 - DNA, 25 bp, Rattus norvegicus
agaggcatctctccaaagcgcatgt

SEQ ID NO: 115930 - DNA, 25 bp, Rattus norvegicus
agaggcatctctgcaaagcgcatgt

SEQ ID NO: 115931 - DNA, 25 bp, Rattus norvegicus
agaggcatctggaactgtacccttc

SEQ ID NO: 115932 - DNA, 25 bp, Rattus norvegicus
agaggcatctggaaggcttagcaat

SEQ ID NO: 115933 - DNA, 25 bp, Rattus norvegicus
agaggcatctggtactgtacccttc

SEQ ID NO: 115934 - DNA, 25 bp, Rattus norvegicus
agaggcatctggtaggcttagcaat

SEQ ID NO: 115935 - DNA, 25 bp, Rattus norvegicus
agaggcatgtgaacgtcagtaccgt

SEQ ID NO: 115936 - DNA, 25 bp, Rattus norvegicus
agaggcatgtgatcgtcagtaccgt

SEQ ID NO: 115937 - DNA, 25 bp, Rattus norvegicus
agaggcattttcaagctggacaggc

SEQ ID NO: 115938 - DNA, 25 bp, Rattus norvegicus
agaggcattttctagctggacaggc

SEQ ID NO: 115939 - DNA, 25 bp, Rattus norvegicus
agaggccaaaggctttctcttccac

SEQ ID NO: 115940 - DNA, 25 bp, Rattus norvegicus
agaggccaaagggtttctcttccac

SEQ ID NO: 115941 - DNA, 25 bp, Rattus norvegicus
agaggccaacaaaaggcactgggaa

SEQ ID NO: 115942 - DNA, 25 bp, Rattus norvegicus
agaggccaacaataggcactgggaa

SEQ ID NO: 115943 - DNA, 25 bp, Rattus norvegicus
agaggccaactgctctacctggtaa

SEQ ID NO: 115944 - DNA, 25 bp, Rattus norvegicus
agaggccaactggtctacctggtaa

SEQ ID NO: 115945 - DNA, 25 bp, Rattus norvegicus
agaggccaagaacctttttctccca

SEQ ID NO: 115946 - DNA, 25 bp, Rattus norvegicus
agaggccaagaagctttttctccca

SEQ ID NO: 115947 - DNA, 25 bp, Rattus norvegicus
agaggccaatcgacctggcatttac

SEQ ID NO: 115948 - DNA, 25 bp, Rattus norvegicus
agaggccaatcgtcctggcatttac

SEQ ID NO: 115949 - DNA, 25 bp, Rattus norvegicus
agaggccacctgagtgactctgtgt

SEQ ID NO: 115950 - DNA, 25 bp, Rattus norvegicus
agaggccacctgtgtgactctgtgt

SEQ ID NO: 115951 - DNA, 25 bp, Rattus norvegicus
agaggccactacagtgtacaagcat

SEQ ID NO: 115952 - DNA, 25 bp, Rattus norvegicus
agaggccactactgtgtacaagcat

SEQ ID NO: 115953 - DNA, 25 bp, Rattus norvegicus
agaggccacttgagctgggacagtt

SEQ ID NO: 115954 - DNA, 25 bp, Rattus norvegicus
agaggccacttgattgctccaaggt

SEQ ID NO: 115955 - DNA, 25 bp, Rattus norvegicus
agaggccacttgtgctgggacagtt

SEQ ID NO: 115956 - DNA, 25 bp, Rattus norvegicus
agaggccacttgtttgctccaaggt

SEQ ID NO: 115957 - DNA, 25 bp, Rattus norvegicus
agaggccactttcttttctcttcct

SEQ ID NO: 115958 - DNA, 25 bp, Rattus norvegicus
agaggccactttgttttctcttcct

SEQ ID NO: 115959 - DNA, 25 bp, Rattus norvegicus
agaggccagactcgacccgcaggtc

SEQ ID NO: 115960 - DNA, 25 bp, Rattus norvegicus
agaggccagactggacccgcaggtc

SEQ ID NO: 115961 - DNA, 25 bp, Rattus norvegicus
agaggccagagaccgacgtcctgcc

SEQ ID NO: 115962 - DNA, 25 bp, Rattus norvegicus
agaggccagagagcgacgtcctgcc

SEQ ID NO: 115963 - DNA, 25 bp, Rattus norvegicus
agaggccagatcatctcaaattccc

SEQ ID NO: 115964 - DNA, 25 bp, Rattus norvegicus
agaggccagatcttctcaaattccc

SEQ ID NO: 115965 - DNA, 25 bp, Rattus norvegicus
agaggccagcccatacctgtggata

SEQ ID NO: 115966 - DNA, 25 bp, Rattus norvegicus
agaggccagcccttacctgtggata

SEQ ID NO: 115967 - DNA, 25 bp, Rattus norvegicus
agaggccaggagacaagactttgaa

SEQ ID NO: 115968 - DNA, 25 bp, Rattus norvegicus
agaggccaggagtcaagactttgaa

SEQ ID NO: 115969 - DNA, 25 bp, Rattus norvegicus
agaggccaggatccctaggtgtcct

SEQ ID NO: 115970 - DNA, 25 bp, Rattus norvegicus
agaggccaggatgcctaggtgtcct

SEQ ID NO: 115971 - DNA, 25 bp, Rattus norvegicus
agaggccaggccagtactatacatg

SEQ ID NO: 115972 - DNA, 25 bp, Rattus norvegicus
agaggccaggcctgtactatacatg

SEQ ID NO: 115973 - DNA, 25 bp, Rattus norvegicus
agaggccaggctctgtttctcaggc

SEQ ID NO: 115974 - DNA, 25 bp, Rattus norvegicus
agaggccaggctgtgtttctcaggc

SEQ ID NO: 115975 - DNA, 25 bp, Rattus norvegicus
agaggccagtctcatctacagagtt

SEQ ID NO: 115976 - DNA, 25 bp, Rattus norvegicus
agaggccagtctgatctacagagtt

SEQ ID NO: 115977 - DNA, 25 bp, Rattus norvegicus
agaggccagttactgtctgagccaa

SEQ ID NO: 115978 - DNA, 25 bp, Rattus norvegicus
agaggccagttagtgtctgagccaa

SEQ ID NO: 115979 - DNA, 25 bp, Rattus norvegicus
agaggccagttccatgggttgttct

SEQ ID NO: 115980 - DNA, 25 bp, Rattus norvegicus
agaggccagttcgatgggttgttct

SEQ ID NO: 115981 - DNA, 25 bp, Rattus norvegicus
agaggccatggcactccgagatcca

SEQ ID NO: 115982 - DNA, 25 bp, Rattus norvegicus
agaggccatggctctccgagatcca

SEQ ID NO: 115983 - DNA, 25 bp, Rattus norvegicus
agaggccatgttcgcaaccagggtt

SEQ ID NO: 115984 - DNA, 25 bp, Rattus norvegicus
agaggccatgttggcaaccagggtt

SEQ ID NO: 115985 - DNA, 25 bp, Rattus norvegicus
agaggcccactcacggagcatgaaa

SEQ ID NO: 115986 - DNA, 25 bp, Rattus norvegicus
agaggcccactctcggagcatgaaa

SEQ ID NO: 115987 - DNA, 25 bp, Rattus norvegicus
agaggcccaggcaaaagaccgcata

SEQ ID NO: 115988 - DNA, 25 bp, Rattus norvegicus
agaggcccaggccatctgatgatgt

SEQ ID NO: 115989 - DNA, 25 bp, Rattus norvegicus
agaggcccaggcgatctgatgatgt

SEQ ID NO: 115990 - DNA, 25 bp, Rattus norvegicus
agaggcccaggctaaagaccgcata

SEQ ID NO: 115991 - DNA, 25 bp, Rattus norvegicus
agaggcccagtccttctcttagaca

SEQ ID NO: 115992 - DNA, 25 bp, Rattus norvegicus
agaggcccagtcgttctcttagaca

SEQ ID NO: 115993 - DNA, 25 bp, Rattus norvegicus
agaggccccaacagtatgtgtgtga

SEQ ID NO: 115994 - DNA, 25 bp, Rattus norvegicus
agaggccccaactgtatgtgtgtga

SEQ ID NO: 115995 - DNA, 25 bp, Rattus norvegicus
agaggccccacacagtctgtaggct

SEQ ID NO: 115996 - DNA, 25 bp, Rattus norvegicus
agaggccccacagagtctgtaggct

SEQ ID NO: 115997 - DNA, 25 bp, Rattus norvegicus
agaggccccgcacttcacagtgtaa

SEQ ID NO: 115998 - DNA, 25 bp, Rattus norvegicus
agaggccccgcagttcacagtgtaa

SEQ ID NO: 115999 - DNA, 25 bp, Rattus norvegicus
agaggcccctatcgagcatccaaat

SEQ ID NO: 116000 - DNA, 25 bp, Rattus norvegicus
agaggcccctatggagcatccaaat

SEQ ID NO: 116001 - DNA, 25 bp, Rattus norvegicus
agaggcccctctatgaatgcttaaa

SEQ ID NO: 116002 - DNA, 25 bp, Rattus norvegicus
agaggcccctctttgaatgcttaaa

SEQ ID NO: 116003 - DNA, 25 bp, Rattus norvegicus
agaggccccttacaaactgagcgat

SEQ ID NO: 116004 - DNA, 25 bp, Rattus norvegicus
agaggccccttagaaactgagcgat

SEQ ID NO: 116005 - DNA, 25 bp, Rattus norvegicus
agaggcccgcacatagctctgctag

SEQ ID NO: 116006 - DNA, 25 bp, Rattus norvegicus
agaggcccgcacttagctctgctag

SEQ ID NO: 116007 - DNA, 25 bp, Rattus norvegicus
agaggcccgtccatgtctgaggatg

SEQ ID NO: 116008 - DNA, 25 bp, Rattus norvegicus
agaggcccgtccttgtctgaggatg

SEQ ID NO: 116009 - DNA, 25 bp, Rattus norvegicus
agaggccctaccactgtcaggtgtg

SEQ ID NO: 116010 - DNA, 25 bp, Rattus norvegicus
agaggccctacctctgtcaggtgtg

SEQ ID NO: 116011 - DNA, 25 bp, Rattus norvegicus
agaggccctatcagtgcagcgagtg

SEQ ID NO: 116012 - DNA, 25 bp, Rattus norvegicus
agaggccctatctgtgcagcgagtg

SEQ ID NO: 116013 - DNA, 25 bp, Rattus norvegicus
agaggccctccactataacactatg

SEQ ID NO: 116014 - DNA, 25 bp, Rattus norvegicus
agaggccctccagtataacactatg

SEQ ID NO: 116015 - DNA, 25 bp, Rattus norvegicus
agaggccctgagaatacacttctgt

SEQ ID NO: 116016 - DNA, 25 bp, Rattus norvegicus
agaggccctgagtatacacttctgt

SEQ ID NO: 116017 - DNA, 25 bp, Rattus norvegicus
agaggccctgtaacttccttgactt

SEQ ID NO: 116018 - DNA, 25 bp, Rattus norvegicus
agaggccctgtatcttccttgactt

SEQ ID NO: 116019 - DNA, 25 bp, Rattus norvegicus
agaggcccttgaagacctggagtcc

SEQ ID NO: 116020 - DNA, 25 bp, Rattus norvegicus
agaggcccttgatgacctggagtcc

SEQ ID NO: 116021 - DNA, 25 bp, Rattus norvegicus
agaggccgacatctgtgcagacccg

SEQ ID NO: 116022 - DNA, 25 bp, Rattus norvegicus
agaggccgacatgtgtgcagacccg

SEQ ID NO: 116023 - DNA, 25 bp, Rattus norvegicus
agaggccgactaaggctggattcgt

SEQ ID NO: 116024 - DNA, 25 bp, Rattus norvegicus
agaggccgactatggctggattcgt

SEQ ID NO: 116025 - DNA, 25 bp, Rattus norvegicus
agaggccgcacgaggagcacactga

SEQ ID NO: 116026 - DNA, 25 bp, Rattus norvegicus
agaggccgcacgtggagcacactga

SEQ ID NO: 116027 - DNA, 25 bp, Rattus norvegicus
agaggccgcaggcagattggcgcga

SEQ ID NO: 116028 - DNA, 25 bp, Rattus norvegicus
agaggccgcagggagattggcgcga

SEQ ID NO: 116029 - DNA, 25 bp, Rattus norvegicus
agaggccgcgcacgcagaacaacgt

SEQ ID NO: 116030 - DNA, 25 bp, Rattus norvegicus
agaggccgcgcaggcagaacaacgt

SEQ ID NO: 116031 - DNA, 25 bp, Rattus norvegicus
agaggccgcggtctctggatttact

SEQ ID NO: 116032 - DNA, 25 bp, Rattus norvegicus
agaggccgcggtgtctggatttact

SEQ ID NO: 116033 - DNA, 25 bp, Rattus norvegicus
agaggccggaagacctggttcctga

SEQ ID NO: 116034 - DNA, 25 bp, Rattus norvegicus
agaggccggaagtcctggttcctga

SEQ ID NO: 116035 - DNA, 25 bp, Rattus norvegicus
agaggccgggttcccaatgcagcta

SEQ ID NO: 116036 - DNA, 25 bp, Rattus norvegicus
agaggccgggttgccaatgcagcta

SEQ ID NO: 116037 - DNA, 25 bp, Rattus norvegicus
agaggccgtatcagacctgcctgaa

SEQ ID NO: 116038 - DNA, 25 bp, Rattus norvegicus
agaggccgtatctgacctgcctgaa

SEQ ID NO: 116039 - DNA, 25 bp, Rattus norvegicus
agaggcctactcattcctgttgtaa

SEQ ID NO: 116040 - DNA, 25 bp, Rattus norvegicus
agaggcctactctttcctgttgtaa

SEQ ID NO: 116041 - DNA, 25 bp, Rattus norvegicus
agaggcctagaccatctgaatgtaa

SEQ ID NO: 116042 - DNA, 25 bp, Rattus norvegicus
agaggcctagaccttcactcgaagg

SEQ ID NO: 116043 - DNA, 25 bp, Rattus norvegicus
agaggcctagacgatctgaatgtaa

SEQ ID NO: 116044 - DNA, 25 bp, Rattus norvegicus
agaggcctagacgttcactcgaagg

SEQ ID NO: 116045 - DNA, 25 bp, Rattus norvegicus
agaggcctagtaatgtgctgacttt

SEQ ID NO: 116046 - DNA, 25 bp, Rattus norvegicus
agaggcctagtattgtgctgacttt

SEQ ID NO: 116047 - DNA, 25 bp, Rattus norvegicus
agaggcctcagcagctttcatttca

SEQ ID NO: 116048 - DNA, 25 bp, Rattus norvegicus
agaggcctcagctgctttcatttca

SEQ ID NO: 116049 - DNA, 25 bp, Rattus norvegicus
agaggcctccaccaggccagtgatt

SEQ ID NO: 116050 - DNA, 25 bp, Rattus norvegicus
agaggcctccacgaggccagtgatt

SEQ ID NO: 116051 - DNA, 25 bp, Rattus norvegicus
agaggcctccagctgtgttttccac

SEQ ID NO: 116052 - DNA, 25 bp, Rattus norvegicus
agaggcctccagcttgagtcttgct

SEQ ID NO: 116053 - DNA, 25 bp, Rattus norvegicus
agaggcctccaggtgtgttttccac

SEQ ID NO: 116054 - DNA, 25 bp, Rattus norvegicus
agaggcctccaggttgagtcttgct

SEQ ID NO: 116055 - DNA, 25 bp, Rattus norvegicus
agaggcctcccactgaagtctgaag

SEQ ID NO: 116056 - DNA, 25 bp, Rattus norvegicus
agaggcctcccagtgaagtctgaag

SEQ ID NO: 116057 - DNA, 25 bp, Rattus norvegicus
agaggcctccctcaggttttgtggc

SEQ ID NO: 116058 - DNA, 25 bp, Rattus norvegicus
agaggcctccctgaggttttgtggc

SEQ ID NO: 116059 - DNA, 25 bp, Rattus norvegicus
agaggcctccttaatcagtactggg

SEQ ID NO: 116060 - DNA, 25 bp, Rattus norvegicus
agaggcctccttctgatcctgaaat

SEQ ID NO: 116061 - DNA, 25 bp, Rattus norvegicus
agaggcctccttgtgatcctgaaat

SEQ ID NO: 116062 - DNA, 25 bp, Rattus norvegicus
agaggcctcctttatcagtactggg

SEQ ID NO: 116063 - DNA, 25 bp, Rattus norvegicus
agaggcctcggcaccctgttagtgg

SEQ ID NO: 116064 - DNA, 25 bp, Rattus norvegicus
agaggcctcggctccctgttagtgg

SEQ ID NO: 116065 - DNA, 25 bp, Rattus norvegicus
agaggcctctccctatttgtgacag

SEQ ID NO: 116066 - DNA, 25 bp, Rattus norvegicus
agaggcctctccgtatttgtgacag

SEQ ID NO: 116067 - DNA, 25 bp, Rattus norvegicus
agaggcctctctatggaaggtcttt

SEQ ID NO: 116068 - DNA, 25 bp, Rattus norvegicus
agaggcctctctcctcgtgtttaac

SEQ ID NO: 116069 - DNA, 25 bp, Rattus norvegicus
agaggcctctctgctcgtgtttaac

SEQ ID NO: 116070 - DNA, 25 bp, Rattus norvegicus
agaggcctctctttggaaggtcttt

SEQ ID NO: 116071 - DNA, 25 bp, Rattus norvegicus
agaggcctctgacctagagaccact

SEQ ID NO: 116072 - DNA, 25 bp, Rattus norvegicus
agaggcctctgagctagagaccact

SEQ ID NO: 116073 - DNA, 25 bp, Rattus norvegicus
agaggcctctggctggacacattcc

SEQ ID NO: 116074 - DNA, 25 bp, Rattus norvegicus
agaggcctctgggtggacacattcc

SEQ ID NO: 116075 - DNA, 25 bp, Rattus norvegicus
agaggcctcttgagcacagcactgt

SEQ ID NO: 116076 - DNA, 25 bp, Rattus norvegicus
agaggcctcttgtgcacagcactgt

SEQ ID NO: 116077 - DNA, 25 bp, Rattus norvegicus
agaggcctgacgattttctctacgg

SEQ ID NO: 116078 - DNA, 25 bp, Rattus norvegicus
agaggcctgacgtttttctctacgg

SEQ ID NO: 116079 - DNA, 25 bp, Rattus norvegicus
agaggcctgatacactcctggtcct

SEQ ID NO: 116080 - DNA, 25 bp, Rattus norvegicus
agaggcctgatagactcctggtcct

SEQ ID NO: 116081 - DNA, 25 bp, Rattus norvegicus
agaggcctgcaactcaacatttgtc

SEQ ID NO: 116082 - DNA, 25 bp, Rattus norvegicus
agaggcctgcaagtcaacatttgtc

SEQ ID NO: 116083 - DNA, 25 bp, Rattus norvegicus
agaggcctgcacacatgtctgcaat

SEQ ID NO: 116084 - DNA, 25 bp, Rattus norvegicus
agaggcctgcactcatgtctgcaat

SEQ ID NO: 116085 - DNA, 25 bp, Rattus norvegicus
agaggcctgcagcaccactgaggat

SEQ ID NO: 116086 - DNA, 25 bp, Rattus norvegicus
agaggcctgcaggaccactgaggat

SEQ ID NO: 116087 - DNA, 25 bp, Rattus norvegicus
agaggcctgcttagtgtctcctgga

SEQ ID NO: 116088 - DNA, 25 bp, Rattus norvegicus
agaggcctgctttgtgtctcctgga

SEQ ID NO: 116089 - DNA, 25 bp, Rattus norvegicus
agaggcctggagacaactcggtgtt

SEQ ID NO: 116090 - DNA, 25 bp, Rattus norvegicus
agaggcctggagtcaactcggtgtt

SEQ ID NO: 116091 - DNA, 25 bp, Rattus norvegicus
agaggcctggatcgctcgtttacag

SEQ ID NO: 116092 - DNA, 25 bp, Rattus norvegicus
agaggcctggatggctcgtttacag

SEQ ID NO: 116093 - DNA, 25 bp, Rattus norvegicus
agaggcctgtatcccaacatggcgg

SEQ ID NO: 116094 - DNA, 25 bp, Rattus norvegicus
agaggcctgtatgccaacatggcgg

SEQ ID NO: 116095 - DNA, 25 bp, Rattus norvegicus
agaggcctgtctccactgtgattca

SEQ ID NO: 116096 - DNA, 25 bp, Rattus norvegicus
agaggcctgtctgcactgtgattca

SEQ ID NO: 116097 - DNA, 25 bp, Rattus norvegicus
agaggcctgtgaacaaactgccaga

SEQ ID NO: 116098 - DNA, 25 bp, Rattus norvegicus
agaggcctgtgatcaaactgccaga

SEQ ID NO: 116099 - DNA, 25 bp, Rattus norvegicus
agaggcctgtgcaagctttgggttc

SEQ ID NO: 116100 - DNA, 25 bp, Rattus norvegicus
agaggcctgtgctagctttgggttc

SEQ ID NO: 116101 - DNA, 25 bp, Rattus norvegicus
agaggccttaaaaatgctacattgg

SEQ ID NO: 116102 - DNA, 25 bp, Rattus norvegicus
agaggccttaaatatgctacattgg

SEQ ID NO: 116103 - DNA, 25 bp, Rattus norvegicus
agaggccttctacatggtccgattc

SEQ ID NO: 116104 - DNA, 25 bp, Rattus norvegicus
agaggccttctagatggtccgattc

SEQ ID NO: 116105 - DNA, 25 bp, Rattus norvegicus
agaggccttgagacttttgcaacac

SEQ ID NO: 116106 - DNA, 25 bp, Rattus norvegicus
agaggccttgagtcttttgcaacac

SEQ ID NO: 116107 - DNA, 25 bp, Rattus norvegicus
agaggccttggcacagccaggctcc

SEQ ID NO: 116108 - DNA, 25 bp, Rattus norvegicus
agaggccttggctcagccaggctcc

SEQ ID NO: 116109 - DNA, 25 bp, Rattus norvegicus
agaggccttgtgactgggagtcaca

SEQ ID NO: 116110 - DNA, 25 bp, Rattus norvegicus
agaggccttgtgtctgggagtcaca

SEQ ID NO: 116111 - DNA, 25 bp, Rattus norvegicus
agaggccttttcattgtttgaccgg

SEQ ID NO: 116112 - DNA, 25 bp, Rattus norvegicus
agaggccttttctttgtttgaccgg

SEQ ID NO: 116113 - DNA, 25 bp, Rattus norvegicus
agaggcctttttccatttgtagaga

SEQ ID NO: 116114 - DNA, 25 bp, Rattus norvegicus
agaggcctttttgcatttgtagaga

SEQ ID NO: 116115 - DNA, 25 bp, Rattus norvegicus
agaggcgactctaccagacttgttt

SEQ ID NO: 116116 - DNA, 25 bp, Rattus norvegicus
agaggcgactcttccagacttgttt

SEQ ID NO: 116117 - DNA, 25 bp, Rattus norvegicus
agaggcgcaggccatccttccagga

SEQ ID NO: 116118 - DNA, 25 bp, Rattus norvegicus
agaggcgcaggcgatccttccagga

SEQ ID NO: 116119 - DNA, 25 bp, Rattus norvegicus
agaggcgcatcactgttcggaatct

SEQ ID NO: 116120 - DNA, 25 bp, Rattus norvegicus
agaggcgcatcagtgttcggaatct

SEQ ID NO: 116121 - DNA, 25 bp, Rattus norvegicus
agaggcgccactctgttgacttaat

SEQ ID NO: 116122 - DNA, 25 bp, Rattus norvegicus
agaggcgccactgtgttgacttaat

SEQ ID NO: 116123 - DNA, 25 bp, Rattus norvegicus
agaggcgccagtacacttaggagct

SEQ ID NO: 116124 - DNA, 25 bp, Rattus norvegicus
agaggcgccagttcacttaggagct

SEQ ID NO: 116125 - DNA, 25 bp, Rattus norvegicus
agaggcgcctttagatccgtccaag

SEQ ID NO: 116126 - DNA, 25 bp, Rattus norvegicus
agaggcgccttttgatccgtccaag

SEQ ID NO: 116127 - DNA, 25 bp, Rattus norvegicus
agaggcgctctcctcagaatccact

SEQ ID NO: 116128 - DNA, 25 bp, Rattus norvegicus
agaggcgctctcgtcagaatccact

SEQ ID NO: 116129 - DNA, 25 bp, Rattus norvegicus
agaggcgctgcccaggccccaacta

SEQ ID NO: 116130 - DNA, 25 bp, Rattus norvegicus
agaggcgctgccgaggccccaacta

SEQ ID NO: 116131 - DNA, 25 bp, Rattus norvegicus
agaggcgctggtacattctgactga

SEQ ID NO: 116132 - DNA, 25 bp, Rattus norvegicus
agaggcgctggttcattctgactga

SEQ ID NO: 116133 - DNA, 25 bp, Rattus norvegicus
agaggcggaggcatggcttttccca

SEQ ID NO: 116134 - DNA, 25 bp, Rattus norvegicus
agaggcggaggcttggcttttccca

SEQ ID NO: 116135 - DNA, 25 bp, Rattus norvegicus
agaggcggcaccacagaagtcagcc

SEQ ID NO: 116136 - DNA, 25 bp, Rattus norvegicus
agaggcggcacctcagaagtcagcc

SEQ ID NO: 116137 - DNA, 25 bp, Rattus norvegicus
agaggcggcccgacttttcctgagg

SEQ ID NO: 116138 - DNA, 25 bp, Rattus norvegicus
agaggcggcccgtcttttcctgagg

SEQ ID NO: 116139 - DNA, 25 bp, Rattus norvegicus
agaggcggctgtccagagagtcgga

SEQ ID NO: 116140 - DNA, 25 bp, Rattus norvegicus
agaggcggctgtgcagagagtcgga

SEQ ID NO: 116141 - DNA, 25 bp, Rattus norvegicus
agaggcggtcctatggctcgttcca

SEQ ID NO: 116142 - DNA, 25 bp, Rattus norvegicus
agaggcggtcctttggctcgttcca

SEQ ID NO: 116143 - DNA, 25 bp, Rattus norvegicus
agaggcggtgaaacaccagctatgt

SEQ ID NO: 116144 - DNA, 25 bp, Rattus norvegicus
agaggcggtgaatcaccagctatgt

SEQ ID NO: 116145 - DNA, 25 bp, Rattus norvegicus
agaggcggttagcagcctttccatt

SEQ ID NO: 116146 - DNA, 25 bp, Rattus norvegicus
agaggcggttaggagcctttccatt

SEQ ID NO: 116147 - DNA, 25 bp, Rattus norvegicus
agaggcgtcaagattccgattaaag

SEQ ID NO: 116148 - DNA, 25 bp, Rattus norvegicus
agaggcgtcaagtttccgattaaag

SEQ ID NO: 116149 - DNA, 25 bp, Rattus norvegicus
agaggcgtcgaactcaccgaagtga

SEQ ID NO: 116150 - DNA, 25 bp, Rattus norvegicus
agaggcgtcgaagtcaccgaagtga

SEQ ID NO: 116151 - DNA, 25 bp, Rattus norvegicus
agaggcgtcggcatccaagaggcta

SEQ ID NO: 116152 - DNA, 25 bp, Rattus norvegicus
agaggcgtcggcttccaagaggcta

SEQ ID NO: 116153 - DNA, 25 bp, Rattus norvegicus
agaggcgtggagaccccaagccctg

SEQ ID NO: 116154 - DNA, 25 bp, Rattus norvegicus
agaggcgtggagtccccaagccctg

SEQ ID NO: 116155 - DNA, 25 bp, Rattus norvegicus
agaggcgtgggtactgtttcattac

SEQ ID NO: 116156 - DNA, 25 bp, Rattus norvegicus
agaggcgtgggttctgtttcattac

SEQ ID NO: 116157 - DNA, 25 bp, Rattus norvegicus
agaggctaagaacaacagaggtacc

SEQ ID NO: 116158 - DNA, 25 bp, Rattus norvegicus
agaggctaagaagaacagaggtacc

SEQ ID NO: 116159 - DNA, 25 bp, Rattus norvegicus
agaggctaatcaacttggcaacaaa

SEQ ID NO: 116160 - DNA, 25 bp, Rattus norvegicus
agaggctaatcatcttggcaacaaa

SEQ ID NO: 116161 - DNA, 25 bp, Rattus norvegicus
agaggctactacagcctccagaaga

SEQ ID NO: 116162 - DNA, 25 bp, Rattus norvegicus
agaggctactactgcctccagaaga

SEQ ID NO: 116163 - DNA, 25 bp, Rattus norvegicus
agaggctactccagatgactctcat

SEQ ID NO: 116164 - DNA, 25 bp, Rattus norvegicus
agaggctactcctgatgactctcat

SEQ ID NO: 116165 - DNA, 25 bp, Rattus norvegicus
agaggctactgtcgcaccaattcaa

SEQ ID NO: 116166 - DNA, 25 bp, Rattus norvegicus
agaggctactgtggcaccaattcaa

SEQ ID NO: 116167 - DNA, 25 bp, Rattus norvegicus
agaggctagggcctgtgaccctcac

SEQ ID NO: 116168 - DNA, 25 bp, Rattus norvegicus
agaggctagggcgtgtgaccctcac

SEQ ID NO: 116169 - DNA, 25 bp, Rattus norvegicus
agaggctatcttcctggatgagtca

SEQ ID NO: 116170 - DNA, 25 bp, Rattus norvegicus
agaggctatcttgctggatgagtca

SEQ ID NO: 116171 - DNA, 25 bp, Rattus norvegicus
agaggctatgcaatcttgtccttag

SEQ ID NO: 116172 - DNA, 25 bp, Rattus norvegicus
agaggctatgcattcttgtccttag

SEQ ID NO: 116173 - DNA, 25 bp, Rattus norvegicus
agaggctatgttagtctggacctag

SEQ ID NO: 116174 - DNA, 25 bp, Rattus norvegicus
agaggctatgtttgtctggacctag

SEQ ID NO: 116175 - DNA, 25 bp, Rattus norvegicus
agaggctcaaaacgcatatcatgtt

SEQ ID NO: 116176 - DNA, 25 bp, Rattus norvegicus
agaggctcaaaaggcatatcatgtt

SEQ ID NO: 116177 - DNA, 25 bp, Rattus norvegicus
agaggctcacaccttagcttgaaag

SEQ ID NO: 116178 - DNA, 25 bp, Rattus norvegicus
agaggctcacacgttagcttgaaag

SEQ ID NO: 116179 - DNA, 25 bp, Rattus norvegicus
agaggctcaccccagttgaagtaga

SEQ ID NO: 116180 - DNA, 25 bp, Rattus norvegicus
agaggctcacccgagttgaagtaga

SEQ ID NO: 116181 - DNA, 25 bp, Rattus norvegicus
agaggctcacctatcagggacgaac

SEQ ID NO: 116182 - DNA, 25 bp, Rattus norvegicus
agaggctcacctttcagggacgaac

SEQ ID NO: 116183 - DNA, 25 bp, Rattus norvegicus
agaggctcagagacagtactgtcac

SEQ ID NO: 116184 - DNA, 25 bp, Rattus norvegicus
agaggctcagagtcagtactgtcac

SEQ ID NO: 116185 - DNA, 25 bp, Rattus norvegicus
agaggctcagtcattgtcttcctga

SEQ ID NO: 116186 - DNA, 25 bp, Rattus norvegicus
agaggctcagtctttgtcttcctga

SEQ ID NO: 116187 - DNA, 25 bp, Rattus norvegicus
agaggctccaatacagctggttgtt

SEQ ID NO: 116188 - DNA, 25 bp, Rattus norvegicus
agaggctccaattcagctggttgtt

SEQ ID NO: 116189 - DNA, 25 bp, Rattus norvegicus
agaggctcccagcacaacgcgagat

SEQ ID NO: 116190 - DNA, 25 bp, Rattus norvegicus
agaggctcccaggacaacgcgagat

SEQ ID NO: 116191 - DNA, 25 bp, Rattus norvegicus
agaggctcccttagactgggcatgg

SEQ ID NO: 116192 - DNA, 25 bp, Rattus norvegicus
agaggctccctttgactgggcatgg

SEQ ID NO: 116193 - DNA, 25 bp, Rattus norvegicus
agaggctccgtcatgcagggtacag

SEQ ID NO: 116194 - DNA, 25 bp, Rattus norvegicus
agaggctccgtcttgcagggtacag

SEQ ID NO: 116195 - DNA, 25 bp, Rattus norvegicus
agaggctcctcgctagagactggat

SEQ ID NO: 116196 - DNA, 25 bp, Rattus norvegicus
agaggctcctcggtagagactggat

SEQ ID NO: 116197 - DNA, 25 bp, Rattus norvegicus
agaggctcctttccgaaactctgga

SEQ ID NO: 116198 - DNA, 25 bp, Rattus norvegicus
agaggctcctttgcgaaactctgga

SEQ ID NO: 116199 - DNA, 25 bp, Rattus norvegicus
agaggctctcagcatgaggacccag

SEQ ID NO: 116200 - DNA, 25 bp, Rattus norvegicus
agaggctctcaggatgaggacccag

SEQ ID NO: 116201 - DNA, 25 bp, Rattus norvegicus
agaggctctcccaactgaaattcta

SEQ ID NO: 116202 - DNA, 25 bp, Rattus norvegicus
agaggctctccctactgaaattcta

SEQ ID NO: 116203 - DNA, 25 bp, Rattus norvegicus
agaggctctcttagtccttttacaa

SEQ ID NO: 116204 - DNA, 25 bp, Rattus norvegicus
agaggctctcttccttgccttccat

SEQ ID NO: 116205 - DNA, 25 bp, Rattus norvegicus
agaggctctcttcggtcttttctta

SEQ ID NO: 116206 - DNA, 25 bp, Rattus norvegicus
agaggctctcttgcttgccttccat

SEQ ID NO: 116207 - DNA, 25 bp, Rattus norvegicus
agaggctctcttgggtcttttctta

SEQ ID NO: 116208 - DNA, 25 bp, Rattus norvegicus
agaggctctctttgtccttttacaa

SEQ ID NO: 116209 - DNA, 25 bp, Rattus norvegicus
agaggctctgaacagtgcccagcat

SEQ ID NO: 116210 - DNA, 25 bp, Rattus norvegicus
agaggctctgaagagtgcccagcat

SEQ ID NO: 116211 - DNA, 25 bp, Rattus norvegicus
agaggctctgacacaacccagagtt

SEQ ID NO: 116212 - DNA, 25 bp, Rattus norvegicus
agaggctctgactcaacccagagtt

SEQ ID NO: 116213 - DNA, 25 bp, Rattus norvegicus
agaggctctgtgatagttcccagca

SEQ ID NO: 116214 - DNA, 25 bp, Rattus norvegicus
agaggctctgtgttagttcccagca

SEQ ID NO: 116215 - DNA, 25 bp, Rattus norvegicus
agaggctgacaaaccccgaaggctg

SEQ ID NO: 116216 - DNA, 25 bp, Rattus norvegicus
agaggctgacaatccccgaaggctg

SEQ ID NO: 116217 - DNA, 25 bp, Rattus norvegicus
agaggctgacctcccaattccagag

SEQ ID NO: 116218 - DNA, 25 bp, Rattus norvegicus
agaggctgacctgccaattccagag

SEQ ID NO: 116219 - DNA, 25 bp, Rattus norvegicus
agaggctgagaaagccctgtccttc

SEQ ID NO: 116220 - DNA, 25 bp, Rattus norvegicus
agaggctgagaatgccctgtccttc

SEQ ID NO: 116221 - DNA, 25 bp, Rattus norvegicus
agaggctgagcactggatgttcttc

SEQ ID NO: 116222 - DNA, 25 bp, Rattus norvegicus
agaggctgagcagtggatgttcttc

SEQ ID NO: 116223 - DNA, 25 bp, Rattus norvegicus
agaggctgatccagaaccatctggt

SEQ ID NO: 116224 - DNA, 25 bp, Rattus norvegicus
agaggctgatcctgaaccatctggt

SEQ ID NO: 116225 - DNA, 25 bp, Rattus norvegicus
agaggctgatctcgttcatcctggg

SEQ ID NO: 116226 - DNA, 25 bp, Rattus norvegicus
agaggctgatctggttcatcctggg

SEQ ID NO: 116227 - DNA, 25 bp, Rattus norvegicus
agaggctgatgtcgtggttctcaac

SEQ ID NO: 116228 - DNA, 25 bp, Rattus norvegicus
agaggctgatgtggtggttctcaac

SEQ ID NO: 116229 - DNA, 25 bp, Rattus norvegicus
agaggctgcaatagcctacctttgt

SEQ ID NO: 116230 - DNA, 25 bp, Rattus norvegicus
agaggctgcaattgcctacctttgt

SEQ ID NO: 116231 - DNA, 25 bp, Rattus norvegicus
agaggctgcataaataacaccacac

SEQ ID NO: 116232 - DNA, 25 bp, Rattus norvegicus
agaggctgcatatataacaccacac

SEQ ID NO: 116233 - DNA, 25 bp, Rattus norvegicus
agaggctgccaaacttgggctgtca

SEQ ID NO: 116234 - DNA, 25 bp, Rattus norvegicus
agaggctgccaatcttgggctgtca

SEQ ID NO: 116235 - DNA, 25 bp, Rattus norvegicus
agaggctgccccaggagatccgtcg

SEQ ID NO: 116236 - DNA, 25 bp, Rattus norvegicus
agaggctgcccctggagatccgtcg

SEQ ID NO: 116237 - DNA, 25 bp, Rattus norvegicus
agaggctgcctacccttgcagaggc

SEQ ID NO: 116238 - DNA, 25 bp, Rattus norvegicus
agaggctgcctagccttgcagaggc

SEQ ID NO: 116239 - DNA, 25 bp, Rattus norvegicus
agaggctgctagcaaggaagacctt

SEQ ID NO: 116240 - DNA, 25 bp, Rattus norvegicus
agaggctgctaggaaggaagacctt

SEQ ID NO: 116241 - DNA, 25 bp, Rattus norvegicus
agaggctgctccattcttgggcatg

SEQ ID NO: 116242 - DNA, 25 bp, Rattus norvegicus
agaggctgctcctttcttgggcatg

SEQ ID NO: 116243 - DNA, 25 bp, Rattus norvegicus
agaggctgctgaacacgccgcgcag

SEQ ID NO: 116244 - DNA, 25 bp, Rattus norvegicus
agaggctgctgatcacgccgcgcag

SEQ ID NO: 116245 - DNA, 25 bp, Rattus norvegicus
agaggctggagacactgtacagttt

SEQ ID NO: 116246 - DNA, 25 bp, Rattus norvegicus
agaggctggagagactgtacagttt

SEQ ID NO: 116247 - DNA, 25 bp, Rattus norvegicus
agaggctggagcacatgaacgcaga

SEQ ID NO: 116248 - DNA, 25 bp, Rattus norvegicus
agaggctggagctcatgaacgcaga

SEQ ID NO: 116249 - DNA, 25 bp, Rattus norvegicus
agaggctggcctactagaggtccct

SEQ ID NO: 116250 - DNA, 25 bp, Rattus norvegicus
agaggctggcctcagctagtgtcct

SEQ ID NO: 116251 - DNA, 25 bp, Rattus norvegicus
agaggctggcctgagctagtgtcct

SEQ ID NO: 116252 - DNA, 25 bp, Rattus norvegicus
agaggctggccttctagaggtccct

SEQ ID NO: 116253 - DNA, 25 bp, Rattus norvegicus
agaggctgggccacatcacctggac

SEQ ID NO: 116254 - DNA, 25 bp, Rattus norvegicus
agaggctgggcctcatcacctggac

SEQ ID NO: 116255 - DNA, 25 bp, Rattus norvegicus
agaggctggtctctctccgttcaga

SEQ ID NO: 116256 - DNA, 25 bp, Rattus norvegicus
agaggctggtctgtctccgttcaga

SEQ ID NO: 116257 - DNA, 25 bp, Rattus norvegicus
agaggctgtcagctcagcaggactt

SEQ ID NO: 116258 - DNA, 25 bp, Rattus norvegicus
agaggctgtcaggtcagcaggactt

SEQ ID NO: 116259 - DNA, 25 bp, Rattus norvegicus
agaggctgtcatccagtcttctctt

SEQ ID NO: 116260 - DNA, 25 bp, Rattus norvegicus
agaggctgtcatgcagtcttctctt

SEQ ID NO: 116261 - DNA, 25 bp, Rattus norvegicus
agaggctgtcctccaagtgtataaa

SEQ ID NO: 116262 - DNA, 25 bp, Rattus norvegicus
agaggctgtcctgcaagtgtataaa

SEQ ID NO: 116263 - DNA, 25 bp, Rattus norvegicus
agaggctgtctgatcgggagaacaa

SEQ ID NO: 116264 - DNA, 25 bp, Rattus norvegicus
agaggctgtctgttcgggagaacaa

SEQ ID NO: 116265 - DNA, 25 bp, Rattus norvegicus
agaggctgtcttatgctgggattgt

SEQ ID NO: 116266 - DNA, 25 bp, Rattus norvegicus
agaggctgtcttttgctgggattgt

SEQ ID NO: 116267 - DNA, 25 bp, Rattus norvegicus
agaggcttaatgctgccgtgttcat

SEQ ID NO: 116268 - DNA, 25 bp, Rattus norvegicus
agaggcttaatggtgccgtgttcat

SEQ ID NO: 116269 - DNA, 25 bp, Rattus norvegicus
agaggcttaccaataagttatagag

SEQ ID NO: 116270 - DNA, 25 bp, Rattus norvegicus
agaggcttaccattaagttatagag

SEQ ID NO: 116271 - DNA, 25 bp, Rattus norvegicus
agaggcttacctaggtgggacctgt

SEQ ID NO: 116272 - DNA, 25 bp, Rattus norvegicus
agaggcttaccttggtgggacctgt

SEQ ID NO: 116273 - DNA, 25 bp, Rattus norvegicus
agaggcttactcaactccagcatgt

SEQ ID NO: 116274 - DNA, 25 bp, Rattus norvegicus
agaggcttactctactccagcatgt

SEQ ID NO: 116275 - DNA, 25 bp, Rattus norvegicus
agaggcttagccctgttttccacac

SEQ ID NO: 116276 - DNA, 25 bp, Rattus norvegicus
agaggcttagccgtgttttccacac

SEQ ID NO: 116277 - DNA, 25 bp, Rattus norvegicus
agaggcttcaaaatcagggcctgga

SEQ ID NO: 116278 - DNA, 25 bp, Rattus norvegicus
agaggcttcaaattcagggcctgga

SEQ ID NO: 116279 - DNA, 25 bp, Rattus norvegicus
agaggcttcacacgatccacaagag

SEQ ID NO: 116280 - DNA, 25 bp, Rattus norvegicus
agaggcttcacaggatccacaagag

SEQ ID NO: 116281 - DNA, 25 bp, Rattus norvegicus
agaggcttcactaggtttcttggga

SEQ ID NO: 116282 - DNA, 25 bp, Rattus norvegicus
agaggcttcacttggtttcttggga

SEQ ID NO: 116283 - DNA, 25 bp, Rattus norvegicus
agaggcttccaccttgctacataat

SEQ ID NO: 116284 - DNA, 25 bp, Rattus norvegicus
agaggcttccacgttgctacataat

SEQ ID NO: 116285 - DNA, 25 bp, Rattus norvegicus
agaggcttcctcaggtcaaggagcc

SEQ ID NO: 116286 - DNA, 25 bp, Rattus norvegicus
agaggcttcctcataaccaataaca

SEQ ID NO: 116287 - DNA, 25 bp, Rattus norvegicus
agaggcttcctctggtcaaggagcc

SEQ ID NO: 116288 - DNA, 25 bp, Rattus norvegicus
agaggcttcctcttaaccaataaca

SEQ ID NO: 116289 - DNA, 25 bp, Rattus norvegicus
agaggcttcctgacacttgggagca

SEQ ID NO: 116290 - DNA, 25 bp, Rattus norvegicus
agaggcttcctgtcacttgggagca

SEQ ID NO: 116291 - DNA, 25 bp, Rattus norvegicus
agaggcttgcagcttgtttgtctta

SEQ ID NO: 116292 - DNA, 25 bp, Rattus norvegicus
agaggcttgcaggttgtttgtctta

SEQ ID NO: 116293 - DNA, 25 bp, Rattus norvegicus
agaggcttggacagcactgcctagt

SEQ ID NO: 116294 - DNA, 25 bp, Rattus norvegicus
agaggcttggactgcactgcctagt

SEQ ID NO: 116295 - DNA, 25 bp, Rattus norvegicus
agaggcttgttcactgctgggccca

SEQ ID NO: 116296 - DNA, 25 bp, Rattus norvegicus
agaggcttgttctctgctgggccca

SEQ ID NO: 116297 - DNA, 25 bp, Rattus norvegicus
agaggctttcacagtacagcccagg

SEQ ID NO: 116298 - DNA, 25 bp, Rattus norvegicus
agaggctttcactgtacagcccagg

SEQ ID NO: 116299 - DNA, 25 bp, Rattus norvegicus
agaggctttccaaccagggctccag

SEQ ID NO: 116300 - DNA, 25 bp, Rattus norvegicus
agaggctttccatccagggctccag

SEQ ID NO: 116301 - DNA, 25 bp, Rattus norvegicus
agaggctttgcacaggcacccagtg

SEQ ID NO: 116302 - DNA, 25 bp, Rattus norvegicus
agaggctttgcagaggcacccagtg

SEQ ID NO: 116303 - DNA, 25 bp, Rattus norvegicus
agaggctttggtcacctgtacatat

SEQ ID NO: 116304 - DNA, 25 bp, Rattus norvegicus
agaggctttggtgacctgtacatat

SEQ ID NO: 116305 - DNA, 25 bp, Rattus norvegicus
agaggcttttcgatgagacccacta

SEQ ID NO: 116306 - DNA, 25 bp, Rattus norvegicus
agaggcttttcgttgagacccacta

SEQ ID NO: 116307 - DNA, 25 bp, Rattus norvegicus
agagggaaacccatgctcagttgca

SEQ ID NO: 116308 - DNA, 25 bp, Rattus norvegicus
agagggaaacccttgctcagttgca

SEQ ID NO: 116309 - DNA, 25 bp, Rattus norvegicus
agagggaaacgtctcacaccatcat

SEQ ID NO: 116310 - DNA, 25 bp, Rattus norvegicus
agagggaaacgtgtcacaccatcat

SEQ ID NO: 116311 - DNA, 25 bp, Rattus norvegicus
agagggaaactcaacctatcagaca

SEQ ID NO: 116312 - DNA, 25 bp, Rattus norvegicus
agagggaaactcatgcactttatct

SEQ ID NO: 116313 - DNA, 25 bp, Rattus norvegicus
agagggaaactctacctatcagaca

SEQ ID NO: 116314 - DNA, 25 bp, Rattus norvegicus
agagggaaactcttgcactttatct

SEQ ID NO: 116315 - DNA, 25 bp, Rattus norvegicus
agagggaactatacttgccgcacgt

SEQ ID NO: 116316 - DNA, 25 bp, Rattus norvegicus
agagggaactattcttgccgcacgt

SEQ ID NO: 116317 - DNA, 25 bp, Rattus norvegicus
agagggaacttgactggctgctttt

SEQ ID NO: 116318 - DNA, 25 bp, Rattus norvegicus
agagggaacttgagccacttcaccc

SEQ ID NO: 116319 - DNA, 25 bp, Rattus norvegicus
agagggaacttgtctggctgctttt

SEQ ID NO: 116320 - DNA, 25 bp, Rattus norvegicus
agagggaacttgtgccacttcaccc

SEQ ID NO: 116321 - DNA, 25 bp, Rattus norvegicus
agagggaagacccatcctaaactgg

SEQ ID NO: 116322 - DNA, 25 bp, Rattus norvegicus
agagggaagaccgatcctaaactgg

SEQ ID NO: 116323 - DNA, 25 bp, Rattus norvegicus
agagggaagcatctgcctttctgta

SEQ ID NO: 116324 - DNA, 25 bp, Rattus norvegicus
agagggaagcatcttcctctctgag

SEQ ID NO: 116325 - DNA, 25 bp, Rattus norvegicus
agagggaagcatgtgcctttctgta

SEQ ID NO: 116326 - DNA, 25 bp, Rattus norvegicus
agagggaagcatgttcctctctgag

SEQ ID NO: 116327 - DNA, 25 bp, Rattus norvegicus
agagggaagccacacacaccatacc

SEQ ID NO: 116328 - DNA, 25 bp, Rattus norvegicus
agagggaagccagacacaccatacc

SEQ ID NO: 116329 - DNA, 25 bp, Rattus norvegicus
agagggaatcagaaaatgccaagcc

SEQ ID NO: 116330 - DNA, 25 bp, Rattus norvegicus
agagggaatcagtaaatgccaagcc

SEQ ID NO: 116331 - DNA, 25 bp, Rattus norvegicus
agagggaatgtgagttttgttacaa

SEQ ID NO: 116332 - DNA, 25 bp, Rattus norvegicus
agagggaatgtgtgttttgttacaa

SEQ ID NO: 116333 - DNA, 25 bp, Rattus norvegicus
agagggacaacaccggaacctagca

SEQ ID NO: 116334 - DNA, 25 bp, Rattus norvegicus
agagggacaacagcggaacctagca

SEQ ID NO: 116335 - DNA, 25 bp, Rattus norvegicus
agagggacagaactgtgttccatcc

SEQ ID NO: 116336 - DNA, 25 bp, Rattus norvegicus
agagggacagaagtgtgttccatcc

SEQ ID NO: 116337 - DNA, 25 bp, Rattus norvegicus
agagggacatagctcagagttccaa

SEQ ID NO: 116338 - DNA, 25 bp, Rattus norvegicus
agagggacataggtcagagttccaa

SEQ ID NO: 116339 - DNA, 25 bp, Rattus norvegicus
agagggacatttctttttcctgatg

SEQ ID NO: 116340 - DNA, 25 bp, Rattus norvegicus
agagggacatttgtttttcctgatg

SEQ ID NO: 116341 - DNA, 25 bp, Rattus norvegicus
agagggaccagtcccagagcagcca

SEQ ID NO: 116342 - DNA, 25 bp, Rattus norvegicus
agagggaccagtgccagagcagcca

SEQ ID NO: 116343 - DNA, 25 bp, Rattus norvegicus
agagggaccgagagcgcttgacata

SEQ ID NO: 116344 - DNA, 25 bp, Rattus norvegicus
agagggaccgagtgcgcttgacata

SEQ ID NO: 116345 - DNA, 25 bp, Rattus norvegicus
agagggaccgctctgaagcttgcct

SEQ ID NO: 116346 - DNA, 25 bp, Rattus norvegicus
agagggaccgctgtgaagcttgcct

SEQ ID NO: 116347 - DNA, 25 bp, Rattus norvegicus
agagggacctctcagatcgagctat

SEQ ID NO: 116348 - DNA, 25 bp, Rattus norvegicus
agagggacctctgagatcgagctat

SEQ ID NO: 116349 - DNA, 25 bp, Rattus norvegicus
agagggacgagaaaccactcctttc

SEQ ID NO: 116350 - DNA, 25 bp, Rattus norvegicus
agagggacgagataccactcctttc

SEQ ID NO: 116351 - DNA, 25 bp, Rattus norvegicus
agagggactcatatcatcttagttg

SEQ ID NO: 116352 - DNA, 25 bp, Rattus norvegicus
agagggactcatttcatcttagttg

SEQ ID NO: 116353 - DNA, 25 bp, Rattus norvegicus
agagggactgtgatcactcagcttt

SEQ ID NO: 116354 - DNA, 25 bp, Rattus norvegicus
agagggactgtgttcactcagcttt

SEQ ID NO: 116355 - DNA, 25 bp, Rattus norvegicus
agagggagacccagatctactcatg

SEQ ID NO: 116356 - DNA, 25 bp, Rattus norvegicus
agagggagaccctgatctactcatg

SEQ ID NO: 116357 - DNA, 25 bp, Rattus norvegicus
agagggagagcgctgttaatacata

SEQ ID NO: 116358 - DNA, 25 bp, Rattus norvegicus
agagggagagcggtgttaatacata

SEQ ID NO: 116359 - DNA, 25 bp, Rattus norvegicus
agagggagatatcttacagcacaag

SEQ ID NO: 116360 - DNA, 25 bp, Rattus norvegicus
agagggagatatgttacagcacaag

SEQ ID NO: 116361 - DNA, 25 bp, Rattus norvegicus
agagggagcattcttcagtctctaa

SEQ ID NO: 116362 - DNA, 25 bp, Rattus norvegicus
agagggagcattgttcagtctctaa

SEQ ID NO: 116363 - DNA, 25 bp, Rattus norvegicus
agagggagcctcacattaacaccta

SEQ ID NO: 116364 - DNA, 25 bp, Rattus norvegicus
agagggagcctctcattaacaccta

SEQ ID NO: 116365 - DNA, 25 bp, Rattus norvegicus
agagggaggccgaagtccttcctca

SEQ ID NO: 116366 - DNA, 25 bp, Rattus norvegicus
agagggaggccgtagtccttcctca

SEQ ID NO: 116367 - DNA, 25 bp, Rattus norvegicus
agagggaggcctacctgccagagca

SEQ ID NO: 116368 - DNA, 25 bp, Rattus norvegicus
agagggaggccttcctgccagagca

SEQ ID NO: 116369 - DNA, 25 bp, Rattus norvegicus
agagggaggtcactcacctgtttcc

SEQ ID NO: 116370 - DNA, 25 bp, Rattus norvegicus
agagggaggtcagtcacctgtttcc

SEQ ID NO: 116371 - DNA, 25 bp, Rattus norvegicus
agagggaggtctcttcagtcagcaa

SEQ ID NO: 116372 - DNA, 25 bp, Rattus norvegicus
agagggaggtctgttcagtcagcaa

SEQ ID NO: 116373 - DNA, 25 bp, Rattus norvegicus
agagggagtcacactttggagccct

SEQ ID NO: 116374 - DNA, 25 bp, Rattus norvegicus
agagggagtcactctttggagccct

SEQ ID NO: 116375 - DNA, 25 bp, Rattus norvegicus
agagggagtctccaagtcacctgcc

SEQ ID NO: 116376 - DNA, 25 bp, Rattus norvegicus
agagggagtctcgaagtcacctgcc

SEQ ID NO: 116377 - DNA, 25 bp, Rattus norvegicus
agagggatacacattcacctttaag

SEQ ID NO: 116378 - DNA, 25 bp, Rattus norvegicus
agagggatacactttcacctttaag

SEQ ID NO: 116379 - DNA, 25 bp, Rattus norvegicus
agagggatcacaacatcctttctgc

SEQ ID NO: 116380 - DNA, 25 bp, Rattus norvegicus
agagggatcacatcatcctttctgc

SEQ ID NO: 116381 - DNA, 25 bp, Rattus norvegicus
agagggatcattacccctcctttca

SEQ ID NO: 116382 - DNA, 25 bp, Rattus norvegicus
agagggatcatttcccctcctttca

SEQ ID NO: 116383 - DNA, 25 bp, Rattus norvegicus
agagggatcccaagccaagtcgact

SEQ ID NO: 116384 - DNA, 25 bp, Rattus norvegicus
agagggatcccatgccaagtcgact

SEQ ID NO: 116385 - DNA, 25 bp, Rattus norvegicus
agagggatctccaggctctgcgact

SEQ ID NO: 116386 - DNA, 25 bp, Rattus norvegicus
agagggatctcctggctctgcgact

SEQ ID NO: 116387 - DNA, 25 bp, Rattus norvegicus
agagggatctgtccttactgccagc

SEQ ID NO: 116388 - DNA, 25 bp, Rattus norvegicus
agagggatctgtgcttactgccagc

SEQ ID NO: 116389 - DNA, 25 bp, Rattus norvegicus
agagggatgcacaaagccctgccgc

SEQ ID NO: 116390 - DNA, 25 bp, Rattus norvegicus
agagggatgcactaagccctgccgc

SEQ ID NO: 116391 - DNA, 25 bp, Rattus norvegicus
agagggatgcgtatggcccctttcc

SEQ ID NO: 116392 - DNA, 25 bp, Rattus norvegicus
agagggatgcgtttggcccctttcc

SEQ ID NO: 116393 - DNA, 25 bp, Rattus norvegicus
agagggatgcttaacctctcctcct

SEQ ID NO: 116394 - DNA, 25 bp, Rattus norvegicus
agagggatgctttacctctcctcct

SEQ ID NO: 116395 - DNA, 25 bp, Rattus norvegicus
agagggattgcacccattctcttac

SEQ ID NO: 116396 - DNA, 25 bp, Rattus norvegicus
agagggattgcagccattctcttac

SEQ ID NO: 116397 - DNA, 25 bp, Rattus norvegicus
agagggatttacaatggcattatca

SEQ ID NO: 116398 - DNA, 25 bp, Rattus norvegicus
agagggatttactatggcattatca

SEQ ID NO: 116399 - DNA, 25 bp, Rattus norvegicus
agagggatttctattgctggtcacc

SEQ ID NO: 116400 - DNA, 25 bp, Rattus norvegicus
agagggatttcttttgctggtcacc

SEQ ID NO: 116401 - DNA, 25 bp, Rattus norvegicus
agagggattttgacagcatcgcctg

SEQ ID NO: 116402 - DNA, 25 bp, Rattus norvegicus
agagggattttgtcagcatcgcctg

SEQ ID NO: 116403 - DNA, 25 bp, Rattus norvegicus
agagggcaactcctttgaactcagc

SEQ ID NO: 116404 - DNA, 25 bp, Rattus norvegicus
agagggcaactcgtttgaactcagc

SEQ ID NO: 116405 - DNA, 25 bp, Rattus norvegicus
agagggcaagagacttccttgcctc

SEQ ID NO: 116406 - DNA, 25 bp, Rattus norvegicus
agagggcaagagtcttccttgcctc

SEQ ID NO: 116407 - DNA, 25 bp, Rattus norvegicus
agagggcaccagactcctttggact

SEQ ID NO: 116408 - DNA, 25 bp, Rattus norvegicus
agagggcaccagtctcctttggact

SEQ ID NO: 116409 - DNA, 25 bp, Rattus norvegicus
agagggcagaggcttctctgcacca

SEQ ID NO: 116410 - DNA, 25 bp, Rattus norvegicus
agagggcagagggttctctgcacca

SEQ ID NO: 116411 - DNA, 25 bp, Rattus norvegicus
agagggcagcaccaagaccaagcag

SEQ ID NO: 116412 - DNA, 25 bp, Rattus norvegicus
agagggcagcacgaagaccaagcag

SEQ ID NO: 116413 - DNA, 25 bp, Rattus norvegicus
agagggcagcgtaaccacggcaaca

SEQ ID NO: 116414 - DNA, 25 bp, Rattus norvegicus
agagggcagcgttaccacggcaaca

SEQ ID NO: 116415 - DNA, 25 bp, Rattus norvegicus
agagggcagtgaccacttggcacaa

SEQ ID NO: 116416 - DNA, 25 bp, Rattus norvegicus
agagggcagtgagcacttggcacaa

SEQ ID NO: 116417 - DNA, 25 bp, Rattus norvegicus
agagggcatccaaactctcgttaca

SEQ ID NO: 116418 - DNA, 25 bp, Rattus norvegicus
agagggcatccacctgacagcggct

SEQ ID NO: 116419 - DNA, 25 bp, Rattus norvegicus
agagggcatccagctgacagcggct

SEQ ID NO: 116420 - DNA, 25 bp, Rattus norvegicus
agagggcatccatactctcgttaca

SEQ ID NO: 116421 - DNA, 25 bp, Rattus norvegicus
agagggcatcgtcagcaattccatc

SEQ ID NO: 116422 - DNA, 25 bp, Rattus norvegicus
agagggcatcgtgagcaattccatc

SEQ ID NO: 116423 - DNA, 25 bp, Rattus norvegicus
agagggcatctaattatactctgcc

SEQ ID NO: 116424 - DNA, 25 bp, Rattus norvegicus
agagggcatctatttatactctgcc

SEQ ID NO: 116425 - DNA, 25 bp, Rattus norvegicus
agagggcatctcagaccctgaagca

SEQ ID NO: 116426 - DNA, 25 bp, Rattus norvegicus
agagggcatctctgaccctgaagca

SEQ ID NO: 116427 - DNA, 25 bp, Rattus norvegicus
agagggccacagacatttgtcacag

SEQ ID NO: 116428 - DNA, 25 bp, Rattus norvegicus
agagggccacagtcatttgtcacag

SEQ ID NO: 116429 - DNA, 25 bp, Rattus norvegicus
agagggccaccaacgaagctttctt

SEQ ID NO: 116430 - DNA, 25 bp, Rattus norvegicus
agagggccaccatcgaagctttctt

SEQ ID NO: 116431 - DNA, 25 bp, Rattus norvegicus
agagggccaccgatcttgtctaatt

SEQ ID NO: 116432 - DNA, 25 bp, Rattus norvegicus
agagggccaccgttcttgtctaatt

SEQ ID NO: 116433 - DNA, 25 bp, Rattus norvegicus
agagggccagccacgagagcactga

SEQ ID NO: 116434 - DNA, 25 bp, Rattus norvegicus
agagggccagcctcgagagcactga

SEQ ID NO: 116435 - DNA, 25 bp, Rattus norvegicus
agagggccattgctatcatgcccgg

SEQ ID NO: 116436 - DNA, 25 bp, Rattus norvegicus
agagggccattggtatcatgcccgg

SEQ ID NO: 116437 - DNA, 25 bp, Rattus norvegicus
agagggcccaccaaagactgatctt

SEQ ID NO: 116438 - DNA, 25 bp, Rattus norvegicus
agagggcccacctaagactgatctt

SEQ ID NO: 116439 - DNA, 25 bp, Rattus norvegicus
agagggcccagtctccagaacagga

SEQ ID NO: 116440 - DNA, 25 bp, Rattus norvegicus
agagggcccagtgtccagaacagga

SEQ ID NO: 116441 - DNA, 25 bp, Rattus norvegicus
agagggcccctgactgtgtggctca

SEQ ID NO: 116442 - DNA, 25 bp, Rattus norvegicus
agagggcccctgtctgtgtggctca

SEQ ID NO: 116443 - DNA, 25 bp, Rattus norvegicus
agagggcccgttcattctgtcttat

SEQ ID NO: 116444 - DNA, 25 bp, Rattus norvegicus
agagggcccgttgattctgtcttat

SEQ ID NO: 116445 - DNA, 25 bp, Rattus norvegicus
agagggccctaaagactgggtccag

SEQ ID NO: 116446 - DNA, 25 bp, Rattus norvegicus
agagggccctaatgactgggtccag

SEQ ID NO: 116447 - DNA, 25 bp, Rattus norvegicus
agagggccctgcaagcactttactt

SEQ ID NO: 116448 - DNA, 25 bp, Rattus norvegicus
agagggccctgctagcactttactt

SEQ ID NO: 116449 - DNA, 25 bp, Rattus norvegicus
agagggccgggtagctaactcttga

SEQ ID NO: 116450 - DNA, 25 bp, Rattus norvegicus
agagggccgggttgctaactcttga

SEQ ID NO: 116451 - DNA, 25 bp, Rattus norvegicus
agagggcctttgaaactgagcctga

SEQ ID NO: 116452 - DNA, 25 bp, Rattus norvegicus
agagggcctttgcatctcctggaac

SEQ ID NO: 116453 - DNA, 25 bp, Rattus norvegicus
agagggcctttggatctcctggaac

SEQ ID NO: 116454 - DNA, 25 bp, Rattus norvegicus
agagggcctttgtaactgagcctga

SEQ ID NO: 116455 - DNA, 25 bp, Rattus norvegicus
agagggcgagcaatttctacaccag

SEQ ID NO: 116456 - DNA, 25 bp, Rattus norvegicus
agagggcgagcattttctacaccag

SEQ ID NO: 116457 - DNA, 25 bp, Rattus norvegicus
agagggcgagtacgccattcttgcc

SEQ ID NO: 116458 - DNA, 25 bp, Rattus norvegicus
agagggcgagtaggccattcttgcc

SEQ ID NO: 116459 - DNA, 25 bp, Rattus norvegicus
agagggcgcacgctgacttctctgc

SEQ ID NO: 116460 - DNA, 25 bp, Rattus norvegicus
agagggcgcacggtgacttctctgc

SEQ ID NO: 116461 - DNA, 25 bp, Rattus norvegicus
agagggcgcccgcagcttactcggc

SEQ ID NO: 116462 - DNA, 25 bp, Rattus norvegicus
agagggcgcccggagcttactcggc

SEQ ID NO: 116463 - DNA, 25 bp, Rattus norvegicus
agagggcgctgtaccgccatgtaat

SEQ ID NO: 116464 - DNA, 25 bp, Rattus norvegicus
agagggcgctgttccgccatgtaat

SEQ ID NO: 116465 - DNA, 25 bp, Rattus norvegicus
agagggcgtcctcacgaaaggtcac

SEQ ID NO: 116466 - DNA, 25 bp, Rattus norvegicus
agagggcgtcctgacgaaaggtcac

SEQ ID NO: 116467 - DNA, 25 bp, Rattus norvegicus
agagggctagttagggctcctgaga

SEQ ID NO: 116468 - DNA, 25 bp, Rattus norvegicus
agagggctagtttgggctcctgaga

SEQ ID NO: 116469 - DNA, 25 bp, Rattus norvegicus
agagggctattgcagtttcctttct

SEQ ID NO: 116470 - DNA, 25 bp, Rattus norvegicus
agagggctattggagtttcctttct

SEQ ID NO: 116471 - DNA, 25 bp, Rattus norvegicus
agagggctcagtcctactcctagaa

SEQ ID NO: 116472 - DNA, 25 bp, Rattus norvegicus
agagggctcagtgctactcctagaa

SEQ ID NO: 116473 - DNA, 25 bp, Rattus norvegicus
agagggctcgtcataggtcgctagt

SEQ ID NO: 116474 - DNA, 25 bp, Rattus norvegicus
agagggctcgtcttaggtcgctagt

SEQ ID NO: 116475 - DNA, 25 bp, Rattus norvegicus
agagggctctgcacagaaccagcta

SEQ ID NO: 116476 - DNA, 25 bp, Rattus norvegicus
agagggctctgctcagaaccagcta

SEQ ID NO: 116477 - DNA, 25 bp, Rattus norvegicus
agagggctctgtatgaaagtgacac

SEQ ID NO: 116478 - DNA, 25 bp, Rattus norvegicus
agagggctctgtttgaaagtgacac

SEQ ID NO: 116479 - DNA, 25 bp, Rattus norvegicus
agagggctgagcagacctttgcaaa

SEQ ID NO: 116480 - DNA, 25 bp, Rattus norvegicus
agagggctgagctgacctttgcaaa

SEQ ID NO: 116481 - DNA, 25 bp, Rattus norvegicus
agagggctgcgcaagacctggatat

SEQ ID NO: 116482 - DNA, 25 bp, Rattus norvegicus
agagggctgcgctagacctggatat

SEQ ID NO: 116483 - DNA, 25 bp, Rattus norvegicus
agagggcttcgaagaatccgcccca

SEQ ID NO: 116484 - DNA, 25 bp, Rattus norvegicus
agagggcttcgatgaatccgcccca

SEQ ID NO: 116485 - DNA, 25 bp, Rattus norvegicus
agagggtaaatcagcctgtgttcta

SEQ ID NO: 116486 - DNA, 25 bp, Rattus norvegicus
agagggtaaatctgcctgtgttcta

SEQ ID NO: 116487 - DNA, 25 bp, Rattus norvegicus
agagggtaacagcttcatccgagat

SEQ ID NO: 116488 - DNA, 25 bp, Rattus norvegicus
agagggtaacaggttcatccgagat

SEQ ID NO: 116489 - DNA, 25 bp, Rattus norvegicus
agagggtacaggcaccggactacca

SEQ ID NO: 116490 - DNA, 25 bp, Rattus norvegicus
agagggtacagggaccggactacca

SEQ ID NO: 116491 - DNA, 25 bp, Rattus norvegicus
agagggtaccaccaaggactttgag

SEQ ID NO: 116492 - DNA, 25 bp, Rattus norvegicus
agagggtaccacgaaggactttgag

SEQ ID NO: 116493 - DNA, 25 bp, Rattus norvegicus
agagggtactagagcctgcgacagc

SEQ ID NO: 116494 - DNA, 25 bp, Rattus norvegicus
agagggtactagtgcctgcgacagc

SEQ ID NO: 116495 - DNA, 25 bp, Rattus norvegicus
agagggtaggcaccatcagactcca

SEQ ID NO: 116496 - DNA, 25 bp, Rattus norvegicus
agagggtaggcagcatcagactcca

SEQ ID NO: 116497 - DNA, 25 bp, Rattus norvegicus
agagggtaggccagcacctccacat

SEQ ID NO: 116498 - DNA, 25 bp, Rattus norvegicus
agagggtaggcctgcacctccacat

SEQ ID NO: 116499 - DNA, 25 bp, Rattus norvegicus
agagggtatcccagtgacatgcctg

SEQ ID NO: 116500 - DNA, 25 bp, Rattus norvegicus
agagggtatccctgtgacatgcctg

SEQ ID NO: 116501 - DNA, 25 bp, Rattus norvegicus
agagggtatcggatgtcagccccac

SEQ ID NO: 116502 - DNA, 25 bp, Rattus norvegicus
agagggtatcggttgtcagccccac

SEQ ID NO: 116503 - DNA, 25 bp, Rattus norvegicus
agagggtcaactccgtttcttgcct

SEQ ID NO: 116504 - DNA, 25 bp, Rattus norvegicus
agagggtcaactgcgtttcttgcct

SEQ ID NO: 116505 - DNA, 25 bp, Rattus norvegicus
agagggtcacaccacctgagggcta

SEQ ID NO: 116506 - DNA, 25 bp, Rattus norvegicus
agagggtcacacgacctgagggcta

SEQ ID NO: 116507 - DNA, 25 bp, Rattus norvegicus
agagggtcaccgctttggacttcat

SEQ ID NO: 116508 - DNA, 25 bp, Rattus norvegicus
agagggtcaccggtttggacttcat

SEQ ID NO: 116509 - DNA, 25 bp, Rattus norvegicus
agagggtcactgactgtgtccttgg

SEQ ID NO: 116510 - DNA, 25 bp, Rattus norvegicus
agagggtcactgtctgtgtccttgg

SEQ ID NO: 116511 - DNA, 25 bp, Rattus norvegicus
agagggtcagacagtgccacttggc

SEQ ID NO: 116512 - DNA, 25 bp, Rattus norvegicus
agagggtcagactgtgccacttggc

SEQ ID NO: 116513 - DNA, 25 bp, Rattus norvegicus
agagggtcccgaaccagaattgtac

SEQ ID NO: 116514 - DNA, 25 bp, Rattus norvegicus
agagggtcccgatccagaattgtac

SEQ ID NO: 116515 - DNA, 25 bp, Rattus norvegicus
agagggtcccggagagtcacttcaa

SEQ ID NO: 116516 - DNA, 25 bp, Rattus norvegicus
agagggtcccggtgagtcacttcaa

SEQ ID NO: 116517 - DNA, 25 bp, Rattus norvegicus
agagggtcctctactttctgtatct

SEQ ID NO: 116518 - DNA, 25 bp, Rattus norvegicus
agagggtcctcttctttctgtatct

SEQ ID NO: 116519 - DNA, 25 bp, Rattus norvegicus
agagggtcctgcagcattagtgcca

SEQ ID NO: 116520 - DNA, 25 bp, Rattus norvegicus
agagggtcctgctgcattagtgcca

SEQ ID NO: 116521 - DNA, 25 bp, Rattus norvegicus
agagggtcgagtccattgcctagct

SEQ ID NO: 116522 - DNA, 25 bp, Rattus norvegicus
agagggtcgagtgcattgcctagct

SEQ ID NO: 116523 - DNA, 25 bp, Rattus norvegicus
agagggtgaatgaccagcctgaact

SEQ ID NO: 116524 - DNA, 25 bp, Rattus norvegicus
agagggtgaatgtccagcctgaact

SEQ ID NO: 116525 - DNA, 25 bp, Rattus norvegicus
agagggtgcaccaatcctgtagaga

SEQ ID NO: 116526 - DNA, 25 bp, Rattus norvegicus
agagggtgcacctatcctgtagaga

SEQ ID NO: 116527 - DNA, 25 bp, Rattus norvegicus
agagggtgcatgctgttactacgct

SEQ ID NO: 116528 - DNA, 25 bp, Rattus norvegicus
agagggtgcatggtgttactacgct

SEQ ID NO: 116529 - DNA, 25 bp, Rattus norvegicus
agagggtgccctcaacatggcccgt

SEQ ID NO: 116530 - DNA, 25 bp, Rattus norvegicus
agagggtgccctgaacatggcccgt

SEQ ID NO: 116531 - DNA, 25 bp, Rattus norvegicus
agagggtgcctgatctcaatgaacc

SEQ ID NO: 116532 - DNA, 25 bp, Rattus norvegicus
agagggtgcctgttctcaatgaacc

SEQ ID NO: 116533 - DNA, 25 bp, Rattus norvegicus
agagggtgctacactggccagtgtt

SEQ ID NO: 116534 - DNA, 25 bp, Rattus norvegicus
agagggtgctactctggccagtgtt

SEQ ID NO: 116535 - DNA, 25 bp, Rattus norvegicus
agagggtgctgtcgtctgctttcca

SEQ ID NO: 116536 - DNA, 25 bp, Rattus norvegicus
agagggtgctgtggtctgctttcca

SEQ ID NO: 116537 - DNA, 25 bp, Rattus norvegicus
agagggtggcggagcctttccacct

SEQ ID NO: 116538 - DNA, 25 bp, Rattus norvegicus
agagggtggcggtgcctttccacct

SEQ ID NO: 116539 - DNA, 25 bp, Rattus norvegicus
agagggtggcttagcttcatggcca

SEQ ID NO: 116540 - DNA, 25 bp, Rattus norvegicus
agagggtggctttgcttcatggcca

SEQ ID NO: 116541 - DNA, 25 bp, Rattus norvegicus
agagggtgtcacctggcactgaaca

SEQ ID NO: 116542 - DNA, 25 bp, Rattus norvegicus
agagggtgtcacgtggcactgaaca

SEQ ID NO: 116543 - DNA, 25 bp, Rattus norvegicus
agagggtgtctcattcaatgcatgt

SEQ ID NO: 116544 - DNA, 25 bp, Rattus norvegicus
agagggtgtctctttcaatgcatgt

SEQ ID NO: 116545 - DNA, 25 bp, Rattus norvegicus
agagggtgtctgactgctggacaaa

SEQ ID NO: 116546 - DNA, 25 bp, Rattus norvegicus
agagggtgtctgtctgctggacaaa

SEQ ID NO: 116547 - DNA, 25 bp, Rattus norvegicus
agagggtgttatctgcctttcgcat

SEQ ID NO: 116548 - DNA, 25 bp, Rattus norvegicus
agagggtgttatgtgcctttcgcat

SEQ ID NO: 116549 - DNA, 25 bp, Rattus norvegicus
agagggttccatatcatctttattc

SEQ ID NO: 116550 - DNA, 25 bp, Rattus norvegicus
agagggttccatttcatctttattc

SEQ ID NO: 116551 - DNA, 25 bp, Rattus norvegicus
agagggttcggactcatccacagac

SEQ ID NO: 116552 - DNA, 25 bp, Rattus norvegicus
agagggttcggagtcatccacagac

SEQ ID NO: 116553 - DNA, 25 bp, Rattus norvegicus
agagggttctatattgcattatgtg

SEQ ID NO: 116554 - DNA, 25 bp, Rattus norvegicus
agagggttctattttgcattatgtg

SEQ ID NO: 116555 - DNA, 25 bp, Rattus norvegicus
agagggttctccactgtgctactgg

SEQ ID NO: 116556 - DNA, 25 bp, Rattus norvegicus
agagggttctcctctgtgctactgg

SEQ ID NO: 116557 - DNA, 25 bp, Rattus norvegicus
agagggttctttacatgtatgcttg

SEQ ID NO: 116558 - DNA, 25 bp, Rattus norvegicus
agagggttcttttcatgtatgcttg

SEQ ID NO: 116559 - DNA, 25 bp, Rattus norvegicus
agaggtaaccatcttcccactgcag

SEQ ID NO: 116560 - DNA, 25 bp, Rattus norvegicus
agaggtaaccatgttcccactgcag

SEQ ID NO: 116561 - DNA, 25 bp, Rattus norvegicus
agaggtaacccaaccgtgtgagcgt

SEQ ID NO: 116562 - DNA, 25 bp, Rattus norvegicus
agaggtaacccatccgtgtgagcgt

SEQ ID NO: 116563 - DNA, 25 bp, Rattus norvegicus
agaggtaagcccactcaacggcttt

SEQ ID NO: 116564 - DNA, 25 bp, Rattus norvegicus
agaggtaagccctctcaacggcttt

SEQ ID NO: 116565 - DNA, 25 bp, Rattus norvegicus
agaggtaattctcttcctgttccct

SEQ ID NO: 116566 - DNA, 25 bp, Rattus norvegicus
agaggtaattctgttcctgttccct

SEQ ID NO: 116567 - DNA, 25 bp, Rattus norvegicus
agaggtacacgtctctgcaggagct

SEQ ID NO: 116568 - DNA, 25 bp, Rattus norvegicus
agaggtacacgtgtctgcaggagct

SEQ ID NO: 116569 - DNA, 25 bp, Rattus norvegicus
agaggtacaggtataactctgtcct

SEQ ID NO: 116570 - DNA, 25 bp, Rattus norvegicus
agaggtacaggtttaactctgtcct

SEQ ID NO: 116571 - DNA, 25 bp, Rattus norvegicus
agaggtacataacttgccttcccag

SEQ ID NO: 116572 - DNA, 25 bp, Rattus norvegicus
agaggtacataagttgccttcccag

SEQ ID NO: 116573 - DNA, 25 bp, Rattus norvegicus
agaggtacccggcagtcagccttcg

SEQ ID NO: 116574 - DNA, 25 bp, Rattus norvegicus
agaggtacccgggagtcagccttcg

SEQ ID NO: 116575 - DNA, 25 bp, Rattus norvegicus
agaggtacgggaatcctcagtgccc

SEQ ID NO: 116576 - DNA, 25 bp, Rattus norvegicus
agaggtacgggattcctcagtgccc

SEQ ID NO: 116577 - DNA, 25 bp, Rattus norvegicus
agaggtacggtgactccgtggcaaa

SEQ ID NO: 116578 - DNA, 25 bp, Rattus norvegicus
agaggtacggtgtctccgtggcaaa

SEQ ID NO: 116579 - DNA, 25 bp, Rattus norvegicus
agaggtagaatgacctcccctatca

SEQ ID NO: 116580 - DNA, 25 bp, Rattus norvegicus
agaggtagaatgtcctcccctatca

SEQ ID NO: 116581 - DNA, 25 bp, Rattus norvegicus
agaggtagacccagagactagccct

SEQ ID NO: 116582 - DNA, 25 bp, Rattus norvegicus
agaggtagaccctgagactagccct

SEQ ID NO: 116583 - DNA, 25 bp, Rattus norvegicus
agaggtagatgccagctgcctctta

SEQ ID NO: 116584 - DNA, 25 bp, Rattus norvegicus
agaggtagatgcgagctgcctctta

SEQ ID NO: 116585 - DNA, 25 bp, Rattus norvegicus
agaggtagatttccctactccagaa

SEQ ID NO: 116586 - DNA, 25 bp, Rattus norvegicus
agaggtagatttgcctactccagaa

SEQ ID NO: 116587 - DNA, 25 bp, Rattus norvegicus
agaggtagccatcgacagccagtgt

SEQ ID NO: 116588 - DNA, 25 bp, Rattus norvegicus
agaggtagccatggacagccagtgt

SEQ ID NO: 116589 - DNA, 25 bp, Rattus norvegicus
agaggtagcccacccacttcagcaa

SEQ ID NO: 116590 - DNA, 25 bp, Rattus norvegicus
agaggtagcccagccacttcagcaa

SEQ ID NO: 116591 - DNA, 25 bp, Rattus norvegicus
agaggtagctctcggtcagtgtaat

SEQ ID NO: 116592 - DNA, 25 bp, Rattus norvegicus
agaggtagctctgggtcagtgtaat

SEQ ID NO: 116593 - DNA, 25 bp, Rattus norvegicus
agaggtagtcctcagctttgctgag

SEQ ID NO: 116594 - DNA, 25 bp, Rattus norvegicus
agaggtagtcctgagctttgctgag

SEQ ID NO: 116595 - DNA, 25 bp, Rattus norvegicus
agaggtagttgcatctggacgccac

SEQ ID NO: 116596 - DNA, 25 bp, Rattus norvegicus
agaggtagttgcttctggacgccac

SEQ ID NO: 116597 - DNA, 25 bp, Rattus norvegicus
agaggtatcatccatgctcgggcac

SEQ ID NO: 116598 - DNA, 25 bp, Rattus norvegicus
agaggtatcatcgatgctcgggcac

SEQ ID NO: 116599 - DNA, 25 bp, Rattus norvegicus
agaggtatccctctcaatggttccg

SEQ ID NO: 116600 - DNA, 25 bp, Rattus norvegicus
agaggtatccctgtcaatggttccg

SEQ ID NO: 116601 - DNA, 25 bp, Rattus norvegicus
agaggtatcgagaagcccctgggca

SEQ ID NO: 116602 - DNA, 25 bp, Rattus norvegicus
agaggtatcgagtagcccctgggca

SEQ ID NO: 116603 - DNA, 25 bp, Rattus norvegicus
agaggtatcgttctttcagccagat

SEQ ID NO: 116604 - DNA, 25 bp, Rattus norvegicus
agaggtatcgttgtttcagccagat

SEQ ID NO: 116605 - DNA, 25 bp, Rattus norvegicus
agaggtatctcactacctttctcca

SEQ ID NO: 116606 - DNA, 25 bp, Rattus norvegicus
agaggtatctcagtacctttctcca

SEQ ID NO: 116607 - DNA, 25 bp, Rattus norvegicus
agaggtatctgcagcgcctgagatg

SEQ ID NO: 116608 - DNA, 25 bp, Rattus norvegicus
agaggtatctgctgcgcctgagatg

SEQ ID NO: 116609 - DNA, 25 bp, Rattus norvegicus
agaggtatgagactcccctgtggca

SEQ ID NO: 116610 - DNA, 25 bp, Rattus norvegicus
agaggtatgagagtcccctgtggca

SEQ ID NO: 116611 - DNA, 25 bp, Rattus norvegicus
agaggtatgtgtccagacgcagtca

SEQ ID NO: 116612 - DNA, 25 bp, Rattus norvegicus
agaggtatgtgtgcagacgcagtca

SEQ ID NO: 116613 - DNA, 25 bp, Rattus norvegicus
agaggtattctccagtgttctctgc

SEQ ID NO: 116614 - DNA, 25 bp, Rattus norvegicus
agaggtattctcgagtgttctctgc

SEQ ID NO: 116615 - DNA, 25 bp, Rattus norvegicus
agaggtatttctatctgtcctcatc

SEQ ID NO: 116616 - DNA, 25 bp, Rattus norvegicus
agaggtatttctccctcagtctttc

SEQ ID NO: 116617 - DNA, 25 bp, Rattus norvegicus
agaggtatttctgcctcagtctttc

SEQ ID NO: 116618 - DNA, 25 bp, Rattus norvegicus
agaggtatttctttctgtcctcatc

SEQ ID NO: 116619 - DNA, 25 bp, Rattus norvegicus
agaggtcaagctcatataggaggca

SEQ ID NO: 116620 - DNA, 25 bp, Rattus norvegicus
agaggtcaagctgatataggaggca

SEQ ID NO: 116621 - DNA, 25 bp, Rattus norvegicus
agaggtcaaggtcagagtgccccta

SEQ ID NO: 116622 - DNA, 25 bp, Rattus norvegicus
agaggtcaaggtgagagtgccccta

SEQ ID NO: 116623 - DNA, 25 bp, Rattus norvegicus
agaggtcacacacaggtcacacact

SEQ ID NO: 116624 - DNA, 25 bp, Rattus norvegicus
agaggtcacacagaggtcacacact

SEQ ID NO: 116625 - DNA, 25 bp, Rattus norvegicus
agaggtcacctacggcatggtcgct

SEQ ID NO: 116626 - DNA, 25 bp, Rattus norvegicus
agaggtcacctagggcatggtcgct

SEQ ID NO: 116627 - DNA, 25 bp, Rattus norvegicus
agaggtcactagacagcgatggaac

SEQ ID NO: 116628 - DNA, 25 bp, Rattus norvegicus
agaggtcactagtcagcgatggaac

SEQ ID NO: 116629 - DNA, 25 bp, Rattus norvegicus
agaggtcactgtccaactttgcgtt

SEQ ID NO: 116630 - DNA, 25 bp, Rattus norvegicus
agaggtcactgtgcaactttgcgtt

SEQ ID NO: 116631 - DNA, 25 bp, Rattus norvegicus
agaggtcacttcagcatcttcctgc

SEQ ID NO: 116632 - DNA, 25 bp, Rattus norvegicus
agaggtcacttctgcatcttcctgc

SEQ ID NO: 116633 - DNA, 25 bp, Rattus norvegicus
agaggtcagactcccgagaagccaa

SEQ ID NO: 116634 - DNA, 25 bp, Rattus norvegicus
agaggtcagactgccgagaagccaa

SEQ ID NO: 116635 - DNA, 25 bp, Rattus norvegicus
agaggtcagcacactgtggctcatt

SEQ ID NO: 116636 - DNA, 25 bp, Rattus norvegicus
agaggtcagcactctgtggctcatt

SEQ ID NO: 116637 - DNA, 25 bp, Rattus norvegicus
agaggtcagcagactgtgtttatct

SEQ ID NO: 116638 - DNA, 25 bp, Rattus norvegicus
agaggtcagcagtctgtgtttatct

SEQ ID NO: 116639 - DNA, 25 bp, Rattus norvegicus
agaggtcaggaccattccttcctat

SEQ ID NO: 116640 - DNA, 25 bp, Rattus norvegicus
agaggtcaggacgattccttcctat

SEQ ID NO: 116641 - DNA, 25 bp, Rattus norvegicus
agaggtcaggcacttgtcacaatac

SEQ ID NO: 116642 - DNA, 25 bp, Rattus norvegicus
agaggtcaggcagttgtcacaatac

SEQ ID NO: 116643 - DNA, 25 bp, Rattus norvegicus
agaggtcagggtcagccccagctac

SEQ ID NO: 116644 - DNA, 25 bp, Rattus norvegicus
agaggtcagggtgagccccagctac

SEQ ID NO: 116645 - DNA, 25 bp, Rattus norvegicus
agaggtcaggttattacgagagcaa

SEQ ID NO: 116646 - DNA, 25 bp, Rattus norvegicus
agaggtcaggtttttacgagagcaa

SEQ ID NO: 116647 - DNA, 25 bp, Rattus norvegicus
agaggtcagtgaccaggcacggctg

SEQ ID NO: 116648 - DNA, 25 bp, Rattus norvegicus
agaggtcagtgagcaggcacggctg

SEQ ID NO: 116649 - DNA, 25 bp, Rattus norvegicus
agaggtcatcttctggctgtaattt

SEQ ID NO: 116650 - DNA, 25 bp, Rattus norvegicus
agaggtcatcttgtggctgtaattt

SEQ ID NO: 116651 - DNA, 25 bp, Rattus norvegicus
agaggtcatttcagggccagggcat

SEQ ID NO: 116652 - DNA, 25 bp, Rattus norvegicus
agaggtcatttctgggccagggcat

SEQ ID NO: 116653 - DNA, 25 bp, Rattus norvegicus
agaggtccactcagagcccaaggaa

SEQ ID NO: 116654 - DNA, 25 bp, Rattus norvegicus
agaggtccactcagggcaggctgca

SEQ ID NO: 116655 - DNA, 25 bp, Rattus norvegicus
agaggtccactctgagcccaaggaa

SEQ ID NO: 116656 - DNA, 25 bp, Rattus norvegicus
agaggtccactctgggcaggctgca

SEQ ID NO: 116657 - DNA, 25 bp, Rattus norvegicus
agaggtccaggcacccgctatcagg

SEQ ID NO: 116658 - DNA, 25 bp, Rattus norvegicus
agaggtccaggctcccgctatcagg

SEQ ID NO: 116659 - DNA, 25 bp, Rattus norvegicus
agaggtcccgtgcagccaatcagag

SEQ ID NO: 116660 - DNA, 25 bp, Rattus norvegicus
agaggtcccgtggagccaatcagag

SEQ ID NO: 116661 - DNA, 25 bp, Rattus norvegicus
agaggtccctgaagctgagagcctt

SEQ ID NO: 116662 - DNA, 25 bp, Rattus norvegicus
agaggtccctgatgctgagagcctt

SEQ ID NO: 116663 - DNA, 25 bp, Rattus norvegicus
agaggtccctgtatctggaggtgca

SEQ ID NO: 116664 - DNA, 25 bp, Rattus norvegicus
agaggtccctgtcctgtccgcctag

SEQ ID NO: 116665 - DNA, 25 bp, Rattus norvegicus
agaggtccctgtcttcattaggtaa

SEQ ID NO: 116666 - DNA, 25 bp, Rattus norvegicus
agaggtccctgtgctgtccgcctag

SEQ ID NO: 116667 - DNA, 25 bp, Rattus norvegicus
agaggtccctgtgttcattaggtaa

SEQ ID NO: 116668 - DNA, 25 bp, Rattus norvegicus
agaggtccctgtttctggaggtgca

SEQ ID NO: 116669 - DNA, 25 bp, Rattus norvegicus
agaggtcccttacctgtatttggtt

SEQ ID NO: 116670 - DNA, 25 bp, Rattus norvegicus
agaggtcccttagctgtatttggtt

SEQ ID NO: 116671 - DNA, 25 bp, Rattus norvegicus
agaggtccgaagaccctccagccag

SEQ ID NO: 116672 - DNA, 25 bp, Rattus norvegicus
agaggtccgaagtccctccagccag

SEQ ID NO: 116673 - DNA, 25 bp, Rattus norvegicus
agaggtcctggtaaaacgcactgat

SEQ ID NO: 116674 - DNA, 25 bp, Rattus norvegicus
agaggtcctggttaaacgcactgat

SEQ ID NO: 116675 - DNA, 25 bp, Rattus norvegicus
agaggtccttaacagccatgaagtt

SEQ ID NO: 116676 - DNA, 25 bp, Rattus norvegicus
agaggtccttaagagccatgaagtt

SEQ ID NO: 116677 - DNA, 25 bp, Rattus norvegicus
agaggtccttggctttgcccagctc

SEQ ID NO: 116678 - DNA, 25 bp, Rattus norvegicus
agaggtccttgggtttgcccagctc

SEQ ID NO: 116679 - DNA, 25 bp, Rattus norvegicus
agaggtcctttcattcttgcattat

SEQ ID NO: 116680 - DNA, 25 bp, Rattus norvegicus
agaggtcctttctttcttgcattat

SEQ ID NO: 116681 - DNA, 25 bp, Rattus norvegicus
agaggtcgtggtacttttcaacgcg

SEQ ID NO: 116682 - DNA, 25 bp, Rattus norvegicus
agaggtcgtggttcttttcaacgcg

SEQ ID NO: 116683 - DNA, 25 bp, Rattus norvegicus
agaggtctagtaatgttatccatta

SEQ ID NO: 116684 - DNA, 25 bp, Rattus norvegicus
agaggtctagtattgttatccatta

SEQ ID NO: 116685 - DNA, 25 bp, Rattus norvegicus
agaggtctatgaagtgcctcccaac

SEQ ID NO: 116686 - DNA, 25 bp, Rattus norvegicus
agaggtctatgatgtgcctcccaac

SEQ ID NO: 116687 - DNA, 25 bp, Rattus norvegicus
agaggtctatggcttatggcttcta

SEQ ID NO: 116688 - DNA, 25 bp, Rattus norvegicus
agaggtctatgggttatggcttcta

SEQ ID NO: 116689 - DNA, 25 bp, Rattus norvegicus
agaggtctctctacagatagccctg

SEQ ID NO: 116690 - DNA, 25 bp, Rattus norvegicus
agaggtctctcttcagatagccctg

SEQ ID NO: 116691 - DNA, 25 bp, Rattus norvegicus
agaggtctctgaaactggcgttaga

SEQ ID NO: 116692 - DNA, 25 bp, Rattus norvegicus
agaggtctctgaactgcccagtgtg

SEQ ID NO: 116693 - DNA, 25 bp, Rattus norvegicus
agaggtctctgatactggcgttaga

SEQ ID NO: 116694 - DNA, 25 bp, Rattus norvegicus
agaggtctctgatctgcccagtgtg

SEQ ID NO: 116695 - DNA, 25 bp, Rattus norvegicus
agaggtctgctcagtttttacttca

SEQ ID NO: 116696 - DNA, 25 bp, Rattus norvegicus
agaggtctgctctgtttttacttca

SEQ ID NO: 116697 - DNA, 25 bp, Rattus norvegicus
agaggtctgctgctcctaggactcc

SEQ ID NO: 116698 - DNA, 25 bp, Rattus norvegicus
agaggtctgctgctgtctttaccaa

SEQ ID NO: 116699 - DNA, 25 bp, Rattus norvegicus
agaggtctgctggtcctaggactcc

SEQ ID NO: 116700 - DNA, 25 bp, Rattus norvegicus
agaggtctgctggtgtctttaccaa

SEQ ID NO: 116701 - DNA, 25 bp, Rattus norvegicus
agaggtctggtcaattcccatgctg

SEQ ID NO: 116702 - DNA, 25 bp, Rattus norvegicus
agaggtctggtctattcccatgctg

SEQ ID NO: 116703 - DNA, 25 bp, Rattus norvegicus
agaggtctgtcaaaccatccatcct

SEQ ID NO: 116704 - DNA, 25 bp, Rattus norvegicus
agaggtctgtcataccatccatcct

SEQ ID NO: 116705 - DNA, 25 bp, Rattus norvegicus
agaggtctgtgaataagctgcagca

SEQ ID NO: 116706 - DNA, 25 bp, Rattus norvegicus
agaggtctgtgattaagctgcagca

SEQ ID NO: 116707 - DNA, 25 bp, Rattus norvegicus
agaggtctgtgtcccattgcccagg

SEQ ID NO: 116708 - DNA, 25 bp, Rattus norvegicus
agaggtctgtgtgccattgcccagg

SEQ ID NO: 116709 - DNA, 25 bp, Rattus norvegicus
agaggtcttcatacctatcaccagt

SEQ ID NO: 116710 - DNA, 25 bp, Rattus norvegicus
agaggtcttcattcctatcaccagt

SEQ ID NO: 116711 - DNA, 25 bp, Rattus norvegicus
agaggtcttgagactcttcaccaca

SEQ ID NO: 116712 - DNA, 25 bp, Rattus norvegicus
agaggtcttgagtctcttcaccaca

SEQ ID NO: 116713 - DNA, 25 bp, Rattus norvegicus
agaggtcttgccaatcagtcactga

SEQ ID NO: 116714 - DNA, 25 bp, Rattus norvegicus
agaggtcttgcctatcagtcactga

SEQ ID NO: 116715 - DNA, 25 bp, Rattus norvegicus
agaggtcttgtgcataaaaactgtg

SEQ ID NO: 116716 - DNA, 25 bp, Rattus norvegicus
agaggtcttgtggataaaaactgtg

SEQ ID NO: 116717 - DNA, 25 bp, Rattus norvegicus
agaggtctttgcataatgagccaat

SEQ ID NO: 116718 - DNA, 25 bp, Rattus norvegicus
agaggtctttgcttaatgagccaat

SEQ ID NO: 116719 - DNA, 25 bp, Rattus norvegicus
agaggtctttggctctagtcattcc

SEQ ID NO: 116720 - DNA, 25 bp, Rattus norvegicus
agaggtctttgggtctagtcattcc

SEQ ID NO: 116721 - DNA, 25 bp, Rattus norvegicus
agaggtgaaaacacccacgctgttt

SEQ ID NO: 116722 - DNA, 25 bp, Rattus norvegicus
agaggtgaaaactcccacgctgttt

SEQ ID NO: 116723 - DNA, 25 bp, Rattus norvegicus
agaggtgaacccctaagtgctgtcc

SEQ ID NO: 116724 - DNA, 25 bp, Rattus norvegicus
agaggtgaacccgtaagtgctgtcc

SEQ ID NO: 116725 - DNA, 25 bp, Rattus norvegicus
agaggtgaccagatcccgggcagct

SEQ ID NO: 116726 - DNA, 25 bp, Rattus norvegicus
agaggtgaccagttcccgggcagct

SEQ ID NO: 116727 - DNA, 25 bp, Rattus norvegicus
agaggtgacccgaggttcatgactc

SEQ ID NO: 116728 - DNA, 25 bp, Rattus norvegicus
agaggtgacccgtggttcatgactc

SEQ ID NO: 116729 - DNA, 25 bp, Rattus norvegicus
agaggtgagagtaggtccttgcaaa

SEQ ID NO: 116730 - DNA, 25 bp, Rattus norvegicus
agaggtgagagttggtccttgcaaa

SEQ ID NO: 116731 - DNA, 25 bp, Rattus norvegicus
agaggtgagtccagcctgctcaggc

SEQ ID NO: 116732 - DNA, 25 bp, Rattus norvegicus
agaggtgagtcctgcctgctcaggc

SEQ ID NO: 116733 - DNA, 25 bp, Rattus norvegicus
agaggtgatctgctgcctatgtcta

SEQ ID NO: 116734 - DNA, 25 bp, Rattus norvegicus
agaggtgatctggtgcctatgtcta

SEQ ID NO: 116735 - DNA, 25 bp, Rattus norvegicus
agaggtgatcttagccatggacgaa

SEQ ID NO: 116736 - DNA, 25 bp, Rattus norvegicus
agaggtgatctttgccatggacgaa

SEQ ID NO: 116737 - DNA, 25 bp, Rattus norvegicus
agaggtgatgtcagcaggctccacc

SEQ ID NO: 116738 - DNA, 25 bp, Rattus norvegicus
agaggtgatgtctgcaggctccacc

SEQ ID NO: 116739 - DNA, 25 bp, Rattus norvegicus
agaggtgattccctattcccagaat

SEQ ID NO: 116740 - DNA, 25 bp, Rattus norvegicus
agaggtgattccgtattcccagaat

SEQ ID NO: 116741 - DNA, 25 bp, Rattus norvegicus
agaggtgatttcagtaggctcctga

SEQ ID NO: 116742 - DNA, 25 bp, Rattus norvegicus
agaggtgatttctgtaggctcctga

SEQ ID NO: 116743 - DNA, 25 bp, Rattus norvegicus
agaggtgcaactccggaggccaaac

SEQ ID NO: 116744 - DNA, 25 bp, Rattus norvegicus
agaggtgcaactgcggaggccaaac

SEQ ID NO: 116745 - DNA, 25 bp, Rattus norvegicus
agaggtgcacatatccagcatgccc

SEQ ID NO: 116746 - DNA, 25 bp, Rattus norvegicus
agaggtgcacatttccagcatgccc

SEQ ID NO: 116747 - DNA, 25 bp, Rattus norvegicus
agaggtgcattacgctgtcatcaag

SEQ ID NO: 116748 - DNA, 25 bp, Rattus norvegicus
agaggtgcattaggctgtcatcaag

SEQ ID NO: 116749 - DNA, 25 bp, Rattus norvegicus
agaggtgcatttagctgctccatca

SEQ ID NO: 116750 - DNA, 25 bp, Rattus norvegicus
agaggtgcattttgctgctccatca

SEQ ID NO: 116751 - DNA, 25 bp, Rattus norvegicus
agaggtgccagtccggattcgaata

SEQ ID NO: 116752 - DNA, 25 bp, Rattus norvegicus
agaggtgccagtgcggattcgaata

SEQ ID NO: 116753 - DNA, 25 bp, Rattus norvegicus
agaggtgcccacagccttggtggaa

SEQ ID NO: 116754 - DNA, 25 bp, Rattus norvegicus
agaggtgcccactgccttggtggaa

SEQ ID NO: 116755 - DNA, 25 bp, Rattus norvegicus
agaggtgcccagacaaggccaatct

SEQ ID NO: 116756 - DNA, 25 bp, Rattus norvegicus
agaggtgcccagtcaaggccaatct

SEQ ID NO: 116757 - DNA, 25 bp, Rattus norvegicus
agaggtgcccctacttctgtgtggg

SEQ ID NO: 116758 - DNA, 25 bp, Rattus norvegicus
agaggtgccccttcttctgtgtggg

SEQ ID NO: 116759 - DNA, 25 bp, Rattus norvegicus
agaggtgccctgaagcagaatttta

SEQ ID NO: 116760 - DNA, 25 bp, Rattus norvegicus
agaggtgccctgtagcagaatttta

SEQ ID NO: 116761 - DNA, 25 bp, Rattus norvegicus
agaggtgcccttaccaggagacttt

SEQ ID NO: 116762 - DNA, 25 bp, Rattus norvegicus
agaggtgccctttccaggagacttt

SEQ ID NO: 116763 - DNA, 25 bp, Rattus norvegicus
agaggtgcctccaatgtgagtccag

SEQ ID NO: 116764 - DNA, 25 bp, Rattus norvegicus
agaggtgcctcctatgtgagtccag

SEQ ID NO: 116765 - DNA, 25 bp, Rattus norvegicus
agaggtgcctctagggcccttagga

SEQ ID NO: 116766 - DNA, 25 bp, Rattus norvegicus
agaggtgcctcttgggcccttagga

SEQ ID NO: 116767 - DNA, 25 bp, Rattus norvegicus
agaggtgcctttaactcagccgtta

SEQ ID NO: 116768 - DNA, 25 bp, Rattus norvegicus
agaggtgcctttagtatccccaaat

SEQ ID NO: 116769 - DNA, 25 bp, Rattus norvegicus
agaggtgccttttactcagccgtta

SEQ ID NO: 116770 - DNA, 25 bp, Rattus norvegicus
agaggtgccttttgtatccccaaat

SEQ ID NO: 116771 - DNA, 25 bp, Rattus norvegicus
agaggtgcggccaccctgagtcaca

SEQ ID NO: 116772 - DNA, 25 bp, Rattus norvegicus
agaggtgcggcctccctgagtcaca

SEQ ID NO: 116773 - DNA, 25 bp, Rattus norvegicus
agaggtgctacacaacgaagagtgc

SEQ ID NO: 116774 - DNA, 25 bp, Rattus norvegicus
agaggtgctacagaacgaagagtgc

SEQ ID NO: 116775 - DNA, 25 bp, Rattus norvegicus
agaggtgctcccagtttgtaacagt

SEQ ID NO: 116776 - DNA, 25 bp, Rattus norvegicus
agaggtgctccctgtttgtaacagt

SEQ ID NO: 116777 - DNA, 25 bp, Rattus norvegicus
agaggtgctgaacaccgccctcatc

SEQ ID NO: 116778 - DNA, 25 bp, Rattus norvegicus
agaggtgctgaagaccgccctcatc

SEQ ID NO: 116779 - DNA, 25 bp, Rattus norvegicus
agaggtgctgacagggatttcttcc

SEQ ID NO: 116780 - DNA, 25 bp, Rattus norvegicus
agaggtgctgactgggatttcttcc

SEQ ID NO: 116781 - DNA, 25 bp, Rattus norvegicus
agaggtgctgcccagttacatgtgt

SEQ ID NO: 116782 - DNA, 25 bp, Rattus norvegicus
agaggtgctgccgagttacatgtgt

SEQ ID NO: 116783 - DNA, 25 bp, Rattus norvegicus
agaggtgctggactaacttgctccc

SEQ ID NO: 116784 - DNA, 25 bp, Rattus norvegicus
agaggtgctggagtaacttgctccc

SEQ ID NO: 116785 - DNA, 25 bp, Rattus norvegicus
agaggtgctgggacttcttccctgc

SEQ ID NO: 116786 - DNA, 25 bp, Rattus norvegicus
agaggtgctgggtcttcttccctgc

SEQ ID NO: 116787 - DNA, 25 bp, Rattus norvegicus
agaggtgctggtcctcatattagcc

SEQ ID NO: 116788 - DNA, 25 bp, Rattus norvegicus
agaggtgctggtgctcatattagcc

SEQ ID NO: 116789 - DNA, 25 bp, Rattus norvegicus
agaggtgctgtgaatcaccacctgg

SEQ ID NO: 116790 - DNA, 25 bp, Rattus norvegicus
agaggtgctgtgtatcaccacctgg

SEQ ID NO: 116791 - DNA, 25 bp, Rattus norvegicus
agaggtggaaccaccatgtatccca

SEQ ID NO: 116792 - DNA, 25 bp, Rattus norvegicus
agaggtggaacctccatgtatccca

SEQ ID NO: 116793 - DNA, 25 bp, Rattus norvegicus
agaggtggagttcctctaagccttc

SEQ ID NO: 116794 - DNA, 25 bp, Rattus norvegicus
agaggtggagttgctctaagccttc

SEQ ID NO: 116795 - DNA, 25 bp, Rattus norvegicus
agaggtggatccaaccactgtggaa

SEQ ID NO: 116796 - DNA, 25 bp, Rattus norvegicus
agaggtggatcctaccactgtggaa

SEQ ID NO: 116797 - DNA, 25 bp, Rattus norvegicus
agaggtggcaccaggtagccttcac

SEQ ID NO: 116798 - DNA, 25 bp, Rattus norvegicus
agaggtggcacctggtagccttcac

SEQ ID NO: 116799 - DNA, 25 bp, Rattus norvegicus
agaggtggccctagtttacagtgag

SEQ ID NO: 116800 - DNA, 25 bp, Rattus norvegicus
agaggtggcccttgtttacagtgag

SEQ ID NO: 116801 - DNA, 25 bp, Rattus norvegicus
agaggtggcctcaggtcgtagctct

SEQ ID NO: 116802 - DNA, 25 bp, Rattus norvegicus
agaggtggcctctggtcgtagctct

SEQ ID NO: 116803 - DNA, 25 bp, Rattus norvegicus
agaggtggcctgagtcatgtgccct

SEQ ID NO: 116804 - DNA, 25 bp, Rattus norvegicus
agaggtggcctgtgtcatgtgccct

SEQ ID NO: 116805 - DNA, 25 bp, Rattus norvegicus
agaggtggcttcacaatcggcttta

SEQ ID NO: 116806 - DNA, 25 bp, Rattus norvegicus
agaggtggcttctcaatcggcttta

SEQ ID NO: 116807 - DNA, 25 bp, Rattus norvegicus
agaggtggcttgatcaggtgctaca

SEQ ID NO: 116808 - DNA, 25 bp, Rattus norvegicus
agaggtggcttgttcaggtgctaca

SEQ ID NO: 116809 - DNA, 25 bp, Rattus norvegicus
agaggtgggattcttgttccccaga

SEQ ID NO: 116810 - DNA, 25 bp, Rattus norvegicus
agaggtgggattgttgttccccaga

SEQ ID NO: 116811 - DNA, 25 bp, Rattus norvegicus
agaggtggtaataccctgacaggca

SEQ ID NO: 116812 - DNA, 25 bp, Rattus norvegicus
agaggtggtaattccctgacaggca

SEQ ID NO: 116813 - DNA, 25 bp, Rattus norvegicus
agaggtggtcacaagccactgtctc

SEQ ID NO: 116814 - DNA, 25 bp, Rattus norvegicus
agaggtggtcactagccactgtctc

SEQ ID NO: 116815 - DNA, 25 bp, Rattus norvegicus
agaggtggtcgtatactccagcgca

SEQ ID NO: 116816 - DNA, 25 bp, Rattus norvegicus
agaggtggtcgtttactccagcgca

SEQ ID NO: 116817 - DNA, 25 bp, Rattus norvegicus
agaggtggtctcagctgccagttat

SEQ ID NO: 116818 - DNA, 25 bp, Rattus norvegicus
agaggtggtctctgctgccagttat

SEQ ID NO: 116819 - DNA, 25 bp, Rattus norvegicus
agaggtgtaataactgcagcagttc

SEQ ID NO: 116820 - DNA, 25 bp, Rattus norvegicus
agaggtgtaatatctgcagcagttc

SEQ ID NO: 116821 - DNA, 25 bp, Rattus norvegicus
agaggtgtacatctgtgcctttctt

SEQ ID NO: 116822 - DNA, 25 bp, Rattus norvegicus
agaggtgtacatgtgtgcctttctt

SEQ ID NO: 116823 - DNA, 25 bp, Rattus norvegicus
agaggtgtaccaccaacagcagtat

SEQ ID NO: 116824 - DNA, 25 bp, Rattus norvegicus
agaggtgtaccagcaacagcagtat

SEQ ID NO: 116825 - DNA, 25 bp, Rattus norvegicus
agaggtgtcaagacgtagccatctt

SEQ ID NO: 116826 - DNA, 25 bp, Rattus norvegicus
agaggtgtcaagtcgtagccatctt

SEQ ID NO: 116827 - DNA, 25 bp, Rattus norvegicus
agaggtgtccccaagttgattttat

SEQ ID NO: 116828 - DNA, 25 bp, Rattus norvegicus
agaggtgtcccccaaagagccatga

SEQ ID NO: 116829 - DNA, 25 bp, Rattus norvegicus
agaggtgtccccgaaagagccatga

SEQ ID NO: 116830 - DNA, 25 bp, Rattus norvegicus
agaggtgtcccctagttgattttat

SEQ ID NO: 116831 - DNA, 25 bp, Rattus norvegicus
agaggtgtcgcacttacgtgtacga

SEQ ID NO: 116832 - DNA, 25 bp, Rattus norvegicus
agaggtgtcgcagttacgtgtacga

SEQ ID NO: 116833 - DNA, 25 bp, Rattus norvegicus
agaggtgtgagtcccacgccggact

SEQ ID NO: 116834 - DNA, 25 bp, Rattus norvegicus
agaggtgtgagtgccacgccggact

SEQ ID NO: 116835 - DNA, 25 bp, Rattus norvegicus
agaggtgtgtctagttcccagcaga

SEQ ID NO: 116836 - DNA, 25 bp, Rattus norvegicus
agaggtgtgtcttgttcccagcaga

SEQ ID NO: 116837 - DNA, 25 bp, Rattus norvegicus
agaggtgttactagagccttcttgt

SEQ ID NO: 116838 - DNA, 25 bp, Rattus norvegicus
agaggtgttacttgagccttcttgt

SEQ ID NO: 116839 - DNA, 25 bp, Rattus norvegicus
agaggtgttattatcttaattcatt

SEQ ID NO: 116840 - DNA, 25 bp, Rattus norvegicus
agaggtgttattttcttaattcatt

SEQ ID NO: 116841 - DNA, 25 bp, Rattus norvegicus
agaggtgttgagaattatgtttttt

SEQ ID NO: 116842 - DNA, 25 bp, Rattus norvegicus
agaggtgttgagtattatgtttttt

SEQ ID NO: 116843 - DNA, 25 bp, Rattus norvegicus
agaggttacagcaaccttctttcca

SEQ ID NO: 116844 - DNA, 25 bp, Rattus norvegicus
agaggttacagctaccttctttcca

SEQ ID NO: 116845 - DNA, 25 bp, Rattus norvegicus
agaggttacctcacagtgcgattct

SEQ ID NO: 116846 - DNA, 25 bp, Rattus norvegicus
agaggttacctcagaatgcccaaga

SEQ ID NO: 116847 - DNA, 25 bp, Rattus norvegicus
agaggttacctctcagtgcgattct

SEQ ID NO: 116848 - DNA, 25 bp, Rattus norvegicus
agaggttacctctgaatgcccaaga

SEQ ID NO: 116849 - DNA, 25 bp, Rattus norvegicus
agaggttagcacacacaggagggta

SEQ ID NO: 116850 - DNA, 25 bp, Rattus norvegicus
agaggttagcactcacaggagggta

SEQ ID NO: 116851 - DNA, 25 bp, Rattus norvegicus
agaggttatcgccagatccaggaag

SEQ ID NO: 116852 - DNA, 25 bp, Rattus norvegicus
agaggttatcgcgagatccaggaag

SEQ ID NO: 116853 - DNA, 25 bp, Rattus norvegicus
agaggttatttgatctcactaccaa

SEQ ID NO: 116854 - DNA, 25 bp, Rattus norvegicus
agaggttatttgttctcactaccaa

SEQ ID NO: 116855 - DNA, 25 bp, Rattus norvegicus
agaggttcaatcaggccactgttat

SEQ ID NO: 116856 - DNA, 25 bp, Rattus norvegicus
agaggttcaatctggccactgttat

SEQ ID NO: 116857 - DNA, 25 bp, Rattus norvegicus
agaggttccaccagaagtcagacat

SEQ ID NO: 116858 - DNA, 25 bp, Rattus norvegicus
agaggttccaccagtgtgctggcag

SEQ ID NO: 116859 - DNA, 25 bp, Rattus norvegicus
agaggttccacctgaagtcagacat

SEQ ID NO: 116860 - DNA, 25 bp, Rattus norvegicus
agaggttccacctgtgtgctggcag

SEQ ID NO: 116861 - DNA, 25 bp, Rattus norvegicus
agaggttctgacaggtttgtgcaca

SEQ ID NO: 116862 - DNA, 25 bp, Rattus norvegicus
agaggttctgactggtttgtgcaca

SEQ ID NO: 116863 - DNA, 25 bp, Rattus norvegicus
agaggttcttccaacttctttacag

SEQ ID NO: 116864 - DNA, 25 bp, Rattus norvegicus
agaggttcttcctacttctttacag

SEQ ID NO: 116865 - DNA, 25 bp, Rattus norvegicus
agaggttgatcgcagccattagcaa

SEQ ID NO: 116866 - DNA, 25 bp, Rattus norvegicus
agaggttgatcggagccattagcaa

SEQ ID NO: 116867 - DNA, 25 bp, Rattus norvegicus
agaggttgatctatgctggtaagca

SEQ ID NO: 116868 - DNA, 25 bp, Rattus norvegicus
agaggttgatctttgctggtaagca

SEQ ID NO: 116869 - DNA, 25 bp, Rattus norvegicus
agaggttgcagcagaacacggccat

SEQ ID NO: 116870 - DNA, 25 bp, Rattus norvegicus
agaggttgcagctgaacacggccat

SEQ ID NO: 116871 - DNA, 25 bp, Rattus norvegicus
agaggttgccgcagctgctggttac

SEQ ID NO: 116872 - DNA, 25 bp, Rattus norvegicus
agaggttgccgctgctgctggttac

SEQ ID NO: 116873 - DNA, 25 bp, Rattus norvegicus
agaggttgctgacagcccagtaccc

SEQ ID NO: 116874 - DNA, 25 bp, Rattus norvegicus
agaggttgctgagagcccagtaccc

SEQ ID NO: 116875 - DNA, 25 bp, Rattus norvegicus
agaggttgggccagatttccttgtc

SEQ ID NO: 116876 - DNA, 25 bp, Rattus norvegicus
agaggttgggcctgatttccttgtc

SEQ ID NO: 116877 - DNA, 25 bp, Rattus norvegicus
agaggttggtcacttaccgtggcac

SEQ ID NO: 116878 - DNA, 25 bp, Rattus norvegicus
agaggttggtcagttaccgtggcac

SEQ ID NO: 116879 - DNA, 25 bp, Rattus norvegicus
agaggttgtgatactcgctgttccc

SEQ ID NO: 116880 - DNA, 25 bp, Rattus norvegicus
agaggttgtgattctcgctgttccc

SEQ ID NO: 116881 - DNA, 25 bp, Rattus norvegicus
agaggtttaaagctgagcgccaaca

SEQ ID NO: 116882 - DNA, 25 bp, Rattus norvegicus
agaggtttaaaggtgagcgccaaca

SEQ ID NO: 116883 - DNA, 25 bp, Rattus norvegicus
agaggtttaatgagctgcttccgat

SEQ ID NO: 116884 - DNA, 25 bp, Rattus norvegicus
agaggtttaatgtgctgcttccgat

SEQ ID NO: 116885 - DNA, 25 bp, Rattus norvegicus
agaggtttactcacagccagctaac

SEQ ID NO: 116886 - DNA, 25 bp, Rattus norvegicus
agaggtttactctcagccagctaac

SEQ ID NO: 116887 - DNA, 25 bp, Rattus norvegicus
agaggtttccatcttcttgggctac

SEQ ID NO: 116888 - DNA, 25 bp, Rattus norvegicus
agaggtttccatgttcttgggctac

SEQ ID NO: 116889 - DNA, 25 bp, Rattus norvegicus
agaggtttcccaactacaaagtagg

SEQ ID NO: 116890 - DNA, 25 bp, Rattus norvegicus
agaggtttcccatctacaaagtagg

SEQ ID NO: 116891 - DNA, 25 bp, Rattus norvegicus
agaggtttgctcaggtttgtctact

SEQ ID NO: 116892 - DNA, 25 bp, Rattus norvegicus
agaggtttgctctggtttgtctact

SEQ ID NO: 116893 - DNA, 25 bp, Rattus norvegicus
agaggtttggccaagtcagcttccc

SEQ ID NO: 116894 - DNA, 25 bp, Rattus norvegicus
agaggtttggcctagtcagcttccc

SEQ ID NO: 116895 - DNA, 25 bp, Rattus norvegicus
agaggtttgggcatactgctttcaa

SEQ ID NO: 116896 - DNA, 25 bp, Rattus norvegicus
agaggtttgggcttactgctttcaa

SEQ ID NO: 116897 - DNA, 25 bp, Rattus norvegicus
agaggtttgtgtccatcggagcact

SEQ ID NO: 116898 - DNA, 25 bp, Rattus norvegicus
agaggtttgtgtgcatcggagcact

SEQ ID NO: 116899 - DNA, 25 bp, Rattus norvegicus
agaggttttgctcgttgctggcccc

SEQ ID NO: 116900 - DNA, 25 bp, Rattus norvegicus
agaggttttgctggttgctggcccc

SEQ ID NO: 116901 - DNA, 25 bp, Rattus norvegicus
agaggttttggacacttcatttgat

SEQ ID NO: 116902 - DNA, 25 bp, Rattus norvegicus
agaggttttggagacttcatttgat

SEQ ID NO: 116903 - DNA, 25 bp, Rattus norvegicus
agagtaaaacacaggcttgcctcgg

SEQ ID NO: 116904 - DNA, 25 bp, Rattus norvegicus
agagtaaaacactggcttgcctcgg

SEQ ID NO: 116905 - DNA, 25 bp, Rattus norvegicus
agagtaaccttgctgttcaccgaag

SEQ ID NO: 116906 - DNA, 25 bp, Rattus norvegicus
agagtaaccttggtgttcaccgaag

SEQ ID NO: 116907 - DNA, 25 bp, Rattus norvegicus
agagtaactctacagaaaccctgtc

SEQ ID NO: 116908 - DNA, 25 bp, Rattus norvegicus
agagtaactctagagaaaccctgtc

SEQ ID NO: 116909 - DNA, 25 bp, Rattus norvegicus
agagtaactgccatgaccggccagg

SEQ ID NO: 116910 - DNA, 25 bp, Rattus norvegicus
agagtaactgccttgaccggccagg

SEQ ID NO: 116911 - DNA, 25 bp, Rattus norvegicus
agagtaagacttccggcttgcttgc

SEQ ID NO: 116912 - DNA, 25 bp, Rattus norvegicus
agagtaagacttgcggcttgcttgc

SEQ ID NO: 116913 - DNA, 25 bp, Rattus norvegicus
agagtaagaggtctgtacaagcccc

SEQ ID NO: 116914 - DNA, 25 bp, Rattus norvegicus
agagtaagaggtgtgtacaagcccc

SEQ ID NO: 116915 - DNA, 25 bp, Rattus norvegicus
agagtaagagttacccatctcccag

SEQ ID NO: 116916 - DNA, 25 bp, Rattus norvegicus
agagtaagagtttcccatctcccag

SEQ ID NO: 116917 - DNA, 25 bp, Rattus norvegicus
agagtaaggacaacctctcctgagt

SEQ ID NO: 116918 - DNA, 25 bp, Rattus norvegicus
agagtaaggacatcctctcctgagt

SEQ ID NO: 116919 - DNA, 25 bp, Rattus norvegicus
agagtaaggtatagcccctgtgtct

SEQ ID NO: 116920 - DNA, 25 bp, Rattus norvegicus
agagtaaggtattgcccctgtgtct

SEQ ID NO: 116921 - DNA, 25 bp, Rattus norvegicus
agagtaatcctcagacctggagaga

SEQ ID NO: 116922 - DNA, 25 bp, Rattus norvegicus
agagtaatcctctgacctggagaga

SEQ ID NO: 116923 - DNA, 25 bp, Rattus norvegicus
agagtaatctcgctgctgacgctcc

SEQ ID NO: 116924 - DNA, 25 bp, Rattus norvegicus
agagtaatctcggtgctgacgctcc

SEQ ID NO: 116925 - DNA, 25 bp, Rattus norvegicus
agagtaattcttctgtctctcgcta

SEQ ID NO: 116926 - DNA, 25 bp, Rattus norvegicus
agagtaattcttgtgtctctcgcta

SEQ ID NO: 116927 - DNA, 25 bp, Rattus norvegicus
agagtacaagctcatcctgtccaca

SEQ ID NO: 116928 - DNA, 25 bp, Rattus norvegicus
agagtacaagctgatcctgtccaca

SEQ ID NO: 116929 - DNA, 25 bp, Rattus norvegicus
agagtacaatatattcccgtgaaag

SEQ ID NO: 116930 - DNA, 25 bp, Rattus norvegicus
agagtacaatattttcccgtgaaag

SEQ ID NO: 116931 - DNA, 25 bp, Rattus norvegicus
agagtacacactaggcacatggcat

SEQ ID NO: 116932 - DNA, 25 bp, Rattus norvegicus
agagtacacacttggcacatggcat

SEQ ID NO: 116933 - DNA, 25 bp, Rattus norvegicus
agagtacaccctcctctgccaagag

SEQ ID NO: 116934 - DNA, 25 bp, Rattus norvegicus
agagtacaccctgctctgccaagag

SEQ ID NO: 116935 - DNA, 25 bp, Rattus norvegicus
agagtacactgaccccaaggtggtg

SEQ ID NO: 116936 - DNA, 25 bp, Rattus norvegicus
agagtacactgagcccaaggtggtg

SEQ ID NO: 116937 - DNA, 25 bp, Rattus norvegicus
agagtacagctgcagtgacccatct

SEQ ID NO: 116938 - DNA, 25 bp, Rattus norvegicus
agagtacagctggagtgacccatct

SEQ ID NO: 116939 - DNA, 25 bp, Rattus norvegicus
agagtacagcttcccacaggttgaa

SEQ ID NO: 116940 - DNA, 25 bp, Rattus norvegicus
agagtacagcttgccacaggttgaa

SEQ ID NO: 116941 - DNA, 25 bp, Rattus norvegicus
agagtacagggccagcagcaccagt

SEQ ID NO: 116942 - DNA, 25 bp, Rattus norvegicus
agagtacagggcgagcagcaccagt

SEQ ID NO: 116943 - DNA, 25 bp, Rattus norvegicus
agagtacagtgactgaacccagcct

SEQ ID NO: 116944 - DNA, 25 bp, Rattus norvegicus
agagtacagtgagtgaacccagcct

SEQ ID NO: 116945 - DNA, 25 bp, Rattus norvegicus
agagtaccaagacctgtgcacagca

SEQ ID NO: 116946 - DNA, 25 bp, Rattus norvegicus
agagtaccaagagctgtgcacagca

SEQ ID NO: 116947 - DNA, 25 bp, Rattus norvegicus
agagtaccaccacaaaatgccgaag

SEQ ID NO: 116948 - DNA, 25 bp, Rattus norvegicus
agagtaccaccagaaaatgccgaag

SEQ ID NO: 116949 - DNA, 25 bp, Rattus norvegicus
agagtaccacccatgatgcgtgcag

SEQ ID NO: 116950 - DNA, 25 bp, Rattus norvegicus
agagtaccacccttgatgcgtgcag

SEQ ID NO: 116951 - DNA, 25 bp, Rattus norvegicus
agagtaccagcaccctgaaggccat

SEQ ID NO: 116952 - DNA, 25 bp, Rattus norvegicus
agagtaccagcagcctgaaggccat

SEQ ID NO: 116953 - DNA, 25 bp, Rattus norvegicus
agagtaccagttcccttattatgac

SEQ ID NO: 116954 - DNA, 25 bp, Rattus norvegicus
agagtaccagttgccttattatgac

SEQ ID NO: 116955 - DNA, 25 bp, Rattus norvegicus
agagtaccatacagcctccaaggca

SEQ ID NO: 116956 - DNA, 25 bp, Rattus norvegicus
agagtaccatactgcctccaaggca

SEQ ID NO: 116957 - DNA, 25 bp, Rattus norvegicus
agagtacccaaaaaggagtctgcca

SEQ ID NO: 116958 - DNA, 25 bp, Rattus norvegicus
agagtacccaaataggagtctgcca

SEQ ID NO: 116959 - DNA, 25 bp, Rattus norvegicus
agagtacccagcagcgcctgtttat

SEQ ID NO: 116960 - DNA, 25 bp, Rattus norvegicus
agagtacccagctgcgcctgtttat

SEQ ID NO: 116961 - DNA, 25 bp, Rattus norvegicus
agagtaccgctcacttcagggactt

SEQ ID NO: 116962 - DNA, 25 bp, Rattus norvegicus
agagtaccgctctcttcagggactt

SEQ ID NO: 116963 - DNA, 25 bp, Rattus norvegicus
agagtaccgcttccatgccgtgaat

SEQ ID NO: 116964 - DNA, 25 bp, Rattus norvegicus
agagtaccgcttccccttccagagg

SEQ ID NO: 116965 - DNA, 25 bp, Rattus norvegicus
agagtaccgcttgcatgccgtgaat

SEQ ID NO: 116966 - DNA, 25 bp, Rattus norvegicus
agagtaccgcttgcccttccagagg

SEQ ID NO: 116967 - DNA, 25 bp, Rattus norvegicus
agagtaccgtcaccttctggttgaa

SEQ ID NO: 116968 - DNA, 25 bp, Rattus norvegicus
agagtaccgtcagcttctggttgaa

SEQ ID NO: 116969 - DNA, 25 bp, Rattus norvegicus
agagtacctctcatctaatgggctt

SEQ ID NO: 116970 - DNA, 25 bp, Rattus norvegicus
agagtacctctcttctaatgggctt

SEQ ID NO: 116971 - DNA, 25 bp, Rattus norvegicus
agagtacctgacctctctacaaact

SEQ ID NO: 116972 - DNA, 25 bp, Rattus norvegicus
agagtacctgacgtctctacaaact

SEQ ID NO: 116973 - DNA, 25 bp, Rattus norvegicus
agagtaccttgcatatacctgctga

SEQ ID NO: 116974 - DNA, 25 bp, Rattus norvegicus
agagtaccttgcttatacctgctga

SEQ ID NO: 116975 - DNA, 25 bp, Rattus norvegicus
agagtactaactcctcttacagaag

SEQ ID NO: 116976 - DNA, 25 bp, Rattus norvegicus
agagtactaactgctcttacagaag

SEQ ID NO: 116977 - DNA, 25 bp, Rattus norvegicus
agagtactacctatattagctcctt

SEQ ID NO: 116978 - DNA, 25 bp, Rattus norvegicus
agagtactacctttattagctcctt

SEQ ID NO: 116979 - DNA, 25 bp, Rattus norvegicus
agagtactactcagccagcaatggg

SEQ ID NO: 116980 - DNA, 25 bp, Rattus norvegicus
agagtactactctgccagcaatggg

SEQ ID NO: 116981 - DNA, 25 bp, Rattus norvegicus
agagtactcagtacacctgcaggct

SEQ ID NO: 116982 - DNA, 25 bp, Rattus norvegicus
agagtactcagttcacctgcaggct

SEQ ID NO: 116983 - DNA, 25 bp, Rattus norvegicus
agagtactcccgaatagtgcctctg

SEQ ID NO: 116984 - DNA, 25 bp, Rattus norvegicus
agagtactcccgtatagtgcctctg

SEQ ID NO: 116985 - DNA, 25 bp, Rattus norvegicus
agagtactccgtaattccaacacac

SEQ ID NO: 116986 - DNA, 25 bp, Rattus norvegicus
agagtactccgttattccaacacac

SEQ ID NO: 116987 - DNA, 25 bp, Rattus norvegicus
agagtactcctcagcacagtatgta

SEQ ID NO: 116988 - DNA, 25 bp, Rattus norvegicus
agagtactcctctgcacagtatgta

SEQ ID NO: 116989 - DNA, 25 bp, Rattus norvegicus
agagtactcttaccgaccccacgtg

SEQ ID NO: 116990 - DNA, 25 bp, Rattus norvegicus
agagtactcttagcgaccccacgtg

SEQ ID NO: 116991 - DNA, 25 bp, Rattus norvegicus
agagtactgaggaagccctcaccac

SEQ ID NO: 116992 - DNA, 25 bp, Rattus norvegicus
agagtactgaggtagccctcaccac

SEQ ID NO: 116993 - DNA, 25 bp, Rattus norvegicus
agagtactggccaagtgtgcatgaa

SEQ ID NO: 116994 - DNA, 25 bp, Rattus norvegicus
agagtactggcctagtgtgcatgaa

SEQ ID NO: 116995 - DNA, 25 bp, Rattus norvegicus
agagtactggcgactgcttcgcaaa

SEQ ID NO: 116996 - DNA, 25 bp, Rattus norvegicus
agagtactggcgtctgcttcgcaaa

SEQ ID NO: 116997 - DNA, 25 bp, Rattus norvegicus
agagtactgggcatcttggtaccta

SEQ ID NO: 116998 - DNA, 25 bp, Rattus norvegicus
agagtactgggcttcttggtaccta

SEQ ID NO: 116999 - DNA, 25 bp, Rattus norvegicus
agagtactggtcagtgtcggccaag

SEQ ID NO: 117000 - DNA, 25 bp, Rattus norvegicus
agagtactggtctgtgtcggccaag

SEQ ID NO: 117001 - DNA, 25 bp, Rattus norvegicus
agagtactggtgctatcacctccat

SEQ ID NO: 117002 - DNA, 25 bp, Rattus norvegicus
agagtactggtggtatcacctccat

SEQ ID NO: 117003 - DNA, 25 bp, Rattus norvegicus
agagtacttcctcgaggcctgcgct

SEQ ID NO: 117004 - DNA, 25 bp, Rattus norvegicus
agagtacttcctggaggcctgcgct

SEQ ID NO: 117005 - DNA, 25 bp, Rattus norvegicus
agagtacttgccagggatatataag

SEQ ID NO: 117006 - DNA, 25 bp, Rattus norvegicus
agagtacttgcctgggatatataag

SEQ ID NO: 117007 - DNA, 25 bp, Rattus norvegicus
agagtagaaacgagactgtctttta

SEQ ID NO: 117008 - DNA, 25 bp, Rattus norvegicus
agagtagaaacgtgactgtctttta

SEQ ID NO: 117009 - DNA, 25 bp, Rattus norvegicus
agagtagaccggatgtgttctcacc

SEQ ID NO: 117010 - DNA, 25 bp, Rattus norvegicus
agagtagaccggttgtgttctcacc

SEQ ID NO: 117011 - DNA, 25 bp, Rattus norvegicus
agagtagacctcaaatcctgcttgg

SEQ ID NO: 117012 - DNA, 25 bp, Rattus norvegicus
agagtagacctctaatcctgcttgg

SEQ ID NO: 117013 - DNA, 25 bp, Rattus norvegicus
agagtagacgagctctctgctcatc

SEQ ID NO: 117014 - DNA, 25 bp, Rattus norvegicus
agagtagacgaggtctctgctcatc

SEQ ID NO: 117015 - DNA, 25 bp, Rattus norvegicus
agagtagaggccatgtccttgggca

SEQ ID NO: 117016 - DNA, 25 bp, Rattus norvegicus
agagtagaggccttgtccttgggca

SEQ ID NO: 117017 - DNA, 25 bp, Rattus norvegicus
agagtagatcttctgctacccaacc

SEQ ID NO: 117018 - DNA, 25 bp, Rattus norvegicus
agagtagatcttgtgctacccaacc

SEQ ID NO: 117019 - DNA, 25 bp, Rattus norvegicus
agagtagcaacaagagggccaccct

SEQ ID NO: 117020 - DNA, 25 bp, Rattus norvegicus
agagtagcaacatgagggccaccct

SEQ ID NO: 117021 - DNA, 25 bp, Rattus norvegicus
agagtagcacaacccaaggacctag

SEQ ID NO: 117022 - DNA, 25 bp, Rattus norvegicus
agagtagcacaagccaaggacctag

SEQ ID NO: 117023 - DNA, 25 bp, Rattus norvegicus
agagtagcacggctatccagctgca

SEQ ID NO: 117024 - DNA, 25 bp, Rattus norvegicus
agagtagcacgggtatccagctgca

SEQ ID NO: 117025 - DNA, 25 bp, Rattus norvegicus
agagtagcattcctagctctctctt

SEQ ID NO: 117026 - DNA, 25 bp, Rattus norvegicus
agagtagcattcgtagctctctctt

SEQ ID NO: 117027 - DNA, 25 bp, Rattus norvegicus
agagtagccacacccagttgactat

SEQ ID NO: 117028 - DNA, 25 bp, Rattus norvegicus
agagtagccacagccagttgactat

SEQ ID NO: 117029 - DNA, 25 bp, Rattus norvegicus
agagtagcccaaccaccaagtgtga

SEQ ID NO: 117030 - DNA, 25 bp, Rattus norvegicus
agagtagcccaagcaccaagtgtga

SEQ ID NO: 117031 - DNA, 25 bp, Rattus norvegicus
agagtagcctccaaaggttgcccct

SEQ ID NO: 117032 - DNA, 25 bp, Rattus norvegicus
agagtagcctcctaaggttgcccct

SEQ ID NO: 117033 - DNA, 25 bp, Rattus norvegicus
agagtagcctttcttgtcagtcaga

SEQ ID NO: 117034 - DNA, 25 bp, Rattus norvegicus
agagtagcctttgttgtcagtcaga

SEQ ID NO: 117035 - DNA, 25 bp, Rattus norvegicus
agagtagctaggacacgagcccaga

SEQ ID NO: 117036 - DNA, 25 bp, Rattus norvegicus
agagtagctaggtcacgagcccaga

SEQ ID NO: 117037 - DNA, 25 bp, Rattus norvegicus
agagtagctcaaacttcccatttct

SEQ ID NO: 117038 - DNA, 25 bp, Rattus norvegicus
agagtagctcaatcttcccatttct

SEQ ID NO: 117039 - DNA, 25 bp, Rattus norvegicus
agagtagctcggcaaatccttcctg

SEQ ID NO: 117040 - DNA, 25 bp, Rattus norvegicus
agagtagctcgggaaatccttcctg

SEQ ID NO: 117041 - DNA, 25 bp, Rattus norvegicus
agagtagcttctctctgagccattt

SEQ ID NO: 117042 - DNA, 25 bp, Rattus norvegicus
agagtagcttctgtctgagccattt

SEQ ID NO: 117043 - DNA, 25 bp, Rattus norvegicus
agagtagctttcaactctttcccca

SEQ ID NO: 117044 - DNA, 25 bp, Rattus norvegicus
agagtagctttctactctttcccca

SEQ ID NO: 117045 - DNA, 25 bp, Rattus norvegicus
agagtaggcccaactgccctggttt

SEQ ID NO: 117046 - DNA, 25 bp, Rattus norvegicus
agagtaggcccatctgccctggttt

SEQ ID NO: 117047 - DNA, 25 bp, Rattus norvegicus
agagtaggcctcaatgataacatat

SEQ ID NO: 117048 - DNA, 25 bp, Rattus norvegicus
agagtaggcctctatgataacatat

SEQ ID NO: 117049 - DNA, 25 bp, Rattus norvegicus
agagtaggtaggctcacatttggat

SEQ ID NO: 117050 - DNA, 25 bp, Rattus norvegicus
agagtaggtagggtcacatttggat

SEQ ID NO: 117051 - DNA, 25 bp, Rattus norvegicus
agagtagtaatcagtcttaaccttt

SEQ ID NO: 117052 - DNA, 25 bp, Rattus norvegicus
agagtagtaatctgtcttaaccttt

SEQ ID NO: 117053 - DNA, 25 bp, Rattus norvegicus
agagtagtaccaagagccttctgta

SEQ ID NO: 117054 - DNA, 25 bp, Rattus norvegicus
agagtagtaccatgagccttctgta

SEQ ID NO: 117055 - DNA, 25 bp, Rattus norvegicus
agagtagtactacagccttgctgtg

SEQ ID NO: 117056 - DNA, 25 bp, Rattus norvegicus
agagtagtactagagccttgctgtg

SEQ ID NO: 117057 - DNA, 25 bp, Rattus norvegicus
agagtagtacttacagtctgcatac

SEQ ID NO: 117058 - DNA, 25 bp, Rattus norvegicus
agagtagtactttcagtctgcatac

SEQ ID NO: 117059 - DNA, 25 bp, Rattus norvegicus
agagtagtagctctttttgcccctc

SEQ ID NO: 117060 - DNA, 25 bp, Rattus norvegicus
agagtagtagctgtttttgcccctc

SEQ ID NO: 117061 - DNA, 25 bp, Rattus norvegicus
agagtagtcagtaagctaactcaac

SEQ ID NO: 117062 - DNA, 25 bp, Rattus norvegicus
agagtagtcagttagctaactcaac

SEQ ID NO: 117063 - DNA, 25 bp, Rattus norvegicus
agagtagtcataagctttcaccagc

SEQ ID NO: 117064 - DNA, 25 bp, Rattus norvegicus
agagtagtcatatgctttcaccagc

SEQ ID NO: 117065 - DNA, 25 bp, Rattus norvegicus
agagtagtgattacgatctaggtaa

SEQ ID NO: 117066 - DNA, 25 bp, Rattus norvegicus
agagtagtgatttcgatctaggtaa

SEQ ID NO: 117067 - DNA, 25 bp, Rattus norvegicus
agagtataccccaaagagcaagaag

SEQ ID NO: 117068 - DNA, 25 bp, Rattus norvegicus
agagtatacccctaagagcaagaag

SEQ ID NO: 117069 - DNA, 25 bp, Rattus norvegicus
agagtatatcctcctattccagagg

SEQ ID NO: 117070 - DNA, 25 bp, Rattus norvegicus
agagtatatcctgctattccagagg

SEQ ID NO: 117071 - DNA, 25 bp, Rattus norvegicus
agagtatatcttcaagccgtcctgt

SEQ ID NO: 117072 - DNA, 25 bp, Rattus norvegicus
agagtatatcttgaagccgtcctgt

SEQ ID NO: 117073 - DNA, 25 bp, Rattus norvegicus
agagtatcaccgaatgcagctatgt

SEQ ID NO: 117074 - DNA, 25 bp, Rattus norvegicus
agagtatcaccgtatgcagctatgt

SEQ ID NO: 117075 - DNA, 25 bp, Rattus norvegicus
agagtatcagggactgtctcctaca

SEQ ID NO: 117076 - DNA, 25 bp, Rattus norvegicus
agagtatcagggtctgtctcctaca

SEQ ID NO: 117077 - DNA, 25 bp, Rattus norvegicus
agagtatcatagacccttcttcaga

SEQ ID NO: 117078 - DNA, 25 bp, Rattus norvegicus
agagtatcatagtcccttcttcaga

SEQ ID NO: 117079 - DNA, 25 bp, Rattus norvegicus
agagtatccagtccgcttctcagta

SEQ ID NO: 117080 - DNA, 25 bp, Rattus norvegicus
agagtatccagtgcgcttctcagta

SEQ ID NO: 117081 - DNA, 25 bp, Rattus norvegicus
agagtatccggacgttcaccacctc

SEQ ID NO: 117082 - DNA, 25 bp, Rattus norvegicus
agagtatccggaggttcaccacctc

SEQ ID NO: 117083 - DNA, 25 bp, Rattus norvegicus
agagtatctaacaccctcattcaga

SEQ ID NO: 117084 - DNA, 25 bp, Rattus norvegicus
agagtatctaactccctcattcaga

SEQ ID NO: 117085 - DNA, 25 bp, Rattus norvegicus
agagtatctatgagtgccacaccac

SEQ ID NO: 117086 - DNA, 25 bp, Rattus norvegicus
agagtatctatgtgtgccacaccac

SEQ ID NO: 117087 - DNA, 25 bp, Rattus norvegicus
agagtatgaaaacagccggcccaat

SEQ ID NO: 117088 - DNA, 25 bp, Rattus norvegicus
agagtatgaaaagagccggcccaat

SEQ ID NO: 117089 - DNA, 25 bp, Rattus norvegicus
agagtatgacccactgtccaactat

SEQ ID NO: 117090 - DNA, 25 bp, Rattus norvegicus
agagtatgaccctctgtccaactat

SEQ ID NO: 117091 - DNA, 25 bp, Rattus norvegicus
agagtatgagatacttttccccggc

SEQ ID NO: 117092 - DNA, 25 bp, Rattus norvegicus
agagtatgagattcttttccccggc

SEQ ID NO: 117093 - DNA, 25 bp, Rattus norvegicus
agagtatgatgcagctgcttcctaa

SEQ ID NO: 117094 - DNA, 25 bp, Rattus norvegicus
agagtatgatgcctacacctggcct

SEQ ID NO: 117095 - DNA, 25 bp, Rattus norvegicus
agagtatgatgcgtacacctggcct

SEQ ID NO: 117096 - DNA, 25 bp, Rattus norvegicus
agagtatgatgctgctgcttcctaa

SEQ ID NO: 117097 - DNA, 25 bp, Rattus norvegicus
agagtatggtgaagtatgcccgtac

SEQ ID NO: 117098 - DNA, 25 bp, Rattus norvegicus
agagtatggtgatgtatgcccgtac

SEQ ID NO: 117099 - DNA, 25 bp, Rattus norvegicus
agagtattaactctcttccctcagc

SEQ ID NO: 117100 - DNA, 25 bp, Rattus norvegicus
agagtattaactgtcttccctcagc

SEQ ID NO: 117101 - DNA, 25 bp, Rattus norvegicus
agagtattactgagaagcccgcaac

SEQ ID NO: 117102 - DNA, 25 bp, Rattus norvegicus
agagtattactgtgaagcccgcaac

SEQ ID NO: 117103 - DNA, 25 bp, Rattus norvegicus
agagtattcatcatgggcacccagc

SEQ ID NO: 117104 - DNA, 25 bp, Rattus norvegicus
agagtattcatcttgggcacccagc

SEQ ID NO: 117105 - DNA, 25 bp, Rattus norvegicus
agagtatttcagctgggaggtccct

SEQ ID NO: 117106 - DNA, 25 bp, Rattus norvegicus
agagtatttcaggtgggaggtccct

SEQ ID NO: 117107 - DNA, 25 bp, Rattus norvegicus
agagtatttgacctccatcgggtac

SEQ ID NO: 117108 - DNA, 25 bp, Rattus norvegicus
agagtatttgacgtccatcgggtac

SEQ ID NO: 117109 - DNA, 25 bp, Rattus norvegicus
agagtattttctccatcctgatggg

SEQ ID NO: 117110 - DNA, 25 bp, Rattus norvegicus
agagtattttctgcatcctgatggg

SEQ ID NO: 117111 - DNA, 25 bp, Rattus norvegicus
agagtatttttaagccatctatcct

SEQ ID NO: 117112 - DNA, 25 bp, Rattus norvegicus
agagtatttttatgccatctatcct

SEQ ID NO: 117113 - DNA, 25 bp, Rattus norvegicus
agagtatttttcaaacgcctggact

SEQ ID NO: 117114 - DNA, 25 bp, Rattus norvegicus
agagtatttttctaacgcctggact

SEQ ID NO: 117115 - DNA, 25 bp, Rattus norvegicus
agagtcaaagccagaaacagtgtcc

SEQ ID NO: 117116 - DNA, 25 bp, Rattus norvegicus
agagtcaaagcctgaaacagtgtcc

SEQ ID NO: 117117 - DNA, 25 bp, Rattus norvegicus
agagtcaaatagaagccccaccact

SEQ ID NO: 117118 - DNA, 25 bp, Rattus norvegicus
agagtcaaatagtagccccaccact

SEQ ID NO: 117119 - DNA, 25 bp, Rattus norvegicus
agagtcaaatccaccgagctctgtg

SEQ ID NO: 117120 - DNA, 25 bp, Rattus norvegicus
agagtcaaatcctccgagctctgtg

SEQ ID NO: 117121 - DNA, 25 bp, Rattus norvegicus
agagtcaactgaaaggatacctgca

SEQ ID NO: 117122 - DNA, 25 bp, Rattus norvegicus
agagtcaactgataggatacctgca

SEQ ID NO: 117123 - DNA, 25 bp, Rattus norvegicus
agagtcaagaccaagctgggaccca

SEQ ID NO: 117124 - DNA, 25 bp, Rattus norvegicus
agagtcaagacctagctgggaccca

SEQ ID NO: 117125 - DNA, 25 bp, Rattus norvegicus
agagtcaagaggctcctgctggatc

SEQ ID NO: 117126 - DNA, 25 bp, Rattus norvegicus
agagtcaagagggtcctgctggatc

SEQ ID NO: 117127 - DNA, 25 bp, Rattus norvegicus
agagtcacaaaaccatccctaacaa

SEQ ID NO: 117128 - DNA, 25 bp, Rattus norvegicus
agagtcacaaaagcatccctaacaa

SEQ ID NO: 117129 - DNA, 25 bp, Rattus norvegicus
agagtcacaagaacccatcacatca

SEQ ID NO: 117130 - DNA, 25 bp, Rattus norvegicus
agagtcacaagatcccatcacatca

SEQ ID NO: 117131 - DNA, 25 bp, Rattus norvegicus
agagtcacactgacaccaggacttc

SEQ ID NO: 117132 - DNA, 25 bp, Rattus norvegicus
agagtcacactgtcaccaggacttc

SEQ ID NO: 117133 - DNA, 25 bp, Rattus norvegicus
agagtcacaggaacagcgggcccga

SEQ ID NO: 117134 - DNA, 25 bp, Rattus norvegicus
agagtcacaggatcagcgggcccga

SEQ ID NO: 117135 - DNA, 25 bp, Rattus norvegicus
agagtcacattcagacgtcttccct

SEQ ID NO: 117136 - DNA, 25 bp, Rattus norvegicus
agagtcacattctgacgtcttccct

SEQ ID NO: 117137 - DNA, 25 bp, Rattus norvegicus
agagtcaccatcatctgatgccagt

SEQ ID NO: 117138 - DNA, 25 bp, Rattus norvegicus
agagtcaccatcttctgatgccagt

SEQ ID NO: 117139 - DNA, 25 bp, Rattus norvegicus
agagtcacccggcagatgtcaccca

SEQ ID NO: 117140 - DNA, 25 bp, Rattus norvegicus
agagtcacccgggagatgtcaccca

SEQ ID NO: 117141 - DNA, 25 bp, Rattus norvegicus
agagtcaccgtgcagcctgcaaatt

SEQ ID NO: 117142 - DNA, 25 bp, Rattus norvegicus
agagtcaccgtggagcctgcaaatt

SEQ ID NO: 117143 - DNA, 25 bp, Rattus norvegicus
agagtcactaacctaggctgctggc

SEQ ID NO: 117144 - DNA, 25 bp, Rattus norvegicus
agagtcactaacgtaggctgctggc

SEQ ID NO: 117145 - DNA, 25 bp, Rattus norvegicus
agagtcactgacaacagggcagaac

SEQ ID NO: 117146 - DNA, 25 bp, Rattus norvegicus
agagtcactgactacagggcagaac

SEQ ID NO: 117147 - DNA, 25 bp, Rattus norvegicus
agagtcactgtcaatctgcacattc

SEQ ID NO: 117148 - DNA, 25 bp, Rattus norvegicus
agagtcactgtcacactctgggctt

SEQ ID NO: 117149 - DNA, 25 bp, Rattus norvegicus
agagtcactgtctatctgcacattc

SEQ ID NO: 117150 - DNA, 25 bp, Rattus norvegicus
agagtcactgtctcactctgggctt

SEQ ID NO: 117151 - DNA, 25 bp, Rattus norvegicus
agagtcacttcacacattctggcta

SEQ ID NO: 117152 - DNA, 25 bp, Rattus norvegicus
agagtcacttcagacattctggcta

SEQ ID NO: 117153 - DNA, 25 bp, Rattus norvegicus
agagtcactttgaaaccctgcatat

SEQ ID NO: 117154 - DNA, 25 bp, Rattus norvegicus
agagtcactttgtaaccctgcatat

SEQ ID NO: 117155 - DNA, 25 bp, Rattus norvegicus
agagtcagacccctaggcttggcaa

SEQ ID NO: 117156 - DNA, 25 bp, Rattus norvegicus
agagtcagacccgtaggcttggcaa

SEQ ID NO: 117157 - DNA, 25 bp, Rattus norvegicus
agagtcagagctcatccaggatgct

SEQ ID NO: 117158 - DNA, 25 bp, Rattus norvegicus
agagtcagagctgatccaggatgct

SEQ ID NO: 117159 - DNA, 25 bp, Rattus norvegicus
agagtcagcagaactgtcgccaggc

SEQ ID NO: 117160 - DNA, 25 bp, Rattus norvegicus
agagtcagcagatctgtcgccaggc

SEQ ID NO: 117161 - DNA, 25 bp, Rattus norvegicus
agagtcagcctcaccgttacttgtg

SEQ ID NO: 117162 - DNA, 25 bp, Rattus norvegicus
agagtcagcctctccgttacttgtg

SEQ ID NO: 117163 - DNA, 25 bp, Rattus norvegicus
agagtcagcggtctcctggcatgta

SEQ ID NO: 117164 - DNA, 25 bp, Rattus norvegicus
agagtcagcggtgtcctggcatgta

SEQ ID NO: 117165 - DNA, 25 bp, Rattus norvegicus
agagtcagtgtgaccttcctgggaa

SEQ ID NO: 117166 - DNA, 25 bp, Rattus norvegicus
agagtcagtgtgtccttcctgggaa

SEQ ID NO: 117167 - DNA, 25 bp, Rattus norvegicus
agagtcatccggaggccttgtgata

SEQ ID NO: 117168 - DNA, 25 bp, Rattus norvegicus
agagtcatccggtggccttgtgata

SEQ ID NO: 117169 - DNA, 25 bp, Rattus norvegicus
agagtcatcctcaactgcatagaga

SEQ ID NO: 117170 - DNA, 25 bp, Rattus norvegicus
agagtcatcctctactgcatagaga

SEQ ID NO: 117171 - DNA, 25 bp, Rattus norvegicus
agagtcatctttcggaccgcaggat

SEQ ID NO: 117172 - DNA, 25 bp, Rattus norvegicus
agagtcatctttgggaccgcaggat

SEQ ID NO: 117173 - DNA, 25 bp, Rattus norvegicus
agagtcatgccccagtagattgatg

SEQ ID NO: 117174 - DNA, 25 bp, Rattus norvegicus
agagtcatgcccgagtagattgatg

SEQ ID NO: 117175 - DNA, 25 bp, Rattus norvegicus
agagtcatgcttaagcctgttctca

SEQ ID NO: 117176 - DNA, 25 bp, Rattus norvegicus
agagtcatgctttagcctgttctca

SEQ ID NO: 117177 - DNA, 25 bp, Rattus norvegicus
agagtcatgtttacttcctcacatc

SEQ ID NO: 117178 - DNA, 25 bp, Rattus norvegicus
agagtcatgttttcttcctcacatc

SEQ ID NO: 117179 - DNA, 25 bp, Rattus norvegicus
agagtcattattaccaaggctcccc

SEQ ID NO: 117180 - DNA, 25 bp, Rattus norvegicus
agagtcattatttccaaggctcccc

SEQ ID NO: 117181 - DNA, 25 bp, Rattus norvegicus
agagtcattcccactcttgaggttg

SEQ ID NO: 117182 - DNA, 25 bp, Rattus norvegicus
agagtcattccctctcttgaggttg

SEQ ID NO: 117183 - DNA, 25 bp, Rattus norvegicus
agagtcattcgcagggtccttgtca

SEQ ID NO: 117184 - DNA, 25 bp, Rattus norvegicus
agagtcattcgctgggtccttgtca

SEQ ID NO: 117185 - DNA, 25 bp, Rattus norvegicus
agagtccaaaaccaagtcccctatg

SEQ ID NO: 117186 - DNA, 25 bp, Rattus norvegicus
agagtccaaaacgaagtcccctatg

SEQ ID NO: 117187 - DNA, 25 bp, Rattus norvegicus
agagtccaaaagctccaggtctgtg

SEQ ID NO: 117188 - DNA, 25 bp, Rattus norvegicus
agagtccaaaaggtccaggtctgtg

SEQ ID NO: 117189 - DNA, 25 bp, Rattus norvegicus
agagtccaagtcaaggtcgcggtcc

SEQ ID NO: 117190 - DNA, 25 bp, Rattus norvegicus
agagtccaagtctaggtcgcggtcc

SEQ ID NO: 117191 - DNA, 25 bp, Rattus norvegicus
agagtccaatgcctagcacgcacat

SEQ ID NO: 117192 - DNA, 25 bp, Rattus norvegicus
agagtccaatgcgtagcacgcacat

SEQ ID NO: 117193 - DNA, 25 bp, Rattus norvegicus
agagtccacagtacaccatcagcct

SEQ ID NO: 117194 - DNA, 25 bp, Rattus norvegicus
agagtccacagttcaccatcagcct

SEQ ID NO: 117195 - DNA, 25 bp, Rattus norvegicus
agagtccaccaaagagtctcctgag

SEQ ID NO: 117196 - DNA, 25 bp, Rattus norvegicus
agagtccaccaatgagtctcctgag

SEQ ID NO: 117197 - DNA, 25 bp, Rattus norvegicus
agagtccagagtcgcgtccatccag

SEQ ID NO: 117198 - DNA, 25 bp, Rattus norvegicus
agagtccagagtggcgtccatccag

SEQ ID NO: 117199 - DNA, 25 bp, Rattus norvegicus
agagtccagcagaacattgtccaac

SEQ ID NO: 117200 - DNA, 25 bp, Rattus norvegicus
agagtccagcagccggccacattga

SEQ ID NO: 117201 - DNA, 25 bp, Rattus norvegicus
agagtccagcagctcatgtgatccc

SEQ ID NO: 117202 - DNA, 25 bp, Rattus norvegicus
agagtccagcaggcggccacattga

SEQ ID NO: 117203 - DNA, 25 bp, Rattus norvegicus
agagtccagcaggtcatgtgatccc

SEQ ID NO: 117204 - DNA, 25 bp, Rattus norvegicus
agagtccagcagtacattgtccaac

SEQ ID NO: 117205 - DNA, 25 bp, Rattus norvegicus
agagtccagccgaaatttcagcgtg

SEQ ID NO: 117206 - DNA, 25 bp, Rattus norvegicus
agagtccagccgtaatttcagcgtg

SEQ ID NO: 117207 - DNA, 25 bp, Rattus norvegicus
agagtccagggaaatctaccgaagg

SEQ ID NO: 117208 - DNA, 25 bp, Rattus norvegicus
agagtccagggatatctaccgaagg

SEQ ID NO: 117209 - DNA, 25 bp, Rattus norvegicus
agagtccagtctctgtgtccaaaca

SEQ ID NO: 117210 - DNA, 25 bp, Rattus norvegicus
agagtccagtctgtgtgtccaaaca

SEQ ID NO: 117211 - DNA, 25 bp, Rattus norvegicus
agagtccatattactttcatgcccc

SEQ ID NO: 117212 - DNA, 25 bp, Rattus norvegicus
agagtccatatttctttcatgcccc

SEQ ID NO: 117213 - DNA, 25 bp, Rattus norvegicus
agagtccatttacaaagctgccagg

SEQ ID NO: 117214 - DNA, 25 bp, Rattus norvegicus
agagtccatttagaaagctgccagg

SEQ ID NO: 117215 - DNA, 25 bp, Rattus norvegicus
agagtcccaaagactgcctgacatg

SEQ ID NO: 117216 - DNA, 25 bp, Rattus norvegicus
agagtcccaaagtctgcctgacatg

SEQ ID NO: 117217 - DNA, 25 bp, Rattus norvegicus
agagtcccaataccctttgcctcaa

SEQ ID NO: 117218 - DNA, 25 bp, Rattus norvegicus
agagtcccaatagcctttgcctcaa

SEQ ID NO: 117219 - DNA, 25 bp, Rattus norvegicus
agagtcccacatacaaacgcctgat

SEQ ID NO: 117220 - DNA, 25 bp, Rattus norvegicus
agagtcccacattcaaacgcctgat

SEQ ID NO: 117221 - DNA, 25 bp, Rattus norvegicus
agagtcccagaactggttacccaca

SEQ ID NO: 117222 - DNA, 25 bp, Rattus norvegicus
agagtcccagaagtggttacccaca

SEQ ID NO: 117223 - DNA, 25 bp, Rattus norvegicus
agagtcccagccatcacgaagacag

SEQ ID NO: 117224 - DNA, 25 bp, Rattus norvegicus
agagtcccagccttcacgaagacag

SEQ ID NO: 117225 - DNA, 25 bp, Rattus norvegicus
agagtcccaggtcccagtctgatga

SEQ ID NO: 117226 - DNA, 25 bp, Rattus norvegicus
agagtcccaggtgccagtctgatga

SEQ ID NO: 117227 - DNA, 25 bp, Rattus norvegicus
agagtcccattgagctttgtcctta

SEQ ID NO: 117228 - DNA, 25 bp, Rattus norvegicus
agagtcccattgtgctttgtcctta

SEQ ID NO: 117229 - DNA, 25 bp, Rattus norvegicus
agagtccccagaactggcccttggg

SEQ ID NO: 117230 - DNA, 25 bp, Rattus norvegicus
agagtccccagatctggcccttggg

SEQ ID NO: 117231 - DNA, 25 bp, Rattus norvegicus
agagtccccaggaggaagagatcat

SEQ ID NO: 117232 - DNA, 25 bp, Rattus norvegicus
agagtccccaggtggaagagatcat

SEQ ID NO: 117233 - DNA, 25 bp, Rattus norvegicus
agagtccccggaaagatgatgcaaa

SEQ ID NO: 117234 - DNA, 25 bp, Rattus norvegicus
agagtccccggaaagctggcactgg

SEQ ID NO: 117235 - DNA, 25 bp, Rattus norvegicus
agagtccccggatagatgatgcaaa

SEQ ID NO: 117236 - DNA, 25 bp, Rattus norvegicus
agagtccccggatagctggcactgg

SEQ ID NO: 117237 - DNA, 25 bp, Rattus norvegicus
agagtccccgtgctggtcctctagg

SEQ ID NO: 117238 - DNA, 25 bp, Rattus norvegicus
agagtccccgtgcttccatgggagt

SEQ ID NO: 117239 - DNA, 25 bp, Rattus norvegicus
agagtccccgtggtggtcctctagg

SEQ ID NO: 117240 - DNA, 25 bp, Rattus norvegicus
agagtccccgtggttccatgggagt

SEQ ID NO: 117241 - DNA, 25 bp, Rattus norvegicus
agagtcccgagaagctagacccgaa

SEQ ID NO: 117242 - DNA, 25 bp, Rattus norvegicus
agagtcccgagatgctagacccgaa

SEQ ID NO: 117243 - DNA, 25 bp, Rattus norvegicus
agagtcccgcccaagggatccaggg

SEQ ID NO: 117244 - DNA, 25 bp, Rattus norvegicus
agagtcccgccctagggatccaggg

SEQ ID NO: 117245 - DNA, 25 bp, Rattus norvegicus
agagtccctaaccatgaggatgaca

SEQ ID NO: 117246 - DNA, 25 bp, Rattus norvegicus
agagtccctaacgatgaggatgaca

SEQ ID NO: 117247 - DNA, 25 bp, Rattus norvegicus
agagtccctgaacacctctgcttga

SEQ ID NO: 117248 - DNA, 25 bp, Rattus norvegicus
agagtccctgaagacctctgcttga

SEQ ID NO: 117249 - DNA, 25 bp, Rattus norvegicus
agagtccctggtatggagcctgtga

SEQ ID NO: 117250 - DNA, 25 bp, Rattus norvegicus
agagtccctggtttggagcctgtga

SEQ ID NO: 117251 - DNA, 25 bp, Rattus norvegicus
agagtccgacgaagacactgaggat

SEQ ID NO: 117252 - DNA, 25 bp, Rattus norvegicus
agagtccgacgatgacactgaggat

SEQ ID NO: 117253 - DNA, 25 bp, Rattus norvegicus
agagtccgagacactctggactgga

SEQ ID NO: 117254 - DNA, 25 bp, Rattus norvegicus
agagtccgagactctctggactgga

SEQ ID NO: 117255 - DNA, 25 bp, Rattus norvegicus
agagtccgagagactgctccgaagt

SEQ ID NO: 117256 - DNA, 25 bp, Rattus norvegicus
agagtccgagagtctgctccgaagt

SEQ ID NO: 117257 - DNA, 25 bp, Rattus norvegicus
agagtccgagccagaggagccccag

SEQ ID NO: 117258 - DNA, 25 bp, Rattus norvegicus
agagtccgagcctgaggagccccag

SEQ ID NO: 117259 - DNA, 25 bp, Rattus norvegicus
agagtccgatgcctctcctggatac

SEQ ID NO: 117260 - DNA, 25 bp, Rattus norvegicus
agagtccgatgcgtctcctggatac

SEQ ID NO: 117261 - DNA, 25 bp, Rattus norvegicus
agagtccggcacaggcatttcgtca

SEQ ID NO: 117262 - DNA, 25 bp, Rattus norvegicus
agagtccggcactggcatttcgtca

SEQ ID NO: 117263 - DNA, 25 bp, Rattus norvegicus
agagtcctagcgagtatctgtcagc

SEQ ID NO: 117264 - DNA, 25 bp, Rattus norvegicus
agagtcctagcgtgtatctgtcagc

SEQ ID NO: 117265 - DNA, 25 bp, Rattus norvegicus
agagtcctcaaacaagatccacctc

SEQ ID NO: 117266 - DNA, 25 bp, Rattus norvegicus
agagtcctcaaagaagatccacctc

SEQ ID NO: 117267 - DNA, 25 bp, Rattus norvegicus
agagtcctcctgagtgaatagaagt

SEQ ID NO: 117268 - DNA, 25 bp, Rattus norvegicus
agagtcctcctgtgtgaatagaagt

SEQ ID NO: 117269 - DNA, 25 bp, Rattus norvegicus
agagtcctcggacaaagcctcggaa

SEQ ID NO: 117270 - DNA, 25 bp, Rattus norvegicus
agagtcctcggagaaagcctcggaa

SEQ ID NO: 117271 - DNA, 25 bp, Rattus norvegicus
agagtcctctatcggcattgcatgt

SEQ ID NO: 117272 - DNA, 25 bp, Rattus norvegicus
agagtcctctatgggcattgcatgt

SEQ ID NO: 117273 - DNA, 25 bp, Rattus norvegicus
agagtcctctgaattgccacaatat

SEQ ID NO: 117274 - DNA, 25 bp, Rattus norvegicus
agagtcctctgatttgccacaatat

SEQ ID NO: 117275 - DNA, 25 bp, Rattus norvegicus
agagtcctctggctgccaatattac

SEQ ID NO: 117276 - DNA, 25 bp, Rattus norvegicus
agagtcctctgggtgccaatattac

SEQ ID NO: 117277 - DNA, 25 bp, Rattus norvegicus
agagtcctgacacctgcagcgacga

SEQ ID NO: 117278 - DNA, 25 bp, Rattus norvegicus
agagtcctgacagctgcagcgacga

SEQ ID NO: 117279 - DNA, 25 bp, Rattus norvegicus
agagtcctgctacctcagtcagtat

SEQ ID NO: 117280 - DNA, 25 bp, Rattus norvegicus
agagtcctgctagctcagtcagtat

SEQ ID NO: 117281 - DNA, 25 bp, Rattus norvegicus
agagtcctggctctcattgaaccaa

SEQ ID NO: 117282 - DNA, 25 bp, Rattus norvegicus
agagtcctggctgtcattgaaccaa

SEQ ID NO: 117283 - DNA, 25 bp, Rattus norvegicus
agagtcctgggacatacccgtgtga

SEQ ID NO: 117284 - DNA, 25 bp, Rattus norvegicus
agagtcctgggagatacccgtgtga

SEQ ID NO: 117285 - DNA, 25 bp, Rattus norvegicus
agagtcctgggcctgttttatacaa

SEQ ID NO: 117286 - DNA, 25 bp, Rattus norvegicus
agagtcctgggcgtgttttatacaa

SEQ ID NO: 117287 - DNA, 25 bp, Rattus norvegicus
agagtcctggtacccagctaagggt

SEQ ID NO: 117288 - DNA, 25 bp, Rattus norvegicus
agagtcctggtagccagctaagggt

SEQ ID NO: 117289 - DNA, 25 bp, Rattus norvegicus
agagtcctgtctcagtaaccagcag

SEQ ID NO: 117290 - DNA, 25 bp, Rattus norvegicus
agagtcctgtctgagtaaccagcag

SEQ ID NO: 117291 - DNA, 25 bp, Rattus norvegicus
agagtccttaaaccggcacaaagac

SEQ ID NO: 117292 - DNA, 25 bp, Rattus norvegicus
agagtccttaaagcggcacaaagac

SEQ ID NO: 117293 - DNA, 25 bp, Rattus norvegicus
agagtccttccccagtatgggctta

SEQ ID NO: 117294 - DNA, 25 bp, Rattus norvegicus
agagtccttcccgagtatgggctta

SEQ ID NO: 117295 - DNA, 25 bp, Rattus norvegicus
agagtcctttgtccgaggtggacat

SEQ ID NO: 117296 - DNA, 25 bp, Rattus norvegicus
agagtcctttgtgcgaggtggacat

SEQ ID NO: 117297 - DNA, 25 bp, Rattus norvegicus
agagtcgaattcatccatgctgctg

SEQ ID NO: 117298 - DNA, 25 bp, Rattus norvegicus
agagtcgaattcttccatgctgctg

SEQ ID NO: 117299 - DNA, 25 bp, Rattus norvegicus
agagtcgatctccaatgttgtgcta

SEQ ID NO: 117300 - DNA, 25 bp, Rattus norvegicus
agagtcgatctcgaatgttgtgcta

SEQ ID NO: 117301 - DNA, 25 bp, Rattus norvegicus
agagtcgcctggacagccatttttc

SEQ ID NO: 117302 - DNA, 25 bp, Rattus norvegicus
agagtcgcctggtcagccatttttc

SEQ ID NO: 117303 - DNA, 25 bp, Rattus norvegicus
agagtcgctccaccttatttaaggc

SEQ ID NO: 117304 - DNA, 25 bp, Rattus norvegicus
agagtcgctccagcttatttaaggc

SEQ ID NO: 117305 - DNA, 25 bp, Rattus norvegicus
agagtcgctgctattatattttaac

SEQ ID NO: 117306 - DNA, 25 bp, Rattus norvegicus
agagtcgctgcttttatattttaac

SEQ ID NO: 117307 - DNA, 25 bp, Rattus norvegicus
agagtcgctggacatgagctcccct

SEQ ID NO: 117308 - DNA, 25 bp, Rattus norvegicus
agagtcgctggagatgagctcccct

SEQ ID NO: 117309 - DNA, 25 bp, Rattus norvegicus
agagtcggacagagactgagccccg

SEQ ID NO: 117310 - DNA, 25 bp, Rattus norvegicus
agagtcggacagtgactgagccccg

SEQ ID NO: 117311 - DNA, 25 bp, Rattus norvegicus
agagtcggaggacatcttctgccat

SEQ ID NO: 117312 - DNA, 25 bp, Rattus norvegicus
agagtcggaggagatcttctgccat

SEQ ID NO: 117313 - DNA, 25 bp, Rattus norvegicus
agagtcggcctcagtctgcatctgt

SEQ ID NO: 117314 - DNA, 25 bp, Rattus norvegicus
agagtcggcctctgtctgcatctgt

SEQ ID NO: 117315 - DNA, 25 bp, Rattus norvegicus
agagtcgtacaaagccctgaaatgg

SEQ ID NO: 117316 - DNA, 25 bp, Rattus norvegicus
agagtcgtacaatgccctgaaatgg

SEQ ID NO: 117317 - DNA, 25 bp, Rattus norvegicus
agagtcgtcattcaagcctccgcag

SEQ ID NO: 117318 - DNA, 25 bp, Rattus norvegicus
agagtcgtcattgaagcctccgcag

SEQ ID NO: 117319 - DNA, 25 bp, Rattus norvegicus
agagtcgtgaaactccatcaccaca

SEQ ID NO: 117320 - DNA, 25 bp, Rattus norvegicus
agagtcgtgaaagtccatcaccaca

SEQ ID NO: 117321 - DNA, 25 bp, Rattus norvegicus
agagtcgtggctagattgtaacatc

SEQ ID NO: 117322 - DNA, 25 bp, Rattus norvegicus
agagtcgtggcttgattgtaacatc

SEQ ID NO: 117323 - DNA, 25 bp, Rattus norvegicus
agagtcgtggtgagctgctcagacc

SEQ ID NO: 117324 - DNA, 25 bp, Rattus norvegicus
agagtcgtggtgtgctgctcagacc

SEQ ID NO: 117325 - DNA, 25 bp, Rattus norvegicus
agagtcgttactctgttctgctgca

SEQ ID NO: 117326 - DNA, 25 bp, Rattus norvegicus
agagtcgttactgtgttctgctgca

SEQ ID NO: 117327 - DNA, 25 bp, Rattus norvegicus
agagtcgtttacagtgtccggagcg

SEQ ID NO: 117328 - DNA, 25 bp, Rattus norvegicus
agagtcgtttactgtgtccggagcg

SEQ ID NO: 117329 - DNA, 25 bp, Rattus norvegicus
agagtctacatccaaacccttaagt

SEQ ID NO: 117330 - DNA, 25 bp, Rattus norvegicus
agagtctacatcgaaacccttaagt

SEQ ID NO: 117331 - DNA, 25 bp, Rattus norvegicus
agagtctacctcagttgtgctggtc

SEQ ID NO: 117332 - DNA, 25 bp, Rattus norvegicus
agagtctacctctgttgtgctggtc

SEQ ID NO: 117333 - DNA, 25 bp, Rattus norvegicus
agagtctactctcatcacttgtgtt

SEQ ID NO: 117334 - DNA, 25 bp, Rattus norvegicus
agagtctactctgatcacttgtgtt

SEQ ID NO: 117335 - DNA, 25 bp, Rattus norvegicus
agagtctactttactgtggcagagt

SEQ ID NO: 117336 - DNA, 25 bp, Rattus norvegicus
agagtctacttttctgtggcagagt

SEQ ID NO: 117337 - DNA, 25 bp, Rattus norvegicus
agagtctatgcccactcccatttct

SEQ ID NO: 117338 - DNA, 25 bp, Rattus norvegicus
agagtctatgccgactcccatttct

SEQ ID NO: 117339 - DNA, 25 bp, Rattus norvegicus
agagtctatttcaaccgagttccac

SEQ ID NO: 117340 - DNA, 25 bp, Rattus norvegicus
agagtctatttctaccgagttccac

SEQ ID NO: 117341 - DNA, 25 bp, Rattus norvegicus
agagtctcaaggagatgcctgcctt

SEQ ID NO: 117342 - DNA, 25 bp, Rattus norvegicus
agagtctcaaggtgatgcctgcctt

SEQ ID NO: 117343 - DNA, 25 bp, Rattus norvegicus
agagtctcacacatctggctcatga

SEQ ID NO: 117344 - DNA, 25 bp, Rattus norvegicus
agagtctcacacttctggctcatga

SEQ ID NO: 117345 - DNA, 25 bp, Rattus norvegicus
agagtctcactcatgctaggcaagc

SEQ ID NO: 117346 - DNA, 25 bp, Rattus norvegicus
agagtctcactcttgctaggcaagc

SEQ ID NO: 117347 - DNA, 25 bp, Rattus norvegicus
agagtctcagtgagatctccagaat

SEQ ID NO: 117348 - DNA, 25 bp, Rattus norvegicus
agagtctcagtgagcgatcctctag

SEQ ID NO: 117349 - DNA, 25 bp, Rattus norvegicus
agagtctcagtgtgatctccagaat

SEQ ID NO: 117350 - DNA, 25 bp, Rattus norvegicus
agagtctcagtgtgcgatcctctag

SEQ ID NO: 117351 - DNA, 25 bp, Rattus norvegicus
agagtctcatcacagaaggcgcccg

SEQ ID NO: 117352 - DNA, 25 bp, Rattus norvegicus
agagtctcatcagagaaggcgcccg

SEQ ID NO: 117353 - DNA, 25 bp, Rattus norvegicus
agagtctcatgtatcccaaactggc

SEQ ID NO: 117354 - DNA, 25 bp, Rattus norvegicus
agagtctcatgtttcccaaactggc

SEQ ID NO: 117355 - DNA, 25 bp, Rattus norvegicus
agagtctcccggcaagtgctacctc

SEQ ID NO: 117356 - DNA, 25 bp, Rattus norvegicus
agagtctcccgggaagtgctacctc

SEQ ID NO: 117357 - DNA, 25 bp, Rattus norvegicus
agagtctcgatcagtgcccaggcac

SEQ ID NO: 117358 - DNA, 25 bp, Rattus norvegicus
agagtctcgatctgtgcccaggcac

SEQ ID NO: 117359 - DNA, 25 bp, Rattus norvegicus
agagtctcgcacatgcaggcaaggc

SEQ ID NO: 117360 - DNA, 25 bp, Rattus norvegicus
agagtctcgcacttgcaggcaaggc

SEQ ID NO: 117361 - DNA, 25 bp, Rattus norvegicus
agagtctctaggaggtctgccccag

SEQ ID NO: 117362 - DNA, 25 bp, Rattus norvegicus
agagtctctaggtggtctgccccag

SEQ ID NO: 117363 - DNA, 25 bp, Rattus norvegicus
agagtctctcatagacccagagctc

SEQ ID NO: 117364 - DNA, 25 bp, Rattus norvegicus
agagtctctcattgacccagagctc

SEQ ID NO: 117365 - DNA, 25 bp, Rattus norvegicus
agagtctctcgtctgtggtcgttct

SEQ ID NO: 117366 - DNA, 25 bp, Rattus norvegicus
agagtctctcgtgtgtggtcgttct

SEQ ID NO: 117367 - DNA, 25 bp, Rattus norvegicus
agagtctctggccttagtcgctcgt

SEQ ID NO: 117368 - DNA, 25 bp, Rattus norvegicus
agagtctctggcgttagtcgctcgt

SEQ ID NO: 117369 - DNA, 25 bp, Rattus norvegicus
agagtctgactcagtcttttagtat

SEQ ID NO: 117370 - DNA, 25 bp, Rattus norvegicus
agagtctgactcatgggtgctaagt

SEQ ID NO: 117371 - DNA, 25 bp, Rattus norvegicus
agagtctgactctgtcttttagtat

SEQ ID NO: 117372 - DNA, 25 bp, Rattus norvegicus
agagtctgactcttgggtgctaagt

SEQ ID NO: 117373 - DNA, 25 bp, Rattus norvegicus
agagtctgagccaattcaaccttac

SEQ ID NO: 117374 - DNA, 25 bp, Rattus norvegicus
agagtctgagcctattcaaccttac

SEQ ID NO: 117375 - DNA, 25 bp, Rattus norvegicus
agagtctgcagacagcccgaggcta

SEQ ID NO: 117376 - DNA, 25 bp, Rattus norvegicus
agagtctgcagagagcccgaggcta

SEQ ID NO: 117377 - DNA, 25 bp, Rattus norvegicus
agagtctgctggctctttgtccatt

SEQ ID NO: 117378 - DNA, 25 bp, Rattus norvegicus
agagtctgctgggtctttgtccatt

SEQ ID NO: 117379 - DNA, 25 bp, Rattus norvegicus
agagtctgctgtcctgtctgtgtca

SEQ ID NO: 117380 - DNA, 25 bp, Rattus norvegicus
agagtctgctgtgctgtctgtgtca

SEQ ID NO: 117381 - DNA, 25 bp, Rattus norvegicus
agagtctggcggagtcttcgccgaa

SEQ ID NO: 117382 - DNA, 25 bp, Rattus norvegicus
agagtctggcggtgtcttcgccgaa

SEQ ID NO: 117383 - DNA, 25 bp, Rattus norvegicus
agagtctgggtcctgctgatgctac

SEQ ID NO: 117384 - DNA, 25 bp, Rattus norvegicus
agagtctgggtcgtgctgatgctac

SEQ ID NO: 117385 - DNA, 25 bp, Rattus norvegicus
agagtctgggttacaaccaccttgt

SEQ ID NO: 117386 - DNA, 25 bp, Rattus norvegicus
agagtctgggtttcaaccaccttgt

SEQ ID NO: 117387 - DNA, 25 bp, Rattus norvegicus
agagtctgtcatacactttgccact

SEQ ID NO: 117388 - DNA, 25 bp, Rattus norvegicus
agagtctgtcattcactttgccact

SEQ ID NO: 117389 - DNA, 25 bp, Rattus norvegicus
agagtctgtgagctctcagtccaga

SEQ ID NO: 117390 - DNA, 25 bp, Rattus norvegicus
agagtctgtgaggtctcagtccaga

SEQ ID NO: 117391 - DNA, 25 bp, Rattus norvegicus
agagtctgtgctccagattggccta

SEQ ID NO: 117392 - DNA, 25 bp, Rattus norvegicus
agagtctgtgctgcagattggccta

SEQ ID NO: 117393 - DNA, 25 bp, Rattus norvegicus
agagtctgttacctggatcattaag

SEQ ID NO: 117394 - DNA, 25 bp, Rattus norvegicus
agagtctgttacgtggatcattaag

SEQ ID NO: 117395 - DNA, 25 bp, Rattus norvegicus
agagtctgttgcctcacgagctaac

SEQ ID NO: 117396 - DNA, 25 bp, Rattus norvegicus
agagtctgttgcgtcacgagctaac

SEQ ID NO: 117397 - DNA, 25 bp, Rattus norvegicus
agagtctgttgtcctggatctcctc

SEQ ID NO: 117398 - DNA, 25 bp, Rattus norvegicus
agagtctgttgtgctggatctcctc

SEQ ID NO: 117399 - DNA, 25 bp, Rattus norvegicus
agagtcttacctacttacagtctaa

SEQ ID NO: 117400 - DNA, 25 bp, Rattus norvegicus
agagtcttaccttcttacagtctaa

SEQ ID NO: 117401 - DNA, 25 bp, Rattus norvegicus
agagtcttagcccttctgtttgttc

SEQ ID NO: 117402 - DNA, 25 bp, Rattus norvegicus
agagtcttagccgttctgtttgttc

SEQ ID NO: 117403 - DNA, 25 bp, Rattus norvegicus
agagtcttataccagggaaatcctt

SEQ ID NO: 117404 - DNA, 25 bp, Rattus norvegicus
agagtcttatacgagggaaatcctt

SEQ ID NO: 117405 - DNA, 25 bp, Rattus norvegicus
agagtcttcaggagctgtgacccca

SEQ ID NO: 117406 - DNA, 25 bp, Rattus norvegicus
agagtcttcaggtgctgtgacccca

SEQ ID NO: 117407 - DNA, 25 bp, Rattus norvegicus
agagtcttcattcctttttgaggag

SEQ ID NO: 117408 - DNA, 25 bp, Rattus norvegicus
agagtcttcattgctttttgaggag

SEQ ID NO: 117409 - DNA, 25 bp, Rattus norvegicus
agagtcttccggactgaatttcagt

SEQ ID NO: 117410 - DNA, 25 bp, Rattus norvegicus
agagtcttccggtctgaatttcagt

SEQ ID NO: 117411 - DNA, 25 bp, Rattus norvegicus
agagtcttcctcagttccacagaac

SEQ ID NO: 117412 - DNA, 25 bp, Rattus norvegicus
agagtcttcctctgttccacagaac

SEQ ID NO: 117413 - DNA, 25 bp, Rattus norvegicus
agagtcttctcactcttgatcttgc

SEQ ID NO: 117414 - DNA, 25 bp, Rattus norvegicus
agagtcttctcagtcttgatcttgc

SEQ ID NO: 117415 - DNA, 25 bp, Rattus norvegicus
agagtcttctgtacgtgcagggcac

SEQ ID NO: 117416 - DNA, 25 bp, Rattus norvegicus
agagtcttctgttcgtgcagggcac

SEQ ID NO: 117417 - DNA, 25 bp, Rattus norvegicus
agagtcttgaaaccctgacaacagg

SEQ ID NO: 117418 - DNA, 25 bp, Rattus norvegicus
agagtcttgaaagcctgacaacagg

SEQ ID NO: 117419 - DNA, 25 bp, Rattus norvegicus
agagtcttgagaaggcacattccta

SEQ ID NO: 117420 - DNA, 25 bp, Rattus norvegicus
agagtcttgagatggcacattccta

SEQ ID NO: 117421 - DNA, 25 bp, Rattus norvegicus
agagtcttgatgaccttctgggaat

SEQ ID NO: 117422 - DNA, 25 bp, Rattus norvegicus
agagtcttgatgtccttctgggaat

SEQ ID NO: 117423 - DNA, 25 bp, Rattus norvegicus
agagtcttggctacatctcggtggc

SEQ ID NO: 117424 - DNA, 25 bp, Rattus norvegicus
agagtcttggcttcatctcggtggc

SEQ ID NO: 117425 - DNA, 25 bp, Rattus norvegicus
agagtcttgggcctaactcaggaaa

SEQ ID NO: 117426 - DNA, 25 bp, Rattus norvegicus
agagtcttgggcgtaactcaggaaa

SEQ ID NO: 117427 - DNA, 25 bp, Rattus norvegicus
agagtcttggtcactctatcgtcta

SEQ ID NO: 117428 - DNA, 25 bp, Rattus norvegicus
agagtcttggtctctctatcgtcta

SEQ ID NO: 117429 - DNA, 25 bp, Rattus norvegicus
agagtcttgttcattataacctggg

SEQ ID NO: 117430 - DNA, 25 bp, Rattus norvegicus
agagtcttgttctttataacctggg

SEQ ID NO: 117431 - DNA, 25 bp, Rattus norvegicus
agagtctttacccttcccatgtaat

SEQ ID NO: 117432 - DNA, 25 bp, Rattus norvegicus
agagtctttaccgttcccatgtaat

SEQ ID NO: 117433 - DNA, 25 bp, Rattus norvegicus
agagtctttgtcacgtagcgctgaa

SEQ ID NO: 117434 - DNA, 25 bp, Rattus norvegicus
agagtctttgtctcgtagcgctgaa

SEQ ID NO: 117435 - DNA, 25 bp, Rattus norvegicus
agagtctttttccacaaaccgccat

SEQ ID NO: 117436 - DNA, 25 bp, Rattus norvegicus
agagtctttttcgacaaaccgccat

SEQ ID NO: 117437 - DNA, 25 bp, Rattus norvegicus
agagtgaaccccagatgtttctttc

SEQ ID NO: 117438 - DNA, 25 bp, Rattus norvegicus
agagtgaacccctgatgtttctttc

SEQ ID NO: 117439 - DNA, 25 bp, Rattus norvegicus
agagtgaacttccagcaacattccc

SEQ ID NO: 117440 - DNA, 25 bp, Rattus norvegicus
agagtgaacttcgagcaacattccc

SEQ ID NO: 117441 - DNA, 25 bp, Rattus norvegicus
agagtgaagcccacgggatccattc

SEQ ID NO: 117442 - DNA, 25 bp, Rattus norvegicus
agagtgaagccctcgggatccattc

SEQ ID NO: 117443 - DNA, 25 bp, Rattus norvegicus
agagtgaagcgtaagcctgtgccct

SEQ ID NO: 117444 - DNA, 25 bp, Rattus norvegicus
agagtgaagcgttagcctgtgccct

SEQ ID NO: 117445 - DNA, 25 bp, Rattus norvegicus
agagtgaagctgcatgcccctgtat

SEQ ID NO: 117446 - DNA, 25 bp, Rattus norvegicus
agagtgaagctggatgcccctgtat

SEQ ID NO: 117447 - DNA, 25 bp, Rattus norvegicus
agagtgaagtggacagccgcagtcc

SEQ ID NO: 117448 - DNA, 25 bp, Rattus norvegicus
agagtgaagtggtcagccgcagtcc

SEQ ID NO: 117449 - DNA, 25 bp, Rattus norvegicus
agagtgacagacacttttctcctct

SEQ ID NO: 117450 - DNA, 25 bp, Rattus norvegicus
agagtgacagactcttttctcctct

SEQ ID NO: 117451 - DNA, 25 bp, Rattus norvegicus
agagtgaccctgaacgtggtgctga

SEQ ID NO: 117452 - DNA, 25 bp, Rattus norvegicus
agagtgaccctgtacgtggtgctga

SEQ ID NO: 117453 - DNA, 25 bp, Rattus norvegicus
agagtgaccgccagcggaagcttat

SEQ ID NO: 117454 - DNA, 25 bp, Rattus norvegicus
agagtgaccgcctgcggaagcttat

SEQ ID NO: 117455 - DNA, 25 bp, Rattus norvegicus
agagtgaccggtaagcgctgctcca

SEQ ID NO: 117456 - DNA, 25 bp, Rattus norvegicus
agagtgaccggttagcgctgctcca

SEQ ID NO: 117457 - DNA, 25 bp, Rattus norvegicus
agagtgacctcaccaccaagaaggt

SEQ ID NO: 117458 - DNA, 25 bp, Rattus norvegicus
agagtgacctcagcaccaagaaggt

SEQ ID NO: 117459 - DNA, 25 bp, Rattus norvegicus
agagtgacctgaagatcagctacag

SEQ ID NO: 117460 - DNA, 25 bp, Rattus norvegicus
agagtgacctgatgatcagctacag

SEQ ID NO: 117461 - DNA, 25 bp, Rattus norvegicus
agagtgacggtcattggccctgatc

SEQ ID NO: 117462 - DNA, 25 bp, Rattus norvegicus
agagtgacggtctttggccctgatc

SEQ ID NO: 117463 - DNA, 25 bp, Rattus norvegicus
agagtgactcctatagtcgccggac

SEQ ID NO: 117464 - DNA, 25 bp, Rattus norvegicus
agagtgactcctttagtcgccggac

SEQ ID NO: 117465 - DNA, 25 bp, Rattus norvegicus
agagtgactctgaactgggcggcca

SEQ ID NO: 117466 - DNA, 25 bp, Rattus norvegicus
agagtgactctgtactgggcggcca

SEQ ID NO: 117467 - DNA, 25 bp, Rattus norvegicus
agagtgactgacacttctgcgcatt

SEQ ID NO: 117468 - DNA, 25 bp, Rattus norvegicus
agagtgactgactcttctgcgcatt

SEQ ID NO: 117469 - DNA, 25 bp, Rattus norvegicus
agagtgactgatcagactctgcccc

SEQ ID NO: 117470 - DNA, 25 bp, Rattus norvegicus
agagtgactgatgagactctgcccc

SEQ ID NO: 117471 - DNA, 25 bp, Rattus norvegicus
agagtgactgcaccacctgtactac

SEQ ID NO: 117472 - DNA, 25 bp, Rattus norvegicus
agagtgactgcagcacctgtactac

SEQ ID NO: 117473 - DNA, 25 bp, Rattus norvegicus
agagtgactgtcattgggaacaagt

SEQ ID NO: 117474 - DNA, 25 bp, Rattus norvegicus
agagtgactgtctttgggaacaagt

SEQ ID NO: 117475 - DNA, 25 bp, Rattus norvegicus
agagtgagaccccagtcctaggctg

SEQ ID NO: 117476 - DNA, 25 bp, Rattus norvegicus
agagtgagacccgagtcctaggctg

SEQ ID NO: 117477 - DNA, 25 bp, Rattus norvegicus
agagtgagagcgagcgagatcttta

SEQ ID NO: 117478 - DNA, 25 bp, Rattus norvegicus
agagtgagagcgtgcgagatcttta

SEQ ID NO: 117479 - DNA, 25 bp, Rattus norvegicus
agagtgagaggccaaccccttcatg

SEQ ID NO: 117480 - DNA, 25 bp, Rattus norvegicus
agagtgagaggcgaaccccttcatg

SEQ ID NO: 117481 - DNA, 25 bp, Rattus norvegicus
agagtgagcaccatgccctcgctgg

SEQ ID NO: 117482 - DNA, 25 bp, Rattus norvegicus
agagtgagcaccttgccctcgctgg

SEQ ID NO: 117483 - DNA, 25 bp, Rattus norvegicus
agagtgagcagaacctttccgacca

SEQ ID NO: 117484 - DNA, 25 bp, Rattus norvegicus
agagtgagcagatcctttccgacca

SEQ ID NO: 117485 - DNA, 25 bp, Rattus norvegicus
agagtgagccccagcccaggtgtct

SEQ ID NO: 117486 - DNA, 25 bp, Rattus norvegicus
agagtgagcccctgcccaggtgtct

SEQ ID NO: 117487 - DNA, 25 bp, Rattus norvegicus
agagtgagcctcatattctgccacg

SEQ ID NO: 117488 - DNA, 25 bp, Rattus norvegicus
agagtgagcctcatgctgtgataga

SEQ ID NO: 117489 - DNA, 25 bp, Rattus norvegicus
agagtgagcctcttattctgccacg

SEQ ID NO: 117490 - DNA, 25 bp, Rattus norvegicus
agagtgagcctcttgctgtgataga

SEQ ID NO: 117491 - DNA, 25 bp, Rattus norvegicus
agagtgagcctgagccttcattttc

SEQ ID NO: 117492 - DNA, 25 bp, Rattus norvegicus
agagtgagcctgtgccttcattttc

SEQ ID NO: 117493 - DNA, 25 bp, Rattus norvegicus
agagtgaggactacacctcccctaa

SEQ ID NO: 117494 - DNA, 25 bp, Rattus norvegicus
agagtgaggacttcacctcccctaa

SEQ ID NO: 117495 - DNA, 25 bp, Rattus norvegicus
agagtgaggagactcagcagccaca

SEQ ID NO: 117496 - DNA, 25 bp, Rattus norvegicus
agagtgaggagagtcagcagccaca

SEQ ID NO: 117497 - DNA, 25 bp, Rattus norvegicus
agagtgagggagactcgcccaccac

SEQ ID NO: 117498 - DNA, 25 bp, Rattus norvegicus
agagtgagggagtctcgcccaccac

SEQ ID NO: 117499 - DNA, 25 bp, Rattus norvegicus
agagtgagtcctctgagctttggcc

SEQ ID NO: 117500 - DNA, 25 bp, Rattus norvegicus
agagtgagtcctgtgagctttggcc

SEQ ID NO: 117501 - DNA, 25 bp, Rattus norvegicus
agagtgagtttgagctccctccggt

SEQ ID NO: 117502 - DNA, 25 bp, Rattus norvegicus
agagtgagtttgtgctccctccggt

SEQ ID NO: 117503 - DNA, 25 bp, Rattus norvegicus
agagtgatccaacatccgcccggat

SEQ ID NO: 117504 - DNA, 25 bp, Rattus norvegicus
agagtgatccaacctggacccttgg

SEQ ID NO: 117505 - DNA, 25 bp, Rattus norvegicus
agagtgatccaagatccgcccggat

SEQ ID NO: 117506 - DNA, 25 bp, Rattus norvegicus
agagtgatccaagctggacccttgg

SEQ ID NO: 117507 - DNA, 25 bp, Rattus norvegicus
agagtgatctggcttctcctgggac

SEQ ID NO: 117508 - DNA, 25 bp, Rattus norvegicus
agagtgatctgggttctcctgggac

SEQ ID NO: 117509 - DNA, 25 bp, Rattus norvegicus
agagtgatctgtatccttagccacc

SEQ ID NO: 117510 - DNA, 25 bp, Rattus norvegicus
agagtgatctgtttccttagccacc

SEQ ID NO: 117511 - DNA, 25 bp, Rattus norvegicus
agagtgatgctcactcttatcatcg

SEQ ID NO: 117512 - DNA, 25 bp, Rattus norvegicus
agagtgatgctctctcttatcatcg

SEQ ID NO: 117513 - DNA, 25 bp, Rattus norvegicus
agagtgattcaccagctgtcaccag

SEQ ID NO: 117514 - DNA, 25 bp, Rattus norvegicus
agagtgattcacgagctgtcaccag

SEQ ID NO: 117515 - DNA, 25 bp, Rattus norvegicus
agagtgattggacgccttctcgcac

SEQ ID NO: 117516 - DNA, 25 bp, Rattus norvegicus
agagtgattggaggccttctcgcac

SEQ ID NO: 117517 - DNA, 25 bp, Rattus norvegicus
agagtgcacttaattctctacaccc

SEQ ID NO: 117518 - DNA, 25 bp, Rattus norvegicus
agagtgcacttatttctctacaccc

SEQ ID NO: 117519 - DNA, 25 bp, Rattus norvegicus
agagtgcacttgctggacaatgcca

SEQ ID NO: 117520 - DNA, 25 bp, Rattus norvegicus
agagtgcacttggtggacaatgcca

SEQ ID NO: 117521 - DNA, 25 bp, Rattus norvegicus
agagtgcaggacctctgtgcatctc

SEQ ID NO: 117522 - DNA, 25 bp, Rattus norvegicus
agagtgcaggacgtctgtgcatctc

SEQ ID NO: 117523 - DNA, 25 bp, Rattus norvegicus
agagtgcagtggaccccgagtctca

SEQ ID NO: 117524 - DNA, 25 bp, Rattus norvegicus
agagtgcagtggtccccgagtctca

SEQ ID NO: 117525 - DNA, 25 bp, Rattus norvegicus
agagtgcatctcactatttccacag

SEQ ID NO: 117526 - DNA, 25 bp, Rattus norvegicus
agagtgcatctctctatttccacag

SEQ ID NO: 117527 - DNA, 25 bp, Rattus norvegicus
agagtgcatgtgcttgcatctctgt

SEQ ID NO: 117528 - DNA, 25 bp, Rattus norvegicus
agagtgcatgtggttgcatctctgt

SEQ ID NO: 117529 - DNA, 25 bp, Rattus norvegicus
agagtgcattcacctcagggcttgc

SEQ ID NO: 117530 - DNA, 25 bp, Rattus norvegicus
agagtgcattcagctcagggcttgc

SEQ ID NO: 117531 - DNA, 25 bp, Rattus norvegicus
agagtgccccatacatcgatcaggt

SEQ ID NO: 117532 - DNA, 25 bp, Rattus norvegicus
agagtgccccattcatcgatcaggt

SEQ ID NO: 117533 - DNA, 25 bp, Rattus norvegicus
agagtgcccgtgattgcatcttgag

SEQ ID NO: 117534 - DNA, 25 bp, Rattus norvegicus
agagtgcccgtgtttgcatcttgag

SEQ ID NO: 117535 - DNA, 25 bp, Rattus norvegicus
agagtgccctccatcataaataagc

SEQ ID NO: 117536 - DNA, 25 bp, Rattus norvegicus
agagtgccctccttcataaataagc

SEQ ID NO: 117537 - DNA, 25 bp, Rattus norvegicus
agagtgccctctactatgtgtatac

SEQ ID NO: 117538 - DNA, 25 bp, Rattus norvegicus
agagtgccctcttctatgtgtatac

SEQ ID NO: 117539 - DNA, 25 bp, Rattus norvegicus
agagtgcctaaacttcaacttgaat

SEQ ID NO: 117540 - DNA, 25 bp, Rattus norvegicus
agagtgcctaaagttcaacttgaat

SEQ ID NO: 117541 - DNA, 25 bp, Rattus norvegicus
agagtgcctaccaggtatatcccag

SEQ ID NO: 117542 - DNA, 25 bp, Rattus norvegicus
agagtgcctacctggtatatcccag

SEQ ID NO: 117543 - DNA, 25 bp, Rattus norvegicus
agagtgcctcatactagttcttttc

SEQ ID NO: 117544 - DNA, 25 bp, Rattus norvegicus
agagtgcctcattctagttcttttc

SEQ ID NO: 117545 - DNA, 25 bp, Rattus norvegicus
agagtgcctcttactgatatccaag

SEQ ID NO: 117546 - DNA, 25 bp, Rattus norvegicus
agagtgcctctttctgatatccaag

SEQ ID NO: 117547 - DNA, 25 bp, Rattus norvegicus
agagtgccttggaggtgacaccaga

SEQ ID NO: 117548 - DNA, 25 bp, Rattus norvegicus
agagtgccttggtggtgacaccaga

SEQ ID NO: 117549 - DNA, 25 bp, Rattus norvegicus
agagtgcgcagtctgatcgtcctct

SEQ ID NO: 117550 - DNA, 25 bp, Rattus norvegicus
agagtgcgcagtgtgatcgtcctct

SEQ ID NO: 117551 - DNA, 25 bp, Rattus norvegicus
agagtgcgcgatcagcctctagtgc

SEQ ID NO: 117552 - DNA, 25 bp, Rattus norvegicus
agagtgcgcgatgagcctctagtgc

SEQ ID NO: 117553 - DNA, 25 bp, Rattus norvegicus
agagtgcggcgtactccagtggatt

SEQ ID NO: 117554 - DNA, 25 bp, Rattus norvegicus
agagtgcggcgttctccagtggatt

SEQ ID NO: 117555 - DNA, 25 bp, Rattus norvegicus
agagtgcgtaccaccggacttggac

SEQ ID NO: 117556 - DNA, 25 bp, Rattus norvegicus
agagtgcgtacctccggacttggac

SEQ ID NO: 117557 - DNA, 25 bp, Rattus norvegicus
agagtgctacagacaccacgttcac

SEQ ID NO: 117558 - DNA, 25 bp, Rattus norvegicus
agagtgctacagctgttctttcctt

SEQ ID NO: 117559 - DNA, 25 bp, Rattus norvegicus
agagtgctacaggtgttctttcctt

SEQ ID NO: 117560 - DNA, 25 bp, Rattus norvegicus
agagtgctacagtcaccacgttcac

SEQ ID NO: 117561 - DNA, 25 bp, Rattus norvegicus
agagtgctattgacaccgaggccac

SEQ ID NO: 117562 - DNA, 25 bp, Rattus norvegicus
agagtgctattgtcaccgaggccac

SEQ ID NO: 117563 - DNA, 25 bp, Rattus norvegicus
agagtgctcaccagtcatgtagcgt

SEQ ID NO: 117564 - DNA, 25 bp, Rattus norvegicus
agagtgctcacctgtcatgtagcgt

SEQ ID NO: 117565 - DNA, 25 bp, Rattus norvegicus
agagtgctcaggctgtacatgcctg

SEQ ID NO: 117566 - DNA, 25 bp, Rattus norvegicus
agagtgctcagggtgtacatgcctg

SEQ ID NO: 117567 - DNA, 25 bp, Rattus norvegicus
agagtgctcgccaagaatgctggaa

SEQ ID NO: 117568 - DNA, 25 bp, Rattus norvegicus
agagtgctcgcctagaatgctggaa

SEQ ID NO: 117569 - DNA, 25 bp, Rattus norvegicus
agagtgctcttgcagagctctcgca

SEQ ID NO: 117570 - DNA, 25 bp, Rattus norvegicus
agagtgctcttggagagctctcgca

SEQ ID NO: 117571 - DNA, 25 bp, Rattus norvegicus
agagtgctgaagaccatgctttaat

SEQ ID NO: 117572 - DNA, 25 bp, Rattus norvegicus
agagtgctgaagtccatgctttaat

SEQ ID NO: 117573 - DNA, 25 bp, Rattus norvegicus
agagtgctgcacagagctcgtggaa

SEQ ID NO: 117574 - DNA, 25 bp, Rattus norvegicus
agagtgctgcactgagctcgtggaa

SEQ ID NO: 117575 - DNA, 25 bp, Rattus norvegicus
agagtgctgcagatacatcctgtat

SEQ ID NO: 117576 - DNA, 25 bp, Rattus norvegicus
agagtgctgcagttacatcctgtat

SEQ ID NO: 117577 - DNA, 25 bp, Rattus norvegicus
agagtgctgcttctctgcactctgc

SEQ ID NO: 117578 - DNA, 25 bp, Rattus norvegicus
agagtgctgcttgtctgcactctgc

SEQ ID NO: 117579 - DNA, 25 bp, Rattus norvegicus
agagtgctggacaaggtatttattt

SEQ ID NO: 117580 - DNA, 25 bp, Rattus norvegicus
agagtgctggacaccggctggccaa

SEQ ID NO: 117581 - DNA, 25 bp, Rattus norvegicus
agagtgctggacactgctctccaag

SEQ ID NO: 117582 - DNA, 25 bp, Rattus norvegicus
agagtgctggactaggtatttattt

SEQ ID NO: 117583 - DNA, 25 bp, Rattus norvegicus
agagtgctggactccggctggccaa

SEQ ID NO: 117584 - DNA, 25 bp, Rattus norvegicus
agagtgctggactctgctctccaag

SEQ ID NO: 117585 - DNA, 25 bp, Rattus norvegicus
agagtgctggccctaatccagtgcc

SEQ ID NO: 117586 - DNA, 25 bp, Rattus norvegicus
agagtgctggccgtaatccagtgcc

SEQ ID NO: 117587 - DNA, 25 bp, Rattus norvegicus
agagtgctgttcacctaaagggcta

SEQ ID NO: 117588 - DNA, 25 bp, Rattus norvegicus
agagtgctgttctcctaaagggcta

SEQ ID NO: 117589 - DNA, 25 bp, Rattus norvegicus
agagtgcttgcaatgtgtctcctcc

SEQ ID NO: 117590 - DNA, 25 bp, Rattus norvegicus
agagtgcttgcattgtgtctcctcc

SEQ ID NO: 117591 - DNA, 25 bp, Rattus norvegicus
agagtgcttttccactgaggcctgt

SEQ ID NO: 117592 - DNA, 25 bp, Rattus norvegicus
agagtgcttttcgactgaggcctgt

SEQ ID NO: 117593 - DNA, 25 bp, Rattus norvegicus
agagtggaacaactgctttaatgca

SEQ ID NO: 117594 - DNA, 25 bp, Rattus norvegicus
agagtggaacaagtgctttaatgca

SEQ ID NO: 117595 - DNA, 25 bp, Rattus norvegicus
agagtggaactgcaacccagctgtc

SEQ ID NO: 117596 - DNA, 25 bp, Rattus norvegicus
agagtggaactggaacccagctgtc

SEQ ID NO: 117597 - DNA, 25 bp, Rattus norvegicus
agagtggaagccacacagcctcaga

SEQ ID NO: 117598 - DNA, 25 bp, Rattus norvegicus
agagtggaagcctcacagcctcaga

SEQ ID NO: 117599 - DNA, 25 bp, Rattus norvegicus
agagtggaccctcaagcagcggcac

SEQ ID NO: 117600 - DNA, 25 bp, Rattus norvegicus
agagtggaccctgaagcagcggcac

SEQ ID NO: 117601 - DNA, 25 bp, Rattus norvegicus
agagtggacggtaaactgctgcaga

SEQ ID NO: 117602 - DNA, 25 bp, Rattus norvegicus
agagtggacggttaactgctgcaga

SEQ ID NO: 117603 - DNA, 25 bp, Rattus norvegicus
agagtggagcacacctcctgggctt

SEQ ID NO: 117604 - DNA, 25 bp, Rattus norvegicus
agagtggagcactcctcctgggctt

SEQ ID NO: 117605 - DNA, 25 bp, Rattus norvegicus
agagtggagcatcgttaccctcaga

SEQ ID NO: 117606 - DNA, 25 bp, Rattus norvegicus
agagtggagcatggttaccctcaga

SEQ ID NO: 117607 - DNA, 25 bp, Rattus norvegicus
agagtggaggacaacccttgccaaa

SEQ ID NO: 117608 - DNA, 25 bp, Rattus norvegicus
agagtggaggactacccttgccaaa

SEQ ID NO: 117609 - DNA, 25 bp, Rattus norvegicus
agagtggagtctcacacgggttccc

SEQ ID NO: 117610 - DNA, 25 bp, Rattus norvegicus
agagtggagtctgacacgggttccc

SEQ ID NO: 117611 - DNA, 25 bp, Rattus norvegicus
agagtggcaactcgcaggctctgaa

SEQ ID NO: 117612 - DNA, 25 bp, Rattus norvegicus
agagtggcaactggcaggctctgaa

SEQ ID NO: 117613 - DNA, 25 bp, Rattus norvegicus
agagtggcaagtatcctggacatgg

SEQ ID NO: 117614 - DNA, 25 bp, Rattus norvegicus
agagtggcaagtttcctggacatgg

SEQ ID NO: 117615 - DNA, 25 bp, Rattus norvegicus
agagtggcacagctctgcgcccaga

SEQ ID NO: 117616 - DNA, 25 bp, Rattus norvegicus
agagtggcacaggtctgcgcccaga

SEQ ID NO: 117617 - DNA, 25 bp, Rattus norvegicus
agagtggcacctacctggcgcttgg

SEQ ID NO: 117618 - DNA, 25 bp, Rattus norvegicus
agagtggcaccttcctggcgcttgg

SEQ ID NO: 117619 - DNA, 25 bp, Rattus norvegicus
agagtggcactgctcccattagtgt

SEQ ID NO: 117620 - DNA, 25 bp, Rattus norvegicus
agagtggcactggtcccattagtgt

SEQ ID NO: 117621 - DNA, 25 bp, Rattus norvegicus
agagtggccgcaatggtctgtaccc

SEQ ID NO: 117622 - DNA, 25 bp, Rattus norvegicus
agagtggccgcattggtctgtaccc

SEQ ID NO: 117623 - DNA, 25 bp, Rattus norvegicus
agagtggcctacagcttccggtaaa

SEQ ID NO: 117624 - DNA, 25 bp, Rattus norvegicus
agagtggcctactgcttccggtaaa

SEQ ID NO: 117625 - DNA, 25 bp, Rattus norvegicus
agagtggcgcgtctgccctcctgtc

SEQ ID NO: 117626 - DNA, 25 bp, Rattus norvegicus
agagtggcgcgtgtgccctcctgtc

SEQ ID NO: 117627 - DNA, 25 bp, Rattus norvegicus
agagtggctccaactgcaaacatct

SEQ ID NO: 117628 - DNA, 25 bp, Rattus norvegicus
agagtggctccatctgcaaacatct

SEQ ID NO: 117629 - DNA, 25 bp, Rattus norvegicus
agagtggctgttaatgcccagagac

SEQ ID NO: 117630 - DNA, 25 bp, Rattus norvegicus
agagtggctgtttatgcccagagac

SEQ ID NO: 117631 - DNA, 25 bp, Rattus norvegicus
agagtggcttatcatcttggcatcc

SEQ ID NO: 117632 - DNA, 25 bp, Rattus norvegicus
agagtggcttatgatcttggcatcc

SEQ ID NO: 117633 - DNA, 25 bp, Rattus norvegicus
agagtggcttcacaaaggcacccca

SEQ ID NO: 117634 - DNA, 25 bp, Rattus norvegicus
agagtggcttcagaaaggcacccca

SEQ ID NO: 117635 - DNA, 25 bp, Rattus norvegicus
agagtggcttgcatttgctgccagc

SEQ ID NO: 117636 - DNA, 25 bp, Rattus norvegicus
agagtggcttgcttttgctgccagc

SEQ ID NO: 117637 - DNA, 25 bp, Rattus norvegicus
agagtgggaaccaatggccgctcca

SEQ ID NO: 117638 - DNA, 25 bp, Rattus norvegicus
agagtgggaacctatggccgctcca

SEQ ID NO: 117639 - DNA, 25 bp, Rattus norvegicus
agagtgggagaacgctatctatgca

SEQ ID NO: 117640 - DNA, 25 bp, Rattus norvegicus
agagtgggagaaggctatctatgca

SEQ ID NO: 117641 - DNA, 25 bp, Rattus norvegicus
agagtgggcgctatccaacccagga

SEQ ID NO: 117642 - DNA, 25 bp, Rattus norvegicus
agagtgggcgctttccaacccagga

SEQ ID NO: 117643 - DNA, 25 bp, Rattus norvegicus
agagtgggtgtaccaagtatattca

SEQ ID NO: 117644 - DNA, 25 bp, Rattus norvegicus
agagtgggtgtagcaagtatattca

SEQ ID NO: 117645 - DNA, 25 bp, Rattus norvegicus
agagtgggttctcactacacctgga

SEQ ID NO: 117646 - DNA, 25 bp, Rattus norvegicus
agagtgggttctgactacacctgga

SEQ ID NO: 117647 - DNA, 25 bp, Rattus norvegicus
agagtggtctccatacagttaggac

SEQ ID NO: 117648 - DNA, 25 bp, Rattus norvegicus
agagtggtctccttacagttaggac

SEQ ID NO: 117649 - DNA, 25 bp, Rattus norvegicus
agagtggtctgtaagctccatcagc

SEQ ID NO: 117650 - DNA, 25 bp, Rattus norvegicus
agagtggtctgtcccctgtaaatgt

SEQ ID NO: 117651 - DNA, 25 bp, Rattus norvegicus
agagtggtctgtgccctgtaaatgt

SEQ ID NO: 117652 - DNA, 25 bp, Rattus norvegicus
agagtggtctgttagctccatcagc

SEQ ID NO: 117653 - DNA, 25 bp, Rattus norvegicus
agagtggtctttctagccaccgctt

SEQ ID NO: 117654 - DNA, 25 bp, Rattus norvegicus
agagtggtctttgtagccaccgctt

SEQ ID NO: 117655 - DNA, 25 bp, Rattus norvegicus
agagtggtgccaactgtccctattc

SEQ ID NO: 117656 - DNA, 25 bp, Rattus norvegicus
agagtggtgccaatatgtcagccct

SEQ ID NO: 117657 - DNA, 25 bp, Rattus norvegicus
agagtggtgccatctgtccctattc

SEQ ID NO: 117658 - DNA, 25 bp, Rattus norvegicus
agagtggtgccattatgtcagccct

SEQ ID NO: 117659 - DNA, 25 bp, Rattus norvegicus
agagtggtgctcctcagcgtatgct

SEQ ID NO: 117660 - DNA, 25 bp, Rattus norvegicus
agagtggtgctcgtcagcgtatgct

SEQ ID NO: 117661 - DNA, 25 bp, Rattus norvegicus
agagtggttcctaggtgaccagtcc

SEQ ID NO: 117662 - DNA, 25 bp, Rattus norvegicus
agagtggttccttggtgaccagtcc

SEQ ID NO: 117663 - DNA, 25 bp, Rattus norvegicus
agagtggtttctatgccctttgtac

SEQ ID NO: 117664 - DNA, 25 bp, Rattus norvegicus
agagtggtttctttgccctttgtac

SEQ ID NO: 117665 - DNA, 25 bp, Rattus norvegicus
agagtgtacgcgactttaggaggcc

SEQ ID NO: 117666 - DNA, 25 bp, Rattus norvegicus
agagtgtacgcgtctttaggaggcc

SEQ ID NO: 117667 - DNA, 25 bp, Rattus norvegicus
agagtgtactccctgttctaacttc

SEQ ID NO: 117668 - DNA, 25 bp, Rattus norvegicus
agagtgtactccgtgttctaacttc

SEQ ID NO: 117669 - DNA, 25 bp, Rattus norvegicus
agagtgtactggatgctgctgtatc

SEQ ID NO: 117670 - DNA, 25 bp, Rattus norvegicus
agagtgtactggttgctgctgtatc

SEQ ID NO: 117671 - DNA, 25 bp, Rattus norvegicus
agagtgtatactcgtctgacgtttg

SEQ ID NO: 117672 - DNA, 25 bp, Rattus norvegicus
agagtgtatactggtctgacgtttg

SEQ ID NO: 117673 - DNA, 25 bp, Rattus norvegicus
agagtgtcacaccttcatgcagaaa

SEQ ID NO: 117674 - DNA, 25 bp, Rattus norvegicus
agagtgtcacacgttcatgcagaaa

SEQ ID NO: 117675 - DNA, 25 bp, Rattus norvegicus
agagtgtcacagcagtaccagccat

SEQ ID NO: 117676 - DNA, 25 bp, Rattus norvegicus
agagtgtcacaggagtaccagccat

SEQ ID NO: 117677 - DNA, 25 bp, Rattus norvegicus
agagtgtcaccacagcagcctgcta

SEQ ID NO: 117678 - DNA, 25 bp, Rattus norvegicus
agagtgtcaccagagcagcctgcta

SEQ ID NO: 117679 - DNA, 25 bp, Rattus norvegicus
agagtgtcagtcagttgtccctatc

SEQ ID NO: 117680 - DNA, 25 bp, Rattus norvegicus
agagtgtcagtctgttgtccctatc

SEQ ID NO: 117681 - DNA, 25 bp, Rattus norvegicus
agagtgtccagcacacacagaggat

SEQ ID NO: 117682 - DNA, 25 bp, Rattus norvegicus
agagtgtccagctcacacagaggat

SEQ ID NO: 117683 - DNA, 25 bp, Rattus norvegicus
agagtgtccctgcagtgcgaaagaa

SEQ ID NO: 117684 - DNA, 25 bp, Rattus norvegicus
agagtgtccctggagtgcgaaagaa

SEQ ID NO: 117685 - DNA, 25 bp, Rattus norvegicus
agagtgtccgggagtgtgcttccaa

SEQ ID NO: 117686 - DNA, 25 bp, Rattus norvegicus
agagtgtccgggtgtgtgcttccaa

SEQ ID NO: 117687 - DNA, 25 bp, Rattus norvegicus
agagtgtcctctcgatgtctgtgtc

SEQ ID NO: 117688 - DNA, 25 bp, Rattus norvegicus
agagtgtcctctggatgtctgtgtc

SEQ ID NO: 117689 - DNA, 25 bp, Rattus norvegicus
agagtgtcctttcagttacctcctt

SEQ ID NO: 117690 - DNA, 25 bp, Rattus norvegicus
agagtgtcctttgagttacctcctt

SEQ ID NO: 117691 - DNA, 25 bp, Rattus norvegicus
agagtgtcgacaatgcagccttcaa

SEQ ID NO: 117692 - DNA, 25 bp, Rattus norvegicus
agagtgtcgacattgcagccttcaa

SEQ ID NO: 117693 - DNA, 25 bp, Rattus norvegicus
agagtgtctatgaccttgccaatga

SEQ ID NO: 117694 - DNA, 25 bp, Rattus norvegicus
agagtgtctatgtccttgccaatga

SEQ ID NO: 117695 - DNA, 25 bp, Rattus norvegicus
agagtgtctcagaagctgaccctga

SEQ ID NO: 117696 - DNA, 25 bp, Rattus norvegicus
agagtgtctcagtagctgaccctga

SEQ ID NO: 117697 - DNA, 25 bp, Rattus norvegicus
agagtgtctcctaccagtgccaggg

SEQ ID NO: 117698 - DNA, 25 bp, Rattus norvegicus
agagtgtctccttccagtgccaggg

SEQ ID NO: 117699 - DNA, 25 bp, Rattus norvegicus
agagtgtgaatcctaggcaccccac

SEQ ID NO: 117700 - DNA, 25 bp, Rattus norvegicus
agagtgtgaatcgtaggcaccccac

SEQ ID NO: 117701 - DNA, 25 bp, Rattus norvegicus
agagtgtgacccaggctgtgtccaa

SEQ ID NO: 117702 - DNA, 25 bp, Rattus norvegicus
agagtgtgaccctggctgtgtccaa

SEQ ID NO: 117703 - DNA, 25 bp, Rattus norvegicus
agagtgtgagttaccatttttcctt

SEQ ID NO: 117704 - DNA, 25 bp, Rattus norvegicus
agagtgtgagtttccatttttcctt

SEQ ID NO: 117705 - DNA, 25 bp, Rattus norvegicus
agagtgtgatgcaccagatcgcggc

SEQ ID NO: 117706 - DNA, 25 bp, Rattus norvegicus
agagtgtgatgctccagatcgcggc

SEQ ID NO: 117707 - DNA, 25 bp, Rattus norvegicus
agagtgtgcgccaggtccaactgga

SEQ ID NO: 117708 - DNA, 25 bp, Rattus norvegicus
agagtgtgcgcctggtccaactgga

SEQ ID NO: 117709 - DNA, 25 bp, Rattus norvegicus
agagtgtgctgtcccctaggttagc

SEQ ID NO: 117710 - DNA, 25 bp, Rattus norvegicus
agagtgtgctgtgccctaggttagc

SEQ ID NO: 117711 - DNA, 25 bp, Rattus norvegicus
agagtgtggaatcttttcggttccg

SEQ ID NO: 117712 - DNA, 25 bp, Rattus norvegicus
agagtgtggaatgttttcggttccg

SEQ ID NO: 117713 - DNA, 25 bp, Rattus norvegicus
agagtgtggattccagccccgagca

SEQ ID NO: 117714 - DNA, 25 bp, Rattus norvegicus
agagtgtggattgcagccccgagca

SEQ ID NO: 117715 - DNA, 25 bp, Rattus norvegicus
agagtgtgggaccttgcttgtacca

SEQ ID NO: 117716 - DNA, 25 bp, Rattus norvegicus
agagtgtgggacgttgcttgtacca

SEQ ID NO: 117717 - DNA, 25 bp, Rattus norvegicus
agagtgtgggccaggtcagacctct

SEQ ID NO: 117718 - DNA, 25 bp, Rattus norvegicus
agagtgtgggcctggtcagacctct

SEQ ID NO: 117719 - DNA, 25 bp, Rattus norvegicus
agagtgtgtctaccgtcttcagtaa

SEQ ID NO: 117720 - DNA, 25 bp, Rattus norvegicus
agagtgtgtctagcgtcttcagtaa

SEQ ID NO: 117721 - DNA, 25 bp, Rattus norvegicus
agagtgtgtcttcgatataatccaa

SEQ ID NO: 117722 - DNA, 25 bp, Rattus norvegicus
agagtgtgtcttggatataatccaa

SEQ ID NO: 117723 - DNA, 25 bp, Rattus norvegicus
agagtgttaagtctcccgcttcctt

SEQ ID NO: 117724 - DNA, 25 bp, Rattus norvegicus
agagtgttaagtgtcccgcttcctt

SEQ ID NO: 117725 - DNA, 25 bp, Rattus norvegicus
agagtgttcacacagacagcagaga

SEQ ID NO: 117726 - DNA, 25 bp, Rattus norvegicus
agagtgttcacagagacagcagaga

SEQ ID NO: 117727 - DNA, 25 bp, Rattus norvegicus
agagtgttcactcgcctagtgtgta

SEQ ID NO: 117728 - DNA, 25 bp, Rattus norvegicus
agagtgttcactggcctagtgtgta

SEQ ID NO: 117729 - DNA, 25 bp, Rattus norvegicus
agagtgttgctgactaccctgttcc

SEQ ID NO: 117730 - DNA, 25 bp, Rattus norvegicus
agagtgttgctgtctaccctgttcc

SEQ ID NO: 117731 - DNA, 25 bp, Rattus norvegicus
agagtgtttcatatcatcggccgtc

SEQ ID NO: 117732 - DNA, 25 bp, Rattus norvegicus
agagtgtttcatttcatcggccgtc

SEQ ID NO: 117733 - DNA, 25 bp, Rattus norvegicus
agagtgtttctgaagactctccctc

SEQ ID NO: 117734 - DNA, 25 bp, Rattus norvegicus
agagtgtttctgatcacgcctgcac

SEQ ID NO: 117735 - DNA, 25 bp, Rattus norvegicus
agagtgtttctgtagactctccctc

SEQ ID NO: 117736 - DNA, 25 bp, Rattus norvegicus
agagtgtttctgttcacgcctgcac

SEQ ID NO: 117737 - DNA, 25 bp, Rattus norvegicus
agagtgttttatatcatcgtgttca

SEQ ID NO: 117738 - DNA, 25 bp, Rattus norvegicus
agagtgttttatttcatcgtgttca

SEQ ID NO: 117739 - DNA, 25 bp, Rattus norvegicus
agagttaaaagcctcgcctggcttc

SEQ ID NO: 117740 - DNA, 25 bp, Rattus norvegicus
agagttaaaagcgtcgcctggcttc

SEQ ID NO: 117741 - DNA, 25 bp, Rattus norvegicus
agagttaagttcatgctcacccagt

SEQ ID NO: 117742 - DNA, 25 bp, Rattus norvegicus
agagttaagttcttgctcacccagt

SEQ ID NO: 117743 - DNA, 25 bp, Rattus norvegicus
agagttaatctcattagggaacatt

SEQ ID NO: 117744 - DNA, 25 bp, Rattus norvegicus
agagttaatctctttagggaacatt

SEQ ID NO: 117745 - DNA, 25 bp, Rattus norvegicus
agagttaatgctcccctgtatgtca

SEQ ID NO: 117746 - DNA, 25 bp, Rattus norvegicus
agagttaatgctgccctgtatgtca

SEQ ID NO: 117747 - DNA, 25 bp, Rattus norvegicus
agagttaatttgacagctgtagtat

SEQ ID NO: 117748 - DNA, 25 bp, Rattus norvegicus
agagttaatttgtcagctgtagtat

SEQ ID NO: 117749 - DNA, 25 bp, Rattus norvegicus
agagttacagccatcagtctcgtgg

SEQ ID NO: 117750 - DNA, 25 bp, Rattus norvegicus
agagttacagccttcagtctcgtgg

SEQ ID NO: 117751 - DNA, 25 bp, Rattus norvegicus
agagttaccagaagactgccacgcc

SEQ ID NO: 117752 - DNA, 25 bp, Rattus norvegicus
agagttaccagatgactgccacgcc

SEQ ID NO: 117753 - DNA, 25 bp, Rattus norvegicus
agagttacctcgatacctccatgtt

SEQ ID NO: 117754 - DNA, 25 bp, Rattus norvegicus
agagttacctcgttacctccatgtt

SEQ ID NO: 117755 - DNA, 25 bp, Rattus norvegicus
agagttacctgcatgcctaaaggaa

SEQ ID NO: 117756 - DNA, 25 bp, Rattus norvegicus
agagttacctgcttgcctaaaggaa

SEQ ID NO: 117757 - DNA, 25 bp, Rattus norvegicus
agagttacctggagacatctggaac

SEQ ID NO: 117758 - DNA, 25 bp, Rattus norvegicus
agagttacctggtgacatctggaac

SEQ ID NO: 117759 - DNA, 25 bp, Rattus norvegicus
agagttacgatgacagtgcattcaa

SEQ ID NO: 117760 - DNA, 25 bp, Rattus norvegicus
agagttacgatgtcagtgcattcaa

SEQ ID NO: 117761 - DNA, 25 bp, Rattus norvegicus
agagttagcttaaagttctagataa

SEQ ID NO: 117762 - DNA, 25 bp, Rattus norvegicus
agagttagcttatagttctagataa

SEQ ID NO: 117763 - DNA, 25 bp, Rattus norvegicus
agagttagttaccacagagcatgga

SEQ ID NO: 117764 - DNA, 25 bp, Rattus norvegicus
agagttagttacgacagagcatgga

SEQ ID NO: 117765 - DNA, 25 bp, Rattus norvegicus
agagttagttctatccatcgaggag

SEQ ID NO: 117766 - DNA, 25 bp, Rattus norvegicus
agagttagttctttccatcgaggag

SEQ ID NO: 117767 - DNA, 25 bp, Rattus norvegicus
agagttataactcggcggtcaccaa

SEQ ID NO: 117768 - DNA, 25 bp, Rattus norvegicus
agagttataactgggcggtcaccaa

SEQ ID NO: 117769 - DNA, 25 bp, Rattus norvegicus
agagttataatgaaaaggcacgatc

SEQ ID NO: 117770 - DNA, 25 bp, Rattus norvegicus
agagttataatgtaaaggcacgatc

SEQ ID NO: 117771 - DNA, 25 bp, Rattus norvegicus
agagttatgcctaacatttctcccc

SEQ ID NO: 117772 - DNA, 25 bp, Rattus norvegicus
agagttatgccttacatttctcccc

SEQ ID NO: 117773 - DNA, 25 bp, Rattus norvegicus
agagttattagcacgtcaggattat

SEQ ID NO: 117774 - DNA, 25 bp, Rattus norvegicus
agagttattagctcgtcaggattat

SEQ ID NO: 117775 - DNA, 25 bp, Rattus norvegicus
agagttcaaacccacctccggagag

SEQ ID NO: 117776 - DNA, 25 bp, Rattus norvegicus
agagttcaaaccgacctccggagag

SEQ ID NO: 117777 - DNA, 25 bp, Rattus norvegicus
agagttcaaagtcccactcaactgt

SEQ ID NO: 117778 - DNA, 25 bp, Rattus norvegicus
agagttcaaagtgccactcaactgt

SEQ ID NO: 117779 - DNA, 25 bp, Rattus norvegicus
agagttcaacacagaccagatgttt

SEQ ID NO: 117780 - DNA, 25 bp, Rattus norvegicus
agagttcaacactgaccagatgttt

SEQ ID NO: 117781 - DNA, 25 bp, Rattus norvegicus
agagttcaacccacaaggaagaagg

SEQ ID NO: 117782 - DNA, 25 bp, Rattus norvegicus
agagttcaaccctcaaggaagaagg

SEQ ID NO: 117783 - DNA, 25 bp, Rattus norvegicus
agagttcaacttcccaaattcttgg

SEQ ID NO: 117784 - DNA, 25 bp, Rattus norvegicus
agagttcaacttgccaaattcttgg

SEQ ID NO: 117785 - DNA, 25 bp, Rattus norvegicus
agagttcacactacagcatttccat

SEQ ID NO: 117786 - DNA, 25 bp, Rattus norvegicus
agagttcacacttcagcatttccat

SEQ ID NO: 117787 - DNA, 25 bp, Rattus norvegicus
agagttcacagtctcagtacattat

SEQ ID NO: 117788 - DNA, 25 bp, Rattus norvegicus
agagttcacagtgtcagtacattat

SEQ ID NO: 117789 - DNA, 25 bp, Rattus norvegicus
agagttcacccgaaaggccctgaat

SEQ ID NO: 117790 - DNA, 25 bp, Rattus norvegicus
agagttcacccgcattgcagtagcc

SEQ ID NO: 117791 - DNA, 25 bp, Rattus norvegicus
agagttcacccggattgcagtagcc

SEQ ID NO: 117792 - DNA, 25 bp, Rattus norvegicus
agagttcacccgtaaggccctgaat

SEQ ID NO: 117793 - DNA, 25 bp, Rattus norvegicus
agagttcacgtcctgtgtttagaca

SEQ ID NO: 117794 - DNA, 25 bp, Rattus norvegicus
agagttcacgtcgtgtgtttagaca

SEQ ID NO: 117795 - DNA, 25 bp, Rattus norvegicus
agagttcactacagggttcagcttc

SEQ ID NO: 117796 - DNA, 25 bp, Rattus norvegicus
agagttcactactgggttcagcttc

SEQ ID NO: 117797 - DNA, 25 bp, Rattus norvegicus
agagttcactgaataaaattttcca

SEQ ID NO: 117798 - DNA, 25 bp, Rattus norvegicus
agagttcactgattaaaattttcca

SEQ ID NO: 117799 - DNA, 25 bp, Rattus norvegicus
agagttcagaggactgcccacctct

SEQ ID NO: 117800 - DNA, 25 bp, Rattus norvegicus
agagttcagaggcaggcttgtctat

SEQ ID NO: 117801 - DNA, 25 bp, Rattus norvegicus
agagttcagagggaggcttgtctat

SEQ ID NO: 117802 - DNA, 25 bp, Rattus norvegicus
agagttcagaggtctgcccacctct

SEQ ID NO: 117803 - DNA, 25 bp, Rattus norvegicus
agagttcagcaacaccacttgtggt

SEQ ID NO: 117804 - DNA, 25 bp, Rattus norvegicus
agagttcagcaagaccacttgtggt

SEQ ID NO: 117805 - DNA, 25 bp, Rattus norvegicus
agagttcagcctcttcttcggaagc

SEQ ID NO: 117806 - DNA, 25 bp, Rattus norvegicus
agagttcagcctgttcttcggaagc

SEQ ID NO: 117807 - DNA, 25 bp, Rattus norvegicus
agagttcagtaccaacaaagttgtt

SEQ ID NO: 117808 - DNA, 25 bp, Rattus norvegicus
agagttcagtacgaacaaagttgtt

SEQ ID NO: 117809 - DNA, 25 bp, Rattus norvegicus
agagttcatcacaagtccaggtaga

SEQ ID NO: 117810 - DNA, 25 bp, Rattus norvegicus
agagttcatcactagtccaggtaga

SEQ ID NO: 117811 - DNA, 25 bp, Rattus norvegicus
agagttcatcggagaagttcaagaa

SEQ ID NO: 117812 - DNA, 25 bp, Rattus norvegicus
agagttcatcggtgaagttcaagaa

SEQ ID NO: 117813 - DNA, 25 bp, Rattus norvegicus
agagttccaattcctgtctgctgga

SEQ ID NO: 117814 - DNA, 25 bp, Rattus norvegicus
agagttccaattgctgtctgctgga

SEQ ID NO: 117815 - DNA, 25 bp, Rattus norvegicus
agagttccagacctgctcagacagg

SEQ ID NO: 117816 - DNA, 25 bp, Rattus norvegicus
agagttccagacgtgctcagacagg

SEQ ID NO: 117817 - DNA, 25 bp, Rattus norvegicus
agagttccagagacacggttccgat

SEQ ID NO: 117818 - DNA, 25 bp, Rattus norvegicus
agagttccagagtcacggttccgat

SEQ ID NO: 117819 - DNA, 25 bp, Rattus norvegicus
agagttccagcgagggcagtatcca

SEQ ID NO: 117820 - DNA, 25 bp, Rattus norvegicus
agagttccagcgtgggcagtatcca

SEQ ID NO: 117821 - DNA, 25 bp, Rattus norvegicus
agagttccagtcagttctcgtccag

SEQ ID NO: 117822 - DNA, 25 bp, Rattus norvegicus
agagttccagtctgttctcgtccag

SEQ ID NO: 117823 - DNA, 25 bp, Rattus norvegicus
agagttcccaacagaatatcttata

SEQ ID NO: 117824 - DNA, 25 bp, Rattus norvegicus
agagttcccaactgaatatcttata

SEQ ID NO: 117825 - DNA, 25 bp, Rattus norvegicus
agagttcccaggcttccagcactac

SEQ ID NO: 117826 - DNA, 25 bp, Rattus norvegicus
agagttcccagggttccagcactac

SEQ ID NO: 117827 - DNA, 25 bp, Rattus norvegicus
agagttcccctcacagaatgatata

SEQ ID NO: 117828 - DNA, 25 bp, Rattus norvegicus
agagttcccctctcagaatgatata

SEQ ID NO: 117829 - DNA, 25 bp, Rattus norvegicus
agagttcccctgagctgctgctaga

SEQ ID NO: 117830 - DNA, 25 bp, Rattus norvegicus
agagttcccctgtgctgctgctaga

SEQ ID NO: 117831 - DNA, 25 bp, Rattus norvegicus
agagttccccttacatgactgcatt

SEQ ID NO: 117832 - DNA, 25 bp, Rattus norvegicus
agagttcccctttcatgactgcatt

SEQ ID NO: 117833 - DNA, 25 bp, Rattus norvegicus
agagttccctacagcccaattgttt

SEQ ID NO: 117834 - DNA, 25 bp, Rattus norvegicus
agagttccctactgcccaattgttt

SEQ ID NO: 117835 - DNA, 25 bp, Rattus norvegicus
agagttccctctacagagtcccaat

SEQ ID NO: 117836 - DNA, 25 bp, Rattus norvegicus
agagttccctcttcagagtcccaat

SEQ ID NO: 117837 - DNA, 25 bp, Rattus norvegicus
agagttccctgcaaaagccgtatct

SEQ ID NO: 117838 - DNA, 25 bp, Rattus norvegicus
agagttccctgctaaagccgtatct

SEQ ID NO: 117839 - DNA, 25 bp, Rattus norvegicus
agagttccgcagcatacagtaacct

SEQ ID NO: 117840 - DNA, 25 bp, Rattus norvegicus
agagttccgcaggatacagtaacct

SEQ ID NO: 117841 - DNA, 25 bp, Rattus norvegicus
agagttccggacacagaagctgtac

SEQ ID NO: 117842 - DNA, 25 bp, Rattus norvegicus
agagttccggactcagaagctgtac

SEQ ID NO: 117843 - DNA, 25 bp, Rattus norvegicus
agagttcctgaaaattttgctgtat

SEQ ID NO: 117844 - DNA, 25 bp, Rattus norvegicus
agagttcctgaatattttgctgtat

SEQ ID NO: 117845 - DNA, 25 bp, Rattus norvegicus
agagttcctggacctttgtgaatcc

SEQ ID NO: 117846 - DNA, 25 bp, Rattus norvegicus
agagttcctggagctttgtgaatcc

SEQ ID NO: 117847 - DNA, 25 bp, Rattus norvegicus
agagttcctgtgagcattcgattac

SEQ ID NO: 117848 - DNA, 25 bp, Rattus norvegicus
agagttcctgtgtgcattcgattac

SEQ ID NO: 117849 - DNA, 25 bp, Rattus norvegicus
agagttccttcaacagtaggtgggt

SEQ ID NO: 117850 - DNA, 25 bp, Rattus norvegicus
agagttccttcatcagtaggtgggt

SEQ ID NO: 117851 - DNA, 25 bp, Rattus norvegicus
agagttcgatccatccaaggagcgc

SEQ ID NO: 117852 - DNA, 25 bp, Rattus norvegicus
agagttcgatccttccaaggagcgc

SEQ ID NO: 117853 - DNA, 25 bp, Rattus norvegicus
agagttcgcaccaaaaggcgcatct

SEQ ID NO: 117854 - DNA, 25 bp, Rattus norvegicus
agagttcgcacctaaaggcgcatct

SEQ ID NO: 117855 - DNA, 25 bp, Rattus norvegicus
agagttcgtctgattttccatctga

SEQ ID NO: 117856 - DNA, 25 bp, Rattus norvegicus
agagttcgtctgtttttccatctga

SEQ ID NO: 117857 - DNA, 25 bp, Rattus norvegicus
agagttctacatccattggaaagct

SEQ ID NO: 117858 - DNA, 25 bp, Rattus norvegicus
agagttctacatcctactgctgaga

SEQ ID NO: 117859 - DNA, 25 bp, Rattus norvegicus
agagttctacatgcattggaaagct

SEQ ID NO: 117860 - DNA, 25 bp, Rattus norvegicus
agagttctacatgctactgctgaga

SEQ ID NO: 117861 - DNA, 25 bp, Rattus norvegicus
agagttctatgtccgacttctcaga

SEQ ID NO: 117862 - DNA, 25 bp, Rattus norvegicus
agagttctatgtgcgacttctcaga

SEQ ID NO: 117863 - DNA, 25 bp, Rattus norvegicus
agagttctcagtatcaccttcattt

SEQ ID NO: 117864 - DNA, 25 bp, Rattus norvegicus
agagttctcagtttcaccttcattt

SEQ ID NO: 117865 - DNA, 25 bp, Rattus norvegicus
agagttctccgtattcctgtggcca

SEQ ID NO: 117866 - DNA, 25 bp, Rattus norvegicus
agagttctccgttttcctgtggcca

SEQ ID NO: 117867 - DNA, 25 bp, Rattus norvegicus
agagttctcgtgattgacctctgct

SEQ ID NO: 117868 - DNA, 25 bp, Rattus norvegicus
agagttctcgtgtttgacctctgct

SEQ ID NO: 117869 - DNA, 25 bp, Rattus norvegicus
agagttctgaccctgttgttttcac

SEQ ID NO: 117870 - DNA, 25 bp, Rattus norvegicus
agagttctgaccgtgttgttttcac

SEQ ID NO: 117871 - DNA, 25 bp, Rattus norvegicus
agagttctgagccttgggtctccaa

SEQ ID NO: 117872 - DNA, 25 bp, Rattus norvegicus
agagttctgagcgttgggtctccaa

SEQ ID NO: 117873 - DNA, 25 bp, Rattus norvegicus
agagttctgccaagcaccacaggaa

SEQ ID NO: 117874 - DNA, 25 bp, Rattus norvegicus
agagttctgccatgcaccacaggaa

SEQ ID NO: 117875 - DNA, 25 bp, Rattus norvegicus
agagttctgcccatgcggaggttag

SEQ ID NO: 117876 - DNA, 25 bp, Rattus norvegicus
agagttctgcccttgcggaggttag

SEQ ID NO: 117877 - DNA, 25 bp, Rattus norvegicus
agagttctgcctcaagagggtctcc

SEQ ID NO: 117878 - DNA, 25 bp, Rattus norvegicus
agagttctgcctgaagagggtctcc

SEQ ID NO: 117879 - DNA, 25 bp, Rattus norvegicus
agagttctgctcagagggaggcaaa

SEQ ID NO: 117880 - DNA, 25 bp, Rattus norvegicus
agagttctgctctgagggaggcaaa

SEQ ID NO: 117881 - DNA, 25 bp, Rattus norvegicus
agagttctgctgaggcagccactaa

SEQ ID NO: 117882 - DNA, 25 bp, Rattus norvegicus
agagttctgctgtggcagccactaa

SEQ ID NO: 117883 - DNA, 25 bp, Rattus norvegicus
agagttctgcttattgtacatatta

SEQ ID NO: 117884 - DNA, 25 bp, Rattus norvegicus
agagttctgctttttgtacatatta

SEQ ID NO: 117885 - DNA, 25 bp, Rattus norvegicus
agagttctgtcacattttgtgtcac

SEQ ID NO: 117886 - DNA, 25 bp, Rattus norvegicus
agagttctgtcagattttgtgtcac

SEQ ID NO: 117887 - DNA, 25 bp, Rattus norvegicus
agagttctgtttctcacacaacggg

SEQ ID NO: 117888 - DNA, 25 bp, Rattus norvegicus
agagttctgtttgtcacacaacggg

SEQ ID NO: 117889 - DNA, 25 bp, Rattus norvegicus
agagttcttaacagcacatcacccg

SEQ ID NO: 117890 - DNA, 25 bp, Rattus norvegicus
agagttcttaactgcacatcacccg

SEQ ID NO: 117891 - DNA, 25 bp, Rattus norvegicus
agagttcttcaacttctttcctggg

SEQ ID NO: 117892 - DNA, 25 bp, Rattus norvegicus
agagttcttcaagttctttcctggg

SEQ ID NO: 117893 - DNA, 25 bp, Rattus norvegicus
agagttcttcatcgttgtgagccac

SEQ ID NO: 117894 - DNA, 25 bp, Rattus norvegicus
agagttcttcatggttgtgagccac

SEQ ID NO: 117895 - DNA, 25 bp, Rattus norvegicus
agagttcttcccacataatagcaag

SEQ ID NO: 117896 - DNA, 25 bp, Rattus norvegicus
agagttcttccctcataatagcaag

SEQ ID NO: 117897 - DNA, 25 bp, Rattus norvegicus
agagttcttctcagtggtgactaca

SEQ ID NO: 117898 - DNA, 25 bp, Rattus norvegicus
agagttcttctctgtggtgactaca

SEQ ID NO: 117899 - DNA, 25 bp, Rattus norvegicus
agagttcttgacaatgatggctaga

SEQ ID NO: 117900 - DNA, 25 bp, Rattus norvegicus
agagttcttgactatgatggctaga

SEQ ID NO: 117901 - DNA, 25 bp, Rattus norvegicus
agagttctttagcatctgtggcaga

SEQ ID NO: 117902 - DNA, 25 bp, Rattus norvegicus
agagttctttagctttggtctccca

SEQ ID NO: 117903 - DNA, 25 bp, Rattus norvegicus
agagttctttaggatctgtggcaga

SEQ ID NO: 117904 - DNA, 25 bp, Rattus norvegicus
agagttctttaggtttggtctccca

SEQ ID NO: 117905 - DNA, 25 bp, Rattus norvegicus
agagttctttctcacagcgctgcag

SEQ ID NO: 117906 - DNA, 25 bp, Rattus norvegicus
agagttctttctcaccgatccacca

SEQ ID NO: 117907 - DNA, 25 bp, Rattus norvegicus
agagttctttctgacagcgctgcag

SEQ ID NO: 117908 - DNA, 25 bp, Rattus norvegicus
agagttctttctgaccgatccacca

SEQ ID NO: 117909 - DNA, 25 bp, Rattus norvegicus
agagttctttgtcaaacctgtccct

SEQ ID NO: 117910 - DNA, 25 bp, Rattus norvegicus
agagttctttgtgaaacctgtccct

SEQ ID NO: 117911 - DNA, 25 bp, Rattus norvegicus
agagttgaacccacacaagtcgttt

SEQ ID NO: 117912 - DNA, 25 bp, Rattus norvegicus
agagttgaacccctgctagtataat

SEQ ID NO: 117913 - DNA, 25 bp, Rattus norvegicus
agagttgaacccgtgctagtataat

SEQ ID NO: 117914 - DNA, 25 bp, Rattus norvegicus
agagttgaaccctcacaagtcgttt

SEQ ID NO: 117915 - DNA, 25 bp, Rattus norvegicus
agagttgaagctaggcccttgtgaa

SEQ ID NO: 117916 - DNA, 25 bp, Rattus norvegicus
agagttgaagcttggcccttgtgaa

SEQ ID NO: 117917 - DNA, 25 bp, Rattus norvegicus
agagttgaagtcagtggcctcactg

SEQ ID NO: 117918 - DNA, 25 bp, Rattus norvegicus
agagttgaagtctgtggcctcactg

SEQ ID NO: 117919 - DNA, 25 bp, Rattus norvegicus
agagttgaccctagcttaattacca

SEQ ID NO: 117920 - DNA, 25 bp, Rattus norvegicus
agagttgacccttgcttaattacca

SEQ ID NO: 117921 - DNA, 25 bp, Rattus norvegicus
agagttgaccggaagcacagaaagc

SEQ ID NO: 117922 - DNA, 25 bp, Rattus norvegicus
agagttgaccggtagcacagaaagc

SEQ ID NO: 117923 - DNA, 25 bp, Rattus norvegicus
agagttgagaacagctgtgctttat

SEQ ID NO: 117924 - DNA, 25 bp, Rattus norvegicus
agagttgagaactgctgtgctttat

SEQ ID NO: 117925 - DNA, 25 bp, Rattus norvegicus
agagttgcagccatataaatgcgga

SEQ ID NO: 117926 - DNA, 25 bp, Rattus norvegicus
agagttgcagccttataaatgcgga

SEQ ID NO: 117927 - DNA, 25 bp, Rattus norvegicus
agagttgcaggcacatggtccatgc

SEQ ID NO: 117928 - DNA, 25 bp, Rattus norvegicus
agagttgcaggcatcctctgccttc

SEQ ID NO: 117929 - DNA, 25 bp, Rattus norvegicus
agagttgcaggctcatggtccatgc

SEQ ID NO: 117930 - DNA, 25 bp, Rattus norvegicus
agagttgcaggcttcctctgccttc

SEQ ID NO: 117931 - DNA, 25 bp, Rattus norvegicus
agagttgccactatgcagtctgagc

SEQ ID NO: 117932 - DNA, 25 bp, Rattus norvegicus
agagttgccactttgcagtctgagc

SEQ ID NO: 117933 - DNA, 25 bp, Rattus norvegicus
agagttgccaggacccagagcaaat

SEQ ID NO: 117934 - DNA, 25 bp, Rattus norvegicus
agagttgccaggtcccagagcaaat

SEQ ID NO: 117935 - DNA, 25 bp, Rattus norvegicus
agagttgcggatagtcccttgatga

SEQ ID NO: 117936 - DNA, 25 bp, Rattus norvegicus
agagttgcggattgtcccttgatga

SEQ ID NO: 117937 - DNA, 25 bp, Rattus norvegicus
agagttgctaagcagtaaaccgaat

SEQ ID NO: 117938 - DNA, 25 bp, Rattus norvegicus
agagttgctaaggagtaaaccgaat

SEQ ID NO: 117939 - DNA, 25 bp, Rattus norvegicus
agagttgctccactccaggaatgaa

SEQ ID NO: 117940 - DNA, 25 bp, Rattus norvegicus
agagttgctccagtccaggaatgaa

SEQ ID NO: 117941 - DNA, 25 bp, Rattus norvegicus
agagttgctgcaaaacatgactggc

SEQ ID NO: 117942 - DNA, 25 bp, Rattus norvegicus
agagttgctgcataacatgactggc

SEQ ID NO: 117943 - DNA, 25 bp, Rattus norvegicus
agagttgcttgcaattttgatttct

SEQ ID NO: 117944 - DNA, 25 bp, Rattus norvegicus
agagttgcttgctattttgatttct

SEQ ID NO: 117945 - DNA, 25 bp, Rattus norvegicus
agagttggacctataaattacagca

SEQ ID NO: 117946 - DNA, 25 bp, Rattus norvegicus
agagttggacctttaaattacagca

SEQ ID NO: 117947 - DNA, 25 bp, Rattus norvegicus
agagttggatctctagcggtccttt

SEQ ID NO: 117948 - DNA, 25 bp, Rattus norvegicus
agagttggatctgtagcggtccttt

SEQ ID NO: 117949 - DNA, 25 bp, Rattus norvegicus
agagttggccaactacgggctgccc

SEQ ID NO: 117950 - DNA, 25 bp, Rattus norvegicus
agagttggccaacttccagttctca

SEQ ID NO: 117951 - DNA, 25 bp, Rattus norvegicus
agagttggccaagtacgggctgccc

SEQ ID NO: 117952 - DNA, 25 bp, Rattus norvegicus
agagttggccaagttccagttctca

SEQ ID NO: 117953 - DNA, 25 bp, Rattus norvegicus
agagttgggtgcctccattacaaaa

SEQ ID NO: 117954 - DNA, 25 bp, Rattus norvegicus
agagttgggtgcgtccattacaaaa

SEQ ID NO: 117955 - DNA, 25 bp, Rattus norvegicus
agagttggtctcagcagttagcctg

SEQ ID NO: 117956 - DNA, 25 bp, Rattus norvegicus
agagttggtctctgcagttagcctg

SEQ ID NO: 117957 - DNA, 25 bp, Rattus norvegicus
agagttggtgcccagtagtgaccca

SEQ ID NO: 117958 - DNA, 25 bp, Rattus norvegicus
agagttggtgccgagtagtgaccca

SEQ ID NO: 117959 - DNA, 25 bp, Rattus norvegicus
agagttgtatccagaagagtttgaa

SEQ ID NO: 117960 - DNA, 25 bp, Rattus norvegicus
agagttgtatcctgaagagtttgaa

SEQ ID NO: 117961 - DNA, 25 bp, Rattus norvegicus
agagttgtattactcctggcttgta

SEQ ID NO: 117962 - DNA, 25 bp, Rattus norvegicus
agagttgtattagtcctggcttgta

SEQ ID NO: 117963 - DNA, 25 bp, Rattus norvegicus
agagttgtcacccatcagcgagatg

SEQ ID NO: 117964 - DNA, 25 bp, Rattus norvegicus
agagttgtcaccgatcagcgagatg

SEQ ID NO: 117965 - DNA, 25 bp, Rattus norvegicus
agagttgtccccaatagctgcttaa

SEQ ID NO: 117966 - DNA, 25 bp, Rattus norvegicus
agagttgtcccctatagctgcttaa

SEQ ID NO: 117967 - DNA, 25 bp, Rattus norvegicus
agagttgtctgcaagagttctaacc

SEQ ID NO: 117968 - DNA, 25 bp, Rattus norvegicus
agagttgtctgcagtatccaggctt

SEQ ID NO: 117969 - DNA, 25 bp, Rattus norvegicus
agagttgtctgctagagttctaacc

SEQ ID NO: 117970 - DNA, 25 bp, Rattus norvegicus
agagttgtctgctgtatccaggctt

SEQ ID NO: 117971 - DNA, 25 bp, Rattus norvegicus
agagttgtgacaagcaagcctgtga

SEQ ID NO: 117972 - DNA, 25 bp, Rattus norvegicus
agagttgtgacatgcaagcctgtga

SEQ ID NO: 117973 - DNA, 25 bp, Rattus norvegicus
agagttgtgctgctatgctttcttt

SEQ ID NO: 117974 - DNA, 25 bp, Rattus norvegicus
agagttgtgctggtatgctttcttt

SEQ ID NO: 117975 - DNA, 25 bp, Rattus norvegicus
agagttgttacccagcaggtcgtct

SEQ ID NO: 117976 - DNA, 25 bp, Rattus norvegicus
agagttgttaccgagcaggtcgtct

SEQ ID NO: 117977 - DNA, 25 bp, Rattus norvegicus
agagttgttcgaagtgccaaggaca

SEQ ID NO: 117978 - DNA, 25 bp, Rattus norvegicus
agagttgttcgatgtgccaaggaca

SEQ ID NO: 117979 - DNA, 25 bp, Rattus norvegicus
agagttgttcgcaagcatttttatt

SEQ ID NO: 117980 - DNA, 25 bp, Rattus norvegicus
agagttgttcgctagcatttttatt

SEQ ID NO: 117981 - DNA, 25 bp, Rattus norvegicus
agagttgtttaacccgatccgctga

SEQ ID NO: 117982 - DNA, 25 bp, Rattus norvegicus
agagttgtttaagccgatccgctga

SEQ ID NO: 117983 - DNA, 25 bp, Rattus norvegicus
agagttgtttccatcctgaatttca

SEQ ID NO: 117984 - DNA, 25 bp, Rattus norvegicus
agagttgtttccttcctgaatttca

SEQ ID NO: 117985 - DNA, 25 bp, Rattus norvegicus
agagttgtttgcaactggttgcgta

SEQ ID NO: 117986 - DNA, 25 bp, Rattus norvegicus
agagttgtttgcacagagacctgac

SEQ ID NO: 117987 - DNA, 25 bp, Rattus norvegicus
agagttgtttgctactggttgcgta

SEQ ID NO: 117988 - DNA, 25 bp, Rattus norvegicus
agagttgtttgctcagagacctgac

SEQ ID NO: 117989 - DNA, 25 bp, Rattus norvegicus
agagtttaaacccagacacaccgag

SEQ ID NO: 117990 - DNA, 25 bp, Rattus norvegicus
agagtttaaaccgagacacaccgag

SEQ ID NO: 117991 - DNA, 25 bp, Rattus norvegicus
agagtttataccagtcgtctccact

SEQ ID NO: 117992 - DNA, 25 bp, Rattus norvegicus
agagtttatacctgtcgtctccact

SEQ ID NO: 117993 - DNA, 25 bp, Rattus norvegicus
agagtttatagcaggagcccgagcg

SEQ ID NO: 117994 - DNA, 25 bp, Rattus norvegicus
agagtttatagctggagcccgagcg

SEQ ID NO: 117995 - DNA, 25 bp, Rattus norvegicus
agagtttcaagcatatgactgttaa

SEQ ID NO: 117996 - DNA, 25 bp, Rattus norvegicus
agagtttcaagcttatgactgttaa

SEQ ID NO: 117997 - DNA, 25 bp, Rattus norvegicus
agagtttcagcgactggcagctcaa

SEQ ID NO: 117998 - DNA, 25 bp, Rattus norvegicus
agagtttcagcgtctggcagctcaa

SEQ ID NO: 117999 - DNA, 25 bp, Rattus norvegicus
agagtttcagggacaacctcagggc

SEQ ID NO: 118000 - DNA, 25 bp, Rattus norvegicus
agagtttcagggtcaacctcagggc

SEQ ID NO: 118001 - DNA, 25 bp, Rattus norvegicus
agagtttcagtcaggcctcagttac

SEQ ID NO: 118002 - DNA, 25 bp, Rattus norvegicus
agagtttcagtctggcctcagttac

SEQ ID NO: 118003 - DNA, 25 bp, Rattus norvegicus
agagtttcattacaaccgctacctg

SEQ ID NO: 118004 - DNA, 25 bp, Rattus norvegicus
agagtttcattagaaccgctacctg

SEQ ID NO: 118005 - DNA, 25 bp, Rattus norvegicus
agagtttccaacatcttgagaacat

SEQ ID NO: 118006 - DNA, 25 bp, Rattus norvegicus
agagtttccaacttcttgagaacat

SEQ ID NO: 118007 - DNA, 25 bp, Rattus norvegicus
agagtttccataactctggctggag

SEQ ID NO: 118008 - DNA, 25 bp, Rattus norvegicus
agagtttccatatctctggctggag

SEQ ID NO: 118009 - DNA, 25 bp, Rattus norvegicus
agagtttcccttcatctgtggcaca

SEQ ID NO: 118010 - DNA, 25 bp, Rattus norvegicus
agagtttcccttgatctgtggcaca

SEQ ID NO: 118011 - DNA, 25 bp, Rattus norvegicus
agagtttcgggacagtagccttcct

SEQ ID NO: 118012 - DNA, 25 bp, Rattus norvegicus
agagtttcgggagagtagccttcct

SEQ ID NO: 118013 - DNA, 25 bp, Rattus norvegicus
agagtttctcccacggtacaaggtg

SEQ ID NO: 118014 - DNA, 25 bp, Rattus norvegicus
agagtttctccccatatgtatatat

SEQ ID NO: 118015 - DNA, 25 bp, Rattus norvegicus
agagtttctcccgatatgtatatat

SEQ ID NO: 118016 - DNA, 25 bp, Rattus norvegicus
agagtttctccctcggtacaaggtg

SEQ ID NO: 118017 - DNA, 25 bp, Rattus norvegicus
agagtttctctccaatccctttatt

SEQ ID NO: 118018 - DNA, 25 bp, Rattus norvegicus
agagtttctctcgaatccctttatt

SEQ ID NO: 118019 - DNA, 25 bp, Rattus norvegicus
agagtttctcttctgggtctccggc

SEQ ID NO: 118020 - DNA, 25 bp, Rattus norvegicus
agagtttctcttgtgggtctccggc

SEQ ID NO: 118021 - DNA, 25 bp, Rattus norvegicus
agagtttctggcctgggacctgaac

SEQ ID NO: 118022 - DNA, 25 bp, Rattus norvegicus
agagtttctggcgtgggacctgaac

SEQ ID NO: 118023 - DNA, 25 bp, Rattus norvegicus
agagtttcttagacattcagtaatg

SEQ ID NO: 118024 - DNA, 25 bp, Rattus norvegicus
agagtttcttagtcattcagtaatg

SEQ ID NO: 118025 - DNA, 25 bp, Rattus norvegicus
agagtttgaataagatgccctcccc

SEQ ID NO: 118026 - DNA, 25 bp, Rattus norvegicus
agagtttgaatatgatgccctcccc

SEQ ID NO: 118027 - DNA, 25 bp, Rattus norvegicus
agagtttgacacagaccaggaccct

SEQ ID NO: 118028 - DNA, 25 bp, Rattus norvegicus
agagtttgacactgaccaggaccct

SEQ ID NO: 118029 - DNA, 25 bp, Rattus norvegicus
agagtttgcatactctgatgtccct

SEQ ID NO: 118030 - DNA, 25 bp, Rattus norvegicus
agagtttgcatagtctgatgtccct

SEQ ID NO: 118031 - DNA, 25 bp, Rattus norvegicus
agagtttgcgaaccgcttccaggaa

SEQ ID NO: 118032 - DNA, 25 bp, Rattus norvegicus
agagtttgcgaagcgcttccaggaa

SEQ ID NO: 118033 - DNA, 25 bp, Rattus norvegicus
agagtttgcgatagtgcccttgcac

SEQ ID NO: 118034 - DNA, 25 bp, Rattus norvegicus
agagtttgcgattgtgcccttgcac

SEQ ID NO: 118035 - DNA, 25 bp, Rattus norvegicus
agagtttgctaaatcacctgctgcc

SEQ ID NO: 118036 - DNA, 25 bp, Rattus norvegicus
agagtttgctaattcacctgctgcc

SEQ ID NO: 118037 - DNA, 25 bp, Rattus norvegicus
agagtttgctatctctgtcacctcg

SEQ ID NO: 118038 - DNA, 25 bp, Rattus norvegicus
agagtttgctatgtctgtcacctcg

SEQ ID NO: 118039 - DNA, 25 bp, Rattus norvegicus
agagtttgctttacacccagccaag

SEQ ID NO: 118040 - DNA, 25 bp, Rattus norvegicus
agagtttgcttttcacccagccaag

SEQ ID NO: 118041 - DNA, 25 bp, Rattus norvegicus
agagtttggcatcttggacaaggtc

SEQ ID NO: 118042 - DNA, 25 bp, Rattus norvegicus
agagtttggcatgttggacaaggtc

SEQ ID NO: 118043 - DNA, 25 bp, Rattus norvegicus
agagtttgtcacagttggatcgccc

SEQ ID NO: 118044 - DNA, 25 bp, Rattus norvegicus
agagtttgtcactgttggatcgccc

SEQ ID NO: 118045 - DNA, 25 bp, Rattus norvegicus
agagtttgtccgatctgtgcaccct

SEQ ID NO: 118046 - DNA, 25 bp, Rattus norvegicus
agagtttgtccgttctgtgcaccct

SEQ ID NO: 118047 - DNA, 25 bp, Rattus norvegicus
agagtttgtggaaccgttcgcgaga

SEQ ID NO: 118048 - DNA, 25 bp, Rattus norvegicus
agagtttgtggatccgttcgcgaga

SEQ ID NO: 118049 - DNA, 25 bp, Rattus norvegicus
agagtttgttgaatgcccatggctt

SEQ ID NO: 118050 - DNA, 25 bp, Rattus norvegicus
agagtttgttgattgcccatggctt

SEQ ID NO: 118051 - DNA, 25 bp, Rattus norvegicus
agagttttagccagttagggtccat

SEQ ID NO: 118052 - DNA, 25 bp, Rattus norvegicus
agagttttagcctgttagggtccat

SEQ ID NO: 118053 - DNA, 25 bp, Rattus norvegicus
agagttttattcctacagtttgttg

SEQ ID NO: 118054 - DNA, 25 bp, Rattus norvegicus
agagttttattcgtacagtttgttg

SEQ ID NO: 118055 - DNA, 25 bp, Rattus norvegicus
agagttttcattattgtgcaccaaa

SEQ ID NO: 118056 - DNA, 25 bp, Rattus norvegicus
agagttttcatttttgtgcaccaaa

SEQ ID NO: 118057 - DNA, 25 bp, Rattus norvegicus
agagttttcctactgttcatctgtc

SEQ ID NO: 118058 - DNA, 25 bp, Rattus norvegicus
agagttttcctagtgttcatctgtc

SEQ ID NO: 118059 - DNA, 25 bp, Rattus norvegicus
agagttttcctgaggctacaaggca

SEQ ID NO: 118060 - DNA, 25 bp, Rattus norvegicus
agagttttcctgtggctacaaggca

SEQ ID NO: 118061 - DNA, 25 bp, Rattus norvegicus
agagttttctttacctgtatccatg

SEQ ID NO: 118062 - DNA, 25 bp, Rattus norvegicus
agagttttcttttcctgtatccatg

SEQ ID NO: 118063 - DNA, 25 bp, Rattus norvegicus
agagtttttaccagctgtggcatct

SEQ ID NO: 118064 - DNA, 25 bp, Rattus norvegicus
agagtttttacctgctgtggcatct

SEQ ID NO: 118065 - DNA, 25 bp, Rattus norvegicus
agagtttttcatcttgcttaatcaa

SEQ ID NO: 118066 - DNA, 25 bp, Rattus norvegicus
agagtttttcatgttgcttaatcaa

SEQ ID NO: 118067 - DNA, 25 bp, Rattus norvegicus
agagtttttctcatctcagggtctt

SEQ ID NO: 118068 - DNA, 25 bp, Rattus norvegicus
agagtttttctcttctcagggtctt

SEQ ID NO: 118069 - DNA, 25 bp, Rattus norvegicus
agagtttttgaaattgcgccgcgtt

SEQ ID NO: 118070 - DNA, 25 bp, Rattus norvegicus
agagtttttgaatttgcgccgcgtt

SEQ ID NO: 118071 - DNA, 25 bp, Rattus norvegicus
agagtttttgagaccctgagcatcc

SEQ ID NO: 118072 - DNA, 25 bp, Rattus norvegicus
agagtttttgagtccctgagcatcc

SEQ ID NO: 118073 - DNA, 25 bp, Rattus norvegicus
agagttttttatactgctggtttca

SEQ ID NO: 118074 - DNA, 25 bp, Rattus norvegicus
agagttttttattctgctggtttca

SEQ ID NO: 118075 - DNA, 25 bp, Rattus norvegicus
agataaaaacctcactggcactgcc

SEQ ID NO: 118076 - DNA, 25 bp, Rattus norvegicus
agataaaaacctgactggcactgcc

SEQ ID NO: 118077 - DNA, 25 bp, Rattus norvegicus
agataaaacagtcggccttggtgag

SEQ ID NO: 118078 - DNA, 25 bp, Rattus norvegicus
agataaaacagtgggccttggtgag

SEQ ID NO: 118079 - DNA, 25 bp, Rattus norvegicus
agataaaatcccacgggcctcttat

SEQ ID NO: 118080 - DNA, 25 bp, Rattus norvegicus
agataaaatccctcgggcctcttat

SEQ ID NO: 118081 - DNA, 25 bp, Rattus norvegicus
agataaacagttcttcagctccttg

SEQ ID NO: 118082 - DNA, 25 bp, Rattus norvegicus
agataaacagttgttcagctccttg

SEQ ID NO: 118083 - DNA, 25 bp, Rattus norvegicus
agataaacatggctgcccggcctat

SEQ ID NO: 118084 - DNA, 25 bp, Rattus norvegicus
agataaacatgggtgcccggcctat

SEQ ID NO: 118085 - DNA, 25 bp, Rattus norvegicus
agataaaccctcaagctcagcctag

SEQ ID NO: 118086 - DNA, 25 bp, Rattus norvegicus
agataaaccctctagctcagcctag

SEQ ID NO: 118087 - DNA, 25 bp, Rattus norvegicus
agataaagccccacttccgagctct

SEQ ID NO: 118088 - DNA, 25 bp, Rattus norvegicus
agataaagcccctcttccgagctct

SEQ ID NO: 118089 - DNA, 25 bp, Rattus norvegicus
agataaagtattacagcctagacct

SEQ ID NO: 118090 - DNA, 25 bp, Rattus norvegicus
agataaagtatttcagcctagacct

SEQ ID NO: 118091 - DNA, 25 bp, Rattus norvegicus
agataaatcttgatctgcccctggg

SEQ ID NO: 118092 - DNA, 25 bp, Rattus norvegicus
agataaatcttgttctgcccctggg

SEQ ID NO: 118093 - DNA, 25 bp, Rattus norvegicus
agataacatctccagttcctgagtc

SEQ ID NO: 118094 - DNA, 25 bp, Rattus norvegicus
agataacatctcgagttcctgagtc

SEQ ID NO: 118095 - DNA, 25 bp, Rattus norvegicus
agataacattcaacgggagctgcct

SEQ ID NO: 118096 - DNA, 25 bp, Rattus norvegicus
agataacattcatcgggagctgcct

SEQ ID NO: 118097 - DNA, 25 bp, Rattus norvegicus
agataaccagctaatgtgtctgcaa

SEQ ID NO: 118098 - DNA, 25 bp, Rattus norvegicus
agataaccagcttatgtgtctgcaa

SEQ ID NO: 118099 - DNA, 25 bp, Rattus norvegicus
agataaccaggtattgctgccctgc

SEQ ID NO: 118100 - DNA, 25 bp, Rattus norvegicus
agataaccaggttttgctgccctgc

SEQ ID NO: 118101 - DNA, 25 bp, Rattus norvegicus
agataaccattgaccatactggaaa

SEQ ID NO: 118102 - DNA, 25 bp, Rattus norvegicus
agataaccattgtccatactggaaa

SEQ ID NO: 118103 - DNA, 25 bp, Rattus norvegicus
agataaccccacacatactcggtgg

SEQ ID NO: 118104 - DNA, 25 bp, Rattus norvegicus
agataaccccactcatactcggtgg

SEQ ID NO: 118105 - DNA, 25 bp, Rattus norvegicus
agataaccggcacggccacaggcat

SEQ ID NO: 118106 - DNA, 25 bp, Rattus norvegicus
agataaccggcagggccacaggcat

SEQ ID NO: 118107 - DNA, 25 bp, Rattus norvegicus
agataaccttctctgacctgtgttg

SEQ ID NO: 118108 - DNA, 25 bp, Rattus norvegicus
agataaccttctgtgacctgtgttg

SEQ ID NO: 118109 - DNA, 25 bp, Rattus norvegicus
agataacggccccagcatattttat

SEQ ID NO: 118110 - DNA, 25 bp, Rattus norvegicus
agataacggcccgagcatattttat

SEQ ID NO: 118111 - DNA, 25 bp, Rattus norvegicus
agataacggtgcacctttgccaatt

SEQ ID NO: 118112 - DNA, 25 bp, Rattus norvegicus
agataacggtgctcctttgccaatt

SEQ ID NO: 118113 - DNA, 25 bp, Rattus norvegicus
agataacgtgaaccaggctcgcctg

SEQ ID NO: 118114 - DNA, 25 bp, Rattus norvegicus
agataacgtgaagcaggctcgcctg

SEQ ID NO: 118115 - DNA, 25 bp, Rattus norvegicus
agataactaactacttggcagctta

SEQ ID NO: 118116 - DNA, 25 bp, Rattus norvegicus
agataactaacttcttggcagctta

SEQ ID NO: 118117 - DNA, 25 bp, Rattus norvegicus
agataactatgaatcctcccagtgc

SEQ ID NO: 118118 - DNA, 25 bp, Rattus norvegicus
agataactatgattcctcccagtgc

SEQ ID NO: 118119 - DNA, 25 bp, Rattus norvegicus
agataactctcaccctcacagaatg

SEQ ID NO: 118120 - DNA, 25 bp, Rattus norvegicus
agataactctcagcctcacagaatg

SEQ ID NO: 118121 - DNA, 25 bp, Rattus norvegicus
agataactgagcacttttccttaca

SEQ ID NO: 118122 - DNA, 25 bp, Rattus norvegicus
agataactgagctcttttccttaca

SEQ ID NO: 118123 - DNA, 25 bp, Rattus norvegicus
agataactgcaaagatgttgtcatt

SEQ ID NO: 118124 - DNA, 25 bp, Rattus norvegicus
agataactgcaatgatgttgtcatt

SEQ ID NO: 118125 - DNA, 25 bp, Rattus norvegicus
agataactgccaccgaggctgttct

SEQ ID NO: 118126 - DNA, 25 bp, Rattus norvegicus
agataactgccagcgaggctgttct

SEQ ID NO: 118127 - DNA, 25 bp, Rattus norvegicus
agataactgctcatgttctttggga

SEQ ID NO: 118128 - DNA, 25 bp, Rattus norvegicus
agataactgctcttgttctttggga

SEQ ID NO: 118129 - DNA, 25 bp, Rattus norvegicus
agataactgctgctgtggccaactc

SEQ ID NO: 118130 - DNA, 25 bp, Rattus norvegicus
agataactgctggtgtggccaactc

SEQ ID NO: 118131 - DNA, 25 bp, Rattus norvegicus
agataactgtgaactcctggtcctc

SEQ ID NO: 118132 - DNA, 25 bp, Rattus norvegicus
agataactgtgatctcctggtcctc

SEQ ID NO: 118133 - DNA, 25 bp, Rattus norvegicus
agataacttcttctctggctctgac

SEQ ID NO: 118134 - DNA, 25 bp, Rattus norvegicus
agataacttcttgtctggctctgac

SEQ ID NO: 118135 - DNA, 25 bp, Rattus norvegicus
agataacttgaaccctgatctaagg

SEQ ID NO: 118136 - DNA, 25 bp, Rattus norvegicus
agataacttgaagcctgatctaagg

SEQ ID NO: 118137 - DNA, 25 bp, Rattus norvegicus
agataacttgcacatcctctgtggc

SEQ ID NO: 118138 - DNA, 25 bp, Rattus norvegicus
agataacttgcagatcctctgtggc

SEQ ID NO: 118139 - DNA, 25 bp, Rattus norvegicus
agataacttggcactgtctcggtct

SEQ ID NO: 118140 - DNA, 25 bp, Rattus norvegicus
agataacttggctctgtctcggtct

SEQ ID NO: 118141 - DNA, 25 bp, Rattus norvegicus
agataacttgtcatttgagaatggg

SEQ ID NO: 118142 - DNA, 25 bp, Rattus norvegicus
agataacttgtcttttgagaatggg

SEQ ID NO: 118143 - DNA, 25 bp, Rattus norvegicus
agataagaaactcggcatcctgctc

SEQ ID NO: 118144 - DNA, 25 bp, Rattus norvegicus
agataagaaactgggcatcctgctc

SEQ ID NO: 118145 - DNA, 25 bp, Rattus norvegicus
agataagaccttactccacagccag

SEQ ID NO: 118146 - DNA, 25 bp, Rattus norvegicus
agataagacctttctccacagccag

SEQ ID NO: 118147 - DNA, 25 bp, Rattus norvegicus
agataagatcctccagaagtctcct

SEQ ID NO: 118148 - DNA, 25 bp, Rattus norvegicus
agataagatcctgcagaagtctcct

SEQ ID NO: 118149 - DNA, 25 bp, Rattus norvegicus
agataagatgggaaggcttgtgctt

SEQ ID NO: 118150 - DNA, 25 bp, Rattus norvegicus
agataagatgggtaggcttgtgctt

SEQ ID NO: 118151 - DNA, 25 bp, Rattus norvegicus
agataagcacagatggagcctccaa

SEQ ID NO: 118152 - DNA, 25 bp, Rattus norvegicus
agataagcacagttggagcctccaa

SEQ ID NO: 118153 - DNA, 25 bp, Rattus norvegicus
agataagcatgtctgtcacccgatg

SEQ ID NO: 118154 - DNA, 25 bp, Rattus norvegicus
agataagcatgtgtgtcacccgatg

SEQ ID NO: 118155 - DNA, 25 bp, Rattus norvegicus
agataagcattcactagcagggccc

SEQ ID NO: 118156 - DNA, 25 bp, Rattus norvegicus
agataagcattctctagcagggccc

SEQ ID NO: 118157 - DNA, 25 bp, Rattus norvegicus
agataagccacccaggagagctgtg

SEQ ID NO: 118158 - DNA, 25 bp, Rattus norvegicus
agataagccaccgaggagagctgtg

SEQ ID NO: 118159 - DNA, 25 bp, Rattus norvegicus
agataagccaggagcagctacctca

SEQ ID NO: 118160 - DNA, 25 bp, Rattus norvegicus
agataagccaggtgcagctacctca

SEQ ID NO: 118161 - DNA, 25 bp, Rattus norvegicus
agataagccctgcatgctagtgtcc

SEQ ID NO: 118162 - DNA, 25 bp, Rattus norvegicus
agataagccctggatgctagtgtcc

SEQ ID NO: 118163 - DNA, 25 bp, Rattus norvegicus
agataaggactgagtgccaggatcg

SEQ ID NO: 118164 - DNA, 25 bp, Rattus norvegicus
agataaggactgtgtgccaggatcg

SEQ ID NO: 118165 - DNA, 25 bp, Rattus norvegicus
agataaggagccctcacgtgcacgc

SEQ ID NO: 118166 - DNA, 25 bp, Rattus norvegicus
agataaggagccgtcacgtgcacgc

SEQ ID NO: 118167 - DNA, 25 bp, Rattus norvegicus
agataaggcctgatgctgtttcgca

SEQ ID NO: 118168 - DNA, 25 bp, Rattus norvegicus
agataaggcctgttgctgtttcgca

SEQ ID NO: 118169 - DNA, 25 bp, Rattus norvegicus
agataaggcgtgagtgctgacaagc

SEQ ID NO: 118170 - DNA, 25 bp, Rattus norvegicus
agataaggcgtgtgtgctgacaagc

SEQ ID NO: 118171 - DNA, 25 bp, Rattus norvegicus
agataaggctgcctcagacgtcctt

SEQ ID NO: 118172 - DNA, 25 bp, Rattus norvegicus
agataaggctgcgtcagacgtcctt

SEQ ID NO: 118173 - DNA, 25 bp, Rattus norvegicus
agataaggtctcctgaggccagcct

SEQ ID NO: 118174 - DNA, 25 bp, Rattus norvegicus
agataaggtctcgtgaggccagcct

SEQ ID NO: 118175 - DNA, 25 bp, Rattus norvegicus
agataagtattcacccttcacacag

SEQ ID NO: 118176 - DNA, 25 bp, Rattus norvegicus
agataagtattctcccttcacacag

SEQ ID NO: 118177 - DNA, 25 bp, Rattus norvegicus
agataagtctctatctccagtatgg

SEQ ID NO: 118178 - DNA, 25 bp, Rattus norvegicus
agataagtctctttctccagtatgg

SEQ ID NO: 118179 - DNA, 25 bp, Rattus norvegicus
agataagttggtccttgccttgtaa

SEQ ID NO: 118180 - DNA, 25 bp, Rattus norvegicus
agataagttggtgcttgccttgtaa

SEQ ID NO: 118181 - DNA, 25 bp, Rattus norvegicus
agataatagcaccttgtaactcatt

SEQ ID NO: 118182 - DNA, 25 bp, Rattus norvegicus
agataatagcacgttgtaactcatt

SEQ ID NO: 118183 - DNA, 25 bp, Rattus norvegicus
agataatagctaccctgtttcttta

SEQ ID NO: 118184 - DNA, 25 bp, Rattus norvegicus
agataatagctagcctgtttcttta

SEQ ID NO: 118185 - DNA, 25 bp, Rattus norvegicus
agataatattttatactcctgtgta

SEQ ID NO: 118186 - DNA, 25 bp, Rattus norvegicus
agataatattttttactcctgtgta

SEQ ID NO: 118187 - DNA, 25 bp, Rattus norvegicus
agataatcacatatggcctctgtcc

SEQ ID NO: 118188 - DNA, 25 bp, Rattus norvegicus
agataatcacatttggcctctgtcc

SEQ ID NO: 118189 - DNA, 25 bp, Rattus norvegicus
agataatcatctctgttcctctgcc

SEQ ID NO: 118190 - DNA, 25 bp, Rattus norvegicus
agataatcatctgtgttcctctgcc

SEQ ID NO: 118191 - DNA, 25 bp, Rattus norvegicus
agataatcctgtatttgctctaaaa

SEQ ID NO: 118192 - DNA, 25 bp, Rattus norvegicus
agataatcctgtttttgctctaaaa

SEQ ID NO: 118193 - DNA, 25 bp, Rattus norvegicus
agataatctcttaccctgggactgg

SEQ ID NO: 118194 - DNA, 25 bp, Rattus norvegicus
agataatctctttccctgggactgg

SEQ ID NO: 118195 - DNA, 25 bp, Rattus norvegicus
agataatgaatcaccccgagcgggt

SEQ ID NO: 118196 - DNA, 25 bp, Rattus norvegicus
agataatgaatctccccgagcgggt

SEQ ID NO: 118197 - DNA, 25 bp, Rattus norvegicus
agataatgagcgacgactgcacccc

SEQ ID NO: 118198 - DNA, 25 bp, Rattus norvegicus
agataatgagcgtcgactgcacccc

SEQ ID NO: 118199 - DNA, 25 bp, Rattus norvegicus
agataatggaacactccagcacgcc

SEQ ID NO: 118200 - DNA, 25 bp, Rattus norvegicus
agataatggaactctccagcacgcc

SEQ ID NO: 118201 - DNA, 25 bp, Rattus norvegicus
agataatgtcttctgcacacccaca

SEQ ID NO: 118202 - DNA, 25 bp, Rattus norvegicus
agataatgtcttgtgcacacccaca

SEQ ID NO: 118203 - DNA, 25 bp, Rattus norvegicus
agataattccatatttcccagctac

SEQ ID NO: 118204 - DNA, 25 bp, Rattus norvegicus
agataattccatttttcccagctac

SEQ ID NO: 118205 - DNA, 25 bp, Rattus norvegicus
agataattccctacaacagactctc

SEQ ID NO: 118206 - DNA, 25 bp, Rattus norvegicus
agataattcccttcaacagactctc

SEQ ID NO: 118207 - DNA, 25 bp, Rattus norvegicus
agataatttagtctggcagcggctc

SEQ ID NO: 118208 - DNA, 25 bp, Rattus norvegicus
agataatttagtgtggcagcggctc

SEQ ID NO: 118209 - DNA, 25 bp, Rattus norvegicus
agataatttcttccattcgcatttt

SEQ ID NO: 118210 - DNA, 25 bp, Rattus norvegicus
agataatttcttgcattcgcatttt

SEQ ID NO: 118211 - DNA, 25 bp, Rattus norvegicus
agatacaacctgcaacgtttcgctg

SEQ ID NO: 118212 - DNA, 25 bp, Rattus norvegicus
agatacaacctggaacgtttcgctg

SEQ ID NO: 118213 - DNA, 25 bp, Rattus norvegicus
agatacaacttcagctggtcctgca

SEQ ID NO: 118214 - DNA, 25 bp, Rattus norvegicus
agatacaacttctgctggtcctgca

SEQ ID NO: 118215 - DNA, 25 bp, Rattus norvegicus
agatacaaggagaggcactgcctca

SEQ ID NO: 118216 - DNA, 25 bp, Rattus norvegicus
agatacaaggagtggcactgcctca

SEQ ID NO: 118217 - DNA, 25 bp, Rattus norvegicus
agatacaattccaccaccatttaat

SEQ ID NO: 118218 - DNA, 25 bp, Rattus norvegicus
agatacaattcctccaccatttaat

SEQ ID NO: 118219 - DNA, 25 bp, Rattus norvegicus
agatacacccacagagctgtagcct

SEQ ID NO: 118220 - DNA, 25 bp, Rattus norvegicus
agatacacccactgagctgtagcct

SEQ ID NO: 118221 - DNA, 25 bp, Rattus norvegicus
agatacacccttagccctttgataa

SEQ ID NO: 118222 - DNA, 25 bp, Rattus norvegicus
agatacaccctttgccctttgataa

SEQ ID NO: 118223 - DNA, 25 bp, Rattus norvegicus
agatacactctccatacaagctttc

SEQ ID NO: 118224 - DNA, 25 bp, Rattus norvegicus
agatacactctcgatacaagctttc

SEQ ID NO: 118225 - DNA, 25 bp, Rattus norvegicus
agatacacttttctccttcttggga

SEQ ID NO: 118226 - DNA, 25 bp, Rattus norvegicus
agatacacttttgtccttcttggga

SEQ ID NO: 118227 - DNA, 25 bp, Rattus norvegicus
agatacagaatcctgcaatgtgcaa

SEQ ID NO: 118228 - DNA, 25 bp, Rattus norvegicus
agatacagaatcgtgcaatgtgcaa

SEQ ID NO: 118229 - DNA, 25 bp, Rattus norvegicus
agatacagactgcaatgccacccct

SEQ ID NO: 118230 - DNA, 25 bp, Rattus norvegicus
agatacagactggaatgccacccct

SEQ ID NO: 118231 - DNA, 25 bp, Rattus norvegicus
agatacagcaccaagcatgatgttt

SEQ ID NO: 118232 - DNA, 25 bp, Rattus norvegicus
agatacagcacctagcatgatgttt

SEQ ID NO: 118233 - DNA, 25 bp, Rattus norvegicus
agatacagctgactggtcggctatc

SEQ ID NO: 118234 - DNA, 25 bp, Rattus norvegicus
agatacagctgagtggtcggctatc

SEQ ID NO: 118235 - DNA, 25 bp, Rattus norvegicus
agatacagtaacaccaaccctctgg

SEQ ID NO: 118236 - DNA, 25 bp, Rattus norvegicus
agatacagtaactccaaccctctgg

SEQ ID NO: 118237 - DNA, 25 bp, Rattus norvegicus
agatacagtgcaattccggatcccc

SEQ ID NO: 118238 - DNA, 25 bp, Rattus norvegicus
agatacagtgcatttccggatcccc

SEQ ID NO: 118239 - DNA, 25 bp, Rattus norvegicus
agatacatacacctggccttgcagg

SEQ ID NO: 118240 - DNA, 25 bp, Rattus norvegicus
agatacatacacgtggccttgcagg

SEQ ID NO: 118241 - DNA, 25 bp, Rattus norvegicus
agatacatccttagcaaccttgaga

SEQ ID NO: 118242 - DNA, 25 bp, Rattus norvegicus
agatacatcctttgcaaccttgaga

SEQ ID NO: 118243 - DNA, 25 bp, Rattus norvegicus
agatacatcgctcagttactgaaaa

SEQ ID NO: 118244 - DNA, 25 bp, Rattus norvegicus
agatacatcgctgagttactgaaaa

SEQ ID NO: 118245 - DNA, 25 bp, Rattus norvegicus
agatacatctctctctactgatcct

SEQ ID NO: 118246 - DNA, 25 bp, Rattus norvegicus
agatacatctctgtctactgatcct

SEQ ID NO: 118247 - DNA, 25 bp, Rattus norvegicus
agatacatctgaccgcccacaggga

SEQ ID NO: 118248 - DNA, 25 bp, Rattus norvegicus
agatacatctgagcgcccacaggga

SEQ ID NO: 118249 - DNA, 25 bp, Rattus norvegicus
agatacatgcctatcatctccagag

SEQ ID NO: 118250 - DNA, 25 bp, Rattus norvegicus
agatacatgcctttcatctccagag

SEQ ID NO: 118251 - DNA, 25 bp, Rattus norvegicus
agatacatgcgaagacattgggtct

SEQ ID NO: 118252 - DNA, 25 bp, Rattus norvegicus
agatacatgcgatgacattgggtct

SEQ ID NO: 118253 - DNA, 25 bp, Rattus norvegicus
agatacattttgatcccatcgagcc

SEQ ID NO: 118254 - DNA, 25 bp, Rattus norvegicus
agatacattttgttcccatcgagcc

SEQ ID NO: 118255 - DNA, 25 bp, Rattus norvegicus
agataccaaatgcactgttccactc

SEQ ID NO: 118256 - DNA, 25 bp, Rattus norvegicus
agataccaaatggactgttccactc

SEQ ID NO: 118257 - DNA, 25 bp, Rattus norvegicus
agataccaatctctgtgccatccac

SEQ ID NO: 118258 - DNA, 25 bp, Rattus norvegicus
agataccaatctgtgtgccatccac

SEQ ID NO: 118259 - DNA, 25 bp, Rattus norvegicus
agataccacctcactatacacgaat

SEQ ID NO: 118260 - DNA, 25 bp, Rattus norvegicus
agataccacctctctatacacgaat

SEQ ID NO: 118261 - DNA, 25 bp, Rattus norvegicus
agataccagttaactcctcagtcta

SEQ ID NO: 118262 - DNA, 25 bp, Rattus norvegicus
agataccagttatctcctcagtcta

SEQ ID NO: 118263 - DNA, 25 bp, Rattus norvegicus
agataccattggatctgtggttaaa

SEQ ID NO: 118264 - DNA, 25 bp, Rattus norvegicus
agataccattggttctgtggttaaa

SEQ ID NO: 118265 - DNA, 25 bp, Rattus norvegicus
agatacccatctattcccatacctt

SEQ ID NO: 118266 - DNA, 25 bp, Rattus norvegicus
agatacccatcttttcccatacctt

SEQ ID NO: 118267 - DNA, 25 bp, Rattus norvegicus
agataccccaatccgtgttcagaca

SEQ ID NO: 118268 - DNA, 25 bp, Rattus norvegicus
agataccccaatgcgtgttcagaca

SEQ ID NO: 118269 - DNA, 25 bp, Rattus norvegicus
agataccccagtactcttggatgat

SEQ ID NO: 118270 - DNA, 25 bp, Rattus norvegicus
agataccccagttctcttggatgat

SEQ ID NO: 118271 - DNA, 25 bp, Rattus norvegicus
agatacccctgacccacaagtacag

SEQ ID NO: 118272 - DNA, 25 bp, Rattus norvegicus
agatacccctgagccacaagtacag

SEQ ID NO: 118273 - DNA, 25 bp, Rattus norvegicus
agatacccttgaagtctgctataat

SEQ ID NO: 118274 - DNA, 25 bp, Rattus norvegicus
agatacccttgatgtctgctataat

SEQ ID NO: 118275 - DNA, 25 bp, Rattus norvegicus
agataccgctgcactggtttctgac

SEQ ID NO: 118276 - DNA, 25 bp, Rattus norvegicus
agataccgctgctctggtttctgac

SEQ ID NO: 118277 - DNA, 25 bp, Rattus norvegicus
agataccggcacaattctcacggct

SEQ ID NO: 118278 - DNA, 25 bp, Rattus norvegicus
agataccggcactattctcacggct

SEQ ID NO: 118279 - DNA, 25 bp, Rattus norvegicus
agatacctccaaagcactgttttat

SEQ ID NO: 118280 - DNA, 25 bp, Rattus norvegicus
agatacctccaatgcactgttttat

SEQ ID NO: 118281 - DNA, 25 bp, Rattus norvegicus
agatacctcgttccactattttagt

SEQ ID NO: 118282 - DNA, 25 bp, Rattus norvegicus
agatacctcgttgcactattttagt

SEQ ID NO: 118283 - DNA, 25 bp, Rattus norvegicus
agatacctgcacaggtttctcagca

SEQ ID NO: 118284 - DNA, 25 bp, Rattus norvegicus
agatacctgcactggtttctcagca

SEQ ID NO: 118285 - DNA, 25 bp, Rattus norvegicus
agatacctgcagctgccggaagctg

SEQ ID NO: 118286 - DNA, 25 bp, Rattus norvegicus
agatacctgcaggtgccggaagctg

SEQ ID NO: 118287 - DNA, 25 bp, Rattus norvegicus
agatacctgtacattcttccatcgt

SEQ ID NO: 118288 - DNA, 25 bp, Rattus norvegicus
agatacctgtactttcttccatcgt

SEQ ID NO: 118289 - DNA, 25 bp, Rattus norvegicus
agatacctgtgtagggctcagctct

SEQ ID NO: 118290 - DNA, 25 bp, Rattus norvegicus
agatacctgtgttgggctcagctct

SEQ ID NO: 118291 - DNA, 25 bp, Rattus norvegicus
agataccttagcacatgtacacacc

SEQ ID NO: 118292 - DNA, 25 bp, Rattus norvegicus
agataccttagctcatgtacacacc

SEQ ID NO: 118293 - DNA, 25 bp, Rattus norvegicus
agataccttcttcggcagggtgtca

SEQ ID NO: 118294 - DNA, 25 bp, Rattus norvegicus
agataccttcttgggcagggtgtca

SEQ ID NO: 118295 - DNA, 25 bp, Rattus norvegicus
agatacctttctccacgtagtcggc

SEQ ID NO: 118296 - DNA, 25 bp, Rattus norvegicus
agatacctttctgcacgtagtcggc

SEQ ID NO: 118297 - DNA, 25 bp, Rattus norvegicus
agatacgagaacagtgggataccac

SEQ ID NO: 118298 - DNA, 25 bp, Rattus norvegicus
agatacgagaactgtgggataccac

SEQ ID NO: 118299 - DNA, 25 bp, Rattus norvegicus
agatacgataccagatccctctttt

SEQ ID NO: 118300 - DNA, 25 bp, Rattus norvegicus
agatacgatacctgatccctctttt

SEQ ID NO: 118301 - DNA, 25 bp, Rattus norvegicus
agatacgccaggcaaccagcagatg

SEQ ID NO: 118302 - DNA, 25 bp, Rattus norvegicus
agatacgccagggaaccagcagatg

SEQ ID NO: 118303 - DNA, 25 bp, Rattus norvegicus
agatacgcccggagatgctggcagc

SEQ ID NO: 118304 - DNA, 25 bp, Rattus norvegicus
agatacgcccggtgatgctggcagc

SEQ ID NO: 118305 - DNA, 25 bp, Rattus norvegicus
agatacgctgtgacatctgctgttt

SEQ ID NO: 118306 - DNA, 25 bp, Rattus norvegicus
agatacgctgtgtcatctgctgttt

SEQ ID NO: 118307 - DNA, 25 bp, Rattus norvegicus
agatacggtgtcacactggcagcag

SEQ ID NO: 118308 - DNA, 25 bp, Rattus norvegicus
agatacggtgtctcactggcagcag

SEQ ID NO: 118309 - DNA, 25 bp, Rattus norvegicus
agatacgtctctaaaaccagcctag

SEQ ID NO: 118310 - DNA, 25 bp, Rattus norvegicus
agatacgtctcttaaaccagcctag

SEQ ID NO: 118311 - DNA, 25 bp, Rattus norvegicus
agatacgtctggctgtttttatatg

SEQ ID NO: 118312 - DNA, 25 bp, Rattus norvegicus
agatacgtctgggtgtttttatatg

SEQ ID NO: 118313 - DNA, 25 bp, Rattus norvegicus
agatacgttcatacagtgctgagtc

SEQ ID NO: 118314 - DNA, 25 bp, Rattus norvegicus
agatacgttcattcagtgctgagtc

SEQ ID NO: 118315 - DNA, 25 bp, Rattus norvegicus
agatactaacagctcattcagagat

SEQ ID NO: 118316 - DNA, 25 bp, Rattus norvegicus
agatactaacaggtcattcagagat

SEQ ID NO: 118317 - DNA, 25 bp, Rattus norvegicus
agatactactttactacctcaggca

SEQ ID NO: 118318 - DNA, 25 bp, Rattus norvegicus
agatactacttttctacctcaggca

SEQ ID NO: 118319 - DNA, 25 bp, Rattus norvegicus
agatactattcaagcacctaccaca

SEQ ID NO: 118320 - DNA, 25 bp, Rattus norvegicus
agatactattcatgcacctaccaca

SEQ ID NO: 118321 - DNA, 25 bp, Rattus norvegicus
agatactcacttactcaacaaactc

SEQ ID NO: 118322 - DNA, 25 bp, Rattus norvegicus
agatactcactttctcaacaaactc

SEQ ID NO: 118323 - DNA, 25 bp, Rattus norvegicus
agatactcattgctttccttggctg

SEQ ID NO: 118324 - DNA, 25 bp, Rattus norvegicus
agatactcattggtttccttggctg

SEQ ID NO: 118325 - DNA, 25 bp, Rattus norvegicus
agatactccccaaacacggtggtgc

SEQ ID NO: 118326 - DNA, 25 bp, Rattus norvegicus
agatactccccatacacggtggtgc

SEQ ID NO: 118327 - DNA, 25 bp, Rattus norvegicus
agatactccggtctttgcgaggcat

SEQ ID NO: 118328 - DNA, 25 bp, Rattus norvegicus
agatactccggtgtttgcgaggcat

SEQ ID NO: 118329 - DNA, 25 bp, Rattus norvegicus
agatactcgcatctgatttctcctc

SEQ ID NO: 118330 - DNA, 25 bp, Rattus norvegicus
agatactcgcatgtgatttctcctc

SEQ ID NO: 118331 - DNA, 25 bp, Rattus norvegicus
agatactcgggtactggttcttgga

SEQ ID NO: 118332 - DNA, 25 bp, Rattus norvegicus
agatactcgggttctggttcttgga

SEQ ID NO: 118333 - DNA, 25 bp, Rattus norvegicus
agatactctcgtcctgtgcggcagt

SEQ ID NO: 118334 - DNA, 25 bp, Rattus norvegicus
agatactctcgtgctgtgcggcagt

SEQ ID NO: 118335 - DNA, 25 bp, Rattus norvegicus
agatactctgcaagatctctagctc

SEQ ID NO: 118336 - DNA, 25 bp, Rattus norvegicus
agatactctgcatgatctctagctc

SEQ ID NO: 118337 - DNA, 25 bp, Rattus norvegicus
agatactctgttcgctcatcgtggc

SEQ ID NO: 118338 - DNA, 25 bp, Rattus norvegicus
agatactctgttggctcatcgtggc

SEQ ID NO: 118339 - DNA, 25 bp, Rattus norvegicus
agatactgacttactctacaagccc

SEQ ID NO: 118340 - DNA, 25 bp, Rattus norvegicus
agatactgactttctctacaagccc

SEQ ID NO: 118341 - DNA, 25 bp, Rattus norvegicus
agatactgcaagaggactcctgcca

SEQ ID NO: 118342 - DNA, 25 bp, Rattus norvegicus
agatactgcaagtggactcctgcca

SEQ ID NO: 118343 - DNA, 25 bp, Rattus norvegicus
agatactgccccaaggaggctattc

SEQ ID NO: 118344 - DNA, 25 bp, Rattus norvegicus
agatactgcccctaggaggctattc

SEQ ID NO: 118345 - DNA, 25 bp, Rattus norvegicus
agatactgccctattgccaaatgac

SEQ ID NO: 118346 - DNA, 25 bp, Rattus norvegicus
agatactgcccttttgccaaatgac

SEQ ID NO: 118347 - DNA, 25 bp, Rattus norvegicus
agatactgctcaacgggcaacgcaa

SEQ ID NO: 118348 - DNA, 25 bp, Rattus norvegicus
agatactgctcatcgggcaacgcaa

SEQ ID NO: 118349 - DNA, 25 bp, Rattus norvegicus
agatactgcttcacaaactaataaa

SEQ ID NO: 118350 - DNA, 25 bp, Rattus norvegicus
agatactgcttctcaaactaataaa

SEQ ID NO: 118351 - DNA, 25 bp, Rattus norvegicus
agatactggcatcagttccaaccac

SEQ ID NO: 118352 - DNA, 25 bp, Rattus norvegicus
agatactggcatgagttccaaccac

SEQ ID NO: 118353 - DNA, 25 bp, Rattus norvegicus
agatactgtgctatctgcttggtat

SEQ ID NO: 118354 - DNA, 25 bp, Rattus norvegicus
agatactgtgctttctgcttggtat

SEQ ID NO: 118355 - DNA, 25 bp, Rattus norvegicus
agatacttccaacgctatttgtttt

SEQ ID NO: 118356 - DNA, 25 bp, Rattus norvegicus
agatacttccaaggctatttgtttt

SEQ ID NO: 118357 - DNA, 25 bp, Rattus norvegicus
agatacttctagacttttcctccta

SEQ ID NO: 118358 - DNA, 25 bp, Rattus norvegicus
agatacttctagtcttttcctccta

SEQ ID NO: 118359 - DNA, 25 bp, Rattus norvegicus
agatacttctcacctgattggctta

SEQ ID NO: 118360 - DNA, 25 bp, Rattus norvegicus
agatacttctcagctgattggctta

SEQ ID NO: 118361 - DNA, 25 bp, Rattus norvegicus
agatacttgccacttgttgtttgta

SEQ ID NO: 118362 - DNA, 25 bp, Rattus norvegicus
agatacttgccagttgttgtttgta

SEQ ID NO: 118363 - DNA, 25 bp, Rattus norvegicus
agatacttgcctactaaaacagcag

SEQ ID NO: 118364 - DNA, 25 bp, Rattus norvegicus
agatacttgccttctaaaacagcag

SEQ ID NO: 118365 - DNA, 25 bp, Rattus norvegicus
agatacttggtcatactggttttat

SEQ ID NO: 118366 - DNA, 25 bp, Rattus norvegicus
agatacttggtcttactggttttat

SEQ ID NO: 118367 - DNA, 25 bp, Rattus norvegicus
agatactttccaaatgcctcttgca

SEQ ID NO: 118368 - DNA, 25 bp, Rattus norvegicus
agatactttccatatgcctcttgca

SEQ ID NO: 118369 - DNA, 25 bp, Rattus norvegicus
agatactttcttatgctttctctgg

SEQ ID NO: 118370 - DNA, 25 bp, Rattus norvegicus
agatactttcttttgctttctctgg

SEQ ID NO: 118371 - DNA, 25 bp, Rattus norvegicus
agatagaaaggcacgccgtctttgt

SEQ ID NO: 118372 - DNA, 25 bp, Rattus norvegicus
agatagaaaggctcgccgtctttgt

SEQ ID NO: 118373 - DNA, 25 bp, Rattus norvegicus
agatagaacgtcagcagaaacaaac

SEQ ID NO: 118374 - DNA, 25 bp, Rattus norvegicus
agatagaacgtctgcagaaacaaac

SEQ ID NO: 118375 - DNA, 25 bp, Rattus norvegicus
agatagaactggcttgccctctgtt

SEQ ID NO: 118376 - DNA, 25 bp, Rattus norvegicus
agatagaactgggttgccctctgtt

SEQ ID NO: 118377 - DNA, 25 bp, Rattus norvegicus
agatagaagaccctcactcctgact

SEQ ID NO: 118378 - DNA, 25 bp, Rattus norvegicus
agatagaagaccgtcactcctgact

SEQ ID NO: 118379 - DNA, 25 bp, Rattus norvegicus
agatagaatttaccccgagactcag

SEQ ID NO: 118380 - DNA, 25 bp, Rattus norvegicus
agatagaatttagcccgagactcag

SEQ ID NO: 118381 - DNA, 25 bp, Rattus norvegicus
agatagacaatcacctgttgcccct

SEQ ID NO: 118382 - DNA, 25 bp, Rattus norvegicus
agatagacaatctcctgttgcccct

SEQ ID NO: 118383 - DNA, 25 bp, Rattus norvegicus
agatagacctacatgctctggttta

SEQ ID NO: 118384 - DNA, 25 bp, Rattus norvegicus
agatagacctacttgctctggttta

SEQ ID NO: 118385 - DNA, 25 bp, Rattus norvegicus
agatagacctcacccaaactggttg

SEQ ID NO: 118386 - DNA, 25 bp, Rattus norvegicus
agatagacctcagccaaactggttg

SEQ ID NO: 118387 - DNA, 25 bp, Rattus norvegicus
agatagacctggaatgtttacattt

SEQ ID NO: 118388 - DNA, 25 bp, Rattus norvegicus
agatagacctggtatgtttacattt

SEQ ID NO: 118389 - DNA, 25 bp, Rattus norvegicus
agatagacctgtattcatccaccag

SEQ ID NO: 118390 - DNA, 25 bp, Rattus norvegicus
agatagacctgttttcatccaccag

SEQ ID NO: 118391 - DNA, 25 bp, Rattus norvegicus
agatagaccttgcagggtggacctc

SEQ ID NO: 118392 - DNA, 25 bp, Rattus norvegicus
agatagaccttggagggtggacctc

SEQ ID NO: 118393 - DNA, 25 bp, Rattus norvegicus
agatagagcgcgcccgtcgctgcca

SEQ ID NO: 118394 - DNA, 25 bp, Rattus norvegicus
agatagagcgcggccgtcgctgcca

SEQ ID NO: 118395 - DNA, 25 bp, Rattus norvegicus
agatagagtagtatcctgtccctct

SEQ ID NO: 118396 - DNA, 25 bp, Rattus norvegicus
agatagagtagtttcctgtccctct

SEQ ID NO: 118397 - DNA, 25 bp, Rattus norvegicus
agatagatatccagtttttcctccc

SEQ ID NO: 118398 - DNA, 25 bp, Rattus norvegicus
agatagatatcctgtttttcctccc

SEQ ID NO: 118399 - DNA, 25 bp, Rattus norvegicus
agatagatctctaagtcagcccctc

SEQ ID NO: 118400 - DNA, 25 bp, Rattus norvegicus
agatagatctcttagtcagcccctc

SEQ ID NO: 118401 - DNA, 25 bp, Rattus norvegicus
agatagatgctacgccacgctgcag

SEQ ID NO: 118402 - DNA, 25 bp, Rattus norvegicus
agatagatgctaggccacgctgcag

SEQ ID NO: 118403 - DNA, 25 bp, Rattus norvegicus
agatagcaacctaactctcctaaac

SEQ ID NO: 118404 - DNA, 25 bp, Rattus norvegicus
agatagcaaccttactctcctaaac

SEQ ID NO: 118405 - DNA, 25 bp, Rattus norvegicus
agatagcacatcaagctgttgtgat

SEQ ID NO: 118406 - DNA, 25 bp, Rattus norvegicus
agatagcacatctagctgttgtgat

SEQ ID NO: 118407 - DNA, 25 bp, Rattus norvegicus
agatagcactaaccactgcccaagt

SEQ ID NO: 118408 - DNA, 25 bp, Rattus norvegicus
agatagcactaagcactgcccaagt

SEQ ID NO: 118409 - DNA, 25 bp, Rattus norvegicus
agatagcactttactgaacccacgc

SEQ ID NO: 118410 - DNA, 25 bp, Rattus norvegicus
agatagcacttttctgaacccacgc

SEQ ID NO: 118411 - DNA, 25 bp, Rattus norvegicus
agatagcagggtccacttccttacc

SEQ ID NO: 118412 - DNA, 25 bp, Rattus norvegicus
agatagcagggtgcacttccttacc

SEQ ID NO: 118413 - DNA, 25 bp, Rattus norvegicus
agatagcatgagactaccgagtggt

SEQ ID NO: 118414 - DNA, 25 bp, Rattus norvegicus
agatagcatgagtctaccgagtggt

SEQ ID NO: 118415 - DNA, 25 bp, Rattus norvegicus
agatagccagataaaccaaacgttt

SEQ ID NO: 118416 - DNA, 25 bp, Rattus norvegicus
agatagccagattaaccaaacgttt

SEQ ID NO: 118417 - DNA, 25 bp, Rattus norvegicus
agatagccaggacttagaacagaga

SEQ ID NO: 118418 - DNA, 25 bp, Rattus norvegicus
agatagccaggagttagaacagaga

SEQ ID NO: 118419 - DNA, 25 bp, Rattus norvegicus
agatagccggccagggaacacagca

SEQ ID NO: 118420 - DNA, 25 bp, Rattus norvegicus
agatagccggcctgggaacacagca

SEQ ID NO: 118421 - DNA, 25 bp, Rattus norvegicus
agatagccgggaacttcctgtttgt

SEQ ID NO: 118422 - DNA, 25 bp, Rattus norvegicus
agatagccgggatcttcctgtttgt

SEQ ID NO: 118423 - DNA, 25 bp, Rattus norvegicus
agatagccgggtcttgtgcctgata

SEQ ID NO: 118424 - DNA, 25 bp, Rattus norvegicus
agatagccgggtgttgtgcctgata

SEQ ID NO: 118425 - DNA, 25 bp, Rattus norvegicus
agatagcctatgatttgtcgttgtt

SEQ ID NO: 118426 - DNA, 25 bp, Rattus norvegicus
agatagcctatgttttgtcgttgtt

SEQ ID NO: 118427 - DNA, 25 bp, Rattus norvegicus
agatagcctggactaccggctgcga

SEQ ID NO: 118428 - DNA, 25 bp, Rattus norvegicus
agatagcctggagtaccggctgcga

SEQ ID NO: 118429 - DNA, 25 bp, Rattus norvegicus
agatagcctgtacaacttctccatg

SEQ ID NO: 118430 - DNA, 25 bp, Rattus norvegicus
agatagcctgtagaacttctccatg

SEQ ID NO: 118431 - DNA, 25 bp, Rattus norvegicus
agatagcctgtgattgagggagttt

SEQ ID NO: 118432 - DNA, 25 bp, Rattus norvegicus
agatagcctgtgtttgagggagttt

SEQ ID NO: 118433 - DNA, 25 bp, Rattus norvegicus
agatagcgagtgactgcttccgctt

SEQ ID NO: 118434 - DNA, 25 bp, Rattus norvegicus
agatagcgagtgctgcagtcaccac

SEQ ID NO: 118435 - DNA, 25 bp, Rattus norvegicus
agatagcgagtggtgcagtcaccac

SEQ ID NO: 118436 - DNA, 25 bp, Rattus norvegicus
agatagcgagtgtctgcttccgctt

SEQ ID NO: 118437 - DNA, 25 bp, Rattus norvegicus
agatagcgggaaactctctgcaggc

SEQ ID NO: 118438 - DNA, 25 bp, Rattus norvegicus
agatagcgggaatctctctgcaggc

SEQ ID NO: 118439 - DNA, 25 bp, Rattus norvegicus
agatagctactccaagtcccgaaat

SEQ ID NO: 118440 - DNA, 25 bp, Rattus norvegicus
agatagctactcgaagtcccgaaat

SEQ ID NO: 118441 - DNA, 25 bp, Rattus norvegicus
agatagctattgcaggcggtcctca

SEQ ID NO: 118442 - DNA, 25 bp, Rattus norvegicus
agatagctattggaggcggtcctca

SEQ ID NO: 118443 - DNA, 25 bp, Rattus norvegicus
agatagctccgtattatacccactt

SEQ ID NO: 118444 - DNA, 25 bp, Rattus norvegicus
agatagctccgttttatacccactt

SEQ ID NO: 118445 - DNA, 25 bp, Rattus norvegicus
agatagctgcatacacctcattact

SEQ ID NO: 118446 - DNA, 25 bp, Rattus norvegicus
agatagctgcattcacctcattact

SEQ ID NO: 118447 - DNA, 25 bp, Rattus norvegicus
agatagctgttccttctgggtgcta

SEQ ID NO: 118448 - DNA, 25 bp, Rattus norvegicus
agatagctgttcgttctgggtgcta

SEQ ID NO: 118449 - DNA, 25 bp, Rattus norvegicus
agatagcttctgagtggatgccccg

SEQ ID NO: 118450 - DNA, 25 bp, Rattus norvegicus
agatagcttctgtgtggatgccccg

SEQ ID NO: 118451 - DNA, 25 bp, Rattus norvegicus
agataggaagccagactctgctgct

SEQ ID NO: 118452 - DNA, 25 bp, Rattus norvegicus
agataggaagcctgactctgctgct

SEQ ID NO: 118453 - DNA, 25 bp, Rattus norvegicus
agataggaccatcccatagccaggg

SEQ ID NO: 118454 - DNA, 25 bp, Rattus norvegicus
agataggaccatgccatagccaggg

SEQ ID NO: 118455 - DNA, 25 bp, Rattus norvegicus
agataggatcatcgcccagtggtca

SEQ ID NO: 118456 - DNA, 25 bp, Rattus norvegicus
agataggatcatggcccagtggtca

SEQ ID NO: 118457 - DNA, 25 bp, Rattus norvegicus
agataggcgcgtcactcgtgacact

SEQ ID NO: 118458 - DNA, 25 bp, Rattus norvegicus
agataggcgcgtgactcgtgacact

SEQ ID NO: 118459 - DNA, 25 bp, Rattus norvegicus
agataggctcacaggatgcctcggc

SEQ ID NO: 118460 - DNA, 25 bp, Rattus norvegicus
agataggctcactggatgcctcggc

SEQ ID NO: 118461 - DNA, 25 bp, Rattus norvegicus
agataggctgccctgttacataaag

SEQ ID NO: 118462 - DNA, 25 bp, Rattus norvegicus
agataggctgccgtgttacataaag

SEQ ID NO: 118463 - DNA, 25 bp, Rattus norvegicus
agataggctgtgctacctaccggct

SEQ ID NO: 118464 - DNA, 25 bp, Rattus norvegicus
agataggctgtggtacctaccggct

SEQ ID NO: 118465 - DNA, 25 bp, Rattus norvegicus
agataggctttacttgaatccccgc

SEQ ID NO: 118466 - DNA, 25 bp, Rattus norvegicus
agataggctttagttgaatccccgc

SEQ ID NO: 118467 - DNA, 25 bp, Rattus norvegicus
agataggctttcagtacacgttccg

SEQ ID NO: 118468 - DNA, 25 bp, Rattus norvegicus
agataggctttctgtacacgttccg

SEQ ID NO: 118469 - DNA, 25 bp, Rattus norvegicus
agatagggcactcaggcacctgtga

SEQ ID NO: 118470 - DNA, 25 bp, Rattus norvegicus
agatagggcactgaggcacctgtga

SEQ ID NO: 118471 - DNA, 25 bp, Rattus norvegicus
agatagggcctcagcacacatcagg

SEQ ID NO: 118472 - DNA, 25 bp, Rattus norvegicus
agatagggcctctgcacacatcagg

SEQ ID NO: 118473 - DNA, 25 bp, Rattus norvegicus
agataggtagctcgagccacaggct

SEQ ID NO: 118474 - DNA, 25 bp, Rattus norvegicus
agataggtagctggagccacaggct

SEQ ID NO: 118475 - DNA, 25 bp, Rattus norvegicus
agataggtcatcagcagcctcaggc

SEQ ID NO: 118476 - DNA, 25 bp, Rattus norvegicus
agataggtcatctgcagcctcaggc

SEQ ID NO: 118477 - DNA, 25 bp, Rattus norvegicus
agataggtgcttcctgtgacacatt

SEQ ID NO: 118478 - DNA, 25 bp, Rattus norvegicus
agataggtgcttgctgtgacacatt

SEQ ID NO: 118479 - DNA, 25 bp, Rattus norvegicus
agataggtgggtccctggaactcac

SEQ ID NO: 118480 - DNA, 25 bp, Rattus norvegicus
agataggtgggtgcctggaactcac

SEQ ID NO: 118481 - DNA, 25 bp, Rattus norvegicus
agataggttactagtcgtctccctg

SEQ ID NO: 118482 - DNA, 25 bp, Rattus norvegicus
agataggttacttgtcgtctccctg

SEQ ID NO: 118483 - DNA, 25 bp, Rattus norvegicus
agataggttggtaggcttcacggcc

SEQ ID NO: 118484 - DNA, 25 bp, Rattus norvegicus
agataggttggttggcttcacggcc

SEQ ID NO: 118485 - DNA, 25 bp, Rattus norvegicus
agatagtaaatcctcgtcacacgac

SEQ ID NO: 118486 - DNA, 25 bp, Rattus norvegicus
agatagtaaatcgtcgtcacacgac

SEQ ID NO: 118487 - DNA, 25 bp, Rattus norvegicus
agatagtaatcaagagaacaccttc

SEQ ID NO: 118488 - DNA, 25 bp, Rattus norvegicus
agatagtaatcatgagaacaccttc

SEQ ID NO: 118489 - DNA, 25 bp, Rattus norvegicus
agatagtcactaacacttcccagac

SEQ ID NO: 118490 - DNA, 25 bp, Rattus norvegicus
agatagtcactacagttcgcaccat

SEQ ID NO: 118491 - DNA, 25 bp, Rattus norvegicus
agatagtcactagagttcgcaccat

SEQ ID NO: 118492 - DNA, 25 bp, Rattus norvegicus
agatagtcactatcacttcccagac

SEQ ID NO: 118493 - DNA, 25 bp, Rattus norvegicus
agatagtcttaactcctgaaccccg

SEQ ID NO: 118494 - DNA, 25 bp, Rattus norvegicus
agatagtcttaagtcctgaaccccg

SEQ ID NO: 118495 - DNA, 25 bp, Rattus norvegicus
agatagtgaaccaaggcagcctgtt

SEQ ID NO: 118496 - DNA, 25 bp, Rattus norvegicus
agatagtgaacctaggcagcctgtt

SEQ ID NO: 118497 - DNA, 25 bp, Rattus norvegicus
agatagtgagataccttgaaccagt

SEQ ID NO: 118498 - DNA, 25 bp, Rattus norvegicus
agatagtgagattccttgaaccagt

SEQ ID NO: 118499 - DNA, 25 bp, Rattus norvegicus
agatagtgcgatacctgtgctgtgt

SEQ ID NO: 118500 - DNA, 25 bp, Rattus norvegicus
agatagtgcgattcctgtgctgtgt

SEQ ID NO: 118501 - DNA, 25 bp, Rattus norvegicus
agatagtggccaaagctgcccagaa

SEQ ID NO: 118502 - DNA, 25 bp, Rattus norvegicus
agatagtggccatagctgcccagaa

SEQ ID NO: 118503 - DNA, 25 bp, Rattus norvegicus
agatagtgtatcaagctcttcccgc

SEQ ID NO: 118504 - DNA, 25 bp, Rattus norvegicus
agatagtgtatctagctcttcccgc

SEQ ID NO: 118505 - DNA, 25 bp, Rattus norvegicus
agatagtgttcaatctcccaaagcc

SEQ ID NO: 118506 - DNA, 25 bp, Rattus norvegicus
agatagtgttcattctcccaaagcc

SEQ ID NO: 118507 - DNA, 25 bp, Rattus norvegicus
agatagttatacatagtgctccaaa

SEQ ID NO: 118508 - DNA, 25 bp, Rattus norvegicus
agatagttatacttagtgctccaaa

SEQ ID NO: 118509 - DNA, 25 bp, Rattus norvegicus
agatagttcctgactccgccttgac

SEQ ID NO: 118510 - DNA, 25 bp, Rattus norvegicus
agatagttcctgtctccgccttgac

SEQ ID NO: 118511 - DNA, 25 bp, Rattus norvegicus
agatagttctgcctgctggtctctc

SEQ ID NO: 118512 - DNA, 25 bp, Rattus norvegicus
agatagttctgcgtgctggtctctc

SEQ ID NO: 118513 - DNA, 25 bp, Rattus norvegicus
agatagttgtgtctggcttctctct

SEQ ID NO: 118514 - DNA, 25 bp, Rattus norvegicus
agatagttgtgtgtggcttctctct

SEQ ID NO: 118515 - DNA, 25 bp, Rattus norvegicus
agatagtttctgagactctgtgaca

SEQ ID NO: 118516 - DNA, 25 bp, Rattus norvegicus
agatagtttctgtgactctgtgaca

SEQ ID NO: 118517 - DNA, 25 bp, Rattus norvegicus
agatagtttgtactgcgtgctctct

SEQ ID NO: 118518 - DNA, 25 bp, Rattus norvegicus
agatagtttgtagtgcgtgctctct

SEQ ID NO: 118519 - DNA, 25 bp, Rattus norvegicus
agatagttttgtcccattggttaat

SEQ ID NO: 118520 - DNA, 25 bp, Rattus norvegicus
agatagttttgtgccattggttaat

SEQ ID NO: 118521 - DNA, 25 bp, Rattus norvegicus
agatataagcgacctcccgacagag

SEQ ID NO: 118522 - DNA, 25 bp, Rattus norvegicus
agatataagcgagctcccgacagag

SEQ ID NO: 118523 - DNA, 25 bp, Rattus norvegicus
agatataaggagcaccgttgtttgt

SEQ ID NO: 118524 - DNA, 25 bp, Rattus norvegicus
agatataaggaggaccgttgtttgt

SEQ ID NO: 118525 - DNA, 25 bp, Rattus norvegicus
agatataatgtcatcgtccacccaa

SEQ ID NO: 118526 - DNA, 25 bp, Rattus norvegicus
agatataatgtcttcgtccacccaa

SEQ ID NO: 118527 - DNA, 25 bp, Rattus norvegicus
agatatacacacattccctgtttcg

SEQ ID NO: 118528 - DNA, 25 bp, Rattus norvegicus
agatatacacactttccctgtttcg

SEQ ID NO: 118529 - DNA, 25 bp, Rattus norvegicus
agatataccactccattggtcccag

SEQ ID NO: 118530 - DNA, 25 bp, Rattus norvegicus
agatataccactgcattggtcccag

SEQ ID NO: 118531 - DNA, 25 bp, Rattus norvegicus
agatatacccatcgacccgtacaat

SEQ ID NO: 118532 - DNA, 25 bp, Rattus norvegicus
agatatacccatggacccgtacaat

SEQ ID NO: 118533 - DNA, 25 bp, Rattus norvegicus
agatatacccctcttagccgtgtag

SEQ ID NO: 118534 - DNA, 25 bp, Rattus norvegicus
agatatacccctgttagccgtgtag

SEQ ID NO: 118535 - DNA, 25 bp, Rattus norvegicus
agatataccgcaatgtttctcagaa

SEQ ID NO: 118536 - DNA, 25 bp, Rattus norvegicus
agatataccgcattgtttctcagaa

SEQ ID NO: 118537 - DNA, 25 bp, Rattus norvegicus
agatatacctgtctaccacatccca

SEQ ID NO: 118538 - DNA, 25 bp, Rattus norvegicus
agatatacctgtgtaccacatccca

SEQ ID NO: 118539 - DNA, 25 bp, Rattus norvegicus
agatatacgaggcactgcgccccag

SEQ ID NO: 118540 - DNA, 25 bp, Rattus norvegicus
agatatacgagggactgcgccccag

SEQ ID NO: 118541 - DNA, 25 bp, Rattus norvegicus
agatatactcatcccattggtcagt

SEQ ID NO: 118542 - DNA, 25 bp, Rattus norvegicus
agatatactcatgccattggtcagt

SEQ ID NO: 118543 - DNA, 25 bp, Rattus norvegicus
agatatagccatctctcctttacct

SEQ ID NO: 118544 - DNA, 25 bp, Rattus norvegicus
agatatagccatgtctcctttacct

SEQ ID NO: 118545 - DNA, 25 bp, Rattus norvegicus
agatatatcccacttattcagcctt

SEQ ID NO: 118546 - DNA, 25 bp, Rattus norvegicus
agatatatcccagttattcagcctt

SEQ ID NO: 118547 - DNA, 25 bp, Rattus norvegicus
agatatattcacacagtactactga

SEQ ID NO: 118548 - DNA, 25 bp, Rattus norvegicus
agatatattcactcagtactactga

SEQ ID NO: 118549 - DNA, 25 bp, Rattus norvegicus
agatatcaagttataagtcaccctt

SEQ ID NO: 118550 - DNA, 25 bp, Rattus norvegicus
agatatcaagttttaagtcaccctt

SEQ ID NO: 118551 - DNA, 25 bp, Rattus norvegicus
agatatcaccctcccataagatggt

SEQ ID NO: 118552 - DNA, 25 bp, Rattus norvegicus
agatatcaccctgccataagatggt

SEQ ID NO: 118553 - DNA, 25 bp, Rattus norvegicus
agatatcagcccagactactatacc

SEQ ID NO: 118554 - DNA, 25 bp, Rattus norvegicus
agatatcagccctgactactatacc

SEQ ID NO: 118555 - DNA, 25 bp, Rattus norvegicus
agatatcatgatctcagccctgagg

SEQ ID NO: 118556 - DNA, 25 bp, Rattus norvegicus
agatatcatgatgtcagccctgagg

SEQ ID NO: 118557 - DNA, 25 bp, Rattus norvegicus
agatatcatttcagtgtgcttttat

SEQ ID NO: 118558 - DNA, 25 bp, Rattus norvegicus
agatatcatttctgtgtgcttttat

SEQ ID NO: 118559 - DNA, 25 bp, Rattus norvegicus
agatatccaaagacgggctcccagg

SEQ ID NO: 118560 - DNA, 25 bp, Rattus norvegicus
agatatccaaagtcgggctcccagg

SEQ ID NO: 118561 - DNA, 25 bp, Rattus norvegicus
agatatccattaacgacccttgcac

SEQ ID NO: 118562 - DNA, 25 bp, Rattus norvegicus
agatatccattatcgacccttgcac

SEQ ID NO: 118563 - DNA, 25 bp, Rattus norvegicus
agatatcccctgcacagacggagca

SEQ ID NO: 118564 - DNA, 25 bp, Rattus norvegicus
agatatcccctggacagacggagca

SEQ ID NO: 118565 - DNA, 25 bp, Rattus norvegicus
agatatcccggaaggactcagggcc

SEQ ID NO: 118566 - DNA, 25 bp, Rattus norvegicus
agatatcccggatggactcagggcc

SEQ ID NO: 118567 - DNA, 25 bp, Rattus norvegicus
agatatcctcatccagtacgatcgg

SEQ ID NO: 118568 - DNA, 25 bp, Rattus norvegicus
agatatcctcatgcagtacgatcgg

SEQ ID NO: 118569 - DNA, 25 bp, Rattus norvegicus
agatatcctgttcatcggactctgt

SEQ ID NO: 118570 - DNA, 25 bp, Rattus norvegicus
agatatcctgttgatcggactctgt

SEQ ID NO: 118571 - DNA, 25 bp, Rattus norvegicus
agatatccttgaactcattgtgtag

SEQ ID NO: 118572 - DNA, 25 bp, Rattus norvegicus
agatatccttgatctcattgtgtag

SEQ ID NO: 118573 - DNA, 25 bp, Rattus norvegicus
agatatcgcaccctatgacattggt

SEQ ID NO: 118574 - DNA, 25 bp, Rattus norvegicus
agatatcgcaccgtatgacattggt

SEQ ID NO: 118575 - DNA, 25 bp, Rattus norvegicus
agatatcgtggcacaagcccaaggt

SEQ ID NO: 118576 - DNA, 25 bp, Rattus norvegicus
agatatcgtggctcaagcccaaggt

SEQ ID NO: 118577 - DNA, 25 bp, Rattus norvegicus
agatatctacaacccgggcctggaa

SEQ ID NO: 118578 - DNA, 25 bp, Rattus norvegicus
agatatctacaagccgggcctggaa

SEQ ID NO: 118579 - DNA, 25 bp, Rattus norvegicus
agatatctagtcaatgctgtggcat

SEQ ID NO: 118580 - DNA, 25 bp, Rattus norvegicus
agatatctagtctatgctgtggcat

SEQ ID NO: 118581 - DNA, 25 bp, Rattus norvegicus
agatatctatcaaacccctctttat

SEQ ID NO: 118582 - DNA, 25 bp, Rattus norvegicus
agatatctatcatacccctctttat

SEQ ID NO: 118583 - DNA, 25 bp, Rattus norvegicus
agatatctatccaccttcaatgcag

SEQ ID NO: 118584 - DNA, 25 bp, Rattus norvegicus
agatatctatcctccttcaatgcag

SEQ ID NO: 118585 - DNA, 25 bp, Rattus norvegicus
agatatctctccatattacccgctg

SEQ ID NO: 118586 - DNA, 25 bp, Rattus norvegicus
agatatctctccttattacccgctg

SEQ ID NO: 118587 - DNA, 25 bp, Rattus norvegicus
agatatctctggctatttccaccag

SEQ ID NO: 118588 - DNA, 25 bp, Rattus norvegicus
agatatctctgggtatttccaccag

SEQ ID NO: 118589 - DNA, 25 bp, Rattus norvegicus
agatatctgctgcatgcctcaggcg

SEQ ID NO: 118590 - DNA, 25 bp, Rattus norvegicus
agatatctgctggatgcctcaggcg

SEQ ID NO: 118591 - DNA, 25 bp, Rattus norvegicus
agatatctgggtagctcccactttg

SEQ ID NO: 118592 - DNA, 25 bp, Rattus norvegicus
agatatctgggttgctcccactttg

SEQ ID NO: 118593 - DNA, 25 bp, Rattus norvegicus
agatatcttccacgataacctagaa

SEQ ID NO: 118594 - DNA, 25 bp, Rattus norvegicus
agatatcttccaggataacctagaa

SEQ ID NO: 118595 - DNA, 25 bp, Rattus norvegicus
agatatcttttcctggatcaagctt

SEQ ID NO: 118596 - DNA, 25 bp, Rattus norvegicus
agatatcttttcgtggatcaagctt

SEQ ID NO: 118597 - DNA, 25 bp, Rattus norvegicus
agatatgaccggactccatgctgca

SEQ ID NO: 118598 - DNA, 25 bp, Rattus norvegicus
agatatgaccggtctccatgctgca

SEQ ID NO: 118599 - DNA, 25 bp, Rattus norvegicus
agatatgagtgacgccagctcctcg

SEQ ID NO: 118600 - DNA, 25 bp, Rattus norvegicus
agatatgagtgaggccagctcctcg

SEQ ID NO: 118601 - DNA, 25 bp, Rattus norvegicus
agatatgcagttccctccaaatgtc

SEQ ID NO: 118602 - DNA, 25 bp, Rattus norvegicus
agatatgcagttgcctccaaatgtc

SEQ ID NO: 118603 - DNA, 25 bp, Rattus norvegicus
agatatgcccttagcatggatcgcc

SEQ ID NO: 118604 - DNA, 25 bp, Rattus norvegicus
agatatgccctttgcatggatcgcc

SEQ ID NO: 118605 - DNA, 25 bp, Rattus norvegicus
agatatggaacccttccttcctttg

SEQ ID NO: 118606 - DNA, 25 bp, Rattus norvegicus
agatatggaaccgttccttcctttg

SEQ ID NO: 118607 - DNA, 25 bp, Rattus norvegicus
agatatggcaagacgcgtgcagtta

SEQ ID NO: 118608 - DNA, 25 bp, Rattus norvegicus
agatatggcaagtcgcgtgcagtta

SEQ ID NO: 118609 - DNA, 25 bp, Rattus norvegicus
agatatggcctcatacagtatttaa

SEQ ID NO: 118610 - DNA, 25 bp, Rattus norvegicus
agatatggcctcttacagtatttaa

SEQ ID NO: 118611 - DNA, 25 bp, Rattus norvegicus
agatatggcgatacaggcacagcag

SEQ ID NO: 118612 - DNA, 25 bp, Rattus norvegicus
agatatggcgattcaggcacagcag

SEQ ID NO: 118613 - DNA, 25 bp, Rattus norvegicus
agatatggctacaccccttactgag

SEQ ID NO: 118614 - DNA, 25 bp, Rattus norvegicus
agatatggctactccccttactgag

SEQ ID NO: 118615 - DNA, 25 bp, Rattus norvegicus
agatatggcttcagatcatcctgtc

SEQ ID NO: 118616 - DNA, 25 bp, Rattus norvegicus
agatatggcttctgatcatcctgtc

SEQ ID NO: 118617 - DNA, 25 bp, Rattus norvegicus
agatatggtgacaggccgagcgcaa

SEQ ID NO: 118618 - DNA, 25 bp, Rattus norvegicus
agatatggtgactggccgagcgcaa

SEQ ID NO: 118619 - DNA, 25 bp, Rattus norvegicus
agatatgtatgtaaccttcaggcag

SEQ ID NO: 118620 - DNA, 25 bp, Rattus norvegicus
agatatgtatgttaccttcaggcag

SEQ ID NO: 118621 - DNA, 25 bp, Rattus norvegicus
agatatgtctgtctatccttcctaa

SEQ ID NO: 118622 - DNA, 25 bp, Rattus norvegicus
agatatgtctgtgtatccttcctaa

SEQ ID NO: 118623 - DNA, 25 bp, Rattus norvegicus
agatatgtgccacaaggacttccag

SEQ ID NO: 118624 - DNA, 25 bp, Rattus norvegicus
agatatgtgccagaaggacttccag

SEQ ID NO: 118625 - DNA, 25 bp, Rattus norvegicus
agatatgtgtacctgcatttgcaaa

SEQ ID NO: 118626 - DNA, 25 bp, Rattus norvegicus
agatatgtgtacgtgcatttgcaaa

SEQ ID NO: 118627 - DNA, 25 bp, Rattus norvegicus
agatatgttaccagtttctcctcac

SEQ ID NO: 118628 - DNA, 25 bp, Rattus norvegicus
agatatgttacctgtttctcctcac

SEQ ID NO: 118629 - DNA, 25 bp, Rattus norvegicus
agatatgttacgctccacagcaggc

SEQ ID NO: 118630 - DNA, 25 bp, Rattus norvegicus
agatatgttacggtccacagcaggc

SEQ ID NO: 118631 - DNA, 25 bp, Rattus norvegicus
agatattaattcctggtggcataca

SEQ ID NO: 118632 - DNA, 25 bp, Rattus norvegicus
agatattaattcgtggtggcataca

SEQ ID NO: 118633 - DNA, 25 bp, Rattus norvegicus
agatattcactaagcatccccagtc

SEQ ID NO: 118634 - DNA, 25 bp, Rattus norvegicus
agatattcactatgcatccccagtc

SEQ ID NO: 118635 - DNA, 25 bp, Rattus norvegicus
agatattccaaaacaattgctcgtg

SEQ ID NO: 118636 - DNA, 25 bp, Rattus norvegicus
agatattccaaatcaattgctcgtg

SEQ ID NO: 118637 - DNA, 25 bp, Rattus norvegicus
agatattctaatcgctacttatgca

SEQ ID NO: 118638 - DNA, 25 bp, Rattus norvegicus
agatattctaatggctacttatgca

SEQ ID NO: 118639 - DNA, 25 bp, Rattus norvegicus
agatattctacgctaaaggcccctg

SEQ ID NO: 118640 - DNA, 25 bp, Rattus norvegicus
agatattctacggtaaaggcccctg

SEQ ID NO: 118641 - DNA, 25 bp, Rattus norvegicus
agatattctactccaagtcctacac

SEQ ID NO: 118642 - DNA, 25 bp, Rattus norvegicus
agatattctactgcaagtcctacac

SEQ ID NO: 118643 - DNA, 25 bp, Rattus norvegicus
agatattctccaaaggccactgtct

SEQ ID NO: 118644 - DNA, 25 bp, Rattus norvegicus
agatattctccataggccactgtct

SEQ ID NO: 118645 - DNA, 25 bp, Rattus norvegicus
agatattctctcataggtcctgtgc

SEQ ID NO: 118646 - DNA, 25 bp, Rattus norvegicus
agatattctctcttaggtcctgtgc

SEQ ID NO: 118647 - DNA, 25 bp, Rattus norvegicus
agatattcttgcatctttaatgggt

SEQ ID NO: 118648 - DNA, 25 bp, Rattus norvegicus
agatattcttgcttctttaatgggt

SEQ ID NO: 118649 - DNA, 25 bp, Rattus norvegicus
agatattgccagctttataccggaa

SEQ ID NO: 118650 - DNA, 25 bp, Rattus norvegicus
agatattgccaggtttataccggaa

SEQ ID NO: 118651 - DNA, 25 bp, Rattus norvegicus
agatattgcctgattcttgacttag

SEQ ID NO: 118652 - DNA, 25 bp, Rattus norvegicus
agatattgcctgtttcttgacttag

SEQ ID NO: 118653 - DNA, 25 bp, Rattus norvegicus
agatattgcttgatggcagccatat

SEQ ID NO: 118654 - DNA, 25 bp, Rattus norvegicus
agatattgcttgttggcagccatat

SEQ ID NO: 118655 - DNA, 25 bp, Rattus norvegicus
agatatttacataatgccccaccca

SEQ ID NO: 118656 - DNA, 25 bp, Rattus norvegicus
agatatttacattatgccccaccca

SEQ ID NO: 118657 - DNA, 25 bp, Rattus norvegicus
agatatttcatcagcgtcttcctgc

SEQ ID NO: 118658 - DNA, 25 bp, Rattus norvegicus
agatatttcatctgcgtcttcctgc

SEQ ID NO: 118659 - DNA, 25 bp, Rattus norvegicus
agatatttgcctctctgtttgccca

SEQ ID NO: 118660 - DNA, 25 bp, Rattus norvegicus
agatatttgcctgtctgtttgccca

SEQ ID NO: 118661 - DNA, 25 bp, Rattus norvegicus
agatattttcctcgtgcctttgata

SEQ ID NO: 118662 - DNA, 25 bp, Rattus norvegicus
agatattttcctggtgcctttgata

SEQ ID NO: 118663 - DNA, 25 bp, Rattus norvegicus
agatcaaacgttccagtggcctcat

SEQ ID NO: 118664 - DNA, 25 bp, Rattus norvegicus
agatcaaacgttgcagtggcctcat

SEQ ID NO: 118665 - DNA, 25 bp, Rattus norvegicus
agatcaaagcctactccatagctct

SEQ ID NO: 118666 - DNA, 25 bp, Rattus norvegicus
agatcaaagccttctccatagctct

SEQ ID NO: 118667 - DNA, 25 bp, Rattus norvegicus
agatcaaagctgcagtttcattcca

SEQ ID NO: 118668 - DNA, 25 bp, Rattus norvegicus
agatcaaagctggagtttcattcca

SEQ ID NO: 118669 - DNA, 25 bp, Rattus norvegicus
agatcaaagtctccgtcattctgtg

SEQ ID NO: 118670 - DNA, 25 bp, Rattus norvegicus
agatcaaagtctgcgtcattctgtg

SEQ ID NO: 118671 - DNA, 25 bp, Rattus norvegicus
agatcaacaggaattgcacctcctc

SEQ ID NO: 118672 - DNA, 25 bp, Rattus norvegicus
agatcaacaggatttgcacctcctc

SEQ ID NO: 118673 - DNA, 25 bp, Rattus norvegicus
agatcaaccaggcttctgactcagt

SEQ ID NO: 118674 - DNA, 25 bp, Rattus norvegicus
agatcaaccagggttctgactcagt

SEQ ID NO: 118675 - DNA, 25 bp, Rattus norvegicus
agatcaaccatcaaggcttctctgc

SEQ ID NO: 118676 - DNA, 25 bp, Rattus norvegicus
agatcaaccatctaggcttctctgc

SEQ ID NO: 118677 - DNA, 25 bp, Rattus norvegicus
agatcaaccccgagtggaatgagat

SEQ ID NO: 118678 - DNA, 25 bp, Rattus norvegicus
agatcaaccccgtgtggaatgagat

SEQ ID NO: 118679 - DNA, 25 bp, Rattus norvegicus
agatcaaccgggacctgtttgactt

SEQ ID NO: 118680 - DNA, 25 bp, Rattus norvegicus
agatcaaccgggtcctgtttgactt

SEQ ID NO: 118681 - DNA, 25 bp, Rattus norvegicus
agatcaacttcacaggtccgtgcta

SEQ ID NO: 118682 - DNA, 25 bp, Rattus norvegicus
agatcaacttcagaggtccgtgcta

SEQ ID NO: 118683 - DNA, 25 bp, Rattus norvegicus
agatcaagaccgcatgtggctgcca

SEQ ID NO: 118684 - DNA, 25 bp, Rattus norvegicus
agatcaagaccggatgtggctgcca

SEQ ID NO: 118685 - DNA, 25 bp, Rattus norvegicus
agatcaagcaggagccagaccccac

SEQ ID NO: 118686 - DNA, 25 bp, Rattus norvegicus
agatcaagcaggtgccagaccccac

SEQ ID NO: 118687 - DNA, 25 bp, Rattus norvegicus
agatcaagcagtagcagaccctctt

SEQ ID NO: 118688 - DNA, 25 bp, Rattus norvegicus
agatcaagcagttgcagaccctctt

SEQ ID NO: 118689 - DNA, 25 bp, Rattus norvegicus
agatcaagccagacaactctcgagc

SEQ ID NO: 118690 - DNA, 25 bp, Rattus norvegicus
agatcaagccagtcaactctcgagc

SEQ ID NO: 118691 - DNA, 25 bp, Rattus norvegicus
agatcaagcggcagcggtcacaggt

SEQ ID NO: 118692 - DNA, 25 bp, Rattus norvegicus
agatcaagcggctgcggtcacaggt

SEQ ID NO: 118693 - DNA, 25 bp, Rattus norvegicus
agatcaagggttcaaattcattttc

SEQ ID NO: 118694 - DNA, 25 bp, Rattus norvegicus
agatcaagggttgaaattcattttc

SEQ ID NO: 118695 - DNA, 25 bp, Rattus norvegicus
agatcaaggtcacgctccaggagga

SEQ ID NO: 118696 - DNA, 25 bp, Rattus norvegicus
agatcaaggtcaggctccaggagga

SEQ ID NO: 118697 - DNA, 25 bp, Rattus norvegicus
agatcaagtcacagcatctgtatca

SEQ ID NO: 118698 - DNA, 25 bp, Rattus norvegicus
agatcaagtcactgcatctgtatca

SEQ ID NO: 118699 - DNA, 25 bp, Rattus norvegicus
agatcaagtcgtccttctggcaggc

SEQ ID NO: 118700 - DNA, 25 bp, Rattus norvegicus
agatcaagtcgtgcttctggcaggc

SEQ ID NO: 118701 - DNA, 25 bp, Rattus norvegicus
agatcaagtgtgagctccgtgtcct

SEQ ID NO: 118702 - DNA, 25 bp, Rattus norvegicus
agatcaagtgtgtgctccgtgtcct

SEQ ID NO: 118703 - DNA, 25 bp, Rattus norvegicus
agatcaatcagcactttcctgtggt

SEQ ID NO: 118704 - DNA, 25 bp, Rattus norvegicus
agatcaatcagctctttcctgtggt

SEQ ID NO: 118705 - DNA, 25 bp, Rattus norvegicus
agatcaatgctgacccacactattt

SEQ ID NO: 118706 - DNA, 25 bp, Rattus norvegicus
agatcaatgctgtcccacactattt

SEQ ID NO: 118707 - DNA, 25 bp, Rattus norvegicus
agatcaatggtcatttcactgtccc

SEQ ID NO: 118708 - DNA, 25 bp, Rattus norvegicus
agatcaatggtcttttcactgtccc

SEQ ID NO: 118709 - DNA, 25 bp, Rattus norvegicus
agatcaatgtctcttctagtcctct

SEQ ID NO: 118710 - DNA, 25 bp, Rattus norvegicus
agatcaatgtctgttctagtcctct

SEQ ID NO: 118711 - DNA, 25 bp, Rattus norvegicus
agatcaattcttctgggcctgtgaa

SEQ ID NO: 118712 - DNA, 25 bp, Rattus norvegicus
agatcaattcttgtgggcctgtgaa

SEQ ID NO: 118713 - DNA, 25 bp, Rattus norvegicus
agatcaattgccagccgcatttgcg

SEQ ID NO: 118714 - DNA, 25 bp, Rattus norvegicus
agatcaattgcctgccgcatttgcg

SEQ ID NO: 118715 - DNA, 25 bp, Rattus norvegicus
agatcaatttctcttcatccacctt

SEQ ID NO: 118716 - DNA, 25 bp, Rattus norvegicus
agatcaatttctgttcatccacctt

SEQ ID NO: 118717 - DNA, 25 bp, Rattus norvegicus
agatcacacatcagaggatactctg

SEQ ID NO: 118718 - DNA, 25 bp, Rattus norvegicus
agatcacacatctgaggatactctg

SEQ ID NO: 118719 - DNA, 25 bp, Rattus norvegicus
agatcacagaccagggcctgcagct

SEQ ID NO: 118720 - DNA, 25 bp, Rattus norvegicus
agatcacagacctgggcctgcagct

SEQ ID NO: 118721 - DNA, 25 bp, Rattus norvegicus
agatcacagatgagagcggccacct

SEQ ID NO: 118722 - DNA, 25 bp, Rattus norvegicus
agatcacagatgtgagcggccacct

SEQ ID NO: 118723 - DNA, 25 bp, Rattus norvegicus
agatcacaggcacgataccgtctcc

SEQ ID NO: 118724 - DNA, 25 bp, Rattus norvegicus
agatcacaggcaggataccgtctcc

SEQ ID NO: 118725 - DNA, 25 bp, Rattus norvegicus
agatcacaggttcctgccgtgttac

SEQ ID NO: 118726 - DNA, 25 bp, Rattus norvegicus
agatcacaggttgctgccgtgttac

SEQ ID NO: 118727 - DNA, 25 bp, Rattus norvegicus
agatcacagtaccattcttctccaa

SEQ ID NO: 118728 - DNA, 25 bp, Rattus norvegicus
agatcacagtacgattcttctccaa

SEQ ID NO: 118729 - DNA, 25 bp, Rattus norvegicus
agatcacatcccaccagatagaagt

SEQ ID NO: 118730 - DNA, 25 bp, Rattus norvegicus
agatcacatccctccagatagaagt

SEQ ID NO: 118731 - DNA, 25 bp, Rattus norvegicus
agatcacatcctccatgttgcaggg

SEQ ID NO: 118732 - DNA, 25 bp, Rattus norvegicus
agatcacatcctgcatgttgcaggg

SEQ ID NO: 118733 - DNA, 25 bp, Rattus norvegicus
agatcaccaacaagccaggacaagt

SEQ ID NO: 118734 - DNA, 25 bp, Rattus norvegicus
agatcaccaacatgccaggacaagt

SEQ ID NO: 118735 - DNA, 25 bp, Rattus norvegicus
agatcaccacgtacttcagacagtt

SEQ ID NO: 118736 - DNA, 25 bp, Rattus norvegicus
agatcaccacgtctgttgcactggc

SEQ ID NO: 118737 - DNA, 25 bp, Rattus norvegicus
agatcaccacgtgtgttgcactggc

SEQ ID NO: 118738 - DNA, 25 bp, Rattus norvegicus
agatcaccacgttcttcagacagtt

SEQ ID NO: 118739 - DNA, 25 bp, Rattus norvegicus
agatcaccagcaaacgccatgaccg

SEQ ID NO: 118740 - DNA, 25 bp, Rattus norvegicus
agatcaccagcatacgccatgaccg

SEQ ID NO: 118741 - DNA, 25 bp, Rattus norvegicus
agatcaccagcgatggtccctgtag

SEQ ID NO: 118742 - DNA, 25 bp, Rattus norvegicus
agatcaccagcgttggtccctgtag

SEQ ID NO: 118743 - DNA, 25 bp, Rattus norvegicus
agatcaccagtactcggtgtccctg

SEQ ID NO: 118744 - DNA, 25 bp, Rattus norvegicus
agatcaccagtagtcggtgtccctg

SEQ ID NO: 118745 - DNA, 25 bp, Rattus norvegicus
agatcaccagtgatgccaaggcctt

SEQ ID NO: 118746 - DNA, 25 bp, Rattus norvegicus
agatcaccagtgttgccaaggcctt

SEQ ID NO: 118747 - DNA, 25 bp, Rattus norvegicus
agatcaccatggacacatcccaggt

SEQ ID NO: 118748 - DNA, 25 bp, Rattus norvegicus
agatcaccatggtcacatcccaggt

SEQ ID NO: 118749 - DNA, 25 bp, Rattus norvegicus
agatcacccacccaactgagtttga

SEQ ID NO: 118750 - DNA, 25 bp, Rattus norvegicus
agatcacccaccgaactgagtttga

SEQ ID NO: 118751 - DNA, 25 bp, Rattus norvegicus
agatcacccctcatttatctggctc

SEQ ID NO: 118752 - DNA, 25 bp, Rattus norvegicus
agatcacccctcttttatctggctc

SEQ ID NO: 118753 - DNA, 25 bp, Rattus norvegicus
agatcacccctgctagataggttct

SEQ ID NO: 118754 - DNA, 25 bp, Rattus norvegicus
agatcacccctggtagataggttct

SEQ ID NO: 118755 - DNA, 25 bp, Rattus norvegicus
agatcaccgctgcagccaaatggat

SEQ ID NO: 118756 - DNA, 25 bp, Rattus norvegicus
agatcaccgctggagccaaatggat

SEQ ID NO: 118757 - DNA, 25 bp, Rattus norvegicus
agatcacctaaaactgctttattag

SEQ ID NO: 118758 - DNA, 25 bp, Rattus norvegicus
agatcacctaaatctgctttattag

SEQ ID NO: 118759 - DNA, 25 bp, Rattus norvegicus
agatcacctacacctcgttactcaa

SEQ ID NO: 118760 - DNA, 25 bp, Rattus norvegicus
agatcacctacagctcgttactcaa

SEQ ID NO: 118761 - DNA, 25 bp, Rattus norvegicus
agatcacctctgatgagcggcttcg

SEQ ID NO: 118762 - DNA, 25 bp, Rattus norvegicus
agatcacctctgttgagcggcttcg

SEQ ID NO: 118763 - DNA, 25 bp, Rattus norvegicus
agatcacctgaaactcctcggctgt

SEQ ID NO: 118764 - DNA, 25 bp, Rattus norvegicus
agatcacctgaatctcctcggctgt

SEQ ID NO: 118765 - DNA, 25 bp, Rattus norvegicus
agatcacctggcctggatgttcttc

SEQ ID NO: 118766 - DNA, 25 bp, Rattus norvegicus
agatcacctggcgtggatgttcttc

SEQ ID NO: 118767 - DNA, 25 bp, Rattus norvegicus
agatcacctttgatgacacctgcaa

SEQ ID NO: 118768 - DNA, 25 bp, Rattus norvegicus
agatcacctttgttgacacctgcaa

SEQ ID NO: 118769 - DNA, 25 bp, Rattus norvegicus
agatcacgactaccagaaccacatt

SEQ ID NO: 118770 - DNA, 25 bp, Rattus norvegicus
agatcacgactagcagaaccacatt

SEQ ID NO: 118771 - DNA, 25 bp, Rattus norvegicus
agatcacgctggactagaactcaca

SEQ ID NO: 118772 - DNA, 25 bp, Rattus norvegicus
agatcacgctggtctagaactcaca

SEQ ID NO: 118773 - DNA, 25 bp, Rattus norvegicus
agatcacgggcgctaatgccaagaa

SEQ ID NO: 118774 - DNA, 25 bp, Rattus norvegicus
agatcacgggcggtaatgccaagaa

SEQ ID NO: 118775 - DNA, 25 bp, Rattus norvegicus
agatcacgtggtacaatggctcagt

SEQ ID NO: 118776 - DNA, 25 bp, Rattus norvegicus
agatcacgtggttcaatggctcagt

SEQ ID NO: 118777 - DNA, 25 bp, Rattus norvegicus
agatcactcaccagaaacacctttt

SEQ ID NO: 118778 - DNA, 25 bp, Rattus norvegicus
agatcactcacctgaaacacctttt

SEQ ID NO: 118779 - DNA, 25 bp, Rattus norvegicus
agatcactcactcctatctgtgtaa

SEQ ID NO: 118780 - DNA, 25 bp, Rattus norvegicus
agatcactcactgctatctgtgtaa

SEQ ID NO: 118781 - DNA, 25 bp, Rattus norvegicus
agatcactctacaaaccaagctcgg

SEQ ID NO: 118782 - DNA, 25 bp, Rattus norvegicus
agatcactctactaaccaagctcgg

SEQ ID NO: 118783 - DNA, 25 bp, Rattus norvegicus
agatcactgcagcttctaggaccca

SEQ ID NO: 118784 - DNA, 25 bp, Rattus norvegicus
agatcactgcaggttctaggaccca

SEQ ID NO: 118785 - DNA, 25 bp, Rattus norvegicus
agatcactggagaagtcctctggta

SEQ ID NO: 118786 - DNA, 25 bp, Rattus norvegicus
agatcactggagtagtcctctggta

SEQ ID NO: 118787 - DNA, 25 bp, Rattus norvegicus
agatcactgtcacttccgaggtgcc

SEQ ID NO: 118788 - DNA, 25 bp, Rattus norvegicus
agatcactgtcagttccgaggtgcc

SEQ ID NO: 118789 - DNA, 25 bp, Rattus norvegicus
agatcactgtctctagcctttctgg

SEQ ID NO: 118790 - DNA, 25 bp, Rattus norvegicus
agatcactgtctgtagcctttctgg

SEQ ID NO: 118791 - DNA, 25 bp, Rattus norvegicus
agatcactgtgcctctctgaagggc

SEQ ID NO: 118792 - DNA, 25 bp, Rattus norvegicus
agatcactgtgcgtctctgaagggc

SEQ ID NO: 118793 - DNA, 25 bp, Rattus norvegicus
agatcacttgccaaacacataccag

SEQ ID NO: 118794 - DNA, 25 bp, Rattus norvegicus
agatcacttgcctaacacataccag

SEQ ID NO: 118795 - DNA, 25 bp, Rattus norvegicus
agatcacttggaccattgagaacaa

SEQ ID NO: 118796 - DNA, 25 bp, Rattus norvegicus
agatcacttggagcattgagaacaa

SEQ ID NO: 118797 - DNA, 25 bp, Rattus norvegicus
agatcacttgttagttctggtccca

SEQ ID NO: 118798 - DNA, 25 bp, Rattus norvegicus
agatcacttgtttgttctggtccca

SEQ ID NO: 118799 - DNA, 25 bp, Rattus norvegicus
agatcactttctcactgggcagtgc

SEQ ID NO: 118800 - DNA, 25 bp, Rattus norvegicus
agatcactttctgactgggcagtgc

SEQ ID NO: 118801 - DNA, 25 bp, Rattus norvegicus
agatcagaaatcacccgtccttttg

SEQ ID NO: 118802 - DNA, 25 bp, Rattus norvegicus
agatcagaaatctcccgtccttttg

SEQ ID NO: 118803 - DNA, 25 bp, Rattus norvegicus
agatcagaagatccctacgctctca

SEQ ID NO: 118804 - DNA, 25 bp, Rattus norvegicus
agatcagaagatgcctacgctctca

SEQ ID NO: 118805 - DNA, 25 bp, Rattus norvegicus
agatcagaagtcactgcgcaggccc

SEQ ID NO: 118806 - DNA, 25 bp, Rattus norvegicus
agatcagaagtctctgcgcaggccc

SEQ ID NO: 118807 - DNA, 25 bp, Rattus norvegicus
agatcagaatatcggccacacctgt

SEQ ID NO: 118808 - DNA, 25 bp, Rattus norvegicus
agatcagaatatgggccacacctgt

SEQ ID NO: 118809 - DNA, 25 bp, Rattus norvegicus
agatcagaggtcatgcccatgagca

SEQ ID NO: 118810 - DNA, 25 bp, Rattus norvegicus
agatcagaggtcttgcccatgagca

SEQ ID NO: 118811 - DNA, 25 bp, Rattus norvegicus
agatcagatgccaggttgctctcaa

SEQ ID NO: 118812 - DNA, 25 bp, Rattus norvegicus
agatcagatgcctggttgctctcaa

SEQ ID NO: 118813 - DNA, 25 bp, Rattus norvegicus
agatcagcaccacggcttgtaagat

SEQ ID NO: 118814 - DNA, 25 bp, Rattus norvegicus
agatcagcaccagggcttgtaagat

SEQ ID NO: 118815 - DNA, 25 bp, Rattus norvegicus
agatcagcacctacatagggacctt

SEQ ID NO: 118816 - DNA, 25 bp, Rattus norvegicus
agatcagcaccttcatagggacctt

SEQ ID NO: 118817 - DNA, 25 bp, Rattus norvegicus
agatcagcagcaccgctccaagatg

SEQ ID NO: 118818 - DNA, 25 bp, Rattus norvegicus
agatcagcagcagcgctccaagatg

SEQ ID NO: 118819 - DNA, 25 bp, Rattus norvegicus
agatcagcctggatacacggtgaga

SEQ ID NO: 118820 - DNA, 25 bp, Rattus norvegicus
agatcagcctggttacacggtgaga

SEQ ID NO: 118821 - DNA, 25 bp, Rattus norvegicus
agatcagcctttatgttccaatgag

SEQ ID NO: 118822 - DNA, 25 bp, Rattus norvegicus
agatcagcctttcagcccagcgagc

SEQ ID NO: 118823 - DNA, 25 bp, Rattus norvegicus
agatcagcctttgagcccagcgagc

SEQ ID NO: 118824 - DNA, 25 bp, Rattus norvegicus
agatcagcctttttgttccaatgag

SEQ ID NO: 118825 - DNA, 25 bp, Rattus norvegicus
agatcagcggtcagagcgctacatt

SEQ ID NO: 118826 - DNA, 25 bp, Rattus norvegicus
agatcagcggtctgagcgctacatt

SEQ ID NO: 118827 - DNA, 25 bp, Rattus norvegicus
agatcagctccccagtcagtgggtt

SEQ ID NO: 118828 - DNA, 25 bp, Rattus norvegicus
agatcagctcccgagtcagtgggtt

SEQ ID NO: 118829 - DNA, 25 bp, Rattus norvegicus
agatcagctcgaacgggtcttttta

SEQ ID NO: 118830 - DNA, 25 bp, Rattus norvegicus
agatcagctcgatcgggtcttttta

SEQ ID NO: 118831 - DNA, 25 bp, Rattus norvegicus
agatcagctgacacctggtacccga

SEQ ID NO: 118832 - DNA, 25 bp, Rattus norvegicus
agatcagctgactcctggtacccga

SEQ ID NO: 118833 - DNA, 25 bp, Rattus norvegicus
agatcagctgcacagtgcaaggcga

SEQ ID NO: 118834 - DNA, 25 bp, Rattus norvegicus
agatcagctgcagagtgcaaggcga

SEQ ID NO: 118835 - DNA, 25 bp, Rattus norvegicus
agatcagcttagatacccacggttc

SEQ ID NO: 118836 - DNA, 25 bp, Rattus norvegicus
agatcagcttagttacccacggttc

SEQ ID NO: 118837 - DNA, 25 bp, Rattus norvegicus
agatcaggaggcatttcatgtgcat

SEQ ID NO: 118838 - DNA, 25 bp, Rattus norvegicus
agatcaggaggcttttcatgtgcat

SEQ ID NO: 118839 - DNA, 25 bp, Rattus norvegicus
agatcaggccagactgggcttcgaa

SEQ ID NO: 118840 - DNA, 25 bp, Rattus norvegicus
agatcaggccagtctgggcttcgaa

SEQ ID NO: 118841 - DNA, 25 bp, Rattus norvegicus
agatcaggccttatgctggagggta

SEQ ID NO: 118842 - DNA, 25 bp, Rattus norvegicus
agatcaggccttctttgttcttcac

SEQ ID NO: 118843 - DNA, 25 bp, Rattus norvegicus
agatcaggccttgtttgttcttcac

SEQ ID NO: 118844 - DNA, 25 bp, Rattus norvegicus
agatcaggccttttgctggagggta

SEQ ID NO: 118845 - DNA, 25 bp, Rattus norvegicus
agatcaggctacctcgatgtctcaa

SEQ ID NO: 118846 - DNA, 25 bp, Rattus norvegicus
agatcaggctacgtcgatgtctcaa

SEQ ID NO: 118847 - DNA, 25 bp, Rattus norvegicus
agatcaggctctatgtttgtgcgtc

SEQ ID NO: 118848 - DNA, 25 bp, Rattus norvegicus
agatcaggctctttgtttgtgcgtc

SEQ ID NO: 118849 - DNA, 25 bp, Rattus norvegicus
agatcagggaccacatcaatcactc

SEQ ID NO: 118850 - DNA, 25 bp, Rattus norvegicus
agatcagggacctcatcaatcactc

SEQ ID NO: 118851 - DNA, 25 bp, Rattus norvegicus
agatcagggcttagttcctataccc

SEQ ID NO: 118852 - DNA, 25 bp, Rattus norvegicus
agatcagggctttgttcctataccc

SEQ ID NO: 118853 - DNA, 25 bp, Rattus norvegicus
agatcagggtgcagagctctcagtt

SEQ ID NO: 118854 - DNA, 25 bp, Rattus norvegicus
agatcagggtgctgagctctcagtt

SEQ ID NO: 118855 - DNA, 25 bp, Rattus norvegicus
agatcaggtgtcattctgctgtcac

SEQ ID NO: 118856 - DNA, 25 bp, Rattus norvegicus
agatcaggtgtctttctgctgtcac

SEQ ID NO: 118857 - DNA, 25 bp, Rattus norvegicus
agatcagtaagcatgttgtttacat

SEQ ID NO: 118858 - DNA, 25 bp, Rattus norvegicus
agatcagtaagcttgttgtttacat

SEQ ID NO: 118859 - DNA, 25 bp, Rattus norvegicus
agatcagtagacatgccctgggaga

SEQ ID NO: 118860 - DNA, 25 bp, Rattus norvegicus
agatcagtagacttgccctgggaga

SEQ ID NO: 118861 - DNA, 25 bp, Rattus norvegicus
agatcagtcttccagtctgtagcac

SEQ ID NO: 118862 - DNA, 25 bp, Rattus norvegicus
agatcagtcttcgagtctgtagcac

SEQ ID NO: 118863 - DNA, 25 bp, Rattus norvegicus
agatcagtgaccacattgaacgaaa

SEQ ID NO: 118864 - DNA, 25 bp, Rattus norvegicus
agatcagtgacctcattgaacgaaa

SEQ ID NO: 118865 - DNA, 25 bp, Rattus norvegicus
agatcagtggccagcgaagagacca

SEQ ID NO: 118866 - DNA, 25 bp, Rattus norvegicus
agatcagtggcctgcgaagagacca

SEQ ID NO: 118867 - DNA, 25 bp, Rattus norvegicus
agatcagtgttaacaggtgacgaca

SEQ ID NO: 118868 - DNA, 25 bp, Rattus norvegicus
agatcagtgttatcaggtgacgaca

SEQ ID NO: 118869 - DNA, 25 bp, Rattus norvegicus
agatcagttaggcacatttgctcat

SEQ ID NO: 118870 - DNA, 25 bp, Rattus norvegicus
agatcagttagggacatttgctcat

SEQ ID NO: 118871 - DNA, 25 bp, Rattus norvegicus
agatcagttccactgtcctcttgaa

SEQ ID NO: 118872 - DNA, 25 bp, Rattus norvegicus
agatcagttccagtgtcctcttgaa

SEQ ID NO: 118873 - DNA, 25 bp, Rattus norvegicus
agatcagttcctatcttctcagagg

SEQ ID NO: 118874 - DNA, 25 bp, Rattus norvegicus
agatcagttcctttcttctcagagg

SEQ ID NO: 118875 - DNA, 25 bp, Rattus norvegicus
agatcagttctcagcacctatgttg

SEQ ID NO: 118876 - DNA, 25 bp, Rattus norvegicus
agatcagttctctgcacctatgttg

SEQ ID NO: 118877 - DNA, 25 bp, Rattus norvegicus
agatcagtttacatacacttcagat

SEQ ID NO: 118878 - DNA, 25 bp, Rattus norvegicus
agatcagtttacttacacttcagat

SEQ ID NO: 118879 - DNA, 25 bp, Rattus norvegicus
agatcagtttgcaggagggcctctt

SEQ ID NO: 118880 - DNA, 25 bp, Rattus norvegicus
agatcagtttgctggagggcctctt

SEQ ID NO: 118881 - DNA, 25 bp, Rattus norvegicus
agatcagttttgacctcttatcctc

SEQ ID NO: 118882 - DNA, 25 bp, Rattus norvegicus
agatcagttttgtcctcttatcctc

SEQ ID NO: 118883 - DNA, 25 bp, Rattus norvegicus
agatcataatgtaacgctcccagac

SEQ ID NO: 118884 - DNA, 25 bp, Rattus norvegicus
agatcataatgttacgctcccagac

SEQ ID NO: 118885 - DNA, 25 bp, Rattus norvegicus
agatcatacccaatctgcctggtca

SEQ ID NO: 118886 - DNA, 25 bp, Rattus norvegicus
agatcatacccattctgcctggtca

SEQ ID NO: 118887 - DNA, 25 bp, Rattus norvegicus
agatcatacgggattgggcttctcc

SEQ ID NO: 118888 - DNA, 25 bp, Rattus norvegicus
agatcatacgggtttgggcttctcc

SEQ ID NO: 118889 - DNA, 25 bp, Rattus norvegicus
agatcatactggaacacagcagctt

SEQ ID NO: 118890 - DNA, 25 bp, Rattus norvegicus
agatcatactggatggtttctccct

SEQ ID NO: 118891 - DNA, 25 bp, Rattus norvegicus
agatcatactggtacacagcagctt

SEQ ID NO: 118892 - DNA, 25 bp, Rattus norvegicus
agatcatactggttggtttctccct

SEQ ID NO: 118893 - DNA, 25 bp, Rattus norvegicus
agatcatactgtatcatcctcttca

SEQ ID NO: 118894 - DNA, 25 bp, Rattus norvegicus
agatcatactgtttcatcctcttca

SEQ ID NO: 118895 - DNA, 25 bp, Rattus norvegicus
agatcatacttacccttaatttttg

SEQ ID NO: 118896 - DNA, 25 bp, Rattus norvegicus
agatcatacttagccttaatttttg

SEQ ID NO: 118897 - DNA, 25 bp, Rattus norvegicus
agatcatagtgtacagtgtcctctg

SEQ ID NO: 118898 - DNA, 25 bp, Rattus norvegicus
agatcatagtgttcagtgtcctctg

SEQ ID NO: 118899 - DNA, 25 bp, Rattus norvegicus
agatcatatctaatgttaggttttg

SEQ ID NO: 118900 - DNA, 25 bp, Rattus norvegicus
agatcatatctattgttaggttttg

SEQ ID NO: 118901 - DNA, 25 bp, Rattus norvegicus
agatcatcaggtcagctctttgccc

SEQ ID NO: 118902 - DNA, 25 bp, Rattus norvegicus
agatcatcaggtgagctctttgccc

SEQ ID NO: 118903 - DNA, 25 bp, Rattus norvegicus
agatcatcagttcagcttgggctac

SEQ ID NO: 118904 - DNA, 25 bp, Rattus norvegicus
agatcatcagttgagcttgggctac

SEQ ID NO: 118905 - DNA, 25 bp, Rattus norvegicus
agatcatcatcaaaccagttattag

SEQ ID NO: 118906 - DNA, 25 bp, Rattus norvegicus
agatcatcatcaactgacagggagg

SEQ ID NO: 118907 - DNA, 25 bp, Rattus norvegicus
agatcatcatcacccgggcctcaaa

SEQ ID NO: 118908 - DNA, 25 bp, Rattus norvegicus
agatcatcatcagccgggcctcaaa

SEQ ID NO: 118909 - DNA, 25 bp, Rattus norvegicus
agatcatcatcataccagttattag

SEQ ID NO: 118910 - DNA, 25 bp, Rattus norvegicus
agatcatcatcatctgacagggagg

SEQ ID NO: 118911 - DNA, 25 bp, Rattus norvegicus
agatcatccctaacttgtcaaaagc

SEQ ID NO: 118912 - DNA, 25 bp, Rattus norvegicus
agatcatccctatcttgtcaaaagc

SEQ ID NO: 118913 - DNA, 25 bp, Rattus norvegicus
agatcatccggtctccagggaggaa

SEQ ID NO: 118914 - DNA, 25 bp, Rattus norvegicus
agatcatccggtgtccagggaggaa

SEQ ID NO: 118915 - DNA, 25 bp, Rattus norvegicus
agatcatcctcacaggccagacagt

SEQ ID NO: 118916 - DNA, 25 bp, Rattus norvegicus
agatcatcctcagaggccagacagt

SEQ ID NO: 118917 - DNA, 25 bp, Rattus norvegicus
agatcatcctccagtcacagtcttg

SEQ ID NO: 118918 - DNA, 25 bp, Rattus norvegicus
agatcatcctcctgtcacagtcttg

SEQ ID NO: 118919 - DNA, 25 bp, Rattus norvegicus
agatcatcctctacttttctagttt

SEQ ID NO: 118920 - DNA, 25 bp, Rattus norvegicus
agatcatcctcttcttttctagttt

SEQ ID NO: 118921 - DNA, 25 bp, Rattus norvegicus
agatcatcgaggacaaaacttttgg

SEQ ID NO: 118922 - DNA, 25 bp, Rattus norvegicus
agatcatcgaggtcaaaacttttgg

SEQ ID NO: 118923 - DNA, 25 bp, Rattus norvegicus
agatcatcgcagacgtgtcccagga

SEQ ID NO: 118924 - DNA, 25 bp, Rattus norvegicus
agatcatcgcagtcgtgtcccagga

SEQ ID NO: 118925 - DNA, 25 bp, Rattus norvegicus
agatcatcgtgcactcagactctga

SEQ ID NO: 118926 - DNA, 25 bp, Rattus norvegicus
agatcatcgtgctctcagactctga

SEQ ID NO: 118927 - DNA, 25 bp, Rattus norvegicus
agatcatctcctccattcttaaggt

SEQ ID NO: 118928 - DNA, 25 bp, Rattus norvegicus
agatcatctcctgcattcttaaggt

SEQ ID NO: 118929 - DNA, 25 bp, Rattus norvegicus
agatcatctctgagcaagtgcccaa

SEQ ID NO: 118930 - DNA, 25 bp, Rattus norvegicus
agatcatctctgtgcaagtgcccaa

SEQ ID NO: 118931 - DNA, 25 bp, Rattus norvegicus
agatcatctggcacctggtctagtc

SEQ ID NO: 118932 - DNA, 25 bp, Rattus norvegicus
agatcatctggctcctggtctagtc

SEQ ID NO: 118933 - DNA, 25 bp, Rattus norvegicus
agatcatctgggagctcactcagag

SEQ ID NO: 118934 - DNA, 25 bp, Rattus norvegicus
agatcatctgggtgctcactcagag

SEQ ID NO: 118935 - DNA, 25 bp, Rattus norvegicus
agatcatcttctcagctagctgcca

SEQ ID NO: 118936 - DNA, 25 bp, Rattus norvegicus
agatcatcttctgagctagctgcca

SEQ ID NO: 118937 - DNA, 25 bp, Rattus norvegicus
agatcatcttggagtccttcagggc

SEQ ID NO: 118938 - DNA, 25 bp, Rattus norvegicus
agatcatcttggtgtccttcagggc

SEQ ID NO: 118939 - DNA, 25 bp, Rattus norvegicus
agatcatcttgtccagaccttcttc

SEQ ID NO: 118940 - DNA, 25 bp, Rattus norvegicus
agatcatcttgtgcagaccttcttc

SEQ ID NO: 118941 - DNA, 25 bp, Rattus norvegicus
agatcatgaagcacctgcgcaagct

SEQ ID NO: 118942 - DNA, 25 bp, Rattus norvegicus
agatcatgaagctcctgcgcaagct

SEQ ID NO: 118943 - DNA, 25 bp, Rattus norvegicus
agatcatgagtcctctggccaaatg

SEQ ID NO: 118944 - DNA, 25 bp, Rattus norvegicus
agatcatgagtcgtctggccaaatg

SEQ ID NO: 118945 - DNA, 25 bp, Rattus norvegicus
agatcatgatatcgcactgtcctgg

SEQ ID NO: 118946 - DNA, 25 bp, Rattus norvegicus
agatcatgatatggcactgtcctgg

SEQ ID NO: 118947 - DNA, 25 bp, Rattus norvegicus
agatcatgcatgcttgaggccttcc

SEQ ID NO: 118948 - DNA, 25 bp, Rattus norvegicus
agatcatgcatggttgaggccttcc

SEQ ID NO: 118949 - DNA, 25 bp, Rattus norvegicus
agatcatgcgatactttgtcagggt

SEQ ID NO: 118950 - DNA, 25 bp, Rattus norvegicus
agatcatgcgattctttgtcagggt

SEQ ID NO: 118951 - DNA, 25 bp, Rattus norvegicus
agatcatgcggcacaccaggttgct

SEQ ID NO: 118952 - DNA, 25 bp, Rattus norvegicus
agatcatgcggctcaccaggttgct

SEQ ID NO: 118953 - DNA, 25 bp, Rattus norvegicus
agatcatgctgcagttgatctccta

SEQ ID NO: 118954 - DNA, 25 bp, Rattus norvegicus
agatcatgctgctgttgatctccta

SEQ ID NO: 118955 - DNA, 25 bp, Rattus norvegicus
agatcatggaggagctcgaggcctc

SEQ ID NO: 118956 - DNA, 25 bp, Rattus norvegicus
agatcatggaggtgctcgaggcctc

SEQ ID NO: 118957 - DNA, 25 bp, Rattus norvegicus
agatcatggcggaccacgtgacctt

SEQ ID NO: 118958 - DNA, 25 bp, Rattus norvegicus
agatcatggcggtccacgtgacctt

SEQ ID NO: 118959 - DNA, 25 bp, Rattus norvegicus
agatcatgggcaatgagcactggat

SEQ ID NO: 118960 - DNA, 25 bp, Rattus norvegicus
agatcatgggcattgagcactggat

SEQ ID NO: 118961 - DNA, 25 bp, Rattus norvegicus
agatcatgtccccatcgttgtgtca

SEQ ID NO: 118962 - DNA, 25 bp, Rattus norvegicus
agatcatgtcccgatcgttgtgtca

SEQ ID NO: 118963 - DNA, 25 bp, Rattus norvegicus
agatcatgtcttaattgccgccttc

SEQ ID NO: 118964 - DNA, 25 bp, Rattus norvegicus
agatcatgtctttattgccgccttc

SEQ ID NO: 118965 - DNA, 25 bp, Rattus norvegicus
agatcatgtgctattccaagtgccc

SEQ ID NO: 118966 - DNA, 25 bp, Rattus norvegicus
agatcatgtgcttttccaagtgccc

SEQ ID NO: 118967 - DNA, 25 bp, Rattus norvegicus
agatcattaaggagccagccccaga

SEQ ID NO: 118968 - DNA, 25 bp, Rattus norvegicus
agatcattaaggtgccagccccaga

SEQ ID NO: 118969 - DNA, 25 bp, Rattus norvegicus
agatcattagccaccttcagattaa

SEQ ID NO: 118970 - DNA, 25 bp, Rattus norvegicus
agatcattagcctccttcagattaa

SEQ ID NO: 118971 - DNA, 25 bp, Rattus norvegicus
agatcattcgcaaggaaatccccgc

SEQ ID NO: 118972 - DNA, 25 bp, Rattus norvegicus
agatcattcgcatggaaatccccgc

SEQ ID NO: 118973 - DNA, 25 bp, Rattus norvegicus
agatcattgccgaggacatcaacaa

SEQ ID NO: 118974 - DNA, 25 bp, Rattus norvegicus
agatcattgccgtggacatcaacaa

SEQ ID NO: 118975 - DNA, 25 bp, Rattus norvegicus
agatcattgtctcccgctacagagg

SEQ ID NO: 118976 - DNA, 25 bp, Rattus norvegicus
agatcattgtctgccgctacagagg

SEQ ID NO: 118977 - DNA, 25 bp, Rattus norvegicus
agatcattgttcagtgtctcctgta

SEQ ID NO: 118978 - DNA, 25 bp, Rattus norvegicus
agatcattgttctgtgtctcctgta

SEQ ID NO: 118979 - DNA, 25 bp, Rattus norvegicus
agatcattttctccaggatgcctgt

SEQ ID NO: 118980 - DNA, 25 bp, Rattus norvegicus
agatcattttctgcaggatgcctgt

SEQ ID NO: 118981 - DNA, 25 bp, Rattus norvegicus
agatccaacactctcatgtctgtgt

SEQ ID NO: 118982 - DNA, 25 bp, Rattus norvegicus
agatccaacactgtcatgtctgtgt

SEQ ID NO: 118983 - DNA, 25 bp, Rattus norvegicus
agatccaaccacctggaggctgctg

SEQ ID NO: 118984 - DNA, 25 bp, Rattus norvegicus
agatccaaccacgtggaggctgctg

SEQ ID NO: 118985 - DNA, 25 bp, Rattus norvegicus
agatccaactttaattccttcgcgt

SEQ ID NO: 118986 - DNA, 25 bp, Rattus norvegicus
agatccaacttttattccttcgcgt

SEQ ID NO: 118987 - DNA, 25 bp, Rattus norvegicus
agatccaagagacatcgttccccaa

SEQ ID NO: 118988 - DNA, 25 bp, Rattus norvegicus
agatccaagagagatcgttccccaa

SEQ ID NO: 118989 - DNA, 25 bp, Rattus norvegicus
agatccaagtctacccaggtagatt

SEQ ID NO: 118990 - DNA, 25 bp, Rattus norvegicus
agatccaagtcttcccaggtagatt

SEQ ID NO: 118991 - DNA, 25 bp, Rattus norvegicus
agatccaagttcaggaggtgtcctt

SEQ ID NO: 118992 - DNA, 25 bp, Rattus norvegicus
agatccaagttctggaggtgtcctt

SEQ ID NO: 118993 - DNA, 25 bp, Rattus norvegicus
agatccaagtttccaacgcaacaca

SEQ ID NO: 118994 - DNA, 25 bp, Rattus norvegicus
agatccaagtttgcaacgcaacaca

SEQ ID NO: 118995 - DNA, 25 bp, Rattus norvegicus
agatccaattccattagtaccgtgc

SEQ ID NO: 118996 - DNA, 25 bp, Rattus norvegicus
agatccaattcctttagtaccgtgc

SEQ ID NO: 118997 - DNA, 25 bp, Rattus norvegicus
agatccacagctagtgcgcatgttt

SEQ ID NO: 118998 - DNA, 25 bp, Rattus norvegicus
agatccacagcttgtgcgcatgttt

SEQ ID NO: 118999 - DNA, 25 bp, Rattus norvegicus
agatccacagtacggctgcctggac

SEQ ID NO: 119000 - DNA, 25 bp, Rattus norvegicus
agatccacagtagggctgcctggac

SEQ ID NO: 119001 - DNA, 25 bp, Rattus norvegicus
agatccacattactacaacattccc

SEQ ID NO: 119002 - DNA, 25 bp, Rattus norvegicus
agatccacattagtacaacattccc

SEQ ID NO: 119003 - DNA, 25 bp, Rattus norvegicus
agatccaccatcagtaatgtccttg

SEQ ID NO: 119004 - DNA, 25 bp, Rattus norvegicus
agatccaccatctgtaatgtccttg

SEQ ID NO: 119005 - DNA, 25 bp, Rattus norvegicus
agatccacctggaggtggtggacaa

SEQ ID NO: 119006 - DNA, 25 bp, Rattus norvegicus
agatccacctggtggtggtggacaa

SEQ ID NO: 119007 - DNA, 25 bp, Rattus norvegicus
agatccacgtggctgtcctgagtcc

SEQ ID NO: 119008 - DNA, 25 bp, Rattus norvegicus
agatccacgtgggtgtcctgagtcc

SEQ ID NO: 119009 - DNA, 25 bp, Rattus norvegicus
agatccactgtcctctgggaagcga

SEQ ID NO: 119010 - DNA, 25 bp, Rattus norvegicus
agatccactgtcgtctgggaagcga

SEQ ID NO: 119011 - DNA, 25 bp, Rattus norvegicus
agatccacttgtccatagctgtcat

SEQ ID NO: 119012 - DNA, 25 bp, Rattus norvegicus
agatccacttgtgcatagctgtcat

SEQ ID NO: 119013 - DNA, 25 bp, Rattus norvegicus
agatccagaacacattaacctcgcc

SEQ ID NO: 119014 - DNA, 25 bp, Rattus norvegicus
agatccagaacagattaacctcgcc

SEQ ID NO: 119015 - DNA, 25 bp, Rattus norvegicus
agatccagaactatgcctggcacgc

SEQ ID NO: 119016 - DNA, 25 bp, Rattus norvegicus
agatccagaactttgcctggcacgc

SEQ ID NO: 119017 - DNA, 25 bp, Rattus norvegicus
agatccagacaaagacatcgcacgg

SEQ ID NO: 119018 - DNA, 25 bp, Rattus norvegicus
agatccagacaatgacatcgcacgg

SEQ ID NO: 119019 - DNA, 25 bp, Rattus norvegicus
agatccagacttcccacagacttta

SEQ ID NO: 119020 - DNA, 25 bp, Rattus norvegicus
agatccagacttgccacagacttta

SEQ ID NO: 119021 - DNA, 25 bp, Rattus norvegicus
agatccagagtgacgtgctcaccat

SEQ ID NO: 119022 - DNA, 25 bp, Rattus norvegicus
agatccagagtgtcgtgctcaccat

SEQ ID NO: 119023 - DNA, 25 bp, Rattus norvegicus
agatccagatccaaccagaaggctc

SEQ ID NO: 119024 - DNA, 25 bp, Rattus norvegicus
agatccagatcctaccagaaggctc

SEQ ID NO: 119025 - DNA, 25 bp, Rattus norvegicus
agatccagattgagtccaagatgtt

SEQ ID NO: 119026 - DNA, 25 bp, Rattus norvegicus
agatccagattgtgtccaagatgtt

SEQ ID NO: 119027 - DNA, 25 bp, Rattus norvegicus
agatccagcacacggtgctgtgtcc

SEQ ID NO: 119028 - DNA, 25 bp, Rattus norvegicus
agatccagcacagggtgctgtgtcc

SEQ ID NO: 119029 - DNA, 25 bp, Rattus norvegicus
agatccagcagcaagggagcgactc

SEQ ID NO: 119030 - DNA, 25 bp, Rattus norvegicus
agatccagcagctagggagcgactc

SEQ ID NO: 119031 - DNA, 25 bp, Rattus norvegicus
agatccagccacatcattgggggga

SEQ ID NO: 119032 - DNA, 25 bp, Rattus norvegicus
agatccagccacttcattgggggga

SEQ ID NO: 119033 - DNA, 25 bp, Rattus norvegicus
agatccagccttatgctagcatctt

SEQ ID NO: 119034 - DNA, 25 bp, Rattus norvegicus
agatccagccttttgctagcatctt

SEQ ID NO: 119035 - DNA, 25 bp, Rattus norvegicus
agatccagctaccactcagtgagtt

SEQ ID NO: 119036 - DNA, 25 bp, Rattus norvegicus
agatccagctacgactcagtgagtt

SEQ ID NO: 119037 - DNA, 25 bp, Rattus norvegicus
agatccagctctagtacagccagga

SEQ ID NO: 119038 - DNA, 25 bp, Rattus norvegicus
agatccagctcttgtacagccagga

SEQ ID NO: 119039 - DNA, 25 bp, Rattus norvegicus
agatccagctggatcgtgggtccct

SEQ ID NO: 119040 - DNA, 25 bp, Rattus norvegicus
agatccagctggttcgtgggtccct

SEQ ID NO: 119041 - DNA, 25 bp, Rattus norvegicus
agatccaggataactgactcccttt

SEQ ID NO: 119042 - DNA, 25 bp, Rattus norvegicus
agatccaggatatctgactcccttt

SEQ ID NO: 119043 - DNA, 25 bp, Rattus norvegicus
agatccaggcatccgacacatagaa

SEQ ID NO: 119044 - DNA, 25 bp, Rattus norvegicus
agatccaggcatgcgacacatagaa

SEQ ID NO: 119045 - DNA, 25 bp, Rattus norvegicus
agatccaggctcacatcagcagcat

SEQ ID NO: 119046 - DNA, 25 bp, Rattus norvegicus
agatccaggctctcatcagcagcat

SEQ ID NO: 119047 - DNA, 25 bp, Rattus norvegicus
agatccaggtacagctttcttctga

SEQ ID NO: 119048 - DNA, 25 bp, Rattus norvegicus
agatccaggtactgctttcttctga

SEQ ID NO: 119049 - DNA, 25 bp, Rattus norvegicus
agatccaggtagactctgccactaa

SEQ ID NO: 119050 - DNA, 25 bp, Rattus norvegicus
agatccaggtagcaggatgccctaa

SEQ ID NO: 119051 - DNA, 25 bp, Rattus norvegicus
agatccaggtaggaggatgccctaa

SEQ ID NO: 119052 - DNA, 25 bp, Rattus norvegicus
agatccaggtagtctctgccactaa

SEQ ID NO: 119053 - DNA, 25 bp, Rattus norvegicus
agatccagtgtccttgtccaaccgg

SEQ ID NO: 119054 - DNA, 25 bp, Rattus norvegicus
agatccagtgtcgttgtccaaccgg

SEQ ID NO: 119055 - DNA, 25 bp, Rattus norvegicus
agatccagttttctaccacacttag

SEQ ID NO: 119056 - DNA, 25 bp, Rattus norvegicus
agatccagttttgtaccacacttag

SEQ ID NO: 119057 - DNA, 25 bp, Rattus norvegicus
agatccatcatgatggcctaacctg

SEQ ID NO: 119058 - DNA, 25 bp, Rattus norvegicus
agatccatcatgttggcctaacctg

SEQ ID NO: 119059 - DNA, 25 bp, Rattus norvegicus
agatccatccagcatttgccaggga

SEQ ID NO: 119060 - DNA, 25 bp, Rattus norvegicus
agatccatccaggatttgccaggga

SEQ ID NO: 119061 - DNA, 25 bp, Rattus norvegicus
agatccatccctatccagttaacaa

SEQ ID NO: 119062 - DNA, 25 bp, Rattus norvegicus
agatccatccctttccagttaacaa

SEQ ID NO: 119063 - DNA, 25 bp, Rattus norvegicus
agatccatcctcagataagccacat

SEQ ID NO: 119064 - DNA, 25 bp, Rattus norvegicus
agatccatcctctgataagccacat

SEQ ID NO: 119065 - DNA, 25 bp, Rattus norvegicus
agatccatcctgcacagtttatcgt

SEQ ID NO: 119066 - DNA, 25 bp, Rattus norvegicus
agatccatcctggacagtttatcgt

SEQ ID NO: 119067 - DNA, 25 bp, Rattus norvegicus
agatccatcgcgagctgaggccgca

SEQ ID NO: 119068 - DNA, 25 bp, Rattus norvegicus
agatccatcgcgtgctgaggccgca

SEQ ID NO: 119069 - DNA, 25 bp, Rattus norvegicus
agatccatctcacggcaatcagtct

SEQ ID NO: 119070 - DNA, 25 bp, Rattus norvegicus
agatccatctcagggcaatcagtct

SEQ ID NO: 119071 - DNA, 25 bp, Rattus norvegicus
agatccatctgcacatggctctcct

SEQ ID NO: 119072 - DNA, 25 bp, Rattus norvegicus
agatccatctgctcatggctctcct

SEQ ID NO: 119073 - DNA, 25 bp, Rattus norvegicus
agatccatgcagaatgagccccggg

SEQ ID NO: 119074 - DNA, 25 bp, Rattus norvegicus
agatccatgcagtatgagccccggg

SEQ ID NO: 119075 - DNA, 25 bp, Rattus norvegicus
agatccatggaacttcaggccttca

SEQ ID NO: 119076 - DNA, 25 bp, Rattus norvegicus
agatccatggaagttcaggccttca

SEQ ID NO: 119077 - DNA, 25 bp, Rattus norvegicus
agatccatgtgtcctgggctcctgt

SEQ ID NO: 119078 - DNA, 25 bp, Rattus norvegicus
agatccatgtgtgctgggctcctgt

SEQ ID NO: 119079 - DNA, 25 bp, Rattus norvegicus
agatccattcctcatactttacgta

SEQ ID NO: 119080 - DNA, 25 bp, Rattus norvegicus
agatccattcctgatactttacgta

SEQ ID NO: 119081 - DNA, 25 bp, Rattus norvegicus
agatccatttccattacatcctttg

SEQ ID NO: 119082 - DNA, 25 bp, Rattus norvegicus
agatccatttcctttacatcctttg

SEQ ID NO: 119083 - DNA, 25 bp, Rattus norvegicus
agatcccaaaggctccagggttcga

SEQ ID NO: 119084 - DNA, 25 bp, Rattus norvegicus
agatcccaaagggtccagggttcga

SEQ ID NO: 119085 - DNA, 25 bp, Rattus norvegicus
agatcccaaatccattaggcttccg

SEQ ID NO: 119086 - DNA, 25 bp, Rattus norvegicus
agatcccaaatcgattaggcttccg

SEQ ID NO: 119087 - DNA, 25 bp, Rattus norvegicus
agatcccaagaaaagctgcacagaa

SEQ ID NO: 119088 - DNA, 25 bp, Rattus norvegicus
agatcccaagaatagctgcacagaa

SEQ ID NO: 119089 - DNA, 25 bp, Rattus norvegicus
agatcccaagggactgtcctttggc

SEQ ID NO: 119090 - DNA, 25 bp, Rattus norvegicus
agatcccaagggtctgtcctttggc

SEQ ID NO: 119091 - DNA, 25 bp, Rattus norvegicus
agatcccaccacaaatatctactgg

SEQ ID NO: 119092 - DNA, 25 bp, Rattus norvegicus
agatcccaccactaatatctactgg

SEQ ID NO: 119093 - DNA, 25 bp, Rattus norvegicus
agatcccaccttctctagaagaaca

SEQ ID NO: 119094 - DNA, 25 bp, Rattus norvegicus
agatcccaccttgtctagaagaaca

SEQ ID NO: 119095 - DNA, 25 bp, Rattus norvegicus
agatcccacgaacctctatgagaga

SEQ ID NO: 119096 - DNA, 25 bp, Rattus norvegicus
agatcccacgaagctctatgagaga

SEQ ID NO: 119097 - DNA, 25 bp, Rattus norvegicus
agatcccacgtcatcagtggattga

SEQ ID NO: 119098 - DNA, 25 bp, Rattus norvegicus
agatcccacgtcttcagtggattga

SEQ ID NO: 119099 - DNA, 25 bp, Rattus norvegicus
agatcccactggagtcctggcatca

SEQ ID NO: 119100 - DNA, 25 bp, Rattus norvegicus
agatcccactggtgtcctggcatca

SEQ ID NO: 119101 - DNA, 25 bp, Rattus norvegicus
agatcccagcagcttgggagtctaa

SEQ ID NO: 119102 - DNA, 25 bp, Rattus norvegicus
agatcccagcaggttgggagtctaa

SEQ ID NO: 119103 - DNA, 25 bp, Rattus norvegicus
agatcccagctacacctctatagat

SEQ ID NO: 119104 - DNA, 25 bp, Rattus norvegicus
agatcccagctagacctctatagat

SEQ ID NO: 119105 - DNA, 25 bp, Rattus norvegicus
agatcccagtacagagcacagctcc

SEQ ID NO: 119106 - DNA, 25 bp, Rattus norvegicus
agatcccagtactgagcacagctcc

SEQ ID NO: 119107 - DNA, 25 bp, Rattus norvegicus
agatcccagtcaatatacccagcta

SEQ ID NO: 119108 - DNA, 25 bp, Rattus norvegicus
agatcccagtcattatacccagcta

SEQ ID NO: 119109 - DNA, 25 bp, Rattus norvegicus
agatcccattgtatctctagcggtt

SEQ ID NO: 119110 - DNA, 25 bp, Rattus norvegicus
agatcccattgtttctctagcggtt

SEQ ID NO: 119111 - DNA, 25 bp, Rattus norvegicus
agatccccaataacactgagcttca

SEQ ID NO: 119112 - DNA, 25 bp, Rattus norvegicus
agatccccaatatcactgagcttca

SEQ ID NO: 119113 - DNA, 25 bp, Rattus norvegicus
agatccccacagaattagtgagcta

SEQ ID NO: 119114 - DNA, 25 bp, Rattus norvegicus
agatccccacagtattagtgagcta

SEQ ID NO: 119115 - DNA, 25 bp, Rattus norvegicus
agatccccagtcatgttctctatgt

SEQ ID NO: 119116 - DNA, 25 bp, Rattus norvegicus
agatccccagtcttgttctctatgt

SEQ ID NO: 119117 - DNA, 25 bp, Rattus norvegicus
agatccccatgcattcccgaatatt

SEQ ID NO: 119118 - DNA, 25 bp, Rattus norvegicus
agatccccatgctttcccgaatatt

SEQ ID NO: 119119 - DNA, 25 bp, Rattus norvegicus
agatccccattgcaatgtcgccatt

SEQ ID NO: 119120 - DNA, 25 bp, Rattus norvegicus
agatccccattggaatgtcgccatt

SEQ ID NO: 119121 - DNA, 25 bp, Rattus norvegicus
agatccccgccaagatgtagccagg

SEQ ID NO: 119122 - DNA, 25 bp, Rattus norvegicus
agatccccgccatgatgtagccagg

SEQ ID NO: 119123 - DNA, 25 bp, Rattus norvegicus
agatcccctgccaagatgactgtca

SEQ ID NO: 119124 - DNA, 25 bp, Rattus norvegicus
agatcccctgcctagatgactgtca

SEQ ID NO: 119125 - DNA, 25 bp, Rattus norvegicus
agatccccttacactctggtaaata

SEQ ID NO: 119126 - DNA, 25 bp, Rattus norvegicus
agatccccttactctctggtaaata

SEQ ID NO: 119127 - DNA, 25 bp, Rattus norvegicus
agatcccgacaccattgttaaggtt

SEQ ID NO: 119128 - DNA, 25 bp, Rattus norvegicus
agatcccgacacgattgttaaggtt

SEQ ID NO: 119129 - DNA, 25 bp, Rattus norvegicus
agatcccgctataccggaggaatca

SEQ ID NO: 119130 - DNA, 25 bp, Rattus norvegicus
agatcccgctattccggaggaatca

SEQ ID NO: 119131 - DNA, 25 bp, Rattus norvegicus
agatcccggtggaaccaggccagag

SEQ ID NO: 119132 - DNA, 25 bp, Rattus norvegicus
agatcccggtggtaccaggccagag

SEQ ID NO: 119133 - DNA, 25 bp, Rattus norvegicus
agatccctaaagctcattggccatc

SEQ ID NO: 119134 - DNA, 25 bp, Rattus norvegicus
agatccctaaaggtcattggccatc

SEQ ID NO: 119135 - DNA, 25 bp, Rattus norvegicus
agatccctaaccactgtgtggagaa

SEQ ID NO: 119136 - DNA, 25 bp, Rattus norvegicus
agatccctaacctctgtgtggagaa

SEQ ID NO: 119137 - DNA, 25 bp, Rattus norvegicus
agatccctacagaactggcctagaa

SEQ ID NO: 119138 - DNA, 25 bp, Rattus norvegicus
agatccctacagtactggcctagaa

SEQ ID NO: 119139 - DNA, 25 bp, Rattus norvegicus
agatccctacttccgcctattataa

SEQ ID NO: 119140 - DNA, 25 bp, Rattus norvegicus
agatccctacttgcgcctattataa

SEQ ID NO: 119141 - DNA, 25 bp, Rattus norvegicus
agatccctatgtccagcagattgct

SEQ ID NO: 119142 - DNA, 25 bp, Rattus norvegicus
agatccctatgtgcagcagattgct

SEQ ID NO: 119143 - DNA, 25 bp, Rattus norvegicus
agatccctccgaatggatgcttgtg

SEQ ID NO: 119144 - DNA, 25 bp, Rattus norvegicus
agatccctccgattggatgcttgtg

SEQ ID NO: 119145 - DNA, 25 bp, Rattus norvegicus
agatccctgaagacttgctagtttg

SEQ ID NO: 119146 - DNA, 25 bp, Rattus norvegicus
agatccctgaagagaccttttcatc

SEQ ID NO: 119147 - DNA, 25 bp, Rattus norvegicus
agatccctgaagtcttgctagtttg

SEQ ID NO: 119148 - DNA, 25 bp, Rattus norvegicus
agatccctgaagtgaccttttcatc

SEQ ID NO: 119149 - DNA, 25 bp, Rattus norvegicus
agatccctgagcaacggtggtacat

SEQ ID NO: 119150 - DNA, 25 bp, Rattus norvegicus
agatccctgagctacggtggtacat

SEQ ID NO: 119151 - DNA, 25 bp, Rattus norvegicus
agatccctgagtccattgagagcct

SEQ ID NO: 119152 - DNA, 25 bp, Rattus norvegicus
agatccctgagtgcattgagagcct

SEQ ID NO: 119153 - DNA, 25 bp, Rattus norvegicus
agatccctgcaaactcaaggctaca

SEQ ID NO: 119154 - DNA, 25 bp, Rattus norvegicus
agatccctgcaatctcaaggctaca

SEQ ID NO: 119155 - DNA, 25 bp, Rattus norvegicus
agatccctggaaaaataggctgaga

SEQ ID NO: 119156 - DNA, 25 bp, Rattus norvegicus
agatccctggaataataggctgaga

SEQ ID NO: 119157 - DNA, 25 bp, Rattus norvegicus
agatccctggctaagagcatgcaag

SEQ ID NO: 119158 - DNA, 25 bp, Rattus norvegicus
agatccctggcttagagcatgcaag

SEQ ID NO: 119159 - DNA, 25 bp, Rattus norvegicus
agatccctgggaactactttcacat

SEQ ID NO: 119160 - DNA, 25 bp, Rattus norvegicus
agatccctgggatctactttcacat

SEQ ID NO: 119161 - DNA, 25 bp, Rattus norvegicus
agatccctgtctcatttctgaatgt

SEQ ID NO: 119162 - DNA, 25 bp, Rattus norvegicus
agatccctgtctgatttctgaatgt

SEQ ID NO: 119163 - DNA, 25 bp, Rattus norvegicus
agatccctttttaccacatctggaa

SEQ ID NO: 119164 - DNA, 25 bp, Rattus norvegicus
agatcccttttttccacatctggaa

SEQ ID NO: 119165 - DNA, 25 bp, Rattus norvegicus
agatccgaacacagcggtcgacatt

SEQ ID NO: 119166 - DNA, 25 bp, Rattus norvegicus
agatccgaacactgcggtcgacatt

SEQ ID NO: 119167 - DNA, 25 bp, Rattus norvegicus
agatccgaattgactgctgcatacc

SEQ ID NO: 119168 - DNA, 25 bp, Rattus norvegicus
agatccgaattgtctgctgcatacc

SEQ ID NO: 119169 - DNA, 25 bp, Rattus norvegicus
agatccgacactatcatacgcacat

SEQ ID NO: 119170 - DNA, 25 bp, Rattus norvegicus
agatccgacactttcatacgcacat

SEQ ID NO: 119171 - DNA, 25 bp, Rattus norvegicus
agatccgacgtgatagccttggttt

SEQ ID NO: 119172 - DNA, 25 bp, Rattus norvegicus
agatccgacgtgttagccttggttt

SEQ ID NO: 119173 - DNA, 25 bp, Rattus norvegicus
agatccgagagacgagccagacgaa

SEQ ID NO: 119174 - DNA, 25 bp, Rattus norvegicus
agatccgagagaggagccagacgaa

SEQ ID NO: 119175 - DNA, 25 bp, Rattus norvegicus
agatccgagctcctactactgcttt

SEQ ID NO: 119176 - DNA, 25 bp, Rattus norvegicus
agatccgagctcgtactactgcttt

SEQ ID NO: 119177 - DNA, 25 bp, Rattus norvegicus
agatccgagggacccacaaccaaag

SEQ ID NO: 119178 - DNA, 25 bp, Rattus norvegicus
agatccgagggagccacaaccaaag

SEQ ID NO: 119179 - DNA, 25 bp, Rattus norvegicus
agatccgagggcagctccggcgtca

SEQ ID NO: 119180 - DNA, 25 bp, Rattus norvegicus
agatccgagggctgctccggcgtca

SEQ ID NO: 119181 - DNA, 25 bp, Rattus norvegicus
agatccgagttgaccaggctggcaa

SEQ ID NO: 119182 - DNA, 25 bp, Rattus norvegicus
agatccgagttgtccaggctggcaa

SEQ ID NO: 119183 - DNA, 25 bp, Rattus norvegicus
agatccgcaccaacactgaggagat

SEQ ID NO: 119184 - DNA, 25 bp, Rattus norvegicus
agatccgcaccatcactgaggagat

SEQ ID NO: 119185 - DNA, 25 bp, Rattus norvegicus
agatccgcagctaggtgcaggccaa

SEQ ID NO: 119186 - DNA, 25 bp, Rattus norvegicus
agatccgcagcttggtgcaggccaa

SEQ ID NO: 119187 - DNA, 25 bp, Rattus norvegicus
agatccgcagttacagactcatcag

SEQ ID NO: 119188 - DNA, 25 bp, Rattus norvegicus
agatccgcagtttcagactcatcag

SEQ ID NO: 119189 - DNA, 25 bp, Rattus norvegicus
agatccgccaagcagacactctgga

SEQ ID NO: 119190 - DNA, 25 bp, Rattus norvegicus
agatccgccaaggagacactctgga

SEQ ID NO: 119191 - DNA, 25 bp, Rattus norvegicus
agatccgcgccaaggacgagatcca

SEQ ID NO: 119192 - DNA, 25 bp, Rattus norvegicus
agatccgcgccatggacgagatcca

SEQ ID NO: 119193 - DNA, 25 bp, Rattus norvegicus
agatccgctggcacgcctagcacta

SEQ ID NO: 119194 - DNA, 25 bp, Rattus norvegicus
agatccgctggctcgcctagcacta

SEQ ID NO: 119195 - DNA, 25 bp, Rattus norvegicus
agatccgcttctctatttggcacat

SEQ ID NO: 119196 - DNA, 25 bp, Rattus norvegicus
agatccgcttctgtatttggcacat

SEQ ID NO: 119197 - DNA, 25 bp, Rattus norvegicus
agatccggagcgacactgaacgcca

SEQ ID NO: 119198 - DNA, 25 bp, Rattus norvegicus
agatccggagcgtcactgaacgcca

SEQ ID NO: 119199 - DNA, 25 bp, Rattus norvegicus
agatccggctgtaggtttcccgctg

SEQ ID NO: 119200 - DNA, 25 bp, Rattus norvegicus
agatccggctgttggtttcccgctg

SEQ ID NO: 119201 - DNA, 25 bp, Rattus norvegicus
agatccggttgtccattaccggctc

SEQ ID NO: 119202 - DNA, 25 bp, Rattus norvegicus
agatccggttgtgcattaccggctc

SEQ ID NO: 119203 - DNA, 25 bp, Rattus norvegicus
agatccgtaacgcttatgctgtgtt

SEQ ID NO: 119204 - DNA, 25 bp, Rattus norvegicus
agatccgtaacggttatgctgtgtt

SEQ ID NO: 119205 - DNA, 25 bp, Rattus norvegicus
agatccgtaagcctagtccctatga

SEQ ID NO: 119206 - DNA, 25 bp, Rattus norvegicus
agatccgtaagcgtagtccctatga

SEQ ID NO: 119207 - DNA, 25 bp, Rattus norvegicus
agatccgtacatcgctcaccagtgt

SEQ ID NO: 119208 - DNA, 25 bp, Rattus norvegicus
agatccgtacatggctcaccagtgt

SEQ ID NO: 119209 - DNA, 25 bp, Rattus norvegicus
agatccgtacctcggagccgcaaag

SEQ ID NO: 119210 - DNA, 25 bp, Rattus norvegicus
agatccgtacctgggagccgcaaag

SEQ ID NO: 119211 - DNA, 25 bp, Rattus norvegicus
agatccgtcaagctggtgtcattga

SEQ ID NO: 119212 - DNA, 25 bp, Rattus norvegicus
agatccgtcaaggtggtgtcattga

SEQ ID NO: 119213 - DNA, 25 bp, Rattus norvegicus
agatccgtgatgaccgtcatgtaat

SEQ ID NO: 119214 - DNA, 25 bp, Rattus norvegicus
agatccgtgatgtccgtcatgtaat

SEQ ID NO: 119215 - DNA, 25 bp, Rattus norvegicus
agatccgtggacagtttctactcct

SEQ ID NO: 119216 - DNA, 25 bp, Rattus norvegicus
agatccgtggactgtttctactcct

SEQ ID NO: 119217 - DNA, 25 bp, Rattus norvegicus
agatccgtgtcaaccaatgttgcca

SEQ ID NO: 119218 - DNA, 25 bp, Rattus norvegicus
agatccgtgtcatccaatgttgcca

SEQ ID NO: 119219 - DNA, 25 bp, Rattus norvegicus
agatcctaaatccagcctaactcat

SEQ ID NO: 119220 - DNA, 25 bp, Rattus norvegicus
agatcctaaatcgagcctaactcat

SEQ ID NO: 119221 - DNA, 25 bp, Rattus norvegicus
agatcctaagttccagactagccct

SEQ ID NO: 119222 - DNA, 25 bp, Rattus norvegicus
agatcctaagttgcagactagccct

SEQ ID NO: 119223 - DNA, 25 bp, Rattus norvegicus
agatcctaattaacaattcttttag

SEQ ID NO: 119224 - DNA, 25 bp, Rattus norvegicus
agatcctaattatcaattcttttag

SEQ ID NO: 119225 - DNA, 25 bp, Rattus norvegicus
agatcctacaagaaagttgaaatgt

SEQ ID NO: 119226 - DNA, 25 bp, Rattus norvegicus
agatcctacaagtaagttgaaatgt

SEQ ID NO: 119227 - DNA, 25 bp, Rattus norvegicus
agatcctacacactgcctctggaaa

SEQ ID NO: 119228 - DNA, 25 bp, Rattus norvegicus
agatcctacacagtgcctctggaaa

SEQ ID NO: 119229 - DNA, 25 bp, Rattus norvegicus
agatcctaccaaactcgagctgctg

SEQ ID NO: 119230 - DNA, 25 bp, Rattus norvegicus
agatcctaccaatctcgagctgctg

SEQ ID NO: 119231 - DNA, 25 bp, Rattus norvegicus
agatcctacgtaaccgctgtgagga

SEQ ID NO: 119232 - DNA, 25 bp, Rattus norvegicus
agatcctacgtatccgctgtgagga

SEQ ID NO: 119233 - DNA, 25 bp, Rattus norvegicus
agatcctacttcagctgcccttgta

SEQ ID NO: 119234 - DNA, 25 bp, Rattus norvegicus
agatcctacttctgctgcccttgta

SEQ ID NO: 119235 - DNA, 25 bp, Rattus norvegicus
agatcctagagtcgaccctgcgagt

SEQ ID NO: 119236 - DNA, 25 bp, Rattus norvegicus
agatcctagagtggaccctgcgagt

SEQ ID NO: 119237 - DNA, 25 bp, Rattus norvegicus
agatcctagcctacaccggcttgtg

SEQ ID NO: 119238 - DNA, 25 bp, Rattus norvegicus
agatcctagccttcaccggcttgtg

SEQ ID NO: 119239 - DNA, 25 bp, Rattus norvegicus
agatcctcaacccttgtcttaaaat

SEQ ID NO: 119240 - DNA, 25 bp, Rattus norvegicus
agatcctcaaccgttgtcttaaaat

SEQ ID NO: 119241 - DNA, 25 bp, Rattus norvegicus
agatcctcaagcagacctacagcaa

SEQ ID NO: 119242 - DNA, 25 bp, Rattus norvegicus
agatcctcaagctgacctacagcaa

SEQ ID NO: 119243 - DNA, 25 bp, Rattus norvegicus
agatcctcacacaggtcaacgtggt

SEQ ID NO: 119244 - DNA, 25 bp, Rattus norvegicus
agatcctcacactggtcaacgtggt

SEQ ID NO: 119245 - DNA, 25 bp, Rattus norvegicus
agatcctcaccaattgctataatag

SEQ ID NO: 119246 - DNA, 25 bp, Rattus norvegicus
agatcctcaccatttgctataatag

SEQ ID NO: 119247 - DNA, 25 bp, Rattus norvegicus
agatcctcagatccactcggaaaat

SEQ ID NO: 119248 - DNA, 25 bp, Rattus norvegicus
agatcctcagatgcactcggaaaat

SEQ ID NO: 119249 - DNA, 25 bp, Rattus norvegicus
agatcctcaggtatcatccgtggtg

SEQ ID NO: 119250 - DNA, 25 bp, Rattus norvegicus
agatcctcaggtttcatccgtggtg

SEQ ID NO: 119251 - DNA, 25 bp, Rattus norvegicus
agatcctcatcgaccgagtccgatt

SEQ ID NO: 119252 - DNA, 25 bp, Rattus norvegicus
agatcctcatcgtccgagtccgatt

SEQ ID NO: 119253 - DNA, 25 bp, Rattus norvegicus
agatcctcccaacatgtccgaacat

SEQ ID NO: 119254 - DNA, 25 bp, Rattus norvegicus
agatcctcccaagatgtccgaacat

SEQ ID NO: 119255 - DNA, 25 bp, Rattus norvegicus
agatcctcccggcaagcaacagtac

SEQ ID NO: 119256 - DNA, 25 bp, Rattus norvegicus
agatcctcccgggaagcaacagtac

SEQ ID NO: 119257 - DNA, 25 bp, Rattus norvegicus
agatcctcccttaggccattaagac

SEQ ID NO: 119258 - DNA, 25 bp, Rattus norvegicus
agatcctccctttggccattaagac

SEQ ID NO: 119259 - DNA, 25 bp, Rattus norvegicus
agatcctcctcacaacaatgcgggt

SEQ ID NO: 119260 - DNA, 25 bp, Rattus norvegicus
agatcctcctcagaacaatgcgggt

SEQ ID NO: 119261 - DNA, 25 bp, Rattus norvegicus
agatcctcggccaggtcaccgaagt

SEQ ID NO: 119262 - DNA, 25 bp, Rattus norvegicus
agatcctcggcctggtcaccgaagt

SEQ ID NO: 119263 - DNA, 25 bp, Rattus norvegicus
agatcctcgggaagctggcttcagg

SEQ ID NO: 119264 - DNA, 25 bp, Rattus norvegicus
agatcctcgggatgctggcttcagg

SEQ ID NO: 119265 - DNA, 25 bp, Rattus norvegicus
agatcctcgtgtcgaagtacccgtc

SEQ ID NO: 119266 - DNA, 25 bp, Rattus norvegicus
agatcctcgtgtggaagtacccgtc

SEQ ID NO: 119267 - DNA, 25 bp, Rattus norvegicus
agatcctctgctagtcattggctct

SEQ ID NO: 119268 - DNA, 25 bp, Rattus norvegicus
agatcctctgcttgtcattggctct

SEQ ID NO: 119269 - DNA, 25 bp, Rattus norvegicus
agatcctctggcattggcctgggac

SEQ ID NO: 119270 - DNA, 25 bp, Rattus norvegicus
agatcctctggctttggcctgggac

SEQ ID NO: 119271 - DNA, 25 bp, Rattus norvegicus
agatcctctgggaagtggcccacca

SEQ ID NO: 119272 - DNA, 25 bp, Rattus norvegicus
agatcctctgggtagtggcccacca

SEQ ID NO: 119273 - DNA, 25 bp, Rattus norvegicus
agatcctctttcacacttcttaaat

SEQ ID NO: 119274 - DNA, 25 bp, Rattus norvegicus
agatcctctttctcacttcttaaat

SEQ ID NO: 119275 - DNA, 25 bp, Rattus norvegicus
agatcctgaacaagcgtggcagctc

SEQ ID NO: 119276 - DNA, 25 bp, Rattus norvegicus
agatcctgaacatgcgtggcagctc

SEQ ID NO: 119277 - DNA, 25 bp, Rattus norvegicus
agatcctgaaggctgcatacctgct

SEQ ID NO: 119278 - DNA, 25 bp, Rattus norvegicus
agatcctgaagggtgcatacctgct

SEQ ID NO: 119279 - DNA, 25 bp, Rattus norvegicus
agatcctgactcagcctatgtctgt

SEQ ID NO: 119280 - DNA, 25 bp, Rattus norvegicus
agatcctgactctgcctatgtctgt

SEQ ID NO: 119281 - DNA, 25 bp, Rattus norvegicus
agatcctgagatcgtcgagtgcccc

SEQ ID NO: 119282 - DNA, 25 bp, Rattus norvegicus
agatcctgagatggtcgagtgcccc

SEQ ID NO: 119283 - DNA, 25 bp, Rattus norvegicus
agatcctgagcgactcctgctgaag

SEQ ID NO: 119284 - DNA, 25 bp, Rattus norvegicus
agatcctgagcgtctcctgctgaag

SEQ ID NO: 119285 - DNA, 25 bp, Rattus norvegicus
agatcctgagctattgctgccgtat

SEQ ID NO: 119286 - DNA, 25 bp, Rattus norvegicus
agatcctgagcttttgctgccgtat

SEQ ID NO: 119287 - DNA, 25 bp, Rattus norvegicus
agatcctgatgcagtaccaagcccg

SEQ ID NO: 119288 - DNA, 25 bp, Rattus norvegicus
agatcctgatgctgtaccaagcccg

SEQ ID NO: 119289 - DNA, 25 bp, Rattus norvegicus
agatcctgattaagtggccttgggc

SEQ ID NO: 119290 - DNA, 25 bp, Rattus norvegicus
agatcctgattatgtggccttgggc

SEQ ID NO: 119291 - DNA, 25 bp, Rattus norvegicus
agatcctgctccaaattctctgttg

SEQ ID NO: 119292 - DNA, 25 bp, Rattus norvegicus
agatcctgctcctaattctctgttg

SEQ ID NO: 119293 - DNA, 25 bp, Rattus norvegicus
agatcctggaatccctgaaccatca

SEQ ID NO: 119294 - DNA, 25 bp, Rattus norvegicus
agatcctggaatgcctgaaccatca

SEQ ID NO: 119295 - DNA, 25 bp, Rattus norvegicus
agatcctggaccacttttccaaaga

SEQ ID NO: 119296 - DNA, 25 bp, Rattus norvegicus
agatcctggacctcttttccaaaga

SEQ ID NO: 119297 - DNA, 25 bp, Rattus norvegicus
agatcctggatcagattatctatgg

SEQ ID NO: 119298 - DNA, 25 bp, Rattus norvegicus
agatcctggatcatcggaggccctg

SEQ ID NO: 119299 - DNA, 25 bp, Rattus norvegicus
agatcctggatctgattatctatgg

SEQ ID NO: 119300 - DNA, 25 bp, Rattus norvegicus
agatcctggatcttcggaggccctg

SEQ ID NO: 119301 - DNA, 25 bp, Rattus norvegicus
agatcctggctccaatgctgtgtcc

SEQ ID NO: 119302 - DNA, 25 bp, Rattus norvegicus
agatcctggctcgaatgctgtgtcc

SEQ ID NO: 119303 - DNA, 25 bp, Rattus norvegicus
agatcctggtggcaaacgctgctct

SEQ ID NO: 119304 - DNA, 25 bp, Rattus norvegicus
agatcctggtgggaaacgctgctct

SEQ ID NO: 119305 - DNA, 25 bp, Rattus norvegicus
agatcctgtaagagctgtcgttcat

SEQ ID NO: 119306 - DNA, 25 bp, Rattus norvegicus
agatcctgtaagtgctgtcgttcat

SEQ ID NO: 119307 - DNA, 25 bp, Rattus norvegicus
agatcctgtgtaatctctgtgccca

SEQ ID NO: 119308 - DNA, 25 bp, Rattus norvegicus
agatcctgtgtattctctgtgccca

SEQ ID NO: 119309 - DNA, 25 bp, Rattus norvegicus
agatcctgtttgatagccttcgtga

SEQ ID NO: 119310 - DNA, 25 bp, Rattus norvegicus
agatcctgtttgttagccttcgtga

SEQ ID NO: 119311 - DNA, 25 bp, Rattus norvegicus
agatccttccagctccatattcaag

SEQ ID NO: 119312 - DNA, 25 bp, Rattus norvegicus
agatccttccaggtccatattcaag

SEQ ID NO: 119313 - DNA, 25 bp, Rattus norvegicus
agatccttcggaccgggagagacct

SEQ ID NO: 119314 - DNA, 25 bp, Rattus norvegicus
agatccttcggagcgggagagacct

SEQ ID NO: 119315 - DNA, 25 bp, Rattus norvegicus
agatccttcgggaagaccggcagca

SEQ ID NO: 119316 - DNA, 25 bp, Rattus norvegicus
agatccttcgggacctggcagagct

SEQ ID NO: 119317 - DNA, 25 bp, Rattus norvegicus
agatccttcgggtagaccggcagca

SEQ ID NO: 119318 - DNA, 25 bp, Rattus norvegicus
agatccttcgggtcctggcagagct

SEQ ID NO: 119319 - DNA, 25 bp, Rattus norvegicus
agatccttctcaagggctcacggtt

SEQ ID NO: 119320 - DNA, 25 bp, Rattus norvegicus
agatccttctcatgggctcacggtt

SEQ ID NO: 119321 - DNA, 25 bp, Rattus norvegicus
agatccttctcccttatttattctc

SEQ ID NO: 119322 - DNA, 25 bp, Rattus norvegicus
agatccttctccgttatttattctc

SEQ ID NO: 119323 - DNA, 25 bp, Rattus norvegicus
agatccttctgcaagactccaagat

SEQ ID NO: 119324 - DNA, 25 bp, Rattus norvegicus
agatccttctgctagactccaagat

SEQ ID NO: 119325 - DNA, 25 bp, Rattus norvegicus
agatccttctggacctgtcagcaaa

SEQ ID NO: 119326 - DNA, 25 bp, Rattus norvegicus
agatccttctggtcctgtcagcaaa

SEQ ID NO: 119327 - DNA, 25 bp, Rattus norvegicus
agatccttcttcacgaggttctgac

SEQ ID NO: 119328 - DNA, 25 bp, Rattus norvegicus
agatccttcttctcgaggttctgac

SEQ ID NO: 119329 - DNA, 25 bp, Rattus norvegicus
agatccttgcaaaaccctttgtgta

SEQ ID NO: 119330 - DNA, 25 bp, Rattus norvegicus
agatccttgcaataccctttgtgta

SEQ ID NO: 119331 - DNA, 25 bp, Rattus norvegicus
agatccttggtcaccaggtgctgag

SEQ ID NO: 119332 - DNA, 25 bp, Rattus norvegicus
agatccttggtctccaggtgctgag

SEQ ID NO: 119333 - DNA, 25 bp, Rattus norvegicus
agatcctttatcaggcatttcaaac

SEQ ID NO: 119334 - DNA, 25 bp, Rattus norvegicus
agatcctttatctggcatttcaaac

SEQ ID NO: 119335 - DNA, 25 bp, Rattus norvegicus
agatcctttgtcagggtccaagcga

SEQ ID NO: 119336 - DNA, 25 bp, Rattus norvegicus
agatcctttgtctgggtccaagcga

SEQ ID NO: 119337 - DNA, 25 bp, Rattus norvegicus
agatccttttgtcagacctagtaaa

SEQ ID NO: 119338 - DNA, 25 bp, Rattus norvegicus
agatccttttgtgagacctagtaaa

SEQ ID NO: 119339 - DNA, 25 bp, Rattus norvegicus
agatcgaaatgaaaactttgccaaa

SEQ ID NO: 119340 - DNA, 25 bp, Rattus norvegicus
agatcgaaatgataactttgccaaa

SEQ ID NO: 119341 - DNA, 25 bp, Rattus norvegicus
agatcgaagagcaccgagaggcctt

SEQ ID NO: 119342 - DNA, 25 bp, Rattus norvegicus
agatcgaagagctccgagaggcctt

SEQ ID NO: 119343 - DNA, 25 bp, Rattus norvegicus
agatcgaaggtccgaactccagtgc

SEQ ID NO: 119344 - DNA, 25 bp, Rattus norvegicus
agatcgaaggtcggaactccagtgc

SEQ ID NO: 119345 - DNA, 25 bp, Rattus norvegicus
agatcgacaactatatccccatctt

SEQ ID NO: 119346 - DNA, 25 bp, Rattus norvegicus
agatcgacaactttatccccatctt

SEQ ID NO: 119347 - DNA, 25 bp, Rattus norvegicus
agatcgaccagaaggttggcttgat

SEQ ID NO: 119348 - DNA, 25 bp, Rattus norvegicus
agatcgaccagatggttggcttgat

SEQ ID NO: 119349 - DNA, 25 bp, Rattus norvegicus
agatcgaccccgctacgaagaggaa

SEQ ID NO: 119350 - DNA, 25 bp, Rattus norvegicus
agatcgaccccggtacgaagaggaa

SEQ ID NO: 119351 - DNA, 25 bp, Rattus norvegicus
agatcgagatccactgtggtttcca

SEQ ID NO: 119352 - DNA, 25 bp, Rattus norvegicus
agatcgagatcctctgtggtttcca

SEQ ID NO: 119353 - DNA, 25 bp, Rattus norvegicus
agatcgagctatccagtcagactag

SEQ ID NO: 119354 - DNA, 25 bp, Rattus norvegicus
agatcgagctatgcagtcagactag

SEQ ID NO: 119355 - DNA, 25 bp, Rattus norvegicus
agatcgaggactcactgcgcaaaga

SEQ ID NO: 119356 - DNA, 25 bp, Rattus norvegicus
agatcgaggactgactgcgcaaaga

SEQ ID NO: 119357 - DNA, 25 bp, Rattus norvegicus
agatcgatatctaccaatttcaatg

SEQ ID NO: 119358 - DNA, 25 bp, Rattus norvegicus
agatcgatatcttccaatttcaatg

SEQ ID NO: 119359 - DNA, 25 bp, Rattus norvegicus
agatcgcagcagacttcagaggcaa

SEQ ID NO: 119360 - DNA, 25 bp, Rattus norvegicus
agatcgcagcagtcttcagaggcaa

SEQ ID NO: 119361 - DNA, 25 bp, Rattus norvegicus
agatcgcagggaagggttgtaacca

SEQ ID NO: 119362 - DNA, 25 bp, Rattus norvegicus
agatcgcagggatgggttgtaacca

SEQ ID NO: 119363 - DNA, 25 bp, Rattus norvegicus
agatcgccatgtcagaccggtacaa

SEQ ID NO: 119364 - DNA, 25 bp, Rattus norvegicus
agatcgccatgtgagaccggtacaa

SEQ ID NO: 119365 - DNA, 25 bp, Rattus norvegicus
agatcgcctcgcacaagggccaact

SEQ ID NO: 119366 - DNA, 25 bp, Rattus norvegicus
agatcgcctcgctcaagggccaact

SEQ ID NO: 119367 - DNA, 25 bp, Rattus norvegicus
agatcgcgccggattattgctgcaa

SEQ ID NO: 119368 - DNA, 25 bp, Rattus norvegicus
agatcgcgccggtttattgctgcaa

SEQ ID NO: 119369 - DNA, 25 bp, Rattus norvegicus
agatcgcggagtctgccaacagcag

SEQ ID NO: 119370 - DNA, 25 bp, Rattus norvegicus
agatcgcggagtgtgccaacagcag

SEQ ID NO: 119371 - DNA, 25 bp, Rattus norvegicus
agatcgctacgccagtgagaatgtc

SEQ ID NO: 119372 - DNA, 25 bp, Rattus norvegicus
agatcgctacgcgagtgagaatgtc

SEQ ID NO: 119373 - DNA, 25 bp, Rattus norvegicus
agatcgctatgacatcagctccctg

SEQ ID NO: 119374 - DNA, 25 bp, Rattus norvegicus
agatcgctatgagatcagctccctg

SEQ ID NO: 119375 - DNA, 25 bp, Rattus norvegicus
agatcgctctccctagataggcgat

SEQ ID NO: 119376 - DNA, 25 bp, Rattus norvegicus
agatcgctctccgtagataggcgat

SEQ ID NO: 119377 - DNA, 25 bp, Rattus norvegicus
agatcgctgcgactgtgtctgtaaa

SEQ ID NO: 119378 - DNA, 25 bp, Rattus norvegicus
agatcgctgcgagtgtgtctgtaaa

SEQ ID NO: 119379 - DNA, 25 bp, Rattus norvegicus
agatcgctgtacacggcagtgggta

SEQ ID NO: 119380 - DNA, 25 bp, Rattus norvegicus
agatcgctgtactcggcagtgggta

SEQ ID NO: 119381 - DNA, 25 bp, Rattus norvegicus
agatcgctgtagagccttggacctg

SEQ ID NO: 119382 - DNA, 25 bp, Rattus norvegicus
agatcgctgtagtgccttggacctg

SEQ ID NO: 119383 - DNA, 25 bp, Rattus norvegicus
agatcggaagacctcaccactaaag

SEQ ID NO: 119384 - DNA, 25 bp, Rattus norvegicus
agatcggaagacgtcaccactaaag

SEQ ID NO: 119385 - DNA, 25 bp, Rattus norvegicus
agatcggaagttagccctcatgaaa

SEQ ID NO: 119386 - DNA, 25 bp, Rattus norvegicus
agatcggaagttcggtgagcaccca

SEQ ID NO: 119387 - DNA, 25 bp, Rattus norvegicus
agatcggaagttgggtgagcaccca

SEQ ID NO: 119388 - DNA, 25 bp, Rattus norvegicus
agatcggaagtttgccctcatgaaa

SEQ ID NO: 119389 - DNA, 25 bp, Rattus norvegicus
agatcggatcataaccattacggga

SEQ ID NO: 119390 - DNA, 25 bp, Rattus norvegicus
agatcggatcattaccattacggga

SEQ ID NO: 119391 - DNA, 25 bp, Rattus norvegicus
agatcggcagcccttggcagcgcat

SEQ ID NO: 119392 - DNA, 25 bp, Rattus norvegicus
agatcggcagccgttggcagcgcat

SEQ ID NO: 119393 - DNA, 25 bp, Rattus norvegicus
agatcggcataaaccagttgaagat

SEQ ID NO: 119394 - DNA, 25 bp, Rattus norvegicus
agatcggcataatccagttgaagat

SEQ ID NO: 119395 - DNA, 25 bp, Rattus norvegicus
agatcggcctgcagctagcattaag

SEQ ID NO: 119396 - DNA, 25 bp, Rattus norvegicus
agatcggcctgctgctagcattaag

SEQ ID NO: 119397 - DNA, 25 bp, Rattus norvegicus
agatcggctcctcagcgcgtgtgac

SEQ ID NO: 119398 - DNA, 25 bp, Rattus norvegicus
agatcggctcctgagcgcgtgtgac

SEQ ID NO: 119399 - DNA, 25 bp, Rattus norvegicus
agatcggctctacgtctgatggtcc

SEQ ID NO: 119400 - DNA, 25 bp, Rattus norvegicus
agatcggctctaggtctgatggtcc

SEQ ID NO: 119401 - DNA, 25 bp, Rattus norvegicus
agatcggctgctagttgcgcctgga

SEQ ID NO: 119402 - DNA, 25 bp, Rattus norvegicus
agatcggctgcttgttgcgcctgga

SEQ ID NO: 119403 - DNA, 25 bp, Rattus norvegicus
agatcggcttaaacagtgcttgagc

SEQ ID NO: 119404 - DNA, 25 bp, Rattus norvegicus
agatcggcttaatcagtgcttgagc

SEQ ID NO: 119405 - DNA, 25 bp, Rattus norvegicus
agatcggcttcaagctgtgtagcaa

SEQ ID NO: 119406 - DNA, 25 bp, Rattus norvegicus
agatcggcttcatgctgtgtagcaa

SEQ ID NO: 119407 - DNA, 25 bp, Rattus norvegicus
agatcgggaaaaacagcctctctgt

SEQ ID NO: 119408 - DNA, 25 bp, Rattus norvegicus
agatcgggaaaatcagcctctctgt

SEQ ID NO: 119409 - DNA, 25 bp, Rattus norvegicus
agatcgggccacaccttggataggt

SEQ ID NO: 119410 - DNA, 25 bp, Rattus norvegicus
agatcgggccactccttggataggt

SEQ ID NO: 119411 - DNA, 25 bp, Rattus norvegicus
agatcggggagaaccgcctggtgat

SEQ ID NO: 119412 - DNA, 25 bp, Rattus norvegicus
agatcggggagatccgcctggtgat

SEQ ID NO: 119413 - DNA, 25 bp, Rattus norvegicus
agatcgggtgctacgtttctccaag

SEQ ID NO: 119414 - DNA, 25 bp, Rattus norvegicus
agatcgggtgcttcgtttctccaag

SEQ ID NO: 119415 - DNA, 25 bp, Rattus norvegicus
agatcgggtggcagttttctgacaa

SEQ ID NO: 119416 - DNA, 25 bp, Rattus norvegicus
agatcgggtggctgttttctgacaa

SEQ ID NO: 119417 - DNA, 25 bp, Rattus norvegicus
agatcggtatctaccatggtaccca

SEQ ID NO: 119418 - DNA, 25 bp, Rattus norvegicus
agatcggtatcttccatggtaccca

SEQ ID NO: 119419 - DNA, 25 bp, Rattus norvegicus
agatcggtattgctgcaggctccag

SEQ ID NO: 119420 - DNA, 25 bp, Rattus norvegicus
agatcggtattggtgcaggctccag

SEQ ID NO: 119421 - DNA, 25 bp, Rattus norvegicus
agatcggtcaagatcggtcctcgtg

SEQ ID NO: 119422 - DNA, 25 bp, Rattus norvegicus
agatcggtcaagttcggtcctcgtg

SEQ ID NO: 119423 - DNA, 25 bp, Rattus norvegicus
agatcggtgctgacaaatacctgga

SEQ ID NO: 119424 - DNA, 25 bp, Rattus norvegicus
agatcggtgctgtcaaatacctgga

SEQ ID NO: 119425 - DNA, 25 bp, Rattus norvegicus
agatcggtggctattgttcagactt

SEQ ID NO: 119426 - DNA, 25 bp, Rattus norvegicus
agatcggtggcttttgttcagactt

SEQ ID NO: 119427 - DNA, 25 bp, Rattus norvegicus
agatcgtaaaggctcccaaggctcc

SEQ ID NO: 119428 - DNA, 25 bp, Rattus norvegicus
agatcgtaaagggtcccaaggctcc

SEQ ID NO: 119429 - DNA, 25 bp, Rattus norvegicus
agatcgtactctcggtggttcctcg

SEQ ID NO: 119430 - DNA, 25 bp, Rattus norvegicus
agatcgtactctgggtggttcctcg

SEQ ID NO: 119431 - DNA, 25 bp, Rattus norvegicus
agatcgtactttataatccgccacc

SEQ ID NO: 119432 - DNA, 25 bp, Rattus norvegicus
agatcgtactttttaatccgccacc

SEQ ID NO: 119433 - DNA, 25 bp, Rattus norvegicus
agatcgtagacacgccacctcatgt

SEQ ID NO: 119434 - DNA, 25 bp, Rattus norvegicus
agatcgtagacaggccacctcatgt

SEQ ID NO: 119435 - DNA, 25 bp, Rattus norvegicus
agatcgtagccaagcactcggtgcg

SEQ ID NO: 119436 - DNA, 25 bp, Rattus norvegicus
agatcgtagccatgcactcggtgcg

SEQ ID NO: 119437 - DNA, 25 bp, Rattus norvegicus
agatcgtcactaacccgccagacat

SEQ ID NO: 119438 - DNA, 25 bp, Rattus norvegicus
agatcgtcactactctcggtgatgt

SEQ ID NO: 119439 - DNA, 25 bp, Rattus norvegicus
agatcgtcactagtctcggtgatgt

SEQ ID NO: 119440 - DNA, 25 bp, Rattus norvegicus
agatcgtcactatcccgccagacat

SEQ ID NO: 119441 - DNA, 25 bp, Rattus norvegicus
agatcgtccgtaacatcctgattga

SEQ ID NO: 119442 - DNA, 25 bp, Rattus norvegicus
agatcgtccgtatcatcctgattga

SEQ ID NO: 119443 - DNA, 25 bp, Rattus norvegicus
agatcgtctttcataatatcccaaa

SEQ ID NO: 119444 - DNA, 25 bp, Rattus norvegicus
agatcgtctttcttaatatcccaaa

SEQ ID NO: 119445 - DNA, 25 bp, Rattus norvegicus
agatcgtgatctctggagaccctca

SEQ ID NO: 119446 - DNA, 25 bp, Rattus norvegicus
agatcgtgatctgtggagaccctca

SEQ ID NO: 119447 - DNA, 25 bp, Rattus norvegicus
agatcgtgcaggatggcgaccacat

SEQ ID NO: 119448 - DNA, 25 bp, Rattus norvegicus
agatcgtgcaggttggcgaccacat

SEQ ID NO: 119449 - DNA, 25 bp, Rattus norvegicus
agatcgtgcagtcagctgggccacc

SEQ ID NO: 119450 - DNA, 25 bp, Rattus norvegicus
agatcgtgcagtgagctgggccacc

SEQ ID NO: 119451 - DNA, 25 bp, Rattus norvegicus
agatcgtggcgtatactgttggctc

SEQ ID NO: 119452 - DNA, 25 bp, Rattus norvegicus
agatcgtggcgtttactgttggctc

SEQ ID NO: 119453 - DNA, 25 bp, Rattus norvegicus
agatcgtgtctacctttgcctagta

SEQ ID NO: 119454 - DNA, 25 bp, Rattus norvegicus
agatcgtgtctagctttgcctagta

SEQ ID NO: 119455 - DNA, 25 bp, Rattus norvegicus
agatcgtgtcttaggaagcaccccg

SEQ ID NO: 119456 - DNA, 25 bp, Rattus norvegicus
agatcgtgtctttggaagcaccccg

SEQ ID NO: 119457 - DNA, 25 bp, Rattus norvegicus
agatcgtgtgatctcactctcagga

SEQ ID NO: 119458 - DNA, 25 bp, Rattus norvegicus
agatcgtgtgatgtcactctcagga

SEQ ID NO: 119459 - DNA, 25 bp, Rattus norvegicus
agatcgttccacaggagtgttcgcc

SEQ ID NO: 119460 - DNA, 25 bp, Rattus norvegicus
agatcgttccactggagtgttcgcc

SEQ ID NO: 119461 - DNA, 25 bp, Rattus norvegicus
agatcgttctttctagggccttgca

SEQ ID NO: 119462 - DNA, 25 bp, Rattus norvegicus
agatcgttctttgtagggccttgca

SEQ ID NO: 119463 - DNA, 25 bp, Rattus norvegicus
agatcgtttgctctttttgctctct

SEQ ID NO: 119464 - DNA, 25 bp, Rattus norvegicus
agatcgtttgctgtttttgctctct

SEQ ID NO: 119465 - DNA, 25 bp, Rattus norvegicus
agatcgtttgtgactctgctggtga

SEQ ID NO: 119466 - DNA, 25 bp, Rattus norvegicus
agatcgtttgtgtctctgctggtga

SEQ ID NO: 119467 - DNA, 25 bp, Rattus norvegicus
agatctaaagctctggccacctact

SEQ ID NO: 119468 - DNA, 25 bp, Rattus norvegicus
agatctaaagctgtggccacctact

SEQ ID NO: 119469 - DNA, 25 bp, Rattus norvegicus
agatctaacctcagcatcatgctta

SEQ ID NO: 119470 - DNA, 25 bp, Rattus norvegicus
agatctaacctctgcatcatgctta

SEQ ID NO: 119471 - DNA, 25 bp, Rattus norvegicus
agatctacaaccagattcacctgga

SEQ ID NO: 119472 - DNA, 25 bp, Rattus norvegicus
agatctacaacctgattcacctgga

SEQ ID NO: 119473 - DNA, 25 bp, Rattus norvegicus
agatctacaatgctggccctggtcc

SEQ ID NO: 119474 - DNA, 25 bp, Rattus norvegicus
agatctacaatggtggccctggtcc

SEQ ID NO: 119475 - DNA, 25 bp, Rattus norvegicus
agatctacacagagtcctcaggaca

SEQ ID NO: 119476 - DNA, 25 bp, Rattus norvegicus
agatctacacagtgtcctcaggaca

SEQ ID NO: 119477 - DNA, 25 bp, Rattus norvegicus
agatctacctttatggcttctggcc

SEQ ID NO: 119478 - DNA, 25 bp, Rattus norvegicus
agatctacctttttggcttctggcc

SEQ ID NO: 119479 - DNA, 25 bp, Rattus norvegicus
agatctactccaagctcaacaaatg

SEQ ID NO: 119480 - DNA, 25 bp, Rattus norvegicus
agatctactccatgctcaacaaatg

SEQ ID NO: 119481 - DNA, 25 bp, Rattus norvegicus
agatctagaagcacagcctcctggg

SEQ ID NO: 119482 - DNA, 25 bp, Rattus norvegicus
agatctagaagctcagcctcctggg

SEQ ID NO: 119483 - DNA, 25 bp, Rattus norvegicus
agatctagagatccacttccttctt

SEQ ID NO: 119484 - DNA, 25 bp, Rattus norvegicus
agatctagagatgcacttccttctt

SEQ ID NO: 119485 - DNA, 25 bp, Rattus norvegicus
agatctagattccattctccgtcta

SEQ ID NO: 119486 - DNA, 25 bp, Rattus norvegicus
agatctagattcgattctccgtcta

SEQ ID NO: 119487 - DNA, 25 bp, Rattus norvegicus
agatctagggcccaccttttatagc

SEQ ID NO: 119488 - DNA, 25 bp, Rattus norvegicus
agatctagggccgaccttttatagc

SEQ ID NO: 119489 - DNA, 25 bp, Rattus norvegicus
agatctatagtcctgcacctactct

SEQ ID NO: 119490 - DNA, 25 bp, Rattus norvegicus
agatctatagtcgtgcacctactct

SEQ ID NO: 119491 - DNA, 25 bp, Rattus norvegicus
agatctatccgacctgtcttggagt

SEQ ID NO: 119492 - DNA, 25 bp, Rattus norvegicus
agatctatccgagctgtcttggagt

SEQ ID NO: 119493 - DNA, 25 bp, Rattus norvegicus
agatctatcctaccatccctgagat

SEQ ID NO: 119494 - DNA, 25 bp, Rattus norvegicus
agatctatcctagcatccctgagat

SEQ ID NO: 119495 - DNA, 25 bp, Rattus norvegicus
agatctatgagaccctcctggtgcc

SEQ ID NO: 119496 - DNA, 25 bp, Rattus norvegicus
agatctatgagagcctcctggtgcc

SEQ ID NO: 119497 - DNA, 25 bp, Rattus norvegicus
agatctatggttacaactacccttg

SEQ ID NO: 119498 - DNA, 25 bp, Rattus norvegicus
agatctatggtttcaactacccttg

SEQ ID NO: 119499 - DNA, 25 bp, Rattus norvegicus
agatctatttttcccagagcaccct

SEQ ID NO: 119500 - DNA, 25 bp, Rattus norvegicus
agatctatttttgccagagcaccct

SEQ ID NO: 119501 - DNA, 25 bp, Rattus norvegicus
agatctcaaaggctgcagctctctt

SEQ ID NO: 119502 - DNA, 25 bp, Rattus norvegicus
agatctcaaagggtgcagctctctt

SEQ ID NO: 119503 - DNA, 25 bp, Rattus norvegicus
agatctcaaatcagacctctgtgcc

SEQ ID NO: 119504 - DNA, 25 bp, Rattus norvegicus
agatctcaaatctgacctctgtgcc

SEQ ID NO: 119505 - DNA, 25 bp, Rattus norvegicus
agatctcaacaaaggctgctgagga

SEQ ID NO: 119506 - DNA, 25 bp, Rattus norvegicus
agatctcaacaatggctgctgagga

SEQ ID NO: 119507 - DNA, 25 bp, Rattus norvegicus
agatctcaagaccattgctcagagg

SEQ ID NO: 119508 - DNA, 25 bp, Rattus norvegicus
agatctcaagacgattgctcagagg

SEQ ID NO: 119509 - DNA, 25 bp, Rattus norvegicus
agatctcaagcaccatcggcgtctt

SEQ ID NO: 119510 - DNA, 25 bp, Rattus norvegicus
agatctcaagcagcatcggcgtctt

SEQ ID NO: 119511 - DNA, 25 bp, Rattus norvegicus
agatctcacgtacctagtcaccttt

SEQ ID NO: 119512 - DNA, 25 bp, Rattus norvegicus
agatctcacgtagctagtcaccttt

SEQ ID NO: 119513 - DNA, 25 bp, Rattus norvegicus
agatctcactgaagtttcttttccc

SEQ ID NO: 119514 - DNA, 25 bp, Rattus norvegicus
agatctcactgatgtttcttttccc

SEQ ID NO: 119515 - DNA, 25 bp, Rattus norvegicus
agatctcactgtaggtttctggaac

SEQ ID NO: 119516 - DNA, 25 bp, Rattus norvegicus
agatctcactgtcatctccctgtta

SEQ ID NO: 119517 - DNA, 25 bp, Rattus norvegicus
agatctcactgtgatctccctgtta

SEQ ID NO: 119518 - DNA, 25 bp, Rattus norvegicus
agatctcactgttggtttctggaac

SEQ ID NO: 119519 - DNA, 25 bp, Rattus norvegicus
agatctcacttcaagctgaacagcc

SEQ ID NO: 119520 - DNA, 25 bp, Rattus norvegicus
agatctcacttctagctgaacagcc

SEQ ID NO: 119521 - DNA, 25 bp, Rattus norvegicus
agatctcagctaattcctttttact

SEQ ID NO: 119522 - DNA, 25 bp, Rattus norvegicus
agatctcagctatttcctttttact

SEQ ID NO: 119523 - DNA, 25 bp, Rattus norvegicus
agatctcagtgtctagcagcccagg

SEQ ID NO: 119524 - DNA, 25 bp, Rattus norvegicus
agatctcagtgtgtagcagcccagg

SEQ ID NO: 119525 - DNA, 25 bp, Rattus norvegicus
agatctcatcctatgacttctgcat

SEQ ID NO: 119526 - DNA, 25 bp, Rattus norvegicus
agatctcatcctttgacttctgcat

SEQ ID NO: 119527 - DNA, 25 bp, Rattus norvegicus
agatctcatggacggcttgactgcc

SEQ ID NO: 119528 - DNA, 25 bp, Rattus norvegicus
agatctcatggagggcttgactgcc

SEQ ID NO: 119529 - DNA, 25 bp, Rattus norvegicus
agatctcattccactgagtcctgaa

SEQ ID NO: 119530 - DNA, 25 bp, Rattus norvegicus
agatctcattccatagcccaggaaa

SEQ ID NO: 119531 - DNA, 25 bp, Rattus norvegicus
agatctcattcctctgagtcctgaa

SEQ ID NO: 119532 - DNA, 25 bp, Rattus norvegicus
agatctcattccttagcccaggaaa

SEQ ID NO: 119533 - DNA, 25 bp, Rattus norvegicus
agatctccactacactcccagaagg

SEQ ID NO: 119534 - DNA, 25 bp, Rattus norvegicus
agatctccactagactcccagaagg

SEQ ID NO: 119535 - DNA, 25 bp, Rattus norvegicus
agatctccagcactacgtaaaccag

SEQ ID NO: 119536 - DNA, 25 bp, Rattus norvegicus
agatctccagcagtacgtaaaccag

SEQ ID NO: 119537 - DNA, 25 bp, Rattus norvegicus
agatctccagttacgcgttttgttt

SEQ ID NO: 119538 - DNA, 25 bp, Rattus norvegicus
agatctccagtttcgcgttttgttt

SEQ ID NO: 119539 - DNA, 25 bp, Rattus norvegicus
agatctcccaatatgagagctggcc

SEQ ID NO: 119540 - DNA, 25 bp, Rattus norvegicus
agatctcccaatttgagagctggcc

SEQ ID NO: 119541 - DNA, 25 bp, Rattus norvegicus
agatctcccgtcagatgatgtaaat

SEQ ID NO: 119542 - DNA, 25 bp, Rattus norvegicus
agatctcccgtctgatgatgtaaat

SEQ ID NO: 119543 - DNA, 25 bp, Rattus norvegicus
agatctccctccagtcaggcttaca

SEQ ID NO: 119544 - DNA, 25 bp, Rattus norvegicus
agatctccctcctgtcaggcttaca

SEQ ID NO: 119545 - DNA, 25 bp, Rattus norvegicus
agatctccgcgcaaggccgtgcacg

SEQ ID NO: 119546 - DNA, 25 bp, Rattus norvegicus
agatctccgcgctaggccgtgcacg

SEQ ID NO: 119547 - DNA, 25 bp, Rattus norvegicus
agatctcctccaatttcgatcggat

SEQ ID NO: 119548 - DNA, 25 bp, Rattus norvegicus
agatctcctccattttcgatcggat

SEQ ID NO: 119549 - DNA, 25 bp, Rattus norvegicus
agatctcctgccataggttccaagg

SEQ ID NO: 119550 - DNA, 25 bp, Rattus norvegicus
agatctcctgccttaggttccaagg

SEQ ID NO: 119551 - DNA, 25 bp, Rattus norvegicus
agatctcctggaactggagtcacaa

SEQ ID NO: 119552 - DNA, 25 bp, Rattus norvegicus
agatctcctggatctggagtcacaa

SEQ ID NO: 119553 - DNA, 25 bp, Rattus norvegicus
agatctcctggcatttatcctagtc

SEQ ID NO: 119554 - DNA, 25 bp, Rattus norvegicus
agatctcctggcttttatcctagtc

SEQ ID NO: 119555 - DNA, 25 bp, Rattus norvegicus
agatctcctgtacctgtttctgtca

SEQ ID NO: 119556 - DNA, 25 bp, Rattus norvegicus
agatctcctgtagctgtttctgtca

SEQ ID NO: 119557 - DNA, 25 bp, Rattus norvegicus
agatctccttaccaaatgcttgagg

SEQ ID NO: 119558 - DNA, 25 bp, Rattus norvegicus
agatctccttacgaaatgcttgagg

SEQ ID NO: 119559 - DNA, 25 bp, Rattus norvegicus
agatctccttgactgagcccatgaa

SEQ ID NO: 119560 - DNA, 25 bp, Rattus norvegicus
agatctccttgagtgagcccatgaa

SEQ ID NO: 119561 - DNA, 25 bp, Rattus norvegicus
agatctccttggagcgaatgccgta

SEQ ID NO: 119562 - DNA, 25 bp, Rattus norvegicus
agatctccttggtgcgaatgccgta

SEQ ID NO: 119563 - DNA, 25 bp, Rattus norvegicus
agatctcgatgtagccggtgtacca

SEQ ID NO: 119564 - DNA, 25 bp, Rattus norvegicus
agatctcgatgttgccggtgtacca

SEQ ID NO: 119565 - DNA, 25 bp, Rattus norvegicus
agatctcgccatcacgtgcccgagg

SEQ ID NO: 119566 - DNA, 25 bp, Rattus norvegicus
agatctcgccatgacgtgcccgagg

SEQ ID NO: 119567 - DNA, 25 bp, Rattus norvegicus
agatctcggtgaacgctggtggcat

SEQ ID NO: 119568 - DNA, 25 bp, Rattus norvegicus
agatctcggtgatcgctggtggcat

SEQ ID NO: 119569 - DNA, 25 bp, Rattus norvegicus
agatctctaagtctacctgtgtctt

SEQ ID NO: 119570 - DNA, 25 bp, Rattus norvegicus
agatctctaagtgtacctgtgtctt

SEQ ID NO: 119571 - DNA, 25 bp, Rattus norvegicus
agatctctatcccagtcatactgat

SEQ ID NO: 119572 - DNA, 25 bp, Rattus norvegicus
agatctctatccgagtcatactgat

SEQ ID NO: 119573 - DNA, 25 bp, Rattus norvegicus
agatctctatttaggcagctttaat

SEQ ID NO: 119574 - DNA, 25 bp, Rattus norvegicus
agatctctattttggcagctttaat

SEQ ID NO: 119575 - DNA, 25 bp, Rattus norvegicus
agatctctcaggactgtcagctgtg

SEQ ID NO: 119576 - DNA, 25 bp, Rattus norvegicus
agatctctcaggtctgtcagctgtg

SEQ ID NO: 119577 - DNA, 25 bp, Rattus norvegicus
agatctctccacctgttaatgaagt

SEQ ID NO: 119578 - DNA, 25 bp, Rattus norvegicus
agatctctccacgtgttaatgaagt

SEQ ID NO: 119579 - DNA, 25 bp, Rattus norvegicus
agatctctcctacccaagggatgtt

SEQ ID NO: 119580 - DNA, 25 bp, Rattus norvegicus
agatctctcctagccaagggatgtt

SEQ ID NO: 119581 - DNA, 25 bp, Rattus norvegicus
agatctctcttccacaggatttggg

SEQ ID NO: 119582 - DNA, 25 bp, Rattus norvegicus
agatctctcttcgacaggatttggg

SEQ ID NO: 119583 - DNA, 25 bp, Rattus norvegicus
agatctctgaatacagccctgaatg

SEQ ID NO: 119584 - DNA, 25 bp, Rattus norvegicus
agatctctgaattcagccctgaatg

SEQ ID NO: 119585 - DNA, 25 bp, Rattus norvegicus
agatctctgacaaagatgacgcagt

SEQ ID NO: 119586 - DNA, 25 bp, Rattus norvegicus
agatctctgacatagatgacgcagt

SEQ ID NO: 119587 - DNA, 25 bp, Rattus norvegicus
agatctctgcaaattaaagtcctca

SEQ ID NO: 119588 - DNA, 25 bp, Rattus norvegicus
agatctctgcaatttaaagtcctca

SEQ ID NO: 119589 - DNA, 25 bp, Rattus norvegicus
agatctctgctcctactgtgttcag

SEQ ID NO: 119590 - DNA, 25 bp, Rattus norvegicus
agatctctgctcgtactgtgttcag

SEQ ID NO: 119591 - DNA, 25 bp, Rattus norvegicus
agatctctgcttctgattcctaata

SEQ ID NO: 119592 - DNA, 25 bp, Rattus norvegicus
agatctctgcttgtgattcctaata

SEQ ID NO: 119593 - DNA, 25 bp, Rattus norvegicus
agatctctgtacagatggcctattc

SEQ ID NO: 119594 - DNA, 25 bp, Rattus norvegicus
agatctctgtactgatggcctattc

SEQ ID NO: 119595 - DNA, 25 bp, Rattus norvegicus
agatctctgtccctgcttatttaat

SEQ ID NO: 119596 - DNA, 25 bp, Rattus norvegicus
agatctctgtccgtgcttatttaat

SEQ ID NO: 119597 - DNA, 25 bp, Rattus norvegicus
agatctcttctgagctgagtggagc

SEQ ID NO: 119598 - DNA, 25 bp, Rattus norvegicus
agatctcttctgatcttaactttaa

SEQ ID NO: 119599 - DNA, 25 bp, Rattus norvegicus
agatctcttctgtgctgagtggagc

SEQ ID NO: 119600 - DNA, 25 bp, Rattus norvegicus
agatctcttctgttcttaactttaa

SEQ ID NO: 119601 - DNA, 25 bp, Rattus norvegicus
agatctcttgcgactgtgactaacc

SEQ ID NO: 119602 - DNA, 25 bp, Rattus norvegicus
agatctcttgcgtctgtgactaacc

SEQ ID NO: 119603 - DNA, 25 bp, Rattus norvegicus
agatctcttgggaacccttctcaaa

SEQ ID NO: 119604 - DNA, 25 bp, Rattus norvegicus
agatctcttgggtacccttctcaaa

SEQ ID NO: 119605 - DNA, 25 bp, Rattus norvegicus
agatctctttagcttaactgcaata

SEQ ID NO: 119606 - DNA, 25 bp, Rattus norvegicus
agatctctttaggttaactgcaata

SEQ ID NO: 119607 - DNA, 25 bp, Rattus norvegicus
agatctctttatcgattccctccca

SEQ ID NO: 119608 - DNA, 25 bp, Rattus norvegicus
agatctctttatggattccctccca

SEQ ID NO: 119609 - DNA, 25 bp, Rattus norvegicus
agatctcttttaaactgccacttgc

SEQ ID NO: 119610 - DNA, 25 bp, Rattus norvegicus
agatctcttttatactgccacttgc

SEQ ID NO: 119611 - DNA, 25 bp, Rattus norvegicus
agatctgaaaaacaactcctacaag

SEQ ID NO: 119612 - DNA, 25 bp, Rattus norvegicus
agatctgaaaaagaactcctacaag

SEQ ID NO: 119613 - DNA, 25 bp, Rattus norvegicus
agatctgaacacacagtgcacagca

SEQ ID NO: 119614 - DNA, 25 bp, Rattus norvegicus
agatctgaacactcagtgcacagca

SEQ ID NO: 119615 - DNA, 25 bp, Rattus norvegicus
agatctgaacatccatgcccttgag

SEQ ID NO: 119616 - DNA, 25 bp, Rattus norvegicus
agatctgaacatgcatgcccttgag

SEQ ID NO: 119617 - DNA, 25 bp, Rattus norvegicus
agatctgaagccataccatatccac

SEQ ID NO: 119618 - DNA, 25 bp, Rattus norvegicus
agatctgaagccttaccatatccac

SEQ ID NO: 119619 - DNA, 25 bp, Rattus norvegicus
agatctgaatttcagacctgcttgg

SEQ ID NO: 119620 - DNA, 25 bp, Rattus norvegicus
agatctgaatttgagacctgcttgg

SEQ ID NO: 119621 - DNA, 25 bp, Rattus norvegicus
agatctgacgtgctcacactggatg

SEQ ID NO: 119622 - DNA, 25 bp, Rattus norvegicus
agatctgacgtggtcacactggatg

SEQ ID NO: 119623 - DNA, 25 bp, Rattus norvegicus
agatctgactgacgtccatctactc

SEQ ID NO: 119624 - DNA, 25 bp, Rattus norvegicus
agatctgactgaggtccatctactc

SEQ ID NO: 119625 - DNA, 25 bp, Rattus norvegicus
agatctgactggctgtttgctgaag

SEQ ID NO: 119626 - DNA, 25 bp, Rattus norvegicus
agatctgactgggtgtttgctgaag

SEQ ID NO: 119627 - DNA, 25 bp, Rattus norvegicus
agatctgactttagacaccagctcc

SEQ ID NO: 119628 - DNA, 25 bp, Rattus norvegicus
agatctgacttttgacaccagctcc

SEQ ID NO: 119629 - DNA, 25 bp, Rattus norvegicus
agatctgagcacattcctggtctga

SEQ ID NO: 119630 - DNA, 25 bp, Rattus norvegicus
agatctgagcactttcctggtctga

SEQ ID NO: 119631 - DNA, 25 bp, Rattus norvegicus
agatctgagcagcatacttcatgta

SEQ ID NO: 119632 - DNA, 25 bp, Rattus norvegicus
agatctgagcaggatacttcatgta

SEQ ID NO: 119633 - DNA, 25 bp, Rattus norvegicus
agatctgagtcaccatctgtgggtt

SEQ ID NO: 119634 - DNA, 25 bp, Rattus norvegicus
agatctgagtcagcatctgtgggtt

SEQ ID NO: 119635 - DNA, 25 bp, Rattus norvegicus
agatctgataccatcctgtgacttt

SEQ ID NO: 119636 - DNA, 25 bp, Rattus norvegicus
agatctgataccttcctgtgacttt

SEQ ID NO: 119637 - DNA, 25 bp, Rattus norvegicus
agatctgatctcaggaaatggccga

SEQ ID NO: 119638 - DNA, 25 bp, Rattus norvegicus
agatctgatctctggaaatggccga

SEQ ID NO: 119639 - DNA, 25 bp, Rattus norvegicus
agatctgatcttcctgttattccgg

SEQ ID NO: 119640 - DNA, 25 bp, Rattus norvegicus
agatctgatcttgctgttattccgg

SEQ ID NO: 119641 - DNA, 25 bp, Rattus norvegicus
agatctgatggaatccagccttgtc

SEQ ID NO: 119642 - DNA, 25 bp, Rattus norvegicus
agatctgatggattccagccttgtc

SEQ ID NO: 119643 - DNA, 25 bp, Rattus norvegicus
agatctgcaaccctcttgctgacta

SEQ ID NO: 119644 - DNA, 25 bp, Rattus norvegicus
agatctgcaaccgtcttgctgacta

SEQ ID NO: 119645 - DNA, 25 bp, Rattus norvegicus
agatctgcaacgcacgacggctggc

SEQ ID NO: 119646 - DNA, 25 bp, Rattus norvegicus
agatctgcaacggacgacggctggc

SEQ ID NO: 119647 - DNA, 25 bp, Rattus norvegicus
agatctgcaatgctgactctgctga

SEQ ID NO: 119648 - DNA, 25 bp, Rattus norvegicus
agatctgcaatggtgactctgctga

SEQ ID NO: 119649 - DNA, 25 bp, Rattus norvegicus
agatctgcacacagagtgtctgaag

SEQ ID NO: 119650 - DNA, 25 bp, Rattus norvegicus
agatctgcacactgagtgtctgaag

SEQ ID NO: 119651 - DNA, 25 bp, Rattus norvegicus
agatctgcagcaccatccggacagg

SEQ ID NO: 119652 - DNA, 25 bp, Rattus norvegicus
agatctgcagcagcatccggacagg

SEQ ID NO: 119653 - DNA, 25 bp, Rattus norvegicus
agatctgcaggcacttggctcaaag

SEQ ID NO: 119654 - DNA, 25 bp, Rattus norvegicus
agatctgcaggctcttggctcaaag

SEQ ID NO: 119655 - DNA, 25 bp, Rattus norvegicus
agatctgccagacgatgggctcctg

SEQ ID NO: 119656 - DNA, 25 bp, Rattus norvegicus
agatctgccagaggatgggctcctg

SEQ ID NO: 119657 - DNA, 25 bp, Rattus norvegicus
agatctgcccatacaggtgacacct

SEQ ID NO: 119658 - DNA, 25 bp, Rattus norvegicus
agatctgcccattcaggtgacacct

SEQ ID NO: 119659 - DNA, 25 bp, Rattus norvegicus
agatctgcccgacctgccaggagac

SEQ ID NO: 119660 - DNA, 25 bp, Rattus norvegicus
agatctgcccgagctgccaggagac

SEQ ID NO: 119661 - DNA, 25 bp, Rattus norvegicus
agatctgccctgctctgcagtgctg

SEQ ID NO: 119662 - DNA, 25 bp, Rattus norvegicus
agatctgccctggtctgcagtgctg

SEQ ID NO: 119663 - DNA, 25 bp, Rattus norvegicus
agatctgcccttactgggtgatgcc

SEQ ID NO: 119664 - DNA, 25 bp, Rattus norvegicus
agatctgccctttctgggtgatgcc

SEQ ID NO: 119665 - DNA, 25 bp, Rattus norvegicus
agatctgcctcaatcgagattttta

SEQ ID NO: 119666 - DNA, 25 bp, Rattus norvegicus
agatctgcctcattcgagattttta

SEQ ID NO: 119667 - DNA, 25 bp, Rattus norvegicus
agatctgcctggctttgtcagtata

SEQ ID NO: 119668 - DNA, 25 bp, Rattus norvegicus
agatctgcctgggtttgtcagtata

SEQ ID NO: 119669 - DNA, 25 bp, Rattus norvegicus
agatctgcctttcttacttgctaaa

SEQ ID NO: 119670 - DNA, 25 bp, Rattus norvegicus
agatctgcctttgttacttgctaaa

SEQ ID NO: 119671 - DNA, 25 bp, Rattus norvegicus
agatctgcgacacggtgagcctctt

SEQ ID NO: 119672 - DNA, 25 bp, Rattus norvegicus
agatctgcgacagggtgagcctctt

SEQ ID NO: 119673 - DNA, 25 bp, Rattus norvegicus
agatctgcgctgaccccaaagagac

SEQ ID NO: 119674 - DNA, 25 bp, Rattus norvegicus
agatctgcgctgtccccaaagagac

SEQ ID NO: 119675 - DNA, 25 bp, Rattus norvegicus
agatctgctactcccaattagagct

SEQ ID NO: 119676 - DNA, 25 bp, Rattus norvegicus
agatctgctactgccaattagagct

SEQ ID NO: 119677 - DNA, 25 bp, Rattus norvegicus
agatctgctataactaccgactgct

SEQ ID NO: 119678 - DNA, 25 bp, Rattus norvegicus
agatctgctatatctaccgactgct

SEQ ID NO: 119679 - DNA, 25 bp, Rattus norvegicus
agatctgctcagagactgcgtccag

SEQ ID NO: 119680 - DNA, 25 bp, Rattus norvegicus
agatctgctcagtgactgcgtccag

SEQ ID NO: 119681 - DNA, 25 bp, Rattus norvegicus
agatctgctccacctgtgtgtgctg

SEQ ID NO: 119682 - DNA, 25 bp, Rattus norvegicus
agatctgctccagctgtgtgtgctg

SEQ ID NO: 119683 - DNA, 25 bp, Rattus norvegicus
agatctgctctgcactcagaatcaa

SEQ ID NO: 119684 - DNA, 25 bp, Rattus norvegicus
agatctgctctggactcagaatcaa

SEQ ID NO: 119685 - DNA, 25 bp, Rattus norvegicus
agatctgctgcgacgtggtttcctt

SEQ ID NO: 119686 - DNA, 25 bp, Rattus norvegicus
agatctgctgcgtcgtggtttcctt

SEQ ID NO: 119687 - DNA, 25 bp, Rattus norvegicus
agatctgctgtcagccgagctgcac

SEQ ID NO: 119688 - DNA, 25 bp, Rattus norvegicus
agatctgctgtctgccgagctgcac

SEQ ID NO: 119689 - DNA, 25 bp, Rattus norvegicus
agatctgcttgcagagaaggtcctc

SEQ ID NO: 119690 - DNA, 25 bp, Rattus norvegicus
agatctgcttgctgagaaggtcctc

SEQ ID NO: 119691 - DNA, 25 bp, Rattus norvegicus
agatctggaaggaactgcccacttt

SEQ ID NO: 119692 - DNA, 25 bp, Rattus norvegicus
agatctggaaggtactgcccacttt

SEQ ID NO: 119693 - DNA, 25 bp, Rattus norvegicus
agatctggaggccttcctttgacac

SEQ ID NO: 119694 - DNA, 25 bp, Rattus norvegicus
agatctggaggcgttcctttgacac

SEQ ID NO: 119695 - DNA, 25 bp, Rattus norvegicus
agatctggagtacctggtcatgaag

SEQ ID NO: 119696 - DNA, 25 bp, Rattus norvegicus
agatctggagtagctggtcatgaag

SEQ ID NO: 119697 - DNA, 25 bp, Rattus norvegicus
agatctggagttctgctgtgctttg

SEQ ID NO: 119698 - DNA, 25 bp, Rattus norvegicus
agatctggagttgtgctgtgctttg

SEQ ID NO: 119699 - DNA, 25 bp, Rattus norvegicus
agatctggctccaggatgaccactg

SEQ ID NO: 119700 - DNA, 25 bp, Rattus norvegicus
agatctggctcctggatgaccactg

SEQ ID NO: 119701 - DNA, 25 bp, Rattus norvegicus
agatctgggcggacctctgcgtgat

SEQ ID NO: 119702 - DNA, 25 bp, Rattus norvegicus
agatctgggcggtcctctgcgtgat

SEQ ID NO: 119703 - DNA, 25 bp, Rattus norvegicus
agatctgggctcactgcatgtccta

SEQ ID NO: 119704 - DNA, 25 bp, Rattus norvegicus
agatctgggctctctgcatgtccta

SEQ ID NO: 119705 - DNA, 25 bp, Rattus norvegicus
agatctgggctgaaaactctgcggc

SEQ ID NO: 119706 - DNA, 25 bp, Rattus norvegicus
agatctgggctgtaaactctgcggc

SEQ ID NO: 119707 - DNA, 25 bp, Rattus norvegicus
agatctggtcccagtgtgtgagagt

SEQ ID NO: 119708 - DNA, 25 bp, Rattus norvegicus
agatctggtccctgtgtgtgagagt

SEQ ID NO: 119709 - DNA, 25 bp, Rattus norvegicus
agatctggtggcacagctccgagct

SEQ ID NO: 119710 - DNA, 25 bp, Rattus norvegicus
agatctggtggctcagctccgagct

SEQ ID NO: 119711 - DNA, 25 bp, Rattus norvegicus
agatctggtgtgcatgttcactgcc

SEQ ID NO: 119712 - DNA, 25 bp, Rattus norvegicus
agatctggtgtggatgttcactgcc

SEQ ID NO: 119713 - DNA, 25 bp, Rattus norvegicus
agatctggtttgatttcctgacgac

SEQ ID NO: 119714 - DNA, 25 bp, Rattus norvegicus
agatctggtttgttttcctgacgac

SEQ ID NO: 119715 - DNA, 25 bp, Rattus norvegicus
agatctgtagtgcaagcagctctta

SEQ ID NO: 119716 - DNA, 25 bp, Rattus norvegicus
agatctgtagtggaagcagctctta

SEQ ID NO: 119717 - DNA, 25 bp, Rattus norvegicus
agatctgtagttctcaacacttaga

SEQ ID NO: 119718 - DNA, 25 bp, Rattus norvegicus
agatctgtagttgtcaacacttaga

SEQ ID NO: 119719 - DNA, 25 bp, Rattus norvegicus
agatctgtatctccatttgctccaa

SEQ ID NO: 119720 - DNA, 25 bp, Rattus norvegicus
agatctgtatctgcatttgctccaa

SEQ ID NO: 119721 - DNA, 25 bp, Rattus norvegicus
agatctgtatggctcctctgccggt

SEQ ID NO: 119722 - DNA, 25 bp, Rattus norvegicus
agatctgtatgggtcctctgccggt

SEQ ID NO: 119723 - DNA, 25 bp, Rattus norvegicus
agatctgtcagaagccacagttgat

SEQ ID NO: 119724 - DNA, 25 bp, Rattus norvegicus
agatctgtcagatgccacagttgat

SEQ ID NO: 119725 - DNA, 25 bp, Rattus norvegicus
agatctgtcagcacactgcagtgac

SEQ ID NO: 119726 - DNA, 25 bp, Rattus norvegicus
agatctgtcagctcactgcagtgac

SEQ ID NO: 119727 - DNA, 25 bp, Rattus norvegicus
agatctgtccctccctctttggtgg

SEQ ID NO: 119728 - DNA, 25 bp, Rattus norvegicus
agatctgtccctgcctctttggtgg

SEQ ID NO: 119729 - DNA, 25 bp, Rattus norvegicus
agatctgtcctcactgactcctgag

SEQ ID NO: 119730 - DNA, 25 bp, Rattus norvegicus
agatctgtcctcatctatgaggtga

SEQ ID NO: 119731 - DNA, 25 bp, Rattus norvegicus
agatctgtcctctctgactcctgag

SEQ ID NO: 119732 - DNA, 25 bp, Rattus norvegicus
agatctgtcctcttctatgaggtga

SEQ ID NO: 119733 - DNA, 25 bp, Rattus norvegicus
agatctgtgaccatctcctgtgttt

SEQ ID NO: 119734 - DNA, 25 bp, Rattus norvegicus
agatctgtgaccttctcctgtgttt

SEQ ID NO: 119735 - DNA, 25 bp, Rattus norvegicus
agatctgtgaggactaccgagccct

SEQ ID NO: 119736 - DNA, 25 bp, Rattus norvegicus
agatctgtgaggtctaccgagccct

SEQ ID NO: 119737 - DNA, 25 bp, Rattus norvegicus
agatctgtgatcagtaacttacagg

SEQ ID NO: 119738 - DNA, 25 bp, Rattus norvegicus
agatctgtgatcatctgctcgccaa

SEQ ID NO: 119739 - DNA, 25 bp, Rattus norvegicus
agatctgtgatctgtaacttacagg

SEQ ID NO: 119740 - DNA, 25 bp, Rattus norvegicus
agatctgtgatcttctgctcgccaa

SEQ ID NO: 119741 - DNA, 25 bp, Rattus norvegicus
agatctgtgatgactacccttcctt

SEQ ID NO: 119742 - DNA, 25 bp, Rattus norvegicus
agatctgtgatgtctacccttcctt

SEQ ID NO: 119743 - DNA, 25 bp, Rattus norvegicus
agatctgtgcagaattccacctctt

SEQ ID NO: 119744 - DNA, 25 bp, Rattus norvegicus
agatctgtgcagtattccacctctt

SEQ ID NO: 119745 - DNA, 25 bp, Rattus norvegicus
agatctgtgcctactctttttagga

SEQ ID NO: 119746 - DNA, 25 bp, Rattus norvegicus
agatctgtgccttctctttttagga

SEQ ID NO: 119747 - DNA, 25 bp, Rattus norvegicus
agatctgtggcgcaaaacactgcaa

SEQ ID NO: 119748 - DNA, 25 bp, Rattus norvegicus
agatctgtggcggaaaacactgcaa

SEQ ID NO: 119749 - DNA, 25 bp, Rattus norvegicus
agatctgttagtctgtcaggagcaa

SEQ ID NO: 119750 - DNA, 25 bp, Rattus norvegicus
agatctgttagtgtgtcaggagcaa

SEQ ID NO: 119751 - DNA, 25 bp, Rattus norvegicus
agatctgttattctggtccatttaa

SEQ ID NO: 119752 - DNA, 25 bp, Rattus norvegicus
agatctgttattgtggtccatttaa

SEQ ID NO: 119753 - DNA, 25 bp, Rattus norvegicus
agatctgttgagagtccccattgca

SEQ ID NO: 119754 - DNA, 25 bp, Rattus norvegicus
agatctgttgagtgtccccattgca

SEQ ID NO: 119755 - DNA, 25 bp, Rattus norvegicus
agatctgttggccttttgtctctcc

SEQ ID NO: 119756 - DNA, 25 bp, Rattus norvegicus
agatctgttggcgttttgtctctcc

SEQ ID NO: 119757 - DNA, 25 bp, Rattus norvegicus
agatcttaaggcaacagcagcaaca

SEQ ID NO: 119758 - DNA, 25 bp, Rattus norvegicus
agatcttaaggctacagcagcaaca

SEQ ID NO: 119759 - DNA, 25 bp, Rattus norvegicus
agatcttaatctctgcatgtggcat

SEQ ID NO: 119760 - DNA, 25 bp, Rattus norvegicus
agatcttaatctgtgcatgtggcat

SEQ ID NO: 119761 - DNA, 25 bp, Rattus norvegicus
agatcttacacaagctcagctctct

SEQ ID NO: 119762 - DNA, 25 bp, Rattus norvegicus
agatcttacacatgctcagctctct

SEQ ID NO: 119763 - DNA, 25 bp, Rattus norvegicus
agatcttagattctcgtcttggaaa

SEQ ID NO: 119764 - DNA, 25 bp, Rattus norvegicus
agatcttagattgtcgtcttggaaa

SEQ ID NO: 119765 - DNA, 25 bp, Rattus norvegicus
agatcttagctgcaaataatggcaa

SEQ ID NO: 119766 - DNA, 25 bp, Rattus norvegicus
agatcttagctggaaataatggcaa

SEQ ID NO: 119767 - DNA, 25 bp, Rattus norvegicus
agatcttagtacaaggagcttgcct

SEQ ID NO: 119768 - DNA, 25 bp, Rattus norvegicus
agatcttagtactaggagcttgcct

SEQ ID NO: 119769 - DNA, 25 bp, Rattus norvegicus
agatcttatttaccccaagccaacc

SEQ ID NO: 119770 - DNA, 25 bp, Rattus norvegicus
agatcttatttagcccaagccaacc

SEQ ID NO: 119771 - DNA, 25 bp, Rattus norvegicus
agatcttcaaatactgctgactccc

SEQ ID NO: 119772 - DNA, 25 bp, Rattus norvegicus
agatcttcaaattctgctgactccc

SEQ ID NO: 119773 - DNA, 25 bp, Rattus norvegicus
agatcttcacttatctagctaccga

SEQ ID NO: 119774 - DNA, 25 bp, Rattus norvegicus
agatcttcacttttctagctaccga

SEQ ID NO: 119775 - DNA, 25 bp, Rattus norvegicus
agatcttcatatctgttgcatggaa

SEQ ID NO: 119776 - DNA, 25 bp, Rattus norvegicus
agatcttcatatgtgttgcatggaa

SEQ ID NO: 119777 - DNA, 25 bp, Rattus norvegicus
agatcttcatcaaagtcttccccag

SEQ ID NO: 119778 - DNA, 25 bp, Rattus norvegicus
agatcttcatcatagtcttccccag

SEQ ID NO: 119779 - DNA, 25 bp, Rattus norvegicus
agatcttcatggctccagaggcacc

SEQ ID NO: 119780 - DNA, 25 bp, Rattus norvegicus
agatcttcatgggtccagaggcacc

SEQ ID NO: 119781 - DNA, 25 bp, Rattus norvegicus
agatcttcatttatccttcttttct

SEQ ID NO: 119782 - DNA, 25 bp, Rattus norvegicus
agatcttcatttttccttcttttct

SEQ ID NO: 119783 - DNA, 25 bp, Rattus norvegicus
agatcttccaggagctcacgctgca

SEQ ID NO: 119784 - DNA, 25 bp, Rattus norvegicus
agatcttccaggtgctcacgctgca

SEQ ID NO: 119785 - DNA, 25 bp, Rattus norvegicus
agatcttcccgacggtcagctgagt

SEQ ID NO: 119786 - DNA, 25 bp, Rattus norvegicus
agatcttcccgagggtcagctgagt

SEQ ID NO: 119787 - DNA, 25 bp, Rattus norvegicus
agatcttccctacgagacggcagca

SEQ ID NO: 119788 - DNA, 25 bp, Rattus norvegicus
agatcttccctaggagacggcagca

SEQ ID NO: 119789 - DNA, 25 bp, Rattus norvegicus
agatcttcctctagtgtccaattca

SEQ ID NO: 119790 - DNA, 25 bp, Rattus norvegicus
agatcttcctcttgtgtccaattca

SEQ ID NO: 119791 - DNA, 25 bp, Rattus norvegicus
agatcttcgatcatattcgctccat

SEQ ID NO: 119792 - DNA, 25 bp, Rattus norvegicus
agatcttcgatcttattcgctccat

SEQ ID NO: 119793 - DNA, 25 bp, Rattus norvegicus
agatcttcgatgaatctctttaaag

SEQ ID NO: 119794 - DNA, 25 bp, Rattus norvegicus
agatcttcgatgtatctctttaaag

SEQ ID NO: 119795 - DNA, 25 bp, Rattus norvegicus
agatcttcggtaaacactgctgtgc

SEQ ID NO: 119796 - DNA, 25 bp, Rattus norvegicus
agatcttcggtatacactgctgtgc

SEQ ID NO: 119797 - DNA, 25 bp, Rattus norvegicus
agatcttcgtctacatcggtgagtc

SEQ ID NO: 119798 - DNA, 25 bp, Rattus norvegicus
agatcttcgtcttcatcggtgagtc

SEQ ID NO: 119799 - DNA, 25 bp, Rattus norvegicus
agatcttctcgacctgcttcagcct

SEQ ID NO: 119800 - DNA, 25 bp, Rattus norvegicus
agatcttctcgagctgcttcagcct

SEQ ID NO: 119801 - DNA, 25 bp, Rattus norvegicus
agatcttctcgtcccgcctgcagga

SEQ ID NO: 119802 - DNA, 25 bp, Rattus norvegicus
agatcttctcgtgccgcctgcagga

SEQ ID NO: 119803 - DNA, 25 bp, Rattus norvegicus
agatcttctctgaaccataataggc

SEQ ID NO: 119804 - DNA, 25 bp, Rattus norvegicus
agatcttctctgtaccataataggc

SEQ ID NO: 119805 - DNA, 25 bp, Rattus norvegicus
agatcttcttttctggttctactgt

SEQ ID NO: 119806 - DNA, 25 bp, Rattus norvegicus
agatcttcttttgtggttctactgt

SEQ ID NO: 119807 - DNA, 25 bp, Rattus norvegicus
agatcttgaaatctgggtcccagga

SEQ ID NO: 119808 - DNA, 25 bp, Rattus norvegicus
agatcttgaaatgtgggtcccagga

SEQ ID NO: 119809 - DNA, 25 bp, Rattus norvegicus
agatcttgagctctcctgagtatgc

SEQ ID NO: 119810 - DNA, 25 bp, Rattus norvegicus
agatcttgagctgtcctgagtatgc

SEQ ID NO: 119811 - DNA, 25 bp, Rattus norvegicus
agatcttgagtgacgacattcccat

SEQ ID NO: 119812 - DNA, 25 bp, Rattus norvegicus
agatcttgagtgtcgacattcccat

SEQ ID NO: 119813 - DNA, 25 bp, Rattus norvegicus
agatcttgagttcccaaaccttgtc

SEQ ID NO: 119814 - DNA, 25 bp, Rattus norvegicus
agatcttgagttgccaaaccttgtc

SEQ ID NO: 119815 - DNA, 25 bp, Rattus norvegicus
agatcttgatctacggactgtttga

SEQ ID NO: 119816 - DNA, 25 bp, Rattus norvegicus
agatcttgatcttcggactgtttga

SEQ ID NO: 119817 - DNA, 25 bp, Rattus norvegicus
agatcttgctgcatgcagtcttact

SEQ ID NO: 119818 - DNA, 25 bp, Rattus norvegicus
agatcttgctgcatggggcctaggt

SEQ ID NO: 119819 - DNA, 25 bp, Rattus norvegicus
agatcttgctgcttgcagtcttact

SEQ ID NO: 119820 - DNA, 25 bp, Rattus norvegicus
agatcttgctgcttggggcctaggt

SEQ ID NO: 119821 - DNA, 25 bp, Rattus norvegicus
agatcttggatgagcaaatgttacc

SEQ ID NO: 119822 - DNA, 25 bp, Rattus norvegicus
agatcttggatgtgcaaatgttacc

SEQ ID NO: 119823 - DNA, 25 bp, Rattus norvegicus
agatcttggcgcacctttaattaac

SEQ ID NO: 119824 - DNA, 25 bp, Rattus norvegicus
agatcttggcgctcctttaattaac

SEQ ID NO: 119825 - DNA, 25 bp, Rattus norvegicus
agatcttgggcactgttcttaacat

SEQ ID NO: 119826 - DNA, 25 bp, Rattus norvegicus
agatcttgggcagtgttcttaacat

SEQ ID NO: 119827 - DNA, 25 bp, Rattus norvegicus
agatcttgtcttctagctgcttgtc

SEQ ID NO: 119828 - DNA, 25 bp, Rattus norvegicus
agatcttgtcttgtagctgcttgtc

SEQ ID NO: 119829 - DNA, 25 bp, Rattus norvegicus
agatcttgtgctacccaaccctaag

SEQ ID NO: 119830 - DNA, 25 bp, Rattus norvegicus
agatcttgtgcttcccaaccctaag

SEQ ID NO: 119831 - DNA, 25 bp, Rattus norvegicus
agatcttgttctcttcatggcataa

SEQ ID NO: 119832 - DNA, 25 bp, Rattus norvegicus
agatcttgttctgttcatggcataa

SEQ ID NO: 119833 - DNA, 25 bp, Rattus norvegicus
agatctttaaaaactccagtggaat

SEQ ID NO: 119834 - DNA, 25 bp, Rattus norvegicus
agatctttaaaatctccagtggaat

SEQ ID NO: 119835 - DNA, 25 bp, Rattus norvegicus
agatctttagctcccatgttggaca

SEQ ID NO: 119836 - DNA, 25 bp, Rattus norvegicus
agatctttagctgccatgttggaca

SEQ ID NO: 119837 - DNA, 25 bp, Rattus norvegicus
agatctttagtcactcattataggt

SEQ ID NO: 119838 - DNA, 25 bp, Rattus norvegicus
agatctttagtctctcattataggt

SEQ ID NO: 119839 - DNA, 25 bp, Rattus norvegicus
agatctttatcacccctttaagctt

SEQ ID NO: 119840 - DNA, 25 bp, Rattus norvegicus
agatctttatcagccctttaagctt

SEQ ID NO: 119841 - DNA, 25 bp, Rattus norvegicus
agatctttatctcgcagtggtacat

SEQ ID NO: 119842 - DNA, 25 bp, Rattus norvegicus
agatctttatctggcagtggtacat

SEQ ID NO: 119843 - DNA, 25 bp, Rattus norvegicus
agatctttatttcccgtgcctatga

SEQ ID NO: 119844 - DNA, 25 bp, Rattus norvegicus
agatctttatttgccgtgcctatga

SEQ ID NO: 119845 - DNA, 25 bp, Rattus norvegicus
agatctttcaacacttcgtcgttat

SEQ ID NO: 119846 - DNA, 25 bp, Rattus norvegicus
agatctttcaactcttcgtcgttat

SEQ ID NO: 119847 - DNA, 25 bp, Rattus norvegicus
agatctttccccacttgtaggacag

SEQ ID NO: 119848 - DNA, 25 bp, Rattus norvegicus
agatctttcccctcttgtaggacag

SEQ ID NO: 119849 - DNA, 25 bp, Rattus norvegicus
agatctttctagagttgtcctggac

SEQ ID NO: 119850 - DNA, 25 bp, Rattus norvegicus
agatctttctagtgttgtcctggac

SEQ ID NO: 119851 - DNA, 25 bp, Rattus norvegicus
agatctttctccaggacgaggacta

SEQ ID NO: 119852 - DNA, 25 bp, Rattus norvegicus
agatctttctcctggacgaggacta

SEQ ID NO: 119853 - DNA, 25 bp, Rattus norvegicus
agatctttctggcagttcttgggaa

SEQ ID NO: 119854 - DNA, 25 bp, Rattus norvegicus
agatctttctgggagttcttgggaa

SEQ ID NO: 119855 - DNA, 25 bp, Rattus norvegicus
agatctttgaacaccattaccccgg

SEQ ID NO: 119856 - DNA, 25 bp, Rattus norvegicus
agatctttgaactccattaccccgg

SEQ ID NO: 119857 - DNA, 25 bp, Rattus norvegicus
agatctttggctagggtggcttctc

SEQ ID NO: 119858 - DNA, 25 bp, Rattus norvegicus
agatctttggcttgggtggcttctc

SEQ ID NO: 119859 - DNA, 25 bp, Rattus norvegicus
agatctttgggactaaatgccagct

SEQ ID NO: 119860 - DNA, 25 bp, Rattus norvegicus
agatctttgggagtaaatgccagct

SEQ ID NO: 119861 - DNA, 25 bp, Rattus norvegicus
agatcttttcctaggtcaggctgtg

SEQ ID NO: 119862 - DNA, 25 bp, Rattus norvegicus
agatcttttccttggtcaggctgtg

SEQ ID NO: 119863 - DNA, 25 bp, Rattus norvegicus
agatcttttgacattatccgtgcaa

SEQ ID NO: 119864 - DNA, 25 bp, Rattus norvegicus
agatcttttgactttatccgtgcaa

SEQ ID NO: 119865 - DNA, 25 bp, Rattus norvegicus
agatcttttttccttcacttattgc

SEQ ID NO: 119866 - DNA, 25 bp, Rattus norvegicus
agatcttttttcgttcacttattgc

SEQ ID NO: 119867 - DNA, 25 bp, Rattus norvegicus
agatgaaaccatccggctgtcagga

SEQ ID NO: 119868 - DNA, 25 bp, Rattus norvegicus
agatgaaaccatgcggctgtcagga

SEQ ID NO: 119869 - DNA, 25 bp, Rattus norvegicus
agatgaaaggccctccatcagtgtc

SEQ ID NO: 119870 - DNA, 25 bp, Rattus norvegicus
agatgaaaggccgtccatcagtgtc

SEQ ID NO: 119871 - DNA, 25 bp, Rattus norvegicus
agatgaaagtaaacactgcggtaat

SEQ ID NO: 119872 - DNA, 25 bp, Rattus norvegicus
agatgaaagtaatcactgcggtaat

SEQ ID NO: 119873 - DNA, 25 bp, Rattus norvegicus
agatgaaatcacactggagaaccca

SEQ ID NO: 119874 - DNA, 25 bp, Rattus norvegicus
agatgaaatcactctggagaaccca

SEQ ID NO: 119875 - DNA, 25 bp, Rattus norvegicus
agatgaacacacagctctgcttcag

SEQ ID NO: 119876 - DNA, 25 bp, Rattus norvegicus
agatgaacacactgctctgcttcag

SEQ ID NO: 119877 - DNA, 25 bp, Rattus norvegicus
agatgaacacctcacttctgggaag

SEQ ID NO: 119878 - DNA, 25 bp, Rattus norvegicus
agatgaacacctgacttctgggaag

SEQ ID NO: 119879 - DNA, 25 bp, Rattus norvegicus
agatgaacctccagtgacttctgtc

SEQ ID NO: 119880 - DNA, 25 bp, Rattus norvegicus
agatgaacctcctgtgacttctgtc

SEQ ID NO: 119881 - DNA, 25 bp, Rattus norvegicus
agatgaacggcccatactccagcaa

SEQ ID NO: 119882 - DNA, 25 bp, Rattus norvegicus
agatgaacggccgatactccagcaa

SEQ ID NO: 119883 - DNA, 25 bp, Rattus norvegicus
agatgaactccacctgaggactcag

SEQ ID NO: 119884 - DNA, 25 bp, Rattus norvegicus
agatgaactccagctgaggactcag

SEQ ID NO: 119885 - DNA, 25 bp, Rattus norvegicus
agatgaactgcccatatccttgtct

SEQ ID NO: 119886 - DNA, 25 bp, Rattus norvegicus
agatgaactgccgatatccttgtct

SEQ ID NO: 119887 - DNA, 25 bp, Rattus norvegicus
agatgaactgtgcacggctgcagct

SEQ ID NO: 119888 - DNA, 25 bp, Rattus norvegicus
agatgaactgtggacggctgcagct

SEQ ID NO: 119889 - DNA, 25 bp, Rattus norvegicus
agatgaagaagtaccggcgggcctt

SEQ ID NO: 119890 - DNA, 25 bp, Rattus norvegicus
agatgaagaagttccggcgggcctt

SEQ ID NO: 119891 - DNA, 25 bp, Rattus norvegicus
agatgaagacatctgctgtggagaa

SEQ ID NO: 119892 - DNA, 25 bp, Rattus norvegicus
agatgaagacatgtgctgtggagaa

SEQ ID NO: 119893 - DNA, 25 bp, Rattus norvegicus
agatgaagactgaactcctccgcct

SEQ ID NO: 119894 - DNA, 25 bp, Rattus norvegicus
agatgaagactgtactcctccgcct

SEQ ID NO: 119895 - DNA, 25 bp, Rattus norvegicus
agatgaagatcaatggagtccatta

SEQ ID NO: 119896 - DNA, 25 bp, Rattus norvegicus
agatgaagatcattggagtccatta

SEQ ID NO: 119897 - DNA, 25 bp, Rattus norvegicus
agatgaagcactctgctgctctcat

SEQ ID NO: 119898 - DNA, 25 bp, Rattus norvegicus
agatgaagcactgtgctgctctcat

SEQ ID NO: 119899 - DNA, 25 bp, Rattus norvegicus
agatgaagcattattgtgtgtgtgt

SEQ ID NO: 119900 - DNA, 25 bp, Rattus norvegicus
agatgaagcatttttgtgtgtgtgt

SEQ ID NO: 119901 - DNA, 25 bp, Rattus norvegicus
agatgaagccaactccggcggcgac

SEQ ID NO: 119902 - DNA, 25 bp, Rattus norvegicus
agatgaagccaagtccggcggcgac

SEQ ID NO: 119903 - DNA, 25 bp, Rattus norvegicus
agatgaagccacaggtcctggttca

SEQ ID NO: 119904 - DNA, 25 bp, Rattus norvegicus
agatgaagccactggtcctggttca

SEQ ID NO: 119905 - DNA, 25 bp, Rattus norvegicus
agatgaagctctctatcctgctcca

SEQ ID NO: 119906 - DNA, 25 bp, Rattus norvegicus
agatgaagctctgtatcctgctcca

SEQ ID NO: 119907 - DNA, 25 bp, Rattus norvegicus
agatgaaggaagattccactgaaga

SEQ ID NO: 119908 - DNA, 25 bp, Rattus norvegicus
agatgaaggaagtttccactgaaga

SEQ ID NO: 119909 - DNA, 25 bp, Rattus norvegicus
agatgaaggcttagacccaggcact

SEQ ID NO: 119910 - DNA, 25 bp, Rattus norvegicus
agatgaaggctttgacccaggcact

SEQ ID NO: 119911 - DNA, 25 bp, Rattus norvegicus
agatgaaggttcactattagcaaaa

SEQ ID NO: 119912 - DNA, 25 bp, Rattus norvegicus
agatgaaggttctctattagcaaaa

SEQ ID NO: 119913 - DNA, 25 bp, Rattus norvegicus
agatgaagtctaccagcttgttcct

SEQ ID NO: 119914 - DNA, 25 bp, Rattus norvegicus
agatgaagtctagcagcttgttcct

SEQ ID NO: 119915 - DNA, 25 bp, Rattus norvegicus
agatgaagtcttctaagcggttaaa

SEQ ID NO: 119916 - DNA, 25 bp, Rattus norvegicus
agatgaagtcttgtaagcggttaaa

SEQ ID NO: 119917 - DNA, 25 bp, Rattus norvegicus
agatgaataatgacgggcgctctgc

SEQ ID NO: 119918 - DNA, 25 bp, Rattus norvegicus
agatgaataatgtcgggcgctctgc

SEQ ID NO: 119919 - DNA, 25 bp, Rattus norvegicus
agatgaattccaaggccagctctac

SEQ ID NO: 119920 - DNA, 25 bp, Rattus norvegicus
agatgaattccatggccagctctac

SEQ ID NO: 119921 - DNA, 25 bp, Rattus norvegicus
agatgaattctgctttaaacctaaa

SEQ ID NO: 119922 - DNA, 25 bp, Rattus norvegicus
agatgaattctggtttaaacctaaa

SEQ ID NO: 119923 - DNA, 25 bp, Rattus norvegicus
agatgacaaaggacccctctacctt

SEQ ID NO: 119924 - DNA, 25 bp, Rattus norvegicus
agatgacaaaggtcccctctacctt

SEQ ID NO: 119925 - DNA, 25 bp, Rattus norvegicus
agatgacaacggctgtttccctctg

SEQ ID NO: 119926 - DNA, 25 bp, Rattus norvegicus
agatgacaacgggtgtttccctctg

SEQ ID NO: 119927 - DNA, 25 bp, Rattus norvegicus
agatgacaagctattccactgtagt

SEQ ID NO: 119928 - DNA, 25 bp, Rattus norvegicus
agatgacaagcttttccactgtagt

SEQ ID NO: 119929 - DNA, 25 bp, Rattus norvegicus
agatgacaattcagtgggtcccctg

SEQ ID NO: 119930 - DNA, 25 bp, Rattus norvegicus
agatgacaattctgtgggtcccctg

SEQ ID NO: 119931 - DNA, 25 bp, Rattus norvegicus
agatgacaccaccatgtggcagtgg

SEQ ID NO: 119932 - DNA, 25 bp, Rattus norvegicus
agatgacaccacgatgtggcagtgg

SEQ ID NO: 119933 - DNA, 25 bp, Rattus norvegicus
agatgacaccctagatccgctgtga

SEQ ID NO: 119934 - DNA, 25 bp, Rattus norvegicus
agatgacacccttgatccgctgtga

SEQ ID NO: 119935 - DNA, 25 bp, Rattus norvegicus
agatgacacgcgcattgtaaccttc

SEQ ID NO: 119936 - DNA, 25 bp, Rattus norvegicus
agatgacacgcggattgtaaccttc

SEQ ID NO: 119937 - DNA, 25 bp, Rattus norvegicus
agatgacacgtccttactcattgac

SEQ ID NO: 119938 - DNA, 25 bp, Rattus norvegicus
agatgacacgtcgttactcattgac

SEQ ID NO: 119939 - DNA, 25 bp, Rattus norvegicus
agatgacactctaggcattgcctga

SEQ ID NO: 119940 - DNA, 25 bp, Rattus norvegicus
agatgacactcttggcattgcctga

SEQ ID NO: 119941 - DNA, 25 bp, Rattus norvegicus
agatgacactttcaggtccttctgc

SEQ ID NO: 119942 - DNA, 25 bp, Rattus norvegicus
agatgacactttgaggtccttctgc

SEQ ID NO: 119943 - DNA, 25 bp, Rattus norvegicus
agatgacagaaaccactctcgccct

SEQ ID NO: 119944 - DNA, 25 bp, Rattus norvegicus
agatgacagaaagcactctcgccct

SEQ ID NO: 119945 - DNA, 25 bp, Rattus norvegicus
agatgacagaagagccagaccaaaa

SEQ ID NO: 119946 - DNA, 25 bp, Rattus norvegicus
agatgacagaagtgccagaccaaaa

SEQ ID NO: 119947 - DNA, 25 bp, Rattus norvegicus
agatgacagaggatccctcggcagg

SEQ ID NO: 119948 - DNA, 25 bp, Rattus norvegicus
agatgacagaggttccctcggcagg

SEQ ID NO: 119949 - DNA, 25 bp, Rattus norvegicus
agatgacagcatacttgactccctc

SEQ ID NO: 119950 - DNA, 25 bp, Rattus norvegicus
agatgacagcattcttgactccctc

SEQ ID NO: 119951 - DNA, 25 bp, Rattus norvegicus
agatgacagccgcacttctggactg

SEQ ID NO: 119952 - DNA, 25 bp, Rattus norvegicus
agatgacagccggacttctggactg

SEQ ID NO: 119953 - DNA, 25 bp, Rattus norvegicus
agatgacagcctactacttgtccat

SEQ ID NO: 119954 - DNA, 25 bp, Rattus norvegicus
agatgacagccttctacttgtccat

SEQ ID NO: 119955 - DNA, 25 bp, Rattus norvegicus
agatgacagcggactgctccagagg

SEQ ID NO: 119956 - DNA, 25 bp, Rattus norvegicus
agatgacagcggtctgctccagagg

SEQ ID NO: 119957 - DNA, 25 bp, Rattus norvegicus
agatgacaggatagggtttgcccat

SEQ ID NO: 119958 - DNA, 25 bp, Rattus norvegicus
agatgacaggattgggtttgcccat

SEQ ID NO: 119959 - DNA, 25 bp, Rattus norvegicus
agatgacaggtcacatgctctcagg

SEQ ID NO: 119960 - DNA, 25 bp, Rattus norvegicus
agatgacaggtctcatgctctcagg

SEQ ID NO: 119961 - DNA, 25 bp, Rattus norvegicus
agatgacagtgcaagctgacagctt

SEQ ID NO: 119962 - DNA, 25 bp, Rattus norvegicus
agatgacagtgctagctgacagctt

SEQ ID NO: 119963 - DNA, 25 bp, Rattus norvegicus
agatgacagtggaggttcgtcccgc

SEQ ID NO: 119964 - DNA, 25 bp, Rattus norvegicus
agatgacagtggtggttcgtcccgc

SEQ ID NO: 119965 - DNA, 25 bp, Rattus norvegicus
agatgacatcatcccatttgcaaaa

SEQ ID NO: 119966 - DNA, 25 bp, Rattus norvegicus
agatgacatcatgccatttgcaaaa

SEQ ID NO: 119967 - DNA, 25 bp, Rattus norvegicus
agatgacatcttactggttttgatt

SEQ ID NO: 119968 - DNA, 25 bp, Rattus norvegicus
agatgacatctttctggttttgatt

SEQ ID NO: 119969 - DNA, 25 bp, Rattus norvegicus
agatgaccacaacccctgtggtgct

SEQ ID NO: 119970 - DNA, 25 bp, Rattus norvegicus
agatgaccacaagccctgtggtgct

SEQ ID NO: 119971 - DNA, 25 bp, Rattus norvegicus
agatgaccagaaccttagtcccttc

SEQ ID NO: 119972 - DNA, 25 bp, Rattus norvegicus
agatgaccagaagcttagtcccttc

SEQ ID NO: 119973 - DNA, 25 bp, Rattus norvegicus
agatgaccaggcactaactgtctct

SEQ ID NO: 119974 - DNA, 25 bp, Rattus norvegicus
agatgaccaggcctgctgagacttc

SEQ ID NO: 119975 - DNA, 25 bp, Rattus norvegicus
agatgaccaggcgtgctgagacttc

SEQ ID NO: 119976 - DNA, 25 bp, Rattus norvegicus
agatgaccaggctctaactgtctct

SEQ ID NO: 119977 - DNA, 25 bp, Rattus norvegicus
agatgaccagtcagagggagcagca

SEQ ID NO: 119978 - DNA, 25 bp, Rattus norvegicus
agatgaccagtctgagggagcagca

SEQ ID NO: 119979 - DNA, 25 bp, Rattus norvegicus
agatgaccatcacatggcacctggg

SEQ ID NO: 119980 - DNA, 25 bp, Rattus norvegicus
agatgaccatcagatggcacctggg

SEQ ID NO: 119981 - DNA, 25 bp, Rattus norvegicus
agatgaccatctcactcttgggtgg

SEQ ID NO: 119982 - DNA, 25 bp, Rattus norvegicus
agatgaccatctgactcttgggtgg

SEQ ID NO: 119983 - DNA, 25 bp, Rattus norvegicus
agatgaccgggcagcagtcctgacc

SEQ ID NO: 119984 - DNA, 25 bp, Rattus norvegicus
agatgaccgggctgcagtcctgacc

SEQ ID NO: 119985 - DNA, 25 bp, Rattus norvegicus
agatgaccgtccagatgcaactcct

SEQ ID NO: 119986 - DNA, 25 bp, Rattus norvegicus
agatgaccgtcctgatgcaactcct

SEQ ID NO: 119987 - DNA, 25 bp, Rattus norvegicus
agatgacctagaatagccatgtaat

SEQ ID NO: 119988 - DNA, 25 bp, Rattus norvegicus
agatgacctagattagccatgtaat

SEQ ID NO: 119989 - DNA, 25 bp, Rattus norvegicus
agatgacctcttaacaatggcttca

SEQ ID NO: 119990 - DNA, 25 bp, Rattus norvegicus
agatgacctctttacaatggcttca

SEQ ID NO: 119991 - DNA, 25 bp, Rattus norvegicus
agatgacctgaccacaccacacaag

SEQ ID NO: 119992 - DNA, 25 bp, Rattus norvegicus
agatgacctgacgacaccacacaag

SEQ ID NO: 119993 - DNA, 25 bp, Rattus norvegicus
agatgacctgccacagaccatgttt

SEQ ID NO: 119994 - DNA, 25 bp, Rattus norvegicus
agatgacctgcctcagaccatgttt

SEQ ID NO: 119995 - DNA, 25 bp, Rattus norvegicus
agatgacctggtcaagatgctcttc

SEQ ID NO: 119996 - DNA, 25 bp, Rattus norvegicus
agatgacctggtgaagatgctcttc

SEQ ID NO: 119997 - DNA, 25 bp, Rattus norvegicus
agatgacctgtactccggctggctg

SEQ ID NO: 119998 - DNA, 25 bp, Rattus norvegicus
agatgacctgtagtccggctggctg

SEQ ID NO: 119999 - DNA, 25 bp, Rattus norvegicus
agatgaccttgacctggttcccttg

SEQ ID NO: 120000 - DNA, 25 bp, Rattus norvegicus
agatgaccttgagctggttcccttg

SEQ ID NO: 120001 - DNA, 25 bp, Rattus norvegicus
agatgaccttgcatccaaagccaat

SEQ ID NO: 120002 - DNA, 25 bp, Rattus norvegicus
agatgaccttgcttccaaagccaat

SEQ ID NO: 120003 - DNA, 25 bp, Rattus norvegicus
agatgaccttgtctccttcaggaga

SEQ ID NO: 120004 - DNA, 25 bp, Rattus norvegicus
agatgaccttgtgtccttcaggaga

SEQ ID NO: 120005 - DNA, 25 bp, Rattus norvegicus
agatgacgaccacgacaccgaagcc

SEQ ID NO: 120006 - DNA, 25 bp, Rattus norvegicus
agatgacgaccaggacaccgaagcc

SEQ ID NO: 120007 - DNA, 25 bp, Rattus norvegicus
agatgacgaccgctccttaataaac

SEQ ID NO: 120008 - DNA, 25 bp, Rattus norvegicus
agatgacgaccggtccttaataaac

SEQ ID NO: 120009 - DNA, 25 bp, Rattus norvegicus
agatgacgacgcctctgtcactagg

SEQ ID NO: 120010 - DNA, 25 bp, Rattus norvegicus
agatgacgacgcgtctgtcactagg

SEQ ID NO: 120011 - DNA, 25 bp, Rattus norvegicus
agatgacgcaaaattaccctccggc

SEQ ID NO: 120012 - DNA, 25 bp, Rattus norvegicus
agatgacgcaaatttaccctccggc

SEQ ID NO: 120013 - DNA, 25 bp, Rattus norvegicus
agatgacgcctgaacagctggcaat

SEQ ID NO: 120014 - DNA, 25 bp, Rattus norvegicus
agatgacgcctgtacagctggcaat

SEQ ID NO: 120015 - DNA, 25 bp, Rattus norvegicus
agatgacggagtactagtggccctg

SEQ ID NO: 120016 - DNA, 25 bp, Rattus norvegicus
agatgacggagttctagtggccctg

SEQ ID NO: 120017 - DNA, 25 bp, Rattus norvegicus
agatgacgggacagaaacacacttc

SEQ ID NO: 120018 - DNA, 25 bp, Rattus norvegicus
agatgacgggactgaaacacacttc

SEQ ID NO: 120019 - DNA, 25 bp, Rattus norvegicus
agatgactatgacgtgagctgccct

SEQ ID NO: 120020 - DNA, 25 bp, Rattus norvegicus
agatgactatgaggtgagctgccct

SEQ ID NO: 120021 - DNA, 25 bp, Rattus norvegicus
agatgactccaacagaaacccaagt

SEQ ID NO: 120022 - DNA, 25 bp, Rattus norvegicus
agatgactccaagagaaacccaagt

SEQ ID NO: 120023 - DNA, 25 bp, Rattus norvegicus
agatgactccacagccaggagcact

SEQ ID NO: 120024 - DNA, 25 bp, Rattus norvegicus
agatgactccactgccaggagcact

SEQ ID NO: 120025 - DNA, 25 bp, Rattus norvegicus
agatgactcccaattttattccctt

SEQ ID NO: 120026 - DNA, 25 bp, Rattus norvegicus
agatgactcccatttttattccctt

SEQ ID NO: 120027 - DNA, 25 bp, Rattus norvegicus
agatgactccgtcatcaaactctca

SEQ ID NO: 120028 - DNA, 25 bp, Rattus norvegicus
agatgactccgtgatcaaactctca

SEQ ID NO: 120029 - DNA, 25 bp, Rattus norvegicus
agatgactcggaatctccaggactc

SEQ ID NO: 120030 - DNA, 25 bp, Rattus norvegicus
agatgactcggattctccaggactc

SEQ ID NO: 120031 - DNA, 25 bp, Rattus norvegicus
agatgactctcacacaacaccggtg

SEQ ID NO: 120032 - DNA, 25 bp, Rattus norvegicus
agatgactctcagacaacaccggtg

SEQ ID NO: 120033 - DNA, 25 bp, Rattus norvegicus
agatgactcttaatggcaaacctgc

SEQ ID NO: 120034 - DNA, 25 bp, Rattus norvegicus
agatgactcttattggcaaacctgc

SEQ ID NO: 120035 - DNA, 25 bp, Rattus norvegicus
agatgactcttcaatccagggtgcc

SEQ ID NO: 120036 - DNA, 25 bp, Rattus norvegicus
agatgactcttctatccagggtgcc

SEQ ID NO: 120037 - DNA, 25 bp, Rattus norvegicus
agatgactgcaacccaaggacgctg

SEQ ID NO: 120038 - DNA, 25 bp, Rattus norvegicus
agatgactgcaagccaaggacgctg

SEQ ID NO: 120039 - DNA, 25 bp, Rattus norvegicus
agatgactgcagcaccaaggtaggt

SEQ ID NO: 120040 - DNA, 25 bp, Rattus norvegicus
agatgactgcaggaccaaggtaggt

SEQ ID NO: 120041 - DNA, 25 bp, Rattus norvegicus
agatgacttcatatccccataagga

SEQ ID NO: 120042 - DNA, 25 bp, Rattus norvegicus
agatgacttcatttccccataagga

SEQ ID NO: 120043 - DNA, 25 bp, Rattus norvegicus
agatgacttcccagggtttggtgat

SEQ ID NO: 120044 - DNA, 25 bp, Rattus norvegicus
agatgacttccctgggtttggtgat

SEQ ID NO: 120045 - DNA, 25 bp, Rattus norvegicus
agatgacttctgatgtagactcaca

SEQ ID NO: 120046 - DNA, 25 bp, Rattus norvegicus
agatgacttctgttgtagactcaca

SEQ ID NO: 120047 - DNA, 25 bp, Rattus norvegicus
agatgagaaccacccgcaaggtttc

SEQ ID NO: 120048 - DNA, 25 bp, Rattus norvegicus
agatgagaaccagccgcaaggtttc

SEQ ID NO: 120049 - DNA, 25 bp, Rattus norvegicus
agatgagaaccgagccttgtggcct

SEQ ID NO: 120050 - DNA, 25 bp, Rattus norvegicus
agatgagaaccgtgccttgtggcct

SEQ ID NO: 120051 - DNA, 25 bp, Rattus norvegicus
agatgagaactccttgcacaagacc

SEQ ID NO: 120052 - DNA, 25 bp, Rattus norvegicus
agatgagaactcgttgcacaagacc

SEQ ID NO: 120053 - DNA, 25 bp, Rattus norvegicus
agatgagaagcactcagcgtccgag

SEQ ID NO: 120054 - DNA, 25 bp, Rattus norvegicus
agatgagaagcagtcagcgtccgag

SEQ ID NO: 120055 - DNA, 25 bp, Rattus norvegicus
agatgagaagccaacctgcatctgt

SEQ ID NO: 120056 - DNA, 25 bp, Rattus norvegicus
agatgagaagcctacctgcatctgt

SEQ ID NO: 120057 - DNA, 25 bp, Rattus norvegicus
agatgagactaaatcttgccccttg

SEQ ID NO: 120058 - DNA, 25 bp, Rattus norvegicus
agatgagactaattcttgccccttg

SEQ ID NO: 120059 - DNA, 25 bp, Rattus norvegicus
agatgagactgtatgcctcgtgcta

SEQ ID NO: 120060 - DNA, 25 bp, Rattus norvegicus
agatgagactgtttgcctcgtgcta

SEQ ID NO: 120061 - DNA, 25 bp, Rattus norvegicus
agatgagagcggagcagcctgtccc

SEQ ID NO: 120062 - DNA, 25 bp, Rattus norvegicus
agatgagagcggtgcagcctgtccc

SEQ ID NO: 120063 - DNA, 25 bp, Rattus norvegicus
agatgagatcatccctatcttggaa

SEQ ID NO: 120064 - DNA, 25 bp, Rattus norvegicus
agatgagatcatgcctatcttggaa

SEQ ID NO: 120065 - DNA, 25 bp, Rattus norvegicus
agatgagattctaggacagcagtgg

SEQ ID NO: 120066 - DNA, 25 bp, Rattus norvegicus
agatgagattcttggacagcagtgg

SEQ ID NO: 120067 - DNA, 25 bp, Rattus norvegicus
agatgagattgtcagtcagcccctt

SEQ ID NO: 120068 - DNA, 25 bp, Rattus norvegicus
agatgagattgtgagtcagcccctt

SEQ ID NO: 120069 - DNA, 25 bp, Rattus norvegicus
agatgagcaaccctgcggttcccaa

SEQ ID NO: 120070 - DNA, 25 bp, Rattus norvegicus
agatgagcaaccgtgcggttcccaa

SEQ ID NO: 120071 - DNA, 25 bp, Rattus norvegicus
agatgagcaagcaggaacccgcttc

SEQ ID NO: 120072 - DNA, 25 bp, Rattus norvegicus
agatgagcaagctggaacccgcttc

SEQ ID NO: 120073 - DNA, 25 bp, Rattus norvegicus
agatgagcacttcctggtcggccaa

SEQ ID NO: 120074 - DNA, 25 bp, Rattus norvegicus
agatgagcacttgctggtcggccaa

SEQ ID NO: 120075 - DNA, 25 bp, Rattus norvegicus
agatgagcagatccctcaccttagg

SEQ ID NO: 120076 - DNA, 25 bp, Rattus norvegicus
agatgagcagatgcctcaccttagg

SEQ ID NO: 120077 - DNA, 25 bp, Rattus norvegicus
agatgagcaggcatgttcctcgtcc

SEQ ID NO: 120078 - DNA, 25 bp, Rattus norvegicus
agatgagcaggcttgttcctcgtcc

SEQ ID NO: 120079 - DNA, 25 bp, Rattus norvegicus
agatgagcaggtattccaccagcta

SEQ ID NO: 120080 - DNA, 25 bp, Rattus norvegicus
agatgagcaggttttccaccagcta

SEQ ID NO: 120081 - DNA, 25 bp, Rattus norvegicus
agatgagccagcagttcaggctcct

SEQ ID NO: 120082 - DNA, 25 bp, Rattus norvegicus
agatgagccagctgttcaggctcct

SEQ ID NO: 120083 - DNA, 25 bp, Rattus norvegicus
agatgagccatcagttctgcagctg

SEQ ID NO: 120084 - DNA, 25 bp, Rattus norvegicus
agatgagccatctgttctgcagctg

SEQ ID NO: 120085 - DNA, 25 bp, Rattus norvegicus
agatgagccgttactaacacccacg

SEQ ID NO: 120086 - DNA, 25 bp, Rattus norvegicus
agatgagccgtttctaacacccacg

SEQ ID NO: 120087 - DNA, 25 bp, Rattus norvegicus
agatgagcctccctcgtacgaggag

SEQ ID NO: 120088 - DNA, 25 bp, Rattus norvegicus
agatgagcctccgtcgtacgaggag

SEQ ID NO: 120089 - DNA, 25 bp, Rattus norvegicus
agatgagcctgtccatgaggaactc

SEQ ID NO: 120090 - DNA, 25 bp, Rattus norvegicus
agatgagcctgtgcatgaggaactc

SEQ ID NO: 120091 - DNA, 25 bp, Rattus norvegicus
agatgagcgcccactgctggcagta

SEQ ID NO: 120092 - DNA, 25 bp, Rattus norvegicus
agatgagcgccctctgctggcagta

SEQ ID NO: 120093 - DNA, 25 bp, Rattus norvegicus
agatgagcggctacggatcaattcg

SEQ ID NO: 120094 - DNA, 25 bp, Rattus norvegicus
agatgagcggcttcggatcaattcg

SEQ ID NO: 120095 - DNA, 25 bp, Rattus norvegicus
agatgagctatcctagcctcctctt

SEQ ID NO: 120096 - DNA, 25 bp, Rattus norvegicus
agatgagctatcgtagcctcctctt

SEQ ID NO: 120097 - DNA, 25 bp, Rattus norvegicus
agatgagctcaacaggatttcccct

SEQ ID NO: 120098 - DNA, 25 bp, Rattus norvegicus
agatgagctcaagaggatttcccct

SEQ ID NO: 120099 - DNA, 25 bp, Rattus norvegicus
agatgagctcacagtgccccgatac

SEQ ID NO: 120100 - DNA, 25 bp, Rattus norvegicus
agatgagctcactgtgccccgatac

SEQ ID NO: 120101 - DNA, 25 bp, Rattus norvegicus
agatgagctcatcgcgtttaaccca

SEQ ID NO: 120102 - DNA, 25 bp, Rattus norvegicus
agatgagctcatggcgtttaaccca

SEQ ID NO: 120103 - DNA, 25 bp, Rattus norvegicus
agatgagctgccctatctcaagtgt

SEQ ID NO: 120104 - DNA, 25 bp, Rattus norvegicus
agatgagctgccgtatctcaagtgt

SEQ ID NO: 120105 - DNA, 25 bp, Rattus norvegicus
agatgagctggccattgcctctcaa

SEQ ID NO: 120106 - DNA, 25 bp, Rattus norvegicus
agatgagctggcgattgcctctcaa

SEQ ID NO: 120107 - DNA, 25 bp, Rattus norvegicus
agatgagctgtcacaccttggaggt

SEQ ID NO: 120108 - DNA, 25 bp, Rattus norvegicus
agatgagctgtctcaccttggaggt

SEQ ID NO: 120109 - DNA, 25 bp, Rattus norvegicus
agatgaggacgcaacactggcccat

SEQ ID NO: 120110 - DNA, 25 bp, Rattus norvegicus
agatgaggacgctacactggcccat

SEQ ID NO: 120111 - DNA, 25 bp, Rattus norvegicus
agatgaggagcaccccttgaagcta

SEQ ID NO: 120112 - DNA, 25 bp, Rattus norvegicus
agatgaggagcagcccttgaagcta

SEQ ID NO: 120113 - DNA, 25 bp, Rattus norvegicus
agatgaggcagaccacctgtgcaat

SEQ ID NO: 120114 - DNA, 25 bp, Rattus norvegicus
agatgaggcagagcacctgtgcaat

SEQ ID NO: 120115 - DNA, 25 bp, Rattus norvegicus
agatgaggcatcaggctgcctgtta

SEQ ID NO: 120116 - DNA, 25 bp, Rattus norvegicus
agatgaggcatctggctgcctgtta

SEQ ID NO: 120117 - DNA, 25 bp, Rattus norvegicus
agatgaggccaaacactaagactaa

SEQ ID NO: 120118 - DNA, 25 bp, Rattus norvegicus
agatgaggccaatcactaagactaa

SEQ ID NO: 120119 - DNA, 25 bp, Rattus norvegicus
agatgaggccatcacagttctctgg

SEQ ID NO: 120120 - DNA, 25 bp, Rattus norvegicus
agatgaggccatgacagttctctgg

SEQ ID NO: 120121 - DNA, 25 bp, Rattus norvegicus
agatgaggcctcaatgcgtcgagac

SEQ ID NO: 120122 - DNA, 25 bp, Rattus norvegicus
agatgaggcctctatgcgtcgagac

SEQ ID NO: 120123 - DNA, 25 bp, Rattus norvegicus
agatgaggccttcactctatgctct

SEQ ID NO: 120124 - DNA, 25 bp, Rattus norvegicus
agatgaggccttgactctatgctct

SEQ ID NO: 120125 - DNA, 25 bp, Rattus norvegicus
agatgaggcgtgacctttccaagct

SEQ ID NO: 120126 - DNA, 25 bp, Rattus norvegicus
agatgaggcgtgtcctttccaagct

SEQ ID NO: 120127 - DNA, 25 bp, Rattus norvegicus
agatgagggactaccgttggtctgt

SEQ ID NO: 120128 - DNA, 25 bp, Rattus norvegicus
agatgagggacttccgttggtctgt

SEQ ID NO: 120129 - DNA, 25 bp, Rattus norvegicus
agatgagggatcatccatgtcgacc

SEQ ID NO: 120130 - DNA, 25 bp, Rattus norvegicus
agatgagggatcttccatgtcgacc

SEQ ID NO: 120131 - DNA, 25 bp, Rattus norvegicus
agatgagggcacattcttctggtca

SEQ ID NO: 120132 - DNA, 25 bp, Rattus norvegicus
agatgagggcactttcttctggtca

SEQ ID NO: 120133 - DNA, 25 bp, Rattus norvegicus
agatgagggcatatcaccaaagtga

SEQ ID NO: 120134 - DNA, 25 bp, Rattus norvegicus
agatgagggcatttcaccaaagtga

SEQ ID NO: 120135 - DNA, 25 bp, Rattus norvegicus
agatgaggtcttcacagggcttcgc

SEQ ID NO: 120136 - DNA, 25 bp, Rattus norvegicus
agatgaggtcttcttcgtctgtaca

SEQ ID NO: 120137 - DNA, 25 bp, Rattus norvegicus
agatgaggtcttgacagggcttcgc

SEQ ID NO: 120138 - DNA, 25 bp, Rattus norvegicus
agatgaggtcttgttcgtctgtaca

SEQ ID NO: 120139 - DNA, 25 bp, Rattus norvegicus
agatgagtaaccaggtggcctccca

SEQ ID NO: 120140 - DNA, 25 bp, Rattus norvegicus
agatgagtaacctggtggcctccca

SEQ ID NO: 120141 - DNA, 25 bp, Rattus norvegicus
agatgagtaagccagctgccccagc

SEQ ID NO: 120142 - DNA, 25 bp, Rattus norvegicus
agatgagtaagcgagctgccccagc

SEQ ID NO: 120143 - DNA, 25 bp, Rattus norvegicus
agatgagtactaaatccgtccccat

SEQ ID NO: 120144 - DNA, 25 bp, Rattus norvegicus
agatgagtactatatccgtccccat

SEQ ID NO: 120145 - DNA, 25 bp, Rattus norvegicus
agatgagtctgtaagcgggtttcca

SEQ ID NO: 120146 - DNA, 25 bp, Rattus norvegicus
agatgagtctgttagcgggtttcca

SEQ ID NO: 120147 - DNA, 25 bp, Rattus norvegicus
agatgagtgagtcaaccaggtgcca

SEQ ID NO: 120148 - DNA, 25 bp, Rattus norvegicus
agatgagtgagtgaaccaggtgcca

SEQ ID NO: 120149 - DNA, 25 bp, Rattus norvegicus
agatgagtggtcatatctcttccct

SEQ ID NO: 120150 - DNA, 25 bp, Rattus norvegicus
agatgagtggtcttatctcttccct

SEQ ID NO: 120151 - DNA, 25 bp, Rattus norvegicus
agatgagtgtacatggagcctcctg

SEQ ID NO: 120152 - DNA, 25 bp, Rattus norvegicus
agatgagtgtacttggagcctcctg

SEQ ID NO: 120153 - DNA, 25 bp, Rattus norvegicus
agatgagtgtccacgaggtctccga

SEQ ID NO: 120154 - DNA, 25 bp, Rattus norvegicus
agatgagtgtcctcgaggtctccga

SEQ ID NO: 120155 - DNA, 25 bp, Rattus norvegicus
agatgagtgtgaacgtcccaggcat

SEQ ID NO: 120156 - DNA, 25 bp, Rattus norvegicus
agatgagtgtgatcgtcccaggcat

SEQ ID NO: 120157 - DNA, 25 bp, Rattus norvegicus
agatgagtgtgcctgtagccccagc

SEQ ID NO: 120158 - DNA, 25 bp, Rattus norvegicus
agatgagtgtgcgtgtagccccagc

SEQ ID NO: 120159 - DNA, 25 bp, Rattus norvegicus
agatgagttggaagccattggcacc

SEQ ID NO: 120160 - DNA, 25 bp, Rattus norvegicus
agatgagttggatgccattggcacc

SEQ ID NO: 120161 - DNA, 25 bp, Rattus norvegicus
agatgagttgtcacggcaccgacga

SEQ ID NO: 120162 - DNA, 25 bp, Rattus norvegicus
agatgagttgtctcggcaccgacga

SEQ ID NO: 120163 - DNA, 25 bp, Rattus norvegicus
agatgagtttgcagtcgcgctcgac

SEQ ID NO: 120164 - DNA, 25 bp, Rattus norvegicus
agatgagtttgctgtcgcgctcgac

SEQ ID NO: 120165 - DNA, 25 bp, Rattus norvegicus
agatgataccttactacactcctgc

SEQ ID NO: 120166 - DNA, 25 bp, Rattus norvegicus
agatgatacctttctacactcctgc

SEQ ID NO: 120167 - DNA, 25 bp, Rattus norvegicus
agatgatagactcagctgggctttc

SEQ ID NO: 120168 - DNA, 25 bp, Rattus norvegicus
agatgatagactgagctgggctttc

SEQ ID NO: 120169 - DNA, 25 bp, Rattus norvegicus
agatgatagtaccacaagccccaga

SEQ ID NO: 120170 - DNA, 25 bp, Rattus norvegicus
agatgatagtacgacaagccccaga

SEQ ID NO: 120171 - DNA, 25 bp, Rattus norvegicus
agatgatattctccccaccacagcg

SEQ ID NO: 120172 - DNA, 25 bp, Rattus norvegicus
agatgatattctgcccaccacagcg

SEQ ID NO: 120173 - DNA, 25 bp, Rattus norvegicus
agatgatattttctcctctggcctc

SEQ ID NO: 120174 - DNA, 25 bp, Rattus norvegicus
agatgatattttgtcctctggcctc

SEQ ID NO: 120175 - DNA, 25 bp, Rattus norvegicus
agatgatccggcacttgatgacctt

SEQ ID NO: 120176 - DNA, 25 bp, Rattus norvegicus
agatgatccggctcttgatgacctt

SEQ ID NO: 120177 - DNA, 25 bp, Rattus norvegicus
agatgatccgtgctgtcaggcttgc

SEQ ID NO: 120178 - DNA, 25 bp, Rattus norvegicus
agatgatccgtggtgtcaggcttgc

SEQ ID NO: 120179 - DNA, 25 bp, Rattus norvegicus
agatgatcggccactacctgggcga

SEQ ID NO: 120180 - DNA, 25 bp, Rattus norvegicus
agatgatcggcctctacctgggcga

SEQ ID NO: 120181 - DNA, 25 bp, Rattus norvegicus
agatgatctattattctcccatgat

SEQ ID NO: 120182 - DNA, 25 bp, Rattus norvegicus
agatgatctatttttctcccatgat

SEQ ID NO: 120183 - DNA, 25 bp, Rattus norvegicus
agatgatctccaattgataaccact

SEQ ID NO: 120184 - DNA, 25 bp, Rattus norvegicus
agatgatctccatttgataaccact

SEQ ID NO: 120185 - DNA, 25 bp, Rattus norvegicus
agatgatctgacatctgtccatcac

SEQ ID NO: 120186 - DNA, 25 bp, Rattus norvegicus
agatgatctgacttctgtccatcac

SEQ ID NO: 120187 - DNA, 25 bp, Rattus norvegicus
agatgatgacctcagctggacagaa

SEQ ID NO: 120188 - DNA, 25 bp, Rattus norvegicus
agatgatgacctcttgcctgaacaa

SEQ ID NO: 120189 - DNA, 25 bp, Rattus norvegicus
agatgatgacctgagctggacagaa

SEQ ID NO: 120190 - DNA, 25 bp, Rattus norvegicus
agatgatgacctgttgcctgaacaa

SEQ ID NO: 120191 - DNA, 25 bp, Rattus norvegicus
agatgatgatgaatggtgccccaaa

SEQ ID NO: 120192 - DNA, 25 bp, Rattus norvegicus
agatgatgatgattggtgccccaaa

SEQ ID NO: 120193 - DNA, 25 bp, Rattus norvegicus
agatgatgattacaccctccaagga

SEQ ID NO: 120194 - DNA, 25 bp, Rattus norvegicus
agatgatgattagaccctccaagga

SEQ ID NO: 120195 - DNA, 25 bp, Rattus norvegicus
agatgatgcaaaacttcgcaagaat

SEQ ID NO: 120196 - DNA, 25 bp, Rattus norvegicus
agatgatgcaaatcttcgcaagaat

SEQ ID NO: 120197 - DNA, 25 bp, Rattus norvegicus
agatgatgcagaaccacatcccgtg

SEQ ID NO: 120198 - DNA, 25 bp, Rattus norvegicus
agatgatgcagatccacatcccgtg

SEQ ID NO: 120199 - DNA, 25 bp, Rattus norvegicus
agatgatggctcagcaagggctgat

SEQ ID NO: 120200 - DNA, 25 bp, Rattus norvegicus
agatgatggctccttttgctgttat

SEQ ID NO: 120201 - DNA, 25 bp, Rattus norvegicus
agatgatggctcgttttgctgttat

SEQ ID NO: 120202 - DNA, 25 bp, Rattus norvegicus
agatgatggctctgcaagggctgat

SEQ ID NO: 120203 - DNA, 25 bp, Rattus norvegicus
agatgatggtgtcgccggtcttccc

SEQ ID NO: 120204 - DNA, 25 bp, Rattus norvegicus
agatgatggtgtggccggtcttccc

SEQ ID NO: 120205 - DNA, 25 bp, Rattus norvegicus
agatgatgttcccattgtccaggat

SEQ ID NO: 120206 - DNA, 25 bp, Rattus norvegicus
agatgatgttccgattgtccaggat

SEQ ID NO: 120207 - DNA, 25 bp, Rattus norvegicus
agatgatgttggcactccactggga

SEQ ID NO: 120208 - DNA, 25 bp, Rattus norvegicus
agatgatgttgggactccactggga

SEQ ID NO: 120209 - DNA, 25 bp, Rattus norvegicus
agatgattagtgatgctttcttcta

SEQ ID NO: 120210 - DNA, 25 bp, Rattus norvegicus
agatgattagtgttgctttcttcta

SEQ ID NO: 120211 - DNA, 25 bp, Rattus norvegicus
agatgattcataaccacccacaact

SEQ ID NO: 120212 - DNA, 25 bp, Rattus norvegicus
agatgattcatatccacccacaact

SEQ ID NO: 120213 - DNA, 25 bp, Rattus norvegicus
agatgattgtctcagcctcggccaa

SEQ ID NO: 120214 - DNA, 25 bp, Rattus norvegicus
agatgattgtctgagcctcggccaa

SEQ ID NO: 120215 - DNA, 25 bp, Rattus norvegicus
agatgatttatcaccctgctgtaaa

SEQ ID NO: 120216 - DNA, 25 bp, Rattus norvegicus
agatgatttatctccctgctgtaaa

SEQ ID NO: 120217 - DNA, 25 bp, Rattus norvegicus
agatgatttcatagctttgggaaac

SEQ ID NO: 120218 - DNA, 25 bp, Rattus norvegicus
agatgatttcattgctttgggaaac

SEQ ID NO: 120219 - DNA, 25 bp, Rattus norvegicus
agatgcaaacttcgcctgcggaaac

SEQ ID NO: 120220 - DNA, 25 bp, Rattus norvegicus
agatgcaaacttggcctgcggaaac

SEQ ID NO: 120221 - DNA, 25 bp, Rattus norvegicus
agatgcaaagtccagccctgtgtac

SEQ ID NO: 120222 - DNA, 25 bp, Rattus norvegicus
agatgcaaagtcgagccctgtgtac

SEQ ID NO: 120223 - DNA, 25 bp, Rattus norvegicus
agatgcaatcccagcactgtcaaga

SEQ ID NO: 120224 - DNA, 25 bp, Rattus norvegicus
agatgcaatccctgcactgtcaaga

SEQ ID NO: 120225 - DNA, 25 bp, Rattus norvegicus
agatgcacaaatctttctctctctc

SEQ ID NO: 120226 - DNA, 25 bp, Rattus norvegicus
agatgcacaaatgtttctctctctc

SEQ ID NO: 120227 - DNA, 25 bp, Rattus norvegicus
agatgcacactcagtttgccgactc

SEQ ID NO: 120228 - DNA, 25 bp, Rattus norvegicus
agatgcacactctgtttgccgactc

SEQ ID NO: 120229 - DNA, 25 bp, Rattus norvegicus
agatgcacggctaaccgtgcagcca

SEQ ID NO: 120230 - DNA, 25 bp, Rattus norvegicus
agatgcacggcttaccgtgcagcca

SEQ ID NO: 120231 - DNA, 25 bp, Rattus norvegicus
agatgcactcccagagactcctgag

SEQ ID NO: 120232 - DNA, 25 bp, Rattus norvegicus
agatgcactccctgagactcctgag

SEQ ID NO: 120233 - DNA, 25 bp, Rattus norvegicus
agatgcactggacagagccggttct

SEQ ID NO: 120234 - DNA, 25 bp, Rattus norvegicus
agatgcactggagagagccggttct

SEQ ID NO: 120235 - DNA, 25 bp, Rattus norvegicus
agatgcactgtcagtgtgaagtcac

SEQ ID NO: 120236 - DNA, 25 bp, Rattus norvegicus
agatgcactgtctgtgtgaagtcac

SEQ ID NO: 120237 - DNA, 25 bp, Rattus norvegicus
agatgcactgttattgtagccttta

SEQ ID NO: 120238 - DNA, 25 bp, Rattus norvegicus
agatgcactgtttttgtagccttta

SEQ ID NO: 120239 - DNA, 25 bp, Rattus norvegicus
agatgcactttgaatcagggtcagc

SEQ ID NO: 120240 - DNA, 25 bp, Rattus norvegicus
agatgcactttgtatcagggtcagc

SEQ ID NO: 120241 - DNA, 25 bp, Rattus norvegicus
agatgcagacccaggctttgtgcac

SEQ ID NO: 120242 - DNA, 25 bp, Rattus norvegicus
agatgcagacccctgtgagccaagc

SEQ ID NO: 120243 - DNA, 25 bp, Rattus norvegicus
agatgcagacccgtgtgagccaagc

SEQ ID NO: 120244 - DNA, 25 bp, Rattus norvegicus
agatgcagaccctggctttgtgcac

SEQ ID NO: 120245 - DNA, 25 bp, Rattus norvegicus
agatgcagactgctgacggccacca

SEQ ID NO: 120246 - DNA, 25 bp, Rattus norvegicus
agatgcagactggtgacggccacca

SEQ ID NO: 120247 - DNA, 25 bp, Rattus norvegicus
agatgcagatgcacagtccaaggcc

SEQ ID NO: 120248 - DNA, 25 bp, Rattus norvegicus
agatgcagatgctcagtccaaggcc

SEQ ID NO: 120249 - DNA, 25 bp, Rattus norvegicus
agatgcagcaaaactgggctggaaa

SEQ ID NO: 120250 - DNA, 25 bp, Rattus norvegicus
agatgcagcaaatctgggctggaaa

SEQ ID NO: 120251 - DNA, 25 bp, Rattus norvegicus
agatgcagcctcctcatgacgacca

SEQ ID NO: 120252 - DNA, 25 bp, Rattus norvegicus
agatgcagcctcgtcatgacgacca

SEQ ID NO: 120253 - DNA, 25 bp, Rattus norvegicus
agatgcagcgcaagctcagccagct

SEQ ID NO: 120254 - DNA, 25 bp, Rattus norvegicus
agatgcagcgcatgctcagccagct

SEQ ID NO: 120255 - DNA, 25 bp, Rattus norvegicus
agatgcagctcccaggcagggtcaa

SEQ ID NO: 120256 - DNA, 25 bp, Rattus norvegicus
agatgcagctccgaggcagggtcaa

SEQ ID NO: 120257 - DNA, 25 bp, Rattus norvegicus
agatgcagctggactctttcagtac

SEQ ID NO: 120258 - DNA, 25 bp, Rattus norvegicus
agatgcagctggcataccggctcca

SEQ ID NO: 120259 - DNA, 25 bp, Rattus norvegicus
agatgcagctgggataccggctcca

SEQ ID NO: 120260 - DNA, 25 bp, Rattus norvegicus
agatgcagctggtctctttcagtac

SEQ ID NO: 120261 - DNA, 25 bp, Rattus norvegicus
agatgcaggagaatcccgtctttgt

SEQ ID NO: 120262 - DNA, 25 bp, Rattus norvegicus
agatgcaggagattcccgtctttgt

SEQ ID NO: 120263 - DNA, 25 bp, Rattus norvegicus
agatgcaggcacagtgcacgctcat

SEQ ID NO: 120264 - DNA, 25 bp, Rattus norvegicus
agatgcaggcactgtgcacgctcat

SEQ ID NO: 120265 - DNA, 25 bp, Rattus norvegicus
agatgcaggcgcaggagctccagtt

SEQ ID NO: 120266 - DNA, 25 bp, Rattus norvegicus
agatgcaggcgctggagctccagtt

SEQ ID NO: 120267 - DNA, 25 bp, Rattus norvegicus
agatgcaggtgccacaacaattcct

SEQ ID NO: 120268 - DNA, 25 bp, Rattus norvegicus
agatgcaggtgcgacaacaattcct

SEQ ID NO: 120269 - DNA, 25 bp, Rattus norvegicus
agatgcagtgttcttgaggccttaa

SEQ ID NO: 120270 - DNA, 25 bp, Rattus norvegicus
agatgcagtgttgttgaggccttaa

SEQ ID NO: 120271 - DNA, 25 bp, Rattus norvegicus
agatgcatacgcctcactgtgttta

SEQ ID NO: 120272 - DNA, 25 bp, Rattus norvegicus
agatgcatacgcgtcactgtgttta

SEQ ID NO: 120273 - DNA, 25 bp, Rattus norvegicus
agatgcatactcaaccacctggagg

SEQ ID NO: 120274 - DNA, 25 bp, Rattus norvegicus
agatgcatactctaccacctggagg

SEQ ID NO: 120275 - DNA, 25 bp, Rattus norvegicus
agatgcatagatccttcctgtgtgc

SEQ ID NO: 120276 - DNA, 25 bp, Rattus norvegicus
agatgcatagatgcttcctgtgtgc

SEQ ID NO: 120277 - DNA, 25 bp, Rattus norvegicus
agatgcatcagcacgcctgggactg

SEQ ID NO: 120278 - DNA, 25 bp, Rattus norvegicus
agatgcatcagctcgcctgggactg

SEQ ID NO: 120279 - DNA, 25 bp, Rattus norvegicus
agatgcatccacagtgatcccagtg

SEQ ID NO: 120280 - DNA, 25 bp, Rattus norvegicus
agatgcatccactgtgatcccagtg

SEQ ID NO: 120281 - DNA, 25 bp, Rattus norvegicus
agatgcatcttgcttttgtcctgga

SEQ ID NO: 120282 - DNA, 25 bp, Rattus norvegicus
agatgcatcttggttttgtcctgga

SEQ ID NO: 120283 - DNA, 25 bp, Rattus norvegicus
agatgcatgatcctctgtccaagcg

SEQ ID NO: 120284 - DNA, 25 bp, Rattus norvegicus
agatgcatgatcgtctgtccaagcg

SEQ ID NO: 120285 - DNA, 25 bp, Rattus norvegicus
agatgcatgcctccttggacaagtt

SEQ ID NO: 120286 - DNA, 25 bp, Rattus norvegicus
agatgcatgcctgcttggacaagtt

SEQ ID NO: 120287 - DNA, 25 bp, Rattus norvegicus
agatgcatggcgagtcatttggtcc

SEQ ID NO: 120288 - DNA, 25 bp, Rattus norvegicus
agatgcatggcgtgtcatttggtcc

SEQ ID NO: 120289 - DNA, 25 bp, Rattus norvegicus
agatgcatgtctctttctgccatgt

SEQ ID NO: 120290 - DNA, 25 bp, Rattus norvegicus
agatgcatgtctgtttctgccatgt

SEQ ID NO: 120291 - DNA, 25 bp, Rattus norvegicus
agatgcatgtgcacgggctgcagcc

SEQ ID NO: 120292 - DNA, 25 bp, Rattus norvegicus
agatgcatgtgctcgggctgcagcc

SEQ ID NO: 120293 - DNA, 25 bp, Rattus norvegicus
agatgcatgtgtccagctggctctg

SEQ ID NO: 120294 - DNA, 25 bp, Rattus norvegicus
agatgcatgtgtgcagctggctctg

SEQ ID NO: 120295 - DNA, 25 bp, Rattus norvegicus
agatgcattgttagccacctttggc

SEQ ID NO: 120296 - DNA, 25 bp, Rattus norvegicus
agatgcattgtttgccacctttggc

SEQ ID NO: 120297 - DNA, 25 bp, Rattus norvegicus
agatgcatttgaccctaagctggct

SEQ ID NO: 120298 - DNA, 25 bp, Rattus norvegicus
agatgcatttgagcctaagctggct

SEQ ID NO: 120299 - DNA, 25 bp, Rattus norvegicus
agatgcattttcaagcagtggcaga

SEQ ID NO: 120300 - DNA, 25 bp, Rattus norvegicus
agatgcattttcattctgataccat

SEQ ID NO: 120301 - DNA, 25 bp, Rattus norvegicus
agatgcattttctagcagtggcaga

SEQ ID NO: 120302 - DNA, 25 bp, Rattus norvegicus
agatgcattttctttctgataccat

SEQ ID NO: 120303 - DNA, 25 bp, Rattus norvegicus
agatgccaagggaggttctcactgc

SEQ ID NO: 120304 - DNA, 25 bp, Rattus norvegicus
agatgccaagggccatgacaaaaca

SEQ ID NO: 120305 - DNA, 25 bp, Rattus norvegicus
agatgccaaggggcatgacaaaaca

SEQ ID NO: 120306 - DNA, 25 bp, Rattus norvegicus
agatgccaagggtggttctcactgc

SEQ ID NO: 120307 - DNA, 25 bp, Rattus norvegicus
agatgccacacaactgtcaactgtt

SEQ ID NO: 120308 - DNA, 25 bp, Rattus norvegicus
agatgccacacatctgtcaactgtt

SEQ ID NO: 120309 - DNA, 25 bp, Rattus norvegicus
agatgccacccaatctctagtgaaa

SEQ ID NO: 120310 - DNA, 25 bp, Rattus norvegicus
agatgccacccattctctagtgaaa

SEQ ID NO: 120311 - DNA, 25 bp, Rattus norvegicus
agatgccacccgagattgttgagac

SEQ ID NO: 120312 - DNA, 25 bp, Rattus norvegicus
agatgccacccgtgattgttgagac

SEQ ID NO: 120313 - DNA, 25 bp, Rattus norvegicus
agatgccagaggatagagccccaga

SEQ ID NO: 120314 - DNA, 25 bp, Rattus norvegicus
agatgccagaggttagagccccaga

SEQ ID NO: 120315 - DNA, 25 bp, Rattus norvegicus
agatgccagcatagagtccttaaag

SEQ ID NO: 120316 - DNA, 25 bp, Rattus norvegicus
agatgccagcattgagtccttaaag

SEQ ID NO: 120317 - DNA, 25 bp, Rattus norvegicus
agatgccatagaagcctggcccctg

SEQ ID NO: 120318 - DNA, 25 bp, Rattus norvegicus
agatgccatagatgcctggcccctg

SEQ ID NO: 120319 - DNA, 25 bp, Rattus norvegicus
agatgccatcgacgctgaactcaca

SEQ ID NO: 120320 - DNA, 25 bp, Rattus norvegicus
agatgccatcgaggctgaactcaca

SEQ ID NO: 120321 - DNA, 25 bp, Rattus norvegicus
agatgccatgcacccaatccgaatg

SEQ ID NO: 120322 - DNA, 25 bp, Rattus norvegicus
agatgccatgcagccaatccgaatg

SEQ ID NO: 120323 - DNA, 25 bp, Rattus norvegicus
agatgccatgtcactgaagtcctgt

SEQ ID NO: 120324 - DNA, 25 bp, Rattus norvegicus
agatgccatgtcctcaaactgtcct

SEQ ID NO: 120325 - DNA, 25 bp, Rattus norvegicus
agatgccatgtcgtcaaactgtcct

SEQ ID NO: 120326 - DNA, 25 bp, Rattus norvegicus
agatgccatgtctctgaagtcctgt

SEQ ID NO: 120327 - DNA, 25 bp, Rattus norvegicus
agatgccattctagtagctcttacc

SEQ ID NO: 120328 - DNA, 25 bp, Rattus norvegicus
agatgccattcttgtagctcttacc

SEQ ID NO: 120329 - DNA, 25 bp, Rattus norvegicus
agatgcccaaaaaccttctctggct

SEQ ID NO: 120330 - DNA, 25 bp, Rattus norvegicus
agatgcccaaaatccttctctggct

SEQ ID NO: 120331 - DNA, 25 bp, Rattus norvegicus
agatgcccaaacaaagcctgtcaac

SEQ ID NO: 120332 - DNA, 25 bp, Rattus norvegicus
agatgcccaaactaagcctgtcaac

SEQ ID NO: 120333 - DNA, 25 bp, Rattus norvegicus
agatgcccaaccaaaggctttgtgg

SEQ ID NO: 120334 - DNA, 25 bp, Rattus norvegicus
agatgcccaacctaaggctttgtgg

SEQ ID NO: 120335 - DNA, 25 bp, Rattus norvegicus
agatgcccaatgcttctaccccagg

SEQ ID NO: 120336 - DNA, 25 bp, Rattus norvegicus
agatgcccaatggttctaccccagg

SEQ ID NO: 120337 - DNA, 25 bp, Rattus norvegicus
agatgcccacagatgagggcctcag

SEQ ID NO: 120338 - DNA, 25 bp, Rattus norvegicus
agatgcccacagttgagggcctcag

SEQ ID NO: 120339 - DNA, 25 bp, Rattus norvegicus
agatgcccaccaattactcaggacg

SEQ ID NO: 120340 - DNA, 25 bp, Rattus norvegicus
agatgcccaccatttactcaggacg

SEQ ID NO: 120341 - DNA, 25 bp, Rattus norvegicus
agatgcccactgcactggttgggaa

SEQ ID NO: 120342 - DNA, 25 bp, Rattus norvegicus
agatgcccactgcagcgaggactgt

SEQ ID NO: 120343 - DNA, 25 bp, Rattus norvegicus
agatgcccactggactggttgggaa

SEQ ID NO: 120344 - DNA, 25 bp, Rattus norvegicus
agatgcccactggagcgaggactgt

SEQ ID NO: 120345 - DNA, 25 bp, Rattus norvegicus
agatgcccagacaccagtgtgaaaa

SEQ ID NO: 120346 - DNA, 25 bp, Rattus norvegicus
agatgcccagactccagtgtgaaaa

SEQ ID NO: 120347 - DNA, 25 bp, Rattus norvegicus
agatgcccagctatgacagatgatg

SEQ ID NO: 120348 - DNA, 25 bp, Rattus norvegicus
agatgcccagctttgacagatgatg

SEQ ID NO: 120349 - DNA, 25 bp, Rattus norvegicus
agatgcccatagcttgtggtcacgg

SEQ ID NO: 120350 - DNA, 25 bp, Rattus norvegicus
agatgcccataggttgtggtcacgg

SEQ ID NO: 120351 - DNA, 25 bp, Rattus norvegicus
agatgcccatgcctgtgtagctgct

SEQ ID NO: 120352 - DNA, 25 bp, Rattus norvegicus
agatgcccatgcgtgtgtagctgct

SEQ ID NO: 120353 - DNA, 25 bp, Rattus norvegicus
agatgcccatgtattgctttagaat

SEQ ID NO: 120354 - DNA, 25 bp, Rattus norvegicus
agatgcccatgttttgctttagaat

SEQ ID NO: 120355 - DNA, 25 bp, Rattus norvegicus
agatgcccctgaaatagctgctgct

SEQ ID NO: 120356 - DNA, 25 bp, Rattus norvegicus
agatgcccctgatatagctgctgct

SEQ ID NO: 120357 - DNA, 25 bp, Rattus norvegicus
agatgcccgcacaatttgcagcatt

SEQ ID NO: 120358 - DNA, 25 bp, Rattus norvegicus
agatgcccgcactatttgcagcatt

SEQ ID NO: 120359 - DNA, 25 bp, Rattus norvegicus
agatgcccgctgagacggtcttctt

SEQ ID NO: 120360 - DNA, 25 bp, Rattus norvegicus
agatgcccgctgtgacggtcttctt

SEQ ID NO: 120361 - DNA, 25 bp, Rattus norvegicus
agatgccctaggcttgggacagcat

SEQ ID NO: 120362 - DNA, 25 bp, Rattus norvegicus
agatgccctagggttgggacagcat

SEQ ID NO: 120363 - DNA, 25 bp, Rattus norvegicus
agatgccctgtgacttccaaagtgg

SEQ ID NO: 120364 - DNA, 25 bp, Rattus norvegicus
agatgccctgtgtcttccaaagtgg

SEQ ID NO: 120365 - DNA, 25 bp, Rattus norvegicus
agatgcccttcactgtctacagtac

SEQ ID NO: 120366 - DNA, 25 bp, Rattus norvegicus
agatgcccttcagtgtctacagtac

SEQ ID NO: 120367 - DNA, 25 bp, Rattus norvegicus
agatgccgatatcagccttggccat

SEQ ID NO: 120368 - DNA, 25 bp, Rattus norvegicus
agatgccgatatgagccttggccat

SEQ ID NO: 120369 - DNA, 25 bp, Rattus norvegicus
agatgccgatgtactctgcgcaatg

SEQ ID NO: 120370 - DNA, 25 bp, Rattus norvegicus
agatgccgatgttctctgcgcaatg

SEQ ID NO: 120371 - DNA, 25 bp, Rattus norvegicus
agatgccggcccacgaacctgaaga

SEQ ID NO: 120372 - DNA, 25 bp, Rattus norvegicus
agatgccggccctcgaacctgaaga

SEQ ID NO: 120373 - DNA, 25 bp, Rattus norvegicus
agatgccgtggcatctggatctcat

SEQ ID NO: 120374 - DNA, 25 bp, Rattus norvegicus
agatgccgtggcttctggatctcat

SEQ ID NO: 120375 - DNA, 25 bp, Rattus norvegicus
agatgccgtgttagactgggagttt

SEQ ID NO: 120376 - DNA, 25 bp, Rattus norvegicus
agatgccgtgtttgactgggagttt

SEQ ID NO: 120377 - DNA, 25 bp, Rattus norvegicus
agatgcctagcaataaccccagtgt

SEQ ID NO: 120378 - DNA, 25 bp, Rattus norvegicus
agatgcctagcattaaccccagtgt

SEQ ID NO: 120379 - DNA, 25 bp, Rattus norvegicus
agatgcctcagacctactccagaga

SEQ ID NO: 120380 - DNA, 25 bp, Rattus norvegicus
agatgcctcagagctactccagaga

SEQ ID NO: 120381 - DNA, 25 bp, Rattus norvegicus
agatgcctccttacgggaattttct

SEQ ID NO: 120382 - DNA, 25 bp, Rattus norvegicus
agatgcctcctttcgggaattttct

SEQ ID NO: 120383 - DNA, 25 bp, Rattus norvegicus
agatgcctctggcaaccccaaaaga

SEQ ID NO: 120384 - DNA, 25 bp, Rattus norvegicus
agatgcctctgggaaccccaaaaga

SEQ ID NO: 120385 - DNA, 25 bp, Rattus norvegicus
agatgcctgagacctacttggaaat

SEQ ID NO: 120386 - DNA, 25 bp, Rattus norvegicus
agatgcctgagagctacttggaaat

SEQ ID NO: 120387 - DNA, 25 bp, Rattus norvegicus
agatgcctggaaaggagcacacctg

SEQ ID NO: 120388 - DNA, 25 bp, Rattus norvegicus
agatgcctggaatggagcacacctg

SEQ ID NO: 120389 - DNA, 25 bp, Rattus norvegicus
agatgcctggcgaacagcaggcaga

SEQ ID NO: 120390 - DNA, 25 bp, Rattus norvegicus
agatgcctggcgtacagcaggcaga

SEQ ID NO: 120391 - DNA, 25 bp, Rattus norvegicus
agatgccttccactgcacggagctc

SEQ ID NO: 120392 - DNA, 25 bp, Rattus norvegicus
agatgccttccagtgcacggagctc

SEQ ID NO: 120393 - DNA, 25 bp, Rattus norvegicus
agatgccttcctcaactgcaaagag

SEQ ID NO: 120394 - DNA, 25 bp, Rattus norvegicus
agatgccttcctgaactgcaaagag

SEQ ID NO: 120395 - DNA, 25 bp, Rattus norvegicus
agatgccttgctatgttgtgttatt

SEQ ID NO: 120396 - DNA, 25 bp, Rattus norvegicus
agatgccttgctttgttgtgttatt

SEQ ID NO: 120397 - DNA, 25 bp, Rattus norvegicus
agatgccttggaacgggagcttaca

SEQ ID NO: 120398 - DNA, 25 bp, Rattus norvegicus
agatgccttggatcgggagcttaca

SEQ ID NO: 120399 - DNA, 25 bp, Rattus norvegicus
agatgccttgtcctgcagaaacaaa

SEQ ID NO: 120400 - DNA, 25 bp, Rattus norvegicus
agatgccttgtcgtgcagaaacaaa

SEQ ID NO: 120401 - DNA, 25 bp, Rattus norvegicus
agatgccttgttattctttgtcaac

SEQ ID NO: 120402 - DNA, 25 bp, Rattus norvegicus
agatgccttgtttttctttgtcaac

SEQ ID NO: 120403 - DNA, 25 bp, Rattus norvegicus
agatgcctttgtcagttacttttat

SEQ ID NO: 120404 - DNA, 25 bp, Rattus norvegicus
agatgcctttgtgagttacttttat

SEQ ID NO: 120405 - DNA, 25 bp, Rattus norvegicus
agatgccttttcagagaagctttgt

SEQ ID NO: 120406 - DNA, 25 bp, Rattus norvegicus
agatgccttttctgagaagctttgt

SEQ ID NO: 120407 - DNA, 25 bp, Rattus norvegicus
agatgcgaaatccttccagtaccag

SEQ ID NO: 120408 - DNA, 25 bp, Rattus norvegicus
agatgcgaaatcgttccagtaccag

SEQ ID NO: 120409 - DNA, 25 bp, Rattus norvegicus
agatgcgaacgtcaagatgctgtgt

SEQ ID NO: 120410 - DNA, 25 bp, Rattus norvegicus
agatgcgaacgtgaagatgctgtgt

SEQ ID NO: 120411 - DNA, 25 bp, Rattus norvegicus
agatgcgatgaacgccttcatttct

SEQ ID NO: 120412 - DNA, 25 bp, Rattus norvegicus
agatgcgatgaaggccttcatttct

SEQ ID NO: 120413 - DNA, 25 bp, Rattus norvegicus
agatgcgcaattcctatcctcaaga

SEQ ID NO: 120414 - DNA, 25 bp, Rattus norvegicus
agatgcgcaattgctatcctcaaga

SEQ ID NO: 120415 - DNA, 25 bp, Rattus norvegicus
agatgcgcatcaaaggacactcctt

SEQ ID NO: 120416 - DNA, 25 bp, Rattus norvegicus
agatgcgcatcataggacactcctt

SEQ ID NO: 120417 - DNA, 25 bp, Rattus norvegicus
agatgcgcatggaggccctcaaggc

SEQ ID NO: 120418 - DNA, 25 bp, Rattus norvegicus
agatgcgcatggtggccctcaaggc

SEQ ID NO: 120419 - DNA, 25 bp, Rattus norvegicus
agatgcgcctttaggtgcgaactct

SEQ ID NO: 120420 - DNA, 25 bp, Rattus norvegicus
agatgcgccttttggtgcgaactct

SEQ ID NO: 120421 - DNA, 25 bp, Rattus norvegicus
agatgcgctcatcgaggtcttcgcc

SEQ ID NO: 120422 - DNA, 25 bp, Rattus norvegicus
agatgcgctcatggaggtcttcgcc

SEQ ID NO: 120423 - DNA, 25 bp, Rattus norvegicus
agatgcgctttcattacagtggctg

SEQ ID NO: 120424 - DNA, 25 bp, Rattus norvegicus
agatgcgctttctttacagtggctg

SEQ ID NO: 120425 - DNA, 25 bp, Rattus norvegicus
agatgcgggctgacggtgttcatta

SEQ ID NO: 120426 - DNA, 25 bp, Rattus norvegicus
agatgcgggctgtcggtgttcatta

SEQ ID NO: 120427 - DNA, 25 bp, Rattus norvegicus
agatgcggtccaagtagggttccag

SEQ ID NO: 120428 - DNA, 25 bp, Rattus norvegicus
agatgcggtccatgtagggttccag

SEQ ID NO: 120429 - DNA, 25 bp, Rattus norvegicus
agatgcggtgtccagagcttctata

SEQ ID NO: 120430 - DNA, 25 bp, Rattus norvegicus
agatgcggtgtcgagagcttctata

SEQ ID NO: 120431 - DNA, 25 bp, Rattus norvegicus
agatgcgtacaaacccatcacggac

SEQ ID NO: 120432 - DNA, 25 bp, Rattus norvegicus
agatgcgtacaatcccatcacggac

SEQ ID NO: 120433 - DNA, 25 bp, Rattus norvegicus
agatgcgtagtcatggcgtggacat

SEQ ID NO: 120434 - DNA, 25 bp, Rattus norvegicus
agatgcgtagtcttggcgtggacat

SEQ ID NO: 120435 - DNA, 25 bp, Rattus norvegicus
agatgcgtcccgagcctgtcacaca

SEQ ID NO: 120436 - DNA, 25 bp, Rattus norvegicus
agatgcgtcccgtgcctgtcacaca

SEQ ID NO: 120437 - DNA, 25 bp, Rattus norvegicus
agatgcgtccctactgaagaagatg

SEQ ID NO: 120438 - DNA, 25 bp, Rattus norvegicus
agatgcgtcccttctgaagaagatg

SEQ ID NO: 120439 - DNA, 25 bp, Rattus norvegicus
agatgcgtctttcataatgctgctg

SEQ ID NO: 120440 - DNA, 25 bp, Rattus norvegicus
agatgcgtctttgataatgctgctg

SEQ ID NO: 120441 - DNA, 25 bp, Rattus norvegicus
agatgcgtgggtacacacctgcggc

SEQ ID NO: 120442 - DNA, 25 bp, Rattus norvegicus
agatgcgtgggttcacacctgcggc

SEQ ID NO: 120443 - DNA, 25 bp, Rattus norvegicus
agatgcgttaagcaagccagctgtg

SEQ ID NO: 120444 - DNA, 25 bp, Rattus norvegicus
agatgcgttaaggaagccagctgtg

SEQ ID NO: 120445 - DNA, 25 bp, Rattus norvegicus
agatgcgttctacaggagcctctaa

SEQ ID NO: 120446 - DNA, 25 bp, Rattus norvegicus
agatgcgttctagaggagcctctaa

SEQ ID NO: 120447 - DNA, 25 bp, Rattus norvegicus
agatgcgttctcaattttgccttta

SEQ ID NO: 120448 - DNA, 25 bp, Rattus norvegicus
agatgcgttctctattttgccttta

SEQ ID NO: 120449 - DNA, 25 bp, Rattus norvegicus
agatgcgttggtcgtcgtgcccttt

SEQ ID NO: 120450 - DNA, 25 bp, Rattus norvegicus
agatgcgttggtggtcgtgcccttt

SEQ ID NO: 120451 - DNA, 25 bp, Rattus norvegicus
agatgctaacctctgtttcctatct

SEQ ID NO: 120452 - DNA, 25 bp, Rattus norvegicus
agatgctaacctgtgtttcctatct

SEQ ID NO: 120453 - DNA, 25 bp, Rattus norvegicus
agatgctaagaaactccctcagaaa

SEQ ID NO: 120454 - DNA, 25 bp, Rattus norvegicus
agatgctaagaatctccctcagaaa

SEQ ID NO: 120455 - DNA, 25 bp, Rattus norvegicus
agatgctaagctcggagccttcgcc

SEQ ID NO: 120456 - DNA, 25 bp, Rattus norvegicus
agatgctaagctgggagccttcgcc

SEQ ID NO: 120457 - DNA, 25 bp, Rattus norvegicus
agatgctaccgtaggcggccagcag

SEQ ID NO: 120458 - DNA, 25 bp, Rattus norvegicus
agatgctaccgttggcggccagcag

SEQ ID NO: 120459 - DNA, 25 bp, Rattus norvegicus
agatgctactgtatgctggctggtt

SEQ ID NO: 120460 - DNA, 25 bp, Rattus norvegicus
agatgctactgtttgctggctggtt

SEQ ID NO: 120461 - DNA, 25 bp, Rattus norvegicus
agatgctacttgagtgagaccctca

SEQ ID NO: 120462 - DNA, 25 bp, Rattus norvegicus
agatgctacttgtgtgagaccctca

SEQ ID NO: 120463 - DNA, 25 bp, Rattus norvegicus
agatgctagcgacgacacctgcgca

SEQ ID NO: 120464 - DNA, 25 bp, Rattus norvegicus
agatgctagcgaggacacctgcgca

SEQ ID NO: 120465 - DNA, 25 bp, Rattus norvegicus
agatgctatgaaagcccctctggcc

SEQ ID NO: 120466 - DNA, 25 bp, Rattus norvegicus
agatgctatgaatgcccctctggcc

SEQ ID NO: 120467 - DNA, 25 bp, Rattus norvegicus
agatgctcaaagacccttttctgtt

SEQ ID NO: 120468 - DNA, 25 bp, Rattus norvegicus
agatgctcaaagtcccttttctgtt

SEQ ID NO: 120469 - DNA, 25 bp, Rattus norvegicus
agatgctcaacgcagctgtcttcag

SEQ ID NO: 120470 - DNA, 25 bp, Rattus norvegicus
agatgctcaacggagctgtcttcag

SEQ ID NO: 120471 - DNA, 25 bp, Rattus norvegicus
agatgctcaataaagccctgctgac

SEQ ID NO: 120472 - DNA, 25 bp, Rattus norvegicus
agatgctcaatatagccctgctgac

SEQ ID NO: 120473 - DNA, 25 bp, Rattus norvegicus
agatgctcacgactctgctagggtt

SEQ ID NO: 120474 - DNA, 25 bp, Rattus norvegicus
agatgctcacgagtctgctagggtt

SEQ ID NO: 120475 - DNA, 25 bp, Rattus norvegicus
agatgctcactgatgtcaccacaat

SEQ ID NO: 120476 - DNA, 25 bp, Rattus norvegicus
agatgctcactgttgtcaccacaat

SEQ ID NO: 120477 - DNA, 25 bp, Rattus norvegicus
agatgctcacttacgacaggactta

SEQ ID NO: 120478 - DNA, 25 bp, Rattus norvegicus
agatgctcactttcgacaggactta

SEQ ID NO: 120479 - DNA, 25 bp, Rattus norvegicus
agatgctcagagatgtttggcttgt

SEQ ID NO: 120480 - DNA, 25 bp, Rattus norvegicus
agatgctcagagttgtttggcttgt

SEQ ID NO: 120481 - DNA, 25 bp, Rattus norvegicus
agatgctcatcaccaagcaggccga

SEQ ID NO: 120482 - DNA, 25 bp, Rattus norvegicus
agatgctcatcagcaagcaggccga

SEQ ID NO: 120483 - DNA, 25 bp, Rattus norvegicus
agatgctcatctagaggctgccgtg

SEQ ID NO: 120484 - DNA, 25 bp, Rattus norvegicus
agatgctcatcttgaggctgccgtg

SEQ ID NO: 120485 - DNA, 25 bp, Rattus norvegicus
agatgctccaaactctcttcaaagg

SEQ ID NO: 120486 - DNA, 25 bp, Rattus norvegicus
agatgctccaaagtctcttcaaagg

SEQ ID NO: 120487 - DNA, 25 bp, Rattus norvegicus
agatgctccagaacctgtgcacagc

SEQ ID NO: 120488 - DNA, 25 bp, Rattus norvegicus
agatgctccagatcctgtgcacagc

SEQ ID NO: 120489 - DNA, 25 bp, Rattus norvegicus
agatgctccagccagcttggtggtc

SEQ ID NO: 120490 - DNA, 25 bp, Rattus norvegicus
agatgctccagcgagcttggtggtc

SEQ ID NO: 120491 - DNA, 25 bp, Rattus norvegicus
agatgctccataacaccagcgttag

SEQ ID NO: 120492 - DNA, 25 bp, Rattus norvegicus
agatgctccatatcaccagcgttag

SEQ ID NO: 120493 - DNA, 25 bp, Rattus norvegicus
agatgctccctgcttcccagaggaa

SEQ ID NO: 120494 - DNA, 25 bp, Rattus norvegicus
agatgctccctggttcccagaggaa

SEQ ID NO: 120495 - DNA, 25 bp, Rattus norvegicus
agatgctcctggctgggccctgtta

SEQ ID NO: 120496 - DNA, 25 bp, Rattus norvegicus
agatgctcctgggtgggccctgtta

SEQ ID NO: 120497 - DNA, 25 bp, Rattus norvegicus
agatgctcctgtctgaccgattcct

SEQ ID NO: 120498 - DNA, 25 bp, Rattus norvegicus
agatgctcctgtgtgaccgattcct

SEQ ID NO: 120499 - DNA, 25 bp, Rattus norvegicus
agatgctcgcagcagctgtctgtgc

SEQ ID NO: 120500 - DNA, 25 bp, Rattus norvegicus
agatgctcgcaggagctgtctgtgc

SEQ ID NO: 120501 - DNA, 25 bp, Rattus norvegicus
agatgctcggagacctgactgacaa

SEQ ID NO: 120502 - DNA, 25 bp, Rattus norvegicus
agatgctcggagtcctgactgacaa

SEQ ID NO: 120503 - DNA, 25 bp, Rattus norvegicus
agatgctctcatcgcccattagcag

SEQ ID NO: 120504 - DNA, 25 bp, Rattus norvegicus
agatgctctcatggcccattagcag

SEQ ID NO: 120505 - DNA, 25 bp, Rattus norvegicus
agatgctctctaaccagtgtaaatg

SEQ ID NO: 120506 - DNA, 25 bp, Rattus norvegicus
agatgctctctatccagtgtaaatg

SEQ ID NO: 120507 - DNA, 25 bp, Rattus norvegicus
agatgctctctcaaaaggaaagtaa

SEQ ID NO: 120508 - DNA, 25 bp, Rattus norvegicus
agatgctctctcctttgcactacag

SEQ ID NO: 120509 - DNA, 25 bp, Rattus norvegicus
agatgctctctcgtttgcactacag

SEQ ID NO: 120510 - DNA, 25 bp, Rattus norvegicus
agatgctctctctaaaggaaagtaa

SEQ ID NO: 120511 - DNA, 25 bp, Rattus norvegicus
agatgctctgctaggcctggtgatg

SEQ ID NO: 120512 - DNA, 25 bp, Rattus norvegicus
agatgctctgcttggcctggtgatg

SEQ ID NO: 120513 - DNA, 25 bp, Rattus norvegicus
agatgctctgggagtggcttgccta

SEQ ID NO: 120514 - DNA, 25 bp, Rattus norvegicus
agatgctctgggtgtggcttgccta

SEQ ID NO: 120515 - DNA, 25 bp, Rattus norvegicus
agatgctcttgtcggttttggttgc

SEQ ID NO: 120516 - DNA, 25 bp, Rattus norvegicus
agatgctcttgtgggttttggttgc

SEQ ID NO: 120517 - DNA, 25 bp, Rattus norvegicus
agatgctgaagcagtgctctctgac

SEQ ID NO: 120518 - DNA, 25 bp, Rattus norvegicus
agatgctgaagctgtgctctctgac

SEQ ID NO: 120519 - DNA, 25 bp, Rattus norvegicus
agatgctgaatgactttgggccaca

SEQ ID NO: 120520 - DNA, 25 bp, Rattus norvegicus
agatgctgaatgtctttgggccaca

SEQ ID NO: 120521 - DNA, 25 bp, Rattus norvegicus
agatgctgacggcattaccacctca

SEQ ID NO: 120522 - DNA, 25 bp, Rattus norvegicus
agatgctgacgggattaccacctca

SEQ ID NO: 120523 - DNA, 25 bp, Rattus norvegicus
agatgctgactgaccctgcagggaa

SEQ ID NO: 120524 - DNA, 25 bp, Rattus norvegicus
agatgctgactgtccctgcagggaa

SEQ ID NO: 120525 - DNA, 25 bp, Rattus norvegicus
agatgctgagctccctgctcgtgcg

SEQ ID NO: 120526 - DNA, 25 bp, Rattus norvegicus
agatgctgagctgcctgctcgtgcg

SEQ ID NO: 120527 - DNA, 25 bp, Rattus norvegicus
agatgctgcccgagcgtgtgtttga

SEQ ID NO: 120528 - DNA, 25 bp, Rattus norvegicus
agatgctgcccgtgcgtgtgtttga

SEQ ID NO: 120529 - DNA, 25 bp, Rattus norvegicus
agatgctgccttatgtgtgttaatt

SEQ ID NO: 120530 - DNA, 25 bp, Rattus norvegicus
agatgctgccttttgtgtgttaatt

SEQ ID NO: 120531 - DNA, 25 bp, Rattus norvegicus
agatgctgcgccaggcactgctgac

SEQ ID NO: 120532 - DNA, 25 bp, Rattus norvegicus
agatgctgcgcctggcactgctgac

SEQ ID NO: 120533 - DNA, 25 bp, Rattus norvegicus
agatgctgcgcgaaattggagctct

SEQ ID NO: 120534 - DNA, 25 bp, Rattus norvegicus
agatgctgcgcgtaattggagctct

SEQ ID NO: 120535 - DNA, 25 bp, Rattus norvegicus
agatgctgcgtgatcattatgccat

SEQ ID NO: 120536 - DNA, 25 bp, Rattus norvegicus
agatgctgcgtgttcattatgccat

SEQ ID NO: 120537 - DNA, 25 bp, Rattus norvegicus
agatgctgctcgctctgggatcatg

SEQ ID NO: 120538 - DNA, 25 bp, Rattus norvegicus
agatgctgctcggtctgggatcatg

SEQ ID NO: 120539 - DNA, 25 bp, Rattus norvegicus
agatgctgctctcgtgatgctgtat

SEQ ID NO: 120540 - DNA, 25 bp, Rattus norvegicus
agatgctgctctggtgatgctgtat

SEQ ID NO: 120541 - DNA, 25 bp, Rattus norvegicus
agatgctgcttcacgaaagcggagt

SEQ ID NO: 120542 - DNA, 25 bp, Rattus norvegicus
agatgctgcttctcgaaagcggagt

SEQ ID NO: 120543 - DNA, 25 bp, Rattus norvegicus
agatgctggaatctgttctgaccaa

SEQ ID NO: 120544 - DNA, 25 bp, Rattus norvegicus
agatgctggaatgtgttctgaccaa

SEQ ID NO: 120545 - DNA, 25 bp, Rattus norvegicus
agatgctggagactgccatccgtaa

SEQ ID NO: 120546 - DNA, 25 bp, Rattus norvegicus
agatgctggagagtgccatccgtaa

SEQ ID NO: 120547 - DNA, 25 bp, Rattus norvegicus
agatgctggagcacttgtaagttga

SEQ ID NO: 120548 - DNA, 25 bp, Rattus norvegicus
agatgctggagctcttgtaagttga

SEQ ID NO: 120549 - DNA, 25 bp, Rattus norvegicus
agatgctggatgctcatcgtcttca

SEQ ID NO: 120550 - DNA, 25 bp, Rattus norvegicus
agatgctggatggtcatcgtcttca

SEQ ID NO: 120551 - DNA, 25 bp, Rattus norvegicus
agatgctggcacaaggcgttgttca

SEQ ID NO: 120552 - DNA, 25 bp, Rattus norvegicus
agatgctggcactaggcgttgttca

SEQ ID NO: 120553 - DNA, 25 bp, Rattus norvegicus
agatgctggccaacatgaagtccat

SEQ ID NO: 120554 - DNA, 25 bp, Rattus norvegicus
agatgctggccatcatgaagtccat

SEQ ID NO: 120555 - DNA, 25 bp, Rattus norvegicus
agatgctggctgactacaggcggct

SEQ ID NO: 120556 - DNA, 25 bp, Rattus norvegicus
agatgctggctgtctacaggcggct

SEQ ID NO: 120557 - DNA, 25 bp, Rattus norvegicus
agatgctgggacctgtaatctcctg

SEQ ID NO: 120558 - DNA, 25 bp, Rattus norvegicus
agatgctgggacgtgtaatctcctg

SEQ ID NO: 120559 - DNA, 25 bp, Rattus norvegicus
agatgctggtgtctcactcatttta

SEQ ID NO: 120560 - DNA, 25 bp, Rattus norvegicus
agatgctggtgtgtcactcatttta

SEQ ID NO: 120561 - DNA, 25 bp, Rattus norvegicus
agatgctgtaacaccatagtgctgg

SEQ ID NO: 120562 - DNA, 25 bp, Rattus norvegicus
agatgctgtaactccatagtgctgg

SEQ ID NO: 120563 - DNA, 25 bp, Rattus norvegicus
agatgctgtcacatattggaaatgc

SEQ ID NO: 120564 - DNA, 25 bp, Rattus norvegicus
agatgctgtcacttattggaaatgc

SEQ ID NO: 120565 - DNA, 25 bp, Rattus norvegicus
agatgctgtcagaaggctccgtagg

SEQ ID NO: 120566 - DNA, 25 bp, Rattus norvegicus
agatgctgtcagtaggctccgtagg

SEQ ID NO: 120567 - DNA, 25 bp, Rattus norvegicus
agatgctgtgcaacaccttccagat

SEQ ID NO: 120568 - DNA, 25 bp, Rattus norvegicus
agatgctgtgcatcaccttccagat

SEQ ID NO: 120569 - DNA, 25 bp, Rattus norvegicus
agatgctgtgggacacatcttgtgt

SEQ ID NO: 120570 - DNA, 25 bp, Rattus norvegicus
agatgctgtgggtcacatcttgtgt

SEQ ID NO: 120571 - DNA, 25 bp, Rattus norvegicus
agatgctgtgtgagtgggcactcct

SEQ ID NO: 120572 - DNA, 25 bp, Rattus norvegicus
agatgctgtgtgtgtgggcactcct

SEQ ID NO: 120573 - DNA, 25 bp, Rattus norvegicus
agatgctgtgttctgcctttttgca

SEQ ID NO: 120574 - DNA, 25 bp, Rattus norvegicus
agatgctgtgttcttctggactcta

SEQ ID NO: 120575 - DNA, 25 bp, Rattus norvegicus
agatgctgtgttgtgcctttttgca

SEQ ID NO: 120576 - DNA, 25 bp, Rattus norvegicus
agatgctgtgttgttctggactcta

SEQ ID NO: 120577 - DNA, 25 bp, Rattus norvegicus
agatgctgttccaggctaacctgga

SEQ ID NO: 120578 - DNA, 25 bp, Rattus norvegicus
agatgctgttcctggctaacctgga

SEQ ID NO: 120579 - DNA, 25 bp, Rattus norvegicus
agatgcttagccacataaccactct

SEQ ID NO: 120580 - DNA, 25 bp, Rattus norvegicus
agatgcttagccatagtgtttccaa

SEQ ID NO: 120581 - DNA, 25 bp, Rattus norvegicus
agatgcttagcctcataaccactct

SEQ ID NO: 120582 - DNA, 25 bp, Rattus norvegicus
agatgcttagccttagtgtttccaa

SEQ ID NO: 120583 - DNA, 25 bp, Rattus norvegicus
agatgcttagctataaccacagtaa

SEQ ID NO: 120584 - DNA, 25 bp, Rattus norvegicus
agatgcttagctttaaccacagtaa

SEQ ID NO: 120585 - DNA, 25 bp, Rattus norvegicus
agatgcttcaggagtcctgctctcc

SEQ ID NO: 120586 - DNA, 25 bp, Rattus norvegicus
agatgcttcaggtgtcctgctctcc

SEQ ID NO: 120587 - DNA, 25 bp, Rattus norvegicus
agatgcttccacagtccaagctgag

SEQ ID NO: 120588 - DNA, 25 bp, Rattus norvegicus
agatgcttccactgtccaagctgag

SEQ ID NO: 120589 - DNA, 25 bp, Rattus norvegicus
agatgcttcctgactaccggttgat

SEQ ID NO: 120590 - DNA, 25 bp, Rattus norvegicus
agatgcttcctgtctaccggttgat

SEQ ID NO: 120591 - DNA, 25 bp, Rattus norvegicus
agatgcttcgacatggcctcctggg

SEQ ID NO: 120592 - DNA, 25 bp, Rattus norvegicus
agatgcttcgacttggcctcctggg

SEQ ID NO: 120593 - DNA, 25 bp, Rattus norvegicus
agatgcttctgcagcagggctccct

SEQ ID NO: 120594 - DNA, 25 bp, Rattus norvegicus
agatgcttctgctgcagggctccct

SEQ ID NO: 120595 - DNA, 25 bp, Rattus norvegicus
agatgcttgcatatgtttgctacag

SEQ ID NO: 120596 - DNA, 25 bp, Rattus norvegicus
agatgcttgcatttgtttgctacag

SEQ ID NO: 120597 - DNA, 25 bp, Rattus norvegicus
agatgcttgcccactaggacaggat

SEQ ID NO: 120598 - DNA, 25 bp, Rattus norvegicus
agatgcttgccctctaggacaggat

SEQ ID NO: 120599 - DNA, 25 bp, Rattus norvegicus
agatgcttggatcctcaggcgtaca

SEQ ID NO: 120600 - DNA, 25 bp, Rattus norvegicus
agatgcttggatgctcaggcgtaca

SEQ ID NO: 120601 - DNA, 25 bp, Rattus norvegicus
agatgcttgtctcctatgaggatga

SEQ ID NO: 120602 - DNA, 25 bp, Rattus norvegicus
agatgcttgtctgctatgaggatga

SEQ ID NO: 120603 - DNA, 25 bp, Rattus norvegicus
agatgctttaatcgcgactgtcttc

SEQ ID NO: 120604 - DNA, 25 bp, Rattus norvegicus
agatgctttaatggcgactgtcttc

SEQ ID NO: 120605 - DNA, 25 bp, Rattus norvegicus
agatgctttcagatctacccgacag

SEQ ID NO: 120606 - DNA, 25 bp, Rattus norvegicus
agatgctttcagttctacccgacag

SEQ ID NO: 120607 - DNA, 25 bp, Rattus norvegicus
agatgctttcccctctcaagaacca

SEQ ID NO: 120608 - DNA, 25 bp, Rattus norvegicus
agatgctttcccgtctcaagaacca

SEQ ID NO: 120609 - DNA, 25 bp, Rattus norvegicus
agatgctttctcacctggtttgcag

SEQ ID NO: 120610 - DNA, 25 bp, Rattus norvegicus
agatgctttctctcctggtttgcag

SEQ ID NO: 120611 - DNA, 25 bp, Rattus norvegicus
agatgctttgaaatgggacctaacc

SEQ ID NO: 120612 - DNA, 25 bp, Rattus norvegicus
agatgctttgaattgggacctaacc

SEQ ID NO: 120613 - DNA, 25 bp, Rattus norvegicus
agatgcttttctattgtctcaacca

SEQ ID NO: 120614 - DNA, 25 bp, Rattus norvegicus
agatgcttttcttttgtctcaacca

SEQ ID NO: 120615 - DNA, 25 bp, Rattus norvegicus
agatggaaaattcccaggccctggt

SEQ ID NO: 120616 - DNA, 25 bp, Rattus norvegicus
agatggaaaattgccaggccctggt

SEQ ID NO: 120617 - DNA, 25 bp, Rattus norvegicus
agatggaaactaccctgccttcacc

SEQ ID NO: 120618 - DNA, 25 bp, Rattus norvegicus
agatggaaactagcctgccttcacc

SEQ ID NO: 120619 - DNA, 25 bp, Rattus norvegicus
agatggaaagttcttaccccactct

SEQ ID NO: 120620 - DNA, 25 bp, Rattus norvegicus
agatggaaagttgttaccccactct

SEQ ID NO: 120621 - DNA, 25 bp, Rattus norvegicus
agatggaacaccaaccctaggactc

SEQ ID NO: 120622 - DNA, 25 bp, Rattus norvegicus
agatggaacacctaccctaggactc

SEQ ID NO: 120623 - DNA, 25 bp, Rattus norvegicus
agatggaaccctcgccttctttgta

SEQ ID NO: 120624 - DNA, 25 bp, Rattus norvegicus
agatggaaccctggccttctttgta

SEQ ID NO: 120625 - DNA, 25 bp, Rattus norvegicus
agatggaaccggaccaggtgtacga

SEQ ID NO: 120626 - DNA, 25 bp, Rattus norvegicus
agatggaaccggtccaggtgtacga

SEQ ID NO: 120627 - DNA, 25 bp, Rattus norvegicus
agatggaactgcatcatccactggg

SEQ ID NO: 120628 - DNA, 25 bp, Rattus norvegicus
agatggaactgcttcatccactggg

SEQ ID NO: 120629 - DNA, 25 bp, Rattus norvegicus
agatggaagttaccccagccactgc

SEQ ID NO: 120630 - DNA, 25 bp, Rattus norvegicus
agatggaagttagcccagccactgc

SEQ ID NO: 120631 - DNA, 25 bp, Rattus norvegicus
agatggaatggtatctgtcttaaca

SEQ ID NO: 120632 - DNA, 25 bp, Rattus norvegicus
agatggaatggtttctgtcttaaca

SEQ ID NO: 120633 - DNA, 25 bp, Rattus norvegicus
agatggacacacaggcttggtgcct

SEQ ID NO: 120634 - DNA, 25 bp, Rattus norvegicus
agatggacacactggcttggtgcct

SEQ ID NO: 120635 - DNA, 25 bp, Rattus norvegicus
agatggacacatatcgcagacccgg

SEQ ID NO: 120636 - DNA, 25 bp, Rattus norvegicus
agatggacacatttcgcagacccgg

SEQ ID NO: 120637 - DNA, 25 bp, Rattus norvegicus
agatggacactgacatcgctgcact

SEQ ID NO: 120638 - DNA, 25 bp, Rattus norvegicus
agatggacactgtcatcgctgcact

SEQ ID NO: 120639 - DNA, 25 bp, Rattus norvegicus
agatggacagtgctgccagtgacct

SEQ ID NO: 120640 - DNA, 25 bp, Rattus norvegicus
agatggacagtggtgccagtgacct

SEQ ID NO: 120641 - DNA, 25 bp, Rattus norvegicus
agatggaccaggaattagccttcta

SEQ ID NO: 120642 - DNA, 25 bp, Rattus norvegicus
agatggaccaggtattagccttcta

SEQ ID NO: 120643 - DNA, 25 bp, Rattus norvegicus
agatggacccaccagcgtcagtgag

SEQ ID NO: 120644 - DNA, 25 bp, Rattus norvegicus
agatggacccacgagcgtcagtgag

SEQ ID NO: 120645 - DNA, 25 bp, Rattus norvegicus
agatggaccctgagtaccgtgtgag

SEQ ID NO: 120646 - DNA, 25 bp, Rattus norvegicus
agatggaccctgtgtaccgtgtgag

SEQ ID NO: 120647 - DNA, 25 bp, Rattus norvegicus
agatggaccgtgctcttccacttgt

SEQ ID NO: 120648 - DNA, 25 bp, Rattus norvegicus
agatggaccgtggtcttccacttgt

SEQ ID NO: 120649 - DNA, 25 bp, Rattus norvegicus
agatggacctgcaaggcaaccccaa

SEQ ID NO: 120650 - DNA, 25 bp, Rattus norvegicus
agatggacctgcagaccccggactc

SEQ ID NO: 120651 - DNA, 25 bp, Rattus norvegicus
agatggacctgctaggcaaccccaa

SEQ ID NO: 120652 - DNA, 25 bp, Rattus norvegicus
agatggacctgctgaccccggactc

SEQ ID NO: 120653 - DNA, 25 bp, Rattus norvegicus
agatggacgatgaccttcccgagag

SEQ ID NO: 120654 - DNA, 25 bp, Rattus norvegicus
agatggacgatgtccttcccgagag

SEQ ID NO: 120655 - DNA, 25 bp, Rattus norvegicus
agatggacgcccacggagctgtaag

SEQ ID NO: 120656 - DNA, 25 bp, Rattus norvegicus
agatggacgccctcggagctgtaag

SEQ ID NO: 120657 - DNA, 25 bp, Rattus norvegicus
agatggactctaacgtttagcccct

SEQ ID NO: 120658 - DNA, 25 bp, Rattus norvegicus
agatggactctatcgtttagcccct

SEQ ID NO: 120659 - DNA, 25 bp, Rattus norvegicus
agatggagaacccactgcctgcttc

SEQ ID NO: 120660 - DNA, 25 bp, Rattus norvegicus
agatggagaaccgactgcctgcttc

SEQ ID NO: 120661 - DNA, 25 bp, Rattus norvegicus
agatggagacctcccgccgccttat

SEQ ID NO: 120662 - DNA, 25 bp, Rattus norvegicus
agatggagacctgccgccgccttat

SEQ ID NO: 120663 - DNA, 25 bp, Rattus norvegicus
agatggagacgtcctgctcccatat

SEQ ID NO: 120664 - DNA, 25 bp, Rattus norvegicus
agatggagacgtgctgctcccatat

SEQ ID NO: 120665 - DNA, 25 bp, Rattus norvegicus
agatggagagctctcgtctgcagaa

SEQ ID NO: 120666 - DNA, 25 bp, Rattus norvegicus
agatggagagctgtcgtctgcagaa

SEQ ID NO: 120667 - DNA, 25 bp, Rattus norvegicus
agatggagaggacctttacccctgt

SEQ ID NO: 120668 - DNA, 25 bp, Rattus norvegicus
agatggagaggagctttacccctgt

SEQ ID NO: 120669 - DNA, 25 bp, Rattus norvegicus
agatggagatcacacggaagacgac

SEQ ID NO: 120670 - DNA, 25 bp, Rattus norvegicus
agatggagatcagacggaagacgac

SEQ ID NO: 120671 - DNA, 25 bp, Rattus norvegicus
agatggagattaccaccagctgctc

SEQ ID NO: 120672 - DNA, 25 bp, Rattus norvegicus
agatggagattagcaccagctgctc

SEQ ID NO: 120673 - DNA, 25 bp, Rattus norvegicus
agatggagccatctactctcacggt

SEQ ID NO: 120674 - DNA, 25 bp, Rattus norvegicus
agatggagccatgtactctcacggt

SEQ ID NO: 120675 - DNA, 25 bp, Rattus norvegicus
agatggagcttgatactgagccgta

SEQ ID NO: 120676 - DNA, 25 bp, Rattus norvegicus
agatggagcttgttactgagccgta

SEQ ID NO: 120677 - DNA, 25 bp, Rattus norvegicus
agatggaggaccagacctctggcca

SEQ ID NO: 120678 - DNA, 25 bp, Rattus norvegicus
agatggaggacctgacctctggcca

SEQ ID NO: 120679 - DNA, 25 bp, Rattus norvegicus
agatggaggaggaagcccctttctg

SEQ ID NO: 120680 - DNA, 25 bp, Rattus norvegicus
agatggaggaggtagcccctttctg

SEQ ID NO: 120681 - DNA, 25 bp, Rattus norvegicus
agatggaggcaacctcttctgcact

SEQ ID NO: 120682 - DNA, 25 bp, Rattus norvegicus
agatggaggcaagctcttctgcact

SEQ ID NO: 120683 - DNA, 25 bp, Rattus norvegicus
agatggagggctatgctactctgtt

SEQ ID NO: 120684 - DNA, 25 bp, Rattus norvegicus
agatggagggctttgctactctgtt

SEQ ID NO: 120685 - DNA, 25 bp, Rattus norvegicus
agatggagggttctgctttgtctct

SEQ ID NO: 120686 - DNA, 25 bp, Rattus norvegicus
agatggagggttgtgctttgtctct

SEQ ID NO: 120687 - DNA, 25 bp, Rattus norvegicus
agatggagtgacatctccctgggaa

SEQ ID NO: 120688 - DNA, 25 bp, Rattus norvegicus
agatggagtgacttctccctgggaa

SEQ ID NO: 120689 - DNA, 25 bp, Rattus norvegicus
agatggagttcaagccagctgcctc

SEQ ID NO: 120690 - DNA, 25 bp, Rattus norvegicus
agatggagttcacttcttccttgac

SEQ ID NO: 120691 - DNA, 25 bp, Rattus norvegicus
agatggagttcagttcttccttgac

SEQ ID NO: 120692 - DNA, 25 bp, Rattus norvegicus
agatggagttcatgccagctgcctc

SEQ ID NO: 120693 - DNA, 25 bp, Rattus norvegicus
agatggatactcacttgtgctacct

SEQ ID NO: 120694 - DNA, 25 bp, Rattus norvegicus
agatggatactctcttgtgctacct

SEQ ID NO: 120695 - DNA, 25 bp, Rattus norvegicus
agatggatagcgacattttcttatg

SEQ ID NO: 120696 - DNA, 25 bp, Rattus norvegicus
agatggatagcgtcattttcttatg

SEQ ID NO: 120697 - DNA, 25 bp, Rattus norvegicus
agatggatcccaatttgagcctgtc

SEQ ID NO: 120698 - DNA, 25 bp, Rattus norvegicus
agatggatcccattttgagcctgtc

SEQ ID NO: 120699 - DNA, 25 bp, Rattus norvegicus
agatggatcctgacttggctctgga

SEQ ID NO: 120700 - DNA, 25 bp, Rattus norvegicus
agatggatcctgcaagactaataga

SEQ ID NO: 120701 - DNA, 25 bp, Rattus norvegicus
agatggatcctggaagactaataga

SEQ ID NO: 120702 - DNA, 25 bp, Rattus norvegicus
agatggatcctgtcttggctctgga

SEQ ID NO: 120703 - DNA, 25 bp, Rattus norvegicus
agatggatctagctcagagactggt

SEQ ID NO: 120704 - DNA, 25 bp, Rattus norvegicus
agatggatctaggtcagagactggt

SEQ ID NO: 120705 - DNA, 25 bp, Rattus norvegicus
agatggatctgcacaccgcttcgag

SEQ ID NO: 120706 - DNA, 25 bp, Rattus norvegicus
agatggatctgctcaccgcttcgag

SEQ ID NO: 120707 - DNA, 25 bp, Rattus norvegicus
agatggatgactacagctcgcccaa

SEQ ID NO: 120708 - DNA, 25 bp, Rattus norvegicus
agatggatgacttcagctcgcccaa

SEQ ID NO: 120709 - DNA, 25 bp, Rattus norvegicus
agatggatgctaaatgcctaggccc

SEQ ID NO: 120710 - DNA, 25 bp, Rattus norvegicus
agatggatgctatatgcctaggccc

SEQ ID NO: 120711 - DNA, 25 bp, Rattus norvegicus
agatggattccactcaacccgaaag

SEQ ID NO: 120712 - DNA, 25 bp, Rattus norvegicus
agatggattccagtcaacccgaaag

SEQ ID NO: 120713 - DNA, 25 bp, Rattus norvegicus
agatggatttctcctgtctttcggc

SEQ ID NO: 120714 - DNA, 25 bp, Rattus norvegicus
agatggatttctgctgtctttcggc

SEQ ID NO: 120715 - DNA, 25 bp, Rattus norvegicus
agatggcaacacacttcctggagga

SEQ ID NO: 120716 - DNA, 25 bp, Rattus norvegicus
agatggcaacactcttcctggagga

SEQ ID NO: 120717 - DNA, 25 bp, Rattus norvegicus
agatggcaagaacctcactgaagat

SEQ ID NO: 120718 - DNA, 25 bp, Rattus norvegicus
agatggcaagaagctcactgaagat

SEQ ID NO: 120719 - DNA, 25 bp, Rattus norvegicus
agatggcacactaggctatggctgt

SEQ ID NO: 120720 - DNA, 25 bp, Rattus norvegicus
agatggcacacttggctatggctgt

SEQ ID NO: 120721 - DNA, 25 bp, Rattus norvegicus
agatggcaccagcaagtcagggctc

SEQ ID NO: 120722 - DNA, 25 bp, Rattus norvegicus
agatggcaccaggaagtcagggctc

SEQ ID NO: 120723 - DNA, 25 bp, Rattus norvegicus
agatggcaccataaccaccaaggag

SEQ ID NO: 120724 - DNA, 25 bp, Rattus norvegicus
agatggcaccattaccaccaaggag

SEQ ID NO: 120725 - DNA, 25 bp, Rattus norvegicus
agatggcacctactattctgggctc

SEQ ID NO: 120726 - DNA, 25 bp, Rattus norvegicus
agatggcacctagtattctgggctc

SEQ ID NO: 120727 - DNA, 25 bp, Rattus norvegicus
agatggcaccttcactttcagcact

SEQ ID NO: 120728 - DNA, 25 bp, Rattus norvegicus
agatggcaccttgactttcagcact

SEQ ID NO: 120729 - DNA, 25 bp, Rattus norvegicus
agatggcactctctgctctgtgata

SEQ ID NO: 120730 - DNA, 25 bp, Rattus norvegicus
agatggcactctgtgctctgtgata

SEQ ID NO: 120731 - DNA, 25 bp, Rattus norvegicus
agatggcagcaacctcttcccaact

SEQ ID NO: 120732 - DNA, 25 bp, Rattus norvegicus
agatggcagcaagctcttcccaact

SEQ ID NO: 120733 - DNA, 25 bp, Rattus norvegicus
agatggcagcctacattttgcgaga

SEQ ID NO: 120734 - DNA, 25 bp, Rattus norvegicus
agatggcagccttcattttgcgaga

SEQ ID NO: 120735 - DNA, 25 bp, Rattus norvegicus
agatggcaggtaccgctgctcccag

SEQ ID NO: 120736 - DNA, 25 bp, Rattus norvegicus
agatggcaggtagcgctgctcccag

SEQ ID NO: 120737 - DNA, 25 bp, Rattus norvegicus
agatggcaggtgctccaaaccagca

SEQ ID NO: 120738 - DNA, 25 bp, Rattus norvegicus
agatggcaggtggtccaaaccagca

SEQ ID NO: 120739 - DNA, 25 bp, Rattus norvegicus
agatggcagtccagagccgagtcca

SEQ ID NO: 120740 - DNA, 25 bp, Rattus norvegicus
agatggcagtcctgagccgagtcca

SEQ ID NO: 120741 - DNA, 25 bp, Rattus norvegicus
agatggcatcaccaggaagtcccgc

SEQ ID NO: 120742 - DNA, 25 bp, Rattus norvegicus
agatggcatcacgaggaagtcccgc

SEQ ID NO: 120743 - DNA, 25 bp, Rattus norvegicus
agatggcatccaagcggctccgttg

SEQ ID NO: 120744 - DNA, 25 bp, Rattus norvegicus
agatggcatccatgcggctccgttg

SEQ ID NO: 120745 - DNA, 25 bp, Rattus norvegicus
agatggccaaagagtccgcactgtg

SEQ ID NO: 120746 - DNA, 25 bp, Rattus norvegicus
agatggccaaagtgtccgcactgtg

SEQ ID NO: 120747 - DNA, 25 bp, Rattus norvegicus
agatggccactaacctgagcttcaa

SEQ ID NO: 120748 - DNA, 25 bp, Rattus norvegicus
agatggccactatcctgagcttcaa

SEQ ID NO: 120749 - DNA, 25 bp, Rattus norvegicus
agatggccagacacagccacttgaa

SEQ ID NO: 120750 - DNA, 25 bp, Rattus norvegicus
agatggccagactcagccacttgaa

SEQ ID NO: 120751 - DNA, 25 bp, Rattus norvegicus
agatggccagcccttcagtgtgtac

SEQ ID NO: 120752 - DNA, 25 bp, Rattus norvegicus
agatggccagccgttcagtgtgtac

SEQ ID NO: 120753 - DNA, 25 bp, Rattus norvegicus
agatggccccagctacagatactaa

SEQ ID NO: 120754 - DNA, 25 bp, Rattus norvegicus
agatggccccaggtacagatactaa

SEQ ID NO: 120755 - DNA, 25 bp, Rattus norvegicus
agatggcccgtacaggtggcacaca

SEQ ID NO: 120756 - DNA, 25 bp, Rattus norvegicus
agatggcccgtagaggtggcacaca

SEQ ID NO: 120757 - DNA, 25 bp, Rattus norvegicus
agatggccctatagtgcctgagtac

SEQ ID NO: 120758 - DNA, 25 bp, Rattus norvegicus
agatggccctattgtgcctgagtac

SEQ ID NO: 120759 - DNA, 25 bp, Rattus norvegicus
agatggcctacactgttccagttgc

SEQ ID NO: 120760 - DNA, 25 bp, Rattus norvegicus
agatggcctacagtgttccagttgc

SEQ ID NO: 120761 - DNA, 25 bp, Rattus norvegicus
agatggcctcaaagacattgtggat

SEQ ID NO: 120762 - DNA, 25 bp, Rattus norvegicus
agatggcctcaatgacattgtggat

SEQ ID NO: 120763 - DNA, 25 bp, Rattus norvegicus
agatggcctcatctgcaaagaagca

SEQ ID NO: 120764 - DNA, 25 bp, Rattus norvegicus
agatggcctcatctgtttgtagacc

SEQ ID NO: 120765 - DNA, 25 bp, Rattus norvegicus
agatggcctcatgtgcaaagaagca

SEQ ID NO: 120766 - DNA, 25 bp, Rattus norvegicus
agatggcctcatgtgtttgtagacc

SEQ ID NO: 120767 - DNA, 25 bp, Rattus norvegicus
agatggcctccaccagcaataggga

SEQ ID NO: 120768 - DNA, 25 bp, Rattus norvegicus
agatggcctccagcagcaataggga

SEQ ID NO: 120769 - DNA, 25 bp, Rattus norvegicus
agatggcctctgaaagatgttgcaa

SEQ ID NO: 120770 - DNA, 25 bp, Rattus norvegicus
agatggcctctgtaagatgttgcaa

SEQ ID NO: 120771 - DNA, 25 bp, Rattus norvegicus
agatggcctgcgctgcatagttcag

SEQ ID NO: 120772 - DNA, 25 bp, Rattus norvegicus
agatggcctgcggtgcatagttcag

SEQ ID NO: 120773 - DNA, 25 bp, Rattus norvegicus
agatggcctgctagggacctattag

SEQ ID NO: 120774 - DNA, 25 bp, Rattus norvegicus
agatggcctgcttgggacctattag

SEQ ID NO: 120775 - DNA, 25 bp, Rattus norvegicus
agatggcctggcaagtctgggctct

SEQ ID NO: 120776 - DNA, 25 bp, Rattus norvegicus
agatggcctggcagtttgtacctga

SEQ ID NO: 120777 - DNA, 25 bp, Rattus norvegicus
agatggcctggctagtctgggctct

SEQ ID NO: 120778 - DNA, 25 bp, Rattus norvegicus
agatggcctggctgtttgtacctga

SEQ ID NO: 120779 - DNA, 25 bp, Rattus norvegicus
agatggcctgtgagacctcaactgc

SEQ ID NO: 120780 - DNA, 25 bp, Rattus norvegicus
agatggcctgtgtgacctcaactgc

SEQ ID NO: 120781 - DNA, 25 bp, Rattus norvegicus
agatggccttgacctcacgacctag

SEQ ID NO: 120782 - DNA, 25 bp, Rattus norvegicus
agatggccttgagctcacgacctag

SEQ ID NO: 120783 - DNA, 25 bp, Rattus norvegicus
agatggccttgcacactgtctaaga

SEQ ID NO: 120784 - DNA, 25 bp, Rattus norvegicus
agatggccttgctcactgtctaaga

SEQ ID NO: 120785 - DNA, 25 bp, Rattus norvegicus
agatggcgaattccagtcggcctcg

SEQ ID NO: 120786 - DNA, 25 bp, Rattus norvegicus
agatggcgaattgcagtcggcctcg

SEQ ID NO: 120787 - DNA, 25 bp, Rattus norvegicus
agatggcgagccctactgtgagaca

SEQ ID NO: 120788 - DNA, 25 bp, Rattus norvegicus
agatggcgagccgtactgtgagaca

SEQ ID NO: 120789 - DNA, 25 bp, Rattus norvegicus
agatggcgaggaacctttacctctg

SEQ ID NO: 120790 - DNA, 25 bp, Rattus norvegicus
agatggcgaggatcctttacctctg

SEQ ID NO: 120791 - DNA, 25 bp, Rattus norvegicus
agatggcgcccaagctacagttaca

SEQ ID NO: 120792 - DNA, 25 bp, Rattus norvegicus
agatggcgcccatgctacagttaca

SEQ ID NO: 120793 - DNA, 25 bp, Rattus norvegicus
agatggcgctatcgcatgctctcac

SEQ ID NO: 120794 - DNA, 25 bp, Rattus norvegicus
agatggcgctatggcatgctctcac

SEQ ID NO: 120795 - DNA, 25 bp, Rattus norvegicus
agatggcgctggaccccgcagagca

SEQ ID NO: 120796 - DNA, 25 bp, Rattus norvegicus
agatggcgctggtccccgcagagca

SEQ ID NO: 120797 - DNA, 25 bp, Rattus norvegicus
agatggcggccaatcacgtcagcat

SEQ ID NO: 120798 - DNA, 25 bp, Rattus norvegicus
agatggcggccattcacgtcagcat

SEQ ID NO: 120799 - DNA, 25 bp, Rattus norvegicus
agatggcggctcagcggcattgtaa

SEQ ID NO: 120800 - DNA, 25 bp, Rattus norvegicus
agatggcggctctgcggcattgtaa

SEQ ID NO: 120801 - DNA, 25 bp, Rattus norvegicus
agatggcggctgaactatctggtac

SEQ ID NO: 120802 - DNA, 25 bp, Rattus norvegicus
agatggcggctgtactatctggtac

SEQ ID NO: 120803 - DNA, 25 bp, Rattus norvegicus
agatggctacacctattactataat

SEQ ID NO: 120804 - DNA, 25 bp, Rattus norvegicus
agatggctacacgtattactataat

SEQ ID NO: 120805 - DNA, 25 bp, Rattus norvegicus
agatggctacatcaactgccgggac

SEQ ID NO: 120806 - DNA, 25 bp, Rattus norvegicus
agatggctacatcggtttggcagat

SEQ ID NO: 120807 - DNA, 25 bp, Rattus norvegicus
agatggctacatgaactgccgggac

SEQ ID NO: 120808 - DNA, 25 bp, Rattus norvegicus
agatggctacatgggtttggcagat

SEQ ID NO: 120809 - DNA, 25 bp, Rattus norvegicus
agatggctacgcagaccaacagaaa

SEQ ID NO: 120810 - DNA, 25 bp, Rattus norvegicus
agatggctacgctgaccaacagaaa

SEQ ID NO: 120811 - DNA, 25 bp, Rattus norvegicus
agatggctatggatttcctcaactg

SEQ ID NO: 120812 - DNA, 25 bp, Rattus norvegicus
agatggctatggttttcctcaactg

SEQ ID NO: 120813 - DNA, 25 bp, Rattus norvegicus
agatggctcaagattcagtggcaaa

SEQ ID NO: 120814 - DNA, 25 bp, Rattus norvegicus
agatggctcaagtttcagtggcaaa

SEQ ID NO: 120815 - DNA, 25 bp, Rattus norvegicus
agatggctcactaggtaagccctgc

SEQ ID NO: 120816 - DNA, 25 bp, Rattus norvegicus
agatggctcacttggtaagccctgc

SEQ ID NO: 120817 - DNA, 25 bp, Rattus norvegicus
agatggctcagtcatcacccaagtt

SEQ ID NO: 120818 - DNA, 25 bp, Rattus norvegicus
agatggctcagtgatcacccaagtt

SEQ ID NO: 120819 - DNA, 25 bp, Rattus norvegicus
agatggctcccacgtggttgcttgc

SEQ ID NO: 120820 - DNA, 25 bp, Rattus norvegicus
agatggctcccaggtggttgcttgc

SEQ ID NO: 120821 - DNA, 25 bp, Rattus norvegicus
agatggctctcccttttgggcaact

SEQ ID NO: 120822 - DNA, 25 bp, Rattus norvegicus
agatggctctccgttttgggcaact

SEQ ID NO: 120823 - DNA, 25 bp, Rattus norvegicus
agatggctctggacagctctggaac

SEQ ID NO: 120824 - DNA, 25 bp, Rattus norvegicus
agatggctctggtcagctctggaac

SEQ ID NO: 120825 - DNA, 25 bp, Rattus norvegicus
agatggctcttgagccagtgagcac

SEQ ID NO: 120826 - DNA, 25 bp, Rattus norvegicus
agatggctcttgattttgctgttgg

SEQ ID NO: 120827 - DNA, 25 bp, Rattus norvegicus
agatggctcttgtgccagtgagcac

SEQ ID NO: 120828 - DNA, 25 bp, Rattus norvegicus
agatggctcttgtttttgctgttgg

SEQ ID NO: 120829 - DNA, 25 bp, Rattus norvegicus
agatggctctttcgtgtcgctgtcc

SEQ ID NO: 120830 - DNA, 25 bp, Rattus norvegicus
agatggctctttggtgtcgctgtcc

SEQ ID NO: 120831 - DNA, 25 bp, Rattus norvegicus
agatggctgcatacgaactgtttta

SEQ ID NO: 120832 - DNA, 25 bp, Rattus norvegicus
agatggctgcattcgaactgtttta

SEQ ID NO: 120833 - DNA, 25 bp, Rattus norvegicus
agatggctgcctcttgttgtttaag

SEQ ID NO: 120834 - DNA, 25 bp, Rattus norvegicus
agatggctgcctgttgttgtttaag

SEQ ID NO: 120835 - DNA, 25 bp, Rattus norvegicus
agatggctgctaacgtgctgctgtg

SEQ ID NO: 120836 - DNA, 25 bp, Rattus norvegicus
agatggctgctatcgtgctgctgtg

SEQ ID NO: 120837 - DNA, 25 bp, Rattus norvegicus
agatggctgcttattgtatgtttgt

SEQ ID NO: 120838 - DNA, 25 bp, Rattus norvegicus
agatggctgctttttgtatgtttgt

SEQ ID NO: 120839 - DNA, 25 bp, Rattus norvegicus
agatggctggatagctttcataacc

SEQ ID NO: 120840 - DNA, 25 bp, Rattus norvegicus
agatggctggattgctttcataacc

SEQ ID NO: 120841 - DNA, 25 bp, Rattus norvegicus
agatggctgtgactcatctctctgt

SEQ ID NO: 120842 - DNA, 25 bp, Rattus norvegicus
agatggctgtgagtcatctctctgt

SEQ ID NO: 120843 - DNA, 25 bp, Rattus norvegicus
agatggcttattatgcattcatgca

SEQ ID NO: 120844 - DNA, 25 bp, Rattus norvegicus
agatggcttattttgcattcatgca

SEQ ID NO: 120845 - DNA, 25 bp, Rattus norvegicus
agatggcttcagagccctgggccat

SEQ ID NO: 120846 - DNA, 25 bp, Rattus norvegicus
agatggcttcagtgccctgggccat

SEQ ID NO: 120847 - DNA, 25 bp, Rattus norvegicus
agatggcttccaagttttctcctag

SEQ ID NO: 120848 - DNA, 25 bp, Rattus norvegicus
agatggcttccatgttttctcctag

SEQ ID NO: 120849 - DNA, 25 bp, Rattus norvegicus
agatggcttcccacggactgtgaag

SEQ ID NO: 120850 - DNA, 25 bp, Rattus norvegicus
agatggcttccctcggactgtgaag

SEQ ID NO: 120851 - DNA, 25 bp, Rattus norvegicus
agatggcttcctagggatctgaaat

SEQ ID NO: 120852 - DNA, 25 bp, Rattus norvegicus
agatggcttccttgggatctgaaat

SEQ ID NO: 120853 - DNA, 25 bp, Rattus norvegicus
agatggcttcgtatgcttttaaaga

SEQ ID NO: 120854 - DNA, 25 bp, Rattus norvegicus
agatggcttcgtttgcttttaaaga

SEQ ID NO: 120855 - DNA, 25 bp, Rattus norvegicus
agatggcttctgactgtcagcctag

SEQ ID NO: 120856 - DNA, 25 bp, Rattus norvegicus
agatggcttctgtctgtcagcctag

SEQ ID NO: 120857 - DNA, 25 bp, Rattus norvegicus
agatggctttgactctccagcacta

SEQ ID NO: 120858 - DNA, 25 bp, Rattus norvegicus
agatggctttgagtctccagcacta

SEQ ID NO: 120859 - DNA, 25 bp, Rattus norvegicus
agatggctttgcctcttccagggaa

SEQ ID NO: 120860 - DNA, 25 bp, Rattus norvegicus
agatggctttgcgtcttccagggaa

SEQ ID NO: 120861 - DNA, 25 bp, Rattus norvegicus
agatgggaaccaactcctgggagct

SEQ ID NO: 120862 - DNA, 25 bp, Rattus norvegicus
agatgggaaccatctcctgggagct

SEQ ID NO: 120863 - DNA, 25 bp, Rattus norvegicus
agatgggaatcccaagcgcccaatg

SEQ ID NO: 120864 - DNA, 25 bp, Rattus norvegicus
agatgggaatccgaagcgcccaatg

SEQ ID NO: 120865 - DNA, 25 bp, Rattus norvegicus
agatgggaatgtaaccggcctcact

SEQ ID NO: 120866 - DNA, 25 bp, Rattus norvegicus
agatgggaatgttaccggcctcact

SEQ ID NO: 120867 - DNA, 25 bp, Rattus norvegicus
agatgggaccaaccacacgcctggt

SEQ ID NO: 120868 - DNA, 25 bp, Rattus norvegicus
agatgggaccaagcacacgcctggt

SEQ ID NO: 120869 - DNA, 25 bp, Rattus norvegicus
agatgggagccaactccttggctat

SEQ ID NO: 120870 - DNA, 25 bp, Rattus norvegicus
agatgggagccacctccatctacca

SEQ ID NO: 120871 - DNA, 25 bp, Rattus norvegicus
agatgggagccagctccatctacca

SEQ ID NO: 120872 - DNA, 25 bp, Rattus norvegicus
agatgggagccatctccttggctat

SEQ ID NO: 120873 - DNA, 25 bp, Rattus norvegicus
agatgggagcctacaggtccattgt

SEQ ID NO: 120874 - DNA, 25 bp, Rattus norvegicus
agatgggagccttcaggtccattgt

SEQ ID NO: 120875 - DNA, 25 bp, Rattus norvegicus
agatgggaggctattctgtcactct

SEQ ID NO: 120876 - DNA, 25 bp, Rattus norvegicus
agatgggaggcttttctgtcactct

SEQ ID NO: 120877 - DNA, 25 bp, Rattus norvegicus
agatgggatcaccacctccagagat

SEQ ID NO: 120878 - DNA, 25 bp, Rattus norvegicus
agatgggatcacgacctccagagat

SEQ ID NO: 120879 - DNA, 25 bp, Rattus norvegicus
agatgggatctcaaggtggcctcac

SEQ ID NO: 120880 - DNA, 25 bp, Rattus norvegicus
agatgggatctctaggtggcctcac

SEQ ID NO: 120881 - DNA, 25 bp, Rattus norvegicus
agatgggattccaggtgttcactac

SEQ ID NO: 120882 - DNA, 25 bp, Rattus norvegicus
agatgggattcctggtgttcactac

SEQ ID NO: 120883 - DNA, 25 bp, Rattus norvegicus
agatgggcacatccagcacgctgtg

SEQ ID NO: 120884 - DNA, 25 bp, Rattus norvegicus
agatgggcacatgcagcacgctgtg

SEQ ID NO: 120885 - DNA, 25 bp, Rattus norvegicus
agatgggcaccccaacacttggctt

SEQ ID NO: 120886 - DNA, 25 bp, Rattus norvegicus
agatgggcacccgaacacttggctt

SEQ ID NO: 120887 - DNA, 25 bp, Rattus norvegicus
agatgggcacctacctgaggttcat

SEQ ID NO: 120888 - DNA, 25 bp, Rattus norvegicus
agatgggcaccttcctgaggttcat

SEQ ID NO: 120889 - DNA, 25 bp, Rattus norvegicus
agatgggcatggcttgctcacttct

SEQ ID NO: 120890 - DNA, 25 bp, Rattus norvegicus
agatgggcatgggttgctcacttct

SEQ ID NO: 120891 - DNA, 25 bp, Rattus norvegicus
agatgggccctcaggaattgcagct

SEQ ID NO: 120892 - DNA, 25 bp, Rattus norvegicus
agatgggccctctggaattgcagct

SEQ ID NO: 120893 - DNA, 25 bp, Rattus norvegicus
agatgggcctcaacttcgaggtggc

SEQ ID NO: 120894 - DNA, 25 bp, Rattus norvegicus
agatgggcctcatcttcgaggtggc

SEQ ID NO: 120895 - DNA, 25 bp, Rattus norvegicus
agatgggccttaatctgtccactaa

SEQ ID NO: 120896 - DNA, 25 bp, Rattus norvegicus
agatgggccttattctgtccactaa

SEQ ID NO: 120897 - DNA, 25 bp, Rattus norvegicus
agatgggccttcctgggtacacaac

SEQ ID NO: 120898 - DNA, 25 bp, Rattus norvegicus
agatgggccttcgtgggtacacaac

SEQ ID NO: 120899 - DNA, 25 bp, Rattus norvegicus
agatgggcgagtacttccagatcca

SEQ ID NO: 120900 - DNA, 25 bp, Rattus norvegicus
agatgggcgagttcttccagatcca

SEQ ID NO: 120901 - DNA, 25 bp, Rattus norvegicus
agatgggctccaactttcagctgtt

SEQ ID NO: 120902 - DNA, 25 bp, Rattus norvegicus
agatgggctccatctttcagctgtt

SEQ ID NO: 120903 - DNA, 25 bp, Rattus norvegicus
agatgggctcctatgtactgactta

SEQ ID NO: 120904 - DNA, 25 bp, Rattus norvegicus
agatgggctcctccacactcacata

SEQ ID NO: 120905 - DNA, 25 bp, Rattus norvegicus
agatgggctcctgcacactcacata

SEQ ID NO: 120906 - DNA, 25 bp, Rattus norvegicus
agatgggctcctttgtactgactta

SEQ ID NO: 120907 - DNA, 25 bp, Rattus norvegicus
agatgggcttggcatgtgaattcca

SEQ ID NO: 120908 - DNA, 25 bp, Rattus norvegicus
agatgggcttgggatgtgaattcca

SEQ ID NO: 120909 - DNA, 25 bp, Rattus norvegicus
agatggggcaggaacagctcccaga

SEQ ID NO: 120910 - DNA, 25 bp, Rattus norvegicus
agatggggcaggtacagctcccaga

SEQ ID NO: 120911 - DNA, 25 bp, Rattus norvegicus
agatgggtacacctggcttggcaca

SEQ ID NO: 120912 - DNA, 25 bp, Rattus norvegicus
agatgggtacacgtggcttggcaca

SEQ ID NO: 120913 - DNA, 25 bp, Rattus norvegicus
agatgggtagacagacctccttcgg

SEQ ID NO: 120914 - DNA, 25 bp, Rattus norvegicus
agatgggtagactgacctccttcgg

SEQ ID NO: 120915 - DNA, 25 bp, Rattus norvegicus
agatgggtatcgacttgtggttaac

SEQ ID NO: 120916 - DNA, 25 bp, Rattus norvegicus
agatgggtatcgtcttgtggttaac

SEQ ID NO: 120917 - DNA, 25 bp, Rattus norvegicus
agatgggtattcactgttattttga

SEQ ID NO: 120918 - DNA, 25 bp, Rattus norvegicus
agatgggtattctctgttattttga

SEQ ID NO: 120919 - DNA, 25 bp, Rattus norvegicus
agatgggtcccacctgtagcattat

SEQ ID NO: 120920 - DNA, 25 bp, Rattus norvegicus
agatgggtcccagctgtagcattat

SEQ ID NO: 120921 - DNA, 25 bp, Rattus norvegicus
agatgggtgagtcttctctgtccac

SEQ ID NO: 120922 - DNA, 25 bp, Rattus norvegicus
agatgggtgagtgttctctgtccac

SEQ ID NO: 120923 - DNA, 25 bp, Rattus norvegicus
agatgggtgcacatgaatccatggg

SEQ ID NO: 120924 - DNA, 25 bp, Rattus norvegicus
agatgggtgcacttgaatccatggg

SEQ ID NO: 120925 - DNA, 25 bp, Rattus norvegicus
agatgggtggccactctgtgcataa

SEQ ID NO: 120926 - DNA, 25 bp, Rattus norvegicus
agatgggtggcctctctgtgcataa

SEQ ID NO: 120927 - DNA, 25 bp, Rattus norvegicus
agatgggttccaagcagttctccag

SEQ ID NO: 120928 - DNA, 25 bp, Rattus norvegicus
agatgggttccatgcagttctccag

SEQ ID NO: 120929 - DNA, 25 bp, Rattus norvegicus
agatgggttcctacatacgtctgaa

SEQ ID NO: 120930 - DNA, 25 bp, Rattus norvegicus
agatgggttccttcatacgtctgaa

SEQ ID NO: 120931 - DNA, 25 bp, Rattus norvegicus
agatgggttctcagtcgaccaaaat

SEQ ID NO: 120932 - DNA, 25 bp, Rattus norvegicus
agatgggttctctgtcgaccaaaat

SEQ ID NO: 120933 - DNA, 25 bp, Rattus norvegicus
agatgggttgctatttgccttccag

SEQ ID NO: 120934 - DNA, 25 bp, Rattus norvegicus
agatgggttgctttttgccttccag

SEQ ID NO: 120935 - DNA, 25 bp, Rattus norvegicus
agatgggttggaaaaatggttcaat

SEQ ID NO: 120936 - DNA, 25 bp, Rattus norvegicus
agatgggttggataaatggttcaat

SEQ ID NO: 120937 - DNA, 25 bp, Rattus norvegicus
agatgggtttccctccagctttgat

SEQ ID NO: 120938 - DNA, 25 bp, Rattus norvegicus
agatgggtttccgtccagctttgat

SEQ ID NO: 120939 - DNA, 25 bp, Rattus norvegicus
agatggtaatttcagtagtgtccga

SEQ ID NO: 120940 - DNA, 25 bp, Rattus norvegicus
agatggtaatttgagtagtgtccga

SEQ ID NO: 120941 - DNA, 25 bp, Rattus norvegicus
agatggtacaagaggtccccgcagt

SEQ ID NO: 120942 - DNA, 25 bp, Rattus norvegicus
agatggtacaagtggtccccgcagt

SEQ ID NO: 120943 - DNA, 25 bp, Rattus norvegicus
agatggtactgtatctctgtagcct

SEQ ID NO: 120944 - DNA, 25 bp, Rattus norvegicus
agatggtactgtttctctgtagcct

SEQ ID NO: 120945 - DNA, 25 bp, Rattus norvegicus
agatggtagtggattgtcgcccacc

SEQ ID NO: 120946 - DNA, 25 bp, Rattus norvegicus
agatggtagtggtttgtcgcccacc

SEQ ID NO: 120947 - DNA, 25 bp, Rattus norvegicus
agatggtatacgacagccccgtgtg

SEQ ID NO: 120948 - DNA, 25 bp, Rattus norvegicus
agatggtatacgtcagccccgtgtg

SEQ ID NO: 120949 - DNA, 25 bp, Rattus norvegicus
agatggtatgtcactagcttctgct

SEQ ID NO: 120950 - DNA, 25 bp, Rattus norvegicus
agatggtatgtctctagcttctgct

SEQ ID NO: 120951 - DNA, 25 bp, Rattus norvegicus
agatggtcaccaagaactcccttat

SEQ ID NO: 120952 - DNA, 25 bp, Rattus norvegicus
agatggtcaccatgaactcccttat

SEQ ID NO: 120953 - DNA, 25 bp, Rattus norvegicus
agatggtcacctcatgccggcgaag

SEQ ID NO: 120954 - DNA, 25 bp, Rattus norvegicus
agatggtcacctgatgccggcgaag

SEQ ID NO: 120955 - DNA, 25 bp, Rattus norvegicus
agatggtcactaactatgctgcaat

SEQ ID NO: 120956 - DNA, 25 bp, Rattus norvegicus
agatggtcactactcacctggtccc

SEQ ID NO: 120957 - DNA, 25 bp, Rattus norvegicus
agatggtcactagtcacctggtccc

SEQ ID NO: 120958 - DNA, 25 bp, Rattus norvegicus
agatggtcactatctatgctgcaat

SEQ ID NO: 120959 - DNA, 25 bp, Rattus norvegicus
agatggtccaacacaccaagtgtcg

SEQ ID NO: 120960 - DNA, 25 bp, Rattus norvegicus
agatggtccaactcaccaagtgtcg

SEQ ID NO: 120961 - DNA, 25 bp, Rattus norvegicus
agatggtccctgagttctgtccaca

SEQ ID NO: 120962 - DNA, 25 bp, Rattus norvegicus
agatggtccctgtgttctgtccaca

SEQ ID NO: 120963 - DNA, 25 bp, Rattus norvegicus
agatggtccttccatgatgttccga

SEQ ID NO: 120964 - DNA, 25 bp, Rattus norvegicus
agatggtccttcgatgatgttccga

SEQ ID NO: 120965 - DNA, 25 bp, Rattus norvegicus
agatggtctcagattttgctggctg

SEQ ID NO: 120966 - DNA, 25 bp, Rattus norvegicus
agatggtctcagtttttgctggctg

SEQ ID NO: 120967 - DNA, 25 bp, Rattus norvegicus
agatggtctgccaggtgaacgctga

SEQ ID NO: 120968 - DNA, 25 bp, Rattus norvegicus
agatggtctgccctggaaaccctgt

SEQ ID NO: 120969 - DNA, 25 bp, Rattus norvegicus
agatggtctgccgtggaaaccctgt

SEQ ID NO: 120970 - DNA, 25 bp, Rattus norvegicus
agatggtctgcctggtgaacgctga

SEQ ID NO: 120971 - DNA, 25 bp, Rattus norvegicus
agatggtgagtaccttttcccttgt

SEQ ID NO: 120972 - DNA, 25 bp, Rattus norvegicus
agatggtgagtagcttttcccttgt

SEQ ID NO: 120973 - DNA, 25 bp, Rattus norvegicus
agatggtgagttaccctaggctgga

SEQ ID NO: 120974 - DNA, 25 bp, Rattus norvegicus
agatggtgagtttccctaggctgga

SEQ ID NO: 120975 - DNA, 25 bp, Rattus norvegicus
agatggtgatagcttttcctttcct

SEQ ID NO: 120976 - DNA, 25 bp, Rattus norvegicus
agatggtgataggttttcctttcct

SEQ ID NO: 120977 - DNA, 25 bp, Rattus norvegicus
agatggtgcagtctttcttaaggct

SEQ ID NO: 120978 - DNA, 25 bp, Rattus norvegicus
agatggtgcagtgtttcttaaggct

SEQ ID NO: 120979 - DNA, 25 bp, Rattus norvegicus
agatggtgcatgcagccacccgaat

SEQ ID NO: 120980 - DNA, 25 bp, Rattus norvegicus
agatggtgcatggagccacccgaat

SEQ ID NO: 120981 - DNA, 25 bp, Rattus norvegicus
agatggtgcctgcttcccgggaaaa

SEQ ID NO: 120982 - DNA, 25 bp, Rattus norvegicus
agatggtgcctggttcccgggaaaa

SEQ ID NO: 120983 - DNA, 25 bp, Rattus norvegicus
agatggtgcgctccaagttgcccaa

SEQ ID NO: 120984 - DNA, 25 bp, Rattus norvegicus
agatggtgcgctgcaagttgcccaa

SEQ ID NO: 120985 - DNA, 25 bp, Rattus norvegicus
agatggtggatgatttcctcactgt

SEQ ID NO: 120986 - DNA, 25 bp, Rattus norvegicus
agatggtggatgttttcctcactgt

SEQ ID NO: 120987 - DNA, 25 bp, Rattus norvegicus
agatggtggcgtaccacaaggccat

SEQ ID NO: 120988 - DNA, 25 bp, Rattus norvegicus
agatggtggcgttccacaaggccat

SEQ ID NO: 120989 - DNA, 25 bp, Rattus norvegicus
agatggtggctgacttggacttcct

SEQ ID NO: 120990 - DNA, 25 bp, Rattus norvegicus
agatggtggctgtcttggacttcct

SEQ ID NO: 120991 - DNA, 25 bp, Rattus norvegicus
agatggtgggcacacacccctcaag

SEQ ID NO: 120992 - DNA, 25 bp, Rattus norvegicus
agatggtgggcagacacccctcaag

SEQ ID NO: 120993 - DNA, 25 bp, Rattus norvegicus
agatggtggtctaagcctacgcttg

SEQ ID NO: 120994 - DNA, 25 bp, Rattus norvegicus
agatggtggtcttagcctacgcttg

SEQ ID NO: 120995 - DNA, 25 bp, Rattus norvegicus
agatggtgtatgatggcctgttact

SEQ ID NO: 120996 - DNA, 25 bp, Rattus norvegicus
agatggtgtatgttggcctgttact

SEQ ID NO: 120997 - DNA, 25 bp, Rattus norvegicus
agatggtgtgcaagtctcgagctga

SEQ ID NO: 120998 - DNA, 25 bp, Rattus norvegicus
agatggtgtgcatgtctcgagctga

SEQ ID NO: 120999 - DNA, 25 bp, Rattus norvegicus
agatggtgtggacttctctggccca

SEQ ID NO: 121000 - DNA, 25 bp, Rattus norvegicus
agatggtgtggagttctctggccca

SEQ ID NO: 121001 - DNA, 25 bp, Rattus norvegicus
agatggtgtggcatccggagcacat

SEQ ID NO: 121002 - DNA, 25 bp, Rattus norvegicus
agatggtgtggcttccggagcacat

SEQ ID NO: 121003 - DNA, 25 bp, Rattus norvegicus
agatggtgtgtcacaggagctcttc

SEQ ID NO: 121004 - DNA, 25 bp, Rattus norvegicus
agatggtgtgtctcaggagctcttc

SEQ ID NO: 121005 - DNA, 25 bp, Rattus norvegicus
agatggtgtgtgaagcccttgtgct

SEQ ID NO: 121006 - DNA, 25 bp, Rattus norvegicus
agatggtgtgtgtagcccttgtgct

SEQ ID NO: 121007 - DNA, 25 bp, Rattus norvegicus
agatggttaaaaaccacagacttta

SEQ ID NO: 121008 - DNA, 25 bp, Rattus norvegicus
agatggttaaaatccacagacttta

SEQ ID NO: 121009 - DNA, 25 bp, Rattus norvegicus
agatggttaactctcccatgggact

SEQ ID NO: 121010 - DNA, 25 bp, Rattus norvegicus
agatggttaactgtcccatgggact

SEQ ID NO: 121011 - DNA, 25 bp, Rattus norvegicus
agatggttaattccctctagctgtg

SEQ ID NO: 121012 - DNA, 25 bp, Rattus norvegicus
agatggttaattgcctctagctgtg

SEQ ID NO: 121013 - DNA, 25 bp, Rattus norvegicus
agatggttcagcattgactgccctt

SEQ ID NO: 121014 - DNA, 25 bp, Rattus norvegicus
agatggttcagctttgactgccctt

SEQ ID NO: 121015 - DNA, 25 bp, Rattus norvegicus
agatggttccttaagggtctcaaca

SEQ ID NO: 121016 - DNA, 25 bp, Rattus norvegicus
agatggttcctttagggtctcaaca

SEQ ID NO: 121017 - DNA, 25 bp, Rattus norvegicus
agatggttcgagaggtttgctccaa

SEQ ID NO: 121018 - DNA, 25 bp, Rattus norvegicus
agatggttcgagtggtttgctccaa

SEQ ID NO: 121019 - DNA, 25 bp, Rattus norvegicus
agatggttctaacccatgtctgctg

SEQ ID NO: 121020 - DNA, 25 bp, Rattus norvegicus
agatggttctaagccatgtctgctg

SEQ ID NO: 121021 - DNA, 25 bp, Rattus norvegicus
agatggttctcacacccgacattaa

SEQ ID NO: 121022 - DNA, 25 bp, Rattus norvegicus
agatggttctcagacccgacattaa

SEQ ID NO: 121023 - DNA, 25 bp, Rattus norvegicus
agatggttctccatactgctttgca

SEQ ID NO: 121024 - DNA, 25 bp, Rattus norvegicus
agatggttctccttactgctttgca

SEQ ID NO: 121025 - DNA, 25 bp, Rattus norvegicus
agatggttctggctctctgcagcca

SEQ ID NO: 121026 - DNA, 25 bp, Rattus norvegicus
agatggttctgggtctctgcagcca

SEQ ID NO: 121027 - DNA, 25 bp, Rattus norvegicus
agatggttctttcacaccttctaag

SEQ ID NO: 121028 - DNA, 25 bp, Rattus norvegicus
agatggttctttgacaccttctaag

SEQ ID NO: 121029 - DNA, 25 bp, Rattus norvegicus
agatggttgagcacttgtttgtggc

SEQ ID NO: 121030 - DNA, 25 bp, Rattus norvegicus
agatggttgagctcttgtttgtggc

SEQ ID NO: 121031 - DNA, 25 bp, Rattus norvegicus
agatggttggatctctgtgagtacc

SEQ ID NO: 121032 - DNA, 25 bp, Rattus norvegicus
agatggttggatgtctgtgagtacc

SEQ ID NO: 121033 - DNA, 25 bp, Rattus norvegicus
agatggttggttaccgtcttctcca

SEQ ID NO: 121034 - DNA, 25 bp, Rattus norvegicus
agatggttggtttccgtcttctcca

SEQ ID NO: 121035 - DNA, 25 bp, Rattus norvegicus
agatggttgtacagctcatttccct

SEQ ID NO: 121036 - DNA, 25 bp, Rattus norvegicus
agatggttgtactgctcatttccct

SEQ ID NO: 121037 - DNA, 25 bp, Rattus norvegicus
agatggttgtggagtacctggcctc

SEQ ID NO: 121038 - DNA, 25 bp, Rattus norvegicus
agatggttgtggtgtacctggcctc

SEQ ID NO: 121039 - DNA, 25 bp, Rattus norvegicus
agatggtttcataagcgtgttcgaa

SEQ ID NO: 121040 - DNA, 25 bp, Rattus norvegicus
agatggtttcatacagcgtcacctt

SEQ ID NO: 121041 - DNA, 25 bp, Rattus norvegicus
agatggtttcattagcgtgttcgaa

SEQ ID NO: 121042 - DNA, 25 bp, Rattus norvegicus
agatggtttcattcagcgtcacctt

SEQ ID NO: 121043 - DNA, 25 bp, Rattus norvegicus
agatggttttctatgcccaatctag

SEQ ID NO: 121044 - DNA, 25 bp, Rattus norvegicus
agatggttttctttgcccaatctag

SEQ ID NO: 121045 - DNA, 25 bp, Rattus norvegicus
agatggttttgtcacaccttttcac

SEQ ID NO: 121046 - DNA, 25 bp, Rattus norvegicus
agatggttttgtgacaccttttcac

SEQ ID NO: 121047 - DNA, 25 bp, Rattus norvegicus
agatgtaaaagccacctgttgcaga

SEQ ID NO: 121048 - DNA, 25 bp, Rattus norvegicus
agatgtaaaagcgacctgttgcaga

SEQ ID NO: 121049 - DNA, 25 bp, Rattus norvegicus
agatgtaaacatatcctgggtggaa

SEQ ID NO: 121050 - DNA, 25 bp, Rattus norvegicus
agatgtaaacatttcctgggtggaa

SEQ ID NO: 121051 - DNA, 25 bp, Rattus norvegicus
agatgtaaactcacagtgactgctc

SEQ ID NO: 121052 - DNA, 25 bp, Rattus norvegicus
agatgtaaactctcagtgactgctc

SEQ ID NO: 121053 - DNA, 25 bp, Rattus norvegicus
agatgtaaagacctcgaagcccacc

SEQ ID NO: 121054 - DNA, 25 bp, Rattus norvegicus
agatgtaaagacgtcgaagcccacc

SEQ ID NO: 121055 - DNA, 25 bp, Rattus norvegicus
agatgtaaatgcactcctgcctcta

SEQ ID NO: 121056 - DNA, 25 bp, Rattus norvegicus
agatgtaaatgctctcctgcctcta

SEQ ID NO: 121057 - DNA, 25 bp, Rattus norvegicus
agatgtaacctcaccaatggccttt

SEQ ID NO: 121058 - DNA, 25 bp, Rattus norvegicus
agatgtaacctctccaatggccttt

SEQ ID NO: 121059 - DNA, 25 bp, Rattus norvegicus
agatgtaacctgaggctcagagtat

SEQ ID NO: 121060 - DNA, 25 bp, Rattus norvegicus
agatgtaacctgtggctcagagtat

SEQ ID NO: 121061 - DNA, 25 bp, Rattus norvegicus
agatgtaagcggagtaaggccagat

SEQ ID NO: 121062 - DNA, 25 bp, Rattus norvegicus
agatgtaagcggtgtaaggccagat

SEQ ID NO: 121063 - DNA, 25 bp, Rattus norvegicus
agatgtaagctaactgctgtgtcag

SEQ ID NO: 121064 - DNA, 25 bp, Rattus norvegicus
agatgtaagctatctgctgtgtcag

SEQ ID NO: 121065 - DNA, 25 bp, Rattus norvegicus
agatgtaagttcatatccactcccc

SEQ ID NO: 121066 - DNA, 25 bp, Rattus norvegicus
agatgtaagttcttatccactcccc

SEQ ID NO: 121067 - DNA, 25 bp, Rattus norvegicus
agatgtacactgagcagagcccctg

SEQ ID NO: 121068 - DNA, 25 bp, Rattus norvegicus
agatgtacactgtgcagagcccctg

SEQ ID NO: 121069 - DNA, 25 bp, Rattus norvegicus
agatgtacagtgagtaccctccagg

SEQ ID NO: 121070 - DNA, 25 bp, Rattus norvegicus
agatgtacagtgtgtaccctccagg

SEQ ID NO: 121071 - DNA, 25 bp, Rattus norvegicus
agatgtacatacaccactgtctgct

SEQ ID NO: 121072 - DNA, 25 bp, Rattus norvegicus
agatgtacatactccactgtctgct

SEQ ID NO: 121073 - DNA, 25 bp, Rattus norvegicus
agatgtacatcactagttcccgaga

SEQ ID NO: 121074 - DNA, 25 bp, Rattus norvegicus
agatgtacatcagtagttcccgaga

SEQ ID NO: 121075 - DNA, 25 bp, Rattus norvegicus
agatgtacatgaacctgccccaggg

SEQ ID NO: 121076 - DNA, 25 bp, Rattus norvegicus
agatgtacatgatcctgccccaggg

SEQ ID NO: 121077 - DNA, 25 bp, Rattus norvegicus
agatgtaccgaacggagttcttaca

SEQ ID NO: 121078 - DNA, 25 bp, Rattus norvegicus
agatgtaccgaagggagttcttaca

SEQ ID NO: 121079 - DNA, 25 bp, Rattus norvegicus
agatgtacctctatgcaacgcacga

SEQ ID NO: 121080 - DNA, 25 bp, Rattus norvegicus
agatgtacctctttgcaacgcacga

SEQ ID NO: 121081 - DNA, 25 bp, Rattus norvegicus
agatgtacgattaccttctccacgg

SEQ ID NO: 121082 - DNA, 25 bp, Rattus norvegicus
agatgtacgatttccttctccacgg

SEQ ID NO: 121083 - DNA, 25 bp, Rattus norvegicus
agatgtagacacctttgctctgctt

SEQ ID NO: 121084 - DNA, 25 bp, Rattus norvegicus
agatgtagacacgtttgctctgctt

SEQ ID NO: 121085 - DNA, 25 bp, Rattus norvegicus
agatgtagacagagggctggcacct

SEQ ID NO: 121086 - DNA, 25 bp, Rattus norvegicus
agatgtagacagtgggctggcacct

SEQ ID NO: 121087 - DNA, 25 bp, Rattus norvegicus
agatgtagccatattgaacatcttg

SEQ ID NO: 121088 - DNA, 25 bp, Rattus norvegicus
agatgtagccattttgaacatcttg

SEQ ID NO: 121089 - DNA, 25 bp, Rattus norvegicus
agatgtagttctcacgtgccctgcc

SEQ ID NO: 121090 - DNA, 25 bp, Rattus norvegicus
agatgtagttctgacgtgccctgcc

SEQ ID NO: 121091 - DNA, 25 bp, Rattus norvegicus
agatgtatctttatgttcgcttgga

SEQ ID NO: 121092 - DNA, 25 bp, Rattus norvegicus
agatgtatctttttgttcgcttgga

SEQ ID NO: 121093 - DNA, 25 bp, Rattus norvegicus
agatgtatggtgctgacttggcccc

SEQ ID NO: 121094 - DNA, 25 bp, Rattus norvegicus
agatgtatggtggtgacttggcccc

SEQ ID NO: 121095 - DNA, 25 bp, Rattus norvegicus
agatgtatgtatccgttcatgggct

SEQ ID NO: 121096 - DNA, 25 bp, Rattus norvegicus
agatgtatgtatgcgttcatgggct

SEQ ID NO: 121097 - DNA, 25 bp, Rattus norvegicus
agatgtattatgactcgggcaaatt

SEQ ID NO: 121098 - DNA, 25 bp, Rattus norvegicus
agatgtattatgtctcgggcaaatt

SEQ ID NO: 121099 - DNA, 25 bp, Rattus norvegicus
agatgtattgttacctatattgcta

SEQ ID NO: 121100 - DNA, 25 bp, Rattus norvegicus
agatgtattgtttcctatattgcta

SEQ ID NO: 121101 - DNA, 25 bp, Rattus norvegicus
agatgtatttataggccccgggcag

SEQ ID NO: 121102 - DNA, 25 bp, Rattus norvegicus
agatgtatttattggccccgggcag

SEQ ID NO: 121103 - DNA, 25 bp, Rattus norvegicus
agatgtattttaatccctccagctt

SEQ ID NO: 121104 - DNA, 25 bp, Rattus norvegicus
agatgtattttattccctccagctt

SEQ ID NO: 121105 - DNA, 25 bp, Rattus norvegicus
agatgtcaaagcctcgtgctgtttc

SEQ ID NO: 121106 - DNA, 25 bp, Rattus norvegicus
agatgtcaaagcgtcgtgctgtttc

SEQ ID NO: 121107 - DNA, 25 bp, Rattus norvegicus
agatgtcaaaggatgttcctttcca

SEQ ID NO: 121108 - DNA, 25 bp, Rattus norvegicus
agatgtcaaaggttgttcctttcca

SEQ ID NO: 121109 - DNA, 25 bp, Rattus norvegicus
agatgtcaaccacccttagcgtatc

SEQ ID NO: 121110 - DNA, 25 bp, Rattus norvegicus
agatgtcaaccagccttagcgtatc

SEQ ID NO: 121111 - DNA, 25 bp, Rattus norvegicus
agatgtcaagatctgtctcctccac

SEQ ID NO: 121112 - DNA, 25 bp, Rattus norvegicus
agatgtcaagatgtgtctcctccac

SEQ ID NO: 121113 - DNA, 25 bp, Rattus norvegicus
agatgtcaaggaaccattgtgcaga

SEQ ID NO: 121114 - DNA, 25 bp, Rattus norvegicus
agatgtcaaggatccattgtgcaga

SEQ ID NO: 121115 - DNA, 25 bp, Rattus norvegicus
agatgtcaaggcagttcggtgcact

SEQ ID NO: 121116 - DNA, 25 bp, Rattus norvegicus
agatgtcaaggctgttcggtgcact

SEQ ID NO: 121117 - DNA, 25 bp, Rattus norvegicus
agatgtcaagttcttctgggctatt

SEQ ID NO: 121118 - DNA, 25 bp, Rattus norvegicus
agatgtcaagttgttctgggctatt

SEQ ID NO: 121119 - DNA, 25 bp, Rattus norvegicus
agatgtcaataactcgccctgctac

SEQ ID NO: 121120 - DNA, 25 bp, Rattus norvegicus
agatgtcaataagtcgccctgctac

SEQ ID NO: 121121 - DNA, 25 bp, Rattus norvegicus
agatgtcaccatccctagttccttg

SEQ ID NO: 121122 - DNA, 25 bp, Rattus norvegicus
agatgtcaccatgcctagttccttg

SEQ ID NO: 121123 - DNA, 25 bp, Rattus norvegicus
agatgtcaccccaggtggacaacat

SEQ ID NO: 121124 - DNA, 25 bp, Rattus norvegicus
agatgtcacccctggtggacaacat

SEQ ID NO: 121125 - DNA, 25 bp, Rattus norvegicus
agatgtcactgaaattttccccttt

SEQ ID NO: 121126 - DNA, 25 bp, Rattus norvegicus
agatgtcactgatattttccccttt

SEQ ID NO: 121127 - DNA, 25 bp, Rattus norvegicus
agatgtcacttcatcctttaaggct

SEQ ID NO: 121128 - DNA, 25 bp, Rattus norvegicus
agatgtcacttcttcctttaaggct

SEQ ID NO: 121129 - DNA, 25 bp, Rattus norvegicus
agatgtcagggtatgcccacaaatg

SEQ ID NO: 121130 - DNA, 25 bp, Rattus norvegicus
agatgtcagggtttgcccacaaatg

SEQ ID NO: 121131 - DNA, 25 bp, Rattus norvegicus
agatgtcagtttcccgctctgcgaa

SEQ ID NO: 121132 - DNA, 25 bp, Rattus norvegicus
agatgtcagtttctgcctcaggcat

SEQ ID NO: 121133 - DNA, 25 bp, Rattus norvegicus
agatgtcagtttgccgctctgcgaa

SEQ ID NO: 121134 - DNA, 25 bp, Rattus norvegicus
agatgtcagtttgtgcctcaggcat

SEQ ID NO: 121135 - DNA, 25 bp, Rattus norvegicus
agatgtcatccaagaccatccccga

SEQ ID NO: 121136 - DNA, 25 bp, Rattus norvegicus
agatgtcatccatgaccatccccga

SEQ ID NO: 121137 - DNA, 25 bp, Rattus norvegicus
agatgtccaggtcgtacagcacctc

SEQ ID NO: 121138 - DNA, 25 bp, Rattus norvegicus
agatgtccaggtggtacagcacctc

SEQ ID NO: 121139 - DNA, 25 bp, Rattus norvegicus
agatgtccatcaccatggtcagcag

SEQ ID NO: 121140 - DNA, 25 bp, Rattus norvegicus
agatgtccatcagcatggtcagcag

SEQ ID NO: 121141 - DNA, 25 bp, Rattus norvegicus
agatgtccatctctgtcttttgaga

SEQ ID NO: 121142 - DNA, 25 bp, Rattus norvegicus
agatgtccatctgtgtcttttgaga

SEQ ID NO: 121143 - DNA, 25 bp, Rattus norvegicus
agatgtccattgatgaactgtcccc

SEQ ID NO: 121144 - DNA, 25 bp, Rattus norvegicus
agatgtccattgttgaactgtcccc

SEQ ID NO: 121145 - DNA, 25 bp, Rattus norvegicus
agatgtcccagcactgtggtaggaa

SEQ ID NO: 121146 - DNA, 25 bp, Rattus norvegicus
agatgtcccagctctgtggtaggaa

SEQ ID NO: 121147 - DNA, 25 bp, Rattus norvegicus
agatgtcccataacatcctgacagg

SEQ ID NO: 121148 - DNA, 25 bp, Rattus norvegicus
agatgtcccatatcatcctgacagg

SEQ ID NO: 121149 - DNA, 25 bp, Rattus norvegicus
agatgtccccttatgtggcaaccag

SEQ ID NO: 121150 - DNA, 25 bp, Rattus norvegicus
agatgtccccttttgtggcaaccag

SEQ ID NO: 121151 - DNA, 25 bp, Rattus norvegicus
agatgtccgtgaactctggtgacca

SEQ ID NO: 121152 - DNA, 25 bp, Rattus norvegicus
agatgtccgtgatctctggtgacca

SEQ ID NO: 121153 - DNA, 25 bp, Rattus norvegicus
agatgtcctattccttgttcacaaa

SEQ ID NO: 121154 - DNA, 25 bp, Rattus norvegicus
agatgtcctattgcttgttcacaaa

SEQ ID NO: 121155 - DNA, 25 bp, Rattus norvegicus
agatgtcctcggatcttcacatatg

SEQ ID NO: 121156 - DNA, 25 bp, Rattus norvegicus
agatgtcctcggttcttcacatatg

SEQ ID NO: 121157 - DNA, 25 bp, Rattus norvegicus
agatgtcctcgtagaaactgaagaa

SEQ ID NO: 121158 - DNA, 25 bp, Rattus norvegicus
agatgtcctcgttgaaactgaagaa

SEQ ID NO: 121159 - DNA, 25 bp, Rattus norvegicus
agatgtcctttgagtttgctaacag

SEQ ID NO: 121160 - DNA, 25 bp, Rattus norvegicus
agatgtcctttgtgtttgctaacag

SEQ ID NO: 121161 - DNA, 25 bp, Rattus norvegicus
agatgtcgcgagcagctaatcgccg

SEQ ID NO: 121162 - DNA, 25 bp, Rattus norvegicus
agatgtcgcgaggagctaatcgccg

SEQ ID NO: 121163 - DNA, 25 bp, Rattus norvegicus
agatgtcggtgtctaccatggcagc

SEQ ID NO: 121164 - DNA, 25 bp, Rattus norvegicus
agatgtcggtgtgtaccatggcagc

SEQ ID NO: 121165 - DNA, 25 bp, Rattus norvegicus
agatgtcgtcgtagccaaggagcga

SEQ ID NO: 121166 - DNA, 25 bp, Rattus norvegicus
agatgtcgtcgttgccaaggagcga

SEQ ID NO: 121167 - DNA, 25 bp, Rattus norvegicus
agatgtctaactactggcttcaata

SEQ ID NO: 121168 - DNA, 25 bp, Rattus norvegicus
agatgtctaacttctggcttcaata

SEQ ID NO: 121169 - DNA, 25 bp, Rattus norvegicus
agatgtctacacagagctccttcaa

SEQ ID NO: 121170 - DNA, 25 bp, Rattus norvegicus
agatgtctacactgagctccttcaa

SEQ ID NO: 121171 - DNA, 25 bp, Rattus norvegicus
agatgtctaggtcatccttaggcaa

SEQ ID NO: 121172 - DNA, 25 bp, Rattus norvegicus
agatgtctaggtgatccttaggcaa

SEQ ID NO: 121173 - DNA, 25 bp, Rattus norvegicus
agatgtctatctcagctgttctcta

SEQ ID NO: 121174 - DNA, 25 bp, Rattus norvegicus
agatgtctatctcagtcctgctacg

SEQ ID NO: 121175 - DNA, 25 bp, Rattus norvegicus
agatgtctatctgagctgttctcta

SEQ ID NO: 121176 - DNA, 25 bp, Rattus norvegicus
agatgtctatctgagtcctgctacg

SEQ ID NO: 121177 - DNA, 25 bp, Rattus norvegicus
agatgtctccaaatacctacacaga

SEQ ID NO: 121178 - DNA, 25 bp, Rattus norvegicus
agatgtctccaattacctacacaga

SEQ ID NO: 121179 - DNA, 25 bp, Rattus norvegicus
agatgtctccagatggtctcttatt

SEQ ID NO: 121180 - DNA, 25 bp, Rattus norvegicus
agatgtctccagttggtctcttatt

SEQ ID NO: 121181 - DNA, 25 bp, Rattus norvegicus
agatgtctccatcgtgactcgacaa

SEQ ID NO: 121182 - DNA, 25 bp, Rattus norvegicus
agatgtctccatggtgactcgacaa

SEQ ID NO: 121183 - DNA, 25 bp, Rattus norvegicus
agatgtctcggacagtccgggccct

SEQ ID NO: 121184 - DNA, 25 bp, Rattus norvegicus
agatgtctcggagagtccgggccct

SEQ ID NO: 121185 - DNA, 25 bp, Rattus norvegicus
agatgtctgaaccttccctgtataa

SEQ ID NO: 121186 - DNA, 25 bp, Rattus norvegicus
agatgtctgaacgttccctgtataa

SEQ ID NO: 121187 - DNA, 25 bp, Rattus norvegicus
agatgtctgaatccctgagagcccc

SEQ ID NO: 121188 - DNA, 25 bp, Rattus norvegicus
agatgtctgaatgcctgagagcccc

SEQ ID NO: 121189 - DNA, 25 bp, Rattus norvegicus
agatgtctgcaacgagctactccct

SEQ ID NO: 121190 - DNA, 25 bp, Rattus norvegicus
agatgtctgcaaggagctactccct

SEQ ID NO: 121191 - DNA, 25 bp, Rattus norvegicus
agatgtctgcatcccaggttttttg

SEQ ID NO: 121192 - DNA, 25 bp, Rattus norvegicus
agatgtctgcatgccaggttttttg

SEQ ID NO: 121193 - DNA, 25 bp, Rattus norvegicus
agatgtctggaaacaccaccaccat

SEQ ID NO: 121194 - DNA, 25 bp, Rattus norvegicus
agatgtctggaatcaccaccaccat

SEQ ID NO: 121195 - DNA, 25 bp, Rattus norvegicus
agatgtctggccaatgacttctacc

SEQ ID NO: 121196 - DNA, 25 bp, Rattus norvegicus
agatgtctggcctatgacttctacc

SEQ ID NO: 121197 - DNA, 25 bp, Rattus norvegicus
agatgtctggctcgcttcatggcaa

SEQ ID NO: 121198 - DNA, 25 bp, Rattus norvegicus
agatgtctggctggcttcatggcaa

SEQ ID NO: 121199 - DNA, 25 bp, Rattus norvegicus
agatgtctgtacaccggcacagcga

SEQ ID NO: 121200 - DNA, 25 bp, Rattus norvegicus
agatgtctgtactccggcacagcga

SEQ ID NO: 121201 - DNA, 25 bp, Rattus norvegicus
agatgtctgtctccgagatctgcaa

SEQ ID NO: 121202 - DNA, 25 bp, Rattus norvegicus
agatgtctgtctgcgagatctgcaa

SEQ ID NO: 121203 - DNA, 25 bp, Rattus norvegicus
agatgtcttagcattcaggtggagt

SEQ ID NO: 121204 - DNA, 25 bp, Rattus norvegicus
agatgtcttagctttcaggtggagt

SEQ ID NO: 121205 - DNA, 25 bp, Rattus norvegicus
agatgtcttcacaggtaagctttgt

SEQ ID NO: 121206 - DNA, 25 bp, Rattus norvegicus
agatgtcttcactggtaagctttgt

SEQ ID NO: 121207 - DNA, 25 bp, Rattus norvegicus
agatgtcttcatagctatccaggct

SEQ ID NO: 121208 - DNA, 25 bp, Rattus norvegicus
agatgtcttcattgctatccaggct

SEQ ID NO: 121209 - DNA, 25 bp, Rattus norvegicus
agatgtcttcttcccaaaacgcgtc

SEQ ID NO: 121210 - DNA, 25 bp, Rattus norvegicus
agatgtcttcttgccaaaacgcgtc

SEQ ID NO: 121211 - DNA, 25 bp, Rattus norvegicus
agatgtcttgttcaggctcagggaa

SEQ ID NO: 121212 - DNA, 25 bp, Rattus norvegicus
agatgtcttgttgaggctcagggaa

SEQ ID NO: 121213 - DNA, 25 bp, Rattus norvegicus
agatgtctttatagtgcgctttgca

SEQ ID NO: 121214 - DNA, 25 bp, Rattus norvegicus
agatgtctttattgtgcgctttgca

SEQ ID NO: 121215 - DNA, 25 bp, Rattus norvegicus
agatgtctttttcgcctcttggaaa

SEQ ID NO: 121216 - DNA, 25 bp, Rattus norvegicus
agatgtctttttggcctcttggaaa

SEQ ID NO: 121217 - DNA, 25 bp, Rattus norvegicus
agatgtgaagaacgctgcccaccag

SEQ ID NO: 121218 - DNA, 25 bp, Rattus norvegicus
agatgtgaagaaggctgcccaccag

SEQ ID NO: 121219 - DNA, 25 bp, Rattus norvegicus
agatgtgaagccaggagctctcctg

SEQ ID NO: 121220 - DNA, 25 bp, Rattus norvegicus
agatgtgaagcctggagctctcctg

SEQ ID NO: 121221 - DNA, 25 bp, Rattus norvegicus
agatgtgaatgcctccatattccct

SEQ ID NO: 121222 - DNA, 25 bp, Rattus norvegicus
agatgtgaatgcgtccatattccct

SEQ ID NO: 121223 - DNA, 25 bp, Rattus norvegicus
agatgtgacctgcaagctactcatt

SEQ ID NO: 121224 - DNA, 25 bp, Rattus norvegicus
agatgtgacctggaagctactcatt

SEQ ID NO: 121225 - DNA, 25 bp, Rattus norvegicus
agatgtgaccttcagctagctgagc

SEQ ID NO: 121226 - DNA, 25 bp, Rattus norvegicus
agatgtgaccttcatcctggatgat

SEQ ID NO: 121227 - DNA, 25 bp, Rattus norvegicus
agatgtgaccttgagctagctgagc

SEQ ID NO: 121228 - DNA, 25 bp, Rattus norvegicus
agatgtgaccttgatcctggatgat

SEQ ID NO: 121229 - DNA, 25 bp, Rattus norvegicus
agatgtgactagctggcttcccctg

SEQ ID NO: 121230 - DNA, 25 bp, Rattus norvegicus
agatgtgactaggtggcttcccctg

SEQ ID NO: 121231 - DNA, 25 bp, Rattus norvegicus
agatgtgactccagtgctgtgggaa

SEQ ID NO: 121232 - DNA, 25 bp, Rattus norvegicus
agatgtgactcctgtgctgtgggaa

SEQ ID NO: 121233 - DNA, 25 bp, Rattus norvegicus
agatgtgactgcagctcgtttctaa

SEQ ID NO: 121234 - DNA, 25 bp, Rattus norvegicus
agatgtgactgctgctcgtttctaa

SEQ ID NO: 121235 - DNA, 25 bp, Rattus norvegicus
agatgtgactggcagggcttcttca

SEQ ID NO: 121236 - DNA, 25 bp, Rattus norvegicus
agatgtgactgggagggcttcttca

SEQ ID NO: 121237 - DNA, 25 bp, Rattus norvegicus
agatgtgagactctggccggttccc

SEQ ID NO: 121238 - DNA, 25 bp, Rattus norvegicus
agatgtgagactgtggccggttccc

SEQ ID NO: 121239 - DNA, 25 bp, Rattus norvegicus
agatgtgagctgcttgcctttgctg

SEQ ID NO: 121240 - DNA, 25 bp, Rattus norvegicus
agatgtgagctggttgcctttgctg

SEQ ID NO: 121241 - DNA, 25 bp, Rattus norvegicus
agatgtgagtgtacgtatatgcagt

SEQ ID NO: 121242 - DNA, 25 bp, Rattus norvegicus
agatgtgagtgttcgtatatgcagt

SEQ ID NO: 121243 - DNA, 25 bp, Rattus norvegicus
agatgtgatatccttgttctcctac

SEQ ID NO: 121244 - DNA, 25 bp, Rattus norvegicus
agatgtgatatcgttgttctcctac

SEQ ID NO: 121245 - DNA, 25 bp, Rattus norvegicus
agatgtgatcctattatttgtaatt

SEQ ID NO: 121246 - DNA, 25 bp, Rattus norvegicus
agatgtgatccttttatttgtaatt

SEQ ID NO: 121247 - DNA, 25 bp, Rattus norvegicus
agatgtgattcaagccagccagccc

SEQ ID NO: 121248 - DNA, 25 bp, Rattus norvegicus
agatgtgattcatgccagccagccc

SEQ ID NO: 121249 - DNA, 25 bp, Rattus norvegicus
agatgtgattggcttcctgctggct

SEQ ID NO: 121250 - DNA, 25 bp, Rattus norvegicus
agatgtgattgggttcctgctggct

SEQ ID NO: 121251 - DNA, 25 bp, Rattus norvegicus
agatgtgcacgaatctccctgggaa

SEQ ID NO: 121252 - DNA, 25 bp, Rattus norvegicus
agatgtgcacgattctccctgggaa

SEQ ID NO: 121253 - DNA, 25 bp, Rattus norvegicus
agatgtgcagcgctcatcaaagcca

SEQ ID NO: 121254 - DNA, 25 bp, Rattus norvegicus
agatgtgcagcggtcatcaaagcca

SEQ ID NO: 121255 - DNA, 25 bp, Rattus norvegicus
agatgtgcatgtcactcctgtgcag

SEQ ID NO: 121256 - DNA, 25 bp, Rattus norvegicus
agatgtgcatgtgactcctgtgcag

SEQ ID NO: 121257 - DNA, 25 bp, Rattus norvegicus
agatgtgccacactaccccagttgt

SEQ ID NO: 121258 - DNA, 25 bp, Rattus norvegicus
agatgtgccacagtaccccagttgt

SEQ ID NO: 121259 - DNA, 25 bp, Rattus norvegicus
agatgtgccaccagcagatcttaca

SEQ ID NO: 121260 - DNA, 25 bp, Rattus norvegicus
agatgtgccacctgcagatcttaca

SEQ ID NO: 121261 - DNA, 25 bp, Rattus norvegicus
agatgtgccccgcacaatttgcgtc

SEQ ID NO: 121262 - DNA, 25 bp, Rattus norvegicus
agatgtgccccggacaatttgcgtc

SEQ ID NO: 121263 - DNA, 25 bp, Rattus norvegicus
agatgtgcccggagactgtcagcta

SEQ ID NO: 121264 - DNA, 25 bp, Rattus norvegicus
agatgtgcccggtgactgtcagcta

SEQ ID NO: 121265 - DNA, 25 bp, Rattus norvegicus
agatgtgccgtgattttgcatttac

SEQ ID NO: 121266 - DNA, 25 bp, Rattus norvegicus
agatgtgccgtgtttttgcatttac

SEQ ID NO: 121267 - DNA, 25 bp, Rattus norvegicus
agatgtgcctccctcagctatgaga

SEQ ID NO: 121268 - DNA, 25 bp, Rattus norvegicus
agatgtgcctccgtcagctatgaga

SEQ ID NO: 121269 - DNA, 25 bp, Rattus norvegicus
agatgtgcctgacctgctgaccagg

SEQ ID NO: 121270 - DNA, 25 bp, Rattus norvegicus
agatgtgcctgagctgctgaccagg

SEQ ID NO: 121271 - DNA, 25 bp, Rattus norvegicus
agatgtgctatgagcctcttgagga

SEQ ID NO: 121272 - DNA, 25 bp, Rattus norvegicus
agatgtgctatgtgcctcttgagga

SEQ ID NO: 121273 - DNA, 25 bp, Rattus norvegicus
agatgtgctctcctgtttggacaat

SEQ ID NO: 121274 - DNA, 25 bp, Rattus norvegicus
agatgtgctctcgtgtttggacaat

SEQ ID NO: 121275 - DNA, 25 bp, Rattus norvegicus
agatgtgctgagaaccctgactgga

SEQ ID NO: 121276 - DNA, 25 bp, Rattus norvegicus
agatgtgctgagtaccctgactgga

SEQ ID NO: 121277 - DNA, 25 bp, Rattus norvegicus
agatgtgctgcaaactctgggtgtg

SEQ ID NO: 121278 - DNA, 25 bp, Rattus norvegicus
agatgtgctgcatactctgggtgtg

SEQ ID NO: 121279 - DNA, 25 bp, Rattus norvegicus
agatgtgctggactgctgtctcgtc

SEQ ID NO: 121280 - DNA, 25 bp, Rattus norvegicus
agatgtgctggagtgctgtctcgtc

SEQ ID NO: 121281 - DNA, 25 bp, Rattus norvegicus
agatgtgctggcaagatctccacca

SEQ ID NO: 121282 - DNA, 25 bp, Rattus norvegicus
agatgtgctggcaagcgcccacagt

SEQ ID NO: 121283 - DNA, 25 bp, Rattus norvegicus
agatgtgctggccacttatcctgag

SEQ ID NO: 121284 - DNA, 25 bp, Rattus norvegicus
agatgtgctggcgacttatcctgag

SEQ ID NO: 121285 - DNA, 25 bp, Rattus norvegicus
agatgtgctggctagatctccacca

SEQ ID NO: 121286 - DNA, 25 bp, Rattus norvegicus
agatgtgctggctagcgcccacagt

SEQ ID NO: 121287 - DNA, 25 bp, Rattus norvegicus
agatgtgctttcagcctgttaggga

SEQ ID NO: 121288 - DNA, 25 bp, Rattus norvegicus
agatgtgctttccagaaccagcgag

SEQ ID NO: 121289 - DNA, 25 bp, Rattus norvegicus
agatgtgctttcgagaaccagcgag

SEQ ID NO: 121290 - DNA, 25 bp, Rattus norvegicus
agatgtgctttctgcctgttaggga

SEQ ID NO: 121291 - DNA, 25 bp, Rattus norvegicus
agatgtgctttgagctggagattcg

SEQ ID NO: 121292 - DNA, 25 bp, Rattus norvegicus
agatgtgctttgtgctggagattcg

SEQ ID NO: 121293 - DNA, 25 bp, Rattus norvegicus
agatgtgcttttagtcgtctgatcc

SEQ ID NO: 121294 - DNA, 25 bp, Rattus norvegicus
agatgtgctttttgtcgtctgatcc

SEQ ID NO: 121295 - DNA, 25 bp, Rattus norvegicus
agatgtggaagtctgctcctctgtc

SEQ ID NO: 121296 - DNA, 25 bp, Rattus norvegicus
agatgtggaagtgtgctcctctgtc

SEQ ID NO: 121297 - DNA, 25 bp, Rattus norvegicus
agatgtggcaatctctgcgctcacg

SEQ ID NO: 121298 - DNA, 25 bp, Rattus norvegicus
agatgtggcaatgtctgcgctcacg

SEQ ID NO: 121299 - DNA, 25 bp, Rattus norvegicus
agatgtggcacacttcagaaacgtt

SEQ ID NO: 121300 - DNA, 25 bp, Rattus norvegicus
agatgtggcacagttcagaaacgtt

SEQ ID NO: 121301 - DNA, 25 bp, Rattus norvegicus
agatgtggcataaagctctgtccct

SEQ ID NO: 121302 - DNA, 25 bp, Rattus norvegicus
agatgtggcatatagctctgtccct

SEQ ID NO: 121303 - DNA, 25 bp, Rattus norvegicus
agatgtggccacagctaactgctga

SEQ ID NO: 121304 - DNA, 25 bp, Rattus norvegicus
agatgtggccactgctaactgctga

SEQ ID NO: 121305 - DNA, 25 bp, Rattus norvegicus
agatgtggcctcaaacttggtttat

SEQ ID NO: 121306 - DNA, 25 bp, Rattus norvegicus
agatgtggcctctaacttggtttat

SEQ ID NO: 121307 - DNA, 25 bp, Rattus norvegicus
agatgtgggcacaattgtcctgggt

SEQ ID NO: 121308 - DNA, 25 bp, Rattus norvegicus
agatgtgggcactattgtcctgggt

SEQ ID NO: 121309 - DNA, 25 bp, Rattus norvegicus
agatgtgggccaatgtcatactgaa

SEQ ID NO: 121310 - DNA, 25 bp, Rattus norvegicus
agatgtgggccattgtcatactgaa

SEQ ID NO: 121311 - DNA, 25 bp, Rattus norvegicus
agatgtgggcctacccaagcctgat

SEQ ID NO: 121312 - DNA, 25 bp, Rattus norvegicus
agatgtgggccttcccaagcctgat

SEQ ID NO: 121313 - DNA, 25 bp, Rattus norvegicus
agatgtggtgctacgagtctactca

SEQ ID NO: 121314 - DNA, 25 bp, Rattus norvegicus
agatgtggtgcttcgagtctactca

SEQ ID NO: 121315 - DNA, 25 bp, Rattus norvegicus
agatgtggtgggactccgagtccca

SEQ ID NO: 121316 - DNA, 25 bp, Rattus norvegicus
agatgtggtgggtctccgagtccca

SEQ ID NO: 121317 - DNA, 25 bp, Rattus norvegicus
agatgtggtgtgatgctagtatgca

SEQ ID NO: 121318 - DNA, 25 bp, Rattus norvegicus
agatgtggtgtgttgctagtatgca

SEQ ID NO: 121319 - DNA, 25 bp, Rattus norvegicus
agatgtggtgttaggccctgtctca

SEQ ID NO: 121320 - DNA, 25 bp, Rattus norvegicus
agatgtggtgtttggccctgtctca

SEQ ID NO: 121321 - DNA, 25 bp, Rattus norvegicus
agatgtgtacgacggtagctgacat

SEQ ID NO: 121322 - DNA, 25 bp, Rattus norvegicus
agatgtgtacgagggtagctgacat

SEQ ID NO: 121323 - DNA, 25 bp, Rattus norvegicus
agatgtgtattacagccgtgcttcc

SEQ ID NO: 121324 - DNA, 25 bp, Rattus norvegicus
agatgtgtattagagccgtgcttcc

SEQ ID NO: 121325 - DNA, 25 bp, Rattus norvegicus
agatgtgtcacacttcttcctcgga

SEQ ID NO: 121326 - DNA, 25 bp, Rattus norvegicus
agatgtgtcacagttcttcctcgga

SEQ ID NO: 121327 - DNA, 25 bp, Rattus norvegicus
agatgtgtcagaattgctttaaaga

SEQ ID NO: 121328 - DNA, 25 bp, Rattus norvegicus
agatgtgtcagatttgctttaaaga

SEQ ID NO: 121329 - DNA, 25 bp, Rattus norvegicus
agatgtgtcagtctttgcttgggtt

SEQ ID NO: 121330 - DNA, 25 bp, Rattus norvegicus
agatgtgtcagtgtttgcttgggtt

SEQ ID NO: 121331 - DNA, 25 bp, Rattus norvegicus
agatgtgtcatccttgccgccagag

SEQ ID NO: 121332 - DNA, 25 bp, Rattus norvegicus
agatgtgtcatcgttgccgccagag

SEQ ID NO: 121333 - DNA, 25 bp, Rattus norvegicus
agatgtgtcccaaggatctcatgat

SEQ ID NO: 121334 - DNA, 25 bp, Rattus norvegicus
agatgtgtcccatggatctcatgat

SEQ ID NO: 121335 - DNA, 25 bp, Rattus norvegicus
agatgtgtccttcacgcaacctaga

SEQ ID NO: 121336 - DNA, 25 bp, Rattus norvegicus
agatgtgtccttgacgcaacctaga

SEQ ID NO: 121337 - DNA, 25 bp, Rattus norvegicus
agatgtgtctgcatcacggccagga

SEQ ID NO: 121338 - DNA, 25 bp, Rattus norvegicus
agatgtgtctgcttcacggccagga

SEQ ID NO: 121339 - DNA, 25 bp, Rattus norvegicus
agatgtgtgagtaagaaagcaagac

SEQ ID NO: 121340 - DNA, 25 bp, Rattus norvegicus
agatgtgtgagttagaaagcaagac

SEQ ID NO: 121341 - DNA, 25 bp, Rattus norvegicus
agatgtgtggctccacaggcttcac

SEQ ID NO: 121342 - DNA, 25 bp, Rattus norvegicus
agatgtgtggctgcacaggcttcac

SEQ ID NO: 121343 - DNA, 25 bp, Rattus norvegicus
agatgtgtgtccagaaccgccctgt

SEQ ID NO: 121344 - DNA, 25 bp, Rattus norvegicus
agatgtgtgtcctgaaccgccctgt

SEQ ID NO: 121345 - DNA, 25 bp, Rattus norvegicus
agatgtgtgttacctctgacccaca

SEQ ID NO: 121346 - DNA, 25 bp, Rattus norvegicus
agatgtgtgttagctctgacccaca

SEQ ID NO: 121347 - DNA, 25 bp, Rattus norvegicus
agatgtgtgtttcaattgccagcag

SEQ ID NO: 121348 - DNA, 25 bp, Rattus norvegicus
agatgtgtgtttgaattgccagcag

SEQ ID NO: 121349 - DNA, 25 bp, Rattus norvegicus
agatgtgttaaccacctctgataca

SEQ ID NO: 121350 - DNA, 25 bp, Rattus norvegicus
agatgtgttaacgacctctgataca

SEQ ID NO: 121351 - DNA, 25 bp, Rattus norvegicus
agatgtgttaatcctaccagtttac

SEQ ID NO: 121352 - DNA, 25 bp, Rattus norvegicus
agatgtgttaatgctaccagtttac

SEQ ID NO: 121353 - DNA, 25 bp, Rattus norvegicus
agatgtgttcttctagacaggacag

SEQ ID NO: 121354 - DNA, 25 bp, Rattus norvegicus
agatgtgttcttgtagacaggacag

SEQ ID NO: 121355 - DNA, 25 bp, Rattus norvegicus
agatgtgttgttatgtagttaccgg

SEQ ID NO: 121356 - DNA, 25 bp, Rattus norvegicus
agatgtgttgttttgtagttaccgg

SEQ ID NO: 121357 - DNA, 25 bp, Rattus norvegicus
agatgtgtttctaggcctgccagtg

SEQ ID NO: 121358 - DNA, 25 bp, Rattus norvegicus
agatgtgtttcttggcctgccagtg

SEQ ID NO: 121359 - DNA, 25 bp, Rattus norvegicus
agatgtgttttacgcctgtgtttca

SEQ ID NO: 121360 - DNA, 25 bp, Rattus norvegicus
agatgtgttttaggcctgtgtttca

SEQ ID NO: 121361 - DNA, 25 bp, Rattus norvegicus
agatgttacagacacgtgcaccgcc

SEQ ID NO: 121362 - DNA, 25 bp, Rattus norvegicus
agatgttacagagacgtgcaccgcc

SEQ ID NO: 121363 - DNA, 25 bp, Rattus norvegicus
agatgttagccgcatgtgttcagag

SEQ ID NO: 121364 - DNA, 25 bp, Rattus norvegicus
agatgttagccggatgtgttcagag

SEQ ID NO: 121365 - DNA, 25 bp, Rattus norvegicus
agatgttatgagatgcccttcggtg

SEQ ID NO: 121366 - DNA, 25 bp, Rattus norvegicus
agatgttatgagttgcccttcggtg

SEQ ID NO: 121367 - DNA, 25 bp, Rattus norvegicus
agatgttcaaaacccaagagtattt

SEQ ID NO: 121368 - DNA, 25 bp, Rattus norvegicus
agatgttcaaaagccaagagtattt

SEQ ID NO: 121369 - DNA, 25 bp, Rattus norvegicus
agatgttcaaccaccaaagcagcag

SEQ ID NO: 121370 - DNA, 25 bp, Rattus norvegicus
agatgttcaacctccaaagcagcag

SEQ ID NO: 121371 - DNA, 25 bp, Rattus norvegicus
agatgttcactcagtaatcgttaga

SEQ ID NO: 121372 - DNA, 25 bp, Rattus norvegicus
agatgttcactctgtaatcgttaga

SEQ ID NO: 121373 - DNA, 25 bp, Rattus norvegicus
agatgttcagacaccagtctcttca

SEQ ID NO: 121374 - DNA, 25 bp, Rattus norvegicus
agatgttcagactccagtctcttca

SEQ ID NO: 121375 - DNA, 25 bp, Rattus norvegicus
agatgttcagggactcctcgaagat

SEQ ID NO: 121376 - DNA, 25 bp, Rattus norvegicus
agatgttcagggtctcctcgaagat

SEQ ID NO: 121377 - DNA, 25 bp, Rattus norvegicus
agatgttcatgtagattgctgctga

SEQ ID NO: 121378 - DNA, 25 bp, Rattus norvegicus
agatgttcatgttgattgctgctga

SEQ ID NO: 121379 - DNA, 25 bp, Rattus norvegicus
agatgttccaatctgtgttttatga

SEQ ID NO: 121380 - DNA, 25 bp, Rattus norvegicus
agatgttccaatgtgtgttttatga

SEQ ID NO: 121381 - DNA, 25 bp, Rattus norvegicus
agatgttccatgaccatccaggtga

SEQ ID NO: 121382 - DNA, 25 bp, Rattus norvegicus
agatgttccatgtccatccaggtga

SEQ ID NO: 121383 - DNA, 25 bp, Rattus norvegicus
agatgttcccacattccttgtgtag

SEQ ID NO: 121384 - DNA, 25 bp, Rattus norvegicus
agatgttcccactttccttgtgtag

SEQ ID NO: 121385 - DNA, 25 bp, Rattus norvegicus
agatgttccctcagagacactggtg

SEQ ID NO: 121386 - DNA, 25 bp, Rattus norvegicus
agatgttccctctgagacactggtg

SEQ ID NO: 121387 - DNA, 25 bp, Rattus norvegicus
agatgttccgctcagaaaccgacaa

SEQ ID NO: 121388 - DNA, 25 bp, Rattus norvegicus
agatgttccgctgagaaaccgacaa

SEQ ID NO: 121389 - DNA, 25 bp, Rattus norvegicus
agatgttcctccagttccgaatgaa

SEQ ID NO: 121390 - DNA, 25 bp, Rattus norvegicus
agatgttcctcctgttccgaatgaa

SEQ ID NO: 121391 - DNA, 25 bp, Rattus norvegicus
agatgttcggccctggttctcgcca

SEQ ID NO: 121392 - DNA, 25 bp, Rattus norvegicus
agatgttcggccgtggttctcgcca

SEQ ID NO: 121393 - DNA, 25 bp, Rattus norvegicus
agatgttctacaacgtgggcgccat

SEQ ID NO: 121394 - DNA, 25 bp, Rattus norvegicus
agatgttctacatcgtgggcgccat

SEQ ID NO: 121395 - DNA, 25 bp, Rattus norvegicus
agatgttctccacaggcagcgggaa

SEQ ID NO: 121396 - DNA, 25 bp, Rattus norvegicus
agatgttctccagaggcagcgggaa

SEQ ID NO: 121397 - DNA, 25 bp, Rattus norvegicus
agatgttctgtacagtgctcaactg

SEQ ID NO: 121398 - DNA, 25 bp, Rattus norvegicus
agatgttctgtagagtgctcaactg

SEQ ID NO: 121399 - DNA, 25 bp, Rattus norvegicus
agatgttcttccagctttgccattt

SEQ ID NO: 121400 - DNA, 25 bp, Rattus norvegicus
agatgttcttcctgctttgccattt

SEQ ID NO: 121401 - DNA, 25 bp, Rattus norvegicus
agatgttcttctagggcactgggtg

SEQ ID NO: 121402 - DNA, 25 bp, Rattus norvegicus
agatgttcttcttgggcactgggtg

SEQ ID NO: 121403 - DNA, 25 bp, Rattus norvegicus
agatgttgatgtaccagggtctcct

SEQ ID NO: 121404 - DNA, 25 bp, Rattus norvegicus
agatgttgatgttccagggtctcct

SEQ ID NO: 121405 - DNA, 25 bp, Rattus norvegicus
agatgttgccttccagtgagttcca

SEQ ID NO: 121406 - DNA, 25 bp, Rattus norvegicus
agatgttgccttgcagtgagttcca

SEQ ID NO: 121407 - DNA, 25 bp, Rattus norvegicus
agatgttgctctagtgaagtcccct

SEQ ID NO: 121408 - DNA, 25 bp, Rattus norvegicus
agatgttgctcttgtgaagtcccct

SEQ ID NO: 121409 - DNA, 25 bp, Rattus norvegicus
agatgttgcttacacgtctctagat

SEQ ID NO: 121410 - DNA, 25 bp, Rattus norvegicus
agatgttgcttagacgtctctagat

SEQ ID NO: 121411 - DNA, 25 bp, Rattus norvegicus
agatgttggatgactgctttgcctc

SEQ ID NO: 121412 - DNA, 25 bp, Rattus norvegicus
agatgttggatgtctgctttgcctc

SEQ ID NO: 121413 - DNA, 25 bp, Rattus norvegicus
agatgttggcccattcctgctgaaa

SEQ ID NO: 121414 - DNA, 25 bp, Rattus norvegicus
agatgttggccctttcctgctgaaa

SEQ ID NO: 121415 - DNA, 25 bp, Rattus norvegicus
agatgttggctcatggcccacataa

SEQ ID NO: 121416 - DNA, 25 bp, Rattus norvegicus
agatgttggctcttggcccacataa

SEQ ID NO: 121417 - DNA, 25 bp, Rattus norvegicus
agatgttggcttagtagctctgtaa

SEQ ID NO: 121418 - DNA, 25 bp, Rattus norvegicus
agatgttggctttgtagctctgtaa

SEQ ID NO: 121419 - DNA, 25 bp, Rattus norvegicus
agatgttgtgttctgctttaggaag

SEQ ID NO: 121420 - DNA, 25 bp, Rattus norvegicus
agatgttgtgttgtgctttaggaag

SEQ ID NO: 121421 - DNA, 25 bp, Rattus norvegicus
agatgttgttgaactcacctgtcca

SEQ ID NO: 121422 - DNA, 25 bp, Rattus norvegicus
agatgttgttgatctcacctgtcca

SEQ ID NO: 121423 - DNA, 25 bp, Rattus norvegicus
agatgtttaccaattctcttatagt

SEQ ID NO: 121424 - DNA, 25 bp, Rattus norvegicus
agatgtttaccatttctcttatagt

SEQ ID NO: 121425 - DNA, 25 bp, Rattus norvegicus
agatgtttagctcggcaccggttca

SEQ ID NO: 121426 - DNA, 25 bp, Rattus norvegicus
agatgtttagctgggcaccggttca

SEQ ID NO: 121427 - DNA, 25 bp, Rattus norvegicus
agatgtttcaacagcaccgtttctt

SEQ ID NO: 121428 - DNA, 25 bp, Rattus norvegicus
agatgtttcaactgcaccgtttctt

SEQ ID NO: 121429 - DNA, 25 bp, Rattus norvegicus
agatgtttcaccacctctcaatagc

SEQ ID NO: 121430 - DNA, 25 bp, Rattus norvegicus
agatgtttcacctcctctcaatagc

SEQ ID NO: 121431 - DNA, 25 bp, Rattus norvegicus
agatgtttccaactcctgatcctct

SEQ ID NO: 121432 - DNA, 25 bp, Rattus norvegicus
agatgtttccaagtcctgatcctct

SEQ ID NO: 121433 - DNA, 25 bp, Rattus norvegicus
agatgtttccatatgtaaatcccag

SEQ ID NO: 121434 - DNA, 25 bp, Rattus norvegicus
agatgtttccatttgtaaatcccag

SEQ ID NO: 121435 - DNA, 25 bp, Rattus norvegicus
agatgtttccccataaatgtgaagc

SEQ ID NO: 121436 - DNA, 25 bp, Rattus norvegicus
agatgtttccccttaaatgtgaagc

SEQ ID NO: 121437 - DNA, 25 bp, Rattus norvegicus
agatgtttctagaacggcctcgtgt

SEQ ID NO: 121438 - DNA, 25 bp, Rattus norvegicus
agatgtttctagacgttccctggga

SEQ ID NO: 121439 - DNA, 25 bp, Rattus norvegicus
agatgtttctagtacggcctcgtgt

SEQ ID NO: 121440 - DNA, 25 bp, Rattus norvegicus
agatgtttctagtcgttccctggga

SEQ ID NO: 121441 - DNA, 25 bp, Rattus norvegicus
agatgtttcttgaaagctttatgaa

SEQ ID NO: 121442 - DNA, 25 bp, Rattus norvegicus
agatgtttcttgtaagctttatgaa

SEQ ID NO: 121443 - DNA, 25 bp, Rattus norvegicus
agatgtttctttccctgtaatctgc

SEQ ID NO: 121444 - DNA, 25 bp, Rattus norvegicus
agatgtttctttcgtagtcctcagc

SEQ ID NO: 121445 - DNA, 25 bp, Rattus norvegicus
agatgtttctttgcctgtaatctgc

SEQ ID NO: 121446 - DNA, 25 bp, Rattus norvegicus
agatgtttctttggtagtcctcagc

SEQ ID NO: 121447 - DNA, 25 bp, Rattus norvegicus
agatgtttgaatagcttctccagat

SEQ ID NO: 121448 - DNA, 25 bp, Rattus norvegicus
agatgtttgaattgcttctccagat

SEQ ID NO: 121449 - DNA, 25 bp, Rattus norvegicus
agatgtttgggaatcagcggcctcc

SEQ ID NO: 121450 - DNA, 25 bp, Rattus norvegicus
agatgtttgggattcagcggcctcc

SEQ ID NO: 121451 - DNA, 25 bp, Rattus norvegicus
agatgtttgggcatgatgagacttt

SEQ ID NO: 121452 - DNA, 25 bp, Rattus norvegicus
agatgtttgggcttgatgagacttt

SEQ ID NO: 121453 - DNA, 25 bp, Rattus norvegicus
agatgtttggtgatggcggactcct

SEQ ID NO: 121454 - DNA, 25 bp, Rattus norvegicus
agatgtttggtgttggcggactcct

SEQ ID NO: 121455 - DNA, 25 bp, Rattus norvegicus
agatgtttgtcaagccacttcacag

SEQ ID NO: 121456 - DNA, 25 bp, Rattus norvegicus
agatgtttgtcatgccacttcacag

SEQ ID NO: 121457 - DNA, 25 bp, Rattus norvegicus
agatgtttgtgacctcagttctgcc

SEQ ID NO: 121458 - DNA, 25 bp, Rattus norvegicus
agatgtttgtgagctcagttctgcc

SEQ ID NO: 121459 - DNA, 25 bp, Rattus norvegicus
agatgttttacaattcactcgaata

SEQ ID NO: 121460 - DNA, 25 bp, Rattus norvegicus
agatgttttacatttcactcgaata

SEQ ID NO: 121461 - DNA, 25 bp, Rattus norvegicus
agatgttttgaaagtgcccttttaa

SEQ ID NO: 121462 - DNA, 25 bp, Rattus norvegicus
agatgttttgaatgtgcccttttaa

SEQ ID NO: 121463 - DNA, 25 bp, Rattus norvegicus
agatgtttttccagacattcctgcc

SEQ ID NO: 121464 - DNA, 25 bp, Rattus norvegicus
agatgtttttcctgacattcctgcc

SEQ ID NO: 121465 - DNA, 25 bp, Rattus norvegicus
agattaaaccctcgcctaagtctct

SEQ ID NO: 121466 - DNA, 25 bp, Rattus norvegicus
agattaaaccctggcctaagtctct

SEQ ID NO: 121467 - DNA, 25 bp, Rattus norvegicus
agattaaagaagcactccctaacaa

SEQ ID NO: 121468 - DNA, 25 bp, Rattus norvegicus
agattaaagaaggactccctaacaa

SEQ ID NO: 121469 - DNA, 25 bp, Rattus norvegicus
agattaaattgcaccgatcccaggc

SEQ ID NO: 121470 - DNA, 25 bp, Rattus norvegicus
agattaaattgctccgatcccaggc

SEQ ID NO: 121471 - DNA, 25 bp, Rattus norvegicus
agattaaatttcacttctggaaaca

SEQ ID NO: 121472 - DNA, 25 bp, Rattus norvegicus
agattaaatttctcttctggaaaca

SEQ ID NO: 121473 - DNA, 25 bp, Rattus norvegicus
agattaacccagacagcacctgttg

SEQ ID NO: 121474 - DNA, 25 bp, Rattus norvegicus
agattaacccagtcagcacctgttg

SEQ ID NO: 121475 - DNA, 25 bp, Rattus norvegicus
agattaactgtgctgagactcccgg

SEQ ID NO: 121476 - DNA, 25 bp, Rattus norvegicus
agattaactgtggtgagactcccgg

SEQ ID NO: 121477 - DNA, 25 bp, Rattus norvegicus
agattaagccctagaagtcagttct

SEQ ID NO: 121478 - DNA, 25 bp, Rattus norvegicus
agattaagcccttgaagtcagttct

SEQ ID NO: 121479 - DNA, 25 bp, Rattus norvegicus
agattaagttccctccctggtatag

SEQ ID NO: 121480 - DNA, 25 bp, Rattus norvegicus
agattaagttccgtccctggtatag

SEQ ID NO: 121481 - DNA, 25 bp, Rattus norvegicus
agattaatgattccaccacaaccct

SEQ ID NO: 121482 - DNA, 25 bp, Rattus norvegicus
agattaatgattgcaccacaaccct

SEQ ID NO: 121483 - DNA, 25 bp, Rattus norvegicus
agattaatggcccagcattctgctg

SEQ ID NO: 121484 - DNA, 25 bp, Rattus norvegicus
agattaatggccgagcattctgctg

SEQ ID NO: 121485 - DNA, 25 bp, Rattus norvegicus
agattacagacaaccaaggcctgga

SEQ ID NO: 121486 - DNA, 25 bp, Rattus norvegicus
agattacagacatccaaggcctgga

SEQ ID NO: 121487 - DNA, 25 bp, Rattus norvegicus
agattacagatcatcccaggagcta

SEQ ID NO: 121488 - DNA, 25 bp, Rattus norvegicus
agattacagatcttcccaggagcta

SEQ ID NO: 121489 - DNA, 25 bp, Rattus norvegicus
agattacaggttccgcgtgtgtgcc

SEQ ID NO: 121490 - DNA, 25 bp, Rattus norvegicus
agattacaggttgcgcgtgtgtgcc

SEQ ID NO: 121491 - DNA, 25 bp, Rattus norvegicus
agattacatctcatagcaacagaag

SEQ ID NO: 121492 - DNA, 25 bp, Rattus norvegicus
agattacatctcttagcaacagaag

SEQ ID NO: 121493 - DNA, 25 bp, Rattus norvegicus
agattacattatacagtcccacaag

SEQ ID NO: 121494 - DNA, 25 bp, Rattus norvegicus
agattacattattcagtcccacaag

SEQ ID NO: 121495 - DNA, 25 bp, Rattus norvegicus
agattaccagctccccagtgcagag

SEQ ID NO: 121496 - DNA, 25 bp, Rattus norvegicus
agattaccagctgcccagtgcagag

SEQ ID NO: 121497 - DNA, 25 bp, Rattus norvegicus
agattacccacacggtcatactttt

SEQ ID NO: 121498 - DNA, 25 bp, Rattus norvegicus
agattacccacagggtcatactttt

SEQ ID NO: 121499 - DNA, 25 bp, Rattus norvegicus
agattaccggcgctttgccgatctg

SEQ ID NO: 121500 - DNA, 25 bp, Rattus norvegicus
agattaccggcggtttgccgatctg

SEQ ID NO: 121501 - DNA, 25 bp, Rattus norvegicus
agattacctaatccctctaaagact

SEQ ID NO: 121502 - DNA, 25 bp, Rattus norvegicus
agattacctaatgcctctaaagact

SEQ ID NO: 121503 - DNA, 25 bp, Rattus norvegicus
agattacggcgcatcggagctctgc

SEQ ID NO: 121504 - DNA, 25 bp, Rattus norvegicus
agattacggcgcttcggagctctgc

SEQ ID NO: 121505 - DNA, 25 bp, Rattus norvegicus
agattactcagtataggtgacttaa

SEQ ID NO: 121506 - DNA, 25 bp, Rattus norvegicus
agattactcagtttaggtgacttaa

SEQ ID NO: 121507 - DNA, 25 bp, Rattus norvegicus
agattactctctcggaattctgtag

SEQ ID NO: 121508 - DNA, 25 bp, Rattus norvegicus
agattactctctgggaattctgtag

SEQ ID NO: 121509 - DNA, 25 bp, Rattus norvegicus
agattactgaagactggttccccac

SEQ ID NO: 121510 - DNA, 25 bp, Rattus norvegicus
agattactgaagtctggttccccac

SEQ ID NO: 121511 - DNA, 25 bp, Rattus norvegicus
agattactggacatcttcttccgga

SEQ ID NO: 121512 - DNA, 25 bp, Rattus norvegicus
agattactggacttcttcttccgga

SEQ ID NO: 121513 - DNA, 25 bp, Rattus norvegicus
agattactggcaaccttctgagaaa

SEQ ID NO: 121514 - DNA, 25 bp, Rattus norvegicus
agattactggcatccttctgagaaa

SEQ ID NO: 121515 - DNA, 25 bp, Rattus norvegicus
agattactgtaaccctctgggagaa

SEQ ID NO: 121516 - DNA, 25 bp, Rattus norvegicus
agattactgtaagcctctgggagaa

SEQ ID NO: 121517 - DNA, 25 bp, Rattus norvegicus
agattacttgccaggcatctctggg

SEQ ID NO: 121518 - DNA, 25 bp, Rattus norvegicus
agattacttgcctggcatctctggg

SEQ ID NO: 121519 - DNA, 25 bp, Rattus norvegicus
agattactttctattcttgaagagg

SEQ ID NO: 121520 - DNA, 25 bp, Rattus norvegicus
agattactttcttttcttgaagagg

SEQ ID NO: 121521 - DNA, 25 bp, Rattus norvegicus
agattagagagtctgcccccttggt

SEQ ID NO: 121522 - DNA, 25 bp, Rattus norvegicus
agattagagagtgtgcccccttggt

SEQ ID NO: 121523 - DNA, 25 bp, Rattus norvegicus
agattagcaaggaccaagcccaaag

SEQ ID NO: 121524 - DNA, 25 bp, Rattus norvegicus
agattagcaaggtccaagcccaaag

SEQ ID NO: 121525 - DNA, 25 bp, Rattus norvegicus
agattagctccaccttcctgagcaa

SEQ ID NO: 121526 - DNA, 25 bp, Rattus norvegicus
agattagctccagcttcctgagcaa

SEQ ID NO: 121527 - DNA, 25 bp, Rattus norvegicus
agattaggcaccaggagtcttggag

SEQ ID NO: 121528 - DNA, 25 bp, Rattus norvegicus
agattaggcacctggagtcttggag

SEQ ID NO: 121529 - DNA, 25 bp, Rattus norvegicus
agattagtgtaaactctggtctctg

SEQ ID NO: 121530 - DNA, 25 bp, Rattus norvegicus
agattagtgtaatctctggtctctg

SEQ ID NO: 121531 - DNA, 25 bp, Rattus norvegicus
agattagtgtctatcgggtctgtcc

SEQ ID NO: 121532 - DNA, 25 bp, Rattus norvegicus
agattagtgtctttcgggtctgtcc

SEQ ID NO: 121533 - DNA, 25 bp, Rattus norvegicus
agattataggcaaacaccgtcacca

SEQ ID NO: 121534 - DNA, 25 bp, Rattus norvegicus
agattataggcatacaccgtcacca

SEQ ID NO: 121535 - DNA, 25 bp, Rattus norvegicus
agattatccactctgcttgacgagt

SEQ ID NO: 121536 - DNA, 25 bp, Rattus norvegicus
agattatccactgtgcttgacgagt

SEQ ID NO: 121537 - DNA, 25 bp, Rattus norvegicus
agattatctcttactacctcagact

SEQ ID NO: 121538 - DNA, 25 bp, Rattus norvegicus
agattatctctttctacctcagact

SEQ ID NO: 121539 - DNA, 25 bp, Rattus norvegicus
agattatctgtcacacccttagtgt

SEQ ID NO: 121540 - DNA, 25 bp, Rattus norvegicus
agattatctgtctcacccttagtgt

SEQ ID NO: 121541 - DNA, 25 bp, Rattus norvegicus
agattatgaaacctccacagggctg

SEQ ID NO: 121542 - DNA, 25 bp, Rattus norvegicus
agattatgaaacgtccacagggctg

SEQ ID NO: 121543 - DNA, 25 bp, Rattus norvegicus
agattattgcaaccaggtccgtgat

SEQ ID NO: 121544 - DNA, 25 bp, Rattus norvegicus
agattattgcaagcaggtccgtgat

SEQ ID NO: 121545 - DNA, 25 bp, Rattus norvegicus
agattattgcacacaaccgctatag

SEQ ID NO: 121546 - DNA, 25 bp, Rattus norvegicus
agattattgcactcaaccgctatag

SEQ ID NO: 121547 - DNA, 25 bp, Rattus norvegicus
agattattgtgcattccctattagg

SEQ ID NO: 121548 - DNA, 25 bp, Rattus norvegicus
agattattgtgctttccctattagg

SEQ ID NO: 121549 - DNA, 25 bp, Rattus norvegicus
agattattttagcacccagctctct

SEQ ID NO: 121550 - DNA, 25 bp, Rattus norvegicus
agattattttaggacccagctctct

SEQ ID NO: 121551 - DNA, 25 bp, Rattus norvegicus
agattcaaattcattctggcagagt

SEQ ID NO: 121552 - DNA, 25 bp, Rattus norvegicus
agattcaaattctttctggcagagt

SEQ ID NO: 121553 - DNA, 25 bp, Rattus norvegicus
agattcaactcgcaagccagtctga

SEQ ID NO: 121554 - DNA, 25 bp, Rattus norvegicus
agattcaactcggaagccagtctga

SEQ ID NO: 121555 - DNA, 25 bp, Rattus norvegicus
agattcaagctgcatccaccctgtg

SEQ ID NO: 121556 - DNA, 25 bp, Rattus norvegicus
agattcaagctggatccaccctgtg

SEQ ID NO: 121557 - DNA, 25 bp, Rattus norvegicus
agattcaagtacacccaaaccggct

SEQ ID NO: 121558 - DNA, 25 bp, Rattus norvegicus
agattcaagtactcccaaaccggct

SEQ ID NO: 121559 - DNA, 25 bp, Rattus norvegicus
agattcaagtcgagctcattctccg

SEQ ID NO: 121560 - DNA, 25 bp, Rattus norvegicus
agattcaagtcgtgctcattctccg

SEQ ID NO: 121561 - DNA, 25 bp, Rattus norvegicus
agattcaataagaaggtgcctgcca

SEQ ID NO: 121562 - DNA, 25 bp, Rattus norvegicus
agattcaataagtaggtgcctgcca

SEQ ID NO: 121563 - DNA, 25 bp, Rattus norvegicus
agattcaatcccctgggatccactc

SEQ ID NO: 121564 - DNA, 25 bp, Rattus norvegicus
agattcaatcccgtgggatccactc

SEQ ID NO: 121565 - DNA, 25 bp, Rattus norvegicus
agattcaatggcatgttcatcctcc

SEQ ID NO: 121566 - DNA, 25 bp, Rattus norvegicus
agattcaatggcttgttcatcctcc

SEQ ID NO: 121567 - DNA, 25 bp, Rattus norvegicus
agattcacacttagacactgattgt

SEQ ID NO: 121568 - DNA, 25 bp, Rattus norvegicus
agattcacactttgacactgattgt

SEQ ID NO: 121569 - DNA, 25 bp, Rattus norvegicus
agattcacctgcactaggacccgaa

SEQ ID NO: 121570 - DNA, 25 bp, Rattus norvegicus
agattcacctgctctaggacccgaa

SEQ ID NO: 121571 - DNA, 25 bp, Rattus norvegicus
agattcacgggcagcagcaatgcat

SEQ ID NO: 121572 - DNA, 25 bp, Rattus norvegicus
agattcacgggctgcagcaatgcat

SEQ ID NO: 121573 - DNA, 25 bp, Rattus norvegicus
agattcactagcctttttgaccagc

SEQ ID NO: 121574 - DNA, 25 bp, Rattus norvegicus
agattcactagcgtttttgaccagc

SEQ ID NO: 121575 - DNA, 25 bp, Rattus norvegicus
agattcactgcgcattctgtagcca

SEQ ID NO: 121576 - DNA, 25 bp, Rattus norvegicus
agattcactgcggattctgtagcca

SEQ ID NO: 121577 - DNA, 25 bp, Rattus norvegicus
agattcagagaaccggtcaccatgg

SEQ ID NO: 121578 - DNA, 25 bp, Rattus norvegicus
agattcagagaagcggtcaccatgg

SEQ ID NO: 121579 - DNA, 25 bp, Rattus norvegicus
agattcagagacatccgacagtgat

SEQ ID NO: 121580 - DNA, 25 bp, Rattus norvegicus
agattcagagacttccgacagtgat

SEQ ID NO: 121581 - DNA, 25 bp, Rattus norvegicus
agattcagattgacacacagatgct

SEQ ID NO: 121582 - DNA, 25 bp, Rattus norvegicus
agattcagattgtcacacagatgct

SEQ ID NO: 121583 - DNA, 25 bp, Rattus norvegicus
agattcagcctgctgctcatttttt

SEQ ID NO: 121584 - DNA, 25 bp, Rattus norvegicus
agattcagcctggtgctcatttttt

SEQ ID NO: 121585 - DNA, 25 bp, Rattus norvegicus
agattcaggctgcaacagaacagaa

SEQ ID NO: 121586 - DNA, 25 bp, Rattus norvegicus
agattcaggctggaacagaacagaa

SEQ ID NO: 121587 - DNA, 25 bp, Rattus norvegicus
agattcagtccaaggcccgctgttt

SEQ ID NO: 121588 - DNA, 25 bp, Rattus norvegicus
agattcagtccatggcccgctgttt

SEQ ID NO: 121589 - DNA, 25 bp, Rattus norvegicus
agattcagtgatcctgtgcagctcc

SEQ ID NO: 121590 - DNA, 25 bp, Rattus norvegicus
agattcagtgatgctgtgcagctcc

SEQ ID NO: 121591 - DNA, 25 bp, Rattus norvegicus
agattcagtgcaacagccgtgtcta

SEQ ID NO: 121592 - DNA, 25 bp, Rattus norvegicus
agattcagtgcatcagccgtgtcta

SEQ ID NO: 121593 - DNA, 25 bp, Rattus norvegicus
agattcagttgcatctgggttttat

SEQ ID NO: 121594 - DNA, 25 bp, Rattus norvegicus
agattcagttgcttctgggttttat

SEQ ID NO: 121595 - DNA, 25 bp, Rattus norvegicus
agattcatatcgcacgtatcgtatc

SEQ ID NO: 121596 - DNA, 25 bp, Rattus norvegicus
agattcatatcggacgtatcgtatc

SEQ ID NO: 121597 - DNA, 25 bp, Rattus norvegicus
agattcatcaacactctaccaggac

SEQ ID NO: 121598 - DNA, 25 bp, Rattus norvegicus
agattcatcaactctctaccaggac

SEQ ID NO: 121599 - DNA, 25 bp, Rattus norvegicus
agattcatcaatcttgtcccttcca

SEQ ID NO: 121600 - DNA, 25 bp, Rattus norvegicus
agattcatcaatgttgtcccttcca

SEQ ID NO: 121601 - DNA, 25 bp, Rattus norvegicus
agattcatccataatccctttctgc

SEQ ID NO: 121602 - DNA, 25 bp, Rattus norvegicus
agattcatccatacctaagctccat

SEQ ID NO: 121603 - DNA, 25 bp, Rattus norvegicus
agattcatccattatccctttctgc

SEQ ID NO: 121604 - DNA, 25 bp, Rattus norvegicus
agattcatccattcctaagctccat

SEQ ID NO: 121605 - DNA, 25 bp, Rattus norvegicus
agattcattaacattgtcccgacca

SEQ ID NO: 121606 - DNA, 25 bp, Rattus norvegicus
agattcattaactttgtcccgacca

SEQ ID NO: 121607 - DNA, 25 bp, Rattus norvegicus
agattcattcacagaccccagatca

SEQ ID NO: 121608 - DNA, 25 bp, Rattus norvegicus
agattcattcactgaccccagatca

SEQ ID NO: 121609 - DNA, 25 bp, Rattus norvegicus
agattccaagttagcccttacctct

SEQ ID NO: 121610 - DNA, 25 bp, Rattus norvegicus
agattccaagttccctgccttttgg

SEQ ID NO: 121611 - DNA, 25 bp, Rattus norvegicus
agattccaagttgcctgccttttgg

SEQ ID NO: 121612 - DNA, 25 bp, Rattus norvegicus
agattccaagtttgcccttacctct

SEQ ID NO: 121613 - DNA, 25 bp, Rattus norvegicus
agattccacagccttcccaaacagt

SEQ ID NO: 121614 - DNA, 25 bp, Rattus norvegicus
agattccacagcgttcccaaacagt

SEQ ID NO: 121615 - DNA, 25 bp, Rattus norvegicus
agattccactaacaaggcagctatg

SEQ ID NO: 121616 - DNA, 25 bp, Rattus norvegicus
agattccactaagaaggcagctatg

SEQ ID NO: 121617 - DNA, 25 bp, Rattus norvegicus
agattccactcgcaacctctttata

SEQ ID NO: 121618 - DNA, 25 bp, Rattus norvegicus
agattccactcggaacctctttata

SEQ ID NO: 121619 - DNA, 25 bp, Rattus norvegicus
agattccagaagacggctccctgaa

SEQ ID NO: 121620 - DNA, 25 bp, Rattus norvegicus
agattccagaagacgtactttaata

SEQ ID NO: 121621 - DNA, 25 bp, Rattus norvegicus
agattccagaagtcggctccctgaa

SEQ ID NO: 121622 - DNA, 25 bp, Rattus norvegicus
agattccagaagtcgtactttaata

SEQ ID NO: 121623 - DNA, 25 bp, Rattus norvegicus
agattccagactcaggtggaccgtc

SEQ ID NO: 121624 - DNA, 25 bp, Rattus norvegicus
agattccagactgaggtggaccgtc

SEQ ID NO: 121625 - DNA, 25 bp, Rattus norvegicus
agattccagagcacatcttctatgc

SEQ ID NO: 121626 - DNA, 25 bp, Rattus norvegicus
agattccagagctcatcttctatgc

SEQ ID NO: 121627 - DNA, 25 bp, Rattus norvegicus
agattccatcagacaccttctatga

SEQ ID NO: 121628 - DNA, 25 bp, Rattus norvegicus
agattccatcagtcaccttctatga

SEQ ID NO: 121629 - DNA, 25 bp, Rattus norvegicus
agattccatcatcctgagttgtcac

SEQ ID NO: 121630 - DNA, 25 bp, Rattus norvegicus
agattccatcatgctgagttgtcac

SEQ ID NO: 121631 - DNA, 25 bp, Rattus norvegicus
agattccatctaatcgtcaactcct

SEQ ID NO: 121632 - DNA, 25 bp, Rattus norvegicus
agattccatctattcgtcaactcct

SEQ ID NO: 121633 - DNA, 25 bp, Rattus norvegicus
agattccatgttctgctgctactga

SEQ ID NO: 121634 - DNA, 25 bp, Rattus norvegicus
agattccatgttgtgctgctactga

SEQ ID NO: 121635 - DNA, 25 bp, Rattus norvegicus
agattccattaacttccatccgtag

SEQ ID NO: 121636 - DNA, 25 bp, Rattus norvegicus
agattccattaagttccatccgtag

SEQ ID NO: 121637 - DNA, 25 bp, Rattus norvegicus
agattccattctacttcagctaacg

SEQ ID NO: 121638 - DNA, 25 bp, Rattus norvegicus
agattccattcttcttcagctaacg

SEQ ID NO: 121639 - DNA, 25 bp, Rattus norvegicus
agattcccacacaaaaggcttcatc

SEQ ID NO: 121640 - DNA, 25 bp, Rattus norvegicus
agattcccacactaaaggcttcatc

SEQ ID NO: 121641 - DNA, 25 bp, Rattus norvegicus
agattcccagctctcattgtggact

SEQ ID NO: 121642 - DNA, 25 bp, Rattus norvegicus
agattcccagctgtcattgtggact

SEQ ID NO: 121643 - DNA, 25 bp, Rattus norvegicus
agattcccatcgaggctaccaataa

SEQ ID NO: 121644 - DNA, 25 bp, Rattus norvegicus
agattcccatcgtggctaccaataa

SEQ ID NO: 121645 - DNA, 25 bp, Rattus norvegicus
agattccccaatctttaagctcgta

SEQ ID NO: 121646 - DNA, 25 bp, Rattus norvegicus
agattccccaatgtttaagctcgta

SEQ ID NO: 121647 - DNA, 25 bp, Rattus norvegicus
agattccccgagaggctggcagctt

SEQ ID NO: 121648 - DNA, 25 bp, Rattus norvegicus
agattccccgagtggctggcagctt

SEQ ID NO: 121649 - DNA, 25 bp, Rattus norvegicus
agattcccggaactgcagtgctaac

SEQ ID NO: 121650 - DNA, 25 bp, Rattus norvegicus
agattcccggaagtgcagtgctaac

SEQ ID NO: 121651 - DNA, 25 bp, Rattus norvegicus
agattccctcctaccacgatttgtg

SEQ ID NO: 121652 - DNA, 25 bp, Rattus norvegicus
agattccctccttccacgatttgtg

SEQ ID NO: 121653 - DNA, 25 bp, Rattus norvegicus
agattcccttctatcctgagtagtc

SEQ ID NO: 121654 - DNA, 25 bp, Rattus norvegicus
agattcccttctttcctgagtagtc

SEQ ID NO: 121655 - DNA, 25 bp, Rattus norvegicus
agattccctttaatcgtaggctcgc

SEQ ID NO: 121656 - DNA, 25 bp, Rattus norvegicus
agattccctttattcgtaggctcgc

SEQ ID NO: 121657 - DNA, 25 bp, Rattus norvegicus
agattccgaggacactgacagcgaa

SEQ ID NO: 121658 - DNA, 25 bp, Rattus norvegicus
agattccgaggagactgacagcgaa

SEQ ID NO: 121659 - DNA, 25 bp, Rattus norvegicus
agattccgccagaggacgctagaga

SEQ ID NO: 121660 - DNA, 25 bp, Rattus norvegicus
agattccgccagtggacgctagaga

SEQ ID NO: 121661 - DNA, 25 bp, Rattus norvegicus
agattccgcctgctttccaagatat

SEQ ID NO: 121662 - DNA, 25 bp, Rattus norvegicus
agattccgcctggtttccaagatat

SEQ ID NO: 121663 - DNA, 25 bp, Rattus norvegicus
agattccggtgtaacttcagatccc

SEQ ID NO: 121664 - DNA, 25 bp, Rattus norvegicus
agattccggtgttacttcagatccc

SEQ ID NO: 121665 - DNA, 25 bp, Rattus norvegicus
agattcctaagtcctgtgggctgtc

SEQ ID NO: 121666 - DNA, 25 bp, Rattus norvegicus
agattcctaagtgctgtgggctgtc

SEQ ID NO: 121667 - DNA, 25 bp, Rattus norvegicus
agattcctatgaagagtgggcaatg

SEQ ID NO: 121668 - DNA, 25 bp, Rattus norvegicus
agattcctatgatgagtgggcaatg

SEQ ID NO: 121669 - DNA, 25 bp, Rattus norvegicus
agattcctccacattgggacactgg

SEQ ID NO: 121670 - DNA, 25 bp, Rattus norvegicus
agattcctccactttgggacactgg

SEQ ID NO: 121671 - DNA, 25 bp, Rattus norvegicus
agattcctctcgagagggtctgact

SEQ ID NO: 121672 - DNA, 25 bp, Rattus norvegicus
agattcctctcgtgagggtctgact

SEQ ID NO: 121673 - DNA, 25 bp, Rattus norvegicus
agattcctcttaccctggtggtgaa

SEQ ID NO: 121674 - DNA, 25 bp, Rattus norvegicus
agattcctcttagcctggtggtgaa

SEQ ID NO: 121675 - DNA, 25 bp, Rattus norvegicus
agattcctgcagacattaggcccct

SEQ ID NO: 121676 - DNA, 25 bp, Rattus norvegicus
agattcctgcagtcattaggcccct

SEQ ID NO: 121677 - DNA, 25 bp, Rattus norvegicus
agattcctgcgacttcgaagccagt

SEQ ID NO: 121678 - DNA, 25 bp, Rattus norvegicus
agattcctgcgagttcgaagccagt

SEQ ID NO: 121679 - DNA, 25 bp, Rattus norvegicus
agattcctgctgagatggtgttaca

SEQ ID NO: 121680 - DNA, 25 bp, Rattus norvegicus
agattcctgctgtgatggtgttaca

SEQ ID NO: 121681 - DNA, 25 bp, Rattus norvegicus
agattcctgggcattaggtgtgctg

SEQ ID NO: 121682 - DNA, 25 bp, Rattus norvegicus
agattcctgggctttaggtgtgctg

SEQ ID NO: 121683 - DNA, 25 bp, Rattus norvegicus
agattcctgtgacccttgaaccatt

SEQ ID NO: 121684 - DNA, 25 bp, Rattus norvegicus
agattcctgtgagccttgaaccatt

SEQ ID NO: 121685 - DNA, 25 bp, Rattus norvegicus
agattccttgacaagtgcttgggca

SEQ ID NO: 121686 - DNA, 25 bp, Rattus norvegicus
agattccttgactagtgcttgggca

SEQ ID NO: 121687 - DNA, 25 bp, Rattus norvegicus
agattcgacggaaccgttagcccaa

SEQ ID NO: 121688 - DNA, 25 bp, Rattus norvegicus
agattcgacggatccgttagcccaa

SEQ ID NO: 121689 - DNA, 25 bp, Rattus norvegicus
agattcgatcatcggagtgctgcaa

SEQ ID NO: 121690 - DNA, 25 bp, Rattus norvegicus
agattcgatcatgggagtgctgcaa

SEQ ID NO: 121691 - DNA, 25 bp, Rattus norvegicus
agattcgatgtgatccttctggctc

SEQ ID NO: 121692 - DNA, 25 bp, Rattus norvegicus
agattcgatgtgttccttctggctc

SEQ ID NO: 121693 - DNA, 25 bp, Rattus norvegicus
agattcgcaaacacatcctgcgcag

SEQ ID NO: 121694 - DNA, 25 bp, Rattus norvegicus
agattcgcaaactcatcctgcgcag

SEQ ID NO: 121695 - DNA, 25 bp, Rattus norvegicus
agattcgcattccagttttcctgat

SEQ ID NO: 121696 - DNA, 25 bp, Rattus norvegicus
agattcgcattcgagttttcctgat

SEQ ID NO: 121697 - DNA, 25 bp, Rattus norvegicus
agattcgccagccagttcaccagat

SEQ ID NO: 121698 - DNA, 25 bp, Rattus norvegicus
agattcgccagcgagttcaccagat

SEQ ID NO: 121699 - DNA, 25 bp, Rattus norvegicus
agattcgcccctcagtcggaaatac

SEQ ID NO: 121700 - DNA, 25 bp, Rattus norvegicus
agattcgcccctgagtcggaaatac

SEQ ID NO: 121701 - DNA, 25 bp, Rattus norvegicus
agattcggaagaactctccggcccg

SEQ ID NO: 121702 - DNA, 25 bp, Rattus norvegicus
agattcggaagatctctccggcccg

SEQ ID NO: 121703 - DNA, 25 bp, Rattus norvegicus
agattcgtgtcccttactctgtgct

SEQ ID NO: 121704 - DNA, 25 bp, Rattus norvegicus
agattcgtgtccgttactctgtgct

SEQ ID NO: 121705 - DNA, 25 bp, Rattus norvegicus
agattcgtttatattgtctcaagac

SEQ ID NO: 121706 - DNA, 25 bp, Rattus norvegicus
agattcgtttattttgtctcaagac

SEQ ID NO: 121707 - DNA, 25 bp, Rattus norvegicus
agattctaagaacctatgctcgcag

SEQ ID NO: 121708 - DNA, 25 bp, Rattus norvegicus
agattctaagaagctatgctcgcag

SEQ ID NO: 121709 - DNA, 25 bp, Rattus norvegicus
agattctagcttactctgcactcgt

SEQ ID NO: 121710 - DNA, 25 bp, Rattus norvegicus
agattctagctttctctgcactcgt

SEQ ID NO: 121711 - DNA, 25 bp, Rattus norvegicus
agattctaggcaacgagctggtctt

SEQ ID NO: 121712 - DNA, 25 bp, Rattus norvegicus
agattctaggcatcgagctggtctt

SEQ ID NO: 121713 - DNA, 25 bp, Rattus norvegicus
agattctatcccaactattgcaagg

SEQ ID NO: 121714 - DNA, 25 bp, Rattus norvegicus
agattctatccctactattgcaagg

SEQ ID NO: 121715 - DNA, 25 bp, Rattus norvegicus
agattctatcttatgtgtaccccag

SEQ ID NO: 121716 - DNA, 25 bp, Rattus norvegicus
agattctatcttttgtgtaccccag

SEQ ID NO: 121717 - DNA, 25 bp, Rattus norvegicus
agattctatgacacaattctatgga

SEQ ID NO: 121718 - DNA, 25 bp, Rattus norvegicus
agattctatgactcaattctatgga

SEQ ID NO: 121719 - DNA, 25 bp, Rattus norvegicus
agattctatggcaccaccaggtata

SEQ ID NO: 121720 - DNA, 25 bp, Rattus norvegicus
agattctatggctccaccaggtata

SEQ ID NO: 121721 - DNA, 25 bp, Rattus norvegicus
agattctatggtagtcttttggtcc

SEQ ID NO: 121722 - DNA, 25 bp, Rattus norvegicus
agattctatggttgtcttttggtcc

SEQ ID NO: 121723 - DNA, 25 bp, Rattus norvegicus
agattctcacccaacacaaagtcga

SEQ ID NO: 121724 - DNA, 25 bp, Rattus norvegicus
agattctcaccctacacaaagtcga

SEQ ID NO: 121725 - DNA, 25 bp, Rattus norvegicus
agattctcagatatggccttacctt

SEQ ID NO: 121726 - DNA, 25 bp, Rattus norvegicus
agattctcagatttggccttacctt

SEQ ID NO: 121727 - DNA, 25 bp, Rattus norvegicus
agattctcaggcagctgtccctacg

SEQ ID NO: 121728 - DNA, 25 bp, Rattus norvegicus
agattctcaggctgctgtccctacg

SEQ ID NO: 121729 - DNA, 25 bp, Rattus norvegicus
agattctcatacatgtcacaccaca

SEQ ID NO: 121730 - DNA, 25 bp, Rattus norvegicus
agattctcatacttgtcacaccaca

SEQ ID NO: 121731 - DNA, 25 bp, Rattus norvegicus
agattctcatcgcaaggtcagatag

SEQ ID NO: 121732 - DNA, 25 bp, Rattus norvegicus
agattctcatcggaaggtcagatag

SEQ ID NO: 121733 - DNA, 25 bp, Rattus norvegicus
agattctccaatacagacttctctg

SEQ ID NO: 121734 - DNA, 25 bp, Rattus norvegicus
agattctccaattcagacttctctg

SEQ ID NO: 121735 - DNA, 25 bp, Rattus norvegicus
agattctccagaaggctgcgaggcc

SEQ ID NO: 121736 - DNA, 25 bp, Rattus norvegicus
agattctccagatggctgcgaggcc

SEQ ID NO: 121737 - DNA, 25 bp, Rattus norvegicus
agattctcccttctaggacttactc

SEQ ID NO: 121738 - DNA, 25 bp, Rattus norvegicus
agattctcccttgtaggacttactc

SEQ ID NO: 121739 - DNA, 25 bp, Rattus norvegicus
agattctcctgtaagtgctgtagct

SEQ ID NO: 121740 - DNA, 25 bp, Rattus norvegicus
agattctcctgttagtgctgtagct

SEQ ID NO: 121741 - DNA, 25 bp, Rattus norvegicus
agattctccttgatgccctggacaa

SEQ ID NO: 121742 - DNA, 25 bp, Rattus norvegicus
agattctccttgttgccctggacaa

SEQ ID NO: 121743 - DNA, 25 bp, Rattus norvegicus
agattctcctttctgggcactttag

SEQ ID NO: 121744 - DNA, 25 bp, Rattus norvegicus
agattctcctttgtgggcactttag

SEQ ID NO: 121745 - DNA, 25 bp, Rattus norvegicus
agattctcgcagcttctcctcagag

SEQ ID NO: 121746 - DNA, 25 bp, Rattus norvegicus
agattctcgcaggttctcctcagag

SEQ ID NO: 121747 - DNA, 25 bp, Rattus norvegicus
agattctcgtctcttgtggtgacta

SEQ ID NO: 121748 - DNA, 25 bp, Rattus norvegicus
agattctcgtctgttgtggtgacta

SEQ ID NO: 121749 - DNA, 25 bp, Rattus norvegicus
agattctctaagagctgtgtttcag

SEQ ID NO: 121750 - DNA, 25 bp, Rattus norvegicus
agattctctaagtgctgtgtttcag

SEQ ID NO: 121751 - DNA, 25 bp, Rattus norvegicus
agattctctcctcagtatctgtcac

SEQ ID NO: 121752 - DNA, 25 bp, Rattus norvegicus
agattctctcctgagtatctgtcac

SEQ ID NO: 121753 - DNA, 25 bp, Rattus norvegicus
agattctctctaatcttccatcatg

SEQ ID NO: 121754 - DNA, 25 bp, Rattus norvegicus
agattctctctattcttccatcatg

SEQ ID NO: 121755 - DNA, 25 bp, Rattus norvegicus
agattctctctgagtttagttaaca

SEQ ID NO: 121756 - DNA, 25 bp, Rattus norvegicus
agattctctctgtgtttagttaaca

SEQ ID NO: 121757 - DNA, 25 bp, Rattus norvegicus
agattctctgacaacgaactccctt

SEQ ID NO: 121758 - DNA, 25 bp, Rattus norvegicus
agattctctgactacgaactccctt

SEQ ID NO: 121759 - DNA, 25 bp, Rattus norvegicus
agattctctgccagaccttctagga

SEQ ID NO: 121760 - DNA, 25 bp, Rattus norvegicus
agattctctgcctgaccttctagga

SEQ ID NO: 121761 - DNA, 25 bp, Rattus norvegicus
agattctctttccaatgcctcaaaa

SEQ ID NO: 121762 - DNA, 25 bp, Rattus norvegicus
agattctctttcgaatgcctcaaaa

SEQ ID NO: 121763 - DNA, 25 bp, Rattus norvegicus
agattctgaggcacccttttttcct

SEQ ID NO: 121764 - DNA, 25 bp, Rattus norvegicus
agattctgaggctcccttttttcct

SEQ ID NO: 121765 - DNA, 25 bp, Rattus norvegicus
agattctgcggccactgcgtaagtg

SEQ ID NO: 121766 - DNA, 25 bp, Rattus norvegicus
agattctgcggcgactgcgtaagtg

SEQ ID NO: 121767 - DNA, 25 bp, Rattus norvegicus
agattctgctgaaagccctcaccaa

SEQ ID NO: 121768 - DNA, 25 bp, Rattus norvegicus
agattctgctgatagccctcaccaa

SEQ ID NO: 121769 - DNA, 25 bp, Rattus norvegicus
agattctgctgcacatgtttgtttc

SEQ ID NO: 121770 - DNA, 25 bp, Rattus norvegicus
agattctgctgctcatgtttgtttc

SEQ ID NO: 121771 - DNA, 25 bp, Rattus norvegicus
agattctggacaatctgcttgctca

SEQ ID NO: 121772 - DNA, 25 bp, Rattus norvegicus
agattctggacattctgcttgctca

SEQ ID NO: 121773 - DNA, 25 bp, Rattus norvegicus
agattctggactctgctgcacagct

SEQ ID NO: 121774 - DNA, 25 bp, Rattus norvegicus
agattctggactgtgctgcacagct

SEQ ID NO: 121775 - DNA, 25 bp, Rattus norvegicus
agattctggagaacgggttggcata

SEQ ID NO: 121776 - DNA, 25 bp, Rattus norvegicus
agattctggagatcgggttggcata

SEQ ID NO: 121777 - DNA, 25 bp, Rattus norvegicus
agattctggccacgatcgagctgct

SEQ ID NO: 121778 - DNA, 25 bp, Rattus norvegicus
agattctggccaggatcgagctgct

SEQ ID NO: 121779 - DNA, 25 bp, Rattus norvegicus
agattctgggcacacagcccaatca

SEQ ID NO: 121780 - DNA, 25 bp, Rattus norvegicus
agattctgggcagacagcccaatca

SEQ ID NO: 121781 - DNA, 25 bp, Rattus norvegicus
agattctgggtaagggactacacag

SEQ ID NO: 121782 - DNA, 25 bp, Rattus norvegicus
agattctgggtatgggactacacag

SEQ ID NO: 121783 - DNA, 25 bp, Rattus norvegicus
agattctggtagctcatccgtacat

SEQ ID NO: 121784 - DNA, 25 bp, Rattus norvegicus
agattctggtaggtcatccgtacat

SEQ ID NO: 121785 - DNA, 25 bp, Rattus norvegicus
agattctgtatcaccaagctccgag

SEQ ID NO: 121786 - DNA, 25 bp, Rattus norvegicus
agattctgtatctccaagctccgag

SEQ ID NO: 121787 - DNA, 25 bp, Rattus norvegicus
agattcttaacacctcctcagaggg

SEQ ID NO: 121788 - DNA, 25 bp, Rattus norvegicus
agattcttaacagctcctcagaggg

SEQ ID NO: 121789 - DNA, 25 bp, Rattus norvegicus
agattcttaaggctcatatgcagca

SEQ ID NO: 121790 - DNA, 25 bp, Rattus norvegicus
agattcttaagggtcatatgcagca

SEQ ID NO: 121791 - DNA, 25 bp, Rattus norvegicus
agattcttaatgcaggtgaccctcg

SEQ ID NO: 121792 - DNA, 25 bp, Rattus norvegicus
agattcttaatggaggtgaccctcg

SEQ ID NO: 121793 - DNA, 25 bp, Rattus norvegicus
agattcttaccaaaggccctgttct

SEQ ID NO: 121794 - DNA, 25 bp, Rattus norvegicus
agattcttaccataggccctgttct

SEQ ID NO: 121795 - DNA, 25 bp, Rattus norvegicus
agattcttcactctcagcaacctag

SEQ ID NO: 121796 - DNA, 25 bp, Rattus norvegicus
agattcttcactgtcagcaacctag

SEQ ID NO: 121797 - DNA, 25 bp, Rattus norvegicus
agattcttcagcataacccacttgt

SEQ ID NO: 121798 - DNA, 25 bp, Rattus norvegicus
agattcttcagcttaacccacttgt

SEQ ID NO: 121799 - DNA, 25 bp, Rattus norvegicus
agattcttccccatccttgtcctgg

SEQ ID NO: 121800 - DNA, 25 bp, Rattus norvegicus
agattcttccccttccttgtcctgg

SEQ ID NO: 121801 - DNA, 25 bp, Rattus norvegicus
agattcttcgacatgaggaggacac

SEQ ID NO: 121802 - DNA, 25 bp, Rattus norvegicus
agattcttcgacttgaggaggacac

SEQ ID NO: 121803 - DNA, 25 bp, Rattus norvegicus
agattcttcgagactggcccagggt

SEQ ID NO: 121804 - DNA, 25 bp, Rattus norvegicus
agattcttcgagtctggcccagggt

SEQ ID NO: 121805 - DNA, 25 bp, Rattus norvegicus
agattcttctctattcctatcgtaa

SEQ ID NO: 121806 - DNA, 25 bp, Rattus norvegicus
agattcttctcttttcctatcgtaa

SEQ ID NO: 121807 - DNA, 25 bp, Rattus norvegicus
agattcttctggaccttgctagata

SEQ ID NO: 121808 - DNA, 25 bp, Rattus norvegicus
agattcttctggtccttgctagata

SEQ ID NO: 121809 - DNA, 25 bp, Rattus norvegicus
agattcttgccgcatgaggcccgga

SEQ ID NO: 121810 - DNA, 25 bp, Rattus norvegicus
agattcttgccggatgaggcccgga

SEQ ID NO: 121811 - DNA, 25 bp, Rattus norvegicus
agattcttgctcacaagctgaggta

SEQ ID NO: 121812 - DNA, 25 bp, Rattus norvegicus
agattcttgctctcaagctgaggta

SEQ ID NO: 121813 - DNA, 25 bp, Rattus norvegicus
agattcttgggtctgaagtgactct

SEQ ID NO: 121814 - DNA, 25 bp, Rattus norvegicus
agattcttgggtgtgaagtgactct

SEQ ID NO: 121815 - DNA, 25 bp, Rattus norvegicus
agattctttatgcagttggcccctt

SEQ ID NO: 121816 - DNA, 25 bp, Rattus norvegicus
agattctttatggagttggcccctt

SEQ ID NO: 121817 - DNA, 25 bp, Rattus norvegicus
agattctttcctcatggccatgtga

SEQ ID NO: 121818 - DNA, 25 bp, Rattus norvegicus
agattctttcctgatggccatgtga

SEQ ID NO: 121819 - DNA, 25 bp, Rattus norvegicus
agattgaaagccagctgcaaacttt

SEQ ID NO: 121820 - DNA, 25 bp, Rattus norvegicus
agattgaaagcctgctgcaaacttt

SEQ ID NO: 121821 - DNA, 25 bp, Rattus norvegicus
agattgaacctactctcccgagtgt

SEQ ID NO: 121822 - DNA, 25 bp, Rattus norvegicus
agattgaacctagtctcccgagtgt

SEQ ID NO: 121823 - DNA, 25 bp, Rattus norvegicus
agattgaagaggagctggccgccct

SEQ ID NO: 121824 - DNA, 25 bp, Rattus norvegicus
agattgaagaggtgctggccgccct

SEQ ID NO: 121825 - DNA, 25 bp, Rattus norvegicus
agattgacaccaacacgccagagat

SEQ ID NO: 121826 - DNA, 25 bp, Rattus norvegicus
agattgacaccatcacgccagagat

SEQ ID NO: 121827 - DNA, 25 bp, Rattus norvegicus
agattgacagaacatccttcacctc

SEQ ID NO: 121828 - DNA, 25 bp, Rattus norvegicus
agattgacagaagatccttcacctc

SEQ ID NO: 121829 - DNA, 25 bp, Rattus norvegicus
agattgacatctctgctcttaggag

SEQ ID NO: 121830 - DNA, 25 bp, Rattus norvegicus
agattgacatctgtgctcttaggag

SEQ ID NO: 121831 - DNA, 25 bp, Rattus norvegicus
agattgagaatgatcccacaggccc

SEQ ID NO: 121832 - DNA, 25 bp, Rattus norvegicus
agattgagaatgttcccacaggccc

SEQ ID NO: 121833 - DNA, 25 bp, Rattus norvegicus
agattgagccaccaaggacttgtat

SEQ ID NO: 121834 - DNA, 25 bp, Rattus norvegicus
agattgagccacgaaggacttgtat

SEQ ID NO: 121835 - DNA, 25 bp, Rattus norvegicus
agattgagccgtatatgccatatga

SEQ ID NO: 121836 - DNA, 25 bp, Rattus norvegicus
agattgagccgtttatgccatatga

SEQ ID NO: 121837 - DNA, 25 bp, Rattus norvegicus
agattgaggaaaccctggcccactt

SEQ ID NO: 121838 - DNA, 25 bp, Rattus norvegicus
agattgaggaaagcctggcccactt

SEQ ID NO: 121839 - DNA, 25 bp, Rattus norvegicus
agattgaggcatactcctgtagccc

SEQ ID NO: 121840 - DNA, 25 bp, Rattus norvegicus
agattgaggcattctcctgtagccc

SEQ ID NO: 121841 - DNA, 25 bp, Rattus norvegicus
agattgatctctaagtggctggctt

SEQ ID NO: 121842 - DNA, 25 bp, Rattus norvegicus
agattgatctcttagtggctggctt

SEQ ID NO: 121843 - DNA, 25 bp, Rattus norvegicus
agattgatgctcagtttcaaagtga

SEQ ID NO: 121844 - DNA, 25 bp, Rattus norvegicus
agattgatgctctgtttcaaagtga

SEQ ID NO: 121845 - DNA, 25 bp, Rattus norvegicus
agattgatgtaactggtccctgtcc

SEQ ID NO: 121846 - DNA, 25 bp, Rattus norvegicus
agattgatgtaagtggtccctgtcc

SEQ ID NO: 121847 - DNA, 25 bp, Rattus norvegicus
agattgattcttatctgtgtgccgc

SEQ ID NO: 121848 - DNA, 25 bp, Rattus norvegicus
agattgattcttttctgtgtgccgc

SEQ ID NO: 121849 - DNA, 25 bp, Rattus norvegicus
agattgcaaatactgcccgcaaacg

SEQ ID NO: 121850 - DNA, 25 bp, Rattus norvegicus
agattgcaaatagtgcccgcaaacg

SEQ ID NO: 121851 - DNA, 25 bp, Rattus norvegicus
agattgcaaggaattcctgctccca

SEQ ID NO: 121852 - DNA, 25 bp, Rattus norvegicus
agattgcaaggatttcctgctccca

SEQ ID NO: 121853 - DNA, 25 bp, Rattus norvegicus
agattgcactacagttgggccgcat

SEQ ID NO: 121854 - DNA, 25 bp, Rattus norvegicus
agattgcactactgttgggccgcat

SEQ ID NO: 121855 - DNA, 25 bp, Rattus norvegicus
agattgcactcactgtgctcaccag

SEQ ID NO: 121856 - DNA, 25 bp, Rattus norvegicus
agattgcactcagtgtgctcaccag

SEQ ID NO: 121857 - DNA, 25 bp, Rattus norvegicus
agattgcactggaaccacgtactgt

SEQ ID NO: 121858 - DNA, 25 bp, Rattus norvegicus
agattgcactggtaccacgtactgt

SEQ ID NO: 121859 - DNA, 25 bp, Rattus norvegicus
agattgcagaccaaagacatcatac

SEQ ID NO: 121860 - DNA, 25 bp, Rattus norvegicus
agattgcagacctaagacatcatac

SEQ ID NO: 121861 - DNA, 25 bp, Rattus norvegicus
agattgcagctgatgtagacgtggc

SEQ ID NO: 121862 - DNA, 25 bp, Rattus norvegicus
agattgcagctgttgtagacgtggc

SEQ ID NO: 121863 - DNA, 25 bp, Rattus norvegicus
agattgcagtgcctctgactcagac

SEQ ID NO: 121864 - DNA, 25 bp, Rattus norvegicus
agattgcagtgcgtctgactcagac

SEQ ID NO: 121865 - DNA, 25 bp, Rattus norvegicus
agattgcatttgagccaggacctgg

SEQ ID NO: 121866 - DNA, 25 bp, Rattus norvegicus
agattgcatttgtgccaggacctgg

SEQ ID NO: 121867 - DNA, 25 bp, Rattus norvegicus
agattgccaatgacattcgcttcct

SEQ ID NO: 121868 - DNA, 25 bp, Rattus norvegicus
agattgccaatgtcattcgcttcct

SEQ ID NO: 121869 - DNA, 25 bp, Rattus norvegicus
agattgccacttaccagtgttttga

SEQ ID NO: 121870 - DNA, 25 bp, Rattus norvegicus
agattgccactttccagtgttttga

SEQ ID NO: 121871 - DNA, 25 bp, Rattus norvegicus
agattgccagtgaacattccttgtt

SEQ ID NO: 121872 - DNA, 25 bp, Rattus norvegicus
agattgccagtgtacattccttgtt

SEQ ID NO: 121873 - DNA, 25 bp, Rattus norvegicus
agattgccgcacacctctgccatgg

SEQ ID NO: 121874 - DNA, 25 bp, Rattus norvegicus
agattgccgcactcctctgccatgg

SEQ ID NO: 121875 - DNA, 25 bp, Rattus norvegicus
agattgccgtctccacacaggtgtg

SEQ ID NO: 121876 - DNA, 25 bp, Rattus norvegicus
agattgccgtctgcacacaggtgtg

SEQ ID NO: 121877 - DNA, 25 bp, Rattus norvegicus
agattgctaatcacacaaccatcca

SEQ ID NO: 121878 - DNA, 25 bp, Rattus norvegicus
agattgctaatctcacaaccatcca

SEQ ID NO: 121879 - DNA, 25 bp, Rattus norvegicus
agattgctacctactttccgtgctt

SEQ ID NO: 121880 - DNA, 25 bp, Rattus norvegicus
agattgctaccttctttccgtgctt

SEQ ID NO: 121881 - DNA, 25 bp, Rattus norvegicus
agattgctagcacctttgaccaccg

SEQ ID NO: 121882 - DNA, 25 bp, Rattus norvegicus
agattgctagcagctttgaccaccg

SEQ ID NO: 121883 - DNA, 25 bp, Rattus norvegicus
agattgctcatgagtgctctcttac

SEQ ID NO: 121884 - DNA, 25 bp, Rattus norvegicus
agattgctcatgtgtgctctcttac

SEQ ID NO: 121885 - DNA, 25 bp, Rattus norvegicus
agattgctcctgagcttctgggatt

SEQ ID NO: 121886 - DNA, 25 bp, Rattus norvegicus
agattgctcctgtgcttctgggatt

SEQ ID NO: 121887 - DNA, 25 bp, Rattus norvegicus
agattgctctccagtgtggtgagct

SEQ ID NO: 121888 - DNA, 25 bp, Rattus norvegicus
agattgctctcctgtgtggtgagct

SEQ ID NO: 121889 - DNA, 25 bp, Rattus norvegicus
agattgctgatgagtcttttatgtt

SEQ ID NO: 121890 - DNA, 25 bp, Rattus norvegicus
agattgctgatgtgtcttttatgtt

SEQ ID NO: 121891 - DNA, 25 bp, Rattus norvegicus
agattgctgcatacctgcagtctga

SEQ ID NO: 121892 - DNA, 25 bp, Rattus norvegicus
agattgctgcattcctgcagtctga

SEQ ID NO: 121893 - DNA, 25 bp, Rattus norvegicus
agattgctgctaacctacatggcca

SEQ ID NO: 121894 - DNA, 25 bp, Rattus norvegicus
agattgctgctatcctacatggcca

SEQ ID NO: 121895 - DNA, 25 bp, Rattus norvegicus
agattgctgttcaggccaatcacca

SEQ ID NO: 121896 - DNA, 25 bp, Rattus norvegicus
agattgctgttctggccaatcacca

SEQ ID NO: 121897 - DNA, 25 bp, Rattus norvegicus
agattgcttattcatggctcctctt

SEQ ID NO: 121898 - DNA, 25 bp, Rattus norvegicus
agattgcttattgatggctcctctt

SEQ ID NO: 121899 - DNA, 25 bp, Rattus norvegicus
agattgcttgctattagtacctcgt

SEQ ID NO: 121900 - DNA, 25 bp, Rattus norvegicus
agattgcttgcttttagtacctcgt

SEQ ID NO: 121901 - DNA, 25 bp, Rattus norvegicus
agattgctttctctccacttggaag

SEQ ID NO: 121902 - DNA, 25 bp, Rattus norvegicus
agattgctttctgtccacttggaag

SEQ ID NO: 121903 - DNA, 25 bp, Rattus norvegicus
agattgcttttaccattgccttccc

SEQ ID NO: 121904 - DNA, 25 bp, Rattus norvegicus
agattgcttttagcattgccttccc

SEQ ID NO: 121905 - DNA, 25 bp, Rattus norvegicus
agattggaacaactcttcctctacc

SEQ ID NO: 121906 - DNA, 25 bp, Rattus norvegicus
agattggaacaagtcttcctctacc

SEQ ID NO: 121907 - DNA, 25 bp, Rattus norvegicus
agattggacatcagtccacctcact

SEQ ID NO: 121908 - DNA, 25 bp, Rattus norvegicus
agattggacatctgtccacctcact

SEQ ID NO: 121909 - DNA, 25 bp, Rattus norvegicus
agattggacccaccccaatgttcac

SEQ ID NO: 121910 - DNA, 25 bp, Rattus norvegicus
agattggacccagcccaatgttcac

SEQ ID NO: 121911 - DNA, 25 bp, Rattus norvegicus
agattggaggccagggttctcactg

SEQ ID NO: 121912 - DNA, 25 bp, Rattus norvegicus
agattggaggcctgggttctcactg

SEQ ID NO: 121913 - DNA, 25 bp, Rattus norvegicus
agattggatgtcctcttatacctcc

SEQ ID NO: 121914 - DNA, 25 bp, Rattus norvegicus
agattggatgtcgtcttatacctcc

SEQ ID NO: 121915 - DNA, 25 bp, Rattus norvegicus
agattggatttcactctgtgggctc

SEQ ID NO: 121916 - DNA, 25 bp, Rattus norvegicus
agattggatttcaggtgaagcacag

SEQ ID NO: 121917 - DNA, 25 bp, Rattus norvegicus
agattggatttctctctgtgggctc

SEQ ID NO: 121918 - DNA, 25 bp, Rattus norvegicus
agattggatttctggtgaagcacag

SEQ ID NO: 121919 - DNA, 25 bp, Rattus norvegicus
agattggcagacatcacctatgctg

SEQ ID NO: 121920 - DNA, 25 bp, Rattus norvegicus
agattggcagacttcacctatgctg

SEQ ID NO: 121921 - DNA, 25 bp, Rattus norvegicus
agattggcatgcatcctgtatttca

SEQ ID NO: 121922 - DNA, 25 bp, Rattus norvegicus
agattggcatgcttcctgtatttca

SEQ ID NO: 121923 - DNA, 25 bp, Rattus norvegicus
agattggccactagagacctctgac

SEQ ID NO: 121924 - DNA, 25 bp, Rattus norvegicus
agattggccacttgagacctctgac

SEQ ID NO: 121925 - DNA, 25 bp, Rattus norvegicus
agattggccaggcaaatcctcacca

SEQ ID NO: 121926 - DNA, 25 bp, Rattus norvegicus
agattggccagggaaatcctcacca

SEQ ID NO: 121927 - DNA, 25 bp, Rattus norvegicus
agattggcctacacagtccagggct

SEQ ID NO: 121928 - DNA, 25 bp, Rattus norvegicus
agattggcctactcagtccagggct

SEQ ID NO: 121929 - DNA, 25 bp, Rattus norvegicus
agattggcggctccgggacaccggc

SEQ ID NO: 121930 - DNA, 25 bp, Rattus norvegicus
agattggcggctgcgggacaccggc

SEQ ID NO: 121931 - DNA, 25 bp, Rattus norvegicus
agattggctgtgacacctaggctac

SEQ ID NO: 121932 - DNA, 25 bp, Rattus norvegicus
agattggctgtgtcacctaggctac

SEQ ID NO: 121933 - DNA, 25 bp, Rattus norvegicus
agattggcttccactttggttaaga

SEQ ID NO: 121934 - DNA, 25 bp, Rattus norvegicus
agattggcttcctctttggttaaga

SEQ ID NO: 121935 - DNA, 25 bp, Rattus norvegicus
agattggcttgtaggttcttcttgt

SEQ ID NO: 121936 - DNA, 25 bp, Rattus norvegicus
agattggcttgttggttcttcttgt

SEQ ID NO: 121937 - DNA, 25 bp, Rattus norvegicus
agattgggagctcaagggcattctt

SEQ ID NO: 121938 - DNA, 25 bp, Rattus norvegicus
agattgggagctgaagggcattctt

SEQ ID NO: 121939 - DNA, 25 bp, Rattus norvegicus
agattgggatcacaggtctcaccta

SEQ ID NO: 121940 - DNA, 25 bp, Rattus norvegicus
agattgggatcagaggtctcaccta

SEQ ID NO: 121941 - DNA, 25 bp, Rattus norvegicus
agattgggattgaaggtggcctcat

SEQ ID NO: 121942 - DNA, 25 bp, Rattus norvegicus
agattgggattgtaggtggcctcat

SEQ ID NO: 121943 - DNA, 25 bp, Rattus norvegicus
agattggtgcctcaactcaggcagc

SEQ ID NO: 121944 - DNA, 25 bp, Rattus norvegicus
agattggtgcctgaactcaggcagc

SEQ ID NO: 121945 - DNA, 25 bp, Rattus norvegicus
agattggtgctgcagtcactcagga

SEQ ID NO: 121946 - DNA, 25 bp, Rattus norvegicus
agattggtgctggagtcactcagga

SEQ ID NO: 121947 - DNA, 25 bp, Rattus norvegicus
agattggtggtgatcagtcagcctc

SEQ ID NO: 121948 - DNA, 25 bp, Rattus norvegicus
agattggtggtgttcagtcagcctc

SEQ ID NO: 121949 - DNA, 25 bp, Rattus norvegicus
agattggtggttattgatgctcgat

SEQ ID NO: 121950 - DNA, 25 bp, Rattus norvegicus
agattggtggtttttgatgctcgat

SEQ ID NO: 121951 - DNA, 25 bp, Rattus norvegicus
agattggtgtcacaggtctccctta

SEQ ID NO: 121952 - DNA, 25 bp, Rattus norvegicus
agattggtgtcagaggtctccctta

SEQ ID NO: 121953 - DNA, 25 bp, Rattus norvegicus
agattggttcttccgcctacaggag

SEQ ID NO: 121954 - DNA, 25 bp, Rattus norvegicus
agattggttcttcctacatacccca

SEQ ID NO: 121955 - DNA, 25 bp, Rattus norvegicus
agattggttcttgcgcctacaggag

SEQ ID NO: 121956 - DNA, 25 bp, Rattus norvegicus
agattggttcttgctacatacccca

SEQ ID NO: 121957 - DNA, 25 bp, Rattus norvegicus
agattggtttgtattgctgctggcc

SEQ ID NO: 121958 - DNA, 25 bp, Rattus norvegicus
agattggtttgttttgctgctggcc

SEQ ID NO: 121959 - DNA, 25 bp, Rattus norvegicus
agattgtaccagctcattctcagcc

SEQ ID NO: 121960 - DNA, 25 bp, Rattus norvegicus
agattgtaccaggtcattctcagcc

SEQ ID NO: 121961 - DNA, 25 bp, Rattus norvegicus
agattgtacgtcacttgtgcatgta

SEQ ID NO: 121962 - DNA, 25 bp, Rattus norvegicus
agattgtacgtctcttgtgcatgta

SEQ ID NO: 121963 - DNA, 25 bp, Rattus norvegicus
agattgtagccacgttttctcccag

SEQ ID NO: 121964 - DNA, 25 bp, Rattus norvegicus
agattgtagccaggttttctcccag

SEQ ID NO: 121965 - DNA, 25 bp, Rattus norvegicus
agattgtaggcacttctagctccat

SEQ ID NO: 121966 - DNA, 25 bp, Rattus norvegicus
agattgtaggcagttctagctccat

SEQ ID NO: 121967 - DNA, 25 bp, Rattus norvegicus
agattgtagtttcgccattattgac

SEQ ID NO: 121968 - DNA, 25 bp, Rattus norvegicus
agattgtagtttggccattattgac

SEQ ID NO: 121969 - DNA, 25 bp, Rattus norvegicus
agattgtcaataaccctggcatcca

SEQ ID NO: 121970 - DNA, 25 bp, Rattus norvegicus
agattgtcaatatccctggcatcca

SEQ ID NO: 121971 - DNA, 25 bp, Rattus norvegicus
agattgtcactgatacgtttcctcc

SEQ ID NO: 121972 - DNA, 25 bp, Rattus norvegicus
agattgtcactgttacgtttcctcc

SEQ ID NO: 121973 - DNA, 25 bp, Rattus norvegicus
agattgtcagcaatgcatcctgcac

SEQ ID NO: 121974 - DNA, 25 bp, Rattus norvegicus
agattgtcagcattgcatcctgcac

SEQ ID NO: 121975 - DNA, 25 bp, Rattus norvegicus
agattgtcatgacggtctccgtagc

SEQ ID NO: 121976 - DNA, 25 bp, Rattus norvegicus
agattgtcatgagggtctccgtagc

SEQ ID NO: 121977 - DNA, 25 bp, Rattus norvegicus
agattgtccaggacaggccaggcca

SEQ ID NO: 121978 - DNA, 25 bp, Rattus norvegicus
agattgtccaggtcaggccaggcca

SEQ ID NO: 121979 - DNA, 25 bp, Rattus norvegicus
agattgtccattaatgccacccata

SEQ ID NO: 121980 - DNA, 25 bp, Rattus norvegicus
agattgtccatttatgccacccata

SEQ ID NO: 121981 - DNA, 25 bp, Rattus norvegicus
agattgtccctgctgatccgctgga

SEQ ID NO: 121982 - DNA, 25 bp, Rattus norvegicus
agattgtccctggtgatccgctgga

SEQ ID NO: 121983 - DNA, 25 bp, Rattus norvegicus
agattgtcctgcaatctccagctgc

SEQ ID NO: 121984 - DNA, 25 bp, Rattus norvegicus
agattgtcctgctatctccagctgc

SEQ ID NO: 121985 - DNA, 25 bp, Rattus norvegicus
agattgtcctttaggacctcagtcc

SEQ ID NO: 121986 - DNA, 25 bp, Rattus norvegicus
agattgtccttttggacctcagtcc

SEQ ID NO: 121987 - DNA, 25 bp, Rattus norvegicus
agattgtcgagtatggcagtcctga

SEQ ID NO: 121988 - DNA, 25 bp, Rattus norvegicus
agattgtcgagtttggcagtcctga

SEQ ID NO: 121989 - DNA, 25 bp, Rattus norvegicus
agattgtctgacaccgggaactgag

SEQ ID NO: 121990 - DNA, 25 bp, Rattus norvegicus
agattgtctgactccgggaactgag

SEQ ID NO: 121991 - DNA, 25 bp, Rattus norvegicus
agattgtctgcaatcattctcgctg

SEQ ID NO: 121992 - DNA, 25 bp, Rattus norvegicus
agattgtctgcattcattctcgctg

SEQ ID NO: 121993 - DNA, 25 bp, Rattus norvegicus
agattgtcttaaccagcatcccggc

SEQ ID NO: 121994 - DNA, 25 bp, Rattus norvegicus
agattgtcttaagcagcatcccggc

SEQ ID NO: 121995 - DNA, 25 bp, Rattus norvegicus
agattgtcttccaacaccaagtctt

SEQ ID NO: 121996 - DNA, 25 bp, Rattus norvegicus
agattgtcttcctacaccaagtctt

SEQ ID NO: 121997 - DNA, 25 bp, Rattus norvegicus
agattgtcttgaacattgcattttt

SEQ ID NO: 121998 - DNA, 25 bp, Rattus norvegicus
agattgtcttgatcattgcattttt

SEQ ID NO: 121999 - DNA, 25 bp, Rattus norvegicus
agattgtgagaccaaacgcctcggt

SEQ ID NO: 122000 - DNA, 25 bp, Rattus norvegicus
agattgtgagacgaaacgcctcggt

SEQ ID NO: 122001 - DNA, 25 bp, Rattus norvegicus
agattgtgcaaactccataccctag

SEQ ID NO: 122002 - DNA, 25 bp, Rattus norvegicus
agattgtgcaaagtccataccctag

SEQ ID NO: 122003 - DNA, 25 bp, Rattus norvegicus
agattgtgccgaagcagaggcctcc

SEQ ID NO: 122004 - DNA, 25 bp, Rattus norvegicus
agattgtgccgatgcagaggcctcc

SEQ ID NO: 122005 - DNA, 25 bp, Rattus norvegicus
agattgtgccttccaactcaggtga

SEQ ID NO: 122006 - DNA, 25 bp, Rattus norvegicus
agattgtgccttgcaactcaggtga

SEQ ID NO: 122007 - DNA, 25 bp, Rattus norvegicus
agattgtgctaacccctgagctgga

SEQ ID NO: 122008 - DNA, 25 bp, Rattus norvegicus
agattgtgctaagccctgagctgga

SEQ ID NO: 122009 - DNA, 25 bp, Rattus norvegicus
agattgtggattccagttttgctga

SEQ ID NO: 122010 - DNA, 25 bp, Rattus norvegicus
agattgtggattgcagttttgctga

SEQ ID NO: 122011 - DNA, 25 bp, Rattus norvegicus
agattgtggcccagatctggtactc

SEQ ID NO: 122012 - DNA, 25 bp, Rattus norvegicus
agattgtggccctgatctggtactc

SEQ ID NO: 122013 - DNA, 25 bp, Rattus norvegicus
agattgtggcctcgctgctctacct

SEQ ID NO: 122014 - DNA, 25 bp, Rattus norvegicus
agattgtggcctggctgctctacct

SEQ ID NO: 122015 - DNA, 25 bp, Rattus norvegicus
agattgtggctgagttctggatccc

SEQ ID NO: 122016 - DNA, 25 bp, Rattus norvegicus
agattgtggctgtgttctggatccc

SEQ ID NO: 122017 - DNA, 25 bp, Rattus norvegicus
agattgtggcttcagtgttttctct

SEQ ID NO: 122018 - DNA, 25 bp, Rattus norvegicus
agattgtggcttgagtgttttctct

SEQ ID NO: 122019 - DNA, 25 bp, Rattus norvegicus
agattgtgggtcaccagccttgcat

SEQ ID NO: 122020 - DNA, 25 bp, Rattus norvegicus
agattgtgggtctccagccttgcat

SEQ ID NO: 122021 - DNA, 25 bp, Rattus norvegicus
agattgtggtgcacccgggttatga

SEQ ID NO: 122022 - DNA, 25 bp, Rattus norvegicus
agattgtggtgctcccgggttatga

SEQ ID NO: 122023 - DNA, 25 bp, Rattus norvegicus
agattgtgtacaacaggtctgtcct

SEQ ID NO: 122024 - DNA, 25 bp, Rattus norvegicus
agattgtgtacatcaggtctgtcct

SEQ ID NO: 122025 - DNA, 25 bp, Rattus norvegicus
agattgtgtgtgactacggctactc

SEQ ID NO: 122026 - DNA, 25 bp, Rattus norvegicus
agattgtgtgtgtctacggctactc

SEQ ID NO: 122027 - DNA, 25 bp, Rattus norvegicus
agattgttattgactctgccctggc

SEQ ID NO: 122028 - DNA, 25 bp, Rattus norvegicus
agattgttattgtctctgccctggc

SEQ ID NO: 122029 - DNA, 25 bp, Rattus norvegicus
agattgttccttccatttcggagta

SEQ ID NO: 122030 - DNA, 25 bp, Rattus norvegicus
agattgttccttgcatttcggagta

SEQ ID NO: 122031 - DNA, 25 bp, Rattus norvegicus
agattgttctcgctcattttcctca

SEQ ID NO: 122032 - DNA, 25 bp, Rattus norvegicus
agattgttctcggtcattttcctca

SEQ ID NO: 122033 - DNA, 25 bp, Rattus norvegicus
agattgttctgaagcgccgggccaa

SEQ ID NO: 122034 - DNA, 25 bp, Rattus norvegicus
agattgttctgatgcgccgggccaa

SEQ ID NO: 122035 - DNA, 25 bp, Rattus norvegicus
agattgttcttgaacaggcctcttt

SEQ ID NO: 122036 - DNA, 25 bp, Rattus norvegicus
agattgttcttgtacaggcctcttt

SEQ ID NO: 122037 - DNA, 25 bp, Rattus norvegicus
agattgttgtgcactctgactccaa

SEQ ID NO: 122038 - DNA, 25 bp, Rattus norvegicus
agattgttgtgctctctgactccaa

SEQ ID NO: 122039 - DNA, 25 bp, Rattus norvegicus
agatttaaaaccatcaacaccaagg

SEQ ID NO: 122040 - DNA, 25 bp, Rattus norvegicus
agatttaaaaccttcaacaccaagg

SEQ ID NO: 122041 - DNA, 25 bp, Rattus norvegicus
agatttaaagcacacatcgcccggg

SEQ ID NO: 122042 - DNA, 25 bp, Rattus norvegicus
agatttaaagcagacatcgcccggg

SEQ ID NO: 122043 - DNA, 25 bp, Rattus norvegicus
agatttaactgcctctgcattcctg

SEQ ID NO: 122044 - DNA, 25 bp, Rattus norvegicus
agatttaactgcgtctgcattcctg

SEQ ID NO: 122045 - DNA, 25 bp, Rattus norvegicus
agatttacaacgatcctgtggctgc

SEQ ID NO: 122046 - DNA, 25 bp, Rattus norvegicus
agatttacaacgttcctgtggctgc

SEQ ID NO: 122047 - DNA, 25 bp, Rattus norvegicus
agatttacagacatattgtcactga

SEQ ID NO: 122048 - DNA, 25 bp, Rattus norvegicus
agatttacagacttattgtcactga

SEQ ID NO: 122049 - DNA, 25 bp, Rattus norvegicus
agatttacagagactcaggctcata

SEQ ID NO: 122050 - DNA, 25 bp, Rattus norvegicus
agatttacagagtctcaggctcata

SEQ ID NO: 122051 - DNA, 25 bp, Rattus norvegicus
agatttacccgtctgtcctctgtat

SEQ ID NO: 122052 - DNA, 25 bp, Rattus norvegicus
agatttacccgtgtgtcctctgtat

SEQ ID NO: 122053 - DNA, 25 bp, Rattus norvegicus
agatttacggaacttctgtcagata

SEQ ID NO: 122054 - DNA, 25 bp, Rattus norvegicus
agatttacggaagttctgtcagata

SEQ ID NO: 122055 - DNA, 25 bp, Rattus norvegicus
agatttactgccctagccagggtac

SEQ ID NO: 122056 - DNA, 25 bp, Rattus norvegicus
agatttactgccgtagccagggtac

SEQ ID NO: 122057 - DNA, 25 bp, Rattus norvegicus
agatttacttgtatactgactgact

SEQ ID NO: 122058 - DNA, 25 bp, Rattus norvegicus
agatttacttgtttactgactgact

SEQ ID NO: 122059 - DNA, 25 bp, Rattus norvegicus
agatttagatctatctcgtctctgc

SEQ ID NO: 122060 - DNA, 25 bp, Rattus norvegicus
agatttagatctttctcgtctctgc

SEQ ID NO: 122061 - DNA, 25 bp, Rattus norvegicus
agatttagccaaatacctctaccac

SEQ ID NO: 122062 - DNA, 25 bp, Rattus norvegicus
agatttagccaattacctctaccac

SEQ ID NO: 122063 - DNA, 25 bp, Rattus norvegicus
agatttatctcaccggattgacaga

SEQ ID NO: 122064 - DNA, 25 bp, Rattus norvegicus
agatttatctcagcggattgacaga

SEQ ID NO: 122065 - DNA, 25 bp, Rattus norvegicus
agatttatctccacattttaaaaag

SEQ ID NO: 122066 - DNA, 25 bp, Rattus norvegicus
agatttatctcctcattttaaaaag

SEQ ID NO: 122067 - DNA, 25 bp, Rattus norvegicus
agatttatctcgattgcccaatgtc

SEQ ID NO: 122068 - DNA, 25 bp, Rattus norvegicus
agatttatctcgtttgcccaatgtc

SEQ ID NO: 122069 - DNA, 25 bp, Rattus norvegicus
agatttatgactattcctcctaccc

SEQ ID NO: 122070 - DNA, 25 bp, Rattus norvegicus
agatttatgacttttcctcctaccc

SEQ ID NO: 122071 - DNA, 25 bp, Rattus norvegicus
agatttatgtttaccacaatgccat

SEQ ID NO: 122072 - DNA, 25 bp, Rattus norvegicus
agatttatgttttccacaatgccat

SEQ ID NO: 122073 - DNA, 25 bp, Rattus norvegicus
agatttcaaaaccaattcagttagc

SEQ ID NO: 122074 - DNA, 25 bp, Rattus norvegicus
agatttcaaaacctgtctgcctaca

SEQ ID NO: 122075 - DNA, 25 bp, Rattus norvegicus
agatttcaaaacgaattcagttagc

SEQ ID NO: 122076 - DNA, 25 bp, Rattus norvegicus
agatttcaaaacgtgtctgcctaca

SEQ ID NO: 122077 - DNA, 25 bp, Rattus norvegicus
agatttcaaaggactggaagcttcc

SEQ ID NO: 122078 - DNA, 25 bp, Rattus norvegicus
agatttcaaaggtctggaagcttcc

SEQ ID NO: 122079 - DNA, 25 bp, Rattus norvegicus
agatttcaactgcagccttaaaggg

SEQ ID NO: 122080 - DNA, 25 bp, Rattus norvegicus
agatttcaactggagccttaaaggg

SEQ ID NO: 122081 - DNA, 25 bp, Rattus norvegicus
agatttcaagctcttttgttccttt

SEQ ID NO: 122082 - DNA, 25 bp, Rattus norvegicus
agatttcaagctgttttgttccttt

SEQ ID NO: 122083 - DNA, 25 bp, Rattus norvegicus
agatttcaatggagacgtggagggc

SEQ ID NO: 122084 - DNA, 25 bp, Rattus norvegicus
agatttcaatggtgacgtggagggc

SEQ ID NO: 122085 - DNA, 25 bp, Rattus norvegicus
agatttcacagaagcgtacccgcag

SEQ ID NO: 122086 - DNA, 25 bp, Rattus norvegicus
agatttcacagatgcgtacccgcag

SEQ ID NO: 122087 - DNA, 25 bp, Rattus norvegicus
agatttcacctaacgagactctcac

SEQ ID NO: 122088 - DNA, 25 bp, Rattus norvegicus
agatttcacctatcgagactctcac

SEQ ID NO: 122089 - DNA, 25 bp, Rattus norvegicus
agatttcactttcaaacctgggaat

SEQ ID NO: 122090 - DNA, 25 bp, Rattus norvegicus
agatttcactttgaaacctgggaat

SEQ ID NO: 122091 - DNA, 25 bp, Rattus norvegicus
agatttcaggtacgtactctgtgaa

SEQ ID NO: 122092 - DNA, 25 bp, Rattus norvegicus
agatttcaggtaggtactctgtgaa

SEQ ID NO: 122093 - DNA, 25 bp, Rattus norvegicus
agatttcagtttccttgcccgggct

SEQ ID NO: 122094 - DNA, 25 bp, Rattus norvegicus
agatttcagtttgcttgcccgggct

SEQ ID NO: 122095 - DNA, 25 bp, Rattus norvegicus
agatttcatgagatttgccttcccc

SEQ ID NO: 122096 - DNA, 25 bp, Rattus norvegicus
agatttcatgagttttgccttcccc

SEQ ID NO: 122097 - DNA, 25 bp, Rattus norvegicus
agatttcattcaattctctatttga

SEQ ID NO: 122098 - DNA, 25 bp, Rattus norvegicus
agatttcattcatttctctatttga

SEQ ID NO: 122099 - DNA, 25 bp, Rattus norvegicus
agatttcattctagtcattttgtaa

SEQ ID NO: 122100 - DNA, 25 bp, Rattus norvegicus
agatttcattcttgtcattttgtaa

SEQ ID NO: 122101 - DNA, 25 bp, Rattus norvegicus
agatttcattggagcgaaactatac

SEQ ID NO: 122102 - DNA, 25 bp, Rattus norvegicus
agatttcattggtgcgaaactatac

SEQ ID NO: 122103 - DNA, 25 bp, Rattus norvegicus
agatttccaacaaggactggtcctg

SEQ ID NO: 122104 - DNA, 25 bp, Rattus norvegicus
agatttccaacatggactggtcctg

SEQ ID NO: 122105 - DNA, 25 bp, Rattus norvegicus
agatttccaagcaagccctcagcga

SEQ ID NO: 122106 - DNA, 25 bp, Rattus norvegicus
agatttccaagctagccctcagcga

SEQ ID NO: 122107 - DNA, 25 bp, Rattus norvegicus
agatttccagaacgcttcggaccca

SEQ ID NO: 122108 - DNA, 25 bp, Rattus norvegicus
agatttccagaaggcttcggaccca

SEQ ID NO: 122109 - DNA, 25 bp, Rattus norvegicus
agatttccagttactagactccctt

SEQ ID NO: 122110 - DNA, 25 bp, Rattus norvegicus
agatttccagtttctagactccctt

SEQ ID NO: 122111 - DNA, 25 bp, Rattus norvegicus
agatttcccagccactgtactgaga

SEQ ID NO: 122112 - DNA, 25 bp, Rattus norvegicus
agatttcccagcgactgtactgaga

SEQ ID NO: 122113 - DNA, 25 bp, Rattus norvegicus
agatttcccttgcttcaggctgttg

SEQ ID NO: 122114 - DNA, 25 bp, Rattus norvegicus
agatttcccttggttcaggctgttg

SEQ ID NO: 122115 - DNA, 25 bp, Rattus norvegicus
agatttcctacaagtctgtgctatt

SEQ ID NO: 122116 - DNA, 25 bp, Rattus norvegicus
agatttcctacatgtctgtgctatt

SEQ ID NO: 122117 - DNA, 25 bp, Rattus norvegicus
agatttcctccaactctaaactctt

SEQ ID NO: 122118 - DNA, 25 bp, Rattus norvegicus
agatttcctccatctctaaactctt

SEQ ID NO: 122119 - DNA, 25 bp, Rattus norvegicus
agatttcctctactttcatgacata

SEQ ID NO: 122120 - DNA, 25 bp, Rattus norvegicus
agatttcctctagtttcatgacata

SEQ ID NO: 122121 - DNA, 25 bp, Rattus norvegicus
agatttcctgccacccattaaggaa

SEQ ID NO: 122122 - DNA, 25 bp, Rattus norvegicus
agatttcctgcctcccattaaggaa

SEQ ID NO: 122123 - DNA, 25 bp, Rattus norvegicus
agatttccttcaaactgggcgtgga

SEQ ID NO: 122124 - DNA, 25 bp, Rattus norvegicus
agatttccttcaagatccatacctg

SEQ ID NO: 122125 - DNA, 25 bp, Rattus norvegicus
agatttccttcatactgggcgtgga

SEQ ID NO: 122126 - DNA, 25 bp, Rattus norvegicus
agatttccttcatgatccatacctg

SEQ ID NO: 122127 - DNA, 25 bp, Rattus norvegicus
agatttccttgtaatggtcagccat

SEQ ID NO: 122128 - DNA, 25 bp, Rattus norvegicus
agatttccttgttatggtcagccat

SEQ ID NO: 122129 - DNA, 25 bp, Rattus norvegicus
agatttcctttgacacttctttctc

SEQ ID NO: 122130 - DNA, 25 bp, Rattus norvegicus
agatttcctttgcatcaaggtgtat

SEQ ID NO: 122131 - DNA, 25 bp, Rattus norvegicus
agatttcctttggatcaaggtgtat

SEQ ID NO: 122132 - DNA, 25 bp, Rattus norvegicus
agatttcctttgtcacttctttctc

SEQ ID NO: 122133 - DNA, 25 bp, Rattus norvegicus
agatttcgactcacacatggttctt

SEQ ID NO: 122134 - DNA, 25 bp, Rattus norvegicus
agatttcgactctcacatggttctt

SEQ ID NO: 122135 - DNA, 25 bp, Rattus norvegicus
agatttcggagtctcttctggctca

SEQ ID NO: 122136 - DNA, 25 bp, Rattus norvegicus
agatttcggagtgtcttctggctca

SEQ ID NO: 122137 - DNA, 25 bp, Rattus norvegicus
agatttcggatgactatgcagaggc

SEQ ID NO: 122138 - DNA, 25 bp, Rattus norvegicus
agatttcggatgtctatgcagaggc

SEQ ID NO: 122139 - DNA, 25 bp, Rattus norvegicus
agatttcggcctatcatggaagaag

SEQ ID NO: 122140 - DNA, 25 bp, Rattus norvegicus
agatttcggcctttcatggaagaag

SEQ ID NO: 122141 - DNA, 25 bp, Rattus norvegicus
agatttcggctgagagactcctcca

SEQ ID NO: 122142 - DNA, 25 bp, Rattus norvegicus
agatttcggctgtgagactcctcca

SEQ ID NO: 122143 - DNA, 25 bp, Rattus norvegicus
agatttctatagagacccccacatt

SEQ ID NO: 122144 - DNA, 25 bp, Rattus norvegicus
agatttctatagtgacccccacatt

SEQ ID NO: 122145 - DNA, 25 bp, Rattus norvegicus
agatttctcaatcctgttgtttaag

SEQ ID NO: 122146 - DNA, 25 bp, Rattus norvegicus
agatttctcaatgctgttgtttaag

SEQ ID NO: 122147 - DNA, 25 bp, Rattus norvegicus
agatttctcaggatcccttcttcta

SEQ ID NO: 122148 - DNA, 25 bp, Rattus norvegicus
agatttctcaggttcccttcttcta

SEQ ID NO: 122149 - DNA, 25 bp, Rattus norvegicus
agatttctcagtagcatttgtccat

SEQ ID NO: 122150 - DNA, 25 bp, Rattus norvegicus
agatttctcagttgcatttgtccat

SEQ ID NO: 122151 - DNA, 25 bp, Rattus norvegicus
agatttctcattctcagtcggaaga

SEQ ID NO: 122152 - DNA, 25 bp, Rattus norvegicus
agatttctcattgtcagtcggaaga

SEQ ID NO: 122153 - DNA, 25 bp, Rattus norvegicus
agatttctcgggagcaggtgcccag

SEQ ID NO: 122154 - DNA, 25 bp, Rattus norvegicus
agatttctcgggtgcaggtgcccag

SEQ ID NO: 122155 - DNA, 25 bp, Rattus norvegicus
agatttctcttaagctgtccttact

SEQ ID NO: 122156 - DNA, 25 bp, Rattus norvegicus
agatttctcttatgctgtccttact

SEQ ID NO: 122157 - DNA, 25 bp, Rattus norvegicus
agatttctgcaaacgctccaggttg

SEQ ID NO: 122158 - DNA, 25 bp, Rattus norvegicus
agatttctgcaatcgctccaggttg

SEQ ID NO: 122159 - DNA, 25 bp, Rattus norvegicus
agatttctggccaaacctactcagg

SEQ ID NO: 122160 - DNA, 25 bp, Rattus norvegicus
agatttctggcctaacctactcagg

SEQ ID NO: 122161 - DNA, 25 bp, Rattus norvegicus
agatttctggtgaaccctgtggtta

SEQ ID NO: 122162 - DNA, 25 bp, Rattus norvegicus
agatttctggtgtaccctgtggtta

SEQ ID NO: 122163 - DNA, 25 bp, Rattus norvegicus
agatttctgtcaaggtgacctaaat

SEQ ID NO: 122164 - DNA, 25 bp, Rattus norvegicus
agatttctgtcatggtgacctaaat

SEQ ID NO: 122165 - DNA, 25 bp, Rattus norvegicus
agatttctgtgactcggaggtcagc

SEQ ID NO: 122166 - DNA, 25 bp, Rattus norvegicus
agatttctgtgacttcacggtccaa

SEQ ID NO: 122167 - DNA, 25 bp, Rattus norvegicus
agatttctgtgagtcggaggtcagc

SEQ ID NO: 122168 - DNA, 25 bp, Rattus norvegicus
agatttctgtgagttcacggtccaa

SEQ ID NO: 122169 - DNA, 25 bp, Rattus norvegicus
agatttcttcctacctatgggcttt

SEQ ID NO: 122170 - DNA, 25 bp, Rattus norvegicus
agatttcttccttcctatgggcttt

SEQ ID NO: 122171 - DNA, 25 bp, Rattus norvegicus
agatttcttctgacctgacattgcc

SEQ ID NO: 122172 - DNA, 25 bp, Rattus norvegicus
agatttcttctgtcctgacattgcc

SEQ ID NO: 122173 - DNA, 25 bp, Rattus norvegicus
agatttcttcttactggcagacttc

SEQ ID NO: 122174 - DNA, 25 bp, Rattus norvegicus
agatttcttctttctggcagacttc

SEQ ID NO: 122175 - DNA, 25 bp, Rattus norvegicus
agatttcttgacattgaccaccttc

SEQ ID NO: 122176 - DNA, 25 bp, Rattus norvegicus
agatttcttgactttgaccaccttc

SEQ ID NO: 122177 - DNA, 25 bp, Rattus norvegicus
agatttcttgtgagggaagtcccca

SEQ ID NO: 122178 - DNA, 25 bp, Rattus norvegicus
agatttcttgtgtgggaagtcccca

SEQ ID NO: 122179 - DNA, 25 bp, Rattus norvegicus
agatttctttgtctggcgtacctgc

SEQ ID NO: 122180 - DNA, 25 bp, Rattus norvegicus
agatttctttgtgtggcgtacctgc

SEQ ID NO: 122181 - DNA, 25 bp, Rattus norvegicus
agatttgaatctcgtctcctctcca

SEQ ID NO: 122182 - DNA, 25 bp, Rattus norvegicus
agatttgaatctggtctcctctcca

SEQ ID NO: 122183 - DNA, 25 bp, Rattus norvegicus
agatttgaatttctttagatcctgg

SEQ ID NO: 122184 - DNA, 25 bp, Rattus norvegicus
agatttgaatttgtttagatcctgg

SEQ ID NO: 122185 - DNA, 25 bp, Rattus norvegicus
agatttgacactatctcctgaactc

SEQ ID NO: 122186 - DNA, 25 bp, Rattus norvegicus
agatttgacactttctcctgaactc

SEQ ID NO: 122187 - DNA, 25 bp, Rattus norvegicus
agatttgaggttctggactccaggt

SEQ ID NO: 122188 - DNA, 25 bp, Rattus norvegicus
agatttgaggttgtggactccaggt

SEQ ID NO: 122189 - DNA, 25 bp, Rattus norvegicus
agatttgatgaccttgccagactgt

SEQ ID NO: 122190 - DNA, 25 bp, Rattus norvegicus
agatttgatgacgttgccagactgt

SEQ ID NO: 122191 - DNA, 25 bp, Rattus norvegicus
agatttgcagttctccccatcatag

SEQ ID NO: 122192 - DNA, 25 bp, Rattus norvegicus
agatttgcagttgtccccatcatag

SEQ ID NO: 122193 - DNA, 25 bp, Rattus norvegicus
agatttgcccgtagacttgcactaa

SEQ ID NO: 122194 - DNA, 25 bp, Rattus norvegicus
agatttgcccgttgacttgcactaa

SEQ ID NO: 122195 - DNA, 25 bp, Rattus norvegicus
agatttgccctaacttaacatgatg

SEQ ID NO: 122196 - DNA, 25 bp, Rattus norvegicus
agatttgccctatcttaacatgatg

SEQ ID NO: 122197 - DNA, 25 bp, Rattus norvegicus
agatttgcctccatttgcttcctga

SEQ ID NO: 122198 - DNA, 25 bp, Rattus norvegicus
agatttgcctccttttgcttcctga

SEQ ID NO: 122199 - DNA, 25 bp, Rattus norvegicus
agatttgctctcctggtacctatgt

SEQ ID NO: 122200 - DNA, 25 bp, Rattus norvegicus
agatttgctctcgtggtacctatgt

SEQ ID NO: 122201 - DNA, 25 bp, Rattus norvegicus
agatttgctgcacctctcctatggg

SEQ ID NO: 122202 - DNA, 25 bp, Rattus norvegicus
agatttgctgcagctctcctatggg

SEQ ID NO: 122203 - DNA, 25 bp, Rattus norvegicus
agatttgctgtaaagtctctcccct

SEQ ID NO: 122204 - DNA, 25 bp, Rattus norvegicus
agatttgctgtatagtctctcccct

SEQ ID NO: 122205 - DNA, 25 bp, Rattus norvegicus
agatttgctttaagacgacctgtat

SEQ ID NO: 122206 - DNA, 25 bp, Rattus norvegicus
agatttgctttatgacgacctgtat

SEQ ID NO: 122207 - DNA, 25 bp, Rattus norvegicus
agatttgctttcaccccttagaaat

SEQ ID NO: 122208 - DNA, 25 bp, Rattus norvegicus
agatttgctttctccccttagaaat

SEQ ID NO: 122209 - DNA, 25 bp, Rattus norvegicus
agatttggactcactgcaggcagct

SEQ ID NO: 122210 - DNA, 25 bp, Rattus norvegicus
agatttggactctctgcaggcagct

SEQ ID NO: 122211 - DNA, 25 bp, Rattus norvegicus
agatttggatacatctctgccgctc

SEQ ID NO: 122212 - DNA, 25 bp, Rattus norvegicus
agatttggatacttctctgccgctc

SEQ ID NO: 122213 - DNA, 25 bp, Rattus norvegicus
agatttggattcaccagctcctgtc

SEQ ID NO: 122214 - DNA, 25 bp, Rattus norvegicus
agatttggattctccagctcctgtc

SEQ ID NO: 122215 - DNA, 25 bp, Rattus norvegicus
agatttggctggagtcagactggat

SEQ ID NO: 122216 - DNA, 25 bp, Rattus norvegicus
agatttggctggtgtcagactggat

SEQ ID NO: 122217 - DNA, 25 bp, Rattus norvegicus
agatttggctgtcgtttttgttgaa

SEQ ID NO: 122218 - DNA, 25 bp, Rattus norvegicus
agatttggctgtggtttttgttgaa

SEQ ID NO: 122219 - DNA, 25 bp, Rattus norvegicus
agatttgggtacatgctctcctgga

SEQ ID NO: 122220 - DNA, 25 bp, Rattus norvegicus
agatttgggtacttgctctcctgga

SEQ ID NO: 122221 - DNA, 25 bp, Rattus norvegicus
agatttggtcccagctggtgaggaa

SEQ ID NO: 122222 - DNA, 25 bp, Rattus norvegicus
agatttggtccctgctggtgaggaa

SEQ ID NO: 122223 - DNA, 25 bp, Rattus norvegicus
agatttggtgtcattcttgttcttg

SEQ ID NO: 122224 - DNA, 25 bp, Rattus norvegicus
agatttggtgtctttcttgttcttg

SEQ ID NO: 122225 - DNA, 25 bp, Rattus norvegicus
agatttggttctatgcagtcagtat

SEQ ID NO: 122226 - DNA, 25 bp, Rattus norvegicus
agatttggttctttgcagtcagtat

SEQ ID NO: 122227 - DNA, 25 bp, Rattus norvegicus
agatttggttttctcctcaggtata

SEQ ID NO: 122228 - DNA, 25 bp, Rattus norvegicus
agatttggttttgtcctcaggtata

SEQ ID NO: 122229 - DNA, 25 bp, Rattus norvegicus
agatttgtaatcactttgctcacca

SEQ ID NO: 122230 - DNA, 25 bp, Rattus norvegicus
agatttgtaatctctttgctcacca

SEQ ID NO: 122231 - DNA, 25 bp, Rattus norvegicus
agatttgtagacagtttctaggata

SEQ ID NO: 122232 - DNA, 25 bp, Rattus norvegicus
agatttgtagactgtttctaggata

SEQ ID NO: 122233 - DNA, 25 bp, Rattus norvegicus
agatttgtggtcacttgtgcccaga

SEQ ID NO: 122234 - DNA, 25 bp, Rattus norvegicus
agatttgtggtctcttgtgcccaga

SEQ ID NO: 122235 - DNA, 25 bp, Rattus norvegicus
agatttgtgtgtacttttatgttta

SEQ ID NO: 122236 - DNA, 25 bp, Rattus norvegicus
agatttgtgtgttcttttatgttta

SEQ ID NO: 122237 - DNA, 25 bp, Rattus norvegicus
agatttgttattatgttcgcgtgat

SEQ ID NO: 122238 - DNA, 25 bp, Rattus norvegicus
agatttgttattttgttcgcgtgat

SEQ ID NO: 122239 - DNA, 25 bp, Rattus norvegicus
agatttgttccacaacccttcactg

SEQ ID NO: 122240 - DNA, 25 bp, Rattus norvegicus
agatttgttccagaacccttcactg

SEQ ID NO: 122241 - DNA, 25 bp, Rattus norvegicus
agatttgtttacaagggcccagaga

SEQ ID NO: 122242 - DNA, 25 bp, Rattus norvegicus
agatttgtttactagggcccagaga

SEQ ID NO: 122243 - DNA, 25 bp, Rattus norvegicus
agattttacataacccgttcctgat

SEQ ID NO: 122244 - DNA, 25 bp, Rattus norvegicus
agattttacatatcccgttcctgat

SEQ ID NO: 122245 - DNA, 25 bp, Rattus norvegicus
agattttaccacatccacggagata

SEQ ID NO: 122246 - DNA, 25 bp, Rattus norvegicus
agattttaccacttccacggagata

SEQ ID NO: 122247 - DNA, 25 bp, Rattus norvegicus
agattttagaaaccgaggctccgcg

SEQ ID NO: 122248 - DNA, 25 bp, Rattus norvegicus
agattttagaaagcgaggctccgcg

SEQ ID NO: 122249 - DNA, 25 bp, Rattus norvegicus
agattttagcatctatgtagcccag

SEQ ID NO: 122250 - DNA, 25 bp, Rattus norvegicus
agattttagcatgtatgtagcccag

SEQ ID NO: 122251 - DNA, 25 bp, Rattus norvegicus
agattttagtgtcctcatggctgtc

SEQ ID NO: 122252 - DNA, 25 bp, Rattus norvegicus
agattttagtgtgctcatggctgtc

SEQ ID NO: 122253 - DNA, 25 bp, Rattus norvegicus
agattttatcctcttctctgttctg

SEQ ID NO: 122254 - DNA, 25 bp, Rattus norvegicus
agattttatcctgttctctgttctg

SEQ ID NO: 122255 - DNA, 25 bp, Rattus norvegicus
agattttattcacagccgagcttag

SEQ ID NO: 122256 - DNA, 25 bp, Rattus norvegicus
agattttattcagagccgagcttag

SEQ ID NO: 122257 - DNA, 25 bp, Rattus norvegicus
agattttatttaactgcgctcagtt

SEQ ID NO: 122258 - DNA, 25 bp, Rattus norvegicus
agattttatttatctgcgctcagtt

SEQ ID NO: 122259 - DNA, 25 bp, Rattus norvegicus
agattttcactcaggacactagacc

SEQ ID NO: 122260 - DNA, 25 bp, Rattus norvegicus
agattttcactctggacactagacc

SEQ ID NO: 122261 - DNA, 25 bp, Rattus norvegicus
agattttcacttccactagaactgg

SEQ ID NO: 122262 - DNA, 25 bp, Rattus norvegicus
agattttcacttgcactagaactgg

SEQ ID NO: 122263 - DNA, 25 bp, Rattus norvegicus
agattttcagtcaagctgccatgtc

SEQ ID NO: 122264 - DNA, 25 bp, Rattus norvegicus
agattttcagtctagctgccatgtc

SEQ ID NO: 122265 - DNA, 25 bp, Rattus norvegicus
agattttcatatctccttcctagga

SEQ ID NO: 122266 - DNA, 25 bp, Rattus norvegicus
agattttcatatgtccttcctagga

SEQ ID NO: 122267 - DNA, 25 bp, Rattus norvegicus
agattttccaacacattccacttgt

SEQ ID NO: 122268 - DNA, 25 bp, Rattus norvegicus
agattttccaactcattccacttgt

SEQ ID NO: 122269 - DNA, 25 bp, Rattus norvegicus
agattttccctcaggctgctgatgc

SEQ ID NO: 122270 - DNA, 25 bp, Rattus norvegicus
agattttccctctggctgctgatgc

SEQ ID NO: 122271 - DNA, 25 bp, Rattus norvegicus
agattttctatcacctctgaccatt

SEQ ID NO: 122272 - DNA, 25 bp, Rattus norvegicus
agattttctatctcctctgaccatt

SEQ ID NO: 122273 - DNA, 25 bp, Rattus norvegicus
agattttctcaactcatcctgttac

SEQ ID NO: 122274 - DNA, 25 bp, Rattus norvegicus
agattttctcaagtcatcctgttac

SEQ ID NO: 122275 - DNA, 25 bp, Rattus norvegicus
agattttctgacacgaagcctgtgg

SEQ ID NO: 122276 - DNA, 25 bp, Rattus norvegicus
agattttctgactcgaagcctgtgg

SEQ ID NO: 122277 - DNA, 25 bp, Rattus norvegicus
agattttgagcaccgaatccccaaa

SEQ ID NO: 122278 - DNA, 25 bp, Rattus norvegicus
agattttgagcaccgtatgccgcgg

SEQ ID NO: 122279 - DNA, 25 bp, Rattus norvegicus
agattttgagcaccgtccaggcgat

SEQ ID NO: 122280 - DNA, 25 bp, Rattus norvegicus
agattttgagcagcgaatccccaaa

SEQ ID NO: 122281 - DNA, 25 bp, Rattus norvegicus
agattttgagcagcgtatgccgcgg

SEQ ID NO: 122282 - DNA, 25 bp, Rattus norvegicus
agattttgagcagcgtccaggcgat

SEQ ID NO: 122283 - DNA, 25 bp, Rattus norvegicus
agattttgagtccaagactttttgg

SEQ ID NO: 122284 - DNA, 25 bp, Rattus norvegicus
agattttgagtcgaagactttttgg

SEQ ID NO: 122285 - DNA, 25 bp, Rattus norvegicus
agattttgcctgacttgggcttcca

SEQ ID NO: 122286 - DNA, 25 bp, Rattus norvegicus
agattttgcctgtcttgggcttcca

SEQ ID NO: 122287 - DNA, 25 bp, Rattus norvegicus
agattttgctggcacaggcctttct

SEQ ID NO: 122288 - DNA, 25 bp, Rattus norvegicus
agattttgctgggacaggcctttct

SEQ ID NO: 122289 - DNA, 25 bp, Rattus norvegicus
agattttgctgtcgcttcattctgt

SEQ ID NO: 122290 - DNA, 25 bp, Rattus norvegicus
agattttgctgtggcttcattctgt

SEQ ID NO: 122291 - DNA, 25 bp, Rattus norvegicus
agattttggagcagcacttgagtgc

SEQ ID NO: 122292 - DNA, 25 bp, Rattus norvegicus
agattttggagctgcacttgagtgc

SEQ ID NO: 122293 - DNA, 25 bp, Rattus norvegicus
agattttggcagctgactcgggtct

SEQ ID NO: 122294 - DNA, 25 bp, Rattus norvegicus
agattttggcaggtgactcgggtct

SEQ ID NO: 122295 - DNA, 25 bp, Rattus norvegicus
agattttggcctaatatccacttat

SEQ ID NO: 122296 - DNA, 25 bp, Rattus norvegicus
agattttggccttatatccacttat

SEQ ID NO: 122297 - DNA, 25 bp, Rattus norvegicus
agattttggctgcatctatccatca

SEQ ID NO: 122298 - DNA, 25 bp, Rattus norvegicus
agattttggctggatctatccatca

SEQ ID NO: 122299 - DNA, 25 bp, Rattus norvegicus
agattttggcttcgtttcttgcctc

SEQ ID NO: 122300 - DNA, 25 bp, Rattus norvegicus
agattttggcttggtttcttgcctc

SEQ ID NO: 122301 - DNA, 25 bp, Rattus norvegicus
agattttgtgacacgagcttcctca

SEQ ID NO: 122302 - DNA, 25 bp, Rattus norvegicus
agattttgtgactcgagcttcctca

SEQ ID NO: 122303 - DNA, 25 bp, Rattus norvegicus
agattttgtgccctgagctttaaca

SEQ ID NO: 122304 - DNA, 25 bp, Rattus norvegicus
agattttgtgccgtgagctttaaca

SEQ ID NO: 122305 - DNA, 25 bp, Rattus norvegicus
agatttttacagatcggtggccttg

SEQ ID NO: 122306 - DNA, 25 bp, Rattus norvegicus
agatttttacagttcggtggccttg

SEQ ID NO: 122307 - DNA, 25 bp, Rattus norvegicus
agatttttactcagcgttttcataa

SEQ ID NO: 122308 - DNA, 25 bp, Rattus norvegicus
agatttttactctgcgttttcataa

SEQ ID NO: 122309 - DNA, 25 bp, Rattus norvegicus
agatttttatctctgactgtggtca

SEQ ID NO: 122310 - DNA, 25 bp, Rattus norvegicus
agatttttatctgtgactgtggtca

SEQ ID NO: 122311 - DNA, 25 bp, Rattus norvegicus
agatttttatgcctaatcacctatt

SEQ ID NO: 122312 - DNA, 25 bp, Rattus norvegicus
agatttttatgcgtaatcacctatt

SEQ ID NO: 122313 - DNA, 25 bp, Rattus norvegicus
agatttttctcacccattaaccata

SEQ ID NO: 122314 - DNA, 25 bp, Rattus norvegicus
agatttttctcagccattaaccata

SEQ ID NO: 122315 - DNA, 25 bp, Rattus norvegicus
agatttttctgtagctctgggtttt

SEQ ID NO: 122316 - DNA, 25 bp, Rattus norvegicus
agatttttctgttgctctgggtttt

SEQ ID NO: 122317 - DNA, 25 bp, Rattus norvegicus
agatttttcttccttcactgattca

SEQ ID NO: 122318 - DNA, 25 bp, Rattus norvegicus
agatttttcttcgttcactgattca

SEQ ID NO: 122319 - DNA, 25 bp, Rattus norvegicus
agatttttgtcacagtcgtcaccac

SEQ ID NO: 122320 - DNA, 25 bp, Rattus norvegicus
agatttttgtcagagtcgtcaccac

SEQ ID NO: 122321 - DNA, 25 bp, Rattus norvegicus
agatttttgtttctgctcctgatga

SEQ ID NO: 122322 - DNA, 25 bp, Rattus norvegicus
agatttttgtttgtgctcctgatga

SEQ ID NO: 122323 - DNA, 25 bp, Rattus norvegicus
agattttttcaaccgctttggcaca

SEQ ID NO: 122324 - DNA, 25 bp, Rattus norvegicus
agattttttcaagcgctttggcaca

SEQ ID NO: 122325 - DNA, 25 bp, Rattus norvegicus
agcaaaaaggtgacgcccaagccag

SEQ ID NO: 122326 - DNA, 25 bp, Rattus norvegicus
agcaaaaaggtgtcgcccaagccag

SEQ ID NO: 122327 - DNA, 25 bp, Rattus norvegicus
agcaaaaccactacggaaactgagt

SEQ ID NO: 122328 - DNA, 25 bp, Rattus norvegicus
agcaaaaccacttcggaaactgagt

SEQ ID NO: 122329 - DNA, 25 bp, Rattus norvegicus
agcaaaacctgcagctgtgtcacct

SEQ ID NO: 122330 - DNA, 25 bp, Rattus norvegicus
agcaaaacctgctgctgtgtcacct

SEQ ID NO: 122331 - DNA, 25 bp, Rattus norvegicus
agcaaaactcgtcccgaattgaatt

SEQ ID NO: 122332 - DNA, 25 bp, Rattus norvegicus
agcaaaactcgtgccgaattgaatt

SEQ ID NO: 122333 - DNA, 25 bp, Rattus norvegicus
agcaaaactttccaactcagtgaag

SEQ ID NO: 122334 - DNA, 25 bp, Rattus norvegicus
agcaaaactttcgaactcagtgaag

SEQ ID NO: 122335 - DNA, 25 bp, Rattus norvegicus
agcaaaagacctcaggcacctggag

SEQ ID NO: 122336 - DNA, 25 bp, Rattus norvegicus
agcaaaagacctgaggcacctggag

SEQ ID NO: 122337 - DNA, 25 bp, Rattus norvegicus
agcaaaagctggatcaggcaccctt

SEQ ID NO: 122338 - DNA, 25 bp, Rattus norvegicus
agcaaaagctggttcaggcaccctt

SEQ ID NO: 122339 - DNA, 25 bp, Rattus norvegicus
agcaaaagggcccagacccagcagt

SEQ ID NO: 122340 - DNA, 25 bp, Rattus norvegicus
agcaaaagggccgagacccagcagt

SEQ ID NO: 122341 - DNA, 25 bp, Rattus norvegicus
agcaaaataaacacctgcttctgcc

SEQ ID NO: 122342 - DNA, 25 bp, Rattus norvegicus
agcaaaataaactcctgcttctgcc

SEQ ID NO: 122343 - DNA, 25 bp, Rattus norvegicus
agcaaaatccccaagctgtgtatta

SEQ ID NO: 122344 - DNA, 25 bp, Rattus norvegicus
agcaaaatcccctagctgtgtatta

SEQ ID NO: 122345 - DNA, 25 bp, Rattus norvegicus
agcaaaatggctcagtgtccctgca

SEQ ID NO: 122346 - DNA, 25 bp, Rattus norvegicus
agcaaaatggctgagtgtccctgca

SEQ ID NO: 122347 - DNA, 25 bp, Rattus norvegicus
agcaaaatggtcctagctccttttc

SEQ ID NO: 122348 - DNA, 25 bp, Rattus norvegicus
agcaaaatggtcgtagctccttttc

SEQ ID NO: 122349 - DNA, 25 bp, Rattus norvegicus
agcaaaattctgaggccaagcggag

SEQ ID NO: 122350 - DNA, 25 bp, Rattus norvegicus
agcaaaattctgtggccaagcggag

SEQ ID NO: 122351 - DNA, 25 bp, Rattus norvegicus
agcaaacaccttaaatcttcactcc

SEQ ID NO: 122352 - DNA, 25 bp, Rattus norvegicus
agcaaacacctttaatcttcactcc

SEQ ID NO: 122353 - DNA, 25 bp, Rattus norvegicus
agcaaacacgcgcacagcaagcctg

SEQ ID NO: 122354 - DNA, 25 bp, Rattus norvegicus
agcaaacacgcggacagcaagcctg

SEQ ID NO: 122355 - DNA, 25 bp, Rattus norvegicus
agcaaacactgaatatccaaacaca

SEQ ID NO: 122356 - DNA, 25 bp, Rattus norvegicus
agcaaacactgattatccaaacaca

SEQ ID NO: 122357 - DNA, 25 bp, Rattus norvegicus
agcaaacactgcctgactataccat

SEQ ID NO: 122358 - DNA, 25 bp, Rattus norvegicus
agcaaacactgcgtgactataccat

SEQ ID NO: 122359 - DNA, 25 bp, Rattus norvegicus
agcaaacagatcacagggtcagcct

SEQ ID NO: 122360 - DNA, 25 bp, Rattus norvegicus
agcaaacagatctcagggtcagcct

SEQ ID NO: 122361 - DNA, 25 bp, Rattus norvegicus
agcaaacaggttccccatgaggcac

SEQ ID NO: 122362 - DNA, 25 bp, Rattus norvegicus
agcaaacaggttgcccatgaggcac

SEQ ID NO: 122363 - DNA, 25 bp, Rattus norvegicus
agcaaacatcttattctctggacct

SEQ ID NO: 122364 - DNA, 25 bp, Rattus norvegicus
agcaaacatctttttctctggacct

SEQ ID NO: 122365 - DNA, 25 bp, Rattus norvegicus
agcaaaccaacgctcagttgctcgt

SEQ ID NO: 122366 - DNA, 25 bp, Rattus norvegicus
agcaaaccaacggtcagttgctcgt

SEQ ID NO: 122367 - DNA, 25 bp, Rattus norvegicus
agcaaaccagatcaggagccccatg

SEQ ID NO: 122368 - DNA, 25 bp, Rattus norvegicus
agcaaaccagatgaggagccccatg

SEQ ID NO: 122369 - DNA, 25 bp, Rattus norvegicus
agcaaacccaagacctttgtgcact

SEQ ID NO: 122370 - DNA, 25 bp, Rattus norvegicus
agcaaacccaagtcctttgtgcact

SEQ ID NO: 122371 - DNA, 25 bp, Rattus norvegicus
agcaaacctgcacgtaccaccaagt

SEQ ID NO: 122372 - DNA, 25 bp, Rattus norvegicus
agcaaacctgcaggtaccaccaagt

SEQ ID NO: 122373 - DNA, 25 bp, Rattus norvegicus
agcaaacctgcgcatatgcctgttg

SEQ ID NO: 122374 - DNA, 25 bp, Rattus norvegicus
agcaaacctgcggatatgcctgttg

SEQ ID NO: 122375 - DNA, 25 bp, Rattus norvegicus
agcaaacctggtagtcgtcatactc

SEQ ID NO: 122376 - DNA, 25 bp, Rattus norvegicus
agcaaacctggttgtcgtcatactc

SEQ ID NO: 122377 - DNA, 25 bp, Rattus norvegicus
agcaaacgagagaggtcaactgtcc

SEQ ID NO: 122378 - DNA, 25 bp, Rattus norvegicus
agcaaacgagagtggtcaactgtcc

SEQ ID NO: 122379 - DNA, 25 bp, Rattus norvegicus
agcaaacggatgacccagagccaga

SEQ ID NO: 122380 - DNA, 25 bp, Rattus norvegicus
agcaaacggatgtcccagagccaga

SEQ ID NO: 122381 - DNA, 25 bp, Rattus norvegicus
agcaaacgggacaatatgaacactt

SEQ ID NO: 122382 - DNA, 25 bp, Rattus norvegicus
agcaaacgggactatatgaacactt

SEQ ID NO: 122383 - DNA, 25 bp, Rattus norvegicus
agcaaactacccatgaagctggcct

SEQ ID NO: 122384 - DNA, 25 bp, Rattus norvegicus
agcaaactacccttgaagctggcct

SEQ ID NO: 122385 - DNA, 25 bp, Rattus norvegicus
agcaaactcaagaccggtcgggaga

SEQ ID NO: 122386 - DNA, 25 bp, Rattus norvegicus
agcaaactcaagtccggtcgggaga

SEQ ID NO: 122387 - DNA, 25 bp, Rattus norvegicus
agcaaactccccatattctgataac

SEQ ID NO: 122388 - DNA, 25 bp, Rattus norvegicus
agcaaactccccttattctgataac

SEQ ID NO: 122389 - DNA, 25 bp, Rattus norvegicus
agcaaactccttaggcatccgctgt

SEQ ID NO: 122390 - DNA, 25 bp, Rattus norvegicus
agcaaactcctttggcatccgctgt

SEQ ID NO: 122391 - DNA, 25 bp, Rattus norvegicus
agcaaactgagtctcggctgtggaa

SEQ ID NO: 122392 - DNA, 25 bp, Rattus norvegicus
agcaaactgagtgtcggctgtggaa

SEQ ID NO: 122393 - DNA, 25 bp, Rattus norvegicus
agcaaactgcacactctcagaaggg

SEQ ID NO: 122394 - DNA, 25 bp, Rattus norvegicus
agcaaactgcactctctcagaaggg

SEQ ID NO: 122395 - DNA, 25 bp, Rattus norvegicus
agcaaactgcgcatggtcggacgga

SEQ ID NO: 122396 - DNA, 25 bp, Rattus norvegicus
agcaaactgcgcttggtcggacgga

SEQ ID NO: 122397 - DNA, 25 bp, Rattus norvegicus
agcaaactgctcataatctcttagg

SEQ ID NO: 122398 - DNA, 25 bp, Rattus norvegicus
agcaaactgctcatgacatatgtat

SEQ ID NO: 122399 - DNA, 25 bp, Rattus norvegicus
agcaaactgctcttaatctcttagg

SEQ ID NO: 122400 - DNA, 25 bp, Rattus norvegicus
agcaaactgctcttgacatatgtat

SEQ ID NO: 122401 - DNA, 25 bp, Rattus norvegicus
agcaaactggagatcccagcgcttg

SEQ ID NO: 122402 - DNA, 25 bp, Rattus norvegicus
agcaaactggagttcccagcgcttg

SEQ ID NO: 122403 - DNA, 25 bp, Rattus norvegicus
agcaaactggccagtggcagcttcc

SEQ ID NO: 122404 - DNA, 25 bp, Rattus norvegicus
agcaaactggcctgtggcagcttcc

SEQ ID NO: 122405 - DNA, 25 bp, Rattus norvegicus
agcaaacttccgagctgaacattgt

SEQ ID NO: 122406 - DNA, 25 bp, Rattus norvegicus
agcaaacttccgtgctgaacattgt

SEQ ID NO: 122407 - DNA, 25 bp, Rattus norvegicus
agcaaacttcgacttcatgaggcag

SEQ ID NO: 122408 - DNA, 25 bp, Rattus norvegicus
agcaaacttcgagttcatgaggcag

SEQ ID NO: 122409 - DNA, 25 bp, Rattus norvegicus
agcaaacttttaactcgcctaggac

SEQ ID NO: 122410 - DNA, 25 bp, Rattus norvegicus
agcaaacttttatctcgcctaggac

SEQ ID NO: 122411 - DNA, 25 bp, Rattus norvegicus
agcaaagaagctcaacagtgacgag

SEQ ID NO: 122412 - DNA, 25 bp, Rattus norvegicus
agcaaagaagctgaacagtgacgag

SEQ ID NO: 122413 - DNA, 25 bp, Rattus norvegicus
agcaaagaatacacagcatgccttt

SEQ ID NO: 122414 - DNA, 25 bp, Rattus norvegicus
agcaaagaatactcagcatgccttt

SEQ ID NO: 122415 - DNA, 25 bp, Rattus norvegicus
agcaaagacaccagcatcccaagtg

SEQ ID NO: 122416 - DNA, 25 bp, Rattus norvegicus
agcaaagacacctgcatcccaagtg

SEQ ID NO: 122417 - DNA, 25 bp, Rattus norvegicus
agcaaagaccctacagtgtggcagt

SEQ ID NO: 122418 - DNA, 25 bp, Rattus norvegicus
agcaaagacccttcagtgtggcagt

SEQ ID NO: 122419 - DNA, 25 bp, Rattus norvegicus
agcaaagagagtcccatcgccagca

SEQ ID NO: 122420 - DNA, 25 bp, Rattus norvegicus
agcaaagagagtgccatcgccagca

SEQ ID NO: 122421 - DNA, 25 bp, Rattus norvegicus
agcaaagagctgatgctcgccttgc

SEQ ID NO: 122422 - DNA, 25 bp, Rattus norvegicus
agcaaagagctgttgctcgccttgc

SEQ ID NO: 122423 - DNA, 25 bp, Rattus norvegicus
agcaaagatgttcctgctccaggga

SEQ ID NO: 122424 - DNA, 25 bp, Rattus norvegicus
agcaaagatgttgctgctccaggga

SEQ ID NO: 122425 - DNA, 25 bp, Rattus norvegicus
agcaaagattgcctgtcccagcact

SEQ ID NO: 122426 - DNA, 25 bp, Rattus norvegicus
agcaaagattgcgtgtcccagcact

SEQ ID NO: 122427 - DNA, 25 bp, Rattus norvegicus
agcaaagcacagcaccacgtggtgt

SEQ ID NO: 122428 - DNA, 25 bp, Rattus norvegicus
agcaaagcacaggaccacgtggtgt

SEQ ID NO: 122429 - DNA, 25 bp, Rattus norvegicus
agcaaagcaccacaggaagcctcga

SEQ ID NO: 122430 - DNA, 25 bp, Rattus norvegicus
agcaaagcaccagaggaagcctcga

SEQ ID NO: 122431 - DNA, 25 bp, Rattus norvegicus
agcaaagcagctcctcatgctgcag

SEQ ID NO: 122432 - DNA, 25 bp, Rattus norvegicus
agcaaagcagctgctcatgctgcag

SEQ ID NO: 122433 - DNA, 25 bp, Rattus norvegicus
agcaaagcatgccagacatccacct

SEQ ID NO: 122434 - DNA, 25 bp, Rattus norvegicus
agcaaagcatgcgagacatccacct

SEQ ID NO: 122435 - DNA, 25 bp, Rattus norvegicus
agcaaagccaatactcttctagaga

SEQ ID NO: 122436 - DNA, 25 bp, Rattus norvegicus
agcaaagccaattctcttctagaga

SEQ ID NO: 122437 - DNA, 25 bp, Rattus norvegicus
agcaaagccgcaccaggcgttctag

SEQ ID NO: 122438 - DNA, 25 bp, Rattus norvegicus
agcaaagccgcagcaggcgttctag

SEQ ID NO: 122439 - DNA, 25 bp, Rattus norvegicus
agcaaagccgtgacggctcctcagg

SEQ ID NO: 122440 - DNA, 25 bp, Rattus norvegicus
agcaaagccgtgtcggctcctcagg

SEQ ID NO: 122441 - DNA, 25 bp, Rattus norvegicus
agcaaagcctacagtctgaacccat

SEQ ID NO: 122442 - DNA, 25 bp, Rattus norvegicus
agcaaagcctactgtctgaacccat

SEQ ID NO: 122443 - DNA, 25 bp, Rattus norvegicus
agcaaagcctccacgagggcagctc

SEQ ID NO: 122444 - DNA, 25 bp, Rattus norvegicus
agcaaagcctcctcgagggcagctc

SEQ ID NO: 122445 - DNA, 25 bp, Rattus norvegicus
agcaaagctgctctgctctcagtca

SEQ ID NO: 122446 - DNA, 25 bp, Rattus norvegicus
agcaaagctgctgtgctctcagtca

SEQ ID NO: 122447 - DNA, 25 bp, Rattus norvegicus
agcaaagcttcaccccttaagggct

SEQ ID NO: 122448 - DNA, 25 bp, Rattus norvegicus
agcaaagcttcagcccttaagggct

SEQ ID NO: 122449 - DNA, 25 bp, Rattus norvegicus
agcaaagcttggaccccactgcgtt

SEQ ID NO: 122450 - DNA, 25 bp, Rattus norvegicus
agcaaagcttggtccccactgcgtt

SEQ ID NO: 122451 - DNA, 25 bp, Rattus norvegicus
agcaaagctttgacgggcatagccg

SEQ ID NO: 122452 - DNA, 25 bp, Rattus norvegicus
agcaaagctttgtcgggcatagccg

SEQ ID NO: 122453 - DNA, 25 bp, Rattus norvegicus
agcaaaggaattaggccctcccata

SEQ ID NO: 122454 - DNA, 25 bp, Rattus norvegicus
agcaaaggaatttggccctcccata

SEQ ID NO: 122455 - DNA, 25 bp, Rattus norvegicus
agcaaaggccctacagcagagcaag

SEQ ID NO: 122456 - DNA, 25 bp, Rattus norvegicus
agcaaaggcccttcagcagagcaag

SEQ ID NO: 122457 - DNA, 25 bp, Rattus norvegicus
agcaaaggcttccttggagctgtta

SEQ ID NO: 122458 - DNA, 25 bp, Rattus norvegicus
agcaaaggcttcgttggagctgtta

SEQ ID NO: 122459 - DNA, 25 bp, Rattus norvegicus
agcaaaggtgtaacgccgggacaac

SEQ ID NO: 122460 - DNA, 25 bp, Rattus norvegicus
agcaaaggtgtatcgccgggacaac

SEQ ID NO: 122461 - DNA, 25 bp, Rattus norvegicus
agcaaagtcacgagccgctgtggag

SEQ ID NO: 122462 - DNA, 25 bp, Rattus norvegicus
agcaaagtcacgtgccgctgtggag

SEQ ID NO: 122463 - DNA, 25 bp, Rattus norvegicus
agcaaagtgttgcaactgtccccag

SEQ ID NO: 122464 - DNA, 25 bp, Rattus norvegicus
agcaaagtgttggaactgtccccag

SEQ ID NO: 122465 - DNA, 25 bp, Rattus norvegicus
agcaaagttaccaactccgaggaga

SEQ ID NO: 122466 - DNA, 25 bp, Rattus norvegicus
agcaaagttacctactccgaggaga

SEQ ID NO: 122467 - DNA, 25 bp, Rattus norvegicus
agcaaagttaggcatgtctgagcat

SEQ ID NO: 122468 - DNA, 25 bp, Rattus norvegicus
agcaaagttagggatgtctgagcat

SEQ ID NO: 122469 - DNA, 25 bp, Rattus norvegicus
agcaaagttctgcattcacgtccca

SEQ ID NO: 122470 - DNA, 25 bp, Rattus norvegicus
agcaaagttctggattcacgtccca

SEQ ID NO: 122471 - DNA, 25 bp, Rattus norvegicus
agcaaagttgacaaaaacctgacaa

SEQ ID NO: 122472 - DNA, 25 bp, Rattus norvegicus
agcaaagttgactaaaacctgacaa

SEQ ID NO: 122473 - DNA, 25 bp, Rattus norvegicus
agcaaataaagcctgagacctgtta

SEQ ID NO: 122474 - DNA, 25 bp, Rattus norvegicus
agcaaataaagcgtgagacctgtta

SEQ ID NO: 122475 - DNA, 25 bp, Rattus norvegicus
agcaaataagccaggacctatgacc

SEQ ID NO: 122476 - DNA, 25 bp, Rattus norvegicus
agcaaataagcctggacctatgacc

SEQ ID NO: 122477 - DNA, 25 bp, Rattus norvegicus
agcaaatactgtatccctattccta

SEQ ID NO: 122478 - DNA, 25 bp, Rattus norvegicus
agcaaatactgtttccctattccta

SEQ ID NO: 122479 - DNA, 25 bp, Rattus norvegicus
agcaaatatgctcttcctaccaaga

SEQ ID NO: 122480 - DNA, 25 bp, Rattus norvegicus
agcaaatatgctgttcctaccaaga

SEQ ID NO: 122481 - DNA, 25 bp, Rattus norvegicus
agcaaatcctacatcttcaggcagc

SEQ ID NO: 122482 - DNA, 25 bp, Rattus norvegicus
agcaaatcctacttcttcaggcagc

SEQ ID NO: 122483 - DNA, 25 bp, Rattus norvegicus
agcaaatcctttaaccagtgacctg

SEQ ID NO: 122484 - DNA, 25 bp, Rattus norvegicus
agcaaatccttttaccagtgacctg

SEQ ID NO: 122485 - DNA, 25 bp, Rattus norvegicus
agcaaatcgatcagcccaggtgtgt

SEQ ID NO: 122486 - DNA, 25 bp, Rattus norvegicus
agcaaatcgatctgcccaggtgtgt

SEQ ID NO: 122487 - DNA, 25 bp, Rattus norvegicus
agcaaatcggtgcactgatcgctgc

SEQ ID NO: 122488 - DNA, 25 bp, Rattus norvegicus
agcaaatcggtggactgatcgctgc

SEQ ID NO: 122489 - DNA, 25 bp, Rattus norvegicus
agcaaatctctccaaaactagtgtg

SEQ ID NO: 122490 - DNA, 25 bp, Rattus norvegicus
agcaaatctctcgaaaactagtgtg

SEQ ID NO: 122491 - DNA, 25 bp, Rattus norvegicus
agcaaatctggtaatcttctccctc

SEQ ID NO: 122492 - DNA, 25 bp, Rattus norvegicus
agcaaatctggttatcttctccctc

SEQ ID NO: 122493 - DNA, 25 bp, Rattus norvegicus
agcaaatgaaccaccggctctcgaa

SEQ ID NO: 122494 - DNA, 25 bp, Rattus norvegicus
agcaaatgaacctccggctctcgaa

SEQ ID NO: 122495 - DNA, 25 bp, Rattus norvegicus
agcaaatgccatacctgatggtccc

SEQ ID NO: 122496 - DNA, 25 bp, Rattus norvegicus
agcaaatgccatattaagggctttt

SEQ ID NO: 122497 - DNA, 25 bp, Rattus norvegicus
agcaaatgccattcctgatggtccc

SEQ ID NO: 122498 - DNA, 25 bp, Rattus norvegicus
agcaaatgccattttaagggctttt

SEQ ID NO: 122499 - DNA, 25 bp, Rattus norvegicus
agcaaatgctgcagagcgctctccc

SEQ ID NO: 122500 - DNA, 25 bp, Rattus norvegicus
agcaaatgctgctgagcgctctccc

SEQ ID NO: 122501 - DNA, 25 bp, Rattus norvegicus
agcaaatgttccatgtgactgtcag

SEQ ID NO: 122502 - DNA, 25 bp, Rattus norvegicus
agcaaatgttccttgtgactgtcag

SEQ ID NO: 122503 - DNA, 25 bp, Rattus norvegicus
agcaaatgttctaacctgctgcact

SEQ ID NO: 122504 - DNA, 25 bp, Rattus norvegicus
agcaaatgttcttacctgctgcact

SEQ ID NO: 122505 - DNA, 25 bp, Rattus norvegicus
agcaaattccagagaaagcccaggg

SEQ ID NO: 122506 - DNA, 25 bp, Rattus norvegicus
agcaaattccagtgaaagcccaggg

SEQ ID NO: 122507 - DNA, 25 bp, Rattus norvegicus
agcaaatttgcacccagactggact

SEQ ID NO: 122508 - DNA, 25 bp, Rattus norvegicus
agcaaatttgcagccagactggact

SEQ ID NO: 122509 - DNA, 25 bp, Rattus norvegicus
agcaacaaacgtccaaatggcaagt

SEQ ID NO: 122510 - DNA, 25 bp, Rattus norvegicus
agcaacaaacgtgcaaatggcaagt

SEQ ID NO: 122511 - DNA, 25 bp, Rattus norvegicus
agcaacaagattccctctctggctc

SEQ ID NO: 122512 - DNA, 25 bp, Rattus norvegicus
agcaacaagattgcctctctggctc

SEQ ID NO: 122513 - DNA, 25 bp, Rattus norvegicus
agcaacaagctgatccactcttggg

SEQ ID NO: 122514 - DNA, 25 bp, Rattus norvegicus
agcaacaagctgttccactcttggg

SEQ ID NO: 122515 - DNA, 25 bp, Rattus norvegicus
agcaacaagttgactgtcacaccca

SEQ ID NO: 122516 - DNA, 25 bp, Rattus norvegicus
agcaacaagttgtctgtcacaccca

SEQ ID NO: 122517 - DNA, 25 bp, Rattus norvegicus
agcaacaatgctctccatgtctctt

SEQ ID NO: 122518 - DNA, 25 bp, Rattus norvegicus
agcaacaatgctgtccatgtctctt

SEQ ID NO: 122519 - DNA, 25 bp, Rattus norvegicus
agcaacacaactactggttccaagt

SEQ ID NO: 122520 - DNA, 25 bp, Rattus norvegicus
agcaacacaacttctggttccaagt

SEQ ID NO: 122521 - DNA, 25 bp, Rattus norvegicus
agcaacacccagcagctgtacagat

SEQ ID NO: 122522 - DNA, 25 bp, Rattus norvegicus
agcaacacccaggagctgtacagat

SEQ ID NO: 122523 - DNA, 25 bp, Rattus norvegicus
agcaacacccctcagtcgaacatgg

SEQ ID NO: 122524 - DNA, 25 bp, Rattus norvegicus
agcaacacccctgagtcgaacatgg

SEQ ID NO: 122525 - DNA, 25 bp, Rattus norvegicus
agcaacaccgaaagaggcttccttt

SEQ ID NO: 122526 - DNA, 25 bp, Rattus norvegicus
agcaacaccgaatgaggcttccttt

SEQ ID NO: 122527 - DNA, 25 bp, Rattus norvegicus
agcaacactgggatttctctgtgaa

SEQ ID NO: 122528 - DNA, 25 bp, Rattus norvegicus
agcaacactgggttttctctgtgaa

SEQ ID NO: 122529 - DNA, 25 bp, Rattus norvegicus
agcaacacttcaacactgagctttc

SEQ ID NO: 122530 - DNA, 25 bp, Rattus norvegicus
agcaacacttcatcactgagctttc

SEQ ID NO: 122531 - DNA, 25 bp, Rattus norvegicus
agcaacagaatccaggaccccagca

SEQ ID NO: 122532 - DNA, 25 bp, Rattus norvegicus
agcaacagaatcgaggaccccagca

SEQ ID NO: 122533 - DNA, 25 bp, Rattus norvegicus
agcaacagcatgctgggactgcagt

SEQ ID NO: 122534 - DNA, 25 bp, Rattus norvegicus
agcaacagcatggtgggactgcagt

SEQ ID NO: 122535 - DNA, 25 bp, Rattus norvegicus
agcaacagccaaatgcaccacttta

SEQ ID NO: 122536 - DNA, 25 bp, Rattus norvegicus
agcaacagccaattgcaccacttta

SEQ ID NO: 122537 - DNA, 25 bp, Rattus norvegicus
agcaacagccacacttcttccagag

SEQ ID NO: 122538 - DNA, 25 bp, Rattus norvegicus
agcaacagccactcttcttccagag

SEQ ID NO: 122539 - DNA, 25 bp, Rattus norvegicus
agcaacagccatactctggtttcac

SEQ ID NO: 122540 - DNA, 25 bp, Rattus norvegicus
agcaacagccattctctggtttcac

SEQ ID NO: 122541 - DNA, 25 bp, Rattus norvegicus
agcaacagctccaatgaactcctac

SEQ ID NO: 122542 - DNA, 25 bp, Rattus norvegicus
agcaacagctcctatgaactcctac

SEQ ID NO: 122543 - DNA, 25 bp, Rattus norvegicus
agcaacaggacgctgggtctccagc

SEQ ID NO: 122544 - DNA, 25 bp, Rattus norvegicus
agcaacaggacggtgggtctccagc

SEQ ID NO: 122545 - DNA, 25 bp, Rattus norvegicus
agcaacaggcctcggctgtgtgaca

SEQ ID NO: 122546 - DNA, 25 bp, Rattus norvegicus
agcaacaggcctgggctgtgtgaca

SEQ ID NO: 122547 - DNA, 25 bp, Rattus norvegicus
agcaacagtggaaaccgggctatgt

SEQ ID NO: 122548 - DNA, 25 bp, Rattus norvegicus
agcaacagtggataccgggctatgt

SEQ ID NO: 122549 - DNA, 25 bp, Rattus norvegicus
agcaacatcctcaccgtgtgaagaa

SEQ ID NO: 122550 - DNA, 25 bp, Rattus norvegicus
agcaacatcctctccgtgtgaagaa

SEQ ID NO: 122551 - DNA, 25 bp, Rattus norvegicus
agcaacatcttcagggtgccgacag

SEQ ID NO: 122552 - DNA, 25 bp, Rattus norvegicus
agcaacatcttctgggtgccgacag

SEQ ID NO: 122553 - DNA, 25 bp, Rattus norvegicus
agcaacatgggcaagcacctatgcg

SEQ ID NO: 122554 - DNA, 25 bp, Rattus norvegicus
agcaacatgggctagcacctatgcg

SEQ ID NO: 122555 - DNA, 25 bp, Rattus norvegicus
agcaacatgtcacagccagccaagc

SEQ ID NO: 122556 - DNA, 25 bp, Rattus norvegicus
agcaacatgtcagagccagccaagc

SEQ ID NO: 122557 - DNA, 25 bp, Rattus norvegicus
agcaacattgatctgacttgcattt

SEQ ID NO: 122558 - DNA, 25 bp, Rattus norvegicus
agcaacattgatgtgacttgcattt

SEQ ID NO: 122559 - DNA, 25 bp, Rattus norvegicus
agcaacatttgcagtgacatagtaa

SEQ ID NO: 122560 - DNA, 25 bp, Rattus norvegicus
agcaacatttgctgtgacatagtaa

SEQ ID NO: 122561 - DNA, 25 bp, Rattus norvegicus
agcaacattttgatggcagagccca

SEQ ID NO: 122562 - DNA, 25 bp, Rattus norvegicus
agcaacattttgttggcagagccca

SEQ ID NO: 122563 - DNA, 25 bp, Rattus norvegicus
agcaaccaacaccaggcagctgttg

SEQ ID NO: 122564 - DNA, 25 bp, Rattus norvegicus
agcaaccaacacgaggcagctgttg

SEQ ID NO: 122565 - DNA, 25 bp, Rattus norvegicus
agcaaccaatccacttagccatgtt

SEQ ID NO: 122566 - DNA, 25 bp, Rattus norvegicus
agcaaccaatcctcttagccatgtt

SEQ ID NO: 122567 - DNA, 25 bp, Rattus norvegicus
agcaaccaatgaagccagttcctgg

SEQ ID NO: 122568 - DNA, 25 bp, Rattus norvegicus
agcaaccaatgatgccagttcctgg

SEQ ID NO: 122569 - DNA, 25 bp, Rattus norvegicus
agcaaccacggcaagtacatcactt

SEQ ID NO: 122570 - DNA, 25 bp, Rattus norvegicus
agcaaccacggctagtacatcactt

SEQ ID NO: 122571 - DNA, 25 bp, Rattus norvegicus
agcaaccatggtagagaccctgtcc

SEQ ID NO: 122572 - DNA, 25 bp, Rattus norvegicus
agcaaccatggttgagaccctgtcc

SEQ ID NO: 122573 - DNA, 25 bp, Rattus norvegicus
agcaaccatgttatacctgagggaa

SEQ ID NO: 122574 - DNA, 25 bp, Rattus norvegicus
agcaaccatgttttacctgagggaa

SEQ ID NO: 122575 - DNA, 25 bp, Rattus norvegicus
agcaaccattagagccaacagctcc

SEQ ID NO: 122576 - DNA, 25 bp, Rattus norvegicus
agcaaccattagtgccaacagctcc

SEQ ID NO: 122577 - DNA, 25 bp, Rattus norvegicus
agcaacccaaatattcatcgacaga

SEQ ID NO: 122578 - DNA, 25 bp, Rattus norvegicus
agcaacccaaattttcatcgacaga

SEQ ID NO: 122579 - DNA, 25 bp, Rattus norvegicus
agcaacccctgcagtttttgtttca

SEQ ID NO: 122580 - DNA, 25 bp, Rattus norvegicus
agcaacccctgctgtttttgtttca

SEQ ID NO: 122581 - DNA, 25 bp, Rattus norvegicus
agcaaccctcacaatgtattctctt

SEQ ID NO: 122582 - DNA, 25 bp, Rattus norvegicus
agcaaccctcactatgtattctctt

SEQ ID NO: 122583 - DNA, 25 bp, Rattus norvegicus
agcaaccctgaccttggagacagtg

SEQ ID NO: 122584 - DNA, 25 bp, Rattus norvegicus
agcaaccctgacgttggagacagtg

SEQ ID NO: 122585 - DNA, 25 bp, Rattus norvegicus
agcaaccctgccattgaaatctcac

SEQ ID NO: 122586 - DNA, 25 bp, Rattus norvegicus
agcaaccctgcctttgaaatctcac

SEQ ID NO: 122587 - DNA, 25 bp, Rattus norvegicus
agcaaccctggtctttgaggtggaa

SEQ ID NO: 122588 - DNA, 25 bp, Rattus norvegicus
agcaaccctggtgtttgaggtggaa

SEQ ID NO: 122589 - DNA, 25 bp, Rattus norvegicus
agcaaccgaggaaccaaattggctg

SEQ ID NO: 122590 - DNA, 25 bp, Rattus norvegicus
agcaaccgaggatccaaattggctg

SEQ ID NO: 122591 - DNA, 25 bp, Rattus norvegicus
agcaaccgcaagataccatgtaccc

SEQ ID NO: 122592 - DNA, 25 bp, Rattus norvegicus
agcaaccgcaagttaccatgtaccc

SEQ ID NO: 122593 - DNA, 25 bp, Rattus norvegicus
agcaaccgccaacagctgttagcac

SEQ ID NO: 122594 - DNA, 25 bp, Rattus norvegicus
agcaaccgccaagagctgttagcac

SEQ ID NO: 122595 - DNA, 25 bp, Rattus norvegicus
agcaaccgccaccaagaatctgaag

SEQ ID NO: 122596 - DNA, 25 bp, Rattus norvegicus
agcaaccgccacgaagaatctgaag

SEQ ID NO: 122597 - DNA, 25 bp, Rattus norvegicus
agcaaccggcctactagcaataatg

SEQ ID NO: 122598 - DNA, 25 bp, Rattus norvegicus
agcaaccggccttctagcaataatg

SEQ ID NO: 122599 - DNA, 25 bp, Rattus norvegicus
agcaaccggtgtacagcagtgccta

SEQ ID NO: 122600 - DNA, 25 bp, Rattus norvegicus
agcaaccggtgttcagcagtgccta

SEQ ID NO: 122601 - DNA, 25 bp, Rattus norvegicus
agcaacctagtgaaaccctatcaga

SEQ ID NO: 122602 - DNA, 25 bp, Rattus norvegicus
agcaacctagtgtaaccctatcaga

SEQ ID NO: 122603 - DNA, 25 bp, Rattus norvegicus
agcaacctcaccagtgacctggagg

SEQ ID NO: 122604 - DNA, 25 bp, Rattus norvegicus
agcaacctcacctgtgacctggagg

SEQ ID NO: 122605 - DNA, 25 bp, Rattus norvegicus
agcaacctcagtccccttagcatgt

SEQ ID NO: 122606 - DNA, 25 bp, Rattus norvegicus
agcaacctcagtgcccttagcatgt

SEQ ID NO: 122607 - DNA, 25 bp, Rattus norvegicus
agcaacctctagctcaaccaggcag

SEQ ID NO: 122608 - DNA, 25 bp, Rattus norvegicus
agcaacctctaggtcaaccaggcag

SEQ ID NO: 122609 - DNA, 25 bp, Rattus norvegicus
agcaacctgatgagcctatctgaca

SEQ ID NO: 122610 - DNA, 25 bp, Rattus norvegicus
agcaacctgatgtgcctatctgaca

SEQ ID NO: 122611 - DNA, 25 bp, Rattus norvegicus
agcaacctgcgcacgcacatgcgta

SEQ ID NO: 122612 - DNA, 25 bp, Rattus norvegicus
agcaacctgcgctcgcacatgcgta

SEQ ID NO: 122613 - DNA, 25 bp, Rattus norvegicus
agcaacctggagaaagagctaccat

SEQ ID NO: 122614 - DNA, 25 bp, Rattus norvegicus
agcaacctggagtaagagctaccat

SEQ ID NO: 122615 - DNA, 25 bp, Rattus norvegicus
agcaacctgggcctgacacagaatg

SEQ ID NO: 122616 - DNA, 25 bp, Rattus norvegicus
agcaacctgggcgtgacacagaatg

SEQ ID NO: 122617 - DNA, 25 bp, Rattus norvegicus
agcaacctggttccagcagcatcgg

SEQ ID NO: 122618 - DNA, 25 bp, Rattus norvegicus
agcaacctggttgcagcagcatcgg

SEQ ID NO: 122619 - DNA, 25 bp, Rattus norvegicus
agcaacctgtttattgtgcctcaaa

SEQ ID NO: 122620 - DNA, 25 bp, Rattus norvegicus
agcaacctgttttttgtgcctcaaa

SEQ ID NO: 122621 - DNA, 25 bp, Rattus norvegicus
agcaaccttcagctgcatatgcagg

SEQ ID NO: 122622 - DNA, 25 bp, Rattus norvegicus
agcaaccttcaggtgcatatgcagg

SEQ ID NO: 122623 - DNA, 25 bp, Rattus norvegicus
agcaacctttgtcatcgctgtcact

SEQ ID NO: 122624 - DNA, 25 bp, Rattus norvegicus
agcaacctttgtgatcgctgtcact

SEQ ID NO: 122625 - DNA, 25 bp, Rattus norvegicus
agcaacgaatccagctgagcagcta

SEQ ID NO: 122626 - DNA, 25 bp, Rattus norvegicus
agcaacgaatcctgctgagcagcta

SEQ ID NO: 122627 - DNA, 25 bp, Rattus norvegicus
agcaacgccccaccaagggcagttg

SEQ ID NO: 122628 - DNA, 25 bp, Rattus norvegicus
agcaacgccccagcaagggcagttg

SEQ ID NO: 122629 - DNA, 25 bp, Rattus norvegicus
agcaacgcctgtaacagtgggtcca

SEQ ID NO: 122630 - DNA, 25 bp, Rattus norvegicus
agcaacgcctgttacagtgggtcca

SEQ ID NO: 122631 - DNA, 25 bp, Rattus norvegicus
agcaacgctaccacgaggacatttt

SEQ ID NO: 122632 - DNA, 25 bp, Rattus norvegicus
agcaacgctacctcgaggacatttt

SEQ ID NO: 122633 - DNA, 25 bp, Rattus norvegicus
agcaacgctgctctacatgtggtgg

SEQ ID NO: 122634 - DNA, 25 bp, Rattus norvegicus
agcaacgctgctgtacatgtggtgg

SEQ ID NO: 122635 - DNA, 25 bp, Rattus norvegicus
agcaacgcttgtccctgagatcatt

SEQ ID NO: 122636 - DNA, 25 bp, Rattus norvegicus
agcaacgcttgtgcctgagatcatt

SEQ ID NO: 122637 - DNA, 25 bp, Rattus norvegicus
agcaacggcaaacaaacccgcagga

SEQ ID NO: 122638 - DNA, 25 bp, Rattus norvegicus
agcaacggcaaagaaacccgcagga

SEQ ID NO: 122639 - DNA, 25 bp, Rattus norvegicus
agcaacggcacgctggtcaacatca

SEQ ID NO: 122640 - DNA, 25 bp, Rattus norvegicus
agcaacggcacggtggtcaacatca

SEQ ID NO: 122641 - DNA, 25 bp, Rattus norvegicus
agcaacggcgcaagtgagtcgtgtt

SEQ ID NO: 122642 - DNA, 25 bp, Rattus norvegicus
agcaacggcgcatgtgagtcgtgtt

SEQ ID NO: 122643 - DNA, 25 bp, Rattus norvegicus
agcaacggctctagcgcatgctttt

SEQ ID NO: 122644 - DNA, 25 bp, Rattus norvegicus
agcaacggctcttgcgcatgctttt

SEQ ID NO: 122645 - DNA, 25 bp, Rattus norvegicus
agcaacgtctgcagttcaagggcaa

SEQ ID NO: 122646 - DNA, 25 bp, Rattus norvegicus
agcaacgtctgctgttcaagggcaa

SEQ ID NO: 122647 - DNA, 25 bp, Rattus norvegicus
agcaacgtgactactgtgcgcacta

SEQ ID NO: 122648 - DNA, 25 bp, Rattus norvegicus
agcaacgtgacttctgtgcgcacta

SEQ ID NO: 122649 - DNA, 25 bp, Rattus norvegicus
agcaacgtgctgctcgtcgtgcatt

SEQ ID NO: 122650 - DNA, 25 bp, Rattus norvegicus
agcaacgtgctggtcgtcgtgcatt

SEQ ID NO: 122651 - DNA, 25 bp, Rattus norvegicus
agcaacgtggacattgacctgaccc

SEQ ID NO: 122652 - DNA, 25 bp, Rattus norvegicus
agcaacgtggactttgacctgaccc

SEQ ID NO: 122653 - DNA, 25 bp, Rattus norvegicus
agcaacgttgagatccactgcggca

SEQ ID NO: 122654 - DNA, 25 bp, Rattus norvegicus
agcaacgttgagttccactgcggca

SEQ ID NO: 122655 - DNA, 25 bp, Rattus norvegicus
agcaactacaccaggatttttccaa

SEQ ID NO: 122656 - DNA, 25 bp, Rattus norvegicus
agcaactacacctggatttttccaa

SEQ ID NO: 122657 - DNA, 25 bp, Rattus norvegicus
agcaactacacgctggctcagagca

SEQ ID NO: 122658 - DNA, 25 bp, Rattus norvegicus
agcaactacacggtggctcagagca

SEQ ID NO: 122659 - DNA, 25 bp, Rattus norvegicus
agcaactactagactcctggacttg

SEQ ID NO: 122660 - DNA, 25 bp, Rattus norvegicus
agcaactactagtctcctggacttg

SEQ ID NO: 122661 - DNA, 25 bp, Rattus norvegicus
agcaactagcttaatcactcagtgc

SEQ ID NO: 122662 - DNA, 25 bp, Rattus norvegicus
agcaactagctttatcactcagtgc

SEQ ID NO: 122663 - DNA, 25 bp, Rattus norvegicus
agcaactaggccatttgtcctggta

SEQ ID NO: 122664 - DNA, 25 bp, Rattus norvegicus
agcaactaggccttttgtcctggta

SEQ ID NO: 122665 - DNA, 25 bp, Rattus norvegicus
agcaactcaactcctttcatcacaa

SEQ ID NO: 122666 - DNA, 25 bp, Rattus norvegicus
agcaactcaactgctttcatcacaa

SEQ ID NO: 122667 - DNA, 25 bp, Rattus norvegicus
agcaactccatgcaaactgtccaga

SEQ ID NO: 122668 - DNA, 25 bp, Rattus norvegicus
agcaactccatggaaactgtccaga

SEQ ID NO: 122669 - DNA, 25 bp, Rattus norvegicus
agcaactcccatatgaccagcaaag

SEQ ID NO: 122670 - DNA, 25 bp, Rattus norvegicus
agcaactcccatttgaccagcaaag

SEQ ID NO: 122671 - DNA, 25 bp, Rattus norvegicus
agcaactccggcacctacaaaggaa

SEQ ID NO: 122672 - DNA, 25 bp, Rattus norvegicus
agcaactccggctcctacaaaggaa

SEQ ID NO: 122673 - DNA, 25 bp, Rattus norvegicus
agcaactccgtgacatttactctgt

SEQ ID NO: 122674 - DNA, 25 bp, Rattus norvegicus
agcaactccgtgtcatttactctgt

SEQ ID NO: 122675 - DNA, 25 bp, Rattus norvegicus
agcaactctccgcaaccgggagtgg

SEQ ID NO: 122676 - DNA, 25 bp, Rattus norvegicus
agcaactctccggaaccgggagtgg

SEQ ID NO: 122677 - DNA, 25 bp, Rattus norvegicus
agcaactctgacagagcccttagtg

SEQ ID NO: 122678 - DNA, 25 bp, Rattus norvegicus
agcaactctgactgagcccttagtg

SEQ ID NO: 122679 - DNA, 25 bp, Rattus norvegicus
agcaactctgagatctgtgtcatat

SEQ ID NO: 122680 - DNA, 25 bp, Rattus norvegicus
agcaactctgagttctgtgtcatat

SEQ ID NO: 122681 - DNA, 25 bp, Rattus norvegicus
agcaactctgtcaacacgtgagctg

SEQ ID NO: 122682 - DNA, 25 bp, Rattus norvegicus
agcaactctgtctacacgtgagctg

SEQ ID NO: 122683 - DNA, 25 bp, Rattus norvegicus
agcaactcttacagtcagtcttagg

SEQ ID NO: 122684 - DNA, 25 bp, Rattus norvegicus
agcaactcttactgtcagtcttagg

SEQ ID NO: 122685 - DNA, 25 bp, Rattus norvegicus
agcaactgcagcagcgccatcaggc

SEQ ID NO: 122686 - DNA, 25 bp, Rattus norvegicus
agcaactgcagctgcgccatcaggc

SEQ ID NO: 122687 - DNA, 25 bp, Rattus norvegicus
agcaactgccccatcagtgatgttt

SEQ ID NO: 122688 - DNA, 25 bp, Rattus norvegicus
agcaactgccccttcagtgatgttt

SEQ ID NO: 122689 - DNA, 25 bp, Rattus norvegicus
agcaactgccttaattttagtcact

SEQ ID NO: 122690 - DNA, 25 bp, Rattus norvegicus
agcaactgccttacaatttatgcca

SEQ ID NO: 122691 - DNA, 25 bp, Rattus norvegicus
agcaactgcctttattttagtcact

SEQ ID NO: 122692 - DNA, 25 bp, Rattus norvegicus
agcaactgcctttcaatttatgcca

SEQ ID NO: 122693 - DNA, 25 bp, Rattus norvegicus
agcaactgctagaccttcattttca

SEQ ID NO: 122694 - DNA, 25 bp, Rattus norvegicus
agcaactgctagtccttcattttca

SEQ ID NO: 122695 - DNA, 25 bp, Rattus norvegicus
agcaactgctggcagatcttctgtc

SEQ ID NO: 122696 - DNA, 25 bp, Rattus norvegicus
agcaactgctgggagatcttctgtc

SEQ ID NO: 122697 - DNA, 25 bp, Rattus norvegicus
agcaactgttgcaacttcaggcaga

SEQ ID NO: 122698 - DNA, 25 bp, Rattus norvegicus
agcaactgttgctacttcaggcaga

SEQ ID NO: 122699 - DNA, 25 bp, Rattus norvegicus
agcaactgtttaccttatgtcccca

SEQ ID NO: 122700 - DNA, 25 bp, Rattus norvegicus
agcaactgtttagcttatgtcccca

SEQ ID NO: 122701 - DNA, 25 bp, Rattus norvegicus
agcaacttacacagcttgcatttgt

SEQ ID NO: 122702 - DNA, 25 bp, Rattus norvegicus
agcaacttacactgcttgcatttgt

SEQ ID NO: 122703 - DNA, 25 bp, Rattus norvegicus
agcaacttataaccattcaatcctt

SEQ ID NO: 122704 - DNA, 25 bp, Rattus norvegicus
agcaacttataagcattcaatcctt

SEQ ID NO: 122705 - DNA, 25 bp, Rattus norvegicus
agcaacttcgagagcaggaggctgt

SEQ ID NO: 122706 - DNA, 25 bp, Rattus norvegicus
agcaacttcgagtgcaggaggctgt

SEQ ID NO: 122707 - DNA, 25 bp, Rattus norvegicus
agcaacttggctagtaatctgagaa

SEQ ID NO: 122708 - DNA, 25 bp, Rattus norvegicus
agcaacttggcttgtaatctgagaa

SEQ ID NO: 122709 - DNA, 25 bp, Rattus norvegicus
agcaacttgttccatgacagcgatg

SEQ ID NO: 122710 - DNA, 25 bp, Rattus norvegicus
agcaacttgttcgatgacagcgatg

SEQ ID NO: 122711 - DNA, 25 bp, Rattus norvegicus
agcaactttgggactgggaatgtaa

SEQ ID NO: 122712 - DNA, 25 bp, Rattus norvegicus
agcaactttgggtctgggaatgtaa

SEQ ID NO: 122713 - DNA, 25 bp, Rattus norvegicus
agcaacttttgcaccagtagcctgg

SEQ ID NO: 122714 - DNA, 25 bp, Rattus norvegicus
agcaacttttgctccagtagcctgg

SEQ ID NO: 122715 - DNA, 25 bp, Rattus norvegicus
agcaagaaagcgacggccgccgaag

SEQ ID NO: 122716 - DNA, 25 bp, Rattus norvegicus
agcaagaaagcgtcggccgccgaag

SEQ ID NO: 122717 - DNA, 25 bp, Rattus norvegicus
agcaagaaaggcacattttgtggaa

SEQ ID NO: 122718 - DNA, 25 bp, Rattus norvegicus
agcaagaaaggctcattttgtggaa

SEQ ID NO: 122719 - DNA, 25 bp, Rattus norvegicus
agcaagaactgcaaagtcctgttgg

SEQ ID NO: 122720 - DNA, 25 bp, Rattus norvegicus
agcaagaactgctaagtcctgttgg

SEQ ID NO: 122721 - DNA, 25 bp, Rattus norvegicus
agcaagaagagaagtgtcatcccac

SEQ ID NO: 122722 - DNA, 25 bp, Rattus norvegicus
agcaagaagagatgtgtcatcccac

SEQ ID NO: 122723 - DNA, 25 bp, Rattus norvegicus
agcaagaagcttctgggccagttca

SEQ ID NO: 122724 - DNA, 25 bp, Rattus norvegicus
agcaagaagcttgtgggccagttca

SEQ ID NO: 122725 - DNA, 25 bp, Rattus norvegicus
agcaagaattgcatttctccccgat

SEQ ID NO: 122726 - DNA, 25 bp, Rattus norvegicus
agcaagaattgcttttctccccgat

SEQ ID NO: 122727 - DNA, 25 bp, Rattus norvegicus
agcaagaatttacggctgagttctc

SEQ ID NO: 122728 - DNA, 25 bp, Rattus norvegicus
agcaagaatttagggctgagttctc

SEQ ID NO: 122729 - DNA, 25 bp, Rattus norvegicus
agcaagaccaggcactcatgcacct

SEQ ID NO: 122730 - DNA, 25 bp, Rattus norvegicus
agcaagaccagggactcatgcacct

SEQ ID NO: 122731 - DNA, 25 bp, Rattus norvegicus
agcaagacccctcaaagtgacccat

SEQ ID NO: 122732 - DNA, 25 bp, Rattus norvegicus
agcaagacccctgaaagtgacccat

SEQ ID NO: 122733 - DNA, 25 bp, Rattus norvegicus
agcaagacgccaaaggagactgttt

SEQ ID NO: 122734 - DNA, 25 bp, Rattus norvegicus
agcaagacgccataggagactgttt

SEQ ID NO: 122735 - DNA, 25 bp, Rattus norvegicus
agcaagactcggcatcactcagatg

SEQ ID NO: 122736 - DNA, 25 bp, Rattus norvegicus
agcaagactcgggatcactcagatg

SEQ ID NO: 122737 - DNA, 25 bp, Rattus norvegicus
agcaagactgttatccaagttctct

SEQ ID NO: 122738 - DNA, 25 bp, Rattus norvegicus
agcaagactgttttccaagttctct

SEQ ID NO: 122739 - DNA, 25 bp, Rattus norvegicus
agcaagacttcaagcctgactggct

SEQ ID NO: 122740 - DNA, 25 bp, Rattus norvegicus
agcaagacttcatgcctgactggct

SEQ ID NO: 122741 - DNA, 25 bp, Rattus norvegicus
agcaagagacggagccgcccggaaa

SEQ ID NO: 122742 - DNA, 25 bp, Rattus norvegicus
agcaagagacggtgccgcccggaaa

SEQ ID NO: 122743 - DNA, 25 bp, Rattus norvegicus
agcaagagagcccagaaccaccgat

SEQ ID NO: 122744 - DNA, 25 bp, Rattus norvegicus
agcaagagagccgagaaccaccgat

SEQ ID NO: 122745 - DNA, 25 bp, Rattus norvegicus
agcaagagcagcaactacagcagct

SEQ ID NO: 122746 - DNA, 25 bp, Rattus norvegicus
agcaagagcagctactacagcagct

SEQ ID NO: 122747 - DNA, 25 bp, Rattus norvegicus
agcaagagcagtatcattcacaaga

SEQ ID NO: 122748 - DNA, 25 bp, Rattus norvegicus
agcaagagcagtttcattcacaaga

SEQ ID NO: 122749 - DNA, 25 bp, Rattus norvegicus
agcaagagcgctaactccagtgcgt

SEQ ID NO: 122750 - DNA, 25 bp, Rattus norvegicus
agcaagagcgcttactccagtgcgt

SEQ ID NO: 122751 - DNA, 25 bp, Rattus norvegicus
agcaagaggctaccctttcatcctg

SEQ ID NO: 122752 - DNA, 25 bp, Rattus norvegicus
agcaagaggctagcctttcatcctg

SEQ ID NO: 122753 - DNA, 25 bp, Rattus norvegicus
agcaagaggctcaagtggtccactc

SEQ ID NO: 122754 - DNA, 25 bp, Rattus norvegicus
agcaagaggctctagtggtccactc

SEQ ID NO: 122755 - DNA, 25 bp, Rattus norvegicus
agcaagagggttagttccgtacatt

SEQ ID NO: 122756 - DNA, 25 bp, Rattus norvegicus
agcaagagggtttgttccgtacatt

SEQ ID NO: 122757 - DNA, 25 bp, Rattus norvegicus
agcaagaggtctatcgtctgccgca

SEQ ID NO: 122758 - DNA, 25 bp, Rattus norvegicus
agcaagaggtctttcgtctgccgca

SEQ ID NO: 122759 - DNA, 25 bp, Rattus norvegicus
agcaagatcaggagctgccacccag

SEQ ID NO: 122760 - DNA, 25 bp, Rattus norvegicus
agcaagatcaggtgctgccacccag

SEQ ID NO: 122761 - DNA, 25 bp, Rattus norvegicus
agcaagatcctgacacatatagcaa

SEQ ID NO: 122762 - DNA, 25 bp, Rattus norvegicus
agcaagatcctgtcacatatagcaa

SEQ ID NO: 122763 - DNA, 25 bp, Rattus norvegicus
agcaagatgatcactccacaagcga

SEQ ID NO: 122764 - DNA, 25 bp, Rattus norvegicus
agcaagatgatctctccacaagcga

SEQ ID NO: 122765 - DNA, 25 bp, Rattus norvegicus
agcaagatgctacgcaaatcctgga

SEQ ID NO: 122766 - DNA, 25 bp, Rattus norvegicus
agcaagatgctaggcaaatcctgga

SEQ ID NO: 122767 - DNA, 25 bp, Rattus norvegicus
agcaagatgctcctgataccctgtg

SEQ ID NO: 122768 - DNA, 25 bp, Rattus norvegicus
agcaagatgctcgtgataccctgtg

SEQ ID NO: 122769 - DNA, 25 bp, Rattus norvegicus
agcaagatgctgacctggcggctgc

SEQ ID NO: 122770 - DNA, 25 bp, Rattus norvegicus
agcaagatgctgtcctggcggctgc

SEQ ID NO: 122771 - DNA, 25 bp, Rattus norvegicus
agcaagattcatacaccagacaggt

SEQ ID NO: 122772 - DNA, 25 bp, Rattus norvegicus
agcaagattcattcaccagacaggt

SEQ ID NO: 122773 - DNA, 25 bp, Rattus norvegicus
agcaagcaacagaaccttctcttaa

SEQ ID NO: 122774 - DNA, 25 bp, Rattus norvegicus
agcaagcaacagaggccatcgtatt

SEQ ID NO: 122775 - DNA, 25 bp, Rattus norvegicus
agcaagcaacagtaccttctcttaa

SEQ ID NO: 122776 - DNA, 25 bp, Rattus norvegicus
agcaagcaacagtggccatcgtatt

SEQ ID NO: 122777 - DNA, 25 bp, Rattus norvegicus
agcaagcaagccctcactgaaatgg

SEQ ID NO: 122778 - DNA, 25 bp, Rattus norvegicus
agcaagcaagccgtcactgaaatgg

SEQ ID NO: 122779 - DNA, 25 bp, Rattus norvegicus
agcaagcaataacacgtcaccctca

SEQ ID NO: 122780 - DNA, 25 bp, Rattus norvegicus
agcaagcaataagacgtcaccctca

SEQ ID NO: 122781 - DNA, 25 bp, Rattus norvegicus
agcaagcacagcctttgatctccaa

SEQ ID NO: 122782 - DNA, 25 bp, Rattus norvegicus
agcaagcacagcgtttgatctccaa

SEQ ID NO: 122783 - DNA, 25 bp, Rattus norvegicus
agcaagcacagtactcccagtggga

SEQ ID NO: 122784 - DNA, 25 bp, Rattus norvegicus
agcaagcacagttctcccagtggga

SEQ ID NO: 122785 - DNA, 25 bp, Rattus norvegicus
agcaagcacatcagggatcaccact

SEQ ID NO: 122786 - DNA, 25 bp, Rattus norvegicus
agcaagcacatctgggatcaccact

SEQ ID NO: 122787 - DNA, 25 bp, Rattus norvegicus
agcaagcacccgagtctctaaagaa

SEQ ID NO: 122788 - DNA, 25 bp, Rattus norvegicus
agcaagcacccgtgtctctaaagaa

SEQ ID NO: 122789 - DNA, 25 bp, Rattus norvegicus
agcaagcacgatcgaggctccccga

SEQ ID NO: 122790 - DNA, 25 bp, Rattus norvegicus
agcaagcacgatggaggctccccga

SEQ ID NO: 122791 - DNA, 25 bp, Rattus norvegicus
agcaagcactgacccgtgaggccaa

SEQ ID NO: 122792 - DNA, 25 bp, Rattus norvegicus
agcaagcactgagccgtgaggccaa

SEQ ID NO: 122793 - DNA, 25 bp, Rattus norvegicus
agcaagcagagcctcttcagctcac

SEQ ID NO: 122794 - DNA, 25 bp, Rattus norvegicus
agcaagcagagcgtcttcagctcac

SEQ ID NO: 122795 - DNA, 25 bp, Rattus norvegicus
agcaagcagctcacctacctggaga

SEQ ID NO: 122796 - DNA, 25 bp, Rattus norvegicus
agcaagcagctctcctacctggaga

SEQ ID NO: 122797 - DNA, 25 bp, Rattus norvegicus
agcaagcaggtcaccattgtagcaa

SEQ ID NO: 122798 - DNA, 25 bp, Rattus norvegicus
agcaagcaggtctccattgtagcaa

SEQ ID NO: 122799 - DNA, 25 bp, Rattus norvegicus
agcaagcagtgaagtccccaccatt

SEQ ID NO: 122800 - DNA, 25 bp, Rattus norvegicus
agcaagcagtgatgtccccaccatt

SEQ ID NO: 122801 - DNA, 25 bp, Rattus norvegicus
agcaagcagtggaggtggctctaca

SEQ ID NO: 122802 - DNA, 25 bp, Rattus norvegicus
agcaagcagtggtggtggctctaca

SEQ ID NO: 122803 - DNA, 25 bp, Rattus norvegicus
agcaagcatagactggcgtccctgg

SEQ ID NO: 122804 - DNA, 25 bp, Rattus norvegicus
agcaagcatagagtggcgtccctgg

SEQ ID NO: 122805 - DNA, 25 bp, Rattus norvegicus
agcaagccagcgctcaacactgaga

SEQ ID NO: 122806 - DNA, 25 bp, Rattus norvegicus
agcaagccagcggtcaacactgaga

SEQ ID NO: 122807 - DNA, 25 bp, Rattus norvegicus
agcaagccaggtctttcttccttgg

SEQ ID NO: 122808 - DNA, 25 bp, Rattus norvegicus
agcaagccaggtgtttcttccttgg

SEQ ID NO: 122809 - DNA, 25 bp, Rattus norvegicus
agcaagccagtcagcacattcgatt

SEQ ID NO: 122810 - DNA, 25 bp, Rattus norvegicus
agcaagccagtctgcacattcgatt

SEQ ID NO: 122811 - DNA, 25 bp, Rattus norvegicus
agcaagcccggcagttctaggcgga

SEQ ID NO: 122812 - DNA, 25 bp, Rattus norvegicus
agcaagcccggctgttctaggcgga

SEQ ID NO: 122813 - DNA, 25 bp, Rattus norvegicus
agcaagcccttgatgttttggtttt

SEQ ID NO: 122814 - DNA, 25 bp, Rattus norvegicus
agcaagcccttgttgttttggtttt

SEQ ID NO: 122815 - DNA, 25 bp, Rattus norvegicus
agcaagccggagctctgaaggccaa

SEQ ID NO: 122816 - DNA, 25 bp, Rattus norvegicus
agcaagccggaggtctgaaggccaa

SEQ ID NO: 122817 - DNA, 25 bp, Rattus norvegicus
agcaagcctcagatctagacatggt

SEQ ID NO: 122818 - DNA, 25 bp, Rattus norvegicus
agcaagcctcagttctagacatggt

SEQ ID NO: 122819 - DNA, 25 bp, Rattus norvegicus
agcaagcctgcccatgtatgaagta

SEQ ID NO: 122820 - DNA, 25 bp, Rattus norvegicus
agcaagcctgccgatgtatgaagta

SEQ ID NO: 122821 - DNA, 25 bp, Rattus norvegicus
agcaagcctggtagctcagagcctt

SEQ ID NO: 122822 - DNA, 25 bp, Rattus norvegicus
agcaagcctggttgctcagagcctt

SEQ ID NO: 122823 - DNA, 25 bp, Rattus norvegicus
agcaagccttgccaaccactgaggg

SEQ ID NO: 122824 - DNA, 25 bp, Rattus norvegicus
agcaagccttgcgaaccactgaggg

SEQ ID NO: 122825 - DNA, 25 bp, Rattus norvegicus
agcaagcgctgtcccatcacttgtc

SEQ ID NO: 122826 - DNA, 25 bp, Rattus norvegicus
agcaagcgctgtgccatcacttgtc

SEQ ID NO: 122827 - DNA, 25 bp, Rattus norvegicus
agcaagctaacaactatcttccgaa

SEQ ID NO: 122828 - DNA, 25 bp, Rattus norvegicus
agcaagctaacatctatcttccgaa

SEQ ID NO: 122829 - DNA, 25 bp, Rattus norvegicus
agcaagctcctgaccgatgtttaaa

SEQ ID NO: 122830 - DNA, 25 bp, Rattus norvegicus
agcaagctcctgtccgatgtttaaa

SEQ ID NO: 122831 - DNA, 25 bp, Rattus norvegicus
agcaagctcgctatttaaacataaa

SEQ ID NO: 122832 - DNA, 25 bp, Rattus norvegicus
agcaagctcgctttttaaacataaa

SEQ ID NO: 122833 - DNA, 25 bp, Rattus norvegicus
agcaagctctgaaacagccaaggct

SEQ ID NO: 122834 - DNA, 25 bp, Rattus norvegicus
agcaagctctgatacagccaaggct

SEQ ID NO: 122835 - DNA, 25 bp, Rattus norvegicus
agcaagctgactcttctcaggtcac

SEQ ID NO: 122836 - DNA, 25 bp, Rattus norvegicus
agcaagctgactgttctcaggtcac

SEQ ID NO: 122837 - DNA, 25 bp, Rattus norvegicus
agcaagctgggcatcagaactcatc

SEQ ID NO: 122838 - DNA, 25 bp, Rattus norvegicus
agcaagctgggcttcagaactcatc

SEQ ID NO: 122839 - DNA, 25 bp, Rattus norvegicus
agcaagctgggtcctccactgagtg

SEQ ID NO: 122840 - DNA, 25 bp, Rattus norvegicus
agcaagctgggtgctccactgagtg

SEQ ID NO: 122841 - DNA, 25 bp, Rattus norvegicus
agcaagctgtgtattttctccaacg

SEQ ID NO: 122842 - DNA, 25 bp, Rattus norvegicus
agcaagctgtgttttttctccaacg

SEQ ID NO: 122843 - DNA, 25 bp, Rattus norvegicus
agcaagcttaaactcaacacaggac

SEQ ID NO: 122844 - DNA, 25 bp, Rattus norvegicus
agcaagcttaaagtcaacacaggac

SEQ ID NO: 122845 - DNA, 25 bp, Rattus norvegicus
agcaagcttccaaactgtagcacaa

SEQ ID NO: 122846 - DNA, 25 bp, Rattus norvegicus
agcaagcttccatactgtagcacaa

SEQ ID NO: 122847 - DNA, 25 bp, Rattus norvegicus
agcaagcttctgatatcttccatgg

SEQ ID NO: 122848 - DNA, 25 bp, Rattus norvegicus
agcaagcttctgttatcttccatgg

SEQ ID NO: 122849 - DNA, 25 bp, Rattus norvegicus
agcaagcttgttactctgatacagt

SEQ ID NO: 122850 - DNA, 25 bp, Rattus norvegicus
agcaagcttgtttctctgatacagt

SEQ ID NO: 122851 - DNA, 25 bp, Rattus norvegicus
agcaaggaatctcaacgctgacccc

SEQ ID NO: 122852 - DNA, 25 bp, Rattus norvegicus
agcaaggaatctgaacgctgacccc

SEQ ID NO: 122853 - DNA, 25 bp, Rattus norvegicus
agcaaggacaccagaggctgcctag

SEQ ID NO: 122854 - DNA, 25 bp, Rattus norvegicus
agcaaggacacctgaggctgcctag

SEQ ID NO: 122855 - DNA, 25 bp, Rattus norvegicus
agcaaggacagcacctacagtctca

SEQ ID NO: 122856 - DNA, 25 bp, Rattus norvegicus
agcaaggacagctcctacagtctca

SEQ ID NO: 122857 - DNA, 25 bp, Rattus norvegicus
agcaaggactgcctcctgagcctgt

SEQ ID NO: 122858 - DNA, 25 bp, Rattus norvegicus
agcaaggactgcgtcctgagcctgt

SEQ ID NO: 122859 - DNA, 25 bp, Rattus norvegicus
agcaaggagccacgcatttcttcct

SEQ ID NO: 122860 - DNA, 25 bp, Rattus norvegicus
agcaaggagccaggcatttcttcct

SEQ ID NO: 122861 - DNA, 25 bp, Rattus norvegicus
agcaaggagcccctgaagaatctca

SEQ ID NO: 122862 - DNA, 25 bp, Rattus norvegicus
agcaaggagcccgtgaagaatctca

SEQ ID NO: 122863 - DNA, 25 bp, Rattus norvegicus
agcaaggagctgcttctgaaggaca

SEQ ID NO: 122864 - DNA, 25 bp, Rattus norvegicus
agcaaggagctggttctgaaggaca

SEQ ID NO: 122865 - DNA, 25 bp, Rattus norvegicus
agcaaggaggcaagacgtctcccac

SEQ ID NO: 122866 - DNA, 25 bp, Rattus norvegicus
agcaaggaggcatgacgtctcccac

SEQ ID NO: 122867 - DNA, 25 bp, Rattus norvegicus
agcaaggattctcacccaaggacat

SEQ ID NO: 122868 - DNA, 25 bp, Rattus norvegicus
agcaaggattctgacccaaggacat

SEQ ID NO: 122869 - DNA, 25 bp, Rattus norvegicus
agcaaggcacacatgaccagactgt

SEQ ID NO: 122870 - DNA, 25 bp, Rattus norvegicus
agcaaggcacacttgaccagactgt

SEQ ID NO: 122871 - DNA, 25 bp, Rattus norvegicus
agcaaggcagcgatgtgaccctggc

SEQ ID NO: 122872 - DNA, 25 bp, Rattus norvegicus
agcaaggcagcgttgtgaccctggc

SEQ ID NO: 122873 - DNA, 25 bp, Rattus norvegicus
agcaaggcagtacccaggacctcca

SEQ ID NO: 122874 - DNA, 25 bp, Rattus norvegicus
agcaaggcagtagccaggacctcca

SEQ ID NO: 122875 - DNA, 25 bp, Rattus norvegicus
agcaaggcagttattcttatttaat

SEQ ID NO: 122876 - DNA, 25 bp, Rattus norvegicus
agcaaggcagtttttcttatttaat

SEQ ID NO: 122877 - DNA, 25 bp, Rattus norvegicus
agcaaggcatgcacacggagagtca

SEQ ID NO: 122878 - DNA, 25 bp, Rattus norvegicus
agcaaggcatgctcacggagagtca

SEQ ID NO: 122879 - DNA, 25 bp, Rattus norvegicus
agcaaggcattcctgggatccctgg

SEQ ID NO: 122880 - DNA, 25 bp, Rattus norvegicus
agcaaggcattcgtgggatccctgg

SEQ ID NO: 122881 - DNA, 25 bp, Rattus norvegicus
agcaaggccataacttcgtttctga

SEQ ID NO: 122882 - DNA, 25 bp, Rattus norvegicus
agcaaggccatatcttcgtttctga

SEQ ID NO: 122883 - DNA, 25 bp, Rattus norvegicus
agcaaggcccagcaacagtaaccta

SEQ ID NO: 122884 - DNA, 25 bp, Rattus norvegicus
agcaaggcccaggaacagtaaccta

SEQ ID NO: 122885 - DNA, 25 bp, Rattus norvegicus
agcaaggccgctacttctgtttttg

SEQ ID NO: 122886 - DNA, 25 bp, Rattus norvegicus
agcaaggccgcttcttctgtttttg

SEQ ID NO: 122887 - DNA, 25 bp, Rattus norvegicus
agcaaggcctgcactggttacggag

SEQ ID NO: 122888 - DNA, 25 bp, Rattus norvegicus
agcaaggcctgctctggttacggag

SEQ ID NO: 122889 - DNA, 25 bp, Rattus norvegicus
agcaaggcctttaccacaggagtga

SEQ ID NO: 122890 - DNA, 25 bp, Rattus norvegicus
agcaaggccttttccacaggagtga

SEQ ID NO: 122891 - DNA, 25 bp, Rattus norvegicus
agcaaggcttagaggcccacatcct

SEQ ID NO: 122892 - DNA, 25 bp, Rattus norvegicus
agcaaggcttagtggcccacatcct

SEQ ID NO: 122893 - DNA, 25 bp, Rattus norvegicus
agcaaggctttccagatctctgact

SEQ ID NO: 122894 - DNA, 25 bp, Rattus norvegicus
agcaaggctttcgagatctctgact

SEQ ID NO: 122895 - DNA, 25 bp, Rattus norvegicus
agcaagggaccactctgagaggcca

SEQ ID NO: 122896 - DNA, 25 bp, Rattus norvegicus
agcaagggaccagtctgagaggcca

SEQ ID NO: 122897 - DNA, 25 bp, Rattus norvegicus
agcaagggcaagctccttagtcctt

SEQ ID NO: 122898 - DNA, 25 bp, Rattus norvegicus
agcaagggcaaggtccttagtcctt

SEQ ID NO: 122899 - DNA, 25 bp, Rattus norvegicus
agcaagggccgaccggaatccatgt

SEQ ID NO: 122900 - DNA, 25 bp, Rattus norvegicus
agcaagggccgagcggaatccatgt

SEQ ID NO: 122901 - DNA, 25 bp, Rattus norvegicus
agcaagggcctccactcggcggcaa

SEQ ID NO: 122902 - DNA, 25 bp, Rattus norvegicus
agcaagggcctcgactcggcggcaa

SEQ ID NO: 122903 - DNA, 25 bp, Rattus norvegicus
agcaagggctggctgccaatccttc

SEQ ID NO: 122904 - DNA, 25 bp, Rattus norvegicus
agcaagggctgggtgccaatccttc

SEQ ID NO: 122905 - DNA, 25 bp, Rattus norvegicus
agcaagggtcaaagctcccgagcgt

SEQ ID NO: 122906 - DNA, 25 bp, Rattus norvegicus
agcaagggtcaatgctcccgagcgt

SEQ ID NO: 122907 - DNA, 25 bp, Rattus norvegicus
agcaagggtgtgagtgacgtcatca

SEQ ID NO: 122908 - DNA, 25 bp, Rattus norvegicus
agcaagggtgtgtgtgacgtcatca

SEQ ID NO: 122909 - DNA, 25 bp, Rattus norvegicus
agcaaggtatagattctccccaatc

SEQ ID NO: 122910 - DNA, 25 bp, Rattus norvegicus
agcaaggtatagtttctccccaatc

SEQ ID NO: 122911 - DNA, 25 bp, Rattus norvegicus
agcaaggtatccacatttgggacaa

SEQ ID NO: 122912 - DNA, 25 bp, Rattus norvegicus
agcaaggtatcctcatttgggacaa

SEQ ID NO: 122913 - DNA, 25 bp, Rattus norvegicus
agcaaggtcagcctgtgtacccaat

SEQ ID NO: 122914 - DNA, 25 bp, Rattus norvegicus
agcaaggtcagcgtgtgtacccaat

SEQ ID NO: 122915 - DNA, 25 bp, Rattus norvegicus
agcaaggtgattatagctggctctt

SEQ ID NO: 122916 - DNA, 25 bp, Rattus norvegicus
agcaaggtgattttagctggctctt

SEQ ID NO: 122917 - DNA, 25 bp, Rattus norvegicus
agcaaggtgcctatctctcacagtg

SEQ ID NO: 122918 - DNA, 25 bp, Rattus norvegicus
agcaaggtgcctttctctcacagtg

SEQ ID NO: 122919 - DNA, 25 bp, Rattus norvegicus
agcaaggtgcttactcttcctcttt

SEQ ID NO: 122920 - DNA, 25 bp, Rattus norvegicus
agcaaggtgctttctcttcctcttt

SEQ ID NO: 122921 - DNA, 25 bp, Rattus norvegicus
agcaaggtgtctagcagtctcagga

SEQ ID NO: 122922 - DNA, 25 bp, Rattus norvegicus
agcaaggtgtctcaggcacagcttt

SEQ ID NO: 122923 - DNA, 25 bp, Rattus norvegicus
agcaaggtgtctgaggcacagcttt

SEQ ID NO: 122924 - DNA, 25 bp, Rattus norvegicus
agcaaggtgtcttgcagtctcagga

SEQ ID NO: 122925 - DNA, 25 bp, Rattus norvegicus
agcaaggtgtggcacatctccatat

SEQ ID NO: 122926 - DNA, 25 bp, Rattus norvegicus
agcaaggtgtgggacatctccatat

SEQ ID NO: 122927 - DNA, 25 bp, Rattus norvegicus
agcaaggttatgctcccaagtggag

SEQ ID NO: 122928 - DNA, 25 bp, Rattus norvegicus
agcaaggttatggtcccaagtggag

SEQ ID NO: 122929 - DNA, 25 bp, Rattus norvegicus
agcaaggtttggacagctatgtgtc

SEQ ID NO: 122930 - DNA, 25 bp, Rattus norvegicus
agcaaggtttggtcagctatgtgtc

SEQ ID NO: 122931 - DNA, 25 bp, Rattus norvegicus
agcaagtacttcatctccactggac

SEQ ID NO: 122932 - DNA, 25 bp, Rattus norvegicus
agcaagtacttcttctccactggac

SEQ ID NO: 122933 - DNA, 25 bp, Rattus norvegicus
agcaagtagcacaggtctggctgaa

SEQ ID NO: 122934 - DNA, 25 bp, Rattus norvegicus
agcaagtagcactggtctggctgaa

SEQ ID NO: 122935 - DNA, 25 bp, Rattus norvegicus
agcaagtaggatacggtggcatttt

SEQ ID NO: 122936 - DNA, 25 bp, Rattus norvegicus
agcaagtaggattcggtggcatttt

SEQ ID NO: 122937 - DNA, 25 bp, Rattus norvegicus
agcaagtagtcacccactggatctc

SEQ ID NO: 122938 - DNA, 25 bp, Rattus norvegicus
agcaagtagtcagccactggatctc

SEQ ID NO: 122939 - DNA, 25 bp, Rattus norvegicus
agcaagtcaatgactgacacccatg

SEQ ID NO: 122940 - DNA, 25 bp, Rattus norvegicus
agcaagtcaatgtctgacacccatg

SEQ ID NO: 122941 - DNA, 25 bp, Rattus norvegicus
agcaagtcaccgactcgcagtcact

SEQ ID NO: 122942 - DNA, 25 bp, Rattus norvegicus
agcaagtcaccgtctcgcagtcact

SEQ ID NO: 122943 - DNA, 25 bp, Rattus norvegicus
agcaagtcaggacaccgggatcccc

SEQ ID NO: 122944 - DNA, 25 bp, Rattus norvegicus
agcaagtcaggagaccgggatcccc

SEQ ID NO: 122945 - DNA, 25 bp, Rattus norvegicus
agcaagtcgagaccagcctccgtga

SEQ ID NO: 122946 - DNA, 25 bp, Rattus norvegicus
agcaagtcgagagcagcctccgtga

SEQ ID NO: 122947 - DNA, 25 bp, Rattus norvegicus
agcaagtcttccaggaggtcggcat

SEQ ID NO: 122948 - DNA, 25 bp, Rattus norvegicus
agcaagtcttcctggaggtcggcat

SEQ ID NO: 122949 - DNA, 25 bp, Rattus norvegicus
agcaagtcttgcagtgtagtgtcaa

SEQ ID NO: 122950 - DNA, 25 bp, Rattus norvegicus
agcaagtcttgctgtgtagtgtcaa

SEQ ID NO: 122951 - DNA, 25 bp, Rattus norvegicus
agcaagtgaactaccgtgggcccct

SEQ ID NO: 122952 - DNA, 25 bp, Rattus norvegicus
agcaagtgaacttccgtgggcccct

SEQ ID NO: 122953 - DNA, 25 bp, Rattus norvegicus
agcaagtgaccaccaggctccaaaa

SEQ ID NO: 122954 - DNA, 25 bp, Rattus norvegicus
agcaagtgaccagcaggctccaaaa

SEQ ID NO: 122955 - DNA, 25 bp, Rattus norvegicus
agcaagtgaccgagccgtgacccgc

SEQ ID NO: 122956 - DNA, 25 bp, Rattus norvegicus
agcaagtgaccgtgccgtgacccgc

SEQ ID NO: 122957 - DNA, 25 bp, Rattus norvegicus
agcaagtgactcctggcactggcta

SEQ ID NO: 122958 - DNA, 25 bp, Rattus norvegicus
agcaagtgactcgtggcactggcta

SEQ ID NO: 122959 - DNA, 25 bp, Rattus norvegicus
agcaagtgcaacaatttttcgacag

SEQ ID NO: 122960 - DNA, 25 bp, Rattus norvegicus
agcaagtgcaactatttttcgacag

SEQ ID NO: 122961 - DNA, 25 bp, Rattus norvegicus
agcaagtgcccaagagtaccagtac

SEQ ID NO: 122962 - DNA, 25 bp, Rattus norvegicus
agcaagtgcccatgagtaccagtac

SEQ ID NO: 122963 - DNA, 25 bp, Rattus norvegicus
agcaagtgctgaatgtctctcctgt

SEQ ID NO: 122964 - DNA, 25 bp, Rattus norvegicus
agcaagtgctgattgtctctcctgt

SEQ ID NO: 122965 - DNA, 25 bp, Rattus norvegicus
agcaagtggatcagtcacctcagtc

SEQ ID NO: 122966 - DNA, 25 bp, Rattus norvegicus
agcaagtggatctgtcacctcagtc

SEQ ID NO: 122967 - DNA, 25 bp, Rattus norvegicus
agcaagtgggagacatgcacagctt

SEQ ID NO: 122968 - DNA, 25 bp, Rattus norvegicus
agcaagtgggagtcatgcacagctt

SEQ ID NO: 122969 - DNA, 25 bp, Rattus norvegicus
agcaagtggtagacttcctctggcc

SEQ ID NO: 122970 - DNA, 25 bp, Rattus norvegicus
agcaagtggtagtcttcctctggcc

SEQ ID NO: 122971 - DNA, 25 bp, Rattus norvegicus
agcaagtggtccacacgaacaccat

SEQ ID NO: 122972 - DNA, 25 bp, Rattus norvegicus
agcaagtggtcctcacgaacaccat

SEQ ID NO: 122973 - DNA, 25 bp, Rattus norvegicus
agcaagtggtgaagatccccagcct

SEQ ID NO: 122974 - DNA, 25 bp, Rattus norvegicus
agcaagtggtgatgatccccagcct

SEQ ID NO: 122975 - DNA, 25 bp, Rattus norvegicus
agcaagtgtctcactagcgtggatg

SEQ ID NO: 122976 - DNA, 25 bp, Rattus norvegicus
agcaagtgtctctctagcgtggatg

SEQ ID NO: 122977 - DNA, 25 bp, Rattus norvegicus
agcaagtgtcttacaggagctcaca

SEQ ID NO: 122978 - DNA, 25 bp, Rattus norvegicus
agcaagtgtctttcaggagctcaca

SEQ ID NO: 122979 - DNA, 25 bp, Rattus norvegicus
agcaagtgtgatccgtggtttccat

SEQ ID NO: 122980 - DNA, 25 bp, Rattus norvegicus
agcaagtgtgatgcgtggtttccat

SEQ ID NO: 122981 - DNA, 25 bp, Rattus norvegicus
agcaagtgtgcaatgttgaaccaga

SEQ ID NO: 122982 - DNA, 25 bp, Rattus norvegicus
agcaagtgtgcaattccagaccttc

SEQ ID NO: 122983 - DNA, 25 bp, Rattus norvegicus
agcaagtgtgcattgttgaaccaga

SEQ ID NO: 122984 - DNA, 25 bp, Rattus norvegicus
agcaagtgtgcatttccagaccttc

SEQ ID NO: 122985 - DNA, 25 bp, Rattus norvegicus
agcaagttaattcctcaaacccgag

SEQ ID NO: 122986 - DNA, 25 bp, Rattus norvegicus
agcaagttaattgctcaaacccgag

SEQ ID NO: 122987 - DNA, 25 bp, Rattus norvegicus
agcaagttccatactgcccattacg

SEQ ID NO: 122988 - DNA, 25 bp, Rattus norvegicus
agcaagttccattctgcccattacg

SEQ ID NO: 122989 - DNA, 25 bp, Rattus norvegicus
agcaagttcctgcatgctcttgtgt

SEQ ID NO: 122990 - DNA, 25 bp, Rattus norvegicus
agcaagttcctggatgctcttgtgt

SEQ ID NO: 122991 - DNA, 25 bp, Rattus norvegicus
agcaagttctcacgcaggtgaccat

SEQ ID NO: 122992 - DNA, 25 bp, Rattus norvegicus
agcaagttctcaggcaggtgaccat

SEQ ID NO: 122993 - DNA, 25 bp, Rattus norvegicus
agcaagttgatcacatgacaagttg

SEQ ID NO: 122994 - DNA, 25 bp, Rattus norvegicus
agcaagttgatctcatgacaagttg

SEQ ID NO: 122995 - DNA, 25 bp, Rattus norvegicus
agcaagttgcctctgaacccagagt

SEQ ID NO: 122996 - DNA, 25 bp, Rattus norvegicus
agcaagttgcctgtgaacccagagt

SEQ ID NO: 122997 - DNA, 25 bp, Rattus norvegicus
agcaagtttgccatagctgtctgtg

SEQ ID NO: 122998 - DNA, 25 bp, Rattus norvegicus
agcaagtttgccttagctgtctgtg

SEQ ID NO: 122999 - DNA, 25 bp, Rattus norvegicus
agcaagttttgtactttcagcctcc

SEQ ID NO: 123000 - DNA, 25 bp, Rattus norvegicus
agcaagttttgttctttcagcctcc

SEQ ID NO: 123001 - DNA, 25 bp, Rattus norvegicus
agcaataaacggaaagtcaccactt

SEQ ID NO: 123002 - DNA, 25 bp, Rattus norvegicus
agcaataaacggtaagtcaccactt

SEQ ID NO: 123003 - DNA, 25 bp, Rattus norvegicus
agcaataacatcatcctagtggccc

SEQ ID NO: 123004 - DNA, 25 bp, Rattus norvegicus
agcaataacatcttcctagtggccc

SEQ ID NO: 123005 - DNA, 25 bp, Rattus norvegicus
agcaataaccatctcctgggagcaa

SEQ ID NO: 123006 - DNA, 25 bp, Rattus norvegicus
agcaataaccatgtcctgggagcaa

SEQ ID NO: 123007 - DNA, 25 bp, Rattus norvegicus
agcaataactccaagcaggctccag

SEQ ID NO: 123008 - DNA, 25 bp, Rattus norvegicus
agcaataactcctagcaggctccag

SEQ ID NO: 123009 - DNA, 25 bp, Rattus norvegicus
agcaataagattcaggctgccctgg

SEQ ID NO: 123010 - DNA, 25 bp, Rattus norvegicus
agcaataagattgaggctgccctgg

SEQ ID NO: 123011 - DNA, 25 bp, Rattus norvegicus
agcaataagtcccttatctctggag

SEQ ID NO: 123012 - DNA, 25 bp, Rattus norvegicus
agcaataagtccgttatctctggag

SEQ ID NO: 123013 - DNA, 25 bp, Rattus norvegicus
agcaataatactcctgtggctgttg

SEQ ID NO: 123014 - DNA, 25 bp, Rattus norvegicus
agcaataatactgctgtggctgttg

SEQ ID NO: 123015 - DNA, 25 bp, Rattus norvegicus
agcaataattctctttcccaaggca

SEQ ID NO: 123016 - DNA, 25 bp, Rattus norvegicus
agcaataattctgtttcccaaggca

SEQ ID NO: 123017 - DNA, 25 bp, Rattus norvegicus
agcaatacccgcattgagaaatcga

SEQ ID NO: 123018 - DNA, 25 bp, Rattus norvegicus
agcaatacccgctttgagaaatcga

SEQ ID NO: 123019 - DNA, 25 bp, Rattus norvegicus
agcaatacctagaggctgacttatt

SEQ ID NO: 123020 - DNA, 25 bp, Rattus norvegicus
agcaatacctagtggctgacttatt

SEQ ID NO: 123021 - DNA, 25 bp, Rattus norvegicus
agcaatactttccttcttggatgaa

SEQ ID NO: 123022 - DNA, 25 bp, Rattus norvegicus
agcaatactttcgttcttggatgaa

SEQ ID NO: 123023 - DNA, 25 bp, Rattus norvegicus
agcaatagccaccagctccagggtg

SEQ ID NO: 123024 - DNA, 25 bp, Rattus norvegicus
agcaatagccacgagctccagggtg

SEQ ID NO: 123025 - DNA, 25 bp, Rattus norvegicus
agcaataggcccagatacctgcatc

SEQ ID NO: 123026 - DNA, 25 bp, Rattus norvegicus
agcaataggccctgatacctgcatc

SEQ ID NO: 123027 - DNA, 25 bp, Rattus norvegicus
agcaatagtccccaatagcgtagat

SEQ ID NO: 123028 - DNA, 25 bp, Rattus norvegicus
agcaatagtcccgaatagcgtagat

SEQ ID NO: 123029 - DNA, 25 bp, Rattus norvegicus
agcaatagtgggaatctaagaatga

SEQ ID NO: 123030 - DNA, 25 bp, Rattus norvegicus
agcaatagtgggtatctaagaatga

SEQ ID NO: 123031 - DNA, 25 bp, Rattus norvegicus
agcaatatcccgacacacgagtaat

SEQ ID NO: 123032 - DNA, 25 bp, Rattus norvegicus
agcaatatcccgtcacacgagtaat

SEQ ID NO: 123033 - DNA, 25 bp, Rattus norvegicus
agcaatatgttcagcctgggcttcc

SEQ ID NO: 123034 - DNA, 25 bp, Rattus norvegicus
agcaatatgttctgcctgggcttcc

SEQ ID NO: 123035 - DNA, 25 bp, Rattus norvegicus
agcaatattggcagcgcctactctt

SEQ ID NO: 123036 - DNA, 25 bp, Rattus norvegicus
agcaatattggctgcgcctactctt

SEQ ID NO: 123037 - DNA, 25 bp, Rattus norvegicus
agcaatcaaacaccttctgggcgat

SEQ ID NO: 123038 - DNA, 25 bp, Rattus norvegicus
agcaatcaaacagcttctgggcgat

SEQ ID NO: 123039 - DNA, 25 bp, Rattus norvegicus
agcaatcacatgactaaacctagtt

SEQ ID NO: 123040 - DNA, 25 bp, Rattus norvegicus
agcaatcacatgtctaaacctagtt

SEQ ID NO: 123041 - DNA, 25 bp, Rattus norvegicus
agcaatcaccacaaaactccttttt

SEQ ID NO: 123042 - DNA, 25 bp, Rattus norvegicus
agcaatcaccactaaactccttttt

SEQ ID NO: 123043 - DNA, 25 bp, Rattus norvegicus
agcaatcagcagcaacgcagcttct

SEQ ID NO: 123044 - DNA, 25 bp, Rattus norvegicus
agcaatcagcaggaacgcagcttct

SEQ ID NO: 123045 - DNA, 25 bp, Rattus norvegicus
agcaatcatctcctcttagaaaatg

SEQ ID NO: 123046 - DNA, 25 bp, Rattus norvegicus
agcaatcatctcgtcttagaaaatg

SEQ ID NO: 123047 - DNA, 25 bp, Rattus norvegicus
agcaatcattctcttactataccaa

SEQ ID NO: 123048 - DNA, 25 bp, Rattus norvegicus
agcaatcattctgttactataccaa

SEQ ID NO: 123049 - DNA, 25 bp, Rattus norvegicus
agcaatccaggaagattccccaaca

SEQ ID NO: 123050 - DNA, 25 bp, Rattus norvegicus
agcaatccaggatgattccccaaca

SEQ ID NO: 123051 - DNA, 25 bp, Rattus norvegicus
agcaatccaggtcagtagtgtcagg

SEQ ID NO: 123052 - DNA, 25 bp, Rattus norvegicus
agcaatccaggtgagtagtgtcagg

SEQ ID NO: 123053 - DNA, 25 bp, Rattus norvegicus
agcaatccatcaaatcctgacagag

SEQ ID NO: 123054 - DNA, 25 bp, Rattus norvegicus
agcaatccatcatatcctgacagag

SEQ ID NO: 123055 - DNA, 25 bp, Rattus norvegicus
agcaatcccagtctgtgtcggatga

SEQ ID NO: 123056 - DNA, 25 bp, Rattus norvegicus
agcaatcccagtgtgtgtcggatga

SEQ ID NO: 123057 - DNA, 25 bp, Rattus norvegicus
agcaatcccattacagtttacatat

SEQ ID NO: 123058 - DNA, 25 bp, Rattus norvegicus
agcaatcccatttcagtttacatat

SEQ ID NO: 123059 - DNA, 25 bp, Rattus norvegicus
agcaatcccgacatggcagcaaaaa

SEQ ID NO: 123060 - DNA, 25 bp, Rattus norvegicus
agcaatcccgacttggcagcaaaaa

SEQ ID NO: 123061 - DNA, 25 bp, Rattus norvegicus
agcaatccgtagattctggttcctg

SEQ ID NO: 123062 - DNA, 25 bp, Rattus norvegicus
agcaatccgtagtttctggttcctg

SEQ ID NO: 123063 - DNA, 25 bp, Rattus norvegicus
agcaatcctatgctgttctacctgg

SEQ ID NO: 123064 - DNA, 25 bp, Rattus norvegicus
agcaatcctatggtgttctacctgg

SEQ ID NO: 123065 - DNA, 25 bp, Rattus norvegicus
agcaatctctccagtaagactgtgg

SEQ ID NO: 123066 - DNA, 25 bp, Rattus norvegicus
agcaatctctcctgtaagactgtgg

SEQ ID NO: 123067 - DNA, 25 bp, Rattus norvegicus
agcaatctgatacttctatcggaga

SEQ ID NO: 123068 - DNA, 25 bp, Rattus norvegicus
agcaatctgatagttctatcggaga

SEQ ID NO: 123069 - DNA, 25 bp, Rattus norvegicus
agcaatctggaaccccagtaccgga

SEQ ID NO: 123070 - DNA, 25 bp, Rattus norvegicus
agcaatctggaagcccagtaccgga

SEQ ID NO: 123071 - DNA, 25 bp, Rattus norvegicus
agcaatctgtgacctgccgctgatg

SEQ ID NO: 123072 - DNA, 25 bp, Rattus norvegicus
agcaatctgtgagctgccgctgatg

SEQ ID NO: 123073 - DNA, 25 bp, Rattus norvegicus
agcaatctttccatttgatcccatt

SEQ ID NO: 123074 - DNA, 25 bp, Rattus norvegicus
agcaatctttccttttgatcccatt

SEQ ID NO: 123075 - DNA, 25 bp, Rattus norvegicus
agcaatgaatgtcctctactgagta

SEQ ID NO: 123076 - DNA, 25 bp, Rattus norvegicus
agcaatgaatgtgctctactgagta

SEQ ID NO: 123077 - DNA, 25 bp, Rattus norvegicus
agcaatgacctcatcgtttatactc

SEQ ID NO: 123078 - DNA, 25 bp, Rattus norvegicus
agcaatgacctcttcgtttatactc

SEQ ID NO: 123079 - DNA, 25 bp, Rattus norvegicus
agcaatgactctccgcacagtatta

SEQ ID NO: 123080 - DNA, 25 bp, Rattus norvegicus
agcaatgactctgcgcacagtatta

SEQ ID NO: 123081 - DNA, 25 bp, Rattus norvegicus
agcaatgactgcaggagccctgcct

SEQ ID NO: 123082 - DNA, 25 bp, Rattus norvegicus
agcaatgactgctggagccctgcct

SEQ ID NO: 123083 - DNA, 25 bp, Rattus norvegicus
agcaatgagagcactgccagttccc

SEQ ID NO: 123084 - DNA, 25 bp, Rattus norvegicus
agcaatgagagctctgccagttccc

SEQ ID NO: 123085 - DNA, 25 bp, Rattus norvegicus
agcaatgcacacagctgctattggg

SEQ ID NO: 123086 - DNA, 25 bp, Rattus norvegicus
agcaatgcacactgctgctattggg

SEQ ID NO: 123087 - DNA, 25 bp, Rattus norvegicus
agcaatgcagggactctcttaagat

SEQ ID NO: 123088 - DNA, 25 bp, Rattus norvegicus
agcaatgcagggtctctcttaagat

SEQ ID NO: 123089 - DNA, 25 bp, Rattus norvegicus
agcaatgccacacagtttacatagg

SEQ ID NO: 123090 - DNA, 25 bp, Rattus norvegicus
agcaatgccacagagtttacatagg

SEQ ID NO: 123091 - DNA, 25 bp, Rattus norvegicus
agcaatgcgtggaaagtcctttatt

SEQ ID NO: 123092 - DNA, 25 bp, Rattus norvegicus
agcaatgcgtggtaagtcctttatt

SEQ ID NO: 123093 - DNA, 25 bp, Rattus norvegicus
agcaatgctgtgacttaagcacaaa

SEQ ID NO: 123094 - DNA, 25 bp, Rattus norvegicus
agcaatgctgtgtcttaagcacaaa

SEQ ID NO: 123095 - DNA, 25 bp, Rattus norvegicus
agcaatgcttgacgccccttacaag

SEQ ID NO: 123096 - DNA, 25 bp, Rattus norvegicus
agcaatgcttgaggccccttacaag

SEQ ID NO: 123097 - DNA, 25 bp, Rattus norvegicus
agcaatggagacagtgatctacttt

SEQ ID NO: 123098 - DNA, 25 bp, Rattus norvegicus
agcaatggagactgtgatctacttt

SEQ ID NO: 123099 - DNA, 25 bp, Rattus norvegicus
agcaatggagtcacgtgtctgccct

SEQ ID NO: 123100 - DNA, 25 bp, Rattus norvegicus
agcaatggagtctcgtgtctgccct

SEQ ID NO: 123101 - DNA, 25 bp, Rattus norvegicus
agcaatggctaaacagacaaggtca

SEQ ID NO: 123102 - DNA, 25 bp, Rattus norvegicus
agcaatggctaatcagacaaggtca

SEQ ID NO: 123103 - DNA, 25 bp, Rattus norvegicus
agcaatggctgcacttgcaaaggtc

SEQ ID NO: 123104 - DNA, 25 bp, Rattus norvegicus
agcaatggctgctcttgcaaaggtc

SEQ ID NO: 123105 - DNA, 25 bp, Rattus norvegicus
agcaatggtcaaaatcagatcatac

SEQ ID NO: 123106 - DNA, 25 bp, Rattus norvegicus
agcaatggtcaatatcagatcatac

SEQ ID NO: 123107 - DNA, 25 bp, Rattus norvegicus
agcaatggtggcagtttgataataa

SEQ ID NO: 123108 - DNA, 25 bp, Rattus norvegicus
agcaatggtggctgtttgataataa

SEQ ID NO: 123109 - DNA, 25 bp, Rattus norvegicus
agcaatggttagcagtcttctctcg

SEQ ID NO: 123110 - DNA, 25 bp, Rattus norvegicus
agcaatggttaggagtcttctctcg

SEQ ID NO: 123111 - DNA, 25 bp, Rattus norvegicus
agcaatgtagctacatgtctgatag

SEQ ID NO: 123112 - DNA, 25 bp, Rattus norvegicus
agcaatgtagcttcatgtctgatag

SEQ ID NO: 123113 - DNA, 25 bp, Rattus norvegicus
agcaatgtatgtctttctggatata

SEQ ID NO: 123114 - DNA, 25 bp, Rattus norvegicus
agcaatgtatgtgtttctggatata

SEQ ID NO: 123115 - DNA, 25 bp, Rattus norvegicus
agcaatgtctccacttctggaagca

SEQ ID NO: 123116 - DNA, 25 bp, Rattus norvegicus
agcaatgtctcctcttctggaagca

SEQ ID NO: 123117 - DNA, 25 bp, Rattus norvegicus
agcaatgtctgaagagcctctgaga

SEQ ID NO: 123118 - DNA, 25 bp, Rattus norvegicus
agcaatgtctgatgagcctctgaga

SEQ ID NO: 123119 - DNA, 25 bp, Rattus norvegicus
agcaatgtgcagctgcaagcttccc

SEQ ID NO: 123120 - DNA, 25 bp, Rattus norvegicus
agcaatgtgcaggtgcaagcttccc

SEQ ID NO: 123121 - DNA, 25 bp, Rattus norvegicus
agcaatgtgtagcactggctggcct

SEQ ID NO: 123122 - DNA, 25 bp, Rattus norvegicus
agcaatgtgtaggactggctggcct

SEQ ID NO: 123123 - DNA, 25 bp, Rattus norvegicus
agcaatgttctgctgaccagacaga

SEQ ID NO: 123124 - DNA, 25 bp, Rattus norvegicus
agcaatgttctggtgaccagacaga

SEQ ID NO: 123125 - DNA, 25 bp, Rattus norvegicus
agcaatgttgacatgttgttgactt

SEQ ID NO: 123126 - DNA, 25 bp, Rattus norvegicus
agcaatgttgacttgttgttgactt

SEQ ID NO: 123127 - DNA, 25 bp, Rattus norvegicus
agcaatgttgctcacaactcccttt

SEQ ID NO: 123128 - DNA, 25 bp, Rattus norvegicus
agcaatgttgctgacaactcccttt

SEQ ID NO: 123129 - DNA, 25 bp, Rattus norvegicus
agcaattacaggacttctgtggttt

SEQ ID NO: 123130 - DNA, 25 bp, Rattus norvegicus
agcaattacaggtcttctgtggttt

SEQ ID NO: 123131 - DNA, 25 bp, Rattus norvegicus
agcaattactaaagtctccgtgagg

SEQ ID NO: 123132 - DNA, 25 bp, Rattus norvegicus
agcaattactaatgtctccgtgagg

SEQ ID NO: 123133 - DNA, 25 bp, Rattus norvegicus
agcaattcaagcagtgttttctaga

SEQ ID NO: 123134 - DNA, 25 bp, Rattus norvegicus
agcaattcaagcagttctaccgcgc

SEQ ID NO: 123135 - DNA, 25 bp, Rattus norvegicus
agcaattcaagctgtgttttctaga

SEQ ID NO: 123136 - DNA, 25 bp, Rattus norvegicus
agcaattcaagctgttctaccgcgc

SEQ ID NO: 123137 - DNA, 25 bp, Rattus norvegicus
agcaattcactcaagaagcttcagt

SEQ ID NO: 123138 - DNA, 25 bp, Rattus norvegicus
agcaattcactcatgatggcggtct

SEQ ID NO: 123139 - DNA, 25 bp, Rattus norvegicus
agcaattcactctagaagcttcagt

SEQ ID NO: 123140 - DNA, 25 bp, Rattus norvegicus
agcaattcactcttgatggcggtct

SEQ ID NO: 123141 - DNA, 25 bp, Rattus norvegicus
agcaattcactgagtctggcatgtg

SEQ ID NO: 123142 - DNA, 25 bp, Rattus norvegicus
agcaattcactgtgtctggcatgtg

SEQ ID NO: 123143 - DNA, 25 bp, Rattus norvegicus
agcaattctatactgttcctgagaa

SEQ ID NO: 123144 - DNA, 25 bp, Rattus norvegicus
agcaattctatagtgttcctgagaa

SEQ ID NO: 123145 - DNA, 25 bp, Rattus norvegicus
agcaattcttgcatgccccagaggc

SEQ ID NO: 123146 - DNA, 25 bp, Rattus norvegicus
agcaattcttgcttgccccagaggc

SEQ ID NO: 123147 - DNA, 25 bp, Rattus norvegicus
agcaattgcttcatccagatcacgt

SEQ ID NO: 123148 - DNA, 25 bp, Rattus norvegicus
agcaattgcttcttccagatcacgt

SEQ ID NO: 123149 - DNA, 25 bp, Rattus norvegicus
agcaattgctttaataccccatcac

SEQ ID NO: 123150 - DNA, 25 bp, Rattus norvegicus
agcaattgcttttataccccatcac

SEQ ID NO: 123151 - DNA, 25 bp, Rattus norvegicus
agcaattgtgccactttacagacac

SEQ ID NO: 123152 - DNA, 25 bp, Rattus norvegicus
agcaattgtgcctctttacagacac

SEQ ID NO: 123153 - DNA, 25 bp, Rattus norvegicus
agcaattgtgctctgttcttggaca

SEQ ID NO: 123154 - DNA, 25 bp, Rattus norvegicus
agcaattgtgctgtgttcttggaca

SEQ ID NO: 123155 - DNA, 25 bp, Rattus norvegicus
agcaatttacacattcttaaaacat

SEQ ID NO: 123156 - DNA, 25 bp, Rattus norvegicus
agcaatttacactttcttaaaacat

SEQ ID NO: 123157 - DNA, 25 bp, Rattus norvegicus
agcaatttatgtctctcgaaggtag

SEQ ID NO: 123158 - DNA, 25 bp, Rattus norvegicus
agcaatttatgtgtctcgaaggtag

SEQ ID NO: 123159 - DNA, 25 bp, Rattus norvegicus
agcaatttcagcaacttctctctaa

SEQ ID NO: 123160 - DNA, 25 bp, Rattus norvegicus
agcaatttcagctacttctctctaa

SEQ ID NO: 123161 - DNA, 25 bp, Rattus norvegicus
agcaatttccctagagctactttgt

SEQ ID NO: 123162 - DNA, 25 bp, Rattus norvegicus
agcaatttcccttgagctactttgt

SEQ ID NO: 123163 - DNA, 25 bp, Rattus norvegicus
agcaatttccgaccagatgtctgac

SEQ ID NO: 123164 - DNA, 25 bp, Rattus norvegicus
agcaatttccgagcagatgtctgac

SEQ ID NO: 123165 - DNA, 25 bp, Rattus norvegicus
agcaatttcctgatgattgcccttt

SEQ ID NO: 123166 - DNA, 25 bp, Rattus norvegicus
agcaatttcctgttgattgcccttt

SEQ ID NO: 123167 - DNA, 25 bp, Rattus norvegicus
agcaatttgacaagcatagcttttg

SEQ ID NO: 123168 - DNA, 25 bp, Rattus norvegicus
agcaatttgacatgcatagcttttg

SEQ ID NO: 123169 - DNA, 25 bp, Rattus norvegicus
agcaatttgtccattctctagttgg

SEQ ID NO: 123170 - DNA, 25 bp, Rattus norvegicus
agcaatttgtcctttctctagttgg

SEQ ID NO: 123171 - DNA, 25 bp, Rattus norvegicus
agcaattttattacagcctttcagc

SEQ ID NO: 123172 - DNA, 25 bp, Rattus norvegicus
agcaattttatttcagcctttcagc

SEQ ID NO: 123173 - DNA, 25 bp, Rattus norvegicus
agcacaaacactaactcttagcaaa

SEQ ID NO: 123174 - DNA, 25 bp, Rattus norvegicus
agcacaaacacttactcttagcaaa

SEQ ID NO: 123175 - DNA, 25 bp, Rattus norvegicus
agcacaaagcaacaagccccggagg

SEQ ID NO: 123176 - DNA, 25 bp, Rattus norvegicus
agcacaaagcaagaagccccggagg

SEQ ID NO: 123177 - DNA, 25 bp, Rattus norvegicus
agcacaaagcagactcaccttttcc

SEQ ID NO: 123178 - DNA, 25 bp, Rattus norvegicus
agcacaaagcagtctcaccttttcc

SEQ ID NO: 123179 - DNA, 25 bp, Rattus norvegicus
agcacaaagccccatattctaattt

SEQ ID NO: 123180 - DNA, 25 bp, Rattus norvegicus
agcacaaagcccgatattctaattt

SEQ ID NO: 123181 - DNA, 25 bp, Rattus norvegicus
agcacaaagtagaggcgtgcccgag

SEQ ID NO: 123182 - DNA, 25 bp, Rattus norvegicus
agcacaaagtagtggcgtgcccgag

SEQ ID NO: 123183 - DNA, 25 bp, Rattus norvegicus
agcacaaagtgcctccattaaaaac

SEQ ID NO: 123184 - DNA, 25 bp, Rattus norvegicus
agcacaaagtgcgtccattaaaaac

SEQ ID NO: 123185 - DNA, 25 bp, Rattus norvegicus
agcacaaagttcacggagctcttga

SEQ ID NO: 123186 - DNA, 25 bp, Rattus norvegicus
agcacaaagttctcggagctcttga

SEQ ID NO: 123187 - DNA, 25 bp, Rattus norvegicus
agcacaaatacgactagtccgcttt

SEQ ID NO: 123188 - DNA, 25 bp, Rattus norvegicus
agcacaaatacgtctagtccgcttt

SEQ ID NO: 123189 - DNA, 25 bp, Rattus norvegicus
agcacaacagcgaaactgggtcaga

SEQ ID NO: 123190 - DNA, 25 bp, Rattus norvegicus
agcacaacagcgtaactgggtcaga

SEQ ID NO: 123191 - DNA, 25 bp, Rattus norvegicus
agcacaacaggtcgcagccgctaag

SEQ ID NO: 123192 - DNA, 25 bp, Rattus norvegicus
agcacaacaggtggcagccgctaag

SEQ ID NO: 123193 - DNA, 25 bp, Rattus norvegicus
agcacaacatctacatctgagcact

SEQ ID NO: 123194 - DNA, 25 bp, Rattus norvegicus
agcacaacatcttcatctgagcact

SEQ ID NO: 123195 - DNA, 25 bp, Rattus norvegicus
agcacaacatgaaccagttcagaaa

SEQ ID NO: 123196 - DNA, 25 bp, Rattus norvegicus
agcacaacatgatccagttcagaaa

SEQ ID NO: 123197 - DNA, 25 bp, Rattus norvegicus
agcacaacattcctcttatgggaga

SEQ ID NO: 123198 - DNA, 25 bp, Rattus norvegicus
agcacaacattcgtcttatgggaga

SEQ ID NO: 123199 - DNA, 25 bp, Rattus norvegicus
agcacaaccatactccctgaaggac

SEQ ID NO: 123200 - DNA, 25 bp, Rattus norvegicus
agcacaaccatagtccctgaaggac

SEQ ID NO: 123201 - DNA, 25 bp, Rattus norvegicus
agcacaaccttcatcacaaaatgag

SEQ ID NO: 123202 - DNA, 25 bp, Rattus norvegicus
agcacaaccttcttcacaaaatgag

SEQ ID NO: 123203 - DNA, 25 bp, Rattus norvegicus
agcacaactacaacccacaaatata

SEQ ID NO: 123204 - DNA, 25 bp, Rattus norvegicus
agcacaactacatcccacaaatata

SEQ ID NO: 123205 - DNA, 25 bp, Rattus norvegicus
agcacaagacacctgaagcctctgt

SEQ ID NO: 123206 - DNA, 25 bp, Rattus norvegicus
agcacaagacacgtgaagcctctgt

SEQ ID NO: 123207 - DNA, 25 bp, Rattus norvegicus
agcacaagatgtatcaccctgacac

SEQ ID NO: 123208 - DNA, 25 bp, Rattus norvegicus
agcacaagatgtttcaccctgacac

SEQ ID NO: 123209 - DNA, 25 bp, Rattus norvegicus
agcacaagcaggacttcatgacttt

SEQ ID NO: 123210 - DNA, 25 bp, Rattus norvegicus
agcacaagcaggtcttcatgacttt

SEQ ID NO: 123211 - DNA, 25 bp, Rattus norvegicus
agcacaagctaactacctggtcagt

SEQ ID NO: 123212 - DNA, 25 bp, Rattus norvegicus
agcacaagctaagtacctggtcagt

SEQ ID NO: 123213 - DNA, 25 bp, Rattus norvegicus
agcacaagctttcggtttctacaac

SEQ ID NO: 123214 - DNA, 25 bp, Rattus norvegicus
agcacaagctttgggtttctacaac

SEQ ID NO: 123215 - DNA, 25 bp, Rattus norvegicus
agcacaaggaggacttatctgcccc

SEQ ID NO: 123216 - DNA, 25 bp, Rattus norvegicus
agcacaaggaggtcttatctgcccc

SEQ ID NO: 123217 - DNA, 25 bp, Rattus norvegicus
agcacaagggtgaacatcccgcttc

SEQ ID NO: 123218 - DNA, 25 bp, Rattus norvegicus
agcacaagggtgtacatcccgcttc

SEQ ID NO: 123219 - DNA, 25 bp, Rattus norvegicus
agcacaaggttgacatccgtccaat

SEQ ID NO: 123220 - DNA, 25 bp, Rattus norvegicus
agcacaaggttgtcatccgtccaat

SEQ ID NO: 123221 - DNA, 25 bp, Rattus norvegicus
agcacaagtggcaatctgtcaccat

SEQ ID NO: 123222 - DNA, 25 bp, Rattus norvegicus
agcacaagtggctatctgtcaccat

SEQ ID NO: 123223 - DNA, 25 bp, Rattus norvegicus
agcacaataaagcttgttgcccatt

SEQ ID NO: 123224 - DNA, 25 bp, Rattus norvegicus
agcacaataaaggttgttgcccatt

SEQ ID NO: 123225 - DNA, 25 bp, Rattus norvegicus
agcacaatgcatccaagtcagggat

SEQ ID NO: 123226 - DNA, 25 bp, Rattus norvegicus
agcacaatgcatgcaagtcagggat

SEQ ID NO: 123227 - DNA, 25 bp, Rattus norvegicus
agcacaatgggcatgacactgttcc

SEQ ID NO: 123228 - DNA, 25 bp, Rattus norvegicus
agcacaatgggcttgacactgttcc

SEQ ID NO: 123229 - DNA, 25 bp, Rattus norvegicus
agcacaatgtgcaagcctacgcttt

SEQ ID NO: 123230 - DNA, 25 bp, Rattus norvegicus
agcacaatgtgctagcctacgcttt

SEQ ID NO: 123231 - DNA, 25 bp, Rattus norvegicus
agcacaatgttaactgctgccacac

SEQ ID NO: 123232 - DNA, 25 bp, Rattus norvegicus
agcacaatgttatctgctgccacac

SEQ ID NO: 123233 - DNA, 25 bp, Rattus norvegicus
agcacaattttgaggctcacccacg

SEQ ID NO: 123234 - DNA, 25 bp, Rattus norvegicus
agcacaattttgtggctcacccacg

SEQ ID NO: 123235 - DNA, 25 bp, Rattus norvegicus
agcacacaagacacctgttcgtcca

SEQ ID NO: 123236 - DNA, 25 bp, Rattus norvegicus
agcacacaagactcctgttcgtcca

SEQ ID NO: 123237 - DNA, 25 bp, Rattus norvegicus
agcacacaagagctcatgtccagat

SEQ ID NO: 123238 - DNA, 25 bp, Rattus norvegicus
agcacacaagaggtcatgtccagat

SEQ ID NO: 123239 - DNA, 25 bp, Rattus norvegicus
agcacacaagctcgttgccttcgac

SEQ ID NO: 123240 - DNA, 25 bp, Rattus norvegicus
agcacacaagctggttgccttcgac

SEQ ID NO: 123241 - DNA, 25 bp, Rattus norvegicus
agcacacacaagctttagtccccag

SEQ ID NO: 123242 - DNA, 25 bp, Rattus norvegicus
agcacacacaaggtttagtccccag

SEQ ID NO: 123243 - DNA, 25 bp, Rattus norvegicus
agcacacacctcaggtggcttctaa

SEQ ID NO: 123244 - DNA, 25 bp, Rattus norvegicus
agcacacacctctggtggcttctaa

SEQ ID NO: 123245 - DNA, 25 bp, Rattus norvegicus
agcacacacctgcagagttctgtca

SEQ ID NO: 123246 - DNA, 25 bp, Rattus norvegicus
agcacacacctggagagttctgtca

SEQ ID NO: 123247 - DNA, 25 bp, Rattus norvegicus
agcacacacgcacgcttatatacaa

SEQ ID NO: 123248 - DNA, 25 bp, Rattus norvegicus
agcacacacgcaggcttatatacaa

SEQ ID NO: 123249 - DNA, 25 bp, Rattus norvegicus
agcacacactaacctatgcctctgt

SEQ ID NO: 123250 - DNA, 25 bp, Rattus norvegicus
agcacacactaagctatgcctctgt

SEQ ID NO: 123251 - DNA, 25 bp, Rattus norvegicus
agcacacactccatggtgtccaggc

SEQ ID NO: 123252 - DNA, 25 bp, Rattus norvegicus
agcacacactccttggtgtccaggc

SEQ ID NO: 123253 - DNA, 25 bp, Rattus norvegicus
agcacacagaagacctggctcatgt

SEQ ID NO: 123254 - DNA, 25 bp, Rattus norvegicus
agcacacagaagtcctggctcatgt

SEQ ID NO: 123255 - DNA, 25 bp, Rattus norvegicus
agcacacagcagaggaggaccatga

SEQ ID NO: 123256 - DNA, 25 bp, Rattus norvegicus
agcacacagcagaggtacagtacaa

SEQ ID NO: 123257 - DNA, 25 bp, Rattus norvegicus
agcacacagcagtggaggaccatga

SEQ ID NO: 123258 - DNA, 25 bp, Rattus norvegicus
agcacacagcagtggtacagtacaa

SEQ ID NO: 123259 - DNA, 25 bp, Rattus norvegicus
agcacacagctgcagttgaagcact

SEQ ID NO: 123260 - DNA, 25 bp, Rattus norvegicus
agcacacagctggagttgaagcact

SEQ ID NO: 123261 - DNA, 25 bp, Rattus norvegicus
agcacacaggccatctgaaacggga

SEQ ID NO: 123262 - DNA, 25 bp, Rattus norvegicus
agcacacaggccttctgaaacggga

SEQ ID NO: 123263 - DNA, 25 bp, Rattus norvegicus
agcacacagtgtacccctgttattt

SEQ ID NO: 123264 - DNA, 25 bp, Rattus norvegicus
agcacacagtgttcccctgttattt

SEQ ID NO: 123265 - DNA, 25 bp, Rattus norvegicus
agcacacagttacctttccatggga

SEQ ID NO: 123266 - DNA, 25 bp, Rattus norvegicus
agcacacagttagctttccatggga

SEQ ID NO: 123267 - DNA, 25 bp, Rattus norvegicus
agcacacatggcacaaggtccttgt

SEQ ID NO: 123268 - DNA, 25 bp, Rattus norvegicus
agcacacatggctcaaggtccttgt

SEQ ID NO: 123269 - DNA, 25 bp, Rattus norvegicus
agcacacatgtcagtagatgtttct

SEQ ID NO: 123270 - DNA, 25 bp, Rattus norvegicus
agcacacatgtctgtagatgtttct

SEQ ID NO: 123271 - DNA, 25 bp, Rattus norvegicus
agcacaccactgatcagagcagctc

SEQ ID NO: 123272 - DNA, 25 bp, Rattus norvegicus
agcacaccactgttcagagcagctc

SEQ ID NO: 123273 - DNA, 25 bp, Rattus norvegicus
agcacaccagtaccataccgaggct

SEQ ID NO: 123274 - DNA, 25 bp, Rattus norvegicus
agcacaccagtagcataccgaggct

SEQ ID NO: 123275 - DNA, 25 bp, Rattus norvegicus
agcacaccagttaatgcactgctga

SEQ ID NO: 123276 - DNA, 25 bp, Rattus norvegicus
agcacaccagtttatgcactgctga

SEQ ID NO: 123277 - DNA, 25 bp, Rattus norvegicus
agcacacccaacatttcttcttgta

SEQ ID NO: 123278 - DNA, 25 bp, Rattus norvegicus
agcacacccaacttttcttcttgta

SEQ ID NO: 123279 - DNA, 25 bp, Rattus norvegicus
agcacacccgctaaggcaaagagaa

SEQ ID NO: 123280 - DNA, 25 bp, Rattus norvegicus
agcacacccgcttaggcaaagagaa

SEQ ID NO: 123281 - DNA, 25 bp, Rattus norvegicus
agcacaccgatgctctgcagtggtt

SEQ ID NO: 123282 - DNA, 25 bp, Rattus norvegicus
agcacaccgatggtctgcagtggtt

SEQ ID NO: 123283 - DNA, 25 bp, Rattus norvegicus
agcacaccggtcaggagtcatatgt

SEQ ID NO: 123284 - DNA, 25 bp, Rattus norvegicus
agcacaccggtctggagtcatatgt

SEQ ID NO: 123285 - DNA, 25 bp, Rattus norvegicus
agcacacctgcaagcctaaatcatg

SEQ ID NO: 123286 - DNA, 25 bp, Rattus norvegicus
agcacacctgcatgcctaaatcatg

SEQ ID NO: 123287 - DNA, 25 bp, Rattus norvegicus
agcacacctggtaatcctagtacgt

SEQ ID NO: 123288 - DNA, 25 bp, Rattus norvegicus
agcacacctggttatcctagtacgt

SEQ ID NO: 123289 - DNA, 25 bp, Rattus norvegicus
agcacacctgtgagactgtacagca

SEQ ID NO: 123290 - DNA, 25 bp, Rattus norvegicus
agcacacctgtgtgactgtacagca

SEQ ID NO: 123291 - DNA, 25 bp, Rattus norvegicus
agcacacctgttaactgagtcctat

SEQ ID NO: 123292 - DNA, 25 bp, Rattus norvegicus
agcacacctgtttactgagtcctat

SEQ ID NO: 123293 - DNA, 25 bp, Rattus norvegicus
agcacaccttggagacttcaaacca

SEQ ID NO: 123294 - DNA, 25 bp, Rattus norvegicus
agcacaccttggtgacttcaaacca

SEQ ID NO: 123295 - DNA, 25 bp, Rattus norvegicus
agcacacgctccctagagaatgtat

SEQ ID NO: 123296 - DNA, 25 bp, Rattus norvegicus
agcacacgctccgtagagaatgtat

SEQ ID NO: 123297 - DNA, 25 bp, Rattus norvegicus
agcacacgtaatcccttctgaaaat

SEQ ID NO: 123298 - DNA, 25 bp, Rattus norvegicus
agcacacgtaatgccttctgaaaat

SEQ ID NO: 123299 - DNA, 25 bp, Rattus norvegicus
agcacacgtcttcccaggacagtca

SEQ ID NO: 123300 - DNA, 25 bp, Rattus norvegicus
agcacacgtcttgccaggacagtca

SEQ ID NO: 123301 - DNA, 25 bp, Rattus norvegicus
agcacactgactacactgtttggtt

SEQ ID NO: 123302 - DNA, 25 bp, Rattus norvegicus
agcacactgactagtggcaagcaca

SEQ ID NO: 123303 - DNA, 25 bp, Rattus norvegicus
agcacactgacttcactgtttggtt

SEQ ID NO: 123304 - DNA, 25 bp, Rattus norvegicus
agcacactgacttgtggcaagcaca

SEQ ID NO: 123305 - DNA, 25 bp, Rattus norvegicus
agcacactgatacctcttggcttgg

SEQ ID NO: 123306 - DNA, 25 bp, Rattus norvegicus
agcacactgatagctcttggcttgg

SEQ ID NO: 123307 - DNA, 25 bp, Rattus norvegicus
agcacactgcatagtgtttgccaca

SEQ ID NO: 123308 - DNA, 25 bp, Rattus norvegicus
agcacactgcattgtgtttgccaca

SEQ ID NO: 123309 - DNA, 25 bp, Rattus norvegicus
agcacactgcgcatatgctgtggaa

SEQ ID NO: 123310 - DNA, 25 bp, Rattus norvegicus
agcacactgcgcttatgctgtggaa

SEQ ID NO: 123311 - DNA, 25 bp, Rattus norvegicus
agcacactgctaactataatctaaa

SEQ ID NO: 123312 - DNA, 25 bp, Rattus norvegicus
agcacactgctatctataatctaaa

SEQ ID NO: 123313 - DNA, 25 bp, Rattus norvegicus
agcacactgctcatgacgtgaggtt

SEQ ID NO: 123314 - DNA, 25 bp, Rattus norvegicus
agcacactgctcttgacgtgaggtt

SEQ ID NO: 123315 - DNA, 25 bp, Rattus norvegicus
agcacactgctgatcaaattcttga

SEQ ID NO: 123316 - DNA, 25 bp, Rattus norvegicus
agcacactgctgctcatcaagatgt

SEQ ID NO: 123317 - DNA, 25 bp, Rattus norvegicus
agcacactgctggtcatcaagatgt

SEQ ID NO: 123318 - DNA, 25 bp, Rattus norvegicus
agcacactgctgttcaaattcttga

SEQ ID NO: 123319 - DNA, 25 bp, Rattus norvegicus
agcacactggctataaaggacacag

SEQ ID NO: 123320 - DNA, 25 bp, Rattus norvegicus
agcacactggctttaaaggacacag

SEQ ID NO: 123321 - DNA, 25 bp, Rattus norvegicus
agcacactgggtacttcaaagagca

SEQ ID NO: 123322 - DNA, 25 bp, Rattus norvegicus
agcacactgggttcttcaaagagca

SEQ ID NO: 123323 - DNA, 25 bp, Rattus norvegicus
agcacactgtcacggaccatccaaa

SEQ ID NO: 123324 - DNA, 25 bp, Rattus norvegicus
agcacactgtcagggaccatccaaa

SEQ ID NO: 123325 - DNA, 25 bp, Rattus norvegicus
agcacactgtggctggtactttcct

SEQ ID NO: 123326 - DNA, 25 bp, Rattus norvegicus
agcacactgtgggtggtactttcct

SEQ ID NO: 123327 - DNA, 25 bp, Rattus norvegicus
agcacacttctcctaagctgcctgt

SEQ ID NO: 123328 - DNA, 25 bp, Rattus norvegicus
agcacacttctcgtaagctgcctgt

SEQ ID NO: 123329 - DNA, 25 bp, Rattus norvegicus
agcacacttgcaagtctcatactgg

SEQ ID NO: 123330 - DNA, 25 bp, Rattus norvegicus
agcacacttgcatgtctcatactgg

SEQ ID NO: 123331 - DNA, 25 bp, Rattus norvegicus
agcacactttcaaggcatttgtcct

SEQ ID NO: 123332 - DNA, 25 bp, Rattus norvegicus
agcacactttcatggcatttgtcct

SEQ ID NO: 123333 - DNA, 25 bp, Rattus norvegicus
agcacagaacgtacttcagtttccc

SEQ ID NO: 123334 - DNA, 25 bp, Rattus norvegicus
agcacagaacgttcttcagtttccc

SEQ ID NO: 123335 - DNA, 25 bp, Rattus norvegicus
agcacagaagtgatccggcagcccg

SEQ ID NO: 123336 - DNA, 25 bp, Rattus norvegicus
agcacagaagtgttccggcagcccg

SEQ ID NO: 123337 - DNA, 25 bp, Rattus norvegicus
agcacagaattcactttaaatggag

SEQ ID NO: 123338 - DNA, 25 bp, Rattus norvegicus
agcacagaattctctttaaatggag

SEQ ID NO: 123339 - DNA, 25 bp, Rattus norvegicus
agcacagacagacacttcctttggt

SEQ ID NO: 123340 - DNA, 25 bp, Rattus norvegicus
agcacagacagagacttcctttggt

SEQ ID NO: 123341 - DNA, 25 bp, Rattus norvegicus
agcacagacaggcatcaaggccaag

SEQ ID NO: 123342 - DNA, 25 bp, Rattus norvegicus
agcacagacagggatcaaggccaag

SEQ ID NO: 123343 - DNA, 25 bp, Rattus norvegicus
agcacagacattaggtcaccttttc

SEQ ID NO: 123344 - DNA, 25 bp, Rattus norvegicus
agcacagacatttggtcaccttttc

SEQ ID NO: 123345 - DNA, 25 bp, Rattus norvegicus
agcacagacccgaaaattccaattt

SEQ ID NO: 123346 - DNA, 25 bp, Rattus norvegicus
agcacagacccgtaaattccaattt

SEQ ID NO: 123347 - DNA, 25 bp, Rattus norvegicus
agcacagacctgacttcctaggaaa

SEQ ID NO: 123348 - DNA, 25 bp, Rattus norvegicus
agcacagacctgtcttcctaggaaa

SEQ ID NO: 123349 - DNA, 25 bp, Rattus norvegicus
agcacagactctcactgattcttct

SEQ ID NO: 123350 - DNA, 25 bp, Rattus norvegicus
agcacagactctgactgattcttct

SEQ ID NO: 123351 - DNA, 25 bp, Rattus norvegicus
agcacagactgaattctttttcctt

SEQ ID NO: 123352 - DNA, 25 bp, Rattus norvegicus
agcacagactgatttctttttcctt

SEQ ID NO: 123353 - DNA, 25 bp, Rattus norvegicus
agcacagagagaattgggtcttccc

SEQ ID NO: 123354 - DNA, 25 bp, Rattus norvegicus
agcacagagagatttgggtcttccc

SEQ ID NO: 123355 - DNA, 25 bp, Rattus norvegicus
agcacagagcagaggttagactcct

SEQ ID NO: 123356 - DNA, 25 bp, Rattus norvegicus
agcacagagcagtggttagactcct

SEQ ID NO: 123357 - DNA, 25 bp, Rattus norvegicus
agcacagagtgaacaggcctttaga

SEQ ID NO: 123358 - DNA, 25 bp, Rattus norvegicus
agcacagagtgatcaggcctttaga

SEQ ID NO: 123359 - DNA, 25 bp, Rattus norvegicus
agcacagatccacgtctcattcaga

SEQ ID NO: 123360 - DNA, 25 bp, Rattus norvegicus
agcacagatccaggtctcattcaga

SEQ ID NO: 123361 - DNA, 25 bp, Rattus norvegicus
agcacagatgagcaaacgccttcct

SEQ ID NO: 123362 - DNA, 25 bp, Rattus norvegicus
agcacagatgaggaaacgccttcct

SEQ ID NO: 123363 - DNA, 25 bp, Rattus norvegicus
agcacagatgctcacaggagtccga

SEQ ID NO: 123364 - DNA, 25 bp, Rattus norvegicus
agcacagatgctccagtctccaaag

SEQ ID NO: 123365 - DNA, 25 bp, Rattus norvegicus
agcacagatgctgacaggagtccga

SEQ ID NO: 123366 - DNA, 25 bp, Rattus norvegicus
agcacagatgctgcagtctccaaag

SEQ ID NO: 123367 - DNA, 25 bp, Rattus norvegicus
agcacagattgcaatggactcagtt

SEQ ID NO: 123368 - DNA, 25 bp, Rattus norvegicus
agcacagattgctatggactcagtt

SEQ ID NO: 123369 - DNA, 25 bp, Rattus norvegicus
agcacagattttctccactgcagca

SEQ ID NO: 123370 - DNA, 25 bp, Rattus norvegicus
agcacagattttgtccactgcagca

SEQ ID NO: 123371 - DNA, 25 bp, Rattus norvegicus
agcacagcaaataggctgctcggtg

SEQ ID NO: 123372 - DNA, 25 bp, Rattus norvegicus
agcacagcaaattggctgctcggtg

SEQ ID NO: 123373 - DNA, 25 bp, Rattus norvegicus
agcacagcacagagtctgcctgcag

SEQ ID NO: 123374 - DNA, 25 bp, Rattus norvegicus
agcacagcacagtgtctgcctgcag

SEQ ID NO: 123375 - DNA, 25 bp, Rattus norvegicus
agcacagcaccgagtggagtcacac

SEQ ID NO: 123376 - DNA, 25 bp, Rattus norvegicus
agcacagcaccgtgtggagtcacac

SEQ ID NO: 123377 - DNA, 25 bp, Rattus norvegicus
agcacagcacgccatgtatagcaaa

SEQ ID NO: 123378 - DNA, 25 bp, Rattus norvegicus
agcacagcacgcgatgtatagcaaa

SEQ ID NO: 123379 - DNA, 25 bp, Rattus norvegicus
agcacagcactccatgtggttctgt

SEQ ID NO: 123380 - DNA, 25 bp, Rattus norvegicus
agcacagcactcgatgtggttctgt

SEQ ID NO: 123381 - DNA, 25 bp, Rattus norvegicus
agcacagcactgatgggagggatca

SEQ ID NO: 123382 - DNA, 25 bp, Rattus norvegicus
agcacagcactgttgggagggatca

SEQ ID NO: 123383 - DNA, 25 bp, Rattus norvegicus
agcacagcagacaaaccccgtagat

SEQ ID NO: 123384 - DNA, 25 bp, Rattus norvegicus
agcacagcagactaaccccgtagat

SEQ ID NO: 123385 - DNA, 25 bp, Rattus norvegicus
agcacagcagccctgagcctcatga

SEQ ID NO: 123386 - DNA, 25 bp, Rattus norvegicus
agcacagcagccgtgagcctcatga

SEQ ID NO: 123387 - DNA, 25 bp, Rattus norvegicus
agcacagcagttaccagtggagccc

SEQ ID NO: 123388 - DNA, 25 bp, Rattus norvegicus
agcacagcagttcctagtccagaga

SEQ ID NO: 123389 - DNA, 25 bp, Rattus norvegicus
agcacagcagttgctagtccagaga

SEQ ID NO: 123390 - DNA, 25 bp, Rattus norvegicus
agcacagcagtttccagtggagccc

SEQ ID NO: 123391 - DNA, 25 bp, Rattus norvegicus
agcacagcccgaatctgtgttgaca

SEQ ID NO: 123392 - DNA, 25 bp, Rattus norvegicus
agcacagcccgattctgtgttgaca

SEQ ID NO: 123393 - DNA, 25 bp, Rattus norvegicus
agcacagccgagagaactctgccac

SEQ ID NO: 123394 - DNA, 25 bp, Rattus norvegicus
agcacagccgagtgaactctgccac

SEQ ID NO: 123395 - DNA, 25 bp, Rattus norvegicus
agcacagccgcgatgtgcacagaag

SEQ ID NO: 123396 - DNA, 25 bp, Rattus norvegicus
agcacagccgcgttgtgcacagaag

SEQ ID NO: 123397 - DNA, 25 bp, Rattus norvegicus
agcacagccggcatcttgcatgaat

SEQ ID NO: 123398 - DNA, 25 bp, Rattus norvegicus
agcacagccggcttcttgcatgaat

SEQ ID NO: 123399 - DNA, 25 bp, Rattus norvegicus
agcacagcctggcttcgtgtccata

SEQ ID NO: 123400 - DNA, 25 bp, Rattus norvegicus
agcacagcctgggttcgtgtccata

SEQ ID NO: 123401 - DNA, 25 bp, Rattus norvegicus
agcacagcgtcacctgggtttggct

SEQ ID NO: 123402 - DNA, 25 bp, Rattus norvegicus
agcacagcgtcagctgggtttggct

SEQ ID NO: 123403 - DNA, 25 bp, Rattus norvegicus
agcacagctaacaagcgttcatctt

SEQ ID NO: 123404 - DNA, 25 bp, Rattus norvegicus
agcacagctaactagcgttcatctt

SEQ ID NO: 123405 - DNA, 25 bp, Rattus norvegicus
agcacagctccaagattcccagtgg

SEQ ID NO: 123406 - DNA, 25 bp, Rattus norvegicus
agcacagctccacgatacaagaaga

SEQ ID NO: 123407 - DNA, 25 bp, Rattus norvegicus
agcacagctccaggatacaagaaga

SEQ ID NO: 123408 - DNA, 25 bp, Rattus norvegicus
agcacagctccatgattcccagtgg

SEQ ID NO: 123409 - DNA, 25 bp, Rattus norvegicus
agcacagctctaaggtgtcaccagt

SEQ ID NO: 123410 - DNA, 25 bp, Rattus norvegicus
agcacagctctatggtgtcaccagt

SEQ ID NO: 123411 - DNA, 25 bp, Rattus norvegicus
agcacagctgtcatttatgcaagca

SEQ ID NO: 123412 - DNA, 25 bp, Rattus norvegicus
agcacagctgtcttttatgcaagca

SEQ ID NO: 123413 - DNA, 25 bp, Rattus norvegicus
agcacagcttggattggatgccatt

SEQ ID NO: 123414 - DNA, 25 bp, Rattus norvegicus
agcacagcttggtttggatgccatt

SEQ ID NO: 123415 - DNA, 25 bp, Rattus norvegicus
agcacagcttgtagctccagtcagg

SEQ ID NO: 123416 - DNA, 25 bp, Rattus norvegicus
agcacagcttgttgctccagtcagg

SEQ ID NO: 123417 - DNA, 25 bp, Rattus norvegicus
agcacagctttgataacacccttca

SEQ ID NO: 123418 - DNA, 25 bp, Rattus norvegicus
agcacagctttgttaacacccttca

SEQ ID NO: 123419 - DNA, 25 bp, Rattus norvegicus
agcacaggacacagttcgccaacaa

SEQ ID NO: 123420 - DNA, 25 bp, Rattus norvegicus
agcacaggacaccaccagtttttag

SEQ ID NO: 123421 - DNA, 25 bp, Rattus norvegicus
agcacaggacacgaccagtttttag

SEQ ID NO: 123422 - DNA, 25 bp, Rattus norvegicus
agcacaggacactgttcgccaacaa

SEQ ID NO: 123423 - DNA, 25 bp, Rattus norvegicus
agcacaggagagcaggttacccaaa

SEQ ID NO: 123424 - DNA, 25 bp, Rattus norvegicus
agcacaggagaggaggttacccaaa

SEQ ID NO: 123425 - DNA, 25 bp, Rattus norvegicus
agcacaggcagcagcagcgtgtatg

SEQ ID NO: 123426 - DNA, 25 bp, Rattus norvegicus
agcacaggcagctgcagcgtgtatg

SEQ ID NO: 123427 - DNA, 25 bp, Rattus norvegicus
agcacaggccaccactagtcaagta

SEQ ID NO: 123428 - DNA, 25 bp, Rattus norvegicus
agcacaggccacgactagtcaagta

SEQ ID NO: 123429 - DNA, 25 bp, Rattus norvegicus
agcacaggccagctggctagagttc

SEQ ID NO: 123430 - DNA, 25 bp, Rattus norvegicus
agcacaggccaggtggctagagttc

SEQ ID NO: 123431 - DNA, 25 bp, Rattus norvegicus
agcacaggccgcacacagtgtgtat

SEQ ID NO: 123432 - DNA, 25 bp, Rattus norvegicus
agcacaggccgctcacagtgtgtat

SEQ ID NO: 123433 - DNA, 25 bp, Rattus norvegicus
agcacaggccttatgatcattttac

SEQ ID NO: 123434 - DNA, 25 bp, Rattus norvegicus
agcacaggccttttgatcattttac

SEQ ID NO: 123435 - DNA, 25 bp, Rattus norvegicus
agcacaggctagctcttggttctaa

SEQ ID NO: 123436 - DNA, 25 bp, Rattus norvegicus
agcacaggctaggtcttggttctaa

SEQ ID NO: 123437 - DNA, 25 bp, Rattus norvegicus
agcacaggctgtagacagccagtgt

SEQ ID NO: 123438 - DNA, 25 bp, Rattus norvegicus
agcacaggctgttgacagccagtgt

SEQ ID NO: 123439 - DNA, 25 bp, Rattus norvegicus
agcacaggcttacaatcaggccaaa

SEQ ID NO: 123440 - DNA, 25 bp, Rattus norvegicus
agcacaggcttagaatcaggccaaa

SEQ ID NO: 123441 - DNA, 25 bp, Rattus norvegicus
agcacagggaggaaacagccatatg

SEQ ID NO: 123442 - DNA, 25 bp, Rattus norvegicus
agcacagggaggtaacagccatatg

SEQ ID NO: 123443 - DNA, 25 bp, Rattus norvegicus
agcacagggccgattgttgacattc

SEQ ID NO: 123444 - DNA, 25 bp, Rattus norvegicus
agcacagggccgtttgttgacattc

SEQ ID NO: 123445 - DNA, 25 bp, Rattus norvegicus
agcacagggctcctttgggtatttt

SEQ ID NO: 123446 - DNA, 25 bp, Rattus norvegicus
agcacagggctcgtttgggtatttt

SEQ ID NO: 123447 - DNA, 25 bp, Rattus norvegicus
agcacagggctgcagttctggtctc

SEQ ID NO: 123448 - DNA, 25 bp, Rattus norvegicus
agcacagggctggagttctggtctc

SEQ ID NO: 123449 - DNA, 25 bp, Rattus norvegicus
agcacagggttcagcaggcatgcat

SEQ ID NO: 123450 - DNA, 25 bp, Rattus norvegicus
agcacagggttcaggcctggtcaga

SEQ ID NO: 123451 - DNA, 25 bp, Rattus norvegicus
agcacagggttctgcaggcatgcat

SEQ ID NO: 123452 - DNA, 25 bp, Rattus norvegicus
agcacagggttctggcctggtcaga

SEQ ID NO: 123453 - DNA, 25 bp, Rattus norvegicus
agcacaggtgcacgcaaaccctgaa

SEQ ID NO: 123454 - DNA, 25 bp, Rattus norvegicus
agcacaggtgcaggcaaaccctgaa

SEQ ID NO: 123455 - DNA, 25 bp, Rattus norvegicus
agcacaggtgcccaagtcagagagc

SEQ ID NO: 123456 - DNA, 25 bp, Rattus norvegicus
agcacaggtgccgaagtcagagagc

SEQ ID NO: 123457 - DNA, 25 bp, Rattus norvegicus
agcacagtacacagttggaaccgga

SEQ ID NO: 123458 - DNA, 25 bp, Rattus norvegicus
agcacagtacactgttggaaccgga

SEQ ID NO: 123459 - DNA, 25 bp, Rattus norvegicus
agcacagtacatattcatgactggg

SEQ ID NO: 123460 - DNA, 25 bp, Rattus norvegicus
agcacagtacattttcatgactggg

SEQ ID NO: 123461 - DNA, 25 bp, Rattus norvegicus
agcacagtcatcatgacactcatgt

SEQ ID NO: 123462 - DNA, 25 bp, Rattus norvegicus
agcacagtcatcttgacactcatgt

SEQ ID NO: 123463 - DNA, 25 bp, Rattus norvegicus
agcacagtccccaggtttacagtct

SEQ ID NO: 123464 - DNA, 25 bp, Rattus norvegicus
agcacagtcccctggtttacagtct

SEQ ID NO: 123465 - DNA, 25 bp, Rattus norvegicus
agcacagtctagagtggtcctgagt

SEQ ID NO: 123466 - DNA, 25 bp, Rattus norvegicus
agcacagtctagtgtggtcctgagt

SEQ ID NO: 123467 - DNA, 25 bp, Rattus norvegicus
agcacagtctccatcaggacaacta

SEQ ID NO: 123468 - DNA, 25 bp, Rattus norvegicus
agcacagtctccttcaggacaacta

SEQ ID NO: 123469 - DNA, 25 bp, Rattus norvegicus
agcacagtgaccaccttgggactaa

SEQ ID NO: 123470 - DNA, 25 bp, Rattus norvegicus
agcacagtgacctccttgggactaa

SEQ ID NO: 123471 - DNA, 25 bp, Rattus norvegicus
agcacagtgcagatgtccaagggac

SEQ ID NO: 123472 - DNA, 25 bp, Rattus norvegicus
agcacagtgcagttgtccaagggac

SEQ ID NO: 123473 - DNA, 25 bp, Rattus norvegicus
agcacagtgcgacgtttttgttttt

SEQ ID NO: 123474 - DNA, 25 bp, Rattus norvegicus
agcacagtgcgaggtttttgttttt

SEQ ID NO: 123475 - DNA, 25 bp, Rattus norvegicus
agcacagtgctcagcctcagtgtta

SEQ ID NO: 123476 - DNA, 25 bp, Rattus norvegicus
agcacagtgctctgcctcagtgtta

SEQ ID NO: 123477 - DNA, 25 bp, Rattus norvegicus
agcacagtgctgaccagagagccca

SEQ ID NO: 123478 - DNA, 25 bp, Rattus norvegicus
agcacagtgctgtccagagagccca

SEQ ID NO: 123479 - DNA, 25 bp, Rattus norvegicus
agcacagtggatcccgtaagtcccc

SEQ ID NO: 123480 - DNA, 25 bp, Rattus norvegicus
agcacagtggatgccgtaagtcccc

SEQ ID NO: 123481 - DNA, 25 bp, Rattus norvegicus
agcacagtgggcctgtggcctattc

SEQ ID NO: 123482 - DNA, 25 bp, Rattus norvegicus
agcacagtgggcgtgtggcctattc

SEQ ID NO: 123483 - DNA, 25 bp, Rattus norvegicus
agcacagtggttctgacaagcccaa

SEQ ID NO: 123484 - DNA, 25 bp, Rattus norvegicus
agcacagtggttgtgacaagcccaa

SEQ ID NO: 123485 - DNA, 25 bp, Rattus norvegicus
agcacagttagaattgctccctcct

SEQ ID NO: 123486 - DNA, 25 bp, Rattus norvegicus
agcacagttagatttgctccctcct

SEQ ID NO: 123487 - DNA, 25 bp, Rattus norvegicus
agcacagttcccagagtccgggagc

SEQ ID NO: 123488 - DNA, 25 bp, Rattus norvegicus
agcacagttccctgagtccgggagc

SEQ ID NO: 123489 - DNA, 25 bp, Rattus norvegicus
agcacagttctacaataccagtcct

SEQ ID NO: 123490 - DNA, 25 bp, Rattus norvegicus
agcacagttctagaataccagtcct

SEQ ID NO: 123491 - DNA, 25 bp, Rattus norvegicus
agcacagttgctacctggaaaccca

SEQ ID NO: 123492 - DNA, 25 bp, Rattus norvegicus
agcacagttgcttcctggaaaccca

SEQ ID NO: 123493 - DNA, 25 bp, Rattus norvegicus
agcacagtttatacttgacgtcctc

SEQ ID NO: 123494 - DNA, 25 bp, Rattus norvegicus
agcacagtttattcttgacgtcctc

SEQ ID NO: 123495 - DNA, 25 bp, Rattus norvegicus
agcacagttttaaaagtctgatcat

SEQ ID NO: 123496 - DNA, 25 bp, Rattus norvegicus
agcacagttttaacaaggtcaccag

SEQ ID NO: 123497 - DNA, 25 bp, Rattus norvegicus
agcacagttttataagtctgatcat

SEQ ID NO: 123498 - DNA, 25 bp, Rattus norvegicus
agcacagttttatcaaggtcaccag

SEQ ID NO: 123499 - DNA, 25 bp, Rattus norvegicus
agcacataagctctgatttccggcc

SEQ ID NO: 123500 - DNA, 25 bp, Rattus norvegicus
agcacataagctgtgatttccggcc

SEQ ID NO: 123501 - DNA, 25 bp, Rattus norvegicus
agcacataccacagatcacactgaa

SEQ ID NO: 123502 - DNA, 25 bp, Rattus norvegicus
agcacataccactgatcacactgaa

SEQ ID NO: 123503 - DNA, 25 bp, Rattus norvegicus
agcacatacgggactttgcacatat

SEQ ID NO: 123504 - DNA, 25 bp, Rattus norvegicus
agcacatacgggtctttgcacatat

SEQ ID NO: 123505 - DNA, 25 bp, Rattus norvegicus
agcacatactggctcagacatcatt

SEQ ID NO: 123506 - DNA, 25 bp, Rattus norvegicus
agcacatactgggtcagacatcatt

SEQ ID NO: 123507 - DNA, 25 bp, Rattus norvegicus
agcacatagaacagcaggctcccta

SEQ ID NO: 123508 - DNA, 25 bp, Rattus norvegicus
agcacatagaactgcaggctcccta

SEQ ID NO: 123509 - DNA, 25 bp, Rattus norvegicus
agcacatagcagacaaaccattgag

SEQ ID NO: 123510 - DNA, 25 bp, Rattus norvegicus
agcacatagcagtcaaaccattgag

SEQ ID NO: 123511 - DNA, 25 bp, Rattus norvegicus
agcacataggcgaagactcctgggt

SEQ ID NO: 123512 - DNA, 25 bp, Rattus norvegicus
agcacataggcgtagactcctgggt

SEQ ID NO: 123513 - DNA, 25 bp, Rattus norvegicus
agcacatatgccaagccatttccta

SEQ ID NO: 123514 - DNA, 25 bp, Rattus norvegicus
agcacatatgcctagccatttccta

SEQ ID NO: 123515 - DNA, 25 bp, Rattus norvegicus
agcacatattcaaggccgccatttt

SEQ ID NO: 123516 - DNA, 25 bp, Rattus norvegicus
agcacatattcatggccgccatttt

SEQ ID NO: 123517 - DNA, 25 bp, Rattus norvegicus
agcacatcacccatggagagcagca

SEQ ID NO: 123518 - DNA, 25 bp, Rattus norvegicus
agcacatcacccttggagagcagca

SEQ ID NO: 123519 - DNA, 25 bp, Rattus norvegicus
agcacatcatgtcacaggccctgtg

SEQ ID NO: 123520 - DNA, 25 bp, Rattus norvegicus
agcacatcatgtgacaggccctgtg

SEQ ID NO: 123521 - DNA, 25 bp, Rattus norvegicus
agcacatcctcaccgccaaggtgta

SEQ ID NO: 123522 - DNA, 25 bp, Rattus norvegicus
agcacatcctcagcgccaaggtgta

SEQ ID NO: 123523 - DNA, 25 bp, Rattus norvegicus
agcacatcctggagttgccgaggta

SEQ ID NO: 123524 - DNA, 25 bp, Rattus norvegicus
agcacatcctggtgttgccgaggta

SEQ ID NO: 123525 - DNA, 25 bp, Rattus norvegicus
agcacatccttaattcgtcgctgat

SEQ ID NO: 123526 - DNA, 25 bp, Rattus norvegicus
agcacatccttatttcgtcgctgat

SEQ ID NO: 123527 - DNA, 25 bp, Rattus norvegicus
agcacatcgagtcacagggtcggat

SEQ ID NO: 123528 - DNA, 25 bp, Rattus norvegicus
agcacatcgagtgacagggtcggat

SEQ ID NO: 123529 - DNA, 25 bp, Rattus norvegicus
agcacatcgcctcactgtagacttt

SEQ ID NO: 123530 - DNA, 25 bp, Rattus norvegicus
agcacatcgcctgactgtagacttt

SEQ ID NO: 123531 - DNA, 25 bp, Rattus norvegicus
agcacatcgctaaccttcaacaaat

SEQ ID NO: 123532 - DNA, 25 bp, Rattus norvegicus
agcacatcgctatccttcaacaaat

SEQ ID NO: 123533 - DNA, 25 bp, Rattus norvegicus
agcacatctagcaccaacacagctt

SEQ ID NO: 123534 - DNA, 25 bp, Rattus norvegicus
agcacatctagctccaacacagctt

SEQ ID NO: 123535 - DNA, 25 bp, Rattus norvegicus
agcacatctgccaaggtccagtggg

SEQ ID NO: 123536 - DNA, 25 bp, Rattus norvegicus
agcacatctgcctaggtccagtggg

SEQ ID NO: 123537 - DNA, 25 bp, Rattus norvegicus
agcacatctgctacatcatggcgga

SEQ ID NO: 123538 - DNA, 25 bp, Rattus norvegicus
agcacatctgcttcatcatggcgga

SEQ ID NO: 123539 - DNA, 25 bp, Rattus norvegicus
agcacatctgtcatgaaatcattta

SEQ ID NO: 123540 - DNA, 25 bp, Rattus norvegicus
agcacatctgtcttgaaatcattta

SEQ ID NO: 123541 - DNA, 25 bp, Rattus norvegicus
agcacatcttgcatgcctcttagag

SEQ ID NO: 123542 - DNA, 25 bp, Rattus norvegicus
agcacatcttgcttgcctcttagag

SEQ ID NO: 123543 - DNA, 25 bp, Rattus norvegicus
agcacatgaagcaggcgttctccaa

SEQ ID NO: 123544 - DNA, 25 bp, Rattus norvegicus
agcacatgaagctggcgttctccaa

SEQ ID NO: 123545 - DNA, 25 bp, Rattus norvegicus
agcacatgacccaaagcagcttgga

SEQ ID NO: 123546 - DNA, 25 bp, Rattus norvegicus
agcacatgaccctaagcagcttgga

SEQ ID NO: 123547 - DNA, 25 bp, Rattus norvegicus
agcacatgacttagccgtgtgtacc

SEQ ID NO: 123548 - DNA, 25 bp, Rattus norvegicus
agcacatgactttgccgtgtgtacc

SEQ ID NO: 123549 - DNA, 25 bp, Rattus norvegicus
agcacatgagtgacagaggtagaca

SEQ ID NO: 123550 - DNA, 25 bp, Rattus norvegicus
agcacatgagtgtcagaggtagaca

SEQ ID NO: 123551 - DNA, 25 bp, Rattus norvegicus
agcacatgatggactcttcccattt

SEQ ID NO: 123552 - DNA, 25 bp, Rattus norvegicus
agcacatgatggtctcttcccattt

SEQ ID NO: 123553 - DNA, 25 bp, Rattus norvegicus
agcacatgcagactgaggagtatca

SEQ ID NO: 123554 - DNA, 25 bp, Rattus norvegicus
agcacatgcagagtgaggagtatca

SEQ ID NO: 123555 - DNA, 25 bp, Rattus norvegicus
agcacatgccacaaggtttgccaga

SEQ ID NO: 123556 - DNA, 25 bp, Rattus norvegicus
agcacatgccactaggtttgccaga

SEQ ID NO: 123557 - DNA, 25 bp, Rattus norvegicus
agcacatgcctgcatcgtagtgatg

SEQ ID NO: 123558 - DNA, 25 bp, Rattus norvegicus
agcacatgcctggatcgtagtgatg

SEQ ID NO: 123559 - DNA, 25 bp, Rattus norvegicus
agcacatgctacatcttcctgtctt

SEQ ID NO: 123560 - DNA, 25 bp, Rattus norvegicus
agcacatgctacttcttcctgtctt

SEQ ID NO: 123561 - DNA, 25 bp, Rattus norvegicus
agcacatgctctcgattggctgcca

SEQ ID NO: 123562 - DNA, 25 bp, Rattus norvegicus
agcacatgctctggattggctgcca

SEQ ID NO: 123563 - DNA, 25 bp, Rattus norvegicus
agcacatgctggcatctcagggaat

SEQ ID NO: 123564 - DNA, 25 bp, Rattus norvegicus
agcacatgctgggatctcagggaat

SEQ ID NO: 123565 - DNA, 25 bp, Rattus norvegicus
agcacatggcctatcctttttattt

SEQ ID NO: 123566 - DNA, 25 bp, Rattus norvegicus
agcacatggcctttcctttttattt

SEQ ID NO: 123567 - DNA, 25 bp, Rattus norvegicus
agcacatggctccagtccccagtgt

SEQ ID NO: 123568 - DNA, 25 bp, Rattus norvegicus
agcacatggctcgagtccccagtgt

SEQ ID NO: 123569 - DNA, 25 bp, Rattus norvegicus
agcacatgtagtcctgagtcctgcc

SEQ ID NO: 123570 - DNA, 25 bp, Rattus norvegicus
agcacatgtagtgctgagtcctgcc

SEQ ID NO: 123571 - DNA, 25 bp, Rattus norvegicus
agcacatgtcccagtgtctgagtct

SEQ ID NO: 123572 - DNA, 25 bp, Rattus norvegicus
agcacatgtccctgtgtctgagtct

SEQ ID NO: 123573 - DNA, 25 bp, Rattus norvegicus
agcacattaagaacacttggagcat

SEQ ID NO: 123574 - DNA, 25 bp, Rattus norvegicus
agcacattaagatcacttggagcat

SEQ ID NO: 123575 - DNA, 25 bp, Rattus norvegicus
agcacattaattcctgtcctataag

SEQ ID NO: 123576 - DNA, 25 bp, Rattus norvegicus
agcacattaattgctgtcctataag

SEQ ID NO: 123577 - DNA, 25 bp, Rattus norvegicus
agcacattagctattctcacaccat

SEQ ID NO: 123578 - DNA, 25 bp, Rattus norvegicus
agcacattagcttttctcacaccat

SEQ ID NO: 123579 - DNA, 25 bp, Rattus norvegicus
agcacattcaggagtgtccactgcc

SEQ ID NO: 123580 - DNA, 25 bp, Rattus norvegicus
agcacattcaggtgtgtccactgcc

SEQ ID NO: 123581 - DNA, 25 bp, Rattus norvegicus
agcacattcctgctctttatgtccc

SEQ ID NO: 123582 - DNA, 25 bp, Rattus norvegicus
agcacattcctggtctttatgtccc

SEQ ID NO: 123583 - DNA, 25 bp, Rattus norvegicus
agcacattcgatactccgagtatga

SEQ ID NO: 123584 - DNA, 25 bp, Rattus norvegicus
agcacattcgattctccgagtatga

SEQ ID NO: 123585 - DNA, 25 bp, Rattus norvegicus
agcacattctatcaacctggacttt

SEQ ID NO: 123586 - DNA, 25 bp, Rattus norvegicus
agcacattctatgaacctggacttt

SEQ ID NO: 123587 - DNA, 25 bp, Rattus norvegicus
agcacattctctactgtggcacact

SEQ ID NO: 123588 - DNA, 25 bp, Rattus norvegicus
agcacattctcttctgtggcacact

SEQ ID NO: 123589 - DNA, 25 bp, Rattus norvegicus
agcacattctgaaagcctcacatgc

SEQ ID NO: 123590 - DNA, 25 bp, Rattus norvegicus
agcacattctgatagcctcacatgc

SEQ ID NO: 123591 - DNA, 25 bp, Rattus norvegicus
agcacattgactacgccattcagta

SEQ ID NO: 123592 - DNA, 25 bp, Rattus norvegicus
agcacattgacttcgccattcagta

SEQ ID NO: 123593 - DNA, 25 bp, Rattus norvegicus
agcacattgatcatcttggccagaa

SEQ ID NO: 123594 - DNA, 25 bp, Rattus norvegicus
agcacattgatcttcttggccagaa

SEQ ID NO: 123595 - DNA, 25 bp, Rattus norvegicus
agcacattgctgcagactctcggcc

SEQ ID NO: 123596 - DNA, 25 bp, Rattus norvegicus
agcacattgctggagactctcggcc

SEQ ID NO: 123597 - DNA, 25 bp, Rattus norvegicus
agcacattttatcagccctgtcact

SEQ ID NO: 123598 - DNA, 25 bp, Rattus norvegicus
agcacattttatgagccctgtcact

SEQ ID NO: 123599 - DNA, 25 bp, Rattus norvegicus
agcacattttgtacctttatatctg

SEQ ID NO: 123600 - DNA, 25 bp, Rattus norvegicus
agcacattttgtatcttgagttggg

SEQ ID NO: 123601 - DNA, 25 bp, Rattus norvegicus
agcacattttgttcctttatatctg

SEQ ID NO: 123602 - DNA, 25 bp, Rattus norvegicus
agcacattttgtttcttgagttggg

SEQ ID NO: 123603 - DNA, 25 bp, Rattus norvegicus
agcaccaaaaacctaggagctgagg

SEQ ID NO: 123604 - DNA, 25 bp, Rattus norvegicus
agcaccaaaaacgtaggagctgagg

SEQ ID NO: 123605 - DNA, 25 bp, Rattus norvegicus
agcaccaacttgactgtcgtaccag

SEQ ID NO: 123606 - DNA, 25 bp, Rattus norvegicus
agcaccaacttgtctgtcgtaccag

SEQ ID NO: 123607 - DNA, 25 bp, Rattus norvegicus
agcaccaagctgaggagagggacca

SEQ ID NO: 123608 - DNA, 25 bp, Rattus norvegicus
agcaccaagctgtggagagggacca

SEQ ID NO: 123609 - DNA, 25 bp, Rattus norvegicus
agcaccaaggcgagtacagcatctt

SEQ ID NO: 123610 - DNA, 25 bp, Rattus norvegicus
agcaccaaggcgtgtacagcatctt

SEQ ID NO: 123611 - DNA, 25 bp, Rattus norvegicus
agcaccaagtggatccagaggccaa

SEQ ID NO: 123612 - DNA, 25 bp, Rattus norvegicus
agcaccaagtggttccagaggccaa

SEQ ID NO: 123613 - DNA, 25 bp, Rattus norvegicus
agcaccaagttcactttctgttatc

SEQ ID NO: 123614 - DNA, 25 bp, Rattus norvegicus
agcaccaagttcaggaaaagcccca

SEQ ID NO: 123615 - DNA, 25 bp, Rattus norvegicus
agcaccaagttctctttctgttatc

SEQ ID NO: 123616 - DNA, 25 bp, Rattus norvegicus
agcaccaagttctggaaaagcccca

SEQ ID NO: 123617 - DNA, 25 bp, Rattus norvegicus
agcaccaatgtcaggaggctcccta

SEQ ID NO: 123618 - DNA, 25 bp, Rattus norvegicus
agcaccaatgtctggaggctcccta

SEQ ID NO: 123619 - DNA, 25 bp, Rattus norvegicus
agcaccacagtccagcaggagcttt

SEQ ID NO: 123620 - DNA, 25 bp, Rattus norvegicus
agcaccacagtcgagcaggagcttt

SEQ ID NO: 123621 - DNA, 25 bp, Rattus norvegicus
agcaccacatggaggttcgcaactg

SEQ ID NO: 123622 - DNA, 25 bp, Rattus norvegicus
agcaccacatggtggttcgcaactg

SEQ ID NO: 123623 - DNA, 25 bp, Rattus norvegicus
agcaccaccgagcagcgcagcttag

SEQ ID NO: 123624 - DNA, 25 bp, Rattus norvegicus
agcaccaccgaggagcgcagcttag

SEQ ID NO: 123625 - DNA, 25 bp, Rattus norvegicus
agcaccacgggccagtctgatactg

SEQ ID NO: 123626 - DNA, 25 bp, Rattus norvegicus
agcaccacgggcgagtctgatactg

SEQ ID NO: 123627 - DNA, 25 bp, Rattus norvegicus
agcaccacgtgcatacagaagctca

SEQ ID NO: 123628 - DNA, 25 bp, Rattus norvegicus
agcaccacgtgcttacagaagctca

SEQ ID NO: 123629 - DNA, 25 bp, Rattus norvegicus
agcaccactacaatgttcacctgaa

SEQ ID NO: 123630 - DNA, 25 bp, Rattus norvegicus
agcaccactacattgttcacctgaa

SEQ ID NO: 123631 - DNA, 25 bp, Rattus norvegicus
agcaccactcggaagatgctgctgt

SEQ ID NO: 123632 - DNA, 25 bp, Rattus norvegicus
agcaccactcggtagatgctgctgt

SEQ ID NO: 123633 - DNA, 25 bp, Rattus norvegicus
agcaccactgacagtccaatctagg

SEQ ID NO: 123634 - DNA, 25 bp, Rattus norvegicus
agcaccactgactgtccaatctagg

SEQ ID NO: 123635 - DNA, 25 bp, Rattus norvegicus
agcaccactgagagatctgtgcagg

SEQ ID NO: 123636 - DNA, 25 bp, Rattus norvegicus
agcaccactgagctttggcgcgcag

SEQ ID NO: 123637 - DNA, 25 bp, Rattus norvegicus
agcaccactgaggtttggcgcgcag

SEQ ID NO: 123638 - DNA, 25 bp, Rattus norvegicus
agcaccactgagtgatctgtgcagg

SEQ ID NO: 123639 - DNA, 25 bp, Rattus norvegicus
agcaccactgcgagtacatactgta

SEQ ID NO: 123640 - DNA, 25 bp, Rattus norvegicus
agcaccactgcgtgtacatactgta

SEQ ID NO: 123641 - DNA, 25 bp, Rattus norvegicus
agcaccacttagagccaacgacatt

SEQ ID NO: 123642 - DNA, 25 bp, Rattus norvegicus
agcaccacttagtgccaacgacatt

SEQ ID NO: 123643 - DNA, 25 bp, Rattus norvegicus
agcaccacttctcttttccaaatga

SEQ ID NO: 123644 - DNA, 25 bp, Rattus norvegicus
agcaccacttctgttttccaaatga

SEQ ID NO: 123645 - DNA, 25 bp, Rattus norvegicus
agcaccacttgcaactggagaggat

SEQ ID NO: 123646 - DNA, 25 bp, Rattus norvegicus
agcaccacttgctactggagaggat

SEQ ID NO: 123647 - DNA, 25 bp, Rattus norvegicus
agcaccagactgaggtctaccagat

SEQ ID NO: 123648 - DNA, 25 bp, Rattus norvegicus
agcaccagactgtggtctaccagat

SEQ ID NO: 123649 - DNA, 25 bp, Rattus norvegicus
agcaccagagccacttgggcaatat

SEQ ID NO: 123650 - DNA, 25 bp, Rattus norvegicus
agcaccagagcctcttgggcaatat

SEQ ID NO: 123651 - DNA, 25 bp, Rattus norvegicus
agcaccagaggcacggagcacggca

SEQ ID NO: 123652 - DNA, 25 bp, Rattus norvegicus
agcaccagaggctcggagcacggca

SEQ ID NO: 123653 - DNA, 25 bp, Rattus norvegicus
agcaccagatttcctcgcggcagac

SEQ ID NO: 123654 - DNA, 25 bp, Rattus norvegicus
agcaccagatttgctcgcggcagac

SEQ ID NO: 123655 - DNA, 25 bp, Rattus norvegicus
agcaccagcacacccagtgtgcaaa

SEQ ID NO: 123656 - DNA, 25 bp, Rattus norvegicus
agcaccagcacagccagtgtgcaaa

SEQ ID NO: 123657 - DNA, 25 bp, Rattus norvegicus
agcaccagcatccagtacagagcct

SEQ ID NO: 123658 - DNA, 25 bp, Rattus norvegicus
agcaccagcatcgagtacagagcct

SEQ ID NO: 123659 - DNA, 25 bp, Rattus norvegicus
agcaccagcggaaccacacgggcga

SEQ ID NO: 123660 - DNA, 25 bp, Rattus norvegicus
agcaccagcggatccacacgggcga

SEQ ID NO: 123661 - DNA, 25 bp, Rattus norvegicus
agcaccagcggcatcgcgacggcgg

SEQ ID NO: 123662 - DNA, 25 bp, Rattus norvegicus
agcaccagcggcttcgcgacggcgg

SEQ ID NO: 123663 - DNA, 25 bp, Rattus norvegicus
agcaccagcgggaagatcacctttg

SEQ ID NO: 123664 - DNA, 25 bp, Rattus norvegicus
agcaccagcgggtagatcacctttg

SEQ ID NO: 123665 - DNA, 25 bp, Rattus norvegicus
agcaccagctatcgttaaccgccaa

SEQ ID NO: 123666 - DNA, 25 bp, Rattus norvegicus
agcaccagctatggttaaccgccaa

SEQ ID NO: 123667 - DNA, 25 bp, Rattus norvegicus
agcaccagctgcacaagcaccatgg

SEQ ID NO: 123668 - DNA, 25 bp, Rattus norvegicus
agcaccagctgctcaagcaccatgg

SEQ ID NO: 123669 - DNA, 25 bp, Rattus norvegicus
agcaccaggactatgtgaagcgcat

SEQ ID NO: 123670 - DNA, 25 bp, Rattus norvegicus
agcaccaggactttgtgaagcgcat

SEQ ID NO: 123671 - DNA, 25 bp, Rattus norvegicus
agcaccaggattatcttacacggat

SEQ ID NO: 123672 - DNA, 25 bp, Rattus norvegicus
agcaccaggattttcttacacggat

SEQ ID NO: 123673 - DNA, 25 bp, Rattus norvegicus
agcaccagggaacgaagcagatgat

SEQ ID NO: 123674 - DNA, 25 bp, Rattus norvegicus
agcaccagggaaggaagcagatgat

SEQ ID NO: 123675 - DNA, 25 bp, Rattus norvegicus
agcaccagtgagatcttagcctcta

SEQ ID NO: 123676 - DNA, 25 bp, Rattus norvegicus
agcaccagtgagttcttagcctcta

SEQ ID NO: 123677 - DNA, 25 bp, Rattus norvegicus
agcaccagttatcagtccttacatt

SEQ ID NO: 123678 - DNA, 25 bp, Rattus norvegicus
agcaccagttatgagtccttacatt

SEQ ID NO: 123679 - DNA, 25 bp, Rattus norvegicus
agcaccataagaataaagcctcagt

SEQ ID NO: 123680 - DNA, 25 bp, Rattus norvegicus
agcaccataagattaaagcctcagt

SEQ ID NO: 123681 - DNA, 25 bp, Rattus norvegicus
agcaccatatctcacatctttgttc

SEQ ID NO: 123682 - DNA, 25 bp, Rattus norvegicus
agcaccatatctgacatctttgttc

SEQ ID NO: 123683 - DNA, 25 bp, Rattus norvegicus
agcaccatcacacaactgttcaaga

SEQ ID NO: 123684 - DNA, 25 bp, Rattus norvegicus
agcaccatcacagaactgttcaaga

SEQ ID NO: 123685 - DNA, 25 bp, Rattus norvegicus
agcaccatcagaatctgtccctctg

SEQ ID NO: 123686 - DNA, 25 bp, Rattus norvegicus
agcaccatcagattctgtccctctg

SEQ ID NO: 123687 - DNA, 25 bp, Rattus norvegicus
agcaccatccacatccagggcagtg

SEQ ID NO: 123688 - DNA, 25 bp, Rattus norvegicus
agcaccatccacttccagggcagtg

SEQ ID NO: 123689 - DNA, 25 bp, Rattus norvegicus
agcaccatccgacatgtgtctctga

SEQ ID NO: 123690 - DNA, 25 bp, Rattus norvegicus
agcaccatccgagatgtgtctctga

SEQ ID NO: 123691 - DNA, 25 bp, Rattus norvegicus
agcaccatgcttaccaaaagactcc

SEQ ID NO: 123692 - DNA, 25 bp, Rattus norvegicus
agcaccatgctttccaaaagactcc

SEQ ID NO: 123693 - DNA, 25 bp, Rattus norvegicus
agcaccatggcgatccagaacgcgc

SEQ ID NO: 123694 - DNA, 25 bp, Rattus norvegicus
agcaccatggcgttccagaacgcgc

SEQ ID NO: 123695 - DNA, 25 bp, Rattus norvegicus
agcaccatggtgcacactcaggact

SEQ ID NO: 123696 - DNA, 25 bp, Rattus norvegicus
agcaccatggtggacactcaggact

SEQ ID NO: 123697 - DNA, 25 bp, Rattus norvegicus
agcaccatggttaaaggcctctttg

SEQ ID NO: 123698 - DNA, 25 bp, Rattus norvegicus
agcaccatggtttaaggcctctttg

SEQ ID NO: 123699 - DNA, 25 bp, Rattus norvegicus
agcaccattaagacttttgtcaagg

SEQ ID NO: 123700 - DNA, 25 bp, Rattus norvegicus
agcaccattaagtcttttgtcaagg

SEQ ID NO: 123701 - DNA, 25 bp, Rattus norvegicus
agcaccattctgacaacaagtttca

SEQ ID NO: 123702 - DNA, 25 bp, Rattus norvegicus
agcaccattctgtcaacaagtttca

SEQ ID NO: 123703 - DNA, 25 bp, Rattus norvegicus
agcaccattgatactgcctggaaat

SEQ ID NO: 123704 - DNA, 25 bp, Rattus norvegicus
agcaccattgattctgcctggaaat

SEQ ID NO: 123705 - DNA, 25 bp, Rattus norvegicus
agcaccatttgcagttgtctgcaga

SEQ ID NO: 123706 - DNA, 25 bp, Rattus norvegicus
agcaccatttgctgttgtctgcaga

SEQ ID NO: 123707 - DNA, 25 bp, Rattus norvegicus
agcacccaactcattatgcacggag

SEQ ID NO: 123708 - DNA, 25 bp, Rattus norvegicus
agcacccaactctttatgcacggag

SEQ ID NO: 123709 - DNA, 25 bp, Rattus norvegicus
agcacccaagcacagagcgcaagag

SEQ ID NO: 123710 - DNA, 25 bp, Rattus norvegicus
agcacccaagcagagagcgcaagag

SEQ ID NO: 123711 - DNA, 25 bp, Rattus norvegicus
agcacccaatgaaaaacttcacatt

SEQ ID NO: 123712 - DNA, 25 bp, Rattus norvegicus
agcacccaatgataaacttcacatt

SEQ ID NO: 123713 - DNA, 25 bp, Rattus norvegicus
agcacccaattcagagactttgcac

SEQ ID NO: 123714 - DNA, 25 bp, Rattus norvegicus
agcacccaattctgagactttgcac

SEQ ID NO: 123715 - DNA, 25 bp, Rattus norvegicus
agcacccacatgctgtccacatgtt

SEQ ID NO: 123716 - DNA, 25 bp, Rattus norvegicus
agcacccacatggtgtccacatgtt

SEQ ID NO: 123717 - DNA, 25 bp, Rattus norvegicus
agcacccacggtccatggtgtttgg

SEQ ID NO: 123718 - DNA, 25 bp, Rattus norvegicus
agcacccacggtgcatggtgtttgg

SEQ ID NO: 123719 - DNA, 25 bp, Rattus norvegicus
agcacccacttgactacttaacaac

SEQ ID NO: 123720 - DNA, 25 bp, Rattus norvegicus
agcacccacttgtctacttaacaac

SEQ ID NO: 123721 - DNA, 25 bp, Rattus norvegicus
agcacccagactacctgcaggaata

SEQ ID NO: 123722 - DNA, 25 bp, Rattus norvegicus
agcacccagacttcctgcaggaata

SEQ ID NO: 123723 - DNA, 25 bp, Rattus norvegicus
agcacccagagcagcgcgaagcaca

SEQ ID NO: 123724 - DNA, 25 bp, Rattus norvegicus
agcacccagagctgcgcgaagcaca

SEQ ID NO: 123725 - DNA, 25 bp, Rattus norvegicus
agcacccaggcacttcggagacttc

SEQ ID NO: 123726 - DNA, 25 bp, Rattus norvegicus
agcacccaggcagttcggagacttc

SEQ ID NO: 123727 - DNA, 25 bp, Rattus norvegicus
agcacccaggctaaccatttagttg

SEQ ID NO: 123728 - DNA, 25 bp, Rattus norvegicus
agcacccaggcttaccatttagttg

SEQ ID NO: 123729 - DNA, 25 bp, Rattus norvegicus
agcacccagggcattgtgacagtct

SEQ ID NO: 123730 - DNA, 25 bp, Rattus norvegicus
agcacccagggctttgtgacagtct

SEQ ID NO: 123731 - DNA, 25 bp, Rattus norvegicus
agcacccagtatccgtgaaggcctt

SEQ ID NO: 123732 - DNA, 25 bp, Rattus norvegicus
agcacccagtatgcgtgaaggcctt

SEQ ID NO: 123733 - DNA, 25 bp, Rattus norvegicus
agcacccagtggatgaacgacccag

SEQ ID NO: 123734 - DNA, 25 bp, Rattus norvegicus
agcacccagtggttgaacgacccag

SEQ ID NO: 123735 - DNA, 25 bp, Rattus norvegicus
agcacccatgaaccgaggagccgga

SEQ ID NO: 123736 - DNA, 25 bp, Rattus norvegicus
agcacccatgaagcgaggagccgga

SEQ ID NO: 123737 - DNA, 25 bp, Rattus norvegicus
agcacccatgggaaaggataggttt

SEQ ID NO: 123738 - DNA, 25 bp, Rattus norvegicus
agcacccatgggtaaggataggttt

SEQ ID NO: 123739 - DNA, 25 bp, Rattus norvegicus
agcaccccactgagtggagcggaga

SEQ ID NO: 123740 - DNA, 25 bp, Rattus norvegicus
agcaccccactgtgtggagcggaga

SEQ ID NO: 123741 - DNA, 25 bp, Rattus norvegicus
agcaccccggcacaaagtccaagaa

SEQ ID NO: 123742 - DNA, 25 bp, Rattus norvegicus
agcaccccggcagaaagtccaagaa

SEQ ID NO: 123743 - DNA, 25 bp, Rattus norvegicus
agcacccctagcaccaggatggacg

SEQ ID NO: 123744 - DNA, 25 bp, Rattus norvegicus
agcacccctagctccaggatggacg

SEQ ID NO: 123745 - DNA, 25 bp, Rattus norvegicus
agcacccctgaaaccaacagagtat

SEQ ID NO: 123746 - DNA, 25 bp, Rattus norvegicus
agcacccctgaatccaacagagtat

SEQ ID NO: 123747 - DNA, 25 bp, Rattus norvegicus
agcacccctggtatggaatggaaca

SEQ ID NO: 123748 - DNA, 25 bp, Rattus norvegicus
agcacccctggtttggaatggaaca

SEQ ID NO: 123749 - DNA, 25 bp, Rattus norvegicus
agcacccgaatcactcgaagccagc

SEQ ID NO: 123750 - DNA, 25 bp, Rattus norvegicus
agcacccgaatctctcgaagccagc

SEQ ID NO: 123751 - DNA, 25 bp, Rattus norvegicus
agcacccgaggtatgcagccaaaaa

SEQ ID NO: 123752 - DNA, 25 bp, Rattus norvegicus
agcacccgaggtttgcagccaaaaa

SEQ ID NO: 123753 - DNA, 25 bp, Rattus norvegicus
agcacccgcagtcgccgttgaagaa

SEQ ID NO: 123754 - DNA, 25 bp, Rattus norvegicus
agcacccgcagtggccgttgaagaa

SEQ ID NO: 123755 - DNA, 25 bp, Rattus norvegicus
agcacccgcctgaaaacatcattga

SEQ ID NO: 123756 - DNA, 25 bp, Rattus norvegicus
agcacccgcctgtaaacatcattga

SEQ ID NO: 123757 - DNA, 25 bp, Rattus norvegicus
agcacccggatacgcctggaagata

SEQ ID NO: 123758 - DNA, 25 bp, Rattus norvegicus
agcacccggataggcctggaagata

SEQ ID NO: 123759 - DNA, 25 bp, Rattus norvegicus
agcacccgttgtcagagcacagttg

SEQ ID NO: 123760 - DNA, 25 bp, Rattus norvegicus
agcacccgttgtgagagcacagttg

SEQ ID NO: 123761 - DNA, 25 bp, Rattus norvegicus
agcacccgtttgataagagcgccaa

SEQ ID NO: 123762 - DNA, 25 bp, Rattus norvegicus
agcacccgtttgttaagagcgccaa

SEQ ID NO: 123763 - DNA, 25 bp, Rattus norvegicus
agcaccctatacctgcaaatggaca

SEQ ID NO: 123764 - DNA, 25 bp, Rattus norvegicus
agcaccctatacgtgcaaatggaca

SEQ ID NO: 123765 - DNA, 25 bp, Rattus norvegicus
agcaccctcagaatagaccctatta

SEQ ID NO: 123766 - DNA, 25 bp, Rattus norvegicus
agcaccctcagactctctttttggg

SEQ ID NO: 123767 - DNA, 25 bp, Rattus norvegicus
agcaccctcagagtctctttttggg

SEQ ID NO: 123768 - DNA, 25 bp, Rattus norvegicus
agcaccctcagattagaccctatta

SEQ ID NO: 123769 - DNA, 25 bp, Rattus norvegicus
agcaccctctgtaagcactgcaata

SEQ ID NO: 123770 - DNA, 25 bp, Rattus norvegicus
agcaccctctgttagcactgcaata

SEQ ID NO: 123771 - DNA, 25 bp, Rattus norvegicus
agcaccctcttgcaggcatgggaga

SEQ ID NO: 123772 - DNA, 25 bp, Rattus norvegicus
agcaccctcttggaggcatgggaga

SEQ ID NO: 123773 - DNA, 25 bp, Rattus norvegicus
agcaccctgacgctgagcaaagcag

SEQ ID NO: 123774 - DNA, 25 bp, Rattus norvegicus
agcaccctgacggtgagcaaagcag

SEQ ID NO: 123775 - DNA, 25 bp, Rattus norvegicus
agcaccctgcgtacatctagtaaag

SEQ ID NO: 123776 - DNA, 25 bp, Rattus norvegicus
agcaccctgcgttcatctagtaaag

SEQ ID NO: 123777 - DNA, 25 bp, Rattus norvegicus
agcaccctggtcaccaagatcctgg

SEQ ID NO: 123778 - DNA, 25 bp, Rattus norvegicus
agcaccctggtctccaagatcctgg

SEQ ID NO: 123779 - DNA, 25 bp, Rattus norvegicus
agcaccctggtgcagatgttcatag

SEQ ID NO: 123780 - DNA, 25 bp, Rattus norvegicus
agcaccctggtggagatgttcatag

SEQ ID NO: 123781 - DNA, 25 bp, Rattus norvegicus
agcaccctgtctctgagcgggcagc

SEQ ID NO: 123782 - DNA, 25 bp, Rattus norvegicus
agcaccctgtctgtgagcgggcagc

SEQ ID NO: 123783 - DNA, 25 bp, Rattus norvegicus
agcacccttgctctgggccaaaggt

SEQ ID NO: 123784 - DNA, 25 bp, Rattus norvegicus
agcacccttgctgtgggccaaaggt

SEQ ID NO: 123785 - DNA, 25 bp, Rattus norvegicus
agcaccctttgaaagctgctcattg

SEQ ID NO: 123786 - DNA, 25 bp, Rattus norvegicus
agcaccctttgatagctgctcattg

SEQ ID NO: 123787 - DNA, 25 bp, Rattus norvegicus
agcaccctttgcagaatacacagaa

SEQ ID NO: 123788 - DNA, 25 bp, Rattus norvegicus
agcaccctttgctgaatacacagaa

SEQ ID NO: 123789 - DNA, 25 bp, Rattus norvegicus
agcaccgaacctcatgttaccgatg

SEQ ID NO: 123790 - DNA, 25 bp, Rattus norvegicus
agcaccgaacctgatgttaccgatg

SEQ ID NO: 123791 - DNA, 25 bp, Rattus norvegicus
agcaccgacaccatattgaattcca

SEQ ID NO: 123792 - DNA, 25 bp, Rattus norvegicus
agcaccgacaccttattgaattcca

SEQ ID NO: 123793 - DNA, 25 bp, Rattus norvegicus
agcaccgacatgacagttgacaact

SEQ ID NO: 123794 - DNA, 25 bp, Rattus norvegicus
agcaccgacatgtcagttgacaact

SEQ ID NO: 123795 - DNA, 25 bp, Rattus norvegicus
agcaccgagtctctgacatgttcgt

SEQ ID NO: 123796 - DNA, 25 bp, Rattus norvegicus
agcaccgagtctgtgacatgttcgt

SEQ ID NO: 123797 - DNA, 25 bp, Rattus norvegicus
agcaccgataaacccgtgtacagtt

SEQ ID NO: 123798 - DNA, 25 bp, Rattus norvegicus
agcaccgataaagccgtgtacagtt

SEQ ID NO: 123799 - DNA, 25 bp, Rattus norvegicus
agcaccgatctgcatgtacatctct

SEQ ID NO: 123800 - DNA, 25 bp, Rattus norvegicus
agcaccgatctggatgtacatctct

SEQ ID NO: 123801 - DNA, 25 bp, Rattus norvegicus
agcaccgcctgtcagtctatccagg

SEQ ID NO: 123802 - DNA, 25 bp, Rattus norvegicus
agcaccgcctgtgagtctatccagg

SEQ ID NO: 123803 - DNA, 25 bp, Rattus norvegicus
agcaccgcgcttaggtagcgattag

SEQ ID NO: 123804 - DNA, 25 bp, Rattus norvegicus
agcaccgcgctttggtagcgattag

SEQ ID NO: 123805 - DNA, 25 bp, Rattus norvegicus
agcaccgctttcatctgatttagac

SEQ ID NO: 123806 - DNA, 25 bp, Rattus norvegicus
agcaccgctttcttctgatttagac

SEQ ID NO: 123807 - DNA, 25 bp, Rattus norvegicus
agcaccggatctcggcactatggaa

SEQ ID NO: 123808 - DNA, 25 bp, Rattus norvegicus
agcaccggatctgggcactatggaa

SEQ ID NO: 123809 - DNA, 25 bp, Rattus norvegicus
agcaccggctgtaagttcaactgag

SEQ ID NO: 123810 - DNA, 25 bp, Rattus norvegicus
agcaccggctgttagttcaactgag

SEQ ID NO: 123811 - DNA, 25 bp, Rattus norvegicus
agcaccgggcctcagagtttagttt

SEQ ID NO: 123812 - DNA, 25 bp, Rattus norvegicus
agcaccgggcctgagagtttagttt

SEQ ID NO: 123813 - DNA, 25 bp, Rattus norvegicus
agcaccgtacgtaatggagacccag

SEQ ID NO: 123814 - DNA, 25 bp, Rattus norvegicus
agcaccgtacgttatggagacccag

SEQ ID NO: 123815 - DNA, 25 bp, Rattus norvegicus
agcaccgtagtactcaccaagtttt

SEQ ID NO: 123816 - DNA, 25 bp, Rattus norvegicus
agcaccgtagtagtcaccaagtttt

SEQ ID NO: 123817 - DNA, 25 bp, Rattus norvegicus
agcaccgtcgacatgtgacccgcag

SEQ ID NO: 123818 - DNA, 25 bp, Rattus norvegicus
agcaccgtcgacttgtgacccgcag

SEQ ID NO: 123819 - DNA, 25 bp, Rattus norvegicus
agcaccgtctccatctatcagaaga

SEQ ID NO: 123820 - DNA, 25 bp, Rattus norvegicus
agcaccgtctccttctatcagaaga

SEQ ID NO: 123821 - DNA, 25 bp, Rattus norvegicus
agcaccgtgctgagacagaggctat

SEQ ID NO: 123822 - DNA, 25 bp, Rattus norvegicus
agcaccgtgctgtgacagaggctat

SEQ ID NO: 123823 - DNA, 25 bp, Rattus norvegicus
agcaccgtgtctctggcctgccaga

SEQ ID NO: 123824 - DNA, 25 bp, Rattus norvegicus
agcaccgtgtctgtggcctgccaga

SEQ ID NO: 123825 - DNA, 25 bp, Rattus norvegicus
agcaccgttccaacgctaattttaa

SEQ ID NO: 123826 - DNA, 25 bp, Rattus norvegicus
agcaccgttccatcgctaattttaa

SEQ ID NO: 123827 - DNA, 25 bp, Rattus norvegicus
agcaccgtttgtcaaagaagccttt

SEQ ID NO: 123828 - DNA, 25 bp, Rattus norvegicus
agcaccgtttgtgaaagaagccttt

SEQ ID NO: 123829 - DNA, 25 bp, Rattus norvegicus
agcacctacaacaaggacttacagg

SEQ ID NO: 123830 - DNA, 25 bp, Rattus norvegicus
agcacctacaactaggacttacagg

SEQ ID NO: 123831 - DNA, 25 bp, Rattus norvegicus
agcacctacacactaagtttccaga

SEQ ID NO: 123832 - DNA, 25 bp, Rattus norvegicus
agcacctacacagtaagtttccaga

SEQ ID NO: 123833 - DNA, 25 bp, Rattus norvegicus
agcacctaccctccctggagagttg

SEQ ID NO: 123834 - DNA, 25 bp, Rattus norvegicus
agcacctaccctgcctggagagttg

SEQ ID NO: 123835 - DNA, 25 bp, Rattus norvegicus
agcacctaggtcatcagctatttgg

SEQ ID NO: 123836 - DNA, 25 bp, Rattus norvegicus
agcacctaggtcttcagctatttgg

SEQ ID NO: 123837 - DNA, 25 bp, Rattus norvegicus
agcacctagtcacatgctctcttaa

SEQ ID NO: 123838 - DNA, 25 bp, Rattus norvegicus
agcacctagtcagatgctctcttaa

SEQ ID NO: 123839 - DNA, 25 bp, Rattus norvegicus
agcacctagttcactcatagtctac

SEQ ID NO: 123840 - DNA, 25 bp, Rattus norvegicus
agcacctagttctctcatagtctac

SEQ ID NO: 123841 - DNA, 25 bp, Rattus norvegicus
agcacctataccaacatcattcagt

SEQ ID NO: 123842 - DNA, 25 bp, Rattus norvegicus
agcacctatacctacatcattcagt

SEQ ID NO: 123843 - DNA, 25 bp, Rattus norvegicus
agcacctattttcactccattttat

SEQ ID NO: 123844 - DNA, 25 bp, Rattus norvegicus
agcacctattttctactgattctac

SEQ ID NO: 123845 - DNA, 25 bp, Rattus norvegicus
agcacctattttgactccattttat

SEQ ID NO: 123846 - DNA, 25 bp, Rattus norvegicus
agcacctattttgtactgattctac

SEQ ID NO: 123847 - DNA, 25 bp, Rattus norvegicus
agcacctcacagcattcatcacatt

SEQ ID NO: 123848 - DNA, 25 bp, Rattus norvegicus
agcacctcacagctgttcaggttgt

SEQ ID NO: 123849 - DNA, 25 bp, Rattus norvegicus
agcacctcacaggattcatcacatt

SEQ ID NO: 123850 - DNA, 25 bp, Rattus norvegicus
agcacctcacaggtgttcaggttgt

SEQ ID NO: 123851 - DNA, 25 bp, Rattus norvegicus
agcacctcagctcctggttcaggct

SEQ ID NO: 123852 - DNA, 25 bp, Rattus norvegicus
agcacctcagctgctggttcaggct

SEQ ID NO: 123853 - DNA, 25 bp, Rattus norvegicus
agcacctccaagctctaatcatgag

SEQ ID NO: 123854 - DNA, 25 bp, Rattus norvegicus
agcacctccaaggtctaatcatgag

SEQ ID NO: 123855 - DNA, 25 bp, Rattus norvegicus
agcacctccacacgcttttgattaa

SEQ ID NO: 123856 - DNA, 25 bp, Rattus norvegicus
agcacctccacaggcttttgattaa

SEQ ID NO: 123857 - DNA, 25 bp, Rattus norvegicus
agcacctcccgaagctagagtgagt

SEQ ID NO: 123858 - DNA, 25 bp, Rattus norvegicus
agcacctcccgatgctagagtgagt

SEQ ID NO: 123859 - DNA, 25 bp, Rattus norvegicus
agcacctcgccgacggagaagacca

SEQ ID NO: 123860 - DNA, 25 bp, Rattus norvegicus
agcacctcgccgtcggagaagacca

SEQ ID NO: 123861 - DNA, 25 bp, Rattus norvegicus
agcacctcgtatcgctcaatcacag

SEQ ID NO: 123862 - DNA, 25 bp, Rattus norvegicus
agcacctcgtatggctcaatcacag

SEQ ID NO: 123863 - DNA, 25 bp, Rattus norvegicus
agcacctcgttcaattgcaaactga

SEQ ID NO: 123864 - DNA, 25 bp, Rattus norvegicus
agcacctcgttctattgcaaactga

SEQ ID NO: 123865 - DNA, 25 bp, Rattus norvegicus
agcacctctcttagctctaagaaag

SEQ ID NO: 123866 - DNA, 25 bp, Rattus norvegicus
agcacctctctttgctctaagaaag

SEQ ID NO: 123867 - DNA, 25 bp, Rattus norvegicus
agcacctctgagatgtttggcaaga

SEQ ID NO: 123868 - DNA, 25 bp, Rattus norvegicus
agcacctctgagttgtttggcaaga

SEQ ID NO: 123869 - DNA, 25 bp, Rattus norvegicus
agcacctctgatcacactggactca

SEQ ID NO: 123870 - DNA, 25 bp, Rattus norvegicus
agcacctctgatgacactggactca

SEQ ID NO: 123871 - DNA, 25 bp, Rattus norvegicus
agcacctcttcaatagtttccaatg

SEQ ID NO: 123872 - DNA, 25 bp, Rattus norvegicus
agcacctcttcattagtttccaatg

SEQ ID NO: 123873 - DNA, 25 bp, Rattus norvegicus
agcacctgaaataaactggcctttt

SEQ ID NO: 123874 - DNA, 25 bp, Rattus norvegicus
agcacctgaaattaactggcctttt

SEQ ID NO: 123875 - DNA, 25 bp, Rattus norvegicus
agcacctgacaccactagtgttttt

SEQ ID NO: 123876 - DNA, 25 bp, Rattus norvegicus
agcacctgacacgactagtgttttt

SEQ ID NO: 123877 - DNA, 25 bp, Rattus norvegicus
agcacctgactcaagttttgttaca

SEQ ID NO: 123878 - DNA, 25 bp, Rattus norvegicus
agcacctgactctagttttgttaca

SEQ ID NO: 123879 - DNA, 25 bp, Rattus norvegicus
agcacctgaggcagccaggctcggt

SEQ ID NO: 123880 - DNA, 25 bp, Rattus norvegicus
agcacctgaggctgccaggctcggt

SEQ ID NO: 123881 - DNA, 25 bp, Rattus norvegicus
agcacctgaggtcgctacagtagtc

SEQ ID NO: 123882 - DNA, 25 bp, Rattus norvegicus
agcacctgaggtggctacagtagtc

SEQ ID NO: 123883 - DNA, 25 bp, Rattus norvegicus
agcacctgatggaactttctccaca

SEQ ID NO: 123884 - DNA, 25 bp, Rattus norvegicus
agcacctgatggtactttctccaca

SEQ ID NO: 123885 - DNA, 25 bp, Rattus norvegicus
agcacctgcgtcagcacagtggatt

SEQ ID NO: 123886 - DNA, 25 bp, Rattus norvegicus
agcacctgcgtctgcacagtggatt

SEQ ID NO: 123887 - DNA, 25 bp, Rattus norvegicus
agcacctgctgccacatgttaatga

SEQ ID NO: 123888 - DNA, 25 bp, Rattus norvegicus
agcacctgctgcgacatgttaatga

SEQ ID NO: 123889 - DNA, 25 bp, Rattus norvegicus
agcacctgctgtacttgccgaggac

SEQ ID NO: 123890 - DNA, 25 bp, Rattus norvegicus
agcacctgctgttcttgccgaggac

SEQ ID NO: 123891 - DNA, 25 bp, Rattus norvegicus
agcacctgctttacctgcaagagat

SEQ ID NO: 123892 - DNA, 25 bp, Rattus norvegicus
agcacctgctttatgtttcctgtaa

SEQ ID NO: 123893 - DNA, 25 bp, Rattus norvegicus
agcacctgcttttcctgcaagagat

SEQ ID NO: 123894 - DNA, 25 bp, Rattus norvegicus
agcacctgctttttgtttcctgtaa

SEQ ID NO: 123895 - DNA, 25 bp, Rattus norvegicus
agcacctggacacgattcctgaaga

SEQ ID NO: 123896 - DNA, 25 bp, Rattus norvegicus
agcacctggacaggattcctgaaga

SEQ ID NO: 123897 - DNA, 25 bp, Rattus norvegicus
agcacctgggagacaaacagtgtat

SEQ ID NO: 123898 - DNA, 25 bp, Rattus norvegicus
agcacctgggagtcaaacagtgtat

SEQ ID NO: 123899 - DNA, 25 bp, Rattus norvegicus
agcacctgggctacagagttcagtt

SEQ ID NO: 123900 - DNA, 25 bp, Rattus norvegicus
agcacctgggcttcagagttcagtt

SEQ ID NO: 123901 - DNA, 25 bp, Rattus norvegicus
agcacctggtctcaaatgtctgatg

SEQ ID NO: 123902 - DNA, 25 bp, Rattus norvegicus
agcacctggtctcgagcgactagaa

SEQ ID NO: 123903 - DNA, 25 bp, Rattus norvegicus
agcacctggtctgaaatgtctgatg

SEQ ID NO: 123904 - DNA, 25 bp, Rattus norvegicus
agcacctggtctggagcgactagaa

SEQ ID NO: 123905 - DNA, 25 bp, Rattus norvegicus
agcacctggtgaagacagcctccag

SEQ ID NO: 123906 - DNA, 25 bp, Rattus norvegicus
agcacctggtgatgacagcctccag

SEQ ID NO: 123907 - DNA, 25 bp, Rattus norvegicus
agcacctgtaccaagccctcacagt

SEQ ID NO: 123908 - DNA, 25 bp, Rattus norvegicus
agcacctgtacctagccctcacagt

SEQ ID NO: 123909 - DNA, 25 bp, Rattus norvegicus
agcacctgtcctagttacgctggat

SEQ ID NO: 123910 - DNA, 25 bp, Rattus norvegicus
agcacctgtccttgttacgctggat

SEQ ID NO: 123911 - DNA, 25 bp, Rattus norvegicus
agcacctgtgtcacctagccgaggc

SEQ ID NO: 123912 - DNA, 25 bp, Rattus norvegicus
agcacctgtgtctcctagccgaggc

SEQ ID NO: 123913 - DNA, 25 bp, Rattus norvegicus
agcacctgtgtgcagacttaagtgg

SEQ ID NO: 123914 - DNA, 25 bp, Rattus norvegicus
agcacctgtgtggagacttaagtgg

SEQ ID NO: 123915 - DNA, 25 bp, Rattus norvegicus
agcacctgtgttattctctttctaa

SEQ ID NO: 123916 - DNA, 25 bp, Rattus norvegicus
agcacctgtgtttttctctttctaa

SEQ ID NO: 123917 - DNA, 25 bp, Rattus norvegicus
agcacctgtttaagattctggcctc

SEQ ID NO: 123918 - DNA, 25 bp, Rattus norvegicus
agcacctgtttatgattctggcctc

SEQ ID NO: 123919 - DNA, 25 bp, Rattus norvegicus
agcaccttaaaacccattgtctgtc

SEQ ID NO: 123920 - DNA, 25 bp, Rattus norvegicus
agcaccttaaaagccattgtctgtc

SEQ ID NO: 123921 - DNA, 25 bp, Rattus norvegicus
agcaccttaccaatcaaacaatctc

SEQ ID NO: 123922 - DNA, 25 bp, Rattus norvegicus
agcaccttaccattcaaacaatctc

SEQ ID NO: 123923 - DNA, 25 bp, Rattus norvegicus
agcaccttccacaccattggagaaa

SEQ ID NO: 123924 - DNA, 25 bp, Rattus norvegicus
agcaccttccactccattggagaaa

SEQ ID NO: 123925 - DNA, 25 bp, Rattus norvegicus
agcaccttccctcgcaggagtggca

SEQ ID NO: 123926 - DNA, 25 bp, Rattus norvegicus
agcaccttccctggcaggagtggca

SEQ ID NO: 123927 - DNA, 25 bp, Rattus norvegicus
agcaccttccttatcttacttgtat

SEQ ID NO: 123928 - DNA, 25 bp, Rattus norvegicus
agcaccttccttttcttacttgtat

SEQ ID NO: 123929 - DNA, 25 bp, Rattus norvegicus
agcaccttcgtgaggcagcgcatga

SEQ ID NO: 123930 - DNA, 25 bp, Rattus norvegicus
agcaccttcgtgtggcagcgcatga

SEQ ID NO: 123931 - DNA, 25 bp, Rattus norvegicus
agcaccttctctccttatgagggag

SEQ ID NO: 123932 - DNA, 25 bp, Rattus norvegicus
agcaccttctctgcttatgagggag

SEQ ID NO: 123933 - DNA, 25 bp, Rattus norvegicus
agcaccttctgcaggtttcctgtct

SEQ ID NO: 123934 - DNA, 25 bp, Rattus norvegicus
agcaccttctgctggtttcctgtct

SEQ ID NO: 123935 - DNA, 25 bp, Rattus norvegicus
agcaccttctggctggacttcttca

SEQ ID NO: 123936 - DNA, 25 bp, Rattus norvegicus
agcaccttctgggtggacttcttca

SEQ ID NO: 123937 - DNA, 25 bp, Rattus norvegicus
agcaccttgtgcagtggaaataact

SEQ ID NO: 123938 - DNA, 25 bp, Rattus norvegicus
agcaccttgtgctgtggaaataact

SEQ ID NO: 123939 - DNA, 25 bp, Rattus norvegicus
agcaccttgtggagtctgtttccta

SEQ ID NO: 123940 - DNA, 25 bp, Rattus norvegicus
agcaccttgtggtgtctgtttccta

SEQ ID NO: 123941 - DNA, 25 bp, Rattus norvegicus
agcacctttgctctacataaaatga

SEQ ID NO: 123942 - DNA, 25 bp, Rattus norvegicus
agcacctttgctgtacataaaatga

SEQ ID NO: 123943 - DNA, 25 bp, Rattus norvegicus
agcacctttggaagttcctacgaag

SEQ ID NO: 123944 - DNA, 25 bp, Rattus norvegicus
agcacctttggatgttcctacgaag

SEQ ID NO: 123945 - DNA, 25 bp, Rattus norvegicus
agcacctttgttaactcagtttcct

SEQ ID NO: 123946 - DNA, 25 bp, Rattus norvegicus
agcacctttgtttactcagtttcct

SEQ ID NO: 123947 - DNA, 25 bp, Rattus norvegicus
agcaccttttgaaacgtacagcgcc

SEQ ID NO: 123948 - DNA, 25 bp, Rattus norvegicus
agcaccttttgatacgtacagcgcc

SEQ ID NO: 123949 - DNA, 25 bp, Rattus norvegicus
agcacgaacacgattgtcaggatat

SEQ ID NO: 123950 - DNA, 25 bp, Rattus norvegicus
agcacgaacacgtttgtcaggatat

SEQ ID NO: 123951 - DNA, 25 bp, Rattus norvegicus
agcacgaacgcccacagcactttga

SEQ ID NO: 123952 - DNA, 25 bp, Rattus norvegicus
agcacgaacgccgacagcactttga

SEQ ID NO: 123953 - DNA, 25 bp, Rattus norvegicus
agcacgaagaacctcatgcccaaag

SEQ ID NO: 123954 - DNA, 25 bp, Rattus norvegicus
agcacgaagaacgtcatgcccaaag

SEQ ID NO: 123955 - DNA, 25 bp, Rattus norvegicus
agcacgaaggctagtcttttccatg

SEQ ID NO: 123956 - DNA, 25 bp, Rattus norvegicus
agcacgaaggcttgtcttttccatg

SEQ ID NO: 123957 - DNA, 25 bp, Rattus norvegicus
agcacgacaaggaactgccttcgat

SEQ ID NO: 123958 - DNA, 25 bp, Rattus norvegicus
agcacgacaaggtactgccttcgat

SEQ ID NO: 123959 - DNA, 25 bp, Rattus norvegicus
agcacgacacatacattcctgtcag

SEQ ID NO: 123960 - DNA, 25 bp, Rattus norvegicus
agcacgacacattcattcctgtcag

SEQ ID NO: 123961 - DNA, 25 bp, Rattus norvegicus
agcacgagaagaagtgcccgctgct

SEQ ID NO: 123962 - DNA, 25 bp, Rattus norvegicus
agcacgagaagatgtgcccgctgct

SEQ ID NO: 123963 - DNA, 25 bp, Rattus norvegicus
agcacgagagacagatcgcgcgcgt

SEQ ID NO: 123964 - DNA, 25 bp, Rattus norvegicus
agcacgagagactgatcgcgcgcgt

SEQ ID NO: 123965 - DNA, 25 bp, Rattus norvegicus
agcacgaggcttaagagacaacaat

SEQ ID NO: 123966 - DNA, 25 bp, Rattus norvegicus
agcacgaggctttagagacaacaat

SEQ ID NO: 123967 - DNA, 25 bp, Rattus norvegicus
agcacgagtcccaggtagacagtgt

SEQ ID NO: 123968 - DNA, 25 bp, Rattus norvegicus
agcacgagtccctggtagacagtgt

SEQ ID NO: 123969 - DNA, 25 bp, Rattus norvegicus
agcacgatgaatccatgtttagcca

SEQ ID NO: 123970 - DNA, 25 bp, Rattus norvegicus
agcacgatgaatgcatgtttagcca

SEQ ID NO: 123971 - DNA, 25 bp, Rattus norvegicus
agcacgatgcggagagcgctgcctt

SEQ ID NO: 123972 - DNA, 25 bp, Rattus norvegicus
agcacgatgcggtgagcgctgcctt

SEQ ID NO: 123973 - DNA, 25 bp, Rattus norvegicus
agcacgatgcttacatggtctcaag

SEQ ID NO: 123974 - DNA, 25 bp, Rattus norvegicus
agcacgatgctttcatggtctcaag

SEQ ID NO: 123975 - DNA, 25 bp, Rattus norvegicus
agcacgcacctacgctctgggtgaa

SEQ ID NO: 123976 - DNA, 25 bp, Rattus norvegicus
agcacgcacctaggctctgggtgaa

SEQ ID NO: 123977 - DNA, 25 bp, Rattus norvegicus
agcacgcagatcagctggtctcaga

SEQ ID NO: 123978 - DNA, 25 bp, Rattus norvegicus
agcacgcagatctgctggtctcaga

SEQ ID NO: 123979 - DNA, 25 bp, Rattus norvegicus
agcacgcagccgcatatccagtgtg

SEQ ID NO: 123980 - DNA, 25 bp, Rattus norvegicus
agcacgcagccggatatccagtgtg

SEQ ID NO: 123981 - DNA, 25 bp, Rattus norvegicus
agcacgcataataacctatcttagt

SEQ ID NO: 123982 - DNA, 25 bp, Rattus norvegicus
agcacgcataattacctatcttagt

SEQ ID NO: 123983 - DNA, 25 bp, Rattus norvegicus
agcacgccagcgctgccaagtagga

SEQ ID NO: 123984 - DNA, 25 bp, Rattus norvegicus
agcacgccagcggtgccaagtagga

SEQ ID NO: 123985 - DNA, 25 bp, Rattus norvegicus
agcacgcctggtattccgggaggaa

SEQ ID NO: 123986 - DNA, 25 bp, Rattus norvegicus
agcacgcctggttttccgggaggaa

SEQ ID NO: 123987 - DNA, 25 bp, Rattus norvegicus
agcacgccttcgacttggtctttgg

SEQ ID NO: 123988 - DNA, 25 bp, Rattus norvegicus
agcacgccttcgtcttggtctttgg

SEQ ID NO: 123989 - DNA, 25 bp, Rattus norvegicus
agcacgcgagggactcccggagagg

SEQ ID NO: 123990 - DNA, 25 bp, Rattus norvegicus
agcacgcgagggtctcccggagagg

SEQ ID NO: 123991 - DNA, 25 bp, Rattus norvegicus
agcacgctcacccagtggaggcact

SEQ ID NO: 123992 - DNA, 25 bp, Rattus norvegicus
agcacgctcaccgagtggaggcact

SEQ ID NO: 123993 - DNA, 25 bp, Rattus norvegicus
agcacgctggagacacagctacaaa

SEQ ID NO: 123994 - DNA, 25 bp, Rattus norvegicus
agcacgctggagtcacagctacaaa

SEQ ID NO: 123995 - DNA, 25 bp, Rattus norvegicus
agcacgctggctaccaagggcagca

SEQ ID NO: 123996 - DNA, 25 bp, Rattus norvegicus
agcacgctggcttccaagggcagca

SEQ ID NO: 123997 - DNA, 25 bp, Rattus norvegicus
agcacgcttagcagacatcctggag

SEQ ID NO: 123998 - DNA, 25 bp, Rattus norvegicus
agcacgcttagctgacatcctggag

SEQ ID NO: 123999 - DNA, 25 bp, Rattus norvegicus
agcacgcttccaccttgcttcggag

SEQ ID NO: 124000 - DNA, 25 bp, Rattus norvegicus
agcacgcttccagcttgcttcggag

SEQ ID NO: 124001 - DNA, 25 bp, Rattus norvegicus
agcacgcttctaattcatgtacctg

SEQ ID NO: 124002 - DNA, 25 bp, Rattus norvegicus
agcacgcttctatttcatgtacctg

SEQ ID NO: 124003 - DNA, 25 bp, Rattus norvegicus
agcacggaaaccatggacatgtgaa

SEQ ID NO: 124004 - DNA, 25 bp, Rattus norvegicus
agcacggaaaccttggacatgtgaa

SEQ ID NO: 124005 - DNA, 25 bp, Rattus norvegicus
agcacggaacttctggctgtccaag

SEQ ID NO: 124006 - DNA, 25 bp, Rattus norvegicus
agcacggaacttgtggctgtccaag

SEQ ID NO: 124007 - DNA, 25 bp, Rattus norvegicus
agcacggacaaacctgacccttggt

SEQ ID NO: 124008 - DNA, 25 bp, Rattus norvegicus
agcacggacaaagctgacccttggt

SEQ ID NO: 124009 - DNA, 25 bp, Rattus norvegicus
agcacggagcgcatggccttctgag

SEQ ID NO: 124010 - DNA, 25 bp, Rattus norvegicus
agcacggagcgcttggccttctgag

SEQ ID NO: 124011 - DNA, 25 bp, Rattus norvegicus
agcacggcgtgaacatgcagcttca

SEQ ID NO: 124012 - DNA, 25 bp, Rattus norvegicus
agcacggcgtgatcatgcagcttca

SEQ ID NO: 124013 - DNA, 25 bp, Rattus norvegicus
agcacggcgtttcgctgtgtacata

SEQ ID NO: 124014 - DNA, 25 bp, Rattus norvegicus
agcacggcgtttggctgtgtacata

SEQ ID NO: 124015 - DNA, 25 bp, Rattus norvegicus
agcacgggattaccaagcaggctgt

SEQ ID NO: 124016 - DNA, 25 bp, Rattus norvegicus
agcacgggattagcaagcaggctgt

SEQ ID NO: 124017 - DNA, 25 bp, Rattus norvegicus
agcacgggtgacactacagggacat

SEQ ID NO: 124018 - DNA, 25 bp, Rattus norvegicus
agcacgggtgactctacagggacat

SEQ ID NO: 124019 - DNA, 25 bp, Rattus norvegicus
agcacgggttcaatggctgccgcaa

SEQ ID NO: 124020 - DNA, 25 bp, Rattus norvegicus
agcacgggttcattggctgccgcaa

SEQ ID NO: 124021 - DNA, 25 bp, Rattus norvegicus
agcacggtctgaatcccagtttgtt

SEQ ID NO: 124022 - DNA, 25 bp, Rattus norvegicus
agcacggtctgattcccagtttgtt

SEQ ID NO: 124023 - DNA, 25 bp, Rattus norvegicus
agcacggtgcacacctatggttgca

SEQ ID NO: 124024 - DNA, 25 bp, Rattus norvegicus
agcacggtgcactcctatggttgca

SEQ ID NO: 124025 - DNA, 25 bp, Rattus norvegicus
agcacggtggatagattcgttcccc

SEQ ID NO: 124026 - DNA, 25 bp, Rattus norvegicus
agcacggtggattgattcgttcccc

SEQ ID NO: 124027 - DNA, 25 bp, Rattus norvegicus
agcacgtagaagctgacccctgcaa

SEQ ID NO: 124028 - DNA, 25 bp, Rattus norvegicus
agcacgtagaaggtgacccctgcaa

SEQ ID NO: 124029 - DNA, 25 bp, Rattus norvegicus
agcacgtagcccacctgggtaaggg

SEQ ID NO: 124030 - DNA, 25 bp, Rattus norvegicus
agcacgtagccctcctgggtaaggg

SEQ ID NO: 124031 - DNA, 25 bp, Rattus norvegicus
agcacgtccaacacttggcattgaa

SEQ ID NO: 124032 - DNA, 25 bp, Rattus norvegicus
agcacgtccaactcttggcattgaa

SEQ ID NO: 124033 - DNA, 25 bp, Rattus norvegicus
agcacgtccattctgtggctcatgg

SEQ ID NO: 124034 - DNA, 25 bp, Rattus norvegicus
agcacgtccattgtgtggctcatgg

SEQ ID NO: 124035 - DNA, 25 bp, Rattus norvegicus
agcacgtctgtcagttaaggagcat

SEQ ID NO: 124036 - DNA, 25 bp, Rattus norvegicus
agcacgtctgtctgttaaggagcat

SEQ ID NO: 124037 - DNA, 25 bp, Rattus norvegicus
agcacgtgacagcttggtcgcatga

SEQ ID NO: 124038 - DNA, 25 bp, Rattus norvegicus
agcacgtgacaggttggtcgcatga

SEQ ID NO: 124039 - DNA, 25 bp, Rattus norvegicus
agcacgtgaccgcaccaggaagcca

SEQ ID NO: 124040 - DNA, 25 bp, Rattus norvegicus
agcacgtgaccggaccaggaagcca

SEQ ID NO: 124041 - DNA, 25 bp, Rattus norvegicus
agcacgtgccgcaagagcgtacgta

SEQ ID NO: 124042 - DNA, 25 bp, Rattus norvegicus
agcacgtgccgctagagcgtacgta

SEQ ID NO: 124043 - DNA, 25 bp, Rattus norvegicus
agcacgtgtgggacttttctatcac

SEQ ID NO: 124044 - DNA, 25 bp, Rattus norvegicus
agcacgtgtgggtcttttctatcac

SEQ ID NO: 124045 - DNA, 25 bp, Rattus norvegicus
agcacgtgtgtacagccttgactgt

SEQ ID NO: 124046 - DNA, 25 bp, Rattus norvegicus
agcacgtgtgtagagccttgactgt

SEQ ID NO: 124047 - DNA, 25 bp, Rattus norvegicus
agcacgtgtgtgactcatgttatgt

SEQ ID NO: 124048 - DNA, 25 bp, Rattus norvegicus
agcacgtgtgtgtctcatgttatgt

SEQ ID NO: 124049 - DNA, 25 bp, Rattus norvegicus
agcacgtgtttgaatgatgtaagca

SEQ ID NO: 124050 - DNA, 25 bp, Rattus norvegicus
agcacgtgtttgtatgatgtaagca

SEQ ID NO: 124051 - DNA, 25 bp, Rattus norvegicus
agcacgttacatatcaagttctctg

SEQ ID NO: 124052 - DNA, 25 bp, Rattus norvegicus
agcacgttacatttcaagttctctg

SEQ ID NO: 124053 - DNA, 25 bp, Rattus norvegicus
agcacgttatcgactacatcctgga

SEQ ID NO: 124054 - DNA, 25 bp, Rattus norvegicus
agcacgttatcgtctacatcctgga

SEQ ID NO: 124055 - DNA, 25 bp, Rattus norvegicus
agcacgttctctcgatttatcattt

SEQ ID NO: 124056 - DNA, 25 bp, Rattus norvegicus
agcacgttctctggatttatcattt

SEQ ID NO: 124057 - DNA, 25 bp, Rattus norvegicus
agcacgttgcggatgcacgagaaga

SEQ ID NO: 124058 - DNA, 25 bp, Rattus norvegicus
agcacgttgcggttgcacgagaaga

SEQ ID NO: 124059 - DNA, 25 bp, Rattus norvegicus
agcacgttggtcctacttggagtat

SEQ ID NO: 124060 - DNA, 25 bp, Rattus norvegicus
agcacgttggtcgtacttggagtat

SEQ ID NO: 124061 - DNA, 25 bp, Rattus norvegicus
agcacgtttgctaagtagctggcct

SEQ ID NO: 124062 - DNA, 25 bp, Rattus norvegicus
agcacgtttgcttagtagctggcct

SEQ ID NO: 124063 - DNA, 25 bp, Rattus norvegicus
agcactaaagcccacattactctgt

SEQ ID NO: 124064 - DNA, 25 bp, Rattus norvegicus
agcactaaagccgacattactctgt

SEQ ID NO: 124065 - DNA, 25 bp, Rattus norvegicus
agcactaaccaaagcctttctagat

SEQ ID NO: 124066 - DNA, 25 bp, Rattus norvegicus
agcactaaccaatgcctttctagat

SEQ ID NO: 124067 - DNA, 25 bp, Rattus norvegicus
agcactaagggtaccctcacaccat

SEQ ID NO: 124068 - DNA, 25 bp, Rattus norvegicus
agcactaagggttccctcacaccat

SEQ ID NO: 124069 - DNA, 25 bp, Rattus norvegicus
agcactaagtcccatgtgtcaccag

SEQ ID NO: 124070 - DNA, 25 bp, Rattus norvegicus
agcactaagtccgatgtgtcaccag

SEQ ID NO: 124071 - DNA, 25 bp, Rattus norvegicus
agcactaagttgaggctggcttccc

SEQ ID NO: 124072 - DNA, 25 bp, Rattus norvegicus
agcactaagttgtggctggcttccc

SEQ ID NO: 124073 - DNA, 25 bp, Rattus norvegicus
agcactacactgatttgctactccc

SEQ ID NO: 124074 - DNA, 25 bp, Rattus norvegicus
agcactacactgttttgctactccc

SEQ ID NO: 124075 - DNA, 25 bp, Rattus norvegicus
agcactacatacaggccatcttgaa

SEQ ID NO: 124076 - DNA, 25 bp, Rattus norvegicus
agcactacatactggccatcttgaa

SEQ ID NO: 124077 - DNA, 25 bp, Rattus norvegicus
agcactaccagaccggcccggtgcc

SEQ ID NO: 124078 - DNA, 25 bp, Rattus norvegicus
agcactaccagagcggcccggtgcc

SEQ ID NO: 124079 - DNA, 25 bp, Rattus norvegicus
agcactacggcgagttcacctgcga

SEQ ID NO: 124080 - DNA, 25 bp, Rattus norvegicus
agcactacggcgtgttcacctgcga

SEQ ID NO: 124081 - DNA, 25 bp, Rattus norvegicus
agcactactagtcatcagcggctca

SEQ ID NO: 124082 - DNA, 25 bp, Rattus norvegicus
agcactactagtgatcagcggctca

SEQ ID NO: 124083 - DNA, 25 bp, Rattus norvegicus
agcactactccgagagcaccagtgg

SEQ ID NO: 124084 - DNA, 25 bp, Rattus norvegicus
agcactactccgtgagcaccagtgg

SEQ ID NO: 124085 - DNA, 25 bp, Rattus norvegicus
agcactacttcaccatctagttcgg

SEQ ID NO: 124086 - DNA, 25 bp, Rattus norvegicus
agcactacttcagcatctagttcgg

SEQ ID NO: 124087 - DNA, 25 bp, Rattus norvegicus
agcactagaaatcaagactacttgg

SEQ ID NO: 124088 - DNA, 25 bp, Rattus norvegicus
agcactagaaatgaagactacttgg

SEQ ID NO: 124089 - DNA, 25 bp, Rattus norvegicus
agcactagcaggatgcgcgccagtt

SEQ ID NO: 124090 - DNA, 25 bp, Rattus norvegicus
agcactagcaggttgcgcgccagtt

SEQ ID NO: 124091 - DNA, 25 bp, Rattus norvegicus
agcactagccaaacattttgaaggg

SEQ ID NO: 124092 - DNA, 25 bp, Rattus norvegicus
agcactagccaatcattttgaaggg

SEQ ID NO: 124093 - DNA, 25 bp, Rattus norvegicus
agcactagccgaatgactcatcaga

SEQ ID NO: 124094 - DNA, 25 bp, Rattus norvegicus
agcactagccgattgactcatcaga

SEQ ID NO: 124095 - DNA, 25 bp, Rattus norvegicus
agcactagcgtactgtctccactca

SEQ ID NO: 124096 - DNA, 25 bp, Rattus norvegicus
agcactagcgtagtgtctccactca

SEQ ID NO: 124097 - DNA, 25 bp, Rattus norvegicus
agcactagctcgcagttcagccaag

SEQ ID NO: 124098 - DNA, 25 bp, Rattus norvegicus
agcactagctcggagttcagccaag

SEQ ID NO: 124099 - DNA, 25 bp, Rattus norvegicus
agcactagctgcagtactcagctct

SEQ ID NO: 124100 - DNA, 25 bp, Rattus norvegicus
agcactagctgctgtactcagctct

SEQ ID NO: 124101 - DNA, 25 bp, Rattus norvegicus
agcactaggccacatgtctcttaga

SEQ ID NO: 124102 - DNA, 25 bp, Rattus norvegicus
agcactaggccagatgtctcttaga

SEQ ID NO: 124103 - DNA, 25 bp, Rattus norvegicus
agcactaggtatctgtgcatgcccc

SEQ ID NO: 124104 - DNA, 25 bp, Rattus norvegicus
agcactaggtatgtgtgcatgcccc

SEQ ID NO: 124105 - DNA, 25 bp, Rattus norvegicus
agcactatagagctcgtcctccaaa

SEQ ID NO: 124106 - DNA, 25 bp, Rattus norvegicus
agcactatagaggtcgtcctccaaa

SEQ ID NO: 124107 - DNA, 25 bp, Rattus norvegicus
agcactatagtacctgagtattaac

SEQ ID NO: 124108 - DNA, 25 bp, Rattus norvegicus
agcactatagtagctgagtattaac

SEQ ID NO: 124109 - DNA, 25 bp, Rattus norvegicus
agcactatcaaacaagggtctcggg

SEQ ID NO: 124110 - DNA, 25 bp, Rattus norvegicus
agcactatcaaagaagggtctcggg

SEQ ID NO: 124111 - DNA, 25 bp, Rattus norvegicus
agcactatccatcaggactggttcc

SEQ ID NO: 124112 - DNA, 25 bp, Rattus norvegicus
agcactatccatgaggactggttcc

SEQ ID NO: 124113 - DNA, 25 bp, Rattus norvegicus
agcactatccttaaggcctcctttg

SEQ ID NO: 124114 - DNA, 25 bp, Rattus norvegicus
agcactatcctttaggcctcctttg

SEQ ID NO: 124115 - DNA, 25 bp, Rattus norvegicus
agcactatctacatcacactttgga

SEQ ID NO: 124116 - DNA, 25 bp, Rattus norvegicus
agcactatctacttcacactttgga

SEQ ID NO: 124117 - DNA, 25 bp, Rattus norvegicus
agcactatgagtcggtgttttcaca

SEQ ID NO: 124118 - DNA, 25 bp, Rattus norvegicus
agcactatgagtgggtgttttcaca

SEQ ID NO: 124119 - DNA, 25 bp, Rattus norvegicus
agcactatgcgtatgattttacaga

SEQ ID NO: 124120 - DNA, 25 bp, Rattus norvegicus
agcactatgcgtttgattttacaga

SEQ ID NO: 124121 - DNA, 25 bp, Rattus norvegicus
agcactcaaacccaggttactgttg

SEQ ID NO: 124122 - DNA, 25 bp, Rattus norvegicus
agcactcaaaccgaggttactgttg

SEQ ID NO: 124123 - DNA, 25 bp, Rattus norvegicus
agcactcaaagtctggttccatttc

SEQ ID NO: 124124 - DNA, 25 bp, Rattus norvegicus
agcactcaaagtgtggttccatttc

SEQ ID NO: 124125 - DNA, 25 bp, Rattus norvegicus
agcactcaagagactcaagctctga

SEQ ID NO: 124126 - DNA, 25 bp, Rattus norvegicus
agcactcaagagtctcaagctctga

SEQ ID NO: 124127 - DNA, 25 bp, Rattus norvegicus
agcactcaagtgactcaaaagcata

SEQ ID NO: 124128 - DNA, 25 bp, Rattus norvegicus
agcactcaagtgtctcaaaagcata

SEQ ID NO: 124129 - DNA, 25 bp, Rattus norvegicus
agcactcaatacacatccagcttgt

SEQ ID NO: 124130 - DNA, 25 bp, Rattus norvegicus
agcactcaatactcatccagcttgt

SEQ ID NO: 124131 - DNA, 25 bp, Rattus norvegicus
agcactcacacaccgaggactcaag

SEQ ID NO: 124132 - DNA, 25 bp, Rattus norvegicus
agcactcacacagcgaggactcaag

SEQ ID NO: 124133 - DNA, 25 bp, Rattus norvegicus
agcactcacagacactgacagcagg

SEQ ID NO: 124134 - DNA, 25 bp, Rattus norvegicus
agcactcacagagactgacagcagg

SEQ ID NO: 124135 - DNA, 25 bp, Rattus norvegicus
agcactcaccccattggtaggttag

SEQ ID NO: 124136 - DNA, 25 bp, Rattus norvegicus
agcactcacccctttggtaggttag

SEQ ID NO: 124137 - DNA, 25 bp, Rattus norvegicus
agcactcacgagctcctcagttaga

SEQ ID NO: 124138 - DNA, 25 bp, Rattus norvegicus
agcactcacgaggtcctcagttaga

SEQ ID NO: 124139 - DNA, 25 bp, Rattus norvegicus
agcactcactacaactgtggatgga

SEQ ID NO: 124140 - DNA, 25 bp, Rattus norvegicus
agcactcactactactgtggatgga

SEQ ID NO: 124141 - DNA, 25 bp, Rattus norvegicus
agcactcactgacagcaagcagcac

SEQ ID NO: 124142 - DNA, 25 bp, Rattus norvegicus
agcactcactgagagcaagcagcac

SEQ ID NO: 124143 - DNA, 25 bp, Rattus norvegicus
agcactcactgcacaagcgcttgag

SEQ ID NO: 124144 - DNA, 25 bp, Rattus norvegicus
agcactcactgctcaagcgcttgag

SEQ ID NO: 124145 - DNA, 25 bp, Rattus norvegicus
agcactcagcacagtgtagcacaca

SEQ ID NO: 124146 - DNA, 25 bp, Rattus norvegicus
agcactcagcactgtgtagcacaca

SEQ ID NO: 124147 - DNA, 25 bp, Rattus norvegicus
agcactcagctaaaccacaaaacat

SEQ ID NO: 124148 - DNA, 25 bp, Rattus norvegicus
agcactcagctataccacaaaacat

SEQ ID NO: 124149 - DNA, 25 bp, Rattus norvegicus
agcactcaggagcatcatctagttc

SEQ ID NO: 124150 - DNA, 25 bp, Rattus norvegicus
agcactcaggaggatcatctagttc

SEQ ID NO: 124151 - DNA, 25 bp, Rattus norvegicus
agcactcaggttccagttctggagc

SEQ ID NO: 124152 - DNA, 25 bp, Rattus norvegicus
agcactcaggttgcagttctggagc

SEQ ID NO: 124153 - DNA, 25 bp, Rattus norvegicus
agcactcagtctactgcagttcgca

SEQ ID NO: 124154 - DNA, 25 bp, Rattus norvegicus
agcactcagtcttctgcagttcgca

SEQ ID NO: 124155 - DNA, 25 bp, Rattus norvegicus
agcactcagtgcagtcacggaagtt

SEQ ID NO: 124156 - DNA, 25 bp, Rattus norvegicus
agcactcagtgctgtcacggaagtt

SEQ ID NO: 124157 - DNA, 25 bp, Rattus norvegicus
agcactcatgtcaactaggatggtc

SEQ ID NO: 124158 - DNA, 25 bp, Rattus norvegicus
agcactcatgtcagctggctcacaa

SEQ ID NO: 124159 - DNA, 25 bp, Rattus norvegicus
agcactcatgtctactaggatggtc

SEQ ID NO: 124160 - DNA, 25 bp, Rattus norvegicus
agcactcatgtctgctggctcacaa

SEQ ID NO: 124161 - DNA, 25 bp, Rattus norvegicus
agcactcatgtgagccagcgagtat

SEQ ID NO: 124162 - DNA, 25 bp, Rattus norvegicus
agcactcatgtgtgccagcgagtat

SEQ ID NO: 124163 - DNA, 25 bp, Rattus norvegicus
agcactcattgccagggtcacagaa

SEQ ID NO: 124164 - DNA, 25 bp, Rattus norvegicus
agcactcattgcgagggtcacagaa

SEQ ID NO: 124165 - DNA, 25 bp, Rattus norvegicus
agcactccactgaatgcacctaatg

SEQ ID NO: 124166 - DNA, 25 bp, Rattus norvegicus
agcactccactgtatgcacctaatg

SEQ ID NO: 124167 - DNA, 25 bp, Rattus norvegicus
agcactccagcaaccaagacggtaa

SEQ ID NO: 124168 - DNA, 25 bp, Rattus norvegicus
agcactccagcatccaagacggtaa

SEQ ID NO: 124169 - DNA, 25 bp, Rattus norvegicus
agcactccctgaaagaaatgacttt

SEQ ID NO: 124170 - DNA, 25 bp, Rattus norvegicus
agcactccctgatagaaatgacttt

SEQ ID NO: 124171 - DNA, 25 bp, Rattus norvegicus
agcactcctccgctggtcactattg

SEQ ID NO: 124172 - DNA, 25 bp, Rattus norvegicus
agcactcctccggtggtcactattg

SEQ ID NO: 124173 - DNA, 25 bp, Rattus norvegicus
agcactcctgaaaagttctccacct

SEQ ID NO: 124174 - DNA, 25 bp, Rattus norvegicus
agcactcctgaatagttctccacct

SEQ ID NO: 124175 - DNA, 25 bp, Rattus norvegicus
agcactcctgtactcacttgaaggg

SEQ ID NO: 124176 - DNA, 25 bp, Rattus norvegicus
agcactcctgtagtcacttgaaggg

SEQ ID NO: 124177 - DNA, 25 bp, Rattus norvegicus
agcactcctgttatcaggctgagtt

SEQ ID NO: 124178 - DNA, 25 bp, Rattus norvegicus
agcactcctgttttcaggctgagtt

SEQ ID NO: 124179 - DNA, 25 bp, Rattus norvegicus
agcactcggcttagaacccaggaag

SEQ ID NO: 124180 - DNA, 25 bp, Rattus norvegicus
agcactcggctttgaacccaggaag

SEQ ID NO: 124181 - DNA, 25 bp, Rattus norvegicus
agcactcgtccacgtgttcttaaga

SEQ ID NO: 124182 - DNA, 25 bp, Rattus norvegicus
agcactcgtccaggtgttcttaaga

SEQ ID NO: 124183 - DNA, 25 bp, Rattus norvegicus
agcactcgtgtcaacttcgagctgg

SEQ ID NO: 124184 - DNA, 25 bp, Rattus norvegicus
agcactcgtgtctacttcgagctgg

SEQ ID NO: 124185 - DNA, 25 bp, Rattus norvegicus
agcactctagtgaccaaggcaggaa

SEQ ID NO: 124186 - DNA, 25 bp, Rattus norvegicus
agcactctagtgtccaaggcaggaa

SEQ ID NO: 124187 - DNA, 25 bp, Rattus norvegicus
agcactctcaagctggagcgcctgg

SEQ ID NO: 124188 - DNA, 25 bp, Rattus norvegicus
agcactctcaaggtggagcgcctgg

SEQ ID NO: 124189 - DNA, 25 bp, Rattus norvegicus
agcactctcttcaaaggcagttctt

SEQ ID NO: 124190 - DNA, 25 bp, Rattus norvegicus
agcactctcttctaaggcagttctt

SEQ ID NO: 124191 - DNA, 25 bp, Rattus norvegicus
agcactctcttgaccggttaggttg

SEQ ID NO: 124192 - DNA, 25 bp, Rattus norvegicus
agcactctcttgtccggttaggttg

SEQ ID NO: 124193 - DNA, 25 bp, Rattus norvegicus
agcactctgacacccgaaacctaaa

SEQ ID NO: 124194 - DNA, 25 bp, Rattus norvegicus
agcactctgacagccgaaacctaaa

SEQ ID NO: 124195 - DNA, 25 bp, Rattus norvegicus
agcactctggagcttcggtgttgaa

SEQ ID NO: 124196 - DNA, 25 bp, Rattus norvegicus
agcactctggaggttcggtgttgaa

SEQ ID NO: 124197 - DNA, 25 bp, Rattus norvegicus
agcactctggcacagctgaattgta

SEQ ID NO: 124198 - DNA, 25 bp, Rattus norvegicus
agcactctggcagagctgaattgta

SEQ ID NO: 124199 - DNA, 25 bp, Rattus norvegicus
agcactctggtgcagttggcattgc

SEQ ID NO: 124200 - DNA, 25 bp, Rattus norvegicus
agcactctggtggagttggcattgc

SEQ ID NO: 124201 - DNA, 25 bp, Rattus norvegicus
agcactctgtttacctaccagaaaa

SEQ ID NO: 124202 - DNA, 25 bp, Rattus norvegicus
agcactctgttttcctaccagaaaa

SEQ ID NO: 124203 - DNA, 25 bp, Rattus norvegicus
agcactcttaccagcacaaggagga

SEQ ID NO: 124204 - DNA, 25 bp, Rattus norvegicus
agcactcttacctgcacaaggagga

SEQ ID NO: 124205 - DNA, 25 bp, Rattus norvegicus
agcactcttccaaaggactcatatg

SEQ ID NO: 124206 - DNA, 25 bp, Rattus norvegicus
agcactcttccataggactcatatg

SEQ ID NO: 124207 - DNA, 25 bp, Rattus norvegicus
agcactcttgttcactctatggtaa

SEQ ID NO: 124208 - DNA, 25 bp, Rattus norvegicus
agcactcttgttgactctatggtaa

SEQ ID NO: 124209 - DNA, 25 bp, Rattus norvegicus
agcactgacacgagaatggcccaat

SEQ ID NO: 124210 - DNA, 25 bp, Rattus norvegicus
agcactgacacgtgaatggcccaat

SEQ ID NO: 124211 - DNA, 25 bp, Rattus norvegicus
agcactgacactcgagggctcacac

SEQ ID NO: 124212 - DNA, 25 bp, Rattus norvegicus
agcactgacactggagggctcacac

SEQ ID NO: 124213 - DNA, 25 bp, Rattus norvegicus
agcactgacagtaaaggctgcagca

SEQ ID NO: 124214 - DNA, 25 bp, Rattus norvegicus
agcactgacagttaaggctgcagca

SEQ ID NO: 124215 - DNA, 25 bp, Rattus norvegicus
agcactgactgcaaactgtctcttg

SEQ ID NO: 124216 - DNA, 25 bp, Rattus norvegicus
agcactgactgctaactgtctcttg

SEQ ID NO: 124217 - DNA, 25 bp, Rattus norvegicus
agcactgactgtactcttggacttg

SEQ ID NO: 124218 - DNA, 25 bp, Rattus norvegicus
agcactgactgttctcttggacttg

SEQ ID NO: 124219 - DNA, 25 bp, Rattus norvegicus
agcactgacttcaggttgcttcaga

SEQ ID NO: 124220 - DNA, 25 bp, Rattus norvegicus
agcactgacttctggttgcttcaga

SEQ ID NO: 124221 - DNA, 25 bp, Rattus norvegicus
agcactgataccagcttgacctgtt

SEQ ID NO: 124222 - DNA, 25 bp, Rattus norvegicus
agcactgatacctgcttgacctgtt

SEQ ID NO: 124223 - DNA, 25 bp, Rattus norvegicus
agcactgatcaacatttttagcaag

SEQ ID NO: 124224 - DNA, 25 bp, Rattus norvegicus
agcactgatcaagatttttagcaag

SEQ ID NO: 124225 - DNA, 25 bp, Rattus norvegicus
agcactgatcagagagctgagcagc

SEQ ID NO: 124226 - DNA, 25 bp, Rattus norvegicus
agcactgatcagtgagctgagcagc

SEQ ID NO: 124227 - DNA, 25 bp, Rattus norvegicus
agcactgatctcagtattgtacccc

SEQ ID NO: 124228 - DNA, 25 bp, Rattus norvegicus
agcactgatctctgtattgtacccc

SEQ ID NO: 124229 - DNA, 25 bp, Rattus norvegicus
agcactgatgagaaggcctggaaac

SEQ ID NO: 124230 - DNA, 25 bp, Rattus norvegicus
agcactgatgagtaggcctggaaac

SEQ ID NO: 124231 - DNA, 25 bp, Rattus norvegicus
agcactgatgctatctatgtactta

SEQ ID NO: 124232 - DNA, 25 bp, Rattus norvegicus
agcactgatgctttctatgtactta

SEQ ID NO: 124233 - DNA, 25 bp, Rattus norvegicus
agcactgatgggaccctcggagcct

SEQ ID NO: 124234 - DNA, 25 bp, Rattus norvegicus
agcactgatgggtccctcggagcct

SEQ ID NO: 124235 - DNA, 25 bp, Rattus norvegicus
agcactgatgtacgtttcacttaga

SEQ ID NO: 124236 - DNA, 25 bp, Rattus norvegicus
agcactgatgtaggtttcacttaga

SEQ ID NO: 124237 - DNA, 25 bp, Rattus norvegicus
agcactgattctctactgtggcagc

SEQ ID NO: 124238 - DNA, 25 bp, Rattus norvegicus
agcactgattctgtactgtggcagc

SEQ ID NO: 124239 - DNA, 25 bp, Rattus norvegicus
agcactgcaataaacgctcagccat

SEQ ID NO: 124240 - DNA, 25 bp, Rattus norvegicus
agcactgcaataacttctcagccca

SEQ ID NO: 124241 - DNA, 25 bp, Rattus norvegicus
agcactgcaatatacgctcagccat

SEQ ID NO: 124242 - DNA, 25 bp, Rattus norvegicus
agcactgcaatatcttctcagccca

SEQ ID NO: 124243 - DNA, 25 bp, Rattus norvegicus
agcactgcaatgactggtactctca

SEQ ID NO: 124244 - DNA, 25 bp, Rattus norvegicus
agcactgcaatgtctggtactctca

SEQ ID NO: 124245 - DNA, 25 bp, Rattus norvegicus
agcactgcactgaactgtgagttgt

SEQ ID NO: 124246 - DNA, 25 bp, Rattus norvegicus
agcactgcactgtactgtgagttgt

SEQ ID NO: 124247 - DNA, 25 bp, Rattus norvegicus
agcactgcagctagggaccttgttg

SEQ ID NO: 124248 - DNA, 25 bp, Rattus norvegicus
agcactgcagcttgggaccttgttg

SEQ ID NO: 124249 - DNA, 25 bp, Rattus norvegicus
agcactgcagggatgtattcttggc

SEQ ID NO: 124250 - DNA, 25 bp, Rattus norvegicus
agcactgcagggttgtattcttggc

SEQ ID NO: 124251 - DNA, 25 bp, Rattus norvegicus
agcactgcatgtctcagagtaacta

SEQ ID NO: 124252 - DNA, 25 bp, Rattus norvegicus
agcactgcatgtgtcagagtaacta

SEQ ID NO: 124253 - DNA, 25 bp, Rattus norvegicus
agcactgcattgctggacccagcaa

SEQ ID NO: 124254 - DNA, 25 bp, Rattus norvegicus
agcactgcattggtggacccagcaa

SEQ ID NO: 124255 - DNA, 25 bp, Rattus norvegicus
agcactgccagcagaacggacagca

SEQ ID NO: 124256 - DNA, 25 bp, Rattus norvegicus
agcactgccagctgaacggacagca

SEQ ID NO: 124257 - DNA, 25 bp, Rattus norvegicus
agcactgccctacaagctattctat

SEQ ID NO: 124258 - DNA, 25 bp, Rattus norvegicus
agcactgccctagaagctattctat

SEQ ID NO: 124259 - DNA, 25 bp, Rattus norvegicus
agcactgcctagaagcagacacatg

SEQ ID NO: 124260 - DNA, 25 bp, Rattus norvegicus
agcactgcctagtagcagacacatg

SEQ ID NO: 124261 - DNA, 25 bp, Rattus norvegicus
agcactgcctctacaacagcaggga

SEQ ID NO: 124262 - DNA, 25 bp, Rattus norvegicus
agcactgcctcttcaacagcaggga

SEQ ID NO: 124263 - DNA, 25 bp, Rattus norvegicus
agcactgcgaggctgtcaacaccgg

SEQ ID NO: 124264 - DNA, 25 bp, Rattus norvegicus
agcactgcgagggtgtcaacaccgg

SEQ ID NO: 124265 - DNA, 25 bp, Rattus norvegicus
agcactgcgcggagatctcactatt

SEQ ID NO: 124266 - DNA, 25 bp, Rattus norvegicus
agcactgcgcggtgatctcactatt

SEQ ID NO: 124267 - DNA, 25 bp, Rattus norvegicus
agcactgcgtttcgtggactgtgac

SEQ ID NO: 124268 - DNA, 25 bp, Rattus norvegicus
agcactgcgtttggtggactgtgac

SEQ ID NO: 124269 - DNA, 25 bp, Rattus norvegicus
agcactgctctcaatgagctttgat

SEQ ID NO: 124270 - DNA, 25 bp, Rattus norvegicus
agcactgctctctatgagctttgat

SEQ ID NO: 124271 - DNA, 25 bp, Rattus norvegicus
agcactgctgctcaatatctcaaag

SEQ ID NO: 124272 - DNA, 25 bp, Rattus norvegicus
agcactgctgctgaatatctcaaag

SEQ ID NO: 124273 - DNA, 25 bp, Rattus norvegicus
agcactgctgggaaattcacaactg

SEQ ID NO: 124274 - DNA, 25 bp, Rattus norvegicus
agcactgctgggtaattcacaactg

SEQ ID NO: 124275 - DNA, 25 bp, Rattus norvegicus
agcactgcttctagggttgggaaga

SEQ ID NO: 124276 - DNA, 25 bp, Rattus norvegicus
agcactgcttcttgggttgggaaga

SEQ ID NO: 124277 - DNA, 25 bp, Rattus norvegicus
agcactggaccacttttctggcaga

SEQ ID NO: 124278 - DNA, 25 bp, Rattus norvegicus
agcactggaccagttttctggcaga

SEQ ID NO: 124279 - DNA, 25 bp, Rattus norvegicus
agcactggatgcaggacacccacag

SEQ ID NO: 124280 - DNA, 25 bp, Rattus norvegicus
agcactggatgctggacacccacag

SEQ ID NO: 124281 - DNA, 25 bp, Rattus norvegicus
agcactggatgtcgtactgaacaca

SEQ ID NO: 124282 - DNA, 25 bp, Rattus norvegicus
agcactggatgtggtactgaacaca

SEQ ID NO: 124283 - DNA, 25 bp, Rattus norvegicus
agcactggcagcattcagcttggag

SEQ ID NO: 124284 - DNA, 25 bp, Rattus norvegicus
agcactggcagctttcagcttggag

SEQ ID NO: 124285 - DNA, 25 bp, Rattus norvegicus
agcactggccacaaaattccaggag

SEQ ID NO: 124286 - DNA, 25 bp, Rattus norvegicus
agcactggccactaaattccaggag

SEQ ID NO: 124287 - DNA, 25 bp, Rattus norvegicus
agcactggcctgatcctttttattt

SEQ ID NO: 124288 - DNA, 25 bp, Rattus norvegicus
agcactggcctgatctcttaacatt

SEQ ID NO: 124289 - DNA, 25 bp, Rattus norvegicus
agcactggcctgttcctttttattt

SEQ ID NO: 124290 - DNA, 25 bp, Rattus norvegicus
agcactggcctgttctcttaacatt

SEQ ID NO: 124291 - DNA, 25 bp, Rattus norvegicus
agcactggctgcactgtgagaggac

SEQ ID NO: 124292 - DNA, 25 bp, Rattus norvegicus
agcactggctgctctgtgagaggac

SEQ ID NO: 124293 - DNA, 25 bp, Rattus norvegicus
agcactggcttgacatgatgaacac

SEQ ID NO: 124294 - DNA, 25 bp, Rattus norvegicus
agcactggcttgtcatgatgaacac

SEQ ID NO: 124295 - DNA, 25 bp, Rattus norvegicus
agcactgggaatccacagagaacca

SEQ ID NO: 124296 - DNA, 25 bp, Rattus norvegicus
agcactgggaatgcacagagaacca

SEQ ID NO: 124297 - DNA, 25 bp, Rattus norvegicus
agcactgggcacagctcagggacac

SEQ ID NO: 124298 - DNA, 25 bp, Rattus norvegicus
agcactgggcactgctcagggacac

SEQ ID NO: 124299 - DNA, 25 bp, Rattus norvegicus
agcactgggcatagactgggataca

SEQ ID NO: 124300 - DNA, 25 bp, Rattus norvegicus
agcactgggcattgactgggataca

SEQ ID NO: 124301 - DNA, 25 bp, Rattus norvegicus
agcactgggtgacagactgccccaa

SEQ ID NO: 124302 - DNA, 25 bp, Rattus norvegicus
agcactgggtgagagactgccccaa

SEQ ID NO: 124303 - DNA, 25 bp, Rattus norvegicus
agcactggtcagcatgctcaacagt

SEQ ID NO: 124304 - DNA, 25 bp, Rattus norvegicus
agcactggtcaggatgctcaacagt

SEQ ID NO: 124305 - DNA, 25 bp, Rattus norvegicus
agcactggtgaacctggactcactg

SEQ ID NO: 124306 - DNA, 25 bp, Rattus norvegicus
agcactggtgaagctggactcactg

SEQ ID NO: 124307 - DNA, 25 bp, Rattus norvegicus
agcactggtgatcggtcaccccaac

SEQ ID NO: 124308 - DNA, 25 bp, Rattus norvegicus
agcactggtgatgggtcaccccaac

SEQ ID NO: 124309 - DNA, 25 bp, Rattus norvegicus
agcactggtggccactcgctggcat

SEQ ID NO: 124310 - DNA, 25 bp, Rattus norvegicus
agcactggtggcgactcgctggcat

SEQ ID NO: 124311 - DNA, 25 bp, Rattus norvegicus
agcactggtgtgagcgcaaggccct

SEQ ID NO: 124312 - DNA, 25 bp, Rattus norvegicus
agcactggtgtgtgcgcaaggccct

SEQ ID NO: 124313 - DNA, 25 bp, Rattus norvegicus
agcactggttgcattcccagagtac

SEQ ID NO: 124314 - DNA, 25 bp, Rattus norvegicus
agcactggttgctttcccagagtac

SEQ ID NO: 124315 - DNA, 25 bp, Rattus norvegicus
agcactgtaaagactccgcttcagg

SEQ ID NO: 124316 - DNA, 25 bp, Rattus norvegicus
agcactgtaaagtctccgcttcagg

SEQ ID NO: 124317 - DNA, 25 bp, Rattus norvegicus
agcactgtacatatcaccctgtgtg

SEQ ID NO: 124318 - DNA, 25 bp, Rattus norvegicus
agcactgtacatttcaccctgtgtg

SEQ ID NO: 124319 - DNA, 25 bp, Rattus norvegicus
agcactgtactcctggcaatcatta

SEQ ID NO: 124320 - DNA, 25 bp, Rattus norvegicus
agcactgtactcgtggcaatcatta

SEQ ID NO: 124321 - DNA, 25 bp, Rattus norvegicus
agcactgtagacaacgtcggtctct

SEQ ID NO: 124322 - DNA, 25 bp, Rattus norvegicus
agcactgtagactacgtcggtctct

SEQ ID NO: 124323 - DNA, 25 bp, Rattus norvegicus
agcactgtaggaacatgtcaaccac

SEQ ID NO: 124324 - DNA, 25 bp, Rattus norvegicus
agcactgtaggatcatgtcaaccac

SEQ ID NO: 124325 - DNA, 25 bp, Rattus norvegicus
agcactgtcagccataccttgtgag

SEQ ID NO: 124326 - DNA, 25 bp, Rattus norvegicus
agcactgtcagcgataccttgtgag

SEQ ID NO: 124327 - DNA, 25 bp, Rattus norvegicus
agcactgtcatcatttagtagccaa

SEQ ID NO: 124328 - DNA, 25 bp, Rattus norvegicus
agcactgtcatcttttagtagccaa

SEQ ID NO: 124329 - DNA, 25 bp, Rattus norvegicus
agcactgtccagctactgctcagca

SEQ ID NO: 124330 - DNA, 25 bp, Rattus norvegicus
agcactgtccaggtactgctcagca

SEQ ID NO: 124331 - DNA, 25 bp, Rattus norvegicus
agcactgtcgccaaagttgagtttg

SEQ ID NO: 124332 - DNA, 25 bp, Rattus norvegicus
agcactgtcgcctaagttgagtttg

SEQ ID NO: 124333 - DNA, 25 bp, Rattus norvegicus
agcactgtctggattgggtctcctg

SEQ ID NO: 124334 - DNA, 25 bp, Rattus norvegicus
agcactgtctggtttgggtctcctg

SEQ ID NO: 124335 - DNA, 25 bp, Rattus norvegicus
agcactgtgatgaagccaaggccgt

SEQ ID NO: 124336 - DNA, 25 bp, Rattus norvegicus
agcactgtgatgtagccaaggccgt

SEQ ID NO: 124337 - DNA, 25 bp, Rattus norvegicus
agcactgtgattctccctgaccatt

SEQ ID NO: 124338 - DNA, 25 bp, Rattus norvegicus
agcactgtgattgtccctgaccatt

SEQ ID NO: 124339 - DNA, 25 bp, Rattus norvegicus
agcactgtgcagattggatatttca

SEQ ID NO: 124340 - DNA, 25 bp, Rattus norvegicus
agcactgtgcagcagttcctgaagc

SEQ ID NO: 124341 - DNA, 25 bp, Rattus norvegicus
agcactgtgcaggagttcctgaagc

SEQ ID NO: 124342 - DNA, 25 bp, Rattus norvegicus
agcactgtgcagtttggatatttca

SEQ ID NO: 124343 - DNA, 25 bp, Rattus norvegicus
agcactgtgccaaatttttacgttg

SEQ ID NO: 124344 - DNA, 25 bp, Rattus norvegicus
agcactgtgccatatttttacgttg

SEQ ID NO: 124345 - DNA, 25 bp, Rattus norvegicus
agcactgtgcctaaatggctctgag

SEQ ID NO: 124346 - DNA, 25 bp, Rattus norvegicus
agcactgtgccttaatggctctgag

SEQ ID NO: 124347 - DNA, 25 bp, Rattus norvegicus
agcactgtgcttaatctagtttcct

SEQ ID NO: 124348 - DNA, 25 bp, Rattus norvegicus
agcactgtgcttcctgactccagat

SEQ ID NO: 124349 - DNA, 25 bp, Rattus norvegicus
agcactgtgcttgctgactccagat

SEQ ID NO: 124350 - DNA, 25 bp, Rattus norvegicus
agcactgtgctttatctagtttcct

SEQ ID NO: 124351 - DNA, 25 bp, Rattus norvegicus
agcactgtggtgagcacacaactcg

SEQ ID NO: 124352 - DNA, 25 bp, Rattus norvegicus
agcactgtggtgtgcacacaactcg

SEQ ID NO: 124353 - DNA, 25 bp, Rattus norvegicus
agcactgtgtacctttataactaaa

SEQ ID NO: 124354 - DNA, 25 bp, Rattus norvegicus
agcactgtgtacgtttataactaaa

SEQ ID NO: 124355 - DNA, 25 bp, Rattus norvegicus
agcactgtgttcatcctgagagacg

SEQ ID NO: 124356 - DNA, 25 bp, Rattus norvegicus
agcactgtgttcttcctgagagacg

SEQ ID NO: 124357 - DNA, 25 bp, Rattus norvegicus
agcactgttcatatttctgttttct

SEQ ID NO: 124358 - DNA, 25 bp, Rattus norvegicus
agcactgttcatttttctgttttct

SEQ ID NO: 124359 - DNA, 25 bp, Rattus norvegicus
agcactgttcccagaggagtccagt

SEQ ID NO: 124360 - DNA, 25 bp, Rattus norvegicus
agcactgttccctgaggagtccagt

SEQ ID NO: 124361 - DNA, 25 bp, Rattus norvegicus
agcactgttctaaccctacactctg

SEQ ID NO: 124362 - DNA, 25 bp, Rattus norvegicus
agcactgttctatccctacactctg

SEQ ID NO: 124363 - DNA, 25 bp, Rattus norvegicus
agcactgttctcagaggccagtagt

SEQ ID NO: 124364 - DNA, 25 bp, Rattus norvegicus
agcactgttctctgaggccagtagt

SEQ ID NO: 124365 - DNA, 25 bp, Rattus norvegicus
agcactgttctgaggccgctctgga

SEQ ID NO: 124366 - DNA, 25 bp, Rattus norvegicus
agcactgttctgtggccgctctgga

SEQ ID NO: 124367 - DNA, 25 bp, Rattus norvegicus
agcactgttgctcaccatggaggac

SEQ ID NO: 124368 - DNA, 25 bp, Rattus norvegicus
agcactgttgctgaccatggaggac

SEQ ID NO: 124369 - DNA, 25 bp, Rattus norvegicus
agcactgtttaacggtcctcagttt

SEQ ID NO: 124370 - DNA, 25 bp, Rattus norvegicus
agcactgtttaagggtcctcagttt

SEQ ID NO: 124371 - DNA, 25 bp, Rattus norvegicus
agcactgtttcacgctaatcttcga

SEQ ID NO: 124372 - DNA, 25 bp, Rattus norvegicus
agcactgtttcaggctaatcttcga

SEQ ID NO: 124373 - DNA, 25 bp, Rattus norvegicus
agcactgtttcgcttctgtttgcat

SEQ ID NO: 124374 - DNA, 25 bp, Rattus norvegicus
agcactgtttcggttctgtttgcat

SEQ ID NO: 124375 - DNA, 25 bp, Rattus norvegicus
agcactgttttaatagggcaatcca

SEQ ID NO: 124376 - DNA, 25 bp, Rattus norvegicus
agcactgttttattagggcaatcca

SEQ ID NO: 124377 - DNA, 25 bp, Rattus norvegicus
agcactgttttgataactgtccgga

SEQ ID NO: 124378 - DNA, 25 bp, Rattus norvegicus
agcactgttttgttaactgtccgga

SEQ ID NO: 124379 - DNA, 25 bp, Rattus norvegicus
agcacttacagaatctccccagtga

SEQ ID NO: 124380 - DNA, 25 bp, Rattus norvegicus
agcacttacagattctccccagtga

SEQ ID NO: 124381 - DNA, 25 bp, Rattus norvegicus
agcacttacagtatgattccacatg

SEQ ID NO: 124382 - DNA, 25 bp, Rattus norvegicus
agcacttacagtttgattccacatg

SEQ ID NO: 124383 - DNA, 25 bp, Rattus norvegicus
agcacttacctgatctcaagctgga

SEQ ID NO: 124384 - DNA, 25 bp, Rattus norvegicus
agcacttacctgttctcaagctgga

SEQ ID NO: 124385 - DNA, 25 bp, Rattus norvegicus
agcacttactggctgtctcacttac

SEQ ID NO: 124386 - DNA, 25 bp, Rattus norvegicus
agcacttactgggtgtctcacttac

SEQ ID NO: 124387 - DNA, 25 bp, Rattus norvegicus
agcacttagcttaaacagttcattt

SEQ ID NO: 124388 - DNA, 25 bp, Rattus norvegicus
agcacttagctttaacagttcattt

SEQ ID NO: 124389 - DNA, 25 bp, Rattus norvegicus
agcacttaggccctccctgatttag

SEQ ID NO: 124390 - DNA, 25 bp, Rattus norvegicus
agcacttaggccgtccctgatttag

SEQ ID NO: 124391 - DNA, 25 bp, Rattus norvegicus
agcacttaggttcgcttagctgcag

SEQ ID NO: 124392 - DNA, 25 bp, Rattus norvegicus
agcacttaggttggcttagctgcag

SEQ ID NO: 124393 - DNA, 25 bp, Rattus norvegicus
agcacttagtgcagggtgtctcaga

SEQ ID NO: 124394 - DNA, 25 bp, Rattus norvegicus
agcacttagtgctgggtgtctcaga

SEQ ID NO: 124395 - DNA, 25 bp, Rattus norvegicus
agcacttagtggctctggccccaac

SEQ ID NO: 124396 - DNA, 25 bp, Rattus norvegicus
agcacttagtgggtctggccccaac

SEQ ID NO: 124397 - DNA, 25 bp, Rattus norvegicus
agcacttattttagcagccccattt

SEQ ID NO: 124398 - DNA, 25 bp, Rattus norvegicus
agcacttatttttgcagccccattt

SEQ ID NO: 124399 - DNA, 25 bp, Rattus norvegicus
agcacttcacatatgtctctatgcc

SEQ ID NO: 124400 - DNA, 25 bp, Rattus norvegicus
agcacttcacatttgtctctatgcc

SEQ ID NO: 124401 - DNA, 25 bp, Rattus norvegicus
agcacttcagcacggctcttaaaag

SEQ ID NO: 124402 - DNA, 25 bp, Rattus norvegicus
agcacttcagcagggctcttaaaag

SEQ ID NO: 124403 - DNA, 25 bp, Rattus norvegicus
agcacttccaccaaaggcagacggg

SEQ ID NO: 124404 - DNA, 25 bp, Rattus norvegicus
agcacttccacctaaggcagacggg

SEQ ID NO: 124405 - DNA, 25 bp, Rattus norvegicus
agcacttccccaagactgaattctg

SEQ ID NO: 124406 - DNA, 25 bp, Rattus norvegicus
agcacttccccatgactgaattctg

SEQ ID NO: 124407 - DNA, 25 bp, Rattus norvegicus
agcacttcctccagttggcagacaa

SEQ ID NO: 124408 - DNA, 25 bp, Rattus norvegicus
agcacttcctcctgttggcagacaa

SEQ ID NO: 124409 - DNA, 25 bp, Rattus norvegicus
agcacttcgttcacatcacagtatg

SEQ ID NO: 124410 - DNA, 25 bp, Rattus norvegicus
agcacttcgttctcatcacagtatg

SEQ ID NO: 124411 - DNA, 25 bp, Rattus norvegicus
agcacttctagtctgagagccaacc

SEQ ID NO: 124412 - DNA, 25 bp, Rattus norvegicus
agcacttctagtgtgagagccaacc

SEQ ID NO: 124413 - DNA, 25 bp, Rattus norvegicus
agcacttctccaatggatgcattca

SEQ ID NO: 124414 - DNA, 25 bp, Rattus norvegicus
agcacttctccattggatgcattca

SEQ ID NO: 124415 - DNA, 25 bp, Rattus norvegicus
agcacttctctacatggcaacacac

SEQ ID NO: 124416 - DNA, 25 bp, Rattus norvegicus
agcacttctctagatggcaacacac

SEQ ID NO: 124417 - DNA, 25 bp, Rattus norvegicus
agcacttcttggaggcttctccggg

SEQ ID NO: 124418 - DNA, 25 bp, Rattus norvegicus
agcacttcttggtggcttctccggg

SEQ ID NO: 124419 - DNA, 25 bp, Rattus norvegicus
agcacttgaccaagtttccttaggg

SEQ ID NO: 124420 - DNA, 25 bp, Rattus norvegicus
agcacttgaccatgtttccttaggg

SEQ ID NO: 124421 - DNA, 25 bp, Rattus norvegicus
agcacttgatcaccagtccaggtta

SEQ ID NO: 124422 - DNA, 25 bp, Rattus norvegicus
agcacttgatcagcagtccaggtta

SEQ ID NO: 124423 - DNA, 25 bp, Rattus norvegicus
agcacttgatgccaagcctcaggac

SEQ ID NO: 124424 - DNA, 25 bp, Rattus norvegicus
agcacttgatgcgaagcctcaggac

SEQ ID NO: 124425 - DNA, 25 bp, Rattus norvegicus
agcacttgatttaatttttctattg

SEQ ID NO: 124426 - DNA, 25 bp, Rattus norvegicus
agcacttgattttatttttctattg

SEQ ID NO: 124427 - DNA, 25 bp, Rattus norvegicus
agcacttgcaaaattgtctctgatg

SEQ ID NO: 124428 - DNA, 25 bp, Rattus norvegicus
agcacttgcaaatttgtctctgatg

SEQ ID NO: 124429 - DNA, 25 bp, Rattus norvegicus
agcacttgcatgaatactctggaga

SEQ ID NO: 124430 - DNA, 25 bp, Rattus norvegicus
agcacttgcatgtatactctggaga

SEQ ID NO: 124431 - DNA, 25 bp, Rattus norvegicus
agcacttgcccactatacataaggt

SEQ ID NO: 124432 - DNA, 25 bp, Rattus norvegicus
agcacttgcccactctttgtattcc

SEQ ID NO: 124433 - DNA, 25 bp, Rattus norvegicus
agcacttgcccagtatacataaggt

SEQ ID NO: 124434 - DNA, 25 bp, Rattus norvegicus
agcacttgcccagtctttgtattcc

SEQ ID NO: 124435 - DNA, 25 bp, Rattus norvegicus
agcacttgcctactcttgtttactg

SEQ ID NO: 124436 - DNA, 25 bp, Rattus norvegicus
agcacttgcctagtcttgtttactg

SEQ ID NO: 124437 - DNA, 25 bp, Rattus norvegicus
agcacttgcctgacatgcacaaaac

SEQ ID NO: 124438 - DNA, 25 bp, Rattus norvegicus
agcacttgcctgtcatgcacaaaac

SEQ ID NO: 124439 - DNA, 25 bp, Rattus norvegicus
agcacttgctctactgtgtacttga

SEQ ID NO: 124440 - DNA, 25 bp, Rattus norvegicus
agcacttgctcttctgtgtacttga

SEQ ID NO: 124441 - DNA, 25 bp, Rattus norvegicus
agcacttgctgcactgcagggctag

SEQ ID NO: 124442 - DNA, 25 bp, Rattus norvegicus
agcacttgctgctctgcagggctag

SEQ ID NO: 124443 - DNA, 25 bp, Rattus norvegicus
agcacttgcttacctctggactcag

SEQ ID NO: 124444 - DNA, 25 bp, Rattus norvegicus
agcacttgcttagctctggactcag

SEQ ID NO: 124445 - DNA, 25 bp, Rattus norvegicus
agcacttggactataaactgggaat

SEQ ID NO: 124446 - DNA, 25 bp, Rattus norvegicus
agcacttggactttaaactgggaat

SEQ ID NO: 124447 - DNA, 25 bp, Rattus norvegicus
agcacttggataatcagggcctctc

SEQ ID NO: 124448 - DNA, 25 bp, Rattus norvegicus
agcacttggatattcagggcctctc

SEQ ID NO: 124449 - DNA, 25 bp, Rattus norvegicus
agcacttggttgaaattgtacttga

SEQ ID NO: 124450 - DNA, 25 bp, Rattus norvegicus
agcacttggttgtaattgtacttga

SEQ ID NO: 124451 - DNA, 25 bp, Rattus norvegicus
agcacttgtcatcccaatgctttga

SEQ ID NO: 124452 - DNA, 25 bp, Rattus norvegicus
agcacttgtcatgccaatgctttga

SEQ ID NO: 124453 - DNA, 25 bp, Rattus norvegicus
agcacttgttgcacatgatggtgga

SEQ ID NO: 124454 - DNA, 25 bp, Rattus norvegicus
agcacttgttgctcatgatggtgga

SEQ ID NO: 124455 - DNA, 25 bp, Rattus norvegicus
agcacttgttggctgtttagcacag

SEQ ID NO: 124456 - DNA, 25 bp, Rattus norvegicus
agcacttgttgggtgtttagcacag

SEQ ID NO: 124457 - DNA, 25 bp, Rattus norvegicus
agcactttaccaactgatcttcatc

SEQ ID NO: 124458 - DNA, 25 bp, Rattus norvegicus
agcactttaccatctgatcttcatc

SEQ ID NO: 124459 - DNA, 25 bp, Rattus norvegicus
agcactttatatccctgtctaaggt

SEQ ID NO: 124460 - DNA, 25 bp, Rattus norvegicus
agcactttatatgcctgtctaaggt

SEQ ID NO: 124461 - DNA, 25 bp, Rattus norvegicus
agcactttatctattgaacttctaa

SEQ ID NO: 124462 - DNA, 25 bp, Rattus norvegicus
agcactttatcttttgaacttctaa

SEQ ID NO: 124463 - DNA, 25 bp, Rattus norvegicus
agcactttatgaagtccttctcaga

SEQ ID NO: 124464 - DNA, 25 bp, Rattus norvegicus
agcactttatgatgtccttctcaga

SEQ ID NO: 124465 - DNA, 25 bp, Rattus norvegicus
agcactttatgcagtctgtaatgga

SEQ ID NO: 124466 - DNA, 25 bp, Rattus norvegicus
agcactttatgctgtctgtaatgga

SEQ ID NO: 124467 - DNA, 25 bp, Rattus norvegicus
agcactttattactgttcttaaggc

SEQ ID NO: 124468 - DNA, 25 bp, Rattus norvegicus
agcactttattagtgttcttaaggc

SEQ ID NO: 124469 - DNA, 25 bp, Rattus norvegicus
agcactttcaaacccacaattgaga

SEQ ID NO: 124470 - DNA, 25 bp, Rattus norvegicus
agcactttcaaagccacaattgaga

SEQ ID NO: 124471 - DNA, 25 bp, Rattus norvegicus
agcactttcaacagacgtcatcatc

SEQ ID NO: 124472 - DNA, 25 bp, Rattus norvegicus
agcactttcaactgacgtcatcatc

SEQ ID NO: 124473 - DNA, 25 bp, Rattus norvegicus
agcactttcagtcaggcttcgacct

SEQ ID NO: 124474 - DNA, 25 bp, Rattus norvegicus
agcactttcagtgaggcttcgacct

SEQ ID NO: 124475 - DNA, 25 bp, Rattus norvegicus
agcactttcatgaagtttaagggaa

SEQ ID NO: 124476 - DNA, 25 bp, Rattus norvegicus
agcactttcatgtagtttaagggaa

SEQ ID NO: 124477 - DNA, 25 bp, Rattus norvegicus
agcactttccttctgcatttggaga

SEQ ID NO: 124478 - DNA, 25 bp, Rattus norvegicus
agcactttccttgtgcatttggaga

SEQ ID NO: 124479 - DNA, 25 bp, Rattus norvegicus
agcactttgaggcacctccagagtg

SEQ ID NO: 124480 - DNA, 25 bp, Rattus norvegicus
agcactttgagggacctccagagtg

SEQ ID NO: 124481 - DNA, 25 bp, Rattus norvegicus
agcactttgattctatgcctccttg

SEQ ID NO: 124482 - DNA, 25 bp, Rattus norvegicus
agcactttgattgtatgcctccttg

SEQ ID NO: 124483 - DNA, 25 bp, Rattus norvegicus
agcactttgcacacaattcttgtat

SEQ ID NO: 124484 - DNA, 25 bp, Rattus norvegicus
agcactttgcactcaattcttgtat

SEQ ID NO: 124485 - DNA, 25 bp, Rattus norvegicus
agcactttgcttaaatccacaagag

SEQ ID NO: 124486 - DNA, 25 bp, Rattus norvegicus
agcactttgctttaatccacaagag

SEQ ID NO: 124487 - DNA, 25 bp, Rattus norvegicus
agcactttggaaccattctcagccc

SEQ ID NO: 124488 - DNA, 25 bp, Rattus norvegicus
agcactttggaagcattctcagccc

SEQ ID NO: 124489 - DNA, 25 bp, Rattus norvegicus
agcactttggtccagctagagcagg

SEQ ID NO: 124490 - DNA, 25 bp, Rattus norvegicus
agcactttggtcgagctagagcagg

SEQ ID NO: 124491 - DNA, 25 bp, Rattus norvegicus
agcactttgtgcattctgaatttta

SEQ ID NO: 124492 - DNA, 25 bp, Rattus norvegicus
agcactttgtgctttctgaatttta

SEQ ID NO: 124493 - DNA, 25 bp, Rattus norvegicus
agcacttttatcaagttcctgggag

SEQ ID NO: 124494 - DNA, 25 bp, Rattus norvegicus
agcacttttatctagttcctgggag

SEQ ID NO: 124495 - DNA, 25 bp, Rattus norvegicus
agcacttttctgcttgccactgaaa

SEQ ID NO: 124496 - DNA, 25 bp, Rattus norvegicus
agcacttttctggttgccactgaaa

SEQ ID NO: 124497 - DNA, 25 bp, Rattus norvegicus
agcacttttgaccaagtcctgttac

SEQ ID NO: 124498 - DNA, 25 bp, Rattus norvegicus
agcacttttgacgaagtcctgttac

SEQ ID NO: 124499 - DNA, 25 bp, Rattus norvegicus
agcacttttgagacgtctttcagaa

SEQ ID NO: 124500 - DNA, 25 bp, Rattus norvegicus
agcacttttgagtcgtctttcagaa

SEQ ID NO: 124501 - DNA, 25 bp, Rattus norvegicus
agcacttttggtactagagcaggac

SEQ ID NO: 124502 - DNA, 25 bp, Rattus norvegicus
agcacttttggtcgtggtaccagca

SEQ ID NO: 124503 - DNA, 25 bp, Rattus norvegicus
agcacttttggtggtggtaccagca

SEQ ID NO: 124504 - DNA, 25 bp, Rattus norvegicus
agcacttttggttctagagcaggac

SEQ ID NO: 124505 - DNA, 25 bp, Rattus norvegicus
agcacttttgtcagcttccagaaaa

SEQ ID NO: 124506 - DNA, 25 bp, Rattus norvegicus
agcacttttgtctgcttccagaaaa

SEQ ID NO: 124507 - DNA, 25 bp, Rattus norvegicus
agcacttttgtgagccagacactat

SEQ ID NO: 124508 - DNA, 25 bp, Rattus norvegicus
agcacttttgtgtgccagacactat

SEQ ID NO: 124509 - DNA, 25 bp, Rattus norvegicus
agcactttttcaaaggcccctattg

SEQ ID NO: 124510 - DNA, 25 bp, Rattus norvegicus
agcactttttcataggcccctattg

SEQ ID NO: 124511 - DNA, 25 bp, Rattus norvegicus
agcagaaaactacctgtctcaacca

SEQ ID NO: 124512 - DNA, 25 bp, Rattus norvegicus
agcagaaaactagctgtctcaacca

SEQ ID NO: 124513 - DNA, 25 bp, Rattus norvegicus
agcagaaagaaaagcccctgacttc

SEQ ID NO: 124514 - DNA, 25 bp, Rattus norvegicus
agcagaaagaaatgcccctgacttc

SEQ ID NO: 124515 - DNA, 25 bp, Rattus norvegicus
agcagaaataaaccttccttagaga

SEQ ID NO: 124516 - DNA, 25 bp, Rattus norvegicus
agcagaaataaagcttccttagaga

SEQ ID NO: 124517 - DNA, 25 bp, Rattus norvegicus
agcagaaattaccatcagcttccca

SEQ ID NO: 124518 - DNA, 25 bp, Rattus norvegicus
agcagaaattacgatcagcttccca

SEQ ID NO: 124519 - DNA, 25 bp, Rattus norvegicus
agcagaacagctagcggccgaggca

SEQ ID NO: 124520 - DNA, 25 bp, Rattus norvegicus
agcagaacagcttgcggccgaggca

SEQ ID NO: 124521 - DNA, 25 bp, Rattus norvegicus
agcagaacagttcatgccgatctta

SEQ ID NO: 124522 - DNA, 25 bp, Rattus norvegicus
agcagaacagttgatgccgatctta

SEQ ID NO: 124523 - DNA, 25 bp, Rattus norvegicus
agcagaacatcgatcccaaggccac

SEQ ID NO: 124524 - DNA, 25 bp, Rattus norvegicus
agcagaacatcgttcccaaggccac

SEQ ID NO: 124525 - DNA, 25 bp, Rattus norvegicus
agcagaaccattacctcagaccttt

SEQ ID NO: 124526 - DNA, 25 bp, Rattus norvegicus
agcagaaccatttcctcagaccttt

SEQ ID NO: 124527 - DNA, 25 bp, Rattus norvegicus
agcagaacccagaccgggacaggca

SEQ ID NO: 124528 - DNA, 25 bp, Rattus norvegicus
agcagaacccagtccgggacaggca

SEQ ID NO: 124529 - DNA, 25 bp, Rattus norvegicus
agcagaacctctcggatgcgctgtt

SEQ ID NO: 124530 - DNA, 25 bp, Rattus norvegicus
agcagaacctctgggatgcgctgtt

SEQ ID NO: 124531 - DNA, 25 bp, Rattus norvegicus
agcagaacctgcaggctagccgcga

SEQ ID NO: 124532 - DNA, 25 bp, Rattus norvegicus
agcagaacctgctggctagccgcga

SEQ ID NO: 124533 - DNA, 25 bp, Rattus norvegicus
agcagaacgtggcaccactcctgtc

SEQ ID NO: 124534 - DNA, 25 bp, Rattus norvegicus
agcagaacgtgggaccactcctgtc

SEQ ID NO: 124535 - DNA, 25 bp, Rattus norvegicus
agcagaactagacaggtttcctcag

SEQ ID NO: 124536 - DNA, 25 bp, Rattus norvegicus
agcagaactagagaggtttcctcag

SEQ ID NO: 124537 - DNA, 25 bp, Rattus norvegicus
agcagaactgctcttgctaggcaag

SEQ ID NO: 124538 - DNA, 25 bp, Rattus norvegicus
agcagaactgctgttgctaggcaag

SEQ ID NO: 124539 - DNA, 25 bp, Rattus norvegicus
agcagaacttcaaattcactccctg

SEQ ID NO: 124540 - DNA, 25 bp, Rattus norvegicus
agcagaacttcatattcactccctg

SEQ ID NO: 124541 - DNA, 25 bp, Rattus norvegicus
agcagaagaaataccattcatgcat

SEQ ID NO: 124542 - DNA, 25 bp, Rattus norvegicus
agcagaagaaattccattcatgcat

SEQ ID NO: 124543 - DNA, 25 bp, Rattus norvegicus
agcagaagaagacccttcggcttcc

SEQ ID NO: 124544 - DNA, 25 bp, Rattus norvegicus
agcagaagaagagccttcggcttcc

SEQ ID NO: 124545 - DNA, 25 bp, Rattus norvegicus
agcagaagacttccttccttagcaa

SEQ ID NO: 124546 - DNA, 25 bp, Rattus norvegicus
agcagaagacttgcttccttagcaa

SEQ ID NO: 124547 - DNA, 25 bp, Rattus norvegicus
agcagaagatagcttttgagcctcc

SEQ ID NO: 124548 - DNA, 25 bp, Rattus norvegicus
agcagaagataggttttgagcctcc

SEQ ID NO: 124549 - DNA, 25 bp, Rattus norvegicus
agcagaagcctgctggcacattcag

SEQ ID NO: 124550 - DNA, 25 bp, Rattus norvegicus
agcagaagcctggtggcacattcag

SEQ ID NO: 124551 - DNA, 25 bp, Rattus norvegicus
agcagaagctgtctaaaggttacaa

SEQ ID NO: 124552 - DNA, 25 bp, Rattus norvegicus
agcagaagctgtgtaaaggttacaa

SEQ ID NO: 124553 - DNA, 25 bp, Rattus norvegicus
agcagaaggagacgtaccgccgcat

SEQ ID NO: 124554 - DNA, 25 bp, Rattus norvegicus
agcagaaggagaggtaccgccgcat

SEQ ID NO: 124555 - DNA, 25 bp, Rattus norvegicus
agcagaagggtgactgagcgcctca

SEQ ID NO: 124556 - DNA, 25 bp, Rattus norvegicus
agcagaagggtgtctgagcgcctca

SEQ ID NO: 124557 - DNA, 25 bp, Rattus norvegicus
agcagaaggtgaagcgtcagctgac

SEQ ID NO: 124558 - DNA, 25 bp, Rattus norvegicus
agcagaaggtgatgcgtcagctgac

SEQ ID NO: 124559 - DNA, 25 bp, Rattus norvegicus
agcagaagttgcagacagcccacca

SEQ ID NO: 124560 - DNA, 25 bp, Rattus norvegicus
agcagaagttgctgacagcccacca

SEQ ID NO: 124561 - DNA, 25 bp, Rattus norvegicus
agcagaatctacctgttactcggat

SEQ ID NO: 124562 - DNA, 25 bp, Rattus norvegicus
agcagaatctacgtgttactcggat

SEQ ID NO: 124563 - DNA, 25 bp, Rattus norvegicus
agcagaatgagaaggccccagctcc

SEQ ID NO: 124564 - DNA, 25 bp, Rattus norvegicus
agcagaatgagatggccccagctcc

SEQ ID NO: 124565 - DNA, 25 bp, Rattus norvegicus
agcagaatgcataacactcggtcct

SEQ ID NO: 124566 - DNA, 25 bp, Rattus norvegicus
agcagaatgcattacactcggtcct

SEQ ID NO: 124567 - DNA, 25 bp, Rattus norvegicus
agcagaatggacacttctacgaccc

SEQ ID NO: 124568 - DNA, 25 bp, Rattus norvegicus
agcagaatggactcttctacgaccc

SEQ ID NO: 124569 - DNA, 25 bp, Rattus norvegicus
agcagaatttgtaagtgtggtattt

SEQ ID NO: 124570 - DNA, 25 bp, Rattus norvegicus
agcagaatttgttagtgtggtattt

SEQ ID NO: 124571 - DNA, 25 bp, Rattus norvegicus
agcagacaagggacaagctggagct

SEQ ID NO: 124572 - DNA, 25 bp, Rattus norvegicus
agcagacaagggtcaagctggagct

SEQ ID NO: 124573 - DNA, 25 bp, Rattus norvegicus
agcagacacagccttgctcaagcaa

SEQ ID NO: 124574 - DNA, 25 bp, Rattus norvegicus
agcagacacagcgttgctcaagcaa

SEQ ID NO: 124575 - DNA, 25 bp, Rattus norvegicus
agcagacacctaatcctaaacaatg

SEQ ID NO: 124576 - DNA, 25 bp, Rattus norvegicus
agcagacacctattcctaaacaatg

SEQ ID NO: 124577 - DNA, 25 bp, Rattus norvegicus
agcagacactgcagagcccatgtga

SEQ ID NO: 124578 - DNA, 25 bp, Rattus norvegicus
agcagacactgctgagcccatgtga

SEQ ID NO: 124579 - DNA, 25 bp, Rattus norvegicus
agcagacacttcagggtggccggtc

SEQ ID NO: 124580 - DNA, 25 bp, Rattus norvegicus
agcagacacttccaagatctcgtac

SEQ ID NO: 124581 - DNA, 25 bp, Rattus norvegicus
agcagacacttcgaagatctcgtac

SEQ ID NO: 124582 - DNA, 25 bp, Rattus norvegicus
agcagacacttctgggtggccggtc

SEQ ID NO: 124583 - DNA, 25 bp, Rattus norvegicus
agcagacagggtatccggtgccagt

SEQ ID NO: 124584 - DNA, 25 bp, Rattus norvegicus
agcagacagggtttccggtgccagt

SEQ ID NO: 124585 - DNA, 25 bp, Rattus norvegicus
agcagacaggtgctctcttgagtcc

SEQ ID NO: 124586 - DNA, 25 bp, Rattus norvegicus
agcagacaggtggtctcttgagtcc

SEQ ID NO: 124587 - DNA, 25 bp, Rattus norvegicus
agcagacagtccatccgcatggcaa

SEQ ID NO: 124588 - DNA, 25 bp, Rattus norvegicus
agcagacagtccttccgcatggcaa

SEQ ID NO: 124589 - DNA, 25 bp, Rattus norvegicus
agcagacagtggatgaggccccttc

SEQ ID NO: 124590 - DNA, 25 bp, Rattus norvegicus
agcagacagtggttgaggccccttc

SEQ ID NO: 124591 - DNA, 25 bp, Rattus norvegicus
agcagacagtgtatattcatcccaa

SEQ ID NO: 124592 - DNA, 25 bp, Rattus norvegicus
agcagacagtgtttattcatcccaa

SEQ ID NO: 124593 - DNA, 25 bp, Rattus norvegicus
agcagacatagtagctcacaactgt

SEQ ID NO: 124594 - DNA, 25 bp, Rattus norvegicus
agcagacatagttgctcacaactgt

SEQ ID NO: 124595 - DNA, 25 bp, Rattus norvegicus
agcagacatctcaagtttccagcat

SEQ ID NO: 124596 - DNA, 25 bp, Rattus norvegicus
agcagacatctctagtttccagcat

SEQ ID NO: 124597 - DNA, 25 bp, Rattus norvegicus
agcagacatgctaggtggttttcag

SEQ ID NO: 124598 - DNA, 25 bp, Rattus norvegicus
agcagacatgcttggtggttttcag

SEQ ID NO: 124599 - DNA, 25 bp, Rattus norvegicus
agcagaccagagacagacctctctc

SEQ ID NO: 124600 - DNA, 25 bp, Rattus norvegicus
agcagaccagagtcagacctctctc

SEQ ID NO: 124601 - DNA, 25 bp, Rattus norvegicus
agcagaccatcaaggacctgcagca

SEQ ID NO: 124602 - DNA, 25 bp, Rattus norvegicus
agcagaccatcatggacctgcagca

SEQ ID NO: 124603 - DNA, 25 bp, Rattus norvegicus
agcagaccatctaagttccttgaac

SEQ ID NO: 124604 - DNA, 25 bp, Rattus norvegicus
agcagaccatcttagttccttgaac

SEQ ID NO: 124605 - DNA, 25 bp, Rattus norvegicus
agcagaccatggaggctggcattca

SEQ ID NO: 124606 - DNA, 25 bp, Rattus norvegicus
agcagaccatggtggctggcattca

SEQ ID NO: 124607 - DNA, 25 bp, Rattus norvegicus
agcagaccctacaaaaatcaggtat

SEQ ID NO: 124608 - DNA, 25 bp, Rattus norvegicus
agcagaccctactaaaatcaggtat

SEQ ID NO: 124609 - DNA, 25 bp, Rattus norvegicus
agcagaccctccatttctgagtggt

SEQ ID NO: 124610 - DNA, 25 bp, Rattus norvegicus
agcagaccctccttttctgagtggt

SEQ ID NO: 124611 - DNA, 25 bp, Rattus norvegicus
agcagaccctgcattactgatgtga

SEQ ID NO: 124612 - DNA, 25 bp, Rattus norvegicus
agcagaccctgctttactgatgtga

SEQ ID NO: 124613 - DNA, 25 bp, Rattus norvegicus
agcagaccgcgtatcctgagaaact

SEQ ID NO: 124614 - DNA, 25 bp, Rattus norvegicus
agcagaccgcgtttcctgagaaact

SEQ ID NO: 124615 - DNA, 25 bp, Rattus norvegicus
agcagacctactacagatgtatata

SEQ ID NO: 124616 - DNA, 25 bp, Rattus norvegicus
agcagacctacttcagatgtatata

SEQ ID NO: 124617 - DNA, 25 bp, Rattus norvegicus
agcagacctagacaagtgttcactt

SEQ ID NO: 124618 - DNA, 25 bp, Rattus norvegicus
agcagacctagagaagtgttcactt

SEQ ID NO: 124619 - DNA, 25 bp, Rattus norvegicus
agcagacctctacatctcattgtta

SEQ ID NO: 124620 - DNA, 25 bp, Rattus norvegicus
agcagacctctagatctcattgtta

SEQ ID NO: 124621 - DNA, 25 bp, Rattus norvegicus
agcagacctggcattcgagctgaga

SEQ ID NO: 124622 - DNA, 25 bp, Rattus norvegicus
agcagacctggctttcgagctgaga

SEQ ID NO: 124623 - DNA, 25 bp, Rattus norvegicus
agcagaccttcaagatccgcatgga

SEQ ID NO: 124624 - DNA, 25 bp, Rattus norvegicus
agcagaccttcatgatccgcatgga

SEQ ID NO: 124625 - DNA, 25 bp, Rattus norvegicus
agcagacgcggcaagaatcagccct

SEQ ID NO: 124626 - DNA, 25 bp, Rattus norvegicus
agcagacgcggctagaatcagccct

SEQ ID NO: 124627 - DNA, 25 bp, Rattus norvegicus
agcagacggatgctcccggaagcct

SEQ ID NO: 124628 - DNA, 25 bp, Rattus norvegicus
agcagacggatggtcccggaagcct

SEQ ID NO: 124629 - DNA, 25 bp, Rattus norvegicus
agcagacggtgcagccgcaggctca

SEQ ID NO: 124630 - DNA, 25 bp, Rattus norvegicus
agcagacggtgctgccgcaggctca

SEQ ID NO: 124631 - DNA, 25 bp, Rattus norvegicus
agcagacgtgctcagttctgtacga

SEQ ID NO: 124632 - DNA, 25 bp, Rattus norvegicus
agcagacgtgctgagttctgtacga

SEQ ID NO: 124633 - DNA, 25 bp, Rattus norvegicus
agcagactacggagcctcatttctc

SEQ ID NO: 124634 - DNA, 25 bp, Rattus norvegicus
agcagactacggtgcctcatttctc

SEQ ID NO: 124635 - DNA, 25 bp, Rattus norvegicus
agcagactcacactccttggattta

SEQ ID NO: 124636 - DNA, 25 bp, Rattus norvegicus
agcagactcacagtccttggattta

SEQ ID NO: 124637 - DNA, 25 bp, Rattus norvegicus
agcagactcacgcttggtatgaagt

SEQ ID NO: 124638 - DNA, 25 bp, Rattus norvegicus
agcagactcacggttggtatgaagt

SEQ ID NO: 124639 - DNA, 25 bp, Rattus norvegicus
agcagactccatctgggttgtgaga

SEQ ID NO: 124640 - DNA, 25 bp, Rattus norvegicus
agcagactccatgtgggttgtgaga

SEQ ID NO: 124641 - DNA, 25 bp, Rattus norvegicus
agcagactcggcacatctgagtaga

SEQ ID NO: 124642 - DNA, 25 bp, Rattus norvegicus
agcagactcggctcatctgagtaga

SEQ ID NO: 124643 - DNA, 25 bp, Rattus norvegicus
agcagactctgcatcgtgaaggaat

SEQ ID NO: 124644 - DNA, 25 bp, Rattus norvegicus
agcagactctgcttcgtgaaggaat

SEQ ID NO: 124645 - DNA, 25 bp, Rattus norvegicus
agcagactctggctatggcctgaga

SEQ ID NO: 124646 - DNA, 25 bp, Rattus norvegicus
agcagactctgggtatggcctgaga

SEQ ID NO: 124647 - DNA, 25 bp, Rattus norvegicus
agcagactctgtctattgccaggga

SEQ ID NO: 124648 - DNA, 25 bp, Rattus norvegicus
agcagactctgtgtattgccaggga

SEQ ID NO: 124649 - DNA, 25 bp, Rattus norvegicus
agcagactgattatctcacaagacc

SEQ ID NO: 124650 - DNA, 25 bp, Rattus norvegicus
agcagactgattttctcacaagacc

SEQ ID NO: 124651 - DNA, 25 bp, Rattus norvegicus
agcagactgcggctgtacctatcac

SEQ ID NO: 124652 - DNA, 25 bp, Rattus norvegicus
agcagactgcgggtgtacctatcac

SEQ ID NO: 124653 - DNA, 25 bp, Rattus norvegicus
agcagactgctgatcggtgactttg

SEQ ID NO: 124654 - DNA, 25 bp, Rattus norvegicus
agcagactgctgctcgctgggttct

SEQ ID NO: 124655 - DNA, 25 bp, Rattus norvegicus
agcagactgctggtcgctgggttct

SEQ ID NO: 124656 - DNA, 25 bp, Rattus norvegicus
agcagactgctgttcggtgactttg

SEQ ID NO: 124657 - DNA, 25 bp, Rattus norvegicus
agcagactggacaggcacatgggaa

SEQ ID NO: 124658 - DNA, 25 bp, Rattus norvegicus
agcagactggactggcacatgggaa

SEQ ID NO: 124659 - DNA, 25 bp, Rattus norvegicus
agcagactggatatgcatctttgca

SEQ ID NO: 124660 - DNA, 25 bp, Rattus norvegicus
agcagactggatttgcatctttgca

SEQ ID NO: 124661 - DNA, 25 bp, Rattus norvegicus
agcagactgtagctgcagctcttgg

SEQ ID NO: 124662 - DNA, 25 bp, Rattus norvegicus
agcagactgtaggtgcagctcttgg

SEQ ID NO: 124663 - DNA, 25 bp, Rattus norvegicus
agcagacttattacctgtaccttca

SEQ ID NO: 124664 - DNA, 25 bp, Rattus norvegicus
agcagacttatttcctgtaccttca

SEQ ID NO: 124665 - DNA, 25 bp, Rattus norvegicus
agcagacttcttcgctttaatagaa

SEQ ID NO: 124666 - DNA, 25 bp, Rattus norvegicus
agcagacttcttggctttaatagaa

SEQ ID NO: 124667 - DNA, 25 bp, Rattus norvegicus
agcagacttgtgcagaggacttctt

SEQ ID NO: 124668 - DNA, 25 bp, Rattus norvegicus
agcagacttgtggagaggacttctt

SEQ ID NO: 124669 - DNA, 25 bp, Rattus norvegicus
agcagagaagaacaatttcctccta

SEQ ID NO: 124670 - DNA, 25 bp, Rattus norvegicus
agcagagaagaagaatttcctccta

SEQ ID NO: 124671 - DNA, 25 bp, Rattus norvegicus
agcagagacgctattcacacgacgc

SEQ ID NO: 124672 - DNA, 25 bp, Rattus norvegicus
agcagagacgcttttcacacgacgc

SEQ ID NO: 124673 - DNA, 25 bp, Rattus norvegicus
agcagagactaccaagccccagaga

SEQ ID NO: 124674 - DNA, 25 bp, Rattus norvegicus
agcagagactacgaagccccagaga

SEQ ID NO: 124675 - DNA, 25 bp, Rattus norvegicus
agcagagacttgcttgaagccctga

SEQ ID NO: 124676 - DNA, 25 bp, Rattus norvegicus
agcagagacttggttgaagccctga

SEQ ID NO: 124677 - DNA, 25 bp, Rattus norvegicus
agcagagagagcaatctcaagcaga

SEQ ID NO: 124678 - DNA, 25 bp, Rattus norvegicus
agcagagagagctatctcaagcaga

SEQ ID NO: 124679 - DNA, 25 bp, Rattus norvegicus
agcagagagcagacacaccacagga

SEQ ID NO: 124680 - DNA, 25 bp, Rattus norvegicus
agcagagagcagtcacaccacagga

SEQ ID NO: 124681 - DNA, 25 bp, Rattus norvegicus
agcagagagtgcctttctgtctccc

SEQ ID NO: 124682 - DNA, 25 bp, Rattus norvegicus
agcagagagtgcgtttctgtctccc

SEQ ID NO: 124683 - DNA, 25 bp, Rattus norvegicus
agcagagatctgaattcatttggga

SEQ ID NO: 124684 - DNA, 25 bp, Rattus norvegicus
agcagagatctgtattcatttggga

SEQ ID NO: 124685 - DNA, 25 bp, Rattus norvegicus
agcagagattcgaccagcaacacat

SEQ ID NO: 124686 - DNA, 25 bp, Rattus norvegicus
agcagagattcgtccagcaacacat

SEQ ID NO: 124687 - DNA, 25 bp, Rattus norvegicus
agcagagcaacaaccgacgtcttca

SEQ ID NO: 124688 - DNA, 25 bp, Rattus norvegicus
agcagagcaacatccgacgtcttca

SEQ ID NO: 124689 - DNA, 25 bp, Rattus norvegicus
agcagagcacatcacctcagttcag

SEQ ID NO: 124690 - DNA, 25 bp, Rattus norvegicus
agcagagcacatgacctcagttcag

SEQ ID NO: 124691 - DNA, 25 bp, Rattus norvegicus
agcagagcagatcttgctctcccaa

SEQ ID NO: 124692 - DNA, 25 bp, Rattus norvegicus
agcagagcagatgttgctctcccaa

SEQ ID NO: 124693 - DNA, 25 bp, Rattus norvegicus
agcagagcagcgatccatccaatgc

SEQ ID NO: 124694 - DNA, 25 bp, Rattus norvegicus
agcagagcagcgttccatccaatgc

SEQ ID NO: 124695 - DNA, 25 bp, Rattus norvegicus
agcagagcaggccatagaagtcccc

SEQ ID NO: 124696 - DNA, 25 bp, Rattus norvegicus
agcagagcaggcgatagaagtcccc

SEQ ID NO: 124697 - DNA, 25 bp, Rattus norvegicus
agcagagcagggagccagggattct

SEQ ID NO: 124698 - DNA, 25 bp, Rattus norvegicus
agcagagcagggtgccagggattct

SEQ ID NO: 124699 - DNA, 25 bp, Rattus norvegicus
agcagagcattgaggattgggcaaa

SEQ ID NO: 124700 - DNA, 25 bp, Rattus norvegicus
agcagagcattgtggattgggcaaa

SEQ ID NO: 124701 - DNA, 25 bp, Rattus norvegicus
agcagagccagtacttggccttgga

SEQ ID NO: 124702 - DNA, 25 bp, Rattus norvegicus
agcagagccagttcttggccttgga

SEQ ID NO: 124703 - DNA, 25 bp, Rattus norvegicus
agcagagcgtgcagacctcaagctg

SEQ ID NO: 124704 - DNA, 25 bp, Rattus norvegicus
agcagagcgtgctgacctcaagctg

SEQ ID NO: 124705 - DNA, 25 bp, Rattus norvegicus
agcagagcgtgtcttcccgtggtac

SEQ ID NO: 124706 - DNA, 25 bp, Rattus norvegicus
agcagagcgtgtgttcccgtggtac

SEQ ID NO: 124707 - DNA, 25 bp, Rattus norvegicus
agcagagctaccagaaaaaggctta

SEQ ID NO: 124708 - DNA, 25 bp, Rattus norvegicus
agcagagctacctgaaaaaggctta

SEQ ID NO: 124709 - DNA, 25 bp, Rattus norvegicus
agcagagctagccacagaaccttta

SEQ ID NO: 124710 - DNA, 25 bp, Rattus norvegicus
agcagagctagcgacagaaccttta

SEQ ID NO: 124711 - DNA, 25 bp, Rattus norvegicus
agcagagctccgaccatgtttgttg

SEQ ID NO: 124712 - DNA, 25 bp, Rattus norvegicus
agcagagctccgtccatgtttgttg

SEQ ID NO: 124713 - DNA, 25 bp, Rattus norvegicus
agcagagctctgacacaggtgatga

SEQ ID NO: 124714 - DNA, 25 bp, Rattus norvegicus
agcagagctctgtcacaggtgatga

SEQ ID NO: 124715 - DNA, 25 bp, Rattus norvegicus
agcagagctggtctcacctgggttc

SEQ ID NO: 124716 - DNA, 25 bp, Rattus norvegicus
agcagagctggtgtcacctgggttc

SEQ ID NO: 124717 - DNA, 25 bp, Rattus norvegicus
agcagagctgtcatccactgcttta

SEQ ID NO: 124718 - DNA, 25 bp, Rattus norvegicus
agcagagctgtcttccactgcttta

SEQ ID NO: 124719 - DNA, 25 bp, Rattus norvegicus
agcagagctttacagaaccaactaa

SEQ ID NO: 124720 - DNA, 25 bp, Rattus norvegicus
agcagagctttagagaaccaactaa

SEQ ID NO: 124721 - DNA, 25 bp, Rattus norvegicus
agcagaggaaccatcccactggaaa

SEQ ID NO: 124722 - DNA, 25 bp, Rattus norvegicus
agcagaggaaccttcccactggaaa

SEQ ID NO: 124723 - DNA, 25 bp, Rattus norvegicus
agcagaggaatcaaacccagcccga

SEQ ID NO: 124724 - DNA, 25 bp, Rattus norvegicus
agcagaggaatctaacccagcccga

SEQ ID NO: 124725 - DNA, 25 bp, Rattus norvegicus
agcagaggacgaagacaaggccaat

SEQ ID NO: 124726 - DNA, 25 bp, Rattus norvegicus
agcagaggacgatgacaaggccaat

SEQ ID NO: 124727 - DNA, 25 bp, Rattus norvegicus
agcagaggcaccaggctgcttagac

SEQ ID NO: 124728 - DNA, 25 bp, Rattus norvegicus
agcagaggcacctggctgcttagac

SEQ ID NO: 124729 - DNA, 25 bp, Rattus norvegicus
agcagaggcatccagtgaaccgaga

SEQ ID NO: 124730 - DNA, 25 bp, Rattus norvegicus
agcagaggcatcgagtgaaccgaga

SEQ ID NO: 124731 - DNA, 25 bp, Rattus norvegicus
agcagaggcccgcaagacttggtac

SEQ ID NO: 124732 - DNA, 25 bp, Rattus norvegicus
agcagaggcccggaagacttggtac

SEQ ID NO: 124733 - DNA, 25 bp, Rattus norvegicus
agcagaggcgctaccaggagctcct

SEQ ID NO: 124734 - DNA, 25 bp, Rattus norvegicus
agcagaggcgcttccaggagctcct

SEQ ID NO: 124735 - DNA, 25 bp, Rattus norvegicus
agcagaggctccacctacagaagag

SEQ ID NO: 124736 - DNA, 25 bp, Rattus norvegicus
agcagaggctcctcctacagaagag

SEQ ID NO: 124737 - DNA, 25 bp, Rattus norvegicus
agcagagggagcagtccttcaccaa

SEQ ID NO: 124738 - DNA, 25 bp, Rattus norvegicus
agcagagggagctgtccttcaccaa

SEQ ID NO: 124739 - DNA, 25 bp, Rattus norvegicus
agcagagggtggatcgcacgcttat

SEQ ID NO: 124740 - DNA, 25 bp, Rattus norvegicus
agcagagggtggttcgcacgcttat

SEQ ID NO: 124741 - DNA, 25 bp, Rattus norvegicus
agcagaggtactagacggctcccca

SEQ ID NO: 124742 - DNA, 25 bp, Rattus norvegicus
agcagaggtacttgacggctcccca

SEQ ID NO: 124743 - DNA, 25 bp, Rattus norvegicus
agcagaggtcatatgaaggcactta

SEQ ID NO: 124744 - DNA, 25 bp, Rattus norvegicus
agcagaggtcatttgaaggcactta

SEQ ID NO: 124745 - DNA, 25 bp, Rattus norvegicus
agcagaggtgccatgaacgcgcaga

SEQ ID NO: 124746 - DNA, 25 bp, Rattus norvegicus
agcagaggtgccttgaacgcgcaga

SEQ ID NO: 124747 - DNA, 25 bp, Rattus norvegicus
agcagaggtggacgtcactcagctt

SEQ ID NO: 124748 - DNA, 25 bp, Rattus norvegicus
agcagaggtggaggtcactcagctt

SEQ ID NO: 124749 - DNA, 25 bp, Rattus norvegicus
agcagaggtttcactatcaacggaa

SEQ ID NO: 124750 - DNA, 25 bp, Rattus norvegicus
agcagaggtttctctatcaacggaa

SEQ ID NO: 124751 - DNA, 25 bp, Rattus norvegicus
agcagagtagccatggcacccgctt

SEQ ID NO: 124752 - DNA, 25 bp, Rattus norvegicus
agcagagtagccttggcacccgctt

SEQ ID NO: 124753 - DNA, 25 bp, Rattus norvegicus
agcagagtatttacatcttgagtga

SEQ ID NO: 124754 - DNA, 25 bp, Rattus norvegicus
agcagagtattttcatcttgagtga

SEQ ID NO: 124755 - DNA, 25 bp, Rattus norvegicus
agcagagtccggctgattccaacaa

SEQ ID NO: 124756 - DNA, 25 bp, Rattus norvegicus
agcagagtccgggtgattccaacaa

SEQ ID NO: 124757 - DNA, 25 bp, Rattus norvegicus
agcagagtcctgaaacgtcagctaa

SEQ ID NO: 124758 - DNA, 25 bp, Rattus norvegicus
agcagagtcctgtaacgtcagctaa

SEQ ID NO: 124759 - DNA, 25 bp, Rattus norvegicus
agcagagtctgtcactaatgtcaca

SEQ ID NO: 124760 - DNA, 25 bp, Rattus norvegicus
agcagagtctgtctcattgccttgt

SEQ ID NO: 124761 - DNA, 25 bp, Rattus norvegicus
agcagagtctgtgactaatgtcaca

SEQ ID NO: 124762 - DNA, 25 bp, Rattus norvegicus
agcagagtctgtgtcattgccttgt

SEQ ID NO: 124763 - DNA, 25 bp, Rattus norvegicus
agcagagtcttgcatcaccctttgt

SEQ ID NO: 124764 - DNA, 25 bp, Rattus norvegicus
agcagagtcttggatcaccctttgt

SEQ ID NO: 124765 - DNA, 25 bp, Rattus norvegicus
agcagagtgccacgatgaccgccat

SEQ ID NO: 124766 - DNA, 25 bp, Rattus norvegicus
agcagagtgccaggatgaccgccat

SEQ ID NO: 124767 - DNA, 25 bp, Rattus norvegicus
agcagagtggttagtgctggctccc

SEQ ID NO: 124768 - DNA, 25 bp, Rattus norvegicus
agcagagtggtttgtgctggctccc

SEQ ID NO: 124769 - DNA, 25 bp, Rattus norvegicus
agcagagttccaaacgtgctaactt

SEQ ID NO: 124770 - DNA, 25 bp, Rattus norvegicus
agcagagttccatacgtgctaactt

SEQ ID NO: 124771 - DNA, 25 bp, Rattus norvegicus
agcagagtttatcgctcccaaggat

SEQ ID NO: 124772 - DNA, 25 bp, Rattus norvegicus
agcagagtttatggctcccaaggat

SEQ ID NO: 124773 - DNA, 25 bp, Rattus norvegicus
agcagagtttctagctggtcaccca

SEQ ID NO: 124774 - DNA, 25 bp, Rattus norvegicus
agcagagtttcttgctggtcaccca

SEQ ID NO: 124775 - DNA, 25 bp, Rattus norvegicus
agcagataatctcccactacgagga

SEQ ID NO: 124776 - DNA, 25 bp, Rattus norvegicus
agcagataatctgccactacgagga

SEQ ID NO: 124777 - DNA, 25 bp, Rattus norvegicus
agcagatactgcacatacaccttgg

SEQ ID NO: 124778 - DNA, 25 bp, Rattus norvegicus
agcagatactgctcatacaccttgg

SEQ ID NO: 124779 - DNA, 25 bp, Rattus norvegicus
agcagatactgtccaccctgtaaca

SEQ ID NO: 124780 - DNA, 25 bp, Rattus norvegicus
agcagatactgtgcaccctgtaaca

SEQ ID NO: 124781 - DNA, 25 bp, Rattus norvegicus
agcagatagtctcggccatcctgga

SEQ ID NO: 124782 - DNA, 25 bp, Rattus norvegicus
agcagatagtctgggccatcctgga

SEQ ID NO: 124783 - DNA, 25 bp, Rattus norvegicus
agcagatatgcaccttgacctttat

SEQ ID NO: 124784 - DNA, 25 bp, Rattus norvegicus
agcagatatgcagcttgacctttat

SEQ ID NO: 124785 - DNA, 25 bp, Rattus norvegicus
agcagatcacaaacctggaggaggt

SEQ ID NO: 124786 - DNA, 25 bp, Rattus norvegicus
agcagatcacaatcctggaggaggt

SEQ ID NO: 124787 - DNA, 25 bp, Rattus norvegicus
agcagatccaatccattcagcagtc

SEQ ID NO: 124788 - DNA, 25 bp, Rattus norvegicus
agcagatccaatgcattcagcagtc

SEQ ID NO: 124789 - DNA, 25 bp, Rattus norvegicus
agcagatccagcactatttcgcatg

SEQ ID NO: 124790 - DNA, 25 bp, Rattus norvegicus
agcagatccagctctatttcgcatg

SEQ ID NO: 124791 - DNA, 25 bp, Rattus norvegicus
agcagatccggacagggccctctgt

SEQ ID NO: 124792 - DNA, 25 bp, Rattus norvegicus
agcagatccggagagggccctctgt

SEQ ID NO: 124793 - DNA, 25 bp, Rattus norvegicus
agcagatcctgactgcagtgaacaa

SEQ ID NO: 124794 - DNA, 25 bp, Rattus norvegicus
agcagatcctgagtgcagtgaacaa

SEQ ID NO: 124795 - DNA, 25 bp, Rattus norvegicus
agcagatccttgatgcttagatatt

SEQ ID NO: 124796 - DNA, 25 bp, Rattus norvegicus
agcagatccttgttgcttagatatt

SEQ ID NO: 124797 - DNA, 25 bp, Rattus norvegicus
agcagatcgcagcacagggcttatg

SEQ ID NO: 124798 - DNA, 25 bp, Rattus norvegicus
agcagatcgcaggacagggcttatg

SEQ ID NO: 124799 - DNA, 25 bp, Rattus norvegicus
agcagatcgcccacaagggtggcaa

SEQ ID NO: 124800 - DNA, 25 bp, Rattus norvegicus
agcagatcgccctcaagggtggcaa

SEQ ID NO: 124801 - DNA, 25 bp, Rattus norvegicus
agcagatcggcccttcatttttctt

SEQ ID NO: 124802 - DNA, 25 bp, Rattus norvegicus
agcagatcggccgttcatttttctt

SEQ ID NO: 124803 - DNA, 25 bp, Rattus norvegicus
agcagatctacccatgcagttgtcc

SEQ ID NO: 124804 - DNA, 25 bp, Rattus norvegicus
agcagatctaccgatgcagttgtcc

SEQ ID NO: 124805 - DNA, 25 bp, Rattus norvegicus
agcagatctctgcagatgtacgaag

SEQ ID NO: 124806 - DNA, 25 bp, Rattus norvegicus
agcagatctctggagatgtacgaag

SEQ ID NO: 124807 - DNA, 25 bp, Rattus norvegicus
agcagatctgttcggtttgcttcct

SEQ ID NO: 124808 - DNA, 25 bp, Rattus norvegicus
agcagatctgttgggtttgcttcct

SEQ ID NO: 124809 - DNA, 25 bp, Rattus norvegicus
agcagatcttgtcccaaggtgctgt

SEQ ID NO: 124810 - DNA, 25 bp, Rattus norvegicus
agcagatcttgtgccaaggtgctgt

SEQ ID NO: 124811 - DNA, 25 bp, Rattus norvegicus
agcagatgacacaaacccttgcact

SEQ ID NO: 124812 - DNA, 25 bp, Rattus norvegicus
agcagatgacacacatcctggtggt

SEQ ID NO: 124813 - DNA, 25 bp, Rattus norvegicus
agcagatgacactaacccttgcact

SEQ ID NO: 124814 - DNA, 25 bp, Rattus norvegicus
agcagatgacactcatcctggtggt

SEQ ID NO: 124815 - DNA, 25 bp, Rattus norvegicus
agcagatgacagagcagtccgtgaa

SEQ ID NO: 124816 - DNA, 25 bp, Rattus norvegicus
agcagatgacagtgcagtccgtgaa

SEQ ID NO: 124817 - DNA, 25 bp, Rattus norvegicus
agcagatgaccccaacaatcaaggc

SEQ ID NO: 124818 - DNA, 25 bp, Rattus norvegicus
agcagatgacccgaacaatcaaggc

SEQ ID NO: 124819 - DNA, 25 bp, Rattus norvegicus
agcagatgaggccttggattcaagt

SEQ ID NO: 124820 - DNA, 25 bp, Rattus norvegicus
agcagatgaggcgttggattcaagt

SEQ ID NO: 124821 - DNA, 25 bp, Rattus norvegicus
agcagatgcagaactaaaccccgcc

SEQ ID NO: 124822 - DNA, 25 bp, Rattus norvegicus
agcagatgcagatctaaaccccgcc

SEQ ID NO: 124823 - DNA, 25 bp, Rattus norvegicus
agcagatgccacaatgcctagcaga

SEQ ID NO: 124824 - DNA, 25 bp, Rattus norvegicus
agcagatgccactatgcctagcaga

SEQ ID NO: 124825 - DNA, 25 bp, Rattus norvegicus
agcagatgcggtagggctccagaca

SEQ ID NO: 124826 - DNA, 25 bp, Rattus norvegicus
agcagatgcggttgggctccagaca

SEQ ID NO: 124827 - DNA, 25 bp, Rattus norvegicus
agcagatgctggagcttctggtgct

SEQ ID NO: 124828 - DNA, 25 bp, Rattus norvegicus
agcagatgctggtgcttctggtgct

SEQ ID NO: 124829 - DNA, 25 bp, Rattus norvegicus
agcagatggaaacgctcccgtgttc

SEQ ID NO: 124830 - DNA, 25 bp, Rattus norvegicus
agcagatggaaaggctcccgtgttc

SEQ ID NO: 124831 - DNA, 25 bp, Rattus norvegicus
agcagatggcccaggagagcatctt

SEQ ID NO: 124832 - DNA, 25 bp, Rattus norvegicus
agcagatggccctggagagcatctt

SEQ ID NO: 124833 - DNA, 25 bp, Rattus norvegicus
agcagatgtaccactgttactctca

SEQ ID NO: 124834 - DNA, 25 bp, Rattus norvegicus
agcagatgtacctctgttactctca

SEQ ID NO: 124835 - DNA, 25 bp, Rattus norvegicus
agcagatgtagccattcgctcatac

SEQ ID NO: 124836 - DNA, 25 bp, Rattus norvegicus
agcagatgtagcgattcgctcatac

SEQ ID NO: 124837 - DNA, 25 bp, Rattus norvegicus
agcagatgtctgctctttcccggga

SEQ ID NO: 124838 - DNA, 25 bp, Rattus norvegicus
agcagatgtctggtctttcccggga

SEQ ID NO: 124839 - DNA, 25 bp, Rattus norvegicus
agcagatgtcttcttgatgagctct

SEQ ID NO: 124840 - DNA, 25 bp, Rattus norvegicus
agcagatgtcttgttgatgagctct

SEQ ID NO: 124841 - DNA, 25 bp, Rattus norvegicus
agcagatgttgcagtttcctcaaaa

SEQ ID NO: 124842 - DNA, 25 bp, Rattus norvegicus
agcagatgttgctgtttcctcaaaa

SEQ ID NO: 124843 - DNA, 25 bp, Rattus norvegicus
agcagattcagtagcagatgccgtt

SEQ ID NO: 124844 - DNA, 25 bp, Rattus norvegicus
agcagattcagttgcagatgccgtt

SEQ ID NO: 124845 - DNA, 25 bp, Rattus norvegicus
agcagattcataataaggcaagcat

SEQ ID NO: 124846 - DNA, 25 bp, Rattus norvegicus
agcagattcatattaaggcaagcat

SEQ ID NO: 124847 - DNA, 25 bp, Rattus norvegicus
agcagattccaaaggctggcctatt

SEQ ID NO: 124848 - DNA, 25 bp, Rattus norvegicus
agcagattccaaattgcagcagatc

SEQ ID NO: 124849 - DNA, 25 bp, Rattus norvegicus
agcagattccaatggctggcctatt

SEQ ID NO: 124850 - DNA, 25 bp, Rattus norvegicus
agcagattccaatttgcagcagatc

SEQ ID NO: 124851 - DNA, 25 bp, Rattus norvegicus
agcagattccagagcccatcagtgg

SEQ ID NO: 124852 - DNA, 25 bp, Rattus norvegicus
agcagattccagtgcccatcagtgg

SEQ ID NO: 124853 - DNA, 25 bp, Rattus norvegicus
agcagattccatcttgcttcctgtt

SEQ ID NO: 124854 - DNA, 25 bp, Rattus norvegicus
agcagattccatgttgcttcctgtt

SEQ ID NO: 124855 - DNA, 25 bp, Rattus norvegicus
agcagattcctcacttgcagtaggt

SEQ ID NO: 124856 - DNA, 25 bp, Rattus norvegicus
agcagattcctctcttgcagtaggt

SEQ ID NO: 124857 - DNA, 25 bp, Rattus norvegicus
agcagattcgccaacagcagcagca

SEQ ID NO: 124858 - DNA, 25 bp, Rattus norvegicus
agcagattcgcctacagcagcagca

SEQ ID NO: 124859 - DNA, 25 bp, Rattus norvegicus
agcagattgaccattatgtacctta

SEQ ID NO: 124860 - DNA, 25 bp, Rattus norvegicus
agcagattgacctttatgtacctta

SEQ ID NO: 124861 - DNA, 25 bp, Rattus norvegicus
agcagattgccaactacatcaggta

SEQ ID NO: 124862 - DNA, 25 bp, Rattus norvegicus
agcagattgccacagctctagtcca

SEQ ID NO: 124863 - DNA, 25 bp, Rattus norvegicus
agcagattgccagagctctagtcca

SEQ ID NO: 124864 - DNA, 25 bp, Rattus norvegicus
agcagattgccatctacatcaggta

SEQ ID NO: 124865 - DNA, 25 bp, Rattus norvegicus
agcagattgcccctgtagtccacgc

SEQ ID NO: 124866 - DNA, 25 bp, Rattus norvegicus
agcagattgcccgtgtagtccacgc

SEQ ID NO: 124867 - DNA, 25 bp, Rattus norvegicus
agcagattgctgacatttcacctcc

SEQ ID NO: 124868 - DNA, 25 bp, Rattus norvegicus
agcagattgctgtcatttcacctcc

SEQ ID NO: 124869 - DNA, 25 bp, Rattus norvegicus
agcagattgggaccacaggccatgt

SEQ ID NO: 124870 - DNA, 25 bp, Rattus norvegicus
agcagattgggagcacaggccatgt

SEQ ID NO: 124871 - DNA, 25 bp, Rattus norvegicus
agcagatttaaactacctcgtggtc

SEQ ID NO: 124872 - DNA, 25 bp, Rattus norvegicus
agcagatttaaagtacctcgtggtc

SEQ ID NO: 124873 - DNA, 25 bp, Rattus norvegicus
agcagatttccaccaatggcagtga

SEQ ID NO: 124874 - DNA, 25 bp, Rattus norvegicus
agcagatttccagcaatggcagtga

SEQ ID NO: 124875 - DNA, 25 bp, Rattus norvegicus
agcagatttggaacccccgcccgga

SEQ ID NO: 124876 - DNA, 25 bp, Rattus norvegicus
agcagatttggatcccccgcccgga

SEQ ID NO: 124877 - DNA, 25 bp, Rattus norvegicus
agcagattttccacacctattgtac

SEQ ID NO: 124878 - DNA, 25 bp, Rattus norvegicus
agcagattttcctcacctattgtac

SEQ ID NO: 124879 - DNA, 25 bp, Rattus norvegicus
agcagcaaacagacagcctcagcaa

SEQ ID NO: 124880 - DNA, 25 bp, Rattus norvegicus
agcagcaaacagtcagcctcagcaa

SEQ ID NO: 124881 - DNA, 25 bp, Rattus norvegicus
agcagcaaaccgatgtggtgccggc

SEQ ID NO: 124882 - DNA, 25 bp, Rattus norvegicus
agcagcaaaccgttgtggtgccggc

SEQ ID NO: 124883 - DNA, 25 bp, Rattus norvegicus
agcagcaaatgcaggctttccacag

SEQ ID NO: 124884 - DNA, 25 bp, Rattus norvegicus
agcagcaaatgctggctttccacag

SEQ ID NO: 124885 - DNA, 25 bp, Rattus norvegicus
agcagcaacacacagcagtccagca

SEQ ID NO: 124886 - DNA, 25 bp, Rattus norvegicus
agcagcaacacagagcagtccagca

SEQ ID NO: 124887 - DNA, 25 bp, Rattus norvegicus
agcagcaaccagctaatccttgtag

SEQ ID NO: 124888 - DNA, 25 bp, Rattus norvegicus
agcagcaaccaggtaatccttgtag

SEQ ID NO: 124889 - DNA, 25 bp, Rattus norvegicus
agcagcaaccttctctctcggcttt

SEQ ID NO: 124890 - DNA, 25 bp, Rattus norvegicus
agcagcaaccttgtctctcggcttt

SEQ ID NO: 124891 - DNA, 25 bp, Rattus norvegicus
agcagcaacgcaccttctgatgcct

SEQ ID NO: 124892 - DNA, 25 bp, Rattus norvegicus
agcagcaacgcagcttctgatgcct

SEQ ID NO: 124893 - DNA, 25 bp, Rattus norvegicus
agcagcaactgcctgcattttgcac

SEQ ID NO: 124894 - DNA, 25 bp, Rattus norvegicus
agcagcaactgcgtgcattttgcac

SEQ ID NO: 124895 - DNA, 25 bp, Rattus norvegicus
agcagcaagctcattattctccaaa

SEQ ID NO: 124896 - DNA, 25 bp, Rattus norvegicus
agcagcaagctctttattctccaaa

SEQ ID NO: 124897 - DNA, 25 bp, Rattus norvegicus
agcagcaaggacactataccacaag

SEQ ID NO: 124898 - DNA, 25 bp, Rattus norvegicus
agcagcaaggacatccggatgaaaa

SEQ ID NO: 124899 - DNA, 25 bp, Rattus norvegicus
agcagcaaggactctataccacaag

SEQ ID NO: 124900 - DNA, 25 bp, Rattus norvegicus
agcagcaaggacttccggatgaaaa

SEQ ID NO: 124901 - DNA, 25 bp, Rattus norvegicus
agcagcaatgagagttctctcctat

SEQ ID NO: 124902 - DNA, 25 bp, Rattus norvegicus
agcagcaatgagtgttctctcctat

SEQ ID NO: 124903 - DNA, 25 bp, Rattus norvegicus
agcagcaatgcactcccagttcagg

SEQ ID NO: 124904 - DNA, 25 bp, Rattus norvegicus
agcagcaatgcagtcccagttcagg

SEQ ID NO: 124905 - DNA, 25 bp, Rattus norvegicus
agcagcaatgctctgaacctctgag

SEQ ID NO: 124906 - DNA, 25 bp, Rattus norvegicus
agcagcaatgctgtgaacctctgag

SEQ ID NO: 124907 - DNA, 25 bp, Rattus norvegicus
agcagcaattccctcctgagaaatg

SEQ ID NO: 124908 - DNA, 25 bp, Rattus norvegicus
agcagcaattccgtcctgagaaatg

SEQ ID NO: 124909 - DNA, 25 bp, Rattus norvegicus
agcagcacactgaaggacaggctat

SEQ ID NO: 124910 - DNA, 25 bp, Rattus norvegicus
agcagcacactgtaggacaggctat

SEQ ID NO: 124911 - DNA, 25 bp, Rattus norvegicus
agcagcacagcaacaccgaggagat

SEQ ID NO: 124912 - DNA, 25 bp, Rattus norvegicus
agcagcacagcatcaccgaggagat

SEQ ID NO: 124913 - DNA, 25 bp, Rattus norvegicus
agcagcacagccacactggcaaaca

SEQ ID NO: 124914 - DNA, 25 bp, Rattus norvegicus
agcagcacagcctcactggcaaaca

SEQ ID NO: 124915 - DNA, 25 bp, Rattus norvegicus
agcagcacagctagagtggccttgt

SEQ ID NO: 124916 - DNA, 25 bp, Rattus norvegicus
agcagcacagctatatcaggaaaac

SEQ ID NO: 124917 - DNA, 25 bp, Rattus norvegicus
agcagcacagctcaggtcactggct

SEQ ID NO: 124918 - DNA, 25 bp, Rattus norvegicus
agcagcacagctcgccatcagagtc

SEQ ID NO: 124919 - DNA, 25 bp, Rattus norvegicus
agcagcacagctgaggtcactggct

SEQ ID NO: 124920 - DNA, 25 bp, Rattus norvegicus
agcagcacagctggccatcagagtc

SEQ ID NO: 124921 - DNA, 25 bp, Rattus norvegicus
agcagcacagcttgagtggccttgt

SEQ ID NO: 124922 - DNA, 25 bp, Rattus norvegicus
agcagcacagctttatcaggaaaac

SEQ ID NO: 124923 - DNA, 25 bp, Rattus norvegicus
agcagcacattccgcagattgagga

SEQ ID NO: 124924 - DNA, 25 bp, Rattus norvegicus
agcagcacattcggcagattgagga

SEQ ID NO: 124925 - DNA, 25 bp, Rattus norvegicus
agcagcaccaagctgtggtgtgcac

SEQ ID NO: 124926 - DNA, 25 bp, Rattus norvegicus
agcagcaccaaggtgtggtgtgcac

SEQ ID NO: 124927 - DNA, 25 bp, Rattus norvegicus
agcagcaccaggagcaatatttttc

SEQ ID NO: 124928 - DNA, 25 bp, Rattus norvegicus
agcagcaccaggtgcaatatttttc

SEQ ID NO: 124929 - DNA, 25 bp, Rattus norvegicus
agcagcaccccactgaagaaacgga

SEQ ID NO: 124930 - DNA, 25 bp, Rattus norvegicus
agcagcaccccagtgaagaaacgga

SEQ ID NO: 124931 - DNA, 25 bp, Rattus norvegicus
agcagcacccccagatggaacaact

SEQ ID NO: 124932 - DNA, 25 bp, Rattus norvegicus
agcagcaccccctgatggaacaact

SEQ ID NO: 124933 - DNA, 25 bp, Rattus norvegicus
agcagcacctgtaccggcttcactt

SEQ ID NO: 124934 - DNA, 25 bp, Rattus norvegicus
agcagcacctgttccggcttcactt

SEQ ID NO: 124935 - DNA, 25 bp, Rattus norvegicus
agcagcacgatcaacagctcagtgg

SEQ ID NO: 124936 - DNA, 25 bp, Rattus norvegicus
agcagcacgatctacagctcagtgg

SEQ ID NO: 124937 - DNA, 25 bp, Rattus norvegicus
agcagcactaacatgaccttttcgt

SEQ ID NO: 124938 - DNA, 25 bp, Rattus norvegicus
agcagcactaacttgaccttttcgt

SEQ ID NO: 124939 - DNA, 25 bp, Rattus norvegicus
agcagcactcagacacttcaggttc

SEQ ID NO: 124940 - DNA, 25 bp, Rattus norvegicus
agcagcactcagtcacttcaggttc

SEQ ID NO: 124941 - DNA, 25 bp, Rattus norvegicus
agcagcactcggacgtggaggactt

SEQ ID NO: 124942 - DNA, 25 bp, Rattus norvegicus
agcagcactcggtcgtggaggactt

SEQ ID NO: 124943 - DNA, 25 bp, Rattus norvegicus
agcagcactctccagtacacagagg

SEQ ID NO: 124944 - DNA, 25 bp, Rattus norvegicus
agcagcactctcgagtacacagagg

SEQ ID NO: 124945 - DNA, 25 bp, Rattus norvegicus
agcagcactgagcaactgggcattt

SEQ ID NO: 124946 - DNA, 25 bp, Rattus norvegicus
agcagcactgagctttgtcacccag

SEQ ID NO: 124947 - DNA, 25 bp, Rattus norvegicus
agcagcactgaggaactgggcattt

SEQ ID NO: 124948 - DNA, 25 bp, Rattus norvegicus
agcagcactgaggtttgtcacccag

SEQ ID NO: 124949 - DNA, 25 bp, Rattus norvegicus
agcagcactgcacacaacaaaaatt

SEQ ID NO: 124950 - DNA, 25 bp, Rattus norvegicus
agcagcactgcagacaacaaaaatt

SEQ ID NO: 124951 - DNA, 25 bp, Rattus norvegicus
agcagcactggcatgtcctcaggtg

SEQ ID NO: 124952 - DNA, 25 bp, Rattus norvegicus
agcagcactggcttgtcctcaggtg

SEQ ID NO: 124953 - DNA, 25 bp, Rattus norvegicus
agcagcactgtgaggcctctctggc

SEQ ID NO: 124954 - DNA, 25 bp, Rattus norvegicus
agcagcactgtgtggcctctctggc

SEQ ID NO: 124955 - DNA, 25 bp, Rattus norvegicus
agcagcactgttcgtcacttcaggc

SEQ ID NO: 124956 - DNA, 25 bp, Rattus norvegicus
agcagcactgttggtcacttcaggc

SEQ ID NO: 124957 - DNA, 25 bp, Rattus norvegicus
agcagcacttaactcccaggacaca

SEQ ID NO: 124958 - DNA, 25 bp, Rattus norvegicus
agcagcacttaagtcccaggacaca

SEQ ID NO: 124959 - DNA, 25 bp, Rattus norvegicus
agcagcacttgtctatagctttcga

SEQ ID NO: 124960 - DNA, 25 bp, Rattus norvegicus
agcagcacttgtgtatagctttcga

SEQ ID NO: 124961 - DNA, 25 bp, Rattus norvegicus
agcagcactttgcactctgatgacc

SEQ ID NO: 124962 - DNA, 25 bp, Rattus norvegicus
agcagcactttggactctgatgacc

SEQ ID NO: 124963 - DNA, 25 bp, Rattus norvegicus
agcagcagacagatcaatctccagc

SEQ ID NO: 124964 - DNA, 25 bp, Rattus norvegicus
agcagcagacagttcaatctccagc

SEQ ID NO: 124965 - DNA, 25 bp, Rattus norvegicus
agcagcagacataccctcaatatga

SEQ ID NO: 124966 - DNA, 25 bp, Rattus norvegicus
agcagcagacattccctcaatatga

SEQ ID NO: 124967 - DNA, 25 bp, Rattus norvegicus
agcagcagagcaaaggttccccaga

SEQ ID NO: 124968 - DNA, 25 bp, Rattus norvegicus
agcagcagagcataggttccccaga

SEQ ID NO: 124969 - DNA, 25 bp, Rattus norvegicus
agcagcagcaaccacagttctgtgt

SEQ ID NO: 124970 - DNA, 25 bp, Rattus norvegicus
agcagcagcaacgacagttctgtgt

SEQ ID NO: 124971 - DNA, 25 bp, Rattus norvegicus
agcagcagcacacatggtcacattg

SEQ ID NO: 124972 - DNA, 25 bp, Rattus norvegicus
agcagcagcacagatggtcacattg

SEQ ID NO: 124973 - DNA, 25 bp, Rattus norvegicus
agcagcagcaccaggcatggcagag

SEQ ID NO: 124974 - DNA, 25 bp, Rattus norvegicus
agcagcagcacctggcatggcagag

SEQ ID NO: 124975 - DNA, 25 bp, Rattus norvegicus
agcagcagcaggaacccacacaggc

SEQ ID NO: 124976 - DNA, 25 bp, Rattus norvegicus
agcagcagcaggtacccacacaggc

SEQ ID NO: 124977 - DNA, 25 bp, Rattus norvegicus
agcagcagcatcatagtcacagtag

SEQ ID NO: 124978 - DNA, 25 bp, Rattus norvegicus
agcagcagcatcttagtcacagtag

SEQ ID NO: 124979 - DNA, 25 bp, Rattus norvegicus
agcagcagcatgatgggccagagta

SEQ ID NO: 124980 - DNA, 25 bp, Rattus norvegicus
agcagcagcatgttgggccagagta

SEQ ID NO: 124981 - DNA, 25 bp, Rattus norvegicus
agcagcagccagcttgagcggattt

SEQ ID NO: 124982 - DNA, 25 bp, Rattus norvegicus
agcagcagccaggttgagcggattt

SEQ ID NO: 124983 - DNA, 25 bp, Rattus norvegicus
agcagcagcctgcatttgctctaaa

SEQ ID NO: 124984 - DNA, 25 bp, Rattus norvegicus
agcagcagcctggatttgctctaaa

SEQ ID NO: 124985 - DNA, 25 bp, Rattus norvegicus
agcagcagcgcgagtccgtacggcc

SEQ ID NO: 124986 - DNA, 25 bp, Rattus norvegicus
agcagcagcgcgtgtccgtacggcc

SEQ ID NO: 124987 - DNA, 25 bp, Rattus norvegicus
agcagcagcgctcttagtgagctaa

SEQ ID NO: 124988 - DNA, 25 bp, Rattus norvegicus
agcagcagcgctgttagtgagctaa

SEQ ID NO: 124989 - DNA, 25 bp, Rattus norvegicus
agcagcagcgtgcatgtcacttttt

SEQ ID NO: 124990 - DNA, 25 bp, Rattus norvegicus
agcagcagcgtggatgtcacttttt

SEQ ID NO: 124991 - DNA, 25 bp, Rattus norvegicus
agcagcagctgcaacagtgcctctt

SEQ ID NO: 124992 - DNA, 25 bp, Rattus norvegicus
agcagcagctgctacagtgcctctt

SEQ ID NO: 124993 - DNA, 25 bp, Rattus norvegicus
agcagcagctgtactcatacgctat

SEQ ID NO: 124994 - DNA, 25 bp, Rattus norvegicus
agcagcagctgttctcatacgctat

SEQ ID NO: 124995 - DNA, 25 bp, Rattus norvegicus
agcagcagcttcaagatgccgtcaa

SEQ ID NO: 124996 - DNA, 25 bp, Rattus norvegicus
agcagcagcttctagatgccgtcaa

SEQ ID NO: 124997 - DNA, 25 bp, Rattus norvegicus
agcagcagcttgatctccttttaca

SEQ ID NO: 124998 - DNA, 25 bp, Rattus norvegicus
agcagcagcttgttctccttttaca

SEQ ID NO: 124999 - DNA, 25 bp, Rattus norvegicus
agcagcaggagacctacatggccca

SEQ ID NO: 125000 - DNA, 25 bp, Rattus norvegicus
agcagcaggagagctacatggccca

SEQ ID NO: 125001 - DNA, 25 bp, Rattus norvegicus
agcagcaggcttctaactcatactc

SEQ ID NO: 125002 - DNA, 25 bp, Rattus norvegicus
agcagcaggcttgtaactcatactc

SEQ ID NO: 125003 - DNA, 25 bp, Rattus norvegicus
agcagcagggtgctcggagttgagc

SEQ ID NO: 125004 - DNA, 25 bp, Rattus norvegicus
agcagcagggtggtcggagttgagc

SEQ ID NO: 125005 - DNA, 25 bp, Rattus norvegicus
agcagcaggtgcactagctcctcat

SEQ ID NO: 125006 - DNA, 25 bp, Rattus norvegicus
agcagcaggtgctctagctcctcat

SEQ ID NO: 125007 - DNA, 25 bp, Rattus norvegicus
agcagcagtatcatgtttcggtgac

SEQ ID NO: 125008 - DNA, 25 bp, Rattus norvegicus
agcagcagtatcttgtttcggtgac

SEQ ID NO: 125009 - DNA, 25 bp, Rattus norvegicus
agcagcagtcacatccaaaggagga

SEQ ID NO: 125010 - DNA, 25 bp, Rattus norvegicus
agcagcagtcacttccaaaggagga

SEQ ID NO: 125011 - DNA, 25 bp, Rattus norvegicus
agcagcagtgacattaacttctggt

SEQ ID NO: 125012 - DNA, 25 bp, Rattus norvegicus
agcagcagtgactttaacttctggt

SEQ ID NO: 125013 - DNA, 25 bp, Rattus norvegicus
agcagcagtgatcccgatgaccact

SEQ ID NO: 125014 - DNA, 25 bp, Rattus norvegicus
agcagcagtgatgccgatgaccact

SEQ ID NO: 125015 - DNA, 25 bp, Rattus norvegicus
agcagcagttccagcaccaataaag

SEQ ID NO: 125016 - DNA, 25 bp, Rattus norvegicus
agcagcagttcctgcaccaataaag

SEQ ID NO: 125017 - DNA, 25 bp, Rattus norvegicus
agcagcagttctaatgtccacttgc

SEQ ID NO: 125018 - DNA, 25 bp, Rattus norvegicus
agcagcagttcttatgtccacttgc

SEQ ID NO: 125019 - DNA, 25 bp, Rattus norvegicus
agcagcagttgtacttaatcaccga

SEQ ID NO: 125020 - DNA, 25 bp, Rattus norvegicus
agcagcagttgttcttaatcaccga

SEQ ID NO: 125021 - DNA, 25 bp, Rattus norvegicus
agcagcatacggcttatctatttcc

SEQ ID NO: 125022 - DNA, 25 bp, Rattus norvegicus
agcagcatacgggttatctatttcc

SEQ ID NO: 125023 - DNA, 25 bp, Rattus norvegicus
agcagcatacgtcttcggcagctgc

SEQ ID NO: 125024 - DNA, 25 bp, Rattus norvegicus
agcagcatacgtgttcggcagctgc

SEQ ID NO: 125025 - DNA, 25 bp, Rattus norvegicus
agcagcatactaagcccagaccagt

SEQ ID NO: 125026 - DNA, 25 bp, Rattus norvegicus
agcagcatactatgcccagaccagt

SEQ ID NO: 125027 - DNA, 25 bp, Rattus norvegicus
agcagcatcaacagcccagacaggg

SEQ ID NO: 125028 - DNA, 25 bp, Rattus norvegicus
agcagcatcaactgcccagacaggg

SEQ ID NO: 125029 - DNA, 25 bp, Rattus norvegicus
agcagcatcagaatgctcctggcaa

SEQ ID NO: 125030 - DNA, 25 bp, Rattus norvegicus
agcagcatcagattgctcctggcaa

SEQ ID NO: 125031 - DNA, 25 bp, Rattus norvegicus
agcagcatcaggcacatgatccgaa

SEQ ID NO: 125032 - DNA, 25 bp, Rattus norvegicus
agcagcatcagggacatgatccgaa

SEQ ID NO: 125033 - DNA, 25 bp, Rattus norvegicus
agcagcatcatcctcagccacagga

SEQ ID NO: 125034 - DNA, 25 bp, Rattus norvegicus
agcagcatcatcgtcagccacagga

SEQ ID NO: 125035 - DNA, 25 bp, Rattus norvegicus
agcagcatccatacttgtctaaacc

SEQ ID NO: 125036 - DNA, 25 bp, Rattus norvegicus
agcagcatccattcttgtctaaacc

SEQ ID NO: 125037 - DNA, 25 bp, Rattus norvegicus
agcagcatcgacacactagcagttg

SEQ ID NO: 125038 - DNA, 25 bp, Rattus norvegicus
agcagcatcgactcactagcagttg

SEQ ID NO: 125039 - DNA, 25 bp, Rattus norvegicus
agcagcatcgtcagctgtgatcaaa

SEQ ID NO: 125040 - DNA, 25 bp, Rattus norvegicus
agcagcatcgtctgctgtgatcaaa

SEQ ID NO: 125041 - DNA, 25 bp, Rattus norvegicus
agcagcatctatacaaggttctttg

SEQ ID NO: 125042 - DNA, 25 bp, Rattus norvegicus
agcagcatctattcaaggttctttg

SEQ ID NO: 125043 - DNA, 25 bp, Rattus norvegicus
agcagcatcttcatcagttgggatt

SEQ ID NO: 125044 - DNA, 25 bp, Rattus norvegicus
agcagcatcttcttcagttgggatt

SEQ ID NO: 125045 - DNA, 25 bp, Rattus norvegicus
agcagcatcttgactttgctcttca

SEQ ID NO: 125046 - DNA, 25 bp, Rattus norvegicus
agcagcatcttgtctttgctcttca

SEQ ID NO: 125047 - DNA, 25 bp, Rattus norvegicus
agcagcatgactcgctcagagctct

SEQ ID NO: 125048 - DNA, 25 bp, Rattus norvegicus
agcagcatgactggctcagagctct

SEQ ID NO: 125049 - DNA, 25 bp, Rattus norvegicus
agcagcatgattcccattttcccat

SEQ ID NO: 125050 - DNA, 25 bp, Rattus norvegicus
agcagcatgattgccattttcccat

SEQ ID NO: 125051 - DNA, 25 bp, Rattus norvegicus
agcagcatggacaattcggttccca

SEQ ID NO: 125052 - DNA, 25 bp, Rattus norvegicus
agcagcatggactattcggttccca

SEQ ID NO: 125053 - DNA, 25 bp, Rattus norvegicus
agcagcattaagagaaccactgaat

SEQ ID NO: 125054 - DNA, 25 bp, Rattus norvegicus
agcagcattaagtgaaccactgaat

SEQ ID NO: 125055 - DNA, 25 bp, Rattus norvegicus
agcagcattcgactcttcaggtgta

SEQ ID NO: 125056 - DNA, 25 bp, Rattus norvegicus
agcagcattcgagtcttcaggtgta

SEQ ID NO: 125057 - DNA, 25 bp, Rattus norvegicus
agcagcattgccaaataatccctga

SEQ ID NO: 125058 - DNA, 25 bp, Rattus norvegicus
agcagcattgcctaataatccctga

SEQ ID NO: 125059 - DNA, 25 bp, Rattus norvegicus
agcagcattggactcctagtgtact

SEQ ID NO: 125060 - DNA, 25 bp, Rattus norvegicus
agcagcattggagtcctagtgtact

SEQ ID NO: 125061 - DNA, 25 bp, Rattus norvegicus
agcagcatttgaacttgaggaggaa

SEQ ID NO: 125062 - DNA, 25 bp, Rattus norvegicus
agcagcatttgatcttgaggaggaa

SEQ ID NO: 125063 - DNA, 25 bp, Rattus norvegicus
agcagcattttgcaagttgctctag

SEQ ID NO: 125064 - DNA, 25 bp, Rattus norvegicus
agcagcattttggaagttgctctag

SEQ ID NO: 125065 - DNA, 25 bp, Rattus norvegicus
agcagccaaaccacttcctgatgac

SEQ ID NO: 125066 - DNA, 25 bp, Rattus norvegicus
agcagccaaacctcttcctgatgac

SEQ ID NO: 125067 - DNA, 25 bp, Rattus norvegicus
agcagccaacctatgtaatgagcca

SEQ ID NO: 125068 - DNA, 25 bp, Rattus norvegicus
agcagccaacctttgtaatgagcca

SEQ ID NO: 125069 - DNA, 25 bp, Rattus norvegicus
agcagccaagcgccttcggatggac

SEQ ID NO: 125070 - DNA, 25 bp, Rattus norvegicus
agcagccaagcggcttcggatggac

SEQ ID NO: 125071 - DNA, 25 bp, Rattus norvegicus
agcagccaagctcatgtctgtgtca

SEQ ID NO: 125072 - DNA, 25 bp, Rattus norvegicus
agcagccaagctgatgtctgtgtca

SEQ ID NO: 125073 - DNA, 25 bp, Rattus norvegicus
agcagccaaggtctgggtcagctat

SEQ ID NO: 125074 - DNA, 25 bp, Rattus norvegicus
agcagccaaggtgtgggtcagctat

SEQ ID NO: 125075 - DNA, 25 bp, Rattus norvegicus
agcagccacatcagtaactcacaac

SEQ ID NO: 125076 - DNA, 25 bp, Rattus norvegicus
agcagccacatctgtaactcacaac

SEQ ID NO: 125077 - DNA, 25 bp, Rattus norvegicus
agcagccaccaaccgtcagaagtac

SEQ ID NO: 125078 - DNA, 25 bp, Rattus norvegicus
agcagccaccaagcgtcagaagtac

SEQ ID NO: 125079 - DNA, 25 bp, Rattus norvegicus
agcagccacctaatttcctgtttgt

SEQ ID NO: 125080 - DNA, 25 bp, Rattus norvegicus
agcagccacctattttcctgtttgt

SEQ ID NO: 125081 - DNA, 25 bp, Rattus norvegicus
agcagccactctaagcagtgtgggt

SEQ ID NO: 125082 - DNA, 25 bp, Rattus norvegicus
agcagccactcttagcagtgtgggt

SEQ ID NO: 125083 - DNA, 25 bp, Rattus norvegicus
agcagccactgtaccttgtggtttt

SEQ ID NO: 125084 - DNA, 25 bp, Rattus norvegicus
agcagccactgttccttgtggtttt

SEQ ID NO: 125085 - DNA, 25 bp, Rattus norvegicus
agcagccagcccagataggaggatg

SEQ ID NO: 125086 - DNA, 25 bp, Rattus norvegicus
agcagccagccctgataggaggatg

SEQ ID NO: 125087 - DNA, 25 bp, Rattus norvegicus
agcagccagcggctcacagtggtcc

SEQ ID NO: 125088 - DNA, 25 bp, Rattus norvegicus
agcagccagcgggtcacagtggtcc

SEQ ID NO: 125089 - DNA, 25 bp, Rattus norvegicus
agcagccagcgtcttggaggtttca

SEQ ID NO: 125090 - DNA, 25 bp, Rattus norvegicus
agcagccagcgtgttggaggtttca

SEQ ID NO: 125091 - DNA, 25 bp, Rattus norvegicus
agcagccaggagacgctgaggcctc

SEQ ID NO: 125092 - DNA, 25 bp, Rattus norvegicus
agcagccaggagtcgctgaggcctc

SEQ ID NO: 125093 - DNA, 25 bp, Rattus norvegicus
agcagccaggatagatgaccgccac

SEQ ID NO: 125094 - DNA, 25 bp, Rattus norvegicus
agcagccaggattgatgaccgccac

SEQ ID NO: 125095 - DNA, 25 bp, Rattus norvegicus
agcagccagggtcaaggtcatgcac

SEQ ID NO: 125096 - DNA, 25 bp, Rattus norvegicus
agcagccagggtgaaggtcatgcac

SEQ ID NO: 125097 - DNA, 25 bp, Rattus norvegicus
agcagccagtacagattaccacaag

SEQ ID NO: 125098 - DNA, 25 bp, Rattus norvegicus
agcagccagtactgattaccacaag

SEQ ID NO: 125099 - DNA, 25 bp, Rattus norvegicus
agcagccagtatactccttctcaga

SEQ ID NO: 125100 - DNA, 25 bp, Rattus norvegicus
agcagccagtattctccttctcaga

SEQ ID NO: 125101 - DNA, 25 bp, Rattus norvegicus
agcagccagtgtccgtcggcacatg

SEQ ID NO: 125102 - DNA, 25 bp, Rattus norvegicus
agcagccagtgtgcgtcggcacatg

SEQ ID NO: 125103 - DNA, 25 bp, Rattus norvegicus
agcagccatactaacccaggaattt

SEQ ID NO: 125104 - DNA, 25 bp, Rattus norvegicus
agcagccatacttacccaggaattt

SEQ ID NO: 125105 - DNA, 25 bp, Rattus norvegicus
agcagccataggcatctgctggtct

SEQ ID NO: 125106 - DNA, 25 bp, Rattus norvegicus
agcagccatagggatctgctggtct

SEQ ID NO: 125107 - DNA, 25 bp, Rattus norvegicus
agcagccatcacatctgggagcatc

SEQ ID NO: 125108 - DNA, 25 bp, Rattus norvegicus
agcagccatcacttctgggagcatc

SEQ ID NO: 125109 - DNA, 25 bp, Rattus norvegicus
agcagccatcagattgaagcacaca

SEQ ID NO: 125110 - DNA, 25 bp, Rattus norvegicus
agcagccatcagtttgaagcacaca

SEQ ID NO: 125111 - DNA, 25 bp, Rattus norvegicus
agcagccatcccaagagaagttcta

SEQ ID NO: 125112 - DNA, 25 bp, Rattus norvegicus
agcagccatccctagagaagttcta

SEQ ID NO: 125113 - DNA, 25 bp, Rattus norvegicus
agcagccatgatctacactaagcct

SEQ ID NO: 125114 - DNA, 25 bp, Rattus norvegicus
agcagccatgatgtacactaagcct

SEQ ID NO: 125115 - DNA, 25 bp, Rattus norvegicus
agcagccattgtacctagctgctga

SEQ ID NO: 125116 - DNA, 25 bp, Rattus norvegicus
agcagccattgttcctagctgctga

SEQ ID NO: 125117 - DNA, 25 bp, Rattus norvegicus
agcagcccaaagcttcttgctggaa

SEQ ID NO: 125118 - DNA, 25 bp, Rattus norvegicus
agcagcccaaaggttcttgctggaa

SEQ ID NO: 125119 - DNA, 25 bp, Rattus norvegicus
agcagcccacgcatggaaaggactg

SEQ ID NO: 125120 - DNA, 25 bp, Rattus norvegicus
agcagcccacgcttggaaaggactg

SEQ ID NO: 125121 - DNA, 25 bp, Rattus norvegicus
agcagcccaggaccttgccttgagc

SEQ ID NO: 125122 - DNA, 25 bp, Rattus norvegicus
agcagcccaggagcttgccttgagc

SEQ ID NO: 125123 - DNA, 25 bp, Rattus norvegicus
agcagcccagtcaatttccagaggt

SEQ ID NO: 125124 - DNA, 25 bp, Rattus norvegicus
agcagcccagtctatttccagaggt

SEQ ID NO: 125125 - DNA, 25 bp, Rattus norvegicus
agcagcccagttcaatagcaaacac

SEQ ID NO: 125126 - DNA, 25 bp, Rattus norvegicus
agcagcccagttgaatagcaaacac

SEQ ID NO: 125127 - DNA, 25 bp, Rattus norvegicus
agcagccccaacaggagttcacact

SEQ ID NO: 125128 - DNA, 25 bp, Rattus norvegicus
agcagccccaactggagttcacact

SEQ ID NO: 125129 - DNA, 25 bp, Rattus norvegicus
agcagccccagccttatgtgatggt

SEQ ID NO: 125130 - DNA, 25 bp, Rattus norvegicus
agcagccccagcgttatgtgatggt

SEQ ID NO: 125131 - DNA, 25 bp, Rattus norvegicus
agcagccccgagctactgagaagga

SEQ ID NO: 125132 - DNA, 25 bp, Rattus norvegicus
agcagccccgaggtactgagaagga

SEQ ID NO: 125133 - DNA, 25 bp, Rattus norvegicus
agcagccccggcatcatggctttgt

SEQ ID NO: 125134 - DNA, 25 bp, Rattus norvegicus
agcagccccggcttcatggctttgt

SEQ ID NO: 125135 - DNA, 25 bp, Rattus norvegicus
agcagccccgttactgagcaaaccg

SEQ ID NO: 125136 - DNA, 25 bp, Rattus norvegicus
agcagccccgtttctgagcaaaccg

SEQ ID NO: 125137 - DNA, 25 bp, Rattus norvegicus
agcagcccctgtacatgtgtgacat

SEQ ID NO: 125138 - DNA, 25 bp, Rattus norvegicus
agcagcccctgttcatgtgtgacat

SEQ ID NO: 125139 - DNA, 25 bp, Rattus norvegicus
agcagccccttgcatttagagccat

SEQ ID NO: 125140 - DNA, 25 bp, Rattus norvegicus
agcagccccttggatttagagccat

SEQ ID NO: 125141 - DNA, 25 bp, Rattus norvegicus
agcagccctacgagaccaaggtgaa

SEQ ID NO: 125142 - DNA, 25 bp, Rattus norvegicus
agcagccctacgtgaccaaggtgaa

SEQ ID NO: 125143 - DNA, 25 bp, Rattus norvegicus
agcagccctgtacttatttttacca

SEQ ID NO: 125144 - DNA, 25 bp, Rattus norvegicus
agcagccctgtagttatttttacca

SEQ ID NO: 125145 - DNA, 25 bp, Rattus norvegicus
agcagccctgtcacagagtctagac

SEQ ID NO: 125146 - DNA, 25 bp, Rattus norvegicus
agcagccctgtcagcaacggcaaag

SEQ ID NO: 125147 - DNA, 25 bp, Rattus norvegicus
agcagccctgtctcagagtctagac

SEQ ID NO: 125148 - DNA, 25 bp, Rattus norvegicus
agcagccctgtctgcaacggcaaag

SEQ ID NO: 125149 - DNA, 25 bp, Rattus norvegicus
agcagccctgtgacgtgagacccgg

SEQ ID NO: 125150 - DNA, 25 bp, Rattus norvegicus
agcagccctgtgtcgtgagacccgg

SEQ ID NO: 125151 - DNA, 25 bp, Rattus norvegicus
agcagcccttagctacctgtgtttt

SEQ ID NO: 125152 - DNA, 25 bp, Rattus norvegicus
agcagcccttaggtacctgtgtttt

SEQ ID NO: 125153 - DNA, 25 bp, Rattus norvegicus
agcagccgagatctttgtggagtct

SEQ ID NO: 125154 - DNA, 25 bp, Rattus norvegicus
agcagccgagatgtttgtggagtct

SEQ ID NO: 125155 - DNA, 25 bp, Rattus norvegicus
agcagccgaggacagtcatccacaa

SEQ ID NO: 125156 - DNA, 25 bp, Rattus norvegicus
agcagccgaggagagtcatccacaa

SEQ ID NO: 125157 - DNA, 25 bp, Rattus norvegicus
agcagccgaggcagatgcattccca

SEQ ID NO: 125158 - DNA, 25 bp, Rattus norvegicus
agcagccgaggctgatgcattccca

SEQ ID NO: 125159 - DNA, 25 bp, Rattus norvegicus
agcagccgatgacactctgcggctc

SEQ ID NO: 125160 - DNA, 25 bp, Rattus norvegicus
agcagccgatgagactctgcggctc

SEQ ID NO: 125161 - DNA, 25 bp, Rattus norvegicus
agcagccgatgcacagtggagtcca

SEQ ID NO: 125162 - DNA, 25 bp, Rattus norvegicus
agcagccgatgctcagtggagtcca

SEQ ID NO: 125163 - DNA, 25 bp, Rattus norvegicus
agcagccgccctctagggagtttga

SEQ ID NO: 125164 - DNA, 25 bp, Rattus norvegicus
agcagccgccctgtagggagtttga

SEQ ID NO: 125165 - DNA, 25 bp, Rattus norvegicus
agcagccgctgcaatgcaaggaact

SEQ ID NO: 125166 - DNA, 25 bp, Rattus norvegicus
agcagccgctgctatgcaaggaact

SEQ ID NO: 125167 - DNA, 25 bp, Rattus norvegicus
agcagccggatcatgcgcgcacgag

SEQ ID NO: 125168 - DNA, 25 bp, Rattus norvegicus
agcagccggatcttgcgcgcacgag

SEQ ID NO: 125169 - DNA, 25 bp, Rattus norvegicus
agcagccggctgagttcagacaatt

SEQ ID NO: 125170 - DNA, 25 bp, Rattus norvegicus
agcagccggctgtgttcagacaatt

SEQ ID NO: 125171 - DNA, 25 bp, Rattus norvegicus
agcagccggtctcggtgggcgctca

SEQ ID NO: 125172 - DNA, 25 bp, Rattus norvegicus
agcagccggtctgggtgggcgctca

SEQ ID NO: 125173 - DNA, 25 bp, Rattus norvegicus
agcagccgtagaataccccattcat

SEQ ID NO: 125174 - DNA, 25 bp, Rattus norvegicus
agcagccgtagattaccccattcat

SEQ ID NO: 125175 - DNA, 25 bp, Rattus norvegicus
agcagcctagccaggtgcggcacca

SEQ ID NO: 125176 - DNA, 25 bp, Rattus norvegicus
agcagcctagcctggtgcggcacca

SEQ ID NO: 125177 - DNA, 25 bp, Rattus norvegicus
agcagcctcagacgattcttacacc

SEQ ID NO: 125178 - DNA, 25 bp, Rattus norvegicus
agcagcctcagaggattcttacacc

SEQ ID NO: 125179 - DNA, 25 bp, Rattus norvegicus
agcagcctccacctggttggatctg

SEQ ID NO: 125180 - DNA, 25 bp, Rattus norvegicus
agcagcctccacgtggttggatctg

SEQ ID NO: 125181 - DNA, 25 bp, Rattus norvegicus
agcagcctccccaatgtgaagaagt

SEQ ID NO: 125182 - DNA, 25 bp, Rattus norvegicus
agcagcctcccctatgtgaagaagt

SEQ ID NO: 125183 - DNA, 25 bp, Rattus norvegicus
agcagcctccgcagacgcagcagat

SEQ ID NO: 125184 - DNA, 25 bp, Rattus norvegicus
agcagcctccgctgacgcagcagat

SEQ ID NO: 125185 - DNA, 25 bp, Rattus norvegicus
agcagcctcctgattcataaccagg

SEQ ID NO: 125186 - DNA, 25 bp, Rattus norvegicus
agcagcctcctgtttcataaccagg

SEQ ID NO: 125187 - DNA, 25 bp, Rattus norvegicus
agcagcctccttaccagatggagaa

SEQ ID NO: 125188 - DNA, 25 bp, Rattus norvegicus
agcagcctcctttccagatggagaa

SEQ ID NO: 125189 - DNA, 25 bp, Rattus norvegicus
agcagcctcgaaaatgttaggccag

SEQ ID NO: 125190 - DNA, 25 bp, Rattus norvegicus
agcagcctcgaatatgttaggccag

SEQ ID NO: 125191 - DNA, 25 bp, Rattus norvegicus
agcagcctcgccaaatgcagtgttc

SEQ ID NO: 125192 - DNA, 25 bp, Rattus norvegicus
agcagcctcgcctaatgcagtgttc

SEQ ID NO: 125193 - DNA, 25 bp, Rattus norvegicus
agcagcctcgtgcatgttatcaacg

SEQ ID NO: 125194 - DNA, 25 bp, Rattus norvegicus
agcagcctcgtggatgttatcaacg

SEQ ID NO: 125195 - DNA, 25 bp, Rattus norvegicus
agcagcctctgaactgtgacgagcc

SEQ ID NO: 125196 - DNA, 25 bp, Rattus norvegicus
agcagcctctgatctgtgacgagcc

SEQ ID NO: 125197 - DNA, 25 bp, Rattus norvegicus
agcagcctgaaacctgctctgtcta

SEQ ID NO: 125198 - DNA, 25 bp, Rattus norvegicus
agcagcctgaaagctgctctgtcta

SEQ ID NO: 125199 - DNA, 25 bp, Rattus norvegicus
agcagcctgaccatgggcagatcaa

SEQ ID NO: 125200 - DNA, 25 bp, Rattus norvegicus
agcagcctgaccttgggcagatcaa

SEQ ID NO: 125201 - DNA, 25 bp, Rattus norvegicus
agcagcctgatgcttctcagttaca

SEQ ID NO: 125202 - DNA, 25 bp, Rattus norvegicus
agcagcctgatggttctcagttaca

SEQ ID NO: 125203 - DNA, 25 bp, Rattus norvegicus
agcagcctgcagcttgtcagttact

SEQ ID NO: 125204 - DNA, 25 bp, Rattus norvegicus
agcagcctgcaggttgtcagttact

SEQ ID NO: 125205 - DNA, 25 bp, Rattus norvegicus
agcagcctgcgtaaaatgtgggaca

SEQ ID NO: 125206 - DNA, 25 bp, Rattus norvegicus
agcagcctgcgtcttcatagagcgt

SEQ ID NO: 125207 - DNA, 25 bp, Rattus norvegicus
agcagcctgcgtgttcatagagcgt

SEQ ID NO: 125208 - DNA, 25 bp, Rattus norvegicus
agcagcctgcgttaaatgtgggaca

SEQ ID NO: 125209 - DNA, 25 bp, Rattus norvegicus
agcagcctgcttactgtagcggtct

SEQ ID NO: 125210 - DNA, 25 bp, Rattus norvegicus
agcagcctgctttctgtagcggtct

SEQ ID NO: 125211 - DNA, 25 bp, Rattus norvegicus
agcagcctggccagactgaagtgtt

SEQ ID NO: 125212 - DNA, 25 bp, Rattus norvegicus
agcagcctggcctgactgaagtgtt

SEQ ID NO: 125213 - DNA, 25 bp, Rattus norvegicus
agcagcctgggaactttaggcagat

SEQ ID NO: 125214 - DNA, 25 bp, Rattus norvegicus
agcagcctgggatctttaggcagat

SEQ ID NO: 125215 - DNA, 25 bp, Rattus norvegicus
agcagcctgggccttatttctcaca

SEQ ID NO: 125216 - DNA, 25 bp, Rattus norvegicus
agcagcctgggcgttatttctcaca

SEQ ID NO: 125217 - DNA, 25 bp, Rattus norvegicus
agcagcctggtgcacatgcagtaca

SEQ ID NO: 125218 - DNA, 25 bp, Rattus norvegicus
agcagcctggtggacatgcagtaca

SEQ ID NO: 125219 - DNA, 25 bp, Rattus norvegicus
agcagcctgtcacacagcactagag

SEQ ID NO: 125220 - DNA, 25 bp, Rattus norvegicus
agcagcctgtcagacagcactagag

SEQ ID NO: 125221 - DNA, 25 bp, Rattus norvegicus
agcagcctgtgaactactcacgagt

SEQ ID NO: 125222 - DNA, 25 bp, Rattus norvegicus
agcagcctgtgaccattgaacccat

SEQ ID NO: 125223 - DNA, 25 bp, Rattus norvegicus
agcagcctgtgagcattgaacccat

SEQ ID NO: 125224 - DNA, 25 bp, Rattus norvegicus
agcagcctgtgatctactcacgagt

SEQ ID NO: 125225 - DNA, 25 bp, Rattus norvegicus
agcagcctgtggatagttttcttca

SEQ ID NO: 125226 - DNA, 25 bp, Rattus norvegicus
agcagcctgtggttagttttcttca

SEQ ID NO: 125227 - DNA, 25 bp, Rattus norvegicus
agcagcctgttgcataagagttgtc

SEQ ID NO: 125228 - DNA, 25 bp, Rattus norvegicus
agcagcctgttggataagagttgtc

SEQ ID NO: 125229 - DNA, 25 bp, Rattus norvegicus
agcagccttcacctcaatggatgaa

SEQ ID NO: 125230 - DNA, 25 bp, Rattus norvegicus
agcagccttcacgtcaatggatgaa

SEQ ID NO: 125231 - DNA, 25 bp, Rattus norvegicus
agcagccttggactttggaggccat

SEQ ID NO: 125232 - DNA, 25 bp, Rattus norvegicus
agcagccttggagtttggaggccat

SEQ ID NO: 125233 - DNA, 25 bp, Rattus norvegicus
agcagcctttccagagcctttgttc

SEQ ID NO: 125234 - DNA, 25 bp, Rattus norvegicus
agcagcctttcctgagcctttgttc

SEQ ID NO: 125235 - DNA, 25 bp, Rattus norvegicus
agcagcctttgtccggcctgggaat

SEQ ID NO: 125236 - DNA, 25 bp, Rattus norvegicus
agcagcctttgtgcggcctgggaat

SEQ ID NO: 125237 - DNA, 25 bp, Rattus norvegicus
agcagccttttgaatgtgtgaatta

SEQ ID NO: 125238 - DNA, 25 bp, Rattus norvegicus
agcagccttttgtatgtgtgaatta

SEQ ID NO: 125239 - DNA, 25 bp, Rattus norvegicus
agcagcgaatccagactccagtggg

SEQ ID NO: 125240 - DNA, 25 bp, Rattus norvegicus
agcagcgaatcctgactccagtggg

SEQ ID NO: 125241 - DNA, 25 bp, Rattus norvegicus
agcagcgacagcagtccctcatctt

SEQ ID NO: 125242 - DNA, 25 bp, Rattus norvegicus
agcagcgacagctgtccctcatctt

SEQ ID NO: 125243 - DNA, 25 bp, Rattus norvegicus
agcagcgagtacctgactgtcttga

SEQ ID NO: 125244 - DNA, 25 bp, Rattus norvegicus
agcagcgagtacgtgactgtcttga

SEQ ID NO: 125245 - DNA, 25 bp, Rattus norvegicus
agcagcgagtccagcatgcttacaa

SEQ ID NO: 125246 - DNA, 25 bp, Rattus norvegicus
agcagcgagtcctgcatgcttacaa

SEQ ID NO: 125247 - DNA, 25 bp, Rattus norvegicus
agcagcgcaaggacgtgtacgtgca

SEQ ID NO: 125248 - DNA, 25 bp, Rattus norvegicus
agcagcgcaaggtcgtgtacgtgca

SEQ ID NO: 125249 - DNA, 25 bp, Rattus norvegicus
agcagcgcactcacaggaagcattg

SEQ ID NO: 125250 - DNA, 25 bp, Rattus norvegicus
agcagcgcactctcaggaagcattg

SEQ ID NO: 125251 - DNA, 25 bp, Rattus norvegicus
agcagcgcagcacaactctttggaa

SEQ ID NO: 125252 - DNA, 25 bp, Rattus norvegicus
agcagcgcagcagaactctttggaa

SEQ ID NO: 125253 - DNA, 25 bp, Rattus norvegicus
agcagcgcagccaacactttaatgt

SEQ ID NO: 125254 - DNA, 25 bp, Rattus norvegicus
agcagcgcagcctacactttaatgt

SEQ ID NO: 125255 - DNA, 25 bp, Rattus norvegicus
agcagcgcatccaagttcaagctgg

SEQ ID NO: 125256 - DNA, 25 bp, Rattus norvegicus
agcagcgcatcctagttcaagctgg

SEQ ID NO: 125257 - DNA, 25 bp, Rattus norvegicus
agcagcgccatcaggcacagcaagg

SEQ ID NO: 125258 - DNA, 25 bp, Rattus norvegicus
agcagcgccatctggcacagcaagg

SEQ ID NO: 125259 - DNA, 25 bp, Rattus norvegicus
agcagcgccgcccaaggtaaaagtt

SEQ ID NO: 125260 - DNA, 25 bp, Rattus norvegicus
agcagcgccgccgaaggtaaaagtt

SEQ ID NO: 125261 - DNA, 25 bp, Rattus norvegicus
agcagcgcctggagtcctgggtaaa

SEQ ID NO: 125262 - DNA, 25 bp, Rattus norvegicus
agcagcgcctggtgtcctgggtaaa

SEQ ID NO: 125263 - DNA, 25 bp, Rattus norvegicus
agcagcgcgcagagccagtggaaaa

SEQ ID NO: 125264 - DNA, 25 bp, Rattus norvegicus
agcagcgcgcagtgccagtggaaaa

SEQ ID NO: 125265 - DNA, 25 bp, Rattus norvegicus
agcagcgcgcccctcgcgatgtccg

SEQ ID NO: 125266 - DNA, 25 bp, Rattus norvegicus
agcagcgcgcccgtcgcgatgtccg

SEQ ID NO: 125267 - DNA, 25 bp, Rattus norvegicus
agcagcgcggacacctcgagttgag

SEQ ID NO: 125268 - DNA, 25 bp, Rattus norvegicus
agcagcgcggactcctcgagttgag

SEQ ID NO: 125269 - DNA, 25 bp, Rattus norvegicus
agcagcgcgtcgctcgtctccgtgg

SEQ ID NO: 125270 - DNA, 25 bp, Rattus norvegicus
agcagcgcgtcggtcgtctccgtgg

SEQ ID NO: 125271 - DNA, 25 bp, Rattus norvegicus
agcagcgctccacatgctgattggc

SEQ ID NO: 125272 - DNA, 25 bp, Rattus norvegicus
agcagcgctccagatgctgattggc

SEQ ID NO: 125273 - DNA, 25 bp, Rattus norvegicus
agcagcgctggaagcttcaggtcca

SEQ ID NO: 125274 - DNA, 25 bp, Rattus norvegicus
agcagcgctggatgcttcaggtcca

SEQ ID NO: 125275 - DNA, 25 bp, Rattus norvegicus
agcagcgctgttaacctgggtcaca

SEQ ID NO: 125276 - DNA, 25 bp, Rattus norvegicus
agcagcgctgtttacctgggtcaca

SEQ ID NO: 125277 - DNA, 25 bp, Rattus norvegicus
agcagcggacacacattatgcggtt

SEQ ID NO: 125278 - DNA, 25 bp, Rattus norvegicus
agcagcggacactcattatgcggtt

SEQ ID NO: 125279 - DNA, 25 bp, Rattus norvegicus
agcagcggaggtacgggaactcctt

SEQ ID NO: 125280 - DNA, 25 bp, Rattus norvegicus
agcagcggaggttcgggaactcctt

SEQ ID NO: 125281 - DNA, 25 bp, Rattus norvegicus
agcagcggcaacacaaccctgagta

SEQ ID NO: 125282 - DNA, 25 bp, Rattus norvegicus
agcagcggcaactcaaccctgagta

SEQ ID NO: 125283 - DNA, 25 bp, Rattus norvegicus
agcagcggcagccaagccacagtgc

SEQ ID NO: 125284 - DNA, 25 bp, Rattus norvegicus
agcagcggcagcgaagccacagtgc

SEQ ID NO: 125285 - DNA, 25 bp, Rattus norvegicus
agcagcggccaacagcagccaacag

SEQ ID NO: 125286 - DNA, 25 bp, Rattus norvegicus
agcagcggccaagagcagccaacag

SEQ ID NO: 125287 - DNA, 25 bp, Rattus norvegicus
agcagcggccttacggctatgagca

SEQ ID NO: 125288 - DNA, 25 bp, Rattus norvegicus
agcagcggcctttcggctatgagca

SEQ ID NO: 125289 - DNA, 25 bp, Rattus norvegicus
agcagcggctgtacaaggacgacca

SEQ ID NO: 125290 - DNA, 25 bp, Rattus norvegicus
agcagcggctgttcaaggacgacca

SEQ ID NO: 125291 - DNA, 25 bp, Rattus norvegicus
agcagcggcttgctggtgacttctc

SEQ ID NO: 125292 - DNA, 25 bp, Rattus norvegicus
agcagcggcttggtggtgacttctc

SEQ ID NO: 125293 - DNA, 25 bp, Rattus norvegicus
agcagcgggcaccattatcaacgaa

SEQ ID NO: 125294 - DNA, 25 bp, Rattus norvegicus
agcagcgggcacgattatcaacgaa

SEQ ID NO: 125295 - DNA, 25 bp, Rattus norvegicus
agcagcggtctgaagcatcaacatc

SEQ ID NO: 125296 - DNA, 25 bp, Rattus norvegicus
agcagcggtctgtagcatcaacatc

SEQ ID NO: 125297 - DNA, 25 bp, Rattus norvegicus
agcagcggtgtgacgatgactccat

SEQ ID NO: 125298 - DNA, 25 bp, Rattus norvegicus
agcagcggtgtgtcgatgactccat

SEQ ID NO: 125299 - DNA, 25 bp, Rattus norvegicus
agcagcgtctctcgcagtcaagata

SEQ ID NO: 125300 - DNA, 25 bp, Rattus norvegicus
agcagcgtctctggcagtcaagata

SEQ ID NO: 125301 - DNA, 25 bp, Rattus norvegicus
agcagcgtgtgcatcaggagcacct

SEQ ID NO: 125302 - DNA, 25 bp, Rattus norvegicus
agcagcgtgtgcttcaggagcacct

SEQ ID NO: 125303 - DNA, 25 bp, Rattus norvegicus
agcagcgttccgatttctgtctgga

SEQ ID NO: 125304 - DNA, 25 bp, Rattus norvegicus
agcagcgttccgttttctgtctgga

SEQ ID NO: 125305 - DNA, 25 bp, Rattus norvegicus
agcagcgtttcaaatcttccattat

SEQ ID NO: 125306 - DNA, 25 bp, Rattus norvegicus
agcagcgtttcatatcttccattat

SEQ ID NO: 125307 - DNA, 25 bp, Rattus norvegicus
agcagcgtttctctggagacacttt

SEQ ID NO: 125308 - DNA, 25 bp, Rattus norvegicus
agcagcgtttctgtggagacacttt

SEQ ID NO: 125309 - DNA, 25 bp, Rattus norvegicus
agcagctaacccattgcagcctggt

SEQ ID NO: 125310 - DNA, 25 bp, Rattus norvegicus
agcagctaaccctttgcagcctggt

SEQ ID NO: 125311 - DNA, 25 bp, Rattus norvegicus
agcagctaagggacttctcttccga

SEQ ID NO: 125312 - DNA, 25 bp, Rattus norvegicus
agcagctaagggtcttctcttccga

SEQ ID NO: 125313 - DNA, 25 bp, Rattus norvegicus
agcagctaatgccaatacttccacc

SEQ ID NO: 125314 - DNA, 25 bp, Rattus norvegicus
agcagctaatgcgaatacttccacc

SEQ ID NO: 125315 - DNA, 25 bp, Rattus norvegicus
agcagctaatttatatccccgagac

SEQ ID NO: 125316 - DNA, 25 bp, Rattus norvegicus
agcagctaatttttatccccgagac

SEQ ID NO: 125317 - DNA, 25 bp, Rattus norvegicus
agcagctacatgcttgtcagccaag

SEQ ID NO: 125318 - DNA, 25 bp, Rattus norvegicus
agcagctacatggttgtcagccaag

SEQ ID NO: 125319 - DNA, 25 bp, Rattus norvegicus
agcagctaccgactgcaggagcaga

SEQ ID NO: 125320 - DNA, 25 bp, Rattus norvegicus
agcagctaccgagtgcaggagcaga

SEQ ID NO: 125321 - DNA, 25 bp, Rattus norvegicus
agcagctacgacacgaccatgggag

SEQ ID NO: 125322 - DNA, 25 bp, Rattus norvegicus
agcagctacgactcgaccatgggag

SEQ ID NO: 125323 - DNA, 25 bp, Rattus norvegicus
agcagctacgccagtgtgaattagt

SEQ ID NO: 125324 - DNA, 25 bp, Rattus norvegicus
agcagctacgcctgtgtgaattagt

SEQ ID NO: 125325 - DNA, 25 bp, Rattus norvegicus
agcagctactagctaccgccagaag

SEQ ID NO: 125326 - DNA, 25 bp, Rattus norvegicus
agcagctactaggtaccgccagaag

SEQ ID NO: 125327 - DNA, 25 bp, Rattus norvegicus
agcagctactgcaggctgagaaagc

SEQ ID NO: 125328 - DNA, 25 bp, Rattus norvegicus
agcagctactgctggctgagaaagc

SEQ ID NO: 125329 - DNA, 25 bp, Rattus norvegicus
agcagctacttcatgtatgcacaag

SEQ ID NO: 125330 - DNA, 25 bp, Rattus norvegicus
agcagctacttcttgtatgcacaag

SEQ ID NO: 125331 - DNA, 25 bp, Rattus norvegicus
agcagctagaatattcctaccccaa

SEQ ID NO: 125332 - DNA, 25 bp, Rattus norvegicus
agcagctagaattttcctaccccaa

SEQ ID NO: 125333 - DNA, 25 bp, Rattus norvegicus
agcagctagacacatgtgccctcac

SEQ ID NO: 125334 - DNA, 25 bp, Rattus norvegicus
agcagctagacagatgtgccctcac

SEQ ID NO: 125335 - DNA, 25 bp, Rattus norvegicus
agcagctagtagaacatttctgaga

SEQ ID NO: 125336 - DNA, 25 bp, Rattus norvegicus
agcagctagtagtacatttctgaga

SEQ ID NO: 125337 - DNA, 25 bp, Rattus norvegicus
agcagctagtcaaatccttcaaaac

SEQ ID NO: 125338 - DNA, 25 bp, Rattus norvegicus
agcagctagtcatatccttcaaaac

SEQ ID NO: 125339 - DNA, 25 bp, Rattus norvegicus
agcagctagtgtctgtggtagtcac

SEQ ID NO: 125340 - DNA, 25 bp, Rattus norvegicus
agcagctagtgtgtgtggtagtcac

SEQ ID NO: 125341 - DNA, 25 bp, Rattus norvegicus
agcagctatagtaacccgcacaaga

SEQ ID NO: 125342 - DNA, 25 bp, Rattus norvegicus
agcagctatagttacccgcacaaga

SEQ ID NO: 125343 - DNA, 25 bp, Rattus norvegicus
agcagctatgcccagatgactttgg

SEQ ID NO: 125344 - DNA, 25 bp, Rattus norvegicus
agcagctatgccgagatgactttgg

SEQ ID NO: 125345 - DNA, 25 bp, Rattus norvegicus
agcagctatgctactttccaataaa

SEQ ID NO: 125346 - DNA, 25 bp, Rattus norvegicus
agcagctatgcttctttccaataaa

SEQ ID NO: 125347 - DNA, 25 bp, Rattus norvegicus
agcagctatttacatggcctcccag

SEQ ID NO: 125348 - DNA, 25 bp, Rattus norvegicus
agcagctatttagatggcctcccag

SEQ ID NO: 125349 - DNA, 25 bp, Rattus norvegicus
agcagctcaagcagttgcgcagtaa

SEQ ID NO: 125350 - DNA, 25 bp, Rattus norvegicus
agcagctcaagctgttgcgcagtaa

SEQ ID NO: 125351 - DNA, 25 bp, Rattus norvegicus
agcagctcagacacagacagaccct

SEQ ID NO: 125352 - DNA, 25 bp, Rattus norvegicus
agcagctcagactcagacagaccct

SEQ ID NO: 125353 - DNA, 25 bp, Rattus norvegicus
agcagctcaggaccactcagtggtg

SEQ ID NO: 125354 - DNA, 25 bp, Rattus norvegicus
agcagctcaggagcactcagtggtg

SEQ ID NO: 125355 - DNA, 25 bp, Rattus norvegicus
agcagctcagtaactactccagagg

SEQ ID NO: 125356 - DNA, 25 bp, Rattus norvegicus
agcagctcagtatctactccagagg

SEQ ID NO: 125357 - DNA, 25 bp, Rattus norvegicus
agcagctcagtcaggtgtcagttca

SEQ ID NO: 125358 - DNA, 25 bp, Rattus norvegicus
agcagctcagtctggtgtcagttca

SEQ ID NO: 125359 - DNA, 25 bp, Rattus norvegicus
agcagctcagttctggtgtttttat

SEQ ID NO: 125360 - DNA, 25 bp, Rattus norvegicus
agcagctcagttgtggtgtttttat

SEQ ID NO: 125361 - DNA, 25 bp, Rattus norvegicus
agcagctcatctaggaaccagacca

SEQ ID NO: 125362 - DNA, 25 bp, Rattus norvegicus
agcagctcatcttggaaccagacca

SEQ ID NO: 125363 - DNA, 25 bp, Rattus norvegicus
agcagctccagtctccctgaagctg

SEQ ID NO: 125364 - DNA, 25 bp, Rattus norvegicus
agcagctccagtgtccctgaagctg

SEQ ID NO: 125365 - DNA, 25 bp, Rattus norvegicus
agcagctcccagagatgctgtattt

SEQ ID NO: 125366 - DNA, 25 bp, Rattus norvegicus
agcagctcccagtgatgctgtattt

SEQ ID NO: 125367 - DNA, 25 bp, Rattus norvegicus
agcagctccctgattgtgagaggaa

SEQ ID NO: 125368 - DNA, 25 bp, Rattus norvegicus
agcagctccctgtttgtgagaggaa

SEQ ID NO: 125369 - DNA, 25 bp, Rattus norvegicus
agcagctcccttcatgttgcttttg

SEQ ID NO: 125370 - DNA, 25 bp, Rattus norvegicus
agcagctcccttgatgttgcttttg

SEQ ID NO: 125371 - DNA, 25 bp, Rattus norvegicus
agcagctccgcgagcgtgcgcagca

SEQ ID NO: 125372 - DNA, 25 bp, Rattus norvegicus
agcagctccgcgtgcgtgcgcagca

SEQ ID NO: 125373 - DNA, 25 bp, Rattus norvegicus
agcagctcctctcttcaacatagga

SEQ ID NO: 125374 - DNA, 25 bp, Rattus norvegicus
agcagctcctctgttcaacatagga

SEQ ID NO: 125375 - DNA, 25 bp, Rattus norvegicus
agcagctcctgcatcagcgggaagt

SEQ ID NO: 125376 - DNA, 25 bp, Rattus norvegicus
agcagctcctgcttcagcgggaagt

SEQ ID NO: 125377 - DNA, 25 bp, Rattus norvegicus
agcagctcgctgaatgtgcgcccat

SEQ ID NO: 125378 - DNA, 25 bp, Rattus norvegicus
agcagctcgctgtatgtgcgcccat

SEQ ID NO: 125379 - DNA, 25 bp, Rattus norvegicus
agcagctcgttgaactgctgggtca

SEQ ID NO: 125380 - DNA, 25 bp, Rattus norvegicus
agcagctcgttgtactgctgggtca

SEQ ID NO: 125381 - DNA, 25 bp, Rattus norvegicus
agcagctctactacaaatcctactt

SEQ ID NO: 125382 - DNA, 25 bp, Rattus norvegicus
agcagctctacttcaaatcctactt

SEQ ID NO: 125383 - DNA, 25 bp, Rattus norvegicus
agcagctctatgagtggtccaagga

SEQ ID NO: 125384 - DNA, 25 bp, Rattus norvegicus
agcagctctatgtgtggtccaagga

SEQ ID NO: 125385 - DNA, 25 bp, Rattus norvegicus
agcagctctctaaggcttacgcaat

SEQ ID NO: 125386 - DNA, 25 bp, Rattus norvegicus
agcagctctctatggcttacgcaat

SEQ ID NO: 125387 - DNA, 25 bp, Rattus norvegicus
agcagctctctgcaggcgtttggaa

SEQ ID NO: 125388 - DNA, 25 bp, Rattus norvegicus
agcagctctctggaggcgtttggaa

SEQ ID NO: 125389 - DNA, 25 bp, Rattus norvegicus
agcagctctcttatctccagagaca

SEQ ID NO: 125390 - DNA, 25 bp, Rattus norvegicus
agcagctctcttttctccagagaca

SEQ ID NO: 125391 - DNA, 25 bp, Rattus norvegicus
agcagctctgcgaggcatacatgta

SEQ ID NO: 125392 - DNA, 25 bp, Rattus norvegicus
agcagctctgcgtggcatacatgta

SEQ ID NO: 125393 - DNA, 25 bp, Rattus norvegicus
agcagctctgtgagggaccttcaaa

SEQ ID NO: 125394 - DNA, 25 bp, Rattus norvegicus
agcagctctgtgtgggaccttcaaa

SEQ ID NO: 125395 - DNA, 25 bp, Rattus norvegicus
agcagctcttcaaggcttttcagaa

SEQ ID NO: 125396 - DNA, 25 bp, Rattus norvegicus
agcagctcttcatggcttttcagaa

SEQ ID NO: 125397 - DNA, 25 bp, Rattus norvegicus
agcagctgaagcacagagcccagta

SEQ ID NO: 125398 - DNA, 25 bp, Rattus norvegicus
agcagctgaagcatctcaaggaaaa

SEQ ID NO: 125399 - DNA, 25 bp, Rattus norvegicus
agcagctgaagctcagagcccagta

SEQ ID NO: 125400 - DNA, 25 bp, Rattus norvegicus
agcagctgaagcttctcaaggaaaa

SEQ ID NO: 125401 - DNA, 25 bp, Rattus norvegicus
agcagctgacacaggcccaggtaga

SEQ ID NO: 125402 - DNA, 25 bp, Rattus norvegicus
agcagctgacactggcccaggtaga

SEQ ID NO: 125403 - DNA, 25 bp, Rattus norvegicus
agcagctgacggaggacccacagtt

SEQ ID NO: 125404 - DNA, 25 bp, Rattus norvegicus
agcagctgacggtggacccacagtt

SEQ ID NO: 125405 - DNA, 25 bp, Rattus norvegicus
agcagctgagataggaagcctccat

SEQ ID NO: 125406 - DNA, 25 bp, Rattus norvegicus
agcagctgagattggaagcctccat

SEQ ID NO: 125407 - DNA, 25 bp, Rattus norvegicus
agcagctgagctagaggaggccctc

SEQ ID NO: 125408 - DNA, 25 bp, Rattus norvegicus
agcagctgagctctagccatgggtc

SEQ ID NO: 125409 - DNA, 25 bp, Rattus norvegicus
agcagctgagctgtagccatgggtc

SEQ ID NO: 125410 - DNA, 25 bp, Rattus norvegicus
agcagctgagcttgaggaggccctc

SEQ ID NO: 125411 - DNA, 25 bp, Rattus norvegicus
agcagctgatccaggttattcgctc

SEQ ID NO: 125412 - DNA, 25 bp, Rattus norvegicus
agcagctgatcctggttattcgctc

SEQ ID NO: 125413 - DNA, 25 bp, Rattus norvegicus
agcagctgatgtctttctggtggaa

SEQ ID NO: 125414 - DNA, 25 bp, Rattus norvegicus
agcagctgatgtgtttctggtggaa

SEQ ID NO: 125415 - DNA, 25 bp, Rattus norvegicus
agcagctgccaacacggccaggtag

SEQ ID NO: 125416 - DNA, 25 bp, Rattus norvegicus
agcagctgccaagacggccaggtag

SEQ ID NO: 125417 - DNA, 25 bp, Rattus norvegicus
agcagctgccacatggctagggaat

SEQ ID NO: 125418 - DNA, 25 bp, Rattus norvegicus
agcagctgccacttggctagggaat

SEQ ID NO: 125419 - DNA, 25 bp, Rattus norvegicus
agcagctgcctcaacatcagctacg

SEQ ID NO: 125420 - DNA, 25 bp, Rattus norvegicus
agcagctgcctctacatcagctacg

SEQ ID NO: 125421 - DNA, 25 bp, Rattus norvegicus
agcagctgccttcggtcagccagtg

SEQ ID NO: 125422 - DNA, 25 bp, Rattus norvegicus
agcagctgccttgggtcagccagtg

SEQ ID NO: 125423 - DNA, 25 bp, Rattus norvegicus
agcagctgcgccaatacatttcatg

SEQ ID NO: 125424 - DNA, 25 bp, Rattus norvegicus
agcagctgcgccagaagatcaacag

SEQ ID NO: 125425 - DNA, 25 bp, Rattus norvegicus
agcagctgcgcctatacatttcatg

SEQ ID NO: 125426 - DNA, 25 bp, Rattus norvegicus
agcagctgcgcctgaagatcaacag

SEQ ID NO: 125427 - DNA, 25 bp, Rattus norvegicus
agcagctgcgcgatcagctcggaca

SEQ ID NO: 125428 - DNA, 25 bp, Rattus norvegicus
agcagctgcgcgttcagctcggaca

SEQ ID NO: 125429 - DNA, 25 bp, Rattus norvegicus
agcagctgcgtcctcagaataggtg

SEQ ID NO: 125430 - DNA, 25 bp, Rattus norvegicus
agcagctgcgtcgtcagaataggtg

SEQ ID NO: 125431 - DNA, 25 bp, Rattus norvegicus
agcagctgctaaactctgggtggca

SEQ ID NO: 125432 - DNA, 25 bp, Rattus norvegicus
agcagctgctaatctctgggtggca

SEQ ID NO: 125433 - DNA, 25 bp, Rattus norvegicus
agcagctgcttcagccagggtggaa

SEQ ID NO: 125434 - DNA, 25 bp, Rattus norvegicus
agcagctgcttctgccagggtggaa

SEQ ID NO: 125435 - DNA, 25 bp, Rattus norvegicus
agcagctggactctgctgagatcct

SEQ ID NO: 125436 - DNA, 25 bp, Rattus norvegicus
agcagctggactgtgctgagatcct

SEQ ID NO: 125437 - DNA, 25 bp, Rattus norvegicus
agcagctggagcactgaggcctcta

SEQ ID NO: 125438 - DNA, 25 bp, Rattus norvegicus
agcagctggagctctgaggcctcta

SEQ ID NO: 125439 - DNA, 25 bp, Rattus norvegicus
agcagctggagtaggagaaacgctt

SEQ ID NO: 125440 - DNA, 25 bp, Rattus norvegicus
agcagctggagttggagaaacgctt

SEQ ID NO: 125441 - DNA, 25 bp, Rattus norvegicus
agcagctggcacagcctcaggaaag

SEQ ID NO: 125442 - DNA, 25 bp, Rattus norvegicus
agcagctggcactgcctcaggaaag

SEQ ID NO: 125443 - DNA, 25 bp, Rattus norvegicus
agcagctggcctactgtatacatga

SEQ ID NO: 125444 - DNA, 25 bp, Rattus norvegicus
agcagctggccttctgtatacatga

SEQ ID NO: 125445 - DNA, 25 bp, Rattus norvegicus
agcagctgggccaattccctggccg

SEQ ID NO: 125446 - DNA, 25 bp, Rattus norvegicus
agcagctgggccctgttccttgtca

SEQ ID NO: 125447 - DNA, 25 bp, Rattus norvegicus
agcagctgggccgtgttccttgtca

SEQ ID NO: 125448 - DNA, 25 bp, Rattus norvegicus
agcagctgggcctattccctggccg

SEQ ID NO: 125449 - DNA, 25 bp, Rattus norvegicus
agcagctgggtgatttctttggcat

SEQ ID NO: 125450 - DNA, 25 bp, Rattus norvegicus
agcagctgggtgttttctttggcat

SEQ ID NO: 125451 - DNA, 25 bp, Rattus norvegicus
agcagctggtcacgcagatcccgca

SEQ ID NO: 125452 - DNA, 25 bp, Rattus norvegicus
agcagctggtcaggcagatcccgca

SEQ ID NO: 125453 - DNA, 25 bp, Rattus norvegicus
agcagctggtctcggacaagtgccc

SEQ ID NO: 125454 - DNA, 25 bp, Rattus norvegicus
agcagctggtctgggacaagtgccc

SEQ ID NO: 125455 - DNA, 25 bp, Rattus norvegicus
agcagctggtgaacgcatatggcat

SEQ ID NO: 125456 - DNA, 25 bp, Rattus norvegicus
agcagctggtgatcgcatatggcat

SEQ ID NO: 125457 - DNA, 25 bp, Rattus norvegicus
agcagctgtcaacgcctaaggtcac

SEQ ID NO: 125458 - DNA, 25 bp, Rattus norvegicus
agcagctgtcaaggcctaaggtcac

SEQ ID NO: 125459 - DNA, 25 bp, Rattus norvegicus
agcagctgtcgccagagctcagcac

SEQ ID NO: 125460 - DNA, 25 bp, Rattus norvegicus
agcagctgtcgcgagagctcagcac

SEQ ID NO: 125461 - DNA, 25 bp, Rattus norvegicus
agcagctgtgctctgtctgcactga

SEQ ID NO: 125462 - DNA, 25 bp, Rattus norvegicus
agcagctgtgctgtgtctgcactga

SEQ ID NO: 125463 - DNA, 25 bp, Rattus norvegicus
agcagctgtgtgagcactgggaatc

SEQ ID NO: 125464 - DNA, 25 bp, Rattus norvegicus
agcagctgtgtgtgcactgggaatc

SEQ ID NO: 125465 - DNA, 25 bp, Rattus norvegicus
agcagcttatcacctgtgttgcggt

SEQ ID NO: 125466 - DNA, 25 bp, Rattus norvegicus
agcagcttatcagctgtgttgcggt

SEQ ID NO: 125467 - DNA, 25 bp, Rattus norvegicus
agcagcttcagcacattgatgagca

SEQ ID NO: 125468 - DNA, 25 bp, Rattus norvegicus
agcagcttcagctcattgatgagca

SEQ ID NO: 125469 - DNA, 25 bp, Rattus norvegicus
agcagcttcagtacttttattacaa

SEQ ID NO: 125470 - DNA, 25 bp, Rattus norvegicus
agcagcttcagtagctgtcactgat

SEQ ID NO: 125471 - DNA, 25 bp, Rattus norvegicus
agcagcttcagttcttttattacaa

SEQ ID NO: 125472 - DNA, 25 bp, Rattus norvegicus
agcagcttcagttgctgtcactgat

SEQ ID NO: 125473 - DNA, 25 bp, Rattus norvegicus
agcagcttccgcaggagtctgtgca

SEQ ID NO: 125474 - DNA, 25 bp, Rattus norvegicus
agcagcttccgctggagtctgtgca

SEQ ID NO: 125475 - DNA, 25 bp, Rattus norvegicus
agcagcttccttagtgatgcccaaa

SEQ ID NO: 125476 - DNA, 25 bp, Rattus norvegicus
agcagcttcctttgtgatgcccaaa

SEQ ID NO: 125477 - DNA, 25 bp, Rattus norvegicus
agcagcttcgagaggcctcttatga

SEQ ID NO: 125478 - DNA, 25 bp, Rattus norvegicus
agcagcttcgagtggcctcttatga

SEQ ID NO: 125479 - DNA, 25 bp, Rattus norvegicus
agcagcttctcaccttctatggatg

SEQ ID NO: 125480 - DNA, 25 bp, Rattus norvegicus
agcagcttctcagcttctatggatg

SEQ ID NO: 125481 - DNA, 25 bp, Rattus norvegicus
agcagcttcttaccactgtcagtgc

SEQ ID NO: 125482 - DNA, 25 bp, Rattus norvegicus
agcagcttcttagcactgtcagtgc

SEQ ID NO: 125483 - DNA, 25 bp, Rattus norvegicus
agcagcttgaatcctgttctctatg

SEQ ID NO: 125484 - DNA, 25 bp, Rattus norvegicus
agcagcttgaatgctgttctctatg

SEQ ID NO: 125485 - DNA, 25 bp, Rattus norvegicus
agcagcttgagcaacggccatggcg

SEQ ID NO: 125486 - DNA, 25 bp, Rattus norvegicus
agcagcttgagctacggccatggcg

SEQ ID NO: 125487 - DNA, 25 bp, Rattus norvegicus
agcagcttgcttacggtgctggcac

SEQ ID NO: 125488 - DNA, 25 bp, Rattus norvegicus
agcagcttgcttagtaggccattta

SEQ ID NO: 125489 - DNA, 25 bp, Rattus norvegicus
agcagcttgctttcggtgctggcac

SEQ ID NO: 125490 - DNA, 25 bp, Rattus norvegicus
agcagcttgctttgtaggccattta

SEQ ID NO: 125491 - DNA, 25 bp, Rattus norvegicus
agcagcttggatcccatgggccgtt

SEQ ID NO: 125492 - DNA, 25 bp, Rattus norvegicus
agcagcttggatgccatgggccgtt

SEQ ID NO: 125493 - DNA, 25 bp, Rattus norvegicus
agcagcttggcccatgaccaaagac

SEQ ID NO: 125494 - DNA, 25 bp, Rattus norvegicus
agcagcttggccgatgaccaaagac

SEQ ID NO: 125495 - DNA, 25 bp, Rattus norvegicus
agcagcttgggcacccggctctgga

SEQ ID NO: 125496 - DNA, 25 bp, Rattus norvegicus
agcagcttgggctcccggctctgga

SEQ ID NO: 125497 - DNA, 25 bp, Rattus norvegicus
agcagcttggtcctcacagtgattg

SEQ ID NO: 125498 - DNA, 25 bp, Rattus norvegicus
agcagcttggtcgtcacagtgattg

SEQ ID NO: 125499 - DNA, 25 bp, Rattus norvegicus
agcagcttgtccacgatcatgctcc

SEQ ID NO: 125500 - DNA, 25 bp, Rattus norvegicus
agcagcttgtcctcgatcatgctcc

SEQ ID NO: 125501 - DNA, 25 bp, Rattus norvegicus
agcagctttaaaagatccccagtgg

SEQ ID NO: 125502 - DNA, 25 bp, Rattus norvegicus
agcagctttaaatgatccccagtgg

SEQ ID NO: 125503 - DNA, 25 bp, Rattus norvegicus
agcagctttcctatgggcagtacac

SEQ ID NO: 125504 - DNA, 25 bp, Rattus norvegicus
agcagctttcctttgggcagtacac

SEQ ID NO: 125505 - DNA, 25 bp, Rattus norvegicus
agcagctttgcaaagagcctccggg

SEQ ID NO: 125506 - DNA, 25 bp, Rattus norvegicus
agcagctttgcatagagcctccggg

SEQ ID NO: 125507 - DNA, 25 bp, Rattus norvegicus
agcagctttgctcagcctatgtcta

SEQ ID NO: 125508 - DNA, 25 bp, Rattus norvegicus
agcagctttgctgagcctatgtcta

SEQ ID NO: 125509 - DNA, 25 bp, Rattus norvegicus
agcagcttttatccacattgacaaa

SEQ ID NO: 125510 - DNA, 25 bp, Rattus norvegicus
agcagcttttatgcacattgacaaa

SEQ ID NO: 125511 - DNA, 25 bp, Rattus norvegicus
agcaggaaacacaataagcaagtct

SEQ ID NO: 125512 - DNA, 25 bp, Rattus norvegicus
agcaggaaacactataagcaagtct

SEQ ID NO: 125513 - DNA, 25 bp, Rattus norvegicus
agcaggaacagcacccgggttttgc

SEQ ID NO: 125514 - DNA, 25 bp, Rattus norvegicus
agcaggaacagcagcgaagaggcct

SEQ ID NO: 125515 - DNA, 25 bp, Rattus norvegicus
agcaggaacagctcccgggttttgc

SEQ ID NO: 125516 - DNA, 25 bp, Rattus norvegicus
agcaggaacagctgcgaagaggcct

SEQ ID NO: 125517 - DNA, 25 bp, Rattus norvegicus
agcaggaacatgacttgatctcttg

SEQ ID NO: 125518 - DNA, 25 bp, Rattus norvegicus
agcaggaacatgtcttgatctcttg

SEQ ID NO: 125519 - DNA, 25 bp, Rattus norvegicus
agcaggaacgacatcgggccaagag

SEQ ID NO: 125520 - DNA, 25 bp, Rattus norvegicus
agcaggaacgacttcgggccaagag

SEQ ID NO: 125521 - DNA, 25 bp, Rattus norvegicus
agcaggaagagaccccttgtctttt

SEQ ID NO: 125522 - DNA, 25 bp, Rattus norvegicus
agcaggaagagagcccttgtctttt

SEQ ID NO: 125523 - DNA, 25 bp, Rattus norvegicus
agcaggaagatcaggccccggaatt

SEQ ID NO: 125524 - DNA, 25 bp, Rattus norvegicus
agcaggaagatctggccccggaatt

SEQ ID NO: 125525 - DNA, 25 bp, Rattus norvegicus
agcaggaagctgatgtgattaatga

SEQ ID NO: 125526 - DNA, 25 bp, Rattus norvegicus
agcaggaagctgttgtgattaatga

SEQ ID NO: 125527 - DNA, 25 bp, Rattus norvegicus
agcaggaagcttcacctcagttctt

SEQ ID NO: 125528 - DNA, 25 bp, Rattus norvegicus
agcaggaagcttgacctcagttctt

SEQ ID NO: 125529 - DNA, 25 bp, Rattus norvegicus
agcaggaaggtgcttggaccatcct

SEQ ID NO: 125530 - DNA, 25 bp, Rattus norvegicus
agcaggaaggtggttggaccatcct

SEQ ID NO: 125531 - DNA, 25 bp, Rattus norvegicus
agcaggaagtaactagcagcctttg

SEQ ID NO: 125532 - DNA, 25 bp, Rattus norvegicus
agcaggaagtaagtagcagcctttg

SEQ ID NO: 125533 - DNA, 25 bp, Rattus norvegicus
agcaggaatctgcattcaggtacaa

SEQ ID NO: 125534 - DNA, 25 bp, Rattus norvegicus
agcaggaatctggattcaggtacaa

SEQ ID NO: 125535 - DNA, 25 bp, Rattus norvegicus
agcaggacacctcgcttcaagtcaa

SEQ ID NO: 125536 - DNA, 25 bp, Rattus norvegicus
agcaggacacctggcttcaagtcaa

SEQ ID NO: 125537 - DNA, 25 bp, Rattus norvegicus
agcaggacagcaagccggttctgaa

SEQ ID NO: 125538 - DNA, 25 bp, Rattus norvegicus
agcaggacagcatgccggttctgaa

SEQ ID NO: 125539 - DNA, 25 bp, Rattus norvegicus
agcaggacagttcacaccctcagct

SEQ ID NO: 125540 - DNA, 25 bp, Rattus norvegicus
agcaggacagttgacaccctcagct

SEQ ID NO: 125541 - DNA, 25 bp, Rattus norvegicus
agcaggacatcgctcagcctatgtg

SEQ ID NO: 125542 - DNA, 25 bp, Rattus norvegicus
agcaggacatcggtcagcctatgtg

SEQ ID NO: 125543 - DNA, 25 bp, Rattus norvegicus
agcaggacattcagagccagcggaa

SEQ ID NO: 125544 - DNA, 25 bp, Rattus norvegicus
agcaggacattctgagccagcggaa

SEQ ID NO: 125545 - DNA, 25 bp, Rattus norvegicus
agcaggaccacaatccagaccagga

SEQ ID NO: 125546 - DNA, 25 bp, Rattus norvegicus
agcaggaccacattccagaccagga

SEQ ID NO: 125547 - DNA, 25 bp, Rattus norvegicus
agcaggaccatacctcatgtggcaa

SEQ ID NO: 125548 - DNA, 25 bp, Rattus norvegicus
agcaggaccatagctcatgtggcaa

SEQ ID NO: 125549 - DNA, 25 bp, Rattus norvegicus
agcaggaccctgaattggacaaaga

SEQ ID NO: 125550 - DNA, 25 bp, Rattus norvegicus
agcaggaccctgtattggacaaaga

SEQ ID NO: 125551 - DNA, 25 bp, Rattus norvegicus
agcaggaccttgctcttcagtggca

SEQ ID NO: 125552 - DNA, 25 bp, Rattus norvegicus
agcaggaccttggtcttcagtggca

SEQ ID NO: 125553 - DNA, 25 bp, Rattus norvegicus
agcaggactatgctcttaggacccc

SEQ ID NO: 125554 - DNA, 25 bp, Rattus norvegicus
agcaggactatggtcttaggacccc

SEQ ID NO: 125555 - DNA, 25 bp, Rattus norvegicus
agcaggactcctaatttttcttgtt

SEQ ID NO: 125556 - DNA, 25 bp, Rattus norvegicus
agcaggactccttatttttcttgtt

SEQ ID NO: 125557 - DNA, 25 bp, Rattus norvegicus
agcaggactcggatacagagaaggt

SEQ ID NO: 125558 - DNA, 25 bp, Rattus norvegicus
agcaggactcggttacagagaaggt

SEQ ID NO: 125559 - DNA, 25 bp, Rattus norvegicus
agcaggactcgtagatgatccccgg

SEQ ID NO: 125560 - DNA, 25 bp, Rattus norvegicus
agcaggactcgttgatgatccccgg

SEQ ID NO: 125561 - DNA, 25 bp, Rattus norvegicus
agcaggactgaacgtccgcctgtga

SEQ ID NO: 125562 - DNA, 25 bp, Rattus norvegicus
agcaggactgaaggtccgcctgtga

SEQ ID NO: 125563 - DNA, 25 bp, Rattus norvegicus
agcaggactggaagtgaccacccca

SEQ ID NO: 125564 - DNA, 25 bp, Rattus norvegicus
agcaggactggatgtgaccacccca

SEQ ID NO: 125565 - DNA, 25 bp, Rattus norvegicus
agcaggactgtactctgtgcatgaa

SEQ ID NO: 125566 - DNA, 25 bp, Rattus norvegicus
agcaggactgtagtctgtgcatgaa

SEQ ID NO: 125567 - DNA, 25 bp, Rattus norvegicus
agcaggactgtcaaccacaatctac

SEQ ID NO: 125568 - DNA, 25 bp, Rattus norvegicus
agcaggactgtctaccacaatctac

SEQ ID NO: 125569 - DNA, 25 bp, Rattus norvegicus
agcaggactttgctgttcttcatga

SEQ ID NO: 125570 - DNA, 25 bp, Rattus norvegicus
agcaggactttggtgttcttcatga

SEQ ID NO: 125571 - DNA, 25 bp, Rattus norvegicus
agcaggagactgcttctcgtttctt

SEQ ID NO: 125572 - DNA, 25 bp, Rattus norvegicus
agcaggagactggttctcgtttctt

SEQ ID NO: 125573 - DNA, 25 bp, Rattus norvegicus
agcaggagagtgctgcttctctgca

SEQ ID NO: 125574 - DNA, 25 bp, Rattus norvegicus
agcaggagagtggtgcttctctgca

SEQ ID NO: 125575 - DNA, 25 bp, Rattus norvegicus
agcaggagcaccagcgcgagcagac

SEQ ID NO: 125576 - DNA, 25 bp, Rattus norvegicus
agcaggagcacctgcgcgagcagac

SEQ ID NO: 125577 - DNA, 25 bp, Rattus norvegicus
agcaggagcagaacacggagtcgaa

SEQ ID NO: 125578 - DNA, 25 bp, Rattus norvegicus
agcaggagcagatcacggagtcgaa

SEQ ID NO: 125579 - DNA, 25 bp, Rattus norvegicus
agcaggagcctaagccctcagtgag

SEQ ID NO: 125580 - DNA, 25 bp, Rattus norvegicus
agcaggagcctatgccctcagtgag

SEQ ID NO: 125581 - DNA, 25 bp, Rattus norvegicus
agcaggagctcaccccttactaaac

SEQ ID NO: 125582 - DNA, 25 bp, Rattus norvegicus
agcaggagctcagcccttactaaac

SEQ ID NO: 125583 - DNA, 25 bp, Rattus norvegicus
agcaggagctctcagtctttccaaa

SEQ ID NO: 125584 - DNA, 25 bp, Rattus norvegicus
agcaggagctctgagtctttccaaa

SEQ ID NO: 125585 - DNA, 25 bp, Rattus norvegicus
agcaggagctgcatccctctgattg

SEQ ID NO: 125586 - DNA, 25 bp, Rattus norvegicus
agcaggagctgcttccctctgattg

SEQ ID NO: 125587 - DNA, 25 bp, Rattus norvegicus
agcaggagctggagcccgtgctggg

SEQ ID NO: 125588 - DNA, 25 bp, Rattus norvegicus
agcaggagctggtgcccgtgctggg

SEQ ID NO: 125589 - DNA, 25 bp, Rattus norvegicus
agcaggagctgtccctcagtgataa

SEQ ID NO: 125590 - DNA, 25 bp, Rattus norvegicus
agcaggagctgtgcctcagtgataa

SEQ ID NO: 125591 - DNA, 25 bp, Rattus norvegicus
agcaggaggatcacttgacttcccg

SEQ ID NO: 125592 - DNA, 25 bp, Rattus norvegicus
agcaggaggatctcttgacttcccg

SEQ ID NO: 125593 - DNA, 25 bp, Rattus norvegicus
agcaggagggtgagcttagccccaa

SEQ ID NO: 125594 - DNA, 25 bp, Rattus norvegicus
agcaggagggtgtgcttagccccaa

SEQ ID NO: 125595 - DNA, 25 bp, Rattus norvegicus
agcaggagtcccctttgtggtgttt

SEQ ID NO: 125596 - DNA, 25 bp, Rattus norvegicus
agcaggagtcccgtttgtggtgttt

SEQ ID NO: 125597 - DNA, 25 bp, Rattus norvegicus
agcaggagtccgagaaggcctaccc

SEQ ID NO: 125598 - DNA, 25 bp, Rattus norvegicus
agcaggagtccgtgaaggcctaccc

SEQ ID NO: 125599 - DNA, 25 bp, Rattus norvegicus
agcaggagtcctcggctctatcact

SEQ ID NO: 125600 - DNA, 25 bp, Rattus norvegicus
agcaggagtcctgggctctatcact

SEQ ID NO: 125601 - DNA, 25 bp, Rattus norvegicus
agcaggagtgcgagtcagaccgtca

SEQ ID NO: 125602 - DNA, 25 bp, Rattus norvegicus
agcaggagtgcgtgtcagaccgtca

SEQ ID NO: 125603 - DNA, 25 bp, Rattus norvegicus
agcaggagtggtcgccagccattcc

SEQ ID NO: 125604 - DNA, 25 bp, Rattus norvegicus
agcaggagtggtggccagccattcc

SEQ ID NO: 125605 - DNA, 25 bp, Rattus norvegicus
agcaggagttccagcgggcccagaa

SEQ ID NO: 125606 - DNA, 25 bp, Rattus norvegicus
agcaggagttcctgcgggcccagaa

SEQ ID NO: 125607 - DNA, 25 bp, Rattus norvegicus
agcaggatatttccgtattctttgg

SEQ ID NO: 125608 - DNA, 25 bp, Rattus norvegicus
agcaggatatttgcgtattctttgg

SEQ ID NO: 125609 - DNA, 25 bp, Rattus norvegicus
agcaggatcctcagatgattccagt

SEQ ID NO: 125610 - DNA, 25 bp, Rattus norvegicus
agcaggatcctctgatgattccagt

SEQ ID NO: 125611 - DNA, 25 bp, Rattus norvegicus
agcaggatcctgctgaatcagtcca

SEQ ID NO: 125612 - DNA, 25 bp, Rattus norvegicus
agcaggatcctggtgaatcagtcca

SEQ ID NO: 125613 - DNA, 25 bp, Rattus norvegicus
agcaggatctatcggcctcagacag

SEQ ID NO: 125614 - DNA, 25 bp, Rattus norvegicus
agcaggatctatgggcctcagacag

SEQ ID NO: 125615 - DNA, 25 bp, Rattus norvegicus
agcaggatgcccacatctttaggaa

SEQ ID NO: 125616 - DNA, 25 bp, Rattus norvegicus
agcaggatgccctcatctttaggaa

SEQ ID NO: 125617 - DNA, 25 bp, Rattus norvegicus
agcaggatgcttctcaccttcttta

SEQ ID NO: 125618 - DNA, 25 bp, Rattus norvegicus
agcaggatgcttgtcaccttcttta

SEQ ID NO: 125619 - DNA, 25 bp, Rattus norvegicus
agcaggatgtggagacttgcctctc

SEQ ID NO: 125620 - DNA, 25 bp, Rattus norvegicus
agcaggatgtggtgacttgcctctc

SEQ ID NO: 125621 - DNA, 25 bp, Rattus norvegicus
agcaggattctgactgcactcagtc

SEQ ID NO: 125622 - DNA, 25 bp, Rattus norvegicus
agcaggattctgtctgcactcagtc

SEQ ID NO: 125623 - DNA, 25 bp, Rattus norvegicus
agcaggattttacgctctcctatcc

SEQ ID NO: 125624 - DNA, 25 bp, Rattus norvegicus
agcaggattttaggctctcctatcc

SEQ ID NO: 125625 - DNA, 25 bp, Rattus norvegicus
agcaggcaaagcctagatccccgtg

SEQ ID NO: 125626 - DNA, 25 bp, Rattus norvegicus
agcaggcaaagcgtagatccccgtg

SEQ ID NO: 125627 - DNA, 25 bp, Rattus norvegicus
agcaggcaatctcatgaaccccagc

SEQ ID NO: 125628 - DNA, 25 bp, Rattus norvegicus
agcaggcaatctgatgaaccccagc

SEQ ID NO: 125629 - DNA, 25 bp, Rattus norvegicus
agcaggcacagactgagctggcctc

SEQ ID NO: 125630 - DNA, 25 bp, Rattus norvegicus
agcaggcacagagtgagctggcctc

SEQ ID NO: 125631 - DNA, 25 bp, Rattus norvegicus
agcaggcaccaaccggcgagtgttt

SEQ ID NO: 125632 - DNA, 25 bp, Rattus norvegicus
agcaggcaccaagcggcgagtgttt

SEQ ID NO: 125633 - DNA, 25 bp, Rattus norvegicus
agcaggcaccacctcatcaggattg

SEQ ID NO: 125634 - DNA, 25 bp, Rattus norvegicus
agcaggcaccacgtcatcaggattg

SEQ ID NO: 125635 - DNA, 25 bp, Rattus norvegicus
agcaggcactcacttcttaccagaa

SEQ ID NO: 125636 - DNA, 25 bp, Rattus norvegicus
agcaggcactcagttcttaccagaa

SEQ ID NO: 125637 - DNA, 25 bp, Rattus norvegicus
agcaggcactgactgttctaccaca

SEQ ID NO: 125638 - DNA, 25 bp, Rattus norvegicus
agcaggcactgagtgttctaccaca

SEQ ID NO: 125639 - DNA, 25 bp, Rattus norvegicus
agcaggcactgcactgtctagtgga

SEQ ID NO: 125640 - DNA, 25 bp, Rattus norvegicus
agcaggcactgctctgtctagtgga

SEQ ID NO: 125641 - DNA, 25 bp, Rattus norvegicus
agcaggcagagtcaacaatccagtg

SEQ ID NO: 125642 - DNA, 25 bp, Rattus norvegicus
agcaggcagagtgaacaatccagtg

SEQ ID NO: 125643 - DNA, 25 bp, Rattus norvegicus
agcaggcagccgagtatcgcgagat

SEQ ID NO: 125644 - DNA, 25 bp, Rattus norvegicus
agcaggcagccgtgtatcgcgagat

SEQ ID NO: 125645 - DNA, 25 bp, Rattus norvegicus
agcaggcagcctcttccagtgggca

SEQ ID NO: 125646 - DNA, 25 bp, Rattus norvegicus
agcaggcagcctgttccagtgggca

SEQ ID NO: 125647 - DNA, 25 bp, Rattus norvegicus
agcaggcagcgcaggagcccaagct

SEQ ID NO: 125648 - DNA, 25 bp, Rattus norvegicus
agcaggcagcgctggagcccaagct

SEQ ID NO: 125649 - DNA, 25 bp, Rattus norvegicus
agcaggcagctcaaacattcagaag

SEQ ID NO: 125650 - DNA, 25 bp, Rattus norvegicus
agcaggcagctctaacattcagaag

SEQ ID NO: 125651 - DNA, 25 bp, Rattus norvegicus
agcaggcagctgaatatgtcccaga

SEQ ID NO: 125652 - DNA, 25 bp, Rattus norvegicus
agcaggcagctgatcatcattgttg

SEQ ID NO: 125653 - DNA, 25 bp, Rattus norvegicus
agcaggcagctgtatatgtcccaga

SEQ ID NO: 125654 - DNA, 25 bp, Rattus norvegicus
agcaggcagctgttcatcattgttg

SEQ ID NO: 125655 - DNA, 25 bp, Rattus norvegicus
agcaggcaggcaccttccagcagaa

SEQ ID NO: 125656 - DNA, 25 bp, Rattus norvegicus
agcaggcaggcagcttccagcagaa

SEQ ID NO: 125657 - DNA, 25 bp, Rattus norvegicus
agcaggcaggccatctagcagaaca

SEQ ID NO: 125658 - DNA, 25 bp, Rattus norvegicus
agcaggcaggccttctagcagaaca

SEQ ID NO: 125659 - DNA, 25 bp, Rattus norvegicus
agcaggcagtgcagaaccatttgta

SEQ ID NO: 125660 - DNA, 25 bp, Rattus norvegicus
agcaggcagtgctgaaccatttgta

SEQ ID NO: 125661 - DNA, 25 bp, Rattus norvegicus
agcaggcatctgctcaagtcctttg

SEQ ID NO: 125662 - DNA, 25 bp, Rattus norvegicus
agcaggcatctggtcaagtcctttg

SEQ ID NO: 125663 - DNA, 25 bp, Rattus norvegicus
agcaggcatgttcctgccagtgtct

SEQ ID NO: 125664 - DNA, 25 bp, Rattus norvegicus
agcaggcatgttgctgccagtgtct

SEQ ID NO: 125665 - DNA, 25 bp, Rattus norvegicus
agcaggccagcaccttccttaaatc

SEQ ID NO: 125666 - DNA, 25 bp, Rattus norvegicus
agcaggccagcagcttccttaaatc

SEQ ID NO: 125667 - DNA, 25 bp, Rattus norvegicus
agcaggccagccacggaaatggaca

SEQ ID NO: 125668 - DNA, 25 bp, Rattus norvegicus
agcaggccagcctcggaaatggaca

SEQ ID NO: 125669 - DNA, 25 bp, Rattus norvegicus
agcaggccaggaacgatttcacacc

SEQ ID NO: 125670 - DNA, 25 bp, Rattus norvegicus
agcaggccaggatcgatttcacacc

SEQ ID NO: 125671 - DNA, 25 bp, Rattus norvegicus
agcaggcccgcaatgtgcagcttta

SEQ ID NO: 125672 - DNA, 25 bp, Rattus norvegicus
agcaggcccgcattgtgcagcttta

SEQ ID NO: 125673 - DNA, 25 bp, Rattus norvegicus
agcaggccctgaagtctgctcagga

SEQ ID NO: 125674 - DNA, 25 bp, Rattus norvegicus
agcaggccctgatgtctgctcagga

SEQ ID NO: 125675 - DNA, 25 bp, Rattus norvegicus
agcaggccctggctatgttcagtgc

SEQ ID NO: 125676 - DNA, 25 bp, Rattus norvegicus
agcaggccctgggtatgttcagtgc

SEQ ID NO: 125677 - DNA, 25 bp, Rattus norvegicus
agcaggccgcacaactggtcttcca

SEQ ID NO: 125678 - DNA, 25 bp, Rattus norvegicus
agcaggccgcactactggtcttcca

SEQ ID NO: 125679 - DNA, 25 bp, Rattus norvegicus
agcaggccggctacatggcgagcat

SEQ ID NO: 125680 - DNA, 25 bp, Rattus norvegicus
agcaggccggcttcatggcgagcat

SEQ ID NO: 125681 - DNA, 25 bp, Rattus norvegicus
agcaggccggtgatctcaattggtt

SEQ ID NO: 125682 - DNA, 25 bp, Rattus norvegicus
agcaggccggtgttctcaattggtt

SEQ ID NO: 125683 - DNA, 25 bp, Rattus norvegicus
agcaggccggttatctctgaggaaa

SEQ ID NO: 125684 - DNA, 25 bp, Rattus norvegicus
agcaggccggttttctctgaggaaa

SEQ ID NO: 125685 - DNA, 25 bp, Rattus norvegicus
agcaggcctcagcaattcctagcat

SEQ ID NO: 125686 - DNA, 25 bp, Rattus norvegicus
agcaggcctcaggaattcctagcat

SEQ ID NO: 125687 - DNA, 25 bp, Rattus norvegicus
agcaggcctccccaaaatgctggct

SEQ ID NO: 125688 - DNA, 25 bp, Rattus norvegicus
agcaggcctcccgaaaatgctggct

SEQ ID NO: 125689 - DNA, 25 bp, Rattus norvegicus
agcaggcctcctctgattttagaga

SEQ ID NO: 125690 - DNA, 25 bp, Rattus norvegicus
agcaggcctcctgtgattttagaga

SEQ ID NO: 125691 - DNA, 25 bp, Rattus norvegicus
agcaggcctgccctgtagtgatgat

SEQ ID NO: 125692 - DNA, 25 bp, Rattus norvegicus
agcaggcctgccgtgtagtgatgat

SEQ ID NO: 125693 - DNA, 25 bp, Rattus norvegicus
agcaggcctggacgcccctggaaaa

SEQ ID NO: 125694 - DNA, 25 bp, Rattus norvegicus
agcaggcctggaggcccctggaaaa

SEQ ID NO: 125695 - DNA, 25 bp, Rattus norvegicus
agcaggcctgtcctttagactttaa

SEQ ID NO: 125696 - DNA, 25 bp, Rattus norvegicus
agcaggcctgtcgtttagactttaa

SEQ ID NO: 125697 - DNA, 25 bp, Rattus norvegicus
agcaggcctgtgctgagtaccctca

SEQ ID NO: 125698 - DNA, 25 bp, Rattus norvegicus
agcaggcctgtggtgagtaccctca

SEQ ID NO: 125699 - DNA, 25 bp, Rattus norvegicus
agcaggccttcaaatgacactctct

SEQ ID NO: 125700 - DNA, 25 bp, Rattus norvegicus
agcaggccttcatatgacactctct

SEQ ID NO: 125701 - DNA, 25 bp, Rattus norvegicus
agcaggccttttagtgtttcattta

SEQ ID NO: 125702 - DNA, 25 bp, Rattus norvegicus
agcaggcctttttgtgtttcattta

SEQ ID NO: 125703 - DNA, 25 bp, Rattus norvegicus
agcaggcgagccagtccggtctcgt

SEQ ID NO: 125704 - DNA, 25 bp, Rattus norvegicus
agcaggcgagcctgtccggtctcgt

SEQ ID NO: 125705 - DNA, 25 bp, Rattus norvegicus
agcaggcgcaggacttcatttttag

SEQ ID NO: 125706 - DNA, 25 bp, Rattus norvegicus
agcaggcgcaggtcttcatttttag

SEQ ID NO: 125707 - DNA, 25 bp, Rattus norvegicus
agcaggcgcatcaaggaattttaat

SEQ ID NO: 125708 - DNA, 25 bp, Rattus norvegicus
agcaggcgcatctaggaattttaat

SEQ ID NO: 125709 - DNA, 25 bp, Rattus norvegicus
agcaggcgccggcaagtcattactt

SEQ ID NO: 125710 - DNA, 25 bp, Rattus norvegicus
agcaggcgccgggaagtcattactt

SEQ ID NO: 125711 - DNA, 25 bp, Rattus norvegicus
agcaggctacttcgtattcctcttg

SEQ ID NO: 125712 - DNA, 25 bp, Rattus norvegicus
agcaggctacttggtattcctcttg

SEQ ID NO: 125713 - DNA, 25 bp, Rattus norvegicus
agcaggctcagcacttgggcctcag

SEQ ID NO: 125714 - DNA, 25 bp, Rattus norvegicus
agcaggctcagctcttgggcctcag

SEQ ID NO: 125715 - DNA, 25 bp, Rattus norvegicus
agcaggctcccgagggcatctttgt

SEQ ID NO: 125716 - DNA, 25 bp, Rattus norvegicus
agcaggctcccgtgggcatctttgt

SEQ ID NO: 125717 - DNA, 25 bp, Rattus norvegicus
agcaggctcggcaaggctcccaagg

SEQ ID NO: 125718 - DNA, 25 bp, Rattus norvegicus
agcaggctcggctaggctcccaagg

SEQ ID NO: 125719 - DNA, 25 bp, Rattus norvegicus
agcaggctctggcttctggttaaat

SEQ ID NO: 125720 - DNA, 25 bp, Rattus norvegicus
agcaggctctgggttctggttaaat

SEQ ID NO: 125721 - DNA, 25 bp, Rattus norvegicus
agcaggctcttcagtttcttcacaa

SEQ ID NO: 125722 - DNA, 25 bp, Rattus norvegicus
agcaggctcttctgtttcttcacaa

SEQ ID NO: 125723 - DNA, 25 bp, Rattus norvegicus
agcaggctcttgagtgctgtggata

SEQ ID NO: 125724 - DNA, 25 bp, Rattus norvegicus
agcaggctcttgtgtgctgtggata

SEQ ID NO: 125725 - DNA, 25 bp, Rattus norvegicus
agcaggctgatcaagaactcaagaa

SEQ ID NO: 125726 - DNA, 25 bp, Rattus norvegicus
agcaggctgatctagaactcaagaa

SEQ ID NO: 125727 - DNA, 25 bp, Rattus norvegicus
agcaggctgcaaactggcccacggc

SEQ ID NO: 125728 - DNA, 25 bp, Rattus norvegicus
agcaggctgcaatctggcccacggc

SEQ ID NO: 125729 - DNA, 25 bp, Rattus norvegicus
agcaggctgctactgtgacttcaga

SEQ ID NO: 125730 - DNA, 25 bp, Rattus norvegicus
agcaggctgctagtgtgacttcaga

SEQ ID NO: 125731 - DNA, 25 bp, Rattus norvegicus
agcaggctgcttactacggacagac

SEQ ID NO: 125732 - DNA, 25 bp, Rattus norvegicus
agcaggctgctttctacggacagac

SEQ ID NO: 125733 - DNA, 25 bp, Rattus norvegicus
agcaggctggagctcctagttcaac

SEQ ID NO: 125734 - DNA, 25 bp, Rattus norvegicus
agcaggctggaggtcctagttcaac

SEQ ID NO: 125735 - DNA, 25 bp, Rattus norvegicus
agcaggctggtgcatttcttggccc

SEQ ID NO: 125736 - DNA, 25 bp, Rattus norvegicus
agcaggctggtggatttcttggccc

SEQ ID NO: 125737 - DNA, 25 bp, Rattus norvegicus
agcaggctgtgaccggcctctgtaa

SEQ ID NO: 125738 - DNA, 25 bp, Rattus norvegicus
agcaggctgtgagcggcctctgtaa

SEQ ID NO: 125739 - DNA, 25 bp, Rattus norvegicus
agcaggctgtgcatggaccatatcc

SEQ ID NO: 125740 - DNA, 25 bp, Rattus norvegicus
agcaggctgtgcttggaccatatcc

SEQ ID NO: 125741 - DNA, 25 bp, Rattus norvegicus
agcaggcttactccatttacagtac

SEQ ID NO: 125742 - DNA, 25 bp, Rattus norvegicus
agcaggcttactgcatttacagtac

SEQ ID NO: 125743 - DNA, 25 bp, Rattus norvegicus
agcaggcttaggaggaggcccttcc

SEQ ID NO: 125744 - DNA, 25 bp, Rattus norvegicus
agcaggcttaggtggaggcccttcc

SEQ ID NO: 125745 - DNA, 25 bp, Rattus norvegicus
agcaggcttcctcatgtagccagga

SEQ ID NO: 125746 - DNA, 25 bp, Rattus norvegicus
agcaggcttcctgatgtagccagga

SEQ ID NO: 125747 - DNA, 25 bp, Rattus norvegicus
agcaggcttcttccattactctgca

SEQ ID NO: 125748 - DNA, 25 bp, Rattus norvegicus
agcaggcttcttgcattactctgca

SEQ ID NO: 125749 - DNA, 25 bp, Rattus norvegicus
agcaggctttcaaagttctctttca

SEQ ID NO: 125750 - DNA, 25 bp, Rattus norvegicus
agcaggctttcatagttctctttca

SEQ ID NO: 125751 - DNA, 25 bp, Rattus norvegicus
agcagggaacacagctccgacagta

SEQ ID NO: 125752 - DNA, 25 bp, Rattus norvegicus
agcagggaacactgctccgacagta

SEQ ID NO: 125753 - DNA, 25 bp, Rattus norvegicus
agcagggaaccccaagagcatccaa

SEQ ID NO: 125754 - DNA, 25 bp, Rattus norvegicus
agcagggaacccgaagagcatccaa

SEQ ID NO: 125755 - DNA, 25 bp, Rattus norvegicus
agcagggaactcaaccgtcttgttt

SEQ ID NO: 125756 - DNA, 25 bp, Rattus norvegicus
agcagggaactctaccgtcttgttt

SEQ ID NO: 125757 - DNA, 25 bp, Rattus norvegicus
agcagggacagcaattcacctcatt

SEQ ID NO: 125758 - DNA, 25 bp, Rattus norvegicus
agcagggacagctattcacctcatt

SEQ ID NO: 125759 - DNA, 25 bp, Rattus norvegicus
agcagggacaggagtgtacccctcc

SEQ ID NO: 125760 - DNA, 25 bp, Rattus norvegicus
agcagggacaggtgtgtacccctcc

SEQ ID NO: 125761 - DNA, 25 bp, Rattus norvegicus
agcagggacctcagatacttttgta

SEQ ID NO: 125762 - DNA, 25 bp, Rattus norvegicus
agcagggacctctgatacttttgta

SEQ ID NO: 125763 - DNA, 25 bp, Rattus norvegicus
agcagggactgcagcccggagctct

SEQ ID NO: 125764 - DNA, 25 bp, Rattus norvegicus
agcagggactgctgcccggagctct

SEQ ID NO: 125765 - DNA, 25 bp, Rattus norvegicus
agcagggaggacaccttggctttga

SEQ ID NO: 125766 - DNA, 25 bp, Rattus norvegicus
agcagggaggactccttggctttga

SEQ ID NO: 125767 - DNA, 25 bp, Rattus norvegicus
agcagggagttgaccccgcattcag

SEQ ID NO: 125768 - DNA, 25 bp, Rattus norvegicus
agcagggagttgtccccgcattcag

SEQ ID NO: 125769 - DNA, 25 bp, Rattus norvegicus
agcagggcaaaccagaagatcttag

SEQ ID NO: 125770 - DNA, 25 bp, Rattus norvegicus
agcagggcaaacgagaagatcttag

SEQ ID NO: 125771 - DNA, 25 bp, Rattus norvegicus
agcagggcaactcacaccagtagca

SEQ ID NO: 125772 - DNA, 25 bp, Rattus norvegicus
agcagggcaactgacaccagtagca

SEQ ID NO: 125773 - DNA, 25 bp, Rattus norvegicus
agcagggcacagctgaggacacaca

SEQ ID NO: 125774 - DNA, 25 bp, Rattus norvegicus
agcagggcacaggtgaggacacaca

SEQ ID NO: 125775 - DNA, 25 bp, Rattus norvegicus
agcagggcacctatgaggacttcgt

SEQ ID NO: 125776 - DNA, 25 bp, Rattus norvegicus
agcagggcacctttgaggacttcgt

SEQ ID NO: 125777 - DNA, 25 bp, Rattus norvegicus
agcagggcagagaagcacattcaaa

SEQ ID NO: 125778 - DNA, 25 bp, Rattus norvegicus
agcagggcagagtagcacattcaaa

SEQ ID NO: 125779 - DNA, 25 bp, Rattus norvegicus
agcagggccaccctgatattgcgag

SEQ ID NO: 125780 - DNA, 25 bp, Rattus norvegicus
agcagggccaccgtgatattgcgag

SEQ ID NO: 125781 - DNA, 25 bp, Rattus norvegicus
agcagggccagccagcgcaagcctc

SEQ ID NO: 125782 - DNA, 25 bp, Rattus norvegicus
agcagggccagcgagcgcaagcctc

SEQ ID NO: 125783 - DNA, 25 bp, Rattus norvegicus
agcagggcccagatgcaggaagtcc

SEQ ID NO: 125784 - DNA, 25 bp, Rattus norvegicus
agcagggcccagttgcaggaagtcc

SEQ ID NO: 125785 - DNA, 25 bp, Rattus norvegicus
agcagggcccatcatcgtagtgata

SEQ ID NO: 125786 - DNA, 25 bp, Rattus norvegicus
agcagggcccatgatcgtagtgata

SEQ ID NO: 125787 - DNA, 25 bp, Rattus norvegicus
agcagggccctactcaagactcggg

SEQ ID NO: 125788 - DNA, 25 bp, Rattus norvegicus
agcagggccctagtcaagactcggg

SEQ ID NO: 125789 - DNA, 25 bp, Rattus norvegicus
agcagggcctctactttggctcact

SEQ ID NO: 125790 - DNA, 25 bp, Rattus norvegicus
agcagggcctcttctttggctcact

SEQ ID NO: 125791 - DNA, 25 bp, Rattus norvegicus
agcagggcgccaattcagaaggcca

SEQ ID NO: 125792 - DNA, 25 bp, Rattus norvegicus
agcagggcgccatttcagaaggcca

SEQ ID NO: 125793 - DNA, 25 bp, Rattus norvegicus
agcagggctatgaccatggacttta

SEQ ID NO: 125794 - DNA, 25 bp, Rattus norvegicus
agcagggctatgtccatggacttta

SEQ ID NO: 125795 - DNA, 25 bp, Rattus norvegicus
agcagggctcttattctaggaaact

SEQ ID NO: 125796 - DNA, 25 bp, Rattus norvegicus
agcagggctctttttctaggaaact

SEQ ID NO: 125797 - DNA, 25 bp, Rattus norvegicus
agcagggctgcacgactgactctct

SEQ ID NO: 125798 - DNA, 25 bp, Rattus norvegicus
agcagggctgcaggactgactctct

SEQ ID NO: 125799 - DNA, 25 bp, Rattus norvegicus
agcagggctgccaagaatcacaaca

SEQ ID NO: 125800 - DNA, 25 bp, Rattus norvegicus
agcagggctgcctagaatcacaaca

SEQ ID NO: 125801 - DNA, 25 bp, Rattus norvegicus
agcagggctgctatttagaagacat

SEQ ID NO: 125802 - DNA, 25 bp, Rattus norvegicus
agcagggctgctttttagaagacat

SEQ ID NO: 125803 - DNA, 25 bp, Rattus norvegicus
agcagggctggcactcatgaacagg

SEQ ID NO: 125804 - DNA, 25 bp, Rattus norvegicus
agcagggctggctctcatgaacagg

SEQ ID NO: 125805 - DNA, 25 bp, Rattus norvegicus
agcagggctgtcaaaccaaggaaag

SEQ ID NO: 125806 - DNA, 25 bp, Rattus norvegicus
agcagggctgtctaaccaaggaaag

SEQ ID NO: 125807 - DNA, 25 bp, Rattus norvegicus
agcagggcttcaattaatcttctcc

SEQ ID NO: 125808 - DNA, 25 bp, Rattus norvegicus
agcagggcttcatttaatcttctcc

SEQ ID NO: 125809 - DNA, 25 bp, Rattus norvegicus
agcagggcttgactcttgccagtta

SEQ ID NO: 125810 - DNA, 25 bp, Rattus norvegicus
agcagggcttgagtcttgccagtta

SEQ ID NO: 125811 - DNA, 25 bp, Rattus norvegicus
agcagggtacctagtctggcagtcc

SEQ ID NO: 125812 - DNA, 25 bp, Rattus norvegicus
agcagggtaccttgtctggcagtcc

SEQ ID NO: 125813 - DNA, 25 bp, Rattus norvegicus
agcagggtccagatccaagcagcag

SEQ ID NO: 125814 - DNA, 25 bp, Rattus norvegicus
agcagggtccagttccaagcagcag

SEQ ID NO: 125815 - DNA, 25 bp, Rattus norvegicus
agcagggtcgtcagcgcacagccaa

SEQ ID NO: 125816 - DNA, 25 bp, Rattus norvegicus
agcagggtcgtctgcgcacagccaa

SEQ ID NO: 125817 - DNA, 25 bp, Rattus norvegicus
agcagggtcgttagcacatcacaga

SEQ ID NO: 125818 - DNA, 25 bp, Rattus norvegicus
agcagggtcgtttgcacatcacaga

SEQ ID NO: 125819 - DNA, 25 bp, Rattus norvegicus
agcagggtctacacagcagggtcag

SEQ ID NO: 125820 - DNA, 25 bp, Rattus norvegicus
agcagggtctactcagcagggtcag

SEQ ID NO: 125821 - DNA, 25 bp, Rattus norvegicus
agcagggtctagaaccccaggaaag

SEQ ID NO: 125822 - DNA, 25 bp, Rattus norvegicus
agcagggtctagtaccccaggaaag

SEQ ID NO: 125823 - DNA, 25 bp, Rattus norvegicus
agcagggtctcaagcatgtgtacat

SEQ ID NO: 125824 - DNA, 25 bp, Rattus norvegicus
agcagggtctcaatatgcggcccag

SEQ ID NO: 125825 - DNA, 25 bp, Rattus norvegicus
agcagggtctcatgcatgtgtacat

SEQ ID NO: 125826 - DNA, 25 bp, Rattus norvegicus
agcagggtctcattatgcggcccag

SEQ ID NO: 125827 - DNA, 25 bp, Rattus norvegicus
agcagggtctgtctttacgtgccta

SEQ ID NO: 125828 - DNA, 25 bp, Rattus norvegicus
agcagggtctgtgtttacgtgccta

SEQ ID NO: 125829 - DNA, 25 bp, Rattus norvegicus
agcagggtcttcagctcagggttag

SEQ ID NO: 125830 - DNA, 25 bp, Rattus norvegicus
agcagggtcttctgctcagggttag

SEQ ID NO: 125831 - DNA, 25 bp, Rattus norvegicus
agcagggtctttcccttctttcgag

SEQ ID NO: 125832 - DNA, 25 bp, Rattus norvegicus
agcagggtctttgccttctttcgag

SEQ ID NO: 125833 - DNA, 25 bp, Rattus norvegicus
agcagggtgtgcatgcctgtgatct

SEQ ID NO: 125834 - DNA, 25 bp, Rattus norvegicus
agcagggtgtgcttgcctgtgatct

SEQ ID NO: 125835 - DNA, 25 bp, Rattus norvegicus
agcagggtgtggagatacacatcca

SEQ ID NO: 125836 - DNA, 25 bp, Rattus norvegicus
agcagggtgtggtgatacacatcca

SEQ ID NO: 125837 - DNA, 25 bp, Rattus norvegicus
agcagggttctcaggctgaccacac

SEQ ID NO: 125838 - DNA, 25 bp, Rattus norvegicus
agcagggttctctggctgaccacac

SEQ ID NO: 125839 - DNA, 25 bp, Rattus norvegicus
agcagggttgtcatccctgtctcca

SEQ ID NO: 125840 - DNA, 25 bp, Rattus norvegicus
agcagggttgtcttccctgtctcca

SEQ ID NO: 125841 - DNA, 25 bp, Rattus norvegicus
agcagggtttgtcagctctctggtc

SEQ ID NO: 125842 - DNA, 25 bp, Rattus norvegicus
agcagggtttgtgagctctctggtc

SEQ ID NO: 125843 - DNA, 25 bp, Rattus norvegicus
agcaggtaaaaacaatgggaccaca

SEQ ID NO: 125844 - DNA, 25 bp, Rattus norvegicus
agcaggtaaaaagaatgggaccaca

SEQ ID NO: 125845 - DNA, 25 bp, Rattus norvegicus
agcaggtaacaaccctcgtggccaa

SEQ ID NO: 125846 - DNA, 25 bp, Rattus norvegicus
agcaggtaacaagcctcgtggccaa

SEQ ID NO: 125847 - DNA, 25 bp, Rattus norvegicus
agcaggtaacccaccagctgaggtg

SEQ ID NO: 125848 - DNA, 25 bp, Rattus norvegicus
agcaggtaaccctccagctgaggtg

SEQ ID NO: 125849 - DNA, 25 bp, Rattus norvegicus
agcaggtacaatacctcaccaagga

SEQ ID NO: 125850 - DNA, 25 bp, Rattus norvegicus
agcaggtacaattcctcaccaagga

SEQ ID NO: 125851 - DNA, 25 bp, Rattus norvegicus
agcaggtacccacgcttagagcagt

SEQ ID NO: 125852 - DNA, 25 bp, Rattus norvegicus
agcaggtacccaggcttagagcagt

SEQ ID NO: 125853 - DNA, 25 bp, Rattus norvegicus
agcaggtactgtcgctttctgggaa

SEQ ID NO: 125854 - DNA, 25 bp, Rattus norvegicus
agcaggtactgtggctttctgggaa

SEQ ID NO: 125855 - DNA, 25 bp, Rattus norvegicus
agcaggtatcaacgtctctggtgtc

SEQ ID NO: 125856 - DNA, 25 bp, Rattus norvegicus
agcaggtatcaaggtctctggtgtc

SEQ ID NO: 125857 - DNA, 25 bp, Rattus norvegicus
agcaggtatcctcagaaccctttaa

SEQ ID NO: 125858 - DNA, 25 bp, Rattus norvegicus
agcaggtatcctgagaaccctttaa

SEQ ID NO: 125859 - DNA, 25 bp, Rattus norvegicus
agcaggtatgatcgcacatggcttt

SEQ ID NO: 125860 - DNA, 25 bp, Rattus norvegicus
agcaggtatgatggcacatggcttt

SEQ ID NO: 125861 - DNA, 25 bp, Rattus norvegicus
agcaggtcaatcatccaacagtcac

SEQ ID NO: 125862 - DNA, 25 bp, Rattus norvegicus
agcaggtcaatcttccaacagtcac

SEQ ID NO: 125863 - DNA, 25 bp, Rattus norvegicus
agcaggtcacacacacagcagcggt

SEQ ID NO: 125864 - DNA, 25 bp, Rattus norvegicus
agcaggtcacactcacagcagcggt

SEQ ID NO: 125865 - DNA, 25 bp, Rattus norvegicus
agcaggtcaccaagagtcaaggcca

SEQ ID NO: 125866 - DNA, 25 bp, Rattus norvegicus
agcaggtcaccaagatgcttgcagt

SEQ ID NO: 125867 - DNA, 25 bp, Rattus norvegicus
agcaggtcaccatgagtcaaggcca

SEQ ID NO: 125868 - DNA, 25 bp, Rattus norvegicus
agcaggtcaccatgatgcttgcagt

SEQ ID NO: 125869 - DNA, 25 bp, Rattus norvegicus
agcaggtcacccattcactgagagt

SEQ ID NO: 125870 - DNA, 25 bp, Rattus norvegicus
agcaggtcaccctttcactgagagt

SEQ ID NO: 125871 - DNA, 25 bp, Rattus norvegicus
agcaggtcactcagcagttcgtgcc

SEQ ID NO: 125872 - DNA, 25 bp, Rattus norvegicus
agcaggtcactctgcagttcgtgcc

SEQ ID NO: 125873 - DNA, 25 bp, Rattus norvegicus
agcaggtcactgatttattccacaa

SEQ ID NO: 125874 - DNA, 25 bp, Rattus norvegicus
agcaggtcactgttttattccacaa

SEQ ID NO: 125875 - DNA, 25 bp, Rattus norvegicus
agcaggtcaggaactcgtagtccat

SEQ ID NO: 125876 - DNA, 25 bp, Rattus norvegicus
agcaggtcaggatctcgtagtccat

SEQ ID NO: 125877 - DNA, 25 bp, Rattus norvegicus
agcaggtccgctccgtctgagacac

SEQ ID NO: 125878 - DNA, 25 bp, Rattus norvegicus
agcaggtccgctgcgtctgagacac

SEQ ID NO: 125879 - DNA, 25 bp, Rattus norvegicus
agcaggtcctaactcatttaaaaag

SEQ ID NO: 125880 - DNA, 25 bp, Rattus norvegicus
agcaggtcctaagtcatttaaaaag

SEQ ID NO: 125881 - DNA, 25 bp, Rattus norvegicus
agcaggtcctacagttgctgtttat

SEQ ID NO: 125882 - DNA, 25 bp, Rattus norvegicus
agcaggtcctactgttgctgtttat

SEQ ID NO: 125883 - DNA, 25 bp, Rattus norvegicus
agcaggtcctggagtccgacgcgga

SEQ ID NO: 125884 - DNA, 25 bp, Rattus norvegicus
agcaggtcctggtgtccgacgcgga

SEQ ID NO: 125885 - DNA, 25 bp, Rattus norvegicus
agcaggtccttgaagacgtggagac

SEQ ID NO: 125886 - DNA, 25 bp, Rattus norvegicus
agcaggtccttgtagacgtggagac

SEQ ID NO: 125887 - DNA, 25 bp, Rattus norvegicus
agcaggtcctttagagggtctctcc

SEQ ID NO: 125888 - DNA, 25 bp, Rattus norvegicus
agcaggtccttttgagggtctctcc

SEQ ID NO: 125889 - DNA, 25 bp, Rattus norvegicus
agcaggtcggtcaccctatttttat

SEQ ID NO: 125890 - DNA, 25 bp, Rattus norvegicus
agcaggtcggtctccctatttttat

SEQ ID NO: 125891 - DNA, 25 bp, Rattus norvegicus
agcaggtcggttcatttgtcacact

SEQ ID NO: 125892 - DNA, 25 bp, Rattus norvegicus
agcaggtcggttgatttgtcacact

SEQ ID NO: 125893 - DNA, 25 bp, Rattus norvegicus
agcaggtctgcaaggcctctgagag

SEQ ID NO: 125894 - DNA, 25 bp, Rattus norvegicus
agcaggtctgcaccgtgctcaagca

SEQ ID NO: 125895 - DNA, 25 bp, Rattus norvegicus
agcaggtctgcagcgtgctcaagca

SEQ ID NO: 125896 - DNA, 25 bp, Rattus norvegicus
agcaggtctgcatggcctctgagag

SEQ ID NO: 125897 - DNA, 25 bp, Rattus norvegicus
agcaggtctgccagagcttagctgc

SEQ ID NO: 125898 - DNA, 25 bp, Rattus norvegicus
agcaggtctgcctgagcttagctgc

SEQ ID NO: 125899 - DNA, 25 bp, Rattus norvegicus
agcaggtctttcagagctttgccca

SEQ ID NO: 125900 - DNA, 25 bp, Rattus norvegicus
agcaggtctttctgagctttgccca

SEQ ID NO: 125901 - DNA, 25 bp, Rattus norvegicus
agcaggtctttgatgaccctctcat

SEQ ID NO: 125902 - DNA, 25 bp, Rattus norvegicus
agcaggtctttgttgaccctctcat

SEQ ID NO: 125903 - DNA, 25 bp, Rattus norvegicus
agcaggtgaaatccgcctccccggt

SEQ ID NO: 125904 - DNA, 25 bp, Rattus norvegicus
agcaggtgaaatgcgcctccccggt

SEQ ID NO: 125905 - DNA, 25 bp, Rattus norvegicus
agcaggtgaagacggttcttttcct

SEQ ID NO: 125906 - DNA, 25 bp, Rattus norvegicus
agcaggtgaagagggttcttttcct

SEQ ID NO: 125907 - DNA, 25 bp, Rattus norvegicus
agcaggtgaccaatcattcctagct

SEQ ID NO: 125908 - DNA, 25 bp, Rattus norvegicus
agcaggtgaccattcattcctagct

SEQ ID NO: 125909 - DNA, 25 bp, Rattus norvegicus
agcaggtgcaggaggactgccactt

SEQ ID NO: 125910 - DNA, 25 bp, Rattus norvegicus
agcaggtgcaggtggactgccactt

SEQ ID NO: 125911 - DNA, 25 bp, Rattus norvegicus
agcaggtgccttatttcctttgaat

SEQ ID NO: 125912 - DNA, 25 bp, Rattus norvegicus
agcaggtgccttttttcctttgaat

SEQ ID NO: 125913 - DNA, 25 bp, Rattus norvegicus
agcaggtggaggcactctcttcgta

SEQ ID NO: 125914 - DNA, 25 bp, Rattus norvegicus
agcaggtggagggactctcttcgta

SEQ ID NO: 125915 - DNA, 25 bp, Rattus norvegicus
agcaggtggatcaatttcatgtttt

SEQ ID NO: 125916 - DNA, 25 bp, Rattus norvegicus
agcaggtggatctatttcatgtttt

SEQ ID NO: 125917 - DNA, 25 bp, Rattus norvegicus
agcaggtggcctcggtgtctaggag

SEQ ID NO: 125918 - DNA, 25 bp, Rattus norvegicus
agcaggtggcctctgttgatgcaaa

SEQ ID NO: 125919 - DNA, 25 bp, Rattus norvegicus
agcaggtggcctgggtgtctaggag

SEQ ID NO: 125920 - DNA, 25 bp, Rattus norvegicus
agcaggtggcctgtgttgatgcaaa

SEQ ID NO: 125921 - DNA, 25 bp, Rattus norvegicus
agcaggtgggccagagtttgatacc

SEQ ID NO: 125922 - DNA, 25 bp, Rattus norvegicus
agcaggtgggcctgagtttgatacc

SEQ ID NO: 125923 - DNA, 25 bp, Rattus norvegicus
agcaggtgtaccaattccccaagct

SEQ ID NO: 125924 - DNA, 25 bp, Rattus norvegicus
agcaggtgtacctattccccaagct

SEQ ID NO: 125925 - DNA, 25 bp, Rattus norvegicus
agcaggtgtctcagtactggtaaga

SEQ ID NO: 125926 - DNA, 25 bp, Rattus norvegicus
agcaggtgtctctgtactggtaaga

SEQ ID NO: 125927 - DNA, 25 bp, Rattus norvegicus
agcaggtgtgcccttgtcccaagga

SEQ ID NO: 125928 - DNA, 25 bp, Rattus norvegicus
agcaggtgtgccgttgtcccaagga

SEQ ID NO: 125929 - DNA, 25 bp, Rattus norvegicus
agcaggtgttgaactgttcgtggcc

SEQ ID NO: 125930 - DNA, 25 bp, Rattus norvegicus
agcaggtgttgatctgttcgtggcc

SEQ ID NO: 125931 - DNA, 25 bp, Rattus norvegicus
agcaggttaagcaggcactggccat

SEQ ID NO: 125932 - DNA, 25 bp, Rattus norvegicus
agcaggttaagctggcactggccat

SEQ ID NO: 125933 - DNA, 25 bp, Rattus norvegicus
agcaggttactgctttcacccatgt

SEQ ID NO: 125934 - DNA, 25 bp, Rattus norvegicus
agcaggttactggtttcacccatgt

SEQ ID NO: 125935 - DNA, 25 bp, Rattus norvegicus
agcaggttaggtccatgcttccagt

SEQ ID NO: 125936 - DNA, 25 bp, Rattus norvegicus
agcaggttaggtgcatgcttccagt

SEQ ID NO: 125937 - DNA, 25 bp, Rattus norvegicus
agcaggttatatccacgtgacacag

SEQ ID NO: 125938 - DNA, 25 bp, Rattus norvegicus
agcaggttatatgcacgtgacacag

SEQ ID NO: 125939 - DNA, 25 bp, Rattus norvegicus
agcaggttcacccaagtagtctttt

SEQ ID NO: 125940 - DNA, 25 bp, Rattus norvegicus
agcaggttcaccgaagtagtctttt

SEQ ID NO: 125941 - DNA, 25 bp, Rattus norvegicus
agcaggttcaggatgctcttcactt

SEQ ID NO: 125942 - DNA, 25 bp, Rattus norvegicus
agcaggttcaggttgctcttcactt

SEQ ID NO: 125943 - DNA, 25 bp, Rattus norvegicus
agcaggttcttcaccttggataaga

SEQ ID NO: 125944 - DNA, 25 bp, Rattus norvegicus
agcaggttcttctccttggataaga

SEQ ID NO: 125945 - DNA, 25 bp, Rattus norvegicus
agcaggttgagcctcattttaccat

SEQ ID NO: 125946 - DNA, 25 bp, Rattus norvegicus
agcaggttgagcgtcattttaccat

SEQ ID NO: 125947 - DNA, 25 bp, Rattus norvegicus
agcaggttggcactggctacccaat

SEQ ID NO: 125948 - DNA, 25 bp, Rattus norvegicus
agcaggttggcagtggctacccaat

SEQ ID NO: 125949 - DNA, 25 bp, Rattus norvegicus
agcaggttgggtcgcagactttcta

SEQ ID NO: 125950 - DNA, 25 bp, Rattus norvegicus
agcaggttgggtggcagactttcta

SEQ ID NO: 125951 - DNA, 25 bp, Rattus norvegicus
agcaggtttacacaagccggagcaa

SEQ ID NO: 125952 - DNA, 25 bp, Rattus norvegicus
agcaggtttacagaagccggagcaa

SEQ ID NO: 125953 - DNA, 25 bp, Rattus norvegicus
agcaggtttcagcttttcactccat

SEQ ID NO: 125954 - DNA, 25 bp, Rattus norvegicus
agcaggtttcaggttttcactccat

SEQ ID NO: 125955 - DNA, 25 bp, Rattus norvegicus
agcaggtttcctcggaatcgagcca

SEQ ID NO: 125956 - DNA, 25 bp, Rattus norvegicus
agcaggtttcctgggaatcgagcca

SEQ ID NO: 125957 - DNA, 25 bp, Rattus norvegicus
agcagtaaccttcccaaatatgtac

SEQ ID NO: 125958 - DNA, 25 bp, Rattus norvegicus
agcagtaaccttgccaaatatgtac

SEQ ID NO: 125959 - DNA, 25 bp, Rattus norvegicus
agcagtaacttgaatgggccgacca

SEQ ID NO: 125960 - DNA, 25 bp, Rattus norvegicus
agcagtaacttgtatgggccgacca

SEQ ID NO: 125961 - DNA, 25 bp, Rattus norvegicus
agcagtaagagcagccagtgtgacc

SEQ ID NO: 125962 - DNA, 25 bp, Rattus norvegicus
agcagtaagagctgccagtgtgacc

SEQ ID NO: 125963 - DNA, 25 bp, Rattus norvegicus
agcagtaagcagaatgtccctctct

SEQ ID NO: 125964 - DNA, 25 bp, Rattus norvegicus
agcagtaagcagtatgtccctctct

SEQ ID NO: 125965 - DNA, 25 bp, Rattus norvegicus
agcagtaaggacaccatttttccct

SEQ ID NO: 125966 - DNA, 25 bp, Rattus norvegicus
agcagtaaggactccatttttccct

SEQ ID NO: 125967 - DNA, 25 bp, Rattus norvegicus
agcagtaaggtgagcagctctgtct

SEQ ID NO: 125968 - DNA, 25 bp, Rattus norvegicus
agcagtaaggtgtgcagctctgtct

SEQ ID NO: 125969 - DNA, 25 bp, Rattus norvegicus
agcagtaagtccaccaatgtcatcg

SEQ ID NO: 125970 - DNA, 25 bp, Rattus norvegicus
agcagtaagtcctccaatgtcatcg

SEQ ID NO: 125971 - DNA, 25 bp, Rattus norvegicus
agcagtacatggcacagcccaagcc

SEQ ID NO: 125972 - DNA, 25 bp, Rattus norvegicus
agcagtacatgggacagcccaagcc

SEQ ID NO: 125973 - DNA, 25 bp, Rattus norvegicus
agcagtaccggcaggtgcagctcct

SEQ ID NO: 125974 - DNA, 25 bp, Rattus norvegicus
agcagtaccggctggtgcagctcct

SEQ ID NO: 125975 - DNA, 25 bp, Rattus norvegicus
agcagtacctgcaagttatcattag

SEQ ID NO: 125976 - DNA, 25 bp, Rattus norvegicus
agcagtacctgcagttggacaccca

SEQ ID NO: 125977 - DNA, 25 bp, Rattus norvegicus
agcagtacctgctagttatcattag

SEQ ID NO: 125978 - DNA, 25 bp, Rattus norvegicus
agcagtacctgctgttggacaccca

SEQ ID NO: 125979 - DNA, 25 bp, Rattus norvegicus
agcagtaccttacggttttgccatt

SEQ ID NO: 125980 - DNA, 25 bp, Rattus norvegicus
agcagtaccttagggttttgccatt

SEQ ID NO: 125981 - DNA, 25 bp, Rattus norvegicus
agcagtacgtacattctatggtcaa

SEQ ID NO: 125982 - DNA, 25 bp, Rattus norvegicus
agcagtacgtactttctatggtcaa

SEQ ID NO: 125983 - DNA, 25 bp, Rattus norvegicus
agcagtactcttaccctctggaaga

SEQ ID NO: 125984 - DNA, 25 bp, Rattus norvegicus
agcagtactctttccctctggaaga

SEQ ID NO: 125985 - DNA, 25 bp, Rattus norvegicus
agcagtactggcagccgctgtatgc

SEQ ID NO: 125986 - DNA, 25 bp, Rattus norvegicus
agcagtactggctgccgctgtatgc

SEQ ID NO: 125987 - DNA, 25 bp, Rattus norvegicus
agcagtacttctcagccatccttag

SEQ ID NO: 125988 - DNA, 25 bp, Rattus norvegicus
agcagtacttctgagccatccttag

SEQ ID NO: 125989 - DNA, 25 bp, Rattus norvegicus
agcagtactttgaccactccagagt

SEQ ID NO: 125990 - DNA, 25 bp, Rattus norvegicus
agcagtactttgtccactccagagt

SEQ ID NO: 125991 - DNA, 25 bp, Rattus norvegicus
agcagtagaaccagtgtcacctctt

SEQ ID NO: 125992 - DNA, 25 bp, Rattus norvegicus
agcagtagaacctgtgtcacctctt

SEQ ID NO: 125993 - DNA, 25 bp, Rattus norvegicus
agcagtagatccacagcctctgagt

SEQ ID NO: 125994 - DNA, 25 bp, Rattus norvegicus
agcagtagatcctcagcctctgagt

SEQ ID NO: 125995 - DNA, 25 bp, Rattus norvegicus
agcagtagcaagcatctccttttaa

SEQ ID NO: 125996 - DNA, 25 bp, Rattus norvegicus
agcagtagcaaggatctccttttaa

SEQ ID NO: 125997 - DNA, 25 bp, Rattus norvegicus
agcagtagccacattggtccccaga

SEQ ID NO: 125998 - DNA, 25 bp, Rattus norvegicus
agcagtagccactttggtccccaga

SEQ ID NO: 125999 - DNA, 25 bp, Rattus norvegicus
agcagtagcccgacctgagcaggag

SEQ ID NO: 126000 - DNA, 25 bp, Rattus norvegicus
agcagtagcccgtcctgagcaggag

SEQ ID NO: 126001 - DNA, 25 bp, Rattus norvegicus
agcagtagcttgctttggaattcac

SEQ ID NO: 126002 - DNA, 25 bp, Rattus norvegicus
agcagtagcttggtttggaattcac

SEQ ID NO: 126003 - DNA, 25 bp, Rattus norvegicus
agcagtatcagacttggcggatgaa

SEQ ID NO: 126004 - DNA, 25 bp, Rattus norvegicus
agcagtatcagagttggcggatgaa

SEQ ID NO: 126005 - DNA, 25 bp, Rattus norvegicus
agcagtatctgcacctcctgacaga

SEQ ID NO: 126006 - DNA, 25 bp, Rattus norvegicus
agcagtatctgctcctcctgacaga

SEQ ID NO: 126007 - DNA, 25 bp, Rattus norvegicus
agcagtatgcttctgaccttatcct

SEQ ID NO: 126008 - DNA, 25 bp, Rattus norvegicus
agcagtatgcttgtgaccttatcct

SEQ ID NO: 126009 - DNA, 25 bp, Rattus norvegicus
agcagtatgtccagagccatgggca

SEQ ID NO: 126010 - DNA, 25 bp, Rattus norvegicus
agcagtatgtcctgagccatgggca

SEQ ID NO: 126011 - DNA, 25 bp, Rattus norvegicus
agcagtattgtgctgctgagccaca

SEQ ID NO: 126012 - DNA, 25 bp, Rattus norvegicus
agcagtattgtggtgctgagccaca

SEQ ID NO: 126013 - DNA, 25 bp, Rattus norvegicus
agcagtatttacactctcctgtaga

SEQ ID NO: 126014 - DNA, 25 bp, Rattus norvegicus
agcagtatttactctctcctgtaga

SEQ ID NO: 126015 - DNA, 25 bp, Rattus norvegicus
agcagtcaaatcagtgcacctctca

SEQ ID NO: 126016 - DNA, 25 bp, Rattus norvegicus
agcagtcaaatctgtgcacctctca

SEQ ID NO: 126017 - DNA, 25 bp, Rattus norvegicus
agcagtcaatgcaccaaaccgttga

SEQ ID NO: 126018 - DNA, 25 bp, Rattus norvegicus
agcagtcaatgctccaaaccgttga

SEQ ID NO: 126019 - DNA, 25 bp, Rattus norvegicus
agcagtcaatggatcctgtgtcttg

SEQ ID NO: 126020 - DNA, 25 bp, Rattus norvegicus
agcagtcaatggttcctgtgtcttg

SEQ ID NO: 126021 - DNA, 25 bp, Rattus norvegicus
agcagtcacagcacctggtttttta

SEQ ID NO: 126022 - DNA, 25 bp, Rattus norvegicus
agcagtcacagctcctggtttttta

SEQ ID NO: 126023 - DNA, 25 bp, Rattus norvegicus
agcagtcaccatccaagctctttga

SEQ ID NO: 126024 - DNA, 25 bp, Rattus norvegicus
agcagtcaccatgcaagctctttga

SEQ ID NO: 126025 - DNA, 25 bp, Rattus norvegicus
agcagtcacccaaagattcagtagt

SEQ ID NO: 126026 - DNA, 25 bp, Rattus norvegicus
agcagtcacccatagattcagtagt

SEQ ID NO: 126027 - DNA, 25 bp, Rattus norvegicus
agcagtcaccccaatggacgatacg

SEQ ID NO: 126028 - DNA, 25 bp, Rattus norvegicus
agcagtcacccctatggacgatacg

SEQ ID NO: 126029 - DNA, 25 bp, Rattus norvegicus
agcagtcactcaaaagcgcgtacat

SEQ ID NO: 126030 - DNA, 25 bp, Rattus norvegicus
agcagtcactcataagcgcgtacat

SEQ ID NO: 126031 - DNA, 25 bp, Rattus norvegicus
agcagtcacttgctgtgccttgaat

SEQ ID NO: 126032 - DNA, 25 bp, Rattus norvegicus
agcagtcacttggtgtgccttgaat

SEQ ID NO: 126033 - DNA, 25 bp, Rattus norvegicus
agcagtcagacccttgtagtatttc

SEQ ID NO: 126034 - DNA, 25 bp, Rattus norvegicus
agcagtcagaccgttgtagtatttc

SEQ ID NO: 126035 - DNA, 25 bp, Rattus norvegicus
agcagtcagcatccagggtcagcga

SEQ ID NO: 126036 - DNA, 25 bp, Rattus norvegicus
agcagtcagcatgcagggtcagcga

SEQ ID NO: 126037 - DNA, 25 bp, Rattus norvegicus
agcagtcaggatactgtgagcttga

SEQ ID NO: 126038 - DNA, 25 bp, Rattus norvegicus
agcagtcaggattctgtgagcttga

SEQ ID NO: 126039 - DNA, 25 bp, Rattus norvegicus
agcagtcaggccatactagttggtg

SEQ ID NO: 126040 - DNA, 25 bp, Rattus norvegicus
agcagtcaggccttactagttggtg

SEQ ID NO: 126041 - DNA, 25 bp, Rattus norvegicus
agcagtcagggcatctgctgctctt

SEQ ID NO: 126042 - DNA, 25 bp, Rattus norvegicus
agcagtcagggcttctgctgctctt

SEQ ID NO: 126043 - DNA, 25 bp, Rattus norvegicus
agcagtcagtctcttgagcaccagt

SEQ ID NO: 126044 - DNA, 25 bp, Rattus norvegicus
agcagtcagtctgttgagcaccagt

SEQ ID NO: 126045 - DNA, 25 bp, Rattus norvegicus
agcagtcatcccaaggcatgcagta

SEQ ID NO: 126046 - DNA, 25 bp, Rattus norvegicus
agcagtcatccctaggcatgcagta

SEQ ID NO: 126047 - DNA, 25 bp, Rattus norvegicus
agcagtcatgaccaggagcaattgt

SEQ ID NO: 126048 - DNA, 25 bp, Rattus norvegicus
agcagtcatgacgaggagcaattgt

SEQ ID NO: 126049 - DNA, 25 bp, Rattus norvegicus
agcagtccaaaaacgctgtgtttca

SEQ ID NO: 126050 - DNA, 25 bp, Rattus norvegicus
agcagtccaaaatcgctgtgtttca

SEQ ID NO: 126051 - DNA, 25 bp, Rattus norvegicus
agcagtccagtgagtccttgataga

SEQ ID NO: 126052 - DNA, 25 bp, Rattus norvegicus
agcagtccagtgtgtccttgataga

SEQ ID NO: 126053 - DNA, 25 bp, Rattus norvegicus
agcagtcccagacccggaggcaaaa

SEQ ID NO: 126054 - DNA, 25 bp, Rattus norvegicus
agcagtcccagagccggaggcaaaa

SEQ ID NO: 126055 - DNA, 25 bp, Rattus norvegicus
agcagtcccagcatgtctgttggga

SEQ ID NO: 126056 - DNA, 25 bp, Rattus norvegicus
agcagtcccagccttgtgctgagaa

SEQ ID NO: 126057 - DNA, 25 bp, Rattus norvegicus
agcagtcccagcgttgtgctgagaa

SEQ ID NO: 126058 - DNA, 25 bp, Rattus norvegicus
agcagtcccagcttgtctgttggga

SEQ ID NO: 126059 - DNA, 25 bp, Rattus norvegicus
agcagtccctgccattatgagagta

SEQ ID NO: 126060 - DNA, 25 bp, Rattus norvegicus
agcagtccctgcgattatgagagta

SEQ ID NO: 126061 - DNA, 25 bp, Rattus norvegicus
agcagtccggaaaggactcctggtg

SEQ ID NO: 126062 - DNA, 25 bp, Rattus norvegicus
agcagtccggaatggactcctggtg

SEQ ID NO: 126063 - DNA, 25 bp, Rattus norvegicus
agcagtccgtggcaagaagctcaca

SEQ ID NO: 126064 - DNA, 25 bp, Rattus norvegicus
agcagtccgtgggaagaagctcaca

SEQ ID NO: 126065 - DNA, 25 bp, Rattus norvegicus
agcagtcctaccagccgtctaacgg

SEQ ID NO: 126066 - DNA, 25 bp, Rattus norvegicus
agcagtcctacctgccgtctaacgg

SEQ ID NO: 126067 - DNA, 25 bp, Rattus norvegicus
agcagtcctcaaagtgggcaggtgt

SEQ ID NO: 126068 - DNA, 25 bp, Rattus norvegicus
agcagtcctcaatgtgggcaggtgt

SEQ ID NO: 126069 - DNA, 25 bp, Rattus norvegicus
agcagtcctcagagccaaagggcaa

SEQ ID NO: 126070 - DNA, 25 bp, Rattus norvegicus
agcagtcctcagtgccaaagggcaa

SEQ ID NO: 126071 - DNA, 25 bp, Rattus norvegicus
agcagtcctctcacggcaaggtgag

SEQ ID NO: 126072 - DNA, 25 bp, Rattus norvegicus
agcagtcctctctcggcaaggtgag

SEQ ID NO: 126073 - DNA, 25 bp, Rattus norvegicus
agcagtcctgagagctcactgatgt

SEQ ID NO: 126074 - DNA, 25 bp, Rattus norvegicus
agcagtcctgagtgctcactgatgt

SEQ ID NO: 126075 - DNA, 25 bp, Rattus norvegicus
agcagtcctgccatttaaatcttgt

SEQ ID NO: 126076 - DNA, 25 bp, Rattus norvegicus
agcagtcctgccttttaaatcttgt

SEQ ID NO: 126077 - DNA, 25 bp, Rattus norvegicus
agcagtccttctattgtacaaatct

SEQ ID NO: 126078 - DNA, 25 bp, Rattus norvegicus
agcagtccttcttttgtacaaatct

SEQ ID NO: 126079 - DNA, 25 bp, Rattus norvegicus
agcagtcgctgacaattgttgattc

SEQ ID NO: 126080 - DNA, 25 bp, Rattus norvegicus
agcagtcgctgagaattgttgattc

SEQ ID NO: 126081 - DNA, 25 bp, Rattus norvegicus
agcagtctaactacagggcatggga

SEQ ID NO: 126082 - DNA, 25 bp, Rattus norvegicus
agcagtctaacttcagggcatggga

SEQ ID NO: 126083 - DNA, 25 bp, Rattus norvegicus
agcagtctacaaatggaagccgtgg

SEQ ID NO: 126084 - DNA, 25 bp, Rattus norvegicus
agcagtctacaattggaagccgtgg

SEQ ID NO: 126085 - DNA, 25 bp, Rattus norvegicus
agcagtctactcatgaaggctcggc

SEQ ID NO: 126086 - DNA, 25 bp, Rattus norvegicus
agcagtctactcttgaaggctcggc

SEQ ID NO: 126087 - DNA, 25 bp, Rattus norvegicus
agcagtctcagactttcttgtctca

SEQ ID NO: 126088 - DNA, 25 bp, Rattus norvegicus
agcagtctcagagtttcttgtctca

SEQ ID NO: 126089 - DNA, 25 bp, Rattus norvegicus
agcagtctctgcatgtaagataaat

SEQ ID NO: 126090 - DNA, 25 bp, Rattus norvegicus
agcagtctctgcttgtaagataaat

SEQ ID NO: 126091 - DNA, 25 bp, Rattus norvegicus
agcagtctgatgacaacagctctga

SEQ ID NO: 126092 - DNA, 25 bp, Rattus norvegicus
agcagtctgatgtcaacagctctga

SEQ ID NO: 126093 - DNA, 25 bp, Rattus norvegicus
agcagtctgccccacagtaggagtg

SEQ ID NO: 126094 - DNA, 25 bp, Rattus norvegicus
agcagtctgcccgacagtaggagtg

SEQ ID NO: 126095 - DNA, 25 bp, Rattus norvegicus
agcagtctgcggagtgtgcagtcca

SEQ ID NO: 126096 - DNA, 25 bp, Rattus norvegicus
agcagtctgcggtgtgtgcagtcca

SEQ ID NO: 126097 - DNA, 25 bp, Rattus norvegicus
agcagtctggtccttacatctgggt

SEQ ID NO: 126098 - DNA, 25 bp, Rattus norvegicus
agcagtctggtcgttacatctgggt

SEQ ID NO: 126099 - DNA, 25 bp, Rattus norvegicus
agcagtcttctgaagcatgtcccac

SEQ ID NO: 126100 - DNA, 25 bp, Rattus norvegicus
agcagtcttctgtagcatgtcccac

SEQ ID NO: 126101 - DNA, 25 bp, Rattus norvegicus
agcagtcttggcctatggtgtcact

SEQ ID NO: 126102 - DNA, 25 bp, Rattus norvegicus
agcagtcttggcgtatggtgtcact

SEQ ID NO: 126103 - DNA, 25 bp, Rattus norvegicus
agcagtcttgggacccttcagatag

SEQ ID NO: 126104 - DNA, 25 bp, Rattus norvegicus
agcagtcttgggtcccttcagatag

SEQ ID NO: 126105 - DNA, 25 bp, Rattus norvegicus
agcagtcttgttacactttccaaag

SEQ ID NO: 126106 - DNA, 25 bp, Rattus norvegicus
agcagtcttgtttcactttccaaag

SEQ ID NO: 126107 - DNA, 25 bp, Rattus norvegicus
agcagtctttctccatgtcgtagat

SEQ ID NO: 126108 - DNA, 25 bp, Rattus norvegicus
agcagtctttctgcatgtcgtagat

SEQ ID NO: 126109 - DNA, 25 bp, Rattus norvegicus
agcagtctttggattttctcttttg

SEQ ID NO: 126110 - DNA, 25 bp, Rattus norvegicus
agcagtctttggtttttctcttttg

SEQ ID NO: 126111 - DNA, 25 bp, Rattus norvegicus
agcagtgaacacaagccatcgggca

SEQ ID NO: 126112 - DNA, 25 bp, Rattus norvegicus
agcagtgaacactagccatcgggca

SEQ ID NO: 126113 - DNA, 25 bp, Rattus norvegicus
agcagtgaacgtattatgagagcca

SEQ ID NO: 126114 - DNA, 25 bp, Rattus norvegicus
agcagtgaacgttttatgagagcca

SEQ ID NO: 126115 - DNA, 25 bp, Rattus norvegicus
agcagtgaacttagtctccaggcaa

SEQ ID NO: 126116 - DNA, 25 bp, Rattus norvegicus
agcagtgaactttgtctccaggcaa

SEQ ID NO: 126117 - DNA, 25 bp, Rattus norvegicus
agcagtgaagcccagcaggcagtaa

SEQ ID NO: 126118 - DNA, 25 bp, Rattus norvegicus
agcagtgaagccgagcaggcagtaa

SEQ ID NO: 126119 - DNA, 25 bp, Rattus norvegicus
agcagtgaagttatactgtataatt

SEQ ID NO: 126120 - DNA, 25 bp, Rattus norvegicus
agcagtgaagttttactgtataatt

SEQ ID NO: 126121 - DNA, 25 bp, Rattus norvegicus
agcagtgacaggcaccgtcagtgtt

SEQ ID NO: 126122 - DNA, 25 bp, Rattus norvegicus
agcagtgacagggaccgtcagtgtt

SEQ ID NO: 126123 - DNA, 25 bp, Rattus norvegicus
agcagtgacattaaacatggtccaa

SEQ ID NO: 126124 - DNA, 25 bp, Rattus norvegicus
agcagtgacatttaacatggtccaa

SEQ ID NO: 126125 - DNA, 25 bp, Rattus norvegicus
agcagtgaccccaagagccgggaac

SEQ ID NO: 126126 - DNA, 25 bp, Rattus norvegicus
agcagtgacccctagagccgggaac

SEQ ID NO: 126127 - DNA, 25 bp, Rattus norvegicus
agcagtgactccctcgggtataaac

SEQ ID NO: 126128 - DNA, 25 bp, Rattus norvegicus
agcagtgactccgtcgggtataaac

SEQ ID NO: 126129 - DNA, 25 bp, Rattus norvegicus
agcagtgacttgatgtgagagttaa

SEQ ID NO: 126130 - DNA, 25 bp, Rattus norvegicus
agcagtgacttgttgtgagagttaa

SEQ ID NO: 126131 - DNA, 25 bp, Rattus norvegicus
agcagtgagaccactgcagctttta

SEQ ID NO: 126132 - DNA, 25 bp, Rattus norvegicus
agcagtgagacctctgcagctttta

SEQ ID NO: 126133 - DNA, 25 bp, Rattus norvegicus
agcagtgagcatctgcacctctctg

SEQ ID NO: 126134 - DNA, 25 bp, Rattus norvegicus
agcagtgagcatgtgcacctctctg

SEQ ID NO: 126135 - DNA, 25 bp, Rattus norvegicus
agcagtgaggccatctctgtgaagc

SEQ ID NO: 126136 - DNA, 25 bp, Rattus norvegicus
agcagtgaggccttctctgtgaagc

SEQ ID NO: 126137 - DNA, 25 bp, Rattus norvegicus
agcagtgagtctctccaggttggaa

SEQ ID NO: 126138 - DNA, 25 bp, Rattus norvegicus
agcagtgagtctgtccaggttggaa

SEQ ID NO: 126139 - DNA, 25 bp, Rattus norvegicus
agcagtgatcacaaacctctcgagt

SEQ ID NO: 126140 - DNA, 25 bp, Rattus norvegicus
agcagtgatcactaacctctcgagt

SEQ ID NO: 126141 - DNA, 25 bp, Rattus norvegicus
agcagtgatcggagtcctgtacctg

SEQ ID NO: 126142 - DNA, 25 bp, Rattus norvegicus
agcagtgatcggtgtcctgtacctg

SEQ ID NO: 126143 - DNA, 25 bp, Rattus norvegicus
agcagtgatgagcacccatctcttc

SEQ ID NO: 126144 - DNA, 25 bp, Rattus norvegicus
agcagtgatgaggacccatctcttc

SEQ ID NO: 126145 - DNA, 25 bp, Rattus norvegicus
agcagtgattctatcttgttattta

SEQ ID NO: 126146 - DNA, 25 bp, Rattus norvegicus
agcagtgattctttcttgttattta

SEQ ID NO: 126147 - DNA, 25 bp, Rattus norvegicus
agcagtgcaagacgctccaacatgg

SEQ ID NO: 126148 - DNA, 25 bp, Rattus norvegicus
agcagtgcaagaggctccaacatgg

SEQ ID NO: 126149 - DNA, 25 bp, Rattus norvegicus
agcagtgcaaggaccagctcttgaa

SEQ ID NO: 126150 - DNA, 25 bp, Rattus norvegicus
agcagtgcaaggtccagctcttgaa

SEQ ID NO: 126151 - DNA, 25 bp, Rattus norvegicus
agcagtgcacataggtaaacatttc

SEQ ID NO: 126152 - DNA, 25 bp, Rattus norvegicus
agcagtgcacattggtaaacatttc

SEQ ID NO: 126153 - DNA, 25 bp, Rattus norvegicus
agcagtgcactgaagccagcagaga

SEQ ID NO: 126154 - DNA, 25 bp, Rattus norvegicus
agcagtgcactgtagccagcagaga

SEQ ID NO: 126155 - DNA, 25 bp, Rattus norvegicus
agcagtgcatgacccagccagatgt

SEQ ID NO: 126156 - DNA, 25 bp, Rattus norvegicus
agcagtgcatgagccagccagatgt

SEQ ID NO: 126157 - DNA, 25 bp, Rattus norvegicus
agcagtgcatggctttgtgtgcctt

SEQ ID NO: 126158 - DNA, 25 bp, Rattus norvegicus
agcagtgcatgggtttgtgtgcctt

SEQ ID NO: 126159 - DNA, 25 bp, Rattus norvegicus
agcagtgccagcaacctaaggaggg

SEQ ID NO: 126160 - DNA, 25 bp, Rattus norvegicus
agcagtgccagctacctaaggaggg

SEQ ID NO: 126161 - DNA, 25 bp, Rattus norvegicus
agcagtgcccaaaggcatcaggaga

SEQ ID NO: 126162 - DNA, 25 bp, Rattus norvegicus
agcagtgcccaatggcatcaggaga

SEQ ID NO: 126163 - DNA, 25 bp, Rattus norvegicus
agcagtgccggcacgggccagcgag

SEQ ID NO: 126164 - DNA, 25 bp, Rattus norvegicus
agcagtgccggctcgggccagcgag

SEQ ID NO: 126165 - DNA, 25 bp, Rattus norvegicus
agcagtgcctctcttgagactcagg

SEQ ID NO: 126166 - DNA, 25 bp, Rattus norvegicus
agcagtgcctctgttgagactcagg

SEQ ID NO: 126167 - DNA, 25 bp, Rattus norvegicus
agcagtgcctgtagcctctgagaag

SEQ ID NO: 126168 - DNA, 25 bp, Rattus norvegicus
agcagtgcctgttgcctctgagaag

SEQ ID NO: 126169 - DNA, 25 bp, Rattus norvegicus
agcagtgccttcagatggatcccat

SEQ ID NO: 126170 - DNA, 25 bp, Rattus norvegicus
agcagtgccttctgatggatcccat

SEQ ID NO: 126171 - DNA, 25 bp, Rattus norvegicus
agcagtgcgtccattgggtctggtc

SEQ ID NO: 126172 - DNA, 25 bp, Rattus norvegicus
agcagtgcgtcctttgggtctggtc

SEQ ID NO: 126173 - DNA, 25 bp, Rattus norvegicus
agcagtgcgttcatttgcattcacg

SEQ ID NO: 126174 - DNA, 25 bp, Rattus norvegicus
agcagtgcgttcttttgcattcacg

SEQ ID NO: 126175 - DNA, 25 bp, Rattus norvegicus
agcagtgctcatccatggcttctga

SEQ ID NO: 126176 - DNA, 25 bp, Rattus norvegicus
agcagtgctcatgcatggcttctga

SEQ ID NO: 126177 - DNA, 25 bp, Rattus norvegicus
agcagtgctccgcttactggcttaa

SEQ ID NO: 126178 - DNA, 25 bp, Rattus norvegicus
agcagtgctccggttactggcttaa

SEQ ID NO: 126179 - DNA, 25 bp, Rattus norvegicus
agcagtgctggcaactaatactcct

SEQ ID NO: 126180 - DNA, 25 bp, Rattus norvegicus
agcagtgctggctactaatactcct

SEQ ID NO: 126181 - DNA, 25 bp, Rattus norvegicus
agcagtgcttacacacaggcagttt

SEQ ID NO: 126182 - DNA, 25 bp, Rattus norvegicus
agcagtgcttactcacaggcagttt

SEQ ID NO: 126183 - DNA, 25 bp, Rattus norvegicus
agcagtggaccgaatgctagtcgaa

SEQ ID NO: 126184 - DNA, 25 bp, Rattus norvegicus
agcagtggaccgtatgctagtcgaa

SEQ ID NO: 126185 - DNA, 25 bp, Rattus norvegicus
agcagtggactcaagaatcctggat

SEQ ID NO: 126186 - DNA, 25 bp, Rattus norvegicus
agcagtggactcagcatctggccag

SEQ ID NO: 126187 - DNA, 25 bp, Rattus norvegicus
agcagtggactctagaatcctggat

SEQ ID NO: 126188 - DNA, 25 bp, Rattus norvegicus
agcagtggactctgcatctggccag

SEQ ID NO: 126189 - DNA, 25 bp, Rattus norvegicus
agcagtggaggtcctctgctcacat

SEQ ID NO: 126190 - DNA, 25 bp, Rattus norvegicus
agcagtggaggtgctctgctcacat

SEQ ID NO: 126191 - DNA, 25 bp, Rattus norvegicus
agcagtggagtcctacatcctagaa

SEQ ID NO: 126192 - DNA, 25 bp, Rattus norvegicus
agcagtggagtcgtacatcctagaa

SEQ ID NO: 126193 - DNA, 25 bp, Rattus norvegicus
agcagtggatccaggccaagttcac

SEQ ID NO: 126194 - DNA, 25 bp, Rattus norvegicus
agcagtggatcctggccaagttcac

SEQ ID NO: 126195 - DNA, 25 bp, Rattus norvegicus
agcagtggatggcttcaacccagca

SEQ ID NO: 126196 - DNA, 25 bp, Rattus norvegicus
agcagtggatgggttcaacccagca

SEQ ID NO: 126197 - DNA, 25 bp, Rattus norvegicus
agcagtggcacaccaactggagttg

SEQ ID NO: 126198 - DNA, 25 bp, Rattus norvegicus
agcagtggcacagcaactggagttg

SEQ ID NO: 126199 - DNA, 25 bp, Rattus norvegicus
agcagtggcagaagtccgacagtct

SEQ ID NO: 126200 - DNA, 25 bp, Rattus norvegicus
agcagtggcagatgtccgacagtct

SEQ ID NO: 126201 - DNA, 25 bp, Rattus norvegicus
agcagtggcagcaatgtccaaggac

SEQ ID NO: 126202 - DNA, 25 bp, Rattus norvegicus
agcagtggcagctatgtccaaggac

SEQ ID NO: 126203 - DNA, 25 bp, Rattus norvegicus
agcagtggcctcatactcattagta

SEQ ID NO: 126204 - DNA, 25 bp, Rattus norvegicus
agcagtggcctcttactcattagta

SEQ ID NO: 126205 - DNA, 25 bp, Rattus norvegicus
agcagtggccttcgccatttgttta

SEQ ID NO: 126206 - DNA, 25 bp, Rattus norvegicus
agcagtggccttggccatttgttta

SEQ ID NO: 126207 - DNA, 25 bp, Rattus norvegicus
agcagtggcgatcccttcggagaca

SEQ ID NO: 126208 - DNA, 25 bp, Rattus norvegicus
agcagtggcgatgccttcggagaca

SEQ ID NO: 126209 - DNA, 25 bp, Rattus norvegicus
agcagtggcgtcaatgaaccagacc

SEQ ID NO: 126210 - DNA, 25 bp, Rattus norvegicus
agcagtggcgtctatgaaccagacc

SEQ ID NO: 126211 - DNA, 25 bp, Rattus norvegicus
agcagtggctctagctcgtcttctg

SEQ ID NO: 126212 - DNA, 25 bp, Rattus norvegicus
agcagtggctcttgctcgtcttctg

SEQ ID NO: 126213 - DNA, 25 bp, Rattus norvegicus
agcagtggcttaccgctcatctgga

SEQ ID NO: 126214 - DNA, 25 bp, Rattus norvegicus
agcagtggcttagcgctcatctgga

SEQ ID NO: 126215 - DNA, 25 bp, Rattus norvegicus
agcagtggcttcacatttagtgcaa

SEQ ID NO: 126216 - DNA, 25 bp, Rattus norvegicus
agcagtggcttctcatttagtgcaa

SEQ ID NO: 126217 - DNA, 25 bp, Rattus norvegicus
agcagtggctttcttcaccatttgc

SEQ ID NO: 126218 - DNA, 25 bp, Rattus norvegicus
agcagtggctttgttcaccatttgc

SEQ ID NO: 126219 - DNA, 25 bp, Rattus norvegicus
agcagtgggcctctagccaaactca

SEQ ID NO: 126220 - DNA, 25 bp, Rattus norvegicus
agcagtgggcctgtagccaaactca

SEQ ID NO: 126221 - DNA, 25 bp, Rattus norvegicus
agcagtgggctcatcatggccagac

SEQ ID NO: 126222 - DNA, 25 bp, Rattus norvegicus
agcagtgggctcttcatggccagac

SEQ ID NO: 126223 - DNA, 25 bp, Rattus norvegicus
agcagtgggcttctgcctgcaccta

SEQ ID NO: 126224 - DNA, 25 bp, Rattus norvegicus
agcagtgggcttgtgcctgcaccta

SEQ ID NO: 126225 - DNA, 25 bp, Rattus norvegicus
agcagtgggtcaaggctttcgtcac

SEQ ID NO: 126226 - DNA, 25 bp, Rattus norvegicus
agcagtgggtcatggctttcgtcac

SEQ ID NO: 126227 - DNA, 25 bp, Rattus norvegicus
agcagtggtaccagcagttcctgta

SEQ ID NO: 126228 - DNA, 25 bp, Rattus norvegicus
agcagtggtacctgcagttcctgta

SEQ ID NO: 126229 - DNA, 25 bp, Rattus norvegicus
agcagtgtaaacctacctgttctgg

SEQ ID NO: 126230 - DNA, 25 bp, Rattus norvegicus
agcagtgtaaacgtacctgttctgg

SEQ ID NO: 126231 - DNA, 25 bp, Rattus norvegicus
agcagtgtacagctgagtttcttat

SEQ ID NO: 126232 - DNA, 25 bp, Rattus norvegicus
agcagtgtacaggtgagtttcttat

SEQ ID NO: 126233 - DNA, 25 bp, Rattus norvegicus
agcagtgtaccgaccagtttgggat

SEQ ID NO: 126234 - DNA, 25 bp, Rattus norvegicus
agcagtgtaccgtccagtttgggat

SEQ ID NO: 126235 - DNA, 25 bp, Rattus norvegicus
agcagtgtagtgacctcgcccagaa

SEQ ID NO: 126236 - DNA, 25 bp, Rattus norvegicus
agcagtgtagtgtcctcgcccagaa

SEQ ID NO: 126237 - DNA, 25 bp, Rattus norvegicus
agcagtgtatcacctaccgacgtgc

SEQ ID NO: 126238 - DNA, 25 bp, Rattus norvegicus
agcagtgtatcagctaccgacgtgc

SEQ ID NO: 126239 - DNA, 25 bp, Rattus norvegicus
agcagtgtcctaaagggcagctgga

SEQ ID NO: 126240 - DNA, 25 bp, Rattus norvegicus
agcagtgtcctatagggcagctgga

SEQ ID NO: 126241 - DNA, 25 bp, Rattus norvegicus
agcagtgtcggtcgctacagaatgt

SEQ ID NO: 126242 - DNA, 25 bp, Rattus norvegicus
agcagtgtcggtggctacagaatgt

SEQ ID NO: 126243 - DNA, 25 bp, Rattus norvegicus
agcagtgtctaaaaggtcattccca

SEQ ID NO: 126244 - DNA, 25 bp, Rattus norvegicus
agcagtgtctaataggtcattccca

SEQ ID NO: 126245 - DNA, 25 bp, Rattus norvegicus
agcagtgtctttctaaatccagggt

SEQ ID NO: 126246 - DNA, 25 bp, Rattus norvegicus
agcagtgtctttgtaaatccagggt

SEQ ID NO: 126247 - DNA, 25 bp, Rattus norvegicus
agcagtgtggttcccggatctacaa

SEQ ID NO: 126248 - DNA, 25 bp, Rattus norvegicus
agcagtgtggttgccggatctacaa

SEQ ID NO: 126249 - DNA, 25 bp, Rattus norvegicus
agcagtgttaccaactctacagtat

SEQ ID NO: 126250 - DNA, 25 bp, Rattus norvegicus
agcagtgttacctactctacagtat

SEQ ID NO: 126251 - DNA, 25 bp, Rattus norvegicus
agcagtgttcaaacccttacaaagg

SEQ ID NO: 126252 - DNA, 25 bp, Rattus norvegicus
agcagtgttcaatcccttacaaagg

SEQ ID NO: 126253 - DNA, 25 bp, Rattus norvegicus
agcagtgttctactcctcaggaggg

SEQ ID NO: 126254 - DNA, 25 bp, Rattus norvegicus
agcagtgttctagtcctcaggaggg

SEQ ID NO: 126255 - DNA, 25 bp, Rattus norvegicus
agcagtgttctgaggtgacccttga

SEQ ID NO: 126256 - DNA, 25 bp, Rattus norvegicus
agcagtgttctgcttccccggagac

SEQ ID NO: 126257 - DNA, 25 bp, Rattus norvegicus
agcagtgttctggttccccggagac

SEQ ID NO: 126258 - DNA, 25 bp, Rattus norvegicus
agcagtgttctgtggtgacccttga

SEQ ID NO: 126259 - DNA, 25 bp, Rattus norvegicus
agcagtgttgttcaactcagagaac

SEQ ID NO: 126260 - DNA, 25 bp, Rattus norvegicus
agcagtgttgttgaactcagagaac

SEQ ID NO: 126261 - DNA, 25 bp, Rattus norvegicus
agcagtgttttaaaaaccccatgaa

SEQ ID NO: 126262 - DNA, 25 bp, Rattus norvegicus
agcagtgttttataaaccccatgaa

SEQ ID NO: 126263 - DNA, 25 bp, Rattus norvegicus
agcagttaacacattgcctggcaca

SEQ ID NO: 126264 - DNA, 25 bp, Rattus norvegicus
agcagttaacactttgcctggcaca

SEQ ID NO: 126265 - DNA, 25 bp, Rattus norvegicus
agcagttaacccaaagacagtgacc

SEQ ID NO: 126266 - DNA, 25 bp, Rattus norvegicus
agcagttaaccctaagacagtgacc

SEQ ID NO: 126267 - DNA, 25 bp, Rattus norvegicus
agcagttacaccaggaagtcccagt

SEQ ID NO: 126268 - DNA, 25 bp, Rattus norvegicus
agcagttacacctggaagtcccagt

SEQ ID NO: 126269 - DNA, 25 bp, Rattus norvegicus
agcagttactctactatcgcaatac

SEQ ID NO: 126270 - DNA, 25 bp, Rattus norvegicus
agcagttactcttctatcgcaatac

SEQ ID NO: 126271 - DNA, 25 bp, Rattus norvegicus
agcagttactgaacctcgagatcaa

SEQ ID NO: 126272 - DNA, 25 bp, Rattus norvegicus
agcagttactgatcctcgagatcaa

SEQ ID NO: 126273 - DNA, 25 bp, Rattus norvegicus
agcagttagcaaaagctttctcgtt

SEQ ID NO: 126274 - DNA, 25 bp, Rattus norvegicus
agcagttagcaatagctttctcgtt

SEQ ID NO: 126275 - DNA, 25 bp, Rattus norvegicus
agcagttcaaggacttccagcgtcg

SEQ ID NO: 126276 - DNA, 25 bp, Rattus norvegicus
agcagttcaaggtcttccagcgtcg

SEQ ID NO: 126277 - DNA, 25 bp, Rattus norvegicus
agcagttcactgacttgagtattta

SEQ ID NO: 126278 - DNA, 25 bp, Rattus norvegicus
agcagttcactgtcttgagtattta

SEQ ID NO: 126279 - DNA, 25 bp, Rattus norvegicus
agcagttcagctatgcagtcagcta

SEQ ID NO: 126280 - DNA, 25 bp, Rattus norvegicus
agcagttcagctcccaacctgatag

SEQ ID NO: 126281 - DNA, 25 bp, Rattus norvegicus
agcagttcagctgccaacctgatag

SEQ ID NO: 126282 - DNA, 25 bp, Rattus norvegicus
agcagttcagctttgcagtcagcta

SEQ ID NO: 126283 - DNA, 25 bp, Rattus norvegicus
agcagttcattgaccctgtaggaca

SEQ ID NO: 126284 - DNA, 25 bp, Rattus norvegicus
agcagttcattgatgtctcctatca

SEQ ID NO: 126285 - DNA, 25 bp, Rattus norvegicus
agcagttcattgtccctgtaggaca

SEQ ID NO: 126286 - DNA, 25 bp, Rattus norvegicus
agcagttcattgttgtctcctatca

SEQ ID NO: 126287 - DNA, 25 bp, Rattus norvegicus
agcagttcatttagtgacgtctctt

SEQ ID NO: 126288 - DNA, 25 bp, Rattus norvegicus
agcagttcattttgtgacgtctctt

SEQ ID NO: 126289 - DNA, 25 bp, Rattus norvegicus
agcagttccccacggaagactggag

SEQ ID NO: 126290 - DNA, 25 bp, Rattus norvegicus
agcagttccccagggaagactggag

SEQ ID NO: 126291 - DNA, 25 bp, Rattus norvegicus
agcagttccctcagacagcagacaa

SEQ ID NO: 126292 - DNA, 25 bp, Rattus norvegicus
agcagttccctctgacagcagacaa

SEQ ID NO: 126293 - DNA, 25 bp, Rattus norvegicus
agcagttccgttcctactcggagag

SEQ ID NO: 126294 - DNA, 25 bp, Rattus norvegicus
agcagttccgttgctactcggagag

SEQ ID NO: 126295 - DNA, 25 bp, Rattus norvegicus
agcagttcctggcactgattggcca

SEQ ID NO: 126296 - DNA, 25 bp, Rattus norvegicus
agcagttcctgggactgattggcca

SEQ ID NO: 126297 - DNA, 25 bp, Rattus norvegicus
agcagttcctgtcaaaatatccatc

SEQ ID NO: 126298 - DNA, 25 bp, Rattus norvegicus
agcagttcctgtgaaaatatccatc

SEQ ID NO: 126299 - DNA, 25 bp, Rattus norvegicus
agcagttccttcactaagctcagag

SEQ ID NO: 126300 - DNA, 25 bp, Rattus norvegicus
agcagttccttcagccaaactttga

SEQ ID NO: 126301 - DNA, 25 bp, Rattus norvegicus
agcagttccttctctaagctcagag

SEQ ID NO: 126302 - DNA, 25 bp, Rattus norvegicus
agcagttccttctgccaaactttga

SEQ ID NO: 126303 - DNA, 25 bp, Rattus norvegicus
agcagttcgcacagctggcccggga

SEQ ID NO: 126304 - DNA, 25 bp, Rattus norvegicus
agcagttcgcactgctggcccggga

SEQ ID NO: 126305 - DNA, 25 bp, Rattus norvegicus
agcagttcggcaactccgaggaggc

SEQ ID NO: 126306 - DNA, 25 bp, Rattus norvegicus
agcagttcggcatctccgaggaggc

SEQ ID NO: 126307 - DNA, 25 bp, Rattus norvegicus
agcagttcgggcaaatgacattaac

SEQ ID NO: 126308 - DNA, 25 bp, Rattus norvegicus
agcagttcgggctaatgacattaac

SEQ ID NO: 126309 - DNA, 25 bp, Rattus norvegicus
agcagttcgttcactctaatcatct

SEQ ID NO: 126310 - DNA, 25 bp, Rattus norvegicus
agcagttcgttctctctaatcatct

SEQ ID NO: 126311 - DNA, 25 bp, Rattus norvegicus
agcagttctaaaagggtccggagat

SEQ ID NO: 126312 - DNA, 25 bp, Rattus norvegicus
agcagttctaaatgggtccggagat

SEQ ID NO: 126313 - DNA, 25 bp, Rattus norvegicus
agcagttctattctaacctcggacg

SEQ ID NO: 126314 - DNA, 25 bp, Rattus norvegicus
agcagttctattgtaacctcggacg

SEQ ID NO: 126315 - DNA, 25 bp, Rattus norvegicus
agcagttctcagctgatggaatgaa

SEQ ID NO: 126316 - DNA, 25 bp, Rattus norvegicus
agcagttctcaggtgatggaatgaa

SEQ ID NO: 126317 - DNA, 25 bp, Rattus norvegicus
agcagttctgatcacagagggacat

SEQ ID NO: 126318 - DNA, 25 bp, Rattus norvegicus
agcagttctgatgacagagggacat

SEQ ID NO: 126319 - DNA, 25 bp, Rattus norvegicus
agcagttcttcaacgggcaccctct

SEQ ID NO: 126320 - DNA, 25 bp, Rattus norvegicus
agcagttcttcacgctgtgtcagca

SEQ ID NO: 126321 - DNA, 25 bp, Rattus norvegicus
agcagttcttcacttgctaccgcgg

SEQ ID NO: 126322 - DNA, 25 bp, Rattus norvegicus
agcagttcttcaggctgtgtcagca

SEQ ID NO: 126323 - DNA, 25 bp, Rattus norvegicus
agcagttcttcagttgctaccgcgg

SEQ ID NO: 126324 - DNA, 25 bp, Rattus norvegicus
agcagttcttcatcgggcaccctct

SEQ ID NO: 126325 - DNA, 25 bp, Rattus norvegicus
agcagttcttgcacaggacattgta

SEQ ID NO: 126326 - DNA, 25 bp, Rattus norvegicus
agcagttcttgctcaggacattgta

SEQ ID NO: 126327 - DNA, 25 bp, Rattus norvegicus
agcagttgaacaatttgcccatcat

SEQ ID NO: 126328 - DNA, 25 bp, Rattus norvegicus
agcagttgaacattttgcccatcat

SEQ ID NO: 126329 - DNA, 25 bp, Rattus norvegicus
agcagttgctagcttacatcccaaa

SEQ ID NO: 126330 - DNA, 25 bp, Rattus norvegicus
agcagttgctaggttacatcccaaa

SEQ ID NO: 126331 - DNA, 25 bp, Rattus norvegicus
agcagttgctgtcacaatgccccgc

SEQ ID NO: 126332 - DNA, 25 bp, Rattus norvegicus
agcagttgctgtgacaatgccccgc

SEQ ID NO: 126333 - DNA, 25 bp, Rattus norvegicus
agcagttgctttccttgtcttattc

SEQ ID NO: 126334 - DNA, 25 bp, Rattus norvegicus
agcagttgctttgcttgtcttattc

SEQ ID NO: 126335 - DNA, 25 bp, Rattus norvegicus
agcagttggagccagttacctcaca

SEQ ID NO: 126336 - DNA, 25 bp, Rattus norvegicus
agcagttggagcgagttacctcaca

SEQ ID NO: 126337 - DNA, 25 bp, Rattus norvegicus
agcagttggatgatcttgcctctga

SEQ ID NO: 126338 - DNA, 25 bp, Rattus norvegicus
agcagttggatgttcttgcctctga

SEQ ID NO: 126339 - DNA, 25 bp, Rattus norvegicus
agcagttggctgagtctgtctggtt

SEQ ID NO: 126340 - DNA, 25 bp, Rattus norvegicus
agcagttggctgtgtctgtctggtt

SEQ ID NO: 126341 - DNA, 25 bp, Rattus norvegicus
agcagttgggcaaggccagctaagt

SEQ ID NO: 126342 - DNA, 25 bp, Rattus norvegicus
agcagttgggcatggccagctaagt

SEQ ID NO: 126343 - DNA, 25 bp, Rattus norvegicus
agcagttgtagacgtcttgcccact

SEQ ID NO: 126344 - DNA, 25 bp, Rattus norvegicus
agcagttgtagaggtcttgcccact

SEQ ID NO: 126345 - DNA, 25 bp, Rattus norvegicus
agcagttgtgcgctgagcttcagat

SEQ ID NO: 126346 - DNA, 25 bp, Rattus norvegicus
agcagttgtgcggtgagcttcagat

SEQ ID NO: 126347 - DNA, 25 bp, Rattus norvegicus
agcagttgttccatcatagacctaa

SEQ ID NO: 126348 - DNA, 25 bp, Rattus norvegicus
agcagttgttccttcatagacctaa

SEQ ID NO: 126349 - DNA, 25 bp, Rattus norvegicus
agcagtttaaagagcctaagggtga

SEQ ID NO: 126350 - DNA, 25 bp, Rattus norvegicus
agcagtttaaagtgcctaagggtga

SEQ ID NO: 126351 - DNA, 25 bp, Rattus norvegicus
agcagtttacctcatttgaccttag

SEQ ID NO: 126352 - DNA, 25 bp, Rattus norvegicus
agcagtttacctgatttgaccttag

SEQ ID NO: 126353 - DNA, 25 bp, Rattus norvegicus
agcagtttccagaaattcgaaaaca

SEQ ID NO: 126354 - DNA, 25 bp, Rattus norvegicus
agcagtttccagtaattcgaaaaca

SEQ ID NO: 126355 - DNA, 25 bp, Rattus norvegicus
agcagtttctggactgttgcaggat

SEQ ID NO: 126356 - DNA, 25 bp, Rattus norvegicus
agcagtttctggtctgttgcaggat

SEQ ID NO: 126357 - DNA, 25 bp, Rattus norvegicus
agcagtttctgtcattgggcacgag

SEQ ID NO: 126358 - DNA, 25 bp, Rattus norvegicus
agcagtttctgtgattgggcacgag

SEQ ID NO: 126359 - DNA, 25 bp, Rattus norvegicus
agcagtttgcacagtatgtcttttc

SEQ ID NO: 126360 - DNA, 25 bp, Rattus norvegicus
agcagtttgcactgtatgtcttttc

SEQ ID NO: 126361 - DNA, 25 bp, Rattus norvegicus
agcagtttgggccttcgtgagatac

SEQ ID NO: 126362 - DNA, 25 bp, Rattus norvegicus
agcagtttgggcgttcgtgagatac

SEQ ID NO: 126363 - DNA, 25 bp, Rattus norvegicus
agcagtttgtcacagagccgctcca

SEQ ID NO: 126364 - DNA, 25 bp, Rattus norvegicus
agcagtttgtcagagagccgctcca

SEQ ID NO: 126365 - DNA, 25 bp, Rattus norvegicus
agcagtttgtccaggttctctggta

SEQ ID NO: 126366 - DNA, 25 bp, Rattus norvegicus
agcagtttgtcctggttctctggta

SEQ ID NO: 126367 - DNA, 25 bp, Rattus norvegicus
agcagttttattatcctatggacac

SEQ ID NO: 126368 - DNA, 25 bp, Rattus norvegicus
agcagttttattttcctatggacac

SEQ ID NO: 126369 - DNA, 25 bp, Rattus norvegicus
agcagttttgaactcggtatgagtt

SEQ ID NO: 126370 - DNA, 25 bp, Rattus norvegicus
agcagttttgaagtcggtatgagtt

SEQ ID NO: 126371 - DNA, 25 bp, Rattus norvegicus
agcagttttggcattaccgtagcct

SEQ ID NO: 126372 - DNA, 25 bp, Rattus norvegicus
agcagttttggctttaccgtagcct

SEQ ID NO: 126373 - DNA, 25 bp, Rattus norvegicus
agcataaaacggagactcccctgta

SEQ ID NO: 126374 - DNA, 25 bp, Rattus norvegicus
agcataaaacggtgactcccctgta

SEQ ID NO: 126375 - DNA, 25 bp, Rattus norvegicus
agcataaacagaaccctggcctgat

SEQ ID NO: 126376 - DNA, 25 bp, Rattus norvegicus
agcataaacagatccctggcctgat

SEQ ID NO: 126377 - DNA, 25 bp, Rattus norvegicus
agcataaagcctaagctccctattc

SEQ ID NO: 126378 - DNA, 25 bp, Rattus norvegicus
agcataaagccttagctccctattc

SEQ ID NO: 126379 - DNA, 25 bp, Rattus norvegicus
agcataagagccctcaaaacaaaat

SEQ ID NO: 126380 - DNA, 25 bp, Rattus norvegicus
agcataagagccgtcaaaacaaaat

SEQ ID NO: 126381 - DNA, 25 bp, Rattus norvegicus
agcataaggctgacaatacacttcc

SEQ ID NO: 126382 - DNA, 25 bp, Rattus norvegicus
agcataaggctgtcaatacacttcc

SEQ ID NO: 126383 - DNA, 25 bp, Rattus norvegicus
agcataaggtctagggtctcccttt

SEQ ID NO: 126384 - DNA, 25 bp, Rattus norvegicus
agcataaggtcttgggtctcccttt

SEQ ID NO: 126385 - DNA, 25 bp, Rattus norvegicus
agcataatcactcggactgtagaac

SEQ ID NO: 126386 - DNA, 25 bp, Rattus norvegicus
agcataatcactgggactgtagaac

SEQ ID NO: 126387 - DNA, 25 bp, Rattus norvegicus
agcataatctaccaagcctatctct

SEQ ID NO: 126388 - DNA, 25 bp, Rattus norvegicus
agcataatctacgaagcctatctct

SEQ ID NO: 126389 - DNA, 25 bp, Rattus norvegicus
agcataattatcatggaccctcagc

SEQ ID NO: 126390 - DNA, 25 bp, Rattus norvegicus
agcataattatcttggaccctcagc

SEQ ID NO: 126391 - DNA, 25 bp, Rattus norvegicus
agcataattgccaactcgcttcttc

SEQ ID NO: 126392 - DNA, 25 bp, Rattus norvegicus
agcataattgcctactcgcttcttc

SEQ ID NO: 126393 - DNA, 25 bp, Rattus norvegicus
agcataattgtccacctcttaggtc

SEQ ID NO: 126394 - DNA, 25 bp, Rattus norvegicus
agcataattgtcgacctcttaggtc

SEQ ID NO: 126395 - DNA, 25 bp, Rattus norvegicus
agcataatttttctggacaaccttg

SEQ ID NO: 126396 - DNA, 25 bp, Rattus norvegicus
agcataatttttgtggacaaccttg

SEQ ID NO: 126397 - DNA, 25 bp, Rattus norvegicus
agcatacaccggctggacctaggcc

SEQ ID NO: 126398 - DNA, 25 bp, Rattus norvegicus
agcatacaccgggtggacctaggcc

SEQ ID NO: 126399 - DNA, 25 bp, Rattus norvegicus
agcatacactagcttcccagtaaga

SEQ ID NO: 126400 - DNA, 25 bp, Rattus norvegicus
agcatacactaggttcccagtaaga

SEQ ID NO: 126401 - DNA, 25 bp, Rattus norvegicus
agcatacatgctaccaacagtgagt

SEQ ID NO: 126402 - DNA, 25 bp, Rattus norvegicus
agcatacatgcttccaacagtgagt

SEQ ID NO: 126403 - DNA, 25 bp, Rattus norvegicus
agcataccatcaagcagctcggtga

SEQ ID NO: 126404 - DNA, 25 bp, Rattus norvegicus
agcataccatcatgcagctcggtga

SEQ ID NO: 126405 - DNA, 25 bp, Rattus norvegicus
agcataccattcctacatccaaatg

SEQ ID NO: 126406 - DNA, 25 bp, Rattus norvegicus
agcataccattcgtacatccaaatg

SEQ ID NO: 126407 - DNA, 25 bp, Rattus norvegicus
agcatacccgccagagaacctagtt

SEQ ID NO: 126408 - DNA, 25 bp, Rattus norvegicus
agcatacccgcctgagaacctagtt

SEQ ID NO: 126409 - DNA, 25 bp, Rattus norvegicus
agcatacctcagacacagaccttag

SEQ ID NO: 126410 - DNA, 25 bp, Rattus norvegicus
agcatacctcagtcacagaccttag

SEQ ID NO: 126411 - DNA, 25 bp, Rattus norvegicus
agcatacctcctcgagaatgaggat

SEQ ID NO: 126412 - DNA, 25 bp, Rattus norvegicus
agcatacctcctggagaatgaggat

SEQ ID NO: 126413 - DNA, 25 bp, Rattus norvegicus
agcatacgtgctcttctaccagaga

SEQ ID NO: 126414 - DNA, 25 bp, Rattus norvegicus
agcatacgtgctgttctaccagaga

SEQ ID NO: 126415 - DNA, 25 bp, Rattus norvegicus
agcatactcgtaaccagttcttcag

SEQ ID NO: 126416 - DNA, 25 bp, Rattus norvegicus
agcatactcgtatccagttcttcag

SEQ ID NO: 126417 - DNA, 25 bp, Rattus norvegicus
agcatactgttgattctaagaccgt

SEQ ID NO: 126418 - DNA, 25 bp, Rattus norvegicus
agcatactgttgtttctaagaccgt

SEQ ID NO: 126419 - DNA, 25 bp, Rattus norvegicus
agcatacttggaacttttctgtaga

SEQ ID NO: 126420 - DNA, 25 bp, Rattus norvegicus
agcatacttggatcttttctgtaga

SEQ ID NO: 126421 - DNA, 25 bp, Rattus norvegicus
agcatacttgttccattgtctctgc

SEQ ID NO: 126422 - DNA, 25 bp, Rattus norvegicus
agcatacttgttgcattgtctctgc

SEQ ID NO: 126423 - DNA, 25 bp, Rattus norvegicus
agcatagaaggacatggctttccat

SEQ ID NO: 126424 - DNA, 25 bp, Rattus norvegicus
agcatagaaggagatggctttccat

SEQ ID NO: 126425 - DNA, 25 bp, Rattus norvegicus
agcatagaccttagggtctccggcc

SEQ ID NO: 126426 - DNA, 25 bp, Rattus norvegicus
agcatagacctttgggtctccggcc

SEQ ID NO: 126427 - DNA, 25 bp, Rattus norvegicus
agcatagagcacatggacctccctt

SEQ ID NO: 126428 - DNA, 25 bp, Rattus norvegicus
agcatagagcacttggacctccctt

SEQ ID NO: 126429 - DNA, 25 bp, Rattus norvegicus
agcatagcaaggacagctcctaaaa

SEQ ID NO: 126430 - DNA, 25 bp, Rattus norvegicus
agcatagcaaggtcagctcctaaaa

SEQ ID NO: 126431 - DNA, 25 bp, Rattus norvegicus
agcatagccagcaccaagctctgga

SEQ ID NO: 126432 - DNA, 25 bp, Rattus norvegicus
agcatagccagctccaagctctgga

SEQ ID NO: 126433 - DNA, 25 bp, Rattus norvegicus
agcatagcgcttcgcttttgaaggc

SEQ ID NO: 126434 - DNA, 25 bp, Rattus norvegicus
agcatagcgcttggcttttgaaggc

SEQ ID NO: 126435 - DNA, 25 bp, Rattus norvegicus
agcatagctacaaaactacacgttt

SEQ ID NO: 126436 - DNA, 25 bp, Rattus norvegicus
agcatagctacataactacacgttt

SEQ ID NO: 126437 - DNA, 25 bp, Rattus norvegicus
agcatagcttttcctgtcatcctgg

SEQ ID NO: 126438 - DNA, 25 bp, Rattus norvegicus
agcatagcttttgctgtcatcctgg

SEQ ID NO: 126439 - DNA, 25 bp, Rattus norvegicus
agcatagtctccctcagatgggcaa

SEQ ID NO: 126440 - DNA, 25 bp, Rattus norvegicus
agcatagtctccgtcagatgggcaa

SEQ ID NO: 126441 - DNA, 25 bp, Rattus norvegicus
agcatagtgccaaccacatgtgtca

SEQ ID NO: 126442 - DNA, 25 bp, Rattus norvegicus
agcatagtgccatccacatgtgtca

SEQ ID NO: 126443 - DNA, 25 bp, Rattus norvegicus
agcatagttggcctcactctgctgg

SEQ ID NO: 126444 - DNA, 25 bp, Rattus norvegicus
agcatagttggcgtcactctgctgg

SEQ ID NO: 126445 - DNA, 25 bp, Rattus norvegicus
agcatagttggtactcactgtagcc

SEQ ID NO: 126446 - DNA, 25 bp, Rattus norvegicus
agcatagttggttctcactgtagcc

SEQ ID NO: 126447 - DNA, 25 bp, Rattus norvegicus
agcatataaaacctttcctgtgtat

SEQ ID NO: 126448 - DNA, 25 bp, Rattus norvegicus
agcatataaaacgtttcctgtgtat

SEQ ID NO: 126449 - DNA, 25 bp, Rattus norvegicus
agcatataacacagccattacatgg

SEQ ID NO: 126450 - DNA, 25 bp, Rattus norvegicus
agcatataacactgccattacatgg

SEQ ID NO: 126451 - DNA, 25 bp, Rattus norvegicus
agcatataactcacattgtgtgtac

SEQ ID NO: 126452 - DNA, 25 bp, Rattus norvegicus
agcatataactctcattgtgtgtac

SEQ ID NO: 126453 - DNA, 25 bp, Rattus norvegicus
agcatataccatcccatgtctgagg

SEQ ID NO: 126454 - DNA, 25 bp, Rattus norvegicus
agcatataccatgccatgtctgagg

SEQ ID NO: 126455 - DNA, 25 bp, Rattus norvegicus
agcatataccttcacacttgtcttt

SEQ ID NO: 126456 - DNA, 25 bp, Rattus norvegicus
agcatataccttgacacttgtcttt

SEQ ID NO: 126457 - DNA, 25 bp, Rattus norvegicus
agcatatagtctacaatttggctaa

SEQ ID NO: 126458 - DNA, 25 bp, Rattus norvegicus
agcatatagtcttcaatttggctaa

SEQ ID NO: 126459 - DNA, 25 bp, Rattus norvegicus
agcatatattacacccatacatggt

SEQ ID NO: 126460 - DNA, 25 bp, Rattus norvegicus
agcatatattactcccatacatggt

SEQ ID NO: 126461 - DNA, 25 bp, Rattus norvegicus
agcatatcacatcgtttgcaaccct

SEQ ID NO: 126462 - DNA, 25 bp, Rattus norvegicus
agcatatcacatggtttgcaaccct

SEQ ID NO: 126463 - DNA, 25 bp, Rattus norvegicus
agcatatccaccatggctctaatgt

SEQ ID NO: 126464 - DNA, 25 bp, Rattus norvegicus
agcatatccaccttggctctaatgt

SEQ ID NO: 126465 - DNA, 25 bp, Rattus norvegicus
agcatatccctgactgatttaatca

SEQ ID NO: 126466 - DNA, 25 bp, Rattus norvegicus
agcatatccctgtctgatttaatca

SEQ ID NO: 126467 - DNA, 25 bp, Rattus norvegicus
agcatatcccttagtttttctcaga

SEQ ID NO: 126468 - DNA, 25 bp, Rattus norvegicus
agcatatcccttcctgggccatgag

SEQ ID NO: 126469 - DNA, 25 bp, Rattus norvegicus
agcatatcccttgctgggccatgag

SEQ ID NO: 126470 - DNA, 25 bp, Rattus norvegicus
agcatatccctttgtttttctcaga

SEQ ID NO: 126471 - DNA, 25 bp, Rattus norvegicus
agcatatctctcatggtcatttaca

SEQ ID NO: 126472 - DNA, 25 bp, Rattus norvegicus
agcatatctctcttggtcatttaca

SEQ ID NO: 126473 - DNA, 25 bp, Rattus norvegicus
agcatatctgaaatccctaatgtaa

SEQ ID NO: 126474 - DNA, 25 bp, Rattus norvegicus
agcatatctgaattccctaatgtaa

SEQ ID NO: 126475 - DNA, 25 bp, Rattus norvegicus
agcatatctgccattattgtgtttg

SEQ ID NO: 126476 - DNA, 25 bp, Rattus norvegicus
agcatatctgcctttattgtgtttg

SEQ ID NO: 126477 - DNA, 25 bp, Rattus norvegicus
agcatatcttgcaaacttttcccat

SEQ ID NO: 126478 - DNA, 25 bp, Rattus norvegicus
agcatatcttgctaacttttcccat

SEQ ID NO: 126479 - DNA, 25 bp, Rattus norvegicus
agcatatgaggcatgggagtcccat

SEQ ID NO: 126480 - DNA, 25 bp, Rattus norvegicus
agcatatgaggcttgggagtcccat

SEQ ID NO: 126481 - DNA, 25 bp, Rattus norvegicus
agcatatgcatgaactgtgtcgtgt

SEQ ID NO: 126482 - DNA, 25 bp, Rattus norvegicus
agcatatgcatgtactgtgtcgtgt

SEQ ID NO: 126483 - DNA, 25 bp, Rattus norvegicus
agcatatgccttcacatgacatcat

SEQ ID NO: 126484 - DNA, 25 bp, Rattus norvegicus
agcatatgccttgacatgacatcat

SEQ ID NO: 126485 - DNA, 25 bp, Rattus norvegicus
agcatatgctggaaaatcgtttttc

SEQ ID NO: 126486 - DNA, 25 bp, Rattus norvegicus
agcatatgctggtaaatcgtttttc

SEQ ID NO: 126487 - DNA, 25 bp, Rattus norvegicus
agcatatttaggatcagctcacata

SEQ ID NO: 126488 - DNA, 25 bp, Rattus norvegicus
agcatatttaggttcagctcacata

SEQ ID NO: 126489 - DNA, 25 bp, Rattus norvegicus
agcatattttgcacagttctaaagc

SEQ ID NO: 126490 - DNA, 25 bp, Rattus norvegicus
agcatattttgctcagttctaaagc

SEQ ID NO: 126491 - DNA, 25 bp, Rattus norvegicus
agcatcaaaatcactcccttttttg

SEQ ID NO: 126492 - DNA, 25 bp, Rattus norvegicus
agcatcaaaatctctcccttttttg

SEQ ID NO: 126493 - DNA, 25 bp, Rattus norvegicus
agcatcaaagccattattccctttc

SEQ ID NO: 126494 - DNA, 25 bp, Rattus norvegicus
agcatcaaagcctttattccctttc

SEQ ID NO: 126495 - DNA, 25 bp, Rattus norvegicus
agcatcaacagcacgattcctggca

SEQ ID NO: 126496 - DNA, 25 bp, Rattus norvegicus
agcatcaacagctcgattcctggca

SEQ ID NO: 126497 - DNA, 25 bp, Rattus norvegicus
agcatcaagctgaaggccttaccct

SEQ ID NO: 126498 - DNA, 25 bp, Rattus norvegicus
agcatcaagctgtaggccttaccct

SEQ ID NO: 126499 - DNA, 25 bp, Rattus norvegicus
agcatcaatggtcttatccaggccc

SEQ ID NO: 126500 - DNA, 25 bp, Rattus norvegicus
agcatcaatggtgttatccaggccc

SEQ ID NO: 126501 - DNA, 25 bp, Rattus norvegicus
agcatcacagctatcatcttcacat

SEQ ID NO: 126502 - DNA, 25 bp, Rattus norvegicus
agcatcacagctttcatcttcacat

SEQ ID NO: 126503 - DNA, 25 bp, Rattus norvegicus
agcatcaccatactccagttggaat

SEQ ID NO: 126504 - DNA, 25 bp, Rattus norvegicus
agcatcaccatagtccagttggaat

SEQ ID NO: 126505 - DNA, 25 bp, Rattus norvegicus
agcatcaccgctagttttggacttt

SEQ ID NO: 126506 - DNA, 25 bp, Rattus norvegicus
agcatcaccgcttgttttggacttt

SEQ ID NO: 126507 - DNA, 25 bp, Rattus norvegicus
agcatcacctggacccatttgtggg

SEQ ID NO: 126508 - DNA, 25 bp, Rattus norvegicus
agcatcacctggtcccatttgtggg

SEQ ID NO: 126509 - DNA, 25 bp, Rattus norvegicus
agcatcacctgtagtagaggctcct

SEQ ID NO: 126510 - DNA, 25 bp, Rattus norvegicus
agcatcacctgttgtagaggctcct

SEQ ID NO: 126511 - DNA, 25 bp, Rattus norvegicus
agcatcactagtctgggctgtgtcc

SEQ ID NO: 126512 - DNA, 25 bp, Rattus norvegicus
agcatcactagtgtgggctgtgtcc

SEQ ID NO: 126513 - DNA, 25 bp, Rattus norvegicus
agcatcacttttcttgagctctaga

SEQ ID NO: 126514 - DNA, 25 bp, Rattus norvegicus
agcatcacttttgttgagctctaga

SEQ ID NO: 126515 - DNA, 25 bp, Rattus norvegicus
agcatcagaaggagccactagggcc

SEQ ID NO: 126516 - DNA, 25 bp, Rattus norvegicus
agcatcagaaggctctcagcacaaa

SEQ ID NO: 126517 - DNA, 25 bp, Rattus norvegicus
agcatcagaagggtctcagcacaaa

SEQ ID NO: 126518 - DNA, 25 bp, Rattus norvegicus
agcatcagaaggtgccactagggcc

SEQ ID NO: 126519 - DNA, 25 bp, Rattus norvegicus
agcatcagaggaacctggctcggag

SEQ ID NO: 126520 - DNA, 25 bp, Rattus norvegicus
agcatcagaggatcctggctcggag

SEQ ID NO: 126521 - DNA, 25 bp, Rattus norvegicus
agcatcagatccctcagagctggag

SEQ ID NO: 126522 - DNA, 25 bp, Rattus norvegicus
agcatcagatccgtcagagctggag

SEQ ID NO: 126523 - DNA, 25 bp, Rattus norvegicus
agcatcagcaccacagtcctatatt

SEQ ID NO: 126524 - DNA, 25 bp, Rattus norvegicus
agcatcagcacctcagtcctatatt

SEQ ID NO: 126525 - DNA, 25 bp, Rattus norvegicus
agcatcaggcagcattgcggcagca

SEQ ID NO: 126526 - DNA, 25 bp, Rattus norvegicus
agcatcaggcaggattgcggcagca

SEQ ID NO: 126527 - DNA, 25 bp, Rattus norvegicus
agcatcaggcatctactgtacccaa

SEQ ID NO: 126528 - DNA, 25 bp, Rattus norvegicus
agcatcaggcatgtactgtacccaa

SEQ ID NO: 126529 - DNA, 25 bp, Rattus norvegicus
agcatcaggcgaccctcgtccagat

SEQ ID NO: 126530 - DNA, 25 bp, Rattus norvegicus
agcatcaggcgagcctcgtccagat

SEQ ID NO: 126531 - DNA, 25 bp, Rattus norvegicus
agcatcagggacaactgtgtttcct

SEQ ID NO: 126532 - DNA, 25 bp, Rattus norvegicus
agcatcagggactactgtgtttcct

SEQ ID NO: 126533 - DNA, 25 bp, Rattus norvegicus
agcatcagggttcacccgggatgaa

SEQ ID NO: 126534 - DNA, 25 bp, Rattus norvegicus
agcatcagggttgacccgggatgaa

SEQ ID NO: 126535 - DNA, 25 bp, Rattus norvegicus
agcatcaggtgtccccgagctggaa

SEQ ID NO: 126536 - DNA, 25 bp, Rattus norvegicus
agcatcaggtgtgcccgagctggaa

SEQ ID NO: 126537 - DNA, 25 bp, Rattus norvegicus
agcatcagtaccagctgccttaaaa

SEQ ID NO: 126538 - DNA, 25 bp, Rattus norvegicus
agcatcagtacctgctgccttaaaa

SEQ ID NO: 126539 - DNA, 25 bp, Rattus norvegicus
agcatcagtctaagagctccactct

SEQ ID NO: 126540 - DNA, 25 bp, Rattus norvegicus
agcatcagtctatgagctccactct

SEQ ID NO: 126541 - DNA, 25 bp, Rattus norvegicus
agcatcagtgccagctcttgcctga

SEQ ID NO: 126542 - DNA, 25 bp, Rattus norvegicus
agcatcagtgcctgctcttgcctga

SEQ ID NO: 126543 - DNA, 25 bp, Rattus norvegicus
agcatcagtgctatacagggaaaat

SEQ ID NO: 126544 - DNA, 25 bp, Rattus norvegicus
agcatcagtgctttacagggaaaat

SEQ ID NO: 126545 - DNA, 25 bp, Rattus norvegicus
agcatcataagcacaaggttagcct

SEQ ID NO: 126546 - DNA, 25 bp, Rattus norvegicus
agcatcataagctcaaggttagcct

SEQ ID NO: 126547 - DNA, 25 bp, Rattus norvegicus
agcatcatcgaaagtctttccttct

SEQ ID NO: 126548 - DNA, 25 bp, Rattus norvegicus
agcatcatcgaatgtctttccttct

SEQ ID NO: 126549 - DNA, 25 bp, Rattus norvegicus
agcatcatctgtcctcaagtttact

SEQ ID NO: 126550 - DNA, 25 bp, Rattus norvegicus
agcatcatctgtgctcaagtttact

SEQ ID NO: 126551 - DNA, 25 bp, Rattus norvegicus
agcatcatctttcttgtctcagtat

SEQ ID NO: 126552 - DNA, 25 bp, Rattus norvegicus
agcatcatctttgttgtctcagtat

SEQ ID NO: 126553 - DNA, 25 bp, Rattus norvegicus
agcatcatgataactgtctcagttt

SEQ ID NO: 126554 - DNA, 25 bp, Rattus norvegicus
agcatcatgatatctgtctcagttt

SEQ ID NO: 126555 - DNA, 25 bp, Rattus norvegicus
agcatcatgcagaggcgggtcattt

SEQ ID NO: 126556 - DNA, 25 bp, Rattus norvegicus
agcatcatgcagtggcgggtcattt

SEQ ID NO: 126557 - DNA, 25 bp, Rattus norvegicus
agcatcatggccagcggttcgcagt

SEQ ID NO: 126558 - DNA, 25 bp, Rattus norvegicus
agcatcatggcctgcggttcgcagt

SEQ ID NO: 126559 - DNA, 25 bp, Rattus norvegicus
agcatcatggcgaaaggctgtttga

SEQ ID NO: 126560 - DNA, 25 bp, Rattus norvegicus
agcatcatggcgtaaggctgtttga

SEQ ID NO: 126561 - DNA, 25 bp, Rattus norvegicus
agcatcatgtctcctttgacggaca

SEQ ID NO: 126562 - DNA, 25 bp, Rattus norvegicus
agcatcatgtctgctttgacggaca

SEQ ID NO: 126563 - DNA, 25 bp, Rattus norvegicus
agcatccaaggaaccgactggtcga

SEQ ID NO: 126564 - DNA, 25 bp, Rattus norvegicus
agcatccaaggaactgactgggtca

SEQ ID NO: 126565 - DNA, 25 bp, Rattus norvegicus
agcatccaaggatccgactggtcga

SEQ ID NO: 126566 - DNA, 25 bp, Rattus norvegicus
agcatccaaggatctgactgggtca

SEQ ID NO: 126567 - DNA, 25 bp, Rattus norvegicus
agcatccaaggtccccatcatggta

SEQ ID NO: 126568 - DNA, 25 bp, Rattus norvegicus
agcatccaaggtgcccatcatggta

SEQ ID NO: 126569 - DNA, 25 bp, Rattus norvegicus
agcatccacgatctggtacgtctca

SEQ ID NO: 126570 - DNA, 25 bp, Rattus norvegicus
agcatccacgatgtggtacgtctca

SEQ ID NO: 126571 - DNA, 25 bp, Rattus norvegicus
agcatccagaaaattgttcctacag

SEQ ID NO: 126572 - DNA, 25 bp, Rattus norvegicus
agcatccagaaatttgttcctacag

SEQ ID NO: 126573 - DNA, 25 bp, Rattus norvegicus
agcatccagactatgcgggcacaga

SEQ ID NO: 126574 - DNA, 25 bp, Rattus norvegicus
agcatccagactttgcgggcacaga

SEQ ID NO: 126575 - DNA, 25 bp, Rattus norvegicus
agcatccaggatctccagcagcttg

SEQ ID NO: 126576 - DNA, 25 bp, Rattus norvegicus
agcatccaggatgtccagcagcttg

SEQ ID NO: 126577 - DNA, 25 bp, Rattus norvegicus
agcatccaggtaactaacttcagaa

SEQ ID NO: 126578 - DNA, 25 bp, Rattus norvegicus
agcatccaggtatctaacttcagaa

SEQ ID NO: 126579 - DNA, 25 bp, Rattus norvegicus
agcatccatctccacatgtactgac

SEQ ID NO: 126580 - DNA, 25 bp, Rattus norvegicus
agcatccatctcgacatgtactgac

SEQ ID NO: 126581 - DNA, 25 bp, Rattus norvegicus
agcatccatgtacactgcctcacaa

SEQ ID NO: 126582 - DNA, 25 bp, Rattus norvegicus
agcatccatgtagactgcctcacaa

SEQ ID NO: 126583 - DNA, 25 bp, Rattus norvegicus
agcatccattgtcccagtaatttct

SEQ ID NO: 126584 - DNA, 25 bp, Rattus norvegicus
agcatccattgtgccagtaatttct

SEQ ID NO: 126585 - DNA, 25 bp, Rattus norvegicus
agcatcccagcaagtccgtttatgt

SEQ ID NO: 126586 - DNA, 25 bp, Rattus norvegicus
agcatcccagcatgtccgtttatgt

SEQ ID NO: 126587 - DNA, 25 bp, Rattus norvegicus
agcatcccctccagacatatggagt

SEQ ID NO: 126588 - DNA, 25 bp, Rattus norvegicus
agcatcccctcctgacatatggagt

SEQ ID NO: 126589 - DNA, 25 bp, Rattus norvegicus
agcatcccctgacactacgtgatca

SEQ ID NO: 126590 - DNA, 25 bp, Rattus norvegicus
agcatcccctgagactacgtgatca

SEQ ID NO: 126591 - DNA, 25 bp, Rattus norvegicus
agcatcccggagcaccggtcccggc

SEQ ID NO: 126592 - DNA, 25 bp, Rattus norvegicus
agcatcccggaggaccggtcccggc

SEQ ID NO: 126593 - DNA, 25 bp, Rattus norvegicus
agcatcccggcccaaaatgaagagt

SEQ ID NO: 126594 - DNA, 25 bp, Rattus norvegicus
agcatcccggccgaaaatgaagagt

SEQ ID NO: 126595 - DNA, 25 bp, Rattus norvegicus
agcatccctgatcttttgaagaaca

SEQ ID NO: 126596 - DNA, 25 bp, Rattus norvegicus
agcatccctgatgttttgaagaaca

SEQ ID NO: 126597 - DNA, 25 bp, Rattus norvegicus
agcatcccttccaaactatgggctg

SEQ ID NO: 126598 - DNA, 25 bp, Rattus norvegicus
agcatcccttcctaactatgggctg

SEQ ID NO: 126599 - DNA, 25 bp, Rattus norvegicus
agcatcccttgtccctgtgtgagca

SEQ ID NO: 126600 - DNA, 25 bp, Rattus norvegicus
agcatcccttgtgcctgtgtgagca

SEQ ID NO: 126601 - DNA, 25 bp, Rattus norvegicus
agcatccgatcacgctgagctgaat

SEQ ID NO: 126602 - DNA, 25 bp, Rattus norvegicus
agcatccgatcaggctgagctgaat

SEQ ID NO: 126603 - DNA, 25 bp, Rattus norvegicus
agcatccgctggaactggctgtatc

SEQ ID NO: 126604 - DNA, 25 bp, Rattus norvegicus
agcatccgctggtactggctgtatc

SEQ ID NO: 126605 - DNA, 25 bp, Rattus norvegicus
agcatccgtgaccaacatacagttt

SEQ ID NO: 126606 - DNA, 25 bp, Rattus norvegicus
agcatccgtgacgaacatacagttt

SEQ ID NO: 126607 - DNA, 25 bp, Rattus norvegicus
agcatcctaaccacagcgcttagag

SEQ ID NO: 126608 - DNA, 25 bp, Rattus norvegicus
agcatcctaacctcagcgcttagag

SEQ ID NO: 126609 - DNA, 25 bp, Rattus norvegicus
agcatcctacgaaggaaagaaccca

SEQ ID NO: 126610 - DNA, 25 bp, Rattus norvegicus
agcatcctacgatggaaagaaccca

SEQ ID NO: 126611 - DNA, 25 bp, Rattus norvegicus
agcatcctagcgataacctctcata

SEQ ID NO: 126612 - DNA, 25 bp, Rattus norvegicus
agcatcctagcgttaacctctcata

SEQ ID NO: 126613 - DNA, 25 bp, Rattus norvegicus
agcatcctcatgcaccagcagtgga

SEQ ID NO: 126614 - DNA, 25 bp, Rattus norvegicus
agcatcctcatggaccagcagtgga

SEQ ID NO: 126615 - DNA, 25 bp, Rattus norvegicus
agcatcctcctgcttggaatggcac

SEQ ID NO: 126616 - DNA, 25 bp, Rattus norvegicus
agcatcctcctggttggaatggcac

SEQ ID NO: 126617 - DNA, 25 bp, Rattus norvegicus
agcatcctctgcagttgcagacggt

SEQ ID NO: 126618 - DNA, 25 bp, Rattus norvegicus
agcatcctctgctgttgcagacggt

SEQ ID NO: 126619 - DNA, 25 bp, Rattus norvegicus
agcatcctctgtagcagctgtgccc

SEQ ID NO: 126620 - DNA, 25 bp, Rattus norvegicus
agcatcctctgttgcagctgtgccc

SEQ ID NO: 126621 - DNA, 25 bp, Rattus norvegicus
agcatcctcttcagggtgctgagga

SEQ ID NO: 126622 - DNA, 25 bp, Rattus norvegicus
agcatcctcttctgggtgctgagga

SEQ ID NO: 126623 - DNA, 25 bp, Rattus norvegicus
agcatcctgactcgcgtgaactatg

SEQ ID NO: 126624 - DNA, 25 bp, Rattus norvegicus
agcatcctgactggcgtgaactatg

SEQ ID NO: 126625 - DNA, 25 bp, Rattus norvegicus
agcatcctgaggctggaaccctgta

SEQ ID NO: 126626 - DNA, 25 bp, Rattus norvegicus
agcatcctgagggtggaaccctgta

SEQ ID NO: 126627 - DNA, 25 bp, Rattus norvegicus
agcatcctgcagatcaatccagagg

SEQ ID NO: 126628 - DNA, 25 bp, Rattus norvegicus
agcatcctgcagttcaatccagagg

SEQ ID NO: 126629 - DNA, 25 bp, Rattus norvegicus
agcatcctgctaaggaagctacaga

SEQ ID NO: 126630 - DNA, 25 bp, Rattus norvegicus
agcatcctgctatggaagctacaga

SEQ ID NO: 126631 - DNA, 25 bp, Rattus norvegicus
agcatcctgctcactgattggtaac

SEQ ID NO: 126632 - DNA, 25 bp, Rattus norvegicus
agcatcctgctctctgattggtaac

SEQ ID NO: 126633 - DNA, 25 bp, Rattus norvegicus
agcatcctggaaaagtatggcggcc

SEQ ID NO: 126634 - DNA, 25 bp, Rattus norvegicus
agcatcctggaatagtatggcggcc

SEQ ID NO: 126635 - DNA, 25 bp, Rattus norvegicus
agcatcctgtgaattctcagccaaa

SEQ ID NO: 126636 - DNA, 25 bp, Rattus norvegicus
agcatcctgtgatttctcagccaaa

SEQ ID NO: 126637 - DNA, 25 bp, Rattus norvegicus
agcatccttaatcattatgagtgat

SEQ ID NO: 126638 - DNA, 25 bp, Rattus norvegicus
agcatccttaatgattatgagtgat

SEQ ID NO: 126639 - DNA, 25 bp, Rattus norvegicus
agcatccttctgatggtccaaggga

SEQ ID NO: 126640 - DNA, 25 bp, Rattus norvegicus
agcatccttctgttggtccaaggga

SEQ ID NO: 126641 - DNA, 25 bp, Rattus norvegicus
agcatccttgatatgtgtttcttat

SEQ ID NO: 126642 - DNA, 25 bp, Rattus norvegicus
agcatccttgatttgtgtttcttat

SEQ ID NO: 126643 - DNA, 25 bp, Rattus norvegicus
agcatccttgcgcagagcacggatt

SEQ ID NO: 126644 - DNA, 25 bp, Rattus norvegicus
agcatccttgcggagagcacggatt

SEQ ID NO: 126645 - DNA, 25 bp, Rattus norvegicus
agcatcctttaacttcccaggtaga

SEQ ID NO: 126646 - DNA, 25 bp, Rattus norvegicus
agcatcctttaagttcccaggtaga

SEQ ID NO: 126647 - DNA, 25 bp, Rattus norvegicus
agcatcctttttcagctacataggt

SEQ ID NO: 126648 - DNA, 25 bp, Rattus norvegicus
agcatcctttttgagctacataggt

SEQ ID NO: 126649 - DNA, 25 bp, Rattus norvegicus
agcatcgaaggccaaccttcgcact

SEQ ID NO: 126650 - DNA, 25 bp, Rattus norvegicus
agcatcgaaggcgaaccttcgcact

SEQ ID NO: 126651 - DNA, 25 bp, Rattus norvegicus
agcatcgagtaaatatcttgaccca

SEQ ID NO: 126652 - DNA, 25 bp, Rattus norvegicus
agcatcgagtaattatcttgaccca

SEQ ID NO: 126653 - DNA, 25 bp, Rattus norvegicus
agcatcgatctgaaattggcattca

SEQ ID NO: 126654 - DNA, 25 bp, Rattus norvegicus
agcatcgatctgtaattggcattca

SEQ ID NO: 126655 - DNA, 25 bp, Rattus norvegicus
agcatcgcattgaggtgtacacagt

SEQ ID NO: 126656 - DNA, 25 bp, Rattus norvegicus
agcatcgcattgtggtgtacacagt

SEQ ID NO: 126657 - DNA, 25 bp, Rattus norvegicus
agcatcgcgcatattgtccgttgac

SEQ ID NO: 126658 - DNA, 25 bp, Rattus norvegicus
agcatcgcgcattttgtccgttgac

SEQ ID NO: 126659 - DNA, 25 bp, Rattus norvegicus
agcatcgcgggacctttcatggtga

SEQ ID NO: 126660 - DNA, 25 bp, Rattus norvegicus
agcatcgcgggagctttcatggtga

SEQ ID NO: 126661 - DNA, 25 bp, Rattus norvegicus
agcatcggaatgagcaagccggaac

SEQ ID NO: 126662 - DNA, 25 bp, Rattus norvegicus
agcatcggaatgtgcaagccggaac

SEQ ID NO: 126663 - DNA, 25 bp, Rattus norvegicus
agcatcggctctcctggattttcat

SEQ ID NO: 126664 - DNA, 25 bp, Rattus norvegicus
agcatcggctctgctggattttcat

SEQ ID NO: 126665 - DNA, 25 bp, Rattus norvegicus
agcatcgggtgtactctgtgttgtc

SEQ ID NO: 126666 - DNA, 25 bp, Rattus norvegicus
agcatcgggtgttctctgtgttgtc

SEQ ID NO: 126667 - DNA, 25 bp, Rattus norvegicus
agcatcgtatttattcctcagaaga

SEQ ID NO: 126668 - DNA, 25 bp, Rattus norvegicus
agcatcgtattttttcctcagaaga

SEQ ID NO: 126669 - DNA, 25 bp, Rattus norvegicus
agcatcgtctacatgggaaggccac

SEQ ID NO: 126670 - DNA, 25 bp, Rattus norvegicus
agcatcgtctacttgggaaggccac

SEQ ID NO: 126671 - DNA, 25 bp, Rattus norvegicus
agcatcgttcagcagcagccgggac

SEQ ID NO: 126672 - DNA, 25 bp, Rattus norvegicus
agcatcgttcaggagcagccgggac

SEQ ID NO: 126673 - DNA, 25 bp, Rattus norvegicus
agcatcgttcttatgccagcagtga

SEQ ID NO: 126674 - DNA, 25 bp, Rattus norvegicus
agcatcgttcttttgccagcagtga

SEQ ID NO: 126675 - DNA, 25 bp, Rattus norvegicus
agcatctaatccctctctaacttgg

SEQ ID NO: 126676 - DNA, 25 bp, Rattus norvegicus
agcatctaatccgtctctaacttgg

SEQ ID NO: 126677 - DNA, 25 bp, Rattus norvegicus
agcatctaatggcaaatctttgggt

SEQ ID NO: 126678 - DNA, 25 bp, Rattus norvegicus
agcatctaatgggaaatctttgggt

SEQ ID NO: 126679 - DNA, 25 bp, Rattus norvegicus
agcatctacgtcaagttcctgagct

SEQ ID NO: 126680 - DNA, 25 bp, Rattus norvegicus
agcatctacgtctagttcctgagct

SEQ ID NO: 126681 - DNA, 25 bp, Rattus norvegicus
agcatctagcagaaacggtagccgt

SEQ ID NO: 126682 - DNA, 25 bp, Rattus norvegicus
agcatctagcagtaacggtagccgt

SEQ ID NO: 126683 - DNA, 25 bp, Rattus norvegicus
agcatctagggcaagtctgtgcagg

SEQ ID NO: 126684 - DNA, 25 bp, Rattus norvegicus
agcatctagggctagtctgtgcagg

SEQ ID NO: 126685 - DNA, 25 bp, Rattus norvegicus
agcatctagggtcacgggaactcaa

SEQ ID NO: 126686 - DNA, 25 bp, Rattus norvegicus
agcatctagggtgacgggaactcaa

SEQ ID NO: 126687 - DNA, 25 bp, Rattus norvegicus
agcatctatatcaactttgtgttta

SEQ ID NO: 126688 - DNA, 25 bp, Rattus norvegicus
agcatctatatctactttgtgttta

SEQ ID NO: 126689 - DNA, 25 bp, Rattus norvegicus
agcatctatctgcagatccccaagt

SEQ ID NO: 126690 - DNA, 25 bp, Rattus norvegicus
agcatctatctggagatccccaagt

SEQ ID NO: 126691 - DNA, 25 bp, Rattus norvegicus
agcatctcactcactgtgcttgctg

SEQ ID NO: 126692 - DNA, 25 bp, Rattus norvegicus
agcatctcactctctgtgcttgctg

SEQ ID NO: 126693 - DNA, 25 bp, Rattus norvegicus
agcatctcattgatttcctggtttc

SEQ ID NO: 126694 - DNA, 25 bp, Rattus norvegicus
agcatctcattgttttcctggtttc

SEQ ID NO: 126695 - DNA, 25 bp, Rattus norvegicus
agcatctccataccctactgttctt

SEQ ID NO: 126696 - DNA, 25 bp, Rattus norvegicus
agcatctccatagcctactgttctt

SEQ ID NO: 126697 - DNA, 25 bp, Rattus norvegicus
agcatctcccaaagacggcggtcaa

SEQ ID NO: 126698 - DNA, 25 bp, Rattus norvegicus
agcatctcccaatgacggcggtcaa

SEQ ID NO: 126699 - DNA, 25 bp, Rattus norvegicus
agcatctccctgagtagcttaagca

SEQ ID NO: 126700 - DNA, 25 bp, Rattus norvegicus
agcatctccctgtgtagcttaagca

SEQ ID NO: 126701 - DNA, 25 bp, Rattus norvegicus
agcatctcctacaaagttcggcaag

SEQ ID NO: 126702 - DNA, 25 bp, Rattus norvegicus
agcatctcctactaagttcggcaag

SEQ ID NO: 126703 - DNA, 25 bp, Rattus norvegicus
agcatctcgccacatcttgaaaaat

SEQ ID NO: 126704 - DNA, 25 bp, Rattus norvegicus
agcatctcgccagatcttgaaaaat

SEQ ID NO: 126705 - DNA, 25 bp, Rattus norvegicus
agcatctcgggcaggcgtcctgcgt

SEQ ID NO: 126706 - DNA, 25 bp, Rattus norvegicus
agcatctcgggctggcgtcctgcgt

SEQ ID NO: 126707 - DNA, 25 bp, Rattus norvegicus
agcatctctaccacaagggcaggaa

SEQ ID NO: 126708 - DNA, 25 bp, Rattus norvegicus
agcatctctacctcaagggcaggaa

SEQ ID NO: 126709 - DNA, 25 bp, Rattus norvegicus
agcatctctgatctcggctttggga

SEQ ID NO: 126710 - DNA, 25 bp, Rattus norvegicus
agcatctctgatgtcggctttggga

SEQ ID NO: 126711 - DNA, 25 bp, Rattus norvegicus
agcatctctgggaaacacagccggt

SEQ ID NO: 126712 - DNA, 25 bp, Rattus norvegicus
agcatctctgggtaacacagccggt

SEQ ID NO: 126713 - DNA, 25 bp, Rattus norvegicus
agcatctctgtgctcatctgcttca

SEQ ID NO: 126714 - DNA, 25 bp, Rattus norvegicus
agcatctctgtggtcatctgcttca

SEQ ID NO: 126715 - DNA, 25 bp, Rattus norvegicus
agcatctcttgcatctggtaccacg

SEQ ID NO: 126716 - DNA, 25 bp, Rattus norvegicus
agcatctcttgcttctggtaccacg

SEQ ID NO: 126717 - DNA, 25 bp, Rattus norvegicus
agcatctgagccctggaacgtgaac

SEQ ID NO: 126718 - DNA, 25 bp, Rattus norvegicus
agcatctgagccgtggaacgtgaac

SEQ ID NO: 126719 - DNA, 25 bp, Rattus norvegicus
agcatctgatctctaccttcataaa

SEQ ID NO: 126720 - DNA, 25 bp, Rattus norvegicus
agcatctgatctgtaccttcataaa

SEQ ID NO: 126721 - DNA, 25 bp, Rattus norvegicus
agcatctgcaatattctgagctatt

SEQ ID NO: 126722 - DNA, 25 bp, Rattus norvegicus
agcatctgcaattttctgagctatt

SEQ ID NO: 126723 - DNA, 25 bp, Rattus norvegicus
agcatctgcacaactttgaggccac

SEQ ID NO: 126724 - DNA, 25 bp, Rattus norvegicus
agcatctgcacatctttgaggccac

SEQ ID NO: 126725 - DNA, 25 bp, Rattus norvegicus
agcatctgcagtcaggttttgtccc

SEQ ID NO: 126726 - DNA, 25 bp, Rattus norvegicus
agcatctgcagtgaggttttgtccc

SEQ ID NO: 126727 - DNA, 25 bp, Rattus norvegicus
agcatctgctgcagaaagtcctggc

SEQ ID NO: 126728 - DNA, 25 bp, Rattus norvegicus
agcatctgctgctgaaagtcctggc

SEQ ID NO: 126729 - DNA, 25 bp, Rattus norvegicus
agcatctggagcatcctcaggaaat

SEQ ID NO: 126730 - DNA, 25 bp, Rattus norvegicus
agcatctggagcttcctcaggaaat

SEQ ID NO: 126731 - DNA, 25 bp, Rattus norvegicus
agcatctgggaacctgtttgacagc

SEQ ID NO: 126732 - DNA, 25 bp, Rattus norvegicus
agcatctgggaagctgtttgacagc

SEQ ID NO: 126733 - DNA, 25 bp, Rattus norvegicus
agcatctgtatgctggctcaaaata

SEQ ID NO: 126734 - DNA, 25 bp, Rattus norvegicus
agcatctgtatggtggctcaaaata

SEQ ID NO: 126735 - DNA, 25 bp, Rattus norvegicus
agcatctgtcacagtccaggctgat

SEQ ID NO: 126736 - DNA, 25 bp, Rattus norvegicus
agcatctgtcacatcacggtcacag

SEQ ID NO: 126737 - DNA, 25 bp, Rattus norvegicus
agcatctgtcactgtccaggctgat

SEQ ID NO: 126738 - DNA, 25 bp, Rattus norvegicus
agcatctgtcacttcacggtcacag

SEQ ID NO: 126739 - DNA, 25 bp, Rattus norvegicus
agcatctgtgaccagcattcaggct

SEQ ID NO: 126740 - DNA, 25 bp, Rattus norvegicus
agcatctgtgacgagcattcaggct

SEQ ID NO: 126741 - DNA, 25 bp, Rattus norvegicus
agcatctgttatctcggtgtgtcac

SEQ ID NO: 126742 - DNA, 25 bp, Rattus norvegicus
agcatctgttatgtcggtgtgtcac

SEQ ID NO: 126743 - DNA, 25 bp, Rattus norvegicus
agcatcttagcgatctagggacctt

SEQ ID NO: 126744 - DNA, 25 bp, Rattus norvegicus
agcatcttagcgttctagggacctt

SEQ ID NO: 126745 - DNA, 25 bp, Rattus norvegicus
agcatcttatgcaaactagccctgc

SEQ ID NO: 126746 - DNA, 25 bp, Rattus norvegicus
agcatcttatgctaactagccctgc

SEQ ID NO: 126747 - DNA, 25 bp, Rattus norvegicus
agcatcttattcatagtcttcaggg

SEQ ID NO: 126748 - DNA, 25 bp, Rattus norvegicus
agcatcttattcttagtcttcaggg

SEQ ID NO: 126749 - DNA, 25 bp, Rattus norvegicus
agcatcttcactccctattgtgttg

SEQ ID NO: 126750 - DNA, 25 bp, Rattus norvegicus
agcatcttcactgcctattgtgttg

SEQ ID NO: 126751 - DNA, 25 bp, Rattus norvegicus
agcatcttcccgcttccagtggtat

SEQ ID NO: 126752 - DNA, 25 bp, Rattus norvegicus
agcatcttcccggttccagtggtat

SEQ ID NO: 126753 - DNA, 25 bp, Rattus norvegicus
agcatcttccctatatgtgtctttg

SEQ ID NO: 126754 - DNA, 25 bp, Rattus norvegicus
agcatcttccctttatgtgtctttg

SEQ ID NO: 126755 - DNA, 25 bp, Rattus norvegicus
agcatcttcggactggccagccggt

SEQ ID NO: 126756 - DNA, 25 bp, Rattus norvegicus
agcatcttcggagtggccagccggt

SEQ ID NO: 126757 - DNA, 25 bp, Rattus norvegicus
agcatcttctatcgtatcactcaag

SEQ ID NO: 126758 - DNA, 25 bp, Rattus norvegicus
agcatcttctatggtatcactcaag

SEQ ID NO: 126759 - DNA, 25 bp, Rattus norvegicus
agcatcttctgcctttaaggagaac

SEQ ID NO: 126760 - DNA, 25 bp, Rattus norvegicus
agcatcttctgcgtttaaggagaac

SEQ ID NO: 126761 - DNA, 25 bp, Rattus norvegicus
agcatcttctgtatttctgcatgga

SEQ ID NO: 126762 - DNA, 25 bp, Rattus norvegicus
agcatcttctgtttttctgcatgga

SEQ ID NO: 126763 - DNA, 25 bp, Rattus norvegicus
agcatcttcttcagagaatcgcccg

SEQ ID NO: 126764 - DNA, 25 bp, Rattus norvegicus
agcatcttcttctgagaatcgcccg

SEQ ID NO: 126765 - DNA, 25 bp, Rattus norvegicus
agcatcttgagacgccctggctgga

SEQ ID NO: 126766 - DNA, 25 bp, Rattus norvegicus
agcatcttgagaggccctggctgga

SEQ ID NO: 126767 - DNA, 25 bp, Rattus norvegicus
agcatcttgcatactggagttctag

SEQ ID NO: 126768 - DNA, 25 bp, Rattus norvegicus
agcatcttgcattctggagttctag

SEQ ID NO: 126769 - DNA, 25 bp, Rattus norvegicus
agcatcttgctcctgtaccaggcat

SEQ ID NO: 126770 - DNA, 25 bp, Rattus norvegicus
agcatcttgctcgtgtaccaggcat

SEQ ID NO: 126771 - DNA, 25 bp, Rattus norvegicus
agcatcttgtggactttgactgcca

SEQ ID NO: 126772 - DNA, 25 bp, Rattus norvegicus
agcatcttgtggtctttgactgcca

SEQ ID NO: 126773 - DNA, 25 bp, Rattus norvegicus
agcatcttgttgaaggagcctcagc

SEQ ID NO: 126774 - DNA, 25 bp, Rattus norvegicus
agcatcttgttgtaggagcctcagc

SEQ ID NO: 126775 - DNA, 25 bp, Rattus norvegicus
agcatctttatcagtgagccatctc

SEQ ID NO: 126776 - DNA, 25 bp, Rattus norvegicus
agcatctttatctgtgagccatctc

SEQ ID NO: 126777 - DNA, 25 bp, Rattus norvegicus
agcatctttcaactgcccacaggtt

SEQ ID NO: 126778 - DNA, 25 bp, Rattus norvegicus
agcatctttcaagtgcccacaggtt

SEQ ID NO: 126779 - DNA, 25 bp, Rattus norvegicus
agcatctttcagctctttgtgtgtg

SEQ ID NO: 126780 - DNA, 25 bp, Rattus norvegicus
agcatctttcaggtctttgtgtgtg

SEQ ID NO: 126781 - DNA, 25 bp, Rattus norvegicus
agcatctttctgcagtgcctcgcat

SEQ ID NO: 126782 - DNA, 25 bp, Rattus norvegicus
agcatctttctggagtgcctcgcat

SEQ ID NO: 126783 - DNA, 25 bp, Rattus norvegicus
agcatctttgggatcggtgatttac

SEQ ID NO: 126784 - DNA, 25 bp, Rattus norvegicus
agcatctttgggttcggtgatttac

SEQ ID NO: 126785 - DNA, 25 bp, Rattus norvegicus
agcatcttttccctcaaatcttaag

SEQ ID NO: 126786 - DNA, 25 bp, Rattus norvegicus
agcatcttttccgtcaaatcttaag

SEQ ID NO: 126787 - DNA, 25 bp, Rattus norvegicus
agcatgaaaagcaacctcctgtggt

SEQ ID NO: 126788 - DNA, 25 bp, Rattus norvegicus
agcatgaaaagctacctcctgtggt

SEQ ID NO: 126789 - DNA, 25 bp, Rattus norvegicus
agcatgaaaatacccttcggcccat

SEQ ID NO: 126790 - DNA, 25 bp, Rattus norvegicus
agcatgaaaatagccttcggcccat

SEQ ID NO: 126791 - DNA, 25 bp, Rattus norvegicus
agcatgaacaccatgacacctgtgg

SEQ ID NO: 126792 - DNA, 25 bp, Rattus norvegicus
agcatgaacaccttgacacctgtgg

SEQ ID NO: 126793 - DNA, 25 bp, Rattus norvegicus
agcatgaacatcctgctccagcaca

SEQ ID NO: 126794 - DNA, 25 bp, Rattus norvegicus
agcatgaacatcgtgctccagcaca

SEQ ID NO: 126795 - DNA, 25 bp, Rattus norvegicus
agcatgaactgtaggcatcacctcc

SEQ ID NO: 126796 - DNA, 25 bp, Rattus norvegicus
agcatgaactgttggcatcacctcc

SEQ ID NO: 126797 - DNA, 25 bp, Rattus norvegicus
agcatgaaggctcgcatgtcctgcc

SEQ ID NO: 126798 - DNA, 25 bp, Rattus norvegicus
agcatgaaggctggcatgtcctgcc

SEQ ID NO: 126799 - DNA, 25 bp, Rattus norvegicus
agcatgaagtccactcgtgccagag

SEQ ID NO: 126800 - DNA, 25 bp, Rattus norvegicus
agcatgaagtcctctcgtgccagag

SEQ ID NO: 126801 - DNA, 25 bp, Rattus norvegicus
agcatgaagttcagagccatcctca

SEQ ID NO: 126802 - DNA, 25 bp, Rattus norvegicus
agcatgaagttctgagccatcctca

SEQ ID NO: 126803 - DNA, 25 bp, Rattus norvegicus
agcatgaatgctcacactgggaatg

SEQ ID NO: 126804 - DNA, 25 bp, Rattus norvegicus
agcatgaatgctctcgttctctttt

SEQ ID NO: 126805 - DNA, 25 bp, Rattus norvegicus
agcatgaatgctgacactgggaatg

SEQ ID NO: 126806 - DNA, 25 bp, Rattus norvegicus
agcatgaatgctgtcgttctctttt

SEQ ID NO: 126807 - DNA, 25 bp, Rattus norvegicus
agcatgacacatctttaatagcaac

SEQ ID NO: 126808 - DNA, 25 bp, Rattus norvegicus
agcatgacacatgtttaatagcaac

SEQ ID NO: 126809 - DNA, 25 bp, Rattus norvegicus
agcatgaccttgaaacggcctctgc

SEQ ID NO: 126810 - DNA, 25 bp, Rattus norvegicus
agcatgaccttgtaacggcctctgc

SEQ ID NO: 126811 - DNA, 25 bp, Rattus norvegicus
agcatgagaattcggcacacacaca

SEQ ID NO: 126812 - DNA, 25 bp, Rattus norvegicus
agcatgagaattgggcacacacaca

SEQ ID NO: 126813 - DNA, 25 bp, Rattus norvegicus
agcatgagagacaccgggatagaga

SEQ ID NO: 126814 - DNA, 25 bp, Rattus norvegicus
agcatgagagactccgggatagaga

SEQ ID NO: 126815 - DNA, 25 bp, Rattus norvegicus
agcatgagatggacccgagccgaat

SEQ ID NO: 126816 - DNA, 25 bp, Rattus norvegicus
agcatgagatggtcccgagccgaat

SEQ ID NO: 126817 - DNA, 25 bp, Rattus norvegicus
agcatgagccttctgagtcactctg

SEQ ID NO: 126818 - DNA, 25 bp, Rattus norvegicus
agcatgagccttgtgagtcactctg

SEQ ID NO: 126819 - DNA, 25 bp, Rattus norvegicus
agcatgagctcaaagtccctttatt

SEQ ID NO: 126820 - DNA, 25 bp, Rattus norvegicus
agcatgagctcatagtccctttatt

SEQ ID NO: 126821 - DNA, 25 bp, Rattus norvegicus
agcatgagctctagtattctattta

SEQ ID NO: 126822 - DNA, 25 bp, Rattus norvegicus
agcatgagctcttgtattctattta

SEQ ID NO: 126823 - DNA, 25 bp, Rattus norvegicus
agcatgaggcctattatatcttaaa

SEQ ID NO: 126824 - DNA, 25 bp, Rattus norvegicus
agcatgaggccttttatatcttaaa

SEQ ID NO: 126825 - DNA, 25 bp, Rattus norvegicus
agcatgaggtccctacgcgtccgaa

SEQ ID NO: 126826 - DNA, 25 bp, Rattus norvegicus
agcatgaggtccgtacgcgtccgaa

SEQ ID NO: 126827 - DNA, 25 bp, Rattus norvegicus
agcatgagtcggctctagcactgat

SEQ ID NO: 126828 - DNA, 25 bp, Rattus norvegicus
agcatgagtcgggtctagcactgat

SEQ ID NO: 126829 - DNA, 25 bp, Rattus norvegicus
agcatgatcttcactcctttggtgg

SEQ ID NO: 126830 - DNA, 25 bp, Rattus norvegicus
agcatgatcttctctcctttggtgg

SEQ ID NO: 126831 - DNA, 25 bp, Rattus norvegicus
agcatgatgctccttaaactctaga

SEQ ID NO: 126832 - DNA, 25 bp, Rattus norvegicus
agcatgatgctcgttaaactctaga

SEQ ID NO: 126833 - DNA, 25 bp, Rattus norvegicus
agcatgatgcttccaagagccctgc

SEQ ID NO: 126834 - DNA, 25 bp, Rattus norvegicus
agcatgatgcttcgcaccctcaagg

SEQ ID NO: 126835 - DNA, 25 bp, Rattus norvegicus
agcatgatgcttgcaagagccctgc

SEQ ID NO: 126836 - DNA, 25 bp, Rattus norvegicus
agcatgatgcttggcaccctcaagg

SEQ ID NO: 126837 - DNA, 25 bp, Rattus norvegicus
agcatgatgtgtaggtcctcgctta

SEQ ID NO: 126838 - DNA, 25 bp, Rattus norvegicus
agcatgatgtgttggtcctcgctta

SEQ ID NO: 126839 - DNA, 25 bp, Rattus norvegicus
agcatgattattagttcttcctccc

SEQ ID NO: 126840 - DNA, 25 bp, Rattus norvegicus
agcatgattatttgttcttcctccc

SEQ ID NO: 126841 - DNA, 25 bp, Rattus norvegicus
agcatgcaagaactcccaggttcca

SEQ ID NO: 126842 - DNA, 25 bp, Rattus norvegicus
agcatgcaagaagtcccaggttcca

SEQ ID NO: 126843 - DNA, 25 bp, Rattus norvegicus
agcatgcacccacgctgaaagctta

SEQ ID NO: 126844 - DNA, 25 bp, Rattus norvegicus
agcatgcacccaggctgaaagctta

SEQ ID NO: 126845 - DNA, 25 bp, Rattus norvegicus
agcatgcacctgaaccaatgacaaa

SEQ ID NO: 126846 - DNA, 25 bp, Rattus norvegicus
agcatgcacctgtaccaatgacaaa

SEQ ID NO: 126847 - DNA, 25 bp, Rattus norvegicus
agcatgcagcagaagcctgtagcta

SEQ ID NO: 126848 - DNA, 25 bp, Rattus norvegicus
agcatgcagcagtagcctgtagcta

SEQ ID NO: 126849 - DNA, 25 bp, Rattus norvegicus
agcatgcagccaccaagcttcagaa

SEQ ID NO: 126850 - DNA, 25 bp, Rattus norvegicus
agcatgcagccagcaagcttcagaa

SEQ ID NO: 126851 - DNA, 25 bp, Rattus norvegicus
agcatgcagctcaatgttccagtca

SEQ ID NO: 126852 - DNA, 25 bp, Rattus norvegicus
agcatgcagctctatgttccagtca

SEQ ID NO: 126853 - DNA, 25 bp, Rattus norvegicus
agcatgcaggacacagacacgtttg

SEQ ID NO: 126854 - DNA, 25 bp, Rattus norvegicus
agcatgcaggactcagacacgtttg

SEQ ID NO: 126855 - DNA, 25 bp, Rattus norvegicus
agcatgcatcaactcctcattcaga

SEQ ID NO: 126856 - DNA, 25 bp, Rattus norvegicus
agcatgcatcaagtcctcattcaga

SEQ ID NO: 126857 - DNA, 25 bp, Rattus norvegicus
agcatgccaaacctgggctccagaa

SEQ ID NO: 126858 - DNA, 25 bp, Rattus norvegicus
agcatgccaaacgtgggctccagaa

SEQ ID NO: 126859 - DNA, 25 bp, Rattus norvegicus
agcatgccaaagaccctgggctcaa

SEQ ID NO: 126860 - DNA, 25 bp, Rattus norvegicus
agcatgccaaagtccctgggctcaa

SEQ ID NO: 126861 - DNA, 25 bp, Rattus norvegicus
agcatgccaaccagcagactagctt

SEQ ID NO: 126862 - DNA, 25 bp, Rattus norvegicus
agcatgccaacctgcagactagctt

SEQ ID NO: 126863 - DNA, 25 bp, Rattus norvegicus
agcatgccagaacccttgggcagaa

SEQ ID NO: 126864 - DNA, 25 bp, Rattus norvegicus
agcatgccagaagccttgggcagaa

SEQ ID NO: 126865 - DNA, 25 bp, Rattus norvegicus
agcatgccagccacatggtggcaag

SEQ ID NO: 126866 - DNA, 25 bp, Rattus norvegicus
agcatgccagcctcatggtggcaag

SEQ ID NO: 126867 - DNA, 25 bp, Rattus norvegicus
agcatgcccaaaacctattaggtga

SEQ ID NO: 126868 - DNA, 25 bp, Rattus norvegicus
agcatgcccaaatcctattaggtga

SEQ ID NO: 126869 - DNA, 25 bp, Rattus norvegicus
agcatgccctacagtgaagtttttt

SEQ ID NO: 126870 - DNA, 25 bp, Rattus norvegicus
agcatgccctactgtgaagtttttt

SEQ ID NO: 126871 - DNA, 25 bp, Rattus norvegicus
agcatgccctgcctcttgtggcctt

SEQ ID NO: 126872 - DNA, 25 bp, Rattus norvegicus
agcatgccctgcgtcttgtggcctt

SEQ ID NO: 126873 - DNA, 25 bp, Rattus norvegicus
agcatgccgcacactttgcacgggc

SEQ ID NO: 126874 - DNA, 25 bp, Rattus norvegicus
agcatgccgcactctttgcacgggc

SEQ ID NO: 126875 - DNA, 25 bp, Rattus norvegicus
agcatgcctaaacgctgcctcattt

SEQ ID NO: 126876 - DNA, 25 bp, Rattus norvegicus
agcatgcctaaaggctgcctcattt

SEQ ID NO: 126877 - DNA, 25 bp, Rattus norvegicus
agcatgcctatgactggaatactta

SEQ ID NO: 126878 - DNA, 25 bp, Rattus norvegicus
agcatgcctatgtctggaatactta

SEQ ID NO: 126879 - DNA, 25 bp, Rattus norvegicus
agcatgcctggcagatgtcaatatt

SEQ ID NO: 126880 - DNA, 25 bp, Rattus norvegicus
agcatgcctggctgatgtcaatatt

SEQ ID NO: 126881 - DNA, 25 bp, Rattus norvegicus
agcatgcctgttccagctttggtaa

SEQ ID NO: 126882 - DNA, 25 bp, Rattus norvegicus
agcatgcctgttcgatctcagtgaa

SEQ ID NO: 126883 - DNA, 25 bp, Rattus norvegicus
agcatgcctgttgcagctttggtaa

SEQ ID NO: 126884 - DNA, 25 bp, Rattus norvegicus
agcatgcctgttggatctcagtgaa

SEQ ID NO: 126885 - DNA, 25 bp, Rattus norvegicus
agcatgcgacctctgtttgatttct

SEQ ID NO: 126886 - DNA, 25 bp, Rattus norvegicus
agcatgcgacctgtgtttgatttct

SEQ ID NO: 126887 - DNA, 25 bp, Rattus norvegicus
agcatgcgcagcaacaggctttcta

SEQ ID NO: 126888 - DNA, 25 bp, Rattus norvegicus
agcatgcgcagctacaggctttcta

SEQ ID NO: 126889 - DNA, 25 bp, Rattus norvegicus
agcatgcgctaaccacactcagtgg

SEQ ID NO: 126890 - DNA, 25 bp, Rattus norvegicus
agcatgcgctaagcacactcagtgg

SEQ ID NO: 126891 - DNA, 25 bp, Rattus norvegicus
agcatgcgctagatagatcctcgta

SEQ ID NO: 126892 - DNA, 25 bp, Rattus norvegicus
agcatgcgctagttagatcctcgta

SEQ ID NO: 126893 - DNA, 25 bp, Rattus norvegicus
agcatgcgctgcatgagggaacctg

SEQ ID NO: 126894 - DNA, 25 bp, Rattus norvegicus
agcatgcgctgcttgagggaacctg

SEQ ID NO: 126895 - DNA, 25 bp, Rattus norvegicus
agcatgcgggacaccctcattgaca

SEQ ID NO: 126896 - DNA, 25 bp, Rattus norvegicus
agcatgcgggactccctcattgaca

SEQ ID NO: 126897 - DNA, 25 bp, Rattus norvegicus
agcatgcgtgagaccctgggctcaa

SEQ ID NO: 126898 - DNA, 25 bp, Rattus norvegicus
agcatgcgtgagtccctgggctcaa

SEQ ID NO: 126899 - DNA, 25 bp, Rattus norvegicus
agcatgcgttttccacagcgagtag

SEQ ID NO: 126900 - DNA, 25 bp, Rattus norvegicus
agcatgcgttttgcacagcgagtag

SEQ ID NO: 126901 - DNA, 25 bp, Rattus norvegicus
agcatgctaatcaggtgtctttata

SEQ ID NO: 126902 - DNA, 25 bp, Rattus norvegicus
agcatgctaatctggtgtctttata

SEQ ID NO: 126903 - DNA, 25 bp, Rattus norvegicus
agcatgctaattcgactttaacgcc

SEQ ID NO: 126904 - DNA, 25 bp, Rattus norvegicus
agcatgctaattggactttaacgcc

SEQ ID NO: 126905 - DNA, 25 bp, Rattus norvegicus
agcatgctagtcagaggtcctgatt

SEQ ID NO: 126906 - DNA, 25 bp, Rattus norvegicus
agcatgctagtctgaggtcctgatt

SEQ ID NO: 126907 - DNA, 25 bp, Rattus norvegicus
agcatgctccagatgttctgcacag

SEQ ID NO: 126908 - DNA, 25 bp, Rattus norvegicus
agcatgctccagttgttctgcacag

SEQ ID NO: 126909 - DNA, 25 bp, Rattus norvegicus
agcatgctccatccacctggaagat

SEQ ID NO: 126910 - DNA, 25 bp, Rattus norvegicus
agcatgctccatgcacctggaagat

SEQ ID NO: 126911 - DNA, 25 bp, Rattus norvegicus
agcatgctccctattggctgtgact

SEQ ID NO: 126912 - DNA, 25 bp, Rattus norvegicus
agcatgctcccttttggctgtgact

SEQ ID NO: 126913 - DNA, 25 bp, Rattus norvegicus
agcatgctcctgaggcttatgggat

SEQ ID NO: 126914 - DNA, 25 bp, Rattus norvegicus
agcatgctcctgcattggtcatcag

SEQ ID NO: 126915 - DNA, 25 bp, Rattus norvegicus
agcatgctcctggattggtcatcag

SEQ ID NO: 126916 - DNA, 25 bp, Rattus norvegicus
agcatgctcctgtggcttatgggat

SEQ ID NO: 126917 - DNA, 25 bp, Rattus norvegicus
agcatgctgcagatagcttatctgt

SEQ ID NO: 126918 - DNA, 25 bp, Rattus norvegicus
agcatgctgcagttagcttatctgt

SEQ ID NO: 126919 - DNA, 25 bp, Rattus norvegicus
agcatgctgctaccaatgcatctca

SEQ ID NO: 126920 - DNA, 25 bp, Rattus norvegicus
agcatgctgctagcaatgcatctca

SEQ ID NO: 126921 - DNA, 25 bp, Rattus norvegicus
agcatgctgctgaagcttctcgaaa

SEQ ID NO: 126922 - DNA, 25 bp, Rattus norvegicus
agcatgctgctgtagcttctcgaaa

SEQ ID NO: 126923 - DNA, 25 bp, Rattus norvegicus
agcatgctggctagaacattctggg

SEQ ID NO: 126924 - DNA, 25 bp, Rattus norvegicus
agcatgctggcttgaacattctggg

SEQ ID NO: 126925 - DNA, 25 bp, Rattus norvegicus
agcatgctggtgaaggcctgccctg

SEQ ID NO: 126926 - DNA, 25 bp, Rattus norvegicus
agcatgctggtgtaggcctgccctg

SEQ ID NO: 126927 - DNA, 25 bp, Rattus norvegicus
agcatgctgtctactggcaaacgga

SEQ ID NO: 126928 - DNA, 25 bp, Rattus norvegicus
agcatgctgtcttctggcaaacgga

SEQ ID NO: 126929 - DNA, 25 bp, Rattus norvegicus
agcatgcttctgagtctagatcaaa

SEQ ID NO: 126930 - DNA, 25 bp, Rattus norvegicus
agcatgcttctgtgtctagatcaaa

SEQ ID NO: 126931 - DNA, 25 bp, Rattus norvegicus
agcatgcttgcaaagttgccaattc

SEQ ID NO: 126932 - DNA, 25 bp, Rattus norvegicus
agcatgcttgcatagttgccaattc

SEQ ID NO: 126933 - DNA, 25 bp, Rattus norvegicus
agcatgcttgtgattgttcagcccc

SEQ ID NO: 126934 - DNA, 25 bp, Rattus norvegicus
agcatgcttgtgtttgttcagcccc

SEQ ID NO: 126935 - DNA, 25 bp, Rattus norvegicus
agcatgctttgtatatactcttttc

SEQ ID NO: 126936 - DNA, 25 bp, Rattus norvegicus
agcatgctttgtttatactcttttc

SEQ ID NO: 126937 - DNA, 25 bp, Rattus norvegicus
agcatggaaaagacaccccttcgag

SEQ ID NO: 126938 - DNA, 25 bp, Rattus norvegicus
agcatggaaaagtcaccccttcgag

SEQ ID NO: 126939 - DNA, 25 bp, Rattus norvegicus
agcatggaatgccacacctgttggt

SEQ ID NO: 126940 - DNA, 25 bp, Rattus norvegicus
agcatggaatgcgacacctgttggt

SEQ ID NO: 126941 - DNA, 25 bp, Rattus norvegicus
agcatggaatgtctctttttatatt

SEQ ID NO: 126942 - DNA, 25 bp, Rattus norvegicus
agcatggaatgtgtctttttatatt

SEQ ID NO: 126943 - DNA, 25 bp, Rattus norvegicus
agcatggacgctattagcttggaaa

SEQ ID NO: 126944 - DNA, 25 bp, Rattus norvegicus
agcatggacgctcttttagggctca

SEQ ID NO: 126945 - DNA, 25 bp, Rattus norvegicus
agcatggacgctgttttagggctca

SEQ ID NO: 126946 - DNA, 25 bp, Rattus norvegicus
agcatggacgcttttagcttggaaa

SEQ ID NO: 126947 - DNA, 25 bp, Rattus norvegicus
agcatggagaccctggacagccccg

SEQ ID NO: 126948 - DNA, 25 bp, Rattus norvegicus
agcatggagaccgtggacagccccg

SEQ ID NO: 126949 - DNA, 25 bp, Rattus norvegicus
agcatggagcccaccgtgactgagg

SEQ ID NO: 126950 - DNA, 25 bp, Rattus norvegicus
agcatggagcccacgcgtgtggtgg

SEQ ID NO: 126951 - DNA, 25 bp, Rattus norvegicus
agcatggagccctccgtgactgagg

SEQ ID NO: 126952 - DNA, 25 bp, Rattus norvegicus
agcatggagccctcgcgtgtggtgg

SEQ ID NO: 126953 - DNA, 25 bp, Rattus norvegicus
agcatggagctgactgtgccacttc

SEQ ID NO: 126954 - DNA, 25 bp, Rattus norvegicus
agcatggagctgtctgtgccacttc

SEQ ID NO: 126955 - DNA, 25 bp, Rattus norvegicus
agcatggaggtgaccccgagaccct

SEQ ID NO: 126956 - DNA, 25 bp, Rattus norvegicus
agcatggaggtgtccccgagaccct

SEQ ID NO: 126957 - DNA, 25 bp, Rattus norvegicus
agcatggagtttcactctgcagccg

SEQ ID NO: 126958 - DNA, 25 bp, Rattus norvegicus
agcatggagtttgactctgcagccg

SEQ ID NO: 126959 - DNA, 25 bp, Rattus norvegicus
agcatggataacctgcccctgagca

SEQ ID NO: 126960 - DNA, 25 bp, Rattus norvegicus
agcatggataacgtgcccctgagca

SEQ ID NO: 126961 - DNA, 25 bp, Rattus norvegicus
agcatggatttgagtttcctcctcg

SEQ ID NO: 126962 - DNA, 25 bp, Rattus norvegicus
agcatggatttgtgtttcctcctcg

SEQ ID NO: 126963 - DNA, 25 bp, Rattus norvegicus
agcatggcacaccatgcttgtgcat

SEQ ID NO: 126964 - DNA, 25 bp, Rattus norvegicus
agcatggcacacgatgcttgtgcat

SEQ ID NO: 126965 - DNA, 25 bp, Rattus norvegicus
agcatggcccacagagaggagcttc

SEQ ID NO: 126966 - DNA, 25 bp, Rattus norvegicus
agcatggcccactgagaggagcttc

SEQ ID NO: 126967 - DNA, 25 bp, Rattus norvegicus
agcatggccccacgaatggttggtc

SEQ ID NO: 126968 - DNA, 25 bp, Rattus norvegicus
agcatggccccaggaatggttggtc

SEQ ID NO: 126969 - DNA, 25 bp, Rattus norvegicus
agcatggctactaatacaagattga

SEQ ID NO: 126970 - DNA, 25 bp, Rattus norvegicus
agcatggctacttatacaagattga

SEQ ID NO: 126971 - DNA, 25 bp, Rattus norvegicus
agcatggctcacagagtggcccaga

SEQ ID NO: 126972 - DNA, 25 bp, Rattus norvegicus
agcatggctcactgagtggcccaga

SEQ ID NO: 126973 - DNA, 25 bp, Rattus norvegicus
agcatggctgacctcttgagagacc

SEQ ID NO: 126974 - DNA, 25 bp, Rattus norvegicus
agcatggctgacgtcttgagagacc

SEQ ID NO: 126975 - DNA, 25 bp, Rattus norvegicus
agcatgggatttccccttcatttgc

SEQ ID NO: 126976 - DNA, 25 bp, Rattus norvegicus
agcatgggatttgcccttcatttgc

SEQ ID NO: 126977 - DNA, 25 bp, Rattus norvegicus
agcatgggcaccagatttcctgtgg

SEQ ID NO: 126978 - DNA, 25 bp, Rattus norvegicus
agcatgggcacctgatttcctgtgg

SEQ ID NO: 126979 - DNA, 25 bp, Rattus norvegicus
agcatgggcatcaaagcttcctttg

SEQ ID NO: 126980 - DNA, 25 bp, Rattus norvegicus
agcatgggcatctaagcttcctttg

SEQ ID NO: 126981 - DNA, 25 bp, Rattus norvegicus
agcatgggtgcacagttctccaaga

SEQ ID NO: 126982 - DNA, 25 bp, Rattus norvegicus
agcatgggtgcacctgtcccagaag

SEQ ID NO: 126983 - DNA, 25 bp, Rattus norvegicus
agcatgggtgcagagttctccaaga

SEQ ID NO: 126984 - DNA, 25 bp, Rattus norvegicus
agcatgggtgcagctgtcccagaag

SEQ ID NO: 126985 - DNA, 25 bp, Rattus norvegicus
agcatgggtgccatcaacgatccgt

SEQ ID NO: 126986 - DNA, 25 bp, Rattus norvegicus
agcatgggtgccttcaacgatccgt

SEQ ID NO: 126987 - DNA, 25 bp, Rattus norvegicus
agcatggtagccagccctttaatcc

SEQ ID NO: 126988 - DNA, 25 bp, Rattus norvegicus
agcatggtagcctgccctttaatcc

SEQ ID NO: 126989 - DNA, 25 bp, Rattus norvegicus
agcatggtcacaccgtctgactcct

SEQ ID NO: 126990 - DNA, 25 bp, Rattus norvegicus
agcatggtcacagcgtctgactcct

SEQ ID NO: 126991 - DNA, 25 bp, Rattus norvegicus
agcatggtcaccatgtactgtaaca

SEQ ID NO: 126992 - DNA, 25 bp, Rattus norvegicus
agcatggtcaccttgtactgtaaca

SEQ ID NO: 126993 - DNA, 25 bp, Rattus norvegicus
agcatggtccagagccaggaggcac

SEQ ID NO: 126994 - DNA, 25 bp, Rattus norvegicus
agcatggtccagtgccaggaggcac

SEQ ID NO: 126995 - DNA, 25 bp, Rattus norvegicus
agcatggtccccagtgaggccaaga

SEQ ID NO: 126996 - DNA, 25 bp, Rattus norvegicus
agcatggtcccctgtgaggccaaga

SEQ ID NO: 126997 - DNA, 25 bp, Rattus norvegicus
agcatggtctacactgtggaattta

SEQ ID NO: 126998 - DNA, 25 bp, Rattus norvegicus
agcatggtctactctgtggaattta

SEQ ID NO: 126999 - DNA, 25 bp, Rattus norvegicus
agcatggtgactcctggtaaagcca

SEQ ID NO: 127000 - DNA, 25 bp, Rattus norvegicus
agcatggtgactgctggtaaagcca

SEQ ID NO: 127001 - DNA, 25 bp, Rattus norvegicus
agcatggtgtctccaacgaacctat

SEQ ID NO: 127002 - DNA, 25 bp, Rattus norvegicus
agcatggtgtctgcaacgaacctat

SEQ ID NO: 127003 - DNA, 25 bp, Rattus norvegicus
agcatgtaacatcccaacccagagg

SEQ ID NO: 127004 - DNA, 25 bp, Rattus norvegicus
agcatgtaacatgccaacccagagg

SEQ ID NO: 127005 - DNA, 25 bp, Rattus norvegicus
agcatgtaatgcctttcagccctca

SEQ ID NO: 127006 - DNA, 25 bp, Rattus norvegicus
agcatgtaatgcgtttcagccctca

SEQ ID NO: 127007 - DNA, 25 bp, Rattus norvegicus
agcatgtacatgaccacattcttcc

SEQ ID NO: 127008 - DNA, 25 bp, Rattus norvegicus
agcatgtacatgtccacattcttcc

SEQ ID NO: 127009 - DNA, 25 bp, Rattus norvegicus
agcatgtacttgaggctctggcaag

SEQ ID NO: 127010 - DNA, 25 bp, Rattus norvegicus
agcatgtacttgtggctctggcaag

SEQ ID NO: 127011 - DNA, 25 bp, Rattus norvegicus
agcatgtagagacccggaacaggta

SEQ ID NO: 127012 - DNA, 25 bp, Rattus norvegicus
agcatgtagagagccggaacaggta

SEQ ID NO: 127013 - DNA, 25 bp, Rattus norvegicus
agcatgtcactaccgtcgctcatca

SEQ ID NO: 127014 - DNA, 25 bp, Rattus norvegicus
agcatgtcactagcgtcgctcatca

SEQ ID NO: 127015 - DNA, 25 bp, Rattus norvegicus
agcatgtcacttagcctcggaagac

SEQ ID NO: 127016 - DNA, 25 bp, Rattus norvegicus
agcatgtcactttgcctcggaagac

SEQ ID NO: 127017 - DNA, 25 bp, Rattus norvegicus
agcatgtctcaccacaatcctgttg

SEQ ID NO: 127018 - DNA, 25 bp, Rattus norvegicus
agcatgtctcacgacaatcctgttg

SEQ ID NO: 127019 - DNA, 25 bp, Rattus norvegicus
agcatgtctggaccgtgagcgacca

SEQ ID NO: 127020 - DNA, 25 bp, Rattus norvegicus
agcatgtctggagcgtgagcgacca

SEQ ID NO: 127021 - DNA, 25 bp, Rattus norvegicus
agcatgtcttggcaccggacagcca

SEQ ID NO: 127022 - DNA, 25 bp, Rattus norvegicus
agcatgtcttgggaccggacagcca

SEQ ID NO: 127023 - DNA, 25 bp, Rattus norvegicus
agcatgtgactcagccagtgtggcg

SEQ ID NO: 127024 - DNA, 25 bp, Rattus norvegicus
agcatgtgactctgccagtgtggcg

SEQ ID NO: 127025 - DNA, 25 bp, Rattus norvegicus
agcatgtgccaccaggatcagttta

SEQ ID NO: 127026 - DNA, 25 bp, Rattus norvegicus
agcatgtgccacgaggatcagttta

SEQ ID NO: 127027 - DNA, 25 bp, Rattus norvegicus
agcatgtgctgcaacgagcgctcct

SEQ ID NO: 127028 - DNA, 25 bp, Rattus norvegicus
agcatgtgctgctacgagcgctcct

SEQ ID NO: 127029 - DNA, 25 bp, Rattus norvegicus
agcatgtgctggagtacgagcccca

SEQ ID NO: 127030 - DNA, 25 bp, Rattus norvegicus
agcatgtgctggtgtacgagcccca

SEQ ID NO: 127031 - DNA, 25 bp, Rattus norvegicus
agcatgtggactacagcctgcgctg

SEQ ID NO: 127032 - DNA, 25 bp, Rattus norvegicus
agcatgtggactacctcagcctgaa

SEQ ID NO: 127033 - DNA, 25 bp, Rattus norvegicus
agcatgtggacttcagcctgcgctg

SEQ ID NO: 127034 - DNA, 25 bp, Rattus norvegicus
agcatgtggacttcctcagcctgaa

SEQ ID NO: 127035 - DNA, 25 bp, Rattus norvegicus
agcatgtgggaaccctgcacttctc

SEQ ID NO: 127036 - DNA, 25 bp, Rattus norvegicus
agcatgtgggaagcctgcacttctc

SEQ ID NO: 127037 - DNA, 25 bp, Rattus norvegicus
agcatgtgggagagccctgctgttc

SEQ ID NO: 127038 - DNA, 25 bp, Rattus norvegicus
agcatgtgggagtgccctgctgttc

SEQ ID NO: 127039 - DNA, 25 bp, Rattus norvegicus
agcatgtgtcatattcttcgtggtc

SEQ ID NO: 127040 - DNA, 25 bp, Rattus norvegicus
agcatgtgtcattttcttcgtggtc

SEQ ID NO: 127041 - DNA, 25 bp, Rattus norvegicus
agcatgtgtctcagttagtgaacca

SEQ ID NO: 127042 - DNA, 25 bp, Rattus norvegicus
agcatgtgtctctgttagtgaacca

SEQ ID NO: 127043 - DNA, 25 bp, Rattus norvegicus
agcatgtgtttgacgctgactgcac

SEQ ID NO: 127044 - DNA, 25 bp, Rattus norvegicus
agcatgtgtttgtcgctgactgcac

SEQ ID NO: 127045 - DNA, 25 bp, Rattus norvegicus
agcatgttacgtaacgttcttccca

SEQ ID NO: 127046 - DNA, 25 bp, Rattus norvegicus
agcatgttacgttacgttcttccca

SEQ ID NO: 127047 - DNA, 25 bp, Rattus norvegicus
agcatgttagagctgggcacttcag

SEQ ID NO: 127048 - DNA, 25 bp, Rattus norvegicus
agcatgttagaggtgggcacttcag

SEQ ID NO: 127049 - DNA, 25 bp, Rattus norvegicus
agcatgttcccgagtcatcagaact

SEQ ID NO: 127050 - DNA, 25 bp, Rattus norvegicus
agcatgttcccgtgtcatcagaact

SEQ ID NO: 127051 - DNA, 25 bp, Rattus norvegicus
agcatgttccctcctagcttaggaa

SEQ ID NO: 127052 - DNA, 25 bp, Rattus norvegicus
agcatgttccctgctagcttaggaa

SEQ ID NO: 127053 - DNA, 25 bp, Rattus norvegicus
agcatgttgtacacgctgaggtcgg

SEQ ID NO: 127054 - DNA, 25 bp, Rattus norvegicus
agcatgttgtactcgctgaggtcgg

SEQ ID NO: 127055 - DNA, 25 bp, Rattus norvegicus
agcatgttgtggatggcgccgcgca

SEQ ID NO: 127056 - DNA, 25 bp, Rattus norvegicus
agcatgttgtggttggcgccgcgca

SEQ ID NO: 127057 - DNA, 25 bp, Rattus norvegicus
agcatgtttggactgctggaccagt

SEQ ID NO: 127058 - DNA, 25 bp, Rattus norvegicus
agcatgtttggagtgctggaccagt

SEQ ID NO: 127059 - DNA, 25 bp, Rattus norvegicus
agcatgttttgtccgattcccagag

SEQ ID NO: 127060 - DNA, 25 bp, Rattus norvegicus
agcatgttttgtgcgattcccagag

SEQ ID NO: 127061 - DNA, 25 bp, Rattus norvegicus
agcattaaacttctcgccttgatca

SEQ ID NO: 127062 - DNA, 25 bp, Rattus norvegicus
agcattaaacttgtcgccttgatca

SEQ ID NO: 127063 - DNA, 25 bp, Rattus norvegicus
agcattaactcaatcatcccaggtg

SEQ ID NO: 127064 - DNA, 25 bp, Rattus norvegicus
agcattaactcattcatcccaggtg

SEQ ID NO: 127065 - DNA, 25 bp, Rattus norvegicus
agcattaactgcagactagtaagtc

SEQ ID NO: 127066 - DNA, 25 bp, Rattus norvegicus
agcattaactgctgactagtaagtc

SEQ ID NO: 127067 - DNA, 25 bp, Rattus norvegicus
agcattaccctgagcgccatggagg

SEQ ID NO: 127068 - DNA, 25 bp, Rattus norvegicus
agcattaccctgtgcgccatggagg

SEQ ID NO: 127069 - DNA, 25 bp, Rattus norvegicus
agcattacctcaccctattacagaa

SEQ ID NO: 127070 - DNA, 25 bp, Rattus norvegicus
agcattacctcagcctattacagaa

SEQ ID NO: 127071 - DNA, 25 bp, Rattus norvegicus
agcattacggtgagaagccttcagc

SEQ ID NO: 127072 - DNA, 25 bp, Rattus norvegicus
agcattacggtgtgaagccttcagc

SEQ ID NO: 127073 - DNA, 25 bp, Rattus norvegicus
agcattactgtaatgtctccggcca

SEQ ID NO: 127074 - DNA, 25 bp, Rattus norvegicus
agcattactgtattgtctccggcca

SEQ ID NO: 127075 - DNA, 25 bp, Rattus norvegicus
agcattagagccatttgggtctgcc

SEQ ID NO: 127076 - DNA, 25 bp, Rattus norvegicus
agcattagagccttttgggtctgcc

SEQ ID NO: 127077 - DNA, 25 bp, Rattus norvegicus
agcattatacacacatggcctcatt

SEQ ID NO: 127078 - DNA, 25 bp, Rattus norvegicus
agcattatacactcatggcctcatt

SEQ ID NO: 127079 - DNA, 25 bp, Rattus norvegicus
agcattatactgaacacccggcatt

SEQ ID NO: 127080 - DNA, 25 bp, Rattus norvegicus
agcattatactgtacacccggcatt

SEQ ID NO: 127081 - DNA, 25 bp, Rattus norvegicus
agcattatctcaagtctttccgagc

SEQ ID NO: 127082 - DNA, 25 bp, Rattus norvegicus
agcattatctcatgtctttccgagc

SEQ ID NO: 127083 - DNA, 25 bp, Rattus norvegicus
agcattatggttatcagaacactca

SEQ ID NO: 127084 - DNA, 25 bp, Rattus norvegicus
agcattatggttttcagaacactca

SEQ ID NO: 127085 - DNA, 25 bp, Rattus norvegicus
agcattcaagagactgcagcagaaa

SEQ ID NO: 127086 - DNA, 25 bp, Rattus norvegicus
agcattcaagagtctgcagcagaaa

SEQ ID NO: 127087 - DNA, 25 bp, Rattus norvegicus
agcattcaccatctatcagtcactg

SEQ ID NO: 127088 - DNA, 25 bp, Rattus norvegicus
agcattcaccatgtatcagtcactg

SEQ ID NO: 127089 - DNA, 25 bp, Rattus norvegicus
agcattcacgttagcttgaagatgg

SEQ ID NO: 127090 - DNA, 25 bp, Rattus norvegicus
agcattcacgtttgcttgaagatgg

SEQ ID NO: 127091 - DNA, 25 bp, Rattus norvegicus
agcattcagtccaatccacagagag

SEQ ID NO: 127092 - DNA, 25 bp, Rattus norvegicus
agcattcagtcctatccacagagag

SEQ ID NO: 127093 - DNA, 25 bp, Rattus norvegicus
agcattcagtgtcgttgtactagcc

SEQ ID NO: 127094 - DNA, 25 bp, Rattus norvegicus
agcattcagtgtggttgtactagcc

SEQ ID NO: 127095 - DNA, 25 bp, Rattus norvegicus
agcattccaaggagtctggcggtcc

SEQ ID NO: 127096 - DNA, 25 bp, Rattus norvegicus
agcattccaaggtgtctggcggtcc

SEQ ID NO: 127097 - DNA, 25 bp, Rattus norvegicus
agcattccaatgctgctgacttatt

SEQ ID NO: 127098 - DNA, 25 bp, Rattus norvegicus
agcattccaatggtgctgacttatt

SEQ ID NO: 127099 - DNA, 25 bp, Rattus norvegicus
agcattccaggtagggactcagcac

SEQ ID NO: 127100 - DNA, 25 bp, Rattus norvegicus
agcattccaggttgggactcagcac

SEQ ID NO: 127101 - DNA, 25 bp, Rattus norvegicus
agcattccagtgctctgtttcagag

SEQ ID NO: 127102 - DNA, 25 bp, Rattus norvegicus
agcattccagtggtctgtttcagag

SEQ ID NO: 127103 - DNA, 25 bp, Rattus norvegicus
agcattcccaaccttacactgtgtg

SEQ ID NO: 127104 - DNA, 25 bp, Rattus norvegicus
agcattcccaacgttacactgtgtg

SEQ ID NO: 127105 - DNA, 25 bp, Rattus norvegicus
agcattcccaggaaggccaaggtgt

SEQ ID NO: 127106 - DNA, 25 bp, Rattus norvegicus
agcattcccaggtaggccaaggtgt

SEQ ID NO: 127107 - DNA, 25 bp, Rattus norvegicus
agcattccctggctgcttcctaggt

SEQ ID NO: 127108 - DNA, 25 bp, Rattus norvegicus
agcattccctgggtgcttcctaggt

SEQ ID NO: 127109 - DNA, 25 bp, Rattus norvegicus
agcattccgcatctagtcagttttg

SEQ ID NO: 127110 - DNA, 25 bp, Rattus norvegicus
agcattccgcatgtagtcagttttg

SEQ ID NO: 127111 - DNA, 25 bp, Rattus norvegicus
agcattcgcaggcagcttttaggaa

SEQ ID NO: 127112 - DNA, 25 bp, Rattus norvegicus
agcattcgcagggagcttttaggaa

SEQ ID NO: 127113 - DNA, 25 bp, Rattus norvegicus
agcattcgccttactagagatctca

SEQ ID NO: 127114 - DNA, 25 bp, Rattus norvegicus
agcattcgcctttctagagatctca

SEQ ID NO: 127115 - DNA, 25 bp, Rattus norvegicus
agcattcgctgcagactggaaacct

SEQ ID NO: 127116 - DNA, 25 bp, Rattus norvegicus
agcattcgctgctgactggaaacct

SEQ ID NO: 127117 - DNA, 25 bp, Rattus norvegicus
agcattcgcttgctttcaaatagca

SEQ ID NO: 127118 - DNA, 25 bp, Rattus norvegicus
agcattcgcttggtttcaaatagca

SEQ ID NO: 127119 - DNA, 25 bp, Rattus norvegicus
agcattcggcttaagtttggcaaca

SEQ ID NO: 127120 - DNA, 25 bp, Rattus norvegicus
agcattcggctttagtttggcaaca

SEQ ID NO: 127121 - DNA, 25 bp, Rattus norvegicus
agcattcgtacactggctactctgc

SEQ ID NO: 127122 - DNA, 25 bp, Rattus norvegicus
agcattcgtacagtggctactctgc

SEQ ID NO: 127123 - DNA, 25 bp, Rattus norvegicus
agcattctcacacggctctggacag

SEQ ID NO: 127124 - DNA, 25 bp, Rattus norvegicus
agcattctcacagggctctggacag

SEQ ID NO: 127125 - DNA, 25 bp, Rattus norvegicus
agcattctcagcctgtggcagtgaa

SEQ ID NO: 127126 - DNA, 25 bp, Rattus norvegicus
agcattctcagcgtgtggcagtgaa

SEQ ID NO: 127127 - DNA, 25 bp, Rattus norvegicus
agcattctcgggatgctgcatgagt

SEQ ID NO: 127128 - DNA, 25 bp, Rattus norvegicus
agcattctcgggttgctgcatgagt

SEQ ID NO: 127129 - DNA, 25 bp, Rattus norvegicus
agcattctctcccttgctgtgcaaa

SEQ ID NO: 127130 - DNA, 25 bp, Rattus norvegicus
agcattctctccgttgctgtgcaaa

SEQ ID NO: 127131 - DNA, 25 bp, Rattus norvegicus
agcattctgatcaacatcgccatct

SEQ ID NO: 127132 - DNA, 25 bp, Rattus norvegicus
agcattctgatctacatcgccatct

SEQ ID NO: 127133 - DNA, 25 bp, Rattus norvegicus
agcattctgcacagtgggcattcag

SEQ ID NO: 127134 - DNA, 25 bp, Rattus norvegicus
agcattctgcactgtgggcattcag

SEQ ID NO: 127135 - DNA, 25 bp, Rattus norvegicus
agcattctggacaagctcatccgga

SEQ ID NO: 127136 - DNA, 25 bp, Rattus norvegicus
agcattctggactagctcatccgga

SEQ ID NO: 127137 - DNA, 25 bp, Rattus norvegicus
agcattctgggcagaccaagggcag

SEQ ID NO: 127138 - DNA, 25 bp, Rattus norvegicus
agcattctgggcatttgtgatacct

SEQ ID NO: 127139 - DNA, 25 bp, Rattus norvegicus
agcattctgggctgaccaagggcag

SEQ ID NO: 127140 - DNA, 25 bp, Rattus norvegicus
agcattctgggcttttgtgatacct

SEQ ID NO: 127141 - DNA, 25 bp, Rattus norvegicus
agcattctgtctctgccttaataac

SEQ ID NO: 127142 - DNA, 25 bp, Rattus norvegicus
agcattctgtctgtgccttaataac

SEQ ID NO: 127143 - DNA, 25 bp, Rattus norvegicus
agcattcttggaacgcattcatttg

SEQ ID NO: 127144 - DNA, 25 bp, Rattus norvegicus
agcattcttggatcgcattcatttg

SEQ ID NO: 127145 - DNA, 25 bp, Rattus norvegicus
agcattctttctcagtacagcgatt

SEQ ID NO: 127146 - DNA, 25 bp, Rattus norvegicus
agcattctttctgagtacagcgatt

SEQ ID NO: 127147 - DNA, 25 bp, Rattus norvegicus
agcattgaagctaccaaggccttgg

SEQ ID NO: 127148 - DNA, 25 bp, Rattus norvegicus
agcattgaagcttccaaggccttgg

SEQ ID NO: 127149 - DNA, 25 bp, Rattus norvegicus
agcattgactgtactgacggcgacc

SEQ ID NO: 127150 - DNA, 25 bp, Rattus norvegicus
agcattgactgttctgacggcgacc

SEQ ID NO: 127151 - DNA, 25 bp, Rattus norvegicus
agcattgagacccagtgcacccaaa

SEQ ID NO: 127152 - DNA, 25 bp, Rattus norvegicus
agcattgagaccgagtgcacccaaa

SEQ ID NO: 127153 - DNA, 25 bp, Rattus norvegicus
agcattgaggagctacaacccttcc

SEQ ID NO: 127154 - DNA, 25 bp, Rattus norvegicus
agcattgaggaggtacaacccttcc

SEQ ID NO: 127155 - DNA, 25 bp, Rattus norvegicus
agcattgattcacccaaaggcagaa

SEQ ID NO: 127156 - DNA, 25 bp, Rattus norvegicus
agcattgattcagccaaaggcagaa

SEQ ID NO: 127157 - DNA, 25 bp, Rattus norvegicus
agcattgcacaacagtggtcttcaa

SEQ ID NO: 127158 - DNA, 25 bp, Rattus norvegicus
agcattgcacaagagtggtcttcaa

SEQ ID NO: 127159 - DNA, 25 bp, Rattus norvegicus
agcattgcctgactgttcgagccaa

SEQ ID NO: 127160 - DNA, 25 bp, Rattus norvegicus
agcattgcctgagtgttcgagccaa

SEQ ID NO: 127161 - DNA, 25 bp, Rattus norvegicus
agcattgcctggagtacaaggtcca

SEQ ID NO: 127162 - DNA, 25 bp, Rattus norvegicus
agcattgcctggtgtacaaggtcca

SEQ ID NO: 127163 - DNA, 25 bp, Rattus norvegicus
agcattgctcaaaaatggccttccc

SEQ ID NO: 127164 - DNA, 25 bp, Rattus norvegicus
agcattgctcaataatggccttccc

SEQ ID NO: 127165 - DNA, 25 bp, Rattus norvegicus
agcattgctctactctgcacagatc

SEQ ID NO: 127166 - DNA, 25 bp, Rattus norvegicus
agcattgctctagtctgcacagatc

SEQ ID NO: 127167 - DNA, 25 bp, Rattus norvegicus
agcattgctctcaagcagtcattct

SEQ ID NO: 127168 - DNA, 25 bp, Rattus norvegicus
agcattgctctctagcagtcattct

SEQ ID NO: 127169 - DNA, 25 bp, Rattus norvegicus
agcattgctgtaagaaaggcttcat

SEQ ID NO: 127170 - DNA, 25 bp, Rattus norvegicus
agcattgctgtatgaaaggcttcat

SEQ ID NO: 127171 - DNA, 25 bp, Rattus norvegicus
agcattgctgttacctgcgaaggat

SEQ ID NO: 127172 - DNA, 25 bp, Rattus norvegicus
agcattgctgtttcctgcgaaggat

SEQ ID NO: 127173 - DNA, 25 bp, Rattus norvegicus
agcattgcttggcagacatactccc

SEQ ID NO: 127174 - DNA, 25 bp, Rattus norvegicus
agcattgcttgggagacatactccc

SEQ ID NO: 127175 - DNA, 25 bp, Rattus norvegicus
agcattggaagaagtcaggagatta

SEQ ID NO: 127176 - DNA, 25 bp, Rattus norvegicus
agcattggaagatgtcaggagatta

SEQ ID NO: 127177 - DNA, 25 bp, Rattus norvegicus
agcattggaagtcagcttccctcta

SEQ ID NO: 127178 - DNA, 25 bp, Rattus norvegicus
agcattggaagtgagcttccctcta

SEQ ID NO: 127179 - DNA, 25 bp, Rattus norvegicus
agcattggaatcaatctctggtagt

SEQ ID NO: 127180 - DNA, 25 bp, Rattus norvegicus
agcattggaatcatccattcccagc

SEQ ID NO: 127181 - DNA, 25 bp, Rattus norvegicus
agcattggaatctatctctggtagt

SEQ ID NO: 127182 - DNA, 25 bp, Rattus norvegicus
agcattggaatcttccattcccagc

SEQ ID NO: 127183 - DNA, 25 bp, Rattus norvegicus
agcattggatctctggacccctgac

SEQ ID NO: 127184 - DNA, 25 bp, Rattus norvegicus
agcattggatctgtggacccctgac

SEQ ID NO: 127185 - DNA, 25 bp, Rattus norvegicus
agcattggccatcagcagaagggca

SEQ ID NO: 127186 - DNA, 25 bp, Rattus norvegicus
agcattggccatgagcagaagggca

SEQ ID NO: 127187 - DNA, 25 bp, Rattus norvegicus
agcattggctgcaatcggtctacat

SEQ ID NO: 127188 - DNA, 25 bp, Rattus norvegicus
agcattggctgctatcggtctacat

SEQ ID NO: 127189 - DNA, 25 bp, Rattus norvegicus
agcattggttaaacagcccggtctc

SEQ ID NO: 127190 - DNA, 25 bp, Rattus norvegicus
agcattggttaatcagcccggtctc

SEQ ID NO: 127191 - DNA, 25 bp, Rattus norvegicus
agcattgtagctccacaactgccat

SEQ ID NO: 127192 - DNA, 25 bp, Rattus norvegicus
agcattgtagctgcacaactgccat

SEQ ID NO: 127193 - DNA, 25 bp, Rattus norvegicus
agcattgtgaagaccagcgtgccaa

SEQ ID NO: 127194 - DNA, 25 bp, Rattus norvegicus
agcattgtgaagtccagcgtgccaa

SEQ ID NO: 127195 - DNA, 25 bp, Rattus norvegicus
agcattgtgaatctctgcaaagcag

SEQ ID NO: 127196 - DNA, 25 bp, Rattus norvegicus
agcattgtgaatgtctgcaaagcag

SEQ ID NO: 127197 - DNA, 25 bp, Rattus norvegicus
agcattgtgctgctgagtttcttac

SEQ ID NO: 127198 - DNA, 25 bp, Rattus norvegicus
agcattgtgctggtgagtttcttac

SEQ ID NO: 127199 - DNA, 25 bp, Rattus norvegicus
agcattgtggctccgagtgcaaccc

SEQ ID NO: 127200 - DNA, 25 bp, Rattus norvegicus
agcattgtggctgcgagtgcaaccc

SEQ ID NO: 127201 - DNA, 25 bp, Rattus norvegicus
agcattgtggtacggtgagacccac

SEQ ID NO: 127202 - DNA, 25 bp, Rattus norvegicus
agcattgtggtagggtgagacccac

SEQ ID NO: 127203 - DNA, 25 bp, Rattus norvegicus
agcattgttctgagctgctgatcct

SEQ ID NO: 127204 - DNA, 25 bp, Rattus norvegicus
agcattgttctgtgctgctgatcct

SEQ ID NO: 127205 - DNA, 25 bp, Rattus norvegicus
agcattgttggcactttggtatcat

SEQ ID NO: 127206 - DNA, 25 bp, Rattus norvegicus
agcattgttggctctttggtatcat

SEQ ID NO: 127207 - DNA, 25 bp, Rattus norvegicus
agcattgtttcgctttgtacatgta

SEQ ID NO: 127208 - DNA, 25 bp, Rattus norvegicus
agcattgtttcggtttgtacatgta

SEQ ID NO: 127209 - DNA, 25 bp, Rattus norvegicus
agcattgtttgcatattgttccaag

SEQ ID NO: 127210 - DNA, 25 bp, Rattus norvegicus
agcattgtttgcttattgttccaag

SEQ ID NO: 127211 - DNA, 25 bp, Rattus norvegicus
agcatttaaataactgtccccagtc

SEQ ID NO: 127212 - DNA, 25 bp, Rattus norvegicus
agcatttaaatatctgtccccagtc

SEQ ID NO: 127213 - DNA, 25 bp, Rattus norvegicus
agcatttacctgatttattcattac

SEQ ID NO: 127214 - DNA, 25 bp, Rattus norvegicus
agcatttacctgttttattcattac

SEQ ID NO: 127215 - DNA, 25 bp, Rattus norvegicus
agcatttaccttcgactctgtcttg

SEQ ID NO: 127216 - DNA, 25 bp, Rattus norvegicus
agcatttaccttggactctgtcttg

SEQ ID NO: 127217 - DNA, 25 bp, Rattus norvegicus
agcatttactaaatctcccaggtag

SEQ ID NO: 127218 - DNA, 25 bp, Rattus norvegicus
agcatttactaattctcccaggtag

SEQ ID NO: 127219 - DNA, 25 bp, Rattus norvegicus
agcatttagaagaggcgtctcccga

SEQ ID NO: 127220 - DNA, 25 bp, Rattus norvegicus
agcatttagaagtggcgtctcccga

SEQ ID NO: 127221 - DNA, 25 bp, Rattus norvegicus
agcatttaggtgactgttcagcagt

SEQ ID NO: 127222 - DNA, 25 bp, Rattus norvegicus
agcatttaggtgtctgttcagcagt

SEQ ID NO: 127223 - DNA, 25 bp, Rattus norvegicus
agcatttattgaacgcatggtacaa

SEQ ID NO: 127224 - DNA, 25 bp, Rattus norvegicus
agcatttattgatcgcatggtacaa

SEQ ID NO: 127225 - DNA, 25 bp, Rattus norvegicus
agcatttcacacacaatgtctggag

SEQ ID NO: 127226 - DNA, 25 bp, Rattus norvegicus
agcatttcacactcaatgtctggag

SEQ ID NO: 127227 - DNA, 25 bp, Rattus norvegicus
agcatttcacccatgtgcaataatg

SEQ ID NO: 127228 - DNA, 25 bp, Rattus norvegicus
agcatttcacccttgtgcaataatg

SEQ ID NO: 127229 - DNA, 25 bp, Rattus norvegicus
agcatttcagagatcacactggaga

SEQ ID NO: 127230 - DNA, 25 bp, Rattus norvegicus
agcatttcagagttcacactggaga

SEQ ID NO: 127231 - DNA, 25 bp, Rattus norvegicus
agcatttcatgcacttacgatttgg

SEQ ID NO: 127232 - DNA, 25 bp, Rattus norvegicus
agcatttcatgctcttacgatttgg

SEQ ID NO: 127233 - DNA, 25 bp, Rattus norvegicus
agcatttccagcagcctgacctcga

SEQ ID NO: 127234 - DNA, 25 bp, Rattus norvegicus
agcatttccagctgcctgacctcga

SEQ ID NO: 127235 - DNA, 25 bp, Rattus norvegicus
agcatttccattattctctaaccct

SEQ ID NO: 127236 - DNA, 25 bp, Rattus norvegicus
agcatttccatttttctctaaccct

SEQ ID NO: 127237 - DNA, 25 bp, Rattus norvegicus
agcatttccctgacttcatgaatga

SEQ ID NO: 127238 - DNA, 25 bp, Rattus norvegicus
agcatttccctgtcttcatgaatga

SEQ ID NO: 127239 - DNA, 25 bp, Rattus norvegicus
agcatttcctcactcttttctagag

SEQ ID NO: 127240 - DNA, 25 bp, Rattus norvegicus
agcatttcctcagtcttttctagag

SEQ ID NO: 127241 - DNA, 25 bp, Rattus norvegicus
agcatttccttcatctgcagagaca

SEQ ID NO: 127242 - DNA, 25 bp, Rattus norvegicus
agcatttccttcttctgcagagaca

SEQ ID NO: 127243 - DNA, 25 bp, Rattus norvegicus
agcatttcggaactgggcatcaaga

SEQ ID NO: 127244 - DNA, 25 bp, Rattus norvegicus
agcatttcggaagtgggcatcaaga

SEQ ID NO: 127245 - DNA, 25 bp, Rattus norvegicus
agcatttcgggcatccttactcttt

SEQ ID NO: 127246 - DNA, 25 bp, Rattus norvegicus
agcatttcgggcttccttactcttt

SEQ ID NO: 127247 - DNA, 25 bp, Rattus norvegicus
agcatttctaccattgtgtccctgt

SEQ ID NO: 127248 - DNA, 25 bp, Rattus norvegicus
agcatttctacctttgtgtccctgt

SEQ ID NO: 127249 - DNA, 25 bp, Rattus norvegicus
agcatttctcaaatccaagtccaag

SEQ ID NO: 127250 - DNA, 25 bp, Rattus norvegicus
agcatttctcaattccaagtccaag

SEQ ID NO: 127251 - DNA, 25 bp, Rattus norvegicus
agcatttctctgctgcagatggctc

SEQ ID NO: 127252 - DNA, 25 bp, Rattus norvegicus
agcatttctctggtgcagatggctc

SEQ ID NO: 127253 - DNA, 25 bp, Rattus norvegicus
agcatttctggacggctgagagcta

SEQ ID NO: 127254 - DNA, 25 bp, Rattus norvegicus
agcatttctggagggctgagagcta

SEQ ID NO: 127255 - DNA, 25 bp, Rattus norvegicus
agcatttctgggacccctctgcaag

SEQ ID NO: 127256 - DNA, 25 bp, Rattus norvegicus
agcatttctgggtcccctctgcaag

SEQ ID NO: 127257 - DNA, 25 bp, Rattus norvegicus
agcatttcttctcccttggccatgg

SEQ ID NO: 127258 - DNA, 25 bp, Rattus norvegicus
agcatttcttctgccttggccatgg

SEQ ID NO: 127259 - DNA, 25 bp, Rattus norvegicus
agcatttgaagcacgtgatcgaaac

SEQ ID NO: 127260 - DNA, 25 bp, Rattus norvegicus
agcatttgaagctcgtgatcgaaac

SEQ ID NO: 127261 - DNA, 25 bp, Rattus norvegicus
agcatttgactgcatccaggtggcc

SEQ ID NO: 127262 - DNA, 25 bp, Rattus norvegicus
agcatttgactggatccaggtggcc

SEQ ID NO: 127263 - DNA, 25 bp, Rattus norvegicus
agcatttgagagaatgaagccatca

SEQ ID NO: 127264 - DNA, 25 bp, Rattus norvegicus
agcatttgagagtatgaagccatca

SEQ ID NO: 127265 - DNA, 25 bp, Rattus norvegicus
agcatttgagttctggctcacccat

SEQ ID NO: 127266 - DNA, 25 bp, Rattus norvegicus
agcatttgagttgtggctcacccat

SEQ ID NO: 127267 - DNA, 25 bp, Rattus norvegicus
agcatttgcaacataccagtctctt

SEQ ID NO: 127268 - DNA, 25 bp, Rattus norvegicus
agcatttgcaacttaccagtctctt

SEQ ID NO: 127269 - DNA, 25 bp, Rattus norvegicus
agcatttgctggagcaccgcaggac

SEQ ID NO: 127270 - DNA, 25 bp, Rattus norvegicus
agcatttgctggtgcaccgcaggac

SEQ ID NO: 127271 - DNA, 25 bp, Rattus norvegicus
agcatttggctgattctactactga

SEQ ID NO: 127272 - DNA, 25 bp, Rattus norvegicus
agcatttggctgtttctactactga

SEQ ID NO: 127273 - DNA, 25 bp, Rattus norvegicus
agcatttgggcaaggctctggctgt

SEQ ID NO: 127274 - DNA, 25 bp, Rattus norvegicus
agcatttgggcatggctctggctgt

SEQ ID NO: 127275 - DNA, 25 bp, Rattus norvegicus
agcatttggtttatacctcctagca

SEQ ID NO: 127276 - DNA, 25 bp, Rattus norvegicus
agcatttggtttttacctcctagca

SEQ ID NO: 127277 - DNA, 25 bp, Rattus norvegicus
agcatttgtagaaccagccatctcc

SEQ ID NO: 127278 - DNA, 25 bp, Rattus norvegicus
agcatttgtagatccagccatctcc

SEQ ID NO: 127279 - DNA, 25 bp, Rattus norvegicus
agcatttgttcacaacagactcaag

SEQ ID NO: 127280 - DNA, 25 bp, Rattus norvegicus
agcatttgttcagaacagactcaag

SEQ ID NO: 127281 - DNA, 25 bp, Rattus norvegicus
agcattttagctactcaatcctttc

SEQ ID NO: 127282 - DNA, 25 bp, Rattus norvegicus
agcattttagcttctcaatcctttc

SEQ ID NO: 127283 - DNA, 25 bp, Rattus norvegicus
agcattttattcaaggatctccaag

SEQ ID NO: 127284 - DNA, 25 bp, Rattus norvegicus
agcattttattctaggatctccaag

SEQ ID NO: 127285 - DNA, 25 bp, Rattus norvegicus
agcattttattgatcccttctccca

SEQ ID NO: 127286 - DNA, 25 bp, Rattus norvegicus
agcattttattgttcccttctccca

SEQ ID NO: 127287 - DNA, 25 bp, Rattus norvegicus
agcattttatttcgcctatcacttg

SEQ ID NO: 127288 - DNA, 25 bp, Rattus norvegicus
agcattttatttggcctatcacttg

SEQ ID NO: 127289 - DNA, 25 bp, Rattus norvegicus
agcattttccctctaaagaccatag

SEQ ID NO: 127290 - DNA, 25 bp, Rattus norvegicus
agcattttccctgtaaagaccatag

SEQ ID NO: 127291 - DNA, 25 bp, Rattus norvegicus
agcattttccgacaggtaccttggc

SEQ ID NO: 127292 - DNA, 25 bp, Rattus norvegicus
agcattttccgagaggtaccttggc

SEQ ID NO: 127293 - DNA, 25 bp, Rattus norvegicus
agcattttctgcagtacattcatga

SEQ ID NO: 127294 - DNA, 25 bp, Rattus norvegicus
agcattttctgctgtacattcatga

SEQ ID NO: 127295 - DNA, 25 bp, Rattus norvegicus
agcattttcttccttccggctggag

SEQ ID NO: 127296 - DNA, 25 bp, Rattus norvegicus
agcattttcttcgttccggctggag

SEQ ID NO: 127297 - DNA, 25 bp, Rattus norvegicus
agcattttgacaatctctgggactc

SEQ ID NO: 127298 - DNA, 25 bp, Rattus norvegicus
agcattttgacattctctgggactc

SEQ ID NO: 127299 - DNA, 25 bp, Rattus norvegicus
agcattttgcttatcagttggtgtc

SEQ ID NO: 127300 - DNA, 25 bp, Rattus norvegicus
agcattttgcttttcagttggtgtc

SEQ ID NO: 127301 - DNA, 25 bp, Rattus norvegicus
agcattttggtcacagtattcaagg

SEQ ID NO: 127302 - DNA, 25 bp, Rattus norvegicus
agcattttggtctcagtattcaagg

SEQ ID NO: 127303 - DNA, 25 bp, Rattus norvegicus
agcatttttccaccgtacgtgaggc

SEQ ID NO: 127304 - DNA, 25 bp, Rattus norvegicus
agcatttttccagcgtacgtgaggc

SEQ ID NO: 127305 - DNA, 25 bp, Rattus norvegicus
agcatttttctgcttgtacaactta

SEQ ID NO: 127306 - DNA, 25 bp, Rattus norvegicus
agcatttttctggttgtacaactta

SEQ ID NO: 127307 - DNA, 25 bp, Rattus norvegicus
agcatttttgttccgttcttgtgta

SEQ ID NO: 127308 - DNA, 25 bp, Rattus norvegicus
agcatttttgttgcgttcttgtgta

SEQ ID NO: 127309 - DNA, 25 bp, Rattus norvegicus
agcattttttgcagtatggcccaag

SEQ ID NO: 127310 - DNA, 25 bp, Rattus norvegicus
agcattttttgctgtatggcccaag

SEQ ID NO: 127311 - DNA, 25 bp, Rattus norvegicus
agccaaaaccccagttgagtcattc

SEQ ID NO: 127312 - DNA, 25 bp, Rattus norvegicus
agccaaaacccctgttgagtcattc

SEQ ID NO: 127313 - DNA, 25 bp, Rattus norvegicus
agccaaaagaacctgtgaccacccg

SEQ ID NO: 127314 - DNA, 25 bp, Rattus norvegicus
agccaaaagaacgtgtgaccacccg

SEQ ID NO: 127315 - DNA, 25 bp, Rattus norvegicus
agccaaaagcacaaggttcatctga

SEQ ID NO: 127316 - DNA, 25 bp, Rattus norvegicus
agccaaaagcactaggttcatctga

SEQ ID NO: 127317 - DNA, 25 bp, Rattus norvegicus
agccaaaagcatatctgactccatc

SEQ ID NO: 127318 - DNA, 25 bp, Rattus norvegicus
agccaaaagcatttctgactccatc

SEQ ID NO: 127319 - DNA, 25 bp, Rattus norvegicus
agccaaaaggtcaccgtctggttca

SEQ ID NO: 127320 - DNA, 25 bp, Rattus norvegicus
agccaaaaggtctccgtctggttca

SEQ ID NO: 127321 - DNA, 25 bp, Rattus norvegicus
agccaaaatactcatcctgacctac

SEQ ID NO: 127322 - DNA, 25 bp, Rattus norvegicus
agccaaaatactgatcctgacctac

SEQ ID NO: 127323 - DNA, 25 bp, Rattus norvegicus
agccaaaatgtcaccggaatctaaa

SEQ ID NO: 127324 - DNA, 25 bp, Rattus norvegicus
agccaaaatgtctccggaatctaaa

SEQ ID NO: 127325 - DNA, 25 bp, Rattus norvegicus
agccaaacatggaggaagctccgga

SEQ ID NO: 127326 - DNA, 25 bp, Rattus norvegicus
agccaaacatggtggaagctccgga

SEQ ID NO: 127327 - DNA, 25 bp, Rattus norvegicus
agccaaaccagtcatacacagcttt

SEQ ID NO: 127328 - DNA, 25 bp, Rattus norvegicus
agccaaaccagtgatacacagcttt

SEQ ID NO: 127329 - DNA, 25 bp, Rattus norvegicus
agccaaactcttcttgctgttgatg

SEQ ID NO: 127330 - DNA, 25 bp, Rattus norvegicus
agccaaactcttgttgctgttgatg

SEQ ID NO: 127331 - DNA, 25 bp, Rattus norvegicus
agccaaactgctaacgaccgtgtat

SEQ ID NO: 127332 - DNA, 25 bp, Rattus norvegicus
agccaaactgcttacgaccgtgtat

SEQ ID NO: 127333 - DNA, 25 bp, Rattus norvegicus
agccaaagaaccagggactaggcca

SEQ ID NO: 127334 - DNA, 25 bp, Rattus norvegicus
agccaaagaacctgggactaggcca

SEQ ID NO: 127335 - DNA, 25 bp, Rattus norvegicus
agccaaagagctattgcggactcct

SEQ ID NO: 127336 - DNA, 25 bp, Rattus norvegicus
agccaaagagcttttgcggactcct

SEQ ID NO: 127337 - DNA, 25 bp, Rattus norvegicus
agccaaagctttctccacattcatt

SEQ ID NO: 127338 - DNA, 25 bp, Rattus norvegicus
agccaaagctttgtccacattcatt

SEQ ID NO: 127339 - DNA, 25 bp, Rattus norvegicus
agccaaaggccacctggactgttta

SEQ ID NO: 127340 - DNA, 25 bp, Rattus norvegicus
agccaaaggccagctggactgttta

SEQ ID NO: 127341 - DNA, 25 bp, Rattus norvegicus
agccaaagggaaagagtctgaccaa

SEQ ID NO: 127342 - DNA, 25 bp, Rattus norvegicus
agccaaagggaatgagtctgaccaa

SEQ ID NO: 127343 - DNA, 25 bp, Rattus norvegicus
agccaaagtcacacgctgggtatca

SEQ ID NO: 127344 - DNA, 25 bp, Rattus norvegicus
agccaaagtcactcgctgggtatca

SEQ ID NO: 127345 - DNA, 25 bp, Rattus norvegicus
agccaaagtgagacggcctctggag

SEQ ID NO: 127346 - DNA, 25 bp, Rattus norvegicus
agccaaagtgagtcggcctctggag

SEQ ID NO: 127347 - DNA, 25 bp, Rattus norvegicus
agccaaagtgttagctcctcatagc

SEQ ID NO: 127348 - DNA, 25 bp, Rattus norvegicus
agccaaagtgtttgctcctcatagc

SEQ ID NO: 127349 - DNA, 25 bp, Rattus norvegicus
agccaaatagggacagtagtctagt

SEQ ID NO: 127350 - DNA, 25 bp, Rattus norvegicus
agccaaatagggtcagtagtctagt

SEQ ID NO: 127351 - DNA, 25 bp, Rattus norvegicus
agccaaatccacatcctgttcaggt

SEQ ID NO: 127352 - DNA, 25 bp, Rattus norvegicus
agccaaatccacttcctgttcaggt

SEQ ID NO: 127353 - DNA, 25 bp, Rattus norvegicus
agccaaatccagatgaagaaggttt

SEQ ID NO: 127354 - DNA, 25 bp, Rattus norvegicus
agccaaatccagttgaagaaggttt

SEQ ID NO: 127355 - DNA, 25 bp, Rattus norvegicus
agccaaatgtccctgttgccattgg

SEQ ID NO: 127356 - DNA, 25 bp, Rattus norvegicus
agccaaatgtccgtgttgccattgg

SEQ ID NO: 127357 - DNA, 25 bp, Rattus norvegicus
agccaaatgtgccttgtgcgctcat

SEQ ID NO: 127358 - DNA, 25 bp, Rattus norvegicus
agccaaatgtgcgttgtgcgctcat

SEQ ID NO: 127359 - DNA, 25 bp, Rattus norvegicus
agccaacacctacctgttatcagtg

SEQ ID NO: 127360 - DNA, 25 bp, Rattus norvegicus
agccaacacctagctgttatcagtg

SEQ ID NO: 127361 - DNA, 25 bp, Rattus norvegicus
agccaacactggcatgtctcggtag

SEQ ID NO: 127362 - DNA, 25 bp, Rattus norvegicus
agccaacactgggatgtctcggtag

SEQ ID NO: 127363 - DNA, 25 bp, Rattus norvegicus
agccaacagacaagcacctttagtg

SEQ ID NO: 127364 - DNA, 25 bp, Rattus norvegicus
agccaacagacatgcacctttagtg

SEQ ID NO: 127365 - DNA, 25 bp, Rattus norvegicus
agccaacagttgatttcttcacctt

SEQ ID NO: 127366 - DNA, 25 bp, Rattus norvegicus
agccaacagttgttttcttcacctt

SEQ ID NO: 127367 - DNA, 25 bp, Rattus norvegicus
agccaacatggtctctgctgtgaaa

SEQ ID NO: 127368 - DNA, 25 bp, Rattus norvegicus
agccaacatggtgtctgctgtgaaa

SEQ ID NO: 127369 - DNA, 25 bp, Rattus norvegicus
agccaaccagagatctccctggaga

SEQ ID NO: 127370 - DNA, 25 bp, Rattus norvegicus
agccaaccagagttctccctggaga

SEQ ID NO: 127371 - DNA, 25 bp, Rattus norvegicus
agccaacccaccagcatagttaatt

SEQ ID NO: 127372 - DNA, 25 bp, Rattus norvegicus
agccaacccacctgcatagttaatt

SEQ ID NO: 127373 - DNA, 25 bp, Rattus norvegicus
agccaaccggaacctattgaccatt

SEQ ID NO: 127374 - DNA, 25 bp, Rattus norvegicus
agccaaccggaagctattgaccatt

SEQ ID NO: 127375 - DNA, 25 bp, Rattus norvegicus
agccaacctgttctcttcataaaaa

SEQ ID NO: 127376 - DNA, 25 bp, Rattus norvegicus
agccaacctgttgtcttcataaaaa

SEQ ID NO: 127377 - DNA, 25 bp, Rattus norvegicus
agccaaccttagacatcactgtaca

SEQ ID NO: 127378 - DNA, 25 bp, Rattus norvegicus
agccaaccttagtcatcactgtaca

SEQ ID NO: 127379 - DNA, 25 bp, Rattus norvegicus
agccaaccttctccctttgagaaag

SEQ ID NO: 127380 - DNA, 25 bp, Rattus norvegicus
agccaaccttctgcctttgagaaag

SEQ ID NO: 127381 - DNA, 25 bp, Rattus norvegicus
agccaacgcccgctgtgggaagaac

SEQ ID NO: 127382 - DNA, 25 bp, Rattus norvegicus
agccaacgcccggtgtgggaagaac

SEQ ID NO: 127383 - DNA, 25 bp, Rattus norvegicus
agccaactaattatcttctgcattt

SEQ ID NO: 127384 - DNA, 25 bp, Rattus norvegicus
agccaactaattttcttctgcattt

SEQ ID NO: 127385 - DNA, 25 bp, Rattus norvegicus
agccaactatctattaccccaaaag

SEQ ID NO: 127386 - DNA, 25 bp, Rattus norvegicus
agccaactatcttttaccccaaaag

SEQ ID NO: 127387 - DNA, 25 bp, Rattus norvegicus
agccaactatggatcttgacaccgt

SEQ ID NO: 127388 - DNA, 25 bp, Rattus norvegicus
agccaactatggttcttgacaccgt

SEQ ID NO: 127389 - DNA, 25 bp, Rattus norvegicus
agccaactgcacagctttctttgtt

SEQ ID NO: 127390 - DNA, 25 bp, Rattus norvegicus
agccaactgcactgctttctttgtt

SEQ ID NO: 127391 - DNA, 25 bp, Rattus norvegicus
agccaactgcgacacattcgtctag

SEQ ID NO: 127392 - DNA, 25 bp, Rattus norvegicus
agccaactgcgagacattcgtctag

SEQ ID NO: 127393 - DNA, 25 bp, Rattus norvegicus
agccaactgtagctcctgtatgttt

SEQ ID NO: 127394 - DNA, 25 bp, Rattus norvegicus
agccaactgtaggtcctgtatgttt

SEQ ID NO: 127395 - DNA, 25 bp, Rattus norvegicus
agccaactgtggcattaccttgttt

SEQ ID NO: 127396 - DNA, 25 bp, Rattus norvegicus
agccaactgtgggattaccttgttt

SEQ ID NO: 127397 - DNA, 25 bp, Rattus norvegicus
agccaactgttgatcctgagacact

SEQ ID NO: 127398 - DNA, 25 bp, Rattus norvegicus
agccaactgttgttcctgagacact

SEQ ID NO: 127399 - DNA, 25 bp, Rattus norvegicus
agccaacttaacactgatgaaacag

SEQ ID NO: 127400 - DNA, 25 bp, Rattus norvegicus
agccaacttaactctgatgaaacag

SEQ ID NO: 127401 - DNA, 25 bp, Rattus norvegicus
agccaacttgagaccttttttcatc

SEQ ID NO: 127402 - DNA, 25 bp, Rattus norvegicus
agccaacttgagatcttcctgactt

SEQ ID NO: 127403 - DNA, 25 bp, Rattus norvegicus
agccaacttgagtccttttttcatc

SEQ ID NO: 127404 - DNA, 25 bp, Rattus norvegicus
agccaacttgagttcttcctgactt

SEQ ID NO: 127405 - DNA, 25 bp, Rattus norvegicus
agccaagaacttactagacgtgaaa

SEQ ID NO: 127406 - DNA, 25 bp, Rattus norvegicus
agccaagaactttctagacgtgaaa

SEQ ID NO: 127407 - DNA, 25 bp, Rattus norvegicus
agccaagaccatacagcctttgaga

SEQ ID NO: 127408 - DNA, 25 bp, Rattus norvegicus
agccaagaccattcagcctttgaga

SEQ ID NO: 127409 - DNA, 25 bp, Rattus norvegicus
agccaagacttcagtgtctagcaga

SEQ ID NO: 127410 - DNA, 25 bp, Rattus norvegicus
agccaagacttctgtgtctagcaga

SEQ ID NO: 127411 - DNA, 25 bp, Rattus norvegicus
agccaagatgcccatcgcacctggg

SEQ ID NO: 127412 - DNA, 25 bp, Rattus norvegicus
agccaagatgccgatcgcacctggg

SEQ ID NO: 127413 - DNA, 25 bp, Rattus norvegicus
agccaagcactgactgcatctctag

SEQ ID NO: 127414 - DNA, 25 bp, Rattus norvegicus
agccaagcactgtctgcatctctag

SEQ ID NO: 127415 - DNA, 25 bp, Rattus norvegicus
agccaagcaggaagcctccgagtag

SEQ ID NO: 127416 - DNA, 25 bp, Rattus norvegicus
agccaagcaggatgcctccgagtag

SEQ ID NO: 127417 - DNA, 25 bp, Rattus norvegicus
agccaagcatacatctctgtttttt

SEQ ID NO: 127418 - DNA, 25 bp, Rattus norvegicus
agccaagcatacttctctgtttttt

SEQ ID NO: 127419 - DNA, 25 bp, Rattus norvegicus
agccaagcatctccaaccaaataag

SEQ ID NO: 127420 - DNA, 25 bp, Rattus norvegicus
agccaagcatctgcaaccaaataag

SEQ ID NO: 127421 - DNA, 25 bp, Rattus norvegicus
agccaagccaggctccaggcagata

SEQ ID NO: 127422 - DNA, 25 bp, Rattus norvegicus
agccaagccagggtccaggcagata

SEQ ID NO: 127423 - DNA, 25 bp, Rattus norvegicus
agccaagccattacgaggtccggag

SEQ ID NO: 127424 - DNA, 25 bp, Rattus norvegicus
agccaagccatttcgaggtccggag

SEQ ID NO: 127425 - DNA, 25 bp, Rattus norvegicus
agccaagcctaaaatgtgtgcctgt

SEQ ID NO: 127426 - DNA, 25 bp, Rattus norvegicus
agccaagcctaatatgtgtgcctgt

SEQ ID NO: 127427 - DNA, 25 bp, Rattus norvegicus
agccaagccttgatagctcggtact

SEQ ID NO: 127428 - DNA, 25 bp, Rattus norvegicus
agccaagccttgttagctcggtact

SEQ ID NO: 127429 - DNA, 25 bp, Rattus norvegicus
agccaagctcctacaatagatgcag

SEQ ID NO: 127430 - DNA, 25 bp, Rattus norvegicus
agccaagctccttcaatagatgcag

SEQ ID NO: 127431 - DNA, 25 bp, Rattus norvegicus
agccaagctctcacaagtcagacag

SEQ ID NO: 127432 - DNA, 25 bp, Rattus norvegicus
agccaagctctctcaagtcagacag

SEQ ID NO: 127433 - DNA, 25 bp, Rattus norvegicus
agccaagctgccacaatgtgtaaaa

SEQ ID NO: 127434 - DNA, 25 bp, Rattus norvegicus
agccaagctgcctcaatgtgtaaaa

SEQ ID NO: 127435 - DNA, 25 bp, Rattus norvegicus
agccaagctttcactcctgaataga

SEQ ID NO: 127436 - DNA, 25 bp, Rattus norvegicus
agccaagctttctctcctgaataga

SEQ ID NO: 127437 - DNA, 25 bp, Rattus norvegicus
agccaagcttttcggatctcctgga

SEQ ID NO: 127438 - DNA, 25 bp, Rattus norvegicus
agccaagcttttgggatctcctgga

SEQ ID NO: 127439 - DNA, 25 bp, Rattus norvegicus
agccaaggagacacttttaccctca

SEQ ID NO: 127440 - DNA, 25 bp, Rattus norvegicus
agccaaggagactcttttaccctca

SEQ ID NO: 127441 - DNA, 25 bp, Rattus norvegicus
agccaaggagagctatccagtctct

SEQ ID NO: 127442 - DNA, 25 bp, Rattus norvegicus
agccaaggagaggtatccagtctct

SEQ ID NO: 127443 - DNA, 25 bp, Rattus norvegicus
agccaaggcaaaaggaatccactta

SEQ ID NO: 127444 - DNA, 25 bp, Rattus norvegicus
agccaaggcaaatggaatccactta

SEQ ID NO: 127445 - DNA, 25 bp, Rattus norvegicus
agccaaggcaaccatggtctgtgtc

SEQ ID NO: 127446 - DNA, 25 bp, Rattus norvegicus
agccaaggcaacgatggtctgtgtc

SEQ ID NO: 127447 - DNA, 25 bp, Rattus norvegicus
agccaaggcacaatccactacaaat

SEQ ID NO: 127448 - DNA, 25 bp, Rattus norvegicus
agccaaggcacattccactacaaat

SEQ ID NO: 127449 - DNA, 25 bp, Rattus norvegicus
agccaaggcggcagaagattccatg

SEQ ID NO: 127450 - DNA, 25 bp, Rattus norvegicus
agccaaggcggctgaagattccatg

SEQ ID NO: 127451 - DNA, 25 bp, Rattus norvegicus
agccaaggctggaagctctgtggaa

SEQ ID NO: 127452 - DNA, 25 bp, Rattus norvegicus
agccaaggctggatacactgaaaaa

SEQ ID NO: 127453 - DNA, 25 bp, Rattus norvegicus
agccaaggctggtagctctgtggaa

SEQ ID NO: 127454 - DNA, 25 bp, Rattus norvegicus
agccaaggctggttacactgaaaaa

SEQ ID NO: 127455 - DNA, 25 bp, Rattus norvegicus
agccaagggcacacgactcaaggag

SEQ ID NO: 127456 - DNA, 25 bp, Rattus norvegicus
agccaagggcactcgactcaaggag

SEQ ID NO: 127457 - DNA, 25 bp, Rattus norvegicus
agccaagggctccagccaggacatg

SEQ ID NO: 127458 - DNA, 25 bp, Rattus norvegicus
agccaagggctcgagccaggacatg

SEQ ID NO: 127459 - DNA, 25 bp, Rattus norvegicus
agccaaggtctgataacatctactg

SEQ ID NO: 127460 - DNA, 25 bp, Rattus norvegicus
agccaaggtctgttaacatctactg

SEQ ID NO: 127461 - DNA, 25 bp, Rattus norvegicus
agccaaggtgggaacccggagccat

SEQ ID NO: 127462 - DNA, 25 bp, Rattus norvegicus
agccaaggtgggtacccggagccat

SEQ ID NO: 127463 - DNA, 25 bp, Rattus norvegicus
agccaagtagacctcagtgatgcca

SEQ ID NO: 127464 - DNA, 25 bp, Rattus norvegicus
agccaagtagacgtcagtgatgcca

SEQ ID NO: 127465 - DNA, 25 bp, Rattus norvegicus
agccaagtccagctgttcagggtcg

SEQ ID NO: 127466 - DNA, 25 bp, Rattus norvegicus
agccaagtccaggtgttcagggtcg

SEQ ID NO: 127467 - DNA, 25 bp, Rattus norvegicus
agccaagtcttacctcacagggagg

SEQ ID NO: 127468 - DNA, 25 bp, Rattus norvegicus
agccaagtcttagctcacagggagg

SEQ ID NO: 127469 - DNA, 25 bp, Rattus norvegicus
agccaagtgctcacaaggtaggtgt

SEQ ID NO: 127470 - DNA, 25 bp, Rattus norvegicus
agccaagtgctcactgaacaagttg

SEQ ID NO: 127471 - DNA, 25 bp, Rattus norvegicus
agccaagtgctctcaaggtaggtgt

SEQ ID NO: 127472 - DNA, 25 bp, Rattus norvegicus
agccaagtgctctctgaacaagttg

SEQ ID NO: 127473 - DNA, 25 bp, Rattus norvegicus
agccaagtgggcagagttctcacac

SEQ ID NO: 127474 - DNA, 25 bp, Rattus norvegicus
agccaagtgggctgagttctcacac

SEQ ID NO: 127475 - DNA, 25 bp, Rattus norvegicus
agccaagtgttaccattagtttcaa

SEQ ID NO: 127476 - DNA, 25 bp, Rattus norvegicus
agccaagtgttagcattagtttcaa

SEQ ID NO: 127477 - DNA, 25 bp, Rattus norvegicus
agccaagttcatagagctgcccact

SEQ ID NO: 127478 - DNA, 25 bp, Rattus norvegicus
agccaagttcattgagctgcccact

SEQ ID NO: 127479 - DNA, 25 bp, Rattus norvegicus
agccaataacatatgctgctccacc

SEQ ID NO: 127480 - DNA, 25 bp, Rattus norvegicus
agccaataacatttgctgctccacc

SEQ ID NO: 127481 - DNA, 25 bp, Rattus norvegicus
agccaataatgaagagccgcggcca

SEQ ID NO: 127482 - DNA, 25 bp, Rattus norvegicus
agccaataatgatgagccgcggcca

SEQ ID NO: 127483 - DNA, 25 bp, Rattus norvegicus
agccaataatgtcagcccctaccta

SEQ ID NO: 127484 - DNA, 25 bp, Rattus norvegicus
agccaataatgtgagcccctaccta

SEQ ID NO: 127485 - DNA, 25 bp, Rattus norvegicus
agccaataggcacgttgtcctcgtt

SEQ ID NO: 127486 - DNA, 25 bp, Rattus norvegicus
agccaataggcaggttgtcctcgtt

SEQ ID NO: 127487 - DNA, 25 bp, Rattus norvegicus
agccaatatattaaccaagcagcgg

SEQ ID NO: 127488 - DNA, 25 bp, Rattus norvegicus
agccaatatatttaccaagcagcgg

SEQ ID NO: 127489 - DNA, 25 bp, Rattus norvegicus
agccaatatgatctgcctgtctcca

SEQ ID NO: 127490 - DNA, 25 bp, Rattus norvegicus
agccaatatgatgtgcctgtctcca

SEQ ID NO: 127491 - DNA, 25 bp, Rattus norvegicus
agccaatcacaacctttttccagtt

SEQ ID NO: 127492 - DNA, 25 bp, Rattus norvegicus
agccaatcacaagctttttccagtt

SEQ ID NO: 127493 - DNA, 25 bp, Rattus norvegicus
agccaatcaggaaagaccttctccc

SEQ ID NO: 127494 - DNA, 25 bp, Rattus norvegicus
agccaatcaggatagaccttctccc

SEQ ID NO: 127495 - DNA, 25 bp, Rattus norvegicus
agccaatcattgatctgtctgtgcc

SEQ ID NO: 127496 - DNA, 25 bp, Rattus norvegicus
agccaatcattgttctgtctgtgcc

SEQ ID NO: 127497 - DNA, 25 bp, Rattus norvegicus
agccaatctctcagactggtctgaa

SEQ ID NO: 127498 - DNA, 25 bp, Rattus norvegicus
agccaatctctctgactggtctgaa

SEQ ID NO: 127499 - DNA, 25 bp, Rattus norvegicus
agccaatctctgagttctcatctct

SEQ ID NO: 127500 - DNA, 25 bp, Rattus norvegicus
agccaatctctgtgttctcatctct

SEQ ID NO: 127501 - DNA, 25 bp, Rattus norvegicus
agccaatctggcatccatagcaagt

SEQ ID NO: 127502 - DNA, 25 bp, Rattus norvegicus
agccaatctggcttccatagcaagt

SEQ ID NO: 127503 - DNA, 25 bp, Rattus norvegicus
agccaatctgttatgatttgtcccc

SEQ ID NO: 127504 - DNA, 25 bp, Rattus norvegicus
agccaatctgttttgatttgtcccc

SEQ ID NO: 127505 - DNA, 25 bp, Rattus norvegicus
agccaatcttggcagacaactgtct

SEQ ID NO: 127506 - DNA, 25 bp, Rattus norvegicus
agccaatcttgggagacaactgtct

SEQ ID NO: 127507 - DNA, 25 bp, Rattus norvegicus
agccaatctttgcttgactcttagg

SEQ ID NO: 127508 - DNA, 25 bp, Rattus norvegicus
agccaatctttggttgactcttagg

SEQ ID NO: 127509 - DNA, 25 bp, Rattus norvegicus
agccaatgcataaacaagtgtccgt

SEQ ID NO: 127510 - DNA, 25 bp, Rattus norvegicus
agccaatgcatatacaagtgtccgt

SEQ ID NO: 127511 - DNA, 25 bp, Rattus norvegicus
agccaatgctgccagactgacttta

SEQ ID NO: 127512 - DNA, 25 bp, Rattus norvegicus
agccaatgctgcgagactgacttta

SEQ ID NO: 127513 - DNA, 25 bp, Rattus norvegicus
agccaatggcagctcttcttgggct

SEQ ID NO: 127514 - DNA, 25 bp, Rattus norvegicus
agccaatggcaggtcttcttgggct

SEQ ID NO: 127515 - DNA, 25 bp, Rattus norvegicus
agccaatgtgacctggaagcccaga

SEQ ID NO: 127516 - DNA, 25 bp, Rattus norvegicus
agccaatgtgacgtggaagcccaga

SEQ ID NO: 127517 - DNA, 25 bp, Rattus norvegicus
agccaatgtggcagctgcctcggat

SEQ ID NO: 127518 - DNA, 25 bp, Rattus norvegicus
agccaatgtggctgctgcctcggat

SEQ ID NO: 127519 - DNA, 25 bp, Rattus norvegicus
agccaatgttagcatagttcctaga

SEQ ID NO: 127520 - DNA, 25 bp, Rattus norvegicus
agccaatgttaggatagttcctaga

SEQ ID NO: 127521 - DNA, 25 bp, Rattus norvegicus
agccaattacatctttttcctgatg

SEQ ID NO: 127522 - DNA, 25 bp, Rattus norvegicus
agccaattacatgtttttcctgatg

SEQ ID NO: 127523 - DNA, 25 bp, Rattus norvegicus
agccaattctctaacatagcaggtg

SEQ ID NO: 127524 - DNA, 25 bp, Rattus norvegicus
agccaattctcttacatagcaggtg

SEQ ID NO: 127525 - DNA, 25 bp, Rattus norvegicus
agccaattggccatcgctgagagcc

SEQ ID NO: 127526 - DNA, 25 bp, Rattus norvegicus
agccaattggccttcgctgagagcc

SEQ ID NO: 127527 - DNA, 25 bp, Rattus norvegicus
agccaatttccaacgtcagatccat

SEQ ID NO: 127528 - DNA, 25 bp, Rattus norvegicus
agccaatttccatcgtcagatccat

SEQ ID NO: 127529 - DNA, 25 bp, Rattus norvegicus
agccaatttggtcccacgtagtgga

SEQ ID NO: 127530 - DNA, 25 bp, Rattus norvegicus
agccaatttggtgccacgtagtgga

SEQ ID NO: 127531 - DNA, 25 bp, Rattus norvegicus
agccacaaagtcatcctgccaggat

SEQ ID NO: 127532 - DNA, 25 bp, Rattus norvegicus
agccacaaagtcttcctgccaggat

SEQ ID NO: 127533 - DNA, 25 bp, Rattus norvegicus
agccacaaatgacaccctgacatgt

SEQ ID NO: 127534 - DNA, 25 bp, Rattus norvegicus
agccacaaatgagaccctgacatgt

SEQ ID NO: 127535 - DNA, 25 bp, Rattus norvegicus
agccacaaattgaacccagtctacc

SEQ ID NO: 127536 - DNA, 25 bp, Rattus norvegicus
agccacaaattgtacccagtctacc

SEQ ID NO: 127537 - DNA, 25 bp, Rattus norvegicus
agccacaacctcatgctgtcattga

SEQ ID NO: 127538 - DNA, 25 bp, Rattus norvegicus
agccacaacctcttgctgtcattga

SEQ ID NO: 127539 - DNA, 25 bp, Rattus norvegicus
agccacaaggccactctgaagggtt

SEQ ID NO: 127540 - DNA, 25 bp, Rattus norvegicus
agccacaaggcctctctgaagggtt

SEQ ID NO: 127541 - DNA, 25 bp, Rattus norvegicus
agccacacactcatggatcatgcta

SEQ ID NO: 127542 - DNA, 25 bp, Rattus norvegicus
agccacacactcttggatcatgcta

SEQ ID NO: 127543 - DNA, 25 bp, Rattus norvegicus
agccacacccaacagagacatcaat

SEQ ID NO: 127544 - DNA, 25 bp, Rattus norvegicus
agccacacccaagagagacatcaat

SEQ ID NO: 127545 - DNA, 25 bp, Rattus norvegicus
agccacacccatactgtgaaggcga

SEQ ID NO: 127546 - DNA, 25 bp, Rattus norvegicus
agccacacccattctgtgaaggcga

SEQ ID NO: 127547 - DNA, 25 bp, Rattus norvegicus
agccacaccgcgcagtggaatgtga

SEQ ID NO: 127548 - DNA, 25 bp, Rattus norvegicus
agccacaccgcggagtggaatgtga

SEQ ID NO: 127549 - DNA, 25 bp, Rattus norvegicus
agccacacctggacagcaggagaca

SEQ ID NO: 127550 - DNA, 25 bp, Rattus norvegicus
agccacacctggtcagcaggagaca

SEQ ID NO: 127551 - DNA, 25 bp, Rattus norvegicus
agccacactagcaagcttcctggat

SEQ ID NO: 127552 - DNA, 25 bp, Rattus norvegicus
agccacactagctagcttcctggat

SEQ ID NO: 127553 - DNA, 25 bp, Rattus norvegicus
agccacactcctagggcattgtgat

SEQ ID NO: 127554 - DNA, 25 bp, Rattus norvegicus
agccacactccttgggcattgtgat

SEQ ID NO: 127555 - DNA, 25 bp, Rattus norvegicus
agccacactgcgctctacgcggtgt

SEQ ID NO: 127556 - DNA, 25 bp, Rattus norvegicus
agccacactgcggtctacgcggtgt

SEQ ID NO: 127557 - DNA, 25 bp, Rattus norvegicus
agccacagaattcctctccaggaag

SEQ ID NO: 127558 - DNA, 25 bp, Rattus norvegicus
agccacagaattgctctccaggaag

SEQ ID NO: 127559 - DNA, 25 bp, Rattus norvegicus
agccacagagaacctgctggatgca

SEQ ID NO: 127560 - DNA, 25 bp, Rattus norvegicus
agccacagagaactcctgagggttt

SEQ ID NO: 127561 - DNA, 25 bp, Rattus norvegicus
agccacagagaagctgctggatgca

SEQ ID NO: 127562 - DNA, 25 bp, Rattus norvegicus
agccacagagaagtcctgagggttt

SEQ ID NO: 127563 - DNA, 25 bp, Rattus norvegicus
agccacagaggcagatgtcttcgct

SEQ ID NO: 127564 - DNA, 25 bp, Rattus norvegicus
agccacagaggctgatgtcttcgct

SEQ ID NO: 127565 - DNA, 25 bp, Rattus norvegicus
agccacagatccctatgaaatagag

SEQ ID NO: 127566 - DNA, 25 bp, Rattus norvegicus
agccacagatccgtatgaaatagag

SEQ ID NO: 127567 - DNA, 25 bp, Rattus norvegicus
agccacagcactacagaggacttga

SEQ ID NO: 127568 - DNA, 25 bp, Rattus norvegicus
agccacagcacttcagaggacttga

SEQ ID NO: 127569 - DNA, 25 bp, Rattus norvegicus
agccacagcagcctacaaaagtata

SEQ ID NO: 127570 - DNA, 25 bp, Rattus norvegicus
agccacagcagcgtacaaaagtata

SEQ ID NO: 127571 - DNA, 25 bp, Rattus norvegicus
agccacagccctctttaaattgttt

SEQ ID NO: 127572 - DNA, 25 bp, Rattus norvegicus
agccacagccctgtttaaattgttt

SEQ ID NO: 127573 - DNA, 25 bp, Rattus norvegicus
agccacagggctccatcagtagcac

SEQ ID NO: 127574 - DNA, 25 bp, Rattus norvegicus
agccacagggctgcatcagtagcac

SEQ ID NO: 127575 - DNA, 25 bp, Rattus norvegicus
agccacaggtaaccagggcctctct

SEQ ID NO: 127576 - DNA, 25 bp, Rattus norvegicus
agccacaggtaagcagggcctctct

SEQ ID NO: 127577 - DNA, 25 bp, Rattus norvegicus
agccacagtaagacgccagcatata

SEQ ID NO: 127578 - DNA, 25 bp, Rattus norvegicus
agccacagtaagtcgccagcatata

SEQ ID NO: 127579 - DNA, 25 bp, Rattus norvegicus
agccacagtataattttagtgacaa

SEQ ID NO: 127580 - DNA, 25 bp, Rattus norvegicus
agccacagtatatttttagtgacaa

SEQ ID NO: 127581 - DNA, 25 bp, Rattus norvegicus
agccacagtcctcgatcccagaagt

SEQ ID NO: 127582 - DNA, 25 bp, Rattus norvegicus
agccacagtcctggatcccagaagt

SEQ ID NO: 127583 - DNA, 25 bp, Rattus norvegicus
agccacagtgacagttgttacaaaa

SEQ ID NO: 127584 - DNA, 25 bp, Rattus norvegicus
agccacagtgactgttgttacaaaa

SEQ ID NO: 127585 - DNA, 25 bp, Rattus norvegicus
agccacataacaaagggtccccagg

SEQ ID NO: 127586 - DNA, 25 bp, Rattus norvegicus
agccacataacatagggtccccagg

SEQ ID NO: 127587 - DNA, 25 bp, Rattus norvegicus
agccacataatcctttctgcatatt

SEQ ID NO: 127588 - DNA, 25 bp, Rattus norvegicus
agccacataatcgtttctgcatatt

SEQ ID NO: 127589 - DNA, 25 bp, Rattus norvegicus
agccacatccaaagctgtgttcctc

SEQ ID NO: 127590 - DNA, 25 bp, Rattus norvegicus
agccacatccaatgctgtgttcctc

SEQ ID NO: 127591 - DNA, 25 bp, Rattus norvegicus
agccacatccccatcacgaaggagt

SEQ ID NO: 127592 - DNA, 25 bp, Rattus norvegicus
agccacatccccttcacgaaggagt

SEQ ID NO: 127593 - DNA, 25 bp, Rattus norvegicus
agccacatggtgcaagtcagcgtct

SEQ ID NO: 127594 - DNA, 25 bp, Rattus norvegicus
agccacatggtggaagtcagcgtct

SEQ ID NO: 127595 - DNA, 25 bp, Rattus norvegicus
agccacatgtacctccacttttagg

SEQ ID NO: 127596 - DNA, 25 bp, Rattus norvegicus
agccacatgtacgtccacttttagg

SEQ ID NO: 127597 - DNA, 25 bp, Rattus norvegicus
agccacatgtgtcagcttactgtca

SEQ ID NO: 127598 - DNA, 25 bp, Rattus norvegicus
agccacatgtgtgagcttactgtca

SEQ ID NO: 127599 - DNA, 25 bp, Rattus norvegicus
agccacattcgcattaatccttatt

SEQ ID NO: 127600 - DNA, 25 bp, Rattus norvegicus
agccacattcgctttaatccttatt

SEQ ID NO: 127601 - DNA, 25 bp, Rattus norvegicus
agccacattgctaattactctttat

SEQ ID NO: 127602 - DNA, 25 bp, Rattus norvegicus
agccacattgcttattactctttat

SEQ ID NO: 127603 - DNA, 25 bp, Rattus norvegicus
agccacattggacgtcaggtacttc

SEQ ID NO: 127604 - DNA, 25 bp, Rattus norvegicus
agccacattggaggtcaggtacttc

SEQ ID NO: 127605 - DNA, 25 bp, Rattus norvegicus
agccacatttgcctttatgctggat

SEQ ID NO: 127606 - DNA, 25 bp, Rattus norvegicus
agccacatttgcgtttatgctggat

SEQ ID NO: 127607 - DNA, 25 bp, Rattus norvegicus
agccaccaaaccagatgacgtgttg

SEQ ID NO: 127608 - DNA, 25 bp, Rattus norvegicus
agccaccaaacctgatgacgtgttg

SEQ ID NO: 127609 - DNA, 25 bp, Rattus norvegicus
agccaccaagataggatgttcttta

SEQ ID NO: 127610 - DNA, 25 bp, Rattus norvegicus
agccaccaagattggatgttcttta

SEQ ID NO: 127611 - DNA, 25 bp, Rattus norvegicus
agccaccaagcccagtttttaatat

SEQ ID NO: 127612 - DNA, 25 bp, Rattus norvegicus
agccaccaagccgagtttttaatat

SEQ ID NO: 127613 - DNA, 25 bp, Rattus norvegicus
agccaccaaggtactcctgatttgt

SEQ ID NO: 127614 - DNA, 25 bp, Rattus norvegicus
agccaccaaggttctcctgatttgt

SEQ ID NO: 127615 - DNA, 25 bp, Rattus norvegicus
agccaccaatctcggcccagaatgt

SEQ ID NO: 127616 - DNA, 25 bp, Rattus norvegicus
agccaccaatctgggcccagaatgt

SEQ ID NO: 127617 - DNA, 25 bp, Rattus norvegicus
agccaccactaaagctcaggcaggt

SEQ ID NO: 127618 - DNA, 25 bp, Rattus norvegicus
agccaccactaatgctcaggcaggt

SEQ ID NO: 127619 - DNA, 25 bp, Rattus norvegicus
agccaccactgactggtcctgagct

SEQ ID NO: 127620 - DNA, 25 bp, Rattus norvegicus
agccaccactgagtggtcctgagct

SEQ ID NO: 127621 - DNA, 25 bp, Rattus norvegicus
agccaccactgcagaggactgcctg

SEQ ID NO: 127622 - DNA, 25 bp, Rattus norvegicus
agccaccactgctgaggactgcctg

SEQ ID NO: 127623 - DNA, 25 bp, Rattus norvegicus
agccaccagaggatcaccagcgcag

SEQ ID NO: 127624 - DNA, 25 bp, Rattus norvegicus
agccaccagaggttcaccagcgcag

SEQ ID NO: 127625 - DNA, 25 bp, Rattus norvegicus
agccaccagatgctgacaggatttg

SEQ ID NO: 127626 - DNA, 25 bp, Rattus norvegicus
agccaccagatggtgacaggatttg

SEQ ID NO: 127627 - DNA, 25 bp, Rattus norvegicus
agccaccaggatctcacctttagaa

SEQ ID NO: 127628 - DNA, 25 bp, Rattus norvegicus
agccaccaggatgtcacctttagaa

SEQ ID NO: 127629 - DNA, 25 bp, Rattus norvegicus
agccaccaggctagattagattctt

SEQ ID NO: 127630 - DNA, 25 bp, Rattus norvegicus
agccaccaggctctgtacatatggg

SEQ ID NO: 127631 - DNA, 25 bp, Rattus norvegicus
agccaccaggctgtgtacatatggg

SEQ ID NO: 127632 - DNA, 25 bp, Rattus norvegicus
agccaccaggcttgattagattctt

SEQ ID NO: 127633 - DNA, 25 bp, Rattus norvegicus
agccaccagggcacagtgacgtgct

SEQ ID NO: 127634 - DNA, 25 bp, Rattus norvegicus
agccaccagggctcagtgacgtgct

SEQ ID NO: 127635 - DNA, 25 bp, Rattus norvegicus
agccaccatctcattgtatattgtt

SEQ ID NO: 127636 - DNA, 25 bp, Rattus norvegicus
agccaccatctctttgtatattgtt

SEQ ID NO: 127637 - DNA, 25 bp, Rattus norvegicus
agccaccatgctactactcttgttg

SEQ ID NO: 127638 - DNA, 25 bp, Rattus norvegicus
agccaccatgcttctactcttgttg

SEQ ID NO: 127639 - DNA, 25 bp, Rattus norvegicus
agccaccatgtgcactctggaaacc

SEQ ID NO: 127640 - DNA, 25 bp, Rattus norvegicus
agccaccatgtggactctggaaacc

SEQ ID NO: 127641 - DNA, 25 bp, Rattus norvegicus
agccaccattctcagtgctgcggaa

SEQ ID NO: 127642 - DNA, 25 bp, Rattus norvegicus
agccaccattctgagtgctgcggaa

SEQ ID NO: 127643 - DNA, 25 bp, Rattus norvegicus
agccaccatttgatctcagccttta

SEQ ID NO: 127644 - DNA, 25 bp, Rattus norvegicus
agccaccatttgttctcagccttta

SEQ ID NO: 127645 - DNA, 25 bp, Rattus norvegicus
agccacccagctatcgaaattgaca

SEQ ID NO: 127646 - DNA, 25 bp, Rattus norvegicus
agccacccagctttcgaaattgaca

SEQ ID NO: 127647 - DNA, 25 bp, Rattus norvegicus
agccacccctagacaatcgaattgg

SEQ ID NO: 127648 - DNA, 25 bp, Rattus norvegicus
agccacccctagtcaatcgaattgg

SEQ ID NO: 127649 - DNA, 25 bp, Rattus norvegicus
agccacccctctcgtttttggagat

SEQ ID NO: 127650 - DNA, 25 bp, Rattus norvegicus
agccacccctctggtttttggagat

SEQ ID NO: 127651 - DNA, 25 bp, Rattus norvegicus
agccacccgcgtagatgagctggac

SEQ ID NO: 127652 - DNA, 25 bp, Rattus norvegicus
agccacccgcgttgatgagctggac

SEQ ID NO: 127653 - DNA, 25 bp, Rattus norvegicus
agccaccctctgaattaggagctga

SEQ ID NO: 127654 - DNA, 25 bp, Rattus norvegicus
agccaccctctgtattaggagctga

SEQ ID NO: 127655 - DNA, 25 bp, Rattus norvegicus
agccaccctgttagtcacttaggat

SEQ ID NO: 127656 - DNA, 25 bp, Rattus norvegicus
agccaccctgtttgtcacttaggat

SEQ ID NO: 127657 - DNA, 25 bp, Rattus norvegicus
agccaccgaacacagcagtgccgag

SEQ ID NO: 127658 - DNA, 25 bp, Rattus norvegicus
agccaccgaacagagcagtgccgag

SEQ ID NO: 127659 - DNA, 25 bp, Rattus norvegicus
agccacctataaagagatccaatgc

SEQ ID NO: 127660 - DNA, 25 bp, Rattus norvegicus
agccacctataatgagatccaatgc

SEQ ID NO: 127661 - DNA, 25 bp, Rattus norvegicus
agccacctctccagttaggatgggt

SEQ ID NO: 127662 - DNA, 25 bp, Rattus norvegicus
agccacctctcctgttaggatgggt

SEQ ID NO: 127663 - DNA, 25 bp, Rattus norvegicus
agccacctgaataaaatgccacttg

SEQ ID NO: 127664 - DNA, 25 bp, Rattus norvegicus
agccacctgaattaaatgccacttg

SEQ ID NO: 127665 - DNA, 25 bp, Rattus norvegicus
agccacctgcctaggtggagctggt

SEQ ID NO: 127666 - DNA, 25 bp, Rattus norvegicus
agccacctgccttggtggagctggt

SEQ ID NO: 127667 - DNA, 25 bp, Rattus norvegicus
agccacctgggactacctggactgg

SEQ ID NO: 127668 - DNA, 25 bp, Rattus norvegicus
agccacctgggagtacctggactgg

SEQ ID NO: 127669 - DNA, 25 bp, Rattus norvegicus
agccaccttaggatgaccacagtca

SEQ ID NO: 127670 - DNA, 25 bp, Rattus norvegicus
agccaccttaggttgaccacagtca

SEQ ID NO: 127671 - DNA, 25 bp, Rattus norvegicus
agccaccttatcacagcctgatgta

SEQ ID NO: 127672 - DNA, 25 bp, Rattus norvegicus
agccaccttatctcagcctgatgta

SEQ ID NO: 127673 - DNA, 25 bp, Rattus norvegicus
agccaccttcatacaaggtccagga

SEQ ID NO: 127674 - DNA, 25 bp, Rattus norvegicus
agccaccttcattcaaggtccagga

SEQ ID NO: 127675 - DNA, 25 bp, Rattus norvegicus
agccaccttccacgctcaaaaaagg

SEQ ID NO: 127676 - DNA, 25 bp, Rattus norvegicus
agccaccttccaggctcaaaaaagg

SEQ ID NO: 127677 - DNA, 25 bp, Rattus norvegicus
agccaccttgctccggagggacatc

SEQ ID NO: 127678 - DNA, 25 bp, Rattus norvegicus
agccaccttgctgcggagggacatc

SEQ ID NO: 127679 - DNA, 25 bp, Rattus norvegicus
agccaccttggccatggttggatac

SEQ ID NO: 127680 - DNA, 25 bp, Rattus norvegicus
agccaccttggcgatggttggatac

SEQ ID NO: 127681 - DNA, 25 bp, Rattus norvegicus
agccacctttcacggtatcctttgg

SEQ ID NO: 127682 - DNA, 25 bp, Rattus norvegicus
agccacctttcagggtatcctttgg

SEQ ID NO: 127683 - DNA, 25 bp, Rattus norvegicus
agccacctttctcacacagggatca

SEQ ID NO: 127684 - DNA, 25 bp, Rattus norvegicus
agccacctttctgacacagggatca

SEQ ID NO: 127685 - DNA, 25 bp, Rattus norvegicus
agccacctttgacgacttgggagtc

SEQ ID NO: 127686 - DNA, 25 bp, Rattus norvegicus
agccacctttgaggacttgggagtc

SEQ ID NO: 127687 - DNA, 25 bp, Rattus norvegicus
agccacctttggactagactatttt

SEQ ID NO: 127688 - DNA, 25 bp, Rattus norvegicus
agccacctttggtctagactatttt

SEQ ID NO: 127689 - DNA, 25 bp, Rattus norvegicus
agccacctttttctagctgggacat

SEQ ID NO: 127690 - DNA, 25 bp, Rattus norvegicus
agccacctttttgtagctgggacat

SEQ ID NO: 127691 - DNA, 25 bp, Rattus norvegicus
agccacgaggttactgtactatgaa

SEQ ID NO: 127692 - DNA, 25 bp, Rattus norvegicus
agccacgaggtttctgtactatgaa

SEQ ID NO: 127693 - DNA, 25 bp, Rattus norvegicus
agccacgatgagagtgctttccaat

SEQ ID NO: 127694 - DNA, 25 bp, Rattus norvegicus
agccacgatgagtgtgctttccaat

SEQ ID NO: 127695 - DNA, 25 bp, Rattus norvegicus
agccacgcaagtccctttaactttg

SEQ ID NO: 127696 - DNA, 25 bp, Rattus norvegicus
agccacgcaagtgcctttaactttg

SEQ ID NO: 127697 - DNA, 25 bp, Rattus norvegicus
agccacgcaatgagtcagtcaccat

SEQ ID NO: 127698 - DNA, 25 bp, Rattus norvegicus
agccacgcaatgtgtcagtcaccat

SEQ ID NO: 127699 - DNA, 25 bp, Rattus norvegicus
agccacgcctggcaagggagccaaa

SEQ ID NO: 127700 - DNA, 25 bp, Rattus norvegicus
agccacgcctgggaagggagccaaa

SEQ ID NO: 127701 - DNA, 25 bp, Rattus norvegicus
agccacggaggcacagcgagtcttt

SEQ ID NO: 127702 - DNA, 25 bp, Rattus norvegicus
agccacggaggctcagcgagtcttt

SEQ ID NO: 127703 - DNA, 25 bp, Rattus norvegicus
agccacggagtgctgcctcttggtt

SEQ ID NO: 127704 - DNA, 25 bp, Rattus norvegicus
agccacggagtggtgcctcttggtt

SEQ ID NO: 127705 - DNA, 25 bp, Rattus norvegicus
agccacggatggcatcattttaaat

SEQ ID NO: 127706 - DNA, 25 bp, Rattus norvegicus
agccacggatgggatcattttaaat

SEQ ID NO: 127707 - DNA, 25 bp, Rattus norvegicus
agccacggccgtacatgggcatgtc

SEQ ID NO: 127708 - DNA, 25 bp, Rattus norvegicus
agccacggccgttcatgggcatgtc

SEQ ID NO: 127709 - DNA, 25 bp, Rattus norvegicus
agccacggcgtcactggaatattta

SEQ ID NO: 127710 - DNA, 25 bp, Rattus norvegicus
agccacggcgtctctggaatattta

SEQ ID NO: 127711 - DNA, 25 bp, Rattus norvegicus
agccacgggagtctgagctctatca

SEQ ID NO: 127712 - DNA, 25 bp, Rattus norvegicus
agccacgggagtgtgagctctatca

SEQ ID NO: 127713 - DNA, 25 bp, Rattus norvegicus
agccacgggctgactgttggacgat

SEQ ID NO: 127714 - DNA, 25 bp, Rattus norvegicus
agccacgggctgtctgttggacgat

SEQ ID NO: 127715 - DNA, 25 bp, Rattus norvegicus
agccacgggtatccatcaactttta

SEQ ID NO: 127716 - DNA, 25 bp, Rattus norvegicus
agccacgggtatgcatcaactttta

SEQ ID NO: 127717 - DNA, 25 bp, Rattus norvegicus
agccacggtatcagccttttgtgga

SEQ ID NO: 127718 - DNA, 25 bp, Rattus norvegicus
agccacggtatctgccttttgtgga

SEQ ID NO: 127719 - DNA, 25 bp, Rattus norvegicus
agccacggtgggaccatgctgctct

SEQ ID NO: 127720 - DNA, 25 bp, Rattus norvegicus
agccacggtgggtccatgctgctct

SEQ ID NO: 127721 - DNA, 25 bp, Rattus norvegicus
agccacgtcctgctttctgtgtaca

SEQ ID NO: 127722 - DNA, 25 bp, Rattus norvegicus
agccacgtcctggtttctgtgtaca

SEQ ID NO: 127723 - DNA, 25 bp, Rattus norvegicus
agccacgtgcaaagtgtgagctttt

SEQ ID NO: 127724 - DNA, 25 bp, Rattus norvegicus
agccacgtgcaatgtgtgagctttt

SEQ ID NO: 127725 - DNA, 25 bp, Rattus norvegicus
agccacgtgggtacggtcatctaga

SEQ ID NO: 127726 - DNA, 25 bp, Rattus norvegicus
agccacgtgggttcggtcatctaga

SEQ ID NO: 127727 - DNA, 25 bp, Rattus norvegicus
agccacgttctacctggactgaggt

SEQ ID NO: 127728 - DNA, 25 bp, Rattus norvegicus
agccacgttctagctggactgaggt

SEQ ID NO: 127729 - DNA, 25 bp, Rattus norvegicus
agccacgtttatacaggcactgctc

SEQ ID NO: 127730 - DNA, 25 bp, Rattus norvegicus
agccacgtttattcaggcactgctc

SEQ ID NO: 127731 - DNA, 25 bp, Rattus norvegicus
agccactaacagaatctcccaggtt

SEQ ID NO: 127732 - DNA, 25 bp, Rattus norvegicus
agccactaacagtatctcccaggtt

SEQ ID NO: 127733 - DNA, 25 bp, Rattus norvegicus
agccactaatttctacaaaggttgt

SEQ ID NO: 127734 - DNA, 25 bp, Rattus norvegicus
agccactaatttgtacaaaggttgt

SEQ ID NO: 127735 - DNA, 25 bp, Rattus norvegicus
agccactacagacgatcttctgact

SEQ ID NO: 127736 - DNA, 25 bp, Rattus norvegicus
agccactacagaggatcttctgact

SEQ ID NO: 127737 - DNA, 25 bp, Rattus norvegicus
agccactacagcaccaggctgggct

SEQ ID NO: 127738 - DNA, 25 bp, Rattus norvegicus
agccactacagctccaggctgggct

SEQ ID NO: 127739 - DNA, 25 bp, Rattus norvegicus
agccactagcgtatattgctcactt

SEQ ID NO: 127740 - DNA, 25 bp, Rattus norvegicus
agccactagcgtttattgctcactt

SEQ ID NO: 127741 - DNA, 25 bp, Rattus norvegicus
agccactcagagacacttcgataag

SEQ ID NO: 127742 - DNA, 25 bp, Rattus norvegicus
agccactcagagacctcagaacaag

SEQ ID NO: 127743 - DNA, 25 bp, Rattus norvegicus
agccactcagagtcacttcgataag

SEQ ID NO: 127744 - DNA, 25 bp, Rattus norvegicus
agccactcagagtcctcagaacaag

SEQ ID NO: 127745 - DNA, 25 bp, Rattus norvegicus
agccactcagcaccttttcaagagg

SEQ ID NO: 127746 - DNA, 25 bp, Rattus norvegicus
agccactcagcagcttttcaagagg

SEQ ID NO: 127747 - DNA, 25 bp, Rattus norvegicus
agccactcagctagcatttactatt

SEQ ID NO: 127748 - DNA, 25 bp, Rattus norvegicus
agccactcagcttgcatttactatt

SEQ ID NO: 127749 - DNA, 25 bp, Rattus norvegicus
agccactcaggcatctatatcaggg

SEQ ID NO: 127750 - DNA, 25 bp, Rattus norvegicus
agccactcaggcttctatatcaggg

SEQ ID NO: 127751 - DNA, 25 bp, Rattus norvegicus
agccactcatttctgctgattctgg

SEQ ID NO: 127752 - DNA, 25 bp, Rattus norvegicus
agccactcatttgtgctgattctgg

SEQ ID NO: 127753 - DNA, 25 bp, Rattus norvegicus
agccactccagacctgcggagagga

SEQ ID NO: 127754 - DNA, 25 bp, Rattus norvegicus
agccactccagagctgcggagagga

SEQ ID NO: 127755 - DNA, 25 bp, Rattus norvegicus
agccactctaggcacatgctaggta

SEQ ID NO: 127756 - DNA, 25 bp, Rattus norvegicus
agccactctagggacatgctaggta

SEQ ID NO: 127757 - DNA, 25 bp, Rattus norvegicus
agccactctgccctgagagaactcg

SEQ ID NO: 127758 - DNA, 25 bp, Rattus norvegicus
agccactctgccgtgagagaactcg

SEQ ID NO: 127759 - DNA, 25 bp, Rattus norvegicus
agccactctggaaatgcgtcctggt

SEQ ID NO: 127760 - DNA, 25 bp, Rattus norvegicus
agccactctggatatgcgtcctggt

SEQ ID NO: 127761 - DNA, 25 bp, Rattus norvegicus
agccactctgggatctgtctagcaa

SEQ ID NO: 127762 - DNA, 25 bp, Rattus norvegicus
agccactctgggattttgcttgttt

SEQ ID NO: 127763 - DNA, 25 bp, Rattus norvegicus
agccactctgggttctgtctagcaa

SEQ ID NO: 127764 - DNA, 25 bp, Rattus norvegicus
agccactctgggtttttgcttgttt

SEQ ID NO: 127765 - DNA, 25 bp, Rattus norvegicus
agccactcttatatcactgctgaag

SEQ ID NO: 127766 - DNA, 25 bp, Rattus norvegicus
agccactcttatttcactgctgaag

SEQ ID NO: 127767 - DNA, 25 bp, Rattus norvegicus
agccactcttttcaatcacttagca

SEQ ID NO: 127768 - DNA, 25 bp, Rattus norvegicus
agccactcttttgaatcacttagca

SEQ ID NO: 127769 - DNA, 25 bp, Rattus norvegicus
agccactgaagccaggactgacatt

SEQ ID NO: 127770 - DNA, 25 bp, Rattus norvegicus
agccactgaagcgaggactgacatt

SEQ ID NO: 127771 - DNA, 25 bp, Rattus norvegicus
agccactgaagtagaacgacccatg

SEQ ID NO: 127772 - DNA, 25 bp, Rattus norvegicus
agccactgaagttgaacgacccatg

SEQ ID NO: 127773 - DNA, 25 bp, Rattus norvegicus
agccactgagacagaaaccctacca

SEQ ID NO: 127774 - DNA, 25 bp, Rattus norvegicus
agccactgagactgaaaccctacca

SEQ ID NO: 127775 - DNA, 25 bp, Rattus norvegicus
agccactgagtacacacggaacatt

SEQ ID NO: 127776 - DNA, 25 bp, Rattus norvegicus
agccactgagtagacacggaacatt

SEQ ID NO: 127777 - DNA, 25 bp, Rattus norvegicus
agccactgagttaattcctttacct

SEQ ID NO: 127778 - DNA, 25 bp, Rattus norvegicus
agccactgagtttattcctttacct

SEQ ID NO: 127779 - DNA, 25 bp, Rattus norvegicus
agccactgcaacaatctcccaaatg

SEQ ID NO: 127780 - DNA, 25 bp, Rattus norvegicus
agccactgcaactatctcccaaatg

SEQ ID NO: 127781 - DNA, 25 bp, Rattus norvegicus
agccactgccaacgagcgtactgag

SEQ ID NO: 127782 - DNA, 25 bp, Rattus norvegicus
agccactgccaaggagcgtactgag

SEQ ID NO: 127783 - DNA, 25 bp, Rattus norvegicus
agccactgcctaacttacacaatag

SEQ ID NO: 127784 - DNA, 25 bp, Rattus norvegicus
agccactgcctatcttacacaatag

SEQ ID NO: 127785 - DNA, 25 bp, Rattus norvegicus
agccactgctcccagaaggaaattt

SEQ ID NO: 127786 - DNA, 25 bp, Rattus norvegicus
agccactgctccgagaaggaaattt

SEQ ID NO: 127787 - DNA, 25 bp, Rattus norvegicus
agccactgctctctacagaactaca

SEQ ID NO: 127788 - DNA, 25 bp, Rattus norvegicus
agccactgctctgtacagaactaca

SEQ ID NO: 127789 - DNA, 25 bp, Rattus norvegicus
agccactgcttacacttgggtttaa

SEQ ID NO: 127790 - DNA, 25 bp, Rattus norvegicus
agccactgcttagacttgggtttaa

SEQ ID NO: 127791 - DNA, 25 bp, Rattus norvegicus
agccactgcttcacatgtggttgat

SEQ ID NO: 127792 - DNA, 25 bp, Rattus norvegicus
agccactgcttctcatgtggttgat

SEQ ID NO: 127793 - DNA, 25 bp, Rattus norvegicus
agccactgctttcctactgtgtagc

SEQ ID NO: 127794 - DNA, 25 bp, Rattus norvegicus
agccactgctttgctactgtgtagc

SEQ ID NO: 127795 - DNA, 25 bp, Rattus norvegicus
agccactggaggatctgttcttaat

SEQ ID NO: 127796 - DNA, 25 bp, Rattus norvegicus
agccactggaggttctgttcttaat

SEQ ID NO: 127797 - DNA, 25 bp, Rattus norvegicus
agccactgggctcggtcctgagcat

SEQ ID NO: 127798 - DNA, 25 bp, Rattus norvegicus
agccactgggctctgaacttattag

SEQ ID NO: 127799 - DNA, 25 bp, Rattus norvegicus
agccactgggctgggtcctgagcat

SEQ ID NO: 127800 - DNA, 25 bp, Rattus norvegicus
agccactgggctgtgaacttattag

SEQ ID NO: 127801 - DNA, 25 bp, Rattus norvegicus
agccactgtaatcccaagcacactg

SEQ ID NO: 127802 - DNA, 25 bp, Rattus norvegicus
agccactgtaatgccaagcacactg

SEQ ID NO: 127803 - DNA, 25 bp, Rattus norvegicus
agccactgtcagctgagtaccgtga

SEQ ID NO: 127804 - DNA, 25 bp, Rattus norvegicus
agccactgtcaggtgagtaccgtga

SEQ ID NO: 127805 - DNA, 25 bp, Rattus norvegicus
agccactgtcatctgtcctctaagg

SEQ ID NO: 127806 - DNA, 25 bp, Rattus norvegicus
agccactgtcatgtgtcctctaagg

SEQ ID NO: 127807 - DNA, 25 bp, Rattus norvegicus
agccactgtgagcaggatgccagca

SEQ ID NO: 127808 - DNA, 25 bp, Rattus norvegicus
agccactgtgaggaggatgccagca

SEQ ID NO: 127809 - DNA, 25 bp, Rattus norvegicus
agccactgtttgagcctccagagag

SEQ ID NO: 127810 - DNA, 25 bp, Rattus norvegicus
agccactgtttgtgcctccagagag

SEQ ID NO: 127811 - DNA, 25 bp, Rattus norvegicus
agccacttacacacagtcgtcagga

SEQ ID NO: 127812 - DNA, 25 bp, Rattus norvegicus
agccacttacactcagtcgtcagga

SEQ ID NO: 127813 - DNA, 25 bp, Rattus norvegicus
agccacttccagaccaagtctttga

SEQ ID NO: 127814 - DNA, 25 bp, Rattus norvegicus
agccacttccagatgtgaccttaaa

SEQ ID NO: 127815 - DNA, 25 bp, Rattus norvegicus
agccacttccagtccaagtctttga

SEQ ID NO: 127816 - DNA, 25 bp, Rattus norvegicus
agccacttccagttgtgaccttaaa

SEQ ID NO: 127817 - DNA, 25 bp, Rattus norvegicus
agccacttccgaactcttctcgagg

SEQ ID NO: 127818 - DNA, 25 bp, Rattus norvegicus
agccacttccgatctcttctcgagg

SEQ ID NO: 127819 - DNA, 25 bp, Rattus norvegicus
agccacttcgggattgtcgattcaa

SEQ ID NO: 127820 - DNA, 25 bp, Rattus norvegicus
agccacttcgggtttgtcgattcaa

SEQ ID NO: 127821 - DNA, 25 bp, Rattus norvegicus
agccacttcgtaccagctgtatgcc

SEQ ID NO: 127822 - DNA, 25 bp, Rattus norvegicus
agccacttcgtagcagctgtatgcc

SEQ ID NO: 127823 - DNA, 25 bp, Rattus norvegicus
agccacttctgaatgagtccttggg

SEQ ID NO: 127824 - DNA, 25 bp, Rattus norvegicus
agccacttctgattgagtccttggg

SEQ ID NO: 127825 - DNA, 25 bp, Rattus norvegicus
agccacttgccacttaactacattt

SEQ ID NO: 127826 - DNA, 25 bp, Rattus norvegicus
agccacttgccagttaactacattt

SEQ ID NO: 127827 - DNA, 25 bp, Rattus norvegicus
agccacttgttcatccacaaggaaa

SEQ ID NO: 127828 - DNA, 25 bp, Rattus norvegicus
agccacttgttcatttgcactcaga

SEQ ID NO: 127829 - DNA, 25 bp, Rattus norvegicus
agccacttgttcttccacaaggaaa

SEQ ID NO: 127830 - DNA, 25 bp, Rattus norvegicus
agccacttgttcttttgcactcaga

SEQ ID NO: 127831 - DNA, 25 bp, Rattus norvegicus
agccagaacccaaacagttcgccag

SEQ ID NO: 127832 - DNA, 25 bp, Rattus norvegicus
agccagaacccatacagttcgccag

SEQ ID NO: 127833 - DNA, 25 bp, Rattus norvegicus
agccagaactgacgcctaacaggcc

SEQ ID NO: 127834 - DNA, 25 bp, Rattus norvegicus
agccagaactgaggcctaacaggcc

SEQ ID NO: 127835 - DNA, 25 bp, Rattus norvegicus
agccagaagggacgctgtgcttctc

SEQ ID NO: 127836 - DNA, 25 bp, Rattus norvegicus
agccagaagggaggctgtgcttctc

SEQ ID NO: 127837 - DNA, 25 bp, Rattus norvegicus
agccagacaatccacttgcagctct

SEQ ID NO: 127838 - DNA, 25 bp, Rattus norvegicus
agccagacaatcgacttgcagctct

SEQ ID NO: 127839 - DNA, 25 bp, Rattus norvegicus
agccagacactccataccacaatat

SEQ ID NO: 127840 - DNA, 25 bp, Rattus norvegicus
agccagacactcgataccacaatat

SEQ ID NO: 127841 - DNA, 25 bp, Rattus norvegicus
agccagacactgcaggtcacagatg

SEQ ID NO: 127842 - DNA, 25 bp, Rattus norvegicus
agccagacactggaggtcacagatg

SEQ ID NO: 127843 - DNA, 25 bp, Rattus norvegicus
agccagacatggaacctctaggaca

SEQ ID NO: 127844 - DNA, 25 bp, Rattus norvegicus
agccagacatggtacctctaggaca

SEQ ID NO: 127845 - DNA, 25 bp, Rattus norvegicus
agccagacctcacccatgactacag

SEQ ID NO: 127846 - DNA, 25 bp, Rattus norvegicus
agccagacctcagccatgactacag

SEQ ID NO: 127847 - DNA, 25 bp, Rattus norvegicus
agccagacctgtagggcagcggcac

SEQ ID NO: 127848 - DNA, 25 bp, Rattus norvegicus
agccagacctgttgggcagcggcac

SEQ ID NO: 127849 - DNA, 25 bp, Rattus norvegicus
agccagacgctcacggagtgcaagc

SEQ ID NO: 127850 - DNA, 25 bp, Rattus norvegicus
agccagacgctctcggagtgcaagc

SEQ ID NO: 127851 - DNA, 25 bp, Rattus norvegicus
agccagactactagtacacttcctt

SEQ ID NO: 127852 - DNA, 25 bp, Rattus norvegicus
agccagactacttgtacacttcctt

SEQ ID NO: 127853 - DNA, 25 bp, Rattus norvegicus
agccagactggaacccaagcctgtt

SEQ ID NO: 127854 - DNA, 25 bp, Rattus norvegicus
agccagactggatcccaagcctgtt

SEQ ID NO: 127855 - DNA, 25 bp, Rattus norvegicus
agccagactggcaagagcaccctca

SEQ ID NO: 127856 - DNA, 25 bp, Rattus norvegicus
agccagactggcagccagagctcag

SEQ ID NO: 127857 - DNA, 25 bp, Rattus norvegicus
agccagactggctagagcaccctca

SEQ ID NO: 127858 - DNA, 25 bp, Rattus norvegicus
agccagactggctgccagagctcag

SEQ ID NO: 127859 - DNA, 25 bp, Rattus norvegicus
agccagactgtgctacatagcaaat

SEQ ID NO: 127860 - DNA, 25 bp, Rattus norvegicus
agccagactgtggtacatagcaaat

SEQ ID NO: 127861 - DNA, 25 bp, Rattus norvegicus
agccagagaaccaggagaaccaggt

SEQ ID NO: 127862 - DNA, 25 bp, Rattus norvegicus
agccagagaacctggagaaccaggt

SEQ ID NO: 127863 - DNA, 25 bp, Rattus norvegicus
agccagagaagccagtccctgagga

SEQ ID NO: 127864 - DNA, 25 bp, Rattus norvegicus
agccagagaagcgagtccctgagga

SEQ ID NO: 127865 - DNA, 25 bp, Rattus norvegicus
agccagagaggcctgagctagacaa

SEQ ID NO: 127866 - DNA, 25 bp, Rattus norvegicus
agccagagaggcgtgagctagacaa

SEQ ID NO: 127867 - DNA, 25 bp, Rattus norvegicus
agccagagagtgctacagatcgctg

SEQ ID NO: 127868 - DNA, 25 bp, Rattus norvegicus
agccagagagtggtacagatcgctg

SEQ ID NO: 127869 - DNA, 25 bp, Rattus norvegicus
agccagagcaggaggagccgccata

SEQ ID NO: 127870 - DNA, 25 bp, Rattus norvegicus
agccagagcaggtggagccgccata

SEQ ID NO: 127871 - DNA, 25 bp, Rattus norvegicus
agccagagcatgctagcttttaata

SEQ ID NO: 127872 - DNA, 25 bp, Rattus norvegicus
agccagagcatggtagcttttaata

SEQ ID NO: 127873 - DNA, 25 bp, Rattus norvegicus
agccagagcccgcaagtgatcgtga

SEQ ID NO: 127874 - DNA, 25 bp, Rattus norvegicus
agccagagcccggaagtgatcgtga

SEQ ID NO: 127875 - DNA, 25 bp, Rattus norvegicus
agccagagctgcacttggcggctac

SEQ ID NO: 127876 - DNA, 25 bp, Rattus norvegicus
agccagagctgctcttggcggctac

SEQ ID NO: 127877 - DNA, 25 bp, Rattus norvegicus
agccagaggccgcttttcctgaatt

SEQ ID NO: 127878 - DNA, 25 bp, Rattus norvegicus
agccagaggccggttttcctgaatt

SEQ ID NO: 127879 - DNA, 25 bp, Rattus norvegicus
agccagaggctactgacggctcctg

SEQ ID NO: 127880 - DNA, 25 bp, Rattus norvegicus
agccagaggctagtgacggctcctg

SEQ ID NO: 127881 - DNA, 25 bp, Rattus norvegicus
agccagagggctaagaccaagatta

SEQ ID NO: 127882 - DNA, 25 bp, Rattus norvegicus
agccagagggctaggaccagctaca

SEQ ID NO: 127883 - DNA, 25 bp, Rattus norvegicus
agccagagggcttagaccaagatta

SEQ ID NO: 127884 - DNA, 25 bp, Rattus norvegicus
agccagagggcttggaccagctaca

SEQ ID NO: 127885 - DNA, 25 bp, Rattus norvegicus
agccagagggtgatttgcgttgaaa

SEQ ID NO: 127886 - DNA, 25 bp, Rattus norvegicus
agccagagggtgttttgcgttgaaa

SEQ ID NO: 127887 - DNA, 25 bp, Rattus norvegicus
agccagaggtccagtggaagcttct

SEQ ID NO: 127888 - DNA, 25 bp, Rattus norvegicus
agccagaggtcctgtggaagcttct

SEQ ID NO: 127889 - DNA, 25 bp, Rattus norvegicus
agccagagtcacacagtcctgagga

SEQ ID NO: 127890 - DNA, 25 bp, Rattus norvegicus
agccagagtcactcagtcctgagga

SEQ ID NO: 127891 - DNA, 25 bp, Rattus norvegicus
agccagagttggacctgccatttct

SEQ ID NO: 127892 - DNA, 25 bp, Rattus norvegicus
agccagagttggtcctgccatttct

SEQ ID NO: 127893 - DNA, 25 bp, Rattus norvegicus
agccagatatggaggtatatgctta

SEQ ID NO: 127894 - DNA, 25 bp, Rattus norvegicus
agccagatatggtggtatatgctta

SEQ ID NO: 127895 - DNA, 25 bp, Rattus norvegicus
agccagatcatgacagtttaagtag

SEQ ID NO: 127896 - DNA, 25 bp, Rattus norvegicus
agccagatcatgtcagtttaagtag

SEQ ID NO: 127897 - DNA, 25 bp, Rattus norvegicus
agccagatcctgataatccctgtgt

SEQ ID NO: 127898 - DNA, 25 bp, Rattus norvegicus
agccagatcctgcaggcccgagctg

SEQ ID NO: 127899 - DNA, 25 bp, Rattus norvegicus
agccagatcctggaggcccgagctg

SEQ ID NO: 127900 - DNA, 25 bp, Rattus norvegicus
agccagatcctgttaatccctgtgt

SEQ ID NO: 127901 - DNA, 25 bp, Rattus norvegicus
agccagatgcccaagtgtccagcaa

SEQ ID NO: 127902 - DNA, 25 bp, Rattus norvegicus
agccagatgccctagtgtccagcaa

SEQ ID NO: 127903 - DNA, 25 bp, Rattus norvegicus
agccagatgtgaagcccttcctctt

SEQ ID NO: 127904 - DNA, 25 bp, Rattus norvegicus
agccagatgtgatgcccttcctctt

SEQ ID NO: 127905 - DNA, 25 bp, Rattus norvegicus
agccagattcagcagcagcgtgtta

SEQ ID NO: 127906 - DNA, 25 bp, Rattus norvegicus
agccagattcaggagcagcgtgtta

SEQ ID NO: 127907 - DNA, 25 bp, Rattus norvegicus
agccagattggcctgaatttcatag

SEQ ID NO: 127908 - DNA, 25 bp, Rattus norvegicus
agccagattggcgtgaatttcatag

SEQ ID NO: 127909 - DNA, 25 bp, Rattus norvegicus
agccagcaaaacagccagccgggag

SEQ ID NO: 127910 - DNA, 25 bp, Rattus norvegicus
agccagcaaaactgccagccgggag

SEQ ID NO: 127911 - DNA, 25 bp, Rattus norvegicus
agccagcaactcatgggagcctgga

SEQ ID NO: 127912 - DNA, 25 bp, Rattus norvegicus
agccagcaactcttgggagcctgga

SEQ ID NO: 127913 - DNA, 25 bp, Rattus norvegicus
agccagcaagccaagggccctgata

SEQ ID NO: 127914 - DNA, 25 bp, Rattus norvegicus
agccagcaagcctagggccctgata

SEQ ID NO: 127915 - DNA, 25 bp, Rattus norvegicus
agccagcacagcacccggggtgaca

SEQ ID NO: 127916 - DNA, 25 bp, Rattus norvegicus
agccagcacagctcccggggtgaca

SEQ ID NO: 127917 - DNA, 25 bp, Rattus norvegicus
agccagcactgacttctttcattga

SEQ ID NO: 127918 - DNA, 25 bp, Rattus norvegicus
agccagcactgagttctttcattga

SEQ ID NO: 127919 - DNA, 25 bp, Rattus norvegicus
agccagcactggacctatgggttgc

SEQ ID NO: 127920 - DNA, 25 bp, Rattus norvegicus
agccagcactggtcctatgggttgc

SEQ ID NO: 127921 - DNA, 25 bp, Rattus norvegicus
agccagcactgtccggtcctggagt

SEQ ID NO: 127922 - DNA, 25 bp, Rattus norvegicus
agccagcactgtgcggtcctggagt

SEQ ID NO: 127923 - DNA, 25 bp, Rattus norvegicus
agccagcagagacaggatgtaatcc

SEQ ID NO: 127924 - DNA, 25 bp, Rattus norvegicus
agccagcagagagaggatgtaatcc

SEQ ID NO: 127925 - DNA, 25 bp, Rattus norvegicus
agccagcagcagatttcagaagcct

SEQ ID NO: 127926 - DNA, 25 bp, Rattus norvegicus
agccagcagcagttttcagaagcct

SEQ ID NO: 127927 - DNA, 25 bp, Rattus norvegicus
agccagcagctcagtcatgttggag

SEQ ID NO: 127928 - DNA, 25 bp, Rattus norvegicus
agccagcagctctgtcatgttggag

SEQ ID NO: 127929 - DNA, 25 bp, Rattus norvegicus
agccagcaggacacccatgaggcct

SEQ ID NO: 127930 - DNA, 25 bp, Rattus norvegicus
agccagcaggactcccatgaggcct

SEQ ID NO: 127931 - DNA, 25 bp, Rattus norvegicus
agccagcaggctcagtttacaaacc

SEQ ID NO: 127932 - DNA, 25 bp, Rattus norvegicus
agccagcaggctgagtttacaaacc

SEQ ID NO: 127933 - DNA, 25 bp, Rattus norvegicus
agccagcatactcccatgttactta

SEQ ID NO: 127934 - DNA, 25 bp, Rattus norvegicus
agccagcatactgccatgttactta

SEQ ID NO: 127935 - DNA, 25 bp, Rattus norvegicus
agccagcatccgagagtgagcagcc

SEQ ID NO: 127936 - DNA, 25 bp, Rattus norvegicus
agccagcatccgtgagtgagcagcc

SEQ ID NO: 127937 - DNA, 25 bp, Rattus norvegicus
agccagcatggtcaggcattcctgt

SEQ ID NO: 127938 - DNA, 25 bp, Rattus norvegicus
agccagcatggtgaggcattcctgt

SEQ ID NO: 127939 - DNA, 25 bp, Rattus norvegicus
agccagcatgttcacctggactgag

SEQ ID NO: 127940 - DNA, 25 bp, Rattus norvegicus
agccagcatgttgacctggactgag

SEQ ID NO: 127941 - DNA, 25 bp, Rattus norvegicus
agccagccaagaagagtctttgcta

SEQ ID NO: 127942 - DNA, 25 bp, Rattus norvegicus
agccagccaagatgagtctttgcta

SEQ ID NO: 127943 - DNA, 25 bp, Rattus norvegicus
agccagccaccaagtcaagcgggtg

SEQ ID NO: 127944 - DNA, 25 bp, Rattus norvegicus
agccagccaccatgtcaagcgggtg

SEQ ID NO: 127945 - DNA, 25 bp, Rattus norvegicus
agccagccacctattcagacctaaa

SEQ ID NO: 127946 - DNA, 25 bp, Rattus norvegicus
agccagccaccttttcagacctaaa

SEQ ID NO: 127947 - DNA, 25 bp, Rattus norvegicus
agccagccacggcaaatatcttatg

SEQ ID NO: 127948 - DNA, 25 bp, Rattus norvegicus
agccagccacgggaaatatcttatg

SEQ ID NO: 127949 - DNA, 25 bp, Rattus norvegicus
agccagccacttaaacacttcttta

SEQ ID NO: 127950 - DNA, 25 bp, Rattus norvegicus
agccagccactttaacacttcttta

SEQ ID NO: 127951 - DNA, 25 bp, Rattus norvegicus
agccagccagctctgatagcctgtg

SEQ ID NO: 127952 - DNA, 25 bp, Rattus norvegicus
agccagccagctgtgatagcctgtg

SEQ ID NO: 127953 - DNA, 25 bp, Rattus norvegicus
agccagccagggatgtatgtgtata

SEQ ID NO: 127954 - DNA, 25 bp, Rattus norvegicus
agccagccagggttgtatgtgtata

SEQ ID NO: 127955 - DNA, 25 bp, Rattus norvegicus
agccagccagtcaataaaccatcca

SEQ ID NO: 127956 - DNA, 25 bp, Rattus norvegicus
agccagccagtcaggtggccatgat

SEQ ID NO: 127957 - DNA, 25 bp, Rattus norvegicus
agccagccagtctataaaccatcca

SEQ ID NO: 127958 - DNA, 25 bp, Rattus norvegicus
agccagccagtctggtggccatgat

SEQ ID NO: 127959 - DNA, 25 bp, Rattus norvegicus
agccagccatcccttgagaagatct

SEQ ID NO: 127960 - DNA, 25 bp, Rattus norvegicus
agccagccatccgttgagaagatct

SEQ ID NO: 127961 - DNA, 25 bp, Rattus norvegicus
agccagcccatgagtaatacgttct

SEQ ID NO: 127962 - DNA, 25 bp, Rattus norvegicus
agccagcccatgtgtaatacgttct

SEQ ID NO: 127963 - DNA, 25 bp, Rattus norvegicus
agccagccccagctagccaggtgtg

SEQ ID NO: 127964 - DNA, 25 bp, Rattus norvegicus
agccagccccaggtagccaggtgtg

SEQ ID NO: 127965 - DNA, 25 bp, Rattus norvegicus
agccagcccccacgtagaaacgtgg

SEQ ID NO: 127966 - DNA, 25 bp, Rattus norvegicus
agccagcccccaggtagaaacgtgg

SEQ ID NO: 127967 - DNA, 25 bp, Rattus norvegicus
agccagccccgaacaaactgggaga

SEQ ID NO: 127968 - DNA, 25 bp, Rattus norvegicus
agccagccccgatcaaactgggaga

SEQ ID NO: 127969 - DNA, 25 bp, Rattus norvegicus
agccagcccctaaatattgttctta

SEQ ID NO: 127970 - DNA, 25 bp, Rattus norvegicus
agccagcccctatatattgttctta

SEQ ID NO: 127971 - DNA, 25 bp, Rattus norvegicus
agccagcccgctccaatgagaagaa

SEQ ID NO: 127972 - DNA, 25 bp, Rattus norvegicus
agccagcccgctgcaatgagaagaa

SEQ ID NO: 127973 - DNA, 25 bp, Rattus norvegicus
agccagcccggcaatggtagtacat

SEQ ID NO: 127974 - DNA, 25 bp, Rattus norvegicus
agccagcccggctatggtagtacat

SEQ ID NO: 127975 - DNA, 25 bp, Rattus norvegicus
agccagcctaaacgcgttgttgctt

SEQ ID NO: 127976 - DNA, 25 bp, Rattus norvegicus
agccagcctaaaggcgttgttgctt

SEQ ID NO: 127977 - DNA, 25 bp, Rattus norvegicus
agccagcctggactaatgagactgt

SEQ ID NO: 127978 - DNA, 25 bp, Rattus norvegicus
agccagcctggagtaatgagactgt

SEQ ID NO: 127979 - DNA, 25 bp, Rattus norvegicus
agccagcctggccatctgtgagaag

SEQ ID NO: 127980 - DNA, 25 bp, Rattus norvegicus
agccagcctggcgatctgtgagaag

SEQ ID NO: 127981 - DNA, 25 bp, Rattus norvegicus
agccagcctgtacttatctgtgtac

SEQ ID NO: 127982 - DNA, 25 bp, Rattus norvegicus
agccagcctgtagttatctgtgtac

SEQ ID NO: 127983 - DNA, 25 bp, Rattus norvegicus
agccagccttcgaaagctttgcaac

SEQ ID NO: 127984 - DNA, 25 bp, Rattus norvegicus
agccagccttcgtaagctttgcaac

SEQ ID NO: 127985 - DNA, 25 bp, Rattus norvegicus
agccagcctttgagggcctgaagac

SEQ ID NO: 127986 - DNA, 25 bp, Rattus norvegicus
agccagcctttgtgggcctgaagac

SEQ ID NO: 127987 - DNA, 25 bp, Rattus norvegicus
agccagcgccccaaagtttttcaga

SEQ ID NO: 127988 - DNA, 25 bp, Rattus norvegicus
agccagcgccccaaggagatttatg

SEQ ID NO: 127989 - DNA, 25 bp, Rattus norvegicus
agccagcgcccctaagtttttcaga

SEQ ID NO: 127990 - DNA, 25 bp, Rattus norvegicus
agccagcgcccctaggagatttatg

SEQ ID NO: 127991 - DNA, 25 bp, Rattus norvegicus
agccagcggaccaggaactccagtt

SEQ ID NO: 127992 - DNA, 25 bp, Rattus norvegicus
agccagcggacctggaactccagtt

SEQ ID NO: 127993 - DNA, 25 bp, Rattus norvegicus
agccagctaaggacggcgcggcctc

SEQ ID NO: 127994 - DNA, 25 bp, Rattus norvegicus
agccagctaaggtcggcgcggcctc

SEQ ID NO: 127995 - DNA, 25 bp, Rattus norvegicus
agccagctacggcaatcacttgtct

SEQ ID NO: 127996 - DNA, 25 bp, Rattus norvegicus
agccagctacgggaatcacttgtct

SEQ ID NO: 127997 - DNA, 25 bp, Rattus norvegicus
agccagctcctaagaatacctccat

SEQ ID NO: 127998 - DNA, 25 bp, Rattus norvegicus
agccagctcctatgaatacctccat

SEQ ID NO: 127999 - DNA, 25 bp, Rattus norvegicus
agccagctcctgaagatacacttcg

SEQ ID NO: 128000 - DNA, 25 bp, Rattus norvegicus
agccagctcctgtagatacacttcg

SEQ ID NO: 128001 - DNA, 25 bp, Rattus norvegicus
agccagctctctagtatgtttataa

SEQ ID NO: 128002 - DNA, 25 bp, Rattus norvegicus
agccagctctcttgtatgtttataa

SEQ ID NO: 128003 - DNA, 25 bp, Rattus norvegicus
agccagctgaggattcgtgtgctct

SEQ ID NO: 128004 - DNA, 25 bp, Rattus norvegicus
agccagctgaggtttcgtgtgctct

SEQ ID NO: 128005 - DNA, 25 bp, Rattus norvegicus
agccagctgctcaatgacggataca

SEQ ID NO: 128006 - DNA, 25 bp, Rattus norvegicus
agccagctgctctatgacggataca

SEQ ID NO: 128007 - DNA, 25 bp, Rattus norvegicus
agccagctggctacttagacattga

SEQ ID NO: 128008 - DNA, 25 bp, Rattus norvegicus
agccagctggcttcttagacattga

SEQ ID NO: 128009 - DNA, 25 bp, Rattus norvegicus
agccagctgggaccctgacaacagg

SEQ ID NO: 128010 - DNA, 25 bp, Rattus norvegicus
agccagctgggagcctgacaacagg

SEQ ID NO: 128011 - DNA, 25 bp, Rattus norvegicus
agccagctgtggaatttctgaccaa

SEQ ID NO: 128012 - DNA, 25 bp, Rattus norvegicus
agccagctgtggatgaacttgaaaa

SEQ ID NO: 128013 - DNA, 25 bp, Rattus norvegicus
agccagctgtggtatttctgaccaa

SEQ ID NO: 128014 - DNA, 25 bp, Rattus norvegicus
agccagctgtggttgaacttgaaaa

SEQ ID NO: 128015 - DNA, 25 bp, Rattus norvegicus
agccagctgttccacactgtattat

SEQ ID NO: 128016 - DNA, 25 bp, Rattus norvegicus
agccagctgttcgacactgtattat

SEQ ID NO: 128017 - DNA, 25 bp, Rattus norvegicus
agccagctgttgaggatgcctttga

SEQ ID NO: 128018 - DNA, 25 bp, Rattus norvegicus
agccagctgttgtggatgcctttga

SEQ ID NO: 128019 - DNA, 25 bp, Rattus norvegicus
agccagcttaagctcacgtgagtca

SEQ ID NO: 128020 - DNA, 25 bp, Rattus norvegicus
agccagcttaaggtcacgtgagtca

SEQ ID NO: 128021 - DNA, 25 bp, Rattus norvegicus
agccagcttcacacagacaacaaag

SEQ ID NO: 128022 - DNA, 25 bp, Rattus norvegicus
agccagcttcactcagacaacaaag

SEQ ID NO: 128023 - DNA, 25 bp, Rattus norvegicus
agccagcttggtcaagttttactac

SEQ ID NO: 128024 - DNA, 25 bp, Rattus norvegicus
agccagcttggtgaagttttactac

SEQ ID NO: 128025 - DNA, 25 bp, Rattus norvegicus
agccagcttgttatctcacacatgg

SEQ ID NO: 128026 - DNA, 25 bp, Rattus norvegicus
agccagcttgttttctcacacatgg

SEQ ID NO: 128027 - DNA, 25 bp, Rattus norvegicus
agccaggaacggaggtcggtcatct

SEQ ID NO: 128028 - DNA, 25 bp, Rattus norvegicus
agccaggaacggtggtcggtcatct

SEQ ID NO: 128029 - DNA, 25 bp, Rattus norvegicus
agccaggaagccctggattcaatcc

SEQ ID NO: 128030 - DNA, 25 bp, Rattus norvegicus
agccaggaagccgtggattcaatcc

SEQ ID NO: 128031 - DNA, 25 bp, Rattus norvegicus
agccaggaaggcatgctcactgtca

SEQ ID NO: 128032 - DNA, 25 bp, Rattus norvegicus
agccaggaaggcttgctcactgtca

SEQ ID NO: 128033 - DNA, 25 bp, Rattus norvegicus
agccaggacctgcagatggatgtca

SEQ ID NO: 128034 - DNA, 25 bp, Rattus norvegicus
agccaggacctggagatggatgtca

SEQ ID NO: 128035 - DNA, 25 bp, Rattus norvegicus
agccaggactaaagagaccccatct

SEQ ID NO: 128036 - DNA, 25 bp, Rattus norvegicus
agccaggactaatgagaccccatct

SEQ ID NO: 128037 - DNA, 25 bp, Rattus norvegicus
agccaggagcctaggcacccgcaat

SEQ ID NO: 128038 - DNA, 25 bp, Rattus norvegicus
agccaggagccttggcacccgcaat

SEQ ID NO: 128039 - DNA, 25 bp, Rattus norvegicus
agccaggcagacagtctacttttat

SEQ ID NO: 128040 - DNA, 25 bp, Rattus norvegicus
agccaggcagactgtctacttttat

SEQ ID NO: 128041 - DNA, 25 bp, Rattus norvegicus
agccaggcagcgacctgcagagccg

SEQ ID NO: 128042 - DNA, 25 bp, Rattus norvegicus
agccaggcagcgtcctgcagagccg

SEQ ID NO: 128043 - DNA, 25 bp, Rattus norvegicus
agccaggccattcttggaactcctt

SEQ ID NO: 128044 - DNA, 25 bp, Rattus norvegicus
agccaggccattgttggaactcctt

SEQ ID NO: 128045 - DNA, 25 bp, Rattus norvegicus
agccaggcccctaatgaggacttgt

SEQ ID NO: 128046 - DNA, 25 bp, Rattus norvegicus
agccaggccccttatgaggacttgt

SEQ ID NO: 128047 - DNA, 25 bp, Rattus norvegicus
agccaggcccttagttctatttgtt

SEQ ID NO: 128048 - DNA, 25 bp, Rattus norvegicus
agccaggccctttgttctatttgtt

SEQ ID NO: 128049 - DNA, 25 bp, Rattus norvegicus
agccaggcctcacctatagcataat

SEQ ID NO: 128050 - DNA, 25 bp, Rattus norvegicus
agccaggcctcagctatagcataat

SEQ ID NO: 128051 - DNA, 25 bp, Rattus norvegicus
agccaggcctccctttggagcaatt

SEQ ID NO: 128052 - DNA, 25 bp, Rattus norvegicus
agccaggcctccgtttggagcaatt

SEQ ID NO: 128053 - DNA, 25 bp, Rattus norvegicus
agccaggcctctactgagcaggaag

SEQ ID NO: 128054 - DNA, 25 bp, Rattus norvegicus
agccaggcctcttctgagcaggaag

SEQ ID NO: 128055 - DNA, 25 bp, Rattus norvegicus
agccaggcctttagtatctttgtaa

SEQ ID NO: 128056 - DNA, 25 bp, Rattus norvegicus
agccaggccttttgtatctttgtaa

SEQ ID NO: 128057 - DNA, 25 bp, Rattus norvegicus
agccaggctaagctgcagtcagtta

SEQ ID NO: 128058 - DNA, 25 bp, Rattus norvegicus
agccaggctaaggtgcagtcagtta

SEQ ID NO: 128059 - DNA, 25 bp, Rattus norvegicus
agccaggctagaactcttgaattca

SEQ ID NO: 128060 - DNA, 25 bp, Rattus norvegicus
agccaggctagaatctcaccattag

SEQ ID NO: 128061 - DNA, 25 bp, Rattus norvegicus
agccaggctagatctcttgaattca

SEQ ID NO: 128062 - DNA, 25 bp, Rattus norvegicus
agccaggctagattctcaccattag

SEQ ID NO: 128063 - DNA, 25 bp, Rattus norvegicus
agccaggctcctccagtttgtgaca

SEQ ID NO: 128064 - DNA, 25 bp, Rattus norvegicus
agccaggctcctgcagtttgtgaca

SEQ ID NO: 128065 - DNA, 25 bp, Rattus norvegicus
agccaggctgatcccctgaagtatg

SEQ ID NO: 128066 - DNA, 25 bp, Rattus norvegicus
agccaggctgatgccctgaagtatg

SEQ ID NO: 128067 - DNA, 25 bp, Rattus norvegicus
agccaggctgccatcgaggagctca

SEQ ID NO: 128068 - DNA, 25 bp, Rattus norvegicus
agccaggctgccttcgaggagctca

SEQ ID NO: 128069 - DNA, 25 bp, Rattus norvegicus
agccagggaaccagccagcctctga

SEQ ID NO: 128070 - DNA, 25 bp, Rattus norvegicus
agccagggaacctgccagcctctga

SEQ ID NO: 128071 - DNA, 25 bp, Rattus norvegicus
agccagggaccacggccttcgtgtc

SEQ ID NO: 128072 - DNA, 25 bp, Rattus norvegicus
agccagggaccagggccttcgtgtc

SEQ ID NO: 128073 - DNA, 25 bp, Rattus norvegicus
agccagggcatccttcaggaggttt

SEQ ID NO: 128074 - DNA, 25 bp, Rattus norvegicus
agccagggcatcgttcaggaggttt

SEQ ID NO: 128075 - DNA, 25 bp, Rattus norvegicus
agccagggcctgaagtaggtcttga

SEQ ID NO: 128076 - DNA, 25 bp, Rattus norvegicus
agccagggcctgctgatattcagcg

SEQ ID NO: 128077 - DNA, 25 bp, Rattus norvegicus
agccagggcctggtgatattcagcg

SEQ ID NO: 128078 - DNA, 25 bp, Rattus norvegicus
agccagggcctgtagtaggtcttga

SEQ ID NO: 128079 - DNA, 25 bp, Rattus norvegicus
agccagggctacattagcagcctct

SEQ ID NO: 128080 - DNA, 25 bp, Rattus norvegicus
agccagggctactttagcagcctct

SEQ ID NO: 128081 - DNA, 25 bp, Rattus norvegicus
agccagggcttcattagcttttatt

SEQ ID NO: 128082 - DNA, 25 bp, Rattus norvegicus
agccagggcttctttagcttttatt

SEQ ID NO: 128083 - DNA, 25 bp, Rattus norvegicus
agccagggtaacatgcaaacgtata

SEQ ID NO: 128084 - DNA, 25 bp, Rattus norvegicus
agccagggtaacttgcaaacgtata

SEQ ID NO: 128085 - DNA, 25 bp, Rattus norvegicus
agccagggtcctcatggagagtcca

SEQ ID NO: 128086 - DNA, 25 bp, Rattus norvegicus
agccagggtcctgatggagagtcca

SEQ ID NO: 128087 - DNA, 25 bp, Rattus norvegicus
agccagggtcttctatagcactaac

SEQ ID NO: 128088 - DNA, 25 bp, Rattus norvegicus
agccagggtcttgtatagcactaac

SEQ ID NO: 128089 - DNA, 25 bp, Rattus norvegicus
agccagggtggcagagaagttttcc

SEQ ID NO: 128090 - DNA, 25 bp, Rattus norvegicus
agccagggtggctgagaagttttcc

SEQ ID NO: 128091 - DNA, 25 bp, Rattus norvegicus
agccagggtgttacatactttatat

SEQ ID NO: 128092 - DNA, 25 bp, Rattus norvegicus
agccagggtgtttcatactttatat

SEQ ID NO: 128093 - DNA, 25 bp, Rattus norvegicus
agccaggtaccgacgaggtcagtca

SEQ ID NO: 128094 - DNA, 25 bp, Rattus norvegicus
agccaggtaccgtcgaggtcagtca

SEQ ID NO: 128095 - DNA, 25 bp, Rattus norvegicus
agccaggtcccgagtgtacagcaca

SEQ ID NO: 128096 - DNA, 25 bp, Rattus norvegicus
agccaggtcccgtgtgtacagcaca

SEQ ID NO: 128097 - DNA, 25 bp, Rattus norvegicus
agccaggtccgtagcagagtagact

SEQ ID NO: 128098 - DNA, 25 bp, Rattus norvegicus
agccaggtccgttgcagagtagact

SEQ ID NO: 128099 - DNA, 25 bp, Rattus norvegicus
agccaggtcctaaagccttttctag

SEQ ID NO: 128100 - DNA, 25 bp, Rattus norvegicus
agccaggtcctatagccttttctag

SEQ ID NO: 128101 - DNA, 25 bp, Rattus norvegicus
agccaggtctccctttggaatgaag

SEQ ID NO: 128102 - DNA, 25 bp, Rattus norvegicus
agccaggtctccgtttggaatgaag

SEQ ID NO: 128103 - DNA, 25 bp, Rattus norvegicus
agccaggtctgcaaaagggccccag

SEQ ID NO: 128104 - DNA, 25 bp, Rattus norvegicus
agccaggtctgctaaagggccccag

SEQ ID NO: 128105 - DNA, 25 bp, Rattus norvegicus
agccaggtgaatctgatgtcccgca

SEQ ID NO: 128106 - DNA, 25 bp, Rattus norvegicus
agccaggtgaatgtgatgtcccgca

SEQ ID NO: 128107 - DNA, 25 bp, Rattus norvegicus
agccaggtgaccagaacttcagcag

SEQ ID NO: 128108 - DNA, 25 bp, Rattus norvegicus
agccaggtgacccttgtttttgcag

SEQ ID NO: 128109 - DNA, 25 bp, Rattus norvegicus
agccaggtgaccgttgtttttgcag

SEQ ID NO: 128110 - DNA, 25 bp, Rattus norvegicus
agccaggtgacctgaacttcagcag

SEQ ID NO: 128111 - DNA, 25 bp, Rattus norvegicus
agccaggtgattcctcagtgagtgc

SEQ ID NO: 128112 - DNA, 25 bp, Rattus norvegicus
agccaggtgattgctcagtgagtgc

SEQ ID NO: 128113 - DNA, 25 bp, Rattus norvegicus
agccaggtgcctcttcaggtaaagg

SEQ ID NO: 128114 - DNA, 25 bp, Rattus norvegicus
agccaggtgcctgttcaggtaaagg

SEQ ID NO: 128115 - DNA, 25 bp, Rattus norvegicus
agccaggtgtgcctagcgcattgcc

SEQ ID NO: 128116 - DNA, 25 bp, Rattus norvegicus
agccaggtgtgcctgtgtttcccgc

SEQ ID NO: 128117 - DNA, 25 bp, Rattus norvegicus
agccaggtgtgcgtagcgcattgcc

SEQ ID NO: 128118 - DNA, 25 bp, Rattus norvegicus
agccaggtgtgcgtgtgtttcccgc

SEQ ID NO: 128119 - DNA, 25 bp, Rattus norvegicus
agccaggttagcatgtgctctgaca

SEQ ID NO: 128120 - DNA, 25 bp, Rattus norvegicus
agccaggttagcttgtgctctgaca

SEQ ID NO: 128121 - DNA, 25 bp, Rattus norvegicus
agccaggttgtgacctaaccatctt

SEQ ID NO: 128122 - DNA, 25 bp, Rattus norvegicus
agccaggttgtgtcctaaccatctt

SEQ ID NO: 128123 - DNA, 25 bp, Rattus norvegicus
agccagtaatttctgtgcaacctta

SEQ ID NO: 128124 - DNA, 25 bp, Rattus norvegicus
agccagtaatttgtgtgcaacctta

SEQ ID NO: 128125 - DNA, 25 bp, Rattus norvegicus
agccagtactagcacattgctgact

SEQ ID NO: 128126 - DNA, 25 bp, Rattus norvegicus
agccagtactaggacattgctgact

SEQ ID NO: 128127 - DNA, 25 bp, Rattus norvegicus
agccagtacttgctgtcactggcgg

SEQ ID NO: 128128 - DNA, 25 bp, Rattus norvegicus
agccagtacttggtgtcactggcgg

SEQ ID NO: 128129 - DNA, 25 bp, Rattus norvegicus
agccagtaggatccttcctgaacaa

SEQ ID NO: 128130 - DNA, 25 bp, Rattus norvegicus
agccagtaggatgcttcctgaacaa

SEQ ID NO: 128131 - DNA, 25 bp, Rattus norvegicus
agccagtatctgatagcctgcctca

SEQ ID NO: 128132 - DNA, 25 bp, Rattus norvegicus
agccagtatctgttagcctgcctca

SEQ ID NO: 128133 - DNA, 25 bp, Rattus norvegicus
agccagtatggtctcagtcctgccc

SEQ ID NO: 128134 - DNA, 25 bp, Rattus norvegicus
agccagtatggtgtcagtcctgccc

SEQ ID NO: 128135 - DNA, 25 bp, Rattus norvegicus
agccagtatttgaggtgctcctgcc

SEQ ID NO: 128136 - DNA, 25 bp, Rattus norvegicus
agccagtatttgtggtgctcctgcc

SEQ ID NO: 128137 - DNA, 25 bp, Rattus norvegicus
agccagtcaaaacagggtgcacacc

SEQ ID NO: 128138 - DNA, 25 bp, Rattus norvegicus
agccagtcaaaagagggtgcacacc

SEQ ID NO: 128139 - DNA, 25 bp, Rattus norvegicus
agccagtcacgcactaagtgttggg

SEQ ID NO: 128140 - DNA, 25 bp, Rattus norvegicus
agccagtcacgctctaagtgttggg

SEQ ID NO: 128141 - DNA, 25 bp, Rattus norvegicus
agccagtcagacagcctcagaggat

SEQ ID NO: 128142 - DNA, 25 bp, Rattus norvegicus
agccagtcagaccttgaaattccag

SEQ ID NO: 128143 - DNA, 25 bp, Rattus norvegicus
agccagtcagacgttgaaattccag

SEQ ID NO: 128144 - DNA, 25 bp, Rattus norvegicus
agccagtcagactgcctcagaggat

SEQ ID NO: 128145 - DNA, 25 bp, Rattus norvegicus
agccagtcagcaagagcgagctcta

SEQ ID NO: 128146 - DNA, 25 bp, Rattus norvegicus
agccagtcagcatgagcgagctcta

SEQ ID NO: 128147 - DNA, 25 bp, Rattus norvegicus
agccagtcagcgcatccaggccaga

SEQ ID NO: 128148 - DNA, 25 bp, Rattus norvegicus
agccagtcagcggatccaggccaga

SEQ ID NO: 128149 - DNA, 25 bp, Rattus norvegicus
agccagtcagctcctttataaagaa

SEQ ID NO: 128150 - DNA, 25 bp, Rattus norvegicus
agccagtcagctgctttataaagaa

SEQ ID NO: 128151 - DNA, 25 bp, Rattus norvegicus
agccagtcagtcacctgagtcaaga

SEQ ID NO: 128152 - DNA, 25 bp, Rattus norvegicus
agccagtcagtctcctgagtcaaga

SEQ ID NO: 128153 - DNA, 25 bp, Rattus norvegicus
agccagtcccagagccggttgattt

SEQ ID NO: 128154 - DNA, 25 bp, Rattus norvegicus
agccagtcccagtgccggttgattt

SEQ ID NO: 128155 - DNA, 25 bp, Rattus norvegicus
agccagtccctaaacacttgtttga

SEQ ID NO: 128156 - DNA, 25 bp, Rattus norvegicus
agccagtccctatacacttgtttga

SEQ ID NO: 128157 - DNA, 25 bp, Rattus norvegicus
agccagtccgaacagacccgtgtgt

SEQ ID NO: 128158 - DNA, 25 bp, Rattus norvegicus
agccagtccgaagagacccgtgtgt

SEQ ID NO: 128159 - DNA, 25 bp, Rattus norvegicus
agccagtccgccacagtggagtaga

SEQ ID NO: 128160 - DNA, 25 bp, Rattus norvegicus
agccagtccgcctcagtggagtaga

SEQ ID NO: 128161 - DNA, 25 bp, Rattus norvegicus
agccagtccgctaccaggctttctt

SEQ ID NO: 128162 - DNA, 25 bp, Rattus norvegicus
agccagtccgcttccaggctttctt

SEQ ID NO: 128163 - DNA, 25 bp, Rattus norvegicus
agccagtccttccagaagccaaaga

SEQ ID NO: 128164 - DNA, 25 bp, Rattus norvegicus
agccagtccttcgagaagccaaaga

SEQ ID NO: 128165 - DNA, 25 bp, Rattus norvegicus
agccagtctatccatgtgcacatgc

SEQ ID NO: 128166 - DNA, 25 bp, Rattus norvegicus
agccagtctatcgatgtgcacatgc

SEQ ID NO: 128167 - DNA, 25 bp, Rattus norvegicus
agccagtctccccaaggtggaaaga

SEQ ID NO: 128168 - DNA, 25 bp, Rattus norvegicus
agccagtctcccgaaggtggaaaga

SEQ ID NO: 128169 - DNA, 25 bp, Rattus norvegicus
agccagtctcttagtttaaacgtat

SEQ ID NO: 128170 - DNA, 25 bp, Rattus norvegicus
agccagtctctttgtttaaacgtat

SEQ ID NO: 128171 - DNA, 25 bp, Rattus norvegicus
agccagtctgatagtgagcctgcca

SEQ ID NO: 128172 - DNA, 25 bp, Rattus norvegicus
agccagtctgattgtgagcctgcca

SEQ ID NO: 128173 - DNA, 25 bp, Rattus norvegicus
agccagtcttgtctaccgagtaagt

SEQ ID NO: 128174 - DNA, 25 bp, Rattus norvegicus
agccagtcttgtgtaccgagtaagt

SEQ ID NO: 128175 - DNA, 25 bp, Rattus norvegicus
agccagtgactgatgctacaattca

SEQ ID NO: 128176 - DNA, 25 bp, Rattus norvegicus
agccagtgactgttgctacaattca

SEQ ID NO: 128177 - DNA, 25 bp, Rattus norvegicus
agccagtgaggcaatactggcctca

SEQ ID NO: 128178 - DNA, 25 bp, Rattus norvegicus
agccagtgaggctatactggcctca

SEQ ID NO: 128179 - DNA, 25 bp, Rattus norvegicus
agccagtgagtgcacctttgccctg

SEQ ID NO: 128180 - DNA, 25 bp, Rattus norvegicus
agccagtgagtggacctttgccctg

SEQ ID NO: 128181 - DNA, 25 bp, Rattus norvegicus
agccagtgctaaccttttgcttagt

SEQ ID NO: 128182 - DNA, 25 bp, Rattus norvegicus
agccagtgctaagcttttgcttagt

SEQ ID NO: 128183 - DNA, 25 bp, Rattus norvegicus
agccagtgctggcaacacttctaca

SEQ ID NO: 128184 - DNA, 25 bp, Rattus norvegicus
agccagtgctgggaacacttctaca

SEQ ID NO: 128185 - DNA, 25 bp, Rattus norvegicus
agccagtggccactaggcactactg

SEQ ID NO: 128186 - DNA, 25 bp, Rattus norvegicus
agccagtggccagtaggcactactg

SEQ ID NO: 128187 - DNA, 25 bp, Rattus norvegicus
agccagtggcgcattgcaaactcaa

SEQ ID NO: 128188 - DNA, 25 bp, Rattus norvegicus
agccagtggcgctttgcaaactcaa

SEQ ID NO: 128189 - DNA, 25 bp, Rattus norvegicus
agccagtgtccgaagagttgccagc

SEQ ID NO: 128190 - DNA, 25 bp, Rattus norvegicus
agccagtgtccgtagagttgccagc

SEQ ID NO: 128191 - DNA, 25 bp, Rattus norvegicus
agccagtgtgtaagaagcgtccctc

SEQ ID NO: 128192 - DNA, 25 bp, Rattus norvegicus
agccagtgtgtatgaagcgtccctc

SEQ ID NO: 128193 - DNA, 25 bp, Rattus norvegicus
agccagtgttttcgtagtggcccct

SEQ ID NO: 128194 - DNA, 25 bp, Rattus norvegicus
agccagtgttttggtagtggcccct

SEQ ID NO: 128195 - DNA, 25 bp, Rattus norvegicus
agccagttacatcctgagtgccagc

SEQ ID NO: 128196 - DNA, 25 bp, Rattus norvegicus
agccagttacatgctgagtgccagc

SEQ ID NO: 128197 - DNA, 25 bp, Rattus norvegicus
agccagttagggaccatgggtgact

SEQ ID NO: 128198 - DNA, 25 bp, Rattus norvegicus
agccagttagggtccatgggtgact

SEQ ID NO: 128199 - DNA, 25 bp, Rattus norvegicus
agccagttgtaaaggtacctgccaa

SEQ ID NO: 128200 - DNA, 25 bp, Rattus norvegicus
agccagttgtaatggtacctgccaa

SEQ ID NO: 128201 - DNA, 25 bp, Rattus norvegicus
agccagttgtgactgttgtgttcca

SEQ ID NO: 128202 - DNA, 25 bp, Rattus norvegicus
agccagttgtgagtgttgtgttcca

SEQ ID NO: 128203 - DNA, 25 bp, Rattus norvegicus
agccagtttccaactcttgtggtga

SEQ ID NO: 128204 - DNA, 25 bp, Rattus norvegicus
agccagtttccatctcttgtggtga

SEQ ID NO: 128205 - DNA, 25 bp, Rattus norvegicus
agccagtttggccaaagccttgaat

SEQ ID NO: 128206 - DNA, 25 bp, Rattus norvegicus
agccagtttggcgaaagccttgaat

SEQ ID NO: 128207 - DNA, 25 bp, Rattus norvegicus
agccagtttgggacactctccagtg

SEQ ID NO: 128208 - DNA, 25 bp, Rattus norvegicus
agccagtttgggtcactctccagtg

SEQ ID NO: 128209 - DNA, 25 bp, Rattus norvegicus
agccataaatgtagccagtgccctc

SEQ ID NO: 128210 - DNA, 25 bp, Rattus norvegicus
agccataaatgttgccagtgccctc

SEQ ID NO: 128211 - DNA, 25 bp, Rattus norvegicus
agccataagcgtcttagtatcctat

SEQ ID NO: 128212 - DNA, 25 bp, Rattus norvegicus
agccataagcgtgttagtatcctat

SEQ ID NO: 128213 - DNA, 25 bp, Rattus norvegicus
agccataagtagatgcttccagcta

SEQ ID NO: 128214 - DNA, 25 bp, Rattus norvegicus
agccataagtagttgcttccagcta

SEQ ID NO: 128215 - DNA, 25 bp, Rattus norvegicus
agccataatctcactgcctttaaag

SEQ ID NO: 128216 - DNA, 25 bp, Rattus norvegicus
agccataatctctctgcctttaaag

SEQ ID NO: 128217 - DNA, 25 bp, Rattus norvegicus
agccataatgttaactgcctcaaag

SEQ ID NO: 128218 - DNA, 25 bp, Rattus norvegicus
agccataatgtttactgcctcaaag

SEQ ID NO: 128219 - DNA, 25 bp, Rattus norvegicus
agccatacaaaaccgagctctccat

SEQ ID NO: 128220 - DNA, 25 bp, Rattus norvegicus
agccatacaaaagcgagctctccat

SEQ ID NO: 128221 - DNA, 25 bp, Rattus norvegicus
agccatacagtaccttgtcctcagc

SEQ ID NO: 128222 - DNA, 25 bp, Rattus norvegicus
agccatacagtagcttgtcctcagc

SEQ ID NO: 128223 - DNA, 25 bp, Rattus norvegicus
agccatacatttcctcaccgtggag

SEQ ID NO: 128224 - DNA, 25 bp, Rattus norvegicus
agccatacatttgctcaccgtggag

SEQ ID NO: 128225 - DNA, 25 bp, Rattus norvegicus
agccataccaggagtctgtctgtaa

SEQ ID NO: 128226 - DNA, 25 bp, Rattus norvegicus
agccataccaggtgtctgtctgtaa

SEQ ID NO: 128227 - DNA, 25 bp, Rattus norvegicus
agccatacccttagcagtagtgacc

SEQ ID NO: 128228 - DNA, 25 bp, Rattus norvegicus
agccataccctttgcagtagtgacc

SEQ ID NO: 128229 - DNA, 25 bp, Rattus norvegicus
agccatacctacatcaactaactct

SEQ ID NO: 128230 - DNA, 25 bp, Rattus norvegicus
agccatacctacttcaactaactct

SEQ ID NO: 128231 - DNA, 25 bp, Rattus norvegicus
agccatacgaccaagatatcagctt

SEQ ID NO: 128232 - DNA, 25 bp, Rattus norvegicus
agccatacgacctagatatcagctt

SEQ ID NO: 128233 - DNA, 25 bp, Rattus norvegicus
agccatacggtaatgacatattttt

SEQ ID NO: 128234 - DNA, 25 bp, Rattus norvegicus
agccatacggtattgacatattttt

SEQ ID NO: 128235 - DNA, 25 bp, Rattus norvegicus
agccatacgtggaggcggtgttcac

SEQ ID NO: 128236 - DNA, 25 bp, Rattus norvegicus
agccatacgtggtggcggtgttcac

SEQ ID NO: 128237 - DNA, 25 bp, Rattus norvegicus
agccatactctgagccatgatacta

SEQ ID NO: 128238 - DNA, 25 bp, Rattus norvegicus
agccatactctgtgccatgatacta

SEQ ID NO: 128239 - DNA, 25 bp, Rattus norvegicus
agccatagagctcttagtctgttag

SEQ ID NO: 128240 - DNA, 25 bp, Rattus norvegicus
agccatagagctgttagtctgttag

SEQ ID NO: 128241 - DNA, 25 bp, Rattus norvegicus
agccatagagggacgtaggtagctt

SEQ ID NO: 128242 - DNA, 25 bp, Rattus norvegicus
agccatagagggtcgtaggtagctt

SEQ ID NO: 128243 - DNA, 25 bp, Rattus norvegicus
agccataggcctcttctttttcttc

SEQ ID NO: 128244 - DNA, 25 bp, Rattus norvegicus
agccataggcctgttctttttcttc

SEQ ID NO: 128245 - DNA, 25 bp, Rattus norvegicus
agccataggcttacttgtatctgtc

SEQ ID NO: 128246 - DNA, 25 bp, Rattus norvegicus
agccataggctttcttgtatctgtc

SEQ ID NO: 128247 - DNA, 25 bp, Rattus norvegicus
agccatagggacatggtcttcactt

SEQ ID NO: 128248 - DNA, 25 bp, Rattus norvegicus
agccatagggacttggtcttcactt

SEQ ID NO: 128249 - DNA, 25 bp, Rattus norvegicus
agccatagtcctagatctatcctgc

SEQ ID NO: 128250 - DNA, 25 bp, Rattus norvegicus
agccatagtccttgatctatcctgc

SEQ ID NO: 128251 - DNA, 25 bp, Rattus norvegicus
agccatagtggtaaagaaagtccta

SEQ ID NO: 128252 - DNA, 25 bp, Rattus norvegicus
agccatagtggttaagaaagtccta

SEQ ID NO: 128253 - DNA, 25 bp, Rattus norvegicus
agccatagttaccttgttgtccatc

SEQ ID NO: 128254 - DNA, 25 bp, Rattus norvegicus
agccatagttacgttgttgtccatc

SEQ ID NO: 128255 - DNA, 25 bp, Rattus norvegicus
agccatatatatattctcggtagca

SEQ ID NO: 128256 - DNA, 25 bp, Rattus norvegicus
agccatatatattttctcggtagca

SEQ ID NO: 128257 - DNA, 25 bp, Rattus norvegicus
agccatatccctctgaggcacaggg

SEQ ID NO: 128258 - DNA, 25 bp, Rattus norvegicus
agccatatccctgtgaggcacaggg

SEQ ID NO: 128259 - DNA, 25 bp, Rattus norvegicus
agccatatcctgatgcattcctgta

SEQ ID NO: 128260 - DNA, 25 bp, Rattus norvegicus
agccatatcctgttgcattcctgta

SEQ ID NO: 128261 - DNA, 25 bp, Rattus norvegicus
agccatatctagagctcgtcacaaa

SEQ ID NO: 128262 - DNA, 25 bp, Rattus norvegicus
agccatatctagtgctcgtcacaaa

SEQ ID NO: 128263 - DNA, 25 bp, Rattus norvegicus
agccatatctccaggatccttccat

SEQ ID NO: 128264 - DNA, 25 bp, Rattus norvegicus
agccatatctcctggatccttccat

SEQ ID NO: 128265 - DNA, 25 bp, Rattus norvegicus
agccatatgtacaagtcaaggcata

SEQ ID NO: 128266 - DNA, 25 bp, Rattus norvegicus
agccatatgtactagtcaaggcata

SEQ ID NO: 128267 - DNA, 25 bp, Rattus norvegicus
agccatattccaccaatgaaccttg

SEQ ID NO: 128268 - DNA, 25 bp, Rattus norvegicus
agccatattccagcaatgaaccttg

SEQ ID NO: 128269 - DNA, 25 bp, Rattus norvegicus
agccatattccgacctgacagcatt

SEQ ID NO: 128270 - DNA, 25 bp, Rattus norvegicus
agccatattccgtcctgacagcatt

SEQ ID NO: 128271 - DNA, 25 bp, Rattus norvegicus
agccatattcgtacaagtcctcttc

SEQ ID NO: 128272 - DNA, 25 bp, Rattus norvegicus
agccatattcgttcaagtcctcttc

SEQ ID NO: 128273 - DNA, 25 bp, Rattus norvegicus
agccatattctaaccctggttagga

SEQ ID NO: 128274 - DNA, 25 bp, Rattus norvegicus
agccatattctatccctggttagga

SEQ ID NO: 128275 - DNA, 25 bp, Rattus norvegicus
agccatattggcagtttagtacatg

SEQ ID NO: 128276 - DNA, 25 bp, Rattus norvegicus
agccatattggctgtttagtacatg

SEQ ID NO: 128277 - DNA, 25 bp, Rattus norvegicus
agccatcaaagacgtgctgctgtcc

SEQ ID NO: 128278 - DNA, 25 bp, Rattus norvegicus
agccatcaaagaggtgctgctgtcc

SEQ ID NO: 128279 - DNA, 25 bp, Rattus norvegicus
agccatcaccgtatcagcgtatcag

SEQ ID NO: 128280 - DNA, 25 bp, Rattus norvegicus
agccatcaccgtttcagcgtatcag

SEQ ID NO: 128281 - DNA, 25 bp, Rattus norvegicus
agccatcactttactgtagacccaa

SEQ ID NO: 128282 - DNA, 25 bp, Rattus norvegicus
agccatcacttttctgtagacccaa

SEQ ID NO: 128283 - DNA, 25 bp, Rattus norvegicus
agccatcatgatagtcagttcagag

SEQ ID NO: 128284 - DNA, 25 bp, Rattus norvegicus
agccatcatgatcagggaagagacc

SEQ ID NO: 128285 - DNA, 25 bp, Rattus norvegicus
agccatcatgatgagggaagagacc

SEQ ID NO: 128286 - DNA, 25 bp, Rattus norvegicus
agccatcatgattgtcagttcagag

SEQ ID NO: 128287 - DNA, 25 bp, Rattus norvegicus
agccatcatggcaacttcatcagaa

SEQ ID NO: 128288 - DNA, 25 bp, Rattus norvegicus
agccatcatggctacttcatcagaa

SEQ ID NO: 128289 - DNA, 25 bp, Rattus norvegicus
agccatcattgtctgtatctccagt

SEQ ID NO: 128290 - DNA, 25 bp, Rattus norvegicus
agccatcattgtgtgtatctccagt

SEQ ID NO: 128291 - DNA, 25 bp, Rattus norvegicus
agccatcatttcagtgtcctataca

SEQ ID NO: 128292 - DNA, 25 bp, Rattus norvegicus
agccatcatttcatttcacatccag

SEQ ID NO: 128293 - DNA, 25 bp, Rattus norvegicus
agccatcatttctgtgtcctataca

SEQ ID NO: 128294 - DNA, 25 bp, Rattus norvegicus
agccatcatttcttttcacatccag

SEQ ID NO: 128295 - DNA, 25 bp, Rattus norvegicus
agccatccacggctcatccggattt

SEQ ID NO: 128296 - DNA, 25 bp, Rattus norvegicus
agccatccacgggtcatccggattt

SEQ ID NO: 128297 - DNA, 25 bp, Rattus norvegicus
agccatccaggcagtgttgtccctg

SEQ ID NO: 128298 - DNA, 25 bp, Rattus norvegicus
agccatccaggctgtgttgtccctg

SEQ ID NO: 128299 - DNA, 25 bp, Rattus norvegicus
agccatccatgtattctctctggga

SEQ ID NO: 128300 - DNA, 25 bp, Rattus norvegicus
agccatccatgttttctctctggga

SEQ ID NO: 128301 - DNA, 25 bp, Rattus norvegicus
agccatcccaagagttcaggcgtgg

SEQ ID NO: 128302 - DNA, 25 bp, Rattus norvegicus
agccatcccaagtgttcaggcgtgg

SEQ ID NO: 128303 - DNA, 25 bp, Rattus norvegicus
agccatcccacgattcctgaaatga

SEQ ID NO: 128304 - DNA, 25 bp, Rattus norvegicus
agccatcccacgtttcctgaaatga

SEQ ID NO: 128305 - DNA, 25 bp, Rattus norvegicus
agccatcccttgcaaactggagagt

SEQ ID NO: 128306 - DNA, 25 bp, Rattus norvegicus
agccatcccttggaaactggagagt

SEQ ID NO: 128307 - DNA, 25 bp, Rattus norvegicus
agccatccgggactttgcagaacac

SEQ ID NO: 128308 - DNA, 25 bp, Rattus norvegicus
agccatccgggagtttgcagaacac

SEQ ID NO: 128309 - DNA, 25 bp, Rattus norvegicus
agccatcctggaatgggttcatcag

SEQ ID NO: 128310 - DNA, 25 bp, Rattus norvegicus
agccatcctggattgggttcatcag

SEQ ID NO: 128311 - DNA, 25 bp, Rattus norvegicus
agccatcctggcaatcagtcttggg

SEQ ID NO: 128312 - DNA, 25 bp, Rattus norvegicus
agccatcctggctatcagtcttggg

SEQ ID NO: 128313 - DNA, 25 bp, Rattus norvegicus
agccatcctttaacagtcacagatc

SEQ ID NO: 128314 - DNA, 25 bp, Rattus norvegicus
agccatcctttatcagtcacagatc

SEQ ID NO: 128315 - DNA, 25 bp, Rattus norvegicus
agccatcctttcactagctagaatt

SEQ ID NO: 128316 - DNA, 25 bp, Rattus norvegicus
agccatcctttctctagctagaatt

SEQ ID NO: 128317 - DNA, 25 bp, Rattus norvegicus
agccatcctttgcaaggcctacatg

SEQ ID NO: 128318 - DNA, 25 bp, Rattus norvegicus
agccatcctttggaaggcctacatg

SEQ ID NO: 128319 - DNA, 25 bp, Rattus norvegicus
agccatcgagcccagggatgtccag

SEQ ID NO: 128320 - DNA, 25 bp, Rattus norvegicus
agccatcgagccgagggatgtccag

SEQ ID NO: 128321 - DNA, 25 bp, Rattus norvegicus
agccatcgcaggcagtgagatcttt

SEQ ID NO: 128322 - DNA, 25 bp, Rattus norvegicus
agccatcgcagggagtgagatcttt

SEQ ID NO: 128323 - DNA, 25 bp, Rattus norvegicus
agccatcgcggactctgttgactgt

SEQ ID NO: 128324 - DNA, 25 bp, Rattus norvegicus
agccatcgcggagtctgttgactgt

SEQ ID NO: 128325 - DNA, 25 bp, Rattus norvegicus
agccatcgtggcagtgtatgtcatc

SEQ ID NO: 128326 - DNA, 25 bp, Rattus norvegicus
agccatcgtggctgtgtatgtcatc

SEQ ID NO: 128327 - DNA, 25 bp, Rattus norvegicus
agccatctaccgcttcatcaccgag

SEQ ID NO: 128328 - DNA, 25 bp, Rattus norvegicus
agccatctaccggttcatcaccgag

SEQ ID NO: 128329 - DNA, 25 bp, Rattus norvegicus
agccatctacgtcctaagctgggag

SEQ ID NO: 128330 - DNA, 25 bp, Rattus norvegicus
agccatctacgtgctaagctgggag

SEQ ID NO: 128331 - DNA, 25 bp, Rattus norvegicus
agccatctcaggctcttcactggaa

SEQ ID NO: 128332 - DNA, 25 bp, Rattus norvegicus
agccatctcagggtcttcactggaa

SEQ ID NO: 128333 - DNA, 25 bp, Rattus norvegicus
agccatctcatcagttgccaacaat

SEQ ID NO: 128334 - DNA, 25 bp, Rattus norvegicus
agccatctcatctgttgccaacaat

SEQ ID NO: 128335 - DNA, 25 bp, Rattus norvegicus
agccatctccgtaatgtaacctcgg

SEQ ID NO: 128336 - DNA, 25 bp, Rattus norvegicus
agccatctccgttatgtaacctcgg

SEQ ID NO: 128337 - DNA, 25 bp, Rattus norvegicus
agccatctcggcatacaggaagcag

SEQ ID NO: 128338 - DNA, 25 bp, Rattus norvegicus
agccatctcggcttacaggaagcag

SEQ ID NO: 128339 - DNA, 25 bp, Rattus norvegicus
agccatctctctactttctaaatta

SEQ ID NO: 128340 - DNA, 25 bp, Rattus norvegicus
agccatctctctcggcttctattta

SEQ ID NO: 128341 - DNA, 25 bp, Rattus norvegicus
agccatctctctgggcttctattta

SEQ ID NO: 128342 - DNA, 25 bp, Rattus norvegicus
agccatctctcttctttctaaatta

SEQ ID NO: 128343 - DNA, 25 bp, Rattus norvegicus
agccatctcttcaactctgtcgctg

SEQ ID NO: 128344 - DNA, 25 bp, Rattus norvegicus
agccatctcttctactctgtcgctg

SEQ ID NO: 128345 - DNA, 25 bp, Rattus norvegicus
agccatctgaaaccccagggatctg

SEQ ID NO: 128346 - DNA, 25 bp, Rattus norvegicus
agccatctgaaagcccagggatctg

SEQ ID NO: 128347 - DNA, 25 bp, Rattus norvegicus
agccatctgacgatattgtgattga

SEQ ID NO: 128348 - DNA, 25 bp, Rattus norvegicus
agccatctgacgttattgtgattga

SEQ ID NO: 128349 - DNA, 25 bp, Rattus norvegicus
agccatctgcttcatcttgttaatc

SEQ ID NO: 128350 - DNA, 25 bp, Rattus norvegicus
agccatctgcttgatcttgttaatc

SEQ ID NO: 128351 - DNA, 25 bp, Rattus norvegicus
agccatctggctaccaataatacag

SEQ ID NO: 128352 - DNA, 25 bp, Rattus norvegicus
agccatctggcttccaataatacag

SEQ ID NO: 128353 - DNA, 25 bp, Rattus norvegicus
agccatctgtcaaagcatcatctca

SEQ ID NO: 128354 - DNA, 25 bp, Rattus norvegicus
agccatctgtcatagcatcatctca

SEQ ID NO: 128355 - DNA, 25 bp, Rattus norvegicus
agccatctgtggacaaggttgtctc

SEQ ID NO: 128356 - DNA, 25 bp, Rattus norvegicus
agccatctgtggtcaaggttgtctc

SEQ ID NO: 128357 - DNA, 25 bp, Rattus norvegicus
agccatcttcacatctgggatcatt

SEQ ID NO: 128358 - DNA, 25 bp, Rattus norvegicus
agccatcttcacttctgggatcatt

SEQ ID NO: 128359 - DNA, 25 bp, Rattus norvegicus
agccatcttctgaaagggtgcccag

SEQ ID NO: 128360 - DNA, 25 bp, Rattus norvegicus
agccatcttctgtaagggtgcccag

SEQ ID NO: 128361 - DNA, 25 bp, Rattus norvegicus
agccatcttgacagtagggtcagga

SEQ ID NO: 128362 - DNA, 25 bp, Rattus norvegicus
agccatcttgactgtagggtcagga

SEQ ID NO: 128363 - DNA, 25 bp, Rattus norvegicus
agccatcttggcacagcgagcagga

SEQ ID NO: 128364 - DNA, 25 bp, Rattus norvegicus
agccatcttggctcagcgagcagga

SEQ ID NO: 128365 - DNA, 25 bp, Rattus norvegicus
agccatcttgggacagctatcctga

SEQ ID NO: 128366 - DNA, 25 bp, Rattus norvegicus
agccatcttgggtcagctatcctga

SEQ ID NO: 128367 - DNA, 25 bp, Rattus norvegicus
agccatctttccatttccagctgga

SEQ ID NO: 128368 - DNA, 25 bp, Rattus norvegicus
agccatctttccttttccagctgga

SEQ ID NO: 128369 - DNA, 25 bp, Rattus norvegicus
agccatgaaagtctagcagcctctt

SEQ ID NO: 128370 - DNA, 25 bp, Rattus norvegicus
agccatgaaagtgtagcagcctctt

SEQ ID NO: 128371 - DNA, 25 bp, Rattus norvegicus
agccatgaacttcaggtcccttgaa

SEQ ID NO: 128372 - DNA, 25 bp, Rattus norvegicus
agccatgaacttgaggtcccttgaa

SEQ ID NO: 128373 - DNA, 25 bp, Rattus norvegicus
agccatgaagttcattctctctctc

SEQ ID NO: 128374 - DNA, 25 bp, Rattus norvegicus
agccatgaagttgattctctctctc

SEQ ID NO: 128375 - DNA, 25 bp, Rattus norvegicus
agccatgacattcataacacctgca

SEQ ID NO: 128376 - DNA, 25 bp, Rattus norvegicus
agccatgacattgataacacctgca

SEQ ID NO: 128377 - DNA, 25 bp, Rattus norvegicus
agccatgaccagatgctgtgagcac

SEQ ID NO: 128378 - DNA, 25 bp, Rattus norvegicus
agccatgaccagttgctgtgagcac

SEQ ID NO: 128379 - DNA, 25 bp, Rattus norvegicus
agccatgacctcaagtttctgggca

SEQ ID NO: 128380 - DNA, 25 bp, Rattus norvegicus
agccatgacctctagtttctgggca

SEQ ID NO: 128381 - DNA, 25 bp, Rattus norvegicus
agccatgactctaagcctgactgga

SEQ ID NO: 128382 - DNA, 25 bp, Rattus norvegicus
agccatgactcttagcctgactgga

SEQ ID NO: 128383 - DNA, 25 bp, Rattus norvegicus
agccatgagcttagtctgtattgtg

SEQ ID NO: 128384 - DNA, 25 bp, Rattus norvegicus
agccatgagctttgtctgtattgtg

SEQ ID NO: 128385 - DNA, 25 bp, Rattus norvegicus
agccatgaggcgagcatccacgtga

SEQ ID NO: 128386 - DNA, 25 bp, Rattus norvegicus
agccatgaggcgtgcatccacgtga

SEQ ID NO: 128387 - DNA, 25 bp, Rattus norvegicus
agccatgagtcacaggtcaccccag

SEQ ID NO: 128388 - DNA, 25 bp, Rattus norvegicus
agccatgagtcagaggtcaccccag

SEQ ID NO: 128389 - DNA, 25 bp, Rattus norvegicus
agccatgatcaaccttggtttctac

SEQ ID NO: 128390 - DNA, 25 bp, Rattus norvegicus
agccatgatcaagcttggtttctac

SEQ ID NO: 128391 - DNA, 25 bp, Rattus norvegicus
agccatgattggaggttctgaccac

SEQ ID NO: 128392 - DNA, 25 bp, Rattus norvegicus
agccatgattggtggttctgaccac

SEQ ID NO: 128393 - DNA, 25 bp, Rattus norvegicus
agccatgcagacattccaagcaaag

SEQ ID NO: 128394 - DNA, 25 bp, Rattus norvegicus
agccatgcagactttccaagcaaag

SEQ ID NO: 128395 - DNA, 25 bp, Rattus norvegicus
agccatgcagcacggtagacactca

SEQ ID NO: 128396 - DNA, 25 bp, Rattus norvegicus
agccatgcagcagggtagacactca

SEQ ID NO: 128397 - DNA, 25 bp, Rattus norvegicus
agccatgcagggaggtttttgttca

SEQ ID NO: 128398 - DNA, 25 bp, Rattus norvegicus
agccatgcagggtggtttttgttca

SEQ ID NO: 128399 - DNA, 25 bp, Rattus norvegicus
agccatgcatacaacgttgacctca

SEQ ID NO: 128400 - DNA, 25 bp, Rattus norvegicus
agccatgcatactacgttgacctca

SEQ ID NO: 128401 - DNA, 25 bp, Rattus norvegicus
agccatgcattcatgttttctccag

SEQ ID NO: 128402 - DNA, 25 bp, Rattus norvegicus
agccatgcattcctgatacaatcca

SEQ ID NO: 128403 - DNA, 25 bp, Rattus norvegicus
agccatgcattcgtgatacaatcca

SEQ ID NO: 128404 - DNA, 25 bp, Rattus norvegicus
agccatgcattcttgttttctccag

SEQ ID NO: 128405 - DNA, 25 bp, Rattus norvegicus
agccatgccgaaccagcagctgtga

SEQ ID NO: 128406 - DNA, 25 bp, Rattus norvegicus
agccatgccgaagcagcagctgtga

SEQ ID NO: 128407 - DNA, 25 bp, Rattus norvegicus
agccatgcctatattcaaccagaat

SEQ ID NO: 128408 - DNA, 25 bp, Rattus norvegicus
agccatgcctattttcaaccagaat

SEQ ID NO: 128409 - DNA, 25 bp, Rattus norvegicus
agccatgcctccaatagatgtctca

SEQ ID NO: 128410 - DNA, 25 bp, Rattus norvegicus
agccatgcctcctatagatgtctca

SEQ ID NO: 128411 - DNA, 25 bp, Rattus norvegicus
agccatgcgaccagccttctaagag

SEQ ID NO: 128412 - DNA, 25 bp, Rattus norvegicus
agccatgcgacctgccttctaagag

SEQ ID NO: 128413 - DNA, 25 bp, Rattus norvegicus
agccatgctcaacggcggcggttca

SEQ ID NO: 128414 - DNA, 25 bp, Rattus norvegicus
agccatgctcaagggcggcggttca

SEQ ID NO: 128415 - DNA, 25 bp, Rattus norvegicus
agccatgctgctcactagttggata

SEQ ID NO: 128416 - DNA, 25 bp, Rattus norvegicus
agccatgctgctgactagttggata

SEQ ID NO: 128417 - DNA, 25 bp, Rattus norvegicus
agccatgctgggagctgtgatctgc

SEQ ID NO: 128418 - DNA, 25 bp, Rattus norvegicus
agccatgctgggtgctgtgatctgc

SEQ ID NO: 128419 - DNA, 25 bp, Rattus norvegicus
agccatgctttgacacactgacttc

SEQ ID NO: 128420 - DNA, 25 bp, Rattus norvegicus
agccatgctttgagcactgtgtgac

SEQ ID NO: 128421 - DNA, 25 bp, Rattus norvegicus
agccatgctttgtcacactgacttc

SEQ ID NO: 128422 - DNA, 25 bp, Rattus norvegicus
agccatgctttgtgcactgtgtgac

SEQ ID NO: 128423 - DNA, 25 bp, Rattus norvegicus
agccatggacgaagggcagtacgac

SEQ ID NO: 128424 - DNA, 25 bp, Rattus norvegicus
agccatggacgatgggcagtacgac

SEQ ID NO: 128425 - DNA, 25 bp, Rattus norvegicus
agccatggagctcacactgacaatg

SEQ ID NO: 128426 - DNA, 25 bp, Rattus norvegicus
agccatggagctgacactgacaatg

SEQ ID NO: 128427 - DNA, 25 bp, Rattus norvegicus
agccatggcatgacccgcacgaagt

SEQ ID NO: 128428 - DNA, 25 bp, Rattus norvegicus
agccatggcatgtcccgcacgaagt

SEQ ID NO: 128429 - DNA, 25 bp, Rattus norvegicus
agccatggccacacagtgaaactct

SEQ ID NO: 128430 - DNA, 25 bp, Rattus norvegicus
agccatggccactcagtgaaactct

SEQ ID NO: 128431 - DNA, 25 bp, Rattus norvegicus
agccatggccagagctcctaagtag

SEQ ID NO: 128432 - DNA, 25 bp, Rattus norvegicus
agccatggccagtgctcctaagtag

SEQ ID NO: 128433 - DNA, 25 bp, Rattus norvegicus
agccatggcctcacagtttgtaata

SEQ ID NO: 128434 - DNA, 25 bp, Rattus norvegicus
agccatggcctctcagtttgtaata

SEQ ID NO: 128435 - DNA, 25 bp, Rattus norvegicus
agccatggctctcaaggcactgatg

SEQ ID NO: 128436 - DNA, 25 bp, Rattus norvegicus
agccatggctctgaaggcactgatg

SEQ ID NO: 128437 - DNA, 25 bp, Rattus norvegicus
agccatggctgaaaacattgtatca

SEQ ID NO: 128438 - DNA, 25 bp, Rattus norvegicus
agccatggctgataacattgtatca

SEQ ID NO: 128439 - DNA, 25 bp, Rattus norvegicus
agccatgggcagagttgccttggca

SEQ ID NO: 128440 - DNA, 25 bp, Rattus norvegicus
agccatgggcagtgttgccttggca

SEQ ID NO: 128441 - DNA, 25 bp, Rattus norvegicus
agccatgggcctatgagcggtctaa

SEQ ID NO: 128442 - DNA, 25 bp, Rattus norvegicus
agccatgggcctttgagcggtctaa

SEQ ID NO: 128443 - DNA, 25 bp, Rattus norvegicus
agccatgggtataactatgtcctac

SEQ ID NO: 128444 - DNA, 25 bp, Rattus norvegicus
agccatgggtatcccttttctcaag

SEQ ID NO: 128445 - DNA, 25 bp, Rattus norvegicus
agccatgggtatgccttttctcaag

SEQ ID NO: 128446 - DNA, 25 bp, Rattus norvegicus
agccatgggtattactatgtcctac

SEQ ID NO: 128447 - DNA, 25 bp, Rattus norvegicus
agccatggtggaccttcctaagaaa

SEQ ID NO: 128448 - DNA, 25 bp, Rattus norvegicus
agccatggtggagcttcctaagaaa

SEQ ID NO: 128449 - DNA, 25 bp, Rattus norvegicus
agccatggtggtagttacggagcac

SEQ ID NO: 128450 - DNA, 25 bp, Rattus norvegicus
agccatggtggttgttacggagcac

SEQ ID NO: 128451 - DNA, 25 bp, Rattus norvegicus
agccatggtgttataaatttgttag

SEQ ID NO: 128452 - DNA, 25 bp, Rattus norvegicus
agccatggtgttttaaatttgttag

SEQ ID NO: 128453 - DNA, 25 bp, Rattus norvegicus
agccatggttgtaggtggtcatctc

SEQ ID NO: 128454 - DNA, 25 bp, Rattus norvegicus
agccatggttgttggtggtcatctc

SEQ ID NO: 128455 - DNA, 25 bp, Rattus norvegicus
agccatgtaacaaacggaactgtaa

SEQ ID NO: 128456 - DNA, 25 bp, Rattus norvegicus
agccatgtaacatacggaactgtaa

SEQ ID NO: 128457 - DNA, 25 bp, Rattus norvegicus
agccatgtaaccaaggcattttgaa

SEQ ID NO: 128458 - DNA, 25 bp, Rattus norvegicus
agccatgtaacctaggcattttgaa

SEQ ID NO: 128459 - DNA, 25 bp, Rattus norvegicus
agccatgtacacagtcattgtacag

SEQ ID NO: 128460 - DNA, 25 bp, Rattus norvegicus
agccatgtacactgtcattgtacag

SEQ ID NO: 128461 - DNA, 25 bp, Rattus norvegicus
agccatgtatgtatacctctctctt

SEQ ID NO: 128462 - DNA, 25 bp, Rattus norvegicus
agccatgtatgtttacctctctctt

SEQ ID NO: 128463 - DNA, 25 bp, Rattus norvegicus
agccatgtctgtctcaactaaagta

SEQ ID NO: 128464 - DNA, 25 bp, Rattus norvegicus
agccatgtctgtctctgaaccaagt

SEQ ID NO: 128465 - DNA, 25 bp, Rattus norvegicus
agccatgtctgtgtcaactaaagta

SEQ ID NO: 128466 - DNA, 25 bp, Rattus norvegicus
agccatgtctgtgtctgaaccaagt

SEQ ID NO: 128467 - DNA, 25 bp, Rattus norvegicus
agccatgtgactacttggtaccaaa

SEQ ID NO: 128468 - DNA, 25 bp, Rattus norvegicus
agccatgtgacttcttggtaccaaa

SEQ ID NO: 128469 - DNA, 25 bp, Rattus norvegicus
agccatgtgctgagcaggacttcta

SEQ ID NO: 128470 - DNA, 25 bp, Rattus norvegicus
agccatgtgctgatggacttagact

SEQ ID NO: 128471 - DNA, 25 bp, Rattus norvegicus
agccatgtgctgtgcaggacttcta

SEQ ID NO: 128472 - DNA, 25 bp, Rattus norvegicus
agccatgtgctgttggacttagact

SEQ ID NO: 128473 - DNA, 25 bp, Rattus norvegicus
agccatgtgcttagggtatctgtca

SEQ ID NO: 128474 - DNA, 25 bp, Rattus norvegicus
agccatgtgctttgggtatctgtca

SEQ ID NO: 128475 - DNA, 25 bp, Rattus norvegicus
agccatgtggagacttgcattgcat

SEQ ID NO: 128476 - DNA, 25 bp, Rattus norvegicus
agccatgtggagtcttgcattgcat

SEQ ID NO: 128477 - DNA, 25 bp, Rattus norvegicus
agccatgtggatattacgagaagag

SEQ ID NO: 128478 - DNA, 25 bp, Rattus norvegicus
agccatgtggattttacgagaagag

SEQ ID NO: 128479 - DNA, 25 bp, Rattus norvegicus
agccatgtgtaacagagcttagaca

SEQ ID NO: 128480 - DNA, 25 bp, Rattus norvegicus
agccatgtgtaagagagcttagaca

SEQ ID NO: 128481 - DNA, 25 bp, Rattus norvegicus
agccatgtgtatccaggtagcccca

SEQ ID NO: 128482 - DNA, 25 bp, Rattus norvegicus
agccatgtgtatgcaggtagcccca

SEQ ID NO: 128483 - DNA, 25 bp, Rattus norvegicus
agccatgtgtggacttggttaccct

SEQ ID NO: 128484 - DNA, 25 bp, Rattus norvegicus
agccatgtgtggtcttggttaccct

SEQ ID NO: 128485 - DNA, 25 bp, Rattus norvegicus
agccatgtgtgtagaacagcccgaa

SEQ ID NO: 128486 - DNA, 25 bp, Rattus norvegicus
agccatgtgtgttgaacagcccgaa

SEQ ID NO: 128487 - DNA, 25 bp, Rattus norvegicus
agccatgttactctagttcctacca

SEQ ID NO: 128488 - DNA, 25 bp, Rattus norvegicus
agccatgttactgtagttcctacca

SEQ ID NO: 128489 - DNA, 25 bp, Rattus norvegicus
agccatgttgtacctgctgtttctc

SEQ ID NO: 128490 - DNA, 25 bp, Rattus norvegicus
agccatgttgtagctgctgtttctc

SEQ ID NO: 128491 - DNA, 25 bp, Rattus norvegicus
agccatgtttctacttttataccaa

SEQ ID NO: 128492 - DNA, 25 bp, Rattus norvegicus
agccatgtttcttcttttataccaa

SEQ ID NO: 128493 - DNA, 25 bp, Rattus norvegicus
agccattacgtgaatgctggtcaca

SEQ ID NO: 128494 - DNA, 25 bp, Rattus norvegicus
agccattacgtgtatgctggtcaca

SEQ ID NO: 128495 - DNA, 25 bp, Rattus norvegicus
agccattagctgactgtcataccat

SEQ ID NO: 128496 - DNA, 25 bp, Rattus norvegicus
agccattagctgtctgtcataccat

SEQ ID NO: 128497 - DNA, 25 bp, Rattus norvegicus
agccattattcaaggtttcttactt

SEQ ID NO: 128498 - DNA, 25 bp, Rattus norvegicus
agccattattcatggtttcttactt

SEQ ID NO: 128499 - DNA, 25 bp, Rattus norvegicus
agccattcaagaaatacctgtactt

SEQ ID NO: 128500 - DNA, 25 bp, Rattus norvegicus
agccattcaagatatacctgtactt

SEQ ID NO: 128501 - DNA, 25 bp, Rattus norvegicus
agccattcagatcagctacctttga

SEQ ID NO: 128502 - DNA, 25 bp, Rattus norvegicus
agccattcagatgagctacctttga

SEQ ID NO: 128503 - DNA, 25 bp, Rattus norvegicus
agccattcagggatttatttcaggg

SEQ ID NO: 128504 - DNA, 25 bp, Rattus norvegicus
agccattcagggttttatttcaggg

SEQ ID NO: 128505 - DNA, 25 bp, Rattus norvegicus
agccattcatctacaccagggattg

SEQ ID NO: 128506 - DNA, 25 bp, Rattus norvegicus
agccattcatcttcaccagggattg

SEQ ID NO: 128507 - DNA, 25 bp, Rattus norvegicus
agccattcatgtccgcgtagctgtc

SEQ ID NO: 128508 - DNA, 25 bp, Rattus norvegicus
agccattcatgtgcgcgtagctgtc

SEQ ID NO: 128509 - DNA, 25 bp, Rattus norvegicus
agccattccaacacacttttttatt

SEQ ID NO: 128510 - DNA, 25 bp, Rattus norvegicus
agccattccaacacgattcacatgt

SEQ ID NO: 128511 - DNA, 25 bp, Rattus norvegicus
agccattccaactcacttttttatt

SEQ ID NO: 128512 - DNA, 25 bp, Rattus norvegicus
agccattccaactcgattcacatgt

SEQ ID NO: 128513 - DNA, 25 bp, Rattus norvegicus
agccattccataatctgcacgtaga

SEQ ID NO: 128514 - DNA, 25 bp, Rattus norvegicus
agccattccatattctgcacgtaga

SEQ ID NO: 128515 - DNA, 25 bp, Rattus norvegicus
agccattcccggctatgatcctagg

SEQ ID NO: 128516 - DNA, 25 bp, Rattus norvegicus
agccattcccgggtatgatcctagg

SEQ ID NO: 128517 - DNA, 25 bp, Rattus norvegicus
agccattccttcacaatcatgtgtt

SEQ ID NO: 128518 - DNA, 25 bp, Rattus norvegicus
agccattccttctcaatcatgtgtt

SEQ ID NO: 128519 - DNA, 25 bp, Rattus norvegicus
agccattcgcctccaagagcaggac

SEQ ID NO: 128520 - DNA, 25 bp, Rattus norvegicus
agccattcgcctgcaagagcaggac

SEQ ID NO: 128521 - DNA, 25 bp, Rattus norvegicus
agccattctgacctgacgagaagtt

SEQ ID NO: 128522 - DNA, 25 bp, Rattus norvegicus
agccattctgacgtgacgagaagtt

SEQ ID NO: 128523 - DNA, 25 bp, Rattus norvegicus
agccattctgatcccctgggtgatg

SEQ ID NO: 128524 - DNA, 25 bp, Rattus norvegicus
agccattctgatgccctgggtgatg

SEQ ID NO: 128525 - DNA, 25 bp, Rattus norvegicus
agccattctgcgaactaactcagcg

SEQ ID NO: 128526 - DNA, 25 bp, Rattus norvegicus
agccattctgcgtactaactcagcg

SEQ ID NO: 128527 - DNA, 25 bp, Rattus norvegicus
agccattctggtcgatacggaagtc

SEQ ID NO: 128528 - DNA, 25 bp, Rattus norvegicus
agccattctggtggatacggaagtc

SEQ ID NO: 128529 - DNA, 25 bp, Rattus norvegicus
agccattctgttactgtctatgctg

SEQ ID NO: 128530 - DNA, 25 bp, Rattus norvegicus
agccattctgtttctgtctatgctg

SEQ ID NO: 128531 - DNA, 25 bp, Rattus norvegicus
agccattcttcacgtcgtagcattt

SEQ ID NO: 128532 - DNA, 25 bp, Rattus norvegicus
agccattcttcaggtcgtagcattt

SEQ ID NO: 128533 - DNA, 25 bp, Rattus norvegicus
agccattgacttaaccttcttggcc

SEQ ID NO: 128534 - DNA, 25 bp, Rattus norvegicus
agccattgactttaccttcttggcc

SEQ ID NO: 128535 - DNA, 25 bp, Rattus norvegicus
agccattgagcaactctcctgaata

SEQ ID NO: 128536 - DNA, 25 bp, Rattus norvegicus
agccattgagcatctctcctgaata

SEQ ID NO: 128537 - DNA, 25 bp, Rattus norvegicus
agccattgatgcctttttgttctgt

SEQ ID NO: 128538 - DNA, 25 bp, Rattus norvegicus
agccattgatgcgtttttgttctgt

SEQ ID NO: 128539 - DNA, 25 bp, Rattus norvegicus
agccattgctatccaccgcgggatg

SEQ ID NO: 128540 - DNA, 25 bp, Rattus norvegicus
agccattgctatgcaccgcgggatg

SEQ ID NO: 128541 - DNA, 25 bp, Rattus norvegicus
agccattggcccagaagcaacctgg

SEQ ID NO: 128542 - DNA, 25 bp, Rattus norvegicus
agccattggccctgaagcaacctgg

SEQ ID NO: 128543 - DNA, 25 bp, Rattus norvegicus
agccattggcggcaccagcaaaata

SEQ ID NO: 128544 - DNA, 25 bp, Rattus norvegicus
agccattggcgggaccagcaaaata

SEQ ID NO: 128545 - DNA, 25 bp, Rattus norvegicus
agccattgggttactttcatttcat

SEQ ID NO: 128546 - DNA, 25 bp, Rattus norvegicus
agccattgggtttctttcatttcat

SEQ ID NO: 128547 - DNA, 25 bp, Rattus norvegicus
agccattgtctgagattttttatat

SEQ ID NO: 128548 - DNA, 25 bp, Rattus norvegicus
agccattgtctgtgattttttatat

SEQ ID NO: 128549 - DNA, 25 bp, Rattus norvegicus
agccattgtgctacatgcattcctg

SEQ ID NO: 128550 - DNA, 25 bp, Rattus norvegicus
agccattgtgctcttgtcgactagg

SEQ ID NO: 128551 - DNA, 25 bp, Rattus norvegicus
agccattgtgctgttgtcgactagg

SEQ ID NO: 128552 - DNA, 25 bp, Rattus norvegicus
agccattgtgcttcatgcattcctg

SEQ ID NO: 128553 - DNA, 25 bp, Rattus norvegicus
agccatttataacatccctcttttg

SEQ ID NO: 128554 - DNA, 25 bp, Rattus norvegicus
agccatttataagatccctcttttg

SEQ ID NO: 128555 - DNA, 25 bp, Rattus norvegicus
agccatttctctagtccttagttac

SEQ ID NO: 128556 - DNA, 25 bp, Rattus norvegicus
agccatttctctccaggcaaagtga

SEQ ID NO: 128557 - DNA, 25 bp, Rattus norvegicus
agccatttctctgcaggcaaagtga

SEQ ID NO: 128558 - DNA, 25 bp, Rattus norvegicus
agccatttctcttgtccttagttac

SEQ ID NO: 128559 - DNA, 25 bp, Rattus norvegicus
agccatttgaggagcgtcagggtcc

SEQ ID NO: 128560 - DNA, 25 bp, Rattus norvegicus
agccatttgaggtgcgtcagggtcc

SEQ ID NO: 128561 - DNA, 25 bp, Rattus norvegicus
agccatttgtttaccttccagaact

SEQ ID NO: 128562 - DNA, 25 bp, Rattus norvegicus
agccatttgttttccttccagaact

SEQ ID NO: 128563 - DNA, 25 bp, Rattus norvegicus
agccattttattctgtttgactgta

SEQ ID NO: 128564 - DNA, 25 bp, Rattus norvegicus
agccattttattgtgtttgactgta

SEQ ID NO: 128565 - DNA, 25 bp, Rattus norvegicus
agccattttgccatttcttatcgat

SEQ ID NO: 128566 - DNA, 25 bp, Rattus norvegicus
agccattttgccttttcttatcgat

SEQ ID NO: 128567 - DNA, 25 bp, Rattus norvegicus
agccattttggcaacatgctctctt

SEQ ID NO: 128568 - DNA, 25 bp, Rattus norvegicus
agccattttggctacatgctctctt

SEQ ID NO: 128569 - DNA, 25 bp, Rattus norvegicus
agccatttttccagctgtgtgacag

SEQ ID NO: 128570 - DNA, 25 bp, Rattus norvegicus
agccatttttcctgctgtgtgacag

SEQ ID NO: 128571 - DNA, 25 bp, Rattus norvegicus
agccatttttcgactcttcacatca

SEQ ID NO: 128572 - DNA, 25 bp, Rattus norvegicus
agccatttttcgtctcttcacatca

SEQ ID NO: 128573 - DNA, 25 bp, Rattus norvegicus
agcccaaaatgtccagcttcctgga

SEQ ID NO: 128574 - DNA, 25 bp, Rattus norvegicus
agcccaaaatgtgcagcttcctgga

SEQ ID NO: 128575 - DNA, 25 bp, Rattus norvegicus
agcccaaacagcaccgcagctttgg

SEQ ID NO: 128576 - DNA, 25 bp, Rattus norvegicus
agcccaaacagctccgcagctttgg

SEQ ID NO: 128577 - DNA, 25 bp, Rattus norvegicus
agcccaaccacaaagtcatgctgga

SEQ ID NO: 128578 - DNA, 25 bp, Rattus norvegicus
agcccaaccacatagtcatgctgga

SEQ ID NO: 128579 - DNA, 25 bp, Rattus norvegicus
agcccaactgagacctggccaaaga

SEQ ID NO: 128580 - DNA, 25 bp, Rattus norvegicus
agcccaactgagtcctggccaaaga

SEQ ID NO: 128581 - DNA, 25 bp, Rattus norvegicus
agcccaacttcaacttcttcaagag

SEQ ID NO: 128582 - DNA, 25 bp, Rattus norvegicus
agcccaacttcatcttcttcaagag

SEQ ID NO: 128583 - DNA, 25 bp, Rattus norvegicus
agcccaagaaccagagctccaagaa

SEQ ID NO: 128584 - DNA, 25 bp, Rattus norvegicus
agcccaagaacctgagctccaagaa

SEQ ID NO: 128585 - DNA, 25 bp, Rattus norvegicus
agcccaagagagctgtggtctacag

SEQ ID NO: 128586 - DNA, 25 bp, Rattus norvegicus
agcccaagagaggtgtggtctacag

SEQ ID NO: 128587 - DNA, 25 bp, Rattus norvegicus
agcccaagcaagctctagagcccat

SEQ ID NO: 128588 - DNA, 25 bp, Rattus norvegicus
agcccaagcaaggtctagagcccat

SEQ ID NO: 128589 - DNA, 25 bp, Rattus norvegicus
agcccaagccagacagtgacgtgac

SEQ ID NO: 128590 - DNA, 25 bp, Rattus norvegicus
agcccaagccagtcagtgacgtgac

SEQ ID NO: 128591 - DNA, 25 bp, Rattus norvegicus
agcccaagctcaaagcagcctgttg

SEQ ID NO: 128592 - DNA, 25 bp, Rattus norvegicus
agcccaagctcatagcagcctgttg

SEQ ID NO: 128593 - DNA, 25 bp, Rattus norvegicus
agcccaaggaagcatgtctgtcaag

SEQ ID NO: 128594 - DNA, 25 bp, Rattus norvegicus
agcccaaggaaggatgtctgtcaag

SEQ ID NO: 128595 - DNA, 25 bp, Rattus norvegicus
agcccaaggctgagtgctgccacaa

SEQ ID NO: 128596 - DNA, 25 bp, Rattus norvegicus
agcccaaggctgtgtgctgccacaa

SEQ ID NO: 128597 - DNA, 25 bp, Rattus norvegicus
agcccaagggcacacataatcataa

SEQ ID NO: 128598 - DNA, 25 bp, Rattus norvegicus
agcccaagggcagacataatcataa

SEQ ID NO: 128599 - DNA, 25 bp, Rattus norvegicus
agcccaaggtacaaagtctcagtga

SEQ ID NO: 128600 - DNA, 25 bp, Rattus norvegicus
agcccaaggtactaagtctcagtga

SEQ ID NO: 128601 - DNA, 25 bp, Rattus norvegicus
agcccaaggtttcgtgtagtcacca

SEQ ID NO: 128602 - DNA, 25 bp, Rattus norvegicus
agcccaaggtttggtgtagtcacca

SEQ ID NO: 128603 - DNA, 25 bp, Rattus norvegicus
agcccaagtccccagttcaaggtgg

SEQ ID NO: 128604 - DNA, 25 bp, Rattus norvegicus
agcccaagtcccgagttcaaggtgg

SEQ ID NO: 128605 - DNA, 25 bp, Rattus norvegicus
agcccaagtcctattttacctatga

SEQ ID NO: 128606 - DNA, 25 bp, Rattus norvegicus
agcccaagtccttttttacctatga

SEQ ID NO: 128607 - DNA, 25 bp, Rattus norvegicus
agcccaagtgaacatgtcctctgat

SEQ ID NO: 128608 - DNA, 25 bp, Rattus norvegicus
agcccaagtgaagatgtcctctgat

SEQ ID NO: 128609 - DNA, 25 bp, Rattus norvegicus
agcccaatcctgatgtggactccag

SEQ ID NO: 128610 - DNA, 25 bp, Rattus norvegicus
agcccaatcctgttgtggactccag

SEQ ID NO: 128611 - DNA, 25 bp, Rattus norvegicus
agcccaatcgatacttcaagtgtga

SEQ ID NO: 128612 - DNA, 25 bp, Rattus norvegicus
agcccaatcgattcttcaagtgtga

SEQ ID NO: 128613 - DNA, 25 bp, Rattus norvegicus
agcccaatgcacaaaacacacctgt

SEQ ID NO: 128614 - DNA, 25 bp, Rattus norvegicus
agcccaatgcactaaacacacctgt

SEQ ID NO: 128615 - DNA, 25 bp, Rattus norvegicus
agcccaatgtatacttggattttta

SEQ ID NO: 128616 - DNA, 25 bp, Rattus norvegicus
agcccaatgtattcttggattttta

SEQ ID NO: 128617 - DNA, 25 bp, Rattus norvegicus
agcccaattagcagtgctaggtccc

SEQ ID NO: 128618 - DNA, 25 bp, Rattus norvegicus
agcccaattagctgtgctaggtccc

SEQ ID NO: 128619 - DNA, 25 bp, Rattus norvegicus
agcccaattgctattaatcttcttg

SEQ ID NO: 128620 - DNA, 25 bp, Rattus norvegicus
agcccaattgcttttaatcttcttg

SEQ ID NO: 128621 - DNA, 25 bp, Rattus norvegicus
agcccaatttctactgtagcctagg

SEQ ID NO: 128622 - DNA, 25 bp, Rattus norvegicus
agcccaatttcttctgtagcctagg

SEQ ID NO: 128623 - DNA, 25 bp, Rattus norvegicus
agcccacaaaggaagctttcatttc

SEQ ID NO: 128624 - DNA, 25 bp, Rattus norvegicus
agcccacaaaggtagctttcatttc

SEQ ID NO: 128625 - DNA, 25 bp, Rattus norvegicus
agcccacaatggatggtcttttgac

SEQ ID NO: 128626 - DNA, 25 bp, Rattus norvegicus
agcccacaatggttggtcttttgac

SEQ ID NO: 128627 - DNA, 25 bp, Rattus norvegicus
agcccacacaggatctcttgatgaa

SEQ ID NO: 128628 - DNA, 25 bp, Rattus norvegicus
agcccacacaggttctcttgatgaa

SEQ ID NO: 128629 - DNA, 25 bp, Rattus norvegicus
agcccacactgactttctgaggagt

SEQ ID NO: 128630 - DNA, 25 bp, Rattus norvegicus
agcccacactgagtttctgaggagt

SEQ ID NO: 128631 - DNA, 25 bp, Rattus norvegicus
agcccacagagactgctgacagttt

SEQ ID NO: 128632 - DNA, 25 bp, Rattus norvegicus
agcccacagagagtgctgacagttt

SEQ ID NO: 128633 - DNA, 25 bp, Rattus norvegicus
agcccacatacaaagggtctcctgt

SEQ ID NO: 128634 - DNA, 25 bp, Rattus norvegicus
agcccacatacatagggtctcctgt

SEQ ID NO: 128635 - DNA, 25 bp, Rattus norvegicus
agcccacatcttaaggttggccagc

SEQ ID NO: 128636 - DNA, 25 bp, Rattus norvegicus
agcccacatctttaggttggccagc

SEQ ID NO: 128637 - DNA, 25 bp, Rattus norvegicus
agcccacattgtagtgtcttgcttt

SEQ ID NO: 128638 - DNA, 25 bp, Rattus norvegicus
agcccacattgttgtgtcttgcttt

SEQ ID NO: 128639 - DNA, 25 bp, Rattus norvegicus
agcccaccaccaacagcagttgtaa

SEQ ID NO: 128640 - DNA, 25 bp, Rattus norvegicus
agcccaccaccatcagcagttgtaa

SEQ ID NO: 128641 - DNA, 25 bp, Rattus norvegicus
agcccaccagaaacctttgtcattt

SEQ ID NO: 128642 - DNA, 25 bp, Rattus norvegicus
agcccaccagaatcctttgtcattt

SEQ ID NO: 128643 - DNA, 25 bp, Rattus norvegicus
agcccacctggcatctgatgagcag

SEQ ID NO: 128644 - DNA, 25 bp, Rattus norvegicus
agcccacctggcttctgatgagcag

SEQ ID NO: 128645 - DNA, 25 bp, Rattus norvegicus
agcccacgcgtgaggtgggcacgta

SEQ ID NO: 128646 - DNA, 25 bp, Rattus norvegicus
agcccacgcgtgtggtgggcacgta

SEQ ID NO: 128647 - DNA, 25 bp, Rattus norvegicus
agcccacgtccgacaggtgtttgtc

SEQ ID NO: 128648 - DNA, 25 bp, Rattus norvegicus
agcccacgtccgtcaggtgtttgtc

SEQ ID NO: 128649 - DNA, 25 bp, Rattus norvegicus
agcccacgtcttacatgaggatatg

SEQ ID NO: 128650 - DNA, 25 bp, Rattus norvegicus
agcccacgtctttcatgaggatatg

SEQ ID NO: 128651 - DNA, 25 bp, Rattus norvegicus
agcccacgtgggagtttactgcggc

SEQ ID NO: 128652 - DNA, 25 bp, Rattus norvegicus
agcccacgtgggtgtttactgcggc

SEQ ID NO: 128653 - DNA, 25 bp, Rattus norvegicus
agcccacgtggtcagcatgctcttt

SEQ ID NO: 128654 - DNA, 25 bp, Rattus norvegicus
agcccacgtggtgagcatgctcttt

SEQ ID NO: 128655 - DNA, 25 bp, Rattus norvegicus
agcccacgtgtcaagagcctgactc

SEQ ID NO: 128656 - DNA, 25 bp, Rattus norvegicus
agcccacgtgtctagagcctgactc

SEQ ID NO: 128657 - DNA, 25 bp, Rattus norvegicus
agcccacgttctcccgagttgtaaa

SEQ ID NO: 128658 - DNA, 25 bp, Rattus norvegicus
agcccacgttctgccgagttgtaaa

SEQ ID NO: 128659 - DNA, 25 bp, Rattus norvegicus
agcccactagggagccattttcagc

SEQ ID NO: 128660 - DNA, 25 bp, Rattus norvegicus
agcccactagggtgccattttcagc

SEQ ID NO: 128661 - DNA, 25 bp, Rattus norvegicus
agcccactcactcgagggaggtgtt

SEQ ID NO: 128662 - DNA, 25 bp, Rattus norvegicus
agcccactcactggagggaggtgtt

SEQ ID NO: 128663 - DNA, 25 bp, Rattus norvegicus
agcccactccagagctatagcataa

SEQ ID NO: 128664 - DNA, 25 bp, Rattus norvegicus
agcccactccagtgctatagcataa

SEQ ID NO: 128665 - DNA, 25 bp, Rattus norvegicus
agcccactccctaagatcaggaaat

SEQ ID NO: 128666 - DNA, 25 bp, Rattus norvegicus
agcccactcccttagatcaggaaat

SEQ ID NO: 128667 - DNA, 25 bp, Rattus norvegicus
agcccactctacctgtgatcgaggt

SEQ ID NO: 128668 - DNA, 25 bp, Rattus norvegicus
agcccactctacgtgtgatcgaggt

SEQ ID NO: 128669 - DNA, 25 bp, Rattus norvegicus
agcccactctgaacagggtcatgga

SEQ ID NO: 128670 - DNA, 25 bp, Rattus norvegicus
agcccactctgatcagggtcatgga

SEQ ID NO: 128671 - DNA, 25 bp, Rattus norvegicus
agcccactgctcaggactaggaaat

SEQ ID NO: 128672 - DNA, 25 bp, Rattus norvegicus
agcccactgctctggactaggaaat

SEQ ID NO: 128673 - DNA, 25 bp, Rattus norvegicus
agcccactgggacttgcttcagcga

SEQ ID NO: 128674 - DNA, 25 bp, Rattus norvegicus
agcccactgggagttgcttcagcga

SEQ ID NO: 128675 - DNA, 25 bp, Rattus norvegicus
agcccactgtgtacctttgttttag

SEQ ID NO: 128676 - DNA, 25 bp, Rattus norvegicus
agcccactgtgttcctttgttttag

SEQ ID NO: 128677 - DNA, 25 bp, Rattus norvegicus
agcccacttcctagggactgcagaa

SEQ ID NO: 128678 - DNA, 25 bp, Rattus norvegicus
agcccacttcctctttacatggcag

SEQ ID NO: 128679 - DNA, 25 bp, Rattus norvegicus
agcccacttcctgtttacatggcag

SEQ ID NO: 128680 - DNA, 25 bp, Rattus norvegicus
agcccacttccttgggactgcagaa

SEQ ID NO: 128681 - DNA, 25 bp, Rattus norvegicus
agcccacttctgaattcccaattgt

SEQ ID NO: 128682 - DNA, 25 bp, Rattus norvegicus
agcccacttctgtattcccaattgt

SEQ ID NO: 128683 - DNA, 25 bp, Rattus norvegicus
agcccacttggcacatttcttaact

SEQ ID NO: 128684 - DNA, 25 bp, Rattus norvegicus
agcccacttggctcatttcttaact

SEQ ID NO: 128685 - DNA, 25 bp, Rattus norvegicus
agcccacttgggatgatatacagca

SEQ ID NO: 128686 - DNA, 25 bp, Rattus norvegicus
agcccacttgggttgatatacagca

SEQ ID NO: 128687 - DNA, 25 bp, Rattus norvegicus
agcccagaaccgctggccgcggtgt

SEQ ID NO: 128688 - DNA, 25 bp, Rattus norvegicus
agcccagaaccggtggccgcggtgt

SEQ ID NO: 128689 - DNA, 25 bp, Rattus norvegicus
agcccagaacctactaatgctgatt

SEQ ID NO: 128690 - DNA, 25 bp, Rattus norvegicus
agcccagaaccttctaatgctgatt

SEQ ID NO: 128691 - DNA, 25 bp, Rattus norvegicus
agcccagacagaaaacaggcccaag

SEQ ID NO: 128692 - DNA, 25 bp, Rattus norvegicus
agcccagacagataacaggcccaag

SEQ ID NO: 128693 - DNA, 25 bp, Rattus norvegicus
agcccagacaggacacaatctttgt

SEQ ID NO: 128694 - DNA, 25 bp, Rattus norvegicus
agcccagacaggaccacagaactgc

SEQ ID NO: 128695 - DNA, 25 bp, Rattus norvegicus
agcccagacaggtcacaatctttgt

SEQ ID NO: 128696 - DNA, 25 bp, Rattus norvegicus
agcccagacaggtccacagaactgc

SEQ ID NO: 128697 - DNA, 25 bp, Rattus norvegicus
agcccagacagtcagtgctctgtgc

SEQ ID NO: 128698 - DNA, 25 bp, Rattus norvegicus
agcccagacagtgagtgctctgtgc

SEQ ID NO: 128699 - DNA, 25 bp, Rattus norvegicus
agcccagacttgagaaagctgattg

SEQ ID NO: 128700 - DNA, 25 bp, Rattus norvegicus
agcccagacttgtgaaagctgattg

SEQ ID NO: 128701 - DNA, 25 bp, Rattus norvegicus
agcccagagcaccttctggaggcct

SEQ ID NO: 128702 - DNA, 25 bp, Rattus norvegicus
agcccagagcacgttctggaggcct

SEQ ID NO: 128703 - DNA, 25 bp, Rattus norvegicus
agcccagagcatcactaacccttag

SEQ ID NO: 128704 - DNA, 25 bp, Rattus norvegicus
agcccagagcatgactaacccttag

SEQ ID NO: 128705 - DNA, 25 bp, Rattus norvegicus
agcccagagctaatgtgtcagccat

SEQ ID NO: 128706 - DNA, 25 bp, Rattus norvegicus
agcccagagctattgtgtcagccat

SEQ ID NO: 128707 - DNA, 25 bp, Rattus norvegicus
agcccagagctgagaccgagtgctg

SEQ ID NO: 128708 - DNA, 25 bp, Rattus norvegicus
agcccagagctgtgaccgagtgctg

SEQ ID NO: 128709 - DNA, 25 bp, Rattus norvegicus
agcccagaggaacctcagtctacaa

SEQ ID NO: 128710 - DNA, 25 bp, Rattus norvegicus
agcccagaggaagctcagtctacaa

SEQ ID NO: 128711 - DNA, 25 bp, Rattus norvegicus
agcccagagtcacggattcctttgc

SEQ ID NO: 128712 - DNA, 25 bp, Rattus norvegicus
agcccagagtcagggattcctttgc

SEQ ID NO: 128713 - DNA, 25 bp, Rattus norvegicus
agcccagatctgactgacatccaga

SEQ ID NO: 128714 - DNA, 25 bp, Rattus norvegicus
agcccagatctgtctgacatccaga

SEQ ID NO: 128715 - DNA, 25 bp, Rattus norvegicus
agcccagattacaatgtgaagacag

SEQ ID NO: 128716 - DNA, 25 bp, Rattus norvegicus
agcccagattactatgtgaagacag

SEQ ID NO: 128717 - DNA, 25 bp, Rattus norvegicus
agcccagcaacccttcccgtgcggt

SEQ ID NO: 128718 - DNA, 25 bp, Rattus norvegicus
agcccagcaaccgttcccgtgcggt

SEQ ID NO: 128719 - DNA, 25 bp, Rattus norvegicus
agcccagcaccaacgggaatcatgg

SEQ ID NO: 128720 - DNA, 25 bp, Rattus norvegicus
agcccagcaccatcgggaatcatgg

SEQ ID NO: 128721 - DNA, 25 bp, Rattus norvegicus
agcccagcacccatcagacatggat

SEQ ID NO: 128722 - DNA, 25 bp, Rattus norvegicus
agcccagcacccttcagacatggat

SEQ ID NO: 128723 - DNA, 25 bp, Rattus norvegicus
agcccagcactccagcattgaggaa

SEQ ID NO: 128724 - DNA, 25 bp, Rattus norvegicus
agcccagcactcgagcattgaggaa

SEQ ID NO: 128725 - DNA, 25 bp, Rattus norvegicus
agcccagcatgacttctgcagaaga

SEQ ID NO: 128726 - DNA, 25 bp, Rattus norvegicus
agcccagcatgagttctgcagaaga

SEQ ID NO: 128727 - DNA, 25 bp, Rattus norvegicus
agcccagccacaatgttggcaattt

SEQ ID NO: 128728 - DNA, 25 bp, Rattus norvegicus
agcccagccacattgttggcaattt

SEQ ID NO: 128729 - DNA, 25 bp, Rattus norvegicus
agcccagccaccacgaatctgtaaa

SEQ ID NO: 128730 - DNA, 25 bp, Rattus norvegicus
agcccagccacctcgaatctgtaaa

SEQ ID NO: 128731 - DNA, 25 bp, Rattus norvegicus
agcccagccataaacttatcttcct

SEQ ID NO: 128732 - DNA, 25 bp, Rattus norvegicus
agcccagccatatacttatcttcct

SEQ ID NO: 128733 - DNA, 25 bp, Rattus norvegicus
agcccagcccctatttgagcttcaa

SEQ ID NO: 128734 - DNA, 25 bp, Rattus norvegicus
agcccagcccctttttgagcttcaa

SEQ ID NO: 128735 - DNA, 25 bp, Rattus norvegicus
agcccagccctcacatgtacgaaga

SEQ ID NO: 128736 - DNA, 25 bp, Rattus norvegicus
agcccagccctctcatgtacgaaga

SEQ ID NO: 128737 - DNA, 25 bp, Rattus norvegicus
agcccagcccttagaatctgtgaca

SEQ ID NO: 128738 - DNA, 25 bp, Rattus norvegicus
agcccagcccttatcaagtaatttg

SEQ ID NO: 128739 - DNA, 25 bp, Rattus norvegicus
agcccagccctttgaatctgtgaca

SEQ ID NO: 128740 - DNA, 25 bp, Rattus norvegicus
agcccagcccttttcaagtaatttg

SEQ ID NO: 128741 - DNA, 25 bp, Rattus norvegicus
agcccagcctggaggttgtgtattg

SEQ ID NO: 128742 - DNA, 25 bp, Rattus norvegicus
agcccagcctggtggttgtgtattg

SEQ ID NO: 128743 - DNA, 25 bp, Rattus norvegicus
agcccagccttcaatttggcacata

SEQ ID NO: 128744 - DNA, 25 bp, Rattus norvegicus
agcccagccttctatttggcacata

SEQ ID NO: 128745 - DNA, 25 bp, Rattus norvegicus
agcccagcgccacccaagaagagga

SEQ ID NO: 128746 - DNA, 25 bp, Rattus norvegicus
agcccagcgccagccaagaagagga

SEQ ID NO: 128747 - DNA, 25 bp, Rattus norvegicus
agcccagcgggcatcttgaattgaa

SEQ ID NO: 128748 - DNA, 25 bp, Rattus norvegicus
agcccagcgggcttcttgaattgaa

SEQ ID NO: 128749 - DNA, 25 bp, Rattus norvegicus
agcccagcgggtagagttggcccaa

SEQ ID NO: 128750 - DNA, 25 bp, Rattus norvegicus
agcccagcgggttgagttggcccaa

SEQ ID NO: 128751 - DNA, 25 bp, Rattus norvegicus
agcccagcggtccagtcaacatgaa

SEQ ID NO: 128752 - DNA, 25 bp, Rattus norvegicus
agcccagcggtcgagtcaacatgaa

SEQ ID NO: 128753 - DNA, 25 bp, Rattus norvegicus
agcccagcgtccagcaggtggtgaa

SEQ ID NO: 128754 - DNA, 25 bp, Rattus norvegicus
agcccagcgtcctgcaggtggtgaa

SEQ ID NO: 128755 - DNA, 25 bp, Rattus norvegicus
agcccagcgtttcatttaggacact

SEQ ID NO: 128756 - DNA, 25 bp, Rattus norvegicus
agcccagcgtttgatttaggacact

SEQ ID NO: 128757 - DNA, 25 bp, Rattus norvegicus
agcccagctatcctttatcttgagt

SEQ ID NO: 128758 - DNA, 25 bp, Rattus norvegicus
agcccagctatcgtttatcttgagt

SEQ ID NO: 128759 - DNA, 25 bp, Rattus norvegicus
agcccagctccacgcacaaattgtg

SEQ ID NO: 128760 - DNA, 25 bp, Rattus norvegicus
agcccagctccaggcacaaattgtg

SEQ ID NO: 128761 - DNA, 25 bp, Rattus norvegicus
agcccagctcctaagctagttgtga

SEQ ID NO: 128762 - DNA, 25 bp, Rattus norvegicus
agcccagctccttagctagttgtga

SEQ ID NO: 128763 - DNA, 25 bp, Rattus norvegicus
agcccagctctcaaagacttttcat

SEQ ID NO: 128764 - DNA, 25 bp, Rattus norvegicus
agcccagctctctaagacttttcat

SEQ ID NO: 128765 - DNA, 25 bp, Rattus norvegicus
agcccagctggtagattcgattcct

SEQ ID NO: 128766 - DNA, 25 bp, Rattus norvegicus
agcccagctggttgattcgattcct

SEQ ID NO: 128767 - DNA, 25 bp, Rattus norvegicus
agcccaggaaacaccttggccaaag

SEQ ID NO: 128768 - DNA, 25 bp, Rattus norvegicus
agcccaggaaactccttggccaaag

SEQ ID NO: 128769 - DNA, 25 bp, Rattus norvegicus
agcccaggaacaaccctatgtaggc

SEQ ID NO: 128770 - DNA, 25 bp, Rattus norvegicus
agcccaggaacatccctatgtaggc

SEQ ID NO: 128771 - DNA, 25 bp, Rattus norvegicus
agcccaggaagcactgtcacagctg

SEQ ID NO: 128772 - DNA, 25 bp, Rattus norvegicus
agcccaggaagctctgtcacagctg

SEQ ID NO: 128773 - DNA, 25 bp, Rattus norvegicus
agcccaggaattagttggcctatct

SEQ ID NO: 128774 - DNA, 25 bp, Rattus norvegicus
agcccaggaatttgttggcctatct

SEQ ID NO: 128775 - DNA, 25 bp, Rattus norvegicus
agcccaggacgcaacccatgaacag

SEQ ID NO: 128776 - DNA, 25 bp, Rattus norvegicus
agcccaggacgctacccatgaacag

SEQ ID NO: 128777 - DNA, 25 bp, Rattus norvegicus
agcccaggactcatgaatgacgact

SEQ ID NO: 128778 - DNA, 25 bp, Rattus norvegicus
agcccaggactcttgaatgacgact

SEQ ID NO: 128779 - DNA, 25 bp, Rattus norvegicus
agcccaggatgcacacggatgctga

SEQ ID NO: 128780 - DNA, 25 bp, Rattus norvegicus
agcccaggatgctcacggatgctga

SEQ ID NO: 128781 - DNA, 25 bp, Rattus norvegicus
agcccaggattgatgccgctgtact

SEQ ID NO: 128782 - DNA, 25 bp, Rattus norvegicus
agcccaggattgttgccgctgtact

SEQ ID NO: 128783 - DNA, 25 bp, Rattus norvegicus
agcccaggcaaactaccaatcagga

SEQ ID NO: 128784 - DNA, 25 bp, Rattus norvegicus
agcccaggcaaagtaccaatcagga

SEQ ID NO: 128785 - DNA, 25 bp, Rattus norvegicus
agcccaggcctgagagaagatccag

SEQ ID NO: 128786 - DNA, 25 bp, Rattus norvegicus
agcccaggcctgtgagaagatccag

SEQ ID NO: 128787 - DNA, 25 bp, Rattus norvegicus
agcccaggctgacttagacttgcca

SEQ ID NO: 128788 - DNA, 25 bp, Rattus norvegicus
agcccaggctgagttagacttgcca

SEQ ID NO: 128789 - DNA, 25 bp, Rattus norvegicus
agcccagggaagcaatgtgctttgc

SEQ ID NO: 128790 - DNA, 25 bp, Rattus norvegicus
agcccagggaaggaatgtgctttgc

SEQ ID NO: 128791 - DNA, 25 bp, Rattus norvegicus
agcccagggagactctgcctcaggc

SEQ ID NO: 128792 - DNA, 25 bp, Rattus norvegicus
agcccagggagactgcagcagcaat

SEQ ID NO: 128793 - DNA, 25 bp, Rattus norvegicus
agcccagggagagtctgcctcaggc

SEQ ID NO: 128794 - DNA, 25 bp, Rattus norvegicus
agcccagggagagtgcagcagcaat

SEQ ID NO: 128795 - DNA, 25 bp, Rattus norvegicus
agcccagggatgaccagctccacgt

SEQ ID NO: 128796 - DNA, 25 bp, Rattus norvegicus
agcccagggatgtccagctccacgt

SEQ ID NO: 128797 - DNA, 25 bp, Rattus norvegicus
agcccagggcctaaagagtactaca

SEQ ID NO: 128798 - DNA, 25 bp, Rattus norvegicus
agcccagggccttaagagtactaca

SEQ ID NO: 128799 - DNA, 25 bp, Rattus norvegicus
agcccagggtgacacagaggactcg

SEQ ID NO: 128800 - DNA, 25 bp, Rattus norvegicus
agcccagggtgagacagaggactcg

SEQ ID NO: 128801 - DNA, 25 bp, Rattus norvegicus
agcccaggtcttcaagctgagcact

SEQ ID NO: 128802 - DNA, 25 bp, Rattus norvegicus
agcccaggtcttgaagctgagcact

SEQ ID NO: 128803 - DNA, 25 bp, Rattus norvegicus
agcccaggtgtgcagctcttctgtc

SEQ ID NO: 128804 - DNA, 25 bp, Rattus norvegicus
agcccaggtgtggagctcttctgtc

SEQ ID NO: 128805 - DNA, 25 bp, Rattus norvegicus
agcccaggtttcacgtttggttcag

SEQ ID NO: 128806 - DNA, 25 bp, Rattus norvegicus
agcccaggtttctcgtttggttcag

SEQ ID NO: 128807 - DNA, 25 bp, Rattus norvegicus
agcccagtaaccagggacgaccgcg

SEQ ID NO: 128808 - DNA, 25 bp, Rattus norvegicus
agcccagtaacctgggacgaccgcg

SEQ ID NO: 128809 - DNA, 25 bp, Rattus norvegicus
agcccagtcctgaggcagaatcatc

SEQ ID NO: 128810 - DNA, 25 bp, Rattus norvegicus
agcccagtcctgtggcagaatcatc

SEQ ID NO: 128811 - DNA, 25 bp, Rattus norvegicus
agcccagtccttagtaatgtgtttt

SEQ ID NO: 128812 - DNA, 25 bp, Rattus norvegicus
agcccagtcctttgtaatgtgtttt

SEQ ID NO: 128813 - DNA, 25 bp, Rattus norvegicus
agcccagtctccagaagctcttagg

SEQ ID NO: 128814 - DNA, 25 bp, Rattus norvegicus
agcccagtctcctgaagctcttagg

SEQ ID NO: 128815 - DNA, 25 bp, Rattus norvegicus
agcccagtctggcagcagagtacta

SEQ ID NO: 128816 - DNA, 25 bp, Rattus norvegicus
agcccagtctgggagcagagtacta

SEQ ID NO: 128817 - DNA, 25 bp, Rattus norvegicus
agcccagtcttcatatctactgcat

SEQ ID NO: 128818 - DNA, 25 bp, Rattus norvegicus
agcccagtcttcttatctactgcat

SEQ ID NO: 128819 - DNA, 25 bp, Rattus norvegicus
agcccagtgaggagctcgagacaaa

SEQ ID NO: 128820 - DNA, 25 bp, Rattus norvegicus
agcccagtgaggtgctcgagacaaa

SEQ ID NO: 128821 - DNA, 25 bp, Rattus norvegicus
agcccagtgcccatggtagtcggcg

SEQ ID NO: 128822 - DNA, 25 bp, Rattus norvegicus
agcccagtgcccttggtagtcggcg

SEQ ID NO: 128823 - DNA, 25 bp, Rattus norvegicus
agcccagtggtgataatataagtcc

SEQ ID NO: 128824 - DNA, 25 bp, Rattus norvegicus
agcccagtggtgttaatataagtcc

SEQ ID NO: 128825 - DNA, 25 bp, Rattus norvegicus
agcccagtgtgaccacagaagacac

SEQ ID NO: 128826 - DNA, 25 bp, Rattus norvegicus
agcccagtgtgagcacagaagacac

SEQ ID NO: 128827 - DNA, 25 bp, Rattus norvegicus
agcccagtgttgaggagcttttgtg

SEQ ID NO: 128828 - DNA, 25 bp, Rattus norvegicus
agcccagtgttgtggagcttttgtg

SEQ ID NO: 128829 - DNA, 25 bp, Rattus norvegicus
agcccagttactaagccattgtctg

SEQ ID NO: 128830 - DNA, 25 bp, Rattus norvegicus
agcccagttacttagccattgtctg

SEQ ID NO: 128831 - DNA, 25 bp, Rattus norvegicus
agcccagttcaacctgtagtggcaa

SEQ ID NO: 128832 - DNA, 25 bp, Rattus norvegicus
agcccagttcaagctgtagtggcaa

SEQ ID NO: 128833 - DNA, 25 bp, Rattus norvegicus
agcccataacacacctgaaggcatg

SEQ ID NO: 128834 - DNA, 25 bp, Rattus norvegicus
agcccataacactcctgaaggcatg

SEQ ID NO: 128835 - DNA, 25 bp, Rattus norvegicus
agcccatacacacctcagatgctta

SEQ ID NO: 128836 - DNA, 25 bp, Rattus norvegicus
agcccatacacagctcagatgctta

SEQ ID NO: 128837 - DNA, 25 bp, Rattus norvegicus
agcccatacggccagctcttgactg

SEQ ID NO: 128838 - DNA, 25 bp, Rattus norvegicus
agcccatacggcgagctcttgactg

SEQ ID NO: 128839 - DNA, 25 bp, Rattus norvegicus
agcccatactaacggattcatcaaa

SEQ ID NO: 128840 - DNA, 25 bp, Rattus norvegicus
agcccatactaagggattcatcaaa

SEQ ID NO: 128841 - DNA, 25 bp, Rattus norvegicus
agcccatactgcctcggtgtcagac

SEQ ID NO: 128842 - DNA, 25 bp, Rattus norvegicus
agcccatactgcgtcggtgtcagac

SEQ ID NO: 128843 - DNA, 25 bp, Rattus norvegicus
agcccatagcacagcacttatttta

SEQ ID NO: 128844 - DNA, 25 bp, Rattus norvegicus
agcccatagcactgcacttatttta

SEQ ID NO: 128845 - DNA, 25 bp, Rattus norvegicus
agcccatagttgatctgtgttcttc

SEQ ID NO: 128846 - DNA, 25 bp, Rattus norvegicus
agcccatagttgttctgtgttcttc

SEQ ID NO: 128847 - DNA, 25 bp, Rattus norvegicus
agcccatattcgcaagtagctgaat

SEQ ID NO: 128848 - DNA, 25 bp, Rattus norvegicus
agcccatattcggaagtagctgaat

SEQ ID NO: 128849 - DNA, 25 bp, Rattus norvegicus
agcccatcaaacaggagctcatctg

SEQ ID NO: 128850 - DNA, 25 bp, Rattus norvegicus
agcccatcaaactggagctcatctg

SEQ ID NO: 128851 - DNA, 25 bp, Rattus norvegicus
agcccatcaaccatatcttcagata

SEQ ID NO: 128852 - DNA, 25 bp, Rattus norvegicus
agcccatcaaccttatcttcagata

SEQ ID NO: 128853 - DNA, 25 bp, Rattus norvegicus
agcccatcaccaacacgattagtaa

SEQ ID NO: 128854 - DNA, 25 bp, Rattus norvegicus
agcccatcaccatcacgattagtaa

SEQ ID NO: 128855 - DNA, 25 bp, Rattus norvegicus
agcccatcactgagcaggtctggaa

SEQ ID NO: 128856 - DNA, 25 bp, Rattus norvegicus
agcccatcactgtgcaggtctggaa

SEQ ID NO: 128857 - DNA, 25 bp, Rattus norvegicus
agcccatcagacacgttcagtaagt

SEQ ID NO: 128858 - DNA, 25 bp, Rattus norvegicus
agcccatcagactcgttcagtaagt

SEQ ID NO: 128859 - DNA, 25 bp, Rattus norvegicus
agcccatcagcaaatactgtttatt

SEQ ID NO: 128860 - DNA, 25 bp, Rattus norvegicus
agcccatcagcatatactgtttatt

SEQ ID NO: 128861 - DNA, 25 bp, Rattus norvegicus
agcccatcaggcaaagatttctatg

SEQ ID NO: 128862 - DNA, 25 bp, Rattus norvegicus
agcccatcaggcaggtagactggca

SEQ ID NO: 128863 - DNA, 25 bp, Rattus norvegicus
agcccatcaggctaagatttctatg

SEQ ID NO: 128864 - DNA, 25 bp, Rattus norvegicus
agcccatcaggctggtagactggca

SEQ ID NO: 128865 - DNA, 25 bp, Rattus norvegicus
agcccatcagttacctgttttacac

SEQ ID NO: 128866 - DNA, 25 bp, Rattus norvegicus
agcccatcagtttcctgttttacac

SEQ ID NO: 128867 - DNA, 25 bp, Rattus norvegicus
agcccatcataaccctgacattttc

SEQ ID NO: 128868 - DNA, 25 bp, Rattus norvegicus
agcccatcataagcctgacattttc

SEQ ID NO: 128869 - DNA, 25 bp, Rattus norvegicus
agcccatccaatcatgtgctcggga

SEQ ID NO: 128870 - DNA, 25 bp, Rattus norvegicus
agcccatccaatgatgtgctcggga

SEQ ID NO: 128871 - DNA, 25 bp, Rattus norvegicus
agcccatccattcagctggcagcag

SEQ ID NO: 128872 - DNA, 25 bp, Rattus norvegicus
agcccatccattgagctggcagcag

SEQ ID NO: 128873 - DNA, 25 bp, Rattus norvegicus
agcccatcctccagacaagattgaa

SEQ ID NO: 128874 - DNA, 25 bp, Rattus norvegicus
agcccatcctcctgacaagattgaa

SEQ ID NO: 128875 - DNA, 25 bp, Rattus norvegicus
agcccatctaataatcttcacggtt

SEQ ID NO: 128876 - DNA, 25 bp, Rattus norvegicus
agcccatctaattatcttcacggtt

SEQ ID NO: 128877 - DNA, 25 bp, Rattus norvegicus
agcccatctctccagataagcttgt

SEQ ID NO: 128878 - DNA, 25 bp, Rattus norvegicus
agcccatctctcgagataagcttgt

SEQ ID NO: 128879 - DNA, 25 bp, Rattus norvegicus
agcccatctgcaaatttcttcgtaa

SEQ ID NO: 128880 - DNA, 25 bp, Rattus norvegicus
agcccatctgcatatttcttcgtaa

SEQ ID NO: 128881 - DNA, 25 bp, Rattus norvegicus
agcccatctgtgacgtctttgaatt

SEQ ID NO: 128882 - DNA, 25 bp, Rattus norvegicus
agcccatctgtgtcgtctttgaatt

SEQ ID NO: 128883 - DNA, 25 bp, Rattus norvegicus
agcccatctttcagtgactgtctta

SEQ ID NO: 128884 - DNA, 25 bp, Rattus norvegicus
agcccatctttctgtgactgtctta

SEQ ID NO: 128885 - DNA, 25 bp, Rattus norvegicus
agcccatgacgaagactgtgttcaa

SEQ ID NO: 128886 - DNA, 25 bp, Rattus norvegicus
agcccatgacgatgactgtgttcaa

SEQ ID NO: 128887 - DNA, 25 bp, Rattus norvegicus
agcccatgatccacctagtaagggt

SEQ ID NO: 128888 - DNA, 25 bp, Rattus norvegicus
agcccatgatcctcctagtaagggt

SEQ ID NO: 128889 - DNA, 25 bp, Rattus norvegicus
agcccatgcctgatagggaagcaaa

SEQ ID NO: 128890 - DNA, 25 bp, Rattus norvegicus
agcccatgcctgttagggaagcaaa

SEQ ID NO: 128891 - DNA, 25 bp, Rattus norvegicus
agcccatgcgttaggattgtagcct

SEQ ID NO: 128892 - DNA, 25 bp, Rattus norvegicus
agcccatgcgtttggattgtagcct

SEQ ID NO: 128893 - DNA, 25 bp, Rattus norvegicus
agcccatggcctcttcttgaagtca

SEQ ID NO: 128894 - DNA, 25 bp, Rattus norvegicus
agcccatggcctgttcttgaagtca

SEQ ID NO: 128895 - DNA, 25 bp, Rattus norvegicus
agcccatggcttacatctgcagata

SEQ ID NO: 128896 - DNA, 25 bp, Rattus norvegicus
agcccatggctttcatctgcagata

SEQ ID NO: 128897 - DNA, 25 bp, Rattus norvegicus
agcccatgggccattggtaagcctc

SEQ ID NO: 128898 - DNA, 25 bp, Rattus norvegicus
agcccatgggcctttggtaagcctc

SEQ ID NO: 128899 - DNA, 25 bp, Rattus norvegicus
agcccatgggtactacttcagcagt

SEQ ID NO: 128900 - DNA, 25 bp, Rattus norvegicus
agcccatgggtagtacttcagcagt

SEQ ID NO: 128901 - DNA, 25 bp, Rattus norvegicus
agcccatgggtcctgccaagaagag

SEQ ID NO: 128902 - DNA, 25 bp, Rattus norvegicus
agcccatgggtcctgggtatcacat

SEQ ID NO: 128903 - DNA, 25 bp, Rattus norvegicus
agcccatgggtcgtgccaagaagag

SEQ ID NO: 128904 - DNA, 25 bp, Rattus norvegicus
agcccatgggtcgtgggtatcacat

SEQ ID NO: 128905 - DNA, 25 bp, Rattus norvegicus
agcccatggtttcgtgcacactaga

SEQ ID NO: 128906 - DNA, 25 bp, Rattus norvegicus
agcccatggtttggtgcacactaga

SEQ ID NO: 128907 - DNA, 25 bp, Rattus norvegicus
agcccatgtatgacaagctggtgga

SEQ ID NO: 128908 - DNA, 25 bp, Rattus norvegicus
agcccatgtatgtcaagctggtgga

SEQ ID NO: 128909 - DNA, 25 bp, Rattus norvegicus
agcccatgtcatatgcttacatttg

SEQ ID NO: 128910 - DNA, 25 bp, Rattus norvegicus
agcccatgtcatttgcttacatttg

SEQ ID NO: 128911 - DNA, 25 bp, Rattus norvegicus
agcccatgtgatctggtgtttgaca

SEQ ID NO: 128912 - DNA, 25 bp, Rattus norvegicus
agcccatgtgatgtggtgtttgaca

SEQ ID NO: 128913 - DNA, 25 bp, Rattus norvegicus
agcccatgttatctttttagccagg

SEQ ID NO: 128914 - DNA, 25 bp, Rattus norvegicus
agcccatgttatgtttttagccagg

SEQ ID NO: 128915 - DNA, 25 bp, Rattus norvegicus
agcccatgttctccgtattctgtga

SEQ ID NO: 128916 - DNA, 25 bp, Rattus norvegicus
agcccatgttctgcgtattctgtga

SEQ ID NO: 128917 - DNA, 25 bp, Rattus norvegicus
agcccatgtttaatcagtcagccaa

SEQ ID NO: 128918 - DNA, 25 bp, Rattus norvegicus
agcccatgtttattcagtcagccaa

SEQ ID NO: 128919 - DNA, 25 bp, Rattus norvegicus
agcccattcactccgtcacagtgaa

SEQ ID NO: 128920 - DNA, 25 bp, Rattus norvegicus
agcccattcactgcgtcacagtgaa

SEQ ID NO: 128921 - DNA, 25 bp, Rattus norvegicus
agcccattctctcactatgtctata

SEQ ID NO: 128922 - DNA, 25 bp, Rattus norvegicus
agcccattctctgactatgtctata

SEQ ID NO: 128923 - DNA, 25 bp, Rattus norvegicus
agcccattgctcagatggccttaaa

SEQ ID NO: 128924 - DNA, 25 bp, Rattus norvegicus
agcccattgctctgatggccttaaa

SEQ ID NO: 128925 - DNA, 25 bp, Rattus norvegicus
agcccattggcactgagactctgga

SEQ ID NO: 128926 - DNA, 25 bp, Rattus norvegicus
agcccattggcagtgagactctgga

SEQ ID NO: 128927 - DNA, 25 bp, Rattus norvegicus
agcccattggtacaatcgttgcaca

SEQ ID NO: 128928 - DNA, 25 bp, Rattus norvegicus
agcccattggtagaatcgttgcaca

SEQ ID NO: 128929 - DNA, 25 bp, Rattus norvegicus
agcccatttctgacttttgtggaca

SEQ ID NO: 128930 - DNA, 25 bp, Rattus norvegicus
agcccatttctgtcttttgtggaca

SEQ ID NO: 128931 - DNA, 25 bp, Rattus norvegicus
agcccatttgacacctaacagaaga

SEQ ID NO: 128932 - DNA, 25 bp, Rattus norvegicus
agcccatttgactcctaacagaaga

SEQ ID NO: 128933 - DNA, 25 bp, Rattus norvegicus
agccccaaaatcactttggcccatt

SEQ ID NO: 128934 - DNA, 25 bp, Rattus norvegicus
agccccaaaatctctttggcccatt

SEQ ID NO: 128935 - DNA, 25 bp, Rattus norvegicus
agccccaaactcagtttacactggt

SEQ ID NO: 128936 - DNA, 25 bp, Rattus norvegicus
agccccaaactctgtttacactggt

SEQ ID NO: 128937 - DNA, 25 bp, Rattus norvegicus
agccccaacatgagaactgcctgat

SEQ ID NO: 128938 - DNA, 25 bp, Rattus norvegicus
agccccaacatgtgaactgcctgat

SEQ ID NO: 128939 - DNA, 25 bp, Rattus norvegicus
agccccaacctgatttctagatttg

SEQ ID NO: 128940 - DNA, 25 bp, Rattus norvegicus
agccccaacctgttttctagatttg

SEQ ID NO: 128941 - DNA, 25 bp, Rattus norvegicus
agccccaagaccagcttcagatgga

SEQ ID NO: 128942 - DNA, 25 bp, Rattus norvegicus
agccccaagacctgcttcagatgga

SEQ ID NO: 128943 - DNA, 25 bp, Rattus norvegicus
agccccaagctcagtgtgagtctgg

SEQ ID NO: 128944 - DNA, 25 bp, Rattus norvegicus
agccccaagctctgtgtgagtctgg

SEQ ID NO: 128945 - DNA, 25 bp, Rattus norvegicus
agccccaaggccctggatatagata

SEQ ID NO: 128946 - DNA, 25 bp, Rattus norvegicus
agccccaaggccgtggatatagata

SEQ ID NO: 128947 - DNA, 25 bp, Rattus norvegicus
agccccaatcatctttagcttttgt

SEQ ID NO: 128948 - DNA, 25 bp, Rattus norvegicus
agccccaatcatgtttagcttttgt

SEQ ID NO: 128949 - DNA, 25 bp, Rattus norvegicus
agccccacaattaagtgttctgtag

SEQ ID NO: 128950 - DNA, 25 bp, Rattus norvegicus
agccccacaattactcttgtgtaac

SEQ ID NO: 128951 - DNA, 25 bp, Rattus norvegicus
agccccacaatttagtgttctgtag

SEQ ID NO: 128952 - DNA, 25 bp, Rattus norvegicus
agccccacaatttctcttgtgtaac

SEQ ID NO: 128953 - DNA, 25 bp, Rattus norvegicus
agccccacactgctgttgaaagagt

SEQ ID NO: 128954 - DNA, 25 bp, Rattus norvegicus
agccccacactggtgttgaaagagt

SEQ ID NO: 128955 - DNA, 25 bp, Rattus norvegicus
agccccacagcccataatgttaagg

SEQ ID NO: 128956 - DNA, 25 bp, Rattus norvegicus
agccccacagccgataatgttaagg

SEQ ID NO: 128957 - DNA, 25 bp, Rattus norvegicus
agccccacaggactttctaataatc

SEQ ID NO: 128958 - DNA, 25 bp, Rattus norvegicus
agccccacaggagtttctaataatc

SEQ ID NO: 128959 - DNA, 25 bp, Rattus norvegicus
agccccacattcacagtcaagtttc

SEQ ID NO: 128960 - DNA, 25 bp, Rattus norvegicus
agccccacattctcagtcaagtttc

SEQ ID NO: 128961 - DNA, 25 bp, Rattus norvegicus
agccccaccaataaaggttcatggt

SEQ ID NO: 128962 - DNA, 25 bp, Rattus norvegicus
agccccaccaattaaggttcatggt

SEQ ID NO: 128963 - DNA, 25 bp, Rattus norvegicus
agccccaccaggcatattgtctgag

SEQ ID NO: 128964 - DNA, 25 bp, Rattus norvegicus
agccccaccagggatattgtctgag

SEQ ID NO: 128965 - DNA, 25 bp, Rattus norvegicus
agccccacgtaactgtctatattag

SEQ ID NO: 128966 - DNA, 25 bp, Rattus norvegicus
agccccacgtaagtgtctatattag

SEQ ID NO: 128967 - DNA, 25 bp, Rattus norvegicus
agccccacgtgcactgatgtttttt

SEQ ID NO: 128968 - DNA, 25 bp, Rattus norvegicus
agccccacgtgctctgatgtttttt

SEQ ID NO: 128969 - DNA, 25 bp, Rattus norvegicus
agccccactactaacgttttggatg

SEQ ID NO: 128970 - DNA, 25 bp, Rattus norvegicus
agccccactacttacgttttggatg

SEQ ID NO: 128971 - DNA, 25 bp, Rattus norvegicus
agccccactggcagaatcagctttg

SEQ ID NO: 128972 - DNA, 25 bp, Rattus norvegicus
agccccactggctgaatcagctttg

SEQ ID NO: 128973 - DNA, 25 bp, Rattus norvegicus
agccccactgtgcacttgagaatgt

SEQ ID NO: 128974 - DNA, 25 bp, Rattus norvegicus
agccccactgtggacttgagaatgt

SEQ ID NO: 128975 - DNA, 25 bp, Rattus norvegicus
agccccacttagcactgatgtccta

SEQ ID NO: 128976 - DNA, 25 bp, Rattus norvegicus
agccccacttaggactgatgtccta

SEQ ID NO: 128977 - DNA, 25 bp, Rattus norvegicus
agccccactttaacacgtgtacaga

SEQ ID NO: 128978 - DNA, 25 bp, Rattus norvegicus
agccccactttatcacgtgtacaga

SEQ ID NO: 128979 - DNA, 25 bp, Rattus norvegicus
agccccagaactcttgttcaatcta

SEQ ID NO: 128980 - DNA, 25 bp, Rattus norvegicus
agccccagaactgttgttcaatcta

SEQ ID NO: 128981 - DNA, 25 bp, Rattus norvegicus
agccccagacaaaatgcatgtgact

SEQ ID NO: 128982 - DNA, 25 bp, Rattus norvegicus
agccccagacaatatgcatgtgact

SEQ ID NO: 128983 - DNA, 25 bp, Rattus norvegicus
agccccagactactgatttggcaga

SEQ ID NO: 128984 - DNA, 25 bp, Rattus norvegicus
agccccagactagtgatttggcaga

SEQ ID NO: 128985 - DNA, 25 bp, Rattus norvegicus
agccccagagtcaaagtgtgtacca

SEQ ID NO: 128986 - DNA, 25 bp, Rattus norvegicus
agccccagagtctaagtgtgtacca

SEQ ID NO: 128987 - DNA, 25 bp, Rattus norvegicus
agccccagatacctggaagcttctt

SEQ ID NO: 128988 - DNA, 25 bp, Rattus norvegicus
agccccagatacgtggaagcttctt

SEQ ID NO: 128989 - DNA, 25 bp, Rattus norvegicus
agccccagcaatcaggactgcgctt

SEQ ID NO: 128990 - DNA, 25 bp, Rattus norvegicus
agccccagcaatgaggactgcgctt

SEQ ID NO: 128991 - DNA, 25 bp, Rattus norvegicus
agccccagcagacagcttagcttag

SEQ ID NO: 128992 - DNA, 25 bp, Rattus norvegicus
agccccagcagagagcttagcttag

SEQ ID NO: 128993 - DNA, 25 bp, Rattus norvegicus
agccccagcatcctaaaattcctat

SEQ ID NO: 128994 - DNA, 25 bp, Rattus norvegicus
agccccagcatcgtaaaattcctat

SEQ ID NO: 128995 - DNA, 25 bp, Rattus norvegicus
agccccagctctcttccataagaag

SEQ ID NO: 128996 - DNA, 25 bp, Rattus norvegicus
agccccagctctgttccataagaag

SEQ ID NO: 128997 - DNA, 25 bp, Rattus norvegicus
agccccaggactctaaactgagcag

SEQ ID NO: 128998 - DNA, 25 bp, Rattus norvegicus
agccccaggactgtaaactgagcag

SEQ ID NO: 128999 - DNA, 25 bp, Rattus norvegicus
agccccaggattccattttctaaag

SEQ ID NO: 129000 - DNA, 25 bp, Rattus norvegicus
agccccaggattgcattttctaaag

SEQ ID NO: 129001 - DNA, 25 bp, Rattus norvegicus
agccccagggacaagatgcgaggat

SEQ ID NO: 129002 - DNA, 25 bp, Rattus norvegicus
agccccagggactagatgcgaggat

SEQ ID NO: 129003 - DNA, 25 bp, Rattus norvegicus
agccccagggcgagaccgtagtcga

SEQ ID NO: 129004 - DNA, 25 bp, Rattus norvegicus
agccccagggcgtgaccgtagtcga

SEQ ID NO: 129005 - DNA, 25 bp, Rattus norvegicus
agccccagggttagtcttatttatg

SEQ ID NO: 129006 - DNA, 25 bp, Rattus norvegicus
agccccagggtttgtcttatttatg

SEQ ID NO: 129007 - DNA, 25 bp, Rattus norvegicus
agccccaggtaactggtgctctgac

SEQ ID NO: 129008 - DNA, 25 bp, Rattus norvegicus
agccccaggtaagtggtgctctgac

SEQ ID NO: 129009 - DNA, 25 bp, Rattus norvegicus
agccccaggtctaagcgtactattt

SEQ ID NO: 129010 - DNA, 25 bp, Rattus norvegicus
agccccaggtcttagcgtactattt

SEQ ID NO: 129011 - DNA, 25 bp, Rattus norvegicus
agccccagtcacaacagcattaatg

SEQ ID NO: 129012 - DNA, 25 bp, Rattus norvegicus
agccccagtcactacagcattaatg

SEQ ID NO: 129013 - DNA, 25 bp, Rattus norvegicus
agccccagtgggagacttcaagacc

SEQ ID NO: 129014 - DNA, 25 bp, Rattus norvegicus
agccccagtgggtgacttcaagacc

SEQ ID NO: 129015 - DNA, 25 bp, Rattus norvegicus
agccccagtgtaactcattcattcc

SEQ ID NO: 129016 - DNA, 25 bp, Rattus norvegicus
agccccagtgtatctcattcattcc

SEQ ID NO: 129017 - DNA, 25 bp, Rattus norvegicus
agccccagttcacagtcttctgagg

SEQ ID NO: 129018 - DNA, 25 bp, Rattus norvegicus
agccccagttcagagtcttctgagg

SEQ ID NO: 129019 - DNA, 25 bp, Rattus norvegicus
agccccagttctcccatttggatta

SEQ ID NO: 129020 - DNA, 25 bp, Rattus norvegicus
agccccagttctgccatttggatta

SEQ ID NO: 129021 - DNA, 25 bp, Rattus norvegicus
agccccatacagctgttggttagaa

SEQ ID NO: 129022 - DNA, 25 bp, Rattus norvegicus
agccccatacaggtgttggttagaa

SEQ ID NO: 129023 - DNA, 25 bp, Rattus norvegicus
agccccatactgaacaatgcctgga

SEQ ID NO: 129024 - DNA, 25 bp, Rattus norvegicus
agccccatactgtacaatgcctgga

SEQ ID NO: 129025 - DNA, 25 bp, Rattus norvegicus
agccccataggcaaaggtctacctt

SEQ ID NO: 129026 - DNA, 25 bp, Rattus norvegicus
agccccataggctaaggtctacctt

SEQ ID NO: 129027 - DNA, 25 bp, Rattus norvegicus
agccccatctacattcttaaatctt

SEQ ID NO: 129028 - DNA, 25 bp, Rattus norvegicus
agccccatctactttcttaaatctt

SEQ ID NO: 129029 - DNA, 25 bp, Rattus norvegicus
agccccattactccattcacagttt

SEQ ID NO: 129030 - DNA, 25 bp, Rattus norvegicus
agccccattactgcattcacagttt

SEQ ID NO: 129031 - DNA, 25 bp, Rattus norvegicus
agccccattcggagtcggtgctgta

SEQ ID NO: 129032 - DNA, 25 bp, Rattus norvegicus
agccccattcggtgtcggtgctgta

SEQ ID NO: 129033 - DNA, 25 bp, Rattus norvegicus
agcccccagtgtaccatcaacaggg

SEQ ID NO: 129034 - DNA, 25 bp, Rattus norvegicus
agcccccagtgttccatcaacaggg

SEQ ID NO: 129035 - DNA, 25 bp, Rattus norvegicus
agccccgagaacaactcccaaagtg

SEQ ID NO: 129036 - DNA, 25 bp, Rattus norvegicus
agccccgagaactactcccaaagtg

SEQ ID NO: 129037 - DNA, 25 bp, Rattus norvegicus
agccccgagagtcactgttcttaat

SEQ ID NO: 129038 - DNA, 25 bp, Rattus norvegicus
agccccgagagtgactgttcttaat

SEQ ID NO: 129039 - DNA, 25 bp, Rattus norvegicus
agccccgaggctctaactgttagaa

SEQ ID NO: 129040 - DNA, 25 bp, Rattus norvegicus
agccccgaggctgtaactgttagaa

SEQ ID NO: 129041 - DNA, 25 bp, Rattus norvegicus
agccccgatggaaaagacactacag

SEQ ID NO: 129042 - DNA, 25 bp, Rattus norvegicus
agccccgatggataagacactacag

SEQ ID NO: 129043 - DNA, 25 bp, Rattus norvegicus
agccccgatggcagcccaggatcag

SEQ ID NO: 129044 - DNA, 25 bp, Rattus norvegicus
agccccgatggctgcccaggatcag

SEQ ID NO: 129045 - DNA, 25 bp, Rattus norvegicus
agccccgccctgattgtcttatgaa

SEQ ID NO: 129046 - DNA, 25 bp, Rattus norvegicus
agccccgccctgtttgtcttatgaa

SEQ ID NO: 129047 - DNA, 25 bp, Rattus norvegicus
agccccgctcccaatattaggaagg

SEQ ID NO: 129048 - DNA, 25 bp, Rattus norvegicus
agccccgctccctatattaggaagg

SEQ ID NO: 129049 - DNA, 25 bp, Rattus norvegicus
agccccgctttcaagtgtggttgca

SEQ ID NO: 129050 - DNA, 25 bp, Rattus norvegicus
agccccgctttctagtgtggttgca

SEQ ID NO: 129051 - DNA, 25 bp, Rattus norvegicus
agccccggagagctaacaccagcga

SEQ ID NO: 129052 - DNA, 25 bp, Rattus norvegicus
agccccggagaggtaacaccagcga

SEQ ID NO: 129053 - DNA, 25 bp, Rattus norvegicus
agccccggagctagtcgacagagtc

SEQ ID NO: 129054 - DNA, 25 bp, Rattus norvegicus
agccccggagcttgtcgacagagtc

SEQ ID NO: 129055 - DNA, 25 bp, Rattus norvegicus
agccccggaggtacaagtcctgcaa

SEQ ID NO: 129056 - DNA, 25 bp, Rattus norvegicus
agccccggaggttcaagtcctgcaa

SEQ ID NO: 129057 - DNA, 25 bp, Rattus norvegicus
agccccggatgcagtctaagttctg

SEQ ID NO: 129058 - DNA, 25 bp, Rattus norvegicus
agccccggatgctgtctaagttctg

SEQ ID NO: 129059 - DNA, 25 bp, Rattus norvegicus
agccccggcttcatggctttgtcct

SEQ ID NO: 129060 - DNA, 25 bp, Rattus norvegicus
agccccggcttcttggctttgtcct

SEQ ID NO: 129061 - DNA, 25 bp, Rattus norvegicus
agccccgggcgaacgagctagcgaa

SEQ ID NO: 129062 - DNA, 25 bp, Rattus norvegicus
agccccgggcgatcgagctagcgaa

SEQ ID NO: 129063 - DNA, 25 bp, Rattus norvegicus
agccccgggtacatctgatgagagt

SEQ ID NO: 129064 - DNA, 25 bp, Rattus norvegicus
agccccgggtacttctgatgagagt

SEQ ID NO: 129065 - DNA, 25 bp, Rattus norvegicus
agccccggtctcactgatatgtaga

SEQ ID NO: 129066 - DNA, 25 bp, Rattus norvegicus
agccccggtctctctgatatgtaga

SEQ ID NO: 129067 - DNA, 25 bp, Rattus norvegicus
agccccggtgaacgtacatgtcgta

SEQ ID NO: 129068 - DNA, 25 bp, Rattus norvegicus
agccccggtgaaggtacatgtcgta

SEQ ID NO: 129069 - DNA, 25 bp, Rattus norvegicus
agccccggttctctgtggtctcaca

SEQ ID NO: 129070 - DNA, 25 bp, Rattus norvegicus
agccccggttctgtgtggtctcaca

SEQ ID NO: 129071 - DNA, 25 bp, Rattus norvegicus
agccccgtcaggaaggctgtctgcc

SEQ ID NO: 129072 - DNA, 25 bp, Rattus norvegicus
agccccgtcaggtaggctgtctgcc

SEQ ID NO: 129073 - DNA, 25 bp, Rattus norvegicus
agccccgtccagaaagattccagaa

SEQ ID NO: 129074 - DNA, 25 bp, Rattus norvegicus
agccccgtccagtaagattccagaa

SEQ ID NO: 129075 - DNA, 25 bp, Rattus norvegicus
agccccgtgagacaggtttccttca

SEQ ID NO: 129076 - DNA, 25 bp, Rattus norvegicus
agccccgtgagagaggtttccttca

SEQ ID NO: 129077 - DNA, 25 bp, Rattus norvegicus
agccccgtgatcacaacagtcagaa

SEQ ID NO: 129078 - DNA, 25 bp, Rattus norvegicus
agccccgtgatctcaacagtcagaa

SEQ ID NO: 129079 - DNA, 25 bp, Rattus norvegicus
agccccgtgcacagaggtttaacct

SEQ ID NO: 129080 - DNA, 25 bp, Rattus norvegicus
agccccgtgcactgaggtttaacct

SEQ ID NO: 129081 - DNA, 25 bp, Rattus norvegicus
agccccgtgggcagtatttatctcc

SEQ ID NO: 129082 - DNA, 25 bp, Rattus norvegicus
agccccgtgggctgtatttatctcc

SEQ ID NO: 129083 - DNA, 25 bp, Rattus norvegicus
agccccgttttgatttgctagatga

SEQ ID NO: 129084 - DNA, 25 bp, Rattus norvegicus
agccccgttttgttttgctagatga

SEQ ID NO: 129085 - DNA, 25 bp, Rattus norvegicus
agcccctaagctattgtgattgtgt

SEQ ID NO: 129086 - DNA, 25 bp, Rattus norvegicus
agcccctaagcttttgtgattgtgt

SEQ ID NO: 129087 - DNA, 25 bp, Rattus norvegicus
agcccctaaggcagcttcttgtgct

SEQ ID NO: 129088 - DNA, 25 bp, Rattus norvegicus
agcccctaaggctgcttcttgtgct

SEQ ID NO: 129089 - DNA, 25 bp, Rattus norvegicus
agcccctaccagaatgtcttcgatt

SEQ ID NO: 129090 - DNA, 25 bp, Rattus norvegicus
agcccctaccagtatgtcttcgatt

SEQ ID NO: 129091 - DNA, 25 bp, Rattus norvegicus
agcccctacctaaggtttgctcaag

SEQ ID NO: 129092 - DNA, 25 bp, Rattus norvegicus
agcccctacctatggtttgctcaag

SEQ ID NO: 129093 - DNA, 25 bp, Rattus norvegicus
agcccctagattcctgcatggtaca

SEQ ID NO: 129094 - DNA, 25 bp, Rattus norvegicus
agcccctagattgctgcatggtaca

SEQ ID NO: 129095 - DNA, 25 bp, Rattus norvegicus
agcccctagtggcatttggactaaa

SEQ ID NO: 129096 - DNA, 25 bp, Rattus norvegicus
agcccctagtgggatttggactaaa

SEQ ID NO: 129097 - DNA, 25 bp, Rattus norvegicus
agcccctatggcatctttctttagt

SEQ ID NO: 129098 - DNA, 25 bp, Rattus norvegicus
agcccctatggcttctttctttagt

SEQ ID NO: 129099 - DNA, 25 bp, Rattus norvegicus
agcccctatttcacgaggtgctatc

SEQ ID NO: 129100 - DNA, 25 bp, Rattus norvegicus
agcccctatttctcgaggtgctatc

SEQ ID NO: 129101 - DNA, 25 bp, Rattus norvegicus
agcccctcaagcagggacttgattt

SEQ ID NO: 129102 - DNA, 25 bp, Rattus norvegicus
agcccctcaagctgggacttgattt

SEQ ID NO: 129103 - DNA, 25 bp, Rattus norvegicus
agcccctcaaggaccgggaatatga

SEQ ID NO: 129104 - DNA, 25 bp, Rattus norvegicus
agcccctcaaggtccgggaatatga

SEQ ID NO: 129105 - DNA, 25 bp, Rattus norvegicus
agcccctcacacatttggatatttg

SEQ ID NO: 129106 - DNA, 25 bp, Rattus norvegicus
agcccctcacacttttggatatttg

SEQ ID NO: 129107 - DNA, 25 bp, Rattus norvegicus
agcccctcacatatgcagagtgtca

SEQ ID NO: 129108 - DNA, 25 bp, Rattus norvegicus
agcccctcacatttgcagagtgtca

SEQ ID NO: 129109 - DNA, 25 bp, Rattus norvegicus
agcccctcacgtattgtggttgggt

SEQ ID NO: 129110 - DNA, 25 bp, Rattus norvegicus
agcccctcacgttttgtggttgggt

SEQ ID NO: 129111 - DNA, 25 bp, Rattus norvegicus
agcccctcactactagtacttggtt

SEQ ID NO: 129112 - DNA, 25 bp, Rattus norvegicus
agcccctcactagtagtacttggtt

SEQ ID NO: 129113 - DNA, 25 bp, Rattus norvegicus
agcccctcatccctgaaatctcagt

SEQ ID NO: 129114 - DNA, 25 bp, Rattus norvegicus
agcccctcatccgtgaaatctcagt

SEQ ID NO: 129115 - DNA, 25 bp, Rattus norvegicus
agcccctcctagataacaagtgcag

SEQ ID NO: 129116 - DNA, 25 bp, Rattus norvegicus
agcccctcctagttaacaagtgcag

SEQ ID NO: 129117 - DNA, 25 bp, Rattus norvegicus
agcccctcctcaaggacaaagatga

SEQ ID NO: 129118 - DNA, 25 bp, Rattus norvegicus
agcccctcctcatggacaaagatga

SEQ ID NO: 129119 - DNA, 25 bp, Rattus norvegicus
agcccctcgcagaatgttagcttat

SEQ ID NO: 129120 - DNA, 25 bp, Rattus norvegicus
agcccctcgcagtatgttagcttat

SEQ ID NO: 129121 - DNA, 25 bp, Rattus norvegicus
agcccctcgccacgatgaagttttc

SEQ ID NO: 129122 - DNA, 25 bp, Rattus norvegicus
agcccctcgccaggatgaagttttc

SEQ ID NO: 129123 - DNA, 25 bp, Rattus norvegicus
agcccctcgtgaatagcgtcttaac

SEQ ID NO: 129124 - DNA, 25 bp, Rattus norvegicus
agcccctcgtgattagcgtcttaac

SEQ ID NO: 129125 - DNA, 25 bp, Rattus norvegicus
agcccctctattaagatggtgcaca

SEQ ID NO: 129126 - DNA, 25 bp, Rattus norvegicus
agcccctctatttagatggtgcaca

SEQ ID NO: 129127 - DNA, 25 bp, Rattus norvegicus
agcccctctccaagtgatgaactga

SEQ ID NO: 129128 - DNA, 25 bp, Rattus norvegicus
agcccctctccatgtgatgaactga

SEQ ID NO: 129129 - DNA, 25 bp, Rattus norvegicus
agcccctctggacttgatcctaatg

SEQ ID NO: 129130 - DNA, 25 bp, Rattus norvegicus
agcccctctggagttgatcctaatg

SEQ ID NO: 129131 - DNA, 25 bp, Rattus norvegicus
agcccctctgttatcacacatgcat

SEQ ID NO: 129132 - DNA, 25 bp, Rattus norvegicus
agcccctctgttttcacacatgcat

SEQ ID NO: 129133 - DNA, 25 bp, Rattus norvegicus
agcccctgaagtacactctgagtgg

SEQ ID NO: 129134 - DNA, 25 bp, Rattus norvegicus
agcccctgaagttcactctgagtgg

SEQ ID NO: 129135 - DNA, 25 bp, Rattus norvegicus
agcccctgacacaaggctttctaaa

SEQ ID NO: 129136 - DNA, 25 bp, Rattus norvegicus
agcccctgacactaggctttctaaa

SEQ ID NO: 129137 - DNA, 25 bp, Rattus norvegicus
agcccctgagctactaatcacagaa

SEQ ID NO: 129138 - DNA, 25 bp, Rattus norvegicus
agcccctgagcttctaatcacagaa

SEQ ID NO: 129139 - DNA, 25 bp, Rattus norvegicus
agcccctgcggacctttatgaggag

SEQ ID NO: 129140 - DNA, 25 bp, Rattus norvegicus
agcccctgcggagctttatgaggag

SEQ ID NO: 129141 - DNA, 25 bp, Rattus norvegicus
agcccctgctgacaatgcactgatt

SEQ ID NO: 129142 - DNA, 25 bp, Rattus norvegicus
agcccctgctgagaatgcactgatt

SEQ ID NO: 129143 - DNA, 25 bp, Rattus norvegicus
agcccctggaaaccctgacttcagt

SEQ ID NO: 129144 - DNA, 25 bp, Rattus norvegicus
agcccctggaaagcctgacttcagt

SEQ ID NO: 129145 - DNA, 25 bp, Rattus norvegicus
agcccctggcatagcgagcgataag

SEQ ID NO: 129146 - DNA, 25 bp, Rattus norvegicus
agcccctggcattgcgagcgataag

SEQ ID NO: 129147 - DNA, 25 bp, Rattus norvegicus
agcccctggcccacagagccttgag

SEQ ID NO: 129148 - DNA, 25 bp, Rattus norvegicus
agcccctggccctcagagccttgag

SEQ ID NO: 129149 - DNA, 25 bp, Rattus norvegicus
agcccctgggacagaccggaaggat

SEQ ID NO: 129150 - DNA, 25 bp, Rattus norvegicus
agcccctgggacaggatcggactat

SEQ ID NO: 129151 - DNA, 25 bp, Rattus norvegicus
agcccctgggactgaccggaaggat

SEQ ID NO: 129152 - DNA, 25 bp, Rattus norvegicus
agcccctgggactggatcggactat

SEQ ID NO: 129153 - DNA, 25 bp, Rattus norvegicus
agcccctgggttaacactgtgtttg

SEQ ID NO: 129154 - DNA, 25 bp, Rattus norvegicus
agcccctgggtttacactgtgtttg

SEQ ID NO: 129155 - DNA, 25 bp, Rattus norvegicus
agcccctgtgcaatgtgggttttga

SEQ ID NO: 129156 - DNA, 25 bp, Rattus norvegicus
agcccctgtgcattgtgggttttga

SEQ ID NO: 129157 - DNA, 25 bp, Rattus norvegicus
agcccctgtggtactctgcagatgg

SEQ ID NO: 129158 - DNA, 25 bp, Rattus norvegicus
agcccctgtggttctctgcagatgg

SEQ ID NO: 129159 - DNA, 25 bp, Rattus norvegicus
agcccctgttatccagctgtgggac

SEQ ID NO: 129160 - DNA, 25 bp, Rattus norvegicus
agcccctgttatgcagctgtgggac

SEQ ID NO: 129161 - DNA, 25 bp, Rattus norvegicus
agcccctgtttcactggtgggagca

SEQ ID NO: 129162 - DNA, 25 bp, Rattus norvegicus
agcccctgtttctctggtgggagca

SEQ ID NO: 129163 - DNA, 25 bp, Rattus norvegicus
agccccttcactagggaatgagctg

SEQ ID NO: 129164 - DNA, 25 bp, Rattus norvegicus
agccccttcacttgggaatgagctg

SEQ ID NO: 129165 - DNA, 25 bp, Rattus norvegicus
agccccttcattcttctaggtatag

SEQ ID NO: 129166 - DNA, 25 bp, Rattus norvegicus
agccccttcattgttctaggtatag

SEQ ID NO: 129167 - DNA, 25 bp, Rattus norvegicus
agccccttcttaacaatactgcgag

SEQ ID NO: 129168 - DNA, 25 bp, Rattus norvegicus
agccccttcttatcaatactgcgag

SEQ ID NO: 129169 - DNA, 25 bp, Rattus norvegicus
agccccttgactagctgggattcca

SEQ ID NO: 129170 - DNA, 25 bp, Rattus norvegicus
agccccttgacttgctgggattcca

SEQ ID NO: 129171 - DNA, 25 bp, Rattus norvegicus
agccccttgctcactttgttaataa

SEQ ID NO: 129172 - DNA, 25 bp, Rattus norvegicus
agccccttgctctctttgttaataa

SEQ ID NO: 129173 - DNA, 25 bp, Rattus norvegicus
agccccttggagactgctcacaaaa

SEQ ID NO: 129174 - DNA, 25 bp, Rattus norvegicus
agccccttggagtctgctcacaaaa

SEQ ID NO: 129175 - DNA, 25 bp, Rattus norvegicus
agccccttggcgatgtggttttcag

SEQ ID NO: 129176 - DNA, 25 bp, Rattus norvegicus
agccccttggcgttgtggttttcag

SEQ ID NO: 129177 - DNA, 25 bp, Rattus norvegicus
agcccctttcagagtcaaccagaag

SEQ ID NO: 129178 - DNA, 25 bp, Rattus norvegicus
agcccctttcagtgtcaaccagaag

SEQ ID NO: 129179 - DNA, 25 bp, Rattus norvegicus
agcccctttccacagatacacaaat

SEQ ID NO: 129180 - DNA, 25 bp, Rattus norvegicus
agcccctttccagagatacacaaat

SEQ ID NO: 129181 - DNA, 25 bp, Rattus norvegicus
agcccctttctcaggtacagtggtg

SEQ ID NO: 129182 - DNA, 25 bp, Rattus norvegicus
agcccctttctctggtacagtggtg

SEQ ID NO: 129183 - DNA, 25 bp, Rattus norvegicus
agcccctttctgagtcctaagaaat

SEQ ID NO: 129184 - DNA, 25 bp, Rattus norvegicus
agcccctttctgtgtcctaagaaat

SEQ ID NO: 129185 - DNA, 25 bp, Rattus norvegicus
agcccctttgcgagaaccatgaaat

SEQ ID NO: 129186 - DNA, 25 bp, Rattus norvegicus
agcccctttgcgtgaaccatgaaat

SEQ ID NO: 129187 - DNA, 25 bp, Rattus norvegicus
agcccctttgttcagcacaagctgg

SEQ ID NO: 129188 - DNA, 25 bp, Rattus norvegicus
agcccctttgttgagcacaagctgg

SEQ ID NO: 129189 - DNA, 25 bp, Rattus norvegicus
agcccgaaccgtcaactcagatgat

SEQ ID NO: 129190 - DNA, 25 bp, Rattus norvegicus
agcccgaaccgtgaactcagatgat

SEQ ID NO: 129191 - DNA, 25 bp, Rattus norvegicus
agcccgaagaccaaccagagcactg

SEQ ID NO: 129192 - DNA, 25 bp, Rattus norvegicus
agcccgaagacctaccagagcactg

SEQ ID NO: 129193 - DNA, 25 bp, Rattus norvegicus
agcccgacacagcagccatggtggt

SEQ ID NO: 129194 - DNA, 25 bp, Rattus norvegicus
agcccgacacaggagccatggtggt

SEQ ID NO: 129195 - DNA, 25 bp, Rattus norvegicus
agcccgaccccaagaaagatacaga

SEQ ID NO: 129196 - DNA, 25 bp, Rattus norvegicus
agcccgaccccatgaaagatacaga

SEQ ID NO: 129197 - DNA, 25 bp, Rattus norvegicus
agcccgactctgacgaagcatggtc

SEQ ID NO: 129198 - DNA, 25 bp, Rattus norvegicus
agcccgactctgtcgaagcatggtc

SEQ ID NO: 129199 - DNA, 25 bp, Rattus norvegicus
agcccgacttagaacaacaatctag

SEQ ID NO: 129200 - DNA, 25 bp, Rattus norvegicus
agcccgacttagtacaacaatctag

SEQ ID NO: 129201 - DNA, 25 bp, Rattus norvegicus
agcccgagagagacttcatactgtg

SEQ ID NO: 129202 - DNA, 25 bp, Rattus norvegicus
agcccgagagagtcttcatactgtg

SEQ ID NO: 129203 - DNA, 25 bp, Rattus norvegicus
agcccgagcctcaggatttagtttt

SEQ ID NO: 129204 - DNA, 25 bp, Rattus norvegicus
agcccgagcctctggatttagtttt

SEQ ID NO: 129205 - DNA, 25 bp, Rattus norvegicus
agcccgaggctcatgtagctcattg

SEQ ID NO: 129206 - DNA, 25 bp, Rattus norvegicus
agcccgaggctcttgtagctcattg

SEQ ID NO: 129207 - DNA, 25 bp, Rattus norvegicus
agcccgagtctcatgacaggtcttt

SEQ ID NO: 129208 - DNA, 25 bp, Rattus norvegicus
agcccgagtctcttgacaggtcttt

SEQ ID NO: 129209 - DNA, 25 bp, Rattus norvegicus
agcccgagtttgcagccccggagca

SEQ ID NO: 129210 - DNA, 25 bp, Rattus norvegicus
agcccgagtttggagccccggagca

SEQ ID NO: 129211 - DNA, 25 bp, Rattus norvegicus
agcccgatcctaccagatctaatgg

SEQ ID NO: 129212 - DNA, 25 bp, Rattus norvegicus
agcccgatcctagcagatctaatgg

SEQ ID NO: 129213 - DNA, 25 bp, Rattus norvegicus
agcccgcaagtgatcgtgagacaga

SEQ ID NO: 129214 - DNA, 25 bp, Rattus norvegicus
agcccgcaagtgttcgtgagacaga

SEQ ID NO: 129215 - DNA, 25 bp, Rattus norvegicus
agcccgcacctaagcatgtgactga

SEQ ID NO: 129216 - DNA, 25 bp, Rattus norvegicus
agcccgcacctatgcatgtgactga

SEQ ID NO: 129217 - DNA, 25 bp, Rattus norvegicus
agcccgcacttccacgtggtagtta

SEQ ID NO: 129218 - DNA, 25 bp, Rattus norvegicus
agcccgcacttcgacgtggtagtta

SEQ ID NO: 129219 - DNA, 25 bp, Rattus norvegicus
agcccgcagtgcagtaatacctcag

SEQ ID NO: 129220 - DNA, 25 bp, Rattus norvegicus
agcccgcagtgctgtaatacctcag

SEQ ID NO: 129221 - DNA, 25 bp, Rattus norvegicus
agcccgccctttactatgtagagag

SEQ ID NO: 129222 - DNA, 25 bp, Rattus norvegicus
agcccgcccttttctatgtagagag

SEQ ID NO: 129223 - DNA, 25 bp, Rattus norvegicus
agcccgccgctgaggccaatagata

SEQ ID NO: 129224 - DNA, 25 bp, Rattus norvegicus
agcccgccgctgtggccaatagata

SEQ ID NO: 129225 - DNA, 25 bp, Rattus norvegicus
agcccgccggccagcgagtacttgt

SEQ ID NO: 129226 - DNA, 25 bp, Rattus norvegicus
agcccgccggcctgcgagtacttgt

SEQ ID NO: 129227 - DNA, 25 bp, Rattus norvegicus
agcccgccgggaaaagacagcgcca

SEQ ID NO: 129228 - DNA, 25 bp, Rattus norvegicus
agcccgccgggataagacagcgcca

SEQ ID NO: 129229 - DNA, 25 bp, Rattus norvegicus
agcccgccgtgaagtgatgggttat

SEQ ID NO: 129230 - DNA, 25 bp, Rattus norvegicus
agcccgccgtgatgtgatgggttat

SEQ ID NO: 129231 - DNA, 25 bp, Rattus norvegicus
agcccgcctgggagtagagcatttt

SEQ ID NO: 129232 - DNA, 25 bp, Rattus norvegicus
agcccgcctgggtgtagagcatttt

SEQ ID NO: 129233 - DNA, 25 bp, Rattus norvegicus
agcccgcgaccaagcccaggaagaa

SEQ ID NO: 129234 - DNA, 25 bp, Rattus norvegicus
agcccgcgaccatgcccaggaagaa

SEQ ID NO: 129235 - DNA, 25 bp, Rattus norvegicus
agcccgctccgcaagaggacggaac

SEQ ID NO: 129236 - DNA, 25 bp, Rattus norvegicus
agcccgctccgctagaggacggaac

SEQ ID NO: 129237 - DNA, 25 bp, Rattus norvegicus
agcccgctctatatttcaagttcta

SEQ ID NO: 129238 - DNA, 25 bp, Rattus norvegicus
agcccgctctatttttcaagttcta

SEQ ID NO: 129239 - DNA, 25 bp, Rattus norvegicus
agcccgctgattctgctgaggcagt

SEQ ID NO: 129240 - DNA, 25 bp, Rattus norvegicus
agcccgctgattgtgctgaggcagt

SEQ ID NO: 129241 - DNA, 25 bp, Rattus norvegicus
agcccgctgggtattattctcttct

SEQ ID NO: 129242 - DNA, 25 bp, Rattus norvegicus
agcccgctgggttttattctcttct

SEQ ID NO: 129243 - DNA, 25 bp, Rattus norvegicus
agcccggaactcaaaaatctctctt

SEQ ID NO: 129244 - DNA, 25 bp, Rattus norvegicus
agcccggaactctaaaatctctctt

SEQ ID NO: 129245 - DNA, 25 bp, Rattus norvegicus
agcccggactttcagcgttttgatt

SEQ ID NO: 129246 - DNA, 25 bp, Rattus norvegicus
agcccggactttgagcgttttgatt

SEQ ID NO: 129247 - DNA, 25 bp, Rattus norvegicus
agcccggagcacaaagtggtccaat

SEQ ID NO: 129248 - DNA, 25 bp, Rattus norvegicus
agcccggagcactaagtggtccaat

SEQ ID NO: 129249 - DNA, 25 bp, Rattus norvegicus
agcccggagctgcaggctgctctat

SEQ ID NO: 129250 - DNA, 25 bp, Rattus norvegicus
agcccggagctggaggctgctctat

SEQ ID NO: 129251 - DNA, 25 bp, Rattus norvegicus
agcccggaggcaccctaggctgaga

SEQ ID NO: 129252 - DNA, 25 bp, Rattus norvegicus
agcccggaggcagcctaggctgaga

SEQ ID NO: 129253 - DNA, 25 bp, Rattus norvegicus
agcccggagtgtctgtatcttctga

SEQ ID NO: 129254 - DNA, 25 bp, Rattus norvegicus
agcccggagtgtgtgtatcttctga

SEQ ID NO: 129255 - DNA, 25 bp, Rattus norvegicus
agcccggcagccatgttgaacctat

SEQ ID NO: 129256 - DNA, 25 bp, Rattus norvegicus
agcccggcagccttgttgaacctat

SEQ ID NO: 129257 - DNA, 25 bp, Rattus norvegicus
agcccggcaggaaccgtgctctgct

SEQ ID NO: 129258 - DNA, 25 bp, Rattus norvegicus
agcccggcaggatccgtgctctgct

SEQ ID NO: 129259 - DNA, 25 bp, Rattus norvegicus
agcccggcataaactgttgtttcag

SEQ ID NO: 129260 - DNA, 25 bp, Rattus norvegicus
agcccggcataatctgttgtttcag

SEQ ID NO: 129261 - DNA, 25 bp, Rattus norvegicus
agcccggcatttaccgtgtaaatca

SEQ ID NO: 129262 - DNA, 25 bp, Rattus norvegicus
agcccggcattttccgtgtaaatca

SEQ ID NO: 129263 - DNA, 25 bp, Rattus norvegicus
agcccggccactagtgagattctga

SEQ ID NO: 129264 - DNA, 25 bp, Rattus norvegicus
agcccggccacttgtgagattctga

SEQ ID NO: 129265 - DNA, 25 bp, Rattus norvegicus
agcccggcctgcagagaggtccata

SEQ ID NO: 129266 - DNA, 25 bp, Rattus norvegicus
agcccggcctgctgagaggtccata

SEQ ID NO: 129267 - DNA, 25 bp, Rattus norvegicus
agcccggctatgatggtttcttcaa

SEQ ID NO: 129268 - DNA, 25 bp, Rattus norvegicus
agcccggctatgttggtttcttcaa

SEQ ID NO: 129269 - DNA, 25 bp, Rattus norvegicus
agcccggctgctaatcaagtactgt

SEQ ID NO: 129270 - DNA, 25 bp, Rattus norvegicus
agcccggctgcttatcaagtactgt

SEQ ID NO: 129271 - DNA, 25 bp, Rattus norvegicus
agcccggcttgcagagacatttgta

SEQ ID NO: 129272 - DNA, 25 bp, Rattus norvegicus
agcccggcttgctgagacatttgta

SEQ ID NO: 129273 - DNA, 25 bp, Rattus norvegicus
agcccgggaacaatagaagctaatt

SEQ ID NO: 129274 - DNA, 25 bp, Rattus norvegicus
agcccgggaacattagaagctaatt

SEQ ID NO: 129275 - DNA, 25 bp, Rattus norvegicus
agcccgggacatagtgcagttcgtg

SEQ ID NO: 129276 - DNA, 25 bp, Rattus norvegicus
agcccgggacattgtgcagttcgtg

SEQ ID NO: 129277 - DNA, 25 bp, Rattus norvegicus
agcccgggagaccagattgcattga

SEQ ID NO: 129278 - DNA, 25 bp, Rattus norvegicus
agcccgggagacgagattgcattga

SEQ ID NO: 129279 - DNA, 25 bp, Rattus norvegicus
agcccggtaagtccagagacgagaa

SEQ ID NO: 129280 - DNA, 25 bp, Rattus norvegicus
agcccggtaagtgcagagacgagaa

SEQ ID NO: 129281 - DNA, 25 bp, Rattus norvegicus
agcccggtgctgatgtgaagccaag

SEQ ID NO: 129282 - DNA, 25 bp, Rattus norvegicus
agcccggtgctgttgtgaagccaag

SEQ ID NO: 129283 - DNA, 25 bp, Rattus norvegicus
agcccggtgtacatgtccttgatga

SEQ ID NO: 129284 - DNA, 25 bp, Rattus norvegicus
agcccggtgtacttgtccttgatga

SEQ ID NO: 129285 - DNA, 25 bp, Rattus norvegicus
agcccggttgctaatgatggatccc

SEQ ID NO: 129286 - DNA, 25 bp, Rattus norvegicus
agcccggttgcttatgatggatccc

SEQ ID NO: 129287 - DNA, 25 bp, Rattus norvegicus
agcccggtttctcagctgggtgata

SEQ ID NO: 129288 - DNA, 25 bp, Rattus norvegicus
agcccggtttctgagctgggtgata

SEQ ID NO: 129289 - DNA, 25 bp, Rattus norvegicus
agcccgtattatatcttcctgagac

SEQ ID NO: 129290 - DNA, 25 bp, Rattus norvegicus
agcccgtattatttcttcctgagac

SEQ ID NO: 129291 - DNA, 25 bp, Rattus norvegicus
agcccgtcaggcaagagtgcagtga

SEQ ID NO: 129292 - DNA, 25 bp, Rattus norvegicus
agcccgtcaggctagagtgcagtga

SEQ ID NO: 129293 - DNA, 25 bp, Rattus norvegicus
agcccgtcctcactttagtgtttga

SEQ ID NO: 129294 - DNA, 25 bp, Rattus norvegicus
agcccgtcctcagtttagtgtttga

SEQ ID NO: 129295 - DNA, 25 bp, Rattus norvegicus
agcccgtctcccagatgctgatgaa

SEQ ID NO: 129296 - DNA, 25 bp, Rattus norvegicus
agcccgtctccctgatgctgatgaa

SEQ ID NO: 129297 - DNA, 25 bp, Rattus norvegicus
agcccgtctcgcaggtggcatgaca

SEQ ID NO: 129298 - DNA, 25 bp, Rattus norvegicus
agcccgtctcgctggtggcatgaca

SEQ ID NO: 129299 - DNA, 25 bp, Rattus norvegicus
agcccgtctgaaagggcagcaccgc

SEQ ID NO: 129300 - DNA, 25 bp, Rattus norvegicus
agcccgtctgaatgggcagcaccgc

SEQ ID NO: 129301 - DNA, 25 bp, Rattus norvegicus
agcccgtctggcacagggcctggct

SEQ ID NO: 129302 - DNA, 25 bp, Rattus norvegicus
agcccgtctggctcagggcctggct

SEQ ID NO: 129303 - DNA, 25 bp, Rattus norvegicus
agcccgtgaacaactgatcctgagg

SEQ ID NO: 129304 - DNA, 25 bp, Rattus norvegicus
agcccgtgaacatctgatcctgagg

SEQ ID NO: 129305 - DNA, 25 bp, Rattus norvegicus
agcccgtgacttagtgcatgaccgt

SEQ ID NO: 129306 - DNA, 25 bp, Rattus norvegicus
agcccgtgactttgtgcatgaccgt

SEQ ID NO: 129307 - DNA, 25 bp, Rattus norvegicus
agcccgtgcttgctctgtgtacaga

SEQ ID NO: 129308 - DNA, 25 bp, Rattus norvegicus
agcccgtgcttggtctgtgtacaga

SEQ ID NO: 129309 - DNA, 25 bp, Rattus norvegicus
agcccgtgtactctagtcagtgttt

SEQ ID NO: 129310 - DNA, 25 bp, Rattus norvegicus
agcccgtgtactgtagtcagtgttt

SEQ ID NO: 129311 - DNA, 25 bp, Rattus norvegicus
agcccgtgtcttctgatcattctga

SEQ ID NO: 129312 - DNA, 25 bp, Rattus norvegicus
agcccgtgtcttgtgatcattctga

SEQ ID NO: 129313 - DNA, 25 bp, Rattus norvegicus
agcccgttcgggaccaatatattgt

SEQ ID NO: 129314 - DNA, 25 bp, Rattus norvegicus
agcccgttcgggtccaatatattgt

SEQ ID NO: 129315 - DNA, 25 bp, Rattus norvegicus
agcccgtttctcagcgtcttattaa

SEQ ID NO: 129316 - DNA, 25 bp, Rattus norvegicus
agcccgtttctctgcgtcttattaa

SEQ ID NO: 129317 - DNA, 25 bp, Rattus norvegicus
agcccgtttgtcatatggactttgc

SEQ ID NO: 129318 - DNA, 25 bp, Rattus norvegicus
agcccgtttgtcttatggactttgc

SEQ ID NO: 129319 - DNA, 25 bp, Rattus norvegicus
agccctaaccccagatcctataaat

SEQ ID NO: 129320 - DNA, 25 bp, Rattus norvegicus
agccctaacccctgatcctataaat

SEQ ID NO: 129321 - DNA, 25 bp, Rattus norvegicus
agccctaaccctagtgcttgtagtt

SEQ ID NO: 129322 - DNA, 25 bp, Rattus norvegicus
agccctaacccttgtgcttgtagtt

SEQ ID NO: 129323 - DNA, 25 bp, Rattus norvegicus
agccctaactgaacactgaccgatg

SEQ ID NO: 129324 - DNA, 25 bp, Rattus norvegicus
agccctaactgatcactgaccgatg

SEQ ID NO: 129325 - DNA, 25 bp, Rattus norvegicus
agccctaagacactacctggacaag

SEQ ID NO: 129326 - DNA, 25 bp, Rattus norvegicus
agccctaagacagtacctggacaag

SEQ ID NO: 129327 - DNA, 25 bp, Rattus norvegicus
agccctaagctcacaggtgaccaca

SEQ ID NO: 129328 - DNA, 25 bp, Rattus norvegicus
agccctaagctctcaggtgaccaca

SEQ ID NO: 129329 - DNA, 25 bp, Rattus norvegicus
agccctacaccacctaggtaatgta

SEQ ID NO: 129330 - DNA, 25 bp, Rattus norvegicus
agccctacaccagctaggtaatgta

SEQ ID NO: 129331 - DNA, 25 bp, Rattus norvegicus
agccctacagctctgggaaagtgta

SEQ ID NO: 129332 - DNA, 25 bp, Rattus norvegicus
agccctacagctgtgggaaagtgta

SEQ ID NO: 129333 - DNA, 25 bp, Rattus norvegicus
agccctacccacaaatttctatgag

SEQ ID NO: 129334 - DNA, 25 bp, Rattus norvegicus
agccctacccactaatttctatgag

SEQ ID NO: 129335 - DNA, 25 bp, Rattus norvegicus
agccctacctgcaggagaaggcgaa

SEQ ID NO: 129336 - DNA, 25 bp, Rattus norvegicus
agccctacctgctggagaaggcgaa

SEQ ID NO: 129337 - DNA, 25 bp, Rattus norvegicus
agccctacgtcacaagcattcctag

SEQ ID NO: 129338 - DNA, 25 bp, Rattus norvegicus
agccctacgtcagaagcattcctag

SEQ ID NO: 129339 - DNA, 25 bp, Rattus norvegicus
agccctactgggatccaaacacaag

SEQ ID NO: 129340 - DNA, 25 bp, Rattus norvegicus
agccctactgggttccaaacacaag

SEQ ID NO: 129341 - DNA, 25 bp, Rattus norvegicus
agccctagactaatattccatgact

SEQ ID NO: 129342 - DNA, 25 bp, Rattus norvegicus
agccctagactattattccatgact

SEQ ID NO: 129343 - DNA, 25 bp, Rattus norvegicus
agccctagatatctgccatgagaaa

SEQ ID NO: 129344 - DNA, 25 bp, Rattus norvegicus
agccctagatatgtgccatgagaaa

SEQ ID NO: 129345 - DNA, 25 bp, Rattus norvegicus
agccctagcccacttgaggctgtga

SEQ ID NO: 129346 - DNA, 25 bp, Rattus norvegicus
agccctagcccagttgaggctgtga

SEQ ID NO: 129347 - DNA, 25 bp, Rattus norvegicus
agccctagctgtcaacatgaccaga

SEQ ID NO: 129348 - DNA, 25 bp, Rattus norvegicus
agccctagctgtgaacatgaccaga

SEQ ID NO: 129349 - DNA, 25 bp, Rattus norvegicus
agccctaggctgcatgttgcaacac

SEQ ID NO: 129350 - DNA, 25 bp, Rattus norvegicus
agccctaggctggatgttgcaacac

SEQ ID NO: 129351 - DNA, 25 bp, Rattus norvegicus
agccctaggcttcagatttcatctg

SEQ ID NO: 129352 - DNA, 25 bp, Rattus norvegicus
agccctaggcttgagatttcatctg

SEQ ID NO: 129353 - DNA, 25 bp, Rattus norvegicus
agccctagtttgcactaaaaatcaa

SEQ ID NO: 129354 - DNA, 25 bp, Rattus norvegicus
agccctagtttggactaaaaatcaa

SEQ ID NO: 129355 - DNA, 25 bp, Rattus norvegicus
agccctatctggcttcagtcagagt

SEQ ID NO: 129356 - DNA, 25 bp, Rattus norvegicus
agccctatctgggttcagtcagagt

SEQ ID NO: 129357 - DNA, 25 bp, Rattus norvegicus
agccctatgctgctcttcaaagaaa

SEQ ID NO: 129358 - DNA, 25 bp, Rattus norvegicus
agccctatgctggtcttcaaagaaa

SEQ ID NO: 129359 - DNA, 25 bp, Rattus norvegicus
agccctatgtttacagccactgaca

SEQ ID NO: 129360 - DNA, 25 bp, Rattus norvegicus
agccctatgttttcagccactgaca

SEQ ID NO: 129361 - DNA, 25 bp, Rattus norvegicus
agccctcaaagacccttgcacgtta

SEQ ID NO: 129362 - DNA, 25 bp, Rattus norvegicus
agccctcaaagagccttgcacgtta

SEQ ID NO: 129363 - DNA, 25 bp, Rattus norvegicus
agccctcaactcaacctggttttat

SEQ ID NO: 129364 - DNA, 25 bp, Rattus norvegicus
agccctcaactctacctggttttat

SEQ ID NO: 129365 - DNA, 25 bp, Rattus norvegicus
agccctcaagacaagaagccagcct

SEQ ID NO: 129366 - DNA, 25 bp, Rattus norvegicus
agccctcaagactagaagccagcct

SEQ ID NO: 129367 - DNA, 25 bp, Rattus norvegicus
agccctcaccttcggatcatggatt

SEQ ID NO: 129368 - DNA, 25 bp, Rattus norvegicus
agccctcaccttgggatcatggatt

SEQ ID NO: 129369 - DNA, 25 bp, Rattus norvegicus
agccctcacggaaaccttctaagta

SEQ ID NO: 129370 - DNA, 25 bp, Rattus norvegicus
agccctcacggataccttctaagta

SEQ ID NO: 129371 - DNA, 25 bp, Rattus norvegicus
agccctcacggcatgatggtttctg

SEQ ID NO: 129372 - DNA, 25 bp, Rattus norvegicus
agccctcacggcttgatggtttctg

SEQ ID NO: 129373 - DNA, 25 bp, Rattus norvegicus
agccctcacggtctcaggacatgat

SEQ ID NO: 129374 - DNA, 25 bp, Rattus norvegicus
agccctcacggtgtcaggacatgat

SEQ ID NO: 129375 - DNA, 25 bp, Rattus norvegicus
agccctcactgtccattagaaaatc

SEQ ID NO: 129376 - DNA, 25 bp, Rattus norvegicus
agccctcactgtgcattagaaaatc

SEQ ID NO: 129377 - DNA, 25 bp, Rattus norvegicus
agccctcagagacttcagtgacgta

SEQ ID NO: 129378 - DNA, 25 bp, Rattus norvegicus
agccctcagagagttcagtgacgta

SEQ ID NO: 129379 - DNA, 25 bp, Rattus norvegicus
agccctcagtccactatagatagtg

SEQ ID NO: 129380 - DNA, 25 bp, Rattus norvegicus
agccctcagtcctctatagatagtg

SEQ ID NO: 129381 - DNA, 25 bp, Rattus norvegicus
agccctcagtgacagtctggcaaac

SEQ ID NO: 129382 - DNA, 25 bp, Rattus norvegicus
agccctcagtgagagtctggcaaac

SEQ ID NO: 129383 - DNA, 25 bp, Rattus norvegicus
agccctcagttaagcggactcctag

SEQ ID NO: 129384 - DNA, 25 bp, Rattus norvegicus
agccctcagttatgcggactcctag

SEQ ID NO: 129385 - DNA, 25 bp, Rattus norvegicus
agccctcataaaagctgaccatggt

SEQ ID NO: 129386 - DNA, 25 bp, Rattus norvegicus
agccctcataaatgctgaccatggt

SEQ ID NO: 129387 - DNA, 25 bp, Rattus norvegicus
agccctccagacaaccaggaacgag

SEQ ID NO: 129388 - DNA, 25 bp, Rattus norvegicus
agccctccagactaccaggaacgag

SEQ ID NO: 129389 - DNA, 25 bp, Rattus norvegicus
agccctccatgtctcggagttgatt

SEQ ID NO: 129390 - DNA, 25 bp, Rattus norvegicus
agccctccatgtgtcggagttgatt

SEQ ID NO: 129391 - DNA, 25 bp, Rattus norvegicus
agccctcccacgaagatcttggtgt

SEQ ID NO: 129392 - DNA, 25 bp, Rattus norvegicus
agccctcccacgtagatcttggtgt

SEQ ID NO: 129393 - DNA, 25 bp, Rattus norvegicus
agccctcccataactgaaagttgtc

SEQ ID NO: 129394 - DNA, 25 bp, Rattus norvegicus
agccctcccatatctgaaagttgtc

SEQ ID NO: 129395 - DNA, 25 bp, Rattus norvegicus
agccctcccggtctagagcagcgga

SEQ ID NO: 129396 - DNA, 25 bp, Rattus norvegicus
agccctcccggtgtagagcagcgga

SEQ ID NO: 129397 - DNA, 25 bp, Rattus norvegicus
agccctccgctgatacttaagtagg

SEQ ID NO: 129398 - DNA, 25 bp, Rattus norvegicus
agccctccgctgttacttaagtagg

SEQ ID NO: 129399 - DNA, 25 bp, Rattus norvegicus
agccctcctaaacctgggatgcgag

SEQ ID NO: 129400 - DNA, 25 bp, Rattus norvegicus
agccctcctaaagctgggatgcgag

SEQ ID NO: 129401 - DNA, 25 bp, Rattus norvegicus
agccctcctagcaacacagttgaaa

SEQ ID NO: 129402 - DNA, 25 bp, Rattus norvegicus
agccctcctagctacacagttgaaa

SEQ ID NO: 129403 - DNA, 25 bp, Rattus norvegicus
agccctcctgaaatccagagtttta

SEQ ID NO: 129404 - DNA, 25 bp, Rattus norvegicus
agccctcctgaacaattcttagaca

SEQ ID NO: 129405 - DNA, 25 bp, Rattus norvegicus
agccctcctgaagaattcttagaca

SEQ ID NO: 129406 - DNA, 25 bp, Rattus norvegicus
agccctcctgaattccagagtttta

SEQ ID NO: 129407 - DNA, 25 bp, Rattus norvegicus
agccctcgaggaaccaggacatttg

SEQ ID NO: 129408 - DNA, 25 bp, Rattus norvegicus
agccctcgaggatccaggacatttg

SEQ ID NO: 129409 - DNA, 25 bp, Rattus norvegicus
agccctcgatgccaattctcggaag

SEQ ID NO: 129410 - DNA, 25 bp, Rattus norvegicus
agccctcgatgcgaattctcggaag

SEQ ID NO: 129411 - DNA, 25 bp, Rattus norvegicus
agccctcgccgaagaagtacttgtt

SEQ ID NO: 129412 - DNA, 25 bp, Rattus norvegicus
agccctcgccgatgaagtacttgtt

SEQ ID NO: 129413 - DNA, 25 bp, Rattus norvegicus
agccctcggttacagatgttgccct

SEQ ID NO: 129414 - DNA, 25 bp, Rattus norvegicus
agccctcggttagagatgttgccct

SEQ ID NO: 129415 - DNA, 25 bp, Rattus norvegicus
agccctcggtttctgtctgtgtcta

SEQ ID NO: 129416 - DNA, 25 bp, Rattus norvegicus
agccctcggtttgtgtctgtgtcta

SEQ ID NO: 129417 - DNA, 25 bp, Rattus norvegicus
agccctcgtgatccaagtatctggg

SEQ ID NO: 129418 - DNA, 25 bp, Rattus norvegicus
agccctcgtgatgcaagtatctggg

SEQ ID NO: 129419 - DNA, 25 bp, Rattus norvegicus
agccctctcaggactgtggccagga

SEQ ID NO: 129420 - DNA, 25 bp, Rattus norvegicus
agccctctcaggtctgtggccagga

SEQ ID NO: 129421 - DNA, 25 bp, Rattus norvegicus
agccctctcttcactggtaaacaag

SEQ ID NO: 129422 - DNA, 25 bp, Rattus norvegicus
agccctctcttctctggtaaacaag

SEQ ID NO: 129423 - DNA, 25 bp, Rattus norvegicus
agccctctgactccatagactgggt

SEQ ID NO: 129424 - DNA, 25 bp, Rattus norvegicus
agccctctgactgcatagactgggt

SEQ ID NO: 129425 - DNA, 25 bp, Rattus norvegicus
agccctctgaggaggattttgtgat

SEQ ID NO: 129426 - DNA, 25 bp, Rattus norvegicus
agccctctgaggtggattttgtgat

SEQ ID NO: 129427 - DNA, 25 bp, Rattus norvegicus
agccctctgcatcctagatgtttag

SEQ ID NO: 129428 - DNA, 25 bp, Rattus norvegicus
agccctctgcatgctagatgtttag

SEQ ID NO: 129429 - DNA, 25 bp, Rattus norvegicus
agccctctgcgtattattcgttgta

SEQ ID NO: 129430 - DNA, 25 bp, Rattus norvegicus
agccctctgcgttttattcgttgta

SEQ ID NO: 129431 - DNA, 25 bp, Rattus norvegicus
agccctctgctaagctactttgtgg

SEQ ID NO: 129432 - DNA, 25 bp, Rattus norvegicus
agccctctgctatgctactttgtgg

SEQ ID NO: 129433 - DNA, 25 bp, Rattus norvegicus
agccctctgctcacaagcgatttgt

SEQ ID NO: 129434 - DNA, 25 bp, Rattus norvegicus
agccctctgctctcaagcgatttgt

SEQ ID NO: 129435 - DNA, 25 bp, Rattus norvegicus
agccctctggctaatgtgggtacca

SEQ ID NO: 129436 - DNA, 25 bp, Rattus norvegicus
agccctctggcttatgtgggtacca

SEQ ID NO: 129437 - DNA, 25 bp, Rattus norvegicus
agccctcttacccaggagcctgaag

SEQ ID NO: 129438 - DNA, 25 bp, Rattus norvegicus
agccctcttaccgaggagcctgaag

SEQ ID NO: 129439 - DNA, 25 bp, Rattus norvegicus
agccctcttagaatccaccaaataa

SEQ ID NO: 129440 - DNA, 25 bp, Rattus norvegicus
agccctcttagattccaccaaataa

SEQ ID NO: 129441 - DNA, 25 bp, Rattus norvegicus
agccctcttatcctgtcatgtgtcc

SEQ ID NO: 129442 - DNA, 25 bp, Rattus norvegicus
agccctcttatcgtgtcatgtgtcc

SEQ ID NO: 129443 - DNA, 25 bp, Rattus norvegicus
agccctgaaattagctgatgcccac

SEQ ID NO: 129444 - DNA, 25 bp, Rattus norvegicus
agccctgaaatttgctgatgcccac

SEQ ID NO: 129445 - DNA, 25 bp, Rattus norvegicus
agccctgaatgactacctgcggatc

SEQ ID NO: 129446 - DNA, 25 bp, Rattus norvegicus
agccctgaatgagtacctgcggatc

SEQ ID NO: 129447 - DNA, 25 bp, Rattus norvegicus
agccctgacagactaatacaccaca

SEQ ID NO: 129448 - DNA, 25 bp, Rattus norvegicus
agccctgacagagtaatacaccaca

SEQ ID NO: 129449 - DNA, 25 bp, Rattus norvegicus
agccctgacctgaggttggcagcaa

SEQ ID NO: 129450 - DNA, 25 bp, Rattus norvegicus
agccctgacctgtggttggcagcaa

SEQ ID NO: 129451 - DNA, 25 bp, Rattus norvegicus
agccctgactgcacttgttgaagac

SEQ ID NO: 129452 - DNA, 25 bp, Rattus norvegicus
agccctgactgctcttgttgaagac

SEQ ID NO: 129453 - DNA, 25 bp, Rattus norvegicus
agccctgagactaacacttgacaag

SEQ ID NO: 129454 - DNA, 25 bp, Rattus norvegicus
agccctgagacttacacttgacaag

SEQ ID NO: 129455 - DNA, 25 bp, Rattus norvegicus
agccctgagccaatctgcaaacttt

SEQ ID NO: 129456 - DNA, 25 bp, Rattus norvegicus
agccctgagccattctgcaaacttt

SEQ ID NO: 129457 - DNA, 25 bp, Rattus norvegicus
agccctgagcccaggatgaaagcag

SEQ ID NO: 129458 - DNA, 25 bp, Rattus norvegicus
agccctgagccctggatgaaagcag

SEQ ID NO: 129459 - DNA, 25 bp, Rattus norvegicus
agccctgaggccaagtgtggatctt

SEQ ID NO: 129460 - DNA, 25 bp, Rattus norvegicus
agccctgaggcctagtgtggatctt

SEQ ID NO: 129461 - DNA, 25 bp, Rattus norvegicus
agccctgagtctctttgtgttgtga

SEQ ID NO: 129462 - DNA, 25 bp, Rattus norvegicus
agccctgagtctgtttgtgttgtga

SEQ ID NO: 129463 - DNA, 25 bp, Rattus norvegicus
agccctgagtttcacacctgttact

SEQ ID NO: 129464 - DNA, 25 bp, Rattus norvegicus
agccctgagtttgacacctgttact

SEQ ID NO: 129465 - DNA, 25 bp, Rattus norvegicus
agccctgataagctaggtccagcat

SEQ ID NO: 129466 - DNA, 25 bp, Rattus norvegicus
agccctgataaggtaggtccagcat

SEQ ID NO: 129467 - DNA, 25 bp, Rattus norvegicus
agccctgatccgatatagcaccaaa

SEQ ID NO: 129468 - DNA, 25 bp, Rattus norvegicus
agccctgatccgttatagcaccaaa

SEQ ID NO: 129469 - DNA, 25 bp, Rattus norvegicus
agccctgatgcccagaggattggca

SEQ ID NO: 129470 - DNA, 25 bp, Rattus norvegicus
agccctgatgccgagaggattggca

SEQ ID NO: 129471 - DNA, 25 bp, Rattus norvegicus
agccctgatggccaacatgcaatga

SEQ ID NO: 129472 - DNA, 25 bp, Rattus norvegicus
agccctgatggcgaacatgcaatga

SEQ ID NO: 129473 - DNA, 25 bp, Rattus norvegicus
agccctgattcacttggatgttctg

SEQ ID NO: 129474 - DNA, 25 bp, Rattus norvegicus
agccctgattcagttggatgttctg

SEQ ID NO: 129475 - DNA, 25 bp, Rattus norvegicus
agccctgcaggcaccaagatttcta

SEQ ID NO: 129476 - DNA, 25 bp, Rattus norvegicus
agccctgcaggctccaagatttcta

SEQ ID NO: 129477 - DNA, 25 bp, Rattus norvegicus
agccctgcagtccttttagagtgag

SEQ ID NO: 129478 - DNA, 25 bp, Rattus norvegicus
agccctgcagtcgttttagagtgag

SEQ ID NO: 129479 - DNA, 25 bp, Rattus norvegicus
agccctgccacaagcatggatgatg

SEQ ID NO: 129480 - DNA, 25 bp, Rattus norvegicus
agccctgccacatgcatggatgatg

SEQ ID NO: 129481 - DNA, 25 bp, Rattus norvegicus
agccctgccaccagtgtatttttgg

SEQ ID NO: 129482 - DNA, 25 bp, Rattus norvegicus
agccctgccacctgtgtatttttgg

SEQ ID NO: 129483 - DNA, 25 bp, Rattus norvegicus
agccctgccaggattttaaactgcg

SEQ ID NO: 129484 - DNA, 25 bp, Rattus norvegicus
agccctgccaggtttttaaactgcg

SEQ ID NO: 129485 - DNA, 25 bp, Rattus norvegicus
agccctgcccacaggctcaagaaga

SEQ ID NO: 129486 - DNA, 25 bp, Rattus norvegicus
agccctgcccactggctcaagaaga

SEQ ID NO: 129487 - DNA, 25 bp, Rattus norvegicus
agccctgcgctgactgatagcttca

SEQ ID NO: 129488 - DNA, 25 bp, Rattus norvegicus
agccctgcgctgtctgatagcttca

SEQ ID NO: 129489 - DNA, 25 bp, Rattus norvegicus
agccctgcggtgcaagacttcatta

SEQ ID NO: 129490 - DNA, 25 bp, Rattus norvegicus
agccctgcggtggaagacttcatta

SEQ ID NO: 129491 - DNA, 25 bp, Rattus norvegicus
agccctgcgtgaaagcaagctctca

SEQ ID NO: 129492 - DNA, 25 bp, Rattus norvegicus
agccctgcgtgatagcaagctctca

SEQ ID NO: 129493 - DNA, 25 bp, Rattus norvegicus
agccctgcgtgcaggttttgacctt

SEQ ID NO: 129494 - DNA, 25 bp, Rattus norvegicus
agccctgcgtgctggttttgacctt

SEQ ID NO: 129495 - DNA, 25 bp, Rattus norvegicus
agccctgctagacagcctgcttctt

SEQ ID NO: 129496 - DNA, 25 bp, Rattus norvegicus
agccctgctagagagcctgcttctt

SEQ ID NO: 129497 - DNA, 25 bp, Rattus norvegicus
agccctgctagccttaactgagaaa

SEQ ID NO: 129498 - DNA, 25 bp, Rattus norvegicus
agccctgctagcgttaactgagaaa

SEQ ID NO: 129499 - DNA, 25 bp, Rattus norvegicus
agccctgctatgcaatactctttgg

SEQ ID NO: 129500 - DNA, 25 bp, Rattus norvegicus
agccctgctatggaatactctttgg

SEQ ID NO: 129501 - DNA, 25 bp, Rattus norvegicus
agccctgctcagcaacagcctatga

SEQ ID NO: 129502 - DNA, 25 bp, Rattus norvegicus
agccctgctcaggaacagcctatga

SEQ ID NO: 129503 - DNA, 25 bp, Rattus norvegicus
agccctgctccacaaggctcggagt

SEQ ID NO: 129504 - DNA, 25 bp, Rattus norvegicus
agccctgctccagaaggctcggagt

SEQ ID NO: 129505 - DNA, 25 bp, Rattus norvegicus
agccctgctgagacccgcgcgttgg

SEQ ID NO: 129506 - DNA, 25 bp, Rattus norvegicus
agccctgctgagtcccgcgcgttgg

SEQ ID NO: 129507 - DNA, 25 bp, Rattus norvegicus
agccctgctgcacctcgtaggtcag

SEQ ID NO: 129508 - DNA, 25 bp, Rattus norvegicus
agccctgctgcagctcgtaggtcag

SEQ ID NO: 129509 - DNA, 25 bp, Rattus norvegicus
agccctgctgctctgagttctaagg

SEQ ID NO: 129510 - DNA, 25 bp, Rattus norvegicus
agccctgctgctgtgagttctaagg

SEQ ID NO: 129511 - DNA, 25 bp, Rattus norvegicus
agccctgctgggaggctctgaacaa

SEQ ID NO: 129512 - DNA, 25 bp, Rattus norvegicus
agccctgctgggtggctctgaacaa

SEQ ID NO: 129513 - DNA, 25 bp, Rattus norvegicus
agccctgcttgtccattttataata

SEQ ID NO: 129514 - DNA, 25 bp, Rattus norvegicus
agccctgcttgtgcattttataata

SEQ ID NO: 129515 - DNA, 25 bp, Rattus norvegicus
agccctgcttttaatctggtgtgca

SEQ ID NO: 129516 - DNA, 25 bp, Rattus norvegicus
agccctgcttttaccaatatcacta

SEQ ID NO: 129517 - DNA, 25 bp, Rattus norvegicus
agccctgctttttatctggtgtgca

SEQ ID NO: 129518 - DNA, 25 bp, Rattus norvegicus
agccctgctttttccaatatcacta

SEQ ID NO: 129519 - DNA, 25 bp, Rattus norvegicus
agccctggaaagagtgtgtcaatgt

SEQ ID NO: 129520 - DNA, 25 bp, Rattus norvegicus
agccctggaaagtgtgtgtcaatgt

SEQ ID NO: 129521 - DNA, 25 bp, Rattus norvegicus
agccctggaacccaacgtcatggag

SEQ ID NO: 129522 - DNA, 25 bp, Rattus norvegicus
agccctggaaccgaacgtcatggag

SEQ ID NO: 129523 - DNA, 25 bp, Rattus norvegicus
agccctggacttcctgagaggcaga

SEQ ID NO: 129524 - DNA, 25 bp, Rattus norvegicus
agccctggacttgctgagaggcaga

SEQ ID NO: 129525 - DNA, 25 bp, Rattus norvegicus
agccctggagcaacactaagacgaa

SEQ ID NO: 129526 - DNA, 25 bp, Rattus norvegicus
agccctggagcatcactaagacgaa

SEQ ID NO: 129527 - DNA, 25 bp, Rattus norvegicus
agccctggagctaacccagtatttt

SEQ ID NO: 129528 - DNA, 25 bp, Rattus norvegicus
agccctggagcttacccagtatttt

SEQ ID NO: 129529 - DNA, 25 bp, Rattus norvegicus
agccctggaggaagacgtgattgac

SEQ ID NO: 129530 - DNA, 25 bp, Rattus norvegicus
agccctggaggacaggcccacaaga

SEQ ID NO: 129531 - DNA, 25 bp, Rattus norvegicus
agccctggaggagaggcccacaaga

SEQ ID NO: 129532 - DNA, 25 bp, Rattus norvegicus
agccctggaggatgacgtgattgac

SEQ ID NO: 129533 - DNA, 25 bp, Rattus norvegicus
agccctggaggcattttggagacct

SEQ ID NO: 129534 - DNA, 25 bp, Rattus norvegicus
agccctggaggctttttggagacct

SEQ ID NO: 129535 - DNA, 25 bp, Rattus norvegicus
agccctggatcgacatctggcaagg

SEQ ID NO: 129536 - DNA, 25 bp, Rattus norvegicus
agccctggatcgtcatctggcaagg

SEQ ID NO: 129537 - DNA, 25 bp, Rattus norvegicus
agccctggatctcggatctacagac

SEQ ID NO: 129538 - DNA, 25 bp, Rattus norvegicus
agccctggatctgggatctacagac

SEQ ID NO: 129539 - DNA, 25 bp, Rattus norvegicus
agccctggccaaccgcgacaaagat

SEQ ID NO: 129540 - DNA, 25 bp, Rattus norvegicus
agccctggccaagcgcgacaaagat

SEQ ID NO: 129541 - DNA, 25 bp, Rattus norvegicus
agccctggcgcaacagctaatggag

SEQ ID NO: 129542 - DNA, 25 bp, Rattus norvegicus
agccctggcgcatcagctaatggag

SEQ ID NO: 129543 - DNA, 25 bp, Rattus norvegicus
agccctggctcaagaccagaggcaa

SEQ ID NO: 129544 - DNA, 25 bp, Rattus norvegicus
agccctggctcatgaccagaggcaa

SEQ ID NO: 129545 - DNA, 25 bp, Rattus norvegicus
agccctggctcgcttcttagaattt

SEQ ID NO: 129546 - DNA, 25 bp, Rattus norvegicus
agccctggctcggttcttagaattt

SEQ ID NO: 129547 - DNA, 25 bp, Rattus norvegicus
agccctggctgcatactttgtataa

SEQ ID NO: 129548 - DNA, 25 bp, Rattus norvegicus
agccctggctgcttactttgtataa

SEQ ID NO: 129549 - DNA, 25 bp, Rattus norvegicus
agccctggcttcagaatggactttg

SEQ ID NO: 129550 - DNA, 25 bp, Rattus norvegicus
agccctggcttctgaatggactttg

SEQ ID NO: 129551 - DNA, 25 bp, Rattus norvegicus
agccctgggaagagagaatgtctct

SEQ ID NO: 129552 - DNA, 25 bp, Rattus norvegicus
agccctgggaagtgagaatgtctct

SEQ ID NO: 129553 - DNA, 25 bp, Rattus norvegicus
agccctgggacccagtcacgggaag

SEQ ID NO: 129554 - DNA, 25 bp, Rattus norvegicus
agccctgggaccgagtcacgggaag

SEQ ID NO: 129555 - DNA, 25 bp, Rattus norvegicus
agccctgggaggagtacttattcta

SEQ ID NO: 129556 - DNA, 25 bp, Rattus norvegicus
agccctgggaggtgtacttattcta

SEQ ID NO: 129557 - DNA, 25 bp, Rattus norvegicus
agccctgggcagcaatgtttgctgc

SEQ ID NO: 129558 - DNA, 25 bp, Rattus norvegicus
agccctgggcaggaatgtttgctgc

SEQ ID NO: 129559 - DNA, 25 bp, Rattus norvegicus
agccctgggctcaaaatatatcttt

SEQ ID NO: 129560 - DNA, 25 bp, Rattus norvegicus
agccctgggctctaaatatatcttt

SEQ ID NO: 129561 - DNA, 25 bp, Rattus norvegicus
agccctggggctctcgctggagatc

SEQ ID NO: 129562 - DNA, 25 bp, Rattus norvegicus
agccctggggctgtcgctggagatc

SEQ ID NO: 129563 - DNA, 25 bp, Rattus norvegicus
agccctgggttcagttcttagcgct

SEQ ID NO: 129564 - DNA, 25 bp, Rattus norvegicus
agccctgggttctgttcttagcgct

SEQ ID NO: 129565 - DNA, 25 bp, Rattus norvegicus
agccctggtaaacgccattgtcaga

SEQ ID NO: 129566 - DNA, 25 bp, Rattus norvegicus
agccctggtaaaggccattgtcaga

SEQ ID NO: 129567 - DNA, 25 bp, Rattus norvegicus
agccctggtcacattgggacttcaa

SEQ ID NO: 129568 - DNA, 25 bp, Rattus norvegicus
agccctggtcactttgggacttcaa

SEQ ID NO: 129569 - DNA, 25 bp, Rattus norvegicus
agccctggtcagatttcaagttgtc

SEQ ID NO: 129570 - DNA, 25 bp, Rattus norvegicus
agccctggtcagttttcaagttgtc

SEQ ID NO: 129571 - DNA, 25 bp, Rattus norvegicus
agccctggtccaagctgaaggcaac

SEQ ID NO: 129572 - DNA, 25 bp, Rattus norvegicus
agccctggtccatgctgaaggcaac

SEQ ID NO: 129573 - DNA, 25 bp, Rattus norvegicus
agccctggtcctagagagatctcat

SEQ ID NO: 129574 - DNA, 25 bp, Rattus norvegicus
agccctggtccttgagagatctcat

SEQ ID NO: 129575 - DNA, 25 bp, Rattus norvegicus
agccctggtgcgctgcaatatgaag

SEQ ID NO: 129576 - DNA, 25 bp, Rattus norvegicus
agccctggtgcggtgcaatatgaag

SEQ ID NO: 129577 - DNA, 25 bp, Rattus norvegicus
agccctggtggaaactgcctgcaga

SEQ ID NO: 129578 - DNA, 25 bp, Rattus norvegicus
agccctggtggatactgcctgcaga

SEQ ID NO: 129579 - DNA, 25 bp, Rattus norvegicus
agccctggtggtagctctgatgtat

SEQ ID NO: 129580 - DNA, 25 bp, Rattus norvegicus
agccctggtggtatttctgtcattt

SEQ ID NO: 129581 - DNA, 25 bp, Rattus norvegicus
agccctggtggttgctctgatgtat

SEQ ID NO: 129582 - DNA, 25 bp, Rattus norvegicus
agccctggtggtttttctgtcattt

SEQ ID NO: 129583 - DNA, 25 bp, Rattus norvegicus
agccctggttgacctggagcgtcat

SEQ ID NO: 129584 - DNA, 25 bp, Rattus norvegicus
agccctggttgacgcagcacctgga

SEQ ID NO: 129585 - DNA, 25 bp, Rattus norvegicus
agccctggttgagctggagcgtcat

SEQ ID NO: 129586 - DNA, 25 bp, Rattus norvegicus
agccctggttgaggcagcacctgga

SEQ ID NO: 129587 - DNA, 25 bp, Rattus norvegicus
agccctggttgccttgacaacacaa

SEQ ID NO: 129588 - DNA, 25 bp, Rattus norvegicus
agccctggttgcgttgacaacacaa

SEQ ID NO: 129589 - DNA, 25 bp, Rattus norvegicus
agccctggttttactcttctagata

SEQ ID NO: 129590 - DNA, 25 bp, Rattus norvegicus
agccctggtttttctcttctagata

SEQ ID NO: 129591 - DNA, 25 bp, Rattus norvegicus
agccctgtagttacccttatggttg

SEQ ID NO: 129592 - DNA, 25 bp, Rattus norvegicus
agccctgtagtttcccttatggttg

SEQ ID NO: 129593 - DNA, 25 bp, Rattus norvegicus
agccctgtcagcaacggcaaagaaa

SEQ ID NO: 129594 - DNA, 25 bp, Rattus norvegicus
agccctgtcagccaaaggtgctgaa

SEQ ID NO: 129595 - DNA, 25 bp, Rattus norvegicus
agccctgtcagcgaaaggtgctgaa

SEQ ID NO: 129596 - DNA, 25 bp, Rattus norvegicus
agccctgtcagctacggcaaagaaa

SEQ ID NO: 129597 - DNA, 25 bp, Rattus norvegicus
agccctgtcctccaattatttgttt

SEQ ID NO: 129598 - DNA, 25 bp, Rattus norvegicus
agccctgtcctcgaattatttgttt

SEQ ID NO: 129599 - DNA, 25 bp, Rattus norvegicus
agccctgtcctgctggtattttcaa

SEQ ID NO: 129600 - DNA, 25 bp, Rattus norvegicus
agccctgtcctggtggtattttcaa

SEQ ID NO: 129601 - DNA, 25 bp, Rattus norvegicus
agccctgtctagcagctcagagtct

SEQ ID NO: 129602 - DNA, 25 bp, Rattus norvegicus
agccctgtctaggagctcagagtct

SEQ ID NO: 129603 - DNA, 25 bp, Rattus norvegicus
agccctgtctgaccttgtccaatgc

SEQ ID NO: 129604 - DNA, 25 bp, Rattus norvegicus
agccctgtctgagcttgtccaatgc

SEQ ID NO: 129605 - DNA, 25 bp, Rattus norvegicus
agccctgtctgcagtgaatttcctt

SEQ ID NO: 129606 - DNA, 25 bp, Rattus norvegicus
agccctgtctgctgtgaatttcctt

SEQ ID NO: 129607 - DNA, 25 bp, Rattus norvegicus
agccctgtgactcaaaaatacacaa

SEQ ID NO: 129608 - DNA, 25 bp, Rattus norvegicus
agccctgtgactgaaaaatacacaa

SEQ ID NO: 129609 - DNA, 25 bp, Rattus norvegicus
agccctgtgaggacgtctgccgaag

SEQ ID NO: 129610 - DNA, 25 bp, Rattus norvegicus
agccctgtgaggtcgtctgccgaag

SEQ ID NO: 129611 - DNA, 25 bp, Rattus norvegicus
agccctgtgcatctttgaaccagga

SEQ ID NO: 129612 - DNA, 25 bp, Rattus norvegicus
agccctgtgcatgtttgaaccagga

SEQ ID NO: 129613 - DNA, 25 bp, Rattus norvegicus
agccctgtggccaatgtgttcatgc

SEQ ID NO: 129614 - DNA, 25 bp, Rattus norvegicus
agccctgtggcctatgtgttcatgc

SEQ ID NO: 129615 - DNA, 25 bp, Rattus norvegicus
agccctgtggctcctgagacgtgca

SEQ ID NO: 129616 - DNA, 25 bp, Rattus norvegicus
agccctgtggctgctgagacgtgca

SEQ ID NO: 129617 - DNA, 25 bp, Rattus norvegicus
agccctgtgggtaagcatccactgt

SEQ ID NO: 129618 - DNA, 25 bp, Rattus norvegicus
agccctgtgggttagcatccactgt

SEQ ID NO: 129619 - DNA, 25 bp, Rattus norvegicus
agccctgtgttacttaatggtgtgg

SEQ ID NO: 129620 - DNA, 25 bp, Rattus norvegicus
agccctgtgttagttaatggtgtgg

SEQ ID NO: 129621 - DNA, 25 bp, Rattus norvegicus
agccctgttaggagactccatcaga

SEQ ID NO: 129622 - DNA, 25 bp, Rattus norvegicus
agccctgttaggtgactccatcaga

SEQ ID NO: 129623 - DNA, 25 bp, Rattus norvegicus
agccctgttctgaccaaatcacgat

SEQ ID NO: 129624 - DNA, 25 bp, Rattus norvegicus
agccctgttctgtccaaatcacgat

SEQ ID NO: 129625 - DNA, 25 bp, Rattus norvegicus
agccctgttgctaaaccatggcaga

SEQ ID NO: 129626 - DNA, 25 bp, Rattus norvegicus
agccctgttgcttaaccatggcaga

SEQ ID NO: 129627 - DNA, 25 bp, Rattus norvegicus
agccctgttgtaatctttcattgca

SEQ ID NO: 129628 - DNA, 25 bp, Rattus norvegicus
agccctgttgtattctttcattgca

SEQ ID NO: 129629 - DNA, 25 bp, Rattus norvegicus
agcccttagagcagtcacacatgag

SEQ ID NO: 129630 - DNA, 25 bp, Rattus norvegicus
agcccttagagctgtcacacatgag

SEQ ID NO: 129631 - DNA, 25 bp, Rattus norvegicus
agcccttaggcaccatgttagtcaa

SEQ ID NO: 129632 - DNA, 25 bp, Rattus norvegicus
agcccttaggcagcatgttagtcaa

SEQ ID NO: 129633 - DNA, 25 bp, Rattus norvegicus
agcccttatgatcttcctacctgga

SEQ ID NO: 129634 - DNA, 25 bp, Rattus norvegicus
agcccttatgatgttcctacctgga

SEQ ID NO: 129635 - DNA, 25 bp, Rattus norvegicus
agcccttatgccatgtcccaaaaat

SEQ ID NO: 129636 - DNA, 25 bp, Rattus norvegicus
agcccttatgccttgtcccaaaaat

SEQ ID NO: 129637 - DNA, 25 bp, Rattus norvegicus
agcccttatggtccttatgcctaaa

SEQ ID NO: 129638 - DNA, 25 bp, Rattus norvegicus
agcccttatggtgcttatgcctaaa

SEQ ID NO: 129639 - DNA, 25 bp, Rattus norvegicus
agcccttatgtcctatgtttctgtc

SEQ ID NO: 129640 - DNA, 25 bp, Rattus norvegicus
agcccttatgtcgtatgtttctgtc

SEQ ID NO: 129641 - DNA, 25 bp, Rattus norvegicus
agcccttcaaatagaacctactcct

SEQ ID NO: 129642 - DNA, 25 bp, Rattus norvegicus
agcccttcaaattgaacctactcct

SEQ ID NO: 129643 - DNA, 25 bp, Rattus norvegicus
agcccttcagttactaagtcagctt

SEQ ID NO: 129644 - DNA, 25 bp, Rattus norvegicus
agcccttcagtttctaagtcagctt

SEQ ID NO: 129645 - DNA, 25 bp, Rattus norvegicus
agcccttccaagagaaaaaggagat

SEQ ID NO: 129646 - DNA, 25 bp, Rattus norvegicus
agcccttccaagtgaaaaaggagat

SEQ ID NO: 129647 - DNA, 25 bp, Rattus norvegicus
agcccttccagcaggagaaagtccc

SEQ ID NO: 129648 - DNA, 25 bp, Rattus norvegicus
agcccttccagcaggtccatggtga

SEQ ID NO: 129649 - DNA, 25 bp, Rattus norvegicus
agcccttccagctggagaaagtccc

SEQ ID NO: 129650 - DNA, 25 bp, Rattus norvegicus
agcccttccagctggtccatggtga

SEQ ID NO: 129651 - DNA, 25 bp, Rattus norvegicus
agcccttccaggcaacaaacagtat

SEQ ID NO: 129652 - DNA, 25 bp, Rattus norvegicus
agcccttccagggaacaaacagtat

SEQ ID NO: 129653 - DNA, 25 bp, Rattus norvegicus
agcccttccggtccatgtgacaatg

SEQ ID NO: 129654 - DNA, 25 bp, Rattus norvegicus
agcccttccggtgcatgtgacaatg

SEQ ID NO: 129655 - DNA, 25 bp, Rattus norvegicus
agcccttcctgaacgtaagtcaaat

SEQ ID NO: 129656 - DNA, 25 bp, Rattus norvegicus
agcccttcctgatcgtaagtcaaat

SEQ ID NO: 129657 - DNA, 25 bp, Rattus norvegicus
agcccttcctgtcgctgttaggtcg

SEQ ID NO: 129658 - DNA, 25 bp, Rattus norvegicus
agcccttcctgtggctgttaggtcg

SEQ ID NO: 129659 - DNA, 25 bp, Rattus norvegicus
agcccttcctttacactgtgaatga

SEQ ID NO: 129660 - DNA, 25 bp, Rattus norvegicus
agcccttccttttcactgtgaatga

SEQ ID NO: 129661 - DNA, 25 bp, Rattus norvegicus
agcccttctagcatctcagagagtt

SEQ ID NO: 129662 - DNA, 25 bp, Rattus norvegicus
agcccttctagccactgaggtggga

SEQ ID NO: 129663 - DNA, 25 bp, Rattus norvegicus
agcccttctagcgactgaggtggga

SEQ ID NO: 129664 - DNA, 25 bp, Rattus norvegicus
agcccttctagcttctcagagagtt

SEQ ID NO: 129665 - DNA, 25 bp, Rattus norvegicus
agcccttctctgacagcttgaggtg

SEQ ID NO: 129666 - DNA, 25 bp, Rattus norvegicus
agcccttctctgtcagcttgaggtg

SEQ ID NO: 129667 - DNA, 25 bp, Rattus norvegicus
agcccttctgaaccatgagaggtct

SEQ ID NO: 129668 - DNA, 25 bp, Rattus norvegicus
agcccttctgaagcatgagaggtct

SEQ ID NO: 129669 - DNA, 25 bp, Rattus norvegicus
agcccttctgggagtgagttttgaa

SEQ ID NO: 129670 - DNA, 25 bp, Rattus norvegicus
agcccttctgggattgagtgtgttc

SEQ ID NO: 129671 - DNA, 25 bp, Rattus norvegicus
agcccttctgggtgtgagttttgaa

SEQ ID NO: 129672 - DNA, 25 bp, Rattus norvegicus
agcccttctgggtttgagtgtgttc

SEQ ID NO: 129673 - DNA, 25 bp, Rattus norvegicus
agcccttcttctcttagacaacagg

SEQ ID NO: 129674 - DNA, 25 bp, Rattus norvegicus
agcccttcttctgttagacaacagg

SEQ ID NO: 129675 - DNA, 25 bp, Rattus norvegicus
agcccttcttgacattcctattagt

SEQ ID NO: 129676 - DNA, 25 bp, Rattus norvegicus
agcccttcttgagattcctattagt

SEQ ID NO: 129677 - DNA, 25 bp, Rattus norvegicus
agcccttgaaggacactcagtgcca

SEQ ID NO: 129678 - DNA, 25 bp, Rattus norvegicus
agcccttgaaggtcactcagtgcca

SEQ ID NO: 129679 - DNA, 25 bp, Rattus norvegicus
agcccttgaccgattgatcatggtt

SEQ ID NO: 129680 - DNA, 25 bp, Rattus norvegicus
agcccttgaccgtttgatcatggtt

SEQ ID NO: 129681 - DNA, 25 bp, Rattus norvegicus
agcccttgactcaccctaaataaag

SEQ ID NO: 129682 - DNA, 25 bp, Rattus norvegicus
agcccttgactctccctaaataaag

SEQ ID NO: 129683 - DNA, 25 bp, Rattus norvegicus
agcccttgatatagagtgttcttga

SEQ ID NO: 129684 - DNA, 25 bp, Rattus norvegicus
agcccttgatattgagtgttcttga

SEQ ID NO: 129685 - DNA, 25 bp, Rattus norvegicus
agcccttgatccacacgtgatgtga

SEQ ID NO: 129686 - DNA, 25 bp, Rattus norvegicus
agcccttgatcctcacgtgatgtga

SEQ ID NO: 129687 - DNA, 25 bp, Rattus norvegicus
agcccttgcattagactccaacaga

SEQ ID NO: 129688 - DNA, 25 bp, Rattus norvegicus
agcccttgcatttgactccaacaga

SEQ ID NO: 129689 - DNA, 25 bp, Rattus norvegicus
agcccttgccacctaggagtcagga

SEQ ID NO: 129690 - DNA, 25 bp, Rattus norvegicus
agcccttgccacgtaggagtcagga

SEQ ID NO: 129691 - DNA, 25 bp, Rattus norvegicus
agcccttgcctgcaactgcatgtga

SEQ ID NO: 129692 - DNA, 25 bp, Rattus norvegicus
agcccttgcctggaactgcatgtga

SEQ ID NO: 129693 - DNA, 25 bp, Rattus norvegicus
agcccttgctcgcaacctacaggaa

SEQ ID NO: 129694 - DNA, 25 bp, Rattus norvegicus
agcccttgctcggaacctacaggaa

SEQ ID NO: 129695 - DNA, 25 bp, Rattus norvegicus
agcccttgctggaacatcagtactg

SEQ ID NO: 129696 - DNA, 25 bp, Rattus norvegicus
agcccttgctggtacatcagtactg

SEQ ID NO: 129697 - DNA, 25 bp, Rattus norvegicus
agcccttgcttacctgtaatgtgct

SEQ ID NO: 129698 - DNA, 25 bp, Rattus norvegicus
agcccttgcttagctgtaatgtgct

SEQ ID NO: 129699 - DNA, 25 bp, Rattus norvegicus
agcccttggatgaagcagtcttgca

SEQ ID NO: 129700 - DNA, 25 bp, Rattus norvegicus
agcccttggatgtagcagtcttgca

SEQ ID NO: 129701 - DNA, 25 bp, Rattus norvegicus
agcccttggccgacagtgagaagct

SEQ ID NO: 129702 - DNA, 25 bp, Rattus norvegicus
agcccttggccgtcagtgagaagct

SEQ ID NO: 129703 - DNA, 25 bp, Rattus norvegicus
agcccttgtgatataccatttcttt

SEQ ID NO: 129704 - DNA, 25 bp, Rattus norvegicus
agcccttgtgatttaccatttcttt

SEQ ID NO: 129705 - DNA, 25 bp, Rattus norvegicus
agccctttcatcatcatcttttggt

SEQ ID NO: 129706 - DNA, 25 bp, Rattus norvegicus
agccctttcatcttcatcttttggt

SEQ ID NO: 129707 - DNA, 25 bp, Rattus norvegicus
agccctttgaatctactcgtgtctt

SEQ ID NO: 129708 - DNA, 25 bp, Rattus norvegicus
agccctttgaatgtactcgtgtctt

SEQ ID NO: 129709 - DNA, 25 bp, Rattus norvegicus
agccctttgctcacacgtggtatag

SEQ ID NO: 129710 - DNA, 25 bp, Rattus norvegicus
agccctttgctctcacgtggtatag

SEQ ID NO: 129711 - DNA, 25 bp, Rattus norvegicus
agccctttgctgataattgttactg

SEQ ID NO: 129712 - DNA, 25 bp, Rattus norvegicus
agccctttgctgttaattgttactg

SEQ ID NO: 129713 - DNA, 25 bp, Rattus norvegicus
agccctttgcttaggtgcgtggtta

SEQ ID NO: 129714 - DNA, 25 bp, Rattus norvegicus
agccctttgctttggtgcgtggtta

SEQ ID NO: 129715 - DNA, 25 bp, Rattus norvegicus
agccctttggctacagattgcctga

SEQ ID NO: 129716 - DNA, 25 bp, Rattus norvegicus
agccctttggcttcagattgcctga

SEQ ID NO: 129717 - DNA, 25 bp, Rattus norvegicus
agccctttggtgatcattgtcatag

SEQ ID NO: 129718 - DNA, 25 bp, Rattus norvegicus
agccctttggtgttcattgtcatag

SEQ ID NO: 129719 - DNA, 25 bp, Rattus norvegicus
agccctttgtctctaggacgttggt

SEQ ID NO: 129720 - DNA, 25 bp, Rattus norvegicus
agccctttgtctgtaggacgttggt

SEQ ID NO: 129721 - DNA, 25 bp, Rattus norvegicus
agccctttgtggaacacctgtatta

SEQ ID NO: 129722 - DNA, 25 bp, Rattus norvegicus
agccctttgtggtacacctgtatta

SEQ ID NO: 129723 - DNA, 25 bp, Rattus norvegicus
agccctttgttactatccttctatc

SEQ ID NO: 129724 - DNA, 25 bp, Rattus norvegicus
agccctttgttagtatccttctatc

SEQ ID NO: 129725 - DNA, 25 bp, Rattus norvegicus
agccctttgtttactgcgctttgag

SEQ ID NO: 129726 - DNA, 25 bp, Rattus norvegicus
agccctttgttttctgcgctttgag

SEQ ID NO: 129727 - DNA, 25 bp, Rattus norvegicus
agccctttttagaaatgtgacgtga

SEQ ID NO: 129728 - DNA, 25 bp, Rattus norvegicus
agccctttttagtaatgtgacgtga

SEQ ID NO: 129729 - DNA, 25 bp, Rattus norvegicus
agcccttttttcatgttgagaggca

SEQ ID NO: 129730 - DNA, 25 bp, Rattus norvegicus
agcccttttttcttgttgagaggca

SEQ ID NO: 129731 - DNA, 25 bp, Rattus norvegicus
agccgaaactctacatcattcaggc

SEQ ID NO: 129732 - DNA, 25 bp, Rattus norvegicus
agccgaaactcttcatcattcaggc

SEQ ID NO: 129733 - DNA, 25 bp, Rattus norvegicus
agccgaaagtgacatccagtctccc

SEQ ID NO: 129734 - DNA, 25 bp, Rattus norvegicus
agccgaaagtgagatccagtctccc

SEQ ID NO: 129735 - DNA, 25 bp, Rattus norvegicus
agccgaaccttcaattttgcagcac

SEQ ID NO: 129736 - DNA, 25 bp, Rattus norvegicus
agccgaaccttctattttgcagcac

SEQ ID NO: 129737 - DNA, 25 bp, Rattus norvegicus
agccgaacggccagcatgtcgtcgg

SEQ ID NO: 129738 - DNA, 25 bp, Rattus norvegicus
agccgaacggcctgcatgtcgtcgg

SEQ ID NO: 129739 - DNA, 25 bp, Rattus norvegicus
agccgaaggtggatgcagagcccaa

SEQ ID NO: 129740 - DNA, 25 bp, Rattus norvegicus
agccgaaggtggttgcagagcccaa

SEQ ID NO: 129741 - DNA, 25 bp, Rattus norvegicus
agccgaagtcgcagggtcagcttga

SEQ ID NO: 129742 - DNA, 25 bp, Rattus norvegicus
agccgaagtcgctgggtcagcttga

SEQ ID NO: 129743 - DNA, 25 bp, Rattus norvegicus
agccgaatgcagctacacgtatttc

SEQ ID NO: 129744 - DNA, 25 bp, Rattus norvegicus
agccgaatgcaggtacacgtatttc

SEQ ID NO: 129745 - DNA, 25 bp, Rattus norvegicus
agccgacaagctctacatccagaca

SEQ ID NO: 129746 - DNA, 25 bp, Rattus norvegicus
agccgacaagctgtacatccagaca

SEQ ID NO: 129747 - DNA, 25 bp, Rattus norvegicus
agccgacaggctagggattatgaaa

SEQ ID NO: 129748 - DNA, 25 bp, Rattus norvegicus
agccgacaggcttgggattatgaaa

SEQ ID NO: 129749 - DNA, 25 bp, Rattus norvegicus
agccgacagtgtcggcaatgcctgc

SEQ ID NO: 129750 - DNA, 25 bp, Rattus norvegicus
agccgacagtgtgggcaatgcctgc

SEQ ID NO: 129751 - DNA, 25 bp, Rattus norvegicus
agccgaccacaccacaggatttgaa

SEQ ID NO: 129752 - DNA, 25 bp, Rattus norvegicus
agccgaccacacgacaggatttgaa

SEQ ID NO: 129753 - DNA, 25 bp, Rattus norvegicus
agccgaccactacgccgggtgaatg

SEQ ID NO: 129754 - DNA, 25 bp, Rattus norvegicus
agccgaccactaggccgggtgaatg

SEQ ID NO: 129755 - DNA, 25 bp, Rattus norvegicus
agccgaccgaagacgacatgcatgt

SEQ ID NO: 129756 - DNA, 25 bp, Rattus norvegicus
agccgaccgaagtcgacatgcatgt

SEQ ID NO: 129757 - DNA, 25 bp, Rattus norvegicus
agccgaccttgcagattgtcacaag

SEQ ID NO: 129758 - DNA, 25 bp, Rattus norvegicus
agccgaccttgctgattgtcacaag

SEQ ID NO: 129759 - DNA, 25 bp, Rattus norvegicus
agccgaccttggaccgcccaggttg

SEQ ID NO: 129760 - DNA, 25 bp, Rattus norvegicus
agccgaccttggtccgcccaggttg

SEQ ID NO: 129761 - DNA, 25 bp, Rattus norvegicus
agccgacgcagtactgggcattcta

SEQ ID NO: 129762 - DNA, 25 bp, Rattus norvegicus
agccgacgcagttctgggcattcta

SEQ ID NO: 129763 - DNA, 25 bp, Rattus norvegicus
agccgacgcggtaccttaatgttag

SEQ ID NO: 129764 - DNA, 25 bp, Rattus norvegicus
agccgacgcggttccttaatgttag

SEQ ID NO: 129765 - DNA, 25 bp, Rattus norvegicus
agccgactcctcctgaaagtaggca

SEQ ID NO: 129766 - DNA, 25 bp, Rattus norvegicus
agccgactcctcgtgaaagtaggca

SEQ ID NO: 129767 - DNA, 25 bp, Rattus norvegicus
agccgacttctaccattcacggatt

SEQ ID NO: 129768 - DNA, 25 bp, Rattus norvegicus
agccgacttctagcattcacggatt

SEQ ID NO: 129769 - DNA, 25 bp, Rattus norvegicus
agccgagaccataggtcgctggttt

SEQ ID NO: 129770 - DNA, 25 bp, Rattus norvegicus
agccgagaccattggtcgctggttt

SEQ ID NO: 129771 - DNA, 25 bp, Rattus norvegicus
agccgagaccggcacctttgactag

SEQ ID NO: 129772 - DNA, 25 bp, Rattus norvegicus
agccgagaccgggacctttgactag

SEQ ID NO: 129773 - DNA, 25 bp, Rattus norvegicus
agccgagagaagaccagattcttaa

SEQ ID NO: 129774 - DNA, 25 bp, Rattus norvegicus
agccgagagaagtccagattcttaa

SEQ ID NO: 129775 - DNA, 25 bp, Rattus norvegicus
agccgagagctacaatacttttatt

SEQ ID NO: 129776 - DNA, 25 bp, Rattus norvegicus
agccgagagctagaatacttttatt

SEQ ID NO: 129777 - DNA, 25 bp, Rattus norvegicus
agccgagatcagaaactatgcatac

SEQ ID NO: 129778 - DNA, 25 bp, Rattus norvegicus
agccgagatcagtaactatgcatac

SEQ ID NO: 129779 - DNA, 25 bp, Rattus norvegicus
agccgagatgacaggaactcctcac

SEQ ID NO: 129780 - DNA, 25 bp, Rattus norvegicus
agccgagatgactggaactcctcac

SEQ ID NO: 129781 - DNA, 25 bp, Rattus norvegicus
agccgagatggccttagtacacaca

SEQ ID NO: 129782 - DNA, 25 bp, Rattus norvegicus
agccgagatggcgttagtacacaca

SEQ ID NO: 129783 - DNA, 25 bp, Rattus norvegicus
agccgagcacgaccggatggccaga

SEQ ID NO: 129784 - DNA, 25 bp, Rattus norvegicus
agccgagcacgagcggatggccaga

SEQ ID NO: 129785 - DNA, 25 bp, Rattus norvegicus
agccgagctccacggacttggtgtt

SEQ ID NO: 129786 - DNA, 25 bp, Rattus norvegicus
agccgagctccagggacttggtgtt

SEQ ID NO: 129787 - DNA, 25 bp, Rattus norvegicus
agccgaggagatactgggacctgca

SEQ ID NO: 129788 - DNA, 25 bp, Rattus norvegicus
agccgaggagattctgggacctgca

SEQ ID NO: 129789 - DNA, 25 bp, Rattus norvegicus
agccgaggtctcatggcgttaagca

SEQ ID NO: 129790 - DNA, 25 bp, Rattus norvegicus
agccgaggtctcttggcgttaagca

SEQ ID NO: 129791 - DNA, 25 bp, Rattus norvegicus
agccgaggtgtaaactgctgtacat

SEQ ID NO: 129792 - DNA, 25 bp, Rattus norvegicus
agccgaggtgtatactgctgtacat

SEQ ID NO: 129793 - DNA, 25 bp, Rattus norvegicus
agccgagtccttaagctttctgctg

SEQ ID NO: 129794 - DNA, 25 bp, Rattus norvegicus
agccgagtcctttagctttctgctg

SEQ ID NO: 129795 - DNA, 25 bp, Rattus norvegicus
agccgagtgctcctaggatttcgca

SEQ ID NO: 129796 - DNA, 25 bp, Rattus norvegicus
agccgagtgctcgtaggatttcgca

SEQ ID NO: 129797 - DNA, 25 bp, Rattus norvegicus
agccgagtggagatcctgtagctgt

SEQ ID NO: 129798 - DNA, 25 bp, Rattus norvegicus
agccgagtggagttcctgtagctgt

SEQ ID NO: 129799 - DNA, 25 bp, Rattus norvegicus
agccgagtgggcatgaccttcagac

SEQ ID NO: 129800 - DNA, 25 bp, Rattus norvegicus
agccgagtgggcttgaccttcagac

SEQ ID NO: 129801 - DNA, 25 bp, Rattus norvegicus
agccgagttcatccggaggcgaaac

SEQ ID NO: 129802 - DNA, 25 bp, Rattus norvegicus
agccgagttcatcctgactgagtat

SEQ ID NO: 129803 - DNA, 25 bp, Rattus norvegicus
agccgagttcatgcggaggcgaaac

SEQ ID NO: 129804 - DNA, 25 bp, Rattus norvegicus
agccgagttcatgctgactgagtat

SEQ ID NO: 129805 - DNA, 25 bp, Rattus norvegicus
agccgataatctaccagcattctag

SEQ ID NO: 129806 - DNA, 25 bp, Rattus norvegicus
agccgataatcttccagcattctag

SEQ ID NO: 129807 - DNA, 25 bp, Rattus norvegicus
agccgatgagacactgcggctctgg

SEQ ID NO: 129808 - DNA, 25 bp, Rattus norvegicus
agccgatgagactctgcggctctgg

SEQ ID NO: 129809 - DNA, 25 bp, Rattus norvegicus
agccgatggccgaactgagtcttga

SEQ ID NO: 129810 - DNA, 25 bp, Rattus norvegicus
agccgatggccgtactgagtcttga

SEQ ID NO: 129811 - DNA, 25 bp, Rattus norvegicus
agccgatgtggccataggtcctaat

SEQ ID NO: 129812 - DNA, 25 bp, Rattus norvegicus
agccgatgtggcgataggtcctaat

SEQ ID NO: 129813 - DNA, 25 bp, Rattus norvegicus
agccgatgttccacactggtttgga

SEQ ID NO: 129814 - DNA, 25 bp, Rattus norvegicus
agccgatgttcctcactggtttgga

SEQ ID NO: 129815 - DNA, 25 bp, Rattus norvegicus
agccgattttcactgcagatgttca

SEQ ID NO: 129816 - DNA, 25 bp, Rattus norvegicus
agccgattttcagtgcagatgttca

SEQ ID NO: 129817 - DNA, 25 bp, Rattus norvegicus
agccgcaacgtgaagtcgctggaaa

SEQ ID NO: 129818 - DNA, 25 bp, Rattus norvegicus
agccgcaacgtgtagtcgctggaaa

SEQ ID NO: 129819 - DNA, 25 bp, Rattus norvegicus
agccgcacacaaccgctgaatttag

SEQ ID NO: 129820 - DNA, 25 bp, Rattus norvegicus
agccgcacacaagcgctgaatttag

SEQ ID NO: 129821 - DNA, 25 bp, Rattus norvegicus
agccgcacagatcctaccatggaga

SEQ ID NO: 129822 - DNA, 25 bp, Rattus norvegicus
agccgcacagatgctaccatggaga

SEQ ID NO: 129823 - DNA, 25 bp, Rattus norvegicus
agccgcacctgtcgaacatcacatg

SEQ ID NO: 129824 - DNA, 25 bp, Rattus norvegicus
agccgcacctgtggaacatcacatg

SEQ ID NO: 129825 - DNA, 25 bp, Rattus norvegicus
agccgcacggacagagcgactactg

SEQ ID NO: 129826 - DNA, 25 bp, Rattus norvegicus
agccgcacggactgagcgactactg

SEQ ID NO: 129827 - DNA, 25 bp, Rattus norvegicus
agccgcacggtgaacatatttcagt

SEQ ID NO: 129828 - DNA, 25 bp, Rattus norvegicus
agccgcacggtgtacatatttcagt

SEQ ID NO: 129829 - DNA, 25 bp, Rattus norvegicus
agccgcagcagcctacagttaactg

SEQ ID NO: 129830 - DNA, 25 bp, Rattus norvegicus
agccgcagcagcgtacagttaactg

SEQ ID NO: 129831 - DNA, 25 bp, Rattus norvegicus
agccgcagccagagcaggagtcgta

SEQ ID NO: 129832 - DNA, 25 bp, Rattus norvegicus
agccgcagccagtgcaggagtcgta

SEQ ID NO: 129833 - DNA, 25 bp, Rattus norvegicus
agccgcagctgaagttccaagttct

SEQ ID NO: 129834 - DNA, 25 bp, Rattus norvegicus
agccgcagctgatgttccaagttct

SEQ ID NO: 129835 - DNA, 25 bp, Rattus norvegicus
agccgcagggctaccacgcgcgaag

SEQ ID NO: 129836 - DNA, 25 bp, Rattus norvegicus
agccgcagggcttccacgcgcgaag

SEQ ID NO: 129837 - DNA, 25 bp, Rattus norvegicus
agccgcagtcagataagccttaagt

SEQ ID NO: 129838 - DNA, 25 bp, Rattus norvegicus
agccgcagtcagttaagccttaagt

SEQ ID NO: 129839 - DNA, 25 bp, Rattus norvegicus
agccgcagtgctactaaacatttcc

SEQ ID NO: 129840 - DNA, 25 bp, Rattus norvegicus
agccgcagtgcttctaaacatttcc

SEQ ID NO: 129841 - DNA, 25 bp, Rattus norvegicus
agccgcatacaaccacattcttgat

SEQ ID NO: 129842 - DNA, 25 bp, Rattus norvegicus
agccgcatacaagcacattcttgat

SEQ ID NO: 129843 - DNA, 25 bp, Rattus norvegicus
agccgccatagcagatgactcctat

SEQ ID NO: 129844 - DNA, 25 bp, Rattus norvegicus
agccgccatagcaggagccgcagtc

SEQ ID NO: 129845 - DNA, 25 bp, Rattus norvegicus
agccgccatagctgatgactcctat

SEQ ID NO: 129846 - DNA, 25 bp, Rattus norvegicus
agccgccatagctggagccgcagtc

SEQ ID NO: 129847 - DNA, 25 bp, Rattus norvegicus
agccgcccacgtacagtcgaaggat

SEQ ID NO: 129848 - DNA, 25 bp, Rattus norvegicus
agccgcccacgttcagtcgaaggat

SEQ ID NO: 129849 - DNA, 25 bp, Rattus norvegicus
agccgcccagaaaatgccattatct

SEQ ID NO: 129850 - DNA, 25 bp, Rattus norvegicus
agccgcccagaatatgccattatct

SEQ ID NO: 129851 - DNA, 25 bp, Rattus norvegicus
agccgcccctctcagattcaggaaa

SEQ ID NO: 129852 - DNA, 25 bp, Rattus norvegicus
agccgcccctctgagattcaggaaa

SEQ ID NO: 129853 - DNA, 25 bp, Rattus norvegicus
agccgccctggaaagtactgagtga

SEQ ID NO: 129854 - DNA, 25 bp, Rattus norvegicus
agccgccctggatagtactgagtga

SEQ ID NO: 129855 - DNA, 25 bp, Rattus norvegicus
agccgccctgttattgaggtctcaa

SEQ ID NO: 129856 - DNA, 25 bp, Rattus norvegicus
agccgccctgtttttgaggtctcaa

SEQ ID NO: 129857 - DNA, 25 bp, Rattus norvegicus
agccgccggagtcggcagatcctca

SEQ ID NO: 129858 - DNA, 25 bp, Rattus norvegicus
agccgccggagtgggcagatcctca

SEQ ID NO: 129859 - DNA, 25 bp, Rattus norvegicus
agccgcctaggaaagacttcgtttg

SEQ ID NO: 129860 - DNA, 25 bp, Rattus norvegicus
agccgcctaggatagacttcgtttg

SEQ ID NO: 129861 - DNA, 25 bp, Rattus norvegicus
agccgcctcagccattgtctggtcg

SEQ ID NO: 129862 - DNA, 25 bp, Rattus norvegicus
agccgcctcagcgattgtctggtcg

SEQ ID NO: 129863 - DNA, 25 bp, Rattus norvegicus
agccgcctgccaagttgctggatga

SEQ ID NO: 129864 - DNA, 25 bp, Rattus norvegicus
agccgcctgccatgttgctggatga

SEQ ID NO: 129865 - DNA, 25 bp, Rattus norvegicus
agccgcctgctcagacacgtgtaag

SEQ ID NO: 129866 - DNA, 25 bp, Rattus norvegicus
agccgcctgctctgacacgtgtaag

SEQ ID NO: 129867 - DNA, 25 bp, Rattus norvegicus
agccgcctgtgcactgctataaaga

SEQ ID NO: 129868 - DNA, 25 bp, Rattus norvegicus
agccgcctgtgctctgctataaaga

SEQ ID NO: 129869 - DNA, 25 bp, Rattus norvegicus
agccgcgctcccacggcgggaagat

SEQ ID NO: 129870 - DNA, 25 bp, Rattus norvegicus
agccgcgctccctcggcgggaagat

SEQ ID NO: 129871 - DNA, 25 bp, Rattus norvegicus
agccgcgctggaactggatgacagt

SEQ ID NO: 129872 - DNA, 25 bp, Rattus norvegicus
agccgcgctggatctggatgacagt

SEQ ID NO: 129873 - DNA, 25 bp, Rattus norvegicus
agccgcggggtcactccagcacgtt

SEQ ID NO: 129874 - DNA, 25 bp, Rattus norvegicus
agccgcggggtctctccagcacgtt

SEQ ID NO: 129875 - DNA, 25 bp, Rattus norvegicus
agccgcgtagtaaaggtcttaattt

SEQ ID NO: 129876 - DNA, 25 bp, Rattus norvegicus
agccgcgtagtataggtcttaattt

SEQ ID NO: 129877 - DNA, 25 bp, Rattus norvegicus
agccgcgtgcctctgaagaccaagt

SEQ ID NO: 129878 - DNA, 25 bp, Rattus norvegicus
agccgcgtgcctgtgaagaccaagt

SEQ ID NO: 129879 - DNA, 25 bp, Rattus norvegicus
agccgcgtgctgcttttcagccaat

SEQ ID NO: 129880 - DNA, 25 bp, Rattus norvegicus
agccgcgtgctggttttcagccaat

SEQ ID NO: 129881 - DNA, 25 bp, Rattus norvegicus
agccgctaccagattaccctttggg

SEQ ID NO: 129882 - DNA, 25 bp, Rattus norvegicus
agccgctaccagtttaccctttggg

SEQ ID NO: 129883 - DNA, 25 bp, Rattus norvegicus
agccgctattagcgtgtgtggactc

SEQ ID NO: 129884 - DNA, 25 bp, Rattus norvegicus
agccgctattagggtgtgtggactc

SEQ ID NO: 129885 - DNA, 25 bp, Rattus norvegicus
agccgctattttcttgactgagaaa

SEQ ID NO: 129886 - DNA, 25 bp, Rattus norvegicus
agccgctattttgttgactgagaaa

SEQ ID NO: 129887 - DNA, 25 bp, Rattus norvegicus
agccgctcaataactaccacatgaa

SEQ ID NO: 129888 - DNA, 25 bp, Rattus norvegicus
agccgctcaatatctaccacatgaa

SEQ ID NO: 129889 - DNA, 25 bp, Rattus norvegicus
agccgctcatctccatattcataag

SEQ ID NO: 129890 - DNA, 25 bp, Rattus norvegicus
agccgctcatctgcatattcataag

SEQ ID NO: 129891 - DNA, 25 bp, Rattus norvegicus
agccgctccagcaagtttctcagag

SEQ ID NO: 129892 - DNA, 25 bp, Rattus norvegicus
agccgctccagctagtttctcagag

SEQ ID NO: 129893 - DNA, 25 bp, Rattus norvegicus
agccgctcctatcagacacttgtag

SEQ ID NO: 129894 - DNA, 25 bp, Rattus norvegicus
agccgctcctatgagacacttgtag

SEQ ID NO: 129895 - DNA, 25 bp, Rattus norvegicus
agccgctcgttcatcctgatgtcga

SEQ ID NO: 129896 - DNA, 25 bp, Rattus norvegicus
agccgctcgttcttcctgatgtcga

SEQ ID NO: 129897 - DNA, 25 bp, Rattus norvegicus
agccgctctagtctcaggaatttgc

SEQ ID NO: 129898 - DNA, 25 bp, Rattus norvegicus
agccgctctagtgtcaggaatttgc

SEQ ID NO: 129899 - DNA, 25 bp, Rattus norvegicus
agccgctgagccagtgcactaagag

SEQ ID NO: 129900 - DNA, 25 bp, Rattus norvegicus
agccgctgagcctgtgcactaagag

SEQ ID NO: 129901 - DNA, 25 bp, Rattus norvegicus
agccgctgcagacctacttctgagg

SEQ ID NO: 129902 - DNA, 25 bp, Rattus norvegicus
agccgctgcagagctacttctgagg

SEQ ID NO: 129903 - DNA, 25 bp, Rattus norvegicus
agccgctgccagatacagtgcagga

SEQ ID NO: 129904 - DNA, 25 bp, Rattus norvegicus
agccgctgccagttacagtgcagga

SEQ ID NO: 129905 - DNA, 25 bp, Rattus norvegicus
agccgctgcctgaacccaagaagag

SEQ ID NO: 129906 - DNA, 25 bp, Rattus norvegicus
agccgctgcctgtacccaagaagag

SEQ ID NO: 129907 - DNA, 25 bp, Rattus norvegicus
agccgctggacaccatggagtctga

SEQ ID NO: 129908 - DNA, 25 bp, Rattus norvegicus
agccgctggacagcatggagtctga

SEQ ID NO: 129909 - DNA, 25 bp, Rattus norvegicus
agccgctggaggataattttgccaa

SEQ ID NO: 129910 - DNA, 25 bp, Rattus norvegicus
agccgctggaggttaattttgccaa

SEQ ID NO: 129911 - DNA, 25 bp, Rattus norvegicus
agccgctggcttctaggtctggaaa

SEQ ID NO: 129912 - DNA, 25 bp, Rattus norvegicus
agccgctggcttgtaggtctggaaa

SEQ ID NO: 129913 - DNA, 25 bp, Rattus norvegicus
agccgctggtgtcttacatggtgca

SEQ ID NO: 129914 - DNA, 25 bp, Rattus norvegicus
agccgctggtgtgttacatggtgca

SEQ ID NO: 129915 - DNA, 25 bp, Rattus norvegicus
agccgctgtggcagaacagattctg

SEQ ID NO: 129916 - DNA, 25 bp, Rattus norvegicus
agccgctgtggctgaacagattctg

SEQ ID NO: 129917 - DNA, 25 bp, Rattus norvegicus
agccgcttacccagagatggagtaa

SEQ ID NO: 129918 - DNA, 25 bp, Rattus norvegicus
agccgcttaccctgagatggagtaa

SEQ ID NO: 129919 - DNA, 25 bp, Rattus norvegicus
agccgcttccatattctatactcaa

SEQ ID NO: 129920 - DNA, 25 bp, Rattus norvegicus
agccgcttccattttctatactcaa

SEQ ID NO: 129921 - DNA, 25 bp, Rattus norvegicus
agccgctttctaactaagagactca

SEQ ID NO: 129922 - DNA, 25 bp, Rattus norvegicus
agccgctttctatctaagagactca

SEQ ID NO: 129923 - DNA, 25 bp, Rattus norvegicus
agccgctttgacctccaatggttat

SEQ ID NO: 129924 - DNA, 25 bp, Rattus norvegicus
agccgctttgacgtccaatggttat

SEQ ID NO: 129925 - DNA, 25 bp, Rattus norvegicus
agccgctttgccagtgcagtgaaac

SEQ ID NO: 129926 - DNA, 25 bp, Rattus norvegicus
agccgctttgcctgtgcagtgaaac

SEQ ID NO: 129927 - DNA, 25 bp, Rattus norvegicus
agccgctttggcctagattgtagca

SEQ ID NO: 129928 - DNA, 25 bp, Rattus norvegicus
agccgctttggcgtagattgtagca

SEQ ID NO: 129929 - DNA, 25 bp, Rattus norvegicus
agccgctttttcatctggaacgtgt

SEQ ID NO: 129930 - DNA, 25 bp, Rattus norvegicus
agccgctttttcttctggaacgtgt

SEQ ID NO: 129931 - DNA, 25 bp, Rattus norvegicus
agccggaactaacgtgcgctactcc

SEQ ID NO: 129932 - DNA, 25 bp, Rattus norvegicus
agccggaactaaggtgcgctactcc

SEQ ID NO: 129933 - DNA, 25 bp, Rattus norvegicus
agccggaagcctccttgggtttgat

SEQ ID NO: 129934 - DNA, 25 bp, Rattus norvegicus
agccggaagcctgcttgggtttgat

SEQ ID NO: 129935 - DNA, 25 bp, Rattus norvegicus
agccggaccagacaccctttgcggg

SEQ ID NO: 129936 - DNA, 25 bp, Rattus norvegicus
agccggaccagagaccctttgcggg

SEQ ID NO: 129937 - DNA, 25 bp, Rattus norvegicus
agccggagcaagctgttgatcatct

SEQ ID NO: 129938 - DNA, 25 bp, Rattus norvegicus
agccggagcaaggtgttgatcatct

SEQ ID NO: 129939 - DNA, 25 bp, Rattus norvegicus
agccggatgcttcgtcccattgggc

SEQ ID NO: 129940 - DNA, 25 bp, Rattus norvegicus
agccggatgcttggtcccattgggc

SEQ ID NO: 129941 - DNA, 25 bp, Rattus norvegicus
agccggatttgaacaggtccagcct

SEQ ID NO: 129942 - DNA, 25 bp, Rattus norvegicus
agccggatttgatcaggtccagcct

SEQ ID NO: 129943 - DNA, 25 bp, Rattus norvegicus
agccggcaatctcttccaaagacag

SEQ ID NO: 129944 - DNA, 25 bp, Rattus norvegicus
agccggcaatctgttccaaagacag

SEQ ID NO: 129945 - DNA, 25 bp, Rattus norvegicus
agccggcattctaaccttttaagag

SEQ ID NO: 129946 - DNA, 25 bp, Rattus norvegicus
agccggcattcttaccttttaagag

SEQ ID NO: 129947 - DNA, 25 bp, Rattus norvegicus
agccggcccctcctgatggtgatga

SEQ ID NO: 129948 - DNA, 25 bp, Rattus norvegicus
agccggcccctcgtgatggtgatga

SEQ ID NO: 129949 - DNA, 25 bp, Rattus norvegicus
agccggcgtagtcacattctcctgt

SEQ ID NO: 129950 - DNA, 25 bp, Rattus norvegicus
agccggcgtagtgacattctcctgt

SEQ ID NO: 129951 - DNA, 25 bp, Rattus norvegicus
agccggctaagcaacctacagaaaa

SEQ ID NO: 129952 - DNA, 25 bp, Rattus norvegicus
agccggctaagctacctacagaaaa

SEQ ID NO: 129953 - DNA, 25 bp, Rattus norvegicus
agccggctattcattgttcttcaaa

SEQ ID NO: 129954 - DNA, 25 bp, Rattus norvegicus
agccggctattctttgttcttcaaa

SEQ ID NO: 129955 - DNA, 25 bp, Rattus norvegicus
agccggctgctgagtaatcccgggc

SEQ ID NO: 129956 - DNA, 25 bp, Rattus norvegicus
agccggctgctgtgtaatcccgggc

SEQ ID NO: 129957 - DNA, 25 bp, Rattus norvegicus
agccgggatgccaaaatggtgaaga

SEQ ID NO: 129958 - DNA, 25 bp, Rattus norvegicus
agccgggatgcctaaatggtgaaga

SEQ ID NO: 129959 - DNA, 25 bp, Rattus norvegicus
agccgggccctgagtaatcacttaa

SEQ ID NO: 129960 - DNA, 25 bp, Rattus norvegicus
agccgggccctgatgagaacatgtg

SEQ ID NO: 129961 - DNA, 25 bp, Rattus norvegicus
agccgggccctgtgtaatcacttaa

SEQ ID NO: 129962 - DNA, 25 bp, Rattus norvegicus
agccgggccctgttgagaacatgtg

SEQ ID NO: 129963 - DNA, 25 bp, Rattus norvegicus
agccgggcctggcactgagtaacac

SEQ ID NO: 129964 - DNA, 25 bp, Rattus norvegicus
agccgggcctgggactgagtaacac

SEQ ID NO: 129965 - DNA, 25 bp, Rattus norvegicus
agccgggcgctaagtcactgggcat

SEQ ID NO: 129966 - DNA, 25 bp, Rattus norvegicus
agccgggcgctatgtcactgggcat

SEQ ID NO: 129967 - DNA, 25 bp, Rattus norvegicus
agccgggcttcacatgggcagctct

SEQ ID NO: 129968 - DNA, 25 bp, Rattus norvegicus
agccgggcttcagatgggcagctct

SEQ ID NO: 129969 - DNA, 25 bp, Rattus norvegicus
agccgggcttctctcactttaaagt

SEQ ID NO: 129970 - DNA, 25 bp, Rattus norvegicus
agccgggcttctgtcactttaaagt

SEQ ID NO: 129971 - DNA, 25 bp, Rattus norvegicus
agccgggtcaaaatttagctgttga

SEQ ID NO: 129972 - DNA, 25 bp, Rattus norvegicus
agccgggtcaaattttagctgttga

SEQ ID NO: 129973 - DNA, 25 bp, Rattus norvegicus
agccgggtctgcacggcttaggctt

SEQ ID NO: 129974 - DNA, 25 bp, Rattus norvegicus
agccgggtctgctcggcttaggctt

SEQ ID NO: 129975 - DNA, 25 bp, Rattus norvegicus
agccgggtgctgctttctagtaaac

SEQ ID NO: 129976 - DNA, 25 bp, Rattus norvegicus
agccgggtgctggtttctagtaaac

SEQ ID NO: 129977 - DNA, 25 bp, Rattus norvegicus
agccgggtgtcaatttcctgaccaa

SEQ ID NO: 129978 - DNA, 25 bp, Rattus norvegicus
agccgggtgtcattttcctgaccaa

SEQ ID NO: 129979 - DNA, 25 bp, Rattus norvegicus
agccgggttctcatggtgctcaaac

SEQ ID NO: 129980 - DNA, 25 bp, Rattus norvegicus
agccgggttctcttggtgctcaaac

SEQ ID NO: 129981 - DNA, 25 bp, Rattus norvegicus
agccggtcaggtcctatgagctgct

SEQ ID NO: 129982 - DNA, 25 bp, Rattus norvegicus
agccggtcaggtgctatgagctgct

SEQ ID NO: 129983 - DNA, 25 bp, Rattus norvegicus
agccggtccctgagcaggagagcac

SEQ ID NO: 129984 - DNA, 25 bp, Rattus norvegicus
agccggtccctgtgcaggagagcac

SEQ ID NO: 129985 - DNA, 25 bp, Rattus norvegicus
agccggtcctgcagtataaacctgt

SEQ ID NO: 129986 - DNA, 25 bp, Rattus norvegicus
agccggtcctgctgtataaacctgt

SEQ ID NO: 129987 - DNA, 25 bp, Rattus norvegicus
agccggtcctgtcacttctgattag

SEQ ID NO: 129988 - DNA, 25 bp, Rattus norvegicus
agccggtcctgtgacttctgattag

SEQ ID NO: 129989 - DNA, 25 bp, Rattus norvegicus
agccggtcgaggaagattgacgcac

SEQ ID NO: 129990 - DNA, 25 bp, Rattus norvegicus
agccggtcgaggtagattgacgcac

SEQ ID NO: 129991 - DNA, 25 bp, Rattus norvegicus
agccggtggcaaagcagtcactcaa

SEQ ID NO: 129992 - DNA, 25 bp, Rattus norvegicus
agccggtggcaatgcagtcactcaa

SEQ ID NO: 129993 - DNA, 25 bp, Rattus norvegicus
agccggttccctacagtctgtttgt

SEQ ID NO: 129994 - DNA, 25 bp, Rattus norvegicus
agccggttcccttcagtctgtttgt

SEQ ID NO: 129995 - DNA, 25 bp, Rattus norvegicus
agccggtttgacagctgtgagaact

SEQ ID NO: 129996 - DNA, 25 bp, Rattus norvegicus
agccggtttgactgctgtgagaact

SEQ ID NO: 129997 - DNA, 25 bp, Rattus norvegicus
agccgtaagagaagcttttcctaat

SEQ ID NO: 129998 - DNA, 25 bp, Rattus norvegicus
agccgtaagagatgcttttcctaat

SEQ ID NO: 129999 - DNA, 25 bp, Rattus norvegicus
agccgtacagctctttctgtttgtg

SEQ ID NO: 130000 - DNA, 25 bp, Rattus norvegicus
agccgtacagctgtttctgtttgtg

SEQ ID NO: 130001 - DNA, 25 bp, Rattus norvegicus
agccgtacattgcaccttcagattt

SEQ ID NO: 130002 - DNA, 25 bp, Rattus norvegicus
agccgtacattggaccttcagattt

SEQ ID NO: 130003 - DNA, 25 bp, Rattus norvegicus
agccgtagtctgcattgatcatgcc

SEQ ID NO: 130004 - DNA, 25 bp, Rattus norvegicus
agccgtagtctggattgatcatgcc

SEQ ID NO: 130005 - DNA, 25 bp, Rattus norvegicus
agccgtattacaataccgagtaatg

SEQ ID NO: 130006 - DNA, 25 bp, Rattus norvegicus
agccgtattacattaccgagtaatg

SEQ ID NO: 130007 - DNA, 25 bp, Rattus norvegicus
agccgtattgaacggccactgcatt

SEQ ID NO: 130008 - DNA, 25 bp, Rattus norvegicus
agccgtattgaagggccactgcatt

SEQ ID NO: 130009 - DNA, 25 bp, Rattus norvegicus
agccgtcaaggcatgaaggtcagca

SEQ ID NO: 130010 - DNA, 25 bp, Rattus norvegicus
agccgtcaaggcttgaaggtcagca

SEQ ID NO: 130011 - DNA, 25 bp, Rattus norvegicus
agccgtcacaggctcttcgttggac

SEQ ID NO: 130012 - DNA, 25 bp, Rattus norvegicus
agccgtcacagggtcttcgttggac

SEQ ID NO: 130013 - DNA, 25 bp, Rattus norvegicus
agccgtcactatcctactgttgcaa

SEQ ID NO: 130014 - DNA, 25 bp, Rattus norvegicus
agccgtcactatgctactgttgcaa

SEQ ID NO: 130015 - DNA, 25 bp, Rattus norvegicus
agccgtcagtgccatccataagctg

SEQ ID NO: 130016 - DNA, 25 bp, Rattus norvegicus
agccgtcagtgcgatccataagctg

SEQ ID NO: 130017 - DNA, 25 bp, Rattus norvegicus
agccgtcatagcagcatttctgtat

SEQ ID NO: 130018 - DNA, 25 bp, Rattus norvegicus
agccgtcatagctgcatttctgtat

SEQ ID NO: 130019 - DNA, 25 bp, Rattus norvegicus
agccgtcatcttctgcagggcagat

SEQ ID NO: 130020 - DNA, 25 bp, Rattus norvegicus
agccgtcatcttgtgcagggcagat

SEQ ID NO: 130021 - DNA, 25 bp, Rattus norvegicus
agccgtcatgggagcgttcatcatc

SEQ ID NO: 130022 - DNA, 25 bp, Rattus norvegicus
agccgtcatgggtgcgttcatcatc

SEQ ID NO: 130023 - DNA, 25 bp, Rattus norvegicus
agccgtccatacctgggtgtagtca

SEQ ID NO: 130024 - DNA, 25 bp, Rattus norvegicus
agccgtccatacgtgggtgtagtca

SEQ ID NO: 130025 - DNA, 25 bp, Rattus norvegicus
agccgtccatttctttctgggcgat

SEQ ID NO: 130026 - DNA, 25 bp, Rattus norvegicus
agccgtccatttgtttctgggcgat

SEQ ID NO: 130027 - DNA, 25 bp, Rattus norvegicus
agccgtcctcacaacacagaagtag

SEQ ID NO: 130028 - DNA, 25 bp, Rattus norvegicus
agccgtcctcactacacagaagtag

SEQ ID NO: 130029 - DNA, 25 bp, Rattus norvegicus
agccgtcctctactcgtgctcggat

SEQ ID NO: 130030 - DNA, 25 bp, Rattus norvegicus
agccgtcctctagtcgtgctcggat

SEQ ID NO: 130031 - DNA, 25 bp, Rattus norvegicus
agccgtcctttgatctgttaccaag

SEQ ID NO: 130032 - DNA, 25 bp, Rattus norvegicus
agccgtcctttgttctgttaccaag

SEQ ID NO: 130033 - DNA, 25 bp, Rattus norvegicus
agccgtcgcttgagatgcccttcaa

SEQ ID NO: 130034 - DNA, 25 bp, Rattus norvegicus
agccgtcgcttgtgatgcccttcaa

SEQ ID NO: 130035 - DNA, 25 bp, Rattus norvegicus
agccgtctactcacagtaccaggta

SEQ ID NO: 130036 - DNA, 25 bp, Rattus norvegicus
agccgtctactctcagtaccaggta

SEQ ID NO: 130037 - DNA, 25 bp, Rattus norvegicus
agccgtctcacaagcaggacctgag

SEQ ID NO: 130038 - DNA, 25 bp, Rattus norvegicus
agccgtctcacatgcaggacctgag

SEQ ID NO: 130039 - DNA, 25 bp, Rattus norvegicus
agccgtctcatcagactaccagcag

SEQ ID NO: 130040 - DNA, 25 bp, Rattus norvegicus
agccgtctcatctgactaccagcag

SEQ ID NO: 130041 - DNA, 25 bp, Rattus norvegicus
agccgtctcggtcttgatggtccca

SEQ ID NO: 130042 - DNA, 25 bp, Rattus norvegicus
agccgtctcggtgttgatggtccca

SEQ ID NO: 130043 - DNA, 25 bp, Rattus norvegicus
agccgtctggctcaaattgagtaac

SEQ ID NO: 130044 - DNA, 25 bp, Rattus norvegicus
agccgtctggctctggtttattaga

SEQ ID NO: 130045 - DNA, 25 bp, Rattus norvegicus
agccgtctggctgaaattgagtaac

SEQ ID NO: 130046 - DNA, 25 bp, Rattus norvegicus
agccgtctggctgtggtttattaga

SEQ ID NO: 130047 - DNA, 25 bp, Rattus norvegicus
agccgtctgtccattgaatctcaat

SEQ ID NO: 130048 - DNA, 25 bp, Rattus norvegicus
agccgtctgtcctttgaatctcaat

SEQ ID NO: 130049 - DNA, 25 bp, Rattus norvegicus
agccgtcttcatccggttaggtata

SEQ ID NO: 130050 - DNA, 25 bp, Rattus norvegicus
agccgtcttcatgcggttaggtata

SEQ ID NO: 130051 - DNA, 25 bp, Rattus norvegicus
agccgtgaaggcatttctagaaaca

SEQ ID NO: 130052 - DNA, 25 bp, Rattus norvegicus
agccgtgaaggcttttctagaaaca

SEQ ID NO: 130053 - DNA, 25 bp, Rattus norvegicus
agccgtgaggtcaatcctgactaag

SEQ ID NO: 130054 - DNA, 25 bp, Rattus norvegicus
agccgtgaggtctatcctgactaag

SEQ ID NO: 130055 - DNA, 25 bp, Rattus norvegicus
agccgtgatactaaactgctttaat

SEQ ID NO: 130056 - DNA, 25 bp, Rattus norvegicus
agccgtgatacttaactgctttaat

SEQ ID NO: 130057 - DNA, 25 bp, Rattus norvegicus
agccgtgatcctccttttgagttca

SEQ ID NO: 130058 - DNA, 25 bp, Rattus norvegicus
agccgtgatcctgcttttgagttca

SEQ ID NO: 130059 - DNA, 25 bp, Rattus norvegicus
agccgtgatggaacagtcaggagca

SEQ ID NO: 130060 - DNA, 25 bp, Rattus norvegicus
agccgtgatggatcagtcaggagca

SEQ ID NO: 130061 - DNA, 25 bp, Rattus norvegicus
agccgtgccattcattatctcaagc

SEQ ID NO: 130062 - DNA, 25 bp, Rattus norvegicus
agccgtgccattgattatctcaagc

SEQ ID NO: 130063 - DNA, 25 bp, Rattus norvegicus
agccgtgcgcccctgaggagagtgc

SEQ ID NO: 130064 - DNA, 25 bp, Rattus norvegicus
agccgtgcgcccgtgaggagagtgc

SEQ ID NO: 130065 - DNA, 25 bp, Rattus norvegicus
agccgtgctattctgaaatgtcaca

SEQ ID NO: 130066 - DNA, 25 bp, Rattus norvegicus
agccgtgctattgtgaaatgtcaca

SEQ ID NO: 130067 - DNA, 25 bp, Rattus norvegicus
agccgtgctgtgaaagcctttgcaa

SEQ ID NO: 130068 - DNA, 25 bp, Rattus norvegicus
agccgtgctgtgctgactaaattca

SEQ ID NO: 130069 - DNA, 25 bp, Rattus norvegicus
agccgtgctgtggtgactaaattca

SEQ ID NO: 130070 - DNA, 25 bp, Rattus norvegicus
agccgtgctgtgtaagcctttgcaa

SEQ ID NO: 130071 - DNA, 25 bp, Rattus norvegicus
agccgtggacctcggccacaagaag

SEQ ID NO: 130072 - DNA, 25 bp, Rattus norvegicus
agccgtggacctgggccacaagaag

SEQ ID NO: 130073 - DNA, 25 bp, Rattus norvegicus
agccgtggactcagaccaaacctca

SEQ ID NO: 130074 - DNA, 25 bp, Rattus norvegicus
agccgtggactctgaccaaacctca

SEQ ID NO: 130075 - DNA, 25 bp, Rattus norvegicus
agccgtgtacagctttgacccagta

SEQ ID NO: 130076 - DNA, 25 bp, Rattus norvegicus
agccgtgtacaggtttgacccagta

SEQ ID NO: 130077 - DNA, 25 bp, Rattus norvegicus
agccgtgtactacctgttagggctg

SEQ ID NO: 130078 - DNA, 25 bp, Rattus norvegicus
agccgtgtactagctgttagggctg

SEQ ID NO: 130079 - DNA, 25 bp, Rattus norvegicus
agccgtgtatgtctaaccttgtgac

SEQ ID NO: 130080 - DNA, 25 bp, Rattus norvegicus
agccgtgtatgtgtaaccttgtgac

SEQ ID NO: 130081 - DNA, 25 bp, Rattus norvegicus
agccgtgtctctcgcccttgtaata

SEQ ID NO: 130082 - DNA, 25 bp, Rattus norvegicus
agccgtgtctctggcccttgtaata

SEQ ID NO: 130083 - DNA, 25 bp, Rattus norvegicus
agccgtgtctgcaaggtggtgattt

SEQ ID NO: 130084 - DNA, 25 bp, Rattus norvegicus
agccgtgtctgctaggtggtgattt

SEQ ID NO: 130085 - DNA, 25 bp, Rattus norvegicus
agccgtgtgtaacttctgtcagcca

SEQ ID NO: 130086 - DNA, 25 bp, Rattus norvegicus
agccgtgtgtaagttctgtcagcca

SEQ ID NO: 130087 - DNA, 25 bp, Rattus norvegicus
agccgtgttgcaactgtaatctcag

SEQ ID NO: 130088 - DNA, 25 bp, Rattus norvegicus
agccgtgttgcatctgtaatctcag

SEQ ID NO: 130089 - DNA, 25 bp, Rattus norvegicus
agccgttccgagatgcaaatgtctt

SEQ ID NO: 130090 - DNA, 25 bp, Rattus norvegicus
agccgttccgagttgcaaatgtctt

SEQ ID NO: 130091 - DNA, 25 bp, Rattus norvegicus
agccgttctctgatcgattggcaga

SEQ ID NO: 130092 - DNA, 25 bp, Rattus norvegicus
agccgttctctgttcgattggcaga

SEQ ID NO: 130093 - DNA, 25 bp, Rattus norvegicus
agccgttctggaagttcacacttga

SEQ ID NO: 130094 - DNA, 25 bp, Rattus norvegicus
agccgttctggatgttcacacttga

SEQ ID NO: 130095 - DNA, 25 bp, Rattus norvegicus
agccgttggcagattctgttacctc

SEQ ID NO: 130096 - DNA, 25 bp, Rattus norvegicus
agccgttggcagtttctgttacctc

SEQ ID NO: 130097 - DNA, 25 bp, Rattus norvegicus
agccgttgtgggactgctcaaattg

SEQ ID NO: 130098 - DNA, 25 bp, Rattus norvegicus
agccgttgtgggtctgctcaaattg

SEQ ID NO: 130099 - DNA, 25 bp, Rattus norvegicus
agccgtttgtatcatgttttctccc

SEQ ID NO: 130100 - DNA, 25 bp, Rattus norvegicus
agccgtttgtatgatgttttctccc

SEQ ID NO: 130101 - DNA, 25 bp, Rattus norvegicus
agccgttttaacatcagcggttatg

SEQ ID NO: 130102 - DNA, 25 bp, Rattus norvegicus
agccgttttaacttcagcggttatg

SEQ ID NO: 130103 - DNA, 25 bp, Rattus norvegicus
agccgttttatgaaactgaattatt

SEQ ID NO: 130104 - DNA, 25 bp, Rattus norvegicus
agccgttttatgtaactgaattatt

SEQ ID NO: 130105 - DNA, 25 bp, Rattus norvegicus
agcctaaagagacctatgtcccctt

SEQ ID NO: 130106 - DNA, 25 bp, Rattus norvegicus
agcctaaagagagctatgtcccctt

SEQ ID NO: 130107 - DNA, 25 bp, Rattus norvegicus
agcctaaaggttatgatctccattt

SEQ ID NO: 130108 - DNA, 25 bp, Rattus norvegicus
agcctaaaggttttgatctccattt

SEQ ID NO: 130109 - DNA, 25 bp, Rattus norvegicus
agcctaaccctcactataatcagaa

SEQ ID NO: 130110 - DNA, 25 bp, Rattus norvegicus
agcctaaccctctctataatcagaa

SEQ ID NO: 130111 - DNA, 25 bp, Rattus norvegicus
agcctaacctcaagctgctggcgat

SEQ ID NO: 130112 - DNA, 25 bp, Rattus norvegicus
agcctaacctcatgctgctggcgat

SEQ ID NO: 130113 - DNA, 25 bp, Rattus norvegicus
agcctaacggagagcttgatttcca

SEQ ID NO: 130114 - DNA, 25 bp, Rattus norvegicus
agcctaacggagtgcttgatttcca

SEQ ID NO: 130115 - DNA, 25 bp, Rattus norvegicus
agcctaaggtcgatcaacttggcgg

SEQ ID NO: 130116 - DNA, 25 bp, Rattus norvegicus
agcctaaggtcgttcaacttggcgg

SEQ ID NO: 130117 - DNA, 25 bp, Rattus norvegicus
agcctaatctggatcatctttcacc

SEQ ID NO: 130118 - DNA, 25 bp, Rattus norvegicus
agcctaatctggttcatctttcacc

SEQ ID NO: 130119 - DNA, 25 bp, Rattus norvegicus
agcctaattattaggccatggtatt

SEQ ID NO: 130120 - DNA, 25 bp, Rattus norvegicus
agcctaattatttggccatggtatt

SEQ ID NO: 130121 - DNA, 25 bp, Rattus norvegicus
agcctacaccagatagctgcatcat

SEQ ID NO: 130122 - DNA, 25 bp, Rattus norvegicus
agcctacaccagttagctgcatcat

SEQ ID NO: 130123 - DNA, 25 bp, Rattus norvegicus
agcctacatacaccctatacagaat

SEQ ID NO: 130124 - DNA, 25 bp, Rattus norvegicus
agcctacatacagcctatacagaat

SEQ ID NO: 130125 - DNA, 25 bp, Rattus norvegicus
agcctaccacgaccagctgtctgtg

SEQ ID NO: 130126 - DNA, 25 bp, Rattus norvegicus
agcctaccacgagcagctgtctgtg

SEQ ID NO: 130127 - DNA, 25 bp, Rattus norvegicus
agcctaccctcacctactaagtaga

SEQ ID NO: 130128 - DNA, 25 bp, Rattus norvegicus
agcctaccctcagctactaagtaga

SEQ ID NO: 130129 - DNA, 25 bp, Rattus norvegicus
agcctaccgcagcacaaggtgtctg

SEQ ID NO: 130130 - DNA, 25 bp, Rattus norvegicus
agcctaccgcaggacaaggtgtctg

SEQ ID NO: 130131 - DNA, 25 bp, Rattus norvegicus
agcctacctcccaacatggatagag

SEQ ID NO: 130132 - DNA, 25 bp, Rattus norvegicus
agcctacctccctacatggatagag

SEQ ID NO: 130133 - DNA, 25 bp, Rattus norvegicus
agcctacttctcagtgatttgggag

SEQ ID NO: 130134 - DNA, 25 bp, Rattus norvegicus
agcctacttctctgtgatttgggag

SEQ ID NO: 130135 - DNA, 25 bp, Rattus norvegicus
agcctacttggtatgaatgtctgaa

SEQ ID NO: 130136 - DNA, 25 bp, Rattus norvegicus
agcctacttggtttgaatgtctgaa

SEQ ID NO: 130137 - DNA, 25 bp, Rattus norvegicus
agcctagaatgtcctgttcttaccc

SEQ ID NO: 130138 - DNA, 25 bp, Rattus norvegicus
agcctagaatgtgctgttcttaccc

SEQ ID NO: 130139 - DNA, 25 bp, Rattus norvegicus
agcctagagacaccttggaatccca

SEQ ID NO: 130140 - DNA, 25 bp, Rattus norvegicus
agcctagagacagcttggaatccca

SEQ ID NO: 130141 - DNA, 25 bp, Rattus norvegicus
agcctagagcttacatcagaccatt

SEQ ID NO: 130142 - DNA, 25 bp, Rattus norvegicus
agcctagagctttcatcagaccatt

SEQ ID NO: 130143 - DNA, 25 bp, Rattus norvegicus
agcctagagttgacggtctggttct

SEQ ID NO: 130144 - DNA, 25 bp, Rattus norvegicus
agcctagagttgtcggtctggttct

SEQ ID NO: 130145 - DNA, 25 bp, Rattus norvegicus
agcctagccctgatgtatttgtatt

SEQ ID NO: 130146 - DNA, 25 bp, Rattus norvegicus
agcctagccctgttgtatttgtatt

SEQ ID NO: 130147 - DNA, 25 bp, Rattus norvegicus
agcctagccgtcagggcaagagccc

SEQ ID NO: 130148 - DNA, 25 bp, Rattus norvegicus
agcctagccgtctgggcaagagccc

SEQ ID NO: 130149 - DNA, 25 bp, Rattus norvegicus
agcctagcctgaaacttgcttacag

SEQ ID NO: 130150 - DNA, 25 bp, Rattus norvegicus
agcctagcctgatacttgcttacag

SEQ ID NO: 130151 - DNA, 25 bp, Rattus norvegicus
agcctagctcaaagctttctggaaa

SEQ ID NO: 130152 - DNA, 25 bp, Rattus norvegicus
agcctagctcaatgctttctggaaa

SEQ ID NO: 130153 - DNA, 25 bp, Rattus norvegicus
agcctagctcatatctacagaggat

SEQ ID NO: 130154 - DNA, 25 bp, Rattus norvegicus
agcctagctcatttctacagaggat

SEQ ID NO: 130155 - DNA, 25 bp, Rattus norvegicus
agcctagctgccagagtttgattac

SEQ ID NO: 130156 - DNA, 25 bp, Rattus norvegicus
agcctagctgcctgagtttgattac

SEQ ID NO: 130157 - DNA, 25 bp, Rattus norvegicus
agcctagctgctatcagagccagag

SEQ ID NO: 130158 - DNA, 25 bp, Rattus norvegicus
agcctagctgctttcagagccagag

SEQ ID NO: 130159 - DNA, 25 bp, Rattus norvegicus
agcctaggatagaccatgcagccaa

SEQ ID NO: 130160 - DNA, 25 bp, Rattus norvegicus
agcctaggatagtccatgcagccaa

SEQ ID NO: 130161 - DNA, 25 bp, Rattus norvegicus
agcctaggcagacatcagacgccaa

SEQ ID NO: 130162 - DNA, 25 bp, Rattus norvegicus
agcctaggcagagatcagacgccaa

SEQ ID NO: 130163 - DNA, 25 bp, Rattus norvegicus
agcctaggccacagagtaagtccca

SEQ ID NO: 130164 - DNA, 25 bp, Rattus norvegicus
agcctaggccactgagtaagtccca

SEQ ID NO: 130165 - DNA, 25 bp, Rattus norvegicus
agcctagggctactcttacatctgg

SEQ ID NO: 130166 - DNA, 25 bp, Rattus norvegicus
agcctagggctagtcttacatctgg

SEQ ID NO: 130167 - DNA, 25 bp, Rattus norvegicus
agcctagggtggattcctgcctata

SEQ ID NO: 130168 - DNA, 25 bp, Rattus norvegicus
agcctagggtggtttcctgcctata

SEQ ID NO: 130169 - DNA, 25 bp, Rattus norvegicus
agcctaggtgagcatcatgcctcga

SEQ ID NO: 130170 - DNA, 25 bp, Rattus norvegicus
agcctaggtgaggatcatgcctcga

SEQ ID NO: 130171 - DNA, 25 bp, Rattus norvegicus
agcctagtctacatagtgaatgtga

SEQ ID NO: 130172 - DNA, 25 bp, Rattus norvegicus
agcctagtctacttagtgaatgtga

SEQ ID NO: 130173 - DNA, 25 bp, Rattus norvegicus
agcctagtgatcctttgctaagaag

SEQ ID NO: 130174 - DNA, 25 bp, Rattus norvegicus
agcctagtgatcgtttgctaagaag

SEQ ID NO: 130175 - DNA, 25 bp, Rattus norvegicus
agcctagtggcacgtcccagtggac

SEQ ID NO: 130176 - DNA, 25 bp, Rattus norvegicus
agcctagtggcaggtcccagtggac

SEQ ID NO: 130177 - DNA, 25 bp, Rattus norvegicus
agcctagttattcgccatttttcct

SEQ ID NO: 130178 - DNA, 25 bp, Rattus norvegicus
agcctagttattggccatttttcct

SEQ ID NO: 130179 - DNA, 25 bp, Rattus norvegicus
agcctagttcatactggtgttccgc

SEQ ID NO: 130180 - DNA, 25 bp, Rattus norvegicus
agcctagttcattctggtgttccgc

SEQ ID NO: 130181 - DNA, 25 bp, Rattus norvegicus
agcctataggtgagtgtgctgcact

SEQ ID NO: 130182 - DNA, 25 bp, Rattus norvegicus
agcctataggtgtgtgtgctgcact

SEQ ID NO: 130183 - DNA, 25 bp, Rattus norvegicus
agcctatccactaggacagtgcgca

SEQ ID NO: 130184 - DNA, 25 bp, Rattus norvegicus
agcctatccacttggacagtgcgca

SEQ ID NO: 130185 - DNA, 25 bp, Rattus norvegicus
agcctatgaggcattcctgtagtga

SEQ ID NO: 130186 - DNA, 25 bp, Rattus norvegicus
agcctatgaggctttcctgtagtga

SEQ ID NO: 130187 - DNA, 25 bp, Rattus norvegicus
agcctatgcaaaacggactccttga

SEQ ID NO: 130188 - DNA, 25 bp, Rattus norvegicus
agcctatgcaaatcggactccttga

SEQ ID NO: 130189 - DNA, 25 bp, Rattus norvegicus
agcctatgccacattacctgtgagg

SEQ ID NO: 130190 - DNA, 25 bp, Rattus norvegicus
agcctatgccactttacctgtgagg

SEQ ID NO: 130191 - DNA, 25 bp, Rattus norvegicus
agcctatgccctcctaagggactgg

SEQ ID NO: 130192 - DNA, 25 bp, Rattus norvegicus
agcctatgccctcgtcttacaaggg

SEQ ID NO: 130193 - DNA, 25 bp, Rattus norvegicus
agcctatgccctgctaagggactgg

SEQ ID NO: 130194 - DNA, 25 bp, Rattus norvegicus
agcctatgccctggtcttacaaggg

SEQ ID NO: 130195 - DNA, 25 bp, Rattus norvegicus
agcctatgcctcacagatactgata

SEQ ID NO: 130196 - DNA, 25 bp, Rattus norvegicus
agcctatgcctctcagatactgata

SEQ ID NO: 130197 - DNA, 25 bp, Rattus norvegicus
agcctatgcgtgacaagttgttgga

SEQ ID NO: 130198 - DNA, 25 bp, Rattus norvegicus
agcctatgcgtgtcaagttgttgga

SEQ ID NO: 130199 - DNA, 25 bp, Rattus norvegicus
agcctatggatgaaccctctctata

SEQ ID NO: 130200 - DNA, 25 bp, Rattus norvegicus
agcctatggatgtaccctctctata

SEQ ID NO: 130201 - DNA, 25 bp, Rattus norvegicus
agcctatggcacaacctgcgcttgg

SEQ ID NO: 130202 - DNA, 25 bp, Rattus norvegicus
agcctatggcactacctgcgcttgg

SEQ ID NO: 130203 - DNA, 25 bp, Rattus norvegicus
agcctatggctacaagggactccca

SEQ ID NO: 130204 - DNA, 25 bp, Rattus norvegicus
agcctatggctagaagggactccca

SEQ ID NO: 130205 - DNA, 25 bp, Rattus norvegicus
agcctatgggtgctgatcgcctttc

SEQ ID NO: 130206 - DNA, 25 bp, Rattus norvegicus
agcctatgggtggtgatcgcctttc

SEQ ID NO: 130207 - DNA, 25 bp, Rattus norvegicus
agcctatgtgtcaatctttactttt

SEQ ID NO: 130208 - DNA, 25 bp, Rattus norvegicus
agcctatgtgtctatctttactttt

SEQ ID NO: 130209 - DNA, 25 bp, Rattus norvegicus
agcctattcattacctttggcagaa

SEQ ID NO: 130210 - DNA, 25 bp, Rattus norvegicus
agcctattcatttcctttggcagaa

SEQ ID NO: 130211 - DNA, 25 bp, Rattus norvegicus
agcctatttgctctgctcaaggata

SEQ ID NO: 130212 - DNA, 25 bp, Rattus norvegicus
agcctatttgctgtgctcaaggata

SEQ ID NO: 130213 - DNA, 25 bp, Rattus norvegicus
agcctcaaatgactcagcctgattt

SEQ ID NO: 130214 - DNA, 25 bp, Rattus norvegicus
agcctcaaatgagtcagcctgattt

SEQ ID NO: 130215 - DNA, 25 bp, Rattus norvegicus
agcctcaactcactgacactgctgt

SEQ ID NO: 130216 - DNA, 25 bp, Rattus norvegicus
agcctcaactcagtgacactgctgt

SEQ ID NO: 130217 - DNA, 25 bp, Rattus norvegicus
agcctcaacttcagggattgcacca

SEQ ID NO: 130218 - DNA, 25 bp, Rattus norvegicus
agcctcaacttctgggattgcacca

SEQ ID NO: 130219 - DNA, 25 bp, Rattus norvegicus
agcctcaattgtacttcctacagtg

SEQ ID NO: 130220 - DNA, 25 bp, Rattus norvegicus
agcctcaattgttcttcctacagtg

SEQ ID NO: 130221 - DNA, 25 bp, Rattus norvegicus
agcctcacacaacaactctgggcaa

SEQ ID NO: 130222 - DNA, 25 bp, Rattus norvegicus
agcctcacacaagaactctgggcaa

SEQ ID NO: 130223 - DNA, 25 bp, Rattus norvegicus
agcctcacacttatagtcatcaaca

SEQ ID NO: 130224 - DNA, 25 bp, Rattus norvegicus
agcctcacacttttagtcatcaaca

SEQ ID NO: 130225 - DNA, 25 bp, Rattus norvegicus
agcctcacatctaacttctggatga

SEQ ID NO: 130226 - DNA, 25 bp, Rattus norvegicus
agcctcacatcttacttctggatga

SEQ ID NO: 130227 - DNA, 25 bp, Rattus norvegicus
agcctcacattgctcagttgtcaca

SEQ ID NO: 130228 - DNA, 25 bp, Rattus norvegicus
agcctcacattggtcagttgtcaca

SEQ ID NO: 130229 - DNA, 25 bp, Rattus norvegicus
agcctcaccagtacagagcggagca

SEQ ID NO: 130230 - DNA, 25 bp, Rattus norvegicus
agcctcaccagttcagagcggagca

SEQ ID NO: 130231 - DNA, 25 bp, Rattus norvegicus
agcctcaccctgaatttgtgtggat

SEQ ID NO: 130232 - DNA, 25 bp, Rattus norvegicus
agcctcaccctgtatttgtgtggat

SEQ ID NO: 130233 - DNA, 25 bp, Rattus norvegicus
agcctcactcggagggatctggaac

SEQ ID NO: 130234 - DNA, 25 bp, Rattus norvegicus
agcctcactcggtgggatctggaac

SEQ ID NO: 130235 - DNA, 25 bp, Rattus norvegicus
agcctcactgcaaaagagtctgtcc

SEQ ID NO: 130236 - DNA, 25 bp, Rattus norvegicus
agcctcactgcataagagtctgtcc

SEQ ID NO: 130237 - DNA, 25 bp, Rattus norvegicus
agcctcactggtcacggcgagtcag

SEQ ID NO: 130238 - DNA, 25 bp, Rattus norvegicus
agcctcactggtgacggcgagtcag

SEQ ID NO: 130239 - DNA, 25 bp, Rattus norvegicus
agcctcagaagaccccggagcagag

SEQ ID NO: 130240 - DNA, 25 bp, Rattus norvegicus
agcctcagaagagcccggagcagag

SEQ ID NO: 130241 - DNA, 25 bp, Rattus norvegicus
agcctcagaccaaggaatgctggga

SEQ ID NO: 130242 - DNA, 25 bp, Rattus norvegicus
agcctcagaccatggaatgctggga

SEQ ID NO: 130243 - DNA, 25 bp, Rattus norvegicus
agcctcagagccctattatgttatg

SEQ ID NO: 130244 - DNA, 25 bp, Rattus norvegicus
agcctcagagccgtattatgttatg

SEQ ID NO: 130245 - DNA, 25 bp, Rattus norvegicus
agcctcagatgactcaatgacccag

SEQ ID NO: 130246 - DNA, 25 bp, Rattus norvegicus
agcctcagatgagtcaatgacccag

SEQ ID NO: 130247 - DNA, 25 bp, Rattus norvegicus
agcctcagatgtcgtttcctgtttt

SEQ ID NO: 130248 - DNA, 25 bp, Rattus norvegicus
agcctcagatgtggtttcctgtttt

SEQ ID NO: 130249 - DNA, 25 bp, Rattus norvegicus
agcctcagcctaccacacaaagtgg

SEQ ID NO: 130250 - DNA, 25 bp, Rattus norvegicus
agcctcagcctagcacacaaagtgg

SEQ ID NO: 130251 - DNA, 25 bp, Rattus norvegicus
agcctcagccttctctcatgtttta

SEQ ID NO: 130252 - DNA, 25 bp, Rattus norvegicus
agcctcagccttgtctcatgtttta

SEQ ID NO: 130253 - DNA, 25 bp, Rattus norvegicus
agcctcagctatacagttttggttt

SEQ ID NO: 130254 - DNA, 25 bp, Rattus norvegicus
agcctcagctattcagttttggttt

SEQ ID NO: 130255 - DNA, 25 bp, Rattus norvegicus
agcctcagctctctccagtggaagg

SEQ ID NO: 130256 - DNA, 25 bp, Rattus norvegicus
agcctcagctctgtccagtggaagg

SEQ ID NO: 130257 - DNA, 25 bp, Rattus norvegicus
agcctcagctgtaggcatgaaaccc

SEQ ID NO: 130258 - DNA, 25 bp, Rattus norvegicus
agcctcagctgttggcatgaaaccc

SEQ ID NO: 130259 - DNA, 25 bp, Rattus norvegicus
agcctcaggaacaccatcaacagat

SEQ ID NO: 130260 - DNA, 25 bp, Rattus norvegicus
agcctcaggaactccatcaacagat

SEQ ID NO: 130261 - DNA, 25 bp, Rattus norvegicus
agcctcaggaccagcatcagtagct

SEQ ID NO: 130262 - DNA, 25 bp, Rattus norvegicus
agcctcaggacctgcatcagtagct

SEQ ID NO: 130263 - DNA, 25 bp, Rattus norvegicus
agcctcaggccaacttcaaggttaa

SEQ ID NO: 130264 - DNA, 25 bp, Rattus norvegicus
agcctcaggccatcttcaaggttaa

SEQ ID NO: 130265 - DNA, 25 bp, Rattus norvegicus
agcctcaggcccaggacagctagtg

SEQ ID NO: 130266 - DNA, 25 bp, Rattus norvegicus
agcctcaggccctggacagctagtg

SEQ ID NO: 130267 - DNA, 25 bp, Rattus norvegicus
agcctcaggtgtagtgaagtcgtcc

SEQ ID NO: 130268 - DNA, 25 bp, Rattus norvegicus
agcctcaggtgttgtgaagtcgtcc

SEQ ID NO: 130269 - DNA, 25 bp, Rattus norvegicus
agcctcagtgatagtctgatcccag

SEQ ID NO: 130270 - DNA, 25 bp, Rattus norvegicus
agcctcagtgattgtctgatcccag

SEQ ID NO: 130271 - DNA, 25 bp, Rattus norvegicus
agcctcagtgcccagcctggaaatg

SEQ ID NO: 130272 - DNA, 25 bp, Rattus norvegicus
agcctcagtgccgagcctggaaatg

SEQ ID NO: 130273 - DNA, 25 bp, Rattus norvegicus
agcctcagtttacccacaaaatcga

SEQ ID NO: 130274 - DNA, 25 bp, Rattus norvegicus
agcctcagtttagccacaaaatcga

SEQ ID NO: 130275 - DNA, 25 bp, Rattus norvegicus
agcctcataaaacggtccgcgtcat

SEQ ID NO: 130276 - DNA, 25 bp, Rattus norvegicus
agcctcataaaagggtccgcgtcat

SEQ ID NO: 130277 - DNA, 25 bp, Rattus norvegicus
agcctcatccagatttctctgttgt

SEQ ID NO: 130278 - DNA, 25 bp, Rattus norvegicus
agcctcatccagttttctctgttgt

SEQ ID NO: 130279 - DNA, 25 bp, Rattus norvegicus
agcctcatctacagtgagttctagg

SEQ ID NO: 130280 - DNA, 25 bp, Rattus norvegicus
agcctcatctactgtgagttctagg

SEQ ID NO: 130281 - DNA, 25 bp, Rattus norvegicus
agcctcatctcacaagacttctcag

SEQ ID NO: 130282 - DNA, 25 bp, Rattus norvegicus
agcctcatctcagaagacttctcag

SEQ ID NO: 130283 - DNA, 25 bp, Rattus norvegicus
agcctcatcttaaaaagccccattt

SEQ ID NO: 130284 - DNA, 25 bp, Rattus norvegicus
agcctcatcttataaagccccattt

SEQ ID NO: 130285 - DNA, 25 bp, Rattus norvegicus
agcctcatgaagctttggtgacccc

SEQ ID NO: 130286 - DNA, 25 bp, Rattus norvegicus
agcctcatgaaggtttggtgacccc

SEQ ID NO: 130287 - DNA, 25 bp, Rattus norvegicus
agcctcatgcatcgacagacctgga

SEQ ID NO: 130288 - DNA, 25 bp, Rattus norvegicus
agcctcatgcatggacagacctgga

SEQ ID NO: 130289 - DNA, 25 bp, Rattus norvegicus
agcctcatgtccacagtgtttaaga

SEQ ID NO: 130290 - DNA, 25 bp, Rattus norvegicus
agcctcatgtcctcagtgtttaaga

SEQ ID NO: 130291 - DNA, 25 bp, Rattus norvegicus
agcctcattgacctagctgctgagt

SEQ ID NO: 130292 - DNA, 25 bp, Rattus norvegicus
agcctcattgacgtagctgctgagt

SEQ ID NO: 130293 - DNA, 25 bp, Rattus norvegicus
agcctcattgcacccaaaccaaaag

SEQ ID NO: 130294 - DNA, 25 bp, Rattus norvegicus
agcctcattgcagccaaaccaaaag

SEQ ID NO: 130295 - DNA, 25 bp, Rattus norvegicus
agcctcattggccagctagtttata

SEQ ID NO: 130296 - DNA, 25 bp, Rattus norvegicus
agcctcattggcgagctagtttata

SEQ ID NO: 130297 - DNA, 25 bp, Rattus norvegicus
agcctcattttgctagccatggcca

SEQ ID NO: 130298 - DNA, 25 bp, Rattus norvegicus
agcctcattttggtagccatggcca

SEQ ID NO: 130299 - DNA, 25 bp, Rattus norvegicus
agcctccaaagacagcgccaaagtg

SEQ ID NO: 130300 - DNA, 25 bp, Rattus norvegicus
agcctccaaagagagcgccaaagtg

SEQ ID NO: 130301 - DNA, 25 bp, Rattus norvegicus
agcctccaacatcgtgattgctgat

SEQ ID NO: 130302 - DNA, 25 bp, Rattus norvegicus
agcctccaacatggtgattgctgat

SEQ ID NO: 130303 - DNA, 25 bp, Rattus norvegicus
agcctccacatgactgatctttaat

SEQ ID NO: 130304 - DNA, 25 bp, Rattus norvegicus
agcctccacatgtctgatctttaat

SEQ ID NO: 130305 - DNA, 25 bp, Rattus norvegicus
agcctccaccatatttgcactaaga

SEQ ID NO: 130306 - DNA, 25 bp, Rattus norvegicus
agcctccaccatttttgcactaaga

SEQ ID NO: 130307 - DNA, 25 bp, Rattus norvegicus
agcctccacctgaggtcttttggga

SEQ ID NO: 130308 - DNA, 25 bp, Rattus norvegicus
agcctccacctgtggtcttttggga

SEQ ID NO: 130309 - DNA, 25 bp, Rattus norvegicus
agcctccagatcaaactcaatgcga

SEQ ID NO: 130310 - DNA, 25 bp, Rattus norvegicus
agcctccagatctaactcaatgcga

SEQ ID NO: 130311 - DNA, 25 bp, Rattus norvegicus
agcctccagggcagcactggagagc

SEQ ID NO: 130312 - DNA, 25 bp, Rattus norvegicus
agcctccagggctgcactggagagc

SEQ ID NO: 130313 - DNA, 25 bp, Rattus norvegicus
agcctccagttcactatttctaata

SEQ ID NO: 130314 - DNA, 25 bp, Rattus norvegicus
agcctccagttctctatttctaata

SEQ ID NO: 130315 - DNA, 25 bp, Rattus norvegicus
agcctccatacactagctggcagat

SEQ ID NO: 130316 - DNA, 25 bp, Rattus norvegicus
agcctccatacagtagctggcagat

SEQ ID NO: 130317 - DNA, 25 bp, Rattus norvegicus
agcctccatcacagacaatctgctg

SEQ ID NO: 130318 - DNA, 25 bp, Rattus norvegicus
agcctccatcaccagacatattctt

SEQ ID NO: 130319 - DNA, 25 bp, Rattus norvegicus
agcctccatcacgagacatattctt

SEQ ID NO: 130320 - DNA, 25 bp, Rattus norvegicus
agcctccatcactgacaatctgctg

SEQ ID NO: 130321 - DNA, 25 bp, Rattus norvegicus
agcctccatttaaagcatgttggcg

SEQ ID NO: 130322 - DNA, 25 bp, Rattus norvegicus
agcctccatttatagcatgttggcg

SEQ ID NO: 130323 - DNA, 25 bp, Rattus norvegicus
agcctcccaagtaacggtgtcacca

SEQ ID NO: 130324 - DNA, 25 bp, Rattus norvegicus
agcctcccaagttacggtgtcacca

SEQ ID NO: 130325 - DNA, 25 bp, Rattus norvegicus
agcctcccaattcctgagatggccg

SEQ ID NO: 130326 - DNA, 25 bp, Rattus norvegicus
agcctcccaattgctgagatggccg

SEQ ID NO: 130327 - DNA, 25 bp, Rattus norvegicus
agcctcccatttcggtacactgtga

SEQ ID NO: 130328 - DNA, 25 bp, Rattus norvegicus
agcctcccatttgggtacactgtga

SEQ ID NO: 130329 - DNA, 25 bp, Rattus norvegicus
agcctccccagaacatgcagaaact

SEQ ID NO: 130330 - DNA, 25 bp, Rattus norvegicus
agcctccccagatcatgcagaaact

SEQ ID NO: 130331 - DNA, 25 bp, Rattus norvegicus
agcctcccctgtagtgctaggtgtg

SEQ ID NO: 130332 - DNA, 25 bp, Rattus norvegicus
agcctcccctgttgtgctaggtgtg

SEQ ID NO: 130333 - DNA, 25 bp, Rattus norvegicus
agcctcccggagacattgaattcga

SEQ ID NO: 130334 - DNA, 25 bp, Rattus norvegicus
agcctcccggagtcattgaattcga

SEQ ID NO: 130335 - DNA, 25 bp, Rattus norvegicus
agcctcccggctactgcgttggtgc

SEQ ID NO: 130336 - DNA, 25 bp, Rattus norvegicus
agcctcccggcttctgcgttggtgc

SEQ ID NO: 130337 - DNA, 25 bp, Rattus norvegicus
agcctccctcctctgtagatgtgtg

SEQ ID NO: 130338 - DNA, 25 bp, Rattus norvegicus
agcctccctcctgtgtagatgtgtg

SEQ ID NO: 130339 - DNA, 25 bp, Rattus norvegicus
agcctccctctaatgagactcttgg

SEQ ID NO: 130340 - DNA, 25 bp, Rattus norvegicus
agcctccctctattgagactcttgg

SEQ ID NO: 130341 - DNA, 25 bp, Rattus norvegicus
agcctcccttatcaccatttgatca

SEQ ID NO: 130342 - DNA, 25 bp, Rattus norvegicus
agcctcccttatgaccatttgatca

SEQ ID NO: 130343 - DNA, 25 bp, Rattus norvegicus
agcctccgactaaactgagactgca

SEQ ID NO: 130344 - DNA, 25 bp, Rattus norvegicus
agcctccgactatactgagactgca

SEQ ID NO: 130345 - DNA, 25 bp, Rattus norvegicus
agcctccgactcatgtgttgtattt

SEQ ID NO: 130346 - DNA, 25 bp, Rattus norvegicus
agcctccgactcttgtgttgtattt

SEQ ID NO: 130347 - DNA, 25 bp, Rattus norvegicus
agcctccgaggcagagagctctaaa

SEQ ID NO: 130348 - DNA, 25 bp, Rattus norvegicus
agcctccgaggctgagagctctaaa

SEQ ID NO: 130349 - DNA, 25 bp, Rattus norvegicus
agcctccggagcacagaaccaaaag

SEQ ID NO: 130350 - DNA, 25 bp, Rattus norvegicus
agcctccggagctcagaaccaaaag

SEQ ID NO: 130351 - DNA, 25 bp, Rattus norvegicus
agcctccggcagatcttcaaagagc

SEQ ID NO: 130352 - DNA, 25 bp, Rattus norvegicus
agcctccggcagttcttcaaagagc

SEQ ID NO: 130353 - DNA, 25 bp, Rattus norvegicus
agcctccggtacagtgctagttata

SEQ ID NO: 130354 - DNA, 25 bp, Rattus norvegicus
agcctccggtactgtgctagttata

SEQ ID NO: 130355 - DNA, 25 bp, Rattus norvegicus
agcctccgtatccttcagtggaagg

SEQ ID NO: 130356 - DNA, 25 bp, Rattus norvegicus
agcctccgtatcgttcagtggaagg

SEQ ID NO: 130357 - DNA, 25 bp, Rattus norvegicus
agcctccgtcttccatggataccag

SEQ ID NO: 130358 - DNA, 25 bp, Rattus norvegicus
agcctccgtcttgcatggataccag

SEQ ID NO: 130359 - DNA, 25 bp, Rattus norvegicus
agcctccgtttaagtagcatcactt

SEQ ID NO: 130360 - DNA, 25 bp, Rattus norvegicus
agcctccgtttatgtagcatcactt

SEQ ID NO: 130361 - DNA, 25 bp, Rattus norvegicus
agcctcctaacgctgaactcttgtt

SEQ ID NO: 130362 - DNA, 25 bp, Rattus norvegicus
agcctcctaacggtgaactcttgtt

SEQ ID NO: 130363 - DNA, 25 bp, Rattus norvegicus
agcctcctacccaggtgaagaccaa

SEQ ID NO: 130364 - DNA, 25 bp, Rattus norvegicus
agcctcctaccctggtgaagaccaa

SEQ ID NO: 130365 - DNA, 25 bp, Rattus norvegicus
agcctcctcatgagttcttttatga

SEQ ID NO: 130366 - DNA, 25 bp, Rattus norvegicus
agcctcctcatgtgttcttttatga

SEQ ID NO: 130367 - DNA, 25 bp, Rattus norvegicus
agcctcctcggccttggacatcgtg

SEQ ID NO: 130368 - DNA, 25 bp, Rattus norvegicus
agcctcctcggcgttggacatcgtg

SEQ ID NO: 130369 - DNA, 25 bp, Rattus norvegicus
agcctcctctacagtggagtccaga

SEQ ID NO: 130370 - DNA, 25 bp, Rattus norvegicus
agcctcctctactgtggagtccaga

SEQ ID NO: 130371 - DNA, 25 bp, Rattus norvegicus
agcctcctgactcacttcagtgaac

SEQ ID NO: 130372 - DNA, 25 bp, Rattus norvegicus
agcctcctgactgacttcagtgaac

SEQ ID NO: 130373 - DNA, 25 bp, Rattus norvegicus
agcctcctgccaagcatgtaagtgg

SEQ ID NO: 130374 - DNA, 25 bp, Rattus norvegicus
agcctcctgccatgcatgtaagtgg

SEQ ID NO: 130375 - DNA, 25 bp, Rattus norvegicus
agcctcctgtgcagtggcttcaggc

SEQ ID NO: 130376 - DNA, 25 bp, Rattus norvegicus
agcctcctgtgccagaatcagtcag

SEQ ID NO: 130377 - DNA, 25 bp, Rattus norvegicus
agcctcctgtgcgagaatcagtcag

SEQ ID NO: 130378 - DNA, 25 bp, Rattus norvegicus
agcctcctgtgctgtggcttcaggc

SEQ ID NO: 130379 - DNA, 25 bp, Rattus norvegicus
agcctcctgttcacagacataggtc

SEQ ID NO: 130380 - DNA, 25 bp, Rattus norvegicus
agcctcctgttctcagacataggtc

SEQ ID NO: 130381 - DNA, 25 bp, Rattus norvegicus
agcctccttatcagtgtcttcatga

SEQ ID NO: 130382 - DNA, 25 bp, Rattus norvegicus
agcctccttatccagggtcaaagct

SEQ ID NO: 130383 - DNA, 25 bp, Rattus norvegicus
agcctccttatcgagggtcaaagct

SEQ ID NO: 130384 - DNA, 25 bp, Rattus norvegicus
agcctccttatctgtgtcttcatga

SEQ ID NO: 130385 - DNA, 25 bp, Rattus norvegicus
agcctccttggcaactgcagaagta

SEQ ID NO: 130386 - DNA, 25 bp, Rattus norvegicus
agcctccttggctactgcagaagta

SEQ ID NO: 130387 - DNA, 25 bp, Rattus norvegicus
agcctcctttacctcatttgtgatt

SEQ ID NO: 130388 - DNA, 25 bp, Rattus norvegicus
agcctcctttacgtcatttgtgatt

SEQ ID NO: 130389 - DNA, 25 bp, Rattus norvegicus
agcctcctttgccaagtgctttaag

SEQ ID NO: 130390 - DNA, 25 bp, Rattus norvegicus
agcctcctttgcgaagtgctttaag

SEQ ID NO: 130391 - DNA, 25 bp, Rattus norvegicus
agcctcgacagaacctgacttttga

SEQ ID NO: 130392 - DNA, 25 bp, Rattus norvegicus
agcctcgacagatcctgacttttga

SEQ ID NO: 130393 - DNA, 25 bp, Rattus norvegicus
agcctcgagaggactgattcaccat

SEQ ID NO: 130394 - DNA, 25 bp, Rattus norvegicus
agcctcgagaggtctgattcaccat

SEQ ID NO: 130395 - DNA, 25 bp, Rattus norvegicus
agcctcgagtttcagttctgttcct

SEQ ID NO: 130396 - DNA, 25 bp, Rattus norvegicus
agcctcgagtttgagttctgttcct

SEQ ID NO: 130397 - DNA, 25 bp, Rattus norvegicus
agcctcgcaattatgtacttagtca

SEQ ID NO: 130398 - DNA, 25 bp, Rattus norvegicus
agcctcgcaattttgtacttagtca

SEQ ID NO: 130399 - DNA, 25 bp, Rattus norvegicus
agcctcgccagcagtgtgtggtgca

SEQ ID NO: 130400 - DNA, 25 bp, Rattus norvegicus
agcctcgccagctgtgtgtggtgca

SEQ ID NO: 130401 - DNA, 25 bp, Rattus norvegicus
agcctcgcctttctaaagctgctaa

SEQ ID NO: 130402 - DNA, 25 bp, Rattus norvegicus
agcctcgcctttgtaaagctgctaa

SEQ ID NO: 130403 - DNA, 25 bp, Rattus norvegicus
agcctcgctaagacctggaattctt

SEQ ID NO: 130404 - DNA, 25 bp, Rattus norvegicus
agcctcgctaagtcctggaattctt

SEQ ID NO: 130405 - DNA, 25 bp, Rattus norvegicus
agcctcggcagcattttcagactga

SEQ ID NO: 130406 - DNA, 25 bp, Rattus norvegicus
agcctcggcagctttttcagactga

SEQ ID NO: 130407 - DNA, 25 bp, Rattus norvegicus
agcctcggcttacctggagtttgag

SEQ ID NO: 130408 - DNA, 25 bp, Rattus norvegicus
agcctcggcttagctggagtttgag

SEQ ID NO: 130409 - DNA, 25 bp, Rattus norvegicus
agcctcgggcataccatgtggtata

SEQ ID NO: 130410 - DNA, 25 bp, Rattus norvegicus
agcctcgggcattccatgtggtata

SEQ ID NO: 130411 - DNA, 25 bp, Rattus norvegicus
agcctcgggcttaacactatcaatg

SEQ ID NO: 130412 - DNA, 25 bp, Rattus norvegicus
agcctcgggctttacactatcaatg

SEQ ID NO: 130413 - DNA, 25 bp, Rattus norvegicus
agcctcgggtttcgttctgtgattt

SEQ ID NO: 130414 - DNA, 25 bp, Rattus norvegicus
agcctcgggtttggttctgtgattt

SEQ ID NO: 130415 - DNA, 25 bp, Rattus norvegicus
agcctcggtcacctgtgtatctgaa

SEQ ID NO: 130416 - DNA, 25 bp, Rattus norvegicus
agcctcggtcacgtgtgtatctgaa

SEQ ID NO: 130417 - DNA, 25 bp, Rattus norvegicus
agcctcggtgctcaagtgtgctgaa

SEQ ID NO: 130418 - DNA, 25 bp, Rattus norvegicus
agcctcggtgctgaagtgtgctgaa

SEQ ID NO: 130419 - DNA, 25 bp, Rattus norvegicus
agcctcgtgaacacctgtggaactg

SEQ ID NO: 130420 - DNA, 25 bp, Rattus norvegicus
agcctcgtgaactcctgtggaactg

SEQ ID NO: 130421 - DNA, 25 bp, Rattus norvegicus
agcctcgtgctcatgagtcagtggg

SEQ ID NO: 130422 - DNA, 25 bp, Rattus norvegicus
agcctcgtgctcttgagtcagtggg

SEQ ID NO: 130423 - DNA, 25 bp, Rattus norvegicus
agcctcgttgagatcttagcaccca

SEQ ID NO: 130424 - DNA, 25 bp, Rattus norvegicus
agcctcgttgagttcttagcaccca

SEQ ID NO: 130425 - DNA, 25 bp, Rattus norvegicus
agcctcgttggtctacatagctgag

SEQ ID NO: 130426 - DNA, 25 bp, Rattus norvegicus
agcctcgttggtgtacatagctgag

SEQ ID NO: 130427 - DNA, 25 bp, Rattus norvegicus
agcctctaaaggaaatgccagcccc

SEQ ID NO: 130428 - DNA, 25 bp, Rattus norvegicus
agcctctaaaggtaatgccagcccc

SEQ ID NO: 130429 - DNA, 25 bp, Rattus norvegicus
agcctctaagagcagtgccattaaa

SEQ ID NO: 130430 - DNA, 25 bp, Rattus norvegicus
agcctctaagaggagtgccattaaa

SEQ ID NO: 130431 - DNA, 25 bp, Rattus norvegicus
agcctctaagcgagctgacatcaga

SEQ ID NO: 130432 - DNA, 25 bp, Rattus norvegicus
agcctctaagcgtgctgacatcaga

SEQ ID NO: 130433 - DNA, 25 bp, Rattus norvegicus
agcctctaccttagtgtcatacaca

SEQ ID NO: 130434 - DNA, 25 bp, Rattus norvegicus
agcctctacctttgtgtcatacaca

SEQ ID NO: 130435 - DNA, 25 bp, Rattus norvegicus
agcctctcaagtctctgggatccat

SEQ ID NO: 130436 - DNA, 25 bp, Rattus norvegicus
agcctctcaagtgtctgggatccat

SEQ ID NO: 130437 - DNA, 25 bp, Rattus norvegicus
agcctctcacacacccaagatggtg

SEQ ID NO: 130438 - DNA, 25 bp, Rattus norvegicus
agcctctcacactcccaagatggtg

SEQ ID NO: 130439 - DNA, 25 bp, Rattus norvegicus
agcctctcacctattagtgattcct

SEQ ID NO: 130440 - DNA, 25 bp, Rattus norvegicus
agcctctcaccttttagtgattcct

SEQ ID NO: 130441 - DNA, 25 bp, Rattus norvegicus
agcctctcacgtaacttcagaaggg

SEQ ID NO: 130442 - DNA, 25 bp, Rattus norvegicus
agcctctcacgttacttcagaaggg

SEQ ID NO: 130443 - DNA, 25 bp, Rattus norvegicus
agcctctcactgatgtgtcaaagct

SEQ ID NO: 130444 - DNA, 25 bp, Rattus norvegicus
agcctctcactgttgtgtcaaagct

SEQ ID NO: 130445 - DNA, 25 bp, Rattus norvegicus
agcctctcagatccggagctccaaa

SEQ ID NO: 130446 - DNA, 25 bp, Rattus norvegicus
agcctctcagatgcggagctccaaa

SEQ ID NO: 130447 - DNA, 25 bp, Rattus norvegicus
agcctctcagttaccaaacagtttc

SEQ ID NO: 130448 - DNA, 25 bp, Rattus norvegicus
agcctctcagtttccaaacagtttc

SEQ ID NO: 130449 - DNA, 25 bp, Rattus norvegicus
agcctctcatctactaagcttgata

SEQ ID NO: 130450 - DNA, 25 bp, Rattus norvegicus
agcctctcatcttctaagcttgata

SEQ ID NO: 130451 - DNA, 25 bp, Rattus norvegicus
agcctctccatcaagtataaaacag

SEQ ID NO: 130452 - DNA, 25 bp, Rattus norvegicus
agcctctccatctagtataaaacag

SEQ ID NO: 130453 - DNA, 25 bp, Rattus norvegicus
agcctctccgagacgcaggtgaagg

SEQ ID NO: 130454 - DNA, 25 bp, Rattus norvegicus
agcctctccgagtcgcaggtgaagg

SEQ ID NO: 130455 - DNA, 25 bp, Rattus norvegicus
agcctctccgtcattgtaagttgat

SEQ ID NO: 130456 - DNA, 25 bp, Rattus norvegicus
agcctctccgtctttgtaagttgat

SEQ ID NO: 130457 - DNA, 25 bp, Rattus norvegicus
agcctctccttgacctggattatag

SEQ ID NO: 130458 - DNA, 25 bp, Rattus norvegicus
agcctctccttgtcctggattatag

SEQ ID NO: 130459 - DNA, 25 bp, Rattus norvegicus
agcctctcgggcaaagccaagcaga

SEQ ID NO: 130460 - DNA, 25 bp, Rattus norvegicus
agcctctcgggctaagccaagcaga

SEQ ID NO: 130461 - DNA, 25 bp, Rattus norvegicus
agcctctcggttacctctggataga

SEQ ID NO: 130462 - DNA, 25 bp, Rattus norvegicus
agcctctcggtttcctctggataga

SEQ ID NO: 130463 - DNA, 25 bp, Rattus norvegicus
agcctctcgttgctcctaagtaggg

SEQ ID NO: 130464 - DNA, 25 bp, Rattus norvegicus
agcctctcgttggtcctaagtaggg

SEQ ID NO: 130465 - DNA, 25 bp, Rattus norvegicus
agcctctctcccatcataaattgaa

SEQ ID NO: 130466 - DNA, 25 bp, Rattus norvegicus
agcctctctcccttcataaattgaa

SEQ ID NO: 130467 - DNA, 25 bp, Rattus norvegicus
agcctctctctgcagtatgttggat

SEQ ID NO: 130468 - DNA, 25 bp, Rattus norvegicus
agcctctctctggagtatgttggat

SEQ ID NO: 130469 - DNA, 25 bp, Rattus norvegicus
agcctctctgagatgattgcaccag

SEQ ID NO: 130470 - DNA, 25 bp, Rattus norvegicus
agcctctctgagttgattgcaccag

SEQ ID NO: 130471 - DNA, 25 bp, Rattus norvegicus
agcctctcttctcggaacacttgga

SEQ ID NO: 130472 - DNA, 25 bp, Rattus norvegicus
agcctctcttctgggaacacttgga

SEQ ID NO: 130473 - DNA, 25 bp, Rattus norvegicus
agcctctgaagacagcgcccagtgg

SEQ ID NO: 130474 - DNA, 25 bp, Rattus norvegicus
agcctctgaagagagcgcccagtgg

SEQ ID NO: 130475 - DNA, 25 bp, Rattus norvegicus
agcctctgacggagtttcagtgtct

SEQ ID NO: 130476 - DNA, 25 bp, Rattus norvegicus
agcctctgacggtgtttcagtgtct

SEQ ID NO: 130477 - DNA, 25 bp, Rattus norvegicus
agcctctgacttagctgactcagaa

SEQ ID NO: 130478 - DNA, 25 bp, Rattus norvegicus
agcctctgactttgctgactcagaa

SEQ ID NO: 130479 - DNA, 25 bp, Rattus norvegicus
agcctctgatacaataaccctgtag

SEQ ID NO: 130480 - DNA, 25 bp, Rattus norvegicus
agcctctgatactataaccctgtag

SEQ ID NO: 130481 - DNA, 25 bp, Rattus norvegicus
agcctctgatctccctagtgtaaac

SEQ ID NO: 130482 - DNA, 25 bp, Rattus norvegicus
agcctctgatctgcctagtgtaaac

SEQ ID NO: 130483 - DNA, 25 bp, Rattus norvegicus
agcctctgcaggcttcagacatgtt

SEQ ID NO: 130484 - DNA, 25 bp, Rattus norvegicus
agcctctgcagggttcagacatgtt

SEQ ID NO: 130485 - DNA, 25 bp, Rattus norvegicus
agcctctgcagtaggatccttgcac

SEQ ID NO: 130486 - DNA, 25 bp, Rattus norvegicus
agcctctgcagttggatccttgcac

SEQ ID NO: 130487 - DNA, 25 bp, Rattus norvegicus
agcctctgccgaattcgatgtcaaa

SEQ ID NO: 130488 - DNA, 25 bp, Rattus norvegicus
agcctctgccgatttcgatgtcaaa

SEQ ID NO: 130489 - DNA, 25 bp, Rattus norvegicus
agcctctgccttaaggttcttgtga

SEQ ID NO: 130490 - DNA, 25 bp, Rattus norvegicus
agcctctgcctttaggttcttgtga

SEQ ID NO: 130491 - DNA, 25 bp, Rattus norvegicus
agcctctgctgacaagtcctttgat

SEQ ID NO: 130492 - DNA, 25 bp, Rattus norvegicus
agcctctgctgagaagtcctttgat

SEQ ID NO: 130493 - DNA, 25 bp, Rattus norvegicus
agcctctggaccaatagctctgagc

SEQ ID NO: 130494 - DNA, 25 bp, Rattus norvegicus
agcctctggacctatagctctgagc

SEQ ID NO: 130495 - DNA, 25 bp, Rattus norvegicus
agcctctggactcctcagtgagaga

SEQ ID NO: 130496 - DNA, 25 bp, Rattus norvegicus
agcctctggactgctcagtgagaga

SEQ ID NO: 130497 - DNA, 25 bp, Rattus norvegicus
agcctctggcttcctttagaacagt

SEQ ID NO: 130498 - DNA, 25 bp, Rattus norvegicus
agcctctggcttgctttagaacagt

SEQ ID NO: 130499 - DNA, 25 bp, Rattus norvegicus
agcctctgggccactgaaggttgag

SEQ ID NO: 130500 - DNA, 25 bp, Rattus norvegicus
agcctctgggcctctgaaggttgag

SEQ ID NO: 130501 - DNA, 25 bp, Rattus norvegicus
agcctctgtacacgctgctgtttta

SEQ ID NO: 130502 - DNA, 25 bp, Rattus norvegicus
agcctctgtacaggctgctgtttta

SEQ ID NO: 130503 - DNA, 25 bp, Rattus norvegicus
agcctctgtactcctccttaaaaaa

SEQ ID NO: 130504 - DNA, 25 bp, Rattus norvegicus
agcctctgtactgctccttaaaaaa

SEQ ID NO: 130505 - DNA, 25 bp, Rattus norvegicus
agcctctgtagaatttccttttccg

SEQ ID NO: 130506 - DNA, 25 bp, Rattus norvegicus
agcctctgtagattttccttttccg

SEQ ID NO: 130507 - DNA, 25 bp, Rattus norvegicus
agcctctgtcatctataccaatctc

SEQ ID NO: 130508 - DNA, 25 bp, Rattus norvegicus
agcctctgtcatgtataccaatctc

SEQ ID NO: 130509 - DNA, 25 bp, Rattus norvegicus
agcctctgtcctagcatttatgtta

SEQ ID NO: 130510 - DNA, 25 bp, Rattus norvegicus
agcctctgtccttgcatttatgtta

SEQ ID NO: 130511 - DNA, 25 bp, Rattus norvegicus
agcctctgtcttcagcctgggactg

SEQ ID NO: 130512 - DNA, 25 bp, Rattus norvegicus
agcctctgtcttgagcctgggactg

SEQ ID NO: 130513 - DNA, 25 bp, Rattus norvegicus
agcctctgtgggagcggagacacaa

SEQ ID NO: 130514 - DNA, 25 bp, Rattus norvegicus
agcctctgtgggtgcggagacacaa

SEQ ID NO: 130515 - DNA, 25 bp, Rattus norvegicus
agcctctgtgtgagcactatacacg

SEQ ID NO: 130516 - DNA, 25 bp, Rattus norvegicus
agcctctgtgtgtgcactatacacg

SEQ ID NO: 130517 - DNA, 25 bp, Rattus norvegicus
agcctctgtttcagatgttctggga

SEQ ID NO: 130518 - DNA, 25 bp, Rattus norvegicus
agcctctgtttctgatgttctggga

SEQ ID NO: 130519 - DNA, 25 bp, Rattus norvegicus
agcctcttaaccactcaagtattgg

SEQ ID NO: 130520 - DNA, 25 bp, Rattus norvegicus
agcctcttaacctctcaagtattgg

SEQ ID NO: 130521 - DNA, 25 bp, Rattus norvegicus
agcctcttactgctgtttctttgca

SEQ ID NO: 130522 - DNA, 25 bp, Rattus norvegicus
agcctcttactggtgtttctttgca

SEQ ID NO: 130523 - DNA, 25 bp, Rattus norvegicus
agcctcttacttctccatgagttgt

SEQ ID NO: 130524 - DNA, 25 bp, Rattus norvegicus
agcctcttacttgtccatgagttgt

SEQ ID NO: 130525 - DNA, 25 bp, Rattus norvegicus
agcctcttaggcaccacagttaaaa

SEQ ID NO: 130526 - DNA, 25 bp, Rattus norvegicus
agcctcttaggctccacagttaaaa

SEQ ID NO: 130527 - DNA, 25 bp, Rattus norvegicus
agcctcttatctaagctaatcgcgt

SEQ ID NO: 130528 - DNA, 25 bp, Rattus norvegicus
agcctcttatcttagctaatcgcgt

SEQ ID NO: 130529 - DNA, 25 bp, Rattus norvegicus
agcctcttcaggatacatagcatgg

SEQ ID NO: 130530 - DNA, 25 bp, Rattus norvegicus
agcctcttcaggcaccgtagtttct

SEQ ID NO: 130531 - DNA, 25 bp, Rattus norvegicus
agcctcttcagggaccgtagtttct

SEQ ID NO: 130532 - DNA, 25 bp, Rattus norvegicus
agcctcttcaggttacatagcatgg

SEQ ID NO: 130533 - DNA, 25 bp, Rattus norvegicus
agcctcttcattccttgaggttggt

SEQ ID NO: 130534 - DNA, 25 bp, Rattus norvegicus
agcctcttcattgcttgaggttggt

SEQ ID NO: 130535 - DNA, 25 bp, Rattus norvegicus
agcctcttcctcactgaatctggaa

SEQ ID NO: 130536 - DNA, 25 bp, Rattus norvegicus
agcctcttcctctctgaatctggaa

SEQ ID NO: 130537 - DNA, 25 bp, Rattus norvegicus
agcctcttctcacacttaggcacag

SEQ ID NO: 130538 - DNA, 25 bp, Rattus norvegicus
agcctcttctcagacttaggcacag

SEQ ID NO: 130539 - DNA, 25 bp, Rattus norvegicus
agcctcttctctcatcctaattagc

SEQ ID NO: 130540 - DNA, 25 bp, Rattus norvegicus
agcctcttctctgatcctaattagc

SEQ ID NO: 130541 - DNA, 25 bp, Rattus norvegicus
agcctcttgaccatgggcaaactgc

SEQ ID NO: 130542 - DNA, 25 bp, Rattus norvegicus
agcctcttgaccttgggcaaactgc

SEQ ID NO: 130543 - DNA, 25 bp, Rattus norvegicus
agcctcttgcaaccagggcctgctg

SEQ ID NO: 130544 - DNA, 25 bp, Rattus norvegicus
agcctcttgcaagcagggcctgctg

SEQ ID NO: 130545 - DNA, 25 bp, Rattus norvegicus
agcctcttgcatatctcttggacat

SEQ ID NO: 130546 - DNA, 25 bp, Rattus norvegicus
agcctcttgcatttctcttggacat

SEQ ID NO: 130547 - DNA, 25 bp, Rattus norvegicus
agcctcttgccacagagccagtcaa

SEQ ID NO: 130548 - DNA, 25 bp, Rattus norvegicus
agcctcttgccagagagccagtcaa

SEQ ID NO: 130549 - DNA, 25 bp, Rattus norvegicus
agcctcttgggtatgctctttgaga

SEQ ID NO: 130550 - DNA, 25 bp, Rattus norvegicus
agcctcttgggtttgctctttgaga

SEQ ID NO: 130551 - DNA, 25 bp, Rattus norvegicus
agcctctttaatccctgtgtgtata

SEQ ID NO: 130552 - DNA, 25 bp, Rattus norvegicus
agcctctttaatgcctgtgtgtata

SEQ ID NO: 130553 - DNA, 25 bp, Rattus norvegicus
agcctctttaggcaggttgtcccta

SEQ ID NO: 130554 - DNA, 25 bp, Rattus norvegicus
agcctctttagggaggttgtcccta

SEQ ID NO: 130555 - DNA, 25 bp, Rattus norvegicus
agcctctttcctcagtgtcctttac

SEQ ID NO: 130556 - DNA, 25 bp, Rattus norvegicus
agcctctttcctctagtatgtcagg

SEQ ID NO: 130557 - DNA, 25 bp, Rattus norvegicus
agcctctttcctgagtgtcctttac

SEQ ID NO: 130558 - DNA, 25 bp, Rattus norvegicus
agcctctttcctgtagtatgtcagg

SEQ ID NO: 130559 - DNA, 25 bp, Rattus norvegicus
agcctctttctaagggacttcctca

SEQ ID NO: 130560 - DNA, 25 bp, Rattus norvegicus
agcctctttctatgggacttcctca

SEQ ID NO: 130561 - DNA, 25 bp, Rattus norvegicus
agcctctttgccatgccttaagagc

SEQ ID NO: 130562 - DNA, 25 bp, Rattus norvegicus
agcctctttgccttgccttaagagc

SEQ ID NO: 130563 - DNA, 25 bp, Rattus norvegicus
agcctctttggccacctctggttag

SEQ ID NO: 130564 - DNA, 25 bp, Rattus norvegicus
agcctctttggcgacctctggttag

SEQ ID NO: 130565 - DNA, 25 bp, Rattus norvegicus
agcctctttgtcaacagttccagga

SEQ ID NO: 130566 - DNA, 25 bp, Rattus norvegicus
agcctctttgtctacagttccagga

SEQ ID NO: 130567 - DNA, 25 bp, Rattus norvegicus
agcctctttgtgagctgagcgtaga

SEQ ID NO: 130568 - DNA, 25 bp, Rattus norvegicus
agcctctttgtgtgctgagcgtaga

SEQ ID NO: 130569 - DNA, 25 bp, Rattus norvegicus
agcctcttttgcactacaaggtcca

SEQ ID NO: 130570 - DNA, 25 bp, Rattus norvegicus
agcctcttttgcagactgtgtattc

SEQ ID NO: 130571 - DNA, 25 bp, Rattus norvegicus
agcctcttttgctctacaaggtcca

SEQ ID NO: 130572 - DNA, 25 bp, Rattus norvegicus
agcctcttttgctgactgtgtattc

SEQ ID NO: 130573 - DNA, 25 bp, Rattus norvegicus
agcctgaacaacatagcttcctctc

SEQ ID NO: 130574 - DNA, 25 bp, Rattus norvegicus
agcctgaacaacttagcttcctctc

SEQ ID NO: 130575 - DNA, 25 bp, Rattus norvegicus
agcctgaactagagagctagtccga

SEQ ID NO: 130576 - DNA, 25 bp, Rattus norvegicus
agcctgaactagtgagctagtccga

SEQ ID NO: 130577 - DNA, 25 bp, Rattus norvegicus
agcctgaagggcattccgagaccaa

SEQ ID NO: 130578 - DNA, 25 bp, Rattus norvegicus
agcctgaagggctttccgagaccaa

SEQ ID NO: 130579 - DNA, 25 bp, Rattus norvegicus
agcctgaagtctcctgggacaatgc

SEQ ID NO: 130580 - DNA, 25 bp, Rattus norvegicus
agcctgaagtctgctgggacaatgc

SEQ ID NO: 130581 - DNA, 25 bp, Rattus norvegicus
agcctgaatggcaatctcctggtac

SEQ ID NO: 130582 - DNA, 25 bp, Rattus norvegicus
agcctgaatggctatctcctggtac

SEQ ID NO: 130583 - DNA, 25 bp, Rattus norvegicus
agcctgaccagaccctgtagcagaa

SEQ ID NO: 130584 - DNA, 25 bp, Rattus norvegicus
agcctgaccagagcctgtagcagaa

SEQ ID NO: 130585 - DNA, 25 bp, Rattus norvegicus
agcctgaccctactgaaatgcctac

SEQ ID NO: 130586 - DNA, 25 bp, Rattus norvegicus
agcctgaccctagtgaaatgcctac

SEQ ID NO: 130587 - DNA, 25 bp, Rattus norvegicus
agcctgacctgcagactgtgttgaa

SEQ ID NO: 130588 - DNA, 25 bp, Rattus norvegicus
agcctgacctgctgactgtgttgaa

SEQ ID NO: 130589 - DNA, 25 bp, Rattus norvegicus
agcctgacctgtacaaggacatcgt

SEQ ID NO: 130590 - DNA, 25 bp, Rattus norvegicus
agcctgacctgttcaaggacatcgt

SEQ ID NO: 130591 - DNA, 25 bp, Rattus norvegicus
agcctgacgcctcagcagtggaagt

SEQ ID NO: 130592 - DNA, 25 bp, Rattus norvegicus
agcctgacgcctgagcagtggaagt

SEQ ID NO: 130593 - DNA, 25 bp, Rattus norvegicus
agcctgacgctcagaattatctgtg

SEQ ID NO: 130594 - DNA, 25 bp, Rattus norvegicus
agcctgacgctctgaattatctgtg

SEQ ID NO: 130595 - DNA, 25 bp, Rattus norvegicus
agcctgactctgaagcctatttggg

SEQ ID NO: 130596 - DNA, 25 bp, Rattus norvegicus
agcctgactctgtagcctatttggg

SEQ ID NO: 130597 - DNA, 25 bp, Rattus norvegicus
agcctgactgaaccctgacgtgcgg

SEQ ID NO: 130598 - DNA, 25 bp, Rattus norvegicus
agcctgactgaagcctgacgtgcgg

SEQ ID NO: 130599 - DNA, 25 bp, Rattus norvegicus
agcctgactgctccaatcagacgga

SEQ ID NO: 130600 - DNA, 25 bp, Rattus norvegicus
agcctgactgctgcaatcagacgga

SEQ ID NO: 130601 - DNA, 25 bp, Rattus norvegicus
agcctgagaccaattggccctggac

SEQ ID NO: 130602 - DNA, 25 bp, Rattus norvegicus
agcctgagaccatttggccctggac

SEQ ID NO: 130603 - DNA, 25 bp, Rattus norvegicus
agcctgagagcaactcttgctgaat

SEQ ID NO: 130604 - DNA, 25 bp, Rattus norvegicus
agcctgagagcatctcttgctgaat

SEQ ID NO: 130605 - DNA, 25 bp, Rattus norvegicus
agcctgagagttacagcgggcacac

SEQ ID NO: 130606 - DNA, 25 bp, Rattus norvegicus
agcctgagagtttcagcgggcacac

SEQ ID NO: 130607 - DNA, 25 bp, Rattus norvegicus
agcctgagcaatcaaaccccgaaga

SEQ ID NO: 130608 - DNA, 25 bp, Rattus norvegicus
agcctgagcaatgaaaccccgaaga

SEQ ID NO: 130609 - DNA, 25 bp, Rattus norvegicus
agcctgagctaccttatctttgaaa

SEQ ID NO: 130610 - DNA, 25 bp, Rattus norvegicus
agcctgagctacgttatctttgaaa

SEQ ID NO: 130611 - DNA, 25 bp, Rattus norvegicus
agcctgagctatctaagaccctacc

SEQ ID NO: 130612 - DNA, 25 bp, Rattus norvegicus
agcctgagctatgtaagaccctacc

SEQ ID NO: 130613 - DNA, 25 bp, Rattus norvegicus
agcctgagctctcggatcctagtat

SEQ ID NO: 130614 - DNA, 25 bp, Rattus norvegicus
agcctgagctctgggatcctagtat

SEQ ID NO: 130615 - DNA, 25 bp, Rattus norvegicus
agcctgagctggcaaatggtctagt

SEQ ID NO: 130616 - DNA, 25 bp, Rattus norvegicus
agcctgagctgggaaatggtctagt

SEQ ID NO: 130617 - DNA, 25 bp, Rattus norvegicus
agcctgaggagcagcctacctgtga

SEQ ID NO: 130618 - DNA, 25 bp, Rattus norvegicus
agcctgaggagctgcctacctgtga

SEQ ID NO: 130619 - DNA, 25 bp, Rattus norvegicus
agcctgaggcagagctgactaaacc

SEQ ID NO: 130620 - DNA, 25 bp, Rattus norvegicus
agcctgaggcagtgctgactaaacc

SEQ ID NO: 130621 - DNA, 25 bp, Rattus norvegicus
agcctgaggcttccaatccatggaa

SEQ ID NO: 130622 - DNA, 25 bp, Rattus norvegicus
agcctgaggcttgcaatccatggaa

SEQ ID NO: 130623 - DNA, 25 bp, Rattus norvegicus
agcctgaggtacatgtgggagcact

SEQ ID NO: 130624 - DNA, 25 bp, Rattus norvegicus
agcctgaggtacttgtgggagcact

SEQ ID NO: 130625 - DNA, 25 bp, Rattus norvegicus
agcctgagtcctctagtggaagcag

SEQ ID NO: 130626 - DNA, 25 bp, Rattus norvegicus
agcctgagtcctgtagtggaagcag

SEQ ID NO: 130627 - DNA, 25 bp, Rattus norvegicus
agcctgagtctcaccttagagttaa

SEQ ID NO: 130628 - DNA, 25 bp, Rattus norvegicus
agcctgagtctctccttagagttaa

SEQ ID NO: 130629 - DNA, 25 bp, Rattus norvegicus
agcctgatccctccatagttttata

SEQ ID NO: 130630 - DNA, 25 bp, Rattus norvegicus
agcctgatccctgcatagttttata

SEQ ID NO: 130631 - DNA, 25 bp, Rattus norvegicus
agcctgatcgacagccagttcgaca

SEQ ID NO: 130632 - DNA, 25 bp, Rattus norvegicus
agcctgatcgactgccagttcgaca

SEQ ID NO: 130633 - DNA, 25 bp, Rattus norvegicus
agcctgatcggtaaactatggaaga

SEQ ID NO: 130634 - DNA, 25 bp, Rattus norvegicus
agcctgatcggttaactatggaaga

SEQ ID NO: 130635 - DNA, 25 bp, Rattus norvegicus
agcctgatctacattgcgagtccgt

SEQ ID NO: 130636 - DNA, 25 bp, Rattus norvegicus
agcctgatctactttgcgagtccgt

SEQ ID NO: 130637 - DNA, 25 bp, Rattus norvegicus
agcctgatctataccatctactggt

SEQ ID NO: 130638 - DNA, 25 bp, Rattus norvegicus
agcctgatctatataatgggttcca

SEQ ID NO: 130639 - DNA, 25 bp, Rattus norvegicus
agcctgatctattccatctactggt

SEQ ID NO: 130640 - DNA, 25 bp, Rattus norvegicus
agcctgatctatttaatgggttcca

SEQ ID NO: 130641 - DNA, 25 bp, Rattus norvegicus
agcctgatgattctacgtctttctt

SEQ ID NO: 130642 - DNA, 25 bp, Rattus norvegicus
agcctgatgattgtacgtctttctt

SEQ ID NO: 130643 - DNA, 25 bp, Rattus norvegicus
agcctgatgtacactggattgggtg

SEQ ID NO: 130644 - DNA, 25 bp, Rattus norvegicus
agcctgatgtactctggattgggtg

SEQ ID NO: 130645 - DNA, 25 bp, Rattus norvegicus
agcctgattcctaggagcgctctga

SEQ ID NO: 130646 - DNA, 25 bp, Rattus norvegicus
agcctgattccttggagcgctctga

SEQ ID NO: 130647 - DNA, 25 bp, Rattus norvegicus
agcctgattgctagcagccctgaag

SEQ ID NO: 130648 - DNA, 25 bp, Rattus norvegicus
agcctgattgcttgcagccctgaag

SEQ ID NO: 130649 - DNA, 25 bp, Rattus norvegicus
agcctgattgtcaccccgaaagtgt

SEQ ID NO: 130650 - DNA, 25 bp, Rattus norvegicus
agcctgattgtctccccgaaagtgt

SEQ ID NO: 130651 - DNA, 25 bp, Rattus norvegicus
agcctgcaacctatgcttattcatg

SEQ ID NO: 130652 - DNA, 25 bp, Rattus norvegicus
agcctgcaacctttgcttattcatg

SEQ ID NO: 130653 - DNA, 25 bp, Rattus norvegicus
agcctgcaatgtagggcatcggaac

SEQ ID NO: 130654 - DNA, 25 bp, Rattus norvegicus
agcctgcaatgttgggcatcggaac

SEQ ID NO: 130655 - DNA, 25 bp, Rattus norvegicus
agcctgcacaaacacctcttgggtg

SEQ ID NO: 130656 - DNA, 25 bp, Rattus norvegicus
agcctgcacaaagacctcttgggtg

SEQ ID NO: 130657 - DNA, 25 bp, Rattus norvegicus
agcctgcacaggaaacacagagcct

SEQ ID NO: 130658 - DNA, 25 bp, Rattus norvegicus
agcctgcacaggtaacacagagcct

SEQ ID NO: 130659 - DNA, 25 bp, Rattus norvegicus
agcctgcacattcttccatgcctgg

SEQ ID NO: 130660 - DNA, 25 bp, Rattus norvegicus
agcctgcacattgttccatgcctgg

SEQ ID NO: 130661 - DNA, 25 bp, Rattus norvegicus
agcctgcaccacaattgtcataggt

SEQ ID NO: 130662 - DNA, 25 bp, Rattus norvegicus
agcctgcaccactattgtcataggt

SEQ ID NO: 130663 - DNA, 25 bp, Rattus norvegicus
agcctgcagattcctttcattcaga

SEQ ID NO: 130664 - DNA, 25 bp, Rattus norvegicus
agcctgcagattgctttcattcaga

SEQ ID NO: 130665 - DNA, 25 bp, Rattus norvegicus
agcctgcagcacagtgggatctcca

SEQ ID NO: 130666 - DNA, 25 bp, Rattus norvegicus
agcctgcagcactgtgggatctcca

SEQ ID NO: 130667 - DNA, 25 bp, Rattus norvegicus
agcctgcagcctagacagtagggcc

SEQ ID NO: 130668 - DNA, 25 bp, Rattus norvegicus
agcctgcagccttgacagtagggcc

SEQ ID NO: 130669 - DNA, 25 bp, Rattus norvegicus
agcctgcagctgcattacgcaacag

SEQ ID NO: 130670 - DNA, 25 bp, Rattus norvegicus
agcctgcagctggattacgcaacag

SEQ ID NO: 130671 - DNA, 25 bp, Rattus norvegicus
agcctgcaggaacggcctcattcat

SEQ ID NO: 130672 - DNA, 25 bp, Rattus norvegicus
agcctgcaggaagggcctcattcat

SEQ ID NO: 130673 - DNA, 25 bp, Rattus norvegicus
agcctgcaggtcctgtccttgctgc

SEQ ID NO: 130674 - DNA, 25 bp, Rattus norvegicus
agcctgcaggtcgtgtccttgctgc

SEQ ID NO: 130675 - DNA, 25 bp, Rattus norvegicus
agcctgcaggtgatcgagtcagcca

SEQ ID NO: 130676 - DNA, 25 bp, Rattus norvegicus
agcctgcaggtgttcgagtcagcca

SEQ ID NO: 130677 - DNA, 25 bp, Rattus norvegicus
agcctgcagtgcacctgtgaggaga

SEQ ID NO: 130678 - DNA, 25 bp, Rattus norvegicus
agcctgcagtgctcctgtgaggaga

SEQ ID NO: 130679 - DNA, 25 bp, Rattus norvegicus
agcctgcataagaggtttttttggg

SEQ ID NO: 130680 - DNA, 25 bp, Rattus norvegicus
agcctgcataagtggtttttttggg

SEQ ID NO: 130681 - DNA, 25 bp, Rattus norvegicus
agcctgcatatcacctggttctgaa

SEQ ID NO: 130682 - DNA, 25 bp, Rattus norvegicus
agcctgcatatctcctggttctgaa

SEQ ID NO: 130683 - DNA, 25 bp, Rattus norvegicus
agcctgcattgtcctcatgtataat

SEQ ID NO: 130684 - DNA, 25 bp, Rattus norvegicus
agcctgcattgtgctcatgtataat

SEQ ID NO: 130685 - DNA, 25 bp, Rattus norvegicus
agcctgcatttactcctttggataa

SEQ ID NO: 130686 - DNA, 25 bp, Rattus norvegicus
agcctgcatttagtcctttggataa

SEQ ID NO: 130687 - DNA, 25 bp, Rattus norvegicus
agcctgccaaatatcaattgcattg

SEQ ID NO: 130688 - DNA, 25 bp, Rattus norvegicus
agcctgccaaatttcaattgcattg

SEQ ID NO: 130689 - DNA, 25 bp, Rattus norvegicus
agcctgccacatccctggatagaaa

SEQ ID NO: 130690 - DNA, 25 bp, Rattus norvegicus
agcctgccacatgcctggatagaaa

SEQ ID NO: 130691 - DNA, 25 bp, Rattus norvegicus
agcctgccacgtagcactaagcgat

SEQ ID NO: 130692 - DNA, 25 bp, Rattus norvegicus
agcctgccacgttgcactaagcgat

SEQ ID NO: 130693 - DNA, 25 bp, Rattus norvegicus
agcctgccactgacaacatattctg

SEQ ID NO: 130694 - DNA, 25 bp, Rattus norvegicus
agcctgccactgtcaacatattctg

SEQ ID NO: 130695 - DNA, 25 bp, Rattus norvegicus
agcctgcccaaactcaaaaaggtgg

SEQ ID NO: 130696 - DNA, 25 bp, Rattus norvegicus
agcctgcccaaagtcaaaaaggtgg

SEQ ID NO: 130697 - DNA, 25 bp, Rattus norvegicus
agcctgcccaggaacatgtagtcag

SEQ ID NO: 130698 - DNA, 25 bp, Rattus norvegicus
agcctgcccaggtacatgtagtcag

SEQ ID NO: 130699 - DNA, 25 bp, Rattus norvegicus
agcctgccccagagaaaacgagcga

SEQ ID NO: 130700 - DNA, 25 bp, Rattus norvegicus
agcctgccccagtgaaaacgagcga

SEQ ID NO: 130701 - DNA, 25 bp, Rattus norvegicus
agcctgccccggaagcggatctcgg

SEQ ID NO: 130702 - DNA, 25 bp, Rattus norvegicus
agcctgccccggtagcggatctcgg

SEQ ID NO: 130703 - DNA, 25 bp, Rattus norvegicus
agcctgccgctactcatctgaaagg

SEQ ID NO: 130704 - DNA, 25 bp, Rattus norvegicus
agcctgccgctagtcatctgaaagg

SEQ ID NO: 130705 - DNA, 25 bp, Rattus norvegicus
agcctgcctcttagcacttggataa

SEQ ID NO: 130706 - DNA, 25 bp, Rattus norvegicus
agcctgcctctttgcacttggataa

SEQ ID NO: 130707 - DNA, 25 bp, Rattus norvegicus
agcctgcctgccaatcagagtctag

SEQ ID NO: 130708 - DNA, 25 bp, Rattus norvegicus
agcctgcctgcctatcagagtctag

SEQ ID NO: 130709 - DNA, 25 bp, Rattus norvegicus
agcctgccttagacttgcagcccgg

SEQ ID NO: 130710 - DNA, 25 bp, Rattus norvegicus
agcctgccttagtcttgcagcccgg

SEQ ID NO: 130711 - DNA, 25 bp, Rattus norvegicus
agcctgcggactcgtttcatgaagc

SEQ ID NO: 130712 - DNA, 25 bp, Rattus norvegicus
agcctgcggactggtttcatgaagc

SEQ ID NO: 130713 - DNA, 25 bp, Rattus norvegicus
agcctgcggttcatgtgcaaggtca

SEQ ID NO: 130714 - DNA, 25 bp, Rattus norvegicus
agcctgcggttccagttctgagcaa

SEQ ID NO: 130715 - DNA, 25 bp, Rattus norvegicus
agcctgcggttcgagttctgagcaa

SEQ ID NO: 130716 - DNA, 25 bp, Rattus norvegicus
agcctgcggttcttgtgcaaggtca

SEQ ID NO: 130717 - DNA, 25 bp, Rattus norvegicus
agcctgcgtgccatcattttgtgac

SEQ ID NO: 130718 - DNA, 25 bp, Rattus norvegicus
agcctgcgtgccttcattttgtgac

SEQ ID NO: 130719 - DNA, 25 bp, Rattus norvegicus
agcctgctagctagctcaactattg

SEQ ID NO: 130720 - DNA, 25 bp, Rattus norvegicus
agcctgctagcttgctcaactattg

SEQ ID NO: 130721 - DNA, 25 bp, Rattus norvegicus
agcctgctccagctggattcttcta

SEQ ID NO: 130722 - DNA, 25 bp, Rattus norvegicus
agcctgctccaggtggattcttcta

SEQ ID NO: 130723 - DNA, 25 bp, Rattus norvegicus
agcctgctcccactcagaaataaat

SEQ ID NO: 130724 - DNA, 25 bp, Rattus norvegicus
agcctgctcccagtcagaaataaat

SEQ ID NO: 130725 - DNA, 25 bp, Rattus norvegicus
agcctgctctcaaagatacctactt

SEQ ID NO: 130726 - DNA, 25 bp, Rattus norvegicus
agcctgctctcatagatacctactt

SEQ ID NO: 130727 - DNA, 25 bp, Rattus norvegicus
agcctgctgcggcaatggtacctgc

SEQ ID NO: 130728 - DNA, 25 bp, Rattus norvegicus
agcctgctgcgggaatggtacctgc

SEQ ID NO: 130729 - DNA, 25 bp, Rattus norvegicus
agcctgctgctgcatctattcccag

SEQ ID NO: 130730 - DNA, 25 bp, Rattus norvegicus
agcctgctgctggatctattcccag

SEQ ID NO: 130731 - DNA, 25 bp, Rattus norvegicus
agcctgctggaaatctccacggtag

SEQ ID NO: 130732 - DNA, 25 bp, Rattus norvegicus
agcctgctggaattctccacggtag

SEQ ID NO: 130733 - DNA, 25 bp, Rattus norvegicus
agcctgctggagacaccgggactga

SEQ ID NO: 130734 - DNA, 25 bp, Rattus norvegicus
agcctgctggagtcaccgggactga

SEQ ID NO: 130735 - DNA, 25 bp, Rattus norvegicus
agcctgctgggacacggagaccatt

SEQ ID NO: 130736 - DNA, 25 bp, Rattus norvegicus
agcctgctgggagacggagaccatt

SEQ ID NO: 130737 - DNA, 25 bp, Rattus norvegicus
agcctgctggtgctctacatggaga

SEQ ID NO: 130738 - DNA, 25 bp, Rattus norvegicus
agcctgctggtggtctacatggaga

SEQ ID NO: 130739 - DNA, 25 bp, Rattus norvegicus
agcctgctgtttagctgtttaaacc

SEQ ID NO: 130740 - DNA, 25 bp, Rattus norvegicus
agcctgctgttttgctgtttaaacc

SEQ ID NO: 130741 - DNA, 25 bp, Rattus norvegicus
agcctgcttcaaaacagactgccag

SEQ ID NO: 130742 - DNA, 25 bp, Rattus norvegicus
agcctgcttcaatacagactgccag

SEQ ID NO: 130743 - DNA, 25 bp, Rattus norvegicus
agcctgcttcgtatggagactgtta

SEQ ID NO: 130744 - DNA, 25 bp, Rattus norvegicus
agcctgcttcgtttggagactgtta

SEQ ID NO: 130745 - DNA, 25 bp, Rattus norvegicus
agcctgcttgccagcggtgaaaacc

SEQ ID NO: 130746 - DNA, 25 bp, Rattus norvegicus
agcctgcttgcctgcggtgaaaacc

SEQ ID NO: 130747 - DNA, 25 bp, Rattus norvegicus
agcctgctttctaatggagcctagg

SEQ ID NO: 130748 - DNA, 25 bp, Rattus norvegicus
agcctgctttcttatggagcctagg

SEQ ID NO: 130749 - DNA, 25 bp, Rattus norvegicus
agcctgctttgcattactgcatgaa

SEQ ID NO: 130750 - DNA, 25 bp, Rattus norvegicus
agcctgctttgctttactgcatgaa

SEQ ID NO: 130751 - DNA, 25 bp, Rattus norvegicus
agcctgcttttcagcaactggtcaa

SEQ ID NO: 130752 - DNA, 25 bp, Rattus norvegicus
agcctgcttttctgcaactggtcaa

SEQ ID NO: 130753 - DNA, 25 bp, Rattus norvegicus
agcctggaaaggatcacgtctaagt

SEQ ID NO: 130754 - DNA, 25 bp, Rattus norvegicus
agcctggaaaggttcacgtctaagt

SEQ ID NO: 130755 - DNA, 25 bp, Rattus norvegicus
agcctggaactcagcgatctgtctg

SEQ ID NO: 130756 - DNA, 25 bp, Rattus norvegicus
agcctggaactctgcgatctgtctg

SEQ ID NO: 130757 - DNA, 25 bp, Rattus norvegicus
agcctggaagctctctgtgatcttc

SEQ ID NO: 130758 - DNA, 25 bp, Rattus norvegicus
agcctggaagctgtctgtgatcttc

SEQ ID NO: 130759 - DNA, 25 bp, Rattus norvegicus
agcctggaccagacaagcggacact

SEQ ID NO: 130760 - DNA, 25 bp, Rattus norvegicus
agcctggaccagtcaagcggacact

SEQ ID NO: 130761 - DNA, 25 bp, Rattus norvegicus
agcctggacccacttctaatgtgca

SEQ ID NO: 130762 - DNA, 25 bp, Rattus norvegicus
agcctggacccagttctaatgtgca

SEQ ID NO: 130763 - DNA, 25 bp, Rattus norvegicus
agcctggacttcattgtgagttctg

SEQ ID NO: 130764 - DNA, 25 bp, Rattus norvegicus
agcctggacttctttgtgagttctg

SEQ ID NO: 130765 - DNA, 25 bp, Rattus norvegicus
agcctggagacgacgctttagctga

SEQ ID NO: 130766 - DNA, 25 bp, Rattus norvegicus
agcctggagacgtcgctttagctga

SEQ ID NO: 130767 - DNA, 25 bp, Rattus norvegicus
agcctggagcctattgcttcagcga

SEQ ID NO: 130768 - DNA, 25 bp, Rattus norvegicus
agcctggagccttttgcttcagcga

SEQ ID NO: 130769 - DNA, 25 bp, Rattus norvegicus
agcctggagctgcacagtcactcca

SEQ ID NO: 130770 - DNA, 25 bp, Rattus norvegicus
agcctggagctggacagtcactcca

SEQ ID NO: 130771 - DNA, 25 bp, Rattus norvegicus
agcctggaggctaattgccacattc

SEQ ID NO: 130772 - DNA, 25 bp, Rattus norvegicus
agcctggaggcttattgccacattc

SEQ ID NO: 130773 - DNA, 25 bp, Rattus norvegicus
agcctggatgctcttgtcttgatga

SEQ ID NO: 130774 - DNA, 25 bp, Rattus norvegicus
agcctggatgctgttgtcttgatga

SEQ ID NO: 130775 - DNA, 25 bp, Rattus norvegicus
agcctggatgtcatccttgtatgga

SEQ ID NO: 130776 - DNA, 25 bp, Rattus norvegicus
agcctggatgtcttccttgtatgga

SEQ ID NO: 130777 - DNA, 25 bp, Rattus norvegicus
agcctggcaaacaatttcacttctt

SEQ ID NO: 130778 - DNA, 25 bp, Rattus norvegicus
agcctggcaaactatttcacttctt

SEQ ID NO: 130779 - DNA, 25 bp, Rattus norvegicus
agcctggcaactctgatcctagtga

SEQ ID NO: 130780 - DNA, 25 bp, Rattus norvegicus
agcctggcaactgtgatcctagtga

SEQ ID NO: 130781 - DNA, 25 bp, Rattus norvegicus
agcctggcaagcatgttgctcaaca

SEQ ID NO: 130782 - DNA, 25 bp, Rattus norvegicus
agcctggcaagcttgttgctcaaca

SEQ ID NO: 130783 - DNA, 25 bp, Rattus norvegicus
agcctggcacctatcaagttggttt

SEQ ID NO: 130784 - DNA, 25 bp, Rattus norvegicus
agcctggcacctttcaagttggttt

SEQ ID NO: 130785 - DNA, 25 bp, Rattus norvegicus
agcctggcactacaggtgacagatg

SEQ ID NO: 130786 - DNA, 25 bp, Rattus norvegicus
agcctggcactagaggtgacagatg

SEQ ID NO: 130787 - DNA, 25 bp, Rattus norvegicus
agcctggcagcaatgtgacttcgtg

SEQ ID NO: 130788 - DNA, 25 bp, Rattus norvegicus
agcctggcagcattgtgacttcgtg

SEQ ID NO: 130789 - DNA, 25 bp, Rattus norvegicus
agcctggccaccctcagagaaaggt

SEQ ID NO: 130790 - DNA, 25 bp, Rattus norvegicus
agcctggccaccgtcagagaaaggt

SEQ ID NO: 130791 - DNA, 25 bp, Rattus norvegicus
agcctggccaggactaaacacacaa

SEQ ID NO: 130792 - DNA, 25 bp, Rattus norvegicus
agcctggccaggtctaaacacacaa

SEQ ID NO: 130793 - DNA, 25 bp, Rattus norvegicus
agcctggcccagagtccgatgtgaa

SEQ ID NO: 130794 - DNA, 25 bp, Rattus norvegicus
agcctggcccagtgtccgatgtgaa

SEQ ID NO: 130795 - DNA, 25 bp, Rattus norvegicus
agcctggccgtccttagaaggcaga

SEQ ID NO: 130796 - DNA, 25 bp, Rattus norvegicus
agcctggccgtcgttagaaggcaga

SEQ ID NO: 130797 - DNA, 25 bp, Rattus norvegicus
agcctggcctacatatgaagactct

SEQ ID NO: 130798 - DNA, 25 bp, Rattus norvegicus
agcctggcctacttatgaagactct

SEQ ID NO: 130799 - DNA, 25 bp, Rattus norvegicus
agcctggccttgatgagtggcctaa

SEQ ID NO: 130800 - DNA, 25 bp, Rattus norvegicus
agcctggccttgttgagtggcctaa

SEQ ID NO: 130801 - DNA, 25 bp, Rattus norvegicus
agcctggcgactaattgggcattgt

SEQ ID NO: 130802 - DNA, 25 bp, Rattus norvegicus
agcctggcgacttattgggcattgt

SEQ ID NO: 130803 - DNA, 25 bp, Rattus norvegicus
agcctggcgagcatgtcacaggaat

SEQ ID NO: 130804 - DNA, 25 bp, Rattus norvegicus
agcctggcgagcttgtcacaggaat

SEQ ID NO: 130805 - DNA, 25 bp, Rattus norvegicus
agcctggcgataagaaacctccttc

SEQ ID NO: 130806 - DNA, 25 bp, Rattus norvegicus
agcctggcgatatgaaacctccttc

SEQ ID NO: 130807 - DNA, 25 bp, Rattus norvegicus
agcctggcggttattaactgggcag

SEQ ID NO: 130808 - DNA, 25 bp, Rattus norvegicus
agcctggcggtttttaactgggcag

SEQ ID NO: 130809 - DNA, 25 bp, Rattus norvegicus
agcctggcgtccaagtgcgtggcca

SEQ ID NO: 130810 - DNA, 25 bp, Rattus norvegicus
agcctggcgtcctagtgcgtggcca

SEQ ID NO: 130811 - DNA, 25 bp, Rattus norvegicus
agcctggctactaaggatctgcttc

SEQ ID NO: 130812 - DNA, 25 bp, Rattus norvegicus
agcctggctacttaggatctgcttc

SEQ ID NO: 130813 - DNA, 25 bp, Rattus norvegicus
agcctggctcagacctctcaggatt

SEQ ID NO: 130814 - DNA, 25 bp, Rattus norvegicus
agcctggctcagtcctctcaggatt

SEQ ID NO: 130815 - DNA, 25 bp, Rattus norvegicus
agcctggctccactcacagtgacag

SEQ ID NO: 130816 - DNA, 25 bp, Rattus norvegicus
agcctggctccagtcacagtgacag

SEQ ID NO: 130817 - DNA, 25 bp, Rattus norvegicus
agcctggctcctctgagatgtccta

SEQ ID NO: 130818 - DNA, 25 bp, Rattus norvegicus
agcctggctcctgtgagatgtccta

SEQ ID NO: 130819 - DNA, 25 bp, Rattus norvegicus
agcctggctcggaggttagaacgcc

SEQ ID NO: 130820 - DNA, 25 bp, Rattus norvegicus
agcctggctcggtggttagaacgcc

SEQ ID NO: 130821 - DNA, 25 bp, Rattus norvegicus
agcctggctgccacataggtatgaa

SEQ ID NO: 130822 - DNA, 25 bp, Rattus norvegicus
agcctggctgcctcataggtatgaa

SEQ ID NO: 130823 - DNA, 25 bp, Rattus norvegicus
agcctggctgtacgtgaggccctta

SEQ ID NO: 130824 - DNA, 25 bp, Rattus norvegicus
agcctggctgtaggtgaggccctta

SEQ ID NO: 130825 - DNA, 25 bp, Rattus norvegicus
agcctggctgtccagtgaacctcag

SEQ ID NO: 130826 - DNA, 25 bp, Rattus norvegicus
agcctggctgtcgagtgaacctcag

SEQ ID NO: 130827 - DNA, 25 bp, Rattus norvegicus
agcctggcttctcattctttgttca

SEQ ID NO: 130828 - DNA, 25 bp, Rattus norvegicus
agcctggcttctgattctttgttca

SEQ ID NO: 130829 - DNA, 25 bp, Rattus norvegicus
agcctggcttgaagcagttggacca

SEQ ID NO: 130830 - DNA, 25 bp, Rattus norvegicus
agcctggcttgatgcagttggacca

SEQ ID NO: 130831 - DNA, 25 bp, Rattus norvegicus
agcctggcttgtatcaccttgttaa

SEQ ID NO: 130832 - DNA, 25 bp, Rattus norvegicus
agcctggcttgtttcaccttgttaa

SEQ ID NO: 130833 - DNA, 25 bp, Rattus norvegicus
agcctggctttcagagaggactgca

SEQ ID NO: 130834 - DNA, 25 bp, Rattus norvegicus
agcctggctttctgagaggactgca

SEQ ID NO: 130835 - DNA, 25 bp, Rattus norvegicus
agcctgggaataactctactgcgtg

SEQ ID NO: 130836 - DNA, 25 bp, Rattus norvegicus
agcctgggaatatctctactgcgtg

SEQ ID NO: 130837 - DNA, 25 bp, Rattus norvegicus
agcctgggacccagccagatgagtt

SEQ ID NO: 130838 - DNA, 25 bp, Rattus norvegicus
agcctgggaccctgccagatgagtt

SEQ ID NO: 130839 - DNA, 25 bp, Rattus norvegicus
agcctgggatgcctgagacgctatc

SEQ ID NO: 130840 - DNA, 25 bp, Rattus norvegicus
agcctgggatgcgtgagacgctatc

SEQ ID NO: 130841 - DNA, 25 bp, Rattus norvegicus
agcctgggattgagccttccttgct

SEQ ID NO: 130842 - DNA, 25 bp, Rattus norvegicus
agcctgggattgtgccttccttgct

SEQ ID NO: 130843 - DNA, 25 bp, Rattus norvegicus
agcctgggcaagacaccttatcgac

SEQ ID NO: 130844 - DNA, 25 bp, Rattus norvegicus
agcctgggcaagtcaccttatcgac

SEQ ID NO: 130845 - DNA, 25 bp, Rattus norvegicus
agcctgggcaatattgagactctgc

SEQ ID NO: 130846 - DNA, 25 bp, Rattus norvegicus
agcctgggcaattttgagactctgc

SEQ ID NO: 130847 - DNA, 25 bp, Rattus norvegicus
agcctgggcattatggccttgctga

SEQ ID NO: 130848 - DNA, 25 bp, Rattus norvegicus
agcctgggcattttggccttgctga

SEQ ID NO: 130849 - DNA, 25 bp, Rattus norvegicus
agcctgggccaacagaattgctgga

SEQ ID NO: 130850 - DNA, 25 bp, Rattus norvegicus
agcctgggccaagagaattgctgga

SEQ ID NO: 130851 - DNA, 25 bp, Rattus norvegicus
agcctgggccacagaccttgggtgc

SEQ ID NO: 130852 - DNA, 25 bp, Rattus norvegicus
agcctgggccactgaccttgggtgc

SEQ ID NO: 130853 - DNA, 25 bp, Rattus norvegicus
agcctgggccccacaacaaatggag

SEQ ID NO: 130854 - DNA, 25 bp, Rattus norvegicus
agcctgggcccctcaacaaatggag

SEQ ID NO: 130855 - DNA, 25 bp, Rattus norvegicus
agcctgggcgcgcatattaaagatg

SEQ ID NO: 130856 - DNA, 25 bp, Rattus norvegicus
agcctgggcgcggatattaaagatg

SEQ ID NO: 130857 - DNA, 25 bp, Rattus norvegicus
agcctgggctagagaccttgtgttt

SEQ ID NO: 130858 - DNA, 25 bp, Rattus norvegicus
agcctgggctagtgaccttgtgttt

SEQ ID NO: 130859 - DNA, 25 bp, Rattus norvegicus
agcctgggctgcacatagaccccat

SEQ ID NO: 130860 - DNA, 25 bp, Rattus norvegicus
agcctgggctgctcatagaccccat

SEQ ID NO: 130861 - DNA, 25 bp, Rattus norvegicus
agcctgggtaatctgagaccgccac

SEQ ID NO: 130862 - DNA, 25 bp, Rattus norvegicus
agcctgggtaatgtgagaccgccac

SEQ ID NO: 130863 - DNA, 25 bp, Rattus norvegicus
agcctgggtatgatggcgcatgtct

SEQ ID NO: 130864 - DNA, 25 bp, Rattus norvegicus
agcctgggtatgttggcgcatgtct

SEQ ID NO: 130865 - DNA, 25 bp, Rattus norvegicus
agcctgggtcgtcttgctcctcttg

SEQ ID NO: 130866 - DNA, 25 bp, Rattus norvegicus
agcctgggtcgtgttgctcctcttg

SEQ ID NO: 130867 - DNA, 25 bp, Rattus norvegicus
agcctgggtgctagtaagtatctat

SEQ ID NO: 130868 - DNA, 25 bp, Rattus norvegicus
agcctgggtgcttgtaagtatctat

SEQ ID NO: 130869 - DNA, 25 bp, Rattus norvegicus
agcctgggtgtgactgtctagcaga

SEQ ID NO: 130870 - DNA, 25 bp, Rattus norvegicus
agcctgggtgtgtctgtctagcaga

SEQ ID NO: 130871 - DNA, 25 bp, Rattus norvegicus
agcctggtcagcaggtcaggcacat

SEQ ID NO: 130872 - DNA, 25 bp, Rattus norvegicus
agcctggtcagctggtcaggcacat

SEQ ID NO: 130873 - DNA, 25 bp, Rattus norvegicus
agcctggtccagatactgagttcca

SEQ ID NO: 130874 - DNA, 25 bp, Rattus norvegicus
agcctggtccagttactgagttcca

SEQ ID NO: 130875 - DNA, 25 bp, Rattus norvegicus
agcctggtccatagagagagtatca

SEQ ID NO: 130876 - DNA, 25 bp, Rattus norvegicus
agcctggtccattgagagagtatca

SEQ ID NO: 130877 - DNA, 25 bp, Rattus norvegicus
agcctggtctagagatcttcacaca

SEQ ID NO: 130878 - DNA, 25 bp, Rattus norvegicus
agcctggtctagtgatcttcacaca

SEQ ID NO: 130879 - DNA, 25 bp, Rattus norvegicus
agcctggtgacccagttgccgagaa

SEQ ID NO: 130880 - DNA, 25 bp, Rattus norvegicus
agcctggtgaccgagttgccgagaa

SEQ ID NO: 130881 - DNA, 25 bp, Rattus norvegicus
agcctggtgccaatgtttgtacaca

SEQ ID NO: 130882 - DNA, 25 bp, Rattus norvegicus
agcctggtgccattgtttgtacaca

SEQ ID NO: 130883 - DNA, 25 bp, Rattus norvegicus
agcctggtggaacccaggtcccttg

SEQ ID NO: 130884 - DNA, 25 bp, Rattus norvegicus
agcctggtggaagccaggtcccttg

SEQ ID NO: 130885 - DNA, 25 bp, Rattus norvegicus
agcctggtggctatagtcctggaca

SEQ ID NO: 130886 - DNA, 25 bp, Rattus norvegicus
agcctggtggctttagtcctggaca

SEQ ID NO: 130887 - DNA, 25 bp, Rattus norvegicus
agcctggtggttctgactttttaag

SEQ ID NO: 130888 - DNA, 25 bp, Rattus norvegicus
agcctggtggttgtgactttttaag

SEQ ID NO: 130889 - DNA, 25 bp, Rattus norvegicus
agcctggtgttaacagtggctaaca

SEQ ID NO: 130890 - DNA, 25 bp, Rattus norvegicus
agcctggtgttatcagtggctaaca

SEQ ID NO: 130891 - DNA, 25 bp, Rattus norvegicus
agcctggttataccacacagactct

SEQ ID NO: 130892 - DNA, 25 bp, Rattus norvegicus
agcctggttatagcacacagactct

SEQ ID NO: 130893 - DNA, 25 bp, Rattus norvegicus
agcctggttcaacgactcacgttgt

SEQ ID NO: 130894 - DNA, 25 bp, Rattus norvegicus
agcctggttcaaggactcacgttgt

SEQ ID NO: 130895 - DNA, 25 bp, Rattus norvegicus
agcctgtaacctctccagcaacaga

SEQ ID NO: 130896 - DNA, 25 bp, Rattus norvegicus
agcctgtaacctgtccagcaacaga

SEQ ID NO: 130897 - DNA, 25 bp, Rattus norvegicus
agcctgtaatacctggaagtttatg

SEQ ID NO: 130898 - DNA, 25 bp, Rattus norvegicus
agcctgtaatacgtggaagtttatg

SEQ ID NO: 130899 - DNA, 25 bp, Rattus norvegicus
agcctgtacaaaagcttatccctgt

SEQ ID NO: 130900 - DNA, 25 bp, Rattus norvegicus
agcctgtacaaatgcttatccctgt

SEQ ID NO: 130901 - DNA, 25 bp, Rattus norvegicus
agcctgtacacgctgctatttctat

SEQ ID NO: 130902 - DNA, 25 bp, Rattus norvegicus
agcctgtacacggtgctatttctat

SEQ ID NO: 130903 - DNA, 25 bp, Rattus norvegicus
agcctgtacaggactcttgctgtca

SEQ ID NO: 130904 - DNA, 25 bp, Rattus norvegicus
agcctgtacaggtctcttgctgtca

SEQ ID NO: 130905 - DNA, 25 bp, Rattus norvegicus
agcctgtacattatcctgaagaacg

SEQ ID NO: 130906 - DNA, 25 bp, Rattus norvegicus
agcctgtacattttcctgaagaacg

SEQ ID NO: 130907 - DNA, 25 bp, Rattus norvegicus
agcctgtactatctgccctgttttg

SEQ ID NO: 130908 - DNA, 25 bp, Rattus norvegicus
agcctgtactatgtgccctgttttg

SEQ ID NO: 130909 - DNA, 25 bp, Rattus norvegicus
agcctgtactcaagggacactgtgt

SEQ ID NO: 130910 - DNA, 25 bp, Rattus norvegicus
agcctgtactcatgggacactgtgt

SEQ ID NO: 130911 - DNA, 25 bp, Rattus norvegicus
agcctgtacttaactttggtagcat

SEQ ID NO: 130912 - DNA, 25 bp, Rattus norvegicus
agcctgtacttatctttggtagcat

SEQ ID NO: 130913 - DNA, 25 bp, Rattus norvegicus
agcctgtaggatcaaacgcccgcat

SEQ ID NO: 130914 - DNA, 25 bp, Rattus norvegicus
agcctgtaggatgaaacgcccgcat

SEQ ID NO: 130915 - DNA, 25 bp, Rattus norvegicus
agcctgtatatcattgctgtctcca

SEQ ID NO: 130916 - DNA, 25 bp, Rattus norvegicus
agcctgtatatctttgctgtctcca

SEQ ID NO: 130917 - DNA, 25 bp, Rattus norvegicus
agcctgtatccccaaaggccaggat

SEQ ID NO: 130918 - DNA, 25 bp, Rattus norvegicus
agcctgtatcccgaaaggccaggat

SEQ ID NO: 130919 - DNA, 25 bp, Rattus norvegicus
agcctgtatcctcacaatacccttg

SEQ ID NO: 130920 - DNA, 25 bp, Rattus norvegicus
agcctgtatcctgacaatacccttg

SEQ ID NO: 130921 - DNA, 25 bp, Rattus norvegicus
agcctgtatggacggcttttgcaaa

SEQ ID NO: 130922 - DNA, 25 bp, Rattus norvegicus
agcctgtatggagggcttttgcaaa

SEQ ID NO: 130923 - DNA, 25 bp, Rattus norvegicus
agcctgtcaacaataatctaatttt

SEQ ID NO: 130924 - DNA, 25 bp, Rattus norvegicus
agcctgtcaacacccctaaggtaat

SEQ ID NO: 130925 - DNA, 25 bp, Rattus norvegicus
agcctgtcaacagccctaaggtaat

SEQ ID NO: 130926 - DNA, 25 bp, Rattus norvegicus
agcctgtcaacattaatctaatttt

SEQ ID NO: 130927 - DNA, 25 bp, Rattus norvegicus
agcctgtcaactacagtctgttctg

SEQ ID NO: 130928 - DNA, 25 bp, Rattus norvegicus
agcctgtcaacttcagtctgttctg

SEQ ID NO: 130929 - DNA, 25 bp, Rattus norvegicus
agcctgtcacatcaccatggagtgg

SEQ ID NO: 130930 - DNA, 25 bp, Rattus norvegicus
agcctgtcacatgaccatggagtgg

SEQ ID NO: 130931 - DNA, 25 bp, Rattus norvegicus
agcctgtcagttcctgctaggacac

SEQ ID NO: 130932 - DNA, 25 bp, Rattus norvegicus
agcctgtcagttgctgctaggacac

SEQ ID NO: 130933 - DNA, 25 bp, Rattus norvegicus
agcctgtcctcgactgcagaagatg

SEQ ID NO: 130934 - DNA, 25 bp, Rattus norvegicus
agcctgtcctcgtctgcagaagatg

SEQ ID NO: 130935 - DNA, 25 bp, Rattus norvegicus
agcctgtccttcagctaatgggact

SEQ ID NO: 130936 - DNA, 25 bp, Rattus norvegicus
agcctgtccttctgctaatgggact

SEQ ID NO: 130937 - DNA, 25 bp, Rattus norvegicus
agcctgtcgagcctggtttctgaac

SEQ ID NO: 130938 - DNA, 25 bp, Rattus norvegicus
agcctgtcgagcgtggtttctgaac

SEQ ID NO: 130939 - DNA, 25 bp, Rattus norvegicus
agcctgtcgctaaccatcagtacaa

SEQ ID NO: 130940 - DNA, 25 bp, Rattus norvegicus
agcctgtcgctatccatcagtacaa

SEQ ID NO: 130941 - DNA, 25 bp, Rattus norvegicus
agcctgtcggagcagcacatcagcg

SEQ ID NO: 130942 - DNA, 25 bp, Rattus norvegicus
agcctgtcggaggagcacatcagcg

SEQ ID NO: 130943 - DNA, 25 bp, Rattus norvegicus
agcctgtctacaccgctgttggtta

SEQ ID NO: 130944 - DNA, 25 bp, Rattus norvegicus
agcctgtctacagcgctgttggtta

SEQ ID NO: 130945 - DNA, 25 bp, Rattus norvegicus
agcctgtctcttcctatgtttatag

SEQ ID NO: 130946 - DNA, 25 bp, Rattus norvegicus
agcctgtctcttgctatgtttatag

SEQ ID NO: 130947 - DNA, 25 bp, Rattus norvegicus
agcctgtctggcctacatggtaatt

SEQ ID NO: 130948 - DNA, 25 bp, Rattus norvegicus
agcctgtctggcgtacatggtaatt

SEQ ID NO: 130949 - DNA, 25 bp, Rattus norvegicus
agcctgtctttaccctataccagtt

SEQ ID NO: 130950 - DNA, 25 bp, Rattus norvegicus
agcctgtctttagcctataccagtt

SEQ ID NO: 130951 - DNA, 25 bp, Rattus norvegicus
agcctgtgaagcagctgggactcaa

SEQ ID NO: 130952 - DNA, 25 bp, Rattus norvegicus
agcctgtgaagctgctgggactcaa

SEQ ID NO: 130953 - DNA, 25 bp, Rattus norvegicus
agcctgtgactgagaatgcctcgtg

SEQ ID NO: 130954 - DNA, 25 bp, Rattus norvegicus
agcctgtgactgtgaatgcctcgtg

SEQ ID NO: 130955 - DNA, 25 bp, Rattus norvegicus
agcctgtgcaagagttagctcctct

SEQ ID NO: 130956 - DNA, 25 bp, Rattus norvegicus
agcctgtgcaagtgttagctcctct

SEQ ID NO: 130957 - DNA, 25 bp, Rattus norvegicus
agcctgtgccaaaacccgcagagaa

SEQ ID NO: 130958 - DNA, 25 bp, Rattus norvegicus
agcctgtgccaatacccgcagagaa

SEQ ID NO: 130959 - DNA, 25 bp, Rattus norvegicus
agcctgtgccatatccaggattttg

SEQ ID NO: 130960 - DNA, 25 bp, Rattus norvegicus
agcctgtgccatttccaggattttg

SEQ ID NO: 130961 - DNA, 25 bp, Rattus norvegicus
agcctgtgcgctctggaagaagcta

SEQ ID NO: 130962 - DNA, 25 bp, Rattus norvegicus
agcctgtgcgctgtggaagaagcta

SEQ ID NO: 130963 - DNA, 25 bp, Rattus norvegicus
agcctgtgcggcaggactcgactgt

SEQ ID NO: 130964 - DNA, 25 bp, Rattus norvegicus
agcctgtgcggctggactcgactgt

SEQ ID NO: 130965 - DNA, 25 bp, Rattus norvegicus
agcctgtgctccacatgagagcggc

SEQ ID NO: 130966 - DNA, 25 bp, Rattus norvegicus
agcctgtgctcctcatgagagcggc

SEQ ID NO: 130967 - DNA, 25 bp, Rattus norvegicus
agcctgtgctgtcctgtcatcgaac

SEQ ID NO: 130968 - DNA, 25 bp, Rattus norvegicus
agcctgtgctgtgctgtcatcgaac

SEQ ID NO: 130969 - DNA, 25 bp, Rattus norvegicus
agcctgtggacaaccccactggata

SEQ ID NO: 130970 - DNA, 25 bp, Rattus norvegicus
agcctgtggacatccccactggata

SEQ ID NO: 130971 - DNA, 25 bp, Rattus norvegicus
agcctgtggcagaaaagagaaactt

SEQ ID NO: 130972 - DNA, 25 bp, Rattus norvegicus
agcctgtggcagtaaagagaaactt

SEQ ID NO: 130973 - DNA, 25 bp, Rattus norvegicus
agcctgtggccgctgtagaaccatt

SEQ ID NO: 130974 - DNA, 25 bp, Rattus norvegicus
agcctgtggccggtgtagaaccatt

SEQ ID NO: 130975 - DNA, 25 bp, Rattus norvegicus
agcctgtggctactagttccttgtg

SEQ ID NO: 130976 - DNA, 25 bp, Rattus norvegicus
agcctgtggctagtagttccttgtg

SEQ ID NO: 130977 - DNA, 25 bp, Rattus norvegicus
agcctgtgtacaacggcagctagtt

SEQ ID NO: 130978 - DNA, 25 bp, Rattus norvegicus
agcctgtgtacatcggcagctagtt

SEQ ID NO: 130979 - DNA, 25 bp, Rattus norvegicus
agcctgtgtaccagaaatctgtgac

SEQ ID NO: 130980 - DNA, 25 bp, Rattus norvegicus
agcctgtgtaccagtgactgtgatg

SEQ ID NO: 130981 - DNA, 25 bp, Rattus norvegicus
agcctgtgtacctgaaatctgtgac

SEQ ID NO: 130982 - DNA, 25 bp, Rattus norvegicus
agcctgtgtacctgtgactgtgatg

SEQ ID NO: 130983 - DNA, 25 bp, Rattus norvegicus
agcctgtgtatcatttctgggtacc

SEQ ID NO: 130984 - DNA, 25 bp, Rattus norvegicus
agcctgtgtatcttttctgggtacc

SEQ ID NO: 130985 - DNA, 25 bp, Rattus norvegicus
agcctgtgtcacagtcagtcatgat

SEQ ID NO: 130986 - DNA, 25 bp, Rattus norvegicus
agcctgtgtcactgtcagtcatgat

SEQ ID NO: 130987 - DNA, 25 bp, Rattus norvegicus
agcctgtgtcttattatcctttgaa

SEQ ID NO: 130988 - DNA, 25 bp, Rattus norvegicus
agcctgtgtctttttatcctttgaa

SEQ ID NO: 130989 - DNA, 25 bp, Rattus norvegicus
agcctgtgtgatctctgtgcgtgta

SEQ ID NO: 130990 - DNA, 25 bp, Rattus norvegicus
agcctgtgtgatgtctgtgcgtgta

SEQ ID NO: 130991 - DNA, 25 bp, Rattus norvegicus
agcctgtgtgctattaaatggtaca

SEQ ID NO: 130992 - DNA, 25 bp, Rattus norvegicus
agcctgtgtgcttttaaatggtaca

SEQ ID NO: 130993 - DNA, 25 bp, Rattus norvegicus
agcctgttccagagctgatgcctga

SEQ ID NO: 130994 - DNA, 25 bp, Rattus norvegicus
agcctgttccagcaagacgccaaag

SEQ ID NO: 130995 - DNA, 25 bp, Rattus norvegicus
agcctgttccaggaagacgccaaag

SEQ ID NO: 130996 - DNA, 25 bp, Rattus norvegicus
agcctgttccagtgctgatgcctga

SEQ ID NO: 130997 - DNA, 25 bp, Rattus norvegicus
agcctgttccttcgttacctgaata

SEQ ID NO: 130998 - DNA, 25 bp, Rattus norvegicus
agcctgttccttggttacctgaata

SEQ ID NO: 130999 - DNA, 25 bp, Rattus norvegicus
agcctgttcgccagtgcagagaatg

SEQ ID NO: 131000 - DNA, 25 bp, Rattus norvegicus
agcctgttcgcctgtgcagagaatg

SEQ ID NO: 131001 - DNA, 25 bp, Rattus norvegicus
agcctgttctatctgattgccatgt

SEQ ID NO: 131002 - DNA, 25 bp, Rattus norvegicus
agcctgttctatgtgattgccatgt

SEQ ID NO: 131003 - DNA, 25 bp, Rattus norvegicus
agcctgttctgcacggtaggaaatg

SEQ ID NO: 131004 - DNA, 25 bp, Rattus norvegicus
agcctgttctgcatctgggcaagga

SEQ ID NO: 131005 - DNA, 25 bp, Rattus norvegicus
agcctgttctgctcggtaggaaatg

SEQ ID NO: 131006 - DNA, 25 bp, Rattus norvegicus
agcctgttctgcttctgggcaagga

SEQ ID NO: 131007 - DNA, 25 bp, Rattus norvegicus
agcctgttcttccatctcttttatg

SEQ ID NO: 131008 - DNA, 25 bp, Rattus norvegicus
agcctgttcttcgatctcttttatg

SEQ ID NO: 131009 - DNA, 25 bp, Rattus norvegicus
agcctgttgacgcttgagggtccct

SEQ ID NO: 131010 - DNA, 25 bp, Rattus norvegicus
agcctgttgacggttgagggtccct

SEQ ID NO: 131011 - DNA, 25 bp, Rattus norvegicus
agcctgttgagcaggttctccaagg

SEQ ID NO: 131012 - DNA, 25 bp, Rattus norvegicus
agcctgttgagctggttctccaagg

SEQ ID NO: 131013 - DNA, 25 bp, Rattus norvegicus
agcctgttgattccttgtggatttt

SEQ ID NO: 131014 - DNA, 25 bp, Rattus norvegicus
agcctgttgattgcttgtggatttt

SEQ ID NO: 131015 - DNA, 25 bp, Rattus norvegicus
agcctgttgtctagtaatgttacca

SEQ ID NO: 131016 - DNA, 25 bp, Rattus norvegicus
agcctgttgtcttgtaatgttacca

SEQ ID NO: 131017 - DNA, 25 bp, Rattus norvegicus
agcctgttgtgactagcctgccatg

SEQ ID NO: 131018 - DNA, 25 bp, Rattus norvegicus
agcctgttgtgagtagcctgccatg

SEQ ID NO: 131019 - DNA, 25 bp, Rattus norvegicus
agcctgtttatgcttactggtcgcc

SEQ ID NO: 131020 - DNA, 25 bp, Rattus norvegicus
agcctgtttatggttactggtcgcc

SEQ ID NO: 131021 - DNA, 25 bp, Rattus norvegicus
agcctgtttctaagttatgagtcac

SEQ ID NO: 131022 - DNA, 25 bp, Rattus norvegicus
agcctgtttctacctgagactagat

SEQ ID NO: 131023 - DNA, 25 bp, Rattus norvegicus
agcctgtttctagctgagactagat

SEQ ID NO: 131024 - DNA, 25 bp, Rattus norvegicus
agcctgtttctatgttatgagtcac

SEQ ID NO: 131025 - DNA, 25 bp, Rattus norvegicus
agcctgtttctcctgcaaaatgtgg

SEQ ID NO: 131026 - DNA, 25 bp, Rattus norvegicus
agcctgtttctcgtgcaaaatgtgg

SEQ ID NO: 131027 - DNA, 25 bp, Rattus norvegicus
agcctgtttcttccttaagttcaca

SEQ ID NO: 131028 - DNA, 25 bp, Rattus norvegicus
agcctgtttcttgcttaagttcaca

SEQ ID NO: 131029 - DNA, 25 bp, Rattus norvegicus
agcctgtttgacaatagtgccacaa

SEQ ID NO: 131030 - DNA, 25 bp, Rattus norvegicus
agcctgtttgactatagtgccacaa

SEQ ID NO: 131031 - DNA, 25 bp, Rattus norvegicus
agcctgtttgctaccttttttgcat

SEQ ID NO: 131032 - DNA, 25 bp, Rattus norvegicus
agcctgtttgctatctttggagaag

SEQ ID NO: 131033 - DNA, 25 bp, Rattus norvegicus
agcctgtttgcttccttttttgcat

SEQ ID NO: 131034 - DNA, 25 bp, Rattus norvegicus
agcctgtttgctttctttggagaag

SEQ ID NO: 131035 - DNA, 25 bp, Rattus norvegicus
agccttaaaacaaagccgctgtctc

SEQ ID NO: 131036 - DNA, 25 bp, Rattus norvegicus
agccttaaaacatagccgctgtctc

SEQ ID NO: 131037 - DNA, 25 bp, Rattus norvegicus
agccttaaaaccaggctgcctgtga

SEQ ID NO: 131038 - DNA, 25 bp, Rattus norvegicus
agccttaaaacctggctgcctgtga

SEQ ID NO: 131039 - DNA, 25 bp, Rattus norvegicus
agccttaaacacagccttggcctaa

SEQ ID NO: 131040 - DNA, 25 bp, Rattus norvegicus
agccttaaacactgccttggcctaa

SEQ ID NO: 131041 - DNA, 25 bp, Rattus norvegicus
agccttaaactcagagacccactgt

SEQ ID NO: 131042 - DNA, 25 bp, Rattus norvegicus
agccttaaactctgagacccactgt

SEQ ID NO: 131043 - DNA, 25 bp, Rattus norvegicus
agccttaaccttactcctggaatga

SEQ ID NO: 131044 - DNA, 25 bp, Rattus norvegicus
agccttaacctttctcctggaatga

SEQ ID NO: 131045 - DNA, 25 bp, Rattus norvegicus
agccttaacgccagctcctggagat

SEQ ID NO: 131046 - DNA, 25 bp, Rattus norvegicus
agccttaacgcctgctcctggagat

SEQ ID NO: 131047 - DNA, 25 bp, Rattus norvegicus
agccttaacgttactttcagcacac

SEQ ID NO: 131048 - DNA, 25 bp, Rattus norvegicus
agccttaacgtttctttcagcacac

SEQ ID NO: 131049 - DNA, 25 bp, Rattus norvegicus
agccttaactgacctctactgacag

SEQ ID NO: 131050 - DNA, 25 bp, Rattus norvegicus
agccttaactgagctctactgacag

SEQ ID NO: 131051 - DNA, 25 bp, Rattus norvegicus
agccttaagccactacttctgtgaa

SEQ ID NO: 131052 - DNA, 25 bp, Rattus norvegicus
agccttaagccagtacttctgtgaa

SEQ ID NO: 131053 - DNA, 25 bp, Rattus norvegicus
agccttaagggcactactgcttgga

SEQ ID NO: 131054 - DNA, 25 bp, Rattus norvegicus
agccttaagggctctactgcttgga

SEQ ID NO: 131055 - DNA, 25 bp, Rattus norvegicus
agccttaatcctcggtgccatagat

SEQ ID NO: 131056 - DNA, 25 bp, Rattus norvegicus
agccttaatcctgggtgccatagat

SEQ ID NO: 131057 - DNA, 25 bp, Rattus norvegicus
agccttaatggcattctaacctgtc

SEQ ID NO: 131058 - DNA, 25 bp, Rattus norvegicus
agccttaatggctttctaacctgtc

SEQ ID NO: 131059 - DNA, 25 bp, Rattus norvegicus
agccttacacttcactccagtggga

SEQ ID NO: 131060 - DNA, 25 bp, Rattus norvegicus
agccttacacttgactccagtggga

SEQ ID NO: 131061 - DNA, 25 bp, Rattus norvegicus
agccttacagataatacggttggtc

SEQ ID NO: 131062 - DNA, 25 bp, Rattus norvegicus
agccttacagattatacggttggtc

SEQ ID NO: 131063 - DNA, 25 bp, Rattus norvegicus
agccttacatgaccattcagcctgc

SEQ ID NO: 131064 - DNA, 25 bp, Rattus norvegicus
agccttacatgagcattcagcctgc

SEQ ID NO: 131065 - DNA, 25 bp, Rattus norvegicus
agccttaccaggcaggctcctgctg

SEQ ID NO: 131066 - DNA, 25 bp, Rattus norvegicus
agccttaccagggaggctcctgctg

SEQ ID NO: 131067 - DNA, 25 bp, Rattus norvegicus
agccttaccctgaggagtctacaga

SEQ ID NO: 131068 - DNA, 25 bp, Rattus norvegicus
agccttaccctgtggagtctacaga

SEQ ID NO: 131069 - DNA, 25 bp, Rattus norvegicus
agccttacctcaccacttgtgatgg

SEQ ID NO: 131070 - DNA, 25 bp, Rattus norvegicus
agccttacctcagcacttgtgatgg

SEQ ID NO: 131071 - DNA, 25 bp, Rattus norvegicus
agccttactactcctaatcactgtc

SEQ ID NO: 131072 - DNA, 25 bp, Rattus norvegicus
agccttactactgctaatcactgtc

SEQ ID NO: 131073 - DNA, 25 bp, Rattus norvegicus
agccttagagctaatcaccagaaga

SEQ ID NO: 131074 - DNA, 25 bp, Rattus norvegicus
agccttagagcttatcaccagaaga

SEQ ID NO: 131075 - DNA, 25 bp, Rattus norvegicus
agccttagagttcggcttctagtca

SEQ ID NO: 131076 - DNA, 25 bp, Rattus norvegicus
agccttagagttgggcttctagtca

SEQ ID NO: 131077 - DNA, 25 bp, Rattus norvegicus
agccttagcagacctgggttcctgg

SEQ ID NO: 131078 - DNA, 25 bp, Rattus norvegicus
agccttagcagagctgggttcctgg

SEQ ID NO: 131079 - DNA, 25 bp, Rattus norvegicus
agccttagctcaacccattaattag

SEQ ID NO: 131080 - DNA, 25 bp, Rattus norvegicus
agccttagctcatcccattaattag

SEQ ID NO: 131081 - DNA, 25 bp, Rattus norvegicus
agccttagctctctacactgagtca

SEQ ID NO: 131082 - DNA, 25 bp, Rattus norvegicus
agccttagctctgtacactgagtca

SEQ ID NO: 131083 - DNA, 25 bp, Rattus norvegicus
agccttagcttcctgactcaaagca

SEQ ID NO: 131084 - DNA, 25 bp, Rattus norvegicus
agccttagcttcgtgactcaaagca

SEQ ID NO: 131085 - DNA, 25 bp, Rattus norvegicus
agccttaggctcctgttagacaaca

SEQ ID NO: 131086 - DNA, 25 bp, Rattus norvegicus
agccttaggctcgtgttagacaaca

SEQ ID NO: 131087 - DNA, 25 bp, Rattus norvegicus
agccttaggcttctctccatgggaa

SEQ ID NO: 131088 - DNA, 25 bp, Rattus norvegicus
agccttaggcttgtctccatgggaa

SEQ ID NO: 131089 - DNA, 25 bp, Rattus norvegicus
agccttaggttgctcaaagctggcc

SEQ ID NO: 131090 - DNA, 25 bp, Rattus norvegicus
agccttaggttggtcaaagctggcc

SEQ ID NO: 131091 - DNA, 25 bp, Rattus norvegicus
agccttagtccccagggcaaagcgc

SEQ ID NO: 131092 - DNA, 25 bp, Rattus norvegicus
agccttagtcccgagggcaaagcgc

SEQ ID NO: 131093 - DNA, 25 bp, Rattus norvegicus
agccttagtgtaccagctgactgtg

SEQ ID NO: 131094 - DNA, 25 bp, Rattus norvegicus
agccttagtgtagcagctgactgtg

SEQ ID NO: 131095 - DNA, 25 bp, Rattus norvegicus
agccttagttgacagctctagccta

SEQ ID NO: 131096 - DNA, 25 bp, Rattus norvegicus
agccttagttgagagctctagccta

SEQ ID NO: 131097 - DNA, 25 bp, Rattus norvegicus
agccttagtttcacattctgttgtc

SEQ ID NO: 131098 - DNA, 25 bp, Rattus norvegicus
agccttagtttctcattctgttgtc

SEQ ID NO: 131099 - DNA, 25 bp, Rattus norvegicus
agccttatccttaattctttcatag

SEQ ID NO: 131100 - DNA, 25 bp, Rattus norvegicus
agccttatcctttattctttcatag

SEQ ID NO: 131101 - DNA, 25 bp, Rattus norvegicus
agccttattaatactttgcctgaaa

SEQ ID NO: 131102 - DNA, 25 bp, Rattus norvegicus
agccttattaattctttgcctgaaa

SEQ ID NO: 131103 - DNA, 25 bp, Rattus norvegicus
agccttattctgaattgggaatgga

SEQ ID NO: 131104 - DNA, 25 bp, Rattus norvegicus
agccttattctgtattgggaatgga

SEQ ID NO: 131105 - DNA, 25 bp, Rattus norvegicus
agccttatttccatatctcataacc

SEQ ID NO: 131106 - DNA, 25 bp, Rattus norvegicus
agccttatttccttatctcataacc

SEQ ID NO: 131107 - DNA, 25 bp, Rattus norvegicus
agccttcaactcctgacaaaagaga

SEQ ID NO: 131108 - DNA, 25 bp, Rattus norvegicus
agccttcaactcgtgacaaaagaga

SEQ ID NO: 131109 - DNA, 25 bp, Rattus norvegicus
agccttcacagtattgtttctcctt

SEQ ID NO: 131110 - DNA, 25 bp, Rattus norvegicus
agccttcacagttttgtttctcctt

SEQ ID NO: 131111 - DNA, 25 bp, Rattus norvegicus
agccttcactggatttctttatgtt

SEQ ID NO: 131112 - DNA, 25 bp, Rattus norvegicus
agccttcactggttttctttatgtt

SEQ ID NO: 131113 - DNA, 25 bp, Rattus norvegicus
agccttcacttacctcagagcactt

SEQ ID NO: 131114 - DNA, 25 bp, Rattus norvegicus
agccttcacttagctcagagcactt

SEQ ID NO: 131115 - DNA, 25 bp, Rattus norvegicus
agccttcaggtcatgctgacagcaa

SEQ ID NO: 131116 - DNA, 25 bp, Rattus norvegicus
agccttcaggtcttgctgacagcaa

SEQ ID NO: 131117 - DNA, 25 bp, Rattus norvegicus
agccttcagtgacgatccgtgtgag

SEQ ID NO: 131118 - DNA, 25 bp, Rattus norvegicus
agccttcagtgaggatccgtgtgag

SEQ ID NO: 131119 - DNA, 25 bp, Rattus norvegicus
agccttcagtgcacttgccaagaaa

SEQ ID NO: 131120 - DNA, 25 bp, Rattus norvegicus
agccttcagtgctcttgccaagaaa

SEQ ID NO: 131121 - DNA, 25 bp, Rattus norvegicus
agccttcatacaaggtctgttgata

SEQ ID NO: 131122 - DNA, 25 bp, Rattus norvegicus
agccttcatacatggtctgttgata

SEQ ID NO: 131123 - DNA, 25 bp, Rattus norvegicus
agccttcatctgatctctatggcat

SEQ ID NO: 131124 - DNA, 25 bp, Rattus norvegicus
agccttcatctgttctctatggcat

SEQ ID NO: 131125 - DNA, 25 bp, Rattus norvegicus
agccttcatggccttggcggcatag

SEQ ID NO: 131126 - DNA, 25 bp, Rattus norvegicus
agccttcatggcgttggcggcatag

SEQ ID NO: 131127 - DNA, 25 bp, Rattus norvegicus
agccttcattttaatcttacaccta

SEQ ID NO: 131128 - DNA, 25 bp, Rattus norvegicus
agccttcatttttatcttacaccta

SEQ ID NO: 131129 - DNA, 25 bp, Rattus norvegicus
agccttccagacaggaaccccgaga

SEQ ID NO: 131130 - DNA, 25 bp, Rattus norvegicus
agccttccagactggaaccccgaga

SEQ ID NO: 131131 - DNA, 25 bp, Rattus norvegicus
agccttccagtgatcacacagcgta

SEQ ID NO: 131132 - DNA, 25 bp, Rattus norvegicus
agccttccagtgttcacacagcgta

SEQ ID NO: 131133 - DNA, 25 bp, Rattus norvegicus
agccttcccaaccaaaatagcctgg

SEQ ID NO: 131134 - DNA, 25 bp, Rattus norvegicus
agccttcccaacgaaaatagcctgg

SEQ ID NO: 131135 - DNA, 25 bp, Rattus norvegicus
agccttcccattctgtgcgcatgtg

SEQ ID NO: 131136 - DNA, 25 bp, Rattus norvegicus
agccttcccattgtgtgcgcatgtg

SEQ ID NO: 131137 - DNA, 25 bp, Rattus norvegicus
agccttccctttaatgcctgtgagt

SEQ ID NO: 131138 - DNA, 25 bp, Rattus norvegicus
agccttcccttttatgcctgtgagt

SEQ ID NO: 131139 - DNA, 25 bp, Rattus norvegicus
agccttccgtatcctggacttttga

SEQ ID NO: 131140 - DNA, 25 bp, Rattus norvegicus
agccttccgtatgctggacttttga

SEQ ID NO: 131141 - DNA, 25 bp, Rattus norvegicus
agccttcctagtcttgcaatccttg

SEQ ID NO: 131142 - DNA, 25 bp, Rattus norvegicus
agccttcctagtgttgcaatccttg

SEQ ID NO: 131143 - DNA, 25 bp, Rattus norvegicus
agccttcctccactcaaaagataaa

SEQ ID NO: 131144 - DNA, 25 bp, Rattus norvegicus
agccttcctccagtcaaaagataaa

SEQ ID NO: 131145 - DNA, 25 bp, Rattus norvegicus
agccttcctctcaatgttttgtgac

SEQ ID NO: 131146 - DNA, 25 bp, Rattus norvegicus
agccttcctctctatgttttgtgac

SEQ ID NO: 131147 - DNA, 25 bp, Rattus norvegicus
agccttcctcttagtatgcttttgg

SEQ ID NO: 131148 - DNA, 25 bp, Rattus norvegicus
agccttcctctttgtatgcttttgg

SEQ ID NO: 131149 - DNA, 25 bp, Rattus norvegicus
agccttcctgtcatgagcttggttt

SEQ ID NO: 131150 - DNA, 25 bp, Rattus norvegicus
agccttcctgtcttgagcttggttt

SEQ ID NO: 131151 - DNA, 25 bp, Rattus norvegicus
agccttccttccaaatattgatcat

SEQ ID NO: 131152 - DNA, 25 bp, Rattus norvegicus
agccttccttcctaatattgatcat

SEQ ID NO: 131153 - DNA, 25 bp, Rattus norvegicus
agccttccttgtcggtttgcacaga

SEQ ID NO: 131154 - DNA, 25 bp, Rattus norvegicus
agccttccttgtgggtttgcacaga

SEQ ID NO: 131155 - DNA, 25 bp, Rattus norvegicus
agccttcgagctcctccttagagaa

SEQ ID NO: 131156 - DNA, 25 bp, Rattus norvegicus
agccttcgagctgctccttagagaa

SEQ ID NO: 131157 - DNA, 25 bp, Rattus norvegicus
agccttctatctagccttgtcttaa

SEQ ID NO: 131158 - DNA, 25 bp, Rattus norvegicus
agccttctatcttgccttgtcttaa

SEQ ID NO: 131159 - DNA, 25 bp, Rattus norvegicus
agccttctcacgctgtgactgagca

SEQ ID NO: 131160 - DNA, 25 bp, Rattus norvegicus
agccttctcacggtgtgactgagca

SEQ ID NO: 131161 - DNA, 25 bp, Rattus norvegicus
agccttctcagaattggtgtgctga

SEQ ID NO: 131162 - DNA, 25 bp, Rattus norvegicus
agccttctcagatttggtgtgctga

SEQ ID NO: 131163 - DNA, 25 bp, Rattus norvegicus
agccttctccataccaatgaatgaa

SEQ ID NO: 131164 - DNA, 25 bp, Rattus norvegicus
agccttctccattccaatgaatgaa

SEQ ID NO: 131165 - DNA, 25 bp, Rattus norvegicus
agccttctcccacatgtattctgga

SEQ ID NO: 131166 - DNA, 25 bp, Rattus norvegicus
agccttctcccagatgtattctgga

SEQ ID NO: 131167 - DNA, 25 bp, Rattus norvegicus
agccttctccctctttgacaaggat

SEQ ID NO: 131168 - DNA, 25 bp, Rattus norvegicus
agccttctccctgtttgacaaggat

SEQ ID NO: 131169 - DNA, 25 bp, Rattus norvegicus
agccttctccgccatgggcatgggt

SEQ ID NO: 131170 - DNA, 25 bp, Rattus norvegicus
agccttctccgcgatgggcatgggt

SEQ ID NO: 131171 - DNA, 25 bp, Rattus norvegicus
agccttctcctacatgatggtgtgg

SEQ ID NO: 131172 - DNA, 25 bp, Rattus norvegicus
agccttctcctagatgatggtgtgg

SEQ ID NO: 131173 - DNA, 25 bp, Rattus norvegicus
agccttctcgataactgacgcgtag

SEQ ID NO: 131174 - DNA, 25 bp, Rattus norvegicus
agccttctcgattactgacgcgtag

SEQ ID NO: 131175 - DNA, 25 bp, Rattus norvegicus
agccttctctagaaaccttcagatg

SEQ ID NO: 131176 - DNA, 25 bp, Rattus norvegicus
agccttctctagtaaccttcagatg

SEQ ID NO: 131177 - DNA, 25 bp, Rattus norvegicus
agccttctctccagatgagctaaag

SEQ ID NO: 131178 - DNA, 25 bp, Rattus norvegicus
agccttctctcctgatgagctaaag

SEQ ID NO: 131179 - DNA, 25 bp, Rattus norvegicus
agccttctgacccaactacagtgct

SEQ ID NO: 131180 - DNA, 25 bp, Rattus norvegicus
agccttctgaccgaactacagtgct

SEQ ID NO: 131181 - DNA, 25 bp, Rattus norvegicus
agccttctgagtaattgggattcca

SEQ ID NO: 131182 - DNA, 25 bp, Rattus norvegicus
agccttctgagttattgggattcca

SEQ ID NO: 131183 - DNA, 25 bp, Rattus norvegicus
agccttctgcagatgcaacatcaga

SEQ ID NO: 131184 - DNA, 25 bp, Rattus norvegicus
agccttctgcagttgcaacatcaga

SEQ ID NO: 131185 - DNA, 25 bp, Rattus norvegicus
agccttctgcccaacctgtatgctg

SEQ ID NO: 131186 - DNA, 25 bp, Rattus norvegicus
agccttctgccctacctgtatgctg

SEQ ID NO: 131187 - DNA, 25 bp, Rattus norvegicus
agccttctggaaactgtcactacta

SEQ ID NO: 131188 - DNA, 25 bp, Rattus norvegicus
agccttctggaatctgtcactacta

SEQ ID NO: 131189 - DNA, 25 bp, Rattus norvegicus
agccttctggtgacacctgtagtta

SEQ ID NO: 131190 - DNA, 25 bp, Rattus norvegicus
agccttctggtgtcacctgtagtta

SEQ ID NO: 131191 - DNA, 25 bp, Rattus norvegicus
agccttctgtccaagacattcagaa

SEQ ID NO: 131192 - DNA, 25 bp, Rattus norvegicus
agccttctgtccaaggcataaggta

SEQ ID NO: 131193 - DNA, 25 bp, Rattus norvegicus
agccttctgtcctagacattcagaa

SEQ ID NO: 131194 - DNA, 25 bp, Rattus norvegicus
agccttctgtcctaggcataaggta

SEQ ID NO: 131195 - DNA, 25 bp, Rattus norvegicus
agccttcttactcctgcagaagctg

SEQ ID NO: 131196 - DNA, 25 bp, Rattus norvegicus
agccttcttactgctgcagaagctg

SEQ ID NO: 131197 - DNA, 25 bp, Rattus norvegicus
agccttcttagccacagggcgatgg

SEQ ID NO: 131198 - DNA, 25 bp, Rattus norvegicus
agccttcttagcgacagggcgatgg

SEQ ID NO: 131199 - DNA, 25 bp, Rattus norvegicus
agccttcttcaactaactctctgga

SEQ ID NO: 131200 - DNA, 25 bp, Rattus norvegicus
agccttcttcaagtaactctctgga

SEQ ID NO: 131201 - DNA, 25 bp, Rattus norvegicus
agccttcttcgtctaatatatttcc

SEQ ID NO: 131202 - DNA, 25 bp, Rattus norvegicus
agccttcttcgtgtaatatatttcc

SEQ ID NO: 131203 - DNA, 25 bp, Rattus norvegicus
agccttcttggcatttgtctagcta

SEQ ID NO: 131204 - DNA, 25 bp, Rattus norvegicus
agccttcttggcttttgtctagcta

SEQ ID NO: 131205 - DNA, 25 bp, Rattus norvegicus
agccttcttttaattatcttatctg

SEQ ID NO: 131206 - DNA, 25 bp, Rattus norvegicus
agccttcttttatttatcttatctg

SEQ ID NO: 131207 - DNA, 25 bp, Rattus norvegicus
agccttgaaagacctttccgactat

SEQ ID NO: 131208 - DNA, 25 bp, Rattus norvegicus
agccttgaaagagctttccgactat

SEQ ID NO: 131209 - DNA, 25 bp, Rattus norvegicus
agccttgaaattcctgaagtcctga

SEQ ID NO: 131210 - DNA, 25 bp, Rattus norvegicus
agccttgaaattgctgaagtcctga

SEQ ID NO: 131211 - DNA, 25 bp, Rattus norvegicus
agccttgaacaaacaccatcctgtt

SEQ ID NO: 131212 - DNA, 25 bp, Rattus norvegicus
agccttgaacaatcaccatcctgtt

SEQ ID NO: 131213 - DNA, 25 bp, Rattus norvegicus
agccttgaagtactgaatgtctaac

SEQ ID NO: 131214 - DNA, 25 bp, Rattus norvegicus
agccttgaagtagtgaatgtctaac

SEQ ID NO: 131215 - DNA, 25 bp, Rattus norvegicus
agccttgagcacactcggactcgga

SEQ ID NO: 131216 - DNA, 25 bp, Rattus norvegicus
agccttgagcactctcggactcgga

SEQ ID NO: 131217 - DNA, 25 bp, Rattus norvegicus
agccttgagcatatctgtcccctgg

SEQ ID NO: 131218 - DNA, 25 bp, Rattus norvegicus
agccttgagcatttctgtcccctgg

SEQ ID NO: 131219 - DNA, 25 bp, Rattus norvegicus
agccttgagccacaaaggtcctgat

SEQ ID NO: 131220 - DNA, 25 bp, Rattus norvegicus
agccttgagccagaaaggtcctgat

SEQ ID NO: 131221 - DNA, 25 bp, Rattus norvegicus
agccttgagctgactgatggccact

SEQ ID NO: 131222 - DNA, 25 bp, Rattus norvegicus
agccttgagctgtctgatggccact

SEQ ID NO: 131223 - DNA, 25 bp, Rattus norvegicus
agccttgatcaaagctgagctcgat

SEQ ID NO: 131224 - DNA, 25 bp, Rattus norvegicus
agccttgatcaatgctgagctcgat

SEQ ID NO: 131225 - DNA, 25 bp, Rattus norvegicus
agccttgatgagctcatacagtctc

SEQ ID NO: 131226 - DNA, 25 bp, Rattus norvegicus
agccttgatgaggtcatacagtctc

SEQ ID NO: 131227 - DNA, 25 bp, Rattus norvegicus
agccttgatgtacctattttcccct

SEQ ID NO: 131228 - DNA, 25 bp, Rattus norvegicus
agccttgatgtagctattttcccct

SEQ ID NO: 131229 - DNA, 25 bp, Rattus norvegicus
agccttgatttacagttctgctctc

SEQ ID NO: 131230 - DNA, 25 bp, Rattus norvegicus
agccttgatttagagttctgctctc

SEQ ID NO: 131231 - DNA, 25 bp, Rattus norvegicus
agccttgcccacacgtagtggactg

SEQ ID NO: 131232 - DNA, 25 bp, Rattus norvegicus
agccttgcccactcgtagtggactg

SEQ ID NO: 131233 - DNA, 25 bp, Rattus norvegicus
agccttgcccagaaccaggaagaaa

SEQ ID NO: 131234 - DNA, 25 bp, Rattus norvegicus
agccttgcccagtaccaggaagaaa

SEQ ID NO: 131235 - DNA, 25 bp, Rattus norvegicus
agccttgccggtctactgtaggatt

SEQ ID NO: 131236 - DNA, 25 bp, Rattus norvegicus
agccttgccggtgtactgtaggatt

SEQ ID NO: 131237 - DNA, 25 bp, Rattus norvegicus
agccttgcctttctaatttgacttc

SEQ ID NO: 131238 - DNA, 25 bp, Rattus norvegicus
agccttgcctttctagggcacagag

SEQ ID NO: 131239 - DNA, 25 bp, Rattus norvegicus
agccttgcctttgtaatttgacttc

SEQ ID NO: 131240 - DNA, 25 bp, Rattus norvegicus
agccttgcctttgtagggcacagag

SEQ ID NO: 131241 - DNA, 25 bp, Rattus norvegicus
agccttgctcatcaagccttgtgtg

SEQ ID NO: 131242 - DNA, 25 bp, Rattus norvegicus
agccttgctcatgaagccttgtgtg

SEQ ID NO: 131243 - DNA, 25 bp, Rattus norvegicus
agccttgctccccagatgcatggaa

SEQ ID NO: 131244 - DNA, 25 bp, Rattus norvegicus
agccttgctcccgagatgcatggaa

SEQ ID NO: 131245 - DNA, 25 bp, Rattus norvegicus
agccttgctgctattaagggcctta

SEQ ID NO: 131246 - DNA, 25 bp, Rattus norvegicus
agccttgctgcttttaagggcctta

SEQ ID NO: 131247 - DNA, 25 bp, Rattus norvegicus
agccttgctggaccggtgtttgaca

SEQ ID NO: 131248 - DNA, 25 bp, Rattus norvegicus
agccttgctggagcggtgtttgaca

SEQ ID NO: 131249 - DNA, 25 bp, Rattus norvegicus
agccttgcttgaagtgatgttttaa

SEQ ID NO: 131250 - DNA, 25 bp, Rattus norvegicus
agccttgcttgatgtgatgttttaa

SEQ ID NO: 131251 - DNA, 25 bp, Rattus norvegicus
agccttggcacgagcagttgggtac

SEQ ID NO: 131252 - DNA, 25 bp, Rattus norvegicus
agccttggcacgtgcagttgggtac

SEQ ID NO: 131253 - DNA, 25 bp, Rattus norvegicus
agccttggcagaccagtgtcagagt

SEQ ID NO: 131254 - DNA, 25 bp, Rattus norvegicus
agccttggcagagcagtgtcagagt

SEQ ID NO: 131255 - DNA, 25 bp, Rattus norvegicus
agccttggcagtctctcagaactga

SEQ ID NO: 131256 - DNA, 25 bp, Rattus norvegicus
agccttggcagtgtctcagaactga

SEQ ID NO: 131257 - DNA, 25 bp, Rattus norvegicus
agccttggccatctcctatgtgaat

SEQ ID NO: 131258 - DNA, 25 bp, Rattus norvegicus
agccttggccatgtcctatgtgaat

SEQ ID NO: 131259 - DNA, 25 bp, Rattus norvegicus
agccttggcctgcttgttcaagttc

SEQ ID NO: 131260 - DNA, 25 bp, Rattus norvegicus
agccttggcctggttgttcaagttc

SEQ ID NO: 131261 - DNA, 25 bp, Rattus norvegicus
agccttggccttcagaaactcagta

SEQ ID NO: 131262 - DNA, 25 bp, Rattus norvegicus
agccttggccttgagaaactcagta

SEQ ID NO: 131263 - DNA, 25 bp, Rattus norvegicus
agccttggcgctaggcataggagca

SEQ ID NO: 131264 - DNA, 25 bp, Rattus norvegicus
agccttggcgcttggcataggagca

SEQ ID NO: 131265 - DNA, 25 bp, Rattus norvegicus
agccttggctatctagtgagttctc

SEQ ID NO: 131266 - DNA, 25 bp, Rattus norvegicus
agccttggctatgtagtgagttctc

SEQ ID NO: 131267 - DNA, 25 bp, Rattus norvegicus
agccttggctgtcaagagttcacca

SEQ ID NO: 131268 - DNA, 25 bp, Rattus norvegicus
agccttggctgtgaagagttcacca

SEQ ID NO: 131269 - DNA, 25 bp, Rattus norvegicus
agccttgggcccagctgaggacaga

SEQ ID NO: 131270 - DNA, 25 bp, Rattus norvegicus
agccttgggccctgctgaggacaga

SEQ ID NO: 131271 - DNA, 25 bp, Rattus norvegicus
agccttggtcggaatcacacacaca

SEQ ID NO: 131272 - DNA, 25 bp, Rattus norvegicus
agccttggtcggtatcacacacaca

SEQ ID NO: 131273 - DNA, 25 bp, Rattus norvegicus
agccttggtctgactccaggagtta

SEQ ID NO: 131274 - DNA, 25 bp, Rattus norvegicus
agccttggtctgtctccaggagtta

SEQ ID NO: 131275 - DNA, 25 bp, Rattus norvegicus
agccttggtgttcaagtggccccag

SEQ ID NO: 131276 - DNA, 25 bp, Rattus norvegicus
agccttggtgttgaagtggccccag

SEQ ID NO: 131277 - DNA, 25 bp, Rattus norvegicus
agccttgtaagcctgtgttaactgt

SEQ ID NO: 131278 - DNA, 25 bp, Rattus norvegicus
agccttgtaagcgtgtgttaactgt

SEQ ID NO: 131279 - DNA, 25 bp, Rattus norvegicus
agccttgtaccgactgaccaaacct

SEQ ID NO: 131280 - DNA, 25 bp, Rattus norvegicus
agccttgtaccgtctgaccaaacct

SEQ ID NO: 131281 - DNA, 25 bp, Rattus norvegicus
agccttgtcataagatgccacctgg

SEQ ID NO: 131282 - DNA, 25 bp, Rattus norvegicus
agccttgtcatatgatgccacctgg

SEQ ID NO: 131283 - DNA, 25 bp, Rattus norvegicus
agccttgtccctctatagctagaag

SEQ ID NO: 131284 - DNA, 25 bp, Rattus norvegicus
agccttgtccctgtatagctagaag

SEQ ID NO: 131285 - DNA, 25 bp, Rattus norvegicus
agccttgtgcaaagttctctgagta

SEQ ID NO: 131286 - DNA, 25 bp, Rattus norvegicus
agccttgtgcaatgttctctgagta

SEQ ID NO: 131287 - DNA, 25 bp, Rattus norvegicus
agccttgtgggcagcaacatgttcc

SEQ ID NO: 131288 - DNA, 25 bp, Rattus norvegicus
agccttgtgggctgcaacatgttcc

SEQ ID NO: 131289 - DNA, 25 bp, Rattus norvegicus
agccttgtgtctaccaacagtctga

SEQ ID NO: 131290 - DNA, 25 bp, Rattus norvegicus
agccttgtgtctcttccttcatgaa

SEQ ID NO: 131291 - DNA, 25 bp, Rattus norvegicus
agccttgtgtctgttccttcatgaa

SEQ ID NO: 131292 - DNA, 25 bp, Rattus norvegicus
agccttgtgtcttccaacagtctga

SEQ ID NO: 131293 - DNA, 25 bp, Rattus norvegicus
agccttgttaagatttctgccactg

SEQ ID NO: 131294 - DNA, 25 bp, Rattus norvegicus
agccttgttaagttttctgccactg

SEQ ID NO: 131295 - DNA, 25 bp, Rattus norvegicus
agccttgttactccagcttccataa

SEQ ID NO: 131296 - DNA, 25 bp, Rattus norvegicus
agccttgttactgcagcttccataa

SEQ ID NO: 131297 - DNA, 25 bp, Rattus norvegicus
agccttgttggccttgtctgcaaag

SEQ ID NO: 131298 - DNA, 25 bp, Rattus norvegicus
agccttgttggcgttgtctgcaaag

SEQ ID NO: 131299 - DNA, 25 bp, Rattus norvegicus
agccttgtttttccctatttcagaa

SEQ ID NO: 131300 - DNA, 25 bp, Rattus norvegicus
agccttgtttttgcctatttcagaa

SEQ ID NO: 131301 - DNA, 25 bp, Rattus norvegicus
agcctttaagttagccacagtctgg

SEQ ID NO: 131302 - DNA, 25 bp, Rattus norvegicus
agcctttaagtttgccacagtctgg

SEQ ID NO: 131303 - DNA, 25 bp, Rattus norvegicus
agcctttaatctatgagcctcagca

SEQ ID NO: 131304 - DNA, 25 bp, Rattus norvegicus
agcctttaatctttgagcctcagca

SEQ ID NO: 131305 - DNA, 25 bp, Rattus norvegicus
agcctttacaatatttccctgaaca

SEQ ID NO: 131306 - DNA, 25 bp, Rattus norvegicus
agcctttacaatttttccctgaaca

SEQ ID NO: 131307 - DNA, 25 bp, Rattus norvegicus
agcctttacacccttgaatgtttca

SEQ ID NO: 131308 - DNA, 25 bp, Rattus norvegicus
agcctttacaccgttgaatgtttca

SEQ ID NO: 131309 - DNA, 25 bp, Rattus norvegicus
agcctttacccgagaattctgttag

SEQ ID NO: 131310 - DNA, 25 bp, Rattus norvegicus
agcctttacccgtgaattctgttag

SEQ ID NO: 131311 - DNA, 25 bp, Rattus norvegicus
agcctttacttcaaccactgactgt

SEQ ID NO: 131312 - DNA, 25 bp, Rattus norvegicus
agcctttacttctaccactgactgt

SEQ ID NO: 131313 - DNA, 25 bp, Rattus norvegicus
agcctttagcacactagccttcttt

SEQ ID NO: 131314 - DNA, 25 bp, Rattus norvegicus
agcctttagcactctagccttcttt

SEQ ID NO: 131315 - DNA, 25 bp, Rattus norvegicus
agcctttaggaacagcagctctatg

SEQ ID NO: 131316 - DNA, 25 bp, Rattus norvegicus
agcctttaggaagagcagctctatg

SEQ ID NO: 131317 - DNA, 25 bp, Rattus norvegicus
agcctttatagccaagtagccccgt

SEQ ID NO: 131318 - DNA, 25 bp, Rattus norvegicus
agcctttatagcgaagtagccccgt

SEQ ID NO: 131319 - DNA, 25 bp, Rattus norvegicus
agcctttatatccatgccttgtgtt

SEQ ID NO: 131320 - DNA, 25 bp, Rattus norvegicus
agcctttatatcgatgccttgtgtt

SEQ ID NO: 131321 - DNA, 25 bp, Rattus norvegicus
agcctttatgccacatggttgttaa

SEQ ID NO: 131322 - DNA, 25 bp, Rattus norvegicus
agcctttatgcctcatggttgttaa

SEQ ID NO: 131323 - DNA, 25 bp, Rattus norvegicus
agcctttattcactgaactctgccc

SEQ ID NO: 131324 - DNA, 25 bp, Rattus norvegicus
agcctttattcagtgaactctgccc

SEQ ID NO: 131325 - DNA, 25 bp, Rattus norvegicus
agcctttcactcaggatcaccgtgg

SEQ ID NO: 131326 - DNA, 25 bp, Rattus norvegicus
agcctttcactctggatcaccgtgg

SEQ ID NO: 131327 - DNA, 25 bp, Rattus norvegicus
agcctttcagaccagtaagacttca

SEQ ID NO: 131328 - DNA, 25 bp, Rattus norvegicus
agcctttcagacgagtaagacttca

SEQ ID NO: 131329 - DNA, 25 bp, Rattus norvegicus
agcctttcagggagcatcgtgtgtt

SEQ ID NO: 131330 - DNA, 25 bp, Rattus norvegicus
agcctttcagggtgcatcgtgtgtt

SEQ ID NO: 131331 - DNA, 25 bp, Rattus norvegicus
agcctttccataccacaaacaagac

SEQ ID NO: 131332 - DNA, 25 bp, Rattus norvegicus
agcctttccatagcacaaacaagac

SEQ ID NO: 131333 - DNA, 25 bp, Rattus norvegicus
agcctttcccaaatctccatagaga

SEQ ID NO: 131334 - DNA, 25 bp, Rattus norvegicus
agcctttcccaattctccatagaga

SEQ ID NO: 131335 - DNA, 25 bp, Rattus norvegicus
agcctttccccacagaggcacaaag

SEQ ID NO: 131336 - DNA, 25 bp, Rattus norvegicus
agcctttccccagagaggcacaaag

SEQ ID NO: 131337 - DNA, 25 bp, Rattus norvegicus
agcctttccctgagcctgaggtgag

SEQ ID NO: 131338 - DNA, 25 bp, Rattus norvegicus
agcctttccctgtgcctgaggtgag

SEQ ID NO: 131339 - DNA, 25 bp, Rattus norvegicus
agcctttcccttcttgaattcttag

SEQ ID NO: 131340 - DNA, 25 bp, Rattus norvegicus
agcctttcccttgttgaattcttag

SEQ ID NO: 131341 - DNA, 25 bp, Rattus norvegicus
agcctttccgacacagacgtttgat

SEQ ID NO: 131342 - DNA, 25 bp, Rattus norvegicus
agcctttccgactcagacgtttgat

SEQ ID NO: 131343 - DNA, 25 bp, Rattus norvegicus
agcctttcctctccaaatttcatat

SEQ ID NO: 131344 - DNA, 25 bp, Rattus norvegicus
agcctttcctctgcaaatttcatat

SEQ ID NO: 131345 - DNA, 25 bp, Rattus norvegicus
agcctttcctggagcagactactga

SEQ ID NO: 131346 - DNA, 25 bp, Rattus norvegicus
agcctttcctggtgcagactactga

SEQ ID NO: 131347 - DNA, 25 bp, Rattus norvegicus
agcctttcctgtcaactcaacagtt

SEQ ID NO: 131348 - DNA, 25 bp, Rattus norvegicus
agcctttcctgtgaactcaacagtt

SEQ ID NO: 131349 - DNA, 25 bp, Rattus norvegicus
agcctttcctttcgacttctgtctt

SEQ ID NO: 131350 - DNA, 25 bp, Rattus norvegicus
agcctttcctttggacttctgtctt

SEQ ID NO: 131351 - DNA, 25 bp, Rattus norvegicus
agcctttcgattatgaccccaatga

SEQ ID NO: 131352 - DNA, 25 bp, Rattus norvegicus
agcctttcgattttgaccccaatga

SEQ ID NO: 131353 - DNA, 25 bp, Rattus norvegicus
agcctttctcggaagtcatctgtgg

SEQ ID NO: 131354 - DNA, 25 bp, Rattus norvegicus
agcctttctcggtagtcatctgtgg

SEQ ID NO: 131355 - DNA, 25 bp, Rattus norvegicus
agcctttctctcacaaggaaaccta

SEQ ID NO: 131356 - DNA, 25 bp, Rattus norvegicus
agcctttctctctcaaggaaaccta

SEQ ID NO: 131357 - DNA, 25 bp, Rattus norvegicus
agcctttctcttctttcataaactg

SEQ ID NO: 131358 - DNA, 25 bp, Rattus norvegicus
agcctttctcttgtttcataaactg

SEQ ID NO: 131359 - DNA, 25 bp, Rattus norvegicus
agcctttctggtcctccctagaggg

SEQ ID NO: 131360 - DNA, 25 bp, Rattus norvegicus
agcctttctggtcctgtgtctctaa

SEQ ID NO: 131361 - DNA, 25 bp, Rattus norvegicus
agcctttctggtctggacaagtctt

SEQ ID NO: 131362 - DNA, 25 bp, Rattus norvegicus
agcctttctggtgctccctagaggg

SEQ ID NO: 131363 - DNA, 25 bp, Rattus norvegicus
agcctttctggtgctgtgtctctaa

SEQ ID NO: 131364 - DNA, 25 bp, Rattus norvegicus
agcctttctggtgtggacaagtctt

SEQ ID NO: 131365 - DNA, 25 bp, Rattus norvegicus
agcctttctgtcatgacacacaagt

SEQ ID NO: 131366 - DNA, 25 bp, Rattus norvegicus
agcctttctgtcttgacacacaagt

SEQ ID NO: 131367 - DNA, 25 bp, Rattus norvegicus
agcctttcttagagcctatgtggaa

SEQ ID NO: 131368 - DNA, 25 bp, Rattus norvegicus
agcctttcttagtgcctatgtggaa

SEQ ID NO: 131369 - DNA, 25 bp, Rattus norvegicus
agcctttcttccatagcagacgtaa

SEQ ID NO: 131370 - DNA, 25 bp, Rattus norvegicus
agcctttcttccttagcagacgtaa

SEQ ID NO: 131371 - DNA, 25 bp, Rattus norvegicus
agcctttcttttcaatcaacctctc

SEQ ID NO: 131372 - DNA, 25 bp, Rattus norvegicus
agcctttcttttgaatcaacctctc

SEQ ID NO: 131373 - DNA, 25 bp, Rattus norvegicus
agcctttgaagacagctctttggag

SEQ ID NO: 131374 - DNA, 25 bp, Rattus norvegicus
agcctttgaagagagctctttggag

SEQ ID NO: 131375 - DNA, 25 bp, Rattus norvegicus
agcctttgaagtccctatgattcta

SEQ ID NO: 131376 - DNA, 25 bp, Rattus norvegicus
agcctttgaagtgcctatgattcta

SEQ ID NO: 131377 - DNA, 25 bp, Rattus norvegicus
agcctttgagttccagtcaccatga

SEQ ID NO: 131378 - DNA, 25 bp, Rattus norvegicus
agcctttgagttgcagtcaccatga

SEQ ID NO: 131379 - DNA, 25 bp, Rattus norvegicus
agcctttgcaaaagctacgacctct

SEQ ID NO: 131380 - DNA, 25 bp, Rattus norvegicus
agcctttgcaaatgctacgacctct

SEQ ID NO: 131381 - DNA, 25 bp, Rattus norvegicus
agcctttgcagtactccaggcggag

SEQ ID NO: 131382 - DNA, 25 bp, Rattus norvegicus
agcctttgcagttctccaggcggag

SEQ ID NO: 131383 - DNA, 25 bp, Rattus norvegicus
agcctttgcataaactctctcagta

SEQ ID NO: 131384 - DNA, 25 bp, Rattus norvegicus
agcctttgcatatactctctcagta

SEQ ID NO: 131385 - DNA, 25 bp, Rattus norvegicus
agcctttgccagagtctccagatgg

SEQ ID NO: 131386 - DNA, 25 bp, Rattus norvegicus
agcctttgccagtgtctccagatgg

SEQ ID NO: 131387 - DNA, 25 bp, Rattus norvegicus
agcctttgcgtgagactgatgttac

SEQ ID NO: 131388 - DNA, 25 bp, Rattus norvegicus
agcctttgcgtgtgactgatgttac

SEQ ID NO: 131389 - DNA, 25 bp, Rattus norvegicus
agcctttggaacacactctagcaat

SEQ ID NO: 131390 - DNA, 25 bp, Rattus norvegicus
agcctttggaactcactctagcaat

SEQ ID NO: 131391 - DNA, 25 bp, Rattus norvegicus
agcctttgggatcatttgttgttac

SEQ ID NO: 131392 - DNA, 25 bp, Rattus norvegicus
agcctttgggatgatttgttgttac

SEQ ID NO: 131393 - DNA, 25 bp, Rattus norvegicus
agcctttgggctatgtactgtactt

SEQ ID NO: 131394 - DNA, 25 bp, Rattus norvegicus
agcctttgggctttgtactgtactt

SEQ ID NO: 131395 - DNA, 25 bp, Rattus norvegicus
agcctttggtaccttgctcagaagc

SEQ ID NO: 131396 - DNA, 25 bp, Rattus norvegicus
agcctttggtacgttgctcagaagc

SEQ ID NO: 131397 - DNA, 25 bp, Rattus norvegicus
agcctttgtaagattcctctcagat

SEQ ID NO: 131398 - DNA, 25 bp, Rattus norvegicus
agcctttgtaagtttcctctcagat

SEQ ID NO: 131399 - DNA, 25 bp, Rattus norvegicus
agcctttgtcacagctgcccggact

SEQ ID NO: 131400 - DNA, 25 bp, Rattus norvegicus
agcctttgtcacatgtccgaacgaa

SEQ ID NO: 131401 - DNA, 25 bp, Rattus norvegicus
agcctttgtcactgctgcccggact

SEQ ID NO: 131402 - DNA, 25 bp, Rattus norvegicus
agcctttgtcacttgtccgaacgaa

SEQ ID NO: 131403 - DNA, 25 bp, Rattus norvegicus
agcctttgtcatatcatcttagcgt

SEQ ID NO: 131404 - DNA, 25 bp, Rattus norvegicus
agcctttgtcatttcatcttagcgt

SEQ ID NO: 131405 - DNA, 25 bp, Rattus norvegicus
agcctttgtgaaacttgctattaca

SEQ ID NO: 131406 - DNA, 25 bp, Rattus norvegicus
agcctttgtgaatcttgctattaca

SEQ ID NO: 131407 - DNA, 25 bp, Rattus norvegicus
agcctttgttctccacttaataaaa

SEQ ID NO: 131408 - DNA, 25 bp, Rattus norvegicus
agcctttgttctgcacttaataaaa

SEQ ID NO: 131409 - DNA, 25 bp, Rattus norvegicus
agcctttgttttcgatctactcatg

SEQ ID NO: 131410 - DNA, 25 bp, Rattus norvegicus
agcctttgttttggatctactcatg

SEQ ID NO: 131411 - DNA, 25 bp, Rattus norvegicus
agccttttcccaagtcacaagcttg

SEQ ID NO: 131412 - DNA, 25 bp, Rattus norvegicus
agccttttcccatgtcacaagcttg

SEQ ID NO: 131413 - DNA, 25 bp, Rattus norvegicus
agccttttcctcagaacccttggat

SEQ ID NO: 131414 - DNA, 25 bp, Rattus norvegicus
agccttttcctctgaacccttggat

SEQ ID NO: 131415 - DNA, 25 bp, Rattus norvegicus
agccttttctgcatgagaccctgga

SEQ ID NO: 131416 - DNA, 25 bp, Rattus norvegicus
agccttttctgcttgagaccctgga

SEQ ID NO: 131417 - DNA, 25 bp, Rattus norvegicus
agccttttgaaacctgctgaccctt

SEQ ID NO: 131418 - DNA, 25 bp, Rattus norvegicus
agccttttgaaagctgctgaccctt

SEQ ID NO: 131419 - DNA, 25 bp, Rattus norvegicus
agccttttgcaaactggtgggataa

SEQ ID NO: 131420 - DNA, 25 bp, Rattus norvegicus
agccttttgcaatctggtgggataa

SEQ ID NO: 131421 - DNA, 25 bp, Rattus norvegicus
agccttttggctacagtggttcaat

SEQ ID NO: 131422 - DNA, 25 bp, Rattus norvegicus
agccttttggctctggtacactttc

SEQ ID NO: 131423 - DNA, 25 bp, Rattus norvegicus
agccttttggctgtggtacactttc

SEQ ID NO: 131424 - DNA, 25 bp, Rattus norvegicus
agccttttggcttcagtggttcaat

SEQ ID NO: 131425 - DNA, 25 bp, Rattus norvegicus
agccttttgggtattcattgccaca

SEQ ID NO: 131426 - DNA, 25 bp, Rattus norvegicus
agccttttgggttttcattgccaca

SEQ ID NO: 131427 - DNA, 25 bp, Rattus norvegicus
agccttttgtggctctctgcctata

SEQ ID NO: 131428 - DNA, 25 bp, Rattus norvegicus
agccttttgtgggtctctgcctata

SEQ ID NO: 131429 - DNA, 25 bp, Rattus norvegicus
agccttttgttgatcttttgccaga

SEQ ID NO: 131430 - DNA, 25 bp, Rattus norvegicus
agccttttgttgttcttttgccaga

SEQ ID NO: 131431 - DNA, 25 bp, Rattus norvegicus
agcctttttactcattgcttggaag

SEQ ID NO: 131432 - DNA, 25 bp, Rattus norvegicus
agcctttttactgattgcttggaag

SEQ ID NO: 131433 - DNA, 25 bp, Rattus norvegicus
agcctttttagtcactcccaggaat

SEQ ID NO: 131434 - DNA, 25 bp, Rattus norvegicus
agcctttttagtgactcccaggaat

SEQ ID NO: 131435 - DNA, 25 bp, Rattus norvegicus
agcctttttcagagagtacgcccca

SEQ ID NO: 131436 - DNA, 25 bp, Rattus norvegicus
agcctttttcagtgagtacgcccca

SEQ ID NO: 131437 - DNA, 25 bp, Rattus norvegicus
agcctttttgctctactctttatga

SEQ ID NO: 131438 - DNA, 25 bp, Rattus norvegicus
agcctttttgctgtactctttatga

SEQ ID NO: 131439 - DNA, 25 bp, Rattus norvegicus
agcgaaaacgagagcccgatgacga

SEQ ID NO: 131440 - DNA, 25 bp, Rattus norvegicus
agcgaaaacgagtgcccgatgacga

SEQ ID NO: 131441 - DNA, 25 bp, Rattus norvegicus
agcgaaactgttacaggtccctgag

SEQ ID NO: 131442 - DNA, 25 bp, Rattus norvegicus
agcgaaactgtttcaggtccctgag

SEQ ID NO: 131443 - DNA, 25 bp, Rattus norvegicus
agcgaaagggcaagcacgttctctt

SEQ ID NO: 131444 - DNA, 25 bp, Rattus norvegicus
agcgaaagggcatgcacgttctctt

SEQ ID NO: 131445 - DNA, 25 bp, Rattus norvegicus
agcgaacatcgaccctgcggaagct

SEQ ID NO: 131446 - DNA, 25 bp, Rattus norvegicus
agcgaacatcgagcctgcggaagct

SEQ ID NO: 131447 - DNA, 25 bp, Rattus norvegicus
agcgaaccaattcctggagggccct

SEQ ID NO: 131448 - DNA, 25 bp, Rattus norvegicus
agcgaaccaattgctggagggccct

SEQ ID NO: 131449 - DNA, 25 bp, Rattus norvegicus
agcgaaccattcaggactttccaag

SEQ ID NO: 131450 - DNA, 25 bp, Rattus norvegicus
agcgaaccattctggactttccaag

SEQ ID NO: 131451 - DNA, 25 bp, Rattus norvegicus
agcgaaccccagctttgggactgat

SEQ ID NO: 131452 - DNA, 25 bp, Rattus norvegicus
agcgaaccccaggtttgggactgat

SEQ ID NO: 131453 - DNA, 25 bp, Rattus norvegicus
agcgaaccgggacagcttcttgctt

SEQ ID NO: 131454 - DNA, 25 bp, Rattus norvegicus
agcgaaccgggagagcttcttgctt

SEQ ID NO: 131455 - DNA, 25 bp, Rattus norvegicus
agcgaacgggttcctaggatgctct

SEQ ID NO: 131456 - DNA, 25 bp, Rattus norvegicus
agcgaacgggttgctaggatgctct

SEQ ID NO: 131457 - DNA, 25 bp, Rattus norvegicus
agcgaacttgcaccttgtgtcctgt

SEQ ID NO: 131458 - DNA, 25 bp, Rattus norvegicus
agcgaacttgcagcttgtgtcctgt

SEQ ID NO: 131459 - DNA, 25 bp, Rattus norvegicus
agcgaagaaggaagctcctgcccct

SEQ ID NO: 131460 - DNA, 25 bp, Rattus norvegicus
agcgaagaaggatgctcctgcccct

SEQ ID NO: 131461 - DNA, 25 bp, Rattus norvegicus
agcgaagagtgtcctccaccaatgg

SEQ ID NO: 131462 - DNA, 25 bp, Rattus norvegicus
agcgaagagtgtgctccaccaatgg

SEQ ID NO: 131463 - DNA, 25 bp, Rattus norvegicus
agcgaagatagtcctctccattgaa

SEQ ID NO: 131464 - DNA, 25 bp, Rattus norvegicus
agcgaagatagtgctctccattgaa

SEQ ID NO: 131465 - DNA, 25 bp, Rattus norvegicus
agcgaagatcttccagacttccctc

SEQ ID NO: 131466 - DNA, 25 bp, Rattus norvegicus
agcgaagatcttgcagacttccctc

SEQ ID NO: 131467 - DNA, 25 bp, Rattus norvegicus
agcgaagcagatcttactcgacctt

SEQ ID NO: 131468 - DNA, 25 bp, Rattus norvegicus
agcgaagcagatgttactcgacctt

SEQ ID NO: 131469 - DNA, 25 bp, Rattus norvegicus
agcgaagccctcctatatgtgacag

SEQ ID NO: 131470 - DNA, 25 bp, Rattus norvegicus
agcgaagccctcgtatatgtgacag

SEQ ID NO: 131471 - DNA, 25 bp, Rattus norvegicus
agcgaagcgacacggctcacagaag

SEQ ID NO: 131472 - DNA, 25 bp, Rattus norvegicus
agcgaagcgacagggctcacagaag

SEQ ID NO: 131473 - DNA, 25 bp, Rattus norvegicus
agcgaagcggtgaggttgtcgtgat

SEQ ID NO: 131474 - DNA, 25 bp, Rattus norvegicus
agcgaagcggtgtggttgtcgtgat

SEQ ID NO: 131475 - DNA, 25 bp, Rattus norvegicus
agcgaaggcacacgcaggtgcatct

SEQ ID NO: 131476 - DNA, 25 bp, Rattus norvegicus
agcgaaggcacaggcaggtgcatct

SEQ ID NO: 131477 - DNA, 25 bp, Rattus norvegicus
agcgaaggcggcagaacttacagga

SEQ ID NO: 131478 - DNA, 25 bp, Rattus norvegicus
agcgaaggcggctgaacttacagga

SEQ ID NO: 131479 - DNA, 25 bp, Rattus norvegicus
agcgaagtgcttaaaacctgccctg

SEQ ID NO: 131480 - DNA, 25 bp, Rattus norvegicus
agcgaagtgctttaaacctgccctg

SEQ ID NO: 131481 - DNA, 25 bp, Rattus norvegicus
agcgaagtggcaattccttgaacaa

SEQ ID NO: 131482 - DNA, 25 bp, Rattus norvegicus
agcgaagtggcatttccttgaacaa

SEQ ID NO: 131483 - DNA, 25 bp, Rattus norvegicus
agcgaagttccccagagacccaata

SEQ ID NO: 131484 - DNA, 25 bp, Rattus norvegicus
agcgaagttcccgagagacccaata

SEQ ID NO: 131485 - DNA, 25 bp, Rattus norvegicus
agcgaatcaagccttctcaccagaa

SEQ ID NO: 131486 - DNA, 25 bp, Rattus norvegicus
agcgaatcaagcgttctcaccagaa

SEQ ID NO: 131487 - DNA, 25 bp, Rattus norvegicus
agcgaatcagcgactggtcactcta

SEQ ID NO: 131488 - DNA, 25 bp, Rattus norvegicus
agcgaatcagcgtctggtcactcta

SEQ ID NO: 131489 - DNA, 25 bp, Rattus norvegicus
agcgaatcctcactgccaagtagaa

SEQ ID NO: 131490 - DNA, 25 bp, Rattus norvegicus
agcgaatcctcagtgccaagtagaa

SEQ ID NO: 131491 - DNA, 25 bp, Rattus norvegicus
agcgaatcgggtcccagtggctcat

SEQ ID NO: 131492 - DNA, 25 bp, Rattus norvegicus
agcgaatcgggtgccagtggctcat

SEQ ID NO: 131493 - DNA, 25 bp, Rattus norvegicus
agcgaatctcttcctatgataatga

SEQ ID NO: 131494 - DNA, 25 bp, Rattus norvegicus
agcgaatctcttgctatgataatga

SEQ ID NO: 131495 - DNA, 25 bp, Rattus norvegicus
agcgaatgtgcaatggaccctcttt

SEQ ID NO: 131496 - DNA, 25 bp, Rattus norvegicus
agcgaatgtgcattggaccctcttt

SEQ ID NO: 131497 - DNA, 25 bp, Rattus norvegicus
agcgaattcaccagatggcggccaa

SEQ ID NO: 131498 - DNA, 25 bp, Rattus norvegicus
agcgaattcacctgatggcggccaa

SEQ ID NO: 131499 - DNA, 25 bp, Rattus norvegicus
agcgaattgattcttacctccaagg

SEQ ID NO: 131500 - DNA, 25 bp, Rattus norvegicus
agcgaattgattgttacctccaagg

SEQ ID NO: 131501 - DNA, 25 bp, Rattus norvegicus
agcgaattggctatgctgtcagcgc

SEQ ID NO: 131502 - DNA, 25 bp, Rattus norvegicus
agcgaattggctttgctgtcagcgc

SEQ ID NO: 131503 - DNA, 25 bp, Rattus norvegicus
agcgacaaaccccaagacttcatgg

SEQ ID NO: 131504 - DNA, 25 bp, Rattus norvegicus
agcgacaaacccgaagacttcatgg

SEQ ID NO: 131505 - DNA, 25 bp, Rattus norvegicus
agcgacaacccacggaacggtagca

SEQ ID NO: 131506 - DNA, 25 bp, Rattus norvegicus
agcgacaacccagggaacggtagca

SEQ ID NO: 131507 - DNA, 25 bp, Rattus norvegicus
agcgacaatgtcactgatacagtgg

SEQ ID NO: 131508 - DNA, 25 bp, Rattus norvegicus
agcgacaatgtctctgatacagtgg

SEQ ID NO: 131509 - DNA, 25 bp, Rattus norvegicus
agcgacacccacatgtgtgtaatat

SEQ ID NO: 131510 - DNA, 25 bp, Rattus norvegicus
agcgacacccacttgtgtgtaatat

SEQ ID NO: 131511 - DNA, 25 bp, Rattus norvegicus
agcgacagacaacaccaagcgggaa

SEQ ID NO: 131512 - DNA, 25 bp, Rattus norvegicus
agcgacagacaagaccaagcgggaa

SEQ ID NO: 131513 - DNA, 25 bp, Rattus norvegicus
agcgacagatgcatcattttgtgaa

SEQ ID NO: 131514 - DNA, 25 bp, Rattus norvegicus
agcgacagatgcttcattttgtgaa

SEQ ID NO: 131515 - DNA, 25 bp, Rattus norvegicus
agcgacagctccctgacaccaagga

SEQ ID NO: 131516 - DNA, 25 bp, Rattus norvegicus
agcgacagctccgtgacaccaagga

SEQ ID NO: 131517 - DNA, 25 bp, Rattus norvegicus
agcgacataggtctggtgatcccac

SEQ ID NO: 131518 - DNA, 25 bp, Rattus norvegicus
agcgacataggtgtggtgatcccac

SEQ ID NO: 131519 - DNA, 25 bp, Rattus norvegicus
agcgacatgtacacttaaccactaa

SEQ ID NO: 131520 - DNA, 25 bp, Rattus norvegicus
agcgacatgtactcttaaccactaa

SEQ ID NO: 131521 - DNA, 25 bp, Rattus norvegicus
agcgacctgtgaaactgtgaacttt

SEQ ID NO: 131522 - DNA, 25 bp, Rattus norvegicus
agcgacctgtgatactgtgaacttt

SEQ ID NO: 131523 - DNA, 25 bp, Rattus norvegicus
agcgaccttcttccacagtgtgtat

SEQ ID NO: 131524 - DNA, 25 bp, Rattus norvegicus
agcgaccttcttgcacagtgtgtat

SEQ ID NO: 131525 - DNA, 25 bp, Rattus norvegicus
agcgacggcagcacttcgtgcggca

SEQ ID NO: 131526 - DNA, 25 bp, Rattus norvegicus
agcgacggcagctcttcgtgcggca

SEQ ID NO: 131527 - DNA, 25 bp, Rattus norvegicus
agcgacggtcagcagttttctaact

SEQ ID NO: 131528 - DNA, 25 bp, Rattus norvegicus
agcgacggtcaggagttttctaact

SEQ ID NO: 131529 - DNA, 25 bp, Rattus norvegicus
agcgacgtgttaattggcctcattc

SEQ ID NO: 131530 - DNA, 25 bp, Rattus norvegicus
agcgacgtgttatttggcctcattc

SEQ ID NO: 131531 - DNA, 25 bp, Rattus norvegicus
agcgactatactcccagttttccga

SEQ ID NO: 131532 - DNA, 25 bp, Rattus norvegicus
agcgactatactgccagttttccga

SEQ ID NO: 131533 - DNA, 25 bp, Rattus norvegicus
agcgactccccgatgctagggcgac

SEQ ID NO: 131534 - DNA, 25 bp, Rattus norvegicus
agcgactccccgttgctagggcgac

SEQ ID NO: 131535 - DNA, 25 bp, Rattus norvegicus
agcgactcccttcagtaggaacgga

SEQ ID NO: 131536 - DNA, 25 bp, Rattus norvegicus
agcgactcccttgagtaggaacgga

SEQ ID NO: 131537 - DNA, 25 bp, Rattus norvegicus
agcgactccgaaaagcagctctgag

SEQ ID NO: 131538 - DNA, 25 bp, Rattus norvegicus
agcgactccgaatagcagctctgag

SEQ ID NO: 131539 - DNA, 25 bp, Rattus norvegicus
agcgactcgcggcacagcaggtaca

SEQ ID NO: 131540 - DNA, 25 bp, Rattus norvegicus
agcgactcgcgggacagcaggtaca

SEQ ID NO: 131541 - DNA, 25 bp, Rattus norvegicus
agcgactgcaccagggacattgtgt

SEQ ID NO: 131542 - DNA, 25 bp, Rattus norvegicus
agcgactgcacctgggacattgtgt

SEQ ID NO: 131543 - DNA, 25 bp, Rattus norvegicus
agcgactgccataaggtttcttcca

SEQ ID NO: 131544 - DNA, 25 bp, Rattus norvegicus
agcgactgccattaggtttcttcca

SEQ ID NO: 131545 - DNA, 25 bp, Rattus norvegicus
agcgactgtacacacgaggctgtca

SEQ ID NO: 131546 - DNA, 25 bp, Rattus norvegicus
agcgactgtacagacgaggctgtca

SEQ ID NO: 131547 - DNA, 25 bp, Rattus norvegicus
agcgactgtttacctttttctcccg

SEQ ID NO: 131548 - DNA, 25 bp, Rattus norvegicus
agcgactgtttagctttttctcccg

SEQ ID NO: 131549 - DNA, 25 bp, Rattus norvegicus
agcgacttctagcttagccaggtgt

SEQ ID NO: 131550 - DNA, 25 bp, Rattus norvegicus
agcgacttctaggttagccaggtgt

SEQ ID NO: 131551 - DNA, 25 bp, Rattus norvegicus
agcgacttgactccatgacttgact

SEQ ID NO: 131552 - DNA, 25 bp, Rattus norvegicus
agcgacttgactgcatgacttgact

SEQ ID NO: 131553 - DNA, 25 bp, Rattus norvegicus
agcgacttgcgactagactttaaac

SEQ ID NO: 131554 - DNA, 25 bp, Rattus norvegicus
agcgacttgcgagtagactttaaac

SEQ ID NO: 131555 - DNA, 25 bp, Rattus norvegicus
agcgacttggtcaccccgtgtgtag

SEQ ID NO: 131556 - DNA, 25 bp, Rattus norvegicus
agcgacttggtctccccgtgtgtag

SEQ ID NO: 131557 - DNA, 25 bp, Rattus norvegicus
agcgactttcctatgcagtgattat

SEQ ID NO: 131558 - DNA, 25 bp, Rattus norvegicus
agcgactttcctttgcagtgattat

SEQ ID NO: 131559 - DNA, 25 bp, Rattus norvegicus
agcgactttctcaaggcgtttgcag

SEQ ID NO: 131560 - DNA, 25 bp, Rattus norvegicus
agcgactttctctaggcgtttgcag

SEQ ID NO: 131561 - DNA, 25 bp, Rattus norvegicus
agcgagaaatccctgcaagcattga

SEQ ID NO: 131562 - DNA, 25 bp, Rattus norvegicus
agcgagaaatccgtgcaagcattga

SEQ ID NO: 131563 - DNA, 25 bp, Rattus norvegicus
agcgagaagcagctgttttcagtca

SEQ ID NO: 131564 - DNA, 25 bp, Rattus norvegicus
agcgagaagcaggtgttttcagtca

SEQ ID NO: 131565 - DNA, 25 bp, Rattus norvegicus
agcgagaagcccagctggtacagct

SEQ ID NO: 131566 - DNA, 25 bp, Rattus norvegicus
agcgagaagcccctgattgaacgtg

SEQ ID NO: 131567 - DNA, 25 bp, Rattus norvegicus
agcgagaagcccctgtcattttcta

SEQ ID NO: 131568 - DNA, 25 bp, Rattus norvegicus
agcgagaagcccgtgattgaacgtg

SEQ ID NO: 131569 - DNA, 25 bp, Rattus norvegicus
agcgagaagcccgtgtcattttcta

SEQ ID NO: 131570 - DNA, 25 bp, Rattus norvegicus
agcgagaagccctgctggtacagct

SEQ ID NO: 131571 - DNA, 25 bp, Rattus norvegicus
agcgagacagatcctcgtgattcat

SEQ ID NO: 131572 - DNA, 25 bp, Rattus norvegicus
agcgagacagatgctcgtgattcat

SEQ ID NO: 131573 - DNA, 25 bp, Rattus norvegicus
agcgagagagcgagctgcgagctgt

SEQ ID NO: 131574 - DNA, 25 bp, Rattus norvegicus
agcgagagagcgtgctgcgagctgt

SEQ ID NO: 131575 - DNA, 25 bp, Rattus norvegicus
agcgagagccctacttaatttttat

SEQ ID NO: 131576 - DNA, 25 bp, Rattus norvegicus
agcgagagcccttcttaatttttat

SEQ ID NO: 131577 - DNA, 25 bp, Rattus norvegicus
agcgagagcctccaacagaagtttg

SEQ ID NO: 131578 - DNA, 25 bp, Rattus norvegicus
agcgagagcctcgaacagaagtttg

SEQ ID NO: 131579 - DNA, 25 bp, Rattus norvegicus
agcgagagctatcaggaagatcctt

SEQ ID NO: 131580 - DNA, 25 bp, Rattus norvegicus
agcgagagctatgaggaagatcctt

SEQ ID NO: 131581 - DNA, 25 bp, Rattus norvegicus
agcgagagggccattcccgtgtcac

SEQ ID NO: 131582 - DNA, 25 bp, Rattus norvegicus
agcgagagggcctttcccgtgtcac

SEQ ID NO: 131583 - DNA, 25 bp, Rattus norvegicus
agcgagaggttcacagtggagccct

SEQ ID NO: 131584 - DNA, 25 bp, Rattus norvegicus
agcgagaggttctcagtggagccct

SEQ ID NO: 131585 - DNA, 25 bp, Rattus norvegicus
agcgagatacacaacaggcctgggt

SEQ ID NO: 131586 - DNA, 25 bp, Rattus norvegicus
agcgagatacactacaggcctgggt

SEQ ID NO: 131587 - DNA, 25 bp, Rattus norvegicus
agcgagatcccactgatcggcgtcg

SEQ ID NO: 131588 - DNA, 25 bp, Rattus norvegicus
agcgagatcccagtgatcggcgtcg

SEQ ID NO: 131589 - DNA, 25 bp, Rattus norvegicus
agcgagcacgtgaccggaccaggaa

SEQ ID NO: 131590 - DNA, 25 bp, Rattus norvegicus
agcgagcacgtgtccggaccaggaa

SEQ ID NO: 131591 - DNA, 25 bp, Rattus norvegicus
agcgagcagattagggtcccactga

SEQ ID NO: 131592 - DNA, 25 bp, Rattus norvegicus
agcgagcagatttgggtcccactga

SEQ ID NO: 131593 - DNA, 25 bp, Rattus norvegicus
agcgagcagcagcttgatagtgcca

SEQ ID NO: 131594 - DNA, 25 bp, Rattus norvegicus
agcgagcagcaggttgatagtgcca

SEQ ID NO: 131595 - DNA, 25 bp, Rattus norvegicus
agcgagcatcagaagggacccgttc

SEQ ID NO: 131596 - DNA, 25 bp, Rattus norvegicus
agcgagcatcagtagggacccgttc

SEQ ID NO: 131597 - DNA, 25 bp, Rattus norvegicus
agcgagcatgctctgcaggtgttca

SEQ ID NO: 131598 - DNA, 25 bp, Rattus norvegicus
agcgagcatgctgtgcaggtgttca

SEQ ID NO: 131599 - DNA, 25 bp, Rattus norvegicus
agcgagccacagacttggaggccat

SEQ ID NO: 131600 - DNA, 25 bp, Rattus norvegicus
agcgagccacagtcttggaggccat

SEQ ID NO: 131601 - DNA, 25 bp, Rattus norvegicus
agcgagcccgagctgttgataatca

SEQ ID NO: 131602 - DNA, 25 bp, Rattus norvegicus
agcgagcccgaggtgttgataatca

SEQ ID NO: 131603 - DNA, 25 bp, Rattus norvegicus
agcgagcctgggaagtctggtctaa

SEQ ID NO: 131604 - DNA, 25 bp, Rattus norvegicus
agcgagcctgggtagtctggtctaa

SEQ ID NO: 131605 - DNA, 25 bp, Rattus norvegicus
agcgagcggtgcacgcagattcctg

SEQ ID NO: 131606 - DNA, 25 bp, Rattus norvegicus
agcgagcggtgctcgcagattcctg

SEQ ID NO: 131607 - DNA, 25 bp, Rattus norvegicus
agcgagcgtcatcattaggcgaact

SEQ ID NO: 131608 - DNA, 25 bp, Rattus norvegicus
agcgagcgtcatgattaggcgaact

SEQ ID NO: 131609 - DNA, 25 bp, Rattus norvegicus
agcgagcgtcgtattgggatcctct

SEQ ID NO: 131610 - DNA, 25 bp, Rattus norvegicus
agcgagcgtcgttttgggatcctct

SEQ ID NO: 131611 - DNA, 25 bp, Rattus norvegicus
agcgagcgtttgacttggaggttaa

SEQ ID NO: 131612 - DNA, 25 bp, Rattus norvegicus
agcgagcgtttgtcttggaggttaa

SEQ ID NO: 131613 - DNA, 25 bp, Rattus norvegicus
agcgagctcagaaaccctttcagtg

SEQ ID NO: 131614 - DNA, 25 bp, Rattus norvegicus
agcgagctcagataccctttcagtg

SEQ ID NO: 131615 - DNA, 25 bp, Rattus norvegicus
agcgagctctagctagggtcctctt

SEQ ID NO: 131616 - DNA, 25 bp, Rattus norvegicus
agcgagctctaggtagggtcctctt

SEQ ID NO: 131617 - DNA, 25 bp, Rattus norvegicus
agcgagctgcagagcggtgaggccc

SEQ ID NO: 131618 - DNA, 25 bp, Rattus norvegicus
agcgagctgcagtgcggtgaggccc

SEQ ID NO: 131619 - DNA, 25 bp, Rattus norvegicus
agcgagctgcttccagagactcaaa

SEQ ID NO: 131620 - DNA, 25 bp, Rattus norvegicus
agcgagctgcttgcagagactcaaa

SEQ ID NO: 131621 - DNA, 25 bp, Rattus norvegicus
agcgaggaagtcatccctgggccag

SEQ ID NO: 131622 - DNA, 25 bp, Rattus norvegicus
agcgaggaagtcttccctgggccag

SEQ ID NO: 131623 - DNA, 25 bp, Rattus norvegicus
agcgaggaccagcatcagccgaagc

SEQ ID NO: 131624 - DNA, 25 bp, Rattus norvegicus
agcgaggaccaggatcagccgaagc

SEQ ID NO: 131625 - DNA, 25 bp, Rattus norvegicus
agcgaggctctaattttgtattcca

SEQ ID NO: 131626 - DNA, 25 bp, Rattus norvegicus
agcgaggctctatttttgtattcca

SEQ ID NO: 131627 - DNA, 25 bp, Rattus norvegicus
agcgagggccagcttgttcttagca

SEQ ID NO: 131628 - DNA, 25 bp, Rattus norvegicus
agcgagggccaggttgttcttagca

SEQ ID NO: 131629 - DNA, 25 bp, Rattus norvegicus
agcgagggctttcggtgtaactact

SEQ ID NO: 131630 - DNA, 25 bp, Rattus norvegicus
agcgagggctttgggtgtaactact

SEQ ID NO: 131631 - DNA, 25 bp, Rattus norvegicus
agcgaggtagctctgctcataccca

SEQ ID NO: 131632 - DNA, 25 bp, Rattus norvegicus
agcgaggtagctgtgctcataccca

SEQ ID NO: 131633 - DNA, 25 bp, Rattus norvegicus
agcgaggtcctaacacagtcaagat

SEQ ID NO: 131634 - DNA, 25 bp, Rattus norvegicus
agcgaggtcctatcacagtcaagat

SEQ ID NO: 131635 - DNA, 25 bp, Rattus norvegicus
agcgaggtgctcacctgcctcttgt

SEQ ID NO: 131636 - DNA, 25 bp, Rattus norvegicus
agcgaggtgctctcctgcctcttgt

SEQ ID NO: 131637 - DNA, 25 bp, Rattus norvegicus
agcgagtcctgtctttacctaatga

SEQ ID NO: 131638 - DNA, 25 bp, Rattus norvegicus
agcgagtcctgtgtttacctaatga

SEQ ID NO: 131639 - DNA, 25 bp, Rattus norvegicus
agcgagtccttgctagtcctgcagt

SEQ ID NO: 131640 - DNA, 25 bp, Rattus norvegicus
agcgagtccttggtagtcctgcagt

SEQ ID NO: 131641 - DNA, 25 bp, Rattus norvegicus
agcgagtcgcatatatcccaggatt

SEQ ID NO: 131642 - DNA, 25 bp, Rattus norvegicus
agcgagtcgcatttatcccaggatt

SEQ ID NO: 131643 - DNA, 25 bp, Rattus norvegicus
agcgagtcgcccagtgcttcaaaaa

SEQ ID NO: 131644 - DNA, 25 bp, Rattus norvegicus
agcgagtcgccctgtgcttcaaaaa

SEQ ID NO: 131645 - DNA, 25 bp, Rattus norvegicus
agcgagtctccacacaaagcccgag

SEQ ID NO: 131646 - DNA, 25 bp, Rattus norvegicus
agcgagtctccagacaaagcccgag

SEQ ID NO: 131647 - DNA, 25 bp, Rattus norvegicus
agcgagtcttctctgcctaccacag

SEQ ID NO: 131648 - DNA, 25 bp, Rattus norvegicus
agcgagtcttctgtgcctaccacag

SEQ ID NO: 131649 - DNA, 25 bp, Rattus norvegicus
agcgagtgaggcatgattcccttcc

SEQ ID NO: 131650 - DNA, 25 bp, Rattus norvegicus
agcgagtgaggcttgattcccttcc

SEQ ID NO: 131651 - DNA, 25 bp, Rattus norvegicus
agcgagttattaattgaccctgtaa

SEQ ID NO: 131652 - DNA, 25 bp, Rattus norvegicus
agcgagttattatttgaccctgtaa

SEQ ID NO: 131653 - DNA, 25 bp, Rattus norvegicus
agcgagttatttatacacatctgta

SEQ ID NO: 131654 - DNA, 25 bp, Rattus norvegicus
agcgagttatttttacacatctgta

SEQ ID NO: 131655 - DNA, 25 bp, Rattus norvegicus
agcgagttccgtcggcctggagcct

SEQ ID NO: 131656 - DNA, 25 bp, Rattus norvegicus
agcgagttccgtgggcctggagcct

SEQ ID NO: 131657 - DNA, 25 bp, Rattus norvegicus
agcgagttgtgcatgaccctagcaa

SEQ ID NO: 131658 - DNA, 25 bp, Rattus norvegicus
agcgagttgtgcttgaccctagcaa

SEQ ID NO: 131659 - DNA, 25 bp, Rattus norvegicus
agcgatactatacccacgtgctctg

SEQ ID NO: 131660 - DNA, 25 bp, Rattus norvegicus
agcgatactatagccacgtgctctg

SEQ ID NO: 131661 - DNA, 25 bp, Rattus norvegicus
agcgatactcaacacatgttcctgc

SEQ ID NO: 131662 - DNA, 25 bp, Rattus norvegicus
agcgatactcaagacatgttcctgc

SEQ ID NO: 131663 - DNA, 25 bp, Rattus norvegicus
agcgatactctgcatgatttgaaca

SEQ ID NO: 131664 - DNA, 25 bp, Rattus norvegicus
agcgatactctggatgatttgaaca

SEQ ID NO: 131665 - DNA, 25 bp, Rattus norvegicus
agcgatagcaatcgatacagtcccc

SEQ ID NO: 131666 - DNA, 25 bp, Rattus norvegicus
agcgatagcaatggatacagtcccc

SEQ ID NO: 131667 - DNA, 25 bp, Rattus norvegicus
agcgataggtgcagctgttcagacc

SEQ ID NO: 131668 - DNA, 25 bp, Rattus norvegicus
agcgataggtgctgctgttcagacc

SEQ ID NO: 131669 - DNA, 25 bp, Rattus norvegicus
agcgatatggtaattgcagcccgat

SEQ ID NO: 131670 - DNA, 25 bp, Rattus norvegicus
agcgatatggtatttgcagcccgat

SEQ ID NO: 131671 - DNA, 25 bp, Rattus norvegicus
agcgatcaaggacctgtcactttgc

SEQ ID NO: 131672 - DNA, 25 bp, Rattus norvegicus
agcgatcaaggagctgtcactttgc

SEQ ID NO: 131673 - DNA, 25 bp, Rattus norvegicus
agcgatcatctcctcgttgaggtag

SEQ ID NO: 131674 - DNA, 25 bp, Rattus norvegicus
agcgatcatctcgtcgttgaggtag

SEQ ID NO: 131675 - DNA, 25 bp, Rattus norvegicus
agcgatccatccaatgctgcctgga

SEQ ID NO: 131676 - DNA, 25 bp, Rattus norvegicus
agcgatccatcctatgctgcctgga

SEQ ID NO: 131677 - DNA, 25 bp, Rattus norvegicus
agcgatccccacaatccagaggttt

SEQ ID NO: 131678 - DNA, 25 bp, Rattus norvegicus
agcgatccccactatccagaggttt

SEQ ID NO: 131679 - DNA, 25 bp, Rattus norvegicus
agcgatcccggaagtggacatggca

SEQ ID NO: 131680 - DNA, 25 bp, Rattus norvegicus
agcgatcccggatgtggacatggca

SEQ ID NO: 131681 - DNA, 25 bp, Rattus norvegicus
agcgatccttaaatgtggccagagt

SEQ ID NO: 131682 - DNA, 25 bp, Rattus norvegicus
agcgatccttaattgtggccagagt

SEQ ID NO: 131683 - DNA, 25 bp, Rattus norvegicus
agcgatcgagctagcattgtgctta

SEQ ID NO: 131684 - DNA, 25 bp, Rattus norvegicus
agcgatcgagcttgcattgtgctta

SEQ ID NO: 131685 - DNA, 25 bp, Rattus norvegicus
agcgatcggatcaggttcacagtta

SEQ ID NO: 131686 - DNA, 25 bp, Rattus norvegicus
agcgatcggatctggttcacagtta

SEQ ID NO: 131687 - DNA, 25 bp, Rattus norvegicus
agcgatgaccacatggccgttacgg

SEQ ID NO: 131688 - DNA, 25 bp, Rattus norvegicus
agcgatgaccacttggccgttacgg

SEQ ID NO: 131689 - DNA, 25 bp, Rattus norvegicus
agcgatgattctctgtcgcagtccc

SEQ ID NO: 131690 - DNA, 25 bp, Rattus norvegicus
agcgatgattctgtgtcgcagtccc

SEQ ID NO: 131691 - DNA, 25 bp, Rattus norvegicus
agcgatgcattaccctgaccacagg

SEQ ID NO: 131692 - DNA, 25 bp, Rattus norvegicus
agcgatgcattagcctgaccacagg

SEQ ID NO: 131693 - DNA, 25 bp, Rattus norvegicus
agcgatgctcaccatttttatctgc

SEQ ID NO: 131694 - DNA, 25 bp, Rattus norvegicus
agcgatgctcacgatttttatctgc

SEQ ID NO: 131695 - DNA, 25 bp, Rattus norvegicus
agcgatgctggcaggagtcctccga

SEQ ID NO: 131696 - DNA, 25 bp, Rattus norvegicus
agcgatgctggctggagtcctccga

SEQ ID NO: 131697 - DNA, 25 bp, Rattus norvegicus
agcgatggaacacccagcccagaat

SEQ ID NO: 131698 - DNA, 25 bp, Rattus norvegicus
agcgatggaacagccagcccagaat

SEQ ID NO: 131699 - DNA, 25 bp, Rattus norvegicus
agcgatggacatcatggcctgtgtc

SEQ ID NO: 131700 - DNA, 25 bp, Rattus norvegicus
agcgatggacatgatggcctgtgtc

SEQ ID NO: 131701 - DNA, 25 bp, Rattus norvegicus
agcgatggcagcaagggaccacccg

SEQ ID NO: 131702 - DNA, 25 bp, Rattus norvegicus
agcgatggcagctagggaccacccg

SEQ ID NO: 131703 - DNA, 25 bp, Rattus norvegicus
agcgatgtctttccctggatgcaaa

SEQ ID NO: 131704 - DNA, 25 bp, Rattus norvegicus
agcgatgtctttgcctggatgcaaa

SEQ ID NO: 131705 - DNA, 25 bp, Rattus norvegicus
agcgatgtgcttaatgatatagcct

SEQ ID NO: 131706 - DNA, 25 bp, Rattus norvegicus
agcgatgtgctttatgatatagcct

SEQ ID NO: 131707 - DNA, 25 bp, Rattus norvegicus
agcgatgttcataaatttcaaggac

SEQ ID NO: 131708 - DNA, 25 bp, Rattus norvegicus
agcgatgttcattaatttcaaggac

SEQ ID NO: 131709 - DNA, 25 bp, Rattus norvegicus
agcgattagcaaaactccagtgtgg

SEQ ID NO: 131710 - DNA, 25 bp, Rattus norvegicus
agcgattagcaatactccagtgtgg

SEQ ID NO: 131711 - DNA, 25 bp, Rattus norvegicus
agcgattccgggaggccatcaagga

SEQ ID NO: 131712 - DNA, 25 bp, Rattus norvegicus
agcgattccgggtggccatcaagga

SEQ ID NO: 131713 - DNA, 25 bp, Rattus norvegicus
agcgattctagtacctgtgcttagt

SEQ ID NO: 131714 - DNA, 25 bp, Rattus norvegicus
agcgattctagttcctgtgcttagt

SEQ ID NO: 131715 - DNA, 25 bp, Rattus norvegicus
agcgattctgtgattctcttcatca

SEQ ID NO: 131716 - DNA, 25 bp, Rattus norvegicus
agcgattctgtgtttctcttcatca

SEQ ID NO: 131717 - DNA, 25 bp, Rattus norvegicus
agcgattggcagatgcttaagtctt

SEQ ID NO: 131718 - DNA, 25 bp, Rattus norvegicus
agcgattggcagttgcttaagtctt

SEQ ID NO: 131719 - DNA, 25 bp, Rattus norvegicus
agcgattgggagagcgcgaccctcc

SEQ ID NO: 131720 - DNA, 25 bp, Rattus norvegicus
agcgattgggagtgcgcgaccctcc

SEQ ID NO: 131721 - DNA, 25 bp, Rattus norvegicus
agcgcaaagctgagtccaagagcca

SEQ ID NO: 131722 - DNA, 25 bp, Rattus norvegicus
agcgcaaagctgattctgattctga

SEQ ID NO: 131723 - DNA, 25 bp, Rattus norvegicus
agcgcaaagctgtgtccaagagcca

SEQ ID NO: 131724 - DNA, 25 bp, Rattus norvegicus
agcgcaaagctgtttctgattctga

SEQ ID NO: 131725 - DNA, 25 bp, Rattus norvegicus
agcgcaacagcaccctgcagctgga

SEQ ID NO: 131726 - DNA, 25 bp, Rattus norvegicus
agcgcaacagcagcctgcagctgga

SEQ ID NO: 131727 - DNA, 25 bp, Rattus norvegicus
agcgcaaccgacagcagctgcgtct

SEQ ID NO: 131728 - DNA, 25 bp, Rattus norvegicus
agcgcaaccgactgcagctgcgtct

SEQ ID NO: 131729 - DNA, 25 bp, Rattus norvegicus
agcgcaacttaccttctgagagcat

SEQ ID NO: 131730 - DNA, 25 bp, Rattus norvegicus
agcgcaacttacgttctgagagcat

SEQ ID NO: 131731 - DNA, 25 bp, Rattus norvegicus
agcgcaagaggcagcgcaaccgcat

SEQ ID NO: 131732 - DNA, 25 bp, Rattus norvegicus
agcgcaagaggctgcgcaaccgcat

SEQ ID NO: 131733 - DNA, 25 bp, Rattus norvegicus
agcgcaagcccaatggcccagagtg

SEQ ID NO: 131734 - DNA, 25 bp, Rattus norvegicus
agcgcaagcccattggcccagagtg

SEQ ID NO: 131735 - DNA, 25 bp, Rattus norvegicus
agcgcaagcctcaccatcaagtata

SEQ ID NO: 131736 - DNA, 25 bp, Rattus norvegicus
agcgcaagcctctccatcaagtata

SEQ ID NO: 131737 - DNA, 25 bp, Rattus norvegicus
agcgcaagctggagcgtatctcgcg

SEQ ID NO: 131738 - DNA, 25 bp, Rattus norvegicus
agcgcaagctggtgcgtatctcgcg

SEQ ID NO: 131739 - DNA, 25 bp, Rattus norvegicus
agcgcaaggccactgttaaagcttt

SEQ ID NO: 131740 - DNA, 25 bp, Rattus norvegicus
agcgcaaggccagtgttaaagcttt

SEQ ID NO: 131741 - DNA, 25 bp, Rattus norvegicus
agcgcaagtctgaccgaggatgcat

SEQ ID NO: 131742 - DNA, 25 bp, Rattus norvegicus
agcgcaagtctgtccgaggatgcat

SEQ ID NO: 131743 - DNA, 25 bp, Rattus norvegicus
agcgcacaatgcaggaactgctcaa

SEQ ID NO: 131744 - DNA, 25 bp, Rattus norvegicus
agcgcacaatgctggaactgctcaa

SEQ ID NO: 131745 - DNA, 25 bp, Rattus norvegicus
agcgcacacaatctagccaggagga

SEQ ID NO: 131746 - DNA, 25 bp, Rattus norvegicus
agcgcacacaatgtagccaggagga

SEQ ID NO: 131747 - DNA, 25 bp, Rattus norvegicus
agcgcacactccaaagcagtattat

SEQ ID NO: 131748 - DNA, 25 bp, Rattus norvegicus
agcgcacactcctaagcagtattat

SEQ ID NO: 131749 - DNA, 25 bp, Rattus norvegicus
agcgcacactgtaagagccactgtc

SEQ ID NO: 131750 - DNA, 25 bp, Rattus norvegicus
agcgcacactgttagagccactgtc

SEQ ID NO: 131751 - DNA, 25 bp, Rattus norvegicus
agcgcacagccaacctaggcgctgg

SEQ ID NO: 131752 - DNA, 25 bp, Rattus norvegicus
agcgcacagccatcctaggcgctgg

SEQ ID NO: 131753 - DNA, 25 bp, Rattus norvegicus
agcgcaccatttcagtttcaacaat

SEQ ID NO: 131754 - DNA, 25 bp, Rattus norvegicus
agcgcaccatttgagtttcaacaat

SEQ ID NO: 131755 - DNA, 25 bp, Rattus norvegicus
agcgcacccttaaagttcgagtcaa

SEQ ID NO: 131756 - DNA, 25 bp, Rattus norvegicus
agcgcacccttatagttcgagtcaa

SEQ ID NO: 131757 - DNA, 25 bp, Rattus norvegicus
agcgcacctgacattgaactcttgg

SEQ ID NO: 131758 - DNA, 25 bp, Rattus norvegicus
agcgcacctgactttgaactcttgg

SEQ ID NO: 131759 - DNA, 25 bp, Rattus norvegicus
agcgcactcctcaattgctggatga

SEQ ID NO: 131760 - DNA, 25 bp, Rattus norvegicus
agcgcactcctctattgctggatga

SEQ ID NO: 131761 - DNA, 25 bp, Rattus norvegicus
agcgcagaccttagactggatgaaa

SEQ ID NO: 131762 - DNA, 25 bp, Rattus norvegicus
agcgcagacctttgactggatgaaa

SEQ ID NO: 131763 - DNA, 25 bp, Rattus norvegicus
agcgcagactgacctcagactcaag

SEQ ID NO: 131764 - DNA, 25 bp, Rattus norvegicus
agcgcagactgagctcagactcaag

SEQ ID NO: 131765 - DNA, 25 bp, Rattus norvegicus
agcgcagagatccttatatatttat

SEQ ID NO: 131766 - DNA, 25 bp, Rattus norvegicus
agcgcagagatcgttatatatttat

SEQ ID NO: 131767 - DNA, 25 bp, Rattus norvegicus
agcgcagagtccaacaagagattga

SEQ ID NO: 131768 - DNA, 25 bp, Rattus norvegicus
agcgcagagtcctacaagagattga

SEQ ID NO: 131769 - DNA, 25 bp, Rattus norvegicus
agcgcagatgacagactcggatcaa

SEQ ID NO: 131770 - DNA, 25 bp, Rattus norvegicus
agcgcagatgactgactcggatcaa

SEQ ID NO: 131771 - DNA, 25 bp, Rattus norvegicus
agcgcagcaatgacgaggtggccaa

SEQ ID NO: 131772 - DNA, 25 bp, Rattus norvegicus
agcgcagcaatgtcgaggtggccaa

SEQ ID NO: 131773 - DNA, 25 bp, Rattus norvegicus
agcgcagcccagaaggtgactccag

SEQ ID NO: 131774 - DNA, 25 bp, Rattus norvegicus
agcgcagcccagtaggtgactccag

SEQ ID NO: 131775 - DNA, 25 bp, Rattus norvegicus
agcgcagccccaacaagtaagaaaa

SEQ ID NO: 131776 - DNA, 25 bp, Rattus norvegicus
agcgcagccccatcaagtaagaaaa

SEQ ID NO: 131777 - DNA, 25 bp, Rattus norvegicus
agcgcagccggcaaatgtatgcagc

SEQ ID NO: 131778 - DNA, 25 bp, Rattus norvegicus
agcgcagccggctaatgtatgcagc

SEQ ID NO: 131779 - DNA, 25 bp, Rattus norvegicus
agcgcagccgggacttcatccagaa

SEQ ID NO: 131780 - DNA, 25 bp, Rattus norvegicus
agcgcagccgggtcttcatccagaa

SEQ ID NO: 131781 - DNA, 25 bp, Rattus norvegicus
agcgcagcctgtctgtcaatggcat

SEQ ID NO: 131782 - DNA, 25 bp, Rattus norvegicus
agcgcagcctgtgtgtcaatggcat

SEQ ID NO: 131783 - DNA, 25 bp, Rattus norvegicus
agcgcagctacgacagctactacta

SEQ ID NO: 131784 - DNA, 25 bp, Rattus norvegicus
agcgcagctacgtcagctactacta

SEQ ID NO: 131785 - DNA, 25 bp, Rattus norvegicus
agcgcagctcctctgtttctgtgtg

SEQ ID NO: 131786 - DNA, 25 bp, Rattus norvegicus
agcgcagctcctgtgtttctgtgtg

SEQ ID NO: 131787 - DNA, 25 bp, Rattus norvegicus
agcgcaggacctcttgctgtcagac

SEQ ID NO: 131788 - DNA, 25 bp, Rattus norvegicus
agcgcaggacctgttgctgtcagac

SEQ ID NO: 131789 - DNA, 25 bp, Rattus norvegicus
agcgcaggcgccagcaacagttgga

SEQ ID NO: 131790 - DNA, 25 bp, Rattus norvegicus
agcgcaggcgcctgcaacagttgga

SEQ ID NO: 131791 - DNA, 25 bp, Rattus norvegicus
agcgcaggctacagaacttgaatca

SEQ ID NO: 131792 - DNA, 25 bp, Rattus norvegicus
agcgcaggctactgaacttgaatca

SEQ ID NO: 131793 - DNA, 25 bp, Rattus norvegicus
agcgcagggcgcacaactcacatgt

SEQ ID NO: 131794 - DNA, 25 bp, Rattus norvegicus
agcgcagggcgctcaactcacatgt

SEQ ID NO: 131795 - DNA, 25 bp, Rattus norvegicus
agcgcaggtgccatctggtaagatg

SEQ ID NO: 131796 - DNA, 25 bp, Rattus norvegicus
agcgcaggtgccttctggtaagatg

SEQ ID NO: 131797 - DNA, 25 bp, Rattus norvegicus
agcgcagtactgaaactccattcat

SEQ ID NO: 131798 - DNA, 25 bp, Rattus norvegicus
agcgcagtactgtaactccattcat

SEQ ID NO: 131799 - DNA, 25 bp, Rattus norvegicus
agcgcagtgcctacccgcgacagag

SEQ ID NO: 131800 - DNA, 25 bp, Rattus norvegicus
agcgcagtgccttcccgcgacagag

SEQ ID NO: 131801 - DNA, 25 bp, Rattus norvegicus
agcgcagtgctgaaggatttgtcca

SEQ ID NO: 131802 - DNA, 25 bp, Rattus norvegicus
agcgcagtgctgtaggatttgtcca

SEQ ID NO: 131803 - DNA, 25 bp, Rattus norvegicus
agcgcagtggaactgatttggtcca

SEQ ID NO: 131804 - DNA, 25 bp, Rattus norvegicus
agcgcagtggaagtgatttggtcca

SEQ ID NO: 131805 - DNA, 25 bp, Rattus norvegicus
agcgcagtggacagaacacgcctca

SEQ ID NO: 131806 - DNA, 25 bp, Rattus norvegicus
agcgcagtggactgaacacgcctca

SEQ ID NO: 131807 - DNA, 25 bp, Rattus norvegicus
agcgcagtggcaatcaggtgcatgt

SEQ ID NO: 131808 - DNA, 25 bp, Rattus norvegicus
agcgcagtggcattcaggtgcatgt

SEQ ID NO: 131809 - DNA, 25 bp, Rattus norvegicus
agcgcagtgtggaaattgctctgca

SEQ ID NO: 131810 - DNA, 25 bp, Rattus norvegicus
agcgcagtgtggtaattgctctgca

SEQ ID NO: 131811 - DNA, 25 bp, Rattus norvegicus
agcgcatacgaacagtccgacccat

SEQ ID NO: 131812 - DNA, 25 bp, Rattus norvegicus
agcgcatacgaagagtccgacccat

SEQ ID NO: 131813 - DNA, 25 bp, Rattus norvegicus
agcgcatacgcaagactacattaca

SEQ ID NO: 131814 - DNA, 25 bp, Rattus norvegicus
agcgcatacgcatgactacattaca

SEQ ID NO: 131815 - DNA, 25 bp, Rattus norvegicus
agcgcatatactatctcacacttat

SEQ ID NO: 131816 - DNA, 25 bp, Rattus norvegicus
agcgcatatactttctcacacttat

SEQ ID NO: 131817 - DNA, 25 bp, Rattus norvegicus
agcgcatatataccatccccaggga

SEQ ID NO: 131818 - DNA, 25 bp, Rattus norvegicus
agcgcatatatagcatccccaggga

SEQ ID NO: 131819 - DNA, 25 bp, Rattus norvegicus
agcgcatcacacaggcagaagcttt

SEQ ID NO: 131820 - DNA, 25 bp, Rattus norvegicus
agcgcatcacactggcagaagcttt

SEQ ID NO: 131821 - DNA, 25 bp, Rattus norvegicus
agcgcatccacactgtcgagaagac

SEQ ID NO: 131822 - DNA, 25 bp, Rattus norvegicus
agcgcatccacagtgtcgagaagac

SEQ ID NO: 131823 - DNA, 25 bp, Rattus norvegicus
agcgcatccgatcgcttctggaagt

SEQ ID NO: 131824 - DNA, 25 bp, Rattus norvegicus
agcgcatccgatggcttctggaagt

SEQ ID NO: 131825 - DNA, 25 bp, Rattus norvegicus
agcgcatccgcaaaggtgaggccaa

SEQ ID NO: 131826 - DNA, 25 bp, Rattus norvegicus
agcgcatccgcataggtgaggccaa

SEQ ID NO: 131827 - DNA, 25 bp, Rattus norvegicus
agcgcatcctatacggtgtcaacaa

SEQ ID NO: 131828 - DNA, 25 bp, Rattus norvegicus
agcgcatcctattcggtgtcaacaa

SEQ ID NO: 131829 - DNA, 25 bp, Rattus norvegicus
agcgcatgacctcagctggtttcag

SEQ ID NO: 131830 - DNA, 25 bp, Rattus norvegicus
agcgcatgacctgagctggtttcag

SEQ ID NO: 131831 - DNA, 25 bp, Rattus norvegicus
agcgcatgcaggactgtcagcgaga

SEQ ID NO: 131832 - DNA, 25 bp, Rattus norvegicus
agcgcatgcaggtctgtcagcgaga

SEQ ID NO: 131833 - DNA, 25 bp, Rattus norvegicus
agcgcattccgcagagcgtgacgga

SEQ ID NO: 131834 - DNA, 25 bp, Rattus norvegicus
agcgcattccgctgagcgtgacgga

SEQ ID NO: 131835 - DNA, 25 bp, Rattus norvegicus
agcgcattctgcattttggaccact

SEQ ID NO: 131836 - DNA, 25 bp, Rattus norvegicus
agcgcattctgctttttggaccact

SEQ ID NO: 131837 - DNA, 25 bp, Rattus norvegicus
agcgcatttctgatggtctgtttat

SEQ ID NO: 131838 - DNA, 25 bp, Rattus norvegicus
agcgcatttctgttggtctgtttat

SEQ ID NO: 131839 - DNA, 25 bp, Rattus norvegicus
agcgccaaggtgaggctcttcgagt

SEQ ID NO: 131840 - DNA, 25 bp, Rattus norvegicus
agcgccaaggtgtggctcttcgagt

SEQ ID NO: 131841 - DNA, 25 bp, Rattus norvegicus
agcgccaagtgcacacatggttaaa

SEQ ID NO: 131842 - DNA, 25 bp, Rattus norvegicus
agcgccaagtgctcacatggttaaa

SEQ ID NO: 131843 - DNA, 25 bp, Rattus norvegicus
agcgccaccattagacatctttcgt

SEQ ID NO: 131844 - DNA, 25 bp, Rattus norvegicus
agcgccaccatttgacatctttcgt

SEQ ID NO: 131845 - DNA, 25 bp, Rattus norvegicus
agcgccacctttcacatggcagaag

SEQ ID NO: 131846 - DNA, 25 bp, Rattus norvegicus
agcgccacctttgacatggcagaag

SEQ ID NO: 131847 - DNA, 25 bp, Rattus norvegicus
agcgccacgaggaagctcagcagga

SEQ ID NO: 131848 - DNA, 25 bp, Rattus norvegicus
agcgccacgaggtagctcagcagga

SEQ ID NO: 131849 - DNA, 25 bp, Rattus norvegicus
agcgccagcgaaagccacaggactt

SEQ ID NO: 131850 - DNA, 25 bp, Rattus norvegicus
agcgccagcgaatgccacaggactt

SEQ ID NO: 131851 - DNA, 25 bp, Rattus norvegicus
agcgccagcgccaagagagcctgcg

SEQ ID NO: 131852 - DNA, 25 bp, Rattus norvegicus
agcgccagcgcctagagagcctgcg

SEQ ID NO: 131853 - DNA, 25 bp, Rattus norvegicus
agcgccagcgcgcatggagtctctc

SEQ ID NO: 131854 - DNA, 25 bp, Rattus norvegicus
agcgccagcgcggatggagtctctc

SEQ ID NO: 131855 - DNA, 25 bp, Rattus norvegicus
agcgccagcgggacacgtgtccagc

SEQ ID NO: 131856 - DNA, 25 bp, Rattus norvegicus
agcgccagcgggtcacgtgtccagc

SEQ ID NO: 131857 - DNA, 25 bp, Rattus norvegicus
agcgccagctgcaggcctgcaagag

SEQ ID NO: 131858 - DNA, 25 bp, Rattus norvegicus
agcgccagctgctggcctgcaagag

SEQ ID NO: 131859 - DNA, 25 bp, Rattus norvegicus
agcgccaggccgcagtctagcggga

SEQ ID NO: 131860 - DNA, 25 bp, Rattus norvegicus
agcgccaggccggagtctagcggga

SEQ ID NO: 131861 - DNA, 25 bp, Rattus norvegicus
agcgccaggcggacatcatcgggaa

SEQ ID NO: 131862 - DNA, 25 bp, Rattus norvegicus
agcgccaggcggtcatcatcgggaa

SEQ ID NO: 131863 - DNA, 25 bp, Rattus norvegicus
agcgccaggttgaagcgtcctcagt

SEQ ID NO: 131864 - DNA, 25 bp, Rattus norvegicus
agcgccaggttgtagcgtcctcagt

SEQ ID NO: 131865 - DNA, 25 bp, Rattus norvegicus
agcgccatctcacagctggtcagca

SEQ ID NO: 131866 - DNA, 25 bp, Rattus norvegicus
agcgccatctcagagctggtcagca

SEQ ID NO: 131867 - DNA, 25 bp, Rattus norvegicus
agcgccatctctacttgttgaatga

SEQ ID NO: 131868 - DNA, 25 bp, Rattus norvegicus
agcgccatctcttcttgttgaatga

SEQ ID NO: 131869 - DNA, 25 bp, Rattus norvegicus
agcgccatctgtctaaagtcactac

SEQ ID NO: 131870 - DNA, 25 bp, Rattus norvegicus
agcgccatctgtgtaaagtcactac

SEQ ID NO: 131871 - DNA, 25 bp, Rattus norvegicus
agcgccatctttataaagcggcctc

SEQ ID NO: 131872 - DNA, 25 bp, Rattus norvegicus
agcgccatctttttaaagcggcctc

SEQ ID NO: 131873 - DNA, 25 bp, Rattus norvegicus
agcgccatgcttatatgactcacta

SEQ ID NO: 131874 - DNA, 25 bp, Rattus norvegicus
agcgccatgcttttatgactcacta

SEQ ID NO: 131875 - DNA, 25 bp, Rattus norvegicus
agcgcccaactcacagatgagcggg

SEQ ID NO: 131876 - DNA, 25 bp, Rattus norvegicus
agcgcccaactctcagatgagcggg

SEQ ID NO: 131877 - DNA, 25 bp, Rattus norvegicus
agcgcccacagaagagcattgcact

SEQ ID NO: 131878 - DNA, 25 bp, Rattus norvegicus
agcgcccacagatgagcattgcact

SEQ ID NO: 131879 - DNA, 25 bp, Rattus norvegicus
agcgcccaccaacctagaacaaggt

SEQ ID NO: 131880 - DNA, 25 bp, Rattus norvegicus
agcgcccaccaagctagaacaaggt

SEQ ID NO: 131881 - DNA, 25 bp, Rattus norvegicus
agcgcccactggattggaagcttct

SEQ ID NO: 131882 - DNA, 25 bp, Rattus norvegicus
agcgcccactggtttggaagcttct

SEQ ID NO: 131883 - DNA, 25 bp, Rattus norvegicus
agcgcccagctgcttgtgtaagtca

SEQ ID NO: 131884 - DNA, 25 bp, Rattus norvegicus
agcgcccagctggttgtgtaagtca

SEQ ID NO: 131885 - DNA, 25 bp, Rattus norvegicus
agcgcccagggcattatagtcacct

SEQ ID NO: 131886 - DNA, 25 bp, Rattus norvegicus
agcgcccagggctttatagtcacct

SEQ ID NO: 131887 - DNA, 25 bp, Rattus norvegicus
agcgcccattctctgtgaagtttga

SEQ ID NO: 131888 - DNA, 25 bp, Rattus norvegicus
agcgcccattctgtgtgaagtttga

SEQ ID NO: 131889 - DNA, 25 bp, Rattus norvegicus
agcgccccacacatcagaatgtaaa

SEQ ID NO: 131890 - DNA, 25 bp, Rattus norvegicus
agcgccccacacttcagaatgtaaa

SEQ ID NO: 131891 - DNA, 25 bp, Rattus norvegicus
agcgccccagcaatcgttcaaggaa

SEQ ID NO: 131892 - DNA, 25 bp, Rattus norvegicus
agcgccccagcattcgttcaaggaa

SEQ ID NO: 131893 - DNA, 25 bp, Rattus norvegicus
agcgcccctgttaagcaaagctatg

SEQ ID NO: 131894 - DNA, 25 bp, Rattus norvegicus
agcgcccctgtttagcaaagctatg

SEQ ID NO: 131895 - DNA, 25 bp, Rattus norvegicus
agcgcccgcgggacaaacacaaaca

SEQ ID NO: 131896 - DNA, 25 bp, Rattus norvegicus
agcgcccgcgggtcaaacacaaaca

SEQ ID NO: 131897 - DNA, 25 bp, Rattus norvegicus
agcgcccgctgcatgctcggtgatt

SEQ ID NO: 131898 - DNA, 25 bp, Rattus norvegicus
agcgcccgctgcttgctcggtgatt

SEQ ID NO: 131899 - DNA, 25 bp, Rattus norvegicus
agcgccctcatcaaggcaaatggga

SEQ ID NO: 131900 - DNA, 25 bp, Rattus norvegicus
agcgccctcatctaggcaaatggga

SEQ ID NO: 131901 - DNA, 25 bp, Rattus norvegicus
agcgccctcctgacagcgatgggag

SEQ ID NO: 131902 - DNA, 25 bp, Rattus norvegicus
agcgccctcctgtcagcgatgggag

SEQ ID NO: 131903 - DNA, 25 bp, Rattus norvegicus
agcgccctgacaaccctgtaaggat

SEQ ID NO: 131904 - DNA, 25 bp, Rattus norvegicus
agcgccctgacatccctgtaaggat

SEQ ID NO: 131905 - DNA, 25 bp, Rattus norvegicus
agcgccctgtcgacttgggaggacc

SEQ ID NO: 131906 - DNA, 25 bp, Rattus norvegicus
agcgccctgtcgtcttgggaggacc

SEQ ID NO: 131907 - DNA, 25 bp, Rattus norvegicus
agcgccgacctcagtggtcaagcag

SEQ ID NO: 131908 - DNA, 25 bp, Rattus norvegicus
agcgccgacctctgtggtcaagcag

SEQ ID NO: 131909 - DNA, 25 bp, Rattus norvegicus
agcgccgacttcaaggttgcccagg

SEQ ID NO: 131910 - DNA, 25 bp, Rattus norvegicus
agcgccgacttctaggttgcccagg

SEQ ID NO: 131911 - DNA, 25 bp, Rattus norvegicus
agcgccgagcagaatacccacaata

SEQ ID NO: 131912 - DNA, 25 bp, Rattus norvegicus
agcgccgagcagtatacccacaata

SEQ ID NO: 131913 - DNA, 25 bp, Rattus norvegicus
agcgccgagtccacgaggagattga

SEQ ID NO: 131914 - DNA, 25 bp, Rattus norvegicus
agcgccgagtcctcgaggagattga

SEQ ID NO: 131915 - DNA, 25 bp, Rattus norvegicus
agcgccgccaccagcagggaaaagt

SEQ ID NO: 131916 - DNA, 25 bp, Rattus norvegicus
agcgccgccacctgcagggaaaagt

SEQ ID NO: 131917 - DNA, 25 bp, Rattus norvegicus
agcgccgctcttatcagcctagaca

SEQ ID NO: 131918 - DNA, 25 bp, Rattus norvegicus
agcgccgctcttttcagcctagaca

SEQ ID NO: 131919 - DNA, 25 bp, Rattus norvegicus
agcgccgctggacgcacaactgtga

SEQ ID NO: 131920 - DNA, 25 bp, Rattus norvegicus
agcgccgctggaggcacaactgtga

SEQ ID NO: 131921 - DNA, 25 bp, Rattus norvegicus
agcgccgcttagattaggttttccg

SEQ ID NO: 131922 - DNA, 25 bp, Rattus norvegicus
agcgccgcttagtttaggttttccg

SEQ ID NO: 131923 - DNA, 25 bp, Rattus norvegicus
agcgccggccgacagtagtgatgag

SEQ ID NO: 131924 - DNA, 25 bp, Rattus norvegicus
agcgccggccgagagtagtgatgag

SEQ ID NO: 131925 - DNA, 25 bp, Rattus norvegicus
agcgccggttagaggctgcttacac

SEQ ID NO: 131926 - DNA, 25 bp, Rattus norvegicus
agcgccggttagtggctgcttacac

SEQ ID NO: 131927 - DNA, 25 bp, Rattus norvegicus
agcgccgtctgcaggatttacaggg

SEQ ID NO: 131928 - DNA, 25 bp, Rattus norvegicus
agcgccgtctgctggatttacaggg

SEQ ID NO: 131929 - DNA, 25 bp, Rattus norvegicus
agcgccgtgtggatttctgcaaaga

SEQ ID NO: 131930 - DNA, 25 bp, Rattus norvegicus
agcgccgtgtggttttctgcaaaga

SEQ ID NO: 131931 - DNA, 25 bp, Rattus norvegicus
agcgcctatagcatcctggagatta

SEQ ID NO: 131932 - DNA, 25 bp, Rattus norvegicus
agcgcctatagcttcctggagatta

SEQ ID NO: 131933 - DNA, 25 bp, Rattus norvegicus
agcgcctcccagaggctggagagac

SEQ ID NO: 131934 - DNA, 25 bp, Rattus norvegicus
agcgcctcccagtggctggagagac

SEQ ID NO: 131935 - DNA, 25 bp, Rattus norvegicus
agcgcctcctggacatgaagagcaa

SEQ ID NO: 131936 - DNA, 25 bp, Rattus norvegicus
agcgcctcctggtcatgaagagcaa

SEQ ID NO: 131937 - DNA, 25 bp, Rattus norvegicus
agcgcctcctgtattgacagccaag

SEQ ID NO: 131938 - DNA, 25 bp, Rattus norvegicus
agcgcctcctgttttgacagccaag

SEQ ID NO: 131939 - DNA, 25 bp, Rattus norvegicus
agcgcctcttttcacaaggtcaaga

SEQ ID NO: 131940 - DNA, 25 bp, Rattus norvegicus
agcgcctcttttgacaaggtcaaga

SEQ ID NO: 131941 - DNA, 25 bp, Rattus norvegicus
agcgcctgaagcactggtttgactg

SEQ ID NO: 131942 - DNA, 25 bp, Rattus norvegicus
agcgcctgaagctctggtttgactg

SEQ ID NO: 131943 - DNA, 25 bp, Rattus norvegicus
agcgcctgaatgaagaggcctctgt

SEQ ID NO: 131944 - DNA, 25 bp, Rattus norvegicus
agcgcctgaatgtagaggcctctgt

SEQ ID NO: 131945 - DNA, 25 bp, Rattus norvegicus
agcgcctgaccgagatcaagaacca

SEQ ID NO: 131946 - DNA, 25 bp, Rattus norvegicus
agcgcctgaccgtgatcaagaacca

SEQ ID NO: 131947 - DNA, 25 bp, Rattus norvegicus
agcgcctgagagaatcactcctgga

SEQ ID NO: 131948 - DNA, 25 bp, Rattus norvegicus
agcgcctgagagtatcactcctgga

SEQ ID NO: 131949 - DNA, 25 bp, Rattus norvegicus
agcgcctgagcgacaggcagaagct

SEQ ID NO: 131950 - DNA, 25 bp, Rattus norvegicus
agcgcctgagcgtcaggcagaagct

SEQ ID NO: 131951 - DNA, 25 bp, Rattus norvegicus
agcgcctgagggaccgtgatatcaa

SEQ ID NO: 131952 - DNA, 25 bp, Rattus norvegicus
agcgcctgagggtccgtgatatcaa

SEQ ID NO: 131953 - DNA, 25 bp, Rattus norvegicus
agcgcctgatgtattagcgatcccg

SEQ ID NO: 131954 - DNA, 25 bp, Rattus norvegicus
agcgcctgatgttttagcgatcccg

SEQ ID NO: 131955 - DNA, 25 bp, Rattus norvegicus
agcgcctgcaggaacatccagagat

SEQ ID NO: 131956 - DNA, 25 bp, Rattus norvegicus
agcgcctgcaggtacatccagagat

SEQ ID NO: 131957 - DNA, 25 bp, Rattus norvegicus
agcgcctggctgagctcaagagcaa

SEQ ID NO: 131958 - DNA, 25 bp, Rattus norvegicus
agcgcctggctgtgctcaagagcaa

SEQ ID NO: 131959 - DNA, 25 bp, Rattus norvegicus
agcgcctggtctactgtgtggagaa

SEQ ID NO: 131960 - DNA, 25 bp, Rattus norvegicus
agcgcctggtcttctgtgtggagaa

SEQ ID NO: 131961 - DNA, 25 bp, Rattus norvegicus
agcgcctgtagacacattctcgtat

SEQ ID NO: 131962 - DNA, 25 bp, Rattus norvegicus
agcgcctgtagagacattctcgtat

SEQ ID NO: 131963 - DNA, 25 bp, Rattus norvegicus
agcgcctgtcccagcggaagtgtag

SEQ ID NO: 131964 - DNA, 25 bp, Rattus norvegicus
agcgcctgtccctgcggaagtgtag

SEQ ID NO: 131965 - DNA, 25 bp, Rattus norvegicus
agcgcctgttctataagtggcagca

SEQ ID NO: 131966 - DNA, 25 bp, Rattus norvegicus
agcgcctgttctttaagtggcagca

SEQ ID NO: 131967 - DNA, 25 bp, Rattus norvegicus
agcgccttactaactccatgatgat

SEQ ID NO: 131968 - DNA, 25 bp, Rattus norvegicus
agcgccttactatctccatgatgat

SEQ ID NO: 131969 - DNA, 25 bp, Rattus norvegicus
agcgccttcagcattctggttttca

SEQ ID NO: 131970 - DNA, 25 bp, Rattus norvegicus
agcgccttcagctttctggttttca

SEQ ID NO: 131971 - DNA, 25 bp, Rattus norvegicus
agcgccttcagtctactgtttccta

SEQ ID NO: 131972 - DNA, 25 bp, Rattus norvegicus
agcgccttcagtgtactgtttccta

SEQ ID NO: 131973 - DNA, 25 bp, Rattus norvegicus
agcgccttcatgcatttgcactatt

SEQ ID NO: 131974 - DNA, 25 bp, Rattus norvegicus
agcgccttcatggatttgcactatt

SEQ ID NO: 131975 - DNA, 25 bp, Rattus norvegicus
agcgccttccagactttttcaaggt

SEQ ID NO: 131976 - DNA, 25 bp, Rattus norvegicus
agcgccttccagtctttttcaaggt

SEQ ID NO: 131977 - DNA, 25 bp, Rattus norvegicus
agcgcctttaatcttttgttgttat

SEQ ID NO: 131978 - DNA, 25 bp, Rattus norvegicus
agcgcctttaatgttttgttgttat

SEQ ID NO: 131979 - DNA, 25 bp, Rattus norvegicus
agcgcctttctgacctggccaagat

SEQ ID NO: 131980 - DNA, 25 bp, Rattus norvegicus
agcgcctttctgtcctggccaagat

SEQ ID NO: 131981 - DNA, 25 bp, Rattus norvegicus
agcgcgaatgatagctttccccata

SEQ ID NO: 131982 - DNA, 25 bp, Rattus norvegicus
agcgcgaatgattgctttccccata

SEQ ID NO: 131983 - DNA, 25 bp, Rattus norvegicus
agcgcgagactgaggtagatttgac

SEQ ID NO: 131984 - DNA, 25 bp, Rattus norvegicus
agcgcgagactgtggtagatttgac

SEQ ID NO: 131985 - DNA, 25 bp, Rattus norvegicus
agcgcgagctcgcaacgagaatcca

SEQ ID NO: 131986 - DNA, 25 bp, Rattus norvegicus
agcgcgagctcggaacgagaatcca

SEQ ID NO: 131987 - DNA, 25 bp, Rattus norvegicus
agcgcgatccagacacagcggagct

SEQ ID NO: 131988 - DNA, 25 bp, Rattus norvegicus
agcgcgatccagtcacagcggagct

SEQ ID NO: 131989 - DNA, 25 bp, Rattus norvegicus
agcgcgatggtcaggccgctctgca

SEQ ID NO: 131990 - DNA, 25 bp, Rattus norvegicus
agcgcgatggtctggccgctctgca

SEQ ID NO: 131991 - DNA, 25 bp, Rattus norvegicus
agcgcgcacacgacggcatatgtgt

SEQ ID NO: 131992 - DNA, 25 bp, Rattus norvegicus
agcgcgcacacgtcggcatatgtgt

SEQ ID NO: 131993 - DNA, 25 bp, Rattus norvegicus
agcgcgcagctgaatcctgaaatgt

SEQ ID NO: 131994 - DNA, 25 bp, Rattus norvegicus
agcgcgcagctgtatcctgaaatgt

SEQ ID NO: 131995 - DNA, 25 bp, Rattus norvegicus
agcgcgcatcttcttgtatggcttt

SEQ ID NO: 131996 - DNA, 25 bp, Rattus norvegicus
agcgcgcatcttgttgtatggcttt

SEQ ID NO: 131997 - DNA, 25 bp, Rattus norvegicus
agcgcgcccttcaggacctacggaa

SEQ ID NO: 131998 - DNA, 25 bp, Rattus norvegicus
agcgcgcccttctggacctacggaa

SEQ ID NO: 131999 - DNA, 25 bp, Rattus norvegicus
agcgcgccggtcacagtggatcata

SEQ ID NO: 132000 - DNA, 25 bp, Rattus norvegicus
agcgcgccggtctcagtggatcata

SEQ ID NO: 132001 - DNA, 25 bp, Rattus norvegicus
agcgcgccttcgatcagggtgcaga

SEQ ID NO: 132002 - DNA, 25 bp, Rattus norvegicus
agcgcgccttcgttcagggtgcaga

SEQ ID NO: 132003 - DNA, 25 bp, Rattus norvegicus
agcgcgcgacccagggcagcacatt

SEQ ID NO: 132004 - DNA, 25 bp, Rattus norvegicus
agcgcgcgaccctgggcagcacatt

SEQ ID NO: 132005 - DNA, 25 bp, Rattus norvegicus
agcgcgcgtcacaccagataagcgg

SEQ ID NO: 132006 - DNA, 25 bp, Rattus norvegicus
agcgcgcgtcactccagataagcgg

SEQ ID NO: 132007 - DNA, 25 bp, Rattus norvegicus
agcgcgcgtgaaccctcggaacctt

SEQ ID NO: 132008 - DNA, 25 bp, Rattus norvegicus
agcgcgcgtgaagcctcggaacctt

SEQ ID NO: 132009 - DNA, 25 bp, Rattus norvegicus
agcgcgctcaccatagagctgttca

SEQ ID NO: 132010 - DNA, 25 bp, Rattus norvegicus
agcgcgctcaccttagagctgttca

SEQ ID NO: 132011 - DNA, 25 bp, Rattus norvegicus
agcgcgctggtaagcagtgcacctg

SEQ ID NO: 132012 - DNA, 25 bp, Rattus norvegicus
agcgcgctggtatgcagtgcacctg

SEQ ID NO: 132013 - DNA, 25 bp, Rattus norvegicus
agcgcgctgtgactgatttctagag

SEQ ID NO: 132014 - DNA, 25 bp, Rattus norvegicus
agcgcgctgtgagtgatttctagag

SEQ ID NO: 132015 - DNA, 25 bp, Rattus norvegicus
agcgcgcttgtccaaaatgcgtaag

SEQ ID NO: 132016 - DNA, 25 bp, Rattus norvegicus
agcgcgcttgtcgaaaatgcgtaag

SEQ ID NO: 132017 - DNA, 25 bp, Rattus norvegicus
agcgcggccatgataccggatcagc

SEQ ID NO: 132018 - DNA, 25 bp, Rattus norvegicus
agcgcggccatgttaccggatcagc

SEQ ID NO: 132019 - DNA, 25 bp, Rattus norvegicus
agcgcggcgcccagaggagtcccag

SEQ ID NO: 132020 - DNA, 25 bp, Rattus norvegicus
agcgcggcgccctgaggagtcccag

SEQ ID NO: 132021 - DNA, 25 bp, Rattus norvegicus
agcgcggcggagcaaccctgtgcag

SEQ ID NO: 132022 - DNA, 25 bp, Rattus norvegicus
agcgcggcggaggaaccctgtgcag

SEQ ID NO: 132023 - DNA, 25 bp, Rattus norvegicus
agcgcggctgatcaacatcgtcgag

SEQ ID NO: 132024 - DNA, 25 bp, Rattus norvegicus
agcgcggctgatgaacatcgtcgag

SEQ ID NO: 132025 - DNA, 25 bp, Rattus norvegicus
agcgcggctggaatgacccacggtt

SEQ ID NO: 132026 - DNA, 25 bp, Rattus norvegicus
agcgcggctggattgacccacggtt

SEQ ID NO: 132027 - DNA, 25 bp, Rattus norvegicus
agcgcgggcggcaccggtggttccg

SEQ ID NO: 132028 - DNA, 25 bp, Rattus norvegicus
agcgcgggcggctccggtggttccg

SEQ ID NO: 132029 - DNA, 25 bp, Rattus norvegicus
agcgcgggctgcaggcacgatttca

SEQ ID NO: 132030 - DNA, 25 bp, Rattus norvegicus
agcgcgggctgctggcacgatttca

SEQ ID NO: 132031 - DNA, 25 bp, Rattus norvegicus
agcgcggtagctccctagaacgagc

SEQ ID NO: 132032 - DNA, 25 bp, Rattus norvegicus
agcgcggtagctgcctagaacgagc

SEQ ID NO: 132033 - DNA, 25 bp, Rattus norvegicus
agcgcgtcagcgaacttgtttaaat

SEQ ID NO: 132034 - DNA, 25 bp, Rattus norvegicus
agcgcgtcagcgtacttgtttaaat

SEQ ID NO: 132035 - DNA, 25 bp, Rattus norvegicus
agcgcgtccttcatggtgtccagca

SEQ ID NO: 132036 - DNA, 25 bp, Rattus norvegicus
agcgcgtccttcttggtgtccagca

SEQ ID NO: 132037 - DNA, 25 bp, Rattus norvegicus
agcgcgtttcagatgagttcatgga

SEQ ID NO: 132038 - DNA, 25 bp, Rattus norvegicus
agcgcgtttcagttgagttcatgga

SEQ ID NO: 132039 - DNA, 25 bp, Rattus norvegicus
agcgctaacagacgttaaagcttaa

SEQ ID NO: 132040 - DNA, 25 bp, Rattus norvegicus
agcgctaacagaggttaaagcttaa

SEQ ID NO: 132041 - DNA, 25 bp, Rattus norvegicus
agcgctaagctcagcgcaaagctga

SEQ ID NO: 132042 - DNA, 25 bp, Rattus norvegicus
agcgctaagctctgcgcaaagctga

SEQ ID NO: 132043 - DNA, 25 bp, Rattus norvegicus
agcgctaagggccagcaaaacatta

SEQ ID NO: 132044 - DNA, 25 bp, Rattus norvegicus
agcgctaagggcgagcaaaacatta

SEQ ID NO: 132045 - DNA, 25 bp, Rattus norvegicus
agcgctaagtaaacttttcagcagg

SEQ ID NO: 132046 - DNA, 25 bp, Rattus norvegicus
agcgctaagtaatcttttcagcagg

SEQ ID NO: 132047 - DNA, 25 bp, Rattus norvegicus
agcgctacaagaaccggccgggact

SEQ ID NO: 132048 - DNA, 25 bp, Rattus norvegicus
agcgctacaagatccggccgggact

SEQ ID NO: 132049 - DNA, 25 bp, Rattus norvegicus
agcgctactcaaagcctggaactct

SEQ ID NO: 132050 - DNA, 25 bp, Rattus norvegicus
agcgctactcaatgcctggaactct

SEQ ID NO: 132051 - DNA, 25 bp, Rattus norvegicus
agcgctactttccagtgtaaccata

SEQ ID NO: 132052 - DNA, 25 bp, Rattus norvegicus
agcgctactttcgagtgtaaccata

SEQ ID NO: 132053 - DNA, 25 bp, Rattus norvegicus
agcgctatcgaaaatctgaaggcca

SEQ ID NO: 132054 - DNA, 25 bp, Rattus norvegicus
agcgctatcgaatatctgaaggcca

SEQ ID NO: 132055 - DNA, 25 bp, Rattus norvegicus
agcgctatgaggactggtatggctc

SEQ ID NO: 132056 - DNA, 25 bp, Rattus norvegicus
agcgctatgaggtctggtatggctc

SEQ ID NO: 132057 - DNA, 25 bp, Rattus norvegicus
agcgctattgcaacctccaggagta

SEQ ID NO: 132058 - DNA, 25 bp, Rattus norvegicus
agcgctattgcatcctccaggagta

SEQ ID NO: 132059 - DNA, 25 bp, Rattus norvegicus
agcgctcacgctcggtttcttagta

SEQ ID NO: 132060 - DNA, 25 bp, Rattus norvegicus
agcgctcacgctgggtttcttagta

SEQ ID NO: 132061 - DNA, 25 bp, Rattus norvegicus
agcgctcagccccagaggtatatgt

SEQ ID NO: 132062 - DNA, 25 bp, Rattus norvegicus
agcgctcagcccgagaggtatatgt

SEQ ID NO: 132063 - DNA, 25 bp, Rattus norvegicus
agcgctcatcgacttcatcagaaaa

SEQ ID NO: 132064 - DNA, 25 bp, Rattus norvegicus
agcgctcatcgagttcatcagaaaa

SEQ ID NO: 132065 - DNA, 25 bp, Rattus norvegicus
agcgctccaggtaactcttggtaga

SEQ ID NO: 132066 - DNA, 25 bp, Rattus norvegicus
agcgctccaggttactcttggtaga

SEQ ID NO: 132067 - DNA, 25 bp, Rattus norvegicus
agcgctcccctcagatctggatggt

SEQ ID NO: 132068 - DNA, 25 bp, Rattus norvegicus
agcgctcccctctgatctggatggt

SEQ ID NO: 132069 - DNA, 25 bp, Rattus norvegicus
agcgctccctttatgaattgtgcag

SEQ ID NO: 132070 - DNA, 25 bp, Rattus norvegicus
agcgctccctttttgaattgtgcag

SEQ ID NO: 132071 - DNA, 25 bp, Rattus norvegicus
agcgctccgcttctgaggtagaaaa

SEQ ID NO: 132072 - DNA, 25 bp, Rattus norvegicus
agcgctccgcttgtgaggtagaaaa

SEQ ID NO: 132073 - DNA, 25 bp, Rattus norvegicus
agcgctccgggaaacatgtgatcat

SEQ ID NO: 132074 - DNA, 25 bp, Rattus norvegicus
agcgctccgggatacatgtgatcat

SEQ ID NO: 132075 - DNA, 25 bp, Rattus norvegicus
agcgctcctttcaggcggctgactg

SEQ ID NO: 132076 - DNA, 25 bp, Rattus norvegicus
agcgctcctttctggcggctgactg

SEQ ID NO: 132077 - DNA, 25 bp, Rattus norvegicus
agcgctcgagctaagcccgggacaa

SEQ ID NO: 132078 - DNA, 25 bp, Rattus norvegicus
agcgctcgagcttagcccgggacaa

SEQ ID NO: 132079 - DNA, 25 bp, Rattus norvegicus
agcgctcgccaacctgagtaataag

SEQ ID NO: 132080 - DNA, 25 bp, Rattus norvegicus
agcgctcgccaagctgagtaataag

SEQ ID NO: 132081 - DNA, 25 bp, Rattus norvegicus
agcgctcggtgaagcatgcctcctt

SEQ ID NO: 132082 - DNA, 25 bp, Rattus norvegicus
agcgctcggtgatgcatgcctcctt

SEQ ID NO: 132083 - DNA, 25 bp, Rattus norvegicus
agcgctctacgcctggatgaagata

SEQ ID NO: 132084 - DNA, 25 bp, Rattus norvegicus
agcgctctacgcgtggatgaagata

SEQ ID NO: 132085 - DNA, 25 bp, Rattus norvegicus
agcgctctcatgactgtttatcatc

SEQ ID NO: 132086 - DNA, 25 bp, Rattus norvegicus
agcgctctcatgtctgtttatcatc

SEQ ID NO: 132087 - DNA, 25 bp, Rattus norvegicus
agcgctctccctctggagtgcagaa

SEQ ID NO: 132088 - DNA, 25 bp, Rattus norvegicus
agcgctctccctgtggagtgcagaa

SEQ ID NO: 132089 - DNA, 25 bp, Rattus norvegicus
agcgctctgcaacctggaaacccag

SEQ ID NO: 132090 - DNA, 25 bp, Rattus norvegicus
agcgctctgcaagctggaaacccag

SEQ ID NO: 132091 - DNA, 25 bp, Rattus norvegicus
agcgctctgcatctaaacagctttt

SEQ ID NO: 132092 - DNA, 25 bp, Rattus norvegicus
agcgctctgcatgtaaacagctttt

SEQ ID NO: 132093 - DNA, 25 bp, Rattus norvegicus
agcgctcttgctatactgtgttgaa

SEQ ID NO: 132094 - DNA, 25 bp, Rattus norvegicus
agcgctcttgctttactgtgttgaa

SEQ ID NO: 132095 - DNA, 25 bp, Rattus norvegicus
agcgctgaagcaatccgatggttct

SEQ ID NO: 132096 - DNA, 25 bp, Rattus norvegicus
agcgctgaagcattccgatggttct

SEQ ID NO: 132097 - DNA, 25 bp, Rattus norvegicus
agcgctgactcgcaactgaaggcat

SEQ ID NO: 132098 - DNA, 25 bp, Rattus norvegicus
agcgctgactcggaactgaaggcat

SEQ ID NO: 132099 - DNA, 25 bp, Rattus norvegicus
agcgctgactctccaacttataaag

SEQ ID NO: 132100 - DNA, 25 bp, Rattus norvegicus
agcgctgactctgcaacttataaag

SEQ ID NO: 132101 - DNA, 25 bp, Rattus norvegicus
agcgctgagatcaggtggttctatt

SEQ ID NO: 132102 - DNA, 25 bp, Rattus norvegicus
agcgctgagatctggtggttctatt

SEQ ID NO: 132103 - DNA, 25 bp, Rattus norvegicus
agcgctgcagagagacgactggtct

SEQ ID NO: 132104 - DNA, 25 bp, Rattus norvegicus
agcgctgcagagtgacgactggtct

SEQ ID NO: 132105 - DNA, 25 bp, Rattus norvegicus
agcgctgcaggccataaccacgtgg

SEQ ID NO: 132106 - DNA, 25 bp, Rattus norvegicus
agcgctgcaggcgataaccacgtgg

SEQ ID NO: 132107 - DNA, 25 bp, Rattus norvegicus
agcgctgcaggtccttcctgaaaag

SEQ ID NO: 132108 - DNA, 25 bp, Rattus norvegicus
agcgctgcaggtgcttcctgaaaag

SEQ ID NO: 132109 - DNA, 25 bp, Rattus norvegicus
agcgctgccacaagatgccgtgtgt

SEQ ID NO: 132110 - DNA, 25 bp, Rattus norvegicus
agcgctgccacatgatgccgtgtgt

SEQ ID NO: 132111 - DNA, 25 bp, Rattus norvegicus
agcgctgcccctaaggctgtggagc

SEQ ID NO: 132112 - DNA, 25 bp, Rattus norvegicus
agcgctgccccttaggctgtggagc

SEQ ID NO: 132113 - DNA, 25 bp, Rattus norvegicus
agcgctgccgctagtaagtgccttt

SEQ ID NO: 132114 - DNA, 25 bp, Rattus norvegicus
agcgctgccgcttgtaagtgccttt

SEQ ID NO: 132115 - DNA, 25 bp, Rattus norvegicus
agcgctgctcaactaactcatctga

SEQ ID NO: 132116 - DNA, 25 bp, Rattus norvegicus
agcgctgctcaagtaactcatctga

SEQ ID NO: 132117 - DNA, 25 bp, Rattus norvegicus
agcgctgctggcagtgagtcttgac

SEQ ID NO: 132118 - DNA, 25 bp, Rattus norvegicus
agcgctgctggctgtgagtcttgac

SEQ ID NO: 132119 - DNA, 25 bp, Rattus norvegicus
agcgctgctgtaccactgttgctgc

SEQ ID NO: 132120 - DNA, 25 bp, Rattus norvegicus
agcgctgctgtagcactgttgctgc

SEQ ID NO: 132121 - DNA, 25 bp, Rattus norvegicus
agcgctgctgtgattattgcttgct

SEQ ID NO: 132122 - DNA, 25 bp, Rattus norvegicus
agcgctgctgtgtttattgcttgct

SEQ ID NO: 132123 - DNA, 25 bp, Rattus norvegicus
agcgctgctttgattgttccctggg

SEQ ID NO: 132124 - DNA, 25 bp, Rattus norvegicus
agcgctgctttgtttgttccctggg

SEQ ID NO: 132125 - DNA, 25 bp, Rattus norvegicus
agcgctggacaactttctttctacc

SEQ ID NO: 132126 - DNA, 25 bp, Rattus norvegicus
agcgctggacaagtttctttctacc

SEQ ID NO: 132127 - DNA, 25 bp, Rattus norvegicus
agcgctgggcagatccaagctctgg

SEQ ID NO: 132128 - DNA, 25 bp, Rattus norvegicus
agcgctgggcagttccaagctctgg

SEQ ID NO: 132129 - DNA, 25 bp, Rattus norvegicus
agcgctgtaacaaaagccgggtgtt

SEQ ID NO: 132130 - DNA, 25 bp, Rattus norvegicus
agcgctgtaacataagccgggtgtt

SEQ ID NO: 132131 - DNA, 25 bp, Rattus norvegicus
agcgctgtagccagtcttgatgtgc

SEQ ID NO: 132132 - DNA, 25 bp, Rattus norvegicus
agcgctgtagcctgtcttgatgtgc

SEQ ID NO: 132133 - DNA, 25 bp, Rattus norvegicus
agcgctgtaggtcgtatgtctttat

SEQ ID NO: 132134 - DNA, 25 bp, Rattus norvegicus
agcgctgtaggtggtatgtctttat

SEQ ID NO: 132135 - DNA, 25 bp, Rattus norvegicus
agcgctgtatatatggactcctaag

SEQ ID NO: 132136 - DNA, 25 bp, Rattus norvegicus
agcgctgtatatttggactcctaag

SEQ ID NO: 132137 - DNA, 25 bp, Rattus norvegicus
agcgctgtgcagcacagtttcttct

SEQ ID NO: 132138 - DNA, 25 bp, Rattus norvegicus
agcgctgtgcaggacagtttcttct

SEQ ID NO: 132139 - DNA, 25 bp, Rattus norvegicus
agcgctgttcgtcataattgcctat

SEQ ID NO: 132140 - DNA, 25 bp, Rattus norvegicus
agcgctgttcgtgataattgcctat

SEQ ID NO: 132141 - DNA, 25 bp, Rattus norvegicus
agcgcttaatgtctggaaccttgag

SEQ ID NO: 132142 - DNA, 25 bp, Rattus norvegicus
agcgcttaatgtgtggaaccttgag

SEQ ID NO: 132143 - DNA, 25 bp, Rattus norvegicus
agcgcttatgcaaccatgtgatcca

SEQ ID NO: 132144 - DNA, 25 bp, Rattus norvegicus
agcgcttatgcatccatgtgatcca

SEQ ID NO: 132145 - DNA, 25 bp, Rattus norvegicus
agcgcttcatcccactggtgtgcaa

SEQ ID NO: 132146 - DNA, 25 bp, Rattus norvegicus
agcgcttcatccgactggtgtgcaa

SEQ ID NO: 132147 - DNA, 25 bp, Rattus norvegicus
agcgcttccttgagtgcatggtaca

SEQ ID NO: 132148 - DNA, 25 bp, Rattus norvegicus
agcgcttccttgtgtgcatggtaca

SEQ ID NO: 132149 - DNA, 25 bp, Rattus norvegicus
agcgcttcgagcagtttgtcatgaa

SEQ ID NO: 132150 - DNA, 25 bp, Rattus norvegicus
agcgcttcgagctgtttgtcatgaa

SEQ ID NO: 132151 - DNA, 25 bp, Rattus norvegicus
agcgcttctcgcagtgctaaagaaa

SEQ ID NO: 132152 - DNA, 25 bp, Rattus norvegicus
agcgcttctcgctgtgctaaagaaa

SEQ ID NO: 132153 - DNA, 25 bp, Rattus norvegicus
agcgcttctgcaaactgcgcaagat

SEQ ID NO: 132154 - DNA, 25 bp, Rattus norvegicus
agcgcttctgcatactgcgcaagat

SEQ ID NO: 132155 - DNA, 25 bp, Rattus norvegicus
agcgcttctgccattggaatgtgtc

SEQ ID NO: 132156 - DNA, 25 bp, Rattus norvegicus
agcgcttctgcctttggaatgtgtc

SEQ ID NO: 132157 - DNA, 25 bp, Rattus norvegicus
agcgcttctggccatgaaattccta

SEQ ID NO: 132158 - DNA, 25 bp, Rattus norvegicus
agcgcttctggcgatgaaattccta

SEQ ID NO: 132159 - DNA, 25 bp, Rattus norvegicus
agcgcttcttcaattgcatgcactt

SEQ ID NO: 132160 - DNA, 25 bp, Rattus norvegicus
agcgcttcttcatttgcatgcactt

SEQ ID NO: 132161 - DNA, 25 bp, Rattus norvegicus
agcgcttctttcctggcaaatgtga

SEQ ID NO: 132162 - DNA, 25 bp, Rattus norvegicus
agcgcttctttcgtggcaaatgtga

SEQ ID NO: 132163 - DNA, 25 bp, Rattus norvegicus
agcgcttgcctaacacgggtaaggg

SEQ ID NO: 132164 - DNA, 25 bp, Rattus norvegicus
agcgcttgcctatcacgggtaaggg

SEQ ID NO: 132165 - DNA, 25 bp, Rattus norvegicus
agcgcttgcgagcatgtcgtcagaa

SEQ ID NO: 132166 - DNA, 25 bp, Rattus norvegicus
agcgcttgcgaggatgtcgtcagaa

SEQ ID NO: 132167 - DNA, 25 bp, Rattus norvegicus
agcgcttgcgtgagcgggatatcaa

SEQ ID NO: 132168 - DNA, 25 bp, Rattus norvegicus
agcgcttgcgtgtgcgggatatcaa

SEQ ID NO: 132169 - DNA, 25 bp, Rattus norvegicus
agcgcttgctggaggctgtcctgac

SEQ ID NO: 132170 - DNA, 25 bp, Rattus norvegicus
agcgcttgctggtggctgtcctgac

SEQ ID NO: 132171 - DNA, 25 bp, Rattus norvegicus
agcgctttagatccccaccatggag

SEQ ID NO: 132172 - DNA, 25 bp, Rattus norvegicus
agcgctttagatgcccaccatggag

SEQ ID NO: 132173 - DNA, 25 bp, Rattus norvegicus
agcgctttcagcatgaggtggacta

SEQ ID NO: 132174 - DNA, 25 bp, Rattus norvegicus
agcgctttcagcttgaggtggacta

SEQ ID NO: 132175 - DNA, 25 bp, Rattus norvegicus
agcgctttcatccaggcaactttgg

SEQ ID NO: 132176 - DNA, 25 bp, Rattus norvegicus
agcgctttcatcgaggcaactttgg

SEQ ID NO: 132177 - DNA, 25 bp, Rattus norvegicus
agcgctttctctaccaggacctctt

SEQ ID NO: 132178 - DNA, 25 bp, Rattus norvegicus
agcgctttctcttccaggacctctt

SEQ ID NO: 132179 - DNA, 25 bp, Rattus norvegicus
agcgctttctgtcgccagcagagac

SEQ ID NO: 132180 - DNA, 25 bp, Rattus norvegicus
agcgctttctgtggccagcagagac

SEQ ID NO: 132181 - DNA, 25 bp, Rattus norvegicus
agcgctttgggaatttgaggcaaga

SEQ ID NO: 132182 - DNA, 25 bp, Rattus norvegicus
agcgctttgggattttgaggcaaga

SEQ ID NO: 132183 - DNA, 25 bp, Rattus norvegicus
agcgcttttagacccttggtgtaaa

SEQ ID NO: 132184 - DNA, 25 bp, Rattus norvegicus
agcgcttttagagccttggtgtaaa

SEQ ID NO: 132185 - DNA, 25 bp, Rattus norvegicus
agcgcttttccacctgtcactgaaa

SEQ ID NO: 132186 - DNA, 25 bp, Rattus norvegicus
agcgcttttccagctgtcactgaaa

SEQ ID NO: 132187 - DNA, 25 bp, Rattus norvegicus
agcggaaagggcctgtttctctaga

SEQ ID NO: 132188 - DNA, 25 bp, Rattus norvegicus
agcggaaagggcgtgtttctctaga

SEQ ID NO: 132189 - DNA, 25 bp, Rattus norvegicus
agcggaaattgcaattcccctccgg

SEQ ID NO: 132190 - DNA, 25 bp, Rattus norvegicus
agcggaaattgctattcccctccgg

SEQ ID NO: 132191 - DNA, 25 bp, Rattus norvegicus
agcggaaggcagacactcacaggaa

SEQ ID NO: 132192 - DNA, 25 bp, Rattus norvegicus
agcggaaggcagtcactcacaggaa

SEQ ID NO: 132193 - DNA, 25 bp, Rattus norvegicus
agcggaagtgctaactgactccagt

SEQ ID NO: 132194 - DNA, 25 bp, Rattus norvegicus
agcggaagtgcttactgactccagt

SEQ ID NO: 132195 - DNA, 25 bp, Rattus norvegicus
agcggaagtttgctcactctctcag

SEQ ID NO: 132196 - DNA, 25 bp, Rattus norvegicus
agcggaagtttggtcactctctcag

SEQ ID NO: 132197 - DNA, 25 bp, Rattus norvegicus
agcggaatcgccaccctggcaggag

SEQ ID NO: 132198 - DNA, 25 bp, Rattus norvegicus
agcggaatcgcctccctggcaggag

SEQ ID NO: 132199 - DNA, 25 bp, Rattus norvegicus
agcggaatgccaatgaccttctcga

SEQ ID NO: 132200 - DNA, 25 bp, Rattus norvegicus
agcggaatgccattgaccttctcga

SEQ ID NO: 132201 - DNA, 25 bp, Rattus norvegicus
agcggaatgttcctttgtgctgctg

SEQ ID NO: 132202 - DNA, 25 bp, Rattus norvegicus
agcggaatgttcgtttgtgctgctg

SEQ ID NO: 132203 - DNA, 25 bp, Rattus norvegicus
agcggacagcggaacttctccagga

SEQ ID NO: 132204 - DNA, 25 bp, Rattus norvegicus
agcggacagcggtacttctccagga

SEQ ID NO: 132205 - DNA, 25 bp, Rattus norvegicus
agcggaccaggtacaaggcctttgt

SEQ ID NO: 132206 - DNA, 25 bp, Rattus norvegicus
agcggaccaggttcaaggcctttgt

SEQ ID NO: 132207 - DNA, 25 bp, Rattus norvegicus
agcggaccttgtctttagatttgga

SEQ ID NO: 132208 - DNA, 25 bp, Rattus norvegicus
agcggaccttgtgtttagatttgga

SEQ ID NO: 132209 - DNA, 25 bp, Rattus norvegicus
agcggacgagccagaccaggtgact

SEQ ID NO: 132210 - DNA, 25 bp, Rattus norvegicus
agcggacgagcctgaccaggtgact

SEQ ID NO: 132211 - DNA, 25 bp, Rattus norvegicus
agcggactccagaggaacgttccag

SEQ ID NO: 132212 - DNA, 25 bp, Rattus norvegicus
agcggactccagtggaacgttccag

SEQ ID NO: 132213 - DNA, 25 bp, Rattus norvegicus
agcggactcctgcaaggcaagccaa

SEQ ID NO: 132214 - DNA, 25 bp, Rattus norvegicus
agcggactcctggaaggcaagccaa

SEQ ID NO: 132215 - DNA, 25 bp, Rattus norvegicus
agcggactctgtaaatgacctcttc

SEQ ID NO: 132216 - DNA, 25 bp, Rattus norvegicus
agcggactctgttaatgacctcttc

SEQ ID NO: 132217 - DNA, 25 bp, Rattus norvegicus
agcggactgagcacagcctggctgt

SEQ ID NO: 132218 - DNA, 25 bp, Rattus norvegicus
agcggactgagctcagcctggctgt

SEQ ID NO: 132219 - DNA, 25 bp, Rattus norvegicus
agcggagaaataaggtacacctctt

SEQ ID NO: 132220 - DNA, 25 bp, Rattus norvegicus
agcggagaaatatggtacacctctt

SEQ ID NO: 132221 - DNA, 25 bp, Rattus norvegicus
agcggagccatcagctgttttgttt

SEQ ID NO: 132222 - DNA, 25 bp, Rattus norvegicus
agcggagccatctgctgttttgttt

SEQ ID NO: 132223 - DNA, 25 bp, Rattus norvegicus
agcggagccccaagtctttgcctga

SEQ ID NO: 132224 - DNA, 25 bp, Rattus norvegicus
agcggagccccatgtctttgcctga

SEQ ID NO: 132225 - DNA, 25 bp, Rattus norvegicus
agcggagcgccccagcttggaggac

SEQ ID NO: 132226 - DNA, 25 bp, Rattus norvegicus
agcggagcgcccgagcttggaggac

SEQ ID NO: 132227 - DNA, 25 bp, Rattus norvegicus
agcggagcgtcgctcgctcgctctt

SEQ ID NO: 132228 - DNA, 25 bp, Rattus norvegicus
agcggagcgtcggtcgctcgctctt

SEQ ID NO: 132229 - DNA, 25 bp, Rattus norvegicus
agcggagctattcgctttctgcgaa

SEQ ID NO: 132230 - DNA, 25 bp, Rattus norvegicus
agcggagctattggctttctgcgaa

SEQ ID NO: 132231 - DNA, 25 bp, Rattus norvegicus
agcggagctgcaaccagtagagcta

SEQ ID NO: 132232 - DNA, 25 bp, Rattus norvegicus
agcggagctgcatccagtagagcta

SEQ ID NO: 132233 - DNA, 25 bp, Rattus norvegicus
agcggagggcatacctacaggccat

SEQ ID NO: 132234 - DNA, 25 bp, Rattus norvegicus
agcggagggcattcctacaggccat

SEQ ID NO: 132235 - DNA, 25 bp, Rattus norvegicus
agcggagggcgcctcatctgcggtg

SEQ ID NO: 132236 - DNA, 25 bp, Rattus norvegicus
agcggagggcgcgtcatctgcggtg

SEQ ID NO: 132237 - DNA, 25 bp, Rattus norvegicus
agcggagggctccagcgggcaatgg

SEQ ID NO: 132238 - DNA, 25 bp, Rattus norvegicus
agcggagggctcgagcgggcaatgg

SEQ ID NO: 132239 - DNA, 25 bp, Rattus norvegicus
agcggagtatgacctggtgtccctc

SEQ ID NO: 132240 - DNA, 25 bp, Rattus norvegicus
agcggagtatgagctggtgtccctc

SEQ ID NO: 132241 - DNA, 25 bp, Rattus norvegicus
agcggagtcatcctctggctcggaa

SEQ ID NO: 132242 - DNA, 25 bp, Rattus norvegicus
agcggagtcatcgtctggctcggaa

SEQ ID NO: 132243 - DNA, 25 bp, Rattus norvegicus
agcggagttacaacgcctggtggcc

SEQ ID NO: 132244 - DNA, 25 bp, Rattus norvegicus
agcggagttacatcgcctggtggcc

SEQ ID NO: 132245 - DNA, 25 bp, Rattus norvegicus
agcggagttggcagcagtccattcc

SEQ ID NO: 132246 - DNA, 25 bp, Rattus norvegicus
agcggagttggctgcagtccattcc

SEQ ID NO: 132247 - DNA, 25 bp, Rattus norvegicus
agcggataccctcactttaatagtt

SEQ ID NO: 132248 - DNA, 25 bp, Rattus norvegicus
agcggataccctgactttaatagtt

SEQ ID NO: 132249 - DNA, 25 bp, Rattus norvegicus
agcggatacttcaaggacttcccca

SEQ ID NO: 132250 - DNA, 25 bp, Rattus norvegicus
agcggatacttctaggacttcccca

SEQ ID NO: 132251 - DNA, 25 bp, Rattus norvegicus
agcggatagggcacactcaagagtc

SEQ ID NO: 132252 - DNA, 25 bp, Rattus norvegicus
agcggatagggctcactcaagagtc

SEQ ID NO: 132253 - DNA, 25 bp, Rattus norvegicus
agcggatatctgactattgccaggt

SEQ ID NO: 132254 - DNA, 25 bp, Rattus norvegicus
agcggatatctgtctattgccaggt

SEQ ID NO: 132255 - DNA, 25 bp, Rattus norvegicus
agcggatatgaaaccactgcctctt

SEQ ID NO: 132256 - DNA, 25 bp, Rattus norvegicus
agcggatatgaatccactgcctctt

SEQ ID NO: 132257 - DNA, 25 bp, Rattus norvegicus
agcggatcccaaatgcgcctgtctg

SEQ ID NO: 132258 - DNA, 25 bp, Rattus norvegicus
agcggatcccaattgcgcctgtctg

SEQ ID NO: 132259 - DNA, 25 bp, Rattus norvegicus
agcggatgcaggaggaaacgtctat

SEQ ID NO: 132260 - DNA, 25 bp, Rattus norvegicus
agcggatgcaggtggaaacgtctat

SEQ ID NO: 132261 - DNA, 25 bp, Rattus norvegicus
agcggatggaggagagatgactgat

SEQ ID NO: 132262 - DNA, 25 bp, Rattus norvegicus
agcggatggaggtgagatgactgat

SEQ ID NO: 132263 - DNA, 25 bp, Rattus norvegicus
agcggattcctgaagctcgaggcca

SEQ ID NO: 132264 - DNA, 25 bp, Rattus norvegicus
agcggattcctgtagctcgaggcca

SEQ ID NO: 132265 - DNA, 25 bp, Rattus norvegicus
agcggattgaaaactcctgtgccct

SEQ ID NO: 132266 - DNA, 25 bp, Rattus norvegicus
agcggattgaaatctcctgtgccct

SEQ ID NO: 132267 - DNA, 25 bp, Rattus norvegicus
agcggattgatgatcgtccccggaa

SEQ ID NO: 132268 - DNA, 25 bp, Rattus norvegicus
agcggattgatgttcgtccccggaa

SEQ ID NO: 132269 - DNA, 25 bp, Rattus norvegicus
agcggattgcgcacaaggccacaga

SEQ ID NO: 132270 - DNA, 25 bp, Rattus norvegicus
agcggattgcgctcaaggccacaga

SEQ ID NO: 132271 - DNA, 25 bp, Rattus norvegicus
agcggattgctcaaaacagttgcat

SEQ ID NO: 132272 - DNA, 25 bp, Rattus norvegicus
agcggattgctctaaacagttgcat

SEQ ID NO: 132273 - DNA, 25 bp, Rattus norvegicus
agcggcacagacagacctggtgtga

SEQ ID NO: 132274 - DNA, 25 bp, Rattus norvegicus
agcggcacagactgacctggtgtga

SEQ ID NO: 132275 - DNA, 25 bp, Rattus norvegicus
agcggcactggccagcattgtctct

SEQ ID NO: 132276 - DNA, 25 bp, Rattus norvegicus
agcggcactggcgagcattgtctct

SEQ ID NO: 132277 - DNA, 25 bp, Rattus norvegicus
agcggcactttcagaggctcagcag

SEQ ID NO: 132278 - DNA, 25 bp, Rattus norvegicus
agcggcactttctgaggctcagcag

SEQ ID NO: 132279 - DNA, 25 bp, Rattus norvegicus
agcggcagccgaagattgcccttcc

SEQ ID NO: 132280 - DNA, 25 bp, Rattus norvegicus
agcggcagccgatgattgcccttcc

SEQ ID NO: 132281 - DNA, 25 bp, Rattus norvegicus
agcggcagcctgacggtacatgcat

SEQ ID NO: 132282 - DNA, 25 bp, Rattus norvegicus
agcggcagcctgtcggtacatgcat

SEQ ID NO: 132283 - DNA, 25 bp, Rattus norvegicus
agcggcagctggaggctctccgaat

SEQ ID NO: 132284 - DNA, 25 bp, Rattus norvegicus
agcggcagctggtggctctccgaat

SEQ ID NO: 132285 - DNA, 25 bp, Rattus norvegicus
agcggcaggattcacctgaccccaa

SEQ ID NO: 132286 - DNA, 25 bp, Rattus norvegicus
agcggcaggattgacctgaccccaa

SEQ ID NO: 132287 - DNA, 25 bp, Rattus norvegicus
agcggcaggcggagcagctccctta

SEQ ID NO: 132288 - DNA, 25 bp, Rattus norvegicus
agcggcaggcggtgcagctccctta

SEQ ID NO: 132289 - DNA, 25 bp, Rattus norvegicus
agcggcaggttacaactcactcgag

SEQ ID NO: 132290 - DNA, 25 bp, Rattus norvegicus
agcggcaggttagaactcactcgag

SEQ ID NO: 132291 - DNA, 25 bp, Rattus norvegicus
agcggcagttcacatggcacccagg

SEQ ID NO: 132292 - DNA, 25 bp, Rattus norvegicus
agcggcagttcagatggcacccagg

SEQ ID NO: 132293 - DNA, 25 bp, Rattus norvegicus
agcggcatccaaagtcctttagtcg

SEQ ID NO: 132294 - DNA, 25 bp, Rattus norvegicus
agcggcatccaatgtcctttagtcg

SEQ ID NO: 132295 - DNA, 25 bp, Rattus norvegicus
agcggcatccacaatgaagtctcga

SEQ ID NO: 132296 - DNA, 25 bp, Rattus norvegicus
agcggcatccactatgaagtctcga

SEQ ID NO: 132297 - DNA, 25 bp, Rattus norvegicus
agcggcatccccaaattgcaagata

SEQ ID NO: 132298 - DNA, 25 bp, Rattus norvegicus
agcggcatcccctaattgcaagata

SEQ ID NO: 132299 - DNA, 25 bp, Rattus norvegicus
agcggcatctccaggattgagcagt

SEQ ID NO: 132300 - DNA, 25 bp, Rattus norvegicus
agcggcatctcctggattgagcagt

SEQ ID NO: 132301 - DNA, 25 bp, Rattus norvegicus
agcggcatgagcatagctgcgctaa

SEQ ID NO: 132302 - DNA, 25 bp, Rattus norvegicus
agcggcatgagcttagctgcgctaa

SEQ ID NO: 132303 - DNA, 25 bp, Rattus norvegicus
agcggcatttacacagggccttgga

SEQ ID NO: 132304 - DNA, 25 bp, Rattus norvegicus
agcggcatttactcagggccttgga

SEQ ID NO: 132305 - DNA, 25 bp, Rattus norvegicus
agcggcatttcaacgatgatgtgca

SEQ ID NO: 132306 - DNA, 25 bp, Rattus norvegicus
agcggcatttcatcgatgatgtgca

SEQ ID NO: 132307 - DNA, 25 bp, Rattus norvegicus
agcggccaacagcagccaacagcag

SEQ ID NO: 132308 - DNA, 25 bp, Rattus norvegicus
agcggccaacaggagccaacagcag

SEQ ID NO: 132309 - DNA, 25 bp, Rattus norvegicus
agcggccagggaccgcgatcctctt

SEQ ID NO: 132310 - DNA, 25 bp, Rattus norvegicus
agcggccagggagcgcgatcctctt

SEQ ID NO: 132311 - DNA, 25 bp, Rattus norvegicus
agcggcccagttctatgatgctagt

SEQ ID NO: 132312 - DNA, 25 bp, Rattus norvegicus
agcggcccagttgtatgatgctagt

SEQ ID NO: 132313 - DNA, 25 bp, Rattus norvegicus
agcggcccgagcagataaccttggt

SEQ ID NO: 132314 - DNA, 25 bp, Rattus norvegicus
agcggcccgagctgataaccttggt

SEQ ID NO: 132315 - DNA, 25 bp, Rattus norvegicus
agcggccctgtaaggaaggttcaca

SEQ ID NO: 132316 - DNA, 25 bp, Rattus norvegicus
agcggccctgtatggaaggttcaca

SEQ ID NO: 132317 - DNA, 25 bp, Rattus norvegicus
agcggccgtagcagcgcagcatcat

SEQ ID NO: 132318 - DNA, 25 bp, Rattus norvegicus
agcggccgtagctgcgcagcatcat

SEQ ID NO: 132319 - DNA, 25 bp, Rattus norvegicus
agcggcctcaagaactgtcacaatg

SEQ ID NO: 132320 - DNA, 25 bp, Rattus norvegicus
agcggcctcaagtactgtcacaatg

SEQ ID NO: 132321 - DNA, 25 bp, Rattus norvegicus
agcggcctccggctctttggagatt

SEQ ID NO: 132322 - DNA, 25 bp, Rattus norvegicus
agcggcctccgggtctttggagatt

SEQ ID NO: 132323 - DNA, 25 bp, Rattus norvegicus
agcggcctggcactcaatataaaaa

SEQ ID NO: 132324 - DNA, 25 bp, Rattus norvegicus
agcggcctggcagtcaatataaaaa

SEQ ID NO: 132325 - DNA, 25 bp, Rattus norvegicus
agcggcctgtaccttggcatgaatg

SEQ ID NO: 132326 - DNA, 25 bp, Rattus norvegicus
agcggcctgtacgttggcatgaatg

SEQ ID NO: 132327 - DNA, 25 bp, Rattus norvegicus
agcggcctgtctatgtgtgtactta

SEQ ID NO: 132328 - DNA, 25 bp, Rattus norvegicus
agcggcctgtctttgtgtgtactta

SEQ ID NO: 132329 - DNA, 25 bp, Rattus norvegicus
agcggccttgctaatatacttgaaa

SEQ ID NO: 132330 - DNA, 25 bp, Rattus norvegicus
agcggccttgcttatatacttgaaa

SEQ ID NO: 132331 - DNA, 25 bp, Rattus norvegicus
agcggccttgtcaatataccttgaa

SEQ ID NO: 132332 - DNA, 25 bp, Rattus norvegicus
agcggccttgtctatataccttgaa

SEQ ID NO: 132333 - DNA, 25 bp, Rattus norvegicus
agcggcgactgcaccgaaggaagaa

SEQ ID NO: 132334 - DNA, 25 bp, Rattus norvegicus
agcggcgactgctccgaaggaagaa

SEQ ID NO: 132335 - DNA, 25 bp, Rattus norvegicus
agcggcgagctcctcgccaaaggac

SEQ ID NO: 132336 - DNA, 25 bp, Rattus norvegicus
agcggcgagctcgtcgccaaaggac

SEQ ID NO: 132337 - DNA, 25 bp, Rattus norvegicus
agcggcgatacaactcccagttcaa

SEQ ID NO: 132338 - DNA, 25 bp, Rattus norvegicus
agcggcgatacatctcccagttcaa

SEQ ID NO: 132339 - DNA, 25 bp, Rattus norvegicus
agcggcgggaagatcgtactacgct

SEQ ID NO: 132340 - DNA, 25 bp, Rattus norvegicus
agcggcgggaagttcgtactacgct

SEQ ID NO: 132341 - DNA, 25 bp, Rattus norvegicus
agcggcgttgatatgtctgacctcg

SEQ ID NO: 132342 - DNA, 25 bp, Rattus norvegicus
agcggcgttgatttgtctgacctcg

SEQ ID NO: 132343 - DNA, 25 bp, Rattus norvegicus
agcggctcaaggaggttttccagac

SEQ ID NO: 132344 - DNA, 25 bp, Rattus norvegicus
agcggctcaaggtggttttccagac

SEQ ID NO: 132345 - DNA, 25 bp, Rattus norvegicus
agcggctcatctacagtggcaaaca

SEQ ID NO: 132346 - DNA, 25 bp, Rattus norvegicus
agcggctcatcttcagtggcaaaca

SEQ ID NO: 132347 - DNA, 25 bp, Rattus norvegicus
agcggctcccaccatggaagagttg

SEQ ID NO: 132348 - DNA, 25 bp, Rattus norvegicus
agcggctcccacgatggaagagttg

SEQ ID NO: 132349 - DNA, 25 bp, Rattus norvegicus
agcggctccgtcactgtgaatgcgg

SEQ ID NO: 132350 - DNA, 25 bp, Rattus norvegicus
agcggctccgtctctgtgaatgcgg

SEQ ID NO: 132351 - DNA, 25 bp, Rattus norvegicus
agcggctcctaaacacatgcgattc

SEQ ID NO: 132352 - DNA, 25 bp, Rattus norvegicus
agcggctcctaatcacatgcgattc

SEQ ID NO: 132353 - DNA, 25 bp, Rattus norvegicus
agcggctcctgtatgtttcctgcaa

SEQ ID NO: 132354 - DNA, 25 bp, Rattus norvegicus
agcggctcctgtttgtttcctgcaa

SEQ ID NO: 132355 - DNA, 25 bp, Rattus norvegicus
agcggctctcatcctgtgctcttgg

SEQ ID NO: 132356 - DNA, 25 bp, Rattus norvegicus
agcggctctcatgctgtgctcttgg

SEQ ID NO: 132357 - DNA, 25 bp, Rattus norvegicus
agcggctctggcaggctatatcgag

SEQ ID NO: 132358 - DNA, 25 bp, Rattus norvegicus
agcggctctggctggctatatcgag

SEQ ID NO: 132359 - DNA, 25 bp, Rattus norvegicus
agcggctctttgactcactgctctg

SEQ ID NO: 132360 - DNA, 25 bp, Rattus norvegicus
agcggctctttgtctcactgctctg

SEQ ID NO: 132361 - DNA, 25 bp, Rattus norvegicus
agcggctgaaggcacgcagttttct

SEQ ID NO: 132362 - DNA, 25 bp, Rattus norvegicus
agcggctgaagggacgcagttttct

SEQ ID NO: 132363 - DNA, 25 bp, Rattus norvegicus
agcggctgaggcactggcttgtctt

SEQ ID NO: 132364 - DNA, 25 bp, Rattus norvegicus
agcggctgaggctctggcttgtctt

SEQ ID NO: 132365 - DNA, 25 bp, Rattus norvegicus
agcggctgccagatcaaaaaatcaa

SEQ ID NO: 132366 - DNA, 25 bp, Rattus norvegicus
agcggctgccagttcaaaaaatcaa

SEQ ID NO: 132367 - DNA, 25 bp, Rattus norvegicus
agcggctgcggtcagcggcgtgtac

SEQ ID NO: 132368 - DNA, 25 bp, Rattus norvegicus
agcggctgcggtgagcggcgtgtac

SEQ ID NO: 132369 - DNA, 25 bp, Rattus norvegicus
agcggctgcttgactggatccaaga

SEQ ID NO: 132370 - DNA, 25 bp, Rattus norvegicus
agcggctgcttgtctggatccaaga

SEQ ID NO: 132371 - DNA, 25 bp, Rattus norvegicus
agcggctgtacccactgcgcaagta

SEQ ID NO: 132372 - DNA, 25 bp, Rattus norvegicus
agcggctgtaccgactgcgcaagta

SEQ ID NO: 132373 - DNA, 25 bp, Rattus norvegicus
agcggctgttacactgttccttagc

SEQ ID NO: 132374 - DNA, 25 bp, Rattus norvegicus
agcggctgttactctgttccttagc

SEQ ID NO: 132375 - DNA, 25 bp, Rattus norvegicus
agcggctgttagatcatgctcacag

SEQ ID NO: 132376 - DNA, 25 bp, Rattus norvegicus
agcggctgttagttcatgctcacag

SEQ ID NO: 132377 - DNA, 25 bp, Rattus norvegicus
agcggcttaggcagcgactgaccaa

SEQ ID NO: 132378 - DNA, 25 bp, Rattus norvegicus
agcggcttaggctgcgactgaccaa

SEQ ID NO: 132379 - DNA, 25 bp, Rattus norvegicus
agcggcttatacatggcgtgtctca

SEQ ID NO: 132380 - DNA, 25 bp, Rattus norvegicus
agcggcttatacttggcgtgtctca

SEQ ID NO: 132381 - DNA, 25 bp, Rattus norvegicus
agcggcttcggaacaattcgctcag

SEQ ID NO: 132382 - DNA, 25 bp, Rattus norvegicus
agcggcttcggatcaattcgctcag

SEQ ID NO: 132383 - DNA, 25 bp, Rattus norvegicus
agcggcttctggacttgagcacgta

SEQ ID NO: 132384 - DNA, 25 bp, Rattus norvegicus
agcggcttctggtcttgagcacgta

SEQ ID NO: 132385 - DNA, 25 bp, Rattus norvegicus
agcggcttgagaagcttggcgactc

SEQ ID NO: 132386 - DNA, 25 bp, Rattus norvegicus
agcggcttgagatgcttggcgactc

SEQ ID NO: 132387 - DNA, 25 bp, Rattus norvegicus
agcggcttgatcagtgggtgtaaac

SEQ ID NO: 132388 - DNA, 25 bp, Rattus norvegicus
agcggcttgatctgtgggtgtaaac

SEQ ID NO: 132389 - DNA, 25 bp, Rattus norvegicus
agcggcttgttcctggacctatgct

SEQ ID NO: 132390 - DNA, 25 bp, Rattus norvegicus
agcggcttgttcgtggacctatgct

SEQ ID NO: 132391 - DNA, 25 bp, Rattus norvegicus
agcggctttcagagattgtgacctt

SEQ ID NO: 132392 - DNA, 25 bp, Rattus norvegicus
agcggctttcagctctggataatct

SEQ ID NO: 132393 - DNA, 25 bp, Rattus norvegicus
agcggctttcaggtctggataatct

SEQ ID NO: 132394 - DNA, 25 bp, Rattus norvegicus
agcggctttcagtgattgtgacctt

SEQ ID NO: 132395 - DNA, 25 bp, Rattus norvegicus
agcgggaaagcacccaccagcagat

SEQ ID NO: 132396 - DNA, 25 bp, Rattus norvegicus
agcgggaaagcagccaccagcagat

SEQ ID NO: 132397 - DNA, 25 bp, Rattus norvegicus
agcgggaagctccacacttgctgag

SEQ ID NO: 132398 - DNA, 25 bp, Rattus norvegicus
agcgggaagctcgacacttgctgag

SEQ ID NO: 132399 - DNA, 25 bp, Rattus norvegicus
agcgggaagtctagcttgtcaaaaa

SEQ ID NO: 132400 - DNA, 25 bp, Rattus norvegicus
agcgggaagtcttgcttgtcaaaaa

SEQ ID NO: 132401 - DNA, 25 bp, Rattus norvegicus
agcgggaatctcactgcaggctgga

SEQ ID NO: 132402 - DNA, 25 bp, Rattus norvegicus
agcgggaatctctctgcaggctgga

SEQ ID NO: 132403 - DNA, 25 bp, Rattus norvegicus
agcgggaatgtcaggactctgctca

SEQ ID NO: 132404 - DNA, 25 bp, Rattus norvegicus
agcgggaatgtctggactctgctca

SEQ ID NO: 132405 - DNA, 25 bp, Rattus norvegicus
agcgggacccgtctatccatagagc

SEQ ID NO: 132406 - DNA, 25 bp, Rattus norvegicus
agcgggacccgtgtatccatagagc

SEQ ID NO: 132407 - DNA, 25 bp, Rattus norvegicus
agcgggactctgatgatgccattgg

SEQ ID NO: 132408 - DNA, 25 bp, Rattus norvegicus
agcgggactctgttgatgccattgg

SEQ ID NO: 132409 - DNA, 25 bp, Rattus norvegicus
agcgggactttgatccgggcaaatg

SEQ ID NO: 132410 - DNA, 25 bp, Rattus norvegicus
agcgggactttgttccgggcaaatg

SEQ ID NO: 132411 - DNA, 25 bp, Rattus norvegicus
agcgggagccctactaatggatttt

SEQ ID NO: 132412 - DNA, 25 bp, Rattus norvegicus
agcgggagcccttctaatggatttt

SEQ ID NO: 132413 - DNA, 25 bp, Rattus norvegicus
agcgggagctgacacctgctcgtcc

SEQ ID NO: 132414 - DNA, 25 bp, Rattus norvegicus
agcgggagctgagacctgctcgtcc

SEQ ID NO: 132415 - DNA, 25 bp, Rattus norvegicus
agcgggagggtgagagcgcgcccca

SEQ ID NO: 132416 - DNA, 25 bp, Rattus norvegicus
agcgggagggtgtgagcgcgcccca

SEQ ID NO: 132417 - DNA, 25 bp, Rattus norvegicus
agcgggatcctcagtgagtgcagca

SEQ ID NO: 132418 - DNA, 25 bp, Rattus norvegicus
agcgggatcctctgtgagtgcagca

SEQ ID NO: 132419 - DNA, 25 bp, Rattus norvegicus
agcgggattatgacttctacctggc

SEQ ID NO: 132420 - DNA, 25 bp, Rattus norvegicus
agcgggattatgtcttctacctggc

SEQ ID NO: 132421 - DNA, 25 bp, Rattus norvegicus
agcgggattggtccacacttggaaa

SEQ ID NO: 132422 - DNA, 25 bp, Rattus norvegicus
agcgggattggtgcacacttggaaa

SEQ ID NO: 132423 - DNA, 25 bp, Rattus norvegicus
agcgggcacgataactggcagtcaa

SEQ ID NO: 132424 - DNA, 25 bp, Rattus norvegicus
agcgggcacgattactggcagtcaa

SEQ ID NO: 132425 - DNA, 25 bp, Rattus norvegicus
agcgggcattaaaccggctgtatgg

SEQ ID NO: 132426 - DNA, 25 bp, Rattus norvegicus
agcgggcattaatccggctgtatgg

SEQ ID NO: 132427 - DNA, 25 bp, Rattus norvegicus
agcgggccagttaggtttttcagtg

SEQ ID NO: 132428 - DNA, 25 bp, Rattus norvegicus
agcgggccagtttggtttttcagtg

SEQ ID NO: 132429 - DNA, 25 bp, Rattus norvegicus
agcgggcctcagacaaatccaagat

SEQ ID NO: 132430 - DNA, 25 bp, Rattus norvegicus
agcgggcctcagtcaaatccaagat

SEQ ID NO: 132431 - DNA, 25 bp, Rattus norvegicus
agcgggcgcacgcttgcttccaaga

SEQ ID NO: 132432 - DNA, 25 bp, Rattus norvegicus
agcgggcgcacggttgcttccaaga

SEQ ID NO: 132433 - DNA, 25 bp, Rattus norvegicus
agcgggcggtgaagctccggctgct

SEQ ID NO: 132434 - DNA, 25 bp, Rattus norvegicus
agcgggcggtgatgctccggctgct

SEQ ID NO: 132435 - DNA, 25 bp, Rattus norvegicus
agcgggctcatgatggccaaccaca

SEQ ID NO: 132436 - DNA, 25 bp, Rattus norvegicus
agcgggctcatgttggccaaccaca

SEQ ID NO: 132437 - DNA, 25 bp, Rattus norvegicus
agcgggctcttacgccgggatggaa

SEQ ID NO: 132438 - DNA, 25 bp, Rattus norvegicus
agcgggctcttaggccgggatggaa

SEQ ID NO: 132439 - DNA, 25 bp, Rattus norvegicus
agcgggctgctcacccaggagtaga

SEQ ID NO: 132440 - DNA, 25 bp, Rattus norvegicus
agcgggctgctctcccaggagtaga

SEQ ID NO: 132441 - DNA, 25 bp, Rattus norvegicus
agcgggtacatacgactgagccatc

SEQ ID NO: 132442 - DNA, 25 bp, Rattus norvegicus
agcgggtacataggactgagccatc

SEQ ID NO: 132443 - DNA, 25 bp, Rattus norvegicus
agcgggtaccacctgaggagaacca

SEQ ID NO: 132444 - DNA, 25 bp, Rattus norvegicus
agcgggtaccacgtgaggagaacca

SEQ ID NO: 132445 - DNA, 25 bp, Rattus norvegicus
agcgggtagggtaccagacctgctc

SEQ ID NO: 132446 - DNA, 25 bp, Rattus norvegicus
agcgggtagggttccagacctgctc

SEQ ID NO: 132447 - DNA, 25 bp, Rattus norvegicus
agcgggtcacaaacacatacggcaa

SEQ ID NO: 132448 - DNA, 25 bp, Rattus norvegicus
agcgggtcacaatcacatacggcaa

SEQ ID NO: 132449 - DNA, 25 bp, Rattus norvegicus
agcgggtcacatcgcattgtattca

SEQ ID NO: 132450 - DNA, 25 bp, Rattus norvegicus
agcgggtcacatggcattgtattca

SEQ ID NO: 132451 - DNA, 25 bp, Rattus norvegicus
agcgggtcatccaacaacacaggct

SEQ ID NO: 132452 - DNA, 25 bp, Rattus norvegicus
agcgggtcatcctacaacacaggct

SEQ ID NO: 132453 - DNA, 25 bp, Rattus norvegicus
agcgggtccgagacctaacagcata

SEQ ID NO: 132454 - DNA, 25 bp, Rattus norvegicus
agcgggtccgagtcctaacagcata

SEQ ID NO: 132455 - DNA, 25 bp, Rattus norvegicus
agcgggtctaacagtggcctggatt

SEQ ID NO: 132456 - DNA, 25 bp, Rattus norvegicus
agcgggtctaactgtggcctggatt

SEQ ID NO: 132457 - DNA, 25 bp, Rattus norvegicus
agcgggtctatgagttccctaagaa

SEQ ID NO: 132458 - DNA, 25 bp, Rattus norvegicus
agcgggtctatgtgttccctaagaa

SEQ ID NO: 132459 - DNA, 25 bp, Rattus norvegicus
agcgggtctgtaaggctgtgctcct

SEQ ID NO: 132460 - DNA, 25 bp, Rattus norvegicus
agcgggtctgtatggctgtgctcct

SEQ ID NO: 132461 - DNA, 25 bp, Rattus norvegicus
agcgggtgacacaatgcaatgcagt

SEQ ID NO: 132462 - DNA, 25 bp, Rattus norvegicus
agcgggtgacactatgcaatgcagt

SEQ ID NO: 132463 - DNA, 25 bp, Rattus norvegicus
agcgggtgctgcagacaggtcttca

SEQ ID NO: 132464 - DNA, 25 bp, Rattus norvegicus
agcgggtgctgctgacaggtcttca

SEQ ID NO: 132465 - DNA, 25 bp, Rattus norvegicus
agcgggttaagcatctcagggctga

SEQ ID NO: 132466 - DNA, 25 bp, Rattus norvegicus
agcgggttaagcttctcagggctga

SEQ ID NO: 132467 - DNA, 25 bp, Rattus norvegicus
agcgggttcaaccattgctgtctga

SEQ ID NO: 132468 - DNA, 25 bp, Rattus norvegicus
agcgggttcaacgattgctgtctga

SEQ ID NO: 132469 - DNA, 25 bp, Rattus norvegicus
agcgggttgtgcacaaaactagcag

SEQ ID NO: 132470 - DNA, 25 bp, Rattus norvegicus
agcgggttgtgctcaaaactagcag

SEQ ID NO: 132471 - DNA, 25 bp, Rattus norvegicus
agcgggtttcctatcttgctttgga

SEQ ID NO: 132472 - DNA, 25 bp, Rattus norvegicus
agcgggtttcctttcttgctttgga

SEQ ID NO: 132473 - DNA, 25 bp, Rattus norvegicus
agcgggtttgttctttgctcttggc

SEQ ID NO: 132474 - DNA, 25 bp, Rattus norvegicus
agcgggtttgttgtttgctcttggc

SEQ ID NO: 132475 - DNA, 25 bp, Rattus norvegicus
agcggtacacgcagagagtgaccaa

SEQ ID NO: 132476 - DNA, 25 bp, Rattus norvegicus
agcggtacacgctgagagtgaccaa

SEQ ID NO: 132477 - DNA, 25 bp, Rattus norvegicus
agcggtaccacacctggacgatcta

SEQ ID NO: 132478 - DNA, 25 bp, Rattus norvegicus
agcggtaccacagctggacgatcta

SEQ ID NO: 132479 - DNA, 25 bp, Rattus norvegicus
agcggtacctgtctttttcgtcact

SEQ ID NO: 132480 - DNA, 25 bp, Rattus norvegicus
agcggtacctgtgtttttcgtcact

SEQ ID NO: 132481 - DNA, 25 bp, Rattus norvegicus
agcggtagctctagccacagtcagg

SEQ ID NO: 132482 - DNA, 25 bp, Rattus norvegicus
agcggtagctcttgccacagtcagg

SEQ ID NO: 132483 - DNA, 25 bp, Rattus norvegicus
agcggtatcatgctgctcatatgct

SEQ ID NO: 132484 - DNA, 25 bp, Rattus norvegicus
agcggtatcatggtgctcatatgct

SEQ ID NO: 132485 - DNA, 25 bp, Rattus norvegicus
agcggtcacaggagtcccaccggtc

SEQ ID NO: 132486 - DNA, 25 bp, Rattus norvegicus
agcggtcacaggtgtcccaccggtc

SEQ ID NO: 132487 - DNA, 25 bp, Rattus norvegicus
agcggtcactcacctcacagtggta

SEQ ID NO: 132488 - DNA, 25 bp, Rattus norvegicus
agcggtcactcagctcacagtggta

SEQ ID NO: 132489 - DNA, 25 bp, Rattus norvegicus
agcggtcactgacattccacagaga

SEQ ID NO: 132490 - DNA, 25 bp, Rattus norvegicus
agcggtcactgagattccacagaga

SEQ ID NO: 132491 - DNA, 25 bp, Rattus norvegicus
agcggtcagacacagcactatgcgt

SEQ ID NO: 132492 - DNA, 25 bp, Rattus norvegicus
agcggtcagacagagcactatgcgt

SEQ ID NO: 132493 - DNA, 25 bp, Rattus norvegicus
agcggtcagctcattatcaatcaaa

SEQ ID NO: 132494 - DNA, 25 bp, Rattus norvegicus
agcggtcagctctttatcaatcaaa

SEQ ID NO: 132495 - DNA, 25 bp, Rattus norvegicus
agcggtccaagtacatagtccaatg

SEQ ID NO: 132496 - DNA, 25 bp, Rattus norvegicus
agcggtccaagttcatagtccaatg

SEQ ID NO: 132497 - DNA, 25 bp, Rattus norvegicus
agcggtccatgacgtacgtacttcc

SEQ ID NO: 132498 - DNA, 25 bp, Rattus norvegicus
agcggtccatgaggtacgtacttcc

SEQ ID NO: 132499 - DNA, 25 bp, Rattus norvegicus
agcggtcccctcagaggaagtgttg

SEQ ID NO: 132500 - DNA, 25 bp, Rattus norvegicus
agcggtcccctctgaggaagtgttg

SEQ ID NO: 132501 - DNA, 25 bp, Rattus norvegicus
agcggtccgggaacaccgatctttg

SEQ ID NO: 132502 - DNA, 25 bp, Rattus norvegicus
agcggtccgggatcaccgatctttg

SEQ ID NO: 132503 - DNA, 25 bp, Rattus norvegicus
agcggtcgtgtaacaggatggattt

SEQ ID NO: 132504 - DNA, 25 bp, Rattus norvegicus
agcggtcgtgtatcaggatggattt

SEQ ID NO: 132505 - DNA, 25 bp, Rattus norvegicus
agcggtctcagcaggtggtaacgtc

SEQ ID NO: 132506 - DNA, 25 bp, Rattus norvegicus
agcggtctcagctggtggtaacgtc

SEQ ID NO: 132507 - DNA, 25 bp, Rattus norvegicus
agcggtctccacagcattgcgagga

SEQ ID NO: 132508 - DNA, 25 bp, Rattus norvegicus
agcggtctccactgcattgcgagga

SEQ ID NO: 132509 - DNA, 25 bp, Rattus norvegicus
agcggtctgaatcttcgttctttct

SEQ ID NO: 132510 - DNA, 25 bp, Rattus norvegicus
agcggtctgaatgttcgttctttct

SEQ ID NO: 132511 - DNA, 25 bp, Rattus norvegicus
agcggtctgctcattgcggttcaca

SEQ ID NO: 132512 - DNA, 25 bp, Rattus norvegicus
agcggtctgctctttgcggttcaca

SEQ ID NO: 132513 - DNA, 25 bp, Rattus norvegicus
agcggtcttcacattaacagtctca

SEQ ID NO: 132514 - DNA, 25 bp, Rattus norvegicus
agcggtcttcactttaacagtctca

SEQ ID NO: 132515 - DNA, 25 bp, Rattus norvegicus
agcggtgactgcactgcgatggtct

SEQ ID NO: 132516 - DNA, 25 bp, Rattus norvegicus
agcggtgactgctctgcgatggtct

SEQ ID NO: 132517 - DNA, 25 bp, Rattus norvegicus
agcggtgcattcagatgtcttgtct

SEQ ID NO: 132518 - DNA, 25 bp, Rattus norvegicus
agcggtgcattctgatgtcttgtct

SEQ ID NO: 132519 - DNA, 25 bp, Rattus norvegicus
agcggtgccaagaaggaacgcccct

SEQ ID NO: 132520 - DNA, 25 bp, Rattus norvegicus
agcggtgccaagtaggaacgcccct

SEQ ID NO: 132521 - DNA, 25 bp, Rattus norvegicus
agcggtgcctctatagagttttcta

SEQ ID NO: 132522 - DNA, 25 bp, Rattus norvegicus
agcggtgcctctttagagttttcta

SEQ ID NO: 132523 - DNA, 25 bp, Rattus norvegicus
agcggtgccttgagcaatgtcagtg

SEQ ID NO: 132524 - DNA, 25 bp, Rattus norvegicus
agcggtgccttgtgcaatgtcagtg

SEQ ID NO: 132525 - DNA, 25 bp, Rattus norvegicus
agcggtggactcaggatcctggaat

SEQ ID NO: 132526 - DNA, 25 bp, Rattus norvegicus
agcggtggactctggatcctggaat

SEQ ID NO: 132527 - DNA, 25 bp, Rattus norvegicus
agcggtggcagcagttcaacatcct

SEQ ID NO: 132528 - DNA, 25 bp, Rattus norvegicus
agcggtggcagctgttcaacatcct

SEQ ID NO: 132529 - DNA, 25 bp, Rattus norvegicus
agcggtggccgtactccgtaagatg

SEQ ID NO: 132530 - DNA, 25 bp, Rattus norvegicus
agcggtggccgttctccgtaagatg

SEQ ID NO: 132531 - DNA, 25 bp, Rattus norvegicus
agcggtgtacatctcagttctagaa

SEQ ID NO: 132532 - DNA, 25 bp, Rattus norvegicus
agcggtgtacatgtcagttctagaa

SEQ ID NO: 132533 - DNA, 25 bp, Rattus norvegicus
agcggtgtgcttccggacgccatct

SEQ ID NO: 132534 - DNA, 25 bp, Rattus norvegicus
agcggtgtgcttgcggacgccatct

SEQ ID NO: 132535 - DNA, 25 bp, Rattus norvegicus
agcggtgttgggaaatgtgaaccct

SEQ ID NO: 132536 - DNA, 25 bp, Rattus norvegicus
agcggtgttgggtaatgtgaaccct

SEQ ID NO: 132537 - DNA, 25 bp, Rattus norvegicus
agcggttaaaggaaaatctctgtga

SEQ ID NO: 132538 - DNA, 25 bp, Rattus norvegicus
agcggttaaaggtaaatctctgtga

SEQ ID NO: 132539 - DNA, 25 bp, Rattus norvegicus
agcggttagggaccagcagattcca

SEQ ID NO: 132540 - DNA, 25 bp, Rattus norvegicus
agcggttagggagcagcagattcca

SEQ ID NO: 132541 - DNA, 25 bp, Rattus norvegicus
agcggttcattcagcccaaaggtta

SEQ ID NO: 132542 - DNA, 25 bp, Rattus norvegicus
agcggttcattctgcccaaaggtta

SEQ ID NO: 132543 - DNA, 25 bp, Rattus norvegicus
agcggttctgttcgacttgtattta

SEQ ID NO: 132544 - DNA, 25 bp, Rattus norvegicus
agcggttctgttggacttgtattta

SEQ ID NO: 132545 - DNA, 25 bp, Rattus norvegicus
agcggttgccatcctgtggaagctc

SEQ ID NO: 132546 - DNA, 25 bp, Rattus norvegicus
agcggttgccatgctgtggaagctc

SEQ ID NO: 132547 - DNA, 25 bp, Rattus norvegicus
agcggttggcccaggatttgacttt

SEQ ID NO: 132548 - DNA, 25 bp, Rattus norvegicus
agcggttggccctggatttgacttt

SEQ ID NO: 132549 - DNA, 25 bp, Rattus norvegicus
agcggttgtatgatgtttgccgaac

SEQ ID NO: 132550 - DNA, 25 bp, Rattus norvegicus
agcggttgtatgttgtttgccgaac

SEQ ID NO: 132551 - DNA, 25 bp, Rattus norvegicus
agcggtttagccacattaattaatt

SEQ ID NO: 132552 - DNA, 25 bp, Rattus norvegicus
agcggtttagcctcattaattaatt

SEQ ID NO: 132553 - DNA, 25 bp, Rattus norvegicus
agcggtttcactagcgggagatcca

SEQ ID NO: 132554 - DNA, 25 bp, Rattus norvegicus
agcggtttcacttgcgggagatcca

SEQ ID NO: 132555 - DNA, 25 bp, Rattus norvegicus
agcggtttctgcaacacaatacagt

SEQ ID NO: 132556 - DNA, 25 bp, Rattus norvegicus
agcggtttctgctacacaatacagt

SEQ ID NO: 132557 - DNA, 25 bp, Rattus norvegicus
agcggttttcagagagctctgtgta

SEQ ID NO: 132558 - DNA, 25 bp, Rattus norvegicus
agcggttttcagtgagctctgtgta

SEQ ID NO: 132559 - DNA, 25 bp, Rattus norvegicus
agcgtaagcattctgacctctgcct

SEQ ID NO: 132560 - DNA, 25 bp, Rattus norvegicus
agcgtaagcattgtgacctctgcct

SEQ ID NO: 132561 - DNA, 25 bp, Rattus norvegicus
agcgtaatctctaggctgtttatac

SEQ ID NO: 132562 - DNA, 25 bp, Rattus norvegicus
agcgtaatctcttggctgtttatac

SEQ ID NO: 132563 - DNA, 25 bp, Rattus norvegicus
agcgtaatggcaagtctgacttctg

SEQ ID NO: 132564 - DNA, 25 bp, Rattus norvegicus
agcgtaatggcatgtctgacttctg

SEQ ID NO: 132565 - DNA, 25 bp, Rattus norvegicus
agcgtacctcatctcagctactgta

SEQ ID NO: 132566 - DNA, 25 bp, Rattus norvegicus
agcgtacctcatgtcagctactgta

SEQ ID NO: 132567 - DNA, 25 bp, Rattus norvegicus
agcgtactatgcacacctggtggcg

SEQ ID NO: 132568 - DNA, 25 bp, Rattus norvegicus
agcgtactatgctcacctggtggcg

SEQ ID NO: 132569 - DNA, 25 bp, Rattus norvegicus
agcgtagaaggcacgcatctcaaca

SEQ ID NO: 132570 - DNA, 25 bp, Rattus norvegicus
agcgtagaaggctcgcatctcaaca

SEQ ID NO: 132571 - DNA, 25 bp, Rattus norvegicus
agcgtagacggaagcgtttggctct

SEQ ID NO: 132572 - DNA, 25 bp, Rattus norvegicus
agcgtagacggatgcgtttggctct

SEQ ID NO: 132573 - DNA, 25 bp, Rattus norvegicus
agcgtagagatgacttcttcccaaa

SEQ ID NO: 132574 - DNA, 25 bp, Rattus norvegicus
agcgtagagatgtcttcttcccaaa

SEQ ID NO: 132575 - DNA, 25 bp, Rattus norvegicus
agcgtagagcccaccgagcatgagg

SEQ ID NO: 132576 - DNA, 25 bp, Rattus norvegicus
agcgtagagccctccgagcatgagg

SEQ ID NO: 132577 - DNA, 25 bp, Rattus norvegicus
agcgtagatctgcagggaatcccta

SEQ ID NO: 132578 - DNA, 25 bp, Rattus norvegicus
agcgtagatctggagggaatcccta

SEQ ID NO: 132579 - DNA, 25 bp, Rattus norvegicus
agcgtagcctgtccagtctggagct

SEQ ID NO: 132580 - DNA, 25 bp, Rattus norvegicus
agcgtagcctgtgcagtctggagct

SEQ ID NO: 132581 - DNA, 25 bp, Rattus norvegicus
agcgtagcttccactacaagttcac

SEQ ID NO: 132582 - DNA, 25 bp, Rattus norvegicus
agcgtagcttcctctacaagttcac

SEQ ID NO: 132583 - DNA, 25 bp, Rattus norvegicus
agcgtaggcctcacacagcttttaa

SEQ ID NO: 132584 - DNA, 25 bp, Rattus norvegicus
agcgtaggcctctcacagcttttaa

SEQ ID NO: 132585 - DNA, 25 bp, Rattus norvegicus
agcgtagtattgattgtcttgcaaa

SEQ ID NO: 132586 - DNA, 25 bp, Rattus norvegicus
agcgtagtattgtttgtcttgcaaa

SEQ ID NO: 132587 - DNA, 25 bp, Rattus norvegicus
agcgtagtctgcaagctcgacagtc

SEQ ID NO: 132588 - DNA, 25 bp, Rattus norvegicus
agcgtagtctgctagctcgacagtc

SEQ ID NO: 132589 - DNA, 25 bp, Rattus norvegicus
agcgtatacttgattgccacctggt

SEQ ID NO: 132590 - DNA, 25 bp, Rattus norvegicus
agcgtatacttgtttgccacctggt

SEQ ID NO: 132591 - DNA, 25 bp, Rattus norvegicus
agcgtatggcccagctggcactgat

SEQ ID NO: 132592 - DNA, 25 bp, Rattus norvegicus
agcgtatggccctgctggcactgat

SEQ ID NO: 132593 - DNA, 25 bp, Rattus norvegicus
agcgtatttattagagcctcctcgt

SEQ ID NO: 132594 - DNA, 25 bp, Rattus norvegicus
agcgtatttatttgagcctcctcgt

SEQ ID NO: 132595 - DNA, 25 bp, Rattus norvegicus
agcgtatttcagacttggtattcct

SEQ ID NO: 132596 - DNA, 25 bp, Rattus norvegicus
agcgtatttcagtcttggtattcct

SEQ ID NO: 132597 - DNA, 25 bp, Rattus norvegicus
agcgtattttatcactacctataga

SEQ ID NO: 132598 - DNA, 25 bp, Rattus norvegicus
agcgtattttatgactacctataga

SEQ ID NO: 132599 - DNA, 25 bp, Rattus norvegicus
agcgtcaactaacctgggaacatgg

SEQ ID NO: 132600 - DNA, 25 bp, Rattus norvegicus
agcgtcaactaagctgggaacatgg

SEQ ID NO: 132601 - DNA, 25 bp, Rattus norvegicus
agcgtcaccttccaactatccggtg

SEQ ID NO: 132602 - DNA, 25 bp, Rattus norvegicus
agcgtcaccttcgaactatccggtg

SEQ ID NO: 132603 - DNA, 25 bp, Rattus norvegicus
agcgtcacgagacccaccagtgata

SEQ ID NO: 132604 - DNA, 25 bp, Rattus norvegicus
agcgtcacgagagccaccagtgata

SEQ ID NO: 132605 - DNA, 25 bp, Rattus norvegicus
agcgtcactctgatgggcgggctct

SEQ ID NO: 132606 - DNA, 25 bp, Rattus norvegicus
agcgtcactctgttgggcgggctct

SEQ ID NO: 132607 - DNA, 25 bp, Rattus norvegicus
agcgtcagatgtacatcctcctgaa

SEQ ID NO: 132608 - DNA, 25 bp, Rattus norvegicus
agcgtcagatgttcatcctcctgaa

SEQ ID NO: 132609 - DNA, 25 bp, Rattus norvegicus
agcgtcagcaataccatcaactcag

SEQ ID NO: 132610 - DNA, 25 bp, Rattus norvegicus
agcgtcagcaattccatcaactcag

SEQ ID NO: 132611 - DNA, 25 bp, Rattus norvegicus
agcgtcagctgactgttgccaggaa

SEQ ID NO: 132612 - DNA, 25 bp, Rattus norvegicus
agcgtcagctgacttggaacctgcg

SEQ ID NO: 132613 - DNA, 25 bp, Rattus norvegicus
agcgtcagctgagtgttgccaggaa

SEQ ID NO: 132614 - DNA, 25 bp, Rattus norvegicus
agcgtcagctgagttggaacctgcg

SEQ ID NO: 132615 - DNA, 25 bp, Rattus norvegicus
agcgtcagtgatactcacacatcgc

SEQ ID NO: 132616 - DNA, 25 bp, Rattus norvegicus
agcgtcagtgattctcacacatcgc

SEQ ID NO: 132617 - DNA, 25 bp, Rattus norvegicus
agcgtcagtttccttacctgtaaag

SEQ ID NO: 132618 - DNA, 25 bp, Rattus norvegicus
agcgtcagtttcgttacctgtaaag

SEQ ID NO: 132619 - DNA, 25 bp, Rattus norvegicus
agcgtcatcgcaaagttctgcgcga

SEQ ID NO: 132620 - DNA, 25 bp, Rattus norvegicus
agcgtcatcgcatagttctgcgcga

SEQ ID NO: 132621 - DNA, 25 bp, Rattus norvegicus
agcgtcatctaactccttttatgta

SEQ ID NO: 132622 - DNA, 25 bp, Rattus norvegicus
agcgtcatctaagtccttttatgta

SEQ ID NO: 132623 - DNA, 25 bp, Rattus norvegicus
agcgtcatctgtaagggcggcatct

SEQ ID NO: 132624 - DNA, 25 bp, Rattus norvegicus
agcgtcatctgttagggcggcatct

SEQ ID NO: 132625 - DNA, 25 bp, Rattus norvegicus
agcgtcatggagcacgacatcctca

SEQ ID NO: 132626 - DNA, 25 bp, Rattus norvegicus
agcgtcatggaggacgacatcctca

SEQ ID NO: 132627 - DNA, 25 bp, Rattus norvegicus
agcgtcatggccactttgatatcag

SEQ ID NO: 132628 - DNA, 25 bp, Rattus norvegicus
agcgtcatggcctctttgatatcag

SEQ ID NO: 132629 - DNA, 25 bp, Rattus norvegicus
agcgtccaaggtccctggttttcta

SEQ ID NO: 132630 - DNA, 25 bp, Rattus norvegicus
agcgtccaaggtgcctggttttcta

SEQ ID NO: 132631 - DNA, 25 bp, Rattus norvegicus
agcgtccatcgaacgccccggtggg

SEQ ID NO: 132632 - DNA, 25 bp, Rattus norvegicus
agcgtccatcgatcgccccggtggg

SEQ ID NO: 132633 - DNA, 25 bp, Rattus norvegicus
agcgtcccaagtcagctggtcagaa

SEQ ID NO: 132634 - DNA, 25 bp, Rattus norvegicus
agcgtcccaagtgagctggtcagaa

SEQ ID NO: 132635 - DNA, 25 bp, Rattus norvegicus
agcgtccccatgctcccaaaagatg

SEQ ID NO: 132636 - DNA, 25 bp, Rattus norvegicus
agcgtccccatggtcccaaaagatg

SEQ ID NO: 132637 - DNA, 25 bp, Rattus norvegicus
agcgtccctagtcctggcaatacaa

SEQ ID NO: 132638 - DNA, 25 bp, Rattus norvegicus
agcgtccctagtgctggcaatacaa

SEQ ID NO: 132639 - DNA, 25 bp, Rattus norvegicus
agcgtcccttctctctgtaacaata

SEQ ID NO: 132640 - DNA, 25 bp, Rattus norvegicus
agcgtcccttctgtctgtaacaata

SEQ ID NO: 132641 - DNA, 25 bp, Rattus norvegicus
agcgtccgacagcagcttcaggatt

SEQ ID NO: 132642 - DNA, 25 bp, Rattus norvegicus
agcgtccgacaggagcttcaggatt

SEQ ID NO: 132643 - DNA, 25 bp, Rattus norvegicus
agcgtccgcggcattcgtgtccttt

SEQ ID NO: 132644 - DNA, 25 bp, Rattus norvegicus
agcgtccgcggctttcgtgtccttt

SEQ ID NO: 132645 - DNA, 25 bp, Rattus norvegicus
agcgtcctatgtcatctcatctttt

SEQ ID NO: 132646 - DNA, 25 bp, Rattus norvegicus
agcgtcctatgtgatctcatctttt

SEQ ID NO: 132647 - DNA, 25 bp, Rattus norvegicus
agcgtcctcaatacgctgcttttgt

SEQ ID NO: 132648 - DNA, 25 bp, Rattus norvegicus
agcgtcctcaattcgctgcttttgt

SEQ ID NO: 132649 - DNA, 25 bp, Rattus norvegicus
agcgtcctcctcatattcggagagg

SEQ ID NO: 132650 - DNA, 25 bp, Rattus norvegicus
agcgtcctcctcttattcggagagg

SEQ ID NO: 132651 - DNA, 25 bp, Rattus norvegicus
agcgtcctctgcagagctgtgtgaa

SEQ ID NO: 132652 - DNA, 25 bp, Rattus norvegicus
agcgtcctctgctgagctgtgtgaa

SEQ ID NO: 132653 - DNA, 25 bp, Rattus norvegicus
agcgtcctggcgaaagctctgagac

SEQ ID NO: 132654 - DNA, 25 bp, Rattus norvegicus
agcgtcctggcgtaagctctgagac

SEQ ID NO: 132655 - DNA, 25 bp, Rattus norvegicus
agcgtcctgtggatgcgtcgcccac

SEQ ID NO: 132656 - DNA, 25 bp, Rattus norvegicus
agcgtcctgtggttgcgtcgcccac

SEQ ID NO: 132657 - DNA, 25 bp, Rattus norvegicus
agcgtccttgttccaaacattccaa

SEQ ID NO: 132658 - DNA, 25 bp, Rattus norvegicus
agcgtccttgttgcaaacattccaa

SEQ ID NO: 132659 - DNA, 25 bp, Rattus norvegicus
agcgtcgaccagaagcctcttcagg

SEQ ID NO: 132660 - DNA, 25 bp, Rattus norvegicus
agcgtcgaccagtagcctcttcagg

SEQ ID NO: 132661 - DNA, 25 bp, Rattus norvegicus
agcgtcgagggcagctttgtactcc

SEQ ID NO: 132662 - DNA, 25 bp, Rattus norvegicus
agcgtcgagggctgctttgtactcc

SEQ ID NO: 132663 - DNA, 25 bp, Rattus norvegicus
agcgtcgcagctattggcatcatta

SEQ ID NO: 132664 - DNA, 25 bp, Rattus norvegicus
agcgtcgcagcttttggcatcatta

SEQ ID NO: 132665 - DNA, 25 bp, Rattus norvegicus
agcgtcgctttgagtggcaagccca

SEQ ID NO: 132666 - DNA, 25 bp, Rattus norvegicus
agcgtcgctttgtgtggcaagccca

SEQ ID NO: 132667 - DNA, 25 bp, Rattus norvegicus
agcgtcgtgcttctggtttggtttt

SEQ ID NO: 132668 - DNA, 25 bp, Rattus norvegicus
agcgtcgtgcttgtggtttggtttt

SEQ ID NO: 132669 - DNA, 25 bp, Rattus norvegicus
agcgtcgttggaatgacaacccaga

SEQ ID NO: 132670 - DNA, 25 bp, Rattus norvegicus
agcgtcgttggattgacaacccaga

SEQ ID NO: 132671 - DNA, 25 bp, Rattus norvegicus
agcgtctagaaaacaaccccagtgg

SEQ ID NO: 132672 - DNA, 25 bp, Rattus norvegicus
agcgtctagaaatcaaccccagtgg

SEQ ID NO: 132673 - DNA, 25 bp, Rattus norvegicus
agcgtctcggttacattgtcaacag

SEQ ID NO: 132674 - DNA, 25 bp, Rattus norvegicus
agcgtctcggtttcattgtcaacag

SEQ ID NO: 132675 - DNA, 25 bp, Rattus norvegicus
agcgtctctcgcaagcacaaaaagt

SEQ ID NO: 132676 - DNA, 25 bp, Rattus norvegicus
agcgtctctcgctagcacaaaaagt

SEQ ID NO: 132677 - DNA, 25 bp, Rattus norvegicus
agcgtctctgtgagggagcatgacc

SEQ ID NO: 132678 - DNA, 25 bp, Rattus norvegicus
agcgtctctgtgtgggagcatgacc

SEQ ID NO: 132679 - DNA, 25 bp, Rattus norvegicus
agcgtctggacactgaggcctctgc

SEQ ID NO: 132680 - DNA, 25 bp, Rattus norvegicus
agcgtctggacagtgaggcctctgc

SEQ ID NO: 132681 - DNA, 25 bp, Rattus norvegicus
agcgtcttagacagagccacatcaa

SEQ ID NO: 132682 - DNA, 25 bp, Rattus norvegicus
agcgtcttagactgagccacatcaa

SEQ ID NO: 132683 - DNA, 25 bp, Rattus norvegicus
agcgtcttagctaaactagcacatt

SEQ ID NO: 132684 - DNA, 25 bp, Rattus norvegicus
agcgtcttagcttaactagcacatt

SEQ ID NO: 132685 - DNA, 25 bp, Rattus norvegicus
agcgtcttcaagctttccaaggtta

SEQ ID NO: 132686 - DNA, 25 bp, Rattus norvegicus
agcgtcttcaaggtttccaaggtta

SEQ ID NO: 132687 - DNA, 25 bp, Rattus norvegicus
agcgtcttctgcagcatgggaagaa

SEQ ID NO: 132688 - DNA, 25 bp, Rattus norvegicus
agcgtcttctgctgcatgggaagaa

SEQ ID NO: 132689 - DNA, 25 bp, Rattus norvegicus
agcgtcttggaccagtaaacccaat

SEQ ID NO: 132690 - DNA, 25 bp, Rattus norvegicus
agcgtcttggacgagtaaacccaat

SEQ ID NO: 132691 - DNA, 25 bp, Rattus norvegicus
agcgtgaagagcatttctcattaga

SEQ ID NO: 132692 - DNA, 25 bp, Rattus norvegicus
agcgtgaagagcttttctcattaga

SEQ ID NO: 132693 - DNA, 25 bp, Rattus norvegicus
agcgtgaagcagctcccctgaatgg

SEQ ID NO: 132694 - DNA, 25 bp, Rattus norvegicus
agcgtgaagcaggtcccctgaatgg

SEQ ID NO: 132695 - DNA, 25 bp, Rattus norvegicus
agcgtgacacaacccgccatgagaa

SEQ ID NO: 132696 - DNA, 25 bp, Rattus norvegicus
agcgtgacacaagccgccatgagaa

SEQ ID NO: 132697 - DNA, 25 bp, Rattus norvegicus
agcgtgacagcaccgccatgctcat

SEQ ID NO: 132698 - DNA, 25 bp, Rattus norvegicus
agcgtgacagcagcgccatgctcat

SEQ ID NO: 132699 - DNA, 25 bp, Rattus norvegicus
agcgtgacgtttactgtgttctcta

SEQ ID NO: 132700 - DNA, 25 bp, Rattus norvegicus
agcgtgacgttttctgtgttctcta

SEQ ID NO: 132701 - DNA, 25 bp, Rattus norvegicus
agcgtgagcacgagaacttcctgtt

SEQ ID NO: 132702 - DNA, 25 bp, Rattus norvegicus
agcgtgagcacgtgaacttcctgtt

SEQ ID NO: 132703 - DNA, 25 bp, Rattus norvegicus
agcgtgaggctaccctgtataggct

SEQ ID NO: 132704 - DNA, 25 bp, Rattus norvegicus
agcgtgaggctagcctgtataggct

SEQ ID NO: 132705 - DNA, 25 bp, Rattus norvegicus
agcgtgagtgtaaagtcctggcccc

SEQ ID NO: 132706 - DNA, 25 bp, Rattus norvegicus
agcgtgagtgtatagtcctggcccc

SEQ ID NO: 132707 - DNA, 25 bp, Rattus norvegicus
agcgtgatgattcgctccacaacag

SEQ ID NO: 132708 - DNA, 25 bp, Rattus norvegicus
agcgtgatgattggctccacaacag

SEQ ID NO: 132709 - DNA, 25 bp, Rattus norvegicus
agcgtgcaaaagaagcctcagggtt

SEQ ID NO: 132710 - DNA, 25 bp, Rattus norvegicus
agcgtgcaaaagtagcctcagggtt

SEQ ID NO: 132711 - DNA, 25 bp, Rattus norvegicus
agcgtgcaagtcaccgagttgctgt

SEQ ID NO: 132712 - DNA, 25 bp, Rattus norvegicus
agcgtgcaagtctccgagttgctgt

SEQ ID NO: 132713 - DNA, 25 bp, Rattus norvegicus
agcgtgcacaaaatcaaactggagc

SEQ ID NO: 132714 - DNA, 25 bp, Rattus norvegicus
agcgtgcacaaattcaaactggagc

SEQ ID NO: 132715 - DNA, 25 bp, Rattus norvegicus
agcgtgcactgtatcgtacacatca

SEQ ID NO: 132716 - DNA, 25 bp, Rattus norvegicus
agcgtgcactgtttcgtacacatca

SEQ ID NO: 132717 - DNA, 25 bp, Rattus norvegicus
agcgtgccacggactcttatttatg

SEQ ID NO: 132718 - DNA, 25 bp, Rattus norvegicus
agcgtgccacggtctcttatttatg

SEQ ID NO: 132719 - DNA, 25 bp, Rattus norvegicus
agcgtgcggctgctatgtgtttcca

SEQ ID NO: 132720 - DNA, 25 bp, Rattus norvegicus
agcgtgcggctggtatgtgtttcca

SEQ ID NO: 132721 - DNA, 25 bp, Rattus norvegicus
agcgtgctggaccttctgtatagct

SEQ ID NO: 132722 - DNA, 25 bp, Rattus norvegicus
agcgtgctggacgttctgtatagct

SEQ ID NO: 132723 - DNA, 25 bp, Rattus norvegicus
agcgtgctggctacggagcgatcta

SEQ ID NO: 132724 - DNA, 25 bp, Rattus norvegicus
agcgtgctggcttcggagcgatcta

SEQ ID NO: 132725 - DNA, 25 bp, Rattus norvegicus
agcgtgctggtcagctgcctagaga

SEQ ID NO: 132726 - DNA, 25 bp, Rattus norvegicus
agcgtgctggtctgctgcctagaga

SEQ ID NO: 132727 - DNA, 25 bp, Rattus norvegicus
agcgtgcttatcagtctgtacggaa

SEQ ID NO: 132728 - DNA, 25 bp, Rattus norvegicus
agcgtgcttatctgtctgtacggaa

SEQ ID NO: 132729 - DNA, 25 bp, Rattus norvegicus
agcgtgcttgctctcgtgattgaca

SEQ ID NO: 132730 - DNA, 25 bp, Rattus norvegicus
agcgtgcttgctgtcgtgattgaca

SEQ ID NO: 132731 - DNA, 25 bp, Rattus norvegicus
agcgtggacattactttatcctctc

SEQ ID NO: 132732 - DNA, 25 bp, Rattus norvegicus
agcgtggacatttctttatcctctc

SEQ ID NO: 132733 - DNA, 25 bp, Rattus norvegicus
agcgtggacccaacagaccagaaga

SEQ ID NO: 132734 - DNA, 25 bp, Rattus norvegicus
agcgtggacccatcagaccagaaga

SEQ ID NO: 132735 - DNA, 25 bp, Rattus norvegicus
agcgtggcatcccaaggttttggat

SEQ ID NO: 132736 - DNA, 25 bp, Rattus norvegicus
agcgtggcatccgaaggttttggat

SEQ ID NO: 132737 - DNA, 25 bp, Rattus norvegicus
agcgtggccaagacatagacatcat

SEQ ID NO: 132738 - DNA, 25 bp, Rattus norvegicus
agcgtggccaagtcatagacatcat

SEQ ID NO: 132739 - DNA, 25 bp, Rattus norvegicus
agcgtggcccagcttcttcagtcag

SEQ ID NO: 132740 - DNA, 25 bp, Rattus norvegicus
agcgtggcccaggttcttcagtcag

SEQ ID NO: 132741 - DNA, 25 bp, Rattus norvegicus
agcgtggcgggtactgcccaatgaa

SEQ ID NO: 132742 - DNA, 25 bp, Rattus norvegicus
agcgtggcgggttctgcccaatgaa

SEQ ID NO: 132743 - DNA, 25 bp, Rattus norvegicus
agcgtgggacgcattgactgtacca

SEQ ID NO: 132744 - DNA, 25 bp, Rattus norvegicus
agcgtgggacgctttgactgtacca

SEQ ID NO: 132745 - DNA, 25 bp, Rattus norvegicus
agcgtgggcgctatggagttccata

SEQ ID NO: 132746 - DNA, 25 bp, Rattus norvegicus
agcgtgggcgctttggagttccata

SEQ ID NO: 132747 - DNA, 25 bp, Rattus norvegicus
agcgtgggtcacatgtctggataaa

SEQ ID NO: 132748 - DNA, 25 bp, Rattus norvegicus
agcgtgggtcacttgtctggataaa

SEQ ID NO: 132749 - DNA, 25 bp, Rattus norvegicus
agcgtggtcttccttagtctgctac

SEQ ID NO: 132750 - DNA, 25 bp, Rattus norvegicus
agcgtggtcttcgttagtctgctac

SEQ ID NO: 132751 - DNA, 25 bp, Rattus norvegicus
agcgtggtgaccaagtgtggttctc

SEQ ID NO: 132752 - DNA, 25 bp, Rattus norvegicus
agcgtggtgacctagtgtggttctc

SEQ ID NO: 132753 - DNA, 25 bp, Rattus norvegicus
agcgtggtgctgatgcgacttgtcc

SEQ ID NO: 132754 - DNA, 25 bp, Rattus norvegicus
agcgtggtgctgttgcgacttgtcc

SEQ ID NO: 132755 - DNA, 25 bp, Rattus norvegicus
agcgtgtaacagacaattccctgcc

SEQ ID NO: 132756 - DNA, 25 bp, Rattus norvegicus
agcgtgtaacagtcaattccctgcc

SEQ ID NO: 132757 - DNA, 25 bp, Rattus norvegicus
agcgtgtactgcaagttcttcagga

SEQ ID NO: 132758 - DNA, 25 bp, Rattus norvegicus
agcgtgtactgctagttcttcagga

SEQ ID NO: 132759 - DNA, 25 bp, Rattus norvegicus
agcgtgtatcaacctgccagggctg

SEQ ID NO: 132760 - DNA, 25 bp, Rattus norvegicus
agcgtgtatcaagctgccagggctg

SEQ ID NO: 132761 - DNA, 25 bp, Rattus norvegicus
agcgtgtccatactcttgagccgtg

SEQ ID NO: 132762 - DNA, 25 bp, Rattus norvegicus
agcgtgtccatagtcttgagccgtg

SEQ ID NO: 132763 - DNA, 25 bp, Rattus norvegicus
agcgtgtctggcacaaattcactga

SEQ ID NO: 132764 - DNA, 25 bp, Rattus norvegicus
agcgtgtctggctcaaattcactga

SEQ ID NO: 132765 - DNA, 25 bp, Rattus norvegicus
agcgtgtgaagcagcccatgttcta

SEQ ID NO: 132766 - DNA, 25 bp, Rattus norvegicus
agcgtgtgaagctgcccatgttcta

SEQ ID NO: 132767 - DNA, 25 bp, Rattus norvegicus
agcgtgtgagttcagctgctgttca

SEQ ID NO: 132768 - DNA, 25 bp, Rattus norvegicus
agcgtgtgagttgagctgctgttca

SEQ ID NO: 132769 - DNA, 25 bp, Rattus norvegicus
agcgtgtgctggctagtctcatcaa

SEQ ID NO: 132770 - DNA, 25 bp, Rattus norvegicus
agcgtgtgctgggtagtctcatcaa

SEQ ID NO: 132771 - DNA, 25 bp, Rattus norvegicus
agcgtgtgcttgattggtcctttaa

SEQ ID NO: 132772 - DNA, 25 bp, Rattus norvegicus
agcgtgtgcttgtttggtcctttaa

SEQ ID NO: 132773 - DNA, 25 bp, Rattus norvegicus
agcgtgtggagtatgctgccttaca

SEQ ID NO: 132774 - DNA, 25 bp, Rattus norvegicus
agcgtgtggagtttgctgccttaca

SEQ ID NO: 132775 - DNA, 25 bp, Rattus norvegicus
agcgtgtggccaatcagtatcagga

SEQ ID NO: 132776 - DNA, 25 bp, Rattus norvegicus
agcgtgtggccattcagtatcagga

SEQ ID NO: 132777 - DNA, 25 bp, Rattus norvegicus
agcgtgtgtgtgatactgcatcatc

SEQ ID NO: 132778 - DNA, 25 bp, Rattus norvegicus
agcgtgtgtgtgttactgcatcatc

SEQ ID NO: 132779 - DNA, 25 bp, Rattus norvegicus
agcgtgttcacacgccgtatcatgt

SEQ ID NO: 132780 - DNA, 25 bp, Rattus norvegicus
agcgtgttcacaggccgtatcatgt

SEQ ID NO: 132781 - DNA, 25 bp, Rattus norvegicus
agcgtgttgatgctactgctcctgg

SEQ ID NO: 132782 - DNA, 25 bp, Rattus norvegicus
agcgtgttgatggtactgctcctgg

SEQ ID NO: 132783 - DNA, 25 bp, Rattus norvegicus
agcgtgttggcccatgccagtgccc

SEQ ID NO: 132784 - DNA, 25 bp, Rattus norvegicus
agcgtgttggccgatgccagtgccc

SEQ ID NO: 132785 - DNA, 25 bp, Rattus norvegicus
agcgttaaccaaatgccagcatcct

SEQ ID NO: 132786 - DNA, 25 bp, Rattus norvegicus
agcgttaaccaattgccagcatcct

SEQ ID NO: 132787 - DNA, 25 bp, Rattus norvegicus
agcgttaaccacaccttactaatag

SEQ ID NO: 132788 - DNA, 25 bp, Rattus norvegicus
agcgttaaccactccttactaatag

SEQ ID NO: 132789 - DNA, 25 bp, Rattus norvegicus
agcgttacctggaggtgctcaactt

SEQ ID NO: 132790 - DNA, 25 bp, Rattus norvegicus
agcgttacctggtggtgctcaactt

SEQ ID NO: 132791 - DNA, 25 bp, Rattus norvegicus
agcgttactgttacggtgtcactaa

SEQ ID NO: 132792 - DNA, 25 bp, Rattus norvegicus
agcgttactgtttcggtgtcactaa

SEQ ID NO: 132793 - DNA, 25 bp, Rattus norvegicus
agcgttatccagctggactccggga

SEQ ID NO: 132794 - DNA, 25 bp, Rattus norvegicus
agcgttatccaggtggactccggga

SEQ ID NO: 132795 - DNA, 25 bp, Rattus norvegicus
agcgttatgggaagcaggccacctt

SEQ ID NO: 132796 - DNA, 25 bp, Rattus norvegicus
agcgttatgggatgcaggccacctt

SEQ ID NO: 132797 - DNA, 25 bp, Rattus norvegicus
agcgttcacctgaccctagtaagtt

SEQ ID NO: 132798 - DNA, 25 bp, Rattus norvegicus
agcgttcacctgtccctagtaagtt

SEQ ID NO: 132799 - DNA, 25 bp, Rattus norvegicus
agcgttcatcgaagagactctactc

SEQ ID NO: 132800 - DNA, 25 bp, Rattus norvegicus
agcgttcatcgatgagactctactc

SEQ ID NO: 132801 - DNA, 25 bp, Rattus norvegicus
agcgttcattcaaggtagccattgt

SEQ ID NO: 132802 - DNA, 25 bp, Rattus norvegicus
agcgttcattcatggtagccattgt

SEQ ID NO: 132803 - DNA, 25 bp, Rattus norvegicus
agcgttcccattagagttgctcttg

SEQ ID NO: 132804 - DNA, 25 bp, Rattus norvegicus
agcgttcccatttgagttgctcttg

SEQ ID NO: 132805 - DNA, 25 bp, Rattus norvegicus
agcgttcccttgcaactcctgatat

SEQ ID NO: 132806 - DNA, 25 bp, Rattus norvegicus
agcgttcccttggaactcctgatat

SEQ ID NO: 132807 - DNA, 25 bp, Rattus norvegicus
agcgttcctggccttgcaaggaaat

SEQ ID NO: 132808 - DNA, 25 bp, Rattus norvegicus
agcgttcctggcgttgcaaggaaat

SEQ ID NO: 132809 - DNA, 25 bp, Rattus norvegicus
agcgttcctgtcacgacacgtgaag

SEQ ID NO: 132810 - DNA, 25 bp, Rattus norvegicus
agcgttcctgtctcgacacgtgaag

SEQ ID NO: 132811 - DNA, 25 bp, Rattus norvegicus
agcgttcggacccacagacgtcgag

SEQ ID NO: 132812 - DNA, 25 bp, Rattus norvegicus
agcgttcggaccgacagacgtcgag

SEQ ID NO: 132813 - DNA, 25 bp, Rattus norvegicus
agcgttctccttcagagcacggtga

SEQ ID NO: 132814 - DNA, 25 bp, Rattus norvegicus
agcgttctccttgagagcacggtga

SEQ ID NO: 132815 - DNA, 25 bp, Rattus norvegicus
agcgttctctagagctagtccacat

SEQ ID NO: 132816 - DNA, 25 bp, Rattus norvegicus
agcgttctctagtgctagtccacat

SEQ ID NO: 132817 - DNA, 25 bp, Rattus norvegicus
agcgttctgaacctaggtgggccca

SEQ ID NO: 132818 - DNA, 25 bp, Rattus norvegicus
agcgttctgaacgtaggtgggccca

SEQ ID NO: 132819 - DNA, 25 bp, Rattus norvegicus
agcgttctgttacgactggttaatc

SEQ ID NO: 132820 - DNA, 25 bp, Rattus norvegicus
agcgttctgttaggactggttaatc

SEQ ID NO: 132821 - DNA, 25 bp, Rattus norvegicus
agcgttctttccaaaagcatccaac

SEQ ID NO: 132822 - DNA, 25 bp, Rattus norvegicus
agcgttctttcctaaagcatccaac

SEQ ID NO: 132823 - DNA, 25 bp, Rattus norvegicus
agcgttgcagctcaccaaggacagc

SEQ ID NO: 132824 - DNA, 25 bp, Rattus norvegicus
agcgttgcagctgaccaaggacagc

SEQ ID NO: 132825 - DNA, 25 bp, Rattus norvegicus
agcgttgccagtcttccttgtgatc

SEQ ID NO: 132826 - DNA, 25 bp, Rattus norvegicus
agcgttgccagtgttccttgtgatc

SEQ ID NO: 132827 - DNA, 25 bp, Rattus norvegicus
agcgttgctgttccaagtagccttg

SEQ ID NO: 132828 - DNA, 25 bp, Rattus norvegicus
agcgttgctgttgcaagtagccttg

SEQ ID NO: 132829 - DNA, 25 bp, Rattus norvegicus
agcgttggctggcttttgttaaagt

SEQ ID NO: 132830 - DNA, 25 bp, Rattus norvegicus
agcgttggctgggttttgttaaagt

SEQ ID NO: 132831 - DNA, 25 bp, Rattus norvegicus
agcgttgtctcgattgggacctgga

SEQ ID NO: 132832 - DNA, 25 bp, Rattus norvegicus
agcgttgtctcgtttgggacctgga

SEQ ID NO: 132833 - DNA, 25 bp, Rattus norvegicus
agcgttgtttgcaagatgcgttctg

SEQ ID NO: 132834 - DNA, 25 bp, Rattus norvegicus
agcgttgtttgctagatgcgttctg

SEQ ID NO: 132835 - DNA, 25 bp, Rattus norvegicus
agcgtttaccacagctgttaagcca

SEQ ID NO: 132836 - DNA, 25 bp, Rattus norvegicus
agcgtttaccactgctgttaagcca

SEQ ID NO: 132837 - DNA, 25 bp, Rattus norvegicus
agcgtttagaatcaccctgaggccg

SEQ ID NO: 132838 - DNA, 25 bp, Rattus norvegicus
agcgtttagaatgaccctgaggccg

SEQ ID NO: 132839 - DNA, 25 bp, Rattus norvegicus
agcgtttatgctctcggtgtgtctg

SEQ ID NO: 132840 - DNA, 25 bp, Rattus norvegicus
agcgtttatgctgtcggtgtgtctg

SEQ ID NO: 132841 - DNA, 25 bp, Rattus norvegicus
agcgtttatggcattgtaggctata

SEQ ID NO: 132842 - DNA, 25 bp, Rattus norvegicus
agcgtttatggctttgtaggctata

SEQ ID NO: 132843 - DNA, 25 bp, Rattus norvegicus
agcgtttcagagagtcgtccatttc

SEQ ID NO: 132844 - DNA, 25 bp, Rattus norvegicus
agcgtttcagagtgtcgtccatttc

SEQ ID NO: 132845 - DNA, 25 bp, Rattus norvegicus
agcgtttcagcaaggagggcatctc

SEQ ID NO: 132846 - DNA, 25 bp, Rattus norvegicus
agcgtttcagcatggagggcatctc

SEQ ID NO: 132847 - DNA, 25 bp, Rattus norvegicus
agcgtttccaacaagcagtggccaa

SEQ ID NO: 132848 - DNA, 25 bp, Rattus norvegicus
agcgtttccaactagcagtggccaa

SEQ ID NO: 132849 - DNA, 25 bp, Rattus norvegicus
agcgtttccagacggagctgagtct

SEQ ID NO: 132850 - DNA, 25 bp, Rattus norvegicus
agcgtttccagagggagctgagtct

SEQ ID NO: 132851 - DNA, 25 bp, Rattus norvegicus
agcgtttccagtatttctccgaact

SEQ ID NO: 132852 - DNA, 25 bp, Rattus norvegicus
agcgtttccagtttttctccgaact

SEQ ID NO: 132853 - DNA, 25 bp, Rattus norvegicus
agcgtttccatgctataaaattcag

SEQ ID NO: 132854 - DNA, 25 bp, Rattus norvegicus
agcgtttccatggtataaaattcag

SEQ ID NO: 132855 - DNA, 25 bp, Rattus norvegicus
agcgtttccattccattcaacaaaa

SEQ ID NO: 132856 - DNA, 25 bp, Rattus norvegicus
agcgtttccattgcattcaacaaaa

SEQ ID NO: 132857 - DNA, 25 bp, Rattus norvegicus
agcgtttccgtcagccagggctact

SEQ ID NO: 132858 - DNA, 25 bp, Rattus norvegicus
agcgtttccgtctgccagggctact

SEQ ID NO: 132859 - DNA, 25 bp, Rattus norvegicus
agcgtttcctctcaaccggctgcag

SEQ ID NO: 132860 - DNA, 25 bp, Rattus norvegicus
agcgtttcctctgaaccggctgcag

SEQ ID NO: 132861 - DNA, 25 bp, Rattus norvegicus
agcgtttctaagcatggagtctact

SEQ ID NO: 132862 - DNA, 25 bp, Rattus norvegicus
agcgtttctaaggatggagtctact

SEQ ID NO: 132863 - DNA, 25 bp, Rattus norvegicus
agcgtttctccgctttgccaatcct

SEQ ID NO: 132864 - DNA, 25 bp, Rattus norvegicus
agcgtttctccggtttgccaatcct

SEQ ID NO: 132865 - DNA, 25 bp, Rattus norvegicus
agcgtttctgccaagttgtacgaga

SEQ ID NO: 132866 - DNA, 25 bp, Rattus norvegicus
agcgtttctgcctagttgtacgaga

SEQ ID NO: 132867 - DNA, 25 bp, Rattus norvegicus
agcgtttctgtcagatggttgtgat

SEQ ID NO: 132868 - DNA, 25 bp, Rattus norvegicus
agcgtttctgtctgatggttgtgat

SEQ ID NO: 132869 - DNA, 25 bp, Rattus norvegicus
agcgtttctgttacttcatcagcca

SEQ ID NO: 132870 - DNA, 25 bp, Rattus norvegicus
agcgtttctgtttcttcatcagcca

SEQ ID NO: 132871 - DNA, 25 bp, Rattus norvegicus
agcgtttgagagctttgctaaagaa

SEQ ID NO: 132872 - DNA, 25 bp, Rattus norvegicus
agcgtttgagaggtttgctaaagaa

SEQ ID NO: 132873 - DNA, 25 bp, Rattus norvegicus
agcgtttgcttgaatctgttggacc

SEQ ID NO: 132874 - DNA, 25 bp, Rattus norvegicus
agcgtttgcttgtatctgttggacc

SEQ ID NO: 132875 - DNA, 25 bp, Rattus norvegicus
agcgtttgtcccacatgtatacatt

SEQ ID NO: 132876 - DNA, 25 bp, Rattus norvegicus
agcgtttgtccctcatgtatacatt

SEQ ID NO: 132877 - DNA, 25 bp, Rattus norvegicus
agcgtttgtttgacttcagagtctc

SEQ ID NO: 132878 - DNA, 25 bp, Rattus norvegicus
agcgtttgtttgtcttcagagtctc

SEQ ID NO: 132879 - DNA, 25 bp, Rattus norvegicus
agcgttttgcccattgagaactcac

SEQ ID NO: 132880 - DNA, 25 bp, Rattus norvegicus
agcgttttgccctttgagaactcac

SEQ ID NO: 132881 - DNA, 25 bp, Rattus norvegicus
agcgttttgttaatctctctgcttg

SEQ ID NO: 132882 - DNA, 25 bp, Rattus norvegicus
agcgttttgttattctctctgcttg

SEQ ID NO: 132883 - DNA, 25 bp, Rattus norvegicus
agcgtttttggaaagcatagcttgt

SEQ ID NO: 132884 - DNA, 25 bp, Rattus norvegicus
agcgtttttggatagcatagcttgt

SEQ ID NO: 132885 - DNA, 25 bp, Rattus norvegicus
agctaaaaaagtctctgccatccct

SEQ ID NO: 132886 - DNA, 25 bp, Rattus norvegicus
agctaaaaaagtgtctgccatccct

SEQ ID NO: 132887 - DNA, 25 bp, Rattus norvegicus
agctaaaagacaatacccctgggtg

SEQ ID NO: 132888 - DNA, 25 bp, Rattus norvegicus
agctaaaagacattacccctgggtg

SEQ ID NO: 132889 - DNA, 25 bp, Rattus norvegicus
agctaaaagcatccgtcagtctcgc

SEQ ID NO: 132890 - DNA, 25 bp, Rattus norvegicus
agctaaaagcatgcgtcagtctcgc

SEQ ID NO: 132891 - DNA, 25 bp, Rattus norvegicus
agctaaaagccacaacatacgttct

SEQ ID NO: 132892 - DNA, 25 bp, Rattus norvegicus
agctaaaagccagaacatacgttct

SEQ ID NO: 132893 - DNA, 25 bp, Rattus norvegicus
agctaaaatgctccccaagttgata

SEQ ID NO: 132894 - DNA, 25 bp, Rattus norvegicus
agctaaaatgctgcccaagttgata

SEQ ID NO: 132895 - DNA, 25 bp, Rattus norvegicus
agctaaacctcacaagaattggcga

SEQ ID NO: 132896 - DNA, 25 bp, Rattus norvegicus
agctaaacctcagaagaattggcga

SEQ ID NO: 132897 - DNA, 25 bp, Rattus norvegicus
agctaaacggttacaagtcagtgat

SEQ ID NO: 132898 - DNA, 25 bp, Rattus norvegicus
agctaaacggtttcaagtcagtgat

SEQ ID NO: 132899 - DNA, 25 bp, Rattus norvegicus
agctaaagagagaccacccgttatc

SEQ ID NO: 132900 - DNA, 25 bp, Rattus norvegicus
agctaaagagagtccacccgttatc

SEQ ID NO: 132901 - DNA, 25 bp, Rattus norvegicus
agctaaagcactcgtcatactcatg

SEQ ID NO: 132902 - DNA, 25 bp, Rattus norvegicus
agctaaagcactggtcatactcatg

SEQ ID NO: 132903 - DNA, 25 bp, Rattus norvegicus
agctaaagccttagtaatattgtta

SEQ ID NO: 132904 - DNA, 25 bp, Rattus norvegicus
agctaaagcctttgtaatattgtta

SEQ ID NO: 132905 - DNA, 25 bp, Rattus norvegicus
agctaaatcgctcccatggtcgggt

SEQ ID NO: 132906 - DNA, 25 bp, Rattus norvegicus
agctaaatcgctgccatggtcgggt

SEQ ID NO: 132907 - DNA, 25 bp, Rattus norvegicus
agctaaatctcccttcggtgcagta

SEQ ID NO: 132908 - DNA, 25 bp, Rattus norvegicus
agctaaatctccgttcggtgcagta

SEQ ID NO: 132909 - DNA, 25 bp, Rattus norvegicus
agctaacagattccagcgggctgga

SEQ ID NO: 132910 - DNA, 25 bp, Rattus norvegicus
agctaacagattgcagcgggctgga

SEQ ID NO: 132911 - DNA, 25 bp, Rattus norvegicus
agctaacaggctcgctgctaggtgc

SEQ ID NO: 132912 - DNA, 25 bp, Rattus norvegicus
agctaacaggctggctgctaggtgc

SEQ ID NO: 132913 - DNA, 25 bp, Rattus norvegicus
agctaacatctgacactggcttgtg

SEQ ID NO: 132914 - DNA, 25 bp, Rattus norvegicus
agctaacatctgtcactggcttgtg

SEQ ID NO: 132915 - DNA, 25 bp, Rattus norvegicus
agctaacatcttccttttaaaatct

SEQ ID NO: 132916 - DNA, 25 bp, Rattus norvegicus
agctaacatcttgcttttaaaatct

SEQ ID NO: 132917 - DNA, 25 bp, Rattus norvegicus
agctaacccattccatgcagtgtag

SEQ ID NO: 132918 - DNA, 25 bp, Rattus norvegicus
agctaacccattgcatgcagtgtag

SEQ ID NO: 132919 - DNA, 25 bp, Rattus norvegicus
agctaaccttcgcaggcacttctgg

SEQ ID NO: 132920 - DNA, 25 bp, Rattus norvegicus
agctaaccttcggaggcacttctgg

SEQ ID NO: 132921 - DNA, 25 bp, Rattus norvegicus
agctaactcctaactgagatatcaa

SEQ ID NO: 132922 - DNA, 25 bp, Rattus norvegicus
agctaactcctatctgagatatcaa

SEQ ID NO: 132923 - DNA, 25 bp, Rattus norvegicus
agctaactgaacctggcttcacatg

SEQ ID NO: 132924 - DNA, 25 bp, Rattus norvegicus
agctaactgaacgtggcttcacatg

SEQ ID NO: 132925 - DNA, 25 bp, Rattus norvegicus
agctaactgctcatgctaactgaag

SEQ ID NO: 132926 - DNA, 25 bp, Rattus norvegicus
agctaactgctcttgctaactgaag

SEQ ID NO: 132927 - DNA, 25 bp, Rattus norvegicus
agctaactgttacaggtttacattt

SEQ ID NO: 132928 - DNA, 25 bp, Rattus norvegicus
agctaactgttagaggtttacattt

SEQ ID NO: 132929 - DNA, 25 bp, Rattus norvegicus
agctaacttgtgcaagttgtcctct

SEQ ID NO: 132930 - DNA, 25 bp, Rattus norvegicus
agctaacttgtggaagttgtcctct

SEQ ID NO: 132931 - DNA, 25 bp, Rattus norvegicus
agctaagacacacctggtgacctat

SEQ ID NO: 132932 - DNA, 25 bp, Rattus norvegicus
agctaagacacagctggtgacctat

SEQ ID NO: 132933 - DNA, 25 bp, Rattus norvegicus
agctaagagctcaggactctgtcca

SEQ ID NO: 132934 - DNA, 25 bp, Rattus norvegicus
agctaagagctcatcttccactgtt

SEQ ID NO: 132935 - DNA, 25 bp, Rattus norvegicus
agctaagagctctggactctgtcca

SEQ ID NO: 132936 - DNA, 25 bp, Rattus norvegicus
agctaagagctcttcttccactgtt

SEQ ID NO: 132937 - DNA, 25 bp, Rattus norvegicus
agctaagaggctcggaacatgtgtt

SEQ ID NO: 132938 - DNA, 25 bp, Rattus norvegicus
agctaagaggctgggaacatgtgtt

SEQ ID NO: 132939 - DNA, 25 bp, Rattus norvegicus
agctaagagtctacacctttgggtg

SEQ ID NO: 132940 - DNA, 25 bp, Rattus norvegicus
agctaagagtcttcacctttgggtg

SEQ ID NO: 132941 - DNA, 25 bp, Rattus norvegicus
agctaagcacacaaccattggcctt

SEQ ID NO: 132942 - DNA, 25 bp, Rattus norvegicus
agctaagcacactaccattggcctt

SEQ ID NO: 132943 - DNA, 25 bp, Rattus norvegicus
agctaagcatgtcatccacacggtg

SEQ ID NO: 132944 - DNA, 25 bp, Rattus norvegicus
agctaagcatgtgatccacacggtg

SEQ ID NO: 132945 - DNA, 25 bp, Rattus norvegicus
agctaagccccactgagcggaagga

SEQ ID NO: 132946 - DNA, 25 bp, Rattus norvegicus
agctaagccccagtgagcggaagga

SEQ ID NO: 132947 - DNA, 25 bp, Rattus norvegicus
agctaagcgcttagtactctgggac

SEQ ID NO: 132948 - DNA, 25 bp, Rattus norvegicus
agctaagcgctttgtactctgggac

SEQ ID NO: 132949 - DNA, 25 bp, Rattus norvegicus
agctaagcgtgtaggactccccgag

SEQ ID NO: 132950 - DNA, 25 bp, Rattus norvegicus
agctaagcgtgttggactccccgag

SEQ ID NO: 132951 - DNA, 25 bp, Rattus norvegicus
agctaagctagcctttctgccaagc

SEQ ID NO: 132952 - DNA, 25 bp, Rattus norvegicus
agctaagctagcgtttctgccaagc

SEQ ID NO: 132953 - DNA, 25 bp, Rattus norvegicus
agctaaggagtgctcaaccccattc

SEQ ID NO: 132954 - DNA, 25 bp, Rattus norvegicus
agctaaggagtggtcaaccccattc

SEQ ID NO: 132955 - DNA, 25 bp, Rattus norvegicus
agctaaggcagaattccacatctcc

SEQ ID NO: 132956 - DNA, 25 bp, Rattus norvegicus
agctaaggcagatttccacatctcc

SEQ ID NO: 132957 - DNA, 25 bp, Rattus norvegicus
agctaaggctgtcgctggttgttca

SEQ ID NO: 132958 - DNA, 25 bp, Rattus norvegicus
agctaaggctgtggctggttgttca

SEQ ID NO: 132959 - DNA, 25 bp, Rattus norvegicus
agctaagggatacttggcgcctcct

SEQ ID NO: 132960 - DNA, 25 bp, Rattus norvegicus
agctaagggatagttggcgcctcct

SEQ ID NO: 132961 - DNA, 25 bp, Rattus norvegicus
agctaaggtaggcaccatggtctcc

SEQ ID NO: 132962 - DNA, 25 bp, Rattus norvegicus
agctaaggtagggaccatggtctcc

SEQ ID NO: 132963 - DNA, 25 bp, Rattus norvegicus
agctaaggtgtgacttagtcagggt

SEQ ID NO: 132964 - DNA, 25 bp, Rattus norvegicus
agctaaggtgtgtcttagtcagggt

SEQ ID NO: 132965 - DNA, 25 bp, Rattus norvegicus
agctaaggtttcagctttcttcctc

SEQ ID NO: 132966 - DNA, 25 bp, Rattus norvegicus
agctaaggtttctgctttcttcctc

SEQ ID NO: 132967 - DNA, 25 bp, Rattus norvegicus
agctaagtagtgacatccccatggg

SEQ ID NO: 132968 - DNA, 25 bp, Rattus norvegicus
agctaagtagtgtcatccccatggg

SEQ ID NO: 132969 - DNA, 25 bp, Rattus norvegicus
agctaagtctatctccacatcaatg

SEQ ID NO: 132970 - DNA, 25 bp, Rattus norvegicus
agctaagtctatgtccacatcaatg

SEQ ID NO: 132971 - DNA, 25 bp, Rattus norvegicus
agctaagtgcttactagttaaccat

SEQ ID NO: 132972 - DNA, 25 bp, Rattus norvegicus
agctaagtgctttctagttaaccat

SEQ ID NO: 132973 - DNA, 25 bp, Rattus norvegicus
agctaagtggcgaggttgactccca

SEQ ID NO: 132974 - DNA, 25 bp, Rattus norvegicus
agctaagtggcgtggttgactccca

SEQ ID NO: 132975 - DNA, 25 bp, Rattus norvegicus
agctaagtgtctccgaggcccaagg

SEQ ID NO: 132976 - DNA, 25 bp, Rattus norvegicus
agctaagtgtctgcgaggcccaagg

SEQ ID NO: 132977 - DNA, 25 bp, Rattus norvegicus
agctaagtgtgcaatttgagtacac

SEQ ID NO: 132978 - DNA, 25 bp, Rattus norvegicus
agctaagtgtgctatttgagtacac

SEQ ID NO: 132979 - DNA, 25 bp, Rattus norvegicus
agctaagtgttcagtacctctttgt

SEQ ID NO: 132980 - DNA, 25 bp, Rattus norvegicus
agctaagtgttctgtacctctttgt

SEQ ID NO: 132981 - DNA, 25 bp, Rattus norvegicus
agctaagttcatctgggttggttaa

SEQ ID NO: 132982 - DNA, 25 bp, Rattus norvegicus
agctaagttcatgtgggttggttaa

SEQ ID NO: 132983 - DNA, 25 bp, Rattus norvegicus
agctaagttccgacatgtggcacat

SEQ ID NO: 132984 - DNA, 25 bp, Rattus norvegicus
agctaagttccgtcatgtggcacat

SEQ ID NO: 132985 - DNA, 25 bp, Rattus norvegicus
agctaataattcacaggcacctgca

SEQ ID NO: 132986 - DNA, 25 bp, Rattus norvegicus
agctaataattctcaggcacctgca

SEQ ID NO: 132987 - DNA, 25 bp, Rattus norvegicus
agctaatcagatctgcctcaggaaa

SEQ ID NO: 132988 - DNA, 25 bp, Rattus norvegicus
agctaatcagatgtgcctcaggaaa

SEQ ID NO: 132989 - DNA, 25 bp, Rattus norvegicus
agctaatcggcaacaccagtagtta

SEQ ID NO: 132990 - DNA, 25 bp, Rattus norvegicus
agctaatcggcatcaccagtagtta

SEQ ID NO: 132991 - DNA, 25 bp, Rattus norvegicus
agctaatgcggtctctgaatcacag

SEQ ID NO: 132992 - DNA, 25 bp, Rattus norvegicus
agctaatgcggtgtctgaatcacag

SEQ ID NO: 132993 - DNA, 25 bp, Rattus norvegicus
agctaatgctatcagctggaggctg

SEQ ID NO: 132994 - DNA, 25 bp, Rattus norvegicus
agctaatgctatgagctggaggctg

SEQ ID NO: 132995 - DNA, 25 bp, Rattus norvegicus
agctaattaagcaacgtggcataaa

SEQ ID NO: 132996 - DNA, 25 bp, Rattus norvegicus
agctaattaagctacgtggcataaa

SEQ ID NO: 132997 - DNA, 25 bp, Rattus norvegicus
agctaattactgagtcctacctttg

SEQ ID NO: 132998 - DNA, 25 bp, Rattus norvegicus
agctaattactgtgtcctacctttg

SEQ ID NO: 132999 - DNA, 25 bp, Rattus norvegicus
agctaattatcaacttcctctgggt

SEQ ID NO: 133000 - DNA, 25 bp, Rattus norvegicus
agctaattatcatcttcctctgggt

SEQ ID NO: 133001 - DNA, 25 bp, Rattus norvegicus
agctaattctcccaagtttcttgag

SEQ ID NO: 133002 - DNA, 25 bp, Rattus norvegicus
agctaattctccgaagtttcttgag

SEQ ID NO: 133003 - DNA, 25 bp, Rattus norvegicus
agctaattcttgatccagtgctatt

SEQ ID NO: 133004 - DNA, 25 bp, Rattus norvegicus
agctaattcttgttccagtgctatt

SEQ ID NO: 133005 - DNA, 25 bp, Rattus norvegicus
agctaattggctactttcatcgcca

SEQ ID NO: 133006 - DNA, 25 bp, Rattus norvegicus
agctaattggcttctttcatcgcca

SEQ ID NO: 133007 - DNA, 25 bp, Rattus norvegicus
agctaatttgtactgtcttgtgaag

SEQ ID NO: 133008 - DNA, 25 bp, Rattus norvegicus
agctaatttgtagtgtcttgtgaag

SEQ ID NO: 133009 - DNA, 25 bp, Rattus norvegicus
agctacaaaaaccttcctgtgtctc

SEQ ID NO: 133010 - DNA, 25 bp, Rattus norvegicus
agctacaaaaacgttcctgtgtctc

SEQ ID NO: 133011 - DNA, 25 bp, Rattus norvegicus
agctacaaaatgaggcctggtcgga

SEQ ID NO: 133012 - DNA, 25 bp, Rattus norvegicus
agctacaaaatgtggcctggtcgga

SEQ ID NO: 133013 - DNA, 25 bp, Rattus norvegicus
agctacaaacacatgctttgctccc

SEQ ID NO: 133014 - DNA, 25 bp, Rattus norvegicus
agctacaaacacttgctttgctccc

SEQ ID NO: 133015 - DNA, 25 bp, Rattus norvegicus
agctacaaggcactgctctcaactg

SEQ ID NO: 133016 - DNA, 25 bp, Rattus norvegicus
agctacaaggcagtgctctcaactg

SEQ ID NO: 133017 - DNA, 25 bp, Rattus norvegicus
agctacaaggtgctccgaggagtcc

SEQ ID NO: 133018 - DNA, 25 bp, Rattus norvegicus
agctacaaggtggtccgaggagtcc

SEQ ID NO: 133019 - DNA, 25 bp, Rattus norvegicus
agctacaatatgatggctccctgca

SEQ ID NO: 133020 - DNA, 25 bp, Rattus norvegicus
agctacaatatgttggctccctgca

SEQ ID NO: 133021 - DNA, 25 bp, Rattus norvegicus
agctacacatacactgcacaagtcg

SEQ ID NO: 133022 - DNA, 25 bp, Rattus norvegicus
agctacacatactctgcacaagtcg

SEQ ID NO: 133023 - DNA, 25 bp, Rattus norvegicus
agctacactcttcagcgccatgtat

SEQ ID NO: 133024 - DNA, 25 bp, Rattus norvegicus
agctacactcttgagcgccatgtat

SEQ ID NO: 133025 - DNA, 25 bp, Rattus norvegicus
agctacactgtaactttctttggaa

SEQ ID NO: 133026 - DNA, 25 bp, Rattus norvegicus
agctacactgtatctttctttggaa

SEQ ID NO: 133027 - DNA, 25 bp, Rattus norvegicus
agctacagacccaaatgctgcctgg

SEQ ID NO: 133028 - DNA, 25 bp, Rattus norvegicus
agctacagaccctaatgctgcctgg

SEQ ID NO: 133029 - DNA, 25 bp, Rattus norvegicus
agctacagcttcatgctgcagacca

SEQ ID NO: 133030 - DNA, 25 bp, Rattus norvegicus
agctacagcttcttgctgcagacca

SEQ ID NO: 133031 - DNA, 25 bp, Rattus norvegicus
agctacaggctcagaattactcatg

SEQ ID NO: 133032 - DNA, 25 bp, Rattus norvegicus
agctacaggctctgaattactcatg

SEQ ID NO: 133033 - DNA, 25 bp, Rattus norvegicus
agctacagggctacgggatgcttga

SEQ ID NO: 133034 - DNA, 25 bp, Rattus norvegicus
agctacagggcttcgggatgcttga

SEQ ID NO: 133035 - DNA, 25 bp, Rattus norvegicus
agctacagttgcaggtttttaccac

SEQ ID NO: 133036 - DNA, 25 bp, Rattus norvegicus
agctacagttgctggtttttaccac

SEQ ID NO: 133037 - DNA, 25 bp, Rattus norvegicus
agctacatatagcagcgttctggaa

SEQ ID NO: 133038 - DNA, 25 bp, Rattus norvegicus
agctacatataggagcgttctggaa

SEQ ID NO: 133039 - DNA, 25 bp, Rattus norvegicus
agctacatctttccgcttacattgt

SEQ ID NO: 133040 - DNA, 25 bp, Rattus norvegicus
agctacatctttgcgcttacattgt

SEQ ID NO: 133041 - DNA, 25 bp, Rattus norvegicus
agctacatttccatggcccttctga

SEQ ID NO: 133042 - DNA, 25 bp, Rattus norvegicus
agctacatttccttggcccttctga

SEQ ID NO: 133043 - DNA, 25 bp, Rattus norvegicus
agctacatttggctgtggcacagga

SEQ ID NO: 133044 - DNA, 25 bp, Rattus norvegicus
agctacatttgggtgtggcacagga

SEQ ID NO: 133045 - DNA, 25 bp, Rattus norvegicus
agctaccaagtaatcacttctgagg

SEQ ID NO: 133046 - DNA, 25 bp, Rattus norvegicus
agctaccaagtattcacttctgagg

SEQ ID NO: 133047 - DNA, 25 bp, Rattus norvegicus
agctaccagagccttcttaactcca

SEQ ID NO: 133048 - DNA, 25 bp, Rattus norvegicus
agctaccagagcgttcttaactcca

SEQ ID NO: 133049 - DNA, 25 bp, Rattus norvegicus
agctaccagtgtcgctgcccgacga

SEQ ID NO: 133050 - DNA, 25 bp, Rattus norvegicus
agctaccagtgtggctgcccgacga

SEQ ID NO: 133051 - DNA, 25 bp, Rattus norvegicus
agctaccatgagctactgtgaatca

SEQ ID NO: 133052 - DNA, 25 bp, Rattus norvegicus
agctaccatgaggtactgtgaatca

SEQ ID NO: 133053 - DNA, 25 bp, Rattus norvegicus
agctacccagaactctcaagccaaa

SEQ ID NO: 133054 - DNA, 25 bp, Rattus norvegicus
agctacccagaagtctcaagccaaa

SEQ ID NO: 133055 - DNA, 25 bp, Rattus norvegicus
agctacccagtacccacggagaagg

SEQ ID NO: 133056 - DNA, 25 bp, Rattus norvegicus
agctacccagtagccacggagaagg

SEQ ID NO: 133057 - DNA, 25 bp, Rattus norvegicus
agctaccctatgctgttacacgtgg

SEQ ID NO: 133058 - DNA, 25 bp, Rattus norvegicus
agctaccctatggtgttacacgtgg

SEQ ID NO: 133059 - DNA, 25 bp, Rattus norvegicus
agctaccctggcacctggtattagc

SEQ ID NO: 133060 - DNA, 25 bp, Rattus norvegicus
agctaccctggctcctggtattagc

SEQ ID NO: 133061 - DNA, 25 bp, Rattus norvegicus
agctaccggcttcagagtctgcaag

SEQ ID NO: 133062 - DNA, 25 bp, Rattus norvegicus
agctaccggcttgagagtctgcaag

SEQ ID NO: 133063 - DNA, 25 bp, Rattus norvegicus
agctaccgtgctactgattcagaca

SEQ ID NO: 133064 - DNA, 25 bp, Rattus norvegicus
agctaccgtgcttctgattcagaca

SEQ ID NO: 133065 - DNA, 25 bp, Rattus norvegicus
agctacctccacatcacgaagaaga

SEQ ID NO: 133066 - DNA, 25 bp, Rattus norvegicus
agctacctccacttcacgaagaaga

SEQ ID NO: 133067 - DNA, 25 bp, Rattus norvegicus
agctacctcctcctacatggaggtg

SEQ ID NO: 133068 - DNA, 25 bp, Rattus norvegicus
agctacctcctcgtacatggaggtg

SEQ ID NO: 133069 - DNA, 25 bp, Rattus norvegicus
agctacctcggtaccagtacttgag

SEQ ID NO: 133070 - DNA, 25 bp, Rattus norvegicus
agctacctcggttccagtacttgag

SEQ ID NO: 133071 - DNA, 25 bp, Rattus norvegicus
agctacctgaaactgttctgagaaa

SEQ ID NO: 133072 - DNA, 25 bp, Rattus norvegicus
agctacctgaaagtgttctgagaaa

SEQ ID NO: 133073 - DNA, 25 bp, Rattus norvegicus
agctacctgagcctgtaaagtaaca

SEQ ID NO: 133074 - DNA, 25 bp, Rattus norvegicus
agctacctgagcgtgtaaagtaaca

SEQ ID NO: 133075 - DNA, 25 bp, Rattus norvegicus
agctacctgattactgcctaagggt

SEQ ID NO: 133076 - DNA, 25 bp, Rattus norvegicus
agctacctgatttctgcctaagggt

SEQ ID NO: 133077 - DNA, 25 bp, Rattus norvegicus
agctacctgcctacattacagggca

SEQ ID NO: 133078 - DNA, 25 bp, Rattus norvegicus
agctacctgccttcattacagggca

SEQ ID NO: 133079 - DNA, 25 bp, Rattus norvegicus
agctacctggccaaggctgaccaga

SEQ ID NO: 133080 - DNA, 25 bp, Rattus norvegicus
agctacctggcctaggctgaccaga

SEQ ID NO: 133081 - DNA, 25 bp, Rattus norvegicus
agctacctggttccaagggattcac

SEQ ID NO: 133082 - DNA, 25 bp, Rattus norvegicus
agctacctggttgcaagggattcac

SEQ ID NO: 133083 - DNA, 25 bp, Rattus norvegicus
agctacctgtgacttccaactgatg

SEQ ID NO: 133084 - DNA, 25 bp, Rattus norvegicus
agctacctgtgagttccaactgatg

SEQ ID NO: 133085 - DNA, 25 bp, Rattus norvegicus
agctaccttgctcgatgtgctgtat

SEQ ID NO: 133086 - DNA, 25 bp, Rattus norvegicus
agctaccttgctggatgtgctgtat

SEQ ID NO: 133087 - DNA, 25 bp, Rattus norvegicus
agctacctttgcctgcttttttctg

SEQ ID NO: 133088 - DNA, 25 bp, Rattus norvegicus
agctacctttgcgtgcttttttctg

SEQ ID NO: 133089 - DNA, 25 bp, Rattus norvegicus
agctacgaccgtacatttgaggacc

SEQ ID NO: 133090 - DNA, 25 bp, Rattus norvegicus
agctacgaccgttcatttgaggacc

SEQ ID NO: 133091 - DNA, 25 bp, Rattus norvegicus
agctacgagtgaaaggccacacctt

SEQ ID NO: 133092 - DNA, 25 bp, Rattus norvegicus
agctacgagtgataggccacacctt

SEQ ID NO: 133093 - DNA, 25 bp, Rattus norvegicus
agctacgatgtgcaagtggccgaca

SEQ ID NO: 133094 - DNA, 25 bp, Rattus norvegicus
agctacgatgtggaagtggccgaca

SEQ ID NO: 133095 - DNA, 25 bp, Rattus norvegicus
agctacgcagcaaagaggccgacct

SEQ ID NO: 133096 - DNA, 25 bp, Rattus norvegicus
agctacgcagcatagaggccgacct

SEQ ID NO: 133097 - DNA, 25 bp, Rattus norvegicus
agctacgcagccatggacgcagcca

SEQ ID NO: 133098 - DNA, 25 bp, Rattus norvegicus
agctacgcagccttggacgcagcca

SEQ ID NO: 133099 - DNA, 25 bp, Rattus norvegicus
agctacgcttaccagttttctatct

SEQ ID NO: 133100 - DNA, 25 bp, Rattus norvegicus
agctacgcttacgagttttctatct

SEQ ID NO: 133101 - DNA, 25 bp, Rattus norvegicus
agctacggagccagttgacattgaa

SEQ ID NO: 133102 - DNA, 25 bp, Rattus norvegicus
agctacggagcctgttgacattgaa

SEQ ID NO: 133103 - DNA, 25 bp, Rattus norvegicus
agctacgggaagacggcctccttct

SEQ ID NO: 133104 - DNA, 25 bp, Rattus norvegicus
agctacgggaagtcggcctccttct

SEQ ID NO: 133105 - DNA, 25 bp, Rattus norvegicus
agctacgtgacgcttgggtccaacg

SEQ ID NO: 133106 - DNA, 25 bp, Rattus norvegicus
agctacgtgacggttgggtccaacg

SEQ ID NO: 133107 - DNA, 25 bp, Rattus norvegicus
agctacgtggccagctcctaggact

SEQ ID NO: 133108 - DNA, 25 bp, Rattus norvegicus
agctacgtggcctgctcctaggact

SEQ ID NO: 133109 - DNA, 25 bp, Rattus norvegicus
agctacgttgttaccatcctgttac

SEQ ID NO: 133110 - DNA, 25 bp, Rattus norvegicus
agctacgttgtttccatcctgttac

SEQ ID NO: 133111 - DNA, 25 bp, Rattus norvegicus
agctactaactgcttttgcttacat

SEQ ID NO: 133112 - DNA, 25 bp, Rattus norvegicus
agctactaactggttttgcttacat

SEQ ID NO: 133113 - DNA, 25 bp, Rattus norvegicus
agctactaccaacattttcctgtgc

SEQ ID NO: 133114 - DNA, 25 bp, Rattus norvegicus
agctactaccaagattttcctgtgc

SEQ ID NO: 133115 - DNA, 25 bp, Rattus norvegicus
agctactactctattcaaatgcggg

SEQ ID NO: 133116 - DNA, 25 bp, Rattus norvegicus
agctactactcttttcaaatgcggg

SEQ ID NO: 133117 - DNA, 25 bp, Rattus norvegicus
agctactataaacacattggaacaa

SEQ ID NO: 133118 - DNA, 25 bp, Rattus norvegicus
agctactataaagacattggaacaa

SEQ ID NO: 133119 - DNA, 25 bp, Rattus norvegicus
agctactcactcattagtgctcagg

SEQ ID NO: 133120 - DNA, 25 bp, Rattus norvegicus
agctactcactctttagtgctcagg

SEQ ID NO: 133121 - DNA, 25 bp, Rattus norvegicus
agctactcagtacatggtcttaaaa

SEQ ID NO: 133122 - DNA, 25 bp, Rattus norvegicus
agctactcagtagatggtcttaaaa

SEQ ID NO: 133123 - DNA, 25 bp, Rattus norvegicus
agctactccaggagcacaggtgcca

SEQ ID NO: 133124 - DNA, 25 bp, Rattus norvegicus
agctactccaggtgcacaggtgcca

SEQ ID NO: 133125 - DNA, 25 bp, Rattus norvegicus
agctactcccacatagctctggcaa

SEQ ID NO: 133126 - DNA, 25 bp, Rattus norvegicus
agctactcccacttagctctggcaa

SEQ ID NO: 133127 - DNA, 25 bp, Rattus norvegicus
agctactctagaccatgaagatcga

SEQ ID NO: 133128 - DNA, 25 bp, Rattus norvegicus
agctactctagagcatgaagatcga

SEQ ID NO: 133129 - DNA, 25 bp, Rattus norvegicus
agctactctagcctacttagcgatc

SEQ ID NO: 133130 - DNA, 25 bp, Rattus norvegicus
agctactctagcgtacttagcgatc

SEQ ID NO: 133131 - DNA, 25 bp, Rattus norvegicus
agctactctcatacaaacagtcctc

SEQ ID NO: 133132 - DNA, 25 bp, Rattus norvegicus
agctactctcattcaaacagtcctc

SEQ ID NO: 133133 - DNA, 25 bp, Rattus norvegicus
agctactctggcattacccacaaag

SEQ ID NO: 133134 - DNA, 25 bp, Rattus norvegicus
agctactctggctttacccacaaag

SEQ ID NO: 133135 - DNA, 25 bp, Rattus norvegicus
agctactcttctccaatctaaacga

SEQ ID NO: 133136 - DNA, 25 bp, Rattus norvegicus
agctactcttctgcaatctaaacga

SEQ ID NO: 133137 - DNA, 25 bp, Rattus norvegicus
agctactcttgaaactaactcccat

SEQ ID NO: 133138 - DNA, 25 bp, Rattus norvegicus
agctactcttgatactaactcccat

SEQ ID NO: 133139 - DNA, 25 bp, Rattus norvegicus
agctactgaagaccttctctttctc

SEQ ID NO: 133140 - DNA, 25 bp, Rattus norvegicus
agctactgaagagcttctctttctc

SEQ ID NO: 133141 - DNA, 25 bp, Rattus norvegicus
agctactgaagccagaatccccaaa

SEQ ID NO: 133142 - DNA, 25 bp, Rattus norvegicus
agctactgaagcgagaatccccaaa

SEQ ID NO: 133143 - DNA, 25 bp, Rattus norvegicus
agctactgaagtactctgttaagga

SEQ ID NO: 133144 - DNA, 25 bp, Rattus norvegicus
agctactgaagttctctgttaagga

SEQ ID NO: 133145 - DNA, 25 bp, Rattus norvegicus
agctactgactacatgcttcattag

SEQ ID NO: 133146 - DNA, 25 bp, Rattus norvegicus
agctactgactagatgcttcattag

SEQ ID NO: 133147 - DNA, 25 bp, Rattus norvegicus
agctactgactgaataaccactttt

SEQ ID NO: 133148 - DNA, 25 bp, Rattus norvegicus
agctactgactgtataaccactttt

SEQ ID NO: 133149 - DNA, 25 bp, Rattus norvegicus
agctactgagatacttggcttcctc

SEQ ID NO: 133150 - DNA, 25 bp, Rattus norvegicus
agctactgagattcttggcttcctc

SEQ ID NO: 133151 - DNA, 25 bp, Rattus norvegicus
agctactgagctcttgagtgtccga

SEQ ID NO: 133152 - DNA, 25 bp, Rattus norvegicus
agctactgagctgttgagtgtccga

SEQ ID NO: 133153 - DNA, 25 bp, Rattus norvegicus
agctactgatggaggcgctcactat

SEQ ID NO: 133154 - DNA, 25 bp, Rattus norvegicus
agctactgatggtggcgctcactat

SEQ ID NO: 133155 - DNA, 25 bp, Rattus norvegicus
agctactgcggactcagggtgctct

SEQ ID NO: 133156 - DNA, 25 bp, Rattus norvegicus
agctactgcggagtcagggtgctct

SEQ ID NO: 133157 - DNA, 25 bp, Rattus norvegicus
agctactgcgtgagaattatactac

SEQ ID NO: 133158 - DNA, 25 bp, Rattus norvegicus
agctactgcgtgtgaattatactac

SEQ ID NO: 133159 - DNA, 25 bp, Rattus norvegicus
agctactgcttaagggcttgctctt

SEQ ID NO: 133160 - DNA, 25 bp, Rattus norvegicus
agctactgcttatgggcttgctctt

SEQ ID NO: 133161 - DNA, 25 bp, Rattus norvegicus
agctactgtgaaaccctctgtggaa

SEQ ID NO: 133162 - DNA, 25 bp, Rattus norvegicus
agctactgtgaatccctctgtggaa

SEQ ID NO: 133163 - DNA, 25 bp, Rattus norvegicus
agctactgtgctatattgactttat

SEQ ID NO: 133164 - DNA, 25 bp, Rattus norvegicus
agctactgtgctttattgactttat

SEQ ID NO: 133165 - DNA, 25 bp, Rattus norvegicus
agctacttagtacttcctgtttggt

SEQ ID NO: 133166 - DNA, 25 bp, Rattus norvegicus
agctacttagtagttcctgtttggt

SEQ ID NO: 133167 - DNA, 25 bp, Rattus norvegicus
agctacttcatcatatctgtctcca

SEQ ID NO: 133168 - DNA, 25 bp, Rattus norvegicus
agctacttcatcttatctgtctcca

SEQ ID NO: 133169 - DNA, 25 bp, Rattus norvegicus
agctacttcccacccattaaaggca

SEQ ID NO: 133170 - DNA, 25 bp, Rattus norvegicus
agctacttcccagccattaaaggca

SEQ ID NO: 133171 - DNA, 25 bp, Rattus norvegicus
agctacttcctcatatccatgtttg

SEQ ID NO: 133172 - DNA, 25 bp, Rattus norvegicus
agctacttcctcttatccatgtttg

SEQ ID NO: 133173 - DNA, 25 bp, Rattus norvegicus
agctacttctgacgcgggaagcaca

SEQ ID NO: 133174 - DNA, 25 bp, Rattus norvegicus
agctacttctgaggcgggaagcaca

SEQ ID NO: 133175 - DNA, 25 bp, Rattus norvegicus
agctacttctgtattacatcctggg

SEQ ID NO: 133176 - DNA, 25 bp, Rattus norvegicus
agctacttctgttttacatcctggg

SEQ ID NO: 133177 - DNA, 25 bp, Rattus norvegicus
agctacttgaagatctgtctcagtt

SEQ ID NO: 133178 - DNA, 25 bp, Rattus norvegicus
agctacttgaagttctgtctcagtt

SEQ ID NO: 133179 - DNA, 25 bp, Rattus norvegicus
agctacttgccaacttggagtgcta

SEQ ID NO: 133180 - DNA, 25 bp, Rattus norvegicus
agctacttgccatcttggagtgcta

SEQ ID NO: 133181 - DNA, 25 bp, Rattus norvegicus
agctacttgctcatgcgtgaaggac

SEQ ID NO: 133182 - DNA, 25 bp, Rattus norvegicus
agctacttgctcttgcgtgaaggac

SEQ ID NO: 133183 - DNA, 25 bp, Rattus norvegicus
agctactttcacatattcacataga

SEQ ID NO: 133184 - DNA, 25 bp, Rattus norvegicus
agctactttcacttattcacataga

SEQ ID NO: 133185 - DNA, 25 bp, Rattus norvegicus
agctactttgacatgctccacaaca

SEQ ID NO: 133186 - DNA, 25 bp, Rattus norvegicus
agctactttgacttgctccacaaca

SEQ ID NO: 133187 - DNA, 25 bp, Rattus norvegicus
agctactttgtgaccactatgtcgt

SEQ ID NO: 133188 - DNA, 25 bp, Rattus norvegicus
agctactttgtgtccactatgtcgt

SEQ ID NO: 133189 - DNA, 25 bp, Rattus norvegicus
agctacttttgcactgctttcagat

SEQ ID NO: 133190 - DNA, 25 bp, Rattus norvegicus
agctacttttgctctgctttcagat

SEQ ID NO: 133191 - DNA, 25 bp, Rattus norvegicus
agctacttttggacacttggcagga

SEQ ID NO: 133192 - DNA, 25 bp, Rattus norvegicus
agctacttttggtcacttggcagga

SEQ ID NO: 133193 - DNA, 25 bp, Rattus norvegicus
agctagaaaccacatccttcagatg

SEQ ID NO: 133194 - DNA, 25 bp, Rattus norvegicus
agctagaaaccagatccttcagatg

SEQ ID NO: 133195 - DNA, 25 bp, Rattus norvegicus
agctagaacgccctccacgggaata

SEQ ID NO: 133196 - DNA, 25 bp, Rattus norvegicus
agctagaacgccgtccacgggaata

SEQ ID NO: 133197 - DNA, 25 bp, Rattus norvegicus
agctagaatctgacctccaacgtgt

SEQ ID NO: 133198 - DNA, 25 bp, Rattus norvegicus
agctagaatctgtcctccaacgtgt

SEQ ID NO: 133199 - DNA, 25 bp, Rattus norvegicus
agctagacactaagccggctgcttt

SEQ ID NO: 133200 - DNA, 25 bp, Rattus norvegicus
agctagacactatgccggctgcttt

SEQ ID NO: 133201 - DNA, 25 bp, Rattus norvegicus
agctagacccttctgtggctttgca

SEQ ID NO: 133202 - DNA, 25 bp, Rattus norvegicus
agctagacccttgtgtggctttgca

SEQ ID NO: 133203 - DNA, 25 bp, Rattus norvegicus
agctagactctacgtgaggcccagc

SEQ ID NO: 133204 - DNA, 25 bp, Rattus norvegicus
agctagactctaggtgaggcccagc

SEQ ID NO: 133205 - DNA, 25 bp, Rattus norvegicus
agctagagagccagtcagccatcga

SEQ ID NO: 133206 - DNA, 25 bp, Rattus norvegicus
agctagagagcctgtcagccatcga

SEQ ID NO: 133207 - DNA, 25 bp, Rattus norvegicus
agctagaggcctcctggcttgtgaa

SEQ ID NO: 133208 - DNA, 25 bp, Rattus norvegicus
agctagaggcctgctggcttgtgaa

SEQ ID NO: 133209 - DNA, 25 bp, Rattus norvegicus
agctagagggatacttaccgcctta

SEQ ID NO: 133210 - DNA, 25 bp, Rattus norvegicus
agctagagggattcttaccgcctta

SEQ ID NO: 133211 - DNA, 25 bp, Rattus norvegicus
agctagagggcacattagtgactca

SEQ ID NO: 133212 - DNA, 25 bp, Rattus norvegicus
agctagagggcagattagtgactca

SEQ ID NO: 133213 - DNA, 25 bp, Rattus norvegicus
agctagatccttccagttcaaacaa

SEQ ID NO: 133214 - DNA, 25 bp, Rattus norvegicus
agctagatccttgcagttcaaacaa

SEQ ID NO: 133215 - DNA, 25 bp, Rattus norvegicus
agctagatgcctagctcctagagga

SEQ ID NO: 133216 - DNA, 25 bp, Rattus norvegicus
agctagatgccttgctcctagagga

SEQ ID NO: 133217 - DNA, 25 bp, Rattus norvegicus
agctagcagtgcatctgtgaataca

SEQ ID NO: 133218 - DNA, 25 bp, Rattus norvegicus
agctagcagtgcttctgtgaataca

SEQ ID NO: 133219 - DNA, 25 bp, Rattus norvegicus
agctagcatggtctatgtgacccca

SEQ ID NO: 133220 - DNA, 25 bp, Rattus norvegicus
agctagcatggtgtatgtgacccca

SEQ ID NO: 133221 - DNA, 25 bp, Rattus norvegicus
agctagcattagatttctgtatatt

SEQ ID NO: 133222 - DNA, 25 bp, Rattus norvegicus
agctagcattagttttctgtatatt

SEQ ID NO: 133223 - DNA, 25 bp, Rattus norvegicus
agctagccaagaattcctgcgaaga

SEQ ID NO: 133224 - DNA, 25 bp, Rattus norvegicus
agctagccaagatttcctgcgaaga

SEQ ID NO: 133225 - DNA, 25 bp, Rattus norvegicus
agctagccacggagacctcaaggta

SEQ ID NO: 133226 - DNA, 25 bp, Rattus norvegicus
agctagccacggagagctgctgaca

SEQ ID NO: 133227 - DNA, 25 bp, Rattus norvegicus
agctagccacggtgacctcaaggta

SEQ ID NO: 133228 - DNA, 25 bp, Rattus norvegicus
agctagccacggtgagctgctgaca

SEQ ID NO: 133229 - DNA, 25 bp, Rattus norvegicus
agctagccagccaaggatgccagac

SEQ ID NO: 133230 - DNA, 25 bp, Rattus norvegicus
agctagccagcctaggatgccagac

SEQ ID NO: 133231 - DNA, 25 bp, Rattus norvegicus
agctagcccttgagatgtcatcaca

SEQ ID NO: 133232 - DNA, 25 bp, Rattus norvegicus
agctagcccttgtgatgtcatcaca

SEQ ID NO: 133233 - DNA, 25 bp, Rattus norvegicus
agctagccgtgtattctattccctg

SEQ ID NO: 133234 - DNA, 25 bp, Rattus norvegicus
agctagccgtgttttctattccctg

SEQ ID NO: 133235 - DNA, 25 bp, Rattus norvegicus
agctagcctcggctctctagggaaa

SEQ ID NO: 133236 - DNA, 25 bp, Rattus norvegicus
agctagcctcgggtctctagggaaa

SEQ ID NO: 133237 - DNA, 25 bp, Rattus norvegicus
agctagcctcttcctgatgatgacc

SEQ ID NO: 133238 - DNA, 25 bp, Rattus norvegicus
agctagcctcttgctgatgatgacc

SEQ ID NO: 133239 - DNA, 25 bp, Rattus norvegicus
agctagcctggcatatacagtggaa

SEQ ID NO: 133240 - DNA, 25 bp, Rattus norvegicus
agctagcctggcttatacagtggaa

SEQ ID NO: 133241 - DNA, 25 bp, Rattus norvegicus
agctagccttatcccacactgaggg

SEQ ID NO: 133242 - DNA, 25 bp, Rattus norvegicus
agctagccttatgccacactgaggg

SEQ ID NO: 133243 - DNA, 25 bp, Rattus norvegicus
agctagcgactcagaggctgtgcat

SEQ ID NO: 133244 - DNA, 25 bp, Rattus norvegicus
agctagcgactctgaggctgtgcat

SEQ ID NO: 133245 - DNA, 25 bp, Rattus norvegicus
agctagcggcagaattctgtacagt

SEQ ID NO: 133246 - DNA, 25 bp, Rattus norvegicus
agctagcggcagtattctgtacagt

SEQ ID NO: 133247 - DNA, 25 bp, Rattus norvegicus
agctagctcgtccatcttaatcaat

SEQ ID NO: 133248 - DNA, 25 bp, Rattus norvegicus
agctagctcgtcgatcttaatcaat

SEQ ID NO: 133249 - DNA, 25 bp, Rattus norvegicus
agctagctctgactgcgattcacac

SEQ ID NO: 133250 - DNA, 25 bp, Rattus norvegicus
agctagctctgagtgcgattcacac

SEQ ID NO: 133251 - DNA, 25 bp, Rattus norvegicus
agctagctctgtctggcagcagact

SEQ ID NO: 133252 - DNA, 25 bp, Rattus norvegicus
agctagctctgtgtggcagcagact

SEQ ID NO: 133253 - DNA, 25 bp, Rattus norvegicus
agctagctgacacgtgcttctccag

SEQ ID NO: 133254 - DNA, 25 bp, Rattus norvegicus
agctagctgacaggtgcttctccag

SEQ ID NO: 133255 - DNA, 25 bp, Rattus norvegicus
agctagctggccagagacgaactca

SEQ ID NO: 133256 - DNA, 25 bp, Rattus norvegicus
agctagctggcctgagacgaactca

SEQ ID NO: 133257 - DNA, 25 bp, Rattus norvegicus
agctagctgtctctggagtggcctt

SEQ ID NO: 133258 - DNA, 25 bp, Rattus norvegicus
agctagctgtctgtggagtggcctt

SEQ ID NO: 133259 - DNA, 25 bp, Rattus norvegicus
agctagctgtgcacatggctgtaat

SEQ ID NO: 133260 - DNA, 25 bp, Rattus norvegicus
agctagctgtgctcatggctgtaat

SEQ ID NO: 133261 - DNA, 25 bp, Rattus norvegicus
agctaggaggtcctctgtcttacat

SEQ ID NO: 133262 - DNA, 25 bp, Rattus norvegicus
agctaggaggtcgtctgtcttacat

SEQ ID NO: 133263 - DNA, 25 bp, Rattus norvegicus
agctaggattgacacattggactct

SEQ ID NO: 133264 - DNA, 25 bp, Rattus norvegicus
agctaggattgagacattggactct

SEQ ID NO: 133265 - DNA, 25 bp, Rattus norvegicus
agctaggctactcttcttgaagcaa

SEQ ID NO: 133266 - DNA, 25 bp, Rattus norvegicus
agctaggctactgttcttgaagcaa

SEQ ID NO: 133267 - DNA, 25 bp, Rattus norvegicus
agctaggctcagaggcacactggtt

SEQ ID NO: 133268 - DNA, 25 bp, Rattus norvegicus
agctaggctcagtggcacactggtt

SEQ ID NO: 133269 - DNA, 25 bp, Rattus norvegicus
agctaggctctcagctgtgtggtag

SEQ ID NO: 133270 - DNA, 25 bp, Rattus norvegicus
agctaggctctctgctgtgtggtag

SEQ ID NO: 133271 - DNA, 25 bp, Rattus norvegicus
agctagggatctagctcagcaggaa

SEQ ID NO: 133272 - DNA, 25 bp, Rattus norvegicus
agctagggatcttgctcagcaggaa

SEQ ID NO: 133273 - DNA, 25 bp, Rattus norvegicus
agctagggcaagctgctctcagtga

SEQ ID NO: 133274 - DNA, 25 bp, Rattus norvegicus
agctagggcaaggtgctctcagtga

SEQ ID NO: 133275 - DNA, 25 bp, Rattus norvegicus
agctagggcatgaggcactgtatgt

SEQ ID NO: 133276 - DNA, 25 bp, Rattus norvegicus
agctagggcatgtggcactgtatgt

SEQ ID NO: 133277 - DNA, 25 bp, Rattus norvegicus
agctaggtcactaccttgctgtaaa

SEQ ID NO: 133278 - DNA, 25 bp, Rattus norvegicus
agctaggtcacttccttgctgtaaa

SEQ ID NO: 133279 - DNA, 25 bp, Rattus norvegicus
agctaggtccttctgtcagtgataa

SEQ ID NO: 133280 - DNA, 25 bp, Rattus norvegicus
agctaggtccttgtgtcagtgataa

SEQ ID NO: 133281 - DNA, 25 bp, Rattus norvegicus
agctagtaattcacatgtttttcaa

SEQ ID NO: 133282 - DNA, 25 bp, Rattus norvegicus
agctagtaattctcatgtttttcaa

SEQ ID NO: 133283 - DNA, 25 bp, Rattus norvegicus
agctagtatgtacaagtcctgagtt

SEQ ID NO: 133284 - DNA, 25 bp, Rattus norvegicus
agctagtatgtagaagtcctgagtt

SEQ ID NO: 133285 - DNA, 25 bp, Rattus norvegicus
agctagtcaggtcagacgctcccag

SEQ ID NO: 133286 - DNA, 25 bp, Rattus norvegicus
agctagtcaggtgagacgctcccag

SEQ ID NO: 133287 - DNA, 25 bp, Rattus norvegicus
agctagtcccttaatctgcattgag

SEQ ID NO: 133288 - DNA, 25 bp, Rattus norvegicus
agctagtccctttatctgcattgag

SEQ ID NO: 133289 - DNA, 25 bp, Rattus norvegicus
agctagtgcagcacatcgaggacta

SEQ ID NO: 133290 - DNA, 25 bp, Rattus norvegicus
agctagtgcagctcatcgaggacta

SEQ ID NO: 133291 - DNA, 25 bp, Rattus norvegicus
agctagtgggttctttgtcctggaa

SEQ ID NO: 133292 - DNA, 25 bp, Rattus norvegicus
agctagtgggttgtttgtcctggaa

SEQ ID NO: 133293 - DNA, 25 bp, Rattus norvegicus
agctagtggttcaggagtcctccta

SEQ ID NO: 133294 - DNA, 25 bp, Rattus norvegicus
agctagtggttctggagtcctccta

SEQ ID NO: 133295 - DNA, 25 bp, Rattus norvegicus
agctagttattgattacctctgtgt

SEQ ID NO: 133296 - DNA, 25 bp, Rattus norvegicus
agctagttattgtttacctctgtgt

SEQ ID NO: 133297 - DNA, 25 bp, Rattus norvegicus
agctagttcactagtcatttctggg

SEQ ID NO: 133298 - DNA, 25 bp, Rattus norvegicus
agctagttcacttgtcatttctggg

SEQ ID NO: 133299 - DNA, 25 bp, Rattus norvegicus
agctagttttgaacagtcaccctaa

SEQ ID NO: 133300 - DNA, 25 bp, Rattus norvegicus
agctagttttgatcagtcaccctaa

SEQ ID NO: 133301 - DNA, 25 bp, Rattus norvegicus
agctataaagcaattttcaattcaa

SEQ ID NO: 133302 - DNA, 25 bp, Rattus norvegicus
agctataaagcatttttcaattcaa

SEQ ID NO: 133303 - DNA, 25 bp, Rattus norvegicus
agctatacatacagccccagcaggt

SEQ ID NO: 133304 - DNA, 25 bp, Rattus norvegicus
agctatacatactgccccagcaggt

SEQ ID NO: 133305 - DNA, 25 bp, Rattus norvegicus
agctataccacccagggctcttaag

SEQ ID NO: 133306 - DNA, 25 bp, Rattus norvegicus
agctataccaccgagggctcttaag

SEQ ID NO: 133307 - DNA, 25 bp, Rattus norvegicus
agctatacctggaaatgctccccag

SEQ ID NO: 133308 - DNA, 25 bp, Rattus norvegicus
agctatacctggcttttgaatagac

SEQ ID NO: 133309 - DNA, 25 bp, Rattus norvegicus
agctatacctgggttttgaatagac

SEQ ID NO: 133310 - DNA, 25 bp, Rattus norvegicus
agctatacctggtaatgctccccag

SEQ ID NO: 133311 - DNA, 25 bp, Rattus norvegicus
agctatagcagaaatgtgggcctcc

SEQ ID NO: 133312 - DNA, 25 bp, Rattus norvegicus
agctatagcagatatgtgggcctcc

SEQ ID NO: 133313 - DNA, 25 bp, Rattus norvegicus
agctatagcagcagtcccaccggag

SEQ ID NO: 133314 - DNA, 25 bp, Rattus norvegicus
agctatagcagcattgcgtggcgca

SEQ ID NO: 133315 - DNA, 25 bp, Rattus norvegicus
agctatagcagctgtcccaccggag

SEQ ID NO: 133316 - DNA, 25 bp, Rattus norvegicus
agctatagcagctttgcgtggcgca

SEQ ID NO: 133317 - DNA, 25 bp, Rattus norvegicus
agctatagccatagctgtgctgtgc

SEQ ID NO: 133318 - DNA, 25 bp, Rattus norvegicus
agctatagccattgctgtgctgtgc

SEQ ID NO: 133319 - DNA, 25 bp, Rattus norvegicus
agctatatacagagagcataccact

SEQ ID NO: 133320 - DNA, 25 bp, Rattus norvegicus
agctatatacagtgagcataccact

SEQ ID NO: 133321 - DNA, 25 bp, Rattus norvegicus
agctatatcgtcctgtgcattgaga

SEQ ID NO: 133322 - DNA, 25 bp, Rattus norvegicus
agctatatcgtcgtgtgcattgaga

SEQ ID NO: 133323 - DNA, 25 bp, Rattus norvegicus
agctatatcttcattcatttctaag

SEQ ID NO: 133324 - DNA, 25 bp, Rattus norvegicus
agctatatcttctttcatttctaag

SEQ ID NO: 133325 - DNA, 25 bp, Rattus norvegicus
agctatatttatactttggtttgaa

SEQ ID NO: 133326 - DNA, 25 bp, Rattus norvegicus
agctatatttattctttggtttgaa

SEQ ID NO: 133327 - DNA, 25 bp, Rattus norvegicus
agctatatttctagtggtgacattc

SEQ ID NO: 133328 - DNA, 25 bp, Rattus norvegicus
agctatatttcttgtggtgacattc

SEQ ID NO: 133329 - DNA, 25 bp, Rattus norvegicus
agctatcacatgaaccacggagagg

SEQ ID NO: 133330 - DNA, 25 bp, Rattus norvegicus
agctatcacatgtaccacggagagg

SEQ ID NO: 133331 - DNA, 25 bp, Rattus norvegicus
agctatcaccacctgccaataaagg

SEQ ID NO: 133332 - DNA, 25 bp, Rattus norvegicus
agctatcaccacgtgccaataaagg

SEQ ID NO: 133333 - DNA, 25 bp, Rattus norvegicus
agctatcagccccaaggacactgac

SEQ ID NO: 133334 - DNA, 25 bp, Rattus norvegicus
agctatcagcccgaaggacactgac

SEQ ID NO: 133335 - DNA, 25 bp, Rattus norvegicus
agctatccaagcctaagggttccgc

SEQ ID NO: 133336 - DNA, 25 bp, Rattus norvegicus
agctatccaagcctctgccttggct

SEQ ID NO: 133337 - DNA, 25 bp, Rattus norvegicus
agctatccaagcgtaagggttccgc

SEQ ID NO: 133338 - DNA, 25 bp, Rattus norvegicus
agctatccaagcgtctgccttggct

SEQ ID NO: 133339 - DNA, 25 bp, Rattus norvegicus
agctatccaggcagaattgcttaaa

SEQ ID NO: 133340 - DNA, 25 bp, Rattus norvegicus
agctatccaggctgaattgcttaaa

SEQ ID NO: 133341 - DNA, 25 bp, Rattus norvegicus
agctatcccttcagaaagggccagt

SEQ ID NO: 133342 - DNA, 25 bp, Rattus norvegicus
agctatcccttctgaaagggccagt

SEQ ID NO: 133343 - DNA, 25 bp, Rattus norvegicus
agctatccgtttatgtagtacacca

SEQ ID NO: 133344 - DNA, 25 bp, Rattus norvegicus
agctatccgtttttgtagtacacca

SEQ ID NO: 133345 - DNA, 25 bp, Rattus norvegicus
agctatcctctgacagaaccaagat

SEQ ID NO: 133346 - DNA, 25 bp, Rattus norvegicus
agctatcctctgtcagaaccaagat

SEQ ID NO: 133347 - DNA, 25 bp, Rattus norvegicus
agctatcctgaaaatcccaaccatg

SEQ ID NO: 133348 - DNA, 25 bp, Rattus norvegicus
agctatcctgaatatcccaaccatg

SEQ ID NO: 133349 - DNA, 25 bp, Rattus norvegicus
agctatcctgctatttgtcacttaa

SEQ ID NO: 133350 - DNA, 25 bp, Rattus norvegicus
agctatcctgctttttgtcacttaa

SEQ ID NO: 133351 - DNA, 25 bp, Rattus norvegicus
agctatcgtgcaagagttgactctc

SEQ ID NO: 133352 - DNA, 25 bp, Rattus norvegicus
agctatcgtgcatgagttgactctc

SEQ ID NO: 133353 - DNA, 25 bp, Rattus norvegicus
agctatctccaaacctgtgggcttt

SEQ ID NO: 133354 - DNA, 25 bp, Rattus norvegicus
agctatctccaatcctgtgggcttt

SEQ ID NO: 133355 - DNA, 25 bp, Rattus norvegicus
agctatctccctccatttgttattg

SEQ ID NO: 133356 - DNA, 25 bp, Rattus norvegicus
agctatctccctgcatttgttattg

SEQ ID NO: 133357 - DNA, 25 bp, Rattus norvegicus
agctatctcctaatttaaacgacac

SEQ ID NO: 133358 - DNA, 25 bp, Rattus norvegicus
agctatctcctattttaaacgacac

SEQ ID NO: 133359 - DNA, 25 bp, Rattus norvegicus
agctatctgcctactgtaggagagt

SEQ ID NO: 133360 - DNA, 25 bp, Rattus norvegicus
agctatctgccttctgtaggagagt

SEQ ID NO: 133361 - DNA, 25 bp, Rattus norvegicus
agctatcttgggaccctggaacacc

SEQ ID NO: 133362 - DNA, 25 bp, Rattus norvegicus
agctatcttgggtccctggaacacc

SEQ ID NO: 133363 - DNA, 25 bp, Rattus norvegicus
agctatgaagcaagctgccttttaa

SEQ ID NO: 133364 - DNA, 25 bp, Rattus norvegicus
agctatgaagcatgctgccttttaa

SEQ ID NO: 133365 - DNA, 25 bp, Rattus norvegicus
agctatgaatttcactctgtgtgtg

SEQ ID NO: 133366 - DNA, 25 bp, Rattus norvegicus
agctatgaatttgactctgtgtgtg

SEQ ID NO: 133367 - DNA, 25 bp, Rattus norvegicus
agctatgacgagcatgtgcacgatc

SEQ ID NO: 133368 - DNA, 25 bp, Rattus norvegicus
agctatgacgaggatgtgcacgatc

SEQ ID NO: 133369 - DNA, 25 bp, Rattus norvegicus
agctatgactctagctggacgtgag

SEQ ID NO: 133370 - DNA, 25 bp, Rattus norvegicus
agctatgactcttgctggacgtgag

SEQ ID NO: 133371 - DNA, 25 bp, Rattus norvegicus
agctatgactgcacttgtgtctgaa

SEQ ID NO: 133372 - DNA, 25 bp, Rattus norvegicus
agctatgactgctcttgtgtctgaa

SEQ ID NO: 133373 - DNA, 25 bp, Rattus norvegicus
agctatgagcctagaagcctttccg

SEQ ID NO: 133374 - DNA, 25 bp, Rattus norvegicus
agctatgagccttgaagcctttccg

SEQ ID NO: 133375 - DNA, 25 bp, Rattus norvegicus
agctatgatctgcagacgccgacgt

SEQ ID NO: 133376 - DNA, 25 bp, Rattus norvegicus
agctatgatctggagacgccgacgt

SEQ ID NO: 133377 - DNA, 25 bp, Rattus norvegicus
agctatgattagatcttctgtgaca

SEQ ID NO: 133378 - DNA, 25 bp, Rattus norvegicus
agctatgattagttcttctgtgaca

SEQ ID NO: 133379 - DNA, 25 bp, Rattus norvegicus
agctatgattttctctgatcaggat

SEQ ID NO: 133380 - DNA, 25 bp, Rattus norvegicus
agctatgattttgtctgatcaggat

SEQ ID NO: 133381 - DNA, 25 bp, Rattus norvegicus
agctatgcacttcgtggaccacagt

SEQ ID NO: 133382 - DNA, 25 bp, Rattus norvegicus
agctatgcacttggtggaccacagt

SEQ ID NO: 133383 - DNA, 25 bp, Rattus norvegicus
agctatgcagccacaggagaccctg

SEQ ID NO: 133384 - DNA, 25 bp, Rattus norvegicus
agctatgcagcctcaggagaccctg

SEQ ID NO: 133385 - DNA, 25 bp, Rattus norvegicus
agctatgctgtcaaactcctaaagt

SEQ ID NO: 133386 - DNA, 25 bp, Rattus norvegicus
agctatgctgtctaactcctaaagt

SEQ ID NO: 133387 - DNA, 25 bp, Rattus norvegicus
agctatgcttcccttttatgttgtt

SEQ ID NO: 133388 - DNA, 25 bp, Rattus norvegicus
agctatgcttccgttttatgttgtt

SEQ ID NO: 133389 - DNA, 25 bp, Rattus norvegicus
agctatggatatcggtgtcctccga

SEQ ID NO: 133390 - DNA, 25 bp, Rattus norvegicus
agctatggatatgggtgtcctccga

SEQ ID NO: 133391 - DNA, 25 bp, Rattus norvegicus
agctatggcagacactcctggagca

SEQ ID NO: 133392 - DNA, 25 bp, Rattus norvegicus
agctatggcagagactcctggagca

SEQ ID NO: 133393 - DNA, 25 bp, Rattus norvegicus
agctatggcagtccggaaacactca

SEQ ID NO: 133394 - DNA, 25 bp, Rattus norvegicus
agctatggcagtgcggaaacactca

SEQ ID NO: 133395 - DNA, 25 bp, Rattus norvegicus
agctatggcttgataggctgtatat

SEQ ID NO: 133396 - DNA, 25 bp, Rattus norvegicus
agctatggcttgttaggctgtatat

SEQ ID NO: 133397 - DNA, 25 bp, Rattus norvegicus
agctatggtcgcacctcaaaggact

SEQ ID NO: 133398 - DNA, 25 bp, Rattus norvegicus
agctatggtcgctcctcaaaggact

SEQ ID NO: 133399 - DNA, 25 bp, Rattus norvegicus
agctatgtacttcaccttgttaagg

SEQ ID NO: 133400 - DNA, 25 bp, Rattus norvegicus
agctatgtacttgaccttgttaagg

SEQ ID NO: 133401 - DNA, 25 bp, Rattus norvegicus
agctatgtagcgcacgtttccaaat

SEQ ID NO: 133402 - DNA, 25 bp, Rattus norvegicus
agctatgtagcggacgtttccaaat

SEQ ID NO: 133403 - DNA, 25 bp, Rattus norvegicus
agctatgtcaggaggcgcacaaccc

SEQ ID NO: 133404 - DNA, 25 bp, Rattus norvegicus
agctatgtcaggtggcgcacaaccc

SEQ ID NO: 133405 - DNA, 25 bp, Rattus norvegicus
agctatgtccccagcagtagacttt

SEQ ID NO: 133406 - DNA, 25 bp, Rattus norvegicus
agctatgtcccctgcagtagacttt

SEQ ID NO: 133407 - DNA, 25 bp, Rattus norvegicus
agctatgtcctgcatttgggtttct

SEQ ID NO: 133408 - DNA, 25 bp, Rattus norvegicus
agctatgtcctggatttgggtttct

SEQ ID NO: 133409 - DNA, 25 bp, Rattus norvegicus
agctatgtctgcagcccattacaga

SEQ ID NO: 133410 - DNA, 25 bp, Rattus norvegicus
agctatgtctgctgcccattacaga

SEQ ID NO: 133411 - DNA, 25 bp, Rattus norvegicus
agctatgtgcagctactaatctctt

SEQ ID NO: 133412 - DNA, 25 bp, Rattus norvegicus
agctatgtgcaggtactaatctctt

SEQ ID NO: 133413 - DNA, 25 bp, Rattus norvegicus
agctatgtgcatcccaagagcagca

SEQ ID NO: 133414 - DNA, 25 bp, Rattus norvegicus
agctatgtgcatgccaagagcagca

SEQ ID NO: 133415 - DNA, 25 bp, Rattus norvegicus
agctatgtgctgagtctgtccaaag

SEQ ID NO: 133416 - DNA, 25 bp, Rattus norvegicus
agctatgtgctgtgtctgtccaaag

SEQ ID NO: 133417 - DNA, 25 bp, Rattus norvegicus
agctatgtgtcaccttactgagcca

SEQ ID NO: 133418 - DNA, 25 bp, Rattus norvegicus
agctatgtgtcagcttactgagcca

SEQ ID NO: 133419 - DNA, 25 bp, Rattus norvegicus
agctatgtgttcatagactcttcta

SEQ ID NO: 133420 - DNA, 25 bp, Rattus norvegicus
agctatgtgttcttagactcttcta

SEQ ID NO: 133421 - DNA, 25 bp, Rattus norvegicus
agctatgtttctctgtttgcagtcc

SEQ ID NO: 133422 - DNA, 25 bp, Rattus norvegicus
agctatgtttctgtgtttgcagtcc

SEQ ID NO: 133423 - DNA, 25 bp, Rattus norvegicus
agctattaaaggcacatctggaaca

SEQ ID NO: 133424 - DNA, 25 bp, Rattus norvegicus
agctattaaagggacatctggaaca

SEQ ID NO: 133425 - DNA, 25 bp, Rattus norvegicus
agctattcagacagttgaggcagga

SEQ ID NO: 133426 - DNA, 25 bp, Rattus norvegicus
agctattcagactgttgaggcagga

SEQ ID NO: 133427 - DNA, 25 bp, Rattus norvegicus
agctattctgctactctttactaaa

SEQ ID NO: 133428 - DNA, 25 bp, Rattus norvegicus
agctattctgcttctctttactaaa

SEQ ID NO: 133429 - DNA, 25 bp, Rattus norvegicus
agctattctgtcatacaccatttca

SEQ ID NO: 133430 - DNA, 25 bp, Rattus norvegicus
agctattctgtcttacaccatttca

SEQ ID NO: 133431 - DNA, 25 bp, Rattus norvegicus
agctattgagatcgctaagatattt

SEQ ID NO: 133432 - DNA, 25 bp, Rattus norvegicus
agctattgagatggctaagatattt

SEQ ID NO: 133433 - DNA, 25 bp, Rattus norvegicus
agctattggcttctactgtactctg

SEQ ID NO: 133434 - DNA, 25 bp, Rattus norvegicus
agctattggcttgtactgtactctg

SEQ ID NO: 133435 - DNA, 25 bp, Rattus norvegicus
agctattggtacatgtagattcccc

SEQ ID NO: 133436 - DNA, 25 bp, Rattus norvegicus
agctattggtacttgtagattcccc

SEQ ID NO: 133437 - DNA, 25 bp, Rattus norvegicus
agctattgtgtcagttcttcctccc

SEQ ID NO: 133438 - DNA, 25 bp, Rattus norvegicus
agctattgtgtctgttcttcctccc

SEQ ID NO: 133439 - DNA, 25 bp, Rattus norvegicus
agctatttattcagaggccacagct

SEQ ID NO: 133440 - DNA, 25 bp, Rattus norvegicus
agctatttattctgaggccacagct

SEQ ID NO: 133441 - DNA, 25 bp, Rattus norvegicus
agctatttccaactctgcctgtacc

SEQ ID NO: 133442 - DNA, 25 bp, Rattus norvegicus
agctatttccaagtctgcctgtacc

SEQ ID NO: 133443 - DNA, 25 bp, Rattus norvegicus
agctatttccagattgtttctagaa

SEQ ID NO: 133444 - DNA, 25 bp, Rattus norvegicus
agctatttccagtttgtttctagaa

SEQ ID NO: 133445 - DNA, 25 bp, Rattus norvegicus
agctatttccctcacagatcaagat

SEQ ID NO: 133446 - DNA, 25 bp, Rattus norvegicus
agctatttccctgacagatcaagat

SEQ ID NO: 133447 - DNA, 25 bp, Rattus norvegicus
agctatttccttatctccatgtttg

SEQ ID NO: 133448 - DNA, 25 bp, Rattus norvegicus
agctatttccttattactactgtgg

SEQ ID NO: 133449 - DNA, 25 bp, Rattus norvegicus
agctatttccttttctccatgtttg

SEQ ID NO: 133450 - DNA, 25 bp, Rattus norvegicus
agctatttcctttttactactgtgg

SEQ ID NO: 133451 - DNA, 25 bp, Rattus norvegicus
agctatttctagatgccctttaaca

SEQ ID NO: 133452 - DNA, 25 bp, Rattus norvegicus
agctatttctagttgccctttaaca

SEQ ID NO: 133453 - DNA, 25 bp, Rattus norvegicus
agctatttgggcacatggtgatcat

SEQ ID NO: 133454 - DNA, 25 bp, Rattus norvegicus
agctatttgggctcatggtgatcat

SEQ ID NO: 133455 - DNA, 25 bp, Rattus norvegicus
agctattttagcagccaacaccctg

SEQ ID NO: 133456 - DNA, 25 bp, Rattus norvegicus
agctattttagctgccaacaccctg

SEQ ID NO: 133457 - DNA, 25 bp, Rattus norvegicus
agctattttagtcgtatttgttcaa

SEQ ID NO: 133458 - DNA, 25 bp, Rattus norvegicus
agctattttagtggtatttgttcaa

SEQ ID NO: 133459 - DNA, 25 bp, Rattus norvegicus
agctatttttaaatcttgtgcctct

SEQ ID NO: 133460 - DNA, 25 bp, Rattus norvegicus
agctatttttaattcttgtgcctct

SEQ ID NO: 133461 - DNA, 25 bp, Rattus norvegicus
agctatttttcaaggccctacttga

SEQ ID NO: 133462 - DNA, 25 bp, Rattus norvegicus
agctatttttcatggccctacttga

SEQ ID NO: 133463 - DNA, 25 bp, Rattus norvegicus
agctcaaaagggaggtggcgcacac

SEQ ID NO: 133464 - DNA, 25 bp, Rattus norvegicus
agctcaaaagggtggtggcgcacac

SEQ ID NO: 133465 - DNA, 25 bp, Rattus norvegicus
agctcaaaccataccagcagaggag

SEQ ID NO: 133466 - DNA, 25 bp, Rattus norvegicus
agctcaaaccattccagcagaggag

SEQ ID NO: 133467 - DNA, 25 bp, Rattus norvegicus
agctcaaacctcacactggatattt

SEQ ID NO: 133468 - DNA, 25 bp, Rattus norvegicus
agctcaaacctctcactggatattt

SEQ ID NO: 133469 - DNA, 25 bp, Rattus norvegicus
agctcaaactctatgcagcacctgt

SEQ ID NO: 133470 - DNA, 25 bp, Rattus norvegicus
agctcaaactctttgcagcacctgt

SEQ ID NO: 133471 - DNA, 25 bp, Rattus norvegicus
agctcaaagaggcagcatgcacagt

SEQ ID NO: 133472 - DNA, 25 bp, Rattus norvegicus
agctcaaagagggagcatgcacagt

SEQ ID NO: 133473 - DNA, 25 bp, Rattus norvegicus
agctcaaagctgatcttgccacaca

SEQ ID NO: 133474 - DNA, 25 bp, Rattus norvegicus
agctcaaagctgctgccacgtatct

SEQ ID NO: 133475 - DNA, 25 bp, Rattus norvegicus
agctcaaagctggtgccacgtatct

SEQ ID NO: 133476 - DNA, 25 bp, Rattus norvegicus
agctcaaagctgttcttgccacaca

SEQ ID NO: 133477 - DNA, 25 bp, Rattus norvegicus
agctcaaaggagacttctgcccctt

SEQ ID NO: 133478 - DNA, 25 bp, Rattus norvegicus
agctcaaaggagtcttctgcccctt

SEQ ID NO: 133479 - DNA, 25 bp, Rattus norvegicus
agctcaaagttacaccacctcggga

SEQ ID NO: 133480 - DNA, 25 bp, Rattus norvegicus
agctcaaagttagaccacctcggga

SEQ ID NO: 133481 - DNA, 25 bp, Rattus norvegicus
agctcaaatagcatctttccattcc

SEQ ID NO: 133482 - DNA, 25 bp, Rattus norvegicus
agctcaaatagcttctttccattcc

SEQ ID NO: 133483 - DNA, 25 bp, Rattus norvegicus
agctcaaatcctcggctctaagagg

SEQ ID NO: 133484 - DNA, 25 bp, Rattus norvegicus
agctcaaatcctgggctctaagagg

SEQ ID NO: 133485 - DNA, 25 bp, Rattus norvegicus
agctcaaatctcaacattcatcaga

SEQ ID NO: 133486 - DNA, 25 bp, Rattus norvegicus
agctcaaatctctacattcatcaga

SEQ ID NO: 133487 - DNA, 25 bp, Rattus norvegicus
agctcaaatctgctctatggccaaa

SEQ ID NO: 133488 - DNA, 25 bp, Rattus norvegicus
agctcaaatctggtctatggccaaa

SEQ ID NO: 133489 - DNA, 25 bp, Rattus norvegicus
agctcaacagatcccttttaacgac

SEQ ID NO: 133490 - DNA, 25 bp, Rattus norvegicus
agctcaacagatgccttttaacgac

SEQ ID NO: 133491 - DNA, 25 bp, Rattus norvegicus
agctcaacatgtaccagaccctgaa

SEQ ID NO: 133492 - DNA, 25 bp, Rattus norvegicus
agctcaacatgttccagaccctgaa

SEQ ID NO: 133493 - DNA, 25 bp, Rattus norvegicus
agctcaacccggaggcgctgggctt

SEQ ID NO: 133494 - DNA, 25 bp, Rattus norvegicus
agctcaacccggtggcgctgggctt

SEQ ID NO: 133495 - DNA, 25 bp, Rattus norvegicus
agctcaacctctacatgcttgagga

SEQ ID NO: 133496 - DNA, 25 bp, Rattus norvegicus
agctcaacctcttcatgcttgagga

SEQ ID NO: 133497 - DNA, 25 bp, Rattus norvegicus
agctcaacgagcaggccgagtttgc

SEQ ID NO: 133498 - DNA, 25 bp, Rattus norvegicus
agctcaacgagctggccgagtttgc

SEQ ID NO: 133499 - DNA, 25 bp, Rattus norvegicus
agctcaacgagtaccgggcatcttt

SEQ ID NO: 133500 - DNA, 25 bp, Rattus norvegicus
agctcaacgagttccgggcatcttt

SEQ ID NO: 133501 - DNA, 25 bp, Rattus norvegicus
agctcaacgcagagacctcattaac

SEQ ID NO: 133502 - DNA, 25 bp, Rattus norvegicus
agctcaacgcagtgacctcattaac

SEQ ID NO: 133503 - DNA, 25 bp, Rattus norvegicus
agctcaacgcgaaatctgtcctcta

SEQ ID NO: 133504 - DNA, 25 bp, Rattus norvegicus
agctcaacgcgatatctgtcctcta

SEQ ID NO: 133505 - DNA, 25 bp, Rattus norvegicus
agctcaactctgaactgttggcggc

SEQ ID NO: 133506 - DNA, 25 bp, Rattus norvegicus
agctcaactctgtactgttggcggc

SEQ ID NO: 133507 - DNA, 25 bp, Rattus norvegicus
agctcaacttccatttctagtgcag

SEQ ID NO: 133508 - DNA, 25 bp, Rattus norvegicus
agctcaacttccttttctagtgcag

SEQ ID NO: 133509 - DNA, 25 bp, Rattus norvegicus
agctcaacttggcattgtgtcccag

SEQ ID NO: 133510 - DNA, 25 bp, Rattus norvegicus
agctcaacttgggattgtgtcccag

SEQ ID NO: 133511 - DNA, 25 bp, Rattus norvegicus
agctcaactttacgctagactcagc

SEQ ID NO: 133512 - DNA, 25 bp, Rattus norvegicus
agctcaactttaggctagactcagc

SEQ ID NO: 133513 - DNA, 25 bp, Rattus norvegicus
agctcaagagtcctcccggaggtgc

SEQ ID NO: 133514 - DNA, 25 bp, Rattus norvegicus
agctcaagagtcgtcccggaggtgc

SEQ ID NO: 133515 - DNA, 25 bp, Rattus norvegicus
agctcaagagttactccagcacaga

SEQ ID NO: 133516 - DNA, 25 bp, Rattus norvegicus
agctcaagagtttctccagcacaga

SEQ ID NO: 133517 - DNA, 25 bp, Rattus norvegicus
agctcaagccaaacgagtcgtccat

SEQ ID NO: 133518 - DNA, 25 bp, Rattus norvegicus
agctcaagccaatcgagtcgtccat

SEQ ID NO: 133519 - DNA, 25 bp, Rattus norvegicus
agctcaaggaaaaacacgtacctgt

SEQ ID NO: 133520 - DNA, 25 bp, Rattus norvegicus
agctcaaggaaatacacgtacctgt

SEQ ID NO: 133521 - DNA, 25 bp, Rattus norvegicus
agctcaagggcacgtcttaaccaag

SEQ ID NO: 133522 - DNA, 25 bp, Rattus norvegicus
agctcaagggcaggtcttaaccaag

SEQ ID NO: 133523 - DNA, 25 bp, Rattus norvegicus
agctcaaggtggctacgtgactctg

SEQ ID NO: 133524 - DNA, 25 bp, Rattus norvegicus
agctcaaggtgggtacgtgactctg

SEQ ID NO: 133525 - DNA, 25 bp, Rattus norvegicus
agctcaagtcagagtctcgatccat

SEQ ID NO: 133526 - DNA, 25 bp, Rattus norvegicus
agctcaagtcagtgtctcgatccat

SEQ ID NO: 133527 - DNA, 25 bp, Rattus norvegicus
agctcaagtttgcaggcaagtccag

SEQ ID NO: 133528 - DNA, 25 bp, Rattus norvegicus
agctcaagtttggaggcaagtccag

SEQ ID NO: 133529 - DNA, 25 bp, Rattus norvegicus
agctcaatacataagtgcatgctga

SEQ ID NO: 133530 - DNA, 25 bp, Rattus norvegicus
agctcaatacattagtgcatgctga

SEQ ID NO: 133531 - DNA, 25 bp, Rattus norvegicus
agctcaatccacagtgctgatggct

SEQ ID NO: 133532 - DNA, 25 bp, Rattus norvegicus
agctcaatccactgtgctgatggct

SEQ ID NO: 133533 - DNA, 25 bp, Rattus norvegicus
agctcaatgctaaccaagccttctt

SEQ ID NO: 133534 - DNA, 25 bp, Rattus norvegicus
agctcaatgctatccaagccttctt

SEQ ID NO: 133535 - DNA, 25 bp, Rattus norvegicus
agctcaatgctcctggtgctggcca

SEQ ID NO: 133536 - DNA, 25 bp, Rattus norvegicus
agctcaatgctcgtggtgctggcca

SEQ ID NO: 133537 - DNA, 25 bp, Rattus norvegicus
agctcaatggctctgctgtattaga

SEQ ID NO: 133538 - DNA, 25 bp, Rattus norvegicus
agctcaatggctgtgctgtattaga

SEQ ID NO: 133539 - DNA, 25 bp, Rattus norvegicus
agctcaatgttacatggcttgccta

SEQ ID NO: 133540 - DNA, 25 bp, Rattus norvegicus
agctcaatgttagatggcttgccta

SEQ ID NO: 133541 - DNA, 25 bp, Rattus norvegicus
agctcacaatccattgaggccttat

SEQ ID NO: 133542 - DNA, 25 bp, Rattus norvegicus
agctcacaatcctttgaggccttat

SEQ ID NO: 133543 - DNA, 25 bp, Rattus norvegicus
agctcacacaatactaggtcttaaa

SEQ ID NO: 133544 - DNA, 25 bp, Rattus norvegicus
agctcacacaattctaggtcttaaa

SEQ ID NO: 133545 - DNA, 25 bp, Rattus norvegicus
agctcacacaggctgcatttgttat

SEQ ID NO: 133546 - DNA, 25 bp, Rattus norvegicus
agctcacacagggtgcatttgttat

SEQ ID NO: 133547 - DNA, 25 bp, Rattus norvegicus
agctcacagacactcagttgaccaa

SEQ ID NO: 133548 - DNA, 25 bp, Rattus norvegicus
agctcacagacagtcagttgaccaa

SEQ ID NO: 133549 - DNA, 25 bp, Rattus norvegicus
agctcacagagaacggaaggttcaa

SEQ ID NO: 133550 - DNA, 25 bp, Rattus norvegicus
agctcacagagatcggaaggttcaa

SEQ ID NO: 133551 - DNA, 25 bp, Rattus norvegicus
agctcacagagcaaacaccctttag

SEQ ID NO: 133552 - DNA, 25 bp, Rattus norvegicus
agctcacagagctaacaccctttag

SEQ ID NO: 133553 - DNA, 25 bp, Rattus norvegicus
agctcacagcagctttggaagcagt

SEQ ID NO: 133554 - DNA, 25 bp, Rattus norvegicus
agctcacagcaggtttggaagcagt

SEQ ID NO: 133555 - DNA, 25 bp, Rattus norvegicus
agctcacagctacactgaccaggag

SEQ ID NO: 133556 - DNA, 25 bp, Rattus norvegicus
agctcacagctagactgaccaggag

SEQ ID NO: 133557 - DNA, 25 bp, Rattus norvegicus
agctcacagtaaacttcagcctcgt

SEQ ID NO: 133558 - DNA, 25 bp, Rattus norvegicus
agctcacagtaatcttcagcctcgt

SEQ ID NO: 133559 - DNA, 25 bp, Rattus norvegicus
agctcacagtccagtattctcaaag

SEQ ID NO: 133560 - DNA, 25 bp, Rattus norvegicus
agctcacagtcctgtattctcaaag

SEQ ID NO: 133561 - DNA, 25 bp, Rattus norvegicus
agctcacatattagattggcacttg

SEQ ID NO: 133562 - DNA, 25 bp, Rattus norvegicus
agctcacatatttgattggcacttg

SEQ ID NO: 133563 - DNA, 25 bp, Rattus norvegicus
agctcacatctcattcaacaccaga

SEQ ID NO: 133564 - DNA, 25 bp, Rattus norvegicus
agctcacatctctttcaacaccaga

SEQ ID NO: 133565 - DNA, 25 bp, Rattus norvegicus
agctcacatgctacttctgtacagt

SEQ ID NO: 133566 - DNA, 25 bp, Rattus norvegicus
agctcacatgcttcttctgtacagt

SEQ ID NO: 133567 - DNA, 25 bp, Rattus norvegicus
agctcacatggtcctaagtgcttag

SEQ ID NO: 133568 - DNA, 25 bp, Rattus norvegicus
agctcacatggtgctaagtgcttag

SEQ ID NO: 133569 - DNA, 25 bp, Rattus norvegicus
agctcaccacgtccttcaggtaaag

SEQ ID NO: 133570 - DNA, 25 bp, Rattus norvegicus
agctcaccacgtgcttcaggtaaag

SEQ ID NO: 133571 - DNA, 25 bp, Rattus norvegicus
agctcacccatgactgctttggaag

SEQ ID NO: 133572 - DNA, 25 bp, Rattus norvegicus
agctcacccatgtctgctttggaag

SEQ ID NO: 133573 - DNA, 25 bp, Rattus norvegicus
agctcacccgctcctgaaatacagg

SEQ ID NO: 133574 - DNA, 25 bp, Rattus norvegicus
agctcacccgctgctgaaatacagg

SEQ ID NO: 133575 - DNA, 25 bp, Rattus norvegicus
agctcacctaccagacagaggaaga

SEQ ID NO: 133576 - DNA, 25 bp, Rattus norvegicus
agctcacctacctgacagaggaaga

SEQ ID NO: 133577 - DNA, 25 bp, Rattus norvegicus
agctcacctaggctctttaaagcac

SEQ ID NO: 133578 - DNA, 25 bp, Rattus norvegicus
agctcacctagggtctttaaagcac

SEQ ID NO: 133579 - DNA, 25 bp, Rattus norvegicus
agctcacctcaaaccatgtcaaaga

SEQ ID NO: 133580 - DNA, 25 bp, Rattus norvegicus
agctcacctcaatccatgtcaaaga

SEQ ID NO: 133581 - DNA, 25 bp, Rattus norvegicus
agctcacctgccagagtaatctcag

SEQ ID NO: 133582 - DNA, 25 bp, Rattus norvegicus
agctcacctgcctgagtaatctcag

SEQ ID NO: 133583 - DNA, 25 bp, Rattus norvegicus
agctcaccttcacggatctgtaaat

SEQ ID NO: 133584 - DNA, 25 bp, Rattus norvegicus
agctcaccttcagggatctgtaaat

SEQ ID NO: 133585 - DNA, 25 bp, Rattus norvegicus
agctcaccttgaccgtctgacggaa

SEQ ID NO: 133586 - DNA, 25 bp, Rattus norvegicus
agctcaccttgagcgtctgacggaa

SEQ ID NO: 133587 - DNA, 25 bp, Rattus norvegicus
agctcaccttttctccctttcaagt

SEQ ID NO: 133588 - DNA, 25 bp, Rattus norvegicus
agctcaccttttgtccctttcaagt

SEQ ID NO: 133589 - DNA, 25 bp, Rattus norvegicus
agctcacgagagacttacagccttg

SEQ ID NO: 133590 - DNA, 25 bp, Rattus norvegicus
agctcacgagagtcttacagccttg

SEQ ID NO: 133591 - DNA, 25 bp, Rattus norvegicus
agctcacgggccaggtagaccaaca

SEQ ID NO: 133592 - DNA, 25 bp, Rattus norvegicus
agctcacgggcctggtagaccaaca

SEQ ID NO: 133593 - DNA, 25 bp, Rattus norvegicus
agctcacgtatacccagcagctgga

SEQ ID NO: 133594 - DNA, 25 bp, Rattus norvegicus
agctcacgtatagccagcagctgga

SEQ ID NO: 133595 - DNA, 25 bp, Rattus norvegicus
agctcacgtgccatggcaatctctg

SEQ ID NO: 133596 - DNA, 25 bp, Rattus norvegicus
agctcacgtgccttggcaatctctg

SEQ ID NO: 133597 - DNA, 25 bp, Rattus norvegicus
agctcactacgcagccgttagaggc

SEQ ID NO: 133598 - DNA, 25 bp, Rattus norvegicus
agctcactacgctgccgttagaggc

SEQ ID NO: 133599 - DNA, 25 bp, Rattus norvegicus
agctcactatatatgttaccctcta

SEQ ID NO: 133600 - DNA, 25 bp, Rattus norvegicus
agctcactatatttgttaccctcta

SEQ ID NO: 133601 - DNA, 25 bp, Rattus norvegicus
agctcactcctccaacgggtgaaat

SEQ ID NO: 133602 - DNA, 25 bp, Rattus norvegicus
agctcactcctcgaacgggtgaaat

SEQ ID NO: 133603 - DNA, 25 bp, Rattus norvegicus
agctcactcttcatgtcttctggtt

SEQ ID NO: 133604 - DNA, 25 bp, Rattus norvegicus
agctcactcttcttgtcttctggtt

SEQ ID NO: 133605 - DNA, 25 bp, Rattus norvegicus
agctcactctttatcgttctgattt

SEQ ID NO: 133606 - DNA, 25 bp, Rattus norvegicus
agctcactctttttcgttctgattt

SEQ ID NO: 133607 - DNA, 25 bp, Rattus norvegicus
agctcactgacaactaaccacattt

SEQ ID NO: 133608 - DNA, 25 bp, Rattus norvegicus
agctcactgacatctaaccacattt

SEQ ID NO: 133609 - DNA, 25 bp, Rattus norvegicus
agctcactgagccaggttcccggac

SEQ ID NO: 133610 - DNA, 25 bp, Rattus norvegicus
agctcactgagcgaggttcccggac

SEQ ID NO: 133611 - DNA, 25 bp, Rattus norvegicus
agctcactgcacatcttgaatgttc

SEQ ID NO: 133612 - DNA, 25 bp, Rattus norvegicus
agctcactgcacttcttgaatgttc

SEQ ID NO: 133613 - DNA, 25 bp, Rattus norvegicus
agctcactgcttcctgcaggtgctt

SEQ ID NO: 133614 - DNA, 25 bp, Rattus norvegicus
agctcactgcttgctgcaggtgctt

SEQ ID NO: 133615 - DNA, 25 bp, Rattus norvegicus
agctcactggtaccaaccttagttt

SEQ ID NO: 133616 - DNA, 25 bp, Rattus norvegicus
agctcactggtagcaaccttagttt

SEQ ID NO: 133617 - DNA, 25 bp, Rattus norvegicus
agctcactgtgcatagtcaactctg

SEQ ID NO: 133618 - DNA, 25 bp, Rattus norvegicus
agctcactgtgcttagtcaactctg

SEQ ID NO: 133619 - DNA, 25 bp, Rattus norvegicus
agctcactgttactgttttcatttc

SEQ ID NO: 133620 - DNA, 25 bp, Rattus norvegicus
agctcactgttagtgttttcatttc

SEQ ID NO: 133621 - DNA, 25 bp, Rattus norvegicus
agctcacttatgattcccttatttc

SEQ ID NO: 133622 - DNA, 25 bp, Rattus norvegicus
agctcacttatgtttcccttatttc

SEQ ID NO: 133623 - DNA, 25 bp, Rattus norvegicus
agctcacttccgcagagacgagttt

SEQ ID NO: 133624 - DNA, 25 bp, Rattus norvegicus
agctcacttccggagagacgagttt

SEQ ID NO: 133625 - DNA, 25 bp, Rattus norvegicus
agctcagaacacaccttaggcagat

SEQ ID NO: 133626 - DNA, 25 bp, Rattus norvegicus
agctcagaacactccttaggcagat

SEQ ID NO: 133627 - DNA, 25 bp, Rattus norvegicus
agctcagaacatacattcctggccc

SEQ ID NO: 133628 - DNA, 25 bp, Rattus norvegicus
agctcagaacattcattcctggccc

SEQ ID NO: 133629 - DNA, 25 bp, Rattus norvegicus
agctcagaaggcaaaatgaatatta

SEQ ID NO: 133630 - DNA, 25 bp, Rattus norvegicus
agctcagaaggctaaatgaatatta

SEQ ID NO: 133631 - DNA, 25 bp, Rattus norvegicus
agctcagaagtcaccggcaacgttt

SEQ ID NO: 133632 - DNA, 25 bp, Rattus norvegicus
agctcagaagtctccggcaacgttt

SEQ ID NO: 133633 - DNA, 25 bp, Rattus norvegicus
agctcagacaacactcagcacagaa

SEQ ID NO: 133634 - DNA, 25 bp, Rattus norvegicus
agctcagacaactctcagcacagaa

SEQ ID NO: 133635 - DNA, 25 bp, Rattus norvegicus
agctcagacctgcaaacagtggcca

SEQ ID NO: 133636 - DNA, 25 bp, Rattus norvegicus
agctcagacctggaaacagtggcca

SEQ ID NO: 133637 - DNA, 25 bp, Rattus norvegicus
agctcagaccttcacagttttccta

SEQ ID NO: 133638 - DNA, 25 bp, Rattus norvegicus
agctcagaccttgacagttttccta

SEQ ID NO: 133639 - DNA, 25 bp, Rattus norvegicus
agctcagacgctcctcaagggttca

SEQ ID NO: 133640 - DNA, 25 bp, Rattus norvegicus
agctcagacgctgctcaagggttca

SEQ ID NO: 133641 - DNA, 25 bp, Rattus norvegicus
agctcagactctcgttcgaattctc

SEQ ID NO: 133642 - DNA, 25 bp, Rattus norvegicus
agctcagactctggttcgaattctc

SEQ ID NO: 133643 - DNA, 25 bp, Rattus norvegicus
agctcagactttctagaacgttccc

SEQ ID NO: 133644 - DNA, 25 bp, Rattus norvegicus
agctcagactttgtagaacgttccc

SEQ ID NO: 133645 - DNA, 25 bp, Rattus norvegicus
agctcagagagacaactcgcccatg

SEQ ID NO: 133646 - DNA, 25 bp, Rattus norvegicus
agctcagagagagaactcgcccatg

SEQ ID NO: 133647 - DNA, 25 bp, Rattus norvegicus
agctcagagagcaccgatgtatcat

SEQ ID NO: 133648 - DNA, 25 bp, Rattus norvegicus
agctcagagagctccgatgtatcat

SEQ ID NO: 133649 - DNA, 25 bp, Rattus norvegicus
agctcagagcacagtgaggaccgcc

SEQ ID NO: 133650 - DNA, 25 bp, Rattus norvegicus
agctcagagcactgtgaggaccgcc

SEQ ID NO: 133651 - DNA, 25 bp, Rattus norvegicus
agctcagagccgctcttagttccat

SEQ ID NO: 133652 - DNA, 25 bp, Rattus norvegicus
agctcagagccggtcttagttccat

SEQ ID NO: 133653 - DNA, 25 bp, Rattus norvegicus
agctcagaggatcgccttcctggtt

SEQ ID NO: 133654 - DNA, 25 bp, Rattus norvegicus
agctcagaggatggccttcctggtt

SEQ ID NO: 133655 - DNA, 25 bp, Rattus norvegicus
agctcagaggccactgattctgcct

SEQ ID NO: 133656 - DNA, 25 bp, Rattus norvegicus
agctcagaggcctctgattctgcct

SEQ ID NO: 133657 - DNA, 25 bp, Rattus norvegicus
agctcagaggctaggtgaccggtat

SEQ ID NO: 133658 - DNA, 25 bp, Rattus norvegicus
agctcagaggctatggcacagaatt

SEQ ID NO: 133659 - DNA, 25 bp, Rattus norvegicus
agctcagaggcttggtgaccggtat

SEQ ID NO: 133660 - DNA, 25 bp, Rattus norvegicus
agctcagaggctttggcacagaatt

SEQ ID NO: 133661 - DNA, 25 bp, Rattus norvegicus
agctcagaggtgaactccggccaga

SEQ ID NO: 133662 - DNA, 25 bp, Rattus norvegicus
agctcagaggtgtactccggccaga

SEQ ID NO: 133663 - DNA, 25 bp, Rattus norvegicus
agctcagagtatcgagaccctccct

SEQ ID NO: 133664 - DNA, 25 bp, Rattus norvegicus
agctcagagtatggagaccctccct

SEQ ID NO: 133665 - DNA, 25 bp, Rattus norvegicus
agctcagataccatgctttcaggaa

SEQ ID NO: 133666 - DNA, 25 bp, Rattus norvegicus
agctcagataccttgctttcaggaa

SEQ ID NO: 133667 - DNA, 25 bp, Rattus norvegicus
agctcagatctgatcgaaggcacta

SEQ ID NO: 133668 - DNA, 25 bp, Rattus norvegicus
agctcagatctgttcgaaggcacta

SEQ ID NO: 133669 - DNA, 25 bp, Rattus norvegicus
agctcagatgatcgtgtccggccac

SEQ ID NO: 133670 - DNA, 25 bp, Rattus norvegicus
agctcagatgatggtgtccggccac

SEQ ID NO: 133671 - DNA, 25 bp, Rattus norvegicus
agctcagatgctagtcacctaaata

SEQ ID NO: 133672 - DNA, 25 bp, Rattus norvegicus
agctcagatgcttgtcacctaaata

SEQ ID NO: 133673 - DNA, 25 bp, Rattus norvegicus
agctcagcacacaggactttggcaa

SEQ ID NO: 133674 - DNA, 25 bp, Rattus norvegicus
agctcagcacactggactttggcaa

SEQ ID NO: 133675 - DNA, 25 bp, Rattus norvegicus
agctcagcagcgaggactcagaagt

SEQ ID NO: 133676 - DNA, 25 bp, Rattus norvegicus
agctcagcagcgtggactcagaagt

SEQ ID NO: 133677 - DNA, 25 bp, Rattus norvegicus
agctcagcaggtcttgcaaccaagt

SEQ ID NO: 133678 - DNA, 25 bp, Rattus norvegicus
agctcagcaggtgttgcaaccaagt

SEQ ID NO: 133679 - DNA, 25 bp, Rattus norvegicus
agctcagcatggagcagaaaaaccc

SEQ ID NO: 133680 - DNA, 25 bp, Rattus norvegicus
agctcagcatggtgcagaaaaaccc

SEQ ID NO: 133681 - DNA, 25 bp, Rattus norvegicus
agctcagcccgaagcacttaaccag

SEQ ID NO: 133682 - DNA, 25 bp, Rattus norvegicus
agctcagcccgatgcacttaaccag

SEQ ID NO: 133683 - DNA, 25 bp, Rattus norvegicus
agctcagccctgaatagtcaactta

SEQ ID NO: 133684 - DNA, 25 bp, Rattus norvegicus
agctcagccctgatgaagaccaagc

SEQ ID NO: 133685 - DNA, 25 bp, Rattus norvegicus
agctcagccctgtatagtcaactta

SEQ ID NO: 133686 - DNA, 25 bp, Rattus norvegicus
agctcagccctgttgaagaccaagc

SEQ ID NO: 133687 - DNA, 25 bp, Rattus norvegicus
agctcagcctgaagcagtggtgcac

SEQ ID NO: 133688 - DNA, 25 bp, Rattus norvegicus
agctcagcctgatgcagtggtgcac

SEQ ID NO: 133689 - DNA, 25 bp, Rattus norvegicus
agctcagccttaccaaatctgcacg

SEQ ID NO: 133690 - DNA, 25 bp, Rattus norvegicus
agctcagccttagcaaatctgcacg

SEQ ID NO: 133691 - DNA, 25 bp, Rattus norvegicus
agctcagcgagtaaagtgcttacca

SEQ ID NO: 133692 - DNA, 25 bp, Rattus norvegicus
agctcagcgagttaagtgcttacca

SEQ ID NO: 133693 - DNA, 25 bp, Rattus norvegicus
agctcagcgtgtctattgattgtgc

SEQ ID NO: 133694 - DNA, 25 bp, Rattus norvegicus
agctcagcgtgtgtattgattgtgc

SEQ ID NO: 133695 - DNA, 25 bp, Rattus norvegicus
agctcagctaccctgtcatgggtat

SEQ ID NO: 133696 - DNA, 25 bp, Rattus norvegicus
agctcagctaccgtgtcatgggtat

SEQ ID NO: 133697 - DNA, 25 bp, Rattus norvegicus
agctcagctcagcaaaacgccagga

SEQ ID NO: 133698 - DNA, 25 bp, Rattus norvegicus
agctcagctcaggaaaacgccagga

SEQ ID NO: 133699 - DNA, 25 bp, Rattus norvegicus
agctcagctctgaatttcttggctc

SEQ ID NO: 133700 - DNA, 25 bp, Rattus norvegicus
agctcagctctgtatttcttggctc

SEQ ID NO: 133701 - DNA, 25 bp, Rattus norvegicus
agctcagctcttacccaaatatttt

SEQ ID NO: 133702 - DNA, 25 bp, Rattus norvegicus
agctcagctctttcccaaatatttt

SEQ ID NO: 133703 - DNA, 25 bp, Rattus norvegicus
agctcagctgcacgaaaacccctat

SEQ ID NO: 133704 - DNA, 25 bp, Rattus norvegicus
agctcagctgcaggaaaacccctat

SEQ ID NO: 133705 - DNA, 25 bp, Rattus norvegicus
agctcagctttcactgggaacacaa

SEQ ID NO: 133706 - DNA, 25 bp, Rattus norvegicus
agctcagctttcctcttgtttatgt

SEQ ID NO: 133707 - DNA, 25 bp, Rattus norvegicus
agctcagctttcgtcttgtttatgt

SEQ ID NO: 133708 - DNA, 25 bp, Rattus norvegicus
agctcagctttctctgggaacacaa

SEQ ID NO: 133709 - DNA, 25 bp, Rattus norvegicus
agctcaggaatgattgccgggcgtc

SEQ ID NO: 133710 - DNA, 25 bp, Rattus norvegicus
agctcaggaatgtttgccgggcgtc

SEQ ID NO: 133711 - DNA, 25 bp, Rattus norvegicus
agctcaggacatctaggattgtgat

SEQ ID NO: 133712 - DNA, 25 bp, Rattus norvegicus
agctcaggacatgtaggattgtgat

SEQ ID NO: 133713 - DNA, 25 bp, Rattus norvegicus
agctcaggagctacagtggcaccag

SEQ ID NO: 133714 - DNA, 25 bp, Rattus norvegicus
agctcaggagcttcagtggcaccag

SEQ ID NO: 133715 - DNA, 25 bp, Rattus norvegicus
agctcaggcagtaaagtgctttcca

SEQ ID NO: 133716 - DNA, 25 bp, Rattus norvegicus
agctcaggcagttaagtgctttcca

SEQ ID NO: 133717 - DNA, 25 bp, Rattus norvegicus
agctcaggctagacatgtaactcat

SEQ ID NO: 133718 - DNA, 25 bp, Rattus norvegicus
agctcaggctagtcatgtaactcat

SEQ ID NO: 133719 - DNA, 25 bp, Rattus norvegicus
agctcaggctctaggtgactgtggc

SEQ ID NO: 133720 - DNA, 25 bp, Rattus norvegicus
agctcaggctctcccacatgaataa

SEQ ID NO: 133721 - DNA, 25 bp, Rattus norvegicus
agctcaggctctgccacatgaataa

SEQ ID NO: 133722 - DNA, 25 bp, Rattus norvegicus
agctcaggctcttggtgactgtggc

SEQ ID NO: 133723 - DNA, 25 bp, Rattus norvegicus
agctcaggctgcacggatacagact

SEQ ID NO: 133724 - DNA, 25 bp, Rattus norvegicus
agctcaggctgctcggatacagact

SEQ ID NO: 133725 - DNA, 25 bp, Rattus norvegicus
agctcagggcttagtgctcaccgga

SEQ ID NO: 133726 - DNA, 25 bp, Rattus norvegicus
agctcagggctttgtgctcaccgga

SEQ ID NO: 133727 - DNA, 25 bp, Rattus norvegicus
agctcaggtcaaaccaaggcggctg

SEQ ID NO: 133728 - DNA, 25 bp, Rattus norvegicus
agctcaggtcaatccaaggcggctg

SEQ ID NO: 133729 - DNA, 25 bp, Rattus norvegicus
agctcagtagcccttacatgtgatt

SEQ ID NO: 133730 - DNA, 25 bp, Rattus norvegicus
agctcagtagccgttacatgtgatt

SEQ ID NO: 133731 - DNA, 25 bp, Rattus norvegicus
agctcagtaggtcgagtgcctgtcc

SEQ ID NO: 133732 - DNA, 25 bp, Rattus norvegicus
agctcagtaggtggagtgcctgtcc

SEQ ID NO: 133733 - DNA, 25 bp, Rattus norvegicus
agctcagtagtcatgtcctttgtcg

SEQ ID NO: 133734 - DNA, 25 bp, Rattus norvegicus
agctcagtagtcttgtcctttgtcg

SEQ ID NO: 133735 - DNA, 25 bp, Rattus norvegicus
agctcagtcaacaggctgtaccttc

SEQ ID NO: 133736 - DNA, 25 bp, Rattus norvegicus
agctcagtcaactggctgtaccttc

SEQ ID NO: 133737 - DNA, 25 bp, Rattus norvegicus
agctcagtcataccacctcctagag

SEQ ID NO: 133738 - DNA, 25 bp, Rattus norvegicus
agctcagtcatagcacctcctagag

SEQ ID NO: 133739 - DNA, 25 bp, Rattus norvegicus
agctcagtccacagtttgcgctgct

SEQ ID NO: 133740 - DNA, 25 bp, Rattus norvegicus
agctcagtccactgtttgcgctgct

SEQ ID NO: 133741 - DNA, 25 bp, Rattus norvegicus
agctcagtccccaagaggcgaagca

SEQ ID NO: 133742 - DNA, 25 bp, Rattus norvegicus
agctcagtcccctagaggcgaagca

SEQ ID NO: 133743 - DNA, 25 bp, Rattus norvegicus
agctcagtccctccaggattagcct

SEQ ID NO: 133744 - DNA, 25 bp, Rattus norvegicus
agctcagtccctgcaggattagcct

SEQ ID NO: 133745 - DNA, 25 bp, Rattus norvegicus
agctcagtgacacaattcttacaga

SEQ ID NO: 133746 - DNA, 25 bp, Rattus norvegicus
agctcagtgacagaattcttacaga

SEQ ID NO: 133747 - DNA, 25 bp, Rattus norvegicus
agctcagtgaccagaggcatgccac

SEQ ID NO: 133748 - DNA, 25 bp, Rattus norvegicus
agctcagtgacctgaggcatgccac

SEQ ID NO: 133749 - DNA, 25 bp, Rattus norvegicus
agctcagtgcagaagctgtgccaca

SEQ ID NO: 133750 - DNA, 25 bp, Rattus norvegicus
agctcagtgcagtagctgtgccaca

SEQ ID NO: 133751 - DNA, 25 bp, Rattus norvegicus
agctcagtgcctccagcggacacag

SEQ ID NO: 133752 - DNA, 25 bp, Rattus norvegicus
agctcagtgcctgcagcggacacag

SEQ ID NO: 133753 - DNA, 25 bp, Rattus norvegicus
agctcagtggctcatgcatatcatc

SEQ ID NO: 133754 - DNA, 25 bp, Rattus norvegicus
agctcagtggctgatgcatatcatc

SEQ ID NO: 133755 - DNA, 25 bp, Rattus norvegicus
agctcagtgggacacttggccttga

SEQ ID NO: 133756 - DNA, 25 bp, Rattus norvegicus
agctcagtgggagacttggccttga

SEQ ID NO: 133757 - DNA, 25 bp, Rattus norvegicus
agctcagtgtgtacgtaagccgcct

SEQ ID NO: 133758 - DNA, 25 bp, Rattus norvegicus
agctcagtgtgttcgtaagccgcct

SEQ ID NO: 133759 - DNA, 25 bp, Rattus norvegicus
agctcagttcttctagctctaggtt

SEQ ID NO: 133760 - DNA, 25 bp, Rattus norvegicus
agctcagttcttgtagctctaggtt

SEQ ID NO: 133761 - DNA, 25 bp, Rattus norvegicus
agctcagttgttagagtgcatgcat

SEQ ID NO: 133762 - DNA, 25 bp, Rattus norvegicus
agctcagttgtttgagtgcatgcat

SEQ ID NO: 133763 - DNA, 25 bp, Rattus norvegicus
agctcagtttccctttcagatgatt

SEQ ID NO: 133764 - DNA, 25 bp, Rattus norvegicus
agctcagtttccgtttcagatgatt

SEQ ID NO: 133765 - DNA, 25 bp, Rattus norvegicus
agctcagtttgcattagaggttctt

SEQ ID NO: 133766 - DNA, 25 bp, Rattus norvegicus
agctcagtttgctttagaggttctt

SEQ ID NO: 133767 - DNA, 25 bp, Rattus norvegicus
agctcagttttgcagttctggttgg

SEQ ID NO: 133768 - DNA, 25 bp, Rattus norvegicus
agctcagttttggagttctggttgg

SEQ ID NO: 133769 - DNA, 25 bp, Rattus norvegicus
agctcataacttccctttccaaggt

SEQ ID NO: 133770 - DNA, 25 bp, Rattus norvegicus
agctcataacttgcctttccaaggt

SEQ ID NO: 133771 - DNA, 25 bp, Rattus norvegicus
agctcatactctaagccgctttgga

SEQ ID NO: 133772 - DNA, 25 bp, Rattus norvegicus
agctcatactcttagccgctttgga

SEQ ID NO: 133773 - DNA, 25 bp, Rattus norvegicus
agctcatacttgatcttgtttcctt

SEQ ID NO: 133774 - DNA, 25 bp, Rattus norvegicus
agctcatacttgttcttgtttcctt

SEQ ID NO: 133775 - DNA, 25 bp, Rattus norvegicus
agctcataggagcacttgacataat

SEQ ID NO: 133776 - DNA, 25 bp, Rattus norvegicus
agctcataggaggacttgacataat

SEQ ID NO: 133777 - DNA, 25 bp, Rattus norvegicus
agctcatatctgaggcagccgcaca

SEQ ID NO: 133778 - DNA, 25 bp, Rattus norvegicus
agctcatatctgtggcagccgcaca

SEQ ID NO: 133779 - DNA, 25 bp, Rattus norvegicus
agctcatattgactcgttggcgcat

SEQ ID NO: 133780 - DNA, 25 bp, Rattus norvegicus
agctcatattgagtcgttggcgcat

SEQ ID NO: 133781 - DNA, 25 bp, Rattus norvegicus
agctcatcaatcatactggcatgga

SEQ ID NO: 133782 - DNA, 25 bp, Rattus norvegicus
agctcatcaatcttactggcatgga

SEQ ID NO: 133783 - DNA, 25 bp, Rattus norvegicus
agctcatcagagaacacatccccaa

SEQ ID NO: 133784 - DNA, 25 bp, Rattus norvegicus
agctcatcagagtacacatccccaa

SEQ ID NO: 133785 - DNA, 25 bp, Rattus norvegicus
agctcatcagatagaaaccctccac

SEQ ID NO: 133786 - DNA, 25 bp, Rattus norvegicus
agctcatcagattgaaaccctccac

SEQ ID NO: 133787 - DNA, 25 bp, Rattus norvegicus
agctcatcagctctgtcagtgttta

SEQ ID NO: 133788 - DNA, 25 bp, Rattus norvegicus
agctcatcagctgtgtcagtgttta

SEQ ID NO: 133789 - DNA, 25 bp, Rattus norvegicus
agctcatccgatatcacttttcacg

SEQ ID NO: 133790 - DNA, 25 bp, Rattus norvegicus
agctcatccgatttcacttttcacg

SEQ ID NO: 133791 - DNA, 25 bp, Rattus norvegicus
agctcatcctggcaaaggctcagga

SEQ ID NO: 133792 - DNA, 25 bp, Rattus norvegicus
agctcatcctgggaaaggctcagga

SEQ ID NO: 133793 - DNA, 25 bp, Rattus norvegicus
agctcatcctttcgtagccatagca

SEQ ID NO: 133794 - DNA, 25 bp, Rattus norvegicus
agctcatcctttggtagccatagca

SEQ ID NO: 133795 - DNA, 25 bp, Rattus norvegicus
agctcatctactctgcaggtgtcta

SEQ ID NO: 133796 - DNA, 25 bp, Rattus norvegicus
agctcatctactgtgcaggtgtcta

SEQ ID NO: 133797 - DNA, 25 bp, Rattus norvegicus
agctcatctcagactagcatgtcag

SEQ ID NO: 133798 - DNA, 25 bp, Rattus norvegicus
agctcatctcagtctagcatgtcag

SEQ ID NO: 133799 - DNA, 25 bp, Rattus norvegicus
agctcatctctgacgaggcagcaac

SEQ ID NO: 133800 - DNA, 25 bp, Rattus norvegicus
agctcatctctgtcgaggcagcaac

SEQ ID NO: 133801 - DNA, 25 bp, Rattus norvegicus
agctcatctgagacaccttttagaa

SEQ ID NO: 133802 - DNA, 25 bp, Rattus norvegicus
agctcatctgagtcaccttttagaa

SEQ ID NO: 133803 - DNA, 25 bp, Rattus norvegicus
agctcatctgttatatcttttggta

SEQ ID NO: 133804 - DNA, 25 bp, Rattus norvegicus
agctcatctgttttatcttttggta

SEQ ID NO: 133805 - DNA, 25 bp, Rattus norvegicus
agctcatcttatcttcccattggaa

SEQ ID NO: 133806 - DNA, 25 bp, Rattus norvegicus
agctcatcttatgttcccattggaa

SEQ ID NO: 133807 - DNA, 25 bp, Rattus norvegicus
agctcatctttcactggaactgcaa

SEQ ID NO: 133808 - DNA, 25 bp, Rattus norvegicus
agctcatctttctctggaactgcaa

SEQ ID NO: 133809 - DNA, 25 bp, Rattus norvegicus
agctcatgaagacacgtggcacact

SEQ ID NO: 133810 - DNA, 25 bp, Rattus norvegicus
agctcatgaagacccatctgccagg

SEQ ID NO: 133811 - DNA, 25 bp, Rattus norvegicus
agctcatgaagagacgtggcacact

SEQ ID NO: 133812 - DNA, 25 bp, Rattus norvegicus
agctcatgaagagccatctgccagg

SEQ ID NO: 133813 - DNA, 25 bp, Rattus norvegicus
agctcatgagagcatactagtttag

SEQ ID NO: 133814 - DNA, 25 bp, Rattus norvegicus
agctcatgagaggatactagtttag

SEQ ID NO: 133815 - DNA, 25 bp, Rattus norvegicus
agctcatgagtaacgaactccagtt

SEQ ID NO: 133816 - DNA, 25 bp, Rattus norvegicus
agctcatgagtatcgaactccagtt

SEQ ID NO: 133817 - DNA, 25 bp, Rattus norvegicus
agctcatgcaaactggtcacgcggc

SEQ ID NO: 133818 - DNA, 25 bp, Rattus norvegicus
agctcatgcaaagtggtcacgcggc

SEQ ID NO: 133819 - DNA, 25 bp, Rattus norvegicus
agctcatgcagtctggcccaggtgt

SEQ ID NO: 133820 - DNA, 25 bp, Rattus norvegicus
agctcatgcagtgtggcccaggtgt

SEQ ID NO: 133821 - DNA, 25 bp, Rattus norvegicus
agctcatgccatcctaggagggctg

SEQ ID NO: 133822 - DNA, 25 bp, Rattus norvegicus
agctcatgccatgctaggagggctg

SEQ ID NO: 133823 - DNA, 25 bp, Rattus norvegicus
agctcatgccttcttcttcagaatt

SEQ ID NO: 133824 - DNA, 25 bp, Rattus norvegicus
agctcatgccttgttcttcagaatt

SEQ ID NO: 133825 - DNA, 25 bp, Rattus norvegicus
agctcatgctgaaggagtgaaccat

SEQ ID NO: 133826 - DNA, 25 bp, Rattus norvegicus
agctcatgctgacgtcctgggttca

SEQ ID NO: 133827 - DNA, 25 bp, Rattus norvegicus
agctcatgctgaggtcctgggttca

SEQ ID NO: 133828 - DNA, 25 bp, Rattus norvegicus
agctcatgctgatggagtgaaccat

SEQ ID NO: 133829 - DNA, 25 bp, Rattus norvegicus
agctcatgcttgaacttccaggact

SEQ ID NO: 133830 - DNA, 25 bp, Rattus norvegicus
agctcatgcttgtacttccaggact

SEQ ID NO: 133831 - DNA, 25 bp, Rattus norvegicus
agctcatgtcatatctctttatatc

SEQ ID NO: 133832 - DNA, 25 bp, Rattus norvegicus
agctcatgtcatttctctttatatc

SEQ ID NO: 133833 - DNA, 25 bp, Rattus norvegicus
agctcattaactacattctttccag

SEQ ID NO: 133834 - DNA, 25 bp, Rattus norvegicus
agctcattaacttcattctttccag

SEQ ID NO: 133835 - DNA, 25 bp, Rattus norvegicus
agctcattatgactgctctggccac

SEQ ID NO: 133836 - DNA, 25 bp, Rattus norvegicus
agctcattatgagtgctctggccac

SEQ ID NO: 133837 - DNA, 25 bp, Rattus norvegicus
agctcattcaaacctctggctaaga

SEQ ID NO: 133838 - DNA, 25 bp, Rattus norvegicus
agctcattcaaagctctggctaaga

SEQ ID NO: 133839 - DNA, 25 bp, Rattus norvegicus
agctcattcaatacattccatggtg

SEQ ID NO: 133840 - DNA, 25 bp, Rattus norvegicus
agctcattcaattcattccatggtg

SEQ ID NO: 133841 - DNA, 25 bp, Rattus norvegicus
agctcattcactcggtcttgtccgg

SEQ ID NO: 133842 - DNA, 25 bp, Rattus norvegicus
agctcattcactgggtcttgtccgg

SEQ ID NO: 133843 - DNA, 25 bp, Rattus norvegicus
agctcattcagcatgggtggttaat

SEQ ID NO: 133844 - DNA, 25 bp, Rattus norvegicus
agctcattcagcttgggtggttaat

SEQ ID NO: 133845 - DNA, 25 bp, Rattus norvegicus
agctcattctgcctagaggactctc

SEQ ID NO: 133846 - DNA, 25 bp, Rattus norvegicus
agctcattctgcgtagaggactctc

SEQ ID NO: 133847 - DNA, 25 bp, Rattus norvegicus
agctcattctgtacggtcagtacta

SEQ ID NO: 133848 - DNA, 25 bp, Rattus norvegicus
agctcattctgttcggtcagtacta

SEQ ID NO: 133849 - DNA, 25 bp, Rattus norvegicus
agctcattgccaatttggatccaga

SEQ ID NO: 133850 - DNA, 25 bp, Rattus norvegicus
agctcattgccattttggatccaga

SEQ ID NO: 133851 - DNA, 25 bp, Rattus norvegicus
agctcatttgctctgtattggtttg

SEQ ID NO: 133852 - DNA, 25 bp, Rattus norvegicus
agctcatttgctgtgtattggtttg

SEQ ID NO: 133853 - DNA, 25 bp, Rattus norvegicus
agctcattttctacccaagccattg

SEQ ID NO: 133854 - DNA, 25 bp, Rattus norvegicus
agctcattttcttcccaagccattg

SEQ ID NO: 133855 - DNA, 25 bp, Rattus norvegicus
agctccaaagctaagcccaggcaga

SEQ ID NO: 133856 - DNA, 25 bp, Rattus norvegicus
agctccaaagcttagcccaggcaga

SEQ ID NO: 133857 - DNA, 25 bp, Rattus norvegicus
agctccaaatggaacatcagacctg

SEQ ID NO: 133858 - DNA, 25 bp, Rattus norvegicus
agctccaaatggtacatcagacctg

SEQ ID NO: 133859 - DNA, 25 bp, Rattus norvegicus
agctccaaccttagtgactgtgggt

SEQ ID NO: 133860 - DNA, 25 bp, Rattus norvegicus
agctccaacctttgtgactgtgggt

SEQ ID NO: 133861 - DNA, 25 bp, Rattus norvegicus
agctccaacgtcatcctgaagaagt

SEQ ID NO: 133862 - DNA, 25 bp, Rattus norvegicus
agctccaacgtcttcctgaagaagt

SEQ ID NO: 133863 - DNA, 25 bp, Rattus norvegicus
agctccaagatgaaagctcgcctct

SEQ ID NO: 133864 - DNA, 25 bp, Rattus norvegicus
agctccaagatgtaagctcgcctct

SEQ ID NO: 133865 - DNA, 25 bp, Rattus norvegicus
agctccaagccgagctacttaagaa

SEQ ID NO: 133866 - DNA, 25 bp, Rattus norvegicus
agctccaagccgtgctacttaagaa

SEQ ID NO: 133867 - DNA, 25 bp, Rattus norvegicus
agctccaatcctcaccagtcagaga

SEQ ID NO: 133868 - DNA, 25 bp, Rattus norvegicus
agctccaatcctgaccagtcagaga

SEQ ID NO: 133869 - DNA, 25 bp, Rattus norvegicus
agctccacaatgataacttctccct

SEQ ID NO: 133870 - DNA, 25 bp, Rattus norvegicus
agctccacaatgttaacttctccct

SEQ ID NO: 133871 - DNA, 25 bp, Rattus norvegicus
agctccacacaaaccatgggacatt

SEQ ID NO: 133872 - DNA, 25 bp, Rattus norvegicus
agctccacacaatccatgggacatt

SEQ ID NO: 133873 - DNA, 25 bp, Rattus norvegicus
agctccacagacatgggacccagga

SEQ ID NO: 133874 - DNA, 25 bp, Rattus norvegicus
agctccacagacttgggacccagga

SEQ ID NO: 133875 - DNA, 25 bp, Rattus norvegicus
agctccacctggaaatgttctgcga

SEQ ID NO: 133876 - DNA, 25 bp, Rattus norvegicus
agctccacctggtaatgttctgcga

SEQ ID NO: 133877 - DNA, 25 bp, Rattus norvegicus
agctccacgagccaaaatcttcagg

SEQ ID NO: 133878 - DNA, 25 bp, Rattus norvegicus
agctccacgagcgaaaatcttcagg

SEQ ID NO: 133879 - DNA, 25 bp, Rattus norvegicus
agctccacgttcatagtttatacag

SEQ ID NO: 133880 - DNA, 25 bp, Rattus norvegicus
agctccacgttcttagtttatacag

SEQ ID NO: 133881 - DNA, 25 bp, Rattus norvegicus
agctccactcttaactgtcctgaat

SEQ ID NO: 133882 - DNA, 25 bp, Rattus norvegicus
agctccactctttactgtcctgaat

SEQ ID NO: 133883 - DNA, 25 bp, Rattus norvegicus
agctccacttgtcctgtgcatcagc

SEQ ID NO: 133884 - DNA, 25 bp, Rattus norvegicus
agctccacttgtgctgtgcatcagc

SEQ ID NO: 133885 - DNA, 25 bp, Rattus norvegicus
agctccactttgactcagcattaga

SEQ ID NO: 133886 - DNA, 25 bp, Rattus norvegicus
agctccactttgtctcagcattaga

SEQ ID NO: 133887 - DNA, 25 bp, Rattus norvegicus
agctccagagacatggcgggcgtta

SEQ ID NO: 133888 - DNA, 25 bp, Rattus norvegicus
agctccagagacttggcgggcgtta

SEQ ID NO: 133889 - DNA, 25 bp, Rattus norvegicus
agctccagagggacttacaacctct

SEQ ID NO: 133890 - DNA, 25 bp, Rattus norvegicus
agctccagagggtcttacaacctct

SEQ ID NO: 133891 - DNA, 25 bp, Rattus norvegicus
agctccagatctaaacctcactatt

SEQ ID NO: 133892 - DNA, 25 bp, Rattus norvegicus
agctccagatcttaacctcactatt

SEQ ID NO: 133893 - DNA, 25 bp, Rattus norvegicus
agctccagatgtcctaccagatcag

SEQ ID NO: 133894 - DNA, 25 bp, Rattus norvegicus
agctccagatgtgctaccagatcag

SEQ ID NO: 133895 - DNA, 25 bp, Rattus norvegicus
agctccagcaccagtgagcgggaaa

SEQ ID NO: 133896 - DNA, 25 bp, Rattus norvegicus
agctccagcacctgtgagcgggaaa

SEQ ID NO: 133897 - DNA, 25 bp, Rattus norvegicus
agctccagcagcacatgtcgggaat

SEQ ID NO: 133898 - DNA, 25 bp, Rattus norvegicus
agctccagcagcaggtcaggcagat

SEQ ID NO: 133899 - DNA, 25 bp, Rattus norvegicus
agctccagcagctcatgtcgggaat

SEQ ID NO: 133900 - DNA, 25 bp, Rattus norvegicus
agctccagcagctggtcaggcagat

SEQ ID NO: 133901 - DNA, 25 bp, Rattus norvegicus
agctccagcatcctgaactttgtag

SEQ ID NO: 133902 - DNA, 25 bp, Rattus norvegicus
agctccagcatcgtgaactttgtag

SEQ ID NO: 133903 - DNA, 25 bp, Rattus norvegicus
agctccaggaacacttaccgtaaag

SEQ ID NO: 133904 - DNA, 25 bp, Rattus norvegicus
agctccaggaactcttaccgtaaag

SEQ ID NO: 133905 - DNA, 25 bp, Rattus norvegicus
agctccaggactcatgtttctcggg

SEQ ID NO: 133906 - DNA, 25 bp, Rattus norvegicus
agctccaggactgatgtttctcggg

SEQ ID NO: 133907 - DNA, 25 bp, Rattus norvegicus
agctccaggagtcacagtatcttcc

SEQ ID NO: 133908 - DNA, 25 bp, Rattus norvegicus
agctccaggagtgacagtatcttcc

SEQ ID NO: 133909 - DNA, 25 bp, Rattus norvegicus
agctccaggatgacattcttgttga

SEQ ID NO: 133910 - DNA, 25 bp, Rattus norvegicus
agctccaggatgtcattcttgttga

SEQ ID NO: 133911 - DNA, 25 bp, Rattus norvegicus
agctccaggccaaattcatctttaa

SEQ ID NO: 133912 - DNA, 25 bp, Rattus norvegicus
agctccaggccatattcatctttaa

SEQ ID NO: 133913 - DNA, 25 bp, Rattus norvegicus
agctccaggcctaggctacaatgct

SEQ ID NO: 133914 - DNA, 25 bp, Rattus norvegicus
agctccaggccttggctacaatgct

SEQ ID NO: 133915 - DNA, 25 bp, Rattus norvegicus
agctccaggctcctaccattgagat

SEQ ID NO: 133916 - DNA, 25 bp, Rattus norvegicus
agctccaggctcgtaccattgagat

SEQ ID NO: 133917 - DNA, 25 bp, Rattus norvegicus
agctccagggacaccaaaggctaat

SEQ ID NO: 133918 - DNA, 25 bp, Rattus norvegicus
agctccagggactccaaaggctaat

SEQ ID NO: 133919 - DNA, 25 bp, Rattus norvegicus
agctccagggagataactgctcttc

SEQ ID NO: 133920 - DNA, 25 bp, Rattus norvegicus
agctccagggagattctactccatc

SEQ ID NO: 133921 - DNA, 25 bp, Rattus norvegicus
agctccagggagttaactgctcttc

SEQ ID NO: 133922 - DNA, 25 bp, Rattus norvegicus
agctccagggagtttctactccatc

SEQ ID NO: 133923 - DNA, 25 bp, Rattus norvegicus
agctccagggccaccgaagagacaa

SEQ ID NO: 133924 - DNA, 25 bp, Rattus norvegicus
agctccagggcctccgaagagacaa

SEQ ID NO: 133925 - DNA, 25 bp, Rattus norvegicus
agctccagggcgcaagttcaggcta

SEQ ID NO: 133926 - DNA, 25 bp, Rattus norvegicus
agctccagggcggaagttcaggcta

SEQ ID NO: 133927 - DNA, 25 bp, Rattus norvegicus
agctccagggtactgcccatgtatg

SEQ ID NO: 133928 - DNA, 25 bp, Rattus norvegicus
agctccagggtagtgcccatgtatg

SEQ ID NO: 133929 - DNA, 25 bp, Rattus norvegicus
agctccaggtgaaactgtgtgcctt

SEQ ID NO: 133930 - DNA, 25 bp, Rattus norvegicus
agctccaggtgatactgtgtgcctt

SEQ ID NO: 133931 - DNA, 25 bp, Rattus norvegicus
agctccagtagaaccagcagcctct

SEQ ID NO: 133932 - DNA, 25 bp, Rattus norvegicus
agctccagtagatccagcagcctct

SEQ ID NO: 133933 - DNA, 25 bp, Rattus norvegicus
agctccagttcccacaaagcactag

SEQ ID NO: 133934 - DNA, 25 bp, Rattus norvegicus
agctccagttccgacaaagcactag

SEQ ID NO: 133935 - DNA, 25 bp, Rattus norvegicus
agctccatcagcactgaggatctgg

SEQ ID NO: 133936 - DNA, 25 bp, Rattus norvegicus
agctccatcagctctgaggatctgg

SEQ ID NO: 133937 - DNA, 25 bp, Rattus norvegicus
agctccatccttactttactaggga

SEQ ID NO: 133938 - DNA, 25 bp, Rattus norvegicus
agctccatcctttctttactaggga

SEQ ID NO: 133939 - DNA, 25 bp, Rattus norvegicus
agctccatcggcacaggactgacag

SEQ ID NO: 133940 - DNA, 25 bp, Rattus norvegicus
agctccatcggctcaggactgacag

SEQ ID NO: 133941 - DNA, 25 bp, Rattus norvegicus
agctccatcgtcaccggcaggcagg

SEQ ID NO: 133942 - DNA, 25 bp, Rattus norvegicus
agctccatcgtctccggcaggcagg

SEQ ID NO: 133943 - DNA, 25 bp, Rattus norvegicus
agctccatctttatatccagaataa

SEQ ID NO: 133944 - DNA, 25 bp, Rattus norvegicus
agctccatctttttatccagaataa

SEQ ID NO: 133945 - DNA, 25 bp, Rattus norvegicus
agctccatgatgactccccagagga

SEQ ID NO: 133946 - DNA, 25 bp, Rattus norvegicus
agctccatgatgtctccccagagga

SEQ ID NO: 133947 - DNA, 25 bp, Rattus norvegicus
agctccatgtttaacttaagttcct

SEQ ID NO: 133948 - DNA, 25 bp, Rattus norvegicus
agctccatgttttacttaagttcct

SEQ ID NO: 133949 - DNA, 25 bp, Rattus norvegicus
agctccattccaccaaggcaaggca

SEQ ID NO: 133950 - DNA, 25 bp, Rattus norvegicus
agctccattccagcaaggcaaggca

SEQ ID NO: 133951 - DNA, 25 bp, Rattus norvegicus
agctccattgatcaattttgccgaa

SEQ ID NO: 133952 - DNA, 25 bp, Rattus norvegicus
agctccattgatgaattttgccgaa

SEQ ID NO: 133953 - DNA, 25 bp, Rattus norvegicus
agctcccaacttccacatgttagga

SEQ ID NO: 133954 - DNA, 25 bp, Rattus norvegicus
agctcccaacttgcacatgttagga

SEQ ID NO: 133955 - DNA, 25 bp, Rattus norvegicus
agctcccaagttaaagtgacatcat

SEQ ID NO: 133956 - DNA, 25 bp, Rattus norvegicus
agctcccaagtttaagtgacatcat

SEQ ID NO: 133957 - DNA, 25 bp, Rattus norvegicus
agctcccaatccaaaagcactcaga

SEQ ID NO: 133958 - DNA, 25 bp, Rattus norvegicus
agctcccaatcctaaagcactcaga

SEQ ID NO: 133959 - DNA, 25 bp, Rattus norvegicus
agctcccacaggatggctcacaagc

SEQ ID NO: 133960 - DNA, 25 bp, Rattus norvegicus
agctcccacaggttggctcacaagc

SEQ ID NO: 133961 - DNA, 25 bp, Rattus norvegicus
agctcccaccatcatggaagctatt

SEQ ID NO: 133962 - DNA, 25 bp, Rattus norvegicus
agctcccaccatgatggaagctatt

SEQ ID NO: 133963 - DNA, 25 bp, Rattus norvegicus
agctcccaccctaactaagaagcat

SEQ ID NO: 133964 - DNA, 25 bp, Rattus norvegicus
agctcccacccttactaagaagcat

SEQ ID NO: 133965 - DNA, 25 bp, Rattus norvegicus
agctcccactgactcgatggttttt

SEQ ID NO: 133966 - DNA, 25 bp, Rattus norvegicus
agctcccactgagtcgatggttttt

SEQ ID NO: 133967 - DNA, 25 bp, Rattus norvegicus
agctcccagagtcagttcgttgtgt

SEQ ID NO: 133968 - DNA, 25 bp, Rattus norvegicus
agctcccagagtgagttcgttgtgt

SEQ ID NO: 133969 - DNA, 25 bp, Rattus norvegicus
agctcccaggctacagaaaatcatc

SEQ ID NO: 133970 - DNA, 25 bp, Rattus norvegicus
agctcccaggcttcagaaaatcatc

SEQ ID NO: 133971 - DNA, 25 bp, Rattus norvegicus
agctcccagggaacgacaaacttat

SEQ ID NO: 133972 - DNA, 25 bp, Rattus norvegicus
agctcccagggatcgacaaacttat

SEQ ID NO: 133973 - DNA, 25 bp, Rattus norvegicus
agctcccagggcaaccataacaaaa

SEQ ID NO: 133974 - DNA, 25 bp, Rattus norvegicus
agctcccagggctaccataacaaaa

SEQ ID NO: 133975 - DNA, 25 bp, Rattus norvegicus
agctcccagggtccacagctggaaa

SEQ ID NO: 133976 - DNA, 25 bp, Rattus norvegicus
agctcccagggtgcacagctggaaa

SEQ ID NO: 133977 - DNA, 25 bp, Rattus norvegicus
agctcccagtacaacacttgatctt

SEQ ID NO: 133978 - DNA, 25 bp, Rattus norvegicus
agctcccagtactacacttgatctt

SEQ ID NO: 133979 - DNA, 25 bp, Rattus norvegicus
agctcccagtctcagacagtggata

SEQ ID NO: 133980 - DNA, 25 bp, Rattus norvegicus
agctcccagtctgagacagtggata

SEQ ID NO: 133981 - DNA, 25 bp, Rattus norvegicus
agctcccagtgacacagcagcataa

SEQ ID NO: 133982 - DNA, 25 bp, Rattus norvegicus
agctcccagtgagacagcagcataa

SEQ ID NO: 133983 - DNA, 25 bp, Rattus norvegicus
agctcccagttcagttcacgtgatt

SEQ ID NO: 133984 - DNA, 25 bp, Rattus norvegicus
agctcccagttctgttcacgtgatt

SEQ ID NO: 133985 - DNA, 25 bp, Rattus norvegicus
agctcccagtttcgcaggctcacaa

SEQ ID NO: 133986 - DNA, 25 bp, Rattus norvegicus
agctcccagtttggcaggctcacaa

SEQ ID NO: 133987 - DNA, 25 bp, Rattus norvegicus
agctccccaaaaatctgtatccaac

SEQ ID NO: 133988 - DNA, 25 bp, Rattus norvegicus
agctccccaaaattctgtatccaac

SEQ ID NO: 133989 - DNA, 25 bp, Rattus norvegicus
agctccccaaatccatttctgtatt

SEQ ID NO: 133990 - DNA, 25 bp, Rattus norvegicus
agctccccaaatgcatttctgtatt

SEQ ID NO: 133991 - DNA, 25 bp, Rattus norvegicus
agctccccaactcccaaagagaagg

SEQ ID NO: 133992 - DNA, 25 bp, Rattus norvegicus
agctccccaactgccaaagagaagg

SEQ ID NO: 133993 - DNA, 25 bp, Rattus norvegicus
agctccccacatcgtcatctaaaaa

SEQ ID NO: 133994 - DNA, 25 bp, Rattus norvegicus
agctccccacatggtcatctaaaaa

SEQ ID NO: 133995 - DNA, 25 bp, Rattus norvegicus
agctccccagtcatcgcttaaaata

SEQ ID NO: 133996 - DNA, 25 bp, Rattus norvegicus
agctccccagtcttcgcttaaaata

SEQ ID NO: 133997 - DNA, 25 bp, Rattus norvegicus
agctccccatgactccataaaataa

SEQ ID NO: 133998 - DNA, 25 bp, Rattus norvegicus
agctccccatgagtccataaaataa

SEQ ID NO: 133999 - DNA, 25 bp, Rattus norvegicus
agctccccatttactgagagaccaa

SEQ ID NO: 134000 - DNA, 25 bp, Rattus norvegicus
agctccccattttctgagagaccaa

SEQ ID NO: 134001 - DNA, 25 bp, Rattus norvegicus
agctccccgtccctggaaatctgag

SEQ ID NO: 134002 - DNA, 25 bp, Rattus norvegicus
agctccccgtccgtggaaatctgag

SEQ ID NO: 134003 - DNA, 25 bp, Rattus norvegicus
agctcccgattacaggactttccat

SEQ ID NO: 134004 - DNA, 25 bp, Rattus norvegicus
agctcccgattagaggactttccat

SEQ ID NO: 134005 - DNA, 25 bp, Rattus norvegicus
agctcccgattcaaagtcgctgctt

SEQ ID NO: 134006 - DNA, 25 bp, Rattus norvegicus
agctcccgattctaagtcgctgctt

SEQ ID NO: 134007 - DNA, 25 bp, Rattus norvegicus
agctcccgcttcctggaagtatgat

SEQ ID NO: 134008 - DNA, 25 bp, Rattus norvegicus
agctcccgcttcgtggaagtatgat

SEQ ID NO: 134009 - DNA, 25 bp, Rattus norvegicus
agctcccggaagattctgcagaggt

SEQ ID NO: 134010 - DNA, 25 bp, Rattus norvegicus
agctcccggaagtttctgcagaggt

SEQ ID NO: 134011 - DNA, 25 bp, Rattus norvegicus
agctcccggagcctctgtagtcagg

SEQ ID NO: 134012 - DNA, 25 bp, Rattus norvegicus
agctcccggagcgtctgtagtcagg

SEQ ID NO: 134013 - DNA, 25 bp, Rattus norvegicus
agctcccggcagatggttctggtga

SEQ ID NO: 134014 - DNA, 25 bp, Rattus norvegicus
agctcccggcagttggttctggtga

SEQ ID NO: 134015 - DNA, 25 bp, Rattus norvegicus
agctcccggtggctcagataataca

SEQ ID NO: 134016 - DNA, 25 bp, Rattus norvegicus
agctcccggtgggtcagataataca

SEQ ID NO: 134017 - DNA, 25 bp, Rattus norvegicus
agctcccgtggaagacagtgatgtc

SEQ ID NO: 134018 - DNA, 25 bp, Rattus norvegicus
agctcccgtggatgacagtgatgtc

SEQ ID NO: 134019 - DNA, 25 bp, Rattus norvegicus
agctccctatgtatgtgtatctgcc

SEQ ID NO: 134020 - DNA, 25 bp, Rattus norvegicus
agctccctatgtttgtgtatctgcc

SEQ ID NO: 134021 - DNA, 25 bp, Rattus norvegicus
agctccctcaacattttgtgcacca

SEQ ID NO: 134022 - DNA, 25 bp, Rattus norvegicus
agctccctcaactttttgtgcacca

SEQ ID NO: 134023 - DNA, 25 bp, Rattus norvegicus
agctccctccctaagaaatgtgtga

SEQ ID NO: 134024 - DNA, 25 bp, Rattus norvegicus
agctccctcccttagaaatgtgtga

SEQ ID NO: 134025 - DNA, 25 bp, Rattus norvegicus
agctccctcctgcacaaataagtaa

SEQ ID NO: 134026 - DNA, 25 bp, Rattus norvegicus
agctccctcctggacaaataagtaa

SEQ ID NO: 134027 - DNA, 25 bp, Rattus norvegicus
agctccctcttgcagagttcgtgaa

SEQ ID NO: 134028 - DNA, 25 bp, Rattus norvegicus
agctccctcttggagagttcgtgaa

SEQ ID NO: 134029 - DNA, 25 bp, Rattus norvegicus
agctccctgagcagttttctgtctg

SEQ ID NO: 134030 - DNA, 25 bp, Rattus norvegicus
agctccctgagctgttttctgtctg

SEQ ID NO: 134031 - DNA, 25 bp, Rattus norvegicus
agctccctgcagattaagaaatcgg

SEQ ID NO: 134032 - DNA, 25 bp, Rattus norvegicus
agctccctgcagtttaagaaatcgg

SEQ ID NO: 134033 - DNA, 25 bp, Rattus norvegicus
agctccctgcatctatcaattcatc

SEQ ID NO: 134034 - DNA, 25 bp, Rattus norvegicus
agctccctgcatgtatcaattcatc

SEQ ID NO: 134035 - DNA, 25 bp, Rattus norvegicus
agctccctggagatcaatgtcttgg

SEQ ID NO: 134036 - DNA, 25 bp, Rattus norvegicus
agctccctggagttcaatgtcttgg

SEQ ID NO: 134037 - DNA, 25 bp, Rattus norvegicus
agctccctggttactgatccgaaag

SEQ ID NO: 134038 - DNA, 25 bp, Rattus norvegicus
agctccctggtttctgatccgaaag

SEQ ID NO: 134039 - DNA, 25 bp, Rattus norvegicus
agctcccttacactgctttggctga

SEQ ID NO: 134040 - DNA, 25 bp, Rattus norvegicus
agctcccttacagtgctttggctga

SEQ ID NO: 134041 - DNA, 25 bp, Rattus norvegicus
agctcccttacgatccagagatgga

SEQ ID NO: 134042 - DNA, 25 bp, Rattus norvegicus
agctcccttacgttccagagatgga

SEQ ID NO: 134043 - DNA, 25 bp, Rattus norvegicus
agctcccttagcagctgatgtcttt

SEQ ID NO: 134044 - DNA, 25 bp, Rattus norvegicus
agctcccttagctgctgatgtcttt

SEQ ID NO: 134045 - DNA, 25 bp, Rattus norvegicus
agctcccttaggcagtcggccgtct

SEQ ID NO: 134046 - DNA, 25 bp, Rattus norvegicus
agctcccttagggagtcggccgtct

SEQ ID NO: 134047 - DNA, 25 bp, Rattus norvegicus
agctcccttctgatctgtgtagtat

SEQ ID NO: 134048 - DNA, 25 bp, Rattus norvegicus
agctcccttctgttctgtgtagtat

SEQ ID NO: 134049 - DNA, 25 bp, Rattus norvegicus
agctccctttcgatttctgttaact

SEQ ID NO: 134050 - DNA, 25 bp, Rattus norvegicus
agctccctttcgttttctgttaact

SEQ ID NO: 134051 - DNA, 25 bp, Rattus norvegicus
agctccgacttcagatgctcatcat

SEQ ID NO: 134052 - DNA, 25 bp, Rattus norvegicus
agctccgacttctgatgctcatcat

SEQ ID NO: 134053 - DNA, 25 bp, Rattus norvegicus
agctccgcactcacatgtgttattg

SEQ ID NO: 134054 - DNA, 25 bp, Rattus norvegicus
agctccgcactctcatgtgttattg

SEQ ID NO: 134055 - DNA, 25 bp, Rattus norvegicus
agctccgcaggacgcagatgccagc

SEQ ID NO: 134056 - DNA, 25 bp, Rattus norvegicus
agctccgcaggaggcagatgccagc

SEQ ID NO: 134057 - DNA, 25 bp, Rattus norvegicus
agctccgcatcaccatgggctacag

SEQ ID NO: 134058 - DNA, 25 bp, Rattus norvegicus
agctccgcatcagcatgggctacag

SEQ ID NO: 134059 - DNA, 25 bp, Rattus norvegicus
agctccgcatgactcagcagtttgt

SEQ ID NO: 134060 - DNA, 25 bp, Rattus norvegicus
agctccgcatgagtcagcagtttgt

SEQ ID NO: 134061 - DNA, 25 bp, Rattus norvegicus
agctccgccatcaagtttgagtaag

SEQ ID NO: 134062 - DNA, 25 bp, Rattus norvegicus
agctccgccatctagtttgagtaag

SEQ ID NO: 134063 - DNA, 25 bp, Rattus norvegicus
agctccgcgtatatcttcctaaggg

SEQ ID NO: 134064 - DNA, 25 bp, Rattus norvegicus
agctccgcgtatttcttcctaaggg

SEQ ID NO: 134065 - DNA, 25 bp, Rattus norvegicus
agctccgcgtgtatcctgtgagaag

SEQ ID NO: 134066 - DNA, 25 bp, Rattus norvegicus
agctccgcgtgtttcctgtgagaag

SEQ ID NO: 134067 - DNA, 25 bp, Rattus norvegicus
agctccggctccagtatgaatgcaa

SEQ ID NO: 134068 - DNA, 25 bp, Rattus norvegicus
agctccggctcctgtatgaatgcaa

SEQ ID NO: 134069 - DNA, 25 bp, Rattus norvegicus
agctccgggccaagatcgaggagtt

SEQ ID NO: 134070 - DNA, 25 bp, Rattus norvegicus
agctccgggccatgatcgaggagtt

SEQ ID NO: 134071 - DNA, 25 bp, Rattus norvegicus
agctccggtctgatattcaaaaacg

SEQ ID NO: 134072 - DNA, 25 bp, Rattus norvegicus
agctccggtctgttattcaaaaacg

SEQ ID NO: 134073 - DNA, 25 bp, Rattus norvegicus
agctccggtgggacctacagagaca

SEQ ID NO: 134074 - DNA, 25 bp, Rattus norvegicus
agctccggtgggtcctacagagaca

SEQ ID NO: 134075 - DNA, 25 bp, Rattus norvegicus
agctccgtagacctgcagacattag

SEQ ID NO: 134076 - DNA, 25 bp, Rattus norvegicus
agctccgtagacgtgcagacattag

SEQ ID NO: 134077 - DNA, 25 bp, Rattus norvegicus
agctccgtcatgaccatggcgacag

SEQ ID NO: 134078 - DNA, 25 bp, Rattus norvegicus
agctccgtcatgtccatggcgacag

SEQ ID NO: 134079 - DNA, 25 bp, Rattus norvegicus
agctccgtctgccttggaagaagaa

SEQ ID NO: 134080 - DNA, 25 bp, Rattus norvegicus
agctccgtctgcgttggaagaagaa

SEQ ID NO: 134081 - DNA, 25 bp, Rattus norvegicus
agctccgtgcttagttgtatgcaga

SEQ ID NO: 134082 - DNA, 25 bp, Rattus norvegicus
agctccgtgctttgttgtatgcaga

SEQ ID NO: 134083 - DNA, 25 bp, Rattus norvegicus
agctcctaaagccatgaagtcctca

SEQ ID NO: 134084 - DNA, 25 bp, Rattus norvegicus
agctcctaaagccatttctctaggg

SEQ ID NO: 134085 - DNA, 25 bp, Rattus norvegicus
agctcctaaagcgatgaagtcctca

SEQ ID NO: 134086 - DNA, 25 bp, Rattus norvegicus
agctcctaaagcgatttctctaggg

SEQ ID NO: 134087 - DNA, 25 bp, Rattus norvegicus
agctcctaagaaagcgttctacaca

SEQ ID NO: 134088 - DNA, 25 bp, Rattus norvegicus
agctcctaagaatgcgttctacaca

SEQ ID NO: 134089 - DNA, 25 bp, Rattus norvegicus
agctcctaagttctcacctagggtg

SEQ ID NO: 134090 - DNA, 25 bp, Rattus norvegicus
agctcctaagttgtcacctagggtg

SEQ ID NO: 134091 - DNA, 25 bp, Rattus norvegicus
agctcctaccagaggacctcagaaa

SEQ ID NO: 134092 - DNA, 25 bp, Rattus norvegicus
agctcctaccagtggacctcagaaa

SEQ ID NO: 134093 - DNA, 25 bp, Rattus norvegicus
agctcctactccatgatgctatgta

SEQ ID NO: 134094 - DNA, 25 bp, Rattus norvegicus
agctcctactccttgatgctatgta

SEQ ID NO: 134095 - DNA, 25 bp, Rattus norvegicus
agctcctacttcagcagcgatgaat

SEQ ID NO: 134096 - DNA, 25 bp, Rattus norvegicus
agctcctacttctgcagcgatgaat

SEQ ID NO: 134097 - DNA, 25 bp, Rattus norvegicus
agctcctaggatatgttgggcccta

SEQ ID NO: 134098 - DNA, 25 bp, Rattus norvegicus
agctcctaggatttgttgggcccta

SEQ ID NO: 134099 - DNA, 25 bp, Rattus norvegicus
agctcctattagctgccctgtggaa

SEQ ID NO: 134100 - DNA, 25 bp, Rattus norvegicus
agctcctattaggtgccctgtggaa

SEQ ID NO: 134101 - DNA, 25 bp, Rattus norvegicus
agctcctcaaaaccgtgtctcaaaa

SEQ ID NO: 134102 - DNA, 25 bp, Rattus norvegicus
agctcctcaaaagcgtgtctcaaaa

SEQ ID NO: 134103 - DNA, 25 bp, Rattus norvegicus
agctcctcacacactaattttcagt

SEQ ID NO: 134104 - DNA, 25 bp, Rattus norvegicus
agctcctcacactctaattttcagt

SEQ ID NO: 134105 - DNA, 25 bp, Rattus norvegicus
agctcctcacttaatgtacaatttc

SEQ ID NO: 134106 - DNA, 25 bp, Rattus norvegicus
agctcctcactttatgtacaatttc

SEQ ID NO: 134107 - DNA, 25 bp, Rattus norvegicus
agctcctcaggcaagatgttcacac

SEQ ID NO: 134108 - DNA, 25 bp, Rattus norvegicus
agctcctcaggctagatgttcacac

SEQ ID NO: 134109 - DNA, 25 bp, Rattus norvegicus
agctcctcccatctctttgatggtg

SEQ ID NO: 134110 - DNA, 25 bp, Rattus norvegicus
agctcctcccatgtctttgatggtg

SEQ ID NO: 134111 - DNA, 25 bp, Rattus norvegicus
agctcctccgtacataccagtagta

SEQ ID NO: 134112 - DNA, 25 bp, Rattus norvegicus
agctcctccgtagataccagtagta

SEQ ID NO: 134113 - DNA, 25 bp, Rattus norvegicus
agctcctcctcgctgaagagccgta

SEQ ID NO: 134114 - DNA, 25 bp, Rattus norvegicus
agctcctcctcggtgaagagccgta

SEQ ID NO: 134115 - DNA, 25 bp, Rattus norvegicus
agctcctcctgccaaagaatgtcgt

SEQ ID NO: 134116 - DNA, 25 bp, Rattus norvegicus
agctcctcctgcgaaagaatgtcgt

SEQ ID NO: 134117 - DNA, 25 bp, Rattus norvegicus
agctcctcgctgatggccttgtact

SEQ ID NO: 134118 - DNA, 25 bp, Rattus norvegicus
agctcctcgctgttggccttgtact

SEQ ID NO: 134119 - DNA, 25 bp, Rattus norvegicus
agctcctctactatcagcaagtctg

SEQ ID NO: 134120 - DNA, 25 bp, Rattus norvegicus
agctcctctactttcagcaagtctg

SEQ ID NO: 134121 - DNA, 25 bp, Rattus norvegicus
agctcctctggcattctatagttaa

SEQ ID NO: 134122 - DNA, 25 bp, Rattus norvegicus
agctcctctggctttctatagttaa

SEQ ID NO: 134123 - DNA, 25 bp, Rattus norvegicus
agctcctcttatagcacttagacag

SEQ ID NO: 134124 - DNA, 25 bp, Rattus norvegicus
agctcctcttattgcacttagacag

SEQ ID NO: 134125 - DNA, 25 bp, Rattus norvegicus
agctcctgactaagagaacctgcag

SEQ ID NO: 134126 - DNA, 25 bp, Rattus norvegicus
agctcctgactatgagaacctgcag

SEQ ID NO: 134127 - DNA, 25 bp, Rattus norvegicus
agctcctgactgctcctagaaaaga

SEQ ID NO: 134128 - DNA, 25 bp, Rattus norvegicus
agctcctgactggtcctagaaaaga

SEQ ID NO: 134129 - DNA, 25 bp, Rattus norvegicus
agctcctgagctacgcagccatgga

SEQ ID NO: 134130 - DNA, 25 bp, Rattus norvegicus
agctcctgagcttcgcagccatgga

SEQ ID NO: 134131 - DNA, 25 bp, Rattus norvegicus
agctcctgagttcactgctgctcag

SEQ ID NO: 134132 - DNA, 25 bp, Rattus norvegicus
agctcctgagttgactgctgctcag

SEQ ID NO: 134133 - DNA, 25 bp, Rattus norvegicus
agctcctgatgaagggcctcctgga

SEQ ID NO: 134134 - DNA, 25 bp, Rattus norvegicus
agctcctgatgatgggcctcctgga

SEQ ID NO: 134135 - DNA, 25 bp, Rattus norvegicus
agctcctgcagcacagaactgaggt

SEQ ID NO: 134136 - DNA, 25 bp, Rattus norvegicus
agctcctgcagctcagaactgaggt

SEQ ID NO: 134137 - DNA, 25 bp, Rattus norvegicus
agctcctgcctcatgaatacacgag

SEQ ID NO: 134138 - DNA, 25 bp, Rattus norvegicus
agctcctgcctcttgaatacacgag

SEQ ID NO: 134139 - DNA, 25 bp, Rattus norvegicus
agctcctgcctgacaagtggtttga

SEQ ID NO: 134140 - DNA, 25 bp, Rattus norvegicus
agctcctgcctgagagagtgtgtac

SEQ ID NO: 134141 - DNA, 25 bp, Rattus norvegicus
agctcctgcctgtcaagtggtttga

SEQ ID NO: 134142 - DNA, 25 bp, Rattus norvegicus
agctcctgcctgtgagagtgtgtac

SEQ ID NO: 134143 - DNA, 25 bp, Rattus norvegicus
agctcctgccttacttacaagaact

SEQ ID NO: 134144 - DNA, 25 bp, Rattus norvegicus
agctcctgcctttcttacaagaact

SEQ ID NO: 134145 - DNA, 25 bp, Rattus norvegicus
agctcctgcgtgaacaagctcaatt

SEQ ID NO: 134146 - DNA, 25 bp, Rattus norvegicus
agctcctgcgtgtacaagctcaatt

SEQ ID NO: 134147 - DNA, 25 bp, Rattus norvegicus
agctcctgctagctagtgcccttct

SEQ ID NO: 134148 - DNA, 25 bp, Rattus norvegicus
agctcctgctaggtagtgcccttct

SEQ ID NO: 134149 - DNA, 25 bp, Rattus norvegicus
agctcctgctcgcactgagaggaag

SEQ ID NO: 134150 - DNA, 25 bp, Rattus norvegicus
agctcctgctcggactgagaggaag

SEQ ID NO: 134151 - DNA, 25 bp, Rattus norvegicus
agctcctgcttcaaatactgtagtg

SEQ ID NO: 134152 - DNA, 25 bp, Rattus norvegicus
agctcctgcttcacggccttaacaa

SEQ ID NO: 134153 - DNA, 25 bp, Rattus norvegicus
agctcctgcttctaatactgtagtg

SEQ ID NO: 134154 - DNA, 25 bp, Rattus norvegicus
agctcctgcttctcggccttaacaa

SEQ ID NO: 134155 - DNA, 25 bp, Rattus norvegicus
agctcctggaatcgcagcttctgaa

SEQ ID NO: 134156 - DNA, 25 bp, Rattus norvegicus
agctcctggaatggcagcttctgaa

SEQ ID NO: 134157 - DNA, 25 bp, Rattus norvegicus
agctcctggacaagagttctgcctt

SEQ ID NO: 134158 - DNA, 25 bp, Rattus norvegicus
agctcctggacatgagttctgcctt

SEQ ID NO: 134159 - DNA, 25 bp, Rattus norvegicus
agctcctggcgccagatctcgatgt

SEQ ID NO: 134160 - DNA, 25 bp, Rattus norvegicus
agctcctggcgcgagatctcgatgt

SEQ ID NO: 134161 - DNA, 25 bp, Rattus norvegicus
agctcctgggccaatctgatgatct

SEQ ID NO: 134162 - DNA, 25 bp, Rattus norvegicus
agctcctgggcctatctgatgatct

SEQ ID NO: 134163 - DNA, 25 bp, Rattus norvegicus
agctcctgggcgaggtatagcacaa

SEQ ID NO: 134164 - DNA, 25 bp, Rattus norvegicus
agctcctgggcgtggtatagcacaa

SEQ ID NO: 134165 - DNA, 25 bp, Rattus norvegicus
agctcctgggtgactttgcacctag

SEQ ID NO: 134166 - DNA, 25 bp, Rattus norvegicus
agctcctgggtgtctttgcacctag

SEQ ID NO: 134167 - DNA, 25 bp, Rattus norvegicus
agctcctggtacaaggtttgtcctt

SEQ ID NO: 134168 - DNA, 25 bp, Rattus norvegicus
agctcctggtactaggtttgtcctt

SEQ ID NO: 134169 - DNA, 25 bp, Rattus norvegicus
agctcctggtccaagcagagcgaaa

SEQ ID NO: 134170 - DNA, 25 bp, Rattus norvegicus
agctcctggtcctagcagagcgaaa

SEQ ID NO: 134171 - DNA, 25 bp, Rattus norvegicus
agctcctggtgcacaagcagcagca

SEQ ID NO: 134172 - DNA, 25 bp, Rattus norvegicus
agctcctggtgctcaagcagcagca

SEQ ID NO: 134173 - DNA, 25 bp, Rattus norvegicus
agctcctgtccccacttcagcacca

SEQ ID NO: 134174 - DNA, 25 bp, Rattus norvegicus
agctcctgtcccgacttcagcacca

SEQ ID NO: 134175 - DNA, 25 bp, Rattus norvegicus
agctcctgtcggagctgtagaacct

SEQ ID NO: 134176 - DNA, 25 bp, Rattus norvegicus
agctcctgtcggtgctgtagaacct

SEQ ID NO: 134177 - DNA, 25 bp, Rattus norvegicus
agctccttcataacagttgtctctt

SEQ ID NO: 134178 - DNA, 25 bp, Rattus norvegicus
agctccttcatatcagttgtctctt

SEQ ID NO: 134179 - DNA, 25 bp, Rattus norvegicus
agctccttccacacgttgaagttga

SEQ ID NO: 134180 - DNA, 25 bp, Rattus norvegicus
agctccttccactcgttgaagttga

SEQ ID NO: 134181 - DNA, 25 bp, Rattus norvegicus
agctccttcccgagaatggcgaatt

SEQ ID NO: 134182 - DNA, 25 bp, Rattus norvegicus
agctccttcccgtgaatggcgaatt

SEQ ID NO: 134183 - DNA, 25 bp, Rattus norvegicus
agctccttcctcaaaatcttttttg

SEQ ID NO: 134184 - DNA, 25 bp, Rattus norvegicus
agctccttcctctaaatcttttttg

SEQ ID NO: 134185 - DNA, 25 bp, Rattus norvegicus
agctccttcctgcatacttttatta

SEQ ID NO: 134186 - DNA, 25 bp, Rattus norvegicus
agctccttcctggatacttttatta

SEQ ID NO: 134187 - DNA, 25 bp, Rattus norvegicus
agctccttcggacggaccttggcca

SEQ ID NO: 134188 - DNA, 25 bp, Rattus norvegicus
agctccttcggagggaccttggcca

SEQ ID NO: 134189 - DNA, 25 bp, Rattus norvegicus
agctccttctctagctcgttgaggg

SEQ ID NO: 134190 - DNA, 25 bp, Rattus norvegicus
agctccttctcttgctcgttgaggg

SEQ ID NO: 134191 - DNA, 25 bp, Rattus norvegicus
agctccttgcatagagtggcatggt

SEQ ID NO: 134192 - DNA, 25 bp, Rattus norvegicus
agctccttgcatctaacttttcacg

SEQ ID NO: 134193 - DNA, 25 bp, Rattus norvegicus
agctccttgcatgtaacttttcacg

SEQ ID NO: 134194 - DNA, 25 bp, Rattus norvegicus
agctccttgcattgagtggcatggt

SEQ ID NO: 134195 - DNA, 25 bp, Rattus norvegicus
agctccttgcctctttcccaaaagg

SEQ ID NO: 134196 - DNA, 25 bp, Rattus norvegicus
agctccttgcctgtttcccaaaagg

SEQ ID NO: 134197 - DNA, 25 bp, Rattus norvegicus
agctccttgcttatgggtttccaga

SEQ ID NO: 134198 - DNA, 25 bp, Rattus norvegicus
agctccttgcttttgggtttccaga

SEQ ID NO: 134199 - DNA, 25 bp, Rattus norvegicus
agctccttggagatgtgtatcttct

SEQ ID NO: 134200 - DNA, 25 bp, Rattus norvegicus
agctccttggagttgtgtatcttct

SEQ ID NO: 134201 - DNA, 25 bp, Rattus norvegicus
agctccttggttatctttctatgga

SEQ ID NO: 134202 - DNA, 25 bp, Rattus norvegicus
agctccttggttttctttctatgga

SEQ ID NO: 134203 - DNA, 25 bp, Rattus norvegicus
agctcctttagtccctacattcagg

SEQ ID NO: 134204 - DNA, 25 bp, Rattus norvegicus
agctcctttagtgcctacattcagg

SEQ ID NO: 134205 - DNA, 25 bp, Rattus norvegicus
agctcctttatgagcaccctgcaaa

SEQ ID NO: 134206 - DNA, 25 bp, Rattus norvegicus
agctcctttatgtgcaccctgcaaa

SEQ ID NO: 134207 - DNA, 25 bp, Rattus norvegicus
agctcctttcctcatttcaaagttg

SEQ ID NO: 134208 - DNA, 25 bp, Rattus norvegicus
agctcctttcctgatttcaaagttg

SEQ ID NO: 134209 - DNA, 25 bp, Rattus norvegicus
agctcctttgctctgacaggctatg

SEQ ID NO: 134210 - DNA, 25 bp, Rattus norvegicus
agctcctttgctgtgacaggctatg

SEQ ID NO: 134211 - DNA, 25 bp, Rattus norvegicus
agctcctttggcacttgagggatag

SEQ ID NO: 134212 - DNA, 25 bp, Rattus norvegicus
agctcctttggccttgaatctgttg

SEQ ID NO: 134213 - DNA, 25 bp, Rattus norvegicus
agctcctttggcgttgaatctgttg

SEQ ID NO: 134214 - DNA, 25 bp, Rattus norvegicus
agctcctttggctcttgagggatag

SEQ ID NO: 134215 - DNA, 25 bp, Rattus norvegicus
agctcctttggtagtgcatatgata

SEQ ID NO: 134216 - DNA, 25 bp, Rattus norvegicus
agctcctttggttgtgcatatgata

SEQ ID NO: 134217 - DNA, 25 bp, Rattus norvegicus
agctcctttttccatagacttctaa

SEQ ID NO: 134218 - DNA, 25 bp, Rattus norvegicus
agctcctttttcgatagacttctaa

SEQ ID NO: 134219 - DNA, 25 bp, Rattus norvegicus
agctcgaacccaactgcatgaaatt

SEQ ID NO: 134220 - DNA, 25 bp, Rattus norvegicus
agctcgaacccatctgcatgaaatt

SEQ ID NO: 134221 - DNA, 25 bp, Rattus norvegicus
agctcgaacgttaatttccagacct

SEQ ID NO: 134222 - DNA, 25 bp, Rattus norvegicus
agctcgaacgtttatttccagacct

SEQ ID NO: 134223 - DNA, 25 bp, Rattus norvegicus
agctcgaccaagacttgccttgtca

SEQ ID NO: 134224 - DNA, 25 bp, Rattus norvegicus
agctcgaccaagtcttgccttgtca

SEQ ID NO: 134225 - DNA, 25 bp, Rattus norvegicus
agctcgactgcaacctgtgagtcat

SEQ ID NO: 134226 - DNA, 25 bp, Rattus norvegicus
agctcgactgcatcctgtgagtcat

SEQ ID NO: 134227 - DNA, 25 bp, Rattus norvegicus
agctcgagatggaactggtgaaatt

SEQ ID NO: 134228 - DNA, 25 bp, Rattus norvegicus
agctcgagatggtactggtgaaatt

SEQ ID NO: 134229 - DNA, 25 bp, Rattus norvegicus
agctcgagcatcagcagtccaagta

SEQ ID NO: 134230 - DNA, 25 bp, Rattus norvegicus
agctcgagcatctgcagtccaagta

SEQ ID NO: 134231 - DNA, 25 bp, Rattus norvegicus
agctcgagcggtaggcagccctcgc

SEQ ID NO: 134232 - DNA, 25 bp, Rattus norvegicus
agctcgagcggttggcagccctcgc

SEQ ID NO: 134233 - DNA, 25 bp, Rattus norvegicus
agctcgaggtctcccaactggaagg

SEQ ID NO: 134234 - DNA, 25 bp, Rattus norvegicus
agctcgaggtctgccaactggaagg

SEQ ID NO: 134235 - DNA, 25 bp, Rattus norvegicus
agctcgagtgttaagtgcgactctc

SEQ ID NO: 134236 - DNA, 25 bp, Rattus norvegicus
agctcgagtgtttagtgcgactctc

SEQ ID NO: 134237 - DNA, 25 bp, Rattus norvegicus
agctcgatctggagtggtagctctg

SEQ ID NO: 134238 - DNA, 25 bp, Rattus norvegicus
agctcgatctggtgtggtagctctg

SEQ ID NO: 134239 - DNA, 25 bp, Rattus norvegicus
agctcgatgatgacttcaaagagat

SEQ ID NO: 134240 - DNA, 25 bp, Rattus norvegicus
agctcgatgatgtcttcaaagagat

SEQ ID NO: 134241 - DNA, 25 bp, Rattus norvegicus
agctcgcccaggaaaacggctttgt

SEQ ID NO: 134242 - DNA, 25 bp, Rattus norvegicus
agctcgcccaggtaaacggctttgt

SEQ ID NO: 134243 - DNA, 25 bp, Rattus norvegicus
agctcgcccgccagaagaacatgaa

SEQ ID NO: 134244 - DNA, 25 bp, Rattus norvegicus
agctcgcccgcctgaagaacatgaa

SEQ ID NO: 134245 - DNA, 25 bp, Rattus norvegicus
agctcgctcgggaggctaacattgt

SEQ ID NO: 134246 - DNA, 25 bp, Rattus norvegicus
agctcgctcgggtggctaacattgt

SEQ ID NO: 134247 - DNA, 25 bp, Rattus norvegicus
agctcgctctgacatgcacaatatt

SEQ ID NO: 134248 - DNA, 25 bp, Rattus norvegicus
agctcgctctgagatgcacaatatt

SEQ ID NO: 134249 - DNA, 25 bp, Rattus norvegicus
agctcgctgaagagcccttaaggat

SEQ ID NO: 134250 - DNA, 25 bp, Rattus norvegicus
agctcgctgaagtgcccttaaggat

SEQ ID NO: 134251 - DNA, 25 bp, Rattus norvegicus
agctcgctgtgaaaggtttaaccct

SEQ ID NO: 134252 - DNA, 25 bp, Rattus norvegicus
agctcgctgtgataggtttaaccct

SEQ ID NO: 134253 - DNA, 25 bp, Rattus norvegicus
agctcggacagcaggtattcagaga

SEQ ID NO: 134254 - DNA, 25 bp, Rattus norvegicus
agctcggacagctggtattcagaga

SEQ ID NO: 134255 - DNA, 25 bp, Rattus norvegicus
agctcggacagtctgcaatggtgca

SEQ ID NO: 134256 - DNA, 25 bp, Rattus norvegicus
agctcggacagtgtgcaatggtgca

SEQ ID NO: 134257 - DNA, 25 bp, Rattus norvegicus
agctcggagaccagggcatatgtat

SEQ ID NO: 134258 - DNA, 25 bp, Rattus norvegicus
agctcggagacctgggcatatgtat

SEQ ID NO: 134259 - DNA, 25 bp, Rattus norvegicus
agctcggagggtattctttagaatg

SEQ ID NO: 134260 - DNA, 25 bp, Rattus norvegicus
agctcggagggttttctttagaatg

SEQ ID NO: 134261 - DNA, 25 bp, Rattus norvegicus
agctcggatgtccatttgctcggaa

SEQ ID NO: 134262 - DNA, 25 bp, Rattus norvegicus
agctcggatgtcgatttgctcggaa

SEQ ID NO: 134263 - DNA, 25 bp, Rattus norvegicus
agctcggctacaccaaggacatgat

SEQ ID NO: 134264 - DNA, 25 bp, Rattus norvegicus
agctcggctacagcaaggacatgat

SEQ ID NO: 134265 - DNA, 25 bp, Rattus norvegicus
agctcggctagcatctgccaacaac

SEQ ID NO: 134266 - DNA, 25 bp, Rattus norvegicus
agctcggctagcttctgccaacaac

SEQ ID NO: 134267 - DNA, 25 bp, Rattus norvegicus
agctcggctcatactaggcagatga

SEQ ID NO: 134268 - DNA, 25 bp, Rattus norvegicus
agctcggctcattctaggcagatga

SEQ ID NO: 134269 - DNA, 25 bp, Rattus norvegicus
agctcggctcggagcatttgtttca

SEQ ID NO: 134270 - DNA, 25 bp, Rattus norvegicus
agctcggctcggtgcatttgtttca

SEQ ID NO: 134271 - DNA, 25 bp, Rattus norvegicus
agctcggctgaaccttgcccctgaa

SEQ ID NO: 134272 - DNA, 25 bp, Rattus norvegicus
agctcggctgaagcttgcccctgaa

SEQ ID NO: 134273 - DNA, 25 bp, Rattus norvegicus
agctcggctgccactgagtatttgc

SEQ ID NO: 134274 - DNA, 25 bp, Rattus norvegicus
agctcggctgcctctgagtatttgc

SEQ ID NO: 134275 - DNA, 25 bp, Rattus norvegicus
agctcggctgctcaaggctctggta

SEQ ID NO: 134276 - DNA, 25 bp, Rattus norvegicus
agctcggctgctgaaggctctggta

SEQ ID NO: 134277 - DNA, 25 bp, Rattus norvegicus
agctcgggactcagcattaattcaa

SEQ ID NO: 134278 - DNA, 25 bp, Rattus norvegicus
agctcgggactcagtgcaagtacca

SEQ ID NO: 134279 - DNA, 25 bp, Rattus norvegicus
agctcgggactctgcattaattcaa

SEQ ID NO: 134280 - DNA, 25 bp, Rattus norvegicus
agctcgggactctgtgcaagtacca

SEQ ID NO: 134281 - DNA, 25 bp, Rattus norvegicus
agctcgggcagcacgcgaacacggt

SEQ ID NO: 134282 - DNA, 25 bp, Rattus norvegicus
agctcgggcagctcgcgaacacggt

SEQ ID NO: 134283 - DNA, 25 bp, Rattus norvegicus
agctcgggccacctcgacacaagag

SEQ ID NO: 134284 - DNA, 25 bp, Rattus norvegicus
agctcgggccacgtcgacacaagag

SEQ ID NO: 134285 - DNA, 25 bp, Rattus norvegicus
agctcgggtgtcatcaggtgtgtat

SEQ ID NO: 134286 - DNA, 25 bp, Rattus norvegicus
agctcgggtgtcttcaggtgtgtat

SEQ ID NO: 134287 - DNA, 25 bp, Rattus norvegicus
agctcgggtttcattggcctgcagg

SEQ ID NO: 134288 - DNA, 25 bp, Rattus norvegicus
agctcgggtttctttggcctgcagg

SEQ ID NO: 134289 - DNA, 25 bp, Rattus norvegicus
agctcggtaattaacgttctcacta

SEQ ID NO: 134290 - DNA, 25 bp, Rattus norvegicus
agctcggtaatttacgttctcacta

SEQ ID NO: 134291 - DNA, 25 bp, Rattus norvegicus
agctcggtgagaaacggcttgcaca

SEQ ID NO: 134292 - DNA, 25 bp, Rattus norvegicus
agctcggtgagatacggcttgcaca

SEQ ID NO: 134293 - DNA, 25 bp, Rattus norvegicus
agctcggtttgcaattcctcatcta

SEQ ID NO: 134294 - DNA, 25 bp, Rattus norvegicus
agctcggtttgctattcctcatcta

SEQ ID NO: 134295 - DNA, 25 bp, Rattus norvegicus
agctcgtaaagcatgggaaactcac

SEQ ID NO: 134296 - DNA, 25 bp, Rattus norvegicus
agctcgtaaagcttgggaaactcac

SEQ ID NO: 134297 - DNA, 25 bp, Rattus norvegicus
agctcgtacctgcatcttttatact

SEQ ID NO: 134298 - DNA, 25 bp, Rattus norvegicus
agctcgtacctggatcttttatact

SEQ ID NO: 134299 - DNA, 25 bp, Rattus norvegicus
agctcgtcagagaaaactgcctaat

SEQ ID NO: 134300 - DNA, 25 bp, Rattus norvegicus
agctcgtcagagtaaactgcctaat

SEQ ID NO: 134301 - DNA, 25 bp, Rattus norvegicus
agctcgtccgtgacaaagttgtgca

SEQ ID NO: 134302 - DNA, 25 bp, Rattus norvegicus
agctcgtccgtgatcaccgacatgg

SEQ ID NO: 134303 - DNA, 25 bp, Rattus norvegicus
agctcgtccgtgtcaaagttgtgca

SEQ ID NO: 134304 - DNA, 25 bp, Rattus norvegicus
agctcgtccgtgttcaccgacatgg

SEQ ID NO: 134305 - DNA, 25 bp, Rattus norvegicus
agctcgtctgctcgccaatgaagta

SEQ ID NO: 134306 - DNA, 25 bp, Rattus norvegicus
agctcgtctgctggccaatgaagta

SEQ ID NO: 134307 - DNA, 25 bp, Rattus norvegicus
agctcgtctttaattcaccagtatc

SEQ ID NO: 134308 - DNA, 25 bp, Rattus norvegicus
agctcgtctttatttcaccagtatc

SEQ ID NO: 134309 - DNA, 25 bp, Rattus norvegicus
agctcgtgctccaaccgagacttgg

SEQ ID NO: 134310 - DNA, 25 bp, Rattus norvegicus
agctcgtgctcctaccgagacttgg

SEQ ID NO: 134311 - DNA, 25 bp, Rattus norvegicus
agctcgtggagtactaccagctcaa

SEQ ID NO: 134312 - DNA, 25 bp, Rattus norvegicus
agctcgtggagttctaccagctcaa

SEQ ID NO: 134313 - DNA, 25 bp, Rattus norvegicus
agctcgtggctcattgaagtctgaa

SEQ ID NO: 134314 - DNA, 25 bp, Rattus norvegicus
agctcgtggctcctgaagactgatg

SEQ ID NO: 134315 - DNA, 25 bp, Rattus norvegicus
agctcgtggctcgtgaagactgatg

SEQ ID NO: 134316 - DNA, 25 bp, Rattus norvegicus
agctcgtggctctttgaagtctgaa

SEQ ID NO: 134317 - DNA, 25 bp, Rattus norvegicus
agctctaaatacagcccactgttgt

SEQ ID NO: 134318 - DNA, 25 bp, Rattus norvegicus
agctctaaatactgcccactgttgt

SEQ ID NO: 134319 - DNA, 25 bp, Rattus norvegicus
agctctaacgtgcacggagacgcca

SEQ ID NO: 134320 - DNA, 25 bp, Rattus norvegicus
agctctaacgtggacggagacgcca

SEQ ID NO: 134321 - DNA, 25 bp, Rattus norvegicus
agctctaactcaaagcctggcttga

SEQ ID NO: 134322 - DNA, 25 bp, Rattus norvegicus
agctctaactcatagcctggcttga

SEQ ID NO: 134323 - DNA, 25 bp, Rattus norvegicus
agctctaactgaaccatttctgtgt

SEQ ID NO: 134324 - DNA, 25 bp, Rattus norvegicus
agctctaactgatccatttctgtgt

SEQ ID NO: 134325 - DNA, 25 bp, Rattus norvegicus
agctctaacttacccataactttgc

SEQ ID NO: 134326 - DNA, 25 bp, Rattus norvegicus
agctctaacttagccataactttgc

SEQ ID NO: 134327 - DNA, 25 bp, Rattus norvegicus
agctctaagcgaactaacggccttt

SEQ ID NO: 134328 - DNA, 25 bp, Rattus norvegicus
agctctaagcgatctaacggccttt

SEQ ID NO: 134329 - DNA, 25 bp, Rattus norvegicus
agctctaagctacaggccactcctg

SEQ ID NO: 134330 - DNA, 25 bp, Rattus norvegicus
agctctaagctagaggccactcctg

SEQ ID NO: 134331 - DNA, 25 bp, Rattus norvegicus
agctctaagggaacagtgcctcctg

SEQ ID NO: 134332 - DNA, 25 bp, Rattus norvegicus
agctctaagggatcagtgcctcctg

SEQ ID NO: 134333 - DNA, 25 bp, Rattus norvegicus
agctctacacacacagcttgtgagg

SEQ ID NO: 134334 - DNA, 25 bp, Rattus norvegicus
agctctacacactcagcttgtgagg

SEQ ID NO: 134335 - DNA, 25 bp, Rattus norvegicus
agctctacacccatgtttctgagaa

SEQ ID NO: 134336 - DNA, 25 bp, Rattus norvegicus
agctctacacccttgtttctgagaa

SEQ ID NO: 134337 - DNA, 25 bp, Rattus norvegicus
agctctacacggactgatggataaa

SEQ ID NO: 134338 - DNA, 25 bp, Rattus norvegicus
agctctacacggtctgatggataaa

SEQ ID NO: 134339 - DNA, 25 bp, Rattus norvegicus
agctctacagccataagaagttcga

SEQ ID NO: 134340 - DNA, 25 bp, Rattus norvegicus
agctctacagccttaagaagttcga

SEQ ID NO: 134341 - DNA, 25 bp, Rattus norvegicus
agctctaccactccaggctatcgga

SEQ ID NO: 134342 - DNA, 25 bp, Rattus norvegicus
agctctaccactgcaggctatcgga

SEQ ID NO: 134343 - DNA, 25 bp, Rattus norvegicus
agctctaccagtatgtcaccaaact

SEQ ID NO: 134344 - DNA, 25 bp, Rattus norvegicus
agctctaccagtttgtcaccaaact

SEQ ID NO: 134345 - DNA, 25 bp, Rattus norvegicus
agctctaccatgagcactacatgcg

SEQ ID NO: 134346 - DNA, 25 bp, Rattus norvegicus
agctctaccatgtgcactacatgcg

SEQ ID NO: 134347 - DNA, 25 bp, Rattus norvegicus
agctctaccctgctaagtggtactt

SEQ ID NO: 134348 - DNA, 25 bp, Rattus norvegicus
agctctaccctggtaagtggtactt

SEQ ID NO: 134349 - DNA, 25 bp, Rattus norvegicus
agctctaccgcgcttggtaccggga

SEQ ID NO: 134350 - DNA, 25 bp, Rattus norvegicus
agctctaccgcggttggtaccggga

SEQ ID NO: 134351 - DNA, 25 bp, Rattus norvegicus
agctctactcctaacctagtatctt

SEQ ID NO: 134352 - DNA, 25 bp, Rattus norvegicus
agctctactccttacctagtatctt

SEQ ID NO: 134353 - DNA, 25 bp, Rattus norvegicus
agctctactgctaaaggattccatc

SEQ ID NO: 134354 - DNA, 25 bp, Rattus norvegicus
agctctactgcttaaggattccatc

SEQ ID NO: 134355 - DNA, 25 bp, Rattus norvegicus
agctctacttggacattgcccaagt

SEQ ID NO: 134356 - DNA, 25 bp, Rattus norvegicus
agctctacttggtcattgcccaagt

SEQ ID NO: 134357 - DNA, 25 bp, Rattus norvegicus
agctctagacccatcatgtgtggtg

SEQ ID NO: 134358 - DNA, 25 bp, Rattus norvegicus
agctctagacccttcatgtgtggtg

SEQ ID NO: 134359 - DNA, 25 bp, Rattus norvegicus
agctctagagggatctgatgccttt

SEQ ID NO: 134360 - DNA, 25 bp, Rattus norvegicus
agctctagagggttctgatgccttt

SEQ ID NO: 134361 - DNA, 25 bp, Rattus norvegicus
agctctagccatatgtgacaaccac

SEQ ID NO: 134362 - DNA, 25 bp, Rattus norvegicus
agctctagccatttgtgacaaccac

SEQ ID NO: 134363 - DNA, 25 bp, Rattus norvegicus
agctctagccttatcttaggtggaa

SEQ ID NO: 134364 - DNA, 25 bp, Rattus norvegicus
agctctagccttttcttaggtggaa

SEQ ID NO: 134365 - DNA, 25 bp, Rattus norvegicus
agctctagctgtctgcatatgtccc

SEQ ID NO: 134366 - DNA, 25 bp, Rattus norvegicus
agctctagctgtgtgcatatgtccc

SEQ ID NO: 134367 - DNA, 25 bp, Rattus norvegicus
agctctagctttagtcaggcagcct

SEQ ID NO: 134368 - DNA, 25 bp, Rattus norvegicus
agctctagcttttgtcaggcagcct

SEQ ID NO: 134369 - DNA, 25 bp, Rattus norvegicus
agctctagggccatggactgaacat

SEQ ID NO: 134370 - DNA, 25 bp, Rattus norvegicus
agctctagggccttggactgaacat

SEQ ID NO: 134371 - DNA, 25 bp, Rattus norvegicus
agctctagtagcagtgtgccactcc

SEQ ID NO: 134372 - DNA, 25 bp, Rattus norvegicus
agctctagtagctgtgtgccactcc

SEQ ID NO: 134373 - DNA, 25 bp, Rattus norvegicus
agctctatactccgagaactagcat

SEQ ID NO: 134374 - DNA, 25 bp, Rattus norvegicus
agctctatactcggagaactagcat

SEQ ID NO: 134375 - DNA, 25 bp, Rattus norvegicus
agctctatagctctgtgttgggaac

SEQ ID NO: 134376 - DNA, 25 bp, Rattus norvegicus
agctctatagctgtgtgttgggaac

SEQ ID NO: 134377 - DNA, 25 bp, Rattus norvegicus
agctctatcgacacagttcctagga

SEQ ID NO: 134378 - DNA, 25 bp, Rattus norvegicus
agctctatcgactcagttcctagga

SEQ ID NO: 134379 - DNA, 25 bp, Rattus norvegicus
agctctatggctaactggtgcttcg

SEQ ID NO: 134380 - DNA, 25 bp, Rattus norvegicus
agctctatggcttactggtgcttcg

SEQ ID NO: 134381 - DNA, 25 bp, Rattus norvegicus
agctctattataagcagtgatggtt

SEQ ID NO: 134382 - DNA, 25 bp, Rattus norvegicus
agctctattatatgcagtgatggtt

SEQ ID NO: 134383 - DNA, 25 bp, Rattus norvegicus
agctctattatcactatcccttctt

SEQ ID NO: 134384 - DNA, 25 bp, Rattus norvegicus
agctctattatcatcgactgcccag

SEQ ID NO: 134385 - DNA, 25 bp, Rattus norvegicus
agctctattatctctatcccttctt

SEQ ID NO: 134386 - DNA, 25 bp, Rattus norvegicus
agctctattatcttcgactgcccag

SEQ ID NO: 134387 - DNA, 25 bp, Rattus norvegicus
agctctcaaagcagggtcagccacc

SEQ ID NO: 134388 - DNA, 25 bp, Rattus norvegicus
agctctcaaagcatactcgctacat

SEQ ID NO: 134389 - DNA, 25 bp, Rattus norvegicus
agctctcaaagctgggtcagccacc

SEQ ID NO: 134390 - DNA, 25 bp, Rattus norvegicus
agctctcaaagcttactcgctacat

SEQ ID NO: 134391 - DNA, 25 bp, Rattus norvegicus
agctctcaacttcaagcctttggga

SEQ ID NO: 134392 - DNA, 25 bp, Rattus norvegicus
agctctcaacttgaagcctttggga

SEQ ID NO: 134393 - DNA, 25 bp, Rattus norvegicus
agctctcaagcaaatcctcccgagg

SEQ ID NO: 134394 - DNA, 25 bp, Rattus norvegicus
agctctcaagcatatcctcccgagg

SEQ ID NO: 134395 - DNA, 25 bp, Rattus norvegicus
agctctcaatggagcttatcactag

SEQ ID NO: 134396 - DNA, 25 bp, Rattus norvegicus
agctctcaatggtgcttatcactag

SEQ ID NO: 134397 - DNA, 25 bp, Rattus norvegicus
agctctcacagaatcaggatctacg

SEQ ID NO: 134398 - DNA, 25 bp, Rattus norvegicus
agctctcacagattcaggatctacg

SEQ ID NO: 134399 - DNA, 25 bp, Rattus norvegicus
agctctcacccaccaaggacatgaa

SEQ ID NO: 134400 - DNA, 25 bp, Rattus norvegicus
agctctcacccagcaaggacatgaa

SEQ ID NO: 134401 - DNA, 25 bp, Rattus norvegicus
agctctcactctacttaagccagaa

SEQ ID NO: 134402 - DNA, 25 bp, Rattus norvegicus
agctctcactcttcttaagccagaa

SEQ ID NO: 134403 - DNA, 25 bp, Rattus norvegicus
agctctcagaaacgagaccgcctgg

SEQ ID NO: 134404 - DNA, 25 bp, Rattus norvegicus
agctctcagaaaggagaccgcctgg

SEQ ID NO: 134405 - DNA, 25 bp, Rattus norvegicus
agctctcagagcctgacatgcccaa

SEQ ID NO: 134406 - DNA, 25 bp, Rattus norvegicus
agctctcagagcgtgacatgcccaa

SEQ ID NO: 134407 - DNA, 25 bp, Rattus norvegicus
agctctcagcaccagtggcagttta

SEQ ID NO: 134408 - DNA, 25 bp, Rattus norvegicus
agctctcagcacgagtggcagttta

SEQ ID NO: 134409 - DNA, 25 bp, Rattus norvegicus
agctctcagggcacggtcaagtgtc

SEQ ID NO: 134410 - DNA, 25 bp, Rattus norvegicus
agctctcagggctcggtcaagtgtc

SEQ ID NO: 134411 - DNA, 25 bp, Rattus norvegicus
agctctcaggtgagccttactcttt

SEQ ID NO: 134412 - DNA, 25 bp, Rattus norvegicus
agctctcaggtgtgccttactcttt

SEQ ID NO: 134413 - DNA, 25 bp, Rattus norvegicus
agctctcagtctccccataatggtc

SEQ ID NO: 134414 - DNA, 25 bp, Rattus norvegicus
agctctcagtctgcccataatggtc

SEQ ID NO: 134415 - DNA, 25 bp, Rattus norvegicus
agctctcagtgacctattttctatc

SEQ ID NO: 134416 - DNA, 25 bp, Rattus norvegicus
agctctcagtgagctattttctatc

SEQ ID NO: 134417 - DNA, 25 bp, Rattus norvegicus
agctctcagtggaagccagcctaga

SEQ ID NO: 134418 - DNA, 25 bp, Rattus norvegicus
agctctcagtggtagccagcctaga

SEQ ID NO: 134419 - DNA, 25 bp, Rattus norvegicus
agctctcatctgaaatgtctcttct

SEQ ID NO: 134420 - DNA, 25 bp, Rattus norvegicus
agctctcatctgtaatgtctcttct

SEQ ID NO: 134421 - DNA, 25 bp, Rattus norvegicus
agctctcattagaagctgcccaggc

SEQ ID NO: 134422 - DNA, 25 bp, Rattus norvegicus
agctctcattagtagctgcccaggc

SEQ ID NO: 134423 - DNA, 25 bp, Rattus norvegicus
agctctccaactcggacaggtatcc

SEQ ID NO: 134424 - DNA, 25 bp, Rattus norvegicus
agctctccaactgggacaggtatcc

SEQ ID NO: 134425 - DNA, 25 bp, Rattus norvegicus
agctctccaagaacaagactctgcg

SEQ ID NO: 134426 - DNA, 25 bp, Rattus norvegicus
agctctccaagatcaagactctgcg

SEQ ID NO: 134427 - DNA, 25 bp, Rattus norvegicus
agctctccaagcatagatgtcctca

SEQ ID NO: 134428 - DNA, 25 bp, Rattus norvegicus
agctctccaagcttagatgtcctca

SEQ ID NO: 134429 - DNA, 25 bp, Rattus norvegicus
agctctccactgatggtgcagtgaa

SEQ ID NO: 134430 - DNA, 25 bp, Rattus norvegicus
agctctccactgttggtgcagtgaa

SEQ ID NO: 134431 - DNA, 25 bp, Rattus norvegicus
agctctccagggacgatttgcgagt

SEQ ID NO: 134432 - DNA, 25 bp, Rattus norvegicus
agctctccagggtcgatttgcgagt

SEQ ID NO: 134433 - DNA, 25 bp, Rattus norvegicus
agctctccagtcactaagcgcggcg

SEQ ID NO: 134434 - DNA, 25 bp, Rattus norvegicus
agctctccagtctctaagcgcggcg

SEQ ID NO: 134435 - DNA, 25 bp, Rattus norvegicus
agctctccattgaggacgtgaccct

SEQ ID NO: 134436 - DNA, 25 bp, Rattus norvegicus
agctctccattgtggacgtgaccct

SEQ ID NO: 134437 - DNA, 25 bp, Rattus norvegicus
agctctccccatctggagtccggaa

SEQ ID NO: 134438 - DNA, 25 bp, Rattus norvegicus
agctctccccatgtggagtccggaa

SEQ ID NO: 134439 - DNA, 25 bp, Rattus norvegicus
agctctccctctctttatggtttca

SEQ ID NO: 134440 - DNA, 25 bp, Rattus norvegicus
agctctccctctgtttatggtttca

SEQ ID NO: 134441 - DNA, 25 bp, Rattus norvegicus
agctctcccttgctaagactatttt

SEQ ID NO: 134442 - DNA, 25 bp, Rattus norvegicus
agctctcccttggtaagactatttt

SEQ ID NO: 134443 - DNA, 25 bp, Rattus norvegicus
agctctccgcaaagctaggcggcgg

SEQ ID NO: 134444 - DNA, 25 bp, Rattus norvegicus
agctctccgcaatgctaggcggcgg

SEQ ID NO: 134445 - DNA, 25 bp, Rattus norvegicus
agctctccggatcgcaaaaaagggt

SEQ ID NO: 134446 - DNA, 25 bp, Rattus norvegicus
agctctccggatggcaaaaaagggt

SEQ ID NO: 134447 - DNA, 25 bp, Rattus norvegicus
agctctccgtaaatcttttggtcaa

SEQ ID NO: 134448 - DNA, 25 bp, Rattus norvegicus
agctctccgtaattcttttggtcaa

SEQ ID NO: 134449 - DNA, 25 bp, Rattus norvegicus
agctctcctcagatctagctgtgat

SEQ ID NO: 134450 - DNA, 25 bp, Rattus norvegicus
agctctcctcagttctagctgtgat

SEQ ID NO: 134451 - DNA, 25 bp, Rattus norvegicus
agctctcctctgagtcaggtaaaga

SEQ ID NO: 134452 - DNA, 25 bp, Rattus norvegicus
agctctcctctgtgtcaggtaaaga

SEQ ID NO: 134453 - DNA, 25 bp, Rattus norvegicus
agctctcctcttaaaactgttcgtt

SEQ ID NO: 134454 - DNA, 25 bp, Rattus norvegicus
agctctcctctttaaactgttcgtt

SEQ ID NO: 134455 - DNA, 25 bp, Rattus norvegicus
agctctcctgtgaaaccttgttatc

SEQ ID NO: 134456 - DNA, 25 bp, Rattus norvegicus
agctctcctgtgtaaccttgttatc

SEQ ID NO: 134457 - DNA, 25 bp, Rattus norvegicus
agctctcgacaacattctgcaaaat

SEQ ID NO: 134458 - DNA, 25 bp, Rattus norvegicus
agctctcgacaagattctgcaaaat

SEQ ID NO: 134459 - DNA, 25 bp, Rattus norvegicus
agctctcgcactcgtcagtattagt

SEQ ID NO: 134460 - DNA, 25 bp, Rattus norvegicus
agctctcgcactggtcagtattagt

SEQ ID NO: 134461 - DNA, 25 bp, Rattus norvegicus
agctctcggagcatcgttcaccaga

SEQ ID NO: 134462 - DNA, 25 bp, Rattus norvegicus
agctctcggagcttcgttcaccaga

SEQ ID NO: 134463 - DNA, 25 bp, Rattus norvegicus
agctctcggagtatgtgggtatttt

SEQ ID NO: 134464 - DNA, 25 bp, Rattus norvegicus
agctctcggagtttgtgggtatttt

SEQ ID NO: 134465 - DNA, 25 bp, Rattus norvegicus
agctctcggctgacacctatgagga

SEQ ID NO: 134466 - DNA, 25 bp, Rattus norvegicus
agctctcggctgtcacctatgagga

SEQ ID NO: 134467 - DNA, 25 bp, Rattus norvegicus
agctctctactgctttggatatcat

SEQ ID NO: 134468 - DNA, 25 bp, Rattus norvegicus
agctctctactggtttggatatcat

SEQ ID NO: 134469 - DNA, 25 bp, Rattus norvegicus
agctctctagacagctttcatcaga

SEQ ID NO: 134470 - DNA, 25 bp, Rattus norvegicus
agctctctagactgctttcatcaga

SEQ ID NO: 134471 - DNA, 25 bp, Rattus norvegicus
agctctctcaaacaaccttcagtga

SEQ ID NO: 134472 - DNA, 25 bp, Rattus norvegicus
agctctctcaaagaaccttcagtga

SEQ ID NO: 134473 - DNA, 25 bp, Rattus norvegicus
agctctctccatcatagtggccatg

SEQ ID NO: 134474 - DNA, 25 bp, Rattus norvegicus
agctctctccatgatagtggccatg

SEQ ID NO: 134475 - DNA, 25 bp, Rattus norvegicus
agctctctccggctcctaggaaggg

SEQ ID NO: 134476 - DNA, 25 bp, Rattus norvegicus
agctctctccgggtcctaggaaggg

SEQ ID NO: 134477 - DNA, 25 bp, Rattus norvegicus
agctctctcgatcctgtcaggaggg

SEQ ID NO: 134478 - DNA, 25 bp, Rattus norvegicus
agctctctcgatgctgtcaggaggg

SEQ ID NO: 134479 - DNA, 25 bp, Rattus norvegicus
agctctctgacgaaatgcctgccta

SEQ ID NO: 134480 - DNA, 25 bp, Rattus norvegicus
agctctctgacgtaatgcctgccta

SEQ ID NO: 134481 - DNA, 25 bp, Rattus norvegicus
agctctctgactctcgctctagagt

SEQ ID NO: 134482 - DNA, 25 bp, Rattus norvegicus
agctctctgactgtcgctctagagt

SEQ ID NO: 134483 - DNA, 25 bp, Rattus norvegicus
agctctctgcacagaaatgcctgta

SEQ ID NO: 134484 - DNA, 25 bp, Rattus norvegicus
agctctctgcacaggtagtgcctct

SEQ ID NO: 134485 - DNA, 25 bp, Rattus norvegicus
agctctctgcactgaaatgcctgta

SEQ ID NO: 134486 - DNA, 25 bp, Rattus norvegicus
agctctctgcactggtagtgcctct

SEQ ID NO: 134487 - DNA, 25 bp, Rattus norvegicus
agctctctgcgcaaacacatgaagg

SEQ ID NO: 134488 - DNA, 25 bp, Rattus norvegicus
agctctctgcgctaacacatgaagg

SEQ ID NO: 134489 - DNA, 25 bp, Rattus norvegicus
agctctctggccaccagtgctggac

SEQ ID NO: 134490 - DNA, 25 bp, Rattus norvegicus
agctctctggcctccagtgctggac

SEQ ID NO: 134491 - DNA, 25 bp, Rattus norvegicus
agctctctggctaaaccggagtatt

SEQ ID NO: 134492 - DNA, 25 bp, Rattus norvegicus
agctctctggcttaaccggagtatt

SEQ ID NO: 134493 - DNA, 25 bp, Rattus norvegicus
agctctctgtaactggaccaatcca

SEQ ID NO: 134494 - DNA, 25 bp, Rattus norvegicus
agctctctgtaagtggaccaatcca

SEQ ID NO: 134495 - DNA, 25 bp, Rattus norvegicus
agctctctgtacattcgcttgtagt

SEQ ID NO: 134496 - DNA, 25 bp, Rattus norvegicus
agctctctgtactttcgcttgtagt

SEQ ID NO: 134497 - DNA, 25 bp, Rattus norvegicus
agctctcttcccagtgcttctagaa

SEQ ID NO: 134498 - DNA, 25 bp, Rattus norvegicus
agctctcttccctgtgcttctagaa

SEQ ID NO: 134499 - DNA, 25 bp, Rattus norvegicus
agctctcttgataaggaaaacgtcc

SEQ ID NO: 134500 - DNA, 25 bp, Rattus norvegicus
agctctcttgattaggaaaacgtcc

SEQ ID NO: 134501 - DNA, 25 bp, Rattus norvegicus
agctctctttcaaggtccaatctca

SEQ ID NO: 134502 - DNA, 25 bp, Rattus norvegicus
agctctctttcatggtccaatctca

SEQ ID NO: 134503 - DNA, 25 bp, Rattus norvegicus
agctctgaaaaaactccggcccttg

SEQ ID NO: 134504 - DNA, 25 bp, Rattus norvegicus
agctctgaaaaatctccggcccttg

SEQ ID NO: 134505 - DNA, 25 bp, Rattus norvegicus
agctctgaaccactgttccgatatt

SEQ ID NO: 134506 - DNA, 25 bp, Rattus norvegicus
agctctgaaccagtgttccgatatt

SEQ ID NO: 134507 - DNA, 25 bp, Rattus norvegicus
agctctgaacctctgggatgtacca

SEQ ID NO: 134508 - DNA, 25 bp, Rattus norvegicus
agctctgaacctgtgggatgtacca

SEQ ID NO: 134509 - DNA, 25 bp, Rattus norvegicus
agctctgaagccctgtatcgggaaa

SEQ ID NO: 134510 - DNA, 25 bp, Rattus norvegicus
agctctgaagccgtgtatcgggaaa

SEQ ID NO: 134511 - DNA, 25 bp, Rattus norvegicus
agctctgacaacactacgctgttgt

SEQ ID NO: 134512 - DNA, 25 bp, Rattus norvegicus
agctctgacaactctacgctgttgt

SEQ ID NO: 134513 - DNA, 25 bp, Rattus norvegicus
agctctgacacccacagcacagggt

SEQ ID NO: 134514 - DNA, 25 bp, Rattus norvegicus
agctctgacaccgacagcacagggt

SEQ ID NO: 134515 - DNA, 25 bp, Rattus norvegicus
agctctgactagatcttatgccctc

SEQ ID NO: 134516 - DNA, 25 bp, Rattus norvegicus
agctctgactagttcttatgccctc

SEQ ID NO: 134517 - DNA, 25 bp, Rattus norvegicus
agctctgagcccaaatcattgtcaa

SEQ ID NO: 134518 - DNA, 25 bp, Rattus norvegicus
agctctgagccctaatcattgtcaa

SEQ ID NO: 134519 - DNA, 25 bp, Rattus norvegicus
agctctgagctaactgactcactca

SEQ ID NO: 134520 - DNA, 25 bp, Rattus norvegicus
agctctgagctaagacccagcaaaa

SEQ ID NO: 134521 - DNA, 25 bp, Rattus norvegicus
agctctgagctatctgactcactca

SEQ ID NO: 134522 - DNA, 25 bp, Rattus norvegicus
agctctgagctatgacccagcaaaa

SEQ ID NO: 134523 - DNA, 25 bp, Rattus norvegicus
agctctgaggcccagttcaaaacag

SEQ ID NO: 134524 - DNA, 25 bp, Rattus norvegicus
agctctgaggccgagttcaaaacag

SEQ ID NO: 134525 - DNA, 25 bp, Rattus norvegicus
agctctgaggctaggtgggacattt

SEQ ID NO: 134526 - DNA, 25 bp, Rattus norvegicus
agctctgaggctagtgggtgtccta

SEQ ID NO: 134527 - DNA, 25 bp, Rattus norvegicus
agctctgaggcttggtgggacattt

SEQ ID NO: 134528 - DNA, 25 bp, Rattus norvegicus
agctctgaggcttgtgggtgtccta

SEQ ID NO: 134529 - DNA, 25 bp, Rattus norvegicus
agctctgagtgcatgtagacttcgt

SEQ ID NO: 134530 - DNA, 25 bp, Rattus norvegicus
agctctgagtgcttgtagacttcgt

SEQ ID NO: 134531 - DNA, 25 bp, Rattus norvegicus
agctctgagtgtctgaggtctacat

SEQ ID NO: 134532 - DNA, 25 bp, Rattus norvegicus
agctctgagtgtgtgaggtctacat

SEQ ID NO: 134533 - DNA, 25 bp, Rattus norvegicus
agctctgatagcaggaggtccttct

SEQ ID NO: 134534 - DNA, 25 bp, Rattus norvegicus
agctctgatagctggaggtccttct

SEQ ID NO: 134535 - DNA, 25 bp, Rattus norvegicus
agctctgatctcagagttgctctac

SEQ ID NO: 134536 - DNA, 25 bp, Rattus norvegicus
agctctgatctctgagttgctctac

SEQ ID NO: 134537 - DNA, 25 bp, Rattus norvegicus
agctctgcaagacgctggtcagcat

SEQ ID NO: 134538 - DNA, 25 bp, Rattus norvegicus
agctctgcaagaggctggtcagcat

SEQ ID NO: 134539 - DNA, 25 bp, Rattus norvegicus
agctctgcaagcctgaatccacatg

SEQ ID NO: 134540 - DNA, 25 bp, Rattus norvegicus
agctctgcaagcgtgaatccacatg

SEQ ID NO: 134541 - DNA, 25 bp, Rattus norvegicus
agctctgcacaactagatcagccag

SEQ ID NO: 134542 - DNA, 25 bp, Rattus norvegicus
agctctgcacaagtagatcagccag

SEQ ID NO: 134543 - DNA, 25 bp, Rattus norvegicus
agctctgcacagctgatgccttcta

SEQ ID NO: 134544 - DNA, 25 bp, Rattus norvegicus
agctctgcacaggtgatgccttcta

SEQ ID NO: 134545 - DNA, 25 bp, Rattus norvegicus
agctctgcagcccaataaatcggtg

SEQ ID NO: 134546 - DNA, 25 bp, Rattus norvegicus
agctctgcagccctgggccaaagaa

SEQ ID NO: 134547 - DNA, 25 bp, Rattus norvegicus
agctctgcagccgaataaatcggtg

SEQ ID NO: 134548 - DNA, 25 bp, Rattus norvegicus
agctctgcagccgtgggccaaagaa

SEQ ID NO: 134549 - DNA, 25 bp, Rattus norvegicus
agctctgccaggactgcttttggag

SEQ ID NO: 134550 - DNA, 25 bp, Rattus norvegicus
agctctgccaggtctgcttttggag

SEQ ID NO: 134551 - DNA, 25 bp, Rattus norvegicus
agctctgccagtaccagcgtgctgt

SEQ ID NO: 134552 - DNA, 25 bp, Rattus norvegicus
agctctgccagttccagcgtgctgt

SEQ ID NO: 134553 - DNA, 25 bp, Rattus norvegicus
agctctgccataaaaacactgtttc

SEQ ID NO: 134554 - DNA, 25 bp, Rattus norvegicus
agctctgccatataaacactgtttc

SEQ ID NO: 134555 - DNA, 25 bp, Rattus norvegicus
agctctgccattactgtgctgtgtg

SEQ ID NO: 134556 - DNA, 25 bp, Rattus norvegicus
agctctgccatttctgtgctgtgtg

SEQ ID NO: 134557 - DNA, 25 bp, Rattus norvegicus
agctctgcccaaacaatctgtggat

SEQ ID NO: 134558 - DNA, 25 bp, Rattus norvegicus
agctctgcccaatcaatctgtggat

SEQ ID NO: 134559 - DNA, 25 bp, Rattus norvegicus
agctctgcccacagaaggcttattc

SEQ ID NO: 134560 - DNA, 20 bp, Rattus norvegicus
agctctgcccacattcagac

SEQ ID NO: 134561 - DNA, 25 bp, Rattus norvegicus
agctctgcccactgaaggcttattc

SEQ ID NO: 134562 - DNA, 25 bp, Rattus norvegicus
agctctgcccagagttaagttcctg

SEQ ID NO: 134563 - DNA, 25 bp, Rattus norvegicus
agctctgcccagtgttaagttcctg

SEQ ID NO: 134564 - DNA, 20 bp, Rattus norvegicus
agctctgcccccattcagac

SEQ ID NO: 134565 - DNA, 25 bp, Rattus norvegicus
agctctgcccgaaagccagcatggg

SEQ ID NO: 134566 - DNA, 25 bp, Rattus norvegicus
agctctgcccgatagccagcatggg

SEQ ID NO: 134567 - DNA, 20 bp, Rattus norvegicus
agctctgcccgcattcagac

SEQ ID NO: 134568 - DNA, 25 bp, Rattus norvegicus
agctctgcccgtcactcagtgagac

SEQ ID NO: 134569 - DNA, 25 bp, Rattus norvegicus
agctctgcccgtgactcagtgagac

SEQ ID NO: 134570 - DNA, 20 bp, Rattus norvegicus
agctctgccctcattcagac

SEQ ID NO: 134571 - DNA, 25 bp, Rattus norvegicus
agctctgcccttctcataatgttta

SEQ ID NO: 134572 - DNA, 25 bp, Rattus norvegicus
agctctgcccttctcggtccttatg

SEQ ID NO: 134573 - DNA, 25 bp, Rattus norvegicus
agctctgcccttgtcataatgttta

SEQ ID NO: 134574 - DNA, 25 bp, Rattus norvegicus
agctctgcccttgtcggtccttatg

SEQ ID NO: 134575 - DNA, 25 bp, Rattus norvegicus
agctctgccgctcagctgagggacc

SEQ ID NO: 134576 - DNA, 25 bp, Rattus norvegicus
agctctgccgctgagctgagggacc

SEQ ID NO: 134577 - DNA, 25 bp, Rattus norvegicus
agctctgcctaacggctcatagcca

SEQ ID NO: 134578 - DNA, 25 bp, Rattus norvegicus
agctctgcctaagggctcatagcca

SEQ ID NO: 134579 - DNA, 25 bp, Rattus norvegicus
agctctgcctagactttttctcaga

SEQ ID NO: 134580 - DNA, 25 bp, Rattus norvegicus
agctctgcctagtctttttctcaga

SEQ ID NO: 134581 - DNA, 25 bp, Rattus norvegicus
agctctgccttcctgtggagtgtgt

SEQ ID NO: 134582 - DNA, 25 bp, Rattus norvegicus
agctctgccttcgtgtggagtgtgt

SEQ ID NO: 134583 - DNA, 25 bp, Rattus norvegicus
agctctgccttgagcgtcagatgaa

SEQ ID NO: 134584 - DNA, 25 bp, Rattus norvegicus
agctctgccttgtgcgtcagatgaa

SEQ ID NO: 134585 - DNA, 25 bp, Rattus norvegicus
agctctgcctttataacagccacag

SEQ ID NO: 134586 - DNA, 25 bp, Rattus norvegicus
agctctgcctttttaacagccacag

SEQ ID NO: 134587 - DNA, 25 bp, Rattus norvegicus
agctctgcgactatgtgccttcaga

SEQ ID NO: 134588 - DNA, 25 bp, Rattus norvegicus
agctctgcgactttgtgccttcaga

SEQ ID NO: 134589 - DNA, 25 bp, Rattus norvegicus
agctctgcgcaaagctgaggcgcgc

SEQ ID NO: 134590 - DNA, 25 bp, Rattus norvegicus
agctctgcgcaatgctgaggcgcgc

SEQ ID NO: 134591 - DNA, 25 bp, Rattus norvegicus
agctctgcgctccattggattgaaa

SEQ ID NO: 134592 - DNA, 25 bp, Rattus norvegicus
agctctgcgctcgattggattgaaa

SEQ ID NO: 134593 - DNA, 25 bp, Rattus norvegicus
agctctgcgcttacagtgcatgcag

SEQ ID NO: 134594 - DNA, 25 bp, Rattus norvegicus
agctctgcgctttcagtgcatgcag

SEQ ID NO: 134595 - DNA, 25 bp, Rattus norvegicus
agctctgcggtgctgtcttctacag

SEQ ID NO: 134596 - DNA, 25 bp, Rattus norvegicus
agctctgcggtggtgtcttctacag

SEQ ID NO: 134597 - DNA, 25 bp, Rattus norvegicus
agctctgcgtatctgtcctatggcg

SEQ ID NO: 134598 - DNA, 25 bp, Rattus norvegicus
agctctgcgtatgtgtcctatggcg

SEQ ID NO: 134599 - DNA, 25 bp, Rattus norvegicus
agctctgctctgaatttttgccgaa

SEQ ID NO: 134600 - DNA, 25 bp, Rattus norvegicus
agctctgctctgactttgcacgtta

SEQ ID NO: 134601 - DNA, 25 bp, Rattus norvegicus
agctctgctctgtatttttgccgaa

SEQ ID NO: 134602 - DNA, 25 bp, Rattus norvegicus
agctctgctctgtctttgcacgtta

SEQ ID NO: 134603 - DNA, 25 bp, Rattus norvegicus
agctctgctgagagttgatgtccac

SEQ ID NO: 134604 - DNA, 25 bp, Rattus norvegicus
agctctgctgagtgttgatgtccac

SEQ ID NO: 134605 - DNA, 25 bp, Rattus norvegicus
agctctgctgcaagggcacattttt

SEQ ID NO: 134606 - DNA, 25 bp, Rattus norvegicus
agctctgctgcacgacaacatgaag

SEQ ID NO: 134607 - DNA, 25 bp, Rattus norvegicus
agctctgctgcaggacaacatgaag

SEQ ID NO: 134608 - DNA, 25 bp, Rattus norvegicus
agctctgctgcatgggcacattttt

SEQ ID NO: 134609 - DNA, 25 bp, Rattus norvegicus
agctctgctgtccatggcttctgga

SEQ ID NO: 134610 - DNA, 25 bp, Rattus norvegicus
agctctgctgtcgatggcttctgga

SEQ ID NO: 134611 - DNA, 25 bp, Rattus norvegicus
agctctgcttccaggcctggtagaa

SEQ ID NO: 134612 - DNA, 25 bp, Rattus norvegicus
agctctgcttcctggcctggtagaa

SEQ ID NO: 134613 - DNA, 25 bp, Rattus norvegicus
agctctgctttgagctgtccaagac

SEQ ID NO: 134614 - DNA, 25 bp, Rattus norvegicus
agctctgctttgtgctgtccaagac

SEQ ID NO: 134615 - DNA, 25 bp, Rattus norvegicus
agctctggaactcatctttgctgga

SEQ ID NO: 134616 - DNA, 25 bp, Rattus norvegicus
agctctggaactgatctttgctgga

SEQ ID NO: 134617 - DNA, 25 bp, Rattus norvegicus
agctctggaagcctcccaataggac

SEQ ID NO: 134618 - DNA, 25 bp, Rattus norvegicus
agctctggaagcgtcccaataggac

SEQ ID NO: 134619 - DNA, 25 bp, Rattus norvegicus
agctctggacaacaagccttgtgga

SEQ ID NO: 134620 - DNA, 25 bp, Rattus norvegicus
agctctggacaagaagccttgtgga

SEQ ID NO: 134621 - DNA, 25 bp, Rattus norvegicus
agctctggacacaactgaatcacac

SEQ ID NO: 134622 - DNA, 25 bp, Rattus norvegicus
agctctggacactactgaatcacac

SEQ ID NO: 134623 - DNA, 25 bp, Rattus norvegicus
agctctggacagctggtttggacaa

SEQ ID NO: 134624 - DNA, 25 bp, Rattus norvegicus
agctctggacaggtggtttggacaa

SEQ ID NO: 134625 - DNA, 25 bp, Rattus norvegicus
agctctggaccaagtgggcagctta

SEQ ID NO: 134626 - DNA, 25 bp, Rattus norvegicus
agctctggaccatgtgggcagctta

SEQ ID NO: 134627 - DNA, 25 bp, Rattus norvegicus
agctctggactcagagctctgccag

SEQ ID NO: 134628 - DNA, 25 bp, Rattus norvegicus
agctctggactctgagctctgccag

SEQ ID NO: 134629 - DNA, 25 bp, Rattus norvegicus
agctctggactgaagatggcctcta

SEQ ID NO: 134630 - DNA, 25 bp, Rattus norvegicus
agctctggactgtagatggcctcta

SEQ ID NO: 134631 - DNA, 25 bp, Rattus norvegicus
agctctggagatatcttagacctca

SEQ ID NO: 134632 - DNA, 25 bp, Rattus norvegicus
agctctggagatttcttagacctca

SEQ ID NO: 134633 - DNA, 25 bp, Rattus norvegicus
agctctggagctattgggcaacttc

SEQ ID NO: 134634 - DNA, 25 bp, Rattus norvegicus
agctctggagcttttgggcaacttc

SEQ ID NO: 134635 - DNA, 25 bp, Rattus norvegicus
agctctggatctaagtggcacctat

SEQ ID NO: 134636 - DNA, 25 bp, Rattus norvegicus
agctctggatcttagtggcacctat

SEQ ID NO: 134637 - DNA, 25 bp, Rattus norvegicus
agctctggccacagcaagggctgga

SEQ ID NO: 134638 - DNA, 25 bp, Rattus norvegicus
agctctggccactgcaagggctgga

SEQ ID NO: 134639 - DNA, 25 bp, Rattus norvegicus
agctctggccatatacgaatctgtg

SEQ ID NO: 134640 - DNA, 25 bp, Rattus norvegicus
agctctggccatttacgaatctgtg

SEQ ID NO: 134641 - DNA, 25 bp, Rattus norvegicus
agctctggcccacgctcaaagaatg

SEQ ID NO: 134642 - DNA, 25 bp, Rattus norvegicus
agctctggcccaggctcaaagaatg

SEQ ID NO: 134643 - DNA, 25 bp, Rattus norvegicus
agctctggcgccagggatgacaacc

SEQ ID NO: 134644 - DNA, 25 bp, Rattus norvegicus
agctctggcgcctgggatgacaacc

SEQ ID NO: 134645 - DNA, 25 bp, Rattus norvegicus
agctctggctgtatttgacgtgcct

SEQ ID NO: 134646 - DNA, 25 bp, Rattus norvegicus
agctctggctgtttttgacgtgcct

SEQ ID NO: 134647 - DNA, 25 bp, Rattus norvegicus
agctctgggacacctgatcacggtg

SEQ ID NO: 134648 - DNA, 25 bp, Rattus norvegicus
agctctgggacagctgatcacggtg

SEQ ID NO: 134649 - DNA, 25 bp, Rattus norvegicus
agctctgggcagaagttgatcatca

SEQ ID NO: 134650 - DNA, 25 bp, Rattus norvegicus
agctctgggcagtagttgatcatca

SEQ ID NO: 134651 - DNA, 25 bp, Rattus norvegicus
agctctgggccccttatgcttttgg

SEQ ID NO: 134652 - DNA, 25 bp, Rattus norvegicus
agctctgggcccgttatgcttttgg

SEQ ID NO: 134653 - DNA, 25 bp, Rattus norvegicus
agctctgggcctctgtggttattac

SEQ ID NO: 134654 - DNA, 25 bp, Rattus norvegicus
agctctgggcctgtgtggttattac

SEQ ID NO: 134655 - DNA, 25 bp, Rattus norvegicus
agctctgggcgcagaacctgtatga

SEQ ID NO: 134656 - DNA, 25 bp, Rattus norvegicus
agctctgggcgctgaacctgtatga

SEQ ID NO: 134657 - DNA, 25 bp, Rattus norvegicus
agctctgggctgctctctgtgaaga

SEQ ID NO: 134658 - DNA, 25 bp, Rattus norvegicus
agctctgggctggtctctgtgaaga

SEQ ID NO: 134659 - DNA, 25 bp, Rattus norvegicus
agctctgggtacattcagcactcag

SEQ ID NO: 134660 - DNA, 25 bp, Rattus norvegicus
agctctgggtactttcagcactcag

SEQ ID NO: 134661 - DNA, 25 bp, Rattus norvegicus
agctctgggtctcgagctaccttta

SEQ ID NO: 134662 - DNA, 25 bp, Rattus norvegicus
agctctgggtctggagctaccttta

SEQ ID NO: 134663 - DNA, 25 bp, Rattus norvegicus
agctctgggtgcatagtcagccaca

SEQ ID NO: 134664 - DNA, 25 bp, Rattus norvegicus
agctctgggtgcttagtcagccaca

SEQ ID NO: 134665 - DNA, 25 bp, Rattus norvegicus
agctctggtcctagcgcttatggaa

SEQ ID NO: 134666 - DNA, 25 bp, Rattus norvegicus
agctctggtcctctcatgtaagtac

SEQ ID NO: 134667 - DNA, 25 bp, Rattus norvegicus
agctctggtcctgtcatgtaagtac

SEQ ID NO: 134668 - DNA, 25 bp, Rattus norvegicus
agctctggtccttgcgcttatggaa

SEQ ID NO: 134669 - DNA, 25 bp, Rattus norvegicus
agctctggtctcagtattttcaacc

SEQ ID NO: 134670 - DNA, 25 bp, Rattus norvegicus
agctctggtctctgtattttcaacc

SEQ ID NO: 134671 - DNA, 25 bp, Rattus norvegicus
agctctggtgacatctcaggctgtt

SEQ ID NO: 134672 - DNA, 25 bp, Rattus norvegicus
agctctggtgacttctcaggctgtt

SEQ ID NO: 134673 - DNA, 25 bp, Rattus norvegicus
agctctggtgccaatcaaacacatt

SEQ ID NO: 134674 - DNA, 25 bp, Rattus norvegicus
agctctggtgcctatcaaacacatt

SEQ ID NO: 134675 - DNA, 25 bp, Rattus norvegicus
agctctggtgctctgatctgaattc

SEQ ID NO: 134676 - DNA, 25 bp, Rattus norvegicus
agctctggtgctgtgatctgaattc

SEQ ID NO: 134677 - DNA, 25 bp, Rattus norvegicus
agctctggttgcagtggaacttgca

SEQ ID NO: 134678 - DNA, 25 bp, Rattus norvegicus
agctctggttgctgtggaacttgca

SEQ ID NO: 134679 - DNA, 25 bp, Rattus norvegicus
agctctggttgtacacttccttgat

SEQ ID NO: 134680 - DNA, 25 bp, Rattus norvegicus
agctctggttgttcacttccttgat

SEQ ID NO: 134681 - DNA, 25 bp, Rattus norvegicus
agctctgtaagacgtggccaccctg

SEQ ID NO: 134682 - DNA, 25 bp, Rattus norvegicus
agctctgtaagaggtggccaccctg

SEQ ID NO: 134683 - DNA, 25 bp, Rattus norvegicus
agctctgtagaacacattaaggcaa

SEQ ID NO: 134684 - DNA, 25 bp, Rattus norvegicus
agctctgtagaagacattaaggcaa

SEQ ID NO: 134685 - DNA, 25 bp, Rattus norvegicus
agctctgtagagcaattaccctctg

SEQ ID NO: 134686 - DNA, 25 bp, Rattus norvegicus
agctctgtagaggaattaccctctg

SEQ ID NO: 134687 - DNA, 25 bp, Rattus norvegicus
agctctgtatcacggtgagggacca

SEQ ID NO: 134688 - DNA, 25 bp, Rattus norvegicus
agctctgtatcagggtgagggacca

SEQ ID NO: 134689 - DNA, 25 bp, Rattus norvegicus
agctctgtatttagttatggaagtc

SEQ ID NO: 134690 - DNA, 25 bp, Rattus norvegicus
agctctgtatttcggccacttgtta

SEQ ID NO: 134691 - DNA, 25 bp, Rattus norvegicus
agctctgtatttctggtatcggttt

SEQ ID NO: 134692 - DNA, 25 bp, Rattus norvegicus
agctctgtatttgggccacttgtta

SEQ ID NO: 134693 - DNA, 25 bp, Rattus norvegicus
agctctgtatttgtggtatcggttt

SEQ ID NO: 134694 - DNA, 25 bp, Rattus norvegicus
agctctgtattttgttatggaagtc

SEQ ID NO: 134695 - DNA, 25 bp, Rattus norvegicus
agctctgtcacacccaactgggaat

SEQ ID NO: 134696 - DNA, 25 bp, Rattus norvegicus
agctctgtcacagccaactgggaat

SEQ ID NO: 134697 - DNA, 25 bp, Rattus norvegicus
agctctgtccacacagctatggtca

SEQ ID NO: 134698 - DNA, 25 bp, Rattus norvegicus
agctctgtccactcagctatggtca

SEQ ID NO: 134699 - DNA, 25 bp, Rattus norvegicus
agctctgtccctaaaagtctgcaaa

SEQ ID NO: 134700 - DNA, 25 bp, Rattus norvegicus
agctctgtcccttaaagtctgcaaa

SEQ ID NO: 134701 - DNA, 25 bp, Rattus norvegicus
agctctgtcgacattgaccaaaggg

SEQ ID NO: 134702 - DNA, 25 bp, Rattus norvegicus
agctctgtcgacctcattgacacaa

SEQ ID NO: 134703 - DNA, 25 bp, Rattus norvegicus
agctctgtcgacgtcattgacacaa

SEQ ID NO: 134704 - DNA, 25 bp, Rattus norvegicus
agctctgtcgactttgaccaaaggg

SEQ ID NO: 134705 - DNA, 25 bp, Rattus norvegicus
agctctgtctgtcccaatttttgtt

SEQ ID NO: 134706 - DNA, 25 bp, Rattus norvegicus
agctctgtctgtgccaatttttgtt

SEQ ID NO: 134707 - DNA, 25 bp, Rattus norvegicus
agctctgtgaccctggaaagttctg

SEQ ID NO: 134708 - DNA, 25 bp, Rattus norvegicus
agctctgtgaccgtggaaagttctg

SEQ ID NO: 134709 - DNA, 25 bp, Rattus norvegicus
agctctgtgactagtgatactttac

SEQ ID NO: 134710 - DNA, 25 bp, Rattus norvegicus
agctctgtgacttgtgatactttac

SEQ ID NO: 134711 - DNA, 25 bp, Rattus norvegicus
agctctgtgcatacaaacgttagaa

SEQ ID NO: 134712 - DNA, 25 bp, Rattus norvegicus
agctctgtgcattcaaacgttagaa

SEQ ID NO: 134713 - DNA, 25 bp, Rattus norvegicus
agctctgtgctgaaagtttgtgatt

SEQ ID NO: 134714 - DNA, 25 bp, Rattus norvegicus
agctctgtgctgtaagtttgtgatt

SEQ ID NO: 134715 - DNA, 25 bp, Rattus norvegicus
agctctgtgcttcaccccgctaagg

SEQ ID NO: 134716 - DNA, 25 bp, Rattus norvegicus
agctctgtgcttcggtgaactgcag

SEQ ID NO: 134717 - DNA, 25 bp, Rattus norvegicus
agctctgtgcttgaccccgctaagg

SEQ ID NO: 134718 - DNA, 25 bp, Rattus norvegicus
agctctgtgcttgggtgaactgcag

SEQ ID NO: 134719 - DNA, 25 bp, Rattus norvegicus
agctctgtggctagatgtgttttca

SEQ ID NO: 134720 - DNA, 25 bp, Rattus norvegicus
agctctgtggcttgatgtgttttca

SEQ ID NO: 134721 - DNA, 25 bp, Rattus norvegicus
agctctgttcccatgtgtgcctggg

SEQ ID NO: 134722 - DNA, 25 bp, Rattus norvegicus
agctctgttcccttgtgtgcctggg

SEQ ID NO: 134723 - DNA, 25 bp, Rattus norvegicus
agctctgttctgctactgtgtcaat

SEQ ID NO: 134724 - DNA, 25 bp, Rattus norvegicus
agctctgttctggtactgtgtcaat

SEQ ID NO: 134725 - DNA, 25 bp, Rattus norvegicus
agctctgttgagatctgcgatcttc

SEQ ID NO: 134726 - DNA, 25 bp, Rattus norvegicus
agctctgttgagttctgcgatcttc

SEQ ID NO: 134727 - DNA, 25 bp, Rattus norvegicus
agctctgttgatctaagtttaacct

SEQ ID NO: 134728 - DNA, 25 bp, Rattus norvegicus
agctctgttgatgtaagtttaacct

SEQ ID NO: 134729 - DNA, 25 bp, Rattus norvegicus
agctctgttggtctcctggtgctga

SEQ ID NO: 134730 - DNA, 25 bp, Rattus norvegicus
agctctgttggtgtcctggtgctga

SEQ ID NO: 134731 - DNA, 25 bp, Rattus norvegicus
agctctgttgttcgccgtgggaaat

SEQ ID NO: 134732 - DNA, 25 bp, Rattus norvegicus
agctctgttgttggccgtgggaaat

SEQ ID NO: 134733 - DNA, 25 bp, Rattus norvegicus
agctcttaaaccacgctgtaaccag

SEQ ID NO: 134734 - DNA, 25 bp, Rattus norvegicus
agctcttaaacctcgctgtaaccag

SEQ ID NO: 134735 - DNA, 25 bp, Rattus norvegicus
agctcttaatgtcctgctcttgaag

SEQ ID NO: 134736 - DNA, 25 bp, Rattus norvegicus
agctcttaatgtgctgctcttgaag

SEQ ID NO: 134737 - DNA, 25 bp, Rattus norvegicus
agctcttacctactagtttgcctag

SEQ ID NO: 134738 - DNA, 25 bp, Rattus norvegicus
agctcttacctagtagtttgcctag

SEQ ID NO: 134739 - DNA, 25 bp, Rattus norvegicus
agctcttacctgcagaggacctatg

SEQ ID NO: 134740 - DNA, 25 bp, Rattus norvegicus
agctcttacctggagaggacctatg

SEQ ID NO: 134741 - DNA, 25 bp, Rattus norvegicus
agctcttactcactcctttgtggaa

SEQ ID NO: 134742 - DNA, 25 bp, Rattus norvegicus
agctcttactcagtcctttgtggaa

SEQ ID NO: 134743 - DNA, 25 bp, Rattus norvegicus
agctcttagcccattttgatcaatg

SEQ ID NO: 134744 - DNA, 25 bp, Rattus norvegicus
agctcttagccctttttgatcaatg

SEQ ID NO: 134745 - DNA, 25 bp, Rattus norvegicus
agctcttcaagacctaagtggcgat

SEQ ID NO: 134746 - DNA, 25 bp, Rattus norvegicus
agctcttcaagagctaagtggcgat

SEQ ID NO: 134747 - DNA, 25 bp, Rattus norvegicus
agctcttcactcacaccaaaggcgg

SEQ ID NO: 134748 - DNA, 25 bp, Rattus norvegicus
agctcttcactctcaccaaaggcgg

SEQ ID NO: 134749 - DNA, 25 bp, Rattus norvegicus
agctcttcagctaggctgctcaaaa

SEQ ID NO: 134750 - DNA, 25 bp, Rattus norvegicus
agctcttcagcttggctgctcaaaa

SEQ ID NO: 134751 - DNA, 25 bp, Rattus norvegicus
agctcttcagtgctgttacccggaa

SEQ ID NO: 134752 - DNA, 25 bp, Rattus norvegicus
agctcttcagtggtgttacccggaa

SEQ ID NO: 134753 - DNA, 25 bp, Rattus norvegicus
agctcttcatctccaatttctacac

SEQ ID NO: 134754 - DNA, 25 bp, Rattus norvegicus
agctcttcatctgcaatttctacac

SEQ ID NO: 134755 - DNA, 25 bp, Rattus norvegicus
agctcttccaagaacctgggttcct

SEQ ID NO: 134756 - DNA, 25 bp, Rattus norvegicus
agctcttccaagtacctgggttcct

SEQ ID NO: 134757 - DNA, 25 bp, Rattus norvegicus
agctcttccagacttctgctttgaa

SEQ ID NO: 134758 - DNA, 25 bp, Rattus norvegicus
agctcttccagagttctgctttgaa

SEQ ID NO: 134759 - DNA, 25 bp, Rattus norvegicus
agctcttccggaaccagggtcagaa

SEQ ID NO: 134760 - DNA, 25 bp, Rattus norvegicus
agctcttccggacatcactgtagta

SEQ ID NO: 134761 - DNA, 25 bp, Rattus norvegicus
agctcttccggagatcactgtagta

SEQ ID NO: 134762 - DNA, 25 bp, Rattus norvegicus
agctcttccggatccagggtcagaa

SEQ ID NO: 134763 - DNA, 25 bp, Rattus norvegicus
agctcttcctgtaccatgcatatgc

SEQ ID NO: 134764 - DNA, 25 bp, Rattus norvegicus
agctcttcctgttccatgcatatgc

SEQ ID NO: 134765 - DNA, 25 bp, Rattus norvegicus
agctcttccttgacctttgtttctg

SEQ ID NO: 134766 - DNA, 25 bp, Rattus norvegicus
agctcttccttgctaatttcaatag

SEQ ID NO: 134767 - DNA, 25 bp, Rattus norvegicus
agctcttccttggtaatttcaatag

SEQ ID NO: 134768 - DNA, 25 bp, Rattus norvegicus
agctcttccttgtcctttgtttctg

SEQ ID NO: 134769 - DNA, 25 bp, Rattus norvegicus
agctcttctctacacagctacacag

SEQ ID NO: 134770 - DNA, 25 bp, Rattus norvegicus
agctcttctctagacagctacacag

SEQ ID NO: 134771 - DNA, 25 bp, Rattus norvegicus
agctcttctctgcacacacaatggt

SEQ ID NO: 134772 - DNA, 25 bp, Rattus norvegicus
agctcttctctggacacacaatggt

SEQ ID NO: 134773 - DNA, 25 bp, Rattus norvegicus
agctcttctggaagtttccgacagt

SEQ ID NO: 134774 - DNA, 25 bp, Rattus norvegicus
agctcttctggatgtttccgacagt

SEQ ID NO: 134775 - DNA, 25 bp, Rattus norvegicus
agctcttcttcaaacagactcggtg

SEQ ID NO: 134776 - DNA, 25 bp, Rattus norvegicus
agctcttcttcaattgtctcttaaa

SEQ ID NO: 134777 - DNA, 25 bp, Rattus norvegicus
agctcttcttcatacagactcggtg

SEQ ID NO: 134778 - DNA, 25 bp, Rattus norvegicus
agctcttcttcatttgtctcttaaa

SEQ ID NO: 134779 - DNA, 25 bp, Rattus norvegicus
agctcttcttgcaggaggtgcactt

SEQ ID NO: 134780 - DNA, 25 bp, Rattus norvegicus
agctcttcttgctggaggtgcactt

SEQ ID NO: 134781 - DNA, 25 bp, Rattus norvegicus
agctcttgaacaccttcatcttgaa

SEQ ID NO: 134782 - DNA, 25 bp, Rattus norvegicus
agctcttgaacagcttcatcttgaa

SEQ ID NO: 134783 - DNA, 25 bp, Rattus norvegicus
agctcttgacacaacctttttcttt

SEQ ID NO: 134784 - DNA, 25 bp, Rattus norvegicus
agctcttgacactacctttttcttt

SEQ ID NO: 134785 - DNA, 25 bp, Rattus norvegicus
agctcttgactcagcacctgaagtg

SEQ ID NO: 134786 - DNA, 25 bp, Rattus norvegicus
agctcttgactctgcacctgaagtg

SEQ ID NO: 134787 - DNA, 25 bp, Rattus norvegicus
agctcttgagatcctagacctgtgg

SEQ ID NO: 134788 - DNA, 25 bp, Rattus norvegicus
agctcttgagatgctagacctgtgg

SEQ ID NO: 134789 - DNA, 25 bp, Rattus norvegicus
agctcttgagctcatcctataggat

SEQ ID NO: 134790 - DNA, 25 bp, Rattus norvegicus
agctcttgagctgatcctataggat

SEQ ID NO: 134791 - DNA, 25 bp, Rattus norvegicus
agctcttgaggaagctagctcgaga

SEQ ID NO: 134792 - DNA, 25 bp, Rattus norvegicus
agctcttgaggatgctagctcgaga

SEQ ID NO: 134793 - DNA, 25 bp, Rattus norvegicus
agctcttgcaagctctgttccagga

SEQ ID NO: 134794 - DNA, 25 bp, Rattus norvegicus
agctcttgcaaggtctgttccagga

SEQ ID NO: 134795 - DNA, 25 bp, Rattus norvegicus
agctcttgccaaatattcccactga

SEQ ID NO: 134796 - DNA, 25 bp, Rattus norvegicus
agctcttgccaattattcccactga

SEQ ID NO: 134797 - DNA, 25 bp, Rattus norvegicus
agctcttgccacactcagaacagga

SEQ ID NO: 134798 - DNA, 25 bp, Rattus norvegicus
agctcttgccactctcagaacagga

SEQ ID NO: 134799 - DNA, 25 bp, Rattus norvegicus
agctcttgcctgacagatactctgt

SEQ ID NO: 134800 - DNA, 25 bp, Rattus norvegicus
agctcttgcctgtcagatactctgt

SEQ ID NO: 134801 - DNA, 25 bp, Rattus norvegicus
agctcttgccttatggaaacgtgtc

SEQ ID NO: 134802 - DNA, 25 bp, Rattus norvegicus
agctcttgccttttggaaacgtgtc

SEQ ID NO: 134803 - DNA, 25 bp, Rattus norvegicus
agctcttgctaaacagtgtctcaca

SEQ ID NO: 134804 - DNA, 25 bp, Rattus norvegicus
agctcttgctaatcagtgtctcaca

SEQ ID NO: 134805 - DNA, 25 bp, Rattus norvegicus
agctcttgctcgctctgggatgaag

SEQ ID NO: 134806 - DNA, 25 bp, Rattus norvegicus
agctcttgctcggtctgggatgaag

SEQ ID NO: 134807 - DNA, 25 bp, Rattus norvegicus
agctcttgctgcaggaggcatggta

SEQ ID NO: 134808 - DNA, 25 bp, Rattus norvegicus
agctcttgctgctggaggcatggta

SEQ ID NO: 134809 - DNA, 25 bp, Rattus norvegicus
agctcttgctggaccacactggtaa

SEQ ID NO: 134810 - DNA, 25 bp, Rattus norvegicus
agctcttgctggatcactgtggctg

SEQ ID NO: 134811 - DNA, 25 bp, Rattus norvegicus
agctcttgctggtccacactggtaa

SEQ ID NO: 134812 - DNA, 25 bp, Rattus norvegicus
agctcttgctggttcactgtggctg

SEQ ID NO: 134813 - DNA, 25 bp, Rattus norvegicus
agctcttggaggacactgctgagaa

SEQ ID NO: 134814 - DNA, 25 bp, Rattus norvegicus
agctcttggaggtcactgctgagaa

SEQ ID NO: 134815 - DNA, 25 bp, Rattus norvegicus
agctcttggcatctttatttagttt

SEQ ID NO: 134816 - DNA, 25 bp, Rattus norvegicus
agctcttggcatgtttatttagttt

SEQ ID NO: 134817 - DNA, 25 bp, Rattus norvegicus
agctcttggctgctggcgatgctaa

SEQ ID NO: 134818 - DNA, 25 bp, Rattus norvegicus
agctcttggctggtggcgatgctaa

SEQ ID NO: 134819 - DNA, 25 bp, Rattus norvegicus
agctcttggtgtacattattgaata

SEQ ID NO: 134820 - DNA, 25 bp, Rattus norvegicus
agctcttggtgttcattattgaata

SEQ ID NO: 134821 - DNA, 25 bp, Rattus norvegicus
agctcttgtatgatgtctcctcgga

SEQ ID NO: 134822 - DNA, 25 bp, Rattus norvegicus
agctcttgtatgttgtctcctcgga

SEQ ID NO: 134823 - DNA, 25 bp, Rattus norvegicus
agctcttgtcctctactgcattgta

SEQ ID NO: 134824 - DNA, 25 bp, Rattus norvegicus
agctcttgtcctgtactgcattgta

SEQ ID NO: 134825 - DNA, 25 bp, Rattus norvegicus
agctcttgtcttcttgacctggatg

SEQ ID NO: 134826 - DNA, 25 bp, Rattus norvegicus
agctcttgtcttgttgacctggatg

SEQ ID NO: 134827 - DNA, 25 bp, Rattus norvegicus
agctcttgtgccctggagatgaagc

SEQ ID NO: 134828 - DNA, 25 bp, Rattus norvegicus
agctcttgtgccgtggagatgaagc

SEQ ID NO: 134829 - DNA, 25 bp, Rattus norvegicus
agctcttgtgtcataatggttacca

SEQ ID NO: 134830 - DNA, 25 bp, Rattus norvegicus
agctcttgtgtccagttacagtgcc

SEQ ID NO: 134831 - DNA, 25 bp, Rattus norvegicus
agctcttgtgtcgagttacagtgcc

SEQ ID NO: 134832 - DNA, 25 bp, Rattus norvegicus
agctcttgtgtcttaatggttacca

SEQ ID NO: 134833 - DNA, 25 bp, Rattus norvegicus
agctcttgttccactggactaaggg

SEQ ID NO: 134834 - DNA, 25 bp, Rattus norvegicus
agctcttgttcctctggactaaggg

SEQ ID NO: 134835 - DNA, 25 bp, Rattus norvegicus
agctctttaagacggacctgccacc

SEQ ID NO: 134836 - DNA, 25 bp, Rattus norvegicus
agctctttaagagggacctgccacc

SEQ ID NO: 134837 - DNA, 25 bp, Rattus norvegicus
agctctttaagtcatccttgttctg

SEQ ID NO: 134838 - DNA, 25 bp, Rattus norvegicus
agctctttaagtgatccttgttctg

SEQ ID NO: 134839 - DNA, 25 bp, Rattus norvegicus
agctctttaatcagcagtccaaatg

SEQ ID NO: 134840 - DNA, 25 bp, Rattus norvegicus
agctctttaatctgcagtccaaatg

SEQ ID NO: 134841 - DNA, 25 bp, Rattus norvegicus
agctctttagagatagccccaggca

SEQ ID NO: 134842 - DNA, 25 bp, Rattus norvegicus
agctctttagagttagccccaggca

SEQ ID NO: 134843 - DNA, 25 bp, Rattus norvegicus
agctctttagttcatcctttctgtt

SEQ ID NO: 134844 - DNA, 25 bp, Rattus norvegicus
agctctttagttgatcctttctgtt

SEQ ID NO: 134845 - DNA, 25 bp, Rattus norvegicus
agctctttatctcggaggccctgtt

SEQ ID NO: 134846 - DNA, 25 bp, Rattus norvegicus
agctctttatctgggaggccctgtt

SEQ ID NO: 134847 - DNA, 25 bp, Rattus norvegicus
agctctttcacaccattaaggactt

SEQ ID NO: 134848 - DNA, 25 bp, Rattus norvegicus
agctctttcacagcattaaggactt

SEQ ID NO: 134849 - DNA, 25 bp, Rattus norvegicus
agctctttccacaaactgcactgtg

SEQ ID NO: 134850 - DNA, 25 bp, Rattus norvegicus
agctctttccactaactgcactgtg

SEQ ID NO: 134851 - DNA, 25 bp, Rattus norvegicus
agctctttccagaacgtgctgcagg

SEQ ID NO: 134852 - DNA, 25 bp, Rattus norvegicus
agctctttccagtacgtgctgcagg

SEQ ID NO: 134853 - DNA, 25 bp, Rattus norvegicus
agctctttccctagtcatagcaata

SEQ ID NO: 134854 - DNA, 25 bp, Rattus norvegicus
agctctttcccttgtcatagcaata

SEQ ID NO: 134855 - DNA, 25 bp, Rattus norvegicus
agctctttcctgatccgtagtatga

SEQ ID NO: 134856 - DNA, 25 bp, Rattus norvegicus
agctctttcctgttccgtagtatga

SEQ ID NO: 134857 - DNA, 25 bp, Rattus norvegicus
agctctttctccatgctgactgtag

SEQ ID NO: 134858 - DNA, 25 bp, Rattus norvegicus
agctctttctccttgctgactgtag

SEQ ID NO: 134859 - DNA, 25 bp, Rattus norvegicus
agctctttctgcaggtcattctgtt

SEQ ID NO: 134860 - DNA, 25 bp, Rattus norvegicus
agctctttctgctggtcattctgtt

SEQ ID NO: 134861 - DNA, 25 bp, Rattus norvegicus
agctctttcttcaggtccacatgtg

SEQ ID NO: 134862 - DNA, 25 bp, Rattus norvegicus
agctctttcttctggtccacatgtg

SEQ ID NO: 134863 - DNA, 25 bp, Rattus norvegicus
agctctttgagaaattttctgaatc

SEQ ID NO: 134864 - DNA, 25 bp, Rattus norvegicus
agctctttgagatattttctgaatc

SEQ ID NO: 134865 - DNA, 25 bp, Rattus norvegicus
agctctttgaggcagcccaaagcca

SEQ ID NO: 134866 - DNA, 25 bp, Rattus norvegicus
agctctttgagggagcccaaagcca

SEQ ID NO: 134867 - DNA, 25 bp, Rattus norvegicus
agctctttgcttacgtttactagtc

SEQ ID NO: 134868 - DNA, 25 bp, Rattus norvegicus
agctctttgcttatgtacctacaga

SEQ ID NO: 134869 - DNA, 25 bp, Rattus norvegicus
agctctttgctttcgtttactagtc

SEQ ID NO: 134870 - DNA, 25 bp, Rattus norvegicus
agctctttgcttttgtacctacaga

SEQ ID NO: 134871 - DNA, 25 bp, Rattus norvegicus
agctctttggctacatcaaggcatc

SEQ ID NO: 134872 - DNA, 25 bp, Rattus norvegicus
agctctttggcttcatcaaggcatc

SEQ ID NO: 134873 - DNA, 25 bp, Rattus norvegicus
agctctttgggcattatggcaggta

SEQ ID NO: 134874 - DNA, 25 bp, Rattus norvegicus
agctctttgggctttatggcaggta

SEQ ID NO: 134875 - DNA, 25 bp, Rattus norvegicus
agctctttggttactaagtctggat

SEQ ID NO: 134876 - DNA, 25 bp, Rattus norvegicus
agctctttggtttctaagtctggat

SEQ ID NO: 134877 - DNA, 25 bp, Rattus norvegicus
agctctttgttgatagtctctgtgt

SEQ ID NO: 134878 - DNA, 25 bp, Rattus norvegicus
agctctttgttgttagtctctgtgt

SEQ ID NO: 134879 - DNA, 25 bp, Rattus norvegicus
agctcttttcctatttgggacacag

SEQ ID NO: 134880 - DNA, 25 bp, Rattus norvegicus
agctcttttcctttttgggacacag

SEQ ID NO: 134881 - DNA, 25 bp, Rattus norvegicus
agctcttttgtgacttccctaggat

SEQ ID NO: 134882 - DNA, 25 bp, Rattus norvegicus
agctcttttgtgcttctttgttgaa

SEQ ID NO: 134883 - DNA, 25 bp, Rattus norvegicus
agctcttttgtggttctttgttgaa

SEQ ID NO: 134884 - DNA, 25 bp, Rattus norvegicus
agctcttttgtgtcttccctaggat

SEQ ID NO: 134885 - DNA, 25 bp, Rattus norvegicus
agctcttttgttccttttagtgtga

SEQ ID NO: 134886 - DNA, 25 bp, Rattus norvegicus
agctcttttgttgcttttagtgtga

SEQ ID NO: 134887 - DNA, 25 bp, Rattus norvegicus
agctctttttgcctgggagatccaa

SEQ ID NO: 134888 - DNA, 25 bp, Rattus norvegicus
agctctttttgcgtgggagatccaa

SEQ ID NO: 134889 - DNA, 25 bp, Rattus norvegicus
agctcttttttaagcttggcttcct

SEQ ID NO: 134890 - DNA, 25 bp, Rattus norvegicus
agctcttttttatgcttggcttcct

SEQ ID NO: 134891 - DNA, 25 bp, Rattus norvegicus
agctgaaaacatccactggcttctt

SEQ ID NO: 134892 - DNA, 25 bp, Rattus norvegicus
agctgaaaacatgcactggcttctt

SEQ ID NO: 134893 - DNA, 25 bp, Rattus norvegicus
agctgaaaccacatgcaacatgatt

SEQ ID NO: 134894 - DNA, 25 bp, Rattus norvegicus
agctgaaaccacttgcaacatgatt

SEQ ID NO: 134895 - DNA, 25 bp, Rattus norvegicus
agctgaaactgtaggtgcacacaca

SEQ ID NO: 134896 - DNA, 25 bp, Rattus norvegicus
agctgaaactgttggtgcacacaca

SEQ ID NO: 134897 - DNA, 25 bp, Rattus norvegicus
agctgaaacttgagaccctcttgac

SEQ ID NO: 134898 - DNA, 25 bp, Rattus norvegicus
agctgaaacttgtgaccctcttgac

SEQ ID NO: 134899 - DNA, 25 bp, Rattus norvegicus
agctgaaagaacaatcctgtccctc

SEQ ID NO: 134900 - DNA, 25 bp, Rattus norvegicus
agctgaaagaactatcctgtccctc

SEQ ID NO: 134901 - DNA, 25 bp, Rattus norvegicus
agctgaaagtcgagttacctgggat

SEQ ID NO: 134902 - DNA, 25 bp, Rattus norvegicus
agctgaaagtcgtgttacctgggat

SEQ ID NO: 134903 - DNA, 25 bp, Rattus norvegicus
agctgaaagtggactgccctggttc

SEQ ID NO: 134904 - DNA, 25 bp, Rattus norvegicus
agctgaaagtggtctgccctggttc

SEQ ID NO: 134905 - DNA, 25 bp, Rattus norvegicus
agctgaaatgaacaggacctctgca

SEQ ID NO: 134906 - DNA, 25 bp, Rattus norvegicus
agctgaaatgaagaggacctctgca

SEQ ID NO: 134907 - DNA, 25 bp, Rattus norvegicus
agctgaaatgtcaccccaaaactta

SEQ ID NO: 134908 - DNA, 25 bp, Rattus norvegicus
agctgaaatgtctccccaaaactta

SEQ ID NO: 134909 - DNA, 25 bp, Rattus norvegicus
agctgaacagttcccacgacaagta

SEQ ID NO: 134910 - DNA, 25 bp, Rattus norvegicus
agctgaacagttgccacgacaagta

SEQ ID NO: 134911 - DNA, 25 bp, Rattus norvegicus
agctgaacatctacctgcagaggga

SEQ ID NO: 134912 - DNA, 25 bp, Rattus norvegicus
agctgaacatcttcctgcagaggga

SEQ ID NO: 134913 - DNA, 25 bp, Rattus norvegicus
agctgaaccaaacccaaatgcctga

SEQ ID NO: 134914 - DNA, 25 bp, Rattus norvegicus
agctgaaccaaagccaaatgcctga

SEQ ID NO: 134915 - DNA, 25 bp, Rattus norvegicus
agctgaacccgactttgctacagtt

SEQ ID NO: 134916 - DNA, 25 bp, Rattus norvegicus
agctgaacccgagtttgctacagtt

SEQ ID NO: 134917 - DNA, 25 bp, Rattus norvegicus
agctgaaccgagagtctgtgcgcgc

SEQ ID NO: 134918 - DNA, 25 bp, Rattus norvegicus
agctgaaccgagtgtctgtgcgcgc

SEQ ID NO: 134919 - DNA, 25 bp, Rattus norvegicus
agctgaacctctctgagactcaggt

SEQ ID NO: 134920 - DNA, 25 bp, Rattus norvegicus
agctgaacctctgtgagactcaggt

SEQ ID NO: 134921 - DNA, 25 bp, Rattus norvegicus
agctgaacgaccagtgggaccaaat

SEQ ID NO: 134922 - DNA, 25 bp, Rattus norvegicus
agctgaacgacctgtgggaccaaat

SEQ ID NO: 134923 - DNA, 25 bp, Rattus norvegicus
agctgaacgcttatacccactggta

SEQ ID NO: 134924 - DNA, 25 bp, Rattus norvegicus
agctgaacgcttttacccactggta

SEQ ID NO: 134925 - DNA, 25 bp, Rattus norvegicus
agctgaactctcaggtccagcctga

SEQ ID NO: 134926 - DNA, 25 bp, Rattus norvegicus
agctgaactctctggtccagcctga

SEQ ID NO: 134927 - DNA, 25 bp, Rattus norvegicus
agctgaactgctcctttatttttta

SEQ ID NO: 134928 - DNA, 25 bp, Rattus norvegicus
agctgaactgctgctttatttttta

SEQ ID NO: 134929 - DNA, 25 bp, Rattus norvegicus
agctgaacttgtacaggctgcttct

SEQ ID NO: 134930 - DNA, 25 bp, Rattus norvegicus
agctgaacttgtccctggactgcaa

SEQ ID NO: 134931 - DNA, 25 bp, Rattus norvegicus
agctgaacttgtgcctggactgcaa

SEQ ID NO: 134932 - DNA, 25 bp, Rattus norvegicus
agctgaacttgttcaggctgcttct

SEQ ID NO: 134933 - DNA, 25 bp, Rattus norvegicus
agctgaactttgcacctacaagtga

SEQ ID NO: 134934 - DNA, 25 bp, Rattus norvegicus
agctgaactttgcagtgggacacag

SEQ ID NO: 134935 - DNA, 25 bp, Rattus norvegicus
agctgaactttggacctacaagtga

SEQ ID NO: 134936 - DNA, 25 bp, Rattus norvegicus
agctgaactttggagtgggacacag

SEQ ID NO: 134937 - DNA, 25 bp, Rattus norvegicus
agctgaagacacatccgatctgctt

SEQ ID NO: 134938 - DNA, 25 bp, Rattus norvegicus
agctgaagacacttccgatctgctt

SEQ ID NO: 134939 - DNA, 25 bp, Rattus norvegicus
agctgaagacctcttacgtagagga

SEQ ID NO: 134940 - DNA, 25 bp, Rattus norvegicus
agctgaagacctgttacgtagagga

SEQ ID NO: 134941 - DNA, 25 bp, Rattus norvegicus
agctgaagacgtctgctccctgcat

SEQ ID NO: 134942 - DNA, 25 bp, Rattus norvegicus
agctgaagacgtgtgctccctgcat

SEQ ID NO: 134943 - DNA, 25 bp, Rattus norvegicus
agctgaagactacgtcggcctcaaa

SEQ ID NO: 134944 - DNA, 25 bp, Rattus norvegicus
agctgaagactaggtcggcctcaaa

SEQ ID NO: 134945 - DNA, 25 bp, Rattus norvegicus
agctgaagatgtacttctcacccat

SEQ ID NO: 134946 - DNA, 25 bp, Rattus norvegicus
agctgaagatgttcttctcacccat

SEQ ID NO: 134947 - DNA, 25 bp, Rattus norvegicus
agctgaagcagtactggctgacctt

SEQ ID NO: 134948 - DNA, 25 bp, Rattus norvegicus
agctgaagcagttctggctgacctt

SEQ ID NO: 134949 - DNA, 25 bp, Rattus norvegicus
agctgaagccagcaggacctttcca

SEQ ID NO: 134950 - DNA, 25 bp, Rattus norvegicus
agctgaagccaggaggacctttcca

SEQ ID NO: 134951 - DNA, 25 bp, Rattus norvegicus
agctgaagccccagagaatgtggtt

SEQ ID NO: 134952 - DNA, 25 bp, Rattus norvegicus
agctgaagcccctgagaatgtggtt

SEQ ID NO: 134953 - DNA, 25 bp, Rattus norvegicus
agctgaagccctcctgatgtttgta

SEQ ID NO: 134954 - DNA, 25 bp, Rattus norvegicus
agctgaagccctgctgatgtttgta

SEQ ID NO: 134955 - DNA, 25 bp, Rattus norvegicus
agctgaagccgcagtgcaacaactc

SEQ ID NO: 134956 - DNA, 25 bp, Rattus norvegicus
agctgaagccgctgtgcaacaactc

SEQ ID NO: 134957 - DNA, 25 bp, Rattus norvegicus
agctgaagccttcaagaccgggctt

SEQ ID NO: 134958 - DNA, 25 bp, Rattus norvegicus
agctgaagccttgaagaccgggctt

SEQ ID NO: 134959 - DNA, 25 bp, Rattus norvegicus
agctgaagcgctcctcccggacgta

SEQ ID NO: 134960 - DNA, 25 bp, Rattus norvegicus
agctgaagcgctgctcccggacgta

SEQ ID NO: 134961 - DNA, 25 bp, Rattus norvegicus
agctgaagcttcacccataattcag

SEQ ID NO: 134962 - DNA, 25 bp, Rattus norvegicus
agctgaagcttcacctgtacaatga

SEQ ID NO: 134963 - DNA, 25 bp, Rattus norvegicus
agctgaagcttctcccataattcag

SEQ ID NO: 134964 - DNA, 25 bp, Rattus norvegicus
agctgaagcttctcctgtacaatga

SEQ ID NO: 134965 - DNA, 25 bp, Rattus norvegicus
agctgaaggacgcagtcacactaca

SEQ ID NO: 134966 - DNA, 25 bp, Rattus norvegicus
agctgaaggacggagtcacactaca

SEQ ID NO: 134967 - DNA, 25 bp, Rattus norvegicus
agctgaaggagcagagccccagcgt

SEQ ID NO: 134968 - DNA, 25 bp, Rattus norvegicus
agctgaaggagctgagccccagcgt

SEQ ID NO: 134969 - DNA, 25 bp, Rattus norvegicus
agctgaaggcgcacagtgcacacaa

SEQ ID NO: 134970 - DNA, 25 bp, Rattus norvegicus
agctgaaggcgctcagtgcacacaa

SEQ ID NO: 134971 - DNA, 25 bp, Rattus norvegicus
agctgaaggctcagttagaccaaga

SEQ ID NO: 134972 - DNA, 25 bp, Rattus norvegicus
agctgaaggctcctctttcattctg

SEQ ID NO: 134973 - DNA, 25 bp, Rattus norvegicus
agctgaaggctcgtctttcattctg

SEQ ID NO: 134974 - DNA, 25 bp, Rattus norvegicus
agctgaaggctctgttagaccaaga

SEQ ID NO: 134975 - DNA, 25 bp, Rattus norvegicus
agctgaagtcttcaagtctgggctt

SEQ ID NO: 134976 - DNA, 25 bp, Rattus norvegicus
agctgaagtcttgaagtctgggctt

SEQ ID NO: 134977 - DNA, 25 bp, Rattus norvegicus
agctgaagttcccttctggcaacta

SEQ ID NO: 134978 - DNA, 25 bp, Rattus norvegicus
agctgaagttccgttctggcaacta

SEQ ID NO: 134979 - DNA, 25 bp, Rattus norvegicus
agctgaatacctactctttgaagac

SEQ ID NO: 134980 - DNA, 25 bp, Rattus norvegicus
agctgaataccttctctttgaagac

SEQ ID NO: 134981 - DNA, 25 bp, Rattus norvegicus
agctgaatagacatgctgtcaacag

SEQ ID NO: 134982 - DNA, 25 bp, Rattus norvegicus
agctgaatagacttgctgtcaacag

SEQ ID NO: 134983 - DNA, 25 bp, Rattus norvegicus
agctgaatattgctcttctcaatga

SEQ ID NO: 134984 - DNA, 25 bp, Rattus norvegicus
agctgaatattggtcttctcaatga

SEQ ID NO: 134985 - DNA, 25 bp, Rattus norvegicus
agctgaatcaccaactcaatctctt

SEQ ID NO: 134986 - DNA, 25 bp, Rattus norvegicus
agctgaatcacctactcaatctctt

SEQ ID NO: 134987 - DNA, 25 bp, Rattus norvegicus
agctgaatcgttactcgatgctctc

SEQ ID NO: 134988 - DNA, 25 bp, Rattus norvegicus
agctgaatcgtttctcgatgctctc

SEQ ID NO: 134989 - DNA, 25 bp, Rattus norvegicus
agctgaatgaacaggctcgcgccga

SEQ ID NO: 134990 - DNA, 25 bp, Rattus norvegicus
agctgaatgaactggctcgcgccga

SEQ ID NO: 134991 - DNA, 25 bp, Rattus norvegicus
agctgaatgccacaggattctccca

SEQ ID NO: 134992 - DNA, 25 bp, Rattus norvegicus
agctgaatgccagaggattctccca

SEQ ID NO: 134993 - DNA, 25 bp, Rattus norvegicus
agctgaatgccgcttggttttccct

SEQ ID NO: 134994 - DNA, 25 bp, Rattus norvegicus
agctgaatgccggttggttttccct

SEQ ID NO: 134995 - DNA, 25 bp, Rattus norvegicus
agctgaatgggtatgcaatccatag

SEQ ID NO: 134996 - DNA, 25 bp, Rattus norvegicus
agctgaatgggtttgcaatccatag

SEQ ID NO: 134997 - DNA, 25 bp, Rattus norvegicus
agctgaatgtacctcgtccttccaa

SEQ ID NO: 134998 - DNA, 25 bp, Rattus norvegicus
agctgaatgtacgtcgtccttccaa

SEQ ID NO: 134999 - DNA, 25 bp, Rattus norvegicus
agctgaatgtgacccgggcgcttcc

SEQ ID NO: 135000 - DNA, 25 bp, Rattus norvegicus
agctgaatgtgagccgggcgcttcc

SEQ ID NO: 135001 - DNA, 25 bp, Rattus norvegicus
agctgaattctgcaccttggtcatg

SEQ ID NO: 135002 - DNA, 25 bp, Rattus norvegicus
agctgaattctggaccttggtcatg

SEQ ID NO: 135003 - DNA, 25 bp, Rattus norvegicus
agctgaattggtcgactctgctcaa

SEQ ID NO: 135004 - DNA, 25 bp, Rattus norvegicus
agctgaattggtggactctgctcaa

SEQ ID NO: 135005 - DNA, 25 bp, Rattus norvegicus
agctgaatttgaacccacgtgtaga

SEQ ID NO: 135006 - DNA, 25 bp, Rattus norvegicus
agctgaatttgatcccacgtgtaga

SEQ ID NO: 135007 - DNA, 25 bp, Rattus norvegicus
agctgacaaagactacggcttgatg

SEQ ID NO: 135008 - DNA, 25 bp, Rattus norvegicus
agctgacaaagagtacggcttgatg

SEQ ID NO: 135009 - DNA, 25 bp, Rattus norvegicus
agctgacaactgctcttgtgctgaa

SEQ ID NO: 135010 - DNA, 25 bp, Rattus norvegicus
agctgacaactggtcttgtgctgaa

SEQ ID NO: 135011 - DNA, 25 bp, Rattus norvegicus
agctgacacactctcggacactaga

SEQ ID NO: 135012 - DNA, 25 bp, Rattus norvegicus
agctgacacactgtcggacactaga

SEQ ID NO: 135013 - DNA, 25 bp, Rattus norvegicus
agctgacacagccatatcatcatcc

SEQ ID NO: 135014 - DNA, 25 bp, Rattus norvegicus
agctgacacagcgatatcatcatcc

SEQ ID NO: 135015 - DNA, 25 bp, Rattus norvegicus
agctgacacgccatgctaggaatga

SEQ ID NO: 135016 - DNA, 25 bp, Rattus norvegicus
agctgacacgccttgctaggaatga

SEQ ID NO: 135017 - DNA, 25 bp, Rattus norvegicus
agctgacactctcaagccttggcag

SEQ ID NO: 135018 - DNA, 25 bp, Rattus norvegicus
agctgacactctgaagccttggcag

SEQ ID NO: 135019 - DNA, 25 bp, Rattus norvegicus
agctgacagactattggttggccca

SEQ ID NO: 135020 - DNA, 25 bp, Rattus norvegicus
agctgacagacttttggttggccca

SEQ ID NO: 135021 - DNA, 25 bp, Rattus norvegicus
agctgacagagaagccgctacagtc

SEQ ID NO: 135022 - DNA, 25 bp, Rattus norvegicus
agctgacagagatgccgctacagtc

SEQ ID NO: 135023 - DNA, 25 bp, Rattus norvegicus
agctgacagcatagcttacgcagga

SEQ ID NO: 135024 - DNA, 25 bp, Rattus norvegicus
agctgacagcatatacctatgtgta

SEQ ID NO: 135025 - DNA, 25 bp, Rattus norvegicus
agctgacagcattgcttacgcagga

SEQ ID NO: 135026 - DNA, 25 bp, Rattus norvegicus
agctgacagcatttacctatgtgta

SEQ ID NO: 135027 - DNA, 25 bp, Rattus norvegicus
agctgacagccaaggccaatggcct

SEQ ID NO: 135028 - DNA, 25 bp, Rattus norvegicus
agctgacagccatggccaatggcct

SEQ ID NO: 135029 - DNA, 25 bp, Rattus norvegicus
agctgacagctaaggctctgggaga

SEQ ID NO: 135030 - DNA, 25 bp, Rattus norvegicus
agctgacagctaatcctggattcca

SEQ ID NO: 135031 - DNA, 25 bp, Rattus norvegicus
agctgacagctatggctctgggaga

SEQ ID NO: 135032 - DNA, 25 bp, Rattus norvegicus
agctgacagctattcctggattcca

SEQ ID NO: 135033 - DNA, 25 bp, Rattus norvegicus
agctgacagctgcagttccgtagaa

SEQ ID NO: 135034 - DNA, 25 bp, Rattus norvegicus
agctgacagctggagttccgtagaa

SEQ ID NO: 135035 - DNA, 25 bp, Rattus norvegicus
agctgacagcttagacttttttaca

SEQ ID NO: 135036 - DNA, 25 bp, Rattus norvegicus
agctgacagctttgacttttttaca

SEQ ID NO: 135037 - DNA, 25 bp, Rattus norvegicus
agctgacaggctctgaaatatggaa

SEQ ID NO: 135038 - DNA, 25 bp, Rattus norvegicus
agctgacaggctgtgaaatatggaa

SEQ ID NO: 135039 - DNA, 25 bp, Rattus norvegicus
agctgacaggttagttatctaatca

SEQ ID NO: 135040 - DNA, 25 bp, Rattus norvegicus
agctgacaggtttgttatctaatca

SEQ ID NO: 135041 - DNA, 25 bp, Rattus norvegicus
agctgacagtctcaagccaccaggt

SEQ ID NO: 135042 - DNA, 25 bp, Rattus norvegicus
agctgacagtctgaagccaccaggt

SEQ ID NO: 135043 - DNA, 25 bp, Rattus norvegicus
agctgacatactctcacagtgtcaa

SEQ ID NO: 135044 - DNA, 25 bp, Rattus norvegicus
agctgacatactgtcacagtgtcaa

SEQ ID NO: 135045 - DNA, 25 bp, Rattus norvegicus
agctgacatcagaaacacaacaaaa

SEQ ID NO: 135046 - DNA, 25 bp, Rattus norvegicus
agctgacatcagtaacacaacaaaa

SEQ ID NO: 135047 - DNA, 25 bp, Rattus norvegicus
agctgacattacacaacgcacactt

SEQ ID NO: 135048 - DNA, 25 bp, Rattus norvegicus
agctgacattactcaacgcacactt

SEQ ID NO: 135049 - DNA, 25 bp, Rattus norvegicus
agctgacatttaataccttacactg

SEQ ID NO: 135050 - DNA, 25 bp, Rattus norvegicus
agctgacatttattaccttacactg

SEQ ID NO: 135051 - DNA, 25 bp, Rattus norvegicus
agctgaccactacaaatccaatctt

SEQ ID NO: 135052 - DNA, 25 bp, Rattus norvegicus
agctgaccactagaaatccaatctt

SEQ ID NO: 135053 - DNA, 25 bp, Rattus norvegicus
agctgacccagaagttccagaggtt

SEQ ID NO: 135054 - DNA, 25 bp, Rattus norvegicus
agctgacccagatgttccagaggtt

SEQ ID NO: 135055 - DNA, 25 bp, Rattus norvegicus
agctgacccaggaccaggatgtgga

SEQ ID NO: 135056 - DNA, 25 bp, Rattus norvegicus
agctgacccaggctgttctaggtag

SEQ ID NO: 135057 - DNA, 25 bp, Rattus norvegicus
agctgacccagggtgttctaggtag

SEQ ID NO: 135058 - DNA, 25 bp, Rattus norvegicus
agctgacccaggtccaggatgtgga

SEQ ID NO: 135059 - DNA, 25 bp, Rattus norvegicus
agctgaccccagatgatgaggacgt

SEQ ID NO: 135060 - DNA, 25 bp, Rattus norvegicus
agctgaccccagttgatgaggacgt

SEQ ID NO: 135061 - DNA, 25 bp, Rattus norvegicus
agctgaccttatcttacctatctgc

SEQ ID NO: 135062 - DNA, 25 bp, Rattus norvegicus
agctgaccttatgttacctatctgc

SEQ ID NO: 135063 - DNA, 25 bp, Rattus norvegicus
agctgaccttgtaggtgctgcggac

SEQ ID NO: 135064 - DNA, 25 bp, Rattus norvegicus
agctgaccttgttggtgctgcggac

SEQ ID NO: 135065 - DNA, 25 bp, Rattus norvegicus
agctgacgccgcaaacggtgatgga

SEQ ID NO: 135066 - DNA, 25 bp, Rattus norvegicus
agctgacgccgctaacggtgatgga

SEQ ID NO: 135067 - DNA, 25 bp, Rattus norvegicus
agctgacggcacacagtggagatga

SEQ ID NO: 135068 - DNA, 25 bp, Rattus norvegicus
agctgacggcactcagtggagatga

SEQ ID NO: 135069 - DNA, 25 bp, Rattus norvegicus
agctgacgtacactttggttttcat

SEQ ID NO: 135070 - DNA, 25 bp, Rattus norvegicus
agctgacgtacagtttggttttcat

SEQ ID NO: 135071 - DNA, 25 bp, Rattus norvegicus
agctgacgtactcccgttctgggca

SEQ ID NO: 135072 - DNA, 25 bp, Rattus norvegicus
agctgacgtactgccgttctgggca

SEQ ID NO: 135073 - DNA, 25 bp, Rattus norvegicus
agctgacgtgccctctagagaatga

SEQ ID NO: 135074 - DNA, 25 bp, Rattus norvegicus
agctgacgtgccgtctagagaatga

SEQ ID NO: 135075 - DNA, 25 bp, Rattus norvegicus
agctgactacagattatgaggcact

SEQ ID NO: 135076 - DNA, 25 bp, Rattus norvegicus
agctgactacagtttatgaggcact

SEQ ID NO: 135077 - DNA, 25 bp, Rattus norvegicus
agctgactactgaaaaatttccata

SEQ ID NO: 135078 - DNA, 25 bp, Rattus norvegicus
agctgactactgtaaaatttccata

SEQ ID NO: 135079 - DNA, 25 bp, Rattus norvegicus
agctgactagctccccaaagataca

SEQ ID NO: 135080 - DNA, 25 bp, Rattus norvegicus
agctgactagctgcccaaagataca

SEQ ID NO: 135081 - DNA, 25 bp, Rattus norvegicus
agctgactctcgctttccacgggaa

SEQ ID NO: 135082 - DNA, 25 bp, Rattus norvegicus
agctgactctcggtttccacgggaa

SEQ ID NO: 135083 - DNA, 25 bp, Rattus norvegicus
agctgactctgtctttcactgtgcc

SEQ ID NO: 135084 - DNA, 25 bp, Rattus norvegicus
agctgactctgtgtttcactgtgcc

SEQ ID NO: 135085 - DNA, 25 bp, Rattus norvegicus
agctgactgaacaatggcatttgca

SEQ ID NO: 135086 - DNA, 25 bp, Rattus norvegicus
agctgactgaactatggcatttgca

SEQ ID NO: 135087 - DNA, 25 bp, Rattus norvegicus
agctgactgctgaaggcccgagtaa

SEQ ID NO: 135088 - DNA, 25 bp, Rattus norvegicus
agctgactgctgtaggcccgagtaa

SEQ ID NO: 135089 - DNA, 25 bp, Rattus norvegicus
agctgactgcttctgctgttgaagt

SEQ ID NO: 135090 - DNA, 25 bp, Rattus norvegicus
agctgactgcttgtgctgttgaagt

SEQ ID NO: 135091 - DNA, 25 bp, Rattus norvegicus
agctgactggaccatttgcagggaa

SEQ ID NO: 135092 - DNA, 25 bp, Rattus norvegicus
agctgactggacgatttgcagggaa

SEQ ID NO: 135093 - DNA, 25 bp, Rattus norvegicus
agctgactggagaagctgccattct

SEQ ID NO: 135094 - DNA, 25 bp, Rattus norvegicus
agctgactggagctttagccacaga

SEQ ID NO: 135095 - DNA, 25 bp, Rattus norvegicus
agctgactggaggtttagccacaga

SEQ ID NO: 135096 - DNA, 25 bp, Rattus norvegicus
agctgactggagtagctgccattct

SEQ ID NO: 135097 - DNA, 25 bp, Rattus norvegicus
agctgactgggacgaaaatgctgtc

SEQ ID NO: 135098 - DNA, 25 bp, Rattus norvegicus
agctgactgggaggaaaatgctgtc

SEQ ID NO: 135099 - DNA, 25 bp, Rattus norvegicus
agctgactgtatacacaaccttgat

SEQ ID NO: 135100 - DNA, 25 bp, Rattus norvegicus
agctgactgtattcacaaccttgat

SEQ ID NO: 135101 - DNA, 25 bp, Rattus norvegicus
agctgacttagacacgtacttctcc

SEQ ID NO: 135102 - DNA, 25 bp, Rattus norvegicus
agctgacttagagacgtacttctcc

SEQ ID NO: 135103 - DNA, 25 bp, Rattus norvegicus
agctgacttcaaaaggaggcgcaca

SEQ ID NO: 135104 - DNA, 25 bp, Rattus norvegicus
agctgacttcaaacctggcccaggt

SEQ ID NO: 135105 - DNA, 25 bp, Rattus norvegicus
agctgacttcaataggaggcgcaca

SEQ ID NO: 135106 - DNA, 25 bp, Rattus norvegicus
agctgacttcaatcctggcccaggt

SEQ ID NO: 135107 - DNA, 25 bp, Rattus norvegicus
agctgacttcagagagggcctctct

SEQ ID NO: 135108 - DNA, 25 bp, Rattus norvegicus
agctgacttcagtgagggcctctct

SEQ ID NO: 135109 - DNA, 25 bp, Rattus norvegicus
agctgacttcttagtatctcgatac

SEQ ID NO: 135110 - DNA, 25 bp, Rattus norvegicus
agctgacttctttgtatctcgatac

SEQ ID NO: 135111 - DNA, 25 bp, Rattus norvegicus
agctgactttctatttaagccacct

SEQ ID NO: 135112 - DNA, 25 bp, Rattus norvegicus
agctgactttctttttaagccacct

SEQ ID NO: 135113 - DNA, 25 bp, Rattus norvegicus
agctgacttttcattgcagttgtcc

SEQ ID NO: 135114 - DNA, 25 bp, Rattus norvegicus
agctgacttttctttgcagttgtcc

SEQ ID NO: 135115 - DNA, 25 bp, Rattus norvegicus
agctgactttttccgaagccataag

SEQ ID NO: 135116 - DNA, 25 bp, Rattus norvegicus
agctgactttttgcgaagccataag

SEQ ID NO: 135117 - DNA, 25 bp, Rattus norvegicus
agctgagaacgtcggttttgcctcc

SEQ ID NO: 135118 - DNA, 25 bp, Rattus norvegicus
agctgagaacgtgggttttgcctcc

SEQ ID NO: 135119 - DNA, 25 bp, Rattus norvegicus
agctgagaagctatgcccaacaaca

SEQ ID NO: 135120 - DNA, 25 bp, Rattus norvegicus
agctgagaagctttgcccaacaaca

SEQ ID NO: 135121 - DNA, 25 bp, Rattus norvegicus
agctgagaagtccatgccatatttt

SEQ ID NO: 135122 - DNA, 25 bp, Rattus norvegicus
agctgagaagtcgatgccatatttt

SEQ ID NO: 135123 - DNA, 25 bp, Rattus norvegicus
agctgagaccagcacacctgtggcc

SEQ ID NO: 135124 - DNA, 25 bp, Rattus norvegicus
agctgagaccaggacacctgtggcc

SEQ ID NO: 135125 - DNA, 25 bp, Rattus norvegicus
agctgagaccccagtgctgtgccta

SEQ ID NO: 135126 - DNA, 25 bp, Rattus norvegicus
agctgagacccctgtgctgtgccta

SEQ ID NO: 135127 - DNA, 25 bp, Rattus norvegicus
agctgagacctgctcgtccgcggaa

SEQ ID NO: 135128 - DNA, 25 bp, Rattus norvegicus
agctgagacctggtcgtccgcggaa

SEQ ID NO: 135129 - DNA, 25 bp, Rattus norvegicus
agctgagacgttacctgaagacttc

SEQ ID NO: 135130 - DNA, 25 bp, Rattus norvegicus
agctgagacgtttcctgaagacttc

SEQ ID NO: 135131 - DNA, 25 bp, Rattus norvegicus
agctgagagactatcggctgaggtc

SEQ ID NO: 135132 - DNA, 25 bp, Rattus norvegicus
agctgagagactttcggctgaggtc

SEQ ID NO: 135133 - DNA, 25 bp, Rattus norvegicus
agctgagaggtcacttcttgtggcc

SEQ ID NO: 135134 - DNA, 25 bp, Rattus norvegicus
agctgagaggtctcttcttgtggcc

SEQ ID NO: 135135 - DNA, 25 bp, Rattus norvegicus
agctgagatcagatgcctaggcatg

SEQ ID NO: 135136 - DNA, 25 bp, Rattus norvegicus
agctgagatcagttgcctaggcatg

SEQ ID NO: 135137 - DNA, 25 bp, Rattus norvegicus
agctgagatgcacgagttcctttca

SEQ ID NO: 135138 - DNA, 25 bp, Rattus norvegicus
agctgagatgcaggagttcctttca

SEQ ID NO: 135139 - DNA, 25 bp, Rattus norvegicus
agctgagatgggactttctgctgat

SEQ ID NO: 135140 - DNA, 25 bp, Rattus norvegicus
agctgagatgggtctttctgctgat

SEQ ID NO: 135141 - DNA, 25 bp, Rattus norvegicus
agctgagcaaacatctcgagttaac

SEQ ID NO: 135142 - DNA, 25 bp, Rattus norvegicus
agctgagcaaacttctcgagttaac

SEQ ID NO: 135143 - DNA, 25 bp, Rattus norvegicus
agctgagcaactacctggaggatga

SEQ ID NO: 135144 - DNA, 25 bp, Rattus norvegicus
agctgagcaacttcctggaggatga

SEQ ID NO: 135145 - DNA, 25 bp, Rattus norvegicus
agctgagcaaggagccactgattca

SEQ ID NO: 135146 - DNA, 25 bp, Rattus norvegicus
agctgagcaaggtgccactgattca

SEQ ID NO: 135147 - DNA, 25 bp, Rattus norvegicus
agctgagcagacactcactgtggca

SEQ ID NO: 135148 - DNA, 25 bp, Rattus norvegicus
agctgagcagactctcactgtggca

SEQ ID NO: 135149 - DNA, 25 bp, Rattus norvegicus
agctgagcaggcacagggctgtcat

SEQ ID NO: 135150 - DNA, 25 bp, Rattus norvegicus
agctgagcaggcactgtcacggcag

SEQ ID NO: 135151 - DNA, 25 bp, Rattus norvegicus
agctgagcaggctcagggctgtcat

SEQ ID NO: 135152 - DNA, 25 bp, Rattus norvegicus
agctgagcaggctctgtcacggcag

SEQ ID NO: 135153 - DNA, 25 bp, Rattus norvegicus
agctgagcatccactcaaaccagat

SEQ ID NO: 135154 - DNA, 25 bp, Rattus norvegicus
agctgagcatcctctcaaaccagat

SEQ ID NO: 135155 - DNA, 25 bp, Rattus norvegicus
agctgagccacgacatttaagtcca

SEQ ID NO: 135156 - DNA, 25 bp, Rattus norvegicus
agctgagccacgaggagacggacac

SEQ ID NO: 135157 - DNA, 25 bp, Rattus norvegicus
agctgagccacgtcatttaagtcca

SEQ ID NO: 135158 - DNA, 25 bp, Rattus norvegicus
agctgagccacgtggagacggacac

SEQ ID NO: 135159 - DNA, 25 bp, Rattus norvegicus
agctgagccagaaaaggaccacccc

SEQ ID NO: 135160 - DNA, 25 bp, Rattus norvegicus
agctgagccagataaggaccacccc

SEQ ID NO: 135161 - DNA, 25 bp, Rattus norvegicus
agctgagccccacgacagagtggtc

SEQ ID NO: 135162 - DNA, 25 bp, Rattus norvegicus
agctgagccccaggacagagtggtc

SEQ ID NO: 135163 - DNA, 25 bp, Rattus norvegicus
agctgagccctcagaccttggaaag

SEQ ID NO: 135164 - DNA, 25 bp, Rattus norvegicus
agctgagccctcctacaggttctgt

SEQ ID NO: 135165 - DNA, 25 bp, Rattus norvegicus
agctgagccctcgtacaggttctgt

SEQ ID NO: 135166 - DNA, 25 bp, Rattus norvegicus
agctgagccctctgaccttggaaag

SEQ ID NO: 135167 - DNA, 25 bp, Rattus norvegicus
agctgagccctgactgtccagatca

SEQ ID NO: 135168 - DNA, 25 bp, Rattus norvegicus
agctgagccctgtctgtccagatca

SEQ ID NO: 135169 - DNA, 25 bp, Rattus norvegicus
agctgagcccttcgacagcagcagg

SEQ ID NO: 135170 - DNA, 25 bp, Rattus norvegicus
agctgagcccttggacagcagcagg

SEQ ID NO: 135171 - DNA, 25 bp, Rattus norvegicus
agctgagccgttcccgcttctggaa

SEQ ID NO: 135172 - DNA, 25 bp, Rattus norvegicus
agctgagccgttgccgcttctggaa

SEQ ID NO: 135173 - DNA, 25 bp, Rattus norvegicus
agctgagcctccagtgatgttagtg

SEQ ID NO: 135174 - DNA, 25 bp, Rattus norvegicus
agctgagcctcctgtgatgttagtg

SEQ ID NO: 135175 - DNA, 25 bp, Rattus norvegicus
agctgagcctggcaggctacccacc

SEQ ID NO: 135176 - DNA, 25 bp, Rattus norvegicus
agctgagcctgggaggctacccacc

SEQ ID NO: 135177 - DNA, 25 bp, Rattus norvegicus
agctgagcctgtcaaaggaggttca

SEQ ID NO: 135178 - DNA, 25 bp, Rattus norvegicus
agctgagcctgtgaaaggaggttca

SEQ ID NO: 135179 - DNA, 25 bp, Rattus norvegicus
agctgagcgaccaccagagcattct

SEQ ID NO: 135180 - DNA, 25 bp, Rattus norvegicus
agctgagcgacctccagagcattct

SEQ ID NO: 135181 - DNA, 25 bp, Rattus norvegicus
agctgagcgagcagcaactgcacct

SEQ ID NO: 135182 - DNA, 25 bp, Rattus norvegicus
agctgagcgagctgcaactgcacct

SEQ ID NO: 135183 - DNA, 25 bp, Rattus norvegicus
agctgagcgctacaaacccctgtgg

SEQ ID NO: 135184 - DNA, 25 bp, Rattus norvegicus
agctgagcgctagaaacccctgtgg

SEQ ID NO: 135185 - DNA, 25 bp, Rattus norvegicus
agctgagcgctgcaattgccctttc

SEQ ID NO: 135186 - DNA, 25 bp, Rattus norvegicus
agctgagcgctggaattgccctttc

SEQ ID NO: 135187 - DNA, 25 bp, Rattus norvegicus
agctgagcgtcgagccctacagtca

SEQ ID NO: 135188 - DNA, 25 bp, Rattus norvegicus
agctgagcgtcgtgccctacagtca

SEQ ID NO: 135189 - DNA, 25 bp, Rattus norvegicus
agctgagctactattaactttttct

SEQ ID NO: 135190 - DNA, 25 bp, Rattus norvegicus
agctgagctacttttaactttttct

SEQ ID NO: 135191 - DNA, 25 bp, Rattus norvegicus
agctgagctattatgcttcctgggc

SEQ ID NO: 135192 - DNA, 25 bp, Rattus norvegicus
agctgagctattttgcttcctgggc

SEQ ID NO: 135193 - DNA, 25 bp, Rattus norvegicus
agctgagctcagacgcctattagac

SEQ ID NO: 135194 - DNA, 25 bp, Rattus norvegicus
agctgagctcagtcgcctattagac

SEQ ID NO: 135195 - DNA, 25 bp, Rattus norvegicus
agctgagctgcaacaccagacagaa

SEQ ID NO: 135196 - DNA, 25 bp, Rattus norvegicus
agctgagctgcatcaccagacagaa

SEQ ID NO: 135197 - DNA, 25 bp, Rattus norvegicus
agctgagctgctatcctggagactt

SEQ ID NO: 135198 - DNA, 25 bp, Rattus norvegicus
agctgagctgctccgtgcctggtac

SEQ ID NO: 135199 - DNA, 25 bp, Rattus norvegicus
agctgagctgctgcgtgcctggtac

SEQ ID NO: 135200 - DNA, 25 bp, Rattus norvegicus
agctgagctgctttcctggagactt

SEQ ID NO: 135201 - DNA, 25 bp, Rattus norvegicus
agctgagctgttaaggaggctcccc

SEQ ID NO: 135202 - DNA, 25 bp, Rattus norvegicus
agctgagctgtttaggaggctcccc

SEQ ID NO: 135203 - DNA, 25 bp, Rattus norvegicus
agctgagcttccaggaagacgctca

SEQ ID NO: 135204 - DNA, 25 bp, Rattus norvegicus
agctgagcttcctggaagacgctca

SEQ ID NO: 135205 - DNA, 25 bp, Rattus norvegicus
agctgaggacttcgatgacttgctg

SEQ ID NO: 135206 - DNA, 25 bp, Rattus norvegicus
agctgaggacttggatgacttgctg

SEQ ID NO: 135207 - DNA, 25 bp, Rattus norvegicus
agctgaggagcaacgctgaaagcac

SEQ ID NO: 135208 - DNA, 25 bp, Rattus norvegicus
agctgaggagcatcgctgaaagcac

SEQ ID NO: 135209 - DNA, 25 bp, Rattus norvegicus
agctgaggagttacttcggcctttc

SEQ ID NO: 135210 - DNA, 25 bp, Rattus norvegicus
agctgaggagtttcttcggcctttc

SEQ ID NO: 135211 - DNA, 25 bp, Rattus norvegicus
agctgaggatgccatgcgcctgtac

SEQ ID NO: 135212 - DNA, 25 bp, Rattus norvegicus
agctgaggatgcgatgcgcctgtac

SEQ ID NO: 135213 - DNA, 25 bp, Rattus norvegicus
agctgaggcagaaagtgactaccgt

SEQ ID NO: 135214 - DNA, 25 bp, Rattus norvegicus
agctgaggcagatagtgactaccgt

SEQ ID NO: 135215 - DNA, 25 bp, Rattus norvegicus
agctgaggcaggaaacctccctctt

SEQ ID NO: 135216 - DNA, 25 bp, Rattus norvegicus
agctgaggcaggtaacctccctctt

SEQ ID NO: 135217 - DNA, 25 bp, Rattus norvegicus
agctgaggccagatgtggtgacaca

SEQ ID NO: 135218 - DNA, 25 bp, Rattus norvegicus
agctgaggccagttgtggtgacaca

SEQ ID NO: 135219 - DNA, 25 bp, Rattus norvegicus
agctgaggctagacgcaagaagcac

SEQ ID NO: 135220 - DNA, 25 bp, Rattus norvegicus
agctgaggctagtcgcaagaagcac

SEQ ID NO: 135221 - DNA, 25 bp, Rattus norvegicus
agctgaggctcccaatttcatggtg

SEQ ID NO: 135222 - DNA, 25 bp, Rattus norvegicus
agctgaggctccgaatttcatggtg

SEQ ID NO: 135223 - DNA, 25 bp, Rattus norvegicus
agctgaggctggaattgccacacct

SEQ ID NO: 135224 - DNA, 25 bp, Rattus norvegicus
agctgaggctggtattgccacacct

SEQ ID NO: 135225 - DNA, 25 bp, Rattus norvegicus
agctgagggaaaacccggcgtgctt

SEQ ID NO: 135226 - DNA, 25 bp, Rattus norvegicus
agctgagggaaatcccggcgtgctt

SEQ ID NO: 135227 - DNA, 25 bp, Rattus norvegicus
agctgagggagaccaccatcatcat

SEQ ID NO: 135228 - DNA, 25 bp, Rattus norvegicus
agctgagggagagcaccatcatcat

SEQ ID NO: 135229 - DNA, 25 bp, Rattus norvegicus
agctgagggcagcatttatctgacc

SEQ ID NO: 135230 - DNA, 25 bp, Rattus norvegicus
agctgagggcaggatttatctgacc

SEQ ID NO: 135231 - DNA, 25 bp, Rattus norvegicus
agctgagggcatccactgcagctca

SEQ ID NO: 135232 - DNA, 25 bp, Rattus norvegicus
agctgagggcatgcactgcagctca

SEQ ID NO: 135233 - DNA, 25 bp, Rattus norvegicus
agctgagggcctccaaggtccgcgt

SEQ ID NO: 135234 - DNA, 25 bp, Rattus norvegicus
agctgagggcctgcaaggtccgcgt

SEQ ID NO: 135235 - DNA, 25 bp, Rattus norvegicus
agctgagggctcagctgaagcaacc

SEQ ID NO: 135236 - DNA, 25 bp, Rattus norvegicus
agctgagggctctgctgaagcaacc

SEQ ID NO: 135237 - DNA, 25 bp, Rattus norvegicus
agctgagggtcactggattctaatc

SEQ ID NO: 135238 - DNA, 25 bp, Rattus norvegicus
agctgagggtcagtggattctaatc

SEQ ID NO: 135239 - DNA, 25 bp, Rattus norvegicus
agctgaggttgcagtgggatacctt

SEQ ID NO: 135240 - DNA, 25 bp, Rattus norvegicus
agctgaggttgctgtgggatacctt

SEQ ID NO: 135241 - DNA, 25 bp, Rattus norvegicus
agctgagtaacaagctcccacagat

SEQ ID NO: 135242 - DNA, 25 bp, Rattus norvegicus
agctgagtaacatgctcccacagat

SEQ ID NO: 135243 - DNA, 25 bp, Rattus norvegicus
agctgagtaggccatcctctgtcag

SEQ ID NO: 135244 - DNA, 25 bp, Rattus norvegicus
agctgagtaggcgatcctctgtcag

SEQ ID NO: 135245 - DNA, 25 bp, Rattus norvegicus
agctgagtcccgatgctggaggtat

SEQ ID NO: 135246 - DNA, 25 bp, Rattus norvegicus
agctgagtcccgatggcgtcgctgc

SEQ ID NO: 135247 - DNA, 25 bp, Rattus norvegicus
agctgagtcccgttgctggaggtat

SEQ ID NO: 135248 - DNA, 25 bp, Rattus norvegicus
agctgagtcccgttggcgtcgctgc

SEQ ID NO: 135249 - DNA, 25 bp, Rattus norvegicus
agctgagtcctgaatgtgccttgca

SEQ ID NO: 135250 - DNA, 25 bp, Rattus norvegicus
agctgagtcctgtatgtgccttgca

SEQ ID NO: 135251 - DNA, 25 bp, Rattus norvegicus
agctgagtccttaaaagagtccggt

SEQ ID NO: 135252 - DNA, 25 bp, Rattus norvegicus
agctgagtcctttaaagagtccggt

SEQ ID NO: 135253 - DNA, 25 bp, Rattus norvegicus
agctgagtgaagactgctcctgcat

SEQ ID NO: 135254 - DNA, 25 bp, Rattus norvegicus
agctgagtgaagtctgctcctgcat

SEQ ID NO: 135255 - DNA, 25 bp, Rattus norvegicus
agctgagtgccccaccgagtagagc

SEQ ID NO: 135256 - DNA, 25 bp, Rattus norvegicus
agctgagtgcccgaccgagtagagc

SEQ ID NO: 135257 - DNA, 25 bp, Rattus norvegicus
agctgagtgctgactgttctagcgt

SEQ ID NO: 135258 - DNA, 25 bp, Rattus norvegicus
agctgagtgctgtctgttctagcgt

SEQ ID NO: 135259 - DNA, 25 bp, Rattus norvegicus
agctgagtgggcctaaagtcccttg

SEQ ID NO: 135260 - DNA, 25 bp, Rattus norvegicus
agctgagtgggcgtaaagtcccttg

SEQ ID NO: 135261 - DNA, 25 bp, Rattus norvegicus
agctgagttatcacgcttggagaac

SEQ ID NO: 135262 - DNA, 25 bp, Rattus norvegicus
agctgagttatctcgcttggagaac

SEQ ID NO: 135263 - DNA, 25 bp, Rattus norvegicus
agctgatacagcaccgccaagacct

SEQ ID NO: 135264 - DNA, 25 bp, Rattus norvegicus
agctgatacagctccgccaagacct

SEQ ID NO: 135265 - DNA, 25 bp, Rattus norvegicus
agctgatacctaaaactttctgcaa

SEQ ID NO: 135266 - DNA, 25 bp, Rattus norvegicus
agctgatacctaaatgtgggttatt

SEQ ID NO: 135267 - DNA, 25 bp, Rattus norvegicus
agctgatacctataactttctgcaa

SEQ ID NO: 135268 - DNA, 25 bp, Rattus norvegicus
agctgatacctatatgtgggttatt

SEQ ID NO: 135269 - DNA, 25 bp, Rattus norvegicus
agctgataggatcgcgctcctccat

SEQ ID NO: 135270 - DNA, 25 bp, Rattus norvegicus
agctgataggatggcgctcctccat

SEQ ID NO: 135271 - DNA, 25 bp, Rattus norvegicus
agctgatatgtgatctattgactga

SEQ ID NO: 135272 - DNA, 25 bp, Rattus norvegicus
agctgatatgtgttctattgactga

SEQ ID NO: 135273 - DNA, 25 bp, Rattus norvegicus
agctgatcagctaatggaccactca

SEQ ID NO: 135274 - DNA, 25 bp, Rattus norvegicus
agctgatcagcttatggaccactca

SEQ ID NO: 135275 - DNA, 25 bp, Rattus norvegicus
agctgatccagcactaccatcgctt

SEQ ID NO: 135276 - DNA, 25 bp, Rattus norvegicus
agctgatccagcatgtggctgtgac

SEQ ID NO: 135277 - DNA, 25 bp, Rattus norvegicus
agctgatccagctctaccatcgctt

SEQ ID NO: 135278 - DNA, 25 bp, Rattus norvegicus
agctgatccagcttgtggctgtgac

SEQ ID NO: 135279 - DNA, 25 bp, Rattus norvegicus
agctgatccagtatgggcttatgaa

SEQ ID NO: 135280 - DNA, 25 bp, Rattus norvegicus
agctgatccagtttgggcttatgaa

SEQ ID NO: 135281 - DNA, 25 bp, Rattus norvegicus
agctgatcccagctttcgagatggt

SEQ ID NO: 135282 - DNA, 25 bp, Rattus norvegicus
agctgatcccaggtttcgagatggt

SEQ ID NO: 135283 - DNA, 25 bp, Rattus norvegicus
agctgatcccatactttgtgacttc

SEQ ID NO: 135284 - DNA, 25 bp, Rattus norvegicus
agctgatcccattctttgtgacttc

SEQ ID NO: 135285 - DNA, 25 bp, Rattus norvegicus
agctgatccccaattatgcatggag

SEQ ID NO: 135286 - DNA, 25 bp, Rattus norvegicus
agctgatccccatttatgcatggag

SEQ ID NO: 135287 - DNA, 25 bp, Rattus norvegicus
agctgatcccttcggcgattcagaa

SEQ ID NO: 135288 - DNA, 25 bp, Rattus norvegicus
agctgatcccttgggcgattcagaa

SEQ ID NO: 135289 - DNA, 25 bp, Rattus norvegicus
agctgatccgatacattgacaacca

SEQ ID NO: 135290 - DNA, 25 bp, Rattus norvegicus
agctgatccgattcattgacaacca

SEQ ID NO: 135291 - DNA, 25 bp, Rattus norvegicus
agctgatcctctctaatctcgggta

SEQ ID NO: 135292 - DNA, 25 bp, Rattus norvegicus
agctgatcctctgtaatctcgggta

SEQ ID NO: 135293 - DNA, 25 bp, Rattus norvegicus
agctgatcgcctagattcgagccaa

SEQ ID NO: 135294 - DNA, 25 bp, Rattus norvegicus
agctgatcgccttgattcgagccaa

SEQ ID NO: 135295 - DNA, 25 bp, Rattus norvegicus
agctgatcggctactgttgtaaaca

SEQ ID NO: 135296 - DNA, 25 bp, Rattus norvegicus
agctgatcggcttctgttgtaaaca

SEQ ID NO: 135297 - DNA, 25 bp, Rattus norvegicus
agctgatcgtccacaggtatgcaga

SEQ ID NO: 135298 - DNA, 25 bp, Rattus norvegicus
agctgatcgtcctcaggtatgcaga

SEQ ID NO: 135299 - DNA, 25 bp, Rattus norvegicus
agctgatctcctatggaaaagccct

SEQ ID NO: 135300 - DNA, 25 bp, Rattus norvegicus
agctgatctcctttggaaaagccct

SEQ ID NO: 135301 - DNA, 25 bp, Rattus norvegicus
agctgatgacttccttgtcttcctg

SEQ ID NO: 135302 - DNA, 25 bp, Rattus norvegicus
agctgatgacttgcttgtcttcctg

SEQ ID NO: 135303 - DNA, 25 bp, Rattus norvegicus
agctgatgcaccagtggttgctctg

SEQ ID NO: 135304 - DNA, 25 bp, Rattus norvegicus
agctgatgcacctgtggttgctctg

SEQ ID NO: 135305 - DNA, 25 bp, Rattus norvegicus
agctgatgcagcctgctcgtgcaag

SEQ ID NO: 135306 - DNA, 25 bp, Rattus norvegicus
agctgatgcagcgtgctcgtgcaag

SEQ ID NO: 135307 - DNA, 25 bp, Rattus norvegicus
agctgatgccaaactccgagcaaaa

SEQ ID NO: 135308 - DNA, 25 bp, Rattus norvegicus
agctgatgccaatctccgagcaaaa

SEQ ID NO: 135309 - DNA, 25 bp, Rattus norvegicus
agctgatgcctcagcacttgtaggt

SEQ ID NO: 135310 - DNA, 25 bp, Rattus norvegicus
agctgatgcctctgcacttgtaggt

SEQ ID NO: 135311 - DNA, 25 bp, Rattus norvegicus
agctgatgcctgataaactgattca

SEQ ID NO: 135312 - DNA, 25 bp, Rattus norvegicus
agctgatgcctgttaaactgattca

SEQ ID NO: 135313 - DNA, 25 bp, Rattus norvegicus
agctgatgctgcctgtttatctcga

SEQ ID NO: 135314 - DNA, 25 bp, Rattus norvegicus
agctgatgctgcgtgtttatctcga

SEQ ID NO: 135315 - DNA, 25 bp, Rattus norvegicus
agctgatgcttgaacaaccccaggg

SEQ ID NO: 135316 - DNA, 25 bp, Rattus norvegicus
agctgatgcttgtacaaccccaggg

SEQ ID NO: 135317 - DNA, 25 bp, Rattus norvegicus
agctgatgctttaattgccctgcag

SEQ ID NO: 135318 - DNA, 25 bp, Rattus norvegicus
agctgatgcttttattgccctgcag

SEQ ID NO: 135319 - DNA, 25 bp, Rattus norvegicus
agctgatggaggagtcgtctttgtt

SEQ ID NO: 135320 - DNA, 25 bp, Rattus norvegicus
agctgatggaggtgtcgtctttgtt

SEQ ID NO: 135321 - DNA, 25 bp, Rattus norvegicus
agctgatggccgagcgttgcgtccc

SEQ ID NO: 135322 - DNA, 25 bp, Rattus norvegicus
agctgatggccgtgcgttgcgtccc

SEQ ID NO: 135323 - DNA, 25 bp, Rattus norvegicus
agctgatgggtaacccagcaccaaa

SEQ ID NO: 135324 - DNA, 25 bp, Rattus norvegicus
agctgatgggtatcccagcaccaaa

SEQ ID NO: 135325 - DNA, 25 bp, Rattus norvegicus
agctgatggtttcctgctgcccata

SEQ ID NO: 135326 - DNA, 25 bp, Rattus norvegicus
agctgatggtttctagattctcttc

SEQ ID NO: 135327 - DNA, 25 bp, Rattus norvegicus
agctgatggtttgctgctgcccata

SEQ ID NO: 135328 - DNA, 25 bp, Rattus norvegicus
agctgatggtttgtagattctcttc

SEQ ID NO: 135329 - DNA, 25 bp, Rattus norvegicus
agctgatgtagccagtgtcttcccc

SEQ ID NO: 135330 - DNA, 25 bp, Rattus norvegicus
agctgatgtagcgagtgtcttcccc

SEQ ID NO: 135331 - DNA, 25 bp, Rattus norvegicus
agctgatgtattaccctgtgctgat

SEQ ID NO: 135332 - DNA, 25 bp, Rattus norvegicus
agctgatgtatttccctgtgctgat

SEQ ID NO: 135333 - DNA, 25 bp, Rattus norvegicus
agctgatgtcaaccagtaatcccag

SEQ ID NO: 135334 - DNA, 25 bp, Rattus norvegicus
agctgatgtcaagcagtaatcccag

SEQ ID NO: 135335 - DNA, 25 bp, Rattus norvegicus
agctgatgtcatattgccaagtgtg

SEQ ID NO: 135336 - DNA, 25 bp, Rattus norvegicus
agctgatgtcattttgccaagtgtg

SEQ ID NO: 135337 - DNA, 25 bp, Rattus norvegicus
agctgatgtgctaatgtgtcccctg

SEQ ID NO: 135338 - DNA, 25 bp, Rattus norvegicus
agctgatgtgcttatgtgtcccctg

SEQ ID NO: 135339 - DNA, 25 bp, Rattus norvegicus
agctgatgtgtactggagtcctctg

SEQ ID NO: 135340 - DNA, 25 bp, Rattus norvegicus
agctgatgtgtagtggagtcctctg

SEQ ID NO: 135341 - DNA, 25 bp, Rattus norvegicus
agctgatgtgtgagggcacctgcca

SEQ ID NO: 135342 - DNA, 25 bp, Rattus norvegicus
agctgatgtgtgcagaacccaccat

SEQ ID NO: 135343 - DNA, 25 bp, Rattus norvegicus
agctgatgtgtggagaacccaccat

SEQ ID NO: 135344 - DNA, 25 bp, Rattus norvegicus
agctgatgtgtgtgggcacctgcca

SEQ ID NO: 135345 - DNA, 25 bp, Rattus norvegicus
agctgattacttctgccagccgaga

SEQ ID NO: 135346 - DNA, 25 bp, Rattus norvegicus
agctgattacttgtgccagccgaga

SEQ ID NO: 135347 - DNA, 25 bp, Rattus norvegicus
agctgattcgctaagctcttgtcct

SEQ ID NO: 135348 - DNA, 25 bp, Rattus norvegicus
agctgattcgcttagctcttgtcct

SEQ ID NO: 135349 - DNA, 25 bp, Rattus norvegicus
agctgattcggtacctagagccaga

SEQ ID NO: 135350 - DNA, 25 bp, Rattus norvegicus
agctgattcggttcctagagccaga

SEQ ID NO: 135351 - DNA, 25 bp, Rattus norvegicus
agctgattgctgaccgagagatttc

SEQ ID NO: 135352 - DNA, 25 bp, Rattus norvegicus
agctgattgctgtccgagagatttc

SEQ ID NO: 135353 - DNA, 25 bp, Rattus norvegicus
agctgattgtcaccgccacaaaaca

SEQ ID NO: 135354 - DNA, 25 bp, Rattus norvegicus
agctgattgtcagcgccacaaaaca

SEQ ID NO: 135355 - DNA, 25 bp, Rattus norvegicus
agctgatttttcacttaactgtact

SEQ ID NO: 135356 - DNA, 25 bp, Rattus norvegicus
agctgatttttctcttaactgtact

SEQ ID NO: 135357 - DNA, 25 bp, Rattus norvegicus
agctgcaaagctaggaggcttccca

SEQ ID NO: 135358 - DNA, 25 bp, Rattus norvegicus
agctgcaaagcttggaggcttccca

SEQ ID NO: 135359 - DNA, 25 bp, Rattus norvegicus
agctgcaaaggcctgggcccacaga

SEQ ID NO: 135360 - DNA, 25 bp, Rattus norvegicus
agctgcaaaggcgtgggcccacaga

SEQ ID NO: 135361 - DNA, 25 bp, Rattus norvegicus
agctgcaacatcctttttaacaatt

SEQ ID NO: 135362 - DNA, 25 bp, Rattus norvegicus
agctgcaacatcgtttttaacaatt

SEQ ID NO: 135363 - DNA, 25 bp, Rattus norvegicus
agctgcaacctgagacagttaaagg

SEQ ID NO: 135364 - DNA, 25 bp, Rattus norvegicus
agctgcaacctgtgacagttaaagg

SEQ ID NO: 135365 - DNA, 25 bp, Rattus norvegicus
agctgcaacggcatcgtgagcactg

SEQ ID NO: 135366 - DNA, 25 bp, Rattus norvegicus
agctgcaacggcttcgtgagcactg

SEQ ID NO: 135367 - DNA, 25 bp, Rattus norvegicus
agctgcaactacctatggtggctgt

SEQ ID NO: 135368 - DNA, 25 bp, Rattus norvegicus
agctgcaactacgtatggtggctgt

SEQ ID NO: 135369 - DNA, 25 bp, Rattus norvegicus
agctgcaactggcatcagactctgc

SEQ ID NO: 135370 - DNA, 25 bp, Rattus norvegicus
agctgcaactgggatcagactctgc

SEQ ID NO: 135371 - DNA, 25 bp, Rattus norvegicus
agctgcaagagcagacctgtctaaa

SEQ ID NO: 135372 - DNA, 25 bp, Rattus norvegicus
agctgcaagagctgacctgtctaaa

SEQ ID NO: 135373 - DNA, 25 bp, Rattus norvegicus
agctgcaagaggagcttggtccctt

SEQ ID NO: 135374 - DNA, 25 bp, Rattus norvegicus
agctgcaagaggtgcttggtccctt

SEQ ID NO: 135375 - DNA, 25 bp, Rattus norvegicus
agctgcaagggcactacccatttcc

SEQ ID NO: 135376 - DNA, 25 bp, Rattus norvegicus
agctgcaagggctctacccatttcc

SEQ ID NO: 135377 - DNA, 25 bp, Rattus norvegicus
agctgcaagtcgaagcaaggactct

SEQ ID NO: 135378 - DNA, 25 bp, Rattus norvegicus
agctgcaagtcgtagcaaggactct

SEQ ID NO: 135379 - DNA, 25 bp, Rattus norvegicus
agctgcaagttgacctctgatttac

SEQ ID NO: 135380 - DNA, 25 bp, Rattus norvegicus
agctgcaagttgtcctctgatttac

SEQ ID NO: 135381 - DNA, 25 bp, Rattus norvegicus
agctgcaagtttccttaccactgaa

SEQ ID NO: 135382 - DNA, 25 bp, Rattus norvegicus
agctgcaagtttgcttaccactgaa

SEQ ID NO: 135383 - DNA, 25 bp, Rattus norvegicus
agctgcaatgacctctttcacaata

SEQ ID NO: 135384 - DNA, 25 bp, Rattus norvegicus
agctgcaatgacgtctttcacaata

SEQ ID NO: 135385 - DNA, 25 bp, Rattus norvegicus
agctgcacaataactcaacaatcga

SEQ ID NO: 135386 - DNA, 25 bp, Rattus norvegicus
agctgcacaatatctcaacaatcga

SEQ ID NO: 135387 - DNA, 25 bp, Rattus norvegicus
agctgcacattacctcctgctgttc

SEQ ID NO: 135388 - DNA, 25 bp, Rattus norvegicus
agctgcacattagctcctgctgttc

SEQ ID NO: 135389 - DNA, 25 bp, Rattus norvegicus
agctgcacgcacaaccaggctgtag

SEQ ID NO: 135390 - DNA, 25 bp, Rattus norvegicus
agctgcacgcactaccaggctgtag

SEQ ID NO: 135391 - DNA, 25 bp, Rattus norvegicus
agctgcactatgagttacagtctgg

SEQ ID NO: 135392 - DNA, 25 bp, Rattus norvegicus
agctgcactatgtgttacagtctgg

SEQ ID NO: 135393 - DNA, 25 bp, Rattus norvegicus
agctgcactcggatagaatcattga

SEQ ID NO: 135394 - DNA, 25 bp, Rattus norvegicus
agctgcactcggttagaatcattga

SEQ ID NO: 135395 - DNA, 25 bp, Rattus norvegicus
agctgcactgaactagaatgcctca

SEQ ID NO: 135396 - DNA, 25 bp, Rattus norvegicus
agctgcactgaagtagaatgcctca

SEQ ID NO: 135397 - DNA, 25 bp, Rattus norvegicus
agctgcactgggaccctaggtttaa

SEQ ID NO: 135398 - DNA, 25 bp, Rattus norvegicus
agctgcactgggtccctaggtttaa

SEQ ID NO: 135399 - DNA, 25 bp, Rattus norvegicus
agctgcactggtcactcacttcaat

SEQ ID NO: 135400 - DNA, 25 bp, Rattus norvegicus
agctgcactggtgactcacttcaat

SEQ ID NO: 135401 - DNA, 25 bp, Rattus norvegicus
agctgcacttggcttcttcactctg

SEQ ID NO: 135402 - DNA, 25 bp, Rattus norvegicus
agctgcacttgggttcttcactctg

SEQ ID NO: 135403 - DNA, 25 bp, Rattus norvegicus
agctgcagaattcctgcctgggaca

SEQ ID NO: 135404 - DNA, 25 bp, Rattus norvegicus
agctgcagaattgctgcctgggaca

SEQ ID NO: 135405 - DNA, 25 bp, Rattus norvegicus
agctgcagacacaggagcccaaaca

SEQ ID NO: 135406 - DNA, 25 bp, Rattus norvegicus
agctgcagacactggagcccaaaca

SEQ ID NO: 135407 - DNA, 25 bp, Rattus norvegicus
agctgcagaccacgtcgaagacctg

SEQ ID NO: 135408 - DNA, 25 bp, Rattus norvegicus
agctgcagaccaggtcgaagacctg

SEQ ID NO: 135409 - DNA, 25 bp, Rattus norvegicus
agctgcagacttcatggcctactgt

SEQ ID NO: 135410 - DNA, 25 bp, Rattus norvegicus
agctgcagacttgatggcctactgt

SEQ ID NO: 135411 - DNA, 25 bp, Rattus norvegicus
agctgcagaggcagacccgggtcct

SEQ ID NO: 135412 - DNA, 25 bp, Rattus norvegicus
agctgcagaggctgacccgggtcct

SEQ ID NO: 135413 - DNA, 25 bp, Rattus norvegicus
agctgcagaggtactccagggacaa

SEQ ID NO: 135414 - DNA, 25 bp, Rattus norvegicus
agctgcagaggttctccagggacaa

SEQ ID NO: 135415 - DNA, 25 bp, Rattus norvegicus
agctgcagcaccatgaactgaacag

SEQ ID NO: 135416 - DNA, 25 bp, Rattus norvegicus
agctgcagcaccttgaactgaacag

SEQ ID NO: 135417 - DNA, 25 bp, Rattus norvegicus
agctgcagccagaagttttgtggta

SEQ ID NO: 135418 - DNA, 25 bp, Rattus norvegicus
agctgcagccagtagttttgtggta

SEQ ID NO: 135419 - DNA, 25 bp, Rattus norvegicus
agctgcagccatagaccgagcgcgg

SEQ ID NO: 135420 - DNA, 25 bp, Rattus norvegicus
agctgcagccattgaccgagcgcgg

SEQ ID NO: 135421 - DNA, 25 bp, Rattus norvegicus
agctgcagccgtccaccgcttatgt

SEQ ID NO: 135422 - DNA, 25 bp, Rattus norvegicus
agctgcagccgtgcaccgcttatgt

SEQ ID NO: 135423 - DNA, 25 bp, Rattus norvegicus
agctgcagctctattgtgtctgctt

SEQ ID NO: 135424 - DNA, 25 bp, Rattus norvegicus
agctgcagctcttttgtgtctgctt

SEQ ID NO: 135425 - DNA, 25 bp, Rattus norvegicus
agctgcagctgaccttgaaagccag

SEQ ID NO: 135426 - DNA, 25 bp, Rattus norvegicus
agctgcagctgagcttgaaagccag

SEQ ID NO: 135427 - DNA, 25 bp, Rattus norvegicus
agctgcagctggactaactctgttt

SEQ ID NO: 135428 - DNA, 25 bp, Rattus norvegicus
agctgcagctggtctaactctgttt

SEQ ID NO: 135429 - DNA, 25 bp, Rattus norvegicus
agctgcaggagaaagcctcagtatt

SEQ ID NO: 135430 - DNA, 25 bp, Rattus norvegicus
agctgcaggagatagcctcagtatt

SEQ ID NO: 135431 - DNA, 25 bp, Rattus norvegicus
agctgcaggagcattggctacggca

SEQ ID NO: 135432 - DNA, 25 bp, Rattus norvegicus
agctgcaggagctttggctacggca

SEQ ID NO: 135433 - DNA, 25 bp, Rattus norvegicus
agctgcaggcgcaggactctgaaga

SEQ ID NO: 135434 - DNA, 25 bp, Rattus norvegicus
agctgcaggcgctggactctgaaga

SEQ ID NO: 135435 - DNA, 25 bp, Rattus norvegicus
agctgcagggatacatcgaagggat

SEQ ID NO: 135436 - DNA, 25 bp, Rattus norvegicus
agctgcagggattcatcgaagggat

SEQ ID NO: 135437 - DNA, 25 bp, Rattus norvegicus
agctgcaggtctcccaggctctgga

SEQ ID NO: 135438 - DNA, 25 bp, Rattus norvegicus
agctgcaggtctgccaggctctgga

SEQ ID NO: 135439 - DNA, 25 bp, Rattus norvegicus
agctgcaggtgcacatggctctaca

SEQ ID NO: 135440 - DNA, 25 bp, Rattus norvegicus
agctgcaggtgctcatggctctaca

SEQ ID NO: 135441 - DNA, 25 bp, Rattus norvegicus
agctgcagtccaatcgaagagtcca

SEQ ID NO: 135442 - DNA, 25 bp, Rattus norvegicus
agctgcagtccattcgaagagtcca

SEQ ID NO: 135443 - DNA, 25 bp, Rattus norvegicus
agctgcagtcccaccagagagtcca

SEQ ID NO: 135444 - DNA, 25 bp, Rattus norvegicus
agctgcagtccctccagagagtcca

SEQ ID NO: 135445 - DNA, 25 bp, Rattus norvegicus
agctgcagtgacactaagactctgt

SEQ ID NO: 135446 - DNA, 25 bp, Rattus norvegicus
agctgcagtgactctaagactctgt

SEQ ID NO: 135447 - DNA, 25 bp, Rattus norvegicus
agctgcagtgagcagcaccgtccct

SEQ ID NO: 135448 - DNA, 25 bp, Rattus norvegicus
agctgcagtgaggagcaccgtccct

SEQ ID NO: 135449 - DNA, 25 bp, Rattus norvegicus
agctgcagtgatcttgacaaccgtg

SEQ ID NO: 135450 - DNA, 25 bp, Rattus norvegicus
agctgcagtgatgttgacaaccgtg

SEQ ID NO: 135451 - DNA, 25 bp, Rattus norvegicus
agctgcagtgttaccatgtttctta

SEQ ID NO: 135452 - DNA, 25 bp, Rattus norvegicus
agctgcagtgtttccatgtttctta

SEQ ID NO: 135453 - DNA, 25 bp, Rattus norvegicus
agctgcagttacatctagggagaga

SEQ ID NO: 135454 - DNA, 25 bp, Rattus norvegicus
agctgcagttacttctagggagaga

SEQ ID NO: 135455 - DNA, 25 bp, Rattus norvegicus
agctgcatccgcaggaccggcaata

SEQ ID NO: 135456 - DNA, 25 bp, Rattus norvegicus
agctgcatccgctggaccggcaata

SEQ ID NO: 135457 - DNA, 25 bp, Rattus norvegicus
agctgcatcctgatactctgtgctg

SEQ ID NO: 135458 - DNA, 25 bp, Rattus norvegicus
agctgcatcctgttactctgtgctg

SEQ ID NO: 135459 - DNA, 25 bp, Rattus norvegicus
agctgcatctgtctgtatctttact

SEQ ID NO: 135460 - DNA, 25 bp, Rattus norvegicus
agctgcatctgtgtgtatctttact

SEQ ID NO: 135461 - DNA, 25 bp, Rattus norvegicus
agctgcatgcacagtcactcttgaa

SEQ ID NO: 135462 - DNA, 25 bp, Rattus norvegicus
agctgcatgcactgtcactcttgaa

SEQ ID NO: 135463 - DNA, 25 bp, Rattus norvegicus
agctgcatgctaaaggatattgctt

SEQ ID NO: 135464 - DNA, 25 bp, Rattus norvegicus
agctgcatgctaacacacgtgaaat

SEQ ID NO: 135465 - DNA, 25 bp, Rattus norvegicus
agctgcatgctataggatattgctt

SEQ ID NO: 135466 - DNA, 25 bp, Rattus norvegicus
agctgcatgctatcacacgtgaaat

SEQ ID NO: 135467 - DNA, 25 bp, Rattus norvegicus
agctgcatgcttcgcggtccaggat

SEQ ID NO: 135468 - DNA, 25 bp, Rattus norvegicus
agctgcatgcttggcggtccaggat

SEQ ID NO: 135469 - DNA, 25 bp, Rattus norvegicus
agctgcatggccacttcatgctgca

SEQ ID NO: 135470 - DNA, 25 bp, Rattus norvegicus
agctgcatggcctcttcatgctgca

SEQ ID NO: 135471 - DNA, 25 bp, Rattus norvegicus
agctgcatgtttacgtgaccttgga

SEQ ID NO: 135472 - DNA, 25 bp, Rattus norvegicus
agctgcatgttttcgtgaccttgga

SEQ ID NO: 135473 - DNA, 25 bp, Rattus norvegicus
agctgcattactcccaaccgatggt

SEQ ID NO: 135474 - DNA, 25 bp, Rattus norvegicus
agctgcattactgccaaccgatggt

SEQ ID NO: 135475 - DNA, 25 bp, Rattus norvegicus
agctgcattcatattccatggctgt

SEQ ID NO: 135476 - DNA, 25 bp, Rattus norvegicus
agctgcattcattttccatggctgt

SEQ ID NO: 135477 - DNA, 25 bp, Rattus norvegicus
agctgcattcctcggcttgtgtacc

SEQ ID NO: 135478 - DNA, 25 bp, Rattus norvegicus
agctgcattcctgggcttgtgtacc

SEQ ID NO: 135479 - DNA, 25 bp, Rattus norvegicus
agctgcattctcaaactcaaactgt

SEQ ID NO: 135480 - DNA, 25 bp, Rattus norvegicus
agctgcattctctaactcaaactgt

SEQ ID NO: 135481 - DNA, 25 bp, Rattus norvegicus
agctgcattgatctggttatggcct

SEQ ID NO: 135482 - DNA, 25 bp, Rattus norvegicus
agctgcattgatgtggttatggcct

SEQ ID NO: 135483 - DNA, 25 bp, Rattus norvegicus
agctgcatttctaggtggttcataa

SEQ ID NO: 135484 - DNA, 25 bp, Rattus norvegicus
agctgcatttcttggtggttcataa

SEQ ID NO: 135485 - DNA, 25 bp, Rattus norvegicus
agctgcattttgagtcacccttgag

SEQ ID NO: 135486 - DNA, 25 bp, Rattus norvegicus
agctgcattttgtgtcacccttgag

SEQ ID NO: 135487 - DNA, 25 bp, Rattus norvegicus
agctgccaagctcgatattgatgcg

SEQ ID NO: 135488 - DNA, 25 bp, Rattus norvegicus
agctgccaagctctaatggtgttag

SEQ ID NO: 135489 - DNA, 25 bp, Rattus norvegicus
agctgccaagctggatattgatgcg

SEQ ID NO: 135490 - DNA, 25 bp, Rattus norvegicus
agctgccaagctgtaatggtgttag

SEQ ID NO: 135491 - DNA, 25 bp, Rattus norvegicus
agctgccaagggactgatttaaatc

SEQ ID NO: 135492 - DNA, 25 bp, Rattus norvegicus
agctgccaagggtctgatttaaatc

SEQ ID NO: 135493 - DNA, 25 bp, Rattus norvegicus
agctgccaagtcactctctgtagat

SEQ ID NO: 135494 - DNA, 25 bp, Rattus norvegicus
agctgccaagtctctctctgtagat

SEQ ID NO: 135495 - DNA, 25 bp, Rattus norvegicus
agctgccaccaacactggtttctga

SEQ ID NO: 135496 - DNA, 25 bp, Rattus norvegicus
agctgccaccaagactggtttctga

SEQ ID NO: 135497 - DNA, 25 bp, Rattus norvegicus
agctgccacctgagaacatcactag

SEQ ID NO: 135498 - DNA, 25 bp, Rattus norvegicus
agctgccacctgctactttgtttag

SEQ ID NO: 135499 - DNA, 25 bp, Rattus norvegicus
agctgccacctggtactttgtttag

SEQ ID NO: 135500 - DNA, 25 bp, Rattus norvegicus
agctgccacctgtgaacatcactag

SEQ ID NO: 135501 - DNA, 25 bp, Rattus norvegicus
agctgccacgttcgtgctgagaatt

SEQ ID NO: 135502 - DNA, 25 bp, Rattus norvegicus
agctgccacgttggtgctgagaatt

SEQ ID NO: 135503 - DNA, 25 bp, Rattus norvegicus
agctgccagaacaacggttaccaat

SEQ ID NO: 135504 - DNA, 25 bp, Rattus norvegicus
agctgccagaactacggttaccaat

SEQ ID NO: 135505 - DNA, 25 bp, Rattus norvegicus
agctgccagaccacttatgggctgc

SEQ ID NO: 135506 - DNA, 25 bp, Rattus norvegicus
agctgccagacctcttatgggctgc

SEQ ID NO: 135507 - DNA, 25 bp, Rattus norvegicus
agctgccagatcaagtgaggctcca

SEQ ID NO: 135508 - DNA, 25 bp, Rattus norvegicus
agctgccagatctagtgaggctcca

SEQ ID NO: 135509 - DNA, 25 bp, Rattus norvegicus
agctgccagcacagggtttattgca

SEQ ID NO: 135510 - DNA, 25 bp, Rattus norvegicus
agctgccagcactgggtttattgca

SEQ ID NO: 135511 - DNA, 25 bp, Rattus norvegicus
agctgccagcagctgtttcctgtgg

SEQ ID NO: 135512 - DNA, 25 bp, Rattus norvegicus
agctgccagcaggtgtttcctgtgg

SEQ ID NO: 135513 - DNA, 25 bp, Rattus norvegicus
agctgccaggcacgcttgacaaaca

SEQ ID NO: 135514 - DNA, 25 bp, Rattus norvegicus
agctgccaggcaggcttgacaaaca

SEQ ID NO: 135515 - DNA, 25 bp, Rattus norvegicus
agctgccaggccatcaagtagtctt

SEQ ID NO: 135516 - DNA, 25 bp, Rattus norvegicus
agctgccaggccttcaagtagtctt

SEQ ID NO: 135517 - DNA, 25 bp, Rattus norvegicus
agctgccaggtcacgcatgaaggga

SEQ ID NO: 135518 - DNA, 25 bp, Rattus norvegicus
agctgccaggtcactcacgaagaga

SEQ ID NO: 135519 - DNA, 25 bp, Rattus norvegicus
agctgccaggtctcgcatgaaggga

SEQ ID NO: 135520 - DNA, 25 bp, Rattus norvegicus
agctgccaggtctctcacgaagaga

SEQ ID NO: 135521 - DNA, 25 bp, Rattus norvegicus
agctgccagttcacctgacctggag

SEQ ID NO: 135522 - DNA, 25 bp, Rattus norvegicus
agctgccagttctcctgacctggag

SEQ ID NO: 135523 - DNA, 25 bp, Rattus norvegicus
agctgccatcagactgtagtgactt

SEQ ID NO: 135524 - DNA, 25 bp, Rattus norvegicus
agctgccatcagtctgtagtgactt

SEQ ID NO: 135525 - DNA, 25 bp, Rattus norvegicus
agctgccatctacgattcagtaaaa

SEQ ID NO: 135526 - DNA, 25 bp, Rattus norvegicus
agctgccatctaggattcagtaaaa

SEQ ID NO: 135527 - DNA, 25 bp, Rattus norvegicus
agctgccatctgctgctgttctgca

SEQ ID NO: 135528 - DNA, 25 bp, Rattus norvegicus
agctgccatctggtgctgttctgca

SEQ ID NO: 135529 - DNA, 25 bp, Rattus norvegicus
agctgccatgccatttctgaatgga

SEQ ID NO: 135530 - DNA, 25 bp, Rattus norvegicus
agctgccatgccttttctgaatgga

SEQ ID NO: 135531 - DNA, 25 bp, Rattus norvegicus
agctgccatggcagaccacctgatg

SEQ ID NO: 135532 - DNA, 25 bp, Rattus norvegicus
agctgccatggctgaccacctgatg

SEQ ID NO: 135533 - DNA, 25 bp, Rattus norvegicus
agctgccatggtattgcactataat

SEQ ID NO: 135534 - DNA, 25 bp, Rattus norvegicus
agctgccatggttttgcactataat

SEQ ID NO: 135535 - DNA, 25 bp, Rattus norvegicus
agctgccattaacctggctctagaa

SEQ ID NO: 135536 - DNA, 25 bp, Rattus norvegicus
agctgccattaagctggctctagaa

SEQ ID NO: 135537 - DNA, 25 bp, Rattus norvegicus
agctgccattctagttcgtgtaggt

SEQ ID NO: 135538 - DNA, 25 bp, Rattus norvegicus
agctgccattcttgttcgtgtaggt

SEQ ID NO: 135539 - DNA, 25 bp, Rattus norvegicus
agctgcccaagaatacgcctgaaga

SEQ ID NO: 135540 - DNA, 25 bp, Rattus norvegicus
agctgcccaagattacgcctgaaga

SEQ ID NO: 135541 - DNA, 25 bp, Rattus norvegicus
agctgcccaatcaggaatccttgat

SEQ ID NO: 135542 - DNA, 25 bp, Rattus norvegicus
agctgcccaatctggaatccttgat

SEQ ID NO: 135543 - DNA, 25 bp, Rattus norvegicus
agctgcccaccaaggattgctccag

SEQ ID NO: 135544 - DNA, 25 bp, Rattus norvegicus
agctgcccaccatggattgctccag

SEQ ID NO: 135545 - DNA, 25 bp, Rattus norvegicus
agctgcccacgtacaactgtgtgat

SEQ ID NO: 135546 - DNA, 25 bp, Rattus norvegicus
agctgcccacgttcaactgtgtgat

SEQ ID NO: 135547 - DNA, 25 bp, Rattus norvegicus
agctgcccaggcaacttacagtggc

SEQ ID NO: 135548 - DNA, 25 bp, Rattus norvegicus
agctgcccaggctacttacagtggc

SEQ ID NO: 135549 - DNA, 25 bp, Rattus norvegicus
agctgcccattgaagagaccctgga

SEQ ID NO: 135550 - DNA, 25 bp, Rattus norvegicus
agctgcccattgtagagaccctgga

SEQ ID NO: 135551 - DNA, 25 bp, Rattus norvegicus
agctgccccaagcacagtggtctga

SEQ ID NO: 135552 - DNA, 25 bp, Rattus norvegicus
agctgccccaaggacagtggtctga

SEQ ID NO: 135553 - DNA, 25 bp, Rattus norvegicus
agctgccccttcatagtgaacatga

SEQ ID NO: 135554 - DNA, 25 bp, Rattus norvegicus
agctgccccttcttagtgaacatga

SEQ ID NO: 135555 - DNA, 25 bp, Rattus norvegicus
agctgcccggaaatgtatccattta

SEQ ID NO: 135556 - DNA, 25 bp, Rattus norvegicus
agctgcccggaattgtatccattta

SEQ ID NO: 135557 - DNA, 25 bp, Rattus norvegicus
agctgccctggaagcacgtttggat

SEQ ID NO: 135558 - DNA, 25 bp, Rattus norvegicus
agctgccctggatgcacgtttggat

SEQ ID NO: 135559 - DNA, 25 bp, Rattus norvegicus
agctgccctgggaaaacctgttcgt

SEQ ID NO: 135560 - DNA, 25 bp, Rattus norvegicus
agctgccctgggacgtgtgacgtac

SEQ ID NO: 135561 - DNA, 25 bp, Rattus norvegicus
agctgccctgggtaaacctgttcgt

SEQ ID NO: 135562 - DNA, 25 bp, Rattus norvegicus
agctgccctgggtcgtgtgacgtac

SEQ ID NO: 135563 - DNA, 25 bp, Rattus norvegicus
agctgccctgtcacatacttgtgat

SEQ ID NO: 135564 - DNA, 25 bp, Rattus norvegicus
agctgccctgtctcatacttgtgat

SEQ ID NO: 135565 - DNA, 25 bp, Rattus norvegicus
agctgcccttacatttgtgtagtag

SEQ ID NO: 135566 - DNA, 25 bp, Rattus norvegicus
agctgcccttacttttgtgtagtag

SEQ ID NO: 135567 - DNA, 25 bp, Rattus norvegicus
agctgccctttaactaacgtggact

SEQ ID NO: 135568 - DNA, 25 bp, Rattus norvegicus
agctgccctttatctaacgtggact

SEQ ID NO: 135569 - DNA, 25 bp, Rattus norvegicus
agctgcccttttaacttattctgga

SEQ ID NO: 135570 - DNA, 25 bp, Rattus norvegicus
agctgccctttttacttattctgga

SEQ ID NO: 135571 - DNA, 25 bp, Rattus norvegicus
agctgccgacctccaggaaaacttt

SEQ ID NO: 135572 - DNA, 25 bp, Rattus norvegicus
agctgccgacctgcaggaaaacttt

SEQ ID NO: 135573 - DNA, 25 bp, Rattus norvegicus
agctgccgatcgatcagcactgaaa

SEQ ID NO: 135574 - DNA, 25 bp, Rattus norvegicus
agctgccgatcgttcagcactgaaa

SEQ ID NO: 135575 - DNA, 25 bp, Rattus norvegicus
agctgccgcatcctgcacgagtaca

SEQ ID NO: 135576 - DNA, 25 bp, Rattus norvegicus
agctgccgcatcgtgcacgagtaca

SEQ ID NO: 135577 - DNA, 25 bp, Rattus norvegicus
agctgccgctgtagacctgtgagag

SEQ ID NO: 135578 - DNA, 25 bp, Rattus norvegicus
agctgccgctgttgacctgtgagag

SEQ ID NO: 135579 - DNA, 25 bp, Rattus norvegicus
agctgccgggatcgattgtcttgtc

SEQ ID NO: 135580 - DNA, 25 bp, Rattus norvegicus
agctgccgggatggattgtcttgtc

SEQ ID NO: 135581 - DNA, 25 bp, Rattus norvegicus
agctgcctaattagtaatagccaga

SEQ ID NO: 135582 - DNA, 25 bp, Rattus norvegicus
agctgcctaatttgtaatagccaga

SEQ ID NO: 135583 - DNA, 25 bp, Rattus norvegicus
agctgcctagctctaccaagatttt

SEQ ID NO: 135584 - DNA, 25 bp, Rattus norvegicus
agctgcctagctgtaccaagatttt

SEQ ID NO: 135585 - DNA, 25 bp, Rattus norvegicus
agctgcctagtacaattccttttgc

SEQ ID NO: 135586 - DNA, 25 bp, Rattus norvegicus
agctgcctagtagaattccttttgc

SEQ ID NO: 135587 - DNA, 25 bp, Rattus norvegicus
agctgcctagtgaagtgctattaca

SEQ ID NO: 135588 - DNA, 25 bp, Rattus norvegicus
agctgcctagtgtagtgctattaca

SEQ ID NO: 135589 - DNA, 25 bp, Rattus norvegicus
agctgcctcaaacttctgctactgt

SEQ ID NO: 135590 - DNA, 25 bp, Rattus norvegicus
agctgcctcaaagttctgctactgt

SEQ ID NO: 135591 - DNA, 25 bp, Rattus norvegicus
agctgcctcaacaatgtggacctgg

SEQ ID NO: 135592 - DNA, 25 bp, Rattus norvegicus
agctgcctcaactatgtggacctgg

SEQ ID NO: 135593 - DNA, 25 bp, Rattus norvegicus
agctgcctcacaaggatccaatcaa

SEQ ID NO: 135594 - DNA, 25 bp, Rattus norvegicus
agctgcctcacatggatccaatcaa

SEQ ID NO: 135595 - DNA, 25 bp, Rattus norvegicus
agctgcctcagaccatactttggga

SEQ ID NO: 135596 - DNA, 25 bp, Rattus norvegicus
agctgcctcagagcatactttggga

SEQ ID NO: 135597 - DNA, 25 bp, Rattus norvegicus
agctgcctcagcaggtgttgcctga

SEQ ID NO: 135598 - DNA, 25 bp, Rattus norvegicus
agctgcctcagccagttgtcattga

SEQ ID NO: 135599 - DNA, 25 bp, Rattus norvegicus
agctgcctcagcgagttgtcattga

SEQ ID NO: 135600 - DNA, 25 bp, Rattus norvegicus
agctgcctcagctggtgttgcctga

SEQ ID NO: 135601 - DNA, 25 bp, Rattus norvegicus
agctgcctcccacatctgaatgtgt

SEQ ID NO: 135602 - DNA, 25 bp, Rattus norvegicus
agctgcctcccagatctgaatgtgt

SEQ ID NO: 135603 - DNA, 25 bp, Rattus norvegicus
agctgcctccccatgtgatgaagaa

SEQ ID NO: 135604 - DNA, 25 bp, Rattus norvegicus
agctgcctccccttgtgatgaagaa

SEQ ID NO: 135605 - DNA, 25 bp, Rattus norvegicus
agctgcctctacagtatagtgcttt

SEQ ID NO: 135606 - DNA, 25 bp, Rattus norvegicus
agctgcctctactgtatagtgcttt

SEQ ID NO: 135607 - DNA, 25 bp, Rattus norvegicus
agctgcctctggaagcttggccagc

SEQ ID NO: 135608 - DNA, 25 bp, Rattus norvegicus
agctgcctctggtagcttggccagc

SEQ ID NO: 135609 - DNA, 25 bp, Rattus norvegicus
agctgcctcttcaggattagtcgga

SEQ ID NO: 135610 - DNA, 25 bp, Rattus norvegicus
agctgcctcttctggattagtcgga

SEQ ID NO: 135611 - DNA, 25 bp, Rattus norvegicus
agctgcctgaatccagttctttacg

SEQ ID NO: 135612 - DNA, 25 bp, Rattus norvegicus
agctgcctgaatgcagttctttacg

SEQ ID NO: 135613 - DNA, 25 bp, Rattus norvegicus
agctgcctgatcaactatggaggcc

SEQ ID NO: 135614 - DNA, 25 bp, Rattus norvegicus
agctgcctgatctactatggaggcc

SEQ ID NO: 135615 - DNA, 25 bp, Rattus norvegicus
agctgcctgcatctctttcacggac

SEQ ID NO: 135616 - DNA, 25 bp, Rattus norvegicus
agctgcctgcatgtctttcacggac

SEQ ID NO: 135617 - DNA, 25 bp, Rattus norvegicus
agctgcctgcccagatggtggaccg

SEQ ID NO: 135618 - DNA, 25 bp, Rattus norvegicus
agctgcctgccctgatggtggaccg

SEQ ID NO: 135619 - DNA, 25 bp, Rattus norvegicus
agctgcctgcctcgctgtctgcttt

SEQ ID NO: 135620 - DNA, 25 bp, Rattus norvegicus
agctgcctgcctggctgtctgcttt

SEQ ID NO: 135621 - DNA, 25 bp, Rattus norvegicus
agctgcctgctgaggtggtgtacga

SEQ ID NO: 135622 - DNA, 25 bp, Rattus norvegicus
agctgcctgctgatgtgccgggaac

SEQ ID NO: 135623 - DNA, 25 bp, Rattus norvegicus
agctgcctgctgtggtggtgtacga

SEQ ID NO: 135624 - DNA, 25 bp, Rattus norvegicus
agctgcctgctgttgtgccgggaac

SEQ ID NO: 135625 - DNA, 25 bp, Rattus norvegicus
agctgcctggtgagaacctggttca

SEQ ID NO: 135626 - DNA, 25 bp, Rattus norvegicus
agctgcctggtgatccgcgaagata

SEQ ID NO: 135627 - DNA, 25 bp, Rattus norvegicus
agctgcctggtgtgaacctggttca

SEQ ID NO: 135628 - DNA, 25 bp, Rattus norvegicus
agctgcctggtgttccgcgaagata

SEQ ID NO: 135629 - DNA, 25 bp, Rattus norvegicus
agctgcctgtgcctttctggagtca

SEQ ID NO: 135630 - DNA, 25 bp, Rattus norvegicus
agctgcctgtgcgtttctggagtca

SEQ ID NO: 135631 - DNA, 25 bp, Rattus norvegicus
agctgccttacacagggaagccttg

SEQ ID NO: 135632 - DNA, 25 bp, Rattus norvegicus
agctgccttacagagggaagccttg

SEQ ID NO: 135633 - DNA, 25 bp, Rattus norvegicus
agctgccttccgctggtttcagtga

SEQ ID NO: 135634 - DNA, 25 bp, Rattus norvegicus
agctgccttccggtggtttcagtga

SEQ ID NO: 135635 - DNA, 25 bp, Rattus norvegicus
agctgccttctcactctgcactggt

SEQ ID NO: 135636 - DNA, 25 bp, Rattus norvegicus
agctgccttctctctctgcactggt

SEQ ID NO: 135637 - DNA, 25 bp, Rattus norvegicus
agctgccttctgatcattgtacttg

SEQ ID NO: 135638 - DNA, 25 bp, Rattus norvegicus
agctgccttctgttcattgtacttg

SEQ ID NO: 135639 - DNA, 25 bp, Rattus norvegicus
agctgccttgctcctactgaggagg

SEQ ID NO: 135640 - DNA, 25 bp, Rattus norvegicus
agctgccttgctgctactgaggagg

SEQ ID NO: 135641 - DNA, 25 bp, Rattus norvegicus
agctgcctttcgagttcctcgcatt

SEQ ID NO: 135642 - DNA, 25 bp, Rattus norvegicus
agctgcctttcgtgttcctcgcatt

SEQ ID NO: 135643 - DNA, 25 bp, Rattus norvegicus
agctgcctttgcattgtgtctgacc

SEQ ID NO: 135644 - DNA, 25 bp, Rattus norvegicus
agctgcctttgctttgtgtctgacc

SEQ ID NO: 135645 - DNA, 25 bp, Rattus norvegicus
agctgcgaaaggattgtgtctagac

SEQ ID NO: 135646 - DNA, 25 bp, Rattus norvegicus
agctgcgaaaggtttgtgtctagac

SEQ ID NO: 135647 - DNA, 25 bp, Rattus norvegicus
agctgcgaaccaaatcacttcttgg

SEQ ID NO: 135648 - DNA, 25 bp, Rattus norvegicus
agctgcgaaccatatcacttcttgg

SEQ ID NO: 135649 - DNA, 25 bp, Rattus norvegicus
agctgcgacagccagtcagaggcca

SEQ ID NO: 135650 - DNA, 25 bp, Rattus norvegicus
agctgcgacagcgagtcagaggcca

SEQ ID NO: 135651 - DNA, 25 bp, Rattus norvegicus
agctgcgaccgtcgctgtcaaagat

SEQ ID NO: 135652 - DNA, 25 bp, Rattus norvegicus
agctgcgaccgtggctgtcaaagat

SEQ ID NO: 135653 - DNA, 25 bp, Rattus norvegicus
agctgcgacgctctcatcgatttct

SEQ ID NO: 135654 - DNA, 25 bp, Rattus norvegicus
agctgcgacgctgtcatcgatttct

SEQ ID NO: 135655 - DNA, 25 bp, Rattus norvegicus
agctgcgagagccacactggccctt

SEQ ID NO: 135656 - DNA, 25 bp, Rattus norvegicus
agctgcgagagcgacactggccctt

SEQ ID NO: 135657 - DNA, 25 bp, Rattus norvegicus
agctgcgagcccatgcatggaagaa

SEQ ID NO: 135658 - DNA, 25 bp, Rattus norvegicus
agctgcgagcccttgcatggaagaa

SEQ ID NO: 135659 - DNA, 25 bp, Rattus norvegicus
agctgcgaggtcattggtgtcagcc

SEQ ID NO: 135660 - DNA, 25 bp, Rattus norvegicus
agctgcgaggtctttggtgtcagcc

SEQ ID NO: 135661 - DNA, 25 bp, Rattus norvegicus
agctgcgatgacagtgtccactgca

SEQ ID NO: 135662 - DNA, 25 bp, Rattus norvegicus
agctgcgatgactgtgtccactgca

SEQ ID NO: 135663 - DNA, 25 bp, Rattus norvegicus
agctgcgccatgattgaagcctgaa

SEQ ID NO: 135664 - DNA, 25 bp, Rattus norvegicus
agctgcgccatgtttgaagcctgaa

SEQ ID NO: 135665 - DNA, 25 bp, Rattus norvegicus
agctgcgccgcgagcaggatttcct

SEQ ID NO: 135666 - DNA, 25 bp, Rattus norvegicus
agctgcgccgcgtgcaggatttcct

SEQ ID NO: 135667 - DNA, 25 bp, Rattus norvegicus
agctgcggagcgaagactgcctttc

SEQ ID NO: 135668 - DNA, 25 bp, Rattus norvegicus
agctgcggagcgtagactgcctttc

SEQ ID NO: 135669 - DNA, 25 bp, Rattus norvegicus
agctgcggatttcaggtcctgtgcc

SEQ ID NO: 135670 - DNA, 25 bp, Rattus norvegicus
agctgcggatttgaggtcctgtgcc

SEQ ID NO: 135671 - DNA, 25 bp, Rattus norvegicus
agctgcggcaccagactgaggcgct

SEQ ID NO: 135672 - DNA, 25 bp, Rattus norvegicus
agctgcggcacctgactgaggcgct

SEQ ID NO: 135673 - DNA, 25 bp, Rattus norvegicus
agctgcggctggctatccaagagat

SEQ ID NO: 135674 - DNA, 25 bp, Rattus norvegicus
agctgcggctgggtatccaagagat

SEQ ID NO: 135675 - DNA, 25 bp, Rattus norvegicus
agctgcgggccaaattctgggactt

SEQ ID NO: 135676 - DNA, 25 bp, Rattus norvegicus
agctgcgggccatattctgggactt

SEQ ID NO: 135677 - DNA, 25 bp, Rattus norvegicus
agctgcgggcgcacgttgggtcgct

SEQ ID NO: 135678 - DNA, 25 bp, Rattus norvegicus
agctgcgggcgctcgttgggtcgct

SEQ ID NO: 135679 - DNA, 25 bp, Rattus norvegicus
agctgcgggctgatgctatggccaa

SEQ ID NO: 135680 - DNA, 25 bp, Rattus norvegicus
agctgcgggctgttgctatggccaa

SEQ ID NO: 135681 - DNA, 25 bp, Rattus norvegicus
agctgcggtctgagccaaagctcga

SEQ ID NO: 135682 - DNA, 25 bp, Rattus norvegicus
agctgcggtctgtgccaaagctcga

SEQ ID NO: 135683 - DNA, 25 bp, Rattus norvegicus
agctgcgtccgcatacagttattat

SEQ ID NO: 135684 - DNA, 25 bp, Rattus norvegicus
agctgcgtccgcttacagttattat

SEQ ID NO: 135685 - DNA, 25 bp, Rattus norvegicus
agctgcgtgagtccatccccaatgt

SEQ ID NO: 135686 - DNA, 25 bp, Rattus norvegicus
agctgcgtgagtgcatccccaatgt

SEQ ID NO: 135687 - DNA, 25 bp, Rattus norvegicus
agctgcgtgccaaattccaggacaa

SEQ ID NO: 135688 - DNA, 25 bp, Rattus norvegicus
agctgcgtgccatattccaggacaa

SEQ ID NO: 135689 - DNA, 25 bp, Rattus norvegicus
agctgcgtttgtatccataattgac

SEQ ID NO: 135690 - DNA, 25 bp, Rattus norvegicus
agctgcgtttgtttccataattgac

SEQ ID NO: 135691 - DNA, 25 bp, Rattus norvegicus
agctgctaacaacactggctctttt

SEQ ID NO: 135692 - DNA, 25 bp, Rattus norvegicus
agctgctaacaagactggctctttt

SEQ ID NO: 135693 - DNA, 25 bp, Rattus norvegicus
agctgctaacacatgcctgtttagt

SEQ ID NO: 135694 - DNA, 25 bp, Rattus norvegicus
agctgctaacacttgcctgtttagt

SEQ ID NO: 135695 - DNA, 25 bp, Rattus norvegicus
agctgctaacggaactgaagaataa

SEQ ID NO: 135696 - DNA, 25 bp, Rattus norvegicus
agctgctaacggtactgaagaataa

SEQ ID NO: 135697 - DNA, 25 bp, Rattus norvegicus
agctgctaagcaagggttcctaatg

SEQ ID NO: 135698 - DNA, 25 bp, Rattus norvegicus
agctgctaagcatgggttcctaatg

SEQ ID NO: 135699 - DNA, 25 bp, Rattus norvegicus
agctgctaccatacccagctttaat

SEQ ID NO: 135700 - DNA, 25 bp, Rattus norvegicus
agctgctaccattcccagctttaat

SEQ ID NO: 135701 - DNA, 25 bp, Rattus norvegicus
agctgctagcttcctgcatcaacag

SEQ ID NO: 135702 - DNA, 25 bp, Rattus norvegicus
agctgctagcttgctgcatcaacag

SEQ ID NO: 135703 - DNA, 25 bp, Rattus norvegicus
agctgctaggtcacaaagggtttca

SEQ ID NO: 135704 - DNA, 25 bp, Rattus norvegicus
agctgctaggtctcaaagggtttca

SEQ ID NO: 135705 - DNA, 25 bp, Rattus norvegicus
agctgctagttgatactcttcgatc

SEQ ID NO: 135706 - DNA, 25 bp, Rattus norvegicus
agctgctagttgttactcttcgatc

SEQ ID NO: 135707 - DNA, 25 bp, Rattus norvegicus
agctgctatctcatctagcttgaat

SEQ ID NO: 135708 - DNA, 25 bp, Rattus norvegicus
agctgctatctcttctagcttgaat

SEQ ID NO: 135709 - DNA, 25 bp, Rattus norvegicus
agctgctcaactctggccctgggaa

SEQ ID NO: 135710 - DNA, 25 bp, Rattus norvegicus
agctgctcaactgtggccctgggaa

SEQ ID NO: 135711 - DNA, 25 bp, Rattus norvegicus
agctgctcaatgctcggacacagga

SEQ ID NO: 135712 - DNA, 25 bp, Rattus norvegicus
agctgctcaatggtcggacacagga

SEQ ID NO: 135713 - DNA, 25 bp, Rattus norvegicus
agctgctcacgaaacgcgtgcgcct

SEQ ID NO: 135714 - DNA, 25 bp, Rattus norvegicus
agctgctcacgatacgcgtgcgcct

SEQ ID NO: 135715 - DNA, 25 bp, Rattus norvegicus
agctgctcacttagcaaggtgccct

SEQ ID NO: 135716 - DNA, 25 bp, Rattus norvegicus
agctgctcactttgcaaggtgccct

SEQ ID NO: 135717 - DNA, 25 bp, Rattus norvegicus
agctgctcagccagaattctttgct

SEQ ID NO: 135718 - DNA, 25 bp, Rattus norvegicus
agctgctcagcctgaattctttgct

SEQ ID NO: 135719 - DNA, 25 bp, Rattus norvegicus
agctgctcagtcattactcaacaag

SEQ ID NO: 135720 - DNA, 25 bp, Rattus norvegicus
agctgctcagtctttactcaacaag

SEQ ID NO: 135721 - DNA, 25 bp, Rattus norvegicus
agctgctcataaacaggctccagaa

SEQ ID NO: 135722 - DNA, 25 bp, Rattus norvegicus
agctgctcataatcaggctccagaa

SEQ ID NO: 135723 - DNA, 25 bp, Rattus norvegicus
agctgctcatgcatcatgctgtagc

SEQ ID NO: 135724 - DNA, 25 bp, Rattus norvegicus
agctgctcatgcttcatgctgtagc

SEQ ID NO: 135725 - DNA, 25 bp, Rattus norvegicus
agctgctccaagcacgggaaaccaa

SEQ ID NO: 135726 - DNA, 25 bp, Rattus norvegicus
agctgctccaaggacgggaaaccaa

SEQ ID NO: 135727 - DNA, 25 bp, Rattus norvegicus
agctgctccaatcagatctgtggat

SEQ ID NO: 135728 - DNA, 25 bp, Rattus norvegicus
agctgctccaatgagatctgtggat

SEQ ID NO: 135729 - DNA, 25 bp, Rattus norvegicus
agctgctccagactgtacccagtgt

SEQ ID NO: 135730 - DNA, 25 bp, Rattus norvegicus
agctgctccagagtgtacccagtgt

SEQ ID NO: 135731 - DNA, 25 bp, Rattus norvegicus
agctgctccccaagagctaggccag

SEQ ID NO: 135732 - DNA, 25 bp, Rattus norvegicus
agctgctccccatgagctaggccag

SEQ ID NO: 135733 - DNA, 25 bp, Rattus norvegicus
agctgctccggacaggaagacgtca

SEQ ID NO: 135734 - DNA, 25 bp, Rattus norvegicus
agctgctccggagaggaagacgtca

SEQ ID NO: 135735 - DNA, 25 bp, Rattus norvegicus
agctgctccgtcagtgtaccgaagt

SEQ ID NO: 135736 - DNA, 25 bp, Rattus norvegicus
agctgctccgtctgtgtaccgaagt

SEQ ID NO: 135737 - DNA, 25 bp, Rattus norvegicus
agctgctcctagctctggcccatgg

SEQ ID NO: 135738 - DNA, 25 bp, Rattus norvegicus
agctgctcctaggtctggcccatgg

SEQ ID NO: 135739 - DNA, 25 bp, Rattus norvegicus
agctgctcctcaacaatgccaaggt

SEQ ID NO: 135740 - DNA, 25 bp, Rattus norvegicus
agctgctcctcacacatcatgatct

SEQ ID NO: 135741 - DNA, 25 bp, Rattus norvegicus
agctgctcctcagacatcatgatct

SEQ ID NO: 135742 - DNA, 25 bp, Rattus norvegicus
agctgctcctcatcaatgccaaggt

SEQ ID NO: 135743 - DNA, 25 bp, Rattus norvegicus
agctgctcctgacttggactacaga

SEQ ID NO: 135744 - DNA, 25 bp, Rattus norvegicus
agctgctcctgagttggactacaga

SEQ ID NO: 135745 - DNA, 25 bp, Rattus norvegicus
agctgctcctgtaccatgtgtatat

SEQ ID NO: 135746 - DNA, 25 bp, Rattus norvegicus
agctgctcctgttccatgtgtatat

SEQ ID NO: 135747 - DNA, 25 bp, Rattus norvegicus
agctgctccttgctggtaaacctca

SEQ ID NO: 135748 - DNA, 25 bp, Rattus norvegicus
agctgctccttggtggtaaacctca

SEQ ID NO: 135749 - DNA, 25 bp, Rattus norvegicus
agctgctcggatatgcctgacttag

SEQ ID NO: 135750 - DNA, 25 bp, Rattus norvegicus
agctgctcggatttgcctgacttag

SEQ ID NO: 135751 - DNA, 25 bp, Rattus norvegicus
agctgctcggtcaacaaggctggga

SEQ ID NO: 135752 - DNA, 25 bp, Rattus norvegicus
agctgctcggtctacaaggctggga

SEQ ID NO: 135753 - DNA, 25 bp, Rattus norvegicus
agctgctctactcacgcttcacaga

SEQ ID NO: 135754 - DNA, 25 bp, Rattus norvegicus
agctgctctactgacgcttcacaga

SEQ ID NO: 135755 - DNA, 25 bp, Rattus norvegicus
agctgctctaggatctgtattctat

SEQ ID NO: 135756 - DNA, 25 bp, Rattus norvegicus
agctgctctaggttctgtattctat

SEQ ID NO: 135757 - DNA, 25 bp, Rattus norvegicus
agctgctctccgagggttgcagtga

SEQ ID NO: 135758 - DNA, 25 bp, Rattus norvegicus
agctgctctccgtgggttgcagtga

SEQ ID NO: 135759 - DNA, 25 bp, Rattus norvegicus
agctgctctcctaaatatggtcctg

SEQ ID NO: 135760 - DNA, 25 bp, Rattus norvegicus
agctgctctccttaatatggtcctg

SEQ ID NO: 135761 - DNA, 25 bp, Rattus norvegicus
agctgctctgaactcacacacactg

SEQ ID NO: 135762 - DNA, 25 bp, Rattus norvegicus
agctgctctgaagtcacacacactg

SEQ ID NO: 135763 - DNA, 25 bp, Rattus norvegicus
agctgctcttacatactgtgtggat

SEQ ID NO: 135764 - DNA, 25 bp, Rattus norvegicus
agctgctcttacttactgtgtggat

SEQ ID NO: 135765 - DNA, 25 bp, Rattus norvegicus
agctgctcttttccttttggatata

SEQ ID NO: 135766 - DNA, 25 bp, Rattus norvegicus
agctgctcttttgcttttggatata

SEQ ID NO: 135767 - DNA, 25 bp, Rattus norvegicus
agctgctgaacgacaggccctggat

SEQ ID NO: 135768 - DNA, 25 bp, Rattus norvegicus
agctgctgaacgtcaggccctggat

SEQ ID NO: 135769 - DNA, 25 bp, Rattus norvegicus
agctgctgacagaccctgggacttg

SEQ ID NO: 135770 - DNA, 25 bp, Rattus norvegicus
agctgctgacagaggccttccttta

SEQ ID NO: 135771 - DNA, 25 bp, Rattus norvegicus
agctgctgacagtccctgggacttg

SEQ ID NO: 135772 - DNA, 25 bp, Rattus norvegicus
agctgctgacagtggccttccttta

SEQ ID NO: 135773 - DNA, 25 bp, Rattus norvegicus
agctgctgagctaatcctgcttgat

SEQ ID NO: 135774 - DNA, 25 bp, Rattus norvegicus
agctgctgagcttatcctgcttgat

SEQ ID NO: 135775 - DNA, 25 bp, Rattus norvegicus
agctgctgatgcagcagtcgctgga

SEQ ID NO: 135776 - DNA, 25 bp, Rattus norvegicus
agctgctgatgctgcagtcgctgga

SEQ ID NO: 135777 - DNA, 25 bp, Rattus norvegicus
agctgctgattgacttcttgttttt

SEQ ID NO: 135778 - DNA, 25 bp, Rattus norvegicus
agctgctgattgtcttcttgttttt

SEQ ID NO: 135779 - DNA, 25 bp, Rattus norvegicus
agctgctgcaaaccatgaaccttac

SEQ ID NO: 135780 - DNA, 25 bp, Rattus norvegicus
agctgctgcaaagcatgaaccttac

SEQ ID NO: 135781 - DNA, 25 bp, Rattus norvegicus
agctgctgcagaaaatggccgacct

SEQ ID NO: 135782 - DNA, 25 bp, Rattus norvegicus
agctgctgcagataatggccgacct

SEQ ID NO: 135783 - DNA, 25 bp, Rattus norvegicus
agctgctgcagcatggcaaggctga

SEQ ID NO: 135784 - DNA, 25 bp, Rattus norvegicus
agctgctgcagcttggcaaggctga

SEQ ID NO: 135785 - DNA, 25 bp, Rattus norvegicus
agctgctgccttcttaagcaaatga

SEQ ID NO: 135786 - DNA, 25 bp, Rattus norvegicus
agctgctgccttgttaagcaaatga

SEQ ID NO: 135787 - DNA, 25 bp, Rattus norvegicus
agctgctgctgcatgcacattagag

SEQ ID NO: 135788 - DNA, 25 bp, Rattus norvegicus
agctgctgctgcttgcacattagag

SEQ ID NO: 135789 - DNA, 25 bp, Rattus norvegicus
agctgctgctggacatcatagactc

SEQ ID NO: 135790 - DNA, 25 bp, Rattus norvegicus
agctgctgctggtcatcatagactc

SEQ ID NO: 135791 - DNA, 25 bp, Rattus norvegicus
agctgctggaaaccactgcttttat

SEQ ID NO: 135792 - DNA, 25 bp, Rattus norvegicus
agctgctggaaagcactgcttttat

SEQ ID NO: 135793 - DNA, 25 bp, Rattus norvegicus
agctgctggactcgctgatggcaaa

SEQ ID NO: 135794 - DNA, 25 bp, Rattus norvegicus
agctgctggactggctgatggcaaa

SEQ ID NO: 135795 - DNA, 25 bp, Rattus norvegicus
agctgctggattaccgttttggttt

SEQ ID NO: 135796 - DNA, 25 bp, Rattus norvegicus
agctgctggatttccgttttggttt

SEQ ID NO: 135797 - DNA, 25 bp, Rattus norvegicus
agctgctggcagaacctccttcttg

SEQ ID NO: 135798 - DNA, 25 bp, Rattus norvegicus
agctgctggcagtacctccttcttg

SEQ ID NO: 135799 - DNA, 25 bp, Rattus norvegicus
agctgctggcctagaagtggcactt

SEQ ID NO: 135800 - DNA, 25 bp, Rattus norvegicus
agctgctggccttgaagtggcactt

SEQ ID NO: 135801 - DNA, 25 bp, Rattus norvegicus
agctgctggctcagctaaggtatgt

SEQ ID NO: 135802 - DNA, 25 bp, Rattus norvegicus
agctgctggctctgctaaggtatgt

SEQ ID NO: 135803 - DNA, 25 bp, Rattus norvegicus
agctgctggctgagctttttgaaga

SEQ ID NO: 135804 - DNA, 25 bp, Rattus norvegicus
agctgctggctgtgctttttgaaga

SEQ ID NO: 135805 - DNA, 25 bp, Rattus norvegicus
agctgctgggacaccgagtttgaca

SEQ ID NO: 135806 - DNA, 25 bp, Rattus norvegicus
agctgctgggactccgagtttgaca

SEQ ID NO: 135807 - DNA, 25 bp, Rattus norvegicus
agctgctgggcaaagtgacgatcgc

SEQ ID NO: 135808 - DNA, 25 bp, Rattus norvegicus
agctgctgggcatagtgacgatcgc

SEQ ID NO: 135809 - DNA, 25 bp, Rattus norvegicus
agctgctgggtgaccattgccatat

SEQ ID NO: 135810 - DNA, 25 bp, Rattus norvegicus
agctgctgggtgtccattgccatat

SEQ ID NO: 135811 - DNA, 25 bp, Rattus norvegicus
agctgctggtctaccttcgtgagag

SEQ ID NO: 135812 - DNA, 25 bp, Rattus norvegicus
agctgctggtcttccttcgtgagag

SEQ ID NO: 135813 - DNA, 25 bp, Rattus norvegicus
agctgctgtactatgtaacctgaag

SEQ ID NO: 135814 - DNA, 25 bp, Rattus norvegicus
agctgctgtactttgtaacctgaag

SEQ ID NO: 135815 - DNA, 25 bp, Rattus norvegicus
agctgctgtattctgtttgacccag

SEQ ID NO: 135816 - DNA, 25 bp, Rattus norvegicus
agctgctgtattgtgtttgacccag

SEQ ID NO: 135817 - DNA, 25 bp, Rattus norvegicus
agctgctgtccaataaatccctgat

SEQ ID NO: 135818 - DNA, 25 bp, Rattus norvegicus
agctgctgtccattaaatccctgat

SEQ ID NO: 135819 - DNA, 25 bp, Rattus norvegicus
agctgctgtcctcccgggctataaa

SEQ ID NO: 135820 - DNA, 25 bp, Rattus norvegicus
agctgctgtcctgccgggctataaa

SEQ ID NO: 135821 - DNA, 25 bp, Rattus norvegicus
agctgctgtctgagttcatagataa

SEQ ID NO: 135822 - DNA, 25 bp, Rattus norvegicus
agctgctgtctgtgttcatagataa

SEQ ID NO: 135823 - DNA, 25 bp, Rattus norvegicus
agctgctgtggtagtaagactttct

SEQ ID NO: 135824 - DNA, 25 bp, Rattus norvegicus
agctgctgtggttgtaagactttct

SEQ ID NO: 135825 - DNA, 25 bp, Rattus norvegicus
agctgctgtgtcagagttgctgaga

SEQ ID NO: 135826 - DNA, 25 bp, Rattus norvegicus
agctgctgtgtccaacaatatagtt

SEQ ID NO: 135827 - DNA, 25 bp, Rattus norvegicus
agctgctgtgtcgaacaatatagtt

SEQ ID NO: 135828 - DNA, 25 bp, Rattus norvegicus
agctgctgtgtctgagttgctgaga

SEQ ID NO: 135829 - DNA, 25 bp, Rattus norvegicus
agctgctgttctccagggacaggaa

SEQ ID NO: 135830 - DNA, 25 bp, Rattus norvegicus
agctgctgttctgcagggacaggaa

SEQ ID NO: 135831 - DNA, 25 bp, Rattus norvegicus
agctgctgttgaatctgatgcgcct

SEQ ID NO: 135832 - DNA, 25 bp, Rattus norvegicus
agctgctgttgattctgatgcgcct

SEQ ID NO: 135833 - DNA, 25 bp, Rattus norvegicus
agctgctgtttcagaatccggacac

SEQ ID NO: 135834 - DNA, 25 bp, Rattus norvegicus
agctgctgtttctgaatccggacac

SEQ ID NO: 135835 - DNA, 25 bp, Rattus norvegicus
agctgctgtttgaaccctgggtgga

SEQ ID NO: 135836 - DNA, 25 bp, Rattus norvegicus
agctgctgtttgtaccctgggtgga

SEQ ID NO: 135837 - DNA, 25 bp, Rattus norvegicus
agctgcttaagcatgcccacaagta

SEQ ID NO: 135838 - DNA, 25 bp, Rattus norvegicus
agctgcttaagcttgcccacaagta

SEQ ID NO: 135839 - DNA, 25 bp, Rattus norvegicus
agctgcttagtcacatactcaggaa

SEQ ID NO: 135840 - DNA, 25 bp, Rattus norvegicus
agctgcttagtctcatactcaggaa

SEQ ID NO: 135841 - DNA, 25 bp, Rattus norvegicus
agctgcttatgcactctacttcagg

SEQ ID NO: 135842 - DNA, 25 bp, Rattus norvegicus
agctgcttatgctctctacttcagg

SEQ ID NO: 135843 - DNA, 25 bp, Rattus norvegicus
agctgcttatggcaccagtggctac

SEQ ID NO: 135844 - DNA, 25 bp, Rattus norvegicus
agctgcttatgggaccagtggctac

SEQ ID NO: 135845 - DNA, 25 bp, Rattus norvegicus
agctgcttcaaaaaccttctgccta

SEQ ID NO: 135846 - DNA, 25 bp, Rattus norvegicus
agctgcttcaaataccttctgccta

SEQ ID NO: 135847 - DNA, 25 bp, Rattus norvegicus
agctgcttcaagattgtgagtccaa

SEQ ID NO: 135848 - DNA, 25 bp, Rattus norvegicus
agctgcttcaagtttgtgagtccaa

SEQ ID NO: 135849 - DNA, 25 bp, Rattus norvegicus
agctgcttcagcaacatgtcctgct

SEQ ID NO: 135850 - DNA, 25 bp, Rattus norvegicus
agctgcttcagcacagaggctttct

SEQ ID NO: 135851 - DNA, 25 bp, Rattus norvegicus
agctgcttcagctacatgtcctgct

SEQ ID NO: 135852 - DNA, 25 bp, Rattus norvegicus
agctgcttcagctcagaggctttct

SEQ ID NO: 135853 - DNA, 25 bp, Rattus norvegicus
agctgcttcatcacatttgaggaca

SEQ ID NO: 135854 - DNA, 25 bp, Rattus norvegicus
agctgcttcatctcatttgaggaca

SEQ ID NO: 135855 - DNA, 25 bp, Rattus norvegicus
agctgcttccagaggaacctgttgt

SEQ ID NO: 135856 - DNA, 25 bp, Rattus norvegicus
agctgcttccagtggaacctgttgt

SEQ ID NO: 135857 - DNA, 25 bp, Rattus norvegicus
agctgcttccatatctatgcattca

SEQ ID NO: 135858 - DNA, 25 bp, Rattus norvegicus
agctgcttccatttctatgcattca

SEQ ID NO: 135859 - DNA, 25 bp, Rattus norvegicus
agctgcttccctatagttggttatt

SEQ ID NO: 135860 - DNA, 25 bp, Rattus norvegicus
agctgcttccctttagttggttatt

SEQ ID NO: 135861 - DNA, 25 bp, Rattus norvegicus
agctgcttccggacctgaaaccagg

SEQ ID NO: 135862 - DNA, 25 bp, Rattus norvegicus
agctgcttccggtcctgaaaccagg

SEQ ID NO: 135863 - DNA, 25 bp, Rattus norvegicus
agctgcttcgcacaaggtcaaaccg

SEQ ID NO: 135864 - DNA, 25 bp, Rattus norvegicus
agctgcttcgcagaaggtcaaaccg

SEQ ID NO: 135865 - DNA, 25 bp, Rattus norvegicus
agctgcttcgggattttggcccaca

SEQ ID NO: 135866 - DNA, 25 bp, Rattus norvegicus
agctgcttcgggtttttggcccaca

SEQ ID NO: 135867 - DNA, 25 bp, Rattus norvegicus
agctgcttctagacccagaggcaag

SEQ ID NO: 135868 - DNA, 25 bp, Rattus norvegicus
agctgcttctagtcccagaggcaag

SEQ ID NO: 135869 - DNA, 25 bp, Rattus norvegicus
agctgcttctcgagtttttaatgta

SEQ ID NO: 135870 - DNA, 25 bp, Rattus norvegicus
agctgcttctcgtgtttttaatgta

SEQ ID NO: 135871 - DNA, 25 bp, Rattus norvegicus
agctgcttctgactcctaaggctgg

SEQ ID NO: 135872 - DNA, 25 bp, Rattus norvegicus
agctgcttctgagtcctaaggctgg

SEQ ID NO: 135873 - DNA, 25 bp, Rattus norvegicus
agctgcttcttccttcactgaaatg

SEQ ID NO: 135874 - DNA, 25 bp, Rattus norvegicus
agctgcttcttcgttcactgaaatg

SEQ ID NO: 135875 - DNA, 25 bp, Rattus norvegicus
agctgcttgatcagctcggtgactc

SEQ ID NO: 135876 - DNA, 25 bp, Rattus norvegicus
agctgcttgatctgctcggtgactc

SEQ ID NO: 135877 - DNA, 25 bp, Rattus norvegicus
agctgcttgctcaactacagtgtag

SEQ ID NO: 135878 - DNA, 25 bp, Rattus norvegicus
agctgcttgctctactacagtgtag

SEQ ID NO: 135879 - DNA, 25 bp, Rattus norvegicus
agctgcttgctgaagtgaccctggt

SEQ ID NO: 135880 - DNA, 25 bp, Rattus norvegicus
agctgcttgctgtagtgaccctggt

SEQ ID NO: 135881 - DNA, 25 bp, Rattus norvegicus
agctgcttggcaaggttccgggttc

SEQ ID NO: 135882 - DNA, 25 bp, Rattus norvegicus
agctgcttggcatggttccgggttc

SEQ ID NO: 135883 - DNA, 25 bp, Rattus norvegicus
agctgcttgtccatctagttaccaa

SEQ ID NO: 135884 - DNA, 25 bp, Rattus norvegicus
agctgcttgtccttctagttaccaa

SEQ ID NO: 135885 - DNA, 25 bp, Rattus norvegicus
agctgctttacacgctgctagctta

SEQ ID NO: 135886 - DNA, 25 bp, Rattus norvegicus
agctgctttacaggctgctagctta

SEQ ID NO: 135887 - DNA, 25 bp, Rattus norvegicus
agctgctttcaaaactgtctgcgta

SEQ ID NO: 135888 - DNA, 25 bp, Rattus norvegicus
agctgctttcaatactgtctgcgta

SEQ ID NO: 135889 - DNA, 25 bp, Rattus norvegicus
agctgctttcgcaatggaagggccc

SEQ ID NO: 135890 - DNA, 25 bp, Rattus norvegicus
agctgctttcgctatggaagggccc

SEQ ID NO: 135891 - DNA, 25 bp, Rattus norvegicus
agctgctttctgcactgtatgacac

SEQ ID NO: 135892 - DNA, 25 bp, Rattus norvegicus
agctgctttctggactgtatgacac

SEQ ID NO: 135893 - DNA, 25 bp, Rattus norvegicus
agctgctttggtctttccattgcta

SEQ ID NO: 135894 - DNA, 25 bp, Rattus norvegicus
agctgctttggtgtttccattgcta

SEQ ID NO: 135895 - DNA, 25 bp, Rattus norvegicus
agctgctttgtgatattggccatag

SEQ ID NO: 135896 - DNA, 25 bp, Rattus norvegicus
agctgctttgtgctcagtgtctaca

SEQ ID NO: 135897 - DNA, 25 bp, Rattus norvegicus
agctgctttgtggtcagtgtctaca

SEQ ID NO: 135898 - DNA, 25 bp, Rattus norvegicus
agctgctttgtgttattggccatag

SEQ ID NO: 135899 - DNA, 25 bp, Rattus norvegicus
agctgctttgttctcctttggtgaa

SEQ ID NO: 135900 - DNA, 25 bp, Rattus norvegicus
agctgctttgttgtcctttggtgaa

SEQ ID NO: 135901 - DNA, 25 bp, Rattus norvegicus
agctgcttttctacgaagtgagtgc

SEQ ID NO: 135902 - DNA, 25 bp, Rattus norvegicus
agctgcttttcttcgaagtgagtgc

SEQ ID NO: 135903 - DNA, 25 bp, Rattus norvegicus
agctgcttttgtcggatatgtcttt

SEQ ID NO: 135904 - DNA, 25 bp, Rattus norvegicus
agctgcttttgtgggatatgtcttt

SEQ ID NO: 135905 - DNA, 25 bp, Rattus norvegicus
agctggaaaccaatggctctctgcg

SEQ ID NO: 135906 - DNA, 25 bp, Rattus norvegicus
agctggaaaccattggctctctgcg

SEQ ID NO: 135907 - DNA, 25 bp, Rattus norvegicus
agctggaaagatcgtgccctggcac

SEQ ID NO: 135908 - DNA, 25 bp, Rattus norvegicus
agctggaaagatggtgccctggcac

SEQ ID NO: 135909 - DNA, 25 bp, Rattus norvegicus
agctggaacagaaccaccgagtctg

SEQ ID NO: 135910 - DNA, 25 bp, Rattus norvegicus
agctggaacagaacctgctcctggg

SEQ ID NO: 135911 - DNA, 25 bp, Rattus norvegicus
agctggaacagatccaccgagtctg

SEQ ID NO: 135912 - DNA, 25 bp, Rattus norvegicus
agctggaacagatcctgctcctggg

SEQ ID NO: 135913 - DNA, 25 bp, Rattus norvegicus
agctggaaccagactaaacttaaca

SEQ ID NO: 135914 - DNA, 25 bp, Rattus norvegicus
agctggaaccagtctaaacttaaca

SEQ ID NO: 135915 - DNA, 25 bp, Rattus norvegicus
agctggaaccttagcatctgatgcc

SEQ ID NO: 135916 - DNA, 25 bp, Rattus norvegicus
agctggaacctttgcatctgatgcc

SEQ ID NO: 135917 - DNA, 25 bp, Rattus norvegicus
agctggaacgtgaattggacttaac

SEQ ID NO: 135918 - DNA, 25 bp, Rattus norvegicus
agctggaacgtgtattggacttaac

SEQ ID NO: 135919 - DNA, 25 bp, Rattus norvegicus
agctggaactttcgctgtggtcgtc

SEQ ID NO: 135920 - DNA, 25 bp, Rattus norvegicus
agctggaactttggctgtggtcgtc

SEQ ID NO: 135921 - DNA, 25 bp, Rattus norvegicus
agctggaaggctaatctgaggacct

SEQ ID NO: 135922 - DNA, 25 bp, Rattus norvegicus
agctggaaggcttatctgaggacct

SEQ ID NO: 135923 - DNA, 25 bp, Rattus norvegicus
agctggaatccactcatcatgaact

SEQ ID NO: 135924 - DNA, 25 bp, Rattus norvegicus
agctggaatccagtcatcatgaact

SEQ ID NO: 135925 - DNA, 25 bp, Rattus norvegicus
agctggaatgacactgtgccccata

SEQ ID NO: 135926 - DNA, 25 bp, Rattus norvegicus
agctggaatgactctgtgccccata

SEQ ID NO: 135927 - DNA, 25 bp, Rattus norvegicus
agctggaattcaagcacatcctcac

SEQ ID NO: 135928 - DNA, 25 bp, Rattus norvegicus
agctggaattcatgcacatcctcac

SEQ ID NO: 135929 - DNA, 25 bp, Rattus norvegicus
agctggacagtcaacgacgggtaag

SEQ ID NO: 135930 - DNA, 25 bp, Rattus norvegicus
agctggacagtctacgacgggtaag

SEQ ID NO: 135931 - DNA, 25 bp, Rattus norvegicus
agctggacatgactactgtagcatt

SEQ ID NO: 135932 - DNA, 25 bp, Rattus norvegicus
agctggacatgagtactgtagcatt

SEQ ID NO: 135933 - DNA, 25 bp, Rattus norvegicus
agctggaccaagaaacctagccctg

SEQ ID NO: 135934 - DNA, 25 bp, Rattus norvegicus
agctggaccaagctgacatgcccaa

SEQ ID NO: 135935 - DNA, 25 bp, Rattus norvegicus
agctggaccaaggtgacatgcccaa

SEQ ID NO: 135936 - DNA, 25 bp, Rattus norvegicus
agctggaccaagtaacctagccctg

SEQ ID NO: 135937 - DNA, 25 bp, Rattus norvegicus
agctggaccatgaaactggctgatc

SEQ ID NO: 135938 - DNA, 25 bp, Rattus norvegicus
agctggaccatgagtgccttagtac

SEQ ID NO: 135939 - DNA, 25 bp, Rattus norvegicus
agctggaccatgtaactggctgatc

SEQ ID NO: 135940 - DNA, 25 bp, Rattus norvegicus
agctggaccatgtgtgccttagtac

SEQ ID NO: 135941 - DNA, 25 bp, Rattus norvegicus
agctggaccctacactggcagaaat

SEQ ID NO: 135942 - DNA, 25 bp, Rattus norvegicus
agctggaccctagactggcagaaat

SEQ ID NO: 135943 - DNA, 25 bp, Rattus norvegicus
agctggaccctgcagaccggtcgaa

SEQ ID NO: 135944 - DNA, 25 bp, Rattus norvegicus
agctggaccctggagaccggtcgaa

SEQ ID NO: 135945 - DNA, 25 bp, Rattus norvegicus
agctggacctcacggttgtgtgtaa

SEQ ID NO: 135946 - DNA, 25 bp, Rattus norvegicus
agctggacctcagggttgtgtgtaa

SEQ ID NO: 135947 - DNA, 25 bp, Rattus norvegicus
agctggacctgccattctaggatat

SEQ ID NO: 135948 - DNA, 25 bp, Rattus norvegicus
agctggacctgcgattctaggatat

SEQ ID NO: 135949 - DNA, 25 bp, Rattus norvegicus
agctggacctgtaggtagtcacttc

SEQ ID NO: 135950 - DNA, 25 bp, Rattus norvegicus
agctggacctgttggtagtcacttc

SEQ ID NO: 135951 - DNA, 25 bp, Rattus norvegicus
agctggacgcttccatcctggagga

SEQ ID NO: 135952 - DNA, 25 bp, Rattus norvegicus
agctggacgcttgcatcctggagga

SEQ ID NO: 135953 - DNA, 25 bp, Rattus norvegicus
agctggactaagcacctgtctacct

SEQ ID NO: 135954 - DNA, 25 bp, Rattus norvegicus
agctggactaaggacctgtctacct

SEQ ID NO: 135955 - DNA, 25 bp, Rattus norvegicus
agctggactcttagtttctcttcaa

SEQ ID NO: 135956 - DNA, 25 bp, Rattus norvegicus
agctggactctttgtttctcttcaa

SEQ ID NO: 135957 - DNA, 25 bp, Rattus norvegicus
agctggactgagcttgccttcgcac

SEQ ID NO: 135958 - DNA, 25 bp, Rattus norvegicus
agctggactgaggttgccttcgcac

SEQ ID NO: 135959 - DNA, 25 bp, Rattus norvegicus
agctggactgccatgtctcacctca

SEQ ID NO: 135960 - DNA, 25 bp, Rattus norvegicus
agctggactgccttgtctcacctca

SEQ ID NO: 135961 - DNA, 25 bp, Rattus norvegicus
agctggactgtcaggctgctttttt

SEQ ID NO: 135962 - DNA, 25 bp, Rattus norvegicus
agctggactgtctggctgctttttt

SEQ ID NO: 135963 - DNA, 25 bp, Rattus norvegicus
agctggactgttcagcaggcctgtc

SEQ ID NO: 135964 - DNA, 25 bp, Rattus norvegicus
agctggactgttgagcaggcctgtc

SEQ ID NO: 135965 - DNA, 25 bp, Rattus norvegicus
agctggagaaagacccaagtgggta

SEQ ID NO: 135966 - DNA, 25 bp, Rattus norvegicus
agctggagaaagtcccaagtgggta

SEQ ID NO: 135967 - DNA, 25 bp, Rattus norvegicus
agctggagaagccacgccaagtgtt

SEQ ID NO: 135968 - DNA, 25 bp, Rattus norvegicus
agctggagaagcgacgccaagtgtt

SEQ ID NO: 135969 - DNA, 25 bp, Rattus norvegicus
agctggagaatcacgttttctggat

SEQ ID NO: 135970 - DNA, 25 bp, Rattus norvegicus
agctggagaatctcgttttctggat

SEQ ID NO: 135971 - DNA, 25 bp, Rattus norvegicus
agctggagacaccttaagatgcccc

SEQ ID NO: 135972 - DNA, 25 bp, Rattus norvegicus
agctggagacacgttaagatgcccc

SEQ ID NO: 135973 - DNA, 25 bp, Rattus norvegicus
agctggagatctcttgttacctttt

SEQ ID NO: 135974 - DNA, 25 bp, Rattus norvegicus
agctggagatctgttgttacctttt

SEQ ID NO: 135975 - DNA, 25 bp, Rattus norvegicus
agctggagatgacacccttcggttc

SEQ ID NO: 135976 - DNA, 25 bp, Rattus norvegicus
agctggagatgagacccttcggttc

SEQ ID NO: 135977 - DNA, 25 bp, Rattus norvegicus
agctggagcagaacatcaccttggt

SEQ ID NO: 135978 - DNA, 25 bp, Rattus norvegicus
agctggagcagatcatcaccttggt

SEQ ID NO: 135979 - DNA, 25 bp, Rattus norvegicus
agctggagcagtaccaccacggcgg

SEQ ID NO: 135980 - DNA, 25 bp, Rattus norvegicus
agctggagcagttccaccacggcgg

SEQ ID NO: 135981 - DNA, 25 bp, Rattus norvegicus
agctggagccacacactcccagagg

SEQ ID NO: 135982 - DNA, 25 bp, Rattus norvegicus
agctggagccactcactcccagagg

SEQ ID NO: 135983 - DNA, 25 bp, Rattus norvegicus
agctggagcgccaggccttggccaa

SEQ ID NO: 135984 - DNA, 25 bp, Rattus norvegicus
agctggagcgcctggccttggccaa

SEQ ID NO: 135985 - DNA, 25 bp, Rattus norvegicus
agctggagcgcgagaacctgctgct

SEQ ID NO: 135986 - DNA, 25 bp, Rattus norvegicus
agctggagcgcgtgaacctgctgct

SEQ ID NO: 135987 - DNA, 25 bp, Rattus norvegicus
agctggagcggcaaggcaacgtcct

SEQ ID NO: 135988 - DNA, 25 bp, Rattus norvegicus
agctggagcggctaggcaacgtcct

SEQ ID NO: 135989 - DNA, 25 bp, Rattus norvegicus
agctggagctccagaagcgaattca

SEQ ID NO: 135990 - DNA, 25 bp, Rattus norvegicus
agctggagctcctgaagcgaattca

SEQ ID NO: 135991 - DNA, 25 bp, Rattus norvegicus
agctggagctgcagacccgagagca

SEQ ID NO: 135992 - DNA, 25 bp, Rattus norvegicus
agctggagctgctgacccgagagca

SEQ ID NO: 135993 - DNA, 25 bp, Rattus norvegicus
agctggagcttaatttttgtgtgtt

SEQ ID NO: 135994 - DNA, 25 bp, Rattus norvegicus
agctggagcttattttttgtgtgtt

SEQ ID NO: 135995 - DNA, 25 bp, Rattus norvegicus
agctggaggctcaggcatccatcgc

SEQ ID NO: 135996 - DNA, 25 bp, Rattus norvegicus
agctggaggctctggcatccatcgc

SEQ ID NO: 135997 - DNA, 25 bp, Rattus norvegicus
agctggaggctgatttcctgagaga

SEQ ID NO: 135998 - DNA, 25 bp, Rattus norvegicus
agctggaggctgttttcctgagaga

SEQ ID NO: 135999 - DNA, 25 bp, Rattus norvegicus
agctggaggtccatagcactgcctt

SEQ ID NO: 136000 - DNA, 25 bp, Rattus norvegicus
agctggaggtccttagcactgcctt

SEQ ID NO: 136001 - DNA, 25 bp, Rattus norvegicus
agctggaggtgaacatcgatcgcat

SEQ ID NO: 136002 - DNA, 25 bp, Rattus norvegicus
agctggaggtgatcatcgatcgcat

SEQ ID NO: 136003 - DNA, 25 bp, Rattus norvegicus
agctggagtaacaagatggcggcat

SEQ ID NO: 136004 - DNA, 25 bp, Rattus norvegicus
agctggagtaactagatggcggcat

SEQ ID NO: 136005 - DNA, 25 bp, Rattus norvegicus
agctggagtggacctctctcctgaa

SEQ ID NO: 136006 - DNA, 25 bp, Rattus norvegicus
agctggagtggagctctctcctgaa

SEQ ID NO: 136007 - DNA, 25 bp, Rattus norvegicus
agctggatacagctgtgcctgtatt

SEQ ID NO: 136008 - DNA, 25 bp, Rattus norvegicus
agctggatacaggtgtgcctgtatt

SEQ ID NO: 136009 - DNA, 25 bp, Rattus norvegicus
agctggatagggatgacacattttc

SEQ ID NO: 136010 - DNA, 25 bp, Rattus norvegicus
agctggatagggttgacacattttc

SEQ ID NO: 136011 - DNA, 25 bp, Rattus norvegicus
agctggatatccacagtatgtctca

SEQ ID NO: 136012 - DNA, 25 bp, Rattus norvegicus
agctggatatcctcagtatgtctca

SEQ ID NO: 136013 - DNA, 25 bp, Rattus norvegicus
agctggatcagcacccgattgatgg

SEQ ID NO: 136014 - DNA, 25 bp, Rattus norvegicus
agctggatcagctcccgattgatgg

SEQ ID NO: 136015 - DNA, 25 bp, Rattus norvegicus
agctggatccagaccctgagggaga

SEQ ID NO: 136016 - DNA, 25 bp, Rattus norvegicus
agctggatccagtccctgagggaga

SEQ ID NO: 136017 - DNA, 25 bp, Rattus norvegicus
agctggatcgctaccagtctggagg

SEQ ID NO: 136018 - DNA, 25 bp, Rattus norvegicus
agctggatcgcttccagtctggagg

SEQ ID NO: 136019 - DNA, 25 bp, Rattus norvegicus
agctggatctctcaggctgactgaa

SEQ ID NO: 136020 - DNA, 25 bp, Rattus norvegicus
agctggatctctgaggctgactgaa

SEQ ID NO: 136021 - DNA, 25 bp, Rattus norvegicus
agctggatgaacaaggacaccctgg

SEQ ID NO: 136022 - DNA, 25 bp, Rattus norvegicus
agctggatgaactaggacaccctgg

SEQ ID NO: 136023 - DNA, 25 bp, Rattus norvegicus
agctggatgcagatgacaccggcgt

SEQ ID NO: 136024 - DNA, 25 bp, Rattus norvegicus
agctggatgcagttgacaccggcgt

SEQ ID NO: 136025 - DNA, 25 bp, Rattus norvegicus
agctggatgccgaaacccacagagc

SEQ ID NO: 136026 - DNA, 25 bp, Rattus norvegicus
agctggatgccgtaacccacagagc

SEQ ID NO: 136027 - DNA, 25 bp, Rattus norvegicus
agctggatgctacgtccttgtctaa

SEQ ID NO: 136028 - DNA, 25 bp, Rattus norvegicus
agctggatgctaggtccttgtctaa

SEQ ID NO: 136029 - DNA, 25 bp, Rattus norvegicus
agctggatggacctcacggctcaaa

SEQ ID NO: 136030 - DNA, 25 bp, Rattus norvegicus
agctggatggacgtcacggctcaaa

SEQ ID NO: 136031 - DNA, 25 bp, Rattus norvegicus
agctggatggagatctcccacactt

SEQ ID NO: 136032 - DNA, 25 bp, Rattus norvegicus
agctggatggagttctcccacactt

SEQ ID NO: 136033 - DNA, 25 bp, Rattus norvegicus
agctggatgttcatagggcggccat

SEQ ID NO: 136034 - DNA, 25 bp, Rattus norvegicus
agctggatgttcttagggcggccat

SEQ ID NO: 136035 - DNA, 25 bp, Rattus norvegicus
agctggattctcagccatttgtaat

SEQ ID NO: 136036 - DNA, 25 bp, Rattus norvegicus
agctggattctctgccatttgtaat

SEQ ID NO: 136037 - DNA, 25 bp, Rattus norvegicus
agctggattggcagactcttcgggc

SEQ ID NO: 136038 - DNA, 25 bp, Rattus norvegicus
agctggattggctgactcttcgggc

SEQ ID NO: 136039 - DNA, 25 bp, Rattus norvegicus
agctggatttccatgagggcgatca

SEQ ID NO: 136040 - DNA, 25 bp, Rattus norvegicus
agctggatttccttgagggcgatca

SEQ ID NO: 136041 - DNA, 25 bp, Rattus norvegicus
agctggatttcgaggtgtacacctt

SEQ ID NO: 136042 - DNA, 25 bp, Rattus norvegicus
agctggatttcgtggtgtacacctt

SEQ ID NO: 136043 - DNA, 25 bp, Rattus norvegicus
agctggattttgacttcccttggtt

SEQ ID NO: 136044 - DNA, 25 bp, Rattus norvegicus
agctggattttgtcttcccttggtt

SEQ ID NO: 136045 - DNA, 25 bp, Rattus norvegicus
agctggcaaaatcagagaagtttac

SEQ ID NO: 136046 - DNA, 25 bp, Rattus norvegicus
agctggcaaaatgagagaagtttac

SEQ ID NO: 136047 - DNA, 25 bp, Rattus norvegicus
agctggcaaagtcaccaagtctgcc

SEQ ID NO: 136048 - DNA, 25 bp, Rattus norvegicus
agctggcaaagtgaccaagtctgcc

SEQ ID NO: 136049 - DNA, 25 bp, Rattus norvegicus
agctggcaagataccttgttcctgt

SEQ ID NO: 136050 - DNA, 25 bp, Rattus norvegicus
agctggcaagattccttgttcctgt

SEQ ID NO: 136051 - DNA, 25 bp, Rattus norvegicus
agctggcaatgtaggcccctttgtg

SEQ ID NO: 136052 - DNA, 25 bp, Rattus norvegicus
agctggcaatgtcatttcttttcaa

SEQ ID NO: 136053 - DNA, 25 bp, Rattus norvegicus
agctggcaatgtgatttcttttcaa

SEQ ID NO: 136054 - DNA, 25 bp, Rattus norvegicus
agctggcaatgttggcccctttgtg

SEQ ID NO: 136055 - DNA, 25 bp, Rattus norvegicus
agctggcacaacacggtggatctct

SEQ ID NO: 136056 - DNA, 25 bp, Rattus norvegicus
agctggcacaactcggtggatctct

SEQ ID NO: 136057 - DNA, 25 bp, Rattus norvegicus
agctggcacaccactacttcgaaat

SEQ ID NO: 136058 - DNA, 25 bp, Rattus norvegicus
agctggcacacctctacttcgaaat

SEQ ID NO: 136059 - DNA, 25 bp, Rattus norvegicus
agctggcacagaatgatggcaccct

SEQ ID NO: 136060 - DNA, 25 bp, Rattus norvegicus
agctggcacagattgatggcaccct

SEQ ID NO: 136061 - DNA, 25 bp, Rattus norvegicus
agctggcacaggactgctagaggaa

SEQ ID NO: 136062 - DNA, 25 bp, Rattus norvegicus
agctggcacaggtctgctagaggaa

SEQ ID NO: 136063 - DNA, 25 bp, Rattus norvegicus
agctggcacccaaggtggagatgaa

SEQ ID NO: 136064 - DNA, 25 bp, Rattus norvegicus
agctggcacccaattcttattggca

SEQ ID NO: 136065 - DNA, 25 bp, Rattus norvegicus
agctggcacccatggtggagatgaa

SEQ ID NO: 136066 - DNA, 25 bp, Rattus norvegicus
agctggcacccatttcttattggca

SEQ ID NO: 136067 - DNA, 25 bp, Rattus norvegicus
agctggcaccgacaagacaagggaa

SEQ ID NO: 136068 - DNA, 25 bp, Rattus norvegicus
agctggcaccgagaagacaagggaa

SEQ ID NO: 136069 - DNA, 25 bp, Rattus norvegicus
agctggcaccttagtgaggctggaa

SEQ ID NO: 136070 - DNA, 25 bp, Rattus norvegicus
agctggcacctttgtgaggctggaa

SEQ ID NO: 136071 - DNA, 25 bp, Rattus norvegicus
agctggcagctgagaggctctatgt

SEQ ID NO: 136072 - DNA, 25 bp, Rattus norvegicus
agctggcagctgtgaggctctatgt

SEQ ID NO: 136073 - DNA, 25 bp, Rattus norvegicus
agctggcaggttctgttagtcctcc

SEQ ID NO: 136074 - DNA, 25 bp, Rattus norvegicus
agctggcaggttgtgttagtcctcc

SEQ ID NO: 136075 - DNA, 25 bp, Rattus norvegicus
agctggcagtacatgagcactctgt

SEQ ID NO: 136076 - DNA, 25 bp, Rattus norvegicus
agctggcagtacttgagcactctgt

SEQ ID NO: 136077 - DNA, 25 bp, Rattus norvegicus
agctggcatcaaaacttcttctttc

SEQ ID NO: 136078 - DNA, 25 bp, Rattus norvegicus
agctggcatcaatacttcttctttc

SEQ ID NO: 136079 - DNA, 25 bp, Rattus norvegicus
agctggcatcctaggtaacaccttc

SEQ ID NO: 136080 - DNA, 25 bp, Rattus norvegicus
agctggcatccttggtaacaccttc

SEQ ID NO: 136081 - DNA, 25 bp, Rattus norvegicus
agctggcatcggctttgagttacca

SEQ ID NO: 136082 - DNA, 25 bp, Rattus norvegicus
agctggcatcgggtttgagttacca

SEQ ID NO: 136083 - DNA, 25 bp, Rattus norvegicus
agctggcatgctacagagggttgca

SEQ ID NO: 136084 - DNA, 25 bp, Rattus norvegicus
agctggcatgcttcagagggttgca

SEQ ID NO: 136085 - DNA, 25 bp, Rattus norvegicus
agctggccaaatctatgaaccttca

SEQ ID NO: 136086 - DNA, 25 bp, Rattus norvegicus
agctggccaaatgtatgaaccttca

SEQ ID NO: 136087 - DNA, 25 bp, Rattus norvegicus
agctggccaatcatcaggagtcctt

SEQ ID NO: 136088 - DNA, 25 bp, Rattus norvegicus
agctggccaatcttcaggagtcctt

SEQ ID NO: 136089 - DNA, 25 bp, Rattus norvegicus
agctggccaccacaagaaactactg

SEQ ID NO: 136090 - DNA, 25 bp, Rattus norvegicus
agctggccaccagaagaaactactg

SEQ ID NO: 136091 - DNA, 25 bp, Rattus norvegicus
agctggccaccgcttgtctgctagt

SEQ ID NO: 136092 - DNA, 25 bp, Rattus norvegicus
agctggccaccggttgtctgctagt

SEQ ID NO: 136093 - DNA, 25 bp, Rattus norvegicus
agctggccacggaagcgctctaaga

SEQ ID NO: 136094 - DNA, 25 bp, Rattus norvegicus
agctggccacggtagcgctctaaga

SEQ ID NO: 136095 - DNA, 25 bp, Rattus norvegicus
agctggccacttcgcaatcatgcct

SEQ ID NO: 136096 - DNA, 25 bp, Rattus norvegicus
agctggccacttggcaatcatgcct

SEQ ID NO: 136097 - DNA, 25 bp, Rattus norvegicus
agctggccagacaaacattcccaac

SEQ ID NO: 136098 - DNA, 25 bp, Rattus norvegicus
agctggccagactaacattcccaac

SEQ ID NO: 136099 - DNA, 25 bp, Rattus norvegicus
agctggccagcaatctctaggactt

SEQ ID NO: 136100 - DNA, 25 bp, Rattus norvegicus
agctggccagcattctctaggactt

SEQ ID NO: 136101 - DNA, 25 bp, Rattus norvegicus
agctggccagctaaaaggttcatca

SEQ ID NO: 136102 - DNA, 25 bp, Rattus norvegicus
agctggccagcttaaaggttcatca

SEQ ID NO: 136103 - DNA, 25 bp, Rattus norvegicus
agctggccatacctctaggtttgta

SEQ ID NO: 136104 - DNA, 25 bp, Rattus norvegicus
agctggccatacgtctaggtttgta

SEQ ID NO: 136105 - DNA, 25 bp, Rattus norvegicus
agctggccattcctgtgtatgtaag

SEQ ID NO: 136106 - DNA, 25 bp, Rattus norvegicus
agctggccattcgtgtgtatgtaag

SEQ ID NO: 136107 - DNA, 25 bp, Rattus norvegicus
agctggcccagcacaaggctgatat

SEQ ID NO: 136108 - DNA, 25 bp, Rattus norvegicus
agctggcccagctcaaggctgatat

SEQ ID NO: 136109 - DNA, 25 bp, Rattus norvegicus
agctggcccctccagtaggatggta

SEQ ID NO: 136110 - DNA, 25 bp, Rattus norvegicus
agctggcccctcgagtaggatggta

SEQ ID NO: 136111 - DNA, 25 bp, Rattus norvegicus
agctggcccgaacaacacaatttgt

SEQ ID NO: 136112 - DNA, 25 bp, Rattus norvegicus
agctggcccgaagaacacaatttgt

SEQ ID NO: 136113 - DNA, 25 bp, Rattus norvegicus
agctggcccgccatgaactggaagg

SEQ ID NO: 136114 - DNA, 25 bp, Rattus norvegicus
agctggcccgccttgaactggaagg

SEQ ID NO: 136115 - DNA, 25 bp, Rattus norvegicus
agctggccctggaatccttgaggaa

SEQ ID NO: 136116 - DNA, 25 bp, Rattus norvegicus
agctggccctggactatgtgtccca

SEQ ID NO: 136117 - DNA, 25 bp, Rattus norvegicus
agctggccctggatatgggagtcac

SEQ ID NO: 136118 - DNA, 25 bp, Rattus norvegicus
agctggccctggtatccttgaggaa

SEQ ID NO: 136119 - DNA, 25 bp, Rattus norvegicus
agctggccctggtctatgtgtccca

SEQ ID NO: 136120 - DNA, 25 bp, Rattus norvegicus
agctggccctggttatgggagtcac

SEQ ID NO: 136121 - DNA, 25 bp, Rattus norvegicus
agctggccgccacgtacatagactt

SEQ ID NO: 136122 - DNA, 25 bp, Rattus norvegicus
agctggccgccaggtacatagactt

SEQ ID NO: 136123 - DNA, 25 bp, Rattus norvegicus
agctggcctatacacttacgaaagt

SEQ ID NO: 136124 - DNA, 25 bp, Rattus norvegicus
agctggcctatagacttacgaaagt

SEQ ID NO: 136125 - DNA, 25 bp, Rattus norvegicus
agctggcctatgagcctaagggaca

SEQ ID NO: 136126 - DNA, 25 bp, Rattus norvegicus
agctggcctatgtgcctaagggaca

SEQ ID NO: 136127 - DNA, 25 bp, Rattus norvegicus
agctggcctcacagttgggccactg

SEQ ID NO: 136128 - DNA, 25 bp, Rattus norvegicus
agctggcctcactgttgggccactg

SEQ ID NO: 136129 - DNA, 25 bp, Rattus norvegicus
agctggcctcatctaatctggaagt

SEQ ID NO: 136130 - DNA, 25 bp, Rattus norvegicus
agctggcctcatgtaatctggaagt

SEQ ID NO: 136131 - DNA, 25 bp, Rattus norvegicus
agctggcctccaagcgggtggacat

SEQ ID NO: 136132 - DNA, 25 bp, Rattus norvegicus
agctggcctccatgcgggtggacat

SEQ ID NO: 136133 - DNA, 25 bp, Rattus norvegicus
agctggcctctactacagagcctgc

SEQ ID NO: 136134 - DNA, 25 bp, Rattus norvegicus
agctggcctctagtacagagcctgc

SEQ ID NO: 136135 - DNA, 25 bp, Rattus norvegicus
agctggcctgctcctgcaaatggat

SEQ ID NO: 136136 - DNA, 25 bp, Rattus norvegicus
agctggcctgctgctgcaaatggat

SEQ ID NO: 136137 - DNA, 25 bp, Rattus norvegicus
agctggccttaaagttgactttgaa

SEQ ID NO: 136138 - DNA, 25 bp, Rattus norvegicus
agctggccttaatgttgactttgaa

SEQ ID NO: 136139 - DNA, 25 bp, Rattus norvegicus
agctggccttggacctacataggag

SEQ ID NO: 136140 - DNA, 25 bp, Rattus norvegicus
agctggccttggacttttgaagtta

SEQ ID NO: 136141 - DNA, 25 bp, Rattus norvegicus
agctggccttggtcctacataggag

SEQ ID NO: 136142 - DNA, 25 bp, Rattus norvegicus
agctggccttggtcttttgaagtta

SEQ ID NO: 136143 - DNA, 25 bp, Rattus norvegicus
agctggcgcccaccgaatataggta

SEQ ID NO: 136144 - DNA, 25 bp, Rattus norvegicus
agctggcgcccagcgaatataggta

SEQ ID NO: 136145 - DNA, 25 bp, Rattus norvegicus
agctggcgtctgagtatgacctgga

SEQ ID NO: 136146 - DNA, 25 bp, Rattus norvegicus
agctggcgtctgtgtatgacctgga

SEQ ID NO: 136147 - DNA, 25 bp, Rattus norvegicus
agctggctaacactgcaggctgcta

SEQ ID NO: 136148 - DNA, 25 bp, Rattus norvegicus
agctggctaacagtgcaggctgcta

SEQ ID NO: 136149 - DNA, 25 bp, Rattus norvegicus
agctggctaaggagctcgaggccca

SEQ ID NO: 136150 - DNA, 25 bp, Rattus norvegicus
agctggctaaggtgctcgaggccca

SEQ ID NO: 136151 - DNA, 25 bp, Rattus norvegicus
agctggctacagacatcgactatct

SEQ ID NO: 136152 - DNA, 25 bp, Rattus norvegicus
agctggctacagtcatcgactatct

SEQ ID NO: 136153 - DNA, 25 bp, Rattus norvegicus
agctggctacgtacatactgggaca

SEQ ID NO: 136154 - DNA, 25 bp, Rattus norvegicus
agctggctacgttcatactgggaca

SEQ ID NO: 136155 - DNA, 25 bp, Rattus norvegicus
agctggctactaagcctagcaaaag

SEQ ID NO: 136156 - DNA, 25 bp, Rattus norvegicus
agctggctactatgcctagcaaaag

SEQ ID NO: 136157 - DNA, 25 bp, Rattus norvegicus
agctggctactgatgttgcacttac

SEQ ID NO: 136158 - DNA, 25 bp, Rattus norvegicus
agctggctactgttgttgcacttac

SEQ ID NO: 136159 - DNA, 25 bp, Rattus norvegicus
agctggctagatacaagcaccccat

SEQ ID NO: 136160 - DNA, 25 bp, Rattus norvegicus
agctggctagattcaagcaccccat

SEQ ID NO: 136161 - DNA, 25 bp, Rattus norvegicus
agctggctagccaacccaatggaag

SEQ ID NO: 136162 - DNA, 25 bp, Rattus norvegicus
agctggctagcctacccaatggaag

SEQ ID NO: 136163 - DNA, 25 bp, Rattus norvegicus
agctggctaggcaactggaagaaaa

SEQ ID NO: 136164 - DNA, 25 bp, Rattus norvegicus
agctggctaggctactggaagaaaa

SEQ ID NO: 136165 - DNA, 25 bp, Rattus norvegicus
agctggctagttattcagtgcccat

SEQ ID NO: 136166 - DNA, 25 bp, Rattus norvegicus
agctggctagtttttcagtgcccat

SEQ ID NO: 136167 - DNA, 25 bp, Rattus norvegicus
agctggctcagcagcgctgcgagat

SEQ ID NO: 136168 - DNA, 25 bp, Rattus norvegicus
agctggctcagctgcgctgcgagat

SEQ ID NO: 136169 - DNA, 25 bp, Rattus norvegicus
agctggctccgtagcaggaatcaca

SEQ ID NO: 136170 - DNA, 25 bp, Rattus norvegicus
agctggctccgttgcaggaatcaca

SEQ ID NO: 136171 - DNA, 25 bp, Rattus norvegicus
agctggctcctgcaccctaaatgag

SEQ ID NO: 136172 - DNA, 25 bp, Rattus norvegicus
agctggctcctggaccctaaatgag

SEQ ID NO: 136173 - DNA, 25 bp, Rattus norvegicus
agctggctcgatctcaatcgccgcg

SEQ ID NO: 136174 - DNA, 25 bp, Rattus norvegicus
agctggctcgatgtcaatcgccgcg

SEQ ID NO: 136175 - DNA, 25 bp, Rattus norvegicus
agctggctgaccaggacacgtacca

SEQ ID NO: 136176 - DNA, 25 bp, Rattus norvegicus
agctggctgacctggacacgtacca

SEQ ID NO: 136177 - DNA, 25 bp, Rattus norvegicus
agctggctgactcttcaatacctgt

SEQ ID NO: 136178 - DNA, 25 bp, Rattus norvegicus
agctggctgactgttcaatacctgt

SEQ ID NO: 136179 - DNA, 25 bp, Rattus norvegicus
agctggctgagaatttccgggcttc

SEQ ID NO: 136180 - DNA, 25 bp, Rattus norvegicus
agctggctgagattttccgggcttc

SEQ ID NO: 136181 - DNA, 25 bp, Rattus norvegicus
agctggctgcacaccattagacttg

SEQ ID NO: 136182 - DNA, 25 bp, Rattus norvegicus
agctggctgcactccattagacttg

SEQ ID NO: 136183 - DNA, 25 bp, Rattus norvegicus
agctggctgccacacagcaggtgaa

SEQ ID NO: 136184 - DNA, 25 bp, Rattus norvegicus
agctggctgccagacagcaggtgaa

SEQ ID NO: 136185 - DNA, 25 bp, Rattus norvegicus
agctggctgctaacttgggtctcac

SEQ ID NO: 136186 - DNA, 25 bp, Rattus norvegicus
agctggctgctatcttgggtctcac

SEQ ID NO: 136187 - DNA, 25 bp, Rattus norvegicus
agctggctgctgaagtagatgtcca

SEQ ID NO: 136188 - DNA, 25 bp, Rattus norvegicus
agctggctgctgtagtagatgtcca

SEQ ID NO: 136189 - DNA, 25 bp, Rattus norvegicus
agctggctggccataaaactctgag

SEQ ID NO: 136190 - DNA, 25 bp, Rattus norvegicus
agctggctggccttaaaactctgag

SEQ ID NO: 136191 - DNA, 25 bp, Rattus norvegicus
agctggctgggcaccggagctggct

SEQ ID NO: 136192 - DNA, 25 bp, Rattus norvegicus
agctggctgggctccggagctggct

SEQ ID NO: 136193 - DNA, 25 bp, Rattus norvegicus
agctggctggtgcacacacaggtct

SEQ ID NO: 136194 - DNA, 25 bp, Rattus norvegicus
agctggctggtggacacacaggtct

SEQ ID NO: 136195 - DNA, 25 bp, Rattus norvegicus
agctggctgtacatgcctggctggt

SEQ ID NO: 136196 - DNA, 25 bp, Rattus norvegicus
agctggctgtacttgcctggctggt

SEQ ID NO: 136197 - DNA, 25 bp, Rattus norvegicus
agctggctgtccactaaaaatctca

SEQ ID NO: 136198 - DNA, 25 bp, Rattus norvegicus
agctggctgtcctctaaaaatctca

SEQ ID NO: 136199 - DNA, 25 bp, Rattus norvegicus
agctggctgttaacgtgtaggcgat

SEQ ID NO: 136200 - DNA, 25 bp, Rattus norvegicus
agctggctgttatcgtgtaggcgat

SEQ ID NO: 136201 - DNA, 25 bp, Rattus norvegicus
agctggcttcagagtgtctttgtca

SEQ ID NO: 136202 - DNA, 25 bp, Rattus norvegicus
agctggcttcagtgtgtctttgtca

SEQ ID NO: 136203 - DNA, 25 bp, Rattus norvegicus
agctggcttctacactcataagtat

SEQ ID NO: 136204 - DNA, 25 bp, Rattus norvegicus
agctggcttctagactcataagtat

SEQ ID NO: 136205 - DNA, 25 bp, Rattus norvegicus
agctgggaaaggatgcgcggcctcc

SEQ ID NO: 136206 - DNA, 25 bp, Rattus norvegicus
agctgggaaaggttgcgcggcctcc

SEQ ID NO: 136207 - DNA, 25 bp, Rattus norvegicus
agctgggaacaacgcattctctgct

SEQ ID NO: 136208 - DNA, 25 bp, Rattus norvegicus
agctgggaacaaggcattctctgct

SEQ ID NO: 136209 - DNA, 25 bp, Rattus norvegicus
agctgggaacagcactcatctgagg

SEQ ID NO: 136210 - DNA, 25 bp, Rattus norvegicus
agctgggaacaggactcatctgagg

SEQ ID NO: 136211 - DNA, 25 bp, Rattus norvegicus
agctgggaactcaggctcctggaaa

SEQ ID NO: 136212 - DNA, 25 bp, Rattus norvegicus
agctgggaactctggctcctggaaa

SEQ ID NO: 136213 - DNA, 25 bp, Rattus norvegicus
agctgggaagctcgtatgagtcaac

SEQ ID NO: 136214 - DNA, 25 bp, Rattus norvegicus
agctgggaagctggtatgagtcaac

SEQ ID NO: 136215 - DNA, 25 bp, Rattus norvegicus
agctgggaatacaacgcctctatct

SEQ ID NO: 136216 - DNA, 25 bp, Rattus norvegicus
agctgggaatactacgcctctatct

SEQ ID NO: 136217 - DNA, 25 bp, Rattus norvegicus
agctgggaccatcctagtcatttcc

SEQ ID NO: 136218 - DNA, 25 bp, Rattus norvegicus
agctgggaccatgctagtcatttcc

SEQ ID NO: 136219 - DNA, 25 bp, Rattus norvegicus
agctgggacccaatgttgtgtagaa

SEQ ID NO: 136220 - DNA, 25 bp, Rattus norvegicus
agctgggacccattgttgtgtagaa

SEQ ID NO: 136221 - DNA, 25 bp, Rattus norvegicus
agctgggaccctatgccttcaagat

SEQ ID NO: 136222 - DNA, 25 bp, Rattus norvegicus
agctgggaccctttgccttcaagat

SEQ ID NO: 136223 - DNA, 25 bp, Rattus norvegicus
agctgggaccgacgaaggctcattt

SEQ ID NO: 136224 - DNA, 25 bp, Rattus norvegicus
agctgggaccgaggaaggctcattt

SEQ ID NO: 136225 - DNA, 25 bp, Rattus norvegicus
agctgggacctacgctatcttatta

SEQ ID NO: 136226 - DNA, 25 bp, Rattus norvegicus
agctgggacctaggctatcttatta

SEQ ID NO: 136227 - DNA, 25 bp, Rattus norvegicus
agctgggactgcagtcacacactgc

SEQ ID NO: 136228 - DNA, 25 bp, Rattus norvegicus
agctgggactgcatgccctgaagac

SEQ ID NO: 136229 - DNA, 25 bp, Rattus norvegicus
agctgggactgctgtcacacactgc

SEQ ID NO: 136230 - DNA, 25 bp, Rattus norvegicus
agctgggactgcttgccctgaagac

SEQ ID NO: 136231 - DNA, 25 bp, Rattus norvegicus
agctgggagctcatttttgtacatt

SEQ ID NO: 136232 - DNA, 25 bp, Rattus norvegicus
agctgggagctcttttttgtacatt

SEQ ID NO: 136233 - DNA, 25 bp, Rattus norvegicus
agctgggagctgagtatctggtctt

SEQ ID NO: 136234 - DNA, 25 bp, Rattus norvegicus
agctgggagctgtgtatctggtctt

SEQ ID NO: 136235 - DNA, 25 bp, Rattus norvegicus
agctgggatgccattgctctcaggg

SEQ ID NO: 136236 - DNA, 25 bp, Rattus norvegicus
agctgggatgcctttgctctcaggg

SEQ ID NO: 136237 - DNA, 25 bp, Rattus norvegicus
agctgggatgtgcagtctctaccat

SEQ ID NO: 136238 - DNA, 25 bp, Rattus norvegicus
agctgggatgtggagtctctaccat

SEQ ID NO: 136239 - DNA, 25 bp, Rattus norvegicus
agctgggattgtcctggttactata

SEQ ID NO: 136240 - DNA, 25 bp, Rattus norvegicus
agctgggattgtgctggttactata

SEQ ID NO: 136241 - DNA, 25 bp, Rattus norvegicus
agctgggcacctctgagccgtcaca

SEQ ID NO: 136242 - DNA, 25 bp, Rattus norvegicus
agctgggcacctgtgagccgtcaca

SEQ ID NO: 136243 - DNA, 25 bp, Rattus norvegicus
agctgggcagaaaccacatcacagt

SEQ ID NO: 136244 - DNA, 25 bp, Rattus norvegicus
agctgggcagaatccacatcacagt

SEQ ID NO: 136245 - DNA, 25 bp, Rattus norvegicus
agctgggcagctagctggcccataa

SEQ ID NO: 136246 - DNA, 25 bp, Rattus norvegicus
agctgggcagcttgctggcccataa

SEQ ID NO: 136247 - DNA, 25 bp, Rattus norvegicus
agctgggcagtcacaacgtggcctg

SEQ ID NO: 136248 - DNA, 25 bp, Rattus norvegicus
agctgggcagtctcaacgtggcctg

SEQ ID NO: 136249 - DNA, 25 bp, Rattus norvegicus
agctgggccaagcaccctccagaga

SEQ ID NO: 136250 - DNA, 25 bp, Rattus norvegicus
agctgggccaaggaccctccagaga

SEQ ID NO: 136251 - DNA, 25 bp, Rattus norvegicus
agctgggccctgagtacacacacat

SEQ ID NO: 136252 - DNA, 25 bp, Rattus norvegicus
agctgggccctgtgtacacacacat

SEQ ID NO: 136253 - DNA, 25 bp, Rattus norvegicus
agctgggcctctcatgtgatgttag

SEQ ID NO: 136254 - DNA, 25 bp, Rattus norvegicus
agctgggcctctcatttgccaagac

SEQ ID NO: 136255 - DNA, 25 bp, Rattus norvegicus
agctgggcctctgatgtgatgttag

SEQ ID NO: 136256 - DNA, 25 bp, Rattus norvegicus
agctgggcctctgatttgccaagac

SEQ ID NO: 136257 - DNA, 25 bp, Rattus norvegicus
agctgggcctgaatgagctactcaa

SEQ ID NO: 136258 - DNA, 25 bp, Rattus norvegicus
agctgggcctgattgagctactcaa

SEQ ID NO: 136259 - DNA, 25 bp, Rattus norvegicus
agctgggccttcaagactgacatga

SEQ ID NO: 136260 - DNA, 25 bp, Rattus norvegicus
agctgggccttctagactgacatga

SEQ ID NO: 136261 - DNA, 25 bp, Rattus norvegicus
agctgggcgcagaggtgcataccct

SEQ ID NO: 136262 - DNA, 25 bp, Rattus norvegicus
agctgggcgcagtggtgcataccct

SEQ ID NO: 136263 - DNA, 25 bp, Rattus norvegicus
agctgggctaatcatcaaggtgata

SEQ ID NO: 136264 - DNA, 25 bp, Rattus norvegicus
agctgggctaatgatcaaggtgata

SEQ ID NO: 136265 - DNA, 25 bp, Rattus norvegicus
agctgggctgctagattgggcctca

SEQ ID NO: 136266 - DNA, 25 bp, Rattus norvegicus
agctgggctgctcaaagtctcagta

SEQ ID NO: 136267 - DNA, 25 bp, Rattus norvegicus
agctgggctgctctgtgttcatcct

SEQ ID NO: 136268 - DNA, 25 bp, Rattus norvegicus
agctgggctgctgaaagtctcagta

SEQ ID NO: 136269 - DNA, 25 bp, Rattus norvegicus
agctgggctgctgtgtgttcatcct

SEQ ID NO: 136270 - DNA, 25 bp, Rattus norvegicus
agctgggctgcttgattgggcctca

SEQ ID NO: 136271 - DNA, 25 bp, Rattus norvegicus
agctgggctgttcctcttcaagaag

SEQ ID NO: 136272 - DNA, 25 bp, Rattus norvegicus
agctgggctgttgctcttcaagaag

SEQ ID NO: 136273 - DNA, 25 bp, Rattus norvegicus
agctgggcttaaacactctaaatgc

SEQ ID NO: 136274 - DNA, 25 bp, Rattus norvegicus
agctgggcttaatcactctaaatgc

SEQ ID NO: 136275 - DNA, 25 bp, Rattus norvegicus
agctgggcttcactctgatttggaa

SEQ ID NO: 136276 - DNA, 25 bp, Rattus norvegicus
agctgggcttcagtctgatttggaa

SEQ ID NO: 136277 - DNA, 25 bp, Rattus norvegicus
agctgggctttccaagttacctgat

SEQ ID NO: 136278 - DNA, 25 bp, Rattus norvegicus
agctgggctttcgaagttacctgat

SEQ ID NO: 136279 - DNA, 25 bp, Rattus norvegicus
agctgggtaaacaatctttgtaaca

SEQ ID NO: 136280 - DNA, 25 bp, Rattus norvegicus
agctgggtaaactatctttgtaaca

SEQ ID NO: 136281 - DNA, 25 bp, Rattus norvegicus
agctgggtacccagggcaagccttg

SEQ ID NO: 136282 - DNA, 25 bp, Rattus norvegicus
agctgggtaccctgggcaagccttg

SEQ ID NO: 136283 - DNA, 25 bp, Rattus norvegicus
agctgggtatggaatctcacgcctg

SEQ ID NO: 136284 - DNA, 25 bp, Rattus norvegicus
agctgggtatggtatctcacgcctg

SEQ ID NO: 136285 - DNA, 25 bp, Rattus norvegicus
agctgggtatttacctgggtgatga

SEQ ID NO: 136286 - DNA, 25 bp, Rattus norvegicus
agctgggtattttcctgggtgatga

SEQ ID NO: 136287 - DNA, 25 bp, Rattus norvegicus
agctgggtgataagcgtcctcctag

SEQ ID NO: 136288 - DNA, 25 bp, Rattus norvegicus
agctgggtgatatgcgtcctcctag

SEQ ID NO: 136289 - DNA, 25 bp, Rattus norvegicus
agctgggtgcgcagactaaagccgt

SEQ ID NO: 136290 - DNA, 25 bp, Rattus norvegicus
agctgggtgcgctgactaaagccgt

SEQ ID NO: 136291 - DNA, 25 bp, Rattus norvegicus
agctgggtgctgacatctgaggatc

SEQ ID NO: 136292 - DNA, 25 bp, Rattus norvegicus
agctgggtgctgtcatctgaggatc

SEQ ID NO: 136293 - DNA, 25 bp, Rattus norvegicus
agctgggtggaaacttgccctgcag

SEQ ID NO: 136294 - DNA, 25 bp, Rattus norvegicus
agctgggtggaatcttgccctgcag

SEQ ID NO: 136295 - DNA, 25 bp, Rattus norvegicus
agctgggtgtctctgtccggtttca

SEQ ID NO: 136296 - DNA, 25 bp, Rattus norvegicus
agctgggtgtctgtgtccggtttca

SEQ ID NO: 136297 - DNA, 25 bp, Rattus norvegicus
agctgggttcccatgatgtcagtgg

SEQ ID NO: 136298 - DNA, 25 bp, Rattus norvegicus
agctgggttcccttgatgtcagtgg

SEQ ID NO: 136299 - DNA, 25 bp, Rattus norvegicus
agctgggtttgcacatgtatgccac

SEQ ID NO: 136300 - DNA, 25 bp, Rattus norvegicus
agctgggtttgctcatgtatgccac

SEQ ID NO: 136301 - DNA, 25 bp, Rattus norvegicus
agctgggtttggactactcttatga

SEQ ID NO: 136302 - DNA, 25 bp, Rattus norvegicus
agctgggtttggtctactcttatga

SEQ ID NO: 136303 - DNA, 25 bp, Rattus norvegicus
agctggtaacgtctttgctgtacaa

SEQ ID NO: 136304 - DNA, 25 bp, Rattus norvegicus
agctggtaacgtgtttgctgtacaa

SEQ ID NO: 136305 - DNA, 25 bp, Rattus norvegicus
agctggtaataacacccctggtcgc

SEQ ID NO: 136306 - DNA, 25 bp, Rattus norvegicus
agctggtaataagacccctggtcgc

SEQ ID NO: 136307 - DNA, 25 bp, Rattus norvegicus
agctggtaatggctctgctcagcgt

SEQ ID NO: 136308 - DNA, 25 bp, Rattus norvegicus
agctggtaatgggtctgctcagcgt

SEQ ID NO: 136309 - DNA, 25 bp, Rattus norvegicus
agctggtacccaccagactacggtg

SEQ ID NO: 136310 - DNA, 25 bp, Rattus norvegicus
agctggtacccagcagactacggtg

SEQ ID NO: 136311 - DNA, 25 bp, Rattus norvegicus
agctggtacctgcaagttactcttt

SEQ ID NO: 136312 - DNA, 25 bp, Rattus norvegicus
agctggtacctggaagttactcttt

SEQ ID NO: 136313 - DNA, 25 bp, Rattus norvegicus
agctggtactgcaccggccaaggcg

SEQ ID NO: 136314 - DNA, 25 bp, Rattus norvegicus
agctggtactgctccggccaaggcg

SEQ ID NO: 136315 - DNA, 25 bp, Rattus norvegicus
agctggtagggcaaacttctgtctt

SEQ ID NO: 136316 - DNA, 25 bp, Rattus norvegicus
agctggtagggctaacttctgtctt

SEQ ID NO: 136317 - DNA, 25 bp, Rattus norvegicus
agctggtatttcaatttcttttgga

SEQ ID NO: 136318 - DNA, 25 bp, Rattus norvegicus
agctggtatttctatttcttttgga

SEQ ID NO: 136319 - DNA, 25 bp, Rattus norvegicus
agctggtcacgcattgcccacggct

SEQ ID NO: 136320 - DNA, 25 bp, Rattus norvegicus
agctggtcacgctttgcccacggct

SEQ ID NO: 136321 - DNA, 25 bp, Rattus norvegicus
agctggtcactgaacacgcgcagat

SEQ ID NO: 136322 - DNA, 25 bp, Rattus norvegicus
agctggtcactgtacacgcgcagat

SEQ ID NO: 136323 - DNA, 25 bp, Rattus norvegicus
agctggtcaggcagatcccgcagag

SEQ ID NO: 136324 - DNA, 25 bp, Rattus norvegicus
agctggtcaggctgatcccgcagag

SEQ ID NO: 136325 - DNA, 25 bp, Rattus norvegicus
agctggtcagggagagtcactcttc

SEQ ID NO: 136326 - DNA, 25 bp, Rattus norvegicus
agctggtcagggtgagtcactcttc

SEQ ID NO: 136327 - DNA, 25 bp, Rattus norvegicus
agctggtccagtccctcacagagtt

SEQ ID NO: 136328 - DNA, 25 bp, Rattus norvegicus
agctggtccagtgcctcacagagtt

SEQ ID NO: 136329 - DNA, 25 bp, Rattus norvegicus
agctggtccctaaaacccatttgat

SEQ ID NO: 136330 - DNA, 25 bp, Rattus norvegicus
agctggtccctataacccatttgat

SEQ ID NO: 136331 - DNA, 25 bp, Rattus norvegicus
agctggtccgtaatgacaccacttt

SEQ ID NO: 136332 - DNA, 25 bp, Rattus norvegicus
agctggtccgtattgacaccacttt

SEQ ID NO: 136333 - DNA, 25 bp, Rattus norvegicus
agctggtcctgtcgcgtaatttcag

SEQ ID NO: 136334 - DNA, 25 bp, Rattus norvegicus
agctggtcctgtggcgtaatttcag

SEQ ID NO: 136335 - DNA, 25 bp, Rattus norvegicus
agctggtcgggacctcactgactac

SEQ ID NO: 136336 - DNA, 25 bp, Rattus norvegicus
agctggtcgggagctcactgactac

SEQ ID NO: 136337 - DNA, 25 bp, Rattus norvegicus
agctggtctagcactgaactggcct

SEQ ID NO: 136338 - DNA, 25 bp, Rattus norvegicus
agctggtctagctctgaactggcct

SEQ ID NO: 136339 - DNA, 25 bp, Rattus norvegicus
agctggtctcagctagttaactatc

SEQ ID NO: 136340 - DNA, 25 bp, Rattus norvegicus
agctggtctcaggtagttaactatc

SEQ ID NO: 136341 - DNA, 25 bp, Rattus norvegicus
agctggtctggcattcttccagtgc

SEQ ID NO: 136342 - DNA, 25 bp, Rattus norvegicus
agctggtctggctttcttccagtgc

SEQ ID NO: 136343 - DNA, 25 bp, Rattus norvegicus
agctggtcttcgaatctgcatgtac

SEQ ID NO: 136344 - DNA, 25 bp, Rattus norvegicus
agctggtcttcgtatctgcatgtac

SEQ ID NO: 136345 - DNA, 25 bp, Rattus norvegicus
agctggtgacctaggtgctcagaga

SEQ ID NO: 136346 - DNA, 25 bp, Rattus norvegicus
agctggtgaccttggtgctcagaga

SEQ ID NO: 136347 - DNA, 25 bp, Rattus norvegicus
agctggtgacttattctcaggttca

SEQ ID NO: 136348 - DNA, 25 bp, Rattus norvegicus
agctggtgactttttctcaggttca

SEQ ID NO: 136349 - DNA, 25 bp, Rattus norvegicus
agctggtgatctctttctccctttg

SEQ ID NO: 136350 - DNA, 25 bp, Rattus norvegicus
agctggtgatctgtttctccctttg

SEQ ID NO: 136351 - DNA, 25 bp, Rattus norvegicus
agctggtgcaaaaagtgtgctttta

SEQ ID NO: 136352 - DNA, 25 bp, Rattus norvegicus
agctggtgcaaatagtgtgctttta

SEQ ID NO: 136353 - DNA, 25 bp, Rattus norvegicus
agctggtgcagccagtgcccaagat

SEQ ID NO: 136354 - DNA, 25 bp, Rattus norvegicus
agctggtgcagcgagtgcccaagat

SEQ ID NO: 136355 - DNA, 25 bp, Rattus norvegicus
agctggtgcgagactacctggatct

SEQ ID NO: 136356 - DNA, 25 bp, Rattus norvegicus
agctggtgcgagtctacctggatct

SEQ ID NO: 136357 - DNA, 25 bp, Rattus norvegicus
agctggtgctcactgcacagtatta

SEQ ID NO: 136358 - DNA, 25 bp, Rattus norvegicus
agctggtgctcagtgcacagtatta

SEQ ID NO: 136359 - DNA, 25 bp, Rattus norvegicus
agctggtgctgtatgacaagcccac

SEQ ID NO: 136360 - DNA, 25 bp, Rattus norvegicus
agctggtgctgtttgacaagcccac

SEQ ID NO: 136361 - DNA, 25 bp, Rattus norvegicus
agctggtgggccacctgcatgtact

SEQ ID NO: 136362 - DNA, 25 bp, Rattus norvegicus
agctggtgggcctcctgcatgtact

SEQ ID NO: 136363 - DNA, 25 bp, Rattus norvegicus
agctggtggtgcaacacgcccaagg

SEQ ID NO: 136364 - DNA, 25 bp, Rattus norvegicus
agctggtggtgctacacgcccaagg

SEQ ID NO: 136365 - DNA, 25 bp, Rattus norvegicus
agctggtgtagcagtgcacaccttt

SEQ ID NO: 136366 - DNA, 25 bp, Rattus norvegicus
agctggtgtagctgtgcacaccttt

SEQ ID NO: 136367 - DNA, 25 bp, Rattus norvegicus
agctggtgtattaccacattgaagt

SEQ ID NO: 136368 - DNA, 25 bp, Rattus norvegicus
agctggtgtatttccacattgaagt

SEQ ID NO: 136369 - DNA, 25 bp, Rattus norvegicus
agctggtgtcagacctggagcctgc

SEQ ID NO: 136370 - DNA, 25 bp, Rattus norvegicus
agctggtgtcagtcctggagcctgc

SEQ ID NO: 136371 - DNA, 25 bp, Rattus norvegicus
agctggtgtcccacggtctccagag

SEQ ID NO: 136372 - DNA, 25 bp, Rattus norvegicus
agctggtgtccctcggtctccagag

SEQ ID NO: 136373 - DNA, 25 bp, Rattus norvegicus
agctggtgtgtgacaactggcatct

SEQ ID NO: 136374 - DNA, 25 bp, Rattus norvegicus
agctggtgtgtgtcaactggcatct

SEQ ID NO: 136375 - DNA, 25 bp, Rattus norvegicus
agctggtgtgttagctggcctcacc

SEQ ID NO: 136376 - DNA, 25 bp, Rattus norvegicus
agctggtgtgtttgctggcctcacc

SEQ ID NO: 136377 - DNA, 25 bp, Rattus norvegicus
agctggtgttggagactctgtgccc

SEQ ID NO: 136378 - DNA, 25 bp, Rattus norvegicus
agctggtgttggtgactctgtgccc

SEQ ID NO: 136379 - DNA, 25 bp, Rattus norvegicus
agctggtgtttgagtcagtcgacat

SEQ ID NO: 136380 - DNA, 25 bp, Rattus norvegicus
agctggtgtttgtgtcagtcgacat

SEQ ID NO: 136381 - DNA, 25 bp, Rattus norvegicus
agctggttcagactcataatcctcc

SEQ ID NO: 136382 - DNA, 25 bp, Rattus norvegicus
agctggttcagagtcataatcctcc

SEQ ID NO: 136383 - DNA, 25 bp, Rattus norvegicus
agctggttctgacagtctgtctttc

SEQ ID NO: 136384 - DNA, 25 bp, Rattus norvegicus
agctggttctgagagtctgtctttc

SEQ ID NO: 136385 - DNA, 25 bp, Rattus norvegicus
agctggttgagtaaccccgtcagta

SEQ ID NO: 136386 - DNA, 25 bp, Rattus norvegicus
agctggttgagttaccccgtcagta

SEQ ID NO: 136387 - DNA, 25 bp, Rattus norvegicus
agctggttgctgctggcacacactt

SEQ ID NO: 136388 - DNA, 25 bp, Rattus norvegicus
agctggttgctggtggcacacactt

SEQ ID NO: 136389 - DNA, 25 bp, Rattus norvegicus
agctggttggtgacttgtttccctc

SEQ ID NO: 136390 - DNA, 25 bp, Rattus norvegicus
agctggttggtgtcttgtttccctc

SEQ ID NO: 136391 - DNA, 25 bp, Rattus norvegicus
agctggttgtcactgctcagaggat

SEQ ID NO: 136392 - DNA, 25 bp, Rattus norvegicus
agctggttgtcagtgctcagaggat

SEQ ID NO: 136393 - DNA, 25 bp, Rattus norvegicus
agctggtttggcaacatgccgctga

SEQ ID NO: 136394 - DNA, 25 bp, Rattus norvegicus
agctggtttggctacatgccgctga

SEQ ID NO: 136395 - DNA, 25 bp, Rattus norvegicus
agctggttttgtcggtgtcacacac

SEQ ID NO: 136396 - DNA, 25 bp, Rattus norvegicus
agctggttttgtgggtgtcacacac

SEQ ID NO: 136397 - DNA, 25 bp, Rattus norvegicus
agctgtaaagctaccctgtaagtca

SEQ ID NO: 136398 - DNA, 25 bp, Rattus norvegicus
agctgtaaagcttccctgtaagtca

SEQ ID NO: 136399 - DNA, 25 bp, Rattus norvegicus
agctgtaaatacaacgcctgccacg

SEQ ID NO: 136400 - DNA, 25 bp, Rattus norvegicus
agctgtaaatactacgcctgccacg

SEQ ID NO: 136401 - DNA, 25 bp, Rattus norvegicus
agctgtaatatcatcactggactcc

SEQ ID NO: 136402 - DNA, 25 bp, Rattus norvegicus
agctgtaatatcttcactggactcc

SEQ ID NO: 136403 - DNA, 25 bp, Rattus norvegicus
agctgtaatcctccacactcagaag

SEQ ID NO: 136404 - DNA, 25 bp, Rattus norvegicus
agctgtaatcctgcacactcagaag

SEQ ID NO: 136405 - DNA, 25 bp, Rattus norvegicus
agctgtaattacaactttcatttaa

SEQ ID NO: 136406 - DNA, 25 bp, Rattus norvegicus
agctgtaattactactttcatttaa

SEQ ID NO: 136407 - DNA, 25 bp, Rattus norvegicus
agctgtaatttcagccgagacctgg

SEQ ID NO: 136408 - DNA, 25 bp, Rattus norvegicus
agctgtaatttctgccgagacctgg

SEQ ID NO: 136409 - DNA, 25 bp, Rattus norvegicus
agctgtacaaacagcctcactggta

SEQ ID NO: 136410 - DNA, 25 bp, Rattus norvegicus
agctgtacaaactgcctcactggta

SEQ ID NO: 136411 - DNA, 25 bp, Rattus norvegicus
agctgtacaatcctttcatcattcg

SEQ ID NO: 136412 - DNA, 25 bp, Rattus norvegicus
agctgtacaatcgtttcatcattcg

SEQ ID NO: 136413 - DNA, 25 bp, Rattus norvegicus
agctgtacagccattgcagttcaag

SEQ ID NO: 136414 - DNA, 25 bp, Rattus norvegicus
agctgtacagcctttgcagttcaag

SEQ ID NO: 136415 - DNA, 25 bp, Rattus norvegicus
agctgtacatgactccttagctgga

SEQ ID NO: 136416 - DNA, 25 bp, Rattus norvegicus
agctgtacatgagtccttagctgga

SEQ ID NO: 136417 - DNA, 25 bp, Rattus norvegicus
agctgtactttcatgtttggtttaa

SEQ ID NO: 136418 - DNA, 25 bp, Rattus norvegicus
agctgtactttcttgtttggtttaa

SEQ ID NO: 136419 - DNA, 25 bp, Rattus norvegicus
agctgtagactgcaccgtcgtaggc

SEQ ID NO: 136420 - DNA, 25 bp, Rattus norvegicus
agctgtagactggaccgtcgtaggc

SEQ ID NO: 136421 - DNA, 25 bp, Rattus norvegicus
agctgtagagttcatccgtttgtcc

SEQ ID NO: 136422 - DNA, 25 bp, Rattus norvegicus
agctgtagagttgatccgtttgtcc

SEQ ID NO: 136423 - DNA, 25 bp, Rattus norvegicus
agctgtagatagatacttgccataa

SEQ ID NO: 136424 - DNA, 25 bp, Rattus norvegicus
agctgtagatagttacttgccataa

SEQ ID NO: 136425 - DNA, 25 bp, Rattus norvegicus
agctgtagcactagggccatggcag

SEQ ID NO: 136426 - DNA, 25 bp, Rattus norvegicus
agctgtagcacttgggccatggcag

SEQ ID NO: 136427 - DNA, 25 bp, Rattus norvegicus
agctgtagcagtacatggcatcact

SEQ ID NO: 136428 - DNA, 25 bp, Rattus norvegicus
agctgtagcagttcatggcatcact

SEQ ID NO: 136429 - DNA, 25 bp, Rattus norvegicus
agctgtagccctatcacccctaaag

SEQ ID NO: 136430 - DNA, 25 bp, Rattus norvegicus
agctgtagccctttcacccctaaag

SEQ ID NO: 136431 - DNA, 25 bp, Rattus norvegicus
agctgtagccttaactggacggtcc

SEQ ID NO: 136432 - DNA, 25 bp, Rattus norvegicus
agctgtagcctttactggacggtcc

SEQ ID NO: 136433 - DNA, 25 bp, Rattus norvegicus
agctgtagctgtcttagttctcaca

SEQ ID NO: 136434 - DNA, 25 bp, Rattus norvegicus
agctgtagctgtgttagttctcaca

SEQ ID NO: 136435 - DNA, 25 bp, Rattus norvegicus
agctgtaggctcctgtactgtttgt

SEQ ID NO: 136436 - DNA, 25 bp, Rattus norvegicus
agctgtaggctcgtgtactgtttgt

SEQ ID NO: 136437 - DNA, 25 bp, Rattus norvegicus
agctgtaggtcccatgctgttcatg

SEQ ID NO: 136438 - DNA, 25 bp, Rattus norvegicus
agctgtaggtccgatgctgttcatg

SEQ ID NO: 136439 - DNA, 25 bp, Rattus norvegicus
agctgtaggtgcaggctgcgtcatc

SEQ ID NO: 136440 - DNA, 25 bp, Rattus norvegicus
agctgtaggtgctggctgcgtcatc

SEQ ID NO: 136441 - DNA, 25 bp, Rattus norvegicus
agctgtatagttatgcctgtgtgaa

SEQ ID NO: 136442 - DNA, 25 bp, Rattus norvegicus
agctgtatagttttgcctgtgtgaa

SEQ ID NO: 136443 - DNA, 25 bp, Rattus norvegicus
agctgtatattcacatgatgccttg

SEQ ID NO: 136444 - DNA, 25 bp, Rattus norvegicus
agctgtatattctcatgatgccttg

SEQ ID NO: 136445 - DNA, 25 bp, Rattus norvegicus
agctgtatcactccctttgtttata

SEQ ID NO: 136446 - DNA, 25 bp, Rattus norvegicus
agctgtatcactgcctttgtttata

SEQ ID NO: 136447 - DNA, 25 bp, Rattus norvegicus
agctgtatccttatgtatatatttt

SEQ ID NO: 136448 - DNA, 25 bp, Rattus norvegicus
agctgtatccttttgtatatatttt

SEQ ID NO: 136449 - DNA, 25 bp, Rattus norvegicus
agctgtatgcttagcgtttgtcttt

SEQ ID NO: 136450 - DNA, 25 bp, Rattus norvegicus
agctgtatgctttgcgtttgtcttt

SEQ ID NO: 136451 - DNA, 25 bp, Rattus norvegicus
agctgtattcatagggctctttaat

SEQ ID NO: 136452 - DNA, 25 bp, Rattus norvegicus
agctgtattcattgggctctttaat

SEQ ID NO: 136453 - DNA, 25 bp, Rattus norvegicus
agctgtattcccacataactggcaa

SEQ ID NO: 136454 - DNA, 25 bp, Rattus norvegicus
agctgtattccctcataactggcaa

SEQ ID NO: 136455 - DNA, 25 bp, Rattus norvegicus
agctgtatttaaccctttcctctgc

SEQ ID NO: 136456 - DNA, 25 bp, Rattus norvegicus
agctgtatttaagcctttcctctgc

SEQ ID NO: 136457 - DNA, 25 bp, Rattus norvegicus
agctgtatttcccttgtgttactgt

SEQ ID NO: 136458 - DNA, 25 bp, Rattus norvegicus
agctgtatttccgttgtgttactgt

SEQ ID NO: 136459 - DNA, 25 bp, Rattus norvegicus
agctgtattttcatgttggagtcca

SEQ ID NO: 136460 - DNA, 25 bp, Rattus norvegicus
agctgtattttcttgttggagtcca

SEQ ID NO: 136461 - DNA, 25 bp, Rattus norvegicus
agctgtcaagacagttcacttcttc

SEQ ID NO: 136462 - DNA, 25 bp, Rattus norvegicus
agctgtcaagactgttcacttcttc

SEQ ID NO: 136463 - DNA, 25 bp, Rattus norvegicus
agctgtcaagggacttcgcaagcat

SEQ ID NO: 136464 - DNA, 25 bp, Rattus norvegicus
agctgtcaagggtcttcgcaagcat

SEQ ID NO: 136465 - DNA, 25 bp, Rattus norvegicus
agctgtcacatgctgtccctaggct

SEQ ID NO: 136466 - DNA, 25 bp, Rattus norvegicus
agctgtcacatggtgtccctaggct

SEQ ID NO: 136467 - DNA, 25 bp, Rattus norvegicus
agctgtcaccagaatctagcctaag

SEQ ID NO: 136468 - DNA, 25 bp, Rattus norvegicus
agctgtcaccagatgccggctcgag

SEQ ID NO: 136469 - DNA, 25 bp, Rattus norvegicus
agctgtcaccagtatctagcctaag

SEQ ID NO: 136470 - DNA, 25 bp, Rattus norvegicus
agctgtcaccagttgccggctcgag

SEQ ID NO: 136471 - DNA, 25 bp, Rattus norvegicus
agctgtcactccaatggtgggaaca

SEQ ID NO: 136472 - DNA, 25 bp, Rattus norvegicus
agctgtcactcctatggtgggaaca

SEQ ID NO: 136473 - DNA, 25 bp, Rattus norvegicus
agctgtcacttcaaggaaattttaa

SEQ ID NO: 136474 - DNA, 25 bp, Rattus norvegicus
agctgtcacttctaggaaattttaa

SEQ ID NO: 136475 - DNA, 25 bp, Rattus norvegicus
agctgtcagaagctgtgtcatgtac

SEQ ID NO: 136476 - DNA, 25 bp, Rattus norvegicus
agctgtcagaaggtgtgtcatgtac

SEQ ID NO: 136477 - DNA, 25 bp, Rattus norvegicus
agctgtcagaccagctgctgtggaa

SEQ ID NO: 136478 - DNA, 25 bp, Rattus norvegicus
agctgtcagacctgctgctgtggaa

SEQ ID NO: 136479 - DNA, 25 bp, Rattus norvegicus
agctgtcagcgtatgccgtgggcac

SEQ ID NO: 136480 - DNA, 25 bp, Rattus norvegicus
agctgtcagcgtttgccgtgggcac

SEQ ID NO: 136481 - DNA, 25 bp, Rattus norvegicus
agctgtcagtctcttttgtgatgct

SEQ ID NO: 136482 - DNA, 25 bp, Rattus norvegicus
agctgtcagtctgttttgtgatgct

SEQ ID NO: 136483 - DNA, 25 bp, Rattus norvegicus
agctgtcagttcacattttagatgt

SEQ ID NO: 136484 - DNA, 25 bp, Rattus norvegicus
agctgtcagttctcattttagatgt

SEQ ID NO: 136485 - DNA, 25 bp, Rattus norvegicus
agctgtcatctaactcaagcatatg

SEQ ID NO: 136486 - DNA, 25 bp, Rattus norvegicus
agctgtcatctatctcaagcatatg

SEQ ID NO: 136487 - DNA, 25 bp, Rattus norvegicus
agctgtcatcttacagaatgctggc

SEQ ID NO: 136488 - DNA, 25 bp, Rattus norvegicus
agctgtcatctttcagaatgctggc

SEQ ID NO: 136489 - DNA, 25 bp, Rattus norvegicus
agctgtccaaccagcggccgtagtt

SEQ ID NO: 136490 - DNA, 25 bp, Rattus norvegicus
agctgtccaacctgcggccgtagtt

SEQ ID NO: 136491 - DNA, 25 bp, Rattus norvegicus
agctgtccaatcatctctttacaga

SEQ ID NO: 136492 - DNA, 25 bp, Rattus norvegicus
agctgtccaatcttctctttacaga

SEQ ID NO: 136493 - DNA, 25 bp, Rattus norvegicus
agctgtccaccgcttaaaccaagtg

SEQ ID NO: 136494 - DNA, 25 bp, Rattus norvegicus
agctgtccaccggttaaaccaagtg

SEQ ID NO: 136495 - DNA, 25 bp, Rattus norvegicus
agctgtccactgagggagatctgga

SEQ ID NO: 136496 - DNA, 25 bp, Rattus norvegicus
agctgtccactgatgctgcttggat

SEQ ID NO: 136497 - DNA, 25 bp, Rattus norvegicus
agctgtccactgtgggagatctgga

SEQ ID NO: 136498 - DNA, 25 bp, Rattus norvegicus
agctgtccactgttgctgcttggat

SEQ ID NO: 136499 - DNA, 25 bp, Rattus norvegicus
agctgtccatatattcacatttgtg

SEQ ID NO: 136500 - DNA, 25 bp, Rattus norvegicus
agctgtccatattttcacatttgtg

SEQ ID NO: 136501 - DNA, 25 bp, Rattus norvegicus
agctgtccatgaaagactccacact

SEQ ID NO: 136502 - DNA, 25 bp, Rattus norvegicus
agctgtccatgatagactccacact

SEQ ID NO: 136503 - DNA, 25 bp, Rattus norvegicus
agctgtcccaggaagacctactgtc

SEQ ID NO: 136504 - DNA, 25 bp, Rattus norvegicus
agctgtcccaggtagacctactgtc

SEQ ID NO: 136505 - DNA, 25 bp, Rattus norvegicus
agctgtcccctcaccatgggctggg

SEQ ID NO: 136506 - DNA, 25 bp, Rattus norvegicus
agctgtcccctctccatgggctggg

SEQ ID NO: 136507 - DNA, 25 bp, Rattus norvegicus
agctgtcccggccaacaagattcag

SEQ ID NO: 136508 - DNA, 25 bp, Rattus norvegicus
agctgtcccggcgaacaagattcag

SEQ ID NO: 136509 - DNA, 25 bp, Rattus norvegicus
agctgtccctgaccgcaggagagaa

SEQ ID NO: 136510 - DNA, 25 bp, Rattus norvegicus
agctgtccctgagcgcaggagagaa

SEQ ID NO: 136511 - DNA, 25 bp, Rattus norvegicus
agctgtccctgcagcctaacttctt

SEQ ID NO: 136512 - DNA, 25 bp, Rattus norvegicus
agctgtccctgctgcctaacttctt

SEQ ID NO: 136513 - DNA, 25 bp, Rattus norvegicus
agctgtccggaaccagccccggaga

SEQ ID NO: 136514 - DNA, 25 bp, Rattus norvegicus
agctgtccggaagcagccccggaga

SEQ ID NO: 136515 - DNA, 25 bp, Rattus norvegicus
agctgtcctatcactgagggtggta

SEQ ID NO: 136516 - DNA, 25 bp, Rattus norvegicus
agctgtcctatctctgagggtggta

SEQ ID NO: 136517 - DNA, 25 bp, Rattus norvegicus
agctgtcctctcctctattgtgaag

SEQ ID NO: 136518 - DNA, 25 bp, Rattus norvegicus
agctgtcctctcgtctattgtgaag

SEQ ID NO: 136519 - DNA, 25 bp, Rattus norvegicus
agctgtcctctgaataatgtatttt

SEQ ID NO: 136520 - DNA, 25 bp, Rattus norvegicus
agctgtcctctgtataatgtatttt

SEQ ID NO: 136521 - DNA, 25 bp, Rattus norvegicus
agctgtcctgtgaagggaaaaccta

SEQ ID NO: 136522 - DNA, 25 bp, Rattus norvegicus
agctgtcctgtgctacccactaagg

SEQ ID NO: 136523 - DNA, 25 bp, Rattus norvegicus
agctgtcctgtggtacccactaagg

SEQ ID NO: 136524 - DNA, 25 bp, Rattus norvegicus
agctgtcctgtgtagggaaaaccta

SEQ ID NO: 136525 - DNA, 25 bp, Rattus norvegicus
agctgtccttacactaaatctgtgc

SEQ ID NO: 136526 - DNA, 25 bp, Rattus norvegicus
agctgtccttactctaaatctgtgc

SEQ ID NO: 136527 - DNA, 25 bp, Rattus norvegicus
agctgtcctttaatgccgcagaaca

SEQ ID NO: 136528 - DNA, 25 bp, Rattus norvegicus
agctgtcctttattgccgcagaaca

SEQ ID NO: 136529 - DNA, 25 bp, Rattus norvegicus
agctgtcctttcacttccagtaatg

SEQ ID NO: 136530 - DNA, 25 bp, Rattus norvegicus
agctgtcctttctcttccagtaatg

SEQ ID NO: 136531 - DNA, 25 bp, Rattus norvegicus
agctgtccttttaatatcttttcta

SEQ ID NO: 136532 - DNA, 25 bp, Rattus norvegicus
agctgtcctttttatatcttttcta

SEQ ID NO: 136533 - DNA, 25 bp, Rattus norvegicus
agctgtcgagggagaccacgtgcat

SEQ ID NO: 136534 - DNA, 25 bp, Rattus norvegicus
agctgtcgagggtgaccacgtgcat

SEQ ID NO: 136535 - DNA, 25 bp, Rattus norvegicus
agctgtcgccatccagtaaggtcat

SEQ ID NO: 136536 - DNA, 25 bp, Rattus norvegicus
agctgtcgccatgcagtaaggtcat

SEQ ID NO: 136537 - DNA, 25 bp, Rattus norvegicus
agctgtcgcccaagaagggtgataa

SEQ ID NO: 136538 - DNA, 25 bp, Rattus norvegicus
agctgtcgcccatgaagggtgataa

SEQ ID NO: 136539 - DNA, 25 bp, Rattus norvegicus
agctgtcgctgcataatctcttcgc

SEQ ID NO: 136540 - DNA, 25 bp, Rattus norvegicus
agctgtcgctgcttaatctcttcgc

SEQ ID NO: 136541 - DNA, 25 bp, Rattus norvegicus
agctgtcgtggtccgggtactcccc

SEQ ID NO: 136542 - DNA, 25 bp, Rattus norvegicus
agctgtcgtggtgcgggtactcccc

SEQ ID NO: 136543 - DNA, 25 bp, Rattus norvegicus
agctgtctaagcattaggtccctct

SEQ ID NO: 136544 - DNA, 25 bp, Rattus norvegicus
agctgtctaagctttaggtccctct

SEQ ID NO: 136545 - DNA, 25 bp, Rattus norvegicus
agctgtctacagacaagtctcggta

SEQ ID NO: 136546 - DNA, 25 bp, Rattus norvegicus
agctgtctacagactttccctcaat

SEQ ID NO: 136547 - DNA, 25 bp, Rattus norvegicus
agctgtctacagtcaagtctcggta

SEQ ID NO: 136548 - DNA, 25 bp, Rattus norvegicus
agctgtctacagtctttccctcaat

SEQ ID NO: 136549 - DNA, 25 bp, Rattus norvegicus
agctgtctactgagcttagtgtgtc

SEQ ID NO: 136550 - DNA, 25 bp, Rattus norvegicus
agctgtctactgtgcttagtgtgtc

SEQ ID NO: 136551 - DNA, 25 bp, Rattus norvegicus
agctgtctcaaccagagagttttta

SEQ ID NO: 136552 - DNA, 25 bp, Rattus norvegicus
agctgtctcaacgagagagttttta

SEQ ID NO: 136553 - DNA, 25 bp, Rattus norvegicus
agctgtctcagaagtgactttctac

SEQ ID NO: 136554 - DNA, 25 bp, Rattus norvegicus
agctgtctcagatgtgactttctac

SEQ ID NO: 136555 - DNA, 25 bp, Rattus norvegicus
agctgtctccataaatatgactcca

SEQ ID NO: 136556 - DNA, 25 bp, Rattus norvegicus
agctgtctccattaatatgactcca

SEQ ID NO: 136557 - DNA, 25 bp, Rattus norvegicus
agctgtctccggcatagagtcgtcc

SEQ ID NO: 136558 - DNA, 25 bp, Rattus norvegicus
agctgtctccgggatagagtcgtcc

SEQ ID NO: 136559 - DNA, 25 bp, Rattus norvegicus
agctgtctcctcacaaaggaccatt

SEQ ID NO: 136560 - DNA, 25 bp, Rattus norvegicus
agctgtctcctctcaaaggaccatt

SEQ ID NO: 136561 - DNA, 25 bp, Rattus norvegicus
agctgtctcctgagtttcttggaat

SEQ ID NO: 136562 - DNA, 25 bp, Rattus norvegicus
agctgtctcctgtgtttcttggaat

SEQ ID NO: 136563 - DNA, 25 bp, Rattus norvegicus
agctgtctcgaaccatactgtcaga

SEQ ID NO: 136564 - DNA, 25 bp, Rattus norvegicus
agctgtctcgaagcatactgtcaga

SEQ ID NO: 136565 - DNA, 25 bp, Rattus norvegicus
agctgtctctaacaggccctcaaag

SEQ ID NO: 136566 - DNA, 25 bp, Rattus norvegicus
agctgtctctaagaggccctcaaag

SEQ ID NO: 136567 - DNA, 25 bp, Rattus norvegicus
agctgtctctgacttatttctgctc

SEQ ID NO: 136568 - DNA, 25 bp, Rattus norvegicus
agctgtctctgagttatttctgctc

SEQ ID NO: 136569 - DNA, 25 bp, Rattus norvegicus
agctgtctgaacacgtccatcaagg

SEQ ID NO: 136570 - DNA, 25 bp, Rattus norvegicus
agctgtctgaactcgtccatcaagg

SEQ ID NO: 136571 - DNA, 25 bp, Rattus norvegicus
agctgtctgaggagcatacctgtcc

SEQ ID NO: 136572 - DNA, 25 bp, Rattus norvegicus
agctgtctgaggtgcatacctgtcc

SEQ ID NO: 136573 - DNA, 25 bp, Rattus norvegicus
agctgtctgcacatctggatcctaa

SEQ ID NO: 136574 - DNA, 25 bp, Rattus norvegicus
agctgtctgcacttctggatcctaa

SEQ ID NO: 136575 - DNA, 25 bp, Rattus norvegicus
agctgtctgcagcacttgtgtgagt

SEQ ID NO: 136576 - DNA, 25 bp, Rattus norvegicus
agctgtctgcaggacttgtgtgagt

SEQ ID NO: 136577 - DNA, 25 bp, Rattus norvegicus
agctgtctgcatactggcatagtca

SEQ ID NO: 136578 - DNA, 25 bp, Rattus norvegicus
agctgtctgcatctggaacctgtca

SEQ ID NO: 136579 - DNA, 25 bp, Rattus norvegicus
agctgtctgcatgtggaacctgtca

SEQ ID NO: 136580 - DNA, 25 bp, Rattus norvegicus
agctgtctgcattctggcatagtca

SEQ ID NO: 136581 - DNA, 25 bp, Rattus norvegicus
agctgtctgggtatactcactactc

SEQ ID NO: 136582 - DNA, 25 bp, Rattus norvegicus
agctgtctgggtttactcactactc

SEQ ID NO: 136583 - DNA, 25 bp, Rattus norvegicus
agctgtctggtgatctgtttgataa

SEQ ID NO: 136584 - DNA, 25 bp, Rattus norvegicus
agctgtctggtgttctgtttgataa

SEQ ID NO: 136585 - DNA, 25 bp, Rattus norvegicus
agctgtctgtacaaacaggtgctgt

SEQ ID NO: 136586 - DNA, 25 bp, Rattus norvegicus
agctgtctgtactaacaggtgctgt

SEQ ID NO: 136587 - DNA, 25 bp, Rattus norvegicus
agctgtctgtagaccgagggcatca

SEQ ID NO: 136588 - DNA, 25 bp, Rattus norvegicus
agctgtctgtagtccgagggcatca

SEQ ID NO: 136589 - DNA, 25 bp, Rattus norvegicus
agctgtctgtgaacttcaccattga

SEQ ID NO: 136590 - DNA, 25 bp, Rattus norvegicus
agctgtctgtgacgcggatctgtcc

SEQ ID NO: 136591 - DNA, 25 bp, Rattus norvegicus
agctgtctgtgaggcggatctgtcc

SEQ ID NO: 136592 - DNA, 25 bp, Rattus norvegicus
agctgtctgtgatcttcaccattga

SEQ ID NO: 136593 - DNA, 25 bp, Rattus norvegicus
agctgtcttcaaaccagtgcatttc

SEQ ID NO: 136594 - DNA, 25 bp, Rattus norvegicus
agctgtcttcaatccagtgcatttc

SEQ ID NO: 136595 - DNA, 25 bp, Rattus norvegicus
agctgtcttctaccatgcaaacctc

SEQ ID NO: 136596 - DNA, 25 bp, Rattus norvegicus
agctgtcttctagcatgcaaacctc

SEQ ID NO: 136597 - DNA, 25 bp, Rattus norvegicus
agctgtctttctattgctctgttcc

SEQ ID NO: 136598 - DNA, 25 bp, Rattus norvegicus
agctgtctttcttttgctctgttcc

SEQ ID NO: 136599 - DNA, 25 bp, Rattus norvegicus
agctgtgaaagcactccggcaggga

SEQ ID NO: 136600 - DNA, 25 bp, Rattus norvegicus
agctgtgaaagctctccggcaggga

SEQ ID NO: 136601 - DNA, 25 bp, Rattus norvegicus
agctgtgaacatatgcagcacaatg

SEQ ID NO: 136602 - DNA, 25 bp, Rattus norvegicus
agctgtgaacatttgcagcacaatg

SEQ ID NO: 136603 - DNA, 25 bp, Rattus norvegicus
agctgtgaagacagtctgctcgttc

SEQ ID NO: 136604 - DNA, 25 bp, Rattus norvegicus
agctgtgaagactgtctgctcgttc

SEQ ID NO: 136605 - DNA, 25 bp, Rattus norvegicus
agctgtgaagtcagcactccaccaa

SEQ ID NO: 136606 - DNA, 25 bp, Rattus norvegicus
agctgtgaagtctgcactccaccaa

SEQ ID NO: 136607 - DNA, 25 bp, Rattus norvegicus
agctgtgaagtgactcctcctgtcg

SEQ ID NO: 136608 - DNA, 25 bp, Rattus norvegicus
agctgtgaagtgtctcctcctgtcg

SEQ ID NO: 136609 - DNA, 25 bp, Rattus norvegicus
agctgtgaatccagagctcttcatt

SEQ ID NO: 136610 - DNA, 25 bp, Rattus norvegicus
agctgtgaatccagttccttccagt

SEQ ID NO: 136611 - DNA, 25 bp, Rattus norvegicus
agctgtgaatcctgagctcttcatt

SEQ ID NO: 136612 - DNA, 25 bp, Rattus norvegicus
agctgtgaatcctgttccttccagt

SEQ ID NO: 136613 - DNA, 25 bp, Rattus norvegicus
agctgtgaatcgctccagatggtcc

SEQ ID NO: 136614 - DNA, 25 bp, Rattus norvegicus
agctgtgaatcggtccagatggtcc

SEQ ID NO: 136615 - DNA, 25 bp, Rattus norvegicus
agctgtgaattcagttgcactgaca

SEQ ID NO: 136616 - DNA, 25 bp, Rattus norvegicus
agctgtgaattctgttgcactgaca

SEQ ID NO: 136617 - DNA, 25 bp, Rattus norvegicus
agctgtgaccttctttagaaataca

SEQ ID NO: 136618 - DNA, 25 bp, Rattus norvegicus
agctgtgaccttgtttagaaataca

SEQ ID NO: 136619 - DNA, 25 bp, Rattus norvegicus
agctgtgacgtcatcatcttgggcc

SEQ ID NO: 136620 - DNA, 25 bp, Rattus norvegicus
agctgtgacgtcttcatcttgggcc

SEQ ID NO: 136621 - DNA, 25 bp, Rattus norvegicus
agctgtgactttataaatctatttc

SEQ ID NO: 136622 - DNA, 25 bp, Rattus norvegicus
agctgtgactttttaaatctatttc

SEQ ID NO: 136623 - DNA, 25 bp, Rattus norvegicus
agctgtgagcatctcatggtcaact

SEQ ID NO: 136624 - DNA, 25 bp, Rattus norvegicus
agctgtgagcatgtcatggtcaact

SEQ ID NO: 136625 - DNA, 25 bp, Rattus norvegicus
agctgtgagcgcatgcgggcactac

SEQ ID NO: 136626 - DNA, 25 bp, Rattus norvegicus
agctgtgagcgcttgcgggcactac

SEQ ID NO: 136627 - DNA, 25 bp, Rattus norvegicus
agctgtgagggccttgctcaacaca

SEQ ID NO: 136628 - DNA, 25 bp, Rattus norvegicus
agctgtgagggcgttgctcaacaca

SEQ ID NO: 136629 - DNA, 25 bp, Rattus norvegicus
agctgtgagtgcaaaactatgtaca

SEQ ID NO: 136630 - DNA, 25 bp, Rattus norvegicus
agctgtgagtgctaaactatgtaca

SEQ ID NO: 136631 - DNA, 25 bp, Rattus norvegicus
agctgtgagtggatccaggcgccct

SEQ ID NO: 136632 - DNA, 25 bp, Rattus norvegicus
agctgtgagtggttccaggcgccct

SEQ ID NO: 136633 - DNA, 25 bp, Rattus norvegicus
agctgtgatcttaccacttcaaatg

SEQ ID NO: 136634 - DNA, 25 bp, Rattus norvegicus
agctgtgatctttccacttcaaatg

SEQ ID NO: 136635 - DNA, 25 bp, Rattus norvegicus
agctgtgcaaagaactctgtgaatg

SEQ ID NO: 136636 - DNA, 25 bp, Rattus norvegicus
agctgtgcaaagtactctgtgaatg

SEQ ID NO: 136637 - DNA, 25 bp, Rattus norvegicus
agctgtgcaaatactctatcttagg

SEQ ID NO: 136638 - DNA, 25 bp, Rattus norvegicus
agctgtgcaaattctctatcttagg

SEQ ID NO: 136639 - DNA, 25 bp, Rattus norvegicus
agctgtgcaacaaaaccaggccctt

SEQ ID NO: 136640 - DNA, 25 bp, Rattus norvegicus
agctgtgcaacataaccaggccctt

SEQ ID NO: 136641 - DNA, 25 bp, Rattus norvegicus
agctgtgcaaggcacgtctagtgat

SEQ ID NO: 136642 - DNA, 25 bp, Rattus norvegicus
agctgtgcaagggacgtctagtgat

SEQ ID NO: 136643 - DNA, 25 bp, Rattus norvegicus
agctgtgcacacacattcgcaatgt

SEQ ID NO: 136644 - DNA, 25 bp, Rattus norvegicus
agctgtgcacactcattcgcaatgt

SEQ ID NO: 136645 - DNA, 25 bp, Rattus norvegicus
agctgtgcacagcagggaagccctt

SEQ ID NO: 136646 - DNA, 25 bp, Rattus norvegicus
agctgtgcacaggagggaagccctt

SEQ ID NO: 136647 - DNA, 25 bp, Rattus norvegicus
agctgtgcacccagggcctaggaga

SEQ ID NO: 136648 - DNA, 25 bp, Rattus norvegicus
agctgtgcaccctgggcctaggaga

SEQ ID NO: 136649 - DNA, 25 bp, Rattus norvegicus
agctgtgcactgcagcatttccgca

SEQ ID NO: 136650 - DNA, 25 bp, Rattus norvegicus
agctgtgcactggagcatttccgca

SEQ ID NO: 136651 - DNA, 25 bp, Rattus norvegicus
agctgtgcacttccaacaggcaact

SEQ ID NO: 136652 - DNA, 25 bp, Rattus norvegicus
agctgtgcacttgcaacaggcaact

SEQ ID NO: 136653 - DNA, 25 bp, Rattus norvegicus
agctgtgcagaaaatcattaccgag

SEQ ID NO: 136654 - DNA, 25 bp, Rattus norvegicus
agctgtgcagaatatcattaccgag

SEQ ID NO: 136655 - DNA, 25 bp, Rattus norvegicus
agctgtgcagccagatagccagaca

SEQ ID NO: 136656 - DNA, 25 bp, Rattus norvegicus
agctgtgcagccatgcctggaggtt

SEQ ID NO: 136657 - DNA, 25 bp, Rattus norvegicus
agctgtgcagcctgatagccagaca

SEQ ID NO: 136658 - DNA, 25 bp, Rattus norvegicus
agctgtgcagccttgcctggaggtt

SEQ ID NO: 136659 - DNA, 25 bp, Rattus norvegicus
agctgtgcagttaggtggttgctac

SEQ ID NO: 136660 - DNA, 25 bp, Rattus norvegicus
agctgtgcagtttggtggttgctac

SEQ ID NO: 136661 - DNA, 25 bp, Rattus norvegicus
agctgtgcatccaggctgagtctga

SEQ ID NO: 136662 - DNA, 25 bp, Rattus norvegicus
agctgtgcatcctggctgagtctga

SEQ ID NO: 136663 - DNA, 25 bp, Rattus norvegicus
agctgtgccattatgtgaacttgtc

SEQ ID NO: 136664 - DNA, 25 bp, Rattus norvegicus
agctgtgccattttgtgaacttgtc

SEQ ID NO: 136665 - DNA, 25 bp, Rattus norvegicus
agctgtgcccaaccatgagcagaaa

SEQ ID NO: 136666 - DNA, 25 bp, Rattus norvegicus
agctgtgcccaagcatgagcagaaa

SEQ ID NO: 136667 - DNA, 25 bp, Rattus norvegicus
agctgtgcctatagtctgacatctg

SEQ ID NO: 136668 - DNA, 25 bp, Rattus norvegicus
agctgtgcctattgtctgacatctg

SEQ ID NO: 136669 - DNA, 25 bp, Rattus norvegicus
agctgtgcctcgaagcctgggcctg

SEQ ID NO: 136670 - DNA, 25 bp, Rattus norvegicus
agctgtgcctcgtagcctgggcctg

SEQ ID NO: 136671 - DNA, 25 bp, Rattus norvegicus
agctgtgcgcttcctgtagagtgaa

SEQ ID NO: 136672 - DNA, 25 bp, Rattus norvegicus
agctgtgcgcttgctgtagagtgaa

SEQ ID NO: 136673 - DNA, 25 bp, Rattus norvegicus
agctgtgcggttctctgatggccac

SEQ ID NO: 136674 - DNA, 25 bp, Rattus norvegicus
agctgtgcggttgtctgatggccac

SEQ ID NO: 136675 - DNA, 25 bp, Rattus norvegicus
agctgtgctactctgtgctgaccga

SEQ ID NO: 136676 - DNA, 25 bp, Rattus norvegicus
agctgtgctactgtgtgctgaccga

SEQ ID NO: 136677 - DNA, 25 bp, Rattus norvegicus
agctgtgctcaaagtgcttcacaaa

SEQ ID NO: 136678 - DNA, 25 bp, Rattus norvegicus
agctgtgctcaatgtgcttcacaaa

SEQ ID NO: 136679 - DNA, 25 bp, Rattus norvegicus
agctgtgctctaatatcttctgtac

SEQ ID NO: 136680 - DNA, 25 bp, Rattus norvegicus
agctgtgctctattatcttctgtac

SEQ ID NO: 136681 - DNA, 25 bp, Rattus norvegicus
agctgtgctgaaccgcatcctggag

SEQ ID NO: 136682 - DNA, 25 bp, Rattus norvegicus
agctgtgctgaagcgcatcctggag

SEQ ID NO: 136683 - DNA, 25 bp, Rattus norvegicus
agctgtgctgagagcatcggtacga

SEQ ID NO: 136684 - DNA, 25 bp, Rattus norvegicus
agctgtgctgagtgcatcggtacga

SEQ ID NO: 136685 - DNA, 25 bp, Rattus norvegicus
agctgtgcttctcactacgctatgt

SEQ ID NO: 136686 - DNA, 25 bp, Rattus norvegicus
agctgtgcttctgactacgctatgt

SEQ ID NO: 136687 - DNA, 25 bp, Rattus norvegicus
agctgtgcttggctgaagttctcat

SEQ ID NO: 136688 - DNA, 25 bp, Rattus norvegicus
agctgtgcttgggtgaagttctcat

SEQ ID NO: 136689 - DNA, 25 bp, Rattus norvegicus
agctgtgctttcatgcgtgagttta

SEQ ID NO: 136690 - DNA, 25 bp, Rattus norvegicus
agctgtgctttcttgcgtgagttta

SEQ ID NO: 136691 - DNA, 25 bp, Rattus norvegicus
agctgtggacacactgcaaagtcgg

SEQ ID NO: 136692 - DNA, 25 bp, Rattus norvegicus
agctgtggacactctgcaaagtcgg

SEQ ID NO: 136693 - DNA, 25 bp, Rattus norvegicus
agctgtggaggaccttgcctacaag

SEQ ID NO: 136694 - DNA, 25 bp, Rattus norvegicus
agctgtggaggagcttgcctacaag

SEQ ID NO: 136695 - DNA, 25 bp, Rattus norvegicus
agctgtggcaaacttctcacgtcaa

SEQ ID NO: 136696 - DNA, 25 bp, Rattus norvegicus
agctgtggcaaagttctcacgtcaa

SEQ ID NO: 136697 - DNA, 25 bp, Rattus norvegicus
agctgtggcacaaagtcctcaaaca

SEQ ID NO: 136698 - DNA, 25 bp, Rattus norvegicus
agctgtggcacatagtcctcaaaca

SEQ ID NO: 136699 - DNA, 25 bp, Rattus norvegicus
agctgtggcactactggcctgcatt

SEQ ID NO: 136700 - DNA, 25 bp, Rattus norvegicus
agctgtggcacttctggcctgcatt

SEQ ID NO: 136701 - DNA, 25 bp, Rattus norvegicus
agctgtggcagcaatgactgggtac

SEQ ID NO: 136702 - DNA, 25 bp, Rattus norvegicus
agctgtggcagctatgactgggtac

SEQ ID NO: 136703 - DNA, 25 bp, Rattus norvegicus
agctgtggccttcaggccgtaaagc

SEQ ID NO: 136704 - DNA, 25 bp, Rattus norvegicus
agctgtggccttgaggccgtaaagc

SEQ ID NO: 136705 - DNA, 25 bp, Rattus norvegicus
agctgtggctctctggacatttaca

SEQ ID NO: 136706 - DNA, 25 bp, Rattus norvegicus
agctgtggctctgtggacatttaca

SEQ ID NO: 136707 - DNA, 25 bp, Rattus norvegicus
agctgtggctgtactggaggtcact

SEQ ID NO: 136708 - DNA, 25 bp, Rattus norvegicus
agctgtggctgttctggaggtcact

SEQ ID NO: 136709 - DNA, 25 bp, Rattus norvegicus
agctgtggcttgatgactgtcgcac

SEQ ID NO: 136710 - DNA, 25 bp, Rattus norvegicus
agctgtggcttgttgactgtcgcac

SEQ ID NO: 136711 - DNA, 25 bp, Rattus norvegicus
agctgtgggaccagggcgaatcttc

SEQ ID NO: 136712 - DNA, 25 bp, Rattus norvegicus
agctgtgggacctgggcgaatcttc

SEQ ID NO: 136713 - DNA, 25 bp, Rattus norvegicus
agctgtgggtaaagcagcgttcctc

SEQ ID NO: 136714 - DNA, 25 bp, Rattus norvegicus
agctgtgggtaatgcagcgttcctc

SEQ ID NO: 136715 - DNA, 25 bp, Rattus norvegicus
agctgtggtacaattgcccgagttg

SEQ ID NO: 136716 - DNA, 25 bp, Rattus norvegicus
agctgtggtacatttgcccgagttg

SEQ ID NO: 136717 - DNA, 25 bp, Rattus norvegicus
agctgtggtcacagcttcattcact

SEQ ID NO: 136718 - DNA, 25 bp, Rattus norvegicus
agctgtggtcactgcttcattcact

SEQ ID NO: 136719 - DNA, 25 bp, Rattus norvegicus
agctgtggtctccaaattgatctca

SEQ ID NO: 136720 - DNA, 25 bp, Rattus norvegicus
agctgtggtctcgaaattgatctca

SEQ ID NO: 136721 - DNA, 25 bp, Rattus norvegicus
agctgtggtctgagatgctgccacc

SEQ ID NO: 136722 - DNA, 25 bp, Rattus norvegicus
agctgtggtctgatccttcttcctg

SEQ ID NO: 136723 - DNA, 25 bp, Rattus norvegicus
agctgtggtctgtgatgctgccacc

SEQ ID NO: 136724 - DNA, 25 bp, Rattus norvegicus
agctgtggtctgttccttcttcctg

SEQ ID NO: 136725 - DNA, 25 bp, Rattus norvegicus
agctgtggtgacaggctcacagtga

SEQ ID NO: 136726 - DNA, 25 bp, Rattus norvegicus
agctgtggtgactggctcacagtga

SEQ ID NO: 136727 - DNA, 25 bp, Rattus norvegicus
agctgtggttagaccagttggtcca

SEQ ID NO: 136728 - DNA, 25 bp, Rattus norvegicus
agctgtggttagtccagttggtcca

SEQ ID NO: 136729 - DNA, 25 bp, Rattus norvegicus
agctgtggttttctgcggcaccata

SEQ ID NO: 136730 - DNA, 25 bp, Rattus norvegicus
agctgtggttttgtgcggcaccata

SEQ ID NO: 136731 - DNA, 25 bp, Rattus norvegicus
agctgtgtaataatccaatgttgtt

SEQ ID NO: 136732 - DNA, 25 bp, Rattus norvegicus
agctgtgtaatattccaatgttgtt

SEQ ID NO: 136733 - DNA, 25 bp, Rattus norvegicus
agctgtgtactcaggcttctatgtg

SEQ ID NO: 136734 - DNA, 25 bp, Rattus norvegicus
agctgtgtactctggcttctatgtg

SEQ ID NO: 136735 - DNA, 25 bp, Rattus norvegicus
agctgtgtactgatgctcctgtttc

SEQ ID NO: 136736 - DNA, 25 bp, Rattus norvegicus
agctgtgtactgttgctcctgtttc

SEQ ID NO: 136737 - DNA, 25 bp, Rattus norvegicus
agctgtgtagctacgaacaactcag

SEQ ID NO: 136738 - DNA, 25 bp, Rattus norvegicus
agctgtgtagcttcgaacaactcag

SEQ ID NO: 136739 - DNA, 25 bp, Rattus norvegicus
agctgtgtagtcacaggccaatcac

SEQ ID NO: 136740 - DNA, 25 bp, Rattus norvegicus
agctgtgtagtctcaggccaatcac

SEQ ID NO: 136741 - DNA, 25 bp, Rattus norvegicus
agctgtgtatccctgttccttgtgg

SEQ ID NO: 136742 - DNA, 25 bp, Rattus norvegicus
agctgtgtatccgtgttccttgtgg

SEQ ID NO: 136743 - DNA, 25 bp, Rattus norvegicus
agctgtgtcaaaaatttttattggc

SEQ ID NO: 136744 - DNA, 25 bp, Rattus norvegicus
agctgtgtcaaatatttttattggc

SEQ ID NO: 136745 - DNA, 25 bp, Rattus norvegicus
agctgtgtcaccaggaccatagcat

SEQ ID NO: 136746 - DNA, 25 bp, Rattus norvegicus
agctgtgtcacctggaccatagcat

SEQ ID NO: 136747 - DNA, 25 bp, Rattus norvegicus
agctgtgtcactcctaacctcttat

SEQ ID NO: 136748 - DNA, 25 bp, Rattus norvegicus
agctgtgtcactgctaacctcttat

SEQ ID NO: 136749 - DNA, 25 bp, Rattus norvegicus
agctgtgtcatgaacaatggatctt

SEQ ID NO: 136750 - DNA, 25 bp, Rattus norvegicus
agctgtgtcatgtacaatggatctt

SEQ ID NO: 136751 - DNA, 25 bp, Rattus norvegicus
agctgtgtccctaagttcccagagc

SEQ ID NO: 136752 - DNA, 25 bp, Rattus norvegicus
agctgtgtcccttagttcccagagc

SEQ ID NO: 136753 - DNA, 25 bp, Rattus norvegicus
agctgtgtctatatccttgtgtgaa

SEQ ID NO: 136754 - DNA, 25 bp, Rattus norvegicus
agctgtgtctatttccttgtgtgaa

SEQ ID NO: 136755 - DNA, 25 bp, Rattus norvegicus
agctgtgtctctacttatgatccct

SEQ ID NO: 136756 - DNA, 25 bp, Rattus norvegicus
agctgtgtctcttcttatgatccct

SEQ ID NO: 136757 - DNA, 25 bp, Rattus norvegicus
agctgtgtcttccagatccggagaa

SEQ ID NO: 136758 - DNA, 25 bp, Rattus norvegicus
agctgtgtcttcgagatccggagaa

SEQ ID NO: 136759 - DNA, 25 bp, Rattus norvegicus
agctgtgtcttgaggccatgctgac

SEQ ID NO: 136760 - DNA, 25 bp, Rattus norvegicus
agctgtgtcttgtggccatgctgac

SEQ ID NO: 136761 - DNA, 25 bp, Rattus norvegicus
agctgtgtctttctatttccagtct

SEQ ID NO: 136762 - DNA, 25 bp, Rattus norvegicus
agctgtgtctttgtatttccagtct

SEQ ID NO: 136763 - DNA, 25 bp, Rattus norvegicus
agctgtgtgaacctgtatgtaccta

SEQ ID NO: 136764 - DNA, 25 bp, Rattus norvegicus
agctgtgtgaacgtgtatgtaccta

SEQ ID NO: 136765 - DNA, 25 bp, Rattus norvegicus
agctgtgtgactacaaccctaagag

SEQ ID NO: 136766 - DNA, 25 bp, Rattus norvegicus
agctgtgtgactccgcatgtttcca

SEQ ID NO: 136767 - DNA, 25 bp, Rattus norvegicus
agctgtgtgactgcgcatgtttcca

SEQ ID NO: 136768 - DNA, 25 bp, Rattus norvegicus
agctgtgtgacttcaaccctaagag

SEQ ID NO: 136769 - DNA, 25 bp, Rattus norvegicus
agctgtgtgagcagtcatcctgctg

SEQ ID NO: 136770 - DNA, 25 bp, Rattus norvegicus
agctgtgtgagctgtcatcctgctg

SEQ ID NO: 136771 - DNA, 25 bp, Rattus norvegicus
agctgtgtgatcatctcaaggccag

SEQ ID NO: 136772 - DNA, 25 bp, Rattus norvegicus
agctgtgtgatcttctcaaggccag

SEQ ID NO: 136773 - DNA, 25 bp, Rattus norvegicus
agctgtgtggaaccaccttcacatt

SEQ ID NO: 136774 - DNA, 25 bp, Rattus norvegicus
agctgtgtggaagcaccttcacatt

SEQ ID NO: 136775 - DNA, 25 bp, Rattus norvegicus
agctgtgtggccagttcactgatta

SEQ ID NO: 136776 - DNA, 25 bp, Rattus norvegicus
agctgtgtggcccattccaagggaa

SEQ ID NO: 136777 - DNA, 25 bp, Rattus norvegicus
agctgtgtggccgattccaagggaa

SEQ ID NO: 136778 - DNA, 25 bp, Rattus norvegicus
agctgtgtggcctgttcactgatta

SEQ ID NO: 136779 - DNA, 25 bp, Rattus norvegicus
agctgtgtgggcagtggctctcaca

SEQ ID NO: 136780 - DNA, 25 bp, Rattus norvegicus
agctgtgtgggctgtggctctcaca

SEQ ID NO: 136781 - DNA, 25 bp, Rattus norvegicus
agctgtgtgtaaacggcagacctat

SEQ ID NO: 136782 - DNA, 25 bp, Rattus norvegicus
agctgtgtgtaatcggcagacctat

SEQ ID NO: 136783 - DNA, 25 bp, Rattus norvegicus
agctgtgtgtatcaaattactttgc

SEQ ID NO: 136784 - DNA, 25 bp, Rattus norvegicus
agctgtgtgtatgaaattactttgc

SEQ ID NO: 136785 - DNA, 25 bp, Rattus norvegicus
agctgtgtgtctcctgaaatgacca

SEQ ID NO: 136786 - DNA, 25 bp, Rattus norvegicus
agctgtgtgtctgctgaaatgacca

SEQ ID NO: 136787 - DNA, 25 bp, Rattus norvegicus
agctgtgtgtggagtcgcgccctct

SEQ ID NO: 136788 - DNA, 25 bp, Rattus norvegicus
agctgtgtgtggtgtcgcgccctct

SEQ ID NO: 136789 - DNA, 25 bp, Rattus norvegicus
agctgtgtgttaatcttctaaaaga

SEQ ID NO: 136790 - DNA, 25 bp, Rattus norvegicus
agctgtgtgttattcttctaaaaga

SEQ ID NO: 136791 - DNA, 25 bp, Rattus norvegicus
agctgtgtgttgattggtggctaca

SEQ ID NO: 136792 - DNA, 25 bp, Rattus norvegicus
agctgtgtgttgtttggtggctaca

SEQ ID NO: 136793 - DNA, 25 bp, Rattus norvegicus
agctgtgtgtttcatcccattccat

SEQ ID NO: 136794 - DNA, 25 bp, Rattus norvegicus
agctgtgtgtttgatcccattccat

SEQ ID NO: 136795 - DNA, 25 bp, Rattus norvegicus
agctgtgttaaacggactcggcatt

SEQ ID NO: 136796 - DNA, 25 bp, Rattus norvegicus
agctgtgttaaagggactcggcatt

SEQ ID NO: 136797 - DNA, 25 bp, Rattus norvegicus
agctgtgttatcaggactttctaat

SEQ ID NO: 136798 - DNA, 25 bp, Rattus norvegicus
agctgtgttatctggactttctaat

SEQ ID NO: 136799 - DNA, 25 bp, Rattus norvegicus
agctgtgttcataactagatggaat

SEQ ID NO: 136800 - DNA, 25 bp, Rattus norvegicus
agctgtgttcattactagatggaat

SEQ ID NO: 136801 - DNA, 25 bp, Rattus norvegicus
agctgtgttctgcttgaaatcctca

SEQ ID NO: 136802 - DNA, 25 bp, Rattus norvegicus
agctgtgttctggttgaaatcctca

SEQ ID NO: 136803 - DNA, 25 bp, Rattus norvegicus
agctgtgtttaaaggttttacctca

SEQ ID NO: 136804 - DNA, 25 bp, Rattus norvegicus
agctgtgtttaatggttttacctca

SEQ ID NO: 136805 - DNA, 25 bp, Rattus norvegicus
agctgtgtttagacactcgtgttca

SEQ ID NO: 136806 - DNA, 25 bp, Rattus norvegicus
agctgtgtttagtcactcgtgttca

SEQ ID NO: 136807 - DNA, 25 bp, Rattus norvegicus
agctgtgtttatccttgacctcaaa

SEQ ID NO: 136808 - DNA, 25 bp, Rattus norvegicus
agctgtgtttatgcttgacctcaaa

SEQ ID NO: 136809 - DNA, 25 bp, Rattus norvegicus
agctgtgttttcctaattgtatata

SEQ ID NO: 136810 - DNA, 25 bp, Rattus norvegicus
agctgtgttttcgtaattgtatata

SEQ ID NO: 136811 - DNA, 25 bp, Rattus norvegicus
agctgttaacatctggatccaggac

SEQ ID NO: 136812 - DNA, 25 bp, Rattus norvegicus
agctgttaacatgtggatccaggac

SEQ ID NO: 136813 - DNA, 25 bp, Rattus norvegicus
agctgttaatgcactgttgaccttc

SEQ ID NO: 136814 - DNA, 25 bp, Rattus norvegicus
agctgttaatgctctgttgaccttc

SEQ ID NO: 136815 - DNA, 25 bp, Rattus norvegicus
agctgttaatttagtctctttctgt

SEQ ID NO: 136816 - DNA, 25 bp, Rattus norvegicus
agctgttaattttgtctctttctgt

SEQ ID NO: 136817 - DNA, 25 bp, Rattus norvegicus
agctgttacagcctcactggtgacg

SEQ ID NO: 136818 - DNA, 25 bp, Rattus norvegicus
agctgttacagcgtcactggtgacg

SEQ ID NO: 136819 - DNA, 25 bp, Rattus norvegicus
agctgttaccagcttcgtcctcaaa

SEQ ID NO: 136820 - DNA, 25 bp, Rattus norvegicus
agctgttaccaggttcgtcctcaaa

SEQ ID NO: 136821 - DNA, 25 bp, Rattus norvegicus
agctgttacccactttctagttcct

SEQ ID NO: 136822 - DNA, 25 bp, Rattus norvegicus
agctgttacccagtttctagttcct

SEQ ID NO: 136823 - DNA, 25 bp, Rattus norvegicus
agctgttacgttactgcttgacata

SEQ ID NO: 136824 - DNA, 25 bp, Rattus norvegicus
agctgttacgtttctgcttgacata

SEQ ID NO: 136825 - DNA, 25 bp, Rattus norvegicus
agctgttactccacatcggctgtta

SEQ ID NO: 136826 - DNA, 25 bp, Rattus norvegicus
agctgttactcctcatcggctgtta

SEQ ID NO: 136827 - DNA, 25 bp, Rattus norvegicus
agctgttactgacactgctctagtt

SEQ ID NO: 136828 - DNA, 25 bp, Rattus norvegicus
agctgttactgagactgctctagtt

SEQ ID NO: 136829 - DNA, 25 bp, Rattus norvegicus
agctgttagcacacttgtgccgtat

SEQ ID NO: 136830 - DNA, 25 bp, Rattus norvegicus
agctgttagcactcttgtgccgtat

SEQ ID NO: 136831 - DNA, 25 bp, Rattus norvegicus
agctgttagctcagaagccctgtat

SEQ ID NO: 136832 - DNA, 25 bp, Rattus norvegicus
agctgttagctctgaagccctgtat

SEQ ID NO: 136833 - DNA, 25 bp, Rattus norvegicus
agctgttagctgattctcttagaga

SEQ ID NO: 136834 - DNA, 25 bp, Rattus norvegicus
agctgttagctgtttctcttagaga

SEQ ID NO: 136835 - DNA, 25 bp, Rattus norvegicus
agctgttaggtgacttgacgaccca

SEQ ID NO: 136836 - DNA, 25 bp, Rattus norvegicus
agctgttaggtgtcttgacgaccca

SEQ ID NO: 136837 - DNA, 25 bp, Rattus norvegicus
agctgttatacaagtcctgattctg

SEQ ID NO: 136838 - DNA, 25 bp, Rattus norvegicus
agctgttatacatgtcctgattctg

SEQ ID NO: 136839 - DNA, 25 bp, Rattus norvegicus
agctgttatcatcaagtacttggaa

SEQ ID NO: 136840 - DNA, 25 bp, Rattus norvegicus
agctgttatcatgaagtacttggaa

SEQ ID NO: 136841 - DNA, 25 bp, Rattus norvegicus
agctgttcagaactccagctgctct

SEQ ID NO: 136842 - DNA, 25 bp, Rattus norvegicus
agctgttcagaagtccagctgctct

SEQ ID NO: 136843 - DNA, 25 bp, Rattus norvegicus
agctgttcagcccttggaactaagt

SEQ ID NO: 136844 - DNA, 25 bp, Rattus norvegicus
agctgttcagccgttggaactaagt

SEQ ID NO: 136845 - DNA, 25 bp, Rattus norvegicus
agctgttcaggcctcatcttatctt

SEQ ID NO: 136846 - DNA, 25 bp, Rattus norvegicus
agctgttcaggcgtcatcttatctt

SEQ ID NO: 136847 - DNA, 25 bp, Rattus norvegicus
agctgttcccttctgtaagccgtaa

SEQ ID NO: 136848 - DNA, 25 bp, Rattus norvegicus
agctgttcccttgtgtaagccgtaa

SEQ ID NO: 136849 - DNA, 25 bp, Rattus norvegicus
agctgttcctaaccactgtgctagg

SEQ ID NO: 136850 - DNA, 25 bp, Rattus norvegicus
agctgttcctaagcactgtgctagg

SEQ ID NO: 136851 - DNA, 25 bp, Rattus norvegicus
agctgttcctggagcttcaagccct

SEQ ID NO: 136852 - DNA, 25 bp, Rattus norvegicus
agctgttcctggtgcttcaagccct

SEQ ID NO: 136853 - DNA, 25 bp, Rattus norvegicus
agctgttcctttccaatctcaatgg

SEQ ID NO: 136854 - DNA, 25 bp, Rattus norvegicus
agctgttcctttgcaatctcaatgg

SEQ ID NO: 136855 - DNA, 25 bp, Rattus norvegicus
agctgttcgaacactgtatcactgt

SEQ ID NO: 136856 - DNA, 25 bp, Rattus norvegicus
agctgttcgaactctgtatcactgt

SEQ ID NO: 136857 - DNA, 25 bp, Rattus norvegicus
agctgttcgagcacatcctaatgga

SEQ ID NO: 136858 - DNA, 25 bp, Rattus norvegicus
agctgttcgagctcatcctaatgga

SEQ ID NO: 136859 - DNA, 25 bp, Rattus norvegicus
agctgttctagaatgtctcctggac

SEQ ID NO: 136860 - DNA, 25 bp, Rattus norvegicus
agctgttctagattgtctcctggac

SEQ ID NO: 136861 - DNA, 25 bp, Rattus norvegicus
agctgttctcgtatgttacatgtaa

SEQ ID NO: 136862 - DNA, 25 bp, Rattus norvegicus
agctgttctcgtttgttacatgtaa

SEQ ID NO: 136863 - DNA, 25 bp, Rattus norvegicus
agctgttctctgatatccatgttgc

SEQ ID NO: 136864 - DNA, 25 bp, Rattus norvegicus
agctgttctctgcatttgttacttg

SEQ ID NO: 136865 - DNA, 25 bp, Rattus norvegicus
agctgttctctggatttgttacttg

SEQ ID NO: 136866 - DNA, 25 bp, Rattus norvegicus
agctgttctctgttatccatgttgc

SEQ ID NO: 136867 - DNA, 25 bp, Rattus norvegicus
agctgttctgtgctggtagatgttc

SEQ ID NO: 136868 - DNA, 25 bp, Rattus norvegicus
agctgttctgtggtggtagatgttc

SEQ ID NO: 136869 - DNA, 25 bp, Rattus norvegicus
agctgttcttatccagaggaacata

SEQ ID NO: 136870 - DNA, 25 bp, Rattus norvegicus
agctgttcttatgcagaggaacata

SEQ ID NO: 136871 - DNA, 25 bp, Rattus norvegicus
agctgttcttctacctggtggagaa

SEQ ID NO: 136872 - DNA, 25 bp, Rattus norvegicus
agctgttcttcttcctggtggagaa

SEQ ID NO: 136873 - DNA, 25 bp, Rattus norvegicus
agctgttcttggctctaaggtcctg

SEQ ID NO: 136874 - DNA, 25 bp, Rattus norvegicus
agctgttcttgggtctaaggtcctg

SEQ ID NO: 136875 - DNA, 25 bp, Rattus norvegicus
agctgttctttcaatctgtctcaaa

SEQ ID NO: 136876 - DNA, 25 bp, Rattus norvegicus
agctgttctttcacaactcttacgt

SEQ ID NO: 136877 - DNA, 25 bp, Rattus norvegicus
agctgttctttcacccaggatgggc

SEQ ID NO: 136878 - DNA, 25 bp, Rattus norvegicus
agctgttctttctatctgtctcaaa

SEQ ID NO: 136879 - DNA, 25 bp, Rattus norvegicus
agctgttctttctcaactcttacgt

SEQ ID NO: 136880 - DNA, 25 bp, Rattus norvegicus
agctgttctttctcccaggatgggc

SEQ ID NO: 136881 - DNA, 25 bp, Rattus norvegicus
agctgttctttgctctgacattcag

SEQ ID NO: 136882 - DNA, 25 bp, Rattus norvegicus
agctgttctttggtctgacattcag

SEQ ID NO: 136883 - DNA, 25 bp, Rattus norvegicus
agctgttgacttctagcgtgttcat

SEQ ID NO: 136884 - DNA, 25 bp, Rattus norvegicus
agctgttgacttgtagcgtgttcat

SEQ ID NO: 136885 - DNA, 25 bp, Rattus norvegicus
agctgttgagccaaccaaagtggat

SEQ ID NO: 136886 - DNA, 25 bp, Rattus norvegicus
agctgttgagcctaccaaagtggat

SEQ ID NO: 136887 - DNA, 25 bp, Rattus norvegicus
agctgttgagtgaatttttctgtat

SEQ ID NO: 136888 - DNA, 25 bp, Rattus norvegicus
agctgttgagtgtatttttctgtat

SEQ ID NO: 136889 - DNA, 25 bp, Rattus norvegicus
agctgttgcaacctgagccatttcc

SEQ ID NO: 136890 - DNA, 25 bp, Rattus norvegicus
agctgttgcaacgtgagccatttcc

SEQ ID NO: 136891 - DNA, 25 bp, Rattus norvegicus
agctgttgccacaactatgccctac

SEQ ID NO: 136892 - DNA, 25 bp, Rattus norvegicus
agctgttgccactactatgccctac

SEQ ID NO: 136893 - DNA, 25 bp, Rattus norvegicus
agctgttgcttgatgtctttctcta

SEQ ID NO: 136894 - DNA, 25 bp, Rattus norvegicus
agctgttgcttgttgtctttctcta

SEQ ID NO: 136895 - DNA, 25 bp, Rattus norvegicus
agctgttgctttctcaaggctctac

SEQ ID NO: 136896 - DNA, 25 bp, Rattus norvegicus
agctgttgctttgtcaaggctctac

SEQ ID NO: 136897 - DNA, 25 bp, Rattus norvegicus
agctgttggcaaatcgcagtccaca

SEQ ID NO: 136898 - DNA, 25 bp, Rattus norvegicus
agctgttggcaattcgcagtccaca

SEQ ID NO: 136899 - DNA, 25 bp, Rattus norvegicus
agctgttggcaccaagttccaccag

SEQ ID NO: 136900 - DNA, 25 bp, Rattus norvegicus
agctgttggcacgaagttccaccag

SEQ ID NO: 136901 - DNA, 25 bp, Rattus norvegicus
agctgttggcctctatgatgactgt

SEQ ID NO: 136902 - DNA, 25 bp, Rattus norvegicus
agctgttggcctgtatgatgactgt

SEQ ID NO: 136903 - DNA, 25 bp, Rattus norvegicus
agctgttgggaaagtgcttgccaca

SEQ ID NO: 136904 - DNA, 25 bp, Rattus norvegicus
agctgttgggaatgtgcttgccaca

SEQ ID NO: 136905 - DNA, 25 bp, Rattus norvegicus
agctgttgtagccttgggtatcatc

SEQ ID NO: 136906 - DNA, 25 bp, Rattus norvegicus
agctgttgtagcgttgggtatcatc

SEQ ID NO: 136907 - DNA, 25 bp, Rattus norvegicus
agctgttgtcaccactgagtcacaa

SEQ ID NO: 136908 - DNA, 25 bp, Rattus norvegicus
agctgttgtcacgactgagtcacaa

SEQ ID NO: 136909 - DNA, 25 bp, Rattus norvegicus
agctgttgtctgctactggtaatct

SEQ ID NO: 136910 - DNA, 25 bp, Rattus norvegicus
agctgttgtctggtactggtaatct

SEQ ID NO: 136911 - DNA, 25 bp, Rattus norvegicus
agctgttgtgcaagaaaatcttgac

SEQ ID NO: 136912 - DNA, 25 bp, Rattus norvegicus
agctgttgtgcatgaaaatcttgac

SEQ ID NO: 136913 - DNA, 25 bp, Rattus norvegicus
agctgtttacagctgaccactgtgt

SEQ ID NO: 136914 - DNA, 25 bp, Rattus norvegicus
agctgtttacaggtgaccactgtgt

SEQ ID NO: 136915 - DNA, 25 bp, Rattus norvegicus
agctgtttataaatttcgcgtccta

SEQ ID NO: 136916 - DNA, 25 bp, Rattus norvegicus
agctgtttataattttcgcgtccta

SEQ ID NO: 136917 - DNA, 25 bp, Rattus norvegicus
agctgtttcagacatggaaatccat

SEQ ID NO: 136918 - DNA, 25 bp, Rattus norvegicus
agctgtttcagagatggaaatccat

SEQ ID NO: 136919 - DNA, 25 bp, Rattus norvegicus
agctgtttcatcagggcctgagtta

SEQ ID NO: 136920 - DNA, 25 bp, Rattus norvegicus
agctgtttcatctgggcctgagtta

SEQ ID NO: 136921 - DNA, 25 bp, Rattus norvegicus
agctgtttcccaaggtgctgctggt

SEQ ID NO: 136922 - DNA, 25 bp, Rattus norvegicus
agctgtttcccatggtgctgctggt

SEQ ID NO: 136923 - DNA, 25 bp, Rattus norvegicus
agctgtttctgcaccattgatggtc

SEQ ID NO: 136924 - DNA, 25 bp, Rattus norvegicus
agctgtttctgctccattgatggtc

SEQ ID NO: 136925 - DNA, 25 bp, Rattus norvegicus
agctgtttctgtcatgctgagcccc

SEQ ID NO: 136926 - DNA, 25 bp, Rattus norvegicus
agctgtttctgtgatgctgagcccc

SEQ ID NO: 136927 - DNA, 25 bp, Rattus norvegicus
agctgtttgaagacccgcagcgaca

SEQ ID NO: 136928 - DNA, 25 bp, Rattus norvegicus
agctgtttgaagtcccgcagcgaca

SEQ ID NO: 136929 - DNA, 25 bp, Rattus norvegicus
agctgtttgactatagtttcctctg

SEQ ID NO: 136930 - DNA, 25 bp, Rattus norvegicus
agctgtttgactttagtttcctctg

SEQ ID NO: 136931 - DNA, 25 bp, Rattus norvegicus
agctgtttgagcacacggatctcac

SEQ ID NO: 136932 - DNA, 25 bp, Rattus norvegicus
agctgtttgagctcacggatctcac

SEQ ID NO: 136933 - DNA, 25 bp, Rattus norvegicus
agctgtttgagtatatcgaccgcat

SEQ ID NO: 136934 - DNA, 25 bp, Rattus norvegicus
agctgtttgagtttatcgaccgcat

SEQ ID NO: 136935 - DNA, 25 bp, Rattus norvegicus
agctgtttgctgagtcaaattattt

SEQ ID NO: 136936 - DNA, 25 bp, Rattus norvegicus
agctgtttgctgattaagccaggct

SEQ ID NO: 136937 - DNA, 25 bp, Rattus norvegicus
agctgtttgctgtgtcaaattattt

SEQ ID NO: 136938 - DNA, 25 bp, Rattus norvegicus
agctgtttgctgtttaagccaggct

SEQ ID NO: 136939 - DNA, 25 bp, Rattus norvegicus
agctgtttgggacttcttgtatttc

SEQ ID NO: 136940 - DNA, 25 bp, Rattus norvegicus
agctgtttgggagttcttgtatttc

SEQ ID NO: 136941 - DNA, 25 bp, Rattus norvegicus
agctgttttataattgtgccttcaa

SEQ ID NO: 136942 - DNA, 25 bp, Rattus norvegicus
agctgttttatatttgtgccttcaa

SEQ ID NO: 136943 - DNA, 25 bp, Rattus norvegicus
agctgttttcacatagtggctctaa

SEQ ID NO: 136944 - DNA, 25 bp, Rattus norvegicus
agctgttttcacttagtggctctaa

SEQ ID NO: 136945 - DNA, 25 bp, Rattus norvegicus
agctgttttcctccatagagtctta

SEQ ID NO: 136946 - DNA, 25 bp, Rattus norvegicus
agctgttttcctgcatagagtctta

SEQ ID NO: 136947 - DNA, 25 bp, Rattus norvegicus
agctgttttgacataatggccacat

SEQ ID NO: 136948 - DNA, 25 bp, Rattus norvegicus
agctgttttgacttaatggccacat

SEQ ID NO: 136949 - DNA, 25 bp, Rattus norvegicus
agctgttttgttcaaagggcctcat

SEQ ID NO: 136950 - DNA, 25 bp, Rattus norvegicus
agctgttttgttgaaagggcctcat

SEQ ID NO: 136951 - DNA, 25 bp, Rattus norvegicus
agctgtttttaaagtatccttatca

SEQ ID NO: 136952 - DNA, 25 bp, Rattus norvegicus
agctgtttttaatgtatccttatca

SEQ ID NO: 136953 - DNA, 25 bp, Rattus norvegicus
agctgtttttctacagaaagcacaa

SEQ ID NO: 136954 - DNA, 25 bp, Rattus norvegicus
agctgtttttcttcagaaagcacaa

SEQ ID NO: 136955 - DNA, 25 bp, Rattus norvegicus
agctgttttttcctactctcttgga

SEQ ID NO: 136956 - DNA, 25 bp, Rattus norvegicus
agctgttttttcgtactctcttgga

SEQ ID NO: 136957 - DNA, 25 bp, Rattus norvegicus
agcttaaaaggcactagtttactat

SEQ ID NO: 136958 - DNA, 25 bp, Rattus norvegicus
agcttaaaaggctctagtttactat

SEQ ID NO: 136959 - DNA, 25 bp, Rattus norvegicus
agcttaaaagtcagtgcccaggcaa

SEQ ID NO: 136960 - DNA, 25 bp, Rattus norvegicus
agcttaaaagtctgtgcccaggcaa

SEQ ID NO: 136961 - DNA, 25 bp, Rattus norvegicus
agcttaaaatgcacttcctcaggag

SEQ ID NO: 136962 - DNA, 25 bp, Rattus norvegicus
agcttaaaatgctcttcctcaggag

SEQ ID NO: 136963 - DNA, 25 bp, Rattus norvegicus
agcttaaaggtcattgtgcttcatc

SEQ ID NO: 136964 - DNA, 25 bp, Rattus norvegicus
agcttaaaggtctttgtgcttcatc

SEQ ID NO: 136965 - DNA, 25 bp, Rattus norvegicus
agcttaaatatcatctgcctcacaa

SEQ ID NO: 136966 - DNA, 25 bp, Rattus norvegicus
agcttaaatatcttctgcctcacaa

SEQ ID NO: 136967 - DNA, 25 bp, Rattus norvegicus
agcttaacaactcggctgtgtacag

SEQ ID NO: 136968 - DNA, 25 bp, Rattus norvegicus
agcttaacaactgggctgtgtacag

SEQ ID NO: 136969 - DNA, 25 bp, Rattus norvegicus
agcttaacatacactgaccacctgg

SEQ ID NO: 136970 - DNA, 25 bp, Rattus norvegicus
agcttaacatactctgaccacctgg

SEQ ID NO: 136971 - DNA, 25 bp, Rattus norvegicus
agcttaacttccatagaaccgccat

SEQ ID NO: 136972 - DNA, 25 bp, Rattus norvegicus
agcttaacttccttagaaccgccat

SEQ ID NO: 136973 - DNA, 25 bp, Rattus norvegicus
agcttaaggcgtaatcagtctatca

SEQ ID NO: 136974 - DNA, 25 bp, Rattus norvegicus
agcttaaggcgttatcagtctatca

SEQ ID NO: 136975 - DNA, 25 bp, Rattus norvegicus
agcttaagtccacccaggagccaat

SEQ ID NO: 136976 - DNA, 25 bp, Rattus norvegicus
agcttaagtccagccaggagccaat

SEQ ID NO: 136977 - DNA, 25 bp, Rattus norvegicus
agcttaatatgtactgttcctcgcc

SEQ ID NO: 136978 - DNA, 25 bp, Rattus norvegicus
agcttaatatgttctgttcctcgcc

SEQ ID NO: 136979 - DNA, 25 bp, Rattus norvegicus
agcttaatcctacaaaaccactcac

SEQ ID NO: 136980 - DNA, 25 bp, Rattus norvegicus
agcttaatcctagaaaaccactcac

SEQ ID NO: 136981 - DNA, 25 bp, Rattus norvegicus
agcttaatggttaaatctccacgta

SEQ ID NO: 136982 - DNA, 25 bp, Rattus norvegicus
agcttaatggtttaatctccacgta

SEQ ID NO: 136983 - DNA, 25 bp, Rattus norvegicus
agcttaattttcacctcgctttgaa

SEQ ID NO: 136984 - DNA, 25 bp, Rattus norvegicus
agcttaattttctcctcgctttgaa

SEQ ID NO: 136985 - DNA, 25 bp, Rattus norvegicus
agcttacaactgagtcgtttgagat

SEQ ID NO: 136986 - DNA, 25 bp, Rattus norvegicus
agcttacaactgtgtcgtttgagat

SEQ ID NO: 136987 - DNA, 25 bp, Rattus norvegicus
agcttacactcaaggctgtctatgt

SEQ ID NO: 136988 - DNA, 25 bp, Rattus norvegicus
agcttacactcatggctgtctatgt

SEQ ID NO: 136989 - DNA, 25 bp, Rattus norvegicus
agcttacagacaaacccctgatgga

SEQ ID NO: 136990 - DNA, 25 bp, Rattus norvegicus
agcttacagacatacccctgatgga

SEQ ID NO: 136991 - DNA, 25 bp, Rattus norvegicus
agcttacatagcagacgccaggcca

SEQ ID NO: 136992 - DNA, 25 bp, Rattus norvegicus
agcttacatagctgacgccaggcca

SEQ ID NO: 136993 - DNA, 25 bp, Rattus norvegicus
agcttacatatccagaccttatctt

SEQ ID NO: 136994 - DNA, 25 bp, Rattus norvegicus
agcttacatatcgagaccttatctt

SEQ ID NO: 136995 - DNA, 25 bp, Rattus norvegicus
agcttacatcaaaaaccttttcaga

SEQ ID NO: 136996 - DNA, 25 bp, Rattus norvegicus
agcttacatcaataaccttttcaga

SEQ ID NO: 136997 - DNA, 25 bp, Rattus norvegicus
agcttacatgttccctaaactcaaa

SEQ ID NO: 136998 - DNA, 25 bp, Rattus norvegicus
agcttacatgttgcctaaactcaaa

SEQ ID NO: 136999 - DNA, 25 bp, Rattus norvegicus
agcttaccaagtcgatgtttctaag

SEQ ID NO: 137000 - DNA, 25 bp, Rattus norvegicus
agcttaccaagtggatgtttctaag

SEQ ID NO: 137001 - DNA, 25 bp, Rattus norvegicus
agcttacccatcacttacaggttct

SEQ ID NO: 137002 - DNA, 25 bp, Rattus norvegicus
agcttacccatctcttacaggttct

SEQ ID NO: 137003 - DNA, 25 bp, Rattus norvegicus
agcttaccggaaacgggccctgatg

SEQ ID NO: 137004 - DNA, 25 bp, Rattus norvegicus
agcttaccggaatcgggccctgatg

SEQ ID NO: 137005 - DNA, 25 bp, Rattus norvegicus
agcttacctctaagtctgtgtgtct

SEQ ID NO: 137006 - DNA, 25 bp, Rattus norvegicus
agcttacctctatgtctgtgtgtct

SEQ ID NO: 137007 - DNA, 25 bp, Rattus norvegicus
agcttacctgagattcactgtggat

SEQ ID NO: 137008 - DNA, 25 bp, Rattus norvegicus
agcttacctgagtttcactgtggat

SEQ ID NO: 137009 - DNA, 25 bp, Rattus norvegicus
agcttacctggaaggcagtggccac

SEQ ID NO: 137010 - DNA, 25 bp, Rattus norvegicus
agcttacctggatggcagtggccac

SEQ ID NO: 137011 - DNA, 25 bp, Rattus norvegicus
agcttacgagtgaccactttgtcct

SEQ ID NO: 137012 - DNA, 25 bp, Rattus norvegicus
agcttacgagtgtccactttgtcct

SEQ ID NO: 137013 - DNA, 25 bp, Rattus norvegicus
agcttactaaatcaccttggttctg

SEQ ID NO: 137014 - DNA, 25 bp, Rattus norvegicus
agcttactaaatgaccttggttctg

SEQ ID NO: 137015 - DNA, 25 bp, Rattus norvegicus
agcttactatggattatgtctgatg

SEQ ID NO: 137016 - DNA, 25 bp, Rattus norvegicus
agcttactatggtttatgtctgatg

SEQ ID NO: 137017 - DNA, 25 bp, Rattus norvegicus
agcttactcgacacatgggcggaga

SEQ ID NO: 137018 - DNA, 25 bp, Rattus norvegicus
agcttactcgactcatgggcggaga

SEQ ID NO: 137019 - DNA, 25 bp, Rattus norvegicus
agcttactctttatgtccactggaa

SEQ ID NO: 137020 - DNA, 25 bp, Rattus norvegicus
agcttactctttttgtccactggaa

SEQ ID NO: 137021 - DNA, 25 bp, Rattus norvegicus
agcttactgattacaaattgtctgg

SEQ ID NO: 137022 - DNA, 25 bp, Rattus norvegicus
agcttactgatttcaaattgtctgg

SEQ ID NO: 137023 - DNA, 25 bp, Rattus norvegicus
agcttactgctaccgaaactgtttt

SEQ ID NO: 137024 - DNA, 25 bp, Rattus norvegicus
agcttactgctagcgaaactgtttt

SEQ ID NO: 137025 - DNA, 25 bp, Rattus norvegicus
agcttactgtagcatcctgagcctg

SEQ ID NO: 137026 - DNA, 25 bp, Rattus norvegicus
agcttactgtaggatcctgagcctg

SEQ ID NO: 137027 - DNA, 25 bp, Rattus norvegicus
agcttacttagtaaccattcctgtc

SEQ ID NO: 137028 - DNA, 25 bp, Rattus norvegicus
agcttacttagttaccattcctgtc

SEQ ID NO: 137029 - DNA, 25 bp, Rattus norvegicus
agcttacttcctcgctgcttgaact

SEQ ID NO: 137030 - DNA, 25 bp, Rattus norvegicus
agcttacttcctggctgcttgaact

SEQ ID NO: 137031 - DNA, 25 bp, Rattus norvegicus
agcttacttgctatttctcctgtta

SEQ ID NO: 137032 - DNA, 25 bp, Rattus norvegicus
agcttacttgctttttctcctgtta

SEQ ID NO: 137033 - DNA, 25 bp, Rattus norvegicus
agcttagaacttatgtctctgtgga

SEQ ID NO: 137034 - DNA, 25 bp, Rattus norvegicus
agcttagaacttttgtctctgtgga

SEQ ID NO: 137035 - DNA, 25 bp, Rattus norvegicus
agcttagagagcacttatcatagag

SEQ ID NO: 137036 - DNA, 25 bp, Rattus norvegicus
agcttagagagctcttatcatagag

SEQ ID NO: 137037 - DNA, 25 bp, Rattus norvegicus
agcttagcactcagccgcggataat

SEQ ID NO: 137038 - DNA, 25 bp, Rattus norvegicus
agcttagcactctgccgcggataat

SEQ ID NO: 137039 - DNA, 25 bp, Rattus norvegicus
agcttagctcacatactggatgttg

SEQ ID NO: 137040 - DNA, 25 bp, Rattus norvegicus
agcttagctcacttactggatgttg

SEQ ID NO: 137041 - DNA, 25 bp, Rattus norvegicus
agcttagctgtgatttttgaccttc

SEQ ID NO: 137042 - DNA, 25 bp, Rattus norvegicus
agcttagctgtgttttttgaccttc

SEQ ID NO: 137043 - DNA, 25 bp, Rattus norvegicus
agcttagcttgtattctggtgctgt

SEQ ID NO: 137044 - DNA, 25 bp, Rattus norvegicus
agcttagcttgttttctggtgctgt

SEQ ID NO: 137045 - DNA, 25 bp, Rattus norvegicus
agcttagctttactcaccgtatctg

SEQ ID NO: 137046 - DNA, 25 bp, Rattus norvegicus
agcttagctttagtcaccgtatctg

SEQ ID NO: 137047 - DNA, 25 bp, Rattus norvegicus
agcttaggcctcagtgtatccacag

SEQ ID NO: 137048 - DNA, 25 bp, Rattus norvegicus
agcttaggcctctgtgtatccacag

SEQ ID NO: 137049 - DNA, 25 bp, Rattus norvegicus
agcttaggctgtcttgatgtctcct

SEQ ID NO: 137050 - DNA, 25 bp, Rattus norvegicus
agcttaggctgtgttgatgtctcct

SEQ ID NO: 137051 - DNA, 25 bp, Rattus norvegicus
agcttagggccaattcatgggctct

SEQ ID NO: 137052 - DNA, 25 bp, Rattus norvegicus
agcttagggccatttcatgggctct

SEQ ID NO: 137053 - DNA, 25 bp, Rattus norvegicus
agcttaggtcctagactgtcacaga

SEQ ID NO: 137054 - DNA, 25 bp, Rattus norvegicus
agcttaggtcctatttcaggctcat

SEQ ID NO: 137055 - DNA, 25 bp, Rattus norvegicus
agcttaggtccttgactgtcacaga

SEQ ID NO: 137056 - DNA, 25 bp, Rattus norvegicus
agcttaggtcctttttcaggctcat

SEQ ID NO: 137057 - DNA, 25 bp, Rattus norvegicus
agcttagtggtgagtcagaccccga

SEQ ID NO: 137058 - DNA, 25 bp, Rattus norvegicus
agcttagtggtgtgtcagaccccga

SEQ ID NO: 137059 - DNA, 25 bp, Rattus norvegicus
agcttagtgtggagctcttgcctag

SEQ ID NO: 137060 - DNA, 25 bp, Rattus norvegicus
agcttagtgtggtgctcttgcctag

SEQ ID NO: 137061 - DNA, 25 bp, Rattus norvegicus
agcttagttcacatatgctagcagg

SEQ ID NO: 137062 - DNA, 25 bp, Rattus norvegicus
agcttagttcacttatgctagcagg

SEQ ID NO: 137063 - DNA, 25 bp, Rattus norvegicus
agcttataccatactctacttacat

SEQ ID NO: 137064 - DNA, 25 bp, Rattus norvegicus
agcttataccattctctacttacat

SEQ ID NO: 137065 - DNA, 25 bp, Rattus norvegicus
agcttatagctgatgtcactttgta

SEQ ID NO: 137066 - DNA, 25 bp, Rattus norvegicus
agcttatagctgttgtcactttgta

SEQ ID NO: 137067 - DNA, 25 bp, Rattus norvegicus
agcttatccatacccctatcagtga

SEQ ID NO: 137068 - DNA, 25 bp, Rattus norvegicus
agcttatccatagccctatcagtga

SEQ ID NO: 137069 - DNA, 25 bp, Rattus norvegicus
agcttatccctgaaacacatgtgcc

SEQ ID NO: 137070 - DNA, 25 bp, Rattus norvegicus
agcttatccctgtaacacatgtgcc

SEQ ID NO: 137071 - DNA, 25 bp, Rattus norvegicus
agcttatctattaagttcctcaggg

SEQ ID NO: 137072 - DNA, 25 bp, Rattus norvegicus
agcttatctatttagttcctcaggg

SEQ ID NO: 137073 - DNA, 25 bp, Rattus norvegicus
agcttatgaagcaggactgtgcatg

SEQ ID NO: 137074 - DNA, 25 bp, Rattus norvegicus
agcttatgaagctggactgtgcatg

SEQ ID NO: 137075 - DNA, 25 bp, Rattus norvegicus
agcttatgtcttctaattgcccaaa

SEQ ID NO: 137076 - DNA, 25 bp, Rattus norvegicus
agcttatgtcttgtaattgcccaaa

SEQ ID NO: 137077 - DNA, 25 bp, Rattus norvegicus
agcttatgtgagacctgacaggctt

SEQ ID NO: 137078 - DNA, 25 bp, Rattus norvegicus
agcttatgtgagtcctgacaggctt

SEQ ID NO: 137079 - DNA, 25 bp, Rattus norvegicus
agcttatgttctccatactctgctc

SEQ ID NO: 137080 - DNA, 25 bp, Rattus norvegicus
agcttatgttctgcatactctgctc

SEQ ID NO: 137081 - DNA, 25 bp, Rattus norvegicus
agcttattaattatccttctcctct

SEQ ID NO: 137082 - DNA, 25 bp, Rattus norvegicus
agcttattaattttccttctcctct

SEQ ID NO: 137083 - DNA, 25 bp, Rattus norvegicus
agcttattatacacaaccacacgga

SEQ ID NO: 137084 - DNA, 25 bp, Rattus norvegicus
agcttattatactcaaccacacgga

SEQ ID NO: 137085 - DNA, 25 bp, Rattus norvegicus
agcttattattcatgagtgaccaca

SEQ ID NO: 137086 - DNA, 25 bp, Rattus norvegicus
agcttattattcttgagtgaccaca

SEQ ID NO: 137087 - DNA, 25 bp, Rattus norvegicus
agcttatttcatcatctgggtctct

SEQ ID NO: 137088 - DNA, 25 bp, Rattus norvegicus
agcttatttcatgatctgggtctct

SEQ ID NO: 137089 - DNA, 25 bp, Rattus norvegicus
agcttatttctaaactcgagttctt

SEQ ID NO: 137090 - DNA, 25 bp, Rattus norvegicus
agcttatttctatactcgagttctt

SEQ ID NO: 137091 - DNA, 25 bp, Rattus norvegicus
agcttatttgtactttccacctcga

SEQ ID NO: 137092 - DNA, 25 bp, Rattus norvegicus
agcttatttgtagtttccacctcga

SEQ ID NO: 137093 - DNA, 25 bp, Rattus norvegicus
agcttattttctcttgtctctgtaa

SEQ ID NO: 137094 - DNA, 25 bp, Rattus norvegicus
agcttattttctgttgtctctgtaa

SEQ ID NO: 137095 - DNA, 25 bp, Rattus norvegicus
agcttcaaaggaaggctccaggtta

SEQ ID NO: 137096 - DNA, 25 bp, Rattus norvegicus
agcttcaaaggatggctccaggtta

SEQ ID NO: 137097 - DNA, 25 bp, Rattus norvegicus
agcttcaacaatctatcatcctgga

SEQ ID NO: 137098 - DNA, 25 bp, Rattus norvegicus
agcttcaacaatgtatcatcctgga

SEQ ID NO: 137099 - DNA, 25 bp, Rattus norvegicus
agcttcaacagtaggctcaggttag

SEQ ID NO: 137100 - DNA, 25 bp, Rattus norvegicus
agcttcaacagttggctcaggttag

SEQ ID NO: 137101 - DNA, 25 bp, Rattus norvegicus
agcttcaacatcatactattctcaa

SEQ ID NO: 137102 - DNA, 25 bp, Rattus norvegicus
agcttcaacatcttactattctcaa

SEQ ID NO: 137103 - DNA, 25 bp, Rattus norvegicus
agcttcaagacactccctggacatc

SEQ ID NO: 137104 - DNA, 25 bp, Rattus norvegicus
agcttcaagacagtccctggacatc

SEQ ID NO: 137105 - DNA, 25 bp, Rattus norvegicus
agcttcaagatgcacgcctggcaga

SEQ ID NO: 137106 - DNA, 25 bp, Rattus norvegicus
agcttcaagatggacgcctggcaga

SEQ ID NO: 137107 - DNA, 25 bp, Rattus norvegicus
agcttcaagttgagcctgggtgatt

SEQ ID NO: 137108 - DNA, 25 bp, Rattus norvegicus
agcttcaagttgtgcctgggtgatt

SEQ ID NO: 137109 - DNA, 25 bp, Rattus norvegicus
agcttcacatagaggctcagtccgg

SEQ ID NO: 137110 - DNA, 25 bp, Rattus norvegicus
agcttcacatagtggctcagtccgg

SEQ ID NO: 137111 - DNA, 25 bp, Rattus norvegicus
agcttcaccagaatctgaggctctg

SEQ ID NO: 137112 - DNA, 25 bp, Rattus norvegicus
agcttcaccagattctgaggctctg

SEQ ID NO: 137113 - DNA, 25 bp, Rattus norvegicus
agcttcaccattaacctgggccagg

SEQ ID NO: 137114 - DNA, 25 bp, Rattus norvegicus
agcttcaccatttacctgggccagg

SEQ ID NO: 137115 - DNA, 25 bp, Rattus norvegicus
agcttcacccggctttggattgctt

SEQ ID NO: 137116 - DNA, 25 bp, Rattus norvegicus
agcttcacccgggtttggattgctt

SEQ ID NO: 137117 - DNA, 25 bp, Rattus norvegicus
agcttcaccgtgcaaggagtctatg

SEQ ID NO: 137118 - DNA, 25 bp, Rattus norvegicus
agcttcaccgtggaaggagtctatg

SEQ ID NO: 137119 - DNA, 25 bp, Rattus norvegicus
agcttcacctgtacaatgacgagca

SEQ ID NO: 137120 - DNA, 25 bp, Rattus norvegicus
agcttcacctgttcaatgacgagca

SEQ ID NO: 137121 - DNA, 25 bp, Rattus norvegicus
agcttcacctttatcctgcggttga

SEQ ID NO: 137122 - DNA, 25 bp, Rattus norvegicus
agcttcacctttttcctgcggttga

SEQ ID NO: 137123 - DNA, 25 bp, Rattus norvegicus
agcttcactaggcacatttttgggt

SEQ ID NO: 137124 - DNA, 25 bp, Rattus norvegicus
agcttcactagggacatttttgggt

SEQ ID NO: 137125 - DNA, 25 bp, Rattus norvegicus
agcttcactgacagtggctgagcag

SEQ ID NO: 137126 - DNA, 25 bp, Rattus norvegicus
agcttcactgactgtggctgagcag

SEQ ID NO: 137127 - DNA, 25 bp, Rattus norvegicus
agcttcagaatcagaggatgacttc

SEQ ID NO: 137128 - DNA, 25 bp, Rattus norvegicus
agcttcagaatctgaggatgacttc

SEQ ID NO: 137129 - DNA, 25 bp, Rattus norvegicus
agcttcagagtcattagccccggaa

SEQ ID NO: 137130 - DNA, 25 bp, Rattus norvegicus
agcttcagagtctttagccccggaa

SEQ ID NO: 137131 - DNA, 25 bp, Rattus norvegicus
agcttcagatctcaggactcagggc

SEQ ID NO: 137132 - DNA, 25 bp, Rattus norvegicus
agcttcagatctgaggactcagggc

SEQ ID NO: 137133 - DNA, 25 bp, Rattus norvegicus
agcttcagcagcagaatcagcgtct

SEQ ID NO: 137134 - DNA, 25 bp, Rattus norvegicus
agcttcagcagccagttcttggagg

SEQ ID NO: 137135 - DNA, 25 bp, Rattus norvegicus
agcttcagcagcgagttcttggagg

SEQ ID NO: 137136 - DNA, 25 bp, Rattus norvegicus
agcttcagcagctgaatcagcgtct

SEQ ID NO: 137137 - DNA, 25 bp, Rattus norvegicus
agcttcagccttactccacagtgag

SEQ ID NO: 137138 - DNA, 25 bp, Rattus norvegicus
agcttcagcctttctccacagtgag

SEQ ID NO: 137139 - DNA, 25 bp, Rattus norvegicus
agcttcagctctcttgaaacctatg

SEQ ID NO: 137140 - DNA, 25 bp, Rattus norvegicus
agcttcagctctgttgaaacctatg

SEQ ID NO: 137141 - DNA, 25 bp, Rattus norvegicus
agcttcaggcaaagccaggcttcta

SEQ ID NO: 137142 - DNA, 25 bp, Rattus norvegicus
agcttcaggcaatgccaggcttcta

SEQ ID NO: 137143 - DNA, 25 bp, Rattus norvegicus
agcttcaggctgaggtactgcgctt

SEQ ID NO: 137144 - DNA, 25 bp, Rattus norvegicus
agcttcaggctgtggtactgcgctt

SEQ ID NO: 137145 - DNA, 25 bp, Rattus norvegicus
agcttcaggtgtatgctgacgtcca

SEQ ID NO: 137146 - DNA, 25 bp, Rattus norvegicus
agcttcaggtgtttgctgacgtcca

SEQ ID NO: 137147 - DNA, 25 bp, Rattus norvegicus
agcttcagtcacatcaccttgtggg

SEQ ID NO: 137148 - DNA, 25 bp, Rattus norvegicus
agcttcagtcacttcaccttgtggg

SEQ ID NO: 137149 - DNA, 25 bp, Rattus norvegicus
agcttcagtgacaggcatgccgtta

SEQ ID NO: 137150 - DNA, 25 bp, Rattus norvegicus
agcttcagtgactggcatgccgtta

SEQ ID NO: 137151 - DNA, 25 bp, Rattus norvegicus
agcttcagtgctcggcatttctcac

SEQ ID NO: 137152 - DNA, 25 bp, Rattus norvegicus
agcttcagtgctgggcatttctcac

SEQ ID NO: 137153 - DNA, 25 bp, Rattus norvegicus
agcttcataagcagctgcgactgca

SEQ ID NO: 137154 - DNA, 25 bp, Rattus norvegicus
agcttcataagctgctgcgactgca

SEQ ID NO: 137155 - DNA, 25 bp, Rattus norvegicus
agcttcataggaccattgtgccacc

SEQ ID NO: 137156 - DNA, 25 bp, Rattus norvegicus
agcttcataggagcattgtgccacc

SEQ ID NO: 137157 - DNA, 25 bp, Rattus norvegicus
agcttcatcatgaccagaagcttga

SEQ ID NO: 137158 - DNA, 25 bp, Rattus norvegicus
agcttcatcatgtccagaagcttga

SEQ ID NO: 137159 - DNA, 25 bp, Rattus norvegicus
agcttcatccttattgttcacactg

SEQ ID NO: 137160 - DNA, 25 bp, Rattus norvegicus
agcttcatcctttttgttcacactg

SEQ ID NO: 137161 - DNA, 25 bp, Rattus norvegicus
agcttcatgagtacggagcccctgt

SEQ ID NO: 137162 - DNA, 25 bp, Rattus norvegicus
agcttcatgagttcggagcccctgt

SEQ ID NO: 137163 - DNA, 25 bp, Rattus norvegicus
agcttcatggtccacccagtatata

SEQ ID NO: 137164 - DNA, 25 bp, Rattus norvegicus
agcttcatggtcgacccagtatata

SEQ ID NO: 137165 - DNA, 25 bp, Rattus norvegicus
agcttcatgtctcactctgcttgct

SEQ ID NO: 137166 - DNA, 25 bp, Rattus norvegicus
agcttcatgtctgactctgcttgct

SEQ ID NO: 137167 - DNA, 25 bp, Rattus norvegicus
agcttcattaagcagatcctggatg

SEQ ID NO: 137168 - DNA, 25 bp, Rattus norvegicus
agcttcattaaggagatcctggatg

SEQ ID NO: 137169 - DNA, 25 bp, Rattus norvegicus
agcttcattcatactgacatggccg

SEQ ID NO: 137170 - DNA, 25 bp, Rattus norvegicus
agcttcattcattctgacatggccg

SEQ ID NO: 137171 - DNA, 25 bp, Rattus norvegicus
agcttcattcttcgcatccatggtc

SEQ ID NO: 137172 - DNA, 25 bp, Rattus norvegicus
agcttcattcttcgctcatgttgaa

SEQ ID NO: 137173 - DNA, 25 bp, Rattus norvegicus
agcttcattcttggcatccatggtc

SEQ ID NO: 137174 - DNA, 25 bp, Rattus norvegicus
agcttcattcttggctcatgttgaa

SEQ ID NO: 137175 - DNA, 25 bp, Rattus norvegicus
agcttcattgctcagtggataggga

SEQ ID NO: 137176 - DNA, 25 bp, Rattus norvegicus
agcttcattgctgagtggataggga

SEQ ID NO: 137177 - DNA, 25 bp, Rattus norvegicus
agcttccaaatgctcgggttataag

SEQ ID NO: 137178 - DNA, 25 bp, Rattus norvegicus
agcttccaaatggtcgggttataag

SEQ ID NO: 137179 - DNA, 25 bp, Rattus norvegicus
agcttccaaggcatttgtgtgcaca

SEQ ID NO: 137180 - DNA, 25 bp, Rattus norvegicus
agcttccaaggcttttgtgtgcaca

SEQ ID NO: 137181 - DNA, 25 bp, Rattus norvegicus
agcttccaagttaagcgtcaccttg

SEQ ID NO: 137182 - DNA, 25 bp, Rattus norvegicus
agcttccaagtttagcgtcaccttg

SEQ ID NO: 137183 - DNA, 25 bp, Rattus norvegicus
agcttccacagaagggtcctatcaa

SEQ ID NO: 137184 - DNA, 25 bp, Rattus norvegicus
agcttccacagatgggtcctatcaa

SEQ ID NO: 137185 - DNA, 25 bp, Rattus norvegicus
agcttccactgcactgttgacatgg

SEQ ID NO: 137186 - DNA, 25 bp, Rattus norvegicus
agcttccactgcagaactactgtag

SEQ ID NO: 137187 - DNA, 25 bp, Rattus norvegicus
agcttccactgctctgttgacatgg

SEQ ID NO: 137188 - DNA, 25 bp, Rattus norvegicus
agcttccactgctgaactactgtag

SEQ ID NO: 137189 - DNA, 25 bp, Rattus norvegicus
agcttccagggacgaccagtgccta

SEQ ID NO: 137190 - DNA, 25 bp, Rattus norvegicus
agcttccagggaggaccagtgccta

SEQ ID NO: 137191 - DNA, 25 bp, Rattus norvegicus
agcttccagttcattctttgttgca

SEQ ID NO: 137192 - DNA, 25 bp, Rattus norvegicus
agcttccagttctttctttgttgca

SEQ ID NO: 137193 - DNA, 25 bp, Rattus norvegicus
agcttccatgttcctaactcagata

SEQ ID NO: 137194 - DNA, 25 bp, Rattus norvegicus
agcttccatgttgctaactcagata

SEQ ID NO: 137195 - DNA, 25 bp, Rattus norvegicus
agcttccattgtccaaatcctgacc

SEQ ID NO: 137196 - DNA, 25 bp, Rattus norvegicus
agcttccattgtgcaaatcctgacc

SEQ ID NO: 137197 - DNA, 25 bp, Rattus norvegicus
agcttcccacttcaggtcaaggcta

SEQ ID NO: 137198 - DNA, 25 bp, Rattus norvegicus
agcttcccacttgaggtcaaggcta

SEQ ID NO: 137199 - DNA, 25 bp, Rattus norvegicus
agcttcccagacagaaccacttgaa

SEQ ID NO: 137200 - DNA, 25 bp, Rattus norvegicus
agcttcccagactgaaccacttgaa

SEQ ID NO: 137201 - DNA, 25 bp, Rattus norvegicus
agcttcccagccctggattccaaag

SEQ ID NO: 137202 - DNA, 25 bp, Rattus norvegicus
agcttcccagccgtggattccaaag

SEQ ID NO: 137203 - DNA, 25 bp, Rattus norvegicus
agcttcccagtcagctcatattgga

SEQ ID NO: 137204 - DNA, 25 bp, Rattus norvegicus
agcttcccagtctgctcatattgga

SEQ ID NO: 137205 - DNA, 25 bp, Rattus norvegicus
agcttcccatctctgctccgaggtg

SEQ ID NO: 137206 - DNA, 25 bp, Rattus norvegicus
agcttcccatctgtgctccgaggtg

SEQ ID NO: 137207 - DNA, 25 bp, Rattus norvegicus
agcttccccatcacatagggagtag

SEQ ID NO: 137208 - DNA, 25 bp, Rattus norvegicus
agcttccccatctcatagggagtag

SEQ ID NO: 137209 - DNA, 25 bp, Rattus norvegicus
agcttcccctgaccttacgtttttg

SEQ ID NO: 137210 - DNA, 25 bp, Rattus norvegicus
agcttcccctgagcttacgtttttg

SEQ ID NO: 137211 - DNA, 25 bp, Rattus norvegicus
agcttccctatcaccgaagagtgga

SEQ ID NO: 137212 - DNA, 25 bp, Rattus norvegicus
agcttccctatctccgaagagtgga

SEQ ID NO: 137213 - DNA, 25 bp, Rattus norvegicus
agcttccctcgaagttggttgatga

SEQ ID NO: 137214 - DNA, 25 bp, Rattus norvegicus
agcttccctcgatgttggttgatga

SEQ ID NO: 137215 - DNA, 25 bp, Rattus norvegicus
agcttccctgaacgttcttgatgag

SEQ ID NO: 137216 - DNA, 25 bp, Rattus norvegicus
agcttccctgaaggttcttgatgag

SEQ ID NO: 137217 - DNA, 25 bp, Rattus norvegicus
agcttccctggccagtttggtttgg

SEQ ID NO: 137218 - DNA, 25 bp, Rattus norvegicus
agcttccctggcgagtttggtttgg

SEQ ID NO: 137219 - DNA, 25 bp, Rattus norvegicus
agcttccgacacctgtgggacagtc

SEQ ID NO: 137220 - DNA, 25 bp, Rattus norvegicus
agcttccgacacgtgtgggacagtc

SEQ ID NO: 137221 - DNA, 25 bp, Rattus norvegicus
agcttccgatctactcttcaaagtt

SEQ ID NO: 137222 - DNA, 25 bp, Rattus norvegicus
agcttccgatcttctcttcaaagtt

SEQ ID NO: 137223 - DNA, 25 bp, Rattus norvegicus
agcttccggaagagaccaactctgt

SEQ ID NO: 137224 - DNA, 25 bp, Rattus norvegicus
agcttccggaagtgaccaactctgt

SEQ ID NO: 137225 - DNA, 25 bp, Rattus norvegicus
agcttccggcttcagtctcacagga

SEQ ID NO: 137226 - DNA, 25 bp, Rattus norvegicus
agcttccggcttgagtctcacagga

SEQ ID NO: 137227 - DNA, 25 bp, Rattus norvegicus
agcttccgtgaaaccaacagttttt

SEQ ID NO: 137228 - DNA, 25 bp, Rattus norvegicus
agcttccgtgaatccaacagttttt

SEQ ID NO: 137229 - DNA, 25 bp, Rattus norvegicus
agcttccgtgcgaaatctcatcatc

SEQ ID NO: 137230 - DNA, 25 bp, Rattus norvegicus
agcttccgtgcgtaatctcatcatc

SEQ ID NO: 137231 - DNA, 25 bp, Rattus norvegicus
agcttcctcatcacgagatcaggat

SEQ ID NO: 137232 - DNA, 25 bp, Rattus norvegicus
agcttcctcatcctgagtcggacgt

SEQ ID NO: 137233 - DNA, 25 bp, Rattus norvegicus
agcttcctcatcgtgagtcggacgt

SEQ ID NO: 137234 - DNA, 25 bp, Rattus norvegicus
agcttcctcatctcgagatcaggat

SEQ ID NO: 137235 - DNA, 25 bp, Rattus norvegicus
agcttcctccacagatggtcaaatt

SEQ ID NO: 137236 - DNA, 25 bp, Rattus norvegicus
agcttcctccactgatggtcaaatt

SEQ ID NO: 137237 - DNA, 25 bp, Rattus norvegicus
agcttcctcctgacagcatttagag

SEQ ID NO: 137238 - DNA, 25 bp, Rattus norvegicus
agcttcctcctgtcagcatttagag

SEQ ID NO: 137239 - DNA, 25 bp, Rattus norvegicus
agcttcctcgacagacaggttcttg

SEQ ID NO: 137240 - DNA, 25 bp, Rattus norvegicus
agcttcctcgactgacaggttcttg

SEQ ID NO: 137241 - DNA, 25 bp, Rattus norvegicus
agcttcctctctacattttcttggc

SEQ ID NO: 137242 - DNA, 25 bp, Rattus norvegicus
agcttcctctcttcattttcttggc

SEQ ID NO: 137243 - DNA, 25 bp, Rattus norvegicus
agcttcctctgaccagagtttcctg

SEQ ID NO: 137244 - DNA, 25 bp, Rattus norvegicus
agcttcctctgagcagagtttcctg

SEQ ID NO: 137245 - DNA, 25 bp, Rattus norvegicus
agcttcctctttaaggcaccacttg

SEQ ID NO: 137246 - DNA, 25 bp, Rattus norvegicus
agcttcctcttttaggcaccacttg

SEQ ID NO: 137247 - DNA, 25 bp, Rattus norvegicus
agcttcctgacacactcggaccaag

SEQ ID NO: 137248 - DNA, 25 bp, Rattus norvegicus
agcttcctgacagactcggaccaag

SEQ ID NO: 137249 - DNA, 25 bp, Rattus norvegicus
agcttcctgatgactcgaatttcac

SEQ ID NO: 137250 - DNA, 25 bp, Rattus norvegicus
agcttcctgatgtctcgaatttcac

SEQ ID NO: 137251 - DNA, 25 bp, Rattus norvegicus
agcttcctgattcgtgtcaccattg

SEQ ID NO: 137252 - DNA, 25 bp, Rattus norvegicus
agcttcctgattggtgtcaccattg

SEQ ID NO: 137253 - DNA, 25 bp, Rattus norvegicus
agcttcctgcagaagtggatccagt

SEQ ID NO: 137254 - DNA, 25 bp, Rattus norvegicus
agcttcctgcagtagtggatccagt

SEQ ID NO: 137255 - DNA, 25 bp, Rattus norvegicus
agcttcctgcgcagaggagacggac

SEQ ID NO: 137256 - DNA, 25 bp, Rattus norvegicus
agcttcctgcgctgaggagacggac

SEQ ID NO: 137257 - DNA, 25 bp, Rattus norvegicus
agcttcctggacacttggtcagaaa

SEQ ID NO: 137258 - DNA, 25 bp, Rattus norvegicus
agcttcctggactcttggtcagaaa

SEQ ID NO: 137259 - DNA, 25 bp, Rattus norvegicus
agcttcctggctctgtcctttaaag

SEQ ID NO: 137260 - DNA, 25 bp, Rattus norvegicus
agcttcctggctgtgtcctttaaag

SEQ ID NO: 137261 - DNA, 25 bp, Rattus norvegicus
agcttcctgtgccttatttaactgt

SEQ ID NO: 137262 - DNA, 25 bp, Rattus norvegicus
agcttcctgtgcgttatttaactgt

SEQ ID NO: 137263 - DNA, 25 bp, Rattus norvegicus
agcttcctgttgactcagtgcaaaa

SEQ ID NO: 137264 - DNA, 25 bp, Rattus norvegicus
agcttcctgttgtctcagtgcaaaa

SEQ ID NO: 137265 - DNA, 25 bp, Rattus norvegicus
agcttccttcagacttgtcctagaa

SEQ ID NO: 137266 - DNA, 25 bp, Rattus norvegicus
agcttccttcagtcttgtcctagaa

SEQ ID NO: 137267 - DNA, 25 bp, Rattus norvegicus
agcttccttcggcttgcagcagtat

SEQ ID NO: 137268 - DNA, 25 bp, Rattus norvegicus
agcttccttcgggttgcagcagtat

SEQ ID NO: 137269 - DNA, 25 bp, Rattus norvegicus
agcttccttctaccactgtattttt

SEQ ID NO: 137270 - DNA, 25 bp, Rattus norvegicus
agcttccttctagcactgtattttt

SEQ ID NO: 137271 - DNA, 25 bp, Rattus norvegicus
agcttccttgctctgcagtcctctt

SEQ ID NO: 137272 - DNA, 25 bp, Rattus norvegicus
agcttccttgctgtgcagtcctctt

SEQ ID NO: 137273 - DNA, 25 bp, Rattus norvegicus
agcttccttgtgcacttctattaaa

SEQ ID NO: 137274 - DNA, 25 bp, Rattus norvegicus
agcttccttgtggacttctattaaa

SEQ ID NO: 137275 - DNA, 25 bp, Rattus norvegicus
agcttccttgttattgacctgctcc

SEQ ID NO: 137276 - DNA, 25 bp, Rattus norvegicus
agcttccttgtttttgacctgctcc

SEQ ID NO: 137277 - DNA, 25 bp, Rattus norvegicus
agcttcctttgcatcagtttctatg

SEQ ID NO: 137278 - DNA, 25 bp, Rattus norvegicus
agcttcctttgcttcagtttctatg

SEQ ID NO: 137279 - DNA, 25 bp, Rattus norvegicus
agcttcctttggcacgtcagttgac

SEQ ID NO: 137280 - DNA, 25 bp, Rattus norvegicus
agcttcctttgggacgtcagttgac

SEQ ID NO: 137281 - DNA, 25 bp, Rattus norvegicus
agcttcgaaaagaacagcgagttca

SEQ ID NO: 137282 - DNA, 25 bp, Rattus norvegicus
agcttcgaaaagtacagcgagttca

SEQ ID NO: 137283 - DNA, 25 bp, Rattus norvegicus
agcttcgaaagtaactaagtgacca

SEQ ID NO: 137284 - DNA, 25 bp, Rattus norvegicus
agcttcgaaagttactaagtgacca

SEQ ID NO: 137285 - DNA, 25 bp, Rattus norvegicus
agcttcgaagctacatcttggcatg

SEQ ID NO: 137286 - DNA, 25 bp, Rattus norvegicus
agcttcgaagcttcatcttggcatg

SEQ ID NO: 137287 - DNA, 25 bp, Rattus norvegicus
agcttcgatactcttctcactttat

SEQ ID NO: 137288 - DNA, 25 bp, Rattus norvegicus
agcttcgatactgttctcactttat

SEQ ID NO: 137289 - DNA, 25 bp, Rattus norvegicus
agcttcgcccagatggttcagaggt

SEQ ID NO: 137290 - DNA, 25 bp, Rattus norvegicus
agcttcgcccagttggttcagaggt

SEQ ID NO: 137291 - DNA, 25 bp, Rattus norvegicus
agcttcgccggcactataagtacac

SEQ ID NO: 137292 - DNA, 25 bp, Rattus norvegicus
agcttcgccggctctataagtacac

SEQ ID NO: 137293 - DNA, 25 bp, Rattus norvegicus
agcttcgcggttatggaaaatttca

SEQ ID NO: 137294 - DNA, 25 bp, Rattus norvegicus
agcttcgcggttttggaaaatttca

SEQ ID NO: 137295 - DNA, 25 bp, Rattus norvegicus
agcttcggagtcaggagtcccgcgc

SEQ ID NO: 137296 - DNA, 25 bp, Rattus norvegicus
agcttcggagtctggagtcccgcgc

SEQ ID NO: 137297 - DNA, 25 bp, Rattus norvegicus
agcttcggcatcctttttcatttga

SEQ ID NO: 137298 - DNA, 25 bp, Rattus norvegicus
agcttcggcatcgtttttcatttga

SEQ ID NO: 137299 - DNA, 25 bp, Rattus norvegicus
agcttcggcgctctgaggaaaccat

SEQ ID NO: 137300 - DNA, 25 bp, Rattus norvegicus
agcttcggcgctgtgaggaaaccat

SEQ ID NO: 137301 - DNA, 25 bp, Rattus norvegicus
agcttcggctggctcagtcagacat

SEQ ID NO: 137302 - DNA, 25 bp, Rattus norvegicus
agcttcggctgggtcagtcagacat

SEQ ID NO: 137303 - DNA, 25 bp, Rattus norvegicus
agcttcgggccgagtgagcatcctg

SEQ ID NO: 137304 - DNA, 25 bp, Rattus norvegicus
agcttcgggccgtgtgagcatcctg

SEQ ID NO: 137305 - DNA, 25 bp, Rattus norvegicus
agcttcgggcgaaggcccgggagca

SEQ ID NO: 137306 - DNA, 25 bp, Rattus norvegicus
agcttcgggcgatggcccgggagca

SEQ ID NO: 137307 - DNA, 25 bp, Rattus norvegicus
agcttcggtgatattgcttctccgt

SEQ ID NO: 137308 - DNA, 25 bp, Rattus norvegicus
agcttcggtgattttgcttctccgt

SEQ ID NO: 137309 - DNA, 25 bp, Rattus norvegicus
agcttcgtcgccagtgtccaggaat

SEQ ID NO: 137310 - DNA, 25 bp, Rattus norvegicus
agcttcgtcgcctgtgtccaggaat

SEQ ID NO: 137311 - DNA, 25 bp, Rattus norvegicus
agcttcgtctggcttctatgctcac

SEQ ID NO: 137312 - DNA, 25 bp, Rattus norvegicus
agcttcgtctgggttctatgctcac

SEQ ID NO: 137313 - DNA, 25 bp, Rattus norvegicus
agcttcgtgccacgaacttgcttcc

SEQ ID NO: 137314 - DNA, 25 bp, Rattus norvegicus
agcttcgtgccaggaacttgcttcc

SEQ ID NO: 137315 - DNA, 25 bp, Rattus norvegicus
agcttcgttctacagacggcggcag

SEQ ID NO: 137316 - DNA, 25 bp, Rattus norvegicus
agcttcgttctagagacggcggcag

SEQ ID NO: 137317 - DNA, 25 bp, Rattus norvegicus
agcttctaaatcacagtaggctttg

SEQ ID NO: 137318 - DNA, 25 bp, Rattus norvegicus
agcttctaaatctcagtaggctttg

SEQ ID NO: 137319 - DNA, 25 bp, Rattus norvegicus
agcttctacagccttgaccagagaa

SEQ ID NO: 137320 - DNA, 25 bp, Rattus norvegicus
agcttctacagcgttgaccagagaa

SEQ ID NO: 137321 - DNA, 25 bp, Rattus norvegicus
agcttctaccagcaccgacaggagt

SEQ ID NO: 137322 - DNA, 25 bp, Rattus norvegicus
agcttctaccaggaccgacaggagt

SEQ ID NO: 137323 - DNA, 25 bp, Rattus norvegicus
agcttctaccggcaacttgcaaaca

SEQ ID NO: 137324 - DNA, 25 bp, Rattus norvegicus
agcttctaccgggaacttgcaaaca

SEQ ID NO: 137325 - DNA, 25 bp, Rattus norvegicus
agcttctacctaataggccgccgcg

SEQ ID NO: 137326 - DNA, 25 bp, Rattus norvegicus
agcttctacctattaggccgccgcg

SEQ ID NO: 137327 - DNA, 25 bp, Rattus norvegicus
agcttctagcacattgatatcccaa

SEQ ID NO: 137328 - DNA, 25 bp, Rattus norvegicus
agcttctagcactttgatatcccaa

SEQ ID NO: 137329 - DNA, 25 bp, Rattus norvegicus
agcttctagcctaggagcgcaagtt

SEQ ID NO: 137330 - DNA, 25 bp, Rattus norvegicus
agcttctagccttggagcgcaagtt

SEQ ID NO: 137331 - DNA, 25 bp, Rattus norvegicus
agcttctagggcagtgctaggcaca

SEQ ID NO: 137332 - DNA, 25 bp, Rattus norvegicus
agcttctagggctgtgctaggcaca

SEQ ID NO: 137333 - DNA, 25 bp, Rattus norvegicus
agcttctatcgtcaacgagctgatc

SEQ ID NO: 137334 - DNA, 25 bp, Rattus norvegicus
agcttctatcgtgaacgagctgatc

SEQ ID NO: 137335 - DNA, 25 bp, Rattus norvegicus
agcttctatgtcacccttcaattag

SEQ ID NO: 137336 - DNA, 25 bp, Rattus norvegicus
agcttctatgtctcccttcaattag

SEQ ID NO: 137337 - DNA, 25 bp, Rattus norvegicus
agcttctcaacaaggaccctgctga

SEQ ID NO: 137338 - DNA, 25 bp, Rattus norvegicus
agcttctcaacatggaccctgctga

SEQ ID NO: 137339 - DNA, 25 bp, Rattus norvegicus
agcttctcaagtacattgctcggaa

SEQ ID NO: 137340 - DNA, 25 bp, Rattus norvegicus
agcttctcaagttcattgctcggaa

SEQ ID NO: 137341 - DNA, 25 bp, Rattus norvegicus
agcttctcacaccagcctttgggtt

SEQ ID NO: 137342 - DNA, 25 bp, Rattus norvegicus
agcttctcacacgagcctttgggtt

SEQ ID NO: 137343 - DNA, 25 bp, Rattus norvegicus
agcttctcagctatcaggtcagaca

SEQ ID NO: 137344 - DNA, 25 bp, Rattus norvegicus
agcttctcagctttcaggtcagaca

SEQ ID NO: 137345 - DNA, 25 bp, Rattus norvegicus
agcttctcatggacctggttgtaga

SEQ ID NO: 137346 - DNA, 25 bp, Rattus norvegicus
agcttctcatggtcctggttgtaga

SEQ ID NO: 137347 - DNA, 25 bp, Rattus norvegicus
agcttctccaacagacaaatgaaat

SEQ ID NO: 137348 - DNA, 25 bp, Rattus norvegicus
agcttctccaactgacaaatgaaat

SEQ ID NO: 137349 - DNA, 25 bp, Rattus norvegicus
agcttctccaggattgtgattccat

SEQ ID NO: 137350 - DNA, 25 bp, Rattus norvegicus
agcttctccaggtttgtgattccat

SEQ ID NO: 137351 - DNA, 25 bp, Rattus norvegicus
agcttctccatgagttcatgcctga

SEQ ID NO: 137352 - DNA, 25 bp, Rattus norvegicus
agcttctccatgtgttcatgcctga

SEQ ID NO: 137353 - DNA, 25 bp, Rattus norvegicus
agcttctccccgacaggaaattgtg

SEQ ID NO: 137354 - DNA, 25 bp, Rattus norvegicus
agcttctccccgtcaggaaattgtg

SEQ ID NO: 137355 - DNA, 25 bp, Rattus norvegicus
agcttctccgcacgtgctgctgggt

SEQ ID NO: 137356 - DNA, 25 bp, Rattus norvegicus
agcttctccgcaggtgctgctgggt

SEQ ID NO: 137357 - DNA, 25 bp, Rattus norvegicus
agcttctccttgaaacacaactgca

SEQ ID NO: 137358 - DNA, 25 bp, Rattus norvegicus
agcttctccttgtaacacaactgca

SEQ ID NO: 137359 - DNA, 25 bp, Rattus norvegicus
agcttctctcttcccatgtttatta

SEQ ID NO: 137360 - DNA, 25 bp, Rattus norvegicus
agcttctctcttgccatgtttatta

SEQ ID NO: 137361 - DNA, 25 bp, Rattus norvegicus
agcttctctgtgatgtcatctttaa

SEQ ID NO: 137362 - DNA, 25 bp, Rattus norvegicus
agcttctctgtgttgtcatctttaa

SEQ ID NO: 137363 - DNA, 25 bp, Rattus norvegicus
agcttctcttctatgcagtattgtc

SEQ ID NO: 137364 - DNA, 25 bp, Rattus norvegicus
agcttctcttctttgcagtattgtc

SEQ ID NO: 137365 - DNA, 25 bp, Rattus norvegicus
agcttctctttaaggccccgatgat

SEQ ID NO: 137366 - DNA, 25 bp, Rattus norvegicus
agcttctctttatggccccgatgat

SEQ ID NO: 137367 - DNA, 25 bp, Rattus norvegicus
agcttctctttcaacagcagacagc

SEQ ID NO: 137368 - DNA, 25 bp, Rattus norvegicus
agcttctctttctacagcagacagc

SEQ ID NO: 137369 - DNA, 25 bp, Rattus norvegicus
agcttctgaagtctgccaatctctg

SEQ ID NO: 137370 - DNA, 25 bp, Rattus norvegicus
agcttctgaagtgtgccaatctctg

SEQ ID NO: 137371 - DNA, 25 bp, Rattus norvegicus
agcttctgaatgagacctgccgtag

SEQ ID NO: 137372 - DNA, 25 bp, Rattus norvegicus
agcttctgaatgtgacctgccgtag

SEQ ID NO: 137373 - DNA, 25 bp, Rattus norvegicus
agcttctgaccacgtttactttatc

SEQ ID NO: 137374 - DNA, 25 bp, Rattus norvegicus
agcttctgaccaggtttactttatc

SEQ ID NO: 137375 - DNA, 25 bp, Rattus norvegicus
agcttctgagaaacgcaacttgagt

SEQ ID NO: 137376 - DNA, 25 bp, Rattus norvegicus
agcttctgagaatcgcaacttgagt

SEQ ID NO: 137377 - DNA, 25 bp, Rattus norvegicus
agcttctgagtgacctgccgagagc

SEQ ID NO: 137378 - DNA, 25 bp, Rattus norvegicus
agcttctgagtgtcctgccgagagc

SEQ ID NO: 137379 - DNA, 25 bp, Rattus norvegicus
agcttctgattgaatgtgactgtga

SEQ ID NO: 137380 - DNA, 25 bp, Rattus norvegicus
agcttctgattgtatgtgactgtga

SEQ ID NO: 137381 - DNA, 25 bp, Rattus norvegicus
agcttctgcatcagggactgttttc

SEQ ID NO: 137382 - DNA, 25 bp, Rattus norvegicus
agcttctgcatctgggactgttttc

SEQ ID NO: 137383 - DNA, 25 bp, Rattus norvegicus
agcttctgcatgcacctagggcgta

SEQ ID NO: 137384 - DNA, 25 bp, Rattus norvegicus
agcttctgcatggacctagggcgta

SEQ ID NO: 137385 - DNA, 25 bp, Rattus norvegicus
agcttctgcattcgccgtgttaatc

SEQ ID NO: 137386 - DNA, 25 bp, Rattus norvegicus
agcttctgcattggccgtgttaatc

SEQ ID NO: 137387 - DNA, 25 bp, Rattus norvegicus
agcttctgccccaactggaaagtct

SEQ ID NO: 137388 - DNA, 25 bp, Rattus norvegicus
agcttctgcccctactggaaagtct

SEQ ID NO: 137389 - DNA, 25 bp, Rattus norvegicus
agcttctgcctcactcactgaggtg

SEQ ID NO: 137390 - DNA, 25 bp, Rattus norvegicus
agcttctgcctctctcactgaggtg

SEQ ID NO: 137391 - DNA, 25 bp, Rattus norvegicus
agcttctgctgcctggagaggccac

SEQ ID NO: 137392 - DNA, 25 bp, Rattus norvegicus
agcttctgctgcgtggagaggccac

SEQ ID NO: 137393 - DNA, 25 bp, Rattus norvegicus
agcttctgcttaagtgtggactgag

SEQ ID NO: 137394 - DNA, 25 bp, Rattus norvegicus
agcttctgcttatgtgtggactgag

SEQ ID NO: 137395 - DNA, 25 bp, Rattus norvegicus
agcttctgcttcagtgtcatccaga

SEQ ID NO: 137396 - DNA, 25 bp, Rattus norvegicus
agcttctgcttctgtgtcatccaga

SEQ ID NO: 137397 - DNA, 25 bp, Rattus norvegicus
agcttctggaatacatacttttgca

SEQ ID NO: 137398 - DNA, 25 bp, Rattus norvegicus
agcttctggaattcatacttttgca

SEQ ID NO: 137399 - DNA, 25 bp, Rattus norvegicus
agcttctggactccatgcatgaggt

SEQ ID NO: 137400 - DNA, 25 bp, Rattus norvegicus
agcttctggactgcatgcatgaggt

SEQ ID NO: 137401 - DNA, 25 bp, Rattus norvegicus
agcttctggatcaagatgcctctca

SEQ ID NO: 137402 - DNA, 25 bp, Rattus norvegicus
agcttctggatcaccagctgatgca

SEQ ID NO: 137403 - DNA, 25 bp, Rattus norvegicus
agcttctggatctagatgcctctca

SEQ ID NO: 137404 - DNA, 25 bp, Rattus norvegicus
agcttctggatctccagctgatgca

SEQ ID NO: 137405 - DNA, 25 bp, Rattus norvegicus
agcttctgggccctcagtaggagta

SEQ ID NO: 137406 - DNA, 25 bp, Rattus norvegicus
agcttctgggccgtcagtaggagta

SEQ ID NO: 137407 - DNA, 25 bp, Rattus norvegicus
agcttctggttacagacaaaatggg

SEQ ID NO: 137408 - DNA, 25 bp, Rattus norvegicus
agcttctggttagagacaaaatggg

SEQ ID NO: 137409 - DNA, 25 bp, Rattus norvegicus
agcttctgtcacatagctgtggtcc

SEQ ID NO: 137410 - DNA, 25 bp, Rattus norvegicus
agcttctgtcacttagctgtggtcc

SEQ ID NO: 137411 - DNA, 25 bp, Rattus norvegicus
agcttctgtcgtcctcttggagaga

SEQ ID NO: 137412 - DNA, 25 bp, Rattus norvegicus
agcttctgtcgtgctcttggagaga

SEQ ID NO: 137413 - DNA, 25 bp, Rattus norvegicus
agcttctgtgagacacctcgtggga

SEQ ID NO: 137414 - DNA, 25 bp, Rattus norvegicus
agcttctgtgagtcacctcgtggga

SEQ ID NO: 137415 - DNA, 25 bp, Rattus norvegicus
agcttctgttatctgttgttccaca

SEQ ID NO: 137416 - DNA, 25 bp, Rattus norvegicus
agcttctgttatgtgttgttccaca

SEQ ID NO: 137417 - DNA, 25 bp, Rattus norvegicus
agcttctgttggctgtgaccagttc

SEQ ID NO: 137418 - DNA, 25 bp, Rattus norvegicus
agcttctgttgggtgtgaccagttc

SEQ ID NO: 137419 - DNA, 25 bp, Rattus norvegicus
agcttcttaagtacttgggacgaca

SEQ ID NO: 137420 - DNA, 25 bp, Rattus norvegicus
agcttcttaagttcttgggacgaca

SEQ ID NO: 137421 - DNA, 25 bp, Rattus norvegicus
agcttcttcaccatcagtcataact

SEQ ID NO: 137422 - DNA, 25 bp, Rattus norvegicus
agcttcttcaccttcagtcataact

SEQ ID NO: 137423 - DNA, 25 bp, Rattus norvegicus
agcttcttcattaattggctcccat

SEQ ID NO: 137424 - DNA, 25 bp, Rattus norvegicus
agcttcttcatttattggctcccat

SEQ ID NO: 137425 - DNA, 25 bp, Rattus norvegicus
agcttcttctgtcttgtggcagcat

SEQ ID NO: 137426 - DNA, 25 bp, Rattus norvegicus
agcttcttctgtgttgtggcagcat

SEQ ID NO: 137427 - DNA, 25 bp, Rattus norvegicus
agcttcttcttgacacacactggac

SEQ ID NO: 137428 - DNA, 25 bp, Rattus norvegicus
agcttcttcttgtcacacactggac

SEQ ID NO: 137429 - DNA, 25 bp, Rattus norvegicus
agcttcttgcataactgctcttcag

SEQ ID NO: 137430 - DNA, 25 bp, Rattus norvegicus
agcttcttgcattactgctcttcag

SEQ ID NO: 137431 - DNA, 25 bp, Rattus norvegicus
agcttcttgggcaattctgaggcag

SEQ ID NO: 137432 - DNA, 25 bp, Rattus norvegicus
agcttcttgggctattctgaggcag

SEQ ID NO: 137433 - DNA, 25 bp, Rattus norvegicus
agcttcttggttacaaccactattt

SEQ ID NO: 137434 - DNA, 25 bp, Rattus norvegicus
agcttcttggtttcaaccactattt

SEQ ID NO: 137435 - DNA, 25 bp, Rattus norvegicus
agcttctttttcctgcagttacaaa

SEQ ID NO: 137436 - DNA, 25 bp, Rattus norvegicus
agcttctttttcgtgcagttacaaa

SEQ ID NO: 137437 - DNA, 25 bp, Rattus norvegicus
agcttgaaggtcaacttgtctcggc

SEQ ID NO: 137438 - DNA, 25 bp, Rattus norvegicus
agcttgaaggtctacttgtctcggc

SEQ ID NO: 137439 - DNA, 25 bp, Rattus norvegicus
agcttgaatgttatattcccatcat

SEQ ID NO: 137440 - DNA, 25 bp, Rattus norvegicus
agcttgaatgttttattcccatcat

SEQ ID NO: 137441 - DNA, 25 bp, Rattus norvegicus
agcttgactaagcagtgctggcaat

SEQ ID NO: 137442 - DNA, 25 bp, Rattus norvegicus
agcttgactaaggagtgctggcaat

SEQ ID NO: 137443 - DNA, 25 bp, Rattus norvegicus
agcttgacttcccttctatgaagtt

SEQ ID NO: 137444 - DNA, 25 bp, Rattus norvegicus
agcttgacttccgttctatgaagtt

SEQ ID NO: 137445 - DNA, 25 bp, Rattus norvegicus
agcttgagaatgctctgtcctgttg

SEQ ID NO: 137446 - DNA, 25 bp, Rattus norvegicus
agcttgagaatggtctgtcctgttg

SEQ ID NO: 137447 - DNA, 25 bp, Rattus norvegicus
agcttgagatacatgaaactgtgtc

SEQ ID NO: 137448 - DNA, 25 bp, Rattus norvegicus
agcttgagatacttgaaactgtgtc

SEQ ID NO: 137449 - DNA, 25 bp, Rattus norvegicus
agcttgagatctcgtgcttttacaa

SEQ ID NO: 137450 - DNA, 25 bp, Rattus norvegicus
agcttgagatctggtgcttttacaa

SEQ ID NO: 137451 - DNA, 25 bp, Rattus norvegicus
agcttgagctcaattctggatacat

SEQ ID NO: 137452 - DNA, 25 bp, Rattus norvegicus
agcttgagctcatttctggatacat

SEQ ID NO: 137453 - DNA, 25 bp, Rattus norvegicus
agcttgagcttaatggactctgcca

SEQ ID NO: 137454 - DNA, 25 bp, Rattus norvegicus
agcttgagcttattggactctgcca

SEQ ID NO: 137455 - DNA, 25 bp, Rattus norvegicus
agcttgagggacagggcccagcttt

SEQ ID NO: 137456 - DNA, 25 bp, Rattus norvegicus
agcttgagggactgggcccagcttt

SEQ ID NO: 137457 - DNA, 25 bp, Rattus norvegicus
agcttgagtagccattgtccacaaa

SEQ ID NO: 137458 - DNA, 25 bp, Rattus norvegicus
agcttgagtagcgattgtccacaaa

SEQ ID NO: 137459 - DNA, 25 bp, Rattus norvegicus
agcttgagtccccatgcagtcatgt

SEQ ID NO: 137460 - DNA, 25 bp, Rattus norvegicus
agcttgagtcccgatgcagtcatgt

SEQ ID NO: 137461 - DNA, 25 bp, Rattus norvegicus
agcttgagttgcacacttactgtcc

SEQ ID NO: 137462 - DNA, 25 bp, Rattus norvegicus
agcttgagttgctcacttactgtcc

SEQ ID NO: 137463 - DNA, 25 bp, Rattus norvegicus
agcttgatcagtattctaagtgcac

SEQ ID NO: 137464 - DNA, 25 bp, Rattus norvegicus
agcttgatcagttttctaagtgcac

SEQ ID NO: 137465 - DNA, 25 bp, Rattus norvegicus
agcttgatcctcatgcctggctcaa

SEQ ID NO: 137466 - DNA, 25 bp, Rattus norvegicus
agcttgatcctcttgcctggctcaa

SEQ ID NO: 137467 - DNA, 25 bp, Rattus norvegicus
agcttgatgaggaccgcagcctgct

SEQ ID NO: 137468 - DNA, 25 bp, Rattus norvegicus
agcttgatgaggtccgcagcctgct

SEQ ID NO: 137469 - DNA, 25 bp, Rattus norvegicus
agcttgatgatgcaggcctttgatc

SEQ ID NO: 137470 - DNA, 25 bp, Rattus norvegicus
agcttgatgatggaggcctttgatc

SEQ ID NO: 137471 - DNA, 25 bp, Rattus norvegicus
agcttgattttcatgtgagttccat

SEQ ID NO: 137472 - DNA, 25 bp, Rattus norvegicus
agcttgattttcttgtgagttccat

SEQ ID NO: 137473 - DNA, 25 bp, Rattus norvegicus
agcttgcaagaaccctggcacaggt

SEQ ID NO: 137474 - DNA, 25 bp, Rattus norvegicus
agcttgcaagaagcctggcacaggt

SEQ ID NO: 137475 - DNA, 25 bp, Rattus norvegicus
agcttgcacctacggccctacagga

SEQ ID NO: 137476 - DNA, 25 bp, Rattus norvegicus
agcttgcacctagggccctacagga

SEQ ID NO: 137477 - DNA, 25 bp, Rattus norvegicus
agcttgcactctcccaaacactaaa

SEQ ID NO: 137478 - DNA, 25 bp, Rattus norvegicus
agcttgcactctgccaaacactaaa

SEQ ID NO: 137479 - DNA, 25 bp, Rattus norvegicus
agcttgcaggctcgaggccagttct

SEQ ID NO: 137480 - DNA, 25 bp, Rattus norvegicus
agcttgcaggctggaggccagttct

SEQ ID NO: 137481 - DNA, 25 bp, Rattus norvegicus
agcttgccacgtaagccgatgaagt

SEQ ID NO: 137482 - DNA, 25 bp, Rattus norvegicus
agcttgccacgttagccgatgaagt

SEQ ID NO: 137483 - DNA, 25 bp, Rattus norvegicus
agcttgccacttagccagccagaag

SEQ ID NO: 137484 - DNA, 25 bp, Rattus norvegicus
agcttgccactttgccagccagaag

SEQ ID NO: 137485 - DNA, 25 bp, Rattus norvegicus
agcttgccagccacagaatacagaa

SEQ ID NO: 137486 - DNA, 25 bp, Rattus norvegicus
agcttgccagcctcagaatacagaa

SEQ ID NO: 137487 - DNA, 25 bp, Rattus norvegicus
agcttgccatttccgtgaagtttga

SEQ ID NO: 137488 - DNA, 25 bp, Rattus norvegicus
agcttgccatttgcgtgaagtttga

SEQ ID NO: 137489 - DNA, 25 bp, Rattus norvegicus
agcttgcccaataggagagccctct

SEQ ID NO: 137490 - DNA, 25 bp, Rattus norvegicus
agcttgcccaattggagagccctct

SEQ ID NO: 137491 - DNA, 25 bp, Rattus norvegicus
agcttgcccacaccatggatcctag

SEQ ID NO: 137492 - DNA, 25 bp, Rattus norvegicus
agcttgcccacactgtgtttggaat

SEQ ID NO: 137493 - DNA, 25 bp, Rattus norvegicus
agcttgcccacagcatggatcctag

SEQ ID NO: 137494 - DNA, 25 bp, Rattus norvegicus
agcttgcccacagtgtgtttggaat

SEQ ID NO: 137495 - DNA, 25 bp, Rattus norvegicus
agcttgcccactacaattttcagtt

SEQ ID NO: 137496 - DNA, 25 bp, Rattus norvegicus
agcttgcccactctcagagactgga

SEQ ID NO: 137497 - DNA, 25 bp, Rattus norvegicus
agcttgcccactgtcagagactgga

SEQ ID NO: 137498 - DNA, 25 bp, Rattus norvegicus
agcttgcccacttcaattttcagtt

SEQ ID NO: 137499 - DNA, 25 bp, Rattus norvegicus
agcttgccccaaaggtggctcagga

SEQ ID NO: 137500 - DNA, 25 bp, Rattus norvegicus
agcttgccccaatggtggctcagga

SEQ ID NO: 137501 - DNA, 25 bp, Rattus norvegicus
agcttgcccgagatctactacagac

SEQ ID NO: 137502 - DNA, 25 bp, Rattus norvegicus
agcttgcccgagttctactacagac

SEQ ID NO: 137503 - DNA, 25 bp, Rattus norvegicus
agcttgccctgaatctatttttctt

SEQ ID NO: 137504 - DNA, 25 bp, Rattus norvegicus
agcttgccctgattctatttttctt

SEQ ID NO: 137505 - DNA, 25 bp, Rattus norvegicus
agcttgcctactcactttcctgggc

SEQ ID NO: 137506 - DNA, 25 bp, Rattus norvegicus
agcttgcctactgactttcctgggc

SEQ ID NO: 137507 - DNA, 25 bp, Rattus norvegicus
agcttgcctagtatttcttacacac

SEQ ID NO: 137508 - DNA, 25 bp, Rattus norvegicus
agcttgcctagtttttcttacacac

SEQ ID NO: 137509 - DNA, 25 bp, Rattus norvegicus
agcttgcctggccttctctaaggta

SEQ ID NO: 137510 - DNA, 25 bp, Rattus norvegicus
agcttgcctggcgttctctaaggta

SEQ ID NO: 137511 - DNA, 25 bp, Rattus norvegicus
agcttgcctgtcacttcagctaatt

SEQ ID NO: 137512 - DNA, 25 bp, Rattus norvegicus
agcttgcctgtctcttcagctaatt

SEQ ID NO: 137513 - DNA, 25 bp, Rattus norvegicus
agcttgcctgtgatctgatttgtca

SEQ ID NO: 137514 - DNA, 25 bp, Rattus norvegicus
agcttgcctgtgttctgatttgtca

SEQ ID NO: 137515 - DNA, 25 bp, Rattus norvegicus
agcttgccttacacaaatttgtagg

SEQ ID NO: 137516 - DNA, 25 bp, Rattus norvegicus
agcttgccttactcaaatttgtagg

SEQ ID NO: 137517 - DNA, 25 bp, Rattus norvegicus
agcttgccttttcgtagactcattt

SEQ ID NO: 137518 - DNA, 25 bp, Rattus norvegicus
agcttgccttttggtagactcattt

SEQ ID NO: 137519 - DNA, 25 bp, Rattus norvegicus
agcttgcggaagcccctttgtaaag

SEQ ID NO: 137520 - DNA, 25 bp, Rattus norvegicus
agcttgcggaaggccctttgtaaag

SEQ ID NO: 137521 - DNA, 25 bp, Rattus norvegicus
agcttgcggcgtagcctagaatggt

SEQ ID NO: 137522 - DNA, 25 bp, Rattus norvegicus
agcttgcggcgttgcctagaatggt

SEQ ID NO: 137523 - DNA, 25 bp, Rattus norvegicus
agcttgctcagcagagagtctgcgt

SEQ ID NO: 137524 - DNA, 25 bp, Rattus norvegicus
agcttgctcagctgagagtctgcgt

SEQ ID NO: 137525 - DNA, 25 bp, Rattus norvegicus
agcttgctccatccacagtgggatt

SEQ ID NO: 137526 - DNA, 25 bp, Rattus norvegicus
agcttgctccatgcacagtgggatt

SEQ ID NO: 137527 - DNA, 25 bp, Rattus norvegicus
agcttgctctagattggcctcatgc

SEQ ID NO: 137528 - DNA, 25 bp, Rattus norvegicus
agcttgctctagtttggcctcatgc

SEQ ID NO: 137529 - DNA, 25 bp, Rattus norvegicus
agcttgctgacccagcttgggagaa

SEQ ID NO: 137530 - DNA, 25 bp, Rattus norvegicus
agcttgctgaccgagcttgggagaa

SEQ ID NO: 137531 - DNA, 25 bp, Rattus norvegicus
agcttgctgagcctcactgggactg

SEQ ID NO: 137532 - DNA, 25 bp, Rattus norvegicus
agcttgctgagcgtcactgggactg

SEQ ID NO: 137533 - DNA, 25 bp, Rattus norvegicus
agcttgctgcccagttcatgagtgg

SEQ ID NO: 137534 - DNA, 25 bp, Rattus norvegicus
agcttgctgccctgttcatgagtgg

SEQ ID NO: 137535 - DNA, 25 bp, Rattus norvegicus
agcttgctgcttcctttgtaggaca

SEQ ID NO: 137536 - DNA, 25 bp, Rattus norvegicus
agcttgctgcttgctttgtaggaca

SEQ ID NO: 137537 - DNA, 25 bp, Rattus norvegicus
agcttgctggctagtcttgtgaact

SEQ ID NO: 137538 - DNA, 25 bp, Rattus norvegicus
agcttgctggcttgtcttgtgaact

SEQ ID NO: 137539 - DNA, 25 bp, Rattus norvegicus
agcttgctgggtccctgtaattttg

SEQ ID NO: 137540 - DNA, 25 bp, Rattus norvegicus
agcttgctgggtctctgtgttatag

SEQ ID NO: 137541 - DNA, 25 bp, Rattus norvegicus
agcttgctgggtgcctgtaattttg

SEQ ID NO: 137542 - DNA, 25 bp, Rattus norvegicus
agcttgctgggtgtctgtgttatag

SEQ ID NO: 137543 - DNA, 25 bp, Rattus norvegicus
agcttgctgtctatcatggttttaa

SEQ ID NO: 137544 - DNA, 25 bp, Rattus norvegicus
agcttgctgtctttcatggttttaa

SEQ ID NO: 137545 - DNA, 25 bp, Rattus norvegicus
agcttgcttggcatgtacatggccc

SEQ ID NO: 137546 - DNA, 25 bp, Rattus norvegicus
agcttgcttggcttgtacatggccc

SEQ ID NO: 137547 - DNA, 25 bp, Rattus norvegicus
agcttgctttggctttggtcagcac

SEQ ID NO: 137548 - DNA, 25 bp, Rattus norvegicus
agcttgctttgggtttggtcagcac

SEQ ID NO: 137549 - DNA, 25 bp, Rattus norvegicus
agcttgctttttctataacccagga

SEQ ID NO: 137550 - DNA, 25 bp, Rattus norvegicus
agcttgctttttgtataacccagga

SEQ ID NO: 137551 - DNA, 25 bp, Rattus norvegicus
agcttggaccacaaactcgccgaag

SEQ ID NO: 137552 - DNA, 25 bp, Rattus norvegicus
agcttggaccactaactcgccgaag

SEQ ID NO: 137553 - DNA, 25 bp, Rattus norvegicus
agcttggactgcatagcgaggcctt

SEQ ID NO: 137554 - DNA, 25 bp, Rattus norvegicus
agcttggactgcttagcgaggcctt

SEQ ID NO: 137555 - DNA, 25 bp, Rattus norvegicus
agcttggagagcagccatctctgga

SEQ ID NO: 137556 - DNA, 25 bp, Rattus norvegicus
agcttggagagctgccatctctgga

SEQ ID NO: 137557 - DNA, 25 bp, Rattus norvegicus
agcttggagatcaacatctgggtct

SEQ ID NO: 137558 - DNA, 25 bp, Rattus norvegicus
agcttggagatctacatctgggtct

SEQ ID NO: 137559 - DNA, 25 bp, Rattus norvegicus
agcttggagctgaacctgacatttg

SEQ ID NO: 137560 - DNA, 25 bp, Rattus norvegicus
agcttggagctgtacctgacatttg

SEQ ID NO: 137561 - DNA, 25 bp, Rattus norvegicus
agcttggagcttccagcctggacag

SEQ ID NO: 137562 - DNA, 25 bp, Rattus norvegicus
agcttggagcttgcagcctggacag

SEQ ID NO: 137563 - DNA, 25 bp, Rattus norvegicus
agcttggattcgatgtggcctttaa

SEQ ID NO: 137564 - DNA, 25 bp, Rattus norvegicus
agcttggattcgttgtggcctttaa

SEQ ID NO: 137565 - DNA, 25 bp, Rattus norvegicus
agcttggattttactgcttccctca

SEQ ID NO: 137566 - DNA, 25 bp, Rattus norvegicus
agcttggatttttctgcttccctca

SEQ ID NO: 137567 - DNA, 25 bp, Rattus norvegicus
agcttggcagggagcaggccctctt

SEQ ID NO: 137568 - DNA, 25 bp, Rattus norvegicus
agcttggcagggtgcaggccctctt

SEQ ID NO: 137569 - DNA, 25 bp, Rattus norvegicus
agcttggccagcaaagccgagtttc

SEQ ID NO: 137570 - DNA, 25 bp, Rattus norvegicus
agcttggccagctaagccgagtttc

SEQ ID NO: 137571 - DNA, 25 bp, Rattus norvegicus
agcttggcccagatgagtcacgaga

SEQ ID NO: 137572 - DNA, 25 bp, Rattus norvegicus
agcttggcccagttgagtcacgaga

SEQ ID NO: 137573 - DNA, 25 bp, Rattus norvegicus
agcttggccctcataatggatgtac

SEQ ID NO: 137574 - DNA, 25 bp, Rattus norvegicus
agcttggccctcttaatggatgtac

SEQ ID NO: 137575 - DNA, 25 bp, Rattus norvegicus
agcttggccgtcagtaacactgcag

SEQ ID NO: 137576 - DNA, 25 bp, Rattus norvegicus
agcttggccgtctgtaacactgcag

SEQ ID NO: 137577 - DNA, 25 bp, Rattus norvegicus
agcttggcgagaatgttaccaccat

SEQ ID NO: 137578 - DNA, 25 bp, Rattus norvegicus
agcttggcgagattgttaccaccat

SEQ ID NO: 137579 - DNA, 25 bp, Rattus norvegicus
agcttggctaccaggtgctgagcga

SEQ ID NO: 137580 - DNA, 25 bp, Rattus norvegicus
agcttggctacctggtgctgagcga

SEQ ID NO: 137581 - DNA, 25 bp, Rattus norvegicus
agcttggctaggcactaagagatac

SEQ ID NO: 137582 - DNA, 25 bp, Rattus norvegicus
agcttggctagggactaagagatac

SEQ ID NO: 137583 - DNA, 25 bp, Rattus norvegicus
agcttggctatgctgtagaccctgg

SEQ ID NO: 137584 - DNA, 25 bp, Rattus norvegicus
agcttggctatggtgtagaccctgg

SEQ ID NO: 137585 - DNA, 25 bp, Rattus norvegicus
agcttggctcacacagggcagtcag

SEQ ID NO: 137586 - DNA, 25 bp, Rattus norvegicus
agcttggctcactcagggcagtcag

SEQ ID NO: 137587 - DNA, 25 bp, Rattus norvegicus
agcttggcttttcatcttggatcac

SEQ ID NO: 137588 - DNA, 25 bp, Rattus norvegicus
agcttggcttttgatcttggatcac

SEQ ID NO: 137589 - DNA, 25 bp, Rattus norvegicus
agcttgggagaaccattgcattctt

SEQ ID NO: 137590 - DNA, 25 bp, Rattus norvegicus
agcttgggagaagcattgcattctt

SEQ ID NO: 137591 - DNA, 25 bp, Rattus norvegicus
agcttgggagctactggcaatcttc

SEQ ID NO: 137592 - DNA, 25 bp, Rattus norvegicus
agcttgggagcttctggcaatcttc

SEQ ID NO: 137593 - DNA, 25 bp, Rattus norvegicus
agcttgggcactccaagcacagcca

SEQ ID NO: 137594 - DNA, 25 bp, Rattus norvegicus
agcttgggcactgcaagcacagcca

SEQ ID NO: 137595 - DNA, 25 bp, Rattus norvegicus
agcttgggctggacggtatttatta

SEQ ID NO: 137596 - DNA, 25 bp, Rattus norvegicus
agcttgggctggtcggtatttatta

SEQ ID NO: 137597 - DNA, 25 bp, Rattus norvegicus
agcttgggtcttcactttgaggcca

SEQ ID NO: 137598 - DNA, 25 bp, Rattus norvegicus
agcttgggtcttgactttgaggcca

SEQ ID NO: 137599 - DNA, 25 bp, Rattus norvegicus
agcttgggttatactgacacttgca

SEQ ID NO: 137600 - DNA, 25 bp, Rattus norvegicus
agcttgggttattctgacacttgca

SEQ ID NO: 137601 - DNA, 25 bp, Rattus norvegicus
agcttgggtttgacaaggcagccat

SEQ ID NO: 137602 - DNA, 25 bp, Rattus norvegicus
agcttgggtttgtcaaggcagccat

SEQ ID NO: 137603 - DNA, 25 bp, Rattus norvegicus
agcttggtacttccctgagtttcaa

SEQ ID NO: 137604 - DNA, 25 bp, Rattus norvegicus
agcttggtacttgcctgagtttcaa

SEQ ID NO: 137605 - DNA, 25 bp, Rattus norvegicus
agcttggtcactaggacactccttg

SEQ ID NO: 137606 - DNA, 25 bp, Rattus norvegicus
agcttggtcacttggacactccttg

SEQ ID NO: 137607 - DNA, 25 bp, Rattus norvegicus
agcttggtcagcagactggagtagc

SEQ ID NO: 137608 - DNA, 25 bp, Rattus norvegicus
agcttggtcagctgactggagtagc

SEQ ID NO: 137609 - DNA, 25 bp, Rattus norvegicus
agcttggtcgcaatgccactgagag

SEQ ID NO: 137610 - DNA, 25 bp, Rattus norvegicus
agcttggtcgcattgccactgagag

SEQ ID NO: 137611 - DNA, 25 bp, Rattus norvegicus
agcttggtctatatctcaagttcca

SEQ ID NO: 137612 - DNA, 25 bp, Rattus norvegicus
agcttggtctatttctcaagttcca

SEQ ID NO: 137613 - DNA, 25 bp, Rattus norvegicus
agcttggtctcacctctacggagag

SEQ ID NO: 137614 - DNA, 25 bp, Rattus norvegicus
agcttggtctcagctctacggagag

SEQ ID NO: 137615 - DNA, 25 bp, Rattus norvegicus
agcttggtctccctagtgagtttca

SEQ ID NO: 137616 - DNA, 25 bp, Rattus norvegicus
agcttggtctccgtagtgagtttca

SEQ ID NO: 137617 - DNA, 25 bp, Rattus norvegicus
agcttggtcttactcagttgctcat

SEQ ID NO: 137618 - DNA, 25 bp, Rattus norvegicus
agcttggtcttagtcagttgctcat

SEQ ID NO: 137619 - DNA, 25 bp, Rattus norvegicus
agcttggtcttcctgtgtgacctaa

SEQ ID NO: 137620 - DNA, 25 bp, Rattus norvegicus
agcttggtcttcgtgtgtgacctaa

SEQ ID NO: 137621 - DNA, 25 bp, Rattus norvegicus
agcttggtgagcagttcttttatac

SEQ ID NO: 137622 - DNA, 25 bp, Rattus norvegicus
agcttggtgagctgttcttttatac

SEQ ID NO: 137623 - DNA, 25 bp, Rattus norvegicus
agcttggtgcaaaatgtcctctcaa

SEQ ID NO: 137624 - DNA, 25 bp, Rattus norvegicus
agcttggtgcaatatgtcctctcaa

SEQ ID NO: 137625 - DNA, 25 bp, Rattus norvegicus
agcttggtggtacacccagtgcccc

SEQ ID NO: 137626 - DNA, 25 bp, Rattus norvegicus
agcttggtggtagacccagtgcccc

SEQ ID NO: 137627 - DNA, 25 bp, Rattus norvegicus
agcttggtgtcacgcctggtgacat

SEQ ID NO: 137628 - DNA, 25 bp, Rattus norvegicus
agcttggtgtcaggcctggtgacat

SEQ ID NO: 137629 - DNA, 25 bp, Rattus norvegicus
agcttggttaccaggctgcctcaga

SEQ ID NO: 137630 - DNA, 25 bp, Rattus norvegicus
agcttggttacctggctgcctcaga

SEQ ID NO: 137631 - DNA, 25 bp, Rattus norvegicus
agcttggttctcagacagggtctcc

SEQ ID NO: 137632 - DNA, 25 bp, Rattus norvegicus
agcttggttctctgacagggtctcc

SEQ ID NO: 137633 - DNA, 25 bp, Rattus norvegicus
agcttggtttccattagggccatct

SEQ ID NO: 137634 - DNA, 25 bp, Rattus norvegicus
agcttggtttcctttagggccatct

SEQ ID NO: 137635 - DNA, 25 bp, Rattus norvegicus
agcttgtaactgacctctattgtca

SEQ ID NO: 137636 - DNA, 25 bp, Rattus norvegicus
agcttgtaactgtcctctattgtca

SEQ ID NO: 137637 - DNA, 25 bp, Rattus norvegicus
agcttgtactggagcgggtccctgc

SEQ ID NO: 137638 - DNA, 25 bp, Rattus norvegicus
agcttgtactggtgcgggtccctgc

SEQ ID NO: 137639 - DNA, 25 bp, Rattus norvegicus
agcttgtagctgcaacgatatgtta

SEQ ID NO: 137640 - DNA, 25 bp, Rattus norvegicus
agcttgtagctggaacgatatgtta

SEQ ID NO: 137641 - DNA, 25 bp, Rattus norvegicus
agcttgtagtccctgtctgactgcc

SEQ ID NO: 137642 - DNA, 25 bp, Rattus norvegicus
agcttgtagtccgtgtctgactgcc

SEQ ID NO: 137643 - DNA, 25 bp, Rattus norvegicus
agcttgtattcacccactgggaggt

SEQ ID NO: 137644 - DNA, 25 bp, Rattus norvegicus
agcttgtattcagccactgggaggt

SEQ ID NO: 137645 - DNA, 25 bp, Rattus norvegicus
agcttgtcaacaattctgtcctgag

SEQ ID NO: 137646 - DNA, 25 bp, Rattus norvegicus
agcttgtcaacatttctgtcctgag

SEQ ID NO: 137647 - DNA, 25 bp, Rattus norvegicus
agcttgtcacacaccagcttcaggc

SEQ ID NO: 137648 - DNA, 25 bp, Rattus norvegicus
agcttgtcacactccagcttcaggc

SEQ ID NO: 137649 - DNA, 25 bp, Rattus norvegicus
agcttgtcacagatggcaggtcacc

SEQ ID NO: 137650 - DNA, 25 bp, Rattus norvegicus
agcttgtcacagttggcaggtcacc

SEQ ID NO: 137651 - DNA, 25 bp, Rattus norvegicus
agcttgtcagggatgccgtcataga

SEQ ID NO: 137652 - DNA, 25 bp, Rattus norvegicus
agcttgtcagggttgccgtcataga

SEQ ID NO: 137653 - DNA, 25 bp, Rattus norvegicus
agcttgtccaacagtgtcccaagga

SEQ ID NO: 137654 - DNA, 25 bp, Rattus norvegicus
agcttgtccaactgtgtcccaagga

SEQ ID NO: 137655 - DNA, 25 bp, Rattus norvegicus
agcttgtccaccagctcctggaagg

SEQ ID NO: 137656 - DNA, 25 bp, Rattus norvegicus
agcttgtccaccatgaaacgcagtt

SEQ ID NO: 137657 - DNA, 25 bp, Rattus norvegicus
agcttgtccacctgctcctggaagg

SEQ ID NO: 137658 - DNA, 25 bp, Rattus norvegicus
agcttgtccaccttgaaacgcagtt

SEQ ID NO: 137659 - DNA, 25 bp, Rattus norvegicus
agcttgtcccagaattacggcgtgt

SEQ ID NO: 137660 - DNA, 25 bp, Rattus norvegicus
agcttgtcccagtattacggcgtgt

SEQ ID NO: 137661 - DNA, 25 bp, Rattus norvegicus
agcttgtccctgaaggctgcgaaga

SEQ ID NO: 137662 - DNA, 25 bp, Rattus norvegicus
agcttgtccctgtaggctgcgaaga

SEQ ID NO: 137663 - DNA, 25 bp, Rattus norvegicus
agcttgtccggaagattgcaaatac

SEQ ID NO: 137664 - DNA, 25 bp, Rattus norvegicus
agcttgtccggatgattgcaaatac

SEQ ID NO: 137665 - DNA, 25 bp, Rattus norvegicus
agcttgtcgctgaggatctgttcat

SEQ ID NO: 137666 - DNA, 25 bp, Rattus norvegicus
agcttgtcgctgtggatctgttcat

SEQ ID NO: 137667 - DNA, 25 bp, Rattus norvegicus
agcttgtcgtttagctggcatacca

SEQ ID NO: 137668 - DNA, 25 bp, Rattus norvegicus
agcttgtcgttttgctggcatacca

SEQ ID NO: 137669 - DNA, 25 bp, Rattus norvegicus
agcttgtctgttctttgcttcagca

SEQ ID NO: 137670 - DNA, 25 bp, Rattus norvegicus
agcttgtctgttgtttgcttcagca

SEQ ID NO: 137671 - DNA, 25 bp, Rattus norvegicus
agcttgtcttgtaaggtcctgccag

SEQ ID NO: 137672 - DNA, 25 bp, Rattus norvegicus
agcttgtcttgttaggtcctgccag

SEQ ID NO: 137673 - DNA, 25 bp, Rattus norvegicus
agcttgtctttcattaacttctgcc

SEQ ID NO: 137674 - DNA, 25 bp, Rattus norvegicus
agcttgtctttctttaacttctgcc

SEQ ID NO: 137675 - DNA, 25 bp, Rattus norvegicus
agcttgtgacataggacaccccact

SEQ ID NO: 137676 - DNA, 25 bp, Rattus norvegicus
agcttgtgacattggacaccccact

SEQ ID NO: 137677 - DNA, 25 bp, Rattus norvegicus
agcttgtgattgctagcctcccaga

SEQ ID NO: 137678 - DNA, 25 bp, Rattus norvegicus
agcttgtgattggtagcctcccaga

SEQ ID NO: 137679 - DNA, 25 bp, Rattus norvegicus
agcttgtgatttaacctctctgtgc

SEQ ID NO: 137680 - DNA, 25 bp, Rattus norvegicus
agcttgtgattttacctctctgtgc

SEQ ID NO: 137681 - DNA, 25 bp, Rattus norvegicus
agcttgtgccttcctgccaggacag

SEQ ID NO: 137682 - DNA, 25 bp, Rattus norvegicus
agcttgtgccttgctgccaggacag

SEQ ID NO: 137683 - DNA, 25 bp, Rattus norvegicus
agcttgtgcttcatccagtcctggc

SEQ ID NO: 137684 - DNA, 25 bp, Rattus norvegicus
agcttgtgcttcttccagtcctggc

SEQ ID NO: 137685 - DNA, 25 bp, Rattus norvegicus
agcttgtggtagaggacttctctgc

SEQ ID NO: 137686 - DNA, 25 bp, Rattus norvegicus
agcttgtggtagtggacttctctgc

SEQ ID NO: 137687 - DNA, 25 bp, Rattus norvegicus
agcttgtgtgtccttaactgtctgc

SEQ ID NO: 137688 - DNA, 25 bp, Rattus norvegicus
agcttgtgtgtcgttaactgtctgc

SEQ ID NO: 137689 - DNA, 25 bp, Rattus norvegicus
agcttgtgtttaactccctggagac

SEQ ID NO: 137690 - DNA, 25 bp, Rattus norvegicus
agcttgtgtttatctccctggagac

SEQ ID NO: 137691 - DNA, 25 bp, Rattus norvegicus
agcttgttacctcttgttgctgtaa

SEQ ID NO: 137692 - DNA, 25 bp, Rattus norvegicus
agcttgttacctgttgttgctgtaa

SEQ ID NO: 137693 - DNA, 25 bp, Rattus norvegicus
agcttgttagccagttcacagtcgt

SEQ ID NO: 137694 - DNA, 25 bp, Rattus norvegicus
agcttgttagcctgttcacagtcgt

SEQ ID NO: 137695 - DNA, 25 bp, Rattus norvegicus
agcttgtttagcagagccactctcg

SEQ ID NO: 137696 - DNA, 25 bp, Rattus norvegicus
agcttgtttagctgagccactctcg

SEQ ID NO: 137697 - DNA, 25 bp, Rattus norvegicus
agcttgtttctgagctggagacaga

SEQ ID NO: 137698 - DNA, 25 bp, Rattus norvegicus
agcttgtttctgtgctggagacaga

SEQ ID NO: 137699 - DNA, 25 bp, Rattus norvegicus
agcttgttttacagcctttaattgg

SEQ ID NO: 137700 - DNA, 25 bp, Rattus norvegicus
agcttgttttactgcctttaattgg

SEQ ID NO: 137701 - DNA, 25 bp, Rattus norvegicus
agctttaacatcagaggccaaaaaa

SEQ ID NO: 137702 - DNA, 25 bp, Rattus norvegicus
agctttaacatctgaggccaaaaaa

SEQ ID NO: 137703 - DNA, 25 bp, Rattus norvegicus
agctttaatagcactttcactgtaa

SEQ ID NO: 137704 - DNA, 25 bp, Rattus norvegicus
agctttaatagctctttcactgtaa

SEQ ID NO: 137705 - DNA, 25 bp, Rattus norvegicus
agctttaccatgctcagggttcagt

SEQ ID NO: 137706 - DNA, 25 bp, Rattus norvegicus
agctttaccatggtcagggttcagt

SEQ ID NO: 137707 - DNA, 25 bp, Rattus norvegicus
agctttacccagagatcttccagga

SEQ ID NO: 137708 - DNA, 25 bp, Rattus norvegicus
agctttacccagtgatcttccagga

SEQ ID NO: 137709 - DNA, 25 bp, Rattus norvegicus
agctttaccccgaattctgaggttg

SEQ ID NO: 137710 - DNA, 25 bp, Rattus norvegicus
agctttaccccgtattctgaggttg

SEQ ID NO: 137711 - DNA, 25 bp, Rattus norvegicus
agctttacctgactagcggactaac

SEQ ID NO: 137712 - DNA, 25 bp, Rattus norvegicus
agctttacctgagtagcggactaac

SEQ ID NO: 137713 - DNA, 25 bp, Rattus norvegicus
agctttactctgaatttcttgtcag

SEQ ID NO: 137714 - DNA, 25 bp, Rattus norvegicus
agctttactctgtatttcttgtcag

SEQ ID NO: 137715 - DNA, 25 bp, Rattus norvegicus
agctttactggtatctggtgatcaa

SEQ ID NO: 137716 - DNA, 25 bp, Rattus norvegicus
agctttactggtttctggtgatcaa

SEQ ID NO: 137717 - DNA, 25 bp, Rattus norvegicus
agctttagccgtcggaagtcctctt

SEQ ID NO: 137718 - DNA, 25 bp, Rattus norvegicus
agctttagccgtgggaagtcctctt

SEQ ID NO: 137719 - DNA, 25 bp, Rattus norvegicus
agctttagccttatattgacctgtt

SEQ ID NO: 137720 - DNA, 25 bp, Rattus norvegicus
agctttagccttttattgacctgtt

SEQ ID NO: 137721 - DNA, 25 bp, Rattus norvegicus
agctttagggtcacaatagtgtcac

SEQ ID NO: 137722 - DNA, 25 bp, Rattus norvegicus
agctttagggtctcaatagtgtcac

SEQ ID NO: 137723 - DNA, 25 bp, Rattus norvegicus
agctttaggtccaatttcaggcaca

SEQ ID NO: 137724 - DNA, 25 bp, Rattus norvegicus
agctttaggtcctatttcaggcaca

SEQ ID NO: 137725 - DNA, 25 bp, Rattus norvegicus
agctttagtcttcaatcaggttctt

SEQ ID NO: 137726 - DNA, 25 bp, Rattus norvegicus
agctttagtcttgaatcaggttctt

SEQ ID NO: 137727 - DNA, 25 bp, Rattus norvegicus
agctttagtgccatagtctgtgccc

SEQ ID NO: 137728 - DNA, 25 bp, Rattus norvegicus
agctttagtgccttagtctgtgccc

SEQ ID NO: 137729 - DNA, 25 bp, Rattus norvegicus
agctttagtttcacaacatttcaga

SEQ ID NO: 137730 - DNA, 25 bp, Rattus norvegicus
agctttagtttctcaacatttcaga

SEQ ID NO: 137731 - DNA, 25 bp, Rattus norvegicus
agctttatactaaccagaggtctca

SEQ ID NO: 137732 - DNA, 25 bp, Rattus norvegicus
agctttatactacctgctcagggat

SEQ ID NO: 137733 - DNA, 25 bp, Rattus norvegicus
agctttatactagctgctcagggat

SEQ ID NO: 137734 - DNA, 25 bp, Rattus norvegicus
agctttatactatccagaggtctca

SEQ ID NO: 137735 - DNA, 25 bp, Rattus norvegicus
agctttatgagcagtgatggatact

SEQ ID NO: 137736 - DNA, 25 bp, Rattus norvegicus
agctttatgagctgtgatggatact

SEQ ID NO: 137737 - DNA, 25 bp, Rattus norvegicus
agctttatgcccatttaatccttat

SEQ ID NO: 137738 - DNA, 25 bp, Rattus norvegicus
agctttatgcccttttaatccttat

SEQ ID NO: 137739 - DNA, 25 bp, Rattus norvegicus
agctttatgcttatgcctgtttgaa

SEQ ID NO: 137740 - DNA, 25 bp, Rattus norvegicus
agctttatgcttttgcctgtttgaa

SEQ ID NO: 137741 - DNA, 25 bp, Rattus norvegicus
agctttatggacagaaccaccacca

SEQ ID NO: 137742 - DNA, 25 bp, Rattus norvegicus
agctttatggactgaaccaccacca

SEQ ID NO: 137743 - DNA, 25 bp, Rattus norvegicus
agctttattgcaatcattacctata

SEQ ID NO: 137744 - DNA, 25 bp, Rattus norvegicus
agctttattgcattcattacctata

SEQ ID NO: 137745 - DNA, 25 bp, Rattus norvegicus
agctttatttatatccctccagtcc

SEQ ID NO: 137746 - DNA, 25 bp, Rattus norvegicus
agctttatttatttccctccagtcc

SEQ ID NO: 137747 - DNA, 25 bp, Rattus norvegicus
agctttatttcccttaactggtatg

SEQ ID NO: 137748 - DNA, 25 bp, Rattus norvegicus
agctttatttccgttaactggtatg

SEQ ID NO: 137749 - DNA, 25 bp, Rattus norvegicus
agctttcaaagaagcctcatctttt

SEQ ID NO: 137750 - DNA, 25 bp, Rattus norvegicus
agctttcaaagatgcctcatctttt

SEQ ID NO: 137751 - DNA, 25 bp, Rattus norvegicus
agctttcaaagccttcactggcgag

SEQ ID NO: 137752 - DNA, 25 bp, Rattus norvegicus
agctttcaaagcgttcactggcgag

SEQ ID NO: 137753 - DNA, 25 bp, Rattus norvegicus
agctttcaaggcaggtactcatttg

SEQ ID NO: 137754 - DNA, 25 bp, Rattus norvegicus
agctttcaaggctggtactcatttg

SEQ ID NO: 137755 - DNA, 25 bp, Rattus norvegicus
agctttcaccgtacctgacaatcag

SEQ ID NO: 137756 - DNA, 25 bp, Rattus norvegicus
agctttcaccgttcctgacaatcag

SEQ ID NO: 137757 - DNA, 25 bp, Rattus norvegicus
agctttcacttgcaagacgctggaa

SEQ ID NO: 137758 - DNA, 25 bp, Rattus norvegicus
agctttcacttggaagacgctggaa

SEQ ID NO: 137759 - DNA, 25 bp, Rattus norvegicus
agctttcagcatcagcttcggtgaa

SEQ ID NO: 137760 - DNA, 25 bp, Rattus norvegicus
agctttcagcatgagcttcggtgaa

SEQ ID NO: 137761 - DNA, 25 bp, Rattus norvegicus
agctttcagcctatgatggtgcttt

SEQ ID NO: 137762 - DNA, 25 bp, Rattus norvegicus
agctttcagcctttgatggtgcttt

SEQ ID NO: 137763 - DNA, 25 bp, Rattus norvegicus
agctttcagcttatctctcccataa

SEQ ID NO: 137764 - DNA, 25 bp, Rattus norvegicus
agctttcagcttttctctcccataa

SEQ ID NO: 137765 - DNA, 25 bp, Rattus norvegicus
agctttcaggtgactttaggtggtt

SEQ ID NO: 137766 - DNA, 25 bp, Rattus norvegicus
agctttcaggtgtctttaggtggtt

SEQ ID NO: 137767 - DNA, 25 bp, Rattus norvegicus
agctttcagtggatactgcaggcag

SEQ ID NO: 137768 - DNA, 25 bp, Rattus norvegicus
agctttcagtggttactgcaggcag

SEQ ID NO: 137769 - DNA, 25 bp, Rattus norvegicus
agctttcataacatcctgtctgagg

SEQ ID NO: 137770 - DNA, 25 bp, Rattus norvegicus
agctttcataacttcctgtctgagg

SEQ ID NO: 137771 - DNA, 25 bp, Rattus norvegicus
agctttcatgacaacagagccacca

SEQ ID NO: 137772 - DNA, 25 bp, Rattus norvegicus
agctttcatgactacagagccacca

SEQ ID NO: 137773 - DNA, 25 bp, Rattus norvegicus
agctttcattccagttccaagctga

SEQ ID NO: 137774 - DNA, 25 bp, Rattus norvegicus
agctttcattcctgttccaagctga

SEQ ID NO: 137775 - DNA, 25 bp, Rattus norvegicus
agctttccacatcgcattcacagta

SEQ ID NO: 137776 - DNA, 25 bp, Rattus norvegicus
agctttccacatggcattcacagta

SEQ ID NO: 137777 - DNA, 25 bp, Rattus norvegicus
agctttccacttaaatcactgtatg

SEQ ID NO: 137778 - DNA, 25 bp, Rattus norvegicus
agctttccactttaatcactgtatg

SEQ ID NO: 137779 - DNA, 25 bp, Rattus norvegicus
agctttccagccagtacttatttgt

SEQ ID NO: 137780 - DNA, 25 bp, Rattus norvegicus
agctttccagcctgtacttatttgt

SEQ ID NO: 137781 - DNA, 25 bp, Rattus norvegicus
agctttccagctcatacagttcaca

SEQ ID NO: 137782 - DNA, 25 bp, Rattus norvegicus
agctttccagctgatacagttcaca

SEQ ID NO: 137783 - DNA, 25 bp, Rattus norvegicus
agctttccagtcctaaggtttcaga

SEQ ID NO: 137784 - DNA, 25 bp, Rattus norvegicus
agctttccagtcgtaaggtttcaga

SEQ ID NO: 137785 - DNA, 25 bp, Rattus norvegicus
agctttccatcactcttcagtgttt

SEQ ID NO: 137786 - DNA, 25 bp, Rattus norvegicus
agctttccatcagtcttcagtgttt

SEQ ID NO: 137787 - DNA, 25 bp, Rattus norvegicus
agctttccatccagtaacattgcac

SEQ ID NO: 137788 - DNA, 25 bp, Rattus norvegicus
agctttccatcctgtaacattgcac

SEQ ID NO: 137789 - DNA, 25 bp, Rattus norvegicus
agctttccattcagttcatctgtat

SEQ ID NO: 137790 - DNA, 25 bp, Rattus norvegicus
agctttccattctgttcatctgtat

SEQ ID NO: 137791 - DNA, 25 bp, Rattus norvegicus
agctttccatttatcctttgtcatc

SEQ ID NO: 137792 - DNA, 25 bp, Rattus norvegicus
agctttccatttttcctttgtcatc

SEQ ID NO: 137793 - DNA, 25 bp, Rattus norvegicus
agctttcccaagaacacggtgtcat

SEQ ID NO: 137794 - DNA, 25 bp, Rattus norvegicus
agctttcccaagtacacggtgtcat

SEQ ID NO: 137795 - DNA, 25 bp, Rattus norvegicus
agctttccccagaggagagctgtgg

SEQ ID NO: 137796 - DNA, 25 bp, Rattus norvegicus
agctttccccagtggagagctgtgg

SEQ ID NO: 137797 - DNA, 25 bp, Rattus norvegicus
agctttccccatagttacatgcatg

SEQ ID NO: 137798 - DNA, 25 bp, Rattus norvegicus
agctttccccattgttacatgcatg

SEQ ID NO: 137799 - DNA, 25 bp, Rattus norvegicus
agctttcccctacggctgggagtca

SEQ ID NO: 137800 - DNA, 25 bp, Rattus norvegicus
agctttcccctagggctgggagtca

SEQ ID NO: 137801 - DNA, 25 bp, Rattus norvegicus
agctttccccttagagagcggcaaa

SEQ ID NO: 137802 - DNA, 25 bp, Rattus norvegicus
agctttcccctttgagagcggcaaa

SEQ ID NO: 137803 - DNA, 25 bp, Rattus norvegicus
agctttccctttagagtatcctgaa

SEQ ID NO: 137804 - DNA, 25 bp, Rattus norvegicus
agctttcccttttgagtatcctgaa

SEQ ID NO: 137805 - DNA, 25 bp, Rattus norvegicus
agctttccgagacggccaacggcta

SEQ ID NO: 137806 - DNA, 25 bp, Rattus norvegicus
agctttccgagagggccaacggcta

SEQ ID NO: 137807 - DNA, 25 bp, Rattus norvegicus
agctttccgctcagaatagctccaa

SEQ ID NO: 137808 - DNA, 25 bp, Rattus norvegicus
agctttccgctctgaatagctccaa

SEQ ID NO: 137809 - DNA, 25 bp, Rattus norvegicus
agctttccgtaactcttcttcagtt

SEQ ID NO: 137810 - DNA, 25 bp, Rattus norvegicus
agctttccgtaagtcttcttcagtt

SEQ ID NO: 137811 - DNA, 25 bp, Rattus norvegicus
agctttccgtcacaaacctcacagt

SEQ ID NO: 137812 - DNA, 25 bp, Rattus norvegicus
agctttccgtcagaaacctcacagt

SEQ ID NO: 137813 - DNA, 25 bp, Rattus norvegicus
agctttcctaaccagtcttttcaga

SEQ ID NO: 137814 - DNA, 25 bp, Rattus norvegicus
agctttcctaacgagtcttttcaga

SEQ ID NO: 137815 - DNA, 25 bp, Rattus norvegicus
agctttcctcacatggcacaggtac

SEQ ID NO: 137816 - DNA, 25 bp, Rattus norvegicus
agctttcctcacttggcacaggtac

SEQ ID NO: 137817 - DNA, 25 bp, Rattus norvegicus
agctttcctgcgcagggtagcagat

SEQ ID NO: 137818 - DNA, 25 bp, Rattus norvegicus
agctttcctgcggagggtagcagat

SEQ ID NO: 137819 - DNA, 25 bp, Rattus norvegicus
agctttcctgtgctctgattttgaa

SEQ ID NO: 137820 - DNA, 25 bp, Rattus norvegicus
agctttcctgtggtctgattttgaa

SEQ ID NO: 137821 - DNA, 25 bp, Rattus norvegicus
agctttcctgttagtttctggacat

SEQ ID NO: 137822 - DNA, 25 bp, Rattus norvegicus
agctttcctgttcatcctggagtag

SEQ ID NO: 137823 - DNA, 25 bp, Rattus norvegicus
agctttcctgttgatcctggagtag

SEQ ID NO: 137824 - DNA, 25 bp, Rattus norvegicus
agctttcctgtttgtttctggacat

SEQ ID NO: 137825 - DNA, 25 bp, Rattus norvegicus
agctttccttgtatgtgtgctaaag

SEQ ID NO: 137826 - DNA, 25 bp, Rattus norvegicus
agctttccttgtttgtgtgctaaag

SEQ ID NO: 137827 - DNA, 25 bp, Rattus norvegicus
agctttccttttctggcaacatttt

SEQ ID NO: 137828 - DNA, 25 bp, Rattus norvegicus
agctttccttttgtggcaacatttt

SEQ ID NO: 137829 - DNA, 25 bp, Rattus norvegicus
agctttcgggctatgtgctgggaat

SEQ ID NO: 137830 - DNA, 25 bp, Rattus norvegicus
agctttcgggctttgtgctgggaat

SEQ ID NO: 137831 - DNA, 25 bp, Rattus norvegicus
agctttcgtcagatatgtggtccct

SEQ ID NO: 137832 - DNA, 25 bp, Rattus norvegicus
agctttcgtcagttatgtggtccct

SEQ ID NO: 137833 - DNA, 25 bp, Rattus norvegicus
agctttctaggactgctatctgaga

SEQ ID NO: 137834 - DNA, 25 bp, Rattus norvegicus
agctttctaggagtgctatctgaga

SEQ ID NO: 137835 - DNA, 25 bp, Rattus norvegicus
agctttctagtgaataaccttgtca

SEQ ID NO: 137836 - DNA, 25 bp, Rattus norvegicus
agctttctagtgtataaccttgtca

SEQ ID NO: 137837 - DNA, 25 bp, Rattus norvegicus
agctttctcaggctgttggagtctg

SEQ ID NO: 137838 - DNA, 25 bp, Rattus norvegicus
agctttctcagggtgttggagtctg

SEQ ID NO: 137839 - DNA, 25 bp, Rattus norvegicus
agctttctccctagagttacactgg

SEQ ID NO: 137840 - DNA, 25 bp, Rattus norvegicus
agctttctcccttgagttacactgg

SEQ ID NO: 137841 - DNA, 25 bp, Rattus norvegicus
agctttctcctgaggacttgggcta

SEQ ID NO: 137842 - DNA, 25 bp, Rattus norvegicus
agctttctcctgtggacttgggcta

SEQ ID NO: 137843 - DNA, 25 bp, Rattus norvegicus
agctttctctgcaatgcattttctt

SEQ ID NO: 137844 - DNA, 25 bp, Rattus norvegicus
agctttctctgctatgcattttctt

SEQ ID NO: 137845 - DNA, 25 bp, Rattus norvegicus
agctttctcttgatcatgacatttc

SEQ ID NO: 137846 - DNA, 25 bp, Rattus norvegicus
agctttctcttgttcatgacatttc

SEQ ID NO: 137847 - DNA, 25 bp, Rattus norvegicus
agctttctgaaactcccatatattg

SEQ ID NO: 137848 - DNA, 25 bp, Rattus norvegicus
agctttctgaaagtcccatatattg

SEQ ID NO: 137849 - DNA, 25 bp, Rattus norvegicus
agctttctgactactgatttttcta

SEQ ID NO: 137850 - DNA, 25 bp, Rattus norvegicus
agctttctgacttctgatttttcta

SEQ ID NO: 137851 - DNA, 25 bp, Rattus norvegicus
agctttctgagcaaacttcatcgga

SEQ ID NO: 137852 - DNA, 25 bp, Rattus norvegicus
agctttctgagctaacttcatcgga

SEQ ID NO: 137853 - DNA, 25 bp, Rattus norvegicus
agctttctgggaatcctccatgaca

SEQ ID NO: 137854 - DNA, 25 bp, Rattus norvegicus
agctttctgggattcctccatgaca

SEQ ID NO: 137855 - DNA, 25 bp, Rattus norvegicus
agctttctgggcactgcaatgaatt

SEQ ID NO: 137856 - DNA, 25 bp, Rattus norvegicus
agctttctgggcagtccacaggata

SEQ ID NO: 137857 - DNA, 25 bp, Rattus norvegicus
agctttctgggctctgcaatgaatt

SEQ ID NO: 137858 - DNA, 25 bp, Rattus norvegicus
agctttctgggctgtccacaggata

SEQ ID NO: 137859 - DNA, 25 bp, Rattus norvegicus
agctttctgtataactcgccgatgt

SEQ ID NO: 137860 - DNA, 25 bp, Rattus norvegicus
agctttctgtattactcgccgatgt

SEQ ID NO: 137861 - DNA, 25 bp, Rattus norvegicus
agctttcttattctggattgccttt

SEQ ID NO: 137862 - DNA, 25 bp, Rattus norvegicus
agctttcttattgtggattgccttt

SEQ ID NO: 137863 - DNA, 25 bp, Rattus norvegicus
agctttcttcatacgccttgagcct

SEQ ID NO: 137864 - DNA, 25 bp, Rattus norvegicus
agctttcttcattcgccttgagcct

SEQ ID NO: 137865 - DNA, 25 bp, Rattus norvegicus
agctttcttgacatggctgtgtcga

SEQ ID NO: 137866 - DNA, 25 bp, Rattus norvegicus
agctttcttgacttggctgtgtcga

SEQ ID NO: 137867 - DNA, 25 bp, Rattus norvegicus
agctttcttgctacacatatttctg

SEQ ID NO: 137868 - DNA, 25 bp, Rattus norvegicus
agctttcttgcttcacatatttctg

SEQ ID NO: 137869 - DNA, 25 bp, Rattus norvegicus
agctttcttttcctatgtcctttat

SEQ ID NO: 137870 - DNA, 25 bp, Rattus norvegicus
agctttcttttcgtatgtcctttat

SEQ ID NO: 137871 - DNA, 25 bp, Rattus norvegicus
agctttgaaacacgtgcacagctct

SEQ ID NO: 137872 - DNA, 25 bp, Rattus norvegicus
agctttgaaacaggtgcacagctct

SEQ ID NO: 137873 - DNA, 25 bp, Rattus norvegicus
agctttgaagcaactggcccaggaa

SEQ ID NO: 137874 - DNA, 25 bp, Rattus norvegicus
agctttgaagcatctggcccaggaa

SEQ ID NO: 137875 - DNA, 25 bp, Rattus norvegicus
agctttgagaaactgccggtcagta

SEQ ID NO: 137876 - DNA, 25 bp, Rattus norvegicus
agctttgagaaagtgccggtcagta

SEQ ID NO: 137877 - DNA, 25 bp, Rattus norvegicus
agctttgaggttaacctgtgctgcc

SEQ ID NO: 137878 - DNA, 25 bp, Rattus norvegicus
agctttgaggtttacctgtgctgcc

SEQ ID NO: 137879 - DNA, 25 bp, Rattus norvegicus
agctttgcaatactcagccctccaa

SEQ ID NO: 137880 - DNA, 25 bp, Rattus norvegicus
agctttgcaatagtcagccctccaa

SEQ ID NO: 137881 - DNA, 25 bp, Rattus norvegicus
agctttgcacacacagccagaaatg

SEQ ID NO: 137882 - DNA, 25 bp, Rattus norvegicus
agctttgcacactcagccagaaatg

SEQ ID NO: 137883 - DNA, 25 bp, Rattus norvegicus
agctttgcagccctccagtggtaga

SEQ ID NO: 137884 - DNA, 25 bp, Rattus norvegicus
agctttgcagccgtccagtggtaga

SEQ ID NO: 137885 - DNA, 25 bp, Rattus norvegicus
agctttgccagcaggaactcccaaa

SEQ ID NO: 137886 - DNA, 25 bp, Rattus norvegicus
agctttgccagctggaactcccaaa

SEQ ID NO: 137887 - DNA, 25 bp, Rattus norvegicus
agctttgcccagaccagatctctag

SEQ ID NO: 137888 - DNA, 25 bp, Rattus norvegicus
agctttgcccagtccagatctctag

SEQ ID NO: 137889 - DNA, 25 bp, Rattus norvegicus
agctttgccttcatggaggtgcagt

SEQ ID NO: 137890 - DNA, 25 bp, Rattus norvegicus
agctttgccttcttggaggtgcagt

SEQ ID NO: 137891 - DNA, 25 bp, Rattus norvegicus
agctttgcgagcagggagttgtccc

SEQ ID NO: 137892 - DNA, 25 bp, Rattus norvegicus
agctttgcgagctgggagttgtccc

SEQ ID NO: 137893 - DNA, 25 bp, Rattus norvegicus
agctttgctaggactccagggaaac

SEQ ID NO: 137894 - DNA, 25 bp, Rattus norvegicus
agctttgctaggtctccagggaaac

SEQ ID NO: 137895 - DNA, 25 bp, Rattus norvegicus
agctttgctgagctacctgcaagga

SEQ ID NO: 137896 - DNA, 25 bp, Rattus norvegicus
agctttgctgaggtacctgcaagga

SEQ ID NO: 137897 - DNA, 25 bp, Rattus norvegicus
agctttgctgtcctagtatctgatg

SEQ ID NO: 137898 - DNA, 25 bp, Rattus norvegicus
agctttgctgtcgtagtatctgatg

SEQ ID NO: 137899 - DNA, 25 bp, Rattus norvegicus
agctttgctgtgaacgtttctcctt

SEQ ID NO: 137900 - DNA, 25 bp, Rattus norvegicus
agctttgctgtgtacgtttctcctt

SEQ ID NO: 137901 - DNA, 25 bp, Rattus norvegicus
agctttgctgttcttgttagggaag

SEQ ID NO: 137902 - DNA, 25 bp, Rattus norvegicus
agctttgctgttgttgttagggaag

SEQ ID NO: 137903 - DNA, 25 bp, Rattus norvegicus
agctttgcttcgcacacctccatgt

SEQ ID NO: 137904 - DNA, 25 bp, Rattus norvegicus
agctttgcttcggacacctccatgt

SEQ ID NO: 137905 - DNA, 25 bp, Rattus norvegicus
agctttgctttcatacctatgttgt

SEQ ID NO: 137906 - DNA, 25 bp, Rattus norvegicus
agctttgctttcttacctatgttgt

SEQ ID NO: 137907 - DNA, 25 bp, Rattus norvegicus
agctttggactgcactctaaacaac

SEQ ID NO: 137908 - DNA, 25 bp, Rattus norvegicus
agctttggactggactctaaacaac

SEQ ID NO: 137909 - DNA, 25 bp, Rattus norvegicus
agctttggatgaacccttttccatc

SEQ ID NO: 137910 - DNA, 25 bp, Rattus norvegicus
agctttggatgatcccttttccatc

SEQ ID NO: 137911 - DNA, 25 bp, Rattus norvegicus
agctttggcacaacaggagttcttt

SEQ ID NO: 137912 - DNA, 25 bp, Rattus norvegicus
agctttggcacatcaggagttcttt

SEQ ID NO: 137913 - DNA, 25 bp, Rattus norvegicus
agctttggccacatgatggtcaact

SEQ ID NO: 137914 - DNA, 25 bp, Rattus norvegicus
agctttggccacttgatggtcaact

SEQ ID NO: 137915 - DNA, 25 bp, Rattus norvegicus
agctttggctacacgctgtatgcgg

SEQ ID NO: 137916 - DNA, 25 bp, Rattus norvegicus
agctttggctactcgctgtatgcgg

SEQ ID NO: 137917 - DNA, 25 bp, Rattus norvegicus
agctttggctctagctttggtggca

SEQ ID NO: 137918 - DNA, 25 bp, Rattus norvegicus
agctttggctcttgctttggtggca

SEQ ID NO: 137919 - DNA, 25 bp, Rattus norvegicus
agctttggctgcaaaggcagtccta

SEQ ID NO: 137920 - DNA, 25 bp, Rattus norvegicus
agctttggctgctaaggcagtccta

SEQ ID NO: 137921 - DNA, 25 bp, Rattus norvegicus
agctttggcttgagttgttcacggg

SEQ ID NO: 137922 - DNA, 25 bp, Rattus norvegicus
agctttggcttgtgttgttcacggg

SEQ ID NO: 137923 - DNA, 25 bp, Rattus norvegicus
agctttgggaagatagcctgctaaa

SEQ ID NO: 137924 - DNA, 25 bp, Rattus norvegicus
agctttgggaagttagcctgctaaa

SEQ ID NO: 137925 - DNA, 25 bp, Rattus norvegicus
agctttgggacacagcttcctggta

SEQ ID NO: 137926 - DNA, 25 bp, Rattus norvegicus
agctttgggacagagcttcctggta

SEQ ID NO: 137927 - DNA, 25 bp, Rattus norvegicus
agctttggtcctccacatagttcag

SEQ ID NO: 137928 - DNA, 25 bp, Rattus norvegicus
agctttggtcctgcacatagttcag

SEQ ID NO: 137929 - DNA, 25 bp, Rattus norvegicus
agctttggtgaactttaagagcaga

SEQ ID NO: 137930 - DNA, 25 bp, Rattus norvegicus
agctttggtgaagtttaagagcaga

SEQ ID NO: 137931 - DNA, 25 bp, Rattus norvegicus
agctttggtgttcaaggcccgactt

SEQ ID NO: 137932 - DNA, 25 bp, Rattus norvegicus
agctttggtgttgaaggcccgactt

SEQ ID NO: 137933 - DNA, 25 bp, Rattus norvegicus
agctttggttatccatgtgtctgag

SEQ ID NO: 137934 - DNA, 25 bp, Rattus norvegicus
agctttggttatgcatgtgtctgag

SEQ ID NO: 137935 - DNA, 25 bp, Rattus norvegicus
agctttggttccctacatccacatg

SEQ ID NO: 137936 - DNA, 25 bp, Rattus norvegicus
agctttggttccgtacatccacatg

SEQ ID NO: 137937 - DNA, 25 bp, Rattus norvegicus
agctttgtaagtacgtcttgccttt

SEQ ID NO: 137938 - DNA, 25 bp, Rattus norvegicus
agctttgtaagttcgtcttgccttt

SEQ ID NO: 137939 - DNA, 25 bp, Rattus norvegicus
agctttgtacttcttgcccacaggt

SEQ ID NO: 137940 - DNA, 25 bp, Rattus norvegicus
agctttgtacttgttgcccacaggt

SEQ ID NO: 137941 - DNA, 25 bp, Rattus norvegicus
agctttgtatagcagctgcccctga

SEQ ID NO: 137942 - DNA, 25 bp, Rattus norvegicus
agctttgtataggagctgcccctga

SEQ ID NO: 137943 - DNA, 25 bp, Rattus norvegicus
agctttgtcaatcacacccttttac

SEQ ID NO: 137944 - DNA, 25 bp, Rattus norvegicus
agctttgtcaatgacacccttttac

SEQ ID NO: 137945 - DNA, 25 bp, Rattus norvegicus
agctttgtcattcgacctgctcaat

SEQ ID NO: 137946 - DNA, 25 bp, Rattus norvegicus
agctttgtcattggacctgctcaat

SEQ ID NO: 137947 - DNA, 25 bp, Rattus norvegicus
agctttgtcgatatggtcttctgca

SEQ ID NO: 137948 - DNA, 25 bp, Rattus norvegicus
agctttgtcgatttggtcttctgca

SEQ ID NO: 137949 - DNA, 25 bp, Rattus norvegicus
agctttgtctacctatttgtgccat

SEQ ID NO: 137950 - DNA, 25 bp, Rattus norvegicus
agctttgtctacgtatttgtgccat

SEQ ID NO: 137951 - DNA, 25 bp, Rattus norvegicus
agctttgtctgtaccgtcttgtcac

SEQ ID NO: 137952 - DNA, 25 bp, Rattus norvegicus
agctttgtctgttccgtcttgtcac

SEQ ID NO: 137953 - DNA, 25 bp, Rattus norvegicus
agctttgtgaacacacgctctgaga

SEQ ID NO: 137954 - DNA, 25 bp, Rattus norvegicus
agctttgtgaacatcctgtgtgatc

SEQ ID NO: 137955 - DNA, 25 bp, Rattus norvegicus
agctttgtgaactcacgctctgaga

SEQ ID NO: 137956 - DNA, 25 bp, Rattus norvegicus
agctttgtgaacttcctgtgtgatc

SEQ ID NO: 137957 - DNA, 25 bp, Rattus norvegicus
agctttgtgaccctgtacttttgaa

SEQ ID NO: 137958 - DNA, 25 bp, Rattus norvegicus
agctttgtgaccgtgtacttttgaa

SEQ ID NO: 137959 - DNA, 25 bp, Rattus norvegicus
agctttgtgcttacattcctagaca

SEQ ID NO: 137960 - DNA, 25 bp, Rattus norvegicus
agctttgtgctttcattcctagaca

SEQ ID NO: 137961 - DNA, 25 bp, Rattus norvegicus
agctttgtgggtatttctttgcagt

SEQ ID NO: 137962 - DNA, 25 bp, Rattus norvegicus
agctttgtgggtttttctttgcagt

SEQ ID NO: 137963 - DNA, 25 bp, Rattus norvegicus
agctttgttcccatgtgcactaaaa

SEQ ID NO: 137964 - DNA, 25 bp, Rattus norvegicus
agctttgttcccttgtgcactaaaa

SEQ ID NO: 137965 - DNA, 25 bp, Rattus norvegicus
agctttgttgatcttgtttctgttt

SEQ ID NO: 137966 - DNA, 25 bp, Rattus norvegicus
agctttgttgatgttgtttctgttt

SEQ ID NO: 137967 - DNA, 25 bp, Rattus norvegicus
agctttgttgctactttatattgga

SEQ ID NO: 137968 - DNA, 25 bp, Rattus norvegicus
agctttgttgcttctttatattgga

SEQ ID NO: 137969 - DNA, 25 bp, Rattus norvegicus
agctttgtttcactctttcttgtca

SEQ ID NO: 137970 - DNA, 25 bp, Rattus norvegicus
agctttgtttcagtctttcttgtca

SEQ ID NO: 137971 - DNA, 25 bp, Rattus norvegicus
agctttgtttccagtgtgccggcca

SEQ ID NO: 137972 - DNA, 25 bp, Rattus norvegicus
agctttgtttcccttgtgattactt

SEQ ID NO: 137973 - DNA, 25 bp, Rattus norvegicus
agctttgtttccgttgtgattactt

SEQ ID NO: 137974 - DNA, 25 bp, Rattus norvegicus
agctttgtttcctgtgtgccggcca

SEQ ID NO: 137975 - DNA, 25 bp, Rattus norvegicus
agctttgttttcagcctttggtaat

SEQ ID NO: 137976 - DNA, 25 bp, Rattus norvegicus
agctttgttttctgcctttggtaat

SEQ ID NO: 137977 - DNA, 25 bp, Rattus norvegicus
agcttttaaacacgatgcgcctttc

SEQ ID NO: 137978 - DNA, 25 bp, Rattus norvegicus
agcttttaaacaggatgcgcctttc

SEQ ID NO: 137979 - DNA, 25 bp, Rattus norvegicus
agcttttaaccgactgatacccgtg

SEQ ID NO: 137980 - DNA, 25 bp, Rattus norvegicus
agcttttaaccgtctgatacccgtg

SEQ ID NO: 137981 - DNA, 25 bp, Rattus norvegicus
agcttttaatctacctgactctgtc

SEQ ID NO: 137982 - DNA, 25 bp, Rattus norvegicus
agcttttaatctagtgccatcttga

SEQ ID NO: 137983 - DNA, 25 bp, Rattus norvegicus
agcttttaatcttcctgactctgtc

SEQ ID NO: 137984 - DNA, 25 bp, Rattus norvegicus
agcttttaatcttgtgccatcttga

SEQ ID NO: 137985 - DNA, 25 bp, Rattus norvegicus
agcttttaatgaactcctgggtttg

SEQ ID NO: 137986 - DNA, 25 bp, Rattus norvegicus
agcttttaatgatctcctgggtttg

SEQ ID NO: 137987 - DNA, 25 bp, Rattus norvegicus
agcttttaattgagccccatggcca

SEQ ID NO: 137988 - DNA, 25 bp, Rattus norvegicus
agcttttaattgtgccccatggcca

SEQ ID NO: 137989 - DNA, 25 bp, Rattus norvegicus
agcttttaggcacctgtgctgagct

SEQ ID NO: 137990 - DNA, 25 bp, Rattus norvegicus
agcttttaggcagctgtgctgagct

SEQ ID NO: 137991 - DNA, 25 bp, Rattus norvegicus
agcttttatgccctttctctataaa

SEQ ID NO: 137992 - DNA, 25 bp, Rattus norvegicus
agcttttatgccgtttctctataaa

SEQ ID NO: 137993 - DNA, 25 bp, Rattus norvegicus
agcttttatttcaaactcacacctc

SEQ ID NO: 137994 - DNA, 25 bp, Rattus norvegicus
agcttttatttctaactcacacctc

SEQ ID NO: 137995 - DNA, 25 bp, Rattus norvegicus
agcttttcaaggctatttctctgga

SEQ ID NO: 137996 - DNA, 25 bp, Rattus norvegicus
agcttttcaagggtatttctctgga

SEQ ID NO: 137997 - DNA, 25 bp, Rattus norvegicus
agcttttcaataatcactggctgac

SEQ ID NO: 137998 - DNA, 25 bp, Rattus norvegicus
agcttttcaatattcactggctgac

SEQ ID NO: 137999 - DNA, 25 bp, Rattus norvegicus
agcttttccacacggcattgctgca

SEQ ID NO: 138000 - DNA, 25 bp, Rattus norvegicus
agcttttccacagggcattgctgca

SEQ ID NO: 138001 - DNA, 25 bp, Rattus norvegicus
agcttttcctacattacatgtcaaa

SEQ ID NO: 138002 - DNA, 25 bp, Rattus norvegicus
agcttttcctactttacatgtcaaa

SEQ ID NO: 138003 - DNA, 25 bp, Rattus norvegicus
agcttttcctgaatagttgcctctt

SEQ ID NO: 138004 - DNA, 25 bp, Rattus norvegicus
agcttttcctgattagttgcctctt

SEQ ID NO: 138005 - DNA, 25 bp, Rattus norvegicus
agcttttccttgctgagggacctga

SEQ ID NO: 138006 - DNA, 25 bp, Rattus norvegicus
agcttttccttggtgagggacctga

SEQ ID NO: 138007 - DNA, 25 bp, Rattus norvegicus
agcttttcctttctctagcgaggga

SEQ ID NO: 138008 - DNA, 25 bp, Rattus norvegicus
agcttttcctttgtctagcgaggga

SEQ ID NO: 138009 - DNA, 25 bp, Rattus norvegicus
agcttttctatcacctttctagcaa

SEQ ID NO: 138010 - DNA, 25 bp, Rattus norvegicus
agcttttctatctcctttctagcaa

SEQ ID NO: 138011 - DNA, 25 bp, Rattus norvegicus
agcttttctgatcctttgaacatag

SEQ ID NO: 138012 - DNA, 25 bp, Rattus norvegicus
agcttttctgatgctttgaacatag

SEQ ID NO: 138013 - DNA, 25 bp, Rattus norvegicus
agcttttctgcaccgtccgagcgtc

SEQ ID NO: 138014 - DNA, 25 bp, Rattus norvegicus
agcttttctgcagcgtccgagcgtc

SEQ ID NO: 138015 - DNA, 25 bp, Rattus norvegicus
agcttttctgctacgaggcatttta

SEQ ID NO: 138016 - DNA, 25 bp, Rattus norvegicus
agcttttctgcttcgaggcatttta

SEQ ID NO: 138017 - DNA, 25 bp, Rattus norvegicus
agcttttctgttatgtatagtctct

SEQ ID NO: 138018 - DNA, 25 bp, Rattus norvegicus
agcttttctgttttgtatagtctct

SEQ ID NO: 138019 - DNA, 25 bp, Rattus norvegicus
agcttttcttttcctctttatgaca

SEQ ID NO: 138020 - DNA, 25 bp, Rattus norvegicus
agcttttcttttgctctttatgaca

SEQ ID NO: 138021 - DNA, 25 bp, Rattus norvegicus
agcttttgacggactctgacttgaa

SEQ ID NO: 138022 - DNA, 25 bp, Rattus norvegicus
agcttttgacggtctctgacttgaa

SEQ ID NO: 138023 - DNA, 25 bp, Rattus norvegicus
agcttttgatgtacatcctctggcc

SEQ ID NO: 138024 - DNA, 25 bp, Rattus norvegicus
agcttttgatgttcatcctctggcc

SEQ ID NO: 138025 - DNA, 25 bp, Rattus norvegicus
agcttttgcaggctcctgcagtaga

SEQ ID NO: 138026 - DNA, 25 bp, Rattus norvegicus
agcttttgcagggtcctgcagtaga

SEQ ID NO: 138027 - DNA, 25 bp, Rattus norvegicus
agcttttgccttcttcaatctggtt

SEQ ID NO: 138028 - DNA, 25 bp, Rattus norvegicus
agcttttgccttgttcaatctggtt

SEQ ID NO: 138029 - DNA, 25 bp, Rattus norvegicus
agcttttggcaaactgggaatggca

SEQ ID NO: 138030 - DNA, 25 bp, Rattus norvegicus
agcttttggcaatctgggaatggca

SEQ ID NO: 138031 - DNA, 25 bp, Rattus norvegicus
agcttttggctaactcatggtttaa

SEQ ID NO: 138032 - DNA, 25 bp, Rattus norvegicus
agcttttggctatctcatggtttaa

SEQ ID NO: 138033 - DNA, 25 bp, Rattus norvegicus
agcttttggtgcaggctgcagagtc

SEQ ID NO: 138034 - DNA, 25 bp, Rattus norvegicus
agcttttggtgctggctgcagagtc

SEQ ID NO: 138035 - DNA, 25 bp, Rattus norvegicus
agcttttgtcatcgtaaacagtggc

SEQ ID NO: 138036 - DNA, 25 bp, Rattus norvegicus
agcttttgtcatggtaaacagtggc

SEQ ID NO: 138037 - DNA, 25 bp, Rattus norvegicus
agcttttgtcctctgtgagaagcaa

SEQ ID NO: 138038 - DNA, 25 bp, Rattus norvegicus
agcttttgtcctgtgtgagaagcaa

SEQ ID NO: 138039 - DNA, 25 bp, Rattus norvegicus
agcttttgtgtgcagcgtttgctcc

SEQ ID NO: 138040 - DNA, 25 bp, Rattus norvegicus
agcttttgtgtggagcgtttgctcc

SEQ ID NO: 138041 - DNA, 25 bp, Rattus norvegicus
agctttttacaaacgagtctcagat

SEQ ID NO: 138042 - DNA, 25 bp, Rattus norvegicus
agctttttacaatcgagtctcagat

SEQ ID NO: 138043 - DNA, 25 bp, Rattus norvegicus
agctttttaggcagtgtccttggct

SEQ ID NO: 138044 - DNA, 25 bp, Rattus norvegicus
agctttttaggctgtgtccttggct

SEQ ID NO: 138045 - DNA, 25 bp, Rattus norvegicus
agctttttcatcagggttctggaga

SEQ ID NO: 138046 - DNA, 25 bp, Rattus norvegicus
agctttttcatctgggttctggaga

SEQ ID NO: 138047 - DNA, 25 bp, Rattus norvegicus
agctttttctcccaggaaggccctg

SEQ ID NO: 138048 - DNA, 25 bp, Rattus norvegicus
agctttttctccgaggaaggccctg

SEQ ID NO: 138049 - DNA, 25 bp, Rattus norvegicus
agctttttctgcagtggcaattatc

SEQ ID NO: 138050 - DNA, 25 bp, Rattus norvegicus
agctttttctgctgtggcaattatc

SEQ ID NO: 138051 - DNA, 25 bp, Rattus norvegicus
agctttttgagtatgtttccactgt

SEQ ID NO: 138052 - DNA, 25 bp, Rattus norvegicus
agctttttgagtttgtttccactgt

SEQ ID NO: 138053 - DNA, 25 bp, Rattus norvegicus
agctttttggacagcgttatcttat

SEQ ID NO: 138054 - DNA, 25 bp, Rattus norvegicus
agctttttggactgcgttatcttat

SEQ ID NO: 138055 - DNA, 25 bp, Rattus norvegicus
aggaaaaaccacaccagtgtcctca

SEQ ID NO: 138056 - DNA, 25 bp, Rattus norvegicus
aggaaaaaccactccagtgtcctca

SEQ ID NO: 138057 - DNA, 25 bp, Rattus norvegicus
aggaaaaatgtacagatgagccaag

SEQ ID NO: 138058 - DNA, 25 bp, Rattus norvegicus
aggaaaaatgtagagatgagccaag

SEQ ID NO: 138059 - DNA, 25 bp, Rattus norvegicus
aggaaaaattctctccgctgacggc

SEQ ID NO: 138060 - DNA, 25 bp, Rattus norvegicus
aggaaaaattctgtccgctgacggc

SEQ ID NO: 138061 - DNA, 25 bp, Rattus norvegicus
aggaaaactccaagcaagtgccaaa

SEQ ID NO: 138062 - DNA, 25 bp, Rattus norvegicus
aggaaaactccatgcaagtgccaaa

SEQ ID NO: 138063 - DNA, 25 bp, Rattus norvegicus
aggaaaactctcatgggctttgcag

SEQ ID NO: 138064 - DNA, 25 bp, Rattus norvegicus
aggaaaactctcttgggctttgcag

SEQ ID NO: 138065 - DNA, 25 bp, Rattus norvegicus
aggaaaactgccacccaaaagctgt

SEQ ID NO: 138066 - DNA, 25 bp, Rattus norvegicus
aggaaaactgcctcccaaaagctgt

SEQ ID NO: 138067 - DNA, 25 bp, Rattus norvegicus
aggaaaagacgcctactgccctgcc

SEQ ID NO: 138068 - DNA, 25 bp, Rattus norvegicus
aggaaaagacgcgtactgccctgcc

SEQ ID NO: 138069 - DNA, 25 bp, Rattus norvegicus
aggaaaagcagacccggtgtgactt

SEQ ID NO: 138070 - DNA, 25 bp, Rattus norvegicus
aggaaaagcagactccctgacccat

SEQ ID NO: 138071 - DNA, 25 bp, Rattus norvegicus
aggaaaagcagagccggtgtgactt

SEQ ID NO: 138072 - DNA, 25 bp, Rattus norvegicus
aggaaaagcagagtccctgacccat

SEQ ID NO: 138073 - DNA, 25 bp, Rattus norvegicus
aggaaaagccaccttctttctgtga

SEQ ID NO: 138074 - DNA, 25 bp, Rattus norvegicus
aggaaaagccacgttctttctgtga

SEQ ID NO: 138075 - DNA, 25 bp, Rattus norvegicus
aggaaaagctttagcctgtctgccc

SEQ ID NO: 138076 - DNA, 25 bp, Rattus norvegicus
aggaaaagcttttgcctgtctgccc

SEQ ID NO: 138077 - DNA, 25 bp, Rattus norvegicus
aggaaaagtcccatgactagactgc

SEQ ID NO: 138078 - DNA, 25 bp, Rattus norvegicus
aggaaaagtcccttgactagactgc

SEQ ID NO: 138079 - DNA, 25 bp, Rattus norvegicus
aggaaaagttaaccacctcccagat

SEQ ID NO: 138080 - DNA, 25 bp, Rattus norvegicus
aggaaaagttaagcacctcccagat

SEQ ID NO: 138081 - DNA, 25 bp, Rattus norvegicus
aggaaaatagacaggcattcatcac

SEQ ID NO: 138082 - DNA, 25 bp, Rattus norvegicus
aggaaaatagactggcattcatcac

SEQ ID NO: 138083 - DNA, 25 bp, Rattus norvegicus
aggaaaatccgaaagctgctctcat

SEQ ID NO: 138084 - DNA, 25 bp, Rattus norvegicus
aggaaaatccgatagctgctctcat

SEQ ID NO: 138085 - DNA, 25 bp, Rattus norvegicus
aggaaaatctccattatccgcccat

SEQ ID NO: 138086 - DNA, 25 bp, Rattus norvegicus
aggaaaatctcctttatccgcccat

SEQ ID NO: 138087 - DNA, 25 bp, Rattus norvegicus
aggaaaatgctcatcgggctctgga

SEQ ID NO: 138088 - DNA, 25 bp, Rattus norvegicus
aggaaaatgctcttcgggctctgga

SEQ ID NO: 138089 - DNA, 25 bp, Rattus norvegicus
aggaaacaaacccatcacctgctgg

SEQ ID NO: 138090 - DNA, 25 bp, Rattus norvegicus
aggaaacaaaccgatcacctgctgg

SEQ ID NO: 138091 - DNA, 25 bp, Rattus norvegicus
aggaaacaaatgcaggtcccctgga

SEQ ID NO: 138092 - DNA, 25 bp, Rattus norvegicus
aggaaacaaatggaggtcccctgga

SEQ ID NO: 138093 - DNA, 25 bp, Rattus norvegicus
aggaaacaaccacctggccggatgt

SEQ ID NO: 138094 - DNA, 25 bp, Rattus norvegicus
aggaaacaaccagctggccggatgt

SEQ ID NO: 138095 - DNA, 25 bp, Rattus norvegicus
aggaaacacacacttgcccacatgc

SEQ ID NO: 138096 - DNA, 25 bp, Rattus norvegicus
aggaaacacacagttgcccacatgc

SEQ ID NO: 138097 - DNA, 25 bp, Rattus norvegicus
aggaaacacctaagttctgtccgcc

SEQ ID NO: 138098 - DNA, 25 bp, Rattus norvegicus
aggaaacacctatgttctgtccgcc

SEQ ID NO: 138099 - DNA, 25 bp, Rattus norvegicus
aggaaacactctaggccatgccttt

SEQ ID NO: 138100 - DNA, 25 bp, Rattus norvegicus
aggaaacactcttggccatgccttt

SEQ ID NO: 138101 - DNA, 25 bp, Rattus norvegicus
aggaaacagaccagcacaagtccct

SEQ ID NO: 138102 - DNA, 25 bp, Rattus norvegicus
aggaaacagacctgcacaagtccct

SEQ ID NO: 138103 - DNA, 25 bp, Rattus norvegicus
aggaaacagcatcatcatgttagaa

SEQ ID NO: 138104 - DNA, 25 bp, Rattus norvegicus
aggaaacagcatgatcatgttagaa

SEQ ID NO: 138105 - DNA, 25 bp, Rattus norvegicus
aggaaacaggccacgacttgtcact

SEQ ID NO: 138106 - DNA, 25 bp, Rattus norvegicus
aggaaacaggcctcgacttgtcact

SEQ ID NO: 138107 - DNA, 25 bp, Rattus norvegicus
aggaaacagtgtcccatcagctctt

SEQ ID NO: 138108 - DNA, 25 bp, Rattus norvegicus
aggaaacagtgtgccatcagctctt

SEQ ID NO: 138109 - DNA, 25 bp, Rattus norvegicus
aggaaacatctcagggaagctgact

SEQ ID NO: 138110 - DNA, 25 bp, Rattus norvegicus
aggaaacatctctgggaagctgact

SEQ ID NO: 138111 - DNA, 25 bp, Rattus norvegicus
aggaaacatgccattctgataagta

SEQ ID NO: 138112 - DNA, 25 bp, Rattus norvegicus
aggaaacatgcctttctgataagta

SEQ ID NO: 138113 - DNA, 25 bp, Rattus norvegicus
aggaaaccaattctcatcgcactga

SEQ ID NO: 138114 - DNA, 25 bp, Rattus norvegicus
aggaaaccaattgtcatcgcactga

SEQ ID NO: 138115 - DNA, 25 bp, Rattus norvegicus
aggaaaccaccactggaccaatgga

SEQ ID NO: 138116 - DNA, 25 bp, Rattus norvegicus
aggaaaccaccagtggaccaatgga

SEQ ID NO: 138117 - DNA, 25 bp, Rattus norvegicus
aggaaaccagtcacccaggatgaaa

SEQ ID NO: 138118 - DNA, 25 bp, Rattus norvegicus
aggaaaccagtctcccaggatgaaa

SEQ ID NO: 138119 - DNA, 25 bp, Rattus norvegicus
aggaaacccaggcagctgacttact

SEQ ID NO: 138120 - DNA, 25 bp, Rattus norvegicus
aggaaacccagggagctgacttact

SEQ ID NO: 138121 - DNA, 25 bp, Rattus norvegicus
aggaaacccagtccctgaagttgaa

SEQ ID NO: 138122 - DNA, 25 bp, Rattus norvegicus
aggaaacccagtgcctgaagttgaa

SEQ ID NO: 138123 - DNA, 25 bp, Rattus norvegicus
aggaaaccctgacagtgctcatgct

SEQ ID NO: 138124 - DNA, 25 bp, Rattus norvegicus
aggaaaccctgagagtgctcatgct

SEQ ID NO: 138125 - DNA, 25 bp, Rattus norvegicus
aggaaacctgctagagactcgctag

SEQ ID NO: 138126 - DNA, 25 bp, Rattus norvegicus
aggaaacctgctagcagcacacttt

SEQ ID NO: 138127 - DNA, 25 bp, Rattus norvegicus
aggaaacctgcttgagactcgctag

SEQ ID NO: 138128 - DNA, 25 bp, Rattus norvegicus
aggaaacctgcttgcagcacacttt

SEQ ID NO: 138129 - DNA, 25 bp, Rattus norvegicus
aggaaacctggcaaccttcataatt

SEQ ID NO: 138130 - DNA, 25 bp, Rattus norvegicus
aggaaacctggctaccttcataatt

SEQ ID NO: 138131 - DNA, 25 bp, Rattus norvegicus
aggaaaccttcaagaccctgtctca

SEQ ID NO: 138132 - DNA, 25 bp, Rattus norvegicus
aggaaaccttcatgaccctgtctca

SEQ ID NO: 138133 - DNA, 25 bp, Rattus norvegicus
aggaaaccttgtcactgagctcatc

SEQ ID NO: 138134 - DNA, 25 bp, Rattus norvegicus
aggaaaccttgtgactgagctcatc

SEQ ID NO: 138135 - DNA, 25 bp, Rattus norvegicus
aggaaacgcaagctgcccacgtagt

SEQ ID NO: 138136 - DNA, 25 bp, Rattus norvegicus
aggaaacgcaaggtgcccacgtagt

SEQ ID NO: 138137 - DNA, 25 bp, Rattus norvegicus
aggaaacgctgcagctaggatgctc

SEQ ID NO: 138138 - DNA, 25 bp, Rattus norvegicus
aggaaacgctgctgctaggatgctc

SEQ ID NO: 138139 - DNA, 25 bp, Rattus norvegicus
aggaaacggctgactgagaccagta

SEQ ID NO: 138140 - DNA, 25 bp, Rattus norvegicus
aggaaacggctgtctgagaccagta

SEQ ID NO: 138141 - DNA, 25 bp, Rattus norvegicus
aggaaactacatacatggccgccaa

SEQ ID NO: 138142 - DNA, 25 bp, Rattus norvegicus
aggaaactacattcatggccgccaa

SEQ ID NO: 138143 - DNA, 25 bp, Rattus norvegicus
aggaaactatcccatggcaggcttg

SEQ ID NO: 138144 - DNA, 25 bp, Rattus norvegicus
aggaaactatccgatggcaggcttg

SEQ ID NO: 138145 - DNA, 25 bp, Rattus norvegicus
aggaaactccagcaatccctaagtg

SEQ ID NO: 138146 - DNA, 25 bp, Rattus norvegicus
aggaaactccaggaatccctaagtg

SEQ ID NO: 138147 - DNA, 25 bp, Rattus norvegicus
aggaaactctccatcccaagagatg

SEQ ID NO: 138148 - DNA, 25 bp, Rattus norvegicus
aggaaactctccttcccaagagatg

SEQ ID NO: 138149 - DNA, 25 bp, Rattus norvegicus
aggaaactcttccacttgggagctc

SEQ ID NO: 138150 - DNA, 25 bp, Rattus norvegicus
aggaaactcttcgacttgggagctc

SEQ ID NO: 138151 - DNA, 25 bp, Rattus norvegicus
aggaaactgactctgatctcactgt

SEQ ID NO: 138152 - DNA, 25 bp, Rattus norvegicus
aggaaactgactgtgatctcactgt

SEQ ID NO: 138153 - DNA, 25 bp, Rattus norvegicus
aggaaactgtccagaaccgggcaca

SEQ ID NO: 138154 - DNA, 25 bp, Rattus norvegicus
aggaaactgtcctgaaccgggcaca

SEQ ID NO: 138155 - DNA, 25 bp, Rattus norvegicus
aggaaacttgaaaccctcatgttga

SEQ ID NO: 138156 - DNA, 25 bp, Rattus norvegicus
aggaaacttgaatccctcatgttga

SEQ ID NO: 138157 - DNA, 25 bp, Rattus norvegicus
aggaaacttgtaactctggtctctt

SEQ ID NO: 138158 - DNA, 25 bp, Rattus norvegicus
aggaaacttgtatctctggtctctt

SEQ ID NO: 138159 - DNA, 25 bp, Rattus norvegicus
aggaaactttccctggcaggtggct

SEQ ID NO: 138160 - DNA, 25 bp, Rattus norvegicus
aggaaactttccgtggcaggtggct

SEQ ID NO: 138161 - DNA, 25 bp, Rattus norvegicus
aggaaagacacaaggatccccgtcc

SEQ ID NO: 138162 - DNA, 25 bp, Rattus norvegicus
aggaaagacacatggatccccgtcc

SEQ ID NO: 138163 - DNA, 25 bp, Rattus norvegicus
aggaaagaccccacagcagcatggt

SEQ ID NO: 138164 - DNA, 25 bp, Rattus norvegicus
aggaaagacccctcagcagcatggt

SEQ ID NO: 138165 - DNA, 25 bp, Rattus norvegicus
aggaaagacctcactgcccaggtgt

SEQ ID NO: 138166 - DNA, 25 bp, Rattus norvegicus
aggaaagacctctctgcccaggtgt

SEQ ID NO: 138167 - DNA, 25 bp, Rattus norvegicus
aggaaagaccttctactccaagaag

SEQ ID NO: 138168 - DNA, 25 bp, Rattus norvegicus
aggaaagaccttgtactccaagaag

SEQ ID NO: 138169 - DNA, 25 bp, Rattus norvegicus
aggaaagacttgatgtccccgtcct

SEQ ID NO: 138170 - DNA, 25 bp, Rattus norvegicus
aggaaagacttgttgtccccgtcct

SEQ ID NO: 138171 - DNA, 25 bp, Rattus norvegicus
aggaaagcaccgagcttctctgctg

SEQ ID NO: 138172 - DNA, 25 bp, Rattus norvegicus
aggaaagcaccgtgcttctctgctg

SEQ ID NO: 138173 - DNA, 25 bp, Rattus norvegicus
aggaaagcactgatgacacctccct

SEQ ID NO: 138174 - DNA, 25 bp, Rattus norvegicus
aggaaagcactgttgacacctccct

SEQ ID NO: 138175 - DNA, 25 bp, Rattus norvegicus
aggaaagcagccctgttagcccagt

SEQ ID NO: 138176 - DNA, 25 bp, Rattus norvegicus
aggaaagcagccgtgttagcccagt

SEQ ID NO: 138177 - DNA, 25 bp, Rattus norvegicus
aggaaagcaggaccaagcctcccca

SEQ ID NO: 138178 - DNA, 25 bp, Rattus norvegicus
aggaaagcaggagcaagcctcccca

SEQ ID NO: 138179 - DNA, 25 bp, Rattus norvegicus
aggaaagccagcacttgccgttact

SEQ ID NO: 138180 - DNA, 25 bp, Rattus norvegicus
aggaaagccagctcttgccgttact

SEQ ID NO: 138181 - DNA, 25 bp, Rattus norvegicus
aggaaagcccatcacgacgctgtga

SEQ ID NO: 138182 - DNA, 25 bp, Rattus norvegicus
aggaaagcccatgacgacgctgtga

SEQ ID NO: 138183 - DNA, 25 bp, Rattus norvegicus
aggaaagcctatagcacctctcagc

SEQ ID NO: 138184 - DNA, 25 bp, Rattus norvegicus
aggaaagcctattgcacctctcagc

SEQ ID NO: 138185 - DNA, 25 bp, Rattus norvegicus
aggaaagccttccttgcttaaagcg

SEQ ID NO: 138186 - DNA, 25 bp, Rattus norvegicus
aggaaagccttcgttgcttaaagcg

SEQ ID NO: 138187 - DNA, 25 bp, Rattus norvegicus
aggaaagctccactgggaaccagga

SEQ ID NO: 138188 - DNA, 25 bp, Rattus norvegicus
aggaaagctccagtgggaaccagga

SEQ ID NO: 138189 - DNA, 25 bp, Rattus norvegicus
aggaaagctgacaccatcacacaca

SEQ ID NO: 138190 - DNA, 25 bp, Rattus norvegicus
aggaaagctgactccatcacacaca

SEQ ID NO: 138191 - DNA, 25 bp, Rattus norvegicus
aggaaagctggacttctgcagcgcc

SEQ ID NO: 138192 - DNA, 25 bp, Rattus norvegicus
aggaaagctggagttctgcagcgcc

SEQ ID NO: 138193 - DNA, 25 bp, Rattus norvegicus
aggaaagctgttagcaatcctcctc

SEQ ID NO: 138194 - DNA, 25 bp, Rattus norvegicus
aggaaagctgtttgcaatcctcctc

SEQ ID NO: 138195 - DNA, 25 bp, Rattus norvegicus
aggaaagcttgcactaccaggctgc

SEQ ID NO: 138196 - DNA, 25 bp, Rattus norvegicus
aggaaagcttgctctaccaggctgc

SEQ ID NO: 138197 - DNA, 25 bp, Rattus norvegicus
aggaaaggacgacttgaggccattt

SEQ ID NO: 138198 - DNA, 25 bp, Rattus norvegicus
aggaaaggacgagttgaggccattt

SEQ ID NO: 138199 - DNA, 25 bp, Rattus norvegicus
aggaaaggagccacacttggacttg

SEQ ID NO: 138200 - DNA, 25 bp, Rattus norvegicus
aggaaaggagccagcttggcccata

SEQ ID NO: 138201 - DNA, 25 bp, Rattus norvegicus
aggaaaggagcctcacttggacttg

SEQ ID NO: 138202 - DNA, 25 bp, Rattus norvegicus
aggaaaggagcctgcttggcccata

SEQ ID NO: 138203 - DNA, 25 bp, Rattus norvegicus
aggaaaggaggtcctacctgcctgc

SEQ ID NO: 138204 - DNA, 25 bp, Rattus norvegicus
aggaaaggaggtgctacctgcctgc

SEQ ID NO: 138205 - DNA, 25 bp, Rattus norvegicus
aggaaaggatgcagctccaacagcc

SEQ ID NO: 138206 - DNA, 25 bp, Rattus norvegicus
aggaaaggatgctgctccaacagcc

SEQ ID NO: 138207 - DNA, 25 bp, Rattus norvegicus
aggaaaggctccatgctgttggcaa

SEQ ID NO: 138208 - DNA, 25 bp, Rattus norvegicus
aggaaaggctccttgctgttggcaa

SEQ ID NO: 138209 - DNA, 25 bp, Rattus norvegicus
aggaaaggcttaattggctcaccca

SEQ ID NO: 138210 - DNA, 25 bp, Rattus norvegicus
aggaaaggcttatttggctcaccca

SEQ ID NO: 138211 - DNA, 25 bp, Rattus norvegicus
aggaaaggcttcacccaggacggag

SEQ ID NO: 138212 - DNA, 25 bp, Rattus norvegicus
aggaaaggcttctcccaggacggag

SEQ ID NO: 138213 - DNA, 25 bp, Rattus norvegicus
aggaaagggcctagacatctccatc

SEQ ID NO: 138214 - DNA, 25 bp, Rattus norvegicus
aggaaagggccttgacatctccatc

SEQ ID NO: 138215 - DNA, 25 bp, Rattus norvegicus
aggaaagggcttccggcccaacagc

SEQ ID NO: 138216 - DNA, 25 bp, Rattus norvegicus
aggaaagggcttgcggcccaacagc

SEQ ID NO: 138217 - DNA, 25 bp, Rattus norvegicus
aggaaagtaagcagccatccctctg

SEQ ID NO: 138218 - DNA, 25 bp, Rattus norvegicus
aggaaagtaagctgccatccctctg

SEQ ID NO: 138219 - DNA, 25 bp, Rattus norvegicus
aggaaagtccctctctagcatcatt

SEQ ID NO: 138220 - DNA, 25 bp, Rattus norvegicus
aggaaagtccctgtctagcatcatt

SEQ ID NO: 138221 - DNA, 25 bp, Rattus norvegicus
aggaaagtgcaccatcagccagagc

SEQ ID NO: 138222 - DNA, 25 bp, Rattus norvegicus
aggaaagtgcacgatcagccagagc

SEQ ID NO: 138223 - DNA, 25 bp, Rattus norvegicus
aggaaagtggcacgcctctctgtaa

SEQ ID NO: 138224 - DNA, 25 bp, Rattus norvegicus
aggaaagtggcaggcctctctgtaa

SEQ ID NO: 138225 - DNA, 25 bp, Rattus norvegicus
aggaaagtgtgtatttgccgtctcg

SEQ ID NO: 138226 - DNA, 25 bp, Rattus norvegicus
aggaaagtgtgtttttgccgtctcg

SEQ ID NO: 138227 - DNA, 25 bp, Rattus norvegicus
aggaaataactaagcactgctttgc

SEQ ID NO: 138228 - DNA, 25 bp, Rattus norvegicus
aggaaataactatgcactgctttgc

SEQ ID NO: 138229 - DNA, 25 bp, Rattus norvegicus
aggaaataactgcactggctcccag

SEQ ID NO: 138230 - DNA, 25 bp, Rattus norvegicus
aggaaataactggactggctcccag

SEQ ID NO: 138231 - DNA, 25 bp, Rattus norvegicus
aggaaatacaccattcaggcagcca

SEQ ID NO: 138232 - DNA, 25 bp, Rattus norvegicus
aggaaatacacctttcaggcagcca

SEQ ID NO: 138233 - DNA, 25 bp, Rattus norvegicus
aggaaatagtccactcctctcatgt

SEQ ID NO: 138234 - DNA, 25 bp, Rattus norvegicus
aggaaatagtcctctcctctcatgt

SEQ ID NO: 138235 - DNA, 25 bp, Rattus norvegicus
aggaaatatcttcgtgctgtccctt

SEQ ID NO: 138236 - DNA, 25 bp, Rattus norvegicus
aggaaatatcttggtgctgtccctt

SEQ ID NO: 138237 - DNA, 25 bp, Rattus norvegicus
aggaaatattctcccacactgctca

SEQ ID NO: 138238 - DNA, 25 bp, Rattus norvegicus
aggaaatattctgccacactgctca

SEQ ID NO: 138239 - DNA, 25 bp, Rattus norvegicus
aggaaatatttcatgtcccctaaat

SEQ ID NO: 138240 - DNA, 25 bp, Rattus norvegicus
aggaaatatttcttgtcccctaaat

SEQ ID NO: 138241 - DNA, 25 bp, Rattus norvegicus
aggaaatcaaatcccattgtcacct

SEQ ID NO: 138242 - DNA, 25 bp, Rattus norvegicus
aggaaatcaaatgccattgtcacct

SEQ ID NO: 138243 - DNA, 25 bp, Rattus norvegicus
aggaaatcagggaccacacacactt

SEQ ID NO: 138244 - DNA, 25 bp, Rattus norvegicus
aggaaatcagggtccacacacactt

SEQ ID NO: 138245 - DNA, 25 bp, Rattus norvegicus
aggaaatcatcacgcctgtggcttt

SEQ ID NO: 138246 - DNA, 25 bp, Rattus norvegicus
aggaaatcatcaggcctgtggcttt

SEQ ID NO: 138247 - DNA, 25 bp, Rattus norvegicus
aggaaatcatgacctcacatgcccc

SEQ ID NO: 138248 - DNA, 25 bp, Rattus norvegicus
aggaaatcatgagctcacatgcccc

SEQ ID NO: 138249 - DNA, 25 bp, Rattus norvegicus
aggaaatccacactgacattctcac

SEQ ID NO: 138250 - DNA, 25 bp, Rattus norvegicus
aggaaatccacagtgacattctcac

SEQ ID NO: 138251 - DNA, 25 bp, Rattus norvegicus
aggaaatcccatcaactccaaaagg

SEQ ID NO: 138252 - DNA, 25 bp, Rattus norvegicus
aggaaatcccatgaactccaaaagg

SEQ ID NO: 138253 - DNA, 25 bp, Rattus norvegicus
aggaaatcccctcattatcaactac

SEQ ID NO: 138254 - DNA, 25 bp, Rattus norvegicus
aggaaatcccctgattatcaactac

SEQ ID NO: 138255 - DNA, 25 bp, Rattus norvegicus
aggaaatcccttattgcactctgaa

SEQ ID NO: 138256 - DNA, 25 bp, Rattus norvegicus
aggaaatccctttttgcactctgaa

SEQ ID NO: 138257 - DNA, 25 bp, Rattus norvegicus
aggaaatcctaactacccacatgag

SEQ ID NO: 138258 - DNA, 25 bp, Rattus norvegicus
aggaaatcctaagtacccacatgag

SEQ ID NO: 138259 - DNA, 25 bp, Rattus norvegicus
aggaaatcctccagcctagagacat

SEQ ID NO: 138260 - DNA, 25 bp, Rattus norvegicus
aggaaatcctcctgcctagagacat

SEQ ID NO: 138261 - DNA, 25 bp, Rattus norvegicus
aggaaatcctctcccaatgtgggtt

SEQ ID NO: 138262 - DNA, 25 bp, Rattus norvegicus
aggaaatcctctgccaatgtgggtt

SEQ ID NO: 138263 - DNA, 25 bp, Rattus norvegicus
aggaaatcctgccagttatactcag

SEQ ID NO: 138264 - DNA, 25 bp, Rattus norvegicus
aggaaatcctgcgagttatactcag

SEQ ID NO: 138265 - DNA, 25 bp, Rattus norvegicus
aggaaatcgcccagccttgaacttt

SEQ ID NO: 138266 - DNA, 25 bp, Rattus norvegicus
aggaaatcgccctgccttgaacttt

SEQ ID NO: 138267 - DNA, 25 bp, Rattus norvegicus
aggaaatctgatagctgctgaataa

SEQ ID NO: 138268 - DNA, 25 bp, Rattus norvegicus
aggaaatctgattgctgctgaataa

SEQ ID NO: 138269 - DNA, 25 bp, Rattus norvegicus
aggaaatctggtctcacttctccac

SEQ ID NO: 138270 - DNA, 25 bp, Rattus norvegicus
aggaaatctggtgtcacttctccac

SEQ ID NO: 138271 - DNA, 25 bp, Rattus norvegicus
aggaaatgaattagcctacccctct

SEQ ID NO: 138272 - DNA, 25 bp, Rattus norvegicus
aggaaatgaatttgcctacccctct

SEQ ID NO: 138273 - DNA, 25 bp, Rattus norvegicus
aggaaatgagccctctaccttctga

SEQ ID NO: 138274 - DNA, 25 bp, Rattus norvegicus
aggaaatgagccgtctaccttctga

SEQ ID NO: 138275 - DNA, 25 bp, Rattus norvegicus
aggaaatgatccagtcagcctggcc

SEQ ID NO: 138276 - DNA, 25 bp, Rattus norvegicus
aggaaatgatcctgtcagcctggcc

SEQ ID NO: 138277 - DNA, 25 bp, Rattus norvegicus
aggaaatgcaataccaagttccatt

SEQ ID NO: 138278 - DNA, 25 bp, Rattus norvegicus
aggaaatgcaattccaagttccatt

SEQ ID NO: 138279 - DNA, 25 bp, Rattus norvegicus
aggaaatgcactagaggctcaaggc

SEQ ID NO: 138280 - DNA, 25 bp, Rattus norvegicus
aggaaatgcacttgaggctcaaggc

SEQ ID NO: 138281 - DNA, 25 bp, Rattus norvegicus
aggaaatgccctagctgtgcaggct

SEQ ID NO: 138282 - DNA, 25 bp, Rattus norvegicus
aggaaatgcccttgctgtgcaggct

SEQ ID NO: 138283 - DNA, 25 bp, Rattus norvegicus
aggaaatgcttcattgtctttgtgc

SEQ ID NO: 138284 - DNA, 25 bp, Rattus norvegicus
aggaaatgcttctttgtctttgtgc

SEQ ID NO: 138285 - DNA, 25 bp, Rattus norvegicus
aggaaatggcaactcagctcgcctt

SEQ ID NO: 138286 - DNA, 25 bp, Rattus norvegicus
aggaaatggcaagtcagctcgcctt

SEQ ID NO: 138287 - DNA, 25 bp, Rattus norvegicus
aggaaatggctgatccttcccagaa

SEQ ID NO: 138288 - DNA, 25 bp, Rattus norvegicus
aggaaatggctgttccttcccagaa

SEQ ID NO: 138289 - DNA, 25 bp, Rattus norvegicus
aggaaatggtgacctccaagctgcc

SEQ ID NO: 138290 - DNA, 25 bp, Rattus norvegicus
aggaaatggtgagctccaagctgcc

SEQ ID NO: 138291 - DNA, 25 bp, Rattus norvegicus
aggaaatgtaccagacgctcgccgc

SEQ ID NO: 138292 - DNA, 25 bp, Rattus norvegicus
aggaaatgtacctgacgctcgccgc

SEQ ID NO: 138293 - DNA, 25 bp, Rattus norvegicus
aggaaatgtagactcacctccctct

SEQ ID NO: 138294 - DNA, 25 bp, Rattus norvegicus
aggaaatgtagagtcacctccctct

SEQ ID NO: 138295 - DNA, 25 bp, Rattus norvegicus
aggaaatgtctgctctactccacat

SEQ ID NO: 138296 - DNA, 25 bp, Rattus norvegicus
aggaaatgtctggtctactccacat

SEQ ID NO: 138297 - DNA, 25 bp, Rattus norvegicus
aggaaatgtcttcttccactcaggc

SEQ ID NO: 138298 - DNA, 25 bp, Rattus norvegicus
aggaaatgtcttgttccactcaggc

SEQ ID NO: 138299 - DNA, 25 bp, Rattus norvegicus
aggaaatgtgacaccgcttctttct

SEQ ID NO: 138300 - DNA, 25 bp, Rattus norvegicus
aggaaatgtgactccgcttctttct

SEQ ID NO: 138301 - DNA, 25 bp, Rattus norvegicus
aggaaatgttttcccacaccattgg

SEQ ID NO: 138302 - DNA, 25 bp, Rattus norvegicus
aggaaatgttttgccacaccattgg

SEQ ID NO: 138303 - DNA, 25 bp, Rattus norvegicus
aggaaattagccagacaccagagaa

SEQ ID NO: 138304 - DNA, 25 bp, Rattus norvegicus
aggaaattagcctgacaccagagaa

SEQ ID NO: 138305 - DNA, 25 bp, Rattus norvegicus
aggaaattattacgcatcccaggct

SEQ ID NO: 138306 - DNA, 25 bp, Rattus norvegicus
aggaaattattaggcatcccaggct

SEQ ID NO: 138307 - DNA, 25 bp, Rattus norvegicus
aggaaattgcaaccccacctttgaa

SEQ ID NO: 138308 - DNA, 25 bp, Rattus norvegicus
aggaaattgcaagcccacctttgaa

SEQ ID NO: 138309 - DNA, 25 bp, Rattus norvegicus
aggaaattgccccaaatttgcctgg

SEQ ID NO: 138310 - DNA, 25 bp, Rattus norvegicus
aggaaattgcccgaaatttgcctgg

SEQ ID NO: 138311 - DNA, 25 bp, Rattus norvegicus
aggaaattgggacggagctacacat

SEQ ID NO: 138312 - DNA, 25 bp, Rattus norvegicus
aggaaattgggagggagctacacat

SEQ ID NO: 138313 - DNA, 25 bp, Rattus norvegicus
aggaaattgtgaacctctctactcc

SEQ ID NO: 138314 - DNA, 25 bp, Rattus norvegicus
aggaaattgtgatcctctctactcc

SEQ ID NO: 138315 - DNA, 25 bp, Rattus norvegicus
aggaaattgttaccaacctttgcaa

SEQ ID NO: 138316 - DNA, 25 bp, Rattus norvegicus
aggaaattgttagcaacctttgcaa

SEQ ID NO: 138317 - DNA, 25 bp, Rattus norvegicus
aggaaattttgcaatcctcccaatc

SEQ ID NO: 138318 - DNA, 25 bp, Rattus norvegicus
aggaaattttgctatcctcccaatc

SEQ ID NO: 138319 - DNA, 25 bp, Rattus norvegicus
aggaaattttttcctcttgaagagg

SEQ ID NO: 138320 - DNA, 25 bp, Rattus norvegicus
aggaaattttttgctcttgaagagg

SEQ ID NO: 138321 - DNA, 25 bp, Rattus norvegicus
aggaacaaagacctcttcagccagc

SEQ ID NO: 138322 - DNA, 25 bp, Rattus norvegicus
aggaacaaagacgtcttcagccagc

SEQ ID NO: 138323 - DNA, 25 bp, Rattus norvegicus
aggaacaacagccaccaggatgaag

SEQ ID NO: 138324 - DNA, 25 bp, Rattus norvegicus
aggaacaacagcgaccaggatgaag

SEQ ID NO: 138325 - DNA, 25 bp, Rattus norvegicus
aggaacaacggacacctgagcccct

SEQ ID NO: 138326 - DNA, 25 bp, Rattus norvegicus
aggaacaacggagacctgagcccct

SEQ ID NO: 138327 - DNA, 25 bp, Rattus norvegicus
aggaacaacttcacagcactttaca

SEQ ID NO: 138328 - DNA, 25 bp, Rattus norvegicus
aggaacaacttctcagcactttaca

SEQ ID NO: 138329 - DNA, 25 bp, Rattus norvegicus
aggaacaatccaagtccctgagctt

SEQ ID NO: 138330 - DNA, 25 bp, Rattus norvegicus
aggaacaatccatgtccctgagctt

SEQ ID NO: 138331 - DNA, 25 bp, Rattus norvegicus
aggaacaatgctcactggcttcatc

SEQ ID NO: 138332 - DNA, 25 bp, Rattus norvegicus
aggaacaatgctgactggcttcatc

SEQ ID NO: 138333 - DNA, 25 bp, Rattus norvegicus
aggaacacactccaaactggccgga

SEQ ID NO: 138334 - DNA, 25 bp, Rattus norvegicus
aggaacacactcgaaactggccgga

SEQ ID NO: 138335 - DNA, 25 bp, Rattus norvegicus
aggaacacagtgaccgctgagctca

SEQ ID NO: 138336 - DNA, 25 bp, Rattus norvegicus
aggaacacagtgtccgctgagctca

SEQ ID NO: 138337 - DNA, 25 bp, Rattus norvegicus
aggaacaccactatgaggccattgc

SEQ ID NO: 138338 - DNA, 25 bp, Rattus norvegicus
aggaacaccactttgaggccattgc

SEQ ID NO: 138339 - DNA, 25 bp, Rattus norvegicus
aggaacaccattactctgcagcttt

SEQ ID NO: 138340 - DNA, 25 bp, Rattus norvegicus
aggaacaccatttctctgcagcttt

SEQ ID NO: 138341 - DNA, 25 bp, Rattus norvegicus
aggaacaccccgaacttgttgcagc

SEQ ID NO: 138342 - DNA, 25 bp, Rattus norvegicus
aggaacaccccgtacttgttgcagc

SEQ ID NO: 138343 - DNA, 25 bp, Rattus norvegicus
aggaacaccggcagccttctgcagg

SEQ ID NO: 138344 - DNA, 25 bp, Rattus norvegicus
aggaacaccggctgccttctgcagg

SEQ ID NO: 138345 - DNA, 25 bp, Rattus norvegicus
aggaacacctggagcctgctgagtc

SEQ ID NO: 138346 - DNA, 25 bp, Rattus norvegicus
aggaacacctggtgcctgctgagtc

SEQ ID NO: 138347 - DNA, 25 bp, Rattus norvegicus
aggaacactaccagcttgtagccag

SEQ ID NO: 138348 - DNA, 25 bp, Rattus norvegicus
aggaacactacctgcttgtagccag

SEQ ID NO: 138349 - DNA, 25 bp, Rattus norvegicus
aggaacactcctcctcactggagga

SEQ ID NO: 138350 - DNA, 25 bp, Rattus norvegicus
aggaacactcctgctcactggagga

SEQ ID NO: 138351 - DNA, 25 bp, Rattus norvegicus
aggaacactgatataacccattggt

SEQ ID NO: 138352 - DNA, 25 bp, Rattus norvegicus
aggaacactgatttaacccattggt

SEQ ID NO: 138353 - DNA, 25 bp, Rattus norvegicus
aggaacactgcaagctaagtacggg

SEQ ID NO: 138354 - DNA, 25 bp, Rattus norvegicus
aggaacactgcatgctaagtacggg

SEQ ID NO: 138355 - DNA, 25 bp, Rattus norvegicus
aggaacactgccatcgctcatatac

SEQ ID NO: 138356 - DNA, 25 bp, Rattus norvegicus
aggaacactgccttcgctcatatac

SEQ ID NO: 138357 - DNA, 25 bp, Rattus norvegicus
aggaacactggcatgctgggactca

SEQ ID NO: 138358 - DNA, 25 bp, Rattus norvegicus
aggaacactggcttgctgggactca

SEQ ID NO: 138359 - DNA, 25 bp, Rattus norvegicus
aggaacactgtcagtttcagtacaa

SEQ ID NO: 138360 - DNA, 25 bp, Rattus norvegicus
aggaacactgtctgtttcagtacaa

SEQ ID NO: 138361 - DNA, 25 bp, Rattus norvegicus
aggaacacttcccatgtagggccat

SEQ ID NO: 138362 - DNA, 25 bp, Rattus norvegicus
aggaacacttccgatgtagggccat

SEQ ID NO: 138363 - DNA, 25 bp, Rattus norvegicus
aggaacacttgtccctgcaggatga

SEQ ID NO: 138364 - DNA, 25 bp, Rattus norvegicus
aggaacacttgtgcctgcaggatga

SEQ ID NO: 138365 - DNA, 25 bp, Rattus norvegicus
aggaacactttcaaacctcatctcc

SEQ ID NO: 138366 - DNA, 25 bp, Rattus norvegicus
aggaacactttctaacctcatctcc

SEQ ID NO: 138367 - DNA, 25 bp, Rattus norvegicus
aggaacagactcacagacatccctg

SEQ ID NO: 138368 - DNA, 25 bp, Rattus norvegicus
aggaacagactctcagacatccctg

SEQ ID NO: 138369 - DNA, 25 bp, Rattus norvegicus
aggaacagcctacacctcttttggt

SEQ ID NO: 138370 - DNA, 25 bp, Rattus norvegicus
aggaacagcctagacctcttttggt

SEQ ID NO: 138371 - DNA, 25 bp, Rattus norvegicus
aggaacagcctgacacatgcacggg

SEQ ID NO: 138372 - DNA, 25 bp, Rattus norvegicus
aggaacagcctgtcacatgcacggg

SEQ ID NO: 138373 - DNA, 25 bp, Rattus norvegicus
aggaacaggatgctaattgtgagct

SEQ ID NO: 138374 - DNA, 25 bp, Rattus norvegicus
aggaacaggatggtaattgtgagct

SEQ ID NO: 138375 - DNA, 25 bp, Rattus norvegicus
aggaacagtccgaggcctttcaggc

SEQ ID NO: 138376 - DNA, 25 bp, Rattus norvegicus
aggaacagtccgtggcctttcaggc

SEQ ID NO: 138377 - DNA, 25 bp, Rattus norvegicus
aggaacagtggcacggcccaggcat

SEQ ID NO: 138378 - DNA, 25 bp, Rattus norvegicus
aggaacagtggctcggcccaggcat

SEQ ID NO: 138379 - DNA, 25 bp, Rattus norvegicus
aggaacagtgttcgccagaactggt

SEQ ID NO: 138380 - DNA, 25 bp, Rattus norvegicus
aggaacagtgttggccagaactggt

SEQ ID NO: 138381 - DNA, 25 bp, Rattus norvegicus
aggaacagttggctgagctctcaaa

SEQ ID NO: 138382 - DNA, 25 bp, Rattus norvegicus
aggaacagttgggtgagctctcaaa

SEQ ID NO: 138383 - DNA, 25 bp, Rattus norvegicus
aggaacatgaatcgcactcctccag

SEQ ID NO: 138384 - DNA, 25 bp, Rattus norvegicus
aggaacatgaatggcactcctccag

SEQ ID NO: 138385 - DNA, 25 bp, Rattus norvegicus
aggaacatgcaccttcaccctgctt

SEQ ID NO: 138386 - DNA, 25 bp, Rattus norvegicus
aggaacatgcacgttcaccctgctt

SEQ ID NO: 138387 - DNA, 25 bp, Rattus norvegicus
aggaacatgccgacattgccagggt

SEQ ID NO: 138388 - DNA, 25 bp, Rattus norvegicus
aggaacatgccgtcattgccagggt

SEQ ID NO: 138389 - DNA, 25 bp, Rattus norvegicus
aggaacattcctcgttgccagtgtc

SEQ ID NO: 138390 - DNA, 25 bp, Rattus norvegicus
aggaacattcctggttgccagtgtc

SEQ ID NO: 138391 - DNA, 25 bp, Rattus norvegicus
aggaaccacacacctctgagaggaa

SEQ ID NO: 138392 - DNA, 25 bp, Rattus norvegicus
aggaaccacacagctctgagaggaa

SEQ ID NO: 138393 - DNA, 25 bp, Rattus norvegicus
aggaaccagggaccttccccaggag

SEQ ID NO: 138394 - DNA, 25 bp, Rattus norvegicus
aggaaccagggagcttccccaggag

SEQ ID NO: 138395 - DNA, 25 bp, Rattus norvegicus
aggaaccagttcactagaccccatg

SEQ ID NO: 138396 - DNA, 25 bp, Rattus norvegicus
aggaaccagttctctagaccccatg

SEQ ID NO: 138397 - DNA, 25 bp, Rattus norvegicus
aggaaccatcccagaaggcattaag

SEQ ID NO: 138398 - DNA, 25 bp, Rattus norvegicus
aggaaccatccctgaaggcattaag

SEQ ID NO: 138399 - DNA, 25 bp, Rattus norvegicus
aggaaccatggacacagcaggaatt

SEQ ID NO: 138400 - DNA, 25 bp, Rattus norvegicus
aggaaccatggagacagcaggaatt

SEQ ID NO: 138401 - DNA, 25 bp, Rattus norvegicus
aggaaccattacacaatttgctcat

SEQ ID NO: 138402 - DNA, 25 bp, Rattus norvegicus
aggaaccattactcaatttgctcat

SEQ ID NO: 138403 - DNA, 25 bp, Rattus norvegicus
aggaaccattgtatgagctttgtac

SEQ ID NO: 138404 - DNA, 25 bp, Rattus norvegicus
aggaaccattgtttgagctttgtac

SEQ ID NO: 138405 - DNA, 25 bp, Rattus norvegicus
aggaacccagccacctgtattttga

SEQ ID NO: 138406 - DNA, 25 bp, Rattus norvegicus
aggaacccagcctcctgtattttga

SEQ ID NO: 138407 - DNA, 25 bp, Rattus norvegicus
aggaacccaggcagcccgctgcgtg

SEQ ID NO: 138408 - DNA, 25 bp, Rattus norvegicus
aggaacccaggctgcccgctgcgtg

SEQ ID NO: 138409 - DNA, 25 bp, Rattus norvegicus
aggaacccatagatggccaggcaga

SEQ ID NO: 138410 - DNA, 25 bp, Rattus norvegicus
aggaacccatagttggccaggcaga

SEQ ID NO: 138411 - DNA, 25 bp, Rattus norvegicus
aggaacccatttaccagctaagagt

SEQ ID NO: 138412 - DNA, 25 bp, Rattus norvegicus
aggaacccattttccagctaagagt

SEQ ID NO: 138413 - DNA, 25 bp, Rattus norvegicus
aggaaccccaatcctgactggtcag

SEQ ID NO: 138414 - DNA, 25 bp, Rattus norvegicus
aggaaccccaatgctgactggtcag

SEQ ID NO: 138415 - DNA, 25 bp, Rattus norvegicus
aggaacccctagacctatcacagta

SEQ ID NO: 138416 - DNA, 25 bp, Rattus norvegicus
aggaacccctagtcctatcacagta

SEQ ID NO: 138417 - DNA, 25 bp, Rattus norvegicus
aggaacccctctctgaagcagcaac

SEQ ID NO: 138418 - DNA, 25 bp, Rattus norvegicus
aggaacccctctgtgaagcagcaac

SEQ ID NO: 138419 - DNA, 25 bp, Rattus norvegicus
aggaacccgtctctcaagcagcagc

SEQ ID NO: 138420 - DNA, 25 bp, Rattus norvegicus
aggaacccgtctgtcaagcagcagc

SEQ ID NO: 138421 - DNA, 25 bp, Rattus norvegicus
aggaaccctaagcagctgcacagca

SEQ ID NO: 138422 - DNA, 25 bp, Rattus norvegicus
aggaaccctaaggagctgcacagca

SEQ ID NO: 138423 - DNA, 25 bp, Rattus norvegicus
aggaaccctagactggcttttcttg

SEQ ID NO: 138424 - DNA, 25 bp, Rattus norvegicus
aggaaccctagagtggcttttcttg

SEQ ID NO: 138425 - DNA, 25 bp, Rattus norvegicus
aggaaccctggactctgtaatgtgt

SEQ ID NO: 138426 - DNA, 25 bp, Rattus norvegicus
aggaaccctggagtctgtaatgtgt

SEQ ID NO: 138427 - DNA, 25 bp, Rattus norvegicus
aggaaccctgtgaccagtcgtggaa

SEQ ID NO: 138428 - DNA, 25 bp, Rattus norvegicus
aggaaccctgtgtccagtcgtggaa

SEQ ID NO: 138429 - DNA, 25 bp, Rattus norvegicus
aggaaccggcgcatggagacgacca

SEQ ID NO: 138430 - DNA, 25 bp, Rattus norvegicus
aggaaccggcgcttggagacgacca

SEQ ID NO: 138431 - DNA, 25 bp, Rattus norvegicus
aggaaccggtggagaccgaccgcat

SEQ ID NO: 138432 - DNA, 25 bp, Rattus norvegicus
aggaaccggtggtgaccgaccgcat

SEQ ID NO: 138433 - DNA, 25 bp, Rattus norvegicus
aggaaccgtagcacttgaccatata

SEQ ID NO: 138434 - DNA, 25 bp, Rattus norvegicus
aggaaccgtagctcttgaccatata

SEQ ID NO: 138435 - DNA, 25 bp, Rattus norvegicus
aggaacctaaccactgcagctggta

SEQ ID NO: 138436 - DNA, 25 bp, Rattus norvegicus
aggaacctaacctctgcagctggta

SEQ ID NO: 138437 - DNA, 25 bp, Rattus norvegicus
aggaacctaggcataccatgtggga

SEQ ID NO: 138438 - DNA, 25 bp, Rattus norvegicus
aggaacctaggcttaccatgtggga

SEQ ID NO: 138439 - DNA, 25 bp, Rattus norvegicus
aggaacctgagaagccgggtcccag

SEQ ID NO: 138440 - DNA, 25 bp, Rattus norvegicus
aggaacctgagatgccgggtcccag

SEQ ID NO: 138441 - DNA, 25 bp, Rattus norvegicus
aggaacctgcacattcgtttgttat

SEQ ID NO: 138442 - DNA, 25 bp, Rattus norvegicus
aggaacctgcactttcgtttgttat

SEQ ID NO: 138443 - DNA, 25 bp, Rattus norvegicus
aggaacctggaactgaggcccctgc

SEQ ID NO: 138444 - DNA, 25 bp, Rattus norvegicus
aggaacctggaagtgaggcccctgc

SEQ ID NO: 138445 - DNA, 25 bp, Rattus norvegicus
aggaacctggacagagactgcttca

SEQ ID NO: 138446 - DNA, 25 bp, Rattus norvegicus
aggaacctggactgagactgcttca

SEQ ID NO: 138447 - DNA, 25 bp, Rattus norvegicus
aggaacctggataccctctaagagt

SEQ ID NO: 138448 - DNA, 25 bp, Rattus norvegicus
aggaacctggattccctctaagagt

SEQ ID NO: 138449 - DNA, 25 bp, Rattus norvegicus
aggaacctggcaatgcacctctctg

SEQ ID NO: 138450 - DNA, 25 bp, Rattus norvegicus
aggaacctggcattgcacctctctg

SEQ ID NO: 138451 - DNA, 25 bp, Rattus norvegicus
aggaacctggtcaaggctagctcct

SEQ ID NO: 138452 - DNA, 25 bp, Rattus norvegicus
aggaacctggtctaggctagctcct

SEQ ID NO: 138453 - DNA, 25 bp, Rattus norvegicus
aggaacctgtctccggctgtgaacc

SEQ ID NO: 138454 - DNA, 25 bp, Rattus norvegicus
aggaacctgtctgcggctgtgaacc

SEQ ID NO: 138455 - DNA, 25 bp, Rattus norvegicus
aggaacctgttcacggcctcggagc

SEQ ID NO: 138456 - DNA, 25 bp, Rattus norvegicus
aggaacctgttctcggcctcggagc

SEQ ID NO: 138457 - DNA, 25 bp, Rattus norvegicus
aggaaccttctgaccatacagcggt

SEQ ID NO: 138458 - DNA, 25 bp, Rattus norvegicus
aggaaccttctgagtgccttacaca

SEQ ID NO: 138459 - DNA, 25 bp, Rattus norvegicus
aggaaccttctgtccatacagcggt

SEQ ID NO: 138460 - DNA, 25 bp, Rattus norvegicus
aggaaccttctgtgtgccttacaca

SEQ ID NO: 138461 - DNA, 25 bp, Rattus norvegicus
aggaaccttgaacaactctgtacat

SEQ ID NO: 138462 - DNA, 25 bp, Rattus norvegicus
aggaaccttgaagaactctgtacat

SEQ ID NO: 138463 - DNA, 25 bp, Rattus norvegicus
aggaaccttgagaactgtgggcaat

SEQ ID NO: 138464 - DNA, 25 bp, Rattus norvegicus
aggaaccttgagtactgtgggcaat

SEQ ID NO: 138465 - DNA, 25 bp, Rattus norvegicus
aggaaccttggtatctgtctagaac

SEQ ID NO: 138466 - DNA, 25 bp, Rattus norvegicus
aggaaccttggtttctgtctagaac

SEQ ID NO: 138467 - DNA, 25 bp, Rattus norvegicus
aggaacctttccaaacagtggaatg

SEQ ID NO: 138468 - DNA, 25 bp, Rattus norvegicus
aggaacctttcctaacagtggaatg

SEQ ID NO: 138469 - DNA, 25 bp, Rattus norvegicus
aggaacctttggcatctgctgcagt

SEQ ID NO: 138470 - DNA, 25 bp, Rattus norvegicus
aggaacctttgggatctgctgcagt

SEQ ID NO: 138471 - DNA, 25 bp, Rattus norvegicus
aggaacgaaacgcagcctggctcag

SEQ ID NO: 138472 - DNA, 25 bp, Rattus norvegicus
aggaacgaaacggagcctggctcag

SEQ ID NO: 138473 - DNA, 25 bp, Rattus norvegicus
aggaacgaaggcacagtctccggtt

SEQ ID NO: 138474 - DNA, 25 bp, Rattus norvegicus
aggaacgaaggctcagtctccggtt

SEQ ID NO: 138475 - DNA, 25 bp, Rattus norvegicus
aggaacgagcccagggtatagtcct

SEQ ID NO: 138476 - DNA, 25 bp, Rattus norvegicus
aggaacgagccctgggtatagtcct

SEQ ID NO: 138477 - DNA, 25 bp, Rattus norvegicus
aggaacgagctgctcctctggtcag

SEQ ID NO: 138478 - DNA, 25 bp, Rattus norvegicus
aggaacgagctggtcctctggtcag

SEQ ID NO: 138479 - DNA, 25 bp, Rattus norvegicus
aggaacgatacacgtcctctgaaga

SEQ ID NO: 138480 - DNA, 25 bp, Rattus norvegicus
aggaacgatacaggtcctctgaaga

SEQ ID NO: 138481 - DNA, 25 bp, Rattus norvegicus
aggaacgatttcacaccatcacaac

SEQ ID NO: 138482 - DNA, 25 bp, Rattus norvegicus
aggaacgatttctcaccatcacaac

SEQ ID NO: 138483 - DNA, 25 bp, Rattus norvegicus
aggaacgccgcaacaccaggccttg

SEQ ID NO: 138484 - DNA, 25 bp, Rattus norvegicus
aggaacgccgcatcaccaggccttg

SEQ ID NO: 138485 - DNA, 25 bp, Rattus norvegicus
aggaacgcctagactctgcacaagc

SEQ ID NO: 138486 - DNA, 25 bp, Rattus norvegicus
aggaacgcctagtctctgcacaagc

SEQ ID NO: 138487 - DNA, 25 bp, Rattus norvegicus
aggaacggaatcatgttttctgaca

SEQ ID NO: 138488 - DNA, 25 bp, Rattus norvegicus
aggaacggaatcttgttttctgaca

SEQ ID NO: 138489 - DNA, 25 bp, Rattus norvegicus
aggaacgggcacaactacaggactc

SEQ ID NO: 138490 - DNA, 25 bp, Rattus norvegicus
aggaacgggcactactacaggactc

SEQ ID NO: 138491 - DNA, 25 bp, Rattus norvegicus
aggaacgggctcctcttttactcag

SEQ ID NO: 138492 - DNA, 25 bp, Rattus norvegicus
aggaacgggctcgtcttttactcag

SEQ ID NO: 138493 - DNA, 25 bp, Rattus norvegicus
aggaacgtaattagcttgccaagcc

SEQ ID NO: 138494 - DNA, 25 bp, Rattus norvegicus
aggaacgtaatttgcttgccaagcc

SEQ ID NO: 138495 - DNA, 25 bp, Rattus norvegicus
aggaacgtcacgagcgggcttacct

SEQ ID NO: 138496 - DNA, 25 bp, Rattus norvegicus
aggaacgtcacgtgcgggcttacct

SEQ ID NO: 138497 - DNA, 25 bp, Rattus norvegicus
aggaacgtccgcagtgccttcacga

SEQ ID NO: 138498 - DNA, 25 bp, Rattus norvegicus
aggaacgtccgctgtgccttcacga

SEQ ID NO: 138499 - DNA, 25 bp, Rattus norvegicus
aggaacgtcctgactctgcggtgca

SEQ ID NO: 138500 - DNA, 25 bp, Rattus norvegicus
aggaacgtcctgtctctgcggtgca

SEQ ID NO: 138501 - DNA, 25 bp, Rattus norvegicus
aggaacgtctttcgcactgcgagtg

SEQ ID NO: 138502 - DNA, 25 bp, Rattus norvegicus
aggaacgtctttggcactgcgagtg

SEQ ID NO: 138503 - DNA, 25 bp, Rattus norvegicus
aggaacgtgctgcaagaggctctcc

SEQ ID NO: 138504 - DNA, 25 bp, Rattus norvegicus
aggaacgtgctggaagaggctctcc

SEQ ID NO: 138505 - DNA, 25 bp, Rattus norvegicus
aggaacgtgcttatttgtacacatt

SEQ ID NO: 138506 - DNA, 25 bp, Rattus norvegicus
aggaacgtgcttttttgtacacatt

SEQ ID NO: 138507 - DNA, 25 bp, Rattus norvegicus
aggaacgtgttgctagccctggcac

SEQ ID NO: 138508 - DNA, 25 bp, Rattus norvegicus
aggaacgtgttggtagccctggcac

SEQ ID NO: 138509 - DNA, 25 bp, Rattus norvegicus
aggaacgtgtttagggtgtcatcat

SEQ ID NO: 138510 - DNA, 25 bp, Rattus norvegicus
aggaacgtgttttgggtgtcatcat

SEQ ID NO: 138511 - DNA, 25 bp, Rattus norvegicus
aggaacgttcctatgcttctgtgga

SEQ ID NO: 138512 - DNA, 25 bp, Rattus norvegicus
aggaacgttcctttgcttctgtgga

SEQ ID NO: 138513 - DNA, 25 bp, Rattus norvegicus
aggaactaacctaactctgtctcaa

SEQ ID NO: 138514 - DNA, 25 bp, Rattus norvegicus
aggaactaaccttactctgtctcaa

SEQ ID NO: 138515 - DNA, 25 bp, Rattus norvegicus
aggaactacgttcatccacttgagc

SEQ ID NO: 138516 - DNA, 25 bp, Rattus norvegicus
aggaactacgttgatccacttgagc

SEQ ID NO: 138517 - DNA, 25 bp, Rattus norvegicus
aggaactagggccagcaggagctgc

SEQ ID NO: 138518 - DNA, 25 bp, Rattus norvegicus
aggaactagggcgagcaggagctgc

SEQ ID NO: 138519 - DNA, 25 bp, Rattus norvegicus
aggaactcacctctgtatgggcaag

SEQ ID NO: 138520 - DNA, 25 bp, Rattus norvegicus
aggaactcacctgtgtatgggcaag

SEQ ID NO: 138521 - DNA, 25 bp, Rattus norvegicus
aggaactcagccctggacacttggg

SEQ ID NO: 138522 - DNA, 25 bp, Rattus norvegicus
aggaactcagccgtggacacttggg

SEQ ID NO: 138523 - DNA, 25 bp, Rattus norvegicus
aggaactcagctattgatacacagt

SEQ ID NO: 138524 - DNA, 25 bp, Rattus norvegicus
aggaactcagcttttgatacacagt

SEQ ID NO: 138525 - DNA, 25 bp, Rattus norvegicus
aggaactcatggacgctgcttaccc

SEQ ID NO: 138526 - DNA, 25 bp, Rattus norvegicus
aggaactcatggtcgctgcttaccc

SEQ ID NO: 138527 - DNA, 25 bp, Rattus norvegicus
aggaactccacaccggtgcatacag

SEQ ID NO: 138528 - DNA, 25 bp, Rattus norvegicus
aggaactccacagcggtgcatacag

SEQ ID NO: 138529 - DNA, 25 bp, Rattus norvegicus
aggaactcccatcgtggctgctagt

SEQ ID NO: 138530 - DNA, 25 bp, Rattus norvegicus
aggaactcccatggtggctgctagt

SEQ ID NO: 138531 - DNA, 25 bp, Rattus norvegicus
aggaactccccactagtctgcaggg

SEQ ID NO: 138532 - DNA, 25 bp, Rattus norvegicus
aggaactccccagtagtctgcaggg

SEQ ID NO: 138533 - DNA, 25 bp, Rattus norvegicus
aggaactcccgaatgtgatctcaca

SEQ ID NO: 138534 - DNA, 25 bp, Rattus norvegicus
aggaactcccgattgtgatctcaca

SEQ ID NO: 138535 - DNA, 25 bp, Rattus norvegicus
aggaactcctcaaactgcatgcagt

SEQ ID NO: 138536 - DNA, 25 bp, Rattus norvegicus
aggaactcctcatactgcatgcagt

SEQ ID NO: 138537 - DNA, 25 bp, Rattus norvegicus
aggaactcgcccaggatgcggtagc

SEQ ID NO: 138538 - DNA, 25 bp, Rattus norvegicus
aggaactcgcccatcttggagatct

SEQ ID NO: 138539 - DNA, 25 bp, Rattus norvegicus
aggaactcgccctggatgcggtagc

SEQ ID NO: 138540 - DNA, 25 bp, Rattus norvegicus
aggaactcgcccttcttggagatct

SEQ ID NO: 138541 - DNA, 25 bp, Rattus norvegicus
aggaactctctgctatcttatttgt

SEQ ID NO: 138542 - DNA, 25 bp, Rattus norvegicus
aggaactctctggtatcttatttgt

SEQ ID NO: 138543 - DNA, 25 bp, Rattus norvegicus
aggaactctgacatttggaaagtag

SEQ ID NO: 138544 - DNA, 25 bp, Rattus norvegicus
aggaactctgacttttggaaagtag

SEQ ID NO: 138545 - DNA, 25 bp, Rattus norvegicus
aggaactctgtaatagcctcccttc

SEQ ID NO: 138546 - DNA, 25 bp, Rattus norvegicus
aggaactctgtattagcctcccttc

SEQ ID NO: 138547 - DNA, 25 bp, Rattus norvegicus
aggaactctgtgacctgctttctcc

SEQ ID NO: 138548 - DNA, 25 bp, Rattus norvegicus
aggaactctgtgtcctgctttctcc

SEQ ID NO: 138549 - DNA, 25 bp, Rattus norvegicus
aggaactctgttctactgcgaaaca

SEQ ID NO: 138550 - DNA, 25 bp, Rattus norvegicus
aggaactctgttgtactgcgaaaca

SEQ ID NO: 138551 - DNA, 25 bp, Rattus norvegicus
aggaactgaaaccagtgcctcccat

SEQ ID NO: 138552 - DNA, 25 bp, Rattus norvegicus
aggaactgaaacgagtgcctcccat

SEQ ID NO: 138553 - DNA, 25 bp, Rattus norvegicus
aggaactgacagattaccgcttagt

SEQ ID NO: 138554 - DNA, 25 bp, Rattus norvegicus
aggaactgacagtttaccgcttagt

SEQ ID NO: 138555 - DNA, 25 bp, Rattus norvegicus
aggaactgacttcgacttgctacat

SEQ ID NO: 138556 - DNA, 25 bp, Rattus norvegicus
aggaactgacttggacttgctacat

SEQ ID NO: 138557 - DNA, 25 bp, Rattus norvegicus
aggaactgagaactgtgcttgcttt

SEQ ID NO: 138558 - DNA, 25 bp, Rattus norvegicus
aggaactgagaagtgtgcttgcttt

SEQ ID NO: 138559 - DNA, 25 bp, Rattus norvegicus
aggaactgagatatcccgccatctg

SEQ ID NO: 138560 - DNA, 25 bp, Rattus norvegicus
aggaactgagatttcccgccatctg

SEQ ID NO: 138561 - DNA, 25 bp, Rattus norvegicus
aggaactgatgtctgcctgactaga

SEQ ID NO: 138562 - DNA, 25 bp, Rattus norvegicus
aggaactgatgtgtgcctgactaga

SEQ ID NO: 138563 - DNA, 25 bp, Rattus norvegicus
aggaactgcaacattcaccatggct

SEQ ID NO: 138564 - DNA, 25 bp, Rattus norvegicus
aggaactgcaactttcaccatggct

SEQ ID NO: 138565 - DNA, 25 bp, Rattus norvegicus
aggaactgccaccattgtctggcga

SEQ ID NO: 138566 - DNA, 25 bp, Rattus norvegicus
aggaactgccacgattgtctggcga

SEQ ID NO: 138567 - DNA, 25 bp, Rattus norvegicus
aggaactgccccatttgtcgcctac

SEQ ID NO: 138568 - DNA, 25 bp, Rattus norvegicus
aggaactgccccttttgtcgcctac

SEQ ID NO: 138569 - DNA, 25 bp, Rattus norvegicus
aggaactgcttcctgtggaacgctc

SEQ ID NO: 138570 - DNA, 25 bp, Rattus norvegicus
aggaactgcttcgtgtggaacgctc

SEQ ID NO: 138571 - DNA, 25 bp, Rattus norvegicus
aggaactggccactgtcagaaccat

SEQ ID NO: 138572 - DNA, 25 bp, Rattus norvegicus
aggaactggccagtgtcagaaccat

SEQ ID NO: 138573 - DNA, 25 bp, Rattus norvegicus
aggaactggcccattctttctgcga

SEQ ID NO: 138574 - DNA, 25 bp, Rattus norvegicus
aggaactggccctttctttctgcga

SEQ ID NO: 138575 - DNA, 25 bp, Rattus norvegicus
aggaactggcgaaggtcactatcaa

SEQ ID NO: 138576 - DNA, 25 bp, Rattus norvegicus
aggaactggcgatggtcactatcaa

SEQ ID NO: 138577 - DNA, 25 bp, Rattus norvegicus
aggaactggctaagagacaccctct

SEQ ID NO: 138578 - DNA, 25 bp, Rattus norvegicus
aggaactggctacgactcccaatct

SEQ ID NO: 138579 - DNA, 25 bp, Rattus norvegicus
aggaactggctaggactcccaatct

SEQ ID NO: 138580 - DNA, 25 bp, Rattus norvegicus
aggaactggctatgagacaccctct

SEQ ID NO: 138581 - DNA, 25 bp, Rattus norvegicus
aggaactggctgctctactcgggaa

SEQ ID NO: 138582 - DNA, 25 bp, Rattus norvegicus
aggaactggctggtctactcgggaa

SEQ ID NO: 138583 - DNA, 25 bp, Rattus norvegicus
aggaactgggacacgtgccttctgc

SEQ ID NO: 138584 - DNA, 25 bp, Rattus norvegicus
aggaactgggactcgtgccttctgc

SEQ ID NO: 138585 - DNA, 25 bp, Rattus norvegicus
aggaactgggcactaacctacctct

SEQ ID NO: 138586 - DNA, 25 bp, Rattus norvegicus
aggaactgggcagtaacctacctct

SEQ ID NO: 138587 - DNA, 25 bp, Rattus norvegicus
aggaactgggtcattctgactccac

SEQ ID NO: 138588 - DNA, 25 bp, Rattus norvegicus
aggaactgggtctttctgactccac

SEQ ID NO: 138589 - DNA, 25 bp, Rattus norvegicus
aggaactggtctccggagcctcaga

SEQ ID NO: 138590 - DNA, 25 bp, Rattus norvegicus
aggaactggtctgcggagcctcaga

SEQ ID NO: 138591 - DNA, 25 bp, Rattus norvegicus
aggaactggtgaaggctaccctgaa

SEQ ID NO: 138592 - DNA, 25 bp, Rattus norvegicus
aggaactggtgatggctaccctgaa

SEQ ID NO: 138593 - DNA, 25 bp, Rattus norvegicus
aggaactgtattcactgctgctttc

SEQ ID NO: 138594 - DNA, 25 bp, Rattus norvegicus
aggaactgtattgactgctgctttc

SEQ ID NO: 138595 - DNA, 25 bp, Rattus norvegicus
aggaactgtccacgctgctgaaaaa

SEQ ID NO: 138596 - DNA, 25 bp, Rattus norvegicus
aggaactgtccaggctgctgaaaaa

SEQ ID NO: 138597 - DNA, 25 bp, Rattus norvegicus
aggaactgtctgactgggtgcgtat

SEQ ID NO: 138598 - DNA, 25 bp, Rattus norvegicus
aggaactgtctgtctgggtgcgtat

SEQ ID NO: 138599 - DNA, 25 bp, Rattus norvegicus
aggaactgtgtcacctgcccctgag

SEQ ID NO: 138600 - DNA, 25 bp, Rattus norvegicus
aggaactgtgtctcctgcccctgag

SEQ ID NO: 138601 - DNA, 25 bp, Rattus norvegicus
aggaacttacctcattcagtctgtt

SEQ ID NO: 138602 - DNA, 25 bp, Rattus norvegicus
aggaacttacctgattcagtctgtt

SEQ ID NO: 138603 - DNA, 25 bp, Rattus norvegicus
aggaacttcctgctattggtgctgc

SEQ ID NO: 138604 - DNA, 25 bp, Rattus norvegicus
aggaacttcctggtattggtgctgc

SEQ ID NO: 138605 - DNA, 25 bp, Rattus norvegicus
aggaacttctcaccctcgacaagaa

SEQ ID NO: 138606 - DNA, 25 bp, Rattus norvegicus
aggaacttctcagcctcgacaagaa

SEQ ID NO: 138607 - DNA, 25 bp, Rattus norvegicus
aggaacttgcaaatctggccacttt

SEQ ID NO: 138608 - DNA, 25 bp, Rattus norvegicus
aggaacttgcaaccgctctggcgag

SEQ ID NO: 138609 - DNA, 25 bp, Rattus norvegicus
aggaacttgcaagcgctctggcgag

SEQ ID NO: 138610 - DNA, 25 bp, Rattus norvegicus
aggaacttgcaattctggccacttt

SEQ ID NO: 138611 - DNA, 25 bp, Rattus norvegicus
aggaacttggctactcatactgaag

SEQ ID NO: 138612 - DNA, 25 bp, Rattus norvegicus
aggaacttggcttctcatactgaag

SEQ ID NO: 138613 - DNA, 25 bp, Rattus norvegicus
aggaacttgtccagagagctgtcgc

SEQ ID NO: 138614 - DNA, 25 bp, Rattus norvegicus
aggaacttgtccatgtctagcacat

SEQ ID NO: 138615 - DNA, 25 bp, Rattus norvegicus
aggaacttgtcctgagagctgtcgc

SEQ ID NO: 138616 - DNA, 25 bp, Rattus norvegicus
aggaacttgtccttgtctagcacat

SEQ ID NO: 138617 - DNA, 25 bp, Rattus norvegicus
aggaactttgatagagggctgctaa

SEQ ID NO: 138618 - DNA, 25 bp, Rattus norvegicus
aggaactttgattgagggctgctaa

SEQ ID NO: 138619 - DNA, 25 bp, Rattus norvegicus
aggaactttgtaatcatccagttgg

SEQ ID NO: 138620 - DNA, 25 bp, Rattus norvegicus
aggaactttgtattcatccagttgg

SEQ ID NO: 138621 - DNA, 25 bp, Rattus norvegicus
aggaagaaaccaccccaatccgcat

SEQ ID NO: 138622 - DNA, 25 bp, Rattus norvegicus
aggaagaaaccagcccaatccgcat

SEQ ID NO: 138623 - DNA, 25 bp, Rattus norvegicus
aggaagaaagccacactgtggagaa

SEQ ID NO: 138624 - DNA, 25 bp, Rattus norvegicus
aggaagaaagcccactggctcgttc

SEQ ID NO: 138625 - DNA, 25 bp, Rattus norvegicus
aggaagaaagccgactggctcgttc

SEQ ID NO: 138626 - DNA, 25 bp, Rattus norvegicus
aggaagaaagcctcactgtggagaa

SEQ ID NO: 138627 - DNA, 25 bp, Rattus norvegicus
aggaagaacaggagcgccgcaaagc

SEQ ID NO: 138628 - DNA, 25 bp, Rattus norvegicus
aggaagaacaggtgcgccgcaaagc

SEQ ID NO: 138629 - DNA, 25 bp, Rattus norvegicus
aggaagaaccaacccagctgaagag

SEQ ID NO: 138630 - DNA, 25 bp, Rattus norvegicus
aggaagaaccaagccagctgaagag

SEQ ID NO: 138631 - DNA, 25 bp, Rattus norvegicus
aggaagaacctactgcgactgcagg

SEQ ID NO: 138632 - DNA, 25 bp, Rattus norvegicus
aggaagaacctagtgcgactgcagg

SEQ ID NO: 138633 - DNA, 25 bp, Rattus norvegicus
aggaagaactgaaaatggccggcca

SEQ ID NO: 138634 - DNA, 25 bp, Rattus norvegicus
aggaagaactgataatggccggcca

SEQ ID NO: 138635 - DNA, 25 bp, Rattus norvegicus
aggaagaactttcagcaccttaaag

SEQ ID NO: 138636 - DNA, 25 bp, Rattus norvegicus
aggaagaactttgagcaccttaaag

SEQ ID NO: 138637 - DNA, 25 bp, Rattus norvegicus
aggaagaagccacccacggttccgt

SEQ ID NO: 138638 - DNA, 25 bp, Rattus norvegicus
aggaagaagccagccacggttccgt

SEQ ID NO: 138639 - DNA, 25 bp, Rattus norvegicus
aggaagaagcctcccaatccggatt

SEQ ID NO: 138640 - DNA, 25 bp, Rattus norvegicus
aggaagaagcctgccaatccggatt

SEQ ID NO: 138641 - DNA, 25 bp, Rattus norvegicus
aggaagaaggccagagtcttcctcc

SEQ ID NO: 138642 - DNA, 25 bp, Rattus norvegicus
aggaagaaggcctgagtcttcctcc

SEQ ID NO: 138643 - DNA, 25 bp, Rattus norvegicus
aggaagaagtctccatcgatctggg

SEQ ID NO: 138644 - DNA, 25 bp, Rattus norvegicus
aggaagaagtctgcatcgatctggg

SEQ ID NO: 138645 - DNA, 25 bp, Rattus norvegicus
aggaagaatcatcctgcagctcagg

SEQ ID NO: 138646 - DNA, 25 bp, Rattus norvegicus
aggaagaatcatgctgcagctcagg

SEQ ID NO: 138647 - DNA, 25 bp, Rattus norvegicus
aggaagaattctatgggctcccttg

SEQ ID NO: 138648 - DNA, 25 bp, Rattus norvegicus
aggaagaattctttgggctcccttg

SEQ ID NO: 138649 - DNA, 25 bp, Rattus norvegicus
aggaagacaaccaggcctctgcagt

SEQ ID NO: 138650 - DNA, 25 bp, Rattus norvegicus
aggaagacaacctggcctctgcagt

SEQ ID NO: 138651 - DNA, 25 bp, Rattus norvegicus
aggaagacaactccgccctgggtct

SEQ ID NO: 138652 - DNA, 25 bp, Rattus norvegicus
aggaagacaactgcgccctgggtct

SEQ ID NO: 138653 - DNA, 25 bp, Rattus norvegicus
aggaagacaaggaggttttgcagca

SEQ ID NO: 138654 - DNA, 25 bp, Rattus norvegicus
aggaagacaaggtggttttgcagca

SEQ ID NO: 138655 - DNA, 25 bp, Rattus norvegicus
aggaagacactcatcgtcaacctct

SEQ ID NO: 138656 - DNA, 25 bp, Rattus norvegicus
aggaagacactcttcgtcaacctct

SEQ ID NO: 138657 - DNA, 25 bp, Rattus norvegicus
aggaagacagcaagaggtggcctct

SEQ ID NO: 138658 - DNA, 25 bp, Rattus norvegicus
aggaagacagcatgaggtggcctct

SEQ ID NO: 138659 - DNA, 25 bp, Rattus norvegicus
aggaagacatccactggtgcactga

SEQ ID NO: 138660 - DNA, 25 bp, Rattus norvegicus
aggaagacatcctctggtgcactga

SEQ ID NO: 138661 - DNA, 25 bp, Rattus norvegicus
aggaagacatcgaccgctgtgtgga

SEQ ID NO: 138662 - DNA, 25 bp, Rattus norvegicus
aggaagacatcgtccgctgtgtgga

SEQ ID NO: 138663 - DNA, 25 bp, Rattus norvegicus
aggaagacccataccaagggcacaa

SEQ ID NO: 138664 - DNA, 25 bp, Rattus norvegicus
aggaagacccattccaagggcacaa

SEQ ID NO: 138665 - DNA, 25 bp, Rattus norvegicus
aggaagaccctgaggcatcatccca

SEQ ID NO: 138666 - DNA, 25 bp, Rattus norvegicus
aggaagaccctgtggcatcatccca

SEQ ID NO: 138667 - DNA, 25 bp, Rattus norvegicus
aggaagacctgcaagggctcacttt

SEQ ID NO: 138668 - DNA, 25 bp, Rattus norvegicus
aggaagacctgccataacctgtttc

SEQ ID NO: 138669 - DNA, 25 bp, Rattus norvegicus
aggaagacctgcgataacctgtttc

SEQ ID NO: 138670 - DNA, 25 bp, Rattus norvegicus
aggaagacctgctagggctcacttt

SEQ ID NO: 138671 - DNA, 25 bp, Rattus norvegicus
aggaagacctttcatgggcctttgc

SEQ ID NO: 138672 - DNA, 25 bp, Rattus norvegicus
aggaagacctttgatgggcctttgc

SEQ ID NO: 138673 - DNA, 25 bp, Rattus norvegicus
aggaagacgctacctcagttgggaa

SEQ ID NO: 138674 - DNA, 25 bp, Rattus norvegicus
aggaagacgctagctcagttgggaa

SEQ ID NO: 138675 - DNA, 25 bp, Rattus norvegicus
aggaagacgctgaccactgtgcagg

SEQ ID NO: 138676 - DNA, 25 bp, Rattus norvegicus
aggaagacgctgtccactgtgcagg

SEQ ID NO: 138677 - DNA, 25 bp, Rattus norvegicus
aggaagactcctaagcagctgtgta

SEQ ID NO: 138678 - DNA, 25 bp, Rattus norvegicus
aggaagactccttagcagctgtgta

SEQ ID NO: 138679 - DNA, 25 bp, Rattus norvegicus
aggaagacttcgagcatattgctaa

SEQ ID NO: 138680 - DNA, 25 bp, Rattus norvegicus
aggaagacttcgtgcatattgctaa

SEQ ID NO: 138681 - DNA, 25 bp, Rattus norvegicus
aggaagacttgtacagctggcctct

SEQ ID NO: 138682 - DNA, 25 bp, Rattus norvegicus
aggaagacttgttcagctggcctct

SEQ ID NO: 138683 - DNA, 25 bp, Rattus norvegicus
aggaagagaccaaagccccgaatct

SEQ ID NO: 138684 - DNA, 25 bp, Rattus norvegicus
aggaagagaccacctcagctgcaac

SEQ ID NO: 138685 - DNA, 25 bp, Rattus norvegicus
aggaagagaccagctcagctgcaac

SEQ ID NO: 138686 - DNA, 25 bp, Rattus norvegicus
aggaagagaccatagccccgaatct

SEQ ID NO: 138687 - DNA, 25 bp, Rattus norvegicus
aggaagagagctctcctcagcgtcc

SEQ ID NO: 138688 - DNA, 25 bp, Rattus norvegicus
aggaagagagctgtcctcagcgtcc

SEQ ID NO: 138689 - DNA, 25 bp, Rattus norvegicus
aggaagagatgaactcccagcagga

SEQ ID NO: 138690 - DNA, 25 bp, Rattus norvegicus
aggaagagatgatctcccagcagga

SEQ ID NO: 138691 - DNA, 25 bp, Rattus norvegicus
aggaagagcacccagccagcaggca

SEQ ID NO: 138692 - DNA, 25 bp, Rattus norvegicus
aggaagagcaccgagccagcaggca

SEQ ID NO: 138693 - DNA, 25 bp, Rattus norvegicus
aggaagagctggacaccttgaagga

SEQ ID NO: 138694 - DNA, 25 bp, Rattus norvegicus
aggaagagctggaccccatggctga

SEQ ID NO: 138695 - DNA, 25 bp, Rattus norvegicus
aggaagagctggctaccctgtctga

SEQ ID NO: 138696 - DNA, 25 bp, Rattus norvegicus
aggaagagctgggtaccctgtctga

SEQ ID NO: 138697 - DNA, 25 bp, Rattus norvegicus
aggaagagctggtcaccttgaagga

SEQ ID NO: 138698 - DNA, 25 bp, Rattus norvegicus
aggaagagctggtccccatggctga

SEQ ID NO: 138699 - DNA, 25 bp, Rattus norvegicus
aggaagaggagaccccaccctagcc

SEQ ID NO: 138700 - DNA, 25 bp, Rattus norvegicus
aggaagaggagagcccaccctagcc

SEQ ID NO: 138701 - DNA, 25 bp, Rattus norvegicus
aggaagaggcacattctcctttggg

SEQ ID NO: 138702 - DNA, 25 bp, Rattus norvegicus
aggaagaggcactttctcctttggg

SEQ ID NO: 138703 - DNA, 25 bp, Rattus norvegicus
aggaagaggctcaggcccttaagct

SEQ ID NO: 138704 - DNA, 25 bp, Rattus norvegicus
aggaagaggctctggcccttaagct

SEQ ID NO: 138705 - DNA, 25 bp, Rattus norvegicus
aggaagagtgcccttcatcttcacc

SEQ ID NO: 138706 - DNA, 25 bp, Rattus norvegicus
aggaagagtgccgttcatcttcacc

SEQ ID NO: 138707 - DNA, 25 bp, Rattus norvegicus
aggaagatactcctacctttctcac

SEQ ID NO: 138708 - DNA, 25 bp, Rattus norvegicus
aggaagatactcgtacctttctcac

SEQ ID NO: 138709 - DNA, 25 bp, Rattus norvegicus
aggaagatcaccatccgagagctcg

SEQ ID NO: 138710 - DNA, 25 bp, Rattus norvegicus
aggaagatcaccttccgagagctcg

SEQ ID NO: 138711 - DNA, 25 bp, Rattus norvegicus
aggaagatccctcagttttgagtca

SEQ ID NO: 138712 - DNA, 25 bp, Rattus norvegicus
aggaagatccctcgactctctgcct

SEQ ID NO: 138713 - DNA, 25 bp, Rattus norvegicus
aggaagatccctgagttttgagtca

SEQ ID NO: 138714 - DNA, 25 bp, Rattus norvegicus
aggaagatccctggactctctgcct

SEQ ID NO: 138715 - DNA, 25 bp, Rattus norvegicus
aggaagatccgtcgcttcttggtgc

SEQ ID NO: 138716 - DNA, 25 bp, Rattus norvegicus
aggaagatccgtggcttcttggtgc

SEQ ID NO: 138717 - DNA, 25 bp, Rattus norvegicus
aggaagatctcgatccttgtcctcg

SEQ ID NO: 138718 - DNA, 25 bp, Rattus norvegicus
aggaagatctcgttccttgtcctcg

SEQ ID NO: 138719 - DNA, 25 bp, Rattus norvegicus
aggaagatgacgatcacgcctttca

SEQ ID NO: 138720 - DNA, 25 bp, Rattus norvegicus
aggaagatgacgttcacgcctttca

SEQ ID NO: 138721 - DNA, 25 bp, Rattus norvegicus
aggaagatgccactcagtctgatga

SEQ ID NO: 138722 - DNA, 25 bp, Rattus norvegicus
aggaagatgccagtcagtctgatga

SEQ ID NO: 138723 - DNA, 25 bp, Rattus norvegicus
aggaagatgcctctaaggacactta

SEQ ID NO: 138724 - DNA, 25 bp, Rattus norvegicus
aggaagatgcctgtaaggacactta

SEQ ID NO: 138725 - DNA, 25 bp, Rattus norvegicus
aggaagatgctcactgtgagtttaa

SEQ ID NO: 138726 - DNA, 25 bp, Rattus norvegicus
aggaagatgctctctgtgagtttaa

SEQ ID NO: 138727 - DNA, 25 bp, Rattus norvegicus
aggaagatgggcacgctcacagaaa

SEQ ID NO: 138728 - DNA, 25 bp, Rattus norvegicus
aggaagatgggctcgctcacagaaa

SEQ ID NO: 138729 - DNA, 25 bp, Rattus norvegicus
aggaagatggtgaccgctctgtgat

SEQ ID NO: 138730 - DNA, 25 bp, Rattus norvegicus
aggaagatggtgtccgctctgtgat

SEQ ID NO: 138731 - DNA, 25 bp, Rattus norvegicus
aggaagatggttcctggtgccccat

SEQ ID NO: 138732 - DNA, 25 bp, Rattus norvegicus
aggaagatggttgctggtgccccat

SEQ ID NO: 138733 - DNA, 25 bp, Rattus norvegicus
aggaagatttcaagcccagcaccag

SEQ ID NO: 138734 - DNA, 25 bp, Rattus norvegicus
aggaagatttcatgcccagcaccag

SEQ ID NO: 138735 - DNA, 25 bp, Rattus norvegicus
aggaagatttccactccaagctttt

SEQ ID NO: 138736 - DNA, 25 bp, Rattus norvegicus
aggaagatttcctctccaagctttt

SEQ ID NO: 138737 - DNA, 25 bp, Rattus norvegicus
aggaagcaatctctcccttcaaaaa

SEQ ID NO: 138738 - DNA, 25 bp, Rattus norvegicus
aggaagcaatctgtcccttcaaaaa

SEQ ID NO: 138739 - DNA, 25 bp, Rattus norvegicus
aggaagcacagaccccatgacctgg

SEQ ID NO: 138740 - DNA, 25 bp, Rattus norvegicus
aggaagcacagagcccatgacctgg

SEQ ID NO: 138741 - DNA, 25 bp, Rattus norvegicus
aggaagcacatgaccctccctgtgt

SEQ ID NO: 138742 - DNA, 25 bp, Rattus norvegicus
aggaagcacatgtccctccctgtgt

SEQ ID NO: 138743 - DNA, 25 bp, Rattus norvegicus
aggaagcagaaacccctccagaaaa

SEQ ID NO: 138744 - DNA, 25 bp, Rattus norvegicus
aggaagcagaaagccctccagaaaa

SEQ ID NO: 138745 - DNA, 25 bp, Rattus norvegicus
aggaagcagccgcaagagccaacct

SEQ ID NO: 138746 - DNA, 25 bp, Rattus norvegicus
aggaagcagccggaagagccaacct

SEQ ID NO: 138747 - DNA, 25 bp, Rattus norvegicus
aggaagcagcgaatccagactccag

SEQ ID NO: 138748 - DNA, 25 bp, Rattus norvegicus
aggaagcagcgattccagactccag

SEQ ID NO: 138749 - DNA, 25 bp, Rattus norvegicus
aggaagcagctcacctttcaccggt

SEQ ID NO: 138750 - DNA, 25 bp, Rattus norvegicus
aggaagcagctctcctttcaccggt

SEQ ID NO: 138751 - DNA, 25 bp, Rattus norvegicus
aggaagcaggatcacctcctaggat

SEQ ID NO: 138752 - DNA, 25 bp, Rattus norvegicus
aggaagcaggatgacctcctaggat

SEQ ID NO: 138753 - DNA, 25 bp, Rattus norvegicus
aggaagcattgcctgattctccagt

SEQ ID NO: 138754 - DNA, 25 bp, Rattus norvegicus
aggaagcattgcgtgattctccagt

SEQ ID NO: 138755 - DNA, 25 bp, Rattus norvegicus
aggaagcattggactttgtcactcg

SEQ ID NO: 138756 - DNA, 25 bp, Rattus norvegicus
aggaagcattggtctttgtcactcg

SEQ ID NO: 138757 - DNA, 25 bp, Rattus norvegicus
aggaagccaaagagtcctcaccagt

SEQ ID NO: 138758 - DNA, 25 bp, Rattus norvegicus
aggaagccaaagcacccctgcagga

SEQ ID NO: 138759 - DNA, 25 bp, Rattus norvegicus
aggaagccaaaggacccctgcagga

SEQ ID NO: 138760 - DNA, 25 bp, Rattus norvegicus
aggaagccaaagtgtcctcaccagt

SEQ ID NO: 138761 - DNA, 25 bp, Rattus norvegicus
aggaagccaatcatctcaacgctgt

SEQ ID NO: 138762 - DNA, 25 bp, Rattus norvegicus
aggaagccaatcttctcaacgctgt

SEQ ID NO: 138763 - DNA, 25 bp, Rattus norvegicus
aggaagccacaacgccatccggcaa

SEQ ID NO: 138764 - DNA, 25 bp, Rattus norvegicus
aggaagccacaactactacatgact

SEQ ID NO: 138765 - DNA, 25 bp, Rattus norvegicus
aggaagccacaaggccatccggcaa

SEQ ID NO: 138766 - DNA, 25 bp, Rattus norvegicus
aggaagccacaagtactacatgact

SEQ ID NO: 138767 - DNA, 25 bp, Rattus norvegicus
aggaagccacatacttctctttgca

SEQ ID NO: 138768 - DNA, 25 bp, Rattus norvegicus
aggaagccacattcttctctttgca

SEQ ID NO: 138769 - DNA, 25 bp, Rattus norvegicus
aggaagccactgcttgttttaaagc

SEQ ID NO: 138770 - DNA, 25 bp, Rattus norvegicus
aggaagccactggttgttttaaagc

SEQ ID NO: 138771 - DNA, 25 bp, Rattus norvegicus
aggaagccatacctctgggcagagc

SEQ ID NO: 138772 - DNA, 25 bp, Rattus norvegicus
aggaagccatacgtctgggcagagc

SEQ ID NO: 138773 - DNA, 25 bp, Rattus norvegicus
aggaagccatccacggagagagttt

SEQ ID NO: 138774 - DNA, 25 bp, Rattus norvegicus
aggaagccatcctcggagagagttt

SEQ ID NO: 138775 - DNA, 25 bp, Rattus norvegicus
aggaagcccaagaccatgtgactat

SEQ ID NO: 138776 - DNA, 25 bp, Rattus norvegicus
aggaagcccaagtccatgtgactat

SEQ ID NO: 138777 - DNA, 25 bp, Rattus norvegicus
aggaagcccactacaacagtctgtc

SEQ ID NO: 138778 - DNA, 25 bp, Rattus norvegicus
aggaagcccacttcaacagtctgtc

SEQ ID NO: 138779 - DNA, 25 bp, Rattus norvegicus
aggaagcccccaatgcaggctgaat

SEQ ID NO: 138780 - DNA, 25 bp, Rattus norvegicus
aggaagcccccattgcaggctgaat

SEQ ID NO: 138781 - DNA, 25 bp, Rattus norvegicus
aggaagcccgaccagcattgacaag

SEQ ID NO: 138782 - DNA, 25 bp, Rattus norvegicus
aggaagcccgacgagcattgacaag

SEQ ID NO: 138783 - DNA, 25 bp, Rattus norvegicus
aggaagcccgagacacccagctgat

SEQ ID NO: 138784 - DNA, 25 bp, Rattus norvegicus
aggaagcccgagtcacccagctgat

SEQ ID NO: 138785 - DNA, 25 bp, Rattus norvegicus
aggaagcccggcatctggaacccaa

SEQ ID NO: 138786 - DNA, 25 bp, Rattus norvegicus
aggaagcccggcttctggaacccaa

SEQ ID NO: 138787 - DNA, 25 bp, Rattus norvegicus
aggaagcccttcatgttcaggactg

SEQ ID NO: 138788 - DNA, 25 bp, Rattus norvegicus
aggaagcccttcttgttcaggactg

SEQ ID NO: 138789 - DNA, 25 bp, Rattus norvegicus
aggaagcctctgaggtactcacttg

SEQ ID NO: 138790 - DNA, 25 bp, Rattus norvegicus
aggaagcctctgtggtactcacttg

SEQ ID NO: 138791 - DNA, 25 bp, Rattus norvegicus
aggaagcctgccctgttgacgctat

SEQ ID NO: 138792 - DNA, 25 bp, Rattus norvegicus
aggaagcctgccgtgttgacgctat

SEQ ID NO: 138793 - DNA, 25 bp, Rattus norvegicus
aggaagcctggcctcagagacagct

SEQ ID NO: 138794 - DNA, 25 bp, Rattus norvegicus
aggaagcctggcgtcagagacagct

SEQ ID NO: 138795 - DNA, 25 bp, Rattus norvegicus
aggaagcctgggatgaccactccgt

SEQ ID NO: 138796 - DNA, 25 bp, Rattus norvegicus
aggaagcctgggttgaccactccgt

SEQ ID NO: 138797 - DNA, 25 bp, Rattus norvegicus
aggaagcctgttcacactttgggat

SEQ ID NO: 138798 - DNA, 25 bp, Rattus norvegicus
aggaagcctgttgacactttgggat

SEQ ID NO: 138799 - DNA, 25 bp, Rattus norvegicus
aggaagccttacagtagtctcgcac

SEQ ID NO: 138800 - DNA, 25 bp, Rattus norvegicus
aggaagccttactgtagtctcgcac

SEQ ID NO: 138801 - DNA, 25 bp, Rattus norvegicus
aggaagccttgcatcaaaccatctc

SEQ ID NO: 138802 - DNA, 25 bp, Rattus norvegicus
aggaagccttgcttcaaaccatctc

SEQ ID NO: 138803 - DNA, 25 bp, Rattus norvegicus
aggaagccttggacactgtacctgc

SEQ ID NO: 138804 - DNA, 25 bp, Rattus norvegicus
aggaagccttggtcactgtacctgc

SEQ ID NO: 138805 - DNA, 25 bp, Rattus norvegicus
aggaagcctttgctctttgcctgct

SEQ ID NO: 138806 - DNA, 25 bp, Rattus norvegicus
aggaagcctttggtctttgcctgct

SEQ ID NO: 138807 - DNA, 25 bp, Rattus norvegicus
aggaagcgacagatgggcccctctt

SEQ ID NO: 138808 - DNA, 25 bp, Rattus norvegicus
aggaagcgacagttgggcccctctt

SEQ ID NO: 138809 - DNA, 25 bp, Rattus norvegicus
aggaagcgagcgatcggcagttcct

SEQ ID NO: 138810 - DNA, 25 bp, Rattus norvegicus
aggaagcgagcgttcggcagttcct

SEQ ID NO: 138811 - DNA, 25 bp, Rattus norvegicus
aggaagcgagtcactgtgtggctct

SEQ ID NO: 138812 - DNA, 25 bp, Rattus norvegicus
aggaagcgagtctctgtgtggctct

SEQ ID NO: 138813 - DNA, 25 bp, Rattus norvegicus
aggaagcgctgtctgctacggctct

SEQ ID NO: 138814 - DNA, 25 bp, Rattus norvegicus
aggaagcgctgtgtgctacggctct

SEQ ID NO: 138815 - DNA, 25 bp, Rattus norvegicus
aggaagcggcccaggctttactact

SEQ ID NO: 138816 - DNA, 25 bp, Rattus norvegicus
aggaagcggccctggctttactact

SEQ ID NO: 138817 - DNA, 25 bp, Rattus norvegicus
aggaagcgtgttacgcccagaggta

SEQ ID NO: 138818 - DNA, 25 bp, Rattus norvegicus
aggaagcgtgtttcgcccagaggta

SEQ ID NO: 138819 - DNA, 25 bp, Rattus norvegicus
aggaagctactaagccgaatcggca

SEQ ID NO: 138820 - DNA, 25 bp, Rattus norvegicus
aggaagctactatgccgaatcggca

SEQ ID NO: 138821 - DNA, 25 bp, Rattus norvegicus
aggaagctagtgcttgggaccccta

SEQ ID NO: 138822 - DNA, 25 bp, Rattus norvegicus
aggaagctagtggttgggaccccta

SEQ ID NO: 138823 - DNA, 25 bp, Rattus norvegicus
aggaagctcatcatgtcacccttaa

SEQ ID NO: 138824 - DNA, 25 bp, Rattus norvegicus
aggaagctcatcttgtcacccttaa

SEQ ID NO: 138825 - DNA, 25 bp, Rattus norvegicus
aggaagctccatattgggcacctgt

SEQ ID NO: 138826 - DNA, 25 bp, Rattus norvegicus
aggaagctccattttgggcacctgt

SEQ ID NO: 138827 - DNA, 25 bp, Rattus norvegicus
aggaagctcttacatctagaccctt

SEQ ID NO: 138828 - DNA, 25 bp, Rattus norvegicus
aggaagctcttagatctagaccctt

SEQ ID NO: 138829 - DNA, 25 bp, Rattus norvegicus
aggaagctctttagctttgctccag

SEQ ID NO: 138830 - DNA, 25 bp, Rattus norvegicus
aggaagctcttttgctttgctccag

SEQ ID NO: 138831 - DNA, 25 bp, Rattus norvegicus
aggaagctgcttcacctgactgcaa

SEQ ID NO: 138832 - DNA, 25 bp, Rattus norvegicus
aggaagctgcttgacctgactgcaa

SEQ ID NO: 138833 - DNA, 25 bp, Rattus norvegicus
aggaagctgtacatgttcctctgca

SEQ ID NO: 138834 - DNA, 25 bp, Rattus norvegicus
aggaagctgtacttgttcctctgca

SEQ ID NO: 138835 - DNA, 25 bp, Rattus norvegicus
aggaagctgttcagctgctcctgga

SEQ ID NO: 138836 - DNA, 25 bp, Rattus norvegicus
aggaagctgttctgctgctcctgga

SEQ ID NO: 138837 - DNA, 25 bp, Rattus norvegicus
aggaagctgtttaaggccctctgac

SEQ ID NO: 138838 - DNA, 25 bp, Rattus norvegicus
aggaagctgtttcaactcgcccgag

SEQ ID NO: 138839 - DNA, 25 bp, Rattus norvegicus
aggaagctgtttgaactcgcccgag

SEQ ID NO: 138840 - DNA, 25 bp, Rattus norvegicus
aggaagctgttttaggccctctgac

SEQ ID NO: 138841 - DNA, 25 bp, Rattus norvegicus
aggaagcttaccaagcatgctcaaa

SEQ ID NO: 138842 - DNA, 25 bp, Rattus norvegicus
aggaagcttacctagcatgctcaaa

SEQ ID NO: 138843 - DNA, 25 bp, Rattus norvegicus
aggaagcttatccacctcctgaggc

SEQ ID NO: 138844 - DNA, 25 bp, Rattus norvegicus
aggaagcttatcgacctcctgaggc

SEQ ID NO: 138845 - DNA, 25 bp, Rattus norvegicus
aggaagcttcctagcccctggagag

SEQ ID NO: 138846 - DNA, 25 bp, Rattus norvegicus
aggaagcttccttgcccctggagag

SEQ ID NO: 138847 - DNA, 25 bp, Rattus norvegicus
aggaagcttcggcaatgtctgtgtt

SEQ ID NO: 138848 - DNA, 25 bp, Rattus norvegicus
aggaagcttcgggaatgtctgtgtt

SEQ ID NO: 138849 - DNA, 25 bp, Rattus norvegicus
aggaaggaacgcctccttatacctg

SEQ ID NO: 138850 - DNA, 25 bp, Rattus norvegicus
aggaaggaacgcgtccttatacctg

SEQ ID NO: 138851 - DNA, 25 bp, Rattus norvegicus
aggaaggacacacgcccggaagcca

SEQ ID NO: 138852 - DNA, 25 bp, Rattus norvegicus
aggaaggacacaggcccggaagcca

SEQ ID NO: 138853 - DNA, 25 bp, Rattus norvegicus
aggaaggacagaatcccagcctctc

SEQ ID NO: 138854 - DNA, 25 bp, Rattus norvegicus
aggaaggacagattcccagcctctc

SEQ ID NO: 138855 - DNA, 25 bp, Rattus norvegicus
aggaaggacatcagctgtctttctt

SEQ ID NO: 138856 - DNA, 25 bp, Rattus norvegicus
aggaaggacatctgctgtctttctt

SEQ ID NO: 138857 - DNA, 25 bp, Rattus norvegicus
aggaaggaccgtaagcacacaccat

SEQ ID NO: 138858 - DNA, 25 bp, Rattus norvegicus
aggaaggaccgttagcacacaccat

SEQ ID NO: 138859 - DNA, 25 bp, Rattus norvegicus
aggaaggacctgcagcgctgtcaat

SEQ ID NO: 138860 - DNA, 25 bp, Rattus norvegicus
aggaaggacctggagcgctgtcaat

SEQ ID NO: 138861 - DNA, 25 bp, Rattus norvegicus
aggaaggaccttcatttcttagagg

SEQ ID NO: 138862 - DNA, 25 bp, Rattus norvegicus
aggaaggaccttgatttcttagagg

SEQ ID NO: 138863 - DNA, 25 bp, Rattus norvegicus
aggaaggagccacaggttcacctca

SEQ ID NO: 138864 - DNA, 25 bp, Rattus norvegicus
aggaaggagccagaggttcacctca

SEQ ID NO: 138865 - DNA, 25 bp, Rattus norvegicus
aggaaggagtcgccaggctcctccc

SEQ ID NO: 138866 - DNA, 25 bp, Rattus norvegicus
aggaaggagtcggcaggctcctccc

SEQ ID NO: 138867 - DNA, 25 bp, Rattus norvegicus
aggaaggataatcagttcgaggcca

SEQ ID NO: 138868 - DNA, 25 bp, Rattus norvegicus
aggaaggataatgagttcgaggcca

SEQ ID NO: 138869 - DNA, 25 bp, Rattus norvegicus
aggaaggatccactctacctgcctc

SEQ ID NO: 138870 - DNA, 25 bp, Rattus norvegicus
aggaaggatccagtctacctgcctc

SEQ ID NO: 138871 - DNA, 25 bp, Rattus norvegicus
aggaaggatcctcatctgctcctct

SEQ ID NO: 138872 - DNA, 25 bp, Rattus norvegicus
aggaaggatcctgatctgctcctct

SEQ ID NO: 138873 - DNA, 25 bp, Rattus norvegicus
aggaaggattcactcctcagggcac

SEQ ID NO: 138874 - DNA, 25 bp, Rattus norvegicus
aggaaggattcagtcctcagggcac

SEQ ID NO: 138875 - DNA, 25 bp, Rattus norvegicus
aggaaggcaagcagtgctgtcttca

SEQ ID NO: 138876 - DNA, 25 bp, Rattus norvegicus
aggaaggcaagctgtgctgtcttca

SEQ ID NO: 138877 - DNA, 25 bp, Rattus norvegicus
aggaaggcaatacgcactggctcat

SEQ ID NO: 138878 - DNA, 25 bp, Rattus norvegicus
aggaaggcaataggcactggctcat

SEQ ID NO: 138879 - DNA, 25 bp, Rattus norvegicus
aggaaggcacttcccaaagcccgag

SEQ ID NO: 138880 - DNA, 25 bp, Rattus norvegicus
aggaaggcacttgccaaagcccgag

SEQ ID NO: 138881 - DNA, 25 bp, Rattus norvegicus
aggaaggcagtaatgcgccagccat

SEQ ID NO: 138882 - DNA, 25 bp, Rattus norvegicus
aggaaggcagtattgcgccagccat

SEQ ID NO: 138883 - DNA, 25 bp, Rattus norvegicus
aggaaggccaccctgaatctgagat

SEQ ID NO: 138884 - DNA, 25 bp, Rattus norvegicus
aggaaggccaccgtgaatctgagat

SEQ ID NO: 138885 - DNA, 25 bp, Rattus norvegicus
aggaaggccaggatccttgagctcc

SEQ ID NO: 138886 - DNA, 25 bp, Rattus norvegicus
aggaaggccaggttccttgagctcc

SEQ ID NO: 138887 - DNA, 25 bp, Rattus norvegicus
aggaaggcccgcacgtgacctgtga

SEQ ID NO: 138888 - DNA, 25 bp, Rattus norvegicus
aggaaggcccgctcgtgacctgtga

SEQ ID NO: 138889 - DNA, 25 bp, Rattus norvegicus
aggaaggccggacctcaagacactc

SEQ ID NO: 138890 - DNA, 25 bp, Rattus norvegicus
aggaaggccggagctcaagacactc

SEQ ID NO: 138891 - DNA, 25 bp, Rattus norvegicus
aggaaggcgaacattccttctctgt

SEQ ID NO: 138892 - DNA, 25 bp, Rattus norvegicus
aggaaggcgaactttccttctctgt

SEQ ID NO: 138893 - DNA, 25 bp, Rattus norvegicus
aggaaggcgcttctgtgcaacattg

SEQ ID NO: 138894 - DNA, 25 bp, Rattus norvegicus
aggaaggcgcttgtgtgcaacattg

SEQ ID NO: 138895 - DNA, 25 bp, Rattus norvegicus
aggaaggcgtcacgtggatccccta

SEQ ID NO: 138896 - DNA, 25 bp, Rattus norvegicus
aggaaggcgtcaggtggatccccta

SEQ ID NO: 138897 - DNA, 25 bp, Rattus norvegicus
aggaaggctcccagcaacaggagta

SEQ ID NO: 138898 - DNA, 25 bp, Rattus norvegicus
aggaaggctccctgcaacaggagta

SEQ ID NO: 138899 - DNA, 25 bp, Rattus norvegicus
aggaaggctcttagccaccagcaca

SEQ ID NO: 138900 - DNA, 25 bp, Rattus norvegicus
aggaaggctcttcggttcttggcac

SEQ ID NO: 138901 - DNA, 25 bp, Rattus norvegicus
aggaaggctcttgggttcttggcac

SEQ ID NO: 138902 - DNA, 25 bp, Rattus norvegicus
aggaaggctctttgccaccagcaca

SEQ ID NO: 138903 - DNA, 25 bp, Rattus norvegicus
aggaaggctgccactttactgaatg

SEQ ID NO: 138904 - DNA, 25 bp, Rattus norvegicus
aggaaggctgcctctttactgaatg

SEQ ID NO: 138905 - DNA, 25 bp, Rattus norvegicus
aggaaggctggtatgctctttctgc

SEQ ID NO: 138906 - DNA, 25 bp, Rattus norvegicus
aggaaggctggtttgctctttctgc

SEQ ID NO: 138907 - DNA, 25 bp, Rattus norvegicus
aggaaggctgtactgtgtttgtatc

SEQ ID NO: 138908 - DNA, 25 bp, Rattus norvegicus
aggaaggctgtagtgtgtttgtatc

SEQ ID NO: 138909 - DNA, 25 bp, Rattus norvegicus
aggaaggctgtcatcgccagctctt

SEQ ID NO: 138910 - DNA, 25 bp, Rattus norvegicus
aggaaggctgtcttcgccagctctt

SEQ ID NO: 138911 - DNA, 25 bp, Rattus norvegicus
aggaagggacctcgctcatatcgat

SEQ ID NO: 138912 - DNA, 25 bp, Rattus norvegicus
aggaagggacctggctcatatcgat

SEQ ID NO: 138913 - DNA, 25 bp, Rattus norvegicus
aggaagggactgatctcttttgata

SEQ ID NO: 138914 - DNA, 25 bp, Rattus norvegicus
aggaagggactgctcacctttctca

SEQ ID NO: 138915 - DNA, 25 bp, Rattus norvegicus
aggaagggactggtcacctttctca

SEQ ID NO: 138916 - DNA, 25 bp, Rattus norvegicus
aggaagggactgttctcttttgata

SEQ ID NO: 138917 - DNA, 25 bp, Rattus norvegicus
aggaagggcccgactcctggtctct

SEQ ID NO: 138918 - DNA, 25 bp, Rattus norvegicus
aggaagggcccgtctcctggtctct

SEQ ID NO: 138919 - DNA, 25 bp, Rattus norvegicus
aggaagggccctctgtctatgcagc

SEQ ID NO: 138920 - DNA, 25 bp, Rattus norvegicus
aggaagggccctgtgtctatgcagc

SEQ ID NO: 138921 - DNA, 25 bp, Rattus norvegicus
aggaagggcctcctttagccattct

SEQ ID NO: 138922 - DNA, 25 bp, Rattus norvegicus
aggaagggcctcgtttagccattct

SEQ ID NO: 138923 - DNA, 25 bp, Rattus norvegicus
aggaagggcctgactttcgtctctg

SEQ ID NO: 138924 - DNA, 25 bp, Rattus norvegicus
aggaagggcctgtctttcgtctctg

SEQ ID NO: 138925 - DNA, 25 bp, Rattus norvegicus
aggaagggtctaactaaagtgagat

SEQ ID NO: 138926 - DNA, 25 bp, Rattus norvegicus
aggaagggtctatctaaagtgagat

SEQ ID NO: 138927 - DNA, 25 bp, Rattus norvegicus
aggaagggtcttactgtgtcactct

SEQ ID NO: 138928 - DNA, 25 bp, Rattus norvegicus
aggaagggtcttctcagcagtctct

SEQ ID NO: 138929 - DNA, 25 bp, Rattus norvegicus
aggaagggtcttgtcagcagtctct

SEQ ID NO: 138930 - DNA, 25 bp, Rattus norvegicus
aggaagggtctttctgtgtcactct

SEQ ID NO: 138931 - DNA, 25 bp, Rattus norvegicus
aggaaggtacagcttcctcaccatc

SEQ ID NO: 138932 - DNA, 25 bp, Rattus norvegicus
aggaaggtacaggttcctcaccatc

SEQ ID NO: 138933 - DNA, 25 bp, Rattus norvegicus
aggaaggtactgcaccatctgcaaa

SEQ ID NO: 138934 - DNA, 25 bp, Rattus norvegicus
aggaaggtactggaccatctgcaaa

SEQ ID NO: 138935 - DNA, 25 bp, Rattus norvegicus
aggaaggtccccagtgcaagctcag

SEQ ID NO: 138936 - DNA, 25 bp, Rattus norvegicus
aggaaggtcccctgtgcaagctcag

SEQ ID NO: 138937 - DNA, 25 bp, Rattus norvegicus
aggaaggtctgaaccgctcgtcggc

SEQ ID NO: 138938 - DNA, 25 bp, Rattus norvegicus
aggaaggtctgatccgctcgtcggc

SEQ ID NO: 138939 - DNA, 25 bp, Rattus norvegicus
aggaaggttccgaatgtcagacaga

SEQ ID NO: 138940 - DNA, 25 bp, Rattus norvegicus
aggaaggttccgtatgtcagacaga

SEQ ID NO: 138941 - DNA, 25 bp, Rattus norvegicus
aggaaggttcctagcagtactgttg

SEQ ID NO: 138942 - DNA, 25 bp, Rattus norvegicus
aggaaggttccttgcagtactgttg

SEQ ID NO: 138943 - DNA, 25 bp, Rattus norvegicus
aggaagtaccacaattacatttatt

SEQ ID NO: 138944 - DNA, 25 bp, Rattus norvegicus
aggaagtaccactattacatttatt

SEQ ID NO: 138945 - DNA, 25 bp, Rattus norvegicus
aggaagtaccatcctggtccacgcc

SEQ ID NO: 138946 - DNA, 25 bp, Rattus norvegicus
aggaagtaccatgctggtccacgcc

SEQ ID NO: 138947 - DNA, 25 bp, Rattus norvegicus
aggaagtaccgtccctctgaccatg

SEQ ID NO: 138948 - DNA, 25 bp, Rattus norvegicus
aggaagtaccgtgcctctgaccatg

SEQ ID NO: 138949 - DNA, 25 bp, Rattus norvegicus
aggaagtagcatcgctccactggta

SEQ ID NO: 138950 - DNA, 25 bp, Rattus norvegicus
aggaagtagcatggctccactggta

SEQ ID NO: 138951 - DNA, 25 bp, Rattus norvegicus
aggaagtagtttcctggctccgctc

SEQ ID NO: 138952 - DNA, 25 bp, Rattus norvegicus
aggaagtagtttgctggctccgctc

SEQ ID NO: 138953 - DNA, 25 bp, Rattus norvegicus
aggaagtcaaagctctaaggtcaga

SEQ ID NO: 138954 - DNA, 25 bp, Rattus norvegicus
aggaagtcaaaggtctaaggtcaga

SEQ ID NO: 138955 - DNA, 25 bp, Rattus norvegicus
aggaagtcaatgatgatcaggctga

SEQ ID NO: 138956 - DNA, 25 bp, Rattus norvegicus
aggaagtcaatgcaaagcctctccc

SEQ ID NO: 138957 - DNA, 25 bp, Rattus norvegicus
aggaagtcaatggaaagcctctccc

SEQ ID NO: 138958 - DNA, 25 bp, Rattus norvegicus
aggaagtcaatgttgatcaggctga

SEQ ID NO: 138959 - DNA, 25 bp, Rattus norvegicus
aggaagtcacctccccaagcaaagt

SEQ ID NO: 138960 - DNA, 25 bp, Rattus norvegicus
aggaagtcacctgcccaagcaaagt

SEQ ID NO: 138961 - DNA, 25 bp, Rattus norvegicus
aggaagtcactgataccatcataag

SEQ ID NO: 138962 - DNA, 25 bp, Rattus norvegicus
aggaagtcactgttaccatcataag

SEQ ID NO: 138963 - DNA, 25 bp, Rattus norvegicus
aggaagtcagtcactctacaagcac

SEQ ID NO: 138964 - DNA, 25 bp, Rattus norvegicus
aggaagtcagtctctctacaagcac

SEQ ID NO: 138965 - DNA, 25 bp, Rattus norvegicus
aggaagtcattcctcttaactagga

SEQ ID NO: 138966 - DNA, 25 bp, Rattus norvegicus
aggaagtcattcgtcttaactagga

SEQ ID NO: 138967 - DNA, 25 bp, Rattus norvegicus
aggaagtccattacaccattcagtc

SEQ ID NO: 138968 - DNA, 25 bp, Rattus norvegicus
aggaagtccatttcaccattcagtc

SEQ ID NO: 138969 - DNA, 25 bp, Rattus norvegicus
aggaagtcctacagcaagcgggtaa

SEQ ID NO: 138970 - DNA, 25 bp, Rattus norvegicus
aggaagtcctactgcaagcgggtaa

SEQ ID NO: 138971 - DNA, 25 bp, Rattus norvegicus
aggaagtcctcacatcctggagctc

SEQ ID NO: 138972 - DNA, 25 bp, Rattus norvegicus
aggaagtcctcagatcctggagctc

SEQ ID NO: 138973 - DNA, 25 bp, Rattus norvegicus
aggaagtcgattccttcacctggat

SEQ ID NO: 138974 - DNA, 25 bp, Rattus norvegicus
aggaagtcgattgcttcacctggat

SEQ ID NO: 138975 - DNA, 25 bp, Rattus norvegicus
aggaagtctactactgcctttgcag

SEQ ID NO: 138976 - DNA, 25 bp, Rattus norvegicus
aggaagtctacttctgcctttgcag

SEQ ID NO: 138977 - DNA, 25 bp, Rattus norvegicus
aggaagtcttggcttgggctcttca

SEQ ID NO: 138978 - DNA, 25 bp, Rattus norvegicus
aggaagtcttgggttgggctcttca

SEQ ID NO: 138979 - DNA, 25 bp, Rattus norvegicus
aggaagtgaaatccccagcaccagc

SEQ ID NO: 138980 - DNA, 25 bp, Rattus norvegicus
aggaagtgaaatgcccagcaccagc

SEQ ID NO: 138981 - DNA, 25 bp, Rattus norvegicus
aggaagtgatgtatctcgccatgcc

SEQ ID NO: 138982 - DNA, 25 bp, Rattus norvegicus
aggaagtgatgtttctcgccatgcc

SEQ ID NO: 138983 - DNA, 25 bp, Rattus norvegicus
aggaagtgccacattattggtaagt

SEQ ID NO: 138984 - DNA, 25 bp, Rattus norvegicus
aggaagtgccactttattggtaagt

SEQ ID NO: 138985 - DNA, 25 bp, Rattus norvegicus
aggaagtgcgtgctctaatctctct

SEQ ID NO: 138986 - DNA, 25 bp, Rattus norvegicus
aggaagtgcgtggtctaatctctct

SEQ ID NO: 138987 - DNA, 25 bp, Rattus norvegicus
aggaagtggccccactaaggcacaa

SEQ ID NO: 138988 - DNA, 25 bp, Rattus norvegicus
aggaagtggcccgactaaggcacaa

SEQ ID NO: 138989 - DNA, 25 bp, Rattus norvegicus
aggaagtggctcactttaactagat

SEQ ID NO: 138990 - DNA, 25 bp, Rattus norvegicus
aggaagtggctctctttaactagat

SEQ ID NO: 138991 - DNA, 25 bp, Rattus norvegicus
aggaagtgtccccaggaactgcctt

SEQ ID NO: 138992 - DNA, 25 bp, Rattus norvegicus
aggaagtgtcccgaggaactgcctt

SEQ ID NO: 138993 - DNA, 25 bp, Rattus norvegicus
aggaagtgtcctcttcagttctcag

SEQ ID NO: 138994 - DNA, 25 bp, Rattus norvegicus
aggaagtgtcctgttcagttctcag

SEQ ID NO: 138995 - DNA, 25 bp, Rattus norvegicus
aggaagtgtgccaggacccgactgc

SEQ ID NO: 138996 - DNA, 25 bp, Rattus norvegicus
aggaagtgtgcctggacccgactgc

SEQ ID NO: 138997 - DNA, 25 bp, Rattus norvegicus
aggaagtgtggtctgtctccactca

SEQ ID NO: 138998 - DNA, 25 bp, Rattus norvegicus
aggaagtgtggtgtgtctccactca

SEQ ID NO: 138999 - DNA, 25 bp, Rattus norvegicus
aggaagtgttttctacctgttgctt

SEQ ID NO: 139000 - DNA, 25 bp, Rattus norvegicus
aggaagtgttttgtacctgttgctt

SEQ ID NO: 139001 - DNA, 25 bp, Rattus norvegicus
aggaagttagccaccagaagatcca

SEQ ID NO: 139002 - DNA, 25 bp, Rattus norvegicus
aggaagttagcctccagaagatcca

SEQ ID NO: 139003 - DNA, 25 bp, Rattus norvegicus
aggaagttcactacctttagttctg

SEQ ID NO: 139004 - DNA, 25 bp, Rattus norvegicus
aggaagttcacttcctttagttctg

SEQ ID NO: 139005 - DNA, 25 bp, Rattus norvegicus
aggaagttctacacgcgtctcacca

SEQ ID NO: 139006 - DNA, 25 bp, Rattus norvegicus
aggaagttctacatgctgtctaccc

SEQ ID NO: 139007 - DNA, 25 bp, Rattus norvegicus
aggaagttctactcgcgtctcacca

SEQ ID NO: 139008 - DNA, 25 bp, Rattus norvegicus
aggaagttctacttgctgtctaccc

SEQ ID NO: 139009 - DNA, 25 bp, Rattus norvegicus
aggaagttctgtagactgcatgcag

SEQ ID NO: 139010 - DNA, 25 bp, Rattus norvegicus
aggaagttctgttgactgcatgcag

SEQ ID NO: 139011 - DNA, 25 bp, Rattus norvegicus
aggaagttttctatgccgctgcata

SEQ ID NO: 139012 - DNA, 25 bp, Rattus norvegicus
aggaagttttctttgccgctgcata

SEQ ID NO: 139013 - DNA, 25 bp, Rattus norvegicus
aggaataactctaccctcatggtgc

SEQ ID NO: 139014 - DNA, 25 bp, Rattus norvegicus
aggaataactcttccctcatggtgc

SEQ ID NO: 139015 - DNA, 25 bp, Rattus norvegicus
aggaatacagggacttctatgcgcg

SEQ ID NO: 139016 - DNA, 25 bp, Rattus norvegicus
aggaatacagggtcttctatgcgcg

SEQ ID NO: 139017 - DNA, 25 bp, Rattus norvegicus
aggaatacgacaagcactctgtgca

SEQ ID NO: 139018 - DNA, 25 bp, Rattus norvegicus
aggaatacgacatgcactctgtgca

SEQ ID NO: 139019 - DNA, 25 bp, Rattus norvegicus
aggaatacgctcaacagccaggtgt

SEQ ID NO: 139020 - DNA, 25 bp, Rattus norvegicus
aggaatacgctctacagccaggtgt

SEQ ID NO: 139021 - DNA, 25 bp, Rattus norvegicus
aggaatactgcaacagccctgtgtc

SEQ ID NO: 139022 - DNA, 25 bp, Rattus norvegicus
aggaatactgcaagcgcgtgcctta

SEQ ID NO: 139023 - DNA, 25 bp, Rattus norvegicus
aggaatactgcatcagccctgtgtc

SEQ ID NO: 139024 - DNA, 25 bp, Rattus norvegicus
aggaatactgcatgcgcgtgcctta

SEQ ID NO: 139025 - DNA, 25 bp, Rattus norvegicus
aggaatactgtcaagccaaaaaggc

SEQ ID NO: 139026 - DNA, 25 bp, Rattus norvegicus
aggaatactgtctagccaaaaaggc

SEQ ID NO: 139027 - DNA, 25 bp, Rattus norvegicus
aggaatacttgcaggtctcgctgag

SEQ ID NO: 139028 - DNA, 25 bp, Rattus norvegicus
aggaatacttgctggtctcgctgag

SEQ ID NO: 139029 - DNA, 25 bp, Rattus norvegicus
aggaatactttgactctggatctga

SEQ ID NO: 139030 - DNA, 25 bp, Rattus norvegicus
aggaatactttgtctctggatctga

SEQ ID NO: 139031 - DNA, 25 bp, Rattus norvegicus
aggaatagacaacagaggaccagct

SEQ ID NO: 139032 - DNA, 25 bp, Rattus norvegicus
aggaatagacaagagaggaccagct

SEQ ID NO: 139033 - DNA, 25 bp, Rattus norvegicus
aggaatagcactcctgaggcctcag

SEQ ID NO: 139034 - DNA, 25 bp, Rattus norvegicus
aggaatagcactgctgaggcctcag

SEQ ID NO: 139035 - DNA, 25 bp, Rattus norvegicus
aggaatagccagagtcaccttcgac

SEQ ID NO: 139036 - DNA, 25 bp, Rattus norvegicus
aggaatagccagtgtcaccttcgac

SEQ ID NO: 139037 - DNA, 25 bp, Rattus norvegicus
aggaatagtttactccgctccacta

SEQ ID NO: 139038 - DNA, 25 bp, Rattus norvegicus
aggaatagtttagtccgctccacta

SEQ ID NO: 139039 - DNA, 25 bp, Rattus norvegicus
aggaatatcacactgtgggccctca

SEQ ID NO: 139040 - DNA, 25 bp, Rattus norvegicus
aggaatatcacagtgtgggccctca

SEQ ID NO: 139041 - DNA, 25 bp, Rattus norvegicus
aggaatatgaccctgtcacctcaga

SEQ ID NO: 139042 - DNA, 25 bp, Rattus norvegicus
aggaatatgaccgtgtcacctcaga

SEQ ID NO: 139043 - DNA, 25 bp, Rattus norvegicus
aggaatatgccccagaaggccacgg

SEQ ID NO: 139044 - DNA, 25 bp, Rattus norvegicus
aggaatatgcccgagaaggccacgg

SEQ ID NO: 139045 - DNA, 25 bp, Rattus norvegicus
aggaatattcagaatccctccctct

SEQ ID NO: 139046 - DNA, 25 bp, Rattus norvegicus
aggaatattcagtatccctccctct

SEQ ID NO: 139047 - DNA, 25 bp, Rattus norvegicus
aggaatcaaaccaggatcttttgaa

SEQ ID NO: 139048 - DNA, 25 bp, Rattus norvegicus
aggaatcaaacctggatcttttgaa

SEQ ID NO: 139049 - DNA, 25 bp, Rattus norvegicus
aggaatcaacctcttgttgcagcct

SEQ ID NO: 139050 - DNA, 25 bp, Rattus norvegicus
aggaatcaacctgttgttgcagcct

SEQ ID NO: 139051 - DNA, 25 bp, Rattus norvegicus
aggaatcaataaactggtgtcagtt

SEQ ID NO: 139052 - DNA, 25 bp, Rattus norvegicus
aggaatcaataatctggtgtcagtt

SEQ ID NO: 139053 - DNA, 25 bp, Rattus norvegicus
aggaatcacaggactctctctacca

SEQ ID NO: 139054 - DNA, 25 bp, Rattus norvegicus
aggaatcacaggtctctctctacca

SEQ ID NO: 139055 - DNA, 25 bp, Rattus norvegicus
aggaatcaccttacagatctgctgt

SEQ ID NO: 139056 - DNA, 25 bp, Rattus norvegicus
aggaatcacctttcagatctgctgt

SEQ ID NO: 139057 - DNA, 25 bp, Rattus norvegicus
aggaatcactgaagcctgacggagg

SEQ ID NO: 139058 - DNA, 25 bp, Rattus norvegicus
aggaatcactgatgcctgacggagg

SEQ ID NO: 139059 - DNA, 25 bp, Rattus norvegicus
aggaatcaggacagccgcacaggct

SEQ ID NO: 139060 - DNA, 25 bp, Rattus norvegicus
aggaatcaggactgccgcacaggct

SEQ ID NO: 139061 - DNA, 25 bp, Rattus norvegicus
aggaatcagtccctttctatcacac

SEQ ID NO: 139062 - DNA, 25 bp, Rattus norvegicus
aggaatcagtccgtttctatcacac

SEQ ID NO: 139063 - DNA, 25 bp, Rattus norvegicus
aggaatcatcatcgcaggctgggac

SEQ ID NO: 139064 - DNA, 25 bp, Rattus norvegicus
aggaatcatcatggcaggctgggac

SEQ ID NO: 139065 - DNA, 25 bp, Rattus norvegicus
aggaatcatctccaacactcaggtc

SEQ ID NO: 139066 - DNA, 25 bp, Rattus norvegicus
aggaatcatctcgaacactcaggtc

SEQ ID NO: 139067 - DNA, 25 bp, Rattus norvegicus
aggaatccaaccagagagtcttctg

SEQ ID NO: 139068 - DNA, 25 bp, Rattus norvegicus
aggaatccaacctgagagtcttctg

SEQ ID NO: 139069 - DNA, 25 bp, Rattus norvegicus
aggaatccactactgtcttaaacta

SEQ ID NO: 139070 - DNA, 25 bp, Rattus norvegicus
aggaatccactagtgtcttaaacta

SEQ ID NO: 139071 - DNA, 25 bp, Rattus norvegicus
aggaatccagaaacattaaggcagg

SEQ ID NO: 139072 - DNA, 25 bp, Rattus norvegicus
aggaatccagaatcattaaggcagg

SEQ ID NO: 139073 - DNA, 25 bp, Rattus norvegicus
aggaatccagacacgtgcgcataaa

SEQ ID NO: 139074 - DNA, 25 bp, Rattus norvegicus
aggaatccagactcgtgcgcataaa

SEQ ID NO: 139075 - DNA, 25 bp, Rattus norvegicus
aggaatccagagaccagatcagcaa

SEQ ID NO: 139076 - DNA, 25 bp, Rattus norvegicus
aggaatccagagtccagatcagcaa

SEQ ID NO: 139077 - DNA, 25 bp, Rattus norvegicus
aggaatccagctactactccttggg

SEQ ID NO: 139078 - DNA, 25 bp, Rattus norvegicus
aggaatccagcttctactccttggg

SEQ ID NO: 139079 - DNA, 25 bp, Rattus norvegicus
aggaatccaggtaagctgtttgtag

SEQ ID NO: 139080 - DNA, 25 bp, Rattus norvegicus
aggaatccaggttagctgtttgtag

SEQ ID NO: 139081 - DNA, 25 bp, Rattus norvegicus
aggaatccagtcatgtcatcacata

SEQ ID NO: 139082 - DNA, 25 bp, Rattus norvegicus
aggaatccagtcttgtcatcacata

SEQ ID NO: 139083 - DNA, 25 bp, Rattus norvegicus
aggaatccatgcatctcagcattgt

SEQ ID NO: 139084 - DNA, 25 bp, Rattus norvegicus
aggaatccatgcttctcagcattgt

SEQ ID NO: 139085 - DNA, 25 bp, Rattus norvegicus
aggaatccctatacccttgagtgct

SEQ ID NO: 139086 - DNA, 25 bp, Rattus norvegicus
aggaatccctattcccttgagtgct

SEQ ID NO: 139087 - DNA, 25 bp, Rattus norvegicus
aggaatcctcagctttttcttctct

SEQ ID NO: 139088 - DNA, 25 bp, Rattus norvegicus
aggaatcctcaggtttttcttctct

SEQ ID NO: 139089 - DNA, 25 bp, Rattus norvegicus
aggaatcctcttagtggctgcaggc

SEQ ID NO: 139090 - DNA, 25 bp, Rattus norvegicus
aggaatcctctttgtggctgcaggc

SEQ ID NO: 139091 - DNA, 25 bp, Rattus norvegicus
aggaatcctgggatatgctttcccc

SEQ ID NO: 139092 - DNA, 25 bp, Rattus norvegicus
aggaatcctgggttatgctttcccc

SEQ ID NO: 139093 - DNA, 25 bp, Rattus norvegicus
aggaatcgtcaacgacagttccctt

SEQ ID NO: 139094 - DNA, 25 bp, Rattus norvegicus
aggaatcgtcaaggacagttccctt

SEQ ID NO: 139095 - DNA, 25 bp, Rattus norvegicus
aggaatcgtgtccaggtgcttgatc

SEQ ID NO: 139096 - DNA, 25 bp, Rattus norvegicus
aggaatcgtgtcgaggtgcttgatc

SEQ ID NO: 139097 - DNA, 25 bp, Rattus norvegicus
aggaatctagccatgagtccagcca

SEQ ID NO: 139098 - DNA, 25 bp, Rattus norvegicus
aggaatctagccttgagtccagcca

SEQ ID NO: 139099 - DNA, 25 bp, Rattus norvegicus
aggaatctgcccacagatggccctc

SEQ ID NO: 139100 - DNA, 25 bp, Rattus norvegicus
aggaatctgccccttagttctacga

SEQ ID NO: 139101 - DNA, 25 bp, Rattus norvegicus
aggaatctgcccgttagttctacga

SEQ ID NO: 139102 - DNA, 25 bp, Rattus norvegicus
aggaatctgccctcagatggccctc

SEQ ID NO: 139103 - DNA, 25 bp, Rattus norvegicus
aggaatctggaaagactcttgagtc

SEQ ID NO: 139104 - DNA, 25 bp, Rattus norvegicus
aggaatctggaaccgatcatggata

SEQ ID NO: 139105 - DNA, 25 bp, Rattus norvegicus
aggaatctggaagcgatcatggata

SEQ ID NO: 139106 - DNA, 25 bp, Rattus norvegicus
aggaatctggaatgactcttgagtc

SEQ ID NO: 139107 - DNA, 25 bp, Rattus norvegicus
aggaatctggccctgtctgatagtc

SEQ ID NO: 139108 - DNA, 25 bp, Rattus norvegicus
aggaatctggccgtgtctgatagtc

SEQ ID NO: 139109 - DNA, 25 bp, Rattus norvegicus
aggaatcttaccagtgccactttgc

SEQ ID NO: 139110 - DNA, 25 bp, Rattus norvegicus
aggaatcttacctgtgccactttgc

SEQ ID NO: 139111 - DNA, 25 bp, Rattus norvegicus
aggaatcttctacagcaaccctttc

SEQ ID NO: 139112 - DNA, 25 bp, Rattus norvegicus
aggaatcttctagagcaaccctttc

SEQ ID NO: 139113 - DNA, 25 bp, Rattus norvegicus
aggaatcttgcacgagtctgggcat

SEQ ID NO: 139114 - DNA, 25 bp, Rattus norvegicus
aggaatcttgcaggagtctgggcat

SEQ ID NO: 139115 - DNA, 25 bp, Rattus norvegicus
aggaatcttttcaacaacaggcatg

SEQ ID NO: 139116 - DNA, 25 bp, Rattus norvegicus
aggaatcttttctacaacaggcatg

SEQ ID NO: 139117 - DNA, 25 bp, Rattus norvegicus
aggaatgaagctacccctggaacat

SEQ ID NO: 139118 - DNA, 25 bp, Rattus norvegicus
aggaatgaagcttcccctggaacat

SEQ ID NO: 139119 - DNA, 25 bp, Rattus norvegicus
aggaatgaatttccctctcttttgc

SEQ ID NO: 139120 - DNA, 25 bp, Rattus norvegicus
aggaatgaatttgcctctcttttgc

SEQ ID NO: 139121 - DNA, 25 bp, Rattus norvegicus
aggaatgacctgatcttgttctaca

SEQ ID NO: 139122 - DNA, 25 bp, Rattus norvegicus
aggaatgacctgttcttgttctaca

SEQ ID NO: 139123 - DNA, 25 bp, Rattus norvegicus
aggaatgagcggacagtcctctctc

SEQ ID NO: 139124 - DNA, 25 bp, Rattus norvegicus
aggaatgagcggtcagtcctctctc

SEQ ID NO: 139125 - DNA, 25 bp, Rattus norvegicus
aggaatgagggcaccagtcaggacc

SEQ ID NO: 139126 - DNA, 25 bp, Rattus norvegicus
aggaatgagggctccagtcaggacc

SEQ ID NO: 139127 - DNA, 25 bp, Rattus norvegicus
aggaatgcacgcaacgctgcctgca

SEQ ID NO: 139128 - DNA, 25 bp, Rattus norvegicus
aggaatgcacgctacgctgcctgca

SEQ ID NO: 139129 - DNA, 25 bp, Rattus norvegicus
aggaatgccaatactcaaactgtgg

SEQ ID NO: 139130 - DNA, 25 bp, Rattus norvegicus
aggaatgccaattctcaaactgtgg

SEQ ID NO: 139131 - DNA, 25 bp, Rattus norvegicus
aggaatgccaccaagttacactgta

SEQ ID NO: 139132 - DNA, 25 bp, Rattus norvegicus
aggaatgccacctagttacactgta

SEQ ID NO: 139133 - DNA, 25 bp, Rattus norvegicus
aggaatgccatcactagcacgctgg

SEQ ID NO: 139134 - DNA, 25 bp, Rattus norvegicus
aggaatgccatctctagcacgctgg

SEQ ID NO: 139135 - DNA, 25 bp, Rattus norvegicus
aggaatgccatgagcccagtgccaa

SEQ ID NO: 139136 - DNA, 25 bp, Rattus norvegicus
aggaatgccatgtgcccagtgccaa

SEQ ID NO: 139137 - DNA, 25 bp, Rattus norvegicus
aggaatgcccggagccaagaatgat

SEQ ID NO: 139138 - DNA, 25 bp, Rattus norvegicus
aggaatgcccggtgccaagaatgat

SEQ ID NO: 139139 - DNA, 25 bp, Rattus norvegicus
aggaatgccgagacccacggtgata

SEQ ID NO: 139140 - DNA, 25 bp, Rattus norvegicus
aggaatgccgagtcccacggtgata

SEQ ID NO: 139141 - DNA, 25 bp, Rattus norvegicus
aggaatgcctgcagacgtgccggac

SEQ ID NO: 139142 - DNA, 25 bp, Rattus norvegicus
aggaatgcctgctgacgtgccggac

SEQ ID NO: 139143 - DNA, 25 bp, Rattus norvegicus
aggaatgcctggaggcttccctggt

SEQ ID NO: 139144 - DNA, 25 bp, Rattus norvegicus
aggaatgcctggtggcttccctggt

SEQ ID NO: 139145 - DNA, 25 bp, Rattus norvegicus
aggaatgccttgagtttggcacccc

SEQ ID NO: 139146 - DNA, 25 bp, Rattus norvegicus
aggaatgccttgtgtttggcacccc

SEQ ID NO: 139147 - DNA, 25 bp, Rattus norvegicus
aggaatgcgcccaggagatcatcaa

SEQ ID NO: 139148 - DNA, 25 bp, Rattus norvegicus
aggaatgcgccctggagatcatcaa

SEQ ID NO: 139149 - DNA, 25 bp, Rattus norvegicus
aggaatgctaccagcactacacagc

SEQ ID NO: 139150 - DNA, 25 bp, Rattus norvegicus
aggaatgctacctgcactacacagc

SEQ ID NO: 139151 - DNA, 25 bp, Rattus norvegicus
aggaatgctgcgacttttcccttaa

SEQ ID NO: 139152 - DNA, 25 bp, Rattus norvegicus
aggaatgctgcgtcttttcccttaa

SEQ ID NO: 139153 - DNA, 25 bp, Rattus norvegicus
aggaatgctgtgaatcaccttggca

SEQ ID NO: 139154 - DNA, 25 bp, Rattus norvegicus
aggaatgctgtgtatcaccttggca

SEQ ID NO: 139155 - DNA, 25 bp, Rattus norvegicus
aggaatggaagcatccccaagtact

SEQ ID NO: 139156 - DNA, 25 bp, Rattus norvegicus
aggaatggaagcttccccaagtact

SEQ ID NO: 139157 - DNA, 25 bp, Rattus norvegicus
aggaatggacacaccaggccagggc

SEQ ID NO: 139158 - DNA, 25 bp, Rattus norvegicus
aggaatggacactccaggccagggc

SEQ ID NO: 139159 - DNA, 25 bp, Rattus norvegicus
aggaatggaccacttcctgtacggc

SEQ ID NO: 139160 - DNA, 25 bp, Rattus norvegicus
aggaatggaccagttcctgtacggc

SEQ ID NO: 139161 - DNA, 25 bp, Rattus norvegicus
aggaatggacctcttctgctatggc

SEQ ID NO: 139162 - DNA, 25 bp, Rattus norvegicus
aggaatggacctgttctgctatggc

SEQ ID NO: 139163 - DNA, 25 bp, Rattus norvegicus
aggaatggccaaccctgctttgtat

SEQ ID NO: 139164 - DNA, 25 bp, Rattus norvegicus
aggaatggccaagcctgctttgtat

SEQ ID NO: 139165 - DNA, 25 bp, Rattus norvegicus
aggaatggtggccttgctaaatcaa

SEQ ID NO: 139166 - DNA, 25 bp, Rattus norvegicus
aggaatggtggcgttgctaaatcaa

SEQ ID NO: 139167 - DNA, 25 bp, Rattus norvegicus
aggaatggttcacagatcccctcca

SEQ ID NO: 139168 - DNA, 25 bp, Rattus norvegicus
aggaatggttcagagatcccctcca

SEQ ID NO: 139169 - DNA, 25 bp, Rattus norvegicus
aggaatgtagctattctgcctcact

SEQ ID NO: 139170 - DNA, 25 bp, Rattus norvegicus
aggaatgtagcttttctgcctcact

SEQ ID NO: 139171 - DNA, 25 bp, Rattus norvegicus
aggaatgtcactaagtctggcccag

SEQ ID NO: 139172 - DNA, 25 bp, Rattus norvegicus
aggaatgtcacttagtctggcccag

SEQ ID NO: 139173 - DNA, 25 bp, Rattus norvegicus
aggaatgtctttaatctcttatcac

SEQ ID NO: 139174 - DNA, 25 bp, Rattus norvegicus
aggaatgtcttttatctcttatcac

SEQ ID NO: 139175 - DNA, 25 bp, Rattus norvegicus
aggaatgtgaacagctctctctctc

SEQ ID NO: 139176 - DNA, 25 bp, Rattus norvegicus
aggaatgtgaactgctctctctctc

SEQ ID NO: 139177 - DNA, 25 bp, Rattus norvegicus
aggaatgtgacaacactcggcctct

SEQ ID NO: 139178 - DNA, 25 bp, Rattus norvegicus
aggaatgtgacatcactcggcctct

SEQ ID NO: 139179 - DNA, 25 bp, Rattus norvegicus
aggaatgtgatcatggaccggcctg

SEQ ID NO: 139180 - DNA, 25 bp, Rattus norvegicus
aggaatgtgatcttggaccggcctg

SEQ ID NO: 139181 - DNA, 25 bp, Rattus norvegicus
aggaatgtgccaagagtcccactgg

SEQ ID NO: 139182 - DNA, 25 bp, Rattus norvegicus
aggaatgtgccatgagtcccactgg

SEQ ID NO: 139183 - DNA, 25 bp, Rattus norvegicus
aggaatgtgggcctctgcctattgt

SEQ ID NO: 139184 - DNA, 25 bp, Rattus norvegicus
aggaatgtgggcgtctgcctattgt

SEQ ID NO: 139185 - DNA, 25 bp, Rattus norvegicus
aggaatgttatccttctcgcctggt

SEQ ID NO: 139186 - DNA, 25 bp, Rattus norvegicus
aggaatgttatcgttctcgcctggt

SEQ ID NO: 139187 - DNA, 25 bp, Rattus norvegicus
aggaatgttgaccatttccccaatt

SEQ ID NO: 139188 - DNA, 25 bp, Rattus norvegicus
aggaatgttgacgatttccccaatt

SEQ ID NO: 139189 - DNA, 25 bp, Rattus norvegicus
aggaattaatccacttatgactaaa

SEQ ID NO: 139190 - DNA, 25 bp, Rattus norvegicus
aggaattaatcctcttatgactaaa

SEQ ID NO: 139191 - DNA, 25 bp, Rattus norvegicus
aggaattacgttagtggtagctcgg

SEQ ID NO: 139192 - DNA, 25 bp, Rattus norvegicus
aggaattacgtttgtggtagctcgg

SEQ ID NO: 139193 - DNA, 25 bp, Rattus norvegicus
aggaattactcccatgtgtgctctt

SEQ ID NO: 139194 - DNA, 25 bp, Rattus norvegicus
aggaattactccgatgtgtgctctt

SEQ ID NO: 139195 - DNA, 25 bp, Rattus norvegicus
aggaattagggtccattcacttaat

SEQ ID NO: 139196 - DNA, 25 bp, Rattus norvegicus
aggaattagggtgcattcacttaat

SEQ ID NO: 139197 - DNA, 25 bp, Rattus norvegicus
aggaattcaatgcaccagggtcagg

SEQ ID NO: 139198 - DNA, 25 bp, Rattus norvegicus
aggaattcaatggaccagggtcagg

SEQ ID NO: 139199 - DNA, 25 bp, Rattus norvegicus
aggaattcccttaagcttgtgggca

SEQ ID NO: 139200 - DNA, 25 bp, Rattus norvegicus
aggaattcccttcgtttctgtgaca

SEQ ID NO: 139201 - DNA, 25 bp, Rattus norvegicus
aggaattcccttggtttctgtgaca

SEQ ID NO: 139202 - DNA, 25 bp, Rattus norvegicus
aggaattccctttagcttgtgggca

SEQ ID NO: 139203 - DNA, 25 bp, Rattus norvegicus
aggaattcctcactgtccgtaggga

SEQ ID NO: 139204 - DNA, 25 bp, Rattus norvegicus
aggaattcctcagtgtccgtaggga

SEQ ID NO: 139205 - DNA, 25 bp, Rattus norvegicus
aggaattcctgcagcagaggcccag

SEQ ID NO: 139206 - DNA, 25 bp, Rattus norvegicus
aggaattcctgctgcagaggcccag

SEQ ID NO: 139207 - DNA, 25 bp, Rattus norvegicus
aggaattcgattagcttgaagccat

SEQ ID NO: 139208 - DNA, 25 bp, Rattus norvegicus
aggaattcgatttgcttgaagccat

SEQ ID NO: 139209 - DNA, 25 bp, Rattus norvegicus
aggaattgtctgacaccaaaataaa

SEQ ID NO: 139210 - DNA, 25 bp, Rattus norvegicus
aggaattgtctgtcaccaaaataaa

SEQ ID NO: 139211 - DNA, 25 bp, Rattus norvegicus
aggaattgtgctatgtcctagctct

SEQ ID NO: 139212 - DNA, 25 bp, Rattus norvegicus
aggaattgtgctttgtcctagctct

SEQ ID NO: 139213 - DNA, 25 bp, Rattus norvegicus
aggaatttatcacggcctttctgag

SEQ ID NO: 139214 - DNA, 25 bp, Rattus norvegicus
aggaatttatcagggcctttctgag

SEQ ID NO: 139215 - DNA, 25 bp, Rattus norvegicus
aggaatttcttgctgacccactggt

SEQ ID NO: 139216 - DNA, 25 bp, Rattus norvegicus
aggaatttcttggtgacccactggt

SEQ ID NO: 139217 - DNA, 25 bp, Rattus norvegicus
aggaatttgacaatagccgtattac

SEQ ID NO: 139218 - DNA, 25 bp, Rattus norvegicus
aggaatttgacattagccgtattac

SEQ ID NO: 139219 - DNA, 25 bp, Rattus norvegicus
aggaattttcatatttgcttatgca

SEQ ID NO: 139220 - DNA, 25 bp, Rattus norvegicus
aggaattttcatttttgcttatgca

SEQ ID NO: 139221 - DNA, 25 bp, Rattus norvegicus
aggaattttctcagcatagctttgc

SEQ ID NO: 139222 - DNA, 25 bp, Rattus norvegicus
aggaattttctctgcatagctttgc

SEQ ID NO: 139223 - DNA, 25 bp, Rattus norvegicus
aggaattttgccagccattcatggg

SEQ ID NO: 139224 - DNA, 25 bp, Rattus norvegicus
aggaattttgcctgccattcatggg

SEQ ID NO: 139225 - DNA, 25 bp, Rattus norvegicus
aggacaaacaaccttggatctccaa

SEQ ID NO: 139226 - DNA, 25 bp, Rattus norvegicus
aggacaaacaacgttggatctccaa

SEQ ID NO: 139227 - DNA, 25 bp, Rattus norvegicus
aggacaaaccccagattgcaaggaa

SEQ ID NO: 139228 - DNA, 25 bp, Rattus norvegicus
aggacaaacccctgattgcaaggaa

SEQ ID NO: 139229 - DNA, 25 bp, Rattus norvegicus
aggacaaagtccacaaacgccatct

SEQ ID NO: 139230 - DNA, 25 bp, Rattus norvegicus
aggacaaagtcctcaaacgccatct

SEQ ID NO: 139231 - DNA, 25 bp, Rattus norvegicus
aggacaaatcttccgttcttctgtg

SEQ ID NO: 139232 - DNA, 25 bp, Rattus norvegicus
aggacaaatcttgcgttcttctgtg

SEQ ID NO: 139233 - DNA, 25 bp, Rattus norvegicus
aggacaaatgtcaagtgctcactgc

SEQ ID NO: 139234 - DNA, 25 bp, Rattus norvegicus
aggacaaatgtctagtgctcactgc

SEQ ID NO: 139235 - DNA, 25 bp, Rattus norvegicus
aggacaacagagacattcccatgtg

SEQ ID NO: 139236 - DNA, 25 bp, Rattus norvegicus
aggacaacagagtcattcccatgtg

SEQ ID NO: 139237 - DNA, 25 bp, Rattus norvegicus
aggacaacatcgaggtgaccttccg

SEQ ID NO: 139238 - DNA, 25 bp, Rattus norvegicus
aggacaacatcgtggtgaccttccg

SEQ ID NO: 139239 - DNA, 25 bp, Rattus norvegicus
aggacaaccctgcagtggcctgttc

SEQ ID NO: 139240 - DNA, 25 bp, Rattus norvegicus
aggacaaccctggagtggcctgttc

SEQ ID NO: 139241 - DNA, 25 bp, Rattus norvegicus
aggacaaccgcacttatggtcaggt

SEQ ID NO: 139242 - DNA, 25 bp, Rattus norvegicus
aggacaaccgcagttatggtcaggt

SEQ ID NO: 139243 - DNA, 25 bp, Rattus norvegicus
aggacaaccttcaatagcagccagc

SEQ ID NO: 139244 - DNA, 25 bp, Rattus norvegicus
aggacaaccttctatagcagccagc

SEQ ID NO: 139245 - DNA, 25 bp, Rattus norvegicus
aggacaacgacaccaagcatcactg

SEQ ID NO: 139246 - DNA, 25 bp, Rattus norvegicus
aggacaacgacagcaagcatcactg

SEQ ID NO: 139247 - DNA, 25 bp, Rattus norvegicus
aggacaacggccagatgcatgctgg

SEQ ID NO: 139248 - DNA, 25 bp, Rattus norvegicus
aggacaacggcctgatgcatgctgg

SEQ ID NO: 139249 - DNA, 25 bp, Rattus norvegicus
aggacaactcttctaccgctgtgct

SEQ ID NO: 139250 - DNA, 25 bp, Rattus norvegicus
aggacaactcttgtaccgctgtgct

SEQ ID NO: 139251 - DNA, 25 bp, Rattus norvegicus
aggacaactgccagctgctagggtt

SEQ ID NO: 139252 - DNA, 25 bp, Rattus norvegicus
aggacaactgcctgctgctagggtt

SEQ ID NO: 139253 - DNA, 25 bp, Rattus norvegicus
aggacaactggcatcgcctagtgaa

SEQ ID NO: 139254 - DNA, 25 bp, Rattus norvegicus
aggacaactggcttcgcctagtgaa

SEQ ID NO: 139255 - DNA, 25 bp, Rattus norvegicus
aggacaactgtaatagatgctgctg

SEQ ID NO: 139256 - DNA, 25 bp, Rattus norvegicus
aggacaactgtattagatgctgctg

SEQ ID NO: 139257 - DNA, 25 bp, Rattus norvegicus
aggacaacttcccagatccatctgc

SEQ ID NO: 139258 - DNA, 25 bp, Rattus norvegicus
aggacaacttccgagatccatctgc

SEQ ID NO: 139259 - DNA, 25 bp, Rattus norvegicus
aggacaagaactcccacttgctccg

SEQ ID NO: 139260 - DNA, 25 bp, Rattus norvegicus
aggacaagaactgccacttgctccg

SEQ ID NO: 139261 - DNA, 25 bp, Rattus norvegicus
aggacaagaaggctccacgcatttg

SEQ ID NO: 139262 - DNA, 25 bp, Rattus norvegicus
aggacaagaagggtccacgcatttg

SEQ ID NO: 139263 - DNA, 25 bp, Rattus norvegicus
aggacaagaattctgaccctgccca

SEQ ID NO: 139264 - DNA, 25 bp, Rattus norvegicus
aggacaagaattgtgaccctgccca

SEQ ID NO: 139265 - DNA, 25 bp, Rattus norvegicus
aggacaagcgttcgctttggaccct

SEQ ID NO: 139266 - DNA, 25 bp, Rattus norvegicus
aggacaagcgttggctttggaccct

SEQ ID NO: 139267 - DNA, 25 bp, Rattus norvegicus
aggacaagctgtctatccgggtctg

SEQ ID NO: 139268 - DNA, 25 bp, Rattus norvegicus
aggacaagctgtgtatccgggtctg

SEQ ID NO: 139269 - DNA, 25 bp, Rattus norvegicus
aggacaaggaaacggcctcagccac

SEQ ID NO: 139270 - DNA, 25 bp, Rattus norvegicus
aggacaaggaaagggcctcagccac

SEQ ID NO: 139271 - DNA, 25 bp, Rattus norvegicus
aggacaaggatgatacccctctcat

SEQ ID NO: 139272 - DNA, 25 bp, Rattus norvegicus
aggacaaggatgttacccctctcat

SEQ ID NO: 139273 - DNA, 25 bp, Rattus norvegicus
aggacaaggcgcactggaagaatta

SEQ ID NO: 139274 - DNA, 25 bp, Rattus norvegicus
aggacaaggcgctctggaagaatta

SEQ ID NO: 139275 - DNA, 25 bp, Rattus norvegicus
aggacaatagtgagctaccaccctt

SEQ ID NO: 139276 - DNA, 25 bp, Rattus norvegicus
aggacaatagtgtgctaccaccctt

SEQ ID NO: 139277 - DNA, 25 bp, Rattus norvegicus
aggacaatgacacatctcctgggac

SEQ ID NO: 139278 - DNA, 25 bp, Rattus norvegicus
aggacaatgacagatctcctgggac

SEQ ID NO: 139279 - DNA, 25 bp, Rattus norvegicus
aggacaatgcagacttcgccacccg

SEQ ID NO: 139280 - DNA, 25 bp, Rattus norvegicus
aggacaatgcagtcttcgccacccg

SEQ ID NO: 139281 - DNA, 25 bp, Rattus norvegicus
aggacaatgcccacagcgtagctga

SEQ ID NO: 139282 - DNA, 25 bp, Rattus norvegicus
aggacaatgccctcagcgtagctga

SEQ ID NO: 139283 - DNA, 25 bp, Rattus norvegicus
aggacaatggcaagcctccccagta

SEQ ID NO: 139284 - DNA, 25 bp, Rattus norvegicus
aggacaatggcatgcctccccagta

SEQ ID NO: 139285 - DNA, 25 bp, Rattus norvegicus
aggacaatgtcccagcaggctgcag

SEQ ID NO: 139286 - DNA, 25 bp, Rattus norvegicus
aggacaatgtccgagcaggctgcag

SEQ ID NO: 139287 - DNA, 25 bp, Rattus norvegicus
aggacaatgtgcacggctttactat

SEQ ID NO: 139288 - DNA, 25 bp, Rattus norvegicus
aggacaatgtgctcggctttactat

SEQ ID NO: 139289 - DNA, 25 bp, Rattus norvegicus
aggacaatttcccatgctgcacttt

SEQ ID NO: 139290 - DNA, 25 bp, Rattus norvegicus
aggacaatttccgatgctgcacttt

SEQ ID NO: 139291 - DNA, 25 bp, Rattus norvegicus
aggacaatttgccatgggccccgga

SEQ ID NO: 139292 - DNA, 25 bp, Rattus norvegicus
aggacaatttgcgatgggccccgga

SEQ ID NO: 139293 - DNA, 25 bp, Rattus norvegicus
aggacacaaacaccagctgttgcct

SEQ ID NO: 139294 - DNA, 25 bp, Rattus norvegicus
aggacacaaacagcagctgttgcct

SEQ ID NO: 139295 - DNA, 25 bp, Rattus norvegicus
aggacacaagtgcttttgcccctta

SEQ ID NO: 139296 - DNA, 25 bp, Rattus norvegicus
aggacacaagtggttttgcccctta

SEQ ID NO: 139297 - DNA, 25 bp, Rattus norvegicus
aggacacaattcagacagccgccat

SEQ ID NO: 139298 - DNA, 25 bp, Rattus norvegicus
aggacacaattcctgcttccttttg

SEQ ID NO: 139299 - DNA, 25 bp, Rattus norvegicus
aggacacaattcgtgcttccttttg

SEQ ID NO: 139300 - DNA, 25 bp, Rattus norvegicus
aggacacaattctgacagccgccat

SEQ ID NO: 139301 - DNA, 25 bp, Rattus norvegicus
aggacacaattgctgccaactagag

SEQ ID NO: 139302 - DNA, 25 bp, Rattus norvegicus
aggacacaattggtgccaactagag

SEQ ID NO: 139303 - DNA, 25 bp, Rattus norvegicus
aggacacacgagaagcatcatctgt

SEQ ID NO: 139304 - DNA, 25 bp, Rattus norvegicus
aggacacacgagtagcatcatctgt

SEQ ID NO: 139305 - DNA, 25 bp, Rattus norvegicus
aggacacactgacctatgaacggga

SEQ ID NO: 139306 - DNA, 25 bp, Rattus norvegicus
aggacacactgagctatgaacggga

SEQ ID NO: 139307 - DNA, 25 bp, Rattus norvegicus
aggacacagaatcgcctgggtacac

SEQ ID NO: 139308 - DNA, 25 bp, Rattus norvegicus
aggacacagaatggcctgggtacac

SEQ ID NO: 139309 - DNA, 25 bp, Rattus norvegicus
aggacacagactccgcagattccca

SEQ ID NO: 139310 - DNA, 25 bp, Rattus norvegicus
aggacacagactgcgcagattccca

SEQ ID NO: 139311 - DNA, 25 bp, Rattus norvegicus
aggacacagcctactcagagggtta

SEQ ID NO: 139312 - DNA, 25 bp, Rattus norvegicus
aggacacagccttctcagagggtta

SEQ ID NO: 139313 - DNA, 25 bp, Rattus norvegicus
aggacacagcttatacctactgagc

SEQ ID NO: 139314 - DNA, 25 bp, Rattus norvegicus
aggacacagcttttacctactgagc

SEQ ID NO: 139315 - DNA, 25 bp, Rattus norvegicus
aggacacaggatcgccgtcgcatac

SEQ ID NO: 139316 - DNA, 25 bp, Rattus norvegicus
aggacacaggatggccgtcgcatac

SEQ ID NO: 139317 - DNA, 25 bp, Rattus norvegicus
aggacacagtggacagctgtaaaca

SEQ ID NO: 139318 - DNA, 25 bp, Rattus norvegicus
aggacacagtggtcagctgtaaaca

SEQ ID NO: 139319 - DNA, 25 bp, Rattus norvegicus
aggacacatcccaggaagacggcca

SEQ ID NO: 139320 - DNA, 25 bp, Rattus norvegicus
aggacacatccctggaagacggcca

SEQ ID NO: 139321 - DNA, 25 bp, Rattus norvegicus
aggacacatcctattctgaaatacg

SEQ ID NO: 139322 - DNA, 25 bp, Rattus norvegicus
aggacacatccttttctgaaatacg

SEQ ID NO: 139323 - DNA, 25 bp, Rattus norvegicus
aggacacatggccagtaccccggtc

SEQ ID NO: 139324 - DNA, 25 bp, Rattus norvegicus
aggacacatggcgagtaccccggtc

SEQ ID NO: 139325 - DNA, 25 bp, Rattus norvegicus
aggacacattttatctgcatttagc

SEQ ID NO: 139326 - DNA, 25 bp, Rattus norvegicus
aggacacattttttctgcatttagc

SEQ ID NO: 139327 - DNA, 25 bp, Rattus norvegicus
aggacaccaacaacttcttcggcgc

SEQ ID NO: 139328 - DNA, 25 bp, Rattus norvegicus
aggacaccaacatcttcttcggcgc

SEQ ID NO: 139329 - DNA, 25 bp, Rattus norvegicus
aggacaccaactccttcttcgctgg

SEQ ID NO: 139330 - DNA, 25 bp, Rattus norvegicus
aggacaccaactgcttcttcgctgg

SEQ ID NO: 139331 - DNA, 25 bp, Rattus norvegicus
aggacaccaagaaggcgacccagaa

SEQ ID NO: 139332 - DNA, 25 bp, Rattus norvegicus
aggacaccaagatggcgacccagaa

SEQ ID NO: 139333 - DNA, 25 bp, Rattus norvegicus
aggacaccaatgatactgaagctat

SEQ ID NO: 139334 - DNA, 25 bp, Rattus norvegicus
aggacaccaatgttactgaagctat

SEQ ID NO: 139335 - DNA, 25 bp, Rattus norvegicus
aggacaccagacacgacttttcagt

SEQ ID NO: 139336 - DNA, 25 bp, Rattus norvegicus
aggacaccagactcgacttttcagt

SEQ ID NO: 139337 - DNA, 25 bp, Rattus norvegicus
aggacaccagcaaactgcccagctt

SEQ ID NO: 139338 - DNA, 25 bp, Rattus norvegicus
aggacaccagcatactgcccagctt

SEQ ID NO: 139339 - DNA, 25 bp, Rattus norvegicus
aggacaccaggtactgaggacattc

SEQ ID NO: 139340 - DNA, 25 bp, Rattus norvegicus
aggacaccaggtcttcttaactgct

SEQ ID NO: 139341 - DNA, 25 bp, Rattus norvegicus
aggacaccaggtgttcttaactgct

SEQ ID NO: 139342 - DNA, 25 bp, Rattus norvegicus
aggacaccaggttctgaggacattc

SEQ ID NO: 139343 - DNA, 25 bp, Rattus norvegicus
aggacaccccaaacatccagaatga

SEQ ID NO: 139344 - DNA, 25 bp, Rattus norvegicus
aggacaccccaatcatccagaatga

SEQ ID NO: 139345 - DNA, 25 bp, Rattus norvegicus
aggacaccccacagatacaatttaa

SEQ ID NO: 139346 - DNA, 25 bp, Rattus norvegicus
aggacaccccactgatacaatttaa

SEQ ID NO: 139347 - DNA, 25 bp, Rattus norvegicus
aggacaccccagagactgctgaagg

SEQ ID NO: 139348 - DNA, 25 bp, Rattus norvegicus
aggacaccccagtgactgctgaagg

SEQ ID NO: 139349 - DNA, 25 bp, Rattus norvegicus
aggacaccccatagacctgaagtca

SEQ ID NO: 139350 - DNA, 25 bp, Rattus norvegicus
aggacaccccattgacctgaagtca

SEQ ID NO: 139351 - DNA, 25 bp, Rattus norvegicus
aggacacccgtgaagagccctcagt

SEQ ID NO: 139352 - DNA, 25 bp, Rattus norvegicus
aggacacccgtgtagagccctcagt

SEQ ID NO: 139353 - DNA, 25 bp, Rattus norvegicus
aggacaccgtctatatgaaacacac

SEQ ID NO: 139354 - DNA, 25 bp, Rattus norvegicus
aggacaccgtctttatgaaacacac

SEQ ID NO: 139355 - DNA, 25 bp, Rattus norvegicus
aggacacctcccagtcggagagtga

SEQ ID NO: 139356 - DNA, 25 bp, Rattus norvegicus
aggacacctccctgtcggagagtga

SEQ ID NO: 139357 - DNA, 25 bp, Rattus norvegicus
aggacacctgctcacagctgttagc

SEQ ID NO: 139358 - DNA, 25 bp, Rattus norvegicus
aggacacctgctgacagctgttagc

SEQ ID NO: 139359 - DNA, 25 bp, Rattus norvegicus
aggacacctttgagacagagaacac

SEQ ID NO: 139360 - DNA, 25 bp, Rattus norvegicus
aggacacctttgtgacagagaacac

SEQ ID NO: 139361 - DNA, 25 bp, Rattus norvegicus
aggacacgattgaactgcccggaat

SEQ ID NO: 139362 - DNA, 25 bp, Rattus norvegicus
aggacacgattgtactgcccggaat

SEQ ID NO: 139363 - DNA, 25 bp, Rattus norvegicus
aggacacgccaacctactctgtgga

SEQ ID NO: 139364 - DNA, 25 bp, Rattus norvegicus
aggacacgccaagctactctgtgga

SEQ ID NO: 139365 - DNA, 25 bp, Rattus norvegicus
aggacactaaatactccacttcgac

SEQ ID NO: 139366 - DNA, 25 bp, Rattus norvegicus
aggacactaaattctccacttcgac

SEQ ID NO: 139367 - DNA, 25 bp, Rattus norvegicus
aggacactacaaaggccagcagatt

SEQ ID NO: 139368 - DNA, 25 bp, Rattus norvegicus
aggacactacaatggccagcagatt

SEQ ID NO: 139369 - DNA, 25 bp, Rattus norvegicus
aggacactagcactaactgccctaa

SEQ ID NO: 139370 - DNA, 25 bp, Rattus norvegicus
aggacactagcagtaactgccctaa

SEQ ID NO: 139371 - DNA, 25 bp, Rattus norvegicus
aggacactaggtagggcctggcctc

SEQ ID NO: 139372 - DNA, 25 bp, Rattus norvegicus
aggacactaggttgggcctggcctc

SEQ ID NO: 139373 - DNA, 25 bp, Rattus norvegicus
aggacactagtcatatcagataggg

SEQ ID NO: 139374 - DNA, 25 bp, Rattus norvegicus
aggacactagtcttatcagataggg

SEQ ID NO: 139375 - DNA, 25 bp, Rattus norvegicus
aggacactagtgacttcgccaagtt

SEQ ID NO: 139376 - DNA, 25 bp, Rattus norvegicus
aggacactagtgtcttcgccaagtt

SEQ ID NO: 139377 - DNA, 25 bp, Rattus norvegicus
aggacactccctcaataacttaagt

SEQ ID NO: 139378 - DNA, 25 bp, Rattus norvegicus
aggacactccctgaataacttaagt

SEQ ID NO: 139379 - DNA, 25 bp, Rattus norvegicus
aggacactccttatccagtcttttg

SEQ ID NO: 139380 - DNA, 25 bp, Rattus norvegicus
aggacactccttttccagtcttttg

SEQ ID NO: 139381 - DNA, 25 bp, Rattus norvegicus
aggacactctggacaatgacatcat

SEQ ID NO: 139382 - DNA, 25 bp, Rattus norvegicus
aggacactctggtcaatgacatcat

SEQ ID NO: 139383 - DNA, 25 bp, Rattus norvegicus
aggacactcttaccttcttctagaa

SEQ ID NO: 139384 - DNA, 25 bp, Rattus norvegicus
aggacactcttagcttcttctagaa

SEQ ID NO: 139385 - DNA, 25 bp, Rattus norvegicus
aggacactgaacctgcatgtgcaga

SEQ ID NO: 139386 - DNA, 25 bp, Rattus norvegicus
aggacactgaacgtgcatgtgcaga

SEQ ID NO: 139387 - DNA, 25 bp, Rattus norvegicus
aggacactgactatggctgggcgat

SEQ ID NO: 139388 - DNA, 25 bp, Rattus norvegicus
aggacactgactttggctgggcgat

SEQ ID NO: 139389 - DNA, 25 bp, Rattus norvegicus
aggacactgcctacccttaggtgca

SEQ ID NO: 139390 - DNA, 25 bp, Rattus norvegicus
aggacactgccttcccttaggtgca

SEQ ID NO: 139391 - DNA, 25 bp, Rattus norvegicus
aggacactgctaacaacgttcggaa

SEQ ID NO: 139392 - DNA, 25 bp, Rattus norvegicus
aggacactgctatcaacgttcggaa

SEQ ID NO: 139393 - DNA, 25 bp, Rattus norvegicus
aggacactggaacagggctccctcc

SEQ ID NO: 139394 - DNA, 25 bp, Rattus norvegicus
aggacactggaagagggctccctcc

SEQ ID NO: 139395 - DNA, 25 bp, Rattus norvegicus
aggacactggccacgggctaccagt

SEQ ID NO: 139396 - DNA, 25 bp, Rattus norvegicus
aggacactggcctcgggctaccagt

SEQ ID NO: 139397 - DNA, 25 bp, Rattus norvegicus
aggacactgtcaactgctttactgc

SEQ ID NO: 139398 - DNA, 25 bp, Rattus norvegicus
aggacactgtcatctgctttactgc

SEQ ID NO: 139399 - DNA, 25 bp, Rattus norvegicus
aggacactgtgaagatacccagcaa

SEQ ID NO: 139400 - DNA, 25 bp, Rattus norvegicus
aggacactgtgatgatacccagcaa

SEQ ID NO: 139401 - DNA, 25 bp, Rattus norvegicus
aggacacttacaaagcacccgcaat

SEQ ID NO: 139402 - DNA, 25 bp, Rattus norvegicus
aggacacttacatagcacccgcaat

SEQ ID NO: 139403 - DNA, 25 bp, Rattus norvegicus
aggacacttcacacatccatttatt

SEQ ID NO: 139404 - DNA, 25 bp, Rattus norvegicus
aggacacttcacagccattttctat

SEQ ID NO: 139405 - DNA, 25 bp, Rattus norvegicus
aggacacttcactcatccatttatt

SEQ ID NO: 139406 - DNA, 25 bp, Rattus norvegicus
aggacacttcactgccattttctat

SEQ ID NO: 139407 - DNA, 25 bp, Rattus norvegicus
aggacacttctgatcattggtcagc

SEQ ID NO: 139408 - DNA, 25 bp, Rattus norvegicus
aggacacttctgttcattggtcagc

SEQ ID NO: 139409 - DNA, 25 bp, Rattus norvegicus
aggacacttgctcgctggtgctgtt

SEQ ID NO: 139410 - DNA, 25 bp, Rattus norvegicus
aggacacttgctggctggtgctgtt

SEQ ID NO: 139411 - DNA, 25 bp, Rattus norvegicus
aggacactttgtcatctggcctgaa

SEQ ID NO: 139412 - DNA, 25 bp, Rattus norvegicus
aggacactttgtgatctggcctgaa

SEQ ID NO: 139413 - DNA, 25 bp, Rattus norvegicus
aggacagaacccattggaggtgcct

SEQ ID NO: 139414 - DNA, 25 bp, Rattus norvegicus
aggacagaaccctttggaggtgcct

SEQ ID NO: 139415 - DNA, 25 bp, Rattus norvegicus
aggacagaaggtcgccaggcacact

SEQ ID NO: 139416 - DNA, 25 bp, Rattus norvegicus
aggacagaaggtggccaggcacact

SEQ ID NO: 139417 - DNA, 25 bp, Rattus norvegicus
aggacagaatgcatccagcccttac

SEQ ID NO: 139418 - DNA, 25 bp, Rattus norvegicus
aggacagaatgcttccagcccttac

SEQ ID NO: 139419 - DNA, 25 bp, Rattus norvegicus
aggacagacagacgtctcctcgtgc

SEQ ID NO: 139420 - DNA, 25 bp, Rattus norvegicus
aggacagacagaggtctcctcgtgc

SEQ ID NO: 139421 - DNA, 25 bp, Rattus norvegicus
aggacagacctgctgctgagcttct

SEQ ID NO: 139422 - DNA, 25 bp, Rattus norvegicus
aggacagacctggtgctgagcttct

SEQ ID NO: 139423 - DNA, 25 bp, Rattus norvegicus
aggacagaccttcaactttgtgctc

SEQ ID NO: 139424 - DNA, 25 bp, Rattus norvegicus
aggacagaccttgaactttgtgctc

SEQ ID NO: 139425 - DNA, 25 bp, Rattus norvegicus
aggacagacttcatgtcctcttcag

SEQ ID NO: 139426 - DNA, 25 bp, Rattus norvegicus
aggacagacttcttgtcctcttcag

SEQ ID NO: 139427 - DNA, 25 bp, Rattus norvegicus
aggacagagcccagctggtagtgta

SEQ ID NO: 139428 - DNA, 25 bp, Rattus norvegicus
aggacagagccctgctggtagtgta

SEQ ID NO: 139429 - DNA, 25 bp, Rattus norvegicus
aggacagagctgaatgctgcctccc

SEQ ID NO: 139430 - DNA, 25 bp, Rattus norvegicus
aggacagagctgtatgctgcctccc

SEQ ID NO: 139431 - DNA, 25 bp, Rattus norvegicus
aggacagagcttcactgcctcaaac

SEQ ID NO: 139432 - DNA, 25 bp, Rattus norvegicus
aggacagagcttgactgcctcaaac

SEQ ID NO: 139433 - DNA, 25 bp, Rattus norvegicus
aggacagaggaaaaccggcgccgcc

SEQ ID NO: 139434 - DNA, 25 bp, Rattus norvegicus
aggacagaggaacaagcctcccaat

SEQ ID NO: 139435 - DNA, 25 bp, Rattus norvegicus
aggacagaggaagaagcctcccaat

SEQ ID NO: 139436 - DNA, 25 bp, Rattus norvegicus
aggacagaggaataccggcgccgcc

SEQ ID NO: 139437 - DNA, 25 bp, Rattus norvegicus
aggacagaggctctacccacacaat

SEQ ID NO: 139438 - DNA, 25 bp, Rattus norvegicus
aggacagaggctgtacccacacaat

SEQ ID NO: 139439 - DNA, 25 bp, Rattus norvegicus
aggacagagggcatcaccttgaacc

SEQ ID NO: 139440 - DNA, 25 bp, Rattus norvegicus
aggacagagggcttcaccttgaacc

SEQ ID NO: 139441 - DNA, 25 bp, Rattus norvegicus
aggacagagtgactacggctttgct

SEQ ID NO: 139442 - DNA, 25 bp, Rattus norvegicus
aggacagagtgagtacggctttgct

SEQ ID NO: 139443 - DNA, 25 bp, Rattus norvegicus
aggacagataatccagtttcttcag

SEQ ID NO: 139444 - DNA, 25 bp, Rattus norvegicus
aggacagataatgcagtttcttcag

SEQ ID NO: 139445 - DNA, 25 bp, Rattus norvegicus
aggacagcacggagactgcggtcat

SEQ ID NO: 139446 - DNA, 25 bp, Rattus norvegicus
aggacagcacggtgactgcggtcat

SEQ ID NO: 139447 - DNA, 25 bp, Rattus norvegicus
aggacagcactgagatagcctccct

SEQ ID NO: 139448 - DNA, 25 bp, Rattus norvegicus
aggacagcactgtgatagcctccct

SEQ ID NO: 139449 - DNA, 25 bp, Rattus norvegicus
aggacagcagacatgcagacctgta

SEQ ID NO: 139450 - DNA, 25 bp, Rattus norvegicus
aggacagcagacttgcagacctgta

SEQ ID NO: 139451 - DNA, 25 bp, Rattus norvegicus
aggacagcagctaccattgagaaga

SEQ ID NO: 139452 - DNA, 25 bp, Rattus norvegicus
aggacagcagcttccattgagaaga

SEQ ID NO: 139453 - DNA, 25 bp, Rattus norvegicus
aggacagcatgacctgcagcacctc

SEQ ID NO: 139454 - DNA, 25 bp, Rattus norvegicus
aggacagcatgagctgcagcacctc

SEQ ID NO: 139455 - DNA, 25 bp, Rattus norvegicus
aggacagcatgtcgccactgggccc

SEQ ID NO: 139456 - DNA, 25 bp, Rattus norvegicus
aggacagcatgtggccactgggccc

SEQ ID NO: 139457 - DNA, 25 bp, Rattus norvegicus
aggacagccagaactcttgggttct

SEQ ID NO: 139458 - DNA, 25 bp, Rattus norvegicus
aggacagccagatctcttgggttct

SEQ ID NO: 139459 - DNA, 25 bp, Rattus norvegicus
aggacagccataaaatctcagtgga

SEQ ID NO: 139460 - DNA, 25 bp, Rattus norvegicus
aggacagccatataatctcagtgga

SEQ ID NO: 139461 - DNA, 25 bp, Rattus norvegicus
aggacagccattcgctctctatcaa

SEQ ID NO: 139462 - DNA, 25 bp, Rattus norvegicus
aggacagccattggctctctatcaa

SEQ ID NO: 139463 - DNA, 25 bp, Rattus norvegicus
aggacagcccataagttctcattaa

SEQ ID NO: 139464 - DNA, 25 bp, Rattus norvegicus
aggacagcccattagttctcattaa

SEQ ID NO: 139465 - DNA, 25 bp, Rattus norvegicus
aggacagccccgaggcctgtgatta

SEQ ID NO: 139466 - DNA, 25 bp, Rattus norvegicus
aggacagccccgtggcctgtgatta

SEQ ID NO: 139467 - DNA, 25 bp, Rattus norvegicus
aggacagccggacgccaaaattcca

SEQ ID NO: 139468 - DNA, 25 bp, Rattus norvegicus
aggacagccggaggccaaaattcca

SEQ ID NO: 139469 - DNA, 25 bp, Rattus norvegicus
aggacagcctagactgtcgctcgct

SEQ ID NO: 139470 - DNA, 25 bp, Rattus norvegicus
aggacagcctagtctgtcgctcgct

SEQ ID NO: 139471 - DNA, 25 bp, Rattus norvegicus
aggacagcctatcacaaatttgtat

SEQ ID NO: 139472 - DNA, 25 bp, Rattus norvegicus
aggacagcctatgacaaatttgtat

SEQ ID NO: 139473 - DNA, 25 bp, Rattus norvegicus
aggacagcctgtatttctatgcaca

SEQ ID NO: 139474 - DNA, 25 bp, Rattus norvegicus
aggacagcctgtctactaaggaact

SEQ ID NO: 139475 - DNA, 25 bp, Rattus norvegicus
aggacagcctgtgtactaaggaact

SEQ ID NO: 139476 - DNA, 25 bp, Rattus norvegicus
aggacagcctgtttttctatgcaca

SEQ ID NO: 139477 - DNA, 25 bp, Rattus norvegicus
aggacagctaatcccagactcaaat

SEQ ID NO: 139478 - DNA, 25 bp, Rattus norvegicus
aggacagctaatgccagactcaaat

SEQ ID NO: 139479 - DNA, 25 bp, Rattus norvegicus
aggacagctacaccctgacagagga

SEQ ID NO: 139480 - DNA, 25 bp, Rattus norvegicus
aggacagctacagcctgacagagga

SEQ ID NO: 139481 - DNA, 25 bp, Rattus norvegicus
aggacagctgggactccaagtggca

SEQ ID NO: 139482 - DNA, 25 bp, Rattus norvegicus
aggacagctgggtctccaagtggca

SEQ ID NO: 139483 - DNA, 25 bp, Rattus norvegicus
aggacagcttggcttggcttagctc

SEQ ID NO: 139484 - DNA, 25 bp, Rattus norvegicus
aggacagcttgggttggcttagctc

SEQ ID NO: 139485 - DNA, 25 bp, Rattus norvegicus
aggacagcttttactcggtttcgct

SEQ ID NO: 139486 - DNA, 25 bp, Rattus norvegicus
aggacagctttttctcggtttcgct

SEQ ID NO: 139487 - DNA, 25 bp, Rattus norvegicus
aggacaggaaacacaacctgaggaa

SEQ ID NO: 139488 - DNA, 25 bp, Rattus norvegicus
aggacaggaaactcaacctgaggaa

SEQ ID NO: 139489 - DNA, 25 bp, Rattus norvegicus
aggacaggaccgctacttgtgccgt

SEQ ID NO: 139490 - DNA, 25 bp, Rattus norvegicus
aggacaggaccggtacttgtgccgt

SEQ ID NO: 139491 - DNA, 25 bp, Rattus norvegicus
aggacaggagagaggttctcagcct

SEQ ID NO: 139492 - DNA, 25 bp, Rattus norvegicus
aggacaggagagtggttctcagcct

SEQ ID NO: 139493 - DNA, 25 bp, Rattus norvegicus
aggacaggataacagcccctcacat

SEQ ID NO: 139494 - DNA, 25 bp, Rattus norvegicus
aggacaggataagagcccctcacat

SEQ ID NO: 139495 - DNA, 25 bp, Rattus norvegicus
aggacaggattgatccctgggaaga

SEQ ID NO: 139496 - DNA, 25 bp, Rattus norvegicus
aggacaggattgttccctgggaaga

SEQ ID NO: 139497 - DNA, 25 bp, Rattus norvegicus
aggacaggcaccactctggagaaaa

SEQ ID NO: 139498 - DNA, 25 bp, Rattus norvegicus
aggacaggcacctctctggagaaaa

SEQ ID NO: 139499 - DNA, 25 bp, Rattus norvegicus
aggacaggcagacactcagcttgga

SEQ ID NO: 139500 - DNA, 25 bp, Rattus norvegicus
aggacaggcagagactcagcttgga

SEQ ID NO: 139501 - DNA, 25 bp, Rattus norvegicus
aggacaggccggatctgacgccgca

SEQ ID NO: 139502 - DNA, 25 bp, Rattus norvegicus
aggacaggccggttctgacgccgca

SEQ ID NO: 139503 - DNA, 25 bp, Rattus norvegicus
aggacaggccttccgtatgggatcc

SEQ ID NO: 139504 - DNA, 25 bp, Rattus norvegicus
aggacaggccttgcgtatgggatcc

SEQ ID NO: 139505 - DNA, 25 bp, Rattus norvegicus
aggacaggcgctacatttagagcag

SEQ ID NO: 139506 - DNA, 25 bp, Rattus norvegicus
aggacaggcgctccttggtgtctcc

SEQ ID NO: 139507 - DNA, 25 bp, Rattus norvegicus
aggacaggcgctgcttggtgtctcc

SEQ ID NO: 139508 - DNA, 25 bp, Rattus norvegicus
aggacaggcgcttcatttagagcag

SEQ ID NO: 139509 - DNA, 25 bp, Rattus norvegicus
aggacaggcgtcatgctttagccca

SEQ ID NO: 139510 - DNA, 25 bp, Rattus norvegicus
aggacaggcgtcttgctttagccca

SEQ ID NO: 139511 - DNA, 25 bp, Rattus norvegicus
aggacaggctgtccttcagcggctt

SEQ ID NO: 139512 - DNA, 25 bp, Rattus norvegicus
aggacaggctgtgcttcagcggctt

SEQ ID NO: 139513 - DNA, 25 bp, Rattus norvegicus
aggacaggcttcagcgtcggccaaa

SEQ ID NO: 139514 - DNA, 25 bp, Rattus norvegicus
aggacaggcttctgcgtcggccaaa

SEQ ID NO: 139515 - DNA, 25 bp, Rattus norvegicus
aggacagggaagatcatggagacat

SEQ ID NO: 139516 - DNA, 25 bp, Rattus norvegicus
aggacagggaagttcatggagacat

SEQ ID NO: 139517 - DNA, 25 bp, Rattus norvegicus
aggacagggagaccattcttcccct

SEQ ID NO: 139518 - DNA, 25 bp, Rattus norvegicus
aggacagggagagcattcttcccct

SEQ ID NO: 139519 - DNA, 25 bp, Rattus norvegicus
aggacagggcctccagcaagcactg

SEQ ID NO: 139520 - DNA, 25 bp, Rattus norvegicus
aggacagggcctgcagcaagcactg

SEQ ID NO: 139521 - DNA, 25 bp, Rattus norvegicus
aggacagggctgaccagagagttct

SEQ ID NO: 139522 - DNA, 25 bp, Rattus norvegicus
aggacagggctgtccagagagttct

SEQ ID NO: 139523 - DNA, 25 bp, Rattus norvegicus
aggacagggtccagtaccctcaagg

SEQ ID NO: 139524 - DNA, 25 bp, Rattus norvegicus
aggacagggtcctgtaccctcaagg

SEQ ID NO: 139525 - DNA, 25 bp, Rattus norvegicus
aggacagtaccacgcagttcgtgca

SEQ ID NO: 139526 - DNA, 25 bp, Rattus norvegicus
aggacagtaccaggcagttcgtgca

SEQ ID NO: 139527 - DNA, 25 bp, Rattus norvegicus
aggacagtacccaattgcagtccca

SEQ ID NO: 139528 - DNA, 25 bp, Rattus norvegicus
aggacagtaccctattgcagtccca

SEQ ID NO: 139529 - DNA, 25 bp, Rattus norvegicus
aggacagtactgcagggccccagac

SEQ ID NO: 139530 - DNA, 25 bp, Rattus norvegicus
aggacagtactggagggccccagac

SEQ ID NO: 139531 - DNA, 25 bp, Rattus norvegicus
aggacagtagctctgtctgcttccc

SEQ ID NO: 139532 - DNA, 25 bp, Rattus norvegicus
aggacagtagctgtgtctgcttccc

SEQ ID NO: 139533 - DNA, 25 bp, Rattus norvegicus
aggacagtatgaatgctacctctac

SEQ ID NO: 139534 - DNA, 25 bp, Rattus norvegicus
aggacagtatgattgctacctctac

SEQ ID NO: 139535 - DNA, 25 bp, Rattus norvegicus
aggacagtatttacaagctcttttt

SEQ ID NO: 139536 - DNA, 25 bp, Rattus norvegicus
aggacagtattttcaagctcttttt

SEQ ID NO: 139537 - DNA, 25 bp, Rattus norvegicus
aggacagtcaaccagcaacttgcac

SEQ ID NO: 139538 - DNA, 25 bp, Rattus norvegicus
aggacagtcaacgagcaacttgcac

SEQ ID NO: 139539 - DNA, 25 bp, Rattus norvegicus
aggacagtcaagagcacaccgagga

SEQ ID NO: 139540 - DNA, 25 bp, Rattus norvegicus
aggacagtcaagtgcacaccgagga

SEQ ID NO: 139541 - DNA, 25 bp, Rattus norvegicus
aggacagtccgcagacaaggtcttt

SEQ ID NO: 139542 - DNA, 25 bp, Rattus norvegicus
aggacagtccgctgacaaggtcttt

SEQ ID NO: 139543 - DNA, 25 bp, Rattus norvegicus
aggacagtcctcagcttgccaaatg

SEQ ID NO: 139544 - DNA, 25 bp, Rattus norvegicus
aggacagtcctctgcttgccaaatg

SEQ ID NO: 139545 - DNA, 25 bp, Rattus norvegicus
aggacagtctagaagccgtgaaggc

SEQ ID NO: 139546 - DNA, 25 bp, Rattus norvegicus
aggacagtctagagctcgtcaccaa

SEQ ID NO: 139547 - DNA, 25 bp, Rattus norvegicus
aggacagtctagtagccgtgaaggc

SEQ ID NO: 139548 - DNA, 25 bp, Rattus norvegicus
aggacagtctagtgctcgtcaccaa

SEQ ID NO: 139549 - DNA, 25 bp, Rattus norvegicus
aggacagtcttaaaaccaattgcaa

SEQ ID NO: 139550 - DNA, 25 bp, Rattus norvegicus
aggacagtcttataaccaattgcaa

SEQ ID NO: 139551 - DNA, 25 bp, Rattus norvegicus
aggacagtcttcactgttggccatg

SEQ ID NO: 139552 - DNA, 25 bp, Rattus norvegicus
aggacagtcttctctgttggccatg

SEQ ID NO: 139553 - DNA, 25 bp, Rattus norvegicus
aggacagtgacaagcttctggcctc

SEQ ID NO: 139554 - DNA, 25 bp, Rattus norvegicus
aggacagtgacatgcttctggcctc

SEQ ID NO: 139555 - DNA, 25 bp, Rattus norvegicus
aggacagtgcaaatgactcgctcaa

SEQ ID NO: 139556 - DNA, 25 bp, Rattus norvegicus
aggacagtgcaattgactcgctcaa

SEQ ID NO: 139557 - DNA, 25 bp, Rattus norvegicus
aggacagtgcagacttgaaggagac

SEQ ID NO: 139558 - DNA, 25 bp, Rattus norvegicus
aggacagtgcagctgtgtgcctctc

SEQ ID NO: 139559 - DNA, 25 bp, Rattus norvegicus
aggacagtgcaggtgtgtgcctctc

SEQ ID NO: 139560 - DNA, 25 bp, Rattus norvegicus
aggacagtgcagtcttgaaggagac

SEQ ID NO: 139561 - DNA, 25 bp, Rattus norvegicus
aggacagtgctgacctccgactgag

SEQ ID NO: 139562 - DNA, 25 bp, Rattus norvegicus
aggacagtgctgtcctccgactgag

SEQ ID NO: 139563 - DNA, 25 bp, Rattus norvegicus
aggacagtgtcccacatatccattg

SEQ ID NO: 139564 - DNA, 25 bp, Rattus norvegicus
aggacagtgtccgacatatccattg

SEQ ID NO: 139565 - DNA, 25 bp, Rattus norvegicus
aggacagttctgctgttaccctgga

SEQ ID NO: 139566 - DNA, 25 bp, Rattus norvegicus
aggacagttctggtgttaccctgga

SEQ ID NO: 139567 - DNA, 25 bp, Rattus norvegicus
aggacagttgacctgagcctcaggt

SEQ ID NO: 139568 - DNA, 25 bp, Rattus norvegicus
aggacagttgacgtgagcctcaggt

SEQ ID NO: 139569 - DNA, 25 bp, Rattus norvegicus
aggacagtttccaagcagcccttgg

SEQ ID NO: 139570 - DNA, 25 bp, Rattus norvegicus
aggacagtttccaagttccaccagc

SEQ ID NO: 139571 - DNA, 25 bp, Rattus norvegicus
aggacagtttccagtcacctttgag

SEQ ID NO: 139572 - DNA, 25 bp, Rattus norvegicus
aggacagtttcctagcagcccttgg

SEQ ID NO: 139573 - DNA, 25 bp, Rattus norvegicus
aggacagtttcctagttccaccagc

SEQ ID NO: 139574 - DNA, 25 bp, Rattus norvegicus
aggacagtttcctgtcacctttgag

SEQ ID NO: 139575 - DNA, 25 bp, Rattus norvegicus
aggacagttttgcagctctactaga

SEQ ID NO: 139576 - DNA, 25 bp, Rattus norvegicus
aggacagttttggagctctactaga

SEQ ID NO: 139577 - DNA, 25 bp, Rattus norvegicus
aggacataaaggctgctgtctgcaa

SEQ ID NO: 139578 - DNA, 25 bp, Rattus norvegicus
aggacataaagggtgctgtctgcaa

SEQ ID NO: 139579 - DNA, 25 bp, Rattus norvegicus
aggacataactcacctttgaacccg

SEQ ID NO: 139580 - DNA, 25 bp, Rattus norvegicus
aggacataactctcctttgaacccg

SEQ ID NO: 139581 - DNA, 25 bp, Rattus norvegicus
aggacataattcaaccatccatggt

SEQ ID NO: 139582 - DNA, 25 bp, Rattus norvegicus
aggacataattctaccatccatggt

SEQ ID NO: 139583 - DNA, 25 bp, Rattus norvegicus
aggacataccggcagaaaccccgag

SEQ ID NO: 139584 - DNA, 25 bp, Rattus norvegicus
aggacataccgggagaaaccccgag

SEQ ID NO: 139585 - DNA, 25 bp, Rattus norvegicus
aggacatactgtccccaccatgtgg

SEQ ID NO: 139586 - DNA, 25 bp, Rattus norvegicus
aggacatactgtgcccaccatgtgg

SEQ ID NO: 139587 - DNA, 25 bp, Rattus norvegicus
aggacatagaccagctcgcaggtga

SEQ ID NO: 139588 - DNA, 25 bp, Rattus norvegicus
aggacatagacctgctcgcaggtga

SEQ ID NO: 139589 - DNA, 25 bp, Rattus norvegicus
aggacatagccaccactgaagtaga

SEQ ID NO: 139590 - DNA, 25 bp, Rattus norvegicus
aggacatagccagcactgaagtaga

SEQ ID NO: 139591 - DNA, 25 bp, Rattus norvegicus
aggacatagtctcaggcaagatgga

SEQ ID NO: 139592 - DNA, 25 bp, Rattus norvegicus
aggacatagtctgaggcaagatgga

SEQ ID NO: 139593 - DNA, 25 bp, Rattus norvegicus
aggacatccaaacccatgacgccag

SEQ ID NO: 139594 - DNA, 25 bp, Rattus norvegicus
aggacatccaaagccatgacgccag

SEQ ID NO: 139595 - DNA, 25 bp, Rattus norvegicus
aggacatccccgaagagtcaccaaa

SEQ ID NO: 139596 - DNA, 25 bp, Rattus norvegicus
aggacatccccgtagagtcaccaaa

SEQ ID NO: 139597 - DNA, 25 bp, Rattus norvegicus
aggacatccgttaatttggaggcag

SEQ ID NO: 139598 - DNA, 25 bp, Rattus norvegicus
aggacatccgtttatttggaggcag

SEQ ID NO: 139599 - DNA, 25 bp, Rattus norvegicus
aggacatcctgacccgttttcggaa

SEQ ID NO: 139600 - DNA, 25 bp, Rattus norvegicus
aggacatcctgaccgttcactgtga

SEQ ID NO: 139601 - DNA, 25 bp, Rattus norvegicus
aggacatcctgagccgttttcggaa

SEQ ID NO: 139602 - DNA, 25 bp, Rattus norvegicus
aggacatcctgagcgttcactgtga

SEQ ID NO: 139603 - DNA, 25 bp, Rattus norvegicus
aggacatcctggcatacttctttga

SEQ ID NO: 139604 - DNA, 25 bp, Rattus norvegicus
aggacatcctgggatacttctttga

SEQ ID NO: 139605 - DNA, 25 bp, Rattus norvegicus
aggacatcctgtacagtggcaccaa

SEQ ID NO: 139606 - DNA, 25 bp, Rattus norvegicus
aggacatcctgttcagtggcaccaa

SEQ ID NO: 139607 - DNA, 25 bp, Rattus norvegicus
aggacatcgatgagtctcctagact

SEQ ID NO: 139608 - DNA, 25 bp, Rattus norvegicus
aggacatcgatgtgtctcctagact

SEQ ID NO: 139609 - DNA, 25 bp, Rattus norvegicus
aggacatcgcctacaagatcgtcag

SEQ ID NO: 139610 - DNA, 25 bp, Rattus norvegicus
aggacatcgccttcaagatcgtcag

SEQ ID NO: 139611 - DNA, 25 bp, Rattus norvegicus
aggacatcggttacaggccaaggcc

SEQ ID NO: 139612 - DNA, 25 bp, Rattus norvegicus
aggacatcggtttcaggccaaggcc

SEQ ID NO: 139613 - DNA, 25 bp, Rattus norvegicus
aggacatcgtcaacatgctcatgca

SEQ ID NO: 139614 - DNA, 25 bp, Rattus norvegicus
aggacatcgtcatcatgctcatgca

SEQ ID NO: 139615 - DNA, 25 bp, Rattus norvegicus
aggacatcttcaccaagcttctgga

SEQ ID NO: 139616 - DNA, 25 bp, Rattus norvegicus
aggacatcttcagcaagcttctgga

SEQ ID NO: 139617 - DNA, 25 bp, Rattus norvegicus
aggacatgaaggctcacacctccat

SEQ ID NO: 139618 - DNA, 25 bp, Rattus norvegicus
aggacatgaagggtcacacctccat

SEQ ID NO: 139619 - DNA, 25 bp, Rattus norvegicus
aggacatgagctcgcctcagtcttt

SEQ ID NO: 139620 - DNA, 25 bp, Rattus norvegicus
aggacatgagctggcctcagtcttt

SEQ ID NO: 139621 - DNA, 25 bp, Rattus norvegicus
aggacatgattgactttcctcccag

SEQ ID NO: 139622 - DNA, 25 bp, Rattus norvegicus
aggacatgattgtctttcctcccag

SEQ ID NO: 139623 - DNA, 25 bp, Rattus norvegicus
aggacatgcagaacctgtggctggg

SEQ ID NO: 139624 - DNA, 25 bp, Rattus norvegicus
aggacatgcagatcctgtggctggg

SEQ ID NO: 139625 - DNA, 25 bp, Rattus norvegicus
aggacatgcccaatgccatgcctgt

SEQ ID NO: 139626 - DNA, 25 bp, Rattus norvegicus
aggacatgcccattgccatgcctgt

SEQ ID NO: 139627 - DNA, 25 bp, Rattus norvegicus
aggacatgctacagagtcccgtcag

SEQ ID NO: 139628 - DNA, 25 bp, Rattus norvegicus
aggacatgctactgagtcccgtcag

SEQ ID NO: 139629 - DNA, 25 bp, Rattus norvegicus
aggacatggaaaacacactcccctc

SEQ ID NO: 139630 - DNA, 25 bp, Rattus norvegicus
aggacatggaaatcacactcccctc

SEQ ID NO: 139631 - DNA, 25 bp, Rattus norvegicus
aggacatggccacatactactccgc

SEQ ID NO: 139632 - DNA, 25 bp, Rattus norvegicus
aggacatggccagatactactccgc

SEQ ID NO: 139633 - DNA, 25 bp, Rattus norvegicus
aggacatgtaccatgacagcagctc

SEQ ID NO: 139634 - DNA, 25 bp, Rattus norvegicus
aggacatgtaccttgacagcagctc

SEQ ID NO: 139635 - DNA, 25 bp, Rattus norvegicus
aggacatgtcctagctcagactctt

SEQ ID NO: 139636 - DNA, 25 bp, Rattus norvegicus
aggacatgtccttgctcagactctt

SEQ ID NO: 139637 - DNA, 25 bp, Rattus norvegicus
aggacatgtgcaaaccaggctctct

SEQ ID NO: 139638 - DNA, 25 bp, Rattus norvegicus
aggacatgtgcataccaggctctct

SEQ ID NO: 139639 - DNA, 25 bp, Rattus norvegicus
aggacattaaaccacatagccagac

SEQ ID NO: 139640 - DNA, 25 bp, Rattus norvegicus
aggacattaaacgacatagccagac

SEQ ID NO: 139641 - DNA, 25 bp, Rattus norvegicus
aggacattacctctgggcccagaag

SEQ ID NO: 139642 - DNA, 25 bp, Rattus norvegicus
aggacattacctgtgggcccagaag

SEQ ID NO: 139643 - DNA, 25 bp, Rattus norvegicus
aggacattactcataaaccctcaat

SEQ ID NO: 139644 - DNA, 25 bp, Rattus norvegicus
aggacattactcttaaaccctcaat

SEQ ID NO: 139645 - DNA, 25 bp, Rattus norvegicus
aggacattcctcagcttttttggca

SEQ ID NO: 139646 - DNA, 25 bp, Rattus norvegicus
aggacattcctctgcttttttggca

SEQ ID NO: 139647 - DNA, 25 bp, Rattus norvegicus
aggacattcgtcaatagcagctcag

SEQ ID NO: 139648 - DNA, 25 bp, Rattus norvegicus
aggacattcgtctatagcagctcag

SEQ ID NO: 139649 - DNA, 25 bp, Rattus norvegicus
aggacattctgtctgcttgtaggga

SEQ ID NO: 139650 - DNA, 25 bp, Rattus norvegicus
aggacattctgtgtgcttgtaggga

SEQ ID NO: 139651 - DNA, 25 bp, Rattus norvegicus
aggacattgatcattcgcatcaccg

SEQ ID NO: 139652 - DNA, 25 bp, Rattus norvegicus
aggacattgatctttcgcatcaccg

SEQ ID NO: 139653 - DNA, 25 bp, Rattus norvegicus
aggacattgatgacacctctaatga

SEQ ID NO: 139654 - DNA, 25 bp, Rattus norvegicus
aggacattgatgtcacctctaatga

SEQ ID NO: 139655 - DNA, 25 bp, Rattus norvegicus
aggacattgcctacaatcaggtttc

SEQ ID NO: 139656 - DNA, 25 bp, Rattus norvegicus
aggacattgccttcaatcaggtttc

SEQ ID NO: 139657 - DNA, 25 bp, Rattus norvegicus
aggacattggccactaactcaaaga

SEQ ID NO: 139658 - DNA, 25 bp, Rattus norvegicus
aggacattggcctctaactcaaaga

SEQ ID NO: 139659 - DNA, 25 bp, Rattus norvegicus
aggacattgggtactcagtgggtaa

SEQ ID NO: 139660 - DNA, 25 bp, Rattus norvegicus
aggacattgggtacttcccagcttc

SEQ ID NO: 139661 - DNA, 25 bp, Rattus norvegicus
aggacattgggttctcagtgggtaa

SEQ ID NO: 139662 - DNA, 25 bp, Rattus norvegicus
aggacattgggttcttcccagcttc

SEQ ID NO: 139663 - DNA, 25 bp, Rattus norvegicus
aggacatttatcatggagcctccgg

SEQ ID NO: 139664 - DNA, 25 bp, Rattus norvegicus
aggacatttatcttggagcctccgg

SEQ ID NO: 139665 - DNA, 25 bp, Rattus norvegicus
aggacatttattacacattaggctg

SEQ ID NO: 139666 - DNA, 25 bp, Rattus norvegicus
aggacatttatttcacattaggctg

SEQ ID NO: 139667 - DNA, 25 bp, Rattus norvegicus
aggacatttcttagagtgtttctcc

SEQ ID NO: 139668 - DNA, 25 bp, Rattus norvegicus
aggacatttcttccctaagccgaga

SEQ ID NO: 139669 - DNA, 25 bp, Rattus norvegicus
aggacatttcttctccttcatgtgg

SEQ ID NO: 139670 - DNA, 25 bp, Rattus norvegicus
aggacatttcttgcctaagccgaga

SEQ ID NO: 139671 - DNA, 25 bp, Rattus norvegicus
aggacatttcttgtccttcatgtgg

SEQ ID NO: 139672 - DNA, 25 bp, Rattus norvegicus
aggacatttctttgagtgtttctcc

SEQ ID NO: 139673 - DNA, 25 bp, Rattus norvegicus
aggacatttgaaaaccacttaggac

SEQ ID NO: 139674 - DNA, 25 bp, Rattus norvegicus
aggacatttgaataccacttaggac

SEQ ID NO: 139675 - DNA, 25 bp, Rattus norvegicus
aggacatttgctcccaggctgcaag

SEQ ID NO: 139676 - DNA, 25 bp, Rattus norvegicus
aggacatttgctgccaggctgcaag

SEQ ID NO: 139677 - DNA, 25 bp, Rattus norvegicus
aggacatttgtgctgtggcctctcc

SEQ ID NO: 139678 - DNA, 25 bp, Rattus norvegicus
aggacatttgtggtgtggcctctcc

SEQ ID NO: 139679 - DNA, 25 bp, Rattus norvegicus
aggaccaacaccatgcacagagaga

SEQ ID NO: 139680 - DNA, 25 bp, Rattus norvegicus
aggaccaacaccttgcacagagaga

SEQ ID NO: 139681 - DNA, 25 bp, Rattus norvegicus
aggaccaacatcagggaggcgttct

SEQ ID NO: 139682 - DNA, 25 bp, Rattus norvegicus
aggaccaacatctgggaggcgttct

SEQ ID NO: 139683 - DNA, 25 bp, Rattus norvegicus
aggaccaacctcagcggatcatgac

SEQ ID NO: 139684 - DNA, 25 bp, Rattus norvegicus
aggaccaacctctgcggatcatgac

SEQ ID NO: 139685 - DNA, 25 bp, Rattus norvegicus
aggaccaactcaccaaggtggcgga

SEQ ID NO: 139686 - DNA, 25 bp, Rattus norvegicus
aggaccaactcagcaaggtggcgga

SEQ ID NO: 139687 - DNA, 25 bp, Rattus norvegicus
aggaccaagccaaatgtctttctat

SEQ ID NO: 139688 - DNA, 25 bp, Rattus norvegicus
aggaccaagccatatgtctttctat

SEQ ID NO: 139689 - DNA, 25 bp, Rattus norvegicus
aggaccaaggttatcattcgcttct

SEQ ID NO: 139690 - DNA, 25 bp, Rattus norvegicus
aggaccaaggttttcattcgcttct

SEQ ID NO: 139691 - DNA, 25 bp, Rattus norvegicus
aggaccaatttacacttagcagtta

SEQ ID NO: 139692 - DNA, 25 bp, Rattus norvegicus
aggaccaatttagacttagcagtta

SEQ ID NO: 139693 - DNA, 25 bp, Rattus norvegicus
aggaccaatttgagagagctgtctt

SEQ ID NO: 139694 - DNA, 25 bp, Rattus norvegicus
aggaccaatttgtgagagctgtctt

SEQ ID NO: 139695 - DNA, 25 bp, Rattus norvegicus
aggaccacactgaggagacaccaca

SEQ ID NO: 139696 - DNA, 25 bp, Rattus norvegicus
aggaccacactgtggagacaccaca

SEQ ID NO: 139697 - DNA, 25 bp, Rattus norvegicus
aggaccacagcacggacctcaaggc

SEQ ID NO: 139698 - DNA, 25 bp, Rattus norvegicus
aggaccacagcagggacctcaaggc

SEQ ID NO: 139699 - DNA, 25 bp, Rattus norvegicus
aggaccacagctctgttccttcggc

SEQ ID NO: 139700 - DNA, 25 bp, Rattus norvegicus
aggaccacagctgtgttccttcggc

SEQ ID NO: 139701 - DNA, 25 bp, Rattus norvegicus
aggaccacatatatacctctgtcac

SEQ ID NO: 139702 - DNA, 25 bp, Rattus norvegicus
aggaccacatatttacctctgtcac

SEQ ID NO: 139703 - DNA, 25 bp, Rattus norvegicus
aggaccaccaaaaggaatgctgtaa

SEQ ID NO: 139704 - DNA, 25 bp, Rattus norvegicus
aggaccaccaaatggaatgctgtaa

SEQ ID NO: 139705 - DNA, 25 bp, Rattus norvegicus
aggaccaccacaacacaggatttga

SEQ ID NO: 139706 - DNA, 25 bp, Rattus norvegicus
aggaccaccacatcacaggatttga

SEQ ID NO: 139707 - DNA, 25 bp, Rattus norvegicus
aggaccaccagtccagatgccagga

SEQ ID NO: 139708 - DNA, 25 bp, Rattus norvegicus
aggaccaccagtgcagatgccagga

SEQ ID NO: 139709 - DNA, 25 bp, Rattus norvegicus
aggaccacctcaatgctgatacggg

SEQ ID NO: 139710 - DNA, 25 bp, Rattus norvegicus
aggaccacctcacctgggaatggaa

SEQ ID NO: 139711 - DNA, 25 bp, Rattus norvegicus
aggaccacctcagctgggaatggaa

SEQ ID NO: 139712 - DNA, 25 bp, Rattus norvegicus
aggaccacctcattgctgatacggg

SEQ ID NO: 139713 - DNA, 25 bp, Rattus norvegicus
aggaccacctgtatgaagcctctac

SEQ ID NO: 139714 - DNA, 25 bp, Rattus norvegicus
aggaccacctgtttgaagcctctac

SEQ ID NO: 139715 - DNA, 25 bp, Rattus norvegicus
aggaccacggaactcacttctggag

SEQ ID NO: 139716 - DNA, 25 bp, Rattus norvegicus
aggaccacggaagtcacttctggag

SEQ ID NO: 139717 - DNA, 25 bp, Rattus norvegicus
aggaccacggacatgagcttttaca

SEQ ID NO: 139718 - DNA, 25 bp, Rattus norvegicus
aggaccacggacttgagcttttaca

SEQ ID NO: 139719 - DNA, 25 bp, Rattus norvegicus
aggaccacgtgcacaaaaaatcttt

SEQ ID NO: 139720 - DNA, 25 bp, Rattus norvegicus
aggaccacgtgctcaaaaaatcttt

SEQ ID NO: 139721 - DNA, 25 bp, Rattus norvegicus
aggaccactggaactaaagctgaaa

SEQ ID NO: 139722 - DNA, 25 bp, Rattus norvegicus
aggaccactggatctaaagctgaaa

SEQ ID NO: 139723 - DNA, 25 bp, Rattus norvegicus
aggaccactgtaccaggctgactgc

SEQ ID NO: 139724 - DNA, 25 bp, Rattus norvegicus
aggaccactgtagcaggctgactgc

SEQ ID NO: 139725 - DNA, 25 bp, Rattus norvegicus
aggaccactttgaccacaacatcag

SEQ ID NO: 139726 - DNA, 25 bp, Rattus norvegicus
aggaccactttgtccacaacatcag

SEQ ID NO: 139727 - DNA, 25 bp, Rattus norvegicus
aggaccagaaccaagagccgtctag

SEQ ID NO: 139728 - DNA, 25 bp, Rattus norvegicus
aggaccagaacctagagccgtctag

SEQ ID NO: 139729 - DNA, 25 bp, Rattus norvegicus
aggaccagacgtacttttataaatg

SEQ ID NO: 139730 - DNA, 25 bp, Rattus norvegicus
aggaccagacgttcttttataaatg

SEQ ID NO: 139731 - DNA, 25 bp, Rattus norvegicus
aggaccagcaggcaagccaagagaa

SEQ ID NO: 139732 - DNA, 25 bp, Rattus norvegicus
aggaccagcagggaagccaagagaa

SEQ ID NO: 139733 - DNA, 25 bp, Rattus norvegicus
aggaccagctccaggccgctgtggt

SEQ ID NO: 139734 - DNA, 25 bp, Rattus norvegicus
aggaccagctcctggccgctgtggt

SEQ ID NO: 139735 - DNA, 25 bp, Rattus norvegicus
aggaccaggagaacatgatgctttt

SEQ ID NO: 139736 - DNA, 25 bp, Rattus norvegicus
aggaccaggagatcatgatgctttt

SEQ ID NO: 139737 - DNA, 25 bp, Rattus norvegicus
aggaccagggtaaagactcggagct

SEQ ID NO: 139738 - DNA, 25 bp, Rattus norvegicus
aggaccagggtatagactcggagct

SEQ ID NO: 139739 - DNA, 25 bp, Rattus norvegicus
aggaccaggtcaacagtctcaggag

SEQ ID NO: 139740 - DNA, 25 bp, Rattus norvegicus
aggaccaggtcatcagtctcaggag

SEQ ID NO: 139741 - DNA, 25 bp, Rattus norvegicus
aggaccagtattatcaatcattgct

SEQ ID NO: 139742 - DNA, 25 bp, Rattus norvegicus
aggaccagtattttcaatcattgct

SEQ ID NO: 139743 - DNA, 25 bp, Rattus norvegicus
aggaccagtgcgacacaggttccag

SEQ ID NO: 139744 - DNA, 25 bp, Rattus norvegicus
aggaccagtgcgtcacaggttccag

SEQ ID NO: 139745 - DNA, 25 bp, Rattus norvegicus
aggaccagtgtcacattcggctaca

SEQ ID NO: 139746 - DNA, 25 bp, Rattus norvegicus
aggaccagtgtcacttcctggagat

SEQ ID NO: 139747 - DNA, 25 bp, Rattus norvegicus
aggaccagtgtctcattcggctaca

SEQ ID NO: 139748 - DNA, 25 bp, Rattus norvegicus
aggaccagtgtctcttcctggagat

SEQ ID NO: 139749 - DNA, 25 bp, Rattus norvegicus
aggaccagttgcagttgtccagtca

SEQ ID NO: 139750 - DNA, 25 bp, Rattus norvegicus
aggaccagttgctgttgtccagtca

SEQ ID NO: 139751 - DNA, 25 bp, Rattus norvegicus
aggaccatatttcccttcccgtctg

SEQ ID NO: 139752 - DNA, 25 bp, Rattus norvegicus
aggaccatatttgccttcccgtctg

SEQ ID NO: 139753 - DNA, 25 bp, Rattus norvegicus
aggaccatccagaatcccatagggt

SEQ ID NO: 139754 - DNA, 25 bp, Rattus norvegicus
aggaccatccagtatcccatagggt

SEQ ID NO: 139755 - DNA, 25 bp, Rattus norvegicus
aggaccatctagaagctctgttctc

SEQ ID NO: 139756 - DNA, 25 bp, Rattus norvegicus
aggaccatctagtagctctgttctc

SEQ ID NO: 139757 - DNA, 25 bp, Rattus norvegicus
aggaccatgactacttggagaatga

SEQ ID NO: 139758 - DNA, 25 bp, Rattus norvegicus
aggaccatgacttcttggagaatga

SEQ ID NO: 139759 - DNA, 25 bp, Rattus norvegicus
aggaccatgcggcagtagcagccat

SEQ ID NO: 139760 - DNA, 25 bp, Rattus norvegicus
aggaccatgcgggagtagcagccat

SEQ ID NO: 139761 - DNA, 25 bp, Rattus norvegicus
aggaccatgctcacaagtggcgatt

SEQ ID NO: 139762 - DNA, 25 bp, Rattus norvegicus
aggaccatgctcagtctctgaggac

SEQ ID NO: 139763 - DNA, 25 bp, Rattus norvegicus
aggaccatgctctcaagtggcgatt

SEQ ID NO: 139764 - DNA, 25 bp, Rattus norvegicus
aggaccatgctctgtctctgaggac

SEQ ID NO: 139765 - DNA, 25 bp, Rattus norvegicus
aggaccatgctgaatacgccacagg

SEQ ID NO: 139766 - DNA, 25 bp, Rattus norvegicus
aggaccatgctgtatacgccacagg

SEQ ID NO: 139767 - DNA, 25 bp, Rattus norvegicus
aggaccatggtcatttccactgcag

SEQ ID NO: 139768 - DNA, 25 bp, Rattus norvegicus
aggaccatggtcttttccactgcag

SEQ ID NO: 139769 - DNA, 25 bp, Rattus norvegicus
aggaccatgtcaattctggttcccc

SEQ ID NO: 139770 - DNA, 25 bp, Rattus norvegicus
aggaccatgtcatttctggttcccc

SEQ ID NO: 139771 - DNA, 25 bp, Rattus norvegicus
aggaccatgtgtcagcttgtacctg

SEQ ID NO: 139772 - DNA, 25 bp, Rattus norvegicus
aggaccatgtgtctgctaggcaaac

SEQ ID NO: 139773 - DNA, 25 bp, Rattus norvegicus
aggaccatgtgtgagcttgtacctg

SEQ ID NO: 139774 - DNA, 25 bp, Rattus norvegicus
aggaccatgtgtgtgctaggcaaac

SEQ ID NO: 139775 - DNA, 25 bp, Rattus norvegicus
aggaccattagcaagcttcggcttt

SEQ ID NO: 139776 - DNA, 25 bp, Rattus norvegicus
aggaccattagctagcttcggcttt

SEQ ID NO: 139777 - DNA, 25 bp, Rattus norvegicus
aggaccattcacagtttcccttgat

SEQ ID NO: 139778 - DNA, 25 bp, Rattus norvegicus
aggaccattcactgtttcccttgat

SEQ ID NO: 139779 - DNA, 25 bp, Rattus norvegicus
aggaccattcccattaatttattgt

SEQ ID NO: 139780 - DNA, 25 bp, Rattus norvegicus
aggaccattccctttaatttattgt

SEQ ID NO: 139781 - DNA, 25 bp, Rattus norvegicus
aggaccattcctcttgtattcaaag

SEQ ID NO: 139782 - DNA, 25 bp, Rattus norvegicus
aggaccattcctgttgtattcaaag

SEQ ID NO: 139783 - DNA, 25 bp, Rattus norvegicus
aggaccattgtcctggagcagcctt

SEQ ID NO: 139784 - DNA, 25 bp, Rattus norvegicus
aggaccattgtcgtggagcagcctt

SEQ ID NO: 139785 - DNA, 25 bp, Rattus norvegicus
aggaccatttgcagtgcctgaccac

SEQ ID NO: 139786 - DNA, 25 bp, Rattus norvegicus
aggaccatttgctgtgcctgaccac

SEQ ID NO: 139787 - DNA, 25 bp, Rattus norvegicus
aggacccaaaccagcttatctgttt

SEQ ID NO: 139788 - DNA, 25 bp, Rattus norvegicus
aggacccaaacctgcttatctgttt

SEQ ID NO: 139789 - DNA, 25 bp, Rattus norvegicus
aggacccaaatcagctactttgagg

SEQ ID NO: 139790 - DNA, 25 bp, Rattus norvegicus
aggacccaaatctgctactttgagg

SEQ ID NO: 139791 - DNA, 25 bp, Rattus norvegicus
aggacccaaggcaggacctgcgagt

SEQ ID NO: 139792 - DNA, 25 bp, Rattus norvegicus
aggacccaaggctggacctgcgagt

SEQ ID NO: 139793 - DNA, 25 bp, Rattus norvegicus
aggacccaagtgactgatgtttaca

SEQ ID NO: 139794 - DNA, 25 bp, Rattus norvegicus
aggacccaagtgtctgatgtttaca

SEQ ID NO: 139795 - DNA, 25 bp, Rattus norvegicus
aggacccacctccaagagtctagac

SEQ ID NO: 139796 - DNA, 25 bp, Rattus norvegicus
aggacccacctcgaagagtctagac

SEQ ID NO: 139797 - DNA, 25 bp, Rattus norvegicus
aggacccacggcctgagtaagcaga

SEQ ID NO: 139798 - DNA, 25 bp, Rattus norvegicus
aggacccacggcgtgagtaagcaga

SEQ ID NO: 139799 - DNA, 25 bp, Rattus norvegicus
aggacccactcaaggatctggtgtc

SEQ ID NO: 139800 - DNA, 25 bp, Rattus norvegicus
aggacccactcatggatctggtgtc

SEQ ID NO: 139801 - DNA, 25 bp, Rattus norvegicus
aggacccactgcctgctttaataaa

SEQ ID NO: 139802 - DNA, 25 bp, Rattus norvegicus
aggacccactgcgtgctttaataaa

SEQ ID NO: 139803 - DNA, 25 bp, Rattus norvegicus
aggacccacttgagcgccagtttga

SEQ ID NO: 139804 - DNA, 25 bp, Rattus norvegicus
aggacccacttgtgcgccagtttga

SEQ ID NO: 139805 - DNA, 25 bp, Rattus norvegicus
aggacccactttaatggctcaccta

SEQ ID NO: 139806 - DNA, 25 bp, Rattus norvegicus
aggacccacttttatggctcaccta

SEQ ID NO: 139807 - DNA, 25 bp, Rattus norvegicus
aggacccagaggagcttcggaacta

SEQ ID NO: 139808 - DNA, 25 bp, Rattus norvegicus
aggacccagaggtgcttcggaacta

SEQ ID NO: 139809 - DNA, 25 bp, Rattus norvegicus
aggacccagattcaaatgccagcat

SEQ ID NO: 139810 - DNA, 25 bp, Rattus norvegicus
aggacccagattgaaatgccagcat

SEQ ID NO: 139811 - DNA, 25 bp, Rattus norvegicus
aggacccagcagaactcaggattct

SEQ ID NO: 139812 - DNA, 25 bp, Rattus norvegicus
aggacccagcagtactcaggattct

SEQ ID NO: 139813 - DNA, 25 bp, Rattus norvegicus
aggacccagctcagttcctgcgcgg

SEQ ID NO: 139814 - DNA, 25 bp, Rattus norvegicus
aggacccagctctgttcctgcgcgg

SEQ ID NO: 139815 - DNA, 25 bp, Rattus norvegicus
aggacccaggccacctagactgagt

SEQ ID NO: 139816 - DNA, 25 bp, Rattus norvegicus
aggacccaggcctcctagactgagt

SEQ ID NO: 139817 - DNA, 25 bp, Rattus norvegicus
aggacccagggcatggctttggact

SEQ ID NO: 139818 - DNA, 25 bp, Rattus norvegicus
aggacccagggcttggctttggact

SEQ ID NO: 139819 - DNA, 25 bp, Rattus norvegicus
aggacccaggtaaaccattctgcac

SEQ ID NO: 139820 - DNA, 25 bp, Rattus norvegicus
aggacccaggtataccattctgcac

SEQ ID NO: 139821 - DNA, 25 bp, Rattus norvegicus
aggacccaggtcacaagcattcttt

SEQ ID NO: 139822 - DNA, 25 bp, Rattus norvegicus
aggacccaggtcatagtgctctatg

SEQ ID NO: 139823 - DNA, 25 bp, Rattus norvegicus
aggacccaggtctcaagcattcttt

SEQ ID NO: 139824 - DNA, 25 bp, Rattus norvegicus
aggacccaggtcttagtgctctatg

SEQ ID NO: 139825 - DNA, 25 bp, Rattus norvegicus
aggacccatattagatcagcccttc

SEQ ID NO: 139826 - DNA, 25 bp, Rattus norvegicus
aggacccatatttgatcagcccttc

SEQ ID NO: 139827 - DNA, 25 bp, Rattus norvegicus
aggaccccaacacagctctagagaa

SEQ ID NO: 139828 - DNA, 25 bp, Rattus norvegicus
aggaccccaacagagctctagagaa

SEQ ID NO: 139829 - DNA, 25 bp, Rattus norvegicus
aggaccccaactcctgagaaccagg

SEQ ID NO: 139830 - DNA, 25 bp, Rattus norvegicus
aggaccccaactctgattagtcttt

SEQ ID NO: 139831 - DNA, 25 bp, Rattus norvegicus
aggaccccaactgctgagaaccagg

SEQ ID NO: 139832 - DNA, 25 bp, Rattus norvegicus
aggaccccaactgtgattagtcttt

SEQ ID NO: 139833 - DNA, 25 bp, Rattus norvegicus
aggaccccaagccaacgtagtgcgt

SEQ ID NO: 139834 - DNA, 25 bp, Rattus norvegicus
aggaccccaagcgaacgtagtgcgt

SEQ ID NO: 139835 - DNA, 25 bp, Rattus norvegicus
aggaccccactcaaggctatgtcag

SEQ ID NO: 139836 - DNA, 25 bp, Rattus norvegicus
aggaccccactctaggctatgtcag

SEQ ID NO: 139837 - DNA, 25 bp, Rattus norvegicus
aggaccccactgaatgttgaaatgc

SEQ ID NO: 139838 - DNA, 25 bp, Rattus norvegicus
aggaccccactgtatgttgaaatgc

SEQ ID NO: 139839 - DNA, 25 bp, Rattus norvegicus
aggaccccagagaatagtgcccctg

SEQ ID NO: 139840 - DNA, 25 bp, Rattus norvegicus
aggaccccagagtatagtgcccctg

SEQ ID NO: 139841 - DNA, 25 bp, Rattus norvegicus
aggaccccagccatattgagtagca

SEQ ID NO: 139842 - DNA, 25 bp, Rattus norvegicus
aggaccccagccttattgagtagca

SEQ ID NO: 139843 - DNA, 25 bp, Rattus norvegicus
aggaccccagctcccgtgtggagaa

SEQ ID NO: 139844 - DNA, 25 bp, Rattus norvegicus
aggaccccagctgccgtgtggagaa

SEQ ID NO: 139845 - DNA, 25 bp, Rattus norvegicus
aggaccccagtaactctgttgtcag

SEQ ID NO: 139846 - DNA, 25 bp, Rattus norvegicus
aggaccccagtatctctgttgtcag

SEQ ID NO: 139847 - DNA, 25 bp, Rattus norvegicus
aggaccccgcggattactgcaaagg

SEQ ID NO: 139848 - DNA, 25 bp, Rattus norvegicus
aggaccccgcggtttactgcaaagg

SEQ ID NO: 139849 - DNA, 25 bp, Rattus norvegicus
aggaccccgtgtaaaagaactgctg

SEQ ID NO: 139850 - DNA, 25 bp, Rattus norvegicus
aggaccccgtgttaaagaactgctg

SEQ ID NO: 139851 - DNA, 25 bp, Rattus norvegicus
aggacccctaccaaccataatgtat

SEQ ID NO: 139852 - DNA, 25 bp, Rattus norvegicus
aggacccctacctaccataatgtat

SEQ ID NO: 139853 - DNA, 25 bp, Rattus norvegicus
aggacccctctccaagattctggga

SEQ ID NO: 139854 - DNA, 25 bp, Rattus norvegicus
aggacccctctcgaagattctggga

SEQ ID NO: 139855 - DNA, 25 bp, Rattus norvegicus
aggacccctgcgagtggtagagctc

SEQ ID NO: 139856 - DNA, 25 bp, Rattus norvegicus
aggacccctgcgtgtggtagagctc

SEQ ID NO: 139857 - DNA, 25 bp, Rattus norvegicus
aggaccccttgtctgtacattttgc

SEQ ID NO: 139858 - DNA, 25 bp, Rattus norvegicus
aggaccccttgtgtgtacattttgc

SEQ ID NO: 139859 - DNA, 25 bp, Rattus norvegicus
aggacccgaggtcatgttgcagcac

SEQ ID NO: 139860 - DNA, 25 bp, Rattus norvegicus
aggacccgaggtgatgttgcagcac

SEQ ID NO: 139861 - DNA, 25 bp, Rattus norvegicus
aggacccgctggagcagttcggcat

SEQ ID NO: 139862 - DNA, 25 bp, Rattus norvegicus
aggacccgctggtgcagttcggcat

SEQ ID NO: 139863 - DNA, 25 bp, Rattus norvegicus
aggacccgtaccagcaatggtgtac

SEQ ID NO: 139864 - DNA, 25 bp, Rattus norvegicus
aggacccgtacctgcaatggtgtac

SEQ ID NO: 139865 - DNA, 25 bp, Rattus norvegicus
aggacccgttagagctgctcagctg

SEQ ID NO: 139866 - DNA, 25 bp, Rattus norvegicus
aggacccgttagtgctgctcagctg

SEQ ID NO: 139867 - DNA, 25 bp, Rattus norvegicus
aggaccctacacagaggctcggtgg

SEQ ID NO: 139868 - DNA, 25 bp, Rattus norvegicus
aggaccctacactgaggctcggtgg

SEQ ID NO: 139869 - DNA, 25 bp, Rattus norvegicus
aggaccctatttatccctgacttag

SEQ ID NO: 139870 - DNA, 25 bp, Rattus norvegicus
aggaccctatttttccctgacttag

SEQ ID NO: 139871 - DNA, 25 bp, Rattus norvegicus
aggaccctcaatcctgagttcaatg

SEQ ID NO: 139872 - DNA, 25 bp, Rattus norvegicus
aggaccctcaatgctgagttcaatg

SEQ ID NO: 139873 - DNA, 25 bp, Rattus norvegicus
aggaccctcgctatgaaatttgcac

SEQ ID NO: 139874 - DNA, 25 bp, Rattus norvegicus
aggaccctcgctttgaaatttgcac

SEQ ID NO: 139875 - DNA, 25 bp, Rattus norvegicus
aggaccctctggctgtggacaaaat

SEQ ID NO: 139876 - DNA, 25 bp, Rattus norvegicus
aggaccctctgggtgtggacaaaat

SEQ ID NO: 139877 - DNA, 25 bp, Rattus norvegicus
aggaccctgacacaagctgcagagc

SEQ ID NO: 139878 - DNA, 25 bp, Rattus norvegicus
aggaccctgacagaagctgcagagc

SEQ ID NO: 139879 - DNA, 25 bp, Rattus norvegicus
aggaccctgagacactgcaagaatg

SEQ ID NO: 139880 - DNA, 25 bp, Rattus norvegicus
aggaccctgagagactgcaagaatg

SEQ ID NO: 139881 - DNA, 25 bp, Rattus norvegicus
aggaccctgcctaggagaagctcag

SEQ ID NO: 139882 - DNA, 25 bp, Rattus norvegicus
aggaccctgcctctgaggatccctg

SEQ ID NO: 139883 - DNA, 25 bp, Rattus norvegicus
aggaccctgcctgtgaggatccctg

SEQ ID NO: 139884 - DNA, 25 bp, Rattus norvegicus
aggaccctgccttggagaagctcag

SEQ ID NO: 139885 - DNA, 25 bp, Rattus norvegicus
aggaccctggacagcttgcgttgga

SEQ ID NO: 139886 - DNA, 25 bp, Rattus norvegicus
aggaccctggactgcttgcgttgga

SEQ ID NO: 139887 - DNA, 25 bp, Rattus norvegicus
aggaccctggcaagaaagcctgaat

SEQ ID NO: 139888 - DNA, 25 bp, Rattus norvegicus
aggaccctggcatgaaagcctgaat

SEQ ID NO: 139889 - DNA, 25 bp, Rattus norvegicus
aggaccctggtgatcttagcctgcc

SEQ ID NO: 139890 - DNA, 25 bp, Rattus norvegicus
aggaccctggtgttcttagcctgcc

SEQ ID NO: 139891 - DNA, 25 bp, Rattus norvegicus
aggaccctgtaccagctgtattgca

SEQ ID NO: 139892 - DNA, 25 bp, Rattus norvegicus
aggaccctgtacgagctgtattgca

SEQ ID NO: 139893 - DNA, 25 bp, Rattus norvegicus
aggaccctgtgtaaaatcgaccaga

SEQ ID NO: 139894 - DNA, 25 bp, Rattus norvegicus
aggaccctgtgttaaatcgaccaga

SEQ ID NO: 139895 - DNA, 25 bp, Rattus norvegicus
aggaccctgttcacttcagtggtac

SEQ ID NO: 139896 - DNA, 25 bp, Rattus norvegicus
aggaccctgttctcttcagtggtac

SEQ ID NO: 139897 - DNA, 25 bp, Rattus norvegicus
aggaccctttcacaatgaacagcag

SEQ ID NO: 139898 - DNA, 25 bp, Rattus norvegicus
aggaccctttcagaatgaacagcag

SEQ ID NO: 139899 - DNA, 25 bp, Rattus norvegicus
aggaccgattccacttcaatgagat

SEQ ID NO: 139900 - DNA, 25 bp, Rattus norvegicus
aggaccgattcctcttcaatgagat

SEQ ID NO: 139901 - DNA, 25 bp, Rattus norvegicus
aggaccgcaagaacatcctccgact

SEQ ID NO: 139902 - DNA, 25 bp, Rattus norvegicus
aggaccgcaagatcatcctccgact

SEQ ID NO: 139903 - DNA, 25 bp, Rattus norvegicus
aggaccgcctaaacccaggaggttg

SEQ ID NO: 139904 - DNA, 25 bp, Rattus norvegicus
aggaccgcctaatcccaggaggttg

SEQ ID NO: 139905 - DNA, 25 bp, Rattus norvegicus
aggaccgctactacaattcatcatg

SEQ ID NO: 139906 - DNA, 25 bp, Rattus norvegicus
aggaccgctacttcaattcatcatg

SEQ ID NO: 139907 - DNA, 25 bp, Rattus norvegicus
aggaccgctagcaaagagactctta

SEQ ID NO: 139908 - DNA, 25 bp, Rattus norvegicus
aggaccgctagctaagagactctta

SEQ ID NO: 139909 - DNA, 25 bp, Rattus norvegicus
aggaccgctgcaccctggcagagaa

SEQ ID NO: 139910 - DNA, 25 bp, Rattus norvegicus
aggaccgctgcagcctggcagagaa

SEQ ID NO: 139911 - DNA, 25 bp, Rattus norvegicus
aggaccgcttccacctcagtgaggt

SEQ ID NO: 139912 - DNA, 25 bp, Rattus norvegicus
aggaccgcttccacttcagtgactt

SEQ ID NO: 139913 - DNA, 25 bp, Rattus norvegicus
aggaccgcttcctcctcagtgaggt

SEQ ID NO: 139914 - DNA, 25 bp, Rattus norvegicus
aggaccgcttcctcttcagtgactt

SEQ ID NO: 139915 - DNA, 25 bp, Rattus norvegicus
aggaccggagaacgccagaacctgt

SEQ ID NO: 139916 - DNA, 25 bp, Rattus norvegicus
aggaccggagaaggccagaacctgt

SEQ ID NO: 139917 - DNA, 25 bp, Rattus norvegicus
aggaccggccttaactgcaagccag

SEQ ID NO: 139918 - DNA, 25 bp, Rattus norvegicus
aggaccggcctttactgcaagccag

SEQ ID NO: 139919 - DNA, 25 bp, Rattus norvegicus
aggaccgtatgtagaatattcttct

SEQ ID NO: 139920 - DNA, 25 bp, Rattus norvegicus
aggaccgtatgttgaatattcttct

SEQ ID NO: 139921 - DNA, 25 bp, Rattus norvegicus
aggaccgtggctatcttttctgtat

SEQ ID NO: 139922 - DNA, 25 bp, Rattus norvegicus
aggaccgtggctttcttttctgtat

SEQ ID NO: 139923 - DNA, 25 bp, Rattus norvegicus
aggaccgtgtcaagaatgccaatgt

SEQ ID NO: 139924 - DNA, 25 bp, Rattus norvegicus
aggaccgtgtcatgaatgccaatgt

SEQ ID NO: 139925 - DNA, 25 bp, Rattus norvegicus
aggaccgttctgcataggtggttta

SEQ ID NO: 139926 - DNA, 25 bp, Rattus norvegicus
aggaccgttctggataggtggttta

SEQ ID NO: 139927 - DNA, 25 bp, Rattus norvegicus
aggacctaagagaagctgtcacttt

SEQ ID NO: 139928 - DNA, 25 bp, Rattus norvegicus
aggacctaagagtagctgtcacttt

SEQ ID NO: 139929 - DNA, 25 bp, Rattus norvegicus
aggacctaaggcagtgtgcactccg

SEQ ID NO: 139930 - DNA, 25 bp, Rattus norvegicus
aggacctaaggctgtgtgcactccg

SEQ ID NO: 139931 - DNA, 25 bp, Rattus norvegicus
aggacctacaggaagtgacccaaga

SEQ ID NO: 139932 - DNA, 25 bp, Rattus norvegicus
aggacctacaggtagtgacccaaga

SEQ ID NO: 139933 - DNA, 25 bp, Rattus norvegicus
aggacctagagacagcctaccaggg

SEQ ID NO: 139934 - DNA, 25 bp, Rattus norvegicus
aggacctagagagagcctaccaggg

SEQ ID NO: 139935 - DNA, 25 bp, Rattus norvegicus
aggacctagatcacagttacccatc

SEQ ID NO: 139936 - DNA, 25 bp, Rattus norvegicus
aggacctagatctcagttacccatc

SEQ ID NO: 139937 - DNA, 25 bp, Rattus norvegicus
aggacctatgtgagaacaactttat

SEQ ID NO: 139938 - DNA, 25 bp, Rattus norvegicus
aggacctatgtgtgaacaactttat

SEQ ID NO: 139939 - DNA, 25 bp, Rattus norvegicus
aggacctattggctgacttgattgg

SEQ ID NO: 139940 - DNA, 25 bp, Rattus norvegicus
aggacctattgggtgacttgattgg

SEQ ID NO: 139941 - DNA, 25 bp, Rattus norvegicus
aggacctcaactcaaaagactaaag

SEQ ID NO: 139942 - DNA, 25 bp, Rattus norvegicus
aggacctcaactgaaaagactaaag

SEQ ID NO: 139943 - DNA, 25 bp, Rattus norvegicus
aggacctcatatcgaaccacacccg

SEQ ID NO: 139944 - DNA, 25 bp, Rattus norvegicus
aggacctcatatggaaccacacccg

SEQ ID NO: 139945 - DNA, 25 bp, Rattus norvegicus
aggacctcatgcctgtacacaagca

SEQ ID NO: 139946 - DNA, 25 bp, Rattus norvegicus
aggacctcatgcgtgtacacaagca

SEQ ID NO: 139947 - DNA, 25 bp, Rattus norvegicus
aggacctccatgcatttgatcactg

SEQ ID NO: 139948 - DNA, 25 bp, Rattus norvegicus
aggacctccatggatttgatcactg

SEQ ID NO: 139949 - DNA, 25 bp, Rattus norvegicus
aggacctccgggatcacaaacttga

SEQ ID NO: 139950 - DNA, 25 bp, Rattus norvegicus
aggacctccgggttcacaaacttga

SEQ ID NO: 139951 - DNA, 25 bp, Rattus norvegicus
aggacctcctgacagcctgagctca

SEQ ID NO: 139952 - DNA, 25 bp, Rattus norvegicus
aggacctcctgactccatgaagaac

SEQ ID NO: 139953 - DNA, 25 bp, Rattus norvegicus
aggacctcctgagagcctgagctca

SEQ ID NO: 139954 - DNA, 25 bp, Rattus norvegicus
aggacctcctgagtccatgaagaac

SEQ ID NO: 139955 - DNA, 25 bp, Rattus norvegicus
aggacctcgtgaaccacttttattg

SEQ ID NO: 139956 - DNA, 25 bp, Rattus norvegicus
aggacctcgtgatccacttttattg

SEQ ID NO: 139957 - DNA, 25 bp, Rattus norvegicus
aggacctcgtggcttgtgcctgaaa

SEQ ID NO: 139958 - DNA, 25 bp, Rattus norvegicus
aggacctcgtgggttgtgcctgaaa

SEQ ID NO: 139959 - DNA, 25 bp, Rattus norvegicus
aggacctctacaaagaagtctatcc

SEQ ID NO: 139960 - DNA, 25 bp, Rattus norvegicus
aggacctctacatagaagtctatcc

SEQ ID NO: 139961 - DNA, 25 bp, Rattus norvegicus
aggacctctatgagttggccttctc

SEQ ID NO: 139962 - DNA, 25 bp, Rattus norvegicus
aggacctctatgtgttggccttctc

SEQ ID NO: 139963 - DNA, 25 bp, Rattus norvegicus
aggacctctctgattaggtgccaac

SEQ ID NO: 139964 - DNA, 25 bp, Rattus norvegicus
aggacctctctgtttaggtgccaac

SEQ ID NO: 139965 - DNA, 25 bp, Rattus norvegicus
aggacctctgctactgtaggatgac

SEQ ID NO: 139966 - DNA, 25 bp, Rattus norvegicus
aggacctctgcttctgtaggatgac

SEQ ID NO: 139967 - DNA, 25 bp, Rattus norvegicus
aggacctctggtatgcttcgagaag

SEQ ID NO: 139968 - DNA, 25 bp, Rattus norvegicus
aggacctctggtttgcttcgagaag

SEQ ID NO: 139969 - DNA, 25 bp, Rattus norvegicus
aggacctctgtactccttggccatt

SEQ ID NO: 139970 - DNA, 25 bp, Rattus norvegicus
aggacctctgtagtccttggccatt

SEQ ID NO: 139971 - DNA, 25 bp, Rattus norvegicus
aggacctcttccagattctcctaaa

SEQ ID NO: 139972 - DNA, 25 bp, Rattus norvegicus
aggacctcttcctgattctcctaaa

SEQ ID NO: 139973 - DNA, 25 bp, Rattus norvegicus
aggacctcttcgcacattcatcaga

SEQ ID NO: 139974 - DNA, 25 bp, Rattus norvegicus
aggacctcttcggacattcatcaga

SEQ ID NO: 139975 - DNA, 25 bp, Rattus norvegicus
aggacctcttgtcttctaggctggg

SEQ ID NO: 139976 - DNA, 25 bp, Rattus norvegicus
aggacctcttgtgttctaggctggg

SEQ ID NO: 139977 - DNA, 25 bp, Rattus norvegicus
aggacctgagacatcaggccttcac

SEQ ID NO: 139978 - DNA, 25 bp, Rattus norvegicus
aggacctgagacttcaggccttcac

SEQ ID NO: 139979 - DNA, 25 bp, Rattus norvegicus
aggacctgagttcttctgtgtgcac

SEQ ID NO: 139980 - DNA, 25 bp, Rattus norvegicus
aggacctgagttgttctgtgtgcac

SEQ ID NO: 139981 - DNA, 25 bp, Rattus norvegicus
aggacctgcaacagcgtctggacga

SEQ ID NO: 139982 - DNA, 25 bp, Rattus norvegicus
aggacctgcaactgcgtctggacga

SEQ ID NO: 139983 - DNA, 25 bp, Rattus norvegicus
aggacctgcataagttggacccttc

SEQ ID NO: 139984 - DNA, 25 bp, Rattus norvegicus
aggacctgcatatgttggacccttc

SEQ ID NO: 139985 - DNA, 25 bp, Rattus norvegicus
aggacctgcatcaagtttactgtgg

SEQ ID NO: 139986 - DNA, 25 bp, Rattus norvegicus
aggacctgcatctagtttactgtgg

SEQ ID NO: 139987 - DNA, 25 bp, Rattus norvegicus
aggacctgcccgagtcaggattctc

SEQ ID NO: 139988 - DNA, 25 bp, Rattus norvegicus
aggacctgcccgtgtcaggattctc

SEQ ID NO: 139989 - DNA, 25 bp, Rattus norvegicus
aggacctgcgctacttcagggaaga

SEQ ID NO: 139990 - DNA, 25 bp, Rattus norvegicus
aggacctgcgcttcttcagggaaga

SEQ ID NO: 139991 - DNA, 25 bp, Rattus norvegicus
aggacctgctgcaatgatgccagat

SEQ ID NO: 139992 - DNA, 25 bp, Rattus norvegicus
aggacctgctgctatgatgccagat

SEQ ID NO: 139993 - DNA, 25 bp, Rattus norvegicus
aggacctggactcagatggtgctca

SEQ ID NO: 139994 - DNA, 25 bp, Rattus norvegicus
aggacctggactgagatggtgctca

SEQ ID NO: 139995 - DNA, 25 bp, Rattus norvegicus
aggacctggcaaagttcttggcctt

SEQ ID NO: 139996 - DNA, 25 bp, Rattus norvegicus
aggacctggcaatgttcttggcctt

SEQ ID NO: 139997 - DNA, 25 bp, Rattus norvegicus
aggacctggcccacatagaggagca

SEQ ID NO: 139998 - DNA, 25 bp, Rattus norvegicus
aggacctggccctcatagaggagca

SEQ ID NO: 139999 - DNA, 25 bp, Rattus norvegicus
aggacctggccgctttcctggcgtc

SEQ ID NO: 140000 - DNA, 25 bp, Rattus norvegicus
aggacctggccggtttcctggcgtc

SEQ ID NO: 140001 - DNA, 25 bp, Rattus norvegicus
aggacctggctgactgctcgggaac

SEQ ID NO: 140002 - DNA, 25 bp, Rattus norvegicus
aggacctggctgtctgctcgggaac

SEQ ID NO: 140003 - DNA, 25 bp, Rattus norvegicus
aggacctggcttaaggccccagaag

SEQ ID NO: 140004 - DNA, 25 bp, Rattus norvegicus
aggacctggctttaggccccagaag

SEQ ID NO: 140005 - DNA, 25 bp, Rattus norvegicus
aggacctgggacacccgtcgagagt

SEQ ID NO: 140006 - DNA, 25 bp, Rattus norvegicus
aggacctgggactcccgtcgagagt

SEQ ID NO: 140007 - DNA, 25 bp, Rattus norvegicus
aggacctgggataggagtgccactc

SEQ ID NO: 140008 - DNA, 25 bp, Rattus norvegicus
aggacctgggattggagtgccactc

SEQ ID NO: 140009 - DNA, 25 bp, Rattus norvegicus
aggacctgtggccaagttcttagtc

SEQ ID NO: 140010 - DNA, 25 bp, Rattus norvegicus
aggacctgtggcgaagttcttagtc

SEQ ID NO: 140011 - DNA, 25 bp, Rattus norvegicus
aggacctgtgttcggttcctagcac

SEQ ID NO: 140012 - DNA, 25 bp, Rattus norvegicus
aggacctgtgttgggttcctagcac

SEQ ID NO: 140013 - DNA, 25 bp, Rattus norvegicus
aggacctgttttacccaatgcaaat

SEQ ID NO: 140014 - DNA, 25 bp, Rattus norvegicus
aggacctgtttttcccaatgcaaat

SEQ ID NO: 140015 - DNA, 25 bp, Rattus norvegicus
aggaccttaaacctctgtgtgaaag

SEQ ID NO: 140016 - DNA, 25 bp, Rattus norvegicus
aggaccttaaacgtctgtgtgaaag

SEQ ID NO: 140017 - DNA, 25 bp, Rattus norvegicus
aggaccttacctcctgtgcattgta

SEQ ID NO: 140018 - DNA, 25 bp, Rattus norvegicus
aggaccttacctgctgtgcattgta

SEQ ID NO: 140019 - DNA, 25 bp, Rattus norvegicus
aggaccttccccagacaggaggaca

SEQ ID NO: 140020 - DNA, 25 bp, Rattus norvegicus
aggaccttcccctgacaggaggaca

SEQ ID NO: 140021 - DNA, 25 bp, Rattus norvegicus
aggaccttcctaagttgcccaagtg

SEQ ID NO: 140022 - DNA, 25 bp, Rattus norvegicus
aggaccttcctatgttgcccaagtg

SEQ ID NO: 140023 - DNA, 25 bp, Rattus norvegicus
aggaccttctagaaccagctgagcc

SEQ ID NO: 140024 - DNA, 25 bp, Rattus norvegicus
aggaccttctagtaccagctgagcc

SEQ ID NO: 140025 - DNA, 25 bp, Rattus norvegicus
aggaccttgccacccttgagtggca

SEQ ID NO: 140026 - DNA, 25 bp, Rattus norvegicus
aggaccttgccagccttgagtggca

SEQ ID NO: 140027 - DNA, 25 bp, Rattus norvegicus
aggaccttgcccaggatgtacgcta

SEQ ID NO: 140028 - DNA, 25 bp, Rattus norvegicus
aggaccttgccctggatgtacgcta

SEQ ID NO: 140029 - DNA, 25 bp, Rattus norvegicus
aggaccttgcttaattacttctgaa

SEQ ID NO: 140030 - DNA, 25 bp, Rattus norvegicus
aggaccttgctttattacttctgaa

SEQ ID NO: 140031 - DNA, 25 bp, Rattus norvegicus
aggaccttggcactgtatttgtaaa

SEQ ID NO: 140032 - DNA, 25 bp, Rattus norvegicus
aggaccttggcagtgtatttgtaaa

SEQ ID NO: 140033 - DNA, 25 bp, Rattus norvegicus
aggaccttggtccattggcactgtc

SEQ ID NO: 140034 - DNA, 25 bp, Rattus norvegicus
aggaccttggtcgattggcactgtc

SEQ ID NO: 140035 - DNA, 25 bp, Rattus norvegicus
aggaccttgtatagcccggactggt

SEQ ID NO: 140036 - DNA, 25 bp, Rattus norvegicus
aggaccttgtattgcccggactggt

SEQ ID NO: 140037 - DNA, 25 bp, Rattus norvegicus
aggaccttgtctactgacagtggga

SEQ ID NO: 140038 - DNA, 25 bp, Rattus norvegicus
aggaccttgtcttctgacagtggga

SEQ ID NO: 140039 - DNA, 25 bp, Rattus norvegicus
aggacctttctgaacatgacacttt

SEQ ID NO: 140040 - DNA, 25 bp, Rattus norvegicus
aggacctttctgtacatgacacttt

SEQ ID NO: 140041 - DNA, 25 bp, Rattus norvegicus
aggacctttcttctggacggagatg

SEQ ID NO: 140042 - DNA, 25 bp, Rattus norvegicus
aggacctttcttgtggacggagatg

SEQ ID NO: 140043 - DNA, 25 bp, Rattus norvegicus
aggacctttggcaggtttagtgcca

SEQ ID NO: 140044 - DNA, 25 bp, Rattus norvegicus
aggacctttggctggtttagtgcca

SEQ ID NO: 140045 - DNA, 25 bp, Rattus norvegicus
aggacctttgtgaaaggtggcctca

SEQ ID NO: 140046 - DNA, 25 bp, Rattus norvegicus
aggacctttgtgtaaggtggcctca

SEQ ID NO: 140047 - DNA, 25 bp, Rattus norvegicus
aggacgaagtggacaggcactccga

SEQ ID NO: 140048 - DNA, 25 bp, Rattus norvegicus
aggacgaagtggtcaggcactccga

SEQ ID NO: 140049 - DNA, 25 bp, Rattus norvegicus
aggacgacacgcacccaacacgagg

SEQ ID NO: 140050 - DNA, 25 bp, Rattus norvegicus
aggacgacacgctcccaacacgagg

SEQ ID NO: 140051 - DNA, 25 bp, Rattus norvegicus
aggacgacagcgcaggagaaggcga

SEQ ID NO: 140052 - DNA, 25 bp, Rattus norvegicus
aggacgacagcggaggagaaggcga

SEQ ID NO: 140053 - DNA, 25 bp, Rattus norvegicus
aggacgacattgacctcagtgatgt

SEQ ID NO: 140054 - DNA, 25 bp, Rattus norvegicus
aggacgacattgtcctcagtgatgt

SEQ ID NO: 140055 - DNA, 25 bp, Rattus norvegicus
aggacgacctcaagctctttaagct

SEQ ID NO: 140056 - DNA, 25 bp, Rattus norvegicus
aggacgacctcatgctctttaagct

SEQ ID NO: 140057 - DNA, 25 bp, Rattus norvegicus
aggacgacctgcctgtgtacttggc

SEQ ID NO: 140058 - DNA, 25 bp, Rattus norvegicus
aggacgacctgcgtgtgtacttggc

SEQ ID NO: 140059 - DNA, 25 bp, Rattus norvegicus
aggacgacctttctactcagttctt

SEQ ID NO: 140060 - DNA, 25 bp, Rattus norvegicus
aggacgacctttgtactcagttctt

SEQ ID NO: 140061 - DNA, 25 bp, Rattus norvegicus
aggacgacgatgacatctgcaccac

SEQ ID NO: 140062 - DNA, 25 bp, Rattus norvegicus
aggacgacgatgtcatctgcaccac

SEQ ID NO: 140063 - DNA, 25 bp, Rattus norvegicus
aggacgacgctgagggagccatctc

SEQ ID NO: 140064 - DNA, 25 bp, Rattus norvegicus
aggacgacgctgtgggagccatctc

SEQ ID NO: 140065 - DNA, 25 bp, Rattus norvegicus
aggacgactcggatcacaggcgtga

SEQ ID NO: 140066 - DNA, 25 bp, Rattus norvegicus
aggacgactcggttcacaggcgtga

SEQ ID NO: 140067 - DNA, 25 bp, Rattus norvegicus
aggacgactctgaggcagatgctgc

SEQ ID NO: 140068 - DNA, 25 bp, Rattus norvegicus
aggacgactctgtggcagatgctgc

SEQ ID NO: 140069 - DNA, 25 bp, Rattus norvegicus
aggacgagagcgaggcactgaccct

SEQ ID NO: 140070 - DNA, 25 bp, Rattus norvegicus
aggacgagagcgtggcactgaccct

SEQ ID NO: 140071 - DNA, 25 bp, Rattus norvegicus
aggacgagatccacatttgccgcag

SEQ ID NO: 140072 - DNA, 25 bp, Rattus norvegicus
aggacgagatcctcatttgccgcag

SEQ ID NO: 140073 - DNA, 25 bp, Rattus norvegicus
aggacgagatggacctggaacccaa

SEQ ID NO: 140074 - DNA, 25 bp, Rattus norvegicus
aggacgagatggtcctggaacccaa

SEQ ID NO: 140075 - DNA, 25 bp, Rattus norvegicus
aggacgagattgactttaaccccag

SEQ ID NO: 140076 - DNA, 25 bp, Rattus norvegicus
aggacgagattgtctttaaccccag

SEQ ID NO: 140077 - DNA, 25 bp, Rattus norvegicus
aggacgagccacagaagcccgagga

SEQ ID NO: 140078 - DNA, 25 bp, Rattus norvegicus
aggacgagccactgaagcccgagga

SEQ ID NO: 140079 - DNA, 25 bp, Rattus norvegicus
aggacgagtcccctgcgtgtccgtc

SEQ ID NO: 140080 - DNA, 25 bp, Rattus norvegicus
aggacgagtcccgtgcgtgtccgtc

SEQ ID NO: 140081 - DNA, 25 bp, Rattus norvegicus
aggacgatgccgagagagcctgcca

SEQ ID NO: 140082 - DNA, 25 bp, Rattus norvegicus
aggacgatgccgtgagagcctgcca

SEQ ID NO: 140083 - DNA, 25 bp, Rattus norvegicus
aggacgatgctgctcattgctcacc

SEQ ID NO: 140084 - DNA, 25 bp, Rattus norvegicus
aggacgatgctggtcattgctcacc

SEQ ID NO: 140085 - DNA, 25 bp, Rattus norvegicus
aggacgattctgagcacgcgtacca

SEQ ID NO: 140086 - DNA, 25 bp, Rattus norvegicus
aggacgattctgtgcacgcgtacca

SEQ ID NO: 140087 - DNA, 25 bp, Rattus norvegicus
aggacgattgtgagctgcctctgga

SEQ ID NO: 140088 - DNA, 25 bp, Rattus norvegicus
aggacgattgtgtgctgcctctgga

SEQ ID NO: 140089 - DNA, 25 bp, Rattus norvegicus
aggacgcactgaccgatcattacaa

SEQ ID NO: 140090 - DNA, 25 bp, Rattus norvegicus
aggacgcactgagcgatcattacaa

SEQ ID NO: 140091 - DNA, 25 bp, Rattus norvegicus
aggacgcagcagcaattcctactct

SEQ ID NO: 140092 - DNA, 25 bp, Rattus norvegicus
aggacgcagcaggaattcctactct

SEQ ID NO: 140093 - DNA, 25 bp, Rattus norvegicus
aggacgcagcctatggttcatcaaa

SEQ ID NO: 140094 - DNA, 25 bp, Rattus norvegicus
aggacgcagcctttggttcatcaaa

SEQ ID NO: 140095 - DNA, 25 bp, Rattus norvegicus
aggacgcagcgtcttttgctttccc

SEQ ID NO: 140096 - DNA, 25 bp, Rattus norvegicus
aggacgcagcgtgttttgctttccc

SEQ ID NO: 140097 - DNA, 25 bp, Rattus norvegicus
aggacgcaggtcaggcccaaagctt

SEQ ID NO: 140098 - DNA, 25 bp, Rattus norvegicus
aggacgcaggtctggcccaaagctt

SEQ ID NO: 140099 - DNA, 25 bp, Rattus norvegicus
aggacgcagtgaagcttctgggccc

SEQ ID NO: 140100 - DNA, 25 bp, Rattus norvegicus
aggacgcagtgatgcttctgggccc

SEQ ID NO: 140101 - DNA, 25 bp, Rattus norvegicus
aggacgcatcttcggaaacttcagt

SEQ ID NO: 140102 - DNA, 25 bp, Rattus norvegicus
aggacgcatcttgggaaacttcagt

SEQ ID NO: 140103 - DNA, 25 bp, Rattus norvegicus
aggacgccaaggatgaacccacaga

SEQ ID NO: 140104 - DNA, 25 bp, Rattus norvegicus
aggacgccaaggttgaacccacaga

SEQ ID NO: 140105 - DNA, 25 bp, Rattus norvegicus
aggacgccagtaagtcatatcccca

SEQ ID NO: 140106 - DNA, 25 bp, Rattus norvegicus
aggacgccagtatgtcatatcccca

SEQ ID NO: 140107 - DNA, 25 bp, Rattus norvegicus
aggacgccatataaccaaggcccag

SEQ ID NO: 140108 - DNA, 25 bp, Rattus norvegicus
aggacgccatattaccaaggcccag

SEQ ID NO: 140109 - DNA, 25 bp, Rattus norvegicus
aggacgccatcccagcattaagaga

SEQ ID NO: 140110 - DNA, 25 bp, Rattus norvegicus
aggacgccatccgagcattaagaga

SEQ ID NO: 140111 - DNA, 25 bp, Rattus norvegicus
aggacgccatggaagagtttgtgaa

SEQ ID NO: 140112 - DNA, 25 bp, Rattus norvegicus
aggacgccatggtagagtttgtgaa

SEQ ID NO: 140113 - DNA, 25 bp, Rattus norvegicus
aggacgccattcatcaacagtgtca

SEQ ID NO: 140114 - DNA, 25 bp, Rattus norvegicus
aggacgccattcttcaacagtgtca

SEQ ID NO: 140115 - DNA, 25 bp, Rattus norvegicus
aggacgccgcgaatttgccttcagt

SEQ ID NO: 140116 - DNA, 25 bp, Rattus norvegicus
aggacgccgcgattttgccttcagt

SEQ ID NO: 140117 - DNA, 25 bp, Rattus norvegicus
aggacgcctacaagcgcatctatgg

SEQ ID NO: 140118 - DNA, 25 bp, Rattus norvegicus
aggacgcctacatgcgcatctatgg

SEQ ID NO: 140119 - DNA, 25 bp, Rattus norvegicus
aggacgcctagaccgcaagattgag

SEQ ID NO: 140120 - DNA, 25 bp, Rattus norvegicus
aggacgcctagagcgcaagattgag

SEQ ID NO: 140121 - DNA, 25 bp, Rattus norvegicus
aggacgcctcacaggactcaaggat

SEQ ID NO: 140122 - DNA, 25 bp, Rattus norvegicus
aggacgcctcactggactcaaggat

SEQ ID NO: 140123 - DNA, 25 bp, Rattus norvegicus
aggacgcctggaccgcaaaattgaa

SEQ ID NO: 140124 - DNA, 25 bp, Rattus norvegicus
aggacgcctggagcgcaaaattgaa

SEQ ID NO: 140125 - DNA, 25 bp, Rattus norvegicus
aggacgcctgtgcttctcagattaa

SEQ ID NO: 140126 - DNA, 25 bp, Rattus norvegicus
aggacgcctgtggttctcagattaa

SEQ ID NO: 140127 - DNA, 25 bp, Rattus norvegicus
aggacgcgggtgaagcctccggcgg

SEQ ID NO: 140128 - DNA, 25 bp, Rattus norvegicus
aggacgcgggtgtagcctccggcgg

SEQ ID NO: 140129 - DNA, 25 bp, Rattus norvegicus
aggacgcgtccccagtctggcacag

SEQ ID NO: 140130 - DNA, 25 bp, Rattus norvegicus
aggacgcgtcccgagtctggcacag

SEQ ID NO: 140131 - DNA, 25 bp, Rattus norvegicus
aggacgcgtgcaccaacaaatgttt

SEQ ID NO: 140132 - DNA, 25 bp, Rattus norvegicus
aggacgcgtgcagcaacaaatgttt

SEQ ID NO: 140133 - DNA, 25 bp, Rattus norvegicus
aggacgcgtgccacgctgaaatgag

SEQ ID NO: 140134 - DNA, 25 bp, Rattus norvegicus
aggacgcgtgcctcgctgaaatgag

SEQ ID NO: 140135 - DNA, 25 bp, Rattus norvegicus
aggacgctcaggagaagtctgtctt

SEQ ID NO: 140136 - DNA, 25 bp, Rattus norvegicus
aggacgctcaggtgaagtctgtctt

SEQ ID NO: 140137 - DNA, 25 bp, Rattus norvegicus
aggacgctcatgagctgctgttcct

SEQ ID NO: 140138 - DNA, 25 bp, Rattus norvegicus
aggacgctcatgtgctgctgttcct

SEQ ID NO: 140139 - DNA, 25 bp, Rattus norvegicus
aggacgctcgggatcatgtcaatca

SEQ ID NO: 140140 - DNA, 25 bp, Rattus norvegicus
aggacgctcgggttcatgtcaatca

SEQ ID NO: 140141 - DNA, 25 bp, Rattus norvegicus
aggacgctctatcttaggttctggt

SEQ ID NO: 140142 - DNA, 25 bp, Rattus norvegicus
aggacgctctatgttaggttctggt

SEQ ID NO: 140143 - DNA, 25 bp, Rattus norvegicus
aggacgctctgcctcagaagaacta

SEQ ID NO: 140144 - DNA, 25 bp, Rattus norvegicus
aggacgctctgcgtcagaagaacta

SEQ ID NO: 140145 - DNA, 25 bp, Rattus norvegicus
aggacgctggtcagccatcaaagga

SEQ ID NO: 140146 - DNA, 25 bp, Rattus norvegicus
aggacgctggtctgccatcaaagga

SEQ ID NO: 140147 - DNA, 25 bp, Rattus norvegicus
aggacgcttagcattgcacactgct

SEQ ID NO: 140148 - DNA, 25 bp, Rattus norvegicus
aggacgcttagctttgcacactgct

SEQ ID NO: 140149 - DNA, 25 bp, Rattus norvegicus
aggacgcttctgcattaaccgtaag

SEQ ID NO: 140150 - DNA, 25 bp, Rattus norvegicus
aggacgcttctggattaaccgtaag

SEQ ID NO: 140151 - DNA, 25 bp, Rattus norvegicus
aggacggacaaacagcctgctgctg

SEQ ID NO: 140152 - DNA, 25 bp, Rattus norvegicus
aggacggacaaagagcctgctgctg

SEQ ID NO: 140153 - DNA, 25 bp, Rattus norvegicus
aggacggacgccaggccacttacag

SEQ ID NO: 140154 - DNA, 25 bp, Rattus norvegicus
aggacggacgcctggccacttacag

SEQ ID NO: 140155 - DNA, 25 bp, Rattus norvegicus
aggacggcactgaggccatgcttgt

SEQ ID NO: 140156 - DNA, 25 bp, Rattus norvegicus
aggacggcactgtggccatgcttgt

SEQ ID NO: 140157 - DNA, 25 bp, Rattus norvegicus
aggacggcagagaatccttcctgca

SEQ ID NO: 140158 - DNA, 25 bp, Rattus norvegicus
aggacggcagagtatccttcctgca

SEQ ID NO: 140159 - DNA, 25 bp, Rattus norvegicus
aggacggccagcactatgtaccttg

SEQ ID NO: 140160 - DNA, 25 bp, Rattus norvegicus
aggacggccagctctatgtaccttg

SEQ ID NO: 140161 - DNA, 25 bp, Rattus norvegicus
aggacggcccacacagcaagcagca

SEQ ID NO: 140162 - DNA, 25 bp, Rattus norvegicus
aggacggcccactcagcaagcagca

SEQ ID NO: 140163 - DNA, 25 bp, Rattus norvegicus
aggacggcgctcagagcaacgcgtt

SEQ ID NO: 140164 - DNA, 25 bp, Rattus norvegicus
aggacggcgctctgagcaacgcgtt

SEQ ID NO: 140165 - DNA, 25 bp, Rattus norvegicus
aggacggcggtgagcaacctgtacc

SEQ ID NO: 140166 - DNA, 25 bp, Rattus norvegicus
aggacggcggtgtgcaacctgtacc

SEQ ID NO: 140167 - DNA, 25 bp, Rattus norvegicus
aggacggctagtcagcattcacagc

SEQ ID NO: 140168 - DNA, 25 bp, Rattus norvegicus
aggacggctagtgagcattcacagc

SEQ ID NO: 140169 - DNA, 25 bp, Rattus norvegicus
aggacggctgtaagcttcggagcac

SEQ ID NO: 140170 - DNA, 25 bp, Rattus norvegicus
aggacggctgtatgcttcggagcac

SEQ ID NO: 140171 - DNA, 25 bp, Rattus norvegicus
aggacgggaccgagttctacagcct

SEQ ID NO: 140172 - DNA, 25 bp, Rattus norvegicus
aggacgggaccgtgttctacagcct

SEQ ID NO: 140173 - DNA, 25 bp, Rattus norvegicus
aggacgggttcgaggaccagatcct

SEQ ID NO: 140174 - DNA, 25 bp, Rattus norvegicus
aggacgggttcgtggaccagatcct

SEQ ID NO: 140175 - DNA, 25 bp, Rattus norvegicus
aggacggtagggacagcatctgcat

SEQ ID NO: 140176 - DNA, 25 bp, Rattus norvegicus
aggacggtagggtcagcatctgcat

SEQ ID NO: 140177 - DNA, 25 bp, Rattus norvegicus
aggacggtatgcagccaagcgtttc

SEQ ID NO: 140178 - DNA, 25 bp, Rattus norvegicus
aggacggtatgctgccaagcgtttc

SEQ ID NO: 140179 - DNA, 25 bp, Rattus norvegicus
aggacggtcactcactgtcagtgtg

SEQ ID NO: 140180 - DNA, 25 bp, Rattus norvegicus
aggacggtcactgactgtcagtgtg

SEQ ID NO: 140181 - DNA, 25 bp, Rattus norvegicus
aggacgtaaatcacttgctgccaac

SEQ ID NO: 140182 - DNA, 25 bp, Rattus norvegicus
aggacgtaaatctcttgctgccaac

SEQ ID NO: 140183 - DNA, 25 bp, Rattus norvegicus
aggacgtaacaccttccgaagatgt

SEQ ID NO: 140184 - DNA, 25 bp, Rattus norvegicus
aggacgtaacacgttccgaagatgt

SEQ ID NO: 140185 - DNA, 25 bp, Rattus norvegicus
aggacgtatgccctggcttcagaga

SEQ ID NO: 140186 - DNA, 25 bp, Rattus norvegicus
aggacgtatgccgtggcttcagaga

SEQ ID NO: 140187 - DNA, 25 bp, Rattus norvegicus
aggacgtatgtgacagcactggctt

SEQ ID NO: 140188 - DNA, 25 bp, Rattus norvegicus
aggacgtatgtgtcagcactggctt

SEQ ID NO: 140189 - DNA, 25 bp, Rattus norvegicus
aggacgtctctgatggctgctcctt

SEQ ID NO: 140190 - DNA, 25 bp, Rattus norvegicus
aggacgtctctgttggctgctcctt

SEQ ID NO: 140191 - DNA, 25 bp, Rattus norvegicus
aggacgtctgagatgattcattact

SEQ ID NO: 140192 - DNA, 25 bp, Rattus norvegicus
aggacgtctgagttgattcattact

SEQ ID NO: 140193 - DNA, 25 bp, Rattus norvegicus
aggacgtcttcaacctgctgccgga

SEQ ID NO: 140194 - DNA, 25 bp, Rattus norvegicus
aggacgtcttcatcctgctgccgga

SEQ ID NO: 140195 - DNA, 25 bp, Rattus norvegicus
aggacgtgagtcactgacctgctgt

SEQ ID NO: 140196 - DNA, 25 bp, Rattus norvegicus
aggacgtgagtctctgacctgctgt

SEQ ID NO: 140197 - DNA, 25 bp, Rattus norvegicus
aggacgtgctctaccctaatcggaa

SEQ ID NO: 140198 - DNA, 25 bp, Rattus norvegicus
aggacgtgctcttccctaatcggaa

SEQ ID NO: 140199 - DNA, 25 bp, Rattus norvegicus
aggacgttcactaatcgggtgccct

SEQ ID NO: 140200 - DNA, 25 bp, Rattus norvegicus
aggacgttcacttatcgggtgccct

SEQ ID NO: 140201 - DNA, 25 bp, Rattus norvegicus
aggactaaaggtctcatctgcccag

SEQ ID NO: 140202 - DNA, 25 bp, Rattus norvegicus
aggactaaaggtgtcatctgcccag

SEQ ID NO: 140203 - DNA, 25 bp, Rattus norvegicus
aggactaacaccctgtcccgaagct

SEQ ID NO: 140204 - DNA, 25 bp, Rattus norvegicus
aggactaacaccgtgtcccgaagct

SEQ ID NO: 140205 - DNA, 25 bp, Rattus norvegicus
aggactaagcctcgcaaagctgtga

SEQ ID NO: 140206 - DNA, 25 bp, Rattus norvegicus
aggactaagcctggcaaagctgtga

SEQ ID NO: 140207 - DNA, 25 bp, Rattus norvegicus
aggactaagcttctaaaactgtaag

SEQ ID NO: 140208 - DNA, 25 bp, Rattus norvegicus
aggactaagcttgtaaaactgtaag

SEQ ID NO: 140209 - DNA, 25 bp, Rattus norvegicus
aggactaattccagcttggcaccct

SEQ ID NO: 140210 - DNA, 25 bp, Rattus norvegicus
aggactaattcctgcttggcaccct

SEQ ID NO: 140211 - DNA, 25 bp, Rattus norvegicus
aggactacagagctgtgctgccact

SEQ ID NO: 140212 - DNA, 25 bp, Rattus norvegicus
aggactacagaggtgtgctgccact

SEQ ID NO: 140213 - DNA, 25 bp, Rattus norvegicus
aggactacaggccaagtaggcccaa

SEQ ID NO: 140214 - DNA, 25 bp, Rattus norvegicus
aggactacaggcgaagtaggcccaa

SEQ ID NO: 140215 - DNA, 25 bp, Rattus norvegicus
aggactacatacacaaacccaaaag

SEQ ID NO: 140216 - DNA, 25 bp, Rattus norvegicus
aggactacatactcaaacccaaaag

SEQ ID NO: 140217 - DNA, 25 bp, Rattus norvegicus
aggactacatggatcccagccagga

SEQ ID NO: 140218 - DNA, 25 bp, Rattus norvegicus
aggactacatggttcccagccagga

SEQ ID NO: 140219 - DNA, 25 bp, Rattus norvegicus
aggactaccatgcaaacagactttt

SEQ ID NO: 140220 - DNA, 25 bp, Rattus norvegicus
aggactaccatggaaacagactttt

SEQ ID NO: 140221 - DNA, 25 bp, Rattus norvegicus
aggactaccggcctgtcattgagcg

SEQ ID NO: 140222 - DNA, 25 bp, Rattus norvegicus
aggactaccggcgtgtcattgagcg

SEQ ID NO: 140223 - DNA, 25 bp, Rattus norvegicus
aggactaccgtgagctgtcctgtca

SEQ ID NO: 140224 - DNA, 25 bp, Rattus norvegicus
aggactaccgtgtgctgtcctgtca

SEQ ID NO: 140225 - DNA, 25 bp, Rattus norvegicus
aggactacctccacggcggcggtga

SEQ ID NO: 140226 - DNA, 25 bp, Rattus norvegicus
aggactacctcctcggcggcggtga

SEQ ID NO: 140227 - DNA, 25 bp, Rattus norvegicus
aggactacctgcctgaggaactgag

SEQ ID NO: 140228 - DNA, 25 bp, Rattus norvegicus
aggactacctgcgtgaggaactgag

SEQ ID NO: 140229 - DNA, 25 bp, Rattus norvegicus
aggactacctggagcagatcttcca

SEQ ID NO: 140230 - DNA, 25 bp, Rattus norvegicus
aggactacctggtgcagatcttcca

SEQ ID NO: 140231 - DNA, 25 bp, Rattus norvegicus
aggactacctgtatgactattggat

SEQ ID NO: 140232 - DNA, 25 bp, Rattus norvegicus
aggactacctgtttgactattggat

SEQ ID NO: 140233 - DNA, 25 bp, Rattus norvegicus
aggactaccttgaggaaccctgtct

SEQ ID NO: 140234 - DNA, 25 bp, Rattus norvegicus
aggactaccttgtggaaccctgtct

SEQ ID NO: 140235 - DNA, 25 bp, Rattus norvegicus
aggactacgcctctgtcggctgaaa

SEQ ID NO: 140236 - DNA, 25 bp, Rattus norvegicus
aggactacgcctgtgtcggctgaaa

SEQ ID NO: 140237 - DNA, 25 bp, Rattus norvegicus
aggactactacaaggcctgtaccat

SEQ ID NO: 140238 - DNA, 25 bp, Rattus norvegicus
aggactactacatggcctgtaccat

SEQ ID NO: 140239 - DNA, 25 bp, Rattus norvegicus
aggactactcttatgctgttttatc

SEQ ID NO: 140240 - DNA, 25 bp, Rattus norvegicus
aggactactcttttgctgttttatc

SEQ ID NO: 140241 - DNA, 25 bp, Rattus norvegicus
aggactacttacagaggcattgcaa

SEQ ID NO: 140242 - DNA, 25 bp, Rattus norvegicus
aggactacttactgaggcattgcaa

SEQ ID NO: 140243 - DNA, 25 bp, Rattus norvegicus
aggactagacagctgtctggttctc

SEQ ID NO: 140244 - DNA, 25 bp, Rattus norvegicus
aggactagacaggtgtctggttctc

SEQ ID NO: 140245 - DNA, 25 bp, Rattus norvegicus
aggactagaggccaccttggtgctt

SEQ ID NO: 140246 - DNA, 25 bp, Rattus norvegicus
aggactagaggcgaccttggtgctt

SEQ ID NO: 140247 - DNA, 25 bp, Rattus norvegicus
aggactagatgacccacggacttct

SEQ ID NO: 140248 - DNA, 25 bp, Rattus norvegicus
aggactagatgagccacggacttct

SEQ ID NO: 140249 - DNA, 25 bp, Rattus norvegicus
aggactagggtcctgctctccctga

SEQ ID NO: 140250 - DNA, 25 bp, Rattus norvegicus
aggactagggtcgtgctctccctga

SEQ ID NO: 140251 - DNA, 25 bp, Rattus norvegicus
aggactagttaaaccgtgctcactt

SEQ ID NO: 140252 - DNA, 25 bp, Rattus norvegicus
aggactagttaatccgtgctcactt

SEQ ID NO: 140253 - DNA, 25 bp, Rattus norvegicus
aggactatatagctagatactgtct

SEQ ID NO: 140254 - DNA, 25 bp, Rattus norvegicus
aggactatataggtagatactgtct

SEQ ID NO: 140255 - DNA, 25 bp, Rattus norvegicus
aggactatccgtatggaccagtgga

SEQ ID NO: 140256 - DNA, 25 bp, Rattus norvegicus
aggactatccgtttggaccagtgga

SEQ ID NO: 140257 - DNA, 25 bp, Rattus norvegicus
aggactatcttcagagttccacaca

SEQ ID NO: 140258 - DNA, 25 bp, Rattus norvegicus
aggactatcttctgagttccacaca

SEQ ID NO: 140259 - DNA, 25 bp, Rattus norvegicus
aggactatttaacctgctgtcagaa

SEQ ID NO: 140260 - DNA, 25 bp, Rattus norvegicus
aggactatttaagctgctgtcagaa

SEQ ID NO: 140261 - DNA, 25 bp, Rattus norvegicus
aggactcaagagatttcgtctgttg

SEQ ID NO: 140262 - DNA, 25 bp, Rattus norvegicus
aggactcaagagttttcgtctgttg

SEQ ID NO: 140263 - DNA, 25 bp, Rattus norvegicus
aggactcaagttatacagcagggct

SEQ ID NO: 140264 - DNA, 25 bp, Rattus norvegicus
aggactcaagttttacagcagggct

SEQ ID NO: 140265 - DNA, 25 bp, Rattus norvegicus
aggactcaatggagcttcttgtcta

SEQ ID NO: 140266 - DNA, 25 bp, Rattus norvegicus
aggactcaatggtgcttcttgtcta

SEQ ID NO: 140267 - DNA, 25 bp, Rattus norvegicus
aggactcacacacaagaactaccca

SEQ ID NO: 140268 - DNA, 25 bp, Rattus norvegicus
aggactcacacagaagaactaccca

SEQ ID NO: 140269 - DNA, 25 bp, Rattus norvegicus
aggactcacaccatatcacacgtgg

SEQ ID NO: 140270 - DNA, 25 bp, Rattus norvegicus
aggactcacaccttatcacacgtgg

SEQ ID NO: 140271 - DNA, 25 bp, Rattus norvegicus
aggactcacatacgactctacacga

SEQ ID NO: 140272 - DNA, 25 bp, Rattus norvegicus
aggactcacataggactctacacga

SEQ ID NO: 140273 - DNA, 25 bp, Rattus norvegicus
aggactcacatgatgcctctggttc

SEQ ID NO: 140274 - DNA, 25 bp, Rattus norvegicus
aggactcacatgttgcctctggttc

SEQ ID NO: 140275 - DNA, 25 bp, Rattus norvegicus
aggactcacctgaacagctccaaaa

SEQ ID NO: 140276 - DNA, 25 bp, Rattus norvegicus
aggactcacctgtacagctccaaaa

SEQ ID NO: 140277 - DNA, 25 bp, Rattus norvegicus
aggactcactgcaataactcaaccc

SEQ ID NO: 140278 - DNA, 25 bp, Rattus norvegicus
aggactcactgctataactcaaccc

SEQ ID NO: 140279 - DNA, 25 bp, Rattus norvegicus
aggactcagaacacaggtgacttca

SEQ ID NO: 140280 - DNA, 25 bp, Rattus norvegicus
aggactcagaactcaggtgacttca

SEQ ID NO: 140281 - DNA, 25 bp, Rattus norvegicus
aggactcagagacccagctgcagga

SEQ ID NO: 140282 - DNA, 25 bp, Rattus norvegicus
aggactcagagagccagctgcagga

SEQ ID NO: 140283 - DNA, 25 bp, Rattus norvegicus
aggactcagggcagaacaccgtaag

SEQ ID NO: 140284 - DNA, 25 bp, Rattus norvegicus
aggactcagggcaggctctacgttg

SEQ ID NO: 140285 - DNA, 25 bp, Rattus norvegicus
aggactcagggctgaacaccgtaag

SEQ ID NO: 140286 - DNA, 25 bp, Rattus norvegicus
aggactcagggctggctctacgttg

SEQ ID NO: 140287 - DNA, 25 bp, Rattus norvegicus
aggactcaggtcacttgccttgaga

SEQ ID NO: 140288 - DNA, 25 bp, Rattus norvegicus
aggactcaggtctcttgccttgaga

SEQ ID NO: 140289 - DNA, 25 bp, Rattus norvegicus
aggactcagtatctctgcagcacat

SEQ ID NO: 140290 - DNA, 25 bp, Rattus norvegicus
aggactcagtatgtctgcagcacat

SEQ ID NO: 140291 - DNA, 25 bp, Rattus norvegicus
aggactcatataagtatctctgaaa

SEQ ID NO: 140292 - DNA, 25 bp, Rattus norvegicus
aggactcatatatgtatctctgaaa

SEQ ID NO: 140293 - DNA, 25 bp, Rattus norvegicus
aggactcatccgctcagagccttga

SEQ ID NO: 140294 - DNA, 25 bp, Rattus norvegicus
aggactcatccggtcagagccttga

SEQ ID NO: 140295 - DNA, 25 bp, Rattus norvegicus
aggactcatctcaatagggctggtg

SEQ ID NO: 140296 - DNA, 25 bp, Rattus norvegicus
aggactcatctctatagggctggtg

SEQ ID NO: 140297 - DNA, 25 bp, Rattus norvegicus
aggactccacggaaacacctgaagt

SEQ ID NO: 140298 - DNA, 25 bp, Rattus norvegicus
aggactccacggtaacacctgaagt

SEQ ID NO: 140299 - DNA, 25 bp, Rattus norvegicus
aggactccacgtcctgtaggaagga

SEQ ID NO: 140300 - DNA, 25 bp, Rattus norvegicus
aggactccacgtgctgtaggaagga

SEQ ID NO: 140301 - DNA, 25 bp, Rattus norvegicus
aggactccagatctacccaggaaga

SEQ ID NO: 140302 - DNA, 25 bp, Rattus norvegicus
aggactccagatgtacccaggaaga

SEQ ID NO: 140303 - DNA, 25 bp, Rattus norvegicus
aggactccagctaacttgctctgag

SEQ ID NO: 140304 - DNA, 25 bp, Rattus norvegicus
aggactccagcttacttgctctgag

SEQ ID NO: 140305 - DNA, 25 bp, Rattus norvegicus
aggactccaggaccccaaagcagca

SEQ ID NO: 140306 - DNA, 25 bp, Rattus norvegicus
aggactccaggagcccaaagcagca

SEQ ID NO: 140307 - DNA, 25 bp, Rattus norvegicus
aggactccagtgctgggctgtaact

SEQ ID NO: 140308 - DNA, 25 bp, Rattus norvegicus
aggactccagtggtgggctgtaact

SEQ ID NO: 140309 - DNA, 25 bp, Rattus norvegicus
aggactccatatatttgcctcattc

SEQ ID NO: 140310 - DNA, 25 bp, Rattus norvegicus
aggactccatatttttgcctcattc

SEQ ID NO: 140311 - DNA, 25 bp, Rattus norvegicus
aggactccatccatgtagtagaaca

SEQ ID NO: 140312 - DNA, 25 bp, Rattus norvegicus
aggactccatccttgtagtagaaca

SEQ ID NO: 140313 - DNA, 25 bp, Rattus norvegicus
aggactccatctactacgagcattt

SEQ ID NO: 140314 - DNA, 25 bp, Rattus norvegicus
aggactccatcttctacgagcattt

SEQ ID NO: 140315 - DNA, 25 bp, Rattus norvegicus
aggactccattgacaaacgcacaca

SEQ ID NO: 140316 - DNA, 25 bp, Rattus norvegicus
aggactccattgacctaccaacgga

SEQ ID NO: 140317 - DNA, 25 bp, Rattus norvegicus
aggactccattgtcaaacgcacaca

SEQ ID NO: 140318 - DNA, 25 bp, Rattus norvegicus
aggactccattgtcctaccaacgga

SEQ ID NO: 140319 - DNA, 25 bp, Rattus norvegicus
aggactcccggaaatgagcacagtt

SEQ ID NO: 140320 - DNA, 25 bp, Rattus norvegicus
aggactcccggatatgagcacagtt

SEQ ID NO: 140321 - DNA, 25 bp, Rattus norvegicus
aggactccctgcagatccggagaat

SEQ ID NO: 140322 - DNA, 25 bp, Rattus norvegicus
aggactccctgctgatccggagaat

SEQ ID NO: 140323 - DNA, 25 bp, Rattus norvegicus
aggactcccttaattccctgagacg

SEQ ID NO: 140324 - DNA, 25 bp, Rattus norvegicus
aggactcccttatttccctgagacg

SEQ ID NO: 140325 - DNA, 25 bp, Rattus norvegicus
aggactccgagcactttactttgag

SEQ ID NO: 140326 - DNA, 25 bp, Rattus norvegicus
aggactccgagctctttactttgag

SEQ ID NO: 140327 - DNA, 25 bp, Rattus norvegicus
aggactccgggaacctttggtgatg

SEQ ID NO: 140328 - DNA, 25 bp, Rattus norvegicus
aggactccgggatcctttggtgatg

SEQ ID NO: 140329 - DNA, 25 bp, Rattus norvegicus
aggactccgtgtatcattgtgggct

SEQ ID NO: 140330 - DNA, 25 bp, Rattus norvegicus
aggactccgtgtttcattgtgggct

SEQ ID NO: 140331 - DNA, 25 bp, Rattus norvegicus
aggactcctcagagcttgctttcgg

SEQ ID NO: 140332 - DNA, 25 bp, Rattus norvegicus
aggactcctcagtgcttgctttcgg

SEQ ID NO: 140333 - DNA, 25 bp, Rattus norvegicus
aggactcctgagaactgtgctggtg

SEQ ID NO: 140334 - DNA, 25 bp, Rattus norvegicus
aggactcctgagtactgtgctggtg

SEQ ID NO: 140335 - DNA, 25 bp, Rattus norvegicus
aggactcctgatcaccctcaaggga

SEQ ID NO: 140336 - DNA, 25 bp, Rattus norvegicus
aggactcctgatgaccctcaaggga

SEQ ID NO: 140337 - DNA, 25 bp, Rattus norvegicus
aggactcctgccattgtgacagaac

SEQ ID NO: 140338 - DNA, 25 bp, Rattus norvegicus
aggactcctgcctttgtgacagaac

SEQ ID NO: 140339 - DNA, 25 bp, Rattus norvegicus
aggactcctgtcagtattcacataa

SEQ ID NO: 140340 - DNA, 25 bp, Rattus norvegicus
aggactcctgtctgtattcacataa

SEQ ID NO: 140341 - DNA, 25 bp, Rattus norvegicus
aggactcctgtgatggtgactctgg

SEQ ID NO: 140342 - DNA, 25 bp, Rattus norvegicus
aggactcctgtgattccgaacaaat

SEQ ID NO: 140343 - DNA, 25 bp, Rattus norvegicus
aggactcctgtgttggtgactctgg

SEQ ID NO: 140344 - DNA, 25 bp, Rattus norvegicus
aggactcctgtgtttccgaacaaat

SEQ ID NO: 140345 - DNA, 25 bp, Rattus norvegicus
aggactccttccagccttggtccgg

SEQ ID NO: 140346 - DNA, 25 bp, Rattus norvegicus
aggactccttcctgccttggtccgg

SEQ ID NO: 140347 - DNA, 25 bp, Rattus norvegicus
aggactccttgcaatctgtttgcat

SEQ ID NO: 140348 - DNA, 25 bp, Rattus norvegicus
aggactccttgctatctgtttgcat

SEQ ID NO: 140349 - DNA, 25 bp, Rattus norvegicus
aggactcgagaacatgcatgctttg

SEQ ID NO: 140350 - DNA, 25 bp, Rattus norvegicus
aggactcgagaagatgcatgctttg

SEQ ID NO: 140351 - DNA, 25 bp, Rattus norvegicus
aggactcgccagactgatgccagga

SEQ ID NO: 140352 - DNA, 25 bp, Rattus norvegicus
aggactcgccagtctgatgccagga

SEQ ID NO: 140353 - DNA, 25 bp, Rattus norvegicus
aggactcgcccaactggaattaata

SEQ ID NO: 140354 - DNA, 25 bp, Rattus norvegicus
aggactcgcccatctggaattaata

SEQ ID NO: 140355 - DNA, 25 bp, Rattus norvegicus
aggactcgctcaccatgcaaactta

SEQ ID NO: 140356 - DNA, 25 bp, Rattus norvegicus
aggactcgctcagcatgcaaactta

SEQ ID NO: 140357 - DNA, 25 bp, Rattus norvegicus
aggactcgctgccattgacttcact

SEQ ID NO: 140358 - DNA, 25 bp, Rattus norvegicus
aggactcgctgcgattgacttcact

SEQ ID NO: 140359 - DNA, 25 bp, Rattus norvegicus
aggactcgtggcagtcactgactgg

SEQ ID NO: 140360 - DNA, 25 bp, Rattus norvegicus
aggactcgtggctgtcactgactgg

SEQ ID NO: 140361 - DNA, 25 bp, Rattus norvegicus
aggactctactcctcagaacttagc

SEQ ID NO: 140362 - DNA, 25 bp, Rattus norvegicus
aggactctactcgtcagaacttagc

SEQ ID NO: 140363 - DNA, 25 bp, Rattus norvegicus
aggactctagagaggctatctttgg

SEQ ID NO: 140364 - DNA, 25 bp, Rattus norvegicus
aggactctagagtggctatctttgg

SEQ ID NO: 140365 - DNA, 25 bp, Rattus norvegicus
aggactctagatccctggacaggtg

SEQ ID NO: 140366 - DNA, 25 bp, Rattus norvegicus
aggactctagatgcctggacaggtg

SEQ ID NO: 140367 - DNA, 25 bp, Rattus norvegicus
aggactctcagtctcaatgaccttt

SEQ ID NO: 140368 - DNA, 25 bp, Rattus norvegicus
aggactctcagtgtcaatgaccttt

SEQ ID NO: 140369 - DNA, 25 bp, Rattus norvegicus
aggactctccctcttacagaggaaa

SEQ ID NO: 140370 - DNA, 25 bp, Rattus norvegicus
aggactctccctgttacagaggaaa

SEQ ID NO: 140371 - DNA, 25 bp, Rattus norvegicus
aggactctcgagcaagtctcagtga

SEQ ID NO: 140372 - DNA, 25 bp, Rattus norvegicus
aggactctcgaggaagtctcagtga

SEQ ID NO: 140373 - DNA, 25 bp, Rattus norvegicus
aggactctctccaaggcacaggttg

SEQ ID NO: 140374 - DNA, 25 bp, Rattus norvegicus
aggactctctcctaggcacaggttg

SEQ ID NO: 140375 - DNA, 25 bp, Rattus norvegicus
aggactctcttaacaaccttcagaa

SEQ ID NO: 140376 - DNA, 25 bp, Rattus norvegicus
aggactctcttatcaaccttcagaa

SEQ ID NO: 140377 - DNA, 25 bp, Rattus norvegicus
aggactctgagaagaacctgcggaa

SEQ ID NO: 140378 - DNA, 25 bp, Rattus norvegicus
aggactctgagacgtatatgcttaa

SEQ ID NO: 140379 - DNA, 25 bp, Rattus norvegicus
aggactctgagaggtatatgcttaa

SEQ ID NO: 140380 - DNA, 25 bp, Rattus norvegicus
aggactctgagatgaacctgcggaa

SEQ ID NO: 140381 - DNA, 25 bp, Rattus norvegicus
aggactctgaggaagcccacgctaa

SEQ ID NO: 140382 - DNA, 25 bp, Rattus norvegicus
aggactctgaggtagcccacgctaa

SEQ ID NO: 140383 - DNA, 25 bp, Rattus norvegicus
aggactctgcctcaggatctgatga

SEQ ID NO: 140384 - DNA, 25 bp, Rattus norvegicus
aggactctgcctgaggatctgatga

SEQ ID NO: 140385 - DNA, 25 bp, Rattus norvegicus
aggactctgctacatgtctgcacgt

SEQ ID NO: 140386 - DNA, 25 bp, Rattus norvegicus
aggactctgctagatgtctgcacgt

SEQ ID NO: 140387 - DNA, 25 bp, Rattus norvegicus
aggactctggctctactgggcacat

SEQ ID NO: 140388 - DNA, 25 bp, Rattus norvegicus
aggactctggctgtactgggcacat

SEQ ID NO: 140389 - DNA, 25 bp, Rattus norvegicus
aggactctgtacacagcgcgcggct

SEQ ID NO: 140390 - DNA, 25 bp, Rattus norvegicus
aggactctgtactcagcgcgcggct

SEQ ID NO: 140391 - DNA, 25 bp, Rattus norvegicus
aggactctgtctcgacgaggctcag

SEQ ID NO: 140392 - DNA, 25 bp, Rattus norvegicus
aggactctgtctggacgaggctcag

SEQ ID NO: 140393 - DNA, 25 bp, Rattus norvegicus
aggactctgttcacgggtggacact

SEQ ID NO: 140394 - DNA, 25 bp, Rattus norvegicus
aggactctgttctcgggtggacact

SEQ ID NO: 140395 - DNA, 25 bp, Rattus norvegicus
aggactctgtttcagccagtttctt

SEQ ID NO: 140396 - DNA, 25 bp, Rattus norvegicus
aggactctgtttgagccagtttctt

SEQ ID NO: 140397 - DNA, 25 bp, Rattus norvegicus
aggactcttatgctgctcagtgcct

SEQ ID NO: 140398 - DNA, 25 bp, Rattus norvegicus
aggactcttatggtgctcagtgcct

SEQ ID NO: 140399 - DNA, 25 bp, Rattus norvegicus
aggactcttggccttgatgtagaaa

SEQ ID NO: 140400 - DNA, 25 bp, Rattus norvegicus
aggactcttggccttgtctgttgcc

SEQ ID NO: 140401 - DNA, 25 bp, Rattus norvegicus
aggactcttggcgttgatgtagaaa

SEQ ID NO: 140402 - DNA, 25 bp, Rattus norvegicus
aggactcttggcgttgtctgttgcc

SEQ ID NO: 140403 - DNA, 25 bp, Rattus norvegicus
aggactcttgtgctcaggactgaat

SEQ ID NO: 140404 - DNA, 25 bp, Rattus norvegicus
aggactcttgtgcttgtcaactcat

SEQ ID NO: 140405 - DNA, 25 bp, Rattus norvegicus
aggactcttgtggtcaggactgaat

SEQ ID NO: 140406 - DNA, 25 bp, Rattus norvegicus
aggactcttgtggttgtcaactcat

SEQ ID NO: 140407 - DNA, 25 bp, Rattus norvegicus
aggactctttcaactgtggctagcc

SEQ ID NO: 140408 - DNA, 25 bp, Rattus norvegicus
aggactctttcatctgtggctagcc

SEQ ID NO: 140409 - DNA, 25 bp, Rattus norvegicus
aggactctttccacagaagcagtaa

SEQ ID NO: 140410 - DNA, 25 bp, Rattus norvegicus
aggactctttcctcagaagcagtaa

SEQ ID NO: 140411 - DNA, 25 bp, Rattus norvegicus
aggactgaaggccacagctcccatg

SEQ ID NO: 140412 - DNA, 25 bp, Rattus norvegicus
aggactgaaggcgacagctcccatg

SEQ ID NO: 140413 - DNA, 25 bp, Rattus norvegicus
aggactgaatggagtccagcctggt

SEQ ID NO: 140414 - DNA, 25 bp, Rattus norvegicus
aggactgaatggtgtccagcctggt

SEQ ID NO: 140415 - DNA, 25 bp, Rattus norvegicus
aggactgacaggaccatatctttaa

SEQ ID NO: 140416 - DNA, 25 bp, Rattus norvegicus
aggactgacaggtccatatctttaa

SEQ ID NO: 140417 - DNA, 25 bp, Rattus norvegicus
aggactgaccatatgccacctgaca

SEQ ID NO: 140418 - DNA, 25 bp, Rattus norvegicus
aggactgaccatttgccacctgaca

SEQ ID NO: 140419 - DNA, 25 bp, Rattus norvegicus
aggactgacctgatctacataaata

SEQ ID NO: 140420 - DNA, 25 bp, Rattus norvegicus
aggactgacctgttctacataaata

SEQ ID NO: 140421 - DNA, 25 bp, Rattus norvegicus
aggactgacgctctggtaggcaata

SEQ ID NO: 140422 - DNA, 25 bp, Rattus norvegicus
aggactgacgctgtggtaggcaata

SEQ ID NO: 140423 - DNA, 25 bp, Rattus norvegicus
aggactgactagcaggaagccccag

SEQ ID NO: 140424 - DNA, 25 bp, Rattus norvegicus
aggactgactaggaggaagccccag

SEQ ID NO: 140425 - DNA, 25 bp, Rattus norvegicus
aggactgactgaaccctggtactgt

SEQ ID NO: 140426 - DNA, 25 bp, Rattus norvegicus
aggactgactgatccctggtactgt

SEQ ID NO: 140427 - DNA, 25 bp, Rattus norvegicus
aggactgagacacggccacaccagg

SEQ ID NO: 140428 - DNA, 25 bp, Rattus norvegicus
aggactgagacagggccacaccagg

SEQ ID NO: 140429 - DNA, 25 bp, Rattus norvegicus
aggactgagcctagatgccacccaa

SEQ ID NO: 140430 - DNA, 25 bp, Rattus norvegicus
aggactgagccttgatgccacccaa

SEQ ID NO: 140431 - DNA, 25 bp, Rattus norvegicus
aggactgagtacctttacttgataa

SEQ ID NO: 140432 - DNA, 25 bp, Rattus norvegicus
aggactgagtacgtttacttgataa

SEQ ID NO: 140433 - DNA, 25 bp, Rattus norvegicus
aggactgagtgcagtcttcgacaaa

SEQ ID NO: 140434 - DNA, 25 bp, Rattus norvegicus
aggactgagtgctgtcttcgacaaa

SEQ ID NO: 140435 - DNA, 25 bp, Rattus norvegicus
aggactgatgttcttgttcccagga

SEQ ID NO: 140436 - DNA, 25 bp, Rattus norvegicus
aggactgatgttgttgttcccagga

SEQ ID NO: 140437 - DNA, 25 bp, Rattus norvegicus
aggactgattccagttcatctgaca

SEQ ID NO: 140438 - DNA, 25 bp, Rattus norvegicus
aggactgattcctgttcatctgaca

SEQ ID NO: 140439 - DNA, 25 bp, Rattus norvegicus
aggactgatttgagggtctttccca

SEQ ID NO: 140440 - DNA, 25 bp, Rattus norvegicus
aggactgatttgtgggtctttccca

SEQ ID NO: 140441 - DNA, 25 bp, Rattus norvegicus
aggactgcaaggataccgcctgcca

SEQ ID NO: 140442 - DNA, 25 bp, Rattus norvegicus
aggactgcaaggttaccgcctgcca

SEQ ID NO: 140443 - DNA, 25 bp, Rattus norvegicus
aggactgcaagtcgccagaaattta

SEQ ID NO: 140444 - DNA, 25 bp, Rattus norvegicus
aggactgcaagtggccagaaattta

SEQ ID NO: 140445 - DNA, 25 bp, Rattus norvegicus
aggactgcacctaaactcttgttaa

SEQ ID NO: 140446 - DNA, 25 bp, Rattus norvegicus
aggactgcaccttaactcttgttaa

SEQ ID NO: 140447 - DNA, 25 bp, Rattus norvegicus
aggactgcagggatatgtaccaaca

SEQ ID NO: 140448 - DNA, 25 bp, Rattus norvegicus
aggactgcagggttatgtaccaaca

SEQ ID NO: 140449 - DNA, 25 bp, Rattus norvegicus
aggactgcatctcctgtctgttgga

SEQ ID NO: 140450 - DNA, 25 bp, Rattus norvegicus
aggactgcatctgctgtctgttgga

SEQ ID NO: 140451 - DNA, 25 bp, Rattus norvegicus
aggactgcattgaccctggacatca

SEQ ID NO: 140452 - DNA, 25 bp, Rattus norvegicus
aggactgcattgtccctggacatca

SEQ ID NO: 140453 - DNA, 25 bp, Rattus norvegicus
aggactgccaatcaggacctagttt

SEQ ID NO: 140454 - DNA, 25 bp, Rattus norvegicus
aggactgccaatgaggacctagttt

SEQ ID NO: 140455 - DNA, 25 bp, Rattus norvegicus
aggactgccacaataagacgctatg

SEQ ID NO: 140456 - DNA, 25 bp, Rattus norvegicus
aggactgccacattaagacgctatg

SEQ ID NO: 140457 - DNA, 25 bp, Rattus norvegicus
aggactgccaggactgcgggaatat

SEQ ID NO: 140458 - DNA, 25 bp, Rattus norvegicus
aggactgccaggtctgcgggaatat

SEQ ID NO: 140459 - DNA, 25 bp, Rattus norvegicus
aggactgccagtatccttgggttag

SEQ ID NO: 140460 - DNA, 25 bp, Rattus norvegicus
aggactgccagtttccttgggttag

SEQ ID NO: 140461 - DNA, 25 bp, Rattus norvegicus
aggactgcggccagcaactggagac

SEQ ID NO: 140462 - DNA, 25 bp, Rattus norvegicus
aggactgcggcctgcaactggagac

SEQ ID NO: 140463 - DNA, 25 bp, Rattus norvegicus
aggactgcgggcaagcggcctctaa

SEQ ID NO: 140464 - DNA, 25 bp, Rattus norvegicus
aggactgcgggctagcggcctctaa

SEQ ID NO: 140465 - DNA, 25 bp, Rattus norvegicus
aggactgctaacattagtcccaggg

SEQ ID NO: 140466 - DNA, 25 bp, Rattus norvegicus
aggactgctaactttagtcccaggg

SEQ ID NO: 140467 - DNA, 25 bp, Rattus norvegicus
aggactgctaatctcagttcgctct

SEQ ID NO: 140468 - DNA, 25 bp, Rattus norvegicus
aggactgctaatgtcagttcgctct

SEQ ID NO: 140469 - DNA, 25 bp, Rattus norvegicus
aggactgctaggaagaacacggttt

SEQ ID NO: 140470 - DNA, 25 bp, Rattus norvegicus
aggactgctaggtagaacacggttt

SEQ ID NO: 140471 - DNA, 25 bp, Rattus norvegicus
aggactgctcccagctggcggcaga

SEQ ID NO: 140472 - DNA, 25 bp, Rattus norvegicus
aggactgctccctgctggcggcaga

SEQ ID NO: 140473 - DNA, 25 bp, Rattus norvegicus
aggactgctgatctagctacacgtt

SEQ ID NO: 140474 - DNA, 25 bp, Rattus norvegicus
aggactgctgatgtagctacacgtt

SEQ ID NO: 140475 - DNA, 25 bp, Rattus norvegicus
aggactgctgggacctgagcttctc

SEQ ID NO: 140476 - DNA, 25 bp, Rattus norvegicus
aggactgctgggtcctgagcttctc

SEQ ID NO: 140477 - DNA, 25 bp, Rattus norvegicus
aggactgctggtaggaaacctgtaa

SEQ ID NO: 140478 - DNA, 25 bp, Rattus norvegicus
aggactgctggttggaaacctgtaa

SEQ ID NO: 140479 - DNA, 25 bp, Rattus norvegicus
aggactgcttctcgacaaaggtgaa

SEQ ID NO: 140480 - DNA, 25 bp, Rattus norvegicus
aggactgcttctggacaaaggtgaa

SEQ ID NO: 140481 - DNA, 25 bp, Rattus norvegicus
aggactggaccaaccagcggctcaa

SEQ ID NO: 140482 - DNA, 25 bp, Rattus norvegicus
aggactggaccaagacagactgcct

SEQ ID NO: 140483 - DNA, 25 bp, Rattus norvegicus
aggactggaccatccagcggctcaa

SEQ ID NO: 140484 - DNA, 25 bp, Rattus norvegicus
aggactggaccatgacagactgcct

SEQ ID NO: 140485 - DNA, 25 bp, Rattus norvegicus
aggactggactcagaccttagcttg

SEQ ID NO: 140486 - DNA, 25 bp, Rattus norvegicus
aggactggactctgaccttagcttg

SEQ ID NO: 140487 - DNA, 25 bp, Rattus norvegicus
aggactggcaaccacactgtgaaat

SEQ ID NO: 140488 - DNA, 25 bp, Rattus norvegicus
aggactggcaacgacactgtgaaat

SEQ ID NO: 140489 - DNA, 25 bp, Rattus norvegicus
aggactggcagaattcagtcatggg

SEQ ID NO: 140490 - DNA, 25 bp, Rattus norvegicus
aggactggcagatttcagtcatggg

SEQ ID NO: 140491 - DNA, 25 bp, Rattus norvegicus
aggactggcatgctcatccatcaag

SEQ ID NO: 140492 - DNA, 25 bp, Rattus norvegicus
aggactggcatggtcatccatcaag

SEQ ID NO: 140493 - DNA, 25 bp, Rattus norvegicus
aggactggccctcgatttctataag

SEQ ID NO: 140494 - DNA, 25 bp, Rattus norvegicus
aggactggccctctgaagagaccaa

SEQ ID NO: 140495 - DNA, 25 bp, Rattus norvegicus
aggactggccctggatttctataag

SEQ ID NO: 140496 - DNA, 25 bp, Rattus norvegicus
aggactggccctgtgaagagaccaa

SEQ ID NO: 140497 - DNA, 25 bp, Rattus norvegicus
aggactggctgtcttttgtccccaa

SEQ ID NO: 140498 - DNA, 25 bp, Rattus norvegicus
aggactggctgtgttttgtccccaa

SEQ ID NO: 140499 - DNA, 25 bp, Rattus norvegicus
aggactgggatccagccagcctgta

SEQ ID NO: 140500 - DNA, 25 bp, Rattus norvegicus
aggactgggatcgagccagcctgta

SEQ ID NO: 140501 - DNA, 25 bp, Rattus norvegicus
aggactgggcccatgatccccacgg

SEQ ID NO: 140502 - DNA, 25 bp, Rattus norvegicus
aggactgggcccttgatccccacgg

SEQ ID NO: 140503 - DNA, 25 bp, Rattus norvegicus
aggactgggctacagctgcacacca

SEQ ID NO: 140504 - DNA, 25 bp, Rattus norvegicus
aggactgggctagagctgcacacca

SEQ ID NO: 140505 - DNA, 25 bp, Rattus norvegicus
aggactggtcagagctttctttcac

SEQ ID NO: 140506 - DNA, 25 bp, Rattus norvegicus
aggactggtcagcaattggcgccaa

SEQ ID NO: 140507 - DNA, 25 bp, Rattus norvegicus
aggactggtcaggaattggcgccaa

SEQ ID NO: 140508 - DNA, 25 bp, Rattus norvegicus
aggactggtcagtgctttctttcac

SEQ ID NO: 140509 - DNA, 25 bp, Rattus norvegicus
aggactggtttcctctgcgctctga

SEQ ID NO: 140510 - DNA, 25 bp, Rattus norvegicus
aggactggtttcgtctgcgctctga

SEQ ID NO: 140511 - DNA, 25 bp, Rattus norvegicus
aggactgtaagcacctgccttaggc

SEQ ID NO: 140512 - DNA, 25 bp, Rattus norvegicus
aggactgtaagctcctgccttaggc

SEQ ID NO: 140513 - DNA, 25 bp, Rattus norvegicus
aggactgtaggtagcctgccatggc

SEQ ID NO: 140514 - DNA, 25 bp, Rattus norvegicus
aggactgtaggttgcctgccatggc

SEQ ID NO: 140515 - DNA, 25 bp, Rattus norvegicus
aggactgtatgcagacagtagatct

SEQ ID NO: 140516 - DNA, 25 bp, Rattus norvegicus
aggactgtatgctgacagtagatct

SEQ ID NO: 140517 - DNA, 25 bp, Rattus norvegicus
aggactgtcaaaaggctctcaagcg

SEQ ID NO: 140518 - DNA, 25 bp, Rattus norvegicus
aggactgtcaaatggctctcaagcg

SEQ ID NO: 140519 - DNA, 25 bp, Rattus norvegicus
aggactgtcagcagctgcttctggg

SEQ ID NO: 140520 - DNA, 25 bp, Rattus norvegicus
aggactgtcagctgctgcttctggg

SEQ ID NO: 140521 - DNA, 25 bp, Rattus norvegicus
aggactgtcatacccacagtttgca

SEQ ID NO: 140522 - DNA, 25 bp, Rattus norvegicus
aggactgtcatagccacagtttgca

SEQ ID NO: 140523 - DNA, 25 bp, Rattus norvegicus
aggactgtcatcaaacagtttagca

SEQ ID NO: 140524 - DNA, 25 bp, Rattus norvegicus
aggactgtcatctaacagtttagca

SEQ ID NO: 140525 - DNA, 25 bp, Rattus norvegicus
aggactgtccagcaccactgtgatc

SEQ ID NO: 140526 - DNA, 25 bp, Rattus norvegicus
aggactgtccaggaccactgtgatc

SEQ ID NO: 140527 - DNA, 25 bp, Rattus norvegicus
aggactgtccggaatttgatggctt

SEQ ID NO: 140528 - DNA, 25 bp, Rattus norvegicus
aggactgtccggtatttgatggctt

SEQ ID NO: 140529 - DNA, 25 bp, Rattus norvegicus
aggactgtcctcacagtactatttt

SEQ ID NO: 140530 - DNA, 25 bp, Rattus norvegicus
aggactgtcctctcagtactatttt

SEQ ID NO: 140531 - DNA, 25 bp, Rattus norvegicus
aggactgtcgtgcaagccctctctt

SEQ ID NO: 140532 - DNA, 25 bp, Rattus norvegicus
aggactgtcgtggaagccctctctt

SEQ ID NO: 140533 - DNA, 25 bp, Rattus norvegicus
aggactgtctaaagaccccatgaat

SEQ ID NO: 140534 - DNA, 25 bp, Rattus norvegicus
aggactgtctaatgaccccatgaat

SEQ ID NO: 140535 - DNA, 25 bp, Rattus norvegicus
aggactgtctatcccaagaacattc

SEQ ID NO: 140536 - DNA, 25 bp, Rattus norvegicus
aggactgtctatgccaagaacattc

SEQ ID NO: 140537 - DNA, 25 bp, Rattus norvegicus
aggactgtgacacgtagcctgtcca

SEQ ID NO: 140538 - DNA, 25 bp, Rattus norvegicus
aggactgtgacaggtagcctgtcca

SEQ ID NO: 140539 - DNA, 25 bp, Rattus norvegicus
aggactgtgcagcagttggtacacc

SEQ ID NO: 140540 - DNA, 25 bp, Rattus norvegicus
aggactgtgcaggagttggtacacc

SEQ ID NO: 140541 - DNA, 25 bp, Rattus norvegicus
aggactgtgggacttcccgtctgtc

SEQ ID NO: 140542 - DNA, 25 bp, Rattus norvegicus
aggactgtgggagttcccgtctgtc

SEQ ID NO: 140543 - DNA, 25 bp, Rattus norvegicus
aggactgtggttatctagtgactca

SEQ ID NO: 140544 - DNA, 25 bp, Rattus norvegicus
aggactgtggttttctagtgactca

SEQ ID NO: 140545 - DNA, 25 bp, Rattus norvegicus
aggactgttggaaccactagctgtc

SEQ ID NO: 140546 - DNA, 25 bp, Rattus norvegicus
aggactgttggacaatctccaccaa

SEQ ID NO: 140547 - DNA, 25 bp, Rattus norvegicus
aggactgttggagaatctccaccaa

SEQ ID NO: 140548 - DNA, 25 bp, Rattus norvegicus
aggactgttggatccactagctgtc

SEQ ID NO: 140549 - DNA, 25 bp, Rattus norvegicus
aggactgttgttatcaagtacttca

SEQ ID NO: 140550 - DNA, 25 bp, Rattus norvegicus
aggactgttgttttcaagtacttca

SEQ ID NO: 140551 - DNA, 25 bp, Rattus norvegicus
aggacttaagcgcttccaggccaat

SEQ ID NO: 140552 - DNA, 25 bp, Rattus norvegicus
aggacttaagcggttccaggccaat

SEQ ID NO: 140553 - DNA, 25 bp, Rattus norvegicus
aggacttaagctatctctactagaa

SEQ ID NO: 140554 - DNA, 25 bp, Rattus norvegicus
aggacttaagctttctctactagaa

SEQ ID NO: 140555 - DNA, 25 bp, Rattus norvegicus
aggacttaaggccactgcaccgtgg

SEQ ID NO: 140556 - DNA, 25 bp, Rattus norvegicus
aggacttaaggcgactgcaccgtgg

SEQ ID NO: 140557 - DNA, 25 bp, Rattus norvegicus
aggacttacccaaggccacataatg

SEQ ID NO: 140558 - DNA, 25 bp, Rattus norvegicus
aggacttacccatggccacataatg

SEQ ID NO: 140559 - DNA, 25 bp, Rattus norvegicus
aggacttaccctcctgtgtttagct

SEQ ID NO: 140560 - DNA, 25 bp, Rattus norvegicus
aggacttaccctgctgtgtttagct

SEQ ID NO: 140561 - DNA, 25 bp, Rattus norvegicus
aggacttactaaaggccctacttgc

SEQ ID NO: 140562 - DNA, 25 bp, Rattus norvegicus
aggacttactaatggccctacttgc

SEQ ID NO: 140563 - DNA, 25 bp, Rattus norvegicus
aggacttactgcaggcctctggaag

SEQ ID NO: 140564 - DNA, 25 bp, Rattus norvegicus
aggacttactgctggcctctggaag

SEQ ID NO: 140565 - DNA, 25 bp, Rattus norvegicus
aggacttacttacttgttcccagtg

SEQ ID NO: 140566 - DNA, 25 bp, Rattus norvegicus
aggacttacttagttgttcccagtg

SEQ ID NO: 140567 - DNA, 25 bp, Rattus norvegicus
aggacttaggagatgatcacgtgat

SEQ ID NO: 140568 - DNA, 25 bp, Rattus norvegicus
aggacttaggagttgatcacgtgat

SEQ ID NO: 140569 - DNA, 25 bp, Rattus norvegicus
aggacttagtacatcactgcctagg

SEQ ID NO: 140570 - DNA, 25 bp, Rattus norvegicus
aggacttagtacttcactgcctagg

SEQ ID NO: 140571 - DNA, 25 bp, Rattus norvegicus
aggacttatcccaagagcctttgat

SEQ ID NO: 140572 - DNA, 25 bp, Rattus norvegicus
aggacttatccctagagcctttgat

SEQ ID NO: 140573 - DNA, 25 bp, Rattus norvegicus
aggacttatgcccagagctccatgc

SEQ ID NO: 140574 - DNA, 25 bp, Rattus norvegicus
aggacttatgccgagagctccatgc

SEQ ID NO: 140575 - DNA, 25 bp, Rattus norvegicus
aggacttatggaccccaaggatctg

SEQ ID NO: 140576 - DNA, 25 bp, Rattus norvegicus
aggacttatggagcccaaggatctg

SEQ ID NO: 140577 - DNA, 25 bp, Rattus norvegicus
aggacttattttagctgcccagtag

SEQ ID NO: 140578 - DNA, 25 bp, Rattus norvegicus
aggacttatttttgctgcccagtag

SEQ ID NO: 140579 - DNA, 25 bp, Rattus norvegicus
aggacttcaaccaattacccacgtg

SEQ ID NO: 140580 - DNA, 25 bp, Rattus norvegicus
aggacttcaacctattacccacgtg

SEQ ID NO: 140581 - DNA, 25 bp, Rattus norvegicus
aggacttcacaactgcataattggg

SEQ ID NO: 140582 - DNA, 25 bp, Rattus norvegicus
aggacttcacaagtgcataattggg

SEQ ID NO: 140583 - DNA, 25 bp, Rattus norvegicus
aggacttcacgcaagatttcaattg

SEQ ID NO: 140584 - DNA, 25 bp, Rattus norvegicus
aggacttcacgctagatttcaattg

SEQ ID NO: 140585 - DNA, 25 bp, Rattus norvegicus
aggacttcagcacctttgaatgtga

SEQ ID NO: 140586 - DNA, 25 bp, Rattus norvegicus
aggacttcagcagctttgaatgtga

SEQ ID NO: 140587 - DNA, 25 bp, Rattus norvegicus
aggacttcaggacctcttctcagag

SEQ ID NO: 140588 - DNA, 25 bp, Rattus norvegicus
aggacttcaggagctcttctcagag

SEQ ID NO: 140589 - DNA, 25 bp, Rattus norvegicus
aggacttcaggtaagcccagagctc

SEQ ID NO: 140590 - DNA, 25 bp, Rattus norvegicus
aggacttcaggttagcccagagctc

SEQ ID NO: 140591 - DNA, 25 bp, Rattus norvegicus
aggacttcagtcatggtgacccgaa

SEQ ID NO: 140592 - DNA, 25 bp, Rattus norvegicus
aggacttcagtcctcactagggcag

SEQ ID NO: 140593 - DNA, 25 bp, Rattus norvegicus
aggacttcagtcgtcactagggcag

SEQ ID NO: 140594 - DNA, 25 bp, Rattus norvegicus
aggacttcagtcttggtgacccgaa

SEQ ID NO: 140595 - DNA, 25 bp, Rattus norvegicus
aggacttcagtgatgagctgtagac

SEQ ID NO: 140596 - DNA, 25 bp, Rattus norvegicus
aggacttcagtgttgagctgtagac

SEQ ID NO: 140597 - DNA, 25 bp, Rattus norvegicus
aggacttcatccatctcaacataaa

SEQ ID NO: 140598 - DNA, 25 bp, Rattus norvegicus
aggacttcatccttctcaacataaa

SEQ ID NO: 140599 - DNA, 25 bp, Rattus norvegicus
aggacttcatctccaagcgcaggaa

SEQ ID NO: 140600 - DNA, 25 bp, Rattus norvegicus
aggacttcatctgcaagcgcaggaa

SEQ ID NO: 140601 - DNA, 25 bp, Rattus norvegicus
aggacttcatgcattgtgctttaac

SEQ ID NO: 140602 - DNA, 25 bp, Rattus norvegicus
aggacttcatgctttgtgctttaac

SEQ ID NO: 140603 - DNA, 25 bp, Rattus norvegicus
aggacttcatttcctgaccttgagg

SEQ ID NO: 140604 - DNA, 25 bp, Rattus norvegicus
aggacttcatttgctgaccttgagg

SEQ ID NO: 140605 - DNA, 25 bp, Rattus norvegicus
aggacttccaagagagactctcgaa

SEQ ID NO: 140606 - DNA, 25 bp, Rattus norvegicus
aggacttccaagtgagactctcgaa

SEQ ID NO: 140607 - DNA, 25 bp, Rattus norvegicus
aggacttccacccatgtgcatggaa

SEQ ID NO: 140608 - DNA, 25 bp, Rattus norvegicus
aggacttccaccgatgtgcatggaa

SEQ ID NO: 140609 - DNA, 25 bp, Rattus norvegicus
aggacttccagcaggagatcgctaa

SEQ ID NO: 140610 - DNA, 25 bp, Rattus norvegicus
aggacttccagctggagatcgctaa

SEQ ID NO: 140611 - DNA, 25 bp, Rattus norvegicus
aggacttccagtacactggtactta

SEQ ID NO: 140612 - DNA, 25 bp, Rattus norvegicus
aggacttccagttcactggtactta

SEQ ID NO: 140613 - DNA, 25 bp, Rattus norvegicus
aggacttccatactttggccaccta

SEQ ID NO: 140614 - DNA, 25 bp, Rattus norvegicus
aggacttccatagtttggccaccta

SEQ ID NO: 140615 - DNA, 25 bp, Rattus norvegicus
aggacttcccttctgagctggtaga

SEQ ID NO: 140616 - DNA, 25 bp, Rattus norvegicus
aggacttcccttgtgagctggtaga

SEQ ID NO: 140617 - DNA, 25 bp, Rattus norvegicus
aggacttccgtgagagcccatgtta

SEQ ID NO: 140618 - DNA, 25 bp, Rattus norvegicus
aggacttccgtgtgagcccatgtta

SEQ ID NO: 140619 - DNA, 25 bp, Rattus norvegicus
aggacttctactctgtgacttgcca

SEQ ID NO: 140620 - DNA, 25 bp, Rattus norvegicus
aggacttctactgtgtgacttgcca

SEQ ID NO: 140621 - DNA, 25 bp, Rattus norvegicus
aggacttctaggagcaatcgccctg

SEQ ID NO: 140622 - DNA, 25 bp, Rattus norvegicus
aggacttctaggtgcaatcgccctg

SEQ ID NO: 140623 - DNA, 25 bp, Rattus norvegicus
aggacttctattatgctctctgact

SEQ ID NO: 140624 - DNA, 25 bp, Rattus norvegicus
aggacttctattttgctctctgact

SEQ ID NO: 140625 - DNA, 25 bp, Rattus norvegicus
aggacttctcggaacatcgacttca

SEQ ID NO: 140626 - DNA, 25 bp, Rattus norvegicus
aggacttctcggtacatcgacttca

SEQ ID NO: 140627 - DNA, 25 bp, Rattus norvegicus
aggacttctcgtcctacttatcaga

SEQ ID NO: 140628 - DNA, 25 bp, Rattus norvegicus
aggacttctcgtgctacttatcaga

SEQ ID NO: 140629 - DNA, 25 bp, Rattus norvegicus
aggacttctctgctgctccaaagaa

SEQ ID NO: 140630 - DNA, 25 bp, Rattus norvegicus
aggacttctctggtgctccaaagaa

SEQ ID NO: 140631 - DNA, 25 bp, Rattus norvegicus
aggacttctgcgatgcccagtgtga

SEQ ID NO: 140632 - DNA, 25 bp, Rattus norvegicus
aggacttctgcgttgcccagtgtga

SEQ ID NO: 140633 - DNA, 25 bp, Rattus norvegicus
aggacttctgctaagcctgtgggct

SEQ ID NO: 140634 - DNA, 25 bp, Rattus norvegicus
aggacttctgcttagcctgtgggct

SEQ ID NO: 140635 - DNA, 25 bp, Rattus norvegicus
aggacttctgtgagccgtttgtctt

SEQ ID NO: 140636 - DNA, 25 bp, Rattus norvegicus
aggacttctgtgtgccgtttgtctt

SEQ ID NO: 140637 - DNA, 25 bp, Rattus norvegicus
aggacttcttacaaacatctcccga

SEQ ID NO: 140638 - DNA, 25 bp, Rattus norvegicus
aggacttcttactaacatctcccga

SEQ ID NO: 140639 - DNA, 25 bp, Rattus norvegicus
aggacttcttctcagtggcggttat

SEQ ID NO: 140640 - DNA, 25 bp, Rattus norvegicus
aggacttcttctgagtggcggttat

SEQ ID NO: 140641 - DNA, 25 bp, Rattus norvegicus
aggacttgaaccagcccttccagaa

SEQ ID NO: 140642 - DNA, 25 bp, Rattus norvegicus
aggacttgaacctgcccttccagaa

SEQ ID NO: 140643 - DNA, 25 bp, Rattus norvegicus
aggacttgagttcgtgctgcctgcc

SEQ ID NO: 140644 - DNA, 25 bp, Rattus norvegicus
aggacttgagttggtgctgcctgcc

SEQ ID NO: 140645 - DNA, 25 bp, Rattus norvegicus
aggacttgatccatctccaggaaga

SEQ ID NO: 140646 - DNA, 25 bp, Rattus norvegicus
aggacttgatccttctccaggaaga

SEQ ID NO: 140647 - DNA, 25 bp, Rattus norvegicus
aggacttgcattctactgtgcttca

SEQ ID NO: 140648 - DNA, 25 bp, Rattus norvegicus
aggacttgcattgtactgtgcttca

SEQ ID NO: 140649 - DNA, 25 bp, Rattus norvegicus
aggacttgccacacaaactgacagt

SEQ ID NO: 140650 - DNA, 25 bp, Rattus norvegicus
aggacttgccactcaaactgacagt

SEQ ID NO: 140651 - DNA, 25 bp, Rattus norvegicus
aggacttgccggcttgcctgaagcc

SEQ ID NO: 140652 - DNA, 25 bp, Rattus norvegicus
aggacttgccgggttgcctgaagcc

SEQ ID NO: 140653 - DNA, 25 bp, Rattus norvegicus
aggacttgccttccatccaaggtct

SEQ ID NO: 140654 - DNA, 25 bp, Rattus norvegicus
aggacttgccttcggttcctcaggc

SEQ ID NO: 140655 - DNA, 25 bp, Rattus norvegicus
aggacttgccttgcatccaaggtct

SEQ ID NO: 140656 - DNA, 25 bp, Rattus norvegicus
aggacttgccttgggttcctcaggc

SEQ ID NO: 140657 - DNA, 25 bp, Rattus norvegicus
aggacttgctatctgctcagtgcca

SEQ ID NO: 140658 - DNA, 25 bp, Rattus norvegicus
aggacttgctatgtgctcagtgcca

SEQ ID NO: 140659 - DNA, 25 bp, Rattus norvegicus
aggacttggattcgcctgcgtgcac

SEQ ID NO: 140660 - DNA, 25 bp, Rattus norvegicus
aggacttggattggcctgcgtgcac

SEQ ID NO: 140661 - DNA, 25 bp, Rattus norvegicus
aggacttggctaagacccgtacaac

SEQ ID NO: 140662 - DNA, 25 bp, Rattus norvegicus
aggacttggctatgacccgtacaac

SEQ ID NO: 140663 - DNA, 25 bp, Rattus norvegicus
aggacttgggctcgcagtcaaacca

SEQ ID NO: 140664 - DNA, 25 bp, Rattus norvegicus
aggacttgggctggcagtcaaacca

SEQ ID NO: 140665 - DNA, 25 bp, Rattus norvegicus
aggacttgtacgaatatggctgggt

SEQ ID NO: 140666 - DNA, 25 bp, Rattus norvegicus
aggacttgtacgtatatggctgggt

SEQ ID NO: 140667 - DNA, 25 bp, Rattus norvegicus
aggacttgtagtatgctggcggcat

SEQ ID NO: 140668 - DNA, 25 bp, Rattus norvegicus
aggacttgtagtttgctggcggcat

SEQ ID NO: 140669 - DNA, 25 bp, Rattus norvegicus
aggacttgtcctaactagctttagg

SEQ ID NO: 140670 - DNA, 25 bp, Rattus norvegicus
aggacttgtccttactagctttagg

SEQ ID NO: 140671 - DNA, 25 bp, Rattus norvegicus
aggacttgtcttcatccaacaggaa

SEQ ID NO: 140672 - DNA, 25 bp, Rattus norvegicus
aggacttgtcttgatccaacaggaa

SEQ ID NO: 140673 - DNA, 25 bp, Rattus norvegicus
aggacttgttagatctagttcattc

SEQ ID NO: 140674 - DNA, 25 bp, Rattus norvegicus
aggacttgttagttctagttcattc

SEQ ID NO: 140675 - DNA, 25 bp, Rattus norvegicus
aggacttgtttaactcgggaggaca

SEQ ID NO: 140676 - DNA, 25 bp, Rattus norvegicus
aggacttgtttatctcgggaggaca

SEQ ID NO: 140677 - DNA, 25 bp, Rattus norvegicus
aggactttaaccatctccagctaag

SEQ ID NO: 140678 - DNA, 25 bp, Rattus norvegicus
aggactttaaccttctccagctaag

SEQ ID NO: 140679 - DNA, 25 bp, Rattus norvegicus
aggactttactcatgagccttgcta

SEQ ID NO: 140680 - DNA, 25 bp, Rattus norvegicus
aggactttactcttgagccttgcta

SEQ ID NO: 140681 - DNA, 25 bp, Rattus norvegicus
aggactttaggtccccagtgtgaca

SEQ ID NO: 140682 - DNA, 25 bp, Rattus norvegicus
aggactttaggtgcccagtgtgaca

SEQ ID NO: 140683 - DNA, 25 bp, Rattus norvegicus
aggactttcagtaacctgtgctgca

SEQ ID NO: 140684 - DNA, 25 bp, Rattus norvegicus
aggactttcagttacctgtgctgca

SEQ ID NO: 140685 - DNA, 25 bp, Rattus norvegicus
aggactttccaacttagcatcctac

SEQ ID NO: 140686 - DNA, 25 bp, Rattus norvegicus
aggactttccaagttagcatcctac

SEQ ID NO: 140687 - DNA, 25 bp, Rattus norvegicus
aggactttccagaggagtgctgcct

SEQ ID NO: 140688 - DNA, 25 bp, Rattus norvegicus
aggactttccagtggagtgctgcct

SEQ ID NO: 140689 - DNA, 25 bp, Rattus norvegicus
aggactttcccaccaaaggattcag

SEQ ID NO: 140690 - DNA, 25 bp, Rattus norvegicus
aggactttcccagcaaaggattcag

SEQ ID NO: 140691 - DNA, 25 bp, Rattus norvegicus
aggactttcccgatcttggtgttca

SEQ ID NO: 140692 - DNA, 25 bp, Rattus norvegicus
aggactttcccgttcttggtgttca

SEQ ID NO: 140693 - DNA, 25 bp, Rattus norvegicus
aggactttcctcactggacggcagt

SEQ ID NO: 140694 - DNA, 25 bp, Rattus norvegicus
aggactttcctcatgtctttaactg

SEQ ID NO: 140695 - DNA, 25 bp, Rattus norvegicus
aggactttcctctctggacggcagt

SEQ ID NO: 140696 - DNA, 25 bp, Rattus norvegicus
aggactttcctcttgtctttaactg

SEQ ID NO: 140697 - DNA, 25 bp, Rattus norvegicus
aggactttctaaagccacctgatcc

SEQ ID NO: 140698 - DNA, 25 bp, Rattus norvegicus
aggactttctaatgccacctgatcc

SEQ ID NO: 140699 - DNA, 25 bp, Rattus norvegicus
aggactttcttcataatgctctcga

SEQ ID NO: 140700 - DNA, 25 bp, Rattus norvegicus
aggactttcttcattacaaccagcg

SEQ ID NO: 140701 - DNA, 25 bp, Rattus norvegicus
aggactttcttcttaatgctctcga

SEQ ID NO: 140702 - DNA, 25 bp, Rattus norvegicus
aggactttcttctttacaaccagcg

SEQ ID NO: 140703 - DNA, 25 bp, Rattus norvegicus
aggactttgaagaacctgcatcccc

SEQ ID NO: 140704 - DNA, 25 bp, Rattus norvegicus
aggactttgaagctgccgtggtaac

SEQ ID NO: 140705 - DNA, 25 bp, Rattus norvegicus
aggactttgaaggtgccgtggtaac

SEQ ID NO: 140706 - DNA, 25 bp, Rattus norvegicus
aggactttgaagtacctgcatcccc

SEQ ID NO: 140707 - DNA, 25 bp, Rattus norvegicus
aggactttgcgacgcttcggctgaa

SEQ ID NO: 140708 - DNA, 25 bp, Rattus norvegicus
aggactttgcgaggcttcggctgaa

SEQ ID NO: 140709 - DNA, 25 bp, Rattus norvegicus
aggactttgcgcagggtcattccca

SEQ ID NO: 140710 - DNA, 25 bp, Rattus norvegicus
aggactttgcgctgggtcattccca

SEQ ID NO: 140711 - DNA, 25 bp, Rattus norvegicus
aggactttgctcctcagcggctgaa

SEQ ID NO: 140712 - DNA, 25 bp, Rattus norvegicus
aggactttgctcgtcagcggctgaa

SEQ ID NO: 140713 - DNA, 25 bp, Rattus norvegicus
aggactttggagacaccactgttta

SEQ ID NO: 140714 - DNA, 25 bp, Rattus norvegicus
aggactttggagtcaccactgttta

SEQ ID NO: 140715 - DNA, 25 bp, Rattus norvegicus
aggactttgggtctcacagcacgaa

SEQ ID NO: 140716 - DNA, 25 bp, Rattus norvegicus
aggactttgggtgtcacagcacgaa

SEQ ID NO: 140717 - DNA, 25 bp, Rattus norvegicus
aggactttgtgcatctctacttaag

SEQ ID NO: 140718 - DNA, 25 bp, Rattus norvegicus
aggactttgtgcttctctacttaag

SEQ ID NO: 140719 - DNA, 25 bp, Rattus norvegicus
aggactttgtggatgggctctccat

SEQ ID NO: 140720 - DNA, 25 bp, Rattus norvegicus
aggactttgtggttgggctctccat

SEQ ID NO: 140721 - DNA, 25 bp, Rattus norvegicus
aggacttttatactgcttgcacgtt

SEQ ID NO: 140722 - DNA, 25 bp, Rattus norvegicus
aggacttttatagtgcttgcacgtt

SEQ ID NO: 140723 - DNA, 25 bp, Rattus norvegicus
aggacttttcctcagtggaactcca

SEQ ID NO: 140724 - DNA, 25 bp, Rattus norvegicus
aggacttttcctgagtggaactcca

SEQ ID NO: 140725 - DNA, 25 bp, Rattus norvegicus
aggacttttcttctgattcactgtt

SEQ ID NO: 140726 - DNA, 25 bp, Rattus norvegicus
aggacttttcttgtgattcactgtt

SEQ ID NO: 140727 - DNA, 25 bp, Rattus norvegicus
aggagaaaaacaaccaagtgggact

SEQ ID NO: 140728 - DNA, 25 bp, Rattus norvegicus
aggagaaaaacatccaagtgggact

SEQ ID NO: 140729 - DNA, 25 bp, Rattus norvegicus
aggagaaaagtgcacagcccgccaa

SEQ ID NO: 140730 - DNA, 25 bp, Rattus norvegicus
aggagaaaagtggacagcccgccaa

SEQ ID NO: 140731 - DNA, 25 bp, Rattus norvegicus
aggagaaacagcagcccatgggttg

SEQ ID NO: 140732 - DNA, 25 bp, Rattus norvegicus
aggagaaacagctgcccatgggttg

SEQ ID NO: 140733 - DNA, 25 bp, Rattus norvegicus
aggagaaaccggacagacacctctg

SEQ ID NO: 140734 - DNA, 25 bp, Rattus norvegicus
aggagaaaccggtcagacacctctg

SEQ ID NO: 140735 - DNA, 25 bp, Rattus norvegicus
aggagaaactccagcctgggtctgc

SEQ ID NO: 140736 - DNA, 25 bp, Rattus norvegicus
aggagaaactccatgcttgctctcg

SEQ ID NO: 140737 - DNA, 25 bp, Rattus norvegicus
aggagaaactcctgcctgggtctgc

SEQ ID NO: 140738 - DNA, 25 bp, Rattus norvegicus
aggagaaactccttgcttgctctcg

SEQ ID NO: 140739 - DNA, 25 bp, Rattus norvegicus
aggagaaactttcacagccgtcacc

SEQ ID NO: 140740 - DNA, 25 bp, Rattus norvegicus
aggagaaactttgacagccgtcacc

SEQ ID NO: 140741 - DNA, 25 bp, Rattus norvegicus
aggagaaagataccccacacgcagt

SEQ ID NO: 140742 - DNA, 25 bp, Rattus norvegicus
aggagaaagatagcccacacgcagt

SEQ ID NO: 140743 - DNA, 25 bp, Rattus norvegicus
aggagaaataagaacggccgcctct

SEQ ID NO: 140744 - DNA, 25 bp, Rattus norvegicus
aggagaaataagtacggccgcctct

SEQ ID NO: 140745 - DNA, 25 bp, Rattus norvegicus
aggagaaataccaggactgggctta

SEQ ID NO: 140746 - DNA, 25 bp, Rattus norvegicus
aggagaaatacctggactgggctta

SEQ ID NO: 140747 - DNA, 25 bp, Rattus norvegicus
aggagaaattcacgccagcagggat

SEQ ID NO: 140748 - DNA, 25 bp, Rattus norvegicus
aggagaaattcaggccagcagggat

SEQ ID NO: 140749 - DNA, 25 bp, Rattus norvegicus
aggagaacagtacggtcgacccata

SEQ ID NO: 140750 - DNA, 25 bp, Rattus norvegicus
aggagaacagtagggtcgacccata

SEQ ID NO: 140751 - DNA, 25 bp, Rattus norvegicus
aggagaacatctcttagccgttgtt

SEQ ID NO: 140752 - DNA, 25 bp, Rattus norvegicus
aggagaacatctgttagccgttgtt

SEQ ID NO: 140753 - DNA, 25 bp, Rattus norvegicus
aggagaacatgcacttctggctggc

SEQ ID NO: 140754 - DNA, 25 bp, Rattus norvegicus
aggagaacatgctcttctggctggc

SEQ ID NO: 140755 - DNA, 25 bp, Rattus norvegicus
aggagaaccactccctactgtgttt

SEQ ID NO: 140756 - DNA, 25 bp, Rattus norvegicus
aggagaaccactgcctactgtgttt

SEQ ID NO: 140757 - DNA, 25 bp, Rattus norvegicus
aggagaaccagaccctcagccagga

SEQ ID NO: 140758 - DNA, 25 bp, Rattus norvegicus
aggagaaccagagcctcagccagga

SEQ ID NO: 140759 - DNA, 25 bp, Rattus norvegicus
aggagaacccagaacccttgctggg

SEQ ID NO: 140760 - DNA, 25 bp, Rattus norvegicus
aggagaacccagtacccttgctggg

SEQ ID NO: 140761 - DNA, 25 bp, Rattus norvegicus
aggagaacggttccttctgacagaa

SEQ ID NO: 140762 - DNA, 25 bp, Rattus norvegicus
aggagaacggttgcttctgacagaa

SEQ ID NO: 140763 - DNA, 25 bp, Rattus norvegicus
aggagaacgtgcagctcatgagcta

SEQ ID NO: 140764 - DNA, 25 bp, Rattus norvegicus
aggagaacgtgctgctcatgagcta

SEQ ID NO: 140765 - DNA, 25 bp, Rattus norvegicus
aggagaactcgacactgggctgcca

SEQ ID NO: 140766 - DNA, 25 bp, Rattus norvegicus
aggagaactcgagactgggctgcca

SEQ ID NO: 140767 - DNA, 25 bp, Rattus norvegicus
aggagaactgcactggacccaggac

SEQ ID NO: 140768 - DNA, 25 bp, Rattus norvegicus
aggagaactgcagtggacccaggac

SEQ ID NO: 140769 - DNA, 25 bp, Rattus norvegicus
aggagaactgctctctgacctgcga

SEQ ID NO: 140770 - DNA, 25 bp, Rattus norvegicus
aggagaactgctgtctgacctgcga

SEQ ID NO: 140771 - DNA, 25 bp, Rattus norvegicus
aggagaacttggaggctctcttccc

SEQ ID NO: 140772 - DNA, 25 bp, Rattus norvegicus
aggagaacttggtggctctcttccc

SEQ ID NO: 140773 - DNA, 25 bp, Rattus norvegicus
aggagaagaacaccctgccgaccaa

SEQ ID NO: 140774 - DNA, 25 bp, Rattus norvegicus
aggagaagaacagcctgccgaccaa

SEQ ID NO: 140775 - DNA, 25 bp, Rattus norvegicus
aggagaagacccagcagcctgccgc

SEQ ID NO: 140776 - DNA, 25 bp, Rattus norvegicus
aggagaagacccagctcaacactgc

SEQ ID NO: 140777 - DNA, 25 bp, Rattus norvegicus
aggagaagaccctgcagcctgccgc

SEQ ID NO: 140778 - DNA, 25 bp, Rattus norvegicus
aggagaagaccctgctcaacactgc

SEQ ID NO: 140779 - DNA, 25 bp, Rattus norvegicus
aggagaagcatcatggcctcttgat

SEQ ID NO: 140780 - DNA, 25 bp, Rattus norvegicus
aggagaagcatcttggcctcttgat

SEQ ID NO: 140781 - DNA, 25 bp, Rattus norvegicus
aggagaagccagagctcctggagca

SEQ ID NO: 140782 - DNA, 25 bp, Rattus norvegicus
aggagaagccagtgctcctggagca

SEQ ID NO: 140783 - DNA, 25 bp, Rattus norvegicus
aggagaagcctcacctgtcacctag

SEQ ID NO: 140784 - DNA, 25 bp, Rattus norvegicus
aggagaagcctctcctgtcacctag

SEQ ID NO: 140785 - DNA, 25 bp, Rattus norvegicus
aggagaagcgcccttcactctgaag

SEQ ID NO: 140786 - DNA, 25 bp, Rattus norvegicus
aggagaagcgccgttcactctgaag

SEQ ID NO: 140787 - DNA, 25 bp, Rattus norvegicus
aggagaagcgttcgcgcagcgccgg

SEQ ID NO: 140788 - DNA, 25 bp, Rattus norvegicus
aggagaagcgttggcgcagcgccgg

SEQ ID NO: 140789 - DNA, 25 bp, Rattus norvegicus
aggagaagctacaacgtgaccccac

SEQ ID NO: 140790 - DNA, 25 bp, Rattus norvegicus
aggagaagctactacgtgaccccac

SEQ ID NO: 140791 - DNA, 25 bp, Rattus norvegicus
aggagaagctgcaggactctcacct

SEQ ID NO: 140792 - DNA, 25 bp, Rattus norvegicus
aggagaagctgctggactctcacct

SEQ ID NO: 140793 - DNA, 25 bp, Rattus norvegicus
aggagaaggcctactctgtgttgaa

SEQ ID NO: 140794 - DNA, 25 bp, Rattus norvegicus
aggagaaggccttctctgtgttgaa

SEQ ID NO: 140795 - DNA, 25 bp, Rattus norvegicus
aggagaatgcacctgtgcctgcgta

SEQ ID NO: 140796 - DNA, 25 bp, Rattus norvegicus
aggagaatgcacgtgtgcctgcgta

SEQ ID NO: 140797 - DNA, 25 bp, Rattus norvegicus
aggagaatgcgcaggtcatgacagc

SEQ ID NO: 140798 - DNA, 25 bp, Rattus norvegicus
aggagaatgcgctggtcatgacagc

SEQ ID NO: 140799 - DNA, 25 bp, Rattus norvegicus
aggagaattttcaaccacgggcaag

SEQ ID NO: 140800 - DNA, 25 bp, Rattus norvegicus
aggagaattttctaccacgggcaag

SEQ ID NO: 140801 - DNA, 25 bp, Rattus norvegicus
aggagacaaagtcccttctaaggct

SEQ ID NO: 140802 - DNA, 25 bp, Rattus norvegicus
aggagacaaagtgccttctaaggct

SEQ ID NO: 140803 - DNA, 25 bp, Rattus norvegicus
aggagacaagcaacttccctggatg

SEQ ID NO: 140804 - DNA, 25 bp, Rattus norvegicus
aggagacaagcatcttccctggatg

SEQ ID NO: 140805 - DNA, 25 bp, Rattus norvegicus
aggagacaattcagccatcatctct

SEQ ID NO: 140806 - DNA, 25 bp, Rattus norvegicus
aggagacaattctgccatcatctct

SEQ ID NO: 140807 - DNA, 25 bp, Rattus norvegicus
aggagacacactcgttctgcactgc

SEQ ID NO: 140808 - DNA, 25 bp, Rattus norvegicus
aggagacacactggttctgcactgc

SEQ ID NO: 140809 - DNA, 25 bp, Rattus norvegicus
aggagacacaggatattgccccact

SEQ ID NO: 140810 - DNA, 25 bp, Rattus norvegicus
aggagacacaggttattgccccact

SEQ ID NO: 140811 - DNA, 25 bp, Rattus norvegicus
aggagacaccggactgaacgtccat

SEQ ID NO: 140812 - DNA, 25 bp, Rattus norvegicus
aggagacaccggtctgaacgtccat

SEQ ID NO: 140813 - DNA, 25 bp, Rattus norvegicus
aggagacactccacacagccaaggg

SEQ ID NO: 140814 - DNA, 25 bp, Rattus norvegicus
aggagacactcctcacagccaaggg

SEQ ID NO: 140815 - DNA, 25 bp, Rattus norvegicus
aggagacactgaagacccggaagaa

SEQ ID NO: 140816 - DNA, 25 bp, Rattus norvegicus
aggagacactgatgacccggaagaa

SEQ ID NO: 140817 - DNA, 25 bp, Rattus norvegicus
aggagacactggctccccgggtatt

SEQ ID NO: 140818 - DNA, 25 bp, Rattus norvegicus
aggagacactgggtccccgggtatt

SEQ ID NO: 140819 - DNA, 25 bp, Rattus norvegicus
aggagacactgtaactgtgggaaca

SEQ ID NO: 140820 - DNA, 25 bp, Rattus norvegicus
aggagacactgttactgtgggaaca

SEQ ID NO: 140821 - DNA, 25 bp, Rattus norvegicus
aggagacagaccagcttcggatgga

SEQ ID NO: 140822 - DNA, 25 bp, Rattus norvegicus
aggagacagacctgcttcggatgga

SEQ ID NO: 140823 - DNA, 25 bp, Rattus norvegicus
aggagacagcacactagaccagggt

SEQ ID NO: 140824 - DNA, 25 bp, Rattus norvegicus
aggagacagcacactcttggagggc

SEQ ID NO: 140825 - DNA, 25 bp, Rattus norvegicus
aggagacagcactctagaccagggt

SEQ ID NO: 140826 - DNA, 25 bp, Rattus norvegicus
aggagacagcactctcttggagggc

SEQ ID NO: 140827 - DNA, 25 bp, Rattus norvegicus
aggagacagctcatttgtaacttgc

SEQ ID NO: 140828 - DNA, 25 bp, Rattus norvegicus
aggagacagctcttttgtaacttgc

SEQ ID NO: 140829 - DNA, 25 bp, Rattus norvegicus
aggagacagtgtcatccttccttgg

SEQ ID NO: 140830 - DNA, 25 bp, Rattus norvegicus
aggagacagtgtgatccttccttgg

SEQ ID NO: 140831 - DNA, 25 bp, Rattus norvegicus
aggagacagttgacccacttcagac

SEQ ID NO: 140832 - DNA, 25 bp, Rattus norvegicus
aggagacagttgtcccacttcagac

SEQ ID NO: 140833 - DNA, 25 bp, Rattus norvegicus
aggagacatggcaggcccttttgac

SEQ ID NO: 140834 - DNA, 25 bp, Rattus norvegicus
aggagacatggctggcccttttgac

SEQ ID NO: 140835 - DNA, 25 bp, Rattus norvegicus
aggagaccaaccacacaattgcact

SEQ ID NO: 140836 - DNA, 25 bp, Rattus norvegicus
aggagaccaacctcacaattgcact

SEQ ID NO: 140837 - DNA, 25 bp, Rattus norvegicus
aggagaccaagaactcaccctaccg

SEQ ID NO: 140838 - DNA, 25 bp, Rattus norvegicus
aggagaccaagatctcaccctaccg

SEQ ID NO: 140839 - DNA, 25 bp, Rattus norvegicus
aggagaccacgcagttgacttgatc

SEQ ID NO: 140840 - DNA, 25 bp, Rattus norvegicus
aggagaccacgctgttgacttgatc

SEQ ID NO: 140841 - DNA, 25 bp, Rattus norvegicus
aggagaccacgtccggttctcagag

SEQ ID NO: 140842 - DNA, 25 bp, Rattus norvegicus
aggagaccacgtgcggttctcagag

SEQ ID NO: 140843 - DNA, 25 bp, Rattus norvegicus
aggagaccagacacttgcttctgat

SEQ ID NO: 140844 - DNA, 25 bp, Rattus norvegicus
aggagaccagactcttgcttctgat

SEQ ID NO: 140845 - DNA, 25 bp, Rattus norvegicus
aggagaccagcacagtcagcacgtt

SEQ ID NO: 140846 - DNA, 25 bp, Rattus norvegicus
aggagaccagcagagtcagcacgtt

SEQ ID NO: 140847 - DNA, 25 bp, Rattus norvegicus
aggagaccataactgtttgcgcgca

SEQ ID NO: 140848 - DNA, 25 bp, Rattus norvegicus
aggagaccataagtgtttgcgcgca

SEQ ID NO: 140849 - DNA, 25 bp, Rattus norvegicus
aggagaccccaccagtcagagtgat

SEQ ID NO: 140850 - DNA, 25 bp, Rattus norvegicus
aggagaccccacgagtcagagtgat

SEQ ID NO: 140851 - DNA, 25 bp, Rattus norvegicus
aggagacccctgagaagtctggcga

SEQ ID NO: 140852 - DNA, 25 bp, Rattus norvegicus
aggagacccctgtgaagtctggcga

SEQ ID NO: 140853 - DNA, 25 bp, Rattus norvegicus
aggagaccctgtcctgtgatcatac

SEQ ID NO: 140854 - DNA, 25 bp, Rattus norvegicus
aggagaccctgtgctgtgatcatac

SEQ ID NO: 140855 - DNA, 25 bp, Rattus norvegicus
aggagacccttaatcactacacaga

SEQ ID NO: 140856 - DNA, 25 bp, Rattus norvegicus
aggagacccttattcactacacaga

SEQ ID NO: 140857 - DNA, 25 bp, Rattus norvegicus
aggagaccgatcagtctggaccgac

SEQ ID NO: 140858 - DNA, 25 bp, Rattus norvegicus
aggagaccgatctgtctggaccgac

SEQ ID NO: 140859 - DNA, 25 bp, Rattus norvegicus
aggagaccggaaccttctggaccag

SEQ ID NO: 140860 - DNA, 25 bp, Rattus norvegicus
aggagaccggaagcttctggaccag

SEQ ID NO: 140861 - DNA, 25 bp, Rattus norvegicus
aggagaccggatcactctctcagga

SEQ ID NO: 140862 - DNA, 25 bp, Rattus norvegicus
aggagaccggatgactctctcagga

SEQ ID NO: 140863 - DNA, 25 bp, Rattus norvegicus
aggagaccgggcatacttaccatgc

SEQ ID NO: 140864 - DNA, 25 bp, Rattus norvegicus
aggagaccgggcttacttaccatgc

SEQ ID NO: 140865 - DNA, 25 bp, Rattus norvegicus
aggagaccgtctccgtgtgtacctg

SEQ ID NO: 140866 - DNA, 25 bp, Rattus norvegicus
aggagaccgtctgcgtgtgtacctg

SEQ ID NO: 140867 - DNA, 25 bp, Rattus norvegicus
aggagacctctcatcaaagaactga

SEQ ID NO: 140868 - DNA, 25 bp, Rattus norvegicus
aggagacctctcttcaaagaactga

SEQ ID NO: 140869 - DNA, 25 bp, Rattus norvegicus
aggagacctgagaccttcttttaca

SEQ ID NO: 140870 - DNA, 25 bp, Rattus norvegicus
aggagacctgagtccttcttttaca

SEQ ID NO: 140871 - DNA, 25 bp, Rattus norvegicus
aggagacctgtgaacgccagaacga

SEQ ID NO: 140872 - DNA, 25 bp, Rattus norvegicus
aggagacctgtgtacgccagaacga

SEQ ID NO: 140873 - DNA, 25 bp, Rattus norvegicus
aggagaccttctcgcttgttggaaa

SEQ ID NO: 140874 - DNA, 25 bp, Rattus norvegicus
aggagaccttctggcttgttggaaa

SEQ ID NO: 140875 - DNA, 25 bp, Rattus norvegicus
aggagacgagacaagcaaccgctat

SEQ ID NO: 140876 - DNA, 25 bp, Rattus norvegicus
aggagacgagactagcaaccgctat

SEQ ID NO: 140877 - DNA, 25 bp, Rattus norvegicus
aggagacgatccaggcagcttgcct

SEQ ID NO: 140878 - DNA, 25 bp, Rattus norvegicus
aggagacgatcctggcagcttgcct

SEQ ID NO: 140879 - DNA, 25 bp, Rattus norvegicus
aggagacgccccaggtggactgtaa

SEQ ID NO: 140880 - DNA, 25 bp, Rattus norvegicus
aggagacgcccctggtggactgtaa

SEQ ID NO: 140881 - DNA, 25 bp, Rattus norvegicus
aggagacgctgcaatgctcaggatc

SEQ ID NO: 140882 - DNA, 25 bp, Rattus norvegicus
aggagacgctgctatgctcaggatc

SEQ ID NO: 140883 - DNA, 25 bp, Rattus norvegicus
aggagacgctggagacattctcgaa

SEQ ID NO: 140884 - DNA, 25 bp, Rattus norvegicus
aggagacgctggtgacattctcgaa

SEQ ID NO: 140885 - DNA, 25 bp, Rattus norvegicus
aggagacgctgtcgcgtattccttc

SEQ ID NO: 140886 - DNA, 25 bp, Rattus norvegicus
aggagacgctgtggcgtattccttc

SEQ ID NO: 140887 - DNA, 25 bp, Rattus norvegicus
aggagacggagaaccacccactttg

SEQ ID NO: 140888 - DNA, 25 bp, Rattus norvegicus
aggagacggagatccacccactttg

SEQ ID NO: 140889 - DNA, 25 bp, Rattus norvegicus
aggagacggctccagtgtcagtcct

SEQ ID NO: 140890 - DNA, 25 bp, Rattus norvegicus
aggagacggctcgagtgtcagtcct

SEQ ID NO: 140891 - DNA, 25 bp, Rattus norvegicus
aggagacgtacacccatttaattga

SEQ ID NO: 140892 - DNA, 25 bp, Rattus norvegicus
aggagacgtacagccatttaattga

SEQ ID NO: 140893 - DNA, 25 bp, Rattus norvegicus
aggagactaaccaggaggcctcttc

SEQ ID NO: 140894 - DNA, 25 bp, Rattus norvegicus
aggagactaacctggaggcctcttc

SEQ ID NO: 140895 - DNA, 25 bp, Rattus norvegicus
aggagactcagaccccttcagtaac

SEQ ID NO: 140896 - DNA, 25 bp, Rattus norvegicus
aggagactcagagcccttcagtaac

SEQ ID NO: 140897 - DNA, 25 bp, Rattus norvegicus
aggagactcagcatgtccatgtcta

SEQ ID NO: 140898 - DNA, 25 bp, Rattus norvegicus
aggagactcagcctccagagacagt

SEQ ID NO: 140899 - DNA, 25 bp, Rattus norvegicus
aggagactcagcgtccagagacagt

SEQ ID NO: 140900 - DNA, 25 bp, Rattus norvegicus
aggagactcagcttgtccatgtcta

SEQ ID NO: 140901 - DNA, 25 bp, Rattus norvegicus
aggagactccatacagccgaggact

SEQ ID NO: 140902 - DNA, 25 bp, Rattus norvegicus
aggagactccattcagccgaggact

SEQ ID NO: 140903 - DNA, 25 bp, Rattus norvegicus
aggagactcccaaagccttgcagag

SEQ ID NO: 140904 - DNA, 25 bp, Rattus norvegicus
aggagactcccatagccttgcagag

SEQ ID NO: 140905 - DNA, 25 bp, Rattus norvegicus
aggagactcgacaaggaccgcacag

SEQ ID NO: 140906 - DNA, 25 bp, Rattus norvegicus
aggagactcgactaggaccgcacag

SEQ ID NO: 140907 - DNA, 25 bp, Rattus norvegicus
aggagactcgatctgggcctcagct

SEQ ID NO: 140908 - DNA, 25 bp, Rattus norvegicus
aggagactcgatgtgggcctcagct

SEQ ID NO: 140909 - DNA, 25 bp, Rattus norvegicus
aggagactcgtcagtggacacttgt

SEQ ID NO: 140910 - DNA, 25 bp, Rattus norvegicus
aggagactcgtctgtggacacttgt

SEQ ID NO: 140911 - DNA, 25 bp, Rattus norvegicus
aggagactctacctcaacactcctg

SEQ ID NO: 140912 - DNA, 25 bp, Rattus norvegicus
aggagactctacgtcaacactcctg

SEQ ID NO: 140913 - DNA, 25 bp, Rattus norvegicus
aggagactctcccttctttggggtg

SEQ ID NO: 140914 - DNA, 25 bp, Rattus norvegicus
aggagactctccgttctttggggtg

SEQ ID NO: 140915 - DNA, 25 bp, Rattus norvegicus
aggagactctgtaccggaagctcag

SEQ ID NO: 140916 - DNA, 25 bp, Rattus norvegicus
aggagactctgtcacctggaacgtc

SEQ ID NO: 140917 - DNA, 25 bp, Rattus norvegicus
aggagactctgtgacctggaacgtc

SEQ ID NO: 140918 - DNA, 25 bp, Rattus norvegicus
aggagactctgttccggaagctcag

SEQ ID NO: 140919 - DNA, 25 bp, Rattus norvegicus
aggagactgagcactactgtggcct

SEQ ID NO: 140920 - DNA, 25 bp, Rattus norvegicus
aggagactgagccaagtgccttccc

SEQ ID NO: 140921 - DNA, 25 bp, Rattus norvegicus
aggagactgagcgaagtgccttccc

SEQ ID NO: 140922 - DNA, 25 bp, Rattus norvegicus
aggagactgagctctactgtggcct

SEQ ID NO: 140923 - DNA, 25 bp, Rattus norvegicus
aggagactgcctacctctggaggtt

SEQ ID NO: 140924 - DNA, 25 bp, Rattus norvegicus
aggagactgccttcctctggaggtt

SEQ ID NO: 140925 - DNA, 25 bp, Rattus norvegicus
aggagactgcttctctgactcgtgg

SEQ ID NO: 140926 - DNA, 25 bp, Rattus norvegicus
aggagactgcttgtctgactcgtgg

SEQ ID NO: 140927 - DNA, 25 bp, Rattus norvegicus
aggagactggctcaagctctgccca

SEQ ID NO: 140928 - DNA, 25 bp, Rattus norvegicus
aggagactggctgaagctctgccca

SEQ ID NO: 140929 - DNA, 25 bp, Rattus norvegicus
aggagactgttaatagctgggaagc

SEQ ID NO: 140930 - DNA, 25 bp, Rattus norvegicus
aggagactgttattagctgggaagc

SEQ ID NO: 140931 - DNA, 25 bp, Rattus norvegicus
aggagagaaaagcatctgtccatca

SEQ ID NO: 140932 - DNA, 25 bp, Rattus norvegicus
aggagagaaaaggatctgtccatca

SEQ ID NO: 140933 - DNA, 25 bp, Rattus norvegicus
aggagagacatcagttggtccagga

SEQ ID NO: 140934 - DNA, 25 bp, Rattus norvegicus
aggagagacatctgttggtccagga

SEQ ID NO: 140935 - DNA, 25 bp, Rattus norvegicus
aggagagaccagctctcacccgctg

SEQ ID NO: 140936 - DNA, 25 bp, Rattus norvegicus
aggagagaccaggtctcacccgctg

SEQ ID NO: 140937 - DNA, 25 bp, Rattus norvegicus
aggagagaccccagggttaccatca

SEQ ID NO: 140938 - DNA, 25 bp, Rattus norvegicus
aggagagacccctgggttaccatca

SEQ ID NO: 140939 - DNA, 25 bp, Rattus norvegicus
aggagagaccttccagtagcctcac

SEQ ID NO: 140940 - DNA, 25 bp, Rattus norvegicus
aggagagaccttgcagtagcctcac

SEQ ID NO: 140941 - DNA, 25 bp, Rattus norvegicus
aggagagactttaaacactggaatc

SEQ ID NO: 140942 - DNA, 25 bp, Rattus norvegicus
aggagagacttttaacactggaatc

SEQ ID NO: 140943 - DNA, 25 bp, Rattus norvegicus
aggagagagctcactccaggctgta

SEQ ID NO: 140944 - DNA, 25 bp, Rattus norvegicus
aggagagagctctctccaggctgta

SEQ ID NO: 140945 - DNA, 25 bp, Rattus norvegicus
aggagagagtgccaactccagcctg

SEQ ID NO: 140946 - DNA, 25 bp, Rattus norvegicus
aggagagagtgcgaactccagcctg

SEQ ID NO: 140947 - DNA, 25 bp, Rattus norvegicus
aggagagagttcactcccactggac

SEQ ID NO: 140948 - DNA, 25 bp, Rattus norvegicus
aggagagagttctctcccactggac

SEQ ID NO: 140949 - DNA, 25 bp, Rattus norvegicus
aggagagatcacaaacccagtcttt

SEQ ID NO: 140950 - DNA, 25 bp, Rattus norvegicus
aggagagatcacaccccaataggga

SEQ ID NO: 140951 - DNA, 25 bp, Rattus norvegicus
aggagagatcactaacccagtcttt

SEQ ID NO: 140952 - DNA, 25 bp, Rattus norvegicus
aggagagatcactccccaataggga

SEQ ID NO: 140953 - DNA, 25 bp, Rattus norvegicus
aggagagatctcaatcggctgacat

SEQ ID NO: 140954 - DNA, 25 bp, Rattus norvegicus
aggagagatctctatcggctgacat

SEQ ID NO: 140955 - DNA, 25 bp, Rattus norvegicus
aggagagatgcacctgcctaggtct

SEQ ID NO: 140956 - DNA, 25 bp, Rattus norvegicus
aggagagatgcagctgcctaggtct

SEQ ID NO: 140957 - DNA, 25 bp, Rattus norvegicus
aggagagattttactatcatgtaga

SEQ ID NO: 140958 - DNA, 25 bp, Rattus norvegicus
aggagagatttttctatcatgtaga

SEQ ID NO: 140959 - DNA, 25 bp, Rattus norvegicus
aggagagcaaggcccgatgcggcag

SEQ ID NO: 140960 - DNA, 25 bp, Rattus norvegicus
aggagagcaagggccgatgcggcag

SEQ ID NO: 140961 - DNA, 25 bp, Rattus norvegicus
aggagagcacccagtggctgacgtc

SEQ ID NO: 140962 - DNA, 25 bp, Rattus norvegicus
aggagagcaccctgtggctgacgtc

SEQ ID NO: 140963 - DNA, 25 bp, Rattus norvegicus
aggagagcacggaagctgcccctgc

SEQ ID NO: 140964 - DNA, 25 bp, Rattus norvegicus
aggagagcacggtagctgcccctgc

SEQ ID NO: 140965 - DNA, 25 bp, Rattus norvegicus
aggagagcagcaatgataacttgat

SEQ ID NO: 140966 - DNA, 25 bp, Rattus norvegicus
aggagagcagcattgataacttgat

SEQ ID NO: 140967 - DNA, 25 bp, Rattus norvegicus
aggagagcaggtatggcgcttttct

SEQ ID NO: 140968 - DNA, 25 bp, Rattus norvegicus
aggagagcaggtttggcgcttttct

SEQ ID NO: 140969 - DNA, 25 bp, Rattus norvegicus
aggagagcatctagttccagaccca

SEQ ID NO: 140970 - DNA, 25 bp, Rattus norvegicus
aggagagcatcttgttccagaccca

SEQ ID NO: 140971 - DNA, 25 bp, Rattus norvegicus
aggagagcatgtaccacgccttggg

SEQ ID NO: 140972 - DNA, 25 bp, Rattus norvegicus
aggagagcatgttccacgccttggg

SEQ ID NO: 140973 - DNA, 25 bp, Rattus norvegicus
aggagagccacaatcatccgcgtga

SEQ ID NO: 140974 - DNA, 25 bp, Rattus norvegicus
aggagagccacattcatccgcgtga

SEQ ID NO: 140975 - DNA, 25 bp, Rattus norvegicus
aggagagccactagctgacagtgct

SEQ ID NO: 140976 - DNA, 25 bp, Rattus norvegicus
aggagagccacttgctgacagtgct

SEQ ID NO: 140977 - DNA, 25 bp, Rattus norvegicus
aggagagccatcaacaagccgccgg

SEQ ID NO: 140978 - DNA, 25 bp, Rattus norvegicus
aggagagccatctacaagccgccgg

SEQ ID NO: 140979 - DNA, 25 bp, Rattus norvegicus
aggagagcccaactccaggcttgta

SEQ ID NO: 140980 - DNA, 25 bp, Rattus norvegicus
aggagagcccaagtccaggcttgta

SEQ ID NO: 140981 - DNA, 25 bp, Rattus norvegicus
aggagagccctcaaatatgccaaat

SEQ ID NO: 140982 - DNA, 25 bp, Rattus norvegicus
aggagagccctcacatgtctgttgg

SEQ ID NO: 140983 - DNA, 25 bp, Rattus norvegicus
aggagagccctctaatatgccaaat

SEQ ID NO: 140984 - DNA, 25 bp, Rattus norvegicus
aggagagccctctcatgtctgttgg

SEQ ID NO: 140985 - DNA, 25 bp, Rattus norvegicus
aggagagcccttcacaaaagacaga

SEQ ID NO: 140986 - DNA, 25 bp, Rattus norvegicus
aggagagcccttgacaaaagacaga

SEQ ID NO: 140987 - DNA, 25 bp, Rattus norvegicus
aggagagcctccatacctcaatgaa

SEQ ID NO: 140988 - DNA, 25 bp, Rattus norvegicus
aggagagcctccttacctcaatgaa

SEQ ID NO: 140989 - DNA, 25 bp, Rattus norvegicus
aggagagccttcaaattccccataa

SEQ ID NO: 140990 - DNA, 25 bp, Rattus norvegicus
aggagagccttctaattccccataa

SEQ ID NO: 140991 - DNA, 25 bp, Rattus norvegicus
aggagagcgaccacatccacatcat

SEQ ID NO: 140992 - DNA, 25 bp, Rattus norvegicus
aggagagcgacctcatccacatcat

SEQ ID NO: 140993 - DNA, 25 bp, Rattus norvegicus
aggagagcgtcactcagaggatgag

SEQ ID NO: 140994 - DNA, 25 bp, Rattus norvegicus
aggagagcgtcagtcagaggatgag

SEQ ID NO: 140995 - DNA, 25 bp, Rattus norvegicus
aggagagctaccacaccacggcata

SEQ ID NO: 140996 - DNA, 25 bp, Rattus norvegicus
aggagagctacctcaccacggcata

SEQ ID NO: 140997 - DNA, 25 bp, Rattus norvegicus
aggagagctacgagctgcgctactt

SEQ ID NO: 140998 - DNA, 25 bp, Rattus norvegicus
aggagagctacgtgctgcgctactt

SEQ ID NO: 140999 - DNA, 25 bp, Rattus norvegicus
aggagagctcacagtaacaccgcgt

SEQ ID NO: 141000 - DNA, 25 bp, Rattus norvegicus
aggagagctcactgtaacaccgcgt

SEQ ID NO: 141001 - DNA, 25 bp, Rattus norvegicus
aggagagctcagagtgccattccca

SEQ ID NO: 141002 - DNA, 25 bp, Rattus norvegicus
aggagagctcagtgtgccattccca

SEQ ID NO: 141003 - DNA, 25 bp, Rattus norvegicus
aggagagctcctcgcaaccacaagg

SEQ ID NO: 141004 - DNA, 25 bp, Rattus norvegicus
aggagagctcctggcaaccacaagg

SEQ ID NO: 141005 - DNA, 25 bp, Rattus norvegicus
aggagagctgaaactttccttccct

SEQ ID NO: 141006 - DNA, 25 bp, Rattus norvegicus
aggagagctgaatctttccttccct

SEQ ID NO: 141007 - DNA, 25 bp, Rattus norvegicus
aggagagctgaccagctcactacca

SEQ ID NO: 141008 - DNA, 25 bp, Rattus norvegicus
aggagagctgacgagctcactacca

SEQ ID NO: 141009 - DNA, 25 bp, Rattus norvegicus
aggagagctgctacgagaggatcat

SEQ ID NO: 141010 - DNA, 25 bp, Rattus norvegicus
aggagagctgctcgcatagcatcgc

SEQ ID NO: 141011 - DNA, 25 bp, Rattus norvegicus
aggagagctgctggcatagcatcgc

SEQ ID NO: 141012 - DNA, 25 bp, Rattus norvegicus
aggagagctgcttcgagaggatcat

SEQ ID NO: 141013 - DNA, 25 bp, Rattus norvegicus
aggagagcttacactcctcttcaga

SEQ ID NO: 141014 - DNA, 25 bp, Rattus norvegicus
aggagagcttactctcctcttcaga

SEQ ID NO: 141015 - DNA, 25 bp, Rattus norvegicus
aggagaggactaccccactatcaga

SEQ ID NO: 141016 - DNA, 25 bp, Rattus norvegicus
aggagaggactagcccactatcaga

SEQ ID NO: 141017 - DNA, 25 bp, Rattus norvegicus
aggagaggactcatctgcttccttt

SEQ ID NO: 141018 - DNA, 25 bp, Rattus norvegicus
aggagaggactcttctgcttccttt

SEQ ID NO: 141019 - DNA, 25 bp, Rattus norvegicus
aggagaggaggtctgactcttcaca

SEQ ID NO: 141020 - DNA, 25 bp, Rattus norvegicus
aggagaggaggtgtgactcttcaca

SEQ ID NO: 141021 - DNA, 25 bp, Rattus norvegicus
aggagaggatctctgaccctttcca

SEQ ID NO: 141022 - DNA, 25 bp, Rattus norvegicus
aggagaggatctgtgaccctttcca

SEQ ID NO: 141023 - DNA, 25 bp, Rattus norvegicus
aggagaggcacaagcaccatcacca

SEQ ID NO: 141024 - DNA, 25 bp, Rattus norvegicus
aggagaggcacatgcaccatcacca

SEQ ID NO: 141025 - DNA, 25 bp, Rattus norvegicus
aggagaggccaaaccgcaggagtct

SEQ ID NO: 141026 - DNA, 25 bp, Rattus norvegicus
aggagaggccaatccgcaggagtct

SEQ ID NO: 141027 - DNA, 25 bp, Rattus norvegicus
aggagaggccaccagactcaacctg

SEQ ID NO: 141028 - DNA, 25 bp, Rattus norvegicus
aggagaggccacgagactcaacctg

SEQ ID NO: 141029 - DNA, 25 bp, Rattus norvegicus
aggagaggccagaatgtcctgccca

SEQ ID NO: 141030 - DNA, 25 bp, Rattus norvegicus
aggagaggccagtatgtcctgccca

SEQ ID NO: 141031 - DNA, 25 bp, Rattus norvegicus
aggagaggccatacgaccgtcagtt

SEQ ID NO: 141032 - DNA, 25 bp, Rattus norvegicus
aggagaggccattcgaccgtcagtt

SEQ ID NO: 141033 - DNA, 25 bp, Rattus norvegicus
aggagaggccctctttgcatctgac

SEQ ID NO: 141034 - DNA, 25 bp, Rattus norvegicus
aggagaggccctgtttgcatctgac

SEQ ID NO: 141035 - DNA, 25 bp, Rattus norvegicus
aggagaggccttagtctctctccag

SEQ ID NO: 141036 - DNA, 25 bp, Rattus norvegicus
aggagaggcctttgtctctctccag

SEQ ID NO: 141037 - DNA, 25 bp, Rattus norvegicus
aggagaggcgtcagacacttgcgct

SEQ ID NO: 141038 - DNA, 25 bp, Rattus norvegicus
aggagaggcgtctgacacttgcgct

SEQ ID NO: 141039 - DNA, 25 bp, Rattus norvegicus
aggagaggcttcatgagcccttggc

SEQ ID NO: 141040 - DNA, 25 bp, Rattus norvegicus
aggagaggcttcttgagcccttggc

SEQ ID NO: 141041 - DNA, 25 bp, Rattus norvegicus
aggagagggcagaaccctgccccaa

SEQ ID NO: 141042 - DNA, 25 bp, Rattus norvegicus
aggagagggcagtaccctgccccaa

SEQ ID NO: 141043 - DNA, 25 bp, Rattus norvegicus
aggagagggctcatgtattactgtg

SEQ ID NO: 141044 - DNA, 25 bp, Rattus norvegicus
aggagagggctcttgtattactgtg

SEQ ID NO: 141045 - DNA, 25 bp, Rattus norvegicus
aggagaggtctgaccaggttcatac

SEQ ID NO: 141046 - DNA, 25 bp, Rattus norvegicus
aggagaggtctgtccaggttcatac

SEQ ID NO: 141047 - DNA, 25 bp, Rattus norvegicus
aggagaggtgcacttgccatccgca

SEQ ID NO: 141048 - DNA, 25 bp, Rattus norvegicus
aggagaggtgcagttgccatccgca

SEQ ID NO: 141049 - DNA, 25 bp, Rattus norvegicus
aggagagtaggcactctagccaccc

SEQ ID NO: 141050 - DNA, 25 bp, Rattus norvegicus
aggagagtaggctctctagccaccc

SEQ ID NO: 141051 - DNA, 25 bp, Rattus norvegicus
aggagagtcagccaatgggcaaata

SEQ ID NO: 141052 - DNA, 25 bp, Rattus norvegicus
aggagagtcagcgaatgggcaaata

SEQ ID NO: 141053 - DNA, 25 bp, Rattus norvegicus
aggagagtcccgcatgctttgcaat

SEQ ID NO: 141054 - DNA, 25 bp, Rattus norvegicus
aggagagtcccggatgctttgcaat

SEQ ID NO: 141055 - DNA, 25 bp, Rattus norvegicus
aggagagtcggaagccgcgtcccct

SEQ ID NO: 141056 - DNA, 25 bp, Rattus norvegicus
aggagagtcggatgccgcgtcccct

SEQ ID NO: 141057 - DNA, 25 bp, Rattus norvegicus
aggagagtctccaggactccggaac

SEQ ID NO: 141058 - DNA, 25 bp, Rattus norvegicus
aggagagtctcctggactccggaac

SEQ ID NO: 141059 - DNA, 25 bp, Rattus norvegicus
aggagagtgcctactgaatgcttaa

SEQ ID NO: 141060 - DNA, 25 bp, Rattus norvegicus
aggagagtgccttctgaatgcttaa

SEQ ID NO: 141061 - DNA, 25 bp, Rattus norvegicus
aggagagtgctgcttctctgcactc

SEQ ID NO: 141062 - DNA, 25 bp, Rattus norvegicus
aggagagtgctggttctctgcactc

SEQ ID NO: 141063 - DNA, 25 bp, Rattus norvegicus
aggagagttggcaccatcctgcctt

SEQ ID NO: 141064 - DNA, 25 bp, Rattus norvegicus
aggagagttggctccatcctgcctt

SEQ ID NO: 141065 - DNA, 25 bp, Rattus norvegicus
aggagagtttctactgcaagtgaca

SEQ ID NO: 141066 - DNA, 25 bp, Rattus norvegicus
aggagagtttcttctgcaagtgaca

SEQ ID NO: 141067 - DNA, 25 bp, Rattus norvegicus
aggagagttttcctagtagcactag

SEQ ID NO: 141068 - DNA, 25 bp, Rattus norvegicus
aggagagttttcgtagtagcactag

SEQ ID NO: 141069 - DNA, 25 bp, Rattus norvegicus
aggagataattcatcctccccaagc

SEQ ID NO: 141070 - DNA, 25 bp, Rattus norvegicus
aggagataattcttcctccccaagc

SEQ ID NO: 141071 - DNA, 25 bp, Rattus norvegicus
aggagataatttaagccttggcttt

SEQ ID NO: 141072 - DNA, 25 bp, Rattus norvegicus
aggagataattttagccttggcttt

SEQ ID NO: 141073 - DNA, 25 bp, Rattus norvegicus
aggagatagagtacctcccggctgc

SEQ ID NO: 141074 - DNA, 25 bp, Rattus norvegicus
aggagatagagttcctcccggctgc

SEQ ID NO: 141075 - DNA, 25 bp, Rattus norvegicus
aggagatcatccaattcccagggag

SEQ ID NO: 141076 - DNA, 25 bp, Rattus norvegicus
aggagatcatcctattcccagggag

SEQ ID NO: 141077 - DNA, 25 bp, Rattus norvegicus
aggagatcatgaacaccgagcgagt

SEQ ID NO: 141078 - DNA, 25 bp, Rattus norvegicus
aggagatcatgatcaccgagcgagt

SEQ ID NO: 141079 - DNA, 25 bp, Rattus norvegicus
aggagatccagcctgccttgtggct

SEQ ID NO: 141080 - DNA, 25 bp, Rattus norvegicus
aggagatccagcgtgccttgtggct

SEQ ID NO: 141081 - DNA, 25 bp, Rattus norvegicus
aggagatccctcctttcagctgtgt

SEQ ID NO: 141082 - DNA, 25 bp, Rattus norvegicus
aggagatccctcgtttcagctgtgt

SEQ ID NO: 141083 - DNA, 25 bp, Rattus norvegicus
aggagatccgcaaggctatgaccaa

SEQ ID NO: 141084 - DNA, 25 bp, Rattus norvegicus
aggagatccgcatggctatgaccaa

SEQ ID NO: 141085 - DNA, 25 bp, Rattus norvegicus
aggagatcctgacagcactgggctt

SEQ ID NO: 141086 - DNA, 25 bp, Rattus norvegicus
aggagatcctgagagcactgggctt

SEQ ID NO: 141087 - DNA, 25 bp, Rattus norvegicus
aggagatcgatccttctcttggaca

SEQ ID NO: 141088 - DNA, 25 bp, Rattus norvegicus
aggagatcgatcgttctcttggaca

SEQ ID NO: 141089 - DNA, 25 bp, Rattus norvegicus
aggagatcgtcactagtcagtgcta

SEQ ID NO: 141090 - DNA, 25 bp, Rattus norvegicus
aggagatcgtcagtagtcagtgcta

SEQ ID NO: 141091 - DNA, 25 bp, Rattus norvegicus
aggagatcgtggacttcgccaagca

SEQ ID NO: 141092 - DNA, 25 bp, Rattus norvegicus
aggagatcgtggtcttcgccaagca

SEQ ID NO: 141093 - DNA, 25 bp, Rattus norvegicus
aggagatctcccagttaatagccga

SEQ ID NO: 141094 - DNA, 25 bp, Rattus norvegicus
aggagatctccctgttaatagccga

SEQ ID NO: 141095 - DNA, 25 bp, Rattus norvegicus
aggagatctcctcgctggcagacag

SEQ ID NO: 141096 - DNA, 25 bp, Rattus norvegicus
aggagatctcctggctggcagacag

SEQ ID NO: 141097 - DNA, 25 bp, Rattus norvegicus
aggagatctcgcagattcacttctt

SEQ ID NO: 141098 - DNA, 25 bp, Rattus norvegicus
aggagatctcgctgattcacttctt

SEQ ID NO: 141099 - DNA, 25 bp, Rattus norvegicus
aggagatctcttaatcgattccctc

SEQ ID NO: 141100 - DNA, 25 bp, Rattus norvegicus
aggagatctctttatcgattccctc

SEQ ID NO: 141101 - DNA, 25 bp, Rattus norvegicus
aggagatctgacaccctaaagcagt

SEQ ID NO: 141102 - DNA, 25 bp, Rattus norvegicus
aggagatctgactccctaaagcagt

SEQ ID NO: 141103 - DNA, 25 bp, Rattus norvegicus
aggagatctggtcaacatggaagca

SEQ ID NO: 141104 - DNA, 25 bp, Rattus norvegicus
aggagatctggtgaacatggaagca

SEQ ID NO: 141105 - DNA, 25 bp, Rattus norvegicus
aggagatcttccaaagttgtatttt

SEQ ID NO: 141106 - DNA, 25 bp, Rattus norvegicus
aggagatcttcctaagttgtatttt

SEQ ID NO: 141107 - DNA, 25 bp, Rattus norvegicus
aggagatcttctacaggaggtcatg

SEQ ID NO: 141108 - DNA, 25 bp, Rattus norvegicus
aggagatcttcttcaggaggtcatg

SEQ ID NO: 141109 - DNA, 25 bp, Rattus norvegicus
aggagatcttggagctgaccctgag

SEQ ID NO: 141110 - DNA, 25 bp, Rattus norvegicus
aggagatcttggtgctgaccctgag

SEQ ID NO: 141111 - DNA, 25 bp, Rattus norvegicus
aggagatgaccaaggccatgcctac

SEQ ID NO: 141112 - DNA, 25 bp, Rattus norvegicus
aggagatgaccatggccatgcctac

SEQ ID NO: 141113 - DNA, 25 bp, Rattus norvegicus
aggagatgcagcaggtggtacacct

SEQ ID NO: 141114 - DNA, 25 bp, Rattus norvegicus
aggagatgcagctggtggtacacct

SEQ ID NO: 141115 - DNA, 25 bp, Rattus norvegicus
aggagatgccctatgatgagatttg

SEQ ID NO: 141116 - DNA, 25 bp, Rattus norvegicus
aggagatgccctttgatgagatttg

SEQ ID NO: 141117 - DNA, 25 bp, Rattus norvegicus
aggagatgcgcgaccacgggcattc

SEQ ID NO: 141118 - DNA, 25 bp, Rattus norvegicus
aggagatgcgcgtccacgggcattc

SEQ ID NO: 141119 - DNA, 25 bp, Rattus norvegicus
aggagatgctcacacaccatagtct

SEQ ID NO: 141120 - DNA, 25 bp, Rattus norvegicus
aggagatgctcagacaccatagtct

SEQ ID NO: 141121 - DNA, 25 bp, Rattus norvegicus
aggagatggactctctcagtctctg

SEQ ID NO: 141122 - DNA, 25 bp, Rattus norvegicus
aggagatggactgtctcagtctctg

SEQ ID NO: 141123 - DNA, 25 bp, Rattus norvegicus
aggagatggtctactttctcttctc

SEQ ID NO: 141124 - DNA, 25 bp, Rattus norvegicus
aggagatggtcttctttctcttctc

SEQ ID NO: 141125 - DNA, 25 bp, Rattus norvegicus
aggagatgtaggatggagcccacta

SEQ ID NO: 141126 - DNA, 25 bp, Rattus norvegicus
aggagatgtaggttggagcccacta

SEQ ID NO: 141127 - DNA, 25 bp, Rattus norvegicus
aggagatgtatactcctggccccac

SEQ ID NO: 141128 - DNA, 25 bp, Rattus norvegicus
aggagatgtatagtcctggccccac

SEQ ID NO: 141129 - DNA, 25 bp, Rattus norvegicus
aggagatgtcaccaaccaggcaact

SEQ ID NO: 141130 - DNA, 25 bp, Rattus norvegicus
aggagatgtcacgaaccaggcaact

SEQ ID NO: 141131 - DNA, 25 bp, Rattus norvegicus
aggagattcctgaattctgagttaa

SEQ ID NO: 141132 - DNA, 25 bp, Rattus norvegicus
aggagattcctgtattctgagttaa

SEQ ID NO: 141133 - DNA, 25 bp, Rattus norvegicus
aggagattctgccagccagccctga

SEQ ID NO: 141134 - DNA, 25 bp, Rattus norvegicus
aggagattctgcgagccagccctga

SEQ ID NO: 141135 - DNA, 25 bp, Rattus norvegicus
aggagattctggctttgctctggtt

SEQ ID NO: 141136 - DNA, 25 bp, Rattus norvegicus
aggagattctgggtttgctctggtt

SEQ ID NO: 141137 - DNA, 25 bp, Rattus norvegicus
aggagattgagtcccatgtgccaca

SEQ ID NO: 141138 - DNA, 25 bp, Rattus norvegicus
aggagattgagtgccatgtgccaca

SEQ ID NO: 141139 - DNA, 25 bp, Rattus norvegicus
aggagattgccgaggcctacgacgt

SEQ ID NO: 141140 - DNA, 25 bp, Rattus norvegicus
aggagattgccgtggcctacgacgt

SEQ ID NO: 141141 - DNA, 25 bp, Rattus norvegicus
aggagattggatcctgccttcactc

SEQ ID NO: 141142 - DNA, 25 bp, Rattus norvegicus
aggagattggatgctgccttcactc

SEQ ID NO: 141143 - DNA, 25 bp, Rattus norvegicus
aggagattggctattcttcactcag

SEQ ID NO: 141144 - DNA, 25 bp, Rattus norvegicus
aggagattggcttttcttcactcag

SEQ ID NO: 141145 - DNA, 25 bp, Rattus norvegicus
aggagattggtcatggctttcactt

SEQ ID NO: 141146 - DNA, 25 bp, Rattus norvegicus
aggagattggtcttggctttcactt

SEQ ID NO: 141147 - DNA, 25 bp, Rattus norvegicus
aggagattgtttccccagagtttca

SEQ ID NO: 141148 - DNA, 25 bp, Rattus norvegicus
aggagattgtttgcccagagtttca

SEQ ID NO: 141149 - DNA, 25 bp, Rattus norvegicus
aggagatttactcgcagttcttccc

SEQ ID NO: 141150 - DNA, 25 bp, Rattus norvegicus
aggagatttactggcagttcttccc

SEQ ID NO: 141151 - DNA, 25 bp, Rattus norvegicus
aggagatttccaccacatctagggt

SEQ ID NO: 141152 - DNA, 25 bp, Rattus norvegicus
aggagatttccagcacatctagggt

SEQ ID NO: 141153 - DNA, 25 bp, Rattus norvegicus
aggagatttctgagttatacataac

SEQ ID NO: 141154 - DNA, 25 bp, Rattus norvegicus
aggagatttctgtgttatacataac

SEQ ID NO: 141155 - DNA, 25 bp, Rattus norvegicus
aggagatttgctcccagcttgtgcc

SEQ ID NO: 141156 - DNA, 25 bp, Rattus norvegicus
aggagatttgctgccagcttgtgcc

SEQ ID NO: 141157 - DNA, 25 bp, Rattus norvegicus
aggagcaaacgtcccgatgtagcca

SEQ ID NO: 141158 - DNA, 25 bp, Rattus norvegicus
aggagcaaacgtgccgatgtagcca

SEQ ID NO: 141159 - DNA, 25 bp, Rattus norvegicus
aggagcaaatgtagcccggaggatt

SEQ ID NO: 141160 - DNA, 25 bp, Rattus norvegicus
aggagcaaatgttgcccggaggatt

SEQ ID NO: 141161 - DNA, 25 bp, Rattus norvegicus
aggagcaacagcacactcggaagct

SEQ ID NO: 141162 - DNA, 25 bp, Rattus norvegicus
aggagcaacagctcactcggaagct

SEQ ID NO: 141163 - DNA, 25 bp, Rattus norvegicus
aggagcaacaggctgaccccatgcc

SEQ ID NO: 141164 - DNA, 25 bp, Rattus norvegicus
aggagcaacagggtgaccccatgcc

SEQ ID NO: 141165 - DNA, 25 bp, Rattus norvegicus
aggagcaacatgagcccgttgccga

SEQ ID NO: 141166 - DNA, 25 bp, Rattus norvegicus
aggagcaacatgtgcccgttgccga

SEQ ID NO: 141167 - DNA, 25 bp, Rattus norvegicus
aggagcaacgacaccttgggcagac

SEQ ID NO: 141168 - DNA, 25 bp, Rattus norvegicus
aggagcaacgactccttgggcagac

SEQ ID NO: 141169 - DNA, 25 bp, Rattus norvegicus
aggagcaacgtgagacatttgtgac

SEQ ID NO: 141170 - DNA, 25 bp, Rattus norvegicus
aggagcaacgtgtgacatttgtgac

SEQ ID NO: 141171 - DNA, 25 bp, Rattus norvegicus
aggagcaagcacacgattggttgtc

SEQ ID NO: 141172 - DNA, 25 bp, Rattus norvegicus
aggagcaagcactcgattggttgtc

SEQ ID NO: 141173 - DNA, 25 bp, Rattus norvegicus
aggagcaagcagacctctgtgagtt

SEQ ID NO: 141174 - DNA, 25 bp, Rattus norvegicus
aggagcaagcagtcctctgtgagtt

SEQ ID NO: 141175 - DNA, 25 bp, Rattus norvegicus
aggagcaatgagacgcccgagacag

SEQ ID NO: 141176 - DNA, 25 bp, Rattus norvegicus
aggagcaatgagtcgcccgagacag

SEQ ID NO: 141177 - DNA, 25 bp, Rattus norvegicus
aggagcaattgtagccccttccagg

SEQ ID NO: 141178 - DNA, 25 bp, Rattus norvegicus
aggagcaattgttgccccttccagg

SEQ ID NO: 141179 - DNA, 25 bp, Rattus norvegicus
aggagcacacacagggctctgtagt

SEQ ID NO: 141180 - DNA, 25 bp, Rattus norvegicus
aggagcacacactgggctctgtagt

SEQ ID NO: 141181 - DNA, 25 bp, Rattus norvegicus
aggagcacaccacggtggtctccta

SEQ ID NO: 141182 - DNA, 25 bp, Rattus norvegicus
aggagcacaccagggtggtctccta

SEQ ID NO: 141183 - DNA, 25 bp, Rattus norvegicus
aggagcaccaccagttgcatgggtc

SEQ ID NO: 141184 - DNA, 25 bp, Rattus norvegicus
aggagcaccacctgttgcatgggtc

SEQ ID NO: 141185 - DNA, 25 bp, Rattus norvegicus
aggagcaccctgagctgctcaccga

SEQ ID NO: 141186 - DNA, 25 bp, Rattus norvegicus
aggagcaccctgtgctgctcaccga

SEQ ID NO: 141187 - DNA, 25 bp, Rattus norvegicus
aggagcacctgcatccgagagcatg

SEQ ID NO: 141188 - DNA, 25 bp, Rattus norvegicus
aggagcacctgccacactgtggatg

SEQ ID NO: 141189 - DNA, 25 bp, Rattus norvegicus
aggagcacctgcctatggcgttgta

SEQ ID NO: 141190 - DNA, 25 bp, Rattus norvegicus
aggagcacctgcgacactgtggatg

SEQ ID NO: 141191 - DNA, 25 bp, Rattus norvegicus
aggagcacctgcgtatggcgttgta

SEQ ID NO: 141192 - DNA, 25 bp, Rattus norvegicus
aggagcacctgcttccgagagcatg

SEQ ID NO: 141193 - DNA, 25 bp, Rattus norvegicus
aggagcacgcacatgcagacactta

SEQ ID NO: 141194 - DNA, 25 bp, Rattus norvegicus
aggagcacgcacttgcagacactta

SEQ ID NO: 141195 - DNA, 25 bp, Rattus norvegicus
aggagcacgtcgaggtcccgcactg

SEQ ID NO: 141196 - DNA, 25 bp, Rattus norvegicus
aggagcacgtcgtggtcccgcactg

SEQ ID NO: 141197 - DNA, 25 bp, Rattus norvegicus
aggagcactacaactgtcgcaggat

SEQ ID NO: 141198 - DNA, 25 bp, Rattus norvegicus
aggagcactacatctgtcgcaggat

SEQ ID NO: 141199 - DNA, 25 bp, Rattus norvegicus
aggagcactcatagctctcacagag

SEQ ID NO: 141200 - DNA, 25 bp, Rattus norvegicus
aggagcactcattgctctcacagag

SEQ ID NO: 141201 - DNA, 25 bp, Rattus norvegicus
aggagcacttccaggagggcttgca

SEQ ID NO: 141202 - DNA, 25 bp, Rattus norvegicus
aggagcacttcctggagggcttgca

SEQ ID NO: 141203 - DNA, 25 bp, Rattus norvegicus
aggagcacttgaactttttccagag

SEQ ID NO: 141204 - DNA, 25 bp, Rattus norvegicus
aggagcacttgatctttttccagag

SEQ ID NO: 141205 - DNA, 25 bp, Rattus norvegicus
aggagcacttttatctggagacaac

SEQ ID NO: 141206 - DNA, 25 bp, Rattus norvegicus
aggagcacttttttctggagacaac

SEQ ID NO: 141207 - DNA, 25 bp, Rattus norvegicus
aggagcagacggacccgatcccgat

SEQ ID NO: 141208 - DNA, 25 bp, Rattus norvegicus
aggagcagacggtcccgatcccgat

SEQ ID NO: 141209 - DNA, 25 bp, Rattus norvegicus
aggagcagagggaccagcaccttct

SEQ ID NO: 141210 - DNA, 25 bp, Rattus norvegicus
aggagcagagggtccagcaccttct

SEQ ID NO: 141211 - DNA, 25 bp, Rattus norvegicus
aggagcagagtaccagaggcccatc

SEQ ID NO: 141212 - DNA, 25 bp, Rattus norvegicus
aggagcagagtagcagaggcccatc

SEQ ID NO: 141213 - DNA, 25 bp, Rattus norvegicus
aggagcagcaaccacaaccgcagtt

SEQ ID NO: 141214 - DNA, 25 bp, Rattus norvegicus
aggagcagcaacgacaaccgcagtt

SEQ ID NO: 141215 - DNA, 25 bp, Rattus norvegicus
aggagcagccccaggacgaagagct

SEQ ID NO: 141216 - DNA, 25 bp, Rattus norvegicus
aggagcagcccctggacgaagagct

SEQ ID NO: 141217 - DNA, 25 bp, Rattus norvegicus
aggagcagcctcaggtgccattgat

SEQ ID NO: 141218 - DNA, 25 bp, Rattus norvegicus
aggagcagcctctggtgccattgat

SEQ ID NO: 141219 - DNA, 25 bp, Rattus norvegicus
aggagcagctatctcgacgaggacc

SEQ ID NO: 141220 - DNA, 25 bp, Rattus norvegicus
aggagcagctatgtcgacgaggacc

SEQ ID NO: 141221 - DNA, 25 bp, Rattus norvegicus
aggagcagctcaaagccgtgcatga

SEQ ID NO: 141222 - DNA, 25 bp, Rattus norvegicus
aggagcagctcatagccgtgcatga

SEQ ID NO: 141223 - DNA, 25 bp, Rattus norvegicus
aggagcagctgcatcgcattgatac

SEQ ID NO: 141224 - DNA, 25 bp, Rattus norvegicus
aggagcagctgcttcgcattgatac

SEQ ID NO: 141225 - DNA, 25 bp, Rattus norvegicus
aggagcagcttcctgagtcagccta

SEQ ID NO: 141226 - DNA, 25 bp, Rattus norvegicus
aggagcagcttcgtgagtcagccta

SEQ ID NO: 141227 - DNA, 25 bp, Rattus norvegicus
aggagcaggaccacatatgacagtc

SEQ ID NO: 141228 - DNA, 25 bp, Rattus norvegicus
aggagcaggacctcatatgacagtc

SEQ ID NO: 141229 - DNA, 25 bp, Rattus norvegicus
aggagcaggagacccttgtcccttg

SEQ ID NO: 141230 - DNA, 25 bp, Rattus norvegicus
aggagcaggagagccttgtcccttg

SEQ ID NO: 141231 - DNA, 25 bp, Rattus norvegicus
aggagcagggccattaagccaagac

SEQ ID NO: 141232 - DNA, 25 bp, Rattus norvegicus
aggagcagggcctttaagccaagac

SEQ ID NO: 141233 - DNA, 25 bp, Rattus norvegicus
aggagcaggtggcttccatacgaca

SEQ ID NO: 141234 - DNA, 25 bp, Rattus norvegicus
aggagcaggtgggttccatacgaca

SEQ ID NO: 141235 - DNA, 25 bp, Rattus norvegicus
aggagcagtccaacatccctgggaa

SEQ ID NO: 141236 - DNA, 25 bp, Rattus norvegicus
aggagcagtccatcatccctgggaa

SEQ ID NO: 141237 - DNA, 25 bp, Rattus norvegicus
aggagcagtgccactgttgggccca

SEQ ID NO: 141238 - DNA, 25 bp, Rattus norvegicus
aggagcagtgcctctgttgggccca

SEQ ID NO: 141239 - DNA, 25 bp, Rattus norvegicus
aggagcagtgctacaccacgggtgc

SEQ ID NO: 141240 - DNA, 25 bp, Rattus norvegicus
aggagcagtgcttcaccacgggtgc

SEQ ID NO: 141241 - DNA, 25 bp, Rattus norvegicus
aggagcagtggacccagcttcctca

SEQ ID NO: 141242 - DNA, 25 bp, Rattus norvegicus
aggagcagtggagccagcttcctca

SEQ ID NO: 141243 - DNA, 25 bp, Rattus norvegicus
aggagcagtggcctctctgtatctc

SEQ ID NO: 141244 - DNA, 25 bp, Rattus norvegicus
aggagcagtggcgtctctgtatctc

SEQ ID NO: 141245 - DNA, 25 bp, Rattus norvegicus
aggagcagtttcatctctgttacta

SEQ ID NO: 141246 - DNA, 25 bp, Rattus norvegicus
aggagcagtttcttctctgttacta

SEQ ID NO: 141247 - DNA, 25 bp, Rattus norvegicus
aggagcatagttccccatatctaga

SEQ ID NO: 141248 - DNA, 25 bp, Rattus norvegicus
aggagcatagttgcccatatctaga

SEQ ID NO: 141249 - DNA, 25 bp, Rattus norvegicus
aggagcatcagcaccgccgcgctgt

SEQ ID NO: 141250 - DNA, 25 bp, Rattus norvegicus
aggagcatcagctccgccgcgctgt

SEQ ID NO: 141251 - DNA, 25 bp, Rattus norvegicus
aggagcatccagagtccatgacgct

SEQ ID NO: 141252 - DNA, 25 bp, Rattus norvegicus
aggagcatccagtgtccatgacgct

SEQ ID NO: 141253 - DNA, 25 bp, Rattus norvegicus
aggagcatcctcatttcttcagcat

SEQ ID NO: 141254 - DNA, 25 bp, Rattus norvegicus
aggagcatcctccaacctttgccgg

SEQ ID NO: 141255 - DNA, 25 bp, Rattus norvegicus
aggagcatcctcgaacctttgccgg

SEQ ID NO: 141256 - DNA, 25 bp, Rattus norvegicus
aggagcatcctcttttcttcagcat

SEQ ID NO: 141257 - DNA, 25 bp, Rattus norvegicus
aggagcatctcgctgcctgggccac

SEQ ID NO: 141258 - DNA, 25 bp, Rattus norvegicus
aggagcatctcggtgcctgggccac

SEQ ID NO: 141259 - DNA, 25 bp, Rattus norvegicus
aggagcatctctctacacaaaggat

SEQ ID NO: 141260 - DNA, 25 bp, Rattus norvegicus
aggagcatctctgtacacaaaggat

SEQ ID NO: 141261 - DNA, 25 bp, Rattus norvegicus
aggagcatctgtattattgggagaa

SEQ ID NO: 141262 - DNA, 25 bp, Rattus norvegicus
aggagcatctgttttattgggagaa

SEQ ID NO: 141263 - DNA, 25 bp, Rattus norvegicus
aggagcatgcatattcagttagtca

SEQ ID NO: 141264 - DNA, 25 bp, Rattus norvegicus
aggagcatgcattttcagttagtca

SEQ ID NO: 141265 - DNA, 25 bp, Rattus norvegicus
aggagcatgggaattgcccttcatt

SEQ ID NO: 141266 - DNA, 25 bp, Rattus norvegicus
aggagcatgggatttgcccttcatt

SEQ ID NO: 141267 - DNA, 25 bp, Rattus norvegicus
aggagcatgtgcagagccctctcgg

SEQ ID NO: 141268 - DNA, 25 bp, Rattus norvegicus
aggagcatgtgctgagccctctcgg

SEQ ID NO: 141269 - DNA, 25 bp, Rattus norvegicus
aggagcatgtgtccccggtgacctt

SEQ ID NO: 141270 - DNA, 25 bp, Rattus norvegicus
aggagcatgtgtgcccggtgacctt

SEQ ID NO: 141271 - DNA, 25 bp, Rattus norvegicus
aggagcatgttaacctctgctacca

SEQ ID NO: 141272 - DNA, 25 bp, Rattus norvegicus
aggagcatgttatcctctgctacca

SEQ ID NO: 141273 - DNA, 25 bp, Rattus norvegicus
aggagcattaccagtgtgacgccca

SEQ ID NO: 141274 - DNA, 25 bp, Rattus norvegicus
aggagcattacctgtgtgacgccca

SEQ ID NO: 141275 - DNA, 25 bp, Rattus norvegicus
aggagcattactcccagccttgtct

SEQ ID NO: 141276 - DNA, 25 bp, Rattus norvegicus
aggagcattactgccagccttgtct

SEQ ID NO: 141277 - DNA, 25 bp, Rattus norvegicus
aggagcattcacattcttggtcaga

SEQ ID NO: 141278 - DNA, 25 bp, Rattus norvegicus
aggagcattcactttcttggtcaga

SEQ ID NO: 141279 - DNA, 25 bp, Rattus norvegicus
aggagcattcctagttcctagacat

SEQ ID NO: 141280 - DNA, 25 bp, Rattus norvegicus
aggagcattccttgttcctagacat

SEQ ID NO: 141281 - DNA, 25 bp, Rattus norvegicus
aggagcattctaagccccattaggg

SEQ ID NO: 141282 - DNA, 25 bp, Rattus norvegicus
aggagcattctatgccccattaggg

SEQ ID NO: 141283 - DNA, 25 bp, Rattus norvegicus
aggagcattgctctctgtgtgatgt

SEQ ID NO: 141284 - DNA, 25 bp, Rattus norvegicus
aggagcattgctgtctgtgtgatgt

SEQ ID NO: 141285 - DNA, 25 bp, Rattus norvegicus
aggagcattgttagctacctgccat

SEQ ID NO: 141286 - DNA, 25 bp, Rattus norvegicus
aggagcattgtttgctacctgccat

SEQ ID NO: 141287 - DNA, 25 bp, Rattus norvegicus
aggagcatttacaaacaggccccac

SEQ ID NO: 141288 - DNA, 25 bp, Rattus norvegicus
aggagcatttacactgagcagtcag

SEQ ID NO: 141289 - DNA, 25 bp, Rattus norvegicus
aggagcatttactaacaggccccac

SEQ ID NO: 141290 - DNA, 25 bp, Rattus norvegicus
aggagcatttactctgagcagtcag

SEQ ID NO: 141291 - DNA, 25 bp, Rattus norvegicus
aggagccaactccttttatacccag

SEQ ID NO: 141292 - DNA, 25 bp, Rattus norvegicus
aggagccaactcgttttatacccag

SEQ ID NO: 141293 - DNA, 25 bp, Rattus norvegicus
aggagccaaggtaagggacactgtc

SEQ ID NO: 141294 - DNA, 25 bp, Rattus norvegicus
aggagccaaggttagggacactgtc

SEQ ID NO: 141295 - DNA, 25 bp, Rattus norvegicus
aggagccaatatcctcttctggatt

SEQ ID NO: 141296 - DNA, 25 bp, Rattus norvegicus
aggagccaatatgctcttctggatt

SEQ ID NO: 141297 - DNA, 25 bp, Rattus norvegicus
aggagccacactacagtgaccactt

SEQ ID NO: 141298 - DNA, 25 bp, Rattus norvegicus
aggagccacacttcagtgaccactt

SEQ ID NO: 141299 - DNA, 25 bp, Rattus norvegicus
aggagccacagcataatgaaaccgt

SEQ ID NO: 141300 - DNA, 25 bp, Rattus norvegicus
aggagccacagcttaatgaaaccgt

SEQ ID NO: 141301 - DNA, 25 bp, Rattus norvegicus
aggagccacatcactacccagggaa

SEQ ID NO: 141302 - DNA, 25 bp, Rattus norvegicus
aggagccacatcattctgtgtcaga

SEQ ID NO: 141303 - DNA, 25 bp, Rattus norvegicus
aggagccacatctctacccagggaa

SEQ ID NO: 141304 - DNA, 25 bp, Rattus norvegicus
aggagccacatctttctgtgtcaga

SEQ ID NO: 141305 - DNA, 25 bp, Rattus norvegicus
aggagccaccagagtgcttatctac

SEQ ID NO: 141306 - DNA, 25 bp, Rattus norvegicus
aggagccaccagtgtgcttatctac

SEQ ID NO: 141307 - DNA, 25 bp, Rattus norvegicus
aggagccacccacaacattgtacgt

SEQ ID NO: 141308 - DNA, 25 bp, Rattus norvegicus
aggagccacccagaacattgtacgt

SEQ ID NO: 141309 - DNA, 25 bp, Rattus norvegicus
aggagccacttcaatgtccttactg

SEQ ID NO: 141310 - DNA, 25 bp, Rattus norvegicus
aggagccacttctatgtccttactg

SEQ ID NO: 141311 - DNA, 25 bp, Rattus norvegicus
aggagccagagaccagcggcctgtt

SEQ ID NO: 141312 - DNA, 25 bp, Rattus norvegicus
aggagccagagagcagcggcctgtt

SEQ ID NO: 141313 - DNA, 25 bp, Rattus norvegicus
aggagccagagtctatgctctccct

SEQ ID NO: 141314 - DNA, 25 bp, Rattus norvegicus
aggagccagagtgtatgctctccct

SEQ ID NO: 141315 - DNA, 25 bp, Rattus norvegicus
aggagccagccacctgagactccag

SEQ ID NO: 141316 - DNA, 25 bp, Rattus norvegicus
aggagccagccagctgagactccag

SEQ ID NO: 141317 - DNA, 25 bp, Rattus norvegicus
aggagccagcttcggccctgtgtct

SEQ ID NO: 141318 - DNA, 25 bp, Rattus norvegicus
aggagccagcttgggccctgtgtct

SEQ ID NO: 141319 - DNA, 25 bp, Rattus norvegicus
aggagcccaactaccgcggtcgcat

SEQ ID NO: 141320 - DNA, 25 bp, Rattus norvegicus
aggagcccaacttccgcggtcgcat

SEQ ID NO: 141321 - DNA, 25 bp, Rattus norvegicus
aggagcccaagcatcttggcggcaa

SEQ ID NO: 141322 - DNA, 25 bp, Rattus norvegicus
aggagcccaagccaacagacatgca

SEQ ID NO: 141323 - DNA, 25 bp, Rattus norvegicus
aggagcccaagcgaacagacatgca

SEQ ID NO: 141324 - DNA, 25 bp, Rattus norvegicus
aggagcccaagcttcttggcggcaa

SEQ ID NO: 141325 - DNA, 25 bp, Rattus norvegicus
aggagcccactaagccatcatgagg

SEQ ID NO: 141326 - DNA, 25 bp, Rattus norvegicus
aggagcccactatgccatcatgagg

SEQ ID NO: 141327 - DNA, 25 bp, Rattus norvegicus
aggagcccagctactccggagatgg

SEQ ID NO: 141328 - DNA, 25 bp, Rattus norvegicus
aggagcccagcttctccggagatgg

SEQ ID NO: 141329 - DNA, 25 bp, Rattus norvegicus
aggagcccaggtcttttgcagaatg

SEQ ID NO: 141330 - DNA, 25 bp, Rattus norvegicus
aggagcccaggtgttttgcagaatg

SEQ ID NO: 141331 - DNA, 25 bp, Rattus norvegicus
aggagcccagtaaatccgagctgca

SEQ ID NO: 141332 - DNA, 25 bp, Rattus norvegicus
aggagcccagtatatccgagctgca

SEQ ID NO: 141333 - DNA, 25 bp, Rattus norvegicus
aggagcccatcgcagtgcccctgga

SEQ ID NO: 141334 - DNA, 25 bp, Rattus norvegicus
aggagcccatcggagtgcccctgga

SEQ ID NO: 141335 - DNA, 25 bp, Rattus norvegicus
aggagcccatgtcactgtgaagaaa

SEQ ID NO: 141336 - DNA, 25 bp, Rattus norvegicus
aggagcccatgtgactgtgaagaaa

SEQ ID NO: 141337 - DNA, 25 bp, Rattus norvegicus
aggagccccgtcagagtggaccatg

SEQ ID NO: 141338 - DNA, 25 bp, Rattus norvegicus
aggagccccgtctgagtggaccatg

SEQ ID NO: 141339 - DNA, 25 bp, Rattus norvegicus
aggagcccctccagggcgtgacctg

SEQ ID NO: 141340 - DNA, 25 bp, Rattus norvegicus
aggagcccctcctgggcgtgacctg

SEQ ID NO: 141341 - DNA, 25 bp, Rattus norvegicus
aggagccctcggagatcatgcggct

SEQ ID NO: 141342 - DNA, 25 bp, Rattus norvegicus
aggagccctcggtgatcatgcggct

SEQ ID NO: 141343 - DNA, 25 bp, Rattus norvegicus
aggagccctgcacgcttggtaccaa

SEQ ID NO: 141344 - DNA, 25 bp, Rattus norvegicus
aggagccctgcactgtgaagccagc

SEQ ID NO: 141345 - DNA, 25 bp, Rattus norvegicus
aggagccctgcaggcttggtaccaa

SEQ ID NO: 141346 - DNA, 25 bp, Rattus norvegicus
aggagccctgcagtgtgaagccagc

SEQ ID NO: 141347 - DNA, 25 bp, Rattus norvegicus
aggagccctggaaacactcaatggt

SEQ ID NO: 141348 - DNA, 25 bp, Rattus norvegicus
aggagccctggactcatcatcaata

SEQ ID NO: 141349 - DNA, 25 bp, Rattus norvegicus
aggagccctggagtcatcatcaata

SEQ ID NO: 141350 - DNA, 25 bp, Rattus norvegicus
aggagccctggatacactcaatggt

SEQ ID NO: 141351 - DNA, 25 bp, Rattus norvegicus
aggagccgaaacacaaaccctagct

SEQ ID NO: 141352 - DNA, 25 bp, Rattus norvegicus
aggagccgaaactcaaaccctagct

SEQ ID NO: 141353 - DNA, 25 bp, Rattus norvegicus
aggagccgaaggcaccaagctcgat

SEQ ID NO: 141354 - DNA, 25 bp, Rattus norvegicus
aggagccgaagggaccaagctcgat

SEQ ID NO: 141355 - DNA, 25 bp, Rattus norvegicus
aggagccgacgcaggaagacccaga

SEQ ID NO: 141356 - DNA, 25 bp, Rattus norvegicus
aggagccgacgctggaagacccaga

SEQ ID NO: 141357 - DNA, 25 bp, Rattus norvegicus
aggagccgagacaggcagcgctcca

SEQ ID NO: 141358 - DNA, 25 bp, Rattus norvegicus
aggagccgagactggcagcgctcca

SEQ ID NO: 141359 - DNA, 25 bp, Rattus norvegicus
aggagccgattcaggtgtaaacaca

SEQ ID NO: 141360 - DNA, 25 bp, Rattus norvegicus
aggagccgattctggtgtaaacaca

SEQ ID NO: 141361 - DNA, 25 bp, Rattus norvegicus
aggagccgcagaaggcctcatagtt

SEQ ID NO: 141362 - DNA, 25 bp, Rattus norvegicus
aggagccgcagatggcctcatagtt

SEQ ID NO: 141363 - DNA, 25 bp, Rattus norvegicus
aggagccgctccactgttatttatt

SEQ ID NO: 141364 - DNA, 25 bp, Rattus norvegicus
aggagccgctccagaacctggagag

SEQ ID NO: 141365 - DNA, 25 bp, Rattus norvegicus
aggagccgctcctctgttatttatt

SEQ ID NO: 141366 - DNA, 25 bp, Rattus norvegicus
aggagccgctcctgaacctggagag

SEQ ID NO: 141367 - DNA, 25 bp, Rattus norvegicus
aggagccggagtaccagcgcatgtc

SEQ ID NO: 141368 - DNA, 25 bp, Rattus norvegicus
aggagccggagttccagcgcatgtc

SEQ ID NO: 141369 - DNA, 25 bp, Rattus norvegicus
aggagccgtacacgttcagcgagac

SEQ ID NO: 141370 - DNA, 25 bp, Rattus norvegicus
aggagccgtacaggttcagcgagac

SEQ ID NO: 141371 - DNA, 25 bp, Rattus norvegicus
aggagccgtccaagctgcagccaat

SEQ ID NO: 141372 - DNA, 25 bp, Rattus norvegicus
aggagccgtccatgctgcagccaat

SEQ ID NO: 141373 - DNA, 25 bp, Rattus norvegicus
aggagccgttgcacgagcccagcca

SEQ ID NO: 141374 - DNA, 25 bp, Rattus norvegicus
aggagccgttgctcgagcccagcca

SEQ ID NO: 141375 - DNA, 25 bp, Rattus norvegicus
aggagcctaagccttcacctaattt

SEQ ID NO: 141376 - DNA, 25 bp, Rattus norvegicus
aggagcctaagcgttcacctaattt

SEQ ID NO: 141377 - DNA, 25 bp, Rattus norvegicus
aggagcctagagagttttcagaagc

SEQ ID NO: 141378 - DNA, 25 bp, Rattus norvegicus
aggagcctagagtgttttcagaagc

SEQ ID NO: 141379 - DNA, 25 bp, Rattus norvegicus
aggagcctcacgctgggattgaacc

SEQ ID NO: 141380 - DNA, 25 bp, Rattus norvegicus
aggagcctcacggtgggattgaacc

SEQ ID NO: 141381 - DNA, 25 bp, Rattus norvegicus
aggagcctcatcagttctgacggca

SEQ ID NO: 141382 - DNA, 25 bp, Rattus norvegicus
aggagcctcatctgttctgacggca

SEQ ID NO: 141383 - DNA, 25 bp, Rattus norvegicus
aggagcctccagccctgtacatggg

SEQ ID NO: 141384 - DNA, 25 bp, Rattus norvegicus
aggagcctccaggcctgtacatggg

SEQ ID NO: 141385 - DNA, 25 bp, Rattus norvegicus
aggagcctcctactgctagatctca

SEQ ID NO: 141386 - DNA, 25 bp, Rattus norvegicus
aggagcctcctagtgctagatctca

SEQ ID NO: 141387 - DNA, 25 bp, Rattus norvegicus
aggagcctcctgaagaggacagccc

SEQ ID NO: 141388 - DNA, 25 bp, Rattus norvegicus
aggagcctcctgtagaggacagccc

SEQ ID NO: 141389 - DNA, 25 bp, Rattus norvegicus
aggagcctcgtgaatttgtatacag

SEQ ID NO: 141390 - DNA, 25 bp, Rattus norvegicus
aggagcctcgtgtatttgtatacag

SEQ ID NO: 141391 - DNA, 25 bp, Rattus norvegicus
aggagcctctcacctgtttcggatc

SEQ ID NO: 141392 - DNA, 25 bp, Rattus norvegicus
aggagcctctcagctgtttcggatc

SEQ ID NO: 141393 - DNA, 25 bp, Rattus norvegicus
aggagcctgaaccatgctgccaagg

SEQ ID NO: 141394 - DNA, 25 bp, Rattus norvegicus
aggagcctgaacgatgctgccaagg

SEQ ID NO: 141395 - DNA, 25 bp, Rattus norvegicus
aggagcctgctacacttccagggca

SEQ ID NO: 141396 - DNA, 25 bp, Rattus norvegicus
aggagcctgctagacttccagggca

SEQ ID NO: 141397 - DNA, 25 bp, Rattus norvegicus
aggagcctggccagtgtgccacatt

SEQ ID NO: 141398 - DNA, 25 bp, Rattus norvegicus
aggagcctggccattcatctgcaga

SEQ ID NO: 141399 - DNA, 25 bp, Rattus norvegicus
aggagcctggcctgtgtgccacatt

SEQ ID NO: 141400 - DNA, 25 bp, Rattus norvegicus
aggagcctggcctttcatctgcaga

SEQ ID NO: 141401 - DNA, 25 bp, Rattus norvegicus
aggagcctgtcacagcctgaaaatg

SEQ ID NO: 141402 - DNA, 25 bp, Rattus norvegicus
aggagcctgtcagagcctgaaaatg

SEQ ID NO: 141403 - DNA, 25 bp, Rattus norvegicus
aggagcctgttccagaattgctaga

SEQ ID NO: 141404 - DNA, 25 bp, Rattus norvegicus
aggagcctgttcgagaattgctaga

SEQ ID NO: 141405 - DNA, 25 bp, Rattus norvegicus
aggagccttctgatacagcatgctg

SEQ ID NO: 141406 - DNA, 25 bp, Rattus norvegicus
aggagccttctgttacagcatgctg

SEQ ID NO: 141407 - DNA, 25 bp, Rattus norvegicus
aggagccttgtcagagccctatgag

SEQ ID NO: 141408 - DNA, 25 bp, Rattus norvegicus
aggagccttgtctgagccctatgag

SEQ ID NO: 141409 - DNA, 25 bp, Rattus norvegicus
aggagcctttgtatggcagctgaag

SEQ ID NO: 141410 - DNA, 25 bp, Rattus norvegicus
aggagcctttgtttggcagctgaag

SEQ ID NO: 141411 - DNA, 25 bp, Rattus norvegicus
aggagccttttacaaactgcaaata

SEQ ID NO: 141412 - DNA, 25 bp, Rattus norvegicus
aggagccttttagaaactgcaaata

SEQ ID NO: 141413 - DNA, 25 bp, Rattus norvegicus
aggagccttttgactttttaagcat

SEQ ID NO: 141414 - DNA, 25 bp, Rattus norvegicus
aggagccttttgtctttttaagcat

SEQ ID NO: 141415 - DNA, 25 bp, Rattus norvegicus
aggagcgagagccagaacagcgagt

SEQ ID NO: 141416 - DNA, 25 bp, Rattus norvegicus
aggagcgagagcgagaacagcgagt

SEQ ID NO: 141417 - DNA, 25 bp, Rattus norvegicus
aggagcgaggatacacgcagatgaa

SEQ ID NO: 141418 - DNA, 25 bp, Rattus norvegicus
aggagcgaggattcacgcagatgaa

SEQ ID NO: 141419 - DNA, 25 bp, Rattus norvegicus
aggagcgattcgacagctttgccaa

SEQ ID NO: 141420 - DNA, 25 bp, Rattus norvegicus
aggagcgattcgtcagctttgccaa

SEQ ID NO: 141421 - DNA, 25 bp, Rattus norvegicus
aggagcgcagagaccgaggactctt

SEQ ID NO: 141422 - DNA, 25 bp, Rattus norvegicus
aggagcgcagagtccgaggactctt

SEQ ID NO: 141423 - DNA, 25 bp, Rattus norvegicus
aggagcgcagatacctcatgcgagt

SEQ ID NO: 141424 - DNA, 25 bp, Rattus norvegicus
aggagcgcagattcctcatgcgagt

SEQ ID NO: 141425 - DNA, 25 bp, Rattus norvegicus
aggagcgccggaaaagcaacagact

SEQ ID NO: 141426 - DNA, 25 bp, Rattus norvegicus
aggagcgccggataagcaacagact

SEQ ID NO: 141427 - DNA, 25 bp, Rattus norvegicus
aggagcgcctccaagccaagaagga

SEQ ID NO: 141428 - DNA, 25 bp, Rattus norvegicus
aggagcgcctcctagccaagaagga

SEQ ID NO: 141429 - DNA, 25 bp, Rattus norvegicus
aggagcgctgcaacaacagcggtaa

SEQ ID NO: 141430 - DNA, 25 bp, Rattus norvegicus
aggagcgctgcatcaacagcggtaa

SEQ ID NO: 141431 - DNA, 25 bp, Rattus norvegicus
aggagcggcactagtcggtggctga

SEQ ID NO: 141432 - DNA, 25 bp, Rattus norvegicus
aggagcggcacttgtcggtggctga

SEQ ID NO: 141433 - DNA, 25 bp, Rattus norvegicus
aggagcgggcatcctctgctaagat

SEQ ID NO: 141434 - DNA, 25 bp, Rattus norvegicus
aggagcgggcatgctctgctaagat

SEQ ID NO: 141435 - DNA, 25 bp, Rattus norvegicus
aggagcgggcctcgatctgacctta

SEQ ID NO: 141436 - DNA, 25 bp, Rattus norvegicus
aggagcgggcctggatctgacctta

SEQ ID NO: 141437 - DNA, 25 bp, Rattus norvegicus
aggagcgtgcatcctgccttgacta

SEQ ID NO: 141438 - DNA, 25 bp, Rattus norvegicus
aggagcgtgcatgctgccttgacta

SEQ ID NO: 141439 - DNA, 25 bp, Rattus norvegicus
aggagcgtgccaccaagccttactg

SEQ ID NO: 141440 - DNA, 25 bp, Rattus norvegicus
aggagcgtgccagcaagccttactg

SEQ ID NO: 141441 - DNA, 25 bp, Rattus norvegicus
aggagcgtgctcagttgctacagcc

SEQ ID NO: 141442 - DNA, 25 bp, Rattus norvegicus
aggagcgtgctctgttgctacagcc

SEQ ID NO: 141443 - DNA, 25 bp, Rattus norvegicus
aggagcgtgtttagtgcagtgcatc

SEQ ID NO: 141444 - DNA, 25 bp, Rattus norvegicus
aggagcgtgttttgtgcagtgcatc

SEQ ID NO: 141445 - DNA, 25 bp, Rattus norvegicus
aggagctaacttatatcaataattt

SEQ ID NO: 141446 - DNA, 25 bp, Rattus norvegicus
aggagctaacttttatcaataattt

SEQ ID NO: 141447 - DNA, 25 bp, Rattus norvegicus
aggagctaagtcaataagtctgtaa

SEQ ID NO: 141448 - DNA, 25 bp, Rattus norvegicus
aggagctaagtctataagtctgtaa

SEQ ID NO: 141449 - DNA, 25 bp, Rattus norvegicus
aggagctacacaccctggcccagtg

SEQ ID NO: 141450 - DNA, 25 bp, Rattus norvegicus
aggagctacacagcctggcccagtg

SEQ ID NO: 141451 - DNA, 25 bp, Rattus norvegicus
aggagctaccttccaactacacatg

SEQ ID NO: 141452 - DNA, 25 bp, Rattus norvegicus
aggagctaccttgcaactacacatg

SEQ ID NO: 141453 - DNA, 25 bp, Rattus norvegicus
aggagctaggcaacctcagtgggcc

SEQ ID NO: 141454 - DNA, 25 bp, Rattus norvegicus
aggagctaggcatcctcagtgggcc

SEQ ID NO: 141455 - DNA, 25 bp, Rattus norvegicus
aggagctagtggcactctgtcgcca

SEQ ID NO: 141456 - DNA, 25 bp, Rattus norvegicus
aggagctagtgggactctgtcgcca

SEQ ID NO: 141457 - DNA, 25 bp, Rattus norvegicus
aggagctcaaagaggcccagactga

SEQ ID NO: 141458 - DNA, 25 bp, Rattus norvegicus
aggagctcaaagtggcccagactga

SEQ ID NO: 141459 - DNA, 25 bp, Rattus norvegicus
aggagctcacagaatcccagtagca

SEQ ID NO: 141460 - DNA, 25 bp, Rattus norvegicus
aggagctcacagtatcccagtagca

SEQ ID NO: 141461 - DNA, 25 bp, Rattus norvegicus
aggagctcacatcctgtcacttaga

SEQ ID NO: 141462 - DNA, 25 bp, Rattus norvegicus
aggagctcacatgctgtcacttaga

SEQ ID NO: 141463 - DNA, 25 bp, Rattus norvegicus
aggagctcaccgctgcttataagca

SEQ ID NO: 141464 - DNA, 25 bp, Rattus norvegicus
aggagctcaccggtgcttataagca

SEQ ID NO: 141465 - DNA, 25 bp, Rattus norvegicus
aggagctcagcaccctccttcgaga

SEQ ID NO: 141466 - DNA, 25 bp, Rattus norvegicus
aggagctcagcagcctccttcgaga

SEQ ID NO: 141467 - DNA, 25 bp, Rattus norvegicus
aggagctcagctagggcagcagccc

SEQ ID NO: 141468 - DNA, 25 bp, Rattus norvegicus
aggagctcagctagtggcacataca

SEQ ID NO: 141469 - DNA, 25 bp, Rattus norvegicus
aggagctcagcttgggcagcagccc

SEQ ID NO: 141470 - DNA, 25 bp, Rattus norvegicus
aggagctcagcttgtggcacataca

SEQ ID NO: 141471 - DNA, 25 bp, Rattus norvegicus
aggagctccaggctcccagagcaag

SEQ ID NO: 141472 - DNA, 25 bp, Rattus norvegicus
aggagctccagggtcccagagcaag

SEQ ID NO: 141473 - DNA, 25 bp, Rattus norvegicus
aggagctcccagactggccagagga

SEQ ID NO: 141474 - DNA, 25 bp, Rattus norvegicus
aggagctcccagtctggccagagga

SEQ ID NO: 141475 - DNA, 25 bp, Rattus norvegicus
aggagctccctcaacattttgtgca

SEQ ID NO: 141476 - DNA, 25 bp, Rattus norvegicus
aggagctccctctacattttgtgca

SEQ ID NO: 141477 - DNA, 25 bp, Rattus norvegicus
aggagctccgtgactttgtgcctgg

SEQ ID NO: 141478 - DNA, 25 bp, Rattus norvegicus
aggagctccgtgatgaccatggaca

SEQ ID NO: 141479 - DNA, 25 bp, Rattus norvegicus
aggagctccgtgtctttgtgcctgg

SEQ ID NO: 141480 - DNA, 25 bp, Rattus norvegicus
aggagctccgtgttgaccatggaca

SEQ ID NO: 141481 - DNA, 25 bp, Rattus norvegicus
aggagctcctcaaggcaggtggcta

SEQ ID NO: 141482 - DNA, 25 bp, Rattus norvegicus
aggagctcctcatggcaggtggcta

SEQ ID NO: 141483 - DNA, 25 bp, Rattus norvegicus
aggagctcctccatctggtggtgct

SEQ ID NO: 141484 - DNA, 25 bp, Rattus norvegicus
aggagctcctccttctggtggtgct

SEQ ID NO: 141485 - DNA, 25 bp, Rattus norvegicus
aggagctcctgacttcagtctctaa

SEQ ID NO: 141486 - DNA, 25 bp, Rattus norvegicus
aggagctcctgagttcagtctctaa

SEQ ID NO: 141487 - DNA, 25 bp, Rattus norvegicus
aggagctcctgcacagaggccgatg

SEQ ID NO: 141488 - DNA, 25 bp, Rattus norvegicus
aggagctcctgctcagaggccgatg

SEQ ID NO: 141489 - DNA, 25 bp, Rattus norvegicus
aggagctcctggctgattaggttaa

SEQ ID NO: 141490 - DNA, 25 bp, Rattus norvegicus
aggagctcctgggtgattaggttaa

SEQ ID NO: 141491 - DNA, 25 bp, Rattus norvegicus
aggagctcctgtatttggccggctg

SEQ ID NO: 141492 - DNA, 25 bp, Rattus norvegicus
aggagctcctgtttttggccggctg

SEQ ID NO: 141493 - DNA, 25 bp, Rattus norvegicus
aggagctccttcaaaggccatgcta

SEQ ID NO: 141494 - DNA, 25 bp, Rattus norvegicus
aggagctccttctaaggccatgcta

SEQ ID NO: 141495 - DNA, 25 bp, Rattus norvegicus
aggagctcgcctcagtggaaagcca

SEQ ID NO: 141496 - DNA, 25 bp, Rattus norvegicus
aggagctcgcctgagtggaaagcca

SEQ ID NO: 141497 - DNA, 25 bp, Rattus norvegicus
aggagctcggagactgttgtttgtc

SEQ ID NO: 141498 - DNA, 25 bp, Rattus norvegicus
aggagctcggagtctgttgtttgtc

SEQ ID NO: 141499 - DNA, 25 bp, Rattus norvegicus
aggagctcggctaatcgctgtttgc

SEQ ID NO: 141500 - DNA, 25 bp, Rattus norvegicus
aggagctcggctactaccgtaagtc

SEQ ID NO: 141501 - DNA, 25 bp, Rattus norvegicus
aggagctcggcttatcgctgtttgc

SEQ ID NO: 141502 - DNA, 25 bp, Rattus norvegicus
aggagctcggcttctaccgtaagtc

SEQ ID NO: 141503 - DNA, 25 bp, Rattus norvegicus
aggagctcgggcaggaccattctat

SEQ ID NO: 141504 - DNA, 25 bp, Rattus norvegicus
aggagctcgggctggaccattctat

SEQ ID NO: 141505 - DNA, 25 bp, Rattus norvegicus
aggagctctaagatctgcagacagc

SEQ ID NO: 141506 - DNA, 25 bp, Rattus norvegicus
aggagctctaagttctgcagacagc

SEQ ID NO: 141507 - DNA, 25 bp, Rattus norvegicus
aggagctctccacgaacacatggcc

SEQ ID NO: 141508 - DNA, 25 bp, Rattus norvegicus
aggagctctccaggaacacatggcc

SEQ ID NO: 141509 - DNA, 25 bp, Rattus norvegicus
aggagctctcctcatggtgcgacct

SEQ ID NO: 141510 - DNA, 25 bp, Rattus norvegicus
aggagctctcctgatggtgcgacct

SEQ ID NO: 141511 - DNA, 25 bp, Rattus norvegicus
aggagctctcggagctggtcaagaa

SEQ ID NO: 141512 - DNA, 25 bp, Rattus norvegicus
aggagctctcggtgctggtcaagaa

SEQ ID NO: 141513 - DNA, 25 bp, Rattus norvegicus
aggagctctctgaggttcttaggtc

SEQ ID NO: 141514 - DNA, 25 bp, Rattus norvegicus
aggagctctctgtggttcttaggtc

SEQ ID NO: 141515 - DNA, 25 bp, Rattus norvegicus
aggagctctggcagtgcagcctcat

SEQ ID NO: 141516 - DNA, 25 bp, Rattus norvegicus
aggagctctggctgtgcagcctcat

SEQ ID NO: 141517 - DNA, 25 bp, Rattus norvegicus
aggagctctgggaaaacctgtggat

SEQ ID NO: 141518 - DNA, 25 bp, Rattus norvegicus
aggagctctgggtaaacctgtggat

SEQ ID NO: 141519 - DNA, 25 bp, Rattus norvegicus
aggagctctgtcagatccgcttcca

SEQ ID NO: 141520 - DNA, 25 bp, Rattus norvegicus
aggagctctgtctgatccgcttcca

SEQ ID NO: 141521 - DNA, 25 bp, Rattus norvegicus
aggagctcttggcagtctcaagtcc

SEQ ID NO: 141522 - DNA, 25 bp, Rattus norvegicus
aggagctcttgggagtctcaagtcc

SEQ ID NO: 141523 - DNA, 25 bp, Rattus norvegicus
aggagctgaacaagtccctcaaagt

SEQ ID NO: 141524 - DNA, 25 bp, Rattus norvegicus
aggagctgaacatgtccctcaaagt

SEQ ID NO: 141525 - DNA, 25 bp, Rattus norvegicus
aggagctgaccacaaaccaaagttc

SEQ ID NO: 141526 - DNA, 25 bp, Rattus norvegicus
aggagctgaccagaaaccaaagttc

SEQ ID NO: 141527 - DNA, 25 bp, Rattus norvegicus
aggagctgaccgctcgatagccggg

SEQ ID NO: 141528 - DNA, 25 bp, Rattus norvegicus
aggagctgaccggtcgatagccggg

SEQ ID NO: 141529 - DNA, 25 bp, Rattus norvegicus
aggagctgagataacggacccacgc

SEQ ID NO: 141530 - DNA, 25 bp, Rattus norvegicus
aggagctgagattacggacccacgc

SEQ ID NO: 141531 - DNA, 25 bp, Rattus norvegicus
aggagctgagccattcatccgggcc

SEQ ID NO: 141532 - DNA, 25 bp, Rattus norvegicus
aggagctgagcctttcatccgggcc

SEQ ID NO: 141533 - DNA, 25 bp, Rattus norvegicus
aggagctgatatagatgcactttgt

SEQ ID NO: 141534 - DNA, 25 bp, Rattus norvegicus
aggagctgatattgatgcactttgt

SEQ ID NO: 141535 - DNA, 25 bp, Rattus norvegicus
aggagctgatcccactgcaaaattc

SEQ ID NO: 141536 - DNA, 25 bp, Rattus norvegicus
aggagctgatccgactgcaaaattc

SEQ ID NO: 141537 - DNA, 25 bp, Rattus norvegicus
aggagctgattcacattctctgcaa

SEQ ID NO: 141538 - DNA, 25 bp, Rattus norvegicus
aggagctgattctcattctctgcaa

SEQ ID NO: 141539 - DNA, 25 bp, Rattus norvegicus
aggagctgcagactcaaggccgcca

SEQ ID NO: 141540 - DNA, 25 bp, Rattus norvegicus
aggagctgcagagtcaaggccgcca

SEQ ID NO: 141541 - DNA, 25 bp, Rattus norvegicus
aggagctgccagaagatatcatctt

SEQ ID NO: 141542 - DNA, 25 bp, Rattus norvegicus
aggagctgccagtagatatcatctt

SEQ ID NO: 141543 - DNA, 25 bp, Rattus norvegicus
aggagctgccctagtctggtgacag

SEQ ID NO: 141544 - DNA, 25 bp, Rattus norvegicus
aggagctgcccttgtctggtgacag

SEQ ID NO: 141545 - DNA, 25 bp, Rattus norvegicus
aggagctgcctccaaaggctggaca

SEQ ID NO: 141546 - DNA, 25 bp, Rattus norvegicus
aggagctgcctcgaaaggctggaca

SEQ ID NO: 141547 - DNA, 25 bp, Rattus norvegicus
aggagctgccttaagcactttagaa

SEQ ID NO: 141548 - DNA, 25 bp, Rattus norvegicus
aggagctgccttccaagccagttgt

SEQ ID NO: 141549 - DNA, 25 bp, Rattus norvegicus
aggagctgccttgcaagccagttgt

SEQ ID NO: 141550 - DNA, 25 bp, Rattus norvegicus
aggagctgcctttagcactttagaa

SEQ ID NO: 141551 - DNA, 25 bp, Rattus norvegicus
aggagctgctcaaggtcttctggga

SEQ ID NO: 141552 - DNA, 25 bp, Rattus norvegicus
aggagctgctcatggtcttctggga

SEQ ID NO: 141553 - DNA, 25 bp, Rattus norvegicus
aggagctgctgcactgagtgagtca

SEQ ID NO: 141554 - DNA, 25 bp, Rattus norvegicus
aggagctgctgctctgagtgagtca

SEQ ID NO: 141555 - DNA, 25 bp, Rattus norvegicus
aggagctgctgtacactcagaggac

SEQ ID NO: 141556 - DNA, 25 bp, Rattus norvegicus
aggagctgctgttcactcagaggac

SEQ ID NO: 141557 - DNA, 25 bp, Rattus norvegicus
aggagctgcttcctcacgtgaattc

SEQ ID NO: 141558 - DNA, 25 bp, Rattus norvegicus
aggagctgcttcgtcacgtgaattc

SEQ ID NO: 141559 - DNA, 25 bp, Rattus norvegicus
aggagctgctttcacctccgagcag

SEQ ID NO: 141560 - DNA, 25 bp, Rattus norvegicus
aggagctgctttctccctagggaaa

SEQ ID NO: 141561 - DNA, 25 bp, Rattus norvegicus
aggagctgctttgacctccgagcag

SEQ ID NO: 141562 - DNA, 25 bp, Rattus norvegicus
aggagctgctttgtccctagggaaa

SEQ ID NO: 141563 - DNA, 25 bp, Rattus norvegicus
aggagctggagtactatctgcggaa

SEQ ID NO: 141564 - DNA, 25 bp, Rattus norvegicus
aggagctggagtctgcaccactctt

SEQ ID NO: 141565 - DNA, 25 bp, Rattus norvegicus
aggagctggagtgtgcaccactctt

SEQ ID NO: 141566 - DNA, 25 bp, Rattus norvegicus
aggagctggagttctatctgcggaa

SEQ ID NO: 141567 - DNA, 25 bp, Rattus norvegicus
aggagctggattacgcctcacggta

SEQ ID NO: 141568 - DNA, 25 bp, Rattus norvegicus
aggagctggatttcgcctcacggta

SEQ ID NO: 141569 - DNA, 25 bp, Rattus norvegicus
aggagctggcaaagtcaccaagtct

SEQ ID NO: 141570 - DNA, 25 bp, Rattus norvegicus
aggagctggcaatgtcaccaagtct

SEQ ID NO: 141571 - DNA, 25 bp, Rattus norvegicus
aggagctggccactgcctcggagac

SEQ ID NO: 141572 - DNA, 25 bp, Rattus norvegicus
aggagctggccagtgcctcggagac

SEQ ID NO: 141573 - DNA, 25 bp, Rattus norvegicus
aggagctggcgtactgatgtcagat

SEQ ID NO: 141574 - DNA, 25 bp, Rattus norvegicus
aggagctggcgttctgatgtcagat

SEQ ID NO: 141575 - DNA, 25 bp, Rattus norvegicus
aggagctggctgcacccgtacacgc

SEQ ID NO: 141576 - DNA, 25 bp, Rattus norvegicus
aggagctggctggacccgtacacgc

SEQ ID NO: 141577 - DNA, 25 bp, Rattus norvegicus
aggagctggcttacactgtggatga

SEQ ID NO: 141578 - DNA, 25 bp, Rattus norvegicus
aggagctggctttcactgtggatga

SEQ ID NO: 141579 - DNA, 25 bp, Rattus norvegicus
aggagctgggacaccaggtccagca

SEQ ID NO: 141580 - DNA, 25 bp, Rattus norvegicus
aggagctgggactccaggtccagca

SEQ ID NO: 141581 - DNA, 25 bp, Rattus norvegicus
aggagctgggccatttcacggcagt

SEQ ID NO: 141582 - DNA, 25 bp, Rattus norvegicus
aggagctgggccttttcacggcagt

SEQ ID NO: 141583 - DNA, 25 bp, Rattus norvegicus
aggagctggtatcactggtgaacca

SEQ ID NO: 141584 - DNA, 25 bp, Rattus norvegicus
aggagctggtatgactggtgaacca

SEQ ID NO: 141585 - DNA, 25 bp, Rattus norvegicus
aggagctgtcacaaatcagtccatc

SEQ ID NO: 141586 - DNA, 25 bp, Rattus norvegicus
aggagctgtcactaatcagtccatc

SEQ ID NO: 141587 - DNA, 25 bp, Rattus norvegicus
aggagctgtcatacctgtgagctga

SEQ ID NO: 141588 - DNA, 25 bp, Rattus norvegicus
aggagctgtcattcctgtgagctga

SEQ ID NO: 141589 - DNA, 25 bp, Rattus norvegicus
aggagctgtccacagcgccatttag

SEQ ID NO: 141590 - DNA, 25 bp, Rattus norvegicus
aggagctgtccagagcgccatttag

SEQ ID NO: 141591 - DNA, 25 bp, Rattus norvegicus
aggagctgtgaacactcccttccga

SEQ ID NO: 141592 - DNA, 25 bp, Rattus norvegicus
aggagctgtgaagactcccttccga

SEQ ID NO: 141593 - DNA, 25 bp, Rattus norvegicus
aggagctgtgctatgggcatgccac

SEQ ID NO: 141594 - DNA, 25 bp, Rattus norvegicus
aggagctgtgctttgggcatgccac

SEQ ID NO: 141595 - DNA, 25 bp, Rattus norvegicus
aggagctgtggccatgtttcaatag

SEQ ID NO: 141596 - DNA, 25 bp, Rattus norvegicus
aggagctgtggcgatgtttcaatag

SEQ ID NO: 141597 - DNA, 25 bp, Rattus norvegicus
aggagcttacatcttccctaaactc

SEQ ID NO: 141598 - DNA, 25 bp, Rattus norvegicus
aggagcttacatgttccctaaactc

SEQ ID NO: 141599 - DNA, 25 bp, Rattus norvegicus
aggagcttagagaccgcgtcacatt

SEQ ID NO: 141600 - DNA, 25 bp, Rattus norvegicus
aggagcttagagtccgcgtcacatt

SEQ ID NO: 141601 - DNA, 25 bp, Rattus norvegicus
aggagcttagcccttttcgaggacg

SEQ ID NO: 141602 - DNA, 25 bp, Rattus norvegicus
aggagcttagccgttttcgaggacg

SEQ ID NO: 141603 - DNA, 25 bp, Rattus norvegicus
aggagcttagtgacgtcctcatcta

SEQ ID NO: 141604 - DNA, 25 bp, Rattus norvegicus
aggagcttagtgtcgtcctcatcta

SEQ ID NO: 141605 - DNA, 25 bp, Rattus norvegicus
aggagcttatatccctgcttagcat

SEQ ID NO: 141606 - DNA, 25 bp, Rattus norvegicus
aggagcttatatgcctgcttagcat

SEQ ID NO: 141607 - DNA, 25 bp, Rattus norvegicus
aggagcttatttcgtctgatgtcta

SEQ ID NO: 141608 - DNA, 25 bp, Rattus norvegicus
aggagcttatttggtctgatgtcta

SEQ ID NO: 141609 - DNA, 25 bp, Rattus norvegicus
aggagcttcaccaggaaatgcttcc

SEQ ID NO: 141610 - DNA, 25 bp, Rattus norvegicus
aggagcttcacctggaaatgcttcc

SEQ ID NO: 141611 - DNA, 25 bp, Rattus norvegicus
aggagcttccacaatgtgcccagga

SEQ ID NO: 141612 - DNA, 25 bp, Rattus norvegicus
aggagcttccactatgtgcccagga

SEQ ID NO: 141613 - DNA, 25 bp, Rattus norvegicus
aggagcttcctcagattcttaggtt

SEQ ID NO: 141614 - DNA, 25 bp, Rattus norvegicus
aggagcttcctctgattcttaggtt

SEQ ID NO: 141615 - DNA, 25 bp, Rattus norvegicus
aggagcttctagctggtctcacaat

SEQ ID NO: 141616 - DNA, 25 bp, Rattus norvegicus
aggagcttctaggtggtctcacaat

SEQ ID NO: 141617 - DNA, 25 bp, Rattus norvegicus
aggagcttgacaagttttaactttt

SEQ ID NO: 141618 - DNA, 25 bp, Rattus norvegicus
aggagcttgacatgttttaactttt

SEQ ID NO: 141619 - DNA, 25 bp, Rattus norvegicus
aggagcttgagcaccacgacacagg

SEQ ID NO: 141620 - DNA, 25 bp, Rattus norvegicus
aggagcttgagctccacgacacagg

SEQ ID NO: 141621 - DNA, 25 bp, Rattus norvegicus
aggagcttgagtaggtgtccccact

SEQ ID NO: 141622 - DNA, 25 bp, Rattus norvegicus
aggagcttgagttggtgtccccact

SEQ ID NO: 141623 - DNA, 25 bp, Rattus norvegicus
aggagcttgcctctcactaggaacg

SEQ ID NO: 141624 - DNA, 25 bp, Rattus norvegicus
aggagcttgcctgtcactaggaacg

SEQ ID NO: 141625 - DNA, 25 bp, Rattus norvegicus
aggagcttggtgatacctttgctgc

SEQ ID NO: 141626 - DNA, 25 bp, Rattus norvegicus
aggagcttggtgttacctttgctgc

SEQ ID NO: 141627 - DNA, 25 bp, Rattus norvegicus
aggagctttgacatttctgcaggca

SEQ ID NO: 141628 - DNA, 25 bp, Rattus norvegicus
aggagctttgacttttctgcaggca

SEQ ID NO: 141629 - DNA, 25 bp, Rattus norvegicus
aggagctttgccagtgcctgggcac

SEQ ID NO: 141630 - DNA, 25 bp, Rattus norvegicus
aggagctttgcctgtgcctgggcac

SEQ ID NO: 141631 - DNA, 25 bp, Rattus norvegicus
aggagcttttgtatgctgaattaaa

SEQ ID NO: 141632 - DNA, 25 bp, Rattus norvegicus
aggagcttttgtttgctgaattaaa

SEQ ID NO: 141633 - DNA, 25 bp, Rattus norvegicus
aggaggaaaaacataggtggaatat

SEQ ID NO: 141634 - DNA, 25 bp, Rattus norvegicus
aggaggaaaaacttaggtggaatat

SEQ ID NO: 141635 - DNA, 25 bp, Rattus norvegicus
aggaggaaacatacaccctgtctac

SEQ ID NO: 141636 - DNA, 25 bp, Rattus norvegicus
aggaggaaacattcaccctgtctac

SEQ ID NO: 141637 - DNA, 25 bp, Rattus norvegicus
aggaggaaacccaggcacttcttag

SEQ ID NO: 141638 - DNA, 25 bp, Rattus norvegicus
aggaggaaaccctggcacttcttag

SEQ ID NO: 141639 - DNA, 25 bp, Rattus norvegicus
aggaggaaagaaagcccatcctact

SEQ ID NO: 141640 - DNA, 25 bp, Rattus norvegicus
aggaggaaagaatgcccatcctact

SEQ ID NO: 141641 - DNA, 25 bp, Rattus norvegicus
aggaggaacaccacagctggctgta

SEQ ID NO: 141642 - DNA, 25 bp, Rattus norvegicus
aggaggaacacctcagctggctgta

SEQ ID NO: 141643 - DNA, 25 bp, Rattus norvegicus
aggaggaacagtcgccttgcttcta

SEQ ID NO: 141644 - DNA, 25 bp, Rattus norvegicus
aggaggaacagtggccttgcttcta

SEQ ID NO: 141645 - DNA, 25 bp, Rattus norvegicus
aggaggaagacaacccggcgtttct

SEQ ID NO: 141646 - DNA, 25 bp, Rattus norvegicus
aggaggaagacatcccggcgtttct

SEQ ID NO: 141647 - DNA, 25 bp, Rattus norvegicus
aggaggaagccaactgacccagcca

SEQ ID NO: 141648 - DNA, 25 bp, Rattus norvegicus
aggaggaagccatctgacccagcca

SEQ ID NO: 141649 - DNA, 25 bp, Rattus norvegicus
aggaggaagtctaagggcccatgat

SEQ ID NO: 141650 - DNA, 25 bp, Rattus norvegicus
aggaggaagtcttagggcccatgat

SEQ ID NO: 141651 - DNA, 25 bp, Rattus norvegicus
aggaggaattccagggtgaatggac

SEQ ID NO: 141652 - DNA, 25 bp, Rattus norvegicus
aggaggaattcctgggtgaatggac

SEQ ID NO: 141653 - DNA, 25 bp, Rattus norvegicus
aggaggacacgcagaaactctcact

SEQ ID NO: 141654 - DNA, 25 bp, Rattus norvegicus
aggaggacacgctgaaactctcact

SEQ ID NO: 141655 - DNA, 25 bp, Rattus norvegicus
aggaggacacggaagccatctttaa

SEQ ID NO: 141656 - DNA, 25 bp, Rattus norvegicus
aggaggacacggtagccatctttaa

SEQ ID NO: 141657 - DNA, 25 bp, Rattus norvegicus
aggaggacactgcagttgttccaaa

SEQ ID NO: 141658 - DNA, 25 bp, Rattus norvegicus
aggaggacactggagttgttccaaa

SEQ ID NO: 141659 - DNA, 25 bp, Rattus norvegicus
aggaggacagaaagggttcccacat

SEQ ID NO: 141660 - DNA, 25 bp, Rattus norvegicus
aggaggacagaatgggttcccacat

SEQ ID NO: 141661 - DNA, 25 bp, Rattus norvegicus
aggaggacagcaaaccactcttcgc

SEQ ID NO: 141662 - DNA, 25 bp, Rattus norvegicus
aggaggacagcataccactcttcgc

SEQ ID NO: 141663 - DNA, 25 bp, Rattus norvegicus
aggaggaccccgatggaccatcgag

SEQ ID NO: 141664 - DNA, 25 bp, Rattus norvegicus
aggaggaccccgttggaccatcgag

SEQ ID NO: 141665 - DNA, 25 bp, Rattus norvegicus
aggaggacctgaccatgtggcctca

SEQ ID NO: 141666 - DNA, 25 bp, Rattus norvegicus
aggaggacctgagcatgtggcctca

SEQ ID NO: 141667 - DNA, 25 bp, Rattus norvegicus
aggaggacctttagcattctcttca

SEQ ID NO: 141668 - DNA, 25 bp, Rattus norvegicus
aggaggaccttttgcattctcttca

SEQ ID NO: 141669 - DNA, 25 bp, Rattus norvegicus
aggaggacgagaacactgtgctgaa

SEQ ID NO: 141670 - DNA, 25 bp, Rattus norvegicus
aggaggacgagatcactgtgctgaa

SEQ ID NO: 141671 - DNA, 25 bp, Rattus norvegicus
aggaggacgcgaacgctatggtccc

SEQ ID NO: 141672 - DNA, 25 bp, Rattus norvegicus
aggaggacgcgatcgctatggtccc

SEQ ID NO: 141673 - DNA, 25 bp, Rattus norvegicus
aggaggactcctcttggtgttcttt

SEQ ID NO: 141674 - DNA, 25 bp, Rattus norvegicus
aggaggactcctgttggtgttcttt

SEQ ID NO: 141675 - DNA, 25 bp, Rattus norvegicus
aggaggactgagatcatcctacggg

SEQ ID NO: 141676 - DNA, 25 bp, Rattus norvegicus
aggaggactgagttcatcctacggg

SEQ ID NO: 141677 - DNA, 25 bp, Rattus norvegicus
aggaggactgataaactggcttttg

SEQ ID NO: 141678 - DNA, 25 bp, Rattus norvegicus
aggaggactgattaactggcttttg

SEQ ID NO: 141679 - DNA, 25 bp, Rattus norvegicus
aggaggactgccattggaccccatt

SEQ ID NO: 141680 - DNA, 25 bp, Rattus norvegicus
aggaggactgcctttggaccccatt

SEQ ID NO: 141681 - DNA, 25 bp, Rattus norvegicus
aggaggactggaactggtacacttt

SEQ ID NO: 141682 - DNA, 25 bp, Rattus norvegicus
aggaggactggatctggtacacttt

SEQ ID NO: 141683 - DNA, 25 bp, Rattus norvegicus
aggaggacttacaggacaggcatgt

SEQ ID NO: 141684 - DNA, 25 bp, Rattus norvegicus
aggaggacttactggacaggcatgt

SEQ ID NO: 141685 - DNA, 25 bp, Rattus norvegicus
aggaggacttcgatgccctagtgtc

SEQ ID NO: 141686 - DNA, 25 bp, Rattus norvegicus
aggaggacttcgttgccctagtgtc

SEQ ID NO: 141687 - DNA, 25 bp, Rattus norvegicus
aggaggagactactaccgaggacta

SEQ ID NO: 141688 - DNA, 25 bp, Rattus norvegicus
aggaggagactagtaccgaggacta

SEQ ID NO: 141689 - DNA, 25 bp, Rattus norvegicus
aggaggagagcacagccctcagcat

SEQ ID NO: 141690 - DNA, 25 bp, Rattus norvegicus
aggaggagagcagagccctcagcat

SEQ ID NO: 141691 - DNA, 25 bp, Rattus norvegicus
aggaggagatccacgtgcctcttca

SEQ ID NO: 141692 - DNA, 25 bp, Rattus norvegicus
aggaggagatcctcgtgcctcttca

SEQ ID NO: 141693 - DNA, 25 bp, Rattus norvegicus
aggaggagcagaccgacacacactt

SEQ ID NO: 141694 - DNA, 25 bp, Rattus norvegicus
aggaggagcagagcgacacacactt

SEQ ID NO: 141695 - DNA, 25 bp, Rattus norvegicus
aggaggagcataagggcaccacccc

SEQ ID NO: 141696 - DNA, 25 bp, Rattus norvegicus
aggaggagcatatgggcaccacccc

SEQ ID NO: 141697 - DNA, 25 bp, Rattus norvegicus
aggaggagcggacgccacactggct

SEQ ID NO: 141698 - DNA, 25 bp, Rattus norvegicus
aggaggagcggaggccacactggct

SEQ ID NO: 141699 - DNA, 25 bp, Rattus norvegicus
aggaggagcttaagagactccggca

SEQ ID NO: 141700 - DNA, 25 bp, Rattus norvegicus
aggaggagcttatgagactccggca

SEQ ID NO: 141701 - DNA, 25 bp, Rattus norvegicus
aggaggaggaaaacacaccagccac

SEQ ID NO: 141702 - DNA, 25 bp, Rattus norvegicus
aggaggaggaaatcacaccagccac

SEQ ID NO: 141703 - DNA, 25 bp, Rattus norvegicus
aggaggaggatgattctgccaatga

SEQ ID NO: 141704 - DNA, 25 bp, Rattus norvegicus
aggaggaggatgtttctgccaatga

SEQ ID NO: 141705 - DNA, 25 bp, Rattus norvegicus
aggaggaggcttacactgcgttcac

SEQ ID NO: 141706 - DNA, 25 bp, Rattus norvegicus
aggaggaggcttatcagtaccctgc

SEQ ID NO: 141707 - DNA, 25 bp, Rattus norvegicus
aggaggaggctttcactgcgttcac

SEQ ID NO: 141708 - DNA, 25 bp, Rattus norvegicus
aggaggaggcttttcagtaccctgc

SEQ ID NO: 141709 - DNA, 25 bp, Rattus norvegicus
aggaggagtctcctccatccactga

SEQ ID NO: 141710 - DNA, 25 bp, Rattus norvegicus
aggaggagtctcgtccatccactga

SEQ ID NO: 141711 - DNA, 25 bp, Rattus norvegicus
aggaggagtctgatcacctagtgcc

SEQ ID NO: 141712 - DNA, 25 bp, Rattus norvegicus
aggaggagtctgttcacctagtgcc

SEQ ID NO: 141713 - DNA, 25 bp, Rattus norvegicus
aggaggagtggcaccagaccgcatc

SEQ ID NO: 141714 - DNA, 25 bp, Rattus norvegicus
aggaggagtggctccagaccgcatc

SEQ ID NO: 141715 - DNA, 25 bp, Rattus norvegicus
aggaggataacaccctgctcaacca

SEQ ID NO: 141716 - DNA, 25 bp, Rattus norvegicus
aggaggataacagcctgctcaacca

SEQ ID NO: 141717 - DNA, 25 bp, Rattus norvegicus
aggaggatcacaagacccaggccaa

SEQ ID NO: 141718 - DNA, 25 bp, Rattus norvegicus
aggaggatcacatgacccaggccaa

SEQ ID NO: 141719 - DNA, 25 bp, Rattus norvegicus
aggaggatctccatgagctgtgagc

SEQ ID NO: 141720 - DNA, 25 bp, Rattus norvegicus
aggaggatctccttgagctgtgagc

SEQ ID NO: 141721 - DNA, 25 bp, Rattus norvegicus
aggaggatctctagacttcccggcc

SEQ ID NO: 141722 - DNA, 25 bp, Rattus norvegicus
aggaggatctcttgacttcccggcc

SEQ ID NO: 141723 - DNA, 25 bp, Rattus norvegicus
aggaggatgatcctgtctctgccca

SEQ ID NO: 141724 - DNA, 25 bp, Rattus norvegicus
aggaggatgatcgtgtctctgccca

SEQ ID NO: 141725 - DNA, 25 bp, Rattus norvegicus
aggaggatgccactggccaagccaa

SEQ ID NO: 141726 - DNA, 25 bp, Rattus norvegicus
aggaggatgccagtggccaagccaa

SEQ ID NO: 141727 - DNA, 25 bp, Rattus norvegicus
aggaggatggcaagtgtccccacta

SEQ ID NO: 141728 - DNA, 25 bp, Rattus norvegicus
aggaggatggcatgtgtccccacta

SEQ ID NO: 141729 - DNA, 25 bp, Rattus norvegicus
aggaggatggctacagaactggcaa

SEQ ID NO: 141730 - DNA, 25 bp, Rattus norvegicus
aggaggatggcttcagaactggcaa

SEQ ID NO: 141731 - DNA, 25 bp, Rattus norvegicus
aggaggatgttactgcccactattc

SEQ ID NO: 141732 - DNA, 25 bp, Rattus norvegicus
aggaggatgttagtgcccactattc

SEQ ID NO: 141733 - DNA, 25 bp, Rattus norvegicus
aggaggattcgcacccttggcgccg

SEQ ID NO: 141734 - DNA, 25 bp, Rattus norvegicus
aggaggattcgctcccttggcgccg

SEQ ID NO: 141735 - DNA, 25 bp, Rattus norvegicus
aggaggattgccatgctggaccctg

SEQ ID NO: 141736 - DNA, 25 bp, Rattus norvegicus
aggaggattgccttgctggaccctg

SEQ ID NO: 141737 - DNA, 25 bp, Rattus norvegicus
aggaggatttctcaacttgaggaca

SEQ ID NO: 141738 - DNA, 25 bp, Rattus norvegicus
aggaggatttctgaacttgaggaca

SEQ ID NO: 141739 - DNA, 25 bp, Rattus norvegicus
aggaggcaaagtatgtcggagaatc

SEQ ID NO: 141740 - DNA, 25 bp, Rattus norvegicus
aggaggcaaagtttgtcggagaatc

SEQ ID NO: 141741 - DNA, 25 bp, Rattus norvegicus
aggaggcaactgatctctgcagcac

SEQ ID NO: 141742 - DNA, 25 bp, Rattus norvegicus
aggaggcaactgttctctgcagcac

SEQ ID NO: 141743 - DNA, 25 bp, Rattus norvegicus
aggaggcacaggaacttgttgccaa

SEQ ID NO: 141744 - DNA, 25 bp, Rattus norvegicus
aggaggcacaggtacttgttgccaa

SEQ ID NO: 141745 - DNA, 25 bp, Rattus norvegicus
aggaggcacatgcataatctccatg

SEQ ID NO: 141746 - DNA, 25 bp, Rattus norvegicus
aggaggcacatggataatctccatg

SEQ ID NO: 141747 - DNA, 25 bp, Rattus norvegicus
aggaggcacattaactcacacaccg

SEQ ID NO: 141748 - DNA, 25 bp, Rattus norvegicus
aggaggcacatttactcacacaccg

SEQ ID NO: 141749 - DNA, 25 bp, Rattus norvegicus
aggaggcaccaacagcttctgtgat

SEQ ID NO: 141750 - DNA, 25 bp, Rattus norvegicus
aggaggcaccaagagcttctgtgat

SEQ ID NO: 141751 - DNA, 25 bp, Rattus norvegicus
aggaggcacgcaaaagggcaagttt

SEQ ID NO: 141752 - DNA, 25 bp, Rattus norvegicus
aggaggcacgcataagggcaagttt

SEQ ID NO: 141753 - DNA, 25 bp, Rattus norvegicus
aggaggcagcagactgaaccagtaa

SEQ ID NO: 141754 - DNA, 25 bp, Rattus norvegicus
aggaggcagcagtctgaaccagtaa

SEQ ID NO: 141755 - DNA, 25 bp, Rattus norvegicus
aggaggcaggctctttcagcctcta

SEQ ID NO: 141756 - DNA, 25 bp, Rattus norvegicus
aggaggcaggctgtttcagcctcta

SEQ ID NO: 141757 - DNA, 25 bp, Rattus norvegicus
aggaggcatccgatccagactcaaa

SEQ ID NO: 141758 - DNA, 25 bp, Rattus norvegicus
aggaggcatccgttccagactcaaa

SEQ ID NO: 141759 - DNA, 25 bp, Rattus norvegicus
aggaggcatctcactggtttcgtac

SEQ ID NO: 141760 - DNA, 25 bp, Rattus norvegicus
aggaggcatctctctggtttcgtac

SEQ ID NO: 141761 - DNA, 25 bp, Rattus norvegicus
aggaggcatctgagtttcctccagc

SEQ ID NO: 141762 - DNA, 25 bp, Rattus norvegicus
aggaggcatctgtgtttcctccagc

SEQ ID NO: 141763 - DNA, 25 bp, Rattus norvegicus
aggaggcatggtcatcctcactgct

SEQ ID NO: 141764 - DNA, 25 bp, Rattus norvegicus
aggaggcatggtgatcctcactgct

SEQ ID NO: 141765 - DNA, 25 bp, Rattus norvegicus
aggaggcattgtaccggcggaacct

SEQ ID NO: 141766 - DNA, 25 bp, Rattus norvegicus
aggaggcattgttccggcggaacct

SEQ ID NO: 141767 - DNA, 25 bp, Rattus norvegicus
aggaggcattttctctggcacacat

SEQ ID NO: 141768 - DNA, 25 bp, Rattus norvegicus
aggaggcattttgtctggcacacat

SEQ ID NO: 141769 - DNA, 25 bp, Rattus norvegicus
aggaggccaaacacccagctgggta

SEQ ID NO: 141770 - DNA, 25 bp, Rattus norvegicus
aggaggccaaactcccagctgggta

SEQ ID NO: 141771 - DNA, 25 bp, Rattus norvegicus
aggaggccacagatcttgctgccac

SEQ ID NO: 141772 - DNA, 25 bp, Rattus norvegicus
aggaggccacagttcttgctgccac

SEQ ID NO: 141773 - DNA, 25 bp, Rattus norvegicus
aggaggccacccagtgagtggacat

SEQ ID NO: 141774 - DNA, 25 bp, Rattus norvegicus
aggaggccaccctgtgagtggacat

SEQ ID NO: 141775 - DNA, 25 bp, Rattus norvegicus
aggaggccacctcctaacagtgcca

SEQ ID NO: 141776 - DNA, 25 bp, Rattus norvegicus
aggaggccacctgctaacagtgcca

SEQ ID NO: 141777 - DNA, 25 bp, Rattus norvegicus
aggaggccagcgaggcctaccttgt

SEQ ID NO: 141778 - DNA, 25 bp, Rattus norvegicus
aggaggccagcgtggcctaccttgt

SEQ ID NO: 141779 - DNA, 25 bp, Rattus norvegicus
aggaggccatcccagagcaccagat

SEQ ID NO: 141780 - DNA, 25 bp, Rattus norvegicus
aggaggccatccgagagcaccagat

SEQ ID NO: 141781 - DNA, 25 bp, Rattus norvegicus
aggaggccattgagtcagcgttagc

SEQ ID NO: 141782 - DNA, 25 bp, Rattus norvegicus
aggaggccattgtgtcagcgttagc

SEQ ID NO: 141783 - DNA, 25 bp, Rattus norvegicus
aggaggccatttaaggtcatgtagt

SEQ ID NO: 141784 - DNA, 25 bp, Rattus norvegicus
aggaggccattttaggtcatgtagt

SEQ ID NO: 141785 - DNA, 25 bp, Rattus norvegicus
aggaggcccagcagagaactgacat

SEQ ID NO: 141786 - DNA, 25 bp, Rattus norvegicus
aggaggcccagctgagaactgacat

SEQ ID NO: 141787 - DNA, 25 bp, Rattus norvegicus
aggaggcccaggacctgcagatcct

SEQ ID NO: 141788 - DNA, 25 bp, Rattus norvegicus
aggaggcccaggtcctgcagatcct

SEQ ID NO: 141789 - DNA, 25 bp, Rattus norvegicus
aggaggcccatgagcttcttagcac

SEQ ID NO: 141790 - DNA, 25 bp, Rattus norvegicus
aggaggcccatgtgcttcttagcac

SEQ ID NO: 141791 - DNA, 25 bp, Rattus norvegicus
aggaggcccctgaccctaatagcct

SEQ ID NO: 141792 - DNA, 25 bp, Rattus norvegicus
aggaggcccctgtccctaatagcct

SEQ ID NO: 141793 - DNA, 25 bp, Rattus norvegicus
aggaggccctagagctggactccat

SEQ ID NO: 141794 - DNA, 25 bp, Rattus norvegicus
aggaggccctagtgctggactccat

SEQ ID NO: 141795 - DNA, 25 bp, Rattus norvegicus
aggaggccctgtcgcaaagctgcca

SEQ ID NO: 141796 - DNA, 25 bp, Rattus norvegicus
aggaggccctgtggcaaagctgcca

SEQ ID NO: 141797 - DNA, 25 bp, Rattus norvegicus
aggaggcccttacacttcgaagtga

SEQ ID NO: 141798 - DNA, 25 bp, Rattus norvegicus
aggaggcccttagacttcgaagtga

SEQ ID NO: 141799 - DNA, 25 bp, Rattus norvegicus
aggaggccgaccaacagaggaaaca

SEQ ID NO: 141800 - DNA, 25 bp, Rattus norvegicus
aggaggccgacctacagaggaaaca

SEQ ID NO: 141801 - DNA, 25 bp, Rattus norvegicus
aggaggccgagaacccatcaaaccc

SEQ ID NO: 141802 - DNA, 25 bp, Rattus norvegicus
aggaggccgagatcccatcaaaccc

SEQ ID NO: 141803 - DNA, 25 bp, Rattus norvegicus
aggaggccggagcactctgtacaca

SEQ ID NO: 141804 - DNA, 25 bp, Rattus norvegicus
aggaggccggagctgagcctgcaga

SEQ ID NO: 141805 - DNA, 25 bp, Rattus norvegicus
aggaggccggaggactctgtacaca

SEQ ID NO: 141806 - DNA, 25 bp, Rattus norvegicus
aggaggccggaggtgagcctgcaga

SEQ ID NO: 141807 - DNA, 25 bp, Rattus norvegicus
aggaggccgtggacagacttccaac

SEQ ID NO: 141808 - DNA, 25 bp, Rattus norvegicus
aggaggccgtggtcagacttccaac

SEQ ID NO: 141809 - DNA, 25 bp, Rattus norvegicus
aggaggcctatgacctggcccgccg

SEQ ID NO: 141810 - DNA, 25 bp, Rattus norvegicus
aggaggcctatgtcctggcccgccg

SEQ ID NO: 141811 - DNA, 25 bp, Rattus norvegicus
aggaggcctccaagctctaccatga

SEQ ID NO: 141812 - DNA, 25 bp, Rattus norvegicus
aggaggcctccatgctctaccatga

SEQ ID NO: 141813 - DNA, 25 bp, Rattus norvegicus
aggaggcctctaagtgccctcaaga

SEQ ID NO: 141814 - DNA, 25 bp, Rattus norvegicus
aggaggcctctatgtgccctcaaga

SEQ ID NO: 141815 - DNA, 25 bp, Rattus norvegicus
aggaggcctgatctgctgtgctcaa

SEQ ID NO: 141816 - DNA, 25 bp, Rattus norvegicus
aggaggcctgatgtgctgtgctcaa

SEQ ID NO: 141817 - DNA, 25 bp, Rattus norvegicus
aggaggcctgtgacacgtccttcaa

SEQ ID NO: 141818 - DNA, 25 bp, Rattus norvegicus
aggaggcctgtgtcacgtccttcaa

SEQ ID NO: 141819 - DNA, 25 bp, Rattus norvegicus
aggaggcgacctactcagagacaac

SEQ ID NO: 141820 - DNA, 25 bp, Rattus norvegicus
aggaggcgaccttctcagagacaac

SEQ ID NO: 141821 - DNA, 25 bp, Rattus norvegicus
aggaggcggctccaggccttgggag

SEQ ID NO: 141822 - DNA, 25 bp, Rattus norvegicus
aggaggcggctcgaggccttgggag

SEQ ID NO: 141823 - DNA, 25 bp, Rattus norvegicus
aggaggcgggctccaaacttcgcat

SEQ ID NO: 141824 - DNA, 25 bp, Rattus norvegicus
aggaggcgggctgcaaacttcgcat

SEQ ID NO: 141825 - DNA, 25 bp, Rattus norvegicus
aggaggcggtgcagttcctgaccct

SEQ ID NO: 141826 - DNA, 25 bp, Rattus norvegicus
aggaggcggtgctgttcctgaccct

SEQ ID NO: 141827 - DNA, 25 bp, Rattus norvegicus
aggaggctatggatcccttgggtct

SEQ ID NO: 141828 - DNA, 25 bp, Rattus norvegicus
aggaggctatggttcccttgggtct

SEQ ID NO: 141829 - DNA, 25 bp, Rattus norvegicus
aggaggctcagaacaccaggcgcaa

SEQ ID NO: 141830 - DNA, 25 bp, Rattus norvegicus
aggaggctcagatcaccaggcgcaa

SEQ ID NO: 141831 - DNA, 25 bp, Rattus norvegicus
aggaggctccagaccaggagcagct

SEQ ID NO: 141832 - DNA, 25 bp, Rattus norvegicus
aggaggctccagatctggagtagct

SEQ ID NO: 141833 - DNA, 25 bp, Rattus norvegicus
aggaggctccagtccaggagcagct

SEQ ID NO: 141834 - DNA, 25 bp, Rattus norvegicus
aggaggctccagttctggagtagct

SEQ ID NO: 141835 - DNA, 25 bp, Rattus norvegicus
aggaggctccctagcttccacagct

SEQ ID NO: 141836 - DNA, 25 bp, Rattus norvegicus
aggaggctcccttgcttccacagct

SEQ ID NO: 141837 - DNA, 25 bp, Rattus norvegicus
aggaggctcctcactgagaatggcc

SEQ ID NO: 141838 - DNA, 25 bp, Rattus norvegicus
aggaggctcctctctgagaatggcc

SEQ ID NO: 141839 - DNA, 25 bp, Rattus norvegicus
aggaggctcctgactgaggtaccgc

SEQ ID NO: 141840 - DNA, 25 bp, Rattus norvegicus
aggaggctcctgtctgaggtaccgc

SEQ ID NO: 141841 - DNA, 25 bp, Rattus norvegicus
aggaggctccttataatcacttcga

SEQ ID NO: 141842 - DNA, 25 bp, Rattus norvegicus
aggaggctccttttaatcacttcga

SEQ ID NO: 141843 - DNA, 25 bp, Rattus norvegicus
aggaggctcgaaatgctgccatggc

SEQ ID NO: 141844 - DNA, 25 bp, Rattus norvegicus
aggaggctcgaattgctgccatggc

SEQ ID NO: 141845 - DNA, 25 bp, Rattus norvegicus
aggaggctctacagcgtcaactaac

SEQ ID NO: 141846 - DNA, 25 bp, Rattus norvegicus
aggaggctctactgcgtcaactaac

SEQ ID NO: 141847 - DNA, 25 bp, Rattus norvegicus
aggaggctctgactgttctctctct

SEQ ID NO: 141848 - DNA, 25 bp, Rattus norvegicus
aggaggctctgagtgttctctctct

SEQ ID NO: 141849 - DNA, 25 bp, Rattus norvegicus
aggaggctctgcagcttagctttac

SEQ ID NO: 141850 - DNA, 25 bp, Rattus norvegicus
aggaggctctgccaacctgtagctg

SEQ ID NO: 141851 - DNA, 25 bp, Rattus norvegicus
aggaggctctgcgaacctgtagctg

SEQ ID NO: 141852 - DNA, 25 bp, Rattus norvegicus
aggaggctctgctgcttagctttac

SEQ ID NO: 141853 - DNA, 25 bp, Rattus norvegicus
aggaggctgaaacttggcaccacca

SEQ ID NO: 141854 - DNA, 25 bp, Rattus norvegicus
aggaggctgaaagttggcaccacca

SEQ ID NO: 141855 - DNA, 25 bp, Rattus norvegicus
aggaggctgaagacagaccctggcc

SEQ ID NO: 141856 - DNA, 25 bp, Rattus norvegicus
aggaggctgaagtcagaccctggcc

SEQ ID NO: 141857 - DNA, 25 bp, Rattus norvegicus
aggaggctgaccctgacctacagag

SEQ ID NO: 141858 - DNA, 25 bp, Rattus norvegicus
aggaggctgaccgtgacctacagag

SEQ ID NO: 141859 - DNA, 25 bp, Rattus norvegicus
aggaggctgagacagcacatcttca

SEQ ID NO: 141860 - DNA, 25 bp, Rattus norvegicus
aggaggctgagagagcacatcttca

SEQ ID NO: 141861 - DNA, 25 bp, Rattus norvegicus
aggaggctgctcatcctgatttatc

SEQ ID NO: 141862 - DNA, 25 bp, Rattus norvegicus
aggaggctgctcttcctgatttatc

SEQ ID NO: 141863 - DNA, 25 bp, Rattus norvegicus
aggaggctggccacaatttggagta

SEQ ID NO: 141864 - DNA, 25 bp, Rattus norvegicus
aggaggctggcctcaatttggagta

SEQ ID NO: 141865 - DNA, 25 bp, Rattus norvegicus
aggaggctgtctctgaaactataca

SEQ ID NO: 141866 - DNA, 25 bp, Rattus norvegicus
aggaggctgtctgtgaaactataca

SEQ ID NO: 141867 - DNA, 25 bp, Rattus norvegicus
aggaggctgttgcagaatttctaga

SEQ ID NO: 141868 - DNA, 25 bp, Rattus norvegicus
aggaggctgttggagaatttctaga

SEQ ID NO: 141869 - DNA, 25 bp, Rattus norvegicus
aggaggcttcctcacagatgttttg

SEQ ID NO: 141870 - DNA, 25 bp, Rattus norvegicus
aggaggcttcctcctccggaggaca

SEQ ID NO: 141871 - DNA, 25 bp, Rattus norvegicus
aggaggcttcctgacagatgttttg

SEQ ID NO: 141872 - DNA, 25 bp, Rattus norvegicus
aggaggcttcctgctccggaggaca

SEQ ID NO: 141873 - DNA, 25 bp, Rattus norvegicus
aggaggcttctgaatgcttgtgaaa

SEQ ID NO: 141874 - DNA, 25 bp, Rattus norvegicus
aggaggcttctgtatgcttgtgaaa

SEQ ID NO: 141875 - DNA, 25 bp, Rattus norvegicus
aggaggcttgttatgttaatcggca

SEQ ID NO: 141876 - DNA, 25 bp, Rattus norvegicus
aggaggcttgttttgttaatcggca

SEQ ID NO: 141877 - DNA, 25 bp, Rattus norvegicus
aggaggctttcaccaatgccatcac

SEQ ID NO: 141878 - DNA, 25 bp, Rattus norvegicus
aggaggctttcagcaatgccatcac

SEQ ID NO: 141879 - DNA, 25 bp, Rattus norvegicus
aggaggctttcccttttggaagatg

SEQ ID NO: 141880 - DNA, 25 bp, Rattus norvegicus
aggaggctttccgttttggaagatg

SEQ ID NO: 141881 - DNA, 25 bp, Rattus norvegicus
aggagggaaagcacttccagctcta

SEQ ID NO: 141882 - DNA, 25 bp, Rattus norvegicus
aggagggaaagctcttccagctcta

SEQ ID NO: 141883 - DNA, 25 bp, Rattus norvegicus
aggagggaacttaccgcagctccat

SEQ ID NO: 141884 - DNA, 25 bp, Rattus norvegicus
aggagggaactttccgcagctccat

SEQ ID NO: 141885 - DNA, 25 bp, Rattus norvegicus
aggagggaccacactttaccaggct

SEQ ID NO: 141886 - DNA, 25 bp, Rattus norvegicus
aggagggaccactctttaccaggct

SEQ ID NO: 141887 - DNA, 25 bp, Rattus norvegicus
aggagggacctgaagcctctggttt

SEQ ID NO: 141888 - DNA, 25 bp, Rattus norvegicus
aggagggacctgtagcctctggttt

SEQ ID NO: 141889 - DNA, 25 bp, Rattus norvegicus
aggagggactccacctgggcatgca

SEQ ID NO: 141890 - DNA, 25 bp, Rattus norvegicus
aggagggactcctcctgggcatgca

SEQ ID NO: 141891 - DNA, 25 bp, Rattus norvegicus
aggagggagccccactggcagcaca

SEQ ID NO: 141892 - DNA, 25 bp, Rattus norvegicus
aggagggagcccgactggcagcaca

SEQ ID NO: 141893 - DNA, 25 bp, Rattus norvegicus
aggagggaggccacaactccgagct

SEQ ID NO: 141894 - DNA, 25 bp, Rattus norvegicus
aggagggaggcctcaactccgagct

SEQ ID NO: 141895 - DNA, 25 bp, Rattus norvegicus
aggagggagtttcttgcctgtcata

SEQ ID NO: 141896 - DNA, 25 bp, Rattus norvegicus
aggagggagtttgttgcctgtcata

SEQ ID NO: 141897 - DNA, 25 bp, Rattus norvegicus
aggagggatagcaccgcatcatgtt

SEQ ID NO: 141898 - DNA, 25 bp, Rattus norvegicus
aggagggatagctccgcatcatgtt

SEQ ID NO: 141899 - DNA, 25 bp, Rattus norvegicus
aggagggatgaacgccacccagtca

SEQ ID NO: 141900 - DNA, 25 bp, Rattus norvegicus
aggagggatgaaggccacccagtca

SEQ ID NO: 141901 - DNA, 25 bp, Rattus norvegicus
aggagggcaaacattcctgggcgct

SEQ ID NO: 141902 - DNA, 25 bp, Rattus norvegicus
aggagggcaaactttcctgggcgct

SEQ ID NO: 141903 - DNA, 25 bp, Rattus norvegicus
aggagggcaaatcctgtcaccacca

SEQ ID NO: 141904 - DNA, 25 bp, Rattus norvegicus
aggagggcaaatgctgtcaccacca

SEQ ID NO: 141905 - DNA, 25 bp, Rattus norvegicus
aggagggcacacagtgacacggaaa

SEQ ID NO: 141906 - DNA, 25 bp, Rattus norvegicus
aggagggcacactgtgacacggaaa

SEQ ID NO: 141907 - DNA, 25 bp, Rattus norvegicus
aggagggcacagcagtctgaccaca

SEQ ID NO: 141908 - DNA, 25 bp, Rattus norvegicus
aggagggcacaggagtctgaccaca

SEQ ID NO: 141909 - DNA, 25 bp, Rattus norvegicus
aggagggcactgagcttcgtgatct

SEQ ID NO: 141910 - DNA, 25 bp, Rattus norvegicus
aggagggcactgtgcttcgtgatct

SEQ ID NO: 141911 - DNA, 25 bp, Rattus norvegicus
aggagggcagcactttcacccactt

SEQ ID NO: 141912 - DNA, 25 bp, Rattus norvegicus
aggagggcagcagtttcacccactt

SEQ ID NO: 141913 - DNA, 25 bp, Rattus norvegicus
aggagggcagccacttgattgcttc

SEQ ID NO: 141914 - DNA, 25 bp, Rattus norvegicus
aggagggcagcctcttgattgcttc

SEQ ID NO: 141915 - DNA, 25 bp, Rattus norvegicus
aggagggcagctattttgtgtgttc

SEQ ID NO: 141916 - DNA, 25 bp, Rattus norvegicus
aggagggcagcttttttgtgtgttc

SEQ ID NO: 141917 - DNA, 25 bp, Rattus norvegicus
aggagggccatgcagctaacccacc

SEQ ID NO: 141918 - DNA, 25 bp, Rattus norvegicus
aggagggccatggagctaacccacc

SEQ ID NO: 141919 - DNA, 25 bp, Rattus norvegicus
aggagggcgccaattatgtcacagt

SEQ ID NO: 141920 - DNA, 25 bp, Rattus norvegicus
aggagggcgccatttatgtcacagt

SEQ ID NO: 141921 - DNA, 25 bp, Rattus norvegicus
aggagggcgctgcaaatccaacgca

SEQ ID NO: 141922 - DNA, 25 bp, Rattus norvegicus
aggagggcgctggaaatccaacgca

SEQ ID NO: 141923 - DNA, 25 bp, Rattus norvegicus
aggagggctcatcgcttctattttc

SEQ ID NO: 141924 - DNA, 25 bp, Rattus norvegicus
aggagggctcatggcttctattttc

SEQ ID NO: 141925 - DNA, 25 bp, Rattus norvegicus
aggagggctctgcagcagccaaaac

SEQ ID NO: 141926 - DNA, 25 bp, Rattus norvegicus
aggagggctctggagcagccaaaac

SEQ ID NO: 141927 - DNA, 25 bp, Rattus norvegicus
aggagggctgagcttgttcctaccc

SEQ ID NO: 141928 - DNA, 25 bp, Rattus norvegicus
aggagggctgaggttgttcctaccc

SEQ ID NO: 141929 - DNA, 25 bp, Rattus norvegicus
aggagggctgatacccaaggagaat

SEQ ID NO: 141930 - DNA, 25 bp, Rattus norvegicus
aggagggctgattcccaaggagaat

SEQ ID NO: 141931 - DNA, 25 bp, Rattus norvegicus
aggaggggcagcctccgttcccaca

SEQ ID NO: 141932 - DNA, 25 bp, Rattus norvegicus
aggaggggcagcgtccgttcccaca

SEQ ID NO: 141933 - DNA, 25 bp, Rattus norvegicus
aggagggtatacatgccctcaccct

SEQ ID NO: 141934 - DNA, 25 bp, Rattus norvegicus
aggagggtatacttgccctcaccct

SEQ ID NO: 141935 - DNA, 25 bp, Rattus norvegicus
aggagggtccacagagctgtccccg

SEQ ID NO: 141936 - DNA, 25 bp, Rattus norvegicus
aggagggtccactgagctgtccccg

SEQ ID NO: 141937 - DNA, 25 bp, Rattus norvegicus
aggagggtccttccagctgttctat

SEQ ID NO: 141938 - DNA, 25 bp, Rattus norvegicus
aggagggtccttgcagctgttctat

SEQ ID NO: 141939 - DNA, 25 bp, Rattus norvegicus
aggagggtctacagtggtcaatcat

SEQ ID NO: 141940 - DNA, 25 bp, Rattus norvegicus
aggagggtctactgtggtcaatcat

SEQ ID NO: 141941 - DNA, 25 bp, Rattus norvegicus
aggagggtgacccatcctgtccaag

SEQ ID NO: 141942 - DNA, 25 bp, Rattus norvegicus
aggagggtgaccgatcctgtccaag

SEQ ID NO: 141943 - DNA, 25 bp, Rattus norvegicus
aggagggtgccacatcacctcatta

SEQ ID NO: 141944 - DNA, 25 bp, Rattus norvegicus
aggagggtgccagatcacctcatta

SEQ ID NO: 141945 - DNA, 25 bp, Rattus norvegicus
aggagggtgcgccaccttaactgct

SEQ ID NO: 141946 - DNA, 25 bp, Rattus norvegicus
aggagggtgcgcgaccttaactgct

SEQ ID NO: 141947 - DNA, 25 bp, Rattus norvegicus
aggagggtttctctctcagctggtc

SEQ ID NO: 141948 - DNA, 25 bp, Rattus norvegicus
aggagggtttctgtctcagctggtc

SEQ ID NO: 141949 - DNA, 25 bp, Rattus norvegicus
aggaggtaccagactctgatgccgt

SEQ ID NO: 141950 - DNA, 25 bp, Rattus norvegicus
aggaggtaccagtctctgatgccgt

SEQ ID NO: 141951 - DNA, 25 bp, Rattus norvegicus
aggaggtactcaactccagcctgga

SEQ ID NO: 141952 - DNA, 25 bp, Rattus norvegicus
aggaggtactcatctccagcctgga

SEQ ID NO: 141953 - DNA, 25 bp, Rattus norvegicus
aggaggtatttcatcatcgtgatag

SEQ ID NO: 141954 - DNA, 25 bp, Rattus norvegicus
aggaggtatttcttcatcgtgatag

SEQ ID NO: 141955 - DNA, 25 bp, Rattus norvegicus
aggaggtcaaggctcttggccacca

SEQ ID NO: 141956 - DNA, 25 bp, Rattus norvegicus
aggaggtcaagggtcttggccacca

SEQ ID NO: 141957 - DNA, 25 bp, Rattus norvegicus
aggaggtccctacagtcttctattt

SEQ ID NO: 141958 - DNA, 25 bp, Rattus norvegicus
aggaggtccctagagtcttctattt

SEQ ID NO: 141959 - DNA, 25 bp, Rattus norvegicus
aggaggtccgaaccaagcttcgcat

SEQ ID NO: 141960 - DNA, 25 bp, Rattus norvegicus
aggaggtccgaagcaagcttcgcat

SEQ ID NO: 141961 - DNA, 25 bp, Rattus norvegicus
aggaggtcctccagtggcaggcaat

SEQ ID NO: 141962 - DNA, 25 bp, Rattus norvegicus
aggaggtcctcctgtggcaggcaat

SEQ ID NO: 141963 - DNA, 25 bp, Rattus norvegicus
aggaggtcctgcaagccatgcgaag

SEQ ID NO: 141964 - DNA, 25 bp, Rattus norvegicus
aggaggtcctgcaggcctgcactaa

SEQ ID NO: 141965 - DNA, 25 bp, Rattus norvegicus
aggaggtcctgctagccatgcgaag

SEQ ID NO: 141966 - DNA, 25 bp, Rattus norvegicus
aggaggtcctgctggcctgcactaa

SEQ ID NO: 141967 - DNA, 25 bp, Rattus norvegicus
aggaggtctaaaagtcttcccagaa

SEQ ID NO: 141968 - DNA, 25 bp, Rattus norvegicus
aggaggtctaaatgtcttcccagaa

SEQ ID NO: 141969 - DNA, 25 bp, Rattus norvegicus
aggaggtctacactcactttacctg

SEQ ID NO: 141970 - DNA, 25 bp, Rattus norvegicus
aggaggtctacagtcactttacctg

SEQ ID NO: 141971 - DNA, 25 bp, Rattus norvegicus
aggaggtctcctacatggcagtgat

SEQ ID NO: 141972 - DNA, 25 bp, Rattus norvegicus
aggaggtctccttcatggcagtgat

SEQ ID NO: 141973 - DNA, 25 bp, Rattus norvegicus
aggaggtctgccagccagtgatgtt

SEQ ID NO: 141974 - DNA, 25 bp, Rattus norvegicus
aggaggtctgcctgccagtgatgtt

SEQ ID NO: 141975 - DNA, 25 bp, Rattus norvegicus
aggaggtgacctccacagtgtgcca

SEQ ID NO: 141976 - DNA, 25 bp, Rattus norvegicus
aggaggtgacctgcacagtgtgcca

SEQ ID NO: 141977 - DNA, 25 bp, Rattus norvegicus
aggaggtgatcccaagatctcccga

SEQ ID NO: 141978 - DNA, 25 bp, Rattus norvegicus
aggaggtgatccgaagatctcccga

SEQ ID NO: 141979 - DNA, 25 bp, Rattus norvegicus
aggaggtgcaggcacctcccactct

SEQ ID NO: 141980 - DNA, 25 bp, Rattus norvegicus
aggaggtgcagggacctcccactct

SEQ ID NO: 141981 - DNA, 25 bp, Rattus norvegicus
aggaggtgctccacgttggcctttc

SEQ ID NO: 141982 - DNA, 25 bp, Rattus norvegicus
aggaggtgctcctcgttggcctttc

SEQ ID NO: 141983 - DNA, 25 bp, Rattus norvegicus
aggaggtgctctcgctaccctgaaa

SEQ ID NO: 141984 - DNA, 25 bp, Rattus norvegicus
aggaggtgctctggctaccctgaaa

SEQ ID NO: 141985 - DNA, 25 bp, Rattus norvegicus
aggaggtgctgacccaagtcttcag

SEQ ID NO: 141986 - DNA, 25 bp, Rattus norvegicus
aggaggtgctgagccaagtcttcag

SEQ ID NO: 141987 - DNA, 25 bp, Rattus norvegicus
aggaggtggacgatagcccagccca

SEQ ID NO: 141988 - DNA, 25 bp, Rattus norvegicus
aggaggtggacgttagcccagccca

SEQ ID NO: 141989 - DNA, 25 bp, Rattus norvegicus
aggaggtggtcccagagctccacaa

SEQ ID NO: 141990 - DNA, 25 bp, Rattus norvegicus
aggaggtggtccgagagctccacaa

SEQ ID NO: 141991 - DNA, 25 bp, Rattus norvegicus
aggaggtgtcccagtgttttaatgt

SEQ ID NO: 141992 - DNA, 25 bp, Rattus norvegicus
aggaggtgtccctgtgttttaatgt

SEQ ID NO: 141993 - DNA, 25 bp, Rattus norvegicus
aggaggtgtgggaatctctgtcttt

SEQ ID NO: 141994 - DNA, 25 bp, Rattus norvegicus
aggaggtgtgggtatctctgtcttt

SEQ ID NO: 141995 - DNA, 25 bp, Rattus norvegicus
aggaggttatccacagctgcactga

SEQ ID NO: 141996 - DNA, 25 bp, Rattus norvegicus
aggaggttatcctcagctgcactga

SEQ ID NO: 141997 - DNA, 25 bp, Rattus norvegicus
aggaggttcagccacactaataatg

SEQ ID NO: 141998 - DNA, 25 bp, Rattus norvegicus
aggaggttcagcgacactaataatg

SEQ ID NO: 141999 - DNA, 25 bp, Rattus norvegicus
aggaggttcatcagatacaatctgt

SEQ ID NO: 142000 - DNA, 25 bp, Rattus norvegicus
aggaggttcatctgatacaatctgt

SEQ ID NO: 142001 - DNA, 25 bp, Rattus norvegicus
aggaggttccacaccactccagtga

SEQ ID NO: 142002 - DNA, 25 bp, Rattus norvegicus
aggaggttccactccactccagtga

SEQ ID NO: 142003 - DNA, 25 bp, Rattus norvegicus
aggaggttcgcaaggcagctcatgt

SEQ ID NO: 142004 - DNA, 25 bp, Rattus norvegicus
aggaggttcgcatggcagctcatgt

SEQ ID NO: 142005 - DNA, 25 bp, Rattus norvegicus
aggaggttctacaggcgctgatact

SEQ ID NO: 142006 - DNA, 25 bp, Rattus norvegicus
aggaggttctactggcgctgatact

SEQ ID NO: 142007 - DNA, 25 bp, Rattus norvegicus
aggaggttgagaatgcccactgcca

SEQ ID NO: 142008 - DNA, 25 bp, Rattus norvegicus
aggaggttgagattgcccactgcca

SEQ ID NO: 142009 - DNA, 25 bp, Rattus norvegicus
aggaggttgccacccagatgccagt

SEQ ID NO: 142010 - DNA, 25 bp, Rattus norvegicus
aggaggttgccagccagatgccagt

SEQ ID NO: 142011 - DNA, 25 bp, Rattus norvegicus
aggaggttgcctacatctctctcta

SEQ ID NO: 142012 - DNA, 25 bp, Rattus norvegicus
aggaggttgccttcatctctctcta

SEQ ID NO: 142013 - DNA, 25 bp, Rattus norvegicus
aggaggttgctgagagtccctgacc

SEQ ID NO: 142014 - DNA, 25 bp, Rattus norvegicus
aggaggttgctgtgagtccctgacc

SEQ ID NO: 142015 - DNA, 25 bp, Rattus norvegicus
aggaggtttgctccgtctttatact

SEQ ID NO: 142016 - DNA, 25 bp, Rattus norvegicus
aggaggtttgctgcgtctttatact

SEQ ID NO: 142017 - DNA, 25 bp, Rattus norvegicus
aggaggttttgacacaccactctgc

SEQ ID NO: 142018 - DNA, 25 bp, Rattus norvegicus
aggaggttttgagacaccactctgc

SEQ ID NO: 142019 - DNA, 25 bp, Rattus norvegicus
aggaggtttttgagcttctagatat

SEQ ID NO: 142020 - DNA, 25 bp, Rattus norvegicus
aggaggtttttgtgcttctagatat

SEQ ID NO: 142021 - DNA, 25 bp, Rattus norvegicus
aggagtaaaggaatctgcccacctc

SEQ ID NO: 142022 - DNA, 25 bp, Rattus norvegicus
aggagtaaaggattctgcccacctc

SEQ ID NO: 142023 - DNA, 25 bp, Rattus norvegicus
aggagtaaccccagttctgaacact

SEQ ID NO: 142024 - DNA, 25 bp, Rattus norvegicus
aggagtaacccctgttctgaacact

SEQ ID NO: 142025 - DNA, 25 bp, Rattus norvegicus
aggagtacaaggaggctcattccct

SEQ ID NO: 142026 - DNA, 25 bp, Rattus norvegicus
aggagtacaaggtggctcattccct

SEQ ID NO: 142027 - DNA, 25 bp, Rattus norvegicus
aggagtacagcaactcggcagcggc

SEQ ID NO: 142028 - DNA, 25 bp, Rattus norvegicus
aggagtacagcatctcggcagcggc

SEQ ID NO: 142029 - DNA, 25 bp, Rattus norvegicus
aggagtacatcgatgccttctcaga

SEQ ID NO: 142030 - DNA, 25 bp, Rattus norvegicus
aggagtacatcgttgccttctcaga

SEQ ID NO: 142031 - DNA, 25 bp, Rattus norvegicus
aggagtaccagcaccgtgttgctga

SEQ ID NO: 142032 - DNA, 25 bp, Rattus norvegicus
aggagtaccagctccgtgttgctga

SEQ ID NO: 142033 - DNA, 25 bp, Rattus norvegicus
aggagtacccctcgagatggtgcat

SEQ ID NO: 142034 - DNA, 25 bp, Rattus norvegicus
aggagtacccctggagatggtgcat

SEQ ID NO: 142035 - DNA, 25 bp, Rattus norvegicus
aggagtacgaagcagccctttctgg

SEQ ID NO: 142036 - DNA, 25 bp, Rattus norvegicus
aggagtacgaaggagccctttctgg

SEQ ID NO: 142037 - DNA, 25 bp, Rattus norvegicus
aggagtacgagcaacgcctggccat

SEQ ID NO: 142038 - DNA, 25 bp, Rattus norvegicus
aggagtacgagctacgcctggccat

SEQ ID NO: 142039 - DNA, 25 bp, Rattus norvegicus
aggagtactcgaagtccatggacga

SEQ ID NO: 142040 - DNA, 25 bp, Rattus norvegicus
aggagtactcgatgtccatggacga

SEQ ID NO: 142041 - DNA, 25 bp, Rattus norvegicus
aggagtactgatctgagctctcacc

SEQ ID NO: 142042 - DNA, 25 bp, Rattus norvegicus
aggagtactgatgtgagctctcacc

SEQ ID NO: 142043 - DNA, 25 bp, Rattus norvegicus
aggagtacttcgagtgggcagcaca

SEQ ID NO: 142044 - DNA, 25 bp, Rattus norvegicus
aggagtacttcgtgtgggcagcaca

SEQ ID NO: 142045 - DNA, 25 bp, Rattus norvegicus
aggagtacttggacacagccaggaa

SEQ ID NO: 142046 - DNA, 25 bp, Rattus norvegicus
aggagtacttggtcacagccaggaa

SEQ ID NO: 142047 - DNA, 25 bp, Rattus norvegicus
aggagtagaaagcacacccatgttt

SEQ ID NO: 142048 - DNA, 25 bp, Rattus norvegicus
aggagtagaaaggacacccatgttt

SEQ ID NO: 142049 - DNA, 25 bp, Rattus norvegicus
aggagtagaactagctgtccctttg

SEQ ID NO: 142050 - DNA, 25 bp, Rattus norvegicus
aggagtagaacttgctgtccctttg

SEQ ID NO: 142051 - DNA, 25 bp, Rattus norvegicus
aggagtagagttagcttcctgccct

SEQ ID NO: 142052 - DNA, 25 bp, Rattus norvegicus
aggagtagagtttgcttcctgccct

SEQ ID NO: 142053 - DNA, 25 bp, Rattus norvegicus
aggagtagcagacctggctcattcc

SEQ ID NO: 142054 - DNA, 25 bp, Rattus norvegicus
aggagtagcagagctggctcattcc

SEQ ID NO: 142055 - DNA, 25 bp, Rattus norvegicus
aggagtatcaccatcaccactgtct

SEQ ID NO: 142056 - DNA, 25 bp, Rattus norvegicus
aggagtatcaccttcaccactgtct

SEQ ID NO: 142057 - DNA, 25 bp, Rattus norvegicus
aggagtatcagcactgtagcccagc

SEQ ID NO: 142058 - DNA, 25 bp, Rattus norvegicus
aggagtatcagcagatcaccaccgg

SEQ ID NO: 142059 - DNA, 25 bp, Rattus norvegicus
aggagtatcagcaggccgtacagca

SEQ ID NO: 142060 - DNA, 25 bp, Rattus norvegicus
aggagtatcagctctgtagcccagc

SEQ ID NO: 142061 - DNA, 25 bp, Rattus norvegicus
aggagtatcagctgatcaccaccgg

SEQ ID NO: 142062 - DNA, 25 bp, Rattus norvegicus
aggagtatcagctggccgtacagca

SEQ ID NO: 142063 - DNA, 25 bp, Rattus norvegicus
aggagtatcatcagtgggagctgct

SEQ ID NO: 142064 - DNA, 25 bp, Rattus norvegicus
aggagtatcatctgtgggagctgct

SEQ ID NO: 142065 - DNA, 25 bp, Rattus norvegicus
aggagtatcattactcatcctgcct

SEQ ID NO: 142066 - DNA, 25 bp, Rattus norvegicus
aggagtatcatttctcatcctgcct

SEQ ID NO: 142067 - DNA, 25 bp, Rattus norvegicus
aggagtatcccgatttctagagatt

SEQ ID NO: 142068 - DNA, 25 bp, Rattus norvegicus
aggagtatcccgttttctagagatt

SEQ ID NO: 142069 - DNA, 25 bp, Rattus norvegicus
aggagtatctccaggactcatctac

SEQ ID NO: 142070 - DNA, 25 bp, Rattus norvegicus
aggagtatctcctggactcatctac

SEQ ID NO: 142071 - DNA, 25 bp, Rattus norvegicus
aggagtatgggaacagcagcagaat

SEQ ID NO: 142072 - DNA, 25 bp, Rattus norvegicus
aggagtatgggatcagcagcagaat

SEQ ID NO: 142073 - DNA, 25 bp, Rattus norvegicus
aggagtatgtgacatgcgagcccca

SEQ ID NO: 142074 - DNA, 25 bp, Rattus norvegicus
aggagtatgtgagatgcgagcccca

SEQ ID NO: 142075 - DNA, 25 bp, Rattus norvegicus
aggagtcaaagcctctccgtagcgc

SEQ ID NO: 142076 - DNA, 25 bp, Rattus norvegicus
aggagtcaaagcgtctccgtagcgc

SEQ ID NO: 142077 - DNA, 25 bp, Rattus norvegicus
aggagtcaaattcagttcctgagca

SEQ ID NO: 142078 - DNA, 25 bp, Rattus norvegicus
aggagtcaaattgagttcctgagca

SEQ ID NO: 142079 - DNA, 25 bp, Rattus norvegicus
aggagtcaacctcgacaccaatgat

SEQ ID NO: 142080 - DNA, 25 bp, Rattus norvegicus
aggagtcaacctggacaccaatgat

SEQ ID NO: 142081 - DNA, 25 bp, Rattus norvegicus
aggagtcaagtgctggtcctcacct

SEQ ID NO: 142082 - DNA, 25 bp, Rattus norvegicus
aggagtcaagtggtggtcctcacct

SEQ ID NO: 142083 - DNA, 25 bp, Rattus norvegicus
aggagtcacagacctcacctcagat

SEQ ID NO: 142084 - DNA, 25 bp, Rattus norvegicus
aggagtcacagagctcacctcagat

SEQ ID NO: 142085 - DNA, 25 bp, Rattus norvegicus
aggagtcacatgcagtcttcagtag

SEQ ID NO: 142086 - DNA, 25 bp, Rattus norvegicus
aggagtcacatggagtcttcagtag

SEQ ID NO: 142087 - DNA, 25 bp, Rattus norvegicus
aggagtcacattagctaatccagac

SEQ ID NO: 142088 - DNA, 25 bp, Rattus norvegicus
aggagtcacatttgctaatccagac

SEQ ID NO: 142089 - DNA, 25 bp, Rattus norvegicus
aggagtcaccacctggaatctcctt

SEQ ID NO: 142090 - DNA, 25 bp, Rattus norvegicus
aggagtcaccacgtggaatctcctt

SEQ ID NO: 142091 - DNA, 25 bp, Rattus norvegicus
aggagtcaccctcttcttggtggaa

SEQ ID NO: 142092 - DNA, 25 bp, Rattus norvegicus
aggagtcaccctgttcttggtggaa

SEQ ID NO: 142093 - DNA, 25 bp, Rattus norvegicus
aggagtcacctccttgtacaaaggg

SEQ ID NO: 142094 - DNA, 25 bp, Rattus norvegicus
aggagtcacctcgttgtacaaaggg

SEQ ID NO: 142095 - DNA, 25 bp, Rattus norvegicus
aggagtcacgttcacagtgtgtgct

SEQ ID NO: 142096 - DNA, 25 bp, Rattus norvegicus
aggagtcacgttgacagtgtgtgct

SEQ ID NO: 142097 - DNA, 25 bp, Rattus norvegicus
aggagtcactaacagccagccacaa

SEQ ID NO: 142098 - DNA, 25 bp, Rattus norvegicus
aggagtcactaagagccagccacaa

SEQ ID NO: 142099 - DNA, 25 bp, Rattus norvegicus
aggagtcacttcacttgctctgtaa

SEQ ID NO: 142100 - DNA, 25 bp, Rattus norvegicus
aggagtcacttctcttgctctgtaa

SEQ ID NO: 142101 - DNA, 25 bp, Rattus norvegicus
aggagtcacttgatacgtcgcagga

SEQ ID NO: 142102 - DNA, 25 bp, Rattus norvegicus
aggagtcacttgttacgtcgcagga

SEQ ID NO: 142103 - DNA, 25 bp, Rattus norvegicus
aggagtcagagaaggcgctccccac

SEQ ID NO: 142104 - DNA, 25 bp, Rattus norvegicus
aggagtcagagatggcgctccccac

SEQ ID NO: 142105 - DNA, 25 bp, Rattus norvegicus
aggagtcagagcattttgtcacaga

SEQ ID NO: 142106 - DNA, 25 bp, Rattus norvegicus
aggagtcagagctttttgtcacaga

SEQ ID NO: 142107 - DNA, 25 bp, Rattus norvegicus
aggagtcagcatccaggtttccact

SEQ ID NO: 142108 - DNA, 25 bp, Rattus norvegicus
aggagtcagcatgcaggtttccact

SEQ ID NO: 142109 - DNA, 25 bp, Rattus norvegicus
aggagtcagctcatggattcttcag

SEQ ID NO: 142110 - DNA, 25 bp, Rattus norvegicus
aggagtcagctcttggattcttcag

SEQ ID NO: 142111 - DNA, 25 bp, Rattus norvegicus
aggagtcaggaacccatgttgcaga

SEQ ID NO: 142112 - DNA, 25 bp, Rattus norvegicus
aggagtcaggaagccatgttgcaga

SEQ ID NO: 142113 - DNA, 25 bp, Rattus norvegicus
aggagtcagggtaatgctctcacct

SEQ ID NO: 142114 - DNA, 25 bp, Rattus norvegicus
aggagtcagggttatgctctcacct

SEQ ID NO: 142115 - DNA, 25 bp, Rattus norvegicus
aggagtcaggtacctgtcccaggcc

SEQ ID NO: 142116 - DNA, 25 bp, Rattus norvegicus
aggagtcaggtagctgtcccaggcc

SEQ ID NO: 142117 - DNA, 25 bp, Rattus norvegicus
aggagtcagtagcaccctccagttg

SEQ ID NO: 142118 - DNA, 25 bp, Rattus norvegicus
aggagtcagtaggaccctccagttg

SEQ ID NO: 142119 - DNA, 25 bp, Rattus norvegicus
aggagtccaaagaccaagctctggt

SEQ ID NO: 142120 - DNA, 25 bp, Rattus norvegicus
aggagtccaaagtccaagctctggt

SEQ ID NO: 142121 - DNA, 25 bp, Rattus norvegicus
aggagtccagacatcctggcaggaa

SEQ ID NO: 142122 - DNA, 25 bp, Rattus norvegicus
aggagtccagacttcctggcaggaa

SEQ ID NO: 142123 - DNA, 25 bp, Rattus norvegicus
aggagtccatgaccactgtgtacat

SEQ ID NO: 142124 - DNA, 25 bp, Rattus norvegicus
aggagtccatgagcactgtgtacat

SEQ ID NO: 142125 - DNA, 25 bp, Rattus norvegicus
aggagtcccatgcacgacaagaaac

SEQ ID NO: 142126 - DNA, 25 bp, Rattus norvegicus
aggagtcccatggacgacaagaaac

SEQ ID NO: 142127 - DNA, 25 bp, Rattus norvegicus
aggagtcctacaacagtcacagcag

SEQ ID NO: 142128 - DNA, 25 bp, Rattus norvegicus
aggagtcctacatcagtcacagcag

SEQ ID NO: 142129 - DNA, 25 bp, Rattus norvegicus
aggagtcctatcactgtggcggcag

SEQ ID NO: 142130 - DNA, 25 bp, Rattus norvegicus
aggagtcctatctctgtggcggcag

SEQ ID NO: 142131 - DNA, 25 bp, Rattus norvegicus
aggagtcctcaaccctctgggatct

SEQ ID NO: 142132 - DNA, 25 bp, Rattus norvegicus
aggagtcctcaagcctctgggatct

SEQ ID NO: 142133 - DNA, 25 bp, Rattus norvegicus
aggagtcctcacctgttatattcag

SEQ ID NO: 142134 - DNA, 25 bp, Rattus norvegicus
aggagtcctcacgtgttatattcag

SEQ ID NO: 142135 - DNA, 25 bp, Rattus norvegicus
aggagtcctttacttttgactgtga

SEQ ID NO: 142136 - DNA, 25 bp, Rattus norvegicus
aggagtcctttagttttgactgtga

SEQ ID NO: 142137 - DNA, 25 bp, Rattus norvegicus
aggagtcggttcctggtactacagc

SEQ ID NO: 142138 - DNA, 25 bp, Rattus norvegicus
aggagtcggttcgtggtactacagc

SEQ ID NO: 142139 - DNA, 25 bp, Rattus norvegicus
aggagtcgtttccttactgaggaga

SEQ ID NO: 142140 - DNA, 25 bp, Rattus norvegicus
aggagtcgtttcgttactgaggaga

SEQ ID NO: 142141 - DNA, 25 bp, Rattus norvegicus
aggagtctaacaacccagcacagag

SEQ ID NO: 142142 - DNA, 25 bp, Rattus norvegicus
aggagtctaacatcccagcacagag

SEQ ID NO: 142143 - DNA, 25 bp, Rattus norvegicus
aggagtctaaccactgctctgtgct

SEQ ID NO: 142144 - DNA, 25 bp, Rattus norvegicus
aggagtctaacctctgctctgtgct

SEQ ID NO: 142145 - DNA, 25 bp, Rattus norvegicus
aggagtctacagattgtcctctgac

SEQ ID NO: 142146 - DNA, 25 bp, Rattus norvegicus
aggagtctacagtttgtcctctgac

SEQ ID NO: 142147 - DNA, 25 bp, Rattus norvegicus
aggagtctcaatactgacctctcta

SEQ ID NO: 142148 - DNA, 25 bp, Rattus norvegicus
aggagtctcaattctgacctctcta

SEQ ID NO: 142149 - DNA, 25 bp, Rattus norvegicus
aggagtctcaggctgtgccccttgt

SEQ ID NO: 142150 - DNA, 25 bp, Rattus norvegicus
aggagtctcagggtgtgccccttgt

SEQ ID NO: 142151 - DNA, 25 bp, Rattus norvegicus
aggagtctccagaaggcgtgttcaa

SEQ ID NO: 142152 - DNA, 25 bp, Rattus norvegicus
aggagtctccagtaggcgtgttcaa

SEQ ID NO: 142153 - DNA, 25 bp, Rattus norvegicus
aggagtctcctcatgtttttatgtg

SEQ ID NO: 142154 - DNA, 25 bp, Rattus norvegicus
aggagtctcctcttgtttttatgtg

SEQ ID NO: 142155 - DNA, 25 bp, Rattus norvegicus
aggagtctctagatcggtgatttgt

SEQ ID NO: 142156 - DNA, 25 bp, Rattus norvegicus
aggagtctctagttcggtgatttgt

SEQ ID NO: 142157 - DNA, 25 bp, Rattus norvegicus
aggagtctctgcctcctggaggaca

SEQ ID NO: 142158 - DNA, 25 bp, Rattus norvegicus
aggagtctctgcgtcctggaggaca

SEQ ID NO: 142159 - DNA, 25 bp, Rattus norvegicus
aggagtctgaagaagccagcagttt

SEQ ID NO: 142160 - DNA, 25 bp, Rattus norvegicus
aggagtctgaagtagccagcagttt

SEQ ID NO: 142161 - DNA, 25 bp, Rattus norvegicus
aggagtctgagacccatatgtctga

SEQ ID NO: 142162 - DNA, 25 bp, Rattus norvegicus
aggagtctgagagccatatgtctga

SEQ ID NO: 142163 - DNA, 25 bp, Rattus norvegicus
aggagtctgaggatgctatacccaa

SEQ ID NO: 142164 - DNA, 25 bp, Rattus norvegicus
aggagtctgaggttgctatacccaa

SEQ ID NO: 142165 - DNA, 25 bp, Rattus norvegicus
aggagtctggacatgtggttactag

SEQ ID NO: 142166 - DNA, 25 bp, Rattus norvegicus
aggagtctggacttgtggttactag

SEQ ID NO: 142167 - DNA, 25 bp, Rattus norvegicus
aggagtctggatctcaggctaccct

SEQ ID NO: 142168 - DNA, 25 bp, Rattus norvegicus
aggagtctggatgtcaggctaccct

SEQ ID NO: 142169 - DNA, 25 bp, Rattus norvegicus
aggagtctgtggcattaccctccac

SEQ ID NO: 142170 - DNA, 25 bp, Rattus norvegicus
aggagtctgtgggattaccctccac

SEQ ID NO: 142171 - DNA, 25 bp, Rattus norvegicus
aggagtctgtgtacaaagactgagc

SEQ ID NO: 142172 - DNA, 25 bp, Rattus norvegicus
aggagtctgtgttcaaagactgagc

SEQ ID NO: 142173 - DNA, 25 bp, Rattus norvegicus
aggagtcttgcaaactacctgctca

SEQ ID NO: 142174 - DNA, 25 bp, Rattus norvegicus
aggagtcttgcatactacctgctca

SEQ ID NO: 142175 - DNA, 25 bp, Rattus norvegicus
aggagtcttgtcactgtgctgcacc

SEQ ID NO: 142176 - DNA, 25 bp, Rattus norvegicus
aggagtcttgtctctgtgctgcacc

SEQ ID NO: 142177 - DNA, 25 bp, Rattus norvegicus
aggagtctttagaactggcgaatta

SEQ ID NO: 142178 - DNA, 25 bp, Rattus norvegicus
aggagtctttagtactggcgaatta

SEQ ID NO: 142179 - DNA, 25 bp, Rattus norvegicus
aggagtctttctcgccttctacaaa

SEQ ID NO: 142180 - DNA, 25 bp, Rattus norvegicus
aggagtctttctggccttctacaaa

SEQ ID NO: 142181 - DNA, 25 bp, Rattus norvegicus
aggagtcttttcattttgaaccatg

SEQ ID NO: 142182 - DNA, 25 bp, Rattus norvegicus
aggagtcttttctttttgaaccatg

SEQ ID NO: 142183 - DNA, 25 bp, Rattus norvegicus
aggagtgaagacagctgccagccct

SEQ ID NO: 142184 - DNA, 25 bp, Rattus norvegicus
aggagtgaagactgctgccagccct

SEQ ID NO: 142185 - DNA, 25 bp, Rattus norvegicus
aggagtgaccagcttgacaccactg

SEQ ID NO: 142186 - DNA, 25 bp, Rattus norvegicus
aggagtgaccaggttgacaccactg

SEQ ID NO: 142187 - DNA, 25 bp, Rattus norvegicus
aggagtgacccacgcagaacatgca

SEQ ID NO: 142188 - DNA, 25 bp, Rattus norvegicus
aggagtgacccaggcagaacatgca

SEQ ID NO: 142189 - DNA, 25 bp, Rattus norvegicus
aggagtgactaaaacgccttcaact

SEQ ID NO: 142190 - DNA, 25 bp, Rattus norvegicus
aggagtgactaatacgccttcaact

SEQ ID NO: 142191 - DNA, 25 bp, Rattus norvegicus
aggagtgacttgagttcctgtgctc

SEQ ID NO: 142192 - DNA, 25 bp, Rattus norvegicus
aggagtgacttgtgttcctgtgctc

SEQ ID NO: 142193 - DNA, 25 bp, Rattus norvegicus
aggagtgatccgcttggcagccatt

SEQ ID NO: 142194 - DNA, 25 bp, Rattus norvegicus
aggagtgatccggttggcagccatt

SEQ ID NO: 142195 - DNA, 25 bp, Rattus norvegicus
aggagtgattctcccaaccaggaca

SEQ ID NO: 142196 - DNA, 25 bp, Rattus norvegicus
aggagtgattctgccaaccaggaca

SEQ ID NO: 142197 - DNA, 25 bp, Rattus norvegicus
aggagtgcaattccttcctaatcgc

SEQ ID NO: 142198 - DNA, 25 bp, Rattus norvegicus
aggagtgcaattgcttcctaatcgc

SEQ ID NO: 142199 - DNA, 25 bp, Rattus norvegicus
aggagtgcacgaccctttctaactg

SEQ ID NO: 142200 - DNA, 25 bp, Rattus norvegicus
aggagtgcacgagcctttctaactg

SEQ ID NO: 142201 - DNA, 25 bp, Rattus norvegicus
aggagtgcagagacctgtgtgcctc

SEQ ID NO: 142202 - DNA, 25 bp, Rattus norvegicus
aggagtgcagagtcctgtgtgcctc

SEQ ID NO: 142203 - DNA, 25 bp, Rattus norvegicus
aggagtgcaggaacctcagcccttt

SEQ ID NO: 142204 - DNA, 25 bp, Rattus norvegicus
aggagtgcaggatcctcagcccttt

SEQ ID NO: 142205 - DNA, 25 bp, Rattus norvegicus
aggagtgcatcaacttctgtgtacg

SEQ ID NO: 142206 - DNA, 25 bp, Rattus norvegicus
aggagtgcatcatcttctgtgtacg

SEQ ID NO: 142207 - DNA, 25 bp, Rattus norvegicus
aggagtgcccagacccaagtgctag

SEQ ID NO: 142208 - DNA, 25 bp, Rattus norvegicus
aggagtgcccagtcccaagtgctag

SEQ ID NO: 142209 - DNA, 25 bp, Rattus norvegicus
aggagtgcccgaatccaggaactat

SEQ ID NO: 142210 - DNA, 25 bp, Rattus norvegicus
aggagtgcccgattccaggaactat

SEQ ID NO: 142211 - DNA, 25 bp, Rattus norvegicus
aggagtgccggccatgcgcattctt

SEQ ID NO: 142212 - DNA, 25 bp, Rattus norvegicus
aggagtgccggcctttcaccacaga

SEQ ID NO: 142213 - DNA, 25 bp, Rattus norvegicus
aggagtgccggcgatgcgcattctt

SEQ ID NO: 142214 - DNA, 25 bp, Rattus norvegicus
aggagtgccggcgtttcaccacaga

SEQ ID NO: 142215 - DNA, 25 bp, Rattus norvegicus
aggagtgcctttaaggatccaggtt

SEQ ID NO: 142216 - DNA, 25 bp, Rattus norvegicus
aggagtgccttttaggatccaggtt

SEQ ID NO: 142217 - DNA, 25 bp, Rattus norvegicus
aggagtgctgacagtcacacaccat

SEQ ID NO: 142218 - DNA, 25 bp, Rattus norvegicus
aggagtgctgacatataagcttaca

SEQ ID NO: 142219 - DNA, 25 bp, Rattus norvegicus
aggagtgctgactgtcacacaccat

SEQ ID NO: 142220 - DNA, 25 bp, Rattus norvegicus
aggagtgctgacttataagcttaca

SEQ ID NO: 142221 - DNA, 25 bp, Rattus norvegicus
aggagtggccaactgggcttcccca

SEQ ID NO: 142222 - DNA, 25 bp, Rattus norvegicus
aggagtggccaagtgggcttcccca

SEQ ID NO: 142223 - DNA, 25 bp, Rattus norvegicus
aggagtggctacactggagctctgc

SEQ ID NO: 142224 - DNA, 25 bp, Rattus norvegicus
aggagtggctactctggagctctgc

SEQ ID NO: 142225 - DNA, 25 bp, Rattus norvegicus
aggagtggctgcagtgcatcaacgt

SEQ ID NO: 142226 - DNA, 25 bp, Rattus norvegicus
aggagtggctgctgtgcatcaacgt

SEQ ID NO: 142227 - DNA, 25 bp, Rattus norvegicus
aggagtgggatccagagtatacccc

SEQ ID NO: 142228 - DNA, 25 bp, Rattus norvegicus
aggagtgggatcgagagtatacccc

SEQ ID NO: 142229 - DNA, 25 bp, Rattus norvegicus
aggagtgggatgagccccagatgaa

SEQ ID NO: 142230 - DNA, 25 bp, Rattus norvegicus
aggagtgggatgtgccccagatgaa

SEQ ID NO: 142231 - DNA, 25 bp, Rattus norvegicus
aggagtggtgaacctcgaacagcca

SEQ ID NO: 142232 - DNA, 25 bp, Rattus norvegicus
aggagtggtgaagctcgaacagcca

SEQ ID NO: 142233 - DNA, 25 bp, Rattus norvegicus
aggagtgtaaatctgcccttcatcc

SEQ ID NO: 142234 - DNA, 25 bp, Rattus norvegicus
aggagtgtaaatgtgcccttcatcc

SEQ ID NO: 142235 - DNA, 25 bp, Rattus norvegicus
aggagtgtaagaaagccttccgaca

SEQ ID NO: 142236 - DNA, 25 bp, Rattus norvegicus
aggagtgtaagatagccttccgaca

SEQ ID NO: 142237 - DNA, 25 bp, Rattus norvegicus
aggagtgtcagcaacatcagcctat

SEQ ID NO: 142238 - DNA, 25 bp, Rattus norvegicus
aggagtgtcagcactgtctgccaac

SEQ ID NO: 142239 - DNA, 25 bp, Rattus norvegicus
aggagtgtcagctacatcagcctat

SEQ ID NO: 142240 - DNA, 25 bp, Rattus norvegicus
aggagtgtcagctctgtctgccaac

SEQ ID NO: 142241 - DNA, 25 bp, Rattus norvegicus
aggagtgtcagtacctgcacgagga

SEQ ID NO: 142242 - DNA, 25 bp, Rattus norvegicus
aggagtgtcagttcctgcacgagga

SEQ ID NO: 142243 - DNA, 25 bp, Rattus norvegicus
aggagtgtcctcagcagattaccat

SEQ ID NO: 142244 - DNA, 25 bp, Rattus norvegicus
aggagtgtcctctgcagattaccat

SEQ ID NO: 142245 - DNA, 25 bp, Rattus norvegicus
aggagtgtcctgcaaagagcttatg

SEQ ID NO: 142246 - DNA, 25 bp, Rattus norvegicus
aggagtgtcctggaaagagcttatg

SEQ ID NO: 142247 - DNA, 25 bp, Rattus norvegicus
aggagtgtcgataccatttctgtcg

SEQ ID NO: 142248 - DNA, 25 bp, Rattus norvegicus
aggagtgtcgattccatttctgtcg

SEQ ID NO: 142249 - DNA, 25 bp, Rattus norvegicus
aggagtgtctaaagcctggcaccca

SEQ ID NO: 142250 - DNA, 25 bp, Rattus norvegicus
aggagtgtctaatgcctggcaccca

SEQ ID NO: 142251 - DNA, 25 bp, Rattus norvegicus
aggagtgtctctacatggcttctgc

SEQ ID NO: 142252 - DNA, 25 bp, Rattus norvegicus
aggagtgtctcttcatggcttctgc

SEQ ID NO: 142253 - DNA, 25 bp, Rattus norvegicus
aggagtgtgagtctctgcaccatca

SEQ ID NO: 142254 - DNA, 25 bp, Rattus norvegicus
aggagtgtgagtgtctgcaccatca

SEQ ID NO: 142255 - DNA, 25 bp, Rattus norvegicus
aggagtgtgtcaaagtctggagcca

SEQ ID NO: 142256 - DNA, 25 bp, Rattus norvegicus
aggagtgtgtcatagtctggagcca

SEQ ID NO: 142257 - DNA, 25 bp, Rattus norvegicus
aggagtgtgtccacttacttttcct

SEQ ID NO: 142258 - DNA, 25 bp, Rattus norvegicus
aggagtgtgtcccaagcattcaagc

SEQ ID NO: 142259 - DNA, 25 bp, Rattus norvegicus
aggagtgtgtccgaagcattcaagc

SEQ ID NO: 142260 - DNA, 25 bp, Rattus norvegicus
aggagtgtgtcctcttacttttcct

SEQ ID NO: 142261 - DNA, 25 bp, Rattus norvegicus
aggagtgttaagaacctgccccact

SEQ ID NO: 142262 - DNA, 25 bp, Rattus norvegicus
aggagtgttaagtacctgccccact

SEQ ID NO: 142263 - DNA, 25 bp, Rattus norvegicus
aggagttacagcatgctcttttgta

SEQ ID NO: 142264 - DNA, 25 bp, Rattus norvegicus
aggagttacagcttgctcttttgta

SEQ ID NO: 142265 - DNA, 25 bp, Rattus norvegicus
aggagttaccagagcagcctgccaa

SEQ ID NO: 142266 - DNA, 25 bp, Rattus norvegicus
aggagttaccagtgcagcctgccaa

SEQ ID NO: 142267 - DNA, 25 bp, Rattus norvegicus
aggagttactgtcttggcgctgaaa

SEQ ID NO: 142268 - DNA, 25 bp, Rattus norvegicus
aggagttactgtgttggcgctgaaa

SEQ ID NO: 142269 - DNA, 25 bp, Rattus norvegicus
aggagttagacactctccgcaacct

SEQ ID NO: 142270 - DNA, 25 bp, Rattus norvegicus
aggagttagacagtctccgcaacct

SEQ ID NO: 142271 - DNA, 25 bp, Rattus norvegicus
aggagttatatcactgtctctgccc

SEQ ID NO: 142272 - DNA, 25 bp, Rattus norvegicus
aggagttatatctctgtctctgccc

SEQ ID NO: 142273 - DNA, 25 bp, Rattus norvegicus
aggagttatgttcacacccaaagga

SEQ ID NO: 142274 - DNA, 25 bp, Rattus norvegicus
aggagttatgttgacacccaaagga

SEQ ID NO: 142275 - DNA, 25 bp, Rattus norvegicus
aggagttcaaagaccctctgatgca

SEQ ID NO: 142276 - DNA, 25 bp, Rattus norvegicus
aggagttcaaagtccctctgatgca

SEQ ID NO: 142277 - DNA, 25 bp, Rattus norvegicus
aggagttcaaggctgccctgagcca

SEQ ID NO: 142278 - DNA, 25 bp, Rattus norvegicus
aggagttcaagggtgccctgagcca

SEQ ID NO: 142279 - DNA, 25 bp, Rattus norvegicus
aggagttcaccaaccatgcaagtca

SEQ ID NO: 142280 - DNA, 25 bp, Rattus norvegicus
aggagttcaccatccatgcaagtca

SEQ ID NO: 142281 - DNA, 25 bp, Rattus norvegicus
aggagttcacgcaacaactgataac

SEQ ID NO: 142282 - DNA, 25 bp, Rattus norvegicus
aggagttcacgctacaactgataac

SEQ ID NO: 142283 - DNA, 25 bp, Rattus norvegicus
aggagttccagaaccagacctttga

SEQ ID NO: 142284 - DNA, 25 bp, Rattus norvegicus
aggagttccagaagcttgtccagct

SEQ ID NO: 142285 - DNA, 25 bp, Rattus norvegicus
aggagttccagatccagacctttga

SEQ ID NO: 142286 - DNA, 25 bp, Rattus norvegicus
aggagttccagatgcttgtccagct

SEQ ID NO: 142287 - DNA, 25 bp, Rattus norvegicus
aggagttcctcacactcatcaggag

SEQ ID NO: 142288 - DNA, 25 bp, Rattus norvegicus
aggagttcctcagactcatcaggag

SEQ ID NO: 142289 - DNA, 25 bp, Rattus norvegicus
aggagttcctctcgcgatcacaggt

SEQ ID NO: 142290 - DNA, 25 bp, Rattus norvegicus
aggagttcctctggcgatcacaggt

SEQ ID NO: 142291 - DNA, 25 bp, Rattus norvegicus
aggagttcggtcagatatgaacaac

SEQ ID NO: 142292 - DNA, 25 bp, Rattus norvegicus
aggagttcggtctgatatgaacaac

SEQ ID NO: 142293 - DNA, 25 bp, Rattus norvegicus
aggagttctatgactgccccgggta

SEQ ID NO: 142294 - DNA, 25 bp, Rattus norvegicus
aggagttctatgtctgccccgggta

SEQ ID NO: 142295 - DNA, 25 bp, Rattus norvegicus
aggagttcttcaacccatacgtctg

SEQ ID NO: 142296 - DNA, 25 bp, Rattus norvegicus
aggagttcttcatcccatacgtctg

SEQ ID NO: 142297 - DNA, 25 bp, Rattus norvegicus
aggagttgcagcacaccatcatctt

SEQ ID NO: 142298 - DNA, 25 bp, Rattus norvegicus
aggagttgcagctcaccatcatctt

SEQ ID NO: 142299 - DNA, 25 bp, Rattus norvegicus
aggagttgcgaccattgccagtttc

SEQ ID NO: 142300 - DNA, 25 bp, Rattus norvegicus
aggagttgcgacgattgccagtttc

SEQ ID NO: 142301 - DNA, 25 bp, Rattus norvegicus
aggagttggaagacatccccagcca

SEQ ID NO: 142302 - DNA, 25 bp, Rattus norvegicus
aggagttggaagtcatccccagcca

SEQ ID NO: 142303 - DNA, 25 bp, Rattus norvegicus
aggagttggccactgatcttgaaga

SEQ ID NO: 142304 - DNA, 25 bp, Rattus norvegicus
aggagttggccagtgatcttgaaga

SEQ ID NO: 142305 - DNA, 25 bp, Rattus norvegicus
aggagttgtcaacatgtaccacatg

SEQ ID NO: 142306 - DNA, 25 bp, Rattus norvegicus
aggagttgtcaagatgtaccacatg

SEQ ID NO: 142307 - DNA, 25 bp, Rattus norvegicus
aggagtttaagaacatccccgctac

SEQ ID NO: 142308 - DNA, 25 bp, Rattus norvegicus
aggagtttaagatcatccccgctac

SEQ ID NO: 142309 - DNA, 25 bp, Rattus norvegicus
aggagtttataccagcagcacagat

SEQ ID NO: 142310 - DNA, 25 bp, Rattus norvegicus
aggagtttatacgagcagcacagat

SEQ ID NO: 142311 - DNA, 25 bp, Rattus norvegicus
aggagtttccctctttctgatgaac

SEQ ID NO: 142312 - DNA, 25 bp, Rattus norvegicus
aggagtttccctgtttctgatgaac

SEQ ID NO: 142313 - DNA, 25 bp, Rattus norvegicus
aggagtttcgagaccgcatgcgtgt

SEQ ID NO: 142314 - DNA, 25 bp, Rattus norvegicus
aggagtttcgagtccgcatgcgtgt

SEQ ID NO: 142315 - DNA, 25 bp, Rattus norvegicus
aggagtttctggactgcttgtgaca

SEQ ID NO: 142316 - DNA, 25 bp, Rattus norvegicus
aggagtttctggtctgcttgtgaca

SEQ ID NO: 142317 - DNA, 25 bp, Rattus norvegicus
aggagtttgaggaagtcccgcttga

SEQ ID NO: 142318 - DNA, 25 bp, Rattus norvegicus
aggagtttgaggtagtcccgcttga

SEQ ID NO: 142319 - DNA, 25 bp, Rattus norvegicus
aggagtttgccaaccactgtgagtc

SEQ ID NO: 142320 - DNA, 25 bp, Rattus norvegicus
aggagtttgccatccactgtgagtc

SEQ ID NO: 142321 - DNA, 25 bp, Rattus norvegicus
aggagttttaacaggcacatggccc

SEQ ID NO: 142322 - DNA, 25 bp, Rattus norvegicus
aggagttttaactggcacatggccc

SEQ ID NO: 142323 - DNA, 25 bp, Rattus norvegicus
aggagttttcgcaatctctgaggga

SEQ ID NO: 142324 - DNA, 25 bp, Rattus norvegicus
aggagttttcgctatctctgaggga

SEQ ID NO: 142325 - DNA, 25 bp, Rattus norvegicus
aggataaaacagactccccacaact

SEQ ID NO: 142326 - DNA, 25 bp, Rattus norvegicus
aggataaaacagtctccccacaact

SEQ ID NO: 142327 - DNA, 25 bp, Rattus norvegicus
aggataaactctactcctcagaggc

SEQ ID NO: 142328 - DNA, 25 bp, Rattus norvegicus
aggataaactctcgcctgcctattt

SEQ ID NO: 142329 - DNA, 25 bp, Rattus norvegicus
aggataaactctggcctgcctattt

SEQ ID NO: 142330 - DNA, 25 bp, Rattus norvegicus
aggataaactcttctcctcagaggc

SEQ ID NO: 142331 - DNA, 25 bp, Rattus norvegicus
aggataaccatcaaagctccactta

SEQ ID NO: 142332 - DNA, 25 bp, Rattus norvegicus
aggataaccatctaagctccactta

SEQ ID NO: 142333 - DNA, 25 bp, Rattus norvegicus
aggataactaacaccatcccgttga

SEQ ID NO: 142334 - DNA, 25 bp, Rattus norvegicus
aggataactaactccatcccgttga

SEQ ID NO: 142335 - DNA, 25 bp, Rattus norvegicus
aggataactgctacgccactgaggg

SEQ ID NO: 142336 - DNA, 25 bp, Rattus norvegicus
aggataactgcttcgccactgaggg

SEQ ID NO: 142337 - DNA, 25 bp, Rattus norvegicus
aggataacttctctgctgctttgcc

SEQ ID NO: 142338 - DNA, 25 bp, Rattus norvegicus
aggataacttctgtgctgctttgcc

SEQ ID NO: 142339 - DNA, 25 bp, Rattus norvegicus
aggataaggcagacctcgcagtcgg

SEQ ID NO: 142340 - DNA, 25 bp, Rattus norvegicus
aggataaggcagtcctcgcagtcgg

SEQ ID NO: 142341 - DNA, 25 bp, Rattus norvegicus
aggataatcagtacctggccaggat

SEQ ID NO: 142342 - DNA, 25 bp, Rattus norvegicus
aggataatcagttcctggccaggat

SEQ ID NO: 142343 - DNA, 25 bp, Rattus norvegicus
aggataatctcccagttctaagaat

SEQ ID NO: 142344 - DNA, 25 bp, Rattus norvegicus
aggataatctccgagttctaagaat

SEQ ID NO: 142345 - DNA, 25 bp, Rattus norvegicus
aggataatgccgaattattttccac

SEQ ID NO: 142346 - DNA, 25 bp, Rattus norvegicus
aggataatgccgtattattttccac

SEQ ID NO: 142347 - DNA, 25 bp, Rattus norvegicus
aggatacaaaaactggccttgccag

SEQ ID NO: 142348 - DNA, 25 bp, Rattus norvegicus
aggatacaaaaagtggccttgccag

SEQ ID NO: 142349 - DNA, 25 bp, Rattus norvegicus
aggatacacattaacacttgcgggt

SEQ ID NO: 142350 - DNA, 25 bp, Rattus norvegicus
aggatacacattaccctgagaaccc

SEQ ID NO: 142351 - DNA, 25 bp, Rattus norvegicus
aggatacacatttacacttgcgggt

SEQ ID NO: 142352 - DNA, 25 bp, Rattus norvegicus
aggatacacatttccctgagaaccc

SEQ ID NO: 142353 - DNA, 25 bp, Rattus norvegicus
aggatacagtgcatttccagtgccc

SEQ ID NO: 142354 - DNA, 25 bp, Rattus norvegicus
aggatacagtgcttttccagtgccc

SEQ ID NO: 142355 - DNA, 25 bp, Rattus norvegicus
aggatacattttcacttgcccctcg

SEQ ID NO: 142356 - DNA, 25 bp, Rattus norvegicus
aggatacattttgacttgcccctcg

SEQ ID NO: 142357 - DNA, 25 bp, Rattus norvegicus
aggataccacagaagagacattaag

SEQ ID NO: 142358 - DNA, 25 bp, Rattus norvegicus
aggataccacagtagagacattaag

SEQ ID NO: 142359 - DNA, 25 bp, Rattus norvegicus
aggataccatgcctctgatctctgt

SEQ ID NO: 142360 - DNA, 25 bp, Rattus norvegicus
aggataccatgcgtctgatctctgt

SEQ ID NO: 142361 - DNA, 25 bp, Rattus norvegicus
aggatacccttccatctgagcagac

SEQ ID NO: 142362 - DNA, 25 bp, Rattus norvegicus
aggatacccttcgatctgagcagac

SEQ ID NO: 142363 - DNA, 25 bp, Rattus norvegicus
aggatacctatcctctattctgtcc

SEQ ID NO: 142364 - DNA, 25 bp, Rattus norvegicus
aggatacctatcgtctattctgtcc

SEQ ID NO: 142365 - DNA, 25 bp, Rattus norvegicus
aggatacctcttaccctgtggtgat

SEQ ID NO: 142366 - DNA, 25 bp, Rattus norvegicus
aggatacctctttccctgtggtgat

SEQ ID NO: 142367 - DNA, 25 bp, Rattus norvegicus
aggatacggaggaggcggctgggcg

SEQ ID NO: 142368 - DNA, 25 bp, Rattus norvegicus
aggatacggaggtggcggctgggcg

SEQ ID NO: 142369 - DNA, 25 bp, Rattus norvegicus
aggatacgggaacctgcaggcctat

SEQ ID NO: 142370 - DNA, 25 bp, Rattus norvegicus
aggatacgggaagctgcaggcctat

SEQ ID NO: 142371 - DNA, 25 bp, Rattus norvegicus
aggatactaactctgaaacacacat

SEQ ID NO: 142372 - DNA, 25 bp, Rattus norvegicus
aggatactaactgtgaaacacacat

SEQ ID NO: 142373 - DNA, 25 bp, Rattus norvegicus
aggatactcaaactgtgggaaacaa

SEQ ID NO: 142374 - DNA, 25 bp, Rattus norvegicus
aggatactcaaagtgtgggaaacaa

SEQ ID NO: 142375 - DNA, 25 bp, Rattus norvegicus
aggatactccatatgccgctggata

SEQ ID NO: 142376 - DNA, 25 bp, Rattus norvegicus
aggatactccatttgccgctggata

SEQ ID NO: 142377 - DNA, 25 bp, Rattus norvegicus
aggatactctgtccaggcagtccca

SEQ ID NO: 142378 - DNA, 25 bp, Rattus norvegicus
aggatactctgtgcaggcagtccca

SEQ ID NO: 142379 - DNA, 25 bp, Rattus norvegicus
aggatactttctccaatgttcatag

SEQ ID NO: 142380 - DNA, 25 bp, Rattus norvegicus
aggatactttctgcaatgttcatag

SEQ ID NO: 142381 - DNA, 25 bp, Rattus norvegicus
aggatagaacgtctaccagccaact

SEQ ID NO: 142382 - DNA, 25 bp, Rattus norvegicus
aggatagaacgtgtaccagccaact

SEQ ID NO: 142383 - DNA, 25 bp, Rattus norvegicus
aggatagactgaccccacctcttca

SEQ ID NO: 142384 - DNA, 25 bp, Rattus norvegicus
aggatagactgagcccacctcttca

SEQ ID NO: 142385 - DNA, 25 bp, Rattus norvegicus
aggatagagcccagacgcagaccga

SEQ ID NO: 142386 - DNA, 25 bp, Rattus norvegicus
aggatagagccctgacgcagaccga

SEQ ID NO: 142387 - DNA, 25 bp, Rattus norvegicus
aggatagaggagctccactgtcctt

SEQ ID NO: 142388 - DNA, 25 bp, Rattus norvegicus
aggatagaggaggtccactgtcctt

SEQ ID NO: 142389 - DNA, 25 bp, Rattus norvegicus
aggatagagtgcaatgtccctcaca

SEQ ID NO: 142390 - DNA, 25 bp, Rattus norvegicus
aggatagagtgctatgtccctcaca

SEQ ID NO: 142391 - DNA, 25 bp, Rattus norvegicus
aggatagcaagacctctgcctggga

SEQ ID NO: 142392 - DNA, 25 bp, Rattus norvegicus
aggatagcaagagctctgcctggga

SEQ ID NO: 142393 - DNA, 25 bp, Rattus norvegicus
aggatagcacagctccgtgggtctt

SEQ ID NO: 142394 - DNA, 25 bp, Rattus norvegicus
aggatagcacaggtccgtgggtctt

SEQ ID NO: 142395 - DNA, 25 bp, Rattus norvegicus
aggatagcatcacgctccgagcgga

SEQ ID NO: 142396 - DNA, 25 bp, Rattus norvegicus
aggatagcatcaggctccgagcgga

SEQ ID NO: 142397 - DNA, 25 bp, Rattus norvegicus
aggatagctcatagggccccactca

SEQ ID NO: 142398 - DNA, 25 bp, Rattus norvegicus
aggatagctcattgggccccactca

SEQ ID NO: 142399 - DNA, 25 bp, Rattus norvegicus
aggatagctggaaccccaggagaca

SEQ ID NO: 142400 - DNA, 25 bp, Rattus norvegicus
aggatagctggatccccaggagaca

SEQ ID NO: 142401 - DNA, 25 bp, Rattus norvegicus
aggatagcttgcctggacagcaccc

SEQ ID NO: 142402 - DNA, 25 bp, Rattus norvegicus
aggatagcttgcgtggacagcaccc

SEQ ID NO: 142403 - DNA, 25 bp, Rattus norvegicus
aggataggaacactgccccttactc

SEQ ID NO: 142404 - DNA, 25 bp, Rattus norvegicus
aggataggaacagtgccccttactc

SEQ ID NO: 142405 - DNA, 25 bp, Rattus norvegicus
aggatagtacccaacgcacagctga

SEQ ID NO: 142406 - DNA, 25 bp, Rattus norvegicus
aggatagtaccctacgcacagctga

SEQ ID NO: 142407 - DNA, 25 bp, Rattus norvegicus
aggatagtagcaaggtctctgattt

SEQ ID NO: 142408 - DNA, 25 bp, Rattus norvegicus
aggatagtagcatggtctctgattt

SEQ ID NO: 142409 - DNA, 25 bp, Rattus norvegicus
aggatagtcatgcttcatccctgag

SEQ ID NO: 142410 - DNA, 25 bp, Rattus norvegicus
aggatagtcatggttcatccctgag

SEQ ID NO: 142411 - DNA, 25 bp, Rattus norvegicus
aggatagtccagagccccgttcttg

SEQ ID NO: 142412 - DNA, 25 bp, Rattus norvegicus
aggatagtccagtgccccgttcttg

SEQ ID NO: 142413 - DNA, 25 bp, Rattus norvegicus
aggatagtcctcagaatatgcttct

SEQ ID NO: 142414 - DNA, 25 bp, Rattus norvegicus
aggatagtcctctgaatatgcttct

SEQ ID NO: 142415 - DNA, 25 bp, Rattus norvegicus
aggatagtctgtctcgtcgttctac

SEQ ID NO: 142416 - DNA, 25 bp, Rattus norvegicus
aggatagtctgtgtcgtcgttctac

SEQ ID NO: 142417 - DNA, 25 bp, Rattus norvegicus
aggatagtgcatcccggtaacccaa

SEQ ID NO: 142418 - DNA, 25 bp, Rattus norvegicus
aggatagtgcatgccggtaacccaa

SEQ ID NO: 142419 - DNA, 25 bp, Rattus norvegicus
aggatagtgccaaatccaacaccct

SEQ ID NO: 142420 - DNA, 25 bp, Rattus norvegicus
aggatagtgccatatccaacaccct

SEQ ID NO: 142421 - DNA, 25 bp, Rattus norvegicus
aggatagtggctcctttctggctga

SEQ ID NO: 142422 - DNA, 25 bp, Rattus norvegicus
aggatagtggctgctttctggctga

SEQ ID NO: 142423 - DNA, 25 bp, Rattus norvegicus
aggatagttctcaccacaccgtgta

SEQ ID NO: 142424 - DNA, 25 bp, Rattus norvegicus
aggatagttctctccacaccgtgta

SEQ ID NO: 142425 - DNA, 25 bp, Rattus norvegicus
aggatatcaaaccagacagcccctg

SEQ ID NO: 142426 - DNA, 25 bp, Rattus norvegicus
aggatatcaaacgagacagcccctg

SEQ ID NO: 142427 - DNA, 25 bp, Rattus norvegicus
aggatatctaagcagcgtgtcccct

SEQ ID NO: 142428 - DNA, 25 bp, Rattus norvegicus
aggatatctaaggagcgtgtcccct

SEQ ID NO: 142429 - DNA, 25 bp, Rattus norvegicus
aggatatctaccagcggctgctagt

SEQ ID NO: 142430 - DNA, 25 bp, Rattus norvegicus
aggatatctacctgcggctgctagt

SEQ ID NO: 142431 - DNA, 25 bp, Rattus norvegicus
aggatatctcgcatctcctctgctt

SEQ ID NO: 142432 - DNA, 25 bp, Rattus norvegicus
aggatatctcgcttctcctctgctt

SEQ ID NO: 142433 - DNA, 25 bp, Rattus norvegicus
aggatatctctgagcagtggctgca

SEQ ID NO: 142434 - DNA, 25 bp, Rattus norvegicus
aggatatctctgtgcagtggctgca

SEQ ID NO: 142435 - DNA, 25 bp, Rattus norvegicus
aggatatctgacatcttacccacat

SEQ ID NO: 142436 - DNA, 25 bp, Rattus norvegicus
aggatatctgacttcttacccacat

SEQ ID NO: 142437 - DNA, 25 bp, Rattus norvegicus
aggatatcttcaaggactcaccgtc

SEQ ID NO: 142438 - DNA, 25 bp, Rattus norvegicus
aggatatcttcatggactcaccgtc

SEQ ID NO: 142439 - DNA, 25 bp, Rattus norvegicus
aggatatcttggctaacggctgccc

SEQ ID NO: 142440 - DNA, 25 bp, Rattus norvegicus
aggatatcttgggtaacggctgccc

SEQ ID NO: 142441 - DNA, 25 bp, Rattus norvegicus
aggatatgccacaactaaaggttag

SEQ ID NO: 142442 - DNA, 25 bp, Rattus norvegicus
aggatatgccacctgcgaactatga

SEQ ID NO: 142443 - DNA, 25 bp, Rattus norvegicus
aggatatgccacgtgcgaactatga

SEQ ID NO: 142444 - DNA, 25 bp, Rattus norvegicus
aggatatgccactactaaaggttag

SEQ ID NO: 142445 - DNA, 25 bp, Rattus norvegicus
aggatatgccgcagctctcaactgt

SEQ ID NO: 142446 - DNA, 25 bp, Rattus norvegicus
aggatatgccgctgctctcaactgt

SEQ ID NO: 142447 - DNA, 25 bp, Rattus norvegicus
aggatatgctagcagttccccggat

SEQ ID NO: 142448 - DNA, 25 bp, Rattus norvegicus
aggatatgctaggagttccccggat

SEQ ID NO: 142449 - DNA, 25 bp, Rattus norvegicus
aggatatggttcaatttacgactgc

SEQ ID NO: 142450 - DNA, 25 bp, Rattus norvegicus
aggatatggttctatttacgactgc

SEQ ID NO: 142451 - DNA, 25 bp, Rattus norvegicus
aggatatgtcccagagatggctcag

SEQ ID NO: 142452 - DNA, 25 bp, Rattus norvegicus
aggatatgtccctgagatggctcag

SEQ ID NO: 142453 - DNA, 25 bp, Rattus norvegicus
aggatatgttccatcttacagaaag

SEQ ID NO: 142454 - DNA, 25 bp, Rattus norvegicus
aggatatgttccttcttacagaaag

SEQ ID NO: 142455 - DNA, 25 bp, Rattus norvegicus
aggatattacatcctcactggagga

SEQ ID NO: 142456 - DNA, 25 bp, Rattus norvegicus
aggatattacatgctcactggagga

SEQ ID NO: 142457 - DNA, 25 bp, Rattus norvegicus
aggatattcggcctgtttcccacga

SEQ ID NO: 142458 - DNA, 25 bp, Rattus norvegicus
aggatattcggcgtgtttcccacga

SEQ ID NO: 142459 - DNA, 25 bp, Rattus norvegicus
aggatattctccagtctccacgtgt

SEQ ID NO: 142460 - DNA, 25 bp, Rattus norvegicus
aggatattctcctgtctccacgtgt

SEQ ID NO: 142461 - DNA, 25 bp, Rattus norvegicus
aggatattgcctatgtacacacaca

SEQ ID NO: 142462 - DNA, 25 bp, Rattus norvegicus
aggatattgcctttgtacacacaca

SEQ ID NO: 142463 - DNA, 25 bp, Rattus norvegicus
aggatattgggaagttcctcaggat

SEQ ID NO: 142464 - DNA, 25 bp, Rattus norvegicus
aggatattgggatgttcctcaggat

SEQ ID NO: 142465 - DNA, 25 bp, Rattus norvegicus
aggatattgtccagctcgcatgtca

SEQ ID NO: 142466 - DNA, 25 bp, Rattus norvegicus
aggatattgtcctgctcgcatgtca

SEQ ID NO: 142467 - DNA, 25 bp, Rattus norvegicus
aggatatttccccaatgagctgcgg

SEQ ID NO: 142468 - DNA, 25 bp, Rattus norvegicus
aggatatttcccgaatgagctgcgg

SEQ ID NO: 142469 - DNA, 25 bp, Rattus norvegicus
aggatatttttcatgcttccgcacg

SEQ ID NO: 142470 - DNA, 25 bp, Rattus norvegicus
aggatatttttcttgcttccgcacg

SEQ ID NO: 142471 - DNA, 25 bp, Rattus norvegicus
aggatcaaaggccatcgtgcccatc

SEQ ID NO: 142472 - DNA, 25 bp, Rattus norvegicus
aggatcaaaggcgatcgtgcccatc

SEQ ID NO: 142473 - DNA, 25 bp, Rattus norvegicus
aggatcaaatccaaccgccatggga

SEQ ID NO: 142474 - DNA, 25 bp, Rattus norvegicus
aggatcaaatccagggcctcatgaa

SEQ ID NO: 142475 - DNA, 25 bp, Rattus norvegicus
aggatcaaatcctaccgccatggga

SEQ ID NO: 142476 - DNA, 25 bp, Rattus norvegicus
aggatcaaatcctgggcctcatgaa

SEQ ID NO: 142477 - DNA, 25 bp, Rattus norvegicus
aggatcaacgttaccatgtctggct

SEQ ID NO: 142478 - DNA, 25 bp, Rattus norvegicus
aggatcaacgtttccatgtctggct

SEQ ID NO: 142479 - DNA, 25 bp, Rattus norvegicus
aggatcaagactcaagacccccaaa

SEQ ID NO: 142480 - DNA, 25 bp, Rattus norvegicus
aggatcaagactcctctgtctctca

SEQ ID NO: 142481 - DNA, 25 bp, Rattus norvegicus
aggatcaagactgaagacccccaaa

SEQ ID NO: 142482 - DNA, 25 bp, Rattus norvegicus
aggatcaagactgctctgtctctca

SEQ ID NO: 142483 - DNA, 25 bp, Rattus norvegicus
aggatcaagggcatgcagcatcccg

SEQ ID NO: 142484 - DNA, 25 bp, Rattus norvegicus
aggatcaagggcttgcagcatcccg

SEQ ID NO: 142485 - DNA, 25 bp, Rattus norvegicus
aggatcaagttaagctcctcccagg

SEQ ID NO: 142486 - DNA, 25 bp, Rattus norvegicus
aggatcaagttatgctcctcccagg

SEQ ID NO: 142487 - DNA, 25 bp, Rattus norvegicus
aggatcaattagaagccagttttta

SEQ ID NO: 142488 - DNA, 25 bp, Rattus norvegicus
aggatcaattagtagccagttttta

SEQ ID NO: 142489 - DNA, 25 bp, Rattus norvegicus
aggatcacaaccacaatggaaggag

SEQ ID NO: 142490 - DNA, 25 bp, Rattus norvegicus
aggatcacaacctcaatggaaggag

SEQ ID NO: 142491 - DNA, 25 bp, Rattus norvegicus
aggatcacaagtatgggaccagcta

SEQ ID NO: 142492 - DNA, 25 bp, Rattus norvegicus
aggatcacaagtttgggaccagcta

SEQ ID NO: 142493 - DNA, 25 bp, Rattus norvegicus
aggatcacacttaccacctgggaaa

SEQ ID NO: 142494 - DNA, 25 bp, Rattus norvegicus
aggatcacactttccacctgggaaa

SEQ ID NO: 142495 - DNA, 25 bp, Rattus norvegicus
aggatcacaggcatggacactccat

SEQ ID NO: 142496 - DNA, 25 bp, Rattus norvegicus
aggatcacaggcttggacactccat

SEQ ID NO: 142497 - DNA, 25 bp, Rattus norvegicus
aggatcacagtgactccaggataca

SEQ ID NO: 142498 - DNA, 25 bp, Rattus norvegicus
aggatcacagtgtctccaggataca

SEQ ID NO: 142499 - DNA, 25 bp, Rattus norvegicus
aggatcaccaaacggcctgtctcta

SEQ ID NO: 142500 - DNA, 25 bp, Rattus norvegicus
aggatcaccaaagggcctgtctcta

SEQ ID NO: 142501 - DNA, 25 bp, Rattus norvegicus
aggatcaccactcacctttccagag

SEQ ID NO: 142502 - DNA, 25 bp, Rattus norvegicus
aggatcaccactgacctttccagag

SEQ ID NO: 142503 - DNA, 25 bp, Rattus norvegicus
aggatcacccagctcgggtaccgct

SEQ ID NO: 142504 - DNA, 25 bp, Rattus norvegicus
aggatcacccaggtcgggtaccgct

SEQ ID NO: 142505 - DNA, 25 bp, Rattus norvegicus
aggatcacgctacgcaggtgtgcca

SEQ ID NO: 142506 - DNA, 25 bp, Rattus norvegicus
aggatcacgctaggcaggtgtgcca

SEQ ID NO: 142507 - DNA, 25 bp, Rattus norvegicus
aggatcactccaacaccggaaatga

SEQ ID NO: 142508 - DNA, 25 bp, Rattus norvegicus
aggatcactccatcaccggaaatga

SEQ ID NO: 142509 - DNA, 25 bp, Rattus norvegicus
aggatcagaaatcaccgtcctccac

SEQ ID NO: 142510 - DNA, 25 bp, Rattus norvegicus
aggatcagaaatgaccgtcctccac

SEQ ID NO: 142511 - DNA, 25 bp, Rattus norvegicus
aggatcagactcctgatgcctcatc

SEQ ID NO: 142512 - DNA, 25 bp, Rattus norvegicus
aggatcagactcgtgatgcctcatc

SEQ ID NO: 142513 - DNA, 25 bp, Rattus norvegicus
aggatcagatgaaaagctctacgaa

SEQ ID NO: 142514 - DNA, 25 bp, Rattus norvegicus
aggatcagatgataagctctacgaa

SEQ ID NO: 142515 - DNA, 25 bp, Rattus norvegicus
aggatcagcagaccccgtgaaggca

SEQ ID NO: 142516 - DNA, 25 bp, Rattus norvegicus
aggatcagcagagcccgtgaaggca

SEQ ID NO: 142517 - DNA, 25 bp, Rattus norvegicus
aggatcagcggcagcagatgctctc

SEQ ID NO: 142518 - DNA, 25 bp, Rattus norvegicus
aggatcagcggctgcagatgctctc

SEQ ID NO: 142519 - DNA, 25 bp, Rattus norvegicus
aggatcaggacacccctttccagga

SEQ ID NO: 142520 - DNA, 25 bp, Rattus norvegicus
aggatcaggacagccctttccagga

SEQ ID NO: 142521 - DNA, 25 bp, Rattus norvegicus
aggatcaggccacaggaggtcacat

SEQ ID NO: 142522 - DNA, 25 bp, Rattus norvegicus
aggatcaggccagaggaggtcacat

SEQ ID NO: 142523 - DNA, 25 bp, Rattus norvegicus
aggatcagtcccagatgtgccggct

SEQ ID NO: 142524 - DNA, 25 bp, Rattus norvegicus
aggatcagtccctgatgtgccggct

SEQ ID NO: 142525 - DNA, 25 bp, Rattus norvegicus
aggatcagtcgcctaagtgcgctca

SEQ ID NO: 142526 - DNA, 25 bp, Rattus norvegicus
aggatcagtcgcgtaagtgcgctca

SEQ ID NO: 142527 - DNA, 25 bp, Rattus norvegicus
aggatcatacagctttaaaaaccat

SEQ ID NO: 142528 - DNA, 25 bp, Rattus norvegicus
aggatcatacaggtttaaaaaccat

SEQ ID NO: 142529 - DNA, 25 bp, Rattus norvegicus
aggatcatagacagggcactctgtc

SEQ ID NO: 142530 - DNA, 25 bp, Rattus norvegicus
aggatcatagactgggcactctgtc

SEQ ID NO: 142531 - DNA, 25 bp, Rattus norvegicus
aggatcatcgacctggacctcgtta

SEQ ID NO: 142532 - DNA, 25 bp, Rattus norvegicus
aggatcatcgacgtggacctcgtta

SEQ ID NO: 142533 - DNA, 25 bp, Rattus norvegicus
aggatcatctggacctgatttttgt

SEQ ID NO: 142534 - DNA, 25 bp, Rattus norvegicus
aggatcatctggtcctgatttttgt

SEQ ID NO: 142535 - DNA, 25 bp, Rattus norvegicus
aggatcatctgtatccgcttgttga

SEQ ID NO: 142536 - DNA, 25 bp, Rattus norvegicus
aggatcatctgtttccgcttgttga

SEQ ID NO: 142537 - DNA, 25 bp, Rattus norvegicus
aggatcatgagccacacctacctac

SEQ ID NO: 142538 - DNA, 25 bp, Rattus norvegicus
aggatcatgagcgacacctacctac

SEQ ID NO: 142539 - DNA, 25 bp, Rattus norvegicus
aggatcatgattccctcagggctgc

SEQ ID NO: 142540 - DNA, 25 bp, Rattus norvegicus
aggatcatgattgcctcagggctgc

SEQ ID NO: 142541 - DNA, 25 bp, Rattus norvegicus
aggatccaatctcaacttttatatg

SEQ ID NO: 142542 - DNA, 25 bp, Rattus norvegicus
aggatccaatctgaacttttatatg

SEQ ID NO: 142543 - DNA, 25 bp, Rattus norvegicus
aggatccacactcgtcagatcacca

SEQ ID NO: 142544 - DNA, 25 bp, Rattus norvegicus
aggatccacactggtcagatcacca

SEQ ID NO: 142545 - DNA, 25 bp, Rattus norvegicus
aggatccagcatatgccgggtgatt

SEQ ID NO: 142546 - DNA, 25 bp, Rattus norvegicus
aggatccagcatttgccgggtgatt

SEQ ID NO: 142547 - DNA, 25 bp, Rattus norvegicus
aggatccatattacggcgcagactg

SEQ ID NO: 142548 - DNA, 25 bp, Rattus norvegicus
aggatccatatttcggcgcagactg

SEQ ID NO: 142549 - DNA, 25 bp, Rattus norvegicus
aggatccatgtgaatcacccgacat

SEQ ID NO: 142550 - DNA, 25 bp, Rattus norvegicus
aggatccatgtgtatcacccgacat

SEQ ID NO: 142551 - DNA, 25 bp, Rattus norvegicus
aggatccattgcagcttgatggcca

SEQ ID NO: 142552 - DNA, 25 bp, Rattus norvegicus
aggatccattgctgcttgatggcca

SEQ ID NO: 142553 - DNA, 25 bp, Rattus norvegicus
aggatcccacttcacagtgtctgtg

SEQ ID NO: 142554 - DNA, 25 bp, Rattus norvegicus
aggatcccacttgacagtgtctgtg

SEQ ID NO: 142555 - DNA, 25 bp, Rattus norvegicus
aggatcccagggacctcggaggcta

SEQ ID NO: 142556 - DNA, 25 bp, Rattus norvegicus
aggatcccagggtcctcggaggcta

SEQ ID NO: 142557 - DNA, 25 bp, Rattus norvegicus
aggatcccagtgaccaggcatgagc

SEQ ID NO: 142558 - DNA, 25 bp, Rattus norvegicus
aggatcccagtgtccaggcatgagc

SEQ ID NO: 142559 - DNA, 25 bp, Rattus norvegicus
aggatcccctctcttatttgaagaa

SEQ ID NO: 142560 - DNA, 25 bp, Rattus norvegicus
aggatcccctctgttatttgaagaa

SEQ ID NO: 142561 - DNA, 25 bp, Rattus norvegicus
aggatcccgcagcagccaatttagg

SEQ ID NO: 142562 - DNA, 25 bp, Rattus norvegicus
aggatcccgcaggagccaatttagg

SEQ ID NO: 142563 - DNA, 25 bp, Rattus norvegicus
aggatcccggtacattccctgtggt

SEQ ID NO: 142564 - DNA, 25 bp, Rattus norvegicus
aggatcccggtagattccctgtggt

SEQ ID NO: 142565 - DNA, 25 bp, Rattus norvegicus
aggatccctagtcactccctttaga

SEQ ID NO: 142566 - DNA, 25 bp, Rattus norvegicus
aggatccctagtgactccctttaga

SEQ ID NO: 142567 - DNA, 25 bp, Rattus norvegicus
aggatccctctactgctgaaaagta

SEQ ID NO: 142568 - DNA, 25 bp, Rattus norvegicus
aggatccctctagtgctgaaaagta

SEQ ID NO: 142569 - DNA, 25 bp, Rattus norvegicus
aggatccctgctataccacgaaggt

SEQ ID NO: 142570 - DNA, 25 bp, Rattus norvegicus
aggatccctgctctcttaagctttt

SEQ ID NO: 142571 - DNA, 25 bp, Rattus norvegicus
aggatccctgctgtcttaagctttt

SEQ ID NO: 142572 - DNA, 25 bp, Rattus norvegicus
aggatccctgctttaccacgaaggt

SEQ ID NO: 142573 - DNA, 25 bp, Rattus norvegicus
aggatccctggaacgtgtcacactg

SEQ ID NO: 142574 - DNA, 25 bp, Rattus norvegicus
aggatccctggaccgtattgatttc

SEQ ID NO: 142575 - DNA, 25 bp, Rattus norvegicus
aggatccctggagcgtattgatttc

SEQ ID NO: 142576 - DNA, 25 bp, Rattus norvegicus
aggatccctggatcgtgtcacactg

SEQ ID NO: 142577 - DNA, 25 bp, Rattus norvegicus
aggatcccttgaatggttacagtgg

SEQ ID NO: 142578 - DNA, 25 bp, Rattus norvegicus
aggatcccttgattggttacagtgg

SEQ ID NO: 142579 - DNA, 25 bp, Rattus norvegicus
aggatccgagacaatgcgtggcatt

SEQ ID NO: 142580 - DNA, 25 bp, Rattus norvegicus
aggatccgagactatgcgtggcatt

SEQ ID NO: 142581 - DNA, 25 bp, Rattus norvegicus
aggatccgaggcatgtgaacacagt

SEQ ID NO: 142582 - DNA, 25 bp, Rattus norvegicus
aggatccgaggcttgtgaacacagt

SEQ ID NO: 142583 - DNA, 25 bp, Rattus norvegicus
aggatccgctgcacgcagcatcagg

SEQ ID NO: 142584 - DNA, 25 bp, Rattus norvegicus
aggatccgctgctcgcagcatcagg

SEQ ID NO: 142585 - DNA, 25 bp, Rattus norvegicus
aggatcctaaatcgtgctgccctgc

SEQ ID NO: 142586 - DNA, 25 bp, Rattus norvegicus
aggatcctaaatggtgctgccctgc

SEQ ID NO: 142587 - DNA, 25 bp, Rattus norvegicus
aggatcctacatatcttccacagtt

SEQ ID NO: 142588 - DNA, 25 bp, Rattus norvegicus
aggatcctacatttcttccacagtt

SEQ ID NO: 142589 - DNA, 25 bp, Rattus norvegicus
aggatcctcctaatgctagacttgg

SEQ ID NO: 142590 - DNA, 25 bp, Rattus norvegicus
aggatcctcctattgctagacttgg

SEQ ID NO: 142591 - DNA, 25 bp, Rattus norvegicus
aggatcctccttatgcatgcgactc

SEQ ID NO: 142592 - DNA, 25 bp, Rattus norvegicus
aggatcctccttttgcatgcgactc

SEQ ID NO: 142593 - DNA, 25 bp, Rattus norvegicus
aggatcctcggacctgggctctgcc

SEQ ID NO: 142594 - DNA, 25 bp, Rattus norvegicus
aggatcctcggagctgggctctgcc

SEQ ID NO: 142595 - DNA, 25 bp, Rattus norvegicus
aggatcctgaggcacccggaagaat

SEQ ID NO: 142596 - DNA, 25 bp, Rattus norvegicus
aggatcctgagggacccggaagaat

SEQ ID NO: 142597 - DNA, 25 bp, Rattus norvegicus
aggatcctgagtagagctctgccca

SEQ ID NO: 142598 - DNA, 25 bp, Rattus norvegicus
aggatcctgagttgagctctgccca

SEQ ID NO: 142599 - DNA, 25 bp, Rattus norvegicus
aggatcctgcctaaagtcaacttat

SEQ ID NO: 142600 - DNA, 25 bp, Rattus norvegicus
aggatcctgccttaagtcaacttat

SEQ ID NO: 142601 - DNA, 25 bp, Rattus norvegicus
aggatcctgtctctgatgccttcag

SEQ ID NO: 142602 - DNA, 25 bp, Rattus norvegicus
aggatcctgtctgtgatgccttcag

SEQ ID NO: 142603 - DNA, 25 bp, Rattus norvegicus
aggatccttcggaggttggcccagt

SEQ ID NO: 142604 - DNA, 25 bp, Rattus norvegicus
aggatccttcggtggttggcccagt

SEQ ID NO: 142605 - DNA, 25 bp, Rattus norvegicus
aggatccttggaaacctacattcaa

SEQ ID NO: 142606 - DNA, 25 bp, Rattus norvegicus
aggatccttggatacctacattcaa

SEQ ID NO: 142607 - DNA, 25 bp, Rattus norvegicus
aggatccttgtgctatagagtcgac

SEQ ID NO: 142608 - DNA, 25 bp, Rattus norvegicus
aggatccttgtggtatagagtcgac

SEQ ID NO: 142609 - DNA, 25 bp, Rattus norvegicus
aggatcgaattcagctcttcatgcc

SEQ ID NO: 142610 - DNA, 25 bp, Rattus norvegicus
aggatcgaattctgctcttcatgcc

SEQ ID NO: 142611 - DNA, 25 bp, Rattus norvegicus
aggatcgacaccagtcaacctgaaa

SEQ ID NO: 142612 - DNA, 25 bp, Rattus norvegicus
aggatcgacacctgtcaacctgaaa

SEQ ID NO: 142613 - DNA, 25 bp, Rattus norvegicus
aggatcgccatccggatcacggcaa

SEQ ID NO: 142614 - DNA, 25 bp, Rattus norvegicus
aggatcgccatcgggatcacggcaa

SEQ ID NO: 142615 - DNA, 25 bp, Rattus norvegicus
aggatcgccgtaagacagccacctg

SEQ ID NO: 142616 - DNA, 25 bp, Rattus norvegicus
aggatcgccgtatgacagccacctg

SEQ ID NO: 142617 - DNA, 25 bp, Rattus norvegicus
aggatcggacaactcttcttcggtg

SEQ ID NO: 142618 - DNA, 25 bp, Rattus norvegicus
aggatcggacaagtcttcttcggtg

SEQ ID NO: 142619 - DNA, 25 bp, Rattus norvegicus
aggatcggatcaacacagccatcta

SEQ ID NO: 142620 - DNA, 25 bp, Rattus norvegicus
aggatcggatcatcacagccatcta

SEQ ID NO: 142621 - DNA, 25 bp, Rattus norvegicus
aggatcggcagacgcctccaaggca

SEQ ID NO: 142622 - DNA, 25 bp, Rattus norvegicus
aggatcggcagaggcctccaaggca

SEQ ID NO: 142623 - DNA, 25 bp, Rattus norvegicus
aggatcggcgctatgcaggcttgaa

SEQ ID NO: 142624 - DNA, 25 bp, Rattus norvegicus
aggatcggcgctttgcaggcttgaa

SEQ ID NO: 142625 - DNA, 25 bp, Rattus norvegicus
aggatcggttccatgggcatcacac

SEQ ID NO: 142626 - DNA, 25 bp, Rattus norvegicus
aggatcggttccttgggcatcacac

SEQ ID NO: 142627 - DNA, 25 bp, Rattus norvegicus
aggatcgtagcgactaccacacggt

SEQ ID NO: 142628 - DNA, 25 bp, Rattus norvegicus
aggatcgtagcgtctaccacacggt

SEQ ID NO: 142629 - DNA, 25 bp, Rattus norvegicus
aggatcgtcgtgatggacactcggt

SEQ ID NO: 142630 - DNA, 25 bp, Rattus norvegicus
aggatcgtcgtgttggacactcggt

SEQ ID NO: 142631 - DNA, 25 bp, Rattus norvegicus
aggatcgtctctcatgatgcccaga

SEQ ID NO: 142632 - DNA, 25 bp, Rattus norvegicus
aggatcgtctctgatgatgcccaga

SEQ ID NO: 142633 - DNA, 25 bp, Rattus norvegicus
aggatctaagttccctccatggatc

SEQ ID NO: 142634 - DNA, 25 bp, Rattus norvegicus
aggatctaagttgcctccatggatc

SEQ ID NO: 142635 - DNA, 25 bp, Rattus norvegicus
aggatctaggccagttctcttttca

SEQ ID NO: 142636 - DNA, 25 bp, Rattus norvegicus
aggatctaggcctgttctcttttca

SEQ ID NO: 142637 - DNA, 25 bp, Rattus norvegicus
aggatctagtccactatggcagcgc

SEQ ID NO: 142638 - DNA, 25 bp, Rattus norvegicus
aggatctagtcctctatggcagcgc

SEQ ID NO: 142639 - DNA, 25 bp, Rattus norvegicus
aggatctcacggatacctgcccact

SEQ ID NO: 142640 - DNA, 25 bp, Rattus norvegicus
aggatctcacggttacctgcccact

SEQ ID NO: 142641 - DNA, 25 bp, Rattus norvegicus
aggatctcagatatactgtccccac

SEQ ID NO: 142642 - DNA, 25 bp, Rattus norvegicus
aggatctcagatcttgggaacaaaa

SEQ ID NO: 142643 - DNA, 25 bp, Rattus norvegicus
aggatctcagatgttgggaacaaaa

SEQ ID NO: 142644 - DNA, 25 bp, Rattus norvegicus
aggatctcagatttactgtccccac

SEQ ID NO: 142645 - DNA, 25 bp, Rattus norvegicus
aggatctcagtgcagggtccacgct

SEQ ID NO: 142646 - DNA, 25 bp, Rattus norvegicus
aggatctcagtggagggtccacgct

SEQ ID NO: 142647 - DNA, 25 bp, Rattus norvegicus
aggatctccaacaccgaaggcgacg

SEQ ID NO: 142648 - DNA, 25 bp, Rattus norvegicus
aggatctccaactccgaaggcgacg

SEQ ID NO: 142649 - DNA, 25 bp, Rattus norvegicus
aggatctccagcacaggcttttggt

SEQ ID NO: 142650 - DNA, 25 bp, Rattus norvegicus
aggatctccagctcaggcttttggt

SEQ ID NO: 142651 - DNA, 25 bp, Rattus norvegicus
aggatctcccaacccgaagatagca

SEQ ID NO: 142652 - DNA, 25 bp, Rattus norvegicus
aggatctcccaagccgaagatagca

SEQ ID NO: 142653 - DNA, 25 bp, Rattus norvegicus
aggatctcctcgaggtagcctaagc

SEQ ID NO: 142654 - DNA, 25 bp, Rattus norvegicus
aggatctcctcgtggtagcctaagc

SEQ ID NO: 142655 - DNA, 25 bp, Rattus norvegicus
aggatctccttgaatagctcctctg

SEQ ID NO: 142656 - DNA, 25 bp, Rattus norvegicus
aggatctccttgtatagctcctctg

SEQ ID NO: 142657 - DNA, 25 bp, Rattus norvegicus
aggatctcgggtcctctggttacgt

SEQ ID NO: 142658 - DNA, 25 bp, Rattus norvegicus
aggatctcgggtgctctggttacgt

SEQ ID NO: 142659 - DNA, 25 bp, Rattus norvegicus
aggatctctactctcttggttgttg

SEQ ID NO: 142660 - DNA, 25 bp, Rattus norvegicus
aggatctctactgtcttggttgttg

SEQ ID NO: 142661 - DNA, 25 bp, Rattus norvegicus
aggatctctcaccagggaggcaagt

SEQ ID NO: 142662 - DNA, 25 bp, Rattus norvegicus
aggatctctcacgagggaggcaagt

SEQ ID NO: 142663 - DNA, 25 bp, Rattus norvegicus
aggatctctccacagttgtgcggaa

SEQ ID NO: 142664 - DNA, 25 bp, Rattus norvegicus
aggatctctccagagttgtgcggaa

SEQ ID NO: 142665 - DNA, 25 bp, Rattus norvegicus
aggatctctggcctgtagagcacag

SEQ ID NO: 142666 - DNA, 25 bp, Rattus norvegicus
aggatctctggcgtgtagagcacag

SEQ ID NO: 142667 - DNA, 25 bp, Rattus norvegicus
aggatctctgtgctccccggaggaa

SEQ ID NO: 142668 - DNA, 25 bp, Rattus norvegicus
aggatctctgtggtccccggaggaa

SEQ ID NO: 142669 - DNA, 25 bp, Rattus norvegicus
aggatctcttgacttcccggccaga

SEQ ID NO: 142670 - DNA, 25 bp, Rattus norvegicus
aggatctcttgagttcccggccaga

SEQ ID NO: 142671 - DNA, 25 bp, Rattus norvegicus
aggatctgactaatggctgagcccc

SEQ ID NO: 142672 - DNA, 25 bp, Rattus norvegicus
aggatctgactattggctgagcccc

SEQ ID NO: 142673 - DNA, 25 bp, Rattus norvegicus
aggatctgagccaactagtataaaa

SEQ ID NO: 142674 - DNA, 25 bp, Rattus norvegicus
aggatctgagcctactagtataaaa

SEQ ID NO: 142675 - DNA, 25 bp, Rattus norvegicus
aggatctgcaagctggagttcccac

SEQ ID NO: 142676 - DNA, 25 bp, Rattus norvegicus
aggatctgcaaggtggagttcccac

SEQ ID NO: 142677 - DNA, 25 bp, Rattus norvegicus
aggatctgccccagagaaagtcctc

SEQ ID NO: 142678 - DNA, 25 bp, Rattus norvegicus
aggatctgcccctgagaaagtcctc

SEQ ID NO: 142679 - DNA, 25 bp, Rattus norvegicus
aggatctgcctgagttggtccattc

SEQ ID NO: 142680 - DNA, 25 bp, Rattus norvegicus
aggatctgcctgtgttggtccattc

SEQ ID NO: 142681 - DNA, 25 bp, Rattus norvegicus
aggatctgcttcagtttaacctcag

SEQ ID NO: 142682 - DNA, 25 bp, Rattus norvegicus
aggatctgcttccagtgagccctta

SEQ ID NO: 142683 - DNA, 25 bp, Rattus norvegicus
aggatctgcttcgagtgagccctta

SEQ ID NO: 142684 - DNA, 25 bp, Rattus norvegicus
aggatctgcttctgtttaacctcag

SEQ ID NO: 142685 - DNA, 25 bp, Rattus norvegicus
aggatctggaatatgaggccaggct

SEQ ID NO: 142686 - DNA, 25 bp, Rattus norvegicus
aggatctggaatttgaggccaggct

SEQ ID NO: 142687 - DNA, 25 bp, Rattus norvegicus
aggatctggactaaccagtgtcccc

SEQ ID NO: 142688 - DNA, 25 bp, Rattus norvegicus
aggatctggactagtgtagccccac

SEQ ID NO: 142689 - DNA, 25 bp, Rattus norvegicus
aggatctggacttaccagtgtcccc

SEQ ID NO: 142690 - DNA, 25 bp, Rattus norvegicus
aggatctggacttgtgtagccccac

SEQ ID NO: 142691 - DNA, 25 bp, Rattus norvegicus
aggatctggcctcactgatgtgcag

SEQ ID NO: 142692 - DNA, 25 bp, Rattus norvegicus
aggatctggcctgactgatgtgcag

SEQ ID NO: 142693 - DNA, 25 bp, Rattus norvegicus
aggatctggcgcagctttcggatgc

SEQ ID NO: 142694 - DNA, 25 bp, Rattus norvegicus
aggatctggcgctgctttcggatgc

SEQ ID NO: 142695 - DNA, 25 bp, Rattus norvegicus
aggatctggtgcattgtatgagtca

SEQ ID NO: 142696 - DNA, 25 bp, Rattus norvegicus
aggatctggtgctttgtatgagtca

SEQ ID NO: 142697 - DNA, 25 bp, Rattus norvegicus
aggatctgtctccagccctgacctt

SEQ ID NO: 142698 - DNA, 25 bp, Rattus norvegicus
aggatctgtctcgagccctgacctt

SEQ ID NO: 142699 - DNA, 25 bp, Rattus norvegicus
aggatctgtgccaaggtcctaggcc

SEQ ID NO: 142700 - DNA, 25 bp, Rattus norvegicus
aggatctgtgcctaggtcctaggcc

SEQ ID NO: 142701 - DNA, 25 bp, Rattus norvegicus
aggatcttacaaatgctgctatgag

SEQ ID NO: 142702 - DNA, 25 bp, Rattus norvegicus
aggatcttacaattgctgctatgag

SEQ ID NO: 142703 - DNA, 25 bp, Rattus norvegicus
aggatcttactgaggccagccagga

SEQ ID NO: 142704 - DNA, 25 bp, Rattus norvegicus
aggatcttactgtggccagccagga

SEQ ID NO: 142705 - DNA, 25 bp, Rattus norvegicus
aggatcttcatgaacacctgcaatc

SEQ ID NO: 142706 - DNA, 25 bp, Rattus norvegicus
aggatcttcatgtacacctgcaatc

SEQ ID NO: 142707 - DNA, 25 bp, Rattus norvegicus
aggatcttctatatatgtcgtttat

SEQ ID NO: 142708 - DNA, 25 bp, Rattus norvegicus
aggatcttctatttatgtcgtttat

SEQ ID NO: 142709 - DNA, 25 bp, Rattus norvegicus
aggatcttctctcgcagggaccagg

SEQ ID NO: 142710 - DNA, 25 bp, Rattus norvegicus
aggatcttctctggcagggaccagg

SEQ ID NO: 142711 - DNA, 25 bp, Rattus norvegicus
aggatcttgacaatctcttccgtga

SEQ ID NO: 142712 - DNA, 25 bp, Rattus norvegicus
aggatcttgacattctcttccgtga

SEQ ID NO: 142713 - DNA, 25 bp, Rattus norvegicus
aggatcttgataccccaatactgtg

SEQ ID NO: 142714 - DNA, 25 bp, Rattus norvegicus
aggatcttgatagcccaatactgtg

SEQ ID NO: 142715 - DNA, 25 bp, Rattus norvegicus
aggatcttgcctcgatcacagcttc

SEQ ID NO: 142716 - DNA, 25 bp, Rattus norvegicus
aggatcttgcctggatcacagcttc

SEQ ID NO: 142717 - DNA, 25 bp, Rattus norvegicus
aggatcttgctaacactgtaaccaa

SEQ ID NO: 142718 - DNA, 25 bp, Rattus norvegicus
aggatcttgctatcactgtaaccaa

SEQ ID NO: 142719 - DNA, 25 bp, Rattus norvegicus
aggatctttcacaggacccgaggga

SEQ ID NO: 142720 - DNA, 25 bp, Rattus norvegicus
aggatctttcactggacccgaggga

SEQ ID NO: 142721 - DNA, 25 bp, Rattus norvegicus
aggatctttcctatagggtcatatt

SEQ ID NO: 142722 - DNA, 25 bp, Rattus norvegicus
aggatctttcctttagggtcatatt

SEQ ID NO: 142723 - DNA, 25 bp, Rattus norvegicus
aggatcttttgaaagccaccctgct

SEQ ID NO: 142724 - DNA, 25 bp, Rattus norvegicus
aggatcttttgatagccaccctgct

SEQ ID NO: 142725 - DNA, 25 bp, Rattus norvegicus
aggatgaaattccatcagccagttt

SEQ ID NO: 142726 - DNA, 25 bp, Rattus norvegicus
aggatgaaattcgatcagccagttt

SEQ ID NO: 142727 - DNA, 25 bp, Rattus norvegicus
aggatgaaccatcttcctggcttgt

SEQ ID NO: 142728 - DNA, 25 bp, Rattus norvegicus
aggatgaaccatgttcctggcttgt

SEQ ID NO: 142729 - DNA, 25 bp, Rattus norvegicus
aggatgaactgccagccatggcccg

SEQ ID NO: 142730 - DNA, 25 bp, Rattus norvegicus
aggatgaactgcgagccatggcccg

SEQ ID NO: 142731 - DNA, 25 bp, Rattus norvegicus
aggatgaactggactactgccacat

SEQ ID NO: 142732 - DNA, 25 bp, Rattus norvegicus
aggatgaactggtctactgccacat

SEQ ID NO: 142733 - DNA, 25 bp, Rattus norvegicus
aggatgaagacgctctgttacctca

SEQ ID NO: 142734 - DNA, 25 bp, Rattus norvegicus
aggatgaagacggtctgttacctca

SEQ ID NO: 142735 - DNA, 25 bp, Rattus norvegicus
aggatgaagcccaggccgttcttga

SEQ ID NO: 142736 - DNA, 25 bp, Rattus norvegicus
aggatgaagccctggccgttcttga

SEQ ID NO: 142737 - DNA, 25 bp, Rattus norvegicus
aggatgaagcctacctggcttctct

SEQ ID NO: 142738 - DNA, 25 bp, Rattus norvegicus
aggatgaagccttcctggcttctct

SEQ ID NO: 142739 - DNA, 25 bp, Rattus norvegicus
aggatgaatctcatccagcgtgcaa

SEQ ID NO: 142740 - DNA, 25 bp, Rattus norvegicus
aggatgaatctcttccagcgtgcaa

SEQ ID NO: 142741 - DNA, 25 bp, Rattus norvegicus
aggatgaatgcccttgtcccttagg

SEQ ID NO: 142742 - DNA, 25 bp, Rattus norvegicus
aggatgaatgccgttgtcccttagg

SEQ ID NO: 142743 - DNA, 25 bp, Rattus norvegicus
aggatgaattggagtgtctcccctg

SEQ ID NO: 142744 - DNA, 25 bp, Rattus norvegicus
aggatgaattggtgtgtctcccctg

SEQ ID NO: 142745 - DNA, 25 bp, Rattus norvegicus
aggatgacaagaactctctaccctt

SEQ ID NO: 142746 - DNA, 25 bp, Rattus norvegicus
aggatgacaagatctctctaccctt

SEQ ID NO: 142747 - DNA, 25 bp, Rattus norvegicus
aggatgacacaaccccttgattcca

SEQ ID NO: 142748 - DNA, 25 bp, Rattus norvegicus
aggatgacacaagcccttgattcca

SEQ ID NO: 142749 - DNA, 25 bp, Rattus norvegicus
aggatgacagcaccaattccactct

SEQ ID NO: 142750 - DNA, 25 bp, Rattus norvegicus
aggatgacagcagcaattccactct

SEQ ID NO: 142751 - DNA, 25 bp, Rattus norvegicus
aggatgacatccagttctggcccta

SEQ ID NO: 142752 - DNA, 25 bp, Rattus norvegicus
aggatgacatccatgaccggctaac

SEQ ID NO: 142753 - DNA, 25 bp, Rattus norvegicus
aggatgacatcctgttctggcccta

SEQ ID NO: 142754 - DNA, 25 bp, Rattus norvegicus
aggatgacatccttgaccggctaac

SEQ ID NO: 142755 - DNA, 25 bp, Rattus norvegicus
aggatgacatggaagagctgctgca

SEQ ID NO: 142756 - DNA, 25 bp, Rattus norvegicus
aggatgacatggtagagctgctgca

SEQ ID NO: 142757 - DNA, 25 bp, Rattus norvegicus
aggatgacatttacacacacgtgtt

SEQ ID NO: 142758 - DNA, 25 bp, Rattus norvegicus
aggatgacattttcacacacgtgtt

SEQ ID NO: 142759 - DNA, 25 bp, Rattus norvegicus
aggatgacccacaggagcagccttg

SEQ ID NO: 142760 - DNA, 25 bp, Rattus norvegicus
aggatgacccacaggtgactcctgt

SEQ ID NO: 142761 - DNA, 25 bp, Rattus norvegicus
aggatgacccactggagcagccttg

SEQ ID NO: 142762 - DNA, 25 bp, Rattus norvegicus
aggatgacccactggtgactcctgt

SEQ ID NO: 142763 - DNA, 25 bp, Rattus norvegicus
aggatgaccctgactttccaattgc

SEQ ID NO: 142764 - DNA, 25 bp, Rattus norvegicus
aggatgaccctgtctttccaattgc

SEQ ID NO: 142765 - DNA, 25 bp, Rattus norvegicus
aggatgacctcgactacaccagaat

SEQ ID NO: 142766 - DNA, 25 bp, Rattus norvegicus
aggatgacctcgtctacaccagaat

SEQ ID NO: 142767 - DNA, 25 bp, Rattus norvegicus
aggatgaccttcatggccatggtgt

SEQ ID NO: 142768 - DNA, 25 bp, Rattus norvegicus
aggatgaccttcttggccatggtgt

SEQ ID NO: 142769 - DNA, 25 bp, Rattus norvegicus
aggatgacgctgaatttctgcctcc

SEQ ID NO: 142770 - DNA, 25 bp, Rattus norvegicus
aggatgacgctgtatttctgcctcc

SEQ ID NO: 142771 - DNA, 25 bp, Rattus norvegicus
aggatgactctgagcccataaggca

SEQ ID NO: 142772 - DNA, 25 bp, Rattus norvegicus
aggatgactctgtgcccataaggca

SEQ ID NO: 142773 - DNA, 25 bp, Rattus norvegicus
aggatgactgccatgctcgagggaa

SEQ ID NO: 142774 - DNA, 25 bp, Rattus norvegicus
aggatgactgccttgctcgagggaa

SEQ ID NO: 142775 - DNA, 25 bp, Rattus norvegicus
aggatgacttaaccgactgtccctt

SEQ ID NO: 142776 - DNA, 25 bp, Rattus norvegicus
aggatgacttaagcgactgtccctt

SEQ ID NO: 142777 - DNA, 25 bp, Rattus norvegicus
aggatgacttgtatctccactacat

SEQ ID NO: 142778 - DNA, 25 bp, Rattus norvegicus
aggatgacttgtttctccactacat

SEQ ID NO: 142779 - DNA, 25 bp, Rattus norvegicus
aggatgagctggagctgctcgttca

SEQ ID NO: 142780 - DNA, 25 bp, Rattus norvegicus
aggatgagctggagctgttccacgc

SEQ ID NO: 142781 - DNA, 25 bp, Rattus norvegicus
aggatgagctggtgctgctcgttca

SEQ ID NO: 142782 - DNA, 25 bp, Rattus norvegicus
aggatgagctggtgctgttccacgc

SEQ ID NO: 142783 - DNA, 25 bp, Rattus norvegicus
aggatgaggctcatcatcgcacttc

SEQ ID NO: 142784 - DNA, 25 bp, Rattus norvegicus
aggatgaggctcttcatcgcacttc

SEQ ID NO: 142785 - DNA, 25 bp, Rattus norvegicus
aggatgagggtcaagccttggctac

SEQ ID NO: 142786 - DNA, 25 bp, Rattus norvegicus
aggatgagggtctagccttggctac

SEQ ID NO: 142787 - DNA, 25 bp, Rattus norvegicus
aggatgaggtacaatctcccagctg

SEQ ID NO: 142788 - DNA, 25 bp, Rattus norvegicus
aggatgaggtacaccaggctgcctg

SEQ ID NO: 142789 - DNA, 25 bp, Rattus norvegicus
aggatgaggtactatctcccagctg

SEQ ID NO: 142790 - DNA, 25 bp, Rattus norvegicus
aggatgaggtactccaggctgcctg

SEQ ID NO: 142791 - DNA, 25 bp, Rattus norvegicus
aggatgaggtgcagcttcggtccac

SEQ ID NO: 142792 - DNA, 25 bp, Rattus norvegicus
aggatgaggtgctgcttcggtccac

SEQ ID NO: 142793 - DNA, 25 bp, Rattus norvegicus
aggatgagtcacaggctccctatga

SEQ ID NO: 142794 - DNA, 25 bp, Rattus norvegicus
aggatgagtcactggctccctatga

SEQ ID NO: 142795 - DNA, 25 bp, Rattus norvegicus
aggatgagtcccagggtggctactc

SEQ ID NO: 142796 - DNA, 25 bp, Rattus norvegicus
aggatgagtccctgggtggctactc

SEQ ID NO: 142797 - DNA, 25 bp, Rattus norvegicus
aggatgagtgtccagcttggttctc

SEQ ID NO: 142798 - DNA, 25 bp, Rattus norvegicus
aggatgagtgtcgagcttggttctc

SEQ ID NO: 142799 - DNA, 25 bp, Rattus norvegicus
aggatgataatcctccatgtgtctc

SEQ ID NO: 142800 - DNA, 25 bp, Rattus norvegicus
aggatgataatcgtccatgtgtctc

SEQ ID NO: 142801 - DNA, 25 bp, Rattus norvegicus
aggatgatctagactgtgtatgttc

SEQ ID NO: 142802 - DNA, 25 bp, Rattus norvegicus
aggatgatctagtctgtgtatgttc

SEQ ID NO: 142803 - DNA, 25 bp, Rattus norvegicus
aggatgatgagtccctccgagaaat

SEQ ID NO: 142804 - DNA, 25 bp, Rattus norvegicus
aggatgatgagtgcctccgagaaat

SEQ ID NO: 142805 - DNA, 25 bp, Rattus norvegicus
aggatgatgtcccaaagcccaggaa

SEQ ID NO: 142806 - DNA, 25 bp, Rattus norvegicus
aggatgatgtccgaaagcccaggaa

SEQ ID NO: 142807 - DNA, 25 bp, Rattus norvegicus
aggatgattctcactcagcagaaga

SEQ ID NO: 142808 - DNA, 25 bp, Rattus norvegicus
aggatgattctctctcagcagaaga

SEQ ID NO: 142809 - DNA, 25 bp, Rattus norvegicus
aggatgattgttcaggagttttaat

SEQ ID NO: 142810 - DNA, 25 bp, Rattus norvegicus
aggatgattgttgaggagttttaat

SEQ ID NO: 142811 - DNA, 25 bp, Rattus norvegicus
aggatgcaacctcatgatagctcag

SEQ ID NO: 142812 - DNA, 25 bp, Rattus norvegicus
aggatgcaacctgatgatagctcag

SEQ ID NO: 142813 - DNA, 25 bp, Rattus norvegicus
aggatgcaagcacaatagaggattc

SEQ ID NO: 142814 - DNA, 25 bp, Rattus norvegicus
aggatgcaagcagaatagaggattc

SEQ ID NO: 142815 - DNA, 25 bp, Rattus norvegicus
aggatgcaatgaccctcgagtctgt

SEQ ID NO: 142816 - DNA, 25 bp, Rattus norvegicus
aggatgcaatgagcctcgagtctgt

SEQ ID NO: 142817 - DNA, 25 bp, Rattus norvegicus
aggatgcacagcacactcagtgttc

SEQ ID NO: 142818 - DNA, 25 bp, Rattus norvegicus
aggatgcacagctcactcagtgttc

SEQ ID NO: 142819 - DNA, 25 bp, Rattus norvegicus
aggatgcaccgccttaaagccacag

SEQ ID NO: 142820 - DNA, 25 bp, Rattus norvegicus
aggatgcaccgcgttaaagccacag

SEQ ID NO: 142821 - DNA, 25 bp, Rattus norvegicus
aggatgcactgcacctgctgttcct

SEQ ID NO: 142822 - DNA, 25 bp, Rattus norvegicus
aggatgcactgctcctgctgttcct

SEQ ID NO: 142823 - DNA, 25 bp, Rattus norvegicus
aggatgcagaatccctcctcggaga

SEQ ID NO: 142824 - DNA, 25 bp, Rattus norvegicus
aggatgcagaatgcctcctcggaga

SEQ ID NO: 142825 - DNA, 25 bp, Rattus norvegicus
aggatgcagctgaccacaagcaggg

SEQ ID NO: 142826 - DNA, 25 bp, Rattus norvegicus
aggatgcagctgtccacaagcaggg

SEQ ID NO: 142827 - DNA, 25 bp, Rattus norvegicus
aggatgcatcccatcagcagagaaa

SEQ ID NO: 142828 - DNA, 25 bp, Rattus norvegicus
aggatgcatcccttcagcagagaaa

SEQ ID NO: 142829 - DNA, 25 bp, Rattus norvegicus
aggatgcatcctctggaccaaggac

SEQ ID NO: 142830 - DNA, 25 bp, Rattus norvegicus
aggatgcatcctgtggaccaaggac

SEQ ID NO: 142831 - DNA, 25 bp, Rattus norvegicus
aggatgcatgctactgatgggccca

SEQ ID NO: 142832 - DNA, 25 bp, Rattus norvegicus
aggatgcatgcttctgatgggccca

SEQ ID NO: 142833 - DNA, 25 bp, Rattus norvegicus
aggatgcatgggagtcacacacagt

SEQ ID NO: 142834 - DNA, 25 bp, Rattus norvegicus
aggatgcatgggtgtcacacacagt

SEQ ID NO: 142835 - DNA, 25 bp, Rattus norvegicus
aggatgccattaatcggacggttgc

SEQ ID NO: 142836 - DNA, 25 bp, Rattus norvegicus
aggatgccattattcggacggttgc

SEQ ID NO: 142837 - DNA, 25 bp, Rattus norvegicus
aggatgcccctgaagaggttcgcaa

SEQ ID NO: 142838 - DNA, 25 bp, Rattus norvegicus
aggatgcccctgtagaggttcgcaa

SEQ ID NO: 142839 - DNA, 25 bp, Rattus norvegicus
aggatgccctcaccagatgtggaag

SEQ ID NO: 142840 - DNA, 25 bp, Rattus norvegicus
aggatgccctcagcagatgtggaag

SEQ ID NO: 142841 - DNA, 25 bp, Rattus norvegicus
aggatgcccttgaagtctcattatg

SEQ ID NO: 142842 - DNA, 25 bp, Rattus norvegicus
aggatgcccttgtagtctcattatg

SEQ ID NO: 142843 - DNA, 25 bp, Rattus norvegicus
aggatgccgcagaccattatctggc

SEQ ID NO: 142844 - DNA, 25 bp, Rattus norvegicus
aggatgccgcagtccattatctggc

SEQ ID NO: 142845 - DNA, 25 bp, Rattus norvegicus
aggatgccgggcaccccttagtcat

SEQ ID NO: 142846 - DNA, 25 bp, Rattus norvegicus
aggatgccgggctccccttagtcat

SEQ ID NO: 142847 - DNA, 25 bp, Rattus norvegicus
aggatgcctcccaaggcttcgtggc

SEQ ID NO: 142848 - DNA, 25 bp, Rattus norvegicus
aggatgcctcccagagctgtaaatt

SEQ ID NO: 142849 - DNA, 25 bp, Rattus norvegicus
aggatgcctccctaggcttcgtggc

SEQ ID NO: 142850 - DNA, 25 bp, Rattus norvegicus
aggatgcctccctgagctgtaaatt

SEQ ID NO: 142851 - DNA, 25 bp, Rattus norvegicus
aggatgcctctgcagagctggcctt

SEQ ID NO: 142852 - DNA, 25 bp, Rattus norvegicus
aggatgcctctggagagctggcctt

SEQ ID NO: 142853 - DNA, 25 bp, Rattus norvegicus
aggatgcgaattcccaagcgcccgg

SEQ ID NO: 142854 - DNA, 25 bp, Rattus norvegicus
aggatgcgaattgccaagcgcccgg

SEQ ID NO: 142855 - DNA, 25 bp, Rattus norvegicus
aggatgcgactgcttttggctttaa

SEQ ID NO: 142856 - DNA, 25 bp, Rattus norvegicus
aggatgcgactggttttggctttaa

SEQ ID NO: 142857 - DNA, 25 bp, Rattus norvegicus
aggatgcgctccaagtgattgctgc

SEQ ID NO: 142858 - DNA, 25 bp, Rattus norvegicus
aggatgcgctcctagtgattgctgc

SEQ ID NO: 142859 - DNA, 25 bp, Rattus norvegicus
aggatgcgctgtcagttccagtttc

SEQ ID NO: 142860 - DNA, 25 bp, Rattus norvegicus
aggatgcgctgtgagttccagtttc

SEQ ID NO: 142861 - DNA, 25 bp, Rattus norvegicus
aggatgcggaccaactgctgagagt

SEQ ID NO: 142862 - DNA, 25 bp, Rattus norvegicus
aggatgcggacctactgctgagagt

SEQ ID NO: 142863 - DNA, 25 bp, Rattus norvegicus
aggatgctaaaactcttctcaaaga

SEQ ID NO: 142864 - DNA, 25 bp, Rattus norvegicus
aggatgctaaaagtcttctcaaaga

SEQ ID NO: 142865 - DNA, 25 bp, Rattus norvegicus
aggatgctatgtcctgtgcatttct

SEQ ID NO: 142866 - DNA, 25 bp, Rattus norvegicus
aggatgctatgtgctgtgcatttct

SEQ ID NO: 142867 - DNA, 25 bp, Rattus norvegicus
aggatgctattcagccagagtacta

SEQ ID NO: 142868 - DNA, 25 bp, Rattus norvegicus
aggatgctattctgccagagtacta

SEQ ID NO: 142869 - DNA, 25 bp, Rattus norvegicus
aggatgctccttatgattgggtaaa

SEQ ID NO: 142870 - DNA, 25 bp, Rattus norvegicus
aggatgctccttttgattgggtaaa

SEQ ID NO: 142871 - DNA, 25 bp, Rattus norvegicus
aggatgctcgagaaggtccccaagc

SEQ ID NO: 142872 - DNA, 25 bp, Rattus norvegicus
aggatgctcgagtaggtccccaagc

SEQ ID NO: 142873 - DNA, 25 bp, Rattus norvegicus
aggatgctcgcgacgcctgtggacc

SEQ ID NO: 142874 - DNA, 25 bp, Rattus norvegicus
aggatgctcgcgtcgcctgtggacc

SEQ ID NO: 142875 - DNA, 25 bp, Rattus norvegicus
aggatgctctgcagttaggatcact

SEQ ID NO: 142876 - DNA, 25 bp, Rattus norvegicus
aggatgctctgctgttaggatcact

SEQ ID NO: 142877 - DNA, 25 bp, Rattus norvegicus
aggatgctctggatgccctgttcaa

SEQ ID NO: 142878 - DNA, 25 bp, Rattus norvegicus
aggatgctctggttgccctgttcaa

SEQ ID NO: 142879 - DNA, 25 bp, Rattus norvegicus
aggatgctctgtcctaccacacgga

SEQ ID NO: 142880 - DNA, 25 bp, Rattus norvegicus
aggatgctctgtgctaccacacgga

SEQ ID NO: 142881 - DNA, 25 bp, Rattus norvegicus
aggatgctcttccatttgtgttttt

SEQ ID NO: 142882 - DNA, 25 bp, Rattus norvegicus
aggatgctcttcgatttgtgttttt

SEQ ID NO: 142883 - DNA, 25 bp, Rattus norvegicus
aggatgctctttagtgggcacaaaa

SEQ ID NO: 142884 - DNA, 25 bp, Rattus norvegicus
aggatgctcttttgtgggcacaaaa

SEQ ID NO: 142885 - DNA, 25 bp, Rattus norvegicus
aggatgctgaagcacccaactgaca

SEQ ID NO: 142886 - DNA, 25 bp, Rattus norvegicus
aggatgctgaaggacccaactgaca

SEQ ID NO: 142887 - DNA, 25 bp, Rattus norvegicus
aggatgctgatgatctctgccctac

SEQ ID NO: 142888 - DNA, 25 bp, Rattus norvegicus
aggatgctgatgttctctgccctac

SEQ ID NO: 142889 - DNA, 25 bp, Rattus norvegicus
aggatgctgccaacaaaaacccatt

SEQ ID NO: 142890 - DNA, 25 bp, Rattus norvegicus
aggatgctgccatcaaaaacccatt

SEQ ID NO: 142891 - DNA, 25 bp, Rattus norvegicus
aggatgctgcctatgactgcttcat

SEQ ID NO: 142892 - DNA, 25 bp, Rattus norvegicus
aggatgctgcctttgactgcttcat

SEQ ID NO: 142893 - DNA, 25 bp, Rattus norvegicus
aggatgctgctcaggcccctgaatt

SEQ ID NO: 142894 - DNA, 25 bp, Rattus norvegicus
aggatgctgctctggcccctgaatt

SEQ ID NO: 142895 - DNA, 25 bp, Rattus norvegicus
aggatgctgcttctaattgtctata

SEQ ID NO: 142896 - DNA, 25 bp, Rattus norvegicus
aggatgctgcttgtaattgtctata

SEQ ID NO: 142897 - DNA, 25 bp, Rattus norvegicus
aggatgctggctacctacagatgca

SEQ ID NO: 142898 - DNA, 25 bp, Rattus norvegicus
aggatgctggcttcctacagatgca

SEQ ID NO: 142899 - DNA, 25 bp, Rattus norvegicus
aggatgctgtgcatctggacttggc

SEQ ID NO: 142900 - DNA, 25 bp, Rattus norvegicus
aggatgctgtgcttctggacttggc

SEQ ID NO: 142901 - DNA, 25 bp, Rattus norvegicus
aggatgctgtgtcccattcctccat

SEQ ID NO: 142902 - DNA, 25 bp, Rattus norvegicus
aggatgctgtgtgccattcctccat

SEQ ID NO: 142903 - DNA, 25 bp, Rattus norvegicus
aggatgcttatcatcactgtgcaaa

SEQ ID NO: 142904 - DNA, 25 bp, Rattus norvegicus
aggatgcttatcttcactgtgcaaa

SEQ ID NO: 142905 - DNA, 25 bp, Rattus norvegicus
aggatgcttcaaagggtgactccgg

SEQ ID NO: 142906 - DNA, 25 bp, Rattus norvegicus
aggatgcttcaatgggtgactccgg

SEQ ID NO: 142907 - DNA, 25 bp, Rattus norvegicus
aggatgcttcctatccacagaggca

SEQ ID NO: 142908 - DNA, 25 bp, Rattus norvegicus
aggatgcttcctctattcaccaatt

SEQ ID NO: 142909 - DNA, 25 bp, Rattus norvegicus
aggatgcttcctgtattcaccaatt

SEQ ID NO: 142910 - DNA, 25 bp, Rattus norvegicus
aggatgcttcctttccacagaggca

SEQ ID NO: 142911 - DNA, 25 bp, Rattus norvegicus
aggatgcttctccatcaagctgtaa

SEQ ID NO: 142912 - DNA, 25 bp, Rattus norvegicus
aggatgcttctcgatcaagctgtaa

SEQ ID NO: 142913 - DNA, 25 bp, Rattus norvegicus
aggatggaaaggacccctgcagaca

SEQ ID NO: 142914 - DNA, 25 bp, Rattus norvegicus
aggatggaaaggtcccctgcagaca

SEQ ID NO: 142915 - DNA, 25 bp, Rattus norvegicus
aggatggactcgctgctcattgcag

SEQ ID NO: 142916 - DNA, 25 bp, Rattus norvegicus
aggatggactcggtgctcattgcag

SEQ ID NO: 142917 - DNA, 25 bp, Rattus norvegicus
aggatggagcctattctgagctagt

SEQ ID NO: 142918 - DNA, 25 bp, Rattus norvegicus
aggatggagccttttctgagctagt

SEQ ID NO: 142919 - DNA, 25 bp, Rattus norvegicus
aggatggagctcagatcgccacctg

SEQ ID NO: 142920 - DNA, 25 bp, Rattus norvegicus
aggatggagctctgatcgccacctg

SEQ ID NO: 142921 - DNA, 25 bp, Rattus norvegicus
aggatggaggagagatgcccactta

SEQ ID NO: 142922 - DNA, 25 bp, Rattus norvegicus
aggatggaggagtgatgcccactta

SEQ ID NO: 142923 - DNA, 25 bp, Rattus norvegicus
aggatggagttcaggaccccaaaca

SEQ ID NO: 142924 - DNA, 25 bp, Rattus norvegicus
aggatggagttctggaccccaaaca

SEQ ID NO: 142925 - DNA, 25 bp, Rattus norvegicus
aggatggatgccactatgcagctag

SEQ ID NO: 142926 - DNA, 25 bp, Rattus norvegicus
aggatggatgcctctatgcagctag

SEQ ID NO: 142927 - DNA, 25 bp, Rattus norvegicus
aggatggatttaatccctgaccctg

SEQ ID NO: 142928 - DNA, 25 bp, Rattus norvegicus
aggatggatttattccctgaccctg

SEQ ID NO: 142929 - DNA, 25 bp, Rattus norvegicus
aggatggattttagttctgtacttc

SEQ ID NO: 142930 - DNA, 25 bp, Rattus norvegicus
aggatggatttttgttctgtacttc

SEQ ID NO: 142931 - DNA, 25 bp, Rattus norvegicus
aggatggcacatacctcttagccat

SEQ ID NO: 142932 - DNA, 25 bp, Rattus norvegicus
aggatggcacattcctcttagccat

SEQ ID NO: 142933 - DNA, 25 bp, Rattus norvegicus
aggatggcacgacagtactaaaggt

SEQ ID NO: 142934 - DNA, 25 bp, Rattus norvegicus
aggatggcacgagagtactaaaggt

SEQ ID NO: 142935 - DNA, 25 bp, Rattus norvegicus
aggatggcacttccagtcactttgc

SEQ ID NO: 142936 - DNA, 25 bp, Rattus norvegicus
aggatggcacttgcagtcactttgc

SEQ ID NO: 142937 - DNA, 25 bp, Rattus norvegicus
aggatggccatcagagcgctgagac

SEQ ID NO: 142938 - DNA, 25 bp, Rattus norvegicus
aggatggccatctgagcgctgagac

SEQ ID NO: 142939 - DNA, 25 bp, Rattus norvegicus
aggatggccccaccgcagacacaaa

SEQ ID NO: 142940 - DNA, 25 bp, Rattus norvegicus
aggatggccccagcgcagacacaaa

SEQ ID NO: 142941 - DNA, 25 bp, Rattus norvegicus
aggatggccctactgcaggttgcac

SEQ ID NO: 142942 - DNA, 25 bp, Rattus norvegicus
aggatggccctagtgcaggttgcac

SEQ ID NO: 142943 - DNA, 25 bp, Rattus norvegicus
aggatggccttaacaggtatcaatg

SEQ ID NO: 142944 - DNA, 25 bp, Rattus norvegicus
aggatggccttatcaggtatcaatg

SEQ ID NO: 142945 - DNA, 25 bp, Rattus norvegicus
aggatggcgcagaacccagtgccaa

SEQ ID NO: 142946 - DNA, 25 bp, Rattus norvegicus
aggatggcgcagtacccagtgccaa

SEQ ID NO: 142947 - DNA, 25 bp, Rattus norvegicus
aggatggcgtggacatacttctctt

SEQ ID NO: 142948 - DNA, 25 bp, Rattus norvegicus
aggatggcgtggtcatacttctctt

SEQ ID NO: 142949 - DNA, 25 bp, Rattus norvegicus
aggatggcgttcaatggctgctgtc

SEQ ID NO: 142950 - DNA, 25 bp, Rattus norvegicus
aggatggcgttctatggctgctgtc

SEQ ID NO: 142951 - DNA, 25 bp, Rattus norvegicus
aggatggctaccactcagggctgaa

SEQ ID NO: 142952 - DNA, 25 bp, Rattus norvegicus
aggatggctacctctcagggctgaa

SEQ ID NO: 142953 - DNA, 25 bp, Rattus norvegicus
aggatggctcctcccactgaacagg

SEQ ID NO: 142954 - DNA, 25 bp, Rattus norvegicus
aggatggctcctgccactgaacagg

SEQ ID NO: 142955 - DNA, 25 bp, Rattus norvegicus
aggatggctcttacccaagtggagg

SEQ ID NO: 142956 - DNA, 25 bp, Rattus norvegicus
aggatggctctttcccaagtggagg

SEQ ID NO: 142957 - DNA, 25 bp, Rattus norvegicus
aggatggctgcacgaccactgcctt

SEQ ID NO: 142958 - DNA, 25 bp, Rattus norvegicus
aggatggctgcaggaccactgcctt

SEQ ID NO: 142959 - DNA, 25 bp, Rattus norvegicus
aggatggctgcgacctggttattgc

SEQ ID NO: 142960 - DNA, 25 bp, Rattus norvegicus
aggatggctgcgtcctggttattgc

SEQ ID NO: 142961 - DNA, 25 bp, Rattus norvegicus
aggatgggaccgctgacatgcacat

SEQ ID NO: 142962 - DNA, 25 bp, Rattus norvegicus
aggatgggaccggtgacatgcacat

SEQ ID NO: 142963 - DNA, 25 bp, Rattus norvegicus
aggatgggccatctgcgccgggcag

SEQ ID NO: 142964 - DNA, 25 bp, Rattus norvegicus
aggatgggccatgtgcgccgggcag

SEQ ID NO: 142965 - DNA, 25 bp, Rattus norvegicus
aggatggtcctacatctccctgtcc

SEQ ID NO: 142966 - DNA, 25 bp, Rattus norvegicus
aggatggtcctagatctccctgtcc

SEQ ID NO: 142967 - DNA, 25 bp, Rattus norvegicus
aggatggtgtgcacacgtgcgcaat

SEQ ID NO: 142968 - DNA, 25 bp, Rattus norvegicus
aggatggtgtgctcacgtgcgcaat

SEQ ID NO: 142969 - DNA, 25 bp, Rattus norvegicus
aggatggttcccactctgccggtgg

SEQ ID NO: 142970 - DNA, 25 bp, Rattus norvegicus
aggatggttccctctctgccggtgg

SEQ ID NO: 142971 - DNA, 25 bp, Rattus norvegicus
aggatggttgcaaagctctctggct

SEQ ID NO: 142972 - DNA, 25 bp, Rattus norvegicus
aggatggttgcatagctctctggct

SEQ ID NO: 142973 - DNA, 25 bp, Rattus norvegicus
aggatggtttcgatgtctcccacaa

SEQ ID NO: 142974 - DNA, 25 bp, Rattus norvegicus
aggatggtttcgttgtctcccacaa

SEQ ID NO: 142975 - DNA, 25 bp, Rattus norvegicus
aggatggtttgactccagcctaggc

SEQ ID NO: 142976 - DNA, 25 bp, Rattus norvegicus
aggatggtttgagtccagcctaggc

SEQ ID NO: 142977 - DNA, 25 bp, Rattus norvegicus
aggatgtaaaacaggccttgaggcc

SEQ ID NO: 142978 - DNA, 25 bp, Rattus norvegicus
aggatgtaaaactggccttgaggcc

SEQ ID NO: 142979 - DNA, 25 bp, Rattus norvegicus
aggatgtaaccactactccatgctg

SEQ ID NO: 142980 - DNA, 25 bp, Rattus norvegicus
aggatgtaaccagtactccatgctg

SEQ ID NO: 142981 - DNA, 25 bp, Rattus norvegicus
aggatgtacaggctctagtttctac

SEQ ID NO: 142982 - DNA, 25 bp, Rattus norvegicus
aggatgtacagggtctagtttctac

SEQ ID NO: 142983 - DNA, 25 bp, Rattus norvegicus
aggatgtaccaccagaacccaagaa

SEQ ID NO: 142984 - DNA, 25 bp, Rattus norvegicus
aggatgtaccacgagaacccaagaa

SEQ ID NO: 142985 - DNA, 25 bp, Rattus norvegicus
aggatgtagagtccctccagttcag

SEQ ID NO: 142986 - DNA, 25 bp, Rattus norvegicus
aggatgtagagtgcctccagttcag

SEQ ID NO: 142987 - DNA, 25 bp, Rattus norvegicus
aggatgtcactgagcttctccagaa

SEQ ID NO: 142988 - DNA, 25 bp, Rattus norvegicus
aggatgtcactgctggcctgttcta

SEQ ID NO: 142989 - DNA, 25 bp, Rattus norvegicus
aggatgtcactggtggcctgttcta

SEQ ID NO: 142990 - DNA, 25 bp, Rattus norvegicus
aggatgtcactgtgcttctccagaa

SEQ ID NO: 142991 - DNA, 25 bp, Rattus norvegicus
aggatgtcagccctatgattcttca

SEQ ID NO: 142992 - DNA, 25 bp, Rattus norvegicus
aggatgtcagccgtatgattcttca

SEQ ID NO: 142993 - DNA, 25 bp, Rattus norvegicus
aggatgtcagtgcaacaaccccgcc

SEQ ID NO: 142994 - DNA, 25 bp, Rattus norvegicus
aggatgtcagtggaacaaccccgcc

SEQ ID NO: 142995 - DNA, 25 bp, Rattus norvegicus
aggatgtcatctctaccagccgcga

SEQ ID NO: 142996 - DNA, 25 bp, Rattus norvegicus
aggatgtcatctgtaccagccgcga

SEQ ID NO: 142997 - DNA, 25 bp, Rattus norvegicus
aggatgtccccaagtctgtcagtgt

SEQ ID NO: 142998 - DNA, 25 bp, Rattus norvegicus
aggatgtccccatgtctgtcagtgt

SEQ ID NO: 142999 - DNA, 25 bp, Rattus norvegicus
aggatgtcccctcagtattagctgt

SEQ ID NO: 143000 - DNA, 25 bp, Rattus norvegicus
aggatgtcccctgagtattagctgt

SEQ ID NO: 143001 - DNA, 25 bp, Rattus norvegicus
aggatgtccgccaggcttttggaga

SEQ ID NO: 143002 - DNA, 25 bp, Rattus norvegicus
aggatgtccgcctggcttttggaga

SEQ ID NO: 143003 - DNA, 25 bp, Rattus norvegicus
aggatgtccgtgctgcttcttacac

SEQ ID NO: 143004 - DNA, 25 bp, Rattus norvegicus
aggatgtccgtggtgcttcttacac

SEQ ID NO: 143005 - DNA, 25 bp, Rattus norvegicus
aggatgtcctctctcctctgcagca

SEQ ID NO: 143006 - DNA, 25 bp, Rattus norvegicus
aggatgtcctctgtcctctgcagca

SEQ ID NO: 143007 - DNA, 25 bp, Rattus norvegicus
aggatgtccttcaggccctagtcag

SEQ ID NO: 143008 - DNA, 25 bp, Rattus norvegicus
aggatgtccttctggccctagtcag

SEQ ID NO: 143009 - DNA, 25 bp, Rattus norvegicus
aggatgtcgatcaggacccaactca

SEQ ID NO: 143010 - DNA, 25 bp, Rattus norvegicus
aggatgtcgatctggacccaactca

SEQ ID NO: 143011 - DNA, 25 bp, Rattus norvegicus
aggatgtctctcagtagtgcgtgct

SEQ ID NO: 143012 - DNA, 25 bp, Rattus norvegicus
aggatgtctctctgtagtgcgtgct

SEQ ID NO: 143013 - DNA, 25 bp, Rattus norvegicus
aggatgtctgtgactctaccctctg

SEQ ID NO: 143014 - DNA, 25 bp, Rattus norvegicus
aggatgtctgtgtctctaccctctg

SEQ ID NO: 143015 - DNA, 25 bp, Rattus norvegicus
aggatgtcttccactttgtccagga

SEQ ID NO: 143016 - DNA, 25 bp, Rattus norvegicus
aggatgtcttcccagtctgtcctga

SEQ ID NO: 143017 - DNA, 25 bp, Rattus norvegicus
aggatgtcttccgagtctgtcctga

SEQ ID NO: 143018 - DNA, 25 bp, Rattus norvegicus
aggatgtcttcctctttgtccagga

SEQ ID NO: 143019 - DNA, 25 bp, Rattus norvegicus
aggatgtcttctctttggtccacca

SEQ ID NO: 143020 - DNA, 25 bp, Rattus norvegicus
aggatgtcttctgtttggtccacca

SEQ ID NO: 143021 - DNA, 25 bp, Rattus norvegicus
aggatgtgacgcacacatgtcccag

SEQ ID NO: 143022 - DNA, 25 bp, Rattus norvegicus
aggatgtgacgctcacatgtcccag

SEQ ID NO: 143023 - DNA, 25 bp, Rattus norvegicus
aggatgtgatgccagccctgcagtt

SEQ ID NO: 143024 - DNA, 25 bp, Rattus norvegicus
aggatgtgatgcgagccctgcagtt

SEQ ID NO: 143025 - DNA, 25 bp, Rattus norvegicus
aggatgtgcatgcactctttgataa

SEQ ID NO: 143026 - DNA, 25 bp, Rattus norvegicus
aggatgtgcatggactctttgataa

SEQ ID NO: 143027 - DNA, 25 bp, Rattus norvegicus
aggatgtgcggacaacctcagctac

SEQ ID NO: 143028 - DNA, 25 bp, Rattus norvegicus
aggatgtgcggagaacctcagctac

SEQ ID NO: 143029 - DNA, 25 bp, Rattus norvegicus
aggatgtggaacctcacttctctct

SEQ ID NO: 143030 - DNA, 25 bp, Rattus norvegicus
aggatgtggaacctggtgctccatc

SEQ ID NO: 143031 - DNA, 25 bp, Rattus norvegicus
aggatgtggaacgtcacttctctct

SEQ ID NO: 143032 - DNA, 25 bp, Rattus norvegicus
aggatgtggaacgtggtgctccatc

SEQ ID NO: 143033 - DNA, 25 bp, Rattus norvegicus
aggatgtggagaaccagcctttccc

SEQ ID NO: 143034 - DNA, 25 bp, Rattus norvegicus
aggatgtggagatccagcctttccc

SEQ ID NO: 143035 - DNA, 25 bp, Rattus norvegicus
aggatgtggatgcttacaccctggc

SEQ ID NO: 143036 - DNA, 25 bp, Rattus norvegicus
aggatgtggatggttacaccctggc

SEQ ID NO: 143037 - DNA, 25 bp, Rattus norvegicus
aggatgtggtccctccttatagagc

SEQ ID NO: 143038 - DNA, 25 bp, Rattus norvegicus
aggatgtggtccgtccttatagagc

SEQ ID NO: 143039 - DNA, 25 bp, Rattus norvegicus
aggatgtggtctcctccattcggaa

SEQ ID NO: 143040 - DNA, 25 bp, Rattus norvegicus
aggatgtggtctgctccattcggaa

SEQ ID NO: 143041 - DNA, 25 bp, Rattus norvegicus
aggatgtgtaccatcaacttcttcc

SEQ ID NO: 143042 - DNA, 25 bp, Rattus norvegicus
aggatgtgtaccttcaacttcttcc

SEQ ID NO: 143043 - DNA, 25 bp, Rattus norvegicus
aggatgtgtttgatattcttgagac

SEQ ID NO: 143044 - DNA, 25 bp, Rattus norvegicus
aggatgtgtttgttattcttgagac

SEQ ID NO: 143045 - DNA, 25 bp, Rattus norvegicus
aggatgttacgtagttgctgcttta

SEQ ID NO: 143046 - DNA, 25 bp, Rattus norvegicus
aggatgttacgttgttgctgcttta

SEQ ID NO: 143047 - DNA, 25 bp, Rattus norvegicus
aggatgttactcaggagccctggtt

SEQ ID NO: 143048 - DNA, 25 bp, Rattus norvegicus
aggatgttactctggagccctggtt

SEQ ID NO: 143049 - DNA, 25 bp, Rattus norvegicus
aggatgttacttcttttgcactgca

SEQ ID NO: 143050 - DNA, 25 bp, Rattus norvegicus
aggatgttacttgttttgcactgca

SEQ ID NO: 143051 - DNA, 25 bp, Rattus norvegicus
aggatgttcatgctagatcgttaga

SEQ ID NO: 143052 - DNA, 25 bp, Rattus norvegicus
aggatgttcatggtagatcgttaga

SEQ ID NO: 143053 - DNA, 25 bp, Rattus norvegicus
aggatgttccagacatcccagtact

SEQ ID NO: 143054 - DNA, 25 bp, Rattus norvegicus
aggatgttccagtcatcccagtact

SEQ ID NO: 143055 - DNA, 25 bp, Rattus norvegicus
aggatgttcccgcaactctaaaact

SEQ ID NO: 143056 - DNA, 25 bp, Rattus norvegicus
aggatgttcccggaactctaaaact

SEQ ID NO: 143057 - DNA, 25 bp, Rattus norvegicus
aggatgttccgcctttgggcattca

SEQ ID NO: 143058 - DNA, 25 bp, Rattus norvegicus
aggatgttccgcgtttgggcattca

SEQ ID NO: 143059 - DNA, 25 bp, Rattus norvegicus
aggatgttcctcatagctttttatt

SEQ ID NO: 143060 - DNA, 25 bp, Rattus norvegicus
aggatgttcctcttagctttttatt

SEQ ID NO: 143061 - DNA, 25 bp, Rattus norvegicus
aggatgttcgatcctccttcgagga

SEQ ID NO: 143062 - DNA, 25 bp, Rattus norvegicus
aggatgttcgatgctccttcgagga

SEQ ID NO: 143063 - DNA, 25 bp, Rattus norvegicus
aggatgttctgcctcttaaggtgat

SEQ ID NO: 143064 - DNA, 25 bp, Rattus norvegicus
aggatgttctgcgtcttaaggtgat

SEQ ID NO: 143065 - DNA, 25 bp, Rattus norvegicus
aggatgtttattaccccgtgatgat

SEQ ID NO: 143066 - DNA, 25 bp, Rattus norvegicus
aggatgtttatttccccgtgatgat

SEQ ID NO: 143067 - DNA, 25 bp, Rattus norvegicus
aggatgtttcagacctccacgcaat

SEQ ID NO: 143068 - DNA, 25 bp, Rattus norvegicus
aggatgtttcagtcctccacgcaat

SEQ ID NO: 143069 - DNA, 25 bp, Rattus norvegicus
aggatgttttttccctcagcctcag

SEQ ID NO: 143070 - DNA, 25 bp, Rattus norvegicus
aggatgttttttgcctcagcctcag

SEQ ID NO: 143071 - DNA, 25 bp, Rattus norvegicus
aggattaacattcggacggccccag

SEQ ID NO: 143072 - DNA, 25 bp, Rattus norvegicus
aggattaacattgggacggccccag

SEQ ID NO: 143073 - DNA, 25 bp, Rattus norvegicus
aggattaactctcccttgttacaat

SEQ ID NO: 143074 - DNA, 25 bp, Rattus norvegicus
aggattaactctgccttgttacaat

SEQ ID NO: 143075 - DNA, 25 bp, Rattus norvegicus
aggattaatggtcacccttcttctt

SEQ ID NO: 143076 - DNA, 25 bp, Rattus norvegicus
aggattaatggtgacccttcttctt

SEQ ID NO: 143077 - DNA, 25 bp, Rattus norvegicus
aggattaatttaatctcttgccatt

SEQ ID NO: 143078 - DNA, 25 bp, Rattus norvegicus
aggattaatttattctcttgccatt

SEQ ID NO: 143079 - DNA, 25 bp, Rattus norvegicus
aggattacagaacacatctccatgt

SEQ ID NO: 143080 - DNA, 25 bp, Rattus norvegicus
aggattacagaagacatctccatgt

SEQ ID NO: 143081 - DNA, 25 bp, Rattus norvegicus
aggattacaggcatggaagctcagg

SEQ ID NO: 143082 - DNA, 25 bp, Rattus norvegicus
aggattacaggcttggaagctcagg

SEQ ID NO: 143083 - DNA, 25 bp, Rattus norvegicus
aggattacagttatacctctctccc

SEQ ID NO: 143084 - DNA, 25 bp, Rattus norvegicus
aggattacagttttacctctctccc

SEQ ID NO: 143085 - DNA, 25 bp, Rattus norvegicus
aggattacatctccgctgtgactac

SEQ ID NO: 143086 - DNA, 25 bp, Rattus norvegicus
aggattacatctgcgctgtgactac

SEQ ID NO: 143087 - DNA, 25 bp, Rattus norvegicus
aggattaccagtatgaccctgagag

SEQ ID NO: 143088 - DNA, 25 bp, Rattus norvegicus
aggattaccagtttgaccctgagag

SEQ ID NO: 143089 - DNA, 25 bp, Rattus norvegicus
aggattacccagagctgtgtgcttc

SEQ ID NO: 143090 - DNA, 25 bp, Rattus norvegicus
aggattacccagtgctgtgtgcttc

SEQ ID NO: 143091 - DNA, 25 bp, Rattus norvegicus
aggattaccgaaagctgagcagcaa

SEQ ID NO: 143092 - DNA, 25 bp, Rattus norvegicus
aggattaccgaatgctgagcagcaa

SEQ ID NO: 143093 - DNA, 25 bp, Rattus norvegicus
aggattacgcacattctacacactg

SEQ ID NO: 143094 - DNA, 25 bp, Rattus norvegicus
aggattacgcactttctacacactg

SEQ ID NO: 143095 - DNA, 25 bp, Rattus norvegicus
aggattactggtctgtgctgtcaca

SEQ ID NO: 143096 - DNA, 25 bp, Rattus norvegicus
aggattactggtgtgtgctgtcaca

SEQ ID NO: 143097 - DNA, 25 bp, Rattus norvegicus
aggattagtaccacaatctcctctg

SEQ ID NO: 143098 - DNA, 25 bp, Rattus norvegicus
aggattagtacctcaatctcctctg

SEQ ID NO: 143099 - DNA, 25 bp, Rattus norvegicus
aggattatggctcatttacctaaaa

SEQ ID NO: 143100 - DNA, 25 bp, Rattus norvegicus
aggattatggctgatttacctaaaa

SEQ ID NO: 143101 - DNA, 25 bp, Rattus norvegicus
aggattatgggcctgcacaccatgt

SEQ ID NO: 143102 - DNA, 25 bp, Rattus norvegicus
aggattatgggcgtgcacaccatgt

SEQ ID NO: 143103 - DNA, 25 bp, Rattus norvegicus
aggattattagtagctcagagacaa

SEQ ID NO: 143104 - DNA, 25 bp, Rattus norvegicus
aggattattagttgctcagagacaa

SEQ ID NO: 143105 - DNA, 25 bp, Rattus norvegicus
aggattcaaaacactctgccaaaga

SEQ ID NO: 143106 - DNA, 25 bp, Rattus norvegicus
aggattcaaaactctctgccaaaga

SEQ ID NO: 143107 - DNA, 25 bp, Rattus norvegicus
aggattcaccctcacatacattatt

SEQ ID NO: 143108 - DNA, 25 bp, Rattus norvegicus
aggattcaccctgacatacattatt

SEQ ID NO: 143109 - DNA, 25 bp, Rattus norvegicus
aggattcagcccaggttcaactgca

SEQ ID NO: 143110 - DNA, 25 bp, Rattus norvegicus
aggattcagccctggttcaactgca

SEQ ID NO: 143111 - DNA, 25 bp, Rattus norvegicus
aggattcagcttctggtcacagcca

SEQ ID NO: 143112 - DNA, 25 bp, Rattus norvegicus
aggattcagcttgtggtcacagcca

SEQ ID NO: 143113 - DNA, 25 bp, Rattus norvegicus
aggattcaggccatagctgctacct

SEQ ID NO: 143114 - DNA, 25 bp, Rattus norvegicus
aggattcaggccttagctgctacct

SEQ ID NO: 143115 - DNA, 25 bp, Rattus norvegicus
aggattcagtttaccaaaggcaaag

SEQ ID NO: 143116 - DNA, 25 bp, Rattus norvegicus
aggattcagttttccaaaggcaaag

SEQ ID NO: 143117 - DNA, 25 bp, Rattus norvegicus
aggattcatcaacaccacacatttt

SEQ ID NO: 143118 - DNA, 25 bp, Rattus norvegicus
aggattcatcaagaccacacatttt

SEQ ID NO: 143119 - DNA, 25 bp, Rattus norvegicus
aggattccacctagttataccattc

SEQ ID NO: 143120 - DNA, 25 bp, Rattus norvegicus
aggattccaccttgttataccattc

SEQ ID NO: 143121 - DNA, 25 bp, Rattus norvegicus
aggattccaggcaatatgaccaaac

SEQ ID NO: 143122 - DNA, 25 bp, Rattus norvegicus
aggattccaggctatatgaccaaac

SEQ ID NO: 143123 - DNA, 25 bp, Rattus norvegicus
aggattccaggtctcttatctcatc

SEQ ID NO: 143124 - DNA, 25 bp, Rattus norvegicus
aggattccaggtgtcttatctcatc

SEQ ID NO: 143125 - DNA, 25 bp, Rattus norvegicus
aggattccatcaccctttgaataag

SEQ ID NO: 143126 - DNA, 25 bp, Rattus norvegicus
aggattccatcagcctttgaataag

SEQ ID NO: 143127 - DNA, 25 bp, Rattus norvegicus
aggattccatgactgctgtgtgctg

SEQ ID NO: 143128 - DNA, 25 bp, Rattus norvegicus
aggattccatgagtgctgtgtgctg

SEQ ID NO: 143129 - DNA, 25 bp, Rattus norvegicus
aggattccatttcttgctgcacggg

SEQ ID NO: 143130 - DNA, 25 bp, Rattus norvegicus
aggattccatttgttgctgcacggg

SEQ ID NO: 143131 - DNA, 25 bp, Rattus norvegicus
aggattcccaatctcaccgttgtag

SEQ ID NO: 143132 - DNA, 25 bp, Rattus norvegicus
aggattcccaatgtcaccgttgtag

SEQ ID NO: 143133 - DNA, 25 bp, Rattus norvegicus
aggattcccagtcgcagcctctctt

SEQ ID NO: 143134 - DNA, 25 bp, Rattus norvegicus
aggattcccagtggcagcctctctt

SEQ ID NO: 143135 - DNA, 25 bp, Rattus norvegicus
aggattccctgactgaacgagttga

SEQ ID NO: 143136 - DNA, 25 bp, Rattus norvegicus
aggattccctgagtgaacgagttga

SEQ ID NO: 143137 - DNA, 25 bp, Rattus norvegicus
aggattcctagcatagcgcttggct

SEQ ID NO: 143138 - DNA, 25 bp, Rattus norvegicus
aggattcctagcttagcgcttggct

SEQ ID NO: 143139 - DNA, 25 bp, Rattus norvegicus
aggattcctctcattacagtacatg

SEQ ID NO: 143140 - DNA, 25 bp, Rattus norvegicus
aggattcctctctttacagtacatg

SEQ ID NO: 143141 - DNA, 25 bp, Rattus norvegicus
aggattcctgttcctttacccacaa

SEQ ID NO: 143142 - DNA, 25 bp, Rattus norvegicus
aggattcctgttcggacagctttat

SEQ ID NO: 143143 - DNA, 25 bp, Rattus norvegicus
aggattcctgttgctttacccacaa

SEQ ID NO: 143144 - DNA, 25 bp, Rattus norvegicus
aggattcctgttgggacagctttat

SEQ ID NO: 143145 - DNA, 25 bp, Rattus norvegicus
aggattcgcatcaacaagctcaacc

SEQ ID NO: 143146 - DNA, 25 bp, Rattus norvegicus
aggattcgcatctacaagctcaacc

SEQ ID NO: 143147 - DNA, 25 bp, Rattus norvegicus
aggattcggattaggtactttatgc

SEQ ID NO: 143148 - DNA, 25 bp, Rattus norvegicus
aggattcggatttggtactttatgc

SEQ ID NO: 143149 - DNA, 25 bp, Rattus norvegicus
aggattcgtctgattttccctttca

SEQ ID NO: 143150 - DNA, 25 bp, Rattus norvegicus
aggattcgtctgtttttccctttca

SEQ ID NO: 143151 - DNA, 25 bp, Rattus norvegicus
aggattcgtggaattaactggcaac

SEQ ID NO: 143152 - DNA, 25 bp, Rattus norvegicus
aggattcgtggatttaactggcaac

SEQ ID NO: 143153 - DNA, 25 bp, Rattus norvegicus
aggattctaaccagcctcctcgaaa

SEQ ID NO: 143154 - DNA, 25 bp, Rattus norvegicus
aggattctaacctgcctcctcgaaa

SEQ ID NO: 143155 - DNA, 25 bp, Rattus norvegicus
aggattctcagaacccatgccaaga

SEQ ID NO: 143156 - DNA, 25 bp, Rattus norvegicus
aggattctcagatcccatgccaaga

SEQ ID NO: 143157 - DNA, 25 bp, Rattus norvegicus
aggattctgaataatcgtacgtcaa

SEQ ID NO: 143158 - DNA, 25 bp, Rattus norvegicus
aggattctgaattatcgtacgtcaa

SEQ ID NO: 143159 - DNA, 25 bp, Rattus norvegicus
aggattctgcacacgtgtggcggct

SEQ ID NO: 143160 - DNA, 25 bp, Rattus norvegicus
aggattctgcactcgtgtggcggct

SEQ ID NO: 143161 - DNA, 25 bp, Rattus norvegicus
aggattctgcctcctggtgatgctg

SEQ ID NO: 143162 - DNA, 25 bp, Rattus norvegicus
aggattctgcctgctggtgatgctg

SEQ ID NO: 143163 - DNA, 25 bp, Rattus norvegicus
aggattctggagagccctaaccgtt

SEQ ID NO: 143164 - DNA, 25 bp, Rattus norvegicus
aggattctggagtgccctaaccgtt

SEQ ID NO: 143165 - DNA, 25 bp, Rattus norvegicus
aggattctggtacctgatacctgat

SEQ ID NO: 143166 - DNA, 25 bp, Rattus norvegicus
aggattctggtagctgatacctgat

SEQ ID NO: 143167 - DNA, 25 bp, Rattus norvegicus
aggattcttatcaagcgttcacaaa

SEQ ID NO: 143168 - DNA, 25 bp, Rattus norvegicus
aggattcttatctagcgttcacaaa

SEQ ID NO: 143169 - DNA, 25 bp, Rattus norvegicus
aggattcttctcaacatcagtcagc

SEQ ID NO: 143170 - DNA, 25 bp, Rattus norvegicus
aggattcttctctacatcagtcagc

SEQ ID NO: 143171 - DNA, 25 bp, Rattus norvegicus
aggattgacactacaggactacagt

SEQ ID NO: 143172 - DNA, 25 bp, Rattus norvegicus
aggattgacacttcaggactacagt

SEQ ID NO: 143173 - DNA, 25 bp, Rattus norvegicus
aggattgacattaagttcccagcaa

SEQ ID NO: 143174 - DNA, 25 bp, Rattus norvegicus
aggattgacatttagttcccagcaa

SEQ ID NO: 143175 - DNA, 25 bp, Rattus norvegicus
aggattgaccagctccagcatttag

SEQ ID NO: 143176 - DNA, 25 bp, Rattus norvegicus
aggattgaccaggtccagcatttag

SEQ ID NO: 143177 - DNA, 25 bp, Rattus norvegicus
aggattgactggctgtctgtgcatt

SEQ ID NO: 143178 - DNA, 25 bp, Rattus norvegicus
aggattgactgggtgtctgtgcatt

SEQ ID NO: 143179 - DNA, 25 bp, Rattus norvegicus
aggattgagaaacccctgaggacac

SEQ ID NO: 143180 - DNA, 25 bp, Rattus norvegicus
aggattgagaaagccctgaggacac

SEQ ID NO: 143181 - DNA, 25 bp, Rattus norvegicus
aggattgagcgtaggagacccataa

SEQ ID NO: 143182 - DNA, 25 bp, Rattus norvegicus
aggattgagcgttggagacccataa

SEQ ID NO: 143183 - DNA, 25 bp, Rattus norvegicus
aggattgaggaacaagccagtcatc

SEQ ID NO: 143184 - DNA, 25 bp, Rattus norvegicus
aggattgaggaagaagccagtcatc

SEQ ID NO: 143185 - DNA, 25 bp, Rattus norvegicus
aggattgagtccagggtctccgaga

SEQ ID NO: 143186 - DNA, 25 bp, Rattus norvegicus
aggattgagtcctgggtctccgaga

SEQ ID NO: 143187 - DNA, 25 bp, Rattus norvegicus
aggattgcaaacagtatttcgctag

SEQ ID NO: 143188 - DNA, 25 bp, Rattus norvegicus
aggattgcaaactgtatttcgctag

SEQ ID NO: 143189 - DNA, 25 bp, Rattus norvegicus
aggattgcaccaatcagttccatgt

SEQ ID NO: 143190 - DNA, 25 bp, Rattus norvegicus
aggattgcaccattcagttccatgt

SEQ ID NO: 143191 - DNA, 25 bp, Rattus norvegicus
aggattgcagccaagacatttctcc

SEQ ID NO: 143192 - DNA, 25 bp, Rattus norvegicus
aggattgcagcctagacatttctcc

SEQ ID NO: 143193 - DNA, 25 bp, Rattus norvegicus
aggattgccactcatgttctctcaa

SEQ ID NO: 143194 - DNA, 25 bp, Rattus norvegicus
aggattgccactgatgttctctcaa

SEQ ID NO: 143195 - DNA, 25 bp, Rattus norvegicus
aggattgcccaaagcatgctgtgca

SEQ ID NO: 143196 - DNA, 25 bp, Rattus norvegicus
aggattgcccaatgcatgctgtgca

SEQ ID NO: 143197 - DNA, 25 bp, Rattus norvegicus
aggattgcggtaattttctatttat

SEQ ID NO: 143198 - DNA, 25 bp, Rattus norvegicus
aggattgcggtatttttctatttat

SEQ ID NO: 143199 - DNA, 25 bp, Rattus norvegicus
aggattgctgatactggtgtgaccc

SEQ ID NO: 143200 - DNA, 25 bp, Rattus norvegicus
aggattgctgatagttccccagagc

SEQ ID NO: 143201 - DNA, 25 bp, Rattus norvegicus
aggattgctgattctggtgtgaccc

SEQ ID NO: 143202 - DNA, 25 bp, Rattus norvegicus
aggattgctgattgttccccagagc

SEQ ID NO: 143203 - DNA, 25 bp, Rattus norvegicus
aggattgctgcaaggttccgaacaa

SEQ ID NO: 143204 - DNA, 25 bp, Rattus norvegicus
aggattgctgcatggttccgaacaa

SEQ ID NO: 143205 - DNA, 25 bp, Rattus norvegicus
aggattgctgctcgattcttacttg

SEQ ID NO: 143206 - DNA, 25 bp, Rattus norvegicus
aggattgctgctggattcttacttg

SEQ ID NO: 143207 - DNA, 25 bp, Rattus norvegicus
aggattggacccacagtcttgcaca

SEQ ID NO: 143208 - DNA, 25 bp, Rattus norvegicus
aggattggaccctcagtcttgcaca

SEQ ID NO: 143209 - DNA, 25 bp, Rattus norvegicus
aggattgggactaactgcactcatg

SEQ ID NO: 143210 - DNA, 25 bp, Rattus norvegicus
aggattgggacttactgcactcatg

SEQ ID NO: 143211 - DNA, 25 bp, Rattus norvegicus
aggattggtgccagatgtatgctaa

SEQ ID NO: 143212 - DNA, 25 bp, Rattus norvegicus
aggattggtgcctgatgtatgctaa

SEQ ID NO: 143213 - DNA, 25 bp, Rattus norvegicus
aggattggtgttcaccacacccgta

SEQ ID NO: 143214 - DNA, 25 bp, Rattus norvegicus
aggattggtgttgaccacacccgta

SEQ ID NO: 143215 - DNA, 25 bp, Rattus norvegicus
aggattgtactcaggcttgtcacta

SEQ ID NO: 143216 - DNA, 25 bp, Rattus norvegicus
aggattgtactctggcttgtcacta

SEQ ID NO: 143217 - DNA, 25 bp, Rattus norvegicus
aggattgtccctaactgttctgaac

SEQ ID NO: 143218 - DNA, 25 bp, Rattus norvegicus
aggattgtcccttactgttctgaac

SEQ ID NO: 143219 - DNA, 25 bp, Rattus norvegicus
aggattgtgacccttggacttctgg

SEQ ID NO: 143220 - DNA, 25 bp, Rattus norvegicus
aggattgtgaccgttggacttctgg

SEQ ID NO: 143221 - DNA, 25 bp, Rattus norvegicus
aggattgtgtgccatagggccttct

SEQ ID NO: 143222 - DNA, 25 bp, Rattus norvegicus
aggattgtgtgcgatagggccttct

SEQ ID NO: 143223 - DNA, 25 bp, Rattus norvegicus
aggattgtgtttccctataagccaa

SEQ ID NO: 143224 - DNA, 25 bp, Rattus norvegicus
aggattgtgtttgcctataagccaa

SEQ ID NO: 143225 - DNA, 25 bp, Rattus norvegicus
aggattgtttccaactacagtaatg

SEQ ID NO: 143226 - DNA, 25 bp, Rattus norvegicus
aggattgtttcccagagtcagaact

SEQ ID NO: 143227 - DNA, 25 bp, Rattus norvegicus
aggattgtttccgagagtcagaact

SEQ ID NO: 143228 - DNA, 25 bp, Rattus norvegicus
aggattgtttcctactacagtaatg

SEQ ID NO: 143229 - DNA, 25 bp, Rattus norvegicus
aggatttaacaaacagcgactttca

SEQ ID NO: 143230 - DNA, 25 bp, Rattus norvegicus
aggatttaacaatcagcgactttca

SEQ ID NO: 143231 - DNA, 25 bp, Rattus norvegicus
aggatttccaggatggccaagccaa

SEQ ID NO: 143232 - DNA, 25 bp, Rattus norvegicus
aggatttccaggttggccaagccaa

SEQ ID NO: 143233 - DNA, 25 bp, Rattus norvegicus
aggatttccatgaagctgtggtgct

SEQ ID NO: 143234 - DNA, 25 bp, Rattus norvegicus
aggatttccatgtagctgtggtgct

SEQ ID NO: 143235 - DNA, 25 bp, Rattus norvegicus
aggatttcccaacagctgctgtaaa

SEQ ID NO: 143236 - DNA, 25 bp, Rattus norvegicus
aggatttcccaagagctgctgtaaa

SEQ ID NO: 143237 - DNA, 25 bp, Rattus norvegicus
aggatttccccgaaagcacttctat

SEQ ID NO: 143238 - DNA, 25 bp, Rattus norvegicus
aggatttccccgtaagcacttctat

SEQ ID NO: 143239 - DNA, 25 bp, Rattus norvegicus
aggatttcccctccagacttctggg

SEQ ID NO: 143240 - DNA, 25 bp, Rattus norvegicus
aggatttcccctgcagacttctggg

SEQ ID NO: 143241 - DNA, 25 bp, Rattus norvegicus
aggatttccctacaagcgctacact

SEQ ID NO: 143242 - DNA, 25 bp, Rattus norvegicus
aggatttccctagaagcgctacact

SEQ ID NO: 143243 - DNA, 25 bp, Rattus norvegicus
aggatttcctatactcgccattgag

SEQ ID NO: 143244 - DNA, 25 bp, Rattus norvegicus
aggatttcctattctcgccattgag

SEQ ID NO: 143245 - DNA, 25 bp, Rattus norvegicus
aggatttcctctacgagttccgaga

SEQ ID NO: 143246 - DNA, 25 bp, Rattus norvegicus
aggatttcctcttcgagttccgaga

SEQ ID NO: 143247 - DNA, 25 bp, Rattus norvegicus
aggatttcctggagcagggacccaa

SEQ ID NO: 143248 - DNA, 25 bp, Rattus norvegicus
aggatttcctggtgcagggacccaa

SEQ ID NO: 143249 - DNA, 25 bp, Rattus norvegicus
aggatttcctgtatctgctgatgat

SEQ ID NO: 143250 - DNA, 25 bp, Rattus norvegicus
aggatttcctgtttctgctgatgat

SEQ ID NO: 143251 - DNA, 25 bp, Rattus norvegicus
aggatttcgagaaaactatgacacg

SEQ ID NO: 143252 - DNA, 25 bp, Rattus norvegicus
aggatttcgagataactatgacacg

SEQ ID NO: 143253 - DNA, 25 bp, Rattus norvegicus
aggatttctactatggccccgaggc

SEQ ID NO: 143254 - DNA, 25 bp, Rattus norvegicus
aggatttctactttggccccgaggc

SEQ ID NO: 143255 - DNA, 25 bp, Rattus norvegicus
aggatttctccacagattgcttgca

SEQ ID NO: 143256 - DNA, 25 bp, Rattus norvegicus
aggatttctccagagattgcttgca

SEQ ID NO: 143257 - DNA, 25 bp, Rattus norvegicus
aggatttctcgcctttggagccact

SEQ ID NO: 143258 - DNA, 25 bp, Rattus norvegicus
aggatttctcgcgtttggagccact

SEQ ID NO: 143259 - DNA, 25 bp, Rattus norvegicus
aggatttctgacaccttgcagccat

SEQ ID NO: 143260 - DNA, 25 bp, Rattus norvegicus
aggatttctgactccttgcagccat

SEQ ID NO: 143261 - DNA, 25 bp, Rattus norvegicus
aggatttgaactacattctcctccc

SEQ ID NO: 143262 - DNA, 25 bp, Rattus norvegicus
aggatttgaacttcattctcctccc

SEQ ID NO: 143263 - DNA, 25 bp, Rattus norvegicus
aggatttgataacagtccctcccct

SEQ ID NO: 143264 - DNA, 25 bp, Rattus norvegicus
aggatttgataagagtccctcccct

SEQ ID NO: 143265 - DNA, 25 bp, Rattus norvegicus
aggatttgccccaggcagctgagca

SEQ ID NO: 143266 - DNA, 25 bp, Rattus norvegicus
aggatttgcccctggcagctgagca

SEQ ID NO: 143267 - DNA, 25 bp, Rattus norvegicus
aggatttgcctacttctgtactttt

SEQ ID NO: 143268 - DNA, 25 bp, Rattus norvegicus
aggatttgcctagttctgtactttt

SEQ ID NO: 143269 - DNA, 25 bp, Rattus norvegicus
aggatttggaacaagctctggtttc

SEQ ID NO: 143270 - DNA, 25 bp, Rattus norvegicus
aggatttggaactagctctggtttc

SEQ ID NO: 143271 - DNA, 25 bp, Rattus norvegicus
aggatttggaggactcgtgtcctct

SEQ ID NO: 143272 - DNA, 25 bp, Rattus norvegicus
aggatttggaggtctcgtgtcctct

SEQ ID NO: 143273 - DNA, 25 bp, Rattus norvegicus
aggatttggataccccttcagtcaa

SEQ ID NO: 143274 - DNA, 25 bp, Rattus norvegicus
aggatttggatagcccttcagtcaa

SEQ ID NO: 143275 - DNA, 25 bp, Rattus norvegicus
aggatttggcttctggcatctgaac

SEQ ID NO: 143276 - DNA, 25 bp, Rattus norvegicus
aggatttggcttgtggcatctgaac

SEQ ID NO: 143277 - DNA, 25 bp, Rattus norvegicus
aggatttgggtacctcaacctgcct

SEQ ID NO: 143278 - DNA, 25 bp, Rattus norvegicus
aggatttgggtagctcaacctgcct

SEQ ID NO: 143279 - DNA, 25 bp, Rattus norvegicus
aggatttgtactcgagccagctatg

SEQ ID NO: 143280 - DNA, 25 bp, Rattus norvegicus
aggatttgtactggagccagctatg

SEQ ID NO: 143281 - DNA, 25 bp, Rattus norvegicus
aggatttgtccgagatgctggccag

SEQ ID NO: 143282 - DNA, 25 bp, Rattus norvegicus
aggatttgtccgtgatgctggccag

SEQ ID NO: 143283 - DNA, 25 bp, Rattus norvegicus
aggatttgtgttctagtcctaccct

SEQ ID NO: 143284 - DNA, 25 bp, Rattus norvegicus
aggatttgtgttgtagtcctaccct

SEQ ID NO: 143285 - DNA, 25 bp, Rattus norvegicus
aggatttgttgcatttactgtggga

SEQ ID NO: 143286 - DNA, 25 bp, Rattus norvegicus
aggatttgttgcttttactgtggga

SEQ ID NO: 143287 - DNA, 25 bp, Rattus norvegicus
aggattttaaaacatgctttcattt

SEQ ID NO: 143288 - DNA, 25 bp, Rattus norvegicus
aggattttaaaagatgctttcattt

SEQ ID NO: 143289 - DNA, 25 bp, Rattus norvegicus
aggattttatggcactggcaccctt

SEQ ID NO: 143290 - DNA, 25 bp, Rattus norvegicus
aggattttatgggactggcaccctt

SEQ ID NO: 143291 - DNA, 25 bp, Rattus norvegicus
aggattttcctacaaagcactttat

SEQ ID NO: 143292 - DNA, 25 bp, Rattus norvegicus
aggattttcctagaaagcactttat

SEQ ID NO: 143293 - DNA, 25 bp, Rattus norvegicus
aggattttcctcctatggtataaag

SEQ ID NO: 143294 - DNA, 25 bp, Rattus norvegicus
aggattttcctcgtatggtataaag

SEQ ID NO: 143295 - DNA, 25 bp, Rattus norvegicus
aggatttttctaacaggctgtaacc

SEQ ID NO: 143296 - DNA, 25 bp, Rattus norvegicus
aggatttttctaaggctacacgtat

SEQ ID NO: 143297 - DNA, 25 bp, Rattus norvegicus
aggatttttctatcaggctgtaacc

SEQ ID NO: 143298 - DNA, 25 bp, Rattus norvegicus
aggatttttctatggctacacgtat

SEQ ID NO: 143299 - DNA, 25 bp, Rattus norvegicus
aggatttttgacacaggcccttcag

SEQ ID NO: 143300 - DNA, 25 bp, Rattus norvegicus
aggatttttgactcaggcccttcag

SEQ ID NO: 143301 - DNA, 25 bp, Rattus norvegicus
aggcaaaaaccgagaccttgtctag

SEQ ID NO: 143302 - DNA, 25 bp, Rattus norvegicus
aggcaaaaaccgtgaccttgtctag

SEQ ID NO: 143303 - DNA, 25 bp, Rattus norvegicus
aggcaaacaagtcctgtctgcttct

SEQ ID NO: 143304 - DNA, 25 bp, Rattus norvegicus
aggcaaacaagtgctgtctgcttct

SEQ ID NO: 143305 - DNA, 25 bp, Rattus norvegicus
aggcaaacctcaccaaatctcagaa

SEQ ID NO: 143306 - DNA, 25 bp, Rattus norvegicus
aggcaaacctcagcaaatctcagaa

SEQ ID NO: 143307 - DNA, 25 bp, Rattus norvegicus
aggcaaacgaaaacgctgtgtcgat

SEQ ID NO: 143308 - DNA, 25 bp, Rattus norvegicus
aggcaaacgaaatcgctgtgtcgat

SEQ ID NO: 143309 - DNA, 25 bp, Rattus norvegicus
aggcaaacggagaagcccttcgctg

SEQ ID NO: 143310 - DNA, 25 bp, Rattus norvegicus
aggcaaacggagtagcccttcgctg

SEQ ID NO: 143311 - DNA, 25 bp, Rattus norvegicus
aggcaaactcatccaagcccagtaa

SEQ ID NO: 143312 - DNA, 25 bp, Rattus norvegicus
aggcaaactcatgcaagcccagtaa

SEQ ID NO: 143313 - DNA, 25 bp, Rattus norvegicus
aggcaaactccacaaactcaccaag

SEQ ID NO: 143314 - DNA, 25 bp, Rattus norvegicus
aggcaaactccagaaactcaccaag

SEQ ID NO: 143315 - DNA, 25 bp, Rattus norvegicus
aggcaaactctgaggaccggcattt

SEQ ID NO: 143316 - DNA, 25 bp, Rattus norvegicus
aggcaaactctgtggaccggcattt

SEQ ID NO: 143317 - DNA, 25 bp, Rattus norvegicus
aggcaaacttctcgccgcagggact

SEQ ID NO: 143318 - DNA, 25 bp, Rattus norvegicus
aggcaaacttctggccgcagggact

SEQ ID NO: 143319 - DNA, 25 bp, Rattus norvegicus
aggcaaagacgcatgcaatggtgac

SEQ ID NO: 143320 - DNA, 25 bp, Rattus norvegicus
aggcaaagacgcttgcaatggtgac

SEQ ID NO: 143321 - DNA, 25 bp, Rattus norvegicus
aggcaaagatggcttcgctgtcccg

SEQ ID NO: 143322 - DNA, 25 bp, Rattus norvegicus
aggcaaagatgggttcgctgtcccg

SEQ ID NO: 143323 - DNA, 25 bp, Rattus norvegicus
aggcaaagcctgcaaacaacccaag

SEQ ID NO: 143324 - DNA, 25 bp, Rattus norvegicus
aggcaaagcctggaaacaacccaag

SEQ ID NO: 143325 - DNA, 25 bp, Rattus norvegicus
aggcaaagccttctccatcgttttt

SEQ ID NO: 143326 - DNA, 25 bp, Rattus norvegicus
aggcaaagccttgtccatcgttttt

SEQ ID NO: 143327 - DNA, 25 bp, Rattus norvegicus
aggcaaagctgaagggctctacccc

SEQ ID NO: 143328 - DNA, 25 bp, Rattus norvegicus
aggcaaagctgatgggctctacccc

SEQ ID NO: 143329 - DNA, 25 bp, Rattus norvegicus
aggcaaaggaaaccctctgctgctt

SEQ ID NO: 143330 - DNA, 25 bp, Rattus norvegicus
aggcaaaggaaagcctctgctgctt

SEQ ID NO: 143331 - DNA, 25 bp, Rattus norvegicus
aggcaaagggtaatgcccaccccag

SEQ ID NO: 143332 - DNA, 25 bp, Rattus norvegicus
aggcaaagggtattgcccaccccag

SEQ ID NO: 143333 - DNA, 25 bp, Rattus norvegicus
aggcaaaggtcactccaaggcatcc

SEQ ID NO: 143334 - DNA, 25 bp, Rattus norvegicus
aggcaaaggtcagtccaaggcatcc

SEQ ID NO: 143335 - DNA, 25 bp, Rattus norvegicus
aggcaaaggtctaggcactttcctc

SEQ ID NO: 143336 - DNA, 25 bp, Rattus norvegicus
aggcaaaggtcttggcactttcctc

SEQ ID NO: 143337 - DNA, 25 bp, Rattus norvegicus
aggcaaagttccaagcacgctctta

SEQ ID NO: 143338 - DNA, 25 bp, Rattus norvegicus
aggcaaagttcctagcacgctctta

SEQ ID NO: 143339 - DNA, 25 bp, Rattus norvegicus
aggcaaataagcctctccgtctttg

SEQ ID NO: 143340 - DNA, 25 bp, Rattus norvegicus
aggcaaataagcgtctccgtctttg

SEQ ID NO: 143341 - DNA, 25 bp, Rattus norvegicus
aggcaaatacctccattgtcttcca

SEQ ID NO: 143342 - DNA, 25 bp, Rattus norvegicus
aggcaaatacctgcattgtcttcca

SEQ ID NO: 143343 - DNA, 25 bp, Rattus norvegicus
aggcaaatccctaaggatccccagt

SEQ ID NO: 143344 - DNA, 25 bp, Rattus norvegicus
aggcaaatcccttaggatccccagt

SEQ ID NO: 143345 - DNA, 25 bp, Rattus norvegicus
aggcaaatgacacctcctcttggga

SEQ ID NO: 143346 - DNA, 25 bp, Rattus norvegicus
aggcaaatgacagctcctcttggga

SEQ ID NO: 143347 - DNA, 25 bp, Rattus norvegicus
aggcaaatgctgagcagccttcctt

SEQ ID NO: 143348 - DNA, 25 bp, Rattus norvegicus
aggcaaatgctgtgcagccttcctt

SEQ ID NO: 143349 - DNA, 25 bp, Rattus norvegicus
aggcaaatgggcactccctagacta

SEQ ID NO: 143350 - DNA, 25 bp, Rattus norvegicus
aggcaaatgggctctccctagacta

SEQ ID NO: 143351 - DNA, 25 bp, Rattus norvegicus
aggcaaattattccttctctcctag

SEQ ID NO: 143352 - DNA, 25 bp, Rattus norvegicus
aggcaaattattgcttctctcctag

SEQ ID NO: 143353 - DNA, 25 bp, Rattus norvegicus
aggcaaattctacttctcagcttac

SEQ ID NO: 143354 - DNA, 25 bp, Rattus norvegicus
aggcaaattctagttctcagcttac

SEQ ID NO: 143355 - DNA, 25 bp, Rattus norvegicus
aggcaaatttcacgcatttcttcaa

SEQ ID NO: 143356 - DNA, 25 bp, Rattus norvegicus
aggcaaatttcaggcatttcttcaa

SEQ ID NO: 143357 - DNA, 25 bp, Rattus norvegicus
aggcaaatttcccaactctgaggtg

SEQ ID NO: 143358 - DNA, 25 bp, Rattus norvegicus
aggcaaatttccgaactctgaggtg

SEQ ID NO: 143359 - DNA, 25 bp, Rattus norvegicus
aggcaacaaactagaccagtgtcct

SEQ ID NO: 143360 - DNA, 25 bp, Rattus norvegicus
aggcaacaaacttgaccagtgtcct

SEQ ID NO: 143361 - DNA, 25 bp, Rattus norvegicus
aggcaacaagagagacctcaccacc

SEQ ID NO: 143362 - DNA, 25 bp, Rattus norvegicus
aggcaacaagagtgacctcaccacc

SEQ ID NO: 143363 - DNA, 25 bp, Rattus norvegicus
aggcaacactgtacttttctcggtc

SEQ ID NO: 143364 - DNA, 25 bp, Rattus norvegicus
aggcaacactgttcttttctcggtc

SEQ ID NO: 143365 - DNA, 25 bp, Rattus norvegicus
aggcaacagcacagggatcttccat

SEQ ID NO: 143366 - DNA, 25 bp, Rattus norvegicus
aggcaacagcactgggatcttccat

SEQ ID NO: 143367 - DNA, 25 bp, Rattus norvegicus
aggcaacattatagtccattttcat

SEQ ID NO: 143368 - DNA, 25 bp, Rattus norvegicus
aggcaacattattgtccattttcat

SEQ ID NO: 143369 - DNA, 25 bp, Rattus norvegicus
aggcaaccaaagctgacccaagagt

SEQ ID NO: 143370 - DNA, 25 bp, Rattus norvegicus
aggcaaccaaaggtgacccaagagt

SEQ ID NO: 143371 - DNA, 25 bp, Rattus norvegicus
aggcaaccaatcatcacagacctgt

SEQ ID NO: 143372 - DNA, 25 bp, Rattus norvegicus
aggcaaccaatcttcacagacctgt

SEQ ID NO: 143373 - DNA, 25 bp, Rattus norvegicus
aggcaaccactgagctctttcaaat

SEQ ID NO: 143374 - DNA, 25 bp, Rattus norvegicus
aggcaaccactgaggcacatgtatg

SEQ ID NO: 143375 - DNA, 25 bp, Rattus norvegicus
aggcaaccactgtgctctttcaaat

SEQ ID NO: 143376 - DNA, 25 bp, Rattus norvegicus
aggcaaccactgtggcacatgtatg

SEQ ID NO: 143377 - DNA, 25 bp, Rattus norvegicus
aggcaaccaggtagtccacttcctc

SEQ ID NO: 143378 - DNA, 25 bp, Rattus norvegicus
aggcaaccaggttgtccacttcctc

SEQ ID NO: 143379 - DNA, 25 bp, Rattus norvegicus
aggcaaccatttatacaccgtgcag

SEQ ID NO: 143380 - DNA, 25 bp, Rattus norvegicus
aggcaaccatttttacaccgtgcag

SEQ ID NO: 143381 - DNA, 25 bp, Rattus norvegicus
aggcaacccaggagcataaggtgtt

SEQ ID NO: 143382 - DNA, 25 bp, Rattus norvegicus
aggcaacccaggtgcataaggtgtt

SEQ ID NO: 143383 - DNA, 25 bp, Rattus norvegicus
aggcaaccctgcagagatcaatgtg

SEQ ID NO: 143384 - DNA, 25 bp, Rattus norvegicus
aggcaaccctgctgagatcaatgtg

SEQ ID NO: 143385 - DNA, 25 bp, Rattus norvegicus
aggcaaccggatatcactgtcagat

SEQ ID NO: 143386 - DNA, 25 bp, Rattus norvegicus
aggcaaccggatttcactgtcagat

SEQ ID NO: 143387 - DNA, 25 bp, Rattus norvegicus
aggcaacctggaaggcctacgatat

SEQ ID NO: 143388 - DNA, 25 bp, Rattus norvegicus
aggcaacctggatggcctacgatat

SEQ ID NO: 143389 - DNA, 25 bp, Rattus norvegicus
aggcaacctggtctaacggtcttct

SEQ ID NO: 143390 - DNA, 25 bp, Rattus norvegicus
aggcaacctggtgtaacggtcttct

SEQ ID NO: 143391 - DNA, 25 bp, Rattus norvegicus
aggcaacctgtaacactgaggccat

SEQ ID NO: 143392 - DNA, 25 bp, Rattus norvegicus
aggcaacctgtatcactgaggccat

SEQ ID NO: 143393 - DNA, 25 bp, Rattus norvegicus
aggcaacgctatctgattatttccc

SEQ ID NO: 143394 - DNA, 25 bp, Rattus norvegicus
aggcaacgctatgtgattatttccc

SEQ ID NO: 143395 - DNA, 25 bp, Rattus norvegicus
aggcaacgggatagtgttccttcct

SEQ ID NO: 143396 - DNA, 25 bp, Rattus norvegicus
aggcaacgggattgtgttccttcct

SEQ ID NO: 143397 - DNA, 25 bp, Rattus norvegicus
aggcaacgtagcacatgcctgtgac

SEQ ID NO: 143398 - DNA, 25 bp, Rattus norvegicus
aggcaacgtagctcatgcctgtgac

SEQ ID NO: 143399 - DNA, 25 bp, Rattus norvegicus
aggcaacgttctccgtagaaaagag

SEQ ID NO: 143400 - DNA, 25 bp, Rattus norvegicus
aggcaacgttctctatggtttttca

SEQ ID NO: 143401 - DNA, 25 bp, Rattus norvegicus
aggcaacgttctgcgtagaaaagag

SEQ ID NO: 143402 - DNA, 25 bp, Rattus norvegicus
aggcaacgttctgtatggtttttca

SEQ ID NO: 143403 - DNA, 25 bp, Rattus norvegicus
aggcaactatctactcaacatcgga

SEQ ID NO: 143404 - DNA, 25 bp, Rattus norvegicus
aggcaactatcttctcaacatcgga

SEQ ID NO: 143405 - DNA, 25 bp, Rattus norvegicus
aggcaactatgcactttcatgagga

SEQ ID NO: 143406 - DNA, 25 bp, Rattus norvegicus
aggcaactatgctctttcatgagga

SEQ ID NO: 143407 - DNA, 25 bp, Rattus norvegicus
aggcaactccaaacggccatcgagg

SEQ ID NO: 143408 - DNA, 25 bp, Rattus norvegicus
aggcaactccaatcggccatcgagg

SEQ ID NO: 143409 - DNA, 25 bp, Rattus norvegicus
aggcaacttactatggctataccac

SEQ ID NO: 143410 - DNA, 25 bp, Rattus norvegicus
aggcaacttactttggctataccac

SEQ ID NO: 143411 - DNA, 25 bp, Rattus norvegicus
aggcaacttggcagttctggctaca

SEQ ID NO: 143412 - DNA, 25 bp, Rattus norvegicus
aggcaacttggctgttctggctaca

SEQ ID NO: 143413 - DNA, 25 bp, Rattus norvegicus
aggcaagaaaaactcctctacctct

SEQ ID NO: 143414 - DNA, 25 bp, Rattus norvegicus
aggcaagaaaaagtcctctacctct

SEQ ID NO: 143415 - DNA, 25 bp, Rattus norvegicus
aggcaagaagcacccaagcacttca

SEQ ID NO: 143416 - DNA, 25 bp, Rattus norvegicus
aggcaagaagcagccaagcacttca

SEQ ID NO: 143417 - DNA, 25 bp, Rattus norvegicus
aggcaagacatcactcctcaaggct

SEQ ID NO: 143418 - DNA, 25 bp, Rattus norvegicus
aggcaagacatctctcctcaaggct

SEQ ID NO: 143419 - DNA, 25 bp, Rattus norvegicus
aggcaagaccatcagcaccgagagc

SEQ ID NO: 143420 - DNA, 25 bp, Rattus norvegicus
aggcaagaccatgagcaccgagagc

SEQ ID NO: 143421 - DNA, 25 bp, Rattus norvegicus
aggcaagactctctggtcaacaccc

SEQ ID NO: 143422 - DNA, 25 bp, Rattus norvegicus
aggcaagactctgtggtcaacaccc

SEQ ID NO: 143423 - DNA, 25 bp, Rattus norvegicus
aggcaagagcagctttgctccctac

SEQ ID NO: 143424 - DNA, 25 bp, Rattus norvegicus
aggcaagagcaggtttgctccctac

SEQ ID NO: 143425 - DNA, 25 bp, Rattus norvegicus
aggcaagagggccacatccgacatg

SEQ ID NO: 143426 - DNA, 25 bp, Rattus norvegicus
aggcaagagggcgacatccgacatg

SEQ ID NO: 143427 - DNA, 25 bp, Rattus norvegicus
aggcaagaggttctcatgcccacct

SEQ ID NO: 143428 - DNA, 25 bp, Rattus norvegicus
aggcaagaggttgtcatgcccacct

SEQ ID NO: 143429 - DNA, 25 bp, Rattus norvegicus
aggcaagatccaacagaagctaaat

SEQ ID NO: 143430 - DNA, 25 bp, Rattus norvegicus
aggcaagatccatcagaagctaaat

SEQ ID NO: 143431 - DNA, 25 bp, Rattus norvegicus
aggcaagcaagaagctcttctccag

SEQ ID NO: 143432 - DNA, 25 bp, Rattus norvegicus
aggcaagcaagatgctcttctccag

SEQ ID NO: 143433 - DNA, 25 bp, Rattus norvegicus
aggcaagcagagcatccagtcagat

SEQ ID NO: 143434 - DNA, 25 bp, Rattus norvegicus
aggcaagcagaggatccagtcagat

SEQ ID NO: 143435 - DNA, 25 bp, Rattus norvegicus
aggcaagcagccacgagtattattg

SEQ ID NO: 143436 - DNA, 25 bp, Rattus norvegicus
aggcaagcagcctcgagtattattg

SEQ ID NO: 143437 - DNA, 25 bp, Rattus norvegicus
aggcaagcatataccgcagtcactg

SEQ ID NO: 143438 - DNA, 25 bp, Rattus norvegicus
aggcaagcatattccgcagtcactg

SEQ ID NO: 143439 - DNA, 25 bp, Rattus norvegicus
aggcaagcatccagtcatcaagcta

SEQ ID NO: 143440 - DNA, 25 bp, Rattus norvegicus
aggcaagcatcctgtcatcaagcta

SEQ ID NO: 143441 - DNA, 25 bp, Rattus norvegicus
aggcaagccgttccttaaggcatct

SEQ ID NO: 143442 - DNA, 25 bp, Rattus norvegicus
aggcaagccgttgcttaaggcatct

SEQ ID NO: 143443 - DNA, 25 bp, Rattus norvegicus
aggcaagcctgcagcatgcctggca

SEQ ID NO: 143444 - DNA, 25 bp, Rattus norvegicus
aggcaagcctgctgcatgcctggca

SEQ ID NO: 143445 - DNA, 25 bp, Rattus norvegicus
aggcaagccttgctcagtacaaaga

SEQ ID NO: 143446 - DNA, 25 bp, Rattus norvegicus
aggcaagccttggtcagtacaaaga

SEQ ID NO: 143447 - DNA, 25 bp, Rattus norvegicus
aggcaagcgcttaggcatcctggtt

SEQ ID NO: 143448 - DNA, 25 bp, Rattus norvegicus
aggcaagcgctttggcatcctggtt

SEQ ID NO: 143449 - DNA, 25 bp, Rattus norvegicus
aggcaagcggcgactcccaatgcag

SEQ ID NO: 143450 - DNA, 25 bp, Rattus norvegicus
aggcaagcggcgtctcccaatgcag

SEQ ID NO: 143451 - DNA, 25 bp, Rattus norvegicus
aggcaagcggctctggacatggaca

SEQ ID NO: 143452 - DNA, 25 bp, Rattus norvegicus
aggcaagcggctgtggacatggaca

SEQ ID NO: 143453 - DNA, 25 bp, Rattus norvegicus
aggcaaggacccacgagccatgtag

SEQ ID NO: 143454 - DNA, 25 bp, Rattus norvegicus
aggcaaggaccctcgagccatgtag

SEQ ID NO: 143455 - DNA, 25 bp, Rattus norvegicus
aggcaaggagcaagtgcacctccct

SEQ ID NO: 143456 - DNA, 25 bp, Rattus norvegicus
aggcaaggagcatgtgcacctccct

SEQ ID NO: 143457 - DNA, 25 bp, Rattus norvegicus
aggcaaggcactccctagcagactc

SEQ ID NO: 143458 - DNA, 25 bp, Rattus norvegicus
aggcaaggcactgcctagcagactc

SEQ ID NO: 143459 - DNA, 25 bp, Rattus norvegicus
aggcaaggcagacccagctttcggt

SEQ ID NO: 143460 - DNA, 25 bp, Rattus norvegicus
aggcaaggcagagccagctttcggt

SEQ ID NO: 143461 - DNA, 25 bp, Rattus norvegicus
aggcaaggccgtagggtagtacaca

SEQ ID NO: 143462 - DNA, 25 bp, Rattus norvegicus
aggcaaggccgttgggtagtacaca

SEQ ID NO: 143463 - DNA, 25 bp, Rattus norvegicus
aggcaaggcctaactgtgttcagat

SEQ ID NO: 143464 - DNA, 25 bp, Rattus norvegicus
aggcaaggcctatctgtgttcagat

SEQ ID NO: 143465 - DNA, 25 bp, Rattus norvegicus
aggcaaggccttagagtgcacagtt

SEQ ID NO: 143466 - DNA, 25 bp, Rattus norvegicus
aggcaaggcctttgagtgcacagtt

SEQ ID NO: 143467 - DNA, 25 bp, Rattus norvegicus
aggcaagggcccacaggcttcacag

SEQ ID NO: 143468 - DNA, 25 bp, Rattus norvegicus
aggcaagggccctcaggcttcacag

SEQ ID NO: 143469 - DNA, 25 bp, Rattus norvegicus
aggcaagggcttctgtgcccatcct

SEQ ID NO: 143470 - DNA, 25 bp, Rattus norvegicus
aggcaagggcttgtgtgcccatcct

SEQ ID NO: 143471 - DNA, 25 bp, Rattus norvegicus
aggcaagggtcaccgtgatttcaca

SEQ ID NO: 143472 - DNA, 25 bp, Rattus norvegicus
aggcaagggtcagcgtgatttcaca

SEQ ID NO: 143473 - DNA, 25 bp, Rattus norvegicus
aggcaagtcattcgctataagtcaa

SEQ ID NO: 143474 - DNA, 25 bp, Rattus norvegicus
aggcaagtcattggctataagtcaa

SEQ ID NO: 143475 - DNA, 25 bp, Rattus norvegicus
aggcaagtccccatccaagaagaag

SEQ ID NO: 143476 - DNA, 25 bp, Rattus norvegicus
aggcaagtccccttccaagaagaag

SEQ ID NO: 143477 - DNA, 25 bp, Rattus norvegicus
aggcaagtctctcggttcaaggcca

SEQ ID NO: 143478 - DNA, 25 bp, Rattus norvegicus
aggcaagtctctgggttcaaggcca

SEQ ID NO: 143479 - DNA, 25 bp, Rattus norvegicus
aggcaagtgcacctaggactggcca

SEQ ID NO: 143480 - DNA, 25 bp, Rattus norvegicus
aggcaagtgcacgtaggactggcca

SEQ ID NO: 143481 - DNA, 25 bp, Rattus norvegicus
aggcaataaactccgggccctggct

SEQ ID NO: 143482 - DNA, 25 bp, Rattus norvegicus
aggcaataaactgcgggccctggct

SEQ ID NO: 143483 - DNA, 25 bp, Rattus norvegicus
aggcaataccacaggtggccccttg

SEQ ID NO: 143484 - DNA, 25 bp, Rattus norvegicus
aggcaataccactggtggccccttg

SEQ ID NO: 143485 - DNA, 25 bp, Rattus norvegicus
aggcaatataccctccttgattaga

SEQ ID NO: 143486 - DNA, 25 bp, Rattus norvegicus
aggcaatataccgtccttgattaga

SEQ ID NO: 143487 - DNA, 25 bp, Rattus norvegicus
aggcaatcaaagcacctgagcacct

SEQ ID NO: 143488 - DNA, 25 bp, Rattus norvegicus
aggcaatcaaaggacctgagcacct

SEQ ID NO: 143489 - DNA, 25 bp, Rattus norvegicus
aggcaatcaaccagcaggtccagat

SEQ ID NO: 143490 - DNA, 25 bp, Rattus norvegicus
aggcaatcaacctgcaggtccagat

SEQ ID NO: 143491 - DNA, 25 bp, Rattus norvegicus
aggcaatcctttactgacggtccaa

SEQ ID NO: 143492 - DNA, 25 bp, Rattus norvegicus
aggcaatccttttctgacggtccaa

SEQ ID NO: 143493 - DNA, 25 bp, Rattus norvegicus
aggcaatctgatcgaagcttttctc

SEQ ID NO: 143494 - DNA, 25 bp, Rattus norvegicus
aggcaatctgatggaagcttttctc

SEQ ID NO: 143495 - DNA, 25 bp, Rattus norvegicus
aggcaatctttcatccaggctgtgg

SEQ ID NO: 143496 - DNA, 25 bp, Rattus norvegicus
aggcaatctttcttccaggctgtgg

SEQ ID NO: 143497 - DNA, 25 bp, Rattus norvegicus
aggcaatgcattcctggttaccaca

SEQ ID NO: 143498 - DNA, 25 bp, Rattus norvegicus
aggcaatgcattgctggttaccaca

SEQ ID NO: 143499 - DNA, 25 bp, Rattus norvegicus
aggcaatgcgggagaaccagctaca

SEQ ID NO: 143500 - DNA, 25 bp, Rattus norvegicus
aggcaatgcgggtgaaccagctaca

SEQ ID NO: 143501 - DNA, 25 bp, Rattus norvegicus
aggcaatgctgtcttctggtttcca

SEQ ID NO: 143502 - DNA, 25 bp, Rattus norvegicus
aggcaatgctgtgttctggtttcca

SEQ ID NO: 143503 - DNA, 25 bp, Rattus norvegicus
aggcaatggagcaggacttaaggaa

SEQ ID NO: 143504 - DNA, 25 bp, Rattus norvegicus
aggcaatggagctggacttaaggaa

SEQ ID NO: 143505 - DNA, 25 bp, Rattus norvegicus
aggcaatgtctacggtcctttgtat

SEQ ID NO: 143506 - DNA, 25 bp, Rattus norvegicus
aggcaatgtctagggtcctttgtat

SEQ ID NO: 143507 - DNA, 25 bp, Rattus norvegicus
aggcaatgtcttagttatggtttca

SEQ ID NO: 143508 - DNA, 25 bp, Rattus norvegicus
aggcaatgtctttgttatggtttca

SEQ ID NO: 143509 - DNA, 25 bp, Rattus norvegicus
aggcaatgtggtcacgttcttccgg

SEQ ID NO: 143510 - DNA, 25 bp, Rattus norvegicus
aggcaatgtggtgacgttcttccgg

SEQ ID NO: 143511 - DNA, 25 bp, Rattus norvegicus
aggcaatgttatagaccctcccttg

SEQ ID NO: 143512 - DNA, 25 bp, Rattus norvegicus
aggcaatgttattgaccctcccttg

SEQ ID NO: 143513 - DNA, 25 bp, Rattus norvegicus
aggcaattattgcatgctggaccca

SEQ ID NO: 143514 - DNA, 25 bp, Rattus norvegicus
aggcaattattggatgctggaccca

SEQ ID NO: 143515 - DNA, 25 bp, Rattus norvegicus
aggcaattccatctgaccacgtcgt

SEQ ID NO: 143516 - DNA, 25 bp, Rattus norvegicus
aggcaattccatgtgaccacgtcgt

SEQ ID NO: 143517 - DNA, 25 bp, Rattus norvegicus
aggcaattccctcgctgattttgaa

SEQ ID NO: 143518 - DNA, 25 bp, Rattus norvegicus
aggcaattccctggctgattttgaa

SEQ ID NO: 143519 - DNA, 25 bp, Rattus norvegicus
aggcaatttcataagctttggcttg

SEQ ID NO: 143520 - DNA, 25 bp, Rattus norvegicus
aggcaatttcattagctttggcttg

SEQ ID NO: 143521 - DNA, 25 bp, Rattus norvegicus
aggcacaaacggaagttctctgata

SEQ ID NO: 143522 - DNA, 25 bp, Rattus norvegicus
aggcacaaacggtagttctctgata

SEQ ID NO: 143523 - DNA, 25 bp, Rattus norvegicus
aggcacaaagccatcttgttaagag

SEQ ID NO: 143524 - DNA, 25 bp, Rattus norvegicus
aggcacaaagccttcttgttaagag

SEQ ID NO: 143525 - DNA, 25 bp, Rattus norvegicus
aggcacaaagctctccagggtgaga

SEQ ID NO: 143526 - DNA, 25 bp, Rattus norvegicus
aggcacaaagctgtccagggtgaga

SEQ ID NO: 143527 - DNA, 25 bp, Rattus norvegicus
aggcacaaatatcgcacacatgaat

SEQ ID NO: 143528 - DNA, 25 bp, Rattus norvegicus
aggcacaaatatggcacacatgaat

SEQ ID NO: 143529 - DNA, 25 bp, Rattus norvegicus
aggcacaaccttccttgtggatttc

SEQ ID NO: 143530 - DNA, 25 bp, Rattus norvegicus
aggcacaaccttgcttgtggatttc

SEQ ID NO: 143531 - DNA, 25 bp, Rattus norvegicus
aggcacaagctcaagttttcattcg

SEQ ID NO: 143532 - DNA, 25 bp, Rattus norvegicus
aggcacaagctctagttttcattcg

SEQ ID NO: 143533 - DNA, 25 bp, Rattus norvegicus
aggcacacagttctcaaccttagaa

SEQ ID NO: 143534 - DNA, 25 bp, Rattus norvegicus
aggcacacagttgtcaaccttagaa

SEQ ID NO: 143535 - DNA, 25 bp, Rattus norvegicus
aggcacacatacaggtccgtaggac

SEQ ID NO: 143536 - DNA, 25 bp, Rattus norvegicus
aggcacacatactggtccgtaggac

SEQ ID NO: 143537 - DNA, 25 bp, Rattus norvegicus
aggcacacctatcggagtggcacag

SEQ ID NO: 143538 - DNA, 25 bp, Rattus norvegicus
aggcacacctatgggagtggcacag

SEQ ID NO: 143539 - DNA, 25 bp, Rattus norvegicus
aggcacacctggctatgtgggtctg

SEQ ID NO: 143540 - DNA, 25 bp, Rattus norvegicus
aggcacacctgggtatgtgggtctg

SEQ ID NO: 143541 - DNA, 25 bp, Rattus norvegicus
aggcacactatgcaggcttcacggt

SEQ ID NO: 143542 - DNA, 25 bp, Rattus norvegicus
aggcacactatggaggcttcacggt

SEQ ID NO: 143543 - DNA, 25 bp, Rattus norvegicus
aggcacactcctagtatagtccaac

SEQ ID NO: 143544 - DNA, 25 bp, Rattus norvegicus
aggcacactccttgtatagtccaac

SEQ ID NO: 143545 - DNA, 25 bp, Rattus norvegicus
aggcacactcttaaccattttccaa

SEQ ID NO: 143546 - DNA, 25 bp, Rattus norvegicus
aggcacactctttaccattttccaa

SEQ ID NO: 143547 - DNA, 25 bp, Rattus norvegicus
aggcacacttgtcggacacctcgca

SEQ ID NO: 143548 - DNA, 25 bp, Rattus norvegicus
aggcacacttgtgggacacctcgca

SEQ ID NO: 143549 - DNA, 25 bp, Rattus norvegicus
aggcacagacagagcacctgttgga

SEQ ID NO: 143550 - DNA, 25 bp, Rattus norvegicus
aggcacagacagtgcacctgttgga

SEQ ID NO: 143551 - DNA, 25 bp, Rattus norvegicus
aggcacagacatatcctgaattgga

SEQ ID NO: 143552 - DNA, 25 bp, Rattus norvegicus
aggcacagacatttcctgaattgga

SEQ ID NO: 143553 - DNA, 25 bp, Rattus norvegicus
aggcacagactccatatgactccat

SEQ ID NO: 143554 - DNA, 25 bp, Rattus norvegicus
aggcacagactcgatatgactccat

SEQ ID NO: 143555 - DNA, 25 bp, Rattus norvegicus
aggcacagactgagctggcctccgc

SEQ ID NO: 143556 - DNA, 25 bp, Rattus norvegicus
aggcacagactgtgctggcctccgc

SEQ ID NO: 143557 - DNA, 25 bp, Rattus norvegicus
aggcacagcaggcattacagagaat

SEQ ID NO: 143558 - DNA, 25 bp, Rattus norvegicus
aggcacagcagggattacagagaat

SEQ ID NO: 143559 - DNA, 25 bp, Rattus norvegicus
aggcacagctgaagtctgacagtct

SEQ ID NO: 143560 - DNA, 25 bp, Rattus norvegicus
aggcacagctgatgtctgacagtct

SEQ ID NO: 143561 - DNA, 25 bp, Rattus norvegicus
aggcacagctttcggagtctcagaa

SEQ ID NO: 143562 - DNA, 25 bp, Rattus norvegicus
aggcacagctttgggagtctcagaa

SEQ ID NO: 143563 - DNA, 25 bp, Rattus norvegicus
aggcacaggaccaactcaagggtat

SEQ ID NO: 143564 - DNA, 25 bp, Rattus norvegicus
aggcacaggacctactcaagggtat

SEQ ID NO: 143565 - DNA, 25 bp, Rattus norvegicus
aggcacaggagaacctttactctct

SEQ ID NO: 143566 - DNA, 25 bp, Rattus norvegicus
aggcacaggagatcctttactctct

SEQ ID NO: 143567 - DNA, 25 bp, Rattus norvegicus
aggcacaggcacacggaaaactatt

SEQ ID NO: 143568 - DNA, 25 bp, Rattus norvegicus
aggcacaggcactcggaaaactatt

SEQ ID NO: 143569 - DNA, 25 bp, Rattus norvegicus
aggcacaggcgcaagccattgagac

SEQ ID NO: 143570 - DNA, 25 bp, Rattus norvegicus
aggcacaggcgctagccattgagac

SEQ ID NO: 143571 - DNA, 25 bp, Rattus norvegicus
aggcacaggtgcatccaagtctcgc

SEQ ID NO: 143572 - DNA, 25 bp, Rattus norvegicus
aggcacaggtgcttccaagtctcgc

SEQ ID NO: 143573 - DNA, 25 bp, Rattus norvegicus
aggcacagtagacacttaccccatt

SEQ ID NO: 143574 - DNA, 25 bp, Rattus norvegicus
aggcacagtagagacttaccccatt

SEQ ID NO: 143575 - DNA, 25 bp, Rattus norvegicus
aggcacagtgccacgtttagcaatt

SEQ ID NO: 143576 - DNA, 25 bp, Rattus norvegicus
aggcacagtgcctcgtttagcaatt

SEQ ID NO: 143577 - DNA, 25 bp, Rattus norvegicus
aggcacagttccaatatcttcatcc

SEQ ID NO: 143578 - DNA, 25 bp, Rattus norvegicus
aggcacagttcctatatcttcatcc

SEQ ID NO: 143579 - DNA, 25 bp, Rattus norvegicus
aggcacagttgcagatccagtcact

SEQ ID NO: 143580 - DNA, 25 bp, Rattus norvegicus
aggcacagttgctgatccagtcact

SEQ ID NO: 143581 - DNA, 25 bp, Rattus norvegicus
aggcacagtttgagattacccctca

SEQ ID NO: 143582 - DNA, 25 bp, Rattus norvegicus
aggcacagtttgtgattacccctca

SEQ ID NO: 143583 - DNA, 25 bp, Rattus norvegicus
aggcacatacggcagtcaggcactg

SEQ ID NO: 143584 - DNA, 25 bp, Rattus norvegicus
aggcacatacgggagtcaggcactg

SEQ ID NO: 143585 - DNA, 25 bp, Rattus norvegicus
aggcacatagcgctgttccatcggc

SEQ ID NO: 143586 - DNA, 25 bp, Rattus norvegicus
aggcacatagcggtgttccatcggc

SEQ ID NO: 143587 - DNA, 25 bp, Rattus norvegicus
aggcacatcagtctctttaaagcaa

SEQ ID NO: 143588 - DNA, 25 bp, Rattus norvegicus
aggcacatcagtgtctttaaagcaa

SEQ ID NO: 143589 - DNA, 25 bp, Rattus norvegicus
aggcacatcgtgctgtctgaagaat

SEQ ID NO: 143590 - DNA, 25 bp, Rattus norvegicus
aggcacatcgtggtgtctgaagaat

SEQ ID NO: 143591 - DNA, 25 bp, Rattus norvegicus
aggcacatgagcaaatagaacgttc

SEQ ID NO: 143592 - DNA, 25 bp, Rattus norvegicus
aggcacatgagctaatagaacgttc

SEQ ID NO: 143593 - DNA, 25 bp, Rattus norvegicus
aggcacattatgaagcagagattaa

SEQ ID NO: 143594 - DNA, 25 bp, Rattus norvegicus
aggcacattatgtagcagagattaa

SEQ ID NO: 143595 - DNA, 25 bp, Rattus norvegicus
aggcacattccaatatcagcatctc

SEQ ID NO: 143596 - DNA, 25 bp, Rattus norvegicus
aggcacattccattatcagcatctc

SEQ ID NO: 143597 - DNA, 25 bp, Rattus norvegicus
aggcacatttttcatccgggtatct

SEQ ID NO: 143598 - DNA, 25 bp, Rattus norvegicus
aggcacatttttgatccgggtatct

SEQ ID NO: 143599 - DNA, 25 bp, Rattus norvegicus
aggcaccaatccctgggctgtgtga

SEQ ID NO: 143600 - DNA, 25 bp, Rattus norvegicus
aggcaccaatccgtgggctgtgtga

SEQ ID NO: 143601 - DNA, 25 bp, Rattus norvegicus
aggcaccaatttacacagcaagctt

SEQ ID NO: 143602 - DNA, 25 bp, Rattus norvegicus
aggcaccaattttcacagcaagctt

SEQ ID NO: 143603 - DNA, 25 bp, Rattus norvegicus
aggcaccacgagaaaccctcgctgt

SEQ ID NO: 143604 - DNA, 25 bp, Rattus norvegicus
aggcaccacgagtaaccctcgctgt

SEQ ID NO: 143605 - DNA, 25 bp, Rattus norvegicus
aggcaccagcagacacgtggcatat

SEQ ID NO: 143606 - DNA, 25 bp, Rattus norvegicus
aggcaccagcagatcacacttgatg

SEQ ID NO: 143607 - DNA, 25 bp, Rattus norvegicus
aggcaccagcagtcacgtggcatat

SEQ ID NO: 143608 - DNA, 25 bp, Rattus norvegicus
aggcaccagcagttcacacttgatg

SEQ ID NO: 143609 - DNA, 25 bp, Rattus norvegicus
aggcaccagcggacccacgaggaag

SEQ ID NO: 143610 - DNA, 25 bp, Rattus norvegicus
aggcaccagcggtcccacgaggaag

SEQ ID NO: 143611 - DNA, 25 bp, Rattus norvegicus
aggcaccagctcaggacaagcacag

SEQ ID NO: 143612 - DNA, 25 bp, Rattus norvegicus
aggcaccagctctggacaagcacag

SEQ ID NO: 143613 - DNA, 25 bp, Rattus norvegicus
aggcaccagcttactcagggtcttt

SEQ ID NO: 143614 - DNA, 25 bp, Rattus norvegicus
aggcaccagcttaggaacttcgtcg

SEQ ID NO: 143615 - DNA, 25 bp, Rattus norvegicus
aggcaccagctttctcagggtcttt

SEQ ID NO: 143616 - DNA, 25 bp, Rattus norvegicus
aggcaccagctttggaacttcgtcg

SEQ ID NO: 143617 - DNA, 25 bp, Rattus norvegicus
aggcaccaggcaaccttgccaggaa

SEQ ID NO: 143618 - DNA, 25 bp, Rattus norvegicus
aggcaccaggcatccttgccaggaa

SEQ ID NO: 143619 - DNA, 25 bp, Rattus norvegicus
aggcaccaggccacaggaggagccc

SEQ ID NO: 143620 - DNA, 25 bp, Rattus norvegicus
aggcaccaggcctcaggaggagccc

SEQ ID NO: 143621 - DNA, 25 bp, Rattus norvegicus
aggcaccaggctaaggtctcacata

SEQ ID NO: 143622 - DNA, 25 bp, Rattus norvegicus
aggcaccaggcttaggtctcacata

SEQ ID NO: 143623 - DNA, 25 bp, Rattus norvegicus
aggcaccattgtatctgtggcttgg

SEQ ID NO: 143624 - DNA, 25 bp, Rattus norvegicus
aggcaccattgtttctgtggcttgg

SEQ ID NO: 143625 - DNA, 25 bp, Rattus norvegicus
aggcacccaaataattgtctctagg

SEQ ID NO: 143626 - DNA, 25 bp, Rattus norvegicus
aggcacccaaattattgtctctagg

SEQ ID NO: 143627 - DNA, 25 bp, Rattus norvegicus
aggcacccaagacccatgtgtgttt

SEQ ID NO: 143628 - DNA, 25 bp, Rattus norvegicus
aggcacccaagagccatgtgtgttt

SEQ ID NO: 143629 - DNA, 25 bp, Rattus norvegicus
aggcacccaccacgctaatttgatt

SEQ ID NO: 143630 - DNA, 25 bp, Rattus norvegicus
aggcacccaccaggctaatttgatt

SEQ ID NO: 143631 - DNA, 25 bp, Rattus norvegicus
aggcacccacttcacatgatttatt

SEQ ID NO: 143632 - DNA, 25 bp, Rattus norvegicus
aggcacccacttgacatgatttatt

SEQ ID NO: 143633 - DNA, 25 bp, Rattus norvegicus
aggcacccagagatctatttatcta

SEQ ID NO: 143634 - DNA, 25 bp, Rattus norvegicus
aggcacccagagttctatttatcta

SEQ ID NO: 143635 - DNA, 25 bp, Rattus norvegicus
aggcacccatccaggtggtgggcaa

SEQ ID NO: 143636 - DNA, 25 bp, Rattus norvegicus
aggcacccatcctggtggtgggcaa

SEQ ID NO: 143637 - DNA, 25 bp, Rattus norvegicus
aggcacccatgcaactgttttgtag

SEQ ID NO: 143638 - DNA, 25 bp, Rattus norvegicus
aggcacccatgctactgttttgtag

SEQ ID NO: 143639 - DNA, 25 bp, Rattus norvegicus
aggcaccccattcagtaacttcttt

SEQ ID NO: 143640 - DNA, 25 bp, Rattus norvegicus
aggcaccccattgagtaacttcttt

SEQ ID NO: 143641 - DNA, 25 bp, Rattus norvegicus
aggcacccgactcagtgccaggctt

SEQ ID NO: 143642 - DNA, 25 bp, Rattus norvegicus
aggcacccgactgagtgccaggctt

SEQ ID NO: 143643 - DNA, 25 bp, Rattus norvegicus
aggcacccgctaacaccggatggaa

SEQ ID NO: 143644 - DNA, 25 bp, Rattus norvegicus
aggcacccgctatcaccggatggaa

SEQ ID NO: 143645 - DNA, 25 bp, Rattus norvegicus
aggcacccgtggctcaaactatcat

SEQ ID NO: 143646 - DNA, 25 bp, Rattus norvegicus
aggcacccgtgggtcaaactatcat

SEQ ID NO: 143647 - DNA, 25 bp, Rattus norvegicus
aggcaccctgtcatcatgacagaga

SEQ ID NO: 143648 - DNA, 25 bp, Rattus norvegicus
aggcaccctgtcttcatgacagaga

SEQ ID NO: 143649 - DNA, 25 bp, Rattus norvegicus
aggcaccgaactcagcatttatttt

SEQ ID NO: 143650 - DNA, 25 bp, Rattus norvegicus
aggcaccgaactgagcatttatttt

SEQ ID NO: 143651 - DNA, 25 bp, Rattus norvegicus
aggcaccgagtcattgtcaggtcag

SEQ ID NO: 143652 - DNA, 25 bp, Rattus norvegicus
aggcaccgagtctttgtcaggtcag

SEQ ID NO: 143653 - DNA, 25 bp, Rattus norvegicus
aggcaccgtcctccagagtgaactg

SEQ ID NO: 143654 - DNA, 25 bp, Rattus norvegicus
aggcaccgtcctgcagagtgaactg

SEQ ID NO: 143655 - DNA, 25 bp, Rattus norvegicus
aggcaccgtggcagttactgcaact

SEQ ID NO: 143656 - DNA, 25 bp, Rattus norvegicus
aggcaccgtggctgttactgcaact

SEQ ID NO: 143657 - DNA, 25 bp, Rattus norvegicus
aggcacctaaagatcgtctaccgaa

SEQ ID NO: 143658 - DNA, 25 bp, Rattus norvegicus
aggcacctaaagttcgtctaccgaa

SEQ ID NO: 143659 - DNA, 25 bp, Rattus norvegicus
aggcacctaggaatgggcaacgcat

SEQ ID NO: 143660 - DNA, 25 bp, Rattus norvegicus
aggcacctaggattgggcaacgcat

SEQ ID NO: 143661 - DNA, 25 bp, Rattus norvegicus
aggcacctataacctgtccttcgac

SEQ ID NO: 143662 - DNA, 25 bp, Rattus norvegicus
aggcacctataagctgtccttcgac

SEQ ID NO: 143663 - DNA, 25 bp, Rattus norvegicus
aggcacctcaaacaccaaggtctga

SEQ ID NO: 143664 - DNA, 25 bp, Rattus norvegicus
aggcacctcaaagaccaaggtctga

SEQ ID NO: 143665 - DNA, 25 bp, Rattus norvegicus
aggcacctctgactgttcccctgga

SEQ ID NO: 143666 - DNA, 25 bp, Rattus norvegicus
aggcacctctgagtgttcccctgga

SEQ ID NO: 143667 - DNA, 25 bp, Rattus norvegicus
aggcacctgctgagacacgtgtgag

SEQ ID NO: 143668 - DNA, 25 bp, Rattus norvegicus
aggcacctgctgtgacacgtgtgag

SEQ ID NO: 143669 - DNA, 25 bp, Rattus norvegicus
aggcacctggatcttctatgagcta

SEQ ID NO: 143670 - DNA, 25 bp, Rattus norvegicus
aggcacctggatgttctatgagcta

SEQ ID NO: 143671 - DNA, 25 bp, Rattus norvegicus
aggcacctgtacaagattctggcat

SEQ ID NO: 143672 - DNA, 25 bp, Rattus norvegicus
aggcacctgtactagattctggcat

SEQ ID NO: 143673 - DNA, 25 bp, Rattus norvegicus
aggcacctgtcccaaaggctagttt

SEQ ID NO: 143674 - DNA, 25 bp, Rattus norvegicus
aggcacctgtccgaaaggctagttt

SEQ ID NO: 143675 - DNA, 25 bp, Rattus norvegicus
aggcacctgtctcagctaagactca

SEQ ID NO: 143676 - DNA, 25 bp, Rattus norvegicus
aggcacctgtctgagctaagactca

SEQ ID NO: 143677 - DNA, 25 bp, Rattus norvegicus
aggcacctgttcctgtttgccacag

SEQ ID NO: 143678 - DNA, 25 bp, Rattus norvegicus
aggcacctgttcgtgtttgccacag

SEQ ID NO: 143679 - DNA, 25 bp, Rattus norvegicus
aggcaccttagtccttgcagagagc

SEQ ID NO: 143680 - DNA, 25 bp, Rattus norvegicus
aggcaccttagtgcttgcagagagc

SEQ ID NO: 143681 - DNA, 25 bp, Rattus norvegicus
aggcacctttatagaccttggaggg

SEQ ID NO: 143682 - DNA, 25 bp, Rattus norvegicus
aggcacctttattgaccttggaggg

SEQ ID NO: 143683 - DNA, 25 bp, Rattus norvegicus
aggcacgaacttccgccgaaggctc

SEQ ID NO: 143684 - DNA, 25 bp, Rattus norvegicus
aggcacgaacttgcgccgaaggctc

SEQ ID NO: 143685 - DNA, 25 bp, Rattus norvegicus
aggcacgaagctctcttccagggat

SEQ ID NO: 143686 - DNA, 25 bp, Rattus norvegicus
aggcacgaagctgtcttccagggat

SEQ ID NO: 143687 - DNA, 25 bp, Rattus norvegicus
aggcacgaatctctgggccacacaa

SEQ ID NO: 143688 - DNA, 25 bp, Rattus norvegicus
aggcacgaatctgtgggccacacaa

SEQ ID NO: 143689 - DNA, 25 bp, Rattus norvegicus
aggcacgacatcattccaggaagga

SEQ ID NO: 143690 - DNA, 25 bp, Rattus norvegicus
aggcacgacatctttccaggaagga

SEQ ID NO: 143691 - DNA, 25 bp, Rattus norvegicus
aggcacgaccctccagcttggagag

SEQ ID NO: 143692 - DNA, 25 bp, Rattus norvegicus
aggcacgaccctgcagcttggagag

SEQ ID NO: 143693 - DNA, 25 bp, Rattus norvegicus
aggcacgacgaacggctcaagcttt

SEQ ID NO: 143694 - DNA, 25 bp, Rattus norvegicus
aggcacgacgaagggctcaagcttt

SEQ ID NO: 143695 - DNA, 25 bp, Rattus norvegicus
aggcacgcacacacgcatgtacgca

SEQ ID NO: 143696 - DNA, 25 bp, Rattus norvegicus
aggcacgcacactcgcatgtacgca

SEQ ID NO: 143697 - DNA, 25 bp, Rattus norvegicus
aggcacgccccaaaggtgagggtct

SEQ ID NO: 143698 - DNA, 25 bp, Rattus norvegicus
aggcacgccccataggtgagggtct

SEQ ID NO: 143699 - DNA, 25 bp, Rattus norvegicus
aggcacgcctagaagctgaggccag

SEQ ID NO: 143700 - DNA, 25 bp, Rattus norvegicus
aggcacgcctagtagctgaggccag

SEQ ID NO: 143701 - DNA, 25 bp, Rattus norvegicus
aggcacgccttcctaatgacaatga

SEQ ID NO: 143702 - DNA, 25 bp, Rattus norvegicus
aggcacgccttcgtaatgacaatga

SEQ ID NO: 143703 - DNA, 25 bp, Rattus norvegicus
aggcacgctgtgcaagaaatcatag

SEQ ID NO: 143704 - DNA, 25 bp, Rattus norvegicus
aggcacgctgtggaagaaatcatag

SEQ ID NO: 143705 - DNA, 25 bp, Rattus norvegicus
aggcacggagatcctgagcccacat

SEQ ID NO: 143706 - DNA, 25 bp, Rattus norvegicus
aggcacggagatgctgagcccacat

SEQ ID NO: 143707 - DNA, 25 bp, Rattus norvegicus
aggcacggatttctctaattctggt

SEQ ID NO: 143708 - DNA, 25 bp, Rattus norvegicus
aggcacggatttgtctaattctggt

SEQ ID NO: 143709 - DNA, 25 bp, Rattus norvegicus
aggcacggcagtaccctggagttca

SEQ ID NO: 143710 - DNA, 25 bp, Rattus norvegicus
aggcacggcagttccctggagttca

SEQ ID NO: 143711 - DNA, 25 bp, Rattus norvegicus
aggcacgggaagcaactagtaccac

SEQ ID NO: 143712 - DNA, 25 bp, Rattus norvegicus
aggcacgggaaggaactagtaccac

SEQ ID NO: 143713 - DNA, 25 bp, Rattus norvegicus
aggcacgggcacaggcaccagtacc

SEQ ID NO: 143714 - DNA, 25 bp, Rattus norvegicus
aggcacgggcactggcaccagtacc

SEQ ID NO: 143715 - DNA, 25 bp, Rattus norvegicus
aggcacggtagtatatccctgctat

SEQ ID NO: 143716 - DNA, 25 bp, Rattus norvegicus
aggcacggtagtttatccctgctat

SEQ ID NO: 143717 - DNA, 25 bp, Rattus norvegicus
aggcacggtggtacacgactgttat

SEQ ID NO: 143718 - DNA, 25 bp, Rattus norvegicus
aggcacggtggttcacgactgttat

SEQ ID NO: 143719 - DNA, 25 bp, Rattus norvegicus
aggcacgtcctgactgtacataaac

SEQ ID NO: 143720 - DNA, 25 bp, Rattus norvegicus
aggcacgtcctgtctgtacataaac

SEQ ID NO: 143721 - DNA, 25 bp, Rattus norvegicus
aggcacgtgcatctatgtatgtaca

SEQ ID NO: 143722 - DNA, 25 bp, Rattus norvegicus
aggcacgtgcatgtatgtatgtaca

SEQ ID NO: 143723 - DNA, 25 bp, Rattus norvegicus
aggcacgtgtcaactggtctggtcg

SEQ ID NO: 143724 - DNA, 25 bp, Rattus norvegicus
aggcacgtgtcatctggtctggtcg

SEQ ID NO: 143725 - DNA, 25 bp, Rattus norvegicus
aggcacgttcctcgtgtcacctaac

SEQ ID NO: 143726 - DNA, 25 bp, Rattus norvegicus
aggcacgttcctggtgtcacctaac

SEQ ID NO: 143727 - DNA, 25 bp, Rattus norvegicus
aggcactaactacggcatgtgttgt

SEQ ID NO: 143728 - DNA, 25 bp, Rattus norvegicus
aggcactaactagggcatgtgttgt

SEQ ID NO: 143729 - DNA, 25 bp, Rattus norvegicus
aggcactaagccagttctgacaccg

SEQ ID NO: 143730 - DNA, 25 bp, Rattus norvegicus
aggcactaagcctgttctgacaccg

SEQ ID NO: 143731 - DNA, 25 bp, Rattus norvegicus
aggcactacagccatctgtaccact

SEQ ID NO: 143732 - DNA, 25 bp, Rattus norvegicus
aggcactacagcgatctgtaccact

SEQ ID NO: 143733 - DNA, 25 bp, Rattus norvegicus
aggcactactacatcttccaaggag

SEQ ID NO: 143734 - DNA, 25 bp, Rattus norvegicus
aggcactactacttcttccaaggag

SEQ ID NO: 143735 - DNA, 25 bp, Rattus norvegicus
aggcactactcacccaagaactgtg

SEQ ID NO: 143736 - DNA, 25 bp, Rattus norvegicus
aggcactactcagccaagaactgtg

SEQ ID NO: 143737 - DNA, 25 bp, Rattus norvegicus
aggcactatctacgttgagccctgc

SEQ ID NO: 143738 - DNA, 25 bp, Rattus norvegicus
aggcactatctaggttgagccctgc

SEQ ID NO: 143739 - DNA, 25 bp, Rattus norvegicus
aggcactcacccagagttgttacaa

SEQ ID NO: 143740 - DNA, 25 bp, Rattus norvegicus
aggcactcaccctgagttgttacaa

SEQ ID NO: 143741 - DNA, 25 bp, Rattus norvegicus
aggcactcacttaccaggtattaaa

SEQ ID NO: 143742 - DNA, 25 bp, Rattus norvegicus
aggcactcactttccaggtattaaa

SEQ ID NO: 143743 - DNA, 25 bp, Rattus norvegicus
aggcactcaggaaggtccagcgttt

SEQ ID NO: 143744 - DNA, 25 bp, Rattus norvegicus
aggcactcaggatggtccagcgttt

SEQ ID NO: 143745 - DNA, 25 bp, Rattus norvegicus
aggcactcagggacaaaccagtcag

SEQ ID NO: 143746 - DNA, 25 bp, Rattus norvegicus
aggcactcagggtcaaaccagtcag

SEQ ID NO: 143747 - DNA, 25 bp, Rattus norvegicus
aggcactcccctatgaggaagtggg

SEQ ID NO: 143748 - DNA, 25 bp, Rattus norvegicus
aggcactcccctttgaggaagtggg

SEQ ID NO: 143749 - DNA, 25 bp, Rattus norvegicus
aggcactctatcatttgtcttcttt

SEQ ID NO: 143750 - DNA, 25 bp, Rattus norvegicus
aggcactctatcttttgtcttcttt

SEQ ID NO: 143751 - DNA, 25 bp, Rattus norvegicus
aggcactctccaaagatatcttcga

SEQ ID NO: 143752 - DNA, 25 bp, Rattus norvegicus
aggcactctccatagatatcttcga

SEQ ID NO: 143753 - DNA, 25 bp, Rattus norvegicus
aggcactctgtcacttccaaaggaa

SEQ ID NO: 143754 - DNA, 25 bp, Rattus norvegicus
aggcactctgtctcttccaaaggaa

SEQ ID NO: 143755 - DNA, 25 bp, Rattus norvegicus
aggcactcttggataggctcagctc

SEQ ID NO: 143756 - DNA, 25 bp, Rattus norvegicus
aggcactcttggttaggctcagctc

SEQ ID NO: 143757 - DNA, 25 bp, Rattus norvegicus
aggcactcttttcatggctgtcagc

SEQ ID NO: 143758 - DNA, 25 bp, Rattus norvegicus
aggcactcttttgatggctgtcagc

SEQ ID NO: 143759 - DNA, 25 bp, Rattus norvegicus
aggcactgaatcagctgtgggcgca

SEQ ID NO: 143760 - DNA, 25 bp, Rattus norvegicus
aggcactgaatctgctgtgggcgca

SEQ ID NO: 143761 - DNA, 25 bp, Rattus norvegicus
aggcactgacagacatgggtttact

SEQ ID NO: 143762 - DNA, 25 bp, Rattus norvegicus
aggcactgacagtcatgggtttact

SEQ ID NO: 143763 - DNA, 25 bp, Rattus norvegicus
aggcactgacctcgacagacactca

SEQ ID NO: 143764 - DNA, 25 bp, Rattus norvegicus
aggcactgacctggacagacactca

SEQ ID NO: 143765 - DNA, 25 bp, Rattus norvegicus
aggcactgagaacccctacggtaaa

SEQ ID NO: 143766 - DNA, 25 bp, Rattus norvegicus
aggcactgagaagccctacggtaaa

SEQ ID NO: 143767 - DNA, 25 bp, Rattus norvegicus
aggcactgatccatctctgacttca

SEQ ID NO: 143768 - DNA, 25 bp, Rattus norvegicus
aggcactgatccttctctgacttca

SEQ ID NO: 143769 - DNA, 25 bp, Rattus norvegicus
aggcactgattcagtttggtcctca

SEQ ID NO: 143770 - DNA, 25 bp, Rattus norvegicus
aggcactgattctgtttggtcctca

SEQ ID NO: 143771 - DNA, 25 bp, Rattus norvegicus
aggcactgcacgcacatggtgagca

SEQ ID NO: 143772 - DNA, 25 bp, Rattus norvegicus
aggcactgcacggacatggtgagca

SEQ ID NO: 143773 - DNA, 25 bp, Rattus norvegicus
aggcactgcctaacagaggtcattt

SEQ ID NO: 143774 - DNA, 25 bp, Rattus norvegicus
aggcactgcctatcagaggtcattt

SEQ ID NO: 143775 - DNA, 25 bp, Rattus norvegicus
aggcactgcctgcatgtgctgcaca

SEQ ID NO: 143776 - DNA, 25 bp, Rattus norvegicus
aggcactgcctggatgtgctgcaca

SEQ ID NO: 143777 - DNA, 25 bp, Rattus norvegicus
aggcactgcgggacaactcgacaat

SEQ ID NO: 143778 - DNA, 25 bp, Rattus norvegicus
aggcactgcgggtcaactcgacaat

SEQ ID NO: 143779 - DNA, 25 bp, Rattus norvegicus
aggcactgcgtgcacactgtacagt

SEQ ID NO: 143780 - DNA, 25 bp, Rattus norvegicus
aggcactgcgtggacactgtacagt

SEQ ID NO: 143781 - DNA, 25 bp, Rattus norvegicus
aggcactgctctacagcgatggata

SEQ ID NO: 143782 - DNA, 25 bp, Rattus norvegicus
aggcactgctcttcagcgatggata

SEQ ID NO: 143783 - DNA, 25 bp, Rattus norvegicus
aggcactggctcaagggcaaattat

SEQ ID NO: 143784 - DNA, 25 bp, Rattus norvegicus
aggcactggctctagggcaaattat

SEQ ID NO: 143785 - DNA, 25 bp, Rattus norvegicus
aggcactgggacattgcaggtgacc

SEQ ID NO: 143786 - DNA, 25 bp, Rattus norvegicus
aggcactgggactttgcaggtgacc

SEQ ID NO: 143787 - DNA, 25 bp, Rattus norvegicus
aggcactgggccaatggaccaaaga

SEQ ID NO: 143788 - DNA, 25 bp, Rattus norvegicus
aggcactgggcctatggaccaaaga

SEQ ID NO: 143789 - DNA, 25 bp, Rattus norvegicus
aggcactggtctcgaccaagccagt

SEQ ID NO: 143790 - DNA, 25 bp, Rattus norvegicus
aggcactggtctggaccaagccagt

SEQ ID NO: 143791 - DNA, 25 bp, Rattus norvegicus
aggcactggttcagaagcgccacta

SEQ ID NO: 143792 - DNA, 25 bp, Rattus norvegicus
aggcactggttctgaagcgccacta

SEQ ID NO: 143793 - DNA, 25 bp, Rattus norvegicus
aggcactgttatcaggacattacct

SEQ ID NO: 143794 - DNA, 25 bp, Rattus norvegicus
aggcactgttatcagtctcaaagga

SEQ ID NO: 143795 - DNA, 25 bp, Rattus norvegicus
aggcactgttatgaggacattacct

SEQ ID NO: 143796 - DNA, 25 bp, Rattus norvegicus
aggcactgttatgagtctcaaagga

SEQ ID NO: 143797 - DNA, 25 bp, Rattus norvegicus
aggcacttagccatgaacctaaaat

SEQ ID NO: 143798 - DNA, 25 bp, Rattus norvegicus
aggcacttagccttgaacctaaaat

SEQ ID NO: 143799 - DNA, 25 bp, Rattus norvegicus
aggcacttcaccaacgctatttgtt

SEQ ID NO: 143800 - DNA, 25 bp, Rattus norvegicus
aggcacttcacctacgctatttgtt

SEQ ID NO: 143801 - DNA, 25 bp, Rattus norvegicus
aggcacttcttaacttctctgtgaa

SEQ ID NO: 143802 - DNA, 25 bp, Rattus norvegicus
aggcacttcttatcttctctgtgaa

SEQ ID NO: 143803 - DNA, 25 bp, Rattus norvegicus
aggcactttctacgacactgacttc

SEQ ID NO: 143804 - DNA, 25 bp, Rattus norvegicus
aggcactttctaggacactgacttc

SEQ ID NO: 143805 - DNA, 25 bp, Rattus norvegicus
aggcactttggtcgttcacttgcac

SEQ ID NO: 143806 - DNA, 25 bp, Rattus norvegicus
aggcactttggtggttcacttgcac

SEQ ID NO: 143807 - DNA, 25 bp, Rattus norvegicus
aggcactttgtcagctgctgccagg

SEQ ID NO: 143808 - DNA, 25 bp, Rattus norvegicus
aggcactttgtctgctgctgccagg

SEQ ID NO: 143809 - DNA, 25 bp, Rattus norvegicus
aggcacttttacagaggcttaatag

SEQ ID NO: 143810 - DNA, 25 bp, Rattus norvegicus
aggcacttttactgaggcttaatag

SEQ ID NO: 143811 - DNA, 25 bp, Rattus norvegicus
aggcagaaatctagctcccagagca

SEQ ID NO: 143812 - DNA, 25 bp, Rattus norvegicus
aggcagaaatcttgctcccagagca

SEQ ID NO: 143813 - DNA, 25 bp, Rattus norvegicus
aggcagaacaccaacgcacaaaaca

SEQ ID NO: 143814 - DNA, 25 bp, Rattus norvegicus
aggcagaacacctacgcacaaaaca

SEQ ID NO: 143815 - DNA, 25 bp, Rattus norvegicus
aggcagaacatgatacctgacccct

SEQ ID NO: 143816 - DNA, 25 bp, Rattus norvegicus
aggcagaacatgcaagtgagacctt

SEQ ID NO: 143817 - DNA, 25 bp, Rattus norvegicus
aggcagaacatggaagtgagacctt

SEQ ID NO: 143818 - DNA, 25 bp, Rattus norvegicus
aggcagaacatgttacctgacccct

SEQ ID NO: 143819 - DNA, 25 bp, Rattus norvegicus
aggcagaaccttctggctgcaggaa

SEQ ID NO: 143820 - DNA, 25 bp, Rattus norvegicus
aggcagaaccttgtggctgcaggaa

SEQ ID NO: 143821 - DNA, 25 bp, Rattus norvegicus
aggcagaagagccaaagcaaccttt

SEQ ID NO: 143822 - DNA, 25 bp, Rattus norvegicus
aggcagaagagcgaaagcaaccttt

SEQ ID NO: 143823 - DNA, 25 bp, Rattus norvegicus
aggcagaagcagctctgtgtccagc

SEQ ID NO: 143824 - DNA, 25 bp, Rattus norvegicus
aggcagaagcaggtctgtgtccagc

SEQ ID NO: 143825 - DNA, 25 bp, Rattus norvegicus
aggcagaagtatactgtcgacttac

SEQ ID NO: 143826 - DNA, 25 bp, Rattus norvegicus
aggcagaagtattctgtcgacttac

SEQ ID NO: 143827 - DNA, 25 bp, Rattus norvegicus
aggcagaatcatctccaggcaggac

SEQ ID NO: 143828 - DNA, 25 bp, Rattus norvegicus
aggcagaatcatgtccaggcaggac

SEQ ID NO: 143829 - DNA, 25 bp, Rattus norvegicus
aggcagaatgtccacaaccacttgt

SEQ ID NO: 143830 - DNA, 25 bp, Rattus norvegicus
aggcagaatgtcgacaaccacttgt

SEQ ID NO: 143831 - DNA, 25 bp, Rattus norvegicus
aggcagaattctctttctgtccctc

SEQ ID NO: 143832 - DNA, 25 bp, Rattus norvegicus
aggcagaattctgtttctgtccctc

SEQ ID NO: 143833 - DNA, 25 bp, Rattus norvegicus
aggcagaccatgatctacgcggagg

SEQ ID NO: 143834 - DNA, 25 bp, Rattus norvegicus
aggcagaccatgttctacgcggagg

SEQ ID NO: 143835 - DNA, 25 bp, Rattus norvegicus
aggcagaccctaagccatagatggt

SEQ ID NO: 143836 - DNA, 25 bp, Rattus norvegicus
aggcagaccctatgccatagatggt

SEQ ID NO: 143837 - DNA, 25 bp, Rattus norvegicus
aggcagacctctcaattccagggca

SEQ ID NO: 143838 - DNA, 25 bp, Rattus norvegicus
aggcagacctctgaattccagggca

SEQ ID NO: 143839 - DNA, 25 bp, Rattus norvegicus
aggcagacgaagagtgtgccccgct

SEQ ID NO: 143840 - DNA, 25 bp, Rattus norvegicus
aggcagacgaagtgtgtgccccgct

SEQ ID NO: 143841 - DNA, 25 bp, Rattus norvegicus
aggcagacgagcagccctttgatct

SEQ ID NO: 143842 - DNA, 25 bp, Rattus norvegicus
aggcagacgagctgccctttgatct

SEQ ID NO: 143843 - DNA, 25 bp, Rattus norvegicus
aggcagacgccaagcttcagttcac

SEQ ID NO: 143844 - DNA, 25 bp, Rattus norvegicus
aggcagacgccatgcttcagttcac

SEQ ID NO: 143845 - DNA, 25 bp, Rattus norvegicus
aggcagactaaaataacctcctcct

SEQ ID NO: 143846 - DNA, 25 bp, Rattus norvegicus
aggcagactaaattaacctcctcct

SEQ ID NO: 143847 - DNA, 25 bp, Rattus norvegicus
aggcagactcttatgtggattccag

SEQ ID NO: 143848 - DNA, 25 bp, Rattus norvegicus
aggcagactcttttgtggattccag

SEQ ID NO: 143849 - DNA, 25 bp, Rattus norvegicus
aggcagactggcactttcctgtgga

SEQ ID NO: 143850 - DNA, 25 bp, Rattus norvegicus
aggcagactggctctttcctgtgga

SEQ ID NO: 143851 - DNA, 25 bp, Rattus norvegicus
aggcagacttttcgctactttgtgg

SEQ ID NO: 143852 - DNA, 25 bp, Rattus norvegicus
aggcagacttttggctactttgtgg

SEQ ID NO: 143853 - DNA, 25 bp, Rattus norvegicus
aggcagagactcctctcggcttttt

SEQ ID NO: 143854 - DNA, 25 bp, Rattus norvegicus
aggcagagactcgtctcggcttttt

SEQ ID NO: 143855 - DNA, 25 bp, Rattus norvegicus
aggcagagacttcgcaatccacatt

SEQ ID NO: 143856 - DNA, 25 bp, Rattus norvegicus
aggcagagacttggcaatccacatt

SEQ ID NO: 143857 - DNA, 25 bp, Rattus norvegicus
aggcagagagcaaggtcctgaccca

SEQ ID NO: 143858 - DNA, 25 bp, Rattus norvegicus
aggcagagagcatggtcctgaccca

SEQ ID NO: 143859 - DNA, 25 bp, Rattus norvegicus
aggcagagatacatggctttgaatg

SEQ ID NO: 143860 - DNA, 25 bp, Rattus norvegicus
aggcagagatacttggctttgaatg

SEQ ID NO: 143861 - DNA, 25 bp, Rattus norvegicus
aggcagagatcacactagccagggc

SEQ ID NO: 143862 - DNA, 25 bp, Rattus norvegicus
aggcagagatcaccaggctcataaa

SEQ ID NO: 143863 - DNA, 25 bp, Rattus norvegicus
aggcagagatcagactagccagggc

SEQ ID NO: 143864 - DNA, 25 bp, Rattus norvegicus
aggcagagatcagcaggctcataaa

SEQ ID NO: 143865 - DNA, 25 bp, Rattus norvegicus
aggcagagcccactttgactacttt

SEQ ID NO: 143866 - DNA, 25 bp, Rattus norvegicus
aggcagagcccagtttgactacttt

SEQ ID NO: 143867 - DNA, 25 bp, Rattus norvegicus
aggcagagccgtctgggagagtcca

SEQ ID NO: 143868 - DNA, 25 bp, Rattus norvegicus
aggcagagccgtgtgggagagtcca

SEQ ID NO: 143869 - DNA, 25 bp, Rattus norvegicus
aggcagaggccgcttgttctcctga

SEQ ID NO: 143870 - DNA, 25 bp, Rattus norvegicus
aggcagaggccggttgttctcctga

SEQ ID NO: 143871 - DNA, 25 bp, Rattus norvegicus
aggcagaggcctaggattcacccca

SEQ ID NO: 143872 - DNA, 25 bp, Rattus norvegicus
aggcagaggcctcaagcagccacta

SEQ ID NO: 143873 - DNA, 25 bp, Rattus norvegicus
aggcagaggcctgaagcagccacta

SEQ ID NO: 143874 - DNA, 25 bp, Rattus norvegicus
aggcagaggccttggattcacccca

SEQ ID NO: 143875 - DNA, 25 bp, Rattus norvegicus
aggcagagggccaggacagctttct

SEQ ID NO: 143876 - DNA, 25 bp, Rattus norvegicus
aggcagagggcctggacagctttct

SEQ ID NO: 143877 - DNA, 25 bp, Rattus norvegicus
aggcagaggtatcgtccgtatgtcc

SEQ ID NO: 143878 - DNA, 25 bp, Rattus norvegicus
aggcagaggtatggtccgtatgtcc

SEQ ID NO: 143879 - DNA, 25 bp, Rattus norvegicus
aggcagagtcaaccacaggtagatc

SEQ ID NO: 143880 - DNA, 25 bp, Rattus norvegicus
aggcagagtcaagcacaggtagatc

SEQ ID NO: 143881 - DNA, 25 bp, Rattus norvegicus
aggcagagtctaaacccagtgggca

SEQ ID NO: 143882 - DNA, 25 bp, Rattus norvegicus
aggcagagtctatacccagtgggca

SEQ ID NO: 143883 - DNA, 25 bp, Rattus norvegicus
aggcagagtctcaacgctacaaact

SEQ ID NO: 143884 - DNA, 25 bp, Rattus norvegicus
aggcagagtctcctggcttcagtgc

SEQ ID NO: 143885 - DNA, 25 bp, Rattus norvegicus
aggcagagtctcgtggcttcagtgc

SEQ ID NO: 143886 - DNA, 25 bp, Rattus norvegicus
aggcagagtctctacgctacaaact

SEQ ID NO: 143887 - DNA, 25 bp, Rattus norvegicus
aggcagagtgccagctagttctctg

SEQ ID NO: 143888 - DNA, 25 bp, Rattus norvegicus
aggcagagtgcctgctagttctctg

SEQ ID NO: 143889 - DNA, 25 bp, Rattus norvegicus
aggcagagttagcaccagcaggctc

SEQ ID NO: 143890 - DNA, 25 bp, Rattus norvegicus
aggcagagttaggaccagcaggctc

SEQ ID NO: 143891 - DNA, 25 bp, Rattus norvegicus
aggcagatcctgaccctgaggaaag

SEQ ID NO: 143892 - DNA, 25 bp, Rattus norvegicus
aggcagatcctgtccctgaggaaag

SEQ ID NO: 143893 - DNA, 25 bp, Rattus norvegicus
aggcagatctgacatctacagctcc

SEQ ID NO: 143894 - DNA, 25 bp, Rattus norvegicus
aggcagatctgagatctacagctcc

SEQ ID NO: 143895 - DNA, 25 bp, Rattus norvegicus
aggcagatcttaactctcattcttc

SEQ ID NO: 143896 - DNA, 25 bp, Rattus norvegicus
aggcagatcttatctctcattcttc

SEQ ID NO: 143897 - DNA, 25 bp, Rattus norvegicus
aggcagatctttaagttcataggac

SEQ ID NO: 143898 - DNA, 25 bp, Rattus norvegicus
aggcagatcttttagttcataggac

SEQ ID NO: 143899 - DNA, 25 bp, Rattus norvegicus
aggcagatgaacaacgcggcacagc

SEQ ID NO: 143900 - DNA, 25 bp, Rattus norvegicus
aggcagatgaactacgcggcacagc

SEQ ID NO: 143901 - DNA, 25 bp, Rattus norvegicus
aggcagatgcctcaattctaggcca

SEQ ID NO: 143902 - DNA, 25 bp, Rattus norvegicus
aggcagatgcctgaattctaggcca

SEQ ID NO: 143903 - DNA, 25 bp, Rattus norvegicus
aggcagatgggtcgccactccttac

SEQ ID NO: 143904 - DNA, 25 bp, Rattus norvegicus
aggcagatgggtggccactccttac

SEQ ID NO: 143905 - DNA, 25 bp, Rattus norvegicus
aggcagattcctattccaagtaaca

SEQ ID NO: 143906 - DNA, 25 bp, Rattus norvegicus
aggcagattccttttccaagtaaca

SEQ ID NO: 143907 - DNA, 25 bp, Rattus norvegicus
aggcagattgccactgatcgctgtg

SEQ ID NO: 143908 - DNA, 25 bp, Rattus norvegicus
aggcagattgcctctgatcgctgtg

SEQ ID NO: 143909 - DNA, 25 bp, Rattus norvegicus
aggcagatttcacgccccaaacaat

SEQ ID NO: 143910 - DNA, 25 bp, Rattus norvegicus
aggcagatttcaggccccaaacaat

SEQ ID NO: 143911 - DNA, 25 bp, Rattus norvegicus
aggcagattttcattggtcttgctc

SEQ ID NO: 143912 - DNA, 25 bp, Rattus norvegicus
aggcagattttctttggtcttgctc

SEQ ID NO: 143913 - DNA, 25 bp, Rattus norvegicus
aggcagcaaatcagctactctccag

SEQ ID NO: 143914 - DNA, 25 bp, Rattus norvegicus
aggcagcaaatctgctactctccag

SEQ ID NO: 143915 - DNA, 25 bp, Rattus norvegicus
aggcagcaagtgctccagtcattgc

SEQ ID NO: 143916 - DNA, 25 bp, Rattus norvegicus
aggcagcaagtggtccagtcattgc

SEQ ID NO: 143917 - DNA, 25 bp, Rattus norvegicus
aggcagcacatcaggcttgttcttc

SEQ ID NO: 143918 - DNA, 25 bp, Rattus norvegicus
aggcagcacatctggcttgttcttc

SEQ ID NO: 143919 - DNA, 25 bp, Rattus norvegicus
aggcagcacggaagtctcagatcaa

SEQ ID NO: 143920 - DNA, 25 bp, Rattus norvegicus
aggcagcacggatgtctcagatcaa

SEQ ID NO: 143921 - DNA, 25 bp, Rattus norvegicus
aggcagcagcagacggaccgagctc

SEQ ID NO: 143922 - DNA, 25 bp, Rattus norvegicus
aggcagcagcagtcggaccgagctc

SEQ ID NO: 143923 - DNA, 25 bp, Rattus norvegicus
aggcagcaggagaaaacataggcga

SEQ ID NO: 143924 - DNA, 25 bp, Rattus norvegicus
aggcagcaggagtaaacataggcga

SEQ ID NO: 143925 - DNA, 25 bp, Rattus norvegicus
aggcagcaggctagtctgttctcct

SEQ ID NO: 143926 - DNA, 25 bp, Rattus norvegicus
aggcagcaggcttgtctgttctcct

SEQ ID NO: 143927 - DNA, 25 bp, Rattus norvegicus
aggcagcagggaatccaccctgaga

SEQ ID NO: 143928 - DNA, 25 bp, Rattus norvegicus
aggcagcagggattccaccctgaga

SEQ ID NO: 143929 - DNA, 25 bp, Rattus norvegicus
aggcagcagtgacacctctgcagct

SEQ ID NO: 143930 - DNA, 25 bp, Rattus norvegicus
aggcagcagtgagacctctgcagct

SEQ ID NO: 143931 - DNA, 25 bp, Rattus norvegicus
aggcagcatagcacaggatcagaga

SEQ ID NO: 143932 - DNA, 25 bp, Rattus norvegicus
aggcagcatagctcaggatcagaga

SEQ ID NO: 143933 - DNA, 25 bp, Rattus norvegicus
aggcagcatcaaaagcagcttctaa

SEQ ID NO: 143934 - DNA, 25 bp, Rattus norvegicus
aggcagcatcaacggttaccatgtt

SEQ ID NO: 143935 - DNA, 25 bp, Rattus norvegicus
aggcagcatcaagggttaccatgtt

SEQ ID NO: 143936 - DNA, 25 bp, Rattus norvegicus
aggcagcatcaatagcagcttctaa

SEQ ID NO: 143937 - DNA, 25 bp, Rattus norvegicus
aggcagcatctcctctttttatgga

SEQ ID NO: 143938 - DNA, 25 bp, Rattus norvegicus
aggcagcatctcgtctttttatgga

SEQ ID NO: 143939 - DNA, 25 bp, Rattus norvegicus
aggcagcatgctattaacatgtgct

SEQ ID NO: 143940 - DNA, 25 bp, Rattus norvegicus
aggcagcatgcttttaacatgtgct

SEQ ID NO: 143941 - DNA, 25 bp, Rattus norvegicus
aggcagccaatcagactctcagtcc

SEQ ID NO: 143942 - DNA, 25 bp, Rattus norvegicus
aggcagccaatctgactctcagtcc

SEQ ID NO: 143943 - DNA, 25 bp, Rattus norvegicus
aggcagccactgagatgtttgcacc

SEQ ID NO: 143944 - DNA, 25 bp, Rattus norvegicus
aggcagccactgtgatgtttgcacc

SEQ ID NO: 143945 - DNA, 25 bp, Rattus norvegicus
aggcagccagcgctggttcttctcc

SEQ ID NO: 143946 - DNA, 25 bp, Rattus norvegicus
aggcagccagcggtggttcttctcc

SEQ ID NO: 143947 - DNA, 25 bp, Rattus norvegicus
aggcagcccatactcttagaatccc

SEQ ID NO: 143948 - DNA, 25 bp, Rattus norvegicus
aggcagcccatagtcttagaatccc

SEQ ID NO: 143949 - DNA, 25 bp, Rattus norvegicus
aggcagcccattctgcacttcagcg

SEQ ID NO: 143950 - DNA, 25 bp, Rattus norvegicus
aggcagcccattgtgcacttcagcg

SEQ ID NO: 143951 - DNA, 25 bp, Rattus norvegicus
aggcagccccgactgctcggaaatg

SEQ ID NO: 143952 - DNA, 25 bp, Rattus norvegicus
aggcagccccgagtgctcggaaatg

SEQ ID NO: 143953 - DNA, 25 bp, Rattus norvegicus
aggcagccctagagatgcggcggat

SEQ ID NO: 143954 - DNA, 25 bp, Rattus norvegicus
aggcagccctagtgatgcggcggat

SEQ ID NO: 143955 - DNA, 25 bp, Rattus norvegicus
aggcagccctggaatgggatcctct

SEQ ID NO: 143956 - DNA, 25 bp, Rattus norvegicus
aggcagccctggtatgggatcctct

SEQ ID NO: 143957 - DNA, 25 bp, Rattus norvegicus
aggcagcctcttatcatggcgatta

SEQ ID NO: 143958 - DNA, 25 bp, Rattus norvegicus
aggcagcctcttttcatggcgatta

SEQ ID NO: 143959 - DNA, 25 bp, Rattus norvegicus
aggcagccttgcattctaatggcac

SEQ ID NO: 143960 - DNA, 25 bp, Rattus norvegicus
aggcagccttgctttctaatggcac

SEQ ID NO: 143961 - DNA, 25 bp, Rattus norvegicus
aggcagcgagctcgtaccctctggc

SEQ ID NO: 143962 - DNA, 25 bp, Rattus norvegicus
aggcagcgagctggtaccctctggc

SEQ ID NO: 143963 - DNA, 25 bp, Rattus norvegicus
aggcagcgatggatcagatcctgga

SEQ ID NO: 143964 - DNA, 25 bp, Rattus norvegicus
aggcagcgatggttcagatcctgga

SEQ ID NO: 143965 - DNA, 25 bp, Rattus norvegicus
aggcagcgccctcaacaggatgaag

SEQ ID NO: 143966 - DNA, 25 bp, Rattus norvegicus
aggcagcgccctgaacaggatgaag

SEQ ID NO: 143967 - DNA, 25 bp, Rattus norvegicus
aggcagcgcctcagagcttgtctca

SEQ ID NO: 143968 - DNA, 25 bp, Rattus norvegicus
aggcagcgcctctgagcttgtctca

SEQ ID NO: 143969 - DNA, 25 bp, Rattus norvegicus
aggcagcggcctcgatgtatgaaca

SEQ ID NO: 143970 - DNA, 25 bp, Rattus norvegicus
aggcagcggcctggatgtatgaaca

SEQ ID NO: 143971 - DNA, 25 bp, Rattus norvegicus
aggcagcgtgccaaggaccttgaag

SEQ ID NO: 143972 - DNA, 25 bp, Rattus norvegicus
aggcagcgtgcctaggaccttgaag

SEQ ID NO: 143973 - DNA, 25 bp, Rattus norvegicus
aggcagctcaagcaggaaaagccat

SEQ ID NO: 143974 - DNA, 25 bp, Rattus norvegicus
aggcagctcaaggaggaaaagccat

SEQ ID NO: 143975 - DNA, 25 bp, Rattus norvegicus
aggcagctcagtacctctgaacatg

SEQ ID NO: 143976 - DNA, 25 bp, Rattus norvegicus
aggcagctcagttcctctgaacatg

SEQ ID NO: 143977 - DNA, 25 bp, Rattus norvegicus
aggcagctcctcaagtctagtgaga

SEQ ID NO: 143978 - DNA, 25 bp, Rattus norvegicus
aggcagctcctctagtctagtgaga

SEQ ID NO: 143979 - DNA, 25 bp, Rattus norvegicus
aggcagctcctgcaaaaattgggaa

SEQ ID NO: 143980 - DNA, 25 bp, Rattus norvegicus
aggcagctcctggaaaaattgggaa

SEQ ID NO: 143981 - DNA, 25 bp, Rattus norvegicus
aggcagctctcgctttttatgactc

SEQ ID NO: 143982 - DNA, 25 bp, Rattus norvegicus
aggcagctctcggtttttatgactc

SEQ ID NO: 143983 - DNA, 25 bp, Rattus norvegicus
aggcagctctctagttgcagagcca

SEQ ID NO: 143984 - DNA, 25 bp, Rattus norvegicus
aggcagctctctcagatctctgagg

SEQ ID NO: 143985 - DNA, 25 bp, Rattus norvegicus
aggcagctctctgagatctctgagg

SEQ ID NO: 143986 - DNA, 25 bp, Rattus norvegicus
aggcagctctcttgttgcagagcca

SEQ ID NO: 143987 - DNA, 25 bp, Rattus norvegicus
aggcagctcttcataccaaggcaaa

SEQ ID NO: 143988 - DNA, 25 bp, Rattus norvegicus
aggcagctcttcttaccaaggcaaa

SEQ ID NO: 143989 - DNA, 25 bp, Rattus norvegicus
aggcagctgaagaggcttccttgga

SEQ ID NO: 143990 - DNA, 25 bp, Rattus norvegicus
aggcagctgaagtggcttccttgga

SEQ ID NO: 143991 - DNA, 25 bp, Rattus norvegicus
aggcagctgacgacacggagatctc

SEQ ID NO: 143992 - DNA, 25 bp, Rattus norvegicus
aggcagctgacgtcacggagatctc

SEQ ID NO: 143993 - DNA, 25 bp, Rattus norvegicus
aggcagctgactacattcttgttta

SEQ ID NO: 143994 - DNA, 25 bp, Rattus norvegicus
aggcagctgacttcattcttgttta

SEQ ID NO: 143995 - DNA, 25 bp, Rattus norvegicus
aggcagctgatcacggtctcccgat

SEQ ID NO: 143996 - DNA, 25 bp, Rattus norvegicus
aggcagctgatctcggtctcccgat

SEQ ID NO: 143997 - DNA, 25 bp, Rattus norvegicus
aggcagctgctgacacttggtaacc

SEQ ID NO: 143998 - DNA, 25 bp, Rattus norvegicus
aggcagctgctgattatagcgatca

SEQ ID NO: 143999 - DNA, 25 bp, Rattus norvegicus
aggcagctgctgtcacttggtaacc

SEQ ID NO: 144000 - DNA, 25 bp, Rattus norvegicus
aggcagctgctgtttatagcgatca

SEQ ID NO: 144001 - DNA, 25 bp, Rattus norvegicus
aggcagctggatatctgactttgag

SEQ ID NO: 144002 - DNA, 25 bp, Rattus norvegicus
aggcagctggatttctgactttgag

SEQ ID NO: 144003 - DNA, 25 bp, Rattus norvegicus
aggcagctgtgcaaggtgtcctcca

SEQ ID NO: 144004 - DNA, 25 bp, Rattus norvegicus
aggcagctgtgctaggtgtcctcca

SEQ ID NO: 144005 - DNA, 25 bp, Rattus norvegicus
aggcagcttcctatacgcagtgtgt

SEQ ID NO: 144006 - DNA, 25 bp, Rattus norvegicus
aggcagcttcctttacgcagtgtgt

SEQ ID NO: 144007 - DNA, 25 bp, Rattus norvegicus
aggcagcttcttcacagcccgttta

SEQ ID NO: 144008 - DNA, 25 bp, Rattus norvegicus
aggcagcttcttcgtccacgggttc

SEQ ID NO: 144009 - DNA, 25 bp, Rattus norvegicus
aggcagcttcttgacagcccgttta

SEQ ID NO: 144010 - DNA, 25 bp, Rattus norvegicus
aggcagcttcttggtccacgggttc

SEQ ID NO: 144011 - DNA, 25 bp, Rattus norvegicus
aggcagcttggcaaacattcccttc

SEQ ID NO: 144012 - DNA, 25 bp, Rattus norvegicus
aggcagcttggctaacattcccttc

SEQ ID NO: 144013 - DNA, 25 bp, Rattus norvegicus
aggcagctttctagaagtttctctt

SEQ ID NO: 144014 - DNA, 25 bp, Rattus norvegicus
aggcagctttcttgaagtttctctt

SEQ ID NO: 144015 - DNA, 25 bp, Rattus norvegicus
aggcaggaaatgcatgtccctccgc

SEQ ID NO: 144016 - DNA, 25 bp, Rattus norvegicus
aggcaggaaatggatgtccctccgc

SEQ ID NO: 144017 - DNA, 25 bp, Rattus norvegicus
aggcaggaaggacctcttccccaaa

SEQ ID NO: 144018 - DNA, 25 bp, Rattus norvegicus
aggcaggaaggacgctttctcacac

SEQ ID NO: 144019 - DNA, 25 bp, Rattus norvegicus
aggcaggaaggagctcttccccaaa

SEQ ID NO: 144020 - DNA, 25 bp, Rattus norvegicus
aggcaggaaggaggctttctcacac

SEQ ID NO: 144021 - DNA, 25 bp, Rattus norvegicus
aggcaggaattcacccaagtcactt

SEQ ID NO: 144022 - DNA, 25 bp, Rattus norvegicus
aggcaggaattctcccaagtcactt

SEQ ID NO: 144023 - DNA, 25 bp, Rattus norvegicus
aggcaggacactaggatgtttgttc

SEQ ID NO: 144024 - DNA, 25 bp, Rattus norvegicus
aggcaggacacttggatgtttgttc

SEQ ID NO: 144025 - DNA, 25 bp, Rattus norvegicus
aggcaggactgtagacatctccaca

SEQ ID NO: 144026 - DNA, 25 bp, Rattus norvegicus
aggcaggactgttgacatctccaca

SEQ ID NO: 144027 - DNA, 25 bp, Rattus norvegicus
aggcaggagatgcagcccagcccct

SEQ ID NO: 144028 - DNA, 25 bp, Rattus norvegicus
aggcaggagatggagcccagcccct

SEQ ID NO: 144029 - DNA, 25 bp, Rattus norvegicus
aggcaggagccaaacgcttggcaat

SEQ ID NO: 144030 - DNA, 25 bp, Rattus norvegicus
aggcaggagccatacgcttggcaat

SEQ ID NO: 144031 - DNA, 25 bp, Rattus norvegicus
aggcaggagctcacggtgcagaccc

SEQ ID NO: 144032 - DNA, 25 bp, Rattus norvegicus
aggcaggagctcaggcccttatggt

SEQ ID NO: 144033 - DNA, 25 bp, Rattus norvegicus
aggcaggagctctcggtgcagaccc

SEQ ID NO: 144034 - DNA, 25 bp, Rattus norvegicus
aggcaggagctctggcccttatggt

SEQ ID NO: 144035 - DNA, 25 bp, Rattus norvegicus
aggcaggagctgcacttcatgtttc

SEQ ID NO: 144036 - DNA, 25 bp, Rattus norvegicus
aggcaggagctggacttcatgtttc

SEQ ID NO: 144037 - DNA, 25 bp, Rattus norvegicus
aggcaggaggccaacttgctttgta

SEQ ID NO: 144038 - DNA, 25 bp, Rattus norvegicus
aggcaggaggcctacttgctttgta

SEQ ID NO: 144039 - DNA, 25 bp, Rattus norvegicus
aggcaggaggtacggcccactctct

SEQ ID NO: 144040 - DNA, 25 bp, Rattus norvegicus
aggcaggaggtagggcccactctct

SEQ ID NO: 144041 - DNA, 25 bp, Rattus norvegicus
aggcaggatctgattaatctgagtt

SEQ ID NO: 144042 - DNA, 25 bp, Rattus norvegicus
aggcaggatctgtttaatctgagtt

SEQ ID NO: 144043 - DNA, 25 bp, Rattus norvegicus
aggcaggatggtatccggatcacct

SEQ ID NO: 144044 - DNA, 25 bp, Rattus norvegicus
aggcaggatggtttccggatcacct

SEQ ID NO: 144045 - DNA, 25 bp, Rattus norvegicus
aggcaggatttcacagggtagctct

SEQ ID NO: 144046 - DNA, 25 bp, Rattus norvegicus
aggcaggatttcacttaggttcagg

SEQ ID NO: 144047 - DNA, 25 bp, Rattus norvegicus
aggcaggatttctcagggtagctct

SEQ ID NO: 144048 - DNA, 25 bp, Rattus norvegicus
aggcaggatttctcttaggttcagg

SEQ ID NO: 144049 - DNA, 25 bp, Rattus norvegicus
aggcaggcaaatccctgagtcccag

SEQ ID NO: 144050 - DNA, 25 bp, Rattus norvegicus
aggcaggcaaatgcctgagtcccag

SEQ ID NO: 144051 - DNA, 25 bp, Rattus norvegicus
aggcaggcactcaaattgggcccca

SEQ ID NO: 144052 - DNA, 25 bp, Rattus norvegicus
aggcaggcactctaattgggcccca

SEQ ID NO: 144053 - DNA, 25 bp, Rattus norvegicus
aggcaggcagccagtcaaagagtaa

SEQ ID NO: 144054 - DNA, 25 bp, Rattus norvegicus
aggcaggcagcctgtcaaagagtaa

SEQ ID NO: 144055 - DNA, 25 bp, Rattus norvegicus
aggcaggcagctctacccaagctgg

SEQ ID NO: 144056 - DNA, 25 bp, Rattus norvegicus
aggcaggcagctgtacccaagctgg

SEQ ID NO: 144057 - DNA, 25 bp, Rattus norvegicus
aggcaggcagtaccagttgtcttaa

SEQ ID NO: 144058 - DNA, 25 bp, Rattus norvegicus
aggcaggcagtagcagttgtcttaa

SEQ ID NO: 144059 - DNA, 25 bp, Rattus norvegicus
aggcaggcatccagcctagtgagaa

SEQ ID NO: 144060 - DNA, 25 bp, Rattus norvegicus
aggcaggcatcctgcctagtgagaa

SEQ ID NO: 144061 - DNA, 25 bp, Rattus norvegicus
aggcaggcatgcatgtaggtaaaaa

SEQ ID NO: 144062 - DNA, 25 bp, Rattus norvegicus
aggcaggcatgcttgtaggtaaaaa

SEQ ID NO: 144063 - DNA, 25 bp, Rattus norvegicus
aggcaggccagcaggtctctgtgca

SEQ ID NO: 144064 - DNA, 25 bp, Rattus norvegicus
aggcaggccagctggtctctgtgca

SEQ ID NO: 144065 - DNA, 25 bp, Rattus norvegicus
aggcaggccctaactgttgttttct

SEQ ID NO: 144066 - DNA, 25 bp, Rattus norvegicus
aggcaggccctatctgttgttttct

SEQ ID NO: 144067 - DNA, 25 bp, Rattus norvegicus
aggcaggcgctgcatcgtcacgtca

SEQ ID NO: 144068 - DNA, 25 bp, Rattus norvegicus
aggcaggcgctggatcgtcacgtca

SEQ ID NO: 144069 - DNA, 25 bp, Rattus norvegicus
aggcaggctccaaaccagtaagaga

SEQ ID NO: 144070 - DNA, 25 bp, Rattus norvegicus
aggcaggctccataccagtaagaga

SEQ ID NO: 144071 - DNA, 25 bp, Rattus norvegicus
aggcaggctgagcatcctagagaca

SEQ ID NO: 144072 - DNA, 25 bp, Rattus norvegicus
aggcaggctgaggatcctagagaca

SEQ ID NO: 144073 - DNA, 25 bp, Rattus norvegicus
aggcaggcttctatttccctccagg

SEQ ID NO: 144074 - DNA, 25 bp, Rattus norvegicus
aggcaggcttctttttccctccagg

SEQ ID NO: 144075 - DNA, 25 bp, Rattus norvegicus
aggcagggaacgcagtccagatcct

SEQ ID NO: 144076 - DNA, 25 bp, Rattus norvegicus
aggcagggaacggagtccagatcct

SEQ ID NO: 144077 - DNA, 25 bp, Rattus norvegicus
aggcagggaccaagagccattttcc

SEQ ID NO: 144078 - DNA, 25 bp, Rattus norvegicus
aggcagggaccatgagccattttcc

SEQ ID NO: 144079 - DNA, 25 bp, Rattus norvegicus
aggcagggatctcatttctgtccat

SEQ ID NO: 144080 - DNA, 25 bp, Rattus norvegicus
aggcagggatctgatttctgtccat

SEQ ID NO: 144081 - DNA, 25 bp, Rattus norvegicus
aggcagggcaatcggtttactctta

SEQ ID NO: 144082 - DNA, 25 bp, Rattus norvegicus
aggcagggcaatgggtttactctta

SEQ ID NO: 144083 - DNA, 25 bp, Rattus norvegicus
aggcagggcagacatctctgtgtta

SEQ ID NO: 144084 - DNA, 25 bp, Rattus norvegicus
aggcagggcagagatctctgtgtta

SEQ ID NO: 144085 - DNA, 25 bp, Rattus norvegicus
aggcagggcatcaccctgagtctta

SEQ ID NO: 144086 - DNA, 25 bp, Rattus norvegicus
aggcagggcatctccctgagtctta

SEQ ID NO: 144087 - DNA, 25 bp, Rattus norvegicus
aggcagggccttagttctggcagca

SEQ ID NO: 144088 - DNA, 25 bp, Rattus norvegicus
aggcagggcctttgttctggcagca

SEQ ID NO: 144089 - DNA, 25 bp, Rattus norvegicus
aggcagggctttcagagctctcata

SEQ ID NO: 144090 - DNA, 25 bp, Rattus norvegicus
aggcagggctttgagagctctcata

SEQ ID NO: 144091 - DNA, 25 bp, Rattus norvegicus
aggcagggtcttatcttcctaggtc

SEQ ID NO: 144092 - DNA, 25 bp, Rattus norvegicus
aggcagggtcttttcttcctaggtc

SEQ ID NO: 144093 - DNA, 25 bp, Rattus norvegicus
aggcaggtacttcctggtggccact

SEQ ID NO: 144094 - DNA, 25 bp, Rattus norvegicus
aggcaggtacttgctggtggccact

SEQ ID NO: 144095 - DNA, 25 bp, Rattus norvegicus
aggcaggtagacaccttagtagaga

SEQ ID NO: 144096 - DNA, 25 bp, Rattus norvegicus
aggcaggtagactccttagtagaga

SEQ ID NO: 144097 - DNA, 25 bp, Rattus norvegicus
aggcaggtcactattactggctccg

SEQ ID NO: 144098 - DNA, 25 bp, Rattus norvegicus
aggcaggtcacttttactggctccg

SEQ ID NO: 144099 - DNA, 25 bp, Rattus norvegicus
aggcaggtcagccactccgttgtga

SEQ ID NO: 144100 - DNA, 25 bp, Rattus norvegicus
aggcaggtcagcgactccgttgtga

SEQ ID NO: 144101 - DNA, 25 bp, Rattus norvegicus
aggcaggtcaggactggccctgtca

SEQ ID NO: 144102 - DNA, 25 bp, Rattus norvegicus
aggcaggtcaggtctggccctgtca

SEQ ID NO: 144103 - DNA, 25 bp, Rattus norvegicus
aggcaggtccatcctaagcttccaa

SEQ ID NO: 144104 - DNA, 25 bp, Rattus norvegicus
aggcaggtccatgctaagcttccaa

SEQ ID NO: 144105 - DNA, 25 bp, Rattus norvegicus
aggcaggtctttactcaccgtgaga

SEQ ID NO: 144106 - DNA, 25 bp, Rattus norvegicus
aggcaggtcttttctcaccgtgaga

SEQ ID NO: 144107 - DNA, 25 bp, Rattus norvegicus
aggcaggtgacacgtccccagagaa

SEQ ID NO: 144108 - DNA, 25 bp, Rattus norvegicus
aggcaggtgacaggtccccagagaa

SEQ ID NO: 144109 - DNA, 25 bp, Rattus norvegicus
aggcaggtgattccagtcttgtctc

SEQ ID NO: 144110 - DNA, 25 bp, Rattus norvegicus
aggcaggtgattgcagtcttgtctc

SEQ ID NO: 144111 - DNA, 25 bp, Rattus norvegicus
aggcaggtggccagataggctttat

SEQ ID NO: 144112 - DNA, 25 bp, Rattus norvegicus
aggcaggtggccatactgtcatctg

SEQ ID NO: 144113 - DNA, 25 bp, Rattus norvegicus
aggcaggtggcctgataggctttat

SEQ ID NO: 144114 - DNA, 25 bp, Rattus norvegicus
aggcaggtggccttactgtcatctg

SEQ ID NO: 144115 - DNA, 25 bp, Rattus norvegicus
aggcaggttctgcttggtctctatc

SEQ ID NO: 144116 - DNA, 25 bp, Rattus norvegicus
aggcaggttctggttggtctctatc

SEQ ID NO: 144117 - DNA, 25 bp, Rattus norvegicus
aggcaggttgctataatgtcactct

SEQ ID NO: 144118 - DNA, 25 bp, Rattus norvegicus
aggcaggttgctttaatgtcactct

SEQ ID NO: 144119 - DNA, 25 bp, Rattus norvegicus
aggcagtaagctccagtccaagtta

SEQ ID NO: 144120 - DNA, 25 bp, Rattus norvegicus
aggcagtaagctgcagtccaagtta

SEQ ID NO: 144121 - DNA, 25 bp, Rattus norvegicus
aggcagtacattccatcaccctcat

SEQ ID NO: 144122 - DNA, 25 bp, Rattus norvegicus
aggcagtacattgcatcaccctcat

SEQ ID NO: 144123 - DNA, 25 bp, Rattus norvegicus
aggcagtacctgctgaaccagggtt

SEQ ID NO: 144124 - DNA, 25 bp, Rattus norvegicus
aggcagtacctggtgaaccagggtt

SEQ ID NO: 144125 - DNA, 25 bp, Rattus norvegicus
aggcagtactgtcctttgaaatgta

SEQ ID NO: 144126 - DNA, 25 bp, Rattus norvegicus
aggcagtactgtgctttgaaatgta

SEQ ID NO: 144127 - DNA, 25 bp, Rattus norvegicus
aggcagtagctgcaagcccctggca

SEQ ID NO: 144128 - DNA, 25 bp, Rattus norvegicus
aggcagtagctggaagcccctggca

SEQ ID NO: 144129 - DNA, 25 bp, Rattus norvegicus
aggcagtaggtgattaggacccaga

SEQ ID NO: 144130 - DNA, 25 bp, Rattus norvegicus
aggcagtaggtgtttaggacccaga

SEQ ID NO: 144131 - DNA, 25 bp, Rattus norvegicus
aggcagtcactcatccgagttcgta

SEQ ID NO: 144132 - DNA, 25 bp, Rattus norvegicus
aggcagtcactcttccgagttcgta

SEQ ID NO: 144133 - DNA, 25 bp, Rattus norvegicus
aggcagtcccacacttagtgtgtca

SEQ ID NO: 144134 - DNA, 25 bp, Rattus norvegicus
aggcagtcccacatcagatttgaga

SEQ ID NO: 144135 - DNA, 25 bp, Rattus norvegicus
aggcagtcccactcttagtgtgtca

SEQ ID NO: 144136 - DNA, 25 bp, Rattus norvegicus
aggcagtcccacttcagatttgaga

SEQ ID NO: 144137 - DNA, 25 bp, Rattus norvegicus
aggcagtcccggcacgagcgatgcg

SEQ ID NO: 144138 - DNA, 25 bp, Rattus norvegicus
aggcagtcccgggacgagcgatgcg

SEQ ID NO: 144139 - DNA, 25 bp, Rattus norvegicus
aggcagtcctgtcgttcaacctaca

SEQ ID NO: 144140 - DNA, 25 bp, Rattus norvegicus
aggcagtcctgtggttcaacctaca

SEQ ID NO: 144141 - DNA, 25 bp, Rattus norvegicus
aggcagtcgggtagccccagtttga

SEQ ID NO: 144142 - DNA, 25 bp, Rattus norvegicus
aggcagtcgggttgccccagtttga

SEQ ID NO: 144143 - DNA, 25 bp, Rattus norvegicus
aggcagtctgtgcagccctcagaaa

SEQ ID NO: 144144 - DNA, 25 bp, Rattus norvegicus
aggcagtctgtggagccctcagaaa

SEQ ID NO: 144145 - DNA, 25 bp, Rattus norvegicus
aggcagtcttatcaagccatctctc

SEQ ID NO: 144146 - DNA, 25 bp, Rattus norvegicus
aggcagtcttatgaagccatctctc

SEQ ID NO: 144147 - DNA, 25 bp, Rattus norvegicus
aggcagtgacacaggcttctgcaga

SEQ ID NO: 144148 - DNA, 25 bp, Rattus norvegicus
aggcagtgacactggcttctgcaga

SEQ ID NO: 144149 - DNA, 25 bp, Rattus norvegicus
aggcagtgacctccaatggcagtat

SEQ ID NO: 144150 - DNA, 25 bp, Rattus norvegicus
aggcagtgacctgcaatggcagtat

SEQ ID NO: 144151 - DNA, 25 bp, Rattus norvegicus
aggcagtgccatctgctcagtggta

SEQ ID NO: 144152 - DNA, 25 bp, Rattus norvegicus
aggcagtgccatgtgctcagtggta

SEQ ID NO: 144153 - DNA, 25 bp, Rattus norvegicus
aggcagtgcctgagctggatcacga

SEQ ID NO: 144154 - DNA, 25 bp, Rattus norvegicus
aggcagtgcctgtgctggatcacga

SEQ ID NO: 144155 - DNA, 25 bp, Rattus norvegicus
aggcagtggaatactccttccggtt

SEQ ID NO: 144156 - DNA, 25 bp, Rattus norvegicus
aggcagtggaattctccttccggtt

SEQ ID NO: 144157 - DNA, 25 bp, Rattus norvegicus
aggcagtggcagagatctcgagttc

SEQ ID NO: 144158 - DNA, 25 bp, Rattus norvegicus
aggcagtggcagtgatctcgagttc

SEQ ID NO: 144159 - DNA, 25 bp, Rattus norvegicus
aggcagtggctgatcaggctctctc

SEQ ID NO: 144160 - DNA, 25 bp, Rattus norvegicus
aggcagtggctgttcaggctctctc

SEQ ID NO: 144161 - DNA, 25 bp, Rattus norvegicus
aggcagtgggcaacatcctcgctca

SEQ ID NO: 144162 - DNA, 25 bp, Rattus norvegicus
aggcagtgggcatcatcctcgctca

SEQ ID NO: 144163 - DNA, 25 bp, Rattus norvegicus
aggcagtggtgtctacctgtagtcc

SEQ ID NO: 144164 - DNA, 25 bp, Rattus norvegicus
aggcagtggtgtgtacctgtagtcc

SEQ ID NO: 144165 - DNA, 25 bp, Rattus norvegicus
aggcagtgtgacctcagtgcatact

SEQ ID NO: 144166 - DNA, 25 bp, Rattus norvegicus
aggcagtgtgacgtcagtgcatact

SEQ ID NO: 144167 - DNA, 25 bp, Rattus norvegicus
aggcagtgtggaattcagctggaaa

SEQ ID NO: 144168 - DNA, 25 bp, Rattus norvegicus
aggcagtgtggatttcagctggaaa

SEQ ID NO: 144169 - DNA, 25 bp, Rattus norvegicus
aggcagtgttccagggctctggtta

SEQ ID NO: 144170 - DNA, 25 bp, Rattus norvegicus
aggcagtgttcctgggctctggtta

SEQ ID NO: 144171 - DNA, 25 bp, Rattus norvegicus
aggcagtgttggaccctgttaggat

SEQ ID NO: 144172 - DNA, 25 bp, Rattus norvegicus
aggcagtgttggtccctgttaggat

SEQ ID NO: 144173 - DNA, 25 bp, Rattus norvegicus
aggcagttactacagcagggtcgca

SEQ ID NO: 144174 - DNA, 25 bp, Rattus norvegicus
aggcagttactacggcccagctaat

SEQ ID NO: 144175 - DNA, 25 bp, Rattus norvegicus
aggcagttactagagcagggtcgca

SEQ ID NO: 144176 - DNA, 25 bp, Rattus norvegicus
aggcagttactagggcccagctaat

SEQ ID NO: 144177 - DNA, 25 bp, Rattus norvegicus
aggcagttactccaggtgcttcact

SEQ ID NO: 144178 - DNA, 25 bp, Rattus norvegicus
aggcagttactcgaggtgcttcact

SEQ ID NO: 144179 - DNA, 25 bp, Rattus norvegicus
aggcagttcaggatagtctcggtat

SEQ ID NO: 144180 - DNA, 25 bp, Rattus norvegicus
aggcagttcaggttagtctcggtat

SEQ ID NO: 144181 - DNA, 25 bp, Rattus norvegicus
aggcagttccacacggttgtcaaaa

SEQ ID NO: 144182 - DNA, 25 bp, Rattus norvegicus
aggcagttccactcggttgtcaaaa

SEQ ID NO: 144183 - DNA, 25 bp, Rattus norvegicus
aggcagttctctcactgaggcgatc

SEQ ID NO: 144184 - DNA, 25 bp, Rattus norvegicus
aggcagttctctgactgaggcgatc

SEQ ID NO: 144185 - DNA, 25 bp, Rattus norvegicus
aggcagttctggctaaccgcagcag

SEQ ID NO: 144186 - DNA, 25 bp, Rattus norvegicus
aggcagttctgggtaaccgcagcag

SEQ ID NO: 144187 - DNA, 25 bp, Rattus norvegicus
aggcagttctgtatcctcattctca

SEQ ID NO: 144188 - DNA, 25 bp, Rattus norvegicus
aggcagttctgtttcctcattctca

SEQ ID NO: 144189 - DNA, 25 bp, Rattus norvegicus
aggcagttcttgaggccagcagctg

SEQ ID NO: 144190 - DNA, 25 bp, Rattus norvegicus
aggcagttcttgtggccagcagctg

SEQ ID NO: 144191 - DNA, 25 bp, Rattus norvegicus
aggcagttgattagaggcccctgac

SEQ ID NO: 144192 - DNA, 25 bp, Rattus norvegicus
aggcagttgatttgaggcccctgac

SEQ ID NO: 144193 - DNA, 25 bp, Rattus norvegicus
aggcagttgctgatcaccatgtgct

SEQ ID NO: 144194 - DNA, 25 bp, Rattus norvegicus
aggcagttgctgttcaccatgtgct

SEQ ID NO: 144195 - DNA, 25 bp, Rattus norvegicus
aggcagttgcttacagtccatttta

SEQ ID NO: 144196 - DNA, 25 bp, Rattus norvegicus
aggcagttgcttaccatgagacaga

SEQ ID NO: 144197 - DNA, 25 bp, Rattus norvegicus
aggcagttgctttcagtccatttta

SEQ ID NO: 144198 - DNA, 25 bp, Rattus norvegicus
aggcagttgctttccatgagacaga

SEQ ID NO: 144199 - DNA, 25 bp, Rattus norvegicus
aggcagttggcacgtcccttttcaa

SEQ ID NO: 144200 - DNA, 25 bp, Rattus norvegicus
aggcagttggcaggtcccttttcaa

SEQ ID NO: 144201 - DNA, 25 bp, Rattus norvegicus
aggcagtttataccttctgatcagt

SEQ ID NO: 144202 - DNA, 25 bp, Rattus norvegicus
aggcagtttatagcttctgatcagt

SEQ ID NO: 144203 - DNA, 25 bp, Rattus norvegicus
aggcagtttccaccagggctctttg

SEQ ID NO: 144204 - DNA, 25 bp, Rattus norvegicus
aggcagtttccagcagggctctttg

SEQ ID NO: 144205 - DNA, 25 bp, Rattus norvegicus
aggcagtttcgaaccaatgtagatg

SEQ ID NO: 144206 - DNA, 25 bp, Rattus norvegicus
aggcagtttcgatccaatgtagatg

SEQ ID NO: 144207 - DNA, 25 bp, Rattus norvegicus
aggcagtttctccttagtggtggcc

SEQ ID NO: 144208 - DNA, 25 bp, Rattus norvegicus
aggcagtttctcgttagtggtggcc

SEQ ID NO: 144209 - DNA, 25 bp, Rattus norvegicus
aggcagtttgcccaggtcagtgaac

SEQ ID NO: 144210 - DNA, 25 bp, Rattus norvegicus
aggcagtttgccgaggtcagtgaac

SEQ ID NO: 144211 - DNA, 25 bp, Rattus norvegicus
aggcataaaaagctcggtctgggct

SEQ ID NO: 144212 - DNA, 25 bp, Rattus norvegicus
aggcataaaaaggtcggtctgggct

SEQ ID NO: 144213 - DNA, 25 bp, Rattus norvegicus
aggcataaacatccctgcaatcatg

SEQ ID NO: 144214 - DNA, 25 bp, Rattus norvegicus
aggcataaacatgcctgcaatcatg

SEQ ID NO: 144215 - DNA, 25 bp, Rattus norvegicus
aggcataaatgccacactttgctct

SEQ ID NO: 144216 - DNA, 25 bp, Rattus norvegicus
aggcataaatgcgacactttgctct

SEQ ID NO: 144217 - DNA, 25 bp, Rattus norvegicus
aggcataacaatcatgtccacccaa

SEQ ID NO: 144218 - DNA, 25 bp, Rattus norvegicus
aggcataacaatgatgtccacccaa

SEQ ID NO: 144219 - DNA, 25 bp, Rattus norvegicus
aggcataacttcagctcaagcacgc

SEQ ID NO: 144220 - DNA, 25 bp, Rattus norvegicus
aggcataacttctgctcaagcacgc

SEQ ID NO: 144221 - DNA, 25 bp, Rattus norvegicus
aggcataaggctctgctccaggatt

SEQ ID NO: 144222 - DNA, 25 bp, Rattus norvegicus
aggcataaggctgtgctccaggatt

SEQ ID NO: 144223 - DNA, 25 bp, Rattus norvegicus
aggcataatttccatggcaccatta

SEQ ID NO: 144224 - DNA, 25 bp, Rattus norvegicus
aggcataatttcgatggcaccatta

SEQ ID NO: 144225 - DNA, 25 bp, Rattus norvegicus
aggcatacaccacctttaagggcaa

SEQ ID NO: 144226 - DNA, 25 bp, Rattus norvegicus
aggcatacaccagctttaagggcaa

SEQ ID NO: 144227 - DNA, 25 bp, Rattus norvegicus
aggcataccctgagtctggagaggt

SEQ ID NO: 144228 - DNA, 25 bp, Rattus norvegicus
aggcataccctgtgtctggagaggt

SEQ ID NO: 144229 - DNA, 25 bp, Rattus norvegicus
aggcataccggcacatacttggcat

SEQ ID NO: 144230 - DNA, 25 bp, Rattus norvegicus
aggcataccggctcatacttggcat

SEQ ID NO: 144231 - DNA, 25 bp, Rattus norvegicus
aggcatacgatacctaccacacctt

SEQ ID NO: 144232 - DNA, 25 bp, Rattus norvegicus
aggcatacgatagctaccacacctt

SEQ ID NO: 144233 - DNA, 25 bp, Rattus norvegicus
aggcatacgtcactatatccagctg

SEQ ID NO: 144234 - DNA, 25 bp, Rattus norvegicus
aggcatacgtcagtatatccagctg

SEQ ID NO: 144235 - DNA, 25 bp, Rattus norvegicus
aggcatactgcgactaaacttcacc

SEQ ID NO: 144236 - DNA, 25 bp, Rattus norvegicus
aggcatactgcgtctaaacttcacc

SEQ ID NO: 144237 - DNA, 25 bp, Rattus norvegicus
aggcatagcacaataatgagacagc

SEQ ID NO: 144238 - DNA, 25 bp, Rattus norvegicus
aggcatagcacattaatgagacagc

SEQ ID NO: 144239 - DNA, 25 bp, Rattus norvegicus
aggcataggcgcagactttcatcct

SEQ ID NO: 144240 - DNA, 25 bp, Rattus norvegicus
aggcataggcgctgactttcatcct

SEQ ID NO: 144241 - DNA, 25 bp, Rattus norvegicus
aggcatataccaccattgccagcag

SEQ ID NO: 144242 - DNA, 25 bp, Rattus norvegicus
aggcatataccagcattgccagcag

SEQ ID NO: 144243 - DNA, 25 bp, Rattus norvegicus
aggcatatgcaaccacctgtatttt

SEQ ID NO: 144244 - DNA, 25 bp, Rattus norvegicus
aggcatatgcaagcacctgtatttt

SEQ ID NO: 144245 - DNA, 25 bp, Rattus norvegicus
aggcatatgcatatcctgctaccgc

SEQ ID NO: 144246 - DNA, 25 bp, Rattus norvegicus
aggcatatgcatttcctgctaccgc

SEQ ID NO: 144247 - DNA, 25 bp, Rattus norvegicus
aggcatatgtggacctcattcgtgc

SEQ ID NO: 144248 - DNA, 25 bp, Rattus norvegicus
aggcatatgtggtcctcattcgtgc

SEQ ID NO: 144249 - DNA, 25 bp, Rattus norvegicus
aggcatattgcgctgtcatttttcc

SEQ ID NO: 144250 - DNA, 25 bp, Rattus norvegicus
aggcatattgcggtgtcatttttcc

SEQ ID NO: 144251 - DNA, 25 bp, Rattus norvegicus
aggcatatttacagctaccccagta

SEQ ID NO: 144252 - DNA, 25 bp, Rattus norvegicus
aggcatatttactgctaccccagta

SEQ ID NO: 144253 - DNA, 25 bp, Rattus norvegicus
aggcatatttttcttccgacttgac

SEQ ID NO: 144254 - DNA, 25 bp, Rattus norvegicus
aggcatatttttgttccgacttgac

SEQ ID NO: 144255 - DNA, 25 bp, Rattus norvegicus
aggcatcaaaaacccacaaacagag

SEQ ID NO: 144256 - DNA, 25 bp, Rattus norvegicus
aggcatcaaaaagccacaaacagag

SEQ ID NO: 144257 - DNA, 25 bp, Rattus norvegicus
aggcatcaacctcgagtccgtgcgc

SEQ ID NO: 144258 - DNA, 25 bp, Rattus norvegicus
aggcatcaacctggagtccgtgcgc

SEQ ID NO: 144259 - DNA, 25 bp, Rattus norvegicus
aggcatcaagctctactccattcag

SEQ ID NO: 144260 - DNA, 25 bp, Rattus norvegicus
aggcatcaagctgtactccattcag

SEQ ID NO: 144261 - DNA, 25 bp, Rattus norvegicus
aggcatcaccataggaggcacggac

SEQ ID NO: 144262 - DNA, 25 bp, Rattus norvegicus
aggcatcaccattggaggcacggac

SEQ ID NO: 144263 - DNA, 25 bp, Rattus norvegicus
aggcatcacctactaacacagacgt

SEQ ID NO: 144264 - DNA, 25 bp, Rattus norvegicus
aggcatcacctagtaacacagacgt

SEQ ID NO: 144265 - DNA, 25 bp, Rattus norvegicus
aggcatcactggagcccacacaaaa

SEQ ID NO: 144266 - DNA, 25 bp, Rattus norvegicus
aggcatcactggtgcccacacaaaa

SEQ ID NO: 144267 - DNA, 25 bp, Rattus norvegicus
aggcatcagagtcccagtctgcgac

SEQ ID NO: 144268 - DNA, 25 bp, Rattus norvegicus
aggcatcagagtgccagtctgcgac

SEQ ID NO: 144269 - DNA, 25 bp, Rattus norvegicus
aggcatcatcttctgctgctccaaa

SEQ ID NO: 144270 - DNA, 25 bp, Rattus norvegicus
aggcatcatcttgtgctgctccaaa

SEQ ID NO: 144271 - DNA, 25 bp, Rattus norvegicus
aggcatcatgccaagtacctgaatg

SEQ ID NO: 144272 - DNA, 25 bp, Rattus norvegicus
aggcatcatgcctagtacctgaatg

SEQ ID NO: 144273 - DNA, 25 bp, Rattus norvegicus
aggcatccatcaacctcaatgctat

SEQ ID NO: 144274 - DNA, 25 bp, Rattus norvegicus
aggcatccatcatcctcaatgctat

SEQ ID NO: 144275 - DNA, 25 bp, Rattus norvegicus
aggcatcccagcctggcacaaagag

SEQ ID NO: 144276 - DNA, 25 bp, Rattus norvegicus
aggcatcccagcgtggcacaaagag

SEQ ID NO: 144277 - DNA, 25 bp, Rattus norvegicus
aggcatccgttcacacagggtgtaa

SEQ ID NO: 144278 - DNA, 25 bp, Rattus norvegicus
aggcatccgttctcacagggtgtaa

SEQ ID NO: 144279 - DNA, 25 bp, Rattus norvegicus
aggcatcctgctcacttccaactgg

SEQ ID NO: 144280 - DNA, 25 bp, Rattus norvegicus
aggcatcctgctgacttccaactgg

SEQ ID NO: 144281 - DNA, 25 bp, Rattus norvegicus
aggcatcgcctgacacatggtgaca

SEQ ID NO: 144282 - DNA, 25 bp, Rattus norvegicus
aggcatcgcctgtcacatggtgaca

SEQ ID NO: 144283 - DNA, 25 bp, Rattus norvegicus
aggcatcgctacattctgcatgttg

SEQ ID NO: 144284 - DNA, 25 bp, Rattus norvegicus
aggcatcgctactttctgcatgttg

SEQ ID NO: 144285 - DNA, 25 bp, Rattus norvegicus
aggcatcgctgcaaggtctgttctg

SEQ ID NO: 144286 - DNA, 25 bp, Rattus norvegicus
aggcatcgctgctaggtctgttctg

SEQ ID NO: 144287 - DNA, 25 bp, Rattus norvegicus
aggcatcggaaacctggccagctgt

SEQ ID NO: 144288 - DNA, 25 bp, Rattus norvegicus
aggcatcggaaagctggccagctgt

SEQ ID NO: 144289 - DNA, 25 bp, Rattus norvegicus
aggcatctacagaggatcatggtct

SEQ ID NO: 144290 - DNA, 25 bp, Rattus norvegicus
aggcatctacagtggatcatggtct

SEQ ID NO: 144291 - DNA, 25 bp, Rattus norvegicus
aggcatctatgtcctacggtttgac

SEQ ID NO: 144292 - DNA, 25 bp, Rattus norvegicus
aggcatctatgtcctgtctgccttg

SEQ ID NO: 144293 - DNA, 25 bp, Rattus norvegicus
aggcatctatgtgctacggtttgac

SEQ ID NO: 144294 - DNA, 25 bp, Rattus norvegicus
aggcatctatgtgctgtctgccttg

SEQ ID NO: 144295 - DNA, 25 bp, Rattus norvegicus
aggcatctatttctccatggtcaac

SEQ ID NO: 144296 - DNA, 25 bp, Rattus norvegicus
aggcatctatttgtccatggtcaac

SEQ ID NO: 144297 - DNA, 25 bp, Rattus norvegicus
aggcatctcatcaaacttctggtca

SEQ ID NO: 144298 - DNA, 25 bp, Rattus norvegicus
aggcatctcatctaacttctggtca

SEQ ID NO: 144299 - DNA, 25 bp, Rattus norvegicus
aggcatctccagatcagtgtggctt

SEQ ID NO: 144300 - DNA, 25 bp, Rattus norvegicus
aggcatctccagttcagtgtggctt

SEQ ID NO: 144301 - DNA, 25 bp, Rattus norvegicus
aggcatctctacagttctgttagca

SEQ ID NO: 144302 - DNA, 25 bp, Rattus norvegicus
aggcatctctactgttctgttagca

SEQ ID NO: 144303 - DNA, 25 bp, Rattus norvegicus
aggcatctcttcctcgagtgttcaa

SEQ ID NO: 144304 - DNA, 25 bp, Rattus norvegicus
aggcatctcttcgtcgagtgttcaa

SEQ ID NO: 144305 - DNA, 25 bp, Rattus norvegicus
aggcatctggaaccgcagtactgct

SEQ ID NO: 144306 - DNA, 25 bp, Rattus norvegicus
aggcatctggaagcgcagtactgct

SEQ ID NO: 144307 - DNA, 25 bp, Rattus norvegicus
aggcatctggtaatgctacatcatg

SEQ ID NO: 144308 - DNA, 25 bp, Rattus norvegicus
aggcatctggtattgctacatcatg

SEQ ID NO: 144309 - DNA, 25 bp, Rattus norvegicus
aggcatctggttcttacttcagggc

SEQ ID NO: 144310 - DNA, 25 bp, Rattus norvegicus
aggcatctggttgttacttcagggc

SEQ ID NO: 144311 - DNA, 25 bp, Rattus norvegicus
aggcatcttagtcgcttttcctgac

SEQ ID NO: 144312 - DNA, 25 bp, Rattus norvegicus
aggcatcttagtggcttttcctgac

SEQ ID NO: 144313 - DNA, 25 bp, Rattus norvegicus
aggcatcttctcagagcttgcagga

SEQ ID NO: 144314 - DNA, 25 bp, Rattus norvegicus
aggcatcttctctgagcttgcagga

SEQ ID NO: 144315 - DNA, 25 bp, Rattus norvegicus
aggcatcttgatcacccttaaaagg

SEQ ID NO: 144316 - DNA, 25 bp, Rattus norvegicus
aggcatcttgatgacccttaaaagg

SEQ ID NO: 144317 - DNA, 25 bp, Rattus norvegicus
aggcatgacatcagggcgtattctt

SEQ ID NO: 144318 - DNA, 25 bp, Rattus norvegicus
aggcatgacatctgggcgtattctt

SEQ ID NO: 144319 - DNA, 25 bp, Rattus norvegicus
aggcatgaccatactccggattctg

SEQ ID NO: 144320 - DNA, 25 bp, Rattus norvegicus
aggcatgaccattctccggattctg

SEQ ID NO: 144321 - DNA, 25 bp, Rattus norvegicus
aggcatgaccggagcttgaccagaa

SEQ ID NO: 144322 - DNA, 25 bp, Rattus norvegicus
aggcatgaccggtgcttgaccagaa

SEQ ID NO: 144323 - DNA, 25 bp, Rattus norvegicus
aggcatgacctcacaacgaatttgg

SEQ ID NO: 144324 - DNA, 25 bp, Rattus norvegicus
aggcatgacctctcaacgaatttgg

SEQ ID NO: 144325 - DNA, 25 bp, Rattus norvegicus
aggcatgagcccaccaatgaaaagg

SEQ ID NO: 144326 - DNA, 25 bp, Rattus norvegicus
aggcatgagccctccaatgaaaagg

SEQ ID NO: 144327 - DNA, 25 bp, Rattus norvegicus
aggcatgagcctcgcactgccacgt

SEQ ID NO: 144328 - DNA, 25 bp, Rattus norvegicus
aggcatgagcctggcactgccacgt

SEQ ID NO: 144329 - DNA, 25 bp, Rattus norvegicus
aggcatgaggccagcacgagccaac

SEQ ID NO: 144330 - DNA, 25 bp, Rattus norvegicus
aggcatgaggcctgcacgagccaac

SEQ ID NO: 144331 - DNA, 25 bp, Rattus norvegicus
aggcatgatttcagagactcgacca

SEQ ID NO: 144332 - DNA, 25 bp, Rattus norvegicus
aggcatgatttctgagactcgacca

SEQ ID NO: 144333 - DNA, 25 bp, Rattus norvegicus
aggcatgcaagacttacacctgcat

SEQ ID NO: 144334 - DNA, 25 bp, Rattus norvegicus
aggcatgcaagagttacacctgcat

SEQ ID NO: 144335 - DNA, 25 bp, Rattus norvegicus
aggcatgccaggatgtgtccctcag

SEQ ID NO: 144336 - DNA, 25 bp, Rattus norvegicus
aggcatgccaggttgtgtccctcag

SEQ ID NO: 144337 - DNA, 25 bp, Rattus norvegicus
aggcatgccccgaacaaagtgttca

SEQ ID NO: 144338 - DNA, 25 bp, Rattus norvegicus
aggcatgccccgtacaaagtgttca

SEQ ID NO: 144339 - DNA, 25 bp, Rattus norvegicus
aggcatgcctaacctctgtcaaaag

SEQ ID NO: 144340 - DNA, 25 bp, Rattus norvegicus
aggcatgcctaagctctgtcaaaag

SEQ ID NO: 144341 - DNA, 25 bp, Rattus norvegicus
aggcatgcgaggactgctttgatct

SEQ ID NO: 144342 - DNA, 25 bp, Rattus norvegicus
aggcatgcgaggtctgctttgatct

SEQ ID NO: 144343 - DNA, 25 bp, Rattus norvegicus
aggcatgcgcgtaggctcctcaagg

SEQ ID NO: 144344 - DNA, 25 bp, Rattus norvegicus
aggcatgcgcgttggctcctcaagg

SEQ ID NO: 144345 - DNA, 25 bp, Rattus norvegicus
aggcatgcgctcagtcactggcaca

SEQ ID NO: 144346 - DNA, 25 bp, Rattus norvegicus
aggcatgcgctctgtcactggcaca

SEQ ID NO: 144347 - DNA, 25 bp, Rattus norvegicus
aggcatgcgtttacaggttcttcca

SEQ ID NO: 144348 - DNA, 25 bp, Rattus norvegicus
aggcatgcgttttcaggttcttcca

SEQ ID NO: 144349 - DNA, 25 bp, Rattus norvegicus
aggcatgctaaacggttccattctc

SEQ ID NO: 144350 - DNA, 25 bp, Rattus norvegicus
aggcatgctaaagggttccattctc

SEQ ID NO: 144351 - DNA, 25 bp, Rattus norvegicus
aggcatgctgcgacctaaggctttg

SEQ ID NO: 144352 - DNA, 25 bp, Rattus norvegicus
aggcatgctgcgtcctaaggctttg

SEQ ID NO: 144353 - DNA, 25 bp, Rattus norvegicus
aggcatgcttaacttcttgtctgtc

SEQ ID NO: 144354 - DNA, 25 bp, Rattus norvegicus
aggcatgcttaagttcttgtctgtc

SEQ ID NO: 144355 - DNA, 25 bp, Rattus norvegicus
aggcatgcttcccactgttcagagc

SEQ ID NO: 144356 - DNA, 25 bp, Rattus norvegicus
aggcatgcttccgactgttcagagc

SEQ ID NO: 144357 - DNA, 25 bp, Rattus norvegicus
aggcatgcttgcacggacagtgact

SEQ ID NO: 144358 - DNA, 25 bp, Rattus norvegicus
aggcatgcttgctcggacagtgact

SEQ ID NO: 144359 - DNA, 25 bp, Rattus norvegicus
aggcatgcttgtcttcatgatcaga

SEQ ID NO: 144360 - DNA, 25 bp, Rattus norvegicus
aggcatgcttgtgttcatgatcaga

SEQ ID NO: 144361 - DNA, 25 bp, Rattus norvegicus
aggcatggactgaatctggttttct

SEQ ID NO: 144362 - DNA, 25 bp, Rattus norvegicus
aggcatggactgtatctggttttct

SEQ ID NO: 144363 - DNA, 25 bp, Rattus norvegicus
aggcatggaggaccatgtccctgct

SEQ ID NO: 144364 - DNA, 25 bp, Rattus norvegicus
aggcatggaggagcatgtccctgct

SEQ ID NO: 144365 - DNA, 25 bp, Rattus norvegicus
aggcatggccacactcagtgaagaa

SEQ ID NO: 144366 - DNA, 25 bp, Rattus norvegicus
aggcatggccactctcagtgaagaa

SEQ ID NO: 144367 - DNA, 25 bp, Rattus norvegicus
aggcatggccatccacgcctgtaat

SEQ ID NO: 144368 - DNA, 25 bp, Rattus norvegicus
aggcatggccatgcacgcctgtaat

SEQ ID NO: 144369 - DNA, 25 bp, Rattus norvegicus
aggcatggctatcagttggctctca

SEQ ID NO: 144370 - DNA, 25 bp, Rattus norvegicus
aggcatggctatgagttggctctca

SEQ ID NO: 144371 - DNA, 25 bp, Rattus norvegicus
aggcatggctcacgttaggctggaa

SEQ ID NO: 144372 - DNA, 25 bp, Rattus norvegicus
aggcatggctcaggttaggctggaa

SEQ ID NO: 144373 - DNA, 25 bp, Rattus norvegicus
aggcatggctgcatcctggagttac

SEQ ID NO: 144374 - DNA, 25 bp, Rattus norvegicus
aggcatggctgcttcctggagttac

SEQ ID NO: 144375 - DNA, 25 bp, Rattus norvegicus
aggcatgggcacagctgtgtctgaa

SEQ ID NO: 144376 - DNA, 25 bp, Rattus norvegicus
aggcatgggcactgctgtgtctgaa

SEQ ID NO: 144377 - DNA, 25 bp, Rattus norvegicus
aggcatgggcagacgtaccctctca

SEQ ID NO: 144378 - DNA, 25 bp, Rattus norvegicus
aggcatgggcagtcgtaccctctca

SEQ ID NO: 144379 - DNA, 25 bp, Rattus norvegicus
aggcatggtggaccctatcagctga

SEQ ID NO: 144380 - DNA, 25 bp, Rattus norvegicus
aggcatggtggagcctatcagctga

SEQ ID NO: 144381 - DNA, 25 bp, Rattus norvegicus
aggcatggttatcctcaccttcaat

SEQ ID NO: 144382 - DNA, 25 bp, Rattus norvegicus
aggcatggttatgctcaccttcaat

SEQ ID NO: 144383 - DNA, 25 bp, Rattus norvegicus
aggcatggttcccacagtgtacgaa

SEQ ID NO: 144384 - DNA, 25 bp, Rattus norvegicus
aggcatggttccgacagtgtacgaa

SEQ ID NO: 144385 - DNA, 25 bp, Rattus norvegicus
aggcatggttgtattcctgtgacaa

SEQ ID NO: 144386 - DNA, 25 bp, Rattus norvegicus
aggcatggttgttttcctgtgacaa

SEQ ID NO: 144387 - DNA, 25 bp, Rattus norvegicus
aggcatgtaccactgtagatggctt

SEQ ID NO: 144388 - DNA, 25 bp, Rattus norvegicus
aggcatgtaccagtgtagatggctt

SEQ ID NO: 144389 - DNA, 25 bp, Rattus norvegicus
aggcatgtactaacacgcctggttt

SEQ ID NO: 144390 - DNA, 25 bp, Rattus norvegicus
aggcatgtactatcacgcctggttt

SEQ ID NO: 144391 - DNA, 25 bp, Rattus norvegicus
aggcatgtcaagcacctgtacctga

SEQ ID NO: 144392 - DNA, 25 bp, Rattus norvegicus
aggcatgtcaaggacctgtacctga

SEQ ID NO: 144393 - DNA, 25 bp, Rattus norvegicus
aggcatgtccaaacactgtgttccc

SEQ ID NO: 144394 - DNA, 25 bp, Rattus norvegicus
aggcatgtccaatcactgtgttccc

SEQ ID NO: 144395 - DNA, 25 bp, Rattus norvegicus
aggcatgtgaccacatctgcactga

SEQ ID NO: 144396 - DNA, 25 bp, Rattus norvegicus
aggcatgtgacctcatctgcactga

SEQ ID NO: 144397 - DNA, 25 bp, Rattus norvegicus
aggcatgtgatgctaagcccacggt

SEQ ID NO: 144398 - DNA, 25 bp, Rattus norvegicus
aggcatgtgatggtaagcccacggt

SEQ ID NO: 144399 - DNA, 25 bp, Rattus norvegicus
aggcatgtgctactgtgagcttctc

SEQ ID NO: 144400 - DNA, 25 bp, Rattus norvegicus
aggcatgtgctagtgtgagcttctc

SEQ ID NO: 144401 - DNA, 25 bp, Rattus norvegicus
aggcatgtgggcaacttactgaatc

SEQ ID NO: 144402 - DNA, 25 bp, Rattus norvegicus
aggcatgtgggctacttactgaatc

SEQ ID NO: 144403 - DNA, 25 bp, Rattus norvegicus
aggcatgtgtgcatttaatttcccc

SEQ ID NO: 144404 - DNA, 25 bp, Rattus norvegicus
aggcatgtgtgcttttaatttcccc

SEQ ID NO: 144405 - DNA, 25 bp, Rattus norvegicus
aggcatgtgttgctgtagtctcttc

SEQ ID NO: 144406 - DNA, 25 bp, Rattus norvegicus
aggcatgtgttggtgtagtctcttc

SEQ ID NO: 144407 - DNA, 25 bp, Rattus norvegicus
aggcattaacgcatctttagatctg

SEQ ID NO: 144408 - DNA, 25 bp, Rattus norvegicus
aggcattaacgcttctttagatctg

SEQ ID NO: 144409 - DNA, 25 bp, Rattus norvegicus
aggcattacaagcagccagtcaaat

SEQ ID NO: 144410 - DNA, 25 bp, Rattus norvegicus
aggcattacaaggagccagtcaaat

SEQ ID NO: 144411 - DNA, 25 bp, Rattus norvegicus
aggcattatctgatccgagctgttc

SEQ ID NO: 144412 - DNA, 25 bp, Rattus norvegicus
aggcattatctgttccgagctgttc

SEQ ID NO: 144413 - DNA, 25 bp, Rattus norvegicus
aggcattcaaccaaatccctaaatc

SEQ ID NO: 144414 - DNA, 25 bp, Rattus norvegicus
aggcattcaacctaatccctaaatc

SEQ ID NO: 144415 - DNA, 25 bp, Rattus norvegicus
aggcattcattcaatctttgctcaa

SEQ ID NO: 144416 - DNA, 25 bp, Rattus norvegicus
aggcattcattcctgcttttcagat

SEQ ID NO: 144417 - DNA, 25 bp, Rattus norvegicus
aggcattcattcgtgcttttcagat

SEQ ID NO: 144418 - DNA, 25 bp, Rattus norvegicus
aggcattcattctatctttgctcaa

SEQ ID NO: 144419 - DNA, 25 bp, Rattus norvegicus
aggcattcccataccaagtgtgagc

SEQ ID NO: 144420 - DNA, 25 bp, Rattus norvegicus
aggcattcccattccaagtgtgagc

SEQ ID NO: 144421 - DNA, 25 bp, Rattus norvegicus
aggcattccttgctgcagtagcatg

SEQ ID NO: 144422 - DNA, 25 bp, Rattus norvegicus
aggcattccttggtgcagtagcatg

SEQ ID NO: 144423 - DNA, 25 bp, Rattus norvegicus
aggcattcgtgccacaaagcagctc

SEQ ID NO: 144424 - DNA, 25 bp, Rattus norvegicus
aggcattcgtgcgacaaagcagctc

SEQ ID NO: 144425 - DNA, 25 bp, Rattus norvegicus
aggcattctgccattgttagttttc

SEQ ID NO: 144426 - DNA, 25 bp, Rattus norvegicus
aggcattctgcctttgttagttttc

SEQ ID NO: 144427 - DNA, 25 bp, Rattus norvegicus
aggcattctggacctggcaggactt

SEQ ID NO: 144428 - DNA, 25 bp, Rattus norvegicus
aggcattctggagctggcaggactt

SEQ ID NO: 144429 - DNA, 25 bp, Rattus norvegicus
aggcattctgtcaaggactctgtca

SEQ ID NO: 144430 - DNA, 25 bp, Rattus norvegicus
aggcattctgtctaggactctgtca

SEQ ID NO: 144431 - DNA, 25 bp, Rattus norvegicus
aggcattctttgactttttgttttg

SEQ ID NO: 144432 - DNA, 25 bp, Rattus norvegicus
aggcattctttgtctttttgttttg

SEQ ID NO: 144433 - DNA, 25 bp, Rattus norvegicus
aggcattgagcaccaacagacagct

SEQ ID NO: 144434 - DNA, 25 bp, Rattus norvegicus
aggcattgagcagcaacagacagct

SEQ ID NO: 144435 - DNA, 25 bp, Rattus norvegicus
aggcattgagtcaatcttggatatc

SEQ ID NO: 144436 - DNA, 25 bp, Rattus norvegicus
aggcattgagtctatcttggatatc

SEQ ID NO: 144437 - DNA, 25 bp, Rattus norvegicus
aggcattgccataccagcactttgc

SEQ ID NO: 144438 - DNA, 25 bp, Rattus norvegicus
aggcattgccattccagcactttgc

SEQ ID NO: 144439 - DNA, 25 bp, Rattus norvegicus
aggcattgctccaggcagaagttct

SEQ ID NO: 144440 - DNA, 25 bp, Rattus norvegicus
aggcattgctcctggcagaagttct

SEQ ID NO: 144441 - DNA, 25 bp, Rattus norvegicus
aggcattgctgtcctttaccttcat

SEQ ID NO: 144442 - DNA, 25 bp, Rattus norvegicus
aggcattgctgtgctttaccttcat

SEQ ID NO: 144443 - DNA, 25 bp, Rattus norvegicus
aggcattgctttcccaccaaattaa

SEQ ID NO: 144444 - DNA, 25 bp, Rattus norvegicus
aggcattgctttgccaccaaattaa

SEQ ID NO: 144445 - DNA, 25 bp, Rattus norvegicus
aggcattggagtagtatgttgtttc

SEQ ID NO: 144446 - DNA, 25 bp, Rattus norvegicus
aggcattggagttgtatgttgtttc

SEQ ID NO: 144447 - DNA, 25 bp, Rattus norvegicus
aggcattggcaaaatcactcctttt

SEQ ID NO: 144448 - DNA, 25 bp, Rattus norvegicus
aggcattggcaatatcactcctttt

SEQ ID NO: 144449 - DNA, 25 bp, Rattus norvegicus
aggcattggctcatgtggctgtgac

SEQ ID NO: 144450 - DNA, 25 bp, Rattus norvegicus
aggcattggctcttgtggctgtgac

SEQ ID NO: 144451 - DNA, 25 bp, Rattus norvegicus
aggcattggtttcgaggctcccctg

SEQ ID NO: 144452 - DNA, 25 bp, Rattus norvegicus
aggcattggtttggaggctcccctg

SEQ ID NO: 144453 - DNA, 25 bp, Rattus norvegicus
aggcattgtgttaatcctggcactt

SEQ ID NO: 144454 - DNA, 25 bp, Rattus norvegicus
aggcattgtgtttatcctggcactt

SEQ ID NO: 144455 - DNA, 25 bp, Rattus norvegicus
aggcattgtttaaagtaccctgaat

SEQ ID NO: 144456 - DNA, 25 bp, Rattus norvegicus
aggcattgtttatagtaccctgaat

SEQ ID NO: 144457 - DNA, 25 bp, Rattus norvegicus
aggcatttaaacattctctggctcc

SEQ ID NO: 144458 - DNA, 25 bp, Rattus norvegicus
aggcatttaaactttctctggctcc

SEQ ID NO: 144459 - DNA, 25 bp, Rattus norvegicus
aggcatttacgacctgagaccctca

SEQ ID NO: 144460 - DNA, 25 bp, Rattus norvegicus
aggcatttacgagctgagaccctca

SEQ ID NO: 144461 - DNA, 25 bp, Rattus norvegicus
aggcatttagaacacagcagagcat

SEQ ID NO: 144462 - DNA, 25 bp, Rattus norvegicus
aggcatttagaagacagcagagcat

SEQ ID NO: 144463 - DNA, 25 bp, Rattus norvegicus
aggcatttatctagtcctgcttggc

SEQ ID NO: 144464 - DNA, 25 bp, Rattus norvegicus
aggcatttatcttgtcctgcttggc

SEQ ID NO: 144465 - DNA, 25 bp, Rattus norvegicus
aggcatttcttactgttcatgtcag

SEQ ID NO: 144466 - DNA, 25 bp, Rattus norvegicus
aggcatttcttagtgttcatgtcag

SEQ ID NO: 144467 - DNA, 25 bp, Rattus norvegicus
aggcatttgaacacttggtttccaa

SEQ ID NO: 144468 - DNA, 25 bp, Rattus norvegicus
aggcatttgaactcttggtttccaa

SEQ ID NO: 144469 - DNA, 25 bp, Rattus norvegicus
aggcatttggcaaacttcagttttc

SEQ ID NO: 144470 - DNA, 25 bp, Rattus norvegicus
aggcatttggcatacttcagttttc

SEQ ID NO: 144471 - DNA, 25 bp, Rattus norvegicus
aggcatttgtagctcttgctggccg

SEQ ID NO: 144472 - DNA, 25 bp, Rattus norvegicus
aggcatttgtaggtcttgctggccg

SEQ ID NO: 144473 - DNA, 25 bp, Rattus norvegicus
aggcatttgtctagcaactgtgaag

SEQ ID NO: 144474 - DNA, 25 bp, Rattus norvegicus
aggcatttgtctatcctagagcctc

SEQ ID NO: 144475 - DNA, 25 bp, Rattus norvegicus
aggcatttgtcttgcaactgtgaag

SEQ ID NO: 144476 - DNA, 25 bp, Rattus norvegicus
aggcatttgtctttcctagagcctc

SEQ ID NO: 144477 - DNA, 25 bp, Rattus norvegicus
aggcattttaatagctgtaggtgtc

SEQ ID NO: 144478 - DNA, 25 bp, Rattus norvegicus
aggcattttaattgctgtaggtgtc

SEQ ID NO: 144479 - DNA, 25 bp, Rattus norvegicus
aggcattttatcattgctcaattgt

SEQ ID NO: 144480 - DNA, 25 bp, Rattus norvegicus
aggcattttatctttgctcaattgt

SEQ ID NO: 144481 - DNA, 25 bp, Rattus norvegicus
aggcattttcctctctggattcaaa

SEQ ID NO: 144482 - DNA, 25 bp, Rattus norvegicus
aggcattttcctgtctggattcaaa

SEQ ID NO: 144483 - DNA, 25 bp, Rattus norvegicus
aggcattttgctcgtcatttcttaa

SEQ ID NO: 144484 - DNA, 25 bp, Rattus norvegicus
aggcattttgctggtcatttcttaa

SEQ ID NO: 144485 - DNA, 25 bp, Rattus norvegicus
aggcattttgtcctttggttcacat

SEQ ID NO: 144486 - DNA, 25 bp, Rattus norvegicus
aggcattttgtcgtttggttcacat

SEQ ID NO: 144487 - DNA, 25 bp, Rattus norvegicus
aggccaaacaagctgcaggacccag

SEQ ID NO: 144488 - DNA, 25 bp, Rattus norvegicus
aggccaaacaaggtgcaggacccag

SEQ ID NO: 144489 - DNA, 25 bp, Rattus norvegicus
aggccaaacggaacaaccacatcag

SEQ ID NO: 144490 - DNA, 25 bp, Rattus norvegicus
aggccaaacggatcaaccacatcag

SEQ ID NO: 144491 - DNA, 25 bp, Rattus norvegicus
aggccaaactcacagcttaaccgag

SEQ ID NO: 144492 - DNA, 25 bp, Rattus norvegicus
aggccaaactcagagcttaaccgag

SEQ ID NO: 144493 - DNA, 25 bp, Rattus norvegicus
aggccaaagaatctttcaagcgctt

SEQ ID NO: 144494 - DNA, 25 bp, Rattus norvegicus
aggccaaagaatgtttcaagcgctt

SEQ ID NO: 144495 - DNA, 25 bp, Rattus norvegicus
aggccaaagagcagccagaccctgt

SEQ ID NO: 144496 - DNA, 25 bp, Rattus norvegicus
aggccaaagagctgccagaccctgt

SEQ ID NO: 144497 - DNA, 25 bp, Rattus norvegicus
aggccaaagatgcttcaggttgatt

SEQ ID NO: 144498 - DNA, 25 bp, Rattus norvegicus
aggccaaagatggttcaggttgatt

SEQ ID NO: 144499 - DNA, 25 bp, Rattus norvegicus
aggccaaagccaccactttcagaca

SEQ ID NO: 144500 - DNA, 25 bp, Rattus norvegicus
aggccaaagccagcactttcagaca

SEQ ID NO: 144501 - DNA, 25 bp, Rattus norvegicus
aggccaaagctccaaggctggtgat

SEQ ID NO: 144502 - DNA, 25 bp, Rattus norvegicus
aggccaaagctcgaaggctggtgat

SEQ ID NO: 144503 - DNA, 25 bp, Rattus norvegicus
aggccaaaggtcaaggtgccctgga

SEQ ID NO: 144504 - DNA, 25 bp, Rattus norvegicus
aggccaaaggtcctatggtccattt

SEQ ID NO: 144505 - DNA, 25 bp, Rattus norvegicus
aggccaaaggtcgtatggtccattt

SEQ ID NO: 144506 - DNA, 25 bp, Rattus norvegicus
aggccaaaggtctaggtgccctgga

SEQ ID NO: 144507 - DNA, 25 bp, Rattus norvegicus
aggccaaagttcctgcgactagcaa

SEQ ID NO: 144508 - DNA, 25 bp, Rattus norvegicus
aggccaaagttcgtgcgactagcaa

SEQ ID NO: 144509 - DNA, 25 bp, Rattus norvegicus
aggccaacaccaacctgtccaagtt

SEQ ID NO: 144510 - DNA, 25 bp, Rattus norvegicus
aggccaacaccatcctgtccaagtt

SEQ ID NO: 144511 - DNA, 25 bp, Rattus norvegicus
aggccaaccaaaatctctgctatct

SEQ ID NO: 144512 - DNA, 25 bp, Rattus norvegicus
aggccaaccaaattctctgctatct

SEQ ID NO: 144513 - DNA, 25 bp, Rattus norvegicus
aggccaaccagaagcgtatcaccac

SEQ ID NO: 144514 - DNA, 25 bp, Rattus norvegicus
aggccaaccagatgcgtatcaccac

SEQ ID NO: 144515 - DNA, 25 bp, Rattus norvegicus
aggccaacctagagggtctcagtgg

SEQ ID NO: 144516 - DNA, 25 bp, Rattus norvegicus
aggccaacctagtgggtctcagtgg

SEQ ID NO: 144517 - DNA, 25 bp, Rattus norvegicus
aggccaacctataggaccaggactt

SEQ ID NO: 144518 - DNA, 25 bp, Rattus norvegicus
aggccaacctattggaccaggactt

SEQ ID NO: 144519 - DNA, 25 bp, Rattus norvegicus
aggccaacctggcaaatagctttgt

SEQ ID NO: 144520 - DNA, 25 bp, Rattus norvegicus
aggccaacctgggaaatagctttgt

SEQ ID NO: 144521 - DNA, 25 bp, Rattus norvegicus
aggccaacggtaaccacgcagctgg

SEQ ID NO: 144522 - DNA, 25 bp, Rattus norvegicus
aggccaacggtatccacgcagctgg

SEQ ID NO: 144523 - DNA, 25 bp, Rattus norvegicus
aggccaacgtttcactttgagggat

SEQ ID NO: 144524 - DNA, 25 bp, Rattus norvegicus
aggccaacgtttgactttgagggat

SEQ ID NO: 144525 - DNA, 25 bp, Rattus norvegicus
aggccaactgtgatgatgacacttg

SEQ ID NO: 144526 - DNA, 25 bp, Rattus norvegicus
aggccaactgtgttgatgacacttg

SEQ ID NO: 144527 - DNA, 25 bp, Rattus norvegicus
aggccaagaagcattttctcccagg

SEQ ID NO: 144528 - DNA, 25 bp, Rattus norvegicus
aggccaagaagctttttctcccagg

SEQ ID NO: 144529 - DNA, 25 bp, Rattus norvegicus
aggccaagagggactgtccacttta

SEQ ID NO: 144530 - DNA, 25 bp, Rattus norvegicus
aggccaagagggtctgtccacttta

SEQ ID NO: 144531 - DNA, 25 bp, Rattus norvegicus
aggccaagccaaagttctctatcaa

SEQ ID NO: 144532 - DNA, 25 bp, Rattus norvegicus
aggccaagccaatgttctctatcaa

SEQ ID NO: 144533 - DNA, 25 bp, Rattus norvegicus
aggccaagccggagtcatctgacag

SEQ ID NO: 144534 - DNA, 25 bp, Rattus norvegicus
aggccaagccggtgtcatctgacag

SEQ ID NO: 144535 - DNA, 25 bp, Rattus norvegicus
aggccaagcgggagctacagtgctt

SEQ ID NO: 144536 - DNA, 25 bp, Rattus norvegicus
aggccaagcgggtgctacagtgctt

SEQ ID NO: 144537 - DNA, 25 bp, Rattus norvegicus
aggccaagcgtaagccaccgagtgg

SEQ ID NO: 144538 - DNA, 25 bp, Rattus norvegicus
aggccaagcgtatgccaccgagtgg

SEQ ID NO: 144539 - DNA, 25 bp, Rattus norvegicus
aggccaaggctgagacaatccgcaa

SEQ ID NO: 144540 - DNA, 25 bp, Rattus norvegicus
aggccaaggctgtgacaatccgcaa

SEQ ID NO: 144541 - DNA, 25 bp, Rattus norvegicus
aggccaagtctacgttccagtacta

SEQ ID NO: 144542 - DNA, 25 bp, Rattus norvegicus
aggccaagtctaggttccagtacta

SEQ ID NO: 144543 - DNA, 25 bp, Rattus norvegicus
aggccaagtctcctgggctaataaa

SEQ ID NO: 144544 - DNA, 25 bp, Rattus norvegicus
aggccaagtctcgtgggctaataaa

SEQ ID NO: 144545 - DNA, 25 bp, Rattus norvegicus
aggccaagtggtacgcatcaacttc

SEQ ID NO: 144546 - DNA, 25 bp, Rattus norvegicus
aggccaagtggttcgcatcaacttc

SEQ ID NO: 144547 - DNA, 25 bp, Rattus norvegicus
aggccaagtgtgagaggcttctcca

SEQ ID NO: 144548 - DNA, 25 bp, Rattus norvegicus
aggccaagtgtgtgaggcttctcca

SEQ ID NO: 144549 - DNA, 25 bp, Rattus norvegicus
aggccaatccagctttctgtcactt

SEQ ID NO: 144550 - DNA, 25 bp, Rattus norvegicus
aggccaatccaggtttctgtcactt

SEQ ID NO: 144551 - DNA, 25 bp, Rattus norvegicus
aggccaatcctaaggagctgctgac

SEQ ID NO: 144552 - DNA, 25 bp, Rattus norvegicus
aggccaatcctatggagctgctgac

SEQ ID NO: 144553 - DNA, 25 bp, Rattus norvegicus
aggccaatctttcccaggtatttat

SEQ ID NO: 144554 - DNA, 25 bp, Rattus norvegicus
aggccaatctttgccaggtatttat

SEQ ID NO: 144555 - DNA, 25 bp, Rattus norvegicus
aggccaatgaggaagccatcgccag

SEQ ID NO: 144556 - DNA, 25 bp, Rattus norvegicus
aggccaatgaggtagccatcgccag

SEQ ID NO: 144557 - DNA, 25 bp, Rattus norvegicus
aggccaatgccgagagtgaagctgt

SEQ ID NO: 144558 - DNA, 25 bp, Rattus norvegicus
aggccaatgccgtgagtgaagctgt

SEQ ID NO: 144559 - DNA, 25 bp, Rattus norvegicus
aggccaatgcttatccatctttaaa

SEQ ID NO: 144560 - DNA, 25 bp, Rattus norvegicus
aggccaatgcttttccatctttaaa

SEQ ID NO: 144561 - DNA, 25 bp, Rattus norvegicus
aggccaattccccaccatgaagaag

SEQ ID NO: 144562 - DNA, 25 bp, Rattus norvegicus
aggccaattcccgaccatgaagaag

SEQ ID NO: 144563 - DNA, 25 bp, Rattus norvegicus
aggccacaacttacacttctaggaa

SEQ ID NO: 144564 - DNA, 25 bp, Rattus norvegicus
aggccacaactttcacttctaggaa

SEQ ID NO: 144565 - DNA, 25 bp, Rattus norvegicus
aggccacaagcaccaacttccgatg

SEQ ID NO: 144566 - DNA, 25 bp, Rattus norvegicus
aggccacaagcagcaacttccgatg

SEQ ID NO: 144567 - DNA, 25 bp, Rattus norvegicus
aggccacacactcagctgcagggtt

SEQ ID NO: 144568 - DNA, 25 bp, Rattus norvegicus
aggccacacactgagctgcagggtt

SEQ ID NO: 144569 - DNA, 25 bp, Rattus norvegicus
aggccacacctgagtatctcattat

SEQ ID NO: 144570 - DNA, 25 bp, Rattus norvegicus
aggccacacctgtgtatctcattat

SEQ ID NO: 144571 - DNA, 25 bp, Rattus norvegicus
aggccacactgacactgaatgcatt

SEQ ID NO: 144572 - DNA, 25 bp, Rattus norvegicus
aggccacactgagactgaatgcatt

SEQ ID NO: 144573 - DNA, 25 bp, Rattus norvegicus
aggccacagactccagtgctggaaa

SEQ ID NO: 144574 - DNA, 25 bp, Rattus norvegicus
aggccacagactgcagtgctggaaa

SEQ ID NO: 144575 - DNA, 25 bp, Rattus norvegicus
aggccacagctcagaactgacgaga

SEQ ID NO: 144576 - DNA, 25 bp, Rattus norvegicus
aggccacagctctgaactgacgaga

SEQ ID NO: 144577 - DNA, 25 bp, Rattus norvegicus
aggccacagtagaggctgcacttgc

SEQ ID NO: 144578 - DNA, 25 bp, Rattus norvegicus
aggccacagtagtggctgcacttgc

SEQ ID NO: 144579 - DNA, 25 bp, Rattus norvegicus
aggccacagtggacttttctgggca

SEQ ID NO: 144580 - DNA, 25 bp, Rattus norvegicus
aggccacagtggtcttttctgggca

SEQ ID NO: 144581 - DNA, 25 bp, Rattus norvegicus
aggccacatacaacaggaagtcact

SEQ ID NO: 144582 - DNA, 25 bp, Rattus norvegicus
aggccacatacatcaggaagtcact

SEQ ID NO: 144583 - DNA, 25 bp, Rattus norvegicus
aggccacatagtacaatcttctttg

SEQ ID NO: 144584 - DNA, 25 bp, Rattus norvegicus
aggccacatagttcaatcttctttg

SEQ ID NO: 144585 - DNA, 25 bp, Rattus norvegicus
aggccacatcagaacctactggaag

SEQ ID NO: 144586 - DNA, 25 bp, Rattus norvegicus
aggccacatcagtacctactggaag

SEQ ID NO: 144587 - DNA, 25 bp, Rattus norvegicus
aggccacatcttaccaatcaagcat

SEQ ID NO: 144588 - DNA, 25 bp, Rattus norvegicus
aggccacatctttccaatcaagcat

SEQ ID NO: 144589 - DNA, 25 bp, Rattus norvegicus
aggccacatgcaactcacaacagag

SEQ ID NO: 144590 - DNA, 25 bp, Rattus norvegicus
aggccacatgcatctcacaacagag

SEQ ID NO: 144591 - DNA, 25 bp, Rattus norvegicus
aggccaccaagaattcacttcttta

SEQ ID NO: 144592 - DNA, 25 bp, Rattus norvegicus
aggccaccaagatttcacttcttta

SEQ ID NO: 144593 - DNA, 25 bp, Rattus norvegicus
aggccaccagaacctgagtgcccga

SEQ ID NO: 144594 - DNA, 25 bp, Rattus norvegicus
aggccaccagaagctgagtgcccga

SEQ ID NO: 144595 - DNA, 25 bp, Rattus norvegicus
aggccaccagggagctctgtgacag

SEQ ID NO: 144596 - DNA, 25 bp, Rattus norvegicus
aggccaccagggtgctctgtgacag

SEQ ID NO: 144597 - DNA, 25 bp, Rattus norvegicus
aggccaccatgcaggcttctaaaac

SEQ ID NO: 144598 - DNA, 25 bp, Rattus norvegicus
aggccaccatgctggcttctaaaac

SEQ ID NO: 144599 - DNA, 25 bp, Rattus norvegicus
aggccacccattcagggcatattta

SEQ ID NO: 144600 - DNA, 25 bp, Rattus norvegicus
aggccacccattgagggcatattta

SEQ ID NO: 144601 - DNA, 25 bp, Rattus norvegicus
aggccaccccaaaagaagctcctga

SEQ ID NO: 144602 - DNA, 25 bp, Rattus norvegicus
aggccaccccaatagaagctcctga

SEQ ID NO: 144603 - DNA, 25 bp, Rattus norvegicus
aggccacccgaaagttaggcttgtg

SEQ ID NO: 144604 - DNA, 25 bp, Rattus norvegicus
aggccacccgaatgttaggcttgtg

SEQ ID NO: 144605 - DNA, 25 bp, Rattus norvegicus
aggccaccctggactatatagtgag

SEQ ID NO: 144606 - DNA, 25 bp, Rattus norvegicus
aggccaccctggtctatatagtgag

SEQ ID NO: 144607 - DNA, 25 bp, Rattus norvegicus
aggccaccctgtcagtggacatact

SEQ ID NO: 144608 - DNA, 25 bp, Rattus norvegicus
aggccaccctgtgagtggacatact

SEQ ID NO: 144609 - DNA, 25 bp, Rattus norvegicus
aggccacctcagaattgcctatggg

SEQ ID NO: 144610 - DNA, 25 bp, Rattus norvegicus
aggccacctcagtattgcctatggg

SEQ ID NO: 144611 - DNA, 25 bp, Rattus norvegicus
aggccacctgaacctcttggcagag

SEQ ID NO: 144612 - DNA, 25 bp, Rattus norvegicus
aggccacctgaagctcttggcagag

SEQ ID NO: 144613 - DNA, 25 bp, Rattus norvegicus
aggccacctgccagtcggattctga

SEQ ID NO: 144614 - DNA, 25 bp, Rattus norvegicus
aggccacctgcctgtcggattctga

SEQ ID NO: 144615 - DNA, 25 bp, Rattus norvegicus
aggccacctgggagctaagctagca

SEQ ID NO: 144616 - DNA, 25 bp, Rattus norvegicus
aggccacctgggtgctaagctagca

SEQ ID NO: 144617 - DNA, 25 bp, Rattus norvegicus
aggccacctggtaatgaatctgtca

SEQ ID NO: 144618 - DNA, 25 bp, Rattus norvegicus
aggccacctggttatgaatctgtca

SEQ ID NO: 144619 - DNA, 25 bp, Rattus norvegicus
aggccaccttatcctctgagggaga

SEQ ID NO: 144620 - DNA, 25 bp, Rattus norvegicus
aggccaccttatgctctgagggaga

SEQ ID NO: 144621 - DNA, 25 bp, Rattus norvegicus
aggccacctttcatagtatagttgc

SEQ ID NO: 144622 - DNA, 25 bp, Rattus norvegicus
aggccacctttcttagtatagttgc

SEQ ID NO: 144623 - DNA, 25 bp, Rattus norvegicus
aggccacgccctaagcaaaactgaa

SEQ ID NO: 144624 - DNA, 25 bp, Rattus norvegicus
aggccacgcccttagcaaaactgaa

SEQ ID NO: 144625 - DNA, 25 bp, Rattus norvegicus
aggccacggagtacctaggtagcga

SEQ ID NO: 144626 - DNA, 25 bp, Rattus norvegicus
aggccacggagttcctaggtagcga

SEQ ID NO: 144627 - DNA, 25 bp, Rattus norvegicus
aggccacggtctcattctcaggtta

SEQ ID NO: 144628 - DNA, 25 bp, Rattus norvegicus
aggccacggtctgattctcaggtta

SEQ ID NO: 144629 - DNA, 25 bp, Rattus norvegicus
aggccacggttcaccagtgcagtga

SEQ ID NO: 144630 - DNA, 25 bp, Rattus norvegicus
aggccacggttctccagtgcagtga

SEQ ID NO: 144631 - DNA, 25 bp, Rattus norvegicus
aggccacgtgctaactgcttgacat

SEQ ID NO: 144632 - DNA, 25 bp, Rattus norvegicus
aggccacgtgcttactgcttgacat

SEQ ID NO: 144633 - DNA, 25 bp, Rattus norvegicus
aggccacgtgggagcatcattgatc

SEQ ID NO: 144634 - DNA, 25 bp, Rattus norvegicus
aggccacgtgggtgcatcattgatc

SEQ ID NO: 144635 - DNA, 25 bp, Rattus norvegicus
aggccactaagaccatctaccttat

SEQ ID NO: 144636 - DNA, 25 bp, Rattus norvegicus
aggccactaagagcatctaccttat

SEQ ID NO: 144637 - DNA, 25 bp, Rattus norvegicus
aggccactagatcacatgactcttc

SEQ ID NO: 144638 - DNA, 25 bp, Rattus norvegicus
aggccactagatgacatgactcttc

SEQ ID NO: 144639 - DNA, 25 bp, Rattus norvegicus
aggccactagtccttggctaatcta

SEQ ID NO: 144640 - DNA, 25 bp, Rattus norvegicus
aggccactagtcgttggctaatcta

SEQ ID NO: 144641 - DNA, 25 bp, Rattus norvegicus
aggccactcttcacgggacttagag

SEQ ID NO: 144642 - DNA, 25 bp, Rattus norvegicus
aggccactcttctcgggacttagag

SEQ ID NO: 144643 - DNA, 25 bp, Rattus norvegicus
aggccactgaggactgatgccagga

SEQ ID NO: 144644 - DNA, 25 bp, Rattus norvegicus
aggccactgaggtctgatgccagga

SEQ ID NO: 144645 - DNA, 25 bp, Rattus norvegicus
aggccactgcggctggtctcctgtc

SEQ ID NO: 144646 - DNA, 25 bp, Rattus norvegicus
aggccactgcgggtggtctcctgtc

SEQ ID NO: 144647 - DNA, 25 bp, Rattus norvegicus
aggccactggagaaacctgagccca

SEQ ID NO: 144648 - DNA, 25 bp, Rattus norvegicus
aggccactggagactcagccacaag

SEQ ID NO: 144649 - DNA, 25 bp, Rattus norvegicus
aggccactggagtaacctgagccca

SEQ ID NO: 144650 - DNA, 25 bp, Rattus norvegicus
aggccactggagtctcagccacaag

SEQ ID NO: 144651 - DNA, 25 bp, Rattus norvegicus
aggccactggctcaaccacgggaag

SEQ ID NO: 144652 - DNA, 25 bp, Rattus norvegicus
aggccactggctgaaccacgggaag

SEQ ID NO: 144653 - DNA, 25 bp, Rattus norvegicus
aggccactgggacaactacaagcgt

SEQ ID NO: 144654 - DNA, 25 bp, Rattus norvegicus
aggccactgggagaactacaagcgt

SEQ ID NO: 144655 - DNA, 25 bp, Rattus norvegicus
aggccactgggtaacgaaacacgct

SEQ ID NO: 144656 - DNA, 25 bp, Rattus norvegicus
aggccactgggttacgaaacacgct

SEQ ID NO: 144657 - DNA, 25 bp, Rattus norvegicus
aggccactgtgtctaagaatactca

SEQ ID NO: 144658 - DNA, 25 bp, Rattus norvegicus
aggccactgtgtgtaagaatactca

SEQ ID NO: 144659 - DNA, 25 bp, Rattus norvegicus
aggccactgttccatttcaaatgct

SEQ ID NO: 144660 - DNA, 25 bp, Rattus norvegicus
aggccactgttcgatttcaaatgct

SEQ ID NO: 144661 - DNA, 25 bp, Rattus norvegicus
aggccacttacaactctggtgaact

SEQ ID NO: 144662 - DNA, 25 bp, Rattus norvegicus
aggccacttacatctctggtgaact

SEQ ID NO: 144663 - DNA, 25 bp, Rattus norvegicus
aggccacttctgagaatccaggcaa

SEQ ID NO: 144664 - DNA, 25 bp, Rattus norvegicus
aggccacttctgtgaatccaggcaa

SEQ ID NO: 144665 - DNA, 25 bp, Rattus norvegicus
aggccacttggcagttgtctttgtt

SEQ ID NO: 144666 - DNA, 25 bp, Rattus norvegicus
aggccacttggctgttgtctttgtt

SEQ ID NO: 144667 - DNA, 25 bp, Rattus norvegicus
aggccacttgtcaacccaataaagt

SEQ ID NO: 144668 - DNA, 25 bp, Rattus norvegicus
aggccacttgtctacccaataaagt

SEQ ID NO: 144669 - DNA, 25 bp, Rattus norvegicus
aggccacttgtgactgttctgcaga

SEQ ID NO: 144670 - DNA, 25 bp, Rattus norvegicus
aggccacttgtgtctgttctgcaga

SEQ ID NO: 144671 - DNA, 25 bp, Rattus norvegicus
aggccactttaccttatacagcagc

SEQ ID NO: 144672 - DNA, 25 bp, Rattus norvegicus
aggccactttacgttatacagcagc

SEQ ID NO: 144673 - DNA, 25 bp, Rattus norvegicus
aggccagaaattaccaccgctaggt

SEQ ID NO: 144674 - DNA, 25 bp, Rattus norvegicus
aggccagaaatttccaccgctaggt

SEQ ID NO: 144675 - DNA, 25 bp, Rattus norvegicus
aggccagacacaccatcgtttacat

SEQ ID NO: 144676 - DNA, 25 bp, Rattus norvegicus
aggccagacacagcatcgtttacat

SEQ ID NO: 144677 - DNA, 25 bp, Rattus norvegicus
aggccagacaccacaatatcagatt

SEQ ID NO: 144678 - DNA, 25 bp, Rattus norvegicus
aggccagacacctcaatatcagatt

SEQ ID NO: 144679 - DNA, 25 bp, Rattus norvegicus
aggccagacagacctaccctttggg

SEQ ID NO: 144680 - DNA, 25 bp, Rattus norvegicus
aggccagacagagctaccctttggg

SEQ ID NO: 144681 - DNA, 25 bp, Rattus norvegicus
aggccagacagcagcacgggagata

SEQ ID NO: 144682 - DNA, 25 bp, Rattus norvegicus
aggccagacagctgcacgggagata

SEQ ID NO: 144683 - DNA, 25 bp, Rattus norvegicus
aggccagacgtcactacgtgggcaa

SEQ ID NO: 144684 - DNA, 25 bp, Rattus norvegicus
aggccagacgtctctacgtgggcaa

SEQ ID NO: 144685 - DNA, 25 bp, Rattus norvegicus
aggccagacgttctcaaggttgcag

SEQ ID NO: 144686 - DNA, 25 bp, Rattus norvegicus
aggccagacgttgtcaaggttgcag

SEQ ID NO: 144687 - DNA, 25 bp, Rattus norvegicus
aggccagagccaacacggaagagga

SEQ ID NO: 144688 - DNA, 25 bp, Rattus norvegicus
aggccagagccatcacggaagagga

SEQ ID NO: 144689 - DNA, 25 bp, Rattus norvegicus
aggccagagcccacctcgacagtgt

SEQ ID NO: 144690 - DNA, 25 bp, Rattus norvegicus
aggccagagcccacttgcttcagct

SEQ ID NO: 144691 - DNA, 25 bp, Rattus norvegicus
aggccagagccccaatatctttcca

SEQ ID NO: 144692 - DNA, 25 bp, Rattus norvegicus
aggccagagcccgaatatctttcca

SEQ ID NO: 144693 - DNA, 25 bp, Rattus norvegicus
aggccagagccctcctcgacagtgt

SEQ ID NO: 144694 - DNA, 25 bp, Rattus norvegicus
aggccagagccctcttgcttcagct

SEQ ID NO: 144695 - DNA, 25 bp, Rattus norvegicus
aggccagagctgcagtacctgacaa

SEQ ID NO: 144696 - DNA, 25 bp, Rattus norvegicus
aggccagagctggagtacctgacaa

SEQ ID NO: 144697 - DNA, 25 bp, Rattus norvegicus
aggccagagtcacgctttaggtcta

SEQ ID NO: 144698 - DNA, 25 bp, Rattus norvegicus
aggccagagtcaggctttaggtcta

SEQ ID NO: 144699 - DNA, 25 bp, Rattus norvegicus
aggccagatcctcacccagaatgtt

SEQ ID NO: 144700 - DNA, 25 bp, Rattus norvegicus
aggccagatcctgacccagaatgtt

SEQ ID NO: 144701 - DNA, 25 bp, Rattus norvegicus
aggccagatggaagctgttcgaatc

SEQ ID NO: 144702 - DNA, 25 bp, Rattus norvegicus
aggccagatggatgctgttcgaatc

SEQ ID NO: 144703 - DNA, 25 bp, Rattus norvegicus
aggccagattgaccacctactgatt

SEQ ID NO: 144704 - DNA, 25 bp, Rattus norvegicus
aggccagattgagcacctactgatt

SEQ ID NO: 144705 - DNA, 25 bp, Rattus norvegicus
aggccagcaaccactgttggtacag

SEQ ID NO: 144706 - DNA, 25 bp, Rattus norvegicus
aggccagcaacctctgttggtacag

SEQ ID NO: 144707 - DNA, 25 bp, Rattus norvegicus
aggccagcactcctgtctacttcga

SEQ ID NO: 144708 - DNA, 25 bp, Rattus norvegicus
aggccagcactcgtgtctacttcga

SEQ ID NO: 144709 - DNA, 25 bp, Rattus norvegicus
aggccagcagctaccactggaggta

SEQ ID NO: 144710 - DNA, 25 bp, Rattus norvegicus
aggccagcagcttccactggaggta

SEQ ID NO: 144711 - DNA, 25 bp, Rattus norvegicus
aggccagcagtacaccttcaaggct

SEQ ID NO: 144712 - DNA, 25 bp, Rattus norvegicus
aggccagcagtagaccttcaaggct

SEQ ID NO: 144713 - DNA, 25 bp, Rattus norvegicus
aggccagcagtcacgttcaaggagc

SEQ ID NO: 144714 - DNA, 25 bp, Rattus norvegicus
aggccagcagtctcgttcaaggagc

SEQ ID NO: 144715 - DNA, 25 bp, Rattus norvegicus
aggccagccaccatgtactgctcag

SEQ ID NO: 144716 - DNA, 25 bp, Rattus norvegicus
aggccagccaccttgtactgctcag

SEQ ID NO: 144717 - DNA, 25 bp, Rattus norvegicus
aggccagccactcctaggtatacag

SEQ ID NO: 144718 - DNA, 25 bp, Rattus norvegicus
aggccagccactgctaggtatacag

SEQ ID NO: 144719 - DNA, 25 bp, Rattus norvegicus
aggccagccaggactctaaatggtc

SEQ ID NO: 144720 - DNA, 25 bp, Rattus norvegicus
aggccagccaggtctctaaatggtc

SEQ ID NO: 144721 - DNA, 25 bp, Rattus norvegicus
aggccagccgtgactcactttatta

SEQ ID NO: 144722 - DNA, 25 bp, Rattus norvegicus
aggccagccgtgtctcactttatta

SEQ ID NO: 144723 - DNA, 25 bp, Rattus norvegicus
aggccagcctagatacaaagcagga

SEQ ID NO: 144724 - DNA, 25 bp, Rattus norvegicus
aggccagcctagcaggttccttcag

SEQ ID NO: 144725 - DNA, 25 bp, Rattus norvegicus
aggccagcctaggaggttccttcag

SEQ ID NO: 144726 - DNA, 25 bp, Rattus norvegicus
aggccagcctagttacaaagcagga

SEQ ID NO: 144727 - DNA, 25 bp, Rattus norvegicus
aggccagcctcaactctagtgtgag

SEQ ID NO: 144728 - DNA, 25 bp, Rattus norvegicus
aggccagcctcactgatagtctgat

SEQ ID NO: 144729 - DNA, 25 bp, Rattus norvegicus
aggccagcctcagtgatagtctgat

SEQ ID NO: 144730 - DNA, 25 bp, Rattus norvegicus
aggccagcctcatctctagtgtgag

SEQ ID NO: 144731 - DNA, 25 bp, Rattus norvegicus
aggccagcctcgcaaatggacatgg

SEQ ID NO: 144732 - DNA, 25 bp, Rattus norvegicus
aggccagcctcggaaatggacatgg

SEQ ID NO: 144733 - DNA, 25 bp, Rattus norvegicus
aggccagcctgacttacctatttat

SEQ ID NO: 144734 - DNA, 25 bp, Rattus norvegicus
aggccagcctgagttacctatttat

SEQ ID NO: 144735 - DNA, 25 bp, Rattus norvegicus
aggccagcctgcacacatagtgaga

SEQ ID NO: 144736 - DNA, 25 bp, Rattus norvegicus
aggccagcctgctcacatagtgaga

SEQ ID NO: 144737 - DNA, 25 bp, Rattus norvegicus
aggccagcctggaatcagttaaact

SEQ ID NO: 144738 - DNA, 25 bp, Rattus norvegicus
aggccagcctggagtcttttccatg

SEQ ID NO: 144739 - DNA, 25 bp, Rattus norvegicus
aggccagcctggtatcagttaaact

SEQ ID NO: 144740 - DNA, 25 bp, Rattus norvegicus
aggccagcctggtgtcttttccatg

SEQ ID NO: 144741 - DNA, 25 bp, Rattus norvegicus
aggccagcgcttcagcttgtcagga

SEQ ID NO: 144742 - DNA, 25 bp, Rattus norvegicus
aggccagcgcttgagcttgtcagga

SEQ ID NO: 144743 - DNA, 25 bp, Rattus norvegicus
aggccagctaacataacctgactgc

SEQ ID NO: 144744 - DNA, 25 bp, Rattus norvegicus
aggccagctaacttaacctgactgc

SEQ ID NO: 144745 - DNA, 25 bp, Rattus norvegicus
aggccagctcctcgctgatgacaaa

SEQ ID NO: 144746 - DNA, 25 bp, Rattus norvegicus
aggccagctcctggctgatgacaaa

SEQ ID NO: 144747 - DNA, 25 bp, Rattus norvegicus
aggccagctctgacacctgggaaag

SEQ ID NO: 144748 - DNA, 25 bp, Rattus norvegicus
aggccagctctgtcacctgggaaag

SEQ ID NO: 144749 - DNA, 25 bp, Rattus norvegicus
aggccagctcttactgcttccaaac

SEQ ID NO: 144750 - DNA, 25 bp, Rattus norvegicus
aggccagctctttctgcttccaaac

SEQ ID NO: 144751 - DNA, 25 bp, Rattus norvegicus
aggccagctgtgacatgttttcgaa

SEQ ID NO: 144752 - DNA, 25 bp, Rattus norvegicus
aggccagctgtgtcatgttttcgaa

SEQ ID NO: 144753 - DNA, 25 bp, Rattus norvegicus
aggccagcttccagagtatgaccag

SEQ ID NO: 144754 - DNA, 25 bp, Rattus norvegicus
aggccagcttccatctcaagacaag

SEQ ID NO: 144755 - DNA, 25 bp, Rattus norvegicus
aggccagcttcctgagtatgaccag

SEQ ID NO: 144756 - DNA, 25 bp, Rattus norvegicus
aggccagcttccttctcaagacaag

SEQ ID NO: 144757 - DNA, 25 bp, Rattus norvegicus
aggccagcttctccttggaggacac

SEQ ID NO: 144758 - DNA, 25 bp, Rattus norvegicus
aggccagcttctgcttggaggacac

SEQ ID NO: 144759 - DNA, 25 bp, Rattus norvegicus
aggccagcttggatctgctcctgta

SEQ ID NO: 144760 - DNA, 25 bp, Rattus norvegicus
aggccagcttggctcagttgatcaa

SEQ ID NO: 144761 - DNA, 25 bp, Rattus norvegicus
aggccagcttgggtcagttgatcaa

SEQ ID NO: 144762 - DNA, 25 bp, Rattus norvegicus
aggccagcttggttctgctcctgta

SEQ ID NO: 144763 - DNA, 25 bp, Rattus norvegicus
aggccaggatcgatgtaagtactaa

SEQ ID NO: 144764 - DNA, 25 bp, Rattus norvegicus
aggccaggatcgttgtaagtactaa

SEQ ID NO: 144765 - DNA, 25 bp, Rattus norvegicus
aggccaggatctacagagtgaaaat

SEQ ID NO: 144766 - DNA, 25 bp, Rattus norvegicus
aggccaggatcttcagagtgaaaat

SEQ ID NO: 144767 - DNA, 25 bp, Rattus norvegicus
aggccaggccaaagaccggtagaag

SEQ ID NO: 144768 - DNA, 25 bp, Rattus norvegicus
aggccaggccaatgaccggtagaag

SEQ ID NO: 144769 - DNA, 25 bp, Rattus norvegicus
aggccaggccacaaggaggaatgca

SEQ ID NO: 144770 - DNA, 25 bp, Rattus norvegicus
aggccaggccactaggaggaatgca

SEQ ID NO: 144771 - DNA, 25 bp, Rattus norvegicus
aggccaggccagactgtgctaatgc

SEQ ID NO: 144772 - DNA, 25 bp, Rattus norvegicus
aggccaggccagtctgtgctaatgc

SEQ ID NO: 144773 - DNA, 25 bp, Rattus norvegicus
aggccaggcccaaatttctgaatgt

SEQ ID NO: 144774 - DNA, 25 bp, Rattus norvegicus
aggccaggcccatatttctgaatgt

SEQ ID NO: 144775 - DNA, 25 bp, Rattus norvegicus
aggccaggcctactgcagcacaaga

SEQ ID NO: 144776 - DNA, 25 bp, Rattus norvegicus
aggccaggcctagtgcagcacaaga

SEQ ID NO: 144777 - DNA, 25 bp, Rattus norvegicus
aggccaggccttcagccacagggca

SEQ ID NO: 144778 - DNA, 25 bp, Rattus norvegicus
aggccaggccttgagccacagggca

SEQ ID NO: 144779 - DNA, 25 bp, Rattus norvegicus
aggccaggcgagcacagagtcttat

SEQ ID NO: 144780 - DNA, 25 bp, Rattus norvegicus
aggccaggcgaggacagagtcttat

SEQ ID NO: 144781 - DNA, 25 bp, Rattus norvegicus
aggccaggctccactatgggaacac

SEQ ID NO: 144782 - DNA, 25 bp, Rattus norvegicus
aggccaggctccattttgctttgag

SEQ ID NO: 144783 - DNA, 25 bp, Rattus norvegicus
aggccaggctcctctatgggaacac

SEQ ID NO: 144784 - DNA, 25 bp, Rattus norvegicus
aggccaggctcctttttgctttgag

SEQ ID NO: 144785 - DNA, 25 bp, Rattus norvegicus
aggccaggctgaacatcctacggga

SEQ ID NO: 144786 - DNA, 25 bp, Rattus norvegicus
aggccaggctgaatcgggctgcttc

SEQ ID NO: 144787 - DNA, 25 bp, Rattus norvegicus
aggccaggctgatcatcctacggga

SEQ ID NO: 144788 - DNA, 25 bp, Rattus norvegicus
aggccaggctgattcgggctgcttc

SEQ ID NO: 144789 - DNA, 25 bp, Rattus norvegicus
aggccaggcttgactgtggtgacct

SEQ ID NO: 144790 - DNA, 25 bp, Rattus norvegicus
aggccaggcttgtctgtggtgacct

SEQ ID NO: 144791 - DNA, 25 bp, Rattus norvegicus
aggccagggagtcctcaggtctaat

SEQ ID NO: 144792 - DNA, 25 bp, Rattus norvegicus
aggccagggagtgctcaggtctaat

SEQ ID NO: 144793 - DNA, 25 bp, Rattus norvegicus
aggccagggtgtatgaagctcacaa

SEQ ID NO: 144794 - DNA, 25 bp, Rattus norvegicus
aggccagggtgtttgaagctcacaa

SEQ ID NO: 144795 - DNA, 25 bp, Rattus norvegicus
aggccaggtctgcatgtcagcagtt

SEQ ID NO: 144796 - DNA, 25 bp, Rattus norvegicus
aggccaggtctggatgtcagcagtt

SEQ ID NO: 144797 - DNA, 25 bp, Rattus norvegicus
aggccaggtgtgacctcatcttttt

SEQ ID NO: 144798 - DNA, 25 bp, Rattus norvegicus
aggccaggtgtgtcctcatcttttt

SEQ ID NO: 144799 - DNA, 25 bp, Rattus norvegicus
aggccaggttcgagaagttcgtaga

SEQ ID NO: 144800 - DNA, 25 bp, Rattus norvegicus
aggccaggttcgtgaagttcgtaga

SEQ ID NO: 144801 - DNA, 25 bp, Rattus norvegicus
aggccagtatggatcctcactcttg

SEQ ID NO: 144802 - DNA, 25 bp, Rattus norvegicus
aggccagtatggttcctcactcttg

SEQ ID NO: 144803 - DNA, 25 bp, Rattus norvegicus
aggccagtcaacagagcacgttcca

SEQ ID NO: 144804 - DNA, 25 bp, Rattus norvegicus
aggccagtcaactgagcacgttcca

SEQ ID NO: 144805 - DNA, 25 bp, Rattus norvegicus
aggccagtccagatacacagtatga

SEQ ID NO: 144806 - DNA, 25 bp, Rattus norvegicus
aggccagtccagttacacagtatga

SEQ ID NO: 144807 - DNA, 25 bp, Rattus norvegicus
aggccagtctaccagcacatgtgag

SEQ ID NO: 144808 - DNA, 25 bp, Rattus norvegicus
aggccagtctacgagcacatgtgag

SEQ ID NO: 144809 - DNA, 25 bp, Rattus norvegicus
aggccagtctccattctgagggctg

SEQ ID NO: 144810 - DNA, 25 bp, Rattus norvegicus
aggccagtctcctttctgagggctg

SEQ ID NO: 144811 - DNA, 25 bp, Rattus norvegicus
aggccagtcttaagaaattcggatg

SEQ ID NO: 144812 - DNA, 25 bp, Rattus norvegicus
aggccagtcttatgaaattcggatg

SEQ ID NO: 144813 - DNA, 25 bp, Rattus norvegicus
aggccagtctttattagctatcttt

SEQ ID NO: 144814 - DNA, 25 bp, Rattus norvegicus
aggccagtcttttttagctatcttt

SEQ ID NO: 144815 - DNA, 25 bp, Rattus norvegicus
aggccagtgcccagctctagagaaa

SEQ ID NO: 144816 - DNA, 25 bp, Rattus norvegicus
aggccagtgccctgctctagagaaa

SEQ ID NO: 144817 - DNA, 25 bp, Rattus norvegicus
aggccagtgtcaatggcctctgggc

SEQ ID NO: 144818 - DNA, 25 bp, Rattus norvegicus
aggccagtgtcattggcctctgggc

SEQ ID NO: 144819 - DNA, 25 bp, Rattus norvegicus
aggccagtgtggagactttacctgt

SEQ ID NO: 144820 - DNA, 25 bp, Rattus norvegicus
aggccagtgtggtgactttacctgt

SEQ ID NO: 144821 - DNA, 25 bp, Rattus norvegicus
aggccagttcagcatgtctgacaat

SEQ ID NO: 144822 - DNA, 25 bp, Rattus norvegicus
aggccagttcaggatgtctgacaat

SEQ ID NO: 144823 - DNA, 25 bp, Rattus norvegicus
aggccagttgaacagtgcttctcat

SEQ ID NO: 144824 - DNA, 25 bp, Rattus norvegicus
aggccagttgaagagtgcttctcat

SEQ ID NO: 144825 - DNA, 25 bp, Rattus norvegicus
aggccagttgatctgctctgtttta

SEQ ID NO: 144826 - DNA, 25 bp, Rattus norvegicus
aggccagttgatgtgctctgtttta

SEQ ID NO: 144827 - DNA, 25 bp, Rattus norvegicus
aggccagttggcaggtttaggtcaa

SEQ ID NO: 144828 - DNA, 25 bp, Rattus norvegicus
aggccagttggcatgcaagtctgtg

SEQ ID NO: 144829 - DNA, 25 bp, Rattus norvegicus
aggccagttggctggtttaggtcaa

SEQ ID NO: 144830 - DNA, 25 bp, Rattus norvegicus
aggccagttggcttgcaagtctgtg

SEQ ID NO: 144831 - DNA, 25 bp, Rattus norvegicus
aggccagtttgtactacacattgag

SEQ ID NO: 144832 - DNA, 25 bp, Rattus norvegicus
aggccagtttgttctacacattgag

SEQ ID NO: 144833 - DNA, 25 bp, Rattus norvegicus
aggccagttttccagcgtgtactgc

SEQ ID NO: 144834 - DNA, 25 bp, Rattus norvegicus
aggccagttttcgagcgtgtactgc

SEQ ID NO: 144835 - DNA, 25 bp, Rattus norvegicus
aggccataacatcccagttcacgta

SEQ ID NO: 144836 - DNA, 25 bp, Rattus norvegicus
aggccataacatgccagttcacgta

SEQ ID NO: 144837 - DNA, 25 bp, Rattus norvegicus
aggccatagcagacctgacctgaat

SEQ ID NO: 144838 - DNA, 25 bp, Rattus norvegicus
aggccatagcagtcctgacctgaat

SEQ ID NO: 144839 - DNA, 25 bp, Rattus norvegicus
aggccatcaccaatgaggctgagcc

SEQ ID NO: 144840 - DNA, 25 bp, Rattus norvegicus
aggccatcaccattgaggctgagcc

SEQ ID NO: 144841 - DNA, 25 bp, Rattus norvegicus
aggccatcagagcacctacgtgtag

SEQ ID NO: 144842 - DNA, 25 bp, Rattus norvegicus
aggccatcagaggacctacgtgtag

SEQ ID NO: 144843 - DNA, 25 bp, Rattus norvegicus
aggccatcagccaagatagaaaaca

SEQ ID NO: 144844 - DNA, 25 bp, Rattus norvegicus
aggccatcagcctagatagaaaaca

SEQ ID NO: 144845 - DNA, 25 bp, Rattus norvegicus
aggccatcaggtatgctcagcagat

SEQ ID NO: 144846 - DNA, 25 bp, Rattus norvegicus
aggccatcaggtttgctcagcagat

SEQ ID NO: 144847 - DNA, 25 bp, Rattus norvegicus
aggccatcagtgaggttctgcagga

SEQ ID NO: 144848 - DNA, 25 bp, Rattus norvegicus
aggccatcagtgtggttctgcagga

SEQ ID NO: 144849 - DNA, 25 bp, Rattus norvegicus
aggccatcatgcatcgttcagcaga

SEQ ID NO: 144850 - DNA, 25 bp, Rattus norvegicus
aggccatcatgcttcgttcagcaga

SEQ ID NO: 144851 - DNA, 25 bp, Rattus norvegicus
aggccatcatggacttcatagagtt

SEQ ID NO: 144852 - DNA, 25 bp, Rattus norvegicus
aggccatcatggtcttcatagagtt

SEQ ID NO: 144853 - DNA, 25 bp, Rattus norvegicus
aggccatccagactcctagtgagga

SEQ ID NO: 144854 - DNA, 25 bp, Rattus norvegicus
aggccatccagagtcctagtgagga

SEQ ID NO: 144855 - DNA, 25 bp, Rattus norvegicus
aggccatccagcatatttttgttgt

SEQ ID NO: 144856 - DNA, 25 bp, Rattus norvegicus
aggccatccagcttatttttgttgt

SEQ ID NO: 144857 - DNA, 25 bp, Rattus norvegicus
aggccatccatcagtgactaaggaa

SEQ ID NO: 144858 - DNA, 25 bp, Rattus norvegicus
aggccatccatctgtgactaaggaa

SEQ ID NO: 144859 - DNA, 25 bp, Rattus norvegicus
aggccatccctcaaccagcccaagt

SEQ ID NO: 144860 - DNA, 25 bp, Rattus norvegicus
aggccatccctctaccagcccaagt

SEQ ID NO: 144861 - DNA, 25 bp, Rattus norvegicus
aggccatcccttcgaatactttgtg

SEQ ID NO: 144862 - DNA, 25 bp, Rattus norvegicus
aggccatcccttggaatactttgtg

SEQ ID NO: 144863 - DNA, 25 bp, Rattus norvegicus
aggccatcctcaaagcagccagtac

SEQ ID NO: 144864 - DNA, 25 bp, Rattus norvegicus
aggccatcctcatagcagccagtac

SEQ ID NO: 144865 - DNA, 25 bp, Rattus norvegicus
aggccatcctgaaagactccatcag

SEQ ID NO: 144866 - DNA, 25 bp, Rattus norvegicus
aggccatcctgaacacttgggcaag

SEQ ID NO: 144867 - DNA, 25 bp, Rattus norvegicus
aggccatcctgacttcctgcggaag

SEQ ID NO: 144868 - DNA, 25 bp, Rattus norvegicus
aggccatcctgagttcctgcggaag

SEQ ID NO: 144869 - DNA, 25 bp, Rattus norvegicus
aggccatcctgatagactccatcag

SEQ ID NO: 144870 - DNA, 25 bp, Rattus norvegicus
aggccatcctgatcacttgggcaag

SEQ ID NO: 144871 - DNA, 25 bp, Rattus norvegicus
aggccatccttgctcacctgataag

SEQ ID NO: 144872 - DNA, 25 bp, Rattus norvegicus
aggccatccttggtcacctgataag

SEQ ID NO: 144873 - DNA, 25 bp, Rattus norvegicus
aggccatcggaaactcttttgtcag

SEQ ID NO: 144874 - DNA, 25 bp, Rattus norvegicus
aggccatcggaatctcttttgtcag

SEQ ID NO: 144875 - DNA, 25 bp, Rattus norvegicus
aggccatcggccatctcgtggctat

SEQ ID NO: 144876 - DNA, 25 bp, Rattus norvegicus
aggccatcggccttctcgtggctat

SEQ ID NO: 144877 - DNA, 25 bp, Rattus norvegicus
aggccatcgtgaatctgctcaaact

SEQ ID NO: 144878 - DNA, 25 bp, Rattus norvegicus
aggccatcgtgattctgctcaaact

SEQ ID NO: 144879 - DNA, 25 bp, Rattus norvegicus
aggccatcgtgtacctggcgcagag

SEQ ID NO: 144880 - DNA, 25 bp, Rattus norvegicus
aggccatcgtgttcctggcgcagag

SEQ ID NO: 144881 - DNA, 25 bp, Rattus norvegicus
aggccatctagtcaatatacccgga

SEQ ID NO: 144882 - DNA, 25 bp, Rattus norvegicus
aggccatctagtgaatatacccgga

SEQ ID NO: 144883 - DNA, 25 bp, Rattus norvegicus
aggccatgacctctttctgtttttg

SEQ ID NO: 144884 - DNA, 25 bp, Rattus norvegicus
aggccatgacctgtttctgtttttg

SEQ ID NO: 144885 - DNA, 25 bp, Rattus norvegicus
aggccatgactgctcctctgaaaag

SEQ ID NO: 144886 - DNA, 25 bp, Rattus norvegicus
aggccatgactggtcctctgaaaag

SEQ ID NO: 144887 - DNA, 25 bp, Rattus norvegicus
aggccatgagagacctcgtggaaaa

SEQ ID NO: 144888 - DNA, 25 bp, Rattus norvegicus
aggccatgagagtcctcgtggaaaa

SEQ ID NO: 144889 - DNA, 25 bp, Rattus norvegicus
aggccatgcaatctgttcactgatg

SEQ ID NO: 144890 - DNA, 25 bp, Rattus norvegicus
aggccatgcaatgtgttcactgatg

SEQ ID NO: 144891 - DNA, 25 bp, Rattus norvegicus
aggccatgcagaacatgctagacag

SEQ ID NO: 144892 - DNA, 25 bp, Rattus norvegicus
aggccatgcagatcatgctagacag

SEQ ID NO: 144893 - DNA, 25 bp, Rattus norvegicus
aggccatgcagtacctaactccagg

SEQ ID NO: 144894 - DNA, 25 bp, Rattus norvegicus
aggccatgcagttcctaactccagg

SEQ ID NO: 144895 - DNA, 25 bp, Rattus norvegicus
aggccatgctaaagtgcgcgcacag

SEQ ID NO: 144896 - DNA, 25 bp, Rattus norvegicus
aggccatgctaatgtgcgcgcacag

SEQ ID NO: 144897 - DNA, 25 bp, Rattus norvegicus
aggccatgctcactggaccctgaag

SEQ ID NO: 144898 - DNA, 25 bp, Rattus norvegicus
aggccatgctcagtggaccctgaag

SEQ ID NO: 144899 - DNA, 25 bp, Rattus norvegicus
aggccatgctgaactcaggactcaa

SEQ ID NO: 144900 - DNA, 25 bp, Rattus norvegicus
aggccatgctgacaaacatctgcca

SEQ ID NO: 144901 - DNA, 25 bp, Rattus norvegicus
aggccatgctgagaaacatctgcca

SEQ ID NO: 144902 - DNA, 25 bp, Rattus norvegicus
aggccatgctgatctcaggactcaa

SEQ ID NO: 144903 - DNA, 25 bp, Rattus norvegicus
aggccatgctggaccgccccttggt

SEQ ID NO: 144904 - DNA, 25 bp, Rattus norvegicus
aggccatgctggtccgccccttggt

SEQ ID NO: 144905 - DNA, 25 bp, Rattus norvegicus
aggccatgctgtatctttaccactc

SEQ ID NO: 144906 - DNA, 25 bp, Rattus norvegicus
aggccatgctgtttctttaccactc

SEQ ID NO: 144907 - DNA, 25 bp, Rattus norvegicus
aggccatggcaccttgacagacgtt

SEQ ID NO: 144908 - DNA, 25 bp, Rattus norvegicus
aggccatggcacgttgacagacgtt

SEQ ID NO: 144909 - DNA, 25 bp, Rattus norvegicus
aggccatggcccatggaggatctta

SEQ ID NO: 144910 - DNA, 25 bp, Rattus norvegicus
aggccatggcccttggaggatctta

SEQ ID NO: 144911 - DNA, 25 bp, Rattus norvegicus
aggccatggctgagagcctctcaca

SEQ ID NO: 144912 - DNA, 25 bp, Rattus norvegicus
aggccatggctgtgagcctctcaca

SEQ ID NO: 144913 - DNA, 25 bp, Rattus norvegicus
aggccatggttaattcttaaggcaa

SEQ ID NO: 144914 - DNA, 25 bp, Rattus norvegicus
aggccatggttatttcttaaggcaa

SEQ ID NO: 144915 - DNA, 25 bp, Rattus norvegicus
aggccatgtaagcatggtccccttc

SEQ ID NO: 144916 - DNA, 25 bp, Rattus norvegicus
aggccatgtaaggatggtccccttc

SEQ ID NO: 144917 - DNA, 25 bp, Rattus norvegicus
aggccatgtcagcagacgcagccgc

SEQ ID NO: 144918 - DNA, 25 bp, Rattus norvegicus
aggccatgtcaggagacgcagccgc

SEQ ID NO: 144919 - DNA, 25 bp, Rattus norvegicus
aggccatgtcatcattcttgctgga

SEQ ID NO: 144920 - DNA, 25 bp, Rattus norvegicus
aggccatgtcatgattcttgctgga

SEQ ID NO: 144921 - DNA, 25 bp, Rattus norvegicus
aggccatgtcctatgagtgtgtgaa

SEQ ID NO: 144922 - DNA, 25 bp, Rattus norvegicus
aggccatgtcctttgagtgtgtgaa

SEQ ID NO: 144923 - DNA, 25 bp, Rattus norvegicus
aggccatgttgactggtccaggtca

SEQ ID NO: 144924 - DNA, 25 bp, Rattus norvegicus
aggccatgttgagtggtccaggtca

SEQ ID NO: 144925 - DNA, 25 bp, Rattus norvegicus
aggccattaaggactcttcttttct

SEQ ID NO: 144926 - DNA, 25 bp, Rattus norvegicus
aggccattaaggtctcttcttttct

SEQ ID NO: 144927 - DNA, 25 bp, Rattus norvegicus
aggccattaccaacatctggaccag

SEQ ID NO: 144928 - DNA, 25 bp, Rattus norvegicus
aggccattaccatcatctggaccag

SEQ ID NO: 144929 - DNA, 25 bp, Rattus norvegicus
aggccattcatgcatccctgaagac

SEQ ID NO: 144930 - DNA, 25 bp, Rattus norvegicus
aggccattcatggatccctgaagac

SEQ ID NO: 144931 - DNA, 25 bp, Rattus norvegicus
aggccattgagaactaccctctagc

SEQ ID NO: 144932 - DNA, 25 bp, Rattus norvegicus
aggccattgagatctaccctctagc

SEQ ID NO: 144933 - DNA, 25 bp, Rattus norvegicus
aggccattggccatcgaaactacca

SEQ ID NO: 144934 - DNA, 25 bp, Rattus norvegicus
aggccattggccttcgaaactacca

SEQ ID NO: 144935 - DNA, 25 bp, Rattus norvegicus
aggccattgtaacccaccatgttgg

SEQ ID NO: 144936 - DNA, 25 bp, Rattus norvegicus
aggccattgtaagccaccatgttgg

SEQ ID NO: 144937 - DNA, 25 bp, Rattus norvegicus
aggccatttggtatctctgccctaa

SEQ ID NO: 144938 - DNA, 25 bp, Rattus norvegicus
aggccatttggtttctctgccctaa

SEQ ID NO: 144939 - DNA, 25 bp, Rattus norvegicus
aggccatttgtcatgtctgaatgaa

SEQ ID NO: 144940 - DNA, 25 bp, Rattus norvegicus
aggccatttgtcttgtctgaatgaa

SEQ ID NO: 144941 - DNA, 25 bp, Rattus norvegicus
aggccattttcacccaatagacacc

SEQ ID NO: 144942 - DNA, 25 bp, Rattus norvegicus
aggccattttcagccaatagacacc

SEQ ID NO: 144943 - DNA, 25 bp, Rattus norvegicus
aggccattttgccatccgtcagaag

SEQ ID NO: 144944 - DNA, 25 bp, Rattus norvegicus
aggccattttgcgatccgtcagaag

SEQ ID NO: 144945 - DNA, 25 bp, Rattus norvegicus
aggccattttggaaggtcattgagt

SEQ ID NO: 144946 - DNA, 25 bp, Rattus norvegicus
aggccattttggtaggtcattgagt

SEQ ID NO: 144947 - DNA, 25 bp, Rattus norvegicus
aggccatttttgcacagccttcttc

SEQ ID NO: 144948 - DNA, 25 bp, Rattus norvegicus
aggccatttttggacagccttcttc

SEQ ID NO: 144949 - DNA, 25 bp, Rattus norvegicus
aggcccaaacccagagcttaaagca

SEQ ID NO: 144950 - DNA, 25 bp, Rattus norvegicus
aggcccaaaccctgagcttaaagca

SEQ ID NO: 144951 - DNA, 25 bp, Rattus norvegicus
aggcccaaagatatatcaacttcaa

SEQ ID NO: 144952 - DNA, 25 bp, Rattus norvegicus
aggcccaaagatcgagctcttcatt

SEQ ID NO: 144953 - DNA, 25 bp, Rattus norvegicus
aggcccaaagatggagctcttcatt

SEQ ID NO: 144954 - DNA, 25 bp, Rattus norvegicus
aggcccaaagatttatcaacttcaa

SEQ ID NO: 144955 - DNA, 25 bp, Rattus norvegicus
aggcccaacacacacccaggaggtt

SEQ ID NO: 144956 - DNA, 25 bp, Rattus norvegicus
aggcccaacacagacccaggaggtt

SEQ ID NO: 144957 - DNA, 25 bp, Rattus norvegicus
aggcccaacaccaaaccaaattatg

SEQ ID NO: 144958 - DNA, 25 bp, Rattus norvegicus
aggcccaacacctaaccaaattatg

SEQ ID NO: 144959 - DNA, 25 bp, Rattus norvegicus
aggcccaacagtacagtacccaagg

SEQ ID NO: 144960 - DNA, 25 bp, Rattus norvegicus
aggcccaacagttcagtacccaagg

SEQ ID NO: 144961 - DNA, 25 bp, Rattus norvegicus
aggcccaacggacgccatcttcaag

SEQ ID NO: 144962 - DNA, 25 bp, Rattus norvegicus
aggcccaacggaggccatcttcaag

SEQ ID NO: 144963 - DNA, 25 bp, Rattus norvegicus
aggcccaagacacttctccattata

SEQ ID NO: 144964 - DNA, 25 bp, Rattus norvegicus
aggcccaagacagttctccattata

SEQ ID NO: 144965 - DNA, 25 bp, Rattus norvegicus
aggcccaagatgaaacccaccagtg

SEQ ID NO: 144966 - DNA, 25 bp, Rattus norvegicus
aggcccaagatgtaacccaccagtg

SEQ ID NO: 144967 - DNA, 25 bp, Rattus norvegicus
aggcccaagctgacctggctcagga

SEQ ID NO: 144968 - DNA, 25 bp, Rattus norvegicus
aggcccaagctgtcctggctcagga

SEQ ID NO: 144969 - DNA, 25 bp, Rattus norvegicus
aggcccaaggacctgacttctgacg

SEQ ID NO: 144970 - DNA, 25 bp, Rattus norvegicus
aggcccaaggacgtgacttctgacg

SEQ ID NO: 144971 - DNA, 25 bp, Rattus norvegicus
aggcccaaggttcctgagtcattcc

SEQ ID NO: 144972 - DNA, 25 bp, Rattus norvegicus
aggcccaaggttgctgagtcattcc

SEQ ID NO: 144973 - DNA, 25 bp, Rattus norvegicus
aggcccacaacgacctgttgcgtac

SEQ ID NO: 144974 - DNA, 25 bp, Rattus norvegicus
aggcccacaacgtcctgttgcgtac

SEQ ID NO: 144975 - DNA, 25 bp, Rattus norvegicus
aggcccacagccagttgagtctaca

SEQ ID NO: 144976 - DNA, 25 bp, Rattus norvegicus
aggcccacagcctgttgagtctaca

SEQ ID NO: 144977 - DNA, 25 bp, Rattus norvegicus
aggcccacaggccattctgttagag

SEQ ID NO: 144978 - DNA, 25 bp, Rattus norvegicus
aggcccacaggcgattctgttagag

SEQ ID NO: 144979 - DNA, 25 bp, Rattus norvegicus
aggcccaccgagatatctgtcccaa

SEQ ID NO: 144980 - DNA, 25 bp, Rattus norvegicus
aggcccaccgagttatctgtcccaa

SEQ ID NO: 144981 - DNA, 25 bp, Rattus norvegicus
aggcccacctagagactcctttgat

SEQ ID NO: 144982 - DNA, 25 bp, Rattus norvegicus
aggcccacctagtgactcctttgat

SEQ ID NO: 144983 - DNA, 25 bp, Rattus norvegicus
aggcccacctcacggagttgcttga

SEQ ID NO: 144984 - DNA, 25 bp, Rattus norvegicus
aggcccacctcagggagttgcttga

SEQ ID NO: 144985 - DNA, 25 bp, Rattus norvegicus
aggcccaccttcagagagctcagga

SEQ ID NO: 144986 - DNA, 25 bp, Rattus norvegicus
aggcccaccttctgagagctcagga

SEQ ID NO: 144987 - DNA, 25 bp, Rattus norvegicus
aggcccacggacaggacacgtctga

SEQ ID NO: 144988 - DNA, 25 bp, Rattus norvegicus
aggcccacggactggacacgtctga

SEQ ID NO: 144989 - DNA, 25 bp, Rattus norvegicus
aggcccacgggtatcagttctgtgt

SEQ ID NO: 144990 - DNA, 25 bp, Rattus norvegicus
aggcccacgggtttcagttctgtgt

SEQ ID NO: 144991 - DNA, 25 bp, Rattus norvegicus
aggcccactaccctgtgaaggtgtc

SEQ ID NO: 144992 - DNA, 25 bp, Rattus norvegicus
aggcccactaccgtgtgaaggtgtc

SEQ ID NO: 144993 - DNA, 25 bp, Rattus norvegicus
aggcccactcacctatggagctgtg

SEQ ID NO: 144994 - DNA, 25 bp, Rattus norvegicus
aggcccactcacgtatggagctgtg

SEQ ID NO: 144995 - DNA, 25 bp, Rattus norvegicus
aggcccactcctagtttagaagcca

SEQ ID NO: 144996 - DNA, 25 bp, Rattus norvegicus
aggcccactccttgtttagaagcca

SEQ ID NO: 144997 - DNA, 25 bp, Rattus norvegicus
aggcccagacagactactaccaaaa

SEQ ID NO: 144998 - DNA, 25 bp, Rattus norvegicus
aggcccagacagtctactaccaaaa

SEQ ID NO: 144999 - DNA, 25 bp, Rattus norvegicus
aggcccagagacatggtacagagtt

SEQ ID NO: 145000 - DNA, 25 bp, Rattus norvegicus
aggcccagagacttggtacagagtt

SEQ ID NO: 145001 - DNA, 25 bp, Rattus norvegicus
aggcccagagtaactctcccagaag

SEQ ID NO: 145002 - DNA, 25 bp, Rattus norvegicus
aggcccagagtatctctcccagaag

SEQ ID NO: 145003 - DNA, 25 bp, Rattus norvegicus
aggcccagccagatggaaattctca

SEQ ID NO: 145004 - DNA, 25 bp, Rattus norvegicus
aggcccagccagttggaaattctca

SEQ ID NO: 145005 - DNA, 25 bp, Rattus norvegicus
aggcccagccatccaaggagacaat

SEQ ID NO: 145006 - DNA, 25 bp, Rattus norvegicus
aggcccagccatgcaaggagacaat

SEQ ID NO: 145007 - DNA, 25 bp, Rattus norvegicus
aggcccagccttagccaggatgagg

SEQ ID NO: 145008 - DNA, 25 bp, Rattus norvegicus
aggcccagcctttgccaggatgagg

SEQ ID NO: 145009 - DNA, 25 bp, Rattus norvegicus
aggcccagctcgatgtgaactgcta

SEQ ID NO: 145010 - DNA, 25 bp, Rattus norvegicus
aggcccagctcgttgtgaactgcta

SEQ ID NO: 145011 - DNA, 25 bp, Rattus norvegicus
aggcccagctggagttacatccaac

SEQ ID NO: 145012 - DNA, 25 bp, Rattus norvegicus
aggcccagctggtgttacatccaac

SEQ ID NO: 145013 - DNA, 25 bp, Rattus norvegicus
aggcccagcttgcttattacttttg

SEQ ID NO: 145014 - DNA, 25 bp, Rattus norvegicus
aggcccagcttggttattacttttg

SEQ ID NO: 145015 - DNA, 25 bp, Rattus norvegicus
aggcccagctttagaccttagtgtg

SEQ ID NO: 145016 - DNA, 25 bp, Rattus norvegicus
aggcccagcttttgaccttagtgtg

SEQ ID NO: 145017 - DNA, 25 bp, Rattus norvegicus
aggcccaggaatcctcattgttgcc

SEQ ID NO: 145018 - DNA, 25 bp, Rattus norvegicus
aggcccaggaatgctcattgttgcc

SEQ ID NO: 145019 - DNA, 25 bp, Rattus norvegicus
aggcccaggagaacttgaagcgagt

SEQ ID NO: 145020 - DNA, 25 bp, Rattus norvegicus
aggcccaggagatcttgaagcgagt

SEQ ID NO: 145021 - DNA, 25 bp, Rattus norvegicus
aggcccaggagcagtcagaatggat

SEQ ID NO: 145022 - DNA, 25 bp, Rattus norvegicus
aggcccaggagctgtcagaatggat

SEQ ID NO: 145023 - DNA, 25 bp, Rattus norvegicus
aggcccaggaggactcattcgagga

SEQ ID NO: 145024 - DNA, 25 bp, Rattus norvegicus
aggcccaggaggtctcattcgagga

SEQ ID NO: 145025 - DNA, 25 bp, Rattus norvegicus
aggcccaggatacagaccttgcaga

SEQ ID NO: 145026 - DNA, 25 bp, Rattus norvegicus
aggcccaggatagagaccttgcaga

SEQ ID NO: 145027 - DNA, 25 bp, Rattus norvegicus
aggcccaggcaacctcgagcaggaa

SEQ ID NO: 145028 - DNA, 25 bp, Rattus norvegicus
aggcccaggcaagctcgagcaggaa

SEQ ID NO: 145029 - DNA, 25 bp, Rattus norvegicus
aggcccagggctagttagataattg

SEQ ID NO: 145030 - DNA, 25 bp, Rattus norvegicus
aggcccagggcttgttagataattg

SEQ ID NO: 145031 - DNA, 25 bp, Rattus norvegicus
aggcccaggtccagagacttggagt

SEQ ID NO: 145032 - DNA, 25 bp, Rattus norvegicus
aggcccaggtcctgagacttggagt

SEQ ID NO: 145033 - DNA, 25 bp, Rattus norvegicus
aggcccaggtttatatcctcagcaa

SEQ ID NO: 145034 - DNA, 25 bp, Rattus norvegicus
aggcccaggtttttatcctcagcaa

SEQ ID NO: 145035 - DNA, 25 bp, Rattus norvegicus
aggcccagtatgacttctctttgag

SEQ ID NO: 145036 - DNA, 25 bp, Rattus norvegicus
aggcccagtatgtcttctctttgag

SEQ ID NO: 145037 - DNA, 25 bp, Rattus norvegicus
aggcccagtcctaagtgcaaatgaa

SEQ ID NO: 145038 - DNA, 25 bp, Rattus norvegicus
aggcccagtccttagtgcaaatgaa

SEQ ID NO: 145039 - DNA, 25 bp, Rattus norvegicus
aggcccagtcgtactcttagacatg

SEQ ID NO: 145040 - DNA, 25 bp, Rattus norvegicus
aggcccagtcgttctcttagacatg

SEQ ID NO: 145041 - DNA, 25 bp, Rattus norvegicus
aggcccagtctaaaaccatggcttg

SEQ ID NO: 145042 - DNA, 25 bp, Rattus norvegicus
aggcccagtctataaccatggcttg

SEQ ID NO: 145043 - DNA, 25 bp, Rattus norvegicus
aggcccagtgacaatggaatcccca

SEQ ID NO: 145044 - DNA, 25 bp, Rattus norvegicus
aggcccagtgactatggaatcccca

SEQ ID NO: 145045 - DNA, 25 bp, Rattus norvegicus
aggcccagtgtcagcagaagttctc

SEQ ID NO: 145046 - DNA, 25 bp, Rattus norvegicus
aggcccagtgtctgcagaagttctc

SEQ ID NO: 145047 - DNA, 25 bp, Rattus norvegicus
aggcccagtgttaaggactgcccac

SEQ ID NO: 145048 - DNA, 25 bp, Rattus norvegicus
aggcccagtgtttaggactgcccac

SEQ ID NO: 145049 - DNA, 25 bp, Rattus norvegicus
aggcccataaccacttctggtacaa

SEQ ID NO: 145050 - DNA, 25 bp, Rattus norvegicus
aggcccataacccttgattgctttt

SEQ ID NO: 145051 - DNA, 25 bp, Rattus norvegicus
aggcccataaccgttgattgctttt

SEQ ID NO: 145052 - DNA, 25 bp, Rattus norvegicus
aggcccataacctcttctggtacaa

SEQ ID NO: 145053 - DNA, 25 bp, Rattus norvegicus
aggcccatcccacacatgtatgtga

SEQ ID NO: 145054 - DNA, 25 bp, Rattus norvegicus
aggcccatcccagacatgtatgtga

SEQ ID NO: 145055 - DNA, 25 bp, Rattus norvegicus
aggcccatctccagaggtcattatc

SEQ ID NO: 145056 - DNA, 25 bp, Rattus norvegicus
aggcccatctccagcgaggtgtttt

SEQ ID NO: 145057 - DNA, 25 bp, Rattus norvegicus
aggcccatctcctgaggtcattatc

SEQ ID NO: 145058 - DNA, 25 bp, Rattus norvegicus
aggcccatctcctgcgaggtgtttt

SEQ ID NO: 145059 - DNA, 25 bp, Rattus norvegicus
aggcccatgaaccaaaacgacatat

SEQ ID NO: 145060 - DNA, 25 bp, Rattus norvegicus
aggcccatgaacgaaaacgacatat

SEQ ID NO: 145061 - DNA, 25 bp, Rattus norvegicus
aggcccatggagcaattcctgctgc

SEQ ID NO: 145062 - DNA, 25 bp, Rattus norvegicus
aggcccatggaggaattcctgctgc

SEQ ID NO: 145063 - DNA, 25 bp, Rattus norvegicus
aggcccatgtatacggagcaggagc

SEQ ID NO: 145064 - DNA, 25 bp, Rattus norvegicus
aggcccatgtattcggagcaggagc

SEQ ID NO: 145065 - DNA, 25 bp, Rattus norvegicus
aggcccattcccaaattgtgtcatg

SEQ ID NO: 145066 - DNA, 25 bp, Rattus norvegicus
aggcccattccctaattgtgtcatg

SEQ ID NO: 145067 - DNA, 25 bp, Rattus norvegicus
aggcccattctcaataaactctgaa

SEQ ID NO: 145068 - DNA, 25 bp, Rattus norvegicus
aggcccattctctataaactctgaa

SEQ ID NO: 145069 - DNA, 25 bp, Rattus norvegicus
aggcccattcttagtggtcacccaa

SEQ ID NO: 145070 - DNA, 25 bp, Rattus norvegicus
aggcccattctttgtggtcacccaa

SEQ ID NO: 145071 - DNA, 25 bp, Rattus norvegicus
aggcccattgctacctggtggcagt

SEQ ID NO: 145072 - DNA, 25 bp, Rattus norvegicus
aggcccattgcttcctggtggcagt

SEQ ID NO: 145073 - DNA, 25 bp, Rattus norvegicus
aggcccattggactgcactgattat

SEQ ID NO: 145074 - DNA, 25 bp, Rattus norvegicus
aggcccattggagtgcactgattat

SEQ ID NO: 145075 - DNA, 25 bp, Rattus norvegicus
aggcccattttgaacactggcaaca

SEQ ID NO: 145076 - DNA, 25 bp, Rattus norvegicus
aggcccattttgtacactggcaaca

SEQ ID NO: 145077 - DNA, 25 bp, Rattus norvegicus
aggccccaaaatccagccagtgaga

SEQ ID NO: 145078 - DNA, 25 bp, Rattus norvegicus
aggccccaaaatgcagccagtgaga

SEQ ID NO: 145079 - DNA, 25 bp, Rattus norvegicus
aggccccaaaccaaggagctgggtg

SEQ ID NO: 145080 - DNA, 25 bp, Rattus norvegicus
aggccccaaacctaggagctgggtg

SEQ ID NO: 145081 - DNA, 25 bp, Rattus norvegicus
aggccccaaactatagaccttgatc

SEQ ID NO: 145082 - DNA, 25 bp, Rattus norvegicus
aggccccaaactttagaccttgatc

SEQ ID NO: 145083 - DNA, 25 bp, Rattus norvegicus
aggccccaagaacacggctcctata

SEQ ID NO: 145084 - DNA, 25 bp, Rattus norvegicus
aggccccaagaagacggctcctata

SEQ ID NO: 145085 - DNA, 25 bp, Rattus norvegicus
aggccccaagcaagcaggacgcggc

SEQ ID NO: 145086 - DNA, 25 bp, Rattus norvegicus
aggccccaagcatgcaggacgcggc

SEQ ID NO: 145087 - DNA, 25 bp, Rattus norvegicus
aggccccacagtcatagtctgggtt

SEQ ID NO: 145088 - DNA, 25 bp, Rattus norvegicus
aggccccacagtgatagtctgggtt

SEQ ID NO: 145089 - DNA, 25 bp, Rattus norvegicus
aggccccaccatagaagaggtcgat

SEQ ID NO: 145090 - DNA, 25 bp, Rattus norvegicus
aggccccaccattgaagaggtcgat

SEQ ID NO: 145091 - DNA, 25 bp, Rattus norvegicus
aggccccacgacacaagtatcttat

SEQ ID NO: 145092 - DNA, 25 bp, Rattus norvegicus
aggccccacgactcaagtatcttat

SEQ ID NO: 145093 - DNA, 25 bp, Rattus norvegicus
aggccccactgaacacacatggtgt

SEQ ID NO: 145094 - DNA, 25 bp, Rattus norvegicus
aggccccactgatcacacatggtgt

SEQ ID NO: 145095 - DNA, 25 bp, Rattus norvegicus
aggccccagaagctgatcaatcctg

SEQ ID NO: 145096 - DNA, 25 bp, Rattus norvegicus
aggccccagaaggtgatcaatcctg

SEQ ID NO: 145097 - DNA, 25 bp, Rattus norvegicus
aggccccagaataatatgttccaag

SEQ ID NO: 145098 - DNA, 25 bp, Rattus norvegicus
aggccccagaattatatgttccaag

SEQ ID NO: 145099 - DNA, 25 bp, Rattus norvegicus
aggccccagagcctgtcagtgccaa

SEQ ID NO: 145100 - DNA, 25 bp, Rattus norvegicus
aggccccagagcgtgtcagtgccaa

SEQ ID NO: 145101 - DNA, 25 bp, Rattus norvegicus
aggccccagaggcacaggctcctag

SEQ ID NO: 145102 - DNA, 25 bp, Rattus norvegicus
aggccccagagggacaggctcctag

SEQ ID NO: 145103 - DNA, 25 bp, Rattus norvegicus
aggccccagcccacagagcaaggtt

SEQ ID NO: 145104 - DNA, 25 bp, Rattus norvegicus
aggccccagccctcagagcaaggtt

SEQ ID NO: 145105 - DNA, 25 bp, Rattus norvegicus
aggccccagccgaggaagtgagatc

SEQ ID NO: 145106 - DNA, 25 bp, Rattus norvegicus
aggccccagccgtggaagtgagatc

SEQ ID NO: 145107 - DNA, 25 bp, Rattus norvegicus
aggccccagcttcagtacggattaa

SEQ ID NO: 145108 - DNA, 25 bp, Rattus norvegicus
aggccccagcttgagtacggattaa

SEQ ID NO: 145109 - DNA, 25 bp, Rattus norvegicus
aggccccagtgccacagtatagagt

SEQ ID NO: 145110 - DNA, 25 bp, Rattus norvegicus
aggccccagtgcgacagtatagagt

SEQ ID NO: 145111 - DNA, 25 bp, Rattus norvegicus
aggccccagtggaagactctgatgg

SEQ ID NO: 145112 - DNA, 25 bp, Rattus norvegicus
aggccccagtggtagactctgatgg

SEQ ID NO: 145113 - DNA, 25 bp, Rattus norvegicus
aggccccataggaatgaaaactgtt

SEQ ID NO: 145114 - DNA, 25 bp, Rattus norvegicus
aggccccataggtatgaaaactgtt

SEQ ID NO: 145115 - DNA, 25 bp, Rattus norvegicus
aggccccatctcagaactgacaatt

SEQ ID NO: 145116 - DNA, 25 bp, Rattus norvegicus
aggccccatctctgaactgacaatt

SEQ ID NO: 145117 - DNA, 25 bp, Rattus norvegicus
aggccccatgagactgcagctgtga

SEQ ID NO: 145118 - DNA, 25 bp, Rattus norvegicus
aggccccatgagtctgcagctgtga

SEQ ID NO: 145119 - DNA, 25 bp, Rattus norvegicus
aggccccatgatactgtaagctgtg

SEQ ID NO: 145120 - DNA, 25 bp, Rattus norvegicus
aggccccatgattctgtaagctgtg

SEQ ID NO: 145121 - DNA, 25 bp, Rattus norvegicus
aggccccattggctgttgtggataa

SEQ ID NO: 145122 - DNA, 25 bp, Rattus norvegicus
aggccccattgggtgttgtggataa

SEQ ID NO: 145123 - DNA, 25 bp, Rattus norvegicus
aggccccgacacagtggagctgtct

SEQ ID NO: 145124 - DNA, 25 bp, Rattus norvegicus
aggccccgacactgtggagctgtct

SEQ ID NO: 145125 - DNA, 25 bp, Rattus norvegicus
aggccccgcccaccaagagttagag

SEQ ID NO: 145126 - DNA, 25 bp, Rattus norvegicus
aggccccgcccagcaagagttagag

SEQ ID NO: 145127 - DNA, 25 bp, Rattus norvegicus
aggccccgcctgatgaacgaaatat

SEQ ID NO: 145128 - DNA, 25 bp, Rattus norvegicus
aggccccgcctgttgaacgaaatat

SEQ ID NO: 145129 - DNA, 25 bp, Rattus norvegicus
aggccccggttaaccagagctctgc

SEQ ID NO: 145130 - DNA, 25 bp, Rattus norvegicus
aggccccggttatccagagctctgc

SEQ ID NO: 145131 - DNA, 25 bp, Rattus norvegicus
aggccccgtatccttgttctgtgga

SEQ ID NO: 145132 - DNA, 25 bp, Rattus norvegicus
aggccccgtatcgttgttctgtgga

SEQ ID NO: 145133 - DNA, 25 bp, Rattus norvegicus
aggcccctagataatccacttctga

SEQ ID NO: 145134 - DNA, 25 bp, Rattus norvegicus
aggcccctagattatccacttctga

SEQ ID NO: 145135 - DNA, 25 bp, Rattus norvegicus
aggcccctatccagagccaatgtag

SEQ ID NO: 145136 - DNA, 25 bp, Rattus norvegicus
aggcccctatcctgagccaatgtag

SEQ ID NO: 145137 - DNA, 25 bp, Rattus norvegicus
aggcccctcaggaactatcaggtct

SEQ ID NO: 145138 - DNA, 25 bp, Rattus norvegicus
aggcccctcaggtactatcaggtct

SEQ ID NO: 145139 - DNA, 25 bp, Rattus norvegicus
aggcccctctctctgcataagcatt

SEQ ID NO: 145140 - DNA, 25 bp, Rattus norvegicus
aggcccctctctgtgcataagcatt

SEQ ID NO: 145141 - DNA, 25 bp, Rattus norvegicus
aggcccctgaagatttattgcatct

SEQ ID NO: 145142 - DNA, 25 bp, Rattus norvegicus
aggcccctgaagttttattgcatct

SEQ ID NO: 145143 - DNA, 25 bp, Rattus norvegicus
aggcccctgagcagggtaccatgaa

SEQ ID NO: 145144 - DNA, 25 bp, Rattus norvegicus
aggcccctgagctgggtaccatgaa

SEQ ID NO: 145145 - DNA, 25 bp, Rattus norvegicus
aggcccctgctaaagccagagatca

SEQ ID NO: 145146 - DNA, 25 bp, Rattus norvegicus
aggcccctgctatagccagagatca

SEQ ID NO: 145147 - DNA, 25 bp, Rattus norvegicus
aggcccctgctgctctagtgaaagt

SEQ ID NO: 145148 - DNA, 25 bp, Rattus norvegicus
aggcccctgctggtctagtgaaagt

SEQ ID NO: 145149 - DNA, 25 bp, Rattus norvegicus
aggcccctggttacagcttgtccta

SEQ ID NO: 145150 - DNA, 25 bp, Rattus norvegicus
aggcccctggtttcagcttgtccta

SEQ ID NO: 145151 - DNA, 25 bp, Rattus norvegicus
aggcccctgtcccttttgtgcatat

SEQ ID NO: 145152 - DNA, 25 bp, Rattus norvegicus
aggcccctgtccgttttgtgcatat

SEQ ID NO: 145153 - DNA, 25 bp, Rattus norvegicus
aggccccttaagactactagctcag

SEQ ID NO: 145154 - DNA, 25 bp, Rattus norvegicus
aggccccttaagtctactagctcag

SEQ ID NO: 145155 - DNA, 25 bp, Rattus norvegicus
aggccccttggcacttcataagaag

SEQ ID NO: 145156 - DNA, 25 bp, Rattus norvegicus
aggccccttggctcttcataagaag

SEQ ID NO: 145157 - DNA, 25 bp, Rattus norvegicus
aggcccctttcaatgtggcactgag

SEQ ID NO: 145158 - DNA, 25 bp, Rattus norvegicus
aggcccctttcattgtggcactgag

SEQ ID NO: 145159 - DNA, 25 bp, Rattus norvegicus
aggcccgacatcacagcatagaatc

SEQ ID NO: 145160 - DNA, 25 bp, Rattus norvegicus
aggcccgacatctcagcatagaatc

SEQ ID NO: 145161 - DNA, 25 bp, Rattus norvegicus
aggcccgagagaaccgagtttgtgc

SEQ ID NO: 145162 - DNA, 25 bp, Rattus norvegicus
aggcccgagagatccgagtttgtgc

SEQ ID NO: 145163 - DNA, 25 bp, Rattus norvegicus
aggcccgagtgcacttcaggaaatc

SEQ ID NO: 145164 - DNA, 25 bp, Rattus norvegicus
aggcccgagtgctcttcaggaaatc

SEQ ID NO: 145165 - DNA, 25 bp, Rattus norvegicus
aggcccgagtgtagcgacacatgca

SEQ ID NO: 145166 - DNA, 25 bp, Rattus norvegicus
aggcccgagtgttgcgacacatgca

SEQ ID NO: 145167 - DNA, 25 bp, Rattus norvegicus
aggcccgattccagagagtgaccca

SEQ ID NO: 145168 - DNA, 25 bp, Rattus norvegicus
aggcccgattcctgagagtgaccca

SEQ ID NO: 145169 - DNA, 25 bp, Rattus norvegicus
aggcccgcacaaccaaggcttttga

SEQ ID NO: 145170 - DNA, 25 bp, Rattus norvegicus
aggcccgcacaagcaaggcttttga

SEQ ID NO: 145171 - DNA, 25 bp, Rattus norvegicus
aggcccgcagctcggcacatattga

SEQ ID NO: 145172 - DNA, 25 bp, Rattus norvegicus
aggcccgcagctgggcacatattga

SEQ ID NO: 145173 - DNA, 25 bp, Rattus norvegicus
aggcccgcaggcacagcaaggattg

SEQ ID NO: 145174 - DNA, 25 bp, Rattus norvegicus
aggcccgcaggctcagcaaggattg

SEQ ID NO: 145175 - DNA, 25 bp, Rattus norvegicus
aggcccgccattatatgttccagat

SEQ ID NO: 145176 - DNA, 25 bp, Rattus norvegicus
aggcccgccattttatgttccagat

SEQ ID NO: 145177 - DNA, 25 bp, Rattus norvegicus
aggcccgctcagaggaactgtcaga

SEQ ID NO: 145178 - DNA, 25 bp, Rattus norvegicus
aggcccgctcagtggaactgtcaga

SEQ ID NO: 145179 - DNA, 25 bp, Rattus norvegicus
aggcccgcttagatatccgcagatc

SEQ ID NO: 145180 - DNA, 25 bp, Rattus norvegicus
aggcccgcttagttatccgcagatc

SEQ ID NO: 145181 - DNA, 25 bp, Rattus norvegicus
aggcccggagcaatcttctgactct

SEQ ID NO: 145182 - DNA, 25 bp, Rattus norvegicus
aggcccggagcattcttctgactct

SEQ ID NO: 145183 - DNA, 25 bp, Rattus norvegicus
aggcccggcagaagcagactgagca

SEQ ID NO: 145184 - DNA, 25 bp, Rattus norvegicus
aggcccggcagatgcagactgagca

SEQ ID NO: 145185 - DNA, 25 bp, Rattus norvegicus
aggcccggcagcatctacagaagat

SEQ ID NO: 145186 - DNA, 25 bp, Rattus norvegicus
aggcccggcagcttctacagaagat

SEQ ID NO: 145187 - DNA, 25 bp, Rattus norvegicus
aggcccggttctctattcagatgtt

SEQ ID NO: 145188 - DNA, 25 bp, Rattus norvegicus
aggcccggttctgtattcagatgtt

SEQ ID NO: 145189 - DNA, 25 bp, Rattus norvegicus
aggcccgtggacagagattcccaga

SEQ ID NO: 145190 - DNA, 25 bp, Rattus norvegicus
aggcccgtggactgagattcccaga

SEQ ID NO: 145191 - DNA, 25 bp, Rattus norvegicus
aggcccgtgtcaagagctgctaagc

SEQ ID NO: 145192 - DNA, 25 bp, Rattus norvegicus
aggcccgtgtcatgagctgctaagc

SEQ ID NO: 145193 - DNA, 25 bp, Rattus norvegicus
aggccctaacgtcctctatggatgc

SEQ ID NO: 145194 - DNA, 25 bp, Rattus norvegicus
aggccctaacgtgctctatggatgc

SEQ ID NO: 145195 - DNA, 25 bp, Rattus norvegicus
aggccctaaggcaagacatcctcaa

SEQ ID NO: 145196 - DNA, 25 bp, Rattus norvegicus
aggccctaaggctagacatcctcaa

SEQ ID NO: 145197 - DNA, 25 bp, Rattus norvegicus
aggccctaccatcaaacacagtgtt

SEQ ID NO: 145198 - DNA, 25 bp, Rattus norvegicus
aggccctaccatgaaacacagtgtt

SEQ ID NO: 145199 - DNA, 25 bp, Rattus norvegicus
aggccctacctgcaagttcagtgaa

SEQ ID NO: 145200 - DNA, 25 bp, Rattus norvegicus
aggccctacctggaagttcagtgaa

SEQ ID NO: 145201 - DNA, 25 bp, Rattus norvegicus
aggccctactgcagtgggtggacaa

SEQ ID NO: 145202 - DNA, 25 bp, Rattus norvegicus
aggccctactgctgtgggtggacaa

SEQ ID NO: 145203 - DNA, 25 bp, Rattus norvegicus
aggccctacttaccactgagagcaa

SEQ ID NO: 145204 - DNA, 25 bp, Rattus norvegicus
aggccctacttagcactgagagcaa

SEQ ID NO: 145205 - DNA, 25 bp, Rattus norvegicus
aggccctagactcatcttggtcctc

SEQ ID NO: 145206 - DNA, 25 bp, Rattus norvegicus
aggccctagactgatcttggtcctc

SEQ ID NO: 145207 - DNA, 25 bp, Rattus norvegicus
aggccctcacatctgctatgcaagc

SEQ ID NO: 145208 - DNA, 25 bp, Rattus norvegicus
aggccctcacatgtgctatgcaagc

SEQ ID NO: 145209 - DNA, 25 bp, Rattus norvegicus
aggccctcagtacgatgctcgagaa

SEQ ID NO: 145210 - DNA, 25 bp, Rattus norvegicus
aggccctcagtaggatgctcgagaa

SEQ ID NO: 145211 - DNA, 25 bp, Rattus norvegicus
aggccctcagtcacatgggtctaca

SEQ ID NO: 145212 - DNA, 25 bp, Rattus norvegicus
aggccctcagtctcatgggtctaca

SEQ ID NO: 145213 - DNA, 25 bp, Rattus norvegicus
aggccctcagtgactgccttagaat

SEQ ID NO: 145214 - DNA, 25 bp, Rattus norvegicus
aggccctcagtgtctgccttagaat

SEQ ID NO: 145215 - DNA, 25 bp, Rattus norvegicus
aggccctcatgaaaaccacgatgtg

SEQ ID NO: 145216 - DNA, 25 bp, Rattus norvegicus
aggccctcatgataaccacgatgtg

SEQ ID NO: 145217 - DNA, 25 bp, Rattus norvegicus
aggccctcattcatgcatggcaagt

SEQ ID NO: 145218 - DNA, 25 bp, Rattus norvegicus
aggccctcattcttgcatggcaagt

SEQ ID NO: 145219 - DNA, 25 bp, Rattus norvegicus
aggccctcccatcatgccaatgatg

SEQ ID NO: 145220 - DNA, 25 bp, Rattus norvegicus
aggccctcccatgatgccaatgatg

SEQ ID NO: 145221 - DNA, 25 bp, Rattus norvegicus
aggccctcctgcacaggttagagct

SEQ ID NO: 145222 - DNA, 25 bp, Rattus norvegicus
aggccctcctgctcaggttagagct

SEQ ID NO: 145223 - DNA, 25 bp, Rattus norvegicus
aggccctccttgcactctgaaaata

SEQ ID NO: 145224 - DNA, 25 bp, Rattus norvegicus
aggccctccttggactctgaaaata

SEQ ID NO: 145225 - DNA, 25 bp, Rattus norvegicus
aggccctcgggtactgactggattt

SEQ ID NO: 145226 - DNA, 25 bp, Rattus norvegicus
aggccctcgggttctgactggattt

SEQ ID NO: 145227 - DNA, 25 bp, Rattus norvegicus
aggccctcggtacttttttgagatg

SEQ ID NO: 145228 - DNA, 25 bp, Rattus norvegicus
aggccctcggtagttttttgagatg

SEQ ID NO: 145229 - DNA, 25 bp, Rattus norvegicus
aggccctctgagatcaatcattaat

SEQ ID NO: 145230 - DNA, 25 bp, Rattus norvegicus
aggccctctgagttcaatcattaat

SEQ ID NO: 145231 - DNA, 25 bp, Rattus norvegicus
aggccctctgctcggaaacccatat

SEQ ID NO: 145232 - DNA, 25 bp, Rattus norvegicus
aggccctctgctgggaaacccatat

SEQ ID NO: 145233 - DNA, 25 bp, Rattus norvegicus
aggccctcttaactcgagttccaca

SEQ ID NO: 145234 - DNA, 25 bp, Rattus norvegicus
aggccctcttaagtcgagttccaca

SEQ ID NO: 145235 - DNA, 25 bp, Rattus norvegicus
aggccctcttataccgagaacaagt

SEQ ID NO: 145236 - DNA, 25 bp, Rattus norvegicus
aggccctcttattccgagaacaagt

SEQ ID NO: 145237 - DNA, 25 bp, Rattus norvegicus
aggccctcttctaattcttttcaga

SEQ ID NO: 145238 - DNA, 25 bp, Rattus norvegicus
aggccctcttctctgagattccagt

SEQ ID NO: 145239 - DNA, 25 bp, Rattus norvegicus
aggccctcttctgtgagattccagt

SEQ ID NO: 145240 - DNA, 25 bp, Rattus norvegicus
aggccctcttcttattcttttcaga

SEQ ID NO: 145241 - DNA, 25 bp, Rattus norvegicus
aggccctcttgaccatctgtgtagt

SEQ ID NO: 145242 - DNA, 25 bp, Rattus norvegicus
aggccctcttgagcatctgtgtagt

SEQ ID NO: 145243 - DNA, 25 bp, Rattus norvegicus
aggccctgaaagctcccagtttcgg

SEQ ID NO: 145244 - DNA, 25 bp, Rattus norvegicus
aggccctgaaaggtcccagtttcgg

SEQ ID NO: 145245 - DNA, 25 bp, Rattus norvegicus
aggccctgaagactggacattccca

SEQ ID NO: 145246 - DNA, 25 bp, Rattus norvegicus
aggccctgaagagtggacattccca

SEQ ID NO: 145247 - DNA, 25 bp, Rattus norvegicus
aggccctgaagcattctgtgactgc

SEQ ID NO: 145248 - DNA, 25 bp, Rattus norvegicus
aggccctgaagctttctgtgactgc

SEQ ID NO: 145249 - DNA, 25 bp, Rattus norvegicus
aggccctgaattcaaagcaccgttt

SEQ ID NO: 145250 - DNA, 25 bp, Rattus norvegicus
aggccctgaattgaaagcaccgttt

SEQ ID NO: 145251 - DNA, 25 bp, Rattus norvegicus
aggccctgacctctagttagtgagt

SEQ ID NO: 145252 - DNA, 25 bp, Rattus norvegicus
aggccctgacctgtagttagtgagt

SEQ ID NO: 145253 - DNA, 25 bp, Rattus norvegicus
aggccctgactaccagctcatgaat

SEQ ID NO: 145254 - DNA, 25 bp, Rattus norvegicus
aggccctgactagcagctcatgaat

SEQ ID NO: 145255 - DNA, 25 bp, Rattus norvegicus
aggccctgagcaaggatgctgtcct

SEQ ID NO: 145256 - DNA, 25 bp, Rattus norvegicus
aggccctgagcatggatgctgtcct

SEQ ID NO: 145257 - DNA, 25 bp, Rattus norvegicus
aggccctgaggcagcgggagaggga

SEQ ID NO: 145258 - DNA, 25 bp, Rattus norvegicus
aggccctgaggctgcgggagaggga

SEQ ID NO: 145259 - DNA, 25 bp, Rattus norvegicus
aggccctgcatgattggaaaaaatt

SEQ ID NO: 145260 - DNA, 25 bp, Rattus norvegicus
aggccctgcatgtttggaaaaaatt

SEQ ID NO: 145261 - DNA, 25 bp, Rattus norvegicus
aggccctgccaccaaataggtctgg

SEQ ID NO: 145262 - DNA, 25 bp, Rattus norvegicus
aggccctgccacgaaataggtctgg

SEQ ID NO: 145263 - DNA, 25 bp, Rattus norvegicus
aggccctgccttcttgcaacatggg

SEQ ID NO: 145264 - DNA, 25 bp, Rattus norvegicus
aggccctgccttgttgcaacatggg

SEQ ID NO: 145265 - DNA, 25 bp, Rattus norvegicus
aggccctgcggcaccaaaaggaacg

SEQ ID NO: 145266 - DNA, 25 bp, Rattus norvegicus
aggccctgcggctccaaaaggaacg

SEQ ID NO: 145267 - DNA, 25 bp, Rattus norvegicus
aggccctgctggaacactactcgga

SEQ ID NO: 145268 - DNA, 25 bp, Rattus norvegicus
aggccctgctggatcctcttgccgg

SEQ ID NO: 145269 - DNA, 25 bp, Rattus norvegicus
aggccctgctggtacactactcgga

SEQ ID NO: 145270 - DNA, 25 bp, Rattus norvegicus
aggccctgctggttcctcttgccgg

SEQ ID NO: 145271 - DNA, 25 bp, Rattus norvegicus
aggccctgctgtctactgagtaaat

SEQ ID NO: 145272 - DNA, 25 bp, Rattus norvegicus
aggccctgctgtgtactgagtaaat

SEQ ID NO: 145273 - DNA, 25 bp, Rattus norvegicus
aggccctgcttacccttgacgaagg

SEQ ID NO: 145274 - DNA, 25 bp, Rattus norvegicus
aggccctgcttagccttgacgaagg

SEQ ID NO: 145275 - DNA, 25 bp, Rattus norvegicus
aggccctgcttccatgtagtgacat

SEQ ID NO: 145276 - DNA, 25 bp, Rattus norvegicus
aggccctgcttcctcatctgtttag

SEQ ID NO: 145277 - DNA, 25 bp, Rattus norvegicus
aggccctgcttcgatgtagtgacat

SEQ ID NO: 145278 - DNA, 25 bp, Rattus norvegicus
aggccctgcttcgtcatctgtttag

SEQ ID NO: 145279 - DNA, 25 bp, Rattus norvegicus
aggccctgcttgagaactgacttaa

SEQ ID NO: 145280 - DNA, 25 bp, Rattus norvegicus
aggccctgcttgtgaactgacttaa

SEQ ID NO: 145281 - DNA, 25 bp, Rattus norvegicus
aggccctggaagagcgcgtgcaaaa

SEQ ID NO: 145282 - DNA, 25 bp, Rattus norvegicus
aggccctggaagcacccacagatgg

SEQ ID NO: 145283 - DNA, 25 bp, Rattus norvegicus
aggccctggaaggacccacagatgg

SEQ ID NO: 145284 - DNA, 25 bp, Rattus norvegicus
aggccctggaagtgcgcgtgcaaaa

SEQ ID NO: 145285 - DNA, 25 bp, Rattus norvegicus
aggccctggagcagttccggaatga

SEQ ID NO: 145286 - DNA, 25 bp, Rattus norvegicus
aggccctggagctgttccggaatga

SEQ ID NO: 145287 - DNA, 25 bp, Rattus norvegicus
aggccctggatcagcaagaggcgtt

SEQ ID NO: 145288 - DNA, 25 bp, Rattus norvegicus
aggccctggatctgcaagaggcgtt

SEQ ID NO: 145289 - DNA, 25 bp, Rattus norvegicus
aggccctggcccagaatgaatgcgg

SEQ ID NO: 145290 - DNA, 25 bp, Rattus norvegicus
aggccctggccctgaatgaatgcgg

SEQ ID NO: 145291 - DNA, 25 bp, Rattus norvegicus
aggccctggctcagtttgttatata

SEQ ID NO: 145292 - DNA, 25 bp, Rattus norvegicus
aggccctggctctgtttgttatata

SEQ ID NO: 145293 - DNA, 25 bp, Rattus norvegicus
aggccctgggtgaagtcatggtcaa

SEQ ID NO: 145294 - DNA, 25 bp, Rattus norvegicus
aggccctgggtgtagtcatggtcaa

SEQ ID NO: 145295 - DNA, 25 bp, Rattus norvegicus
aggccctggtgaagctctttgacaa

SEQ ID NO: 145296 - DNA, 25 bp, Rattus norvegicus
aggccctggtgatgctctttgacaa

SEQ ID NO: 145297 - DNA, 25 bp, Rattus norvegicus
aggccctgtaacctatgcaggtttc

SEQ ID NO: 145298 - DNA, 25 bp, Rattus norvegicus
aggccctgtaacgtatgcaggtttc

SEQ ID NO: 145299 - DNA, 25 bp, Rattus norvegicus
aggccctgtgtccatgctgtgtgtc

SEQ ID NO: 145300 - DNA, 25 bp, Rattus norvegicus
aggccctgtgtcgatgctgtgtgtc

SEQ ID NO: 145301 - DNA, 25 bp, Rattus norvegicus
aggccctgttcccaaaacaaacatg

SEQ ID NO: 145302 - DNA, 25 bp, Rattus norvegicus
aggccctgttccgaaaacaaacatg

SEQ ID NO: 145303 - DNA, 25 bp, Rattus norvegicus
aggccctgttttatgtgttagctga

SEQ ID NO: 145304 - DNA, 25 bp, Rattus norvegicus
aggccctgttttcgatccagagtgt

SEQ ID NO: 145305 - DNA, 25 bp, Rattus norvegicus
aggccctgttttggatccagagtgt

SEQ ID NO: 145306 - DNA, 25 bp, Rattus norvegicus
aggccctgttttttgtgttagctga

SEQ ID NO: 145307 - DNA, 25 bp, Rattus norvegicus
aggcccttacttccacatcaatcag

SEQ ID NO: 145308 - DNA, 25 bp, Rattus norvegicus
aggcccttacttgcacatcaatcag

SEQ ID NO: 145309 - DNA, 25 bp, Rattus norvegicus
aggcccttatacctacttgtgctga

SEQ ID NO: 145310 - DNA, 25 bp, Rattus norvegicus
aggcccttatacgtacttgtgctga

SEQ ID NO: 145311 - DNA, 25 bp, Rattus norvegicus
aggcccttcacaaatcatgcttact

SEQ ID NO: 145312 - DNA, 25 bp, Rattus norvegicus
aggcccttcacatatcatgcttact

SEQ ID NO: 145313 - DNA, 25 bp, Rattus norvegicus
aggcccttcagacctggagatcgca

SEQ ID NO: 145314 - DNA, 25 bp, Rattus norvegicus
aggcccttcagagctggagatcgca

SEQ ID NO: 145315 - DNA, 25 bp, Rattus norvegicus
aggcccttctaccactggagactga

SEQ ID NO: 145316 - DNA, 25 bp, Rattus norvegicus
aggcccttctacgactggagactga

SEQ ID NO: 145317 - DNA, 25 bp, Rattus norvegicus
aggcccttgactcactttatccaca

SEQ ID NO: 145318 - DNA, 25 bp, Rattus norvegicus
aggcccttgactcctactgattctc

SEQ ID NO: 145319 - DNA, 25 bp, Rattus norvegicus
aggcccttgactgactttatccaca

SEQ ID NO: 145320 - DNA, 25 bp, Rattus norvegicus
aggcccttgactgctactgattctc

SEQ ID NO: 145321 - DNA, 25 bp, Rattus norvegicus
aggcccttgagaagcccaatggttc

SEQ ID NO: 145322 - DNA, 25 bp, Rattus norvegicus
aggcccttgagatgcccaatggttc

SEQ ID NO: 145323 - DNA, 25 bp, Rattus norvegicus
aggcccttgcgaaatcttcatgcat

SEQ ID NO: 145324 - DNA, 25 bp, Rattus norvegicus
aggcccttgcgatatcttcatgcat

SEQ ID NO: 145325 - DNA, 25 bp, Rattus norvegicus
aggcccttgggaccatctgcacatg

SEQ ID NO: 145326 - DNA, 25 bp, Rattus norvegicus
aggcccttgggagcatctgcacatg

SEQ ID NO: 145327 - DNA, 25 bp, Rattus norvegicus
aggcccttgtgaaactttgttcttc

SEQ ID NO: 145328 - DNA, 25 bp, Rattus norvegicus
aggcccttgtgatactttgttcttc

SEQ ID NO: 145329 - DNA, 25 bp, Rattus norvegicus
aggccctttcccagtaaattgcaat

SEQ ID NO: 145330 - DNA, 25 bp, Rattus norvegicus
aggccctttccctgtaaattgcaat

SEQ ID NO: 145331 - DNA, 25 bp, Rattus norvegicus
aggccctttgcaccctacagtgcta

SEQ ID NO: 145332 - DNA, 25 bp, Rattus norvegicus
aggccctttgcagcctacagtgcta

SEQ ID NO: 145333 - DNA, 25 bp, Rattus norvegicus
aggccgaccgacagtctgaggaccg

SEQ ID NO: 145334 - DNA, 25 bp, Rattus norvegicus
aggccgaccgactgtctgaggaccg

SEQ ID NO: 145335 - DNA, 25 bp, Rattus norvegicus
aggccgactgggagtgttctgcttc

SEQ ID NO: 145336 - DNA, 25 bp, Rattus norvegicus
aggccgactgggtgtgttctgcttc

SEQ ID NO: 145337 - DNA, 25 bp, Rattus norvegicus
aggccgagaagtacgacctgcagga

SEQ ID NO: 145338 - DNA, 25 bp, Rattus norvegicus
aggccgagaagttcgacctgcagga

SEQ ID NO: 145339 - DNA, 25 bp, Rattus norvegicus
aggccgagcagcagcgcagacagaa

SEQ ID NO: 145340 - DNA, 25 bp, Rattus norvegicus
aggccgagcagctgcgcagacagaa

SEQ ID NO: 145341 - DNA, 25 bp, Rattus norvegicus
aggccgagcccacctacggaagtag

SEQ ID NO: 145342 - DNA, 25 bp, Rattus norvegicus
aggccgagcccagctacggaagtag

SEQ ID NO: 145343 - DNA, 25 bp, Rattus norvegicus
aggccgagtttcactgtagtatcca

SEQ ID NO: 145344 - DNA, 25 bp, Rattus norvegicus
aggccgagtttctctgtagtatcca

SEQ ID NO: 145345 - DNA, 25 bp, Rattus norvegicus
aggccgatatcgatgttatgcgcag

SEQ ID NO: 145346 - DNA, 25 bp, Rattus norvegicus
aggccgatatcgttgttatgcgcag

SEQ ID NO: 145347 - DNA, 25 bp, Rattus norvegicus
aggccgatgggcaccaatgtttata

SEQ ID NO: 145348 - DNA, 25 bp, Rattus norvegicus
aggccgatgggctccaatgtttata

SEQ ID NO: 145349 - DNA, 25 bp, Rattus norvegicus
aggccgatgtcactttacttcaata

SEQ ID NO: 145350 - DNA, 25 bp, Rattus norvegicus
aggccgatgtcagtttacttcaata

SEQ ID NO: 145351 - DNA, 25 bp, Rattus norvegicus
aggccgcaagctcgagttctgcaga

SEQ ID NO: 145352 - DNA, 25 bp, Rattus norvegicus
aggccgcaagctggagttctgcaga

SEQ ID NO: 145353 - DNA, 25 bp, Rattus norvegicus
aggccgcacatcaagtgtctctggg

SEQ ID NO: 145354 - DNA, 25 bp, Rattus norvegicus
aggccgcacatctagtgtctctggg

SEQ ID NO: 145355 - DNA, 25 bp, Rattus norvegicus
aggccgcagaaacctgtcagacgca

SEQ ID NO: 145356 - DNA, 25 bp, Rattus norvegicus
aggccgcagaaagctgtcagacgca

SEQ ID NO: 145357 - DNA, 25 bp, Rattus norvegicus
aggccgcagacacactcagcagtgg

SEQ ID NO: 145358 - DNA, 25 bp, Rattus norvegicus
aggccgcagacagactcagcagtgg

SEQ ID NO: 145359 - DNA, 25 bp, Rattus norvegicus
aggccgcctactacgagaagcgtgt

SEQ ID NO: 145360 - DNA, 25 bp, Rattus norvegicus
aggccgcctacttcgagaagcgtgt

SEQ ID NO: 145361 - DNA, 25 bp, Rattus norvegicus
aggccgcctgaaagctgactgttga

SEQ ID NO: 145362 - DNA, 25 bp, Rattus norvegicus
aggccgcctgaatgctgactgttga

SEQ ID NO: 145363 - DNA, 25 bp, Rattus norvegicus
aggccgcctgagaaaggacctgtgc

SEQ ID NO: 145364 - DNA, 25 bp, Rattus norvegicus
aggccgcctgagtaaggacctgtgc

SEQ ID NO: 145365 - DNA, 25 bp, Rattus norvegicus
aggccgcctggtagattgtgctata

SEQ ID NO: 145366 - DNA, 25 bp, Rattus norvegicus
aggccgcctggttgattgtgctata

SEQ ID NO: 145367 - DNA, 25 bp, Rattus norvegicus
aggccgcgactgacttgcactacag

SEQ ID NO: 145368 - DNA, 25 bp, Rattus norvegicus
aggccgcgactgtcttgcactacag

SEQ ID NO: 145369 - DNA, 25 bp, Rattus norvegicus
aggccgcgagcacagtctccgtgtt

SEQ ID NO: 145370 - DNA, 25 bp, Rattus norvegicus
aggccgcgagcagagtctccgtgtt

SEQ ID NO: 145371 - DNA, 25 bp, Rattus norvegicus
aggccgcgccagagctgtgcatgac

SEQ ID NO: 145372 - DNA, 25 bp, Rattus norvegicus
aggccgcgccagtgctgtgcatgac

SEQ ID NO: 145373 - DNA, 25 bp, Rattus norvegicus
aggccgctacctatatgaatgatgc

SEQ ID NO: 145374 - DNA, 25 bp, Rattus norvegicus
aggccgctacctttatgaatgatgc

SEQ ID NO: 145375 - DNA, 25 bp, Rattus norvegicus
aggccgctcttgaacttgagacctg

SEQ ID NO: 145376 - DNA, 25 bp, Rattus norvegicus
aggccgctcttgtacttgagacctg

SEQ ID NO: 145377 - DNA, 25 bp, Rattus norvegicus
aggccgctggatatctccaggagtc

SEQ ID NO: 145378 - DNA, 25 bp, Rattus norvegicus
aggccgctggatttctccaggagtc

SEQ ID NO: 145379 - DNA, 25 bp, Rattus norvegicus
aggccgcttctcagtgttaaataat

SEQ ID NO: 145380 - DNA, 25 bp, Rattus norvegicus
aggccgcttctctgtgttaaataat

SEQ ID NO: 145381 - DNA, 25 bp, Rattus norvegicus
aggccgctttgaactccagagacta

SEQ ID NO: 145382 - DNA, 25 bp, Rattus norvegicus
aggccgctttgatctccagagacta

SEQ ID NO: 145383 - DNA, 25 bp, Rattus norvegicus
aggccggaacctacgacatagcggt

SEQ ID NO: 145384 - DNA, 25 bp, Rattus norvegicus
aggccggaaccttcgacatagcggt

SEQ ID NO: 145385 - DNA, 25 bp, Rattus norvegicus
aggccggacatcacattggttcaga

SEQ ID NO: 145386 - DNA, 25 bp, Rattus norvegicus
aggccggacatctcattggttcaga

SEQ ID NO: 145387 - DNA, 25 bp, Rattus norvegicus
aggccggagatcacgcttatctaga

SEQ ID NO: 145388 - DNA, 25 bp, Rattus norvegicus
aggccggagatctcgcttatctaga

SEQ ID NO: 145389 - DNA, 25 bp, Rattus norvegicus
aggccggatggtccctcagactctg

SEQ ID NO: 145390 - DNA, 25 bp, Rattus norvegicus
aggccggatggtgcctcagactctg

SEQ ID NO: 145391 - DNA, 25 bp, Rattus norvegicus
aggccggccggtaggagtctacatt

SEQ ID NO: 145392 - DNA, 25 bp, Rattus norvegicus
aggccggccggttggagtctacatt

SEQ ID NO: 145393 - DNA, 25 bp, Rattus norvegicus
aggccggcgagcagtgtctgtgcat

SEQ ID NO: 145394 - DNA, 25 bp, Rattus norvegicus
aggccggcgagctgtgtctgtgcat

SEQ ID NO: 145395 - DNA, 25 bp, Rattus norvegicus
aggccggcgtgtacatgtcatcgat

SEQ ID NO: 145396 - DNA, 25 bp, Rattus norvegicus
aggccggcgtgttcatgtcatcgat

SEQ ID NO: 145397 - DNA, 25 bp, Rattus norvegicus
aggccggcttgacctactcagtcag

SEQ ID NO: 145398 - DNA, 25 bp, Rattus norvegicus
aggccggcttgagctactcagtcag

SEQ ID NO: 145399 - DNA, 25 bp, Rattus norvegicus
aggccggcttggaaaaactgatttg

SEQ ID NO: 145400 - DNA, 25 bp, Rattus norvegicus
aggccggcttggtaaaactgatttg

SEQ ID NO: 145401 - DNA, 25 bp, Rattus norvegicus
aggccgggaggcagccccaagtact

SEQ ID NO: 145402 - DNA, 25 bp, Rattus norvegicus
aggccgggaggctgccccaagtact

SEQ ID NO: 145403 - DNA, 25 bp, Rattus norvegicus
aggccgggcagccacagtacccagg

SEQ ID NO: 145404 - DNA, 25 bp, Rattus norvegicus
aggccgggcagcgacagtacccagg

SEQ ID NO: 145405 - DNA, 25 bp, Rattus norvegicus
aggccgggcttgaaatacctcctct

SEQ ID NO: 145406 - DNA, 25 bp, Rattus norvegicus
aggccgggcttgtaatacctcctct

SEQ ID NO: 145407 - DNA, 25 bp, Rattus norvegicus
aggccggtgatcatggagattttaa

SEQ ID NO: 145408 - DNA, 25 bp, Rattus norvegicus
aggccggtgatcttggagattttaa

SEQ ID NO: 145409 - DNA, 25 bp, Rattus norvegicus
aggccggttcaaaatgcgatccaat

SEQ ID NO: 145410 - DNA, 25 bp, Rattus norvegicus
aggccggttcaatatgcgatccaat

SEQ ID NO: 145411 - DNA, 25 bp, Rattus norvegicus
aggccgtacgggagcagccactctc

SEQ ID NO: 145412 - DNA, 25 bp, Rattus norvegicus
aggccgtacgggtgcagccactctc

SEQ ID NO: 145413 - DNA, 25 bp, Rattus norvegicus
aggccgtagaaaagtctccctatgg

SEQ ID NO: 145414 - DNA, 25 bp, Rattus norvegicus
aggccgtagaaatgtctccctatgg

SEQ ID NO: 145415 - DNA, 25 bp, Rattus norvegicus
aggccgtataacagctggactggat

SEQ ID NO: 145416 - DNA, 25 bp, Rattus norvegicus
aggccgtataactgctggactggat

SEQ ID NO: 145417 - DNA, 25 bp, Rattus norvegicus
aggccgtcaactctgcagaaatgta

SEQ ID NO: 145418 - DNA, 25 bp, Rattus norvegicus
aggccgtcaactgtgcagaaatgta

SEQ ID NO: 145419 - DNA, 25 bp, Rattus norvegicus
aggccgtcatcacgaaggagctgat

SEQ ID NO: 145420 - DNA, 25 bp, Rattus norvegicus
aggccgtcatcaggaaggagctgat

SEQ ID NO: 145421 - DNA, 25 bp, Rattus norvegicus
aggccgtccattcgtctgtcagcaa

SEQ ID NO: 145422 - DNA, 25 bp, Rattus norvegicus
aggccgtccattggtctgtcagcaa

SEQ ID NO: 145423 - DNA, 25 bp, Rattus norvegicus
aggccgtccctaagcagaggtgttt

SEQ ID NO: 145424 - DNA, 25 bp, Rattus norvegicus
aggccgtccctatgcagaggtgttt

SEQ ID NO: 145425 - DNA, 25 bp, Rattus norvegicus
aggccgtcgaagagtagcatgctac

SEQ ID NO: 145426 - DNA, 25 bp, Rattus norvegicus
aggccgtcgaagtgtagcatgctac

SEQ ID NO: 145427 - DNA, 25 bp, Rattus norvegicus
aggccgtcttcgctgtattatggag

SEQ ID NO: 145428 - DNA, 25 bp, Rattus norvegicus
aggccgtcttcggtgtattatggag

SEQ ID NO: 145429 - DNA, 25 bp, Rattus norvegicus
aggccgtgagccctaagactctaga

SEQ ID NO: 145430 - DNA, 25 bp, Rattus norvegicus
aggccgtgagccgtaagactctaga

SEQ ID NO: 145431 - DNA, 25 bp, Rattus norvegicus
aggccgtgatctcaagcgcctggct

SEQ ID NO: 145432 - DNA, 25 bp, Rattus norvegicus
aggccgtgatctgaagcgcctggct

SEQ ID NO: 145433 - DNA, 25 bp, Rattus norvegicus
aggccgtgctctcgaatgcttttca

SEQ ID NO: 145434 - DNA, 25 bp, Rattus norvegicus
aggccgtgctctggaatgcttttca

SEQ ID NO: 145435 - DNA, 25 bp, Rattus norvegicus
aggccgtgtacgattgtgtcctgga

SEQ ID NO: 145436 - DNA, 25 bp, Rattus norvegicus
aggccgtgtacgtttgtgtcctgga

SEQ ID NO: 145437 - DNA, 25 bp, Rattus norvegicus
aggccgtgtgcaaagtttctttatt

SEQ ID NO: 145438 - DNA, 25 bp, Rattus norvegicus
aggccgtgtgcatagtttctttatt

SEQ ID NO: 145439 - DNA, 25 bp, Rattus norvegicus
aggccgtgtgccaggcgcaaatgct

SEQ ID NO: 145440 - DNA, 25 bp, Rattus norvegicus
aggccgtgtgcctggcgcaaatgct

SEQ ID NO: 145441 - DNA, 25 bp, Rattus norvegicus
aggccgttagggacttgattattat

SEQ ID NO: 145442 - DNA, 25 bp, Rattus norvegicus
aggccgttagggtcttgattattat

SEQ ID NO: 145443 - DNA, 25 bp, Rattus norvegicus
aggccgttcagaaagcacatcttga

SEQ ID NO: 145444 - DNA, 25 bp, Rattus norvegicus
aggccgttcagatagcacatcttga

SEQ ID NO: 145445 - DNA, 25 bp, Rattus norvegicus
aggccgttccctcagcgagatggtc

SEQ ID NO: 145446 - DNA, 25 bp, Rattus norvegicus
aggccgttccctgagcgagatggtc

SEQ ID NO: 145447 - DNA, 25 bp, Rattus norvegicus
aggccgttctcgagaacgcgatcga

SEQ ID NO: 145448 - DNA, 25 bp, Rattus norvegicus
aggccgttctcgtgaacgcgatcga

SEQ ID NO: 145449 - DNA, 25 bp, Rattus norvegicus
aggcctaagcttctggaaataccac

SEQ ID NO: 145450 - DNA, 25 bp, Rattus norvegicus
aggcctaagcttgtggaaataccac

SEQ ID NO: 145451 - DNA, 25 bp, Rattus norvegicus
aggcctaatggacctaactggtgca

SEQ ID NO: 145452 - DNA, 25 bp, Rattus norvegicus
aggcctaatggagctaactggtgca

SEQ ID NO: 145453 - DNA, 25 bp, Rattus norvegicus
aggcctaatggcacctacttgtaac

SEQ ID NO: 145454 - DNA, 25 bp, Rattus norvegicus
aggcctaatggctcctacttgtaac

SEQ ID NO: 145455 - DNA, 25 bp, Rattus norvegicus
aggcctacacacaggtttcacaaag

SEQ ID NO: 145456 - DNA, 25 bp, Rattus norvegicus
aggcctacacactggtttcacaaag

SEQ ID NO: 145457 - DNA, 25 bp, Rattus norvegicus
aggcctacagccagtatttcatctc

SEQ ID NO: 145458 - DNA, 25 bp, Rattus norvegicus
aggcctacagcctgtatttcatctc

SEQ ID NO: 145459 - DNA, 25 bp, Rattus norvegicus
aggcctacaggtaccatgcatgtgt

SEQ ID NO: 145460 - DNA, 25 bp, Rattus norvegicus
aggcctacaggttccatgcatgtgt

SEQ ID NO: 145461 - DNA, 25 bp, Rattus norvegicus
aggcctacctgacagcctcggtgtg

SEQ ID NO: 145462 - DNA, 25 bp, Rattus norvegicus
aggcctacctgagagcctcggtgtg

SEQ ID NO: 145463 - DNA, 25 bp, Rattus norvegicus
aggcctacgccgaaccgagtgcgca

SEQ ID NO: 145464 - DNA, 25 bp, Rattus norvegicus
aggcctacgccgtaccgagtgcgca

SEQ ID NO: 145465 - DNA, 25 bp, Rattus norvegicus
aggcctactggtctgattgtggtac

SEQ ID NO: 145466 - DNA, 25 bp, Rattus norvegicus
aggcctactggtgtgattgtggtac

SEQ ID NO: 145467 - DNA, 25 bp, Rattus norvegicus
aggcctacttctactgcagaactta

SEQ ID NO: 145468 - DNA, 25 bp, Rattus norvegicus
aggcctacttcttctgcagaactta

SEQ ID NO: 145469 - DNA, 25 bp, Rattus norvegicus
aggcctagactgctttcgggtgcaa

SEQ ID NO: 145470 - DNA, 25 bp, Rattus norvegicus
aggcctagactggtttcgggtgcaa

SEQ ID NO: 145471 - DNA, 25 bp, Rattus norvegicus
aggcctagagagcttgaccttctgc

SEQ ID NO: 145472 - DNA, 25 bp, Rattus norvegicus
aggcctagagaggttgaccttctgc

SEQ ID NO: 145473 - DNA, 25 bp, Rattus norvegicus
aggcctagggccatggttctttgca

SEQ ID NO: 145474 - DNA, 25 bp, Rattus norvegicus
aggcctagggccttggttctttgca

SEQ ID NO: 145475 - DNA, 25 bp, Rattus norvegicus
aggcctagtgttactgtcacacgag

SEQ ID NO: 145476 - DNA, 25 bp, Rattus norvegicus
aggcctagtgtttctgtcacacgag

SEQ ID NO: 145477 - DNA, 25 bp, Rattus norvegicus
aggcctataccacatgacgaattgt

SEQ ID NO: 145478 - DNA, 25 bp, Rattus norvegicus
aggcctataccagatgacgaattgt

SEQ ID NO: 145479 - DNA, 25 bp, Rattus norvegicus
aggcctatagccagagacattctat

SEQ ID NO: 145480 - DNA, 25 bp, Rattus norvegicus
aggcctatagcctgagacattctat

SEQ ID NO: 145481 - DNA, 25 bp, Rattus norvegicus
aggcctatcccacgaggagtcctaa

SEQ ID NO: 145482 - DNA, 25 bp, Rattus norvegicus
aggcctatcccaggaggagtcctaa

SEQ ID NO: 145483 - DNA, 25 bp, Rattus norvegicus
aggcctatccgtctcgggatatcga

SEQ ID NO: 145484 - DNA, 25 bp, Rattus norvegicus
aggcctatccgtgtcgggatatcga

SEQ ID NO: 145485 - DNA, 25 bp, Rattus norvegicus
aggcctatgagaacgcagggctgtt

SEQ ID NO: 145486 - DNA, 25 bp, Rattus norvegicus
aggcctatgagatcgcagggctgtt

SEQ ID NO: 145487 - DNA, 25 bp, Rattus norvegicus
aggcctatgcctcaagctgtaacag

SEQ ID NO: 145488 - DNA, 25 bp, Rattus norvegicus
aggcctatgcctcgtatgtgtttgc

SEQ ID NO: 145489 - DNA, 25 bp, Rattus norvegicus
aggcctatgcctgaagctgtaacag

SEQ ID NO: 145490 - DNA, 25 bp, Rattus norvegicus
aggcctatgcctggtatgtgtttgc

SEQ ID NO: 145491 - DNA, 25 bp, Rattus norvegicus
aggcctatggccactgctatgtatg

SEQ ID NO: 145492 - DNA, 25 bp, Rattus norvegicus
aggcctatggcctctgctatgtatg

SEQ ID NO: 145493 - DNA, 25 bp, Rattus norvegicus
aggcctatgggaacttagccccaag

SEQ ID NO: 145494 - DNA, 25 bp, Rattus norvegicus
aggcctatgggatcttagccccaag

SEQ ID NO: 145495 - DNA, 25 bp, Rattus norvegicus
aggcctatgggcatatgcacaaaaa

SEQ ID NO: 145496 - DNA, 25 bp, Rattus norvegicus
aggcctatgggcttatgcacaaaaa

SEQ ID NO: 145497 - DNA, 25 bp, Rattus norvegicus
aggcctattaacactccatgactaa

SEQ ID NO: 145498 - DNA, 25 bp, Rattus norvegicus
aggcctattaactctccatgactaa

SEQ ID NO: 145499 - DNA, 25 bp, Rattus norvegicus
aggcctattagccagaggattcctt

SEQ ID NO: 145500 - DNA, 25 bp, Rattus norvegicus
aggcctattagcgagaggattcctt

SEQ ID NO: 145501 - DNA, 25 bp, Rattus norvegicus
aggcctcaaaggattgtgagctgat

SEQ ID NO: 145502 - DNA, 25 bp, Rattus norvegicus
aggcctcaaaggtttgtgagctgat

SEQ ID NO: 145503 - DNA, 25 bp, Rattus norvegicus
aggcctcaacctacactcttaagtt

SEQ ID NO: 145504 - DNA, 25 bp, Rattus norvegicus
aggcctcaaccttcactcttaagtt

SEQ ID NO: 145505 - DNA, 25 bp, Rattus norvegicus
aggcctcaagaaaggcagcctctct

SEQ ID NO: 145506 - DNA, 25 bp, Rattus norvegicus
aggcctcaagaatggcagcctctct

SEQ ID NO: 145507 - DNA, 25 bp, Rattus norvegicus
aggcctcaagttaggcatgtgatca

SEQ ID NO: 145508 - DNA, 25 bp, Rattus norvegicus
aggcctcaagtttggcatgtgatca

SEQ ID NO: 145509 - DNA, 25 bp, Rattus norvegicus
aggcctcaattcatgggttgtcgca

SEQ ID NO: 145510 - DNA, 25 bp, Rattus norvegicus
aggcctcaattcttgggttgtcgca

SEQ ID NO: 145511 - DNA, 25 bp, Rattus norvegicus
aggcctcacttaccgccagcaataa

SEQ ID NO: 145512 - DNA, 25 bp, Rattus norvegicus
aggcctcacttagcgccagcaataa

SEQ ID NO: 145513 - DNA, 25 bp, Rattus norvegicus
aggcctcacttcatgatgtgtcagt

SEQ ID NO: 145514 - DNA, 25 bp, Rattus norvegicus
aggcctcacttcttgatgtgtcagt

SEQ ID NO: 145515 - DNA, 25 bp, Rattus norvegicus
aggcctcagacacggaagccattga

SEQ ID NO: 145516 - DNA, 25 bp, Rattus norvegicus
aggcctcagacagggaagccattga

SEQ ID NO: 145517 - DNA, 25 bp, Rattus norvegicus
aggcctcagataccaacctgtctct

SEQ ID NO: 145518 - DNA, 25 bp, Rattus norvegicus
aggcctcagatagcaacctgtctct

SEQ ID NO: 145519 - DNA, 25 bp, Rattus norvegicus
aggcctcagatccagtcagaaagtg

SEQ ID NO: 145520 - DNA, 25 bp, Rattus norvegicus
aggcctcagatcgagtcagaaagtg

SEQ ID NO: 145521 - DNA, 25 bp, Rattus norvegicus
aggcctcaggagctggaattgactt

SEQ ID NO: 145522 - DNA, 25 bp, Rattus norvegicus
aggcctcaggaggtggaattgactt

SEQ ID NO: 145523 - DNA, 25 bp, Rattus norvegicus
aggcctcagtacaggaacccgggag

SEQ ID NO: 145524 - DNA, 25 bp, Rattus norvegicus
aggcctcagtactggaacccgggag

SEQ ID NO: 145525 - DNA, 25 bp, Rattus norvegicus
aggcctcagtttacccatgctaact

SEQ ID NO: 145526 - DNA, 25 bp, Rattus norvegicus
aggcctcagttttcccatgctaact

SEQ ID NO: 145527 - DNA, 25 bp, Rattus norvegicus
aggcctcatcacagtgtttgcataa

SEQ ID NO: 145528 - DNA, 25 bp, Rattus norvegicus
aggcctcatcactgtgtttgcataa

SEQ ID NO: 145529 - DNA, 25 bp, Rattus norvegicus
aggcctccaaaaccagagtctctgc

SEQ ID NO: 145530 - DNA, 25 bp, Rattus norvegicus
aggcctccaaaagcagagtctctgc

SEQ ID NO: 145531 - DNA, 25 bp, Rattus norvegicus
aggcctccaaggctacatcaaaggt

SEQ ID NO: 145532 - DNA, 25 bp, Rattus norvegicus
aggcctccaagggtacatcaaaggt

SEQ ID NO: 145533 - DNA, 25 bp, Rattus norvegicus
aggcctccacctctggacgagagag

SEQ ID NO: 145534 - DNA, 25 bp, Rattus norvegicus
aggcctccacctgtggacgagagag

SEQ ID NO: 145535 - DNA, 25 bp, Rattus norvegicus
aggcctccagacctgtgacttttgt

SEQ ID NO: 145536 - DNA, 25 bp, Rattus norvegicus
aggcctccagacgtgtgacttttgt

SEQ ID NO: 145537 - DNA, 25 bp, Rattus norvegicus
aggcctccatgactttggtgcagtc

SEQ ID NO: 145538 - DNA, 25 bp, Rattus norvegicus
aggcctccatgagtttggtgcagtc

SEQ ID NO: 145539 - DNA, 25 bp, Rattus norvegicus
aggcctccatttaaaatgtcattca

SEQ ID NO: 145540 - DNA, 25 bp, Rattus norvegicus
aggcctccattttaaatgtcattca

SEQ ID NO: 145541 - DNA, 25 bp, Rattus norvegicus
aggcctcccaagaagtgttttctcg

SEQ ID NO: 145542 - DNA, 25 bp, Rattus norvegicus
aggcctcccaagtagtgttttctcg

SEQ ID NO: 145543 - DNA, 25 bp, Rattus norvegicus
aggcctcccacacaagtattcagct

SEQ ID NO: 145544 - DNA, 25 bp, Rattus norvegicus
aggcctcccacagaagtattcagct

SEQ ID NO: 145545 - DNA, 25 bp, Rattus norvegicus
aggcctccccgcagtgtggatgcgc

SEQ ID NO: 145546 - DNA, 25 bp, Rattus norvegicus
aggcctccccgctgtgtggatgcgc

SEQ ID NO: 145547 - DNA, 25 bp, Rattus norvegicus
aggcctcccgggaacacaagccagg

SEQ ID NO: 145548 - DNA, 25 bp, Rattus norvegicus
aggcctcccgggtacacaagccagg

SEQ ID NO: 145549 - DNA, 25 bp, Rattus norvegicus
aggcctcccgtacagggctacgcga

SEQ ID NO: 145550 - DNA, 25 bp, Rattus norvegicus
aggcctcccgtagagggctacgcga

SEQ ID NO: 145551 - DNA, 25 bp, Rattus norvegicus
aggcctccgcaactggacgacagca

SEQ ID NO: 145552 - DNA, 25 bp, Rattus norvegicus
aggcctccgcaagtggacgacagca

SEQ ID NO: 145553 - DNA, 25 bp, Rattus norvegicus
aggcctccgcacactaatggacagt

SEQ ID NO: 145554 - DNA, 25 bp, Rattus norvegicus
aggcctccgcactctaatggacagt

SEQ ID NO: 145555 - DNA, 25 bp, Rattus norvegicus
aggcctccggatagctacaatttaa

SEQ ID NO: 145556 - DNA, 25 bp, Rattus norvegicus
aggcctccggattgctacaatttaa

SEQ ID NO: 145557 - DNA, 25 bp, Rattus norvegicus
aggcctccggccaattctgggttag

SEQ ID NO: 145558 - DNA, 25 bp, Rattus norvegicus
aggcctccggcctattctgggttag

SEQ ID NO: 145559 - DNA, 25 bp, Rattus norvegicus
aggcctcctcgtagggacctggata

SEQ ID NO: 145560 - DNA, 25 bp, Rattus norvegicus
aggcctcctcgttgggacctggata

SEQ ID NO: 145561 - DNA, 25 bp, Rattus norvegicus
aggcctcctgggaaactgatttctc

SEQ ID NO: 145562 - DNA, 25 bp, Rattus norvegicus
aggcctcctgggtaactgatttctc

SEQ ID NO: 145563 - DNA, 25 bp, Rattus norvegicus
aggcctccttttcttgtgaggctat

SEQ ID NO: 145564 - DNA, 25 bp, Rattus norvegicus
aggcctccttttgttgtgaggctat

SEQ ID NO: 145565 - DNA, 25 bp, Rattus norvegicus
aggcctcgacaaactggtgctgtga

SEQ ID NO: 145566 - DNA, 25 bp, Rattus norvegicus
aggcctcgacaatctggtgctgtga

SEQ ID NO: 145567 - DNA, 25 bp, Rattus norvegicus
aggcctcgaggtacacaagcgttgt

SEQ ID NO: 145568 - DNA, 25 bp, Rattus norvegicus
aggcctcgaggttcacaagcgttgt

SEQ ID NO: 145569 - DNA, 25 bp, Rattus norvegicus
aggcctcgcgaaccttcaacataaa

SEQ ID NO: 145570 - DNA, 25 bp, Rattus norvegicus
aggcctcgcgaagcttcaacataaa

SEQ ID NO: 145571 - DNA, 25 bp, Rattus norvegicus
aggcctcgcgagcagacagtccatc

SEQ ID NO: 145572 - DNA, 25 bp, Rattus norvegicus
aggcctcgcgaggagacagtccatc

SEQ ID NO: 145573 - DNA, 25 bp, Rattus norvegicus
aggcctcgctcaatggtcagcgctt

SEQ ID NO: 145574 - DNA, 25 bp, Rattus norvegicus
aggcctcgctcattggtcagcgctt

SEQ ID NO: 145575 - DNA, 25 bp, Rattus norvegicus
aggcctcgggatcggaacattattc

SEQ ID NO: 145576 - DNA, 25 bp, Rattus norvegicus
aggcctcgggatgggaacattattc

SEQ ID NO: 145577 - DNA, 25 bp, Rattus norvegicus
aggcctcgtgccagggattctgaga

SEQ ID NO: 145578 - DNA, 25 bp, Rattus norvegicus
aggcctcgtgcctgggattctgaga

SEQ ID NO: 145579 - DNA, 25 bp, Rattus norvegicus
aggcctctaaggatcaagtggattc

SEQ ID NO: 145580 - DNA, 25 bp, Rattus norvegicus
aggcctctaaggttcaagtggattc

SEQ ID NO: 145581 - DNA, 25 bp, Rattus norvegicus
aggcctctagacagtgtccagcttg

SEQ ID NO: 145582 - DNA, 25 bp, Rattus norvegicus
aggcctctagactgtgtccagcttg

SEQ ID NO: 145583 - DNA, 25 bp, Rattus norvegicus
aggcctctatctaccaacaagtgac

SEQ ID NO: 145584 - DNA, 25 bp, Rattus norvegicus
aggcctctatcttccaacaagtgac

SEQ ID NO: 145585 - DNA, 25 bp, Rattus norvegicus
aggcctctcatcaagtccttggtga

SEQ ID NO: 145586 - DNA, 25 bp, Rattus norvegicus
aggcctctcatctagtccttggtga

SEQ ID NO: 145587 - DNA, 25 bp, Rattus norvegicus
aggcctctccatcgagttctgttta

SEQ ID NO: 145588 - DNA, 25 bp, Rattus norvegicus
aggcctctccatggagttctgttta

SEQ ID NO: 145589 - DNA, 25 bp, Rattus norvegicus
aggcctctcctgaagggttcttgcc

SEQ ID NO: 145590 - DNA, 25 bp, Rattus norvegicus
aggcctctcctgctggaagcacagt

SEQ ID NO: 145591 - DNA, 25 bp, Rattus norvegicus
aggcctctcctggtggaagcacagt

SEQ ID NO: 145592 - DNA, 25 bp, Rattus norvegicus
aggcctctcctgtagggttcttgcc

SEQ ID NO: 145593 - DNA, 25 bp, Rattus norvegicus
aggcctctcgctacttaagttattt

SEQ ID NO: 145594 - DNA, 25 bp, Rattus norvegicus
aggcctctcgcttcttaagttattt

SEQ ID NO: 145595 - DNA, 25 bp, Rattus norvegicus
aggcctctctacagttgctggacag

SEQ ID NO: 145596 - DNA, 25 bp, Rattus norvegicus
aggcctctctactgttgctggacag

SEQ ID NO: 145597 - DNA, 25 bp, Rattus norvegicus
aggcctctctctctgaaaatgttac

SEQ ID NO: 145598 - DNA, 25 bp, Rattus norvegicus
aggcctctctctgtgaaaatgttac

SEQ ID NO: 145599 - DNA, 25 bp, Rattus norvegicus
aggcctctctgcacatgtgatgtgt

SEQ ID NO: 145600 - DNA, 25 bp, Rattus norvegicus
aggcctctctgctcatgtgatgtgt

SEQ ID NO: 145601 - DNA, 25 bp, Rattus norvegicus
aggcctctctgtagaaagctgatga

SEQ ID NO: 145602 - DNA, 25 bp, Rattus norvegicus
aggcctctctgtccctgagaagcag

SEQ ID NO: 145603 - DNA, 25 bp, Rattus norvegicus
aggcctctctgtgcctgagaagcag

SEQ ID NO: 145604 - DNA, 25 bp, Rattus norvegicus
aggcctctctgttgaaagctgatga

SEQ ID NO: 145605 - DNA, 25 bp, Rattus norvegicus
aggcctctgagcaagactgttcgat

SEQ ID NO: 145606 - DNA, 25 bp, Rattus norvegicus
aggcctctgagcaggtcttgacacg

SEQ ID NO: 145607 - DNA, 25 bp, Rattus norvegicus
aggcctctgagctagactgttcgat

SEQ ID NO: 145608 - DNA, 25 bp, Rattus norvegicus
aggcctctgagctggtcttgacacg

SEQ ID NO: 145609 - DNA, 25 bp, Rattus norvegicus
aggcctctgaggagtcgtgtccaca

SEQ ID NO: 145610 - DNA, 25 bp, Rattus norvegicus
aggcctctgaggtgtcgtgtccaca

SEQ ID NO: 145611 - DNA, 25 bp, Rattus norvegicus
aggcctctgagtctctcaccatgta

SEQ ID NO: 145612 - DNA, 25 bp, Rattus norvegicus
aggcctctgagtgtctcaccatgta

SEQ ID NO: 145613 - DNA, 25 bp, Rattus norvegicus
aggcctctgctcatacacaagctgt

SEQ ID NO: 145614 - DNA, 25 bp, Rattus norvegicus
aggcctctgctcttacacaagctgt

SEQ ID NO: 145615 - DNA, 25 bp, Rattus norvegicus
aggcctctggcacgtctaactgggt

SEQ ID NO: 145616 - DNA, 25 bp, Rattus norvegicus
aggcctctggcaggtctaactgggt

SEQ ID NO: 145617 - DNA, 25 bp, Rattus norvegicus
aggcctctgttgaggacatgctcct

SEQ ID NO: 145618 - DNA, 25 bp, Rattus norvegicus
aggcctctgttgcatcaattagttt

SEQ ID NO: 145619 - DNA, 25 bp, Rattus norvegicus
aggcctctgttggatcaattagttt

SEQ ID NO: 145620 - DNA, 25 bp, Rattus norvegicus
aggcctctgttgtggacatgctcct

SEQ ID NO: 145621 - DNA, 25 bp, Rattus norvegicus
aggcctctgtttactcagttgctaa

SEQ ID NO: 145622 - DNA, 25 bp, Rattus norvegicus
aggcctctgttttctcagttgctaa

SEQ ID NO: 145623 - DNA, 25 bp, Rattus norvegicus
aggcctcttcctcaaaaagccggat

SEQ ID NO: 145624 - DNA, 25 bp, Rattus norvegicus
aggcctcttcctgaaaaagccggat

SEQ ID NO: 145625 - DNA, 25 bp, Rattus norvegicus
aggcctcttgccaaggctgaatagt

SEQ ID NO: 145626 - DNA, 25 bp, Rattus norvegicus
aggcctcttgcctaggctgaatagt

SEQ ID NO: 145627 - DNA, 25 bp, Rattus norvegicus
aggcctcttggcattagcttgattg

SEQ ID NO: 145628 - DNA, 25 bp, Rattus norvegicus
aggcctcttggctttagcttgattg

SEQ ID NO: 145629 - DNA, 25 bp, Rattus norvegicus
aggcctctttcccaagtggtctggg

SEQ ID NO: 145630 - DNA, 25 bp, Rattus norvegicus
aggcctctttccgaagtggtctggg

SEQ ID NO: 145631 - DNA, 25 bp, Rattus norvegicus
aggcctctttggatttgctcaggaa

SEQ ID NO: 145632 - DNA, 25 bp, Rattus norvegicus
aggcctctttggttttgctcaggaa

SEQ ID NO: 145633 - DNA, 25 bp, Rattus norvegicus
aggcctcttttcacagtctggtagg

SEQ ID NO: 145634 - DNA, 25 bp, Rattus norvegicus
aggcctcttttctcagtctggtagg

SEQ ID NO: 145635 - DNA, 25 bp, Rattus norvegicus
aggcctgaaaacatgttgtacacat

SEQ ID NO: 145636 - DNA, 25 bp, Rattus norvegicus
aggcctgaaaacttgttgtacacat

SEQ ID NO: 145637 - DNA, 25 bp, Rattus norvegicus
aggcctgaagccagttttgctagca

SEQ ID NO: 145638 - DNA, 25 bp, Rattus norvegicus
aggcctgaagcctgttttgctagca

SEQ ID NO: 145639 - DNA, 25 bp, Rattus norvegicus
aggcctgaccaacagcacagatgta

SEQ ID NO: 145640 - DNA, 25 bp, Rattus norvegicus
aggcctgaccaagagcacagatgta

SEQ ID NO: 145641 - DNA, 25 bp, Rattus norvegicus
aggcctgacctcatttgagcctgaa

SEQ ID NO: 145642 - DNA, 25 bp, Rattus norvegicus
aggcctgacctcttttgagcctgaa

SEQ ID NO: 145643 - DNA, 25 bp, Rattus norvegicus
aggcctgacgagagcctgtttctga

SEQ ID NO: 145644 - DNA, 25 bp, Rattus norvegicus
aggcctgacgagtgcctgtttctga

SEQ ID NO: 145645 - DNA, 25 bp, Rattus norvegicus
aggcctgactgcaagagccacatgg

SEQ ID NO: 145646 - DNA, 25 bp, Rattus norvegicus
aggcctgactgctagagccacatgg

SEQ ID NO: 145647 - DNA, 25 bp, Rattus norvegicus
aggcctgactgtagggctctggtca

SEQ ID NO: 145648 - DNA, 25 bp, Rattus norvegicus
aggcctgactgttgggctctggtca

SEQ ID NO: 145649 - DNA, 25 bp, Rattus norvegicus
aggcctgacttcaacagagatgttt

SEQ ID NO: 145650 - DNA, 25 bp, Rattus norvegicus
aggcctgacttctacagagatgttt

SEQ ID NO: 145651 - DNA, 25 bp, Rattus norvegicus
aggcctgacttgaagccacaatctt

SEQ ID NO: 145652 - DNA, 25 bp, Rattus norvegicus
aggcctgacttgtagccacaatctt

SEQ ID NO: 145653 - DNA, 25 bp, Rattus norvegicus
aggcctgactttcaatctcttttgt

SEQ ID NO: 145654 - DNA, 25 bp, Rattus norvegicus
aggcctgactttgaatctcttttgt

SEQ ID NO: 145655 - DNA, 25 bp, Rattus norvegicus
aggcctgagagaagttctataaagt

SEQ ID NO: 145656 - DNA, 25 bp, Rattus norvegicus
aggcctgagagatgttctataaagt

SEQ ID NO: 145657 - DNA, 25 bp, Rattus norvegicus
aggcctgagatcagagcttcctgtt

SEQ ID NO: 145658 - DNA, 25 bp, Rattus norvegicus
aggcctgagatctgagcttcctgtt

SEQ ID NO: 145659 - DNA, 25 bp, Rattus norvegicus
aggcctgagcaaacttccgttgtca

SEQ ID NO: 145660 - DNA, 25 bp, Rattus norvegicus
aggcctgagcaatcttccgttgtca

SEQ ID NO: 145661 - DNA, 25 bp, Rattus norvegicus
aggcctgatacactgctgtctttct

SEQ ID NO: 145662 - DNA, 25 bp, Rattus norvegicus
aggcctgatacagtgctgtctttct

SEQ ID NO: 145663 - DNA, 25 bp, Rattus norvegicus
aggcctgcacgaccaaatcttcggg

SEQ ID NO: 145664 - DNA, 25 bp, Rattus norvegicus
aggcctgcacgagcaaatcttcggg

SEQ ID NO: 145665 - DNA, 25 bp, Rattus norvegicus
aggcctgcagtaaccggtttctata

SEQ ID NO: 145666 - DNA, 25 bp, Rattus norvegicus
aggcctgcagtatccggtttctata

SEQ ID NO: 145667 - DNA, 25 bp, Rattus norvegicus
aggcctgcagtcattccgtggagaa

SEQ ID NO: 145668 - DNA, 25 bp, Rattus norvegicus
aggcctgcagtctttccgtggagaa

SEQ ID NO: 145669 - DNA, 25 bp, Rattus norvegicus
aggcctgcatccagaccttgattgg

SEQ ID NO: 145670 - DNA, 25 bp, Rattus norvegicus
aggcctgcatcctgaccttgattgg

SEQ ID NO: 145671 - DNA, 25 bp, Rattus norvegicus
aggcctgcccaacatggtcgagtct

SEQ ID NO: 145672 - DNA, 25 bp, Rattus norvegicus
aggcctgcccaagatggtcgagtct

SEQ ID NO: 145673 - DNA, 25 bp, Rattus norvegicus
aggcctgccccgacaaagaagggtg

SEQ ID NO: 145674 - DNA, 25 bp, Rattus norvegicus
aggcctgccccgtcaaagaagggtg

SEQ ID NO: 145675 - DNA, 25 bp, Rattus norvegicus
aggcctgcctacattggatgccaat

SEQ ID NO: 145676 - DNA, 25 bp, Rattus norvegicus
aggcctgcctactttggatgccaat

SEQ ID NO: 145677 - DNA, 25 bp, Rattus norvegicus
aggcctgcctcacagcattgctcta

SEQ ID NO: 145678 - DNA, 25 bp, Rattus norvegicus
aggcctgcctcagagcattgctcta

SEQ ID NO: 145679 - DNA, 25 bp, Rattus norvegicus
aggcctgcctgacacacatgaaaat

SEQ ID NO: 145680 - DNA, 25 bp, Rattus norvegicus
aggcctgcctgacgttctcatacat

SEQ ID NO: 145681 - DNA, 25 bp, Rattus norvegicus
aggcctgcctgagacacatgaaaat

SEQ ID NO: 145682 - DNA, 25 bp, Rattus norvegicus
aggcctgcctgaggttctcatacat

SEQ ID NO: 145683 - DNA, 25 bp, Rattus norvegicus
aggcctgcctggacttgtggtcttc

SEQ ID NO: 145684 - DNA, 25 bp, Rattus norvegicus
aggcctgcctggtcttgtggtcttc

SEQ ID NO: 145685 - DNA, 25 bp, Rattus norvegicus
aggcctgccttcctgagtcaggttt

SEQ ID NO: 145686 - DNA, 25 bp, Rattus norvegicus
aggcctgccttcctgggactagatg

SEQ ID NO: 145687 - DNA, 25 bp, Rattus norvegicus
aggcctgccttcgtgagtcaggttt

SEQ ID NO: 145688 - DNA, 25 bp, Rattus norvegicus
aggcctgccttcgtgggactagatg

SEQ ID NO: 145689 - DNA, 25 bp, Rattus norvegicus
aggcctgcctttctagatttctata

SEQ ID NO: 145690 - DNA, 25 bp, Rattus norvegicus
aggcctgcctttgtagatttctata

SEQ ID NO: 145691 - DNA, 25 bp, Rattus norvegicus
aggcctgctgccattacttggtaaa

SEQ ID NO: 145692 - DNA, 25 bp, Rattus norvegicus
aggcctgctgcctttacttggtaaa

SEQ ID NO: 145693 - DNA, 25 bp, Rattus norvegicus
aggcctgctgggaacaggacttcta

SEQ ID NO: 145694 - DNA, 25 bp, Rattus norvegicus
aggcctgctgggtacaggacttcta

SEQ ID NO: 145695 - DNA, 25 bp, Rattus norvegicus
aggcctgctgtcactctctgctctg

SEQ ID NO: 145696 - DNA, 25 bp, Rattus norvegicus
aggcctgctgtctctctctgctctg

SEQ ID NO: 145697 - DNA, 25 bp, Rattus norvegicus
aggcctgctttccatctcttagaga

SEQ ID NO: 145698 - DNA, 25 bp, Rattus norvegicus
aggcctgctttccatggcaaacagt

SEQ ID NO: 145699 - DNA, 25 bp, Rattus norvegicus
aggcctgctttcgatctcttagaga

SEQ ID NO: 145700 - DNA, 25 bp, Rattus norvegicus
aggcctgctttcgatggcaaacagt

SEQ ID NO: 145701 - DNA, 25 bp, Rattus norvegicus
aggcctggacccagagatggactgc

SEQ ID NO: 145702 - DNA, 25 bp, Rattus norvegicus
aggcctggaccctgagatggactgc

SEQ ID NO: 145703 - DNA, 25 bp, Rattus norvegicus
aggcctggaggacaagcagcctcct

SEQ ID NO: 145704 - DNA, 25 bp, Rattus norvegicus
aggcctggaggagaagcagcctcct

SEQ ID NO: 145705 - DNA, 25 bp, Rattus norvegicus
aggcctggagtactgctaaatttac

SEQ ID NO: 145706 - DNA, 25 bp, Rattus norvegicus
aggcctggagtacttgtacctgtca

SEQ ID NO: 145707 - DNA, 25 bp, Rattus norvegicus
aggcctggagtagtgctaaatttac

SEQ ID NO: 145708 - DNA, 25 bp, Rattus norvegicus
aggcctggagtagttgtacctgtca

SEQ ID NO: 145709 - DNA, 25 bp, Rattus norvegicus
aggcctggatctcgacaccataggg

SEQ ID NO: 145710 - DNA, 25 bp, Rattus norvegicus
aggcctggatctggacaccataggg

SEQ ID NO: 145711 - DNA, 25 bp, Rattus norvegicus
aggcctggcacaacctgagtcagag

SEQ ID NO: 145712 - DNA, 25 bp, Rattus norvegicus
aggcctggcacatcctgagtcagag

SEQ ID NO: 145713 - DNA, 25 bp, Rattus norvegicus
aggcctggccatacgtaaccaaagg

SEQ ID NO: 145714 - DNA, 25 bp, Rattus norvegicus
aggcctggccattcgtaaccaaagg

SEQ ID NO: 145715 - DNA, 25 bp, Rattus norvegicus
aggcctggccggcttattaggatca

SEQ ID NO: 145716 - DNA, 25 bp, Rattus norvegicus
aggcctggccgggttattaggatca

SEQ ID NO: 145717 - DNA, 25 bp, Rattus norvegicus
aggcctggccttctcttgggcaaaa

SEQ ID NO: 145718 - DNA, 25 bp, Rattus norvegicus
aggcctggccttgtcttgggcaaaa

SEQ ID NO: 145719 - DNA, 25 bp, Rattus norvegicus
aggcctggctagcacaacttaagga

SEQ ID NO: 145720 - DNA, 25 bp, Rattus norvegicus
aggcctggctaggacaacttaagga

SEQ ID NO: 145721 - DNA, 25 bp, Rattus norvegicus
aggcctggctcaagtggcgtttcat

SEQ ID NO: 145722 - DNA, 25 bp, Rattus norvegicus
aggcctggctcatgtggcgtttcat

SEQ ID NO: 145723 - DNA, 25 bp, Rattus norvegicus
aggcctggctctaagactcaaagct

SEQ ID NO: 145724 - DNA, 25 bp, Rattus norvegicus
aggcctggctctatgttactgtttg

SEQ ID NO: 145725 - DNA, 25 bp, Rattus norvegicus
aggcctggctcttagactcaaagct

SEQ ID NO: 145726 - DNA, 25 bp, Rattus norvegicus
aggcctggctctttgttactgtttg

SEQ ID NO: 145727 - DNA, 25 bp, Rattus norvegicus
aggcctgggcatcaccctagctggc

SEQ ID NO: 145728 - DNA, 25 bp, Rattus norvegicus
aggcctgggcatgaccctagctggc

SEQ ID NO: 145729 - DNA, 25 bp, Rattus norvegicus
aggcctgggcttaagacggctgaca

SEQ ID NO: 145730 - DNA, 25 bp, Rattus norvegicus
aggcctgggctttagacggctgaca

SEQ ID NO: 145731 - DNA, 25 bp, Rattus norvegicus
aggcctgggtacattctggtgagct

SEQ ID NO: 145732 - DNA, 25 bp, Rattus norvegicus
aggcctgggtactttctggtgagct

SEQ ID NO: 145733 - DNA, 25 bp, Rattus norvegicus
aggcctggtacaaagtcactactca

SEQ ID NO: 145734 - DNA, 25 bp, Rattus norvegicus
aggcctggtacatagtcactactca

SEQ ID NO: 145735 - DNA, 25 bp, Rattus norvegicus
aggcctggtactaacgtctgtctag

SEQ ID NO: 145736 - DNA, 25 bp, Rattus norvegicus
aggcctggtacttacgtctgtctag

SEQ ID NO: 145737 - DNA, 25 bp, Rattus norvegicus
aggcctggtgagagctggctggaag

SEQ ID NO: 145738 - DNA, 25 bp, Rattus norvegicus
aggcctggtgagtgctggctggaag

SEQ ID NO: 145739 - DNA, 25 bp, Rattus norvegicus
aggcctggtgtgctctccaaagtga

SEQ ID NO: 145740 - DNA, 25 bp, Rattus norvegicus
aggcctggtgtggtctccaaagtga

SEQ ID NO: 145741 - DNA, 25 bp, Rattus norvegicus
aggcctggtttcagttacaaccttg

SEQ ID NO: 145742 - DNA, 25 bp, Rattus norvegicus
aggcctggtttctgttacaaccttg

SEQ ID NO: 145743 - DNA, 25 bp, Rattus norvegicus
aggcctgtaaatccagtgctgagta

SEQ ID NO: 145744 - DNA, 25 bp, Rattus norvegicus
aggcctgtaaatgcagtgctgagta

SEQ ID NO: 145745 - DNA, 25 bp, Rattus norvegicus
aggcctgtaattcgaccagaagtaa

SEQ ID NO: 145746 - DNA, 25 bp, Rattus norvegicus
aggcctgtaattggaccagaagtaa

SEQ ID NO: 145747 - DNA, 25 bp, Rattus norvegicus
aggcctgtacccagcagtgtactat

SEQ ID NO: 145748 - DNA, 25 bp, Rattus norvegicus
aggcctgtaccctgcagtgtactat

SEQ ID NO: 145749 - DNA, 25 bp, Rattus norvegicus
aggcctgtacgacctgggttctgcc

SEQ ID NO: 145750 - DNA, 25 bp, Rattus norvegicus
aggcctgtacgagctgggttctgcc

SEQ ID NO: 145751 - DNA, 25 bp, Rattus norvegicus
aggcctgtactgaggagtcttccca

SEQ ID NO: 145752 - DNA, 25 bp, Rattus norvegicus
aggcctgtactgtggagtcttccca

SEQ ID NO: 145753 - DNA, 25 bp, Rattus norvegicus
aggcctgtagccaaggtctgagctc

SEQ ID NO: 145754 - DNA, 25 bp, Rattus norvegicus
aggcctgtagcctaggtctgagctc

SEQ ID NO: 145755 - DNA, 25 bp, Rattus norvegicus
aggcctgtatctactgttcggctac

SEQ ID NO: 145756 - DNA, 25 bp, Rattus norvegicus
aggcctgtatcttctgttcggctac

SEQ ID NO: 145757 - DNA, 25 bp, Rattus norvegicus
aggcctgtcacacgaatctggttgg

SEQ ID NO: 145758 - DNA, 25 bp, Rattus norvegicus
aggcctgtcacaggaatctggttgg

SEQ ID NO: 145759 - DNA, 25 bp, Rattus norvegicus
aggcctgtccctccctagtgagaaa

SEQ ID NO: 145760 - DNA, 25 bp, Rattus norvegicus
aggcctgtccctgcctagtgagaaa

SEQ ID NO: 145761 - DNA, 25 bp, Rattus norvegicus
aggcctgtccggaagactgcaacga

SEQ ID NO: 145762 - DNA, 25 bp, Rattus norvegicus
aggcctgtccggtagactgcaacga

SEQ ID NO: 145763 - DNA, 25 bp, Rattus norvegicus
aggcctgtctcgctgctgttgagaa

SEQ ID NO: 145764 - DNA, 25 bp, Rattus norvegicus
aggcctgtctcggtgctgttgagaa

SEQ ID NO: 145765 - DNA, 25 bp, Rattus norvegicus
aggcctgtctggagtgttctgaaac

SEQ ID NO: 145766 - DNA, 25 bp, Rattus norvegicus
aggcctgtctggtgtgttctgaaac

SEQ ID NO: 145767 - DNA, 25 bp, Rattus norvegicus
aggcctgtgaatcgacttccctaag

SEQ ID NO: 145768 - DNA, 25 bp, Rattus norvegicus
aggcctgtgaatggacttccctaag

SEQ ID NO: 145769 - DNA, 25 bp, Rattus norvegicus
aggcctgtgacgcaattcgctgtta

SEQ ID NO: 145770 - DNA, 25 bp, Rattus norvegicus
aggcctgtgacggaattcgctgtta

SEQ ID NO: 145771 - DNA, 25 bp, Rattus norvegicus
aggcctgtgccaactgtgaatatga

SEQ ID NO: 145772 - DNA, 25 bp, Rattus norvegicus
aggcctgtgccatctgtgaatatga

SEQ ID NO: 145773 - DNA, 25 bp, Rattus norvegicus
aggcctgtgcttcaactgattacca

SEQ ID NO: 145774 - DNA, 25 bp, Rattus norvegicus
aggcctgtgcttcttgagcatgcaa

SEQ ID NO: 145775 - DNA, 25 bp, Rattus norvegicus
aggcctgtgcttgaactgattacca

SEQ ID NO: 145776 - DNA, 25 bp, Rattus norvegicus
aggcctgtgcttgttgagcatgcaa

SEQ ID NO: 145777 - DNA, 25 bp, Rattus norvegicus
aggcctgtgtctcattatggaaacg

SEQ ID NO: 145778 - DNA, 25 bp, Rattus norvegicus
aggcctgtgtctgattatggaaacg

SEQ ID NO: 145779 - DNA, 25 bp, Rattus norvegicus
aggcctgttctgctgcgcatggaaa

SEQ ID NO: 145780 - DNA, 25 bp, Rattus norvegicus
aggcctgttctggtgcgcatggaaa

SEQ ID NO: 145781 - DNA, 25 bp, Rattus norvegicus
aggcctgttggcattgagactgtag

SEQ ID NO: 145782 - DNA, 25 bp, Rattus norvegicus
aggcctgttggctttgagactgtag

SEQ ID NO: 145783 - DNA, 25 bp, Rattus norvegicus
aggcctgttttgagaactgcgttga

SEQ ID NO: 145784 - DNA, 25 bp, Rattus norvegicus
aggcctgttttgtgaactgcgttga

SEQ ID NO: 145785 - DNA, 25 bp, Rattus norvegicus
aggccttaacgcactgattcaggac

SEQ ID NO: 145786 - DNA, 25 bp, Rattus norvegicus
aggccttaacgctctgattcaggac

SEQ ID NO: 145787 - DNA, 25 bp, Rattus norvegicus
aggccttacaaaccacactgcagga

SEQ ID NO: 145788 - DNA, 25 bp, Rattus norvegicus
aggccttacaaagcacactgcagga

SEQ ID NO: 145789 - DNA, 25 bp, Rattus norvegicus
aggccttacaatagcagtgacccgg

SEQ ID NO: 145790 - DNA, 25 bp, Rattus norvegicus
aggccttacaattgcagtgacccgg

SEQ ID NO: 145791 - DNA, 25 bp, Rattus norvegicus
aggccttacccactagcttggaaga

SEQ ID NO: 145792 - DNA, 25 bp, Rattus norvegicus
aggccttacccagtagcttggaaga

SEQ ID NO: 145793 - DNA, 25 bp, Rattus norvegicus
aggccttactgcactgtttacagtg

SEQ ID NO: 145794 - DNA, 25 bp, Rattus norvegicus
aggccttactgctctgtttacagtg

SEQ ID NO: 145795 - DNA, 25 bp, Rattus norvegicus
aggccttagcagattttggagtgtc

SEQ ID NO: 145796 - DNA, 25 bp, Rattus norvegicus
aggccttagcagtttttggagtgtc

SEQ ID NO: 145797 - DNA, 25 bp, Rattus norvegicus
aggccttatgccatgctgatttttt

SEQ ID NO: 145798 - DNA, 25 bp, Rattus norvegicus
aggccttatgccttgctgatttttt

SEQ ID NO: 145799 - DNA, 25 bp, Rattus norvegicus
aggccttcaatcacatccgtgaaaa

SEQ ID NO: 145800 - DNA, 25 bp, Rattus norvegicus
aggccttcaatctcatccgtgaaaa

SEQ ID NO: 145801 - DNA, 25 bp, Rattus norvegicus
aggccttcaggtcgccaaagggctt

SEQ ID NO: 145802 - DNA, 25 bp, Rattus norvegicus
aggccttcaggtggccaaagggctt

SEQ ID NO: 145803 - DNA, 25 bp, Rattus norvegicus
aggccttcccagctgtgcacagttt

SEQ ID NO: 145804 - DNA, 25 bp, Rattus norvegicus
aggccttcccaggtgtgcacagttt

SEQ ID NO: 145805 - DNA, 25 bp, Rattus norvegicus
aggccttccgttcgctgcacaatga

SEQ ID NO: 145806 - DNA, 25 bp, Rattus norvegicus
aggccttccgttggctgcacaatga

SEQ ID NO: 145807 - DNA, 25 bp, Rattus norvegicus
aggccttcgcttagccaaattactg

SEQ ID NO: 145808 - DNA, 25 bp, Rattus norvegicus
aggccttcgctttgccaaattactg

SEQ ID NO: 145809 - DNA, 25 bp, Rattus norvegicus
aggccttctagtattttatgcaaca

SEQ ID NO: 145810 - DNA, 25 bp, Rattus norvegicus
aggccttctagttttttatgcaaca

SEQ ID NO: 145811 - DNA, 25 bp, Rattus norvegicus
aggccttctcagctgccatcgaaag

SEQ ID NO: 145812 - DNA, 25 bp, Rattus norvegicus
aggccttctcaggtgccatcgaaag

SEQ ID NO: 145813 - DNA, 25 bp, Rattus norvegicus
aggccttctccccaggatcatctgg

SEQ ID NO: 145814 - DNA, 25 bp, Rattus norvegicus
aggccttctcccgaggatcatctgg

SEQ ID NO: 145815 - DNA, 25 bp, Rattus norvegicus
aggccttctctcataattttgtatt

SEQ ID NO: 145816 - DNA, 25 bp, Rattus norvegicus
aggccttctctcttaattttgtatt

SEQ ID NO: 145817 - DNA, 25 bp, Rattus norvegicus
aggccttctgaacctgtggtaccaa

SEQ ID NO: 145818 - DNA, 25 bp, Rattus norvegicus
aggccttctgaagctgtggtaccaa

SEQ ID NO: 145819 - DNA, 25 bp, Rattus norvegicus
aggccttcttacaggctgtcggtgc

SEQ ID NO: 145820 - DNA, 25 bp, Rattus norvegicus
aggccttcttactggctgtcggtgc

SEQ ID NO: 145821 - DNA, 25 bp, Rattus norvegicus
aggccttcttcaaactctgagtacg

SEQ ID NO: 145822 - DNA, 25 bp, Rattus norvegicus
aggccttcttcatactctgagtacg

SEQ ID NO: 145823 - DNA, 25 bp, Rattus norvegicus
aggccttcttcccaaacatggtgaa

SEQ ID NO: 145824 - DNA, 25 bp, Rattus norvegicus
aggccttcttccgaaacatggtgaa

SEQ ID NO: 145825 - DNA, 25 bp, Rattus norvegicus
aggccttgaacaactctggagcagc

SEQ ID NO: 145826 - DNA, 25 bp, Rattus norvegicus
aggccttgaacatctctggagcagc

SEQ ID NO: 145827 - DNA, 25 bp, Rattus norvegicus
aggccttgacttcaggtatttggaa

SEQ ID NO: 145828 - DNA, 25 bp, Rattus norvegicus
aggccttgacttgaggtatttggaa

SEQ ID NO: 145829 - DNA, 25 bp, Rattus norvegicus
aggccttgatccacattttcacagg

SEQ ID NO: 145830 - DNA, 25 bp, Rattus norvegicus
aggccttgatcctcattttcacagg

SEQ ID NO: 145831 - DNA, 25 bp, Rattus norvegicus
aggccttgatggcaagctaacccca

SEQ ID NO: 145832 - DNA, 25 bp, Rattus norvegicus
aggccttgatgggaagctaacccca

SEQ ID NO: 145833 - DNA, 25 bp, Rattus norvegicus
aggccttgcagcaaggttccgagcc

SEQ ID NO: 145834 - DNA, 25 bp, Rattus norvegicus
aggccttgcagctaggttccgagcc

SEQ ID NO: 145835 - DNA, 25 bp, Rattus norvegicus
aggccttgccagacgctgtggtgta

SEQ ID NO: 145836 - DNA, 25 bp, Rattus norvegicus
aggccttgccagtcgctgtggtgta

SEQ ID NO: 145837 - DNA, 25 bp, Rattus norvegicus
aggccttgcccaagttgtaccacat

SEQ ID NO: 145838 - DNA, 25 bp, Rattus norvegicus
aggccttgcccatgttgtaccacat

SEQ ID NO: 145839 - DNA, 25 bp, Rattus norvegicus
aggccttgctgcagcaggctttcaa

SEQ ID NO: 145840 - DNA, 25 bp, Rattus norvegicus
aggccttgctgcagtatgccatggg

SEQ ID NO: 145841 - DNA, 25 bp, Rattus norvegicus
aggccttgctgctgcaggctttcaa

SEQ ID NO: 145842 - DNA, 25 bp, Rattus norvegicus
aggccttgctgctgtatgccatggg

SEQ ID NO: 145843 - DNA, 25 bp, Rattus norvegicus
aggccttggactcgagaatcgatca

SEQ ID NO: 145844 - DNA, 25 bp, Rattus norvegicus
aggccttggactggagaatcgatca

SEQ ID NO: 145845 - DNA, 25 bp, Rattus norvegicus
aggccttggcagcagactcaaacac

SEQ ID NO: 145846 - DNA, 25 bp, Rattus norvegicus
aggccttggcaggagactcaaacac

SEQ ID NO: 145847 - DNA, 25 bp, Rattus norvegicus
aggccttggccccttatggtcgcaa

SEQ ID NO: 145848 - DNA, 25 bp, Rattus norvegicus
aggccttggcccgttatggtcgcaa

SEQ ID NO: 145849 - DNA, 25 bp, Rattus norvegicus
aggccttggcctcagagaacatttt

SEQ ID NO: 145850 - DNA, 25 bp, Rattus norvegicus
aggccttggcctgagagaacatttt

SEQ ID NO: 145851 - DNA, 25 bp, Rattus norvegicus
aggccttgggaacatcctcaactcc

SEQ ID NO: 145852 - DNA, 25 bp, Rattus norvegicus
aggccttgggaagatcctcaactcc

SEQ ID NO: 145853 - DNA, 25 bp, Rattus norvegicus
aggccttgggccaggacagctgtaa

SEQ ID NO: 145854 - DNA, 25 bp, Rattus norvegicus
aggccttgggcctggacagctgtaa

SEQ ID NO: 145855 - DNA, 25 bp, Rattus norvegicus
aggccttgggtgacctgctggtata

SEQ ID NO: 145856 - DNA, 25 bp, Rattus norvegicus
aggccttgggtgtcctgctggtata

SEQ ID NO: 145857 - DNA, 25 bp, Rattus norvegicus
aggccttgtcatctggaagccccag

SEQ ID NO: 145858 - DNA, 25 bp, Rattus norvegicus
aggccttgtcatgtggaagccccag

SEQ ID NO: 145859 - DNA, 25 bp, Rattus norvegicus
aggccttgtccacagatacatgcaa

SEQ ID NO: 145860 - DNA, 25 bp, Rattus norvegicus
aggccttgtccagagatacatgcaa

SEQ ID NO: 145861 - DNA, 25 bp, Rattus norvegicus
aggccttgtgacctgacagtagctc

SEQ ID NO: 145862 - DNA, 25 bp, Rattus norvegicus
aggccttgtgacgtgacagtagctc

SEQ ID NO: 145863 - DNA, 25 bp, Rattus norvegicus
aggccttgtggcactgtctcccaag

SEQ ID NO: 145864 - DNA, 25 bp, Rattus norvegicus
aggccttgtggctctgtctcccaag

SEQ ID NO: 145865 - DNA, 25 bp, Rattus norvegicus
aggccttgtggtctctgtcttgcac

SEQ ID NO: 145866 - DNA, 25 bp, Rattus norvegicus
aggccttgtggtgtctgtcttgcac

SEQ ID NO: 145867 - DNA, 25 bp, Rattus norvegicus
aggcctttaaatacacctttatgat

SEQ ID NO: 145868 - DNA, 25 bp, Rattus norvegicus
aggcctttaaattcacctttatgat

SEQ ID NO: 145869 - DNA, 25 bp, Rattus norvegicus
aggcctttaattactgtctgcttat

SEQ ID NO: 145870 - DNA, 25 bp, Rattus norvegicus
aggcctttaatttctgtctgcttat

SEQ ID NO: 145871 - DNA, 25 bp, Rattus norvegicus
aggcctttaggacctatctctgcag

SEQ ID NO: 145872 - DNA, 25 bp, Rattus norvegicus
aggcctttaggagctatctctgcag

SEQ ID NO: 145873 - DNA, 25 bp, Rattus norvegicus
aggcctttaggcctttttcactcag

SEQ ID NO: 145874 - DNA, 25 bp, Rattus norvegicus
aggcctttaggcgtttttcactcag

SEQ ID NO: 145875 - DNA, 25 bp, Rattus norvegicus
aggcctttctagacattcactgccc

SEQ ID NO: 145876 - DNA, 25 bp, Rattus norvegicus
aggcctttctagtcattcactgccc

SEQ ID NO: 145877 - DNA, 25 bp, Rattus norvegicus
aggcctttctgcagggtcaaacaag

SEQ ID NO: 145878 - DNA, 25 bp, Rattus norvegicus
aggcctttctgctgggtcaaacaag

SEQ ID NO: 145879 - DNA, 25 bp, Rattus norvegicus
aggcctttctggacttgatgtttcc

SEQ ID NO: 145880 - DNA, 25 bp, Rattus norvegicus
aggcctttctggtcttgatgtttcc

SEQ ID NO: 145881 - DNA, 25 bp, Rattus norvegicus
aggcctttctgtagagtggacgtgc

SEQ ID NO: 145882 - DNA, 25 bp, Rattus norvegicus
aggcctttctgttgagtggacgtgc

SEQ ID NO: 145883 - DNA, 25 bp, Rattus norvegicus
aggcctttgacaccctccaaatgat

SEQ ID NO: 145884 - DNA, 25 bp, Rattus norvegicus
aggcctttgacagcctccaaatgat

SEQ ID NO: 145885 - DNA, 25 bp, Rattus norvegicus
aggcctttgcaacaagagctcccgt

SEQ ID NO: 145886 - DNA, 25 bp, Rattus norvegicus
aggcctttgcaagaagagctcccgt

SEQ ID NO: 145887 - DNA, 25 bp, Rattus norvegicus
aggcctttgcctagctcgaattgat

SEQ ID NO: 145888 - DNA, 25 bp, Rattus norvegicus
aggcctttgccttgctcgaattgat

SEQ ID NO: 145889 - DNA, 25 bp, Rattus norvegicus
aggcctttggaaatctggtctttct

SEQ ID NO: 145890 - DNA, 25 bp, Rattus norvegicus
aggcctttggaattctggtctttct

SEQ ID NO: 145891 - DNA, 25 bp, Rattus norvegicus
aggcctttggcacagttcatgtcta

SEQ ID NO: 145892 - DNA, 25 bp, Rattus norvegicus
aggcctttggcagagttcatgtcta

SEQ ID NO: 145893 - DNA, 25 bp, Rattus norvegicus
aggcctttggctcactgtgtggaac

SEQ ID NO: 145894 - DNA, 25 bp, Rattus norvegicus
aggcctttggctgactgtgtggaac

SEQ ID NO: 145895 - DNA, 25 bp, Rattus norvegicus
aggcctttgggcagctagcttctat

SEQ ID NO: 145896 - DNA, 25 bp, Rattus norvegicus
aggcctttgggctgctagcttctat

SEQ ID NO: 145897 - DNA, 25 bp, Rattus norvegicus
aggcctttggtcaacacacagtata

SEQ ID NO: 145898 - DNA, 25 bp, Rattus norvegicus
aggcctttggtctacacacagtata

SEQ ID NO: 145899 - DNA, 25 bp, Rattus norvegicus
aggcctttggttcgttcagccccat

SEQ ID NO: 145900 - DNA, 25 bp, Rattus norvegicus
aggcctttggttggttcagccccat

SEQ ID NO: 145901 - DNA, 25 bp, Rattus norvegicus
aggcctttgtgaactctgctccaag

SEQ ID NO: 145902 - DNA, 25 bp, Rattus norvegicus
aggcctttgtgatctctgctccaag

SEQ ID NO: 145903 - DNA, 25 bp, Rattus norvegicus
aggccttttagcagaccctggagag

SEQ ID NO: 145904 - DNA, 25 bp, Rattus norvegicus
aggccttttagctgaccctggagag

SEQ ID NO: 145905 - DNA, 25 bp, Rattus norvegicus
aggccttttattctgttactggaca

SEQ ID NO: 145906 - DNA, 25 bp, Rattus norvegicus
aggccttttattgtgttactggaca

SEQ ID NO: 145907 - DNA, 25 bp, Rattus norvegicus
aggccttttcctattgatcccaaat

SEQ ID NO: 145908 - DNA, 25 bp, Rattus norvegicus
aggccttttccttttgatcccaaat

SEQ ID NO: 145909 - DNA, 25 bp, Rattus norvegicus
aggccttttcttactgtacagcagg

SEQ ID NO: 145910 - DNA, 25 bp, Rattus norvegicus
aggccttttctttctgtacagcagg

SEQ ID NO: 145911 - DNA, 25 bp, Rattus norvegicus
aggccttttgacctagaagccagca

SEQ ID NO: 145912 - DNA, 25 bp, Rattus norvegicus
aggccttttgacgtagaagccagca

SEQ ID NO: 145913 - DNA, 25 bp, Rattus norvegicus
aggccttttgtgatggaggacactg

SEQ ID NO: 145914 - DNA, 25 bp, Rattus norvegicus
aggccttttgtgttggaggacactg

SEQ ID NO: 145915 - DNA, 25 bp, Rattus norvegicus
aggcgaaagatccagtgacagctcc

SEQ ID NO: 145916 - DNA, 25 bp, Rattus norvegicus
aggcgaaagatcgagtgacagctcc

SEQ ID NO: 145917 - DNA, 25 bp, Rattus norvegicus
aggcgaacaagactcccatggactg

SEQ ID NO: 145918 - DNA, 25 bp, Rattus norvegicus
aggcgaacaagagtcccatggactg

SEQ ID NO: 145919 - DNA, 25 bp, Rattus norvegicus
aggcgaagcccactttggagtctga

SEQ ID NO: 145920 - DNA, 25 bp, Rattus norvegicus
aggcgaagcccagtttggagtctga

SEQ ID NO: 145921 - DNA, 25 bp, Rattus norvegicus
aggcgaagccccagggcccgagcaa

SEQ ID NO: 145922 - DNA, 25 bp, Rattus norvegicus
aggcgaagcccctgggcccgagcaa

SEQ ID NO: 145923 - DNA, 25 bp, Rattus norvegicus
aggcgaagccgcagccgcgagataa

SEQ ID NO: 145924 - DNA, 25 bp, Rattus norvegicus
aggcgaagccgctgccgcgagataa

SEQ ID NO: 145925 - DNA, 25 bp, Rattus norvegicus
aggcgaatctctagagcttggctgc

SEQ ID NO: 145926 - DNA, 25 bp, Rattus norvegicus
aggcgaatctcttgagcttggctgc

SEQ ID NO: 145927 - DNA, 25 bp, Rattus norvegicus
aggcgaatgtcacttgccatccagc

SEQ ID NO: 145928 - DNA, 25 bp, Rattus norvegicus
aggcgaatgtcagttgccatccagc

SEQ ID NO: 145929 - DNA, 25 bp, Rattus norvegicus
aggcgacaaagtcactcaggcccaa

SEQ ID NO: 145930 - DNA, 25 bp, Rattus norvegicus
aggcgacaaagtgactcaggcccaa

SEQ ID NO: 145931 - DNA, 25 bp, Rattus norvegicus
aggcgacacagaagccacagcgcgt

SEQ ID NO: 145932 - DNA, 25 bp, Rattus norvegicus
aggcgacacagatgccacagcgcgt

SEQ ID NO: 145933 - DNA, 25 bp, Rattus norvegicus
aggcgacagaaccttgtcctcaggt

SEQ ID NO: 145934 - DNA, 25 bp, Rattus norvegicus
aggcgacagaacgttgtcctcaggt

SEQ ID NO: 145935 - DNA, 25 bp, Rattus norvegicus
aggcgacagactacctcaccgaggt

SEQ ID NO: 145936 - DNA, 25 bp, Rattus norvegicus
aggcgacagacttcctcaccgaggt

SEQ ID NO: 145937 - DNA, 25 bp, Rattus norvegicus
aggcgacagtatacttgccctcagt

SEQ ID NO: 145938 - DNA, 25 bp, Rattus norvegicus
aggcgacagtattcttgccctcagt

SEQ ID NO: 145939 - DNA, 25 bp, Rattus norvegicus
aggcgaccacttatatctgatgaag

SEQ ID NO: 145940 - DNA, 25 bp, Rattus norvegicus
aggcgaccacttttatctgatgaag

SEQ ID NO: 145941 - DNA, 25 bp, Rattus norvegicus
aggcgacccggaactacatagcaag

SEQ ID NO: 145942 - DNA, 25 bp, Rattus norvegicus
aggcgacccggatctacatagcaag

SEQ ID NO: 145943 - DNA, 25 bp, Rattus norvegicus
aggcgacctgccagaagttttcagc

SEQ ID NO: 145944 - DNA, 25 bp, Rattus norvegicus
aggcgacctgcctgaagttttcagc

SEQ ID NO: 145945 - DNA, 25 bp, Rattus norvegicus
aggcgacctggcatttgacttatct

SEQ ID NO: 145946 - DNA, 25 bp, Rattus norvegicus
aggcgacctggcttttgacttatct

SEQ ID NO: 145947 - DNA, 25 bp, Rattus norvegicus
aggcgaccttgcaatagcagctctt

SEQ ID NO: 145948 - DNA, 25 bp, Rattus norvegicus
aggcgaccttgctatagcagctctt

SEQ ID NO: 145949 - DNA, 25 bp, Rattus norvegicus
aggcgacggcgtcgacaggcgcgaa

SEQ ID NO: 145950 - DNA, 25 bp, Rattus norvegicus
aggcgacggcgtggacaggcgcgaa

SEQ ID NO: 145951 - DNA, 25 bp, Rattus norvegicus
aggcgactcagacactcgggaactg

SEQ ID NO: 145952 - DNA, 25 bp, Rattus norvegicus
aggcgactcagagactcgggaactg

SEQ ID NO: 145953 - DNA, 25 bp, Rattus norvegicus
aggcgactcaggaccttcacgtagt

SEQ ID NO: 145954 - DNA, 25 bp, Rattus norvegicus
aggcgactcaggtccttcacgtagt

SEQ ID NO: 145955 - DNA, 25 bp, Rattus norvegicus
aggcgactgggaaaccaggctctct

SEQ ID NO: 145956 - DNA, 25 bp, Rattus norvegicus
aggcgactgggataccaggctctct

SEQ ID NO: 145957 - DNA, 25 bp, Rattus norvegicus
aggcgacttctaagaggagccaaga

SEQ ID NO: 145958 - DNA, 25 bp, Rattus norvegicus
aggcgacttctatgaggagccaaga

SEQ ID NO: 145959 - DNA, 25 bp, Rattus norvegicus
aggcgagagcgacctctgcgctggg

SEQ ID NO: 145960 - DNA, 25 bp, Rattus norvegicus
aggcgagagcgagctctgcgctggg

SEQ ID NO: 145961 - DNA, 25 bp, Rattus norvegicus
aggcgagatgtcaaccaatggtcag

SEQ ID NO: 145962 - DNA, 25 bp, Rattus norvegicus
aggcgagatgtctaccaatggtcag

SEQ ID NO: 145963 - DNA, 25 bp, Rattus norvegicus
aggcgagccattcccagcatttgca

SEQ ID NO: 145964 - DNA, 25 bp, Rattus norvegicus
aggcgagccattgccagcatttgca

SEQ ID NO: 145965 - DNA, 25 bp, Rattus norvegicus
aggcgagcccttccatagagcgtta

SEQ ID NO: 145966 - DNA, 25 bp, Rattus norvegicus
aggcgagcccttgcatagagcgtta

SEQ ID NO: 145967 - DNA, 25 bp, Rattus norvegicus
aggcgagccggcagcggtcacgtga

SEQ ID NO: 145968 - DNA, 25 bp, Rattus norvegicus
aggcgagccggctgcggtcacgtga

SEQ ID NO: 145969 - DNA, 25 bp, Rattus norvegicus
aggcgagccttactagttcagcact

SEQ ID NO: 145970 - DNA, 25 bp, Rattus norvegicus
aggcgagccttagtagttcagcact

SEQ ID NO: 145971 - DNA, 25 bp, Rattus norvegicus
aggcgagcggtactgcaagactact

SEQ ID NO: 145972 - DNA, 25 bp, Rattus norvegicus
aggcgagcggtagtgcaagactact

SEQ ID NO: 145973 - DNA, 25 bp, Rattus norvegicus
aggcgagctactccgtgtgttcaca

SEQ ID NO: 145974 - DNA, 25 bp, Rattus norvegicus
aggcgagctactgcgtgtgttcaca

SEQ ID NO: 145975 - DNA, 25 bp, Rattus norvegicus
aggcgagctgccatgactgcttagt

SEQ ID NO: 145976 - DNA, 25 bp, Rattus norvegicus
aggcgagctgccttgactgcttagt

SEQ ID NO: 145977 - DNA, 25 bp, Rattus norvegicus
aggcgaggacacacaggcccggact

SEQ ID NO: 145978 - DNA, 25 bp, Rattus norvegicus
aggcgaggacactcaggcccggact

SEQ ID NO: 145979 - DNA, 25 bp, Rattus norvegicus
aggcgaggccgcagagctgacatat

SEQ ID NO: 145980 - DNA, 25 bp, Rattus norvegicus
aggcgaggccgctgagctgacatat

SEQ ID NO: 145981 - DNA, 25 bp, Rattus norvegicus
aggcgagggctcaggagcactctca

SEQ ID NO: 145982 - DNA, 25 bp, Rattus norvegicus
aggcgagggctctggagcactctca

SEQ ID NO: 145983 - DNA, 25 bp, Rattus norvegicus
aggcgagtaactatgcagcatgagt

SEQ ID NO: 145984 - DNA, 25 bp, Rattus norvegicus
aggcgagtaactttgcagcatgagt

SEQ ID NO: 145985 - DNA, 25 bp, Rattus norvegicus
aggcgagtcctaccaggatcttgtc

SEQ ID NO: 145986 - DNA, 25 bp, Rattus norvegicus
aggcgagtcctagcaggatcttgtc

SEQ ID NO: 145987 - DNA, 25 bp, Rattus norvegicus
aggcgagtggatcccagacttctga

SEQ ID NO: 145988 - DNA, 25 bp, Rattus norvegicus
aggcgagtggatgccagacttctga

SEQ ID NO: 145989 - DNA, 25 bp, Rattus norvegicus
aggcgagttcatccacgccagtggt

SEQ ID NO: 145990 - DNA, 25 bp, Rattus norvegicus
aggcgagttcatgcacgccagtggt

SEQ ID NO: 145991 - DNA, 25 bp, Rattus norvegicus
aggcgagttcttagttccaaacctg

SEQ ID NO: 145992 - DNA, 25 bp, Rattus norvegicus
aggcgagttctttgttccaaacctg

SEQ ID NO: 145993 - DNA, 25 bp, Rattus norvegicus
aggcgataatctcctctatgttcat

SEQ ID NO: 145994 - DNA, 25 bp, Rattus norvegicus
aggcgataatctgctctatgttcat

SEQ ID NO: 145995 - DNA, 25 bp, Rattus norvegicus
aggcgatcgtgaccgctatgcagat

SEQ ID NO: 145996 - DNA, 25 bp, Rattus norvegicus
aggcgatcgtgagcgctatgcagat

SEQ ID NO: 145997 - DNA, 25 bp, Rattus norvegicus
aggcgatctcatatttgctctctga

SEQ ID NO: 145998 - DNA, 25 bp, Rattus norvegicus
aggcgatctcatttttgctctctga

SEQ ID NO: 145999 - DNA, 25 bp, Rattus norvegicus
aggcgatgcctccaactctaaagtg

SEQ ID NO: 146000 - DNA, 25 bp, Rattus norvegicus
aggcgatgcctcgaactctaaagtg

SEQ ID NO: 146001 - DNA, 25 bp, Rattus norvegicus
aggcgatgcgaacccagatgcagca

SEQ ID NO: 146002 - DNA, 25 bp, Rattus norvegicus
aggcgatgcgaagccagatgcagca

SEQ ID NO: 146003 - DNA, 25 bp, Rattus norvegicus
aggcgatgcttcctgtgcaaagtga

SEQ ID NO: 146004 - DNA, 25 bp, Rattus norvegicus
aggcgatgcttcgtgtgcaaagtga

SEQ ID NO: 146005 - DNA, 25 bp, Rattus norvegicus
aggcgatgtttcctttgtttgctgt

SEQ ID NO: 146006 - DNA, 25 bp, Rattus norvegicus
aggcgatgtttcgtttgtttgctgt

SEQ ID NO: 146007 - DNA, 25 bp, Rattus norvegicus
aggcgattatcgctttaaggtctta

SEQ ID NO: 146008 - DNA, 25 bp, Rattus norvegicus
aggcgattatcggtttaaggtctta

SEQ ID NO: 146009 - DNA, 25 bp, Rattus norvegicus
aggcgatttctgattgtctttttac

SEQ ID NO: 146010 - DNA, 25 bp, Rattus norvegicus
aggcgatttctgtttgtctttttac

SEQ ID NO: 146011 - DNA, 25 bp, Rattus norvegicus
aggcgcaactggaacactggtgatc

SEQ ID NO: 146012 - DNA, 25 bp, Rattus norvegicus
aggcgcaactggtacactggtgatc

SEQ ID NO: 146013 - DNA, 25 bp, Rattus norvegicus
aggcgcacaacgagcactctcaggg

SEQ ID NO: 146014 - DNA, 25 bp, Rattus norvegicus
aggcgcacaacgtgcactctcaggg

SEQ ID NO: 146015 - DNA, 25 bp, Rattus norvegicus
aggcgcacaggcactattgggagct

SEQ ID NO: 146016 - DNA, 25 bp, Rattus norvegicus
aggcgcacaggctctattgggagct

SEQ ID NO: 146017 - DNA, 25 bp, Rattus norvegicus
aggcgcacgtgaacacctgctataa

SEQ ID NO: 146018 - DNA, 25 bp, Rattus norvegicus
aggcgcacgtgatcacctgctataa

SEQ ID NO: 146019 - DNA, 25 bp, Rattus norvegicus
aggcgcacttcacagacacgagcac

SEQ ID NO: 146020 - DNA, 25 bp, Rattus norvegicus
aggcgcacttcagagacacgagcac

SEQ ID NO: 146021 - DNA, 25 bp, Rattus norvegicus
aggcgcagatctagagggccttctc

SEQ ID NO: 146022 - DNA, 25 bp, Rattus norvegicus
aggcgcagatcttgagggccttctc

SEQ ID NO: 146023 - DNA, 25 bp, Rattus norvegicus
aggcgcagcagcatgccaatgtgga

SEQ ID NO: 146024 - DNA, 25 bp, Rattus norvegicus
aggcgcagcagcttgccaatgtgga

SEQ ID NO: 146025 - DNA, 25 bp, Rattus norvegicus
aggcgcagctctcggcctccagaga

SEQ ID NO: 146026 - DNA, 25 bp, Rattus norvegicus
aggcgcagctctgggcctccagaga

SEQ ID NO: 146027 - DNA, 25 bp, Rattus norvegicus
aggcgcagctttcccggtggaacat

SEQ ID NO: 146028 - DNA, 25 bp, Rattus norvegicus
aggcgcagctttgccggtggaacat

SEQ ID NO: 146029 - DNA, 25 bp, Rattus norvegicus
aggcgcatctctcgtgggtcacatc

SEQ ID NO: 146030 - DNA, 25 bp, Rattus norvegicus
aggcgcatctctggtgggtcacatc

SEQ ID NO: 146031 - DNA, 25 bp, Rattus norvegicus
aggcgccaaaggctatcgtatgttc

SEQ ID NO: 146032 - DNA, 25 bp, Rattus norvegicus
aggcgccaaagggtatcgtatgttc

SEQ ID NO: 146033 - DNA, 25 bp, Rattus norvegicus
aggcgccacccaaggagaagccgga

SEQ ID NO: 146034 - DNA, 25 bp, Rattus norvegicus
aggcgccacccatggagaagccgga

SEQ ID NO: 146035 - DNA, 25 bp, Rattus norvegicus
aggcgccactgtatcttaatcaagg

SEQ ID NO: 146036 - DNA, 25 bp, Rattus norvegicus
aggcgccactgtcaaagccctggtt

SEQ ID NO: 146037 - DNA, 25 bp, Rattus norvegicus
aggcgccactgtgaaagccctggtt

SEQ ID NO: 146038 - DNA, 25 bp, Rattus norvegicus
aggcgccactgtttcttaatcaagg

SEQ ID NO: 146039 - DNA, 25 bp, Rattus norvegicus
aggcgccagaccatgaagccaatgt

SEQ ID NO: 146040 - DNA, 25 bp, Rattus norvegicus
aggcgccagaccttgaagccaatgt

SEQ ID NO: 146041 - DNA, 25 bp, Rattus norvegicus
aggcgccaggttatgcgtgaccttt

SEQ ID NO: 146042 - DNA, 25 bp, Rattus norvegicus
aggcgccaggttttgcgtgaccttt

SEQ ID NO: 146043 - DNA, 25 bp, Rattus norvegicus
aggcgccagtgtcccatcttagatg

SEQ ID NO: 146044 - DNA, 25 bp, Rattus norvegicus
aggcgccagtgtgccatcttagatg

SEQ ID NO: 146045 - DNA, 25 bp, Rattus norvegicus
aggcgcccaatacctatttgttgaa

SEQ ID NO: 146046 - DNA, 25 bp, Rattus norvegicus
aggcgcccaatagctatttgttgaa

SEQ ID NO: 146047 - DNA, 25 bp, Rattus norvegicus
aggcgcccatcaattctaaaagcta

SEQ ID NO: 146048 - DNA, 25 bp, Rattus norvegicus
aggcgcccatcatttctaaaagcta

SEQ ID NO: 146049 - DNA, 25 bp, Rattus norvegicus
aggcgcccctggagcattgaagagc

SEQ ID NO: 146050 - DNA, 25 bp, Rattus norvegicus
aggcgcccctggtgcattgaagagc

SEQ ID NO: 146051 - DNA, 25 bp, Rattus norvegicus
aggcgcccgatccaggtcatgatga

SEQ ID NO: 146052 - DNA, 25 bp, Rattus norvegicus
aggcgcccgatcgaggtcatgatga

SEQ ID NO: 146053 - DNA, 25 bp, Rattus norvegicus
aggcgccctcaaagagtggctttct

SEQ ID NO: 146054 - DNA, 25 bp, Rattus norvegicus
aggcgccctcaatgagtggctttct

SEQ ID NO: 146055 - DNA, 25 bp, Rattus norvegicus
aggcgccctctgagtaactatgaag

SEQ ID NO: 146056 - DNA, 25 bp, Rattus norvegicus
aggcgccctctgtgtaactatgaag

SEQ ID NO: 146057 - DNA, 25 bp, Rattus norvegicus
aggcgccgagggaaagtcacttaat

SEQ ID NO: 146058 - DNA, 25 bp, Rattus norvegicus
aggcgccgagggtaagtcacttaat

SEQ ID NO: 146059 - DNA, 25 bp, Rattus norvegicus
aggcgcctacagcaggactttgttt

SEQ ID NO: 146060 - DNA, 25 bp, Rattus norvegicus
aggcgcctacaggaggactttgttt

SEQ ID NO: 146061 - DNA, 25 bp, Rattus norvegicus
aggcgcctagtcaaattactgggtt

SEQ ID NO: 146062 - DNA, 25 bp, Rattus norvegicus
aggcgcctagtctaattactgggtt

SEQ ID NO: 146063 - DNA, 25 bp, Rattus norvegicus
aggcgcctgactcagcttcaaagga

SEQ ID NO: 146064 - DNA, 25 bp, Rattus norvegicus
aggcgcctgactgagcttcaaagga

SEQ ID NO: 146065 - DNA, 25 bp, Rattus norvegicus
aggcgcctgctcatccgggtgtcag

SEQ ID NO: 146066 - DNA, 25 bp, Rattus norvegicus
aggcgcctgctcttccgggtgtcag

SEQ ID NO: 146067 - DNA, 25 bp, Rattus norvegicus
aggcgcgagcctccgagggcggtgt

SEQ ID NO: 146068 - DNA, 25 bp, Rattus norvegicus
aggcgcgagcctgcgagggcggtgt

SEQ ID NO: 146069 - DNA, 25 bp, Rattus norvegicus
aggcgcgcaggcacaagtggctcca

SEQ ID NO: 146070 - DNA, 25 bp, Rattus norvegicus
aggcgcgcaggctcaagtggctcca

SEQ ID NO: 146071 - DNA, 25 bp, Rattus norvegicus
aggcgcgcttatcctggatcccagg

SEQ ID NO: 146072 - DNA, 25 bp, Rattus norvegicus
aggcgcgcttatgctggatcccagg

SEQ ID NO: 146073 - DNA, 25 bp, Rattus norvegicus
aggcgcggtgccattaagcccagac

SEQ ID NO: 146074 - DNA, 25 bp, Rattus norvegicus
aggcgcggtgcctttaagcccagac

SEQ ID NO: 146075 - DNA, 25 bp, Rattus norvegicus
aggcgctaacttccttaaatgtgaa

SEQ ID NO: 146076 - DNA, 25 bp, Rattus norvegicus
aggcgctaacttgcttaaatgtgaa

SEQ ID NO: 146077 - DNA, 25 bp, Rattus norvegicus
aggcgctacctcattagggactatg

SEQ ID NO: 146078 - DNA, 25 bp, Rattus norvegicus
aggcgctacctctttagggactatg

SEQ ID NO: 146079 - DNA, 25 bp, Rattus norvegicus
aggcgctactccaagagctgaggcc

SEQ ID NO: 146080 - DNA, 25 bp, Rattus norvegicus
aggcgctactcctagagctgaggcc

SEQ ID NO: 146081 - DNA, 25 bp, Rattus norvegicus
aggcgctcagtaacaccatctaatg

SEQ ID NO: 146082 - DNA, 25 bp, Rattus norvegicus
aggcgctcagtatcaccatctaatg

SEQ ID NO: 146083 - DNA, 25 bp, Rattus norvegicus
aggcgctcgcctaatatatacaaca

SEQ ID NO: 146084 - DNA, 25 bp, Rattus norvegicus
aggcgctcgccttatatatacaaca

SEQ ID NO: 146085 - DNA, 25 bp, Rattus norvegicus
aggcgctctcctctaaaagatacgg

SEQ ID NO: 146086 - DNA, 25 bp, Rattus norvegicus
aggcgctctcctgtaaaagatacgg

SEQ ID NO: 146087 - DNA, 25 bp, Rattus norvegicus
aggcgctctcggcacttggtttgtc

SEQ ID NO: 146088 - DNA, 25 bp, Rattus norvegicus
aggcgctctcgggacttggtttgtc

SEQ ID NO: 146089 - DNA, 25 bp, Rattus norvegicus
aggcgctctcttctgtgtagaacag

SEQ ID NO: 146090 - DNA, 25 bp, Rattus norvegicus
aggcgctctcttgtgtgtagaacag

SEQ ID NO: 146091 - DNA, 25 bp, Rattus norvegicus
aggcgctcttatatctctgcatgat

SEQ ID NO: 146092 - DNA, 25 bp, Rattus norvegicus
aggcgctcttatttctctgcatgat

SEQ ID NO: 146093 - DNA, 25 bp, Rattus norvegicus
aggcgctgactcctgtagcaaagtg

SEQ ID NO: 146094 - DNA, 25 bp, Rattus norvegicus
aggcgctgactcgtgtagcaaagtg

SEQ ID NO: 146095 - DNA, 25 bp, Rattus norvegicus
aggcgctgccggatacgtaaagatg

SEQ ID NO: 146096 - DNA, 25 bp, Rattus norvegicus
aggcgctgccggttacgtaaagatg

SEQ ID NO: 146097 - DNA, 25 bp, Rattus norvegicus
aggcgctggctcagttgggcatcac

SEQ ID NO: 146098 - DNA, 25 bp, Rattus norvegicus
aggcgctggctctgttgggcatcac

SEQ ID NO: 146099 - DNA, 25 bp, Rattus norvegicus
aggcgctgggaaccatagccctcaa

SEQ ID NO: 146100 - DNA, 25 bp, Rattus norvegicus
aggcgctgggaagcatagccctcaa

SEQ ID NO: 146101 - DNA, 25 bp, Rattus norvegicus
aggcgctgggacacaggagttcctt

SEQ ID NO: 146102 - DNA, 25 bp, Rattus norvegicus
aggcgctgggactcaggagttcctt

SEQ ID NO: 146103 - DNA, 25 bp, Rattus norvegicus
aggcgctgtacgaggctccagcata

SEQ ID NO: 146104 - DNA, 25 bp, Rattus norvegicus
aggcgctgtacgtggctccagcata

SEQ ID NO: 146105 - DNA, 25 bp, Rattus norvegicus
aggcgctgtattaatttctccatga

SEQ ID NO: 146106 - DNA, 25 bp, Rattus norvegicus
aggcgctgtatttatttctccatga

SEQ ID NO: 146107 - DNA, 25 bp, Rattus norvegicus
aggcgctgtgagactcgctggactt

SEQ ID NO: 146108 - DNA, 25 bp, Rattus norvegicus
aggcgctgtgagtctcgctggactt

SEQ ID NO: 146109 - DNA, 25 bp, Rattus norvegicus
aggcgcttctgcaggactatgtcag

SEQ ID NO: 146110 - DNA, 25 bp, Rattus norvegicus
aggcgcttctgctggactatgtcag

SEQ ID NO: 146111 - DNA, 25 bp, Rattus norvegicus
aggcgcttggttcgagagtcctcaa

SEQ ID NO: 146112 - DNA, 25 bp, Rattus norvegicus
aggcgcttggttggagagtcctcaa

SEQ ID NO: 146113 - DNA, 25 bp, Rattus norvegicus
aggcggaaaccgaccagctggaaga

SEQ ID NO: 146114 - DNA, 25 bp, Rattus norvegicus
aggcggaaaccgtccagctggaaga

SEQ ID NO: 146115 - DNA, 25 bp, Rattus norvegicus
aggcggaaagccaacacttgggcac

SEQ ID NO: 146116 - DNA, 25 bp, Rattus norvegicus
aggcggaaagcctacacttgggcac

SEQ ID NO: 146117 - DNA, 25 bp, Rattus norvegicus
aggcggaactcactgaccctagggc

SEQ ID NO: 146118 - DNA, 25 bp, Rattus norvegicus
aggcggaactcagtgaccctagggc

SEQ ID NO: 146119 - DNA, 25 bp, Rattus norvegicus
aggcggaacttcacgcaggaatttc

SEQ ID NO: 146120 - DNA, 25 bp, Rattus norvegicus
aggcggaacttctcgcaggaatttc

SEQ ID NO: 146121 - DNA, 25 bp, Rattus norvegicus
aggcggaagcggactcacagagcta

SEQ ID NO: 146122 - DNA, 25 bp, Rattus norvegicus
aggcggaagcggtctcacagagcta

SEQ ID NO: 146123 - DNA, 25 bp, Rattus norvegicus
aggcggaaggcccaccttgccaaag

SEQ ID NO: 146124 - DNA, 25 bp, Rattus norvegicus
aggcggaaggccgaccttgccaaag

SEQ ID NO: 146125 - DNA, 25 bp, Rattus norvegicus
aggcggacagtgacagatgcgtttt

SEQ ID NO: 146126 - DNA, 25 bp, Rattus norvegicus
aggcggacagtgctctagtgttcta

SEQ ID NO: 146127 - DNA, 25 bp, Rattus norvegicus
aggcggacagtggtctagtgttcta

SEQ ID NO: 146128 - DNA, 25 bp, Rattus norvegicus
aggcggacagtgtcagatgcgtttt

SEQ ID NO: 146129 - DNA, 25 bp, Rattus norvegicus
aggcggaccggcactagaatctagg

SEQ ID NO: 146130 - DNA, 25 bp, Rattus norvegicus
aggcggaccggctctagaatctagg

SEQ ID NO: 146131 - DNA, 25 bp, Rattus norvegicus
aggcggaccttcaccacatccaggg

SEQ ID NO: 146132 - DNA, 25 bp, Rattus norvegicus
aggcggaccttctccacatccaggg

SEQ ID NO: 146133 - DNA, 25 bp, Rattus norvegicus
aggcggacgatgaacgactcaacaa

SEQ ID NO: 146134 - DNA, 25 bp, Rattus norvegicus
aggcggacgatgtacgactcaacaa

SEQ ID NO: 146135 - DNA, 25 bp, Rattus norvegicus
aggcggactgttactgagctgcgtt

SEQ ID NO: 146136 - DNA, 25 bp, Rattus norvegicus
aggcggactgtttctgagctgcgtt

SEQ ID NO: 146137 - DNA, 25 bp, Rattus norvegicus
aggcggagccgcaacttcctggatc

SEQ ID NO: 146138 - DNA, 25 bp, Rattus norvegicus
aggcggagccgctacttcctggatc

SEQ ID NO: 146139 - DNA, 25 bp, Rattus norvegicus
aggcggagctgaaccgtaggctcaa

SEQ ID NO: 146140 - DNA, 25 bp, Rattus norvegicus
aggcggagctgatccgtaggctcaa

SEQ ID NO: 146141 - DNA, 25 bp, Rattus norvegicus
aggcggagctggagaacgcctacta

SEQ ID NO: 146142 - DNA, 25 bp, Rattus norvegicus
aggcggagctggtgaacgcctacta

SEQ ID NO: 146143 - DNA, 25 bp, Rattus norvegicus
aggcggaggaacaggccaacaccaa

SEQ ID NO: 146144 - DNA, 25 bp, Rattus norvegicus
aggcggaggaactggccaacaccaa

SEQ ID NO: 146145 - DNA, 25 bp, Rattus norvegicus
aggcggatcaccagtttggcctggt

SEQ ID NO: 146146 - DNA, 25 bp, Rattus norvegicus
aggcggatcacctgtttggcctggt

SEQ ID NO: 146147 - DNA, 25 bp, Rattus norvegicus
aggcggatcctgattgtaaggcttt

SEQ ID NO: 146148 - DNA, 25 bp, Rattus norvegicus
aggcggatcctgtttgtaaggcttt

SEQ ID NO: 146149 - DNA, 25 bp, Rattus norvegicus
aggcggatctatcgcattgacgacc

SEQ ID NO: 146150 - DNA, 25 bp, Rattus norvegicus
aggcggatctatggcattgacgacc

SEQ ID NO: 146151 - DNA, 25 bp, Rattus norvegicus
aggcggatctccagacgagttctca

SEQ ID NO: 146152 - DNA, 25 bp, Rattus norvegicus
aggcggatctcctgacgagttctca

SEQ ID NO: 146153 - DNA, 25 bp, Rattus norvegicus
aggcggatgtcacgatttctctctg

SEQ ID NO: 146154 - DNA, 25 bp, Rattus norvegicus
aggcggatgtcaggatttctctctg

SEQ ID NO: 146155 - DNA, 25 bp, Rattus norvegicus
aggcggattcaacagacctctggat

SEQ ID NO: 146156 - DNA, 25 bp, Rattus norvegicus
aggcggattcaagagacctctggat

SEQ ID NO: 146157 - DNA, 25 bp, Rattus norvegicus
aggcggcaagcaacaacaatcatag

SEQ ID NO: 146158 - DNA, 25 bp, Rattus norvegicus
aggcggcaagcatcaacaatcatag

SEQ ID NO: 146159 - DNA, 25 bp, Rattus norvegicus
aggcggcagcgcactgggtcccaca

SEQ ID NO: 146160 - DNA, 25 bp, Rattus norvegicus
aggcggcagcgctctgggtcccaca

SEQ ID NO: 146161 - DNA, 25 bp, Rattus norvegicus
aggcggcatgtgatccagccgacga

SEQ ID NO: 146162 - DNA, 25 bp, Rattus norvegicus
aggcggcatgtgttccagccgacga

SEQ ID NO: 146163 - DNA, 25 bp, Rattus norvegicus
aggcggccccaaaggatgcatggat

SEQ ID NO: 146164 - DNA, 25 bp, Rattus norvegicus
aggcggccccaatggatgcatggat

SEQ ID NO: 146165 - DNA, 25 bp, Rattus norvegicus
aggcggccctacactgacaggcagg

SEQ ID NO: 146166 - DNA, 25 bp, Rattus norvegicus
aggcggccctactctgacaggcagg

SEQ ID NO: 146167 - DNA, 25 bp, Rattus norvegicus
aggcggcccttcacgggcgctctaa

SEQ ID NO: 146168 - DNA, 25 bp, Rattus norvegicus
aggcggcccttctcgggcgctctaa

SEQ ID NO: 146169 - DNA, 25 bp, Rattus norvegicus
aggcggcctggcaatacagatgctg

SEQ ID NO: 146170 - DNA, 25 bp, Rattus norvegicus
aggcggcctggctatacagatgctg

SEQ ID NO: 146171 - DNA, 25 bp, Rattus norvegicus
aggcggcctgtgcagacgacttcat

SEQ ID NO: 146172 - DNA, 25 bp, Rattus norvegicus
aggcggcctgtggagacgacttcat

SEQ ID NO: 146173 - DNA, 25 bp, Rattus norvegicus
aggcggcgagttctcttggtcaaca

SEQ ID NO: 146174 - DNA, 25 bp, Rattus norvegicus
aggcggcgagttgtcttggtcaaca

SEQ ID NO: 146175 - DNA, 25 bp, Rattus norvegicus
aggcggcggagtacggcgcggcttc

SEQ ID NO: 146176 - DNA, 25 bp, Rattus norvegicus
aggcggcggagttcggcgcggcttc

SEQ ID NO: 146177 - DNA, 25 bp, Rattus norvegicus
aggcggcggcgaaggatcacattta

SEQ ID NO: 146178 - DNA, 25 bp, Rattus norvegicus
aggcggcggcgatggatcacattta

SEQ ID NO: 146179 - DNA, 25 bp, Rattus norvegicus
aggcggctagtgcagaaactcacaa

SEQ ID NO: 146180 - DNA, 25 bp, Rattus norvegicus
aggcggctagtggagaaactcacaa

SEQ ID NO: 146181 - DNA, 25 bp, Rattus norvegicus
aggcggctcggcctgcacgatggag

SEQ ID NO: 146182 - DNA, 25 bp, Rattus norvegicus
aggcggctcggcgtgcacgatggag

SEQ ID NO: 146183 - DNA, 25 bp, Rattus norvegicus
aggcggctctctaacaagtgttcca

SEQ ID NO: 146184 - DNA, 25 bp, Rattus norvegicus
aggcggctctcttacaagtgttcca

SEQ ID NO: 146185 - DNA, 25 bp, Rattus norvegicus
aggcggctctgaatccagggatcca

SEQ ID NO: 146186 - DNA, 25 bp, Rattus norvegicus
aggcggctctgattccagggatcca

SEQ ID NO: 146187 - DNA, 25 bp, Rattus norvegicus
aggcggctgggcaccggccgggagt

SEQ ID NO: 146188 - DNA, 25 bp, Rattus norvegicus
aggcggctgggctccggccgggagt

SEQ ID NO: 146189 - DNA, 25 bp, Rattus norvegicus
aggcggcttgaacgctgagcctaat

SEQ ID NO: 146190 - DNA, 25 bp, Rattus norvegicus
aggcggcttgaaggctgagcctaat

SEQ ID NO: 146191 - DNA, 25 bp, Rattus norvegicus
aggcgggaacgcagcaccctgagct

SEQ ID NO: 146192 - DNA, 25 bp, Rattus norvegicus
aggcgggaacgctgcaccctgagct

SEQ ID NO: 146193 - DNA, 25 bp, Rattus norvegicus
aggcgggaagatacatccactgtgt

SEQ ID NO: 146194 - DNA, 25 bp, Rattus norvegicus
aggcgggaagattcatccactgtgt

SEQ ID NO: 146195 - DNA, 25 bp, Rattus norvegicus
aggcgggagacaccgatcaaatcgt

SEQ ID NO: 146196 - DNA, 25 bp, Rattus norvegicus
aggcgggagacagcgatcaaatcgt

SEQ ID NO: 146197 - DNA, 25 bp, Rattus norvegicus
aggcgggcaagacatggcactcctc

SEQ ID NO: 146198 - DNA, 25 bp, Rattus norvegicus
aggcgggcaagagatggcactcctc

SEQ ID NO: 146199 - DNA, 25 bp, Rattus norvegicus
aggcgggcacacctgcagtgtctca

SEQ ID NO: 146200 - DNA, 25 bp, Rattus norvegicus
aggcgggcacacgtgcagtgtctca

SEQ ID NO: 146201 - DNA, 25 bp, Rattus norvegicus
aggcgggcagctatctagactacac

SEQ ID NO: 146202 - DNA, 25 bp, Rattus norvegicus
aggcgggcagctttctagactacac

SEQ ID NO: 146203 - DNA, 25 bp, Rattus norvegicus
aggcgggcagggagttctttcttca

SEQ ID NO: 146204 - DNA, 25 bp, Rattus norvegicus
aggcgggcagggtgttctttcttca

SEQ ID NO: 146205 - DNA, 25 bp, Rattus norvegicus
aggcgggcctcgatctcaacatgga

SEQ ID NO: 146206 - DNA, 25 bp, Rattus norvegicus
aggcgggcctcgttctcaacatgga

SEQ ID NO: 146207 - DNA, 25 bp, Rattus norvegicus
aggcgggcgttgaactctatacttg

SEQ ID NO: 146208 - DNA, 25 bp, Rattus norvegicus
aggcgggcgttgtactctatacttg

SEQ ID NO: 146209 - DNA, 25 bp, Rattus norvegicus
aggcgggtcacaccttcgaaagtgc

SEQ ID NO: 146210 - DNA, 25 bp, Rattus norvegicus
aggcgggtcacagcttcgaaagtgc

SEQ ID NO: 146211 - DNA, 25 bp, Rattus norvegicus
aggcgggtcccaagcatgcatgcga

SEQ ID NO: 146212 - DNA, 25 bp, Rattus norvegicus
aggcgggtcccatgcatgcatgcga

SEQ ID NO: 146213 - DNA, 25 bp, Rattus norvegicus
aggcggtagccgatcagacttgcta

SEQ ID NO: 146214 - DNA, 25 bp, Rattus norvegicus
aggcggtagccgttcagacttgcta

SEQ ID NO: 146215 - DNA, 25 bp, Rattus norvegicus
aggcggtcacacaccaagtccagga

SEQ ID NO: 146216 - DNA, 25 bp, Rattus norvegicus
aggcggtcacactccaagtccagga

SEQ ID NO: 146217 - DNA, 25 bp, Rattus norvegicus
aggcggtccccaatgacactgtgca

SEQ ID NO: 146218 - DNA, 25 bp, Rattus norvegicus
aggcggtccccattgacactgtgca

SEQ ID NO: 146219 - DNA, 25 bp, Rattus norvegicus
aggcggtcctttcaaatgttccagt

SEQ ID NO: 146220 - DNA, 25 bp, Rattus norvegicus
aggcggtcctttgaaatgttccagt

SEQ ID NO: 146221 - DNA, 25 bp, Rattus norvegicus
aggcggtcggccacgaagctcgcca

SEQ ID NO: 146222 - DNA, 25 bp, Rattus norvegicus
aggcggtcggcctcgaagctcgcca

SEQ ID NO: 146223 - DNA, 25 bp, Rattus norvegicus
aggcggtctctgaacaaaacaaagt

SEQ ID NO: 146224 - DNA, 25 bp, Rattus norvegicus
aggcggtctctgtacaaaacaaagt

SEQ ID NO: 146225 - DNA, 25 bp, Rattus norvegicus
aggcggtgaaccaagcaatccagag

SEQ ID NO: 146226 - DNA, 25 bp, Rattus norvegicus
aggcggtgaacctagcaatccagag

SEQ ID NO: 146227 - DNA, 25 bp, Rattus norvegicus
aggcggtgcactattgaggactcaa

SEQ ID NO: 146228 - DNA, 25 bp, Rattus norvegicus
aggcggtgcacttttgaggactcaa

SEQ ID NO: 146229 - DNA, 25 bp, Rattus norvegicus
aggcggtgcatcaatcacggagcta

SEQ ID NO: 146230 - DNA, 25 bp, Rattus norvegicus
aggcggtgcatctatcacggagcta

SEQ ID NO: 146231 - DNA, 25 bp, Rattus norvegicus
aggcggtgccttcaattgggtctca

SEQ ID NO: 146232 - DNA, 25 bp, Rattus norvegicus
aggcggtgccttgaattgggtctca

SEQ ID NO: 146233 - DNA, 25 bp, Rattus norvegicus
aggcggtggcgcccggtgtccggag

SEQ ID NO: 146234 - DNA, 25 bp, Rattus norvegicus
aggcggtggcgcgcggtgtccggag

SEQ ID NO: 146235 - DNA, 25 bp, Rattus norvegicus
aggcggttatttaccatttctcttg

SEQ ID NO: 146236 - DNA, 25 bp, Rattus norvegicus
aggcggttattttccatttctcttg

SEQ ID NO: 146237 - DNA, 25 bp, Rattus norvegicus
aggcggttccttcttggttctaatg

SEQ ID NO: 146238 - DNA, 25 bp, Rattus norvegicus
aggcggttccttgttggttctaatg

SEQ ID NO: 146239 - DNA, 25 bp, Rattus norvegicus
aggcggttctcactaccgggcgaca

SEQ ID NO: 146240 - DNA, 25 bp, Rattus norvegicus
aggcggttctcagtaccgggcgaca

SEQ ID NO: 146241 - DNA, 25 bp, Rattus norvegicus
aggcggttgcgaaccacctgacagg

SEQ ID NO: 146242 - DNA, 25 bp, Rattus norvegicus
aggcggttgcgatccacctgacagg

SEQ ID NO: 146243 - DNA, 25 bp, Rattus norvegicus
aggcggtttgagacgagtgcacccc

SEQ ID NO: 146244 - DNA, 25 bp, Rattus norvegicus
aggcggtttgagtcgagtgcacccc

SEQ ID NO: 146245 - DNA, 25 bp, Rattus norvegicus
aggcgtacaccaccatttatagcta

SEQ ID NO: 146246 - DNA, 25 bp, Rattus norvegicus
aggcgtacaccagcatttatagcta

SEQ ID NO: 146247 - DNA, 25 bp, Rattus norvegicus
aggcgtacctagcagtcctgtgaaa

SEQ ID NO: 146248 - DNA, 25 bp, Rattus norvegicus
aggcgtacctaggagtcctgtgaaa

SEQ ID NO: 146249 - DNA, 25 bp, Rattus norvegicus
aggcgtacctgcaagtgacacggga

SEQ ID NO: 146250 - DNA, 25 bp, Rattus norvegicus
aggcgtacctgctagtgacacggga

SEQ ID NO: 146251 - DNA, 25 bp, Rattus norvegicus
aggcgtaccttgcattgtttctgaa

SEQ ID NO: 146252 - DNA, 25 bp, Rattus norvegicus
aggcgtaccttggattgtttctgaa

SEQ ID NO: 146253 - DNA, 25 bp, Rattus norvegicus
aggcgtataactctggcgtagtcat

SEQ ID NO: 146254 - DNA, 25 bp, Rattus norvegicus
aggcgtataactgtggcgtagtcat

SEQ ID NO: 146255 - DNA, 25 bp, Rattus norvegicus
aggcgtatatgcagggctccaacag

SEQ ID NO: 146256 - DNA, 25 bp, Rattus norvegicus
aggcgtatatgctgggctccaacag

SEQ ID NO: 146257 - DNA, 25 bp, Rattus norvegicus
aggcgtatgttccatatttctggga

SEQ ID NO: 146258 - DNA, 25 bp, Rattus norvegicus
aggcgtatgttcgatatttctggga

SEQ ID NO: 146259 - DNA, 25 bp, Rattus norvegicus
aggcgtatgtttatatgtggcttta

SEQ ID NO: 146260 - DNA, 25 bp, Rattus norvegicus
aggcgtatgtttttatgtggcttta

SEQ ID NO: 146261 - DNA, 25 bp, Rattus norvegicus
aggcgtcaaactcgacctcttaaga

SEQ ID NO: 146262 - DNA, 25 bp, Rattus norvegicus
aggcgtcaaactggacctcttaaga

SEQ ID NO: 146263 - DNA, 25 bp, Rattus norvegicus
aggcgtcacccactaacacagtgtg

SEQ ID NO: 146264 - DNA, 25 bp, Rattus norvegicus
aggcgtcacccagtaacacagtgtg

SEQ ID NO: 146265 - DNA, 25 bp, Rattus norvegicus
aggcgtcagctccaagtcaaacagg

SEQ ID NO: 146266 - DNA, 25 bp, Rattus norvegicus
aggcgtcagctcgaagtcaaacagg

SEQ ID NO: 146267 - DNA, 25 bp, Rattus norvegicus
aggcgtcagttaccacagaacagga

SEQ ID NO: 146268 - DNA, 25 bp, Rattus norvegicus
aggcgtcagttagcacagaacagga

SEQ ID NO: 146269 - DNA, 25 bp, Rattus norvegicus
aggcgtccatcaattctcgtaagaa

SEQ ID NO: 146270 - DNA, 25 bp, Rattus norvegicus
aggcgtccatcatttctcgtaagaa

SEQ ID NO: 146271 - DNA, 25 bp, Rattus norvegicus
aggcgtccatctatgtggtgatgca

SEQ ID NO: 146272 - DNA, 25 bp, Rattus norvegicus
aggcgtccatctttgtggtgatgca

SEQ ID NO: 146273 - DNA, 25 bp, Rattus norvegicus
aggcgtccccgacgcagaagatgca

SEQ ID NO: 146274 - DNA, 25 bp, Rattus norvegicus
aggcgtccccgaggcagaagatgca

SEQ ID NO: 146275 - DNA, 25 bp, Rattus norvegicus
aggcgtcctctcagagatccaggag

SEQ ID NO: 146276 - DNA, 25 bp, Rattus norvegicus
aggcgtcctctctgagatccaggag

SEQ ID NO: 146277 - DNA, 25 bp, Rattus norvegicus
aggcgtcctctgagggtatgagata

SEQ ID NO: 146278 - DNA, 25 bp, Rattus norvegicus
aggcgtcctctgtgggtatgagata

SEQ ID NO: 146279 - DNA, 25 bp, Rattus norvegicus
aggcgtcgactcctgacttacaaga

SEQ ID NO: 146280 - DNA, 25 bp, Rattus norvegicus
aggcgtcgactcgtgacttacaaga

SEQ ID NO: 146281 - DNA, 25 bp, Rattus norvegicus
aggcgtctacccagagcacgatgaa

SEQ ID NO: 146282 - DNA, 25 bp, Rattus norvegicus
aggcgtctaccctgagcacgatgaa

SEQ ID NO: 146283 - DNA, 25 bp, Rattus norvegicus
aggcgtctctgtaccaggaagcggt

SEQ ID NO: 146284 - DNA, 25 bp, Rattus norvegicus
aggcgtctctgttccaggaagcggt

SEQ ID NO: 146285 - DNA, 25 bp, Rattus norvegicus
aggcgtctgcttaggttagttatca

SEQ ID NO: 146286 - DNA, 25 bp, Rattus norvegicus
aggcgtctgctttggttagttatca

SEQ ID NO: 146287 - DNA, 25 bp, Rattus norvegicus
aggcgtctggacctagattccaagc

SEQ ID NO: 146288 - DNA, 25 bp, Rattus norvegicus
aggcgtctggacgtagattccaagc

SEQ ID NO: 146289 - DNA, 25 bp, Rattus norvegicus
aggcgtcttctaaagcatggccaag

SEQ ID NO: 146290 - DNA, 25 bp, Rattus norvegicus
aggcgtcttctatagcatggccaag

SEQ ID NO: 146291 - DNA, 25 bp, Rattus norvegicus
aggcgtcttgctatagcccaagctt

SEQ ID NO: 146292 - DNA, 25 bp, Rattus norvegicus
aggcgtcttgctttagcccaagctt

SEQ ID NO: 146293 - DNA, 25 bp, Rattus norvegicus
aggcgtgaaagaactcgctcctttg

SEQ ID NO: 146294 - DNA, 25 bp, Rattus norvegicus
aggcgtgaaagatctcgctcctttg

SEQ ID NO: 146295 - DNA, 25 bp, Rattus norvegicus
aggcgtgacctgctcttgtagaacc

SEQ ID NO: 146296 - DNA, 25 bp, Rattus norvegicus
aggcgtgacctggtcttgtagaacc

SEQ ID NO: 146297 - DNA, 25 bp, Rattus norvegicus
aggcgtgatttgatttatggctgtt

SEQ ID NO: 146298 - DNA, 25 bp, Rattus norvegicus
aggcgtgatttgttttatggctgtt

SEQ ID NO: 146299 - DNA, 25 bp, Rattus norvegicus
aggcgtgcacctcatgtgcatgcat

SEQ ID NO: 146300 - DNA, 25 bp, Rattus norvegicus
aggcgtgcacctgatgtgcatgcat

SEQ ID NO: 146301 - DNA, 25 bp, Rattus norvegicus
aggcgtgcagtgatggtacactcaa

SEQ ID NO: 146302 - DNA, 25 bp, Rattus norvegicus
aggcgtgcagtgttggtacactcaa

SEQ ID NO: 146303 - DNA, 25 bp, Rattus norvegicus
aggcgtgcatgcaggcagatgcaat

SEQ ID NO: 146304 - DNA, 25 bp, Rattus norvegicus
aggcgtgcatgctggcagatgcaat

SEQ ID NO: 146305 - DNA, 25 bp, Rattus norvegicus
aggcgtgccagccacaatcctgagc

SEQ ID NO: 146306 - DNA, 25 bp, Rattus norvegicus
aggcgtgccagcgacaatcctgagc

SEQ ID NO: 146307 - DNA, 25 bp, Rattus norvegicus
aggcgtgcctccaaacataatcgat

SEQ ID NO: 146308 - DNA, 25 bp, Rattus norvegicus
aggcgtgcctcctaacataatcgat

SEQ ID NO: 146309 - DNA, 25 bp, Rattus norvegicus
aggcgtggcgtaacaagtctctccg

SEQ ID NO: 146310 - DNA, 25 bp, Rattus norvegicus
aggcgtggcgtatcaagtctctccg

SEQ ID NO: 146311 - DNA, 25 bp, Rattus norvegicus
aggcgtgggtaaaccaagtctgatc

SEQ ID NO: 146312 - DNA, 25 bp, Rattus norvegicus
aggcgtgggtaatccaagtctgatc

SEQ ID NO: 146313 - DNA, 25 bp, Rattus norvegicus
aggcgtggtgatctactcttttatt

SEQ ID NO: 146314 - DNA, 25 bp, Rattus norvegicus
aggcgtggtgatgtactcttttatt

SEQ ID NO: 146315 - DNA, 25 bp, Rattus norvegicus
aggcgtggtgctcagcttgattatc

SEQ ID NO: 146316 - DNA, 25 bp, Rattus norvegicus
aggcgtggtgctccgtgcctttaat

SEQ ID NO: 146317 - DNA, 25 bp, Rattus norvegicus
aggcgtggtgctgagcttgattatc

SEQ ID NO: 146318 - DNA, 25 bp, Rattus norvegicus
aggcgtggtgctgcgtgcctttaat

SEQ ID NO: 146319 - DNA, 25 bp, Rattus norvegicus
aggcgtgtaagcaggcccagtccaa

SEQ ID NO: 146320 - DNA, 25 bp, Rattus norvegicus
aggcgtgtaagctggcccagtccaa

SEQ ID NO: 146321 - DNA, 25 bp, Rattus norvegicus
aggcgtgtacacaaggatccctgaa

SEQ ID NO: 146322 - DNA, 25 bp, Rattus norvegicus
aggcgtgtacactaggatccctgaa

SEQ ID NO: 146323 - DNA, 25 bp, Rattus norvegicus
aggcgtgtcagcacccaattatgga

SEQ ID NO: 146324 - DNA, 25 bp, Rattus norvegicus
aggcgtgtcagctcccaattatgga

SEQ ID NO: 146325 - DNA, 25 bp, Rattus norvegicus
aggcgtgtctaacggctatggcttt

SEQ ID NO: 146326 - DNA, 25 bp, Rattus norvegicus
aggcgtgtctaagggctatggcttt

SEQ ID NO: 146327 - DNA, 25 bp, Rattus norvegicus
aggcgtgttctcaaacgagagcttg

SEQ ID NO: 146328 - DNA, 25 bp, Rattus norvegicus
aggcgtgttctctaacgagagcttg

SEQ ID NO: 146329 - DNA, 25 bp, Rattus norvegicus
aggcgtgtttaaccatgccctcacc

SEQ ID NO: 146330 - DNA, 25 bp, Rattus norvegicus
aggcgtgtttaagcatgccctcacc

SEQ ID NO: 146331 - DNA, 25 bp, Rattus norvegicus
aggcgtgtttgcaaatgtcccaggc

SEQ ID NO: 146332 - DNA, 25 bp, Rattus norvegicus
aggcgtgtttgctaatgtcccaggc

SEQ ID NO: 146333 - DNA, 25 bp, Rattus norvegicus
aggcgttacacgagtttatccatga

SEQ ID NO: 146334 - DNA, 25 bp, Rattus norvegicus
aggcgttacacgtgtttatccatga

SEQ ID NO: 146335 - DNA, 25 bp, Rattus norvegicus
aggcgttactgcacacagcatcagc

SEQ ID NO: 146336 - DNA, 25 bp, Rattus norvegicus
aggcgttactgctcacagcatcagc

SEQ ID NO: 146337 - DNA, 25 bp, Rattus norvegicus
aggcgttatgtaatcctatgacaac

SEQ ID NO: 146338 - DNA, 25 bp, Rattus norvegicus
aggcgttatgtattcctatgacaac

SEQ ID NO: 146339 - DNA, 25 bp, Rattus norvegicus
aggcgttcagccagattcacgtttt

SEQ ID NO: 146340 - DNA, 25 bp, Rattus norvegicus
aggcgttcagcctgattcacgtttt

SEQ ID NO: 146341 - DNA, 25 bp, Rattus norvegicus
aggcgttcaggcagaggcactctta

SEQ ID NO: 146342 - DNA, 25 bp, Rattus norvegicus
aggcgttcaggctgaggcactctta

SEQ ID NO: 146343 - DNA, 25 bp, Rattus norvegicus
aggcgttccggtaggacacgcccat

SEQ ID NO: 146344 - DNA, 25 bp, Rattus norvegicus
aggcgttccggttggacacgcccat

SEQ ID NO: 146345 - DNA, 25 bp, Rattus norvegicus
aggcgttcctgtagccacagtggca

SEQ ID NO: 146346 - DNA, 25 bp, Rattus norvegicus
aggcgttcctgttgccacagtggca

SEQ ID NO: 146347 - DNA, 25 bp, Rattus norvegicus
aggcgttcgcggaaggcgcgggatc

SEQ ID NO: 146348 - DNA, 25 bp, Rattus norvegicus
aggcgttcgcggtaggcgcgggatc

SEQ ID NO: 146349 - DNA, 25 bp, Rattus norvegicus
aggcgttctatgactgtcacctgga

SEQ ID NO: 146350 - DNA, 25 bp, Rattus norvegicus
aggcgttctatgtctgtcacctgga

SEQ ID NO: 146351 - DNA, 25 bp, Rattus norvegicus
aggcgttctcataagtgctcttgaa

SEQ ID NO: 146352 - DNA, 25 bp, Rattus norvegicus
aggcgttctcattagtgctcttgaa

SEQ ID NO: 146353 - DNA, 25 bp, Rattus norvegicus
aggcgttcttagctgagacaccaag

SEQ ID NO: 146354 - DNA, 25 bp, Rattus norvegicus
aggcgttcttaggtgagacaccaag

SEQ ID NO: 146355 - DNA, 25 bp, Rattus norvegicus
aggcgttcttgtacaccgaatgcag

SEQ ID NO: 146356 - DNA, 25 bp, Rattus norvegicus
aggcgttcttgttcaccgaatgcag

SEQ ID NO: 146357 - DNA, 25 bp, Rattus norvegicus
aggcgttgcctgaactcggctgagt

SEQ ID NO: 146358 - DNA, 25 bp, Rattus norvegicus
aggcgttgcctgtactcggctgagt

SEQ ID NO: 146359 - DNA, 25 bp, Rattus norvegicus
aggcgttggttaacagtcttctgta

SEQ ID NO: 146360 - DNA, 25 bp, Rattus norvegicus
aggcgttggttatcagtcttctgta

SEQ ID NO: 146361 - DNA, 25 bp, Rattus norvegicus
aggcgtttcctaccgaggtgtacca

SEQ ID NO: 146362 - DNA, 25 bp, Rattus norvegicus
aggcgtttcctagcgaggtgtacca

SEQ ID NO: 146363 - DNA, 25 bp, Rattus norvegicus
aggcgtttctgtcactggagcaagc

SEQ ID NO: 146364 - DNA, 25 bp, Rattus norvegicus
aggcgtttctgtgactggagcaagc

SEQ ID NO: 146365 - DNA, 25 bp, Rattus norvegicus
aggcgtttgcataccaggcgtacaa

SEQ ID NO: 146366 - DNA, 25 bp, Rattus norvegicus
aggcgtttgcattccaggcgtacaa

SEQ ID NO: 146367 - DNA, 25 bp, Rattus norvegicus
aggctaaaccgaaccagtcctttct

SEQ ID NO: 146368 - DNA, 25 bp, Rattus norvegicus
aggctaaaccgatccagtcctttct

SEQ ID NO: 146369 - DNA, 25 bp, Rattus norvegicus
aggctaaccatgactcacgtgggca

SEQ ID NO: 146370 - DNA, 25 bp, Rattus norvegicus
aggctaaccatgtctcacgtgggca

SEQ ID NO: 146371 - DNA, 25 bp, Rattus norvegicus
aggctaacgcttcctttattggctt

SEQ ID NO: 146372 - DNA, 25 bp, Rattus norvegicus
aggctaacgcttgctttattggctt

SEQ ID NO: 146373 - DNA, 25 bp, Rattus norvegicus
aggctaactcggctaccacagggtt

SEQ ID NO: 146374 - DNA, 25 bp, Rattus norvegicus
aggctaactcgggtaccacagggtt

SEQ ID NO: 146375 - DNA, 25 bp, Rattus norvegicus
aggctaactgctcggcatgacatga

SEQ ID NO: 146376 - DNA, 25 bp, Rattus norvegicus
aggctaactgctgggcatgacatga

SEQ ID NO: 146377 - DNA, 25 bp, Rattus norvegicus
aggctaactggaatgttctcctcat

SEQ ID NO: 146378 - DNA, 25 bp, Rattus norvegicus
aggctaactggattgttctcctcat

SEQ ID NO: 146379 - DNA, 25 bp, Rattus norvegicus
aggctaagacctacagagtccttcc

SEQ ID NO: 146380 - DNA, 25 bp, Rattus norvegicus
aggctaagaccttcagagtccttcc

SEQ ID NO: 146381 - DNA, 25 bp, Rattus norvegicus
aggctaaggcggaggcttttctcta

SEQ ID NO: 146382 - DNA, 25 bp, Rattus norvegicus
aggctaaggcggtggcttttctcta

SEQ ID NO: 146383 - DNA, 25 bp, Rattus norvegicus
aggctaagttgtcctctataagagt

SEQ ID NO: 146384 - DNA, 25 bp, Rattus norvegicus
aggctaagttgtgctctataagagt

SEQ ID NO: 146385 - DNA, 25 bp, Rattus norvegicus
aggctaatgaaacccagcgccattc

SEQ ID NO: 146386 - DNA, 25 bp, Rattus norvegicus
aggctaatgaaagccagcgccattc

SEQ ID NO: 146387 - DNA, 25 bp, Rattus norvegicus
aggctaatgagacacctggtgttaa

SEQ ID NO: 146388 - DNA, 25 bp, Rattus norvegicus
aggctaatgagagacctggtgttaa

SEQ ID NO: 146389 - DNA, 25 bp, Rattus norvegicus
aggctaatggctaatctcctattca

SEQ ID NO: 146390 - DNA, 25 bp, Rattus norvegicus
aggctaatggcttatctcctattca

SEQ ID NO: 146391 - DNA, 25 bp, Rattus norvegicus
aggctaattgtgcttctttcagaat

SEQ ID NO: 146392 - DNA, 25 bp, Rattus norvegicus
aggctaattgtggttctttcagaat

SEQ ID NO: 146393 - DNA, 25 bp, Rattus norvegicus
aggctacaagacacatcgtactcct

SEQ ID NO: 146394 - DNA, 25 bp, Rattus norvegicus
aggctacaagactcatcgtactcct

SEQ ID NO: 146395 - DNA, 25 bp, Rattus norvegicus
aggctacacattataatggggctgg

SEQ ID NO: 146396 - DNA, 25 bp, Rattus norvegicus
aggctacacattttaatggggctgg

SEQ ID NO: 146397 - DNA, 25 bp, Rattus norvegicus
aggctacactgcagctttgaggact

SEQ ID NO: 146398 - DNA, 25 bp, Rattus norvegicus
aggctacactgctgctttgaggact

SEQ ID NO: 146399 - DNA, 25 bp, Rattus norvegicus
aggctacagagaaagcccagtggtt

SEQ ID NO: 146400 - DNA, 25 bp, Rattus norvegicus
aggctacagagatagcccagtggtt

SEQ ID NO: 146401 - DNA, 25 bp, Rattus norvegicus
aggctacaggagaccccggctcaaa

SEQ ID NO: 146402 - DNA, 25 bp, Rattus norvegicus
aggctacaggagtccccggctcaaa

SEQ ID NO: 146403 - DNA, 25 bp, Rattus norvegicus
aggctacaggatacccagtcaactt

SEQ ID NO: 146404 - DNA, 25 bp, Rattus norvegicus
aggctacaggattcccagtcaactt

SEQ ID NO: 146405 - DNA, 25 bp, Rattus norvegicus
aggctacatcttcccgtttttccaa

SEQ ID NO: 146406 - DNA, 25 bp, Rattus norvegicus
aggctacatcttgccgtttttccaa

SEQ ID NO: 146407 - DNA, 25 bp, Rattus norvegicus
aggctacatgccagagtgcaaacag

SEQ ID NO: 146408 - DNA, 25 bp, Rattus norvegicus
aggctacatgcctgagtgcaaacag

SEQ ID NO: 146409 - DNA, 25 bp, Rattus norvegicus
aggctaccattgactctgtggactg

SEQ ID NO: 146410 - DNA, 25 bp, Rattus norvegicus
aggctaccattgtctctgtggactg

SEQ ID NO: 146411 - DNA, 25 bp, Rattus norvegicus
aggctacccaggaagtcaggaccct

SEQ ID NO: 146412 - DNA, 25 bp, Rattus norvegicus
aggctacccaggtagtcaggaccct

SEQ ID NO: 146413 - DNA, 25 bp, Rattus norvegicus
aggctaccctgtcgtcgttgaagat

SEQ ID NO: 146414 - DNA, 25 bp, Rattus norvegicus
aggctaccctgtggtcgttgaagat

SEQ ID NO: 146415 - DNA, 25 bp, Rattus norvegicus
aggctaccggcacagttactgctat

SEQ ID NO: 146416 - DNA, 25 bp, Rattus norvegicus
aggctaccggcagagttactgctat

SEQ ID NO: 146417 - DNA, 25 bp, Rattus norvegicus
aggctaccgtaaacagtgaaccctg

SEQ ID NO: 146418 - DNA, 25 bp, Rattus norvegicus
aggctaccgtaatcagtgaaccctg

SEQ ID NO: 146419 - DNA, 25 bp, Rattus norvegicus
aggctacctgtaattttcaatagaa

SEQ ID NO: 146420 - DNA, 25 bp, Rattus norvegicus
aggctacctgtatttttcaatagaa

SEQ ID NO: 146421 - DNA, 25 bp, Rattus norvegicus
aggctacggcccacgggctttgtag

SEQ ID NO: 146422 - DNA, 25 bp, Rattus norvegicus
aggctacggccctcgggctttgtag

SEQ ID NO: 146423 - DNA, 25 bp, Rattus norvegicus
aggctacggtgaacctgagcatctt

SEQ ID NO: 146424 - DNA, 25 bp, Rattus norvegicus
aggctacggtgatcctgagcatctt

SEQ ID NO: 146425 - DNA, 25 bp, Rattus norvegicus
aggctacgtcccaggtgctgtggaa

SEQ ID NO: 146426 - DNA, 25 bp, Rattus norvegicus
aggctacgtccctggtgctgtggaa

SEQ ID NO: 146427 - DNA, 25 bp, Rattus norvegicus
aggctactacatcttttaagggcta

SEQ ID NO: 146428 - DNA, 25 bp, Rattus norvegicus
aggctactacatgttttaagggcta

SEQ ID NO: 146429 - DNA, 25 bp, Rattus norvegicus
aggctactagatacagatacccagg

SEQ ID NO: 146430 - DNA, 25 bp, Rattus norvegicus
aggctactagattcagatacccagg

SEQ ID NO: 146431 - DNA, 25 bp, Rattus norvegicus
aggctactatctctgaactgttcgc

SEQ ID NO: 146432 - DNA, 25 bp, Rattus norvegicus
aggctactatctgtgaactgttcgc

SEQ ID NO: 146433 - DNA, 25 bp, Rattus norvegicus
aggctactcagcactacggcatttt

SEQ ID NO: 146434 - DNA, 25 bp, Rattus norvegicus
aggctactcagctctacggcatttt

SEQ ID NO: 146435 - DNA, 25 bp, Rattus norvegicus
aggctactcgacaagattgtttcta

SEQ ID NO: 146436 - DNA, 25 bp, Rattus norvegicus
aggctactcgactagattgtttcta

SEQ ID NO: 146437 - DNA, 25 bp, Rattus norvegicus
aggctactgaaacccgaattcgact

SEQ ID NO: 146438 - DNA, 25 bp, Rattus norvegicus
aggctactgaaagccgaattcgact

SEQ ID NO: 146439 - DNA, 25 bp, Rattus norvegicus
aggctactgactatgagcaccgtat

SEQ ID NO: 146440 - DNA, 25 bp, Rattus norvegicus
aggctactgactttgagcaccgtat

SEQ ID NO: 146441 - DNA, 25 bp, Rattus norvegicus
aggctactggagacctacttcagaa

SEQ ID NO: 146442 - DNA, 25 bp, Rattus norvegicus
aggctactggagcaagttcactgat

SEQ ID NO: 146443 - DNA, 25 bp, Rattus norvegicus
aggctactggaggaagttcactgat

SEQ ID NO: 146444 - DNA, 25 bp, Rattus norvegicus
aggctactggagtcctacttcagaa

SEQ ID NO: 146445 - DNA, 25 bp, Rattus norvegicus
aggctagaacccaatcaatggcttt

SEQ ID NO: 146446 - DNA, 25 bp, Rattus norvegicus
aggctagaaccctatcaatggcttt

SEQ ID NO: 146447 - DNA, 25 bp, Rattus norvegicus
aggctagacagtcttggccacacgt

SEQ ID NO: 146448 - DNA, 25 bp, Rattus norvegicus
aggctagacagtgttggccacacgt

SEQ ID NO: 146449 - DNA, 25 bp, Rattus norvegicus
aggctagaccctagcacgaacatag

SEQ ID NO: 146450 - DNA, 25 bp, Rattus norvegicus
aggctagacccttgcacgaacatag

SEQ ID NO: 146451 - DNA, 25 bp, Rattus norvegicus
aggctagactaacgtcctacctcac

SEQ ID NO: 146452 - DNA, 25 bp, Rattus norvegicus
aggctagactaaggtcctacctcac

SEQ ID NO: 146453 - DNA, 25 bp, Rattus norvegicus
aggctagactcacaatctttgtatt

SEQ ID NO: 146454 - DNA, 25 bp, Rattus norvegicus
aggctagactcagaatctttgtatt

SEQ ID NO: 146455 - DNA, 25 bp, Rattus norvegicus
aggctagccatgatttatcacgtga

SEQ ID NO: 146456 - DNA, 25 bp, Rattus norvegicus
aggctagccatgttttatcacgtga

SEQ ID NO: 146457 - DNA, 25 bp, Rattus norvegicus
aggctagccctgaactaccagtcag

SEQ ID NO: 146458 - DNA, 25 bp, Rattus norvegicus
aggctagccctgtactaccagtcag

SEQ ID NO: 146459 - DNA, 25 bp, Rattus norvegicus
aggctagcctagcttacatatcgag

SEQ ID NO: 146460 - DNA, 25 bp, Rattus norvegicus
aggctagcctaggttacatatcgag

SEQ ID NO: 146461 - DNA, 25 bp, Rattus norvegicus
aggctagcctcaagtagtgagttcc

SEQ ID NO: 146462 - DNA, 25 bp, Rattus norvegicus
aggctagcctcatgtagtgagttcc

SEQ ID NO: 146463 - DNA, 25 bp, Rattus norvegicus
aggctagccttgctagtgctgctac

SEQ ID NO: 146464 - DNA, 25 bp, Rattus norvegicus
aggctagccttggtagtgctgctac

SEQ ID NO: 146465 - DNA, 25 bp, Rattus norvegicus
aggctagcggccagcggtctcagta

SEQ ID NO: 146466 - DNA, 25 bp, Rattus norvegicus
aggctagcggcctgcggtctcagta

SEQ ID NO: 146467 - DNA, 25 bp, Rattus norvegicus
aggctagcgtttcgacctccagaac

SEQ ID NO: 146468 - DNA, 25 bp, Rattus norvegicus
aggctagcgtttggacctccagaac

SEQ ID NO: 146469 - DNA, 25 bp, Rattus norvegicus
aggctagctcatagccagtctggtg

SEQ ID NO: 146470 - DNA, 25 bp, Rattus norvegicus
aggctagctcattgccagtctggtg

SEQ ID NO: 146471 - DNA, 25 bp, Rattus norvegicus
aggctagctccaattctgtagctga

SEQ ID NO: 146472 - DNA, 25 bp, Rattus norvegicus
aggctagctccatttctgtagctga

SEQ ID NO: 146473 - DNA, 25 bp, Rattus norvegicus
aggctagcttcaaatttgccgtcat

SEQ ID NO: 146474 - DNA, 25 bp, Rattus norvegicus
aggctagcttcatatttgccgtcat

SEQ ID NO: 146475 - DNA, 25 bp, Rattus norvegicus
aggctaggccgacgctttctcatta

SEQ ID NO: 146476 - DNA, 25 bp, Rattus norvegicus
aggctaggccgaggctttctcatta

SEQ ID NO: 146477 - DNA, 25 bp, Rattus norvegicus
aggctaggctggctcaccaagtaaa

SEQ ID NO: 146478 - DNA, 25 bp, Rattus norvegicus
aggctaggctgggtcaccaagtaaa

SEQ ID NO: 146479 - DNA, 25 bp, Rattus norvegicus
aggctaggttcccacttaatgcaaa

SEQ ID NO: 146480 - DNA, 25 bp, Rattus norvegicus
aggctaggttccgacttaatgcaaa

SEQ ID NO: 146481 - DNA, 25 bp, Rattus norvegicus
aggctagtaactacccagtcctcag

SEQ ID NO: 146482 - DNA, 25 bp, Rattus norvegicus
aggctagtaacttcccagtcctcag

SEQ ID NO: 146483 - DNA, 25 bp, Rattus norvegicus
aggctagtcagaccccctggtgtaa

SEQ ID NO: 146484 - DNA, 25 bp, Rattus norvegicus
aggctagtcagagcccctggtgtaa

SEQ ID NO: 146485 - DNA, 25 bp, Rattus norvegicus
aggctagtggtgactcttgatggta

SEQ ID NO: 146486 - DNA, 25 bp, Rattus norvegicus
aggctagtggtgtctcttgatggta

SEQ ID NO: 146487 - DNA, 25 bp, Rattus norvegicus
aggctataagcccaagtatctccag

SEQ ID NO: 146488 - DNA, 25 bp, Rattus norvegicus
aggctataagccgaagtatctccag

SEQ ID NO: 146489 - DNA, 25 bp, Rattus norvegicus
aggctatacagcaagatcacatcta

SEQ ID NO: 146490 - DNA, 25 bp, Rattus norvegicus
aggctatacagctagatcacatcta

SEQ ID NO: 146491 - DNA, 25 bp, Rattus norvegicus
aggctatacgcaagcaaacagtcgc

SEQ ID NO: 146492 - DNA, 25 bp, Rattus norvegicus
aggctatacgcatgcaaacagtcgc

SEQ ID NO: 146493 - DNA, 25 bp, Rattus norvegicus
aggctatactgcaagggctccattc

SEQ ID NO: 146494 - DNA, 25 bp, Rattus norvegicus
aggctatactgctagggctccattc

SEQ ID NO: 146495 - DNA, 25 bp, Rattus norvegicus
aggctatagaaacgccggaggccaa

SEQ ID NO: 146496 - DNA, 25 bp, Rattus norvegicus
aggctatagaaaggccggaggccaa

SEQ ID NO: 146497 - DNA, 25 bp, Rattus norvegicus
aggctatatagcaactttgcccacc

SEQ ID NO: 146498 - DNA, 25 bp, Rattus norvegicus
aggctatatagctactttgcccacc

SEQ ID NO: 146499 - DNA, 25 bp, Rattus norvegicus
aggctatattttccaaatctcccaa

SEQ ID NO: 146500 - DNA, 25 bp, Rattus norvegicus
aggctatattttgcaaatctcccaa

SEQ ID NO: 146501 - DNA, 25 bp, Rattus norvegicus
aggctatcaccgatactcttgaatt

SEQ ID NO: 146502 - DNA, 25 bp, Rattus norvegicus
aggctatcaccgttactcttgaatt

SEQ ID NO: 146503 - DNA, 25 bp, Rattus norvegicus
aggctatcactccaaacctactgcg

SEQ ID NO: 146504 - DNA, 25 bp, Rattus norvegicus
aggctatcactcgaaacctactgcg

SEQ ID NO: 146505 - DNA, 25 bp, Rattus norvegicus
aggctatccatgatcagccgtcggg

SEQ ID NO: 146506 - DNA, 25 bp, Rattus norvegicus
aggctatccatgttcagccgtcggg

SEQ ID NO: 146507 - DNA, 25 bp, Rattus norvegicus
aggctatccctacagtaccatgctt

SEQ ID NO: 146508 - DNA, 25 bp, Rattus norvegicus
aggctatccctagagtaccatgctt

SEQ ID NO: 146509 - DNA, 25 bp, Rattus norvegicus
aggctatcctcccaagcgtcatgtt

SEQ ID NO: 146510 - DNA, 25 bp, Rattus norvegicus
aggctatcctccgaagcgtcatgtt

SEQ ID NO: 146511 - DNA, 25 bp, Rattus norvegicus
aggctatcggatcccagacagtgaa

SEQ ID NO: 146512 - DNA, 25 bp, Rattus norvegicus
aggctatcggatgccagacagtgaa

SEQ ID NO: 146513 - DNA, 25 bp, Rattus norvegicus
aggctatgacatcatccttgccaga

SEQ ID NO: 146514 - DNA, 25 bp, Rattus norvegicus
aggctatgacatgatccttgccaga

SEQ ID NO: 146515 - DNA, 25 bp, Rattus norvegicus
aggctatgcaggcacatgcagccct

SEQ ID NO: 146516 - DNA, 25 bp, Rattus norvegicus
aggctatgcagggacatgcagccct

SEQ ID NO: 146517 - DNA, 25 bp, Rattus norvegicus
aggctatgccagaacttgggactta

SEQ ID NO: 146518 - DNA, 25 bp, Rattus norvegicus
aggctatgccagtacttgggactta

SEQ ID NO: 146519 - DNA, 25 bp, Rattus norvegicus
aggctatgcggacatcggcaaaccc

SEQ ID NO: 146520 - DNA, 25 bp, Rattus norvegicus
aggctatgcggagatcggcaaaccc

SEQ ID NO: 146521 - DNA, 25 bp, Rattus norvegicus
aggctatgctaaatcctccttctca

SEQ ID NO: 146522 - DNA, 25 bp, Rattus norvegicus
aggctatgctaattcctccttctca

SEQ ID NO: 146523 - DNA, 25 bp, Rattus norvegicus
aggctatggacacccgcctacagtt

SEQ ID NO: 146524 - DNA, 25 bp, Rattus norvegicus
aggctatggacagccgcctacagtt

SEQ ID NO: 146525 - DNA, 25 bp, Rattus norvegicus
aggctatgtcagaacctggtgtatt

SEQ ID NO: 146526 - DNA, 25 bp, Rattus norvegicus
aggctatgtcagtacctggtgtatt

SEQ ID NO: 146527 - DNA, 25 bp, Rattus norvegicus
aggctatgtgctcactcatgcgctt

SEQ ID NO: 146528 - DNA, 25 bp, Rattus norvegicus
aggctatgtgctgactcatgcgctt

SEQ ID NO: 146529 - DNA, 25 bp, Rattus norvegicus
aggctattaatgatgcccaccaaat

SEQ ID NO: 146530 - DNA, 25 bp, Rattus norvegicus
aggctattaatgttgcccaccaaat

SEQ ID NO: 146531 - DNA, 25 bp, Rattus norvegicus
aggctattattcctggaggaaccca

SEQ ID NO: 146532 - DNA, 25 bp, Rattus norvegicus
aggctattattcgtggaggaaccca

SEQ ID NO: 146533 - DNA, 25 bp, Rattus norvegicus
aggctattcaagatctctggcagtg

SEQ ID NO: 146534 - DNA, 25 bp, Rattus norvegicus
aggctattcaagatgctggtttcca

SEQ ID NO: 146535 - DNA, 25 bp, Rattus norvegicus
aggctattcaagttctctggcagtg

SEQ ID NO: 146536 - DNA, 25 bp, Rattus norvegicus
aggctattcaagttgctggtttcca

SEQ ID NO: 146537 - DNA, 25 bp, Rattus norvegicus
aggctattctggacaacatctttgg

SEQ ID NO: 146538 - DNA, 25 bp, Rattus norvegicus
aggctattctggtcaacatctttgg

SEQ ID NO: 146539 - DNA, 25 bp, Rattus norvegicus
aggctatttatgatgttctcttgta

SEQ ID NO: 146540 - DNA, 25 bp, Rattus norvegicus
aggctatttatgttgttctcttgta

SEQ ID NO: 146541 - DNA, 25 bp, Rattus norvegicus
aggctatttcctcctagtgtagtgg

SEQ ID NO: 146542 - DNA, 25 bp, Rattus norvegicus
aggctatttcctgctagtgtagtgg

SEQ ID NO: 146543 - DNA, 25 bp, Rattus norvegicus
aggctcaaaactactgttctgttca

SEQ ID NO: 146544 - DNA, 25 bp, Rattus norvegicus
aggctcaaaacttctgttctgttca

SEQ ID NO: 146545 - DNA, 25 bp, Rattus norvegicus
aggctcaaaggtacaggactcaaca

SEQ ID NO: 146546 - DNA, 25 bp, Rattus norvegicus
aggctcaaaggttcaggactcaaca

SEQ ID NO: 146547 - DNA, 25 bp, Rattus norvegicus
aggctcaaccttactgcttcctgta

SEQ ID NO: 146548 - DNA, 25 bp, Rattus norvegicus
aggctcaacctttctgcttcctgta

SEQ ID NO: 146549 - DNA, 25 bp, Rattus norvegicus
aggctcaagttcacctgggacagaa

SEQ ID NO: 146550 - DNA, 25 bp, Rattus norvegicus
aggctcaagttctcctgggacagaa

SEQ ID NO: 146551 - DNA, 25 bp, Rattus norvegicus
aggctcacactcctgtcaatgaaga

SEQ ID NO: 146552 - DNA, 25 bp, Rattus norvegicus
aggctcacactcgtgtcaatgaaga

SEQ ID NO: 146553 - DNA, 25 bp, Rattus norvegicus
aggctcacattcagaccaagtgtac

SEQ ID NO: 146554 - DNA, 25 bp, Rattus norvegicus
aggctcacattcctacagtggcagg

SEQ ID NO: 146555 - DNA, 25 bp, Rattus norvegicus
aggctcacattcgtacagtggcagg

SEQ ID NO: 146556 - DNA, 25 bp, Rattus norvegicus
aggctcacattctgaccaagtgtac

SEQ ID NO: 146557 - DNA, 25 bp, Rattus norvegicus
aggctcaccagcagaatggccacag

SEQ ID NO: 146558 - DNA, 25 bp, Rattus norvegicus
aggctcaccagctgaatggccacag

SEQ ID NO: 146559 - DNA, 25 bp, Rattus norvegicus
aggctcacctctctgtagattgctt

SEQ ID NO: 146560 - DNA, 25 bp, Rattus norvegicus
aggctcacctctgtgtagattgctt

SEQ ID NO: 146561 - DNA, 25 bp, Rattus norvegicus
aggctcacgactagtgttgtctcct

SEQ ID NO: 146562 - DNA, 25 bp, Rattus norvegicus
aggctcacgacttgtgttgtctcct

SEQ ID NO: 146563 - DNA, 25 bp, Rattus norvegicus
aggctcactataccatgtcatcaag

SEQ ID NO: 146564 - DNA, 25 bp, Rattus norvegicus
aggctcactatagcatgtcatcaag

SEQ ID NO: 146565 - DNA, 25 bp, Rattus norvegicus
aggctcactccacagttttgttaag

SEQ ID NO: 146566 - DNA, 25 bp, Rattus norvegicus
aggctcactccagagttttgttaag

SEQ ID NO: 146567 - DNA, 25 bp, Rattus norvegicus
aggctcactcggaaactccattcgt

SEQ ID NO: 146568 - DNA, 25 bp, Rattus norvegicus
aggctcactcggtaactccattcgt

SEQ ID NO: 146569 - DNA, 25 bp, Rattus norvegicus
aggctcactctcagaaacagaagca

SEQ ID NO: 146570 - DNA, 25 bp, Rattus norvegicus
aggctcactctctgaaacagaagca

SEQ ID NO: 146571 - DNA, 25 bp, Rattus norvegicus
aggctcactcttacctcatgtattt

SEQ ID NO: 146572 - DNA, 25 bp, Rattus norvegicus
aggctcactctttcctcatgtattt

SEQ ID NO: 146573 - DNA, 25 bp, Rattus norvegicus
aggctcactttgagcctctggtgaa

SEQ ID NO: 146574 - DNA, 25 bp, Rattus norvegicus
aggctcactttgtgcctctggtgaa

SEQ ID NO: 146575 - DNA, 25 bp, Rattus norvegicus
aggctcagagcacaaatcagctgga

SEQ ID NO: 146576 - DNA, 25 bp, Rattus norvegicus
aggctcagagcagaaatcagctgga

SEQ ID NO: 146577 - DNA, 25 bp, Rattus norvegicus
aggctcagagccagtggtttcccat

SEQ ID NO: 146578 - DNA, 25 bp, Rattus norvegicus
aggctcagagcctgtggtttcccat

SEQ ID NO: 146579 - DNA, 25 bp, Rattus norvegicus
aggctcagagttcgtggctgactcc

SEQ ID NO: 146580 - DNA, 25 bp, Rattus norvegicus
aggctcagagttggtggctgactcc

SEQ ID NO: 146581 - DNA, 25 bp, Rattus norvegicus
aggctcagctgccactcagtggcat

SEQ ID NO: 146582 - DNA, 25 bp, Rattus norvegicus
aggctcagctgcgactcagtggcat

SEQ ID NO: 146583 - DNA, 25 bp, Rattus norvegicus
aggctcaggactctctgctcgtgtc

SEQ ID NO: 146584 - DNA, 25 bp, Rattus norvegicus
aggctcaggactgtctgctcgtgtc

SEQ ID NO: 146585 - DNA, 25 bp, Rattus norvegicus
aggctcaggccaatgacatcacagt

SEQ ID NO: 146586 - DNA, 25 bp, Rattus norvegicus
aggctcaggccattgacatcacagt

SEQ ID NO: 146587 - DNA, 25 bp, Rattus norvegicus
aggctcagggaacactgtggaagag

SEQ ID NO: 146588 - DNA, 25 bp, Rattus norvegicus
aggctcagggaagactgtggaagag

SEQ ID NO: 146589 - DNA, 25 bp, Rattus norvegicus
aggctcagggctcgcagtcgacaca

SEQ ID NO: 146590 - DNA, 25 bp, Rattus norvegicus
aggctcagggctggcagtcgacaca

SEQ ID NO: 146591 - DNA, 25 bp, Rattus norvegicus
aggctcagggtcagagtccccggca

SEQ ID NO: 146592 - DNA, 25 bp, Rattus norvegicus
aggctcagggtctgagtccccggca

SEQ ID NO: 146593 - DNA, 25 bp, Rattus norvegicus
aggctcagtgacaaaccgtgcttct

SEQ ID NO: 146594 - DNA, 25 bp, Rattus norvegicus
aggctcagtgactaaccgtgcttct

SEQ ID NO: 146595 - DNA, 25 bp, Rattus norvegicus
aggctcagttgcaccatgttagttc

SEQ ID NO: 146596 - DNA, 25 bp, Rattus norvegicus
aggctcagttgctccatgttagttc

SEQ ID NO: 146597 - DNA, 25 bp, Rattus norvegicus
aggctcagttttcccatcagtagaa

SEQ ID NO: 146598 - DNA, 25 bp, Rattus norvegicus
aggctcagttttgccatcagtagaa

SEQ ID NO: 146599 - DNA, 25 bp, Rattus norvegicus
aggctcataaaaagttcctcgtttt

SEQ ID NO: 146600 - DNA, 25 bp, Rattus norvegicus
aggctcataaaatgttcctcgtttt

SEQ ID NO: 146601 - DNA, 25 bp, Rattus norvegicus
aggctcatagagcatctcctacttt

SEQ ID NO: 146602 - DNA, 25 bp, Rattus norvegicus
aggctcatagaggatctcctacttt

SEQ ID NO: 146603 - DNA, 25 bp, Rattus norvegicus
aggctcatagtgacccctgcaggct

SEQ ID NO: 146604 - DNA, 25 bp, Rattus norvegicus
aggctcatagtgtcccctgcaggct

SEQ ID NO: 146605 - DNA, 25 bp, Rattus norvegicus
aggctcatcaaaagctgcagctgtg

SEQ ID NO: 146606 - DNA, 25 bp, Rattus norvegicus
aggctcatcaaatgctgcagctgtg

SEQ ID NO: 146607 - DNA, 25 bp, Rattus norvegicus
aggctcatcaagctgttcgttctca

SEQ ID NO: 146608 - DNA, 25 bp, Rattus norvegicus
aggctcatcaaggtgttcgttctca

SEQ ID NO: 146609 - DNA, 25 bp, Rattus norvegicus
aggctcatctctatgactctgaggc

SEQ ID NO: 146610 - DNA, 25 bp, Rattus norvegicus
aggctcatctctttgactctgaggc

SEQ ID NO: 146611 - DNA, 25 bp, Rattus norvegicus
aggctcatctgcagccgggaagaag

SEQ ID NO: 146612 - DNA, 25 bp, Rattus norvegicus
aggctcatctgctgccgggaagaag

SEQ ID NO: 146613 - DNA, 25 bp, Rattus norvegicus
aggctcatcttaaattttctacccc

SEQ ID NO: 146614 - DNA, 25 bp, Rattus norvegicus
aggctcatcttatattttctacccc

SEQ ID NO: 146615 - DNA, 25 bp, Rattus norvegicus
aggctcatgaccaccaaaacttgga

SEQ ID NO: 146616 - DNA, 25 bp, Rattus norvegicus
aggctcatgacctccaaaacttgga

SEQ ID NO: 146617 - DNA, 25 bp, Rattus norvegicus
aggctcatgccaccctgctgcagga

SEQ ID NO: 146618 - DNA, 25 bp, Rattus norvegicus
aggctcatgccagcctgctgcagga

SEQ ID NO: 146619 - DNA, 25 bp, Rattus norvegicus
aggctcatgccgagcagctggcaaa

SEQ ID NO: 146620 - DNA, 25 bp, Rattus norvegicus
aggctcatgccgtgcagctggcaaa

SEQ ID NO: 146621 - DNA, 25 bp, Rattus norvegicus
aggctcatggccaagaccttatgaa

SEQ ID NO: 146622 - DNA, 25 bp, Rattus norvegicus
aggctcatggcctagaccttatgaa

SEQ ID NO: 146623 - DNA, 25 bp, Rattus norvegicus
aggctcatgtccacttgtatatgtg

SEQ ID NO: 146624 - DNA, 25 bp, Rattus norvegicus
aggctcatgtcctcttgtatatgtg

SEQ ID NO: 146625 - DNA, 25 bp, Rattus norvegicus
aggctcattgaacgccatggctcga

SEQ ID NO: 146626 - DNA, 25 bp, Rattus norvegicus
aggctcattgaaggccatggctcga

SEQ ID NO: 146627 - DNA, 25 bp, Rattus norvegicus
aggctccaagcaagcatcatttgtg

SEQ ID NO: 146628 - DNA, 25 bp, Rattus norvegicus
aggctccaagcatgcatcatttgtg

SEQ ID NO: 146629 - DNA, 25 bp, Rattus norvegicus
aggctccaagtgatggcctttctga

SEQ ID NO: 146630 - DNA, 25 bp, Rattus norvegicus
aggctccaagtgttggcctttctga

SEQ ID NO: 146631 - DNA, 25 bp, Rattus norvegicus
aggctccactccctggaagagaaat

SEQ ID NO: 146632 - DNA, 25 bp, Rattus norvegicus
aggctccactccgtggaagagaaat

SEQ ID NO: 146633 - DNA, 25 bp, Rattus norvegicus
aggctccagaacagccccggaaggg

SEQ ID NO: 146634 - DNA, 25 bp, Rattus norvegicus
aggctccagaactgccccggaaggg

SEQ ID NO: 146635 - DNA, 25 bp, Rattus norvegicus
aggctccagactcagggccgcctga

SEQ ID NO: 146636 - DNA, 25 bp, Rattus norvegicus
aggctccagactgagggccgcctga

SEQ ID NO: 146637 - DNA, 25 bp, Rattus norvegicus
aggctccaggacacatgggcagtga

SEQ ID NO: 146638 - DNA, 25 bp, Rattus norvegicus
aggctccaggactcatgggcagtga

SEQ ID NO: 146639 - DNA, 25 bp, Rattus norvegicus
aggctccagtgaaggctcggatcct

SEQ ID NO: 146640 - DNA, 25 bp, Rattus norvegicus
aggctccagtgatggctcggatcct

SEQ ID NO: 146641 - DNA, 25 bp, Rattus norvegicus
aggctccagtgcagcaggcagcaag

SEQ ID NO: 146642 - DNA, 25 bp, Rattus norvegicus
aggctccagtgctgcaggcagcaag

SEQ ID NO: 146643 - DNA, 25 bp, Rattus norvegicus
aggctccagtggcttgtataggtct

SEQ ID NO: 146644 - DNA, 25 bp, Rattus norvegicus
aggctccagtgggttgtataggtct

SEQ ID NO: 146645 - DNA, 25 bp, Rattus norvegicus
aggctccagtgtactgtgtgtccag

SEQ ID NO: 146646 - DNA, 25 bp, Rattus norvegicus
aggctccagtgttctgtgtgtccag

SEQ ID NO: 146647 - DNA, 25 bp, Rattus norvegicus
aggctccagttgaggctacaaccta

SEQ ID NO: 146648 - DNA, 25 bp, Rattus norvegicus
aggctccagttgtggctacaaccta

SEQ ID NO: 146649 - DNA, 25 bp, Rattus norvegicus
aggctccatcataccttgagttcct

SEQ ID NO: 146650 - DNA, 25 bp, Rattus norvegicus
aggctccatcattccttgagttcct

SEQ ID NO: 146651 - DNA, 25 bp, Rattus norvegicus
aggctccatctcagagacctttgtg

SEQ ID NO: 146652 - DNA, 25 bp, Rattus norvegicus
aggctccatctctgagacctttgtg

SEQ ID NO: 146653 - DNA, 25 bp, Rattus norvegicus
aggctccattcactcactggatgtt

SEQ ID NO: 146654 - DNA, 25 bp, Rattus norvegicus
aggctccattcagtcactggatgtt

SEQ ID NO: 146655 - DNA, 25 bp, Rattus norvegicus
aggctccattggagctgcaagttga

SEQ ID NO: 146656 - DNA, 25 bp, Rattus norvegicus
aggctccattggtgctgcaagttga

SEQ ID NO: 146657 - DNA, 25 bp, Rattus norvegicus
aggctcccactgcagttccagaaga

SEQ ID NO: 146658 - DNA, 25 bp, Rattus norvegicus
aggctcccactggagttccagaaga

SEQ ID NO: 146659 - DNA, 25 bp, Rattus norvegicus
aggctcccacttcctgaaggaaaag

SEQ ID NO: 146660 - DNA, 25 bp, Rattus norvegicus
aggctcccacttgctgaaggaaaag

SEQ ID NO: 146661 - DNA, 25 bp, Rattus norvegicus
aggctcccagacctgtgatagcaat

SEQ ID NO: 146662 - DNA, 25 bp, Rattus norvegicus
aggctcccagacgtgtgatagcaat

SEQ ID NO: 146663 - DNA, 25 bp, Rattus norvegicus
aggctcccagctcatatacagacat

SEQ ID NO: 146664 - DNA, 25 bp, Rattus norvegicus
aggctcccagctgatatacagacat

SEQ ID NO: 146665 - DNA, 25 bp, Rattus norvegicus
aggctcccaggcagcagatctctga

SEQ ID NO: 146666 - DNA, 25 bp, Rattus norvegicus
aggctcccaggctgcagatctctga

SEQ ID NO: 146667 - DNA, 25 bp, Rattus norvegicus
aggctcccataaagcctgtgtgcga

SEQ ID NO: 146668 - DNA, 25 bp, Rattus norvegicus
aggctcccataatgcctgtgtgcga

SEQ ID NO: 146669 - DNA, 25 bp, Rattus norvegicus
aggctccccaccagctcagaggaga

SEQ ID NO: 146670 - DNA, 25 bp, Rattus norvegicus
aggctccccacctgctcagaggaga

SEQ ID NO: 146671 - DNA, 25 bp, Rattus norvegicus
aggctccccgcacgtaaggcatagt

SEQ ID NO: 146672 - DNA, 25 bp, Rattus norvegicus
aggctccccgcaggtaaggcatagt

SEQ ID NO: 146673 - DNA, 25 bp, Rattus norvegicus
aggctcccctggagtgactgacgtg

SEQ ID NO: 146674 - DNA, 25 bp, Rattus norvegicus
aggctcccctggtgtgactgacgtg

SEQ ID NO: 146675 - DNA, 25 bp, Rattus norvegicus
aggctccccttaccatgtacagaat

SEQ ID NO: 146676 - DNA, 25 bp, Rattus norvegicus
aggctccccttagcatgtacagaat

SEQ ID NO: 146677 - DNA, 25 bp, Rattus norvegicus
aggctcccgggaatggtatggacac

SEQ ID NO: 146678 - DNA, 25 bp, Rattus norvegicus
aggctcccgggattggtatggacac

SEQ ID NO: 146679 - DNA, 25 bp, Rattus norvegicus
aggctcccgggcactagagtctaga

SEQ ID NO: 146680 - DNA, 25 bp, Rattus norvegicus
aggctcccgggcataggcaacacaa

SEQ ID NO: 146681 - DNA, 25 bp, Rattus norvegicus
aggctcccgggctctagagtctaga

SEQ ID NO: 146682 - DNA, 25 bp, Rattus norvegicus
aggctcccgggcttaggcaacacaa

SEQ ID NO: 146683 - DNA, 25 bp, Rattus norvegicus
aggctccctgggagtcatggcacac

SEQ ID NO: 146684 - DNA, 25 bp, Rattus norvegicus
aggctccctgggtgtcatggcacac

SEQ ID NO: 146685 - DNA, 25 bp, Rattus norvegicus
aggctcccttgcagccaggagggaa

SEQ ID NO: 146686 - DNA, 25 bp, Rattus norvegicus
aggctcccttgctgccaggagggaa

SEQ ID NO: 146687 - DNA, 25 bp, Rattus norvegicus
aggctcccttgtagtgggttgagta

SEQ ID NO: 146688 - DNA, 25 bp, Rattus norvegicus
aggctcccttgttgtgggttgagta

SEQ ID NO: 146689 - DNA, 25 bp, Rattus norvegicus
aggctccgacttcctcatgaagaga

SEQ ID NO: 146690 - DNA, 25 bp, Rattus norvegicus
aggctccgacttgctcatgaagaga

SEQ ID NO: 146691 - DNA, 25 bp, Rattus norvegicus
aggctccgcgacatgttaaaaccag

SEQ ID NO: 146692 - DNA, 25 bp, Rattus norvegicus
aggctccgcgacttgttaaaaccag

SEQ ID NO: 146693 - DNA, 25 bp, Rattus norvegicus
aggctccggagtcaagctacaggca

SEQ ID NO: 146694 - DNA, 25 bp, Rattus norvegicus
aggctccggagtgaagctacaggca

SEQ ID NO: 146695 - DNA, 25 bp, Rattus norvegicus
aggctccgtagaagtaagcgaggtt

SEQ ID NO: 146696 - DNA, 25 bp, Rattus norvegicus
aggctccgtagatgtaagcgaggtt

SEQ ID NO: 146697 - DNA, 25 bp, Rattus norvegicus
aggctccgtccaagcagtacaggtg

SEQ ID NO: 146698 - DNA, 25 bp, Rattus norvegicus
aggctccgtccatgcagtacaggtg

SEQ ID NO: 146699 - DNA, 25 bp, Rattus norvegicus
aggctccgtgtacgtgctggaaact

SEQ ID NO: 146700 - DNA, 25 bp, Rattus norvegicus
aggctccgtgtaggtgctggaaact

SEQ ID NO: 146701 - DNA, 25 bp, Rattus norvegicus
aggctccgttctcagcaggctgttt

SEQ ID NO: 146702 - DNA, 25 bp, Rattus norvegicus
aggctccgttctgagcaggctgttt

SEQ ID NO: 146703 - DNA, 25 bp, Rattus norvegicus
aggctcctaaacacatgtgagtaca

SEQ ID NO: 146704 - DNA, 25 bp, Rattus norvegicus
aggctcctaaactcatgtgagtaca

SEQ ID NO: 146705 - DNA, 25 bp, Rattus norvegicus
aggctcctatctcaatctgttgtac

SEQ ID NO: 146706 - DNA, 25 bp, Rattus norvegicus
aggctcctatctccagtcacaggta

SEQ ID NO: 146707 - DNA, 25 bp, Rattus norvegicus
aggctcctatctgaatctgttgtac

SEQ ID NO: 146708 - DNA, 25 bp, Rattus norvegicus
aggctcctatctgcagtcacaggta

SEQ ID NO: 146709 - DNA, 25 bp, Rattus norvegicus
aggctcctcacacgttacatatctg

SEQ ID NO: 146710 - DNA, 25 bp, Rattus norvegicus
aggctcctcacaggttacatatctg

SEQ ID NO: 146711 - DNA, 25 bp, Rattus norvegicus
aggctcctccagctaggccagtgaa

SEQ ID NO: 146712 - DNA, 25 bp, Rattus norvegicus
aggctcctccaggtaggccagtgaa

SEQ ID NO: 146713 - DNA, 25 bp, Rattus norvegicus
aggctcctccctaccagagaaagaa

SEQ ID NO: 146714 - DNA, 25 bp, Rattus norvegicus
aggctcctcccttccagagaaagaa

SEQ ID NO: 146715 - DNA, 25 bp, Rattus norvegicus
aggctcctccgccatggaagtccgt

SEQ ID NO: 146716 - DNA, 25 bp, Rattus norvegicus
aggctcctccgcgatggaagtccgt

SEQ ID NO: 146717 - DNA, 25 bp, Rattus norvegicus
aggctcctctcgacacaaacctgtt

SEQ ID NO: 146718 - DNA, 25 bp, Rattus norvegicus
aggctcctctcgtcacaaacctgtt

SEQ ID NO: 146719 - DNA, 25 bp, Rattus norvegicus
aggctcctgcctaaaagattgaggt

SEQ ID NO: 146720 - DNA, 25 bp, Rattus norvegicus
aggctcctgccttaaagattgaggt

SEQ ID NO: 146721 - DNA, 25 bp, Rattus norvegicus
aggctcctggccaggctctgaggct

SEQ ID NO: 146722 - DNA, 25 bp, Rattus norvegicus
aggctcctggcctggctctgaggct

SEQ ID NO: 146723 - DNA, 25 bp, Rattus norvegicus
aggctcctgggacaagaatggctca

SEQ ID NO: 146724 - DNA, 25 bp, Rattus norvegicus
aggctcctgggagaagaatggctca

SEQ ID NO: 146725 - DNA, 25 bp, Rattus norvegicus
aggctcctgggtcttaattgcttca

SEQ ID NO: 146726 - DNA, 25 bp, Rattus norvegicus
aggctcctgggtgttaattgcttca

SEQ ID NO: 146727 - DNA, 25 bp, Rattus norvegicus
aggctcctggtcagcgtatttactg

SEQ ID NO: 146728 - DNA, 25 bp, Rattus norvegicus
aggctcctggtctgcgtatttactg

SEQ ID NO: 146729 - DNA, 25 bp, Rattus norvegicus
aggctcctgtcaacttggccgaggc

SEQ ID NO: 146730 - DNA, 25 bp, Rattus norvegicus
aggctcctgtcatcttggccgaggc

SEQ ID NO: 146731 - DNA, 25 bp, Rattus norvegicus
aggctcctgtgacactctgaagaca

SEQ ID NO: 146732 - DNA, 25 bp, Rattus norvegicus
aggctcctgtgagactctgaagaca

SEQ ID NO: 146733 - DNA, 25 bp, Rattus norvegicus
aggctccttcctagttggctaacca

SEQ ID NO: 146734 - DNA, 25 bp, Rattus norvegicus
aggctccttccttgttggctaacca

SEQ ID NO: 146735 - DNA, 25 bp, Rattus norvegicus
aggctccttcgtacatttgtttgtt

SEQ ID NO: 146736 - DNA, 25 bp, Rattus norvegicus
aggctccttcgttcatttgtttgtt

SEQ ID NO: 146737 - DNA, 25 bp, Rattus norvegicus
aggctccttggacagttcaccatgg

SEQ ID NO: 146738 - DNA, 25 bp, Rattus norvegicus
aggctccttggacgtttgtttgatc

SEQ ID NO: 146739 - DNA, 25 bp, Rattus norvegicus
aggctccttggagagttcaccatgg

SEQ ID NO: 146740 - DNA, 25 bp, Rattus norvegicus
aggctccttggaggtttgtttgatc

SEQ ID NO: 146741 - DNA, 25 bp, Rattus norvegicus
aggctccttggcacgaacataaatg

SEQ ID NO: 146742 - DNA, 25 bp, Rattus norvegicus
aggctccttggctcgaacataaatg

SEQ ID NO: 146743 - DNA, 25 bp, Rattus norvegicus
aggctcctttttctcaaaactccat

SEQ ID NO: 146744 - DNA, 25 bp, Rattus norvegicus
aggctcctttttgtcaaaactccat

SEQ ID NO: 146745 - DNA, 25 bp, Rattus norvegicus
aggctcgattttctatctgcaggca

SEQ ID NO: 146746 - DNA, 25 bp, Rattus norvegicus
aggctcgattttgtatctgcaggca

SEQ ID NO: 146747 - DNA, 25 bp, Rattus norvegicus
aggctcgccgtactctggagtacat

SEQ ID NO: 146748 - DNA, 25 bp, Rattus norvegicus
aggctcgccgtagtctggagtacat

SEQ ID NO: 146749 - DNA, 25 bp, Rattus norvegicus
aggctcgctgtgctcttgtccagtg

SEQ ID NO: 146750 - DNA, 25 bp, Rattus norvegicus
aggctcgctgtggtcttgtccagtg

SEQ ID NO: 146751 - DNA, 25 bp, Rattus norvegicus
aggctcgcttctcatgctctgtgga

SEQ ID NO: 146752 - DNA, 25 bp, Rattus norvegicus
aggctcgcttctgatgctctgtgga

SEQ ID NO: 146753 - DNA, 25 bp, Rattus norvegicus
aggctcggagtcagccgtcaccgac

SEQ ID NO: 146754 - DNA, 25 bp, Rattus norvegicus
aggctcggagtctgccgtcaccgac

SEQ ID NO: 146755 - DNA, 25 bp, Rattus norvegicus
aggctcggcagcatgcctctgtaac

SEQ ID NO: 146756 - DNA, 25 bp, Rattus norvegicus
aggctcggcagcttgcctctgtaac

SEQ ID NO: 146757 - DNA, 25 bp, Rattus norvegicus
aggctcggcgacatcggacagtgaa

SEQ ID NO: 146758 - DNA, 25 bp, Rattus norvegicus
aggctcggcgacttcggacagtgaa

SEQ ID NO: 146759 - DNA, 25 bp, Rattus norvegicus
aggctcggtggaaggaacatcctac

SEQ ID NO: 146760 - DNA, 25 bp, Rattus norvegicus
aggctcggtggatggaacatcctac

SEQ ID NO: 146761 - DNA, 25 bp, Rattus norvegicus
aggctcggtgtcaaaattcttgatc

SEQ ID NO: 146762 - DNA, 25 bp, Rattus norvegicus
aggctcggtgtctaaattcttgatc

SEQ ID NO: 146763 - DNA, 25 bp, Rattus norvegicus
aggctctaaaggctgtttgctctgt

SEQ ID NO: 146764 - DNA, 25 bp, Rattus norvegicus
aggctctaaagggtgtttgctctgt

SEQ ID NO: 146765 - DNA, 25 bp, Rattus norvegicus
aggctctaaattcgctttcctcggg

SEQ ID NO: 146766 - DNA, 25 bp, Rattus norvegicus
aggctctaaattggctttcctcggg

SEQ ID NO: 146767 - DNA, 25 bp, Rattus norvegicus
aggctctaaggcactgctttgctag

SEQ ID NO: 146768 - DNA, 25 bp, Rattus norvegicus
aggctctaaggctctgctttgctag

SEQ ID NO: 146769 - DNA, 25 bp, Rattus norvegicus
aggctctaccagctcattccgaaag

SEQ ID NO: 146770 - DNA, 25 bp, Rattus norvegicus
aggctctaccaggtcattccgaaag

SEQ ID NO: 146771 - DNA, 25 bp, Rattus norvegicus
aggctctaccccattggtagctctt

SEQ ID NO: 146772 - DNA, 25 bp, Rattus norvegicus
aggctctacccctttggtagctctt

SEQ ID NO: 146773 - DNA, 25 bp, Rattus norvegicus
aggctctaccctcttggtagctttg

SEQ ID NO: 146774 - DNA, 25 bp, Rattus norvegicus
aggctctaccctgttggtagctttg

SEQ ID NO: 146775 - DNA, 25 bp, Rattus norvegicus
aggctctactggactgcagcacaga

SEQ ID NO: 146776 - DNA, 25 bp, Rattus norvegicus
aggctctactggtctgcagcacaga

SEQ ID NO: 146777 - DNA, 25 bp, Rattus norvegicus
aggctctagaacacatgcaccagtg

SEQ ID NO: 146778 - DNA, 25 bp, Rattus norvegicus
aggctctagaactcatgcaccagtg

SEQ ID NO: 146779 - DNA, 25 bp, Rattus norvegicus
aggctctagcccctgaattaaagag

SEQ ID NO: 146780 - DNA, 25 bp, Rattus norvegicus
aggctctagcccgtgaattaaagag

SEQ ID NO: 146781 - DNA, 25 bp, Rattus norvegicus
aggctctagctacaggctcttacat

SEQ ID NO: 146782 - DNA, 25 bp, Rattus norvegicus
aggctctagctactcagctttagca

SEQ ID NO: 146783 - DNA, 25 bp, Rattus norvegicus
aggctctagctagaggctcttacat

SEQ ID NO: 146784 - DNA, 25 bp, Rattus norvegicus
aggctctagctagtcagctttagca

SEQ ID NO: 146785 - DNA, 25 bp, Rattus norvegicus
aggctctattctaacccaaggacca

SEQ ID NO: 146786 - DNA, 25 bp, Rattus norvegicus
aggctctattcttacccaaggacca

SEQ ID NO: 146787 - DNA, 25 bp, Rattus norvegicus
aggctctcaccgaggcagacaattg

SEQ ID NO: 146788 - DNA, 25 bp, Rattus norvegicus
aggctctcaccgtggcagacaattg

SEQ ID NO: 146789 - DNA, 25 bp, Rattus norvegicus
aggctctcactgactggaacccatt

SEQ ID NO: 146790 - DNA, 25 bp, Rattus norvegicus
aggctctcactgtctggaacccatt

SEQ ID NO: 146791 - DNA, 25 bp, Rattus norvegicus
aggctctcagacactcatgtgcagg

SEQ ID NO: 146792 - DNA, 25 bp, Rattus norvegicus
aggctctcagactctcatgtgcagg

SEQ ID NO: 146793 - DNA, 25 bp, Rattus norvegicus
aggctctcatctcgccaggatgtca

SEQ ID NO: 146794 - DNA, 25 bp, Rattus norvegicus
aggctctcatctggccaggatgtca

SEQ ID NO: 146795 - DNA, 25 bp, Rattus norvegicus
aggctctccaggattgtgtaagtct

SEQ ID NO: 146796 - DNA, 25 bp, Rattus norvegicus
aggctctccaggtttgtgtaagtct

SEQ ID NO: 146797 - DNA, 25 bp, Rattus norvegicus
aggctctcccaaaattacagttacc

SEQ ID NO: 146798 - DNA, 25 bp, Rattus norvegicus
aggctctcccaatattacagttacc

SEQ ID NO: 146799 - DNA, 25 bp, Rattus norvegicus
aggctctccgagcagcatttgaatg

SEQ ID NO: 146800 - DNA, 25 bp, Rattus norvegicus
aggctctccgaggagcatttgaatg

SEQ ID NO: 146801 - DNA, 25 bp, Rattus norvegicus
aggctctcgctgaatttttactgga

SEQ ID NO: 146802 - DNA, 25 bp, Rattus norvegicus
aggctctcgctgtatttttactgga

SEQ ID NO: 146803 - DNA, 25 bp, Rattus norvegicus
aggctctctaaactctttcgcagaa

SEQ ID NO: 146804 - DNA, 25 bp, Rattus norvegicus
aggctctctaaagtctttcgcagaa

SEQ ID NO: 146805 - DNA, 25 bp, Rattus norvegicus
aggctctctactcggcattagggac

SEQ ID NO: 146806 - DNA, 25 bp, Rattus norvegicus
aggctctctactgggcattagggac

SEQ ID NO: 146807 - DNA, 25 bp, Rattus norvegicus
aggctctctagaagcacgatccaat

SEQ ID NO: 146808 - DNA, 25 bp, Rattus norvegicus
aggctctctagatgcacgatccaat

SEQ ID NO: 146809 - DNA, 25 bp, Rattus norvegicus
aggctctctcataacacaggagtca

SEQ ID NO: 146810 - DNA, 25 bp, Rattus norvegicus
aggctctctcattacacaggagtca

SEQ ID NO: 146811 - DNA, 25 bp, Rattus norvegicus
aggctctctccccagattatgaggg

SEQ ID NO: 146812 - DNA, 25 bp, Rattus norvegicus
aggctctctcccgagattatgaggg

SEQ ID NO: 146813 - DNA, 25 bp, Rattus norvegicus
aggctctctcctatgaacacaaacc

SEQ ID NO: 146814 - DNA, 25 bp, Rattus norvegicus
aggctctctcctatggttgatctgg

SEQ ID NO: 146815 - DNA, 25 bp, Rattus norvegicus
aggctctctcctttgaacacaaacc

SEQ ID NO: 146816 - DNA, 25 bp, Rattus norvegicus
aggctctctcctttggttgatctgg

SEQ ID NO: 146817 - DNA, 25 bp, Rattus norvegicus
aggctctctgtgcttgcactgtgaa

SEQ ID NO: 146818 - DNA, 25 bp, Rattus norvegicus
aggctctctgtggttgcactgtgaa

SEQ ID NO: 146819 - DNA, 25 bp, Rattus norvegicus
aggctctcttcaacgtgagctcaga

SEQ ID NO: 146820 - DNA, 25 bp, Rattus norvegicus
aggctctcttcatcgtgagctcaga

SEQ ID NO: 146821 - DNA, 25 bp, Rattus norvegicus
aggctctcttccctggaaaaccatg

SEQ ID NO: 146822 - DNA, 25 bp, Rattus norvegicus
aggctctcttccgtggaaaaccatg

SEQ ID NO: 146823 - DNA, 25 bp, Rattus norvegicus
aggctctcttgaaaccagtctgggt

SEQ ID NO: 146824 - DNA, 25 bp, Rattus norvegicus
aggctctcttgataccagtctgggt

SEQ ID NO: 146825 - DNA, 25 bp, Rattus norvegicus
aggctctctttactggctgggctgc

SEQ ID NO: 146826 - DNA, 25 bp, Rattus norvegicus
aggctctctttagtggctgggctgc

SEQ ID NO: 146827 - DNA, 25 bp, Rattus norvegicus
aggctctgactacatttccctaata

SEQ ID NO: 146828 - DNA, 25 bp, Rattus norvegicus
aggctctgactaccgaagcatctga

SEQ ID NO: 146829 - DNA, 25 bp, Rattus norvegicus
aggctctgactagatttccctaata

SEQ ID NO: 146830 - DNA, 25 bp, Rattus norvegicus
aggctctgactagcgaagcatctga

SEQ ID NO: 146831 - DNA, 25 bp, Rattus norvegicus
aggctctgacttcgacctgttgaca

SEQ ID NO: 146832 - DNA, 25 bp, Rattus norvegicus
aggctctgacttggacctgttgaca

SEQ ID NO: 146833 - DNA, 25 bp, Rattus norvegicus
aggctctgagctccctggatgaaga

SEQ ID NO: 146834 - DNA, 25 bp, Rattus norvegicus
aggctctgagctgcctggatgaaga

SEQ ID NO: 146835 - DNA, 25 bp, Rattus norvegicus
aggctctgaggcatgccctggaact

SEQ ID NO: 146836 - DNA, 25 bp, Rattus norvegicus
aggctctgaggcttgccctggaact

SEQ ID NO: 146837 - DNA, 25 bp, Rattus norvegicus
aggctctgagtccttgcaggcagta

SEQ ID NO: 146838 - DNA, 25 bp, Rattus norvegicus
aggctctgagtcgttgcaggcagta

SEQ ID NO: 146839 - DNA, 25 bp, Rattus norvegicus
aggctctgcagccactgataaacag

SEQ ID NO: 146840 - DNA, 25 bp, Rattus norvegicus
aggctctgcagcgactgataaacag

SEQ ID NO: 146841 - DNA, 25 bp, Rattus norvegicus
aggctctgccggagttggaccaata

SEQ ID NO: 146842 - DNA, 25 bp, Rattus norvegicus
aggctctgccggtgttggaccaata

SEQ ID NO: 146843 - DNA, 25 bp, Rattus norvegicus
aggctctgcctccaacaaagtggct

SEQ ID NO: 146844 - DNA, 25 bp, Rattus norvegicus
aggctctgcctcgaacaaagtggct

SEQ ID NO: 146845 - DNA, 25 bp, Rattus norvegicus
aggctctgcctgcatctgaatcctg

SEQ ID NO: 146846 - DNA, 25 bp, Rattus norvegicus
aggctctgcctggatctgaatcctg

SEQ ID NO: 146847 - DNA, 25 bp, Rattus norvegicus
aggctctgcgggaagccgaagactt

SEQ ID NO: 146848 - DNA, 25 bp, Rattus norvegicus
aggctctgcgggtagccgaagactt

SEQ ID NO: 146849 - DNA, 25 bp, Rattus norvegicus
aggctctgctcacaactgctgagga

SEQ ID NO: 146850 - DNA, 25 bp, Rattus norvegicus
aggctctgctcagaactgctgagga

SEQ ID NO: 146851 - DNA, 25 bp, Rattus norvegicus
aggctctgctctctgaccacgagag

SEQ ID NO: 146852 - DNA, 25 bp, Rattus norvegicus
aggctctgctctgtgaccacgagag

SEQ ID NO: 146853 - DNA, 25 bp, Rattus norvegicus
aggctctggaagagagcgtctgccc

SEQ ID NO: 146854 - DNA, 25 bp, Rattus norvegicus
aggctctggaagtgagcgtctgccc

SEQ ID NO: 146855 - DNA, 25 bp, Rattus norvegicus
aggctctggctaatctgtctctcat

SEQ ID NO: 146856 - DNA, 25 bp, Rattus norvegicus
aggctctggctattctgtctctcat

SEQ ID NO: 146857 - DNA, 25 bp, Rattus norvegicus
aggctctggctcactaataccaggg

SEQ ID NO: 146858 - DNA, 25 bp, Rattus norvegicus
aggctctggctcagagactgagtaa

SEQ ID NO: 146859 - DNA, 25 bp, Rattus norvegicus
aggctctggctcagcaagaactaga

SEQ ID NO: 146860 - DNA, 25 bp, Rattus norvegicus
aggctctggctctctaataccaggg

SEQ ID NO: 146861 - DNA, 25 bp, Rattus norvegicus
aggctctggctctgagactgagtaa

SEQ ID NO: 146862 - DNA, 25 bp, Rattus norvegicus
aggctctggctctgcaagaactaga

SEQ ID NO: 146863 - DNA, 25 bp, Rattus norvegicus
aggctctggcttacaactcggattc

SEQ ID NO: 146864 - DNA, 25 bp, Rattus norvegicus
aggctctggctttcaactcggattc

SEQ ID NO: 146865 - DNA, 25 bp, Rattus norvegicus
aggctctggtctagtggctgtttac

SEQ ID NO: 146866 - DNA, 25 bp, Rattus norvegicus
aggctctggtcttgtggctgtttac

SEQ ID NO: 146867 - DNA, 25 bp, Rattus norvegicus
aggctctggtgtaatggagctcaca

SEQ ID NO: 146868 - DNA, 25 bp, Rattus norvegicus
aggctctggtgttatggagctcaca

SEQ ID NO: 146869 - DNA, 25 bp, Rattus norvegicus
aggctctggttcatgttctcttttg

SEQ ID NO: 146870 - DNA, 25 bp, Rattus norvegicus
aggctctggttcttgttctcttttg

SEQ ID NO: 146871 - DNA, 25 bp, Rattus norvegicus
aggctctgtatcacaggtagacatt

SEQ ID NO: 146872 - DNA, 25 bp, Rattus norvegicus
aggctctgtatctcaggtagacatt

SEQ ID NO: 146873 - DNA, 25 bp, Rattus norvegicus
aggctctgtcctatacatactggaa

SEQ ID NO: 146874 - DNA, 25 bp, Rattus norvegicus
aggctctgtcctttacatactggaa

SEQ ID NO: 146875 - DNA, 25 bp, Rattus norvegicus
aggctctgtctaactcagttggaga

SEQ ID NO: 146876 - DNA, 25 bp, Rattus norvegicus
aggctctgtctatctcagttggaga

SEQ ID NO: 146877 - DNA, 25 bp, Rattus norvegicus
aggctctgtggcatctctacatctt

SEQ ID NO: 146878 - DNA, 25 bp, Rattus norvegicus
aggctctgtggcttctctacatctt

SEQ ID NO: 146879 - DNA, 25 bp, Rattus norvegicus
aggctctgtgtcaccattctgaata

SEQ ID NO: 146880 - DNA, 25 bp, Rattus norvegicus
aggctctgtgtctccattctgaata

SEQ ID NO: 146881 - DNA, 25 bp, Rattus norvegicus
aggctctgtgtgatcgaggccagcc

SEQ ID NO: 146882 - DNA, 25 bp, Rattus norvegicus
aggctctgtgtgttcgaggccagcc

SEQ ID NO: 146883 - DNA, 25 bp, Rattus norvegicus
aggctctgtttgatactgcatgtgg

SEQ ID NO: 146884 - DNA, 25 bp, Rattus norvegicus
aggctctgtttgttactgcatgtgg

SEQ ID NO: 146885 - DNA, 25 bp, Rattus norvegicus
aggctcttacagcagcatcccaggg

SEQ ID NO: 146886 - DNA, 25 bp, Rattus norvegicus
aggctcttacaggagcatcccaggg

SEQ ID NO: 146887 - DNA, 25 bp, Rattus norvegicus
aggctcttagctactgatcttgtac

SEQ ID NO: 146888 - DNA, 25 bp, Rattus norvegicus
aggctcttagcttctgatcttgtac

SEQ ID NO: 146889 - DNA, 25 bp, Rattus norvegicus
aggctcttaggcatgtggacagctt

SEQ ID NO: 146890 - DNA, 25 bp, Rattus norvegicus
aggctcttaggcttgtggacagctt

SEQ ID NO: 146891 - DNA, 25 bp, Rattus norvegicus
aggctcttcaaaatctctgggctct

SEQ ID NO: 146892 - DNA, 25 bp, Rattus norvegicus
aggctcttcaaattctctgggctct

SEQ ID NO: 146893 - DNA, 25 bp, Rattus norvegicus
aggctcttccaaacaggcagcagtt

SEQ ID NO: 146894 - DNA, 25 bp, Rattus norvegicus
aggctcttccaatcaggcagcagtt

SEQ ID NO: 146895 - DNA, 25 bp, Rattus norvegicus
aggctcttcgagacaagaatgctgt

SEQ ID NO: 146896 - DNA, 25 bp, Rattus norvegicus
aggctcttcgagtcaagaatgctgt

SEQ ID NO: 146897 - DNA, 25 bp, Rattus norvegicus
aggctcttctgacgaaacccgctca

SEQ ID NO: 146898 - DNA, 25 bp, Rattus norvegicus
aggctcttctgaggaaacccgctca

SEQ ID NO: 146899 - DNA, 25 bp, Rattus norvegicus
aggctcttgaagacttgggaccgat

SEQ ID NO: 146900 - DNA, 25 bp, Rattus norvegicus
aggctcttgaagtcttgggaccgat

SEQ ID NO: 146901 - DNA, 25 bp, Rattus norvegicus
aggctcttgaggagactctactgtc

SEQ ID NO: 146902 - DNA, 25 bp, Rattus norvegicus
aggctcttgaggtgactctactgtc

SEQ ID NO: 146903 - DNA, 25 bp, Rattus norvegicus
aggctcttgcctcggtgtggcaaaa

SEQ ID NO: 146904 - DNA, 25 bp, Rattus norvegicus
aggctcttgcctgggtgtggcaaaa

SEQ ID NO: 146905 - DNA, 25 bp, Rattus norvegicus
aggctcttgggcagttaggaacatt

SEQ ID NO: 146906 - DNA, 25 bp, Rattus norvegicus
aggctcttgggctgttaggaacatt

SEQ ID NO: 146907 - DNA, 25 bp, Rattus norvegicus
aggctcttggtgactcgttcaagaa

SEQ ID NO: 146908 - DNA, 25 bp, Rattus norvegicus
aggctcttggtgtctcgttcaagaa

SEQ ID NO: 146909 - DNA, 25 bp, Rattus norvegicus
aggctcttgtcaaaggctccttgca

SEQ ID NO: 146910 - DNA, 25 bp, Rattus norvegicus
aggctcttgtcaccgagctggaaaa

SEQ ID NO: 146911 - DNA, 25 bp, Rattus norvegicus
aggctcttgtcagcgagctggaaaa

SEQ ID NO: 146912 - DNA, 25 bp, Rattus norvegicus
aggctcttgtcataggctccttgca

SEQ ID NO: 146913 - DNA, 25 bp, Rattus norvegicus
aggctcttgtccataagatactccc

SEQ ID NO: 146914 - DNA, 25 bp, Rattus norvegicus
aggctcttgtccttaagatactccc

SEQ ID NO: 146915 - DNA, 25 bp, Rattus norvegicus
aggctcttgttcaggcctgtcagct

SEQ ID NO: 146916 - DNA, 25 bp, Rattus norvegicus
aggctcttgttctggcctgtcagct

SEQ ID NO: 146917 - DNA, 25 bp, Rattus norvegicus
aggctctttagacaggaacttccaa

SEQ ID NO: 146918 - DNA, 25 bp, Rattus norvegicus
aggctctttagagaggaacttccaa

SEQ ID NO: 146919 - DNA, 25 bp, Rattus norvegicus
aggctctttggcaaatctcatactt

SEQ ID NO: 146920 - DNA, 25 bp, Rattus norvegicus
aggctctttggccgccgccacgaga

SEQ ID NO: 146921 - DNA, 25 bp, Rattus norvegicus
aggctctttggcggccgccacgaga

SEQ ID NO: 146922 - DNA, 25 bp, Rattus norvegicus
aggctctttggctaatctcatactt

SEQ ID NO: 146923 - DNA, 25 bp, Rattus norvegicus
aggctgaaagccatagttcccacag

SEQ ID NO: 146924 - DNA, 25 bp, Rattus norvegicus
aggctgaaagccttagttcccacag

SEQ ID NO: 146925 - DNA, 25 bp, Rattus norvegicus
aggctgaaagtgatctctggaatct

SEQ ID NO: 146926 - DNA, 25 bp, Rattus norvegicus
aggctgaaagtgttctctggaatct

SEQ ID NO: 146927 - DNA, 25 bp, Rattus norvegicus
aggctgaaatgcatgatgacctcat

SEQ ID NO: 146928 - DNA, 25 bp, Rattus norvegicus
aggctgaaatgcttgatgacctcat

SEQ ID NO: 146929 - DNA, 25 bp, Rattus norvegicus
aggctgaacactaccactttgatta

SEQ ID NO: 146930 - DNA, 25 bp, Rattus norvegicus
aggctgaacacttccactttgatta

SEQ ID NO: 146931 - DNA, 25 bp, Rattus norvegicus
aggctgaacagtcaagagcactgac

SEQ ID NO: 146932 - DNA, 25 bp, Rattus norvegicus
aggctgaacagtgaagagcactgac

SEQ ID NO: 146933 - DNA, 25 bp, Rattus norvegicus
aggctgaagagtcgttcacacccca

SEQ ID NO: 146934 - DNA, 25 bp, Rattus norvegicus
aggctgaagagtggttcacacccca

SEQ ID NO: 146935 - DNA, 25 bp, Rattus norvegicus
aggctgacaaggctcttcttgcagc

SEQ ID NO: 146936 - DNA, 25 bp, Rattus norvegicus
aggctgacaagggtcttcttgcagc

SEQ ID NO: 146937 - DNA, 25 bp, Rattus norvegicus
aggctgacagtgactaaggatgctt

SEQ ID NO: 146938 - DNA, 25 bp, Rattus norvegicus
aggctgacagtgtctaaggatgctt

SEQ ID NO: 146939 - DNA, 25 bp, Rattus norvegicus
aggctgacatgcctgtggccgacat

SEQ ID NO: 146940 - DNA, 25 bp, Rattus norvegicus
aggctgacatgcgtgtggccgacat

SEQ ID NO: 146941 - DNA, 25 bp, Rattus norvegicus
aggctgacattaatgcaccgacctc

SEQ ID NO: 146942 - DNA, 25 bp, Rattus norvegicus
aggctgacattattgcaccgacctc

SEQ ID NO: 146943 - DNA, 25 bp, Rattus norvegicus
aggctgaccacaatgagattctttt

SEQ ID NO: 146944 - DNA, 25 bp, Rattus norvegicus
aggctgaccacattgagattctttt

SEQ ID NO: 146945 - DNA, 25 bp, Rattus norvegicus
aggctgaccttgactgttcttcctt

SEQ ID NO: 146946 - DNA, 25 bp, Rattus norvegicus
aggctgaccttgtctgttcttcctt

SEQ ID NO: 146947 - DNA, 25 bp, Rattus norvegicus
aggctgacgcccaagaagctggaca

SEQ ID NO: 146948 - DNA, 25 bp, Rattus norvegicus
aggctgacgccctagaagctggaca

SEQ ID NO: 146949 - DNA, 25 bp, Rattus norvegicus
aggctgacgtggacttctcgccaag

SEQ ID NO: 146950 - DNA, 25 bp, Rattus norvegicus
aggctgacgtggtcttctcgccaag

SEQ ID NO: 146951 - DNA, 25 bp, Rattus norvegicus
aggctgactgcaaacatgatctgtg

SEQ ID NO: 146952 - DNA, 25 bp, Rattus norvegicus
aggctgactgcatacatgatctgtg

SEQ ID NO: 146953 - DNA, 25 bp, Rattus norvegicus
aggctgactgtcactaagtttatgg

SEQ ID NO: 146954 - DNA, 25 bp, Rattus norvegicus
aggctgactgtctctaagtttatgg

SEQ ID NO: 146955 - DNA, 25 bp, Rattus norvegicus
aggctgactgtgaggcctcctatcc

SEQ ID NO: 146956 - DNA, 25 bp, Rattus norvegicus
aggctgactgtgtggcctcctatcc

SEQ ID NO: 146957 - DNA, 25 bp, Rattus norvegicus
aggctgacttggatctggcctggcc

SEQ ID NO: 146958 - DNA, 25 bp, Rattus norvegicus
aggctgacttggttctggcctggcc

SEQ ID NO: 146959 - DNA, 25 bp, Rattus norvegicus
aggctgagaagccatcctaccatcc

SEQ ID NO: 146960 - DNA, 25 bp, Rattus norvegicus
aggctgagaagcgatcctaccatcc

SEQ ID NO: 146961 - DNA, 25 bp, Rattus norvegicus
aggctgagaatgaggctgctgaaac

SEQ ID NO: 146962 - DNA, 25 bp, Rattus norvegicus
aggctgagaatgtggctgctgaaac

SEQ ID NO: 146963 - DNA, 25 bp, Rattus norvegicus
aggctgagaattagttcccctccaa

SEQ ID NO: 146964 - DNA, 25 bp, Rattus norvegicus
aggctgagaatttgttcccctccaa

SEQ ID NO: 146965 - DNA, 25 bp, Rattus norvegicus
aggctgagcctcctaaacaccagaa

SEQ ID NO: 146966 - DNA, 25 bp, Rattus norvegicus
aggctgagcctcgtaaacaccagaa

SEQ ID NO: 146967 - DNA, 25 bp, Rattus norvegicus
aggctgagctggactacctcatgga

SEQ ID NO: 146968 - DNA, 25 bp, Rattus norvegicus
aggctgagctggatctacgacccca

SEQ ID NO: 146969 - DNA, 25 bp, Rattus norvegicus
aggctgagctggtctacctcatgga

SEQ ID NO: 146970 - DNA, 25 bp, Rattus norvegicus
aggctgagctggttctacgacccca

SEQ ID NO: 146971 - DNA, 25 bp, Rattus norvegicus
aggctgagctgtatgctgtgtagta

SEQ ID NO: 146972 - DNA, 25 bp, Rattus norvegicus
aggctgagctgtttgctgtgtagta

SEQ ID NO: 146973 - DNA, 25 bp, Rattus norvegicus
aggctgagcttaccccatcgacagc

SEQ ID NO: 146974 - DNA, 25 bp, Rattus norvegicus
aggctgagcttagcccatcgacagc

SEQ ID NO: 146975 - DNA, 25 bp, Rattus norvegicus
aggctgaggaccatctccctcagat

SEQ ID NO: 146976 - DNA, 25 bp, Rattus norvegicus
aggctgaggaccttctccctcagat

SEQ ID NO: 146977 - DNA, 25 bp, Rattus norvegicus
aggctgaggaggacatggatccata

SEQ ID NO: 146978 - DNA, 25 bp, Rattus norvegicus
aggctgaggaggtcatggatccata

SEQ ID NO: 146979 - DNA, 25 bp, Rattus norvegicus
aggctgagggctcgactctgcactc

SEQ ID NO: 146980 - DNA, 25 bp, Rattus norvegicus
aggctgagggctggactctgcactc

SEQ ID NO: 146981 - DNA, 25 bp, Rattus norvegicus
aggctgagggtcatgaactccaatc

SEQ ID NO: 146982 - DNA, 25 bp, Rattus norvegicus
aggctgagggtcttgaactccaatc

SEQ ID NO: 146983 - DNA, 25 bp, Rattus norvegicus
aggctgaggtgaccgcgtcctccat

SEQ ID NO: 146984 - DNA, 25 bp, Rattus norvegicus
aggctgaggtgagcgcgtcctccat

SEQ ID NO: 146985 - DNA, 25 bp, Rattus norvegicus
aggctgaggttgcttctccgttcac

SEQ ID NO: 146986 - DNA, 25 bp, Rattus norvegicus
aggctgaggttggttctccgttcac

SEQ ID NO: 146987 - DNA, 25 bp, Rattus norvegicus
aggctgagtactacgtggctgccgt

SEQ ID NO: 146988 - DNA, 25 bp, Rattus norvegicus
aggctgagtactccatccgtcggat

SEQ ID NO: 146989 - DNA, 25 bp, Rattus norvegicus
aggctgagtactgcatccgtcggat

SEQ ID NO: 146990 - DNA, 25 bp, Rattus norvegicus
aggctgagtacttcgtggctgccgt

SEQ ID NO: 146991 - DNA, 25 bp, Rattus norvegicus
aggctgagtcatacttccagatgcc

SEQ ID NO: 146992 - DNA, 25 bp, Rattus norvegicus
aggctgagtcattcttccagatgcc

SEQ ID NO: 146993 - DNA, 25 bp, Rattus norvegicus
aggctgatgctgactttctggtctc

SEQ ID NO: 146994 - DNA, 25 bp, Rattus norvegicus
aggctgatgctgtctttctggtctc

SEQ ID NO: 146995 - DNA, 25 bp, Rattus norvegicus
aggctgattggcagcattaccctgc

SEQ ID NO: 146996 - DNA, 25 bp, Rattus norvegicus
aggctgattggctgcattaccctgc

SEQ ID NO: 146997 - DNA, 25 bp, Rattus norvegicus
aggctgcaatttcacagagagttgt

SEQ ID NO: 146998 - DNA, 25 bp, Rattus norvegicus
aggctgcaatttcctctttgcattt

SEQ ID NO: 146999 - DNA, 25 bp, Rattus norvegicus
aggctgcaatttgacagagagttgt

SEQ ID NO: 147000 - DNA, 25 bp, Rattus norvegicus
aggctgcaatttgctctttgcattt

SEQ ID NO: 147001 - DNA, 25 bp, Rattus norvegicus
aggctgcacaggacgattgttcatt

SEQ ID NO: 147002 - DNA, 25 bp, Rattus norvegicus
aggctgcacaggtcgattgttcatt

SEQ ID NO: 147003 - DNA, 25 bp, Rattus norvegicus
aggctgcacctgactagtcacaggt

SEQ ID NO: 147004 - DNA, 25 bp, Rattus norvegicus
aggctgcacctgtctagtcacaggt

SEQ ID NO: 147005 - DNA, 25 bp, Rattus norvegicus
aggctgcacgtacctgctctaactt

SEQ ID NO: 147006 - DNA, 25 bp, Rattus norvegicus
aggctgcacgtagctgctctaactt

SEQ ID NO: 147007 - DNA, 25 bp, Rattus norvegicus
aggctgcagattacccagttaaggt

SEQ ID NO: 147008 - DNA, 25 bp, Rattus norvegicus
aggctgcagatttcccagttaaggt

SEQ ID NO: 147009 - DNA, 25 bp, Rattus norvegicus
aggctgcagcccagtataaggtctc

SEQ ID NO: 147010 - DNA, 25 bp, Rattus norvegicus
aggctgcagccctgtataaggtctc

SEQ ID NO: 147011 - DNA, 25 bp, Rattus norvegicus
aggctgcaggagactttggccacta

SEQ ID NO: 147012 - DNA, 25 bp, Rattus norvegicus
aggctgcaggagtctttggccacta

SEQ ID NO: 147013 - DNA, 25 bp, Rattus norvegicus
aggctgcagtgacagttgcccatac

SEQ ID NO: 147014 - DNA, 25 bp, Rattus norvegicus
aggctgcagtgagagttgcccatac

SEQ ID NO: 147015 - DNA, 25 bp, Rattus norvegicus
aggctgcatagcagagttccatctc

SEQ ID NO: 147016 - DNA, 25 bp, Rattus norvegicus
aggctgcatagctgagttccatctc

SEQ ID NO: 147017 - DNA, 25 bp, Rattus norvegicus
aggctgcatgcccagacagtgttac

SEQ ID NO: 147018 - DNA, 25 bp, Rattus norvegicus
aggctgcatgccgagacagtgttac

SEQ ID NO: 147019 - DNA, 25 bp, Rattus norvegicus
aggctgcattccagctcatgggagc

SEQ ID NO: 147020 - DNA, 25 bp, Rattus norvegicus
aggctgcattcctgctcatgggagc

SEQ ID NO: 147021 - DNA, 25 bp, Rattus norvegicus
aggctgccaaacactaccgtgaact

SEQ ID NO: 147022 - DNA, 25 bp, Rattus norvegicus
aggctgccaaactctaccgtgaact

SEQ ID NO: 147023 - DNA, 25 bp, Rattus norvegicus
aggctgccacccagtgtggaagaag

SEQ ID NO: 147024 - DNA, 25 bp, Rattus norvegicus
aggctgccaccctgtgtggaagaag

SEQ ID NO: 147025 - DNA, 25 bp, Rattus norvegicus
aggctgccacgcagagacaggactg

SEQ ID NO: 147026 - DNA, 25 bp, Rattus norvegicus
aggctgccacgctgagacaggactg

SEQ ID NO: 147027 - DNA, 25 bp, Rattus norvegicus
aggctgccagcaaaggtcaccatga

SEQ ID NO: 147028 - DNA, 25 bp, Rattus norvegicus
aggctgccagcaatggactctcgtt

SEQ ID NO: 147029 - DNA, 25 bp, Rattus norvegicus
aggctgccagcataggtcaccatga

SEQ ID NO: 147030 - DNA, 25 bp, Rattus norvegicus
aggctgccagcattggactctcgtt

SEQ ID NO: 147031 - DNA, 25 bp, Rattus norvegicus
aggctgccagccacatcaagggtgt

SEQ ID NO: 147032 - DNA, 25 bp, Rattus norvegicus
aggctgccagcctcatcaagggtgt

SEQ ID NO: 147033 - DNA, 25 bp, Rattus norvegicus
aggctgcccactcaaactagaatta

SEQ ID NO: 147034 - DNA, 25 bp, Rattus norvegicus
aggctgcccactgaaactagaatta

SEQ ID NO: 147035 - DNA, 25 bp, Rattus norvegicus
aggctgcccagcctctcagtgagga

SEQ ID NO: 147036 - DNA, 25 bp, Rattus norvegicus
aggctgcccagcgtctcagtgagga

SEQ ID NO: 147037 - DNA, 25 bp, Rattus norvegicus
aggctgcccatgattctgccagtgt

SEQ ID NO: 147038 - DNA, 25 bp, Rattus norvegicus
aggctgcccatgtttctgccagtgt

SEQ ID NO: 147039 - DNA, 25 bp, Rattus norvegicus
aggctgcccctacaggttatttctc

SEQ ID NO: 147040 - DNA, 25 bp, Rattus norvegicus
aggctgcccctacttagagacaaaa

SEQ ID NO: 147041 - DNA, 25 bp, Rattus norvegicus
aggctgcccctagaggttatttctc

SEQ ID NO: 147042 - DNA, 25 bp, Rattus norvegicus
aggctgcccctagttagagacaaaa

SEQ ID NO: 147043 - DNA, 25 bp, Rattus norvegicus
aggctgcccgtaattgtgccaacaa

SEQ ID NO: 147044 - DNA, 25 bp, Rattus norvegicus
aggctgcccgtatttgtgccaacaa

SEQ ID NO: 147045 - DNA, 25 bp, Rattus norvegicus
aggctgcccttaatgcttatatatg

SEQ ID NO: 147046 - DNA, 25 bp, Rattus norvegicus
aggctgcccttattgcttatatatg

SEQ ID NO: 147047 - DNA, 25 bp, Rattus norvegicus
aggctgccgaaaacacaaaactcaa

SEQ ID NO: 147048 - DNA, 25 bp, Rattus norvegicus
aggctgccgaaatcacaaaactcaa

SEQ ID NO: 147049 - DNA, 25 bp, Rattus norvegicus
aggctgccgactacgccgagcagtt

SEQ ID NO: 147050 - DNA, 25 bp, Rattus norvegicus
aggctgccgacttcgccgagcagtt

SEQ ID NO: 147051 - DNA, 25 bp, Rattus norvegicus
aggctgcctacaactcattctgttg

SEQ ID NO: 147052 - DNA, 25 bp, Rattus norvegicus
aggctgcctacactcttttcctttt

SEQ ID NO: 147053 - DNA, 25 bp, Rattus norvegicus
aggctgcctacagtcttttcctttt

SEQ ID NO: 147054 - DNA, 25 bp, Rattus norvegicus
aggctgcctacatctcattctgttg

SEQ ID NO: 147055 - DNA, 25 bp, Rattus norvegicus
aggctgcctcaaactctcgattttc

SEQ ID NO: 147056 - DNA, 25 bp, Rattus norvegicus
aggctgcctcaatctctcgattttc

SEQ ID NO: 147057 - DNA, 25 bp, Rattus norvegicus
aggctgcctcagattatcatggagt

SEQ ID NO: 147058 - DNA, 25 bp, Rattus norvegicus
aggctgcctcagtttatcatggagt

SEQ ID NO: 147059 - DNA, 25 bp, Rattus norvegicus
aggctgcctcttctcagtcaggcct

SEQ ID NO: 147060 - DNA, 25 bp, Rattus norvegicus
aggctgcctcttgtcagtcaggcct

SEQ ID NO: 147061 - DNA, 25 bp, Rattus norvegicus
aggctgcctgaactagcagcggcaa

SEQ ID NO: 147062 - DNA, 25 bp, Rattus norvegicus
aggctgcctgaagtagcagcggcaa

SEQ ID NO: 147063 - DNA, 25 bp, Rattus norvegicus
aggctgcctgatcggacttcactga

SEQ ID NO: 147064 - DNA, 25 bp, Rattus norvegicus
aggctgcctgatgggacttcactga

SEQ ID NO: 147065 - DNA, 25 bp, Rattus norvegicus
aggctgcctgcactctgtctattaa

SEQ ID NO: 147066 - DNA, 25 bp, Rattus norvegicus
aggctgcctgcagtctgtctattaa

SEQ ID NO: 147067 - DNA, 25 bp, Rattus norvegicus
aggctgcctgtgaaagggtgtctct

SEQ ID NO: 147068 - DNA, 25 bp, Rattus norvegicus
aggctgcctgtgtaagggtgtctct

SEQ ID NO: 147069 - DNA, 25 bp, Rattus norvegicus
aggctgccttccagagggtcatctc

SEQ ID NO: 147070 - DNA, 25 bp, Rattus norvegicus
aggctgccttcctgagggtcatctc

SEQ ID NO: 147071 - DNA, 25 bp, Rattus norvegicus
aggctgccttgacttcagagctcca

SEQ ID NO: 147072 - DNA, 25 bp, Rattus norvegicus
aggctgccttgagttcagagctcca

SEQ ID NO: 147073 - DNA, 25 bp, Rattus norvegicus
aggctgccttgcacgatgtagactt

SEQ ID NO: 147074 - DNA, 25 bp, Rattus norvegicus
aggctgccttgctcgatgtagactt

SEQ ID NO: 147075 - DNA, 25 bp, Rattus norvegicus
aggctgccttggactcacagagttc

SEQ ID NO: 147076 - DNA, 25 bp, Rattus norvegicus
aggctgccttggtctcacagagttc

SEQ ID NO: 147077 - DNA, 25 bp, Rattus norvegicus
aggctgcctttcaactttcaaataa

SEQ ID NO: 147078 - DNA, 25 bp, Rattus norvegicus
aggctgcctttctactttcaaataa

SEQ ID NO: 147079 - DNA, 25 bp, Rattus norvegicus
aggctgcctttgcagggacaccaat

SEQ ID NO: 147080 - DNA, 25 bp, Rattus norvegicus
aggctgcctttggagggacaccaat

SEQ ID NO: 147081 - DNA, 25 bp, Rattus norvegicus
aggctgccttttctcgctataagaa

SEQ ID NO: 147082 - DNA, 25 bp, Rattus norvegicus
aggctgccttttgtcgctataagaa

SEQ ID NO: 147083 - DNA, 25 bp, Rattus norvegicus
aggctgcgatccaatggtagcaatt

SEQ ID NO: 147084 - DNA, 25 bp, Rattus norvegicus
aggctgcgatcctatggtagcaatt

SEQ ID NO: 147085 - DNA, 25 bp, Rattus norvegicus
aggctgcgcagaagtgtgtacccac

SEQ ID NO: 147086 - DNA, 25 bp, Rattus norvegicus
aggctgcgcagatgtgtgtacccac

SEQ ID NO: 147087 - DNA, 25 bp, Rattus norvegicus
aggctgcgcctgcagctgagtacaa

SEQ ID NO: 147088 - DNA, 25 bp, Rattus norvegicus
aggctgcgcctggagctgagtacaa

SEQ ID NO: 147089 - DNA, 25 bp, Rattus norvegicus
aggctgcggagaagatgtcgacttt

SEQ ID NO: 147090 - DNA, 25 bp, Rattus norvegicus
aggctgcggagatgatgtcgacttt

SEQ ID NO: 147091 - DNA, 25 bp, Rattus norvegicus
aggctgcgtcttagacgccctgaat

SEQ ID NO: 147092 - DNA, 25 bp, Rattus norvegicus
aggctgcgtctttgacgccctgaat

SEQ ID NO: 147093 - DNA, 25 bp, Rattus norvegicus
aggctgctaatgattctgttcacgt

SEQ ID NO: 147094 - DNA, 25 bp, Rattus norvegicus
aggctgctaatgtttctgttcacgt

SEQ ID NO: 147095 - DNA, 25 bp, Rattus norvegicus
aggctgctacccattgtacctagct

SEQ ID NO: 147096 - DNA, 25 bp, Rattus norvegicus
aggctgctaccctttgtacctagct

SEQ ID NO: 147097 - DNA, 25 bp, Rattus norvegicus
aggctgctacgtaggcactggatta

SEQ ID NO: 147098 - DNA, 25 bp, Rattus norvegicus
aggctgctacgttggcactggatta

SEQ ID NO: 147099 - DNA, 25 bp, Rattus norvegicus
aggctgctatatatagtcgggttac

SEQ ID NO: 147100 - DNA, 25 bp, Rattus norvegicus
aggctgctatatttagtcgggttac

SEQ ID NO: 147101 - DNA, 25 bp, Rattus norvegicus
aggctgctattcacagggaccttag

SEQ ID NO: 147102 - DNA, 25 bp, Rattus norvegicus
aggctgctattctcagggaccttag

SEQ ID NO: 147103 - DNA, 25 bp, Rattus norvegicus
aggctgctcagaatcccctggagtg

SEQ ID NO: 147104 - DNA, 25 bp, Rattus norvegicus
aggctgctcagattcccctggagtg

SEQ ID NO: 147105 - DNA, 25 bp, Rattus norvegicus
aggctgctcctcagtaacgcttctt

SEQ ID NO: 147106 - DNA, 25 bp, Rattus norvegicus
aggctgctcctctgtaacgcttctt

SEQ ID NO: 147107 - DNA, 25 bp, Rattus norvegicus
aggctgctcctgcaagctctaattt

SEQ ID NO: 147108 - DNA, 25 bp, Rattus norvegicus
aggctgctcctggaagctctaattt

SEQ ID NO: 147109 - DNA, 25 bp, Rattus norvegicus
aggctgctctctagagccatttgtt

SEQ ID NO: 147110 - DNA, 25 bp, Rattus norvegicus
aggctgctctcttgagccatttgtt

SEQ ID NO: 147111 - DNA, 25 bp, Rattus norvegicus
aggctgctctgtatgggcaccctaa

SEQ ID NO: 147112 - DNA, 25 bp, Rattus norvegicus
aggctgctctgtttgggcaccctaa

SEQ ID NO: 147113 - DNA, 25 bp, Rattus norvegicus
aggctgctgaggcagtcaacttaat

SEQ ID NO: 147114 - DNA, 25 bp, Rattus norvegicus
aggctgctgagggagtcaacttaat

SEQ ID NO: 147115 - DNA, 25 bp, Rattus norvegicus
aggctgctgatcattcctgggagca

SEQ ID NO: 147116 - DNA, 25 bp, Rattus norvegicus
aggctgctgatctttcctgggagca

SEQ ID NO: 147117 - DNA, 25 bp, Rattus norvegicus
aggctgctgccactcaagagcacag

SEQ ID NO: 147118 - DNA, 25 bp, Rattus norvegicus
aggctgctgccagtcaagagcacag

SEQ ID NO: 147119 - DNA, 25 bp, Rattus norvegicus
aggctgctgctgacgtgacatttga

SEQ ID NO: 147120 - DNA, 25 bp, Rattus norvegicus
aggctgctgctgtcgtgacatttga

SEQ ID NO: 147121 - DNA, 25 bp, Rattus norvegicus
aggctgctggagatacaggacgcca

SEQ ID NO: 147122 - DNA, 25 bp, Rattus norvegicus
aggctgctggagttacaggacgcca

SEQ ID NO: 147123 - DNA, 25 bp, Rattus norvegicus
aggctgctggatctattccttgaga

SEQ ID NO: 147124 - DNA, 25 bp, Rattus norvegicus
aggctgctggatgtattccttgaga

SEQ ID NO: 147125 - DNA, 25 bp, Rattus norvegicus
aggctgctggctaggctccaaagaa

SEQ ID NO: 147126 - DNA, 25 bp, Rattus norvegicus
aggctgctggcttggctccaaagaa

SEQ ID NO: 147127 - DNA, 25 bp, Rattus norvegicus
aggctgctgggcagtcaccatgcat

SEQ ID NO: 147128 - DNA, 25 bp, Rattus norvegicus
aggctgctgggctgtcaccatgcat

SEQ ID NO: 147129 - DNA, 25 bp, Rattus norvegicus
aggctgctgtaaccgtggacccctt

SEQ ID NO: 147130 - DNA, 25 bp, Rattus norvegicus
aggctgctgtaagcgtggacccctt

SEQ ID NO: 147131 - DNA, 25 bp, Rattus norvegicus
aggctgctgtgacctcctgtaggca

SEQ ID NO: 147132 - DNA, 25 bp, Rattus norvegicus
aggctgctgtgagctcctgtaggca

SEQ ID NO: 147133 - DNA, 25 bp, Rattus norvegicus
aggctgcttagtacccttagctttt

SEQ ID NO: 147134 - DNA, 25 bp, Rattus norvegicus
aggctgcttagttcccttagctttt

SEQ ID NO: 147135 - DNA, 25 bp, Rattus norvegicus
aggctgcttcccacaagagtaacta

SEQ ID NO: 147136 - DNA, 25 bp, Rattus norvegicus
aggctgcttccctcaagagtaacta

SEQ ID NO: 147137 - DNA, 25 bp, Rattus norvegicus
aggctgcttcctagtaggcactgta

SEQ ID NO: 147138 - DNA, 25 bp, Rattus norvegicus
aggctgcttccttgtaggcactgta

SEQ ID NO: 147139 - DNA, 25 bp, Rattus norvegicus
aggctgcttcttacgttttcaaata

SEQ ID NO: 147140 - DNA, 25 bp, Rattus norvegicus
aggctgcttctttcgttttcaaata

SEQ ID NO: 147141 - DNA, 25 bp, Rattus norvegicus
aggctgcttggaaggcatggcacct

SEQ ID NO: 147142 - DNA, 25 bp, Rattus norvegicus
aggctgcttggatggcatggcacct

SEQ ID NO: 147143 - DNA, 25 bp, Rattus norvegicus
aggctgcttgggaactcttttaggt

SEQ ID NO: 147144 - DNA, 25 bp, Rattus norvegicus
aggctgcttgggtactcttttaggt

SEQ ID NO: 147145 - DNA, 25 bp, Rattus norvegicus
aggctgcttggtaaccttttggtgc

SEQ ID NO: 147146 - DNA, 25 bp, Rattus norvegicus
aggctgcttggttaccttttggtgc

SEQ ID NO: 147147 - DNA, 25 bp, Rattus norvegicus
aggctggaacttaggttcccttctg

SEQ ID NO: 147148 - DNA, 25 bp, Rattus norvegicus
aggctggaactttggttcccttctg

SEQ ID NO: 147149 - DNA, 25 bp, Rattus norvegicus
aggctggaagcaatcgttttcctaa

SEQ ID NO: 147150 - DNA, 25 bp, Rattus norvegicus
aggctggaagcattcgttttcctaa

SEQ ID NO: 147151 - DNA, 25 bp, Rattus norvegicus
aggctggaagcgaagtgtagaactc

SEQ ID NO: 147152 - DNA, 25 bp, Rattus norvegicus
aggctggaagcgtagtgtagaactc

SEQ ID NO: 147153 - DNA, 25 bp, Rattus norvegicus
aggctggaagctcctgggtttcatc

SEQ ID NO: 147154 - DNA, 25 bp, Rattus norvegicus
aggctggaagctgctgggtttcatc

SEQ ID NO: 147155 - DNA, 25 bp, Rattus norvegicus
aggctggaataacgactcctctcct

SEQ ID NO: 147156 - DNA, 25 bp, Rattus norvegicus
aggctggaataaggactcctctcct

SEQ ID NO: 147157 - DNA, 25 bp, Rattus norvegicus
aggctggacagcctacaccggagtc

SEQ ID NO: 147158 - DNA, 25 bp, Rattus norvegicus
aggctggacagcgtacaccggagtc

SEQ ID NO: 147159 - DNA, 25 bp, Rattus norvegicus
aggctggacaggcttatctacacag

SEQ ID NO: 147160 - DNA, 25 bp, Rattus norvegicus
aggctggacagggttatctacacag

SEQ ID NO: 147161 - DNA, 25 bp, Rattus norvegicus
aggctggaccctcaatagtgctggt

SEQ ID NO: 147162 - DNA, 25 bp, Rattus norvegicus
aggctggaccctgaatagtgctggt

SEQ ID NO: 147163 - DNA, 25 bp, Rattus norvegicus
aggctggaccgcagggcctgctcca

SEQ ID NO: 147164 - DNA, 25 bp, Rattus norvegicus
aggctggaccgctgggcctgctcca

SEQ ID NO: 147165 - DNA, 25 bp, Rattus norvegicus
aggctggagcccaccctggctgctg

SEQ ID NO: 147166 - DNA, 25 bp, Rattus norvegicus
aggctggagccctccctggctgctg

SEQ ID NO: 147167 - DNA, 25 bp, Rattus norvegicus
aggctggagcttcgaactgctttcc

SEQ ID NO: 147168 - DNA, 25 bp, Rattus norvegicus
aggctggagcttggaactgctttcc

SEQ ID NO: 147169 - DNA, 25 bp, Rattus norvegicus
aggctggaggaaagactgactgctc

SEQ ID NO: 147170 - DNA, 25 bp, Rattus norvegicus
aggctggaggaatgactgactgctc

SEQ ID NO: 147171 - DNA, 25 bp, Rattus norvegicus
aggctggagtcgaagtcgtgcacca

SEQ ID NO: 147172 - DNA, 25 bp, Rattus norvegicus
aggctggagtcgtagtcgtgcacca

SEQ ID NO: 147173 - DNA, 25 bp, Rattus norvegicus
aggctggagtctctgttatctgtca

SEQ ID NO: 147174 - DNA, 25 bp, Rattus norvegicus
aggctggagtctgtgttatctgtca

SEQ ID NO: 147175 - DNA, 25 bp, Rattus norvegicus
aggctggagtgcattcctttggaag

SEQ ID NO: 147176 - DNA, 25 bp, Rattus norvegicus
aggctggagtgctttcctttggaag

SEQ ID NO: 147177 - DNA, 25 bp, Rattus norvegicus
aggctggatctcactaagttgccca

SEQ ID NO: 147178 - DNA, 25 bp, Rattus norvegicus
aggctggatctctctaagttgccca

SEQ ID NO: 147179 - DNA, 25 bp, Rattus norvegicus
aggctggatgccatgttccgtgctt

SEQ ID NO: 147180 - DNA, 25 bp, Rattus norvegicus
aggctggatgccttgttccgtgctt

SEQ ID NO: 147181 - DNA, 25 bp, Rattus norvegicus
aggctggatgtcactagtgctactg

SEQ ID NO: 147182 - DNA, 25 bp, Rattus norvegicus
aggctggatgtctctagtgctactg

SEQ ID NO: 147183 - DNA, 25 bp, Rattus norvegicus
aggctggattttctcagtctctgct

SEQ ID NO: 147184 - DNA, 25 bp, Rattus norvegicus
aggctggattttgtcagtctctgct

SEQ ID NO: 147185 - DNA, 25 bp, Rattus norvegicus
aggctggcatggctggaccacacat

SEQ ID NO: 147186 - DNA, 25 bp, Rattus norvegicus
aggctggcatgggtggaccacacat

SEQ ID NO: 147187 - DNA, 25 bp, Rattus norvegicus
aggctggcattcaacgggctggtcc

SEQ ID NO: 147188 - DNA, 25 bp, Rattus norvegicus
aggctggcattctacgggctggtcc

SEQ ID NO: 147189 - DNA, 25 bp, Rattus norvegicus
aggctggcccaaactattgtcattc

SEQ ID NO: 147190 - DNA, 25 bp, Rattus norvegicus
aggctggcccaatctattgtcattc

SEQ ID NO: 147191 - DNA, 25 bp, Rattus norvegicus
aggctggcctcaaatcctgagctag

SEQ ID NO: 147192 - DNA, 25 bp, Rattus norvegicus
aggctggcctcaccaaggataactt

SEQ ID NO: 147193 - DNA, 25 bp, Rattus norvegicus
aggctggcctcagcaaggataactt

SEQ ID NO: 147194 - DNA, 25 bp, Rattus norvegicus
aggctggcctcatatcctgagctag

SEQ ID NO: 147195 - DNA, 25 bp, Rattus norvegicus
aggctggcctctagtaaagcttcct

SEQ ID NO: 147196 - DNA, 25 bp, Rattus norvegicus
aggctggcctcttgtaaagcttcct

SEQ ID NO: 147197 - DNA, 25 bp, Rattus norvegicus
aggctggcctggatttcattctctt

SEQ ID NO: 147198 - DNA, 25 bp, Rattus norvegicus
aggctggcctggttttcattctctt

SEQ ID NO: 147199 - DNA, 25 bp, Rattus norvegicus
aggctggccttgatcgtttcaggtc

SEQ ID NO: 147200 - DNA, 25 bp, Rattus norvegicus
aggctggccttgttcgtttcaggtc

SEQ ID NO: 147201 - DNA, 25 bp, Rattus norvegicus
aggctggcgcagaacactcgggaaa

SEQ ID NO: 147202 - DNA, 25 bp, Rattus norvegicus
aggctggcgcagtacactcgggaaa

SEQ ID NO: 147203 - DNA, 25 bp, Rattus norvegicus
aggctggcggagacttccagagcta

SEQ ID NO: 147204 - DNA, 25 bp, Rattus norvegicus
aggctggcggagtcttccagagcta

SEQ ID NO: 147205 - DNA, 25 bp, Rattus norvegicus
aggctggctatgcacttgctttgta

SEQ ID NO: 147206 - DNA, 25 bp, Rattus norvegicus
aggctggctatggacttgctttgta

SEQ ID NO: 147207 - DNA, 25 bp, Rattus norvegicus
aggctggctccaaatagtaagatca

SEQ ID NO: 147208 - DNA, 25 bp, Rattus norvegicus
aggctggctccaagctaacaaaaga

SEQ ID NO: 147209 - DNA, 25 bp, Rattus norvegicus
aggctggctccatatagtaagatca

SEQ ID NO: 147210 - DNA, 25 bp, Rattus norvegicus
aggctggctccatgctaacaaaaga

SEQ ID NO: 147211 - DNA, 25 bp, Rattus norvegicus
aggctggctgcaaggtgctgcttta

SEQ ID NO: 147212 - DNA, 25 bp, Rattus norvegicus
aggctggctgcatggtgctgcttta

SEQ ID NO: 147213 - DNA, 25 bp, Rattus norvegicus
aggctggctgcccaaactgttctgg

SEQ ID NO: 147214 - DNA, 25 bp, Rattus norvegicus
aggctggctgccgaaactgttctgg

SEQ ID NO: 147215 - DNA, 25 bp, Rattus norvegicus
aggctggctggcaggagcatattac

SEQ ID NO: 147216 - DNA, 25 bp, Rattus norvegicus
aggctggctggctggagcatattac

SEQ ID NO: 147217 - DNA, 25 bp, Rattus norvegicus
aggctggcttcaatcagttcactat

SEQ ID NO: 147218 - DNA, 25 bp, Rattus norvegicus
aggctggcttcattcagttcactat

SEQ ID NO: 147219 - DNA, 25 bp, Rattus norvegicus
aggctggcttctaactgattgtata

SEQ ID NO: 147220 - DNA, 25 bp, Rattus norvegicus
aggctggcttctatgacaatgggta

SEQ ID NO: 147221 - DNA, 25 bp, Rattus norvegicus
aggctggcttcttactgattgtata

SEQ ID NO: 147222 - DNA, 25 bp, Rattus norvegicus
aggctggcttctttgacaatgggta

SEQ ID NO: 147223 - DNA, 25 bp, Rattus norvegicus
aggctggcttgaagaattcccggtc

SEQ ID NO: 147224 - DNA, 25 bp, Rattus norvegicus
aggctggcttgatgaattcccggtc

SEQ ID NO: 147225 - DNA, 25 bp, Rattus norvegicus
aggctgggagagcacccatcactac

SEQ ID NO: 147226 - DNA, 25 bp, Rattus norvegicus
aggctgggagaggacccatcactac

SEQ ID NO: 147227 - DNA, 25 bp, Rattus norvegicus
aggctgggcacactttcctcaggag

SEQ ID NO: 147228 - DNA, 25 bp, Rattus norvegicus
aggctgggcacagtttcctcaggag

SEQ ID NO: 147229 - DNA, 25 bp, Rattus norvegicus
aggctgggcagtccatccagagaca

SEQ ID NO: 147230 - DNA, 25 bp, Rattus norvegicus
aggctgggcagtgcatccagagaca

SEQ ID NO: 147231 - DNA, 25 bp, Rattus norvegicus
aggctgggccaacatctctaacatg

SEQ ID NO: 147232 - DNA, 25 bp, Rattus norvegicus
aggctgggccaagatctctaacatg

SEQ ID NO: 147233 - DNA, 25 bp, Rattus norvegicus
aggctgggctgtatgctgtcagtcc

SEQ ID NO: 147234 - DNA, 25 bp, Rattus norvegicus
aggctgggctgtcgcttcaagtttt

SEQ ID NO: 147235 - DNA, 25 bp, Rattus norvegicus
aggctgggctgtggcttcaagtttt

SEQ ID NO: 147236 - DNA, 25 bp, Rattus norvegicus
aggctgggctgtttgctgtcagtcc

SEQ ID NO: 147237 - DNA, 25 bp, Rattus norvegicus
aggctgggcttacaagtgccaccaa

SEQ ID NO: 147238 - DNA, 25 bp, Rattus norvegicus
aggctgggcttagaagtgccaccaa

SEQ ID NO: 147239 - DNA, 25 bp, Rattus norvegicus
aggctgggcttgacaatacacttcc

SEQ ID NO: 147240 - DNA, 25 bp, Rattus norvegicus
aggctgggcttgtcaatacacttcc

SEQ ID NO: 147241 - DNA, 25 bp, Rattus norvegicus
aggctgggtgcactagtgcacactt

SEQ ID NO: 147242 - DNA, 25 bp, Rattus norvegicus
aggctgggtgcagtagtgcacactt

SEQ ID NO: 147243 - DNA, 25 bp, Rattus norvegicus
aggctggtaagaatgcccctgacaa

SEQ ID NO: 147244 - DNA, 25 bp, Rattus norvegicus
aggctggtaagattgcccctgacaa

SEQ ID NO: 147245 - DNA, 25 bp, Rattus norvegicus
aggctggtcactctgccagacatca

SEQ ID NO: 147246 - DNA, 25 bp, Rattus norvegicus
aggctggtcactgtgccagacatca

SEQ ID NO: 147247 - DNA, 25 bp, Rattus norvegicus
aggctggtccccattcctgaccatg

SEQ ID NO: 147248 - DNA, 25 bp, Rattus norvegicus
aggctggtcccctttcctgaccatg

SEQ ID NO: 147249 - DNA, 25 bp, Rattus norvegicus
aggctggtccctcaagacgtactca

SEQ ID NO: 147250 - DNA, 25 bp, Rattus norvegicus
aggctggtccctcctatgattagtg

SEQ ID NO: 147251 - DNA, 25 bp, Rattus norvegicus
aggctggtccctgaagacgtactca

SEQ ID NO: 147252 - DNA, 25 bp, Rattus norvegicus
aggctggtccctgctatgattagtg

SEQ ID NO: 147253 - DNA, 25 bp, Rattus norvegicus
aggctggtctgtccggtttgcatct

SEQ ID NO: 147254 - DNA, 25 bp, Rattus norvegicus
aggctggtctgtgcggtttgcatct

SEQ ID NO: 147255 - DNA, 25 bp, Rattus norvegicus
aggctggtcttcacagacgtccaac

SEQ ID NO: 147256 - DNA, 25 bp, Rattus norvegicus
aggctggtcttctcagacgtccaac

SEQ ID NO: 147257 - DNA, 25 bp, Rattus norvegicus
aggctggtgcagcaaggactcctca

SEQ ID NO: 147258 - DNA, 25 bp, Rattus norvegicus
aggctggtgcaggaaggactcctca

SEQ ID NO: 147259 - DNA, 25 bp, Rattus norvegicus
aggctggtggttagatgcatgtctc

SEQ ID NO: 147260 - DNA, 25 bp, Rattus norvegicus
aggctggtggttctgacctcatctg

SEQ ID NO: 147261 - DNA, 25 bp, Rattus norvegicus
aggctggtggttgtgacctcatctg

SEQ ID NO: 147262 - DNA, 25 bp, Rattus norvegicus
aggctggtggtttgatgcatgtctc

SEQ ID NO: 147263 - DNA, 25 bp, Rattus norvegicus
aggctggtgtgcatgtggctaacaa

SEQ ID NO: 147264 - DNA, 25 bp, Rattus norvegicus
aggctggtgtgcttgtggctaacaa

SEQ ID NO: 147265 - DNA, 25 bp, Rattus norvegicus
aggctggttccgatacacaggtcca

SEQ ID NO: 147266 - DNA, 25 bp, Rattus norvegicus
aggctggttccgttacacaggtcca

SEQ ID NO: 147267 - DNA, 25 bp, Rattus norvegicus
aggctggttgtcctgtacctgaata

SEQ ID NO: 147268 - DNA, 25 bp, Rattus norvegicus
aggctggttgtcgtgtacctgaata

SEQ ID NO: 147269 - DNA, 25 bp, Rattus norvegicus
aggctgtaagcccagcattctggaa

SEQ ID NO: 147270 - DNA, 25 bp, Rattus norvegicus
aggctgtaagccgagcattctggaa

SEQ ID NO: 147271 - DNA, 25 bp, Rattus norvegicus
aggctgtactccctgctgtggatga

SEQ ID NO: 147272 - DNA, 25 bp, Rattus norvegicus
aggctgtactccgtgctgtggatga

SEQ ID NO: 147273 - DNA, 25 bp, Rattus norvegicus
aggctgtagcctagctgtcctgtta

SEQ ID NO: 147274 - DNA, 25 bp, Rattus norvegicus
aggctgtagccttgctgtcctgtta

SEQ ID NO: 147275 - DNA, 25 bp, Rattus norvegicus
aggctgtagcttatcaggttcctca

SEQ ID NO: 147276 - DNA, 25 bp, Rattus norvegicus
aggctgtagcttttcaggttcctca

SEQ ID NO: 147277 - DNA, 25 bp, Rattus norvegicus
aggctgtagggcacccataaaggaa

SEQ ID NO: 147278 - DNA, 25 bp, Rattus norvegicus
aggctgtagggctcccataaaggaa

SEQ ID NO: 147279 - DNA, 25 bp, Rattus norvegicus
aggctgtagttcacatcttaaggtt

SEQ ID NO: 147280 - DNA, 25 bp, Rattus norvegicus
aggctgtagttctcatcttaaggtt

SEQ ID NO: 147281 - DNA, 25 bp, Rattus norvegicus
aggctgtatattacttcccaagtgt

SEQ ID NO: 147282 - DNA, 25 bp, Rattus norvegicus
aggctgtatatttcttcccaagtgt

SEQ ID NO: 147283 - DNA, 25 bp, Rattus norvegicus
aggctgtcaaccatgtccaacatta

SEQ ID NO: 147284 - DNA, 25 bp, Rattus norvegicus
aggctgtcaaccttgtccaacatta

SEQ ID NO: 147285 - DNA, 25 bp, Rattus norvegicus
aggctgtcaagcagcccatagtgaa

SEQ ID NO: 147286 - DNA, 25 bp, Rattus norvegicus
aggctgtcaagctgcccatagtgaa

SEQ ID NO: 147287 - DNA, 25 bp, Rattus norvegicus
aggctgtcaaggatctaatctggtc

SEQ ID NO: 147288 - DNA, 25 bp, Rattus norvegicus
aggctgtcaaggttctaatctggtc

SEQ ID NO: 147289 - DNA, 25 bp, Rattus norvegicus
aggctgtcagctacgggacccagca

SEQ ID NO: 147290 - DNA, 25 bp, Rattus norvegicus
aggctgtcagcttcgggacccagca

SEQ ID NO: 147291 - DNA, 25 bp, Rattus norvegicus
aggctgtcagggagactgccactca

SEQ ID NO: 147292 - DNA, 25 bp, Rattus norvegicus
aggctgtcagggtgactgccactca

SEQ ID NO: 147293 - DNA, 25 bp, Rattus norvegicus
aggctgtcagtaatcttcctggtca

SEQ ID NO: 147294 - DNA, 25 bp, Rattus norvegicus
aggctgtcagtattcttcctggtca

SEQ ID NO: 147295 - DNA, 25 bp, Rattus norvegicus
aggctgtcatgcaaggtggtccctt

SEQ ID NO: 147296 - DNA, 25 bp, Rattus norvegicus
aggctgtcatgctaggtggtccctt

SEQ ID NO: 147297 - DNA, 25 bp, Rattus norvegicus
aggctgtccatccaagcagaaccag

SEQ ID NO: 147298 - DNA, 25 bp, Rattus norvegicus
aggctgtccatcgaagcagaaccag

SEQ ID NO: 147299 - DNA, 25 bp, Rattus norvegicus
aggctgtcccatctcatgactcaca

SEQ ID NO: 147300 - DNA, 25 bp, Rattus norvegicus
aggctgtcccatgtcatgactcaca

SEQ ID NO: 147301 - DNA, 25 bp, Rattus norvegicus
aggctgtccccaaaggtgctgagat

SEQ ID NO: 147302 - DNA, 25 bp, Rattus norvegicus
aggctgtccccataggtgctgagat

SEQ ID NO: 147303 - DNA, 25 bp, Rattus norvegicus
aggctgtcccctctgtacggattaa

SEQ ID NO: 147304 - DNA, 25 bp, Rattus norvegicus
aggctgtcccctgtgtacggattaa

SEQ ID NO: 147305 - DNA, 25 bp, Rattus norvegicus
aggctgtcctaaagctgggcttggc

SEQ ID NO: 147306 - DNA, 25 bp, Rattus norvegicus
aggctgtcctaatgctgggcttggc

SEQ ID NO: 147307 - DNA, 25 bp, Rattus norvegicus
aggctgtcctggagcttactatgta

SEQ ID NO: 147308 - DNA, 25 bp, Rattus norvegicus
aggctgtcctggcttctatactaag

SEQ ID NO: 147309 - DNA, 25 bp, Rattus norvegicus
aggctgtcctgggttctatactaag

SEQ ID NO: 147310 - DNA, 25 bp, Rattus norvegicus
aggctgtcctggtgcttactatgta

SEQ ID NO: 147311 - DNA, 25 bp, Rattus norvegicus
aggctgtcgtgtctacactgtgtct

SEQ ID NO: 147312 - DNA, 25 bp, Rattus norvegicus
aggctgtcgtgtgtacactgtgtct

SEQ ID NO: 147313 - DNA, 25 bp, Rattus norvegicus
aggctgtctaccagttgactcgcat

SEQ ID NO: 147314 - DNA, 25 bp, Rattus norvegicus
aggctgtctacctgttgactcgcat

SEQ ID NO: 147315 - DNA, 25 bp, Rattus norvegicus
aggctgtctcacaaaacgaggaaag

SEQ ID NO: 147316 - DNA, 25 bp, Rattus norvegicus
aggctgtctcactaaacgaggaaag

SEQ ID NO: 147317 - DNA, 25 bp, Rattus norvegicus
aggctgtctcagctaaccagttctt

SEQ ID NO: 147318 - DNA, 25 bp, Rattus norvegicus
aggctgtctcaggtaaccagttctt

SEQ ID NO: 147319 - DNA, 25 bp, Rattus norvegicus
aggctgtctctcagtagcttatgtt

SEQ ID NO: 147320 - DNA, 25 bp, Rattus norvegicus
aggctgtctctctgtagcttatgtt

SEQ ID NO: 147321 - DNA, 25 bp, Rattus norvegicus
aggctgtctgtaccaagttacccaa

SEQ ID NO: 147322 - DNA, 25 bp, Rattus norvegicus
aggctgtctgtagcaagttacccaa

SEQ ID NO: 147323 - DNA, 25 bp, Rattus norvegicus
aggctgtctgtgcttgactcttcgg

SEQ ID NO: 147324 - DNA, 25 bp, Rattus norvegicus
aggctgtctgtggttgactcttcgg

SEQ ID NO: 147325 - DNA, 25 bp, Rattus norvegicus
aggctgtgaactctgtctcatgtag

SEQ ID NO: 147326 - DNA, 25 bp, Rattus norvegicus
aggctgtgaactgtgtctcatgtag

SEQ ID NO: 147327 - DNA, 25 bp, Rattus norvegicus
aggctgtgaagccaccttagcaccg

SEQ ID NO: 147328 - DNA, 25 bp, Rattus norvegicus
aggctgtgaagcgaccttagcaccg

SEQ ID NO: 147329 - DNA, 25 bp, Rattus norvegicus
aggctgtgactcagtagtgttcatt

SEQ ID NO: 147330 - DNA, 25 bp, Rattus norvegicus
aggctgtgactctgtagtgttcatt

SEQ ID NO: 147331 - DNA, 25 bp, Rattus norvegicus
aggctgtgactgacactctcgctcc

SEQ ID NO: 147332 - DNA, 25 bp, Rattus norvegicus
aggctgtgactgtcactctcgctcc

SEQ ID NO: 147333 - DNA, 25 bp, Rattus norvegicus
aggctgtgacttaggcatggctgct

SEQ ID NO: 147334 - DNA, 25 bp, Rattus norvegicus
aggctgtgacttctggttcagtttt

SEQ ID NO: 147335 - DNA, 25 bp, Rattus norvegicus
aggctgtgacttgtggttcagtttt

SEQ ID NO: 147336 - DNA, 25 bp, Rattus norvegicus
aggctgtgactttggcatggctgct

SEQ ID NO: 147337 - DNA, 25 bp, Rattus norvegicus
aggctgtgagagcttgtcatttcaa

SEQ ID NO: 147338 - DNA, 25 bp, Rattus norvegicus
aggctgtgagaggttgtcatttcaa

SEQ ID NO: 147339 - DNA, 25 bp, Rattus norvegicus
aggctgtgagtgcttttcagaccat

SEQ ID NO: 147340 - DNA, 25 bp, Rattus norvegicus
aggctgtgagtggttttcagaccat

SEQ ID NO: 147341 - DNA, 25 bp, Rattus norvegicus
aggctgtgatcaactgctgtgtgga

SEQ ID NO: 147342 - DNA, 25 bp, Rattus norvegicus
aggctgtgatcatctgctgtgtgga

SEQ ID NO: 147343 - DNA, 25 bp, Rattus norvegicus
aggctgtgcctgaggacatccatgt

SEQ ID NO: 147344 - DNA, 25 bp, Rattus norvegicus
aggctgtgcctgtggacatccatgt

SEQ ID NO: 147345 - DNA, 25 bp, Rattus norvegicus
aggctgtgccttccaaacaggacaa

SEQ ID NO: 147346 - DNA, 25 bp, Rattus norvegicus
aggctgtgccttgcaaacaggacaa

SEQ ID NO: 147347 - DNA, 25 bp, Rattus norvegicus
aggctgtgcgtgattgtactttaga

SEQ ID NO: 147348 - DNA, 25 bp, Rattus norvegicus
aggctgtgcgtgtttgtactttaga

SEQ ID NO: 147349 - DNA, 25 bp, Rattus norvegicus
aggctgtgctgaacccgtggtaaga

SEQ ID NO: 147350 - DNA, 25 bp, Rattus norvegicus
aggctgtgctgatcccgtggtaaga

SEQ ID NO: 147351 - DNA, 25 bp, Rattus norvegicus
aggctgtggcctcttgtgtttatgc

SEQ ID NO: 147352 - DNA, 25 bp, Rattus norvegicus
aggctgtggcctgttgtgtttatgc

SEQ ID NO: 147353 - DNA, 25 bp, Rattus norvegicus
aggctgtggcgcagaacatggattc

SEQ ID NO: 147354 - DNA, 25 bp, Rattus norvegicus
aggctgtggcgctgaacatggattc

SEQ ID NO: 147355 - DNA, 25 bp, Rattus norvegicus
aggctgtgggcaaggtcatcccaga

SEQ ID NO: 147356 - DNA, 25 bp, Rattus norvegicus
aggctgtgggcatggtcatcccaga

SEQ ID NO: 147357 - DNA, 25 bp, Rattus norvegicus
aggctgtggttactggttcccgcca

SEQ ID NO: 147358 - DNA, 25 bp, Rattus norvegicus
aggctgtggttagtggttcccgcca

SEQ ID NO: 147359 - DNA, 25 bp, Rattus norvegicus
aggctgtgtctcaagcgcccggaaa

SEQ ID NO: 147360 - DNA, 25 bp, Rattus norvegicus
aggctgtgtctctagcgcccggaaa

SEQ ID NO: 147361 - DNA, 25 bp, Rattus norvegicus
aggctgtgtgttactttcccaggag

SEQ ID NO: 147362 - DNA, 25 bp, Rattus norvegicus
aggctgtgtgtttctttcccaggag

SEQ ID NO: 147363 - DNA, 25 bp, Rattus norvegicus
aggctgtgttctcgcatgcttctct

SEQ ID NO: 147364 - DNA, 25 bp, Rattus norvegicus
aggctgtgttctggcatgcttctct

SEQ ID NO: 147365 - DNA, 25 bp, Rattus norvegicus
aggctgttagttacctcaacttcat

SEQ ID NO: 147366 - DNA, 25 bp, Rattus norvegicus
aggctgttagtttcctcaacttcat

SEQ ID NO: 147367 - DNA, 25 bp, Rattus norvegicus
aggctgttcctaaactcccagcagt

SEQ ID NO: 147368 - DNA, 25 bp, Rattus norvegicus
aggctgttcctatactcccagcagt

SEQ ID NO: 147369 - DNA, 25 bp, Rattus norvegicus
aggctgttcctgagttctgtctgct

SEQ ID NO: 147370 - DNA, 25 bp, Rattus norvegicus
aggctgttcctgtgttctgtctgct

SEQ ID NO: 147371 - DNA, 25 bp, Rattus norvegicus
aggctgttcgttcctggcagtcttc

SEQ ID NO: 147372 - DNA, 25 bp, Rattus norvegicus
aggctgttcgttgctggcagtcttc

SEQ ID NO: 147373 - DNA, 25 bp, Rattus norvegicus
aggctgttgaaacgacctctcagaa

SEQ ID NO: 147374 - DNA, 25 bp, Rattus norvegicus
aggctgttgaaaggacctctcagaa

SEQ ID NO: 147375 - DNA, 25 bp, Rattus norvegicus
aggctgttgactatatgtactcggg

SEQ ID NO: 147376 - DNA, 25 bp, Rattus norvegicus
aggctgttgactttatgtactcggg

SEQ ID NO: 147377 - DNA, 25 bp, Rattus norvegicus
aggctgttggttactacatcttccg

SEQ ID NO: 147378 - DNA, 25 bp, Rattus norvegicus
aggctgttggtttctacatcttccg

SEQ ID NO: 147379 - DNA, 25 bp, Rattus norvegicus
aggctgtttaacacatggctccaag

SEQ ID NO: 147380 - DNA, 25 bp, Rattus norvegicus
aggctgtttaactcatggctccaag

SEQ ID NO: 147381 - DNA, 25 bp, Rattus norvegicus
aggctgtttaagatcgtgccctcag

SEQ ID NO: 147382 - DNA, 25 bp, Rattus norvegicus
aggctgtttaagttcgtgccctcag

SEQ ID NO: 147383 - DNA, 25 bp, Rattus norvegicus
aggctgtttatcagtccagggaaaa

SEQ ID NO: 147384 - DNA, 25 bp, Rattus norvegicus
aggctgtttatctgtccagggaaaa

SEQ ID NO: 147385 - DNA, 25 bp, Rattus norvegicus
aggctgtttgacatctttactgaga

SEQ ID NO: 147386 - DNA, 25 bp, Rattus norvegicus
aggctgtttgacttctttactgaga

SEQ ID NO: 147387 - DNA, 25 bp, Rattus norvegicus
aggctgttttgcaggaactcctgag

SEQ ID NO: 147388 - DNA, 25 bp, Rattus norvegicus
aggctgttttgctggaactcctgag

SEQ ID NO: 147389 - DNA, 25 bp, Rattus norvegicus
aggctgttttgtatgtatctgttaa

SEQ ID NO: 147390 - DNA, 25 bp, Rattus norvegicus
aggctgttttgtctaagggctgatc

SEQ ID NO: 147391 - DNA, 25 bp, Rattus norvegicus
aggctgttttgtgtaagggctgatc

SEQ ID NO: 147392 - DNA, 25 bp, Rattus norvegicus
aggctgttttgtttgtatctgttaa

SEQ ID NO: 147393 - DNA, 25 bp, Rattus norvegicus
aggcttaaatcgctggctttggaca

SEQ ID NO: 147394 - DNA, 25 bp, Rattus norvegicus
aggcttaaatcggtggctttggaca

SEQ ID NO: 147395 - DNA, 25 bp, Rattus norvegicus
aggcttaactacatatccctggctg

SEQ ID NO: 147396 - DNA, 25 bp, Rattus norvegicus
aggcttaactacttatccctggctg

SEQ ID NO: 147397 - DNA, 25 bp, Rattus norvegicus
aggcttaactgtaagcaaacgccga

SEQ ID NO: 147398 - DNA, 25 bp, Rattus norvegicus
aggcttaactgttagcaaacgccga

SEQ ID NO: 147399 - DNA, 25 bp, Rattus norvegicus
aggcttaaggaaacttatgctcaaa

SEQ ID NO: 147400 - DNA, 25 bp, Rattus norvegicus
aggcttaaggaatcttatgctcaaa

SEQ ID NO: 147401 - DNA, 25 bp, Rattus norvegicus
aggcttaagggactctcctctacct

SEQ ID NO: 147402 - DNA, 25 bp, Rattus norvegicus
aggcttaagggagtctcctctacct

SEQ ID NO: 147403 - DNA, 25 bp, Rattus norvegicus
aggcttacacatccggccctgcagg

SEQ ID NO: 147404 - DNA, 25 bp, Rattus norvegicus
aggcttacacatgcggccctgcagg

SEQ ID NO: 147405 - DNA, 25 bp, Rattus norvegicus
aggcttaccattaagttggaggcaa

SEQ ID NO: 147406 - DNA, 25 bp, Rattus norvegicus
aggcttaccatttagttggaggcaa

SEQ ID NO: 147407 - DNA, 25 bp, Rattus norvegicus
aggcttactctgacctgttacagtt

SEQ ID NO: 147408 - DNA, 25 bp, Rattus norvegicus
aggcttactctgtcctgttacagtt

SEQ ID NO: 147409 - DNA, 25 bp, Rattus norvegicus
aggcttagagccacttagcgctggg

SEQ ID NO: 147410 - DNA, 25 bp, Rattus norvegicus
aggcttagagccagggaagttcctg

SEQ ID NO: 147411 - DNA, 25 bp, Rattus norvegicus
aggcttagagcctcttagcgctggg

SEQ ID NO: 147412 - DNA, 25 bp, Rattus norvegicus
aggcttagagcctgggaagttcctg

SEQ ID NO: 147413 - DNA, 25 bp, Rattus norvegicus
aggcttagagcgacccctaggagag

SEQ ID NO: 147414 - DNA, 25 bp, Rattus norvegicus
aggcttagagcgtcccctaggagag

SEQ ID NO: 147415 - DNA, 25 bp, Rattus norvegicus
aggcttagaggcacagccgcaggta

SEQ ID NO: 147416 - DNA, 25 bp, Rattus norvegicus
aggcttagaggctcagccgcaggta

SEQ ID NO: 147417 - DNA, 25 bp, Rattus norvegicus
aggcttagcatcatcagcttgttta

SEQ ID NO: 147418 - DNA, 25 bp, Rattus norvegicus
aggcttagcatcttcagcttgttta

SEQ ID NO: 147419 - DNA, 25 bp, Rattus norvegicus
aggcttaggcaaaggctcaggcaca

SEQ ID NO: 147420 - DNA, 25 bp, Rattus norvegicus
aggcttaggcaatggctcaggcaca

SEQ ID NO: 147421 - DNA, 25 bp, Rattus norvegicus
aggcttaggctcacagctcctttga

SEQ ID NO: 147422 - DNA, 25 bp, Rattus norvegicus
aggcttaggctctcagctcctttga

SEQ ID NO: 147423 - DNA, 25 bp, Rattus norvegicus
aggcttagggttaggtcctgacaca

SEQ ID NO: 147424 - DNA, 25 bp, Rattus norvegicus
aggcttagggtttggtcctgacaca

SEQ ID NO: 147425 - DNA, 25 bp, Rattus norvegicus
aggcttagtatgatgtattctccca

SEQ ID NO: 147426 - DNA, 25 bp, Rattus norvegicus
aggcttagtatgttgtattctccca

SEQ ID NO: 147427 - DNA, 25 bp, Rattus norvegicus
aggcttatagttctgcaccactgca

SEQ ID NO: 147428 - DNA, 25 bp, Rattus norvegicus
aggcttatagttgtgcaccactgca

SEQ ID NO: 147429 - DNA, 25 bp, Rattus norvegicus
aggcttatggagacagaccgtgaat

SEQ ID NO: 147430 - DNA, 25 bp, Rattus norvegicus
aggcttatggagtcagaccgtgaat

SEQ ID NO: 147431 - DNA, 25 bp, Rattus norvegicus
aggcttattcctaggctatatgtca

SEQ ID NO: 147432 - DNA, 25 bp, Rattus norvegicus
aggcttattccttggctatatgtca

SEQ ID NO: 147433 - DNA, 25 bp, Rattus norvegicus
aggcttcaactactgtgctatacat

SEQ ID NO: 147434 - DNA, 25 bp, Rattus norvegicus
aggcttcaactagtgtgctatacat

SEQ ID NO: 147435 - DNA, 25 bp, Rattus norvegicus
aggcttcaagaacgagtgtcccagc

SEQ ID NO: 147436 - DNA, 25 bp, Rattus norvegicus
aggcttcaagaaggagtgtcccagc

SEQ ID NO: 147437 - DNA, 25 bp, Rattus norvegicus
aggcttcaattcatggtcaggcaga

SEQ ID NO: 147438 - DNA, 25 bp, Rattus norvegicus
aggcttcaattcttggtcaggcaga

SEQ ID NO: 147439 - DNA, 25 bp, Rattus norvegicus
aggcttcacagacatcgctggcttt

SEQ ID NO: 147440 - DNA, 25 bp, Rattus norvegicus
aggcttcacagagatcgctggcttt

SEQ ID NO: 147441 - DNA, 25 bp, Rattus norvegicus
aggcttcacagccaaccgaggtttc

SEQ ID NO: 147442 - DNA, 25 bp, Rattus norvegicus
aggcttcacagcgaaccgaggtttc

SEQ ID NO: 147443 - DNA, 25 bp, Rattus norvegicus
aggcttcacattctcacccagggtg

SEQ ID NO: 147444 - DNA, 25 bp, Rattus norvegicus
aggcttcacattgtcacccagggtg

SEQ ID NO: 147445 - DNA, 25 bp, Rattus norvegicus
aggcttcacccgaaatggcagcagc

SEQ ID NO: 147446 - DNA, 25 bp, Rattus norvegicus
aggcttcacccgtaatggcagcagc

SEQ ID NO: 147447 - DNA, 25 bp, Rattus norvegicus
aggcttcacgttccaatgatgatta

SEQ ID NO: 147448 - DNA, 25 bp, Rattus norvegicus
aggcttcacgttgcaatgatgatta

SEQ ID NO: 147449 - DNA, 25 bp, Rattus norvegicus
aggcttcactctcacctaggtgcag

SEQ ID NO: 147450 - DNA, 25 bp, Rattus norvegicus
aggcttcactctgacctaggtgcag

SEQ ID NO: 147451 - DNA, 25 bp, Rattus norvegicus
aggcttcactgcatattgtctgttg

SEQ ID NO: 147452 - DNA, 25 bp, Rattus norvegicus
aggcttcactgcttattgtctgttg

SEQ ID NO: 147453 - DNA, 25 bp, Rattus norvegicus
aggcttcataatccatcatcgtcat

SEQ ID NO: 147454 - DNA, 25 bp, Rattus norvegicus
aggcttcataatgcatcatcgtcat

SEQ ID NO: 147455 - DNA, 25 bp, Rattus norvegicus
aggcttcatgataatcccgctgtta

SEQ ID NO: 147456 - DNA, 25 bp, Rattus norvegicus
aggcttcatgattatcccgctgtta

SEQ ID NO: 147457 - DNA, 25 bp, Rattus norvegicus
aggcttcatgctctctggatgtttc

SEQ ID NO: 147458 - DNA, 25 bp, Rattus norvegicus
aggcttcatgctgtctggatgtttc

SEQ ID NO: 147459 - DNA, 25 bp, Rattus norvegicus
aggcttcattggcacactgtgttct

SEQ ID NO: 147460 - DNA, 25 bp, Rattus norvegicus
aggcttcattgggacactgtgttct

SEQ ID NO: 147461 - DNA, 25 bp, Rattus norvegicus
aggcttcatttcaaaacgttctgta

SEQ ID NO: 147462 - DNA, 25 bp, Rattus norvegicus
aggcttcatttctaaacgttctgta

SEQ ID NO: 147463 - DNA, 25 bp, Rattus norvegicus
aggcttccaaaaaatcaacgcatag

SEQ ID NO: 147464 - DNA, 25 bp, Rattus norvegicus
aggcttccaaaatatcaacgcatag

SEQ ID NO: 147465 - DNA, 25 bp, Rattus norvegicus
aggcttccacagctcaagcattgca

SEQ ID NO: 147466 - DNA, 25 bp, Rattus norvegicus
aggcttccacaggtcaagcattgca

SEQ ID NO: 147467 - DNA, 25 bp, Rattus norvegicus
aggcttccagacacgtctgtgtgta

SEQ ID NO: 147468 - DNA, 25 bp, Rattus norvegicus
aggcttccagactcgtctgtgtgta

SEQ ID NO: 147469 - DNA, 25 bp, Rattus norvegicus
aggcttccagtcaaccacagaggct

SEQ ID NO: 147470 - DNA, 25 bp, Rattus norvegicus
aggcttccagtctaccacagaggct

SEQ ID NO: 147471 - DNA, 25 bp, Rattus norvegicus
aggcttccatgtccactatagagtt

SEQ ID NO: 147472 - DNA, 25 bp, Rattus norvegicus
aggcttccatgtgcactatagagtt

SEQ ID NO: 147473 - DNA, 25 bp, Rattus norvegicus
aggcttccatttcccgtgtgacaaa

SEQ ID NO: 147474 - DNA, 25 bp, Rattus norvegicus
aggcttccatttctcatatttggca

SEQ ID NO: 147475 - DNA, 25 bp, Rattus norvegicus
aggcttccatttgccgtgtgacaaa

SEQ ID NO: 147476 - DNA, 25 bp, Rattus norvegicus
aggcttccatttgtcatatttggca

SEQ ID NO: 147477 - DNA, 25 bp, Rattus norvegicus
aggcttcccaggactagctgtgtaa

SEQ ID NO: 147478 - DNA, 25 bp, Rattus norvegicus
aggcttcccaggtctagctgtgtaa

SEQ ID NO: 147479 - DNA, 25 bp, Rattus norvegicus
aggcttcccggaattggcaggagct

SEQ ID NO: 147480 - DNA, 25 bp, Rattus norvegicus
aggcttcccggatttggcaggagct

SEQ ID NO: 147481 - DNA, 25 bp, Rattus norvegicus
aggcttccctggacattcaaggcaa

SEQ ID NO: 147482 - DNA, 25 bp, Rattus norvegicus
aggcttccctggtcattcaaggcaa

SEQ ID NO: 147483 - DNA, 25 bp, Rattus norvegicus
aggcttcccttaccacaaatgtgtg

SEQ ID NO: 147484 - DNA, 25 bp, Rattus norvegicus
aggcttcccttacgatacaccaaga

SEQ ID NO: 147485 - DNA, 25 bp, Rattus norvegicus
aggcttcccttagcacaaatgtgtg

SEQ ID NO: 147486 - DNA, 25 bp, Rattus norvegicus
aggcttcccttaggatacaccaaga

SEQ ID NO: 147487 - DNA, 25 bp, Rattus norvegicus
aggcttcctagtcgtggatgtccca

SEQ ID NO: 147488 - DNA, 25 bp, Rattus norvegicus
aggcttcctagtggtggatgtccca

SEQ ID NO: 147489 - DNA, 25 bp, Rattus norvegicus
aggcttcctcctaccaaggctggcg

SEQ ID NO: 147490 - DNA, 25 bp, Rattus norvegicus
aggcttcctccttccaaggctggcg

SEQ ID NO: 147491 - DNA, 25 bp, Rattus norvegicus
aggcttcctgccagaggaatgtcct

SEQ ID NO: 147492 - DNA, 25 bp, Rattus norvegicus
aggcttcctgcctgaggaatgtcct

SEQ ID NO: 147493 - DNA, 25 bp, Rattus norvegicus
aggcttcgaagtccgccatcaaaaa

SEQ ID NO: 147494 - DNA, 25 bp, Rattus norvegicus
aggcttcgaagtgcgccatcaaaaa

SEQ ID NO: 147495 - DNA, 25 bp, Rattus norvegicus
aggcttcggctccacgggaaagaat

SEQ ID NO: 147496 - DNA, 25 bp, Rattus norvegicus
aggcttcggctcgacgggaaagaat

SEQ ID NO: 147497 - DNA, 25 bp, Rattus norvegicus
aggcttcgggacattctggctgaga

SEQ ID NO: 147498 - DNA, 25 bp, Rattus norvegicus
aggcttcgggactttctggctgaga

SEQ ID NO: 147499 - DNA, 25 bp, Rattus norvegicus
aggcttcgtccactttgggccagtg

SEQ ID NO: 147500 - DNA, 25 bp, Rattus norvegicus
aggcttcgtccagtttgggccagtg

SEQ ID NO: 147501 - DNA, 25 bp, Rattus norvegicus
aggcttcgtggcctctttccagccg

SEQ ID NO: 147502 - DNA, 25 bp, Rattus norvegicus
aggcttcgtggcgtctttccagccg

SEQ ID NO: 147503 - DNA, 25 bp, Rattus norvegicus
aggcttctactgctgtattctgtac

SEQ ID NO: 147504 - DNA, 25 bp, Rattus norvegicus
aggcttctactggtgtattctgtac

SEQ ID NO: 147505 - DNA, 25 bp, Rattus norvegicus
aggcttctaggcatgcaatcattga

SEQ ID NO: 147506 - DNA, 25 bp, Rattus norvegicus
aggcttctaggcttgcaatcattga

SEQ ID NO: 147507 - DNA, 25 bp, Rattus norvegicus
aggcttctcaagcacactgtgggtt

SEQ ID NO: 147508 - DNA, 25 bp, Rattus norvegicus
aggcttctcaaggacactgtgggtt

SEQ ID NO: 147509 - DNA, 25 bp, Rattus norvegicus
aggcttctccaaagttctaccaatt

SEQ ID NO: 147510 - DNA, 25 bp, Rattus norvegicus
aggcttctccaatgttctaccaatt

SEQ ID NO: 147511 - DNA, 25 bp, Rattus norvegicus
aggcttctccagcaacagcgacagg

SEQ ID NO: 147512 - DNA, 25 bp, Rattus norvegicus
aggcttctccaggaacagcgacagg

SEQ ID NO: 147513 - DNA, 25 bp, Rattus norvegicus
aggcttctccctatagcaggtgtag

SEQ ID NO: 147514 - DNA, 25 bp, Rattus norvegicus
aggcttctccctttagcaggtgtag

SEQ ID NO: 147515 - DNA, 25 bp, Rattus norvegicus
aggcttctctgtaccagtgtgttga

SEQ ID NO: 147516 - DNA, 25 bp, Rattus norvegicus
aggcttctctgttccagtgtgttga

SEQ ID NO: 147517 - DNA, 25 bp, Rattus norvegicus
aggcttctgaatacggctattccat

SEQ ID NO: 147518 - DNA, 25 bp, Rattus norvegicus
aggcttctgaatctatctgtggtcc

SEQ ID NO: 147519 - DNA, 25 bp, Rattus norvegicus
aggcttctgaatgtatctgtggtcc

SEQ ID NO: 147520 - DNA, 25 bp, Rattus norvegicus
aggcttctgaattcggctattccat

SEQ ID NO: 147521 - DNA, 25 bp, Rattus norvegicus
aggcttctgagcctcgaccagaggt

SEQ ID NO: 147522 - DNA, 25 bp, Rattus norvegicus
aggcttctgagcgtcgaccagaggt

SEQ ID NO: 147523 - DNA, 25 bp, Rattus norvegicus
aggcttctgaggcagacaaccgctt

SEQ ID NO: 147524 - DNA, 25 bp, Rattus norvegicus
aggcttctgagggagacaaccgctt

SEQ ID NO: 147525 - DNA, 25 bp, Rattus norvegicus
aggcttctgcatcgccaggtagtgc

SEQ ID NO: 147526 - DNA, 25 bp, Rattus norvegicus
aggcttctgcatggccaggtagtgc

SEQ ID NO: 147527 - DNA, 25 bp, Rattus norvegicus
aggcttctgcctatttgttatttag

SEQ ID NO: 147528 - DNA, 25 bp, Rattus norvegicus
aggcttctgcctttttgttatttag

SEQ ID NO: 147529 - DNA, 25 bp, Rattus norvegicus
aggcttctgctgctgtccggctatg

SEQ ID NO: 147530 - DNA, 25 bp, Rattus norvegicus
aggcttctgctggtgtccggctatg

SEQ ID NO: 147531 - DNA, 25 bp, Rattus norvegicus
aggcttctggctcgatgtgtatgta

SEQ ID NO: 147532 - DNA, 25 bp, Rattus norvegicus
aggcttctggctggatgtgtatgta

SEQ ID NO: 147533 - DNA, 25 bp, Rattus norvegicus
aggcttctgggaattcagcatcctc

SEQ ID NO: 147534 - DNA, 25 bp, Rattus norvegicus
aggcttctgggatttcagcatcctc

SEQ ID NO: 147535 - DNA, 25 bp, Rattus norvegicus
aggcttctgggcaatgccagttcct

SEQ ID NO: 147536 - DNA, 25 bp, Rattus norvegicus
aggcttctgggctatgccagttcct

SEQ ID NO: 147537 - DNA, 25 bp, Rattus norvegicus
aggcttctgtaaactggcttcttca

SEQ ID NO: 147538 - DNA, 25 bp, Rattus norvegicus
aggcttctgtaatctggcttcttca

SEQ ID NO: 147539 - DNA, 25 bp, Rattus norvegicus
aggcttctgtagatgcttctcttaa

SEQ ID NO: 147540 - DNA, 25 bp, Rattus norvegicus
aggcttctgtagttgcttctcttaa

SEQ ID NO: 147541 - DNA, 25 bp, Rattus norvegicus
aggcttctgtctcagaccatcaatg

SEQ ID NO: 147542 - DNA, 25 bp, Rattus norvegicus
aggcttctgtctgagaccatcaatg

SEQ ID NO: 147543 - DNA, 25 bp, Rattus norvegicus
aggcttcttctgcagtctgtgcaag

SEQ ID NO: 147544 - DNA, 25 bp, Rattus norvegicus
aggcttcttctggagtctgtgcaag

SEQ ID NO: 147545 - DNA, 25 bp, Rattus norvegicus
aggcttcttgaaccgtggagaccag

SEQ ID NO: 147546 - DNA, 25 bp, Rattus norvegicus
aggcttcttgaagcgtggagaccag

SEQ ID NO: 147547 - DNA, 25 bp, Rattus norvegicus
aggcttctttacacttcccaagaat

SEQ ID NO: 147548 - DNA, 25 bp, Rattus norvegicus
aggcttctttactcttcccaagaat

SEQ ID NO: 147549 - DNA, 25 bp, Rattus norvegicus
aggcttctttctcgctctctggaaa

SEQ ID NO: 147550 - DNA, 25 bp, Rattus norvegicus
aggcttctttctggctctctggaaa

SEQ ID NO: 147551 - DNA, 25 bp, Rattus norvegicus
aggcttcttttcactgtcagtcaag

SEQ ID NO: 147552 - DNA, 25 bp, Rattus norvegicus
aggcttcttttctctgtcagtcaag

SEQ ID NO: 147553 - DNA, 25 bp, Rattus norvegicus
aggcttgaaaagctctttccccagg

SEQ ID NO: 147554 - DNA, 25 bp, Rattus norvegicus
aggcttgaaaaggtctttccccagg

SEQ ID NO: 147555 - DNA, 25 bp, Rattus norvegicus
aggcttgaccatcctgtcactatgg

SEQ ID NO: 147556 - DNA, 25 bp, Rattus norvegicus
aggcttgaccatgctgtcactatgg

SEQ ID NO: 147557 - DNA, 25 bp, Rattus norvegicus
aggcttgagaaaccttcccagtggg

SEQ ID NO: 147558 - DNA, 25 bp, Rattus norvegicus
aggcttgagaaagcttcccagtggg

SEQ ID NO: 147559 - DNA, 25 bp, Rattus norvegicus
aggcttgagaaccactggctaccct

SEQ ID NO: 147560 - DNA, 25 bp, Rattus norvegicus
aggcttgagaacgactggctaccct

SEQ ID NO: 147561 - DNA, 25 bp, Rattus norvegicus
aggcttgaggtcatgctccaggaca

SEQ ID NO: 147562 - DNA, 25 bp, Rattus norvegicus
aggcttgaggtcttgctccaggaca

SEQ ID NO: 147563 - DNA, 25 bp, Rattus norvegicus
aggcttgatcttatgctcttgtgat

SEQ ID NO: 147564 - DNA, 25 bp, Rattus norvegicus
aggcttgatcttttgctcttgtgat

SEQ ID NO: 147565 - DNA, 25 bp, Rattus norvegicus
aggcttgatgtgcacgacctgctaa

SEQ ID NO: 147566 - DNA, 25 bp, Rattus norvegicus
aggcttgatgtggacgacctgctaa

SEQ ID NO: 147567 - DNA, 25 bp, Rattus norvegicus
aggcttgcaaatccctgggttaagc

SEQ ID NO: 147568 - DNA, 25 bp, Rattus norvegicus
aggcttgcaaatgcctgggttaagc

SEQ ID NO: 147569 - DNA, 25 bp, Rattus norvegicus
aggcttgcagaccacaccttgaact

SEQ ID NO: 147570 - DNA, 25 bp, Rattus norvegicus
aggcttgcagacgacaccttgaact

SEQ ID NO: 147571 - DNA, 25 bp, Rattus norvegicus
aggcttgcagtcacacccaatggag

SEQ ID NO: 147572 - DNA, 25 bp, Rattus norvegicus
aggcttgcagtctcacccaatggag

SEQ ID NO: 147573 - DNA, 25 bp, Rattus norvegicus
aggcttgcatcaacatagtgtgtgt

SEQ ID NO: 147574 - DNA, 25 bp, Rattus norvegicus
aggcttgcatcatcatagtgtgtgt

SEQ ID NO: 147575 - DNA, 25 bp, Rattus norvegicus
aggcttgccagaacccctgccaaga

SEQ ID NO: 147576 - DNA, 25 bp, Rattus norvegicus
aggcttgccagatcccctgccaaga

SEQ ID NO: 147577 - DNA, 25 bp, Rattus norvegicus
aggcttgccatcacaactgtctgta

SEQ ID NO: 147578 - DNA, 25 bp, Rattus norvegicus
aggcttgccatctcaactgtctgta

SEQ ID NO: 147579 - DNA, 25 bp, Rattus norvegicus
aggcttgcccatagtttccactgaa

SEQ ID NO: 147580 - DNA, 25 bp, Rattus norvegicus
aggcttgcccattgtttccactgaa

SEQ ID NO: 147581 - DNA, 25 bp, Rattus norvegicus
aggcttgccccgaggaggactacgt

SEQ ID NO: 147582 - DNA, 25 bp, Rattus norvegicus
aggcttgccccgtggaggactacgt

SEQ ID NO: 147583 - DNA, 25 bp, Rattus norvegicus
aggcttgccctgagtttatgtaact

SEQ ID NO: 147584 - DNA, 25 bp, Rattus norvegicus
aggcttgccctgtgtttatgtaact

SEQ ID NO: 147585 - DNA, 25 bp, Rattus norvegicus
aggcttgcctttagattccattgac

SEQ ID NO: 147586 - DNA, 25 bp, Rattus norvegicus
aggcttgccttttgattccattgac

SEQ ID NO: 147587 - DNA, 25 bp, Rattus norvegicus
aggcttgcggccacgtggtgaagga

SEQ ID NO: 147588 - DNA, 25 bp, Rattus norvegicus
aggcttgcggcctcgtggtgaagga

SEQ ID NO: 147589 - DNA, 25 bp, Rattus norvegicus
aggcttgctacaattgacagtgcta

SEQ ID NO: 147590 - DNA, 25 bp, Rattus norvegicus
aggcttgctacatttgacagtgcta

SEQ ID NO: 147591 - DNA, 25 bp, Rattus norvegicus
aggcttgctcgcacatgcctgaaat

SEQ ID NO: 147592 - DNA, 25 bp, Rattus norvegicus
aggcttgctcgctcatgcctgaaat

SEQ ID NO: 147593 - DNA, 25 bp, Rattus norvegicus
aggcttgctctcagaggatctcaaa

SEQ ID NO: 147594 - DNA, 25 bp, Rattus norvegicus
aggcttgctctctgaggatctcaaa

SEQ ID NO: 147595 - DNA, 25 bp, Rattus norvegicus
aggcttgcttatcggacttcatctg

SEQ ID NO: 147596 - DNA, 25 bp, Rattus norvegicus
aggcttgcttatgggacttcatctg

SEQ ID NO: 147597 - DNA, 25 bp, Rattus norvegicus
aggcttggagctctggagacctcac

SEQ ID NO: 147598 - DNA, 25 bp, Rattus norvegicus
aggcttggagctgtggagacctcac

SEQ ID NO: 147599 - DNA, 25 bp, Rattus norvegicus
aggcttggcaacaaacacccgtatc

SEQ ID NO: 147600 - DNA, 25 bp, Rattus norvegicus
aggcttggcaacaaatgcctgttga

SEQ ID NO: 147601 - DNA, 25 bp, Rattus norvegicus
aggcttggcaactaacacccgtatc

SEQ ID NO: 147602 - DNA, 25 bp, Rattus norvegicus
aggcttggcaactaatgcctgttga

SEQ ID NO: 147603 - DNA, 25 bp, Rattus norvegicus
aggcttggcagcatcaactcggaac

SEQ ID NO: 147604 - DNA, 25 bp, Rattus norvegicus
aggcttggcagcttcaactcggaac

SEQ ID NO: 147605 - DNA, 25 bp, Rattus norvegicus
aggcttggcccaatgctttagtcct

SEQ ID NO: 147606 - DNA, 25 bp, Rattus norvegicus
aggcttggcccattgctttagtcct

SEQ ID NO: 147607 - DNA, 25 bp, Rattus norvegicus
aggcttggccctaagcttaaagaag

SEQ ID NO: 147608 - DNA, 25 bp, Rattus norvegicus
aggcttggcccttagcttaaagaag

SEQ ID NO: 147609 - DNA, 25 bp, Rattus norvegicus
aggcttggcctaagtagctgtcttc

SEQ ID NO: 147610 - DNA, 25 bp, Rattus norvegicus
aggcttggcctatgtagctgtcttc

SEQ ID NO: 147611 - DNA, 25 bp, Rattus norvegicus
aggcttggcggcatctcagtacttg

SEQ ID NO: 147612 - DNA, 25 bp, Rattus norvegicus
aggcttggcggcttctcagtacttg

SEQ ID NO: 147613 - DNA, 25 bp, Rattus norvegicus
aggcttggcttgcatcagggcttta

SEQ ID NO: 147614 - DNA, 25 bp, Rattus norvegicus
aggcttggcttggatcagggcttta

SEQ ID NO: 147615 - DNA, 25 bp, Rattus norvegicus
aggcttgggattatgcgtgtttgca

SEQ ID NO: 147616 - DNA, 25 bp, Rattus norvegicus
aggcttgggattttgcgtgtttgca

SEQ ID NO: 147617 - DNA, 25 bp, Rattus norvegicus
aggcttgggctcagctgttcaggaa

SEQ ID NO: 147618 - DNA, 25 bp, Rattus norvegicus
aggcttgggctcaggtgatcctcca

SEQ ID NO: 147619 - DNA, 25 bp, Rattus norvegicus
aggcttgggctctgctgttcaggaa

SEQ ID NO: 147620 - DNA, 25 bp, Rattus norvegicus
aggcttgggctctggtgatcctcca

SEQ ID NO: 147621 - DNA, 25 bp, Rattus norvegicus
aggcttggtgagaccttttaatctc

SEQ ID NO: 147622 - DNA, 25 bp, Rattus norvegicus
aggcttggtgagtccttttaatctc

SEQ ID NO: 147623 - DNA, 25 bp, Rattus norvegicus
aggcttggtgtcagtgttgaagatc

SEQ ID NO: 147624 - DNA, 25 bp, Rattus norvegicus
aggcttggtgtctgtgttgaagatc

SEQ ID NO: 147625 - DNA, 25 bp, Rattus norvegicus
aggcttgtacaacacccctggctgt

SEQ ID NO: 147626 - DNA, 25 bp, Rattus norvegicus
aggcttgtacaacatattcctgaca

SEQ ID NO: 147627 - DNA, 25 bp, Rattus norvegicus
aggcttgtacaagacccctggctgt

SEQ ID NO: 147628 - DNA, 25 bp, Rattus norvegicus
aggcttgtacaagatattcctgaca

SEQ ID NO: 147629 - DNA, 25 bp, Rattus norvegicus
aggcttgtccacaccagatttgcga

SEQ ID NO: 147630 - DNA, 25 bp, Rattus norvegicus
aggcttgtccactccagatttgcga

SEQ ID NO: 147631 - DNA, 25 bp, Rattus norvegicus
aggcttgtgaaacctccaactttgg

SEQ ID NO: 147632 - DNA, 25 bp, Rattus norvegicus
aggcttgtgaaagctccaactttgg

SEQ ID NO: 147633 - DNA, 25 bp, Rattus norvegicus
aggcttgtgattctcgaaatcttgt

SEQ ID NO: 147634 - DNA, 25 bp, Rattus norvegicus
aggcttgtgattgtcgaaatcttgt

SEQ ID NO: 147635 - DNA, 25 bp, Rattus norvegicus
aggcttgttgacacctttgaggttt

SEQ ID NO: 147636 - DNA, 25 bp, Rattus norvegicus
aggcttgttgactcctttgaggttt

SEQ ID NO: 147637 - DNA, 25 bp, Rattus norvegicus
aggctttaactcagtagtccactag

SEQ ID NO: 147638 - DNA, 25 bp, Rattus norvegicus
aggctttaactctgtagtccactag

SEQ ID NO: 147639 - DNA, 25 bp, Rattus norvegicus
aggctttactcactgctgcattgtt

SEQ ID NO: 147640 - DNA, 25 bp, Rattus norvegicus
aggctttactcagtgctgcattgtt

SEQ ID NO: 147641 - DNA, 25 bp, Rattus norvegicus
aggctttactccattcgggtcacta

SEQ ID NO: 147642 - DNA, 25 bp, Rattus norvegicus
aggctttactcctttcgggtcacta

SEQ ID NO: 147643 - DNA, 25 bp, Rattus norvegicus
aggctttactttagagtgtctcttt

SEQ ID NO: 147644 - DNA, 25 bp, Rattus norvegicus
aggctttacttttgagtgtctcttt

SEQ ID NO: 147645 - DNA, 25 bp, Rattus norvegicus
aggctttagcctctttgctgaaggt

SEQ ID NO: 147646 - DNA, 25 bp, Rattus norvegicus
aggctttagcctgtttgctgaaggt

SEQ ID NO: 147647 - DNA, 25 bp, Rattus norvegicus
aggctttaggcccacttgggtcagt

SEQ ID NO: 147648 - DNA, 25 bp, Rattus norvegicus
aggctttaggccgacttgggtcagt

SEQ ID NO: 147649 - DNA, 25 bp, Rattus norvegicus
aggctttagttgctctgctcccaga

SEQ ID NO: 147650 - DNA, 25 bp, Rattus norvegicus
aggctttagttggtctgctcccaga

SEQ ID NO: 147651 - DNA, 25 bp, Rattus norvegicus
aggctttatattactactgttgaac

SEQ ID NO: 147652 - DNA, 25 bp, Rattus norvegicus
aggctttatatttctactgttgaac

SEQ ID NO: 147653 - DNA, 25 bp, Rattus norvegicus
aggctttatcctatcttgtgccacg

SEQ ID NO: 147654 - DNA, 25 bp, Rattus norvegicus
aggctttatcctttcttgtgccacg

SEQ ID NO: 147655 - DNA, 25 bp, Rattus norvegicus
aggctttatctgatctctttatatt

SEQ ID NO: 147656 - DNA, 25 bp, Rattus norvegicus
aggctttatctgttctctttatatt

SEQ ID NO: 147657 - DNA, 25 bp, Rattus norvegicus
aggctttcaaaactgacttcacctg

SEQ ID NO: 147658 - DNA, 25 bp, Rattus norvegicus
aggctttcaaaagtgacttcacctg

SEQ ID NO: 147659 - DNA, 25 bp, Rattus norvegicus
aggctttcaaagaggcagcccctga

SEQ ID NO: 147660 - DNA, 25 bp, Rattus norvegicus
aggctttcaaagtggcagcccctga

SEQ ID NO: 147661 - DNA, 25 bp, Rattus norvegicus
aggctttcaaggcaccgtccacaga

SEQ ID NO: 147662 - DNA, 25 bp, Rattus norvegicus
aggctttcaagggaccgtccacaga

SEQ ID NO: 147663 - DNA, 25 bp, Rattus norvegicus
aggctttcagtcatcattggcagga

SEQ ID NO: 147664 - DNA, 25 bp, Rattus norvegicus
aggctttcagtcttcattggcagga

SEQ ID NO: 147665 - DNA, 25 bp, Rattus norvegicus
aggctttcagtgagcttgtgctctc

SEQ ID NO: 147666 - DNA, 25 bp, Rattus norvegicus
aggctttcagtgtgcttgtgctctc

SEQ ID NO: 147667 - DNA, 25 bp, Rattus norvegicus
aggctttcctctccattgaattctc

SEQ ID NO: 147668 - DNA, 25 bp, Rattus norvegicus
aggctttcctctgcattgaattctc

SEQ ID NO: 147669 - DNA, 25 bp, Rattus norvegicus
aggctttcctgcacaaatatttcgt

SEQ ID NO: 147670 - DNA, 25 bp, Rattus norvegicus
aggctttcctgcacatgcgtagcag

SEQ ID NO: 147671 - DNA, 25 bp, Rattus norvegicus
aggctttcctgccatcaaaggagta

SEQ ID NO: 147672 - DNA, 25 bp, Rattus norvegicus
aggctttcctgcgatcaaaggagta

SEQ ID NO: 147673 - DNA, 25 bp, Rattus norvegicus
aggctttcctgctcaaatatttcgt

SEQ ID NO: 147674 - DNA, 25 bp, Rattus norvegicus
aggctttcctgctcatgcgtagcag

SEQ ID NO: 147675 - DNA, 25 bp, Rattus norvegicus
aggctttcctgtctgcaaataatac

SEQ ID NO: 147676 - DNA, 25 bp, Rattus norvegicus
aggctttcctgtgtgcaaataatac

SEQ ID NO: 147677 - DNA, 25 bp, Rattus norvegicus
aggctttctacaactgggattgcta

SEQ ID NO: 147678 - DNA, 25 bp, Rattus norvegicus
aggctttctacatctgggattgcta

SEQ ID NO: 147679 - DNA, 25 bp, Rattus norvegicus
aggctttctaggagagctcacatcc

SEQ ID NO: 147680 - DNA, 25 bp, Rattus norvegicus
aggctttctaggtgagctcacatcc

SEQ ID NO: 147681 - DNA, 25 bp, Rattus norvegicus
aggctttctcacataactcttgtac

SEQ ID NO: 147682 - DNA, 25 bp, Rattus norvegicus
aggctttctcacttaactcttgtac

SEQ ID NO: 147683 - DNA, 25 bp, Rattus norvegicus
aggctttctcagctagttttctgct

SEQ ID NO: 147684 - DNA, 25 bp, Rattus norvegicus
aggctttctcaggtagttttctgct

SEQ ID NO: 147685 - DNA, 25 bp, Rattus norvegicus
aggctttctccgcaggcagcgacat

SEQ ID NO: 147686 - DNA, 25 bp, Rattus norvegicus
aggctttctccggaggcagcgacat

SEQ ID NO: 147687 - DNA, 25 bp, Rattus norvegicus
aggctttctgatcctccagaggaaa

SEQ ID NO: 147688 - DNA, 25 bp, Rattus norvegicus
aggctttctgatgctccagaggaaa

SEQ ID NO: 147689 - DNA, 25 bp, Rattus norvegicus
aggctttctgtgagtacttctggct

SEQ ID NO: 147690 - DNA, 25 bp, Rattus norvegicus
aggctttctgtgtgtacttctggct

SEQ ID NO: 147691 - DNA, 25 bp, Rattus norvegicus
aggctttctttacctctttcacact

SEQ ID NO: 147692 - DNA, 25 bp, Rattus norvegicus
aggctttctttagctctttcacact

SEQ ID NO: 147693 - DNA, 25 bp, Rattus norvegicus
aggctttctttgagatactctttag

SEQ ID NO: 147694 - DNA, 25 bp, Rattus norvegicus
aggctttctttgtgatactctttag

SEQ ID NO: 147695 - DNA, 25 bp, Rattus norvegicus
aggctttgaaaaccagctgtactgg

SEQ ID NO: 147696 - DNA, 25 bp, Rattus norvegicus
aggctttgaaaagcagctgtactgg

SEQ ID NO: 147697 - DNA, 25 bp, Rattus norvegicus
aggctttgaacaagtgtcgccaagc

SEQ ID NO: 147698 - DNA, 25 bp, Rattus norvegicus
aggctttgaacatgtgtcgccaagc

SEQ ID NO: 147699 - DNA, 25 bp, Rattus norvegicus
aggctttgaaggagacagtctgaca

SEQ ID NO: 147700 - DNA, 25 bp, Rattus norvegicus
aggctttgaaggtgacagtctgaca

SEQ ID NO: 147701 - DNA, 25 bp, Rattus norvegicus
aggctttgactgactcttctggaag

SEQ ID NO: 147702 - DNA, 25 bp, Rattus norvegicus
aggctttgactgtctcttctggaag

SEQ ID NO: 147703 - DNA, 25 bp, Rattus norvegicus
aggctttgagtcacctgtaggaccc

SEQ ID NO: 147704 - DNA, 25 bp, Rattus norvegicus
aggctttgagtctcctgtaggaccc

SEQ ID NO: 147705 - DNA, 25 bp, Rattus norvegicus
aggctttgatggcttatgagctcgc

SEQ ID NO: 147706 - DNA, 25 bp, Rattus norvegicus
aggctttgatgggttatgagctcgc

SEQ ID NO: 147707 - DNA, 25 bp, Rattus norvegicus
aggctttgattactgacacctcctg

SEQ ID NO: 147708 - DNA, 25 bp, Rattus norvegicus
aggctttgattagtgacacctcctg

SEQ ID NO: 147709 - DNA, 25 bp, Rattus norvegicus
aggctttgatttagttctctctggt

SEQ ID NO: 147710 - DNA, 25 bp, Rattus norvegicus
aggctttgattttgttctctctggt

SEQ ID NO: 147711 - DNA, 25 bp, Rattus norvegicus
aggctttgcaacacgcttgtgtaga

SEQ ID NO: 147712 - DNA, 25 bp, Rattus norvegicus
aggctttgcaactcgcttgtgtaga

SEQ ID NO: 147713 - DNA, 25 bp, Rattus norvegicus
aggctttgcagaactagcctgcgtt

SEQ ID NO: 147714 - DNA, 25 bp, Rattus norvegicus
aggctttgcagatctagcctgcgtt

SEQ ID NO: 147715 - DNA, 25 bp, Rattus norvegicus
aggctttgccaacatgtagctcttg

SEQ ID NO: 147716 - DNA, 25 bp, Rattus norvegicus
aggctttgccaagatgtagctcttg

SEQ ID NO: 147717 - DNA, 25 bp, Rattus norvegicus
aggctttgccatctactttggctat

SEQ ID NO: 147718 - DNA, 25 bp, Rattus norvegicus
aggctttgccatgtactttggctat

SEQ ID NO: 147719 - DNA, 25 bp, Rattus norvegicus
aggctttgccctagtacagtagttt

SEQ ID NO: 147720 - DNA, 25 bp, Rattus norvegicus
aggctttgcccttgtacagtagttt

SEQ ID NO: 147721 - DNA, 25 bp, Rattus norvegicus
aggctttgcgatcacatgtactgta

SEQ ID NO: 147722 - DNA, 25 bp, Rattus norvegicus
aggctttgcgatgacatgtactgta

SEQ ID NO: 147723 - DNA, 25 bp, Rattus norvegicus
aggctttgctcaccttctaataagg

SEQ ID NO: 147724 - DNA, 25 bp, Rattus norvegicus
aggctttgctcagcttctaataagg

SEQ ID NO: 147725 - DNA, 25 bp, Rattus norvegicus
aggctttgctgtatcttgatttgac

SEQ ID NO: 147726 - DNA, 25 bp, Rattus norvegicus
aggctttgctgtttcttgatttgac

SEQ ID NO: 147727 - DNA, 25 bp, Rattus norvegicus
aggctttgctttatctgtatgttaa

SEQ ID NO: 147728 - DNA, 25 bp, Rattus norvegicus
aggctttgctttttctgtatgttaa

SEQ ID NO: 147729 - DNA, 25 bp, Rattus norvegicus
aggctttggattctgaccccggtag

SEQ ID NO: 147730 - DNA, 25 bp, Rattus norvegicus
aggctttggattgtgaccccggtag

SEQ ID NO: 147731 - DNA, 25 bp, Rattus norvegicus
aggctttggcgtaggctgcgaacca

SEQ ID NO: 147732 - DNA, 25 bp, Rattus norvegicus
aggctttggcgttggctgcgaacca

SEQ ID NO: 147733 - DNA, 25 bp, Rattus norvegicus
aggctttggctcagctggagttcaa

SEQ ID NO: 147734 - DNA, 25 bp, Rattus norvegicus
aggctttggctctgctggagttcaa

SEQ ID NO: 147735 - DNA, 25 bp, Rattus norvegicus
aggctttggttcatgttgttcgcag

SEQ ID NO: 147736 - DNA, 25 bp, Rattus norvegicus
aggctttggttcttgttgttcgcag

SEQ ID NO: 147737 - DNA, 25 bp, Rattus norvegicus
aggctttgtagacctggtggccttt

SEQ ID NO: 147738 - DNA, 25 bp, Rattus norvegicus
aggctttgtagagctggtggccttt

SEQ ID NO: 147739 - DNA, 25 bp, Rattus norvegicus
aggctttgtggacctaggaccctgc

SEQ ID NO: 147740 - DNA, 25 bp, Rattus norvegicus
aggctttgtggagctaggaccctgc

SEQ ID NO: 147741 - DNA, 25 bp, Rattus norvegicus
aggctttgtgggagccccagtgcac

SEQ ID NO: 147742 - DNA, 25 bp, Rattus norvegicus
aggctttgtgggtgccccagtgcac

SEQ ID NO: 147743 - DNA, 25 bp, Rattus norvegicus
aggctttgtggtccgagatgctccc

SEQ ID NO: 147744 - DNA, 25 bp, Rattus norvegicus
aggctttgtggtgcgagatgctccc

SEQ ID NO: 147745 - DNA, 25 bp, Rattus norvegicus
aggctttgtgtgagaggacctccat

SEQ ID NO: 147746 - DNA, 25 bp, Rattus norvegicus
aggctttgtgtgtgaggacctccat

SEQ ID NO: 147747 - DNA, 25 bp, Rattus norvegicus
aggctttgttgcatgtccaggtgtc

SEQ ID NO: 147748 - DNA, 25 bp, Rattus norvegicus
aggctttgttgcttgtccaggtgtc

SEQ ID NO: 147749 - DNA, 25 bp, Rattus norvegicus
aggctttgtttcacatttgtatttt

SEQ ID NO: 147750 - DNA, 25 bp, Rattus norvegicus
aggctttgtttctcatttgtatttt

SEQ ID NO: 147751 - DNA, 25 bp, Rattus norvegicus
aggcttttaaccaattccatccatg

SEQ ID NO: 147752 - DNA, 25 bp, Rattus norvegicus
aggcttttaacctattccatccatg

SEQ ID NO: 147753 - DNA, 25 bp, Rattus norvegicus
aggcttttacaacagtgatgggtac

SEQ ID NO: 147754 - DNA, 25 bp, Rattus norvegicus
aggcttttacaagagtgatgggtac

SEQ ID NO: 147755 - DNA, 25 bp, Rattus norvegicus
aggcttttactgaaccccttctgat

SEQ ID NO: 147756 - DNA, 25 bp, Rattus norvegicus
aggcttttactgtaccccttctgat

SEQ ID NO: 147757 - DNA, 25 bp, Rattus norvegicus
aggcttttacttatcttgtgatgca

SEQ ID NO: 147758 - DNA, 25 bp, Rattus norvegicus
aggcttttacttttcttgtgatgca

SEQ ID NO: 147759 - DNA, 25 bp, Rattus norvegicus
aggcttttcaccatcagcctcgtga

SEQ ID NO: 147760 - DNA, 25 bp, Rattus norvegicus
aggcttttcaccttcagcctcgtga

SEQ ID NO: 147761 - DNA, 25 bp, Rattus norvegicus
aggcttttcagcagcatggtcaatt

SEQ ID NO: 147762 - DNA, 25 bp, Rattus norvegicus
aggcttttcagctgcatggtcaatt

SEQ ID NO: 147763 - DNA, 25 bp, Rattus norvegicus
aggcttttctaaaattcttgctctc

SEQ ID NO: 147764 - DNA, 25 bp, Rattus norvegicus
aggcttttctaatattcttgctctc

SEQ ID NO: 147765 - DNA, 25 bp, Rattus norvegicus
aggcttttctgacctctgagctagc

SEQ ID NO: 147766 - DNA, 25 bp, Rattus norvegicus
aggcttttctgagctctgagctagc

SEQ ID NO: 147767 - DNA, 25 bp, Rattus norvegicus
aggcttttctgtcgccaaaccattc

SEQ ID NO: 147768 - DNA, 25 bp, Rattus norvegicus
aggcttttctgtggccaaaccattc

SEQ ID NO: 147769 - DNA, 25 bp, Rattus norvegicus
aggcttttgatcatgcactttggga

SEQ ID NO: 147770 - DNA, 25 bp, Rattus norvegicus
aggcttttgatcttgcactttggga

SEQ ID NO: 147771 - DNA, 25 bp, Rattus norvegicus
aggcttttgcctaagtatctggctc

SEQ ID NO: 147772 - DNA, 25 bp, Rattus norvegicus
aggcttttgcctatgtatgactttg

SEQ ID NO: 147773 - DNA, 25 bp, Rattus norvegicus
aggcttttgccttagtatctggctc

SEQ ID NO: 147774 - DNA, 25 bp, Rattus norvegicus
aggcttttgcctttgtatgactttg

SEQ ID NO: 147775 - DNA, 25 bp, Rattus norvegicus
aggcttttgctcactgagtcaagta

SEQ ID NO: 147776 - DNA, 25 bp, Rattus norvegicus
aggcttttgctctctgagtcaagta

SEQ ID NO: 147777 - DNA, 25 bp, Rattus norvegicus
aggctttttacaagtctttccacat

SEQ ID NO: 147778 - DNA, 25 bp, Rattus norvegicus
aggctttttacatgtctttccacat

SEQ ID NO: 147779 - DNA, 25 bp, Rattus norvegicus
agggaaaacaacagctcacttctcc

SEQ ID NO: 147780 - DNA, 25 bp, Rattus norvegicus
agggaaaacaactgctcacttctcc

SEQ ID NO: 147781 - DNA, 25 bp, Rattus norvegicus
agggaaaacagaccttcactcctcc

SEQ ID NO: 147782 - DNA, 25 bp, Rattus norvegicus
agggaaaacagagcttcactcctcc

SEQ ID NO: 147783 - DNA, 25 bp, Rattus norvegicus
agggaaaactgtccggccacatatc

SEQ ID NO: 147784 - DNA, 25 bp, Rattus norvegicus
agggaaaactgtgcggccacatatc

SEQ ID NO: 147785 - DNA, 25 bp, Rattus norvegicus
agggaaacaactcctcaggtgccat

SEQ ID NO: 147786 - DNA, 25 bp, Rattus norvegicus
agggaaacaactgctcaggtgccat

SEQ ID NO: 147787 - DNA, 25 bp, Rattus norvegicus
agggaaacagttccatccccaagca

SEQ ID NO: 147788 - DNA, 25 bp, Rattus norvegicus
agggaaacagttgcatccccaagca

SEQ ID NO: 147789 - DNA, 25 bp, Rattus norvegicus
agggaaaccatgatccttgctgcat

SEQ ID NO: 147790 - DNA, 25 bp, Rattus norvegicus
agggaaaccatgttccttgctgcat

SEQ ID NO: 147791 - DNA, 25 bp, Rattus norvegicus
agggaaaccgctccccagtggtcta

SEQ ID NO: 147792 - DNA, 25 bp, Rattus norvegicus
agggaaaccgctgcccagtggtcta

SEQ ID NO: 147793 - DNA, 25 bp, Rattus norvegicus
agggaaacgagtagcctggcttaat

SEQ ID NO: 147794 - DNA, 25 bp, Rattus norvegicus
agggaaacgagttgcctggcttaat

SEQ ID NO: 147795 - DNA, 25 bp, Rattus norvegicus
agggaaactgacacacttgtgactg

SEQ ID NO: 147796 - DNA, 25 bp, Rattus norvegicus
agggaaactgactcacttgtgactg

SEQ ID NO: 147797 - DNA, 25 bp, Rattus norvegicus
agggaaacttaaactctgaggccac

SEQ ID NO: 147798 - DNA, 25 bp, Rattus norvegicus
agggaaacttaatctctgaggccac

SEQ ID NO: 147799 - DNA, 25 bp, Rattus norvegicus
agggaaagaatcactctgtcgcctt

SEQ ID NO: 147800 - DNA, 25 bp, Rattus norvegicus
agggaaagaatctctctgtcgcctt

SEQ ID NO: 147801 - DNA, 25 bp, Rattus norvegicus
agggaaagagaccagctagaaagct

SEQ ID NO: 147802 - DNA, 25 bp, Rattus norvegicus
agggaaagagacgagctagaaagct

SEQ ID NO: 147803 - DNA, 25 bp, Rattus norvegicus
agggaaagagcaagccctgtgtgtc

SEQ ID NO: 147804 - DNA, 25 bp, Rattus norvegicus
agggaaagagcatgccctgtgtgtc

SEQ ID NO: 147805 - DNA, 25 bp, Rattus norvegicus
agggaaaggcgtccgcgcttcgcag

SEQ ID NO: 147806 - DNA, 25 bp, Rattus norvegicus
agggaaaggcgtgcgcgcttcgcag

SEQ ID NO: 147807 - DNA, 25 bp, Rattus norvegicus
agggaaagggccatttaatctctct

SEQ ID NO: 147808 - DNA, 25 bp, Rattus norvegicus
agggaaagggccttttaatctctct

SEQ ID NO: 147809 - DNA, 25 bp, Rattus norvegicus
agggaaaggtgtcataggctcatct

SEQ ID NO: 147810 - DNA, 25 bp, Rattus norvegicus
agggaaaggtgtgataggctcatct

SEQ ID NO: 147811 - DNA, 25 bp, Rattus norvegicus
agggaaatcctgacacatgaaatga

SEQ ID NO: 147812 - DNA, 25 bp, Rattus norvegicus
agggaaatcctgtcacatgaaatga

SEQ ID NO: 147813 - DNA, 25 bp, Rattus norvegicus
agggaacaagcccatcttcagcaac

SEQ ID NO: 147814 - DNA, 25 bp, Rattus norvegicus
agggaacaagccgatcttcagcaac

SEQ ID NO: 147815 - DNA, 25 bp, Rattus norvegicus
agggaacacctcaccaatgtttgtg

SEQ ID NO: 147816 - DNA, 25 bp, Rattus norvegicus
agggaacacctctccaatgtttgtg

SEQ ID NO: 147817 - DNA, 25 bp, Rattus norvegicus
agggaacacctgaggaagctgatcc

SEQ ID NO: 147818 - DNA, 25 bp, Rattus norvegicus
agggaacacctgtggaagctgatcc

SEQ ID NO: 147819 - DNA, 25 bp, Rattus norvegicus
agggaacactgaatgcgctccaccg

SEQ ID NO: 147820 - DNA, 25 bp, Rattus norvegicus
agggaacactgattgcgctccaccg

SEQ ID NO: 147821 - DNA, 25 bp, Rattus norvegicus
agggaacacttcagccactattttc

SEQ ID NO: 147822 - DNA, 25 bp, Rattus norvegicus
agggaacacttctgccactattttc

SEQ ID NO: 147823 - DNA, 25 bp, Rattus norvegicus
agggaacagcatcctaacctcaggc

SEQ ID NO: 147824 - DNA, 25 bp, Rattus norvegicus
agggaacagcatgctaacctcaggc

SEQ ID NO: 147825 - DNA, 25 bp, Rattus norvegicus
agggaacatccgcactgagacattg

SEQ ID NO: 147826 - DNA, 25 bp, Rattus norvegicus
agggaacatccggactgagacattg

SEQ ID NO: 147827 - DNA, 25 bp, Rattus norvegicus
agggaaccaggcctagtagcacacc

SEQ ID NO: 147828 - DNA, 25 bp, Rattus norvegicus
agggaaccaggcgtagtagcacacc

SEQ ID NO: 147829 - DNA, 25 bp, Rattus norvegicus
agggaaccattacctaaccacttgt

SEQ ID NO: 147830 - DNA, 25 bp, Rattus norvegicus
agggaaccattagctaaccacttgt

SEQ ID NO: 147831 - DNA, 25 bp, Rattus norvegicus
agggaaccccgccatctgaagagag

SEQ ID NO: 147832 - DNA, 25 bp, Rattus norvegicus
agggaaccccgcgatctgaagagag

SEQ ID NO: 147833 - DNA, 25 bp, Rattus norvegicus
agggaacctgagatggccatctcgg

SEQ ID NO: 147834 - DNA, 25 bp, Rattus norvegicus
agggaacctgagttggccatctcgg

SEQ ID NO: 147835 - DNA, 25 bp, Rattus norvegicus
agggaaccttggcagctacagcgct

SEQ ID NO: 147836 - DNA, 25 bp, Rattus norvegicus
agggaaccttgggagctacagcgct

SEQ ID NO: 147837 - DNA, 25 bp, Rattus norvegicus
agggaacgcctaatggcctgtggac

SEQ ID NO: 147838 - DNA, 25 bp, Rattus norvegicus
agggaacgcctattggcctgtggac

SEQ ID NO: 147839 - DNA, 25 bp, Rattus norvegicus
agggaacgtgcaaccctcgcagccg

SEQ ID NO: 147840 - DNA, 25 bp, Rattus norvegicus
agggaacgtgcatccctcgcagccg

SEQ ID NO: 147841 - DNA, 25 bp, Rattus norvegicus
agggaacgttgcagaacagcttcga

SEQ ID NO: 147842 - DNA, 25 bp, Rattus norvegicus
agggaacgttgctgaacagcttcga

SEQ ID NO: 147843 - DNA, 25 bp, Rattus norvegicus
agggaactaagtcaacagctgtgct

SEQ ID NO: 147844 - DNA, 25 bp, Rattus norvegicus
agggaactaagtgaacagctgtgct

SEQ ID NO: 147845 - DNA, 25 bp, Rattus norvegicus
agggaactatacaggccaatgctct

SEQ ID NO: 147846 - DNA, 25 bp, Rattus norvegicus
agggaactatactggccaatgctct

SEQ ID NO: 147847 - DNA, 25 bp, Rattus norvegicus
agggaactccatccttgatagagac

SEQ ID NO: 147848 - DNA, 25 bp, Rattus norvegicus
agggaactccatgcttgatagagac

SEQ ID NO: 147849 - DNA, 25 bp, Rattus norvegicus
agggaactctgcagtctgagcacat

SEQ ID NO: 147850 - DNA, 25 bp, Rattus norvegicus
agggaactctgctgtctgagcacat

SEQ ID NO: 147851 - DNA, 25 bp, Rattus norvegicus
agggaactgaagactgtgctggaac

SEQ ID NO: 147852 - DNA, 25 bp, Rattus norvegicus
agggaactgaagtctgtgctggaac

SEQ ID NO: 147853 - DNA, 25 bp, Rattus norvegicus
agggaactgacaccactgactgcaa

SEQ ID NO: 147854 - DNA, 25 bp, Rattus norvegicus
agggaactgacagcactgactgcaa

SEQ ID NO: 147855 - DNA, 25 bp, Rattus norvegicus
agggaactgccactcctggttgcca

SEQ ID NO: 147856 - DNA, 25 bp, Rattus norvegicus
agggaactgccagtcctggttgcca

SEQ ID NO: 147857 - DNA, 25 bp, Rattus norvegicus
agggaacttcacaggagagctgagt

SEQ ID NO: 147858 - DNA, 25 bp, Rattus norvegicus
agggaacttcactggagagctgagt

SEQ ID NO: 147859 - DNA, 25 bp, Rattus norvegicus
agggaacttcctatagcagcagcaa

SEQ ID NO: 147860 - DNA, 25 bp, Rattus norvegicus
agggaacttcctttagcagcagcaa

SEQ ID NO: 147861 - DNA, 25 bp, Rattus norvegicus
agggaacttctcaggcatggctttg

SEQ ID NO: 147862 - DNA, 25 bp, Rattus norvegicus
agggaacttctctggcatggctttg

SEQ ID NO: 147863 - DNA, 25 bp, Rattus norvegicus
agggaagacgttcacaactgttagt

SEQ ID NO: 147864 - DNA, 25 bp, Rattus norvegicus
agggaagacgttgacaactgttagt

SEQ ID NO: 147865 - DNA, 25 bp, Rattus norvegicus
agggaagacttgctccctctgagtc

SEQ ID NO: 147866 - DNA, 25 bp, Rattus norvegicus
agggaagacttggtccctctgagtc

SEQ ID NO: 147867 - DNA, 25 bp, Rattus norvegicus
agggaagagaggattccaccatgtt

SEQ ID NO: 147868 - DNA, 25 bp, Rattus norvegicus
agggaagagaggtttccaccatgtt

SEQ ID NO: 147869 - DNA, 25 bp, Rattus norvegicus
agggaagagcccctcagatgtttcc

SEQ ID NO: 147870 - DNA, 25 bp, Rattus norvegicus
agggaagagcccgtcagatgtttcc

SEQ ID NO: 147871 - DNA, 25 bp, Rattus norvegicus
agggaagagccgactcaatccatgt

SEQ ID NO: 147872 - DNA, 25 bp, Rattus norvegicus
agggaagagccgtctcaatccatgt

SEQ ID NO: 147873 - DNA, 25 bp, Rattus norvegicus
agggaagaggtgactacctgccctc

SEQ ID NO: 147874 - DNA, 25 bp, Rattus norvegicus
agggaagaggtgtctacctgccctc

SEQ ID NO: 147875 - DNA, 25 bp, Rattus norvegicus
agggaagatcatcgcccctctctgg

SEQ ID NO: 147876 - DNA, 25 bp, Rattus norvegicus
agggaagatcatggcccctctctgg

SEQ ID NO: 147877 - DNA, 25 bp, Rattus norvegicus
agggaagcaccacttctcagaaaca

SEQ ID NO: 147878 - DNA, 25 bp, Rattus norvegicus
agggaagcaccagttctcagaaaca

SEQ ID NO: 147879 - DNA, 25 bp, Rattus norvegicus
agggaagcacttatctagttgtctg

SEQ ID NO: 147880 - DNA, 25 bp, Rattus norvegicus
agggaagcacttttctagttgtctg

SEQ ID NO: 147881 - DNA, 25 bp, Rattus norvegicus
agggaagcagtcaggtcctccgttg

SEQ ID NO: 147882 - DNA, 25 bp, Rattus norvegicus
agggaagcagtctggtcctccgttg

SEQ ID NO: 147883 - DNA, 25 bp, Rattus norvegicus
agggaagccagcatggtggcctaaa

SEQ ID NO: 147884 - DNA, 25 bp, Rattus norvegicus
agggaagccagcttggtggcctaaa

SEQ ID NO: 147885 - DNA, 25 bp, Rattus norvegicus
agggaagccaggctcctcgtgcctt

SEQ ID NO: 147886 - DNA, 25 bp, Rattus norvegicus
agggaagccagggtcctcgtgcctt

SEQ ID NO: 147887 - DNA, 25 bp, Rattus norvegicus
agggaagccattaatcctgcttatc

SEQ ID NO: 147888 - DNA, 25 bp, Rattus norvegicus
agggaagccatttatcctgcttatc

SEQ ID NO: 147889 - DNA, 25 bp, Rattus norvegicus
agggaagcccatactggataacaat

SEQ ID NO: 147890 - DNA, 25 bp, Rattus norvegicus
agggaagcccattctggataacaat

SEQ ID NO: 147891 - DNA, 25 bp, Rattus norvegicus
agggaagccctaacagatcccagtc

SEQ ID NO: 147892 - DNA, 25 bp, Rattus norvegicus
agggaagccctatcagatcccagtc

SEQ ID NO: 147893 - DNA, 25 bp, Rattus norvegicus
agggaagcccttcttattggtctca

SEQ ID NO: 147894 - DNA, 25 bp, Rattus norvegicus
agggaagcccttgttattggtctca

SEQ ID NO: 147895 - DNA, 25 bp, Rattus norvegicus
agggaagcctccaagtcagattagt

SEQ ID NO: 147896 - DNA, 25 bp, Rattus norvegicus
agggaagcctccagaaaggccttca

SEQ ID NO: 147897 - DNA, 25 bp, Rattus norvegicus
agggaagcctcctagtcagattagt

SEQ ID NO: 147898 - DNA, 25 bp, Rattus norvegicus
agggaagcctcctgaaaggccttca

SEQ ID NO: 147899 - DNA, 25 bp, Rattus norvegicus
agggaagcctgactccagctgtcaa

SEQ ID NO: 147900 - DNA, 25 bp, Rattus norvegicus
agggaagcctgagtccagctgtcaa

SEQ ID NO: 147901 - DNA, 25 bp, Rattus norvegicus
agggaagcgtccacactggcagatg

SEQ ID NO: 147902 - DNA, 25 bp, Rattus norvegicus
agggaagcgtcctcactggcagatg

SEQ ID NO: 147903 - DNA, 25 bp, Rattus norvegicus
agggaagctatgcacctgactgtct

SEQ ID NO: 147904 - DNA, 25 bp, Rattus norvegicus
agggaagctatggacctgactgtct

SEQ ID NO: 147905 - DNA, 25 bp, Rattus norvegicus
agggaagctgtcacacctgcctgga

SEQ ID NO: 147906 - DNA, 25 bp, Rattus norvegicus
agggaagctgtctcacctgcctgga

SEQ ID NO: 147907 - DNA, 25 bp, Rattus norvegicus
agggaaggacacaactccagcttgt

SEQ ID NO: 147908 - DNA, 25 bp, Rattus norvegicus
agggaaggacactactccagcttgt

SEQ ID NO: 147909 - DNA, 25 bp, Rattus norvegicus
agggaaggatgtcctatttcctgtt

SEQ ID NO: 147910 - DNA, 25 bp, Rattus norvegicus
agggaaggatgtgctatttcctgtt

SEQ ID NO: 147911 - DNA, 25 bp, Rattus norvegicus
agggaaggcacccttcctctgtact

SEQ ID NO: 147912 - DNA, 25 bp, Rattus norvegicus
agggaaggcaccgttcctctgtact

SEQ ID NO: 147913 - DNA, 25 bp, Rattus norvegicus
agggaaggcatccagaaggctcttt

SEQ ID NO: 147914 - DNA, 25 bp, Rattus norvegicus
agggaaggcatcgagaaggctcttt

SEQ ID NO: 147915 - DNA, 25 bp, Rattus norvegicus
agggaaggccacatggtctaccccg

SEQ ID NO: 147916 - DNA, 25 bp, Rattus norvegicus
agggaaggccacttggtctaccccg

SEQ ID NO: 147917 - DNA, 25 bp, Rattus norvegicus
agggaaggccagagccttgtcctgt

SEQ ID NO: 147918 - DNA, 25 bp, Rattus norvegicus
agggaaggccagtgccttgtcctgt

SEQ ID NO: 147919 - DNA, 25 bp, Rattus norvegicus
agggaagggaacaccagtcagaact

SEQ ID NO: 147920 - DNA, 25 bp, Rattus norvegicus
agggaagggaactccagtcagaact

SEQ ID NO: 147921 - DNA, 25 bp, Rattus norvegicus
agggaagggacactccccagacata

SEQ ID NO: 147922 - DNA, 25 bp, Rattus norvegicus
agggaagggacagtccccagacata

SEQ ID NO: 147923 - DNA, 25 bp, Rattus norvegicus
agggaagggaccagtcgccagactt

SEQ ID NO: 147924 - DNA, 25 bp, Rattus norvegicus
agggaagggacctgtcgccagactt

SEQ ID NO: 147925 - DNA, 25 bp, Rattus norvegicus
agggaagggcacagctcaggacatc

SEQ ID NO: 147926 - DNA, 25 bp, Rattus norvegicus
agggaagggcactgctcaggacatc

SEQ ID NO: 147927 - DNA, 25 bp, Rattus norvegicus
agggaaggttccctctcagctggcc

SEQ ID NO: 147928 - DNA, 25 bp, Rattus norvegicus
agggaaggttccgtctcagctggcc

SEQ ID NO: 147929 - DNA, 25 bp, Rattus norvegicus
agggaaggtttgacagctgctatag

SEQ ID NO: 147930 - DNA, 25 bp, Rattus norvegicus
agggaaggtttgtcagctgctatag

SEQ ID NO: 147931 - DNA, 25 bp, Rattus norvegicus
agggaagtatgtccctcctagtctc

SEQ ID NO: 147932 - DNA, 25 bp, Rattus norvegicus
agggaagtatgtgcctcctagtctc

SEQ ID NO: 147933 - DNA, 25 bp, Rattus norvegicus
agggaagtctggcatgccactccaa

SEQ ID NO: 147934 - DNA, 25 bp, Rattus norvegicus
agggaagtctgggatgccactccaa

SEQ ID NO: 147935 - DNA, 25 bp, Rattus norvegicus
agggaagtgtgccatctgctcccag

SEQ ID NO: 147936 - DNA, 25 bp, Rattus norvegicus
agggaagtgtgcgatctgctcccag

SEQ ID NO: 147937 - DNA, 25 bp, Rattus norvegicus
agggaagtgttaaactatatctata

SEQ ID NO: 147938 - DNA, 25 bp, Rattus norvegicus
agggaagtgttatactatatctata

SEQ ID NO: 147939 - DNA, 25 bp, Rattus norvegicus
agggaagttggcagacagaacgttt

SEQ ID NO: 147940 - DNA, 25 bp, Rattus norvegicus
agggaagttggctgacagaacgttt

SEQ ID NO: 147941 - DNA, 25 bp, Rattus norvegicus
agggaataacacaccaactctccat

SEQ ID NO: 147942 - DNA, 25 bp, Rattus norvegicus
agggaataacactccaactctccat

SEQ ID NO: 147943 - DNA, 25 bp, Rattus norvegicus
agggaatacctcaccaagcatcaga

SEQ ID NO: 147944 - DNA, 25 bp, Rattus norvegicus
agggaatacctcaggttgctccgca

SEQ ID NO: 147945 - DNA, 25 bp, Rattus norvegicus
agggaatacctctccaagcatcaga

SEQ ID NO: 147946 - DNA, 25 bp, Rattus norvegicus
agggaatacctctggttgctccgca

SEQ ID NO: 147947 - DNA, 25 bp, Rattus norvegicus
agggaataggacattgcttagagca

SEQ ID NO: 147948 - DNA, 25 bp, Rattus norvegicus
agggaataggactttgcttagagca

SEQ ID NO: 147949 - DNA, 25 bp, Rattus norvegicus
agggaatcacccagagtaccttgct

SEQ ID NO: 147950 - DNA, 25 bp, Rattus norvegicus
agggaatcaccctgagtaccttgct

SEQ ID NO: 147951 - DNA, 25 bp, Rattus norvegicus
agggaatccagaccagcaggaagat

SEQ ID NO: 147952 - DNA, 25 bp, Rattus norvegicus
agggaatccagagcagcaggaagat

SEQ ID NO: 147953 - DNA, 25 bp, Rattus norvegicus
agggaatcccaaagccgctgactct

SEQ ID NO: 147954 - DNA, 25 bp, Rattus norvegicus
agggaatcccaatgccgctgactct

SEQ ID NO: 147955 - DNA, 25 bp, Rattus norvegicus
agggaatcccacagtgctgagagca

SEQ ID NO: 147956 - DNA, 25 bp, Rattus norvegicus
agggaatcccactgtgctgagagca

SEQ ID NO: 147957 - DNA, 25 bp, Rattus norvegicus
agggaatccctcctgttgcctggtc

SEQ ID NO: 147958 - DNA, 25 bp, Rattus norvegicus
agggaatccctcgtgttgcctggtc

SEQ ID NO: 147959 - DNA, 25 bp, Rattus norvegicus
agggaatccttacgatgctgatgac

SEQ ID NO: 147960 - DNA, 25 bp, Rattus norvegicus
agggaatccttaggatgctgatgac

SEQ ID NO: 147961 - DNA, 25 bp, Rattus norvegicus
agggaatcgtaacaccttctggcct

SEQ ID NO: 147962 - DNA, 25 bp, Rattus norvegicus
agggaatcgtaagaccttctggcct

SEQ ID NO: 147963 - DNA, 25 bp, Rattus norvegicus
agggaatctaacacctctggtcttt

SEQ ID NO: 147964 - DNA, 25 bp, Rattus norvegicus
agggaatctaactcctctggtcttt

SEQ ID NO: 147965 - DNA, 25 bp, Rattus norvegicus
agggaatctgggactgctcacctga

SEQ ID NO: 147966 - DNA, 25 bp, Rattus norvegicus
agggaatctgggtctgctcacctga

SEQ ID NO: 147967 - DNA, 25 bp, Rattus norvegicus
agggaatctttactttctgccgtca

SEQ ID NO: 147968 - DNA, 25 bp, Rattus norvegicus
agggaatctttagtttctgccgtca

SEQ ID NO: 147969 - DNA, 25 bp, Rattus norvegicus
agggaatgagtcactcttctggtcc

SEQ ID NO: 147970 - DNA, 25 bp, Rattus norvegicus
agggaatgagtctctcttctggtcc

SEQ ID NO: 147971 - DNA, 25 bp, Rattus norvegicus
agggaatgcctaagctttcctggca

SEQ ID NO: 147972 - DNA, 25 bp, Rattus norvegicus
agggaatgcctatgctttcctggca

SEQ ID NO: 147973 - DNA, 25 bp, Rattus norvegicus
agggaatgcttcctggaccttgcaa

SEQ ID NO: 147974 - DNA, 25 bp, Rattus norvegicus
agggaatgcttcgtggaccttgcaa

SEQ ID NO: 147975 - DNA, 25 bp, Rattus norvegicus
agggaattaacaaagtacgcatagg

SEQ ID NO: 147976 - DNA, 25 bp, Rattus norvegicus
agggaattaacatagtacgcatagg

SEQ ID NO: 147977 - DNA, 25 bp, Rattus norvegicus
agggaattacacctacagtctaaag

SEQ ID NO: 147978 - DNA, 25 bp, Rattus norvegicus
agggaattacacgtacagtctaaag

SEQ ID NO: 147979 - DNA, 25 bp, Rattus norvegicus
agggaattacccaacgtggccatat

SEQ ID NO: 147980 - DNA, 25 bp, Rattus norvegicus
agggaattaccctacgtggccatat

SEQ ID NO: 147981 - DNA, 25 bp, Rattus norvegicus
agggaattccaacccatctaagact

SEQ ID NO: 147982 - DNA, 25 bp, Rattus norvegicus
agggaattccaagccatctaagact

SEQ ID NO: 147983 - DNA, 25 bp, Rattus norvegicus
agggaattgggcctcctgatattct

SEQ ID NO: 147984 - DNA, 25 bp, Rattus norvegicus
agggaattgggcgtcctgatattct

SEQ ID NO: 147985 - DNA, 25 bp, Rattus norvegicus
agggaattggtaatgccgatggaca

SEQ ID NO: 147986 - DNA, 25 bp, Rattus norvegicus
agggaattggtattgccgatggaca

SEQ ID NO: 147987 - DNA, 25 bp, Rattus norvegicus
agggaattgtgtatactgagcacct

SEQ ID NO: 147988 - DNA, 25 bp, Rattus norvegicus
agggaattgtgtttactgagcacct

SEQ ID NO: 147989 - DNA, 25 bp, Rattus norvegicus
agggacaaacctatcacattcactc

SEQ ID NO: 147990 - DNA, 25 bp, Rattus norvegicus
agggacaaacctctggcccagcagg

SEQ ID NO: 147991 - DNA, 25 bp, Rattus norvegicus
agggacaaacctgtggcccagcagg

SEQ ID NO: 147992 - DNA, 25 bp, Rattus norvegicus
agggacaaacctttcacattcactc

SEQ ID NO: 147993 - DNA, 25 bp, Rattus norvegicus
agggacaaatgcaacctttccagac

SEQ ID NO: 147994 - DNA, 25 bp, Rattus norvegicus
agggacaaatgctacctttccagac

SEQ ID NO: 147995 - DNA, 25 bp, Rattus norvegicus
agggacaaattcatcttggctcacc

SEQ ID NO: 147996 - DNA, 25 bp, Rattus norvegicus
agggacaaattcttcttggctcacc

SEQ ID NO: 147997 - DNA, 25 bp, Rattus norvegicus
agggacaaatttactcagctgaggt

SEQ ID NO: 147998 - DNA, 25 bp, Rattus norvegicus
agggacaaattttctcagctgaggt

SEQ ID NO: 147999 - DNA, 25 bp, Rattus norvegicus
agggacaacccaactgtagggcatt

SEQ ID NO: 148000 - DNA, 25 bp, Rattus norvegicus
agggacaacccatctgtagggcatt

SEQ ID NO: 148001 - DNA, 25 bp, Rattus norvegicus
agggacaactgcaaccttgtgggac

SEQ ID NO: 148002 - DNA, 25 bp, Rattus norvegicus
agggacaactgctaccttgtgggac

SEQ ID NO: 148003 - DNA, 25 bp, Rattus norvegicus
agggacaagcctcatacatctgcgc

SEQ ID NO: 148004 - DNA, 25 bp, Rattus norvegicus
agggacaagcctgatacatctgcgc

SEQ ID NO: 148005 - DNA, 25 bp, Rattus norvegicus
agggacaagcttaactctgagtagg

SEQ ID NO: 148006 - DNA, 25 bp, Rattus norvegicus
agggacaagctttactctgagtagg

SEQ ID NO: 148007 - DNA, 25 bp, Rattus norvegicus
agggacaaggacatctgcagaagca

SEQ ID NO: 148008 - DNA, 25 bp, Rattus norvegicus
agggacaaggacttctgcagaagca

SEQ ID NO: 148009 - DNA, 25 bp, Rattus norvegicus
agggacaatctcattgtcctgtggg

SEQ ID NO: 148010 - DNA, 25 bp, Rattus norvegicus
agggacaatctctttgtcctgtggg

SEQ ID NO: 148011 - DNA, 25 bp, Rattus norvegicus
agggacaatggcctctgcagagcaa

SEQ ID NO: 148012 - DNA, 25 bp, Rattus norvegicus
agggacaatggcgtctgcagagcaa

SEQ ID NO: 148013 - DNA, 25 bp, Rattus norvegicus
agggacaatggtagctctgttcctc

SEQ ID NO: 148014 - DNA, 25 bp, Rattus norvegicus
agggacaatggttgctctgttcctc

SEQ ID NO: 148015 - DNA, 25 bp, Rattus norvegicus
agggacaatgtcatctgtatgttct

SEQ ID NO: 148016 - DNA, 25 bp, Rattus norvegicus
agggacaatgtcttctgtatgttct

SEQ ID NO: 148017 - DNA, 25 bp, Rattus norvegicus
agggacacaaccatggctctgaaca

SEQ ID NO: 148018 - DNA, 25 bp, Rattus norvegicus
agggacacaaccttggctctgaaca

SEQ ID NO: 148019 - DNA, 25 bp, Rattus norvegicus
agggacacacagattcgacggcatc

SEQ ID NO: 148020 - DNA, 25 bp, Rattus norvegicus
agggacacacagcttcctgcctctt

SEQ ID NO: 148021 - DNA, 25 bp, Rattus norvegicus
agggacacacaggttcctgcctctt

SEQ ID NO: 148022 - DNA, 25 bp, Rattus norvegicus
agggacacacagtttcgacggcatc

SEQ ID NO: 148023 - DNA, 25 bp, Rattus norvegicus
agggacacacatcacttccttcgta

SEQ ID NO: 148024 - DNA, 25 bp, Rattus norvegicus
agggacacacatgacttccttcgta

SEQ ID NO: 148025 - DNA, 25 bp, Rattus norvegicus
agggacacaccaccaagcagcggag

SEQ ID NO: 148026 - DNA, 25 bp, Rattus norvegicus
agggacacaccagcaagcagcggag

SEQ ID NO: 148027 - DNA, 25 bp, Rattus norvegicus
agggacacagaccatcagtttcttc

SEQ ID NO: 148028 - DNA, 25 bp, Rattus norvegicus
agggacacagacgatcagtttcttc

SEQ ID NO: 148029 - DNA, 25 bp, Rattus norvegicus
agggacacccctctatcatagtgga

SEQ ID NO: 148030 - DNA, 25 bp, Rattus norvegicus
agggacacccctgtatcatagtgga

SEQ ID NO: 148031 - DNA, 25 bp, Rattus norvegicus
agggacacccgcagttgggcctgac

SEQ ID NO: 148032 - DNA, 25 bp, Rattus norvegicus
agggacacccgctgttgggcctgac

SEQ ID NO: 148033 - DNA, 25 bp, Rattus norvegicus
agggacacgccaacatcagccggac

SEQ ID NO: 148034 - DNA, 25 bp, Rattus norvegicus
agggacacgccatcatcagccggac

SEQ ID NO: 148035 - DNA, 25 bp, Rattus norvegicus
agggacactcctaggttggtgatct

SEQ ID NO: 148036 - DNA, 25 bp, Rattus norvegicus
agggacactccttggttggtgatct

SEQ ID NO: 148037 - DNA, 25 bp, Rattus norvegicus
agggacactgtgagctgcttttcac

SEQ ID NO: 148038 - DNA, 25 bp, Rattus norvegicus
agggacactgtgtgctgcttttcac

SEQ ID NO: 148039 - DNA, 25 bp, Rattus norvegicus
agggacacttgtaatcttcagggac

SEQ ID NO: 148040 - DNA, 25 bp, Rattus norvegicus
agggacacttgttatcttcagggac

SEQ ID NO: 148041 - DNA, 25 bp, Rattus norvegicus
agggacagaaacagcccggcaatcc

SEQ ID NO: 148042 - DNA, 25 bp, Rattus norvegicus
agggacagaaactgcccggcaatcc

SEQ ID NO: 148043 - DNA, 25 bp, Rattus norvegicus
agggacagacaccttctgagcagga

SEQ ID NO: 148044 - DNA, 25 bp, Rattus norvegicus
agggacagacacgttctgagcagga

SEQ ID NO: 148045 - DNA, 25 bp, Rattus norvegicus
agggacagacgactctcccaggctt

SEQ ID NO: 148046 - DNA, 25 bp, Rattus norvegicus
agggacagacgagtctcccaggctt

SEQ ID NO: 148047 - DNA, 25 bp, Rattus norvegicus
agggacagcagcctggtctccacag

SEQ ID NO: 148048 - DNA, 25 bp, Rattus norvegicus
agggacagcagcgtggtctccacag

SEQ ID NO: 148049 - DNA, 25 bp, Rattus norvegicus
agggacagcgcaactcttaggagtg

SEQ ID NO: 148050 - DNA, 25 bp, Rattus norvegicus
agggacagcgcatctcttaggagtg

SEQ ID NO: 148051 - DNA, 25 bp, Rattus norvegicus
agggacagctcacaccacgttgttt

SEQ ID NO: 148052 - DNA, 25 bp, Rattus norvegicus
agggacagctcacgctcttggtgac

SEQ ID NO: 148053 - DNA, 25 bp, Rattus norvegicus
agggacagctcagaccacgttgttt

SEQ ID NO: 148054 - DNA, 25 bp, Rattus norvegicus
agggacagctcaggctcttggtgac

SEQ ID NO: 148055 - DNA, 25 bp, Rattus norvegicus
agggacaggtggctcatcaccgtca

SEQ ID NO: 148056 - DNA, 25 bp, Rattus norvegicus
agggacaggtgggtcatcaccgtca

SEQ ID NO: 148057 - DNA, 25 bp, Rattus norvegicus
agggacagtagacggccctccttag

SEQ ID NO: 148058 - DNA, 25 bp, Rattus norvegicus
agggacagtagagggccctccttag

SEQ ID NO: 148059 - DNA, 25 bp, Rattus norvegicus
agggacagtcagcaactcctggtta

SEQ ID NO: 148060 - DNA, 25 bp, Rattus norvegicus
agggacagtcaggaactcctggtta

SEQ ID NO: 148061 - DNA, 25 bp, Rattus norvegicus
agggacagtctgagccaggcctaat

SEQ ID NO: 148062 - DNA, 25 bp, Rattus norvegicus
agggacagtctgtgccaggcctaat

SEQ ID NO: 148063 - DNA, 25 bp, Rattus norvegicus
agggacagtgataccgaggacgact

SEQ ID NO: 148064 - DNA, 25 bp, Rattus norvegicus
agggacagtgattccgaggacgact

SEQ ID NO: 148065 - DNA, 25 bp, Rattus norvegicus
agggacagttttactctagtatgac

SEQ ID NO: 148066 - DNA, 25 bp, Rattus norvegicus
agggacagtttttctctagtatgac

SEQ ID NO: 148067 - DNA, 25 bp, Rattus norvegicus
agggacatatttcacctctgctagt

SEQ ID NO: 148068 - DNA, 25 bp, Rattus norvegicus
agggacatatttgacctctgctagt

SEQ ID NO: 148069 - DNA, 25 bp, Rattus norvegicus
agggacatcatcacttctgggagtg

SEQ ID NO: 148070 - DNA, 25 bp, Rattus norvegicus
agggacatcatcagacaccttggct

SEQ ID NO: 148071 - DNA, 25 bp, Rattus norvegicus
agggacatcatctcttctgggagtg

SEQ ID NO: 148072 - DNA, 25 bp, Rattus norvegicus
agggacatcatctgacaccttggct

SEQ ID NO: 148073 - DNA, 25 bp, Rattus norvegicus
agggacatctatcctgcttgggcca

SEQ ID NO: 148074 - DNA, 25 bp, Rattus norvegicus
agggacatctatgctgcttgggcca

SEQ ID NO: 148075 - DNA, 25 bp, Rattus norvegicus
agggacatctctacactgttcccat

SEQ ID NO: 148076 - DNA, 25 bp, Rattus norvegicus
agggacatctcttcactgttcccat

SEQ ID NO: 148077 - DNA, 25 bp, Rattus norvegicus
agggacatcttaagctgtcttgaca

SEQ ID NO: 148078 - DNA, 25 bp, Rattus norvegicus
agggacatcttatgctgtcttgaca

SEQ ID NO: 148079 - DNA, 25 bp, Rattus norvegicus
agggacatgcttcctcagaccagtg

SEQ ID NO: 148080 - DNA, 25 bp, Rattus norvegicus
agggacatgcttgctcagaccagtg

SEQ ID NO: 148081 - DNA, 25 bp, Rattus norvegicus
agggacatggaactccgtcacggaa

SEQ ID NO: 148082 - DNA, 25 bp, Rattus norvegicus
agggacatggaagtccgtcacggaa

SEQ ID NO: 148083 - DNA, 25 bp, Rattus norvegicus
agggacatggccaccaggacacagt

SEQ ID NO: 148084 - DNA, 25 bp, Rattus norvegicus
agggacatggcctccaggacacagt

SEQ ID NO: 148085 - DNA, 25 bp, Rattus norvegicus
agggacatgtccatggcacttgact

SEQ ID NO: 148086 - DNA, 25 bp, Rattus norvegicus
agggacatgtccttggcacttgact

SEQ ID NO: 148087 - DNA, 25 bp, Rattus norvegicus
agggacattacaccctgacccagat

SEQ ID NO: 148088 - DNA, 25 bp, Rattus norvegicus
agggacattacagcctgacccagat

SEQ ID NO: 148089 - DNA, 25 bp, Rattus norvegicus
agggacattctacgcctgggtacaa

SEQ ID NO: 148090 - DNA, 25 bp, Rattus norvegicus
agggacattctaggcctgggtacaa

SEQ ID NO: 148091 - DNA, 25 bp, Rattus norvegicus
agggacattgaaacctgccttcaaa

SEQ ID NO: 148092 - DNA, 25 bp, Rattus norvegicus
agggacattgaatcctgccttcaaa

SEQ ID NO: 148093 - DNA, 25 bp, Rattus norvegicus
agggacatttgtctgcagctggaca

SEQ ID NO: 148094 - DNA, 25 bp, Rattus norvegicus
agggacatttgtgtgcagctggaca

SEQ ID NO: 148095 - DNA, 25 bp, Rattus norvegicus
agggaccaagaacctgcatgtctct

SEQ ID NO: 148096 - DNA, 25 bp, Rattus norvegicus
agggaccaagaagctgcatgtctct

SEQ ID NO: 148097 - DNA, 25 bp, Rattus norvegicus
agggaccaaggtcctagccacgctg

SEQ ID NO: 148098 - DNA, 25 bp, Rattus norvegicus
agggaccaaggtgctagccacgctg

SEQ ID NO: 148099 - DNA, 25 bp, Rattus norvegicus
agggaccaatagaccaggtgaccct

SEQ ID NO: 148100 - DNA, 25 bp, Rattus norvegicus
agggaccaatagtccaggtgaccct

SEQ ID NO: 148101 - DNA, 25 bp, Rattus norvegicus
agggaccacatgcagaccttggctg

SEQ ID NO: 148102 - DNA, 25 bp, Rattus norvegicus
agggaccacatggagaccttggctg

SEQ ID NO: 148103 - DNA, 25 bp, Rattus norvegicus
agggaccaccgtccagtgttctgga

SEQ ID NO: 148104 - DNA, 25 bp, Rattus norvegicus
agggaccaccgtgcagtgttctgga

SEQ ID NO: 148105 - DNA, 25 bp, Rattus norvegicus
agggaccacgtaagggcatttgaaa

SEQ ID NO: 148106 - DNA, 25 bp, Rattus norvegicus
agggaccacgtatgggcatttgaaa

SEQ ID NO: 148107 - DNA, 25 bp, Rattus norvegicus
agggaccagcccatagaggagccga

SEQ ID NO: 148108 - DNA, 25 bp, Rattus norvegicus
agggaccagcccttagaggagccga

SEQ ID NO: 148109 - DNA, 25 bp, Rattus norvegicus
agggaccagcctcatttgaactatt

SEQ ID NO: 148110 - DNA, 25 bp, Rattus norvegicus
agggaccagcctgatttgaactatt

SEQ ID NO: 148111 - DNA, 25 bp, Rattus norvegicus
agggaccagctcagttgcatggcag

SEQ ID NO: 148112 - DNA, 25 bp, Rattus norvegicus
agggaccagctctgttgcatggcag

SEQ ID NO: 148113 - DNA, 25 bp, Rattus norvegicus
agggaccaggaaactccatgaggaa

SEQ ID NO: 148114 - DNA, 25 bp, Rattus norvegicus
agggaccaggaatctccatgaggaa

SEQ ID NO: 148115 - DNA, 25 bp, Rattus norvegicus
agggaccaggccagcatcatgcttc

SEQ ID NO: 148116 - DNA, 25 bp, Rattus norvegicus
agggaccaggcctgcatcatgcttc

SEQ ID NO: 148117 - DNA, 25 bp, Rattus norvegicus
agggaccaggtcattctcacttgtc

SEQ ID NO: 148118 - DNA, 25 bp, Rattus norvegicus
agggaccaggtctttctcacttgtc

SEQ ID NO: 148119 - DNA, 25 bp, Rattus norvegicus
agggaccatcggctccactattgtc

SEQ ID NO: 148120 - DNA, 25 bp, Rattus norvegicus
agggaccatcgggtccactattgtc

SEQ ID NO: 148121 - DNA, 25 bp, Rattus norvegicus
agggaccatggtacctagatctcac

SEQ ID NO: 148122 - DNA, 25 bp, Rattus norvegicus
agggaccatggttcctagatctcac

SEQ ID NO: 148123 - DNA, 25 bp, Rattus norvegicus
agggaccatgttcggcctctgtgca

SEQ ID NO: 148124 - DNA, 25 bp, Rattus norvegicus
agggaccatgttgggcctctgtgca

SEQ ID NO: 148125 - DNA, 25 bp, Rattus norvegicus
agggacccagccaacatgttattaa

SEQ ID NO: 148126 - DNA, 25 bp, Rattus norvegicus
agggacccagcctacatgttattaa

SEQ ID NO: 148127 - DNA, 25 bp, Rattus norvegicus
agggacccagctatcacgcaaattc

SEQ ID NO: 148128 - DNA, 25 bp, Rattus norvegicus
agggacccagctttcacgcaaattc

SEQ ID NO: 148129 - DNA, 25 bp, Rattus norvegicus
agggacccctgtagtatgtcctggc

SEQ ID NO: 148130 - DNA, 25 bp, Rattus norvegicus
agggacccctgttgtatgtcctggc

SEQ ID NO: 148131 - DNA, 25 bp, Rattus norvegicus
agggaccgacttctattcagcagtt

SEQ ID NO: 148132 - DNA, 25 bp, Rattus norvegicus
agggaccgacttgtattcagcagtt

SEQ ID NO: 148133 - DNA, 25 bp, Rattus norvegicus
agggaccgcctgactggacgcccgc

SEQ ID NO: 148134 - DNA, 25 bp, Rattus norvegicus
agggaccgcctgtctggacgcccgc

SEQ ID NO: 148135 - DNA, 25 bp, Rattus norvegicus
agggaccggacaatcactcagtgag

SEQ ID NO: 148136 - DNA, 25 bp, Rattus norvegicus
agggaccggacattcactcagtgag

SEQ ID NO: 148137 - DNA, 25 bp, Rattus norvegicus
agggaccgtgacatcggtagcttgc

SEQ ID NO: 148138 - DNA, 25 bp, Rattus norvegicus
agggaccgtgacttcggtagcttgc

SEQ ID NO: 148139 - DNA, 25 bp, Rattus norvegicus
agggacctacatctttctgtttctc

SEQ ID NO: 148140 - DNA, 25 bp, Rattus norvegicus
agggacctacatgtttctgtttctc

SEQ ID NO: 148141 - DNA, 25 bp, Rattus norvegicus
agggacctctcaccgctgaaacaaa

SEQ ID NO: 148142 - DNA, 25 bp, Rattus norvegicus
agggacctctcagcgctgaaacaaa

SEQ ID NO: 148143 - DNA, 25 bp, Rattus norvegicus
agggacctctgaccacagcttctgc

SEQ ID NO: 148144 - DNA, 25 bp, Rattus norvegicus
agggacctctgagcacagcttctgc

SEQ ID NO: 148145 - DNA, 25 bp, Rattus norvegicus
agggacctgaacaccttcctgtgga

SEQ ID NO: 148146 - DNA, 25 bp, Rattus norvegicus
agggacctgaactccttcctgtgga

SEQ ID NO: 148147 - DNA, 25 bp, Rattus norvegicus
agggacctgacactctctagaccat

SEQ ID NO: 148148 - DNA, 25 bp, Rattus norvegicus
agggacctgacagtctctagaccat

SEQ ID NO: 148149 - DNA, 25 bp, Rattus norvegicus
agggacctgcatatcattattaaga

SEQ ID NO: 148150 - DNA, 25 bp, Rattus norvegicus
agggacctgcatttcattattaaga

SEQ ID NO: 148151 - DNA, 25 bp, Rattus norvegicus
agggacctgggcacgttcagtatcc

SEQ ID NO: 148152 - DNA, 25 bp, Rattus norvegicus
agggacctgggctcgttcagtatcc

SEQ ID NO: 148153 - DNA, 25 bp, Rattus norvegicus
agggaccttaatcgctggcggaact

SEQ ID NO: 148154 - DNA, 25 bp, Rattus norvegicus
agggaccttaatggctggcggaact

SEQ ID NO: 148155 - DNA, 25 bp, Rattus norvegicus
agggaccttgaaccagggcctcgta

SEQ ID NO: 148156 - DNA, 25 bp, Rattus norvegicus
agggaccttgaagcagggcctcgta

SEQ ID NO: 148157 - DNA, 25 bp, Rattus norvegicus
agggacgattgcatgggctacgcca

SEQ ID NO: 148158 - DNA, 25 bp, Rattus norvegicus
agggacgattgcttgggctacgcca

SEQ ID NO: 148159 - DNA, 25 bp, Rattus norvegicus
agggacgcccaacttgtcggacaca

SEQ ID NO: 148160 - DNA, 25 bp, Rattus norvegicus
agggacgcccaagttgtcggacaca

SEQ ID NO: 148161 - DNA, 25 bp, Rattus norvegicus
agggacggccccacgcgaaaagcag

SEQ ID NO: 148162 - DNA, 25 bp, Rattus norvegicus
agggacggcccctcgcgaaaagcag

SEQ ID NO: 148163 - DNA, 25 bp, Rattus norvegicus
agggacggtgacagcctggacctct

SEQ ID NO: 148164 - DNA, 25 bp, Rattus norvegicus
agggacggtgactgcctggacctct

SEQ ID NO: 148165 - DNA, 25 bp, Rattus norvegicus
agggacggtgctcagattgttacat

SEQ ID NO: 148166 - DNA, 25 bp, Rattus norvegicus
agggacggtgctgagattgttacat

SEQ ID NO: 148167 - DNA, 25 bp, Rattus norvegicus
agggacgtgaccaacatctggcttt

SEQ ID NO: 148168 - DNA, 25 bp, Rattus norvegicus
agggacgtgacctacatctggcttt

SEQ ID NO: 148169 - DNA, 25 bp, Rattus norvegicus
agggacgtgtgcagccacagagcta

SEQ ID NO: 148170 - DNA, 25 bp, Rattus norvegicus
agggacgtgtgctgccacagagcta

SEQ ID NO: 148171 - DNA, 25 bp, Rattus norvegicus
agggacgtttacactgcaggcagtt

SEQ ID NO: 148172 - DNA, 25 bp, Rattus norvegicus
agggacgtttactctgcaggcagtt

SEQ ID NO: 148173 - DNA, 25 bp, Rattus norvegicus
agggactaaggcctctgcattctat

SEQ ID NO: 148174 - DNA, 25 bp, Rattus norvegicus
agggactaaggcgtctgcattctat

SEQ ID NO: 148175 - DNA, 25 bp, Rattus norvegicus
agggactagccaaggctgactcttc

SEQ ID NO: 148176 - DNA, 25 bp, Rattus norvegicus
agggactagccatggctgactcttc

SEQ ID NO: 148177 - DNA, 25 bp, Rattus norvegicus
agggactaggtcaggctggccttac

SEQ ID NO: 148178 - DNA, 25 bp, Rattus norvegicus
agggactaggtctggctggccttac

SEQ ID NO: 148179 - DNA, 25 bp, Rattus norvegicus
agggactagtttcctgaccacagaa

SEQ ID NO: 148180 - DNA, 25 bp, Rattus norvegicus
agggactagtttgctgaccacagaa

SEQ ID NO: 148181 - DNA, 25 bp, Rattus norvegicus
agggactatgacaaagggcttactt

SEQ ID NO: 148182 - DNA, 25 bp, Rattus norvegicus
agggactatgacagtgactgtgact

SEQ ID NO: 148183 - DNA, 25 bp, Rattus norvegicus
agggactatgactaagggcttactt

SEQ ID NO: 148184 - DNA, 25 bp, Rattus norvegicus
agggactatgactgtgactgtgact

SEQ ID NO: 148185 - DNA, 25 bp, Rattus norvegicus
agggactccagtcctgaaaacctgg

SEQ ID NO: 148186 - DNA, 25 bp, Rattus norvegicus
agggactccagtgctgaaaacctgg

SEQ ID NO: 148187 - DNA, 25 bp, Rattus norvegicus
agggactcccacaatggccagaaat

SEQ ID NO: 148188 - DNA, 25 bp, Rattus norvegicus
agggactcccactatggccagaaat

SEQ ID NO: 148189 - DNA, 25 bp, Rattus norvegicus
agggactccgtacctcaccaaggtt

SEQ ID NO: 148190 - DNA, 25 bp, Rattus norvegicus
agggactccgtagctcaccaaggtt

SEQ ID NO: 148191 - DNA, 25 bp, Rattus norvegicus
agggactcctgacggctgatacaca

SEQ ID NO: 148192 - DNA, 25 bp, Rattus norvegicus
agggactcctgagggctgatacaca

SEQ ID NO: 148193 - DNA, 25 bp, Rattus norvegicus
agggactcgctgctctaaagtttga

SEQ ID NO: 148194 - DNA, 25 bp, Rattus norvegicus
agggactcgctggtctaaagtttga

SEQ ID NO: 148195 - DNA, 25 bp, Rattus norvegicus
agggactctctaagtagattaggca

SEQ ID NO: 148196 - DNA, 25 bp, Rattus norvegicus
agggactctctatgtagattaggca

SEQ ID NO: 148197 - DNA, 25 bp, Rattus norvegicus
agggactctggcagttacatctcat

SEQ ID NO: 148198 - DNA, 25 bp, Rattus norvegicus
agggactctggctgttacatctcat

SEQ ID NO: 148199 - DNA, 25 bp, Rattus norvegicus
agggactcttcaacacctttgagat

SEQ ID NO: 148200 - DNA, 25 bp, Rattus norvegicus
agggactcttcatcacctttgagat

SEQ ID NO: 148201 - DNA, 25 bp, Rattus norvegicus
agggactcttggaagtacctctgtc

SEQ ID NO: 148202 - DNA, 25 bp, Rattus norvegicus
agggactcttggtagtacctctgtc

SEQ ID NO: 148203 - DNA, 25 bp, Rattus norvegicus
agggactgacctagggcttcatgca

SEQ ID NO: 148204 - DNA, 25 bp, Rattus norvegicus
agggactgaccttgggcttcatgca

SEQ ID NO: 148205 - DNA, 25 bp, Rattus norvegicus
agggactgactgaggcgttggccat

SEQ ID NO: 148206 - DNA, 25 bp, Rattus norvegicus
agggactgactgtggcgttggccat

SEQ ID NO: 148207 - DNA, 25 bp, Rattus norvegicus
agggactgaggcaggcgggtgcttt

SEQ ID NO: 148208 - DNA, 25 bp, Rattus norvegicus
agggactgaggctggcgggtgcttt

SEQ ID NO: 148209 - DNA, 25 bp, Rattus norvegicus
agggactgcagccttgtctcagact

SEQ ID NO: 148210 - DNA, 25 bp, Rattus norvegicus
agggactgcagcgttgtctcagact

SEQ ID NO: 148211 - DNA, 25 bp, Rattus norvegicus
agggactgccagatcctatttatca

SEQ ID NO: 148212 - DNA, 25 bp, Rattus norvegicus
agggactgccagttcctatttatca

SEQ ID NO: 148213 - DNA, 25 bp, Rattus norvegicus
agggactgccatcatgttgagcaca

SEQ ID NO: 148214 - DNA, 25 bp, Rattus norvegicus
agggactgccatgatgttgagcaca

SEQ ID NO: 148215 - DNA, 25 bp, Rattus norvegicus
agggactgccccagagctaggtatc

SEQ ID NO: 148216 - DNA, 25 bp, Rattus norvegicus
agggactgccccaggaagaacaaga

SEQ ID NO: 148217 - DNA, 25 bp, Rattus norvegicus
agggactgcccctgagctaggtatc

SEQ ID NO: 148218 - DNA, 25 bp, Rattus norvegicus
agggactgcccctggaagaacaaga

SEQ ID NO: 148219 - DNA, 25 bp, Rattus norvegicus
agggactgcctcactaaagatctga

SEQ ID NO: 148220 - DNA, 25 bp, Rattus norvegicus
agggactgcctctctaaagatctga

SEQ ID NO: 148221 - DNA, 25 bp, Rattus norvegicus
agggactgcctgctgtccatccaac

SEQ ID NO: 148222 - DNA, 25 bp, Rattus norvegicus
agggactgcctggtgtccatccaac

SEQ ID NO: 148223 - DNA, 25 bp, Rattus norvegicus
agggactggagtaatgacaagcttc

SEQ ID NO: 148224 - DNA, 25 bp, Rattus norvegicus
agggactggagttatgacaagcttc

SEQ ID NO: 148225 - DNA, 25 bp, Rattus norvegicus
agggactgggcaactggctgtttct

SEQ ID NO: 148226 - DNA, 25 bp, Rattus norvegicus
agggactgggcatctggctgtttct

SEQ ID NO: 148227 - DNA, 25 bp, Rattus norvegicus
agggactgtccaagttttataaact

SEQ ID NO: 148228 - DNA, 25 bp, Rattus norvegicus
agggactgtccatgttttataaact

SEQ ID NO: 148229 - DNA, 25 bp, Rattus norvegicus
agggactgtctgctatgatgccgct

SEQ ID NO: 148230 - DNA, 25 bp, Rattus norvegicus
agggactgtctggtatgatgccgct

SEQ ID NO: 148231 - DNA, 25 bp, Rattus norvegicus
agggactgttagaatctcctggaga

SEQ ID NO: 148232 - DNA, 25 bp, Rattus norvegicus
agggactgttagtatctcctggaga

SEQ ID NO: 148233 - DNA, 25 bp, Rattus norvegicus
agggactgttgcaagactctgattc

SEQ ID NO: 148234 - DNA, 25 bp, Rattus norvegicus
agggactgttgctagactctgattc

SEQ ID NO: 148235 - DNA, 25 bp, Rattus norvegicus
agggactgttgtcgcccgtgagctg

SEQ ID NO: 148236 - DNA, 25 bp, Rattus norvegicus
agggactgttgtggcccgtgagctg

SEQ ID NO: 148237 - DNA, 25 bp, Rattus norvegicus
agggactgtttcagagcccagttcc

SEQ ID NO: 148238 - DNA, 25 bp, Rattus norvegicus
agggactgtttctgagcccagttcc

SEQ ID NO: 148239 - DNA, 25 bp, Rattus norvegicus
agggacttaaatacagctgtctgta

SEQ ID NO: 148240 - DNA, 25 bp, Rattus norvegicus
agggacttaaattcagctgtctgta

SEQ ID NO: 148241 - DNA, 25 bp, Rattus norvegicus
agggacttaagtcccttcacacaat

SEQ ID NO: 148242 - DNA, 25 bp, Rattus norvegicus
agggacttaagtgccttcacacaat

SEQ ID NO: 148243 - DNA, 25 bp, Rattus norvegicus
agggacttcacgcacatgtactcct

SEQ ID NO: 148244 - DNA, 25 bp, Rattus norvegicus
agggacttcacggacatgtactcct

SEQ ID NO: 148245 - DNA, 25 bp, Rattus norvegicus
agggacttcccacagaagagaccat

SEQ ID NO: 148246 - DNA, 25 bp, Rattus norvegicus
agggacttcccagagaagagaccat

SEQ ID NO: 148247 - DNA, 25 bp, Rattus norvegicus
agggacttccggacataccgcctga

SEQ ID NO: 148248 - DNA, 25 bp, Rattus norvegicus
agggacttccggtcataccgcctga

SEQ ID NO: 148249 - DNA, 25 bp, Rattus norvegicus
agggacttggccctttagctcaata

SEQ ID NO: 148250 - DNA, 25 bp, Rattus norvegicus
agggacttggccgtttagctcaata

SEQ ID NO: 148251 - DNA, 25 bp, Rattus norvegicus
agggacttttgtctcatatcttaaa

SEQ ID NO: 148252 - DNA, 25 bp, Rattus norvegicus
agggacttttgtgtcatatcttaaa

SEQ ID NO: 148253 - DNA, 25 bp, Rattus norvegicus
agggagaaatcgacaccactgggca

SEQ ID NO: 148254 - DNA, 25 bp, Rattus norvegicus
agggagaaatcgtcaccactgggca

SEQ ID NO: 148255 - DNA, 25 bp, Rattus norvegicus
agggagaagccgctcgagcctctac

SEQ ID NO: 148256 - DNA, 25 bp, Rattus norvegicus
agggagaagccggtcgagcctctac

SEQ ID NO: 148257 - DNA, 25 bp, Rattus norvegicus
agggagaagctcactgccctgcgtg

SEQ ID NO: 148258 - DNA, 25 bp, Rattus norvegicus
agggagaagctcatgccgcactcag

SEQ ID NO: 148259 - DNA, 25 bp, Rattus norvegicus
agggagaagctctctgccctgcgtg

SEQ ID NO: 148260 - DNA, 25 bp, Rattus norvegicus
agggagaagctcttgccgcactcag

SEQ ID NO: 148261 - DNA, 25 bp, Rattus norvegicus
agggagaatccgagagctgtgttta

SEQ ID NO: 148262 - DNA, 25 bp, Rattus norvegicus
agggagaatccgtgagctgtgttta

SEQ ID NO: 148263 - DNA, 25 bp, Rattus norvegicus
agggagaattcacgcctagtcttcc

SEQ ID NO: 148264 - DNA, 25 bp, Rattus norvegicus
agggagaattcaggcctagtcttcc

SEQ ID NO: 148265 - DNA, 25 bp, Rattus norvegicus
agggagacaaggctgctgctccttt

SEQ ID NO: 148266 - DNA, 25 bp, Rattus norvegicus
agggagacaagggtgctgctccttt

SEQ ID NO: 148267 - DNA, 25 bp, Rattus norvegicus
agggagacaccgacactgagcctct

SEQ ID NO: 148268 - DNA, 25 bp, Rattus norvegicus
agggagacaccgtcactgagcctct

SEQ ID NO: 148269 - DNA, 25 bp, Rattus norvegicus
agggagaccagccctccggacctat

SEQ ID NO: 148270 - DNA, 25 bp, Rattus norvegicus
agggagaccagcgctccggacctat

SEQ ID NO: 148271 - DNA, 25 bp, Rattus norvegicus
agggagaccccactgttccagaggc

SEQ ID NO: 148272 - DNA, 25 bp, Rattus norvegicus
agggagaccccagtgttccagaggc

SEQ ID NO: 148273 - DNA, 25 bp, Rattus norvegicus
agggagacccgtctgaatgccttcc

SEQ ID NO: 148274 - DNA, 25 bp, Rattus norvegicus
agggagacccgtgtgaatgccttcc

SEQ ID NO: 148275 - DNA, 25 bp, Rattus norvegicus
agggagaccctaatgacggctcgta

SEQ ID NO: 148276 - DNA, 25 bp, Rattus norvegicus
agggagaccctattgacggctcgta

SEQ ID NO: 148277 - DNA, 25 bp, Rattus norvegicus
agggagaccgcacacaggccacttg

SEQ ID NO: 148278 - DNA, 25 bp, Rattus norvegicus
agggagaccgcagacaggccacttg

SEQ ID NO: 148279 - DNA, 25 bp, Rattus norvegicus
agggagacgcacaacttacaccatc

SEQ ID NO: 148280 - DNA, 25 bp, Rattus norvegicus
agggagacgcactacttacaccatc

SEQ ID NO: 148281 - DNA, 25 bp, Rattus norvegicus
agggagacgtcccaggtcattctga

SEQ ID NO: 148282 - DNA, 25 bp, Rattus norvegicus
agggagacgtccgaggtcattctga

SEQ ID NO: 148283 - DNA, 25 bp, Rattus norvegicus
agggagactcctctagtgctaccag

SEQ ID NO: 148284 - DNA, 25 bp, Rattus norvegicus
agggagactcctgtagtgctaccag

SEQ ID NO: 148285 - DNA, 25 bp, Rattus norvegicus
agggagactctaatccggtgtatca

SEQ ID NO: 148286 - DNA, 25 bp, Rattus norvegicus
agggagactctattccggtgtatca

SEQ ID NO: 148287 - DNA, 25 bp, Rattus norvegicus
agggagacttcacagatgacatcat

SEQ ID NO: 148288 - DNA, 25 bp, Rattus norvegicus
agggagacttcagagatgacatcat

SEQ ID NO: 148289 - DNA, 25 bp, Rattus norvegicus
agggagacttctcagccagtaaagt

SEQ ID NO: 148290 - DNA, 25 bp, Rattus norvegicus
agggagacttctgagccagtaaagt

SEQ ID NO: 148291 - DNA, 25 bp, Rattus norvegicus
agggagagacggacagccttaccac

SEQ ID NO: 148292 - DNA, 25 bp, Rattus norvegicus
agggagagacggtcagccttaccac

SEQ ID NO: 148293 - DNA, 25 bp, Rattus norvegicus
agggagagcacgatgcagccttcca

SEQ ID NO: 148294 - DNA, 25 bp, Rattus norvegicus
agggagagcacgttgcagccttcca

SEQ ID NO: 148295 - DNA, 25 bp, Rattus norvegicus
agggagagcagcctgagcttcccat

SEQ ID NO: 148296 - DNA, 25 bp, Rattus norvegicus
agggagagcagcgtgagcttcccat

SEQ ID NO: 148297 - DNA, 25 bp, Rattus norvegicus
agggagagccacctggtactttcgt

SEQ ID NO: 148298 - DNA, 25 bp, Rattus norvegicus
agggagagccacgtggtactttcgt

SEQ ID NO: 148299 - DNA, 25 bp, Rattus norvegicus
agggagagccttcactttgaggaca

SEQ ID NO: 148300 - DNA, 25 bp, Rattus norvegicus
agggagagccttgactttgaggaca

SEQ ID NO: 148301 - DNA, 25 bp, Rattus norvegicus
agggagagcggccagcggcgagcgc

SEQ ID NO: 148302 - DNA, 25 bp, Rattus norvegicus
agggagagcggcgagcggcgagcgc

SEQ ID NO: 148303 - DNA, 25 bp, Rattus norvegicus
agggagagctccacagcataactgc

SEQ ID NO: 148304 - DNA, 25 bp, Rattus norvegicus
agggagagctcctcagcataactgc

SEQ ID NO: 148305 - DNA, 25 bp, Rattus norvegicus
agggagaggttcactgacagagcaa

SEQ ID NO: 148306 - DNA, 25 bp, Rattus norvegicus
agggagaggttctctgacagagcaa

SEQ ID NO: 148307 - DNA, 25 bp, Rattus norvegicus
agggagagttccagcttcctcaagt

SEQ ID NO: 148308 - DNA, 25 bp, Rattus norvegicus
agggagagttcctgcttcctcaagt

SEQ ID NO: 148309 - DNA, 25 bp, Rattus norvegicus
agggagatacatactgcccggtagc

SEQ ID NO: 148310 - DNA, 25 bp, Rattus norvegicus
agggagatacattctgcccggtagc

SEQ ID NO: 148311 - DNA, 25 bp, Rattus norvegicus
agggagatcgcccaggatttcaaaa

SEQ ID NO: 148312 - DNA, 25 bp, Rattus norvegicus
agggagatcgccgaggatttcaaaa

SEQ ID NO: 148313 - DNA, 25 bp, Rattus norvegicus
agggagatggacattgtgtaagata

SEQ ID NO: 148314 - DNA, 25 bp, Rattus norvegicus
agggagatggactttgtgtaagata

SEQ ID NO: 148315 - DNA, 25 bp, Rattus norvegicus
agggagattacgatctggctgtgaa

SEQ ID NO: 148316 - DNA, 25 bp, Rattus norvegicus
agggagattacgttctggctgtgaa

SEQ ID NO: 148317 - DNA, 25 bp, Rattus norvegicus
agggagattgtcatacataggaata

SEQ ID NO: 148318 - DNA, 25 bp, Rattus norvegicus
agggagattgtcttacataggaata

SEQ ID NO: 148319 - DNA, 25 bp, Rattus norvegicus
agggagcacccactaaccatgacta

SEQ ID NO: 148320 - DNA, 25 bp, Rattus norvegicus
agggagcacccagtaaccatgacta

SEQ ID NO: 148321 - DNA, 25 bp, Rattus norvegicus
agggagcagcctaggagaccaccag

SEQ ID NO: 148322 - DNA, 25 bp, Rattus norvegicus
agggagcagcctcccatgccttcaa

SEQ ID NO: 148323 - DNA, 25 bp, Rattus norvegicus
agggagcagcctgccatgccttcaa

SEQ ID NO: 148324 - DNA, 25 bp, Rattus norvegicus
agggagcagccttggagaccaccag

SEQ ID NO: 148325 - DNA, 25 bp, Rattus norvegicus
agggagcatgctaccagtttcggta

SEQ ID NO: 148326 - DNA, 25 bp, Rattus norvegicus
agggagcatgcttccagtttcggta

SEQ ID NO: 148327 - DNA, 25 bp, Rattus norvegicus
agggagccaattacaagtgcagaca

SEQ ID NO: 148328 - DNA, 25 bp, Rattus norvegicus
agggagccaatttcaagtgcagaca

SEQ ID NO: 148329 - DNA, 25 bp, Rattus norvegicus
agggagccagtcacgtttgccagga

SEQ ID NO: 148330 - DNA, 25 bp, Rattus norvegicus
agggagccagtctcgtttgccagga

SEQ ID NO: 148331 - DNA, 25 bp, Rattus norvegicus
agggagccatctcaactgccagctg

SEQ ID NO: 148332 - DNA, 25 bp, Rattus norvegicus
agggagccatctgaactgccagctg

SEQ ID NO: 148333 - DNA, 25 bp, Rattus norvegicus
agggagcccactccatagtttggaa

SEQ ID NO: 148334 - DNA, 25 bp, Rattus norvegicus
agggagcccactgcatagtttggaa

SEQ ID NO: 148335 - DNA, 25 bp, Rattus norvegicus
agggagcccatgactgtagttgaaa

SEQ ID NO: 148336 - DNA, 25 bp, Rattus norvegicus
agggagcccatgtctgtagttgaaa

SEQ ID NO: 148337 - DNA, 25 bp, Rattus norvegicus
agggagcccattagctggcaacagc

SEQ ID NO: 148338 - DNA, 25 bp, Rattus norvegicus
agggagcccatttgctggcaacagc

SEQ ID NO: 148339 - DNA, 25 bp, Rattus norvegicus
agggagcccctgaggaccttgaact

SEQ ID NO: 148340 - DNA, 25 bp, Rattus norvegicus
agggagcccctgtggaccttgaact

SEQ ID NO: 148341 - DNA, 25 bp, Rattus norvegicus
agggagccggccaacctgagcagtc

SEQ ID NO: 148342 - DNA, 25 bp, Rattus norvegicus
agggagccggcctacctgagcagtc

SEQ ID NO: 148343 - DNA, 25 bp, Rattus norvegicus
agggagccgtaccagagtgtttaca

SEQ ID NO: 148344 - DNA, 25 bp, Rattus norvegicus
agggagccgtacgagagtgtttaca

SEQ ID NO: 148345 - DNA, 25 bp, Rattus norvegicus
agggagcctctcagagcaccaccga

SEQ ID NO: 148346 - DNA, 25 bp, Rattus norvegicus
agggagcctctctgagcaccaccga

SEQ ID NO: 148347 - DNA, 25 bp, Rattus norvegicus
agggagcctgcaaaggactaaccta

SEQ ID NO: 148348 - DNA, 25 bp, Rattus norvegicus
agggagcctgcaccctctgttggaa

SEQ ID NO: 148349 - DNA, 25 bp, Rattus norvegicus
agggagcctgcagcctctgttggaa

SEQ ID NO: 148350 - DNA, 25 bp, Rattus norvegicus
agggagcctgcataggactaaccta

SEQ ID NO: 148351 - DNA, 25 bp, Rattus norvegicus
agggagcctggactgtagtctccaa

SEQ ID NO: 148352 - DNA, 25 bp, Rattus norvegicus
agggagcctggagtgtagtctccaa

SEQ ID NO: 148353 - DNA, 25 bp, Rattus norvegicus
agggagcggaacacatgtccctgct

SEQ ID NO: 148354 - DNA, 25 bp, Rattus norvegicus
agggagcggaactcatgtccctgct

SEQ ID NO: 148355 - DNA, 25 bp, Rattus norvegicus
agggagcggagccatttgcataacc

SEQ ID NO: 148356 - DNA, 25 bp, Rattus norvegicus
agggagcggagcgatttgcataacc

SEQ ID NO: 148357 - DNA, 25 bp, Rattus norvegicus
agggagcggagtatctctccagcac

SEQ ID NO: 148358 - DNA, 25 bp, Rattus norvegicus
agggagcggagtttctctccagcac

SEQ ID NO: 148359 - DNA, 25 bp, Rattus norvegicus
agggagcgtgggaatgcattttctt

SEQ ID NO: 148360 - DNA, 25 bp, Rattus norvegicus
agggagcgtgggtatgcattttctt

SEQ ID NO: 148361 - DNA, 25 bp, Rattus norvegicus
agggagctagagagtctctctggcc

SEQ ID NO: 148362 - DNA, 25 bp, Rattus norvegicus
agggagctagagtgtctctctggcc

SEQ ID NO: 148363 - DNA, 25 bp, Rattus norvegicus
agggagctcacactgacaactgaag

SEQ ID NO: 148364 - DNA, 25 bp, Rattus norvegicus
agggagctcacagtgacaactgaag

SEQ ID NO: 148365 - DNA, 25 bp, Rattus norvegicus
agggagctcccaccataccatagga

SEQ ID NO: 148366 - DNA, 25 bp, Rattus norvegicus
agggagctcccagcataccatagga

SEQ ID NO: 148367 - DNA, 25 bp, Rattus norvegicus
agggagctcctgatcctgacttgta

SEQ ID NO: 148368 - DNA, 25 bp, Rattus norvegicus
agggagctcctgttcctgacttgta

SEQ ID NO: 148369 - DNA, 25 bp, Rattus norvegicus
agggagctcgagactcttctggcct

SEQ ID NO: 148370 - DNA, 25 bp, Rattus norvegicus
agggagctcgagtctcttctggcct

SEQ ID NO: 148371 - DNA, 25 bp, Rattus norvegicus
agggagctctacaggcgcctgaagc

SEQ ID NO: 148372 - DNA, 25 bp, Rattus norvegicus
agggagctctactggcgcctgaagc

SEQ ID NO: 148373 - DNA, 25 bp, Rattus norvegicus
agggagctctgacatctaccagact

SEQ ID NO: 148374 - DNA, 25 bp, Rattus norvegicus
agggagctctgagatctaccagact

SEQ ID NO: 148375 - DNA, 25 bp, Rattus norvegicus
agggagctctgcctgctggcaataa

SEQ ID NO: 148376 - DNA, 25 bp, Rattus norvegicus
agggagctctgcgtgctggcaataa

SEQ ID NO: 148377 - DNA, 25 bp, Rattus norvegicus
agggagctgagacacctgtacagac

SEQ ID NO: 148378 - DNA, 25 bp, Rattus norvegicus
agggagctgagagacctgtacagac

SEQ ID NO: 148379 - DNA, 25 bp, Rattus norvegicus
agggagctgctcagctacgtacgaa

SEQ ID NO: 148380 - DNA, 25 bp, Rattus norvegicus
agggagctgctctgctacgtacgaa

SEQ ID NO: 148381 - DNA, 25 bp, Rattus norvegicus
agggaggaacatatgcttcagcgga

SEQ ID NO: 148382 - DNA, 25 bp, Rattus norvegicus
agggaggaacatttgcttcagcgga

SEQ ID NO: 148383 - DNA, 25 bp, Rattus norvegicus
agggaggacttgcacactgtactac

SEQ ID NO: 148384 - DNA, 25 bp, Rattus norvegicus
agggaggacttggacactgtactac

SEQ ID NO: 148385 - DNA, 25 bp, Rattus norvegicus
agggaggagcacatttcagatgtct

SEQ ID NO: 148386 - DNA, 25 bp, Rattus norvegicus
agggaggagcacttttcagatgtct

SEQ ID NO: 148387 - DNA, 25 bp, Rattus norvegicus
agggaggagtccatggtccagctct

SEQ ID NO: 148388 - DNA, 25 bp, Rattus norvegicus
agggaggagtccttggtccagctct

SEQ ID NO: 148389 - DNA, 25 bp, Rattus norvegicus
agggaggatgtcctgcttacactgt

SEQ ID NO: 148390 - DNA, 25 bp, Rattus norvegicus
agggaggatgtcgtgcttacactgt

SEQ ID NO: 148391 - DNA, 25 bp, Rattus norvegicus
agggaggcacctcctgtcgagtctt

SEQ ID NO: 148392 - DNA, 25 bp, Rattus norvegicus
agggaggcacctgctgtcgagtctt

SEQ ID NO: 148393 - DNA, 25 bp, Rattus norvegicus
agggaggcagctccaacggcttaac

SEQ ID NO: 148394 - DNA, 25 bp, Rattus norvegicus
agggaggcagctgcaacggcttaac

SEQ ID NO: 148395 - DNA, 25 bp, Rattus norvegicus
agggaggcagttcctcccctacaac

SEQ ID NO: 148396 - DNA, 25 bp, Rattus norvegicus
agggaggcagttgctcccctacaac

SEQ ID NO: 148397 - DNA, 25 bp, Rattus norvegicus
agggaggcatcactccacaaacccg

SEQ ID NO: 148398 - DNA, 25 bp, Rattus norvegicus
agggaggcatcagtccacaaacccg

SEQ ID NO: 148399 - DNA, 25 bp, Rattus norvegicus
agggaggcgcctcctctggaccatc

SEQ ID NO: 148400 - DNA, 25 bp, Rattus norvegicus
agggaggcgcctgctctggaccatc

SEQ ID NO: 148401 - DNA, 25 bp, Rattus norvegicus
agggaggctacaccacatctgcaca

SEQ ID NO: 148402 - DNA, 25 bp, Rattus norvegicus
agggaggctacagcacatctgcaca

SEQ ID NO: 148403 - DNA, 25 bp, Rattus norvegicus
agggaggctaccactctgacagcag

SEQ ID NO: 148404 - DNA, 25 bp, Rattus norvegicus
agggaggctacctctctgacagcag

SEQ ID NO: 148405 - DNA, 25 bp, Rattus norvegicus
agggaggctccgcacagcttccagc

SEQ ID NO: 148406 - DNA, 25 bp, Rattus norvegicus
agggaggctccggacagcttccagc

SEQ ID NO: 148407 - DNA, 25 bp, Rattus norvegicus
agggaggctcctatgcagcatttct

SEQ ID NO: 148408 - DNA, 25 bp, Rattus norvegicus
agggaggctcctttgcagcatttct

SEQ ID NO: 148409 - DNA, 25 bp, Rattus norvegicus
agggaggctgccattgatacagaga

SEQ ID NO: 148410 - DNA, 25 bp, Rattus norvegicus
agggaggctgcctttgatacagaga

SEQ ID NO: 148411 - DNA, 25 bp, Rattus norvegicus
agggagggacccacctgctagttgt

SEQ ID NO: 148412 - DNA, 25 bp, Rattus norvegicus
agggagggaccctcctgctagttgt

SEQ ID NO: 148413 - DNA, 25 bp, Rattus norvegicus
agggagggacctcctcagtgcccac

SEQ ID NO: 148414 - DNA, 25 bp, Rattus norvegicus
agggagggacctgctcagtgcccac

SEQ ID NO: 148415 - DNA, 25 bp, Rattus norvegicus
agggagggatttacgtcctcactct

SEQ ID NO: 148416 - DNA, 25 bp, Rattus norvegicus
agggagggattttcgtcctcactct

SEQ ID NO: 148417 - DNA, 25 bp, Rattus norvegicus
agggagggcaggcacaccacttcca

SEQ ID NO: 148418 - DNA, 25 bp, Rattus norvegicus
agggagggcagggacaccacttcca

SEQ ID NO: 148419 - DNA, 25 bp, Rattus norvegicus
agggagggcctgatctgtccaagaa

SEQ ID NO: 148420 - DNA, 25 bp, Rattus norvegicus
agggagggcctgttctgtccaagaa

SEQ ID NO: 148421 - DNA, 25 bp, Rattus norvegicus
agggagggcggtctccctaccacat

SEQ ID NO: 148422 - DNA, 25 bp, Rattus norvegicus
agggagggcggtgtccctaccacat

SEQ ID NO: 148423 - DNA, 25 bp, Rattus norvegicus
agggagggcttcaagggcatcactc

SEQ ID NO: 148424 - DNA, 25 bp, Rattus norvegicus
agggagggcttctagggcatcactc

SEQ ID NO: 148425 - DNA, 25 bp, Rattus norvegicus
agggagggtctccatactctgagct

SEQ ID NO: 148426 - DNA, 25 bp, Rattus norvegicus
agggagggtctcgatactctgagct

SEQ ID NO: 148427 - DNA, 25 bp, Rattus norvegicus
agggagggtttacctcagtctcatc

SEQ ID NO: 148428 - DNA, 25 bp, Rattus norvegicus
agggagggtttagctcagtctcatc

SEQ ID NO: 148429 - DNA, 25 bp, Rattus norvegicus
agggaggtcaaacgcacttgtctgt

SEQ ID NO: 148430 - DNA, 25 bp, Rattus norvegicus
agggaggtcaaaggcacttgtctgt

SEQ ID NO: 148431 - DNA, 25 bp, Rattus norvegicus
agggaggtcaccagcaacccatatt

SEQ ID NO: 148432 - DNA, 25 bp, Rattus norvegicus
agggaggtcacctgcaacccatatt

SEQ ID NO: 148433 - DNA, 25 bp, Rattus norvegicus
agggaggtcctgacttgctctgcat

SEQ ID NO: 148434 - DNA, 25 bp, Rattus norvegicus
agggaggtcctgtcttgctctgcat

SEQ ID NO: 148435 - DNA, 25 bp, Rattus norvegicus
agggaggtcttaccttggcagccta

SEQ ID NO: 148436 - DNA, 25 bp, Rattus norvegicus
agggaggtcttagcttggcagccta

SEQ ID NO: 148437 - DNA, 25 bp, Rattus norvegicus
agggaggtcttgactcccctcctgg

SEQ ID NO: 148438 - DNA, 25 bp, Rattus norvegicus
agggaggtcttgtctcccctcctgg

SEQ ID NO: 148439 - DNA, 25 bp, Rattus norvegicus
agggaggtggagagaccacttacct

SEQ ID NO: 148440 - DNA, 25 bp, Rattus norvegicus
agggaggtggagtgaccacttacct

SEQ ID NO: 148441 - DNA, 25 bp, Rattus norvegicus
agggaggtggccattgaatactgcc

SEQ ID NO: 148442 - DNA, 25 bp, Rattus norvegicus
agggaggtggcctttgaatactgcc

SEQ ID NO: 148443 - DNA, 25 bp, Rattus norvegicus
agggaggtgtccaatgccaggtcca

SEQ ID NO: 148444 - DNA, 25 bp, Rattus norvegicus
agggaggtgtcctatgccaggtcca

SEQ ID NO: 148445 - DNA, 25 bp, Rattus norvegicus
agggaggttcttatgctgtcgttat

SEQ ID NO: 148446 - DNA, 25 bp, Rattus norvegicus
agggaggttcttttgctgtcgttat

SEQ ID NO: 148447 - DNA, 25 bp, Rattus norvegicus
agggaggttgataagctttagcttt

SEQ ID NO: 148448 - DNA, 25 bp, Rattus norvegicus
agggaggttgattagctttagcttt

SEQ ID NO: 148449 - DNA, 25 bp, Rattus norvegicus
agggagtacctaactgagagacggc

SEQ ID NO: 148450 - DNA, 25 bp, Rattus norvegicus
agggagtacctatctgagagacggc

SEQ ID NO: 148451 - DNA, 25 bp, Rattus norvegicus
agggagtagcttcagccactggcaa

SEQ ID NO: 148452 - DNA, 25 bp, Rattus norvegicus
agggagtagcttgagccactggcaa

SEQ ID NO: 148453 - DNA, 25 bp, Rattus norvegicus
agggagtcaagcagccgcagcagct

SEQ ID NO: 148454 - DNA, 25 bp, Rattus norvegicus
agggagtcaagctgccgcagcagct

SEQ ID NO: 148455 - DNA, 25 bp, Rattus norvegicus
agggagtcaatgctcttcagaagga

SEQ ID NO: 148456 - DNA, 25 bp, Rattus norvegicus
agggagtcaatggtcttcagaagga

SEQ ID NO: 148457 - DNA, 25 bp, Rattus norvegicus
agggagtcattcactggctaccgtc

SEQ ID NO: 148458 - DNA, 25 bp, Rattus norvegicus
agggagtcattctctggctaccgtc

SEQ ID NO: 148459 - DNA, 25 bp, Rattus norvegicus
agggagtcattgatgtcacatgcaa

SEQ ID NO: 148460 - DNA, 25 bp, Rattus norvegicus
agggagtcattgttgtcacatgcaa

SEQ ID NO: 148461 - DNA, 25 bp, Rattus norvegicus
agggagtccaccataaacacccagt

SEQ ID NO: 148462 - DNA, 25 bp, Rattus norvegicus
agggagtccaccttaaacacccagt

SEQ ID NO: 148463 - DNA, 25 bp, Rattus norvegicus
agggagtccgttaccagacatcgac

SEQ ID NO: 148464 - DNA, 25 bp, Rattus norvegicus
agggagtccgtttccagacatcgac

SEQ ID NO: 148465 - DNA, 25 bp, Rattus norvegicus
agggagtctcctcctttagtgtagg

SEQ ID NO: 148466 - DNA, 25 bp, Rattus norvegicus
agggagtctcctgctttagtgtagg

SEQ ID NO: 148467 - DNA, 25 bp, Rattus norvegicus
agggagtctctcaaacttctctcaa

SEQ ID NO: 148468 - DNA, 25 bp, Rattus norvegicus
agggagtctctctaacttctctcaa

SEQ ID NO: 148469 - DNA, 25 bp, Rattus norvegicus
agggagtctgatccctttggactgt

SEQ ID NO: 148470 - DNA, 25 bp, Rattus norvegicus
agggagtctgatgcctttggactgt

SEQ ID NO: 148471 - DNA, 25 bp, Rattus norvegicus
agggagtctgccaatcttgaatgaa

SEQ ID NO: 148472 - DNA, 25 bp, Rattus norvegicus
agggagtctgcctatcttgaatgaa

SEQ ID NO: 148473 - DNA, 25 bp, Rattus norvegicus
agggagtctggcctttgtcatcact

SEQ ID NO: 148474 - DNA, 25 bp, Rattus norvegicus
agggagtctggcgtttgtcatcact

SEQ ID NO: 148475 - DNA, 25 bp, Rattus norvegicus
agggagtgacctactgtcttcagtt

SEQ ID NO: 148476 - DNA, 25 bp, Rattus norvegicus
agggagtgaccttctgtcttcagtt

SEQ ID NO: 148477 - DNA, 25 bp, Rattus norvegicus
agggagtgcctaactttcttattaa

SEQ ID NO: 148478 - DNA, 25 bp, Rattus norvegicus
agggagtgcctatctttcttattaa

SEQ ID NO: 148479 - DNA, 25 bp, Rattus norvegicus
agggagtggcaaccctgtgtttctc

SEQ ID NO: 148480 - DNA, 25 bp, Rattus norvegicus
agggagtggcaagcctgtgtttctc

SEQ ID NO: 148481 - DNA, 25 bp, Rattus norvegicus
agggagtggcttatctccaccgtga

SEQ ID NO: 148482 - DNA, 25 bp, Rattus norvegicus
agggagtggcttttctccaccgtga

SEQ ID NO: 148483 - DNA, 25 bp, Rattus norvegicus
agggagtgtaaccatctggccttcc

SEQ ID NO: 148484 - DNA, 25 bp, Rattus norvegicus
agggagtgtaacgatctggccttcc

SEQ ID NO: 148485 - DNA, 25 bp, Rattus norvegicus
agggagtgtatcagccagagtagca

SEQ ID NO: 148486 - DNA, 25 bp, Rattus norvegicus
agggagtgtatctgccagagtagca

SEQ ID NO: 148487 - DNA, 25 bp, Rattus norvegicus
agggagtgtcccaacattccaaatc

SEQ ID NO: 148488 - DNA, 25 bp, Rattus norvegicus
agggagtgtccctacattccaaatc

SEQ ID NO: 148489 - DNA, 25 bp, Rattus norvegicus
agggagttcaccaagaatgcacaaa

SEQ ID NO: 148490 - DNA, 25 bp, Rattus norvegicus
agggagttcacctagaatgcacaaa

SEQ ID NO: 148491 - DNA, 25 bp, Rattus norvegicus
agggagttccagaccagtgtaatca

SEQ ID NO: 148492 - DNA, 25 bp, Rattus norvegicus
agggagttccagtccagtgtaatca

SEQ ID NO: 148493 - DNA, 25 bp, Rattus norvegicus
agggagttccatcttctcttgtgac

SEQ ID NO: 148494 - DNA, 25 bp, Rattus norvegicus
agggagttccatgttctcttgtgac

SEQ ID NO: 148495 - DNA, 25 bp, Rattus norvegicus
agggagttccggactggctctagca

SEQ ID NO: 148496 - DNA, 25 bp, Rattus norvegicus
agggagttccggtctggctctagca

SEQ ID NO: 148497 - DNA, 25 bp, Rattus norvegicus
agggagttcctcaaaagcctgcgga

SEQ ID NO: 148498 - DNA, 25 bp, Rattus norvegicus
agggagttcctctaaagcctgcgga

SEQ ID NO: 148499 - DNA, 25 bp, Rattus norvegicus
agggagttgagtccctcctcctggc

SEQ ID NO: 148500 - DNA, 25 bp, Rattus norvegicus
agggagttgagtgcctcctcctggc

SEQ ID NO: 148501 - DNA, 25 bp, Rattus norvegicus
agggataacaccagggtccttatgc

SEQ ID NO: 148502 - DNA, 25 bp, Rattus norvegicus
agggataacacctgggtccttatgc

SEQ ID NO: 148503 - DNA, 25 bp, Rattus norvegicus
agggataacagcattctccaggtcc

SEQ ID NO: 148504 - DNA, 25 bp, Rattus norvegicus
agggataacagctttctccaggtcc

SEQ ID NO: 148505 - DNA, 25 bp, Rattus norvegicus
agggatacagctccttttgatgttt

SEQ ID NO: 148506 - DNA, 25 bp, Rattus norvegicus
agggatacagctgcttttgatgttt

SEQ ID NO: 148507 - DNA, 25 bp, Rattus norvegicus
agggatacatcaacccgggtgtcag

SEQ ID NO: 148508 - DNA, 25 bp, Rattus norvegicus
agggatacatcatcccgggtgtcag

SEQ ID NO: 148509 - DNA, 25 bp, Rattus norvegicus
agggatactactagaactttcctat

SEQ ID NO: 148510 - DNA, 25 bp, Rattus norvegicus
agggatactacttgaactttcctat

SEQ ID NO: 148511 - DNA, 25 bp, Rattus norvegicus
agggatagcatcacttaagtcttat

SEQ ID NO: 148512 - DNA, 25 bp, Rattus norvegicus
agggatagcatctcttaagtcttat

SEQ ID NO: 148513 - DNA, 25 bp, Rattus norvegicus
agggatagctgtcctggccacacta

SEQ ID NO: 148514 - DNA, 25 bp, Rattus norvegicus
agggatagctgtgctggccacacta

SEQ ID NO: 148515 - DNA, 25 bp, Rattus norvegicus
agggatatctatccccggagcatca

SEQ ID NO: 148516 - DNA, 25 bp, Rattus norvegicus
agggatatctatgcccggagcatca

SEQ ID NO: 148517 - DNA, 25 bp, Rattus norvegicus
agggatatctggcatctgcaactcc

SEQ ID NO: 148518 - DNA, 25 bp, Rattus norvegicus
agggatatctgggatctgcaactcc

SEQ ID NO: 148519 - DNA, 25 bp, Rattus norvegicus
agggatatggctatgtctccttttt

SEQ ID NO: 148520 - DNA, 25 bp, Rattus norvegicus
agggatatggctttgtctccttttt

SEQ ID NO: 148521 - DNA, 25 bp, Rattus norvegicus
agggatattcttattgtgcactgtg

SEQ ID NO: 148522 - DNA, 25 bp, Rattus norvegicus
agggatattctttttgtgcactgtg

SEQ ID NO: 148523 - DNA, 25 bp, Rattus norvegicus
agggatcaccaacacatcttgcaat

SEQ ID NO: 148524 - DNA, 25 bp, Rattus norvegicus
agggatcaccaagacatcttgcaat

SEQ ID NO: 148525 - DNA, 25 bp, Rattus norvegicus
agggatcactccagatgctcctgtg

SEQ ID NO: 148526 - DNA, 25 bp, Rattus norvegicus
agggatcactcctgatgctcctgtg

SEQ ID NO: 148527 - DNA, 25 bp, Rattus norvegicus
agggatcagcgccaacctttaatga

SEQ ID NO: 148528 - DNA, 25 bp, Rattus norvegicus
agggatcagcgcgaacctttaatga

SEQ ID NO: 148529 - DNA, 25 bp, Rattus norvegicus
agggatcagctgactgtgtcatgct

SEQ ID NO: 148530 - DNA, 25 bp, Rattus norvegicus
agggatcagctgtctgtgtcatgct

SEQ ID NO: 148531 - DNA, 25 bp, Rattus norvegicus
agggatcaggacacttacgactcaa

SEQ ID NO: 148532 - DNA, 25 bp, Rattus norvegicus
agggatcaggactcttacgactcaa

SEQ ID NO: 148533 - DNA, 25 bp, Rattus norvegicus
agggatcaggccctccaaacagaat

SEQ ID NO: 148534 - DNA, 25 bp, Rattus norvegicus
agggatcaggccgtccaaacagaat

SEQ ID NO: 148535 - DNA, 25 bp, Rattus norvegicus
agggatcatcccattgtggaatctt

SEQ ID NO: 148536 - DNA, 25 bp, Rattus norvegicus
agggatcatccctttgtggaatctt

SEQ ID NO: 148537 - DNA, 25 bp, Rattus norvegicus
agggatcatggtcggcgttttcctc

SEQ ID NO: 148538 - DNA, 25 bp, Rattus norvegicus
agggatcatggtgggcgttttcctc

SEQ ID NO: 148539 - DNA, 25 bp, Rattus norvegicus
agggatcattgactaccccttcgac

SEQ ID NO: 148540 - DNA, 25 bp, Rattus norvegicus
agggatcattgagtaccccttcgac

SEQ ID NO: 148541 - DNA, 25 bp, Rattus norvegicus
agggatccaaccactcagcaaggag

SEQ ID NO: 148542 - DNA, 25 bp, Rattus norvegicus
agggatccaacctctcagcaaggag

SEQ ID NO: 148543 - DNA, 25 bp, Rattus norvegicus
agggatccacctctttgagccttca

SEQ ID NO: 148544 - DNA, 25 bp, Rattus norvegicus
agggatccacctgtttgagccttca

SEQ ID NO: 148545 - DNA, 25 bp, Rattus norvegicus
agggatccacggcttctgctccact

SEQ ID NO: 148546 - DNA, 25 bp, Rattus norvegicus
agggatccacgggttctgctccact

SEQ ID NO: 148547 - DNA, 25 bp, Rattus norvegicus
agggatccagccaggactgcaggaa

SEQ ID NO: 148548 - DNA, 25 bp, Rattus norvegicus
agggatccagcctggactgcaggaa

SEQ ID NO: 148549 - DNA, 25 bp, Rattus norvegicus
agggatccatccatattgttcagag

SEQ ID NO: 148550 - DNA, 25 bp, Rattus norvegicus
agggatccatccttattgttcagag

SEQ ID NO: 148551 - DNA, 25 bp, Rattus norvegicus
agggatccctaacctatatcataaa

SEQ ID NO: 148552 - DNA, 25 bp, Rattus norvegicus
agggatccctaagctatatcataaa

SEQ ID NO: 148553 - DNA, 25 bp, Rattus norvegicus
agggatccctgcagctcgggtttag

SEQ ID NO: 148554 - DNA, 25 bp, Rattus norvegicus
agggatccctgctgctcgggtttag

SEQ ID NO: 148555 - DNA, 25 bp, Rattus norvegicus
agggatcctagcactgtgccgttaa

SEQ ID NO: 148556 - DNA, 25 bp, Rattus norvegicus
agggatcctagctctgtgccgttaa

SEQ ID NO: 148557 - DNA, 25 bp, Rattus norvegicus
agggatcctctgaatgactggctca

SEQ ID NO: 148558 - DNA, 25 bp, Rattus norvegicus
agggatcctctgtatgactggctca

SEQ ID NO: 148559 - DNA, 25 bp, Rattus norvegicus
agggatcctgggagacctaggctct

SEQ ID NO: 148560 - DNA, 25 bp, Rattus norvegicus
agggatcctgggtgacctaggctct

SEQ ID NO: 148561 - DNA, 25 bp, Rattus norvegicus
agggatcctgttagtgtctggtaaa

SEQ ID NO: 148562 - DNA, 25 bp, Rattus norvegicus
agggatcctgtttgtgtctggtaaa

SEQ ID NO: 148563 - DNA, 25 bp, Rattus norvegicus
agggatcgattcacacaccatcttt

SEQ ID NO: 148564 - DNA, 25 bp, Rattus norvegicus
agggatcgattctcacaccatcttt

SEQ ID NO: 148565 - DNA, 25 bp, Rattus norvegicus
agggatcggagccatcatcgcgcca

SEQ ID NO: 148566 - DNA, 25 bp, Rattus norvegicus
agggatcggagcgatcatcgcgcca

SEQ ID NO: 148567 - DNA, 25 bp, Rattus norvegicus
agggatcgtggcattcatcgtcttc

SEQ ID NO: 148568 - DNA, 25 bp, Rattus norvegicus
agggatcgtggctttcatcgtcttc

SEQ ID NO: 148569 - DNA, 25 bp, Rattus norvegicus
agggatcgtttacacttgagaagaa

SEQ ID NO: 148570 - DNA, 25 bp, Rattus norvegicus
agggatcgtttagacttgagaagaa

SEQ ID NO: 148571 - DNA, 25 bp, Rattus norvegicus
agggatcgtttcacagactcaagtt

SEQ ID NO: 148572 - DNA, 25 bp, Rattus norvegicus
agggatcgtttctcagactcaagtt

SEQ ID NO: 148573 - DNA, 25 bp, Rattus norvegicus
agggatctcaatacccacttgtgca

SEQ ID NO: 148574 - DNA, 25 bp, Rattus norvegicus
agggatctcaattcccacttgtgca

SEQ ID NO: 148575 - DNA, 25 bp, Rattus norvegicus
agggatctcgaactcttccttggcc

SEQ ID NO: 148576 - DNA, 25 bp, Rattus norvegicus
agggatctcgaagtcttccttggcc

SEQ ID NO: 148577 - DNA, 25 bp, Rattus norvegicus
agggatctcgtacaccctgtccagg

SEQ ID NO: 148578 - DNA, 25 bp, Rattus norvegicus
agggatctcgtagaccctgtccagg

SEQ ID NO: 148579 - DNA, 25 bp, Rattus norvegicus
agggatctcttcaaagtaccccagg

SEQ ID NO: 148580 - DNA, 25 bp, Rattus norvegicus
agggatctcttctaagtaccccagg

SEQ ID NO: 148581 - DNA, 25 bp, Rattus norvegicus
agggatctgaacagaccgtgtttcg

SEQ ID NO: 148582 - DNA, 25 bp, Rattus norvegicus
agggatctgaactgaccgtgtttcg

SEQ ID NO: 148583 - DNA, 25 bp, Rattus norvegicus
agggatctgcctatttcatttcaag

SEQ ID NO: 148584 - DNA, 25 bp, Rattus norvegicus
agggatctgcctttttcatttcaag

SEQ ID NO: 148585 - DNA, 25 bp, Rattus norvegicus
agggatctggccaagcagctctcct

SEQ ID NO: 148586 - DNA, 25 bp, Rattus norvegicus
agggatctggcctagcagctctcct

SEQ ID NO: 148587 - DNA, 25 bp, Rattus norvegicus
agggatctgtctacctttgggagaa

SEQ ID NO: 148588 - DNA, 25 bp, Rattus norvegicus
agggatctgtcttcctttgggagaa

SEQ ID NO: 148589 - DNA, 25 bp, Rattus norvegicus
agggatcttcccagcgtgagttcaa

SEQ ID NO: 148590 - DNA, 25 bp, Rattus norvegicus
agggatcttccctgcgtgagttcaa

SEQ ID NO: 148591 - DNA, 25 bp, Rattus norvegicus
agggatctttaaagcctctccagct

SEQ ID NO: 148592 - DNA, 25 bp, Rattus norvegicus
agggatctttaatgcctctccagct

SEQ ID NO: 148593 - DNA, 25 bp, Rattus norvegicus
agggatgaagctacctggccagtgc

SEQ ID NO: 148594 - DNA, 25 bp, Rattus norvegicus
agggatgaagcttcctggccagtgc

SEQ ID NO: 148595 - DNA, 25 bp, Rattus norvegicus
agggatgaattcagggacactgcgc

SEQ ID NO: 148596 - DNA, 25 bp, Rattus norvegicus
agggatgaattctgggacactgcgc

SEQ ID NO: 148597 - DNA, 25 bp, Rattus norvegicus
agggatgagcagatattgccacata

SEQ ID NO: 148598 - DNA, 25 bp, Rattus norvegicus
agggatgagcagttattgccacata

SEQ ID NO: 148599 - DNA, 25 bp, Rattus norvegicus
agggatgaggacaccacagagcgtt

SEQ ID NO: 148600 - DNA, 25 bp, Rattus norvegicus
agggatgaggactccacagagcgtt

SEQ ID NO: 148601 - DNA, 25 bp, Rattus norvegicus
agggatgatcagattcagactttaa

SEQ ID NO: 148602 - DNA, 25 bp, Rattus norvegicus
agggatgatcagtttcagactttaa

SEQ ID NO: 148603 - DNA, 25 bp, Rattus norvegicus
agggatgcagctaatctacctgcca

SEQ ID NO: 148604 - DNA, 25 bp, Rattus norvegicus
agggatgcagcttatctacctgcca

SEQ ID NO: 148605 - DNA, 25 bp, Rattus norvegicus
agggatgcagtaccacttgcagaca

SEQ ID NO: 148606 - DNA, 25 bp, Rattus norvegicus
agggatgcagtagcacttgcagaca

SEQ ID NO: 148607 - DNA, 25 bp, Rattus norvegicus
agggatgccacaaagtctctgtgac

SEQ ID NO: 148608 - DNA, 25 bp, Rattus norvegicus
agggatgccacatagtctctgtgac

SEQ ID NO: 148609 - DNA, 25 bp, Rattus norvegicus
agggatgcccacaagttccaaaatt

SEQ ID NO: 148610 - DNA, 25 bp, Rattus norvegicus
agggatgcccactagttccaaaatt

SEQ ID NO: 148611 - DNA, 25 bp, Rattus norvegicus
agggatgctggacccgacctcaata

SEQ ID NO: 148612 - DNA, 25 bp, Rattus norvegicus
agggatgctggagccgacctcaata

SEQ ID NO: 148613 - DNA, 25 bp, Rattus norvegicus
agggatgctggcattcagctcagac

SEQ ID NO: 148614 - DNA, 25 bp, Rattus norvegicus
agggatgctggctttcagctcagac

SEQ ID NO: 148615 - DNA, 25 bp, Rattus norvegicus
agggatgctgttctggttgcctaca

SEQ ID NO: 148616 - DNA, 25 bp, Rattus norvegicus
agggatgctgttgtggttgcctaca

SEQ ID NO: 148617 - DNA, 25 bp, Rattus norvegicus
agggatgctttccagcctgcagcaa

SEQ ID NO: 148618 - DNA, 25 bp, Rattus norvegicus
agggatgctttcgagcctgcagcaa

SEQ ID NO: 148619 - DNA, 25 bp, Rattus norvegicus
agggatggaatacggctgcctctca

SEQ ID NO: 148620 - DNA, 25 bp, Rattus norvegicus
agggatggaatagggctgcctctca

SEQ ID NO: 148621 - DNA, 25 bp, Rattus norvegicus
agggatggacaaaaatactctaatt

SEQ ID NO: 148622 - DNA, 25 bp, Rattus norvegicus
agggatggacaataatactctaatt

SEQ ID NO: 148623 - DNA, 25 bp, Rattus norvegicus
agggatggactcacagactgtgtgc

SEQ ID NO: 148624 - DNA, 25 bp, Rattus norvegicus
agggatggactctcagactgtgtgc

SEQ ID NO: 148625 - DNA, 25 bp, Rattus norvegicus
agggatggagctctggcttcccctc

SEQ ID NO: 148626 - DNA, 25 bp, Rattus norvegicus
agggatggagctgtggcttcccctc

SEQ ID NO: 148627 - DNA, 25 bp, Rattus norvegicus
agggatggatctatacaggtgacgt

SEQ ID NO: 148628 - DNA, 25 bp, Rattus norvegicus
agggatggatctttacaggtgacgt

SEQ ID NO: 148629 - DNA, 25 bp, Rattus norvegicus
agggatggatggaacaggctactat

SEQ ID NO: 148630 - DNA, 25 bp, Rattus norvegicus
agggatggatggtacaggctactat

SEQ ID NO: 148631 - DNA, 25 bp, Rattus norvegicus
agggatggcccacccacagttctga

SEQ ID NO: 148632 - DNA, 25 bp, Rattus norvegicus
agggatggcccagccacagttctga

SEQ ID NO: 148633 - DNA, 25 bp, Rattus norvegicus
agggatggcgccaatcaaatcagag

SEQ ID NO: 148634 - DNA, 25 bp, Rattus norvegicus
agggatggcgcctatcaaatcagag

SEQ ID NO: 148635 - DNA, 25 bp, Rattus norvegicus
agggatggctccaataggacagcta

SEQ ID NO: 148636 - DNA, 25 bp, Rattus norvegicus
agggatggctcctataggacagcta

SEQ ID NO: 148637 - DNA, 25 bp, Rattus norvegicus
agggatgggactagtcacactctgt

SEQ ID NO: 148638 - DNA, 25 bp, Rattus norvegicus
agggatgggacttgtcacactctgt

SEQ ID NO: 148639 - DNA, 25 bp, Rattus norvegicus
agggatgggcgcatcatattgctaa

SEQ ID NO: 148640 - DNA, 25 bp, Rattus norvegicus
agggatgggcgcttcatattgctaa

SEQ ID NO: 148641 - DNA, 25 bp, Rattus norvegicus
agggatgggtagcttcatcgccatt

SEQ ID NO: 148642 - DNA, 25 bp, Rattus norvegicus
agggatgggtaggttcatcgccatt

SEQ ID NO: 148643 - DNA, 25 bp, Rattus norvegicus
agggatgggtgaaacttcttgcttc

SEQ ID NO: 148644 - DNA, 25 bp, Rattus norvegicus
agggatgggtgatacttcttgcttc

SEQ ID NO: 148645 - DNA, 25 bp, Rattus norvegicus
agggatgggtgtagcatgtcttttt

SEQ ID NO: 148646 - DNA, 25 bp, Rattus norvegicus
agggatgggtgttgcatgtcttttt

SEQ ID NO: 148647 - DNA, 25 bp, Rattus norvegicus
agggatggtagccacctctgcttca

SEQ ID NO: 148648 - DNA, 25 bp, Rattus norvegicus
agggatggtagcgacctctgcttca

SEQ ID NO: 148649 - DNA, 25 bp, Rattus norvegicus
agggatggtgacagctctgtcctca

SEQ ID NO: 148650 - DNA, 25 bp, Rattus norvegicus
agggatggtgactgctctgtcctca

SEQ ID NO: 148651 - DNA, 25 bp, Rattus norvegicus
agggatgtcaaactcatactgcagt

SEQ ID NO: 148652 - DNA, 25 bp, Rattus norvegicus
agggatgtcaaagtcatactgcagt

SEQ ID NO: 148653 - DNA, 25 bp, Rattus norvegicus
agggatgtcagaatttgcctgtacc

SEQ ID NO: 148654 - DNA, 25 bp, Rattus norvegicus
agggatgtcagattttgcctgtacc

SEQ ID NO: 148655 - DNA, 25 bp, Rattus norvegicus
agggatgtgtcgaacttccaggcca

SEQ ID NO: 148656 - DNA, 25 bp, Rattus norvegicus
agggatgtgtcgtacttccaggcca

SEQ ID NO: 148657 - DNA, 25 bp, Rattus norvegicus
agggatgtgtctagcctcaaatcaa

SEQ ID NO: 148658 - DNA, 25 bp, Rattus norvegicus
agggatgtgtcttgcctcaaatcaa

SEQ ID NO: 148659 - DNA, 25 bp, Rattus norvegicus
agggatgtttcccacataacctgtt

SEQ ID NO: 148660 - DNA, 25 bp, Rattus norvegicus
agggatgtttccgacataacctgtt

SEQ ID NO: 148661 - DNA, 25 bp, Rattus norvegicus
agggattcacagaccagatgctgcc

SEQ ID NO: 148662 - DNA, 25 bp, Rattus norvegicus
agggattcacagtccagatgctgcc

SEQ ID NO: 148663 - DNA, 25 bp, Rattus norvegicus
agggattcagtcatttatctgggac

SEQ ID NO: 148664 - DNA, 25 bp, Rattus norvegicus
agggattcagtcttttatctgggac

SEQ ID NO: 148665 - DNA, 25 bp, Rattus norvegicus
agggattccaggattatccaggcct

SEQ ID NO: 148666 - DNA, 25 bp, Rattus norvegicus
agggattccaggtttatccaggcct

SEQ ID NO: 148667 - DNA, 25 bp, Rattus norvegicus
agggattccatgactctcccttcca

SEQ ID NO: 148668 - DNA, 25 bp, Rattus norvegicus
agggattccatgtctctcccttcca

SEQ ID NO: 148669 - DNA, 25 bp, Rattus norvegicus
agggattccttcagccgaatgagcc

SEQ ID NO: 148670 - DNA, 25 bp, Rattus norvegicus
agggattccttctgccgaatgagcc

SEQ ID NO: 148671 - DNA, 25 bp, Rattus norvegicus
agggattcgcagagctgtgactcat

SEQ ID NO: 148672 - DNA, 25 bp, Rattus norvegicus
agggattcgcagtgctgtgactcat

SEQ ID NO: 148673 - DNA, 25 bp, Rattus norvegicus
agggattcggagcacaccctgcagt

SEQ ID NO: 148674 - DNA, 25 bp, Rattus norvegicus
agggattcggagcttcgcctgacta

SEQ ID NO: 148675 - DNA, 25 bp, Rattus norvegicus
agggattcggaggacaccctgcagt

SEQ ID NO: 148676 - DNA, 25 bp, Rattus norvegicus
agggattcggaggttcgcctgacta

SEQ ID NO: 148677 - DNA, 25 bp, Rattus norvegicus
agggattctcagactcaggtgccaa

SEQ ID NO: 148678 - DNA, 25 bp, Rattus norvegicus
agggattctcagtctcaggtgccaa

SEQ ID NO: 148679 - DNA, 25 bp, Rattus norvegicus
agggattctctcatcactagatgga

SEQ ID NO: 148680 - DNA, 25 bp, Rattus norvegicus
agggattctctcttcactagatgga

SEQ ID NO: 148681 - DNA, 25 bp, Rattus norvegicus
agggattctggaaacttctagcatg

SEQ ID NO: 148682 - DNA, 25 bp, Rattus norvegicus
agggattctggatacttctagcatg

SEQ ID NO: 148683 - DNA, 25 bp, Rattus norvegicus
agggattgatgcctttgtcatgagt

SEQ ID NO: 148684 - DNA, 25 bp, Rattus norvegicus
agggattgatgcgtttgtcatgagt

SEQ ID NO: 148685 - DNA, 25 bp, Rattus norvegicus
agggattgccggcttcgcgtgcgcc

SEQ ID NO: 148686 - DNA, 25 bp, Rattus norvegicus
agggattgccgggttcgcgtgcgcc

SEQ ID NO: 148687 - DNA, 25 bp, Rattus norvegicus
agggattgctacagagactcttcag

SEQ ID NO: 148688 - DNA, 25 bp, Rattus norvegicus
agggattgctactgagactcttcag

SEQ ID NO: 148689 - DNA, 25 bp, Rattus norvegicus
agggattgtggtcagccccttcaat

SEQ ID NO: 148690 - DNA, 25 bp, Rattus norvegicus
agggattgtggtgagccccttcaat

SEQ ID NO: 148691 - DNA, 25 bp, Rattus norvegicus
agggattgtgtaagtctgtcattct

SEQ ID NO: 148692 - DNA, 25 bp, Rattus norvegicus
agggattgtgtatgtctgtcattct

SEQ ID NO: 148693 - DNA, 25 bp, Rattus norvegicus
agggatttacacatgaccagagaaa

SEQ ID NO: 148694 - DNA, 25 bp, Rattus norvegicus
agggatttacacttgaccagagaaa

SEQ ID NO: 148695 - DNA, 25 bp, Rattus norvegicus
agggatttatatcgctgtgcccgcg

SEQ ID NO: 148696 - DNA, 25 bp, Rattus norvegicus
agggatttatatggctgtgcccgcg

SEQ ID NO: 148697 - DNA, 25 bp, Rattus norvegicus
agggatttatttaagctcagcgcaa

SEQ ID NO: 148698 - DNA, 25 bp, Rattus norvegicus
agggatttattttagctcagcgcaa

SEQ ID NO: 148699 - DNA, 25 bp, Rattus norvegicus
agggatttcactccttagataggta

SEQ ID NO: 148700 - DNA, 25 bp, Rattus norvegicus
agggatttcactgcttagataggta

SEQ ID NO: 148701 - DNA, 25 bp, Rattus norvegicus
agggatttgccccattctctggcat

SEQ ID NO: 148702 - DNA, 25 bp, Rattus norvegicus
agggatttgcccgattctctggcat

SEQ ID NO: 148703 - DNA, 25 bp, Rattus norvegicus
agggatttgtagaccgtgagacagt

SEQ ID NO: 148704 - DNA, 25 bp, Rattus norvegicus
agggatttgtagtccgtgagacagt

SEQ ID NO: 148705 - DNA, 25 bp, Rattus norvegicus
agggatttgtgaccctttccttaga

SEQ ID NO: 148706 - DNA, 25 bp, Rattus norvegicus
agggatttgtgagcctttccttaga

SEQ ID NO: 148707 - DNA, 25 bp, Rattus norvegicus
agggattttcttactgtagctcaag

SEQ ID NO: 148708 - DNA, 25 bp, Rattus norvegicus
agggattttctttctgtagctcaag

SEQ ID NO: 148709 - DNA, 25 bp, Rattus norvegicus
agggatttttatccgtctgtgttac

SEQ ID NO: 148710 - DNA, 25 bp, Rattus norvegicus
agggatttttatgcgtctgtgttac

SEQ ID NO: 148711 - DNA, 25 bp, Rattus norvegicus
agggatttttccacacaagcgcata

SEQ ID NO: 148712 - DNA, 25 bp, Rattus norvegicus
agggatttttcctcacaagcgcata

SEQ ID NO: 148713 - DNA, 25 bp, Rattus norvegicus
agggcaaaagcacccaagattggaa

SEQ ID NO: 148714 - DNA, 25 bp, Rattus norvegicus
agggcaaaagcagccaagattggaa

SEQ ID NO: 148715 - DNA, 25 bp, Rattus norvegicus
agggcaaactgacctcctctgagga

SEQ ID NO: 148716 - DNA, 25 bp, Rattus norvegicus
agggcaaactgagctcctctgagga

SEQ ID NO: 148717 - DNA, 25 bp, Rattus norvegicus
agggcaaactgcaccatttcgggac

SEQ ID NO: 148718 - DNA, 25 bp, Rattus norvegicus
agggcaaactgctccatttcgggac

SEQ ID NO: 148719 - DNA, 25 bp, Rattus norvegicus
agggcaaagggcaacgctcagcgac

SEQ ID NO: 148720 - DNA, 25 bp, Rattus norvegicus
agggcaaagggctacgctcagcgac

SEQ ID NO: 148721 - DNA, 25 bp, Rattus norvegicus
agggcaaagtctcgatggctccttc

SEQ ID NO: 148722 - DNA, 25 bp, Rattus norvegicus
agggcaaagtctggatggctccttc

SEQ ID NO: 148723 - DNA, 25 bp, Rattus norvegicus
agggcaaataccacatcctcaagga

SEQ ID NO: 148724 - DNA, 25 bp, Rattus norvegicus
agggcaaatacctcatcctcaagga

SEQ ID NO: 148725 - DNA, 25 bp, Rattus norvegicus
agggcaaatgacagacttcccacac

SEQ ID NO: 148726 - DNA, 25 bp, Rattus norvegicus
agggcaaatgactgacttcccacac

SEQ ID NO: 148727 - DNA, 25 bp, Rattus norvegicus
agggcaaatgggatcgggcttctca

SEQ ID NO: 148728 - DNA, 25 bp, Rattus norvegicus
agggcaaatgggttcgggcttctca

SEQ ID NO: 148729 - DNA, 25 bp, Rattus norvegicus
agggcaacacagcttctggcacgaa

SEQ ID NO: 148730 - DNA, 25 bp, Rattus norvegicus
agggcaacacaggttctggcacgaa

SEQ ID NO: 148731 - DNA, 25 bp, Rattus norvegicus
agggcaacaggtcccctaagctggt

SEQ ID NO: 148732 - DNA, 25 bp, Rattus norvegicus
agggcaacaggtgccctaagctggt

SEQ ID NO: 148733 - DNA, 25 bp, Rattus norvegicus
agggcaacatgcctgaatcttgtag

SEQ ID NO: 148734 - DNA, 25 bp, Rattus norvegicus
agggcaacatgcgtgaatcttgtag

SEQ ID NO: 148735 - DNA, 25 bp, Rattus norvegicus
agggcaaccagaagtccaagtgagc

SEQ ID NO: 148736 - DNA, 25 bp, Rattus norvegicus
agggcaaccagatgtccaagtgagc

SEQ ID NO: 148737 - DNA, 25 bp, Rattus norvegicus
agggcaaccttacccggtcagtcga

SEQ ID NO: 148738 - DNA, 25 bp, Rattus norvegicus
agggcaaccttagccggtcagtcga

SEQ ID NO: 148739 - DNA, 25 bp, Rattus norvegicus
agggcaactactcgacgctcgatcc

SEQ ID NO: 148740 - DNA, 25 bp, Rattus norvegicus
agggcaactactggacgctcgatcc

SEQ ID NO: 148741 - DNA, 25 bp, Rattus norvegicus
agggcaagaagccatccgtgctgtt

SEQ ID NO: 148742 - DNA, 25 bp, Rattus norvegicus
agggcaagaagcgatccgtgctgtt

SEQ ID NO: 148743 - DNA, 25 bp, Rattus norvegicus
agggcaagatgacccctagtgacaa

SEQ ID NO: 148744 - DNA, 25 bp, Rattus norvegicus
agggcaagatgagccctagtgacaa

SEQ ID NO: 148745 - DNA, 25 bp, Rattus norvegicus
agggcaagcaatcttctgctgacca

SEQ ID NO: 148746 - DNA, 25 bp, Rattus norvegicus
agggcaagcaatgttctgctgacca

SEQ ID NO: 148747 - DNA, 25 bp, Rattus norvegicus
agggcaagccctagcttagattcag

SEQ ID NO: 148748 - DNA, 25 bp, Rattus norvegicus
agggcaagcccttgcttagattcag

SEQ ID NO: 148749 - DNA, 25 bp, Rattus norvegicus
agggcaagcttacggtccacacatc

SEQ ID NO: 148750 - DNA, 25 bp, Rattus norvegicus
agggcaagcttagggtccacacatc

SEQ ID NO: 148751 - DNA, 25 bp, Rattus norvegicus
agggcaagcttcacgcctgtattgc

SEQ ID NO: 148752 - DNA, 25 bp, Rattus norvegicus
agggcaagcttctcgcctgtattgc

SEQ ID NO: 148753 - DNA, 25 bp, Rattus norvegicus
agggcaaggagacggtcacactaac

SEQ ID NO: 148754 - DNA, 25 bp, Rattus norvegicus
agggcaaggagagggtcacactaac

SEQ ID NO: 148755 - DNA, 25 bp, Rattus norvegicus
agggcaaggaggacatcatccaccg

SEQ ID NO: 148756 - DNA, 25 bp, Rattus norvegicus
agggcaaggaggtcatcatccaccg

SEQ ID NO: 148757 - DNA, 25 bp, Rattus norvegicus
agggcaaggcctaccaagtgagctt

SEQ ID NO: 148758 - DNA, 25 bp, Rattus norvegicus
agggcaaggccttccaagtgagctt

SEQ ID NO: 148759 - DNA, 25 bp, Rattus norvegicus
agggcaagtactctgactgctgcta

SEQ ID NO: 148760 - DNA, 25 bp, Rattus norvegicus
agggcaagtactgtgactgctgcta

SEQ ID NO: 148761 - DNA, 25 bp, Rattus norvegicus
agggcaagtcaaagtggctctgttt

SEQ ID NO: 148762 - DNA, 25 bp, Rattus norvegicus
agggcaagtcaatgtggctctgttt

SEQ ID NO: 148763 - DNA, 25 bp, Rattus norvegicus
agggcaagtcccaagagtgctaagt

SEQ ID NO: 148764 - DNA, 25 bp, Rattus norvegicus
agggcaagtccctagagtgctaagt

SEQ ID NO: 148765 - DNA, 25 bp, Rattus norvegicus
agggcaagtcttcgtccacgttcat

SEQ ID NO: 148766 - DNA, 25 bp, Rattus norvegicus
agggcaagtcttggtccacgttcat

SEQ ID NO: 148767 - DNA, 25 bp, Rattus norvegicus
agggcaagtgctctggtaccactct

SEQ ID NO: 148768 - DNA, 25 bp, Rattus norvegicus
agggcaagtgctgtggtaccactct

SEQ ID NO: 148769 - DNA, 25 bp, Rattus norvegicus
agggcaagtttgatctctgttttag

SEQ ID NO: 148770 - DNA, 25 bp, Rattus norvegicus
agggcaagtttgttctctgttttag

SEQ ID NO: 148771 - DNA, 25 bp, Rattus norvegicus
agggcaataaccaactcccacagag

SEQ ID NO: 148772 - DNA, 25 bp, Rattus norvegicus
agggcaataaccatgacatcttgaa

SEQ ID NO: 148773 - DNA, 25 bp, Rattus norvegicus
agggcaataacctactcccacagag

SEQ ID NO: 148774 - DNA, 25 bp, Rattus norvegicus
agggcaataaccttgacatcttgaa

SEQ ID NO: 148775 - DNA, 25 bp, Rattus norvegicus
agggcaatatttaactgctagcttg

SEQ ID NO: 148776 - DNA, 25 bp, Rattus norvegicus
agggcaatattttactgctagcttg

SEQ ID NO: 148777 - DNA, 25 bp, Rattus norvegicus
agggcaatccacattactataactt

SEQ ID NO: 148778 - DNA, 25 bp, Rattus norvegicus
agggcaatccactttactataactt

SEQ ID NO: 148779 - DNA, 25 bp, Rattus norvegicus
agggcaatcgacctcggttcatttg

SEQ ID NO: 148780 - DNA, 25 bp, Rattus norvegicus
agggcaatcgacgtcggttcatttg

SEQ ID NO: 148781 - DNA, 25 bp, Rattus norvegicus
agggcaatcgtgacgcacgccggct

SEQ ID NO: 148782 - DNA, 25 bp, Rattus norvegicus
agggcaatcgtgtcgcacgccggct

SEQ ID NO: 148783 - DNA, 25 bp, Rattus norvegicus
agggcaatcttgcagacgcctattc

SEQ ID NO: 148784 - DNA, 25 bp, Rattus norvegicus
agggcaatcttggagacgcctattc

SEQ ID NO: 148785 - DNA, 25 bp, Rattus norvegicus
agggcaatgagacccagctcatctc

SEQ ID NO: 148786 - DNA, 25 bp, Rattus norvegicus
agggcaatgagagccagctcatctc

SEQ ID NO: 148787 - DNA, 25 bp, Rattus norvegicus
agggcaatgtgcagtcttgtccagg

SEQ ID NO: 148788 - DNA, 25 bp, Rattus norvegicus
agggcaatgtgctgtcttgtccagg

SEQ ID NO: 148789 - DNA, 25 bp, Rattus norvegicus
agggcaattcctagttatacacaat

SEQ ID NO: 148790 - DNA, 25 bp, Rattus norvegicus
agggcaattccttgttatacacaat

SEQ ID NO: 148791 - DNA, 25 bp, Rattus norvegicus
agggcaattctgacctgcggaagca

SEQ ID NO: 148792 - DNA, 25 bp, Rattus norvegicus
agggcaattctgtcctgcggaagca

SEQ ID NO: 148793 - DNA, 25 bp, Rattus norvegicus
agggcaattcttacctgtcagtcat

SEQ ID NO: 148794 - DNA, 25 bp, Rattus norvegicus
agggcaattctttcctgtcagtcat

SEQ ID NO: 148795 - DNA, 25 bp, Rattus norvegicus
agggcacaaaaaacctgcgtccttg

SEQ ID NO: 148796 - DNA, 25 bp, Rattus norvegicus
agggcacaaaaatcctgcgtccttg

SEQ ID NO: 148797 - DNA, 25 bp, Rattus norvegicus
agggcacaaatgattactgctgcgg

SEQ ID NO: 148798 - DNA, 25 bp, Rattus norvegicus
agggcacaaatgtttactgctgcgg

SEQ ID NO: 148799 - DNA, 25 bp, Rattus norvegicus
agggcacaacccagaggcacgaaga

SEQ ID NO: 148800 - DNA, 25 bp, Rattus norvegicus
agggcacaaccctgaggcacgaaga

SEQ ID NO: 148801 - DNA, 25 bp, Rattus norvegicus
agggcacaaggccttcttcacaaag

SEQ ID NO: 148802 - DNA, 25 bp, Rattus norvegicus
agggcacaaggcgttcttcacaaag

SEQ ID NO: 148803 - DNA, 25 bp, Rattus norvegicus
agggcacaccataaagtttactttg

SEQ ID NO: 148804 - DNA, 25 bp, Rattus norvegicus
agggcacaccattaagtttactttg

SEQ ID NO: 148805 - DNA, 25 bp, Rattus norvegicus
agggcacacctgaagggagctatcc

SEQ ID NO: 148806 - DNA, 25 bp, Rattus norvegicus
agggcacacctgtagggagctatcc

SEQ ID NO: 148807 - DNA, 25 bp, Rattus norvegicus
agggcacactcaacttcaagacttt

SEQ ID NO: 148808 - DNA, 25 bp, Rattus norvegicus
agggcacactcatcttcaagacttt

SEQ ID NO: 148809 - DNA, 25 bp, Rattus norvegicus
agggcacactgacctctaggagcct

SEQ ID NO: 148810 - DNA, 25 bp, Rattus norvegicus
agggcacactgagctctaggagcct

SEQ ID NO: 148811 - DNA, 25 bp, Rattus norvegicus
agggcacactggagacactcacatc

SEQ ID NO: 148812 - DNA, 25 bp, Rattus norvegicus
agggcacactggtgacactcacatc

SEQ ID NO: 148813 - DNA, 25 bp, Rattus norvegicus
agggcacagaggcaccaggtaccaa

SEQ ID NO: 148814 - DNA, 25 bp, Rattus norvegicus
agggcacagagggaccaggtaccaa

SEQ ID NO: 148815 - DNA, 25 bp, Rattus norvegicus
agggcacagcacagacatctccaat

SEQ ID NO: 148816 - DNA, 25 bp, Rattus norvegicus
agggcacagcactgacatctccaat

SEQ ID NO: 148817 - DNA, 25 bp, Rattus norvegicus
agggcacagcccatggtccagttag

SEQ ID NO: 148818 - DNA, 25 bp, Rattus norvegicus
agggcacagcccttggtccagttag

SEQ ID NO: 148819 - DNA, 25 bp, Rattus norvegicus
agggcacagctgatatacagtcatt

SEQ ID NO: 148820 - DNA, 25 bp, Rattus norvegicus
agggcacagctgttatacagtcatt

SEQ ID NO: 148821 - DNA, 25 bp, Rattus norvegicus
agggcacaggaccaggcttcttgaa

SEQ ID NO: 148822 - DNA, 25 bp, Rattus norvegicus
agggcacaggacgaggcttcttgaa

SEQ ID NO: 148823 - DNA, 25 bp, Rattus norvegicus
agggcacaggccaacatatctacct

SEQ ID NO: 148824 - DNA, 25 bp, Rattus norvegicus
agggcacaggcctacatatctacct

SEQ ID NO: 148825 - DNA, 25 bp, Rattus norvegicus
agggcacagtgcatccagagcatga

SEQ ID NO: 148826 - DNA, 25 bp, Rattus norvegicus
agggcacagtgcttccagagcatga

SEQ ID NO: 148827 - DNA, 25 bp, Rattus norvegicus
agggcacatcccacagtctggagat

SEQ ID NO: 148828 - DNA, 25 bp, Rattus norvegicus
agggcacatccctcagtctggagat

SEQ ID NO: 148829 - DNA, 25 bp, Rattus norvegicus
agggcacatctgatcccggttggat

SEQ ID NO: 148830 - DNA, 25 bp, Rattus norvegicus
agggcacatctgatgtaatgcgaag

SEQ ID NO: 148831 - DNA, 25 bp, Rattus norvegicus
agggcacatctgttcccggttggat

SEQ ID NO: 148832 - DNA, 25 bp, Rattus norvegicus
agggcacatctgttgtaatgcgaag

SEQ ID NO: 148833 - DNA, 25 bp, Rattus norvegicus
agggcacatgacattcctagccttt

SEQ ID NO: 148834 - DNA, 25 bp, Rattus norvegicus
agggcacatgactttcctagccttt

SEQ ID NO: 148835 - DNA, 25 bp, Rattus norvegicus
agggcaccacaccaatgttgcagat

SEQ ID NO: 148836 - DNA, 25 bp, Rattus norvegicus
agggcaccacacgaatgttgcagat

SEQ ID NO: 148837 - DNA, 25 bp, Rattus norvegicus
agggcaccagcacctgatataccgc

SEQ ID NO: 148838 - DNA, 25 bp, Rattus norvegicus
agggcaccagcagctgatataccgc

SEQ ID NO: 148839 - DNA, 25 bp, Rattus norvegicus
agggcaccagccattatatgcagtc

SEQ ID NO: 148840 - DNA, 25 bp, Rattus norvegicus
agggcaccagccattgctcggagtg

SEQ ID NO: 148841 - DNA, 25 bp, Rattus norvegicus
agggcaccagccctgcacagggcat

SEQ ID NO: 148842 - DNA, 25 bp, Rattus norvegicus
agggcaccagccgtgcacagggcat

SEQ ID NO: 148843 - DNA, 25 bp, Rattus norvegicus
agggcaccagcctttatatgcagtc

SEQ ID NO: 148844 - DNA, 25 bp, Rattus norvegicus
agggcaccagcctttgctcggagtg

SEQ ID NO: 148845 - DNA, 25 bp, Rattus norvegicus
agggcaccattacccgaggctgtac

SEQ ID NO: 148846 - DNA, 25 bp, Rattus norvegicus
agggcaccattagccgaggctgtac

SEQ ID NO: 148847 - DNA, 25 bp, Rattus norvegicus
agggcaccattcactgtacacgttt

SEQ ID NO: 148848 - DNA, 25 bp, Rattus norvegicus
agggcaccattctctgtacacgttt

SEQ ID NO: 148849 - DNA, 25 bp, Rattus norvegicus
agggcacccaagcttgacaatctga

SEQ ID NO: 148850 - DNA, 25 bp, Rattus norvegicus
agggcacccaaggttgacaatctga

SEQ ID NO: 148851 - DNA, 25 bp, Rattus norvegicus
agggcacccaccacgtcaatgtgta

SEQ ID NO: 148852 - DNA, 25 bp, Rattus norvegicus
agggcacccacctcgtcaatgtgta

SEQ ID NO: 148853 - DNA, 25 bp, Rattus norvegicus
agggcaccctttactgggcagcaca

SEQ ID NO: 148854 - DNA, 25 bp, Rattus norvegicus
agggcacccttttctgggcagcaca

SEQ ID NO: 148855 - DNA, 25 bp, Rattus norvegicus
agggcaccgtatcttaagttctctt

SEQ ID NO: 148856 - DNA, 25 bp, Rattus norvegicus
agggcaccgtatgttaagttctctt

SEQ ID NO: 148857 - DNA, 25 bp, Rattus norvegicus
agggcaccgtctctgagctgccaca

SEQ ID NO: 148858 - DNA, 25 bp, Rattus norvegicus
agggcaccgtctgtgagctgccaca

SEQ ID NO: 148859 - DNA, 25 bp, Rattus norvegicus
agggcacctgccaggcattcaggag

SEQ ID NO: 148860 - DNA, 25 bp, Rattus norvegicus
agggcacctgcctggcattcaggag

SEQ ID NO: 148861 - DNA, 25 bp, Rattus norvegicus
agggcacgcggacctcgtgggtgag

SEQ ID NO: 148862 - DNA, 25 bp, Rattus norvegicus
agggcacgcggagctcgtgggtgag

SEQ ID NO: 148863 - DNA, 25 bp, Rattus norvegicus
agggcacgggagcatctgcatcatc

SEQ ID NO: 148864 - DNA, 25 bp, Rattus norvegicus
agggcacgggaggatctgcatcatc

SEQ ID NO: 148865 - DNA, 25 bp, Rattus norvegicus
agggcacgtagcactccagggaagc

SEQ ID NO: 148866 - DNA, 25 bp, Rattus norvegicus
agggcacgtagctctccagggaagc

SEQ ID NO: 148867 - DNA, 25 bp, Rattus norvegicus
agggcacgtcgtcctcggccttgca

SEQ ID NO: 148868 - DNA, 25 bp, Rattus norvegicus
agggcacgtcgtgctcggccttgca

SEQ ID NO: 148869 - DNA, 25 bp, Rattus norvegicus
agggcactaagcacagtactgttaa

SEQ ID NO: 148870 - DNA, 25 bp, Rattus norvegicus
agggcactaagccactgctcttttg

SEQ ID NO: 148871 - DNA, 25 bp, Rattus norvegicus
agggcactaagcgactgctcttttg

SEQ ID NO: 148872 - DNA, 25 bp, Rattus norvegicus
agggcactaagctcagtactgttaa

SEQ ID NO: 148873 - DNA, 25 bp, Rattus norvegicus
agggcactatatcgagcctccttac

SEQ ID NO: 148874 - DNA, 25 bp, Rattus norvegicus
agggcactatatggagcctccttac

SEQ ID NO: 148875 - DNA, 25 bp, Rattus norvegicus
agggcactatgtcccaggtgtcctt

SEQ ID NO: 148876 - DNA, 25 bp, Rattus norvegicus
agggcactatgtgccaggtgtcctt

SEQ ID NO: 148877 - DNA, 25 bp, Rattus norvegicus
agggcactattcatcctttcacggt

SEQ ID NO: 148878 - DNA, 25 bp, Rattus norvegicus
agggcactattcttcctttcacggt

SEQ ID NO: 148879 - DNA, 25 bp, Rattus norvegicus
agggcactccctcgtaattatatca

SEQ ID NO: 148880 - DNA, 25 bp, Rattus norvegicus
agggcactccctggtaattatatca

SEQ ID NO: 148881 - DNA, 25 bp, Rattus norvegicus
agggcactcggcagctaggtatcca

SEQ ID NO: 148882 - DNA, 25 bp, Rattus norvegicus
agggcactcggctgctaggtatcca

SEQ ID NO: 148883 - DNA, 25 bp, Rattus norvegicus
agggcactgaacacacgtgcgtgta

SEQ ID NO: 148884 - DNA, 25 bp, Rattus norvegicus
agggcactgaactcacgtgcgtgta

SEQ ID NO: 148885 - DNA, 25 bp, Rattus norvegicus
agggcactgcgtaagccttaacaca

SEQ ID NO: 148886 - DNA, 25 bp, Rattus norvegicus
agggcactgcgttagccttaacaca

SEQ ID NO: 148887 - DNA, 25 bp, Rattus norvegicus
agggcactggcccaaggaagcctat

SEQ ID NO: 148888 - DNA, 25 bp, Rattus norvegicus
agggcactggccgaaggaagcctat

SEQ ID NO: 148889 - DNA, 25 bp, Rattus norvegicus
agggcactgtctacatttaatgtta

SEQ ID NO: 148890 - DNA, 25 bp, Rattus norvegicus
agggcactgtcttcatttaatgtta

SEQ ID NO: 148891 - DNA, 25 bp, Rattus norvegicus
agggcactgtggctctcaccctggt

SEQ ID NO: 148892 - DNA, 25 bp, Rattus norvegicus
agggcactgtgggtctcaccctggt

SEQ ID NO: 148893 - DNA, 25 bp, Rattus norvegicus
agggcacttcataatctcggacgtg

SEQ ID NO: 148894 - DNA, 25 bp, Rattus norvegicus
agggcacttcattatctcggacgtg

SEQ ID NO: 148895 - DNA, 25 bp, Rattus norvegicus
agggcacttcctctggtggattcca

SEQ ID NO: 148896 - DNA, 25 bp, Rattus norvegicus
agggcacttcctgtggtggattcca

SEQ ID NO: 148897 - DNA, 25 bp, Rattus norvegicus
agggcacttttcagcttctggagaa

SEQ ID NO: 148898 - DNA, 25 bp, Rattus norvegicus
agggcacttttctgcttctggagaa

SEQ ID NO: 148899 - DNA, 25 bp, Rattus norvegicus
agggcagaaatcaaccagctccaag

SEQ ID NO: 148900 - DNA, 25 bp, Rattus norvegicus
agggcagaaatcatgggctgtgtta

SEQ ID NO: 148901 - DNA, 25 bp, Rattus norvegicus
agggcagaaatctaccagctccaag

SEQ ID NO: 148902 - DNA, 25 bp, Rattus norvegicus
agggcagaaatcttgggctgtgtta

SEQ ID NO: 148903 - DNA, 25 bp, Rattus norvegicus
agggcagaacagacagagcctcatt

SEQ ID NO: 148904 - DNA, 25 bp, Rattus norvegicus
agggcagaacagtcagagcctcatt

SEQ ID NO: 148905 - DNA, 25 bp, Rattus norvegicus
agggcagaacccagaccttgacact

SEQ ID NO: 148906 - DNA, 25 bp, Rattus norvegicus
agggcagaaccctgaccttgacact

SEQ ID NO: 148907 - DNA, 25 bp, Rattus norvegicus
agggcagaacgcactggcctgctca

SEQ ID NO: 148908 - DNA, 25 bp, Rattus norvegicus
agggcagaacgctctggcctgctca

SEQ ID NO: 148909 - DNA, 25 bp, Rattus norvegicus
agggcagaactaacacgggcacaga

SEQ ID NO: 148910 - DNA, 25 bp, Rattus norvegicus
agggcagaactatcacgggcacaga

SEQ ID NO: 148911 - DNA, 25 bp, Rattus norvegicus
agggcagaatggacccatgcacgct

SEQ ID NO: 148912 - DNA, 25 bp, Rattus norvegicus
agggcagaatggtcccatgcacgct

SEQ ID NO: 148913 - DNA, 25 bp, Rattus norvegicus
agggcagaatgtcggtcaaccccgc

SEQ ID NO: 148914 - DNA, 25 bp, Rattus norvegicus
agggcagaatgtgggtcaaccccgc

SEQ ID NO: 148915 - DNA, 25 bp, Rattus norvegicus
agggcagacaagcagaccctgtcta

SEQ ID NO: 148916 - DNA, 25 bp, Rattus norvegicus
agggcagacaaggagaccctgtcta

SEQ ID NO: 148917 - DNA, 25 bp, Rattus norvegicus
agggcagacaccagcaaaatcagtt

SEQ ID NO: 148918 - DNA, 25 bp, Rattus norvegicus
agggcagacacctgcaaaatcagtt

SEQ ID NO: 148919 - DNA, 25 bp, Rattus norvegicus
agggcagacccactaggatgtgttt

SEQ ID NO: 148920 - DNA, 25 bp, Rattus norvegicus
agggcagacccagtaggatgtgttt

SEQ ID NO: 148921 - DNA, 25 bp, Rattus norvegicus
agggcagacgcccaaaacgtgactg

SEQ ID NO: 148922 - DNA, 25 bp, Rattus norvegicus
agggcagacgccgaaaacgtgactg

SEQ ID NO: 148923 - DNA, 25 bp, Rattus norvegicus
agggcagacggcactaccaggaacc

SEQ ID NO: 148924 - DNA, 25 bp, Rattus norvegicus
agggcagacggcatttatacaaagt

SEQ ID NO: 148925 - DNA, 25 bp, Rattus norvegicus
agggcagacggctctaccaggaacc

SEQ ID NO: 148926 - DNA, 25 bp, Rattus norvegicus
agggcagacggcttttatacaaagt

SEQ ID NO: 148927 - DNA, 25 bp, Rattus norvegicus
agggcagactgcaaacacttactga

SEQ ID NO: 148928 - DNA, 25 bp, Rattus norvegicus
agggcagactgctaacacttactga

SEQ ID NO: 148929 - DNA, 25 bp, Rattus norvegicus
agggcagagaagcacgattcagatc

SEQ ID NO: 148930 - DNA, 25 bp, Rattus norvegicus
agggcagagaaggacgattcagatc

SEQ ID NO: 148931 - DNA, 25 bp, Rattus norvegicus
agggcagagcacagcacccagagga

SEQ ID NO: 148932 - DNA, 25 bp, Rattus norvegicus
agggcagagcactgcacccagagga

SEQ ID NO: 148933 - DNA, 25 bp, Rattus norvegicus
agggcagagccgacctgaagctgat

SEQ ID NO: 148934 - DNA, 25 bp, Rattus norvegicus
agggcagagccgtcctgaagctgat

SEQ ID NO: 148935 - DNA, 25 bp, Rattus norvegicus
agggcagagggcacttcataaattt

SEQ ID NO: 148936 - DNA, 25 bp, Rattus norvegicus
agggcagagggctcttcataaattt

SEQ ID NO: 148937 - DNA, 25 bp, Rattus norvegicus
agggcagagtatactattctatcta

SEQ ID NO: 148938 - DNA, 25 bp, Rattus norvegicus
agggcagagtattctattctatcta

SEQ ID NO: 148939 - DNA, 25 bp, Rattus norvegicus
agggcagagtgtaccaaacgcctcc

SEQ ID NO: 148940 - DNA, 25 bp, Rattus norvegicus
agggcagagtgttccaaacgcctcc

SEQ ID NO: 148941 - DNA, 25 bp, Rattus norvegicus
agggcagatgccagtttccctggcc

SEQ ID NO: 148942 - DNA, 25 bp, Rattus norvegicus
agggcagatgcctgtttccctggcc

SEQ ID NO: 148943 - DNA, 25 bp, Rattus norvegicus
agggcagcaaaaatgtgattctcaa

SEQ ID NO: 148944 - DNA, 25 bp, Rattus norvegicus
agggcagcaaaattgtgattctcaa

SEQ ID NO: 148945 - DNA, 25 bp, Rattus norvegicus
agggcagcaacgatgcgtaccacag

SEQ ID NO: 148946 - DNA, 25 bp, Rattus norvegicus
agggcagcaacgttgcgtaccacag

SEQ ID NO: 148947 - DNA, 25 bp, Rattus norvegicus
agggcagcaagtcatttgccttatt

SEQ ID NO: 148948 - DNA, 25 bp, Rattus norvegicus
agggcagcaagtgatttgccttatt

SEQ ID NO: 148949 - DNA, 25 bp, Rattus norvegicus
agggcagcacagagtcgcaacgttc

SEQ ID NO: 148950 - DNA, 25 bp, Rattus norvegicus
agggcagcacagtgtcgcaacgttc

SEQ ID NO: 148951 - DNA, 25 bp, Rattus norvegicus
agggcagcacatagtgtgctttttt

SEQ ID NO: 148952 - DNA, 25 bp, Rattus norvegicus
agggcagcacattgtgtgctttttt

SEQ ID NO: 148953 - DNA, 25 bp, Rattus norvegicus
agggcagcacccacataactaatgc

SEQ ID NO: 148954 - DNA, 25 bp, Rattus norvegicus
agggcagcaccctcataactaatgc

SEQ ID NO: 148955 - DNA, 25 bp, Rattus norvegicus
agggcagcagaaaaccacactccag

SEQ ID NO: 148956 - DNA, 25 bp, Rattus norvegicus
agggcagcagaataccacactccag

SEQ ID NO: 148957 - DNA, 25 bp, Rattus norvegicus
agggcagcagatcctccagagctag

SEQ ID NO: 148958 - DNA, 25 bp, Rattus norvegicus
agggcagcagatgctccagagctag

SEQ ID NO: 148959 - DNA, 25 bp, Rattus norvegicus
agggcagcagcacacctacccccag

SEQ ID NO: 148960 - DNA, 25 bp, Rattus norvegicus
agggcagcagcagacctacccccag

SEQ ID NO: 148961 - DNA, 25 bp, Rattus norvegicus
agggcagcagctaccacagtaaaca

SEQ ID NO: 148962 - DNA, 25 bp, Rattus norvegicus
agggcagcagctaccgagaagctca

SEQ ID NO: 148963 - DNA, 25 bp, Rattus norvegicus
agggcagcagcttccacagtaaaca

SEQ ID NO: 148964 - DNA, 25 bp, Rattus norvegicus
agggcagcagcttccgagaagctca

SEQ ID NO: 148965 - DNA, 25 bp, Rattus norvegicus
agggcagcatcccaatgtgccatat

SEQ ID NO: 148966 - DNA, 25 bp, Rattus norvegicus
agggcagcatccgaatgtgccatat

SEQ ID NO: 148967 - DNA, 25 bp, Rattus norvegicus
agggcagcattaactctgtgttctt

SEQ ID NO: 148968 - DNA, 25 bp, Rattus norvegicus
agggcagcattatctctgtgttctt

SEQ ID NO: 148969 - DNA, 25 bp, Rattus norvegicus
agggcagccagactcgttctccaca

SEQ ID NO: 148970 - DNA, 25 bp, Rattus norvegicus
agggcagccagagtcgttctccaca

SEQ ID NO: 148971 - DNA, 25 bp, Rattus norvegicus
agggcagcccagcaagacgcagtca

SEQ ID NO: 148972 - DNA, 25 bp, Rattus norvegicus
agggcagcccaggaagacgcagtca

SEQ ID NO: 148973 - DNA, 25 bp, Rattus norvegicus
agggcagccctgaaagtcaacacag

SEQ ID NO: 148974 - DNA, 25 bp, Rattus norvegicus
agggcagccctgtaagtcaacacag

SEQ ID NO: 148975 - DNA, 25 bp, Rattus norvegicus
agggcagcgatgagatcacacttca

SEQ ID NO: 148976 - DNA, 25 bp, Rattus norvegicus
agggcagcgatgtgatcacacttca

SEQ ID NO: 148977 - DNA, 25 bp, Rattus norvegicus
agggcagcgccaaccgcagagcaga

SEQ ID NO: 148978 - DNA, 25 bp, Rattus norvegicus
agggcagcgccatccgcagagcaga

SEQ ID NO: 148979 - DNA, 25 bp, Rattus norvegicus
agggcagctatcatgtgcgggattt

SEQ ID NO: 148980 - DNA, 25 bp, Rattus norvegicus
agggcagctatcttgtgcgggattt

SEQ ID NO: 148981 - DNA, 25 bp, Rattus norvegicus
agggcagctcaaagggccaggtaat

SEQ ID NO: 148982 - DNA, 25 bp, Rattus norvegicus
agggcagctcaatgggccaggtaat

SEQ ID NO: 148983 - DNA, 25 bp, Rattus norvegicus
agggcagctcacagtgtgtggactc

SEQ ID NO: 148984 - DNA, 25 bp, Rattus norvegicus
agggcagctcactgtgtgtggactc

SEQ ID NO: 148985 - DNA, 25 bp, Rattus norvegicus
agggcagctctcagtcaatctcaaa

SEQ ID NO: 148986 - DNA, 25 bp, Rattus norvegicus
agggcagctctctgtcaatctcaaa

SEQ ID NO: 148987 - DNA, 25 bp, Rattus norvegicus
agggcagctctgaactccttcaagg

SEQ ID NO: 148988 - DNA, 25 bp, Rattus norvegicus
agggcagctctgtactccttcaagg

SEQ ID NO: 148989 - DNA, 25 bp, Rattus norvegicus
agggcagctgaaaggcccactggcc

SEQ ID NO: 148990 - DNA, 25 bp, Rattus norvegicus
agggcagctgaatggcccactggcc

SEQ ID NO: 148991 - DNA, 25 bp, Rattus norvegicus
agggcagctggacaaccaggtaata

SEQ ID NO: 148992 - DNA, 25 bp, Rattus norvegicus
agggcagctggagaaccaggtaata

SEQ ID NO: 148993 - DNA, 25 bp, Rattus norvegicus
agggcagctgtaaaagtcatcctta

SEQ ID NO: 148994 - DNA, 25 bp, Rattus norvegicus
agggcagctgtataagtcatcctta

SEQ ID NO: 148995 - DNA, 25 bp, Rattus norvegicus
agggcagctgttctcctgaaacaag

SEQ ID NO: 148996 - DNA, 25 bp, Rattus norvegicus
agggcagctgttgtcctgaaacaag

SEQ ID NO: 148997 - DNA, 25 bp, Rattus norvegicus
agggcagcttgcacgaggatgtcat

SEQ ID NO: 148998 - DNA, 25 bp, Rattus norvegicus
agggcagcttgctcgaggatgtcat

SEQ ID NO: 148999 - DNA, 25 bp, Rattus norvegicus
agggcagctttgaccaaaaccagga

SEQ ID NO: 149000 - DNA, 25 bp, Rattus norvegicus
agggcagctttgtccaaaaccagga

SEQ ID NO: 149001 - DNA, 25 bp, Rattus norvegicus
agggcaggaagaccagcctacaacc

SEQ ID NO: 149002 - DNA, 25 bp, Rattus norvegicus
agggcaggaagagcagcctacaacc

SEQ ID NO: 149003 - DNA, 25 bp, Rattus norvegicus
agggcaggaagtccattttcctttc

SEQ ID NO: 149004 - DNA, 25 bp, Rattus norvegicus
agggcaggaagtgcattttcctttc

SEQ ID NO: 149005 - DNA, 25 bp, Rattus norvegicus
agggcaggagcgattcaacagcatt

SEQ ID NO: 149006 - DNA, 25 bp, Rattus norvegicus
agggcaggagcgtttcaacagcatt

SEQ ID NO: 149007 - DNA, 25 bp, Rattus norvegicus
agggcaggcattatctgtcttcttc

SEQ ID NO: 149008 - DNA, 25 bp, Rattus norvegicus
agggcaggcattttctgtcttcttc

SEQ ID NO: 149009 - DNA, 25 bp, Rattus norvegicus
agggcaggcctgaggctcatccgac

SEQ ID NO: 149010 - DNA, 25 bp, Rattus norvegicus
agggcaggcctgtggctcatccgac

SEQ ID NO: 149011 - DNA, 25 bp, Rattus norvegicus
agggcaggccttcttttgttggctc

SEQ ID NO: 149012 - DNA, 25 bp, Rattus norvegicus
agggcaggccttgttttgttggctc

SEQ ID NO: 149013 - DNA, 25 bp, Rattus norvegicus
agggcaggcttcagctttcatacaa

SEQ ID NO: 149014 - DNA, 25 bp, Rattus norvegicus
agggcaggcttcaggccaaaggtcc

SEQ ID NO: 149015 - DNA, 25 bp, Rattus norvegicus
agggcaggcttctgctttcatacaa

SEQ ID NO: 149016 - DNA, 25 bp, Rattus norvegicus
agggcaggcttctggccaaaggtcc

SEQ ID NO: 149017 - DNA, 25 bp, Rattus norvegicus
agggcaggcttgcttgtatgcacca

SEQ ID NO: 149018 - DNA, 25 bp, Rattus norvegicus
agggcaggcttggttgtatgcacca

SEQ ID NO: 149019 - DNA, 25 bp, Rattus norvegicus
agggcagggctgctacatgtctcct

SEQ ID NO: 149020 - DNA, 25 bp, Rattus norvegicus
agggcagggctggtacatgtctcct

SEQ ID NO: 149021 - DNA, 25 bp, Rattus norvegicus
agggcaggtagcatgaacatcttcc

SEQ ID NO: 149022 - DNA, 25 bp, Rattus norvegicus
agggcaggtagcttgaacatcttcc

SEQ ID NO: 149023 - DNA, 25 bp, Rattus norvegicus
agggcaggtggcaccaggttttcaa

SEQ ID NO: 149024 - DNA, 25 bp, Rattus norvegicus
agggcaggtggctccaggttttcaa

SEQ ID NO: 149025 - DNA, 25 bp, Rattus norvegicus
agggcaggttatatcttcatgagaa

SEQ ID NO: 149026 - DNA, 25 bp, Rattus norvegicus
agggcaggttatttcttcatgagaa

SEQ ID NO: 149027 - DNA, 25 bp, Rattus norvegicus
agggcagtaacgctctgacttgcta

SEQ ID NO: 149028 - DNA, 25 bp, Rattus norvegicus
agggcagtaacggtctgacttgcta

SEQ ID NO: 149029 - DNA, 25 bp, Rattus norvegicus
agggcagtacagatcagggttttct

SEQ ID NO: 149030 - DNA, 25 bp, Rattus norvegicus
agggcagtacagttcagggttttct

SEQ ID NO: 149031 - DNA, 25 bp, Rattus norvegicus
agggcagtaggccataccttggaat

SEQ ID NO: 149032 - DNA, 25 bp, Rattus norvegicus
agggcagtaggcgataccttggaat

SEQ ID NO: 149033 - DNA, 25 bp, Rattus norvegicus
agggcagtcacaactcatgtacacg

SEQ ID NO: 149034 - DNA, 25 bp, Rattus norvegicus
agggcagtcacatctcatgtacacg

SEQ ID NO: 149035 - DNA, 25 bp, Rattus norvegicus
agggcagtcaggagccagtcagacc

SEQ ID NO: 149036 - DNA, 25 bp, Rattus norvegicus
agggcagtcaggtgccagtcagacc

SEQ ID NO: 149037 - DNA, 25 bp, Rattus norvegicus
agggcagtccatactaaatctagca

SEQ ID NO: 149038 - DNA, 25 bp, Rattus norvegicus
agggcagtccattctaaatctagca

SEQ ID NO: 149039 - DNA, 25 bp, Rattus norvegicus
agggcagtcctgctgtgatccctgt

SEQ ID NO: 149040 - DNA, 25 bp, Rattus norvegicus
agggcagtcctggtgtgatccctgt

SEQ ID NO: 149041 - DNA, 25 bp, Rattus norvegicus
agggcagtctccaacagtaagggtt

SEQ ID NO: 149042 - DNA, 25 bp, Rattus norvegicus
agggcagtctcctacagtaagggtt

SEQ ID NO: 149043 - DNA, 25 bp, Rattus norvegicus
agggcagtgagcacacagcactagt

SEQ ID NO: 149044 - DNA, 25 bp, Rattus norvegicus
agggcagtgagctcacagcactagt

SEQ ID NO: 149045 - DNA, 25 bp, Rattus norvegicus
agggcagtgctacctgtacatgaag

SEQ ID NO: 149046 - DNA, 25 bp, Rattus norvegicus
agggcagtgctagctgtacatgaag

SEQ ID NO: 149047 - DNA, 25 bp, Rattus norvegicus
agggcagtggatctcatccgacatg

SEQ ID NO: 149048 - DNA, 25 bp, Rattus norvegicus
agggcagtggatgtcatccgacatg

SEQ ID NO: 149049 - DNA, 25 bp, Rattus norvegicus
agggcagtgggtcctcctgaccact

SEQ ID NO: 149050 - DNA, 25 bp, Rattus norvegicus
agggcagtgggtgctcctgaccact

SEQ ID NO: 149051 - DNA, 25 bp, Rattus norvegicus
agggcagtggttacacctacctgtt

SEQ ID NO: 149052 - DNA, 25 bp, Rattus norvegicus
agggcagtggtttcacctacctgtt

SEQ ID NO: 149053 - DNA, 25 bp, Rattus norvegicus
agggcagttgcacccgatgcacctg

SEQ ID NO: 149054 - DNA, 25 bp, Rattus norvegicus
agggcagttgcagccgatgcacctg

SEQ ID NO: 149055 - DNA, 25 bp, Rattus norvegicus
agggcagttgggacaccatagtctc

SEQ ID NO: 149056 - DNA, 25 bp, Rattus norvegicus
agggcagttgggtcaccatagtctc

SEQ ID NO: 149057 - DNA, 25 bp, Rattus norvegicus
agggcagtttctagcccagttgcca

SEQ ID NO: 149058 - DNA, 25 bp, Rattus norvegicus
agggcagtttcttgcccagttgcca

SEQ ID NO: 149059 - DNA, 25 bp, Rattus norvegicus
agggcatacccaaccatggacggtg

SEQ ID NO: 149060 - DNA, 25 bp, Rattus norvegicus
agggcatacccatccatggacggtg

SEQ ID NO: 149061 - DNA, 25 bp, Rattus norvegicus
agggcataccttagcttaggctgat

SEQ ID NO: 149062 - DNA, 25 bp, Rattus norvegicus
agggcatacctttgcttaggctgat

SEQ ID NO: 149063 - DNA, 25 bp, Rattus norvegicus
agggcatagccaccaggtgtcgcca

SEQ ID NO: 149064 - DNA, 25 bp, Rattus norvegicus
agggcatagccagcaggtgtcgcca

SEQ ID NO: 149065 - DNA, 25 bp, Rattus norvegicus
agggcatatcctatttactgggcct

SEQ ID NO: 149066 - DNA, 25 bp, Rattus norvegicus
agggcatatcctttttactgggcct

SEQ ID NO: 149067 - DNA, 25 bp, Rattus norvegicus
agggcatatgccactgcagactggc

SEQ ID NO: 149068 - DNA, 25 bp, Rattus norvegicus
agggcatatgcctctgcagactggc

SEQ ID NO: 149069 - DNA, 25 bp, Rattus norvegicus
agggcatcaaccagcaggagcgcgt

SEQ ID NO: 149070 - DNA, 25 bp, Rattus norvegicus
agggcatcaacctgcaggagcgcgt

SEQ ID NO: 149071 - DNA, 25 bp, Rattus norvegicus
agggcatcagcccatactacagctt

SEQ ID NO: 149072 - DNA, 25 bp, Rattus norvegicus
agggcatcagccgatactacagctt

SEQ ID NO: 149073 - DNA, 25 bp, Rattus norvegicus
agggcatcatccagtttgtgagccg

SEQ ID NO: 149074 - DNA, 25 bp, Rattus norvegicus
agggcatcatcctgtttgtgagccg

SEQ ID NO: 149075 - DNA, 25 bp, Rattus norvegicus
agggcatccaagatgctgctaacct

SEQ ID NO: 149076 - DNA, 25 bp, Rattus norvegicus
agggcatccaagttgctgctaacct

SEQ ID NO: 149077 - DNA, 25 bp, Rattus norvegicus
agggcatccagtattacactcagtt

SEQ ID NO: 149078 - DNA, 25 bp, Rattus norvegicus
agggcatccagttttacactcagtt

SEQ ID NO: 149079 - DNA, 25 bp, Rattus norvegicus
agggcatcccagacgacctgtggtg

SEQ ID NO: 149080 - DNA, 25 bp, Rattus norvegicus
agggcatcccagtcgacctgtggtg

SEQ ID NO: 149081 - DNA, 25 bp, Rattus norvegicus
agggcatccctgagttgccaagcga

SEQ ID NO: 149082 - DNA, 25 bp, Rattus norvegicus
agggcatccctgatacttggacaag

SEQ ID NO: 149083 - DNA, 25 bp, Rattus norvegicus
agggcatccctgtgttgccaagcga

SEQ ID NO: 149084 - DNA, 25 bp, Rattus norvegicus
agggcatccctgttacttggacaag

SEQ ID NO: 149085 - DNA, 25 bp, Rattus norvegicus
agggcatcgagtacgacgtcatcac

SEQ ID NO: 149086 - DNA, 25 bp, Rattus norvegicus
agggcatcgagttcgacgtcatcac

SEQ ID NO: 149087 - DNA, 25 bp, Rattus norvegicus
agggcatctcccagagtcttacctt

SEQ ID NO: 149088 - DNA, 25 bp, Rattus norvegicus
agggcatctccctgagtcttacctt

SEQ ID NO: 149089 - DNA, 25 bp, Rattus norvegicus
agggcatctcctctgtgttttaaag

SEQ ID NO: 149090 - DNA, 25 bp, Rattus norvegicus
agggcatctcctgtgtgttttaaag

SEQ ID NO: 149091 - DNA, 25 bp, Rattus norvegicus
agggcatctcttatattgacccaga

SEQ ID NO: 149092 - DNA, 25 bp, Rattus norvegicus
agggcatctcttttattgacccaga

SEQ ID NO: 149093 - DNA, 25 bp, Rattus norvegicus
agggcatcttcaccagcagaacctt

SEQ ID NO: 149094 - DNA, 25 bp, Rattus norvegicus
agggcatcttcagcagcagaacctt

SEQ ID NO: 149095 - DNA, 25 bp, Rattus norvegicus
agggcatcttgacggcgcatctgct

SEQ ID NO: 149096 - DNA, 25 bp, Rattus norvegicus
agggcatcttgagggcgcatctgct

SEQ ID NO: 149097 - DNA, 25 bp, Rattus norvegicus
agggcatgaccaaccgttggtggat

SEQ ID NO: 149098 - DNA, 25 bp, Rattus norvegicus
agggcatgaccatccgttggtggat

SEQ ID NO: 149099 - DNA, 25 bp, Rattus norvegicus
agggcatgaggcagcacatctacca

SEQ ID NO: 149100 - DNA, 25 bp, Rattus norvegicus
agggcatgaggctgcacatctacca

SEQ ID NO: 149101 - DNA, 25 bp, Rattus norvegicus
agggcatgccgcacttgcagtaaat

SEQ ID NO: 149102 - DNA, 25 bp, Rattus norvegicus
agggcatgccgctcttgcagtaaat

SEQ ID NO: 149103 - DNA, 25 bp, Rattus norvegicus
agggcatgcctcagagcctccaggt

SEQ ID NO: 149104 - DNA, 25 bp, Rattus norvegicus
agggcatgcctctgagcctccaggt

SEQ ID NO: 149105 - DNA, 25 bp, Rattus norvegicus
agggcatgcgacaatacagcttatt

SEQ ID NO: 149106 - DNA, 25 bp, Rattus norvegicus
agggcatgcgactatacagcttatt

SEQ ID NO: 149107 - DNA, 25 bp, Rattus norvegicus
agggcatgcttcagtccccatatga

SEQ ID NO: 149108 - DNA, 25 bp, Rattus norvegicus
agggcatgcttctgtccccatatga

SEQ ID NO: 149109 - DNA, 25 bp, Rattus norvegicus
agggcatggaacatctgctcagcat

SEQ ID NO: 149110 - DNA, 25 bp, Rattus norvegicus
agggcatggaacttctgctcagcat

SEQ ID NO: 149111 - DNA, 25 bp, Rattus norvegicus
agggcatggcctagctcctgagcaa

SEQ ID NO: 149112 - DNA, 25 bp, Rattus norvegicus
agggcatggccttgctcctgagcaa

SEQ ID NO: 149113 - DNA, 25 bp, Rattus norvegicus
agggcatggcgtattccttcaccaa

SEQ ID NO: 149114 - DNA, 25 bp, Rattus norvegicus
agggcatggcgtctagcttccccaa

SEQ ID NO: 149115 - DNA, 25 bp, Rattus norvegicus
agggcatggcgtgtagcttccccaa

SEQ ID NO: 149116 - DNA, 25 bp, Rattus norvegicus
agggcatggcgttttccttcaccaa

SEQ ID NO: 149117 - DNA, 25 bp, Rattus norvegicus
agggcatggcttcgctcccaagata

SEQ ID NO: 149118 - DNA, 25 bp, Rattus norvegicus
agggcatggcttggctcccaagata

SEQ ID NO: 149119 - DNA, 25 bp, Rattus norvegicus
agggcatgggctatgagtcagcact

SEQ ID NO: 149120 - DNA, 25 bp, Rattus norvegicus
agggcatgggctttgagtcagcact

SEQ ID NO: 149121 - DNA, 25 bp, Rattus norvegicus
agggcatgggtcattcttccatatc

SEQ ID NO: 149122 - DNA, 25 bp, Rattus norvegicus
agggcatgggtctttcttccatatc

SEQ ID NO: 149123 - DNA, 25 bp, Rattus norvegicus
agggcatgtcgcatctctctgggaa

SEQ ID NO: 149124 - DNA, 25 bp, Rattus norvegicus
agggcatgtcgcttctctctgggaa

SEQ ID NO: 149125 - DNA, 25 bp, Rattus norvegicus
agggcatgtctgctttagttctaga

SEQ ID NO: 149126 - DNA, 25 bp, Rattus norvegicus
agggcatgtctggtttagttctaga

SEQ ID NO: 149127 - DNA, 25 bp, Rattus norvegicus
agggcatgtgacctttgaggcaaat

SEQ ID NO: 149128 - DNA, 25 bp, Rattus norvegicus
agggcatgtgacgtttgaggcaaat

SEQ ID NO: 149129 - DNA, 25 bp, Rattus norvegicus
agggcatgtgcccaccaaaacccag

SEQ ID NO: 149130 - DNA, 25 bp, Rattus norvegicus
agggcatgtgccgaccaaaacccag

SEQ ID NO: 149131 - DNA, 25 bp, Rattus norvegicus
agggcatgtgctatatcagactgaa

SEQ ID NO: 149132 - DNA, 25 bp, Rattus norvegicus
agggcatgtgctttatcagactgaa

SEQ ID NO: 149133 - DNA, 25 bp, Rattus norvegicus
agggcatgtgtaacctgcatcctaa

SEQ ID NO: 149134 - DNA, 25 bp, Rattus norvegicus
agggcatgtgtatcctgcatcctaa

SEQ ID NO: 149135 - DNA, 25 bp, Rattus norvegicus
agggcatgttacacagtcacctgaa

SEQ ID NO: 149136 - DNA, 25 bp, Rattus norvegicus
agggcatgttactcagtcacctgaa

SEQ ID NO: 149137 - DNA, 25 bp, Rattus norvegicus
agggcatgttttcccacctgtgcaa

SEQ ID NO: 149138 - DNA, 25 bp, Rattus norvegicus
agggcatgttttgccacctgtgcaa

SEQ ID NO: 149139 - DNA, 25 bp, Rattus norvegicus
agggcattcatgctgcctcagtaaa

SEQ ID NO: 149140 - DNA, 25 bp, Rattus norvegicus
agggcattcatggtgcctcagtaaa

SEQ ID NO: 149141 - DNA, 25 bp, Rattus norvegicus
agggcattccatacctcatgtgcag

SEQ ID NO: 149142 - DNA, 25 bp, Rattus norvegicus
agggcattccattcctcatgtgcag

SEQ ID NO: 149143 - DNA, 25 bp, Rattus norvegicus
agggcattcccacgcaaggcagacg

SEQ ID NO: 149144 - DNA, 25 bp, Rattus norvegicus
agggcattcccaggcaaggcagacg

SEQ ID NO: 149145 - DNA, 25 bp, Rattus norvegicus
agggcattcctgctgatcttagaag

SEQ ID NO: 149146 - DNA, 25 bp, Rattus norvegicus
agggcattcctggtgatcttagaag

SEQ ID NO: 149147 - DNA, 25 bp, Rattus norvegicus
agggcattctgcattttagctttga

SEQ ID NO: 149148 - DNA, 25 bp, Rattus norvegicus
agggcattctgctttttagctttga

SEQ ID NO: 149149 - DNA, 25 bp, Rattus norvegicus
agggcattgggtacgccagtaactg

SEQ ID NO: 149150 - DNA, 25 bp, Rattus norvegicus
agggcattgggttcgccagtaactg

SEQ ID NO: 149151 - DNA, 25 bp, Rattus norvegicus
agggcattgtccaatggttgggcta

SEQ ID NO: 149152 - DNA, 25 bp, Rattus norvegicus
agggcattgtcctatggttgggcta

SEQ ID NO: 149153 - DNA, 25 bp, Rattus norvegicus
agggcatttcctctgtagtgttagc

SEQ ID NO: 149154 - DNA, 25 bp, Rattus norvegicus
agggcatttcctgtgtagtgttagc

SEQ ID NO: 149155 - DNA, 25 bp, Rattus norvegicus
agggcatttcttatatctgtgtctt

SEQ ID NO: 149156 - DNA, 25 bp, Rattus norvegicus
agggcatttcttttatctgtgtctt

SEQ ID NO: 149157 - DNA, 25 bp, Rattus norvegicus
agggcatttgacactgagccttggc

SEQ ID NO: 149158 - DNA, 25 bp, Rattus norvegicus
agggcatttgactctgagccttggc

SEQ ID NO: 149159 - DNA, 25 bp, Rattus norvegicus
agggcatttgcccagcataaattaa

SEQ ID NO: 149160 - DNA, 25 bp, Rattus norvegicus
agggcatttgccgagcataaattaa

SEQ ID NO: 149161 - DNA, 25 bp, Rattus norvegicus
agggcatttggaccctgtggctaaa

SEQ ID NO: 149162 - DNA, 25 bp, Rattus norvegicus
agggcatttggagcctgtggctaaa

SEQ ID NO: 149163 - DNA, 25 bp, Rattus norvegicus
agggcatttggtaagccttcctcca

SEQ ID NO: 149164 - DNA, 25 bp, Rattus norvegicus
agggcatttggttagccttcctcca

SEQ ID NO: 149165 - DNA, 25 bp, Rattus norvegicus
agggcatttttcctttatgcttcaa

SEQ ID NO: 149166 - DNA, 25 bp, Rattus norvegicus
agggcatttttcgtttatgcttcaa

SEQ ID NO: 149167 - DNA, 25 bp, Rattus norvegicus
agggccaaacgcaagattgtcccac

SEQ ID NO: 149168 - DNA, 25 bp, Rattus norvegicus
agggccaaacgctagattgtcccac

SEQ ID NO: 149169 - DNA, 25 bp, Rattus norvegicus
agggccaacagcagccggtagttct

SEQ ID NO: 149170 - DNA, 25 bp, Rattus norvegicus
agggccaacagctgccggtagttct

SEQ ID NO: 149171 - DNA, 25 bp, Rattus norvegicus
agggccaaccaccagacaggcagtt

SEQ ID NO: 149172 - DNA, 25 bp, Rattus norvegicus
agggccaaccacgagacaggcagtt

SEQ ID NO: 149173 - DNA, 25 bp, Rattus norvegicus
agggccaactgcaaagcgctaggtt

SEQ ID NO: 149174 - DNA, 25 bp, Rattus norvegicus
agggccaactgctaagcgctaggtt

SEQ ID NO: 149175 - DNA, 25 bp, Rattus norvegicus
agggccaagccaccccttggatgaa

SEQ ID NO: 149176 - DNA, 25 bp, Rattus norvegicus
agggccaagccagcccttggatgaa

SEQ ID NO: 149177 - DNA, 25 bp, Rattus norvegicus
agggccaagcgaaccaggtctaagt

SEQ ID NO: 149178 - DNA, 25 bp, Rattus norvegicus
agggccaagcgatccaggtctaagt

SEQ ID NO: 149179 - DNA, 25 bp, Rattus norvegicus
agggccaaggcacggacaactcaaa

SEQ ID NO: 149180 - DNA, 25 bp, Rattus norvegicus
agggccaaggcagggacaactcaaa

SEQ ID NO: 149181 - DNA, 25 bp, Rattus norvegicus
agggccaatggcagaacttaataat

SEQ ID NO: 149182 - DNA, 25 bp, Rattus norvegicus
agggccaatggctgaacttaataat

SEQ ID NO: 149183 - DNA, 25 bp, Rattus norvegicus
agggccacacagatgtgctctagaa

SEQ ID NO: 149184 - DNA, 25 bp, Rattus norvegicus
agggccacacagttgtgctctagaa

SEQ ID NO: 149185 - DNA, 25 bp, Rattus norvegicus
agggccacacatctatgacagtcac

SEQ ID NO: 149186 - DNA, 25 bp, Rattus norvegicus
agggccacacatgtatgacagtcac

SEQ ID NO: 149187 - DNA, 25 bp, Rattus norvegicus
agggccacaccaaagtacactcagg

SEQ ID NO: 149188 - DNA, 25 bp, Rattus norvegicus
agggccacaccatagtacactcagg

SEQ ID NO: 149189 - DNA, 25 bp, Rattus norvegicus
agggccacactgcacacagctcggt

SEQ ID NO: 149190 - DNA, 25 bp, Rattus norvegicus
agggccacactgctggtttcttcct

SEQ ID NO: 149191 - DNA, 25 bp, Rattus norvegicus
agggccacactggacacagctcggt

SEQ ID NO: 149192 - DNA, 25 bp, Rattus norvegicus
agggccacactggtggtttcttcct

SEQ ID NO: 149193 - DNA, 25 bp, Rattus norvegicus
agggccacacttccttgcccattat

SEQ ID NO: 149194 - DNA, 25 bp, Rattus norvegicus
agggccacacttgcttgcccattat

SEQ ID NO: 149195 - DNA, 25 bp, Rattus norvegicus
agggccacagacattcctggtagag

SEQ ID NO: 149196 - DNA, 25 bp, Rattus norvegicus
agggccacagactttcctggtagag

SEQ ID NO: 149197 - DNA, 25 bp, Rattus norvegicus
agggccacagatcacgtgccattat

SEQ ID NO: 149198 - DNA, 25 bp, Rattus norvegicus
agggccacagatgacgtgccattat

SEQ ID NO: 149199 - DNA, 25 bp, Rattus norvegicus
agggccacagccaggagaaaccatc

SEQ ID NO: 149200 - DNA, 25 bp, Rattus norvegicus
agggccacagcctggagaaaccatc

SEQ ID NO: 149201 - DNA, 25 bp, Rattus norvegicus
agggccacattaccagttgacttga

SEQ ID NO: 149202 - DNA, 25 bp, Rattus norvegicus
agggccacattagcagttgacttga

SEQ ID NO: 149203 - DNA, 25 bp, Rattus norvegicus
agggccacctagcaagccatggttt

SEQ ID NO: 149204 - DNA, 25 bp, Rattus norvegicus
agggccacctaggaagccatggttt

SEQ ID NO: 149205 - DNA, 25 bp, Rattus norvegicus
agggccacctcacgagcttgttgaa

SEQ ID NO: 149206 - DNA, 25 bp, Rattus norvegicus
agggccacctcaggagcttgttgaa

SEQ ID NO: 149207 - DNA, 25 bp, Rattus norvegicus
agggccacctgccagggtgatacca

SEQ ID NO: 149208 - DNA, 25 bp, Rattus norvegicus
agggccacctgcgagggtgatacca

SEQ ID NO: 149209 - DNA, 25 bp, Rattus norvegicus
agggccaccttcaaggagctcagag

SEQ ID NO: 149210 - DNA, 25 bp, Rattus norvegicus
agggccaccttctaggagctcagag

SEQ ID NO: 149211 - DNA, 25 bp, Rattus norvegicus
agggccacgccaattgctgaagcca

SEQ ID NO: 149212 - DNA, 25 bp, Rattus norvegicus
agggccacgccatttgctgaagcca

SEQ ID NO: 149213 - DNA, 25 bp, Rattus norvegicus
agggccactgtgctgagatcattca

SEQ ID NO: 149214 - DNA, 25 bp, Rattus norvegicus
agggccactgtggtgagatcattca

SEQ ID NO: 149215 - DNA, 25 bp, Rattus norvegicus
agggccacttctagtgttcggttca

SEQ ID NO: 149216 - DNA, 25 bp, Rattus norvegicus
agggccacttcttgtgttcggttca

SEQ ID NO: 149217 - DNA, 25 bp, Rattus norvegicus
agggccagaagtcaagggtcacatc

SEQ ID NO: 149218 - DNA, 25 bp, Rattus norvegicus
agggccagaagtgaagggtcacatc

SEQ ID NO: 149219 - DNA, 25 bp, Rattus norvegicus
agggccagaccactctctgcatgga

SEQ ID NO: 149220 - DNA, 25 bp, Rattus norvegicus
agggccagaccagtctctgcatgga

SEQ ID NO: 149221 - DNA, 25 bp, Rattus norvegicus
agggccagatgacggctaagcctct

SEQ ID NO: 149222 - DNA, 25 bp, Rattus norvegicus
agggccagatgagggctaagcctct

SEQ ID NO: 149223 - DNA, 25 bp, Rattus norvegicus
agggccagcaaaccagctcggtttc

SEQ ID NO: 149224 - DNA, 25 bp, Rattus norvegicus
agggccagcaaagcagctcggtttc

SEQ ID NO: 149225 - DNA, 25 bp, Rattus norvegicus
agggccagcccacgatacacgagac

SEQ ID NO: 149226 - DNA, 25 bp, Rattus norvegicus
agggccagcccaggatacacgagac

SEQ ID NO: 149227 - DNA, 25 bp, Rattus norvegicus
agggccagccctagagtgtatcatc

SEQ ID NO: 149228 - DNA, 25 bp, Rattus norvegicus
agggccagcccttgagtgtatcatc

SEQ ID NO: 149229 - DNA, 25 bp, Rattus norvegicus
agggccagcctaacctgaatttaca

SEQ ID NO: 149230 - DNA, 25 bp, Rattus norvegicus
agggccagcctatcctgaatttaca

SEQ ID NO: 149231 - DNA, 25 bp, Rattus norvegicus
agggccagcctcatggtactgggaa

SEQ ID NO: 149232 - DNA, 25 bp, Rattus norvegicus
agggccagcctcttggtactgggaa

SEQ ID NO: 149233 - DNA, 25 bp, Rattus norvegicus
agggccagctaaaaaagcctcccct

SEQ ID NO: 149234 - DNA, 25 bp, Rattus norvegicus
agggccagctaataaagcctcccct

SEQ ID NO: 149235 - DNA, 25 bp, Rattus norvegicus
agggccaggactctataccactcat

SEQ ID NO: 149236 - DNA, 25 bp, Rattus norvegicus
agggccaggactgtataccactcat

SEQ ID NO: 149237 - DNA, 25 bp, Rattus norvegicus
agggccaggatgatacaaggtctat

SEQ ID NO: 149238 - DNA, 25 bp, Rattus norvegicus
agggccaggatgttacaaggtctat

SEQ ID NO: 149239 - DNA, 25 bp, Rattus norvegicus
agggccaggcacagaccgtgctttc

SEQ ID NO: 149240 - DNA, 25 bp, Rattus norvegicus
agggccaggcactgaccgtgctttc

SEQ ID NO: 149241 - DNA, 25 bp, Rattus norvegicus
agggccaggcatacactacacagag

SEQ ID NO: 149242 - DNA, 25 bp, Rattus norvegicus
agggccaggcattcactacacagag

SEQ ID NO: 149243 - DNA, 25 bp, Rattus norvegicus
agggccaggcctctgagacatccaa

SEQ ID NO: 149244 - DNA, 25 bp, Rattus norvegicus
agggccaggcctgtgagacatccaa

SEQ ID NO: 149245 - DNA, 25 bp, Rattus norvegicus
agggccagggcaacaagaacccagt

SEQ ID NO: 149246 - DNA, 25 bp, Rattus norvegicus
agggccagggcatcaagaacccagt

SEQ ID NO: 149247 - DNA, 25 bp, Rattus norvegicus
agggccagggtacagctttgactac

SEQ ID NO: 149248 - DNA, 25 bp, Rattus norvegicus
agggccagggtagagctttgactac

SEQ ID NO: 149249 - DNA, 25 bp, Rattus norvegicus
agggccaggtgcaccagacccaagg

SEQ ID NO: 149250 - DNA, 25 bp, Rattus norvegicus
agggccaggtgctccagacccaagg

SEQ ID NO: 149251 - DNA, 25 bp, Rattus norvegicus
agggccagtaccaggtccccgatgg

SEQ ID NO: 149252 - DNA, 25 bp, Rattus norvegicus
agggccagtacctggtccccgatgg

SEQ ID NO: 149253 - DNA, 25 bp, Rattus norvegicus
agggccagtatcatctgaggctgca

SEQ ID NO: 149254 - DNA, 25 bp, Rattus norvegicus
agggccagtatcttctgaggctgca

SEQ ID NO: 149255 - DNA, 25 bp, Rattus norvegicus
agggccagtcacaatgctcaggtaa

SEQ ID NO: 149256 - DNA, 25 bp, Rattus norvegicus
agggccagtcactatgctcaggtaa

SEQ ID NO: 149257 - DNA, 25 bp, Rattus norvegicus
agggccagtgcgcagatccacatct

SEQ ID NO: 149258 - DNA, 25 bp, Rattus norvegicus
agggccagtgcggagatccacatct

SEQ ID NO: 149259 - DNA, 25 bp, Rattus norvegicus
agggccagttgaatccagttctcag

SEQ ID NO: 149260 - DNA, 25 bp, Rattus norvegicus
agggccagttgattccagttctcag

SEQ ID NO: 149261 - DNA, 25 bp, Rattus norvegicus
agggccagttgtcgttactcatcct

SEQ ID NO: 149262 - DNA, 25 bp, Rattus norvegicus
agggccagttgtggttactcatcct

SEQ ID NO: 149263 - DNA, 25 bp, Rattus norvegicus
agggccatacctcttaatcctcaaa

SEQ ID NO: 149264 - DNA, 25 bp, Rattus norvegicus
agggccatacctgttaatcctcaaa

SEQ ID NO: 149265 - DNA, 25 bp, Rattus norvegicus
agggccatacttaaacctggacagc

SEQ ID NO: 149266 - DNA, 25 bp, Rattus norvegicus
agggccatactttaacctggacagc

SEQ ID NO: 149267 - DNA, 25 bp, Rattus norvegicus
agggccatattgacctgctgcagga

SEQ ID NO: 149268 - DNA, 25 bp, Rattus norvegicus
agggccatattgtcctgctgcagga

SEQ ID NO: 149269 - DNA, 25 bp, Rattus norvegicus
agggccatcaataggttcatcgtcc

SEQ ID NO: 149270 - DNA, 25 bp, Rattus norvegicus
agggccatcaattggttcatcgtcc

SEQ ID NO: 149271 - DNA, 25 bp, Rattus norvegicus
agggccatctccagagggaccaagg

SEQ ID NO: 149272 - DNA, 25 bp, Rattus norvegicus
agggccatctcctgagggaccaagg

SEQ ID NO: 149273 - DNA, 25 bp, Rattus norvegicus
agggccatgatgaagcctccttact

SEQ ID NO: 149274 - DNA, 25 bp, Rattus norvegicus
agggccatgatgtagcctccttact

SEQ ID NO: 149275 - DNA, 25 bp, Rattus norvegicus
agggccatgcaccaggcctcaggta

SEQ ID NO: 149276 - DNA, 25 bp, Rattus norvegicus
agggccatgcacgaggcctcaggta

SEQ ID NO: 149277 - DNA, 25 bp, Rattus norvegicus
agggccatgcctaagttggacccaa

SEQ ID NO: 149278 - DNA, 25 bp, Rattus norvegicus
agggccatgccttagttggacccaa

SEQ ID NO: 149279 - DNA, 25 bp, Rattus norvegicus
agggccatgctcctgcaagccaatg

SEQ ID NO: 149280 - DNA, 25 bp, Rattus norvegicus
agggccatgctcgtgcaagccaatg

SEQ ID NO: 149281 - DNA, 25 bp, Rattus norvegicus
agggccatgctgacgtggtcaacat

SEQ ID NO: 149282 - DNA, 25 bp, Rattus norvegicus
agggccatgctgtcgtggtcaacat

SEQ ID NO: 149283 - DNA, 25 bp, Rattus norvegicus
agggccatggcaagagctagatgta

SEQ ID NO: 149284 - DNA, 25 bp, Rattus norvegicus
agggccatggcatgagctagatgta

SEQ ID NO: 149285 - DNA, 25 bp, Rattus norvegicus
agggccatggctatgagacactgca

SEQ ID NO: 149286 - DNA, 25 bp, Rattus norvegicus
agggccatggctttgagacactgca

SEQ ID NO: 149287 - DNA, 25 bp, Rattus norvegicus
agggccatgggtacaagcctcacga

SEQ ID NO: 149288 - DNA, 25 bp, Rattus norvegicus
agggccatgggttcaagcctcacga

SEQ ID NO: 149289 - DNA, 25 bp, Rattus norvegicus
agggccatgtccacatgtgccagta

SEQ ID NO: 149290 - DNA, 25 bp, Rattus norvegicus
agggccatgtcctcatgtgccagta

SEQ ID NO: 149291 - DNA, 25 bp, Rattus norvegicus
agggccattacactgctctctgtaa

SEQ ID NO: 149292 - DNA, 25 bp, Rattus norvegicus
agggccattacagtgctctctgtaa

SEQ ID NO: 149293 - DNA, 25 bp, Rattus norvegicus
agggccattcctcatttggatgctg

SEQ ID NO: 149294 - DNA, 25 bp, Rattus norvegicus
agggccattcctgatttggatgctg

SEQ ID NO: 149295 - DNA, 25 bp, Rattus norvegicus
agggccattgcaaactcgttgacat

SEQ ID NO: 149296 - DNA, 25 bp, Rattus norvegicus
agggccattgcatactcgttgacat

SEQ ID NO: 149297 - DNA, 25 bp, Rattus norvegicus
agggccattgtcctagctgcaagaa

SEQ ID NO: 149298 - DNA, 25 bp, Rattus norvegicus
agggccattgtcgtagctgcaagaa

SEQ ID NO: 149299 - DNA, 25 bp, Rattus norvegicus
agggccatttgcaaatctgtccttg

SEQ ID NO: 149300 - DNA, 25 bp, Rattus norvegicus
agggccatttgctaatctgtccttg

SEQ ID NO: 149301 - DNA, 25 bp, Rattus norvegicus
agggccatttggcttctgagacttc

SEQ ID NO: 149302 - DNA, 25 bp, Rattus norvegicus
agggccatttgggttctgagacttc

SEQ ID NO: 149303 - DNA, 25 bp, Rattus norvegicus
agggcccaatgtcccaaatgttgat

SEQ ID NO: 149304 - DNA, 25 bp, Rattus norvegicus
agggcccaatgtgccaaatgttgat

SEQ ID NO: 149305 - DNA, 25 bp, Rattus norvegicus
agggcccacaaaagaccttgtttgt

SEQ ID NO: 149306 - DNA, 25 bp, Rattus norvegicus
agggcccacaaatgaccttgtttgt

SEQ ID NO: 149307 - DNA, 25 bp, Rattus norvegicus
agggcccacagacgctggtcttgaa

SEQ ID NO: 149308 - DNA, 25 bp, Rattus norvegicus
agggcccacagaggctggtcttgaa

SEQ ID NO: 149309 - DNA, 25 bp, Rattus norvegicus
agggcccactctccagatctagtgc

SEQ ID NO: 149310 - DNA, 25 bp, Rattus norvegicus
agggcccactctgcagatctagtgc

SEQ ID NO: 149311 - DNA, 25 bp, Rattus norvegicus
agggcccagagcaagatcttctttg

SEQ ID NO: 149312 - DNA, 25 bp, Rattus norvegicus
agggcccagagctagatcttctttg

SEQ ID NO: 149313 - DNA, 25 bp, Rattus norvegicus
agggcccagcctattggtagtgcta

SEQ ID NO: 149314 - DNA, 25 bp, Rattus norvegicus
agggcccagccttttggtagtgcta

SEQ ID NO: 149315 - DNA, 25 bp, Rattus norvegicus
agggcccagctgaggcgagctcttc

SEQ ID NO: 149316 - DNA, 25 bp, Rattus norvegicus
agggcccagctgtggcgagctcttc

SEQ ID NO: 149317 - DNA, 25 bp, Rattus norvegicus
agggcccagcttagctgctgacaga

SEQ ID NO: 149318 - DNA, 25 bp, Rattus norvegicus
agggcccagctttgctgctgacaga

SEQ ID NO: 149319 - DNA, 25 bp, Rattus norvegicus
agggcccagggtcatttctcatgag

SEQ ID NO: 149320 - DNA, 25 bp, Rattus norvegicus
agggcccagggtgatttctcatgag

SEQ ID NO: 149321 - DNA, 25 bp, Rattus norvegicus
agggcccagtgaccaggtctatgaa

SEQ ID NO: 149322 - DNA, 25 bp, Rattus norvegicus
agggcccagtgagcaggtctatgaa

SEQ ID NO: 149323 - DNA, 25 bp, Rattus norvegicus
agggcccatgagactgaggtctcag

SEQ ID NO: 149324 - DNA, 25 bp, Rattus norvegicus
agggcccatgagtctgaggtctcag

SEQ ID NO: 149325 - DNA, 25 bp, Rattus norvegicus
agggccccactgaccagggcacaga

SEQ ID NO: 149326 - DNA, 25 bp, Rattus norvegicus
agggccccactgtccagggcacaga

SEQ ID NO: 149327 - DNA, 25 bp, Rattus norvegicus
agggccccaggccaggcatattgaa

SEQ ID NO: 149328 - DNA, 25 bp, Rattus norvegicus
agggccccaggcgaggcatattgaa

SEQ ID NO: 149329 - DNA, 25 bp, Rattus norvegicus
agggccccggagacccatgtgagaa

SEQ ID NO: 149330 - DNA, 25 bp, Rattus norvegicus
agggccccggagtcccatgtgagaa

SEQ ID NO: 149331 - DNA, 25 bp, Rattus norvegicus
agggcccctcctcgttctcagaggt

SEQ ID NO: 149332 - DNA, 25 bp, Rattus norvegicus
agggcccctcctggttctcagaggt

SEQ ID NO: 149333 - DNA, 25 bp, Rattus norvegicus
agggccccttcccttggtgctctgt

SEQ ID NO: 149334 - DNA, 25 bp, Rattus norvegicus
agggccccttccgttggtgctctgt

SEQ ID NO: 149335 - DNA, 25 bp, Rattus norvegicus
agggccccttgcactgtgagcctag

SEQ ID NO: 149336 - DNA, 25 bp, Rattus norvegicus
agggccccttgctctgtgagcctag

SEQ ID NO: 149337 - DNA, 25 bp, Rattus norvegicus
agggcccctttgagtcacaccctgg

SEQ ID NO: 149338 - DNA, 25 bp, Rattus norvegicus
agggcccctttgtgtcacaccctgg

SEQ ID NO: 149339 - DNA, 25 bp, Rattus norvegicus
agggcccgcatgatctttctggagg

SEQ ID NO: 149340 - DNA, 25 bp, Rattus norvegicus
agggcccgcatgttctttctggagg

SEQ ID NO: 149341 - DNA, 25 bp, Rattus norvegicus
agggcccggactagaagctagagct

SEQ ID NO: 149342 - DNA, 25 bp, Rattus norvegicus
agggcccggacttgaagctagagct

SEQ ID NO: 149343 - DNA, 25 bp, Rattus norvegicus
agggccctagacaatcttgcttttg

SEQ ID NO: 149344 - DNA, 25 bp, Rattus norvegicus
agggccctagactatcttgcttttg

SEQ ID NO: 149345 - DNA, 25 bp, Rattus norvegicus
agggccctccatagaggacggcata

SEQ ID NO: 149346 - DNA, 25 bp, Rattus norvegicus
agggccctccatcatgtaggcagga

SEQ ID NO: 149347 - DNA, 25 bp, Rattus norvegicus
agggccctccatgatgtaggcagga

SEQ ID NO: 149348 - DNA, 25 bp, Rattus norvegicus
agggccctccattgaggacggcata

SEQ ID NO: 149349 - DNA, 25 bp, Rattus norvegicus
agggccctccggatcaggataagaa

SEQ ID NO: 149350 - DNA, 25 bp, Rattus norvegicus
agggccctccggttcaggataagaa

SEQ ID NO: 149351 - DNA, 25 bp, Rattus norvegicus
agggccctcggcacaccagtggcag

SEQ ID NO: 149352 - DNA, 25 bp, Rattus norvegicus
agggccctcggctcaccagtggcag

SEQ ID NO: 149353 - DNA, 25 bp, Rattus norvegicus
agggccctgaatactgaacctgtga

SEQ ID NO: 149354 - DNA, 25 bp, Rattus norvegicus
agggccctgaattctgaacctgtga

SEQ ID NO: 149355 - DNA, 25 bp, Rattus norvegicus
agggccctgctccacattgtgagtt

SEQ ID NO: 149356 - DNA, 25 bp, Rattus norvegicus
agggccctgctcgacattgtgagtt

SEQ ID NO: 149357 - DNA, 25 bp, Rattus norvegicus
agggccctgcttagatgaagtccga

SEQ ID NO: 149358 - DNA, 25 bp, Rattus norvegicus
agggccctgctttgatgaagtccga

SEQ ID NO: 149359 - DNA, 25 bp, Rattus norvegicus
agggccctggcaatccttatactga

SEQ ID NO: 149360 - DNA, 25 bp, Rattus norvegicus
agggccctggcattccttatactga

SEQ ID NO: 149361 - DNA, 25 bp, Rattus norvegicus
agggccctgggcataaacctatgcg

SEQ ID NO: 149362 - DNA, 25 bp, Rattus norvegicus
agggccctgggcttaaacctatgcg

SEQ ID NO: 149363 - DNA, 25 bp, Rattus norvegicus
agggccctgtgcagctgggacccaa

SEQ ID NO: 149364 - DNA, 25 bp, Rattus norvegicus
agggccctgtgctgctgggacccaa

SEQ ID NO: 149365 - DNA, 25 bp, Rattus norvegicus
agggcccttaaacattcatcatctt

SEQ ID NO: 149366 - DNA, 25 bp, Rattus norvegicus
agggcccttaaagattcatcatctt

SEQ ID NO: 149367 - DNA, 25 bp, Rattus norvegicus
agggcccttcagcatctaacaatac

SEQ ID NO: 149368 - DNA, 25 bp, Rattus norvegicus
agggcccttcaggatctaacaatac

SEQ ID NO: 149369 - DNA, 25 bp, Rattus norvegicus
agggcccttgtactcttgtgctgtc

SEQ ID NO: 149370 - DNA, 25 bp, Rattus norvegicus
agggcccttgtagtcttgtgctgtc

SEQ ID NO: 149371 - DNA, 25 bp, Rattus norvegicus
agggcccttgtgagtcccaccctgg

SEQ ID NO: 149372 - DNA, 25 bp, Rattus norvegicus
agggcccttgtgtgtcccaccctgg

SEQ ID NO: 149373 - DNA, 25 bp, Rattus norvegicus
agggcccttttcactatggtatgaa

SEQ ID NO: 149374 - DNA, 25 bp, Rattus norvegicus
agggcccttttctctatggtatgaa

SEQ ID NO: 149375 - DNA, 25 bp, Rattus norvegicus
agggccgagggcaccttaagaagat

SEQ ID NO: 149376 - DNA, 25 bp, Rattus norvegicus
agggccgagggctccttaagaagat

SEQ ID NO: 149377 - DNA, 25 bp, Rattus norvegicus
agggccgatggcaggactctgacca

SEQ ID NO: 149378 - DNA, 25 bp, Rattus norvegicus
agggccgatggctggactctgacca

SEQ ID NO: 149379 - DNA, 25 bp, Rattus norvegicus
agggccgccgtgagggttatctata

SEQ ID NO: 149380 - DNA, 25 bp, Rattus norvegicus
agggccgccgtgtgggttatctata

SEQ ID NO: 149381 - DNA, 25 bp, Rattus norvegicus
agggccgctagtcatgttcacgtac

SEQ ID NO: 149382 - DNA, 25 bp, Rattus norvegicus
agggccgctagtgatgttcacgtac

SEQ ID NO: 149383 - DNA, 25 bp, Rattus norvegicus
agggccgctgtgacagaggacgctg

SEQ ID NO: 149384 - DNA, 25 bp, Rattus norvegicus
agggccgctgtgtcagaggacgctg

SEQ ID NO: 149385 - DNA, 25 bp, Rattus norvegicus
agggccggagacaggacctgcttcc

SEQ ID NO: 149386 - DNA, 25 bp, Rattus norvegicus
agggccggagactggacctgcttcc

SEQ ID NO: 149387 - DNA, 25 bp, Rattus norvegicus
agggccgggaagacagagctccact

SEQ ID NO: 149388 - DNA, 25 bp, Rattus norvegicus
agggccgggaagtcagagctccact

SEQ ID NO: 149389 - DNA, 25 bp, Rattus norvegicus
agggccgtccccagatgtaatgttg

SEQ ID NO: 149390 - DNA, 25 bp, Rattus norvegicus
agggccgtcccctgatgtaatgttg

SEQ ID NO: 149391 - DNA, 25 bp, Rattus norvegicus
agggccgtcggacctctgagttcca

SEQ ID NO: 149392 - DNA, 25 bp, Rattus norvegicus
agggccgtcggagctctgagttcca

SEQ ID NO: 149393 - DNA, 25 bp, Rattus norvegicus
agggccgtggacaacaaccaacaat

SEQ ID NO: 149394 - DNA, 25 bp, Rattus norvegicus
agggccgtggactacaaccaacaat

SEQ ID NO: 149395 - DNA, 25 bp, Rattus norvegicus
agggccgtggtgacacacatcttta

SEQ ID NO: 149396 - DNA, 25 bp, Rattus norvegicus
agggccgtggtgtcacacatcttta

SEQ ID NO: 149397 - DNA, 25 bp, Rattus norvegicus
agggcctaaccccatcaggtcgagg

SEQ ID NO: 149398 - DNA, 25 bp, Rattus norvegicus
agggcctaacccgatcaggtcgagg

SEQ ID NO: 149399 - DNA, 25 bp, Rattus norvegicus
agggcctaagctactagtgacctgt

SEQ ID NO: 149400 - DNA, 25 bp, Rattus norvegicus
agggcctaagcttctagtgacctgt

SEQ ID NO: 149401 - DNA, 25 bp, Rattus norvegicus
agggcctaatctcggtttcagtata

SEQ ID NO: 149402 - DNA, 25 bp, Rattus norvegicus
agggcctaatctgggtttcagtata

SEQ ID NO: 149403 - DNA, 25 bp, Rattus norvegicus
agggcctacaacaaccggagctatg

SEQ ID NO: 149404 - DNA, 25 bp, Rattus norvegicus
agggcctacaactaccggagctatg

SEQ ID NO: 149405 - DNA, 25 bp, Rattus norvegicus
agggcctacgtgacaagctcgtgaa

SEQ ID NO: 149406 - DNA, 25 bp, Rattus norvegicus
agggcctacgtgtcaagctcgtgaa

SEQ ID NO: 149407 - DNA, 25 bp, Rattus norvegicus
agggcctactggctatctcagcaag

SEQ ID NO: 149408 - DNA, 25 bp, Rattus norvegicus
agggcctactgggtatctcagcaag

SEQ ID NO: 149409 - DNA, 25 bp, Rattus norvegicus
agggcctcaaccacactcaaagaag

SEQ ID NO: 149410 - DNA, 25 bp, Rattus norvegicus
agggcctcaacctcactcaaagaag

SEQ ID NO: 149411 - DNA, 25 bp, Rattus norvegicus
agggcctcaaggaaatatggtctca

SEQ ID NO: 149412 - DNA, 25 bp, Rattus norvegicus
agggcctcaaggtaatatggtctca

SEQ ID NO: 149413 - DNA, 25 bp, Rattus norvegicus
agggcctcaagtatagcttagggct

SEQ ID NO: 149414 - DNA, 25 bp, Rattus norvegicus
agggcctcaagtttagcttagggct

SEQ ID NO: 149415 - DNA, 25 bp, Rattus norvegicus
agggcctcacacattctggtaatag

SEQ ID NO: 149416 - DNA, 25 bp, Rattus norvegicus
agggcctcacactttctggtaatag

SEQ ID NO: 149417 - DNA, 25 bp, Rattus norvegicus
agggcctcagacatcagctttgggt

SEQ ID NO: 149418 - DNA, 25 bp, Rattus norvegicus
agggcctcagacttcagctttgggt

SEQ ID NO: 149419 - DNA, 25 bp, Rattus norvegicus
agggcctcagcaaggcccagctttg

SEQ ID NO: 149420 - DNA, 25 bp, Rattus norvegicus
agggcctcagcatggcccagctttg

SEQ ID NO: 149421 - DNA, 25 bp, Rattus norvegicus
agggcctcaggtaagcttctgcaga

SEQ ID NO: 149422 - DNA, 25 bp, Rattus norvegicus
agggcctcaggttagcttctgcaga

SEQ ID NO: 149423 - DNA, 25 bp, Rattus norvegicus
agggcctcatagatattgttttcaa

SEQ ID NO: 149424 - DNA, 25 bp, Rattus norvegicus
agggcctcatagttattgttttcaa

SEQ ID NO: 149425 - DNA, 25 bp, Rattus norvegicus
agggcctcatgcatgtgctgtgtct

SEQ ID NO: 149426 - DNA, 25 bp, Rattus norvegicus
agggcctcatgcttgtgctgtgtct

SEQ ID NO: 149427 - DNA, 25 bp, Rattus norvegicus
agggcctccaacaatgacctcaatg

SEQ ID NO: 149428 - DNA, 25 bp, Rattus norvegicus
agggcctccaactatgacctcaatg

SEQ ID NO: 149429 - DNA, 25 bp, Rattus norvegicus
agggcctccaagatagtgtttctca

SEQ ID NO: 149430 - DNA, 25 bp, Rattus norvegicus
agggcctccaagttagtgtttctca

SEQ ID NO: 149431 - DNA, 25 bp, Rattus norvegicus
agggcctccacactagcagtagcac

SEQ ID NO: 149432 - DNA, 25 bp, Rattus norvegicus
agggcctccacagtagcagtagcac

SEQ ID NO: 149433 - DNA, 25 bp, Rattus norvegicus
agggcctcctacaactactgagaag

SEQ ID NO: 149434 - DNA, 25 bp, Rattus norvegicus
agggcctcctactactactgagaag

SEQ ID NO: 149435 - DNA, 25 bp, Rattus norvegicus
agggcctcctagctcacgagcagat

SEQ ID NO: 149436 - DNA, 25 bp, Rattus norvegicus
agggcctcctaggtcacgagcagat

SEQ ID NO: 149437 - DNA, 25 bp, Rattus norvegicus
agggcctcctcacttgatttctggg

SEQ ID NO: 149438 - DNA, 25 bp, Rattus norvegicus
agggcctcctcagttgatttctggg

SEQ ID NO: 149439 - DNA, 25 bp, Rattus norvegicus
agggcctcctggaaactgtgctcaa

SEQ ID NO: 149440 - DNA, 25 bp, Rattus norvegicus
agggcctcctggattttgactctga

SEQ ID NO: 149441 - DNA, 25 bp, Rattus norvegicus
agggcctcctggtaactgtgctcaa

SEQ ID NO: 149442 - DNA, 25 bp, Rattus norvegicus
agggcctcctggtttttgactctga

SEQ ID NO: 149443 - DNA, 25 bp, Rattus norvegicus
agggcctccttcctggacaggacca

SEQ ID NO: 149444 - DNA, 25 bp, Rattus norvegicus
agggcctccttcgtggacaggacca

SEQ ID NO: 149445 - DNA, 25 bp, Rattus norvegicus
agggcctcgaggcagcttcacctta

SEQ ID NO: 149446 - DNA, 25 bp, Rattus norvegicus
agggcctcgagggagcttcacctta

SEQ ID NO: 149447 - DNA, 25 bp, Rattus norvegicus
agggcctcgcctacatgaaacctgt

SEQ ID NO: 149448 - DNA, 25 bp, Rattus norvegicus
agggcctcgccttcatgaaacctgt

SEQ ID NO: 149449 - DNA, 25 bp, Rattus norvegicus
agggcctcgggcaccaaagaagtca

SEQ ID NO: 149450 - DNA, 25 bp, Rattus norvegicus
agggcctcgggctccaaagaagtca

SEQ ID NO: 149451 - DNA, 25 bp, Rattus norvegicus
agggcctcgtagcaagtgattcttc

SEQ ID NO: 149452 - DNA, 25 bp, Rattus norvegicus
agggcctcgtaggaagtgattcttc

SEQ ID NO: 149453 - DNA, 25 bp, Rattus norvegicus
agggcctctaggcaagctccacatg

SEQ ID NO: 149454 - DNA, 25 bp, Rattus norvegicus
agggcctctagggaagctccacatg

SEQ ID NO: 149455 - DNA, 25 bp, Rattus norvegicus
agggcctctgcaaggactagcaaac

SEQ ID NO: 149456 - DNA, 25 bp, Rattus norvegicus
agggcctctgcatggactagcaaac

SEQ ID NO: 149457 - DNA, 25 bp, Rattus norvegicus
agggcctctgtgctcactcacaaag

SEQ ID NO: 149458 - DNA, 25 bp, Rattus norvegicus
agggcctctgtggtcactcacaaag

SEQ ID NO: 149459 - DNA, 25 bp, Rattus norvegicus
agggcctctttaagttgtgctgcaa

SEQ ID NO: 149460 - DNA, 25 bp, Rattus norvegicus
agggcctctttatgttgtgctgcaa

SEQ ID NO: 149461 - DNA, 25 bp, Rattus norvegicus
agggcctctttgagaaatcccacta

SEQ ID NO: 149462 - DNA, 25 bp, Rattus norvegicus
agggcctctttgtgaaatcccacta

SEQ ID NO: 149463 - DNA, 25 bp, Rattus norvegicus
agggcctgacctcaactctcagttg

SEQ ID NO: 149464 - DNA, 25 bp, Rattus norvegicus
agggcctgacctgaactctcagttg

SEQ ID NO: 149465 - DNA, 25 bp, Rattus norvegicus
agggcctgagccagtctgcacagca

SEQ ID NO: 149466 - DNA, 25 bp, Rattus norvegicus
agggcctgagcctgtctgcacagca

SEQ ID NO: 149467 - DNA, 25 bp, Rattus norvegicus
agggcctgatctacatactcatctt

SEQ ID NO: 149468 - DNA, 25 bp, Rattus norvegicus
agggcctgatcttcatactcatctt

SEQ ID NO: 149469 - DNA, 25 bp, Rattus norvegicus
agggcctgcaaaactgcggacggac

SEQ ID NO: 149470 - DNA, 25 bp, Rattus norvegicus
agggcctgcaaatctgcggacggac

SEQ ID NO: 149471 - DNA, 25 bp, Rattus norvegicus
agggcctgcccaacattagaaatgc

SEQ ID NO: 149472 - DNA, 25 bp, Rattus norvegicus
agggcctgcccatcattagaaatgc

SEQ ID NO: 149473 - DNA, 25 bp, Rattus norvegicus
agggcctgcctgactaactaagtcc

SEQ ID NO: 149474 - DNA, 25 bp, Rattus norvegicus
agggcctgcctgtctaactaagtcc

SEQ ID NO: 149475 - DNA, 25 bp, Rattus norvegicus
agggcctgctctctagaagtcggat

SEQ ID NO: 149476 - DNA, 25 bp, Rattus norvegicus
agggcctgctctgtagaagtcggat

SEQ ID NO: 149477 - DNA, 25 bp, Rattus norvegicus
agggcctggagcacctacggcaaaa

SEQ ID NO: 149478 - DNA, 25 bp, Rattus norvegicus
agggcctggagctcctacggcaaaa

SEQ ID NO: 149479 - DNA, 25 bp, Rattus norvegicus
agggcctggatgacgctactgctta

SEQ ID NO: 149480 - DNA, 25 bp, Rattus norvegicus
agggcctggatgtcgctactgctta

SEQ ID NO: 149481 - DNA, 25 bp, Rattus norvegicus
agggcctggcatatgaaatcctaga

SEQ ID NO: 149482 - DNA, 25 bp, Rattus norvegicus
agggcctggcatttgaaatcctaga

SEQ ID NO: 149483 - DNA, 25 bp, Rattus norvegicus
agggcctggctacagttcccagagt

SEQ ID NO: 149484 - DNA, 25 bp, Rattus norvegicus
agggcctggctagagttcccagagt

SEQ ID NO: 149485 - DNA, 25 bp, Rattus norvegicus
agggcctggctcagttacctgatac

SEQ ID NO: 149486 - DNA, 25 bp, Rattus norvegicus
agggcctggctctgttacctgatac

SEQ ID NO: 149487 - DNA, 25 bp, Rattus norvegicus
agggcctggcttagaggtcaatgct

SEQ ID NO: 149488 - DNA, 25 bp, Rattus norvegicus
agggcctggcttcgtctgacactgc

SEQ ID NO: 149489 - DNA, 25 bp, Rattus norvegicus
agggcctggcttggtctgacactgc

SEQ ID NO: 149490 - DNA, 25 bp, Rattus norvegicus
agggcctggctttgaggtcaatgct

SEQ ID NO: 149491 - DNA, 25 bp, Rattus norvegicus
agggcctggttgaatagctgcccag

SEQ ID NO: 149492 - DNA, 25 bp, Rattus norvegicus
agggcctggttgtatagctgcccag

SEQ ID NO: 149493 - DNA, 25 bp, Rattus norvegicus
agggcctgtcccagtcccagtggca

SEQ ID NO: 149494 - DNA, 25 bp, Rattus norvegicus
agggcctgtccctgtcccagtggca

SEQ ID NO: 149495 - DNA, 25 bp, Rattus norvegicus
agggcctgtctgacatccccaaggc

SEQ ID NO: 149496 - DNA, 25 bp, Rattus norvegicus
agggcctgtctgtcatccccaaggc

SEQ ID NO: 149497 - DNA, 25 bp, Rattus norvegicus
agggcctgtgttaatgacttggtaa

SEQ ID NO: 149498 - DNA, 25 bp, Rattus norvegicus
agggcctgtgttacatgagcttgca

SEQ ID NO: 149499 - DNA, 25 bp, Rattus norvegicus
agggcctgtgtttatgacttggtaa

SEQ ID NO: 149500 - DNA, 25 bp, Rattus norvegicus
agggcctgtgtttcatgagcttgca

SEQ ID NO: 149501 - DNA, 25 bp, Rattus norvegicus
agggcctgttgcacaagagtgcact

SEQ ID NO: 149502 - DNA, 25 bp, Rattus norvegicus
agggcctgttgctcaagagtgcact

SEQ ID NO: 149503 - DNA, 25 bp, Rattus norvegicus
agggccttactgatctcatcagggc

SEQ ID NO: 149504 - DNA, 25 bp, Rattus norvegicus
agggccttactgttctcatcagggc

SEQ ID NO: 149505 - DNA, 25 bp, Rattus norvegicus
agggccttacttactctataactct

SEQ ID NO: 149506 - DNA, 25 bp, Rattus norvegicus
agggccttactttctctataactct

SEQ ID NO: 149507 - DNA, 25 bp, Rattus norvegicus
agggccttagttactgcattttcat

SEQ ID NO: 149508 - DNA, 25 bp, Rattus norvegicus
agggccttagtttctgcattttcat

SEQ ID NO: 149509 - DNA, 25 bp, Rattus norvegicus
agggccttatctaggctaacagcag

SEQ ID NO: 149510 - DNA, 25 bp, Rattus norvegicus
agggccttatcttggctaacagcag

SEQ ID NO: 149511 - DNA, 25 bp, Rattus norvegicus
agggccttatgaagttgctttcttt

SEQ ID NO: 149512 - DNA, 25 bp, Rattus norvegicus
agggccttatgatgttgctttcttt

SEQ ID NO: 149513 - DNA, 25 bp, Rattus norvegicus
agggccttatgcacgataggtctac

SEQ ID NO: 149514 - DNA, 25 bp, Rattus norvegicus
agggccttatgctcgataggtctac

SEQ ID NO: 149515 - DNA, 25 bp, Rattus norvegicus
agggccttattcatctcatctatga

SEQ ID NO: 149516 - DNA, 25 bp, Rattus norvegicus
agggccttattcttctcatctatga

SEQ ID NO: 149517 - DNA, 25 bp, Rattus norvegicus
agggccttctgtcagcgttaactac

SEQ ID NO: 149518 - DNA, 25 bp, Rattus norvegicus
agggccttctgtgagcgttaactac

SEQ ID NO: 149519 - DNA, 25 bp, Rattus norvegicus
agggccttgcacctgctagttaagt

SEQ ID NO: 149520 - DNA, 25 bp, Rattus norvegicus
agggccttgcacgtgctagttaagt

SEQ ID NO: 149521 - DNA, 25 bp, Rattus norvegicus
agggccttgcagactagttttctgc

SEQ ID NO: 149522 - DNA, 25 bp, Rattus norvegicus
agggccttgcagtctagttttctgc

SEQ ID NO: 149523 - DNA, 25 bp, Rattus norvegicus
agggccttgctcatgtagcccttgg

SEQ ID NO: 149524 - DNA, 25 bp, Rattus norvegicus
agggccttgctcttgtagcccttgg

SEQ ID NO: 149525 - DNA, 25 bp, Rattus norvegicus
agggccttggctcggatatcatcat

SEQ ID NO: 149526 - DNA, 25 bp, Rattus norvegicus
agggccttggctgggatatcatcat

SEQ ID NO: 149527 - DNA, 25 bp, Rattus norvegicus
agggccttgggaaccagcgcacagc

SEQ ID NO: 149528 - DNA, 25 bp, Rattus norvegicus
agggccttgggatccagcgcacagc

SEQ ID NO: 149529 - DNA, 25 bp, Rattus norvegicus
agggccttgggtcctgctcccatac

SEQ ID NO: 149530 - DNA, 25 bp, Rattus norvegicus
agggccttgggtgctgctcccatac

SEQ ID NO: 149531 - DNA, 25 bp, Rattus norvegicus
agggccttggtgaagagcgacttct

SEQ ID NO: 149532 - DNA, 25 bp, Rattus norvegicus
agggccttggtgtagagcgacttct

SEQ ID NO: 149533 - DNA, 25 bp, Rattus norvegicus
agggccttgtgcacataagcaggat

SEQ ID NO: 149534 - DNA, 25 bp, Rattus norvegicus
agggccttgtgccagcttagcactc

SEQ ID NO: 149535 - DNA, 25 bp, Rattus norvegicus
agggccttgtgcgagcttagcactc

SEQ ID NO: 149536 - DNA, 25 bp, Rattus norvegicus
agggccttgtgctcataagcaggat

SEQ ID NO: 149537 - DNA, 25 bp, Rattus norvegicus
agggcctttaacctcatggtcaaat

SEQ ID NO: 149538 - DNA, 25 bp, Rattus norvegicus
agggcctttaacgtcatggtcaaat

SEQ ID NO: 149539 - DNA, 25 bp, Rattus norvegicus
agggcctttatcagatgcatgttaa

SEQ ID NO: 149540 - DNA, 25 bp, Rattus norvegicus
agggcctttatctgatgcatgttaa

SEQ ID NO: 149541 - DNA, 25 bp, Rattus norvegicus
agggcctttcttctgatgacgagca

SEQ ID NO: 149542 - DNA, 25 bp, Rattus norvegicus
agggcctttcttgtgatgacgagca

SEQ ID NO: 149543 - DNA, 25 bp, Rattus norvegicus
agggcctttggaacgtttgccatga

SEQ ID NO: 149544 - DNA, 25 bp, Rattus norvegicus
agggcctttggatcgtttgccatga

SEQ ID NO: 149545 - DNA, 25 bp, Rattus norvegicus
agggcgaaccccaggatttcgatga

SEQ ID NO: 149546 - DNA, 25 bp, Rattus norvegicus
agggcgaacccctggatttcgatga

SEQ ID NO: 149547 - DNA, 25 bp, Rattus norvegicus
agggcgaaggccattctaattccaa

SEQ ID NO: 149548 - DNA, 25 bp, Rattus norvegicus
agggcgaaggcctttctaattccaa

SEQ ID NO: 149549 - DNA, 25 bp, Rattus norvegicus
agggcgacagtcacttctggagttt

SEQ ID NO: 149550 - DNA, 25 bp, Rattus norvegicus
agggcgacagtctcttctggagttt

SEQ ID NO: 149551 - DNA, 25 bp, Rattus norvegicus
agggcgacccgaaagccgaggacaa

SEQ ID NO: 149552 - DNA, 25 bp, Rattus norvegicus
agggcgacccgatagccgaggacaa

SEQ ID NO: 149553 - DNA, 25 bp, Rattus norvegicus
agggcgagctaaacctgctgaggac

SEQ ID NO: 149554 - DNA, 25 bp, Rattus norvegicus
agggcgagctaatcctgctgaggac

SEQ ID NO: 149555 - DNA, 25 bp, Rattus norvegicus
agggcgatgttgacttactcagtgc

SEQ ID NO: 149556 - DNA, 25 bp, Rattus norvegicus
agggcgatgttgtcttactcagtgc

SEQ ID NO: 149557 - DNA, 25 bp, Rattus norvegicus
agggcgcaacccataggaccagtgc

SEQ ID NO: 149558 - DNA, 25 bp, Rattus norvegicus
agggcgcaacccttaggaccagtgc

SEQ ID NO: 149559 - DNA, 25 bp, Rattus norvegicus
agggcgcaatcaagggcatcttctt

SEQ ID NO: 149560 - DNA, 25 bp, Rattus norvegicus
agggcgcaatcatgggcatcttctt

SEQ ID NO: 149561 - DNA, 25 bp, Rattus norvegicus
agggcgcacctgcagtccacgagat

SEQ ID NO: 149562 - DNA, 25 bp, Rattus norvegicus
agggcgcacctggagtccacgagat

SEQ ID NO: 149563 - DNA, 25 bp, Rattus norvegicus
agggcgcagagcacaaacctggttt

SEQ ID NO: 149564 - DNA, 25 bp, Rattus norvegicus
agggcgcagagctcaaacctggttt

SEQ ID NO: 149565 - DNA, 25 bp, Rattus norvegicus
agggcgcagccacaaagagctgaaa

SEQ ID NO: 149566 - DNA, 25 bp, Rattus norvegicus
agggcgcagccagaaagagctgaaa

SEQ ID NO: 149567 - DNA, 25 bp, Rattus norvegicus
agggcgcagtggctgtgctggtggt

SEQ ID NO: 149568 - DNA, 25 bp, Rattus norvegicus
agggcgcagtgggtgtgctggtggt

SEQ ID NO: 149569 - DNA, 25 bp, Rattus norvegicus
agggcgcgatgacctcgacaagtaa

SEQ ID NO: 149570 - DNA, 25 bp, Rattus norvegicus
agggcgcgatgagctcgacaagtaa

SEQ ID NO: 149571 - DNA, 25 bp, Rattus norvegicus
agggcgctactacctcatcgtagat

SEQ ID NO: 149572 - DNA, 25 bp, Rattus norvegicus
agggcgctactagctcatcgtagat

SEQ ID NO: 149573 - DNA, 25 bp, Rattus norvegicus
agggcgctctagcacagcatcggat

SEQ ID NO: 149574 - DNA, 25 bp, Rattus norvegicus
agggcgctctaggacagcatcggat

SEQ ID NO: 149575 - DNA, 25 bp, Rattus norvegicus
agggcgcttttaatgtcctggacaa

SEQ ID NO: 149576 - DNA, 25 bp, Rattus norvegicus
agggcgcttttattgtcctggacaa

SEQ ID NO: 149577 - DNA, 25 bp, Rattus norvegicus
agggcggagctcactgtggccttac

SEQ ID NO: 149578 - DNA, 25 bp, Rattus norvegicus
agggcggagctctctgtggccttac

SEQ ID NO: 149579 - DNA, 25 bp, Rattus norvegicus
agggcggcacagataggaattctac

SEQ ID NO: 149580 - DNA, 25 bp, Rattus norvegicus
agggcggcacagttaggaattctac

SEQ ID NO: 149581 - DNA, 25 bp, Rattus norvegicus
agggcggcagccagttctaggcaca

SEQ ID NO: 149582 - DNA, 25 bp, Rattus norvegicus
agggcggcagcctgttctaggcaca

SEQ ID NO: 149583 - DNA, 25 bp, Rattus norvegicus
agggcggcatgcatcctaggcaaac

SEQ ID NO: 149584 - DNA, 25 bp, Rattus norvegicus
agggcggcatgcttcctaggcaaac

SEQ ID NO: 149585 - DNA, 25 bp, Rattus norvegicus
agggcggcatggagttctccatcta

SEQ ID NO: 149586 - DNA, 25 bp, Rattus norvegicus
agggcggcatggtgttctccatcta

SEQ ID NO: 149587 - DNA, 25 bp, Rattus norvegicus
agggcggcatgtacgtgttccagct

SEQ ID NO: 149588 - DNA, 25 bp, Rattus norvegicus
agggcggcatgttcgtgttccagct

SEQ ID NO: 149589 - DNA, 25 bp, Rattus norvegicus
agggcggcctgtcatctgtgtatcc

SEQ ID NO: 149590 - DNA, 25 bp, Rattus norvegicus
agggcggcctgtgatctgtgtatcc

SEQ ID NO: 149591 - DNA, 25 bp, Rattus norvegicus
agggcggcggccattccaactgacg

SEQ ID NO: 149592 - DNA, 25 bp, Rattus norvegicus
agggcggcggcctttccaactgacg

SEQ ID NO: 149593 - DNA, 25 bp, Rattus norvegicus
agggcggctcctaggacgacttagt

SEQ ID NO: 149594 - DNA, 25 bp, Rattus norvegicus
agggcggctccttggacgacttagt

SEQ ID NO: 149595 - DNA, 25 bp, Rattus norvegicus
agggcggctggtatgtttagcaact

SEQ ID NO: 149596 - DNA, 25 bp, Rattus norvegicus
agggcggctggtttgtttagcaact

SEQ ID NO: 149597 - DNA, 25 bp, Rattus norvegicus
agggcggcttccaggacatcgacgt

SEQ ID NO: 149598 - DNA, 25 bp, Rattus norvegicus
agggcggcttcctggacatcgacgt

SEQ ID NO: 149599 - DNA, 25 bp, Rattus norvegicus
agggcgggagtcctggcagcggagc

SEQ ID NO: 149600 - DNA, 25 bp, Rattus norvegicus
agggcgggagtcgtggcagcggagc

SEQ ID NO: 149601 - DNA, 25 bp, Rattus norvegicus
agggcgggctcgagctgatcactct

SEQ ID NO: 149602 - DNA, 25 bp, Rattus norvegicus
agggcgggctcgtgctgatcactct

SEQ ID NO: 149603 - DNA, 25 bp, Rattus norvegicus
agggcgggtcttaactgtcttgcac

SEQ ID NO: 149604 - DNA, 25 bp, Rattus norvegicus
agggcgggtctttactgtcttgcac

SEQ ID NO: 149605 - DNA, 25 bp, Rattus norvegicus
agggcggtactcctgaactcagatc

SEQ ID NO: 149606 - DNA, 25 bp, Rattus norvegicus
agggcggtactcgtgaactcagatc

SEQ ID NO: 149607 - DNA, 25 bp, Rattus norvegicus
agggcggtgcccacatctatgtgtg

SEQ ID NO: 149608 - DNA, 25 bp, Rattus norvegicus
agggcggtgccctcatctatgtgtg

SEQ ID NO: 149609 - DNA, 25 bp, Rattus norvegicus
agggcggttttccagcagctgccat

SEQ ID NO: 149610 - DNA, 25 bp, Rattus norvegicus
agggcggttttcgagcagctgccat

SEQ ID NO: 149611 - DNA, 25 bp, Rattus norvegicus
agggcgtagcctaatcaattcttcc

SEQ ID NO: 149612 - DNA, 25 bp, Rattus norvegicus
agggcgtagccttatcaattcttcc

SEQ ID NO: 149613 - DNA, 25 bp, Rattus norvegicus
agggcgtatctccttatcagtggga

SEQ ID NO: 149614 - DNA, 25 bp, Rattus norvegicus
agggcgtatctcgttatcagtggga

SEQ ID NO: 149615 - DNA, 25 bp, Rattus norvegicus
agggcgtcagagactacaatttcat

SEQ ID NO: 149616 - DNA, 25 bp, Rattus norvegicus
agggcgtcagagtctacaatttcat

SEQ ID NO: 149617 - DNA, 25 bp, Rattus norvegicus
agggcgtcattcacttcgagcagaa

SEQ ID NO: 149618 - DNA, 25 bp, Rattus norvegicus
agggcgtcattctcttcgagcagaa

SEQ ID NO: 149619 - DNA, 25 bp, Rattus norvegicus
agggcgtcggacactggatccctga

SEQ ID NO: 149620 - DNA, 25 bp, Rattus norvegicus
agggcgtcggactctggatccctga

SEQ ID NO: 149621 - DNA, 25 bp, Rattus norvegicus
agggcgtcttggactagatgtctga

SEQ ID NO: 149622 - DNA, 25 bp, Rattus norvegicus
agggcgtcttggtctagatgtctga

SEQ ID NO: 149623 - DNA, 25 bp, Rattus norvegicus
agggcgtgagagatccctgtccttg

SEQ ID NO: 149624 - DNA, 25 bp, Rattus norvegicus
agggcgtgagagttccctgtccttg

SEQ ID NO: 149625 - DNA, 25 bp, Rattus norvegicus
agggcgttcccacgtgtctctgttg

SEQ ID NO: 149626 - DNA, 25 bp, Rattus norvegicus
agggcgttcccaggtgtctctgttg

SEQ ID NO: 149627 - DNA, 25 bp, Rattus norvegicus
agggcgttggatctcatctttcttt

SEQ ID NO: 149628 - DNA, 25 bp, Rattus norvegicus
agggcgttggatgtcatctttcttt

SEQ ID NO: 149629 - DNA, 25 bp, Rattus norvegicus
agggcgtttcatatctacagtctac

SEQ ID NO: 149630 - DNA, 25 bp, Rattus norvegicus
agggcgtttcatttctacagtctac

SEQ ID NO: 149631 - DNA, 25 bp, Rattus norvegicus
agggctaaaaacaggcgtctaacag

SEQ ID NO: 149632 - DNA, 25 bp, Rattus norvegicus
agggctaaaaactggcgtctaacag

SEQ ID NO: 149633 - DNA, 25 bp, Rattus norvegicus
agggctaaactccattgtcactttg

SEQ ID NO: 149634 - DNA, 25 bp, Rattus norvegicus
agggctaaactcgattgtcactttg

SEQ ID NO: 149635 - DNA, 25 bp, Rattus norvegicus
agggctaaagagctccgcgttttct

SEQ ID NO: 149636 - DNA, 25 bp, Rattus norvegicus
agggctaaagaggtccgcgttttct

SEQ ID NO: 149637 - DNA, 25 bp, Rattus norvegicus
agggctaagcaacatcatcggcatc

SEQ ID NO: 149638 - DNA, 25 bp, Rattus norvegicus
agggctaagcaagatcatcggcatc

SEQ ID NO: 149639 - DNA, 25 bp, Rattus norvegicus
agggctaagctacgctctgcccaga

SEQ ID NO: 149640 - DNA, 25 bp, Rattus norvegicus
agggctaagctaggctctgcccaga

SEQ ID NO: 149641 - DNA, 25 bp, Rattus norvegicus
agggctaaggtcatctgtctggaaa

SEQ ID NO: 149642 - DNA, 25 bp, Rattus norvegicus
agggctaaggtcttctgtctggaaa

SEQ ID NO: 149643 - DNA, 25 bp, Rattus norvegicus
agggctaataacactgtactgtcgt

SEQ ID NO: 149644 - DNA, 25 bp, Rattus norvegicus
agggctaataactctgtactgtcgt

SEQ ID NO: 149645 - DNA, 25 bp, Rattus norvegicus
agggctaatcagattcacctgttgc

SEQ ID NO: 149646 - DNA, 25 bp, Rattus norvegicus
agggctaatcagtttcacctgttgc

SEQ ID NO: 149647 - DNA, 25 bp, Rattus norvegicus
agggctaatgttacaacctccttct

SEQ ID NO: 149648 - DNA, 25 bp, Rattus norvegicus
agggctaatgtttcaacctccttct

SEQ ID NO: 149649 - DNA, 25 bp, Rattus norvegicus
agggctacactgaatccacttatcc

SEQ ID NO: 149650 - DNA, 25 bp, Rattus norvegicus
agggctacactgtatccacttatcc

SEQ ID NO: 149651 - DNA, 25 bp, Rattus norvegicus
agggctacagctccaagtgtcctca

SEQ ID NO: 149652 - DNA, 25 bp, Rattus norvegicus
agggctacagctgcaagtgtcctca

SEQ ID NO: 149653 - DNA, 25 bp, Rattus norvegicus
agggctacctgcaacagagtctgtg

SEQ ID NO: 149654 - DNA, 25 bp, Rattus norvegicus
agggctacctgctacagagtctgtg

SEQ ID NO: 149655 - DNA, 25 bp, Rattus norvegicus
agggctacctttctcacacactggt

SEQ ID NO: 149656 - DNA, 25 bp, Rattus norvegicus
agggctacctttgtcacacactggt

SEQ ID NO: 149657 - DNA, 25 bp, Rattus norvegicus
agggctactcccagagcactgggtc

SEQ ID NO: 149658 - DNA, 25 bp, Rattus norvegicus
agggctactccctgagcactgggtc

SEQ ID NO: 149659 - DNA, 25 bp, Rattus norvegicus
agggctactcgtcagaaccaggaat

SEQ ID NO: 149660 - DNA, 25 bp, Rattus norvegicus
agggctactcgtccttgtatagtac

SEQ ID NO: 149661 - DNA, 25 bp, Rattus norvegicus
agggctactcgtgagaaccaggaat

SEQ ID NO: 149662 - DNA, 25 bp, Rattus norvegicus
agggctactcgtgcttgtatagtac

SEQ ID NO: 149663 - DNA, 25 bp, Rattus norvegicus
agggctactgcacccaccgaggtaa

SEQ ID NO: 149664 - DNA, 25 bp, Rattus norvegicus
agggctactgcagccaccgaggtaa

SEQ ID NO: 149665 - DNA, 25 bp, Rattus norvegicus
agggctactgccagctacaggtgcc

SEQ ID NO: 149666 - DNA, 25 bp, Rattus norvegicus
agggctactgcctgctacaggtgcc

SEQ ID NO: 149667 - DNA, 25 bp, Rattus norvegicus
agggctagccagcatcagaggcaat

SEQ ID NO: 149668 - DNA, 25 bp, Rattus norvegicus
agggctagccaggatcagaggcaat

SEQ ID NO: 149669 - DNA, 25 bp, Rattus norvegicus
agggctagccgaagctccgcagcca

SEQ ID NO: 149670 - DNA, 25 bp, Rattus norvegicus
agggctagccgatgctccgcagcca

SEQ ID NO: 149671 - DNA, 25 bp, Rattus norvegicus
agggctagcctgagctctgaaacta

SEQ ID NO: 149672 - DNA, 25 bp, Rattus norvegicus
agggctagcctgtgctctgaaacta

SEQ ID NO: 149673 - DNA, 25 bp, Rattus norvegicus
agggctagccttcgccggatctttc

SEQ ID NO: 149674 - DNA, 25 bp, Rattus norvegicus
agggctagccttggccggatctttc

SEQ ID NO: 149675 - DNA, 25 bp, Rattus norvegicus
agggctagcttcacatccctgggat

SEQ ID NO: 149676 - DNA, 25 bp, Rattus norvegicus
agggctagcttctcatccctgggat

SEQ ID NO: 149677 - DNA, 25 bp, Rattus norvegicus
agggctagttttactgcggatcgga

SEQ ID NO: 149678 - DNA, 25 bp, Rattus norvegicus
agggctagtttttctgcggatcgga

SEQ ID NO: 149679 - DNA, 25 bp, Rattus norvegicus
agggctatcccacaaatacgacaca

SEQ ID NO: 149680 - DNA, 25 bp, Rattus norvegicus
agggctatcccagaaatacgacaca

SEQ ID NO: 149681 - DNA, 25 bp, Rattus norvegicus
agggctatcgacacaacagaaatgg

SEQ ID NO: 149682 - DNA, 25 bp, Rattus norvegicus
agggctatcgactcaacagaaatgg

SEQ ID NO: 149683 - DNA, 25 bp, Rattus norvegicus
agggctatgaccattcctattttca

SEQ ID NO: 149684 - DNA, 25 bp, Rattus norvegicus
agggctatgacctttcctattttca

SEQ ID NO: 149685 - DNA, 25 bp, Rattus norvegicus
agggctatgctcagagtcaggacta

SEQ ID NO: 149686 - DNA, 25 bp, Rattus norvegicus
agggctatgctctgagtcaggacta

SEQ ID NO: 149687 - DNA, 25 bp, Rattus norvegicus
agggctattgtgagtccagctctgt

SEQ ID NO: 149688 - DNA, 25 bp, Rattus norvegicus
agggctattgtgtgtccagctctgt

SEQ ID NO: 149689 - DNA, 25 bp, Rattus norvegicus
agggctcaagcaattgtaactacag

SEQ ID NO: 149690 - DNA, 25 bp, Rattus norvegicus
agggctcaagcatttgtaactacag

SEQ ID NO: 149691 - DNA, 25 bp, Rattus norvegicus
agggctcaatgaactccggcgtggt

SEQ ID NO: 149692 - DNA, 25 bp, Rattus norvegicus
agggctcaatgatctccggcgtggt

SEQ ID NO: 149693 - DNA, 25 bp, Rattus norvegicus
agggctcaatgcatagtctggatac

SEQ ID NO: 149694 - DNA, 25 bp, Rattus norvegicus
agggctcaatgcttagtctggatac

SEQ ID NO: 149695 - DNA, 25 bp, Rattus norvegicus
agggctcacaaacaccatgatttaa

SEQ ID NO: 149696 - DNA, 25 bp, Rattus norvegicus
agggctcacaaagaccatgatttaa

SEQ ID NO: 149697 - DNA, 25 bp, Rattus norvegicus
agggctcacaaccacatttaacttc

SEQ ID NO: 149698 - DNA, 25 bp, Rattus norvegicus
agggctcacaacgacatttaacttc

SEQ ID NO: 149699 - DNA, 25 bp, Rattus norvegicus
agggctcacagtccacctggataac

SEQ ID NO: 149700 - DNA, 25 bp, Rattus norvegicus
agggctcacagtgcacctggataac

SEQ ID NO: 149701 - DNA, 25 bp, Rattus norvegicus
agggctcaccctagctgttgtacag

SEQ ID NO: 149702 - DNA, 25 bp, Rattus norvegicus
agggctcacccttgctgttgtacag

SEQ ID NO: 149703 - DNA, 25 bp, Rattus norvegicus
agggctcacgggaagcacagaccac

SEQ ID NO: 149704 - DNA, 25 bp, Rattus norvegicus
agggctcacgggtagcacagaccac

SEQ ID NO: 149705 - DNA, 25 bp, Rattus norvegicus
agggctcactccagggctgcagaga

SEQ ID NO: 149706 - DNA, 25 bp, Rattus norvegicus
agggctcactcctgggctgcagaga

SEQ ID NO: 149707 - DNA, 25 bp, Rattus norvegicus
agggctcactctaggcagcagctga

SEQ ID NO: 149708 - DNA, 25 bp, Rattus norvegicus
agggctcactcttggcagcagctga

SEQ ID NO: 149709 - DNA, 25 bp, Rattus norvegicus
agggctcactgactacaccaggctg

SEQ ID NO: 149710 - DNA, 25 bp, Rattus norvegicus
agggctcactgagtacaccaggctg

SEQ ID NO: 149711 - DNA, 25 bp, Rattus norvegicus
agggctcagaagacaacccaggcca

SEQ ID NO: 149712 - DNA, 25 bp, Rattus norvegicus
agggctcagaagtcaacccaggcca

SEQ ID NO: 149713 - DNA, 25 bp, Rattus norvegicus
agggctcagaccacttctacgacga

SEQ ID NO: 149714 - DNA, 25 bp, Rattus norvegicus
agggctcagacctcttctacgacga

SEQ ID NO: 149715 - DNA, 25 bp, Rattus norvegicus
agggctcagcagacaccagggactt

SEQ ID NO: 149716 - DNA, 25 bp, Rattus norvegicus
agggctcagcagtcaccagggactt

SEQ ID NO: 149717 - DNA, 25 bp, Rattus norvegicus
agggctcagtccaatcctggaatat

SEQ ID NO: 149718 - DNA, 25 bp, Rattus norvegicus
agggctcagtcccttgttgactcgg

SEQ ID NO: 149719 - DNA, 25 bp, Rattus norvegicus
agggctcagtccgttgttgactcgg

SEQ ID NO: 149720 - DNA, 25 bp, Rattus norvegicus
agggctcagtcctatcctggaatat

SEQ ID NO: 149721 - DNA, 25 bp, Rattus norvegicus
agggctcagttcagacaccagggat

SEQ ID NO: 149722 - DNA, 25 bp, Rattus norvegicus
agggctcagttctgacaccagggat

SEQ ID NO: 149723 - DNA, 25 bp, Rattus norvegicus
agggctcatcagagttgctgcgaca

SEQ ID NO: 149724 - DNA, 25 bp, Rattus norvegicus
agggctcatcagtgttgctgcgaca

SEQ ID NO: 149725 - DNA, 25 bp, Rattus norvegicus
agggctcatgccagttacacagcaa

SEQ ID NO: 149726 - DNA, 25 bp, Rattus norvegicus
agggctcatgcctgttacacagcaa

SEQ ID NO: 149727 - DNA, 25 bp, Rattus norvegicus
agggctcatgttacattctttctga

SEQ ID NO: 149728 - DNA, 25 bp, Rattus norvegicus
agggctcatgtttcattctttctga

SEQ ID NO: 149729 - DNA, 25 bp, Rattus norvegicus
agggctcattttcactgctcatgtt

SEQ ID NO: 149730 - DNA, 25 bp, Rattus norvegicus
agggctcattttgactgctcatgtt

SEQ ID NO: 149731 - DNA, 25 bp, Rattus norvegicus
agggctccaacgagatcgagctcag

SEQ ID NO: 149732 - DNA, 25 bp, Rattus norvegicus
agggctccaacgtgatcgagctcag

SEQ ID NO: 149733 - DNA, 25 bp, Rattus norvegicus
agggctccaagcaccaagtttggca

SEQ ID NO: 149734 - DNA, 25 bp, Rattus norvegicus
agggctccaagctccaagtttggca

SEQ ID NO: 149735 - DNA, 25 bp, Rattus norvegicus
agggctccacagacatctggctcat

SEQ ID NO: 149736 - DNA, 25 bp, Rattus norvegicus
agggctccacagtcatctggctcat

SEQ ID NO: 149737 - DNA, 25 bp, Rattus norvegicus
agggctccaccgcattgactgtgtg

SEQ ID NO: 149738 - DNA, 25 bp, Rattus norvegicus
agggctccaccggattgactgtgtg

SEQ ID NO: 149739 - DNA, 25 bp, Rattus norvegicus
agggctccaggaaatcttctgctaa

SEQ ID NO: 149740 - DNA, 25 bp, Rattus norvegicus
agggctccaggaacaagtaccttct

SEQ ID NO: 149741 - DNA, 25 bp, Rattus norvegicus
agggctccaggatatcttctgctaa

SEQ ID NO: 149742 - DNA, 25 bp, Rattus norvegicus
agggctccaggatcaagtaccttct

SEQ ID NO: 149743 - DNA, 25 bp, Rattus norvegicus
agggctcccattcactagatgctgt

SEQ ID NO: 149744 - DNA, 25 bp, Rattus norvegicus
agggctcccattgactagatgctgt

SEQ ID NO: 149745 - DNA, 25 bp, Rattus norvegicus
agggctcccgaactctggatctgaa

SEQ ID NO: 149746 - DNA, 25 bp, Rattus norvegicus
agggctcccgaagtctggatctgaa

SEQ ID NO: 149747 - DNA, 25 bp, Rattus norvegicus
agggctccctacacatagggcagtg

SEQ ID NO: 149748 - DNA, 25 bp, Rattus norvegicus
agggctccctactcatagggcagtg

SEQ ID NO: 149749 - DNA, 25 bp, Rattus norvegicus
agggctccctccctagaggagtgaa

SEQ ID NO: 149750 - DNA, 25 bp, Rattus norvegicus
agggctccctccgtagaggagtgaa

SEQ ID NO: 149751 - DNA, 25 bp, Rattus norvegicus
agggctccctgaactctggcggagt

SEQ ID NO: 149752 - DNA, 25 bp, Rattus norvegicus
agggctccctgatctctggcggagt

SEQ ID NO: 149753 - DNA, 25 bp, Rattus norvegicus
agggctcccttcagctgagtgcaat

SEQ ID NO: 149754 - DNA, 25 bp, Rattus norvegicus
agggctcccttctgctgagtgcaat

SEQ ID NO: 149755 - DNA, 25 bp, Rattus norvegicus
agggctccgaccaggtcaaggctca

SEQ ID NO: 149756 - DNA, 25 bp, Rattus norvegicus
agggctccgacctggtcaaggctca

SEQ ID NO: 149757 - DNA, 25 bp, Rattus norvegicus
agggctccggctcctggcaaatgtc

SEQ ID NO: 149758 - DNA, 25 bp, Rattus norvegicus
agggctccggctgctggcaaatgtc

SEQ ID NO: 149759 - DNA, 25 bp, Rattus norvegicus
agggctccgtatacagtctctggta

SEQ ID NO: 149760 - DNA, 25 bp, Rattus norvegicus
agggctccgtattcagtctctggta

SEQ ID NO: 149761 - DNA, 25 bp, Rattus norvegicus
agggctcctcatagaggctttgctt

SEQ ID NO: 149762 - DNA, 25 bp, Rattus norvegicus
agggctcctcattgaggctttgctt

SEQ ID NO: 149763 - DNA, 25 bp, Rattus norvegicus
agggctcctctgagggatgcctatg

SEQ ID NO: 149764 - DNA, 25 bp, Rattus norvegicus
agggctcctctgtgggatgcctatg

SEQ ID NO: 149765 - DNA, 25 bp, Rattus norvegicus
agggctcctgccctgagcgaattac

SEQ ID NO: 149766 - DNA, 25 bp, Rattus norvegicus
agggctcctgccgtgagcgaattac

SEQ ID NO: 149767 - DNA, 25 bp, Rattus norvegicus
agggctccttcactccttgaaatta

SEQ ID NO: 149768 - DNA, 25 bp, Rattus norvegicus
agggctccttcagtccttgaaatta

SEQ ID NO: 149769 - DNA, 25 bp, Rattus norvegicus
agggctccttgcaactgggcaatag

SEQ ID NO: 149770 - DNA, 25 bp, Rattus norvegicus
agggctccttgctactgggcaatag

SEQ ID NO: 149771 - DNA, 25 bp, Rattus norvegicus
agggctccttggctgcatgtgtcta

SEQ ID NO: 149772 - DNA, 25 bp, Rattus norvegicus
agggctccttgggtgcatgtgtcta

SEQ ID NO: 149773 - DNA, 25 bp, Rattus norvegicus
agggctcgagtgagtcgctttctct

SEQ ID NO: 149774 - DNA, 25 bp, Rattus norvegicus
agggctcgagtgtgtcgctttctct

SEQ ID NO: 149775 - DNA, 25 bp, Rattus norvegicus
agggctcggaacaaactccttgttg

SEQ ID NO: 149776 - DNA, 25 bp, Rattus norvegicus
agggctcggaactaactccttgttg

SEQ ID NO: 149777 - DNA, 25 bp, Rattus norvegicus
agggctcggaagaagacaaagctca

SEQ ID NO: 149778 - DNA, 25 bp, Rattus norvegicus
agggctcggaagtagacaaagctca

SEQ ID NO: 149779 - DNA, 25 bp, Rattus norvegicus
agggctcggtgacaaaactcttgac

SEQ ID NO: 149780 - DNA, 25 bp, Rattus norvegicus
agggctcggtgagaaaactcttgac

SEQ ID NO: 149781 - DNA, 25 bp, Rattus norvegicus
agggctcgtcataggtgccgtctac

SEQ ID NO: 149782 - DNA, 25 bp, Rattus norvegicus
agggctcgtcattggtgccgtctac

SEQ ID NO: 149783 - DNA, 25 bp, Rattus norvegicus
agggctctaatcatcgtgcagtcac

SEQ ID NO: 149784 - DNA, 25 bp, Rattus norvegicus
agggctctaatcttcgtgcagtcac

SEQ ID NO: 149785 - DNA, 25 bp, Rattus norvegicus
agggctctactgcttggagcttaac

SEQ ID NO: 149786 - DNA, 25 bp, Rattus norvegicus
agggctctactggttggagcttaac

SEQ ID NO: 149787 - DNA, 25 bp, Rattus norvegicus
agggctctagtgacactgcccagaa

SEQ ID NO: 149788 - DNA, 25 bp, Rattus norvegicus
agggctctagtgtcactgcccagaa

SEQ ID NO: 149789 - DNA, 25 bp, Rattus norvegicus
agggctctatccagtaacagtttta

SEQ ID NO: 149790 - DNA, 25 bp, Rattus norvegicus
agggctctatcctgtaacagtttta

SEQ ID NO: 149791 - DNA, 25 bp, Rattus norvegicus
agggctctatgcagtctgtgctctc

SEQ ID NO: 149792 - DNA, 25 bp, Rattus norvegicus
agggctctatgctgtctgtgctctc

SEQ ID NO: 149793 - DNA, 25 bp, Rattus norvegicus
agggctctcaaaagagcaccttttt

SEQ ID NO: 149794 - DNA, 25 bp, Rattus norvegicus
agggctctcaaatgagcaccttttt

SEQ ID NO: 149795 - DNA, 25 bp, Rattus norvegicus
agggctctcagtctggcatgcttaa

SEQ ID NO: 149796 - DNA, 25 bp, Rattus norvegicus
agggctctcagtgtggcatgcttaa

SEQ ID NO: 149797 - DNA, 25 bp, Rattus norvegicus
agggctctcctcactgattgatatg

SEQ ID NO: 149798 - DNA, 25 bp, Rattus norvegicus
agggctctcctctctgattgatatg

SEQ ID NO: 149799 - DNA, 25 bp, Rattus norvegicus
agggctctctctactcaagggttta

SEQ ID NO: 149800 - DNA, 25 bp, Rattus norvegicus
agggctctctcttctcaagggttta

SEQ ID NO: 149801 - DNA, 25 bp, Rattus norvegicus
agggctctctggaccccatcttgag

SEQ ID NO: 149802 - DNA, 25 bp, Rattus norvegicus
agggctctctggtccccatcttgag

SEQ ID NO: 149803 - DNA, 25 bp, Rattus norvegicus
agggctctgaacacctggcggtaga

SEQ ID NO: 149804 - DNA, 25 bp, Rattus norvegicus
agggctctgaactcctggcggtaga

SEQ ID NO: 149805 - DNA, 25 bp, Rattus norvegicus
agggctctgagcacaccgtgaacaa

SEQ ID NO: 149806 - DNA, 25 bp, Rattus norvegicus
agggctctgagctcaccgtgaacaa

SEQ ID NO: 149807 - DNA, 25 bp, Rattus norvegicus
agggctctgattccctcagattcct

SEQ ID NO: 149808 - DNA, 25 bp, Rattus norvegicus
agggctctgattgcctcagattcct

SEQ ID NO: 149809 - DNA, 25 bp, Rattus norvegicus
agggctctgcggctgtgtataactc

SEQ ID NO: 149810 - DNA, 25 bp, Rattus norvegicus
agggctctgcgggtgtgtataactc

SEQ ID NO: 149811 - DNA, 25 bp, Rattus norvegicus
agggctctgcttagattttctgcca

SEQ ID NO: 149812 - DNA, 25 bp, Rattus norvegicus
agggctctgctttgattttctgcca

SEQ ID NO: 149813 - DNA, 25 bp, Rattus norvegicus
agggctctggcacatagctatccaa

SEQ ID NO: 149814 - DNA, 25 bp, Rattus norvegicus
agggctctggcagatagctatccaa

SEQ ID NO: 149815 - DNA, 25 bp, Rattus norvegicus
agggctctggctactgttaaaattc

SEQ ID NO: 149816 - DNA, 25 bp, Rattus norvegicus
agggctctggcttctgttaaaattc

SEQ ID NO: 149817 - DNA, 25 bp, Rattus norvegicus
agggctctgtggagagacctgcctc

SEQ ID NO: 149818 - DNA, 25 bp, Rattus norvegicus
agggctctgtggtgagacctgcctc

SEQ ID NO: 149819 - DNA, 25 bp, Rattus norvegicus
agggctctgtgtccattcctggtac

SEQ ID NO: 149820 - DNA, 25 bp, Rattus norvegicus
agggctctgtgtgcattcctggtac

SEQ ID NO: 149821 - DNA, 25 bp, Rattus norvegicus
agggctctgttcctgcaagaatagt

SEQ ID NO: 149822 - DNA, 25 bp, Rattus norvegicus
agggctctgttcgtgcaagaatagt

SEQ ID NO: 149823 - DNA, 25 bp, Rattus norvegicus
agggctcttaataccacagccatga

SEQ ID NO: 149824 - DNA, 25 bp, Rattus norvegicus
agggctcttaattccacagccatga

SEQ ID NO: 149825 - DNA, 25 bp, Rattus norvegicus
agggctcttattcgctgtttagaca

SEQ ID NO: 149826 - DNA, 25 bp, Rattus norvegicus
agggctcttattggctgtttagaca

SEQ ID NO: 149827 - DNA, 25 bp, Rattus norvegicus
agggctcttcctcgaacactgtaat

SEQ ID NO: 149828 - DNA, 25 bp, Rattus norvegicus
agggctcttcctggaacactgtaat

SEQ ID NO: 149829 - DNA, 25 bp, Rattus norvegicus
agggctcttggactcccatggtgct

SEQ ID NO: 149830 - DNA, 25 bp, Rattus norvegicus
agggctcttggagtcccatggtgct

SEQ ID NO: 149831 - DNA, 25 bp, Rattus norvegicus
agggctcttgttctgtatatacttg

SEQ ID NO: 149832 - DNA, 25 bp, Rattus norvegicus
agggctcttgttgtgtatatacttg

SEQ ID NO: 149833 - DNA, 25 bp, Rattus norvegicus
agggctctttatactcaattcatcg

SEQ ID NO: 149834 - DNA, 25 bp, Rattus norvegicus
agggctctttattctcaattcatcg

SEQ ID NO: 149835 - DNA, 25 bp, Rattus norvegicus
agggctctttttctaatttgtgcat

SEQ ID NO: 149836 - DNA, 25 bp, Rattus norvegicus
agggctctttttgtaatttgtgcat

SEQ ID NO: 149837 - DNA, 25 bp, Rattus norvegicus
agggctgaacgcacatcagagtcca

SEQ ID NO: 149838 - DNA, 25 bp, Rattus norvegicus
agggctgaacgctcatcagagtcca

SEQ ID NO: 149839 - DNA, 25 bp, Rattus norvegicus
agggctgaactcagcactgtgatat

SEQ ID NO: 149840 - DNA, 25 bp, Rattus norvegicus
agggctgaactctgcactgtgatat

SEQ ID NO: 149841 - DNA, 25 bp, Rattus norvegicus
agggctgaagccacactatgctcaa

SEQ ID NO: 149842 - DNA, 25 bp, Rattus norvegicus
agggctgaagcctcactatgctcaa

SEQ ID NO: 149843 - DNA, 25 bp, Rattus norvegicus
agggctgaaggaatctgcagaccta

SEQ ID NO: 149844 - DNA, 25 bp, Rattus norvegicus
agggctgaaggattctgcagaccta

SEQ ID NO: 149845 - DNA, 25 bp, Rattus norvegicus
agggctgaagtccttcctcctgggc

SEQ ID NO: 149846 - DNA, 25 bp, Rattus norvegicus
agggctgaagtcgttcctcctgggc

SEQ ID NO: 149847 - DNA, 25 bp, Rattus norvegicus
agggctgacggtagttaactctgta

SEQ ID NO: 149848 - DNA, 25 bp, Rattus norvegicus
agggctgacggttgttaactctgta

SEQ ID NO: 149849 - DNA, 25 bp, Rattus norvegicus
agggctgactagagggctgcacaca

SEQ ID NO: 149850 - DNA, 25 bp, Rattus norvegicus
agggctgactagtgggctgcacaca

SEQ ID NO: 149851 - DNA, 25 bp, Rattus norvegicus
agggctgactgcacaggcttttctt

SEQ ID NO: 149852 - DNA, 25 bp, Rattus norvegicus
agggctgactgctcaggcttttctt

SEQ ID NO: 149853 - DNA, 25 bp, Rattus norvegicus
agggctgagacgaacgtctttcctc

SEQ ID NO: 149854 - DNA, 25 bp, Rattus norvegicus
agggctgagacgtacgtctttcctc

SEQ ID NO: 149855 - DNA, 25 bp, Rattus norvegicus
agggctgagactccacccatcatct

SEQ ID NO: 149856 - DNA, 25 bp, Rattus norvegicus
agggctgagactgcacccatcatct

SEQ ID NO: 149857 - DNA, 25 bp, Rattus norvegicus
agggctgagggtagatccctttgac

SEQ ID NO: 149858 - DNA, 25 bp, Rattus norvegicus
agggctgagggttgatccctttgac

SEQ ID NO: 149859 - DNA, 25 bp, Rattus norvegicus
agggctgagtctacctgctgtcacc

SEQ ID NO: 149860 - DNA, 25 bp, Rattus norvegicus
agggctgagtctacttttgttctgt

SEQ ID NO: 149861 - DNA, 25 bp, Rattus norvegicus
agggctgagtcttcctgctgtcacc

SEQ ID NO: 149862 - DNA, 25 bp, Rattus norvegicus
agggctgagtcttcttttgttctgt

SEQ ID NO: 149863 - DNA, 25 bp, Rattus norvegicus
agggctgatcttatcatacatagga

SEQ ID NO: 149864 - DNA, 25 bp, Rattus norvegicus
agggctgatcttttcatacatagga

SEQ ID NO: 149865 - DNA, 25 bp, Rattus norvegicus
agggctgatttcagttctgaacacc

SEQ ID NO: 149866 - DNA, 25 bp, Rattus norvegicus
agggctgatttctgttctgaacacc

SEQ ID NO: 149867 - DNA, 25 bp, Rattus norvegicus
agggctgatttgaatcccaggcttc

SEQ ID NO: 149868 - DNA, 25 bp, Rattus norvegicus
agggctgatttgtatcccaggcttc

SEQ ID NO: 149869 - DNA, 25 bp, Rattus norvegicus
agggctgcaaatccacgaactgcaa

SEQ ID NO: 149870 - DNA, 25 bp, Rattus norvegicus
agggctgcaaatctgacttctcatt

SEQ ID NO: 149871 - DNA, 25 bp, Rattus norvegicus
agggctgcaaatgcacgaactgcaa

SEQ ID NO: 149872 - DNA, 25 bp, Rattus norvegicus
agggctgcaaatgtgacttctcatt

SEQ ID NO: 149873 - DNA, 25 bp, Rattus norvegicus
agggctgcaagacttttctggtcac

SEQ ID NO: 149874 - DNA, 25 bp, Rattus norvegicus
agggctgcaagagttttctggtcac

SEQ ID NO: 149875 - DNA, 25 bp, Rattus norvegicus
agggctgcacggactgcgcatagaa

SEQ ID NO: 149876 - DNA, 25 bp, Rattus norvegicus
agggctgcacggtctgcgcatagaa

SEQ ID NO: 149877 - DNA, 25 bp, Rattus norvegicus
agggctgcactccatagcgtgtatt

SEQ ID NO: 149878 - DNA, 25 bp, Rattus norvegicus
agggctgcactcgatagcgtgtatt

SEQ ID NO: 149879 - DNA, 25 bp, Rattus norvegicus
agggctgcacttcgatgagctgaac

SEQ ID NO: 149880 - DNA, 25 bp, Rattus norvegicus
agggctgcacttggatgagctgaac

SEQ ID NO: 149881 - DNA, 25 bp, Rattus norvegicus
agggctgcagatatctttcttgaaa

SEQ ID NO: 149882 - DNA, 25 bp, Rattus norvegicus
agggctgcagatttctttcttgaaa

SEQ ID NO: 149883 - DNA, 25 bp, Rattus norvegicus
agggctgcagctaatggaacggctt

SEQ ID NO: 149884 - DNA, 25 bp, Rattus norvegicus
agggctgcagcttatggaacggctt

SEQ ID NO: 149885 - DNA, 25 bp, Rattus norvegicus
agggctgcagtccatagtgctgtcc

SEQ ID NO: 149886 - DNA, 25 bp, Rattus norvegicus
agggctgcagtcgatagtgctgtcc

SEQ ID NO: 149887 - DNA, 25 bp, Rattus norvegicus
agggctgcagttattcagactccca

SEQ ID NO: 149888 - DNA, 25 bp, Rattus norvegicus
agggctgcagtttttcagactccca

SEQ ID NO: 149889 - DNA, 25 bp, Rattus norvegicus
agggctgcatatcttctggctagtg

SEQ ID NO: 149890 - DNA, 25 bp, Rattus norvegicus
agggctgcatatgttctggctagtg

SEQ ID NO: 149891 - DNA, 25 bp, Rattus norvegicus
agggctgcatgacagcctaggcctt

SEQ ID NO: 149892 - DNA, 25 bp, Rattus norvegicus
agggctgcatgagagcctaggcctt

SEQ ID NO: 149893 - DNA, 25 bp, Rattus norvegicus
agggctgccactattgtacgtgtaa

SEQ ID NO: 149894 - DNA, 25 bp, Rattus norvegicus
agggctgccacttttgtacgtgtaa

SEQ ID NO: 149895 - DNA, 25 bp, Rattus norvegicus
agggctgccaggaccttagtttaca

SEQ ID NO: 149896 - DNA, 25 bp, Rattus norvegicus
agggctgccaggactttttgtggct

SEQ ID NO: 149897 - DNA, 25 bp, Rattus norvegicus
agggctgccaggtccttagtttaca

SEQ ID NO: 149898 - DNA, 25 bp, Rattus norvegicus
agggctgccaggtctttttgtggct

SEQ ID NO: 149899 - DNA, 25 bp, Rattus norvegicus
agggctgccagtcttaacctggtac

SEQ ID NO: 149900 - DNA, 25 bp, Rattus norvegicus
agggctgccagtgttaacctggtac

SEQ ID NO: 149901 - DNA, 25 bp, Rattus norvegicus
agggctgcccaacatctacctgagc

SEQ ID NO: 149902 - DNA, 25 bp, Rattus norvegicus
agggctgcccaagatctacctgagc

SEQ ID NO: 149903 - DNA, 25 bp, Rattus norvegicus
agggctgcctacctgtattcctgta

SEQ ID NO: 149904 - DNA, 25 bp, Rattus norvegicus
agggctgcctacgtgtattcctgta

SEQ ID NO: 149905 - DNA, 25 bp, Rattus norvegicus
agggctgcgaaccactgacacagaa

SEQ ID NO: 149906 - DNA, 25 bp, Rattus norvegicus
agggctgcgaacgactgacacagaa

SEQ ID NO: 149907 - DNA, 25 bp, Rattus norvegicus
agggctgctcatcgctgtccagcag

SEQ ID NO: 149908 - DNA, 25 bp, Rattus norvegicus
agggctgctcatggctgtccagcag

SEQ ID NO: 149909 - DNA, 25 bp, Rattus norvegicus
agggctgctgcactctcaaccagga

SEQ ID NO: 149910 - DNA, 25 bp, Rattus norvegicus
agggctgctgcagtctcaaccagga

SEQ ID NO: 149911 - DNA, 25 bp, Rattus norvegicus
agggctgctgtcatcctacggagag

SEQ ID NO: 149912 - DNA, 25 bp, Rattus norvegicus
agggctgctgtcttcctacggagag

SEQ ID NO: 149913 - DNA, 25 bp, Rattus norvegicus
agggctgctgttcttgtactgccgt

SEQ ID NO: 149914 - DNA, 25 bp, Rattus norvegicus
agggctgctgttgttgtactgccgt

SEQ ID NO: 149915 - DNA, 25 bp, Rattus norvegicus
agggctgcttaccaagtcgccgctt

SEQ ID NO: 149916 - DNA, 25 bp, Rattus norvegicus
agggctgcttacgaagtcgccgctt

SEQ ID NO: 149917 - DNA, 25 bp, Rattus norvegicus
agggctgctttcctgggccagaatc

SEQ ID NO: 149918 - DNA, 25 bp, Rattus norvegicus
agggctgctttcgtgggccagaatc

SEQ ID NO: 149919 - DNA, 25 bp, Rattus norvegicus
agggctgctttgatttgtttcggga

SEQ ID NO: 149920 - DNA, 25 bp, Rattus norvegicus
agggctgctttgttttgtttcggga

SEQ ID NO: 149921 - DNA, 25 bp, Rattus norvegicus
agggctgcttttatgcatctttgca

SEQ ID NO: 149922 - DNA, 25 bp, Rattus norvegicus
agggctgcttttttgcatctttgca

SEQ ID NO: 149923 - DNA, 25 bp, Rattus norvegicus
agggctggacctatggccaaggaca

SEQ ID NO: 149924 - DNA, 25 bp, Rattus norvegicus
agggctggacctttggccaaggaca

SEQ ID NO: 149925 - DNA, 25 bp, Rattus norvegicus
agggctggatccatgtctgtactct

SEQ ID NO: 149926 - DNA, 25 bp, Rattus norvegicus
agggctggatccttgtctgtactct

SEQ ID NO: 149927 - DNA, 25 bp, Rattus norvegicus
agggctggatggaaagacttcacgt

SEQ ID NO: 149928 - DNA, 25 bp, Rattus norvegicus
agggctggatggtaagacttcacgt

SEQ ID NO: 149929 - DNA, 25 bp, Rattus norvegicus
agggctggcactaggcaacgtcacc

SEQ ID NO: 149930 - DNA, 25 bp, Rattus norvegicus
agggctggcacttggcaacgtcacc

SEQ ID NO: 149931 - DNA, 25 bp, Rattus norvegicus
agggctggccaaagccgagctgtcc

SEQ ID NO: 149932 - DNA, 25 bp, Rattus norvegicus
agggctggccaatgccgagctgtcc

SEQ ID NO: 149933 - DNA, 25 bp, Rattus norvegicus
agggctggccaccttagaagctgct

SEQ ID NO: 149934 - DNA, 25 bp, Rattus norvegicus
agggctggccacgttagaagctgct

SEQ ID NO: 149935 - DNA, 25 bp, Rattus norvegicus
agggctggccatcggtaccttactt

SEQ ID NO: 149936 - DNA, 25 bp, Rattus norvegicus
agggctggccatgggtaccttactt

SEQ ID NO: 149937 - DNA, 25 bp, Rattus norvegicus
agggctggctctaccctcttcactg

SEQ ID NO: 149938 - DNA, 25 bp, Rattus norvegicus
agggctggctcttccctcttcactg

SEQ ID NO: 149939 - DNA, 25 bp, Rattus norvegicus
agggctggctgaattggatttcttt

SEQ ID NO: 149940 - DNA, 25 bp, Rattus norvegicus
agggctggctgatttggatttcttt

SEQ ID NO: 149941 - DNA, 25 bp, Rattus norvegicus
agggctggctgcaaactgttgactc

SEQ ID NO: 149942 - DNA, 25 bp, Rattus norvegicus
agggctggctgcagatcaaggcaca

SEQ ID NO: 149943 - DNA, 25 bp, Rattus norvegicus
agggctggctgctaactgttgactc

SEQ ID NO: 149944 - DNA, 25 bp, Rattus norvegicus
agggctggctgctgatcaaggcaca

SEQ ID NO: 149945 - DNA, 25 bp, Rattus norvegicus
agggctggcttcactcatgcttttc

SEQ ID NO: 149946 - DNA, 25 bp, Rattus norvegicus
agggctggcttctctcatgcttttc

SEQ ID NO: 149947 - DNA, 25 bp, Rattus norvegicus
agggctgggagccattacaaccatc

SEQ ID NO: 149948 - DNA, 25 bp, Rattus norvegicus
agggctgggagcgattacaaccatc

SEQ ID NO: 149949 - DNA, 25 bp, Rattus norvegicus
agggctgggccacaccaccataatg

SEQ ID NO: 149950 - DNA, 25 bp, Rattus norvegicus
agggctgggccagaccaccataatg

SEQ ID NO: 149951 - DNA, 25 bp, Rattus norvegicus
agggctgggctcagatctccagcct

SEQ ID NO: 149952 - DNA, 25 bp, Rattus norvegicus
agggctgggctctgatctccagcct

SEQ ID NO: 149953 - DNA, 25 bp, Rattus norvegicus
agggctgggtttatcatcaaccact

SEQ ID NO: 149954 - DNA, 25 bp, Rattus norvegicus
agggctgggtttttcatcaaccact

SEQ ID NO: 149955 - DNA, 25 bp, Rattus norvegicus
agggctggtccaagactgtgtgtta

SEQ ID NO: 149956 - DNA, 25 bp, Rattus norvegicus
agggctggtccatgactgtgtgtta

SEQ ID NO: 149957 - DNA, 25 bp, Rattus norvegicus
agggctggtgctatctgcctacaat

SEQ ID NO: 149958 - DNA, 25 bp, Rattus norvegicus
agggctggtgctattgtcagctttc

SEQ ID NO: 149959 - DNA, 25 bp, Rattus norvegicus
agggctggtgctttctgcctacaat

SEQ ID NO: 149960 - DNA, 25 bp, Rattus norvegicus
agggctggtgcttttgtcagctttc

SEQ ID NO: 149961 - DNA, 25 bp, Rattus norvegicus
agggctggtgtgcactacacactcc

SEQ ID NO: 149962 - DNA, 25 bp, Rattus norvegicus
agggctggtgtggactacacactcc

SEQ ID NO: 149963 - DNA, 25 bp, Rattus norvegicus
agggctgtacaccaactctagtttg

SEQ ID NO: 149964 - DNA, 25 bp, Rattus norvegicus
agggctgtacacgaactctagtttg

SEQ ID NO: 149965 - DNA, 25 bp, Rattus norvegicus
agggctgtactgacccaaggtgtgc

SEQ ID NO: 149966 - DNA, 25 bp, Rattus norvegicus
agggctgtactgtcccaaggtgtgc

SEQ ID NO: 149967 - DNA, 25 bp, Rattus norvegicus
agggctgtccctagtgtcttttaga

SEQ ID NO: 149968 - DNA, 25 bp, Rattus norvegicus
agggctgtcccttgtgtcttttaga

SEQ ID NO: 149969 - DNA, 25 bp, Rattus norvegicus
agggctgtctggaggcatcgaatct

SEQ ID NO: 149970 - DNA, 25 bp, Rattus norvegicus
agggctgtctggtggcatcgaatct

SEQ ID NO: 149971 - DNA, 25 bp, Rattus norvegicus
agggctgtcttaacttctgggaaca

SEQ ID NO: 149972 - DNA, 25 bp, Rattus norvegicus
agggctgtcttatcttctgggaaca

SEQ ID NO: 149973 - DNA, 25 bp, Rattus norvegicus
agggctgtcttgacttggagctgcc

SEQ ID NO: 149974 - DNA, 25 bp, Rattus norvegicus
agggctgtcttgtcttggagctgcc

SEQ ID NO: 149975 - DNA, 25 bp, Rattus norvegicus
agggctgtgaatcttatcttgatat

SEQ ID NO: 149976 - DNA, 25 bp, Rattus norvegicus
agggctgtgaatgttatcttgatat

SEQ ID NO: 149977 - DNA, 25 bp, Rattus norvegicus
agggctgtgagaccagagcttccca

SEQ ID NO: 149978 - DNA, 25 bp, Rattus norvegicus
agggctgtgagagcagagcttccca

SEQ ID NO: 149979 - DNA, 25 bp, Rattus norvegicus
agggctgtgaggactcggtactcca

SEQ ID NO: 149980 - DNA, 25 bp, Rattus norvegicus
agggctgtgaggtctcggtactcca

SEQ ID NO: 149981 - DNA, 25 bp, Rattus norvegicus
agggctgtgatacagggccacctca

SEQ ID NO: 149982 - DNA, 25 bp, Rattus norvegicus
agggctgtgatagagggccacctca

SEQ ID NO: 149983 - DNA, 25 bp, Rattus norvegicus
agggctgtgcatagggctgtactct

SEQ ID NO: 149984 - DNA, 25 bp, Rattus norvegicus
agggctgtgcattgggctgtactct

SEQ ID NO: 149985 - DNA, 25 bp, Rattus norvegicus
agggctgtgctacgagtgacttcaa

SEQ ID NO: 149986 - DNA, 25 bp, Rattus norvegicus
agggctgtgctaggagtgacttcaa

SEQ ID NO: 149987 - DNA, 25 bp, Rattus norvegicus
agggctgtgctcatggtacacgaca

SEQ ID NO: 149988 - DNA, 25 bp, Rattus norvegicus
agggctgtgctcttggtacacgaca

SEQ ID NO: 149989 - DNA, 25 bp, Rattus norvegicus
agggctgtgttgcaactcaacgcaa

SEQ ID NO: 149990 - DNA, 25 bp, Rattus norvegicus
agggctgtgttggaactcaacgcaa

SEQ ID NO: 149991 - DNA, 25 bp, Rattus norvegicus
agggctgttacacatccttccagga

SEQ ID NO: 149992 - DNA, 25 bp, Rattus norvegicus
agggctgttacactgtgatcctcaa

SEQ ID NO: 149993 - DNA, 25 bp, Rattus norvegicus
agggctgttacagatccttccagga

SEQ ID NO: 149994 - DNA, 25 bp, Rattus norvegicus
agggctgttacagtgtgatcctcaa

SEQ ID NO: 149995 - DNA, 25 bp, Rattus norvegicus
agggctgttagccacattatctgtg

SEQ ID NO: 149996 - DNA, 25 bp, Rattus norvegicus
agggctgttagcgacattatctgtg

SEQ ID NO: 149997 - DNA, 25 bp, Rattus norvegicus
agggctgttcctcccacgattgctg

SEQ ID NO: 149998 - DNA, 25 bp, Rattus norvegicus
agggctgttcctgccacgattgctg

SEQ ID NO: 149999 - DNA, 25 bp, Rattus norvegicus
agggctgttctgaccgtcgcagcag

SEQ ID NO: 150000 - DNA, 25 bp, Rattus norvegicus
agggctgttctgtccgtcgcagcag

SEQ ID NO: 150001 - DNA, 25 bp, Rattus norvegicus
agggctgttcttacagagagcattc

SEQ ID NO: 150002 - DNA, 25 bp, Rattus norvegicus
agggctgttctttcagagagcattc

SEQ ID NO: 150003 - DNA, 25 bp, Rattus norvegicus
agggctgttgtacttcaaacccgca

SEQ ID NO: 150004 - DNA, 25 bp, Rattus norvegicus
agggctgttgtagttcaaacccgca

SEQ ID NO: 150005 - DNA, 25 bp, Rattus norvegicus
agggctgtttaaataatcgcttgca

SEQ ID NO: 150006 - DNA, 25 bp, Rattus norvegicus
agggctgtttaattaatcgcttgca

SEQ ID NO: 150007 - DNA, 25 bp, Rattus norvegicus
agggcttaacaacggttgctctcca

SEQ ID NO: 150008 - DNA, 25 bp, Rattus norvegicus
agggcttaacaagggttgctctcca

SEQ ID NO: 150009 - DNA, 25 bp, Rattus norvegicus
agggcttaatccatctacttgtaga

SEQ ID NO: 150010 - DNA, 25 bp, Rattus norvegicus
agggcttaatccttctacttgtaga

SEQ ID NO: 150011 - DNA, 25 bp, Rattus norvegicus
agggcttacagcagagctgccggca

SEQ ID NO: 150012 - DNA, 25 bp, Rattus norvegicus
agggcttacagctgagctgccggca

SEQ ID NO: 150013 - DNA, 25 bp, Rattus norvegicus
agggcttagcccagagctcctggga

SEQ ID NO: 150014 - DNA, 25 bp, Rattus norvegicus
agggcttagccctgagctcctggga

SEQ ID NO: 150015 - DNA, 25 bp, Rattus norvegicus
agggcttagggacacaggttcactt

SEQ ID NO: 150016 - DNA, 25 bp, Rattus norvegicus
agggcttagggagacaggttcactt

SEQ ID NO: 150017 - DNA, 25 bp, Rattus norvegicus
agggcttatggaattcatggttctc

SEQ ID NO: 150018 - DNA, 25 bp, Rattus norvegicus
agggcttatggatttcatggttctc

SEQ ID NO: 150019 - DNA, 25 bp, Rattus norvegicus
agggcttatgtccaacggtcccatt

SEQ ID NO: 150020 - DNA, 25 bp, Rattus norvegicus
agggcttatgtcgaacggtcccatt

SEQ ID NO: 150021 - DNA, 25 bp, Rattus norvegicus
agggcttattagctctcaaagatag

SEQ ID NO: 150022 - DNA, 25 bp, Rattus norvegicus
agggcttattaggtctcaaagatag

SEQ ID NO: 150023 - DNA, 25 bp, Rattus norvegicus
agggcttattccatgcatcatgcac

SEQ ID NO: 150024 - DNA, 25 bp, Rattus norvegicus
agggcttattccttgcatcatgcac

SEQ ID NO: 150025 - DNA, 25 bp, Rattus norvegicus
agggcttcaagcaggtggcactgaa

SEQ ID NO: 150026 - DNA, 25 bp, Rattus norvegicus
agggcttcaagctggtggcactgaa

SEQ ID NO: 150027 - DNA, 25 bp, Rattus norvegicus
agggcttcaaggcagtctacctgga

SEQ ID NO: 150028 - DNA, 25 bp, Rattus norvegicus
agggcttcaagggagtctacctgga

SEQ ID NO: 150029 - DNA, 25 bp, Rattus norvegicus
agggcttcacacagcactaaaggga

SEQ ID NO: 150030 - DNA, 25 bp, Rattus norvegicus
agggcttcacactgcactaaaggga

SEQ ID NO: 150031 - DNA, 25 bp, Rattus norvegicus
agggcttcacatattgctcaaccat

SEQ ID NO: 150032 - DNA, 25 bp, Rattus norvegicus
agggcttcacattttgctcaaccat

SEQ ID NO: 150033 - DNA, 25 bp, Rattus norvegicus
agggcttcacccatgactggatggt

SEQ ID NO: 150034 - DNA, 25 bp, Rattus norvegicus
agggcttcacccttgactggatggt

SEQ ID NO: 150035 - DNA, 25 bp, Rattus norvegicus
agggcttcagaacactggcctcaac

SEQ ID NO: 150036 - DNA, 25 bp, Rattus norvegicus
agggcttcagaagactggcctcaac

SEQ ID NO: 150037 - DNA, 25 bp, Rattus norvegicus
agggcttcagctcccgggtatcaaa

SEQ ID NO: 150038 - DNA, 25 bp, Rattus norvegicus
agggcttcagctgccgggtatcaaa

SEQ ID NO: 150039 - DNA, 25 bp, Rattus norvegicus
agggcttcagtccttgcaataccaa

SEQ ID NO: 150040 - DNA, 25 bp, Rattus norvegicus
agggcttcagtcgttgcaataccaa

SEQ ID NO: 150041 - DNA, 25 bp, Rattus norvegicus
agggcttcatcacagactctggatt

SEQ ID NO: 150042 - DNA, 25 bp, Rattus norvegicus
agggcttcatcagagactctggatt

SEQ ID NO: 150043 - DNA, 25 bp, Rattus norvegicus
agggcttcatgtccttgctccgtgt

SEQ ID NO: 150044 - DNA, 25 bp, Rattus norvegicus
agggcttcatgtgcttgctccgtgt

SEQ ID NO: 150045 - DNA, 25 bp, Rattus norvegicus
agggcttcattgagactgcttctag

SEQ ID NO: 150046 - DNA, 25 bp, Rattus norvegicus
agggcttcattgtgactgcttctag

SEQ ID NO: 150047 - DNA, 25 bp, Rattus norvegicus
agggcttccagaaactcttggttct

SEQ ID NO: 150048 - DNA, 25 bp, Rattus norvegicus
agggcttccagatactcttggttct

SEQ ID NO: 150049 - DNA, 25 bp, Rattus norvegicus
agggcttccaggctgcttcgcaaat

SEQ ID NO: 150050 - DNA, 25 bp, Rattus norvegicus
agggcttccagggtgcttcgcaaat

SEQ ID NO: 150051 - DNA, 25 bp, Rattus norvegicus
agggcttcccagaagccatgacaga

SEQ ID NO: 150052 - DNA, 25 bp, Rattus norvegicus
agggcttcccagtagccatgacaga

SEQ ID NO: 150053 - DNA, 25 bp, Rattus norvegicus
agggcttcctggacacactaatggt

SEQ ID NO: 150054 - DNA, 25 bp, Rattus norvegicus
agggcttcctggtcacactaatggt

SEQ ID NO: 150055 - DNA, 25 bp, Rattus norvegicus
agggcttcctttcagctcaacttga

SEQ ID NO: 150056 - DNA, 25 bp, Rattus norvegicus
agggcttcctttgagctcaacttga

SEQ ID NO: 150057 - DNA, 25 bp, Rattus norvegicus
agggcttcgacaatgcatgctggga

SEQ ID NO: 150058 - DNA, 25 bp, Rattus norvegicus
agggcttcgacattgcatgctggga

SEQ ID NO: 150059 - DNA, 25 bp, Rattus norvegicus
agggcttcgcacctaagctggatga

SEQ ID NO: 150060 - DNA, 25 bp, Rattus norvegicus
agggcttcgcacgtaagctggatga

SEQ ID NO: 150061 - DNA, 25 bp, Rattus norvegicus
agggcttcgccactagaactatgtt

SEQ ID NO: 150062 - DNA, 25 bp, Rattus norvegicus
agggcttcgccagtagaactatgtt

SEQ ID NO: 150063 - DNA, 25 bp, Rattus norvegicus
agggcttcggccactgagacttcaa

SEQ ID NO: 150064 - DNA, 25 bp, Rattus norvegicus
agggcttcggccatcaggatgccag

SEQ ID NO: 150065 - DNA, 25 bp, Rattus norvegicus
agggcttcggcctctgagacttcaa

SEQ ID NO: 150066 - DNA, 25 bp, Rattus norvegicus
agggcttcggccttcaggatgccag

SEQ ID NO: 150067 - DNA, 25 bp, Rattus norvegicus
agggcttctcacataggtgactctt

SEQ ID NO: 150068 - DNA, 25 bp, Rattus norvegicus
agggcttctcacttaggtgactctt

SEQ ID NO: 150069 - DNA, 25 bp, Rattus norvegicus
agggcttctcagacctacctgtaat

SEQ ID NO: 150070 - DNA, 25 bp, Rattus norvegicus
agggcttctcagtcctacctgtaat

SEQ ID NO: 150071 - DNA, 25 bp, Rattus norvegicus
agggcttctcggaacttctcaggct

SEQ ID NO: 150072 - DNA, 25 bp, Rattus norvegicus
agggcttctcggtacttctcaggct

SEQ ID NO: 150073 - DNA, 25 bp, Rattus norvegicus
agggcttctctcaacaagtggatcg

SEQ ID NO: 150074 - DNA, 25 bp, Rattus norvegicus
agggcttctctctacaagtggatcg

SEQ ID NO: 150075 - DNA, 25 bp, Rattus norvegicus
agggcttcttggatcgctgtcatac

SEQ ID NO: 150076 - DNA, 25 bp, Rattus norvegicus
agggcttcttggttcgctgtcatac

SEQ ID NO: 150077 - DNA, 25 bp, Rattus norvegicus
agggcttgacgacttggaaaatgct

SEQ ID NO: 150078 - DNA, 25 bp, Rattus norvegicus
agggcttgacgagttggaaaatgct

SEQ ID NO: 150079 - DNA, 25 bp, Rattus norvegicus
agggcttgagttacttcatgtgaac

SEQ ID NO: 150080 - DNA, 25 bp, Rattus norvegicus
agggcttgagtttcttcatgtgaac

SEQ ID NO: 150081 - DNA, 25 bp, Rattus norvegicus
agggcttgcccaccctatgagaggc

SEQ ID NO: 150082 - DNA, 25 bp, Rattus norvegicus
agggcttgcccagcctatgagaggc

SEQ ID NO: 150083 - DNA, 25 bp, Rattus norvegicus
agggcttggaaaacctcttgggccg

SEQ ID NO: 150084 - DNA, 25 bp, Rattus norvegicus
agggcttggaaatcctcttgggccg

SEQ ID NO: 150085 - DNA, 25 bp, Rattus norvegicus
agggcttggctgcaggcaccttcct

SEQ ID NO: 150086 - DNA, 25 bp, Rattus norvegicus
agggcttggctggaggcaccttcct

SEQ ID NO: 150087 - DNA, 25 bp, Rattus norvegicus
agggcttggttcagcatttacattt

SEQ ID NO: 150088 - DNA, 25 bp, Rattus norvegicus
agggcttggttctgcatttacattt

SEQ ID NO: 150089 - DNA, 25 bp, Rattus norvegicus
agggcttggttgaattggtcttgca

SEQ ID NO: 150090 - DNA, 25 bp, Rattus norvegicus
agggcttggttgtattggtcttgca

SEQ ID NO: 150091 - DNA, 25 bp, Rattus norvegicus
agggcttgtcggacagggtcctcta

SEQ ID NO: 150092 - DNA, 25 bp, Rattus norvegicus
agggcttgtcggtcagggtcctcta

SEQ ID NO: 150093 - DNA, 25 bp, Rattus norvegicus
agggcttgtcttcactgtcagaggt

SEQ ID NO: 150094 - DNA, 25 bp, Rattus norvegicus
agggcttgtcttgactgtcagaggt

SEQ ID NO: 150095 - DNA, 25 bp, Rattus norvegicus
agggcttgtgatcagttcctgctcc

SEQ ID NO: 150096 - DNA, 25 bp, Rattus norvegicus
agggcttgtgatgagttcctgctcc

SEQ ID NO: 150097 - DNA, 25 bp, Rattus norvegicus
agggcttgtgccattttagttcact

SEQ ID NO: 150098 - DNA, 25 bp, Rattus norvegicus
agggcttgtgcctttttagttcact

SEQ ID NO: 150099 - DNA, 25 bp, Rattus norvegicus
agggcttgtggcattgaacttccta

SEQ ID NO: 150100 - DNA, 25 bp, Rattus norvegicus
agggcttgtggctttgaacttccta

SEQ ID NO: 150101 - DNA, 25 bp, Rattus norvegicus
agggcttgtttgactttcatctgtg

SEQ ID NO: 150102 - DNA, 25 bp, Rattus norvegicus
agggcttgtttgtctttcatctgtg

SEQ ID NO: 150103 - DNA, 25 bp, Rattus norvegicus
agggctttaaataggctcactctaa

SEQ ID NO: 150104 - DNA, 25 bp, Rattus norvegicus
agggctttaaattggctcactctaa

SEQ ID NO: 150105 - DNA, 25 bp, Rattus norvegicus
agggctttcaatcgctccagcaatg

SEQ ID NO: 150106 - DNA, 25 bp, Rattus norvegicus
agggctttcaatggctccagcaatg

SEQ ID NO: 150107 - DNA, 25 bp, Rattus norvegicus
agggctttcccacaggagcgatact

SEQ ID NO: 150108 - DNA, 25 bp, Rattus norvegicus
agggctttcccagaggagcgatact

SEQ ID NO: 150109 - DNA, 25 bp, Rattus norvegicus
agggctttccgcaaccaggacaact

SEQ ID NO: 150110 - DNA, 25 bp, Rattus norvegicus
agggctttccgctaccaggacaact

SEQ ID NO: 150111 - DNA, 25 bp, Rattus norvegicus
agggctttcctacaataactccact

SEQ ID NO: 150112 - DNA, 25 bp, Rattus norvegicus
agggctttcctagaataactccact

SEQ ID NO: 150113 - DNA, 25 bp, Rattus norvegicus
agggctttcgtgagcctgttggacc

SEQ ID NO: 150114 - DNA, 25 bp, Rattus norvegicus
agggctttcgtgtgcctgttggacc

SEQ ID NO: 150115 - DNA, 25 bp, Rattus norvegicus
agggctttgaaacttctcatccaaa

SEQ ID NO: 150116 - DNA, 25 bp, Rattus norvegicus
agggctttgaaagttctcatccaaa

SEQ ID NO: 150117 - DNA, 25 bp, Rattus norvegicus
agggctttgacccacacttgtatgc

SEQ ID NO: 150118 - DNA, 25 bp, Rattus norvegicus
agggctttgaccgacacttgtatgc

SEQ ID NO: 150119 - DNA, 25 bp, Rattus norvegicus
agggctttgagcacaggaactgata

SEQ ID NO: 150120 - DNA, 25 bp, Rattus norvegicus
agggctttgagctcaggaactgata

SEQ ID NO: 150121 - DNA, 25 bp, Rattus norvegicus
agggctttgcctagaggagaccccg

SEQ ID NO: 150122 - DNA, 25 bp, Rattus norvegicus
agggctttgccttgaggagaccccg

SEQ ID NO: 150123 - DNA, 25 bp, Rattus norvegicus
agggctttgctgacagattcttaac

SEQ ID NO: 150124 - DNA, 25 bp, Rattus norvegicus
agggctttgctgtcagattcttaac

SEQ ID NO: 150125 - DNA, 25 bp, Rattus norvegicus
agggctttggatcctattactagtc

SEQ ID NO: 150126 - DNA, 25 bp, Rattus norvegicus
agggctttggatgctattactagtc

SEQ ID NO: 150127 - DNA, 25 bp, Rattus norvegicus
agggctttgggtactgtgaccctca

SEQ ID NO: 150128 - DNA, 25 bp, Rattus norvegicus
agggctttgggttctgtgaccctca

SEQ ID NO: 150129 - DNA, 25 bp, Rattus norvegicus
aggggatccagtcgcctcttttggc

SEQ ID NO: 150130 - DNA, 25 bp, Rattus norvegicus
aggggatccagtggcctcttttggc

SEQ ID NO: 150131 - DNA, 25 bp, Rattus norvegicus
aggggccatgcacgagcttgaagca

SEQ ID NO: 150132 - DNA, 25 bp, Rattus norvegicus
aggggccatgcaggagcttgaagca

SEQ ID NO: 150133 - DNA, 25 bp, Rattus norvegicus
aggggccttttgacctgttagcaat

SEQ ID NO: 150134 - DNA, 25 bp, Rattus norvegicus
aggggccttttgtcctgttagcaat

SEQ ID NO: 150135 - DNA, 25 bp, Rattus norvegicus
aggggctagtgcacaaagacaggtc

SEQ ID NO: 150136 - DNA, 25 bp, Rattus norvegicus
aggggctagtgctcaaagacaggtc

SEQ ID NO: 150137 - DNA, 25 bp, Rattus norvegicus
aggggctgatttatcaaactgtgtg

SEQ ID NO: 150138 - DNA, 25 bp, Rattus norvegicus
aggggctgatttttcaaactgtgtg

SEQ ID NO: 150139 - DNA, 25 bp, Rattus norvegicus
agggtaaacatcagccaggctccat

SEQ ID NO: 150140 - DNA, 25 bp, Rattus norvegicus
agggtaaacatctgccaggctccat

SEQ ID NO: 150141 - DNA, 25 bp, Rattus norvegicus
agggtaaaggctccagtctgccaag

SEQ ID NO: 150142 - DNA, 25 bp, Rattus norvegicus
agggtaaaggctgcagtctgccaag

SEQ ID NO: 150143 - DNA, 25 bp, Rattus norvegicus
agggtaaagttgagccacatctgtg

SEQ ID NO: 150144 - DNA, 25 bp, Rattus norvegicus
agggtaaagttgtgccacatctgtg

SEQ ID NO: 150145 - DNA, 25 bp, Rattus norvegicus
agggtaaatgtcctactcgtcagaa

SEQ ID NO: 150146 - DNA, 25 bp, Rattus norvegicus
agggtaaatgtcgtactcgtcagaa

SEQ ID NO: 150147 - DNA, 25 bp, Rattus norvegicus
agggtaacagcacctaaggcctgca

SEQ ID NO: 150148 - DNA, 25 bp, Rattus norvegicus
agggtaacagcagctaaggcctgca

SEQ ID NO: 150149 - DNA, 25 bp, Rattus norvegicus
agggtaacatccctcagcaatctga

SEQ ID NO: 150150 - DNA, 25 bp, Rattus norvegicus
agggtaacatccgtcagcaatctga

SEQ ID NO: 150151 - DNA, 25 bp, Rattus norvegicus
agggtaaccaggaagtgtgatatca

SEQ ID NO: 150152 - DNA, 25 bp, Rattus norvegicus
agggtaaccaggtagtgtgatatca

SEQ ID NO: 150153 - DNA, 25 bp, Rattus norvegicus
agggtaacccttcaacaactgcgcg

SEQ ID NO: 150154 - DNA, 25 bp, Rattus norvegicus
agggtaacccttgaacaactgcgcg

SEQ ID NO: 150155 - DNA, 25 bp, Rattus norvegicus
agggtaacctgtcagatccaccgtt

SEQ ID NO: 150156 - DNA, 25 bp, Rattus norvegicus
agggtaacctgtgagatccaccgtt

SEQ ID NO: 150157 - DNA, 25 bp, Rattus norvegicus
agggtaagaggcctcaacttcctgg

SEQ ID NO: 150158 - DNA, 25 bp, Rattus norvegicus
agggtaagaggcgtcaacttcctgg

SEQ ID NO: 150159 - DNA, 25 bp, Rattus norvegicus
agggtaaggcccatcagcagtatcc

SEQ ID NO: 150160 - DNA, 25 bp, Rattus norvegicus
agggtaaggcccttcagcagtatcc

SEQ ID NO: 150161 - DNA, 25 bp, Rattus norvegicus
agggtaatccctagagctttcagac

SEQ ID NO: 150162 - DNA, 25 bp, Rattus norvegicus
agggtaatcccttgagctttcagac

SEQ ID NO: 150163 - DNA, 25 bp, Rattus norvegicus
agggtaatgcatcaatcctgctcct

SEQ ID NO: 150164 - DNA, 25 bp, Rattus norvegicus
agggtaatgcatgaatcctgctcct

SEQ ID NO: 150165 - DNA, 25 bp, Rattus norvegicus
agggtaatgcctctcattcctgaag

SEQ ID NO: 150166 - DNA, 25 bp, Rattus norvegicus
agggtaatgcctgtcattcctgaag

SEQ ID NO: 150167 - DNA, 25 bp, Rattus norvegicus
agggtacacatcaagaggccacatc

SEQ ID NO: 150168 - DNA, 25 bp, Rattus norvegicus
agggtacacatctagaggccacatc

SEQ ID NO: 150169 - DNA, 25 bp, Rattus norvegicus
agggtacagaacatcgctgggccaa

SEQ ID NO: 150170 - DNA, 25 bp, Rattus norvegicus
agggtacagaacttcgctgggccaa

SEQ ID NO: 150171 - DNA, 25 bp, Rattus norvegicus
agggtacatccacaaggctcagaca

SEQ ID NO: 150172 - DNA, 25 bp, Rattus norvegicus
agggtacatccagaaggctcagaca

SEQ ID NO: 150173 - DNA, 25 bp, Rattus norvegicus
agggtacatcccaggcatcagagaa

SEQ ID NO: 150174 - DNA, 25 bp, Rattus norvegicus
agggtacatccctggcatcagagaa

SEQ ID NO: 150175 - DNA, 25 bp, Rattus norvegicus
agggtaccagacatcaccagtgtct

SEQ ID NO: 150176 - DNA, 25 bp, Rattus norvegicus
agggtaccagacttcaccagtgtct

SEQ ID NO: 150177 - DNA, 25 bp, Rattus norvegicus
agggtaccagctcgagcctgcttca

SEQ ID NO: 150178 - DNA, 25 bp, Rattus norvegicus
agggtaccagctggagcctgcttca

SEQ ID NO: 150179 - DNA, 25 bp, Rattus norvegicus
agggtaccatatcatctcattgcaa

SEQ ID NO: 150180 - DNA, 25 bp, Rattus norvegicus
agggtaccatatgatctcattgcaa

SEQ ID NO: 150181 - DNA, 25 bp, Rattus norvegicus
agggtaccgctgcagatgctctgat

SEQ ID NO: 150182 - DNA, 25 bp, Rattus norvegicus
agggtaccgctggagatgctctgat

SEQ ID NO: 150183 - DNA, 25 bp, Rattus norvegicus
agggtacctatgcttgtttccaatg

SEQ ID NO: 150184 - DNA, 25 bp, Rattus norvegicus
agggtacctatggttgtttccaatg

SEQ ID NO: 150185 - DNA, 25 bp, Rattus norvegicus
agggtacgtcctcatgacagggaat

SEQ ID NO: 150186 - DNA, 25 bp, Rattus norvegicus
agggtacgtcctgatgacagggaat

SEQ ID NO: 150187 - DNA, 25 bp, Rattus norvegicus
agggtactagctcgtgatcggcccc

SEQ ID NO: 150188 - DNA, 25 bp, Rattus norvegicus
agggtactagctggtgatcggcccc

SEQ ID NO: 150189 - DNA, 25 bp, Rattus norvegicus
agggtacttaggcagtagcttccaa

SEQ ID NO: 150190 - DNA, 25 bp, Rattus norvegicus
agggtacttagggagtagcttccaa

SEQ ID NO: 150191 - DNA, 25 bp, Rattus norvegicus
agggtagaacacattcctgacctgt

SEQ ID NO: 150192 - DNA, 25 bp, Rattus norvegicus
agggtagaacactttcctgacctgt

SEQ ID NO: 150193 - DNA, 25 bp, Rattus norvegicus
agggtagaccccacagagaatccat

SEQ ID NO: 150194 - DNA, 25 bp, Rattus norvegicus
agggtagacccctcagagaatccat

SEQ ID NO: 150195 - DNA, 25 bp, Rattus norvegicus
agggtagcaagccacgtctatcaag

SEQ ID NO: 150196 - DNA, 25 bp, Rattus norvegicus
agggtagcaagcgacgtctatcaag

SEQ ID NO: 150197 - DNA, 25 bp, Rattus norvegicus
agggtagcacggcactcttcagagt

SEQ ID NO: 150198 - DNA, 25 bp, Rattus norvegicus
agggtagcacgggactcttcagagt

SEQ ID NO: 150199 - DNA, 25 bp, Rattus norvegicus
agggtagccaccaccagacctggta

SEQ ID NO: 150200 - DNA, 25 bp, Rattus norvegicus
agggtagccacctccagacctggta

SEQ ID NO: 150201 - DNA, 25 bp, Rattus norvegicus
agggtagccagcacctttagaggat

SEQ ID NO: 150202 - DNA, 25 bp, Rattus norvegicus
agggtagccagctcctttagaggat

SEQ ID NO: 150203 - DNA, 25 bp, Rattus norvegicus
agggtagcccctagacactttctgg

SEQ ID NO: 150204 - DNA, 25 bp, Rattus norvegicus
agggtagccccttgacactttctgg

SEQ ID NO: 150205 - DNA, 25 bp, Rattus norvegicus
agggtagccctgcattgtcgactgt

SEQ ID NO: 150206 - DNA, 25 bp, Rattus norvegicus
agggtagccctggattgtcgactgt

SEQ ID NO: 150207 - DNA, 25 bp, Rattus norvegicus
agggtagcctgtacaatgccaacta

SEQ ID NO: 150208 - DNA, 25 bp, Rattus norvegicus
agggtagcctgttcaatgccaacta

SEQ ID NO: 150209 - DNA, 25 bp, Rattus norvegicus
agggtagctggcatttctggtctgt

SEQ ID NO: 150210 - DNA, 25 bp, Rattus norvegicus
agggtagctggcttttctggtctgt

SEQ ID NO: 150211 - DNA, 25 bp, Rattus norvegicus
agggtagctgtgcacctttaggaat

SEQ ID NO: 150212 - DNA, 25 bp, Rattus norvegicus
agggtagctgtggacctttaggaat

SEQ ID NO: 150213 - DNA, 25 bp, Rattus norvegicus
agggtaggcagaaccgcagtccttc

SEQ ID NO: 150214 - DNA, 25 bp, Rattus norvegicus
agggtaggcagatccgcagtccttc

SEQ ID NO: 150215 - DNA, 25 bp, Rattus norvegicus
agggtaggcattcgtgttcacgcac

SEQ ID NO: 150216 - DNA, 25 bp, Rattus norvegicus
agggtaggcattggtgttcacgcac

SEQ ID NO: 150217 - DNA, 25 bp, Rattus norvegicus
agggtaggccttcttggcagcacca

SEQ ID NO: 150218 - DNA, 25 bp, Rattus norvegicus
agggtaggccttgttggcagcacca

SEQ ID NO: 150219 - DNA, 25 bp, Rattus norvegicus
agggtagggtgcctcattcctctgc

SEQ ID NO: 150220 - DNA, 25 bp, Rattus norvegicus
agggtagggtgcgtcattcctctgc

SEQ ID NO: 150221 - DNA, 25 bp, Rattus norvegicus
agggtagtctagacggtcctcagcc

SEQ ID NO: 150222 - DNA, 25 bp, Rattus norvegicus
agggtagtctagtcggtcctcagcc

SEQ ID NO: 150223 - DNA, 25 bp, Rattus norvegicus
agggtagtgattaccacacctgctt

SEQ ID NO: 150224 - DNA, 25 bp, Rattus norvegicus
agggtagtgatttccacacctgctt

SEQ ID NO: 150225 - DNA, 25 bp, Rattus norvegicus
agggtataaggaactgcagcaggat

SEQ ID NO: 150226 - DNA, 25 bp, Rattus norvegicus
agggtataaggatctgcagcaggat

SEQ ID NO: 150227 - DNA, 25 bp, Rattus norvegicus
agggtatactccataaccatgctat

SEQ ID NO: 150228 - DNA, 25 bp, Rattus norvegicus
agggtatactccttaaccatgctat

SEQ ID NO: 150229 - DNA, 25 bp, Rattus norvegicus
agggtataggcaatccagccactgt

SEQ ID NO: 150230 - DNA, 25 bp, Rattus norvegicus
agggtataggcattccagccactgt

SEQ ID NO: 150231 - DNA, 25 bp, Rattus norvegicus
agggtatattgcaccagtgttgtaa

SEQ ID NO: 150232 - DNA, 25 bp, Rattus norvegicus
agggtatattgctccagtgttgtaa

SEQ ID NO: 150233 - DNA, 25 bp, Rattus norvegicus
agggtatcatttctctggcttgcaa

SEQ ID NO: 150234 - DNA, 25 bp, Rattus norvegicus
agggtatcatttgtctggcttgcaa

SEQ ID NO: 150235 - DNA, 25 bp, Rattus norvegicus
agggtatccagaagccagtgtctcc

SEQ ID NO: 150236 - DNA, 25 bp, Rattus norvegicus
agggtatccagatgccagtgtctcc

SEQ ID NO: 150237 - DNA, 25 bp, Rattus norvegicus
agggtatcccagcatgaagcctcat

SEQ ID NO: 150238 - DNA, 25 bp, Rattus norvegicus
agggtatcccaggatgaagcctcat

SEQ ID NO: 150239 - DNA, 25 bp, Rattus norvegicus
agggtatctacccacagattttctc

SEQ ID NO: 150240 - DNA, 25 bp, Rattus norvegicus
agggtatctaccgacagattttctc

SEQ ID NO: 150241 - DNA, 25 bp, Rattus norvegicus
agggtatctaggataactgtggcac

SEQ ID NO: 150242 - DNA, 25 bp, Rattus norvegicus
agggtatctaggttaactgtggcac

SEQ ID NO: 150243 - DNA, 25 bp, Rattus norvegicus
agggtatctgcgctttccagttcac

SEQ ID NO: 150244 - DNA, 25 bp, Rattus norvegicus
agggtatctgcggtttccagttcac

SEQ ID NO: 150245 - DNA, 25 bp, Rattus norvegicus
agggtatgattgctcagtcctgcac

SEQ ID NO: 150246 - DNA, 25 bp, Rattus norvegicus
agggtatgattggtcagtcctgcac

SEQ ID NO: 150247 - DNA, 25 bp, Rattus norvegicus
agggtatgcacacactgaccaccat

SEQ ID NO: 150248 - DNA, 25 bp, Rattus norvegicus
agggtatgcacagactgaccaccat

SEQ ID NO: 150249 - DNA, 25 bp, Rattus norvegicus
agggtatgtcccctcttactgacct

SEQ ID NO: 150250 - DNA, 25 bp, Rattus norvegicus
agggtatgtcccgtcttactgacct

SEQ ID NO: 150251 - DNA, 25 bp, Rattus norvegicus
agggtattactgaccattcttggcc

SEQ ID NO: 150252 - DNA, 25 bp, Rattus norvegicus
agggtattactgtccattcttggcc

SEQ ID NO: 150253 - DNA, 25 bp, Rattus norvegicus
agggtattccagacctgtgctgaat

SEQ ID NO: 150254 - DNA, 25 bp, Rattus norvegicus
agggtattccagtcctgtgctgaat

SEQ ID NO: 150255 - DNA, 25 bp, Rattus norvegicus
agggtattccctccaagttgtttag

SEQ ID NO: 150256 - DNA, 25 bp, Rattus norvegicus
agggtattccctgcaagttgtttag

SEQ ID NO: 150257 - DNA, 25 bp, Rattus norvegicus
agggtattctgaagcccactcgttt

SEQ ID NO: 150258 - DNA, 25 bp, Rattus norvegicus
agggtattctgatgcccactcgttt

SEQ ID NO: 150259 - DNA, 25 bp, Rattus norvegicus
agggtattgaggctccattgcccaa

SEQ ID NO: 150260 - DNA, 25 bp, Rattus norvegicus
agggtattgagggtccattgcccaa

SEQ ID NO: 150261 - DNA, 25 bp, Rattus norvegicus
agggtattgcctaacagtcttctgc

SEQ ID NO: 150262 - DNA, 25 bp, Rattus norvegicus
agggtattgccttacagtcttctgc

SEQ ID NO: 150263 - DNA, 25 bp, Rattus norvegicus
agggtattggaaaatctctgatcta

SEQ ID NO: 150264 - DNA, 25 bp, Rattus norvegicus
agggtattggaatatctctgatcta

SEQ ID NO: 150265 - DNA, 25 bp, Rattus norvegicus
agggtatttaggacacctgctcttc

SEQ ID NO: 150266 - DNA, 25 bp, Rattus norvegicus
agggtatttaggtcacctgctcttc

SEQ ID NO: 150267 - DNA, 25 bp, Rattus norvegicus
agggtattttctaacgccagcaacg

SEQ ID NO: 150268 - DNA, 25 bp, Rattus norvegicus
agggtattttcttacgccagcaacg

SEQ ID NO: 150269 - DNA, 25 bp, Rattus norvegicus
agggtcaacaacacctggtactcca

SEQ ID NO: 150270 - DNA, 25 bp, Rattus norvegicus
agggtcaacaactcctggtactcca

SEQ ID NO: 150271 - DNA, 25 bp, Rattus norvegicus
agggtcaaccccagaagcagattta

SEQ ID NO: 150272 - DNA, 25 bp, Rattus norvegicus
agggtcaacccctgaagcagattta

SEQ ID NO: 150273 - DNA, 25 bp, Rattus norvegicus
agggtcaagctgacaaggtcatctt

SEQ ID NO: 150274 - DNA, 25 bp, Rattus norvegicus
agggtcaagctgtcaaggtcatctt

SEQ ID NO: 150275 - DNA, 25 bp, Rattus norvegicus
agggtcaagggtctcttcttgccca

SEQ ID NO: 150276 - DNA, 25 bp, Rattus norvegicus
agggtcaagggtgtcttcttgccca

SEQ ID NO: 150277 - DNA, 25 bp, Rattus norvegicus
agggtcaagtagcagttgccaacac

SEQ ID NO: 150278 - DNA, 25 bp, Rattus norvegicus
agggtcaagtaggagttgccaacac

SEQ ID NO: 150279 - DNA, 25 bp, Rattus norvegicus
agggtcaagtgcctgcatcaactct

SEQ ID NO: 150280 - DNA, 25 bp, Rattus norvegicus
agggtcaagtgcgtgcatcaactct

SEQ ID NO: 150281 - DNA, 25 bp, Rattus norvegicus
agggtcaagttcctcatttgctttg

SEQ ID NO: 150282 - DNA, 25 bp, Rattus norvegicus
agggtcaagttcgtcatttgctttg

SEQ ID NO: 150283 - DNA, 25 bp, Rattus norvegicus
agggtcaatcccaggtacatgcaga

SEQ ID NO: 150284 - DNA, 25 bp, Rattus norvegicus
agggtcaatccctggtacatgcaga

SEQ ID NO: 150285 - DNA, 25 bp, Rattus norvegicus
agggtcacaagtccacacgcaacca

SEQ ID NO: 150286 - DNA, 25 bp, Rattus norvegicus
agggtcacaagtgcacacgcaacca

SEQ ID NO: 150287 - DNA, 25 bp, Rattus norvegicus
agggtcacactgaacacgctgcagt

SEQ ID NO: 150288 - DNA, 25 bp, Rattus norvegicus
agggtcacactgtacacgctgcagt

SEQ ID NO: 150289 - DNA, 25 bp, Rattus norvegicus
agggtcacatcacccgtctgcagga

SEQ ID NO: 150290 - DNA, 25 bp, Rattus norvegicus
agggtcacatcagccgtctgcagga

SEQ ID NO: 150291 - DNA, 25 bp, Rattus norvegicus
agggtcacatgtagtccaggctttc

SEQ ID NO: 150292 - DNA, 25 bp, Rattus norvegicus
agggtcacatgttgtccaggctttc

SEQ ID NO: 150293 - DNA, 25 bp, Rattus norvegicus
agggtcaccactctgtcctgtgtaa

SEQ ID NO: 150294 - DNA, 25 bp, Rattus norvegicus
agggtcaccactgtgtcctgtgtaa

SEQ ID NO: 150295 - DNA, 25 bp, Rattus norvegicus
agggtcaccagcagtggtccagttg

SEQ ID NO: 150296 - DNA, 25 bp, Rattus norvegicus
agggtcaccagctgtggtccagttg

SEQ ID NO: 150297 - DNA, 25 bp, Rattus norvegicus
agggtcaccgaactttctacagcac

SEQ ID NO: 150298 - DNA, 25 bp, Rattus norvegicus
agggtcaccgaagtttctacagcac

SEQ ID NO: 150299 - DNA, 25 bp, Rattus norvegicus
agggtcacctcaaggttcatttttc

SEQ ID NO: 150300 - DNA, 25 bp, Rattus norvegicus
agggtcacctcatggttcatttttc

SEQ ID NO: 150301 - DNA, 25 bp, Rattus norvegicus
agggtcacctctcggtagacatgca

SEQ ID NO: 150302 - DNA, 25 bp, Rattus norvegicus
agggtcacctctgggtagacatgca

SEQ ID NO: 150303 - DNA, 25 bp, Rattus norvegicus
agggtcaccttaagtccaccaagga

SEQ ID NO: 150304 - DNA, 25 bp, Rattus norvegicus
agggtcaccttatgtccaccaagga

SEQ ID NO: 150305 - DNA, 25 bp, Rattus norvegicus
agggtcaccttcaggagagggtctt

SEQ ID NO: 150306 - DNA, 25 bp, Rattus norvegicus
agggtcaccttctggagagggtctt

SEQ ID NO: 150307 - DNA, 25 bp, Rattus norvegicus
agggtcacgcccaagtaactgaaat

SEQ ID NO: 150308 - DNA, 25 bp, Rattus norvegicus
agggtcacgccctagtaactgaaat

SEQ ID NO: 150309 - DNA, 25 bp, Rattus norvegicus
agggtcactcaaaccttctctgaga

SEQ ID NO: 150310 - DNA, 25 bp, Rattus norvegicus
agggtcactcaatccttctctgaga

SEQ ID NO: 150311 - DNA, 25 bp, Rattus norvegicus
agggtcactgctctctatgcatggc

SEQ ID NO: 150312 - DNA, 25 bp, Rattus norvegicus
agggtcactgctgtctatgcatggc

SEQ ID NO: 150313 - DNA, 25 bp, Rattus norvegicus
agggtcagaagcagctgtggcctca

SEQ ID NO: 150314 - DNA, 25 bp, Rattus norvegicus
agggtcagaagctgctgtggcctca

SEQ ID NO: 150315 - DNA, 25 bp, Rattus norvegicus
agggtcagaaggatcatcgcccaac

SEQ ID NO: 150316 - DNA, 25 bp, Rattus norvegicus
agggtcagaaggttcatcgcccaac

SEQ ID NO: 150317 - DNA, 25 bp, Rattus norvegicus
agggtcagcactatggttggattcc

SEQ ID NO: 150318 - DNA, 25 bp, Rattus norvegicus
agggtcagcactttggttggattcc

SEQ ID NO: 150319 - DNA, 25 bp, Rattus norvegicus
agggtcagcccacaagtcttcatgg

SEQ ID NO: 150320 - DNA, 25 bp, Rattus norvegicus
agggtcagcccagaagtcttcatgg

SEQ ID NO: 150321 - DNA, 25 bp, Rattus norvegicus
agggtcaggcaaactccagggtcag

SEQ ID NO: 150322 - DNA, 25 bp, Rattus norvegicus
agggtcaggcaatctccagggtcag

SEQ ID NO: 150323 - DNA, 25 bp, Rattus norvegicus
agggtcagtatacgctctttacgta

SEQ ID NO: 150324 - DNA, 25 bp, Rattus norvegicus
agggtcagtataggctctttacgta

SEQ ID NO: 150325 - DNA, 25 bp, Rattus norvegicus
agggtcagtatcaggctttcaccac

SEQ ID NO: 150326 - DNA, 25 bp, Rattus norvegicus
agggtcagtatctggctttcaccac

SEQ ID NO: 150327 - DNA, 25 bp, Rattus norvegicus
agggtcagtcccattacagagctgc

SEQ ID NO: 150328 - DNA, 25 bp, Rattus norvegicus
agggtcagtccctttacagagctgc

SEQ ID NO: 150329 - DNA, 25 bp, Rattus norvegicus
agggtcagttggatattctcttaca

SEQ ID NO: 150330 - DNA, 25 bp, Rattus norvegicus
agggtcagttggttattctcttaca

SEQ ID NO: 150331 - DNA, 25 bp, Rattus norvegicus
agggtcatacggatcccaacctgag

SEQ ID NO: 150332 - DNA, 25 bp, Rattus norvegicus
agggtcatacggttcccaacctgag

SEQ ID NO: 150333 - DNA, 25 bp, Rattus norvegicus
agggtcatagttcagctctcaagtc

SEQ ID NO: 150334 - DNA, 25 bp, Rattus norvegicus
agggtcatagttcggcatactcatc

SEQ ID NO: 150335 - DNA, 25 bp, Rattus norvegicus
agggtcatagttgagctctcaagtc

SEQ ID NO: 150336 - DNA, 25 bp, Rattus norvegicus
agggtcatagttgggcatactcatc

SEQ ID NO: 150337 - DNA, 25 bp, Rattus norvegicus
agggtcatatccctcccagatcaga

SEQ ID NO: 150338 - DNA, 25 bp, Rattus norvegicus
agggtcatatccgtcccagatcaga

SEQ ID NO: 150339 - DNA, 25 bp, Rattus norvegicus
agggtcatatctattttctactatt

SEQ ID NO: 150340 - DNA, 25 bp, Rattus norvegicus
agggtcatatcttttttctactatt

SEQ ID NO: 150341 - DNA, 25 bp, Rattus norvegicus
agggtcatcaggcaggcctcctcct

SEQ ID NO: 150342 - DNA, 25 bp, Rattus norvegicus
agggtcatcagggaggcctcctcct

SEQ ID NO: 150343 - DNA, 25 bp, Rattus norvegicus
agggtcatccccattggtgctgctt

SEQ ID NO: 150344 - DNA, 25 bp, Rattus norvegicus
agggtcatcccctttggtgctgctt

SEQ ID NO: 150345 - DNA, 25 bp, Rattus norvegicus
agggtcatcctactgagtggttcca

SEQ ID NO: 150346 - DNA, 25 bp, Rattus norvegicus
agggtcatcctagtgagtggttcca

SEQ ID NO: 150347 - DNA, 25 bp, Rattus norvegicus
agggtcatcctcaagctacataaag

SEQ ID NO: 150348 - DNA, 25 bp, Rattus norvegicus
agggtcatcctctagctacataaag

SEQ ID NO: 150349 - DNA, 25 bp, Rattus norvegicus
agggtcatctcaagaggccggtcaa

SEQ ID NO: 150350 - DNA, 25 bp, Rattus norvegicus
agggtcatctcatgaggccggtcaa

SEQ ID NO: 150351 - DNA, 25 bp, Rattus norvegicus
agggtcatctgcatctgtcagtgcg

SEQ ID NO: 150352 - DNA, 25 bp, Rattus norvegicus
agggtcatctgcttctgtcagtgcg

SEQ ID NO: 150353 - DNA, 25 bp, Rattus norvegicus
agggtcatggcaatggtcctcacag

SEQ ID NO: 150354 - DNA, 25 bp, Rattus norvegicus
agggtcatggcattggtcctcacag

SEQ ID NO: 150355 - DNA, 25 bp, Rattus norvegicus
agggtcattcggaaccattgctgta

SEQ ID NO: 150356 - DNA, 25 bp, Rattus norvegicus
agggtcattcggtaccattgctgta

SEQ ID NO: 150357 - DNA, 25 bp, Rattus norvegicus
agggtccaactgctgctttgcaaaa

SEQ ID NO: 150358 - DNA, 25 bp, Rattus norvegicus
agggtccaactggtgctttgcaaaa

SEQ ID NO: 150359 - DNA, 25 bp, Rattus norvegicus
agggtccaatggactgtcccacagg

SEQ ID NO: 150360 - DNA, 25 bp, Rattus norvegicus
agggtccaatggtctgtcccacagg

SEQ ID NO: 150361 - DNA, 25 bp, Rattus norvegicus
agggtccacaagagtccagctgtct

SEQ ID NO: 150362 - DNA, 25 bp, Rattus norvegicus
agggtccacaagtgtccagctgtct

SEQ ID NO: 150363 - DNA, 25 bp, Rattus norvegicus
agggtccaccacacttcaagaggag

SEQ ID NO: 150364 - DNA, 25 bp, Rattus norvegicus
agggtccaccactcttcaagaggag

SEQ ID NO: 150365 - DNA, 25 bp, Rattus norvegicus
agggtccacctacaattccaggcag

SEQ ID NO: 150366 - DNA, 25 bp, Rattus norvegicus
agggtccacctagaattccaggcag

SEQ ID NO: 150367 - DNA, 25 bp, Rattus norvegicus
agggtccacctcacaggaacttcat

SEQ ID NO: 150368 - DNA, 25 bp, Rattus norvegicus
agggtccacctctcaggaacttcat

SEQ ID NO: 150369 - DNA, 25 bp, Rattus norvegicus
agggtccacgttagactgccgagga

SEQ ID NO: 150370 - DNA, 25 bp, Rattus norvegicus
agggtccacgtttgactgccgagga

SEQ ID NO: 150371 - DNA, 25 bp, Rattus norvegicus
agggtccactgcaggaggcattttc

SEQ ID NO: 150372 - DNA, 25 bp, Rattus norvegicus
agggtccactgctggaggcattttc

SEQ ID NO: 150373 - DNA, 25 bp, Rattus norvegicus
agggtccagattctcactatggcac

SEQ ID NO: 150374 - DNA, 25 bp, Rattus norvegicus
agggtccagattgtcactatggcac

SEQ ID NO: 150375 - DNA, 25 bp, Rattus norvegicus
agggtccaggatctaaaggtgcttt

SEQ ID NO: 150376 - DNA, 25 bp, Rattus norvegicus
agggtccaggatgtaaaggtgcttt

SEQ ID NO: 150377 - DNA, 25 bp, Rattus norvegicus
agggtccagggaccactgtcttcac

SEQ ID NO: 150378 - DNA, 25 bp, Rattus norvegicus
agggtccagggagcactgtcttcac

SEQ ID NO: 150379 - DNA, 25 bp, Rattus norvegicus
agggtccatgtgagcctgtatcgac

SEQ ID NO: 150380 - DNA, 25 bp, Rattus norvegicus
agggtccatgtgtgcctgtatcgac

SEQ ID NO: 150381 - DNA, 25 bp, Rattus norvegicus
agggtccatgttccttcccagggag

SEQ ID NO: 150382 - DNA, 25 bp, Rattus norvegicus
agggtccatgttgcttcccagggag

SEQ ID NO: 150383 - DNA, 25 bp, Rattus norvegicus
agggtcccacgtcatggaagaaaag

SEQ ID NO: 150384 - DNA, 25 bp, Rattus norvegicus
agggtcccacgtgatggaagaaaag

SEQ ID NO: 150385 - DNA, 25 bp, Rattus norvegicus
agggtcccagtcaaaacacaggtgc

SEQ ID NO: 150386 - DNA, 25 bp, Rattus norvegicus
agggtcccagtctaaacacaggtgc

SEQ ID NO: 150387 - DNA, 25 bp, Rattus norvegicus
agggtcccctacacaaggagctgag

SEQ ID NO: 150388 - DNA, 25 bp, Rattus norvegicus
agggtcccctactcaaggagctgag

SEQ ID NO: 150389 - DNA, 25 bp, Rattus norvegicus
agggtcccctcacgagagagactca

SEQ ID NO: 150390 - DNA, 25 bp, Rattus norvegicus
agggtcccctcaggagagagactca

SEQ ID NO: 150391 - DNA, 25 bp, Rattus norvegicus
agggtcccgcgcatctagactgagg

SEQ ID NO: 150392 - DNA, 25 bp, Rattus norvegicus
agggtcccgcgcttctagactgagg

SEQ ID NO: 150393 - DNA, 25 bp, Rattus norvegicus
agggtccctgagcaactgatttctg

SEQ ID NO: 150394 - DNA, 25 bp, Rattus norvegicus
agggtccctgaggaactgatttctg

SEQ ID NO: 150395 - DNA, 25 bp, Rattus norvegicus
agggtccctgtcatatagcctatga

SEQ ID NO: 150396 - DNA, 25 bp, Rattus norvegicus
agggtccctgtcttatagcctatga

SEQ ID NO: 150397 - DNA, 25 bp, Rattus norvegicus
agggtcccttcaaaattagtgggca

SEQ ID NO: 150398 - DNA, 25 bp, Rattus norvegicus
agggtcccttcataattagtgggca

SEQ ID NO: 150399 - DNA, 25 bp, Rattus norvegicus
agggtcctcacacttatcttcacat

SEQ ID NO: 150400 - DNA, 25 bp, Rattus norvegicus
agggtcctcacagttatcttcacat

SEQ ID NO: 150401 - DNA, 25 bp, Rattus norvegicus
agggtcctccttatctatgagtgct

SEQ ID NO: 150402 - DNA, 25 bp, Rattus norvegicus
agggtcctccttttctatgagtgct

SEQ ID NO: 150403 - DNA, 25 bp, Rattus norvegicus
agggtcctctgcagggcatttgcgt

SEQ ID NO: 150404 - DNA, 25 bp, Rattus norvegicus
agggtcctctgctgggcatttgcgt

SEQ ID NO: 150405 - DNA, 25 bp, Rattus norvegicus
agggtcctcttcagtgcgccaggag

SEQ ID NO: 150406 - DNA, 25 bp, Rattus norvegicus
agggtcctcttctgtgcgccaggag

SEQ ID NO: 150407 - DNA, 25 bp, Rattus norvegicus
agggtcctgaaacccagcgctgcaa

SEQ ID NO: 150408 - DNA, 25 bp, Rattus norvegicus
agggtcctgaaagccagcgctgcaa

SEQ ID NO: 150409 - DNA, 25 bp, Rattus norvegicus
agggtcctgatcctggactctaaat

SEQ ID NO: 150410 - DNA, 25 bp, Rattus norvegicus
agggtcctgatcgtggactctaaat

SEQ ID NO: 150411 - DNA, 25 bp, Rattus norvegicus
agggtccttacaacgagcagccaag

SEQ ID NO: 150412 - DNA, 25 bp, Rattus norvegicus
agggtccttacatcgagcagccaag

SEQ ID NO: 150413 - DNA, 25 bp, Rattus norvegicus
agggtccttagtacagtctccactg

SEQ ID NO: 150414 - DNA, 25 bp, Rattus norvegicus
agggtccttagttcagtctccactg

SEQ ID NO: 150415 - DNA, 25 bp, Rattus norvegicus
agggtccttcacatgctggatgcca

SEQ ID NO: 150416 - DNA, 25 bp, Rattus norvegicus
agggtccttcacttgctggatgcca

SEQ ID NO: 150417 - DNA, 25 bp, Rattus norvegicus
agggtcctttgcacttctatatgaa

SEQ ID NO: 150418 - DNA, 25 bp, Rattus norvegicus
agggtcctttgctcttctatatgaa

SEQ ID NO: 150419 - DNA, 25 bp, Rattus norvegicus
agggtcgaacgcacatctttaagat

SEQ ID NO: 150420 - DNA, 25 bp, Rattus norvegicus
agggtcgaacgctcatctttaagat

SEQ ID NO: 150421 - DNA, 25 bp, Rattus norvegicus
agggtcgaagtccagcctttgatca

SEQ ID NO: 150422 - DNA, 25 bp, Rattus norvegicus
agggtcgaagtcgagcctttgatca

SEQ ID NO: 150423 - DNA, 25 bp, Rattus norvegicus
agggtcgacctcatagtgtacagca

SEQ ID NO: 150424 - DNA, 25 bp, Rattus norvegicus
agggtcgacctcttagtgtacagca

SEQ ID NO: 150425 - DNA, 25 bp, Rattus norvegicus
agggtcgcactgactgtgtcagctt

SEQ ID NO: 150426 - DNA, 25 bp, Rattus norvegicus
agggtcgcactgtctgtgtcagctt

SEQ ID NO: 150427 - DNA, 25 bp, Rattus norvegicus
agggtcgcatgtactgcctgagcac

SEQ ID NO: 150428 - DNA, 25 bp, Rattus norvegicus
agggtcgcatgttctgcctgagcac

SEQ ID NO: 150429 - DNA, 25 bp, Rattus norvegicus
agggtcgctcatcattctgaggtgc

SEQ ID NO: 150430 - DNA, 25 bp, Rattus norvegicus
agggtcgctcatgattctgaggtgc

SEQ ID NO: 150431 - DNA, 25 bp, Rattus norvegicus
agggtcgctggactcaggctccatt

SEQ ID NO: 150432 - DNA, 25 bp, Rattus norvegicus
agggtcgctggagtcaggctccatt

SEQ ID NO: 150433 - DNA, 25 bp, Rattus norvegicus
agggtcggacatcaggtctgctcct

SEQ ID NO: 150434 - DNA, 25 bp, Rattus norvegicus
agggtcggacatgaggtctgctcct

SEQ ID NO: 150435 - DNA, 25 bp, Rattus norvegicus
agggtcggccatatgcagttgaaac

SEQ ID NO: 150436 - DNA, 25 bp, Rattus norvegicus
agggtcggccatttgcagttgaaac

SEQ ID NO: 150437 - DNA, 25 bp, Rattus norvegicus
agggtcggcgctactgtctagaata

SEQ ID NO: 150438 - DNA, 25 bp, Rattus norvegicus
agggtcggcgcttctgtctagaata

SEQ ID NO: 150439 - DNA, 25 bp, Rattus norvegicus
agggtcgggactccagcatccatga

SEQ ID NO: 150440 - DNA, 25 bp, Rattus norvegicus
agggtcgggactgcagcatccatga

SEQ ID NO: 150441 - DNA, 25 bp, Rattus norvegicus
agggtcgtcttcaagtccagtggag

SEQ ID NO: 150442 - DNA, 25 bp, Rattus norvegicus
agggtcgtcttctagtccagtggag

SEQ ID NO: 150443 - DNA, 25 bp, Rattus norvegicus
agggtctaaacacctggcgtggctc

SEQ ID NO: 150444 - DNA, 25 bp, Rattus norvegicus
agggtctaaacagctggcgtggctc

SEQ ID NO: 150445 - DNA, 25 bp, Rattus norvegicus
agggtctacaacatccacagccgga

SEQ ID NO: 150446 - DNA, 25 bp, Rattus norvegicus
agggtctacaacttccacagccgga

SEQ ID NO: 150447 - DNA, 25 bp, Rattus norvegicus
agggtctacataatcattttctagg

SEQ ID NO: 150448 - DNA, 25 bp, Rattus norvegicus
agggtctacatattcattttctagg

SEQ ID NO: 150449 - DNA, 25 bp, Rattus norvegicus
agggtctaccctactggcctgtgtt

SEQ ID NO: 150450 - DNA, 25 bp, Rattus norvegicus
agggtctacccttctggcctgtgtt

SEQ ID NO: 150451 - DNA, 25 bp, Rattus norvegicus
agggtctactgcaacagggcctcca

SEQ ID NO: 150452 - DNA, 25 bp, Rattus norvegicus
agggtctactgctacagggcctcca

SEQ ID NO: 150453 - DNA, 25 bp, Rattus norvegicus
agggtctacttgaagctgctgtcct

SEQ ID NO: 150454 - DNA, 25 bp, Rattus norvegicus
agggtctacttgtagctgctgtcct

SEQ ID NO: 150455 - DNA, 25 bp, Rattus norvegicus
agggtctatactccctggcacacag

SEQ ID NO: 150456 - DNA, 25 bp, Rattus norvegicus
agggtctatactgcctggcacacag

SEQ ID NO: 150457 - DNA, 25 bp, Rattus norvegicus
agggtctatgttctctgtccgagca

SEQ ID NO: 150458 - DNA, 25 bp, Rattus norvegicus
agggtctatgttgtctgtccgagca

SEQ ID NO: 150459 - DNA, 25 bp, Rattus norvegicus
agggtctcaagtcatcaacctgaag

SEQ ID NO: 150460 - DNA, 25 bp, Rattus norvegicus
agggtctcaagtgatcaacctgaag

SEQ ID NO: 150461 - DNA, 25 bp, Rattus norvegicus
agggtctcactaaatcaccttgact

SEQ ID NO: 150462 - DNA, 25 bp, Rattus norvegicus
agggtctcactacgtggccccgatt

SEQ ID NO: 150463 - DNA, 25 bp, Rattus norvegicus
agggtctcactaggtggccccgatt

SEQ ID NO: 150464 - DNA, 25 bp, Rattus norvegicus
agggtctcactatatcaccttgact

SEQ ID NO: 150465 - DNA, 25 bp, Rattus norvegicus
agggtctcactcaaactcaagctaa

SEQ ID NO: 150466 - DNA, 25 bp, Rattus norvegicus
agggtctcactctaactcaagctaa

SEQ ID NO: 150467 - DNA, 25 bp, Rattus norvegicus
agggtctcactgaagggccatgctg

SEQ ID NO: 150468 - DNA, 25 bp, Rattus norvegicus
agggtctcactgagtttgaatccca

SEQ ID NO: 150469 - DNA, 25 bp, Rattus norvegicus
agggtctcactgcttcccggaattg

SEQ ID NO: 150470 - DNA, 25 bp, Rattus norvegicus
agggtctcactggttcccggaattg

SEQ ID NO: 150471 - DNA, 25 bp, Rattus norvegicus
agggtctcactgtagggccatgctg

SEQ ID NO: 150472 - DNA, 25 bp, Rattus norvegicus
agggtctcactgtgtttgaatccca

SEQ ID NO: 150473 - DNA, 25 bp, Rattus norvegicus
agggtctcatacatcctgaactgga

SEQ ID NO: 150474 - DNA, 25 bp, Rattus norvegicus
agggtctcatacttcctgaactgga

SEQ ID NO: 150475 - DNA, 25 bp, Rattus norvegicus
agggtctccaacaacatcgactgga

SEQ ID NO: 150476 - DNA, 25 bp, Rattus norvegicus
agggtctccaactacatcgactgga

SEQ ID NO: 150477 - DNA, 25 bp, Rattus norvegicus
agggtctccattcccaaatgcagag

SEQ ID NO: 150478 - DNA, 25 bp, Rattus norvegicus
agggtctccattgccaaatgcagag

SEQ ID NO: 150479 - DNA, 25 bp, Rattus norvegicus
agggtctcccatcgattgctggaac

SEQ ID NO: 150480 - DNA, 25 bp, Rattus norvegicus
agggtctcccatggattgctggaac

SEQ ID NO: 150481 - DNA, 25 bp, Rattus norvegicus
agggtctccccaacatttggctgaa

SEQ ID NO: 150482 - DNA, 25 bp, Rattus norvegicus
agggtctccccatcatttggctgaa

SEQ ID NO: 150483 - DNA, 25 bp, Rattus norvegicus
agggtctccgctacctggtgatcta

SEQ ID NO: 150484 - DNA, 25 bp, Rattus norvegicus
agggtctccgcttcctggtgatcta

SEQ ID NO: 150485 - DNA, 25 bp, Rattus norvegicus
agggtctccgtgcaatcacgtagca

SEQ ID NO: 150486 - DNA, 25 bp, Rattus norvegicus
agggtctccgtggaatcacgtagca

SEQ ID NO: 150487 - DNA, 25 bp, Rattus norvegicus
agggtctcctaaagcagtagctgct

SEQ ID NO: 150488 - DNA, 25 bp, Rattus norvegicus
agggtctcctaatgcagtagctgct

SEQ ID NO: 150489 - DNA, 25 bp, Rattus norvegicus
agggtctcctcactgatgactggtg

SEQ ID NO: 150490 - DNA, 25 bp, Rattus norvegicus
agggtctcctcagtgatgactggtg

SEQ ID NO: 150491 - DNA, 25 bp, Rattus norvegicus
agggtctcctggatgggcgttacat

SEQ ID NO: 150492 - DNA, 25 bp, Rattus norvegicus
agggtctcctggttgggcgttacat

SEQ ID NO: 150493 - DNA, 25 bp, Rattus norvegicus
agggtctcctttaatttgtccagca

SEQ ID NO: 150494 - DNA, 25 bp, Rattus norvegicus
agggtctcctttatagctcagtgaa

SEQ ID NO: 150495 - DNA, 25 bp, Rattus norvegicus
agggtctccttttatttgtccagca

SEQ ID NO: 150496 - DNA, 25 bp, Rattus norvegicus
agggtctcctttttagctcagtgaa

SEQ ID NO: 150497 - DNA, 25 bp, Rattus norvegicus
agggtctcgagaaatttagtcaaac

SEQ ID NO: 150498 - DNA, 25 bp, Rattus norvegicus
agggtctcgagatatttagtcaaac

SEQ ID NO: 150499 - DNA, 25 bp, Rattus norvegicus
agggtctcggtcagtgtcccagatc

SEQ ID NO: 150500 - DNA, 25 bp, Rattus norvegicus
agggtctcggtctgtgtcccagatc

SEQ ID NO: 150501 - DNA, 25 bp, Rattus norvegicus
agggtctcgtttcctgcagcacatt

SEQ ID NO: 150502 - DNA, 25 bp, Rattus norvegicus
agggtctcgtttgctgcagcacatt

SEQ ID NO: 150503 - DNA, 25 bp, Rattus norvegicus
agggtctgagctacagaagccagag

SEQ ID NO: 150504 - DNA, 25 bp, Rattus norvegicus
agggtctgagcttcagaagccagag

SEQ ID NO: 150505 - DNA, 25 bp, Rattus norvegicus
agggtctgcaccaatcctgttgcta

SEQ ID NO: 150506 - DNA, 25 bp, Rattus norvegicus
agggtctgcacctatcctgttgcta

SEQ ID NO: 150507 - DNA, 25 bp, Rattus norvegicus
agggtctgcactctgtggcgctaaa

SEQ ID NO: 150508 - DNA, 25 bp, Rattus norvegicus
agggtctgcactgtgtggcgctaaa

SEQ ID NO: 150509 - DNA, 25 bp, Rattus norvegicus
agggtctgccacatgcagcgagcat

SEQ ID NO: 150510 - DNA, 25 bp, Rattus norvegicus
agggtctgccacttgcagcgagcat

SEQ ID NO: 150511 - DNA, 25 bp, Rattus norvegicus
agggtctgccagaccccttgggcgt

SEQ ID NO: 150512 - DNA, 25 bp, Rattus norvegicus
agggtctgccagtccccttgggcgt

SEQ ID NO: 150513 - DNA, 25 bp, Rattus norvegicus
agggtctgccggacagcaatttaga

SEQ ID NO: 150514 - DNA, 25 bp, Rattus norvegicus
agggtctgccggtcagcaatttaga

SEQ ID NO: 150515 - DNA, 25 bp, Rattus norvegicus
agggtctgcgccaacaggtccatgg

SEQ ID NO: 150516 - DNA, 25 bp, Rattus norvegicus
agggtctgcgcctacaggtccatgg

SEQ ID NO: 150517 - DNA, 25 bp, Rattus norvegicus
agggtctgctccacgtgggagacca

SEQ ID NO: 150518 - DNA, 25 bp, Rattus norvegicus
agggtctgctcctcgtgggagacca

SEQ ID NO: 150519 - DNA, 25 bp, Rattus norvegicus
agggtctggcctcgatggtcattcc

SEQ ID NO: 150520 - DNA, 25 bp, Rattus norvegicus
agggtctggcctggatggtcattcc

SEQ ID NO: 150521 - DNA, 25 bp, Rattus norvegicus
agggtctgggtgacactgccgctca

SEQ ID NO: 150522 - DNA, 25 bp, Rattus norvegicus
agggtctgggtgtcactgccgctca

SEQ ID NO: 150523 - DNA, 25 bp, Rattus norvegicus
agggtctgtgtcaaaggagcccaca

SEQ ID NO: 150524 - DNA, 25 bp, Rattus norvegicus
agggtctgtgtctaaggagcccaca

SEQ ID NO: 150525 - DNA, 25 bp, Rattus norvegicus
agggtctgttctattcattgctgta

SEQ ID NO: 150526 - DNA, 25 bp, Rattus norvegicus
agggtctgttcttttcattgctgta

SEQ ID NO: 150527 - DNA, 25 bp, Rattus norvegicus
agggtcttaactctgaagccctggc

SEQ ID NO: 150528 - DNA, 25 bp, Rattus norvegicus
agggtcttaactgtgaagccctggc

SEQ ID NO: 150529 - DNA, 25 bp, Rattus norvegicus
agggtcttagcaataggaacgttga

SEQ ID NO: 150530 - DNA, 25 bp, Rattus norvegicus
agggtcttagcattaggaacgttga

SEQ ID NO: 150531 - DNA, 25 bp, Rattus norvegicus
agggtcttatgtagtagtccagtac

SEQ ID NO: 150532 - DNA, 25 bp, Rattus norvegicus
agggtcttatgttgtagtccagtac

SEQ ID NO: 150533 - DNA, 25 bp, Rattus norvegicus
agggtcttcaaacacgtgcttcagc

SEQ ID NO: 150534 - DNA, 25 bp, Rattus norvegicus
agggtcttcaaagacgtgcttcagc

SEQ ID NO: 150535 - DNA, 25 bp, Rattus norvegicus
agggtcttcaccctgcaggttcagg

SEQ ID NO: 150536 - DNA, 25 bp, Rattus norvegicus
agggtcttcaccgtgcaggttcagg

SEQ ID NO: 150537 - DNA, 25 bp, Rattus norvegicus
agggtcttcccacacattgcacctg

SEQ ID NO: 150538 - DNA, 25 bp, Rattus norvegicus
agggtcttcccagacattgcacctg

SEQ ID NO: 150539 - DNA, 25 bp, Rattus norvegicus
agggtcttcttcaattcatccatgg

SEQ ID NO: 150540 - DNA, 25 bp, Rattus norvegicus
agggtcttcttctattcatccatgg

SEQ ID NO: 150541 - DNA, 25 bp, Rattus norvegicus
agggtcttcttgcacatactcagca

SEQ ID NO: 150542 - DNA, 25 bp, Rattus norvegicus
agggtcttcttggacatactcagca

SEQ ID NO: 150543 - DNA, 25 bp, Rattus norvegicus
agggtcttgactaacggccacagct

SEQ ID NO: 150544 - DNA, 25 bp, Rattus norvegicus
agggtcttgacttacggccacagct

SEQ ID NO: 150545 - DNA, 25 bp, Rattus norvegicus
agggtcttgcatcccttagcagaga

SEQ ID NO: 150546 - DNA, 25 bp, Rattus norvegicus
agggtcttgcatgccttagcagaga

SEQ ID NO: 150547 - DNA, 25 bp, Rattus norvegicus
agggtcttgctactcacgggttcag

SEQ ID NO: 150548 - DNA, 25 bp, Rattus norvegicus
agggtcttgctagtcacgggttcag

SEQ ID NO: 150549 - DNA, 25 bp, Rattus norvegicus
agggtcttgctgaattgcctaggca

SEQ ID NO: 150550 - DNA, 25 bp, Rattus norvegicus
agggtcttgctgtattgcctaggca

SEQ ID NO: 150551 - DNA, 25 bp, Rattus norvegicus
agggtctttaacagttcctctcata

SEQ ID NO: 150552 - DNA, 25 bp, Rattus norvegicus
agggtctttaactgttcctctcata

SEQ ID NO: 150553 - DNA, 25 bp, Rattus norvegicus
agggtctttcccatggtgactctga

SEQ ID NO: 150554 - DNA, 25 bp, Rattus norvegicus
agggtctttcccttggtgactctga

SEQ ID NO: 150555 - DNA, 25 bp, Rattus norvegicus
agggtctttcctcagagccgaagtc

SEQ ID NO: 150556 - DNA, 25 bp, Rattus norvegicus
agggtctttcctgagagccgaagtc

SEQ ID NO: 150557 - DNA, 25 bp, Rattus norvegicus
agggtctttctcagccacaggatgg

SEQ ID NO: 150558 - DNA, 25 bp, Rattus norvegicus
agggtctttctctgccacaggatgg

SEQ ID NO: 150559 - DNA, 25 bp, Rattus norvegicus
agggtctttcttctgcaattatatt

SEQ ID NO: 150560 - DNA, 25 bp, Rattus norvegicus
agggtctttcttgtgcaattatatt

SEQ ID NO: 150561 - DNA, 25 bp, Rattus norvegicus
agggtgaaaaggatcgctcagctgt

SEQ ID NO: 150562 - DNA, 25 bp, Rattus norvegicus
agggtgaaaaggttcgctcagctgt

SEQ ID NO: 150563 - DNA, 25 bp, Rattus norvegicus
agggtgaagttcaccaagctcgctg

SEQ ID NO: 150564 - DNA, 25 bp, Rattus norvegicus
agggtgaagttctccaagctcgctg

SEQ ID NO: 150565 - DNA, 25 bp, Rattus norvegicus
agggtgacacacaggatgtctcctt

SEQ ID NO: 150566 - DNA, 25 bp, Rattus norvegicus
agggtgacacacctgggtccttagc

SEQ ID NO: 150567 - DNA, 25 bp, Rattus norvegicus
agggtgacacacgtgggtccttagc

SEQ ID NO: 150568 - DNA, 25 bp, Rattus norvegicus
agggtgacacactggatgtctcctt

SEQ ID NO: 150569 - DNA, 25 bp, Rattus norvegicus
agggtgacactaatgcttttggatc

SEQ ID NO: 150570 - DNA, 25 bp, Rattus norvegicus
agggtgacactattgcttttggatc

SEQ ID NO: 150571 - DNA, 25 bp, Rattus norvegicus
agggtgacatgcaaccttggactgt

SEQ ID NO: 150572 - DNA, 25 bp, Rattus norvegicus
agggtgacatgctaccttggactgt

SEQ ID NO: 150573 - DNA, 25 bp, Rattus norvegicus
agggtgaccagacctgtgccaacaa

SEQ ID NO: 150574 - DNA, 25 bp, Rattus norvegicus
agggtgaccagagctgtgccaacaa

SEQ ID NO: 150575 - DNA, 25 bp, Rattus norvegicus
agggtgaccagcagacccaggaaca

SEQ ID NO: 150576 - DNA, 25 bp, Rattus norvegicus
agggtgaccagctgacccaggaaca

SEQ ID NO: 150577 - DNA, 25 bp, Rattus norvegicus
agggtgaccatgaccacaggcctgg

SEQ ID NO: 150578 - DNA, 25 bp, Rattus norvegicus
agggtgaccatgtccacaggcctgg

SEQ ID NO: 150579 - DNA, 25 bp, Rattus norvegicus
agggtgaccattagtcttctgcctg

SEQ ID NO: 150580 - DNA, 25 bp, Rattus norvegicus
agggtgaccatttgtcttctgcctg

SEQ ID NO: 150581 - DNA, 25 bp, Rattus norvegicus
agggtgacctgaatccgccacctct

SEQ ID NO: 150582 - DNA, 25 bp, Rattus norvegicus
agggtgacctgattccgccacctct

SEQ ID NO: 150583 - DNA, 25 bp, Rattus norvegicus
agggtgacctgtactagctgtgatc

SEQ ID NO: 150584 - DNA, 25 bp, Rattus norvegicus
agggtgacctgttctagctgtgatc

SEQ ID NO: 150585 - DNA, 25 bp, Rattus norvegicus
agggtgagacacactgctggtgaaa

SEQ ID NO: 150586 - DNA, 25 bp, Rattus norvegicus
agggtgagacactctgctggtgaaa

SEQ ID NO: 150587 - DNA, 25 bp, Rattus norvegicus
agggtgagcaagacttccgcttggc

SEQ ID NO: 150588 - DNA, 25 bp, Rattus norvegicus
agggtgagcaagtcttccgcttggc

SEQ ID NO: 150589 - DNA, 25 bp, Rattus norvegicus
agggtgagcagccatggcatcactt

SEQ ID NO: 150590 - DNA, 25 bp, Rattus norvegicus
agggtgagcagcgatggcatcactt

SEQ ID NO: 150591 - DNA, 25 bp, Rattus norvegicus
agggtgagccaaactgctctcgcct

SEQ ID NO: 150592 - DNA, 25 bp, Rattus norvegicus
agggtgagccaatctgctctcgcct

SEQ ID NO: 150593 - DNA, 25 bp, Rattus norvegicus
agggtgagcgacacctgtactgtag

SEQ ID NO: 150594 - DNA, 25 bp, Rattus norvegicus
agggtgagcgactcctgtactgtag

SEQ ID NO: 150595 - DNA, 25 bp, Rattus norvegicus
agggtgagcttgagttaatctttga

SEQ ID NO: 150596 - DNA, 25 bp, Rattus norvegicus
agggtgagcttgtgttaatctttga

SEQ ID NO: 150597 - DNA, 25 bp, Rattus norvegicus
agggtgaggcctacatccgtgctgc

SEQ ID NO: 150598 - DNA, 25 bp, Rattus norvegicus
agggtgaggccttcatccgtgctgc

SEQ ID NO: 150599 - DNA, 25 bp, Rattus norvegicus
agggtgagtcccatactgaatttgg

SEQ ID NO: 150600 - DNA, 25 bp, Rattus norvegicus
agggtgagtcccttactgaatttgg

SEQ ID NO: 150601 - DNA, 25 bp, Rattus norvegicus
agggtgagtctgatcatccagttca

SEQ ID NO: 150602 - DNA, 25 bp, Rattus norvegicus
agggtgagtctgttcatccagttca

SEQ ID NO: 150603 - DNA, 25 bp, Rattus norvegicus
agggtgataccaatgcagccttgcc

SEQ ID NO: 150604 - DNA, 25 bp, Rattus norvegicus
agggtgataccattgcagccttgcc

SEQ ID NO: 150605 - DNA, 25 bp, Rattus norvegicus
agggtgatacctagggattctcaaa

SEQ ID NO: 150606 - DNA, 25 bp, Rattus norvegicus
agggtgataccttgggattctcaaa

SEQ ID NO: 150607 - DNA, 25 bp, Rattus norvegicus
agggtgatagttccctgcccaggct

SEQ ID NO: 150608 - DNA, 25 bp, Rattus norvegicus
agggtgatagttgcctgcccaggct

SEQ ID NO: 150609 - DNA, 25 bp, Rattus norvegicus
agggtgatatcaagtcttccgactg

SEQ ID NO: 150610 - DNA, 25 bp, Rattus norvegicus
agggtgatatcatgtcttccgactg

SEQ ID NO: 150611 - DNA, 25 bp, Rattus norvegicus
agggtgatcctgatactacagttgt

SEQ ID NO: 150612 - DNA, 25 bp, Rattus norvegicus
agggtgatcctgttactacagttgt

SEQ ID NO: 150613 - DNA, 25 bp, Rattus norvegicus
agggtgatcggtcactctgtattaa

SEQ ID NO: 150614 - DNA, 25 bp, Rattus norvegicus
agggtgatcggtgactctgtattaa

SEQ ID NO: 150615 - DNA, 25 bp, Rattus norvegicus
agggtgatctgtccgctgtgctctt

SEQ ID NO: 150616 - DNA, 25 bp, Rattus norvegicus
agggtgatctgtgcgctgtgctctt

SEQ ID NO: 150617 - DNA, 25 bp, Rattus norvegicus
agggtgatgaatcctctctctgagc

SEQ ID NO: 150618 - DNA, 25 bp, Rattus norvegicus
agggtgatgaatgctctctctgagc

SEQ ID NO: 150619 - DNA, 25 bp, Rattus norvegicus
agggtgatgaggatgcctctcgcat

SEQ ID NO: 150620 - DNA, 25 bp, Rattus norvegicus
agggtgatgaggttgcctctcgcat

SEQ ID NO: 150621 - DNA, 25 bp, Rattus norvegicus
agggtgatggtaaatgcattcctaa

SEQ ID NO: 150622 - DNA, 25 bp, Rattus norvegicus
agggtgatggtatatgcattcctaa

SEQ ID NO: 150623 - DNA, 25 bp, Rattus norvegicus
agggtgatgtgtagtcccctcttcc

SEQ ID NO: 150624 - DNA, 25 bp, Rattus norvegicus
agggtgatgtgttgtcccctcttcc

SEQ ID NO: 150625 - DNA, 25 bp, Rattus norvegicus
agggtgattcaacgccagcttccat

SEQ ID NO: 150626 - DNA, 25 bp, Rattus norvegicus
agggtgattcaacggattcctctta

SEQ ID NO: 150627 - DNA, 25 bp, Rattus norvegicus
agggtgattcaaggccagcttccat

SEQ ID NO: 150628 - DNA, 25 bp, Rattus norvegicus
agggtgattcaagggattcctctta

SEQ ID NO: 150629 - DNA, 25 bp, Rattus norvegicus
agggtgattcagcttggcctcctgt

SEQ ID NO: 150630 - DNA, 25 bp, Rattus norvegicus
agggtgattcaggttggcctcctgt

SEQ ID NO: 150631 - DNA, 25 bp, Rattus norvegicus
agggtgattgtccagcttgaccaca

SEQ ID NO: 150632 - DNA, 25 bp, Rattus norvegicus
agggtgattgtcgagcttgaccaca

SEQ ID NO: 150633 - DNA, 25 bp, Rattus norvegicus
agggtgcaaaccagaacgtccggct

SEQ ID NO: 150634 - DNA, 25 bp, Rattus norvegicus
agggtgcaaacctgaacgtccggct

SEQ ID NO: 150635 - DNA, 25 bp, Rattus norvegicus
agggtgcacaccagtctgacttgac

SEQ ID NO: 150636 - DNA, 25 bp, Rattus norvegicus
agggtgcacacctgtctgacttgac

SEQ ID NO: 150637 - DNA, 25 bp, Rattus norvegicus
agggtgcacatcctgtgctttccat

SEQ ID NO: 150638 - DNA, 25 bp, Rattus norvegicus
agggtgcacatcgtgtgctttccat

SEQ ID NO: 150639 - DNA, 25 bp, Rattus norvegicus
agggtgcactttcagatacccgccc

SEQ ID NO: 150640 - DNA, 25 bp, Rattus norvegicus
agggtgcactttgagatacccgccc

SEQ ID NO: 150641 - DNA, 25 bp, Rattus norvegicus
agggtgcagtagaccaactgccttg

SEQ ID NO: 150642 - DNA, 25 bp, Rattus norvegicus
agggtgcagtagtccaactgccttg

SEQ ID NO: 150643 - DNA, 25 bp, Rattus norvegicus
agggtgcatcagagactccttgcta

SEQ ID NO: 150644 - DNA, 25 bp, Rattus norvegicus
agggtgcatcagtgactccttgcta

SEQ ID NO: 150645 - DNA, 25 bp, Rattus norvegicus
agggtgcatgctcgtgcttcacgaa

SEQ ID NO: 150646 - DNA, 25 bp, Rattus norvegicus
agggtgcatgctggtgcttcacgaa

SEQ ID NO: 150647 - DNA, 25 bp, Rattus norvegicus
agggtgcattctctttctccttcct

SEQ ID NO: 150648 - DNA, 25 bp, Rattus norvegicus
agggtgcattctgtttctccttcct

SEQ ID NO: 150649 - DNA, 25 bp, Rattus norvegicus
agggtgccatcaatctgtgccagct

SEQ ID NO: 150650 - DNA, 25 bp, Rattus norvegicus
agggtgccatcattctgtgccagct

SEQ ID NO: 150651 - DNA, 25 bp, Rattus norvegicus
agggtgcctatcagtaactgtgtac

SEQ ID NO: 150652 - DNA, 25 bp, Rattus norvegicus
agggtgcctatctgtaactgtgtac

SEQ ID NO: 150653 - DNA, 25 bp, Rattus norvegicus
agggtgccttatactttgttctagc

SEQ ID NO: 150654 - DNA, 25 bp, Rattus norvegicus
agggtgccttattctttgttctagc

SEQ ID NO: 150655 - DNA, 25 bp, Rattus norvegicus
agggtgctatggcaacaggcccact

SEQ ID NO: 150656 - DNA, 25 bp, Rattus norvegicus
agggtgctatgggaacaggcccact

SEQ ID NO: 150657 - DNA, 25 bp, Rattus norvegicus
agggtgctcagtaaggtcctgcccc

SEQ ID NO: 150658 - DNA, 25 bp, Rattus norvegicus
agggtgctcagttaggtcctgcccc

SEQ ID NO: 150659 - DNA, 25 bp, Rattus norvegicus
agggtgctccacagagtccagtgta

SEQ ID NO: 150660 - DNA, 25 bp, Rattus norvegicus
agggtgctccactgagtccagtgta

SEQ ID NO: 150661 - DNA, 25 bp, Rattus norvegicus
agggtgctctttccacaggacagca

SEQ ID NO: 150662 - DNA, 25 bp, Rattus norvegicus
agggtgctctttgcacaggacagca

SEQ ID NO: 150663 - DNA, 25 bp, Rattus norvegicus
agggtgctgaagatccggctgactc

SEQ ID NO: 150664 - DNA, 25 bp, Rattus norvegicus
agggtgctgaagttccggctgactc

SEQ ID NO: 150665 - DNA, 25 bp, Rattus norvegicus
agggtgctgaatagcatggcctgtc

SEQ ID NO: 150666 - DNA, 25 bp, Rattus norvegicus
agggtgctgaattgcatggcctgtc

SEQ ID NO: 150667 - DNA, 25 bp, Rattus norvegicus
agggtgctgcccacttgcagagctt

SEQ ID NO: 150668 - DNA, 25 bp, Rattus norvegicus
agggtgctgccctcttgcagagctt

SEQ ID NO: 150669 - DNA, 25 bp, Rattus norvegicus
agggtgcttcttaactttgcttgag

SEQ ID NO: 150670 - DNA, 25 bp, Rattus norvegicus
agggtgcttctttactttgcttgag

SEQ ID NO: 150671 - DNA, 25 bp, Rattus norvegicus
agggtgcttgttaccagacctgaca

SEQ ID NO: 150672 - DNA, 25 bp, Rattus norvegicus
agggtgcttgtttccagacctgaca

SEQ ID NO: 150673 - DNA, 25 bp, Rattus norvegicus
agggtggaaatcactactggctcca

SEQ ID NO: 150674 - DNA, 25 bp, Rattus norvegicus
agggtggaaatctctactggctcca

SEQ ID NO: 150675 - DNA, 25 bp, Rattus norvegicus
agggtggacacaatctccacttatt

SEQ ID NO: 150676 - DNA, 25 bp, Rattus norvegicus
agggtggacacattctccacttatt

SEQ ID NO: 150677 - DNA, 25 bp, Rattus norvegicus
agggtggacctgagaaattctcaag

SEQ ID NO: 150678 - DNA, 25 bp, Rattus norvegicus
agggtggacctgtgaaattctcaag

SEQ ID NO: 150679 - DNA, 25 bp, Rattus norvegicus
agggtggacttgaacctgcgatcct

SEQ ID NO: 150680 - DNA, 25 bp, Rattus norvegicus
agggtggacttgtacctgcgatcct

SEQ ID NO: 150681 - DNA, 25 bp, Rattus norvegicus
agggtggagactccagaccgcccca

SEQ ID NO: 150682 - DNA, 25 bp, Rattus norvegicus
agggtggagactgcagaccgcccca

SEQ ID NO: 150683 - DNA, 25 bp, Rattus norvegicus
agggtggagcttcgactctcccgcc

SEQ ID NO: 150684 - DNA, 25 bp, Rattus norvegicus
agggtggagcttggactctcccgcc

SEQ ID NO: 150685 - DNA, 25 bp, Rattus norvegicus
agggtggagtctacacattccagca

SEQ ID NO: 150686 - DNA, 25 bp, Rattus norvegicus
agggtggagtcttcacattccagca

SEQ ID NO: 150687 - DNA, 25 bp, Rattus norvegicus
agggtggatttaagttctaggaacg

SEQ ID NO: 150688 - DNA, 25 bp, Rattus norvegicus
agggtggatttatgttctaggaacg

SEQ ID NO: 150689 - DNA, 25 bp, Rattus norvegicus
agggtggcaaatctccggaactaga

SEQ ID NO: 150690 - DNA, 25 bp, Rattus norvegicus
agggtggcaaatgtccggaactaga

SEQ ID NO: 150691 - DNA, 25 bp, Rattus norvegicus
agggtggcaactatgttctggtcaa

SEQ ID NO: 150692 - DNA, 25 bp, Rattus norvegicus
agggtggcaactttgttctggtcaa

SEQ ID NO: 150693 - DNA, 25 bp, Rattus norvegicus
agggtggcaggcacaacgtgacctt

SEQ ID NO: 150694 - DNA, 25 bp, Rattus norvegicus
agggtggcaggctcaacgtgacctt

SEQ ID NO: 150695 - DNA, 25 bp, Rattus norvegicus
agggtggccattcctgctcaatgag

SEQ ID NO: 150696 - DNA, 25 bp, Rattus norvegicus
agggtggccattgctgctcaatgag

SEQ ID NO: 150697 - DNA, 25 bp, Rattus norvegicus
agggtggccgcactcagtaactaat

SEQ ID NO: 150698 - DNA, 25 bp, Rattus norvegicus
agggtggccgcagtcagtaactaat

SEQ ID NO: 150699 - DNA, 25 bp, Rattus norvegicus
agggtggccttgaccagttctcctt

SEQ ID NO: 150700 - DNA, 25 bp, Rattus norvegicus
agggtggccttgtccagttctcctt

SEQ ID NO: 150701 - DNA, 25 bp, Rattus norvegicus
agggtggctactccagagacatcct

SEQ ID NO: 150702 - DNA, 25 bp, Rattus norvegicus
agggtggctactgcagagacatcct

SEQ ID NO: 150703 - DNA, 25 bp, Rattus norvegicus
agggtggctcaccttctgtttcggt

SEQ ID NO: 150704 - DNA, 25 bp, Rattus norvegicus
agggtggctcacgttctgtttcggt

SEQ ID NO: 150705 - DNA, 25 bp, Rattus norvegicus
agggtggcttgcagactaacgcaca

SEQ ID NO: 150706 - DNA, 25 bp, Rattus norvegicus
agggtggcttgctgactaacgcaca

SEQ ID NO: 150707 - DNA, 25 bp, Rattus norvegicus
agggtgggcatcctcagtgcttcaa

SEQ ID NO: 150708 - DNA, 25 bp, Rattus norvegicus
agggtgggcatcgtcagtgcttcaa

SEQ ID NO: 150709 - DNA, 25 bp, Rattus norvegicus
agggtgggcctgagaaactgtttct

SEQ ID NO: 150710 - DNA, 25 bp, Rattus norvegicus
agggtgggcctgtgaaactgtttct

SEQ ID NO: 150711 - DNA, 25 bp, Rattus norvegicus
agggtggtcaacacagtgaggtcct

SEQ ID NO: 150712 - DNA, 25 bp, Rattus norvegicus
agggtggtcaactcagtgaggtcct

SEQ ID NO: 150713 - DNA, 25 bp, Rattus norvegicus
agggtggtctggaactgcatttata

SEQ ID NO: 150714 - DNA, 25 bp, Rattus norvegicus
agggtggtctggtactgcatttata

SEQ ID NO: 150715 - DNA, 25 bp, Rattus norvegicus
agggtggtgatgctaaccccttcca

SEQ ID NO: 150716 - DNA, 25 bp, Rattus norvegicus
agggtggtgatggtaaccccttcca

SEQ ID NO: 150717 - DNA, 25 bp, Rattus norvegicus
agggtggttccgattcatgctgttc

SEQ ID NO: 150718 - DNA, 25 bp, Rattus norvegicus
agggtggttccgtttcatgctgttc

SEQ ID NO: 150719 - DNA, 25 bp, Rattus norvegicus
agggtggttcctctctcggcgccca

SEQ ID NO: 150720 - DNA, 25 bp, Rattus norvegicus
agggtggttcctgtctcggcgccca

SEQ ID NO: 150721 - DNA, 25 bp, Rattus norvegicus
agggtgtaaatcacccagcctggca

SEQ ID NO: 150722 - DNA, 25 bp, Rattus norvegicus
agggtgtaaatctcccagcctggca

SEQ ID NO: 150723 - DNA, 25 bp, Rattus norvegicus
agggtgtaccttaggtcagtaacag

SEQ ID NO: 150724 - DNA, 25 bp, Rattus norvegicus
agggtgtacctttggtcagtaacag

SEQ ID NO: 150725 - DNA, 25 bp, Rattus norvegicus
agggtgtcaccaacagtctgaatac

SEQ ID NO: 150726 - DNA, 25 bp, Rattus norvegicus
agggtgtcaccatcagtctgaatac

SEQ ID NO: 150727 - DNA, 25 bp, Rattus norvegicus
agggtgtcagacatatatctttaaa

SEQ ID NO: 150728 - DNA, 25 bp, Rattus norvegicus
agggtgtcagacttatatctttaaa

SEQ ID NO: 150729 - DNA, 25 bp, Rattus norvegicus
agggtgtccatcctgccccaggaaa

SEQ ID NO: 150730 - DNA, 25 bp, Rattus norvegicus
agggtgtccatcgtgccccaggaaa

SEQ ID NO: 150731 - DNA, 25 bp, Rattus norvegicus
agggtgtccctaagccacgatgggt

SEQ ID NO: 150732 - DNA, 25 bp, Rattus norvegicus
agggtgtccctatgccacgatgggt

SEQ ID NO: 150733 - DNA, 25 bp, Rattus norvegicus
agggtgtcctgaacattttcgatga

SEQ ID NO: 150734 - DNA, 25 bp, Rattus norvegicus
agggtgtcctgatcattttcgatga

SEQ ID NO: 150735 - DNA, 25 bp, Rattus norvegicus
agggtgtcgtctcgaagcatctaca

SEQ ID NO: 150736 - DNA, 25 bp, Rattus norvegicus
agggtgtcgtctggaagcatctaca

SEQ ID NO: 150737 - DNA, 25 bp, Rattus norvegicus
agggtgtctgtcatgtggttagtca

SEQ ID NO: 150738 - DNA, 25 bp, Rattus norvegicus
agggtgtctgtcttgtggttagtca

SEQ ID NO: 150739 - DNA, 25 bp, Rattus norvegicus
agggtgtgacacagaccagcgcgca

SEQ ID NO: 150740 - DNA, 25 bp, Rattus norvegicus
agggtgtgacactgaccagcgcgca

SEQ ID NO: 150741 - DNA, 25 bp, Rattus norvegicus
agggtgtgacctagtacagagcccc

SEQ ID NO: 150742 - DNA, 25 bp, Rattus norvegicus
agggtgtgaccttgtacagagcccc

SEQ ID NO: 150743 - DNA, 25 bp, Rattus norvegicus
agggtgtgaggcatcatgttagtaa

SEQ ID NO: 150744 - DNA, 25 bp, Rattus norvegicus
agggtgtgaggcttcatgttagtaa

SEQ ID NO: 150745 - DNA, 25 bp, Rattus norvegicus
agggtgtgcaacctttgctttacca

SEQ ID NO: 150746 - DNA, 25 bp, Rattus norvegicus
agggtgtgcaacgtttgctttacca

SEQ ID NO: 150747 - DNA, 25 bp, Rattus norvegicus
agggtgtgcaggatccctctgtgcc

SEQ ID NO: 150748 - DNA, 25 bp, Rattus norvegicus
agggtgtgcaggttccctctgtgcc

SEQ ID NO: 150749 - DNA, 25 bp, Rattus norvegicus
agggtgtgctgtccactgaagtcca

SEQ ID NO: 150750 - DNA, 25 bp, Rattus norvegicus
agggtgtgctgtgcactgaagtcca

SEQ ID NO: 150751 - DNA, 25 bp, Rattus norvegicus
agggtgtggcacaggcttagaatct

SEQ ID NO: 150752 - DNA, 25 bp, Rattus norvegicus
agggtgtggcactggcttagaatct

SEQ ID NO: 150753 - DNA, 25 bp, Rattus norvegicus
agggtgtggcccagacagttcttgc

SEQ ID NO: 150754 - DNA, 25 bp, Rattus norvegicus
agggtgtggcccagttgcttctctg

SEQ ID NO: 150755 - DNA, 25 bp, Rattus norvegicus
agggtgtggcccataaatctgtcac

SEQ ID NO: 150756 - DNA, 25 bp, Rattus norvegicus
agggtgtggccctgacagttcttgc

SEQ ID NO: 150757 - DNA, 25 bp, Rattus norvegicus
agggtgtggccctgttgcttctctg

SEQ ID NO: 150758 - DNA, 25 bp, Rattus norvegicus
agggtgtggcccttaaatctgtcac

SEQ ID NO: 150759 - DNA, 25 bp, Rattus norvegicus
agggtgtggctgacaaagttcttta

SEQ ID NO: 150760 - DNA, 25 bp, Rattus norvegicus
agggtgtggctgtcaaagttcttta

SEQ ID NO: 150761 - DNA, 25 bp, Rattus norvegicus
agggtgtggtctagcctttatagga

SEQ ID NO: 150762 - DNA, 25 bp, Rattus norvegicus
agggtgtggtcttgcctttatagga

SEQ ID NO: 150763 - DNA, 25 bp, Rattus norvegicus
agggtgtgtaacatcagctctgcag

SEQ ID NO: 150764 - DNA, 25 bp, Rattus norvegicus
agggtgtgtaacttcagctctgcag

SEQ ID NO: 150765 - DNA, 25 bp, Rattus norvegicus
agggtgttacacacatgtcctcact

SEQ ID NO: 150766 - DNA, 25 bp, Rattus norvegicus
agggtgttacactcatgtcctcact

SEQ ID NO: 150767 - DNA, 25 bp, Rattus norvegicus
agggtgttacccaaactctctgatc

SEQ ID NO: 150768 - DNA, 25 bp, Rattus norvegicus
agggtgttaccctaactctctgatc

SEQ ID NO: 150769 - DNA, 25 bp, Rattus norvegicus
agggtgttagatcccacagtcttga

SEQ ID NO: 150770 - DNA, 25 bp, Rattus norvegicus
agggtgttagatgccacagtcttga

SEQ ID NO: 150771 - DNA, 25 bp, Rattus norvegicus
agggtgttccctcatcatacgatgc

SEQ ID NO: 150772 - DNA, 25 bp, Rattus norvegicus
agggtgttccctgatcatacgatgc

SEQ ID NO: 150773 - DNA, 25 bp, Rattus norvegicus
agggtgttctccactgacaagttac

SEQ ID NO: 150774 - DNA, 25 bp, Rattus norvegicus
agggtgttctcctctgacaagttac

SEQ ID NO: 150775 - DNA, 25 bp, Rattus norvegicus
agggttaaactcacagccttactag

SEQ ID NO: 150776 - DNA, 25 bp, Rattus norvegicus
agggttaaactctcagccttactag

SEQ ID NO: 150777 - DNA, 25 bp, Rattus norvegicus
agggttaacttcagatcctcctgtc

SEQ ID NO: 150778 - DNA, 25 bp, Rattus norvegicus
agggttaacttctgatcctcctgtc

SEQ ID NO: 150779 - DNA, 25 bp, Rattus norvegicus
agggttaagtcacaggatcctgcaa

SEQ ID NO: 150780 - DNA, 25 bp, Rattus norvegicus
agggttaagtcagaggatcctgcaa

SEQ ID NO: 150781 - DNA, 25 bp, Rattus norvegicus
agggttacaggcaacctcagtggct

SEQ ID NO: 150782 - DNA, 25 bp, Rattus norvegicus
agggttacaggctacctcagtggct

SEQ ID NO: 150783 - DNA, 25 bp, Rattus norvegicus
agggttacatagcaggacctcacct

SEQ ID NO: 150784 - DNA, 25 bp, Rattus norvegicus
agggttacataggaggacctcacct

SEQ ID NO: 150785 - DNA, 25 bp, Rattus norvegicus
agggttacctcactcaactctgatc

SEQ ID NO: 150786 - DNA, 25 bp, Rattus norvegicus
agggttacctcagtcaactctgatc

SEQ ID NO: 150787 - DNA, 25 bp, Rattus norvegicus
agggttactcctaggttatccagat

SEQ ID NO: 150788 - DNA, 25 bp, Rattus norvegicus
agggttactccttggttatccagat

SEQ ID NO: 150789 - DNA, 25 bp, Rattus norvegicus
agggttactctcagactaccatagg

SEQ ID NO: 150790 - DNA, 25 bp, Rattus norvegicus
agggttactctctgactaccatagg

SEQ ID NO: 150791 - DNA, 25 bp, Rattus norvegicus
agggttagtgtcagtactccaccac

SEQ ID NO: 150792 - DNA, 25 bp, Rattus norvegicus
agggttagtgtctgtactccaccac

SEQ ID NO: 150793 - DNA, 25 bp, Rattus norvegicus
agggttatacaaagagactcggtct

SEQ ID NO: 150794 - DNA, 25 bp, Rattus norvegicus
agggttatacaatgagactcggtct

SEQ ID NO: 150795 - DNA, 25 bp, Rattus norvegicus
agggttatagacagaagctcttgca

SEQ ID NO: 150796 - DNA, 25 bp, Rattus norvegicus
agggttatagactgaagctcttgca

SEQ ID NO: 150797 - DNA, 25 bp, Rattus norvegicus
agggttatatctatgagcctatcaa

SEQ ID NO: 150798 - DNA, 25 bp, Rattus norvegicus
agggttatatctttgagcctatcaa

SEQ ID NO: 150799 - DNA, 25 bp, Rattus norvegicus
agggttatcctccagatcagcagaa

SEQ ID NO: 150800 - DNA, 25 bp, Rattus norvegicus
agggttatcctcgagatcagcagaa

SEQ ID NO: 150801 - DNA, 25 bp, Rattus norvegicus
agggttatctctagcatctgggaaa

SEQ ID NO: 150802 - DNA, 25 bp, Rattus norvegicus
agggttatctcttgcatctgggaaa

SEQ ID NO: 150803 - DNA, 25 bp, Rattus norvegicus
agggttatgaccctccatgtgggta

SEQ ID NO: 150804 - DNA, 25 bp, Rattus norvegicus
agggttatgaccgtccatgtgggta

SEQ ID NO: 150805 - DNA, 25 bp, Rattus norvegicus
agggttatgctaagcctaaaacagg

SEQ ID NO: 150806 - DNA, 25 bp, Rattus norvegicus
agggttatgctatgcctaaaacagg

SEQ ID NO: 150807 - DNA, 25 bp, Rattus norvegicus
agggttatgtgcacccatagcaaac

SEQ ID NO: 150808 - DNA, 25 bp, Rattus norvegicus
agggttatgtgctcccatagcaaac

SEQ ID NO: 150809 - DNA, 25 bp, Rattus norvegicus
agggttatttatagccttcctctgc

SEQ ID NO: 150810 - DNA, 25 bp, Rattus norvegicus
agggttatttattgccttcctctgc

SEQ ID NO: 150811 - DNA, 25 bp, Rattus norvegicus
agggttcaacttcacagtgtccttt

SEQ ID NO: 150812 - DNA, 25 bp, Rattus norvegicus
agggttcaacttgacagtgtccttt

SEQ ID NO: 150813 - DNA, 25 bp, Rattus norvegicus
agggttcaccgcctgtcagccaggc

SEQ ID NO: 150814 - DNA, 25 bp, Rattus norvegicus
agggttcaccgcgtgtcagccaggc

SEQ ID NO: 150815 - DNA, 25 bp, Rattus norvegicus
agggttcactttcaaaatgctactg

SEQ ID NO: 150816 - DNA, 25 bp, Rattus norvegicus
agggttcactttgaaaatgctactg

SEQ ID NO: 150817 - DNA, 25 bp, Rattus norvegicus
agggttcagatgatgttctttccaa

SEQ ID NO: 150818 - DNA, 25 bp, Rattus norvegicus
agggttcagatgttgttctttccaa

SEQ ID NO: 150819 - DNA, 25 bp, Rattus norvegicus
agggttcagtcccagaggcagccct

SEQ ID NO: 150820 - DNA, 25 bp, Rattus norvegicus
agggttcagtccgagaggcagccct

SEQ ID NO: 150821 - DNA, 25 bp, Rattus norvegicus
agggttcagttcagcgagtgaccag

SEQ ID NO: 150822 - DNA, 25 bp, Rattus norvegicus
agggttcagttctgcgagtgaccag

SEQ ID NO: 150823 - DNA, 25 bp, Rattus norvegicus
agggttcattgtcttgagggcttcc

SEQ ID NO: 150824 - DNA, 25 bp, Rattus norvegicus
agggttcattgtgttgagggcttcc

SEQ ID NO: 150825 - DNA, 25 bp, Rattus norvegicus
agggttccaacacgcatagaaggcc

SEQ ID NO: 150826 - DNA, 25 bp, Rattus norvegicus
agggttccaacaggcatagaaggcc

SEQ ID NO: 150827 - DNA, 25 bp, Rattus norvegicus
agggttccagcaatacttcattttc

SEQ ID NO: 150828 - DNA, 25 bp, Rattus norvegicus
agggttccagcactaccaagttgga

SEQ ID NO: 150829 - DNA, 25 bp, Rattus norvegicus
agggttccagcagtaccaagttgga

SEQ ID NO: 150830 - DNA, 25 bp, Rattus norvegicus
agggttccagcattacttcattttc

SEQ ID NO: 150831 - DNA, 25 bp, Rattus norvegicus
agggttccaggcacaagaggagatc

SEQ ID NO: 150832 - DNA, 25 bp, Rattus norvegicus
agggttccaggctcaagaggagatc

SEQ ID NO: 150833 - DNA, 25 bp, Rattus norvegicus
agggttcccagaagcaggctgaaga

SEQ ID NO: 150834 - DNA, 25 bp, Rattus norvegicus
agggttcccagatgcaggctgaaga

SEQ ID NO: 150835 - DNA, 25 bp, Rattus norvegicus
agggttcccagcaacacttgtgcag

SEQ ID NO: 150836 - DNA, 25 bp, Rattus norvegicus
agggttcccagctacacttgtgcag

SEQ ID NO: 150837 - DNA, 25 bp, Rattus norvegicus
agggttcctcctatcacagaattat

SEQ ID NO: 150838 - DNA, 25 bp, Rattus norvegicus
agggttcctcctttcacagaattat

SEQ ID NO: 150839 - DNA, 25 bp, Rattus norvegicus
agggttcctgcaccgttaacccagc

SEQ ID NO: 150840 - DNA, 25 bp, Rattus norvegicus
agggttcctgcagcgttaacccagc

SEQ ID NO: 150841 - DNA, 25 bp, Rattus norvegicus
agggttcgacaaacgcctgctgctc

SEQ ID NO: 150842 - DNA, 25 bp, Rattus norvegicus
agggttcgacaatcgcctgctgctc

SEQ ID NO: 150843 - DNA, 25 bp, Rattus norvegicus
agggttcggttcagtggcgctttct

SEQ ID NO: 150844 - DNA, 25 bp, Rattus norvegicus
agggttcggttctgtggcgctttct

SEQ ID NO: 150845 - DNA, 25 bp, Rattus norvegicus
agggttctaaggcaatgtttctcaa

SEQ ID NO: 150846 - DNA, 25 bp, Rattus norvegicus
agggttctaagggaatgtttctcaa

SEQ ID NO: 150847 - DNA, 25 bp, Rattus norvegicus
agggttctcaggctgaccacactgg

SEQ ID NO: 150848 - DNA, 25 bp, Rattus norvegicus
agggttctcagggtgaccacactgg

SEQ ID NO: 150849 - DNA, 25 bp, Rattus norvegicus
agggttctcatgaaagactctccag

SEQ ID NO: 150850 - DNA, 25 bp, Rattus norvegicus
agggttctcatgtaagactctccag

SEQ ID NO: 150851 - DNA, 25 bp, Rattus norvegicus
agggttctccaacgacatctacacc

SEQ ID NO: 150852 - DNA, 25 bp, Rattus norvegicus
agggttctccaaggacatctacacc

SEQ ID NO: 150853 - DNA, 25 bp, Rattus norvegicus
agggttctcccactagagcttttgg

SEQ ID NO: 150854 - DNA, 25 bp, Rattus norvegicus
agggttctcccagtagagcttttgg

SEQ ID NO: 150855 - DNA, 25 bp, Rattus norvegicus
agggttctccccatcttgtgataat

SEQ ID NO: 150856 - DNA, 25 bp, Rattus norvegicus
agggttctccccttcttgtgataat

SEQ ID NO: 150857 - DNA, 25 bp, Rattus norvegicus
agggttctctccaacagcccaagaa

SEQ ID NO: 150858 - DNA, 25 bp, Rattus norvegicus
agggttctctcctacagcccaagaa

SEQ ID NO: 150859 - DNA, 25 bp, Rattus norvegicus
agggttctctggacatgtctacttg

SEQ ID NO: 150860 - DNA, 25 bp, Rattus norvegicus
agggttctctggcttcatcaggaac

SEQ ID NO: 150861 - DNA, 25 bp, Rattus norvegicus
agggttctctgggttcatcaggaac

SEQ ID NO: 150862 - DNA, 25 bp, Rattus norvegicus
agggttctctggtcatgtctacttg

SEQ ID NO: 150863 - DNA, 25 bp, Rattus norvegicus
agggttctgcagagcccatgagtca

SEQ ID NO: 150864 - DNA, 25 bp, Rattus norvegicus
agggttctgcagtgcccatgagtca

SEQ ID NO: 150865 - DNA, 25 bp, Rattus norvegicus
agggttctggaaccttctgttggcc

SEQ ID NO: 150866 - DNA, 25 bp, Rattus norvegicus
agggttctggaagcttctgttggcc

SEQ ID NO: 150867 - DNA, 25 bp, Rattus norvegicus
agggttctgggaaccaactctgtaa

SEQ ID NO: 150868 - DNA, 25 bp, Rattus norvegicus
agggttctgggatccaactctgtaa

SEQ ID NO: 150869 - DNA, 25 bp, Rattus norvegicus
agggttcttcctatgacacttgtgc

SEQ ID NO: 150870 - DNA, 25 bp, Rattus norvegicus
agggttcttcctttgacacttgtgc

SEQ ID NO: 150871 - DNA, 25 bp, Rattus norvegicus
agggttcttcgtatggatcactcac

SEQ ID NO: 150872 - DNA, 25 bp, Rattus norvegicus
agggttcttcgtttggatcactcac

SEQ ID NO: 150873 - DNA, 25 bp, Rattus norvegicus
agggttgagagcagccccatggcca

SEQ ID NO: 150874 - DNA, 25 bp, Rattus norvegicus
agggttgagagctgccccatggcca

SEQ ID NO: 150875 - DNA, 25 bp, Rattus norvegicus
agggttgagggcacagacccacgac

SEQ ID NO: 150876 - DNA, 25 bp, Rattus norvegicus
agggttgagggctcagacccacgac

SEQ ID NO: 150877 - DNA, 25 bp, Rattus norvegicus
agggttgatcaacggagtctcgccc

SEQ ID NO: 150878 - DNA, 25 bp, Rattus norvegicus
agggttgatcaagggagtctcgccc

SEQ ID NO: 150879 - DNA, 25 bp, Rattus norvegicus
agggttgcaaatactctcgtgcttt

SEQ ID NO: 150880 - DNA, 25 bp, Rattus norvegicus
agggttgcaaattctctcgtgcttt

SEQ ID NO: 150881 - DNA, 25 bp, Rattus norvegicus
agggttgcagaaagccatgcagact

SEQ ID NO: 150882 - DNA, 25 bp, Rattus norvegicus
agggttgcagaatgccatgcagact

SEQ ID NO: 150883 - DNA, 25 bp, Rattus norvegicus
agggttgcatttcagttcgtgcccc

SEQ ID NO: 150884 - DNA, 25 bp, Rattus norvegicus
agggttgcatttgagttcgtgcccc

SEQ ID NO: 150885 - DNA, 25 bp, Rattus norvegicus
agggttgccaatcctcggctggata

SEQ ID NO: 150886 - DNA, 25 bp, Rattus norvegicus
agggttgccaatgctcggctggata

SEQ ID NO: 150887 - DNA, 25 bp, Rattus norvegicus
agggttgccagtacacttggccctg

SEQ ID NO: 150888 - DNA, 25 bp, Rattus norvegicus
agggttgccagttcacttggccctg

SEQ ID NO: 150889 - DNA, 25 bp, Rattus norvegicus
agggttgccatcaaacttctcagga

SEQ ID NO: 150890 - DNA, 25 bp, Rattus norvegicus
agggttgccatctaacttctcagga

SEQ ID NO: 150891 - DNA, 25 bp, Rattus norvegicus
agggttgcccaaccacatcttgttg

SEQ ID NO: 150892 - DNA, 25 bp, Rattus norvegicus
agggttgcccaagcacatcttgttg

SEQ ID NO: 150893 - DNA, 25 bp, Rattus norvegicus
agggttgctggcaatcatgtaagac

SEQ ID NO: 150894 - DNA, 25 bp, Rattus norvegicus
agggttgctggctatcatgtaagac

SEQ ID NO: 150895 - DNA, 25 bp, Rattus norvegicus
agggttgcttgaacccatccaaaca

SEQ ID NO: 150896 - DNA, 25 bp, Rattus norvegicus
agggttgcttgatcccatccaaaca

SEQ ID NO: 150897 - DNA, 25 bp, Rattus norvegicus
agggttggacacaggttcgtctgct

SEQ ID NO: 150898 - DNA, 25 bp, Rattus norvegicus
agggttggacactggttcgtctgct

SEQ ID NO: 150899 - DNA, 25 bp, Rattus norvegicus
agggttggcaatagctatgctcccc

SEQ ID NO: 150900 - DNA, 25 bp, Rattus norvegicus
agggttggcaattgctatgctcccc

SEQ ID NO: 150901 - DNA, 25 bp, Rattus norvegicus
agggttggccccagggatcgatcca

SEQ ID NO: 150902 - DNA, 25 bp, Rattus norvegicus
agggttggcccctgggatcgatcca

SEQ ID NO: 150903 - DNA, 25 bp, Rattus norvegicus
agggttggcctcataatccaatcat

SEQ ID NO: 150904 - DNA, 25 bp, Rattus norvegicus
agggttggcctcttaatccaatcat

SEQ ID NO: 150905 - DNA, 25 bp, Rattus norvegicus
agggttgggcctacgaacagaccag

SEQ ID NO: 150906 - DNA, 25 bp, Rattus norvegicus
agggttgggccttcgaacagaccag

SEQ ID NO: 150907 - DNA, 25 bp, Rattus norvegicus
agggttggtgggacacacctctaat

SEQ ID NO: 150908 - DNA, 25 bp, Rattus norvegicus
agggttggtgggtcacacctctaat

SEQ ID NO: 150909 - DNA, 25 bp, Rattus norvegicus
agggttgtaaagaggccagcactgt

SEQ ID NO: 150910 - DNA, 25 bp, Rattus norvegicus
agggttgtaaagtggccagcactgt

SEQ ID NO: 150911 - DNA, 25 bp, Rattus norvegicus
agggttgtattaatggctttgatga

SEQ ID NO: 150912 - DNA, 25 bp, Rattus norvegicus
agggttgtattattggctttgatga

SEQ ID NO: 150913 - DNA, 25 bp, Rattus norvegicus
agggttgtgaacaccagttctgctt

SEQ ID NO: 150914 - DNA, 25 bp, Rattus norvegicus
agggttgtgaactccagttctgctt

SEQ ID NO: 150915 - DNA, 25 bp, Rattus norvegicus
agggttgtgtctccaaactctgtct

SEQ ID NO: 150916 - DNA, 25 bp, Rattus norvegicus
agggttgtgtctgcaaactctgtct

SEQ ID NO: 150917 - DNA, 25 bp, Rattus norvegicus
agggttgttggacttgtctgctcaa

SEQ ID NO: 150918 - DNA, 25 bp, Rattus norvegicus
agggttgttggagttgtctgctcaa

SEQ ID NO: 150919 - DNA, 25 bp, Rattus norvegicus
agggtttagcaaacctgaaaatgtt

SEQ ID NO: 150920 - DNA, 25 bp, Rattus norvegicus
agggtttagcaatcctgaaaatgtt

SEQ ID NO: 150921 - DNA, 25 bp, Rattus norvegicus
agggtttagctcaccctgcaagcca

SEQ ID NO: 150922 - DNA, 25 bp, Rattus norvegicus
agggtttagctctccctgcaagcca

SEQ ID NO: 150923 - DNA, 25 bp, Rattus norvegicus
agggtttatatcacatctgtccata

SEQ ID NO: 150924 - DNA, 25 bp, Rattus norvegicus
agggtttatatctcatctgtccata

SEQ ID NO: 150925 - DNA, 25 bp, Rattus norvegicus
agggtttatcctactaatcattcaa

SEQ ID NO: 150926 - DNA, 25 bp, Rattus norvegicus
agggtttatccttctaatcattcaa

SEQ ID NO: 150927 - DNA, 25 bp, Rattus norvegicus
agggtttcacggacgtagccatctt

SEQ ID NO: 150928 - DNA, 25 bp, Rattus norvegicus
agggtttcacggtcgtagccatctt

SEQ ID NO: 150929 - DNA, 25 bp, Rattus norvegicus
agggtttcactaagcagccgaggct

SEQ ID NO: 150930 - DNA, 25 bp, Rattus norvegicus
agggtttcactaatcagccttgaca

SEQ ID NO: 150931 - DNA, 25 bp, Rattus norvegicus
agggtttcactatgcagccgaggct

SEQ ID NO: 150932 - DNA, 25 bp, Rattus norvegicus
agggtttcactattcagccttgaca

SEQ ID NO: 150933 - DNA, 25 bp, Rattus norvegicus
agggtttcagtgacagatgcatcta

SEQ ID NO: 150934 - DNA, 25 bp, Rattus norvegicus
agggtttcagtgtcagatgcatcta

SEQ ID NO: 150935 - DNA, 25 bp, Rattus norvegicus
agggtttccacgacagcatgctgaa

SEQ ID NO: 150936 - DNA, 25 bp, Rattus norvegicus
agggtttccacgtcagcatgctgaa

SEQ ID NO: 150937 - DNA, 25 bp, Rattus norvegicus
agggtttccactatctctgaaaatg

SEQ ID NO: 150938 - DNA, 25 bp, Rattus norvegicus
agggtttccactttctctgaaaatg

SEQ ID NO: 150939 - DNA, 25 bp, Rattus norvegicus
agggtttccctgagcatacccctgg

SEQ ID NO: 150940 - DNA, 25 bp, Rattus norvegicus
agggtttccctgcttagtgctacta

SEQ ID NO: 150941 - DNA, 25 bp, Rattus norvegicus
agggtttccctggttagtgctacta

SEQ ID NO: 150942 - DNA, 25 bp, Rattus norvegicus
agggtttccctgtgcatacccctgg

SEQ ID NO: 150943 - DNA, 25 bp, Rattus norvegicus
agggtttcggccattgttgagcaga

SEQ ID NO: 150944 - DNA, 25 bp, Rattus norvegicus
agggtttcggcctttgttgagcaga

SEQ ID NO: 150945 - DNA, 25 bp, Rattus norvegicus
agggtttctatgacatgtttatttt

SEQ ID NO: 150946 - DNA, 25 bp, Rattus norvegicus
agggtttctatgtcatgtttatttt

SEQ ID NO: 150947 - DNA, 25 bp, Rattus norvegicus
agggtttctcgtctttaggcttcat

SEQ ID NO: 150948 - DNA, 25 bp, Rattus norvegicus
agggtttctcgtgtttaggcttcat

SEQ ID NO: 150949 - DNA, 25 bp, Rattus norvegicus
agggtttctctaactaggtattctt

SEQ ID NO: 150950 - DNA, 25 bp, Rattus norvegicus
agggtttctctatctaggtattctt

SEQ ID NO: 150951 - DNA, 25 bp, Rattus norvegicus
agggtttctgaaaggctcactgctt

SEQ ID NO: 150952 - DNA, 25 bp, Rattus norvegicus
agggtttctgaatggctcactgctt

SEQ ID NO: 150953 - DNA, 25 bp, Rattus norvegicus
agggtttctggacttcaggccagct

SEQ ID NO: 150954 - DNA, 25 bp, Rattus norvegicus
agggtttctggagttcaggccagct

SEQ ID NO: 150955 - DNA, 25 bp, Rattus norvegicus
agggtttcttctcagggttctccat

SEQ ID NO: 150956 - DNA, 25 bp, Rattus norvegicus
agggtttcttctgagggttctccat

SEQ ID NO: 150957 - DNA, 25 bp, Rattus norvegicus
agggtttcttttacagcttcagcca

SEQ ID NO: 150958 - DNA, 25 bp, Rattus norvegicus
agggtttctttttcagcttcagcca

SEQ ID NO: 150959 - DNA, 25 bp, Rattus norvegicus
agggtttgaagcacttgctctgatt

SEQ ID NO: 150960 - DNA, 25 bp, Rattus norvegicus
agggtttgaagctcttgctctgatt

SEQ ID NO: 150961 - DNA, 25 bp, Rattus norvegicus
agggtttgagaaccccacagaaaat

SEQ ID NO: 150962 - DNA, 25 bp, Rattus norvegicus
agggtttgagaagcccacagaaaat

SEQ ID NO: 150963 - DNA, 25 bp, Rattus norvegicus
agggtttgctgcacctgctcctgga

SEQ ID NO: 150964 - DNA, 25 bp, Rattus norvegicus
agggtttgctgctcctgctcctgga

SEQ ID NO: 150965 - DNA, 25 bp, Rattus norvegicus
agggtttggcaccaatcacctggga

SEQ ID NO: 150966 - DNA, 25 bp, Rattus norvegicus
agggtttggcacgaatcacctggga

SEQ ID NO: 150967 - DNA, 25 bp, Rattus norvegicus
agggtttggcgcaccttccagagag

SEQ ID NO: 150968 - DNA, 25 bp, Rattus norvegicus
agggtttggcgctccttccagagag

SEQ ID NO: 150969 - DNA, 25 bp, Rattus norvegicus
agggtttgggtcatagcacttataa

SEQ ID NO: 150970 - DNA, 25 bp, Rattus norvegicus
agggtttgggtcttagcacttataa

SEQ ID NO: 150971 - DNA, 25 bp, Rattus norvegicus
agggtttggtgcctaaatactgatg

SEQ ID NO: 150972 - DNA, 25 bp, Rattus norvegicus
agggtttggtgcgtaaatactgatg

SEQ ID NO: 150973 - DNA, 25 bp, Rattus norvegicus
agggtttgtatcacctggacctgga

SEQ ID NO: 150974 - DNA, 25 bp, Rattus norvegicus
agggtttgtatctcctggacctgga

SEQ ID NO: 150975 - DNA, 25 bp, Rattus norvegicus
agggtttgtgatactcttttgtcag

SEQ ID NO: 150976 - DNA, 25 bp, Rattus norvegicus
agggtttgtgattctcttttgtcag

SEQ ID NO: 150977 - DNA, 25 bp, Rattus norvegicus
agggtttgtggaaatccctcagcaa

SEQ ID NO: 150978 - DNA, 25 bp, Rattus norvegicus
agggtttgtggatatccctcagcaa

SEQ ID NO: 150979 - DNA, 25 bp, Rattus norvegicus
agggttttagacaatctccaggtag

SEQ ID NO: 150980 - DNA, 25 bp, Rattus norvegicus
agggttttagactatctccaggtag

SEQ ID NO: 150981 - DNA, 25 bp, Rattus norvegicus
agggttttcattacagcaccgagaa

SEQ ID NO: 150982 - DNA, 25 bp, Rattus norvegicus
agggttttcatttcagcaccgagaa

SEQ ID NO: 150983 - DNA, 25 bp, Rattus norvegicus
agggttttcccaccaacgaatggca

SEQ ID NO: 150984 - DNA, 25 bp, Rattus norvegicus
agggttttcccagcaacgaatggca

SEQ ID NO: 150985 - DNA, 25 bp, Rattus norvegicus
agggttttgcctatatcagctttca

SEQ ID NO: 150986 - DNA, 25 bp, Rattus norvegicus
agggttttgcctttatcagctttca

SEQ ID NO: 150987 - DNA, 25 bp, Rattus norvegicus
agggttttgggcatcctctggctag

SEQ ID NO: 150988 - DNA, 25 bp, Rattus norvegicus
agggttttgggcttcctctggctag

SEQ ID NO: 150989 - DNA, 25 bp, Rattus norvegicus
agggtttttctacgccatcccagtg

SEQ ID NO: 150990 - DNA, 25 bp, Rattus norvegicus
agggtttttctaggccatcccagtg

SEQ ID NO: 150991 - DNA, 25 bp, Rattus norvegicus
agggtttttgctatgtggacttcac

SEQ ID NO: 150992 - DNA, 25 bp, Rattus norvegicus
agggtttttgctttgtggacttcac

SEQ ID NO: 150993 - DNA, 25 bp, Rattus norvegicus
aggtaaaagagcagcccaccgtggt

SEQ ID NO: 150994 - DNA, 25 bp, Rattus norvegicus
aggtaaaagagctgcccaccgtggt

SEQ ID NO: 150995 - DNA, 25 bp, Rattus norvegicus
aggtaaaatgcccttccttgcttct

SEQ ID NO: 150996 - DNA, 25 bp, Rattus norvegicus
aggtaaaatgccgttccttgcttct

SEQ ID NO: 150997 - DNA, 25 bp, Rattus norvegicus
aggtaaacacacctgcagccgaggt

SEQ ID NO: 150998 - DNA, 25 bp, Rattus norvegicus
aggtaaacacacgtgcagccgaggt

SEQ ID NO: 150999 - DNA, 25 bp, Rattus norvegicus
aggtaaacacagcactcgctagaga

SEQ ID NO: 151000 - DNA, 25 bp, Rattus norvegicus
aggtaaacacaggactcgctagaga

SEQ ID NO: 151001 - DNA, 25 bp, Rattus norvegicus
aggtaaacacctagcttctatctca

SEQ ID NO: 151002 - DNA, 25 bp, Rattus norvegicus
aggtaaacaccttgcttctatctca

SEQ ID NO: 151003 - DNA, 25 bp, Rattus norvegicus
aggtaaactggtacaggctccgctc

SEQ ID NO: 151004 - DNA, 25 bp, Rattus norvegicus
aggtaaactggttcaggctccgctc

SEQ ID NO: 151005 - DNA, 25 bp, Rattus norvegicus
aggtaaatgtgtatcctgccacgcc

SEQ ID NO: 151006 - DNA, 25 bp, Rattus norvegicus
aggtaaatgtgtttcctgccacgcc

SEQ ID NO: 151007 - DNA, 25 bp, Rattus norvegicus
aggtaacacgtcaacatcagaagtt

SEQ ID NO: 151008 - DNA, 25 bp, Rattus norvegicus
aggtaacacgtctacatcagaagtt

SEQ ID NO: 151009 - DNA, 25 bp, Rattus norvegicus
aggtaacaggacatctcggagctag

SEQ ID NO: 151010 - DNA, 25 bp, Rattus norvegicus
aggtaacaggacttctcggagctag

SEQ ID NO: 151011 - DNA, 25 bp, Rattus norvegicus
aggtaacagtctatgaccactccct

SEQ ID NO: 151012 - DNA, 25 bp, Rattus norvegicus
aggtaacagtctttgaccactccct

SEQ ID NO: 151013 - DNA, 25 bp, Rattus norvegicus
aggtaacatactattgctcactcac

SEQ ID NO: 151014 - DNA, 25 bp, Rattus norvegicus
aggtaacatacttttgctcactcac

SEQ ID NO: 151015 - DNA, 25 bp, Rattus norvegicus
aggtaacattagacattgctctggg

SEQ ID NO: 151016 - DNA, 25 bp, Rattus norvegicus
aggtaacattagtcattgctctggg

SEQ ID NO: 151017 - DNA, 25 bp, Rattus norvegicus
aggtaaccagccactcagaggagag

SEQ ID NO: 151018 - DNA, 25 bp, Rattus norvegicus
aggtaaccagcctctcagaggagag

SEQ ID NO: 151019 - DNA, 25 bp, Rattus norvegicus
aggtaaccagtcagctgcgccccag

SEQ ID NO: 151020 - DNA, 25 bp, Rattus norvegicus
aggtaaccagtctgctgcgccccag

SEQ ID NO: 151021 - DNA, 25 bp, Rattus norvegicus
aggtaacccacacacttgtcaacgt

SEQ ID NO: 151022 - DNA, 25 bp, Rattus norvegicus
aggtaacccacagacttgtcaacgt

SEQ ID NO: 151023 - DNA, 25 bp, Rattus norvegicus
aggtaacctcacatctgactatcaa

SEQ ID NO: 151024 - DNA, 25 bp, Rattus norvegicus
aggtaacctcacttctgactatcaa

SEQ ID NO: 151025 - DNA, 25 bp, Rattus norvegicus
aggtaactccgtaatcacatctctg

SEQ ID NO: 151026 - DNA, 25 bp, Rattus norvegicus
aggtaactccgttatcacatctctg

SEQ ID NO: 151027 - DNA, 25 bp, Rattus norvegicus
aggtaactcggtcgcgcctgtgcca

SEQ ID NO: 151028 - DNA, 25 bp, Rattus norvegicus
aggtaactcggtggcgcctgtgcca

SEQ ID NO: 151029 - DNA, 25 bp, Rattus norvegicus
aggtaacttcagcagttcggccaga

SEQ ID NO: 151030 - DNA, 25 bp, Rattus norvegicus
aggtaacttcaggagttcggccaga

SEQ ID NO: 151031 - DNA, 25 bp, Rattus norvegicus
aggtaacttcttattctgggagctt

SEQ ID NO: 151032 - DNA, 25 bp, Rattus norvegicus
aggtaacttctttttctgggagctt

SEQ ID NO: 151033 - DNA, 25 bp, Rattus norvegicus
aggtaacttgcgctgtgtatttctc

SEQ ID NO: 151034 - DNA, 25 bp, Rattus norvegicus
aggtaacttgcggtgtgtatttctc

SEQ ID NO: 151035 - DNA, 25 bp, Rattus norvegicus
aggtaacttgggatttcctgcatcc

SEQ ID NO: 151036 - DNA, 25 bp, Rattus norvegicus
aggtaacttgggttttcctgcatcc

SEQ ID NO: 151037 - DNA, 25 bp, Rattus norvegicus
aggtaagaagcacgcttcctccttt

SEQ ID NO: 151038 - DNA, 25 bp, Rattus norvegicus
aggtaagaagcaggcttcctccttt

SEQ ID NO: 151039 - DNA, 25 bp, Rattus norvegicus
aggtaagattaacggccatccccag

SEQ ID NO: 151040 - DNA, 25 bp, Rattus norvegicus
aggtaagattaagggccatccccag

SEQ ID NO: 151041 - DNA, 25 bp, Rattus norvegicus
aggtaagcactcatctactgaccta

SEQ ID NO: 151042 - DNA, 25 bp, Rattus norvegicus
aggtaagcactcttctactgaccta

SEQ ID NO: 151043 - DNA, 25 bp, Rattus norvegicus
aggtaagcatgtatgccgcaaagct

SEQ ID NO: 151044 - DNA, 25 bp, Rattus norvegicus
aggtaagcatgtttgccgcaaagct

SEQ ID NO: 151045 - DNA, 25 bp, Rattus norvegicus
aggtaagccagcagggactgagccc

SEQ ID NO: 151046 - DNA, 25 bp, Rattus norvegicus
aggtaagccagctgggactgagccc

SEQ ID NO: 151047 - DNA, 25 bp, Rattus norvegicus
aggtaagcccaacatctgacaaatg

SEQ ID NO: 151048 - DNA, 25 bp, Rattus norvegicus
aggtaagcccaagatctgacaaatg

SEQ ID NO: 151049 - DNA, 25 bp, Rattus norvegicus
aggtaagctaggacacacacctgcc

SEQ ID NO: 151050 - DNA, 25 bp, Rattus norvegicus
aggtaagctaggtcacacacctgcc

SEQ ID NO: 151051 - DNA, 25 bp, Rattus norvegicus
aggtaaggactgctgattctgcttc

SEQ ID NO: 151052 - DNA, 25 bp, Rattus norvegicus
aggtaaggactggtgattctgcttc

SEQ ID NO: 151053 - DNA, 25 bp, Rattus norvegicus
aggtaaggccccaccagtgctttgt

SEQ ID NO: 151054 - DNA, 25 bp, Rattus norvegicus
aggtaaggcccctccagtgctttgt

SEQ ID NO: 151055 - DNA, 25 bp, Rattus norvegicus
aggtaagggaacacgccgcgctccg

SEQ ID NO: 151056 - DNA, 25 bp, Rattus norvegicus
aggtaagggaactcgccgcgctccg

SEQ ID NO: 151057 - DNA, 25 bp, Rattus norvegicus
aggtaagttggcatcctctgaacaa

SEQ ID NO: 151058 - DNA, 25 bp, Rattus norvegicus
aggtaagttggcttcctctgaacaa

SEQ ID NO: 151059 - DNA, 25 bp, Rattus norvegicus
aggtaataaacactcttgattcccg

SEQ ID NO: 151060 - DNA, 25 bp, Rattus norvegicus
aggtaataaacagtcttgattcccg

SEQ ID NO: 151061 - DNA, 25 bp, Rattus norvegicus
aggtaatagaccagcttatgctggg

SEQ ID NO: 151062 - DNA, 25 bp, Rattus norvegicus
aggtaatagacctgcttatgctggg

SEQ ID NO: 151063 - DNA, 25 bp, Rattus norvegicus
aggtaatagcgcagtgtggtgtata

SEQ ID NO: 151064 - DNA, 25 bp, Rattus norvegicus
aggtaatagcgctgtgtggtgtata

SEQ ID NO: 151065 - DNA, 25 bp, Rattus norvegicus
aggtaatgacttccgtttgtgatat

SEQ ID NO: 151066 - DNA, 25 bp, Rattus norvegicus
aggtaatgacttcttataaactcac

SEQ ID NO: 151067 - DNA, 25 bp, Rattus norvegicus
aggtaatgacttgcgtttgtgatat

SEQ ID NO: 151068 - DNA, 25 bp, Rattus norvegicus
aggtaatgacttgttataaactcac

SEQ ID NO: 151069 - DNA, 25 bp, Rattus norvegicus
aggtaatgcaaaacacccaggtgat

SEQ ID NO: 151070 - DNA, 25 bp, Rattus norvegicus
aggtaatgcaaatcacccaggtgat

SEQ ID NO: 151071 - DNA, 25 bp, Rattus norvegicus
aggtaatgcatactgttccttccct

SEQ ID NO: 151072 - DNA, 25 bp, Rattus norvegicus
aggtaatgcatagtgttccttccct

SEQ ID NO: 151073 - DNA, 25 bp, Rattus norvegicus
aggtaatgcattctgttttccttct

SEQ ID NO: 151074 - DNA, 25 bp, Rattus norvegicus
aggtaatgcattgtgttttccttct

SEQ ID NO: 151075 - DNA, 25 bp, Rattus norvegicus
aggtaatgcttgacttcagcgtcaa

SEQ ID NO: 151076 - DNA, 25 bp, Rattus norvegicus
aggtaatgcttgtcttcagcgtcaa

SEQ ID NO: 151077 - DNA, 25 bp, Rattus norvegicus
aggtaatgtcctactgcttggtcat

SEQ ID NO: 151078 - DNA, 25 bp, Rattus norvegicus
aggtaatgtccttctgcttggtcat

SEQ ID NO: 151079 - DNA, 25 bp, Rattus norvegicus
aggtaattaatccttcactccactc

SEQ ID NO: 151080 - DNA, 25 bp, Rattus norvegicus
aggtaattaatcgttcactccactc

SEQ ID NO: 151081 - DNA, 25 bp, Rattus norvegicus
aggtaattcagccaaagggcaattt

SEQ ID NO: 151082 - DNA, 25 bp, Rattus norvegicus
aggtaattcagcgaaagggcaattt

SEQ ID NO: 151083 - DNA, 25 bp, Rattus norvegicus
aggtaatttttcactccagtgtggg

SEQ ID NO: 151084 - DNA, 25 bp, Rattus norvegicus
aggtaatttttctctccagtgtggg

SEQ ID NO: 151085 - DNA, 25 bp, Rattus norvegicus
aggtacaaatggcttaggtctattt

SEQ ID NO: 151086 - DNA, 25 bp, Rattus norvegicus
aggtacaaatgggttaggtctattt

SEQ ID NO: 151087 - DNA, 25 bp, Rattus norvegicus
aggtacaatctaaccatgggcccct

SEQ ID NO: 151088 - DNA, 25 bp, Rattus norvegicus
aggtacaatctatccatgggcccct

SEQ ID NO: 151089 - DNA, 25 bp, Rattus norvegicus
aggtacaatgtgacgtcctctgttt

SEQ ID NO: 151090 - DNA, 25 bp, Rattus norvegicus
aggtacaatgtgtcgtcctctgttt

SEQ ID NO: 151091 - DNA, 25 bp, Rattus norvegicus
aggtacacagaaacgcagcagccac

SEQ ID NO: 151092 - DNA, 25 bp, Rattus norvegicus
aggtacacagaatcgcagcagccac

SEQ ID NO: 151093 - DNA, 25 bp, Rattus norvegicus
aggtacaccagcagacggtggctaa

SEQ ID NO: 151094 - DNA, 25 bp, Rattus norvegicus
aggtacaccagctgacggtggctaa

SEQ ID NO: 151095 - DNA, 25 bp, Rattus norvegicus
aggtacagcgctatggggacattgc

SEQ ID NO: 151096 - DNA, 25 bp, Rattus norvegicus
aggtacagcgctttggggacattgc

SEQ ID NO: 151097 - DNA, 25 bp, Rattus norvegicus
aggtacaggcgtatgctgccaagcc

SEQ ID NO: 151098 - DNA, 25 bp, Rattus norvegicus
aggtacaggcgtttgctgccaagcc

SEQ ID NO: 151099 - DNA, 25 bp, Rattus norvegicus
aggtacaggtgcacagcggccagct

SEQ ID NO: 151100 - DNA, 25 bp, Rattus norvegicus
aggtacaggtgctcagcggccagct

SEQ ID NO: 151101 - DNA, 25 bp, Rattus norvegicus
aggtacatacccacagtcagtcata

SEQ ID NO: 151102 - DNA, 25 bp, Rattus norvegicus
aggtacataccctcagtcagtcata

SEQ ID NO: 151103 - DNA, 25 bp, Rattus norvegicus
aggtacatgattccatccatgctcc

SEQ ID NO: 151104 - DNA, 25 bp, Rattus norvegicus
aggtacatgattgcatccatgctcc

SEQ ID NO: 151105 - DNA, 25 bp, Rattus norvegicus
aggtacattgcccttgtcaagagca

SEQ ID NO: 151106 - DNA, 25 bp, Rattus norvegicus
aggtacattgccgttgtcaagagca

SEQ ID NO: 151107 - DNA, 25 bp, Rattus norvegicus
aggtacattgttacagctgtgttct

SEQ ID NO: 151108 - DNA, 25 bp, Rattus norvegicus
aggtacattgtttcagctgtgttct

SEQ ID NO: 151109 - DNA, 25 bp, Rattus norvegicus
aggtacatttacctcattgtgtata

SEQ ID NO: 151110 - DNA, 25 bp, Rattus norvegicus
aggtacatttacgtcattgtgtata

SEQ ID NO: 151111 - DNA, 25 bp, Rattus norvegicus
aggtaccaaattactcccacagagg

SEQ ID NO: 151112 - DNA, 25 bp, Rattus norvegicus
aggtaccaaatttctcccacagagg

SEQ ID NO: 151113 - DNA, 25 bp, Rattus norvegicus
aggtaccacatgcaacccaggtctg

SEQ ID NO: 151114 - DNA, 25 bp, Rattus norvegicus
aggtaccacatggaacccaggtctg

SEQ ID NO: 151115 - DNA, 25 bp, Rattus norvegicus
aggtaccaccttatctcacatggca

SEQ ID NO: 151116 - DNA, 25 bp, Rattus norvegicus
aggtaccaccttttctcacatggca

SEQ ID NO: 151117 - DNA, 25 bp, Rattus norvegicus
aggtaccactcactgctaacatgga

SEQ ID NO: 151118 - DNA, 25 bp, Rattus norvegicus
aggtaccactcagtgctaacatgga

SEQ ID NO: 151119 - DNA, 25 bp, Rattus norvegicus
aggtaccatctgagtctccatagcg

SEQ ID NO: 151120 - DNA, 25 bp, Rattus norvegicus
aggtaccatctgtgtctccatagcg

SEQ ID NO: 151121 - DNA, 25 bp, Rattus norvegicus
aggtacccaccgaaatctgcagagg

SEQ ID NO: 151122 - DNA, 25 bp, Rattus norvegicus
aggtacccaccgtaatctgcagagg

SEQ ID NO: 151123 - DNA, 25 bp, Rattus norvegicus
aggtacccatcactcggaagcagcg

SEQ ID NO: 151124 - DNA, 25 bp, Rattus norvegicus
aggtacccatcagtcggaagcagcg

SEQ ID NO: 151125 - DNA, 25 bp, Rattus norvegicus
aggtaccctggcaattgggagccaa

SEQ ID NO: 151126 - DNA, 25 bp, Rattus norvegicus
aggtaccctggctattgggagccaa

SEQ ID NO: 151127 - DNA, 25 bp, Rattus norvegicus
aggtaccctgtgactactggagttc

SEQ ID NO: 151128 - DNA, 25 bp, Rattus norvegicus
aggtaccctgtgtctactggagttc

SEQ ID NO: 151129 - DNA, 25 bp, Rattus norvegicus
aggtaccgagtcacaggtccccgag

SEQ ID NO: 151130 - DNA, 25 bp, Rattus norvegicus
aggtaccgagtctcaggtccccgag

SEQ ID NO: 151131 - DNA, 25 bp, Rattus norvegicus
aggtaccggtttcgcatttctgtgc

SEQ ID NO: 151132 - DNA, 25 bp, Rattus norvegicus
aggtaccggtttggcatttctgtgc

SEQ ID NO: 151133 - DNA, 25 bp, Rattus norvegicus
aggtaccgttatatcttcacactgc

SEQ ID NO: 151134 - DNA, 25 bp, Rattus norvegicus
aggtaccgttatttcttcacactgc

SEQ ID NO: 151135 - DNA, 25 bp, Rattus norvegicus
aggtacctctacaccctggttatca

SEQ ID NO: 151136 - DNA, 25 bp, Rattus norvegicus
aggtacctctactccctggttatca

SEQ ID NO: 151137 - DNA, 25 bp, Rattus norvegicus
aggtacctgacaactttaacttctc

SEQ ID NO: 151138 - DNA, 25 bp, Rattus norvegicus
aggtacctgacatctttaacttctc

SEQ ID NO: 151139 - DNA, 25 bp, Rattus norvegicus
aggtaccttctcaccaggacggaga

SEQ ID NO: 151140 - DNA, 25 bp, Rattus norvegicus
aggtaccttctctccaggacggaga

SEQ ID NO: 151141 - DNA, 25 bp, Rattus norvegicus
aggtaccttgaaaagatgcccacca

SEQ ID NO: 151142 - DNA, 25 bp, Rattus norvegicus
aggtaccttgaatagatgcccacca

SEQ ID NO: 151143 - DNA, 25 bp, Rattus norvegicus
aggtacgaatggctcatccagtgag

SEQ ID NO: 151144 - DNA, 25 bp, Rattus norvegicus
aggtacgaatgggtcatccagtgag

SEQ ID NO: 151145 - DNA, 25 bp, Rattus norvegicus
aggtacgactgcagtggactgatcc

SEQ ID NO: 151146 - DNA, 25 bp, Rattus norvegicus
aggtacgactgctgtggactgatcc

SEQ ID NO: 151147 - DNA, 25 bp, Rattus norvegicus
aggtacgagatcagttccatggaac

SEQ ID NO: 151148 - DNA, 25 bp, Rattus norvegicus
aggtacgagatctgttccatggaac

SEQ ID NO: 151149 - DNA, 25 bp, Rattus norvegicus
aggtacgatgacagtgttccccgat

SEQ ID NO: 151150 - DNA, 25 bp, Rattus norvegicus
aggtacgatgactgtgttccccgat

SEQ ID NO: 151151 - DNA, 25 bp, Rattus norvegicus
aggtacgcccacacttccaagtgtg

SEQ ID NO: 151152 - DNA, 25 bp, Rattus norvegicus
aggtacgcccactcttccaagtgtg

SEQ ID NO: 151153 - DNA, 25 bp, Rattus norvegicus
aggtacgttgcgcttctgaagaaga

SEQ ID NO: 151154 - DNA, 25 bp, Rattus norvegicus
aggtacgttgcggttctgaagaaga

SEQ ID NO: 151155 - DNA, 25 bp, Rattus norvegicus
aggtactaattactgcccagcccgg

SEQ ID NO: 151156 - DNA, 25 bp, Rattus norvegicus
aggtactaattagtgcccagcccgg

SEQ ID NO: 151157 - DNA, 25 bp, Rattus norvegicus
aggtactatgctatacaacgtggta

SEQ ID NO: 151158 - DNA, 25 bp, Rattus norvegicus
aggtactatgctttacaacgtggta

SEQ ID NO: 151159 - DNA, 25 bp, Rattus norvegicus
aggtactccgtcagaaaagttctga

SEQ ID NO: 151160 - DNA, 25 bp, Rattus norvegicus
aggtactccgtctgaaaagttctga

SEQ ID NO: 151161 - DNA, 25 bp, Rattus norvegicus
aggtactgaatcattaggacttgca

SEQ ID NO: 151162 - DNA, 25 bp, Rattus norvegicus
aggtactgaatctttaggacttgca

SEQ ID NO: 151163 - DNA, 25 bp, Rattus norvegicus
aggtactgagacagttggccctcat

SEQ ID NO: 151164 - DNA, 25 bp, Rattus norvegicus
aggtactgagactgttggccctcat

SEQ ID NO: 151165 - DNA, 25 bp, Rattus norvegicus
aggtactgagagcagcttgttttaa

SEQ ID NO: 151166 - DNA, 25 bp, Rattus norvegicus
aggtactgagaggagcttgttttaa

SEQ ID NO: 151167 - DNA, 25 bp, Rattus norvegicus
aggtactgccttatctcatgggtgt

SEQ ID NO: 151168 - DNA, 25 bp, Rattus norvegicus
aggtactgccttttctcatgggtgt

SEQ ID NO: 151169 - DNA, 25 bp, Rattus norvegicus
aggtactgcggtagcattgcctgac

SEQ ID NO: 151170 - DNA, 25 bp, Rattus norvegicus
aggtactgcggttgcattgcctgac

SEQ ID NO: 151171 - DNA, 25 bp, Rattus norvegicus
aggtactggcacacggcgacgtcag

SEQ ID NO: 151172 - DNA, 25 bp, Rattus norvegicus
aggtactggcactcggcgacgtcag

SEQ ID NO: 151173 - DNA, 25 bp, Rattus norvegicus
aggtactgggacagttgtgcccctg

SEQ ID NO: 151174 - DNA, 25 bp, Rattus norvegicus
aggtactgggactgttgtgcccctg

SEQ ID NO: 151175 - DNA, 25 bp, Rattus norvegicus
aggtactgtcttcctgaggtcgtca

SEQ ID NO: 151176 - DNA, 25 bp, Rattus norvegicus
aggtactgtcttgctgaggtcgtca

SEQ ID NO: 151177 - DNA, 25 bp, Rattus norvegicus
aggtactgtgtgattcatcagaaac

SEQ ID NO: 151178 - DNA, 25 bp, Rattus norvegicus
aggtactgtgtgtttcatcagaaac

SEQ ID NO: 151179 - DNA, 25 bp, Rattus norvegicus
aggtactgtttcaggcggaacttgc

SEQ ID NO: 151180 - DNA, 25 bp, Rattus norvegicus
aggtactgtttctggcggaacttgc

SEQ ID NO: 151181 - DNA, 25 bp, Rattus norvegicus
aggtacttactgctctgtgatttgt

SEQ ID NO: 151182 - DNA, 25 bp, Rattus norvegicus
aggtacttactggtctgtgatttgt

SEQ ID NO: 151183 - DNA, 25 bp, Rattus norvegicus
aggtacttctgcagcttgaagcgcc

SEQ ID NO: 151184 - DNA, 25 bp, Rattus norvegicus
aggtacttctgctgcttgaagcgcc

SEQ ID NO: 151185 - DNA, 25 bp, Rattus norvegicus
aggtacttgactcctgctgctgtgc

SEQ ID NO: 151186 - DNA, 25 bp, Rattus norvegicus
aggtacttgactgctgctgctgtgc

SEQ ID NO: 151187 - DNA, 25 bp, Rattus norvegicus
aggtacttgctacggcggatcctca

SEQ ID NO: 151188 - DNA, 25 bp, Rattus norvegicus
aggtacttgctagggcggatcctca

SEQ ID NO: 151189 - DNA, 25 bp, Rattus norvegicus
aggtacttgctgagtctgcctgaca

SEQ ID NO: 151190 - DNA, 25 bp, Rattus norvegicus
aggtacttgctgtgtctgcctgaca

SEQ ID NO: 151191 - DNA, 25 bp, Rattus norvegicus
aggtacttgggacgctagctgccct

SEQ ID NO: 151192 - DNA, 25 bp, Rattus norvegicus
aggtacttgggaggctagctgccct

SEQ ID NO: 151193 - DNA, 25 bp, Rattus norvegicus
aggtactttaccctcaggtctccat

SEQ ID NO: 151194 - DNA, 25 bp, Rattus norvegicus
aggtactttaccgtcaggtctccat

SEQ ID NO: 151195 - DNA, 25 bp, Rattus norvegicus
aggtagaaagatctcctcggcaccg

SEQ ID NO: 151196 - DNA, 25 bp, Rattus norvegicus
aggtagaaagatgtcctcggcaccg

SEQ ID NO: 151197 - DNA, 25 bp, Rattus norvegicus
aggtagaaatgtcgccctctgtcct

SEQ ID NO: 151198 - DNA, 25 bp, Rattus norvegicus
aggtagaaatgtggccctctgtcct

SEQ ID NO: 151199 - DNA, 25 bp, Rattus norvegicus
aggtagaaccctccccatgttggaa

SEQ ID NO: 151200 - DNA, 25 bp, Rattus norvegicus
aggtagaaccctgcccatgttggaa

SEQ ID NO: 151201 - DNA, 25 bp, Rattus norvegicus
aggtagaacctgagacttttgtggt

SEQ ID NO: 151202 - DNA, 25 bp, Rattus norvegicus
aggtagaacctgtgacttttgtggt

SEQ ID NO: 151203 - DNA, 25 bp, Rattus norvegicus
aggtagaactacagggccacggacg

SEQ ID NO: 151204 - DNA, 25 bp, Rattus norvegicus
aggtagaactactgggccacggacg

SEQ ID NO: 151205 - DNA, 25 bp, Rattus norvegicus
aggtagaccaacacctggcgcgaca

SEQ ID NO: 151206 - DNA, 25 bp, Rattus norvegicus
aggtagaccaactcctggcgcgaca

SEQ ID NO: 151207 - DNA, 25 bp, Rattus norvegicus
aggtagacctttctgtgacatcaag

SEQ ID NO: 151208 - DNA, 25 bp, Rattus norvegicus
aggtagacctttgtgtgacatcaag

SEQ ID NO: 151209 - DNA, 25 bp, Rattus norvegicus
aggtagacgtgtatcctggcttgaa

SEQ ID NO: 151210 - DNA, 25 bp, Rattus norvegicus
aggtagacgtgtttcctggcttgaa

SEQ ID NO: 151211 - DNA, 25 bp, Rattus norvegicus
aggtagactacaactgattccctac

SEQ ID NO: 151212 - DNA, 25 bp, Rattus norvegicus
aggtagactacatctgattccctac

SEQ ID NO: 151213 - DNA, 25 bp, Rattus norvegicus
aggtagactcccactgaccacagtg

SEQ ID NO: 151214 - DNA, 25 bp, Rattus norvegicus
aggtagactccctctgaccacagtg

SEQ ID NO: 151215 - DNA, 25 bp, Rattus norvegicus
aggtagagctaaccagtctgtgact

SEQ ID NO: 151216 - DNA, 25 bp, Rattus norvegicus
aggtagagctaagcagtctgtgact

SEQ ID NO: 151217 - DNA, 25 bp, Rattus norvegicus
aggtagagggcccaccagttcaatg

SEQ ID NO: 151218 - DNA, 25 bp, Rattus norvegicus
aggtagagggccgaccagttcaatg

SEQ ID NO: 151219 - DNA, 25 bp, Rattus norvegicus
aggtagaggtggcagctctgccctt

SEQ ID NO: 151220 - DNA, 25 bp, Rattus norvegicus
aggtagaggtgggagctctgccctt

SEQ ID NO: 151221 - DNA, 25 bp, Rattus norvegicus
aggtagagtccaactgagcagccta

SEQ ID NO: 151222 - DNA, 25 bp, Rattus norvegicus
aggtagagtccatctgagcagccta

SEQ ID NO: 151223 - DNA, 25 bp, Rattus norvegicus
aggtagagtctactgcacgcatctt

SEQ ID NO: 151224 - DNA, 25 bp, Rattus norvegicus
aggtagagtctagtgcacgcatctt

SEQ ID NO: 151225 - DNA, 25 bp, Rattus norvegicus
aggtagagtgtccatgggaacccat

SEQ ID NO: 151226 - DNA, 25 bp, Rattus norvegicus
aggtagagtgtcgatgggaacccat

SEQ ID NO: 151227 - DNA, 25 bp, Rattus norvegicus
aggtagatattccagactcttcctc

SEQ ID NO: 151228 - DNA, 25 bp, Rattus norvegicus
aggtagatattcgagactcttcctc

SEQ ID NO: 151229 - DNA, 25 bp, Rattus norvegicus
aggtagatcaagaccagctatggca

SEQ ID NO: 151230 - DNA, 25 bp, Rattus norvegicus
aggtagatcaagtccagctatggca

SEQ ID NO: 151231 - DNA, 25 bp, Rattus norvegicus
aggtagattcttatcacttgggtat

SEQ ID NO: 151232 - DNA, 25 bp, Rattus norvegicus
aggtagattcttttcacttgggtat

SEQ ID NO: 151233 - DNA, 25 bp, Rattus norvegicus
aggtagattgttaaagtgttcataa

SEQ ID NO: 151234 - DNA, 25 bp, Rattus norvegicus
aggtagattgtttaagtgttcataa

SEQ ID NO: 151235 - DNA, 25 bp, Rattus norvegicus
aggtagcaagcccatagtcatttat

SEQ ID NO: 151236 - DNA, 25 bp, Rattus norvegicus
aggtagcaagccgatagtcatttat

SEQ ID NO: 151237 - DNA, 25 bp, Rattus norvegicus
aggtagcacagtccctggtttgtca

SEQ ID NO: 151238 - DNA, 25 bp, Rattus norvegicus
aggtagcacagtgcctggtttgtca

SEQ ID NO: 151239 - DNA, 25 bp, Rattus norvegicus
aggtagcagctccacacctcagagg

SEQ ID NO: 151240 - DNA, 25 bp, Rattus norvegicus
aggtagcagctcgacacctcagagg

SEQ ID NO: 151241 - DNA, 25 bp, Rattus norvegicus
aggtagcagtttactcgtgtgcctt

SEQ ID NO: 151242 - DNA, 25 bp, Rattus norvegicus
aggtagcagttttctcgtgtgcctt

SEQ ID NO: 151243 - DNA, 25 bp, Rattus norvegicus
aggtagcatattatttctcttccat

SEQ ID NO: 151244 - DNA, 25 bp, Rattus norvegicus
aggtagcatattttttctcttccat

SEQ ID NO: 151245 - DNA, 25 bp, Rattus norvegicus
aggtagccaaggatgccccaagcat

SEQ ID NO: 151246 - DNA, 25 bp, Rattus norvegicus
aggtagccaaggttgccccaagcat

SEQ ID NO: 151247 - DNA, 25 bp, Rattus norvegicus
aggtagcccctgagtacttgtaact

SEQ ID NO: 151248 - DNA, 25 bp, Rattus norvegicus
aggtagcccctgtgtacttgtaact

SEQ ID NO: 151249 - DNA, 25 bp, Rattus norvegicus
aggtagccctggctgtatgacaccc

SEQ ID NO: 151250 - DNA, 25 bp, Rattus norvegicus
aggtagccctgggtgtatgacaccc

SEQ ID NO: 151251 - DNA, 25 bp, Rattus norvegicus
aggtagccgcgcacagatctctgga

SEQ ID NO: 151252 - DNA, 25 bp, Rattus norvegicus
aggtagccgcgctcagatctctgga

SEQ ID NO: 151253 - DNA, 25 bp, Rattus norvegicus
aggtagcctgtcacgaaagaactca

SEQ ID NO: 151254 - DNA, 25 bp, Rattus norvegicus
aggtagcctgtctcgaaagaactca

SEQ ID NO: 151255 - DNA, 25 bp, Rattus norvegicus
aggtagccttctcggagtatcatca

SEQ ID NO: 151256 - DNA, 25 bp, Rattus norvegicus
aggtagccttctgggagtatcatca

SEQ ID NO: 151257 - DNA, 25 bp, Rattus norvegicus
aggtagcgcaggctgccccaagact

SEQ ID NO: 151258 - DNA, 25 bp, Rattus norvegicus
aggtagcgcagggtgccccaagact

SEQ ID NO: 151259 - DNA, 25 bp, Rattus norvegicus
aggtagcgctgcaacagccatacaa

SEQ ID NO: 151260 - DNA, 25 bp, Rattus norvegicus
aggtagcgctgctacagccatacaa

SEQ ID NO: 151261 - DNA, 25 bp, Rattus norvegicus
aggtagctaagcagatgtccacact

SEQ ID NO: 151262 - DNA, 25 bp, Rattus norvegicus
aggtagctaagctgatgtccacact

SEQ ID NO: 151263 - DNA, 25 bp, Rattus norvegicus
aggtagctactgaccagaggaccaa

SEQ ID NO: 151264 - DNA, 25 bp, Rattus norvegicus
aggtagctactgtccagaggaccaa

SEQ ID NO: 151265 - DNA, 25 bp, Rattus norvegicus
aggtagctcaccatcacctgtaact

SEQ ID NO: 151266 - DNA, 25 bp, Rattus norvegicus
aggtagctcaccttcacctgtaact

SEQ ID NO: 151267 - DNA, 25 bp, Rattus norvegicus
aggtagctcttaaggccagtggcac

SEQ ID NO: 151268 - DNA, 25 bp, Rattus norvegicus
aggtagctcttatggccagtggcac

SEQ ID NO: 151269 - DNA, 25 bp, Rattus norvegicus
aggtagcttcccagtgagactcaga

SEQ ID NO: 151270 - DNA, 25 bp, Rattus norvegicus
aggtagcttccctgtgagactcaga

SEQ ID NO: 151271 - DNA, 25 bp, Rattus norvegicus
aggtagcttttaactcctgttgacc

SEQ ID NO: 151272 - DNA, 25 bp, Rattus norvegicus
aggtagcttttatctcctgttgacc

SEQ ID NO: 151273 - DNA, 25 bp, Rattus norvegicus
aggtaggaaggtccctgcttttcct

SEQ ID NO: 151274 - DNA, 25 bp, Rattus norvegicus
aggtaggaaggtgcctgcttttcct

SEQ ID NO: 151275 - DNA, 25 bp, Rattus norvegicus
aggtaggaggtcagctaaccccagg

SEQ ID NO: 151276 - DNA, 25 bp, Rattus norvegicus
aggtaggaggtctgctaaccccagg

SEQ ID NO: 151277 - DNA, 25 bp, Rattus norvegicus
aggtaggagtctcgctacccatgta

SEQ ID NO: 151278 - DNA, 25 bp, Rattus norvegicus
aggtaggagtctggctacccatgta

SEQ ID NO: 151279 - DNA, 25 bp, Rattus norvegicus
aggtaggcactacctcctaactcag

SEQ ID NO: 151280 - DNA, 25 bp, Rattus norvegicus
aggtaggcactagctcctaactcag

SEQ ID NO: 151281 - DNA, 25 bp, Rattus norvegicus
aggtaggcagacacgctgagcccag

SEQ ID NO: 151282 - DNA, 25 bp, Rattus norvegicus
aggtaggcagactcgctgagcccag

SEQ ID NO: 151283 - DNA, 25 bp, Rattus norvegicus
aggtaggccttgatctgtccagata

SEQ ID NO: 151284 - DNA, 25 bp, Rattus norvegicus
aggtaggccttgttctgtccagata

SEQ ID NO: 151285 - DNA, 25 bp, Rattus norvegicus
aggtagggtcttctcactgtttcca

SEQ ID NO: 151286 - DNA, 25 bp, Rattus norvegicus
aggtagggtcttgtcactgtttcca

SEQ ID NO: 151287 - DNA, 25 bp, Rattus norvegicus
aggtaggtctgccaatctgccaaaa

SEQ ID NO: 151288 - DNA, 25 bp, Rattus norvegicus
aggtaggtctgcgaatctgccaaaa

SEQ ID NO: 151289 - DNA, 25 bp, Rattus norvegicus
aggtaggtggctacctctgtctcag

SEQ ID NO: 151290 - DNA, 25 bp, Rattus norvegicus
aggtaggtggcttcctctgtctcag

SEQ ID NO: 151291 - DNA, 25 bp, Rattus norvegicus
aggtagtatgccatcacactggatc

SEQ ID NO: 151292 - DNA, 25 bp, Rattus norvegicus
aggtagtatgccttcacactggatc

SEQ ID NO: 151293 - DNA, 25 bp, Rattus norvegicus
aggtagtatttcagagtgcccagaa

SEQ ID NO: 151294 - DNA, 25 bp, Rattus norvegicus
aggtagtatttctgagtgcccagaa

SEQ ID NO: 151295 - DNA, 25 bp, Rattus norvegicus
aggtagtccgggacgcagcgcaggc

SEQ ID NO: 151296 - DNA, 25 bp, Rattus norvegicus
aggtagtccgggtcgcagcgcaggc

SEQ ID NO: 151297 - DNA, 25 bp, Rattus norvegicus
aggtagtcggccactgcttcaagct

SEQ ID NO: 151298 - DNA, 25 bp, Rattus norvegicus
aggtagtcggcctctgcttcaagct

SEQ ID NO: 151299 - DNA, 25 bp, Rattus norvegicus
aggtagtctatgaatccagagttac

SEQ ID NO: 151300 - DNA, 25 bp, Rattus norvegicus
aggtagtctatgtatccagagttac

SEQ ID NO: 151301 - DNA, 25 bp, Rattus norvegicus
aggtagtctgagatagccactcgct

SEQ ID NO: 151302 - DNA, 25 bp, Rattus norvegicus
aggtagtctgagttagccactcgct

SEQ ID NO: 151303 - DNA, 25 bp, Rattus norvegicus
aggtagtgccatcgctgctgactcc

SEQ ID NO: 151304 - DNA, 25 bp, Rattus norvegicus
aggtagtgccatggctgctgactcc

SEQ ID NO: 151305 - DNA, 25 bp, Rattus norvegicus
aggtagtgcctcaaaccattgtctc

SEQ ID NO: 151306 - DNA, 25 bp, Rattus norvegicus
aggtagtgcctctaaccattgtctc

SEQ ID NO: 151307 - DNA, 25 bp, Rattus norvegicus
aggtagtggacgacctcttgtttgt

SEQ ID NO: 151308 - DNA, 25 bp, Rattus norvegicus
aggtagtggacgtcctcttgtttgt

SEQ ID NO: 151309 - DNA, 25 bp, Rattus norvegicus
aggtagtggtgacctccacagtctg

SEQ ID NO: 151310 - DNA, 25 bp, Rattus norvegicus
aggtagtggtgagctccacagtctg

SEQ ID NO: 151311 - DNA, 25 bp, Rattus norvegicus
aggtagtggttccaatcctttccag

SEQ ID NO: 151312 - DNA, 25 bp, Rattus norvegicus
aggtagtggttcgaatcctttccag

SEQ ID NO: 151313 - DNA, 25 bp, Rattus norvegicus
aggtagttagcgcacatttgcccac

SEQ ID NO: 151314 - DNA, 25 bp, Rattus norvegicus
aggtagttagcggacatttgcccac

SEQ ID NO: 151315 - DNA, 25 bp, Rattus norvegicus
aggtagttctcaaggatcctctttt

SEQ ID NO: 151316 - DNA, 25 bp, Rattus norvegicus
aggtagttctcatggatcctctttt

SEQ ID NO: 151317 - DNA, 25 bp, Rattus norvegicus
aggtagttgtcacggttagctgcca

SEQ ID NO: 151318 - DNA, 25 bp, Rattus norvegicus
aggtagttgtcagggttagctgcca

SEQ ID NO: 151319 - DNA, 25 bp, Rattus norvegicus
aggtataacattccagaccctcaat

SEQ ID NO: 151320 - DNA, 25 bp, Rattus norvegicus
aggtataacattgcagaccctcaat

SEQ ID NO: 151321 - DNA, 25 bp, Rattus norvegicus
aggtataacggacacacacatcagt

SEQ ID NO: 151322 - DNA, 25 bp, Rattus norvegicus
aggtataacggagacacacatcagt

SEQ ID NO: 151323 - DNA, 25 bp, Rattus norvegicus
aggtataagacgagatgtccctggg

SEQ ID NO: 151324 - DNA, 25 bp, Rattus norvegicus
aggtataagacgtgatgtccctggg

SEQ ID NO: 151325 - DNA, 25 bp, Rattus norvegicus
aggtataagcctcctccgagtgagt

SEQ ID NO: 151326 - DNA, 25 bp, Rattus norvegicus
aggtataagcctgctccgagtgagt
